United States Patent 7,795,419 (VIRAL AND VIRAL ASSOCIATED MIRNAS AND USES THEREOF) - sequence listing, part 16

SEQ ID NO: 459613 - RNA, 64 nt, Human
uccuuguggacguggagaggggccgaaccgugaagggcuggaggccccggcggcuaggugagca

SEQ ID NO: 459614 - RNA, 64 nt, Human
ugaggcccgaggugggggcgguggccaggacaacgggcuggagggucugggcaacgacagccga

SEQ ID NO: 459615 - RNA, 64 nt, Human
uccccucaucaggggcagaggcaugaaagagucggggcuggauggccgggggcuucugggcccg

SEQ ID NO: 459616 - RNA, 64 nt, Human
ccaccgaggccgccgaguaccaggaggcccuggagggcuggacggugagcagggcggcgguggg

SEQ ID NO: 459617 - RNA, 64 nt, Human
acccacugccuagaggccaucuuaaaggaagcaggggcuggaugccuuucaucccaacuauucu

SEQ ID NO: 459618 - RNA, 64 nt, Human
gcuccccaaccucggaccucaccgcaggggcgcugggcuggagagcagguucgggcagccgucg

SEQ ID NO: 459619 - RNA, 64 nt, Human
cuccacccgcagccccgggguggcguagggaagggggcuggaagccacggguacgguuaaccug

SEQ ID NO: 459620 - RNA, 62 nt, Human
uuucuuauguugcuaggcuacuguuucugaaagcccuggaucucuuugcaccaaaaaugguc

SEQ ID NO: 459621 - RNA, 62 nt, Human
uaacauaagccugggcucugagccucagcugagcccuggaagauucuccccauggggcagag

SEQ ID NO: 459622 - RNA, 62 nt, Human
ugcuuucuucacccugauuccuagaggucauugcccuggaucugcuugaaguccuccugugc

SEQ ID NO: 459623 - RNA, 64 nt, Human
gcuaucgguggguugggguggaggaaccaggagagggcuggagggagggagauggucucagccc

SEQ ID NO: 459624 - RNA, 64 nt, Human
gccaaggccacuucgucugaggaaggcucaacuggggcuggagccacuuccaagccagugcccu

SEQ ID NO: 459625 - RNA, 64 nt, Human
ccagugggggccagggccacacucagcgcagugugggcuggacccgccucugugcuccaggggc

SEQ ID NO: 459626 - RNA, 64 nt, Human
uggcccgaagccguuuccaccgcagcaggcagaggggcuggacaggcacugucagccaaugugg

SEQ ID NO: 459627 - RNA, 64 nt, Human
agugggggaucaguagaggcuugcacugccuuuggggcuggagggagacguggguccaccaggc

SEQ ID NO: 459628 - RNA, 64 nt, Human
agggacuuggaaaggggaacugggauuuggggaggggcuggaggacuuccgcacgcuuccaccu

SEQ ID NO: 459629 - RNA, 64 nt, Human
cacacgauaccucguuccaccuuggcgucacggugggcuggaggcagcccccccccccacaaca

SEQ ID NO: 459630 - RNA, 64 nt, Human
ugcccccugguggaaugcgggggagcaggcaguggggcuggaagcagaaacaaaaugaaaaaaa

SEQ ID NO: 459631 - RNA, 64 nt, Human
aggccucagagcuguguggcagggcccccugcuggggcuggacaucacugcaguccagugcaaa

SEQ ID NO: 459632 - RNA, 64 nt, Human
cgcccgcucccaggaggccagggcaggccugcgugggcuggaggcgggcgaggccggcccaccc

SEQ ID NO: 459633 - RNA, 64 nt, Human
aucaggggccugauggcugccccuuccccagacagggcuggacuucuggagcugcuaagccacc

SEQ ID NO: 459634 - RNA, 64 nt, Human
uggagaacaucggcuaccagaugcugaugaagaugggcuggaaggagggcgaggggcugggcuc

SEQ ID NO: 459635 - RNA, 64 nt, Human
acauguucuuauuuuaacugcagagaaucacucugggcuggacuguuuuguauaacuguacagu

SEQ ID NO: 459636 - RNA, 64 nt, Human
aacuuauaugaaaaccaacacaaccauauguuuagggcuggaaagggccaugacgccuggccau

SEQ ID NO: 459637 - RNA, 64 nt, Human
gccgagcugaagaacuggguaugaggcuggggcggggcuggagguggcgcccccuggugggaca

SEQ ID NO: 459638 - RNA, 62 nt, Human
auuguagcuguagucuccaucaguaacagcaggcccuggaagacuugaucaccuuuuucugu

SEQ ID NO: 459639 - RNA, 62 nt, Human
aaauuucuacuccaguccaauguaacuauuuagcccuggauuauacauacuguccaauuuuc

SEQ ID NO: 459640 - RNA, 62 nt, Human
cuuaauugaggagaugggagacucgaacucuagcccuggaucugccuuccugcugaaacuug

SEQ ID NO: 459641 - RNA, 64 nt, Human
aggguuccuccaucugcccagaugggagaauagggggcuggaccccaggguccgaaugagcccu

SEQ ID NO: 459642 - RNA, 64 nt, Human
uaguaaucugccuuagccuugggaggucugggaagggcuggaaaucacuggggacaggaaacca

SEQ ID NO: 459643 - RNA, 64 nt, Human
ggucucucucaaggccacucggcuacucaggacagggcuggaauuuaaagccuguccgauucug

SEQ ID NO: 459644 - RNA, 64 nt, Human
cgcccaccuuggccugccaaagugcugggauuacgggcuggagccaccgugcccggccggccga

SEQ ID NO: 459645 - RNA, 64 nt, Human
cuuccaaccugaguggcggagaagcugggacccugggcuggacuguccuuuccugcagccccac

SEQ ID NO: 459646 - RNA, 64 nt, Human
agacuguagagucaggucccuaaguccaccccaggggcuggaaaccuggaguucagggcccaga

SEQ ID NO: 459647 - RNA, 64 nt, Human
cauauccacuugagggcgauuugucugagagcuggggcuggaugcuuggguaacuggggcaggg

SEQ ID NO: 459648 - RNA, 64 nt, Human
gcucugcgggugugcggccaaaggcaaggcccacgggcuggaugucacuuccccgacugucucu

SEQ ID NO: 459649 - RNA, 64 nt, Human
ccuccuguugcagcacaaggccggggucucuggggggcuggagaagccucccucauuccuccca

SEQ ID NO: 459650 - RNA, 64 nt, Human
gcuggauacuugcaggaagcugcuaccacccuuagggcuggagaacccagggaagcuaagagga

SEQ ID NO: 459651 - RNA, 64 nt, Human
ugaaucccagccuggccauacccucaaccucagugggcuggaaaugacagugggcccuguagca

SEQ ID NO: 459652 - RNA, 64 nt, Human
aggugaggccaucucaucugcaggcugggaggcagggcuggacucaggaacccacagcuuacug

SEQ ID NO: 459653 - RNA, 64 nt, Human
ggauugauaucgugaaauccucagccgagaaauugggcuggauugugcuuugguuaauacaucu

SEQ ID NO: 459654 - RNA, 64 nt, Human
aauccuggccucugcucaugcgcaggccacaaccgggcuggaagugcgguugagcucucugcca

SEQ ID NO: 459655 - RNA, 64 nt, Human
uuuuacccggcacauuccccuugccuaaauacaagggcuggagucugcacgggaccuauuagag

SEQ ID NO: 459656 - RNA, 62 nt, Human
guggcauuccugucaaauggccugcccaugaagcccuggaauuccagcuccaccuccacuac

SEQ ID NO: 459657 - RNA, 62 nt, Human
aggaguagcuuugccacaucuugaucugcucagcccuggaggugccagcaaagccccaugcu

SEQ ID NO: 459658 - RNA, 62 nt, Human
cuuccccaccagugaucucucccgacugcacugcccuggagaggcagcaucaggaccuaagc

SEQ ID NO: 459659 - RNA, 64 nt, Human
uggucagccugccaggaggaggggagucaccuuggggcuggaggccucucagaccccauccuga

SEQ ID NO: 459660 - RNA, 64 nt, Human
uguauaugucuucccugcuguguuaggaaaaugggggcuggauaucccaagaaucagagguuau

SEQ ID NO: 459661 - RNA, 64 nt, Human
gaucccgaucccugucgggcuccuccgacuccucgggcuggacaccgaaaccucccuucuuaaa

SEQ ID NO: 459662 - RNA, 64 nt, Human
ggcgauguuaauuacucuccagcccccucagaaggggcuggauugauggaggcuggcaagggaa

SEQ ID NO: 459663 - RNA, 64 nt, Human
accccuccaaggaaagaccaccuucuggggacaugggcuggagggcaggaccuagaggcaccaa

SEQ ID NO: 459664 - RNA, 64 nt, Human
cacugcugcggaggaacugccuucagagaagguggggcuggaaaaggguuagaagccuccuagc

SEQ ID NO: 459665 - RNA, 64 nt, Human
uguuuuuuugagacagagucaugcucugucacccgggcuggagugcaguggugcgaucucagcu

SEQ ID NO: 459666 - RNA, 64 nt, Human
aagacucaacuccucuaaccgguaccucugaauggggcuggauaaccggagaccccaugggagg

SEQ ID NO: 459667 - RNA, 64 nt, Human
gaugauauaaugcgggugagaguaaugaggcuuggggcuggagaggacaagauggguaaacccu

SEQ ID NO: 459668 - RNA, 64 nt, Human
gcagucccuuaauauugaggcugcagcaggugcugggcuggacuggccauuuuucuggggguag

SEQ ID NO: 459669 - RNA, 64 nt, Human
uagcuccgucucccggggaccugggccugagggagggcuggagucgcacgcgcuuuguccuuag

SEQ ID NO: 459670 - RNA, 64 nt, Human
aggcugggguguggguguggccugggguggcucagggcuggaacugcugccugauuccugugug

SEQ ID NO: 459671 - RNA, 64 nt, Human
gcugcugcaggcgcugcgcguggccaggaugcccgggcuggagcggagcguccgugagcgcuuc

SEQ ID NO: 459672 - RNA, 64 nt, Human
gucccuguguguguguugcgggaggggaggacuggggcuggaaguccagcacccagggaagauc

SEQ ID NO: 459673 - RNA, 64 nt, Human
uccaggaacccagagccacauuagaaguuccugagggcuggagaacacugcugggcacacucuc

SEQ ID NO: 459674 - RNA, 62 nt, Human
ugggggguggcccaagggaaggcuccucuggggcccuggauggcacaugacucccagugagg

SEQ ID NO: 459675 - RNA, 62 nt, Human
ucauuccuggugcgccuaucggugugacaugagcccuggagugugucgucccucucagcccu

SEQ ID NO: 459676 - RNA, 62 nt, Human
uggccucgugaggggcaagcuaggccccagaggcccuggaggucuccaggggccugcagaag

SEQ ID NO: 459677 - RNA, 64 nt, Human
guguucugugcugugacuauagaaaucuuggucagggcuggauagauuaucuaagucaagcuug

SEQ ID NO: 459678 - RNA, 64 nt, Human
caccaggacagccugggguuccccugaggggcacgggcuggaggaggaggcauggcacaaguga

SEQ ID NO: 459679 - RNA, 64 nt, Human
ucuccugcucuuucuacaugacugggccucccuugggcuggaagaauuggggauucucuauugg

SEQ ID NO: 459680 - RNA, 64 nt, Human
ucccgcucaccuccuggagggguggagcagcugggggcuggagcccuguuucuuugugucaucg

SEQ ID NO: 459681 - RNA, 64 nt, Human
uuuucucuugcccuguuccuggugccuucugauggggcuggaauaguugagguggaugguucua

SEQ ID NO: 459682 - RNA, 64 nt, Human
gggacugaguuuggacuggguuuuggaccuccaggggcuggagcuucaucaccugggcaguguc

SEQ ID NO: 459683 - RNA, 64 nt, Human
aagacaacagaaacacaaggaggcggcuguggccgggcuggacugugcugggguuuguugugau

SEQ ID NO: 459684 - RNA, 64 nt, Human
accauaaaucuuaaaggggguaugugauaauagagggcuggaauuuaaaccuguauuuaaaaaa

SEQ ID NO: 459685 - RNA, 64 nt, Human
uuaaucaagagagacaaaauugcugaggagcucagggcuggauuggcaggugugggcucccacg

SEQ ID NO: 459686 - RNA, 64 nt, Human
agccacccgucccucacuguccugguguccgauugggcuggaugguguuggggcaugaugugug

SEQ ID NO: 459687 - RNA, 64 nt, Human
gccagggcgugugguuuaauguuugcccccuucggggcuggaggucucaguguuucuagauucc

SEQ ID NO: 459688 - RNA, 64 nt, Human
ccagcccggccgcuccugcugaccccuccuggacgggcuggagcugggcuccugccuuugcugc

SEQ ID NO: 459689 - RNA, 64 nt, Human
cuggaggaaugggagccguuuugaugagaaaaaugggcuggagagaaggagaaggauuaggaaa

SEQ ID NO: 459690 - RNA, 64 nt, Human
uugcaaauuuaggaccgugggucaugcagcgaaggggcuggaugguaggaagggaugugcccgc

SEQ ID NO: 459691 - RNA, 64 nt, Human
gaugaccaaauucaccccagcuccuucauucacagggcuggauguagcugggauugaguccaug

SEQ ID NO: 459692 - RNA, 62 nt, Human
cccacccagcuguucuaacccugcuauccacagcccuggaggaacuggggcuccuggaagga

SEQ ID NO: 459693 - RNA, 62 nt, Human
cccccauccccagaggcuggaggaacaacugggcccuggaccagcaccacuuccgagguccc

SEQ ID NO: 459694 - RNA, 62 nt, Human
acccacacacucgcccgcccacuguccugggcgcccuggaagccggcggcccaagcccgacu

SEQ ID NO: 459695 - RNA, 64 nt, Human
cccggaaugaaucagcugcugacugucuccagaagggcuggaaaggaugcugccaggugacccg

SEQ ID NO: 459696 - RNA, 64 nt, Human
cuuggcucugcagcgagaaagacacagcccagcagggcuggagacgcccauguccagcaggcgc

SEQ ID NO: 459697 - RNA, 64 nt, Human
gcugccgccagucucaugcccaggugggugcucugggcuggagcgagggccagguuuugggccg

SEQ ID NO: 459698 - RNA, 64 nt, Human
ucaucugauucccuccuugcccgaccucugcuaggggcuggagaacagagcucagagcacccag

SEQ ID NO: 459699 - RNA, 64 nt, Human
ucauuuucgcacaacccugaagcccaaagaaacugggcuggaggacagaccucaggagcuuuca

SEQ ID NO: 459700 - RNA, 64 nt, Human
ccuggguggcucccuagccccaagaggccaggaagggcuggaaggcagggccugcaggugcucc

SEQ ID NO: 459701 - RNA, 64 nt, Human
augcccccuuccagcggcuucugccaaccauggggggcuggaccaccauggccacugacccagc

SEQ ID NO: 459702 - RNA, 64 nt, Human
aaggguacugacuggguuuguuuaaagucaggcagggcuggagugagcagccagggccauguug

SEQ ID NO: 459703 - RNA, 64 nt, Human
gccagcgcgcgcugacacagugaugggcugcccagggcuggaggggacgcuguuccucccgccg

SEQ ID NO: 459704 - RNA, 64 nt, Human
cccuuuuuucuugcucugcucaccgguguggccugggcuggagugcacucucccugggggcagc

SEQ ID NO: 459705 - RNA, 64 nt, Human
uaaaaugagaagccccugugucaacaagauccaggggcuggagcccaaugccaagccuguguug

SEQ ID NO: 459706 - RNA, 64 nt, Human
cuucccgccgccacccuccucgcugccauucucugggcuggaaugugaagccucagucacucua

SEQ ID NO: 459707 - RNA, 64 nt, Human
ugaggccggcucagcagugcagccuggucccugggggcuggacccaggcuccuaaauaaaccag

SEQ ID NO: 459708 - RNA, 64 nt, Human
ucaucccucccuccaagcccccgaugcggagcuagggcuggagcucugcccaggugcccugggg

SEQ ID NO: 459709 - RNA, 64 nt, Human
uaagucuuauuagugucuauucuuaaaauuaagugggcuggagaagaauggagcuccacaugcc

SEQ ID NO: 459710 - RNA, 62 nt, Human
agacgcaggcuggcugggcucuccugcuggcugcccuggaggauuucaacaugucccaggau

SEQ ID NO: 459711 - RNA, 62 nt, Human
ucuaguagcuguugucugguggggacgcaguggcccuggacacggcuccccucugcaggucu

SEQ ID NO: 459712 - RNA, 62 nt, Human
guguguucccuguaacugccccauagugggcagcccuggaggaacaaggggcuggcuguccu

SEQ ID NO: 459713 - RNA, 64 nt, Human
cccuuccucugggagauuguggacuggggagcgugggcuggacuucugccucuacuugucccuu

SEQ ID NO: 459714 - RNA, 64 nt, Human
cccucugagggccaagcugccuggccacugggcugggcuggagucuggcugguccaacacagau

SEQ ID NO: 459715 - RNA, 55 nt, Human
ccugguggaccagcaacuagcccuggggcuggacaguggacccuaccagccugcg

SEQ ID NO: 459716 - RNA, 64 nt, Human
gccccagcuccucuuccugccucucucauggcuugggcuggagugggcucucuggaccugacca

SEQ ID NO: 459717 - RNA, 64 nt, Human
gcugcaaauaacagaaaacccagcaaacacugaagggcuggauaagaacccugagaggggguac

SEQ ID NO: 459718 - RNA, 64 nt, Human
ccugcuggagcaccgcgaccacaucaugcgcaaugggcuggauuauaaugagcuggccaugcac

SEQ ID NO: 459719 - RNA, 64 nt, Human
ugggcuccgugggggcgccccuucuuggaaggcagggcuggacacugauggacagcaggcaggg

SEQ ID NO: 459720 - RNA, 64 nt, Human
ucuauggggcuuagcaaaaaaagggaggaagugggggcuggauaugcccaccccugccaaaagc

SEQ ID NO: 459721 - RNA, 64 nt, Human
gggggcugggggucagagucuuguucuguugccugggcuggagugcaguggcaugaucucagcu

SEQ ID NO: 459722 - RNA, 58 nt, Human
guuacuauuuuuguaucuaaaacuucuggggcuggauucuuuuaaucccuugacuauu

SEQ ID NO: 459723 - RNA, 64 nt, Human
guuauauggaaaagaaauugauugcuauuuuggggggcuggaguggguagaguauugagaccuu

SEQ ID NO: 459724 - RNA, 64 nt, Human
caucucggggcccuauucucucugagcaccuggagggcuggacucaggcuugugccagggccug

SEQ ID NO: 459725 - RNA, 64 nt, Human
agguucaucucaaccucaacacuauugacuuuuggggcuggauaguucucuguuguggggguuu

SEQ ID NO: 459726 - RNA, 64 nt, Human
gucuucaugguuuauauuuucacuuauauaugcugggcuggauuaagcuuuguugugauuguga

SEQ ID NO: 459727 - RNA, 64 nt, Human
uuuuuaacucccaagcaguagcaggacgaugauagggcuggagggcuauggauucccagcccau

SEQ ID NO: 459728 - RNA, 62 nt, Human
ucaccuaagcugcacuucaaguucgacacgacgcccuggauccugugcaagggggacuggag

SEQ ID NO: 459729 - RNA, 62 nt, Human
gacgugaacaacgcaguggugugagucugcaggcccuggacccgcuggccagagggacaccu

SEQ ID NO: 459730 - RNA, 62 nt, Human
ugggcugcagggcuccgucugcacguggacuugcccuggaccuugaguguggcccucccuuu

SEQ ID NO: 459731 - RNA, 64 nt, Human
ucucuucuccucugguuugcguccuuccuggguugggcuggagucuggacuggcugagauaaga

SEQ ID NO: 459732 - RNA, 64 nt, Human
gagccugccucagcugcucgcacagauuacuucagggcuggaaaagucacacagacacacaaaa

SEQ ID NO: 459733 - RNA, 64 nt, Human
accuugggccggccaggcagggcacccagacggggggcuggaggacacccucaguuugcuccac

SEQ ID NO: 459734 - RNA, 64 nt, Human
agauaguuaccccugaucuccagucccuagcugggggcuggacagggggaagggagagaggauu

SEQ ID NO: 459735 - RNA, 64 nt, Human
gggugcagguucaguuuauauggaaaugcaaacugggcuggaagauauuccugaguuaggcuuu

SEQ ID NO: 459736 - RNA, 64 nt, Human
ccugaccuaccccugcugcaccauucccccagcugggcuggaagguuccauaacuggccagcug

SEQ ID NO: 459737 - RNA, 64 nt, Human
gagaggcaagcuggcugugaacuguccuguuguggggcuggagcugcucccaccucccugaccu

SEQ ID NO: 459738 - RNA, 64 nt, Human
ggaauagcgcuccaguuaccugcugcuggggucggggcuggagccucacucacucggaagugcu

SEQ ID NO: 459739 - RNA, 64 nt, Human
cucgccccucaccuggcguggagcugccugguuugggcuggagcagagcugguuuccuggaaug

SEQ ID NO: 459740 - RNA, 64 nt, Human
acuaugacuacacagaaucuccugauaguaaagggggcuggagacaaggauaaguuauagagca

SEQ ID NO: 459741 - RNA, 64 nt, Human
acagcagauagcaacuugucgucacagcuggcaugggcuggacaguugcuugaaaugaccuaac

SEQ ID NO: 459742 - RNA, 64 nt, Human
aaaaguggcauuuccuggucagugguggucuucaagacgacagcucuguaucugccaugugaag

SEQ ID NO: 459743 - RNA, 62 nt, Human
aaaaccacugggugcgucucuugcugggguuugcccuggaggugaggugagugcucgaggga

SEQ ID NO: 459744 - RNA, 62 nt, Human
uuccccacuccucuagcaucgccacccgcauggcccuggaacucccgcggcggcgggggcgg

SEQ ID NO: 459745 - RNA, 62 nt, Human
gucccugcaacucagcccccaccacaaacacagcccuggaaacauacaguggcgcaaggucc

SEQ ID NO: 459746 - RNA, 64 nt, Human
uaaaaggacuauugaugauagaagaauaggggcaagacgacaaaaguaccuuugaauaaaacaa

SEQ ID NO: 459747 - RNA, 64 nt, Human
gagaaaacacccaaauuauacuugcacuauggaaagacgacaugaauauguugacuggguacuu

SEQ ID NO: 459748 - RNA, 64 nt, Human
cugaggucaaugucauccuccacgggaagcugggagacgacagaaagccacuguuagaucugca

SEQ ID NO: 459749 - RNA, 64 nt, Human
uacugacaaguagaaucaaaggugcagcugacugagacgacaugcauguaagauccacaaaaug

SEQ ID NO: 459750 - RNA, 64 nt, Human
uucauuuuuaaaugcaugauuguacauuauguauagacgacaauguuuuuaauuuauaaauuuc

SEQ ID NO: 459751 - RNA, 64 nt, Human
ggccucuuggggggugugggggauaaaacaggacagacgacagguccacccaagacugucaagg

SEQ ID NO: 459752 - RNA, 64 nt, Human
gccuggguggaggcaggguagggcaggggccuggagacgacaugguguugucuguggagaccgg

SEQ ID NO: 459753 - RNA, 64 nt, Human
gaccagacuguccccacgccgggaaccaagcaggagacgacaggcgagagaggagccagacaga

SEQ ID NO: 459754 - RNA, 64 nt, Human
aucagaacaugacagaaucuucagacuaugaggaagacgacaaugaagauacugacaguaguga

SEQ ID NO: 459755 - RNA, 64 nt, Human
uguaaaaccaucuuuuaaagccuucagacugucaagacgacaugagcagcucaccauaugauaa

SEQ ID NO: 459756 - RNA, 64 nt, Human
acauggaagaauaucuggcaggcuuacuuuuagaagacgacaaaucgguaaggcuuauucaugg

SEQ ID NO: 459757 - RNA, 64 nt, Human
agccacugcucccggcugauuuuuguauuaguagagacgacaggguuucaccauguuggccagg

SEQ ID NO: 459758 - RNA, 64 nt, Human
uaguuaccucccaacuaaaaaguaaaaaugaaaaagacgacauggcagaaguugaaacaaacuu

SEQ ID NO: 459759 - RNA, 64 nt, Human
caguugacaguugugcauugggauggguggagaaagacgacaagagagcagagaaucugcugau

SEQ ID NO: 459760 - RNA, 64 nt, Human
ggaucugaggaggggcccuugggucgggcccuggagacgacacacggcagcccacaggccacga

SEQ ID NO: 459761 - RNA, 62 nt, Human
auuuucuuuaagcagcugcucuccaagacagggcccuggaaaggcccacacauacagcccag

SEQ ID NO: 459762 - RNA, 62 nt, Human
ccaguggguuggugaacaugccaucaguaaaagcccuggaaacaaggucauacuagagauug

SEQ ID NO: 459763 - RNA, 62 nt, Human
agaauacagauguuauagugaguccuacaauagcccuggaaggcaagagcuguuuccuuucc

SEQ ID NO: 459764 - RNA, 64 nt, Human
cuugaacccaggaaguggcaguugcagugagccgagacgacaccacugcacuccagccugggug

SEQ ID NO: 459765 - RNA, 64 nt, Human
accaaccugcuuggucucuauuagucaguaaugaagacgacagccuggccaaccaagggaaagg

SEQ ID NO: 459766 - RNA, 64 nt, Human
gaggaggagcuggaggaggaggucgacgagcugcagacgacaaaugucagcgaccugggcuugg

SEQ ID NO: 459767 - RNA, 64 nt, Human
uggauuccugcaucugcauaugcguauuugccaaagacgacagggugggcuggggugcgcuccg

SEQ ID NO: 459768 - RNA, 64 nt, Human
acuguguacacacaucccucugagaagcacaaggagacgacacgcgcauuguaaccuuugcacu

SEQ ID NO: 459769 - RNA, 64 nt, Human
cugugaucaucccuagaaagagggaaggagcaggagacgacaggggaggggcugguuuguucug

SEQ ID NO: 459770 - RNA, 64 nt, Human
uuuccuauggaaaagaagauggcagauacaggagagacgacagaggguccuaggcuggaauguu

SEQ ID NO: 459771 - RNA, 64 nt, Human
aaggaucacaugcuacaacuagaaugaaccuugaagacgacacugcuaagugaaauaaacuagu

SEQ ID NO: 459772 - RNA, 64 nt, Human
cuguagaucuguucuuagaucucuugaauuagugagacgacaguucccuuaggcaguuugugca

SEQ ID NO: 459773 - RNA, 64 nt, Human
uacaguagggugugaauuauuuugauguugaauuagacgacaaagcaucuauauagcuaagcua

SEQ ID NO: 459774 - RNA, 64 nt, Human
cugcaccaggcguccuggggaaugugcucagugaagacgacacugggcuuugcacagccuggug

SEQ ID NO: 459775 - RNA, 64 nt, Human
gggcggaaccagaaguagggccucgacuugcuucagacgacacagagcaagaggaacugaccau

SEQ ID NO: 459776 - RNA, 64 nt, Human
gacugucaaaucuucuucggaggaucacccgggaagacgacagagacugaagauuggucacugu

SEQ ID NO: 459777 - RNA, 64 nt, Human
agcccgcagaugguggccauguggcacgcugcugagacgacacuaccaauaaaccaaacugcca

SEQ ID NO: 459778 - RNA, 64 nt, Human
guuuaccucacuagggccggacccguggcuccuuagacgacagacuaccucacggagguuuugu

SEQ ID NO: 459779 - RNA, 62 nt, Human
ggaccuguuuauaaauugaggaauggaugagggcccuggaggguccuugggaguaguuagug

SEQ ID NO: 459780 - RNA, 62 nt, Human
ucgucuacaaauuggaaggaaauaugaaugaagcccuggaguacuaugagcgggcccugaga

SEQ ID NO: 459781 - RNA, 62 nt, Human
gaaggugcuugguguucgccugccagcccagagcccuggaggagccggcugcacagagaggc

SEQ ID NO: 459782 - RNA, 64 nt, Human
gugcaagugccuuugauucguuccuucuuucuaaagacgacagucuuuguuguuagcacugaau

SEQ ID NO: 459783 - RNA, 64 nt, Human
cgcagcacccacagcaccacguccucgaauucucagacgacaccuggagacugucccgacacag

SEQ ID NO: 459784 - RNA, 64 nt, Human
agcacagaccccuuaaaccggcauuguauuccaaagacgacaauuuuuaacacgcuuagugucu

SEQ ID NO: 459785 - RNA, 64 nt, Human
ccauccacauaaguuuuauagguacaacugucaaagacgacacuggagaagagccaagcuggau

SEQ ID NO: 459786 - RNA, 64 nt, Human
gcccugcgggcucagaacgauguggcugcccggcagacgacagagaugcugaaggugaggcugg

SEQ ID NO: 459787 - RNA, 64 nt, Human
acucacaucuucacuccugggccuuugcacuuccagacgacaggucaucguucaagcagaaugc

SEQ ID NO: 459788 - RNA, 64 nt, Human; identical to SEQ ID NO: 150036

SEQ ID NO: 459789 - RNA, 64 nt, Human; identical to SEQ ID NO: 150037

SEQ ID NO: 459790 - RNA, 64 nt, Human; identical to SEQ ID NO: 150038

SEQ ID NO: 459791 - RNA, 64 nt, Human; identical to SEQ ID NO: 150039

SEQ ID NO: 459792 - RNA, 64 nt, Human; identical to SEQ ID NO: 150040

SEQ ID NO: 459793 - RNA, 64 nt, Human; identical to SEQ ID NO: 150041

SEQ ID NO: 459794 - RNA, 64 nt, Human; identical to SEQ ID NO: 150042

SEQ ID NO: 459795 - RNA, 64 nt, Human; identical to SEQ ID NO: 150043

SEQ ID NO: 459796 - RNA, 62 nt, Human
uggggaacaguaacaggaaagcaucuucccuugcccuggacuugggucuagggauuuccaac

SEQ ID NO: 459797 - RNA, 62 nt, Human
ucacgugugucugugucauggaugcaaugcaggcccuggaggacugugcgucacccgucaac

SEQ ID NO: 459798 - RNA, 62 nt, Human
cagucaggccgcaccgccgccagccuccuccggcccuggagggagcaucucgggcugggggc

SEQ ID NO: 459799 - RNA, 64 nt, Human; identical to SEQ ID NO: 150044

SEQ ID NO: 459800 - RNA, 64 nt, Human; identical to SEQ ID NO: 150045

SEQ ID NO: 459801 - RNA, 64 nt, Human; identical to SEQ ID NO: 150046

SEQ ID NO: 459802 - RNA, 64 nt, Human; identical to SEQ ID NO: 150047

SEQ ID NO: 459803 - RNA, 64 nt, Human; identical to SEQ ID NO: 150048

SEQ ID NO: 459804 - RNA, 64 nt, Human; identical to SEQ ID NO: 150049

SEQ ID NO: 459805 - RNA, 64 nt, Human; identical to SEQ ID NO: 150050

SEQ ID NO: 459806 - RNA, 64 nt, Human; identical to SEQ ID NO: 150051

SEQ ID NO: 459807 - RNA, 64 nt, Human; identical to SEQ ID NO: 150052

SEQ ID NO: 459808 - RNA, 64 nt, Human; identical to SEQ ID NO: 150053

SEQ ID NO: 459809 - RNA, 64 nt, Human; identical to SEQ ID NO: 150054

SEQ ID NO: 459810 - RNA, 64 nt, Human; identical to SEQ ID NO: 150055

SEQ ID NO: 459811 - RNA, 64 nt, Human; identical to SEQ ID NO: 150056

SEQ ID NO: 459812 - RNA, 64 nt, Human; identical to SEQ ID NO: 150057

SEQ ID NO: 459813 - RNA, 64 nt, Human; identical to SEQ ID NO: 150058

SEQ ID NO: 459814 - RNA, 62 nt, Human
guaucucaguccaggagaggcagcccaucuuggcccuggaugaagaaggaaacccacagagg

SEQ ID NO: 459815 - RNA, 62 nt, Human
cuucaaugagaagccuucucacugaaagagcugcccuggacggaaaaugaguagugagauga

SEQ ID NO: 459816 - RNA, 62 nt, Human
uaucuguggauguguaaauggcuggggggccagcccuggauagguuuuuaugggaauucuuu

SEQ ID NO: 459817 - RNA, 62 nt, Human
uuccuauuauguaaaucccagcuggacagacagcccuggagccagguggcccuguccccugu

SEQ ID NO: 459818 - RNA, 64 nt, Human; identical to SEQ ID NO: 150059

SEQ ID NO: 459819 - RNA, 64 nt, Human; identical to SEQ ID NO: 150060

SEQ ID NO: 459820 - RNA, 55 nt, Human; identical to SEQ ID NO: 150061

SEQ ID NO: 459821 - RNA, 64 nt, Human; identical to SEQ ID NO: 150062

SEQ ID NO: 459822 - RNA, 64 nt, Human; identical to SEQ ID NO: 150063

SEQ ID NO: 459823 - RNA, 64 nt, Human; identical to SEQ ID NO: 150064

SEQ ID NO: 459824 - RNA, 64 nt, Human; identical to SEQ ID NO: 150065

SEQ ID NO: 459825 - RNA, 64 nt, Human; identical to SEQ ID NO: 150066

SEQ ID NO: 459826 - RNA, 64 nt, Human; identical to SEQ ID NO: 150067

SEQ ID NO: 459827 - RNA, 64 nt, Human; identical to SEQ ID NO: 150068

SEQ ID NO: 459828 - RNA, 64 nt, Human; identical to SEQ ID NO: 150069

SEQ ID NO: 459829 - RNA, 64 nt, Human; identical to SEQ ID NO: 150070

SEQ ID NO: 459830 - RNA, 64 nt, Human; identical to SEQ ID NO: 150071

SEQ ID NO: 459831 - RNA, 62 nt, Human
auuuucuuuaagcagcugcucuccaagacagggcccuggaaagaggcccacacauacagccc

SEQ ID NO: 459832 - RNA, 62 nt, Human
ccugccauucuguuacccacucucccaggugagcccuggauuggcucccagaaggccuuugu

SEQ ID NO: 459833 - RNA, 62 nt, Human
acucuggaagcugaggugagaggaucacuugagcccuggaauuccaugccagccuaugcaac

SEQ ID NO: 459834 - RNA, 64 nt, Human
gucugaugcaccuguguacgugugucaagccuagccaccucagcugcagggaggcagaaggcaa

SEQ ID NO: 459835 - RNA, 64 nt, Human
gcuggucucaaacuccugaccucaggugauccgcccaccucagccucccaaagugcugggauga

SEQ ID NO: 459836 - RNA, 64 nt, Human
ccagcacucuagcuccugaccuuugacccgagggccaccucaaccccagcuucugacgugucca

SEQ ID NO: 459837 - RNA, 64 nt, Human
uagaaacugacuguugcccuuuauuuaugcaaaaccaccucagaauccaguuuacccugugcug

SEQ ID NO: 459838 - RNA, 62 nt, Human
agaagagccucauccugucugccccucacucugcccuggaaucaacaucuuccgaguccuuc

SEQ ID NO: 459839 - RNA, 62 nt, Human
uucccuuuacuuugguggccugcuucccucaugcccuggaauacaacucagagcuccaggca

SEQ ID NO: 459840 - RNA, 62 nt, Human
ggcuguucuggguagccuggggcugaggaggugcccuggacucagggcuauccuguccuguc

SEQ ID NO: 459841 - RNA, 64 nt, Human
ugcaaccucugccuccuggguucaagcaauucucccaccucagccuccugaguagcugggauua

SEQ ID NO: 459842 - RNA, 64 nt, Human
uguaaccuccgacuccuggguucaagugacccucccaccucagccucucaaguagcugggacua

SEQ ID NO: 459843 - RNA, 64 nt, Human
gcaacccugccuggccaccuccaggccuggcuccccaccucacacauuaugcggacuuauugcc

SEQ ID NO: 459844 - RNA, 64 nt, Human
gagaagacuuauaaccaccgcgucuccuccuccaccaccucaucccgcccaccuguguggggcu

SEQ ID NO: 459845 - RNA, 64 nt, Human
aggauggucuugaucucuugaccucgugauccguccaccucagccucccaaagugcugggauua

SEQ ID NO: 459846 - RNA, 64 nt, Human
gggcugccuagcccagcuaagaucuuccuucagcccaccucaggauccgggcuugagggcugca

SEQ ID NO: 459847 - RNA, 64 nt, Human
ucugggagugcagugaccgggaccagaaccuuccccaccucaauuagggcuuagccaucucccu

SEQ ID NO: 459848 - RNA, 64 nt, Human
cuaacauugcgcuuuauaagggaugauauuucuaccaccucacucauauuuuuagcugaaauga

SEQ ID NO: 459849 - RNA, 64 nt, Human
uccacccucccagaccugccucuucccccugcuuccaccucaccccacuuaucccucuccauaa

SEQ ID NO: 459850 - RNA, 64 nt, Human
cauugcccaccauuaauaagcuuagcuucucuugccaccucaggggcuuggauauguggaauag

SEQ ID NO: 459851 - RNA, 64 nt, Human
aggcuagucuugaauuccugaccuccugaccugcccaccucaaccucccaaagugcugagauua

SEQ ID NO: 459852 - RNA, 64 nt, Human
acuccccaccuuucuuucguucaucuccagggccccaccucagaucaaagcagcucuggaugag

SEQ ID NO: 459853 - RNA, 64 nt, Human
caguuuuccacaacuguaaacaaacugcuaagccccaccucaaacuuguucacuggggacuuug

SEQ ID NO: 459854 - RNA, 64 nt, Human
cagagguggccugggaccgccaguugcacgccugccaccucagccagcccccgcccagcucauc

SEQ ID NO: 459855 - RNA, 64 nt, Human
agccucgccuuucuacccaggcccccugcccugcccaccucaggcccccacccuccacuccucc

SEQ ID NO: 459856 - RNA, 62 nt, Human
ccuuucaccaagcucuguuuuggccuuucucggcccuggacugaggcucagccuacacgcuc

SEQ ID NO: 459857 - RNA, 62 nt, Human
gccuuugaugucuuucaaagcuucuguggugcgcccuggauugagaaccaccacccgagggg

SEQ ID NO: 459858 - RNA, 62 nt, Human
acaugagcaaaagcuguugccccaaagugauggcccuggaggcggggcugaggaacagggaa

SEQ ID NO: 459859 - RNA, 62 nt, Human
aaacaacccccaaagucccugcugauccaguagcccuggagguuccccagguagggagagcc

SEQ ID NO: 459860 - RNA, 64 nt, Human
caguguugaucaaugcaucaguuaagaaauaaugccaccucaggaauuaacuggcauugggaac

SEQ ID NO: 459861 - RNA, 64 nt, Human
accaauuaugauaaaggacaaaauaagcuguuugccaccucaaaacuuuaugaacuucaccacc

SEQ ID NO: 459862 - RNA, 64 nt, Human
aguucuccaccacacaaguuguauucuucuuuugccaccucaaaccaucacagagucuuuaaau

SEQ ID NO: 459863 - RNA, 64 nt, Human
ucccggcuccagagcaggaaauucagcccaccagccaccucauccccaacccccuguaagguuc

SEQ ID NO: 459864 - RNA, 64 nt, Human
cauucgcaagugucuuccugggccagacuccccuccaccucauguacuugcuauauugaggaug

SEQ ID NO: 459865 - RNA, 64 nt, Human
aggauggucuugaucucccgaccucgugaucugcccaccucagccucccaaaaugcugggauua

SEQ ID NO: 459866 - RNA, 64 nt, Human
gccagucucaaacuccuggccucaugugaucugcccaccucagccucccaaaguacagggauua

SEQ ID NO: 459867 - RNA, 64 nt, Human
gcuccuucgacuauugggcuuaagcgauccucccccaccucagccuuccaaguaacugggacua

SEQ ID NO: 459868 - RNA, 64 nt, Human
gcaaggagcaggagacggcauugcgcgucuacagccaccucaagaggugggcgcccggccccgc

SEQ ID NO: 459869 - RNA, 64 nt, Human
uuuuuuuuaaucguaguuuuuuugagaauuggucccaccucagccgcaccuugcuggaugcuuc

SEQ ID NO: 459870 - RNA, 64 nt, Human
aggcccagcucagcugggccagagcccagaagugccaccucaucauaauucaaguguucuucca

SEQ ID NO: 459871 - RNA, 64 nt, Human
ccccuuccccuacccaacccugcccugccccaccccaccucacagcuacucaguggggcuggca

SEQ ID NO: 459872 - RNA, 64 nt, Human
auccagcagauuuccagccuucuacugcucuccuccaccucaacuccgugcuuaaccaaagaag

SEQ ID NO: 459873 - RNA, 64 nt, Human
cuacccuguuccucagcauggagcucuggcauccccaccucaguaucuaaccugaaccagccug

SEQ ID NO: 459874 - RNA, 64 nt, Human
ugcagucuugaccuccugggcucaggugauccuuccaccucagcuuccuaaguagcugggacca

SEQ ID NO: 459875 - RNA, 62 nt, Human
cagaaacacacugugggcgugcaucugguucagcccuggauaugccuccacuguggagggaa

SEQ ID NO: 459876 - RNA, 62 nt, Human
uauguuauuccugguuaagcaggcauugcuuugcccuggagcagcuauuuuaagccaucuca

SEQ ID NO: 459877 - RNA, 62 nt, Human
ugccucugcccuuucuagccaagguuauagcugcccuggacugcucacucucuggucucaau

SEQ ID NO: 459878 - RNA, 62 nt, Human
aggugagcugggggcauacagggaggaacacugcccuggacuauccauugcauuuuugccuc

SEQ ID NO: 459879 - RNA, 64 nt, Human
gcaggcagaagcugcuggauaaaauaggcuacagccaccucagaugcuuucagugcucugucug

SEQ ID NO: 459880 - RNA, 64 nt, Human
gcccuuccuccccuccaucaagaucuuugagggaccaccucacccugcaaaagagacagguccu

SEQ ID NO: 459881 - RNA, 64 nt, Human
ccccgcugccugggcccugugguugcugggccucccaccucaaggaggggaagguuguacagcc

SEQ ID NO: 459882 - RNA, 64 nt, Human
cagcccaccccaggcaccucagugggguuccgggccaccucaggacuccaagaggcugugugga

SEQ ID NO: 459883 - RNA, 64 nt, Human
auaguauaucuggacaagccaacuuguaaauacaccaccucacuccuguuacuuaccuaaacag

SEQ ID NO: 459884 - RNA, 64 nt, Human
aggcuggucucgaacuccugaccucaugauccacccaccucagccucccaaagugcugggauua

SEQ ID NO: 459885 - RNA, 64 nt, Human
uggccucccaaagugcugggauuacagacacgagccaccucaccuagccugaugagauuuuuaa

SEQ ID NO: 459886 - RNA, 64 nt, Human
caugguguuagauuugugcauuuuauuuuccugaccaccucauuccagccaauguaugguuauc

SEQ ID NO: 459887 - RNA, 64 nt, Human
cucuuaaaggagaggagcuuuuaauuuacacuuaccaccucauuugcuuuucuggaggccaugc

SEQ ID NO: 459888 - RNA, 64 nt, Human
gcuggucuugaauuccugggcucaagcaauucuuccaccucagccucccaaagugcugagauua

SEQ ID NO: 459889 - RNA, 64 nt, Human
ucuccacagcccacccauccccugagcacacuaaccaccucaugcaggccccaccugccaauag

SEQ ID NO: 459890 - RNA, 64 nt, Human
guuggaaaaucuccaagagcccugaccucaucuuccaccucagcaaccaugaccugaaaccuca

SEQ ID NO: 459891 - RNA, 64 nt, Human
ucagggacagugggcaagaggacacccccccccaccaccucaguggaacacaccauucuccccc

SEQ ID NO: 459892 - RNA, 64 nt, Human
gcuggcuuuugugcccaagcucaccagcccugcgccaccucacugcaguagugcaccaucucac

SEQ ID NO: 459893 - RNA, 64 nt, Human
gaagcggaaaguagcugccacuaucuuuguuuccccaccucaggccucacacuuucccaugaaa

SEQ ID NO: 459894 - RNA, 62 nt, Human
uuccuauccuuauaggccugucccuugccucugcccuggauugguuggcaaacuaaaggacu

SEQ ID NO: 459895 - RNA, 62 nt, Human
aaauuaaagacuauauauaauuaaacuacucugcccuggacacucucugagaaacagaucua

SEQ ID NO: 459896 - RNA, 62 nt, Human
aggcccgcgggcacagccagcccaaaccuugggcccuggaagaguccuccaccccaucacua

SEQ ID NO: 459897 - RNA, 62 nt, Human
ucacaaaggagagagggaagaaaagaucuuuugcccuggagauaugguccugaaaucucucc

SEQ ID NO: 459898 - RNA, 64 nt, Human
cucaccccauguccauuuacauguccuucaaugcccaccucaaaagguaccucuucuguaaagc

SEQ ID NO: 459899 - RNA, 64 nt, Human
cuagaugcauggccugaggcaggguggucaggaaccaccucaaaaagugcggaggaaguagcug

SEQ ID NO: 459900 - RNA, 64 nt, Human
caccgggcgcaccaucuuuccuucaugcuacccaccaccucagugcugaggucaaggcagguaa

SEQ ID NO: 459901 - RNA, 64 nt, Human
ccagugcagugccagacugucuccucugcuccucccaccucaucccuaggaggacccaccagug

SEQ ID NO: 459902 - RNA, 64 nt, Human
uccuccucccucuggacuuuuuucaucuuuuccuccaccucaaaaaauacuuacacacagauuc

SEQ ID NO: 459903 - RNA, 64 nt, Human
gcuggucucgaacucccaaccucaggugauccgcccaccucagcucucaaagugcugggauuac

SEQ ID NO: 459904 - RNA, 64 nt, Human
cgcuaaguugcugauggguaguaccuguacuaaaccaccucagaaaggauuuuacagaaacgug

SEQ ID NO: 459905 - RNA, 64 nt, Human
auuacccagucccccuucaacccaguugauguaaccaccucauuuuuuacaaauacagaaucua

SEQ ID NO: 459906 - RNA, 64 nt, Human
ugcagccuugaccucccgggcccagguaguccucccaccucagccucccauguagcaggaacca

SEQ ID NO: 459907 - RNA, 64 nt, Human
aucuuagagagccgccaaacauuccuccagacguccaccucagugcacgagcuggcccagaggc

SEQ ID NO: 459908 - RNA, 64 nt, Human
cagccucccaaguagcugggauuacaggcacccaccaccucacccagcuaauuuuuguauuuuc

SEQ ID NO: 459909 - RNA, 64 nt, Human
uggucuugugaacuccuggccucaggugaucugcccaccucauccuccaaaagugcugggauua

SEQ ID NO: 459910 - RNA, 64 nt, Human
caucccaggaugcuggguggcccugcagccuccuccaccucaccuccaugacagcgcuaaacgu

SEQ ID NO: 459911 - RNA, 64 nt, Human
cugcaugcugcuuuauuugcuucucccuccccaaccaccucaugguauauuuaagagugaaagg

SEQ ID NO: 459912 - RNA, 64 nt, Human
ggaauggaaucaaaagaacguagucuccuggugaccaccucagaucucuauuauuaggcuagau

SEQ ID NO: 459913 - RNA, 62 nt, Human
gggcaucccaccuccgggcucuggguuccucugcccuggaagggcuccaggacccgucccaa

SEQ ID NO: 459914 - RNA, 62 nt, Human
agacagccacuagaagaucuuccuccagcggcgcccuggacggcugcuccugcgaacagccc

SEQ ID NO: 459915 - RNA, 62 nt, Human
ggguaaccuucucccuugucaucucagccugagcccuggaggcugggccugcccacuccagc

SEQ ID NO: 459916 - RNA, 62 nt, Human
uccaccugggauucuccagccuccacccagcagcccuggauugcuuucuccaauuaaggccu

SEQ ID NO: 459917 - RNA, 64 nt, Human
gacuggccucaggaauucucccuuccacaccugcccaccucaccucacugcaccgcaccgcacc

SEQ ID NO: 459918 - RNA, 64 nt, Human
uuauuucaaggauaugugccagggaauucaggaaccaccucaccaaccccaucucccacucaga

SEQ ID NO: 459919 - RNA, 64 nt, Human
caccagucacaaccuaugcagcgccccacuucuuccaccucaacaccaagcuguaggccagccc

SEQ ID NO: 459920 - RNA, 64 nt, Human
ugcagccucgaccucccaggcucaagugauccucccaccucagccuccagaguagcuaggacua

SEQ ID NO: 459921 - RNA, 64 nt, Human
gcuggucucaaacuccuggguucaagccauccucccaccucagccucccaaaaugcugggauua

SEQ ID NO: 459922 - RNA, 58 nt, Human
ggaaccgcaaucagcugugaagccagcaccaccucagagacacuguucccugcuccag

SEQ ID NO: 459923 - RNA, 64 nt, Human
ggugggaggauggagggauugggcugaagcugcuccaccucauccuugcugagugggggagaca

SEQ ID NO: 459924 - RNA, 54 nt, Human
cacauuacaaugggcugugacucuccaccucagcauugcaucguaucaucauuu

SEQ ID NO: 459925 - RNA, 64 nt, Human
cuuguacuuuguaagucguuugcgagaaugcagaccaccucacuaaacuguaaacgguaaagag

SEQ ID NO: 459926 - RNA, 64 nt, Human
ugcagcuucaaucuucugggcucaaguaauccuuccaccucagccucccauauagcuggaacua

SEQ ID NO: 459927 - RNA, 64 nt, Human
ugcagccucuaccuccugggcucaagcaguccucccaccucagucuccugaguagcugagacua

SEQ ID NO: 459928 - RNA, 64 nt, Human
uguagucucgaccucccaggcucaagcuguccucccaccucagccucccaaguagcugagacua

SEQ ID NO: 459929 - RNA, 64 nt, Human
gcuggucucaaacuccugggcucaagcgauccucccaccucagcuucucaaaguucugggacua

SEQ ID NO: 459930 - RNA, 64 nt, Human
cucuggauaggaaaugaccgccaucuccagccggccaccucaggccccuguugggccaccaaug

SEQ ID NO: 459931 - RNA, 64 nt, Human
acugcaguggugcgaucucggcucacugcaaccuccaccucacagguucaagcgauucucgugg

SEQ ID NO: 459932 - RNA, 53 nt, Human; identical to SEQ ID NO: 372160

SEQ ID NO: 459933 - RNA, 62 nt, Human
aauaguauacauuuaaaagaaaaaaaacaaaagcccuggaaguugaggccaagccugcugag

SEQ ID NO: 459934 - RNA, 62 nt, Human
ugauucgcuugcggcucaccucagucgaggaagcccuggaauguucagcagaacaccaccac

SEQ ID NO: 459935 - RNA, 62 nt, Human
ugcccucugaggccccguacaccagaagggaggcccuggaaaauuuugugcuuccaacgugg

SEQ ID NO: 459936 - RNA, 64 nt, Human
auccauuugucuuuguguagagcaagcacguuuuccaccucacugucuccauccuccaccucug

SEQ ID NO: 459937 - RNA, 64 nt, Human
acagacuggaaacugggcagcaagcagccugcaaccaccucagacauccuggacugggaggugg

SEQ ID NO: 459938 - RNA, 64 nt, Human
caguucccaacaaguuccucaucuucaucugaggccaccucagccuggacuuuguuguccauau

SEQ ID NO: 459939 - RNA, 64 nt, Human
uuuuaaaaucacugugcauauuauagaguuguagccaccucacaaugaaguacuacagccugug

SEQ ID NO: 459940 - RNA, 64 nt, Human
accugcagccccaggccucccucccccggggucuccaccucaggggagacuuaggccagaggug

SEQ ID NO: 459941 - RNA, 64 nt, Human
ucagcccucuggugccgcucugcccgaugcacagccaccucagccagcccccagguagaaacgu

SEQ ID NO: 459942 - RNA, 64 nt, Human
cuagccuuuuggugggggaaaagauccagcccucccaccucauuuuuuacuauaauauguugcu

SEQ ID NO: 459943 - RNA, 64 nt, Human
ggaagagaauauucgcuuaauucccccaaccugaccaccucauucuuaucuuucuucuguuucu

SEQ ID NO: 459944 - RNA, 64 nt, Human
cugccgccgcgccgaggagacucgcaugccgccaccaccucacugggagggcgccgagcccacc

SEQ ID NO: 459945 - RNA, 57 nt, Human
gcccggugucuucauucugaugaguuaccaccucaaguucuaugaagcaggccuagu

SEQ ID NO: 459946 - RNA, 64 nt, Human
aauuuggaauucuguucauuuguuauucuuaagaccaccucaaauuuaaaggcuaccuuauugu

SEQ ID NO: 459947 - RNA, 64 nt, Human
cguggaugggggaaugguuucaggaugaacuguuccaccucagaucaucaggcauuagauucuc

SEQ ID NO: 459948 - RNA, 64 nt, Human
uguauaugcuggugauucuuaugcaaaggugaagccaccucaagaugaauaucuuaauuuauua

SEQ ID NO: 459949 - RNA, 64 nt, Human
uuggcagcaugcacugcauauuuguuacugcugcccaccucaccuuuccucugcugaaggagaa

SEQ ID NO: 459950 - RNA, 64 nt, Human
uuucccacuuuugcucuuccccaaggaacugcucccaccucagcacguggaggccucucacggu

SEQ ID NO: 459951 - RNA, 62 nt, Human
ugccugccugagguccccgcugccagucccgggcccuggagagcagaugcugucuuguuaug

SEQ ID NO: 459952 - RNA, 62 nt, Human
cucugcccugccuacuuuuaguugacucacaggcccuggagaagcagcuaacaaugucuggu

SEQ ID NO: 459953 - RNA, 62 nt, Human
uuucuccuaguaacaugggcucaggggacucagcccuggacagagagccuccagagagugaa

SEQ ID NO: 459954 - RNA, 62 nt, Human
gcccucuggccagagggaagcgggcagcucuagcccuggagauuguggucacauuggggcuu

SEQ ID NO: 459955 - RNA, 58 nt, Human
ggaucgaagagcagacguaaccccugccccaccucagcccggcagccagcgagguaca

SEQ ID NO: 459956 - RNA, 64 nt, Human
acccaggacuguguggguuucuuaccugccugagccaccucagggaaucuuccagccuaaugca

SEQ ID NO: 459957 - RNA, 64 nt, Human
gcugguuucaaacuccugaccucaggugauccgcccaccucagccucccaaaauggugggauua

SEQ ID NO: 459958 - RNA, 64 nt, Human
agagauggggucucgcuuuguuggcgcaauccucccaccucagacucccaaagugcuggaauua

SEQ ID NO: 459959 - RNA, 64 nt, Human
auuucuguuaacuugaaagauuugggauuuuuucccaccucaucauagaugggaacuuuuguuu

SEQ ID NO: 459960 - RNA, 64 nt, Human
gcggaaaaugagaauugaugguguccccaaugccccaccucacagaguuacuaaaaaaugucug

SEQ ID NO: 459961 - RNA, 64 nt, Human
cagggaaauguuuucugccuuccugcuucuagaaccaccucagguacugaugaaccccacuuag

SEQ ID NO: 459962 - RNA, 64 nt, Human
aggggugagccugccuuuccuaucuucacaccugccaccucauguucacaccuaucuuucucac

SEQ ID NO: 459963 - RNA, 64 nt, Human
ccuuaauuauuaaauguuuauaagguggugguaaccaccucaaguuucugaugaacauucugca

SEQ ID NO: 459964 - RNA, 64 nt, Human
cuguuuuacuuagaauguaacauaugcugccuacccaccucaaaaugucuguacugcaagaggg

SEQ ID NO: 459965 - RNA, 64 nt, Human
uaucagcccccugggacucccuggccccaaccugccaccucaccaaagcucugagcccugcuag

SEQ ID NO: 459966 - RNA, 64 nt, Human
agaggucacugggaaauagcuagggagccccuccccaccucacuuggggcccccagcagguugc

SEQ ID NO: 459967 - RNA, 64 nt, Human
ccuaucccuagccaccgcccagugcucucacuauccaccucaacacacauccaucucaagagga

SEQ ID NO: 459968 - RNA, 64 nt, Human
acgauuacaaugcucucagugucugccccaaguaccaccucaugaaggaugccacugcuuucug

SEQ ID NO: 459969 - RNA, 64 nt, Human
uuaaguguguuuuugggacaacgugcugcuuauuccaccucagccacauauguguuuguguuua

SEQ ID NO: 459970 - RNA, 62 nt, Human
agaggggccacagcccuucuccuccaugggaggcccuggagccugauagaaaucaguggugu

SEQ ID NO: 459971 - RNA, 62 nt, Human
gagccacagccaugauacagggcucuuauggagcccuggaguuguugggcaaggaugcuguc

SEQ ID NO: 459972 - RNA, 62 nt, Human
augaagcccuuggugaugaggacauagcaucugcccuggaaaucguuauuccaacauaauau

SEQ ID NO: 459973 - RNA, 62 nt, Human
cguuauuccaacauaauauuauuuucuagaaugcccuggaaggacagaauauuuaaaaauau

SEQ ID NO: 459974 - RNA, 64 nt, Human
aaaagccuugaccuccugggcucaggugauccucccaccucagccuccugaguagcuaggacua

SEQ ID NO: 459975 - RNA, 64 nt, Human
ugcagccucugccuccugggcucaaacaguccucccaccucagccuucugaguagcugagacua

SEQ ID NO: 459976 - RNA, 64 nt, Human
ugcagccucaaccuccuggggccaagugauccucccaccucagccucucaaguggcugggacca

SEQ ID NO: 459977 - RNA, 64 nt, Human
guuucuccauguucgacaggcuggucucgaacucccaccucagccucccaaacugcugggauua

SEQ ID NO: 459978 - RNA, 64 nt, Human
gcucauugcagccucgaccucccaggugauccucccaccucagcuuccagauuagcuggugcua

SEQ ID NO: 459979 - RNA, 64 nt, Human
uucauguugaaaacaauuacuacagauauuucauccaccucaguauuuaucaaggaaauggaaa

SEQ ID NO: 459980 - RNA, 64 nt, Human
ccccagcucccugaugaugcucacccccgcccccccaccucaggugcugcuggugugagccaaa

SEQ ID NO: 459981 - RNA, 64 nt, Human
gcuggucucaaacuccugaccucaggugauucgcccaccucagccucccaaagugcugggauua

SEQ ID NO: 459982 - RNA, 64 nt, Human
ucagcucugucuggcucacccucacgggcuacccccaccucacccugugcuccuugugccacug

SEQ ID NO: 459983 - RNA, 64 nt, Human
uguucucuuuggaguguugguaggugucuguuucccaccucaccugagagccauugaauuugcc

SEQ ID NO: 459984 - RNA, 64 nt, Human
cacuuaggagccuucugacuuaggguuugucacuccaccucauugagccugacuguucugcucc

SEQ ID NO: 459985 - RNA, 64 nt, Human
acagccuugaccuccccaggcucaggugaucuucccaccucagccuuccaaguagcugggacua

SEQ ID NO: 459986 - RNA, 64 nt, Human
gcuggucuugaacuccuggcaucaagugauccucccaccucagccucccaaaguguugggauua

SEQ ID NO: 459987 - RNA, 64 nt, Human
gagcuuagugcuacugaauacccuggccacagagccaccucaggauauucuuuucuccacccua

SEQ ID NO: 459988 - RNA, 64 nt, Human
cauuucaaaauuauugugauucucaccucccuccccaccucaguguuuugucuguccgcgccca

SEQ ID NO: 459989 - RNA, 62 nt, Human
acucauaaggcugaggugggaggaucuauugagcccuggaauucgaggaugcaauuaauugu

SEQ ID NO: 459990 - RNA, 62 nt, Human
cugcuuguagacaguucccauaacuguccacggcccuggagcacgcacccaggggcagagcc

SEQ ID NO: 459991 - RNA, 62 nt, Human
cuggccagccuggggccuggcagggaggucaggcccuggaacucuaucugggccugggcuag

SEQ ID NO: 459992 - RNA, 62 nt, Human
cucugagggcccagcccuccccggggcgcucugcccuggagacuccggacacugacagccgc

SEQ ID NO: 459993 - RNA, 64 nt, Human
cugacagauuucuucccucuucccuccccaucacccaccucagugauaacacauuacugauaga

SEQ ID NO: 459994 - RNA, 64 nt, Human
auggagccccuccaccgggcgcaugccucccaggccaccucagucucaccugccggcucugggc

SEQ ID NO: 459995 - RNA, 64 nt, Human
cauucaagaucccuccucagugcccaugucucccccaccucagggugcugucaacccucccuug

SEQ ID NO: 459996 - RNA, 64 nt, Human
ugcaaccucugccuccugggcucaagcaauucucccaccucagccucccaaauagcugggauca

SEQ ID NO: 459997 - RNA, 64 nt, Human
cccaccccggcuccucugcacccagagcugggggccaccucagaagugucaucucucucugagc

SEQ ID NO: 459998 - RNA, 64 nt, Human
ccucugagcacccugccccaccccaccuccacucccaccucacccggccucuucgccuuuccca

SEQ ID NO: 459999 - RNA, 64 nt, Human
gagcgugauucuguucuacuugauauuuccuucaccaccucaugucauuucucauggauuuggu

SEQ ID NO: 460000 - RNA, 64 nt, Human
auucaaaaauuuuuucagaaaugcuuguacuagaccaccucauuuggauauauagcuaucacau

SEQ ID NO: 460001 - RNA, 64 nt, Human
aaauacaccuacagcuuuuggucccuugccucuuccaccucaaagaauuucaaggcucuuaccu

SEQ ID NO: 460002 - RNA, 64 nt, Human
ugcaauguguauauaguugcaggcaaaaaaaaaaccaccucacugcaaaacuuauuguuaauuu

SEQ ID NO: 460003 - RNA, 64 nt, Human
gagccucaucgguaaacaguggggguuaugaaacccaccucacaggguuguugugaggauccaa

SEQ ID NO: 460004 - RNA, 64 nt, Human
gaaaccacuguuacagacaagcuuauuuccaaagccaccucauuuccaaacaucucacucagga

SEQ ID NO: 460005 - RNA, 64 nt, Human
uucugccucccucaugcucgcagccacucugugcccaccucaucuucguagggaccuugauuuu

SEQ ID NO: 460006 - RNA, 64 nt, Human
accaaacaugacuguucuuuccguguaagcuaucccaccucagcggcacccucacugcugguga

SEQ ID NO: 460007 - RNA, 64 nt, Human
gagauuucaguuucccagggcuuaaccagaaccgccaccucaaugcauugucaguaggauacau

SEQ ID NO: 460008 - RNA, 62 nt, Human
aacauggaucugaggaggggcccuugggucgggcccuggagacgacacacggcagcccacag

SEQ ID NO: 460009 - RNA, 62 nt, Human
aguuggagcagcuccgagggaggacgaccauggcccuggaccugccauccucccacuugcag

SEQ ID NO: 460010 - RNA, 62 nt, Human
ccugagcaccccagcuggggccaggcugggucgcccuggacugugugcucaggagcccuggg

SEQ ID NO: 460011 - RNA, 62 nt, Human
gaaacucacugugauuccaaaaauguuucugagcccuggaccccugcccccaaaauauuuuc

SEQ ID NO: 460012 - RNA, 64 nt, Human
gagauuucaguuucccagggcuuaaccagaaccgccaccucaaugcauugucaguagaauacau

SEQ ID NO: 460013 - RNA, 64 nt, Human
acuggucuugaacucuugaccucaggugauccacccaccucagccucccaaagugcugggauua

SEQ ID NO: 460014 - RNA, 64 nt, Human
aucuguaagcggugguuuguaauuccugaucuucccaccucacagugauguuguggggauccag

SEQ ID NO: 460015 - RNA, 64 nt, Human
gaaacuggauugauuugcauuuccuggaacucugccaccucauuucacaagcauuuauggagca

SEQ ID NO: 460016 - RNA, 64 nt, Human
gucagccagugaugccucgggccacgcuguggggccaccucaguccugccuggguccuggugcc

SEQ ID NO: 460017 - RNA, 64 nt, Human
acuguucggaaacuccugggcucaagugauccuuccaccucagccuccccaguagcugggacua

SEQ ID NO: 460018 - RNA, 64 nt, Human
guaaagcuuauuagucuaauguuuuguuccuuucccaccucaccccuaccucuuuuguuuuguu

SEQ ID NO: 460019 - RNA, 64 nt, Human
cugcugcuuucccuccugggcucaagcaguucucccaccucagccucucgacuaacagggacua

SEQ ID NO: 460020 - RNA, 64 nt, Human
gugcuuuugucuccagaguaugcgggagacccuuccaccucaagauggauauuucuuccccaag

SEQ ID NO: 460021 - RNA, 64 nt, Human
gcuggccuugagcuccugggcucaagcaauccucccaccucagccuccccaguacugggacugu

SEQ ID NO: 460022 - RNA, 64 nt, Human
ugcagcuuugaccucccagacccaagugauccucccaccucagccucccucagagcugggacua

SEQ ID NO: 460023 - RNA, 64 nt, Human
gcugaucucgagcuccugggcucaagugauccucccaccucagccucccaaagugcugggauua

SEQ ID NO: 460024 - RNA, 52 nt, Human
gauuccaagugacaucuugaaaccaccucaccagaaccauuggagcaccugu

SEQ ID NO: 460025 - RNA, 64 nt, Human
uuggagagacuauuuaaaaaugagauuccuaggcccaccucagauugugauaaaucugugugac

SEQ ID NO: 460026 - RNA, 64 nt, Human
aaggaucaggugaccuucgcaacaaaguuugcccccaccucacauaggacccggaagcagccug

SEQ ID NO: 460027 - RNA, 62 nt, Human
gcugccugucccgcuuugcugccaaugcaacagcccuggaagaaacccuagaggguugcaua

SEQ ID NO: 460028 - RNA, 62 nt, Human
ggauauaguauguuguauaugaugcugugauugcccuggaguuccugccaugacauggaaac

SEQ ID NO: 460029 - RNA, 62 nt, Human
cuggacuggccugucuggccccugagaguggugcccuggaacacuccucuacucuuacagag

SEQ ID NO: 460030 - RNA, 62 nt, Human
acauuucuuuuuuuuuuuuuuuccuuuagaaugcccuggaaauauauuuaagugguaaugaa

SEQ ID NO: 460031 - RNA, 64 nt, Human
acgggcaaauuggcauuugaauaaagcccugggaccaccucaacaugcguagccucuugucuua

SEQ ID NO: 460032 - RNA, 64 nt, Human
ugcagccuugacuuccugggcugaacugauccuuccaccucagccuccugaguagcugggacua

SEQ ID NO: 460033 - RNA, 64 nt, Human
auguauguguuuuaaguauaugagugccccaaccccaccucacaaucuucacaaaguagaacuu

SEQ ID NO: 460034 - RNA, 64 nt, Human
aggauggucucaaucuccugacccugcgaucugcccaccucagccucccaaagugcugggauua

SEQ ID NO: 460035 - RNA, 64 nt, Human
ggaaauauuugggcgucuuguaccuggcuacgcaccaccucaguguuguuccuacauaaacagg

SEQ ID NO: 460036 - RNA, 64 nt, Human
acugaguuguuuuuauguauugauggggacuuuuccaccucauuagacuaauacucauucaaaa

SEQ ID NO: 460037 - RNA, 64 nt, Human
uccacuucuucccuaaaugcgcuuuguguguuuuccaccucaguagccuugcacacaucauuac

SEQ ID NO: 460038 - RNA, 64 nt, Human
guuuucgaagacuguuuuuuucaucacgcuccugccaccucauuauuuugcauugaagauacau

SEQ ID NO: 460039 - RNA, 64 nt, Human
ucacugcauccuugacuuccugggcucaagugauccaccucagccugccugguagcugagacuu

SEQ ID NO: 460040 - RNA, 64 nt, Human
ccuaaguccucauugaauguucugguucaaggcuccaccucagaaauucugaaauggguaguaa

SEQ ID NO: 460041 - RNA, 64 nt, Human
ugcaaccucugccuccugggcucaacggauccuuccaccucagccucccaaguagcuuggacua

SEQ ID NO: 460042 - RNA, 64 nt, Human
agaugucucuaccuaaugagcucaagugauccucccaccucagccuaccaaguagccaggacca

SEQ ID NO: 460043 - RNA, 64 nt, Human
cacaguucacuuuauuuaacaauuuucaugucccccaccucauguuuucaccuuuucugggcca

SEQ ID NO: 460044 - RNA, 64 nt, Human
cagggaacuucugagaaguuaucugcagagagccccaccucacucccuuuggcuacccuggccg

SEQ ID NO: 460045 - RNA, 64 nt, Human
gugucacugaucacaggugucaccguaguggcuaccaccucagggcagccccucccuccagcug

SEQ ID NO: 460046 - RNA, 62 nt, Human
uccccaagggcacugccacugugcucggaggugcccuggacuguguacaucugaacuuuggu

SEQ ID NO: 460047 - RNA, 62 nt, Human
agaggcaccugcggguuagcccaggggcccaagcccuggauuuggccugcggaggagcuuag

SEQ ID NO: 460048 - RNA, 62 nt, Human
ggcacagugcccccuucccggacggguggcaggcccuggagaggaacugagugucacccuga

SEQ ID NO: 460049 - RNA, 62 nt, Human
ugggugagucaccaucccaaagcaggaagggugcccuggagagaaccacccuccuccuacuc

SEQ ID NO: 460050 - RNA, 64 nt, Human
ugaggguuagcaagacaaagcaaauaaaugccuuccaccucaccgcaaaccuucugcuaaauug

SEQ ID NO: 460051 - RNA, 64 nt, Human
ugcagccucaaccuccuggguccaagugauccucccaccucagcacacaacaccaugcccaauu

SEQ ID NO: 460052 - RNA, 64 nt, Human
aagacaaaaaaagggggacccaggucuucuguaaccaccucauaggucucccuggugccaccug

SEQ ID NO: 460053 - RNA, 64 nt, Human
caggcuggucucgaacuccugaccgcgugauccaccaccucagcuucccaaaguggugggauua

SEQ ID NO: 460054 - RNA, 64 nt, Human
ccacugugcuccagccugguggcacagugagacuccaccucaaaaaaaaaaaaaaauccuugaa

SEQ ID NO: 460055 - RNA, 64 nt, Human
gucacuuuucuaauacuuuuacuauaaugugguaccaccucagcccuaauaaauaauauuuuua

SEQ ID NO: 460056 - RNA, 64 nt, Human
uuaacuagcucagaaacguacucccccaccaaccccaccucaccgccccccaucccgguucugg

SEQ ID NO: 460057 - RNA, 64 nt, Human
acacauacacuuccauaaauagcuuuaacguaugccaccucagagauaaaucuaagaaguauuu

SEQ ID NO: 460058 - RNA, 64 nt, Human
cguagccucaaacuccugggcucaagugauucucccaccucaggcacccaaauagcuggaacua

SEQ ID NO: 460059 - RNA, 64 nt, Human
gcuagucucgaacucgugaccgcaagcgauucacccaccucagccucccaaagugcugggauua

SEQ ID NO: 460060 - RNA, 64 nt, Human
cuggucuugaacuuccugaccucagguuauccacccaccucagccucccaaagugcugggauua

SEQ ID NO: 460061 - RNA, 64 nt, Human
ggggaagaagguaugguuuugagaugaaacugcuccaccucagaccaucaggcauuaguuagau

SEQ ID NO: 460062 - RNA, 64 nt, Human
aaaccacugaaagucguggaggaaugggcaagaaccaccucaugauucugcaggccauugcuaa

SEQ ID NO: 460063 - RNA, 64 nt, Human
uauugccacccugcuucuccaagagcagaccaggccaccucauccguaaggacucgguucugug

SEQ ID NO: 460064 - RNA, 64 nt, Human
auggaacagagggugagagaggcaguggccgucuccaccucagcuccugcucccucugcaucag

SEQ ID NO: 460065 - RNA, 62 nt, Human
aaagaauucuauaagcaauagcugauuaaugggcccuggaagaugaagauuauaacuguuua

SEQ ID NO: 460066 - RNA, 62 nt, Human
uuuccaaaacagcuacacaaaugcuucugaaugcccuggauacgcagaccgaguggcagucu

SEQ ID NO: 460067 - RNA, 62 nt, Human
acugccauaggauucugagcaaggccuacuuggcccuggauagaaauuguuuucaaagagaa

SEQ ID NO: 460068 - RNA, 62 nt, Human
caauccucaaggcuggcacaggcuuuggggaagcccuggagccugugaagacccuggaaacc

SEQ ID NO: 460069 - RNA, 64 nt, Human
gguuggagguggggaaggcuuuguauaaucccacccaccucaccaaaacgaugaaguuaugcug

SEQ ID NO: 460070 - RNA, 64 nt, Human
cuugauggaugucugcagagugcucucuaagaguccaccucagugccucgugugcucagugguc

SEQ ID NO: 460071 - RNA, 64 nt, Human
ucccacuccucagccuacacgcagaggaacgggcccaccucagagucacaccacuggcugccag

SEQ ID NO: 460072 - RNA, 64 nt, Human
ggaagggacccgcguggcgcgacccugaccgaucccaccucaacagcucccugacucucggggg

SEQ ID NO: 460073 - RNA, 64 nt, Human
ggacaggccagucgcguuccuuccgcauccuugcccaccucacaggcaccgaguucaguaagug

SEQ ID NO: 460074 - RNA, 64 nt, Human
ugcagccuugaacuccugggcucaagcgauccucccaccucagccucccaaguagcugggacua

SEQ ID NO: 460075 - RNA, 64 nt, Human
cugcaguuuacugagggcauuucaguuccuccuaccaccucaacaggacuuuguccagacucuc

SEQ ID NO: 460076 - RNA, 64 nt, Human
uggagagggagugugggaauccaccaucuuguggccaccucagacaucacuucucuuuggaaga

SEQ ID NO: 460077 - RNA, 64 nt, Human
ccgggcugcaccagugggaguggcuccacccuucccaccucagagccauggggagccagggcuc

SEQ ID NO: 460078 - RNA, 64 nt, Human
cuggcuccccagggccuggccuacucaaucucucccaccucauccucuggcauggacgcaguca

SEQ ID NO: 460079 - RNA, 64 nt, Human
uaaauaugugaaauuuuaucccugugcccuuuccccaccucaggcccuaccccuggacccuccc

SEQ ID NO: 460080 - RNA, 64 nt, Human
uccccccccgccccucugcuucccuccccacccaccaccucaaggguagggaguugcucuuccu

SEQ ID NO: 460081 - RNA, 64 nt, Human
ugcaaccuccaccucccagacucaagccauccucccaccucaaccucccaaguagcugggacua

SEQ ID NO: 460082 - RNA, 64 nt, Human
cucuuuacagccucucucugugacuggaaucucuccaccucaucguaucuaaggauaacccaga

SEQ ID NO: 460083 - RNA, 64 nt, Human
ccugcuugcugcugcuuuacuacauuccagaugcccaccucauccaauuuccagagccacuauc

SEQ ID NO: 460084 - RNA, 62 nt, Human
accccagcucuggggcuugggggugagggucagcccuggacagaccucugcccagggaacug

SEQ ID NO: 460085 - RNA, 62 nt, Human
ucccggcagaggggccagaaucgcccggcccagcccuggagcccccuccacucccccaggcc

SEQ ID NO: 460086 - RNA, 62 nt, Human
ucagcagccugcgcucggcaggaaggagcggcgcccuggacuugguacaguugcaggagcgu

SEQ ID NO: 460087 - RNA, 62 nt, Human
agcugggacggggccccgcugccggaccugcagcccuggacagauggggaacacugugccuc

SEQ ID NO: 460088 - RNA, 64 nt, Human
ggcuccucuccagcacucugucguucucugagccccaccucagcaggucuccaggaucccucac

SEQ ID NO: 460089 - RNA, 64 nt, Human
cucuuccuggguucuggcuccugcauagcucaccccaccucaucaugagccucaacugccuaca

SEQ ID NO: 460090 - RNA, 64 nt, Human
ugcagccucgaccuccccagcucaagcaauccucccaccucagccuccuaaguaccugguacua

SEQ ID NO: 460091 - RNA, 64 nt, Human
gcuggucuugaacuccugaacucaagugauccgcccaccucagccucccaaaguguugggauua

SEQ ID NO: 460092 - RNA, 64 nt, Human
cacugcacuccagccugggcgacagagcgagacuccaccucaaaaaauaaaaucaagauaaccu

SEQ ID NO: 460093 - RNA, 64 nt, Human
gcacucacacucuucuggucaugaucucugaucuccaccucaaaugacaauaaaaaacuggucc

SEQ ID NO: 460094 - RNA, 64 nt, Human
uacaguuucaacgucccccgcucaggugguccuuccaccucagccucccaaguagcugggacca

SEQ ID NO: 460095 - RNA, 64 nt, Human
uaggaccucugaaggcagagugagagcagaaaccccaccucacaugaagggaagggcaucucca

SEQ ID NO: 460096 - RNA, 64 nt, Human
ucccaugucagccuucugaugaucccacuccaccccaccucaacuuauuuaacuuccuaauuaa

SEQ ID NO: 460097 - RNA, 64 nt, Human
acacuguuccgaguggucuccucauccauccuucccaccucacacccuucacucuccuuuuucu

SEQ ID NO: 460098 - RNA, 64 nt, Human
cagggcugaaccccaccucccucccaccuuccucccaccucaccugucgcacccacugugaaag

SEQ ID NO: 460099 - RNA, 64 nt, Human
gcuggucuugaauuccugaccucaggugaucugcccaccucagccucccaaagugcugggauua

SEQ ID NO: 460100 - RNA, 64 nt, Human
ugcagccuugaacuccugggcuuaagugacccucccaccucagucuccugaguagcuaggacua

SEQ ID NO: 460101 - RNA, 64 nt, Human
acccuuggugggcacugcucccuuagguucuuccccaccucaaucuaccugccuagaguagcag

SEQ ID NO: 460102 - RNA, 64 nt, Human
ccagaguccuuuaaaaaguauugcugcuugguucccaccucagagguucugaguuaauuggacu

SEQ ID NO: 460103 - RNA, 62 nt, Human
aucaucuuuaugauuagaacaauuugcucaaagcccuggaaaaugccugguaacccagugcc

SEQ ID NO: 460104 - RNA, 62 nt, Human
ugagaggaugcuuuccuguucaugggguuuuugcccuggagccucagcagcaaaugccacuc

SEQ ID NO: 460105 - RNA, 62 nt, Human
cugcucuuagccuccccauggcucacguuccugcccuggaugggaugugaguggggcccaca

SEQ ID NO: 460106 - RNA, 62 nt, Human
ugggaggugguguuggaggccccaugaagagcgcccuggacugcugagggugggccaacagc

SEQ ID NO: 460107 - RNA, 64 nt, Human
cuuuguagccgaucucuaggcccuucuugcacugccaccucacuuuccaccacugucagccugg

SEQ ID NO: 460108 - RNA, 64 nt, Human
gcugcucucaaacuccugaucucaagugaucugcccaccucaccaucccaaagugcugggauua

SEQ ID NO: 460109 - RNA, 64 nt, Human
acgguagcgucauaugagaagaaagaaauccccaccaccucaaccucugcugagauugugugcu

SEQ ID NO: 460110 - RNA, 64 nt, Human
ccagcgggccugcggggacaggccaggccugaucccaccucacuuccugcacgcgccacuccgc

SEQ ID NO: 460111 - RNA, 64 nt, Human
aaggaaacggggaaaaucaaaagggguucaaaccccaccucaguagguggaggggagcgccugc

SEQ ID NO: 460112 - RNA, 64 nt, Human
ggggccccgaggccugagggccccuccccuguccccaccucagugccugcggggcccugagccu

SEQ ID NO: 460113 - RNA, 64 nt, Human
uuacucguaccaaaaaugaagacaagccccacacccaccucagcccuugcuuggccaugcugug

SEQ ID NO: 460114 - RNA, 64 nt, Human
acauuuacccagguauauguuacuaaaacaggcuccaccucaguuuaucaacauuauaaguuac

SEQ ID NO: 460115 - RNA, 64 nt, Human
ucuagccuugaauuccugggcccaagcaauucucccaccucagccuccugaguagcugggacua

SEQ ID NO: 460116 - RNA, 64 nt, Human
ggcaucgucuaugcuucccuugcccucuccagcuccaccucacccagagcaccucccagccacc

SEQ ID NO: 460117 - RNA, 64 nt, Human
cggccaggcuaagccgcagagacccucucagcccccaccucagguuagggcucugcccgcagcc

SEQ ID NO: 460118 - RNA, 64 nt, Human
gcugguuucaaacuccuggacucaagaaauccacccaccucagccucccaaagugcuaggauua

SEQ ID NO: 460119 - RNA, 64 nt, Human
gggauggucuugaucuccugaccucaugauccacccaccucagccucccaaaguguugggauua

SEQ ID NO: 460120 - RNA, 64 nt, Human
cauuguggaccacccacacugagaccaccugcccccaccucaguuauuguuuugaugucuagcc

SEQ ID NO: 460121 - RNA, 64 nt, Human
agcaggaggggcccacaccucaagccuggaccagccaccucaaggccuuggggagcuuagggga

SEQ ID NO: 460122 - RNA, 62 nt, Human
aguugagcgugcgcacugcaugggaaauagcggcccuggaggauguuagacuugcucccucu

SEQ ID NO: 460123 - RNA, 62 nt, Human
ccugccugcagccagggcugggguugccagaggcccuggagggaaggacagucccugcuggg

SEQ ID NO: 460124 - RNA, 62 nt, Human
ccugaaagcaccuuccuggaggaugugggagggcccuggacauggcccggccccacugcuga

SEQ ID NO: 460125 - RNA, 62 nt, Human
gcccaaggucaggcuuaucuccagagggaggugcccuggacuggggcccagauguucaggga

SEQ ID NO: 460126 - RNA, 64 nt, Human
agaagacaauuaagaggaaaacaaacagaaccagccaccucaccauagaguacuccaacaagac

SEQ ID NO: 460127 - RNA, 64 nt, Human
caccgcauugaccuccuuggcucaaggcauccucccaccucagcuuccugacuagcugggacua

SEQ ID NO: 460128 - RNA, 64 nt, Human
aacuucccaaagaccuguaaaauggagggauuuaccaccucacauauguccaguuaaacaguuu

SEQ ID NO: 460129 - RNA, 64 nt, Human
ugcagccucgaccucccaggcuccagugacucucccaccucagccuccuaaguagcugggagua

SEQ ID NO: 460130 - RNA, 64 nt, Human
ugucccugucuccaguuccucuccccucaggaggccaccucaggaaggauuuugacaggugacc

SEQ ID NO: 460131 - RNA, 64 nt, Human
acgccggagggcaucccuccaccagaagauuccgccaccucaagugaacugcaggaauccucca

SEQ ID NO: 460132 - RNA, 64 nt, Human
auccuugcagccucuggacagaugugagaaggcaccaccucaagaggggaggagcggggcugau

SEQ ID NO: 460133 - RNA, 64 nt, Human
ugcagccucugccucuuggguucaagugauucuuccaccucagccucccagguagcugggauua

SEQ ID NO: 460134 - RNA, 64 nt, Human
gcuggaguuuauuuuaaaacaaaugaagcaugggccaccucaugaugcaguggcuccucucugg

SEQ ID NO: 460135 - RNA, 64 nt, Human
ugcagccuccaacuccuggacucaagugauccucccaccucagccuccagaguaaguaggacca

SEQ ID NO: 460136 - RNA, 64 nt, Human
uugucacaguccauuacaguuauuguugcuagauccaccucauuugcagauguccaaacuuaaa

SEQ ID NO: 460137 - RNA, 64 nt, Human
gcugaccucaaauucugggguucaagcaauccucccaccucaacccacaaguagcuacgacugc

SEQ ID NO: 460138 - RNA, 64 nt, Human
cucacccucgauuuccugggcucaagcaauccucccaccucagcccccaaguagcugggccuac

SEQ ID NO: 460139 - RNA, 64 nt, Human
gcccagggcugggcacucccugagacccaaagacccaccucaacgacgaguggcguugagccac

SEQ ID NO: 460140 - RNA, 64 nt, Human
ucuccccuugugauucuguccccuccccaagaccccaccucauaucaucuuauggguuaggaau

SEQ ID NO: 460141 - RNA, 62 nt, Human
gguuggggcaguggugacgagcugugggaagagcccuggauaggaagccacugagucugccc

SEQ ID NO: 460142 - RNA, 62 nt, Human
ggcuugggcgacuacagggucuucgggccccagcccuggagcugcaggaguugggaacgggg

SEQ ID NO: 460143 - RNA, 62 nt, Human
cccacccuccccggcugggagggcucuggagggcccuggaggggggguccccgcggcagcug

SEQ ID NO: 460144 - RNA, 62 nt, Human
caagucacaugcguaaacgacacucucuggaagcccuggagacccucgcccaacuccaccag

SEQ ID NO: 460145 - RNA, 64 nt, Human
uuuccucugaagguacgccacccaccuccgucgcccaccucagcgcccaggagccuugggacuu

SEQ ID NO: 460146 - RNA, 64 nt, Human
agugugaauagccuggccaccagccauccucccuccaccucaagacccccauuugucccagacu

SEQ ID NO: 460147 - RNA, 64 nt, Human
gguggucucgaauuccuggacucaagcagucugcccaccucagacucccaaagcgguggaauua

SEQ ID NO: 460148 - RNA, 64 nt, Human
uauagccuugaccucucaggcucaagcgauucucccaccucagccauccaaauagcugggacca

SEQ ID NO: 460149 - RNA, 64 nt, Human
ugaaggaccccagguaagauguuaaucucccagcccaccucaacccagaggcuacucuugacuu

SEQ ID NO: 460150 - RNA, 64 nt, Human
uaggggcugucacugagugaaagugacauccuggccaccucacgcauuugaucacagacuguag

SEQ ID NO: 460151 - RNA, 64 nt, Human
ucuuaaacaauuugaaacaaaaugagcucuccuaccaccucacuuuuucauuuccacacuaaug

SEQ ID NO: 460152 - RNA, 64 nt, Human
ccaguuauacuuauaaaugccugcagggauuucaccaccucaggguggagagacugaaugcuug

SEQ ID NO: 460153 - RNA, 64 nt, Human
gcugcuguuacagaguaagaaacucauggaagggccaccucaggagggggauauaauguguguu

SEQ ID NO: 460154 - RNA, 64 nt, Human
aaaacacagaaucagcccucagggugcacuccagccaccucagugcucuaagcucacagaagug

SEQ ID NO: 460155 - RNA, 64 nt, Human
ccugagcugcaccugagggccuggcuucucacugccaccucacacccgcugccagagcccaccu

SEQ ID NO: 460156 - RNA, 64 nt, Human
gcacagcagcggcggggagggcgccucuggccccccaccucacggccaguucccgcgggcaccg

SEQ ID NO: 460157 - RNA, 64 nt, Human
acccuccucuaccagcaaugccugcuaaaugccaccaccucaguucaagcccugaagccugggg

SEQ ID NO: 460158 - RNA, 64 nt, Human
aacugacugcccacggaaagugcagaaugcuccuccaccucacucuccugccuugaaaaagaca

SEQ ID NO: 460159 - RNA, 64 nt, Human
uccucucugccauuucuuggcugggagcugugguccaccucaaaaaaaaggagcacucuggagg

SEQ ID NO: 460160 - RNA, 62 nt, Human
ucuuuucuuagcaaaaggauuuuaaaacuugagcccuggaccuuuuguccuaugugugugga

SEQ ID NO: 460161 - RNA, 62 nt, Human
cccaagaugcaagaaggaggcuaugcucaggggcccuggagcagccaccccaugcuggccuu

SEQ ID NO: 460162 - RNA, 62 nt, Human
cuaaagggccauagcccagugagcagccuggagcccuggagaccccaccagccucaccagcg

SEQ ID NO: 460163 - RNA, 62 nt, Human
acagggagucugcaggagcgcagacaggcacagcccuggagcaggcaggccgagggcugcgg

SEQ ID NO: 460164 - RNA, 64 nt, Human
cucugagcuggccuggacccugucaggaugggccccaccucagaaccaaacucacuguccccac

SEQ ID NO: 460165 - RNA, 64 nt, Human
cucagcugaggggccccucugcccccuucuaccuccaccucagcacccucccccagcuugaugu

SEQ ID NO: 460166 - RNA, 64 nt, Human
cugggaaccacucaccuccuucugugccaugaggccaccucagcccugacaccaaccccgugcg

SEQ ID NO: 460167 - RNA, 64 nt, Human
gggcuggcccuggcucgggcaggguggggcaucaccaccucacuggccuugcuggaggcacagg

SEQ ID NO: 460168 - RNA, 64 nt, Human
ccccuucccagucaaggugguggccugggccgcuccaccucaccggugcagugacccaggacgg

SEQ ID NO: 460169 - RNA, 64 nt, Human
caugguggguguccuggggccugugcggagggagccaccucacccugcagcccaguuugcaggu

SEQ ID NO: 460170 - RNA, 54 nt, Human
cgagcaggaugugucacuaaugcuccaccucacccuuuggaagaaaggaaagcu

SEQ ID NO: 460171 - RNA, 64 nt, Human
cucccaagaacuucggugccuaaagccuccuguuccaccucagguuuucacaggugcucccacc

SEQ ID NO: 460172 - RNA, 64 nt, Human
gccccuggccuagccuggagcccaggaccuaaguccaccucaccuagagccuggaauuaggauc

SEQ ID NO: 460173 - RNA, 64 nt, Human
acaucaccucccucugagccccacgccagcguggccaccucagcucucuucucuccucuccuuu

SEQ ID NO: 460174 - RNA, 64 nt, Human
cccggcacuccagccuggcgacaagagugagacuccaccucaaaaaaaaaaaaaagaauccaau

SEQ ID NO: 460175 - RNA, 64 nt, Human
uuuuuuuuaacccuccugggcccaagugauccuuccaccucagucucccagcuaauugagacca

SEQ ID NO: 460176 - RNA, 64 nt, Human
caauucuaaaacagacucaaugucccccucacccccaccucaaggucaggaugagaacacacug

SEQ ID NO: 460177 - RNA, 64 nt, Human
aggcccggcccggcgaguggucaagggacagggaccaccucaccgggcaaauggggucgggggg

SEQ ID NO: 460178 - RNA, 64 nt, Human
ggcccugcuggucccugucgccccauccccgaccccaccucacucuuucgugaauguucuccac

SEQ ID NO: 460179 - RNA, 62 nt, Human
ggaggucugagaaugacgauacccgugacucagcccuggacacugguccgagaagggacaug

SEQ ID NO: 460180 - RNA, 62 nt, Human
cggaggaggcagaggccacgaaggcacaccacgcccuggagcagguaggcagccaccaccuc

SEQ ID NO: 460181 - RNA, 62 nt, Human
ugugugcuaaggcuccguccugacugcccugugcccuggaaaagcagcaauagcauccgccc

SEQ ID NO: 460182 - RNA, 62 nt, Human
aacgcagccucccucccuggaggcugccuccugcccuggaucuggaguggagcugcucugag

SEQ ID NO: 460183 - RNA, 64 nt, Human
ccuguugugaguaacugaagccuaggccccguccccaccucaaaucacacacacccccucccca

SEQ ID NO: 460184 - RNA, 64 nt, Human
gacugacagccccgggcccaagaaaaacccauaaccaccucagauggaucugacguggcuaagg

SEQ ID NO: 460185 - RNA, 64 nt, Human
gcagccuuggcuucccugggcucaagcaguccucccaccucagucucccaaauagcuaggacua

SEQ ID NO: 460186 - RNA, 64 nt, Human
aguuuccaagccagugucguuuuugcacugguuuccaccucacugucagauauuguucuuuuga

SEQ ID NO: 460187 - RNA, 64 nt, Human
caaguguacccagaguagaaggccuuccccacucccaccucaaacccaggagcagaacucagua

SEQ ID NO: 460188 - RNA, 64 nt, Human
gucaagcccaggcagcucauucacuaccugugauccaccucagggcacgggcaaacacauaggc

SEQ ID NO: 460189 - RNA, 64 nt, Human
cccaguggggugccaugcacaggccacaggcccuccaccucaccuccagcucaggggccgcacc

SEQ ID NO: 460190 - RNA, 64 nt, Human
caccagcaccuuacugcccaggccuaucuggaagccaccucaccaaggaccuuggaagagcaag

SEQ ID NO: 460191 - RNA, 64 nt, Human
caguucccaaaaaguuuuucaucuccaucugagaccaccucagccugaauuuuauugucaauau

SEQ ID NO: 460192 - RNA, 64 nt, Human
acagcccuacugaucagcgcauguguguaaggaaccaccucaggccagagaaagagccauguga

SEQ ID NO: 460193 - RNA, 64 nt, Human
auccuggucacauucucugucuccuggaaugcucccaccucaaguggaguuagaaggaagguag

SEQ ID NO: 460194 - RNA, 64 nt, Human
gcucaccuugaccuccuaggcucaacugaucuucccaccucagccuccugaauagcugggacua

SEQ ID NO: 460195 - RNA, 64 nt, Human
uuuuauugcaaggggaaaaaaaugucaucuccccccaccucaucccucuuugugacagcagacc

SEQ ID NO: 460196 - RNA, 64 nt, Human
uugaggacugcuggcuguaaccagggcacaucacccaccucaagacaagcccacgcccuuguca

SEQ ID NO: 460197 - RNA, 64 nt, Human
uuggagauccugaggcagcugugccuacuguuccccaccucagaagcuuccugcccagagagcc

SEQ ID NO: 460198 - RNA, 62 nt, Human
uucauuuguccacuguuucuugucaucacgcagcccuggacccaaagggugaacuaaaguuu

SEQ ID NO: 460199 - RNA, 62 nt, Human
uucuggaacagcggcaaccaagaggccuugcagcccuggaagugggucagggcccuuggugg

SEQ ID NO: 460200 - RNA, 62 nt, Human
aagugcccuuaaggaucaccccagcccccacagcccuggaauaaauuucgcaauuaguuucc

SEQ ID NO: 460201 - RNA, 62 nt, Human
ggggugagaccugaaggaccucccccuguguggcccuggacacagcccacccucugugagcc

SEQ ID NO: 460202 - RNA, 64 nt, Human
uuugcaaagaaaauauacaauuaucaagcagagaccaccucagauuaauagagaaugaauauaa

SEQ ID NO: 460203 - RNA, 64 nt, Human
gacaaugcggccaggggacgagcgccuuccuugcccaccucacugccacauuccagugggacgg

SEQ ID NO: 460204 - RNA, 64 nt, Human
cccuccgauugucccuuggggguuaccccucagcccaccucacuauggugcuggguagagggga

SEQ ID NO: 460205 - RNA, 64 nt, Human
aguugccccacccuaccugccuuuuauaguaugcccaccucaggcagacacagagcacaaugcu

SEQ ID NO: 460206 - RNA, 64 nt, Human
ugccuccuccaaucuguguucucaacugugguugccaccucauuaacuuacaaaaaaaugaagg

SEQ ID NO: 460207 - RNA, 64 nt, Human
ggaaggcacugagagcccccuuccucugagggccccaccucaccccuuggugucacccccacca

SEQ ID NO: 460208 - RNA, 64 nt, Human
cguucccgaaugugcuuuccucccucuccccugcccaccucaaguuuaauaaauaagguuguac

SEQ ID NO: 460209 - RNA, 64 nt, Human
gcugccacccucaccuagaaacaugccuuugugcccaccucaagaugggcagugucccuguucu

SEQ ID NO: 460210 - RNA, 64 nt, Human
acuccucacuuacuauguaaguucaucuagaucuccaccucaccuguaucaaaagacuguucuu

SEQ ID NO: 460211 - RNA, 64 nt, Human
ggaguuuccuugcugagauuucaaauaguccuccccaccucaacugucaccacugcuaagggac

SEQ ID NO: 460212 - RNA, 64 nt, Human
gcuggucuugaacuuuugagcucgagugauccacccaccucagccucccaaaaugcugggauua

SEQ ID NO: 460213 - RNA, 64 nt, Human
uuaaaagggacaguauucucagugcucuccuaccccaccucaugccuggccccccuccaggcau

SEQ ID NO: 460214 - RNA, 64 nt, Human
gcuggucgcgaacuccugagcucaggcaauccgcccaccucagccucccaaaguguugggauua

SEQ ID NO: 460215 - RNA, 64 nt, Human
aggcuggucuugaacuccugaccuccugauccacccaccucagcgucccgaagugcugggauua

SEQ ID NO: 460216 - RNA, 64 nt, Human
caaaccacuggacuggcagggcaacgacuucuucccaccucaagaugagguccucgcccccuug

SEQ ID NO: 460217 - RNA, 62 nt, Human
gcucauaaacaaaaugcccauguugguccucugcccuggaccugugacauucuggacuauuu

SEQ ID NO: 460218 - RNA, 62 nt, Human
ccuugggaggcuaagacaggaggauuccuugagcccuggaguuugaguccagccugggugac

SEQ ID NO: 460219 - RNA, 62 nt, Human
gccagcccccuccccucugcccaggcugccacgcccuggaugccacccagugcagccuggca

SEQ ID NO: 460220 - RNA, 62 nt, Human
cuguguagcugugaccugcugagcucugagaggcccuggaucagcguggccuuguucuguca

SEQ ID NO: 460221 - RNA, 64 nt, Human
gcaguggugugaucucggcucacuucagccuccgccaccucaaggcaguucaagcaauucuccu

SEQ ID NO: 460222 - RNA, 64 nt, Human
ucauagcucacugcagccugaaacuccuuggcuuccaccucagccucccaaagcauuaggauua

SEQ ID NO: 460223 - RNA, 64 nt, Human
gcuggucuugaacuccuaugcucaagugauccucccaccucagccucccaaaguacugugauua

SEQ ID NO: 460224 - RNA, 64 nt, Human
uuuuuaacuguugccuuauuaaccccucccucucccaccucaucuucguguccuuccugccccc

SEQ ID NO: 460225 - RNA, 64 nt, Human
ccaacccaagucgacaugggucuuaggacacugaccaccucacaugccauacccucaguuaagc

SEQ ID NO: 460226 - RNA, 64 nt, Human
gaagcuuggggugugacuguggggaggacuccauccaccucaucacuggacugcauggggaggc

SEQ ID NO: 460227 - RNA, 64 nt, Human
ccugcuuccaucucccagcccaccagcccucugcccaccucacaugccuccccauggauugggg

SEQ ID NO: 460228 - RNA, 64 nt, Human
uccuacaaaauggagggagccaucccuucccuguccaccucaccaggggugcuaugacaugcaa

SEQ ID NO: 460229 - RNA, 64 nt, Human
agcugcaauguggagacacguccuccuccccaacccaccucaugccaccgccaacccccugccc

SEQ ID NO: 460230 - RNA, 64 nt, Human
cugugaacuugcuggaaauacaaauccucaggccccaccucagaccuacugaaucagaaucucu

SEQ ID NO: 460231 - RNA, 64 nt, Human
aaauacacaaucacuaaguacuacaaaauaauaaccaccucaacugauagcaaaauaucuaauu

SEQ ID NO: 460232 - RNA, 64 nt, Human
gauguggaccucuacuuuccaggcuaguccggacccaccucaccccguuacagcuccccaagug

SEQ ID NO: 460233 - RNA, 64 nt, Human
acccccagguggcaucgccaacuccugccucgugccaccucaugcuuauaauaaagccggcguc

SEQ ID NO: 460234 - RNA, 64 nt, Human
ccuccuaccuaccuguuucuuccuucaucuccucccaccucagcuucucaaguagcucuggcac

SEQ ID NO: 460235 - RNA, 64 nt, Human
ugcugcaugcgauuaucuacccacguccacgcggccaccucacccucuccgcacaccucuggcu

SEQ ID NO: 460236 - RNA, 62 nt, Human
cuucugccaaacacauccagaaccugcccucagcccuggaagcuagcaucuucuggggccag

SEQ ID NO: 460237 - RNA, 62 nt, Human
gccacccuauucccacauggggagcaccaggagcccuggagccccuuccacccaaucccauc

SEQ ID NO: 460238 - RNA, 62 nt, Human
cuggagccggguccucagcugucugcucagcagcccuggacccgcgugcguuacgucaggcc

SEQ ID NO: 460239 - RNA, 62 nt, Human
uugugccuuaaaggcagagaagcgaggcggaugcccuggaagcacccagcaucacacccagg

SEQ ID NO: 460240 - RNA, 64 nt, Human
gcagccucaacugccccagguuuaagcaauccucccaccucagcccccagguaacugggacuac

SEQ ID NO: 460241 - RNA, 64 nt, Human
gcuagucuugaacuccugaccucaaaugacccacccaccucagccucccaaagugcugagauua

SEQ ID NO: 460242 - RNA, 64 nt, Human
accgucgagaaauggcuccagcgcugacuagcggccaccucauuuccccccuugaccacugggc

SEQ ID NO: 460243 - RNA, 64 nt, Human
ccaugacuuccacccuggagcuugaauccagcacccaccucaugucuguucucauaagucugaa

SEQ ID NO: 460244 - RNA, 64 nt, Human
auuucucccuaagucaggagcaugcagagcuagcccaccucauguccagcuguccacuuuccau

SEQ ID NO: 460245 - RNA, 64 nt, Human
cccagagccuuugccacagugcucccaccagcccccaccucauccgucuguuugcagagccuca

SEQ ID NO: 460246 - RNA, 63 nt, Human
accaagaagaugaaugcugaaggaaccaacaguccaccucagcgggccagcagcccagggaac

SEQ ID NO: 460247 - RNA, 64 nt, Human
gcagggaaaugcaaaucaaagccacaaugagauaccaccucacaccuguuagguuacaucugcu

SEQ ID NO: 460248 - RNA, 64 nt, Human
ccuggucucaaacuccuguccucaagugauccucccaccucagccuuucaaagugcuggaauua

SEQ ID NO: 460249 - RNA, 64 nt, Human
ugcaagcuccgccuccuggguucacgccauucucccaccucagcuucccaagcagcugggacua

SEQ ID NO: 460250 - RNA, 64 nt, Human
guuuagaaaaaugguuuucauauucaccauucuuccaccucauugaauugcaugcuguaguucu

SEQ ID NO: 460251 - RNA, 64 nt, Human
agcauggaugugucucaggcaccucauccccaccccaccucaccccaacaaacuccucuagaag

SEQ ID NO: 460252 - RNA, 64 nt, Human
cggccaccaugauugggaucucuguggcacugggccaccucauugggguaaggaacagagggga

SEQ ID NO: 460253 - RNA, 64 nt, Human
guuccuucacccucacaguauuuauuauccugcaccaccucacuguuccccaugcgcacacaca

SEQ ID NO: 460254 - RNA, 63 nt, Human
gcagaggagaugacuauuaaacuuaguccaaagccaccucaacaccuuuauuuucugagcuuu

SEQ ID NO: 460255 - RNA, 51 nt, Human; identical to SEQ ID NO: 372044

SEQ ID NO: 460256 - RNA, 62 nt, Human
gagggucccucucagagcgggagaacgccagagcccuggauggugaugcgcuggcugggggu

SEQ ID NO: 460257 - RNA, 62 nt, Human
ugccuaauuaaugaaagaugaaaauaggaagugcccuggagggggccagcaggucacggggc

SEQ ID NO: 460258 - RNA, 62 nt, Human
gguuaggauuccugggaaggccgcggauuccggcccuggaagaggcaggauccuggagcagu

SEQ ID NO: 460259 - RNA, 64 nt, Human
uugcagcacugaguggucaaaauacauuucugggccaccucagggaacccaugcaucugccugg

SEQ ID NO: 460260 - RNA, 64 nt, Human
uuuguggucuguguugacagccacccacccucucccaccucaugcuccugcaccugcaccacca

SEQ ID NO: 460261 - RNA, 64 nt, Human
uuugggguucucugcuugaaugucuucuccuuuaccaccucaccuuguugguaccucccucccu

SEQ ID NO: 460262 - RNA, 64 nt, Human
ugggucugucugaggaaggagggggucccgccuuccaccucaacacaucccuucagugacucag

SEQ ID NO: 460263 - RNA, 64 nt, Human
cugugcugccggaaaaagccgggggccugcaucaccaccucagagcuguucaggaagcuggucc

SEQ ID NO: 460264 - RNA, 64 nt, Human
aggcuggucucgaacuccugaccucgugauuggcccaccucagccucccaaagugcugguauua

SEQ ID NO: 460265 - RNA, 64 nt, Human
gcuguccugugaugucagcggugcagcgugugugccaccucauuauuaucuagcuaagcggaac

SEQ ID NO: 460266 - RNA, 64 nt, Human
aggccgauauugcuaacugaucacagauucuuucccaccucacaauccuuccgaaugugcucca

SEQ ID NO: 460267 - RNA, 64 nt, Human
ccuauucagcauucuuucugauuucuagaacuauccaccucauuaggccuucuuccuaucccca

SEQ ID NO: 460268 - RNA, 64 nt, Human
ugaagccgcgacaucccaggcucaagugauccucccaccucagcuuccugaguagguaggacua

SEQ ID NO: 460269 - RNA, 64 nt, Human
auuuuugaacugaagcuacugguacuccccagcaccaccucauacuaagaauuccucacucuga

SEQ ID NO: 460270 - RNA, 64 nt, Human
cccaccacgauguggcccuggccugcugggcucuccaccucagccuuggauaaugcuguugccu

SEQ ID NO: 460271 - RNA, 64 nt, Human
cacuccacacuccuggaauaccucuucccuaaugccaccucaguuuguuucuuucuguuccccc

SEQ ID NO: 460272 - RNA, 64 nt, Human
uauguacuaucuggaaagauaacacauacuccagccaccucaccugauuggcuaucuuggggcc

SEQ ID NO: 460273 - RNA, 64 nt, Human
caaggaaagccacccgcuagacccauggccucacccaccucagcacuuggaagaagaggugacu

SEQ ID NO: 460274 - RNA, 62 nt, Human
aacacuccuucuuucagccccaccuccccagggcccuggaggagacccccacccugcaaucc

SEQ ID NO: 460275 - RNA, 62 nt, Human
caucgugguccauggagccuuucaaaaugggugcccuggaggggccugacaguggguuccuu

SEQ ID NO: 460276 - RNA, 62 nt, Human
gauaggccauugcuuucaccgauuccaacccagcccuggacugaggauggaugguuccauga

SEQ ID NO: 460277 - RNA, 62 nt, Human
ugugaaccaauuuuaaauacauucuccuuuuugcccuggauuguugacaugaguggaauacu

SEQ ID NO: 460278 - RNA, 64 nt, Human
ccagguucucuuuucuuauugaggaacgauccgaccaccucacaggccugcccugcagcuggaa

SEQ ID NO: 460279 - RNA, 64 nt, Human
auugggagcacaaggggccucccaaaaaggagccccaccucagcaucacugccuuaaucguggc

SEQ ID NO: 460280 - RNA, 64 nt, Human
gcugguugcaaacuccuugcuucaagggauccucccaccucagccucccaagcagccgggacug

SEQ ID NO: 460281 - RNA, 64 nt, Human
cuauggagucacauaagccaacgccagagccccuccaccucaggccccagccccugccucucca

SEQ ID NO: 460282 - RNA, 64 nt, Human
aggcuggccucaaacuccugaccuugugauccacccaccucagccucccaaagugcugggauua

SEQ ID NO: 460283 - RNA, 64 nt, Human
ucuccuguugcucugucauccuaaugugcugcauccaccucauggaccaagauggcugccacag

SEQ ID NO: 460284 - RNA, 64 nt, Human
acgggcgggcgucacguguguucagagcuugucuccaccucacggcucugugcucuucugugug

SEQ ID NO: 460285 - RNA, 64 nt, Human
ugcaagcuccgccuccuggguucacgccauucucccaccucagccucccgaguagcugggacua

SEQ ID NO: 460286 - RNA, 64 nt, Human
ccuaaacccaaugacuucccugcuccaacccccgccaccucagggcacgcaggaccaguuugau

SEQ ID NO: 460287 - RNA, 64 nt, Human
aauuagccaggugugguggcaagugccuuuaaucccaccucaggaggcugaggcaggagaaucg

SEQ ID NO: 460288 - RNA, 64 nt, Human
caagguauuuuguuuuuuauuaauucgcgcuuggccaccucaucuguaaagagauucuaaaagc

SEQ ID NO: 460289 - RNA, 64 nt, Human
cugucccugguguagagccugggggacccaucuuccaccucaccucuuuguucuuccugucucc

SEQ ID NO: 460290 - RNA, 64 nt, Human
gcugaucucaaacuccuggcuucaagagauccacccaccucagccucccaaagcgcuaggauua

SEQ ID NO: 460291 - RNA, 64 nt, Human
uagcccuggaucugccuuccugcugaaacuuguuccaccucaguccccucaucugucacacgca

SEQ ID NO: 460292 - RNA, 64 nt, Human
uauaaccucuuccuccaggguucaagugauucucccaccucagccucccaaguagcugggacua

SEQ ID NO: 460293 - RNA, 62 nt, Human
ugucaucuugcuucccaaucuaagaaccuguggcccuggaacacuuuucaagaauugguuca

SEQ ID NO: 460294 - RNA, 62 nt, Human
ugcaggacuccugaaggaggugggagcugagggcccuggaggauggggaagguuugcagaga

SEQ ID NO: 460295 - RNA, 62 nt, Human
gauuuuacaaaagaaaguaagcugcuuagaaggcccuggaagggaagugaggaggagggaca

SEQ ID NO: 460296 - RNA, 62 nt, Human
cacgcagaacgaacaugacuccagaggaccucgcccuggagcugagccuggcgccgggucag

SEQ ID NO: 460297 - RNA, 64 nt, Human
uagcgucugcucucucggccucugccuccgcuucccaccucaccuggcuucugucuaugucagu

SEQ ID NO: 460298 - RNA, 64 nt, Human
agcucaaaucccucaccccacccccuggccccgcccaccucacaggaacuguucaguucccacc

SEQ ID NO: 460299 - RNA, 64 nt, Human
acagugaaugggagguggaggaggguugcagcucccaccucaguuuaguuuuuaauucaggguu

SEQ ID NO: 460300 - RNA, 64 nt, Human
cuggaacuugaacgacugggcugaagugaucuucccaccucagccucccaaguagcugggaaua

SEQ ID NO: 460301 - RNA, 64 nt, Human
cuggucucuuaacuccuaggcucaagugauccucccaccucagccucccaaagugcuuggauga

SEQ ID NO: 460302 - RNA, 64 nt, Human
ugccgcuucaaucuccugggcucaaaugauccuuccaccucagccucccauguggcugggacua

SEQ ID NO: 460303 - RNA, 64 nt, Human
gagaggagggauggagaagcucugcucgcugcuuccaccucaccguguguccuccccuccccuc

SEQ ID NO: 460304 - RNA, 64 nt, Human
uuggcccagaaaccaaaugugaacuuccugucucccaccucagcacuaguccaugccaggacac

SEQ ID NO: 460305 - RNA, 64 nt, Human
aacauaucugcuuuaauggggauguaccagaaacccaccucaccccggcucacaucuaaagggg

SEQ ID NO: 460306 - RNA, 64 nt, Human
ugcaaccucugccuccuggguucaagcaauucucccaccucagccucccaaguagcugggauua

SEQ ID NO: 460307 - RNA, 64 nt, Human
acgagaugcgaaaugcagucaacgacgcaggauuccaccucaacaaccagcucuaugacaucau

SEQ ID NO: 460308 - RNA, 64 nt, Human
gaaagaaaccccucaguuuuuuccgucuaguccgccaccucauuccccauuaagucaugggcau

SEQ ID NO: 460309 - RNA, 64 nt, Human
cuggggccugguggguaggcaaguagcucuggggccaccucaagugaccaaaugcuauuaauuu

SEQ ID NO: 460310 - RNA, 51 nt, Human
cugccagcaugccugccugacccaccucagagccugcuuugcaucacuggg

SEQ ID NO: 460311 - RNA, 64 nt, Human
gggucugcaaaggcauagaacuccccaguguuuuccaccucauucucccagauugagcucccuu

SEQ ID NO: 460312 - RNA, 62 nt, Human
cccuccucccuuccccugccccuccuuuccacgcccuggaaaccaucucacuucacagggca

SEQ ID NO: 460313 - RNA, 62 nt, Human
gaaaaugaacuauauaucuaauuaacaaacaggcccuggaucauauuccggggaucaucaca

SEQ ID NO: 460314 - RNA, 62 nt, Human
acccauaaaaccugcuuugauuccaaaaugaggcccuggagugcgcaaggagugcccggaug

SEQ ID NO: 460315 - RNA, 62 nt, Human
ggaggccuccugggguggccuguccugcaggggcccuggaaugggggcaagcagcugggugg

SEQ ID NO: 460316 - RNA, 64 nt, Human
ggauguacaaggcgaucccaucuugauaagaccaccaccucagaguauggagcucagagagggc

SEQ ID NO: 460317 - RNA, 64 nt, Human
agccgaggauguaguuguugcugccgucgucccaccaccucagggaccagagggcuagguuggc

SEQ ID NO: 460318 - RNA, 64 nt, Human
agggugaaagaugaauacaauaacaaccaugaacccaccucacggaagcuuuuuuugcacuuug

SEQ ID NO: 460319 - RNA, 64 nt, Human
guggccugagaacugagcccagacuuugacaaacccaccucaacaucaagccuggggcaggugg

SEQ ID NO: 460320 - RNA, 64 nt, Human
ccgggccuuugcggcagcuacuggcagggccuggccaccucauaggacucaguucccuucugaa

SEQ ID NO: 460321 - RNA, 64 nt, Human
ggggacucccagaagccaguagagagaccaggagccaccucaaucagcaggacagccucacugc

SEQ ID NO: 460322 - RNA, 64 nt, Human
acugcacuccagccugggcgacaagagugaaacuccaccucaaaaaaaaaaaaaaaagaguuaa

SEQ ID NO: 460323 - RNA, 64 nt, Human
aggauggccucgaucucuugaccucgugauccgcccaccucagccucccaaagugcuaggauua

SEQ ID NO: 460324 - RNA, 64 nt, Human
uuuuucaacugccaaucaaggcuaggaggcucgaccaccucaacauuggagacaucacuugcca

SEQ ID NO: 460325 - RNA, 64 nt, Human
aggcuggucucgaacuccugaccuugugaucugcccaccucagccucccaaagugcuaugauua

SEQ ID NO: 460326 - RNA, 64 nt, Human
augaagccuucucuggaaccacuccagcccagcuccaccucagccuuggccuucacgcugugga

SEQ ID NO: 460327 - RNA, 64 nt, Human
gcuggucucaaacuccagggcucaagcaguccucccaccucagccucccaaagugcugggauca

SEQ ID NO: 460328 - RNA, 64 nt, Human
gcugccccccgcugcucaggaugaaccuggaggcccaccucaaggagugcgagcacaucaaaug

SEQ ID NO: 460329 - RNA, 64 nt, Human
uggccuaccccuuucuccagcccugacuaaacuaccaccucaggugacuuuuuaaaaaaugcug

SEQ ID NO: 460330 - RNA, 64 nt, Human
gcuggucucaaacucuugaccucaggugauccacccaccucagccucccaaagugcugggauua

SEQ ID NO: 460331 - RNA, 62 nt, Human
gguguaguguuugcuaggagcccaggauaccugcccuggacuuaaauugugauugaagugga

SEQ ID NO: 460332 - RNA, 62 nt, Human
ucugcaucacccugagccccauuugcuucccagcccuggaguuuuuacccggcuuugccugc

SEQ ID NO: 460333 - RNA, 62 nt, Human
aggauagcuaucugggacauuauuggcagugggcccuggaggccagucccuagccccccuug

SEQ ID NO: 460334 - RNA, 62 nt, Human
gucagacaggucacccaggagccucgaggaaagcccuggagggaaucacauguguacuuuuu

SEQ ID NO: 460335 - RNA, 64 nt, Human
cugcagccucaaccuccugggcuaagugauccucccaccucagccucccgaauagcugggacua

SEQ ID NO: 460336 - RNA, 64 nt, Human
uggagauuuuucuuaaauaauaauauugugcucuccaccucacccuuguguaaacccucagguc

SEQ ID NO: 460337 - RNA, 64 nt, Human
ugcagccuggaccuccuagccucaagcaauccacccaccucagccuuccaaguagcugggacua

SEQ ID NO: 460338 - RNA, 64 nt, Human
uauucucaaccuccugggcucaaaugaucuccucccaccucagccucccaaguagcugagacua

SEQ ID NO: 460339 - RNA, 64 nt, Human
gcuggucucaaacuccuggccucaagcaauccucccaccucagccuccuaaagcacugggauua

SEQ ID NO: 460340 - RNA, 64 nt, Human
ccaaucuccauuucucugccaagcccauuuacccccaccucaugcaucccaaggcucuacuggg

SEQ ID NO: 460341 - RNA, 64 nt, Human
ggcuucauuucaccccugcugggaggccagguucccaccucaccacccugggauuccugagugu

SEQ ID NO: 460342 - RNA, 64 nt, Human
gugcagagugcagaggcggcucugguuccuccagccaccucagucccucuuugggaggugaugu

SEQ ID NO: 460343 - RNA, 64 nt, Human
gcaggcaacuuuagcacaugaugaaaacagacuuccaccucaguggccugugggcacgcacaag

SEQ ID NO: 460344 - RNA, 64 nt, Human
accuucuuguauucauuaaccauaguacuccuccccaccucaaguagacaccucucucaggagc

SEQ ID NO: 460345 - RNA, 64 nt, Human
gcuggucucgaacuccuguccucagguaauccgcccaccucagccucccaaagugcugggauua

SEQ ID NO: 460346 - RNA, 64 nt, Human
gggacccaccauuuguggggaaaguagcauuccuccaccucaggccuuggguagauuuggcaaa

SEQ ID NO: 460347 - RNA, 64 nt, Human
cugugugugcgcccagugcccgcuucguaggacaccaccucacacucacuucccgccucucuuu

SEQ ID NO: 460348 - RNA, 64 nt, Human
cuggucucgaacuccugaccucaggugaucccccccaccucagccucccaaagugcugggauua

SEQ ID NO: 460349 - RNA, 64 nt, Human
uccugucauaaccuucuaacuuguuucuugacgaccaccucauguggccaauaaauggacuggg

SEQ ID NO: 460350 - RNA, 62 nt, Human
cuguuccccaguauugcccucaauuccugagagcccuggagcgguuuccuaccauucccuuc

SEQ ID NO: 460351 - RNA, 62 nt, Human
agagaauuuauuuccuucuccacucucuccaugcccuggagaaaaaaaaguccagaagaaau

SEQ ID NO: 460352 - RNA, 62 nt, Human
cuugaccccucuauuucuguuggcuaaggccagcccuggacauuguccaggaaggccugggg

SEQ ID NO: 460353 - RNA, 62 nt, Human
guggggugggugggcaugggagguaggggugggcccuggagaugaggagggugggccauccu

SEQ ID NO: 460354 - RNA, 64 nt, Human
agaagggccggugggcaccggggccgggaagcccccaccucaccaccugagggccccugggagg

SEQ ID NO: 460355 - RNA, 64 nt, Human
gccggucucaaacuccugaccucaggugaugcacccaccucagccucccaaagugcagggauua

SEQ ID NO: 460356 - RNA, 64 nt, Human
uucgccccaggacuagccugcgcccccgucaccuccaccucaccugugcugccacuuccuagug

SEQ ID NO: 460357 - RNA, 64 nt, Human
ggcgugggagucagggcugcaugcuccuccccucccaccucacaggcggccuuaggcaagucau

SEQ ID NO: 460358 - RNA, 64 nt, Human
ucguggccuacgggcagagggaccccagcgccuaccaccucaacagacaccuccagcacagcuu

SEQ ID NO: 460359 - RNA, 64 nt, Human
cucucaccgcugccauugagaagaugaaaaccacccaccucaaggaacagaaagcauuugcccu

SEQ ID NO: 460360 - RNA, 64 nt, Human
cuguugccaaacaacucccugaggccucuccgcaccaccucagcgggcaggaggucccaccaug

SEQ ID NO: 460361 - RNA, 64 nt, Human
uggagaccuccaggcuuuccugcccugggcagccccaccucacagccagagucaaugccuucau

SEQ ID NO: 460362 - RNA, 64 nt, Human
uucaggagccucagauaaguauuuguacuugagaccaccucacacaaucuguaugggcccaacc

SEQ ID NO: 460363 - RNA, 64 nt, Human
uuggauucaaguauccugguuagcaagaccacucccaccucaggaagcuaguauucaugcccag

SEQ ID NO: 460364 - RNA, 64 nt, Human
acucuuaucuuacaacucccccaccgcccacucuccaccucacuagcuccccaaucccugaccc

SEQ ID NO: 460365 - RNA, 64 nt, Human
auuagaucaaagcuguuguugggcaccagguuggccaccucaaucaccagccaagaugguugcu

SEQ ID NO: 460366 - RNA, 64 nt, Human
caaauucagcaauaguaugcagaucagccccucaccaccucauuguucucaucuggaacugaaa

SEQ ID NO: 460367 - RNA, 64 nt, Human
ugcagccucaaccuccugggcucaagugauccucccaccucagccuccugaguagcugagacca

SEQ ID NO: 460368 - RNA, 64 nt, Human
acccgaggccuccugggagaccugcagaccacgcccaccucauuuacauguucacucccgaccc

SEQ ID NO: 460369 - RNA, 62 nt, Human
ugagucggaagcucccggggacgacgcugacugcccuggaggccgcagccaacccggcacug

SEQ ID NO: 460370 - RNA, 62 nt, Human
caucuuagagucaaaggcagaggggcuuccaggcccuggaugggguauuuuggugucaccug

SEQ ID NO: 460371 - RNA, 62 nt, Human
cugacgccaccuuccugcugaggugggacugggcccuggacacaccccucagccccucuguc

SEQ ID NO: 460372 - RNA, 60 nt, Human; identical to SEQ ID NO: 372077

SEQ ID NO: 460373 - RNA, 64 nt, Human
ucugguauucugguauuagcaacuguaaauucugccaccucauacauggaacagagcuuguggg

SEQ ID NO: 460374 - RNA, 64 nt, Human
gcuggugucgaauuccuggucucaagcaguccucccaccucagccucccaaggugcugggauua

SEQ ID NO: 460375 - RNA, 64 nt, Human
gccucacucgagcugcugaccucaagugauccucccaccucagccugccaaagcacugggauua

SEQ ID NO: 460376 - RNA, 64 nt, Human
uggaauguauccccugacaggcccccuuccgccuccaccucaacccaggucuuggauuucaggu

SEQ ID NO: 460377 - RNA, 64 nt, Human
ggaagaagcacaugaccguacucugcguggggcuccaccucacacccaccccugggcaucuuag

SEQ ID NO: 460378 - RNA, 64 nt, Human
agaggggaccucccagcucuuauuugcacccuccccaccucaccaacuuuggucccucucuggg

SEQ ID NO: 460379 - RNA, 64 nt, Human
uaguggccagaccagagcucuggagccaccugucccaccucaaaugggucugggggucaggagg

SEQ ID NO: 460380 - RNA, 64 nt, Human
ugaccucucagucagacuggggugcaggaccuguccaccucaaugaaggagagaggagcauggg

SEQ ID NO: 460381 - RNA, 64 nt, Human
gcuggcuggaucagcaccgauucccgaaagcuuuccaccucagccucagaguccagcugcccgg

SEQ ID NO: 460382 - RNA, 64 nt, Human
ccccucuuuucuguacuccacgugcuguccugguccaccucacuccuccaugggcuucuugaga

SEQ ID NO: 460383 - RNA, 64 nt, Human
cuugcacacccacugccccgugugaauguagcuuccaccucauggauugccacagcucaacucg

SEQ ID NO: 460384 - RNA, 64 nt, Human
agagugaagcccugccauaggaggagaacacagcccaccucaggccuccugcaaaaauacauag

SEQ ID NO: 460385 - RNA, 64 nt, Human
aggauugucuccaucucuugaccuugugauccacccaccucagccucccaaagugcugggauua

SEQ ID NO: 460386 - RNA, 64 nt, Human
uccgcccggguuuggcucgcccggcccgcgggcuccaccucagguuuucacuuuucgcuccgga

SEQ ID NO: 460387 - RNA, 64 nt, Human
agaguaggaagaaggggacgagccgggagcaaaaccaccucagacacccgggccuucucagccu

SEQ ID NO: 460388 - RNA, 62 nt, Human
gugugcaccaggguucaguagaguccacuucugcccuggagaccacaaaucaacuagcucca

SEQ ID NO: 460389 - RNA, 62 nt, Human
uucacacauuccugaccagagaucccagccaggcccuggaggucugacagccccucccuccc

SEQ ID NO: 460390 - RNA, 62 nt, Human
cuucauuucuuaucuacuuggcaugaaagggugcccuggauaggaggguguguacagggcaa

SEQ ID NO: 460391 - RNA, 62 nt, Human
gcagagaacaaggacagaggccaggcacugaggcccuggagacagcuguuccacuugcacac

SEQ ID NO: 460392 - RNA, 64 nt, Human
acaaccuccacucccuggggcucaagcgauccucccaccucagccgccgaaguagcugggacua

SEQ ID NO: 460393 - RNA, 64 nt, Human
agacucugaucuccaggaaccccauagccccucuccaccucaccccauguugaugcccaggguc

SEQ ID NO: 460394 - RNA, 64 nt, Human
guuccucaguuguuguuuugacauauuucaguuuccaccucacguuuuuagagcagaaccacac

SEQ ID NO: 460395 - RNA, 64 nt, Human
ugcagccucagcguccugggcucaaaugauccucccaccucagccuccugaguagcugggacua

SEQ ID NO: 460396 - RNA, 64 nt, Human
aaaucucucucccaguacaccaguuguuccucccccaccucagcccucuccugcauccuccugu

SEQ ID NO: 460397 - RNA, 64 nt, Human
ccgcgggcccauggacucugaguggcgacugccuccaccucauucccgugacucguggcaugcg

SEQ ID NO: 460398 - RNA, 64 nt, Human
ccuuucaucugaaagaagauaccucccucccaguccaccucauuuagaaaaccaaagugugggu

SEQ ID NO: 460399 - RNA, 64 nt, Human
gcuggucucaaacuccugaccucaggugauccacccaccucagccucccaaagugcugggauua

SEQ ID NO: 460400 - RNA, 64 nt, Human
uacuccccuguggugaguaccguggaaccccagcccaccucacuaucauacucagcuuccccug

SEQ ID NO: 460401 - RNA, 64 nt, Human
aggagauccuaagggguucagggggacccuacccccaccucagguugggcuucccugggcacuc

SEQ ID NO: 460402 - RNA, 64 nt, Human
gcuggucuugaacuccugaccucagguguuccacccaccucagccuuccaaagugcuaggauua

SEQ ID NO: 460403 - RNA, 64 nt, Human
cccuucagagcuagggacgaacagcagugugcucccaccucagggccuugccucugcggccucc

SEQ ID NO: 460404 - RNA, 64 nt, Human
uuuguccucucagcaggaaguggaucccccucagccaccucaauucuucaaaagaaagagacuu

SEQ ID NO: 460405 - RNA, 64 nt, Human
uggcuucugucuguagagccgcauggcacucuucccaccucagugcccacagccaagguagggu

SEQ ID NO: 460406 - RNA, 64 nt, Human
agaugcacgaugcuggggucaaagacuuguguccccaccucaggcugccaggauggcgugugug

SEQ ID NO: 460407 - RNA, 62 nt, Human
ccauccuccagcagggaaaaugcagcagggaugcccuggagguggcugagccccugucuaga

SEQ ID NO: 460408 - RNA, 62 nt, Human
ggaaauaggcccaaccaccagaugagaauuaggcccuggaugaguagcgcuauaguuacugu

SEQ ID NO: 460409 - RNA, 62 nt, Human
aacugauucuacaauuggacauucauuugugugcccuggaauuuccaacuaguaauaaacaa

SEQ ID NO: 460410 - RNA, 62 nt, Human
cggcccggggcaccuucggcugguccuguggggcccuggacgguggcccagugguggcaggg

SEQ ID NO: 460411 - RNA, 64 nt, Human
aggagagagacacucuccaugaacacuucuccagccaccucauacccccuucccaggguaagug

SEQ ID NO: 460412 - RNA, 64 nt, Human
ugcaucuguaauccacaaagauucugggcagcugccaccucagucucuucucuguauuaucaua

SEQ ID NO: 460413 - RNA, 64 nt, Human
ucuacgcugccucaggcccccagcccuguggcuuccaccucagcucuagaagccugcucccucu

SEQ ID NO: 460414 - RNA, 64 nt, Human
uucuuuucucccaugacacugacaagaggaauuaccaccucagccucuuuugccccucuucuug

SEQ ID NO: 460415 - RNA, 64 nt, Human
gcugaccuugaacuccugggcucaagcagucuacccaccucagccuccuguguagcugggauua

SEQ ID NO: 460416 - RNA, 54 nt, Human
uccgcauccagcgcuccugagggcccaccucacucgccuugggguucugcgagu

SEQ ID NO: 460417 - RNA, 64 nt, Human
ggaacagcgggucccuucccuccucagacacaagccaccucagcuuguggcucuuggcccccag

SEQ ID NO: 460418 - RNA, 64 nt, Human
ggcgugcgggggaacugcccuguggaugcagccaccaccucacaaagccaugaauucccaaagc

SEQ ID NO: 460419 - RNA, 64 nt, Human
aggcuggucucaaacuccugaccuugugauccgcccaccucagccuccgaaagugcugggauua

SEQ ID NO: 460420 - RNA, 64 nt, Human
cccuugcaagggugccucuguucugucccugcccccaccucaccuucucuacuccuccaguaag

SEQ ID NO: 460421 - RNA, 64 nt, Human
gcuccucaaguagggaacaaagccaagaagaaucccaccucagugaaaugcuacaacugugaau

SEQ ID NO: 460422 - RNA, 64 nt, Human
ugcagccucgagcuccugagcucaaaggauccucccaccucagccuccagaguagcucagauua

SEQ ID NO: 460423 - RNA, 64 nt, Human
aggcuuccacuaggguccaccaggaguucucccaccaccucaccaguuuccaggugguaagcac

SEQ ID NO: 460424 - RNA, 64 nt, Human
uccaagcucugcuuccucaguuuccaaaauggaaccaccucaccuccgcagcacccgacuuacc

SEQ ID NO: 460425 - RNA, 64 nt, Human
cuucaucauggauuucgccuaagugauauuacagccaccucauucuucuaaaaguggauauuuu

SEQ ID NO: 460426 - RNA, 62 nt, Human
agcaguggaauuuuccugccauccuaauaagagcccuggauuccaucauuaacauuucagcc

SEQ ID NO: 460427 - RNA, 62 nt, Human
aaaucuuuguguacuuuauuuguaaauuauuugcccuggaguuuuagaaaauaguuucugaa

SEQ ID NO: 460428 - RNA, 62 nt, Human
ugauggccgcacagaaggacuucuucugggaggcccuggacaugcugcagagggcugaagga

SEQ ID NO: 460429 - RNA, 62 nt, Human
ucuccauggggaggccucaccccagggacagggcccuggagcucaggguccuuguuucugcc

SEQ ID NO: 460430 - RNA, 64 nt, Human
uuaggaaggucuucgaaauacuaauuuguaagccccaccucaggccuacugaaucagaagcucu

SEQ ID NO: 460431 - RNA, 64 nt, Human
gagacacagaccugauacaguaugucuuucugcaccaccucacaauuuuccugaaccccaaagg

SEQ ID NO: 460432 - RNA, 64 nt, Human
uaacuccugggcucaagcaauccaagugauccucccaccucaaccuucggaguagcugggauca

SEQ ID NO: 460433 - RNA, 64 nt, Human
aaauguaguuuguacagaagucacacuuuuuuguccaccucacagaugugaacuuuacuuuguu

SEQ ID NO: 460434 - RNA, 64 nt, Human
cuuguauaaucuagcagucuguugauuuauccuuccaccucauaaaaaaugcauagguggcagu

SEQ ID NO: 460435 - RNA, 64 nt, Human
accaccugcagccucggcagggcagguacaggggccaccucagaugggagccugggucccugcc

SEQ ID NO: 460436 - RNA, 64 nt, Human
caagagggagugggcacccuggcgggcccucuccccaccucaccucuuaauaaaggucagacac

SEQ ID NO: 460437 - RNA, 64 nt, Human
ugcagucuugaccuuuugggcucaagugauccucccaccucagccuccugaguagcugggacca

SEQ ID NO: 460438 - RNA, 64 nt, Human
gcaaccucugccuccugggguucaagugauccucccaccucagccuccugaguagcugggauua

SEQ ID NO: 460439 - RNA, 64 nt, Human
auuuuccaccuggaaucauggauuuaaaauuuccccaccucauggggaaaaaacuaacccagaa

SEQ ID NO: 460440 - RNA, 64 nt, Human
aaauuaauuuaaggucuuuucuuaaaaaaaaaauccaccucauuuucaguuaacaugugccauu

SEQ ID NO: 460441 - RNA, 64 nt, Human
cuuagcugacacacccccagcuggcccuccacccccaccucaagugccuuauucucacagcaag

SEQ ID NO: 460442 - RNA, 64 nt, Human
gcugguggugagcuccuggccucaggugauccacccaccucaguguuccaaagugcugauauua

SEQ ID NO: 460443 - RNA, 64 nt, Human
gcuggucuaaaacuccugaccucaagugaucugcccaccucagccucccaaagugcugagauua

SEQ ID NO: 460444 - RNA, 64 nt, Human
ugcagccuugacuucucaacgccaagucauccucccaccucagccuccugaguagcuaugacua

SEQ ID NO: 460445 - RNA, 62 nt, Human
ucccuugacugcccgcacuggcgccugucugugcccuggagcauucugcccaggcuacgugg

SEQ ID NO: 460446 - RNA, 62 nt, Human
agccuugccuggcugagcuguguuccaggggagcccuggacaagcccucauaggcagggagg

SEQ ID NO: 460447 - RNA, 62 nt, Human
gugugguccuugaguggguuucucggauccgugcccuggaauaccuggcucaggaaugcugu

SEQ ID NO: 460448 - RNA, 62 nt, Human
uugauuacaauugagauucaugugacuauugagcccuggaaauguagcuuguccaaauugag

SEQ ID NO: 460449 - RNA, 64 nt, Human
cccugucccaccccuaccucuaguaaauuuaaguccaccucacguucuggcaucacuuggccuu

SEQ ID NO: 460450 - RNA, 64 nt, Human
ugcagucucugccucccaggcucaagugauccucccaccucagccucucaaguagcugggacua

SEQ ID NO: 460451 - RNA, 64 nt, Human
gguggucucaaacuccugugcucaagugacccucccaccucauucucaaguggcugcaauuaca

SEQ ID NO: 460452 - RNA, 64 nt, Human
cuuuguguguguucagggagcucuccuggcucugccaccucauuugucuuuauuuuuuucucuu

SEQ ID NO: 460453 - RNA, 64 nt, Human
uucucagcuucuuuaccucuccuuugaguuagguccaccucaguuuucuaaaggucaaauuaag

SEQ ID NO: 460454 - RNA, 64 nt, Human
gcacugagugugggagaguuuuuagccaaaauucccaccucauucggcaccaaaaaguucacac

SEQ ID NO: 460455 - RNA, 64 nt, Human
ugcaaccucugcuuccugggcucaagcacucugcccaccucagccuccagaguagcuggaaaua

SEQ ID NO: 460456 - RNA, 64 nt, Human
ugcagccucaaauuccugggcucaagcgauccucccaccucagccuccacagcagcuggaacuc

SEQ ID NO: 460457 - RNA, 64 nt, Human
ucucccuccaggugccugguggugcuagcuccucccaccucagcaccugcugcaucuggagcag

SEQ ID NO: 460458 - RNA, 64 nt, Human
ugugcccagugcccuugggcaggaccugugagagccaccucacaggcagagcccccaccaggca

SEQ ID NO: 460459 - RNA, 64 nt, Human
ucuccuuggggcccugcccaccuccaggccucucccaccucaggcccugcccgacccuggggag

SEQ ID NO: 460460 - RNA, 50 nt, Human
agcagcccguguaccugugaccaccucaucccuugccugccacugugccu

SEQ ID NO: 460461 - RNA, 64 nt, Human
accagggguuccgggguugggagcugaaccauccccaccucaggguuauauuucccucuccccu

SEQ ID NO: 460462 - RNA, 64 nt, Human
aggaggccucuauccugucccuccaccccacccuccaccucaauccccucccaucuuccccaga

SEQ ID NO: 460463 - RNA, 64 nt, Human
gggccagagguguaauguuuuggcugaguguaugccaccucagauucauauguugaaaccuuac

SEQ ID NO: 460464 - RNA, 62 nt, Human
gaggaucccagguugaagaguggccccuugaggcccuggaaagaccaaucacuggacuucuu

SEQ ID NO: 460465 - RNA, 62 nt, Human
agggauaaggcugauuuggaccccaggcuucugcccuggacagcacuugugucugcagauua

SEQ ID NO: 460466 - RNA, 62 nt, Human
agcacccuggugccaaggccuucucagcccaugcccuggagggcauuccccuggccagccuc

SEQ ID NO: 460467 - RNA, 62 nt, Human
cuggcauucugguaccuucacccagccugagugcccuggagagggaacaggaaaugcugauc

SEQ ID NO: 460468 - RNA, 64 nt, Human
cuucucuacccaagucacaaccugucaggcugcaccaccucauccuggcccgccgaaccuugac

SEQ ID NO: 460469 - RNA, 64 nt, Human
ugcagccuugaacucccagacucaagugauccuuccaccucagccucuggaguagcugggacua

SEQ ID NO: 460470 - RNA, 64 nt, Human
gcuggucucaaacuccugcccucaggugauccacccaccucagccucucaaagugcugggauua

SEQ ID NO: 460471 - RNA, 64 nt, Human
uuucucaucucauuggcccccaccccagagaccuccaccucaacuucuggcugucccuacccug

SEQ ID NO: 460472 - RNA, 64 nt, Human
ccccucuaguuucaugggcgagcacccccaucugccaccucagacugacacacagccagcuggc

SEQ ID NO: 460473 - RNA, 64 nt, Human
gcggguuucgaaauccugaccucaaaugauccacccaccucagccucccaaagugcugggauua

SEQ ID NO: 460474 - RNA, 64 nt, Human
ugcagccuccacguccugugcuuaagcgauccucccaccucagccucucgaguagccgggacca

SEQ ID NO: 460475 - RNA, 64 nt, Human
gcugguuuugaacuccuggccucaagugauccacccaccucagccucccaaagugcugggauua

SEQ ID NO: 460476 - RNA, 64 nt, Human
ccucauggugugccuccaaccccccuguuccccaccaccucaaccaauaaacugguuccugcua

SEQ ID NO: 460477 - RNA, 64 nt, Human
guaucuuuggccccuuuucaccuacugcgaccacccaccucauccuggcucagccuggugaugg

SEQ ID NO: 460478 - RNA, 64 nt, Human
ugaagcuucaaucuccuggguucaagggauccucccaccucagccuccaaaguugcuaggacca

SEQ ID NO: 460479 - RNA, 64 nt, Human
gcuggucucaaacuccugaccucaggcaaucugcccaccucagccucccaaagugcugggauua

SEQ ID NO: 460480 - RNA, 64 nt, Human
acagcguucacagcaucuucaccaggaguaaauuccaccucaugaaaccacuuucgaggcuccu

SEQ ID NO: 460481 - RNA, 64 nt, Human
ucuuuucagggaucucaagggcauuucccuuugcccaccucaccuuuucauauuugguaaacug

SEQ ID NO: 460482 - RNA, 64 nt, Human
aggcuggucuugaacuccugaccucaugauccgcccaccucagccucccaaaguguugggauua

SEQ ID NO: 460483 - RNA, 62 nt, Human
aaccggagagaagugauuggaaaugaacucuugcccuggaauaaucuugacaauuaaaacug

SEQ ID NO: 460484 - RNA, 62 nt, Human
gcccccaugcucgcgcugggcagggaccggcagcccuggaaggggcacuugauauuuuucaa

SEQ ID NO: 460485 - RNA, 62 nt, Human
gcuucugugcaccuccugcaaagcuggcagaggcccuggaauuccagaucaccugaggggaa

SEQ ID NO: 460486 - RNA, 62 nt, Human
ccaggccuuccggcgggcaaggaccagggcgagcccuggagcgccggagcggacgcccccag

SEQ ID NO: 460487 - RNA, 64 nt, Human
gcuugucuugaacuccuggccuuaagugauccucccaccucagccuccugaguagcugggacua

SEQ ID NO: 460488 - RNA, 64 nt, Human
ugcagccgcgacuucuuaggcucaggugauccucccaccucagccucccaagcagcugggauga

SEQ ID NO: 460489 - RNA, 64 nt, Human
uucuuaccccuccccugcuuucucaaacacuugcccaccucaggcacucagcgggcuccgccgu

SEQ ID NO: 460490 - RNA, 64 nt, Human
aaauccaccgagauaaggguuuuggucacugucuccaccucaguuccucagggcuguuggccac

SEQ ID NO: 460491 - RNA, 64 nt, Human
accaugugacgugucaacagacucaaggagacaaccaccucaacugggucauguggcaugccug

SEQ ID NO: 460492 - RNA, 64 nt, Human
acacccuucucuccuuucucguccccaugcucccccaccucagugcuccgugcuguaugcgugu

SEQ ID NO: 460493 - RNA, 64 nt, Human
gcuggucgugaacuccugagcucaagugauccacccaccucagccucccagagugcuaggauua

SEQ ID NO: 460494 - RNA, 64 nt, Human
acccugggcuagagcaagcacaucuccaucucuuccaccucaggcaguguggcuccagauguca

SEQ ID NO: 460495 - RNA, 64 nt, Human
aaccuucguuugagggacugaugugaguguauguccaccucacugguggcaccgagaaacuuac

SEQ ID NO: 460496 - RNA, 64 nt, Human
cugcugaagacagacaugcagcagcgggcccgggccaccucacguuuccauaccuagugccuga

SEQ ID NO: 460497 - RNA, 64 nt, Human
gcuggucucgaacuccuggccucaagugauccacccaccucagccgcccaaaguguugggauua

SEQ ID NO: 460498 - RNA, 64 nt, Human
gcuggucucgaauuccuggauucaagugauccucccaccucagccuccuaaaguccuaggauua

SEQ ID NO: 460499 - RNA, 64 nt, Human
ugcaaccucugccuccugagcucaagugauccucccaccucagccucccaagggugugugugac

SEQ ID NO: 460500 - RNA, 64 nt, Human
gcuggucacaaacuccugaccucaggugauccacccaccucagccuccgaaagugcugggauca

SEQ ID NO: 460501 - RNA, 64 nt, Human
ugcagccuccaucuccuaggcucaagccauuuucccaccucagccucccgaguagcugggacua

SEQ ID NO: 460502 - RNA, 62 nt, Human
cuccccugcagaguggccagauggaguccugagcccuggacaugggcccggcuuuccuggau

SEQ ID NO: 460503 - RNA, 62 nt, Human
cugccucuuccucccucauuccaccuucccaugcccuggauccaucaggccacuugaugacc

SEQ ID NO: 460504 - RNA, 62 nt, Human
uaugucucugauuuuuuuuuuuccccaguauugcccuggagcugucucuggaaaguagcugg

SEQ ID NO: 460505 - RNA, 62 nt, Human
ggggucgcgcggcuuuggaaaaacaaauccuggcccuggacucgguuucccagcgcggucaa

SEQ ID NO: 460506 - RNA, 64 nt, Human
caucauguugaacuccugaccucaagugaucugcccaccucagccucccaaagugcugggauua

SEQ ID NO: 460507 - RNA, 64 nt, Human
auccuggaggaauacacaauucaucguugcacccccaccucagaguguaaucgcauuucugcuu

SEQ ID NO: 460508 - RNA, 64 nt, Human
accugaagccgagcuccuccagagcuuucuccgcccaccucacugcaucccaaguggagcuuuu

SEQ ID NO: 460509 - RNA, 64 nt, Human
gacucuagccugagcagugcagccaccuacugccccaccucagagaagugcagcgggaaggagg

SEQ ID NO: 460510 - RNA, 64 nt, Human
ccggugcaggugugaccagagaccaccucuguggccaccucagauagucaucucaguccaagga

SEQ ID NO: 460511 - RNA, 64 nt, Human
gagccggcauccuuccaucccugucgaguccccuccaccucagcucccaguccuugugcuuuuu

SEQ ID NO: 460512 - RNA, 64 nt, Human
ugcaacuuccgccuccuggguucaagugauucucccaccucagccucccaaguaggugggauua

SEQ ID NO: 460513 - RNA, 64 nt, Human
ucuucacgagcgugcaucagggcgccuggcucccccaccucagccagugagucagacacggguu

SEQ ID NO: 460514 - RNA, 64 nt, Human
ugcccuguccuggggcuggcugagggcgaacgccccaccucacuuucuagagcccugucugucc

SEQ ID NO: 460515 - RNA, 64 nt, Human
uagcucuagaaacauuuuuaagaaggagggaaucccaccucaucccauuuuuuaaguguaaaug

SEQ ID NO: 460516 - RNA, 64 nt, Human
caacuagcaccauucuugauguccagggaagaagccaccucaagacauaugaggggugcccugg

SEQ ID NO: 460517 - RNA, 64 nt, Human
gagcuuucugugcuacccacuuguuagauuccagccaccucagggauucugauccaugucauua

SEQ ID NO: 460518 - RNA, 64 nt, Human
ugaaaugaacgauccggacccucaccaacuuuccccaccucaggcagcccuguguguuuaccgu

SEQ ID NO: 460519 - RNA, 64 nt, Human
agcccagggaccacaucaaugugagaggaagccuccaccucauguuuucaaacuuaauacugga

SEQ ID NO: 460520 - RNA, 64 nt, Human
caaugccacagaccccugagcgccagacccugccccaccucacuucccucccuucccgcugagc

SEQ ID NO: 460521 - RNA, 53 nt, Human; identical to SEQ ID NO: 371999

SEQ ID NO: 460522 - RNA, 62 nt, Human
cugagcacuuugggauguauucagccuacguugcccuggaaaaggaagcaggagaugucucc

SEQ ID NO: 460523 - RNA, 62 nt, Human
caaugauuaaauugaauguguaaugugcaaaagcccuggaacgcaauuaaauacacuaguaa

SEQ ID NO: 460524 - RNA, 62 nt, Human
agacaaagccgccgccaauccugggcucuggggcccuggacuccucaccucgcgcucugccu

SEQ ID NO: 460525 - RNA, 64 nt, Human
gaggauuguaauucccaccccucuugcuucuuccccaccucaccaucucccagacccucuuccc

SEQ ID NO: 460526 - RNA, 64 nt, Human
uacagucuggagugggguccuaagaagaagggucccaccucaaccccugucaguguccacugug

SEQ ID NO: 460527 - RNA, 64 nt, Human
uguggcugucccagagugcgguuguacauccuccccaccucauaacgcagccacugaggaagag

SEQ ID NO: 460528 - RNA, 64 nt, Human
cgaguuccccuucaccgcccccagggaggguuucccaccucagaguacaccgaggggaccugca

SEQ ID NO: 460529 - RNA, 64 nt, Human
cuggguggggcaagaucccccagcccgacuagacccaccucaccugaagggggugagacccuug

SEQ ID NO: 460530 - RNA, 64 nt, Human
ccgugugccccacagggauggcucaggggacuguccaccucaccccugcaccucucagccucug

SEQ ID NO: 460531 - RNA, 64 nt, Human
cagauguuccugccuuagagucaucucuaguuccccaccucaaucccggcauccagccuucagu

SEQ ID NO: 460532 - RNA, 64 nt, Human
ccaggcugggagacagagucaggcuguugcgcucccaccucagccccaaguuccccaggcccag

SEQ ID NO: 460533 - RNA, 64 nt, Human
gcuggugcuggccgcccccagcccccuccuggugccaccucagaccccggggugagggggggcu

SEQ ID NO: 460534 - RNA, 64 nt, Human
aacagauugacccaggaaugaaucugcuacaauuccaccucauucuuucacacccagagccaga

SEQ ID NO: 460535 - RNA, 64 nt, Human
ccccugcccccagccugugugcccuguuccuugcccaccucaggccuggugguggcaguggagg

SEQ ID NO: 460536 - RNA, 64 nt, Human
cgguuugaauguugguuccaugccuggcccagccccaccucagucuccaggacauuccuuuccc

SEQ ID NO: 460537 - RNA, 54 nt, Human
aggggagggccaaggcaugaggggccaccucauccagggccccucccuugccug

SEQ ID NO: 460538 - RNA, 64 nt, Human
ugggaaaaccgaagccagcaagaccaggagagggccaccucacugggccugccucccccaccuc

SEQ ID NO: 460539 - RNA, 64 nt, Human
cggaucagguuggcacggccgccugcgugucuguccaccucaucccuccguguaucugagggag

SEQ ID NO: 460540 - RNA, 62 nt, Human
gugcgcucccacucuucuccugcucccccccugcccuggaggggaggggcgauaaauaccuu

SEQ ID NO: 460541 - RNA, 62 nt, Human
ggaugagcagaaaaugagcugagcuuagcucugcccuggaaccuaccagagcagagaagggc

SEQ ID NO: 460542 - RNA, 62 nt, Human
agcagcaagaaaggcaaguugcuccugcuggggcccuggacucugccuuagcucccaccucu

SEQ ID NO: 460543 - RNA, 62 nt, Human
ccaacacaagcuccagucuuccucuucggcaugcccuggaagcuucuuccagucuuccucuu

SEQ ID NO: 460544 - RNA, 64 nt, Human
gccgguggguguguccccgcucccgucgucccgcccaccucaaaccccgcaggugugccuccca

SEQ ID NO: 460545 - RNA, 64 nt, Human
agcucaugaugugggcgcucaaggacgucugcuuccaccucaagcgcacaggugaggccccgcu

SEQ ID NO: 460546 - RNA, 64 nt, Human
gaugcaguuccagaggauccuggacgaccccuccccaccucagccuggggaggagaagcuggca

SEQ ID NO: 460547 - RNA, 64 nt, Human
uaaaccacaggucccaccagcuccaugggagugaccaccucaguccagggaaaacagcugaaga

SEQ ID NO: 460548 - RNA, 64 nt, Human
cccaccagucagagcccugaaucucuuccuugucccaccucauuccccaccucuaccuuucuaa

SEQ ID NO: 460549 - RNA, 64 nt, Human
gcuggucucgaacuccugaccucaggugauccguccaccucagccucccaaagagcugggauua

SEQ ID NO: 460550 - RNA, 64 nt, Human
cuugcccaguggcaggggaaaggggcaccucacuccaccucaaagucauuugacugcccccauc

SEQ ID NO: 460551 - RNA, 64 nt, Human
gccuaggauggaggccuggcuuagaucuuucauuccaccucaggaaugagguugugaucuuucc

SEQ ID NO: 460552 - RNA, 64 nt, Human
acuggagcaacaaugccccugcuuccauuucuccccaccucacucucaccaagucaccagaggg

SEQ ID NO: 460553 - RNA, 64 nt, Human
ugaaaaaagaagcaugccuccuucucccucccacccaccucaagcaguugaacacagccaguua

SEQ ID NO: 460554 - RNA, 64 nt, Human
gcugcucugggaaaugagaugguuuggccaugcaccaccucagaucuccaaacugaugucccug

SEQ ID NO: 460555 - RNA, 64 nt, Human
uaaggggauuuaacaguggacuagagguaauaagccaccucagucaggauuaauaauucauuaa

SEQ ID NO: 460556 - RNA, 64 nt, Human
gcauccucugcuucccccaccacguucccaucacccaccucauugauccacugaccaaauccuu

SEQ ID NO: 460557 - RNA, 64 nt, Human
aggcuggucuugaacuccugaccucgugauccacccaccucaggaagugcugggauuacaggcg

SEQ ID NO: 460558 - RNA, 64 nt, Human
acccagggccaacaugacuaagcucucucaugacccaccucagcucagccccccagccccugcc

SEQ ID NO: 460559 - RNA, 62 nt, Human
uccucccagggguucagauguggugggguagggcccuggaagucucccaggucuucccuccc

SEQ ID NO: 460560 - RNA, 62 nt, Human
acuuggguuuuuccacugcagccacguggccagcccuggauuuuggagccuguggcugcaag

SEQ ID NO: 460561 - RNA, 62 nt, Human
gagcggagcaagugucccgggcccuucagccagcccuggauagcuacuuccaucccccgggg

SEQ ID NO: 460562 - RNA, 62 nt, Human
augaagacauccugggcagcuugggcuggcgggcccuggagcucaagccguggccggggucc

SEQ ID NO: 460563 - RNA, 64 nt, Human
aucugaagaaagcuuuuggugcuuguccucacaaccaccucaguccucccucccuguccucccc

SEQ ID NO: 460564 - RNA, 64 nt, Human
agggugcuacugaagauccagccuuagccaaucaccaccucauugggugaaaguuccagggcuc

SEQ ID NO: 460565 - RNA, 64 nt, Human
gucauagaacagcauuugacgccuagaacuaugaccaccucauggucagagaugagaauguagc

SEQ ID NO: 460566 - RNA, 64 nt, Human
uuccuuuucucuuuuuuuuuuguaaagauuaacuccaccucaccaccacaaugagguauuuuuc

SEQ ID NO: 460567 - RNA, 64 nt, Human; identical to SEQ ID NO: 459834

SEQ ID NO: 460568 - RNA, 64 nt, Human; identical to SEQ ID NO: 459835

SEQ ID NO: 460569 - RNA, 64 nt, Human; identical to SEQ ID NO: 459836

SEQ ID NO: 460570 - RNA, 64 nt, Human; identical to SEQ ID NO: 459837

SEQ ID NO: 460571 - RNA, 64 nt, Human; identical to SEQ ID NO: 459841

SEQ ID NO: 460572 - RNA, 64 nt, Human; identical to SEQ ID NO: 459842

SEQ ID NO: 460573 - RNA, 64 nt, Human; identical to SEQ ID NO: 459843

SEQ ID NO: 460574 - RNA, 64 nt, Human; identical to SEQ ID NO: 459844

SEQ ID NO: 460575 - RNA, 62 nt, Human
acagugaccugaucuccuccucaugaccuucugcccuggacaagcccccugaacuggauuug

SEQ ID NO: 460576 - RNA, 50 nt, Human; identical to SEQ ID NO: 372016

SEQ ID NO: 460577 - RNA, 62 nt, Human
aacaaaaugucaggaaucuagcaguguugucugcccuggagcaaacaaacaguaugugauuu

SEQ ID NO: 460578 - RNA, 62 nt, Human
guugggauuauaggcgugagccaccgcgcccagcccuggagugauacuuuuuauggaagaca

SEQ ID NO: 460579 - RNA, 64 nt, Human; identical to SEQ ID NO: 459845

SEQ ID NO: 460580 - RNA, 64 nt, Human; identical to SEQ ID NO: 459846

SEQ ID NO: 460581 - RNA, 64 nt, Human; identical to SEQ ID NO: 459847

SEQ ID NO: 460582 - RNA, 64 nt, Human; identical to SEQ ID NO: 459848

SEQ ID NO: 460583 - RNA, 64 nt, Human; identical to SEQ ID NO: 459849

SEQ ID NO: 460584 - RNA, 64 nt, Human; identical to SEQ ID NO: 459850

SEQ ID NO: 460585 - RNA, 64 nt, Human; identical to SEQ ID NO: 459851

SEQ ID NO: 460586 - RNA, 64 nt, Human; identical to SEQ ID NO: 459852

SEQ ID NO: 460587 - RNA, 64 nt, Human; identical to SEQ ID NO: 459853

SEQ ID NO: 460588 - RNA, 64 nt, Human; identical to SEQ ID NO: 459854

SEQ ID NO: 460589 - RNA, 64 nt, Human; identical to SEQ ID NO: 459855

SEQ ID NO: 460590 - RNA, 64 nt, Human; identical to SEQ ID NO: 459860

SEQ ID NO: 460591 - RNA, 64 nt, Human; identical to SEQ ID NO: 459861

SEQ ID NO: 460592 - RNA, 64 nt, Human; identical to SEQ ID NO: 459862

SEQ ID NO: 460593 - RNA, 64 nt, Human; identical to SEQ ID NO: 459863

SEQ ID NO: 460594 - RNA, 62 nt, Human
ggugucuguccccggcccagcgcaucuugaaggcccuggacucuguuaccaguggggggccu

SEQ ID NO: 460595 - RNA, 62 nt, Human
gggaagccucccaugccaaggaggugggaggugcccuggaaauagcugccucaugccacuua

SEQ ID NO: 460596 - RNA, 62 nt, Human
agcagcccgcgggccucggagccguuuacgcggcccuggagcgcauggggcuggacggcugc

SEQ ID NO: 460597 - RNA, 62 nt, Human
uggacuggcuggugcugggggagcugcagauggcccuggagugggcaggcaggccagggcug

SEQ ID NO: 460598 - RNA, 64 nt, Human; identical to SEQ ID NO: 459864

SEQ ID NO: 460599 - RNA, 64 nt, Human; identical to SEQ ID NO: 459865

SEQ ID NO: 460600 - RNA, 64 nt, Human; identical to SEQ ID NO: 459866

SEQ ID NO: 460601 - RNA, 64 nt, Human; identical to SEQ ID NO: 459867

SEQ ID NO: 460602 - RNA, 64 nt, Human; identical to SEQ ID NO: 459868

SEQ ID NO: 460603 - RNA, 64 nt, Human; identical to SEQ ID NO: 459869

SEQ ID NO: 460604 - RNA, 64 nt, Human; identical to SEQ ID NO: 459870

SEQ ID NO: 460605 - RNA, 64 nt, Human; identical to SEQ ID NO: 459871

SEQ ID NO: 460606 - RNA, 64 nt, Human; identical to SEQ ID NO: 459872

SEQ ID NO: 460607 - RNA, 64 nt, Human; identical to SEQ ID NO: 459873

SEQ ID NO: 460608 - RNA, 64 nt, Human; identical to SEQ ID NO: 459874

SEQ ID NO: 460609 - RNA, 64 nt, Human; identical to SEQ ID NO: 459879

SEQ ID NO: 460610 - RNA, 64 nt, Human; identical to SEQ ID NO: 459880

SEQ ID NO: 460611 - RNA, 64 nt, Human; identical to SEQ ID NO: 459881

SEQ ID NO: 460612 - RNA, 64 nt, Human; identical to SEQ ID NO: 459882

SEQ ID NO: 460613 - RNA, 62 nt, Human
gcugccagguucuguacuuguguccagcuguggcccuggaugcuggagcuggaggguuuucu

SEQ ID NO: 460614 - RNA, 62 nt, Human
cuauagaaacaccaguaccugaaagcacuguagcccuggaccugccuccuucccucggggcc

SEQ ID NO: 460615 - RNA, 62 nt, Human
gccuuugcuuaagccaucuuugugguagaggggcccuggaauugcagcuguacugaggauga

SEQ ID NO: 460616 - RNA, 62 nt, Human
ugccaaacccucagcuuauguagcuagaaagggcccuggagugagaaagccuggauuuucaa

SEQ ID NO: 460617 - RNA, 64 nt, Human; identical to SEQ ID NO: 459883

SEQ ID NO: 460618 - RNA, 64 nt, Human; identical to SEQ ID NO: 459884

SEQ ID NO: 460619 - RNA, 64 nt, Human; identical to SEQ ID NO: 459885

SEQ ID NO: 460620 - RNA, 64 nt, Human; identical to SEQ ID NO: 459886

SEQ ID NO: 460621 - RNA, 64 nt, Human; identical to SEQ ID NO: 459887

SEQ ID NO: 460622 - RNA, 64 nt, Human; identical to SEQ ID NO: 459888

SEQ ID NO: 460623 - RNA, 64 nt, Human; identical to SEQ ID NO: 459889

SEQ ID NO: 460624 - RNA, 64 nt, Human; identical to SEQ ID NO: 459890

SEQ ID NO: 460625 - RNA, 64 nt, Human; identical to SEQ ID NO: 459891

SEQ ID NO: 460626 - RNA, 64 nt, Human; identical to SEQ ID NO: 459892

SEQ ID NO: 460627 - RNA, 64 nt, Human; identical to SEQ ID NO: 459893

SEQ ID NO: 460628 - RNA, 64 nt, Human; identical to SEQ ID NO: 459898

SEQ ID NO: 460629 - RNA, 64 nt, Human; identical to SEQ ID NO: 459899

SEQ ID NO: 460630 - RNA, 64 nt, Human; identical to SEQ ID NO: 459900

SEQ ID NO: 460631 - RNA, 64 nt, Human; identical to SEQ ID NO: 459901

SEQ ID NO: 460632 - RNA, 62 nt, Human
accucugaguagcucugagguggcacuguccagcccuggauagggggggcagugggccagcu

SEQ ID NO: 460633 - RNA, 55 nt, Human; identical to SEQ ID NO: 371989

SEQ ID NO: 460634 - RNA, 62 nt, Human
accuguaccucuucucugcccuccacuucccugcccuggaguccguuucuggagacuagaaa

SEQ ID NO: 460635 - RNA, 62 nt, Human
gcuucuccgucaggaggccucaucucacuguagcccuggaacccaggguccaucuugcccuu

SEQ ID NO: 460636 - RNA, 64 nt, Human; identical to SEQ ID NO: 459902

SEQ ID NO: 460637 - RNA, 64 nt, Human; identical to SEQ ID NO: 459903

SEQ ID NO: 460638 - RNA, 64 nt, Human; identical to SEQ ID NO: 459904

SEQ ID NO: 460639 - RNA, 64 nt, Human; identical to SEQ ID NO: 459905

SEQ ID NO: 460640 - RNA, 64 nt, Human; identical to SEQ ID NO: 459906

SEQ ID NO: 460641 - RNA, 64 nt, Human; identical to SEQ ID NO: 459907

SEQ ID NO: 460642 - RNA, 64 nt, Human; identical to SEQ ID NO: 459908

SEQ ID NO: 460643 - RNA, 64 nt, Human; identical to SEQ ID NO: 459909

SEQ ID NO: 460644 - RNA, 64 nt, Human; identical to SEQ ID NO: 459910

SEQ ID NO: 460645 - RNA, 64 nt, Human; identical to SEQ ID NO: 459911

SEQ ID NO: 460646 - RNA, 64 nt, Human; identical to SEQ ID NO: 459912

SEQ ID NO: 460647 - RNA, 64 nt, Human; identical to SEQ ID NO: 459917

SEQ ID NO: 460648 - RNA, 64 nt, Human; identical to SEQ ID NO: 459918

SEQ ID NO: 460649 - RNA, 64 nt, Human; identical to SEQ ID NO: 459919

SEQ ID NO: 460650 - RNA, 64 nt, Human; identical to SEQ ID NO: 459920

SEQ ID NO: 460651 - RNA, 62 nt, Human
gcccaguucaggccucagccccucuuucccaggcccuggaucucaccagcagccaagguuga

SEQ ID NO: 460652 - RNA, 62 nt, Human
uauauccugaugguagagacagacuccaggcagcccuggacuugcuagcccaaagaaggagg

SEQ ID NO: 460653 - RNA, 62 nt, Human
auaccucaguguccacacacccaccaugcccagcccuggagccaucacuacucacaccgugg

SEQ ID NO: 460654 - RNA, 62 nt, Human
aggaguuucaucugcaugggggcacucugcaggcccuggaacauugggccugaguggagaug

SEQ ID NO: 460655 - RNA, 64 nt, Human; identical to SEQ ID NO: 459921

SEQ ID NO: 460656 - RNA, 58 nt, Human; identical to SEQ ID NO: 459922

SEQ ID NO: 460657 - RNA, 64 nt, Human; identical to SEQ ID NO: 459923

SEQ ID NO: 460658 - RNA, 54 nt, Human; identical to SEQ ID NO: 459924

SEQ ID NO: 460659 - RNA, 64 nt, Human; identical to SEQ ID NO: 459925

SEQ ID NO: 460660 - RNA, 64 nt, Human; identical to SEQ ID NO: 459926

SEQ ID NO: 460661 - RNA, 64 nt, Human; identical to SEQ ID NO: 459927

SEQ ID NO: 460662 - RNA, 64 nt, Human; identical to SEQ ID NO: 459928

SEQ ID NO: 460663 - RNA, 64 nt, Human; identical to SEQ ID NO: 459929

SEQ ID NO: 460664 - RNA, 64 nt, Human; identical to SEQ ID NO: 459930

SEQ ID NO: 460665 - RNA, 64 nt, Human; identical to SEQ ID NO: 459931

SEQ ID NO: 460666 - RNA, 64 nt, Human; identical to SEQ ID NO: 459936

SEQ ID NO: 460667 - RNA, 64 nt, Human; identical to SEQ ID NO: 459937

SEQ ID NO: 460668 - RNA, 64 nt, Human; identical to SEQ ID NO: 459938

SEQ ID NO: 460669 - RNA, 64 nt, Human; identical to SEQ ID NO: 459939

SEQ ID NO: 460670 - RNA, 62 nt, Human
gcagguguucaucgcccucauccuagguacuagcccuggauguccccauggcuucacacaca

SEQ ID NO: 460671 - RNA, 62 nt, Human
ggccugagucaccuagcauaggguugcagcaagcccuggauucagaguguuaaacagaggcu

SEQ ID NO: 460672 - RNA, 62 nt, Human
gacugggaugagggugaggggugacggguguggcccuggauguggugguuuucccuuggcca

SEQ ID NO: 460673 - RNA, 62 nt, Human
acacaggaggccuguaugacuuccugcucacagcccuggaguccuguuacgagcacauccag

SEQ ID NO: 460674 - RNA, 64 nt, Human; identical to SEQ ID NO: 459940

SEQ ID NO: 460675 - RNA, 64 nt, Human; identical to SEQ ID NO: 459941

SEQ ID NO: 460676 - RNA, 64 nt, Human; identical to SEQ ID NO: 459942

SEQ ID NO: 460677 - RNA, 64 nt, Human; identical to SEQ ID NO: 459943

SEQ ID NO: 460678 - RNA, 64 nt, Human; identical to SEQ ID NO: 459944

SEQ ID NO: 460679 - RNA, 57 nt, Human; identical to SEQ ID NO: 459945

SEQ ID NO: 460680 - RNA, 64 nt, Human; identical to SEQ ID NO: 459946

SEQ ID NO: 460681 - RNA, 64 nt, Human; identical to SEQ ID NO: 459947

SEQ ID NO: 460682 - RNA, 64 nt, Human; identical to SEQ ID NO: 459948

SEQ ID NO: 460683 - RNA, 64 nt, Human; identical to SEQ ID NO: 459949

SEQ ID NO: 460684 - RNA, 64 nt, Human; identical to SEQ ID NO: 459950

SEQ ID NO: 460685 - RNA, 58 nt, Human; identical to SEQ ID NO: 459955

SEQ ID NO: 460686 - RNA, 64 nt, Human; identical to SEQ ID NO: 459956

SEQ ID NO: 460687 - RNA, 64 nt, Human; identical to SEQ ID NO: 459957

SEQ ID NO: 460688 - RNA, 64 nt, Human; identical to SEQ ID NO: 459958

SEQ ID NO: 460689 - RNA, 62 nt, Human; identical to SEQ ID NO: 372020

SEQ ID NO: 460690 - RNA, 62 nt, Human
ugcugcgaguugccuuagagcgcaagggccaggcccuggaggaggaugaagacacagagaca

SEQ ID NO: 460691 - RNA, 62 nt, Human
gugcacucucaccccacuguaggcugagcuuggcccuggacucggaacacaccugcaguccc

SEQ ID NO: 460692 - RNA, 62 nt, Human
cggccugcuguugcuucagccuggccugggcagcccuggaagcucggaggagaggccaccuu

SEQ ID NO: 460693 - RNA, 64 nt, Human; identical to SEQ ID NO: 459959

SEQ ID NO: 460694 - RNA, 64 nt, Human; identical to SEQ ID NO: 459960

SEQ ID NO: 460695 - RNA, 64 nt, Human; identical to SEQ ID NO: 459961

SEQ ID NO: 460696 - RNA, 64 nt, Human; identical to SEQ ID NO: 459962

SEQ ID NO: 460697 - RNA, 64 nt, Human; identical to SEQ ID NO: 459963

SEQ ID NO: 460698 - RNA, 64 nt, Human; identical to SEQ ID NO: 459964

SEQ ID NO: 460699 - RNA, 64 nt, Human; identical to SEQ ID NO: 459965

SEQ ID NO: 460700 - RNA, 64 nt, Human; identical to SEQ ID NO: 459966

SEQ ID NO: 460701 - RNA, 64 nt, Human; identical to SEQ ID NO: 459967

SEQ ID NO: 460702 - RNA, 64 nt, Human; identical to SEQ ID NO: 459968

SEQ ID NO: 460703 - RNA, 64 nt, Human; identical to SEQ ID NO: 459969

SEQ ID NO: 460704 - RNA, 64 nt, Human; identical to SEQ ID NO: 459974

SEQ ID NO: 460705 - RNA, 64 nt, Human; identical to SEQ ID NO: 459975

SEQ ID NO: 460706 - RNA, 64 nt, Human; identical to SEQ ID NO: 459976

SEQ ID NO: 460707 - RNA, 64 nt, Human; identical to SEQ ID NO: 459977

SEQ ID NO: 460708 - RNA, 62 nt, Human
guugccaagaaaagggaccuaguuuagccauugcccuggagaugaaauuaauggaggcucaa

SEQ ID NO: 460709 - RNA, 62 nt, Human
gacuacugguuagccagaggagcucagcugaagcccuggaaacccucaggucugagauagga

SEQ ID NO: 460710 - RNA, 62 nt, Human
cagagccuguuggaaagcagggguagaggggagcccuggaagcagggcuuuuccggaugccu

SEQ ID NO: 460711 - RNA, 62 nt, Human
cugaacucugugggaaucacauccauacuggagcccuggauuuuugcaguucugcccuccac

SEQ ID NO: 460712 - RNA, 64 nt, Human; identical to SEQ ID NO: 459978

SEQ ID NO: 460713 - RNA, 64 nt, Human; identical to SEQ ID NO: 459979

SEQ ID NO: 460714 - RNA, 64 nt, Human; identical to SEQ ID NO: 459980

SEQ ID NO: 460715 - RNA, 64 nt, Human; identical to SEQ ID NO: 459981

SEQ ID NO: 460716 - RNA, 64 nt, Human; identical to SEQ ID NO: 459982

SEQ ID NO: 460717 - RNA, 64 nt, Human; identical to SEQ ID NO: 459983

SEQ ID NO: 460718 - RNA, 64 nt, Human; identical to SEQ ID NO: 459984

SEQ ID NO: 460719 - RNA, 64 nt, Human; identical to SEQ ID NO: 459985

SEQ ID NO: 460720 - RNA, 64 nt, Human; identical to SEQ ID NO: 459986

SEQ ID NO: 460721 - RNA, 64 nt, Human; identical to SEQ ID NO: 459987

SEQ ID NO: 460722 - RNA, 64 nt, Human; identical to SEQ ID NO: 459988

SEQ ID NO: 460723 - RNA, 64 nt, Human; identical to SEQ ID NO: 459993

SEQ ID NO: 460724 - RNA, 64 nt, Human; identical to SEQ ID NO: 459994

SEQ ID NO: 460725 - RNA, 64 nt, Human; identical to SEQ ID NO: 459995

SEQ ID NO: 460726 - RNA, 64 nt, Human; identical to SEQ ID NO: 459996

SEQ ID NO: 460727 - RNA, 62 nt, Human
ucugcugccuccuccccccaccaaguuucagggcccuggauuguucccaguucccauugugg

SEQ ID NO: 460728 - RNA, 62 nt, Human
cagcuccuagucucguccgugacuuuccgguugcccuggaucucagaauauauucguccacc

SEQ ID NO: 460729 - RNA, 62 nt, Human
ugauggugcuccccuuccugccagcgucagaggcccuggagaggggcuguccauggcagcug

SEQ ID NO: 460730 - RNA, 62 nt, Human
gaagguccccacacagagucuggauggaggcugcccuggaagcagccccgggcugggaaagg

SEQ ID NO: 460731 - RNA, 64 nt, Human; identical to SEQ ID NO: 459997

SEQ ID NO: 460732 - RNA, 64 nt, Human; identical to SEQ ID NO: 459998

SEQ ID NO: 460733 - RNA, 64 nt, Human; identical to SEQ ID NO: 459999

SEQ ID NO: 460734 - RNA, 64 nt, Human; identical to SEQ ID NO: 460000

SEQ ID NO: 460735 - RNA, 64 nt, Human; identical to SEQ ID NO: 460001

SEQ ID NO: 460736 - RNA, 64 nt, Human; identical to SEQ ID NO: 460002

SEQ ID NO: 460737 - RNA, 64 nt, Human; identical to SEQ ID NO: 460003

SEQ ID NO: 460738 - RNA, 64 nt, Human; identical to SEQ ID NO: 460004

SEQ ID NO: 460739 - RNA, 64 nt, Human; identical to SEQ ID NO: 460005

SEQ ID NO: 460740 - RNA, 64 nt, Human; identical to SEQ ID NO: 460006

SEQ ID NO: 460741 - RNA, 64 nt, Human; identical to SEQ ID NO: 460007

SEQ ID NO: 460742 - RNA, 64 nt, Human; identical to SEQ ID NO: 460012

SEQ ID NO: 460743 - RNA, 64 nt, Human; identical to SEQ ID NO: 460013

SEQ ID NO: 460744 - RNA, 64 nt, Human; identical to SEQ ID NO: 460014

SEQ ID NO: 460745 - RNA, 64 nt, Human; identical to SEQ ID NO: 460015

SEQ ID NO: 460746 - RNA, 64 nt, Human
acgucuguaaucccagcacuuugggaggcugaggcgggcggaucaccugagguugggaguucaa

SEQ ID NO: 460747 - RNA, 64 nt, Human
acaccuguaaucccagcacuuugggaggcugaggcgggcggaacaccugaggucagguguucga

SEQ ID NO: 460748 - RNA, 64 nt, Human
cgacaccacuggccccggaugccucugccccucccgggcggaccuccugaggccuggaccccca

SEQ ID NO: 460749 - RNA, 64 nt, Human; identical to SEQ ID NO: 460016

SEQ ID NO: 460750 - RNA, 64 nt, Human; identical to SEQ ID NO: 460017

SEQ ID NO: 460751 - RNA, 64 nt, Human; identical to SEQ ID NO: 460018

SEQ ID NO: 460752 - RNA, 64 nt, Human; identical to SEQ ID NO: 460019

SEQ ID NO: 460753 - RNA, 64 nt, Human; identical to SEQ ID NO: 460020

SEQ ID NO: 460754 - RNA, 64 nt, Human; identical to SEQ ID NO: 460021

SEQ ID NO: 460755 - RNA, 64 nt, Human; identical to SEQ ID NO: 460022

SEQ ID NO: 460756 - RNA, 64 nt, Human; identical to SEQ ID NO: 460023

SEQ ID NO: 460757 - RNA, 52 nt, Human; identical to SEQ ID NO: 460024

SEQ ID NO: 460758 - RNA, 64 nt, Human; identical to SEQ ID NO: 460025

SEQ ID NO: 460759 - RNA, 64 nt, Human; identical to SEQ ID NO: 460026

SEQ ID NO: 460760 - RNA, 64 nt, Human; identical to SEQ ID NO: 460031

SEQ ID NO: 460761 - RNA, 64 nt, Human; identical to SEQ ID NO: 460032

SEQ ID NO: 460762 - RNA, 64 nt, Human; identical to SEQ ID NO: 460033

SEQ ID NO: 460763 - RNA, 64 nt, Human; identical to SEQ ID NO: 460034

SEQ ID NO: 460764 - RNA, 64 nt, Human
accccugucaucccagcacuuugagaggccaaggcgggcggaucacuggaggucaggaguuuaa

SEQ ID NO: 460765 - RNA, 64 nt, Human
augccuguaaucccagcacuuugggaggccgaggcgggcggaucacgaggucaggagaucgaga

SEQ ID NO: 460766 - RNA, 64 nt, Human
cugcgccggccuccgucaugaaugccuuccgggccgggcggaaggggacgcgggcugugccuua

SEQ ID NO: 460767 - RNA, 64 nt, Human; identical to SEQ ID NO: 460035

SEQ ID NO: 460768 - RNA, 64 nt, Human; identical to SEQ ID NO: 460036

SEQ ID NO: 460769 - RNA, 64 nt, Human; identical to SEQ ID NO: 460037

SEQ ID NO: 460770 - RNA, 64 nt, Human; identical to SEQ ID NO: 460038

SEQ ID NO: 460771 - RNA, 64 nt, Human; identical to SEQ ID NO: 460039

SEQ ID NO: 460772 - RNA, 64 nt, Human; identical to SEQ ID NO: 460040

SEQ ID NO: 460773 - RNA, 64 nt, Human; identical to SEQ ID NO: 460041

SEQ ID NO: 460774 - RNA, 64 nt, Human; identical to SEQ ID NO: 460042

SEQ ID NO: 460775 - RNA, 64 nt, Human; identical to SEQ ID NO: 460043

SEQ ID NO: 460776 - RNA, 64 nt, Human; identical to SEQ ID NO: 460044

SEQ ID NO: 460777 - RNA, 64 nt, Human; identical to SEQ ID NO: 460045

SEQ ID NO: 460778 - RNA, 64 nt, Human; identical to SEQ ID NO: 460050

SEQ ID NO: 460779 - RNA, 64 nt, Human; identical to SEQ ID NO: 460051

SEQ ID NO: 460780 - RNA, 64 nt, Human; identical to SEQ ID NO: 460052

SEQ ID NO: 460781 - RNA, 64 nt, Human; identical to SEQ ID NO: 460053

SEQ ID NO: 460782 - RNA, 64 nt, Human
acgccuguaauccuagcaccuugggaggccgaggcgggcggaucacuugaggucaggaguucca

SEQ ID NO: 460783 - RNA, 64 nt, Human
augccuguaaucccagcacuaugggaggccgagacgggcggaucacgaggucaggagacugaga

SEQ ID NO: 460784 - RNA, 64 nt, Human
gaucccuaacagggcggcuucccagggcugcaggcgggcggagguuccaggagaugggacuuca

SEQ ID NO: 460785 - RNA, 64 nt, Human; identical to SEQ ID NO: 460054

SEQ ID NO: 460786 - RNA, 64 nt, Human; identical to SEQ ID NO: 460055

SEQ ID NO: 460787 - RNA, 64 nt, Human; identical to SEQ ID NO: 460056

SEQ ID NO: 460788 - RNA, 64 nt, Human; identical to SEQ ID NO: 460057

SEQ ID NO: 460789 - RNA, 64 nt, Human; identical to SEQ ID NO: 460058

SEQ ID NO: 460790 - RNA, 64 nt, Human; identical to SEQ ID NO: 460059

SEQ ID NO: 460791 - RNA, 64 nt, Human; identical to SEQ ID NO: 460060

SEQ ID NO: 460792 - RNA, 64 nt, Human; identical to SEQ ID NO: 460061

SEQ ID NO: 460793 - RNA, 64 nt, Human; identical to SEQ ID NO: 460062

SEQ ID NO: 460794 - RNA, 64 nt, Human; identical to SEQ ID NO: 460063

SEQ ID NO: 460795 - RNA, 64 nt, Human; identical to SEQ ID NO: 460064

SEQ ID NO: 460796 - RNA, 64 nt, Human; identical to SEQ ID NO: 460069

SEQ ID NO: 460797 - RNA, 64 nt, Human; identical to SEQ ID NO: 460070

SEQ ID NO: 460798 - RNA, 64 nt, Human; identical to SEQ ID NO: 460071

SEQ ID NO: 460799 - RNA, 64 nt, Human; identical to SEQ ID NO: 460072

SEQ ID NO: 460800 - RNA, 64 nt, Human
acgccuguaaucccagcacuuugggaggccgaggcgggcggaucaauaggucaggaaauccaga

SEQ ID NO: 460801 - RNA, 64 nt, Human
uucagaccguucuccuguaaguucauuacaaacacgggcggaaggcacucaggcuuucguugga

SEQ ID NO: 460802 - RNA, 64 nt, Human
acgccugcaaucccagcacuuugggagacugaggcgggcggaucaugaggucaggagaucgcga

SEQ ID NO: 460803 - RNA, 64 nt, Human; identical to SEQ ID NO: 460073

SEQ ID NO: 460804 - RNA, 64 nt, Human; identical to SEQ ID NO: 460074

SEQ ID NO: 460805 - RNA, 64 nt, Human; identical to SEQ ID NO: 460075

SEQ ID NO: 460806 - RNA, 64 nt, Human; identical to SEQ ID NO: 460076

SEQ ID NO: 460807 - RNA, 64 nt, Human; identical to SEQ ID NO: 460077

SEQ ID NO: 460808 - RNA, 64 nt, Human; identical to SEQ ID NO: 460078

SEQ ID NO: 460809 - RNA, 64 nt, Human; identical to SEQ ID NO: 460079

SEQ ID NO: 460810 - RNA, 64 nt, Human; identical to SEQ ID NO: 460080

SEQ ID NO: 460811 - RNA, 64 nt, Human; identical to SEQ ID NO: 460081

SEQ ID NO: 460812 - RNA, 64 nt, Human; identical to SEQ ID NO: 460082

SEQ ID NO: 460813 - RNA, 64 nt, Human; identical to SEQ ID NO: 460083

SEQ ID NO: 460814 - RNA, 64 nt, Human; identical to SEQ ID NO: 460088

SEQ ID NO: 460815 - RNA, 64 nt, Human; identical to SEQ ID NO: 460089

SEQ ID NO: 460816 - RNA, 64 nt, Human; identical to SEQ ID NO: 460090

SEQ ID NO: 460817 - RNA, 64 nt, Human; identical to SEQ ID NO: 460091

SEQ ID NO: 460818 - RNA, 63 nt, Human
acgcauguaaucccagcacuuugggaggccaaggcgggcggaucacgaggucaggaguucgag

SEQ ID NO: 460819 - RNA, 64 nt, Human
augccuguaauccgagcacuuugggaggccaaggcgggcggaucacgaggucaggagaucgaga

SEQ ID NO: 460820 - RNA, 64 nt, Human
acgccuguaaucccagcacuuugggaggccgaggcgggcggaucacgaggucaggaguucgaga

SEQ ID NO: 460821 - RNA, 64 nt, Human; identical to SEQ ID NO: 460092

SEQ ID NO: 460822 - RNA, 64 nt, Human; identical to SEQ ID NO: 460093

SEQ ID NO: 460823 - RNA, 64 nt, Human; identical to SEQ ID NO: 460094

SEQ ID NO: 460824 - RNA, 64 nt, Human; identical to SEQ ID NO: 460095

SEQ ID NO: 460825 - RNA, 64 nt, Human; identical to SEQ ID NO: 460096

SEQ ID NO: 460826 - RNA, 64 nt, Human; identical to SEQ ID NO: 460097

SEQ ID NO: 460827 - RNA, 64 nt, Human; identical to SEQ ID NO: 460098

SEQ ID NO: 460828 - RNA, 64 nt, Human; identical to SEQ ID NO: 460099

SEQ ID NO: 460829 - RNA, 64 nt, Human; identical to SEQ ID NO: 460100

SEQ ID NO: 460830 - RNA, 64 nt, Human; identical to SEQ ID NO: 460101

SEQ ID NO: 460831 - RNA, 64 nt, Human; identical to SEQ ID NO: 460102

SEQ ID NO: 460832 - RNA, 64 nt, Human; identical to SEQ ID NO: 460107

SEQ ID NO: 460833 - RNA, 64 nt, Human; identical to SEQ ID NO: 460108

SEQ ID NO: 460834 - RNA, 64 nt, Human; identical to SEQ ID NO: 460109

SEQ ID NO: 460835 - RNA, 64 nt, Human; identical to SEQ ID NO: 460110

SEQ ID NO: 460836 - RNA, 64 nt, Human
gcccuucagugcccugccuguacucgagcggcuccgggcggagaacaagucggcugugaguuuc

SEQ ID NO: 460837 - RNA, 64 nt, Human
agggaggccagaccaagggaggcacgcgcgcugccgggcggacagaggcugaggcucacacccc

SEQ ID NO: 460838 - RNA, 62 nt, Human
ugucuuucccagggugaugcaagcaugccgcagcccuggaggcugggaauguggaggcucug

SEQ ID NO: 460839 - RNA, 62 nt, Human
agggugagcuggugccugcuuugacgggccaggcccuggagggcagagacaaucacgggcgg

SEQ ID NO: 460840 - RNA, 64 nt, Human; identical to SEQ ID NO: 460111

SEQ ID NO: 460841 - RNA, 64 nt, Human; identical to SEQ ID NO: 460112

SEQ ID NO: 460842 - RNA, 64 nt, Human; identical to SEQ ID NO: 460113

SEQ ID NO: 460843 - RNA, 64 nt, Human; identical to SEQ ID NO: 460114

SEQ ID NO: 460844 - RNA, 64 nt, Human; identical to SEQ ID NO: 460115

SEQ ID NO: 460845 - RNA, 64 nt, Human; identical to SEQ ID NO: 460116

SEQ ID NO: 460846 - RNA, 64 nt, Human; identical to SEQ ID NO: 460117

SEQ ID NO: 460847 - RNA, 64 nt, Human; identical to SEQ ID NO: 460118

SEQ ID NO: 460848 - RNA, 64 nt, Human; identical to SEQ ID NO: 460119

SEQ ID NO: 460849 - RNA, 64 nt, Human; identical to SEQ ID NO: 460120

SEQ ID NO: 460850 - RNA, 64 nt, Human; identical to SEQ ID NO: 460121

SEQ ID NO: 460851 - RNA, 64 nt, Human; identical to SEQ ID NO: 460126

SEQ ID NO: 460852 - RNA, 64 nt, Human; identical to SEQ ID NO: 460127

SEQ ID NO: 460853 - RNA, 64 nt, Human; identical to SEQ ID NO: 460128

SEQ ID NO: 460854 - RNA, 64 nt, Human; identical to SEQ ID NO: 460129

SEQ ID NO: 460855 - RNA, 62 nt, Human
ucuccauauuaguuaacaagaggugucuuuaggcccuggauguuaccaucucauuuggucaa

SEQ ID NO: 460856 - RNA, 62 nt, Human
agugagguccucauucuccagccagccucucugcccuggagaaucaugugcuauguucuaag

SEQ ID NO: 460857 - RNA, 62 nt, Human
uggugcugcugagugagccggccugugcccaugcccuggaggcuuuggcuacucuccugcgc

SEQ ID NO: 460858 - RNA, 62 nt, Human
gaugcuccccaugcugccacuauuuauugugagcccuggaggcucccaugugcuugaggaag

SEQ ID NO: 460859 - RNA, 64 nt, Human; identical to SEQ ID NO: 460130

SEQ ID NO: 460860 - RNA, 64 nt, Human; identical to SEQ ID NO: 460131

SEQ ID NO: 460861 - RNA, 64 nt, Human; identical to SEQ ID NO: 460132

SEQ ID NO: 460862 - RNA, 64 nt, Human; identical to SEQ ID NO: 460133

SEQ ID NO: 460863 - RNA, 64 nt, Human; identical to SEQ ID NO: 460134

SEQ ID NO: 460864 - RNA, 64 nt, Human; identical to SEQ ID NO: 460135

SEQ ID NO: 460865 - RNA, 64 nt, Human; identical to SEQ ID NO: 460136

SEQ ID NO: 460866 - RNA, 64 nt, Human; identical to SEQ ID NO: 460137

SEQ ID NO: 460867 - RNA, 64 nt, Human; identical to SEQ ID NO: 460138

SEQ ID NO: 460868 - RNA, 64 nt, Human; identical to SEQ ID NO: 460139

SEQ ID NO: 460869 - RNA, 64 nt, Human; identical to SEQ ID NO: 460140

SEQ ID NO: 460870 - RNA, 64 nt, Human; identical to SEQ ID NO: 460145

SEQ ID NO: 460871 - RNA, 64 nt, Human; identical to SEQ ID NO: 460146

SEQ ID NO: 460872 - RNA, 64 nt, Human; identical to SEQ ID NO: 460147

SEQ ID NO: 460873 - RNA, 64 nt, Human; identical to SEQ ID NO: 460148

SEQ ID NO: 460874 - RNA, 62 nt, Human
ucugaaaggguggccacagccccacguggugugcccuggaggcuuagguuggucugagguug

SEQ ID NO: 460875 - RNA, 62 nt, Human
ccucaucacaggcuaaagaagagcaguagacagcccuggacacucugaagcagaggcaagac

SEQ ID NO: 460876 - RNA, 62 nt, Human
ccaggaguuugugugucuuuuauaaaaaguuugcccuggaugucauauuggcaguuggagga

SEQ ID NO: 460877 - RNA, 62 nt, Human
augagucccaggggcacuggucagccuguggagcccuggaugcuauccacacccaccuaucc

SEQ ID NO: 460878 - RNA, 64 nt, Human; identical to SEQ ID NO: 460149

SEQ ID NO: 460879 - RNA, 64 nt, Human; identical to SEQ ID NO: 460150

SEQ ID NO: 460880 - RNA, 64 nt, Human; identical to SEQ ID NO: 460151

SEQ ID NO: 460881 - RNA, 64 nt, Human; identical to SEQ ID NO: 460152

SEQ ID NO: 460882 - RNA, 64 nt, Human; identical to SEQ ID NO: 460153

SEQ ID NO: 460883 - RNA, 64 nt, Human; identical to SEQ ID NO: 460154

SEQ ID NO: 460884 - RNA, 64 nt, Human; identical to SEQ ID NO: 460155

SEQ ID NO: 460885 - RNA, 64 nt, Human; identical to SEQ ID NO: 460156

SEQ ID NO: 460886 - RNA, 64 nt, Human; identical to SEQ ID NO: 460157

SEQ ID NO: 460887 - RNA, 64 nt, Human; identical to SEQ ID NO: 460158

SEQ ID NO: 460888 - RNA, 64 nt, Human; identical to SEQ ID NO: 460159

SEQ ID NO: 460889 - RNA, 64 nt, Human; identical to SEQ ID NO: 460164

SEQ ID NO: 460890 - RNA, 64 nt, Human; identical to SEQ ID NO: 460165

SEQ ID NO: 460891 - RNA, 64 nt, Human; identical to SEQ ID NO: 460166

SEQ ID NO: 460892 - RNA, 64 nt, Human; identical to SEQ ID NO: 460167

SEQ ID NO: 460893 - RNA, 62 nt, Human
ugacagaaucaaggcgccaggaugggcacucugcccuggauacaggcucuacccuccucccc

SEQ ID NO: 460894 - RNA, 62 nt, Human
cucugcugcugaagaggcggaagaaagcucgggcccuggaggcugcggcucuggcccacuga

SEQ ID NO: 460895 - RNA, 62 nt, Human
gaagugggugcaggaagguggcagugaccagcgcccuggaccaugcaguucggcggccgcgg

SEQ ID NO: 460896 - RNA, 62 nt, Human
uuccuucuagaaagugcuuggggguuuuugcugcccuggaagccaggagccugcucacucca

SEQ ID NO: 460897 - RNA, 64 nt, Human; identical to SEQ ID NO: 460168

SEQ ID NO: 460898 - RNA, 64 nt, Human; identical to SEQ ID NO: 460169

SEQ ID NO: 460899 - RNA, 54 nt, Human; identical to SEQ ID NO: 460170

SEQ ID NO: 460900 - RNA, 64 nt, Human; identical to SEQ ID NO: 460171

SEQ ID NO: 460901 - RNA, 64 nt, Human; identical to SEQ ID NO: 460172

SEQ ID NO: 460902 - RNA, 64 nt, Human; identical to SEQ ID NO: 460173

SEQ ID NO: 460903 - RNA, 64 nt, Human; identical to SEQ ID NO: 460174

SEQ ID NO: 460904 - RNA, 64 nt, Human; identical to SEQ ID NO: 460175

SEQ ID NO: 460905 - RNA, 64 nt, Human; identical to SEQ ID NO: 460176

SEQ ID NO: 460906 - RNA, 64 nt, Human; identical to SEQ ID NO: 460177

SEQ ID NO: 460907 - RNA, 64 nt, Human; identical to SEQ ID NO: 460178

SEQ ID NO: 460908 - RNA, 64 nt, Human; identical to SEQ ID NO: 460183

SEQ ID NO: 460909 - RNA, 64 nt, Human; identical to SEQ ID NO: 460184

SEQ ID NO: 460910 - RNA, 64 nt, Human; identical to SEQ ID NO: 460185

SEQ ID NO: 460911 - RNA, 64 nt, Human; identical to SEQ ID NO: 460186

SEQ ID NO: 460912 - RNA, 62 nt, Human
gugaguucuccaaggcccaugaggauaugacugcccuggagaaggauuacaaggaggugggc

SEQ ID NO: 460913 - RNA, 62 nt, Human
caaggaugcaggucuggaaaaugauaucggaggcccuggaguuugugagcuuggcucuaguc

SEQ ID NO: 460914 - RNA, 62 nt, Human
agcucuccagcuccaagaccuguugguuccaagcccuggagccaacugcugcuuuuugaggu

SEQ ID NO: 460915 - RNA, 62 nt, Human
ccccagggcuggaaggagaccaaggggcagccgcccuggagggacaucagugcuuccucuuc

SEQ ID NO: 460916 - RNA, 64 nt, Human; identical to SEQ ID NO: 460187

SEQ ID NO: 460917 - RNA, 64 nt, Human; identical to SEQ ID NO: 460188

SEQ ID NO: 460918 - RNA, 64 nt, Human; identical to SEQ ID NO: 460189

SEQ ID NO: 460919 - RNA, 64 nt, Human; identical to SEQ ID NO: 460190

SEQ ID NO: 460920 - RNA, 64 nt, Human; identical to SEQ ID NO: 460191

SEQ ID NO: 460921 - RNA, 64 nt, Human; identical to SEQ ID NO: 460192

SEQ ID NO: 460922 - RNA, 64 nt, Human; identical to SEQ ID NO: 460193

SEQ ID NO: 460923 - RNA, 64 nt, Human; identical to SEQ ID NO: 460194

SEQ ID NO: 460924 - RNA, 64 nt, Human; identical to SEQ ID NO: 460195

SEQ ID NO: 460925 - RNA, 64 nt, Human; identical to SEQ ID NO: 460196

SEQ ID NO: 460926 - RNA, 64 nt, Human; identical to SEQ ID NO: 460197

SEQ ID NO: 460927 - RNA, 64 nt, Human; identical to SEQ ID NO: 460202

SEQ ID NO: 460928 - RNA, 64 nt, Human; identical to SEQ ID NO: 460203

SEQ ID NO: 460929 - RNA, 64 nt, Human; identical to SEQ ID NO: 460204

SEQ ID NO: 460930 - RNA, 64 nt, Human; identical to SEQ ID NO: 460205

SEQ ID NO: 460931 - RNA, 62 nt, Human
ugucaugaagugcacaggagccaaaugaccgagcccuggagagccccaugguggguaggugg

SEQ ID NO: 460932 - RNA, 62 nt, Human
cucgccaauaauucuugucuuugaguguuggagcccuggauucuggugcuauagcuccuggu

SEQ ID NO: 460933 - RNA, 62 nt, Human
gccugcucuccagccucuggcaggaacucagggcccuggagcugcuggggccaagccaaggc

SEQ ID NO: 460934 - RNA, 62 nt, Human
acgugcuuugaaacuuuuccccucacccuccagcccuggaggcuuuugcugggaugaauguu

SEQ ID NO: 460935 - RNA, 64 nt, Human; identical to SEQ ID NO: 460206

SEQ ID NO: 460936 - RNA, 64 nt, Human; identical to SEQ ID NO: 460207

SEQ ID NO: 460937 - RNA, 64 nt, Human; identical to SEQ ID NO: 460208

SEQ ID NO: 460938 - RNA, 64 nt, Human; identical to SEQ ID NO: 460209

SEQ ID NO: 460939 - RNA, 64 nt, Human; identical to SEQ ID NO: 460210

SEQ ID NO: 460940 - RNA, 64 nt, Human; identical to SEQ ID NO: 460211

SEQ ID NO: 460941 - RNA, 64 nt, Human; identical to SEQ ID NO: 460212

SEQ ID NO: 460942 - RNA, 64 nt, Human; identical to SEQ ID NO: 460213

SEQ ID NO: 460943 - RNA, 64 nt, Human; identical to SEQ ID NO: 460214

SEQ ID NO: 460944 - RNA, 64 nt, Human; identical to SEQ ID NO: 460215

SEQ ID NO: 460945 - RNA, 64 nt, Human; identical to SEQ ID NO: 460216

SEQ ID NO: 460946 - RNA, 64 nt, Human; identical to SEQ ID NO: 460221

SEQ ID NO: 460947 - RNA, 64 nt, Human; identical to SEQ ID NO: 460222

SEQ ID NO: 460948 - RNA, 64 nt, Human; identical to SEQ ID NO: 460223

SEQ ID NO: 460949 - RNA, 64 nt, Human; identical to SEQ ID NO: 460224

SEQ ID NO: 460950 - RNA, 62 nt, Human
ccgugcagccacgaacacgcaugccucagccagcccuggaggcuggauggcuccccugaggc

SEQ ID NO: 460951 - RNA, 62 nt, Human
gggccuucacagccuccauccuuagcuuuggcgcccuggacccacuuucucucucaaacugu

SEQ ID NO: 460952 - RNA, 62 nt, Human
gcacuuaccugaagucaguggccuggaucauagcccuggaucauuucccagucuguccugug

SEQ ID NO: 460953 - RNA, 62 nt, Human
agauucuacacuagcguccuguugggaauuaugcccuggaauucugccugaauugaccuacg

SEQ ID NO: 460954 - RNA, 64 nt, Human; identical to SEQ ID NO: 460225

SEQ ID NO: 460955 - RNA, 64 nt, Human; identical to SEQ ID NO: 460226

SEQ ID NO: 460956 - RNA, 64 nt, Human; identical to SEQ ID NO: 460227

SEQ ID NO: 460957 - RNA, 64 nt, Human; identical to SEQ ID NO: 460228

SEQ ID NO: 460958 - RNA, 64 nt, Human; identical to SEQ ID NO: 460229

SEQ ID NO: 460959 - RNA, 64 nt, Human; identical to SEQ ID NO: 460230

SEQ ID NO: 460960 - RNA, 64 nt, Human; identical to SEQ ID NO: 460231

SEQ ID NO: 460961 - RNA, 64 nt, Human; identical to SEQ ID NO: 460232

SEQ ID NO: 460962 - RNA, 64 nt, Human; identical to SEQ ID NO: 460233

SEQ ID NO: 460963 - RNA, 64 nt, Human; identical to SEQ ID NO: 460234

SEQ ID NO: 460964 - RNA, 64 nt, Human; identical to SEQ ID NO: 460235

SEQ ID NO: 460965 - RNA, 64 nt, Human; identical to SEQ ID NO: 460240

SEQ ID NO: 460966 - RNA, 64 nt, Human; identical to SEQ ID NO: 460241

SEQ ID NO: 460967 - RNA, 64 nt, Human; identical to SEQ ID NO: 460242

SEQ ID NO: 460968 - RNA, 64 nt, Human; identical to SEQ ID NO: 460243

SEQ ID NO: 460969 - RNA, 62 nt, Human
accaacaaagaguaccuaggaaugggaguugagcccuggaauggggcucuauggagaggugc

SEQ ID NO: 460970 - RNA, 62 nt, Human
caaugcacucagaaagaaauccaguuuccauggcccuggauggucuggcccaccuccagccu

SEQ ID NO: 460971 - RNA, 62 nt, Human
ccgcuggcuaacaucugcucuugguuucugcugcccuggagccugacccucagucuccauuc

SEQ ID NO: 460972 - RNA, 62 nt, Human
ugcggacugugaagaaucacaaugcucuauaugcccuggacuguguggcaaaugcagguugc

SEQ ID NO: 460973 - RNA, 64 nt, Human; identical to SEQ ID NO: 460244

SEQ ID NO: 460974 - RNA, 64 nt, Human; identical to SEQ ID NO: 460245

SEQ ID NO: 460975 - RNA, 63 nt, Human; identical to SEQ ID NO: 460246

SEQ ID NO: 460976 - RNA, 64 nt, Human; identical to SEQ ID NO: 460247

SEQ ID NO: 460977 - RNA, 64 nt, Human; identical to SEQ ID NO: 460248

SEQ ID NO: 460978 - RNA, 64 nt, Human; identical to SEQ ID NO: 460249

SEQ ID NO: 460979 - RNA, 64 nt, Human; identical to SEQ ID NO: 460250

SEQ ID NO: 460980 - RNA, 64 nt, Human; identical to SEQ ID NO: 460251

SEQ ID NO: 460981 - RNA, 64 nt, Human; identical to SEQ ID NO: 460252

SEQ ID NO: 460982 - RNA, 64 nt, Human; identical to SEQ ID NO: 460253

SEQ ID NO: 460983 - RNA, 63 nt, Human; identical to SEQ ID NO: 460254

SEQ ID NO: 460984 - RNA, 64 nt, Human; identical to SEQ ID NO: 460259

SEQ ID NO: 460985 - RNA, 64 nt, Human; identical to SEQ ID NO: 460260

SEQ ID NO: 460986 - RNA, 64 nt, Human; identical to SEQ ID NO: 460261

SEQ ID NO: 460987 - RNA, 64 nt, Human; identical to SEQ ID NO: 460262

SEQ ID NO: 460988 - RNA, 64 nt, Human
acgccuguaaucccaacacuuugggaggcccaggcgggcggaucacgaggucaggagaucgaga

SEQ ID NO: 460989 - RNA, 64 nt, Human
acgccuguaaucccagcacuuugggaggccgaggcgggcggaucacgaggucaggagaucgaga

SEQ ID NO: 460990 - RNA, 64 nt, Human
augccuguaaucccagcacguugggaggccaagucgggcggaucacaaggucaggagaucaagg

SEQ ID NO: 460991 - RNA, 64 nt, Human; identical to SEQ ID NO: 460263

SEQ ID NO: 460992 - RNA, 64 nt, Human; identical to SEQ ID NO: 460264

SEQ ID NO: 460993 - RNA, 64 nt, Human; identical to SEQ ID NO: 460265

SEQ ID NO: 460994 - RNA, 64 nt, Human; identical to SEQ ID NO: 460266

SEQ ID NO: 460995 - RNA, 64 nt, Human; identical to SEQ ID NO: 460267

SEQ ID NO: 460996 - RNA, 64 nt, Human; identical to SEQ ID NO: 460268

SEQ ID NO: 460997 - RNA, 64 nt, Human; identical to SEQ ID NO: 460269

SEQ ID NO: 460998 - RNA, 64 nt, Human; identical to SEQ ID NO: 460270

SEQ ID NO: 460999 - RNA, 64 nt, Human; identical to SEQ ID NO: 460271

SEQ ID NO: 461000 - RNA, 64 nt, Human; identical to SEQ ID NO: 460272

SEQ ID NO: 461001 - RNA, 64 nt, Human; identical to SEQ ID NO: 460273

SEQ ID NO: 461002 - RNA, 64 nt, Human; identical to SEQ ID NO: 460278

SEQ ID NO: 461003 - RNA, 64 nt, Human; identical to SEQ ID NO: 460279

SEQ ID NO: 461004 - RNA, 64 nt, Human; identical to SEQ ID NO: 460280

SEQ ID NO: 461005 - RNA, 64 nt, Human; identical to SEQ ID NO: 460281

SEQ ID NO: 461006 - RNA, 64 nt, Human
acgccuguaaucccagcacuuugggaggccaaggcgggcggaucaugaggucaggagaucgaga

SEQ ID NO: 461007 - RNA, 64 nt, Human
aagccuguaaucccagcacuuugggaggccgaggcgggcggaucaugaggucaggaguucgaga

SEQ ID NO: 461008 - RNA, 64 nt, Human
acgccuguaaucccagcacuuugggaggccgaggcgggcggaucaugaggucaggagaucgaga

SEQ ID NO: 461009 - RNA, 64 nt, Human; identical to SEQ ID NO: 460282

SEQ ID NO: 461010 - RNA, 64 nt, Human; identical to SEQ ID NO: 460283

SEQ ID NO: 461011 - RNA, 64 nt, Human; identical to SEQ ID NO: 460284

SEQ ID NO: 461012 - RNA, 64 nt, Human; identical to SEQ ID NO: 460285

SEQ ID NO: 461013 - RNA, 64 nt, Human; identical to SEQ ID NO: 460286

SEQ ID NO: 461014 - RNA, 64 nt, Human; identical to SEQ ID NO: 460287

SEQ ID NO: 461015 - RNA, 64 nt, Human; identical to SEQ ID NO: 460288

SEQ ID NO: 461016 - RNA, 64 nt, Human; identical to SEQ ID NO: 460289

SEQ ID NO: 461017 - RNA, 64 nt, Human; identical to SEQ ID NO: 460290

SEQ ID NO: 461018 - RNA, 64 nt, Human; identical to SEQ ID NO: 460291

SEQ ID NO: 461019 - RNA, 64 nt, Human; identical to SEQ ID NO: 460292

SEQ ID NO: 461020 - RNA, 64 nt, Human; identical to SEQ ID NO: 460297

SEQ ID NO: 461021 - RNA, 64 nt, Human; identical to SEQ ID NO: 460298

SEQ ID NO: 461022 - RNA, 64 nt, Human; identical to SEQ ID NO: 460299

SEQ ID NO: 461023 - RNA, 64 nt, Human; identical to SEQ ID NO: 460300

SEQ ID NO: 461024 - RNA, 64 nt, Human
agaauacuucuggcagcacuuugggaggccaaggcgggcggaucacgaggucaggagaucgaga

SEQ ID NO: 461025 - RNA, 64 nt, Human
gccuccggugcuguaaaacgcaggcgcugggccgcgggcggagcugaggacaggccuuggcugg

SEQ ID NO: 461026 - RNA, 64 nt, Human
acgccgguaaucccagcacuuugggaggccgaggcgggcggaucacgaggucaggagaucgaga

SEQ ID NO: 461027 - RNA, 64 nt, Human; identical to SEQ ID NO: 460301

SEQ ID NO: 461028 - RNA, 64 nt, Human; identical to SEQ ID NO: 460302

SEQ ID NO: 461029 - RNA, 64 nt, Human; identical to SEQ ID NO: 460303

SEQ ID NO: 461030 - RNA, 64 nt, Human; identical to SEQ ID NO: 460304

SEQ ID NO: 461031 - RNA, 64 nt, Human; identical to SEQ ID NO: 460305

SEQ ID NO: 461032 - RNA, 64 nt, Human; identical to SEQ ID NO: 460306

SEQ ID NO: 461033 - RNA, 64 nt, Human; identical to SEQ ID NO: 460307

SEQ ID NO: 461034 - RNA, 64 nt, Human; identical to SEQ ID NO: 460308

SEQ ID NO: 461035 - RNA, 64 nt, Human; identical to SEQ ID NO: 460309

SEQ ID NO: 461036 - RNA, 51 nt, Human; identical to SEQ ID NO: 460310

SEQ ID NO: 461037 - RNA, 64 nt, Human; identical to SEQ ID NO: 460311

SEQ ID NO: 461038 - RNA, 64 nt, Human; identical to SEQ ID NO: 460316

SEQ ID NO: 461039 - RNA, 64 nt, Human; identical to SEQ ID NO: 460317

SEQ ID NO: 461040 - RNA, 64 nt, Human; identical to SEQ ID NO: 460318

SEQ ID NO: 461041 - RNA, 64 nt, Human; identical to SEQ ID NO: 460319

SEQ ID NO: 461042 - RNA, 62 nt, Human
gagagugggaggagggcacguaccgggugccagcccuggagcccucagggagacagacacag

SEQ ID NO: 461043 - RNA, 62 nt, Human
agagacagcccuggcugcuuuccuuuccuacugcccuggaauggguguugcucuuaggaugu

SEQ ID NO: 461044 - RNA, 62 nt, Human
uauuuguuuucugugagagcacugaaauggcagcccuggaaucuacaauuuggcucuccacu

SEQ ID NO: 461045 - RNA, 62 nt, Human
gaacugucgcucaccuguggcugacacacccagcccuggaaacggggccccagacgccacgu

SEQ ID NO: 461046 - RNA, 64 nt, Human; identical to SEQ ID NO: 460320

SEQ ID NO: 461047 - RNA, 64 nt, Human; identical to SEQ ID NO: 460321

SEQ ID NO: 461048 - RNA, 64 nt, Human; identical to SEQ ID NO: 460322

SEQ ID NO: 461049 - RNA, 64 nt, Human; identical to SEQ ID NO: 460323

SEQ ID NO: 461050 - RNA, 64 nt, Human; identical to SEQ ID NO: 460324

SEQ ID NO: 461051 - RNA, 64 nt, Human; identical to SEQ ID NO: 460325

SEQ ID NO: 461052 - RNA, 64 nt, Human; identical to SEQ ID NO: 460326

SEQ ID NO: 461053 - RNA, 64 nt, Human; identical to SEQ ID NO: 460327

SEQ ID NO: 461054 - RNA, 64 nt, Human; identical to SEQ ID NO: 460328

SEQ ID NO: 461055 - RNA, 64 nt, Human; identical to SEQ ID NO: 460329

SEQ ID NO: 461056 - RNA, 64 nt, Human; identical to SEQ ID NO: 460330

SEQ ID NO: 461057 - RNA, 64 nt, Human; identical to SEQ ID NO: 460335

SEQ ID NO: 461058 - RNA, 64 nt, Human; identical to SEQ ID NO: 460336

SEQ ID NO: 461059 - RNA, 64 nt, Human; identical to SEQ ID NO: 460337

SEQ ID NO: 461060 - RNA, 64 nt, Human; identical to SEQ ID NO: 460338

SEQ ID NO: 461061 - RNA, 64 nt, Human
acuccuguaaucccagcacuuugggaggccgaggcgggcggaucaccaggucaggagaucaaga

SEQ ID NO: 461062 - RNA, 64 nt, Human
aagccuguaaucccagcacuuugggaggccgaggcgggcggaucacuugagaccaggaguucga

SEQ ID NO: 461063 - RNA, 64 nt, Human
guuuguuucuguuuucuuggguggggagcagggacgggcggagggaggagagcagguuucagau

SEQ ID NO: 461064 - RNA, 64 nt, Human; identical to SEQ ID NO: 460339

SEQ ID NO: 461065 - RNA, 64 nt, Human; identical to SEQ ID NO: 460340

SEQ ID NO: 461066 - RNA, 64 nt, Human; identical to SEQ ID NO: 460341

SEQ ID NO: 461067 - RNA, 64 nt, Human; identical to SEQ ID NO: 460342

SEQ ID NO: 461068 - RNA, 64 nt, Human; identical to SEQ ID NO: 460343

SEQ ID NO: 461069 - RNA, 64 nt, Human; identical to SEQ ID NO: 460344

SEQ ID NO: 461070 - RNA, 64 nt, Human; identical to SEQ ID NO: 460345

SEQ ID NO: 461071 - RNA, 64 nt, Human; identical to SEQ ID NO: 460346

SEQ ID NO: 461072 - RNA, 64 nt, Human; identical to SEQ ID NO: 460347

SEQ ID NO: 461073 - RNA, 64 nt, Human; identical to SEQ ID NO: 460348

SEQ ID NO: 461074 - RNA, 64 nt, Human; identical to SEQ ID NO: 460349

SEQ ID NO: 461075 - RNA, 64 nt, Human; identical to SEQ ID NO: 460354

SEQ ID NO: 461076 - RNA, 64 nt, Human; identical to SEQ ID NO: 460355

SEQ ID NO: 461077 - RNA, 64 nt, Human; identical to SEQ ID NO: 460356

SEQ ID NO: 461078 - RNA, 64 nt, Human; identical to SEQ ID NO: 460357

SEQ ID NO: 461079 - RNA, 64 nt, Human
acgccuguaaucccagcacuuugggaggccgaggcgggcggaucacaaagucaggacgagacca

SEQ ID NO: 461080 - RNA, 64 nt, Human
acccccaaagugcagauuccggagcagacacauccgggcggagagacucagcagacaagugcug

SEQ ID NO: 461081 - RNA, 64 nt, Human
acaccuguaaucccagcacuuugggagaccaaggcgggcggaucacuuaaagucaggaguccaa

SEQ ID NO: 461082 - RNA, 64 nt, Human; identical to SEQ ID NO: 460358

SEQ ID NO: 461083 - RNA, 64 nt, Human; identical to SEQ ID NO: 460359

SEQ ID NO: 461084 - RNA, 64 nt, Human; identical to SEQ ID NO: 460360

SEQ ID NO: 461085 - RNA, 64 nt, Human; identical to SEQ ID NO: 460361

SEQ ID NO: 461086 - RNA, 64 nt, Human; identical to SEQ ID NO: 460362

SEQ ID NO: 461087 - RNA, 64 nt, Human; identical to SEQ ID NO: 460363

SEQ ID NO: 461088 - RNA, 64 nt, Human; identical to SEQ ID NO: 460364

SEQ ID NO: 461089 - RNA, 64 nt, Human; identical to SEQ ID NO: 460365

SEQ ID NO: 461090 - RNA, 64 nt, Human; identical to SEQ ID NO: 460366

SEQ ID NO: 461091 - RNA, 64 nt, Human; identical to SEQ ID NO: 460367

SEQ ID NO: 461092 - RNA, 64 nt, Human; identical to SEQ ID NO: 460368

SEQ ID NO: 461093 - RNA, 64 nt, Human; identical to SEQ ID NO: 460373

SEQ ID NO: 461094 - RNA, 64 nt, Human; identical to SEQ ID NO: 460374

SEQ ID NO: 461095 - RNA, 64 nt, Human; identical to SEQ ID NO: 460375

SEQ ID NO: 461096 - RNA, 64 nt, Human; identical to SEQ ID NO: 460376

SEQ ID NO: 461097 - RNA, 64 nt, Human
cccccauccccacgcgggccgggcacgaccacaccgggcggaccgcuggacagacgcacccacu

SEQ ID NO: 461098 - RNA, 64 nt, Human
augccuguaaucccagcauuuugggaggccaaggcgggcggaucacuugaggucaggagcucaa

SEQ ID NO: 461099 - RNA, 64 nt, Human
acgccuguaaucccaacacuuuaggaguccaaggcgggcggaucacuugaggucaggaguucaa

SEQ ID NO: 461100 - RNA, 64 nt, Human; identical to SEQ ID NO: 460377

SEQ ID NO: 461101 - RNA, 64 nt, Human; identical to SEQ ID NO: 460378

SEQ ID NO: 461102 - RNA, 64 nt, Human; identical to SEQ ID NO: 460379

SEQ ID NO: 461103 - RNA, 64 nt, Human; identical to SEQ ID NO: 460380

SEQ ID NO: 461104 - RNA, 64 nt, Human; identical to SEQ ID NO: 460381

SEQ ID NO: 461105 - RNA, 64 nt, Human; identical to SEQ ID NO: 460382

SEQ ID NO: 461106 - RNA, 64 nt, Human; identical to SEQ ID NO: 460383

SEQ ID NO: 461107 - RNA, 64 nt, Human; identical to SEQ ID NO: 460384

SEQ ID NO: 461108 - RNA, 64 nt, Human; identical to SEQ ID NO: 460385

SEQ ID NO: 461109 - RNA, 64 nt, Human; identical to SEQ ID NO: 460386

SEQ ID NO: 461110 - RNA, 64 nt, Human; identical to SEQ ID NO: 460387

SEQ ID NO: 461111 - RNA, 64 nt, Human; identical to SEQ ID NO: 460392

SEQ ID NO: 461112 - RNA, 64 nt, Human; identical to SEQ ID NO: 460393

SEQ ID NO: 461113 - RNA, 64 nt, Human; identical to SEQ ID NO: 460394

SEQ ID NO: 461114 - RNA, 64 nt, Human; identical to SEQ ID NO: 460395

SEQ ID NO: 461115 - RNA, 64 nt, Human
gccgccacggccuggcuggugggaaggccggcagcgggcggaggggauccagccacuucccccu

SEQ ID NO: 461116 - RNA, 64 nt, Human
acaccuguaaucccagcacuuugggaggccgaggcgggcggaucaccugaagucaggaguuuga

SEQ ID NO: 461117 - RNA, 64 nt, Human
augccuguaaucccagcacuuugggaggccgaggcgggcggaucacaaggucaggagaucgaga

SEQ ID NO: 461118 - RNA, 64 nt, Human; identical to SEQ ID NO: 460396

SEQ ID NO: 461119 - RNA, 64 nt, Human; identical to SEQ ID NO: 460397

SEQ ID NO: 461120 - RNA, 64 nt, Human; identical to SEQ ID NO: 460398

SEQ ID NO: 461121 - RNA, 64 nt, Human; identical to SEQ ID NO: 460399

SEQ ID NO: 461122 - RNA, 64 nt, Human; identical to SEQ ID NO: 460400

SEQ ID NO: 461123 - RNA, 64 nt, Human; identical to SEQ ID NO: 460401

SEQ ID NO: 461124 - RNA, 64 nt, Human; identical to SEQ ID NO: 460402

SEQ ID NO: 461125 - RNA, 64 nt, Human; identical to SEQ ID NO: 460403

SEQ ID NO: 461126 - RNA, 64 nt, Human; identical to SEQ ID NO: 460404

SEQ ID NO: 461127 - RNA, 64 nt, Human; identical to SEQ ID NO: 460405

SEQ ID NO: 461128 - RNA, 64 nt, Human; identical to SEQ ID NO: 460406

SEQ ID NO: 461129 - RNA, 64 nt, Human; identical to SEQ ID NO: 460411

SEQ ID NO: 461130 - RNA, 64 nt, Human; identical to SEQ ID NO: 460412

SEQ ID NO: 461131 - RNA, 64 nt, Human; identical to SEQ ID NO: 460413

SEQ ID NO: 461132 - RNA, 64 nt, Human; identical to SEQ ID NO: 460414

SEQ ID NO: 461133 - RNA, 64 nt, Human
acgccuguaaucccagcacuuugggaggccgaggcgggcggaucaccugagguggggaguauga

SEQ ID NO: 461134 - RNA, 64 nt, Human
augccuauaaucccagcacguugggaggcugaggcgggcggaucgguugagcucaggcguucgg

SEQ ID NO: 461135 - RNA, 64 nt, Human
augccuguaaucccagcacuuugggaggccgaggcgggcggaucaccugaggccaggaguugga

SEQ ID NO: 461136 - RNA, 64 nt, Human; identical to SEQ ID NO: 460415

SEQ ID NO: 461137 - RNA, 54 nt, Human; identical to SEQ ID NO: 460416

SEQ ID NO: 461138 - RNA, 64 nt, Human; identical to SEQ ID NO: 460417

SEQ ID NO: 461139 - RNA, 64 nt, Human; identical to SEQ ID NO: 460418

SEQ ID NO: 461140 - RNA, 64 nt, Human; identical to SEQ ID NO: 460419

SEQ ID NO: 461141 - RNA, 64 nt, Human; identical to SEQ ID NO: 460420

SEQ ID NO: 461142 - RNA, 64 nt, Human; identical to SEQ ID NO: 460421

SEQ ID NO: 461143 - RNA, 64 nt, Human; identical to SEQ ID NO: 460422

SEQ ID NO: 461144 - RNA, 64 nt, Human; identical to SEQ ID NO: 460423

SEQ ID NO: 461145 - RNA, 64 nt, Human; identical to SEQ ID NO: 460424

SEQ ID NO: 461146 - RNA, 64 nt, Human; identical to SEQ ID NO: 460425

SEQ ID NO: 461147 - RNA, 64 nt, Human; identical to SEQ ID NO: 460430

SEQ ID NO: 461148 - RNA, 64 nt, Human; identical to SEQ ID NO: 460431

SEQ ID NO: 461149 - RNA, 64 nt, Human; identical to SEQ ID NO: 460432

SEQ ID NO: 461150 - RNA, 64 nt, Human; identical to SEQ ID NO: 460433

SEQ ID NO: 461151 - RNA, 64 nt, Human
gagagcgggcauccagagaggaguccugggagagcgggcggagcgagcgagggcccccggacug

SEQ ID NO: 461152 - RNA, 64 nt, Human
acgccuguaaucccagcacuuugggaggccgaggcgggcggaucaugagguuaggagagcgaga

SEQ ID NO: 461153 - RNA, 64 nt, Human
ccacugucaaucccagcacuuugggaggccuaggcgggcggaucaugaagucaagaguucgaga

SEQ ID NO: 461154 - RNA, 64 nt, Human; identical to SEQ ID NO: 460434

SEQ ID NO: 461155 - RNA, 64 nt, Human; identical to SEQ ID NO: 460435

SEQ ID NO: 461156 - RNA, 64 nt, Human; identical to SEQ ID NO: 460436

SEQ ID NO: 461157 - RNA, 64 nt, Human; identical to SEQ ID NO: 460437

SEQ ID NO: 461158 - RNA, 64 nt, Human; identical to SEQ ID NO: 460438

SEQ ID NO: 461159 - RNA, 64 nt, Human; identical to SEQ ID NO: 460439

SEQ ID NO: 461160 - RNA, 64 nt, Human; identical to SEQ ID NO: 460440

SEQ ID NO: 461161 - RNA, 64 nt, Human; identical to SEQ ID NO: 460441

SEQ ID NO: 461162 - RNA, 64 nt, Human; identical to SEQ ID NO: 460442

SEQ ID NO: 461163 - RNA, 64 nt, Human; identical to SEQ ID NO: 460443

SEQ ID NO: 461164 - RNA, 64 nt, Human; identical to SEQ ID NO: 460444

SEQ ID NO: 461165 - RNA, 64 nt, Human; identical to SEQ ID NO: 460449

SEQ ID NO: 461166 - RNA, 64 nt, Human; identical to SEQ ID NO: 460450

SEQ ID NO: 461167 - RNA, 64 nt, Human; identical to SEQ ID NO: 460451

SEQ ID NO: 461168 - RNA, 64 nt, Human; identical to SEQ ID NO: 460452

SEQ ID NO: 461169 - RNA, 62 nt, Human
auuugccugccagugcucuccagcgccauccugcccuggacaccacccugacgugaugccuc

SEQ ID NO: 461170 - RNA, 62 nt, Human
agaggcaaugaugagugaucaagaauuagagugcccuggaggucacucacaaguccucaugg

SEQ ID NO: 461171 - RNA, 62 nt, Human
gaucucuggccccaacccccaccagaccucaugcccuggacacugcugcugaguuggcucag

SEQ ID NO: 461172 - RNA, 62 nt, Human
gcuuucugguuggagccuggccggaaggaagagcccuggaggugguugggggcaaaugugcc

SEQ ID NO: 461173 - RNA, 64 nt, Human; identical to SEQ ID NO: 460453

SEQ ID NO: 461174 - RNA, 64 nt, Human; identical to SEQ ID NO: 460454

SEQ ID NO: 461175 - RNA, 64 nt, Human; identical to SEQ ID NO: 460455

SEQ ID NO: 461176 - RNA, 64 nt, Human; identical to SEQ ID NO: 460456

SEQ ID NO: 461177 - RNA, 64 nt, Human; identical to SEQ ID NO: 460457

SEQ ID NO: 461178 - RNA, 64 nt, Human; identical to SEQ ID NO: 460458

SEQ ID NO: 461179 - RNA, 64 nt, Human; identical to SEQ ID NO: 460459

SEQ ID NO: 461180 - RNA, 50 nt, Human; identical to SEQ ID NO: 460460

SEQ ID NO: 461181 - RNA, 64 nt, Human; identical to SEQ ID NO: 460461

SEQ ID NO: 461182 - RNA, 64 nt, Human; identical to SEQ ID NO: 460462

SEQ ID NO: 461183 - RNA, 64 nt, Human; identical to SEQ ID NO: 460463

SEQ ID NO: 461184 - RNA, 64 nt, Human; identical to SEQ ID NO: 460468

SEQ ID NO: 461185 - RNA, 64 nt, Human; identical to SEQ ID NO: 460469

SEQ ID NO: 461186 - RNA, 64 nt, Human; identical to SEQ ID NO: 460470

SEQ ID NO: 461187 - RNA, 64 nt, Human; identical to SEQ ID NO: 460471

SEQ ID NO: 461188 - RNA, 64 nt, Human
acgccuguaaucccagcacuuugggaggccgagacgggcggaucaccugaggucaggaguucga

SEQ ID NO: 461189 - RNA, 64 nt, Human
acgccuguaaucccagcacuuugggaggccaaggcgggcggaucaccugaggucgggaguuuga

SEQ ID NO: 461190 - RNA, 64 nt, Human
uggucacucagccgucgugagcgcaggcgcggggcgggcggagcgggaccccuggggcucuccc

SEQ ID NO: 461191 - RNA, 64 nt, Human; identical to SEQ ID NO: 460472

SEQ ID NO: 461192 - RNA, 64 nt, Human; identical to SEQ ID NO: 460473

SEQ ID NO: 461193 - RNA, 64 nt, Human; identical to SEQ ID NO: 460474

SEQ ID NO: 461194 - RNA, 64 nt, Human; identical to SEQ ID NO: 460475

SEQ ID NO: 461195 - RNA, 64 nt, Human; identical to SEQ ID NO: 460476

SEQ ID NO: 461196 - RNA, 64 nt, Human; identical to SEQ ID NO: 460477

SEQ ID NO: 461197 - RNA, 64 nt, Human; identical to SEQ ID NO: 460478

SEQ ID NO: 461198 - RNA, 64 nt, Human; identical to SEQ ID NO: 460479

SEQ ID NO: 461199 - RNA, 64 nt, Human; identical to SEQ ID NO: 460480

SEQ ID NO: 461200 - RNA, 64 nt, Human; identical to SEQ ID NO: 460481

SEQ ID NO: 461201 - RNA, 64 nt, Human; identical to SEQ ID NO: 460482

SEQ ID NO: 461202 - RNA, 64 nt, Human; identical to SEQ ID NO: 460487

SEQ ID NO: 461203 - RNA, 64 nt, Human; identical to SEQ ID NO: 460488

SEQ ID NO: 461204 - RNA, 64 nt, Human; identical to SEQ ID NO: 460489

SEQ ID NO: 461205 - RNA, 64 nt, Human; identical to SEQ ID NO: 460490

SEQ ID NO: 461206 - RNA, 64 nt, Human
acgccuguaaucccagcacuuugggaggcugaggcgggcggaucacgaggucaggagaucgaga

SEQ ID NO: 461207 - RNA, 64 nt, Human
acaccuguaaucccagcacuuugggaggccgaggcgggcggaucacaaggucaggaguucgaga

SEQ ID NO: 461208 - RNA, 64 nt, Human
acaccuguaaucccagcacuuugggaggccaaggcgggcggaucagcugaggucaggaguugga

SEQ ID NO: 461209 - RNA, 64 nt, Human; identical to SEQ ID NO: 460491

SEQ ID NO: 461210 - RNA, 64 nt, Human; identical to SEQ ID NO: 460492

SEQ ID NO: 461211 - RNA, 64 nt, Human; identical to SEQ ID NO: 460493

SEQ ID NO: 461212 - RNA, 64 nt, Human; identical to SEQ ID NO: 460494

SEQ ID NO: 461213 - RNA, 64 nt, Human; identical to SEQ ID NO: 460495

SEQ ID NO: 461214 - RNA, 64 nt, Human; identical to SEQ ID NO: 460496

SEQ ID NO: 461215 - RNA, 64 nt, Human; identical to SEQ ID NO: 460497

SEQ ID NO: 461216 - RNA, 64 nt, Human; identical to SEQ ID NO: 460498

SEQ ID NO: 461217 - RNA, 64 nt, Human; identical to SEQ ID NO: 460499

SEQ ID NO: 461218 - RNA, 64 nt, Human; identical to SEQ ID NO: 460500

SEQ ID NO: 461219 - RNA, 64 nt, Human; identical to SEQ ID NO: 460501

SEQ ID NO: 461220 - RNA, 64 nt, Human; identical to SEQ ID NO: 460506

SEQ ID NO: 461221 - RNA, 64 nt, Human; identical to SEQ ID NO: 460507

SEQ ID NO: 461222 - RNA, 64 nt, Human; identical to SEQ ID NO: 460508

SEQ ID NO: 461223 - RNA, 64 nt, Human; identical to SEQ ID NO: 460509

SEQ ID NO: 461224 - RNA, 64 nt, Human
cgugugggacugagucagcgguggcgaggagaggcgggcggauuuggggagggcccugaggacc

SEQ ID NO: 461225 - RNA, 51 nt, Human
uucucgucagcugguguuagccgggcggaguguguuagucucuccagaggg

SEQ ID NO: 461226 - RNA, 64 nt, Human
gggaccugcuccucacagagccccucccaaggaucgggcggaagcugcugggacccuccugggc

SEQ ID NO: 461227 - RNA, 64 nt, Human; identical to SEQ ID NO: 460510

SEQ ID NO: 461228 - RNA, 64 nt, Human; identical to SEQ ID NO: 460511

SEQ ID NO: 461229 - RNA, 64 nt, Human; identical to SEQ ID NO: 460512

SEQ ID NO: 461230 - RNA, 64 nt, Human; identical to SEQ ID NO: 460513

SEQ ID NO: 461231 - RNA, 64 nt, Human; identical to SEQ ID NO: 460514

SEQ ID NO: 461232 - RNA, 64 nt, Human; identical to SEQ ID NO: 460515

SEQ ID NO: 461233 - RNA, 64 nt, Human; identical to SEQ ID NO: 460516

SEQ ID NO: 461234 - RNA, 64 nt, Human; identical to SEQ ID NO: 460517

SEQ ID NO: 461235 - RNA, 64 nt, Human; identical to SEQ ID NO: 460518

SEQ ID NO: 461236 - RNA, 64 nt, Human; identical to SEQ ID NO: 460519

SEQ ID NO: 461237 - RNA, 64 nt, Human; identical to SEQ ID NO: 460520

SEQ ID NO: 461238 - RNA, 64 nt, Human; identical to SEQ ID NO: 460525

SEQ ID NO: 461239 - RNA, 64 nt, Human; identical to SEQ ID NO: 460526

SEQ ID NO: 461240 - RNA, 64 nt, Human; identical to SEQ ID NO: 460527

SEQ ID NO: 461241 - RNA, 64 nt, Human; identical to SEQ ID NO: 460528

SEQ ID NO: 461242 - RNA, 64 nt, Human
auuuuauuggagccccaucuccccagcgggcaggcgggcggagccuguauauauguauauacuc

SEQ ID NO: 461243 - RNA, 64 nt, Human
cggcagugcacgcggcuuguugacuucgcagccccgggcggagccuucccgggcgggcguggga

SEQ ID NO: 461244 - RNA, 64 nt, Human
cagcccugaggucgcgcgcagcgcgugcacagcgcgggcggaggcggcuccagguccggagggg

SEQ ID NO: 461245 - RNA, 64 nt, Human; identical to SEQ ID NO: 460529

SEQ ID NO: 461246 - RNA, 64 nt, Human; identical to SEQ ID NO: 460530

SEQ ID NO: 461247 - RNA, 64 nt, Human; identical to SEQ ID NO: 460531

SEQ ID NO: 461248 - RNA, 64 nt, Human; identical to SEQ ID NO: 460532

SEQ ID NO: 461249 - RNA, 64 nt, Human; identical to SEQ ID NO: 460533

SEQ ID NO: 461250 - RNA, 64 nt, Human; identical to SEQ ID NO: 460534

SEQ ID NO: 461251 - RNA, 64 nt, Human; identical to SEQ ID NO: 460535

SEQ ID NO: 461252 - RNA, 64 nt, Human; identical to SEQ ID NO: 460536

SEQ ID NO: 461253 - RNA, 54 nt, Human; identical to SEQ ID NO: 460537

SEQ ID NO: 461254 - RNA, 64 nt, Human; identical to SEQ ID NO: 460538

SEQ ID NO: 461255 - RNA, 64 nt, Human; identical to SEQ ID NO: 460539

SEQ ID NO: 461256 - RNA, 64 nt, Human; identical to SEQ ID NO: 460544

SEQ ID NO: 461257 - RNA, 64 nt, Human; identical to SEQ ID NO: 460545

SEQ ID NO: 461258 - RNA, 64 nt, Human; identical to SEQ ID NO: 460546

SEQ ID NO: 461259 - RNA, 64 nt, Human; identical to SEQ ID NO: 460547

SEQ ID NO: 461260 - RNA, 64 nt, Human
augccuguaaucccagcacuuugggaggccaagacgggcggaucuuuugaggucgggaguugga

SEQ ID NO: 461261 - RNA, 64 nt, Human
acgccuguaaucccaacacuuugggagcccgaggcgggcggaucacaaggucaggaguucgaga

SEQ ID NO: 461262 - RNA, 64 nt, Human
caugguguaauccuaacacuuugggaggccaaggcgggcggauugccugagcucaggaguucaa

SEQ ID NO: 461263 - RNA, 64 nt, Human; identical to SEQ ID NO: 460548

SEQ ID NO: 461264 - RNA, 64 nt, Human; identical to SEQ ID NO: 460549

SEQ ID NO: 461265 - RNA, 64 nt, Human; identical to SEQ ID NO: 460550

SEQ ID NO: 461266 - RNA, 64 nt, Human; identical to SEQ ID NO: 460551

SEQ ID NO: 461267 - RNA, 64 nt, Human; identical to SEQ ID NO: 460552

SEQ ID NO: 461268 - RNA, 64 nt, Human; identical to SEQ ID NO: 460553

SEQ ID NO: 461269 - RNA, 64 nt, Human; identical to SEQ ID NO: 460554

SEQ ID NO: 461270 - RNA, 64 nt, Human; identical to SEQ ID NO: 460555

SEQ ID NO: 461271 - RNA, 64 nt, Human; identical to SEQ ID NO: 460556

SEQ ID NO: 461272 - RNA, 64 nt, Human; identical to SEQ ID NO: 460557

SEQ ID NO: 461273 - RNA, 64 nt, Human; identical to SEQ ID NO: 460558

SEQ ID NO: 461274 - RNA, 64 nt, Human; identical to SEQ ID NO: 460563

SEQ ID NO: 461275 - RNA, 64 nt, Human; identical to SEQ ID NO: 460564

SEQ ID NO: 461276 - RNA, 64 nt, Human; identical to SEQ ID NO: 460565

SEQ ID NO: 461277 - RNA, 64 nt, Human; identical to SEQ ID NO: 460566

SEQ ID NO: 461278 - RNA, 64 nt, Human
augccuguaaucccagcacuuugggaggcugaggcgggcggaucaccugagguugggaguucga

SEQ ID NO: 461279 - RNA, 64 nt, Human
accucaagaggggaggagcggggcugauccuggucgggcggaccugagucgggcagccgcucuc

SEQ ID NO: 461280 - RNA, 64 nt, Human
acgccuguaaucccagcacuuugggaggccgaggcgggcggaugaccugaggucaggaguucaa

SEQ ID NO: 461281 - RNA, 64 nt, Human
ucacuccugagaaugggcuccuguuagaugggcacgggcggauuaauuuuagcaaaauguucug

SEQ ID NO: 461282 - RNA, 64 nt, Human
acgccuguaaucccaacacuuugggaggccgaggcgggcggaucacgaggucagaucaagaaca

SEQ ID NO: 461283 - RNA, 64 nt, Human
acaccuguaaucccagcacuuugggaggccgaggcgggcggaucacgaggucaggaguucgaga

SEQ ID NO: 461284 - RNA, 64 nt, Human
acgccuguaaucucagcacuuugggaggcugaggcgggcggaucacaagguccagaguucaaga

SEQ ID NO: 461285 - RNA, 64 nt, Human
ccauaaaggaugagccuggggucacagggggugucgggcggaggaaagugcaucccccagagcu

SEQ ID NO: 461286 - RNA, 64 nt, Human
augccuguaaucccagcacuuugggaggcugaggcgggcggaucaccugaggucgggaguucga

SEQ ID NO: 461287 - RNA, 64 nt, Human
acgccuguaaucccagcacuuugagagaccgaggcgggcggaucacgaggucaggagaucgaga

SEQ ID NO: 461288 - RNA, 64 nt, Human
acgccuguaauccuagcacuuugggaggccaagacgggcggaucaccugaggugaggaguucaa

SEQ ID NO: 461289 - RNA, 64 nt, Human
augccuguaaucccagcacuuugggaggccgaggcgggcggaucacgaggucaggagauugaga

SEQ ID NO: 461290 - RNA, 64 nt, Human
acgacuauguguaaugcucuaagaccucucagcacgggcggaagaaacucccggagagcucacc

SEQ ID NO: 461291 - RNA, 64 nt, Human
acggcuguaaucccaacacuuugggagucugaggcgggcggaucaugaggucaggagauuaaga

SEQ ID NO: 461292 - RNA, 64 nt, Human
acgccugugaucccagcacuuugggaggccaagacgggcggaucaugaggucaagagaucaaga

SEQ ID NO: 461293 - RNA, 64 nt, Human; identical to SEQ ID NO: 460989

SEQ ID NO: 461294 - RNA, 64 nt, Human
acaccugcaaucccagcacuuugggaggccgaggcgggcggaucaccugaggucagcaguucaa

SEQ ID NO: 461295 - RNA, 64 nt, Human
acgccuauaaucccagcacuuugggaggccgaggcgggcggaucacgaggucaggagauugaga

SEQ ID NO: 461296 - RNA, 64 nt, Human
acgccuguaaucccagcacuuugggaggccgaggcgggcggaucacaaggucaggagaucgaga

SEQ ID NO: 461297 - RNA, 62 nt, Human
acuggccaagaccuccacguccccagaguccagcccuggaaauuccaagggcccuggcgucc

SEQ ID NO: 461298 - RNA, 62 nt, Human
ggcuguggaagaacucugcucgagggcagggugcccuggaacacugguaguucuggggcugg

SEQ ID NO: 461299 - RNA, 62 nt, Human
gugucugccaucccccucccucccugggcccggcccuggacccgucaggugccuguccccag

SEQ ID NO: 461300 - RNA, 62 nt, Human
auugggaccugcucugacagcuggacacaugagcccuggaugaguaugguaggggguuugaa

SEQ ID NO: 461301 - RNA, 62 nt, Human
guuuccaccccacccccaaccuugucccaagugcccuggacuaaauuuccugugccagugac

SEQ ID NO: 461302 - RNA, 62 nt, Human
ccaggauuggggagagcccuugucucuggucagcccuggagcaugggaucgugggaaagagg

SEQ ID NO: 461303 - RNA, 62 nt, Human
caccaucccacaagggcgcuggggguggaagugcccuggaagccccuccccucucacacuga

SEQ ID NO: 461304 - RNA, 62 nt, Human
gcuuccucagggcccagcaggcggggguuugagcccuggaccccaggcucuuagagacuaag

SEQ ID NO: 461305 - RNA, 62 nt, Human
guguuagagcggagcccaaaggaaggaugggagcccuggagugggcaagaccaggccaccug

SEQ ID NO: 461306 - RNA, 62 nt, Human
caggugccuccucucagucaggcuucagagcagcccuggagacaggagggccauguuaaaag

SEQ ID NO: 461307 - RNA, 62 nt, Human
uuuccggugaggcucaccgggucccaaguccagcccuggaucucccaauggccuuccaaucc

SEQ ID NO: 461308 - RNA, 59 nt, Human; identical to SEQ ID NO: 371936

SEQ ID NO: 461309 - RNA, 62 nt, Human
guccccaccaucagccaccacacaccucugcugcccuggagacugugcucuugaccugcucc

SEQ ID NO: 461310 - RNA, 64 nt, Human; identical to SEQ ID NO: 64138

SEQ ID NO: 461311 - RNA, 64 nt, Human; identical to SEQ ID NO: 64139

SEQ ID NO: 461312 - RNA, 64 nt, Human; identical to SEQ ID NO: 64140

SEQ ID NO: 461313 - RNA, 64 nt, Human; identical to SEQ ID NO: 64085

SEQ ID NO: 461314 - RNA, 64 nt, Human; identical to SEQ ID NO: 64086

SEQ ID NO: 461315 - RNA, 64 nt, Human; identical to SEQ ID NO: 64087

SEQ ID NO: 461316 - RNA, 64 nt, Human; identical to SEQ ID NO: 64088

SEQ ID NO: 461317 - RNA, 64 nt, Human; identical to SEQ ID NO: 64089

SEQ ID NO: 461318 - RNA, 64 nt, Human; identical to SEQ ID NO: 64090

SEQ ID NO: 461319 - RNA, 64 nt, Human; identical to SEQ ID NO: 64091

SEQ ID NO: 461320 - RNA, 64 nt, Human; identical to SEQ ID NO: 64092

SEQ ID NO: 461321 - RNA, 64 nt, Human; identical to SEQ ID NO: 64093

SEQ ID NO: 461322 - RNA, 64 nt, Human; identical to SEQ ID NO: 64094

SEQ ID NO: 461323 - RNA, 64 nt, Human; identical to SEQ ID NO: 64095

SEQ ID NO: 461324 - RNA, 64 nt, Human; identical to SEQ ID NO: 64096

SEQ ID NO: 461325 - RNA, 64 nt, Human; identical to SEQ ID NO: 64097

SEQ ID NO: 461326 - RNA, 64 nt, Human; identical to SEQ ID NO: 64098

SEQ ID NO: 461327 - RNA, 64 nt, Human; identical to SEQ ID NO: 64099

SEQ ID NO: 461328 - RNA, 64 nt, Human; identical to SEQ ID NO: 64100

SEQ ID NO: 461329 - RNA, 64 nt, Human; identical to SEQ ID NO: 64101

SEQ ID NO: 461330 - RNA, 51 nt, Human; identical to SEQ ID NO: 64102

SEQ ID NO: 461331 - RNA, 64 nt, Human; identical to SEQ ID NO: 64103

SEQ ID NO: 461332 - RNA, 64 nt, Human; identical to SEQ ID NO: 64104

SEQ ID NO: 461333 - RNA, 57 nt, Human; identical to SEQ ID NO: 64105

SEQ ID NO: 461334 - RNA, 64 nt, Human
aaagggacgggaggaagcauccgaaaccuaggauucguccuacgauucugaaccugugccaaua

SEQ ID NO: 461335 - RNA, 64 nt, Human
agcauuuaucucccaugacagaaauaaauuuaccucguccuacauuuucauugcucaaguccaa

SEQ ID NO: 461336 - RNA, 64 nt, Human
aggucuugacaaaacagaagaaaaacaagccuccucguccuagucuuuucuagcaaagggauaa

SEQ ID NO: 461337 - RNA, 64 nt, Human
uaggccgugauucuggaaaaccuuggaugggccuucguccuaugucagccuucccuuugauccu

SEQ ID NO: 461338 - RNA, 64 nt, Human
caaauguuacaguuuauauuguggaauaaauccuucguccuaacauaacacuaaaugcugauua

SEQ ID NO: 461339 - RNA, 64 nt, Human
cuauugcuaagcauuguuucccugguaauucuucucguccuaaucucaaucuuacuguacugga

SEQ ID NO: 461340 - RNA, 64 nt, Human
aagugggaguuauuaucugagacauuccugcuugucguccuaacaacgcugaugaaacguaaaa

SEQ ID NO: 461341 - RNA, 64 nt, Human
aacuucagugguuaauuauaaaaguuguguuacuucguccuaaauuaaauugauagaaagauuu

SEQ ID NO: 461342 - RNA, 64 nt, Human
acuccagcguucccgccauugucauggcgggucuucguccuaaacugagaagaaaagcauuccu

SEQ ID NO: 461343 - RNA, 64 nt, Human
agugaugcuugaaauuuuuguaugaauuauuuugucguccuacccuuuuccuccaaaacaaaaa

SEQ ID NO: 461344 - RNA, 64 nt, Human
uuuuaaucugucaauuauuucagucaucaucucaucguccuagaaagccuggucauuuuacugu

SEQ ID NO: 461345 - RNA, 60 nt, Human; identical to SEQ ID NO: 431292

SEQ ID NO: 461346 - RNA, 64 nt, Human
ugcuucccagaggacuggcccuacgugcucucucucguccuaccuaucaaugcccagcauggca

SEQ ID NO: 461347 - RNA, 64 nt, Human
uuacuccgucaccauauccauauggaauaagggcucguccuaccuaaagcuuccugccaauaau

SEQ ID NO: 461348 - RNA, 64 nt, Human; identical to SEQ ID NO: 116576

SEQ ID NO: 461349 - RNA, 64 nt, Human; identical to SEQ ID NO: 116577

SEQ ID NO: 461350 - RNA, 64 nt, Human; identical to SEQ ID NO: 116578

SEQ ID NO: 461351 - RNA, 64 nt, Human
ugccggaaaggaauuuggggaucaagaacuuagcucguccuacccccauguugaguucugcccu

SEQ ID NO: 461352 - RNA, 64 nt, Human
caucccccacacagggcucugguuuucacucgcuucguccuagauaguuuaaaugggaaucgga

SEQ ID NO: 461353 - RNA, 64 nt, Human
agcagaaauauugcuaguuuaauauugugucaggucguccuauuaaccaggagcagaugacagu

SEQ ID NO: 461354 - RNA, 64 nt, Human
cacuaagaaggcaguaauugaaugcugcccuggcucguccuagaaucauuucuccuccaugaug

SEQ ID NO: 461355 - RNA, 64 nt, Human
gagacaaucuugcaacacccgggcauguuugucgucguccuacaaaugaggaaaccgagccuau

SEQ ID NO: 461356 - RNA, 64 nt, Human
agacugguuucuagcacuaccggucacggccaugucguccuagaaggguccagaagauuauuuu

SEQ ID NO: 461357 - RNA, 64 nt, Human
gagaaggugguggacacucgugauggaauggaaaucguccuaccgugcagccacacccugcccu

SEQ ID NO: 461358 - RNA, 64 nt, Human; identical to SEQ ID NO: 116536

SEQ ID NO: 461359 - RNA, 61 nt, Human; identical to SEQ ID NO: 116537

SEQ ID NO: 461360 - RNA, 64 nt, Human; identical to SEQ ID NO: 116538

SEQ ID NO: 461361 - RNA, 64 nt, Human; identical to SEQ ID NO: 116539

SEQ ID NO: 461362 - RNA, 64 nt, Human; identical to SEQ ID NO: 116540

SEQ ID NO: 461363 - RNA, 64 nt, Human; identical to SEQ ID NO: 116541

SEQ ID NO: 461364 - RNA, 64 nt, Human; identical to SEQ ID NO: 116542

SEQ ID NO: 461365 - RNA, 64 nt, Human; identical to SEQ ID NO: 116543

SEQ ID NO: 461366 - RNA, 64 nt, Human; identical to SEQ ID NO: 116544

SEQ ID NO: 461367 - RNA, 64 nt, Human; identical to SEQ ID NO: 116545

SEQ ID NO: 461368 - RNA, 64 nt, Human; identical to SEQ ID NO: 116546

SEQ ID NO: 461369 - RNA, 64 nt, Human; identical to SEQ ID NO: 116671

SEQ ID NO: 461370 - RNA, 64 nt, Human; identical to SEQ ID NO: 116672

SEQ ID NO: 461371 - RNA, 64 nt, Human; identical to SEQ ID NO: 116673

SEQ ID NO: 461372 - RNA, 64 nt, Human; identical to SEQ ID NO: 116674

SEQ ID NO: 461373 - RNA, 64 nt, Human; identical to SEQ ID NO: 116675

SEQ ID NO: 461374 - RNA, 64 nt, Human; identical to SEQ ID NO: 116676

SEQ ID NO: 461375 - RNA, 64 nt, Human; identical to SEQ ID NO: 116677

SEQ ID NO: 461376 - RNA, 64 nt, Human; identical to SEQ ID NO: 116678

SEQ ID NO: 461377 - RNA, 64 nt, Human; identical to SEQ ID NO: 116679

SEQ ID NO: 461378 - RNA, 64 nt, Human; identical to SEQ ID NO: 116680

SEQ ID NO: 461379 - RNA, 64 nt, Human; identical to SEQ ID NO: 116681

SEQ ID NO: 461380 - RNA, 64 nt, Human; identical to SEQ ID NO: 116682

SEQ ID NO: 461381 - RNA, 64 nt, Human; identical to SEQ ID NO: 116683

SEQ ID NO: 461382 - RNA, 64 nt, Human; identical to SEQ ID NO: 116684

SEQ ID NO: 461383 - RNA, 64 nt, Human; identical to SEQ ID NO: 116685

SEQ ID NO: 461384 - RNA, 64 nt, Human; identical to SEQ ID NO: 116686

SEQ ID NO: 461385 - RNA, 64 nt, Human; identical to SEQ ID NO: 116687

SEQ ID NO: 461386 - RNA, 64 nt, Human; identical to SEQ ID NO: 116688

SEQ ID NO: 461387 - RNA, 64 nt, Human; identical to SEQ ID NO: 116689

SEQ ID NO: 461388 - RNA, 64 nt, Human; identical to SEQ ID NO: 116690

SEQ ID NO: 461389 - RNA, 64 nt, Human; identical to SEQ ID NO: 116909

SEQ ID NO: 461390 - RNA, 64 nt, Human; identical to SEQ ID NO: 116910

SEQ ID NO: 461391 - RNA, 64 nt, Human; identical to SEQ ID NO: 116911

SEQ ID NO: 461392 - RNA, 64 nt, Human; identical to SEQ ID NO: 116912

SEQ ID NO: 461393 - RNA, 64 nt, Human; identical to SEQ ID NO: 116913

SEQ ID NO: 461394 - RNA, 64 nt, Human; identical to SEQ ID NO: 116914

SEQ ID NO: 461395 - RNA, 64 nt, Human; identical to SEQ ID NO: 116915

SEQ ID NO: 461396 - RNA, 64 nt, Human; identical to SEQ ID NO: 116916

SEQ ID NO: 461397 - RNA, 64 nt, Human; identical to SEQ ID NO: 116917

SEQ ID NO: 461398 - RNA, 64 nt, Human; identical to SEQ ID NO: 116918

SEQ ID NO: 461399 - RNA, 64 nt, Human; identical to SEQ ID NO: 116919

SEQ ID NO: 461400 - RNA, 64 nt, Human; identical to SEQ ID NO: 116920

SEQ ID NO: 461401 - RNA, 64 nt, Human; identical to SEQ ID NO: 116921

SEQ ID NO: 461402 - RNA, 64 nt, Human; identical to SEQ ID NO: 116922

SEQ ID NO: 461403 - RNA, 64 nt, Human; identical to SEQ ID NO: 116923

SEQ ID NO: 461404 - RNA, 64 nt, Human; identical to SEQ ID NO: 116924

SEQ ID NO: 461405 - RNA, 64 nt, Human; identical to SEQ ID NO: 116925

SEQ ID NO: 461406 - RNA, 64 nt, Human; identical to SEQ ID NO: 116926

SEQ ID NO: 461407 - RNA, 64 nt, Human; identical to SEQ ID NO: 116927

SEQ ID NO: 461408 - RNA, 64 nt, Human; identical to SEQ ID NO: 116928

SEQ ID NO: 461409 - RNA, 64 nt, Human; identical to SEQ ID NO: 116929

SEQ ID NO: 461410 - RNA, 64 nt, Human; identical to SEQ ID NO: 116930

SEQ ID NO: 461411 - RNA, 64 nt, Human; identical to SEQ ID NO: 116931

SEQ ID NO: 461412 - RNA, 64 nt, Human; identical to SEQ ID NO: 116932

SEQ ID NO: 461413 - RNA, 64 nt, Human; identical to SEQ ID NO: 116933

SEQ ID NO: 461414 - RNA, 63 nt, Human; identical to SEQ ID NO: 116934

SEQ ID NO: 461415 - RNA, 64 nt, Human; identical to SEQ ID NO: 116935

SEQ ID NO: 461416 - RNA, 64 nt, Human; identical to SEQ ID NO: 116936

SEQ ID NO: 461417 - RNA, 64 nt, Human; identical to SEQ ID NO: 116937

SEQ ID NO: 461418 - RNA, 64 nt, Human; identical to SEQ ID NO: 116938

SEQ ID NO: 461419 - RNA, 64 nt, Human; identical to SEQ ID NO: 116939

SEQ ID NO: 461420 - RNA, 64 nt, Human; identical to SEQ ID NO: 116940

SEQ ID NO: 461421 - RNA, 64 nt, Human; identical to SEQ ID NO: 116941

SEQ ID NO: 461422 - RNA, 64 nt, Human; identical to SEQ ID NO: 116942

SEQ ID NO: 461423 - RNA, 64 nt, Human; identical to SEQ ID NO: 116943

SEQ ID NO: 461424 - RNA, 64 nt, Human; identical to SEQ ID NO: 116944

SEQ ID NO: 461425 - RNA, 64 nt, Human; identical to SEQ ID NO: 116945

SEQ ID NO: 461426 - RNA, 64 nt, Human; identical to SEQ ID NO: 116946

SEQ ID NO: 461427 - RNA, 64 nt, Human; identical to SEQ ID NO: 116947

SEQ ID NO: 461428 - RNA, 64 nt, Human; identical to SEQ ID NO: 116948

SEQ ID NO: 461429 - RNA, 64 nt, Human; identical to SEQ ID NO: 116949

SEQ ID NO: 461430 - RNA, 64 nt, Human; identical to SEQ ID NO: 116950

SEQ ID NO: 461431 - RNA, 64 nt, Human; identical to SEQ ID NO: 116951

SEQ ID NO: 461432 - RNA, 64 nt, Human; identical to SEQ ID NO: 116952

SEQ ID NO: 461433 - RNA, 64 nt, Human; identical to SEQ ID NO: 116953

SEQ ID NO: 461434 - RNA, 64 nt, Human; identical to SEQ ID NO: 116954

SEQ ID NO: 461435 - RNA, 64 nt, Human; identical to SEQ ID NO: 116955

SEQ ID NO: 461436 - RNA, 64 nt, Human; identical to SEQ ID NO: 116956

SEQ ID NO: 461437 - RNA, 64 nt, Human; identical to SEQ ID NO: 116957

SEQ ID NO: 461438 - RNA, 64 nt, Human; identical to SEQ ID NO: 116958

SEQ ID NO: 461439 - RNA, 64 nt, Human; identical to SEQ ID NO: 116959

SEQ ID NO: 461440 - RNA, 64 nt, Human; identical to SEQ ID NO: 116960

SEQ ID NO: 461441 - RNA, 64 nt, Human; identical to SEQ ID NO: 116961

SEQ ID NO: 461442 - RNA, 64 nt, Human; identical to SEQ ID NO: 116962

SEQ ID NO: 461443 - RNA, 64 nt, Human; identical to SEQ ID NO: 116963

SEQ ID NO: 461444 - RNA, 64 nt, Human; identical to SEQ ID NO: 116964

SEQ ID NO: 461445 - RNA, 64 nt, Human; identical to SEQ ID NO: 116965

SEQ ID NO: 461446 - RNA, 64 nt, Human; identical to SEQ ID NO: 116966

SEQ ID NO: 461447 - RNA, 64 nt, Human; identical to SEQ ID NO: 116967

SEQ ID NO: 461448 - RNA, 64 nt, Human; identical to SEQ ID NO: 116968

SEQ ID NO: 461449 - RNA, 64 nt, Human; identical to SEQ ID NO: 116969

SEQ ID NO: 461450 - RNA, 64 nt, Human; identical to SEQ ID NO: 116970

SEQ ID NO: 461451 - RNA, 64 nt, Human; identical to SEQ ID NO: 116971

SEQ ID NO: 461452 - RNA, 64 nt, Human; identical to SEQ ID NO: 116972

SEQ ID NO: 461453 - RNA, 64 nt, Human; identical to SEQ ID NO: 116973

SEQ ID NO: 461454 - RNA, 64 nt, Human; identical to SEQ ID NO: 116974

SEQ ID NO: 461455 - RNA, 64 nt, Human; identical to SEQ ID NO: 116975

SEQ ID NO: 461456 - RNA, 64 nt, Human; identical to SEQ ID NO: 116976

SEQ ID NO: 461457 - RNA, 64 nt, Human; identical to SEQ ID NO: 116977

SEQ ID NO: 461458 - RNA, 64 nt, Human; identical to SEQ ID NO: 116978

SEQ ID NO: 461459 - RNA, 64 nt, Human; identical to SEQ ID NO: 116979

SEQ ID NO: 461460 - RNA, 64 nt, Human; identical to SEQ ID NO: 116980

SEQ ID NO: 461461 - RNA, 64 nt, Human; identical to SEQ ID NO: 116981

SEQ ID NO: 461462 - RNA, 64 nt, Human; identical to SEQ ID NO: 116982

SEQ ID NO: 461463 - RNA, 64 nt, Human; identical to SEQ ID NO: 116983

SEQ ID NO: 461464 - RNA, 64 nt, Human; identical to SEQ ID NO: 116984

SEQ ID NO: 461465 - RNA, 64 nt, Human; identical to SEQ ID NO: 116985

SEQ ID NO: 461466 - RNA, 64 nt, Human; identical to SEQ ID NO: 116986

SEQ ID NO: 461467 - RNA, 64 nt, Human; identical to SEQ ID NO: 116987

SEQ ID NO: 461468 - RNA, 64 nt, Human; identical to SEQ ID NO: 116988

SEQ ID NO: 461469 - RNA, 64 nt, Human; identical to SEQ ID NO: 116989

SEQ ID NO: 461470 - RNA, 64 nt, Human; identical to SEQ ID NO: 116990

SEQ ID NO: 461471 - RNA, 64 nt, Human; identical to SEQ ID NO: 116991

SEQ ID NO: 461472 - RNA, 64 nt, Human; identical to SEQ ID NO: 116992

SEQ ID NO: 461473 - RNA, 64 nt, Human; identical to SEQ ID NO: 116993

SEQ ID NO: 461474 - RNA, 64 nt, Human; identical to SEQ ID NO: 116994

SEQ ID NO: 461475 - RNA, 64 nt, Human; identical to SEQ ID NO: 116995

SEQ ID NO: 461476 - RNA, 64 nt, Human; identical to SEQ ID NO: 116996

SEQ ID NO: 461477 - RNA, 64 nt, Human; identical to SEQ ID NO: 116997

SEQ ID NO: 461478 - RNA, 64 nt, Human; identical to SEQ ID NO: 116998

SEQ ID NO: 461479 - RNA, 64 nt, Human; identical to SEQ ID NO: 116999

SEQ ID NO: 461480 - RNA, 64 nt, Human; identical to SEQ ID NO: 117000

SEQ ID NO: 461481 - RNA, 64 nt, Human; identical to SEQ ID NO: 117001

SEQ ID NO: 461482 - RNA, 64 nt, Human; identical to SEQ ID NO: 117002

SEQ ID NO: 461483 - RNA, 64 nt, Human; identical to SEQ ID NO: 117003

SEQ ID NO: 461484 - RNA, 64 nt, Human; identical to SEQ ID NO: 117004

SEQ ID NO: 461485 - RNA, 64 nt, Human; identical to SEQ ID NO: 117005

SEQ ID NO: 461486 - RNA, 51 nt, Human; identical to SEQ ID NO: 117006

SEQ ID NO: 461487 - RNA, 64 nt, Human; identical to SEQ ID NO: 117007

SEQ ID NO: 461488 - RNA, 64 nt, Human; identical to SEQ ID NO: 117008

SEQ ID NO: 461489 - RNA, 64 nt, Human; identical to SEQ ID NO: 117007

SEQ ID NO: 461490 - RNA, 64 nt, Human; identical to SEQ ID NO: 117010

SEQ ID NO: 461491 - RNA, 64 nt, Human; identical to SEQ ID NO: 117011

SEQ ID NO: 461492 - RNA, 64 nt, Human; identical to SEQ ID NO: 117012

SEQ ID NO: 461493 - RNA, 64 nt, Human; identical to SEQ ID NO: 117013

SEQ ID NO: 461494 - RNA, 64 nt, Human; identical to SEQ ID NO: 117014

SEQ ID NO: 461495 - RNA, 64 nt, Human; identical to SEQ ID NO: 117015

SEQ ID NO: 461496 - RNA, 64 nt, Human; identical to SEQ ID NO: 117016

SEQ ID NO: 461497 - RNA, 64 nt, Human; identical to SEQ ID NO: 117017

SEQ ID NO: 461498 - RNA, 64 nt, Human; identical to SEQ ID NO: 117018

SEQ ID NO: 461499 - RNA, 64 nt, Human; identical to SEQ ID NO: 117019

SEQ ID NO: 461500 - RNA, 64 nt, Human; identical to SEQ ID NO: 117020

SEQ ID NO: 461501 - RNA, 64 nt, Human; identical to SEQ ID NO: 117021

SEQ ID NO: 461502 - RNA, 64 nt, Human; identical to SEQ ID NO: 117022

SEQ ID NO: 461503 - RNA, 64 nt, Human; identical to SEQ ID NO: 117007

SEQ ID NO: 461504 - RNA, 64 nt, Human; identical to SEQ ID NO: 117024

SEQ ID NO: 461505 - RNA, 64 nt, Human; identical to SEQ ID NO: 117025

SEQ ID NO: 461506 - RNA, 64 nt, Human; identical to SEQ ID NO: 117026

SEQ ID NO: 461507 - RNA, 64 nt, Human; identical to SEQ ID NO: 117027

SEQ ID NO: 461508 - RNA, 64 nt, Human; identical to SEQ ID NO: 117028

SEQ ID NO: 461509 - RNA, 64 nt, Human; identical to SEQ ID NO: 117029

SEQ ID NO: 461510 - RNA, 64 nt, Human; identical to SEQ ID NO: 117030

SEQ ID NO: 461511 - RNA, 64 nt, Human; identical to SEQ ID NO: 117031

SEQ ID NO: 461512 - RNA, 64 nt, Human
uucggcaucugaggagcagcugcagcaaaaucuagggguguaaguguaucaggacuuaugugac

SEQ ID NO: 461513 - RNA, 64 nt, Human
uacugccacuucuuuuuaggagcaaaucuccccagggguguacgguauuucuugacucugggaa

SEQ ID NO: 461514 - RNA, 64 nt, Human
uggguuaggaguauccuuucuggagacugagaaagggguguauuuaauuccaucagguccagua

SEQ ID NO: 461515 - RNA, 64 nt, Human
agccagauauaccaaagcgguuuacucagagucagggguguagcucuggcugccugucagcucc

SEQ ID NO: 461516 - RNA, 64 nt, Human
cuucccuucaugccuaucaggaagccucuaaaaugggguguaggaucuggccagaaacacugua

SEQ ID NO: 461517 - RNA, 64 nt, Human
gcucagguucacacuucugcuuugagaccaggaugggguguaagccauagaguaagguuaacaa

SEQ ID NO: 461518 - RNA, 64 nt, Human
aucuauuacaggaaugugacuuuuccuucucuuagggguguacaacucuaaaaacuuuuuacuu

SEQ ID NO: 461519 - RNA, 64 nt, Human
uugccccaagacugagcaggucugcccuuucauugggguguauacauaucaggggacccugagg

SEQ ID NO: 461520 - RNA, 64 nt, Human
agcugguuaguaaaccucaugugggggugggguggggguguauuccuugggggaugguuugggc

SEQ ID NO: 461521 - RNA, 64 nt, Human
gaagcaugaaaaaugagcaggggccuggaucagugggguguauucagagcaccucuccagaugc

SEQ ID NO: 461522 - RNA, 64 nt, Human
acaaaaaaaauaaaugaccaguuuuguguugggggggguguauggugcugguuacuuuuccgca

SEQ ID NO: 461523 - RNA, 64 nt, Human
guaauuaccuuuguguuuccagaacacuauaauugggguguaucuuaauucaguuaaauauuau

SEQ ID NO: 461524 - RNA, 64 nt, Human
aacauuuuugaagauuuauucuuuuuguguugcugggguguauacauuuaugucuuugugaaau

SEQ ID NO: 461525 - RNA, 64 nt, Human
ggaaaccagggaagcauagaccuauaguacaacagggguguagugaccacuggaccugaugaag

SEQ ID NO: 461526 - RNA, 64 nt, Human
gagauuucuuucagcuuuugcucagcuuuauggugggguguacuguuuuaucugggcggugagg

SEQ ID NO: 461527 - RNA, 64 nt, Human
gacccaccccugaauaaaccucaauugcuggagugggguguaguuauuaaagggaugcuuuuua

SEQ ID NO: 461528 - RNA, 64 nt, Human
augacuaaaugaucacuuuggaggcagggugguggggguguauuagcagccaaauaagcacauc

SEQ ID NO: 461529 - RNA, 64 nt, Human
aaaauguacugauugggauuugaguggacauugugggguguauuucuggauacccucaagaucu

SEQ ID NO: 461530 - RNA, 64 nt, Human
ggcuguaacaaaucauguuagaugguuuucaguugggguguagaaauaggaagaugcaaaggaa

SEQ ID NO: 461531 - RNA, 64 nt, Human
ggacucccuucuguaaacugccuauuugcuuaucgggguguauuggaacacgcaauguccuucg

SEQ ID NO: 461532 - RNA, 64 nt, Human
aaaaaaaaaaaaaaugaaauaguugaaaaacucugggguguaaacaaaugauuguaacccuaca

SEQ ID NO: 461533 - RNA, 64 nt, Human
cggcugccagcccgucccuugggauccuuccccugggguguagccuuguucauuaguauauacu

SEQ ID NO: 461534 - RNA, 64 nt, Human
ucaauucuuuguuggcuuucuucuugauucuguggggguguauaacaagccugaaggacauugu

SEQ ID NO: 461535 - RNA, 64 nt, Human
gagcuugugcucaggaguccagccguccagccucgggguguagguuucugaggugugccauugg

SEQ ID NO: 461536 - RNA, 64 nt, Human
gagguguuuggaggagguaccagccauauaauaggggguguaugugugaauuuuguuuaaacuc

SEQ ID NO: 461537 - RNA, 64 nt, Human
aucaaagaggucauaagaauuuauuuucuuuugugggguguaacuacuagcuuuagauuacccc

SEQ ID NO: 461538 - RNA, 64 nt, Human
aaacacacacacauucuuaaggcaauaaaacuaggggguguauauuaucuucuggugcauguuc

SEQ ID NO: 461539 - RNA, 64 nt, Human
aaacuacuuuccaugaguaaauugguccuugguggggguguaucauauuuuuaacuuacugaga

SEQ ID NO: 461540 - RNA, 64 nt, Human
aaacuggacaccuugguugucagguuagaaggaugggguguaggguugguaagaaaagaauuca

SEQ ID NO: 461541 - RNA, 64 nt, Human
guuugcaaaauaauuuggcucccaaacucuuguugggguguaguguuugcuaggagcccaggau

SEQ ID NO: 461542 - RNA, 64 nt, Human
uucucagauuauugugagaagggucagguuggaagggguguaggaagaggggugagggguaguu

SEQ ID NO: 461543 - RNA, 64 nt, Human
aagguugagguauauaugauuuuuaacuguauuagggguguaugaaccaguuuaaaaacgaggu

SEQ ID NO: 461544 - RNA, 64 nt, Human
cuugagugacauugaccucauggcaccucagccagggguguagccaaguagguaagcacugaac

SEQ ID NO: 461545 - RNA, 64 nt, Human
gacauuguggguuuggggcucagagucgagggacgggguguagccucggcauuugcuugaguuu

SEQ ID NO: 461546 - RNA, 64 nt, Human
aaaagccugagaaaccaaacacagcuaaugcuaugggguguaugaauaugucaaguuuagguca

SEQ ID NO: 461547 - RNA, 64 nt, Human
aaacacaaagacauuagaauaccuagguucacuggggguguaugggguagauggguggagaggg

SEQ ID NO: 461548 - RNA, 64 nt, Human
caccaggacuaaugauuuuuauaaaccguuuucugggguguaccaaaaacauuugaauagguuu

SEQ ID NO: 461549 - RNA, 64 nt, Human
ucuggaucgaugugaucuuauugcauguuuccaugggguguaccuauacuuuaagccaauccug

SEQ ID NO: 461550 - RNA, 64 nt, Human
aguaagggagcaacacguaaaaugggagaggagugggguguacucacuugccuccucuuuuguc

SEQ ID NO: 461551 - RNA, 64 nt, Human
cccagcucuucaccccccaaucucuugguggggagggguguaccuaaauauuuaucauauccuu

SEQ ID NO: 461552 - RNA, 64 nt, Human
ugcuuuguuaaaugugaccuugacuggcuuuacagggguguagaauguaaucuacacaagguga

SEQ ID NO: 461553 - RNA, 64 nt, Human
gaaaucccuccugauuguagauuuccuaacaggagggguguaaugugacauuguucauacuugc

SEQ ID NO: 461554 - RNA, 64 nt, Human
accaauaaugaagaaagcacuaggagcucuuuuggggguguaguggugcccccacaugaacaug

SEQ ID NO: 461555 - RNA, 64 nt, Human
ggguaaaaugcugucauaggggcagcagucucaggggguguaaacucuggaauccacuaugguu

SEQ ID NO: 461556 - RNA, 64 nt, Human
gucccucuggugguuggggauggagcggcagcaagggguguaauggggcuggguucugucuucu

SEQ ID NO: 461557 - RNA, 64 nt, Human
gguuggccuuguggccucugggcuguaugccucugggguguagggaagaggcgggaggagucau

SEQ ID NO: 461558 - RNA, 64 nt, Human
uuacugcagaaccugccaagucugucaucacugugggguguagccugccucagagggaccugca

SEQ ID NO: 461559 - RNA, 64 nt, Human
uccaacagaagaaacagaaaucuuuuaucacagagggguguaggcgugaguuuuaggugaauuu

SEQ ID NO: 461560 - RNA, 64 nt, Human
gacaaggaaccugcagaauguggacaugaagauugggguguaacaccuacaccauuaucuugga

SEQ ID NO: 461561 - RNA, 64 nt, Human
cccugggcauugcuuuccacugagguuggggguugggguguacuaguuacacaucuucaacaga

SEQ ID NO: 461562 - RNA, 64 nt, Human
cugugagccgccaggaacccuccuccugucaauggggguguaguauuuuugccaaaauaucaug

SEQ ID NO: 461563 - RNA, 64 nt, Human
aagggacagugggcagguccucacucaggagugggggguguaggcuggccagcccccagggcuu

SEQ ID NO: 461564 - RNA, 64 nt, Human
gggccugcaugaggucccugucaguauacacccugggguguaccccaccccuucccacuuuaau

SEQ ID NO: 461565 - RNA, 64 nt, Human
agaagucccuaggagggaaggagcuguuggggcagggguguaaauuauuuccuuuuucuaguuu

SEQ ID NO: 461566 - RNA, 64 nt, Human
gauuuccugaaaguuuacaaugcaguagcauuuugggguguaggguggcagcuccccaaggccc

SEQ ID NO: 461567 - RNA, 64 nt, Human
cccagguuugaaaggccaucagauuagcagggacgggguguagggcaucacccaagguuccuuc

SEQ ID NO: 461568 - RNA, 64 nt, Human
guaagggauguccuaagagcugcacccuggagaugggguguaggaagaaguggcuuccuuugga

SEQ ID NO: 461569 - RNA, 64 nt, Human
guagggcagagaggagggcuugcucaucugaacagggguguauuucauuccaggcccucagucu

SEQ ID NO: 461570 - RNA, 64 nt, Human
gaugggaugguaccuccuaggaguacaagugccugggguguaaugagcuccugcucauuguggc

SEQ ID NO: 461571 - RNA, 64 nt, Human
auagaaaaucuaaacuaauuuaguuauccauugggggguguauuuacugugaugaagaugagac

SEQ ID NO: 461572 - RNA, 64 nt, Human
agccugaccugagaguccguacucggcuuccugugggguguagguucucgcgauucaggacguc

SEQ ID NO: 461573 - RNA, 64 nt, Human
auuuuuguuucaaagaaacaucucaauacacuuagggguguauuguuucccacauauuaaguca

SEQ ID NO: 461574 - RNA, 64 nt, Human
guuugcaaaaugguaagggggugucgggggggaugggguguauuuuguugcaaguuugugaggg

SEQ ID NO: 461575 - RNA, 64 nt, Human
uguggauuauauuuccuugauauuuuugagacuugggguguaauuguucagugguuuuugcuca

SEQ ID NO: 461576 - RNA, 64 nt, Human
aggcccaagugcccaaugcagacccucacugguugggguguagcugggucuacagucagacuuc

SEQ ID NO: 461577 - RNA, 64 nt, Human
agaugaagaagcugcaauucugccugggugccuugggguguauuuuacuuauaaccuguguguu

SEQ ID NO: 461578 - RNA, 64 nt, Human
augcacauugaguuuugucagguuuuguuuucaggggguguaccaagggcaaggacccucuggc

SEQ ID NO: 461579 - RNA, 64 nt, Human
auaggagcguuuuguuauuuuuacaaggcagaaugggguguaacaguugaauuaaacuuagcaa

SEQ ID NO: 461580 - RNA, 64 nt, Human
agcugacauuccagcugcugugaucaugaauuuggggguguacuguccugccugugcaucuucu

SEQ ID NO: 461581 - RNA, 64 nt, Human
gucugugacaagccuguggcucaccugccuguccgggguguaguacgcuguccuagcggcugcc

SEQ ID NO: 461582 - RNA, 64 nt, Human
augaacuguaucaaaaguauugguaauuguauaugggguguaccuguuuaucuguuaacuauua

SEQ ID NO: 461583 - RNA, 64 nt, Human
uuuugucacaagcuguagauaacagcaagagauggggguguauuggaauugcaauacauuguuc

SEQ ID NO: 461584 - RNA, 64 nt, Human
cccacccucccucuacacuugaggaccacaguuggggguguagggaccacccagacccugguug

SEQ ID NO: 461585 - RNA, 64 nt, Human
augaacuguauaaaaaguauuaguaauuguauaugggguguaccuguuuaucuguaacuguuau

SEQ ID NO: 461586 - RNA, 64 nt, Human
ugccaugucaccccugagcaugccugucuucccagggguguaccucuuggcuggcaaagcccaa

SEQ ID NO: 461587 - RNA, 64 nt, Human
aaaauacuugcuuaagaaagggaggggggugggagggguguagggagagggaagggagggaaac

SEQ ID NO: 461588 - RNA, 64 nt, Human
ggcaagacagaaaagugccugagcuggggaagccgggguguaacuuccugcugcacccugcgcc

SEQ ID NO: 461589 - RNA, 64 nt, Human
accacgggccacugcucacccacuggccccgagggggguguagacgccaagacucacgcaugug

SEQ ID NO: 461590 - RNA, 64 nt, Human
uagaaauuaaaccuuuuuucagcuuaaugacccagggguguauuuuugaaggacuugggagcuc

SEQ ID NO: 461591 - RNA, 64 nt, Human
cccacccugaccgccaggaugcuucugccauccagggguguagugaggacccacggggagccug

SEQ ID NO: 461592 - RNA, 64 nt, Human
acuaucuucauuucccacuuccccucucugauuggggguguauauuuuacaucuuuuuuucuuu

SEQ ID NO: 461593 - RNA, 64 nt, Human
ggucaagguggaaggggcuccccuagagaggguggggguguaguuacuucccaguuggccagaa

SEQ ID NO: 461594 - RNA, 64 nt, Human
cccaccuggcccugcccuggccgccacgcuggcugggguguagggccgggcagguggggcugag

SEQ ID NO: 461595 - RNA, 64 nt, Human
ccuuccagugcaaauccugcuccuuugauuuaaugggguguacuggggccaggggcugauucac

SEQ ID NO: 461596 - RNA, 64 nt, Human
agaagcagcagcauccugggggauggccgugcaugggguguacacucgcuauaggcauaggccc

SEQ ID NO: 461597 - RNA, 64 nt, Human
uuuuuucauagauguucugccacacaaagaacuugggguguaaggauaaggcaaaagcuccaau

SEQ ID NO: 461598 - RNA, 64 nt, Human
uagccaccaguggguguguggggcaguggcuguggggguguaagaaugacugcaacaggcacuu

SEQ ID NO: 461599 - RNA, 64 nt, Human
auccucccucauggcucuggcacaguguaauccagggguguagaugggggaacugugaauacuu

SEQ ID NO: 461600 - RNA, 64 nt, Human
ggacugcaccuugugaaggaaaaacaugcuuaaggggguguaaugaaaaugauguagacauuuu

SEQ ID NO: 461601 - RNA, 64 nt, Human
uuuauauuuuaaaguacuuugaguauuuuugggggggguguaaaugagugaucaguguacauug

SEQ ID NO: 461602 - RNA, 64 nt, Human
uuagaauagaaccaacccaaacuguguguaguuugggguguauacuucuauuucucuuccuaca

SEQ ID NO: 461603 - RNA, 64 nt, Human
gagguuuugcaucuguucaauagcagaggagagagggguguacugucuguggcccccagcaugg

SEQ ID NO: 461604 - RNA, 64 nt, Human
gucuuaccagcauccacucucccuuguccucccggggguguaucugagucagccaguggcuucu

SEQ ID NO: 461605 - RNA, 64 nt, Human
gucuuuccagcauccacucucccuuguccuucuggggguguaucacagucagccaguggcuucu

SEQ ID NO: 461606 - RNA, 64 nt, Human
acaggagaagcuccccagaguaggggagaagguugggguguagggccuuccacguggaacagac

SEQ ID NO: 461607 - RNA, 64 nt, Human
ugagaagacaugaacguuuucucuucaccgccgugggguguauugacuggucccccaugggcug

SEQ ID NO: 461608 - RNA, 64 nt, Human
uccgccccuuaaguagaucugaggcagacccuuggggguguaaaagagagucacagguacccca

SEQ ID NO: 461609 - RNA, 64 nt, Human
ucagaggcucagucuguugagucuguugugacugucuuaugaaucaaucuguugugccaacccu

SEQ ID NO: 461610 - RNA, 64 nt, Human
ccuuaaagguuaugggagggcaugagggaacacuucuuaugagaaaacauuuauaaacaaaaga

SEQ ID NO: 461611 - RNA, 64 nt, Human
uuucuuguaugucccauaaaaauauuuguguaauucuuaugaaacaggcugguagaggagguuu

SEQ ID NO: 461612 - RNA, 64 nt, Human
uaugguaugaccagugagagggauuuguguccuuucuuaugaaccuuccugauuuuuuaacuua

SEQ ID NO: 461613 - RNA, 64 nt, Human
gugaaguguuuacuaugugcaacgguauugaaguucuuaugaccacagaucaucaguacuguug

SEQ ID NO: 461614 - RNA, 64 nt, Human
uaggaaauauaccuuuagaaguaacucgcaccuuucuuaugauguuaagagaaacacuaguguu

SEQ ID NO: 461615 - RNA, 64 nt, Human
ccuuuuaccuaagaaauuuucugucagugccuuaucuuaugaagaaacagaaccucucuagcua

SEQ ID NO: 461616 - RNA, 64 nt, Human
guugauauuacauagaacggguauuccagacacuucuuaugaugaaaguccaaaaguggcaucc

SEQ ID NO: 461617 - RNA, 64 nt, Human
augcugaaaguacacugggaucacugggacacugucuuaugaagguuugcuugggaugaaaaag

SEQ ID NO: 461618 - RNA, 64 nt, Human
uuaaugauggauaaacuugugcugguguuuuggaucuuaugaugcugagcauguucugcacugg

SEQ ID NO: 461619 - RNA, 64 nt, Human
uaugccuuuguguauacacuuaucaaagcuauuuucuuaugaaaacgucccucucuccauacca

SEQ ID NO: 461620 - RNA, 64 nt, Human
uuuugcguauacguaacugcucaaagauuaugaaucuuaugaauguuaaccuuuccguuuauua

SEQ ID NO: 461621 - RNA, 64 nt, Human
uuuuuucagggcugauaggauaucauuaagagugucuuaugagacauuaguggauauacucaua

SEQ ID NO: 461622 - RNA, 64 nt, Human
cuuccauaguugucuuagccgaauccuuccauauucuuaugauuacuuggguuaaagcuucugu

SEQ ID NO: 461623 - RNA, 64 nt, Human
cuguuuuguccaauauugguaguacuuuuuugccucuuaugauuccucuagcagauaaauaaaa

SEQ ID NO: 461624 - RNA, 64 nt, Human
aaagccaagaaguuggucuuauccaguuaggucuucuuaugaagaguuuucauccagggauaua

SEQ ID NO: 461625 - RNA, 64 nt, Human
auauaugcuaaagcauuuugcauaugaaaaagcuucuuaugaauauuguuauuccuaggcaaac

SEQ ID NO: 461626 - RNA, 64 nt, Human
cuuucugaugaggcugccauauuuugagcaucaaucuuaugauaaacuauucuugucacuuggc

SEQ ID NO: 461627 - RNA, 64 nt, Human
ucuacacaauaagaaaagacaaaguccucgagauucuuaugaguuuuguuugaaaacucuuuca

SEQ ID NO: 461628 - RNA, 64 nt, Human
aauguauugaauuuuaaaauaaccaggcacucacucuuaugaauuaauaaacauuuggagguau

SEQ ID NO: 461629 - RNA, 64 nt, Human
ggucaaauguuuccauuuucaaauuauuuagaauucuuaugaguuuaaaauuuguaaauuucua

SEQ ID NO: 461630 - RNA, 64 nt, Human
cugaugguuagccccuugcugccugcuccaugugucuuaugagagcccguaguuacaguguccu

SEQ ID NO: 461631 - RNA, 64 nt, Human
gaaggcauaugcacagucaaggucacuuaaagggucuuaugaaacaauuugagccagagagcau

SEQ ID NO: 461632 - RNA, 64 nt, Human
gugugcuuacagugaggcgagauucaccauuguuucuuaugauugugcauuuuguuuuacuuau

SEQ ID NO: 461633 - RNA, 64 nt, Human
ucucucucagaacuuuuaucuauuacuuuuuucuucuuaugaguauguuuacucucagaguauc

SEQ ID NO: 461634 - RNA, 64 nt, Human
uggggggaagagugggagggggaguuaaauccagucuuaugaaguauuguuauuaaaugucuuu

SEQ ID NO: 461635 - RNA, 64 nt, Human
ugacaaguauaauaugugcaauaaucauuguuucucuuaugauuuaauucaacuaaaauucuac

SEQ ID NO: 461636 - RNA, 64 nt, Human
auauucaugcagcagcaguugacugaaaauuuauucuuaugagacguauaguauucauuuuuaa

SEQ ID NO: 461637 - RNA, 64 nt, Human
gagcauaccaguacucaguauagcauugaacauuucuuaugauuuuuaaaaguugcuaguacug

SEQ ID NO: 461638 - RNA, 64 nt, Human
caguggcuacaauauucacaaaauucuuauguucucuuaugaaaaauauacacuuuucauuuug

SEQ ID NO: 461639 - RNA, 64 nt, Human
acugaguggaaaucgccccuuuugaaggugccauucuuaugagccaaaaguuugucauuuaaaa

SEQ ID NO: 461640 - RNA, 64 nt, Human
auguauuuucccuuuauguaaaaauuagugaauaucuuaugaauuaaggcauuccucuuucccu

SEQ ID NO: 461641 - RNA, 64 nt, Human
aacagaaagguacuauuuuccaaauguuuuuccaucuuaugaauucagaagaagcuuggaacuu

SEQ ID NO: 461642 - RNA, 64 nt, Human
uuaguaguuccaauuuuauaucacaguuuuauuuucuuaugaaaucaaaaaaugcauugauacu

SEQ ID NO: 461643 - RNA, 64 nt, Human
cuuucuugauaucuggagauuucuagaguggaucucuuaugaaugaggaggaauguggaaaguu

SEQ ID NO: 461644 - RNA, 64 nt, Human
cuuugugcauauguuaaagcuuauuuuuauguggucuuaugauuuuauuacagaaauguuuuua

SEQ ID NO: 461645 - RNA, 64 nt, Human
ccuauaacagauguucaaaauucggccacagcucucuuaugaaggcagagucagauaaaaugau

SEQ ID NO: 461646 - RNA, 64 nt, Human
uccaauguauuccaagcuaagaaacuuacuugauucuuaugaaaucuugauaaaauauuuauaa

SEQ ID NO: 461647 - RNA, 64 nt, Human
acauuggaaaaugacaauaucaacaaaacuguauucuuaugaaaagaacuauuuguuacaauga

SEQ ID NO: 461648 - RNA, 64 nt, Human
uaauuugaagugagaagauacauggaaauugcccucuuaugacauguugauguuauaagcacaa

SEQ ID NO: 461649 - RNA, 64 nt, Human
caccugugguccauuguucauuuuaauucacauuucuuaugaaguaugguaacagggagggaga

SEQ ID NO: 461650 - RNA, 64 nt, Human
aagauggaagccuggacagaaaccuuggaagcccucuuaugagcgaauucaggaaaugaaagcu

SEQ ID NO: 461651 - RNA, 64 nt, Human
cuguacggugguguguuggagcuggcuuguaaugucuuaugagugacaaucguuaguuugagga

SEQ ID NO: 461652 - RNA, 64 nt, Human
gagcguguguggaagggggagagauauacuugagucuuaugauuaaugucuaaaccagaauuug

SEQ ID NO: 461653 - RNA, 64 nt, Human
ucaagugucuuaggguagaaaguaaaaaguugcuucuuaugaguugcuaaaggaaggcuucugu

SEQ ID NO: 461654 - RNA, 64 nt, Human
uauaauuugcacuuuugagacugguagcuaaccaucuuaugagugccaaugugucauuuaguaa

SEQ ID NO: 461655 - RNA, 64 nt, Human
acuucaguauccucauuaacauuugaaguugguuucuuaugaauauuucguggcuaaaaugauu

SEQ ID NO: 461656 - RNA, 64 nt, Human
ugugucugacggauaaguaguaucuuucucucuuucuuaugaacaaaacaaaacaacaacaaaa

SEQ ID NO: 461657 - RNA, 64 nt, Human
gaauuuuauuuaauuccuuuaaguguuagcagugucuuaugaaacguguauuuaccuaacguuu

SEQ ID NO: 461658 - RNA, 64 nt, Human
auauagacuacugaaaugucauuuuaguuauuuuucuuaugaccacauuguacaaaugaaucug

SEQ ID NO: 461659 - RNA, 64 nt, Human
cuuucaaugucacacacauaguauugaucagaaaucuuaugaaucauacauacacucaacaaac

SEQ ID NO: 461660 - RNA, 64 nt, Human
gaauguucuaucaaauauuuauuuaaauuguuaaucuuaugagaaccuuuuuauuuuuguacag

SEQ ID NO: 461661 - RNA, 64 nt, Human
auaauaaacuacacaaggaaagucagccacugugucuuaugaggaauuggaccuaauaaauuuu

SEQ ID NO: 461662 - RNA, 64 nt, Human
uugauuuuacccaauuugucuguagugaaaaaacucuuaugagcaaaaguauucaguaggaauu

SEQ ID NO: 461663 - RNA, 64 nt, Human
ggaaucucauuuuuaaauagucucuccaagugauucuuaugaacucuuuauguuuaaaaucaug

SEQ ID NO: 461664 - RNA, 64 nt, Human
aggcuggaacuuuuuucuuuuuuuucagcugaagucuuaugacuuuucaugagucaaaauuguu

SEQ ID NO: 461665 - RNA, 64 nt, Human
aucucacauagcuaauggaaguugcuuucugcuuucuuaugacuguuuuuauaaauaaacuguu

SEQ ID NO: 461666 - RNA, 64 nt, Human
uuuuccaggucuuaaacacugaauaucacacucuucuuaugacucuuguuagcgauucaaggac

SEQ ID NO: 461667 - RNA, 64 nt, Human
gggugggaaauaguguuggaauguguuugcacagucuuaugauauucagucucagucugcuaua

SEQ ID NO: 461668 - RNA, 64 nt, Human
ccgagaaagauuuaguaggaguguaaagugacauucuuaugaaacaagucaaaaaaguuuuuuu

SEQ ID NO: 461669 - RNA, 64 nt, Human
gccuuuucacaccaaauccaagaagccugugaugucuuaugaaccuuaugagaaaacuccgaag

SEQ ID NO: 461670 - RNA, 64 nt, Human
aaucuuaaauagauuucagcugaaaauaaucaguucuuaugaaaacaaauagagaaauaucagu

SEQ ID NO: 461671 - RNA, 64 nt, Human
guuuuaagaggggucaggcuggcagauaaaagucucuuaugaagcagauauaaauccaguaagc

SEQ ID NO: 461672 - RNA, 64 nt, Human
uauuggucuuuccagcuguuauaaucuaaaguauucuuaugaucuguguaagcucugaaugaac

SEQ ID NO: 461673 - RNA, 64 nt, Human
ucuuuccuuuuucuuccccauuuugccaucugucucuuaugauuuauaaggggaaaaaaacuug

SEQ ID NO: 461674 - RNA, 64 nt, Human
auaugagaggauacaaaaugucaucguuauccucucuuaugaacaacuguagucaaaauaaggu

SEQ ID NO: 461675 - RNA, 64 nt, Human
agauuuuuauuuaacuuagcauuuuagcaaguuuucuuaugaaaauaccuuugugcuuucuaag

SEQ ID NO: 461676 - RNA, 64 nt, Human
uuuaauuuggcuuuucuuauuuaaaauuccauuaucuuaugaauaagcacuugaaucaguuuuu

SEQ ID NO: 461677 - RNA, 64 nt, Human
uauauuucuuaauaaaauaauucucaaauuuguuucuuaugaaucaucucucaaaucuaguuag

SEQ ID NO: 461678 - RNA, 64 nt, Human
agacugaucaacuuugguagcuuuuuuguucagaucuuaugacacacuacucuucucaccguga

SEQ ID NO: 461679 - RNA, 64 nt, Human
uuuuuguauguguguuuuuucuuuuuuuuuaaguucuuaugaggaggggaggguaaauaaacca

SEQ ID NO: 461680 - RNA, 64 nt, Human
auugauaggaacccauuugauaaauuccuuaacuucuuaugauugucuuguugauuaaauuguu

SEQ ID NO: 461681 - RNA, 64 nt, Human
uuaaugccauuuaaauguaguuuuugugguuuaaucuuaugaguagauuguaaugaaaucauua

SEQ ID NO: 461682 - RNA, 64 nt, Human
cucagaguucaacauaugcuauaauuuagaauuuucuuaugaauccacucuacuuggguagaaa

SEQ ID NO: 461683 - RNA, 64 nt, Human
acagauuuuacauaaugccuacuucugguagaugucuuaugagauuguucugcuuuuucuaagu

SEQ ID NO: 461684 - RNA, 64 nt, Human
aacauuuguugcauuuuaaguaugagaugacugaucuuaugaauguuuuguagaaaauguuaua

SEQ ID NO: 461685 - RNA, 64 nt, Human
cagggugaaccacugauuuuaauuugccuaauuaucuuaugacaaguaucaaauuaagaugaca

SEQ ID NO: 461686 - RNA, 64 nt, Human
cuuauuuuuuccuucuugaagacuaguaguaacaucuuaugauuuagaguaaguugauuguaac

SEQ ID NO: 461687 - RNA, 64 nt, Human
cuaucauaguguugagagcguguguagugcugcaucuuaugacaaggggacagacaagcuggga

SEQ ID NO: 461688 - RNA, 64 nt, Human
guuugucugccaggauguauggaauguuucauacucuuaugaccugauccaucaggaucagucc

SEQ ID NO: 461689 - RNA, 64 nt, Human
cauuuuuauucuacaaaauaugucaugcauucuuucuuaugaauuguauauuuagaaaucuuuc

SEQ ID NO: 461690 - RNA, 64 nt, Human
aaacaaaaagucuauuuuuuaaaguaauguuuuuucuuaugagaaaaagguuuagauagaauug

SEQ ID NO: 461691 - RNA, 64 nt, Human
uauuuauauuacucaagagacaauauauaugaauucuuaugaaagugcuugagcuuuuaaccag

SEQ ID NO: 461692 - RNA, 64 nt, Human
agauuaucagauggugcuaaagaaagugugaagaucuuaugaaauagguggaugguaaguugaa

SEQ ID NO: 461693 - RNA, 64 nt, Human
gguggccuucuuauucccuagccuuugguccauuucuuaugauuuccuuuaaaggcaccaaauc

SEQ ID NO: 461694 - RNA, 64 nt, Human
ugggaaagucacuuuuccaguaugucuccuggccucuuaugaugagauuucuggucaaggagcg

SEQ ID NO: 461695 - RNA, 64 nt, Human
uuagaggaggggugaagauuggggccaguaucgaucuuaugaagcuggaggacuugugcagugc

SEQ ID NO: 461696 - RNA, 64 nt, Human
guaucugagggcugcuccccuuuuagaauuuaccucuuaugagcuccauguugcuucacucuau

SEQ ID NO: 461697 - RNA, 64 nt, Human
cauuuucugcagugaacuccaguaaagcuaagugucuuaugaaaucuaaacucauauauguaca

SEQ ID NO: 461698 - RNA, 64 nt, Human
acuaaggaggaagaaaggauccacuacuucuuguucuuaugaaugacucuagaaaaaucagaau

SEQ ID NO: 461699 - RNA, 64 nt, Human
uuauguaaauaagaacagguuuuggggaaaaaaaucuuaugauuucuggauugauaucugaauu

SEQ ID NO: 461700 - RNA, 64 nt, Human
augcaagggaauuaagagagguaauguguacuuuucuuaugauaagaucacucauaaaacaguu

SEQ ID NO: 461701 - RNA, 64 nt, Human
agaagcaugcacugccugaguguauauuuuggauucuuaugagccagucuuuucuugaauuaga

SEQ ID NO: 461702 - RNA, 64 nt, Human
ccaguauucuguuucacgcuuagauggaaauguaucuuaugaauagagacauauuaaaauaaug

SEQ ID NO: 461703 - RNA, 64 nt, Human
auugcagaaaagcaagaaauauuuauguagaaguucuuaugaaaacuuauugaauuuaauuuug

SEQ ID NO: 461704 - RNA, 64 nt, Human
aaaaguaggcaaaugugaaaauaguuucaauauaucuuaugauuucuuaauguaaaauguuuug

SEQ ID NO: 461705 - RNA, 64 nt, Human
gaaugagcacaaugaaaugccgccuacugaugcuucuuaugaucagaacucuuuuuuaauaaaa

SEQ ID NO: 461706 - RNA, 64 nt, Human
uuaaagaaggauguaacuuauaacauuuuuuuucucuuaugaauucuauugagagauauuauaa

SEQ ID NO: 461707 - RNA, 64 nt, Human
ugcauuuuacaguuccaguaucaaauauuuauaaucuuaugagaaaugaaugaauguuucuauu

SEQ ID NO: 461708 - RNA, 64 nt, Human
gucuggguguuuuauuugcagagaacaagaugugucuuaugagucuucuuucucaauaccugcc

SEQ ID NO: 461709 - RNA, 64 nt, Human
uaagcauggaauuuaccaugcaguugugcuauguucuuaugaacagauauaucauuccuauuga

SEQ ID NO: 461710 - RNA, 64 nt, Human
auauugcuuuucuuuuaagugacaauuugacuauucuuaugauaagcacaugagagugucuuac

SEQ ID NO: 461711 - RNA, 64 nt, Human
uuuuauggaugcagacaauccaugcacaaccacuucuuaugauacuaguuuauuuccuuaaaua

SEQ ID NO: 461712 - RNA, 64 nt, Human
ucauuaaaggacacucuugaguauuaguaaacccucuuaugaugauuaaaagagaagggcagcc

SEQ ID NO: 461713 - RNA, 64 nt, Human
uguguauucaucucagcgugaauaccucagccagucuuaugaauaggaggcuauguaugggcag

SEQ ID NO: 461714 - RNA, 64 nt, Human
ucuguucuuggaauacagugcccuaaaaugguguucuuaugaccugcagaaaauauuuacacau

SEQ ID NO: 461715 - RNA, 64 nt, Human
gcccuugacgugcuuggaccaauauuuccuuccuucuuaugaaccagguuuuuccuucugauuu

SEQ ID NO: 461716 - RNA, 64 nt, Human
accuacuacgcagagggaauuuuucccugcugcuucuuaugaaaguggccagguuuauuauuag

SEQ ID NO: 461717 - RNA, 64 nt, Human
cuuuaucagugauggucucacagagccaacucacucuuaugaaaugggcuuuaacaaaacaaga

SEQ ID NO: 461718 - RNA, 64 nt, Human
aauuuucucauauacaguauucagugcacagaaaucuuaugauuggcucaaguacaguaaguua

SEQ ID NO: 461719 - RNA, 64 nt, Human
gaagaauaauauuugcuacauauuucacagggguucuuaugaagguaaauuuaccagauuaaua

SEQ ID NO: 461720 - RNA, 64 nt, Human
auaguuuugguaugcgauacagacagcuaacuuuucuuaugaaaaauacauauuugcauguaaa

SEQ ID NO: 461721 - RNA, 64 nt, Human
uaagcacagacaauucuaaugguaacuuuuguagucuuaugaauagacauaaauuguaauuugg

SEQ ID NO: 461722 - RNA, 64 nt, Human
uuacccuuuuuuuuuuuuuaaauuuuguagccauucuuaugaugcucuugauuuguugguuaca

SEQ ID NO: 461723 - RNA, 64 nt, Human
uacacugcacauuuaagggagagucccuccccuaucuuaugaguuaaaaaagacuucacuaggu

SEQ ID NO: 461724 - RNA, 64 nt, Human
uauucaauuugaggaacuuggugaaagccccuccucuuaugacagccagguuccugcuggcuag

SEQ ID NO: 461725 - RNA, 64 nt, Human
aaaagcauggcuagauuuacuucaguauaaauuaucuuaugaaaaccaaauuuuaaaagccaca

SEQ ID NO: 461726 - RNA, 64 nt, Human
gguuccccucagaaaaaaauucaugauacucauuucuuaugaaucuuuccagggauuuuugagu

SEQ ID NO: 461727 - RNA, 64 nt, Human
aauaacuugagaugauggcuagcuuuguuuaaugucuuaugaaauuuucaugaacaauccaagc

SEQ ID NO: 461728 - RNA, 64 nt, Human
gguuuucuugaugggaauucaauagcuuguaaugucuuaugaagaccuauuaaaaaaauacuuc

SEQ ID NO: 461729 - RNA, 64 nt, Human
ccucaugcaaguuuagacaaguggauuuauacugucuuaugagugcccgccccugauauauuac

SEQ ID NO: 461730 - RNA, 64 nt, Human
ugugaaaugaaauuuuuggcucuugagaaagaauucuuaugaauuguuaugcgaauuuuauaua

SEQ ID NO: 461731 - RNA, 64 nt, Human
aagcgcagggcccaaauguuauagccaaagaaagucuuaugauaaaagugaggcaaauuucagc

SEQ ID NO: 461732 - RNA, 64 nt, Human
ugcuuucuucguacuaaaauuugauuccuuuuuuucuuaugaaaaacgaacucaguuuaaaagu

SEQ ID NO: 461733 - RNA, 64 nt, Human
ugccuucuugacaucaaugaaaaguagcauauucucuuaugaaauagcaugagaaaacacaggg

SEQ ID NO: 461734 - RNA, 64 nt, Human
uauuaauguuuguagcuuuuuauauuuguacauuucuuaugagcuuuguuuauauacccauuac

SEQ ID NO: 461735 - RNA, 64 nt, Human
acgaauaugaagcuuagcacagcucuaguuacauucuuaugauauggcauuaaauuauuuccau

SEQ ID NO: 461736 - RNA, 64 nt, Human
acugaauucugcuaguccaguagcaaugucuuccucuuaugaccagaguucugugcauaacagg

SEQ ID NO: 461737 - RNA, 64 nt, Human
gcaaaagcuagacucuccucgugucuacggcaucucuuaugaucauuggcugccauccaggacc

SEQ ID NO: 461738 - RNA, 64 nt, Human
gaaacaccucauuagcugaguguagagaagugcaucuuaugaaacagucuuagcagugguaggu

SEQ ID NO: 461739 - RNA, 64 nt, Human
uuguauuuccuuguguguaaaauguucauucauuucuuaugaccacuuguuaagaggaacugau

SEQ ID NO: 461740 - RNA, 64 nt, Human
ugagaaaaagcauacuuaguacuccuguauuuguucuuaugaaaugacuaucugccuucuugua

SEQ ID NO: 461741 - RNA, 64 nt, Human
gaaaacuuuuguaaauuauugaugauuuuguaauucuuaugacuaaauuuucuuuuaagcauuu

SEQ ID NO: 461742 - RNA, 64 nt, Human
auagggaacucuguaggcugagccacuguccugcucuuaugacauuauaucuugugccuuucuc

SEQ ID NO: 461743 - RNA, 64 nt, Human
ggucagguauuugguuuacuuauauuuaacaaugucuuaugaauuuuuuuuacuuuaucuguua

SEQ ID NO: 461744 - RNA, 64 nt, Human
gcagaguauuacuauaguuaauuuucuaggguucucuuaugaaaaguauauguaaacacauuca

SEQ ID NO: 461745 - RNA, 64 nt, Human
aaagcauuaguaaaaaucuaacaauaugaagggcucuuaugagucauuuuuuucaaaagaugaa

SEQ ID NO: 461746 - RNA, 64 nt, Human
guagauuuuuauuuucuacuuuugauuauuaacaucuuaugaaaaaaauauuuuaaaaaaccca

SEQ ID NO: 461747 - RNA, 64 nt, Human
auuucauacaucaaaucuaugaucucccuuauauucuuaugaugaggcuaaauaaaagucuaau

SEQ ID NO: 461748 - RNA, 64 nt, Human
acaugacaaacagggugaucuguuguacacacuaucuuaugagggagauggugacuucuccuuu

SEQ ID NO: 461749 - RNA, 64 nt, Human
uauguuggaaugaagugaaaaguaaaauggccauucuuaugaaccuacaaaauguuuguggcuu

SEQ ID NO: 461750 - RNA, 64 nt, Human
uugucaccauauggccaauuugcaacaaugggacucuuaugaaaaaccuuuauuuaggccuucu

SEQ ID NO: 461751 - RNA, 64 nt, Human
aauucaaacugcauuugcaaaaugugcaaagaccucuuaugagggaccaauucaggucccuuau

SEQ ID NO: 461752 - RNA, 64 nt, Human
uuuggauguacagaucgacuacagaguacuuuuuucuuaugaugauugguguagaaauguguga

SEQ ID NO: 461753 - RNA, 64 nt, Human
ucuuuuucacuuugagcuuugggaaaacucuuuaucuuaugaggcuguauuccucaauaccuaa

SEQ ID NO: 461754 - RNA, 64 nt, Human
ccucugccccagccagccacacagagaagcaaauucuuaugacuuuugacuguaaugacaucug

SEQ ID NO: 461755 - RNA, 64 nt, Human
aggggaaauuuuucaaaaauugaauuuuaaaauuucuuaugauuuuaaauaccuugacauugau

SEQ ID NO: 461756 - RNA, 64 nt, Human
uuugaguaggcaacauaacuaaauuuuucuaguuucuuaugauacagguucauaaacuacaaua

SEQ ID NO: 461757 - RNA, 64 nt, Human
agucuacaugcaagacuaguaaagucuuauggagucuuaugauggauuuuuaacuucccgugga

SEQ ID NO: 461758 - RNA, 64 nt, Human
aaaagaagauauugcauuuuuaagaguuuaaaaaucuuaugagugagaaauauuaaaaaaaucu

SEQ ID NO: 461759 - RNA, 64 nt, Human
gcaccucgagcuaugcaaccucuguucuuguauuucuuaugaucucugauggguucuucucgaa

SEQ ID NO: 461760 - RNA, 64 nt, Human
cacccugacccacagcgucaccccacucccucugucuuaugacuccccuccccaacccccucau

SEQ ID NO: 461761 - RNA, 64 nt, Human
ucuguguaaugagugaugcuauggcuugcucgugucuuaugauccaauccuuuucuacaucagc

SEQ ID NO: 461762 - RNA, 64 nt, Human
uuuuuuagaaacuaagagaaugauaggcuuuuguucuuaugaacgaaaaagagguagcacuaca

SEQ ID NO: 461763 - RNA, 64 nt, Human
ugaugggggugaggagacuguugggcccuuauucucuuaugaaaaucuguuucuacaaggacua

SEQ ID NO: 461764 - RNA, 64 nt, Human
ucuguaaugcagaugauauaaugcccacuugugcucuuaugaaguuaacuguucacagaugcca

SEQ ID NO: 461765 - RNA, 64 nt, Human
auaaucuuauuuaaucuucacaccaaaacuguauucuuaugaauauacgcuaaaagauuaagua

SEQ ID NO: 461766 - RNA, 64 nt, Human
cguggccgccccuggaccagugaugacugaugaaucuuaugagcuucugauugaucucgggguc

SEQ ID NO: 461767 - RNA, 64 nt, Human
gaaaaaagggagaaauauuaaucagaaaguugauucuuaugauaauauggaaaaguuaaccauu

SEQ ID NO: 461768 - RNA, 64 nt, Human
auaccugcuguuucugaauuugauggaacauguuucuuaugacaguugaagcuuaugcuaaucu

SEQ ID NO: 461769 - RNA, 64 nt, Human
ucaaccuaauguucuuacacuguguuuuuugacuucuuaugaucccuaauucugagacuuacuc

SEQ ID NO: 461770 - RNA, 64 nt, Human
ccuccaaagcaugugcuaguggcaagacagugguucuuaugauguuuucccuuaacuuuuccuu

SEQ ID NO: 461771 - RNA, 64 nt, Human
acugcaucuaguuaaaauuuguaacaaauagcccucuuaugagucucauuuaugcccuuuucuu

SEQ ID NO: 461772 - RNA, 64 nt, Human
gggaaauauuagcaaaaugcauguaguaaagacaucuuaugaaaacuguauucauggaauuuga

SEQ ID NO: 461773 - RNA, 64 nt, Human
uaaaaaaucuggcacaaaacauuguuauguaaugucuuaugaugugugccucucccucccccaa

SEQ ID NO: 461774 - RNA, 64 nt, Human
gcugauaugacccuguugucaccccagcugaauuucuuaugacccucccaaaccaaagcucaga

SEQ ID NO: 461775 - RNA, 64 nt, Human
uuuaagucaaaaacuaugcuuuaaaggaauuacaucuuaugaucaaauaacuuucaggauguau

SEQ ID NO: 461776 - RNA, 64 nt, Human
ucagucaaauuggcuucuuauuaaauacaauaauucuuaugaaaaucauaguacccuauuuuca

SEQ ID NO: 461777 - RNA, 64 nt, Human
uggcuuucuacaccaacucuaauccauaaacgggucuuaugacaucuaugaaguaguagcaaga

SEQ ID NO: 461778 - RNA, 63 nt, Human
auaguccaacauuuuuuaaacaauaaacugcuugucuuaugaccauguguuagauuuauuuac

SEQ ID NO: 461779 - RNA, 64 nt, Human
guguauuuuagaaacaauuauuuuucccauuauuucuuaugagauuaguuguuucaaguaggag

SEQ ID NO: 461780 - RNA, 64 nt, Human
gcaauauuucucugaguagcuucugcuaugauauucuuaugaagaaaaggggcaacuuucuguc

SEQ ID NO: 461781 - RNA, 64 nt, Human
uuuaacccaccaaaaagucccuccaacagcaauaucuuaugaaagucuggcuguucucaauaau

SEQ ID NO: 461782 - RNA, 64 nt, Human
cagucugcguauaagggacugaaugugagguaacucuuaugaaucauaauaggcccagaaagcc

SEQ ID NO: 461783 - RNA, 64 nt, Human
augugcggaagauuuccuugaaaucuucucaagcucuuaugacucacuggggguuuaagagauc

SEQ ID NO: 461784 - RNA, 64 nt, Human
aguauuuuguaaauaaagaugauuuaaauaugaaucuuaugaguaaauuauuucaauuuuauuu

SEQ ID NO: 461785 - RNA, 64 nt, Human
aaagugguuugagauagugguauaagaaagcauuucuuaugacuuauuuuguaucauuuguuuu

SEQ ID NO: 461786 - RNA, 64 nt, Human
auagaaauagguuuuuaaccuaacaaggucugccucuuaugacgagaaugcaacagcuugguaa

SEQ ID NO: 461787 - RNA, 64 nt, Human
acauaauaaguuucauagguaacacauuauauucucuuaugauacuugagguaccaguuguauu

SEQ ID NO: 461788 - RNA, 64 nt, Human
aaagcacgugauggaaucugugaugucuaaugugucuuaugaaaauugccaaacaacugucccu

SEQ ID NO: 461789 - RNA, 64 nt, Human
gcuaugcucugauuguuccuuagaccacauauguucuuaugaagcagcauuaugcaaggggaaa

SEQ ID NO: 461790 - RNA, 64 nt, Human
auuugcacccuuacaaaaucuuuccaaaggucacucuuaugaauggauguugguuauacuuuua

SEQ ID NO: 461791 - RNA, 64 nt, Human
uggguguuaguuugcaguccugugugcuucccucucuuaugacugugucccugguugucaauaa

SEQ ID NO: 461792 - RNA, 63 nt, Human
acuggccaugccauaauguugaauaaaacucucuucuuaugagguucucucuuaacuucuuug

SEQ ID NO: 461793 - RNA, 64 nt, Human
gaacaucaugaaagcggcgucauguacuguguauucuuaugaaugguuucuuuccaucagcaua

SEQ ID NO: 461794 - RNA, 64 nt, Human
uguacuuuucccauuuguaauuuguaaaauguucucuuaugaucaccauguauuuuguaaauaa

SEQ ID NO: 461795 - RNA, 64 nt, Human
caaagcagaaaagggaggaagauccugaagauucucuuaugaagcuccaaaauugauaauccug

SEQ ID NO: 461796 - RNA, 64 nt, Human
uuauugauuucaguuugcaauuuuuaauuuauguucuuaugaugguuuaaaccuauagucaggc

SEQ ID NO: 461797 - RNA, 64 nt, Human
uuugggggugggagguggaaaaggaacccaauuuucuuaugaacagauauuuuuaacuuaaugg

SEQ ID NO: 461798 - RNA, 64 nt, Human
uuaugcagaguaucuuggaguuugguaauuuccaucuuaugauaauauauacuuugcauuugug

SEQ ID NO: 461799 - RNA, 64 nt, Human
aauuugugugcuguguacacaaaaacauaauguaucuuaugaaagcauuacccaaccuguuuga

SEQ ID NO: 461800 - RNA, 64 nt, Human
guuuuuuuauauuaguuuuauuuucuagaaaaugucuuaugaauuucuccuauuugcucuagca

SEQ ID NO: 461801 - RNA, 64 nt, Human
guuuuuuuauauuaguuuuauuuucuagaaaacgucuuaugaauuucucccauuugcucuagca

SEQ ID NO: 461802 - RNA, 64 nt, Human
guauucgugcauuuuuggaucauuuuuaacugauucuuaugauuacuaucauggcauauaacca

SEQ ID NO: 461803 - RNA, 64 nt, Human
cuuuucuccugauggagcauuacuggcuacugcaucuuaugauacucgaguauauaucugggau

SEQ ID NO: 461804 - RNA, 64 nt, Human
aacacagguuaucaaguucaucucucuugacuacucuuaugauagcugaugccacagagccuau

SEQ ID NO: 461805 - RNA, 64 nt, Human
aagaucuaaagccuuuuuaucccauaucccaaauucuuaugagccacucacagcaggcagcaua

SEQ ID NO: 461806 - RNA, 64 nt, Human
cuuauucuuauguuagucucuaaauuauuuuucuucuuaugaaaacuacaguguaacacagagu

SEQ ID NO: 461807 - RNA, 64 nt, Human
cucucuguuggccugcaaacacauuuacuucuccucuuaugagacuauuuaucuuuaauaaagc

SEQ ID NO: 461808 - RNA, 64 nt, Human
aucaaaauaaaggaugauaauagauauuauuuuuucuuaugacagaagcaaaugaugugauuua

SEQ ID NO: 461809 - RNA, 64 nt, Human
agcagugaaaugcaugcggucuauccguagguggucuuaugaaauguuucgaaaugaacgugca

SEQ ID NO: 461810 - RNA, 64 nt, Human
agcaauucuccagaggacuaucucacauaagucaucuuaugagcucacaggacaagaauauacc

SEQ ID NO: 461811 - RNA, 64 nt, Human
uguguaauaccaagagauugcacuguuuuccaauucuuaugaauauuaucagcaaugggcuacu

SEQ ID NO: 461812 - RNA, 64 nt, Human
uagacagcugguaaacugaagagcacaacuauauucuuaugaaggaauuuguaccuuuggggua

SEQ ID NO: 461813 - RNA, 64 nt, Human
cagcauugagagaauaaaaugucacuaccucucaucuuaugaacaggauaauauaauucuuuaa

SEQ ID NO: 461814 - RNA, 62 nt, Human
cacuuucaggaggcagauaaauaaaggccuuaucuuaugaaagcacacaagagccuccauac

SEQ ID NO: 461815 - RNA, 64 nt, Human
auaaugguaccccccaguaaacuuccuaaugauuucuuaugacuguuaucaggcuuuauuggga

SEQ ID NO: 461816 - RNA, 64 nt, Human
caucaggaccuuuaauaaaugaguuaaaaauuugucuuaugagacacaccuauuuaaguacaga

SEQ ID NO: 461817 - RNA, 64 nt, Human
gaugacauaaaaagcaaguguuuuccccauuuccucuuaugaaacaccgucugagcccaaggua

SEQ ID NO: 461818 - RNA, 64 nt, Human
uaauauucagcugugaucucacaagugugaaaaaucuuaugaauguaaaauguguggagauucu

SEQ ID NO: 461819 - RNA, 64 nt, Human
guggcucagucacaccuuugcugaaacacaguagucuuaugaaaagcacuggacacauacuuug

SEQ ID NO: 461820 - RNA, 64 nt, Human
aauaguuuugugcgcuaauuguuauuagaacguuucuuaugaauguguacauugcaguauauuc

SEQ ID NO: 461821 - RNA, 64 nt, Human
acauagauguauauauuguauagauuucagacucucuuaugaaaaaaaaugugauugugguuaa

SEQ ID NO: 461822 - RNA, 64 nt, Human
aaauaauaucucccaucauaauauaaaauauuuuucuuaugaauucuuaaaguacuaaagacua

SEQ ID NO: 461823 - RNA, 64 nt, Human
accuggcaauuccauauacaauguuaaacuugauucuuaugacauauuccuaugaaaauaauaa

SEQ ID NO: 461824 - RNA, 64 nt, Human
aguuccgauauguacccucgaaaugugaauguuaucuuaugagacucuguuuuauuuguaucca

SEQ ID NO: 461825 - RNA, 64 nt, Human
cgcuguguuagccuggauggucucgauuuucugaucuuaugauucacccaccucuaccucccga

SEQ ID NO: 461826 - RNA, 64 nt, Human
uuacacaggaagcgggauucgggucucuaagaugucuuaugaaugcaggucagagggucacaug

SEQ ID NO: 461827 - RNA, 64 nt, Human
uccaguugguacuuuuucacucccucuuagaaucucuuaugaaaaaaugaucagagagaaaagu

SEQ ID NO: 461828 - RNA, 64 nt, Human
aagcauuucuggcaaagaggaaaauaccgacuggucuuaugagaagcaguggccaagacuaccu

SEQ ID NO: 461829 - RNA, 64 nt, Human
cauuguguucagagaugauacagucagugccuguucuuaugaagcaaacauucuauaauaguag

SEQ ID NO: 461830 - RNA, 64 nt, Human
ugcccccaacucccggaggugucaccuuccuaguucuuaugagcuagcauggcccgggccuuau

SEQ ID NO: 461831 - RNA, 64 nt, Human
uacaaaugaaacuuaccuacacugaucuuaguucucuuaugaaaaaaauaagauguuaucccau

SEQ ID NO: 461832 - RNA, 64 nt, Human
auuccaugcuuuuaaguaguuuucuccaccuuuuucuuaugagucucacuagauugacugagga

SEQ ID NO: 461833 - RNA, 64 nt, Human
auucuugggcuuauagagccaguuagaucauaauucuuaugaaauagagaguguccuaaauauc

SEQ ID NO: 461834 - RNA, 64 nt, Human
gugacggcauugauugaacauuuuuuacuaguagucuuaugacuuuuguauuuuuuuuuuuuuu

SEQ ID NO: 461835 - RNA, 64 nt, Human
aaaaaaagcacagagaaauguuuaacuguuugacucuuaugauacuucuuggaaacuaugacau

SEQ ID NO: 461836 - RNA, 64 nt, Human
cugguuauuuuagggcaacaacccaguuggggagucuuaugaaucauuccagccaacucucuga

SEQ ID NO: 461837 - RNA, 64 nt, Human
cauuuauuaaacuuuggaucaaagauaaugugauucuuaugauugauuucucaaacuagcuuuu

SEQ ID NO: 461838 - RNA, 64 nt, Human
uaccuggaggcucaccuugcagaaccagugacaaucuuaugaguauaaugaacacucagccagg

SEQ ID NO: 461839 - RNA, 64 nt, Human
uuguacuugucucaggccaaaucuaugcugugguucuuaugagacuuguaugaagaugcccuga

SEQ ID NO: 461840 - RNA, 64 nt, Human
uuccugauuauuuuguuuauaauuuaauaauauaucuuaugagcccuauauauucaaaauauua

SEQ ID NO: 461841 - RNA, 64 nt, Human
gaauaugaaaaauacuguuucuucuauccaacucucuuaugaaaaggaacucuguauuuucuau

SEQ ID NO: 461842 - RNA, 64 nt, Human
uuuguuuuuaauugcucaaagcugucgccgcuagucuuaugagcuaucuacuaaaacuauggag

SEQ ID NO: 461843 - RNA, 64 nt, Human
uaucucgucuuuccuccuuagaagaacagaccuaacuagcgaauguaugaaugaaaaugcaucu

SEQ ID NO: 461844 - RNA, 61 nt, Human
gaaaaaguucgaagaaaugaaaccauuuuucacuagcgacagccacuuuuuacucucccuc

SEQ ID NO: 461845 - RNA, 64 nt, Human
auuuuuuauucuugugaauauguacauaggcagcacuagcgacauugcagucugcuucugcacc

SEQ ID NO: 461846 - RNA, 52 nt, Human
uuguucaauaucaaagcugaaaacuagcgaggucugcuguacugcuuauuga

SEQ ID NO: 461847 - RNA, 64 nt, Human
gauggaaagccaguaaagaagucaguauagaaccacuagcgaauaguguugcucuggcacagac

SEQ ID NO: 461848 - RNA, 64 nt, Human
aaacacauguuccgucuugauugccuuaagaguuacuagcgaggucaguguuaggcuugcaaua

SEQ ID NO: 461849 - RNA, 64 nt, Human
auaauucuauccuauugucacugaaguccuuguaacuagcgagugaauguguuccuguguccuu

SEQ ID NO: 461850 - RNA, 64 nt, Human
cuauauuuuaauacuguuccuaacauuucauuuuacuagcgagaaaucuuugauuucauuuuau

SEQ ID NO: 461851 - RNA, 64 nt, Human
ccaccggcagccguaagggaaaaggguguccagaacuagcgaccgggagagcuuuucuuuaacg

SEQ ID NO: 461852 - RNA, 64 nt, Human
uucucuuaacucagcuuuugcuacuuuggcaaaaacuagcgagggguagcagaaaccugcacca

SEQ ID NO: 461853 - RNA, 64 nt, Human
acagcucuuguggggcagcccaccuuagaaccugacuagcgagggaccuccgcugcaucucagc

SEQ ID NO: 461854 - RNA, 64 nt, Human
guccguucaggaccaugagccauccucugcccugacuagcgaggggcagagcacaccccagugc

SEQ ID NO: 461855 - RNA, 64 nt, Human
ugugcugagaacagagaggcccugcccucuguccacuagcgagaaucccuagcugccccagccc

SEQ ID NO: 461856 - RNA, 64 nt, Human
uccucucugcagagacgcgacuggcggcuccagcagggacuaccuuucuuauaaacccaggggg

SEQ ID NO: 461857 - RNA, 64 nt, Human
caugagggugcucuugugacuuaauuuuuguucaagggacuaaauugcuuauguuuauucccug

SEQ ID NO: 461858 - RNA, 64 nt, Human
aaucccaaccucaggugagcagagccucuacuugagggacuauuguuacuauaggaauccuuac

SEQ ID NO: 461859 - RNA, 64 nt, Human
cuguauguccagcacuuuguagccaugggaggaaagggacuauaaaaguguacaauguuaaugg

SEQ ID NO: 461860 - RNA, 64 nt, Human
cugcuuugcaaccugaucaccuugaguucugagcagggacuaggcuugcaggugagauaauggg

SEQ ID NO: 461861 - RNA, 64 nt, Human
uggggaggugaugucuucucucugcucagagagcagggacuaggguaggacccucaccgcugcg

SEQ ID NO: 461862 - RNA, 64 nt, Human
uuacuaaaugucaaaccaaacuuuuucucaaaccagggacuaucaucuaagauuaauuacagua

SEQ ID NO: 461863 - RNA, 64 nt, Human
agagguugggcagugagugagggaccccuaaugcagggacuagaagccucaguuuccccauuuu

SEQ ID NO: 461864 - RNA, 64 nt, Human
cgugugcgugugcauguguguaaaccccgugggcagggacuacagggaaggcuccuucauccca

SEQ ID NO: 461865 - RNA, 64 nt, Human
aagaaaucauguacaggaauaauaugcuaugcacagggacuaugcuccuuggcucaccccuucu

SEQ ID NO: 461866 - RNA, 64 nt, Human
gaagcucuucucuccaguguuucuacaaucagcuagggacuacuuaauaggugaguuaauuaug

SEQ ID NO: 461867 - RNA, 64 nt, Human
ggccaguuccugauuagaacacaggaccugugggagggacuaucagagaugcaaaaauuacuuc

SEQ ID NO: 461868 - RNA, 64 nt, Human
ucuguuuguuauaagauuggaaacaauuuuugagagggacuaauuuaaacaaguccuccuuuag

SEQ ID NO: 461869 - RNA, 64 nt, Human
uucuuagcccaugaaagagaucauugccugacccagggacuaccucaagggcuuuugaugagga

SEQ ID NO: 461870 - RNA, 64 nt, Human
gucuguaacuuuauuuauacuuaugaauauauccagggacuacuucucauugcugagcagcuuu

SEQ ID NO: 461871 - RNA, 64 nt, Human
guagcuguucagaagaauaaaauaugacuguuuuagggacuagaccaugugcuuuuuuaacacu

SEQ ID NO: 461872 - RNA, 64 nt, Human
guuugagcaacuuuuucauuuaauccagaaggguagggacuaugcaguguaagcugcaucacuu

SEQ ID NO: 461873 - RNA, 64 nt, Human
cuggagacuucuugcuggaaugaacagugugcucagggacuauuuggaacuggauguuuuugaa

SEQ ID NO: 461874 - RNA, 64 nt, Human
gaaaacucaauaccaucaucucuuaucucuauacagggacuagguaauaaaaccuucaaagguu

SEQ ID NO: 461875 - RNA, 64 nt, Human
aaccaagcaaauuaggaaccuugcaacgguauccagggacuaugaugagaggccagcacauuau

SEQ ID NO: 461876 - RNA, 64 nt, Human
cuagggacuaacuguugcucuuggugggcuuggcagggacuaggcugaagaugugucuucuccc

SEQ ID NO: 461877 - RNA, 64 nt, Human
ggauguguggguacuugguggggacggaggagcuagggacuaacuguugcucuuggugggcuug

SEQ ID NO: 461878 - RNA, 64 nt, Human
uugccugcaggaaugaagcaugacauaccuguugagggacuaggggagugguggggaggugagu

SEQ ID NO: 461879 - RNA, 64 nt, Human
ugacuaggucccaggauccccuugucccuggaguagggacuaacuauagcacaaaguaauaugu

SEQ ID NO: 461880 - RNA, 64 nt, Human
cccuagcuuguguguggccugccuccaccauagcagggacuagggagggaggcagggaacguuu

SEQ ID NO: 461881 - RNA, 64 nt, Human
agauugcuuugauuaauccagaauaacuagcaccagggacuaugaaugggcaaaacugaauuau

SEQ ID NO: 461882 - RNA, 64 nt, Human
cacugcccuuuaggcucccagggccagaggagccagggacuauuuucugcaccagcccccaggg

SEQ ID NO: 461883 - RNA, 64 nt, Human
cugggauuacaggcgugagccaccgcgccuggccagggacuauacucuuuuuaaaauagacauu

SEQ ID NO: 461884 - RNA, 64 nt, Human
acugugagaacccaguuucccguccaucucccuuagggacuacccauagacaugaaaggucccc

SEQ ID NO: 461885 - RNA, 64 nt, Human
auuugugcccagaccacaauauuucuucuuccucagggacuacaugccacagaccuguaucccc

SEQ ID NO: 461886 - RNA, 64 nt, Human
aauacugccauucuagguaggguuuuauuaucccagggacuaccucggcuuuuaauuuaaaaaa

SEQ ID NO: 461887 - RNA, 64 nt, Human
gcugggagcacccacaggucucugugggggagacagggacuauaacagggaggcagaauucagg

SEQ ID NO: 461888 - RNA, 64 nt, Human
uaagccuggacauuguuaaauagucccugcuuuaagggacuacgauaauguguacuaugacaaa

SEQ ID NO: 461889 - RNA, 64 nt, Human
caagcaguucucccaccucagccucucgacuaacagggacuauaaucuugcagcaccaugccga

SEQ ID NO: 461890 - RNA, 64 nt, Human
uauaaaugaggaggacagcaggccccaagaaaguagggacuaaguaugucuuguucaaaauugu

SEQ ID NO: 461891 - RNA, 64 nt, Human
uuuagaacuuuguauuuucggaaaguuaaauaacagggacuacguauuuuucugacuuuuacag

SEQ ID NO: 461892 - RNA, 64 nt, Human
auuuaucauuguuuaaugaauaguagaggugucaagggacuauguauacaugauuaggguaaga

SEQ ID NO: 461893 - RNA, 64 nt, Human
cccucagccagucgcuaugcagcacuuucggaccagggacuagacaucaaagcagcguuccaac

SEQ ID NO: 461894 - RNA, 64 nt, Human
cauagcugaccuuuuaugacaaggcaguuugaauagggacuauuguaauacccucacacauuau

SEQ ID NO: 461895 - RNA, 64 nt, Human
ggagccccacccccgccucuggauggaccgaaucagggacuagaguuuaacugcagcggaacau

SEQ ID NO: 461896 - RNA, 64 nt, Human
aucgccuggcccagcaggagcugcuucagccgagagggacuauuacccaagagagguauccuca

SEQ ID NO: 461897 - RNA, 64 nt, Human
uuuggguggauuuuuuuuucucaaaauaagcuguagggacuauuuuaacagcuuaaacaggagc

SEQ ID NO: 461898 - RNA, 64 nt, Human
uuucuccgcucuguggugcaauaucccuauuuguagggacuacaagaaauaacuuugaagggaa

SEQ ID NO: 461899 - RNA, 64 nt, Human
ucaaauugcagaaaaggcucaauauccaagagacagggacuaaugcacuguacaaucugcuuau

SEQ ID NO: 461900 - RNA, 64 nt, Human
ucaauacggugauauccuuauuugcuagcagaaaagggacuaacgucccauuccucuuuucugc

SEQ ID NO: 461901 - RNA, 64 nt, Human
acucagugccuccucggcuuccuuggaagcccagagggacuaugaucugauggccucuaggugu

SEQ ID NO: 461902 - RNA, 64 nt, Human
ggaaacagccaccgagaagguucuagcucuagaaagggacuaaacuuauucucucauccgaagu

SEQ ID NO: 461903 - RNA, 64 nt, Human
gcugggacaaccucucucuugccuuaccucagagagggacuaugcccugaccccuccuuucuga

SEQ ID NO: 461904 - RNA, 64 nt, Human
uuuugaacaauaauauacugguuugcuuuaaagaagggacuaaauaugacuuuaaagagacuuc

SEQ ID NO: 461905 - RNA, 64 nt, Human
aaggugacuucuugcugugcccacacauggugaaagggacuaccaacucucuggagucucuuuu

SEQ ID NO: 461906 - RNA, 64 nt, Human
caaaaaaaaaaaaaaagacugggaagagagcuagagggacuaggagauaauguguauguagguu

SEQ ID NO: 461907 - RNA, 64 nt, Human
caaauacguuguuaguagaaggucaauuuaaaauagggacuagaaauuauuugaaguuuucuuu

SEQ ID NO: 461908 - RNA, 64 nt, Human
ccccuaacagacagcugcugcuucuauuuugugaagggacuauauuuuuugagaaaggaaaauc

SEQ ID NO: 461909 - RNA, 64 nt, Human
uaagauccaggucaaauuccauuugacaaaucccagggacuauccaggaauuuuuuuuuaacug

SEQ ID NO: 461910 - RNA, 64 nt, Human
ucccaauggugugagucugacuuuggaaagaaaaagggacuaaagagaaauguaacaaacuuac

SEQ ID NO: 461911 - RNA, 64 nt, Human
agaaaccaagggggcugcugaggagaccuggugcagggacuaauccuggaucauuccuguauua

SEQ ID NO: 461912 - RNA, 64 nt, Human
agaaaguucuuuguuuggggaaguaaaauccuuaagggacuaaauuaaugcuugggugcauuaa

SEQ ID NO: 461913 - RNA, 64 nt, Human
aguuguacagaaauguguucaucaaaucuggucaagggacuaagcuccuagcugaccauucauu

SEQ ID NO: 461914 - RNA, 64 nt, Human
uucagacugugucuagcaguuacguccugcuuaaagggacuagaagucaaaguuccuugucuca

SEQ ID NO: 461915 - RNA, 64 nt, Human
cugaugauagauucccagagcuggauggaucccuagggacuaccuaaucugacuuucuguccac

SEQ ID NO: 461916 - RNA, 64 nt, Human
cuuuaaaaaauuccuuccuuuuaaaaaauauaaaagggacuacuguucauuccaguuuucuucu

SEQ ID NO: 461917 - RNA, 64 nt, Human
ggugggccuggccgagucccuccuuugugcucccagggacuauuuucuccucguaagccagcga

SEQ ID NO: 461918 - RNA, 64 nt, Human
cuagucccuggaggagggaguccggccccaggccagggacuaaggagcaaugaccauugugcac

SEQ ID NO: 461919 - RNA, 64 nt, Human
cacccacgaucuucuuugggcuuccauuuccaccagggacuaaaaucugcuguagcuagugaga

SEQ ID NO: 461920 - RNA, 64 nt, Human
uucuagagcagucaaggagacagcuaaucucucuagggacuauuuggugguuuaaaaaaagggu

SEQ ID NO: 461921 - RNA, 64 nt, Human
agaugucuuuuuacugugacugcacgugguggaaagggacuagcaagcuuaccccauucaugag

SEQ ID NO: 461922 - RNA, 64 nt, Human
cuuuacaccaucacugugauugcucugagaguugagggacuauugggcuuuauuuggacaaacc

SEQ ID NO: 461923 - RNA, 64 nt, Human
gcgggcucgcccauacccgugacaguggcugacaagggacuagugagucagcaccuuggcccag

SEQ ID NO: 461924 - RNA, 54 nt, Human
aguuuagaagcccgagguagguggagggacuagaggacuucuccagacaugauu

SEQ ID NO: 461925 - RNA, 64 nt, Human
uagguuguacagacuuauuuauaucaucguuuugagggacuaauggaggcuuauuguaacauau

SEQ ID NO: 461926 - RNA, 64 nt, Human
uggaauucuuggagagcauuccuuguaguuaagcagggacuacuguauucuguugagcuuucac

SEQ ID NO: 461927 - RNA, 64 nt, Human
uucacacgugacccguggggcagccaguccucccagggacuacauaacaggcaccuuugagaga

SEQ ID NO: 461928 - RNA, 64 nt, Human
gucggccucugcagccccuccaagcaagugcuccagggacuauccuguguuuguagcugcuucc

SEQ ID NO: 461929 - RNA, 64 nt, Human
aaugccaagucagcagauuugcuuuaugaauuacagggacuagaaaugcccacauucaggaaau

SEQ ID NO: 461930 - RNA, 64 nt, Human
aauucucuuacauccuucccaaaaaucagugucuagggacuaguugaucuggaugaguuauaca

SEQ ID NO: 461931 - RNA, 64 nt, Human
auugugaagaguaguuuuaccuguaaauauuagcagggacuaucaagagugaccuuugaagcaa

SEQ ID NO: 461932 - RNA, 64 nt, Human
uccacugcguguggucaaaguuccucacccagcaagggacuauagauacucgugucccaauucc

SEQ ID NO: 461933 - RNA, 64 nt, Human
auuguacuugcacauuggagacugaaaggaaagaagggacuaaaugcuggggagguaaauuaag

SEQ ID NO: 461934 - RNA, 64 nt, Human
agugcgggcuuugcugcucccuggcccaggaaagagggacuaccugacccucaccuggcacccc

SEQ ID NO: 461935 - RNA, 64 nt, Human
uuaauauuuuacagaccauauuaccuggauuaccagggacuaucuuugcugcagagaucaaggg

SEQ ID NO: 461936 - RNA, 64 nt, Human
gccauacaauaucaagcacccucccucuagguccagggacuaucacagaagaagcaggcaugua

SEQ ID NO: 461937 - RNA, 64 nt, Human
cuuaacagcuuggggaggugaccagugguucaggagggacuagacaauuaccuguccagugugg

SEQ ID NO: 461938 - RNA, 64 nt, Human
uaagcacaaagcaucuuccuuaaagcacaaagagagggacuaacugaugcugcaucuagaaaac

SEQ ID NO: 461939 - RNA, 64 nt, Human
ugccucccucgaaucaagugcuacauccaauaauagggacuaaacccacaucuguagcuucuga

SEQ ID NO: 461940 - RNA, 64 nt, Human
ggaagcccagggagguugagcagugagagagggaagggacuaacgugcuccggaaggguggagg

SEQ ID NO: 461941 - RNA, 64 nt, Human
auccccaggcaucucuggugucacugaggacagaagggacuagggcucuggcggggucuuugua

SEQ ID NO: 461942 - RNA, 64 nt, Human
uccgcuccuguagaagguagggagcacaauaccuagggacuaagggauguucgccgguuguggu

SEQ ID NO: 461943 - RNA, 64 nt, Human
cccugcucacucuucucucagccaaagccuccaaagggacuagagagaagccuccugcuccccu

SEQ ID NO: 461944 - RNA, 64 nt, Human
aagaaaagggaucugagaaaaguacucuuucaggagggacuagaaagagaagggggugauaugu

SEQ ID NO: 461945 - RNA, 64 nt, Human
ugaagaggaugcacugugauaccuaccagucuccagggacuaugacccuaaaccagggccugcg

SEQ ID NO: 461946 - RNA, 64 nt, Human
ccccauccaucuucccuacccuuccugccaagccagggacuaagcagcccagaagcccaguaac

SEQ ID NO: 461947 - RNA, 64 nt, Human
uuugcuugugaaaugaggcugggugggagcggggagggacuagaucagaagagaucaagggcuc

SEQ ID NO: 461948 - RNA, 64 nt, Human
ccaguauagagacuugguuggcaucuucugcugcagggacuaaaaguauuugacuggggcacau

SEQ ID NO: 461949 - RNA, 64 nt, Human
ccuucuuuaacaauaaaugucuuucacagacuuaagggacuauguacuacuguuaauaucucua

SEQ ID NO: 461950 - RNA, 64 nt, Human
guaacuggagaauugccaauacagccagagagaaagggacuacagcuuuuuagaggaaaaguug

SEQ ID NO: 461951 - RNA, 64 nt, Human
ugauuuccugcccuaaguccugugagaagaugucagggacuagggagggagggagggaaggcag

SEQ ID NO: 461952 - RNA, 64 nt, Human
augccauacgaaauuugaacguagcuuuggaaaaagggacuauuuguggaguaauggcauuaau

SEQ ID NO: 461953 - RNA, 64 nt, Human
caguguugucaugcauugguuagucaaaauggggagggacuagggcaguuuggauagcucaaca

SEQ ID NO: 461954 - RNA, 64 nt, Human
aggguggaggugauauggcauucugaaaguagggagggacuaagucagucaucauacuaaacaa

SEQ ID NO: 461955 - RNA, 64 nt, Human
agcuauuggucuguccuuuugacauacagcuaaaagggacuaaauuuguaaaaaauuaguuugu

SEQ ID NO: 461956 - RNA, 64 nt, Human
uuaauuuugagauauacgcccucuuucaucuguaagggacuaggaaauuccaaauggugugaac

SEQ ID NO: 461957 - RNA, 64 nt, Human
ccuuuaggccuuggguggcuggaaggcuuuguuaagggacuaggagaaauggggguaucuuucc

SEQ ID NO: 461958 - RNA, 64 nt, Human
ucauugaguuauuuccucauucuuuuaaaaaauaagggacuauaaaucaguuauguaguaucuu

SEQ ID NO: 461959 - RNA, 64 nt, Human
gaaggagaauacuggaagauaaugcacaaaaugaagggacuaguuaaggauuaacuagcccuuu

SEQ ID NO: 461960 - RNA, 64 nt, Human
ccuuucucuccguaaacuauuuagugagauuuuuagggacuauuuuucaguaucucuguaccug

SEQ ID NO: 461961 - RNA, 64 nt, Human
guguaccugacaguagucuaagaugagagaguuuagggacuacucuguuuuagcaagagauauu

SEQ ID NO: 461962 - RNA, 64 nt, Human
cucagccuggagaaauggugggggggcagugucuagggacuagagugagaaguaggggagcuac

SEQ ID NO: 461963 - RNA, 64 nt, Human
gugucagacugaagccccauccagcccguuccgcagggacuagaggcuuucggcuuuuugggac

SEQ ID NO: 461964 - RNA, 64 nt, Human
agggugccuucuagcuguguccucacaugacugaagggacuagcuaucucuguggggucuauuu

SEQ ID NO: 461965 - RNA, 64 nt, Human
gcagcagcccuucccacccagccaccuuccucacagggacuaggaggcucaguccccaacggcu

SEQ ID NO: 461966 - RNA, 64 nt, Human
aaacuuacccucuagggaugcaggugggauguccagggacuauagguuugggaaaaccauaccu

SEQ ID NO: 461967 - RNA, 64 nt, Human
cugguccgagaacgagccgaacacagcgcgacgcagggacuaggacggcccggugaccgcgcgg

SEQ ID NO: 461968 - RNA, 64 nt, Human
ccugacugccagauggugggacuuggucuggagcagggacuacuuggaaugauaaaggcaaaac

SEQ ID NO: 461969 - RNA, 64 nt, Human
guuuccuacagggagaugccuuggauccagguucagggacuaaauacacuuggcagcugaagau

SEQ ID NO: 461970 - RNA, 64 nt, Human
acuuggauaggguaggcugagggggcccuaagggagggacuaaggcuccaaggcaggucacuuu

SEQ ID NO: 461971 - RNA, 64 nt, Human
aaagccuuccucauaaguuauccccaagggguucagggacuacagaccauuaguacccaaguga

SEQ ID NO: 461972 - RNA, 64 nt, Human
acaacaaccuucagcucaacugacuugucuuuugagggacuaauuuacuuugcugcugacagcc

SEQ ID NO: 461973 - RNA, 64 nt, Human
uguaguguguauguccuuguaacacucuguuuucagggacuacaaccuuuuuccuucugugacc

SEQ ID NO: 461974 - RNA, 64 nt, Human
gcuccccagcccaggguucccccagcccuguggaagggacuaggagcacuguaguaaauggcaa

SEQ ID NO: 461975 - RNA, 64 nt, Human
cuaaccagagccaaauacuuuugaagaguuucccagggacuagucaugguaauagcauauaauu

SEQ ID NO: 461976 - RNA, 64 nt, Human
uuuuugcauuaaugaaguuugacuauauguguaaagggacuaaauauuuuugcaacagccuguu

SEQ ID NO: 461977 - RNA, 64 nt, Human
ucagagucaagggugacuuggggacuugguggagagggacuacguggaagaccuggggccagcc

SEQ ID NO: 461978 - RNA, 64 nt, Human
gugggggaacacugagaaagaggcagggaccuaaagggacuaccucugugccuugccacauuaa

SEQ ID NO: 461979 - RNA, 64 nt, Human
ugugugagucagugugcagcauuugaaaaccccaagggacuaauucaugguuguuccaaagaua

SEQ ID NO: 461980 - RNA, 64 nt, Human
uauuuugcucccuuccccccauuuuuguuuuaauagggacuaaugugggaagaacuggcuaauu

SEQ ID NO: 461981 - RNA, 64 nt, Human
uacaguuacuuuaagaaaaugggcagucagaauuagggacuagaauguauaugagaaaccccca

SEQ ID NO: 461982 - RNA, 64 nt, Human
cuuuauuaugguauaguuaggacuugauuguagaagggacuaaauguuccaacauaaucuuuac

SEQ ID NO: 461983 - RNA, 64 nt, Human
ggcagaguggucagggcugaagucggagaagcauagggacuaggcccaauccagccuggaaagu

SEQ ID NO: 461984 - RNA, 64 nt, Human
ggauggcugggaaauggagaucacugaaguacacagggacuaaccaaggagaugagggggucga

SEQ ID NO: 461985 - RNA, 64 nt, Human
cuaacuucagccucucaucugcugcuccgggcugagggacuagaggacaucucggucguuugag

SEQ ID NO: 461986 - RNA, 64 nt, Human
aaagaaggggaggauccuccuauguuguugaaggagggacuagggggagaaacugaaagcugau

SEQ ID NO: 461987 - RNA, 64 nt, Human
acccuucaucccuggcugccggucccauccuuggagggacuaagcugggggugggggacaugag

SEQ ID NO: 461988 - RNA, 64 nt, Human
acagguuucuaggugauuuuguuguugcugauguagggacuacauuuugagaacuguccuaucc

SEQ ID NO: 461989 - RNA, 64 nt, Human
gccuuauugcuggaauaaugaacugaaagcagacagggacuagaugaacaguauauggucaucc

SEQ ID NO: 461990 - RNA, 64 nt, Human
uuggcccagaggacucugcuggugaccugaaaagagggacuacauauuucaggauauuguuggu

SEQ ID NO: 461991 - RNA, 64 nt, Human
aauaggaccagagcgguaucucuggcaccacacuagggacuaucagguaauaaaagcuuugacu

SEQ ID NO: 461992 - RNA, 64 nt, Human
agccaaauauguagaggaccuaccaagcccacugagggacuagguuuucaugucucuagucaua

SEQ ID NO: 461993 - RNA, 64 nt, Human
uuccacaaguauuuacugauuaccugcuugugccagggacuauucucaggcugaagaagguggg

SEQ ID NO: 461994 - RNA, 64 nt, Human
gcucaaucugaacacacagaaugucagagcuggaagggacuauagagaucaucugaucugaucc

SEQ ID NO: 461995 - RNA, 64 nt, Human
aacuucuauuauguaaagaaucucuaguguacaaagggacuacaucguuggcuuuugaccuugc

SEQ ID NO: 461996 - RNA, 64 nt, Human
guuguacucuguccccucaugacuuuuuagacacagggacuaggacaucgaccacccucugccc

SEQ ID NO: 461997 - RNA, 64 nt, Human
gauuugcuucuaaaaauuaguuucagugagucccagggacuaauuaagguuuauuuuaaaaagu

SEQ ID NO: 461998 - RNA, 64 nt, Human
aggcacucugaguuuuagacaauguuuauaguugagggacuaucagccgagauacuuguaauua

SEQ ID NO: 461999 - RNA, 64 nt, Human
gcuggcugugcuggguuccagcucgcucccaccgagggacuagcuuggccuuugcgcuuugauu

SEQ ID NO: 462000 - RNA, 64 nt, Human
ucucccugccccccaugccccagaccggcccaccagggacuagccgcugucgcacagccucugg

SEQ ID NO: 462001 - RNA, 64 nt, Human
auaccccuuacaaaugaaaaauuccacucaaaauagggacuaucuaucuuaauacuaaggaacc

SEQ ID NO: 462002 - RNA, 64 nt, Human
ugaguaaacuuggaaaggggcucccucccagagaagggacuacucucuucaccccuuuauucca

SEQ ID NO: 462003 - RNA, 64 nt, Human
uuuuuuuuuuuuuuuuuuuugguuaugaaaacuuagggacuaaaauuaauauaaaaauuggcau

SEQ ID NO: 462004 - RNA, 64 nt, Human
ggucacaaauuuugaugcugagggggauuauucaagggacuaggaugaacuaaauaagaacuca

SEQ ID NO: 462005 - RNA, 64 nt, Human
ccucuguuuaauaaggauccuuaugaugacuuuuagggacuacccagauuacuccaggauaauc

SEQ ID NO: 462006 - RNA, 64 nt, Human
ccacaugccuaagaccugcccugacaaucagaguagggacuacaagaguguaugguguaugagg

SEQ ID NO: 462007 - RNA, 64 nt, Human
uauucucuuagaucacauuuaguagcauaacuguagggacuauuagagauggcaucucaucgau

SEQ ID NO: 462008 - RNA, 64 nt, Human
auggugaugcgugucguaggugugcagcuauuugagggacuaagggauggagauauucugucaa

SEQ ID NO: 462009 - RNA, 64 nt, Human
guaaggccuugggucuaaggcauccacgacuggaagggacuacugauguucugugauacaucag

SEQ ID NO: 462010 - RNA, 58 nt, Human
gccaaccauuuuaagccucuaaaagaccucgggcaagucucacagaaacugagcugca

SEQ ID NO: 462011 - RNA, 58 nt, Human
uggucuaagugcugacuggcuacguaguucgggcaaauccuccaaaagggaaagggag

SEQ ID NO: 462012 - RNA, 58 nt, Human
aaauugggaugagcccuaauggaggaagucgggcaaauugaaaguauaaaugaauggg

SEQ ID NO: 462013 - RNA, 58 nt, Human
uucuuuauauugccaaccucggagauagucgggcaaucuugugucguuauaaugagga

SEQ ID NO: 462014 - RNA, 58 nt, Human
cuguuguuggaaacuggagaaaugauugucgggcaaccguuuauuuuuuauuguauuu

SEQ ID NO: 462015 - RNA, 58 nt, Human
gaaggagaugaagguagaagcaccuggcucgggcaaggcuagaaagaugcuacguugg

SEQ ID NO: 462016 - RNA, 58 nt, Human
acuuuagguucacauaccugccugcuagucgggcaacaugaaguaggacaguucuguu

SEQ ID NO: 462017 - RNA, 58 nt, Human
aacuuaucauguugguguguuagguaaaucgggcaaauaugauagugucuuacauugg

SEQ ID NO: 462018 - RNA, 58 nt, Human
ccuggaaacugcuguuugacccugguauucgggcaaagaggacaugagcaagcguauc

SEQ ID NO: 462019 - RNA, 58 nt, Human
uugucccuaugacucagaggaggguuugucgggcaaauucagguggaugaaguaugug

SEQ ID NO: 462020 - RNA, 58 nt, Human
cacuguaauguugcuuuucuuauuuuagucgggcaaaccucuuguugaucauagucuu

SEQ ID NO: 462021 - RNA, 58 nt, Human
agcagaguggagcugagcuguggaccucucgggcaacucugugggugugggggcccug

SEQ ID NO: 462022 - RNA, 56 nt, Human; identical to SEQ ID NO: 441445

SEQ ID NO: 462023 - RNA, 58 nt, Human
aagaaaaugaagaaggagugauugaaugucgggcaaggcacuggcugagcugcugugg

SEQ ID NO: 462024 - RNA, 58 nt, Human
gaaugguacauucaucauccacccagacucgggcaaccucaccguggccaggaguguc

SEQ ID NO: 462025 - RNA, 58 nt, Human
guuucaaauuuaccucagcguuuguguaucgggcaaaaaucguuuugcccgauuccgu

SEQ ID NO: 462026 - RNA, 58 nt, Human
agggggccuccaggcaggacgagacuccucgggcaagggccgugcccgcccaccucug

SEQ ID NO: 462027 - RNA, 58 nt, Human
uuauuuuaucuuuaauuaaugagguaauucgggcaaagaguagaauuuaagacaaaac

SEQ ID NO: 462028 - RNA, 58 nt, Human
auaaggggaaacgaguggucugcucugcucgggcaaaacaagagaugcccauuacugu

SEQ ID NO: 462029 - RNA, 58 nt, Human
auccuauucauccuggagaggaaaagugucgggcaaagggggaucuggggggagcuca

SEQ ID NO: 462030 - RNA, 58 nt, Human
ccagccuuugccagaucucucgugcgguucgggcaaagccgggguagaccugggcuau

SEQ ID NO: 462031 - RNA, 58 nt, Human
ggaugggugucuaaggcaggaguugacaucgggcaaccaaagaaaugaguuuugggga

SEQ ID NO: 462032 - RNA, 58 nt, Human
ggcccugggggucuccuuaaaugccaccucgggcaagucccagucccaguccucggcc

SEQ ID NO: 462033 - RNA, 58 nt, Human
ggccagaugacacccuaaagcaggcugaucgggcaaugggagguggccaggccugcca

SEQ ID NO: 462034 - RNA, 58 nt, Human
aaucucucaggaggacuuugagcgacucucgggcaauuuucccuucgccugccauggg

SEQ ID NO: 462035 - RNA, 58 nt, Human
ccccuucauugacaacaccuacucgugcucgggcaagcugcuggagagggagaucaag

SEQ ID NO: 462036 - RNA, 58 nt, Human
gcccacccguguucuccuccaaaugcugucgggcaagauagcuccuucaugcuuuucu

SEQ ID NO: 462037 - RNA, 58 nt, Human
cuuaaaguaaaaacuacaugauuuauuuucgggcaauuauguuuagcuuucaucauua

SEQ ID NO: 462038 - RNA, 58 nt, Human
gccucuggcacugaccagcugccuggccucgggcaagucacuucacuucucugguccu

SEQ ID NO: 462039 - RNA, 58 nt, Human
ccugggcucagggaauagcugucaacacucgggcaaaguuuuugucugugcaugugua

SEQ ID NO: 462040 - RNA, 58 nt, Human
cuucugucaguauuugcaaccaagguggucgggcaaaguauugccaggagauacugaa

SEQ ID NO: 462041 - RNA, 18 nt, Human
auuuauuuucgggcaauu

SEQ ID NO: 462042 - RNA, 18 nt, Human
gucaacacucgggcaaag

SEQ ID NO: 462043 - RNA, 18 nt, Human
caagguggucgggcaaag

SEQ ID NO: 462044 - RNA, 18 nt, Human
aaaagaccucgggcaagu

SEQ ID NO: 462045 - RNA, 18 nt, Human
uacguaguucgggcaaau

SEQ ID NO: 462046 - RNA, 18 nt, Human
ggaggaagucgggcaaau

SEQ ID NO: 462047 - RNA, 18 nt, Human
ggagauagucgggcaauc

SEQ ID NO: 462048 - RNA, 18 nt, Human
aaugauugucgggcaacc

SEQ ID NO: 462049 - RNA, 18 nt, Human
caccuggcucgggcaagg

SEQ ID NO: 462050 - RNA, 18 nt, Human
ccugcuagucgggcaaca

SEQ ID NO: 462051 - RNA, 18 nt, Human
uagguaaaucgggcaaau

SEQ ID NO: 462052 - RNA, 18 nt, Human
ccugguauucgggcaaag

SEQ ID NO: 462053 - RNA, 18 nt, Human
aggguuugucgggcaaau

SEQ ID NO: 462054 - RNA, 18 nt, Human
uauuuuagucgggcaaac

SEQ ID NO: 462055 - RNA, 18 nt, Human
acccagacucgggcaacc

SEQ ID NO: 462056 - RNA, 18 nt, Human
uggaccucucgggcaacu

SEQ ID NO: 462057 - RNA, 16 nt, Human
agagucucgggcaaga

SEQ ID NO: 462058 - RNA, 18 nt, Human
auugaaugucgggcaagg

SEQ ID NO: 462059 - RNA, 18 nt, Human
gagguaauucgggcaaag

SEQ ID NO: 462060 - RNA, 18 nt, Human
cgugcgguucgggcaaag

SEQ ID NO: 462061 - RNA, 18 nt, Human
uuuguguaucgggcaaaa

SEQ ID NO: 462062 - RNA, 18 nt, Human
gagacuccucgggcaagg

SEQ ID NO: 462063 - RNA, 18 nt, Human
ugcucugcucgggcaaaa

SEQ ID NO: 462064 - RNA, 18 nt, Human
gaaaagugucgggcaaag

SEQ ID NO: 462065 - RNA, 18 nt, Human
aguugacaucgggcaacc

SEQ ID NO: 462066 - RNA, 18 nt, Human
augccaccucgggcaagu

SEQ ID NO: 462067 - RNA, 18 nt, Human
caggcugaucgggcaaug

SEQ ID NO: 462068 - RNA, 18 nt, Human
agcgacucucgggcaauu

SEQ ID NO: 462069 - RNA, 18 nt, Human
acucgugcucgggcaagc

SEQ ID NO: 462070 - RNA, 18 nt, Human
aaaugcugucgggcaaga

SEQ ID NO: 462071 - RNA, 18 nt, Human
gccuggccucgggcaagu

SEQ ID NO: 462072 - RNA, 64 nt, Human; identical to SEQ ID NO: 255539

SEQ ID NO: 462073 - RNA, 64 nt, Human; identical to SEQ ID NO: 255540

SEQ ID NO: 462074 - RNA, 64 nt, Human; identical to SEQ ID NO: 255541

SEQ ID NO: 462075 - RNA, 64 nt, Human
uguaucacugccuguggaaaucuauccucaucagucauugcauuuuucccugccuauaccugug

SEQ ID NO: 462076 - RNA, 64 nt, Human
cauuguuugcagcggaucacuggacaucaaagauucauugcacuuaugaacaaggaaccuucuu

SEQ ID NO: 462077 - RNA, 64 nt, Human
auaguuaccaaaaaugguugaagggagggauuucucauugcagaggguggggugcaagggaaua

SEQ ID NO: 462078 - RNA, 64 nt, Human; identical to SEQ ID NO: 255542

SEQ ID NO: 462079 - RNA, 64 nt, Human; identical to SEQ ID NO: 255543

SEQ ID NO: 462080 - RNA, 64 nt, Human; identical to SEQ ID NO: 255544

SEQ ID NO: 462081 - RNA, 64 nt, Human; identical to SEQ ID NO: 255545

SEQ ID NO: 462082 - RNA, 64 nt, Human; identical to SEQ ID NO: 255546

SEQ ID NO: 462083 - RNA, 64 nt, Human; identical to SEQ ID NO: 255547

SEQ ID NO: 462084 - RNA, 64 nt, Human; identical to SEQ ID NO: 255548

SEQ ID NO: 462085 - RNA, 64 nt, Human; identical to SEQ ID NO: 255549

SEQ ID NO: 462086 - RNA, 64 nt, Human; identical to SEQ ID NO: 255550

SEQ ID NO: 462087 - RNA, 64 nt, Human; identical to SEQ ID NO: 255551

SEQ ID NO: 462088 - RNA, 64 nt, Human; identical to SEQ ID NO: 255552

SEQ ID NO: 462089 - RNA, 64 nt, Human; identical to SEQ ID NO: 255553

SEQ ID NO: 462090 - RNA, 64 nt, Human; identical to SEQ ID NO: 255554

SEQ ID NO: 462091 - RNA, 64 nt, Human; identical to SEQ ID NO: 255558

SEQ ID NO: 462092 - RNA, 64 nt, Human; identical to SEQ ID NO: 255559

SEQ ID NO: 462093 - RNA, 64 nt, Human; identical to SEQ ID NO: 174645

SEQ ID NO: 462094 - RNA, 64 nt, Human; identical to SEQ ID NO: 174646

SEQ ID NO: 462095 - RNA, 64 nt, Human; identical to SEQ ID NO: 174647

SEQ ID NO: 462096 - RNA, 64 nt, Human; identical to SEQ ID NO: 255560

SEQ ID NO: 462097 - RNA, 64 nt, Human; identical to SEQ ID NO: 255561

SEQ ID NO: 462098 - RNA, 64 nt, Human; identical to SEQ ID NO: 255562

SEQ ID NO: 462099 - RNA, 64 nt, Human; identical to SEQ ID NO: 255563

SEQ ID NO: 462100 - RNA, 64 nt, Human; identical to SEQ ID NO: 255564

SEQ ID NO: 462101 - RNA, 64 nt, Human; identical to SEQ ID NO: 255565

SEQ ID NO: 462102 - RNA, 64 nt, Human; identical to SEQ ID NO: 255566

SEQ ID NO: 462103 - RNA, 64 nt, Human; identical to SEQ ID NO: 255567

SEQ ID NO: 462104 - RNA, 64 nt, Human; identical to SEQ ID NO: 255568

SEQ ID NO: 462105 - RNA, 64 nt, Human; identical to SEQ ID NO: 255569

SEQ ID NO: 462106 - RNA, 64 nt, Human; identical to SEQ ID NO: 255570

SEQ ID NO: 462107 - RNA, 64 nt, Human; identical to SEQ ID NO: 255571

SEQ ID NO: 462108 - RNA, 64 nt, Human; identical to SEQ ID NO: 255572

SEQ ID NO: 462109 - RNA, 64 nt, Human; identical to SEQ ID NO: 255573

SEQ ID NO: 462110 - RNA, 64 nt, Human; identical to SEQ ID NO: 255577

SEQ ID NO: 462111 - RNA, 64 nt, Human; identical to SEQ ID NO: 174546

SEQ ID NO: 462112 - RNA, 64 nt, Human; identical to SEQ ID NO: 174547

SEQ ID NO: 462113 - RNA, 64 nt, Human; identical to SEQ ID NO: 174548

SEQ ID NO: 462114 - RNA, 64 nt, Human; identical to SEQ ID NO: 255578

SEQ ID NO: 462115 - RNA, 64 nt, Human; identical to SEQ ID NO: 255579

SEQ ID NO: 462116 - RNA, 64 nt, Human; identical to SEQ ID NO: 255580

SEQ ID NO: 462117 - RNA, 64 nt, Human; identical to SEQ ID NO: 255581

SEQ ID NO: 462118 - RNA, 64 nt, Human; identical to SEQ ID NO: 255582

SEQ ID NO: 462119 - RNA, 64 nt, Human; identical to SEQ ID NO: 255583

SEQ ID NO: 462120 - RNA, 64 nt, Human; identical to SEQ ID NO: 255584

SEQ ID NO: 462121 - RNA, 64 nt, Human; identical to SEQ ID NO: 255585

SEQ ID NO: 462122 - RNA, 64 nt, Human; identical to SEQ ID NO: 255586

SEQ ID NO: 462123 - RNA, 64 nt, Human; identical to SEQ ID NO: 255587

SEQ ID NO: 462124 - RNA, 64 nt, Human; identical to SEQ ID NO: 255588

SEQ ID NO: 462125 - RNA, 64 nt, Human; identical to SEQ ID NO: 255589

SEQ ID NO: 462126 - RNA, 64 nt, Human; identical to SEQ ID NO: 255590

SEQ ID NO: 462127 - RNA, 64 nt, Human; identical to SEQ ID NO: 255591

SEQ ID NO: 462128 - RNA, 64 nt, Human; identical to SEQ ID NO: 255592

SEQ ID NO: 462129 - RNA, 64 nt, Human; identical to SEQ ID NO: 174648

SEQ ID NO: 462130 - RNA, 64 nt, Human; identical to SEQ ID NO: 174649

SEQ ID NO: 462131 - RNA, 64 nt, Human; identical to SEQ ID NO: 174650

SEQ ID NO: 462132 - RNA, 64 nt, Human; identical to SEQ ID NO: 255596

SEQ ID NO: 462133 - RNA, 64 nt, Human; identical to SEQ ID NO: 255597

SEQ ID NO: 462134 - RNA, 64 nt, Human; identical to SEQ ID NO: 255598

SEQ ID NO: 462135 - RNA, 64 nt, Human; identical to SEQ ID NO: 255599

SEQ ID NO: 462136 - RNA, 64 nt, Human; identical to SEQ ID NO: 255600

SEQ ID NO: 462137 - RNA, 64 nt, Human; identical to SEQ ID NO: 255601

SEQ ID NO: 462138 - RNA, 64 nt, Human; identical to SEQ ID NO: 255602

SEQ ID NO: 462139 - RNA, 64 nt, Human; identical to SEQ ID NO: 255603

SEQ ID NO: 462140 - RNA, 64 nt, Human; identical to SEQ ID NO: 255604

SEQ ID NO: 462141 - RNA, 64 nt, Human; identical to SEQ ID NO: 255605

SEQ ID NO: 462142 - RNA, 64 nt, Human; identical to SEQ ID NO: 255606

SEQ ID NO: 462143 - RNA, 64 nt, Human; identical to SEQ ID NO: 255607

SEQ ID NO: 462144 - RNA, 64 nt, Human; identical to SEQ ID NO: 255608

SEQ ID NO: 462145 - RNA, 64 nt, Human; identical to SEQ ID NO: 255609

SEQ ID NO: 462146 - RNA, 64 nt, Human; identical to SEQ ID NO: 255610

SEQ ID NO: 462147 - RNA, 64 nt, Human; identical to SEQ ID NO: 174651

SEQ ID NO: 462148 - RNA, 64 nt, Human
cuuuuggcugaauggugagcagccacugugcaguucaacguaagugugccuuaauugcacagag

SEQ ID NO: 462149 - RNA, 64 nt, Human
ugaccauaagcgguacggccuuucaggagcugccucaacguagggguggguagucuguguucua

SEQ ID NO: 462150 - RNA, 64 nt, Human; identical to SEQ ID NO: 255611

SEQ ID NO: 462151 - RNA, 64 nt, Human; identical to SEQ ID NO: 255615

SEQ ID NO: 462152 - RNA, 64 nt, Human; identical to SEQ ID NO: 255616

SEQ ID NO: 462153 - RNA, 52 nt, Human; identical to SEQ ID NO: 255617

SEQ ID NO: 462154 - RNA, 64 nt, Human; identical to SEQ ID NO: 255618

SEQ ID NO: 462155 - RNA, 64 nt, Human; identical to SEQ ID NO: 255619

SEQ ID NO: 462156 - RNA, 64 nt, Human; identical to SEQ ID NO: 255620

SEQ ID NO: 462157 - RNA, 64 nt, Human; identical to SEQ ID NO: 255621

SEQ ID NO: 462158 - RNA, 64 nt, Human; identical to SEQ ID NO: 255622

SEQ ID NO: 462159 - RNA, 64 nt, Human; identical to SEQ ID NO: 255623

SEQ ID NO: 462160 - RNA, 64 nt, Human; identical to SEQ ID NO: 255624

SEQ ID NO: 462161 - RNA, 64 nt, Human; identical to SEQ ID NO: 255625

SEQ ID NO: 462162 - RNA, 64 nt, Human; identical to SEQ ID NO: 255626

SEQ ID NO: 462163 - RNA, 64 nt, Human; identical to SEQ ID NO: 255627

SEQ ID NO: 462164 - RNA, 64 nt, Human; identical to SEQ ID NO: 255628

SEQ ID NO: 462165 - RNA, 64 nt, Human
uuucguacugucucuauagcuguagcuuuaaaauucaacguauauaauuggcauggaaacuuaa

SEQ ID NO: 462166 - RNA, 64 nt, Human
aaaagaaauucuaagugaaugcgcguaugacaggucaacguauuaggaaggagccagaaaguau

SEQ ID NO: 462167 - RNA, 64 nt, Human
ucaugagaugauaaaauguaaaacaaaacucuagucaacguagaaagaguuaacugugcugaaa

SEQ ID NO: 462168 - RNA, 64 nt, Human; identical to SEQ ID NO: 255629

SEQ ID NO: 462169 - RNA, 64 nt, Human; identical to SEQ ID NO: 255630

SEQ ID NO: 462170 - RNA, 64 nt, Human; identical to SEQ ID NO: 255634

SEQ ID NO: 462171 - RNA, 64 nt, Human; identical to SEQ ID NO: 255635

SEQ ID NO: 462172 - RNA, 64 nt, Human; identical to SEQ ID NO: 255636

SEQ ID NO: 462173 - RNA, 64 nt, Human; identical to SEQ ID NO: 255637

SEQ ID NO: 462174 - RNA, 64 nt, Human; identical to SEQ ID NO: 255638

SEQ ID NO: 462175 - RNA, 53 nt, Human; identical to SEQ ID NO: 255639

SEQ ID NO: 462176 - RNA, 64 nt, Human; identical to SEQ ID NO: 255640

SEQ ID NO: 462177 - RNA, 64 nt, Human; identical to SEQ ID NO: 255641

SEQ ID NO: 462178 - RNA, 64 nt, Human; identical to SEQ ID NO: 255642

SEQ ID NO: 462179 - RNA, 64 nt, Human; identical to SEQ ID NO: 255643

SEQ ID NO: 462180 - RNA, 64 nt, Human; identical to SEQ ID NO: 255644

SEQ ID NO: 462181 - RNA, 64 nt, Human; identical to SEQ ID NO: 255645

SEQ ID NO: 462182 - RNA, 64 nt, Human; identical to SEQ ID NO: 255646

SEQ ID NO: 462183 - RNA, 64 nt, Human
cugcggaagcccagcgguucacacaggccucccuucaacguagucauccccuggugguggaagc

SEQ ID NO: 462184 - RNA, 64 nt, Human
uaaagucccuuuccuugcuccaacuccuugucucucaacguauuggcuaugacgcagcaagcag

SEQ ID NO: 462185 - RNA, 64 nt, Human
uaugcaaagcauaugauaauuuaucauucuaacuucaacguauaauagggauugugaccugaua

SEQ ID NO: 462186 - RNA, 64 nt, Human; identical to SEQ ID NO: 255647

SEQ ID NO: 462187 - RNA, 64 nt, Human; identical to SEQ ID NO: 255648

SEQ ID NO: 462188 - RNA, 64 nt, Human; identical to SEQ ID NO: 255649

SEQ ID NO: 462189 - RNA, 64 nt, Human; identical to SEQ ID NO: 255653

SEQ ID NO: 462190 - RNA, 64 nt, Human; identical to SEQ ID NO: 255654

SEQ ID NO: 462191 - RNA, 64 nt, Human; identical to SEQ ID NO: 255655

SEQ ID NO: 462192 - RNA, 64 nt, Human; identical to SEQ ID NO: 255656

SEQ ID NO: 462193 - RNA, 64 nt, Human; identical to SEQ ID NO: 255657

SEQ ID NO: 462194 - RNA, 64 nt, Human; identical to SEQ ID NO: 255658

SEQ ID NO: 462195 - RNA, 64 nt, Human; identical to SEQ ID NO: 255659

SEQ ID NO: 462196 - RNA, 64 nt, Human; identical to SEQ ID NO: 255660

SEQ ID NO: 462197 - RNA, 64 nt, Human; identical to SEQ ID NO: 255661

SEQ ID NO: 462198 - RNA, 64 nt, Human; identical to SEQ ID NO: 255662

SEQ ID NO: 462199 - RNA, 64 nt, Human; identical to SEQ ID NO: 255663

SEQ ID NO: 462200 - RNA, 64 nt, Human; identical to SEQ ID NO: 255664

SEQ ID NO: 462201 - RNA, 64 nt, Human
cuccaccaugcaggacaaacaucuucucaagcagucaacguagaaugcuugggaaauagucaua

SEQ ID NO: 462202 - RNA, 64 nt, Human
uugcagcacuauucucaauagcaaagauguggaaucaacguaaaugcccaucagcaguagacca

SEQ ID NO: 462203 - RNA, 64 nt, Human
acagcaagaaagauacaucugaccagccucaacgucaacguauuuccccucucacccuggcuuc

SEQ ID NO: 462204 - RNA, 64 nt, Human; identical to SEQ ID NO: 255665

SEQ ID NO: 462205 - RNA, 64 nt, Human
uuugaaucguuaacauuauuuaaagacugaaaauucauugcaauuagggaacgcacagccucac

SEQ ID NO: 462206 - RNA, 64 nt, Human
cucuguauugugcugauuguggaucuuuucauucucauugcagaauaauguucuauugugggac

SEQ ID NO: 462207 - RNA, 64 nt, Human
ugguagaugcugcacaaaguuaccuucuguuucaucauugcaaacaaaaaucauugaaaauacu

SEQ ID NO: 462208 - RNA, 64 nt, Human; identical to SEQ ID NO: 255666

SEQ ID NO: 462209 - RNA, 64 nt, Human; identical to SEQ ID NO: 255667

SEQ ID NO: 462210 - RNA, 64 nt, Human; identical to SEQ ID NO: 255668

SEQ ID NO: 462211 - RNA, 62 nt, Human; identical to SEQ ID NO: 255672

SEQ ID NO: 462212 - RNA, 64 nt, Human; identical to SEQ ID NO: 255673

SEQ ID NO: 462213 - RNA, 64 nt, Human; identical to SEQ ID NO: 255674

SEQ ID NO: 462214 - RNA, 64 nt, Human; identical to SEQ ID NO: 255675

SEQ ID NO: 462215 - RNA, 64 nt, Human; identical to SEQ ID NO: 255676

SEQ ID NO: 462216 - RNA, 64 nt, Human; identical to SEQ ID NO: 255677

SEQ ID NO: 462217 - RNA, 64 nt, Human; identical to SEQ ID NO: 255678

SEQ ID NO: 462218 - RNA, 64 nt, Human; identical to SEQ ID NO: 255679

SEQ ID NO: 462219 - RNA, 64 nt, Human; identical to SEQ ID NO: 255680

SEQ ID NO: 462220 - RNA, 64 nt, Human; identical to SEQ ID NO: 255681

SEQ ID NO: 462221 - RNA, 64 nt, Human; identical to SEQ ID NO: 255682

SEQ ID NO: 462222 - RNA, 64 nt, Human; identical to SEQ ID NO: 255683

SEQ ID NO: 462223 - RNA, 64 nt, Human
aaggccaugaguuuucagaugauuucauugagcuucauugcagccugaaauuuuaaaaaaguug

SEQ ID NO: 462224 - RNA, 64 nt, Human
acaagacacuccaaaccuuucagauaacaaacuaucauugcagaccuucacuuuuggaaugcaa

SEQ ID NO: 462225 - RNA, 64 nt, Human
uccuggacagcuagaaaacacaaaaucuuguaggucauugcaccuaucucagccauaggugcag

SEQ ID NO: 462226 - RNA, 64 nt, Human; identical to SEQ ID NO: 255684

SEQ ID NO: 462227 - RNA, 64 nt, Human; identical to SEQ ID NO: 255685

SEQ ID NO: 462228 - RNA, 64 nt, Human; identical to SEQ ID NO: 255686

SEQ ID NO: 462229 - RNA, 64 nt, Human; identical to SEQ ID NO: 255687

SEQ ID NO: 462230 - RNA, 64 nt, Human; identical to SEQ ID NO: 255691

SEQ ID NO: 462231 - RNA, 64 nt, Human; identical to SEQ ID NO: 255692

SEQ ID NO: 462232 - RNA, 64 nt, Human; identical to SEQ ID NO: 255693

SEQ ID NO: 462233 - RNA, 64 nt, Human; identical to SEQ ID NO: 255694

SEQ ID NO: 462234 - RNA, 64 nt, Human; identical to SEQ ID NO: 255695

SEQ ID NO: 462235 - RNA, 64 nt, Human; identical to SEQ ID NO: 255696

SEQ ID NO: 462236 - RNA, 64 nt, Human; identical to SEQ ID NO: 255697

SEQ ID NO: 462237 - RNA, 64 nt, Human; identical to SEQ ID NO: 255698

SEQ ID NO: 462238 - RNA, 64 nt, Human; identical to SEQ ID NO: 255699

SEQ ID NO: 462239 - RNA, 64 nt, Human; identical to SEQ ID NO: 255700

SEQ ID NO: 462240 - RNA, 64 nt, Human; identical to SEQ ID NO: 255701

SEQ ID NO: 462241 - RNA, 64 nt, Human
cacccagacuggcgugcaguggcacuaucuuggcucauugcaaccucugccucccaggucagcc

SEQ ID NO: 462242 - RNA, 64 nt, Human
uagcggaauguaugguucaaccuuaauuauagcuucauugcaggacuuuacuguuucuccauuu

SEQ ID NO: 462243 - RNA, 64 nt, Human
guuuucuccauaggccuugugcagaaagguuuucucauugcauccauacugugagaauaaacug

SEQ ID NO: 462244 - RNA, 64 nt, Human; identical to SEQ ID NO: 255702

SEQ ID NO: 462245 - RNA, 64 nt, Human; identical to SEQ ID NO: 255703

SEQ ID NO: 462246 - RNA, 53 nt, Human; identical to SEQ ID NO: 255704

SEQ ID NO: 462247 - RNA, 64 nt, Human; identical to SEQ ID NO: 255705

SEQ ID NO: 462248 - RNA, 64 nt, Human; identical to SEQ ID NO: 255706

SEQ ID NO: 462249 - RNA, 64 nt, Human; identical to SEQ ID NO: 255710

SEQ ID NO: 462250 - RNA, 64 nt, Human; identical to SEQ ID NO: 255711

SEQ ID NO: 462251 - RNA, 64 nt, Human; identical to SEQ ID NO: 255712

SEQ ID NO: 462252 - RNA, 64 nt, Human; identical to SEQ ID NO: 255713

SEQ ID NO: 462253 - RNA, 64 nt, Human; identical to SEQ ID NO: 255714

SEQ ID NO: 462254 - RNA, 64 nt, Human; identical to SEQ ID NO: 255715

SEQ ID NO: 462255 - RNA, 64 nt, Human; identical to SEQ ID NO: 255716

SEQ ID NO: 462256 - RNA, 64 nt, Human; identical to SEQ ID NO: 255717

SEQ ID NO: 462257 - RNA, 64 nt, Human; identical to SEQ ID NO: 255718

SEQ ID NO: 462258 - RNA, 64 nt, Human; identical to SEQ ID NO: 255719

SEQ ID NO: 462259 - RNA, 64 nt, Human; identical to SEQ ID NO: 174599

SEQ ID NO: 462260 - RNA, 64 nt, Human; identical to SEQ ID NO: 174600

SEQ ID NO: 462261 - RNA, 64 nt, Human; identical to SEQ ID NO: 174601

SEQ ID NO: 462262 - RNA, 64 nt, Human; identical to SEQ ID NO: 255720

SEQ ID NO: 462263 - RNA, 64 nt, Human; identical to SEQ ID NO: 255721

SEQ ID NO: 462264 - RNA, 64 nt, Human; identical to SEQ ID NO: 255722

SEQ ID NO: 462265 - RNA, 64 nt, Human; identical to SEQ ID NO: 255723

SEQ ID NO: 462266 - RNA, 64 nt, Human; identical to SEQ ID NO: 255724

SEQ ID NO: 462267 - RNA, 64 nt, Human; identical to SEQ ID NO: 255725

SEQ ID NO: 462268 - RNA, 64 nt, Human; identical to SEQ ID NO: 255729

SEQ ID NO: 462269 - RNA, 64 nt, Human; identical to SEQ ID NO: 255730

SEQ ID NO: 462270 - RNA, 64 nt, Human; identical to SEQ ID NO: 255731

SEQ ID NO: 462271 - RNA, 64 nt, Human; identical to SEQ ID NO: 255732

SEQ ID NO: 462272 - RNA, 64 nt, Human; identical to SEQ ID NO: 255733

SEQ ID NO: 462273 - RNA, 64 nt, Human; identical to SEQ ID NO: 255734

SEQ ID NO: 462274 - RNA, 64 nt, Human; identical to SEQ ID NO: 255735

SEQ ID NO: 462275 - RNA, 64 nt, Human; identical to SEQ ID NO: 255736

SEQ ID NO: 462276 - RNA, 60 nt, Human; identical to SEQ ID NO: 255737

SEQ ID NO: 462277 - RNA, 64 nt, Human; identical to SEQ ID NO: 174595

SEQ ID NO: 462278 - RNA, 64 nt, Human; identical to SEQ ID NO: 174596

SEQ ID NO: 462279 - RNA, 64 nt, Human; identical to SEQ ID NO: 174597

SEQ ID NO: 462280 - RNA, 64 nt, Human; identical to SEQ ID NO: 255738

SEQ ID NO: 462281 - RNA, 64 nt, Human; identical to SEQ ID NO: 255739

SEQ ID NO: 462282 - RNA, 64 nt, Human; identical to SEQ ID NO: 255740

SEQ ID NO: 462283 - RNA, 64 nt, Human; identical to SEQ ID NO: 255741

SEQ ID NO: 462284 - RNA, 64 nt, Human; identical to SEQ ID NO: 255742

SEQ ID NO: 462285 - RNA, 64 nt, Human; identical to SEQ ID NO: 255743

SEQ ID NO: 462286 - RNA, 64 nt, Human; identical to SEQ ID NO: 255744

SEQ ID NO: 462287 - RNA, 64 nt, Human; identical to SEQ ID NO: 255748

SEQ ID NO: 462288 - RNA, 64 nt, Human; identical to SEQ ID NO: 255749

SEQ ID NO: 462289 - RNA, 64 nt, Human; identical to SEQ ID NO: 255750

SEQ ID NO: 462290 - RNA, 64 nt, Human; identical to SEQ ID NO: 255751

SEQ ID NO: 462291 - RNA, 64 nt, Human; identical to SEQ ID NO: 255752

SEQ ID NO: 462292 - RNA, 64 nt, Human; identical to SEQ ID NO: 255753

SEQ ID NO: 462293 - RNA, 64 nt, Human; identical to SEQ ID NO: 255754

SEQ ID NO: 462294 - RNA, 64 nt, Human; identical to SEQ ID NO: 255755

SEQ ID NO: 462295 - RNA, 64 nt, Human; identical to SEQ ID NO: 174602

SEQ ID NO: 462296 - RNA, 64 nt, Human; identical to SEQ ID NO: 174603

SEQ ID NO: 462297 - RNA, 64 nt, Human; identical to SEQ ID NO: 174604

SEQ ID NO: 462298 - RNA, 64 nt, Human; identical to SEQ ID NO: 255756

SEQ ID NO: 462299 - RNA, 64 nt, Human; identical to SEQ ID NO: 255757

SEQ ID NO: 462300 - RNA, 64 nt, Human; identical to SEQ ID NO: 255758

SEQ ID NO: 462301 - RNA, 64 nt, Human; identical to SEQ ID NO: 255759

SEQ ID NO: 462302 - RNA, 64 nt, Human; identical to SEQ ID NO: 255760

SEQ ID NO: 462303 - RNA, 64 nt, Human; identical to SEQ ID NO: 255761

SEQ ID NO: 462304 - RNA, 64 nt, Human; identical to SEQ ID NO: 255762

SEQ ID NO: 462305 - RNA, 63 nt, Human; identical to SEQ ID NO: 255763

SEQ ID NO: 462306 - RNA, 64 nt, Human; identical to SEQ ID NO: 255767

SEQ ID NO: 462307 - RNA, 64 nt, Human; identical to SEQ ID NO: 255768

SEQ ID NO: 462308 - RNA, 64 nt, Human; identical to SEQ ID NO: 255769

SEQ ID NO: 462309 - RNA, 64 nt, Human; identical to SEQ ID NO: 255770

SEQ ID NO: 462310 - RNA, 64 nt, Human; identical to SEQ ID NO: 255771

SEQ ID NO: 462311 - RNA, 64 nt, Human; identical to SEQ ID NO: 255772

SEQ ID NO: 462312 - RNA, 64 nt, Human; identical to SEQ ID NO: 255773

SEQ ID NO: 462313 - RNA, 64 nt, Human; identical to SEQ ID NO: 174606

SEQ ID NO: 462314 - RNA, 54 nt, Human; identical to SEQ ID NO: 174607

SEQ ID NO: 462315 - RNA, 64 nt, Human; identical to SEQ ID NO: 174608

SEQ ID NO: 462316 - RNA, 64 nt, Human; identical to SEQ ID NO: 255774

SEQ ID NO: 462317 - RNA, 64 nt, Human; identical to SEQ ID NO: 255775

SEQ ID NO: 462318 - RNA, 64 nt, Human; identical to SEQ ID NO: 255776

SEQ ID NO: 462319 - RNA, 64 nt, Human; identical to SEQ ID NO: 255777

SEQ ID NO: 462320 - RNA, 64 nt, Human; identical to SEQ ID NO: 255778

SEQ ID NO: 462321 - RNA, 64 nt, Human; identical to SEQ ID NO: 255779

SEQ ID NO: 462322 - RNA, 64 nt, Human; identical to SEQ ID NO: 255780

SEQ ID NO: 462323 - RNA, 64 nt, Human; identical to SEQ ID NO: 255781

SEQ ID NO: 462324 - RNA, 64 nt, Human; identical to SEQ ID NO: 255782

SEQ ID NO: 462325 - RNA, 64 nt, Human; identical to SEQ ID NO: 255786

SEQ ID NO: 462326 - RNA, 64 nt, Human; identical to SEQ ID NO: 255787

SEQ ID NO: 462327 - RNA, 64 nt, Human; identical to SEQ ID NO: 255788

SEQ ID NO: 462328 - RNA, 64 nt, Human; identical to SEQ ID NO: 255789

SEQ ID NO: 462329 - RNA, 64 nt, Human; identical to SEQ ID NO: 255790

SEQ ID NO: 462330 - RNA, 64 nt, Human; identical to SEQ ID NO: 255791

SEQ ID NO: 462331 - RNA, 63 nt, Human; identical to SEQ ID NO: 174609

SEQ ID NO: 462332 - RNA, 64 nt, Human; identical to SEQ ID NO: 174610

SEQ ID NO: 462333 - RNA, 64 nt, Human; identical to SEQ ID NO: 174611

SEQ ID NO: 462334 - RNA, 64 nt, Human; identical to SEQ ID NO: 255792

SEQ ID NO: 462335 - RNA, 64 nt, Human; identical to SEQ ID NO: 255793

SEQ ID NO: 462336 - RNA, 64 nt, Human; identical to SEQ ID NO: 255794

SEQ ID NO: 462337 - RNA, 64 nt, Human; identical to SEQ ID NO: 255795

SEQ ID NO: 462338 - RNA, 64 nt, Human; identical to SEQ ID NO: 255796

SEQ ID NO: 462339 - RNA, 64 nt, Human; identical to SEQ ID NO: 255797

SEQ ID NO: 462340 - RNA, 64 nt, Human; identical to SEQ ID NO: 255798

SEQ ID NO: 462341 - RNA, 64 nt, Human; identical to SEQ ID NO: 255799

SEQ ID NO: 462342 - RNA, 64 nt, Human; identical to SEQ ID NO: 255800

SEQ ID NO: 462343 - RNA, 64 nt, Human; identical to SEQ ID NO: 255801

SEQ ID NO: 462344 - RNA, 64 nt, Human; identical to SEQ ID NO: 255805

SEQ ID NO: 462345 - RNA, 64 nt, Human; identical to SEQ ID NO: 255806

SEQ ID NO: 462346 - RNA, 64 nt, Human; identical to SEQ ID NO: 255807

SEQ ID NO: 462347 - RNA, 64 nt, Human; identical to SEQ ID NO: 255808

SEQ ID NO: 462348 - RNA, 64 nt, Human; identical to SEQ ID NO: 255809

SEQ ID NO: 462349 - RNA, 64 nt, Human
auaagggugaugaguuugggaaagccuucagucaucauugcaaccuuauuaggcauuuuagaau

SEQ ID NO: 462350 - RNA, 64 nt, Human
cugccugucuccuggauuucaaagaccacugucuucauugcacaacaaugugaauauaaucaac

SEQ ID NO: 462351 - RNA, 64 nt, Human
aacuuuagaaucugaaaaccagaaagaagucuugucauugcagcagcaucgauuccggugauag

SEQ ID NO: 462352 - RNA, 64 nt, Human; identical to SEQ ID NO: 255810

SEQ ID NO: 462353 - RNA, 64 nt, Human; identical to SEQ ID NO: 255811

SEQ ID NO: 462354 - RNA, 64 nt, Human; identical to SEQ ID NO: 255812

SEQ ID NO: 462355 - RNA, 64 nt, Human; identical to SEQ ID NO: 255813

SEQ ID NO: 462356 - RNA, 64 nt, Human; identical to SEQ ID NO: 255814

SEQ ID NO: 462357 - RNA, 64 nt, Human; identical to SEQ ID NO: 255815

SEQ ID NO: 462358 - RNA, 64 nt, Human; identical to SEQ ID NO: 255816

SEQ ID NO: 462359 - RNA, 64 nt, Human; identical to SEQ ID NO: 255817

SEQ ID NO: 462360 - RNA, 64 nt, Human; identical to SEQ ID NO: 255818

SEQ ID NO: 462361 - RNA, 64 nt, Human; identical to SEQ ID NO: 255819

SEQ ID NO: 462362 - RNA, 64 nt, Human; identical to SEQ ID NO: 255820

SEQ ID NO: 462363 - RNA, 64 nt, Human; identical to SEQ ID NO: 255824

SEQ ID NO: 462364 - RNA, 64 nt, Human; identical to SEQ ID NO: 255825

SEQ ID NO: 462365 - RNA, 64 nt, Human; identical to SEQ ID NO: 255826

SEQ ID NO: 462366 - RNA, 64 nt, Human; identical to SEQ ID NO: 255827

SEQ ID NO: 462367 - RNA, 64 nt, Human; identical to SEQ ID NO: 174613

SEQ ID NO: 462368 - RNA, 64 nt, Human; identical to SEQ ID NO: 174614

SEQ ID NO: 462369 - RNA, 64 nt, Human; identical to SEQ ID NO: 174615

SEQ ID NO: 462370 - RNA, 64 nt, Human; identical to SEQ ID NO: 255828

SEQ ID NO: 462371 - RNA, 64 nt, Human; identical to SEQ ID NO: 255829

SEQ ID NO: 462372 - RNA, 64 nt, Human; identical to SEQ ID NO: 255830

SEQ ID NO: 462373 - RNA, 64 nt, Human; identical to SEQ ID NO: 255831

SEQ ID NO: 462374 - RNA, 64 nt, Human; identical to SEQ ID NO: 255832

SEQ ID NO: 462375 - RNA, 64 nt, Human; identical to SEQ ID NO: 255833

SEQ ID NO: 462376 - RNA, 64 nt, Human; identical to SEQ ID NO: 255834

SEQ ID NO: 462377 - RNA, 64 nt, Human; identical to SEQ ID NO: 255835

SEQ ID NO: 462378 - RNA, 64 nt, Human; identical to SEQ ID NO: 255836

SEQ ID NO: 462379 - RNA, 64 nt, Human; identical to SEQ ID NO: 255837

SEQ ID NO: 462380 - RNA, 64 nt, Human; identical to SEQ ID NO: 255838

SEQ ID NO: 462381 - RNA, 64 nt, Human; identical to SEQ ID NO: 255839

SEQ ID NO: 462382 - RNA, 64 nt, Human; identical to SEQ ID NO: 255843

SEQ ID NO: 462383 - RNA, 64 nt, Human; identical to SEQ ID NO: 255844

SEQ ID NO: 462384 - RNA, 64 nt, Human; identical to SEQ ID NO: 255845

SEQ ID NO: 462385 - RNA, 64 nt, Human; identical to SEQ ID NO: 174616

SEQ ID NO: 462386 - RNA, 64 nt, Human; identical to SEQ ID NO: 174617

SEQ ID NO: 462387 - RNA, 64 nt, Human; identical to SEQ ID NO: 174618

SEQ ID NO: 462388 - RNA, 64 nt, Human; identical to SEQ ID NO: 255846

SEQ ID NO: 462389 - RNA, 64 nt, Human; identical to SEQ ID NO: 255847

SEQ ID NO: 462390 - RNA, 64 nt, Human; identical to SEQ ID NO: 255848

SEQ ID NO: 462391 - RNA, 64 nt, Human; identical to SEQ ID NO: 255849

SEQ ID NO: 462392 - RNA, 64 nt, Human; identical to SEQ ID NO: 255850

SEQ ID NO: 462393 - RNA, 64 nt, Human; identical to SEQ ID NO: 255851

SEQ ID NO: 462394 - RNA, 64 nt, Human; identical to SEQ ID NO: 255852

SEQ ID NO: 462395 - RNA, 64 nt, Human; identical to SEQ ID NO: 255853

SEQ ID NO: 462396 - RNA, 64 nt, Human; identical to SEQ ID NO: 255854

SEQ ID NO: 462397 - RNA, 64 nt, Human; identical to SEQ ID NO: 255855

SEQ ID NO: 462398 - RNA, 64 nt, Human; identical to SEQ ID NO: 255856

SEQ ID NO: 462399 - RNA, 64 nt, Human; identical to SEQ ID NO: 255857

SEQ ID NO: 462400 - RNA, 58 nt, Human; identical to SEQ ID NO: 255858

SEQ ID NO: 462401 - RNA, 64 nt, Human; identical to SEQ ID NO: 255862

SEQ ID NO: 462402 - RNA, 64 nt, Human; identical to SEQ ID NO: 255863

SEQ ID NO: 462403 - RNA, 64 nt, Human; identical to SEQ ID NO: 174620

SEQ ID NO: 462404 - RNA, 64 nt, Human; identical to SEQ ID NO: 174621

SEQ ID NO: 462405 - RNA, 64 nt, Human; identical to SEQ ID NO: 174622

SEQ ID NO: 462406 - RNA, 64 nt, Human; identical to SEQ ID NO: 255864

SEQ ID NO: 462407 - RNA, 64 nt, Human; identical to SEQ ID NO: 255865

SEQ ID NO: 462408 - RNA, 64 nt, Human; identical to SEQ ID NO: 255866

SEQ ID NO: 462409 - RNA, 64 nt, Human; identical to SEQ ID NO: 255867

SEQ ID NO: 462410 - RNA, 64 nt, Human; identical to SEQ ID NO: 255868

SEQ ID NO: 462411 - RNA, 64 nt, Human; identical to SEQ ID NO: 255869

SEQ ID NO: 462412 - RNA, 64 nt, Human; identical to SEQ ID NO: 255870

SEQ ID NO: 462413 - RNA, 64 nt, Human; identical to SEQ ID NO: 255871

SEQ ID NO: 462414 - RNA, 64 nt, Human; identical to SEQ ID NO: 255872

SEQ ID NO: 462415 - RNA, 64 nt, Human; identical to SEQ ID NO: 255873

SEQ ID NO: 462416 - RNA, 64 nt, Human; identical to SEQ ID NO: 255874

SEQ ID NO: 462417 - RNA, 64 nt, Human; identical to SEQ ID NO: 255875

SEQ ID NO: 462418 - RNA, 64 nt, Human; identical to SEQ ID NO: 255876

SEQ ID NO: 462419 - RNA, 64 nt, Human; identical to SEQ ID NO: 255877

SEQ ID NO: 462420 - RNA, 64 nt, Human; identical to SEQ ID NO: 255881

SEQ ID NO: 462421 - RNA, 64 nt, Human; identical to SEQ ID NO: 174623

SEQ ID NO: 462422 - RNA, 64 nt, Human; identical to SEQ ID NO: 174624

SEQ ID NO: 462423 - RNA, 64 nt, Human; identical to SEQ ID NO: 174625

SEQ ID NO: 462424 - RNA, 64 nt, Human; identical to SEQ ID NO: 255882

SEQ ID NO: 462425 - RNA, 64 nt, Human; identical to SEQ ID NO: 255883

SEQ ID NO: 462426 - RNA, 64 nt, Human; identical to SEQ ID NO: 255884

SEQ ID NO: 462427 - RNA, 64 nt, Human; identical to SEQ ID NO: 255885

SEQ ID NO: 462428 - RNA, 64 nt, Human; identical to SEQ ID NO: 255886

SEQ ID NO: 462429 - RNA, 64 nt, Human; identical to SEQ ID NO: 255887

SEQ ID NO: 462430 - RNA, 64 nt, Human; identical to SEQ ID NO: 255888

SEQ ID NO: 462431 - RNA, 64 nt, Human; identical to SEQ ID NO: 255889

SEQ ID NO: 462432 - RNA, 64 nt, Human; identical to SEQ ID NO: 255890

SEQ ID NO: 462433 - RNA, 64 nt, Human; identical to SEQ ID NO: 255891

SEQ ID NO: 462434 - RNA, 64 nt, Human; identical to SEQ ID NO: 255892

SEQ ID NO: 462435 - RNA, 64 nt, Human; identical to SEQ ID NO: 255893

SEQ ID NO: 462436 - RNA, 64 nt, Human; identical to SEQ ID NO: 255894

SEQ ID NO: 462437 - RNA, 64 nt, Human; identical to SEQ ID NO: 255895

SEQ ID NO: 462438 - RNA, 64 nt, Human; identical to SEQ ID NO: 174627

SEQ ID NO: 462439 - RNA, 64 nt, Human; identical to SEQ ID NO: 174628

SEQ ID NO: 462440 - RNA, 64 nt, Human; identical to SEQ ID NO: 174629

SEQ ID NO: 462441 - RNA, 64 nt, Human
uucuauuuugccaaaaaguuaaauaccgauaaaauggccuuaaguguauuccugacaguuaaau

SEQ ID NO: 462442 - RNA, 64 nt, Human
ugaguuugaggcagggucauuugugugauguguuuggccuuaccaaagcaaaagagggugcaag

SEQ ID NO: 462443 - RNA, 64 nt, Human
ggaagcuacgcggacuugcagagguuuuauuuuuuggccuuagaaucugcagaaauuaggaggc

SEQ ID NO: 462444 - RNA, 64 nt, Human
ggcagguggcaaggccuggccgggccuuccuuccuggccuuagccaccuggcucugucugcagc

SEQ ID NO: 462445 - RNA, 64 nt, Human
cggaccccgguuggccaaucacaacaggggggcguggccuuaccuucuccugcucgcccucagc

SEQ ID NO: 462446 - RNA, 64 nt, Human
cugccaaguacugcgcaugcaagagacccuuuauuggccuuacagugggccauucauuucuaua

SEQ ID NO: 462447 - RNA, 64 nt, Human
gaggacaucguuuuuaugcccauaaaaacauaaauggccuuauugaugcuuucagcagaauuuc

SEQ ID NO: 462448 - RNA, 64 nt, Human
ccugcaacacccacugcuggaaaucucuucauuguggccuuaucagauguuugaauuucagauc

SEQ ID NO: 462449 - RNA, 64 nt, Human
cagcaccagauaagcuucagugcucuccuuucuuuggccuuaauauuauuggauuaaagaauua

SEQ ID NO: 462450 - RNA, 64 nt, Human
cugcugcaaaccccgugaagguguaugccacaccuggccuuaaagagggacaggcugaagagag

SEQ ID NO: 462451 - RNA, 64 nt, Human
aaaagcauuuaaaaucaauagaucugggauuauguggccuuagguagcugguuguacaucuuuc

SEQ ID NO: 462452 - RNA, 64 nt, Human
gauauuuuauuguuuggccuauugauucuagaccuggccuuaagucugcaaaagccaucuuuau

SEQ ID NO: 462453 - RNA, 64 nt, Human
ccaagaagugcuuacugaaugccugcccugugcguggccuuaaacauugagaagugcugcucuc

SEQ ID NO: 462454 - RNA, 64 nt, Human; identical to SEQ ID NO: 174630

SEQ ID NO: 462455 - RNA, 64 nt, Human; identical to SEQ ID NO: 174631

SEQ ID NO: 462456 - RNA, 64 nt, Human; identical to SEQ ID NO: 174632

SEQ ID NO: 462457 - RNA, 64 nt, Human
gucaccucuuuuguucucucacacugaccagucuuggccuuaagcugacuuagaaggguuuuuc

SEQ ID NO: 462458 - RNA, 64 nt, Human
cagcugaaaaaggaaguugguuaugccaccuucuuggccuuaauggcauuaaaugaaauuuaua

SEQ ID NO: 462459 - RNA, 64 nt, Human
aaagcugaauggaaaaguuaagaacauuccuagguggccuuauucuaauaaguuucuucugucu

SEQ ID NO: 462460 - RNA, 64 nt, Human
gaagcuuucaucacagaacaguguugucuccaccuggccuuagauggcacgccaugauucgggc

SEQ ID NO: 462461 - RNA, 64 nt, Human
uaauuaaugucuuugaaaagggaaaaguauaaacuggccuuaaaauuguccaauuauaguuuua

SEQ ID NO: 462462 - RNA, 64 nt, Human
auguauauuugccuggcggacuauuugcguuguguggccuuaguuuguuuauugacauuaacga

SEQ ID NO: 462463 - RNA, 64 nt, Human
agaaagagccuggcaaggcccuguugacuagcaauggccuuagcugucccacacaacucagugg

SEQ ID NO: 462464 - RNA, 64 nt, Human
ccaggguaagauuccaacuuguccaaaagcuuucuggccuuacauauuuuauuauaaaaauucu

SEQ ID NO: 462465 - RNA, 64 nt, Human
ucugccuugggguugcccuuuucugagaucagacuggccuuaacagagcccaacuuucuuggaa

SEQ ID NO: 462466 - RNA, 64 nt, Human
gcauuuaucaauggcucaaaucuucauuuaucucuggccuuaacccuggcuccugaggcugcgg

SEQ ID NO: 462467 - RNA, 64 nt, Human
uaaaacugaggaugauuucccuaaugcuucugcuuggccuuauggaggagcugcuccuuccuua

SEQ ID NO: 462468 - RNA, 64 nt, Human
uuuauuaucucagugucuuuauuuagcauaaaaguggccuuagaagaagggugaagguuagaua

SEQ ID NO: 462469 - RNA, 64 nt, Human
uuuucaaaaucaaagcgacagcucuacuuccacuuggccuuagaucucugcuauacccugccau

SEQ ID NO: 462470 - RNA, 64 nt, Human
agucagggaaggggagaagaaagaaaaacacauuuggccuuaaaauagcaugcauucucccaga

SEQ ID NO: 462471 - RNA, 64 nt, Human
cauauagcagaccaaucuauuuuugugugcuguguggccuuauuuugcuucuugauacaggggc

SEQ ID NO: 462472 - RNA, 64 nt, Human
agaaccucccaaauuugaguugcacccuucccuguggccuuaugagcucagccucgcuuugagg

SEQ ID NO: 462473 - RNA, 64 nt, Human
aauuaauaaugccaguuuuccaagagugagaaaaucauugcacucuauacaguuuuaagauaua

SEQ ID NO: 462474 - RNA, 64 nt, Human
acuaauccuuacuauccuauuaggauaccacuuuucauugcaaaguuugugucaauaaagucau

SEQ ID NO: 462475 - RNA, 64 nt, Human
guaauucaugguugaguuucagaacaaaagauauucauugcacauuaaccauuuagaggucauu

SEQ ID NO: 462476 - RNA, 64 nt, Human
guacugccgcccaggguggguggccagugaggacuggccuuagcccaguggaccuguggcuucu

SEQ ID NO: 462477 - RNA, 64 nt, Human
cuuugucaauugucaguucugacuccuuuugcuguggccuuauccguacuauauuguggguaga

SEQ ID NO: 462478 - RNA, 64 nt, Human
gccccuagauguugccacauucacaucuccuugauggccuuagaucucuugacuagucaaggac

SEQ ID NO: 462479 - RNA, 64 nt, Human
aaaucuuugguuguguggaugccuguguucagaguggccuuaucuugaccucaguucuggauuu

SEQ ID NO: 462480 - RNA, 64 nt, Human
gcaaaacaccaaguuuuaaaaauaacucacagaauggccuuaguuuucaaugucugaugguaua

SEQ ID NO: 462481 - RNA, 64 nt, Human
cucaggcacagccagcugugagcucccaggucauuggccuuaccaguugucaggagucugugcu

SEQ ID NO: 462482 - RNA, 64 nt, Human
ucgugccuugccucucaggaccuggcacaguggcuggccuuauggaguauggaaaaggccucug

SEQ ID NO: 462483 - RNA, 64 nt, Human
cauuuuuuugugcuuuucccaguuugguguuagguggccuuaaguucucaguaaugacacuuau

SEQ ID NO: 462484 - RNA, 64 nt, Human
uauguccucuccucuguggcuggcaaggcucaccuggccuuauccacccacuuauggaaccuca

SEQ ID NO: 462485 - RNA, 64 nt, Human
gguuacaucugcuagcagaguaguguuaggaaccuggccuuacucuccucugacaaucgcaauu

SEQ ID NO: 462486 - RNA, 64 nt, Human
uuuuuguguucuugcugcaaugccuuuaccaaaguggccuuaaauaugaguagugaauugagaa

SEQ ID NO: 462487 - RNA, 64 nt, Human
ggagcucagucagccacaccuuccugcauccuauuggccuuauucauuuuaaaugaguuaauga

SEQ ID NO: 462488 - RNA, 64 nt, Human
acugaaggaucauuucuuggucuaggcuauaggcuggccuuagaaucaacucaccugguguccu

SEQ ID NO: 462489 - RNA, 64 nt, Human
auaucaccuccuuauugagacaaguuuggacaucuggccuuaagccucuguugaacaggagaag

SEQ ID NO: 462490 - RNA, 64 nt, Human
ugguucaaauuucucuuggaauuuuuacuuuuguuggccuuauuuuaugauccuuuucauauuu

SEQ ID NO: 462491 - RNA, 64 nt, Human
ugcaauuuuggguguucucuuucuuguuugcauauggccuuacuuauguggaagauuaauacug

SEQ ID NO: 462492 - RNA, 64 nt, Human; identical to SEQ ID NO: 174557

SEQ ID NO: 462493 - RNA, 64 nt, Human; identical to SEQ ID NO: 174558

SEQ ID NO: 462494 - RNA, 64 nt, Human; identical to SEQ ID NO: 174559

SEQ ID NO: 462495 - RNA, 64 nt, Human
uggcccaauaugcucaucacugauaaaugcucccuggccuuaaaaacuaccaacauauaauaua

SEQ ID NO: 462496 - RNA, 64 nt, Human
ggaaaaagaaaugcuuaauuaauuauucuguauuuggccuuauucgggcauuaggaaaucuaga

SEQ ID NO: 462497 - RNA, 64 nt, Human
uuacuuguugcaacccgaggaugggcaugagguuuggccuuagguauuccugucugggaaaaug

SEQ ID NO: 462498 - RNA, 64 nt, Human
uguacuacccacauaacugaaaauauuggccauuuggccuuaucugugagauuugacacuaagu

SEQ ID NO: 462499 - RNA, 64 nt, Human
uuaaugaauaucaguuuuaauuuauagacugccauggccuuaaaaauauucuguacaauauacu

SEQ ID NO: 462500 - RNA, 64 nt, Human
gauagagugugaaagguguguugcuugaaagguguggccuuagacacuaggagaugauggguag

SEQ ID NO: 462501 - RNA, 64 nt, Human
auaaauucaauggaucaauuuauuugucuucaaauggccuuaacuuggauugucuguuuggcca

SEQ ID NO: 462502 - RNA, 64 nt, Human
uaccgaguuuuauauaugagugggauacucaaucuggccuuaaaaagauacacaaagaugggcu

SEQ ID NO: 462503 - RNA, 64 nt, Human
auguguuaaccugucucugucaaccuaagaauguuggccuuacugacacaccuuugcuccaugu

SEQ ID NO: 462504 - RNA, 64 nt, Human
acuuugugaacauucccagguauuggagccucuguggccuuaaauguggcucaguggagggaga

SEQ ID NO: 462505 - RNA, 64 nt, Human
gagugaggccucugugcuguccugcccuggugcauggccuuagcuuucuaggccacugggaguu

SEQ ID NO: 462506 - RNA, 64 nt, Human
ggaagaggguuguucaaaugcccacuuuccaguuuggccuuaugcuucaugcagacuugagugu

SEQ ID NO: 462507 - RNA, 64 nt, Human
aagaaaaugcaucaucaguuugcuauuucccugauggccuuaauuuuagaguggucuuggauua

SEQ ID NO: 462508 - RNA, 64 nt, Human
aacauguuuaggcaacuagucagaaaaccagcuauggccuuacagaaagggaaaaauuaaccca

SEQ ID NO: 462509 - RNA, 64 nt, Human
aggaaaaagguaaauacagcauugaggcuucauuuggccuuagucccugggaguuacuggcguu

SEQ ID NO: 462510 - RNA, 64 nt, Human
uuuggauaaguacacaaagcgucaaugcuguuaauggccuuagcaaaggcucaugcugaaauuu

SEQ ID NO: 462511 - RNA, 64 nt, Human; identical to SEQ ID NO: 174560

SEQ ID NO: 462512 - RNA, 64 nt, Human; identical to SEQ ID NO: 174561

SEQ ID NO: 462513 - RNA, 64 nt, Human; identical to SEQ ID NO: 174562

SEQ ID NO: 462514 - RNA, 64 nt, Human
gcuggacuuucggacucuuggacuuuuggaugccuggccuuaggcuguggcccagaagcuggaa

SEQ ID NO: 462515 - RNA, 64 nt, Human
aaguucauucccacccaaagucagaaucccucauuggccuuaagguagcagucauaagacagag

SEQ ID NO: 462516 - RNA, 64 nt, Human
aauugcacuuuaauugauuaauccucaauucauguggccuuacgggauggugggucugggaccc

SEQ ID NO: 462517 - RNA, 64 nt, Human
uuuuuaaaggacaaacagugaauuuaagcaugaguggccuuaauaaauauaguugucuuucuuu

SEQ ID NO: 462518 - RNA, 64 nt, Human
ugaauguuuugaugaaaugaauguuuuuguauaauggccuuaaacuuuucuggaaguauuucaa

SEQ ID NO: 462519 - RNA, 64 nt, Human
ugcaggcuuccuguccuuuugugguaugguuuuuuggccuuauuuucacuggcuuuuccuucuc

SEQ ID NO: 462520 - RNA, 64 nt, Human
gugaauaauaguuuucccagucucccucggaugguggccuuaaggccugguagugcuucaagag

SEQ ID NO: 462521 - RNA, 64 nt, Human
uugauuaaucucuacaucauuuuaacagcugguauggccuuaccuugggugaacuaaccaaaua

SEQ ID NO: 462522 - RNA, 64 nt, Human
agaggagcaguaaaagauagcauuugguuugacauggccuuagugaguccugccuuuccuagca

SEQ ID NO: 462523 - RNA, 64 nt, Human
gcauaaaagacaggauuuuuugugcuaccaauucuggccuuacuggaccauaaaguuaauuaua

SEQ ID NO: 462524 - RNA, 64 nt, Human
uggccucaaaggcccuagaacuugccuaccuuucuggccuuaccuccuagcuacuuauccaucu

SEQ ID NO: 462525 - RNA, 64 nt, Human
gcagcagcuggggugucgggcagaaugugacuuguggccuuaccauggacuugaaugggacuug

SEQ ID NO: 462526 - RNA, 64 nt, Human
ccguguagauacugagaggugguggcaguaauuguggccuuaucagccgcucaguuccaggcuu

SEQ ID NO: 462527 - RNA, 64 nt, Human
gacgcucuuuaaguuugauuccuaacacuggaguuggccuuaaacaaaacaaacacaaaaacuu

SEQ ID NO: 462528 - RNA, 64 nt, Human
cuuuuuuggggauugaggggccuacauaacuagcuggccuuaccccauaucuuuuguucaaaca

SEQ ID NO: 462529 - RNA, 64 nt, Human
ucucagccagcucuaaaacagauugcuuuuucaguggccuuacucuuuguggguuuuuuuuuuu

SEQ ID NO: 462530 - RNA, 64 nt, Human; identical to SEQ ID NO: 174564

SEQ ID NO: 462531 - RNA, 64 nt, Human; identical to SEQ ID NO: 174565

SEQ ID NO: 462532 - RNA, 64 nt, Human; identical to SEQ ID NO: 174566

SEQ ID NO: 462533 - RNA, 64 nt, Human
acuggucauuucagaaaauucuucauagugguauuggccuuauauuuaacuuuuuuuuuauuuu

SEQ ID NO: 462534 - RNA, 64 nt, Human
uggaggaggcaagaccugugggucaauuuugaacuggccuuacuuugauuuuuaaaacaagaga

SEQ ID NO: 462535 - RNA, 64 nt, Human
uacuaacuuguuaaaagauaucuauauaauugccuggccuuauauuuuucaguagauuagaccg

SEQ ID NO: 462536 - RNA, 64 nt, Human
caugguuuggaagagauaaaccugaaaagaagaguggccuuaucuucacuuuaucgauaaguca

SEQ ID NO: 462537 - RNA, 64 nt, Human
uuguaaaauaucccaacaguucuuaaaugaaaacuggccuuaagucuauucaagcaugacagca

SEQ ID NO: 462538 - RNA, 64 nt, Human
ggaauuuuuugauccuguaaucacaacucagcauuggccuuaauauaccuaaaucuccaaaaac

SEQ ID NO: 462539 - RNA, 64 nt, Human
aauugaagaaaacccuuuaguugucuacauuggauggccuuauuaccucucaaucaucuuuuca

SEQ ID NO: 462540 - RNA, 64 nt, Human
uuccuuuaugugaauuuuuaagcugcaaaucugauggccuuaauuuccuuuuugacacugaaag

SEQ ID NO: 462541 - RNA, 64 nt, Human
aagugcugggauuacaggcgugagccacugcaccuggccuuauaaauauccuuuuaacuaacuc

SEQ ID NO: 462542 - RNA, 64 nt, Human
gcuuucaagaaccagagaaccugauugcugaugauggccuuaaagguggugagggagauacugg

SEQ ID NO: 462543 - RNA, 64 nt, Human
ccuuuugcuaccacucaaggaaggaagucaccaguggccuuagugcaggaaacucagcccuggu

SEQ ID NO: 462544 - RNA, 64 nt, Human
uuguauccuuuauuucugauaagacaugaaagguuggccuuacuguugaacaauaaguaaaucc

SEQ ID NO: 462545 - RNA, 64 nt, Human
gacuuugucuuaagugcauucacgcacuuacucuuggccuuauguacacagccuugcccggccg

SEQ ID NO: 462546 - RNA, 64 nt, Human
uuggucugcagaccauccagaggaauaaaaagguuggccuuaguagucaaaaacaaagcugaua

SEQ ID NO: 462547 - RNA, 64 nt, Human
gugcucagggcuugguacaaugagcugaauuagauggccuuaugaaacucuuucuaaccucuua

SEQ ID NO: 462548 - RNA, 64 nt, Human
uuugaaaucccaucaggucaccgcgaggccugacuggccuuauuguugaauaaauguaucugaa

SEQ ID NO: 462549 - RNA, 64 nt, Human; identical to SEQ ID NO: 174567

SEQ ID NO: 462550 - RNA, 64 nt, Human; identical to SEQ ID NO: 174568

SEQ ID NO: 462551 - RNA, 64 nt, Human; identical to SEQ ID NO: 174569

SEQ ID NO: 462552 - RNA, 64 nt, Human
aaauagaugggacuacugaugcacacugccaugcuggccuuacgaaauguuuuaauaggcauuu

SEQ ID NO: 462553 - RNA, 64 nt, Human
auaaguggcucauuuuacugucuucugauccugguggccuuauuuuugcuauguuaagguugug

SEQ ID NO: 462554 - RNA, 64 nt, Human
uuuucccccaguggcuucaccucauuccucccacuggccuuaccccuuccuuccccaguggaag

SEQ ID NO: 462555 - RNA, 64 nt, Human
agaggaaagagaaggguauuuguauacaaagcccuggccuuaaagaauguuacuuaguagcuac

SEQ ID NO: 462556 - RNA, 64 nt, Human
cuuguuuguucugcuucucuucauauaacugagcuggccuuauccuuggcaucccccuaaacaa

SEQ ID NO: 462557 - RNA, 64 nt, Human
uuggauggggcauauuucugugcuguggaugacauggccuuacuccagaaucccaggcccucca

SEQ ID NO: 462558 - RNA, 64 nt, Human
uggcuucccauaguggggccugggaggguuccccuggccuuaaaaggggcccaagccccaucuc

SEQ ID NO: 462559 - RNA, 64 nt, Human
ccugggccagcagggaccucugaagccuucuuuguggccuuauuuuuuuuuuuuuuuuuuucau

SEQ ID NO: 462560 - RNA, 64 nt, Human
cacuuaacauuuuuuaggucugcuuuuucuuauuuggccuuauuucugcaccaugaaauuaaaa

SEQ ID NO: 462561 - RNA, 64 nt, Human
gauuuguuggguuuuaugagaggcuguuacuuaguggccuuaaaucuuuucugaaugucuguuu

SEQ ID NO: 462562 - RNA, 64 nt, Human
ugcucagguuugguaacccgggaguguucccagguggccuuagaaagcaaagcuuguaacuggc

SEQ ID NO: 462563 - RNA, 64 nt, Human
uacagcugugcuuaaaacccucauuucauauaaauggccuuaaguuuucuaauucaagcggguu

SEQ ID NO: 462564 - RNA, 64 nt, Human
ccccugacacuccacagugugccugcaacccaaguggccuuauccgugcagugguggcaguuca

SEQ ID NO: 462565 - RNA, 64 nt, Human
caccauaaggaaugugggaaaguuuucagccacauggccuuauuugacuucaaagaauccacau

SEQ ID NO: 462566 - RNA, 64 nt, Human
ucgcccucugggucagggugacugaggcauuuuguggccuuaaaacgggguguucagggucagc

SEQ ID NO: 462567 - RNA, 64 nt, Human
aauauugcaagaggcgaguuuaaaauucugcagauggccuuauuuguguauuugucuuuuuauu

SEQ ID NO: 462568 - RNA, 64 nt, Human; identical to SEQ ID NO: 174634

SEQ ID NO: 462569 - RNA, 64 nt, Human; identical to SEQ ID NO: 174635

SEQ ID NO: 462570 - RNA, 64 nt, Human; identical to SEQ ID NO: 174636

SEQ ID NO: 462571 - RNA, 64 nt, Human
uucuuuccuuucaauuauagugacauagaguaguuggccuuauaaguagaucccauuuagcccc

SEQ ID NO: 462572 - RNA, 64 nt, Human
cuggauugauacaagguugagaaaugaaugcuccuggccuuaaacaucaccguaggaaggguuu

SEQ ID NO: 462573 - RNA, 64 nt, Human
auuuaaccauagcugccaaagcuaugcacccaguuggccuuagaaaaccacaauguuuacagcc

SEQ ID NO: 462574 - RNA, 64 nt, Human
ggcaguuggggaauaaucugacuucguuggcaguuggccuuaacuucuuaaucauugauccagg

SEQ ID NO: 462575 - RNA, 64 nt, Human
uuggcaaagucagucgacauaagcccuguggauauggccuuauguacacuguaaugcagacagg

SEQ ID NO: 462576 - RNA, 64 nt, Human
cccuggcugaccuggccuagcaguuuggcccugcuggccuuagcagggagacaggggagcaaag

SEQ ID NO: 462577 - RNA, 64 nt, Human
ggaaaggcccucugcuuuucuucccagcaaagguuggccuuacgaaauccuuugugucgauuuc

SEQ ID NO: 462578 - RNA, 64 nt, Human
uugaagauaaauaagguagcaaugucuauaguuuuggccuuaacuaugccaaucuaauuauaau

SEQ ID NO: 462579 - RNA, 64 nt, Human
ugcagauaaaauuauuuuacugaagaucuagcaauggccuuaauuagcaacuggugaguucuaa

SEQ ID NO: 462580 - RNA, 64 nt, Human
agcccccagcccccagcuggccccugacuccauguggccuuagcugggcccaucugcugggccu

SEQ ID NO: 462581 - RNA, 64 nt, Human
gguaugucuugcuuaaguauuucuucuccaugaauggccuuaacauuauuuuguauucacgugu

SEQ ID NO: 462582 - RNA, 64 nt, Human
auugccuuuuguccauuaaucagcaaauaaaacauggccuuaacaaaguuguuuguguuauugu

SEQ ID NO: 462583 - RNA, 64 nt, Human
caccugcuggggcaccauucuuaguauacagagguggccuuacacacaucuugcauggauggca

SEQ ID NO: 462584 - RNA, 64 nt, Human
ccuggaagugaagagaaaugaacccacuauguuuuggccuuaaaauucuucugugaaauuucaa

SEQ ID NO: 462585 - RNA, 64 nt, Human
guaguccuuugauagaagauaaugacuugguuuauggccuuaauauacuacuuaauuacuuaag

SEQ ID NO: 462586 - RNA, 64 nt, Human
aaugaaucuguuaaaauguuugauuccuugggaauggccuuaaaaauaaauguaauaaagucag

SEQ ID NO: 462587 - RNA, 64 nt, Human; identical to SEQ ID NO: 174571

SEQ ID NO: 462588 - RNA, 52 nt, Human; identical to SEQ ID NO: 174572

SEQ ID NO: 462589 - RNA, 64 nt, Human; identical to SEQ ID NO: 174573

SEQ ID NO: 462590 - RNA, 64 nt, Human
aacacuuggaacaguguuuacuuuaaauccuuaauggccuuaauuaauucucagauuccugccc

SEQ ID NO: 462591 - RNA, 64 nt, Human
aaacgaacaaaaugguuuuaguuuugcugaagacuggccuuauuaauggacagcuuuccuaaca

SEQ ID NO: 462592 - RNA, 64 nt, Human
aaaaagaaaaaaaaaaacgcauucagguuaaauuuggccuuaauuuaauauacuuguuagcaag

SEQ ID NO: 462593 - RNA, 64 nt, Human
aagcgguggaauuagaggcgugagcccccaugcuuggccuuaccuuucuacuuuuauaauucug

SEQ ID NO: 462594 - RNA, 64 nt, Human
ccccuccucacaucccucuauugcggauccacaguggccuuacucuuaacuuggaugagagcaa

SEQ ID NO: 462595 - RNA, 64 nt, Human
cuuaagaagucaucaaauuagugaacugagacauuggccuuaguaggcuguauucacugcuaau

SEQ ID NO: 462596 - RNA, 64 nt, Human
uguacucugcagacugaaaagacaaaguuuaucuuggccuuacuguauaaaggugugcuguguc

SEQ ID NO: 462597 - RNA, 64 nt, Human
gcuugccucuccuccaauuccaaacuuagugaaauggccuuaagcauuuuaaacuguauguaua

SEQ ID NO: 462598 - RNA, 64 nt, Human
auuaauagauuugcauguacauagaagucuuuguuggccuuauaaucugcuguuauauuuggca

SEQ ID NO: 462599 - RNA, 64 nt, Human
cagagcauugccauugacaucaaacucuauggcguggccuuaucgauugcagugggaaguuguu

SEQ ID NO: 462600 - RNA, 64 nt, Human
uuuuacauuaaugguuucacaguugccaauuacuuggccuuaaggguaaaaaguacaauauaca

SEQ ID NO: 462601 - RNA, 64 nt, Human
uggccuuuugguuugaagccacagguguggcuucuggccuuagcagaugguaugcuugcggacc

SEQ ID NO: 462602 - RNA, 64 nt, Human
aaaggaaaagagagaaaaaggcaaagcaagguuguggccuuagguuggaccuggaauaucccuu

SEQ ID NO: 462603 - RNA, 64 nt, Human
auauauuuauauuauaagauuaaacugacuuucuuggccuuaacaagguccuuauauaaaauuu

SEQ ID NO: 462604 - RNA, 64 nt, Human
uauugcacagugcacuuauuuuguggccaaagcauggccuuaccagcuugucugcacuauuuuc

SEQ ID NO: 462605 - RNA, 64 nt, Human
gaaagaaaccuuugggaauggauaucagaagauuuggccuuaauauauuuccauugugaccagc

SEQ ID NO: 462606 - RNA, 64 nt, Human; identical to SEQ ID NO: 174574

SEQ ID NO: 462607 - RNA, 64 nt, Human; identical to SEQ ID NO: 174575

SEQ ID NO: 462608 - RNA, 64 nt, Human; identical to SEQ ID NO: 174576

SEQ ID NO: 462609 - RNA, 64 nt, Human
ugccugcuuaaugguguuaauaauacaaaugaauuggccuuauuuucaaggauuuuauaaauga

SEQ ID NO: 462610 - RNA, 64 nt, Human
agaaggacagucugguuaaaauuauauugacugguggccuuagggaucuagaaacuucuacuaa

SEQ ID NO: 462611 - RNA, 64 nt, Human
uuugaauuuuaacauugguuauuuauuuguguaauggccuuacauguggauauuaacaguguaa

SEQ ID NO: 462612 - RNA, 64 nt, Human
ccuccuguguugcccaggcugguauucaaacuccuggccuuaugcauuccucccacccuggccu

SEQ ID NO: 462613 - RNA, 64 nt, Human
uaaauaaguuguauaaguuugggcugaagaaaccuggccuuauaucauuucauauaaaaaagac

SEQ ID NO: 462614 - RNA, 64 nt, Human
gggagaugcuuccuucuguaacaccagaaccauuuggccuuaauuccaaugugagagacagaau

SEQ ID NO: 462615 - RNA, 64 nt, Human
gcuacuuuaagggguuuguccaaaauaaauauuguggccuuauauaucacacuauuguagaaag

SEQ ID NO: 462616 - RNA, 64 nt, Human
accauucuggccuuccccaccccacauccucucuuggccuuacugaagaugggggaaggguaag

SEQ ID NO: 462617 - RNA, 64 nt, Human
ugccaccuaggccaguuuugacccuggcauuaacuggccuuagaagaaacuggauccugguagg

SEQ ID NO: 462618 - RNA, 64 nt, Human
cacuggccucucugcagggccuuccgcccagcgcuggccuuaaugcuaaagccaaaugcagcuu

SEQ ID NO: 462619 - RNA, 64 nt, Human
uuguauuuucacuuuaugaaugaggaaacugaaauggccuuaagggagcaaguuauuucuuuuu

SEQ ID NO: 462620 - RNA, 64 nt, Human
guuaagcuguccaaaucaacaagggucauauaaauggccuuaaacuuugggguugcuuucugca

SEQ ID NO: 462621 - RNA, 64 nt, Human
cucaaauuccugaccccaggugaucugcccaccuuggccuuaaaaagugcugggauuaaaggcg

SEQ ID NO: 462622 - RNA, 64 nt, Human
uauuaaacaaaaauaacaaaaaaagaaacaaccuuggccuuaaugucaauaaaagggaguugug

SEQ ID NO: 462623 - RNA, 64 nt, Human
accgcgccuggucuauaugugauuucaaauuagguggccuuauaaauauaagcagaugguuucu

SEQ ID NO: 462624 - RNA, 64 nt, Human
ccgacgacaaaucuuuuggcagauuuucuucuaguggccuuagaaaacaugggcuuuuaagaaa

SEQ ID NO: 462625 - RNA, 64 nt, Human; identical to SEQ ID NO: 174578

SEQ ID NO: 462626 - RNA, 64 nt, Human; identical to SEQ ID NO: 174579

SEQ ID NO: 462627 - RNA, 64 nt, Human; identical to SEQ ID NO: 174580

SEQ ID NO: 462628 - RNA, 64 nt, Human
ggaggaggggaagggaggaaugggccaccauauuuggccuuacaggaauuaaggagacuuccug

SEQ ID NO: 462629 - RNA, 64 nt, Human
cccugauccuaugcucuauuuaaaagauaaccuuuggccuuagacuccguuagcuccuauuucc

SEQ ID NO: 462630 - RNA, 64 nt, Human
aaguuaaugaacacuucucuaguuuucuuaguuauggccuuaauaauuagucucuuggcuuaaa

SEQ ID NO: 462631 - RNA, 64 nt, Human
ggauugugcuucauuccaaucuauugcuucaccauggccuuaugaggcaggugagagauguuug

SEQ ID NO: 462632 - RNA, 64 nt, Human
uucucccuccccccacccccauaggaacaggauuuggccuuagcuucugggccuaucggcugcc

SEQ ID NO: 462633 - RNA, 64 nt, Human
guaucucacagggaaacauuuucuuucauuccaguggccuuagucaucucugaagaaauacuua

SEQ ID NO: 462634 - RNA, 64 nt, Human
uguucuaaagaaagauugcugggaaguuucuccguggccuuagguuucugacauccuggauagu

SEQ ID NO: 462635 - RNA, 64 nt, Human
auggccaguugccaggccccagcgccagccagucuggccuuacccuccgguuggcgccugccag

SEQ ID NO: 462636 - RNA, 64 nt, Human
cuaggcccauguggucugggcccuuccagugcuuuggccuuacgcccuuccccuugaccuuguc

SEQ ID NO: 462637 - RNA, 64 nt, Human
ucuguuacagguuuccaagguggacuugaacagauggccuuauauuaccaaaacuuuuauauuc

SEQ ID NO: 462638 - RNA, 64 nt, Human
uugugucuaaauuaaagcauuucuuuagaacaaauggccuuaaauucucacggaauuccuggaa

SEQ ID NO: 462639 - RNA, 64 nt, Human
cagcugccacacccccgacacuccugcuguccacuggccuuagcuccugcaaguuccccagugu

SEQ ID NO: 462640 - RNA, 64 nt, Human
ccacugcaauuccuccuagggcugcacaaucauguggccuuagggcacacuguccugcauccag

SEQ ID NO: 462641 - RNA, 64 nt, Human
caccaccccacuaagccuuggcaaccucauuuuguggccuuauuauuaaagauugcuugguagu

SEQ ID NO: 462642 - RNA, 64 nt, Human
aggguaaucuucaguuggcccugauucaauuaaauggccuuaauuuuuuuuuaaggaauuugug

SEQ ID NO: 462643 - RNA, 64 nt, Human
ccacucagaggcagagacugaguuaagucauagguggccuuaggcaucugcauuguuugcaggg

SEQ ID NO: 462644 - RNA, 64 nt, Human; identical to SEQ ID NO: 174581

SEQ ID NO: 462645 - RNA, 64 nt, Human; identical to SEQ ID NO: 174582

SEQ ID NO: 462646 - RNA, 64 nt, Human; identical to SEQ ID NO: 174583

SEQ ID NO: 462647 - RNA, 64 nt, Human
ugaggaccaggacccagccccguggcuccuugauuggccuuagggugggcaucagcagacguuc

SEQ ID NO: 462648 - RNA, 64 nt, Human
gucagcagccaaaacaccaggaaacacauuucuguggccuuagccaagcaguuuguuaguuaca

SEQ ID NO: 462649 - RNA, 64 nt, Human
gaaggauuucuagaucgcuucaagccuauacugauggccuuagcuuuguucagucauuguaacu

SEQ ID NO: 462650 - RNA, 64 nt, Human
ugugaucuaagugccagaaccauggaggagacucuggccuuaucuguagggaccuaaauuuuuu

SEQ ID NO: 462651 - RNA, 64 nt, Human
aauguagacuuacuuugaauaaaauuaguuuaauuggccuuaaaauuacauuaauaaaacuuug

SEQ ID NO: 462652 - RNA, 64 nt, Human
cagaaacagccagggguggauucuuuaucaccaguggccuuacuucguaagcagaauuuccagc

SEQ ID NO: 462653 - RNA, 64 nt, Human
acuuagccagaguuagguugucuccaggccaugauggccuuacacugaaaaugucacauucuau

SEQ ID NO: 462654 - RNA, 64 nt, Human
uauuuaaaaggaaaagaauaaguauucuugcaucuggccuuagaaaugugaaguuauauucuca

SEQ ID NO: 462655 - RNA, 64 nt, Human
cucaaggaaaaaaacaaacgcagaauugggauauuggccuuaggauaucugcuuaaaguccuac

SEQ ID NO: 462656 - RNA, 64 nt, Human
auagagaagaaagggaaguagggcagugcaugacuggccuuagguuuuuucuuuccaaguuuau

SEQ ID NO: 462657 - RNA, 64 nt, Human
gacacuccauccuugccaaaccucuacccaaaaguggccuuaagcaccggaaugccaauuaacu

SEQ ID NO: 462658 - RNA, 64 nt, Human
gcugagggacgagagaccaggaugauuucgagguuggccuuagaggaaacagaucaugggaauu

SEQ ID NO: 462659 - RNA, 64 nt, Human
aaauuuuguuugacuccuaacaaaagacaauggauggccuuagcaucagaauuaaaauaaucug

SEQ ID NO: 462660 - RNA, 64 nt, Human
cccaggacuuagccucaguugacgauaguaacaauggccuuaacaucuaccuuaacagcuaccu

SEQ ID NO: 462661 - RNA, 64 nt, Human
ggggcggcucuguacagugugacugguggacagauggccuuaggcacaggugguuuugaaaucu

SEQ ID NO: 462662 - RNA, 64 nt, Human
ggaacccgaaaaagaaacuugauuccucuauugcuggccuuacuugaugucuuuuauaaaacuu

SEQ ID NO: 462663 - RNA, 64 nt, Human; identical to SEQ ID NO: 174585

SEQ ID NO: 462664 - RNA, 64 nt, Human; identical to SEQ ID NO: 174586

SEQ ID NO: 462665 - RNA, 64 nt, Human; identical to SEQ ID NO: 174587

SEQ ID NO: 462666 - RNA, 64 nt, Human
uuaaacccuuuauuugccagccugucugugucguuggccuuaugacgaggagugccuguggguu

SEQ ID NO: 462667 - RNA, 64 nt, Human
ugaauaaaacaaugcaacuuagcaaaccaauuuauggccuuagagaaacauuuuugcaugaguu

SEQ ID NO: 462668 - RNA, 64 nt, Human
uccuuucccccuccuccgggggccaaggacaggguggccuuacucaguaaagguguuuccugca

SEQ ID NO: 462669 - RNA, 64 nt, Human
uguuggaacugaacaauaauauuucccagauagcuggccuuagcaugugaucacgguuguugua

SEQ ID NO: 462670 - RNA, 64 nt, Human
uaagagagcucaucucauuuuuacuuuugaacguuggccuuacaaucaaauguaaguuauauau

SEQ ID NO: 462671 - RNA, 64 nt, Human
caagugagggugguaaauguaggagaaagagccuuggccuuaaggaaaucuuuacuccuguaag

SEQ ID NO: 462672 - RNA, 64 nt, Human
aucaccgugaauccggcuuccucugagcauucgauggccuuagcaccucaucaagccagcacau

SEQ ID NO: 462673 - RNA, 64 nt, Human
cagcuuggcucucccagagaggugaaggagcaccuggccuuaggaauccuggcugccaccacca

SEQ ID NO: 462674 - RNA, 64 nt, Human
cugaaagauuuguaucucugugcuugaacuugaauggccuuaaaccuguuucagcuuuaacagu

SEQ ID NO: 462675 - RNA, 64 nt, Human
gcccuuccugcuccagcuacaguugggccagcuguggccuuaguggauggucuggguggauggc

SEQ ID NO: 462676 - RNA, 64 nt, Human
gcucuccuuccagaacgaaagggcugauaauuuuuggccuuaguuccagguagauuaaaaagcu

SEQ ID NO: 462677 - RNA, 64 nt, Human
uuuuguagcuggguuaaaucuuuuuauuuuaguauggccuuauggcaaagaacacuguauuauu

SEQ ID NO: 462678 - RNA, 64 nt, Human
acugcaguauucccaauugcacuggcccugggcauggccuuacccagucuaagcuggcaggauc

SEQ ID NO: 462679 - RNA, 64 nt, Human
cuggacagggcuuugcccuuggaggauccccagguggccuuacccgugauucuuacucggcauc

SEQ ID NO: 462680 - RNA, 64 nt, Human
augagauagucccuuuacuguccucaaauggacuuggccuuagagacgugguaaagcacuuugg

SEQ ID NO: 462681 - RNA, 64 nt, Human
ugggucccuggaccuaacccugcuuucauccugguggccuuaacuacaguggagguggaacuuc

SEQ ID NO: 462682 - RNA, 64 nt, Human; identical to SEQ ID NO: 174588

SEQ ID NO: 462683 - RNA, 64 nt, Human; identical to SEQ ID NO: 174589

SEQ ID NO: 462684 - RNA, 64 nt, Human; identical to SEQ ID NO: 174590

SEQ ID NO: 462685 - RNA, 64 nt, Human
acaggugggcuccuagcagcugauccccaaugccuggccuuaaagccgagcucaguuaccauag

SEQ ID NO: 462686 - RNA, 64 nt, Human
cuucaguggguagaauggggccagggcccagcuuuggccuuagcuugacggcagggccccugcc

SEQ ID NO: 462687 - RNA, 64 nt, Human
gggcacccccgucuagaaugccagaaccagcggguggccuuaggggcugugaggcaguggggac

SEQ ID NO: 462688 - RNA, 64 nt, Human
ccucuucuuucucuuucuuuucccuuugggcccuuggccuuacuaugaugauaugagauucuuu

SEQ ID NO: 462689 - RNA, 64 nt, Human
uugaugacgauucuuaacaauaacgauacaaauuuggccuuaagaacugugucuggcguucuca

SEQ ID NO: 462690 - RNA, 64 nt, Human
acugaaagucuguggcccaagagagagacacaaguggccuuaagucuuuuugaaguguuauuuc

SEQ ID NO: 462691 - RNA, 64 nt, Human
accaggggugcagccagcuuuuggagaaccuggauggccuuaggguuccuucugcggcuauugc

SEQ ID NO: 462692 - RNA, 64 nt, Human
auucauagcuuugucuagaaggaguaaaauaucauggccuuaacacaaagggugcugcguagaa

SEQ ID NO: 462693 - RNA, 64 nt, Human
uuguuuaaguacaggaucaagccuugcuugagauuggccuuaccucuggacuuuuuuuguuaua

SEQ ID NO: 462694 - RNA, 64 nt, Human
auuugaccauguggcccaggccaaagcccaguguuggccuuacgcauggucggcaggagaguca

SEQ ID NO: 462695 - RNA, 64 nt, Human
acauguaauaauauuuuccucaguacaauuuugcuggccuuaacugguaucaaacgcugucauu

SEQ ID NO: 462696 - RNA, 64 nt, Human
aaggggcagagaguagggucuagcuggcuaucucuggccuuacuaacaccccccuggaggcaug

SEQ ID NO: 462697 - RNA, 64 nt, Human
uucaccucucagcacugaaaacccaaaacccagcuggccuuaacacuccuuaaagacagaaguc

SEQ ID NO: 462698 - RNA, 64 nt, Human
uuaacaggguucaaagaugagagcugaaaaaucguggccuuaacaacugaaagcuuuacagugu

SEQ ID NO: 462699 - RNA, 64 nt, Human
cagggcuucucuggagcagauauugucaaguucauggccuuagguagcauguaucuggucuuaa

SEQ ID NO: 462700 - RNA, 64 nt, Human
uuggccucaggagagucaccuuuucucacggcccuggccuuaacucauaucuuaggcauuccug

SEQ ID NO: 462701 - RNA, 57 nt, Human; identical to SEQ ID NO: 174637

SEQ ID NO: 462702 - RNA, 64 nt, Human; identical to SEQ ID NO: 174638

SEQ ID NO: 462703 - RNA, 50 nt, Human; identical to SEQ ID NO: 174639

SEQ ID NO: 462704 - RNA, 64 nt, Human
aaacaggcgcggggucucagguuggauuauuuguuggccuuaagucccaacugauguccauuag

SEQ ID NO: 462705 - RNA, 64 nt, Human
cuuuaauugcaauccuagguaucuauagcaugaguggccuuagugaguuuguugaagugcacau

SEQ ID NO: 462706 - RNA, 64 nt, Human
aagaagacagagcuaauggauaaauaucauaacauggccuuacaugucugcugucaucagcccu

SEQ ID NO: 462707 - RNA, 64 nt, Human
uccccugcuuccucagcgggaccccuucaucuguuggccuuaccuguccucagaaaggaagagg

SEQ ID NO: 462708 - RNA, 64 nt, Human
agcugcaggcugacgagagauggucccuucccauuggccuuagcccaagacuuggagucgaccc

SEQ ID NO: 462709 - RNA, 64 nt, Human
uggauaccaaauuaaucaacuaauuugagcuaucuggccuuacucuuaguaguuuuuaguacgu

SEQ ID NO: 462710 - RNA, 64 nt, Human
cugaguggccuguaguccaucuccagcauguaacuggccuuacgauggcaauuggcaucauucu

SEQ ID NO: 462711 - RNA, 64 nt, Human
cguuuucaucuucuaguuugucuauuuuaauaaauggccuuacauuaaaaaauuguaaagaaau

SEQ ID NO: 462712 - RNA, 64 nt, Human
cagaaugguucuacaguucauaacauuuugaagguggccuuauuuugugauagucugcuucaug

SEQ ID NO: 462713 - RNA, 64 nt, Human
ugaaacucugucuuaaaaaacacaaaaaaagacuuggccuuagggccgagugcgguggcucacg

SEQ ID NO: 462714 - RNA, 64 nt, Human
gucucuaucuccugaccucgugaucugccugccuuggccuuauuauuuuuuuuuuuuaaggaca

SEQ ID NO: 462715 - RNA, 64 nt, Human
ucagccucugucuccuuccaucccugucccugucuggccuuaacucuucccucuuuuucuuuuc

SEQ ID NO: 462716 - RNA, 64 nt, Human
agaaguucaaagccuuuaaaguuucaucugauucuggccuuagaauuguccuuaaaagcuuucu

SEQ ID NO: 462717 - RNA, 64 nt, Human
cuucccuccuuucucguccaaaucaugaaauguuuggccuuagucaaugucuaugcccgucaca

SEQ ID NO: 462718 - RNA, 64 nt, Human
agggcagcugccuuaaccucugagagucugcgcuuggccuuaguccuggagacccagccuccag

SEQ ID NO: 462719 - RNA, 64 nt, Human
aaaugccuuuuggagguuguaaugacucauggauuggccuuagauaccauccugagggucugaa

SEQ ID NO: 462720 - RNA, 64 nt, Human; identical to SEQ ID NO: 174592

SEQ ID NO: 462721 - RNA, 64 nt, Human; identical to SEQ ID NO: 174593

SEQ ID NO: 462722 - RNA, 64 nt, Human; identical to SEQ ID NO: 174594

SEQ ID NO: 462723 - RNA, 64 nt, Human
aaaugccuuuuggagguuguaauggcucacagauuggccuuagaugcaucccgagggucugaaa

SEQ ID NO: 462724 - RNA, 64 nt, Human
guugguaacuuguuggguuuuuuuccaaccaucauggccuuaucuguuccaguuuucucagugu

SEQ ID NO: 462725 - RNA, 64 nt, Human
cuccuguguauugcccugguucaugugaugauaauggccuuaugauaaagccgccuuuagucuu

SEQ ID NO: 462726 - RNA, 64 nt, Human
gccaaaguguuugaguccaucggcaaguuuggccuggccuuagcuguugcaggaggcaugguga

SEQ ID NO: 462727 - RNA, 64 nt, Human
ccauucuggggaauuuauauuugaauugaggcuuuggccuuaacacccaggaacuuuucuauua

SEQ ID NO: 462728 - RNA, 64 nt, Human
cacgucaucaggaccuccugagguucguguuaauuggccuuagacucucccuguccccagaccc

SEQ ID NO: 462729 - RNA, 64 nt, Human
ucucacuguguugcccaagcuugucuugaacuccuggccuuaagugauccucccaccucagccu

SEQ ID NO: 462730 - RNA, 64 nt, Human
cauuguccuucugauuugguccauguguuggguuuggccuuaguagaaaucucugaaggcagca

SEQ ID NO: 462731 - RNA, 64 nt, Human
cuaauuaugguuacuuuccuugugaugaaaaacuuggccuuacagggcucuaguuaugguuacu

SEQ ID NO: 462732 - RNA, 64 nt, Human
guuucuuuccuguuugucuugugucuugagagcuuggccuuaugaccagugagaacucucuccc

SEQ ID NO: 462733 - RNA, 64 nt, Human
aagugcugagauuacaggcgugagccacugugccuggccuuauguaaagcucuugaccuagcau

SEQ ID NO: 462734 - RNA, 64 nt, Human
ccucucaucacagcuuugugugugggcugagugcuggccuuaacccuaggcguggaagagaaaa

SEQ ID NO: 462735 - RNA, 64 nt, Human
gggaggucugagugguggucuuugggauaaccuuuggccuuauggauuuggacucgaaauuaga

SEQ ID NO: 462736 - RNA, 64 nt, Human
auugaaaauguccaggaaaguggccaagaagcaguggccuuauugcaucccaaaccacgccucu

SEQ ID NO: 462737 - RNA, 64 nt, Human
ggauggauauucuagcgcucccaaaaaagcacuauggccuuauaugcagggaaggcacauacca

SEQ ID NO: 462738 - RNA, 64 nt, Human
uaauguguaugucugguaaauagguauuauauuuuggccuuacaauaccguaacaauguuuguc

SEQ ID NO: 462739 - RNA, 64 nt, Human; identical to SEQ ID NO: 174550

SEQ ID NO: 462740 - RNA, 64 nt, Human; identical to SEQ ID NO: 174551

SEQ ID NO: 462741 - RNA, 64 nt, Human; identical to SEQ ID NO: 174552

SEQ ID NO: 462742 - RNA, 64 nt, Human
cccauggcuuagcagacccccagauguaggucaguggccuuaccugucucuauccaugcuguca

SEQ ID NO: 462743 - RNA, 64 nt, Human
guccccagaccccaucccuucuccuuuuccuuuguggccuuaacccuucugcaucagggagccc

SEQ ID NO: 462744 - RNA, 64 nt, Human
cccuauggauucaucuuggccugacccagccagguggccuuauuucuucccugucaccuccccu

SEQ ID NO: 462745 - RNA, 64 nt, Human
uuucuacccagacaggcccugcuuuucuaggauguggccuuagagcaagaacagacccaacagc

SEQ ID NO: 462746 - RNA, 64 nt, Human
cagccagagagggcagaagcagaccguagcccauuggccuuaugugcgugugugcgugcgagug

SEQ ID NO: 462747 - RNA, 64 nt, Human
uccaggggcugcagcccccugcuucucccgccauuggccuuaacuggcccucgggcccucucuc

SEQ ID NO: 462748 - RNA, 64 nt, Human
ccugagcuguuuucuguuggccccuuuuguuuuuuggccuuaacgcuccugcugcacaggguga

SEQ ID NO: 462749 - RNA, 64 nt, Human
ugagaagucccuggacuucaacccuccuguuguuuggccuuagcccagagggagcugcucaccu

SEQ ID NO: 462750 - RNA, 64 nt, Human
uaaaaaaagaaaaaaguacaaaaaaaucuuguuauggccuuaagaagggguuagugcaucuuuc

SEQ ID NO: 462751 - RNA, 64 nt, Human
aaaaggugaucuauccauccaauggaauauuauuuggccuuaaaaaggaaggacauucugauau

SEQ ID NO: 462752 - RNA, 64 nt, Human
augagcaaugcuguuggaaaugugaagucaccaguggccuuaccccugccuuugggagcaggau

SEQ ID NO: 462753 - RNA, 64 nt, Human
ggagcguagaaucuguguagacgaagggggcaucuggccuuacaccucguuagggaagagaaac

SEQ ID NO: 462754 - RNA, 64 nt, Human
ugaggcagcaaacccugcaaagggcugggacugguggccuuaugucaguugucuacucuggagc

SEQ ID NO: 462755 - RNA, 64 nt, Human
uaaccaugucuuuuacuuaaacaauuccaggaacuggccuuaggagauccaaauagggaaccaa

SEQ ID NO: 462756 - RNA, 64 nt, Human
gggggugggggggggggguggggggacuuaucccuggccuuaggacacaggacaaaucuauuuu

SEQ ID NO: 462757 - RNA, 64 nt, Human
aauauguguaucucaaauucucccuaaaguguuguggccuuaacuguucaguauugcaauaaaa

SEQ ID NO: 462758 - RNA, 64 nt, Human; identical to SEQ ID NO: 174553

SEQ ID NO: 462759 - RNA, 64 nt, Human; identical to SEQ ID NO: 174554

SEQ ID NO: 462760 - RNA, 64 nt, Human; identical to SEQ ID NO: 174555

SEQ ID NO: 462761 - RNA, 60 nt, Human
aagaaggaggagaggagugauaaguccagauggccuuagguguccugacugucuaggcag

SEQ ID NO: 462762 - RNA, 64 nt, Human
ugauuagaagauaaaaguacauaaugaaaauccauggccuuauuuggaauauauaucacuuucc

SEQ ID NO: 462763 - RNA, 64 nt, Human
uacccagaggagccuuucucaguguguuucuaaauggccuuacacuugguagaagaaauugaag

SEQ ID NO: 462764 - RNA, 64 nt, Human; identical to SEQ ID NO: 174529

SEQ ID NO: 462765 - RNA, 64 nt, Human; identical to SEQ ID NO: 174530

SEQ ID NO: 462766 - RNA, 64 nt, Human; identical to SEQ ID NO: 174531

SEQ ID NO: 462767 - RNA, 64 nt, Human; identical to SEQ ID NO: 174532

SEQ ID NO: 462768 - RNA, 64 nt, Human; identical to SEQ ID NO: 174533

SEQ ID NO: 462769 - RNA, 64 nt, Human; identical to SEQ ID NO: 174534

SEQ ID NO: 462770 - RNA, 64 nt, Human; identical to SEQ ID NO: 174535

SEQ ID NO: 462771 - RNA, 64 nt, Human; identical to SEQ ID NO: 174536

SEQ ID NO: 462772 - RNA, 64 nt, Human; identical to SEQ ID NO: 174537

SEQ ID NO: 462773 - RNA, 64 nt, Human; identical to SEQ ID NO: 174538

SEQ ID NO: 462774 - RNA, 64 nt, Human; identical to SEQ ID NO: 174539

SEQ ID NO: 462775 - RNA, 64 nt, Human; identical to SEQ ID NO: 174540

SEQ ID NO: 462776 - RNA, 64 nt, Human; identical to SEQ ID NO: 174541

SEQ ID NO: 462777 - RNA, 64 nt, Human; identical to SEQ ID NO: 174542

SEQ ID NO: 462778 - RNA, 64 nt, Human; identical to SEQ ID NO: 174543

SEQ ID NO: 462779 - RNA, 64 nt, Human; identical to SEQ ID NO: 174544

SEQ ID NO: 462780 - RNA, 64 nt, Human; identical to SEQ ID NO: 174545

SEQ ID NO: 462781 - RNA, 64 nt, Human
uaacuuuuccauaagcugauuuugguucauuuuaucaacguaagcacacccuguucauagggaa

SEQ ID NO: 462782 - RNA, 64 nt, Human
guguuuuuaccaccacagggaaacugcguucaaaucaacguauuuauaugguacugcugugacg

SEQ ID NO: 462783 - RNA, 64 nt, Human
aaaaauauuccaagcuucauauuaacccuaccugucaacguaacgauuucaugaacguuauuau

SEQ ID NO: 462784 - RNA, 64 nt, Human
ucuuugcuucugcuaagaagcagucuaaauauaaucaacguacagugagcucuuugaagccaac

SEQ ID NO: 462785 - RNA, 64 nt, Human
uguacacaacucacuccuuuuaaagaaaaaaacuucaacguaagacuguguaagauuuguuuuu

SEQ ID NO: 462786 - RNA, 64 nt, Human
ucagugucucuuuucuuagcuuucugucuuucuuucaacguagugugaagugucuuauccuuuu

SEQ ID NO: 462787 - RNA, 64 nt, Human
cucacaagguuauauccauuucuuuguaucuauaucaacguauacuuuuccgagacuguauacg

SEQ ID NO: 462788 - RNA, 64 nt, Human
uucugguauauuuuugaaacagucauauuacaugucaacguaacuauaauguaaacaucauauc

SEQ ID NO: 462789 - RNA, 64 nt, Human
ugauaacuuugcagcugagauaguuccuaauucaucaacguaacaaacaaagcuauuggguguc

SEQ ID NO: 462790 - RNA, 64 nt, Human
uucagggccuauuaugauuuuagaaauaagauaaucaacguacaacucuuuguaaaacaaaagc

SEQ ID NO: 462791 - RNA, 64 nt, Human
cccuggggcugugaucaugguggaugaggaagccucaacguagauuccugaacucaagguacca

SEQ ID NO: 462792 - RNA, 64 nt, Human
auauuaaacuuagaugauaaucaaaaucaaaaagucaacguaaaaacugguuucuugguuuggu

SEQ ID NO: 462793 - RNA, 64 nt, Human
aacucacuucaagcuggucuguuuuaauaaauuuucaacguaauugucuauuuuuuucccuccc

SEQ ID NO: 462794 - RNA, 64 nt, Human
auaucaaaaauaucgauaaguagguuuuguguuuucaacguagggaaaauguuaucagugaaua

SEQ ID NO: 462795 - RNA, 64 nt, Human
uuaaaaauuagcugcguguaguagcauaugccuuucaacguagcuacucaggaggcugaggugg

SEQ ID NO: 462796 - RNA, 64 nt, Human
ugaaaauggagggcacucuaucagucuauaacuaucaacguagugcaacaggguguuuugauac

SEQ ID NO: 462797 - RNA, 64 nt, Human
uaucauauauauaguugaauggcaguauucaggcucaacguacaguuugauccugaguaugcuu

SEQ ID NO: 462798 - RNA, 64 nt, Human
ugcguaaguguguaugcuuguuuuaaacaaacacucaacguacauauguacauaaucuacacau

SEQ ID NO: 462799 - RNA, 64 nt, Human
caaccuuaaaccucuucuauugcuaguucuaauuucaacguauguguguuuucuaauacgagcc

SEQ ID NO: 462800 - RNA, 64 nt, Human
ggacguucguacagucuuuacggaagacacuuggucaacguacaccgagacccuuauucaccac

SEQ ID NO: 462801 - RNA, 64 nt, Human
agauagacuuuauuaucagguuucaucauagauuucaacguaagugagcuuauuguugauagaa

SEQ ID NO: 462802 - RNA, 64 nt, Human
gaaggcgcucucugcacuuagaugcugucagcccucaacguaggaggggccguggggucccuaa

SEQ ID NO: 462803 - RNA, 64 nt, Human
cuguaaaauagauugaugugucagcuauauuaagucaacguacaguuugcuugaguuauagaaa

SEQ ID NO: 462804 - RNA, 64 nt, Human
ucuuaucacaucgccaauuaguuguaauaaacguucaacguacaaacacuggaguguguuuuua

SEQ ID NO: 462805 - RNA, 64 nt, Human
augagaaggaacuuccagguguuacuguaauuccucaacguauuguuucggcagcacuuauuua

SEQ ID NO: 462806 - RNA, 50 nt, Human
auuugcauggugcugcgugagcggaggaccccucugaauccugaaacccc

SEQ ID NO: 462807 - RNA, 62 nt, Human
caugguagcgugagcauuaggugacguggcuagcggaggacuacccuugcucacugacuucc

SEQ ID NO: 462808 - RNA, 62 nt, Human
guugacacauaugaacacagacaaagugcuaugcggaggaaagcaaguguuggucaguaguu

SEQ ID NO: 462809 - RNA, 62 nt, Human
gccagaagcccguccuccuaugcugguggaaggcggaggaccggagucccugcagaaggccc

SEQ ID NO: 462810 - RNA, 62 nt, Human
gucaucgaagggcugcucggggagguggcagggcggaggaccugcuugggaagaaacuccaa

SEQ ID NO: 462811 - RNA, 62 nt, Human
cucgaccagugacaggccagcagcagagggcggcggaggaaggguuagggguucauucuccc

SEQ ID NO: 462812 - RNA, 62 nt, Human
aggcaggguggucaggaaccaccucaaaaagugcggaggaaguagcuggacaggcccugccc

SEQ ID NO: 462813 - RNA, 62 nt, Human
aaggaugagccuggggucacagggggugucgggcggaggaaagugcaucccccagagcuugg

SEQ ID NO: 462814 - RNA, 62 nt, Human
ggaguucagccucccgagcugcggcgcccgcagcggaggagguuuucaguggcugauugaaa

SEQ ID NO: 462815 - RNA, 62 nt, Human
cgaucccccaagaaccccuccagggccggccugcggaggagccgauccucgcacccuccgcu

SEQ ID NO: 462816 - RNA, 62 nt, Human
ccgcuguuaccgccgcucagcgccccggcugggcggaggaggagacgcccaugccccucagg

SEQ ID NO: 462817 - RNA, 62 nt, Human
gagaauuaagcucauccucugugauuccacuggcggaggauucuuggaagcuugcacuuagu

SEQ ID NO: 462818 - RNA, 62 nt, Human
caguuugauggcagcugcaaacuggaggugaggcggaggaaaggcagguaggaaggaguaag

SEQ ID NO: 462819 - RNA, 62 nt, Human
cuggcgaucucccagggcucucuggaccauacgcggaggaguuuucuguguggucuccagcu

SEQ ID NO: 462820 - RNA, 62 nt, Human
cuucaauuuuuuagcaacagcugaauagcuuugcggaggaguuuaauaguuacacauucaug

SEQ ID NO: 462821 - RNA, 62 nt, Human
agggccggauguggguguggacagcaguaguggcggaggagagcucggggcugggcugccug

SEQ ID NO: 462822 - RNA, 60 nt, Human
acaucaccagccucgguugaacguggaugcgcggaggagcuagccugaaggauucuggga

SEQ ID NO: 462823 - RNA, 62 nt, Human
ucacauaggacccggaagcagccugagcuguggcggaggauccaggaagcuacggagagaag

SEQ ID NO: 462824 - RNA, 62 nt, Human
gcuuuaccagcugaaaguugggacucuggagagcggaggagagagaggcagaagaacccugg

SEQ ID NO: 462825 - RNA, 62 nt, Human
ggccggcggccggagcggggaagggcgcgggcgcggaggacgcacgcggggccccggcucgc

SEQ ID NO: 462826 - RNA, 62 nt, Human
uaggagcuggugcugcccccgcccgccgggccgcggaggaggcaggcggcccccacacugug

SEQ ID NO: 462827 - RNA, 62 nt, Human
gccggggacccacucugcccagccggagggacgcggaggaggaagaggguagacaggggcga

SEQ ID NO: 462828 - RNA, 62 nt, Human
uggaagcgcagcagcgggagcuaggggcgggggcggaggaggacacgaacuggaaggggguu

SEQ ID NO: 462829 - RNA, 62 nt, Human
gaagggcugguuuguccgaaaagugagaggaggcggaggagaggugaggagagcaagugcaa

SEQ ID NO: 462830 - RNA, 62 nt, Human
aacucaacacuggcagccaccgucucaccccugcggaggagcgcucccgucucccacaggug

SEQ ID NO: 462831 - RNA, 62 nt, Human
cucaugcuggagggaggcugggcggguacagcgcggaggaggagggaggccaggcgggcaug

SEQ ID NO: 462832 - RNA, 62 nt, Human
cguagaugcccccgcgagacggguuagggaaagcggaggaggaaagcgaggggguggggggc

SEQ ID NO: 462833 - RNA, 62 nt, Human
gcucuguccuuacauguauuugaugugcaucagcggaggagaacacuggcuuggcccugcuc

SEQ ID NO: 462834 - RNA, 62 nt, Human
acauugccaucacucuuguacugccugccaccgcggaggaggcuggugacaggccaaaggcc

SEQ ID NO: 462835 - RNA, 62 nt, Human
uagcccaggggcccaagcccuggauuuggccugcggaggagcuuaggauccucguuuucugg

SEQ ID NO: 462836 - RNA, 62 nt, Human
agcgucccaggguacccgccugagcuccugcugcggaggagcugccugcuuggcccggccgg

SEQ ID NO: 462837 - RNA, 62 nt, Human
aaauccaaagcaucuuugaaaaguccugcgcugcggaggacaggaagcacccccucaauagc

SEQ ID NO: 462838 - RNA, 62 nt, Human
caccacguccugccgcgcagguucuuccccgcgcggaggagcgcgcagggugggcggcuuac

SEQ ID NO: 462839 - RNA, 62 nt, Human
ccgccuugcaggggaggccuggcugcagagaggcggaggaggaagcuggcgcugggggaggc

SEQ ID NO: 462840 - RNA, 62 nt, Human
cugggguccccgaaguccuugcucccgcuccugcggaggagguguggucaccaggaggcggc

SEQ ID NO: 462841 - RNA, 62 nt, Human
gccugcagcgugagcugugggagaggggucgugcggaggauccuguauugugcccgggccca

SEQ ID NO: 462842 - RNA, 62 nt, Human
aacaaccaucccuguaagccauggguuuucaugcggaggaaggagagggcuaguugucugag

SEQ ID NO: 462843 - RNA, 62 nt, Human
uauuuuacaaccuccuuucccuccaugcuuccgcggaggagucuauacuaucucuauauaca

SEQ ID NO: 462844 - RNA, 62 nt, Human
aucaugguugguaugauggaccauucuuuggggcggaggauugauuauguuacucucuuuaa

SEQ ID NO: 462845 - RNA, 62 nt, Human
ggaaucagucuucacagacagacgugagccaggcggaggacucguuccuugcagaggucagu

SEQ ID NO: 462846 - RNA, 62 nt, Human
cccagcacuuugcgaccugcggcccagcaggcgcggaggauggcggggaggaagccagcagc

SEQ ID NO: 462847 - RNA, 62 nt, Human
uggacgucagcagggacuucguggccagcggggcggaggaccggcacggcuacaucugggac

SEQ ID NO: 462848 - RNA, 62 nt, Human
ugguggccgaccccaugcagccgccaccaaucgcggaggagauugaccugcugguguucgac

SEQ ID NO: 462849 - RNA, 62 nt, Human
gaaggccaagcaggcccugggaugggaguggggcggaggaggguccuaagagcugauuauuu

SEQ ID NO: 462850 - RNA, 62 nt, Human
agaccaaagaccuugugcccuucccaggagccgcggaggaggacagugagggaggaauggaa

SEQ ID NO: 462851 - RNA, 62 nt, Human
uugaauuaacauuucagcauggaacuaacugggcggaggaaggaucguuauacgucuucaga

SEQ ID NO: 462852 - RNA, 62 nt, Human
gugcagaugagcagucacacuguuacuccacagcggaggagaccagcucagaggcccaggaa

SEQ ID NO: 462853 - RNA, 62 nt, Human
gagcugagagaaggcacugagagggacaguaggcggaggaccaggugaggucagcaucgggg

SEQ ID NO: 462854 - RNA, 62 nt, Human
uuucugcggccuuccaccgggccugaaccacagcggaggagcuccgcuaagaccuccccacc

SEQ ID NO: 462855 - RNA, 62 nt, Human
gacgugggagagaguguggugggaagucuugagcggaggaggggaucugcccuucuccacuc

SEQ ID NO: 462856 - RNA, 62 nt, Human
gugugugugcguggggacagaggccuggaaaugcggaggacuauacagagaaggcagguuuu

SEQ ID NO: 462857 - RNA, 62 nt, Human
agcccauugcuccugcucagcucagcccggcugcggaggaacccuuggcaggcagaaccugg

SEQ ID NO: 462858 - RNA, 62 nt, Human
gcugggagcaucaccgccuggacgcccgcgccgcggaggagccggcgcccaucuccacccgc

SEQ ID NO: 462859 - RNA, 62 nt, Human
gugcugccuguuccccaaagccugcuugucccgcggaggacggcugccuuugacccugcuua

SEQ ID NO: 462860 - RNA, 62 nt, Human
uggugcugucuaaagaccuggcauuaauggaggcggaggagcagccuuacgggagggaugga

SEQ ID NO: 462861 - RNA, 62 nt, Human
uccagaaugcccuggccagagcgagcaacacggcggaggagaccaucagugccaugaagacu

SEQ ID NO: 462862 - RNA, 62 nt, Human
ucaaauuugaggccaggugcaguggcucaugggcggaggagggcagauuacuugaggcuagg

SEQ ID NO: 462863 - RNA, 62 nt, Human
aaaaguguggacguggccagagcgagagaguagcggaggaaaggagcaauccaugcacacuc

SEQ ID NO: 462864 - RNA, 62 nt, Human
cacccaaggucugggcaaacucagcauuaguggcggaggauggagccacuccauucaggacc

SEQ ID NO: 462865 - RNA, 62 nt, Human
uagguaagaagagcauuuccucagacucccaggcggaggacugagccuagccuucagcaacc

SEQ ID NO: 462866 - RNA, 62 nt, Human
gcccagggcagaccuucagggccagagcccuggcggaggagaggcccuuugccaggagcaca

SEQ ID NO: 462867 - RNA, 62 nt, Human
uggacacuacacccagcaauagagacgggacugcggaggaaggaggacccaggacaggaucc

SEQ ID NO: 462868 - RNA, 62 nt, Human
ccccaaagugaggggcuccacaccaaccccaggcggaggaacacucagacagauuaaggaua

SEQ ID NO: 462869 - RNA, 62 nt, Human
cggcugcccaggacugcugcugagccccaggggcggaggagggagcgcccuguccacccggg

SEQ ID NO: 462870 - RNA, 62 nt, Human
ccacugcagaauuaaagaaggaagaagggaaggcggaggagucuauaagaaggaaucaugau

SEQ ID NO: 462871 - RNA, 62 nt, Human
ucugccccucccaccuguccccgccuccaacugcggaggaccaguuccuggcccucuuuucu

SEQ ID NO: 462872 - RNA, 62 nt, Human
cgggcgggcgccggcgcugccuggcgggggccgcggaggagccgaaagggcguugggaucca

SEQ ID NO: 462873 - RNA, 62 nt, Human
ccccuggaaccagcaagucccagacaaggagagcggaggaggaagucaugggaacgcagccu

SEQ ID NO: 462874 - RNA, 62 nt, Human
ugaggcccugccauaaccaggcgcccagcccugcggaggaggccggggcucccaggaagcgg

SEQ ID NO: 462875 - RNA, 62 nt, Human
uuauuguacuuggugggguguuuggggugggggcggaggagagcuuguucucgugggguugu

SEQ ID NO: 462876 - RNA, 62 nt, Human
gagcaguccugguccuuccacugugcaccugcgcggaggacgcgaccucaguuguccugccc

SEQ ID NO: 462877 - RNA, 62 nt, Human
cugcuggcccgcggcggcgaggagcagagggagcggaggaggggccggcccgcgggagccgc

SEQ ID NO: 462878 - RNA, 62 nt, Human
ccuugggcaaggcgcggugcuggaugaugggugcggaggaauuuggguaaaggcagagggaa

SEQ ID NO: 462879 - RNA, 62 nt, Human
ccggcggccaaaccagucacucggggaggaaugcggaggagcgcucauuccauucuauuuaa

SEQ ID NO: 462880 - RNA, 62 nt, Human
gaggaccaagggauggcccgacucggcgguuugcggaggaugcagggauaugcucacagcgc

SEQ ID NO: 462881 - RNA, 62 nt, Human
aaccaaaaauuccauguguugggggguggggggcggaggagggugaggggugccgcccaugg

SEQ ID NO: 462882 - RNA, 62 nt, Human
acacauuuggaagguuuuaacauugaaagugagcggaggacuugggggcagagcagcacaaa

SEQ ID NO: 462883 - RNA, 62 nt, Human
cuuuggggaaagcaggaaugguguccacugcugcggaggaacugccuucagagaaggugggg

SEQ ID NO: 462884 - RNA, 62 nt, Human
aagguggagaagggcaggggcaggagagggcugcggaggaggggccacggugcagcaggccg

SEQ ID NO: 462885 - RNA, 62 nt, Human
cuuccugacuguccccagccucccagaaggccgcggaggagccggaugcugagccgggaggc

SEQ ID NO: 462886 - RNA, 62 nt, Human
aaacugcucaaggauuaguuuuccaggacucugcggaggaacggcaggaagaaccucagaga

SEQ ID NO: 462887 - RNA, 62 nt, Human
accugcugaggaccagccgcgugcacuggauugcggaggagccucccgcagcacugguccgg

SEQ ID NO: 462888 - RNA, 62 nt, Human
aggcacggaaggcgggacucugggagaagcgugcggaggaccguggcgucggcgucccggau

SEQ ID NO: 462889 - RNA, 62 nt, Human
ccgugggcacuuuuccuuuugugguggggggugcggaggagguacccccaccccuggcacag

SEQ ID NO: 462890 - RNA, 62 nt, Human
ggcugggggagacccagccccaaggguccggggcggaggaugcuuuguucuuuucugguuuu

SEQ ID NO: 462891 - RNA, 62 nt, Human
gcccuguccgacuguaacagaccaggaggguggcggaggaacuccugccacgccacuguguc

SEQ ID NO: 462892 - RNA, 64 nt, Human
gaguuugaggcugcagugagccaucaucauggcaucauugcauuccagccugggcaacagagca

SEQ ID NO: 462893 - RNA, 64 nt, Human
acaugagccguguauaauauuuuuuuuaacauuuucauugcaguauugaccaucauccuugguu

SEQ ID NO: 462894 - RNA, 64 nt, Human; identical to SEQ ID NO: 436684

SEQ ID NO: 462895 - RNA, 64 nt, Human; identical to SEQ ID NO: 436685

SEQ ID NO: 462896 - RNA, 64 nt, Human; identical to SEQ ID NO: 436686

SEQ ID NO: 462897 - RNA, 64 nt, Human; identical to SEQ ID NO: 436687

SEQ ID NO: 462898 - RNA, 64 nt, Human; identical to SEQ ID NO: 436688

SEQ ID NO: 462899 - RNA, 64 nt, Human; identical to SEQ ID NO: 436689

SEQ ID NO: 462900 - RNA, 64 nt, Human; identical to SEQ ID NO: 436690

SEQ ID NO: 462901 - RNA, 64 nt, Human; identical to SEQ ID NO: 436691

SEQ ID NO: 462902 - RNA, 64 nt, Human; identical to SEQ ID NO: 436692

SEQ ID NO: 462903 - RNA, 64 nt, Human; identical to SEQ ID NO: 436693

SEQ ID NO: 462904 - RNA, 64 nt, Human; identical to SEQ ID NO: 436694

SEQ ID NO: 462905 - RNA, 64 nt, Human; identical to SEQ ID NO: 436698

SEQ ID NO: 462906 - RNA, 64 nt, Human; identical to SEQ ID NO: 436699

SEQ ID NO: 462907 - RNA, 64 nt, Human; identical to SEQ ID NO: 436700

SEQ ID NO: 462908 - RNA, 64 nt, Human; identical to SEQ ID NO: 436701

SEQ ID NO: 462909 - RNA, 64 nt, Human; identical to SEQ ID NO: 436702

SEQ ID NO: 462910 - RNA, 64 nt, Human
uaucaagugagguaaauucacccaucacagggucucgcccuaccauccuggaauuauuucacuu

SEQ ID NO: 462911 - RNA, 64 nt, Human
gaacagagggcucccggucagcuucccaggcccuucgcccuaugcccagagggcagacugccuc

SEQ ID NO: 462912 - RNA, 64 nt, Human
cuucuuucuagcccuucaaagaugcugccaguguucgcccuagaguuauuacaaagccagugcc

SEQ ID NO: 462913 - RNA, 64 nt, Human; identical to SEQ ID NO: 436703

SEQ ID NO: 462914 - RNA, 64 nt, Human; identical to SEQ ID NO: 436704

SEQ ID NO: 462915 - RNA, 64 nt, Human; identical to SEQ ID NO: 436705

SEQ ID NO: 462916 - RNA, 64 nt, Human; identical to SEQ ID NO: 436706

SEQ ID NO: 462917 - RNA, 64 nt, Human; identical to SEQ ID NO: 436707

SEQ ID NO: 462918 - RNA, 64 nt, Human; identical to SEQ ID NO: 436708

SEQ ID NO: 462919 - RNA, 64 nt, Human; identical to SEQ ID NO: 436709

SEQ ID NO: 462920 - RNA, 64 nt, Human; identical to SEQ ID NO: 436710

SEQ ID NO: 462921 - RNA, 64 nt, Human; identical to SEQ ID NO: 436711

SEQ ID NO: 462922 - RNA, 64 nt, Human; identical to SEQ ID NO: 436712

SEQ ID NO: 462923 - RNA, 64 nt, Human; identical to SEQ ID NO: 436716

SEQ ID NO: 462924 - RNA, 64 nt, Human; identical to SEQ ID NO: 436717

SEQ ID NO: 462925 - RNA, 64 nt, Human; identical to SEQ ID NO: 436718

SEQ ID NO: 462926 - RNA, 64 nt, Human; identical to SEQ ID NO: 436719

SEQ ID NO: 462927 - RNA, 64 nt, Human; identical to SEQ ID NO: 436720

SEQ ID NO: 462928 - RNA, 64 nt, Human; identical to SEQ ID NO: 436721

SEQ ID NO: 462929 - RNA, 64 nt, Human
ucauacuguaaacaguuuuauaaguagaucuuuuucauugcaaaauugccacauuuucuuaugg

SEQ ID NO: 462930 - RNA, 64 nt, Human
gccauauuuucauauagugguauacaacacaguaucauugcaaaugcaguuuacagggauuuuu

SEQ ID NO: 462931 - RNA, 64 nt, Human
ccaguagugcauucaguucaacacagcaagugcuucauugcauggaaaacacuuugaagacaaa

SEQ ID NO: 462932 - RNA, 64 nt, Human; identical to SEQ ID NO: 436722

SEQ ID NO: 462933 - RNA, 64 nt, Human; identical to SEQ ID NO: 436723

SEQ ID NO: 462934 - RNA, 64 nt, Human; identical to SEQ ID NO: 436724

SEQ ID NO: 462935 - RNA, 64 nt, Human; identical to SEQ ID NO: 436725

SEQ ID NO: 462936 - RNA, 64 nt, Human; identical to SEQ ID NO: 436726

SEQ ID NO: 462937 - RNA, 64 nt, Human; identical to SEQ ID NO: 436727

SEQ ID NO: 462938 - RNA, 64 nt, Human; identical to SEQ ID NO: 436728

SEQ ID NO: 462939 - RNA, 64 nt, Human; identical to SEQ ID NO: 436729

SEQ ID NO: 462940 - RNA, 64 nt, Human; identical to SEQ ID NO: 436730

SEQ ID NO: 462941 - RNA, 64 nt, Human; identical to SEQ ID NO: 436734

SEQ ID NO: 462942 - RNA, 64 nt, Human; identical to SEQ ID NO: 436735

SEQ ID NO: 462943 - RNA, 64 nt, Human; identical to SEQ ID NO: 436736

SEQ ID NO: 462944 - RNA, 64 nt, Human; identical to SEQ ID NO: 436737

SEQ ID NO: 462945 - RNA, 64 nt, Human; identical to SEQ ID NO: 436738

SEQ ID NO: 462946 - RNA, 64 nt, Human; identical to SEQ ID NO: 436739

SEQ ID NO: 462947 - RNA, 64 nt, Human; identical to SEQ ID NO: 436740

SEQ ID NO: 462948 - RNA, 64 nt, Human
aaagaacuauggggccuucccagcauuugacuguucauugcauagaaugaauuaaauauccagu

SEQ ID NO: 462949 - RNA, 64 nt, Human
uuggggccuuucccauuggucugcaugucuuuuaucauugcaggccaguggacagagggagaag

SEQ ID NO: 462950 - RNA, 64 nt, Human
gaucuugguguuauuuaaaaaauugaggugauggucauugcaagcucaucuauuaaguacuaua

SEQ ID NO: 462951 - RNA, 64 nt, Human; identical to SEQ ID NO: 436741

SEQ ID NO: 462952 - RNA, 64 nt, Human; identical to SEQ ID NO: 436742

SEQ ID NO: 462953 - RNA, 64 nt, Human; identical to SEQ ID NO: 436743

SEQ ID NO: 462954 - RNA, 64 nt, Human; identical to SEQ ID NO: 436744

SEQ ID NO: 462955 - RNA, 64 nt, Human; identical to SEQ ID NO: 436745

SEQ ID NO: 462956 - RNA, 64 nt, Human; identical to SEQ ID NO: 436746

SEQ ID NO: 462957 - RNA, 64 nt, Human; identical to SEQ ID NO: 436747

SEQ ID NO: 462958 - RNA, 64 nt, Human; identical to SEQ ID NO: 436748

SEQ ID NO: 462959 - RNA, 64 nt, Human; identical to SEQ ID NO: 436752

SEQ ID NO: 462960 - RNA, 64 nt, Human; identical to SEQ ID NO: 436753

SEQ ID NO: 462961 - RNA, 64 nt, Human; identical to SEQ ID NO: 436754

SEQ ID NO: 462962 - RNA, 64 nt, Human; identical to SEQ ID NO: 436755

SEQ ID NO: 462963 - RNA, 64 nt, Human; identical to SEQ ID NO: 436756

SEQ ID NO: 462964 - RNA, 64 nt, Human; identical to SEQ ID NO: 436757

SEQ ID NO: 462965 - RNA, 64 nt, Human; identical to SEQ ID NO: 436758

SEQ ID NO: 462966 - RNA, 64 nt, Human; identical to SEQ ID NO: 436759

SEQ ID NO: 462967 - RNA, 64 nt, Human
cugagcauuauaagaaaaugaccucugcuccuuuucauugcagaaaauugccaggggcuuauuu

SEQ ID NO: 462968 - RNA, 64 nt, Human
ucugaucagcucaaaaagauuuggcuuaguguuuucauugcaaauuauaauugcuguagagcca

SEQ ID NO: 462969 - RNA, 64 nt, Human
cuaauuuauacacagcaggcauaugaaacuccacucauugcaguacuuucacagcacagugaca

SEQ ID NO: 462970 - RNA, 64 nt, Human; identical to SEQ ID NO: 436760

SEQ ID NO: 462971 - RNA, 64 nt, Human; identical to SEQ ID NO: 436761

SEQ ID NO: 462972 - RNA, 64 nt, Human; identical to SEQ ID NO: 436762

SEQ ID NO: 462973 - RNA, 64 nt, Human; identical to SEQ ID NO: 436763

SEQ ID NO: 462974 - RNA, 64 nt, Human; identical to SEQ ID NO: 436764

SEQ ID NO: 462975 - RNA, 64 nt, Human; identical to SEQ ID NO: 436765

SEQ ID NO: 462976 - RNA, 64 nt, Human; identical to SEQ ID NO: 436766

SEQ ID NO: 462977 - RNA, 64 nt, Human; identical to SEQ ID NO: 436770

SEQ ID NO: 462978 - RNA, 64 nt, Human; identical to SEQ ID NO: 436771

SEQ ID NO: 462979 - RNA, 64 nt, Human; identical to SEQ ID NO: 436772

SEQ ID NO: 462980 - RNA, 64 nt, Human; identical to SEQ ID NO: 436773

SEQ ID NO: 462981 - RNA, 64 nt, Human; identical to SEQ ID NO: 436774

SEQ ID NO: 462982 - RNA, 64 nt, Human; identical to SEQ ID NO: 436775

SEQ ID NO: 462983 - RNA, 64 nt, Human; identical to SEQ ID NO: 436776

SEQ ID NO: 462984 - RNA, 64 nt, Human; identical to SEQ ID NO: 436777

SEQ ID NO: 462985 - RNA, 64 nt, Human; identical to SEQ ID NO: 436778

SEQ ID NO: 462986 - RNA, 64 nt, Human
aaggaaaaugaacccaucuuuugccugccaugaaucauugcagggcaggcuguuacuggcuaaa

SEQ ID NO: 462987 - RNA, 64 nt, Human
gacauugcuuuugcucugcaacagcagagucgagucauugcaacaaagagcauauggccccaca

SEQ ID NO: 462988 - RNA, 64 nt, Human
ucuuagcugucuaauuuuuagagaauaagauuguucauugcauuucugaguauuauguaaccua

SEQ ID NO: 462989 - RNA, 64 nt, Human; identical to SEQ ID NO: 436779

SEQ ID NO: 462990 - RNA, 64 nt, Human; identical to SEQ ID NO: 436780

SEQ ID NO: 462991 - RNA, 64 nt, Human; identical to SEQ ID NO: 436781

SEQ ID NO: 462992 - RNA, 64 nt, Human; identical to SEQ ID NO: 436782

SEQ ID NO: 462993 - RNA, 64 nt, Human; identical to SEQ ID NO: 436783

SEQ ID NO: 462994 - RNA, 64 nt, Human; identical to SEQ ID NO: 436784

SEQ ID NO: 462995 - RNA, 64 nt, Human; identical to SEQ ID NO: 436788

SEQ ID NO: 462996 - RNA, 64 nt, Human; identical to SEQ ID NO: 436789

SEQ ID NO: 462997 - RNA, 64 nt, Human; identical to SEQ ID NO: 436790

SEQ ID NO: 462998 - RNA, 64 nt, Human; identical to SEQ ID NO: 436791

SEQ ID NO: 462999 - RNA, 64 nt, Human; identical to SEQ ID NO: 436792

SEQ ID NO: 463000 - RNA, 64 nt, Human; identical to SEQ ID NO: 436793

SEQ ID NO: 463001 - RNA, 64 nt, Human; identical to SEQ ID NO: 436794

SEQ ID NO: 463002 - RNA, 64 nt, Human; identical to SEQ ID NO: 436795

SEQ ID NO: 463003 - RNA, 64 nt, Human; identical to SEQ ID NO: 436796

SEQ ID NO: 463004 - RNA, 64 nt, Human; identical to SEQ ID NO: 436797

SEQ ID NO: 463005 - RNA, 64 nt, Human
caggacuucgaggcugcaaugagcuauaauugcaucauugcacuccagccugggcaacagagac

SEQ ID NO: 463006 - RNA, 64 nt, Human
ugagugaggcgguauccacauuuucaacuucaagucauugcaguuucuuuuucccagaaaacaa

SEQ ID NO: 463007 - RNA, 64 nt, Human
cccagcacugcccaucccaccccaugaggcucacucauugcagaucccagcccacccugccccu

SEQ ID NO: 463008 - RNA, 64 nt, Human; identical to SEQ ID NO: 436798

SEQ ID NO: 463009 - RNA, 64 nt, Human; identical to SEQ ID NO: 436799

SEQ ID NO: 463010 - RNA, 64 nt, Human; identical to SEQ ID NO: 436800

SEQ ID NO: 463011 - RNA, 64 nt, Human; identical to SEQ ID NO: 436801

SEQ ID NO: 463012 - RNA, 64 nt, Human; identical to SEQ ID NO: 436802

SEQ ID NO: 463013 - RNA, 64 nt, Human; identical to SEQ ID NO: 436806

SEQ ID NO: 463014 - RNA, 64 nt, Human; identical to SEQ ID NO: 436807

SEQ ID NO: 463015 - RNA, 64 nt, Human; identical to SEQ ID NO: 436808

SEQ ID NO: 463016 - RNA, 64 nt, Human; identical to SEQ ID NO: 436809

SEQ ID NO: 463017 - RNA, 64 nt, Human; identical to SEQ ID NO: 436810

SEQ ID NO: 463018 - RNA, 64 nt, Human; identical to SEQ ID NO: 436811

SEQ ID NO: 463019 - RNA, 64 nt, Human; identical to SEQ ID NO: 436812

SEQ ID NO: 463020 - RNA, 64 nt, Human; identical to SEQ ID NO: 436813

SEQ ID NO: 463021 - RNA, 64 nt, Human; identical to SEQ ID NO: 436814

SEQ ID NO: 463022 - RNA, 64 nt, Human; identical to SEQ ID NO: 436815

SEQ ID NO: 463023 - RNA, 64 nt, Human; identical to SEQ ID NO: 436816

SEQ ID NO: 463024 - RNA, 64 nt, Human
ccaguugugaguggcuuuuuaauuaacuugucuuucauugcacuucacucugccuguuuucaag

SEQ ID NO: 463025 - RNA, 64 nt, Human
guucuuuaaaagaaggagguaugaacuguauuucucauugcaaauacaaaauaaaaauuaguug

SEQ ID NO: 463026 - RNA, 64 nt, Human
aaaauuuacgcaccuuuaaucuuggguguucuauucauugcauagaaugacuuguaagcagaau

SEQ ID NO: 463027 - RNA, 64 nt, Human; identical to SEQ ID NO: 436817

SEQ ID NO: 463028 - RNA, 64 nt, Human
augaacgucucuuccuaauuuuacaucuucagcaucauugcauuaaagugguguaaucuccuuc

SEQ ID NO: 463029 - RNA, 64 nt, Human
ucuuuguguauuuuaugacuguguguguuugcacucauugcaauaaaguaggacaaaaugauuu

SEQ ID NO: 463030 - RNA, 64 nt, Human
ggucggaacacuuuaggagugcagggguucugcuucauugcauuuucagaauuaaccugaaagu

SEQ ID NO: 463031 - RNA, 64 nt, Human
augugacaacugugcauugaacccugggucagggacguuccaauggccaagagagugacacagc

SEQ ID NO: 463032 - RNA, 64 nt, Human
aacaucccuugacuuugguuuauuuauaaacgugacguuccaguugcucaacuacugcaggauc

SEQ ID NO: 463033 - RNA, 64 nt, Human
ugggguccggacacugggccccgcaggcgaaagcacguuccagccaccaggaggccaccuauug

SEQ ID NO: 463034 - RNA, 64 nt, Human
uacuguugggaucagccuccugucuuaugugggcacguuccaaaguuuaaaugcauuuuuuuga

SEQ ID NO: 463035 - RNA, 64 nt, Human
gacuuuucucgccggccggucucaggccgcacagacguuccagaggaggagggugacauuuuua

SEQ ID NO: 463036 - RNA, 64 nt, Human
uucaaggguucugcccccagauuucgggagauccacguuccauguucugauugguuuucuggga

SEQ ID NO: 463037 - RNA, 62 nt, Human
ucaccacccagccgcuggaggaagccuucucugccagcgaucucgcagcacuguguuuacag

SEQ ID NO: 463038 - RNA, 62 nt, Human
cggaaaagcagcccagucagaugugggaacgugccagcgagggagagaccuuuccacugcag

SEQ ID NO: 463039 - RNA, 62 nt, Human
gagcagcuugccgaggaccccgcgugaagaaagccagcgaggggggcuucugcucccugaga

SEQ ID NO: 463040 - RNA, 62 nt, Human
cacggugggagucagccaagauuuaaagggaugccagcgauugcucuuuucaaaaccuacca

SEQ ID NO: 463041 - RNA, 62 nt, Human
gcgcaggaccgcuggaggacgcagcguccagggccagcgagcucccccggcagcaggucccc

SEQ ID NO: 463042 - RNA, 62 nt, Human
guuugguuccugaccuaggcuugggaagacaagccagcgaauaaaggaugguugaacgugaa

SEQ ID NO: 463043 - RNA, 62 nt, Human
uggcacuacccaccccgugugacagaauaggagccagcgacucaggacugcucacgggucag

SEQ ID NO: 463044 - RNA, 62 nt, Human
ugccgggagggccacgcaggucguggucaccugccagcgacugucucagacugggcagggag

SEQ ID NO: 463045 - RNA, 62 nt, Human
agcuacugaagggacccaaggcacccccugaagccagcgauagagggucccucucugcuccc

SEQ ID NO: 463046 - RNA, 64 nt, Human; identical to SEQ ID NO: 436818

SEQ ID NO: 463047 - RNA, 64 nt, Human; identical to SEQ ID NO: 436819

SEQ ID NO: 463048 - RNA, 64 nt, Human; identical to SEQ ID NO: 436820

SEQ ID NO: 463049 - RNA, 64 nt, Human; identical to SEQ ID NO: 436824

SEQ ID NO: 463050 - RNA, 64 nt, Human; identical to SEQ ID NO: 436825

SEQ ID NO: 463051 - RNA, 64 nt, Human; identical to SEQ ID NO: 436826

SEQ ID NO: 463052 - RNA, 64 nt, Human; identical to SEQ ID NO: 436827

SEQ ID NO: 463053 - RNA, 64 nt, Human; identical to SEQ ID NO: 436828

SEQ ID NO: 463054 - RNA, 64 nt, Human; identical to SEQ ID NO: 436829

SEQ ID NO: 463055 - RNA, 64 nt, Human; identical to SEQ ID NO: 436830

SEQ ID NO: 463056 - RNA, 64 nt, Human; identical to SEQ ID NO: 436831

SEQ ID NO: 463057 - RNA, 64 nt, Human; identical to SEQ ID NO: 436832

SEQ ID NO: 463058 - RNA, 64 nt, Human; identical to SEQ ID NO: 436833

SEQ ID NO: 463059 - RNA, 64 nt, Human; identical to SEQ ID NO: 436834

SEQ ID NO: 463060 - RNA, 64 nt, Human; identical to SEQ ID NO: 436835

SEQ ID NO: 463061 - RNA, 64 nt, Human; identical to SEQ ID NO: 436836

SEQ ID NO: 463062 - RNA, 62 nt, Human
gcaugcggcacccagcggcugcuucccugcaagccagcgacuugccgagcagaaugagcucu

SEQ ID NO: 463063 - RNA, 62 nt, Human
uaccuggcucaggaaugcugucagaccagccagccagcgagcucuaggcaaaaggacaugga

SEQ ID NO: 463064 - RNA, 62 nt, Human
accugagccauccccaguucuuagccaguugagccagcgacaacagcaccagagccaggcag

SEQ ID NO: 463065 - RNA, 62 nt, Human
ggaaggaggccacauuccugucugcagcagccgccagcgauggucuucagcaauaaaaguug

SEQ ID NO: 463066 - RNA, 64 nt, Human; identical to SEQ ID NO: 436837

SEQ ID NO: 463067 - RNA, 64 nt, Human; identical to SEQ ID NO: 436838

SEQ ID NO: 463068 - RNA, 64 nt, Human; identical to SEQ ID NO: 436842

SEQ ID NO: 463069 - RNA, 64 nt, Human; identical to SEQ ID NO: 436843

SEQ ID NO: 463070 - RNA, 64 nt, Human; identical to SEQ ID NO: 436844

SEQ ID NO: 463071 - RNA, 64 nt, Human; identical to SEQ ID NO: 436845

SEQ ID NO: 463072 - RNA, 64 nt, Human; identical to SEQ ID NO: 436846

SEQ ID NO: 463073 - RNA, 64 nt, Human; identical to SEQ ID NO: 436847

SEQ ID NO: 463074 - RNA, 64 nt, Human; identical to SEQ ID NO: 436848

SEQ ID NO: 463075 - RNA, 64 nt, Human; identical to SEQ ID NO: 436849

SEQ ID NO: 463076 - RNA, 64 nt, Human; identical to SEQ ID NO: 436850

SEQ ID NO: 463077 - RNA, 64 nt, Human; identical to SEQ ID NO: 436851

SEQ ID NO: 463078 - RNA, 64 nt, Human; identical to SEQ ID NO: 436852

SEQ ID NO: 463079 - RNA, 64 nt, Human; identical to SEQ ID NO: 436853

SEQ ID NO: 463080 - RNA, 64 nt, Human; identical to SEQ ID NO: 436854

SEQ ID NO: 463081 - RNA, 64 nt, Human; identical to SEQ ID NO: 436855

SEQ ID NO: 463082 - RNA, 62 nt, Human
ggggcaugcuggccucugagcgaucaggcgaggccagcgagggugugcuugcaaauucaagc

SEQ ID NO: 463083 - RNA, 62 nt, Human; identical to SEQ ID NO: 463041

SEQ ID NO: 463084 - RNA, 62 nt, Human
ccaagggcacuuaaagugaccugucauuccgagccagcgaaccccagcaguaggaauccgua

SEQ ID NO: 463085 - RNA, 64 nt, Human; identical to SEQ ID NO: 436856

SEQ ID NO: 463086 - RNA, 64 nt, Human; identical to SEQ ID NO: 436860

SEQ ID NO: 463087 - RNA, 64 nt, Human; identical to SEQ ID NO: 436861

SEQ ID NO: 463088 - RNA, 64 nt, Human; identical to SEQ ID NO: 436862

SEQ ID NO: 463089 - RNA, 64 nt, Human; identical to SEQ ID NO: 436863

SEQ ID NO: 463090 - RNA, 64 nt, Human; identical to SEQ ID NO: 436864

SEQ ID NO: 463091 - RNA, 64 nt, Human; identical to SEQ ID NO: 436865

SEQ ID NO: 463092 - RNA, 64 nt, Human; identical to SEQ ID NO: 436866

SEQ ID NO: 463093 - RNA, 64 nt, Human; identical to SEQ ID NO: 436867

SEQ ID NO: 463094 - RNA, 64 nt, Human; identical to SEQ ID NO: 436868

SEQ ID NO: 463095 - RNA, 64 nt, Human; identical to SEQ ID NO: 436869

SEQ ID NO: 463096 - RNA, 64 nt, Human; identical to SEQ ID NO: 436870

SEQ ID NO: 463097 - RNA, 64 nt, Human; identical to SEQ ID NO: 436871

SEQ ID NO: 463098 - RNA, 64 nt, Human; identical to SEQ ID NO: 436872

SEQ ID NO: 463099 - RNA, 64 nt, Human; identical to SEQ ID NO: 436873

SEQ ID NO: 463100 - RNA, 64 nt, Human; identical to SEQ ID NO: 436874

SEQ ID NO: 463101 - RNA, 62 nt, Human
aggggagaaccccauccucagagcugcucccagccagcgagucaggagcgggggagacaggg

SEQ ID NO: 463102 - RNA, 62 nt, Human
ggcagagccucgaaaauaggcagaccguuugagccagcgaccucaccucuaggaacugagcc

SEQ ID NO: 463103 - RNA, 64 nt, Human; identical to SEQ ID NO: 436878

SEQ ID NO: 463104 - RNA, 64 nt, Human; identical to SEQ ID NO: 436879

SEQ ID NO: 463105 - RNA, 64 nt, Human; identical to SEQ ID NO: 436880

SEQ ID NO: 463106 - RNA, 64 nt, Human; identical to SEQ ID NO: 436881

SEQ ID NO: 463107 - RNA, 64 nt, Human; identical to SEQ ID NO: 436882

SEQ ID NO: 463108 - RNA, 64 nt, Human; identical to SEQ ID NO: 436883

SEQ ID NO: 463109 - RNA, 64 nt, Human; identical to SEQ ID NO: 436884

SEQ ID NO: 463110 - RNA, 64 nt, Human; identical to SEQ ID NO: 436885

SEQ ID NO: 463111 - RNA, 64 nt, Human; identical to SEQ ID NO: 436886

SEQ ID NO: 463112 - RNA, 64 nt, Human; identical to SEQ ID NO: 436887

SEQ ID NO: 463113 - RNA, 64 nt, Human; identical to SEQ ID NO: 436888

SEQ ID NO: 463114 - RNA, 64 nt, Human; identical to SEQ ID NO: 436889

SEQ ID NO: 463115 - RNA, 64 nt, Human; identical to SEQ ID NO: 436890

SEQ ID NO: 463116 - RNA, 64 nt, Human; identical to SEQ ID NO: 436891

SEQ ID NO: 463117 - RNA, 64 nt, Human; identical to SEQ ID NO: 436892

SEQ ID NO: 463118 - RNA, 64 nt, Human; identical to SEQ ID NO: 436896

SEQ ID NO: 463119 - RNA, 64 nt, Human; identical to SEQ ID NO: 274745

SEQ ID NO: 463120 - RNA, 64 nt, Human; identical to SEQ ID NO: 274763

SEQ ID NO: 463121 - RNA, 64 nt, Human; identical to SEQ ID NO: 436897

SEQ ID NO: 463122 - RNA, 64 nt, Human; identical to SEQ ID NO: 436898

SEQ ID NO: 463123 - RNA, 64 nt, Human; identical to SEQ ID NO: 436899

SEQ ID NO: 463124 - RNA, 64 nt, Human; identical to SEQ ID NO: 436900

SEQ ID NO: 463125 - RNA, 64 nt, Human; identical to SEQ ID NO: 436901

SEQ ID NO: 463126 - RNA, 64 nt, Human; identical to SEQ ID NO: 436902

SEQ ID NO: 463127 - RNA, 64 nt, Human; identical to SEQ ID NO: 436903

SEQ ID NO: 463128 - RNA, 64 nt, Human; identical to SEQ ID NO: 436904

SEQ ID NO: 463129 - RNA, 64 nt, Human; identical to SEQ ID NO: 436905

SEQ ID NO: 463130 - RNA, 64 nt, Human; identical to SEQ ID NO: 436906

SEQ ID NO: 463131 - RNA, 64 nt, Human; identical to SEQ ID NO: 436907

SEQ ID NO: 463132 - RNA, 64 nt, Human; identical to SEQ ID NO: 436908

SEQ ID NO: 463133 - RNA, 64 nt, Human; identical to SEQ ID NO: 436909

SEQ ID NO: 463134 - RNA, 64 nt, Human; identical to SEQ ID NO: 436910

SEQ ID NO: 463135 - RNA, 64 nt, Human; identical to SEQ ID NO: 436914

SEQ ID NO: 463136 - RNA, 64 nt, Human; identical to SEQ ID NO: 436915

SEQ ID NO: 463137 - RNA, 64 nt, Human; identical to SEQ ID NO: 274812

SEQ ID NO: 463138 - RNA, 64 nt, Human; identical to SEQ ID NO: 274627

SEQ ID NO: 463139 - RNA, 50 nt, Human; identical to SEQ ID NO: 274795

SEQ ID NO: 463140 - RNA, 64 nt, Human; identical to SEQ ID NO: 270500

SEQ ID NO: 463141 - RNA, 64 nt, Human; identical to SEQ ID NO: 436916

SEQ ID NO: 463142 - RNA, 64 nt, Human; identical to SEQ ID NO: 436917

SEQ ID NO: 463143 - RNA, 64 nt, Human; identical to SEQ ID NO: 436918

SEQ ID NO: 463144 - RNA, 64 nt, Human; identical to SEQ ID NO: 436919

SEQ ID NO: 463145 - RNA, 64 nt, Human; identical to SEQ ID NO: 436920

SEQ ID NO: 463146 - RNA, 64 nt, Human; identical to SEQ ID NO: 436921

SEQ ID NO: 463147 - RNA, 64 nt, Human; identical to SEQ ID NO: 436922

SEQ ID NO: 463148 - RNA, 64 nt, Human; identical to SEQ ID NO: 436923

SEQ ID NO: 463149 - RNA, 64 nt, Human; identical to SEQ ID NO: 436924

SEQ ID NO: 463150 - RNA, 64 nt, Human; identical to SEQ ID NO: 436925

SEQ ID NO: 463151 - RNA, 64 nt, Human; identical to SEQ ID NO: 436926

SEQ ID NO: 463152 - RNA, 64 nt, Human; identical to SEQ ID NO: 436927

SEQ ID NO: 463153 - RNA, 64 nt, Human; identical to SEQ ID NO: 436928

SEQ ID NO: 463154 - RNA, 64 nt, Human; identical to SEQ ID NO: 436932

SEQ ID NO: 463155 - RNA, 64 nt, Human; identical to SEQ ID NO: 436933

SEQ ID NO: 463156 - RNA, 64 nt, Human; identical to SEQ ID NO: 436934

SEQ ID NO: 463157 - RNA, 64 nt, Human; identical to SEQ ID NO: 274490

SEQ ID NO: 463158 - RNA, 64 nt, Human; identical to SEQ ID NO: 274507

SEQ ID NO: 463159 - RNA, 64 nt, Human; identical to SEQ ID NO: 274372

SEQ ID NO: 463160 - RNA, 64 nt, Human; identical to SEQ ID NO: 270518

SEQ ID NO: 463161 - RNA, 64 nt, Human; identical to SEQ ID NO: 436935

SEQ ID NO: 463162 - RNA, 64 nt, Human; identical to SEQ ID NO: 436936

SEQ ID NO: 463163 - RNA, 64 nt, Human; identical to SEQ ID NO: 436937

SEQ ID NO: 463164 - RNA, 64 nt, Human; identical to SEQ ID NO: 436938

SEQ ID NO: 463165 - RNA, 64 nt, Human; identical to SEQ ID NO: 436939

SEQ ID NO: 463166 - RNA, 64 nt, Human; identical to SEQ ID NO: 436940

SEQ ID NO: 463167 - RNA, 64 nt, Human; identical to SEQ ID NO: 436941

SEQ ID NO: 463168 - RNA, 64 nt, Human; identical to SEQ ID NO: 436942

SEQ ID NO: 463169 - RNA, 64 nt, Human; identical to SEQ ID NO: 436943

SEQ ID NO: 463170 - RNA, 64 nt, Human; identical to SEQ ID NO: 436944

SEQ ID NO: 463171 - RNA, 64 nt, Human; identical to SEQ ID NO: 436945

SEQ ID NO: 463172 - RNA, 64 nt, Human; identical to SEQ ID NO: 436946

SEQ ID NO: 463173 - RNA, 64 nt, Human; identical to SEQ ID NO: 436950

SEQ ID NO: 463174 - RNA, 64 nt, Human; identical to SEQ ID NO: 436951

SEQ ID NO: 463175 - RNA, 64 nt, Human; identical to SEQ ID NO: 436952

SEQ ID NO: 463176 - RNA, 64 nt, Human; identical to SEQ ID NO: 436953

SEQ ID NO: 463177 - RNA, 64 nt, Human; identical to SEQ ID NO: 274593

SEQ ID NO: 463178 - RNA, 64 nt, Human; identical to SEQ ID NO: 270534

SEQ ID NO: 463179 - RNA, 60 nt, Human; identical to SEQ ID NO: 455496

SEQ ID NO: 463180 - RNA, 60 nt, Human; identical to SEQ ID NO: 455532

SEQ ID NO: 463181 - RNA, 64 nt, Human; identical to SEQ ID NO: 436954

SEQ ID NO: 463182 - RNA, 64 nt, Human; identical to SEQ ID NO: 436955

SEQ ID NO: 463183 - RNA, 64 nt, Human; identical to SEQ ID NO: 436956

SEQ ID NO: 463184 - RNA, 64 nt, Human; identical to SEQ ID NO: 436957

SEQ ID NO: 463185 - RNA, 64 nt, Human; identical to SEQ ID NO: 436958

SEQ ID NO: 463186 - RNA, 64 nt, Human; identical to SEQ ID NO: 436959

SEQ ID NO: 463187 - RNA, 58 nt, Human; identical to SEQ ID NO: 436960

SEQ ID NO: 463188 - RNA, 64 nt, Human; identical to SEQ ID NO: 436961

SEQ ID NO: 463189 - RNA, 64 nt, Human; identical to SEQ ID NO: 436962

SEQ ID NO: 463190 - RNA, 64 nt, Human; identical to SEQ ID NO: 436963

SEQ ID NO: 463191 - RNA, 64 nt, Human; identical to SEQ ID NO: 436964

SEQ ID NO: 463192 - RNA, 64 nt, Human; identical to SEQ ID NO: 436968

SEQ ID NO: 463193 - RNA, 64 nt, Human; identical to SEQ ID NO: 436969

SEQ ID NO: 463194 - RNA, 64 nt, Human; identical to SEQ ID NO: 436970

SEQ ID NO: 463195 - RNA, 64 nt, Human; identical to SEQ ID NO: 436971

SEQ ID NO: 463196 - RNA, 64 nt, Human; identical to SEQ ID NO: 436972

SEQ ID NO: 463197 - RNA, 60 nt, Human; identical to SEQ ID NO: 455579

SEQ ID NO: 463198 - RNA, 60 nt, Human; identical to SEQ ID NO: 455613

SEQ ID NO: 463199 - RNA, 60 nt, Human; identical to SEQ ID NO: 455644

SEQ ID NO: 463200 - RNA, 60 nt, Human; identical to SEQ ID NO: 455701

SEQ ID NO: 463201 - RNA, 64 nt, Human; identical to SEQ ID NO: 436973

SEQ ID NO: 463202 - RNA, 64 nt, Human; identical to SEQ ID NO: 436974

SEQ ID NO: 463203 - RNA, 64 nt, Human; identical to SEQ ID NO: 436975

SEQ ID NO: 463204 - RNA, 64 nt, Human; identical to SEQ ID NO: 436976

SEQ ID NO: 463205 - RNA, 64 nt, Human; identical to SEQ ID NO: 436977

SEQ ID NO: 463206 - RNA, 64 nt, Human; identical to SEQ ID NO: 436978

SEQ ID NO: 463207 - RNA, 64 nt, Human; identical to SEQ ID NO: 436979

SEQ ID NO: 463208 - RNA, 64 nt, Human; identical to SEQ ID NO: 436980

SEQ ID NO: 463209 - RNA, 64 nt, Human; identical to SEQ ID NO: 436981

SEQ ID NO: 463210 - RNA, 64 nt, Human; identical to SEQ ID NO: 436982

SEQ ID NO: 463211 - RNA, 64 nt, Human; identical to SEQ ID NO: 436986

SEQ ID NO: 463212 - RNA, 64 nt, Human; identical to SEQ ID NO: 436987

SEQ ID NO: 463213 - RNA, 64 nt, Human; identical to SEQ ID NO: 436988

SEQ ID NO: 463214 - RNA, 64 nt, Human; identical to SEQ ID NO: 436989

SEQ ID NO: 463215 - RNA, 64 nt, Human; identical to SEQ ID NO: 436990

SEQ ID NO: 463216 - RNA, 64 nt, Human; identical to SEQ ID NO: 436991

SEQ ID NO: 463217 - RNA, 60 nt, Human; identical to SEQ ID NO: 455777

SEQ ID NO: 463218 - RNA, 60 nt, Human; identical to SEQ ID NO: 455262

SEQ ID NO: 463219 - RNA, 60 nt, Human; identical to SEQ ID NO: 455334

SEQ ID NO: 463220 - RNA, 100 nt, Human
cuuaaagagcucucuagucucuuaaagagcucucuagucuaacggucuuguaguuagagaucuaaaugacauuuuaucauucuaaaugacauuuuaucau

SEQ ID NO: 463221 - RNA, 64 nt, Human; identical to SEQ ID NO: 436992

SEQ ID NO: 463222 - RNA, 64 nt, Human; identical to SEQ ID NO: 436993

SEQ ID NO: 463223 - RNA, 64 nt, Human; identical to SEQ ID NO: 436994

SEQ ID NO: 463224 - RNA, 64 nt, Human; identical to SEQ ID NO: 436995

SEQ ID NO: 463225 - RNA, 64 nt, Human; identical to SEQ ID NO: 436996

SEQ ID NO: 463226 - RNA, 64 nt, Human; identical to SEQ ID NO: 436997

SEQ ID NO: 463227 - RNA, 64 nt, Human; identical to SEQ ID NO: 436998

SEQ ID NO: 463228 - RNA, 64 nt, Human; identical to SEQ ID NO: 436999

SEQ ID NO: 463229 - RNA, 64 nt, Human; identical to SEQ ID NO: 437000

SEQ ID NO: 463230 - RNA, 64 nt, Human; identical to SEQ ID NO: 437004

SEQ ID NO: 463231 - RNA, 64 nt, Human; identical to SEQ ID NO: 437005

SEQ ID NO: 463232 - RNA, 64 nt, Human; identical to SEQ ID NO: 437006

SEQ ID NO: 463233 - RNA, 64 nt, Human; identical to SEQ ID NO: 437007

SEQ ID NO: 463234 - RNA, 64 nt, Human; identical to SEQ ID NO: 437008

SEQ ID NO: 463235 - RNA, 64 nt, Human; identical to SEQ ID NO: 437009

SEQ ID NO: 463236 - RNA, 64 nt, Human; identical to SEQ ID NO: 437010

SEQ ID NO: 463237 - RNA, 100 nt, Human
cuuuucaggaagaacaaaaacuuuucaggaagaacaaaaaugucagugcauaguuagauaaaaugguaaaauguuuuacuaaaugguaaaauguuuuacu

SEQ ID NO: 463238 - RNA, 60 nt, Human; identical to SEQ ID NO: 455840

SEQ ID NO: 463239 - RNA, 60 nt, Human; identical to SEQ ID NO: 455846

SEQ ID NO: 463240 - RNA, 60 nt, Human; identical to SEQ ID NO: 455406

SEQ ID NO: 463241 - RNA, 64 nt, Human; identical to SEQ ID NO: 437011

SEQ ID NO: 463242 - RNA, 64 nt, Human; identical to SEQ ID NO: 437012

SEQ ID NO: 463243 - RNA, 64 nt, Human; identical to SEQ ID NO: 437013

SEQ ID NO: 463244 - RNA, 64 nt, Human; identical to SEQ ID NO: 437014

SEQ ID NO: 463245 - RNA, 64 nt, Human; identical to SEQ ID NO: 437015

SEQ ID NO: 463246 - RNA, 64 nt, Human; identical to SEQ ID NO: 437016

SEQ ID NO: 463247 - RNA, 64 nt, Human; identical to SEQ ID NO: 437017

SEQ ID NO: 463248 - RNA, 64 nt, Human; identical to SEQ ID NO: 437018

SEQ ID NO: 463249 - RNA, 64 nt, Human; identical to SEQ ID NO: 437022

SEQ ID NO: 463250 - RNA, 64 nt, Human; identical to SEQ ID NO: 437023

SEQ ID NO: 463251 - RNA, 64 nt, Human; identical to SEQ ID NO: 437024

SEQ ID NO: 463252 - RNA, 64 nt, Human; identical to SEQ ID NO: 437025

SEQ ID NO: 463253 - RNA, 64 nt, Human; identical to SEQ ID NO: 437026

SEQ ID NO: 463254 - RNA, 64 nt, Human; identical to SEQ ID NO: 437027

SEQ ID NO: 463255 - RNA, 64 nt, Human; identical to SEQ ID NO: 437028

SEQ ID NO: 463256 - RNA, 64 nt, Human; identical to SEQ ID NO: 437029

SEQ ID NO: 463257 - RNA, 60 nt, Human; identical to SEQ ID NO: 455460

SEQ ID NO: 463258 - RNA, 60 nt, Human; identical to SEQ ID NO: 455561

SEQ ID NO: 463259 - RNA, 60 nt, Human; identical to SEQ ID NO: 455046

SEQ ID NO: 463260 - RNA, 60 nt, Human; identical to SEQ ID NO: 455082

SEQ ID NO: 463261 - RNA, 64 nt, Human; identical to SEQ ID NO: 437030

SEQ ID NO: 463262 - RNA, 64 nt, Human; identical to SEQ ID NO: 437031

SEQ ID NO: 463263 - RNA, 64 nt, Human; identical to SEQ ID NO: 437032

SEQ ID NO: 463264 - RNA, 64 nt, Human; identical to SEQ ID NO: 437033

SEQ ID NO: 463265 - RNA, 64 nt, Human; identical to SEQ ID NO: 437034

SEQ ID NO: 463266 - RNA, 64 nt, Human; identical to SEQ ID NO: 437035

SEQ ID NO: 463267 - RNA, 64 nt, Human; identical to SEQ ID NO: 437036

SEQ ID NO: 463268 - RNA, 64 nt, Human; identical to SEQ ID NO: 437040

SEQ ID NO: 463269 - RNA, 64 nt, Human; identical to SEQ ID NO: 437041

SEQ ID NO: 463270 - RNA, 64 nt, Human; identical to SEQ ID NO: 437042

SEQ ID NO: 463271 - RNA, 64 nt, Human; identical to SEQ ID NO: 437043

SEQ ID NO: 463272 - RNA, 64 nt, Human; identical to SEQ ID NO: 437044

SEQ ID NO: 463273 - RNA, 64 nt, Human; identical to SEQ ID NO: 437045

SEQ ID NO: 463274 - RNA, 64 nt, Human; identical to SEQ ID NO: 437046

SEQ ID NO: 463275 - RNA, 64 nt, Human; identical to SEQ ID NO: 437047

SEQ ID NO: 463276 - RNA, 64 nt, Human; identical to SEQ ID NO: 437048

SEQ ID NO: 463277 - RNA, 60 nt, Human; identical to SEQ ID NO: 455118

SEQ ID NO: 463278 - RNA, 60 nt, Human; identical to SEQ ID NO: 455171

SEQ ID NO: 463279 - RNA, 60 nt, Human; identical to SEQ ID NO: 455207

SEQ ID NO: 463280 - RNA, 60 nt, Human; identical to SEQ ID NO: 455854

SEQ ID NO: 463281 - RNA, 64 nt, Human; identical to SEQ ID NO: 437049

SEQ ID NO: 463282 - RNA, 64 nt, Human; identical to SEQ ID NO: 437050

SEQ ID NO: 463283 - RNA, 64 nt, Human; identical to SEQ ID NO: 437051

SEQ ID NO: 463284 - RNA, 64 nt, Human; identical to SEQ ID NO: 437052

SEQ ID NO: 463285 - RNA, 64 nt, Human; identical to SEQ ID NO: 437053

SEQ ID NO: 463286 - RNA, 64 nt, Human; identical to SEQ ID NO: 437054

SEQ ID NO: 463287 - RNA, 64 nt, Human; identical to SEQ ID NO: 437058

SEQ ID NO: 463288 - RNA, 64 nt, Human; identical to SEQ ID NO: 437059

SEQ ID NO: 463289 - RNA, 64 nt, Human; identical to SEQ ID NO: 437060

SEQ ID NO: 463290 - RNA, 64 nt, Human; identical to SEQ ID NO: 437061

SEQ ID NO: 463291 - RNA, 64 nt, Human; identical to SEQ ID NO: 437062

SEQ ID NO: 463292 - RNA, 64 nt, Human; identical to SEQ ID NO: 437063

SEQ ID NO: 463293 - RNA, 64 nt, Human; identical to SEQ ID NO: 437064

SEQ ID NO: 463294 - RNA, 64 nt, Human; identical to SEQ ID NO: 437065

SEQ ID NO: 463295 - RNA, 64 nt, Human; identical to SEQ ID NO: 437066

SEQ ID NO: 463296 - RNA, 64 nt, Human; identical to SEQ ID NO: 437067

SEQ ID NO: 463297 - RNA, 62 nt, Human; identical to SEQ ID NO: 455860

SEQ ID NO: 463298 - RNA, 62 nt, Human; identical to SEQ ID NO: 455870

SEQ ID NO: 463299 - RNA, 62 nt, Human; identical to SEQ ID NO: 455877

SEQ ID NO: 463300 - RNA, 62 nt, Human; identical to SEQ ID NO: 455884

SEQ ID NO: 463301 - RNA, 64 nt, Human; identical to SEQ ID NO: 437068

SEQ ID NO: 463302 - RNA, 64 nt, Human; identical to SEQ ID NO: 437069

SEQ ID NO: 463303 - RNA, 64 nt, Human; identical to SEQ ID NO: 437070

SEQ ID NO: 463304 - RNA, 64 nt, Human; identical to SEQ ID NO: 437071

SEQ ID NO: 463305 - RNA, 64 nt, Human; identical to SEQ ID NO: 437072

SEQ ID NO: 463306 - RNA, 64 nt, Human; identical to SEQ ID NO: 437076

SEQ ID NO: 463307 - RNA, 64 nt, Human; identical to SEQ ID NO: 437077

SEQ ID NO: 463308 - RNA, 64 nt, Human; identical to SEQ ID NO: 437078

SEQ ID NO: 463309 - RNA, 64 nt, Human; identical to SEQ ID NO: 437079

SEQ ID NO: 463310 - RNA, 64 nt, Human; identical to SEQ ID NO: 437080

SEQ ID NO: 463311 - RNA, 64 nt, Human; identical to SEQ ID NO: 437081

SEQ ID NO: 463312 - RNA, 64 nt, Human; identical to SEQ ID NO: 437082

SEQ ID NO: 463313 - RNA, 64 nt, Human; identical to SEQ ID NO: 437083

SEQ ID NO: 463314 - RNA, 64 nt, Human; identical to SEQ ID NO: 437084

SEQ ID NO: 463315 - RNA, 64 nt, Human; identical to SEQ ID NO: 437085

SEQ ID NO: 463316 - RNA, 64 nt, Human; identical to SEQ ID NO: 437086

SEQ ID NO: 463317 - RNA, 62 nt, Human; identical to SEQ ID NO: 455226

SEQ ID NO: 463318 - RNA, 54 nt, Human; identical to SEQ ID NO: 448885

SEQ ID NO: 463319 - RNA, 62 nt, Human; identical to SEQ ID NO: 455890

SEQ ID NO: 463320 - RNA, 62 nt, Human; identical to SEQ ID NO: 455897

SEQ ID NO: 463321 - RNA, 64 nt, Human; identical to SEQ ID NO: 437087

SEQ ID NO: 463322 - RNA, 64 nt, Human; identical to SEQ ID NO: 437088

SEQ ID NO: 463323 - RNA, 64 nt, Human; identical to SEQ ID NO: 437089

SEQ ID NO: 463324 - RNA, 64 nt, Human; identical to SEQ ID NO: 437090

SEQ ID NO: 463325 - RNA, 64 nt, Human; identical to SEQ ID NO: 437094

SEQ ID NO: 463326 - RNA, 64 nt, Human; identical to SEQ ID NO: 437095

SEQ ID NO: 463327 - RNA, 64 nt, Human; identical to SEQ ID NO: 437096

SEQ ID NO: 463328 - RNA, 64 nt, Human; identical to SEQ ID NO: 437097

SEQ ID NO: 463329 - RNA, 64 nt, Human; identical to SEQ ID NO: 437098

SEQ ID NO: 463330 - RNA, 64 nt, Human; identical to SEQ ID NO: 437099

SEQ ID NO: 463331 - RNA, 55 nt, Human; identical to SEQ ID NO: 437100

SEQ ID NO: 463332 - RNA, 64 nt, Human; identical to SEQ ID NO: 437101

SEQ ID NO: 463333 - RNA, 64 nt, Human; identical to SEQ ID NO: 437102

SEQ ID NO: 463334 - RNA, 64 nt, Human; identical to SEQ ID NO: 437103

SEQ ID NO: 463335 - RNA, 64 nt, Human; identical to SEQ ID NO: 437104

SEQ ID NO: 463336 - RNA, 64 nt, Human; identical to SEQ ID NO: 437105

SEQ ID NO: 463337 - RNA, 62 nt, Human; identical to SEQ ID NO: 455904

SEQ ID NO: 463338 - RNA, 62 nt, Human; identical to SEQ ID NO: 454811

SEQ ID NO: 463339 - RNA, 62 nt, Human; identical to SEQ ID NO: 455909

SEQ ID NO: 463340 - RNA, 62 nt, Human; identical to SEQ ID NO: 455916

SEQ ID NO: 463341 - RNA, 64 nt, Human; identical to SEQ ID NO: 437106

SEQ ID NO: 463342 - RNA, 64 nt, Human; identical to SEQ ID NO: 437107

SEQ ID NO: 463343 - RNA, 64 nt, Human; identical to SEQ ID NO: 437108

SEQ ID NO: 463344 - RNA, 64 nt, Human; identical to SEQ ID NO: 437112

SEQ ID NO: 463345 - RNA, 64 nt, Human; identical to SEQ ID NO: 437113

SEQ ID NO: 463346 - RNA, 64 nt, Human; identical to SEQ ID NO: 437114

SEQ ID NO: 463347 - RNA, 64 nt, Human; identical to SEQ ID NO: 437115

SEQ ID NO: 463348 - RNA, 64 nt, Human; identical to SEQ ID NO: 437116

SEQ ID NO: 463349 - RNA, 64 nt, Human; identical to SEQ ID NO: 437117

SEQ ID NO: 463350 - RNA, 64 nt, Human; identical to SEQ ID NO: 437118

SEQ ID NO: 463351 - RNA, 64 nt, Human; identical to SEQ ID NO: 437119

SEQ ID NO: 463352 - RNA, 64 nt, Human; identical to SEQ ID NO: 437120

SEQ ID NO: 463353 - RNA, 64 nt, Human; identical to SEQ ID NO: 437121

SEQ ID NO: 463354 - RNA, 64 nt, Human; identical to SEQ ID NO: 437122

SEQ ID NO: 463355 - RNA, 64 nt, Human; identical to SEQ ID NO: 437123

SEQ ID NO: 463356 - RNA, 64 nt, Human; identical to SEQ ID NO: 437124

SEQ ID NO: 463357 - RNA, 62 nt, Human; identical to SEQ ID NO: 455923

SEQ ID NO: 463358 - RNA, 62 nt, Human; identical to SEQ ID NO: 454848

SEQ ID NO: 463359 - RNA, 62 nt, Human; identical to SEQ ID NO: 455931

SEQ ID NO: 463360 - RNA, 62 nt, Human; identical to SEQ ID NO: 455938

SEQ ID NO: 463361 - RNA, 64 nt, Human; identical to SEQ ID NO: 437125

SEQ ID NO: 463362 - RNA, 64 nt, Human; identical to SEQ ID NO: 437126

SEQ ID NO: 463363 - RNA, 64 nt, Human; identical to SEQ ID NO: 437130

SEQ ID NO: 463364 - RNA, 64 nt, Human; identical to SEQ ID NO: 437131

SEQ ID NO: 463365 - RNA, 64 nt, Human; identical to SEQ ID NO: 437132

SEQ ID NO: 463366 - RNA, 64 nt, Human; identical to SEQ ID NO: 437133

SEQ ID NO: 463367 - RNA, 64 nt, Human; identical to SEQ ID NO: 437134

SEQ ID NO: 463368 - RNA, 64 nt, Human; identical to SEQ ID NO: 437135

SEQ ID NO: 463369 - RNA, 64 nt, Human; identical to SEQ ID NO: 437136

SEQ ID NO: 463370 - RNA, 64 nt, Human; identical to SEQ ID NO: 437137

SEQ ID NO: 463371 - RNA, 64 nt, Human; identical to SEQ ID NO: 437138

SEQ ID NO: 463372 - RNA, 64 nt, Human; identical to SEQ ID NO: 437139

SEQ ID NO: 463373 - RNA, 64 nt, Human; identical to SEQ ID NO: 437140

SEQ ID NO: 463374 - RNA, 64 nt, Human; identical to SEQ ID NO: 437141

SEQ ID NO: 463375 - RNA, 64 nt, Human; identical to SEQ ID NO: 437142

SEQ ID NO: 463376 - RNA, 64 nt, Human; identical to SEQ ID NO: 437143

SEQ ID NO: 463377 - RNA, 62 nt, Human; identical to SEQ ID NO: 455943

SEQ ID NO: 463378 - RNA, 62 nt, Human; identical to SEQ ID NO: 455949

SEQ ID NO: 463379 - RNA, 62 nt, Human; identical to SEQ ID NO: 455957

SEQ ID NO: 463380 - RNA, 62 nt, Human; identical to SEQ ID NO: 455962

SEQ ID NO: 463381 - RNA, 64 nt, Human; identical to SEQ ID NO: 437144

SEQ ID NO: 463382 - RNA, 64 nt, Human; identical to SEQ ID NO: 437148

SEQ ID NO: 463383 - RNA, 64 nt, Human; identical to SEQ ID NO: 437149

SEQ ID NO: 463384 - RNA, 64 nt, Human; identical to SEQ ID NO: 437150

SEQ ID NO: 463385 - RNA, 64 nt, Human; identical to SEQ ID NO: 437151

SEQ ID NO: 463386 - RNA, 64 nt, Human; identical to SEQ ID NO: 437152

SEQ ID NO: 463387 - RNA, 64 nt, Human; identical to SEQ ID NO: 437153

SEQ ID NO: 463388 - RNA, 64 nt, Human; identical to SEQ ID NO: 437154

SEQ ID NO: 463389 - RNA, 64 nt, Human; identical to SEQ ID NO: 437155

SEQ ID NO: 463390 - RNA, 64 nt, Human; identical to SEQ ID NO: 437156

SEQ ID NO: 463391 - RNA, 64 nt, Human; identical to SEQ ID NO: 437157

SEQ ID NO: 463392 - RNA, 64 nt, Human; identical to SEQ ID NO: 437158

SEQ ID NO: 463393 - RNA, 64 nt, Human; identical to SEQ ID NO: 437159

SEQ ID NO: 463394 - RNA, 64 nt, Human; identical to SEQ ID NO: 437160

SEQ ID NO: 463395 - RNA, 64 nt, Human; identical to SEQ ID NO: 437161

SEQ ID NO: 463396 - RNA, 64 nt, Human; identical to SEQ ID NO: 437162

SEQ ID NO: 463397 - RNA, 62 nt, Human; identical to SEQ ID NO: 455969

SEQ ID NO: 463398 - RNA, 62 nt, Human; identical to SEQ ID NO: 455974

SEQ ID NO: 463399 - RNA, 62 nt, Human; identical to SEQ ID NO: 455981

SEQ ID NO: 463400 - RNA, 62 nt, Human; identical to SEQ ID NO: 448904

SEQ ID NO: 463401 - RNA, 64 nt, Human; identical to SEQ ID NO: 437166

SEQ ID NO: 463402 - RNA, 64 nt, Human; identical to SEQ ID NO: 437167

SEQ ID NO: 463403 - RNA, 64 nt, Human; identical to SEQ ID NO: 437168

SEQ ID NO: 463404 - RNA, 64 nt, Human; identical to SEQ ID NO: 437169

SEQ ID NO: 463405 - RNA, 64 nt, Human; identical to SEQ ID NO: 437170

SEQ ID NO: 463406 - RNA, 64 nt, Human; identical to SEQ ID NO: 437171

SEQ ID NO: 463407 - RNA, 64 nt, Human; identical to SEQ ID NO: 437172

SEQ ID NO: 463408 - RNA, 64 nt, Human; identical to SEQ ID NO: 437173

SEQ ID NO: 463409 - RNA, 64 nt, Human; identical to SEQ ID NO: 437174

SEQ ID NO: 463410 - RNA, 64 nt, Human; identical to SEQ ID NO: 437175

SEQ ID NO: 463411 - RNA, 64 nt, Human; identical to SEQ ID NO: 437176

SEQ ID NO: 463412 - RNA, 64 nt, Human; identical to SEQ ID NO: 437177

SEQ ID NO: 463413 - RNA, 64 nt, Human; identical to SEQ ID NO: 437178

SEQ ID NO: 463414 - RNA, 64 nt, Human; identical to SEQ ID NO: 437179

SEQ ID NO: 463415 - RNA, 64 nt, Human; identical to SEQ ID NO: 437180

SEQ ID NO: 463416 - RNA, 64 nt, Human; identical to SEQ ID NO: 437184

SEQ ID NO: 463417 - RNA, 62 nt, Human; identical to SEQ ID NO: 455990

SEQ ID NO: 463418 - RNA, 62 nt, Human; identical to SEQ ID NO: 455995

SEQ ID NO: 463419 - RNA, 62 nt, Human; identical to SEQ ID NO: 456000

SEQ ID NO: 463420 - RNA, 62 nt, Human; identical to SEQ ID NO: 456011

SEQ ID NO: 463421 - RNA, 64 nt, Human; identical to SEQ ID NO: 436684

SEQ ID NO: 463422 - RNA, 64 nt, Human; identical to SEQ ID NO: 436685

SEQ ID NO: 463423 - RNA, 64 nt, Human; identical to SEQ ID NO: 436686

SEQ ID NO: 463424 - RNA, 64 nt, Human; identical to SEQ ID NO: 436687

SEQ ID NO: 463425 - RNA, 64 nt, Human; identical to SEQ ID NO: 436688

SEQ ID NO: 463426 - RNA, 64 nt, Human; identical to SEQ ID NO: 436689

SEQ ID NO: 463427 - RNA, 64 nt, Human; identical to SEQ ID NO: 436690

SEQ ID NO: 463428 - RNA, 64 nt, Human; identical to SEQ ID NO: 436691

SEQ ID NO: 463429 - RNA, 64 nt, Human; identical to SEQ ID NO: 436692

SEQ ID NO: 463430 - RNA, 64 nt, Human; identical to SEQ ID NO: 436693

SEQ ID NO: 463431 - RNA, 64 nt, Human; identical to SEQ ID NO: 436694

SEQ ID NO: 463432 - RNA, 64 nt, Human; identical to SEQ ID NO: 436698

SEQ ID NO: 463433 - RNA, 64 nt, Human; identical to SEQ ID NO: 436699

SEQ ID NO: 463434 - RNA, 64 nt, Human; identical to SEQ ID NO: 436700

SEQ ID NO: 463435 - RNA, 64 nt, Human; identical to SEQ ID NO: 436701

SEQ ID NO: 463436 - RNA, 64 nt, Human; identical to SEQ ID NO: 436702

SEQ ID NO: 463437 - RNA, 62 nt, Human; identical to SEQ ID NO: 456016

SEQ ID NO: 463438 - RNA, 62 nt, Human; identical to SEQ ID NO: 456024

SEQ ID NO: 463439 - RNA, 62 nt, Human; identical to SEQ ID NO: 456031

SEQ ID NO: 463440 - RNA, 62 nt, Human; identical to SEQ ID NO: 456039

SEQ ID NO: 463441 - RNA, 64 nt, Human; identical to SEQ ID NO: 436703

SEQ ID NO: 463442 - RNA, 64 nt, Human; identical to SEQ ID NO: 436704

SEQ ID NO: 463443 - RNA, 64 nt, Human; identical to SEQ ID NO: 436705

SEQ ID NO: 463444 - RNA, 64 nt, Human; identical to SEQ ID NO: 436706

SEQ ID NO: 463445 - RNA, 64 nt, Human; identical to SEQ ID NO: 436707

SEQ ID NO: 463446 - RNA, 64 nt, Human; identical to SEQ ID NO: 436708

SEQ ID NO: 463447 - RNA, 64 nt, Human; identical to SEQ ID NO: 436709

SEQ ID NO: 463448 - RNA, 64 nt, Human; identical to SEQ ID NO: 436710

SEQ ID NO: 463449 - RNA, 64 nt, Human; identical to SEQ ID NO: 436711

SEQ ID NO: 463450 - RNA, 64 nt, Human; identical to SEQ ID NO: 436712

SEQ ID NO: 463451 - RNA, 64 nt, Human; identical to SEQ ID NO: 436716

SEQ ID NO: 463452 - RNA, 64 nt, Human; identical to SEQ ID NO: 436717

SEQ ID NO: 463453 - RNA, 64 nt, Human; identical to SEQ ID NO: 436718

SEQ ID NO: 463454 - RNA, 64 nt, Human; identical to SEQ ID NO: 436719

SEQ ID NO: 463455 - RNA, 64 nt, Human; identical to SEQ ID NO: 436720

SEQ ID NO: 463456 - RNA, 64 nt, Human; identical to SEQ ID NO: 436721

SEQ ID NO: 463457 - RNA, 62 nt, Human; identical to SEQ ID NO: 456044

SEQ ID NO: 463458 - RNA, 62 nt, Human; identical to SEQ ID NO: 456054

SEQ ID NO: 463459 - RNA, 62 nt, Human; identical to SEQ ID NO: 456061

SEQ ID NO: 463460 - RNA, 56 nt, Human; identical to SEQ ID NO: 456066

SEQ ID NO: 463461 - RNA, 64 nt, Human; identical to SEQ ID NO: 436722

SEQ ID NO: 463462 - RNA, 64 nt, Human; identical to SEQ ID NO: 436723

SEQ ID NO: 463463 - RNA, 64 nt, Human; identical to SEQ ID NO: 436724

SEQ ID NO: 463464 - RNA, 64 nt, Human; identical to SEQ ID NO: 436725

SEQ ID NO: 463465 - RNA, 64 nt, Human; identical to SEQ ID NO: 436726

SEQ ID NO: 463466 - RNA, 64 nt, Human; identical to SEQ ID NO: 436727

SEQ ID NO: 463467 - RNA, 64 nt, Human; identical to SEQ ID NO: 436728

SEQ ID NO: 463468 - RNA, 64 nt, Human; identical to SEQ ID NO: 436729

SEQ ID NO: 463469 - RNA, 64 nt, Human; identical to SEQ ID NO: 436730

SEQ ID NO: 463470 - RNA, 64 nt, Human; identical to SEQ ID NO: 436734

SEQ ID NO: 463471 - RNA, 64 nt, Human; identical to SEQ ID NO: 436735

SEQ ID NO: 463472 - RNA, 64 nt, Human; identical to SEQ ID NO: 436736

SEQ ID NO: 463473 - RNA, 64 nt, Human; identical to SEQ ID NO: 436737

SEQ ID NO: 463474 - RNA, 64 nt, Human; identical to SEQ ID NO: 436738

SEQ ID NO: 463475 - RNA, 64 nt, Human; identical to SEQ ID NO: 436739

SEQ ID NO: 463476 - RNA, 64 nt, Human; identical to SEQ ID NO: 436740

SEQ ID NO: 463477 - RNA, 62 nt, Human; identical to SEQ ID NO: 456073

SEQ ID NO: 463478 - RNA, 62 nt, Human; identical to SEQ ID NO: 456081

SEQ ID NO: 463479 - RNA, 62 nt, Human; identical to SEQ ID NO: 456089

SEQ ID NO: 463480 - RNA, 62 nt, Human; identical to SEQ ID NO: 456094

SEQ ID NO: 463481 - RNA, 64 nt, Human; identical to SEQ ID NO: 436741

SEQ ID NO: 463482 - RNA, 64 nt, Human; identical to SEQ ID NO: 436742

SEQ ID NO: 463483 - RNA, 64 nt, Human; identical to SEQ ID NO: 436743

SEQ ID NO: 463484 - RNA, 64 nt, Human; identical to SEQ ID NO: 436744

SEQ ID NO: 463485 - RNA, 64 nt, Human; identical to SEQ ID NO: 436745

SEQ ID NO: 463486 - RNA, 64 nt, Human; identical to SEQ ID NO: 436746

SEQ ID NO: 463487 - RNA, 64 nt, Human; identical to SEQ ID NO: 436747

SEQ ID NO: 463488 - RNA, 64 nt, Human; identical to SEQ ID NO: 436748

SEQ ID NO: 463489 - RNA, 64 nt, Human; identical to SEQ ID NO: 436752

SEQ ID NO: 463490 - RNA, 64 nt, Human; identical to SEQ ID NO: 436753

SEQ ID NO: 463491 - RNA, 64 nt, Human; identical to SEQ ID NO: 436754

SEQ ID NO: 463492 - RNA, 64 nt, Human; identical to SEQ ID NO: 436755

SEQ ID NO: 463493 - RNA, 64 nt, Human; identical to SEQ ID NO: 436756

SEQ ID NO: 463494 - RNA, 64 nt, Human; identical to SEQ ID NO: 436757

SEQ ID NO: 463495 - RNA, 64 nt, Human; identical to SEQ ID NO: 436758

SEQ ID NO: 463496 - RNA, 64 nt, Human; identical to SEQ ID NO: 436759

SEQ ID NO: 463497 - RNA, 54 nt, Human; identical to SEQ ID NO: 456101

SEQ ID NO: 463498 - RNA, 62 nt, Human; identical to SEQ ID NO: 456106

SEQ ID NO: 463499 - RNA, 62 nt, Human; identical to SEQ ID NO: 456111

SEQ ID NO: 463500 - RNA, 62 nt, Human; identical to SEQ ID NO: 456119

SEQ ID NO: 463501 - RNA, 64 nt, Human; identical to SEQ ID NO: 436760

SEQ ID NO: 463502 - RNA, 64 nt, Human; identical to SEQ ID NO: 436761

SEQ ID NO: 463503 - RNA, 64 nt, Human; identical to SEQ ID NO: 436762

SEQ ID NO: 463504 - RNA, 64 nt, Human; identical to SEQ ID NO: 436763

SEQ ID NO: 463505 - RNA, 64 nt, Human; identical to SEQ ID NO: 436764

SEQ ID NO: 463506 - RNA, 64 nt, Human; identical to SEQ ID NO: 436765

SEQ ID NO: 463507 - RNA, 64 nt, Human; identical to SEQ ID NO: 436766

SEQ ID NO: 463508 - RNA, 64 nt, Human; identical to SEQ ID NO: 436770

SEQ ID NO: 463509 - RNA, 64 nt, Human; identical to SEQ ID NO: 436771

SEQ ID NO: 463510 - RNA, 64 nt, Human; identical to SEQ ID NO: 436772

SEQ ID NO: 463511 - RNA, 64 nt, Human; identical to SEQ ID NO: 436773

SEQ ID NO: 463512 - RNA, 64 nt, Human; identical to SEQ ID NO: 436774

SEQ ID NO: 463513 - RNA, 64 nt, Human; identical to SEQ ID NO: 436775

SEQ ID NO: 463514 - RNA, 64 nt, Human; identical to SEQ ID NO: 436776

SEQ ID NO: 463515 - RNA, 64 nt, Human; identical to SEQ ID NO: 436777

SEQ ID NO: 463516 - RNA, 64 nt, Human; identical to SEQ ID NO: 436778

SEQ ID NO: 463517 - RNA, 62 nt, Human; identical to SEQ ID NO: 456124

SEQ ID NO: 463518 - RNA, 62 nt, Human; identical to SEQ ID NO: 456131

SEQ ID NO: 463519 - RNA, 62 nt, Human; identical to SEQ ID NO: 456139

SEQ ID NO: 463520 - RNA, 62 nt, Human; identical to SEQ ID NO: 456144

SEQ ID NO: 463521 - RNA, 64 nt, Human; identical to SEQ ID NO: 436779

SEQ ID NO: 463522 - RNA, 64 nt, Human; identical to SEQ ID NO: 436780

SEQ ID NO: 463523 - RNA, 64 nt, Human; identical to SEQ ID NO: 436781

SEQ ID NO: 463524 - RNA, 64 nt, Human; identical to SEQ ID NO: 436782

SEQ ID NO: 463525 - RNA, 64 nt, Human; identical to SEQ ID NO: 436783

SEQ ID NO: 463526 - RNA, 64 nt, Human; identical to SEQ ID NO: 436784

SEQ ID NO: 463527 - RNA, 64 nt, Human; identical to SEQ ID NO: 436788

SEQ ID NO: 463528 - RNA, 64 nt, Human; identical to SEQ ID NO: 436789

SEQ ID NO: 463529 - RNA, 64 nt, Human; identical to SEQ ID NO: 436790

SEQ ID NO: 463530 - RNA, 64 nt, Human; identical to SEQ ID NO: 436791

SEQ ID NO: 463531 - RNA, 64 nt, Human; identical to SEQ ID NO: 436792

SEQ ID NO: 463532 - RNA, 64 nt, Human; identical to SEQ ID NO: 436793

SEQ ID NO: 463533 - RNA, 64 nt, Human; identical to SEQ ID NO: 436794

SEQ ID NO: 463534 - RNA, 64 nt, Human; identical to SEQ ID NO: 436795

SEQ ID NO: 463535 - RNA, 64 nt, Human; identical to SEQ ID NO: 436796

SEQ ID NO: 463536 - RNA, 64 nt, Human; identical to SEQ ID NO: 436797

SEQ ID NO: 463537 - RNA, 62 nt, Human; identical to SEQ ID NO: 454938

SEQ ID NO: 463538 - RNA, 62 nt, Human; identical to SEQ ID NO: 448906

SEQ ID NO: 463539 - RNA, 62 nt, Human; identical to SEQ ID NO: 456154

SEQ ID NO: 463540 - RNA, 62 nt, Human; identical to SEQ ID NO: 456159

SEQ ID NO: 463541 - RNA, 64 nt, Human; identical to SEQ ID NO: 436798

SEQ ID NO: 463542 - RNA, 64 nt, Human; identical to SEQ ID NO: 436799

SEQ ID NO: 463543 - RNA, 64 nt, Human; identical to SEQ ID NO: 436800

SEQ ID NO: 463544 - RNA, 64 nt, Human; identical to SEQ ID NO: 436801

SEQ ID NO: 463545 - RNA, 64 nt, Human; identical to SEQ ID NO: 436802

SEQ ID NO: 463546 - RNA, 64 nt, Human; identical to SEQ ID NO: 436806

SEQ ID NO: 463547 - RNA, 64 nt, Human; identical to SEQ ID NO: 436807

SEQ ID NO: 463548 - RNA, 64 nt, Human; identical to SEQ ID NO: 436808

SEQ ID NO: 463549 - RNA, 64 nt, Human; identical to SEQ ID NO: 436809

SEQ ID NO: 463550 - RNA, 64 nt, Human; identical to SEQ ID NO: 436810

SEQ ID NO: 463551 - RNA, 64 nt, Human; identical to SEQ ID NO: 436811

SEQ ID NO: 463552 - RNA, 64 nt, Human; identical to SEQ ID NO: 436812

SEQ ID NO: 463553 - RNA, 64 nt, Human; identical to SEQ ID NO: 436813

SEQ ID NO: 463554 - RNA, 64 nt, Human; identical to SEQ ID NO: 436814

SEQ ID NO: 463555 - RNA, 64 nt, Human; identical to SEQ ID NO: 436815

SEQ ID NO: 463556 - RNA, 64 nt, Human; identical to SEQ ID NO: 436816

SEQ ID NO: 463557 - RNA, 62 nt, Human; identical to SEQ ID NO: 456169

SEQ ID NO: 463558 - RNA, 62 nt, Human; identical to SEQ ID NO: 456174

SEQ ID NO: 463559 - RNA, 62 nt, Human; identical to SEQ ID NO: 456179

SEQ ID NO: 463560 - RNA, 62 nt, Human; identical to SEQ ID NO: 456184

SEQ ID NO: 463561 - RNA, 64 nt, Human; identical to SEQ ID NO: 436817

SEQ ID NO: 463562 - RNA, 64 nt, Human; identical to SEQ ID NO: 436818

SEQ ID NO: 463563 - RNA, 64 nt, Human; identical to SEQ ID NO: 436819

SEQ ID NO: 463564 - RNA, 64 nt, Human; identical to SEQ ID NO: 436820

SEQ ID NO: 463565 - RNA, 64 nt, Human; identical to SEQ ID NO: 436824

SEQ ID NO: 463566 - RNA, 64 nt, Human; identical to SEQ ID NO: 436825

SEQ ID NO: 463567 - RNA, 64 nt, Human; identical to SEQ ID NO: 436826

SEQ ID NO: 463568 - RNA, 64 nt, Human; identical to SEQ ID NO: 436827

SEQ ID NO: 463569 - RNA, 64 nt, Human; identical to SEQ ID NO: 436828

SEQ ID NO: 463570 - RNA, 64 nt, Human; identical to SEQ ID NO: 436829

SEQ ID NO: 463571 - RNA, 64 nt, Human; identical to SEQ ID NO: 436830

SEQ ID NO: 463572 - RNA, 64 nt, Human; identical to SEQ ID NO: 436831

SEQ ID NO: 463573 - RNA, 64 nt, Human; identical to SEQ ID NO: 436832

SEQ ID NO: 463574 - RNA, 64 nt, Human; identical to SEQ ID NO: 436833

SEQ ID NO: 463575 - RNA, 64 nt, Human; identical to SEQ ID NO: 436834

SEQ ID NO: 463576 - RNA, 64 nt, Human; identical to SEQ ID NO: 436835

SEQ ID NO: 463577 - RNA, 62 nt, Human; identical to SEQ ID NO: 448923

SEQ ID NO: 463578 - RNA, 62 nt, Human; identical to SEQ ID NO: 456194

SEQ ID NO: 463579 - RNA, 61 nt, Human; identical to SEQ ID NO: 456197

SEQ ID NO: 463580 - RNA, 61 nt, Human; identical to SEQ ID NO: 456204

SEQ ID NO: 463581 - RNA, 64 nt, Human; identical to SEQ ID NO: 436836

SEQ ID NO: 463582 - RNA, 64 nt, Human; identical to SEQ ID NO: 436837

SEQ ID NO: 463583 - RNA, 64 nt, Human; identical to SEQ ID NO: 436838

SEQ ID NO: 463584 - RNA, 64 nt, Human; identical to SEQ ID NO: 436842

SEQ ID NO: 463585 - RNA, 64 nt, Human; identical to SEQ ID NO: 436843

SEQ ID NO: 463586 - RNA, 64 nt, Human; identical to SEQ ID NO: 436844

SEQ ID NO: 463587 - RNA, 64 nt, Human; identical to SEQ ID NO: 436845

SEQ ID NO: 463588 - RNA, 64 nt, Human; identical to SEQ ID NO: 436846

SEQ ID NO: 463589 - RNA, 64 nt, Human; identical to SEQ ID NO: 436847

SEQ ID NO: 463590 - RNA, 64 nt, Human; identical to SEQ ID NO: 436848

SEQ ID NO: 463591 - RNA, 64 nt, Human; identical to SEQ ID NO: 436849

SEQ ID NO: 463592 - RNA, 64 nt, Human; identical to SEQ ID NO: 436850

SEQ ID NO: 463593 - RNA, 64 nt, Human; identical to SEQ ID NO: 436851

SEQ ID NO: 463594 - RNA, 64 nt, Human; identical to SEQ ID NO: 436852

SEQ ID NO: 463595 - RNA, 64 nt, Human; identical to SEQ ID NO: 436853

SEQ ID NO: 463596 - RNA, 64 nt, Human; identical to SEQ ID NO: 436854

SEQ ID NO: 463597 - RNA, 61 nt, Human; identical to SEQ ID NO: 455153

SEQ ID NO: 463598 - RNA, 61 nt, Human; identical to SEQ ID NO: 455316

SEQ ID NO: 463599 - RNA, 61 nt, Human; identical to SEQ ID NO: 448942

SEQ ID NO: 463600 - RNA, 61 nt, Human; identical to SEQ ID NO: 456085

SEQ ID NO: 463601 - RNA, 64 nt, Human; identical to SEQ ID NO: 436855

SEQ ID NO: 463602 - RNA, 64 nt, Human; identical to SEQ ID NO: 436856

SEQ ID NO: 463603 - RNA, 64 nt, Human; identical to SEQ ID NO: 436860

SEQ ID NO: 463604 - RNA, 64 nt, Human; identical to SEQ ID NO: 436861

SEQ ID NO: 463605 - RNA, 64 nt, Human; identical to SEQ ID NO: 436862

SEQ ID NO: 463606 - RNA, 64 nt, Human; identical to SEQ ID NO: 436863

SEQ ID NO: 463607 - RNA, 64 nt, Human; identical to SEQ ID NO: 436864

SEQ ID NO: 463608 - RNA, 64 nt, Human; identical to SEQ ID NO: 436865

SEQ ID NO: 463609 - RNA, 64 nt, Human; identical to SEQ ID NO: 436866

SEQ ID NO: 463610 - RNA, 64 nt, Human; identical to SEQ ID NO: 436867

SEQ ID NO: 463611 - RNA, 64 nt, Human; identical to SEQ ID NO: 436868

SEQ ID NO: 463612 - RNA, 64 nt, Human; identical to SEQ ID NO: 436869

SEQ ID NO: 463613 - RNA, 64 nt, Human; identical to SEQ ID NO: 436870

SEQ ID NO: 463614 - RNA, 64 nt, Human; identical to SEQ ID NO: 436871

SEQ ID NO: 463615 - RNA, 64 nt, Human; identical to SEQ ID NO: 436872

SEQ ID NO: 463616 - RNA, 64 nt, Human; identical to SEQ ID NO: 436873

SEQ ID NO: 463617 - RNA, 61 nt, Human; identical to SEQ ID NO: 448944

SEQ ID NO: 463618 - RNA, 61 nt, Human; identical to SEQ ID NO: 456209

SEQ ID NO: 463619 - RNA, 61 nt, Human; identical to SEQ ID NO: 456210

SEQ ID NO: 463620 - RNA, 61 nt, Human; identical to SEQ ID NO: 456211

SEQ ID NO: 463621 - RNA, 64 nt, Human; identical to SEQ ID NO: 436874

SEQ ID NO: 463622 - RNA, 64 nt, Human; identical to SEQ ID NO: 436878

SEQ ID NO: 463623 - RNA, 64 nt, Human; identical to SEQ ID NO: 436879

SEQ ID NO: 463624 - RNA, 64 nt, Human; identical to SEQ ID NO: 436880

SEQ ID NO: 463625 - RNA, 64 nt, Human; identical to SEQ ID NO: 436881

SEQ ID NO: 463626 - RNA, 64 nt, Human; identical to SEQ ID NO: 436882

SEQ ID NO: 463627 - RNA, 64 nt, Human; identical to SEQ ID NO: 436883

SEQ ID NO: 463628 - RNA, 64 nt, Human; identical to SEQ ID NO: 436884

SEQ ID NO: 463629 - RNA, 64 nt, Human; identical to SEQ ID NO: 436885

SEQ ID NO: 463630 - RNA, 64 nt, Human; identical to SEQ ID NO: 436886

SEQ ID NO: 463631 - RNA, 64 nt, Human; identical to SEQ ID NO: 436887

SEQ ID NO: 463632 - RNA, 64 nt, Human; identical to SEQ ID NO: 436888

SEQ ID NO: 463633 - RNA, 64 nt, Human; identical to SEQ ID NO: 436889

SEQ ID NO: 463634 - RNA, 64 nt, Human; identical to SEQ ID NO: 436890

SEQ ID NO: 463635 - RNA, 64 nt, Human; identical to SEQ ID NO: 436891

SEQ ID NO: 463636 - RNA, 64 nt, Human; identical to SEQ ID NO: 436892

SEQ ID NO: 463637 - RNA, 64 nt, Human
uuccucacauacugaucuaggauuuuaaauuauuucauugcaaaguaauugugucucuccuuuc

SEQ ID NO: 463638 - RNA, 64 nt, Human
auuuguucaaaauaaugaaguuauggcuucacauucauugcagugggauaugguuuuuauguaa

SEQ ID NO: 463639 - RNA, 64 nt, Human
ucgggggaggagagaccuuccucuccugcggacuucauugcaggugcaaguugccuacacccaa

SEQ ID NO: 463640 - RNA, 64 nt, Human; identical to SEQ ID NO: 436896

SEQ ID NO: 463641 - RNA, 64 nt, Human; identical to SEQ ID NO: 436897

SEQ ID NO: 463642 - RNA, 64 nt, Human; identical to SEQ ID NO: 436898

SEQ ID NO: 463643 - RNA, 64 nt, Human; identical to SEQ ID NO: 436899

SEQ ID NO: 463644 - RNA, 64 nt, Human; identical to SEQ ID NO: 436900

SEQ ID NO: 463645 - RNA, 64 nt, Human; identical to SEQ ID NO: 436901

SEQ ID NO: 463646 - RNA, 64 nt, Human; identical to SEQ ID NO: 436902

SEQ ID NO: 463647 - RNA, 64 nt, Human; identical to SEQ ID NO: 436903

SEQ ID NO: 463648 - RNA, 64 nt, Human; identical to SEQ ID NO: 436904

SEQ ID NO: 463649 - RNA, 64 nt, Human; identical to SEQ ID NO: 436905

SEQ ID NO: 463650 - RNA, 64 nt, Human; identical to SEQ ID NO: 436906

SEQ ID NO: 463651 - RNA, 64 nt, Human; identical to SEQ ID NO: 436907

SEQ ID NO: 463652 - RNA, 64 nt, Human; identical to SEQ ID NO: 436908

SEQ ID NO: 463653 - RNA, 64 nt, Human; identical to SEQ ID NO: 436909

SEQ ID NO: 463654 - RNA, 64 nt, Human; identical to SEQ ID NO: 436910

SEQ ID NO: 463655 - RNA, 64 nt, Human; identical to SEQ ID NO: 436914

SEQ ID NO: 463656 - RNA, 64 nt, Human
uuaauuuaaauuaauauuuccauuaauaaccuauucauugcagauaccuauuauacuguguaac

SEQ ID NO: 463657 - RNA, 64 nt, Human
ucugcagcaaauaauuauuaugucugauguugacucauugcaguuuaaacauuucuucuuguuu

SEQ ID NO: 463658 - RNA, 64 nt, Human
uccccugugaaaugagaacacgggguaacugcgaucauugcacuugguguucacagugggccag

SEQ ID NO: 463659 - RNA, 64 nt, Human; identical to SEQ ID NO: 436915

SEQ ID NO: 463660 - RNA, 64 nt, Human; identical to SEQ ID NO: 436916

SEQ ID NO: 463661 - RNA, 64 nt, Human; identical to SEQ ID NO: 436917

SEQ ID NO: 463662 - RNA, 64 nt, Human; identical to SEQ ID NO: 436918

SEQ ID NO: 463663 - RNA, 64 nt, Human; identical to SEQ ID NO: 436919

SEQ ID NO: 463664 - RNA, 64 nt, Human; identical to SEQ ID NO: 436920

SEQ ID NO: 463665 - RNA, 64 nt, Human; identical to SEQ ID NO: 436921

SEQ ID NO: 463666 - RNA, 64 nt, Human; identical to SEQ ID NO: 436922

SEQ ID NO: 463667 - RNA, 64 nt, Human; identical to SEQ ID NO: 436923

SEQ ID NO: 463668 - RNA, 64 nt, Human; identical to SEQ ID NO: 436924

SEQ ID NO: 463669 - RNA, 64 nt, Human; identical to SEQ ID NO: 436925

SEQ ID NO: 463670 - RNA, 64 nt, Human; identical to SEQ ID NO: 436926

SEQ ID NO: 463671 - RNA, 64 nt, Human; identical to SEQ ID NO: 436927

SEQ ID NO: 463672 - RNA, 64 nt, Human; identical to SEQ ID NO: 436928

SEQ ID NO: 463673 - RNA, 64 nt, Human; identical to SEQ ID NO: 436932

SEQ ID NO: 463674 - RNA, 64 nt, Human; identical to SEQ ID NO: 436933

SEQ ID NO: 463675 - RNA, 64 nt, Human
cuccauaagagaaaauauuuaugaacuauauuucucauugcacucuguaauaaaaagcaguuag

SEQ ID NO: 463676 - RNA, 64 nt, Human
uuggcagacuagaguacaguggugagaucacaguucauugcagccuugacuucucaacgccaag

SEQ ID NO: 463677 - RNA, 64 nt, Human
acuuuguuuuuaaauuaugcuuucuauuuugagaucauugcaaacucaacacaauuguaaguaa

SEQ ID NO: 463678 - RNA, 64 nt, Human; identical to SEQ ID NO: 436934

SEQ ID NO: 463679 - RNA, 64 nt, Human; identical to SEQ ID NO: 436935

SEQ ID NO: 463680 - RNA, 64 nt, Human; identical to SEQ ID NO: 436936

SEQ ID NO: 463681 - RNA, 64 nt, Human; identical to SEQ ID NO: 436937

SEQ ID NO: 463682 - RNA, 64 nt, Human; identical to SEQ ID NO: 436938

SEQ ID NO: 463683 - RNA, 64 nt, Human; identical to SEQ ID NO: 436939

SEQ ID NO: 463684 - RNA, 64 nt, Human; identical to SEQ ID NO: 436940

SEQ ID NO: 463685 - RNA, 64 nt, Human; identical to SEQ ID NO: 436941

SEQ ID NO: 463686 - RNA, 64 nt, Human; identical to SEQ ID NO: 436942

SEQ ID NO: 463687 - RNA, 64 nt, Human; identical to SEQ ID NO: 436943

SEQ ID NO: 463688 - RNA, 64 nt, Human; identical to SEQ ID NO: 436944

SEQ ID NO: 463689 - RNA, 64 nt, Human; identical to SEQ ID NO: 436945

SEQ ID NO: 463690 - RNA, 64 nt, Human; identical to SEQ ID NO: 436946

SEQ ID NO: 463691 - RNA, 64 nt, Human; identical to SEQ ID NO: 436950

SEQ ID NO: 463692 - RNA, 64 nt, Human; identical to SEQ ID NO: 436951

SEQ ID NO: 463693 - RNA, 64 nt, Human; identical to SEQ ID NO: 436952

SEQ ID NO: 463694 - RNA, 64 nt, Human
cgccauacugaggcugagcacagauuugucuuuuucauugcaucugucaagcuuaaauaaccac

SEQ ID NO: 463695 - RNA, 64 nt, Human
aaucauuccaccauaaagacaaacacuuguauguucauugcagcacuauucucaauagcaaaga

SEQ ID NO: 463696 - RNA, 64 nt, Human
aaauaugcucuguuaguuuguauggaaugauauuucauugcacuuuuaauuuaacuuaaaaaug

SEQ ID NO: 463697 - RNA, 64 nt, Human; identical to SEQ ID NO: 436953

SEQ ID NO: 463698 - RNA, 64 nt, Human; identical to SEQ ID NO: 436954

SEQ ID NO: 463699 - RNA, 64 nt, Human; identical to SEQ ID NO: 436955

SEQ ID NO: 463700 - RNA, 64 nt, Human; identical to SEQ ID NO: 436956

SEQ ID NO: 463701 - RNA, 64 nt, Human; identical to SEQ ID NO: 436957

SEQ ID NO: 463702 - RNA, 64 nt, Human; identical to SEQ ID NO: 436958

SEQ ID NO: 463703 - RNA, 64 nt, Human; identical to SEQ ID NO: 436959

SEQ ID NO: 463704 - RNA, 58 nt, Human; identical to SEQ ID NO: 436960

SEQ ID NO: 463705 - RNA, 64 nt, Human; identical to SEQ ID NO: 436961

SEQ ID NO: 463706 - RNA, 64 nt, Human; identical to SEQ ID NO: 436962

SEQ ID NO: 463707 - RNA, 64 nt, Human; identical to SEQ ID NO: 436963

SEQ ID NO: 463708 - RNA, 64 nt, Human; identical to SEQ ID NO: 436964

SEQ ID NO: 463709 - RNA, 64 nt, Human; identical to SEQ ID NO: 436968

SEQ ID NO: 463710 - RNA, 64 nt, Human; identical to SEQ ID NO: 436969

SEQ ID NO: 463711 - RNA, 64 nt, Human; identical to SEQ ID NO: 436970

SEQ ID NO: 463712 - RNA, 64 nt, Human; identical to SEQ ID NO: 436971

SEQ ID NO: 463713 - RNA, 64 nt, Human
cucccaggcuagaguaccguggcacaaucucagcucauugcaaccucugcuuccugggcucaag

SEQ ID NO: 463714 - RNA, 64 nt, Human
cagggagucauguacuggucuauagcuguauaguucauugcaccaugaguuauaguagccagaa

SEQ ID NO: 463715 - RNA, 64 nt, Human
gaauauggcaaggccaucugaaggaauuaacaccucauugcacauuacaugaucacuuccagag

SEQ ID NO: 463716 - RNA, 64 nt, Human; identical to SEQ ID NO: 436972

SEQ ID NO: 463717 - RNA, 64 nt, Human; identical to SEQ ID NO: 436973

SEQ ID NO: 463718 - RNA, 64 nt, Human; identical to SEQ ID NO: 436974

SEQ ID NO: 463719 - RNA, 64 nt, Human; identical to SEQ ID NO: 436975

SEQ ID NO: 463720 - RNA, 64 nt, Human; identical to SEQ ID NO: 436976

SEQ ID NO: 463721 - RNA, 64 nt, Human; identical to SEQ ID NO: 436977

SEQ ID NO: 463722 - RNA, 64 nt, Human; identical to SEQ ID NO: 436978

SEQ ID NO: 463723 - RNA, 64 nt, Human; identical to SEQ ID NO: 436979

SEQ ID NO: 463724 - RNA, 64 nt, Human; identical to SEQ ID NO: 436980

SEQ ID NO: 463725 - RNA, 64 nt, Human; identical to SEQ ID NO: 436981

SEQ ID NO: 463726 - RNA, 64 nt, Human; identical to SEQ ID NO: 436982

SEQ ID NO: 463727 - RNA, 64 nt, Human; identical to SEQ ID NO: 436986

SEQ ID NO: 463728 - RNA, 64 nt, Human; identical to SEQ ID NO: 436987

SEQ ID NO: 463729 - RNA, 64 nt, Human; identical to SEQ ID NO: 436988

SEQ ID NO: 463730 - RNA, 64 nt, Human; identical to SEQ ID NO: 436989

SEQ ID NO: 463731 - RNA, 64 nt, Human; identical to SEQ ID NO: 436990

SEQ ID NO: 463732 - RNA, 64 nt, Human
uucacgagggauuuuguuagaacuuuaacaucagucauugcacaggagcuaaggcuuauaaaau

SEQ ID NO: 463733 - RNA, 64 nt, Human
guaaggaucccuucagucaccacucaguucucacucauugcagaaggauucauaccagggggaa

SEQ ID NO: 463734 - RNA, 64 nt, Human
cuggagauaaucuccagucccugugcagacacugucauugcacuuucugcugaaaugguaguuu

SEQ ID NO: 463735 - RNA, 64 nt, Human; identical to SEQ ID NO: 436991

SEQ ID NO: 463736 - RNA, 64 nt, Human; identical to SEQ ID NO: 436992

SEQ ID NO: 463737 - RNA, 64 nt, Human; identical to SEQ ID NO: 436993

SEQ ID NO: 463738 - RNA, 64 nt, Human; identical to SEQ ID NO: 436994

SEQ ID NO: 463739 - RNA, 64 nt, Human; identical to SEQ ID NO: 436995

SEQ ID NO: 463740 - RNA, 64 nt, Human; identical to SEQ ID NO: 436996

SEQ ID NO: 463741 - RNA, 64 nt, Human; identical to SEQ ID NO: 436997

SEQ ID NO: 463742 - RNA, 64 nt, Human; identical to SEQ ID NO: 436998

SEQ ID NO: 463743 - RNA, 64 nt, Human; identical to SEQ ID NO: 436999

SEQ ID NO: 463744 - RNA, 64 nt, Human; identical to SEQ ID NO: 437000

SEQ ID NO: 463745 - RNA, 64 nt, Human; identical to SEQ ID NO: 437004

SEQ ID NO: 463746 - RNA, 64 nt, Human; identical to SEQ ID NO: 437005

SEQ ID NO: 463747 - RNA, 64 nt, Human; identical to SEQ ID NO: 437006

SEQ ID NO: 463748 - RNA, 64 nt, Human; identical to SEQ ID NO: 437007

SEQ ID NO: 463749 - RNA, 64 nt, Human; identical to SEQ ID NO: 437008

SEQ ID NO: 463750 - RNA, 64 nt, Human; identical to SEQ ID NO: 437009

SEQ ID NO: 463751 - RNA, 64 nt, Human; identical to SEQ ID NO: 72766

SEQ ID NO: 463752 - RNA, 64 nt, Human; identical to SEQ ID NO: 72773

SEQ ID NO: 463753 - RNA, 64 nt, Human; identical to SEQ ID NO: 72780

SEQ ID NO: 463754 - RNA, 64 nt, Human; identical to SEQ ID NO: 437010

SEQ ID NO: 463755 - RNA, 64 nt, Human; identical to SEQ ID NO: 437011

SEQ ID NO: 463756 - RNA, 64 nt, Human; identical to SEQ ID NO: 437012

SEQ ID NO: 463757 - RNA, 64 nt, Human; identical to SEQ ID NO: 437013

SEQ ID NO: 463758 - RNA, 64 nt, Human; identical to SEQ ID NO: 437014

SEQ ID NO: 463759 - RNA, 64 nt, Human; identical to SEQ ID NO: 437015

SEQ ID NO: 463760 - RNA, 64 nt, Human; identical to SEQ ID NO: 437016

SEQ ID NO: 463761 - RNA, 64 nt, Human; identical to SEQ ID NO: 437017

SEQ ID NO: 463762 - RNA, 64 nt, Human; identical to SEQ ID NO: 437018

SEQ ID NO: 463763 - RNA, 64 nt, Human; identical to SEQ ID NO: 437022

SEQ ID NO: 463764 - RNA, 64 nt, Human; identical to SEQ ID NO: 437023

SEQ ID NO: 463765 - RNA, 64 nt, Human; identical to SEQ ID NO: 437024

SEQ ID NO: 463766 - RNA, 64 nt, Human; identical to SEQ ID NO: 437025

SEQ ID NO: 463767 - RNA, 64 nt, Human; identical to SEQ ID NO: 437026

SEQ ID NO: 463768 - RNA, 64 nt, Human; identical to SEQ ID NO: 437027

SEQ ID NO: 463769 - RNA, 64 nt, Human; identical to SEQ ID NO: 437028

SEQ ID NO: 463770 - RNA, 64 nt, Human
ucauuccauuuuucugauuaaacugucaaaucugucauugcauaugccaucguuuucuagcaaa

SEQ ID NO: 463771 - RNA, 64 nt, Human
ggccuuguagcucugggcacagauguguuuggauucauugcagcggaccaccgggcacuguuga

SEQ ID NO: 463772 - RNA, 64 nt, Human
ugcccaagcuugagggcaguggugcaaucauaacucauugcagccucgaacuccugggcuuaag

SEQ ID NO: 463773 - RNA, 64 nt, Human; identical to SEQ ID NO: 437029

SEQ ID NO: 463774 - RNA, 64 nt, Human; identical to SEQ ID NO: 437030

SEQ ID NO: 463775 - RNA, 64 nt, Human; identical to SEQ ID NO: 437031

SEQ ID NO: 463776 - RNA, 64 nt, Human; identical to SEQ ID NO: 437032

SEQ ID NO: 463777 - RNA, 64 nt, Human; identical to SEQ ID NO: 437033

SEQ ID NO: 463778 - RNA, 64 nt, Human; identical to SEQ ID NO: 437034

SEQ ID NO: 463779 - RNA, 64 nt, Human; identical to SEQ ID NO: 437035

SEQ ID NO: 463780 - RNA, 64 nt, Human; identical to SEQ ID NO: 437036

SEQ ID NO: 463781 - RNA, 64 nt, Human; identical to SEQ ID NO: 437040

SEQ ID NO: 463782 - RNA, 64 nt, Human; identical to SEQ ID NO: 437041

SEQ ID NO: 463783 - RNA, 64 nt, Human; identical to SEQ ID NO: 437042

SEQ ID NO: 463784 - RNA, 64 nt, Human; identical to SEQ ID NO: 437043

SEQ ID NO: 463785 - RNA, 64 nt, Human; identical to SEQ ID NO: 437044

SEQ ID NO: 463786 - RNA, 64 nt, Human; identical to SEQ ID NO: 437045

SEQ ID NO: 463787 - RNA, 64 nt, Human; identical to SEQ ID NO: 437046

SEQ ID NO: 463788 - RNA, 64 nt, Human; identical to SEQ ID NO: 437047

SEQ ID NO: 463789 - RNA, 64 nt, Human
gaugcauuucggcuuuuaaccaguuugguucugaucauugcaaccucugugcuuuuauaauuca

SEQ ID NO: 463790 - RNA, 64 nt, Human
gcccccggccccauuugugccauaaaggguugcuucauugcaggagggguggcugaaaccacca

SEQ ID NO: 463791 - RNA, 64 nt, Human
uuacacgugacuuuaaucgcccaacugugacuagucauugcagcuacucagcuacaguauuuau

SEQ ID NO: 463792 - RNA, 64 nt, Human; identical to SEQ ID NO: 437048

SEQ ID NO: 463793 - RNA, 64 nt, Human; identical to SEQ ID NO: 437049

SEQ ID NO: 463794 - RNA, 64 nt, Human; identical to SEQ ID NO: 437050

SEQ ID NO: 463795 - RNA, 64 nt, Human; identical to SEQ ID NO: 437051

SEQ ID NO: 463796 - RNA, 64 nt, Human; identical to SEQ ID NO: 437052

SEQ ID NO: 463797 - RNA, 64 nt, Human; identical to SEQ ID NO: 437053

SEQ ID NO: 463798 - RNA, 64 nt, Human; identical to SEQ ID NO: 437054

SEQ ID NO: 463799 - RNA, 64 nt, Human; identical to SEQ ID NO: 437058

SEQ ID NO: 463800 - RNA, 64 nt, Human; identical to SEQ ID NO: 437059

SEQ ID NO: 463801 - RNA, 64 nt, Human; identical to SEQ ID NO: 437060

SEQ ID NO: 463802 - RNA, 64 nt, Human; identical to SEQ ID NO: 437061

SEQ ID NO: 463803 - RNA, 64 nt, Human; identical to SEQ ID NO: 437062

SEQ ID NO: 463804 - RNA, 64 nt, Human; identical to SEQ ID NO: 437063

SEQ ID NO: 463805 - RNA, 64 nt, Human; identical to SEQ ID NO: 437064

SEQ ID NO: 463806 - RNA, 64 nt, Human; identical to SEQ ID NO: 437065

SEQ ID NO: 463807 - RNA, 64 nt, Human; identical to SEQ ID NO: 437066

SEQ ID NO: 463808 - RNA, 64 nt, Human
guacacggguuuaaaguuuauuuuuaugguuuagucauugcagaguucuuauuuuggggggagg

SEQ ID NO: 463809 - RNA, 64 nt, Human
accacagauuuucugagcuucuaaauguagccuuucauugcacauuucagugaucagaauagau

SEQ ID NO: 463810 - RNA, 64 nt, Human
aggcugcagcuaauuugugaaaguggcaagcucuucauugcacugcaguuauuuaccagaaguu

SEQ ID NO: 463811 - RNA, 64 nt, Human; identical to SEQ ID NO: 437067

SEQ ID NO: 463812 - RNA, 64 nt, Human; identical to SEQ ID NO: 437068

SEQ ID NO: 463813 - RNA, 64 nt, Human; identical to SEQ ID NO: 437069

SEQ ID NO: 463814 - RNA, 64 nt, Human; identical to SEQ ID NO: 437070

SEQ ID NO: 463815 - RNA, 64 nt, Human; identical to SEQ ID NO: 437071

SEQ ID NO: 463816 - RNA, 64 nt, Human; identical to SEQ ID NO: 437072

SEQ ID NO: 463817 - RNA, 64 nt, Human; identical to SEQ ID NO: 437076

SEQ ID NO: 463818 - RNA, 64 nt, Human; identical to SEQ ID NO: 437077

SEQ ID NO: 463819 - RNA, 64 nt, Human; identical to SEQ ID NO: 437078

SEQ ID NO: 463820 - RNA, 64 nt, Human; identical to SEQ ID NO: 437079

SEQ ID NO: 463821 - RNA, 64 nt, Human; identical to SEQ ID NO: 437080

SEQ ID NO: 463822 - RNA, 64 nt, Human; identical to SEQ ID NO: 437081

SEQ ID NO: 463823 - RNA, 64 nt, Human; identical to SEQ ID NO: 437082

SEQ ID NO: 463824 - RNA, 64 nt, Human; identical to SEQ ID NO: 437083

SEQ ID NO: 463825 - RNA, 64 nt, Human; identical to SEQ ID NO: 437084

SEQ ID NO: 463826 - RNA, 64 nt, Human; identical to SEQ ID NO: 437085

SEQ ID NO: 463827 - RNA, 64 nt, Human
ggaguaguagcugaauuugauucuccagccaaccucauugcagcuagaggcaucuucuacggga

SEQ ID NO: 463828 - RNA, 64 nt, Human
gggauuuagagauacuguuguuacuucugcauguucauugcaaacagaagguuccuugagcacc

SEQ ID NO: 463829 - RNA, 64 nt, Human
ccuaccauaccaauuucaauaacaaucuugccugucauugcacucagaaucuuaagaucauguu

SEQ ID NO: 463830 - RNA, 64 nt, Human; identical to SEQ ID NO: 437086

SEQ ID NO: 463831 - RNA, 64 nt, Human; identical to SEQ ID NO: 437087

SEQ ID NO: 463832 - RNA, 64 nt, Human; identical to SEQ ID NO: 437088

SEQ ID NO: 463833 - RNA, 64 nt, Human; identical to SEQ ID NO: 437089

SEQ ID NO: 463834 - RNA, 64 nt, Human; identical to SEQ ID NO: 437090

SEQ ID NO: 463835 - RNA, 64 nt, Human; identical to SEQ ID NO: 437094

SEQ ID NO: 463836 - RNA, 64 nt, Human; identical to SEQ ID NO: 437095

SEQ ID NO: 463837 - RNA, 64 nt, Human; identical to SEQ ID NO: 437096

SEQ ID NO: 463838 - RNA, 64 nt, Human; identical to SEQ ID NO: 437097

SEQ ID NO: 463839 - RNA, 64 nt, Human; identical to SEQ ID NO: 437098

SEQ ID NO: 463840 - RNA, 64 nt, Human; identical to SEQ ID NO: 437099

SEQ ID NO: 463841 - RNA, 55 nt, Human; identical to SEQ ID NO: 437100

SEQ ID NO: 463842 - RNA, 64 nt, Human; identical to SEQ ID NO: 437101

SEQ ID NO: 463843 - RNA, 64 nt, Human; identical to SEQ ID NO: 437102

SEQ ID NO: 463844 - RNA, 64 nt, Human; identical to SEQ ID NO: 437103

SEQ ID NO: 463845 - RNA, 64 nt, Human; identical to SEQ ID NO: 437104

SEQ ID NO: 463846 - RNA, 64 nt, Human
ggauuuccucuugaaccagaaccagucuuucaacucauugcaucauuuacaagacaacauugua

SEQ ID NO: 463847 - RNA, 64 nt, Human
ggaacucagccacagauuugugugugguccaagaucauugcaguuucucacccuguuuauuucc

SEQ ID NO: 463848 - RNA, 64 nt, Human
ugccuuucaguggucugcccagguccaugauagaucauugcagaaagucauuuuuggauaggcu

SEQ ID NO: 463849 - RNA, 64 nt, Human; identical to SEQ ID NO: 437105

SEQ ID NO: 463850 - RNA, 64 nt, Human; identical to SEQ ID NO: 437106

SEQ ID NO: 463851 - RNA, 64 nt, Human; identical to SEQ ID NO: 437107

SEQ ID NO: 463852 - RNA, 64 nt, Human; identical to SEQ ID NO: 437108

SEQ ID NO: 463853 - RNA, 64 nt, Human; identical to SEQ ID NO: 437112

SEQ ID NO: 463854 - RNA, 64 nt, Human; identical to SEQ ID NO: 437113

SEQ ID NO: 463855 - RNA, 64 nt, Human; identical to SEQ ID NO: 437114

SEQ ID NO: 463856 - RNA, 64 nt, Human; identical to SEQ ID NO: 437115

SEQ ID NO: 463857 - RNA, 64 nt, Human; identical to SEQ ID NO: 437116

SEQ ID NO: 463858 - RNA, 64 nt, Human; identical to SEQ ID NO: 437117

SEQ ID NO: 463859 - RNA, 64 nt, Human; identical to SEQ ID NO: 437118

SEQ ID NO: 463860 - RNA, 64 nt, Human; identical to SEQ ID NO: 437119

SEQ ID NO: 463861 - RNA, 64 nt, Human; identical to SEQ ID NO: 437120

SEQ ID NO: 463862 - RNA, 64 nt, Human; identical to SEQ ID NO: 437121

SEQ ID NO: 463863 - RNA, 64 nt, Human; identical to SEQ ID NO: 437122

SEQ ID NO: 463864 - RNA, 64 nt, Human; identical to SEQ ID NO: 437123

SEQ ID NO: 463865 - RNA, 64 nt, Human
gaugcuugguagguuuuuuucauuguucaaauauucauugcacaguggauuguuuugauuaguu

SEQ ID NO: 463866 - RNA, 64 nt, Human
uuuccuagugaggaaagccucugaucuggcagacucauugcagcaggugguaaugauaaaauac

SEQ ID NO: 463867 - RNA, 64 nt, Human
gagaguggaaaguuaguggaauauucaugaaacuucauugcagggguaauagaagaaaaaguaa

SEQ ID NO: 463868 - RNA, 64 nt, Human; identical to SEQ ID NO: 437124

SEQ ID NO: 463869 - RNA, 64 nt, Human; identical to SEQ ID NO: 437125

SEQ ID NO: 463870 - RNA, 64 nt, Human; identical to SEQ ID NO: 437126

SEQ ID NO: 463871 - RNA, 64 nt, Human; identical to SEQ ID NO: 437130

SEQ ID NO: 463872 - RNA, 64 nt, Human; identical to SEQ ID NO: 437131

SEQ ID NO: 463873 - RNA, 64 nt, Human; identical to SEQ ID NO: 437132

SEQ ID NO: 463874 - RNA, 64 nt, Human; identical to SEQ ID NO: 437133

SEQ ID NO: 463875 - RNA, 64 nt, Human; identical to SEQ ID NO: 437134

SEQ ID NO: 463876 - RNA, 64 nt, Human; identical to SEQ ID NO: 437135

SEQ ID NO: 463877 - RNA, 64 nt, Human; identical to SEQ ID NO: 437136

SEQ ID NO: 463878 - RNA, 64 nt, Human; identical to SEQ ID NO: 437137

SEQ ID NO: 463879 - RNA, 64 nt, Human; identical to SEQ ID NO: 437138

SEQ ID NO: 463880 - RNA, 64 nt, Human; identical to SEQ ID NO: 437139

SEQ ID NO: 463881 - RNA, 64 nt, Human; identical to SEQ ID NO: 437140

SEQ ID NO: 463882 - RNA, 64 nt, Human; identical to SEQ ID NO: 437141

SEQ ID NO: 463883 - RNA, 64 nt, Human; identical to SEQ ID NO: 437142

SEQ ID NO: 463884 - RNA, 64 nt, Human
gcuugaacuugcccacaguugaacacaagugcugucauugcauuucuuccauugugaauacgaa

SEQ ID NO: 463885 - RNA, 64 nt, Human
gaugagacuguguuugguuacauuuuccaaaguuucauugcauucucccuuggggaggcuguga

SEQ ID NO: 463886 - RNA, 64 nt, Human
auuuaaguaaauucauaagagucagugcauuuuaucauugcacauccagauacuguuuuaggug

SEQ ID NO: 463887 - RNA, 64 nt, Human; identical to SEQ ID NO: 437143

SEQ ID NO: 463888 - RNA, 64 nt, Human; identical to SEQ ID NO: 437144

SEQ ID NO: 463889 - RNA, 64 nt, Human; identical to SEQ ID NO: 437148

SEQ ID NO: 463890 - RNA, 64 nt, Human; identical to SEQ ID NO: 437149

SEQ ID NO: 463891 - RNA, 64 nt, Human; identical to SEQ ID NO: 437150

SEQ ID NO: 463892 - RNA, 64 nt, Human; identical to SEQ ID NO: 437151

SEQ ID NO: 463893 - RNA, 64 nt, Human; identical to SEQ ID NO: 437152

SEQ ID NO: 463894 - RNA, 64 nt, Human; identical to SEQ ID NO: 437153

SEQ ID NO: 463895 - RNA, 64 nt, Human; identical to SEQ ID NO: 437154

SEQ ID NO: 463896 - RNA, 64 nt, Human; identical to SEQ ID NO: 437155

SEQ ID NO: 463897 - RNA, 64 nt, Human; identical to SEQ ID NO: 437156

SEQ ID NO: 463898 - RNA, 64 nt, Human; identical to SEQ ID NO: 437157

SEQ ID NO: 463899 - RNA, 64 nt, Human; identical to SEQ ID NO: 437158

SEQ ID NO: 463900 - RNA, 64 nt, Human; identical to SEQ ID NO: 437159

SEQ ID NO: 463901 - RNA, 64 nt, Human; identical to SEQ ID NO: 437160

SEQ ID NO: 463902 - RNA, 64 nt, Human; identical to SEQ ID NO: 437161

SEQ ID NO: 463903 - RNA, 64 nt, Human
ccaauauuacaacagcauuguuuucaguuauuuuucauugcagauacgaagagaaaauuuucua

SEQ ID NO: 463904 - RNA, 64 nt, Human
cagaagccuggagaggggagugaccugcucagagucauugcagagccgggauggggaccagguc

SEQ ID NO: 463905 - RNA, 64 nt, Human
ccaguuuauuccugugaacuucagauugaaccauucauugcagcaguagccuuaaaaaggcuuu

SEQ ID NO: 463906 - RNA, 64 nt, Human; identical to SEQ ID NO: 437162

SEQ ID NO: 463907 - RNA, 64 nt, Human; identical to SEQ ID NO: 437166

SEQ ID NO: 463908 - RNA, 64 nt, Human; identical to SEQ ID NO: 437167

SEQ ID NO: 463909 - RNA, 64 nt, Human; identical to SEQ ID NO: 437168

SEQ ID NO: 463910 - RNA, 64 nt, Human; identical to SEQ ID NO: 437169

SEQ ID NO: 463911 - RNA, 64 nt, Human; identical to SEQ ID NO: 437170

SEQ ID NO: 463912 - RNA, 64 nt, Human; identical to SEQ ID NO: 437171

SEQ ID NO: 463913 - RNA, 64 nt, Human; identical to SEQ ID NO: 437172

SEQ ID NO: 463914 - RNA, 64 nt, Human; identical to SEQ ID NO: 437173

SEQ ID NO: 463915 - RNA, 64 nt, Human; identical to SEQ ID NO: 437174

SEQ ID NO: 463916 - RNA, 64 nt, Human; identical to SEQ ID NO: 437175

SEQ ID NO: 463917 - RNA, 64 nt, Human; identical to SEQ ID NO: 437176

SEQ ID NO: 463918 - RNA, 64 nt, Human; identical to SEQ ID NO: 437177

SEQ ID NO: 463919 - RNA, 64 nt, Human; identical to SEQ ID NO: 437178

SEQ ID NO: 463920 - RNA, 64 nt, Human; identical to SEQ ID NO: 437179

SEQ ID NO: 463921 - RNA, 64 nt, Human; identical to SEQ ID NO: 437180

SEQ ID NO: 463922 - RNA, 64 nt, Human
auacugcaguuacggagcuguguaaaccaguuucucauugcauaagauacagauguaaauugca

SEQ ID NO: 463923 - RNA, 64 nt, Human
ggucccuccucacccagcaggccugguccaccucucauugcaagccccaagcacugagccagca

SEQ ID NO: 463924 - RNA, 64 nt, Human
ccccuguauauguggaucucgccuacaucccgaaucauugcaguggcaagacugcugaccuuga

SEQ ID NO: 463925 - RNA, 64 nt, Human; identical to SEQ ID NO: 437184

SEQ ID NO: 463926 - RNA, 64 nt, Human; identical to SEQ ID NO: 361620

SEQ ID NO: 463927 - RNA, 64 nt, Human; identical to SEQ ID NO: 361621

SEQ ID NO: 463928 - RNA, 64 nt, Human; identical to SEQ ID NO: 361622

SEQ ID NO: 463929 - RNA, 64 nt, Human; identical to SEQ ID NO: 361626

SEQ ID NO: 463930 - RNA, 64 nt, Human; identical to SEQ ID NO: 361627

SEQ ID NO: 463931 - RNA, 64 nt, Human; identical to SEQ ID NO: 361628

SEQ ID NO: 463932 - RNA, 64 nt, Human; identical to SEQ ID NO: 361629

SEQ ID NO: 463933 - RNA, 64 nt, Human; identical to SEQ ID NO: 361630

SEQ ID NO: 463934 - RNA, 64 nt, Human; identical to SEQ ID NO: 361631

SEQ ID NO: 463935 - RNA, 64 nt, Human; identical to SEQ ID NO: 361632

SEQ ID NO: 463936 - RNA, 64 nt, Human; identical to SEQ ID NO: 361633

SEQ ID NO: 463937 - RNA, 64 nt, Human; identical to SEQ ID NO: 361634

SEQ ID NO: 463938 - RNA, 64 nt, Human
cggagccaccuccaacucuaacaauaaaccaaguucauugcagauaguguagugcugcuuaggc

SEQ ID NO: 463939 - RNA, 64 nt, Human
accugugucuuugcugcuuuuguuuugggggcauucauugcagguguggcaguauacugcuauc

SEQ ID NO: 463940 - RNA, 64 nt, Human
cagguuuuucugucucacauacauaagcagcauuucauugcagauaugggacugauucuguggc

SEQ ID NO: 463941 - RNA, 64 nt, Human; identical to SEQ ID NO: 361635

SEQ ID NO: 463942 - RNA, 64 nt, Human; identical to SEQ ID NO: 361636

SEQ ID NO: 463943 - RNA, 64 nt, Human; identical to SEQ ID NO: 361637

SEQ ID NO: 463944 - RNA, 64 nt, Human; identical to SEQ ID NO: 361638

SEQ ID NO: 463945 - RNA, 64 nt, Human; identical to SEQ ID NO: 361639

SEQ ID NO: 463946 - RNA, 64 nt, Human; identical to SEQ ID NO: 361640

SEQ ID NO: 463947 - RNA, 64 nt, Human; identical to SEQ ID NO: 361641

SEQ ID NO: 463948 - RNA, 64 nt, Human; identical to SEQ ID NO: 361645

SEQ ID NO: 463949 - RNA, 64 nt, Human; identical to SEQ ID NO: 361646

SEQ ID NO: 463950 - RNA, 64 nt, Human; identical to SEQ ID NO: 361647

SEQ ID NO: 463951 - RNA, 64 nt, Human; identical to SEQ ID NO: 361648

SEQ ID NO: 463952 - RNA, 64 nt, Human; identical to SEQ ID NO: 361649

SEQ ID NO: 463953 - RNA, 64 nt, Human; identical to SEQ ID NO: 361650

SEQ ID NO: 463954 - RNA, 64 nt, Human
uuuuuugguuucauuuuuauuuuuuaauucugagucauugcauccucuaccagcuguuaaucca

SEQ ID NO: 463955 - RNA, 64 nt, Human
ccagauugagcucccuuccaaaggaucguuccucucauugcacagccauauuacaaaggguuuc

SEQ ID NO: 463956 - RNA, 64 nt, Human
ggcuaaugauugcccacccccaagguaaagagccucauugcacucuacccaauugcguuagucu

SEQ ID NO: 463957 - RNA, 64 nt, Human; identical to SEQ ID NO: 361651

SEQ ID NO: 463958 - RNA, 64 nt, Human; identical to SEQ ID NO: 361652

SEQ ID NO: 463959 - RNA, 64 nt, Human; identical to SEQ ID NO: 361653

SEQ ID NO: 463960 - RNA, 64 nt, Human; identical to SEQ ID NO: 361654

SEQ ID NO: 463961 - RNA, 64 nt, Human; identical to SEQ ID NO: 361655

SEQ ID NO: 463962 - RNA, 64 nt, Human; identical to SEQ ID NO: 361656

SEQ ID NO: 463963 - RNA, 64 nt, Human; identical to SEQ ID NO: 361657

SEQ ID NO: 463964 - RNA, 64 nt, Human; identical to SEQ ID NO: 361658

SEQ ID NO: 463965 - RNA, 64 nt, Human; identical to SEQ ID NO: 361659

SEQ ID NO: 463966 - RNA, 64 nt, Human; identical to SEQ ID NO: 361660

SEQ ID NO: 463967 - RNA, 64 nt, Human; identical to SEQ ID NO: 361664

SEQ ID NO: 463968 - RNA, 64 nt, Human; identical to SEQ ID NO: 361665

SEQ ID NO: 463969 - RNA, 64 nt, Human; identical to SEQ ID NO: 361666

SEQ ID NO: 463970 - RNA, 64 nt, Human
cucacggaagcuuuuuuugcacuuugaacagaagucauugcaguugggguguuuuguccaggga

SEQ ID NO: 463971 - RNA, 64 nt, Human
accaagggacaacuguacuuauuuaccuuuauugucauugcaagcuucuuauggaaacuuuaua

SEQ ID NO: 463972 - RNA, 64 nt, Human
cuuuugauuuuuuuucccuaaaacuaaacaucaaucauugcaggaguuguugguauuaggagca

SEQ ID NO: 463973 - RNA, 64 nt, Human; identical to SEQ ID NO: 361667

SEQ ID NO: 463974 - RNA, 64 nt, Human; identical to SEQ ID NO: 361668

SEQ ID NO: 463975 - RNA, 64 nt, Human; identical to SEQ ID NO: 361669

SEQ ID NO: 463976 - RNA, 64 nt, Human; identical to SEQ ID NO: 361670

SEQ ID NO: 463977 - RNA, 64 nt, Human; identical to SEQ ID NO: 361671

SEQ ID NO: 463978 - RNA, 64 nt, Human; identical to SEQ ID NO: 361672

SEQ ID NO: 463979 - RNA, 64 nt, Human; identical to SEQ ID NO: 361673

SEQ ID NO: 463980 - RNA, 64 nt, Human; identical to SEQ ID NO: 361674

SEQ ID NO: 463981 - RNA, 64 nt, Human; identical to SEQ ID NO: 361675

SEQ ID NO: 463982 - RNA, 64 nt, Human; identical to SEQ ID NO: 361676

SEQ ID NO: 463983 - RNA, 64 nt, Human; identical to SEQ ID NO: 361677

SEQ ID NO: 463984 - RNA, 64 nt, Human; identical to SEQ ID NO: 361678

SEQ ID NO: 463985 - RNA, 64 nt, Human; identical to SEQ ID NO: 361679

SEQ ID NO: 463986 - RNA, 64 nt, Human
cacccgaccccacucccaaugaugaggggcauuuucauugcaagucaaaggcaagacaggcuuc

SEQ ID NO: 463987 - RNA, 64 nt, Human
gagccaugcugaugaugugggucucguucuuucuucauugcaggcuaguauauaccgaggggga

SEQ ID NO: 463988 - RNA, 64 nt, Human
agcaaagagugacagucaccuccaugcccugcccucauugcaaagcccucacucaccuucuggu

SEQ ID NO: 463989 - RNA, 64 nt, Human; identical to SEQ ID NO: 361683

SEQ ID NO: 463990 - RNA, 64 nt, Human; identical to SEQ ID NO: 361684

SEQ ID NO: 463991 - RNA, 64 nt, Human; identical to SEQ ID NO: 361685

SEQ ID NO: 463992 - RNA, 64 nt, Human; identical to SEQ ID NO: 361686

SEQ ID NO: 463993 - RNA, 64 nt, Human; identical to SEQ ID NO: 361687

SEQ ID NO: 463994 - RNA, 64 nt, Human; identical to SEQ ID NO: 361688

SEQ ID NO: 463995 - RNA, 64 nt, Human; identical to SEQ ID NO: 361689

SEQ ID NO: 463996 - RNA, 64 nt, Human; identical to SEQ ID NO: 361690

SEQ ID NO: 463997 - RNA, 64 nt, Human; identical to SEQ ID NO: 361691

SEQ ID NO: 463998 - RNA, 64 nt, Human; identical to SEQ ID NO: 361692

SEQ ID NO: 463999 - RNA, 64 nt, Human; identical to SEQ ID NO: 361693

SEQ ID NO: 464000 - RNA, 64 nt, Human; identical to SEQ ID NO: 361694

SEQ ID NO: 464001 - RNA, 64 nt, Human; identical to SEQ ID NO: 361695

SEQ ID NO: 464002 - RNA, 64 nt, Human
ucaauucagaaaauggacugaagucugaauaaggucauugcauuuaaaaagcauauaacuguac

SEQ ID NO: 464003 - RNA, 64 nt, Human
auuuuuucauaaucuauauuuaaacaaaauuacaucauugcaucaucuuuucuaaauucaucuc

SEQ ID NO: 464004 - RNA, 64 nt, Human
ugcccaagguagagugcaguggcgugaucucugcucauugcaacugccgccucccggguucaag

SEQ ID NO: 464005 - RNA, 64 nt, Human; identical to SEQ ID NO: 361696

SEQ ID NO: 464006 - RNA, 64 nt, Human; identical to SEQ ID NO: 361697

SEQ ID NO: 464007 - RNA, 64 nt, Human; identical to SEQ ID NO: 361698

SEQ ID NO: 464008 - RNA, 64 nt, Human; identical to SEQ ID NO: 361702

SEQ ID NO: 464009 - RNA, 64 nt, Human; identical to SEQ ID NO: 361703

SEQ ID NO: 464010 - RNA, 64 nt, Human; identical to SEQ ID NO: 361704

SEQ ID NO: 464011 - RNA, 64 nt, Human; identical to SEQ ID NO: 361705

SEQ ID NO: 464012 - RNA, 64 nt, Human; identical to SEQ ID NO: 361706

SEQ ID NO: 464013 - RNA, 64 nt, Human; identical to SEQ ID NO: 361707

SEQ ID NO: 464014 - RNA, 64 nt, Human; identical to SEQ ID NO: 361708

SEQ ID NO: 464015 - RNA, 64 nt, Human; identical to SEQ ID NO: 361709

SEQ ID NO: 464016 - RNA, 64 nt, Human; identical to SEQ ID NO: 361710

SEQ ID NO: 464017 - RNA, 64 nt, Human; identical to SEQ ID NO: 361711

SEQ ID NO: 464018 - RNA, 64 nt, Human
ccaucucuacuaaaaauagaaaaauuagccaggcacguuccaggcaccugugaucccagcuacu

SEQ ID NO: 464019 - RNA, 64 nt, Human
ugccaguuauuuccagcaugcuaaaucccuacccacguuccagccucuaggugagucagugcgu

SEQ ID NO: 464020 - RNA, 64 nt, Human
ugcaagcucaccugcuggacgugagaauguuggaacguuccaguuggaagguuccuaugccuag

SEQ ID NO: 464021 - RNA, 64 nt, Human; identical to SEQ ID NO: 361712

SEQ ID NO: 464022 - RNA, 64 nt, Human; identical to SEQ ID NO: 361713

SEQ ID NO: 464023 - RNA, 64 nt, Human; identical to SEQ ID NO: 361714

SEQ ID NO: 464024 - RNA, 64 nt, Human; identical to SEQ ID NO: 361715

SEQ ID NO: 464025 - RNA, 64 nt, Human; identical to SEQ ID NO: 361716

SEQ ID NO: 464026 - RNA, 64 nt, Human; identical to SEQ ID NO: 361717

SEQ ID NO: 464027 - RNA, 64 nt, Human; identical to SEQ ID NO: 361721

SEQ ID NO: 464028 - RNA, 64 nt, Human; identical to SEQ ID NO: 361722

SEQ ID NO: 464029 - RNA, 64 nt, Human; identical to SEQ ID NO: 361723

SEQ ID NO: 464030 - RNA, 64 nt, Human; identical to SEQ ID NO: 361724

SEQ ID NO: 464031 - RNA, 64 nt, Human; identical to SEQ ID NO: 361725

SEQ ID NO: 464032 - RNA, 64 nt, Human; identical to SEQ ID NO: 361726

SEQ ID NO: 464033 - RNA, 64 nt, Human; identical to SEQ ID NO: 361727

SEQ ID NO: 464034 - RNA, 64 nt, Human
cugcuggccaagucguggguccuccucugucccuucauugcauggcacagcucacuuuggcccu

SEQ ID NO: 464035 - RNA, 64 nt, Human
ccaucucuuccugacagccccuuuacagguuacaucauugcaguccaccgaaaaaugguuaguu

SEQ ID NO: 464036 - RNA, 64 nt, Human
auccucccccagcccuugaauagguugguccucaucauugcaaggaaugagaaagggaggauuu

SEQ ID NO: 464037 - RNA, 64 nt, Human; identical to SEQ ID NO: 361728

SEQ ID NO: 464038 - RNA, 64 nt, Human; identical to SEQ ID NO: 361729

SEQ ID NO: 464039 - RNA, 64 nt, Human; identical to SEQ ID NO: 361730

SEQ ID NO: 464040 - RNA, 64 nt, Human; identical to SEQ ID NO: 361731

SEQ ID NO: 464041 - RNA, 64 nt, Human; identical to SEQ ID NO: 361732

SEQ ID NO: 464042 - RNA, 64 nt, Human; identical to SEQ ID NO: 361733

SEQ ID NO: 464043 - RNA, 64 nt, Human
ugacagguuaacuagaaaaugugacaaucacauuuccucuuagcucaaauaauucuguuuuucc

SEQ ID NO: 464044 - RNA, 64 nt, Human
ucccguuguuuuaccuuccuauuucccaaacaguuccucuuauuuugucuuuugcaccaguuuc

SEQ ID NO: 464045 - RNA, 64 nt, Human
cuucaaggaagugcuugggggacccccagccucauccucuuaguugggucucuuguucccuuug

SEQ ID NO: 464046 - RNA, 64 nt, Human
aaagcccaagccugucagccacagaaacaggcucuccucuuacuuugcugucuaaacuggagau

SEQ ID NO: 464047 - RNA, 64 nt, Human
aaagggcuuuaacguuuuuuccagugaaaacaaauccucuuauauuaaaucuaagcaacugcuu

SEQ ID NO: 464048 - RNA, 64 nt, Human
ucucauuaagcaucccuaacccccagucacaccuuccucuuacauacuguuccccaauggaggc

SEQ ID NO: 464049 - RNA, 64 nt, Human
aaagauguuuauuuuccuuaagaguaaaaaacagucauugcauucagaaaaaaaaaaaaaaaaa

SEQ ID NO: 464050 - RNA, 64 nt, Human
cuugagccagggaggucauggcuacagugaccccucauugcaccacuuuacuuagccuggguga

SEQ ID NO: 464051 - RNA, 64 nt, Human
agagugaaccauguguauuguacaggcgcgguugucauugcagaaaccgcuggguggagaagaa

SEQ ID NO: 464052 - RNA, 64 nt, Human
acccucucgcccucagagagguccaccugguuugucauugcaaugcuuuucauuuuuuuuuuuu

SEQ ID NO: 464053 - RNA, 64 nt, Human
auaaaaaucaucuuucaucuuuaauuuuacuccuuccucuuauuuuuuuaaaagauuaucgaac

SEQ ID NO: 464054 - RNA, 64 nt, Human
gagagagcccaugggucuuauuuaugggauaugguccucuuaggcucuguuguacaaccuuagg

SEQ ID NO: 464055 - RNA, 64 nt, Human
gccuuuggaucucucuuccaagccuuuccugacuuccucuuagaucauagauuggaccugguuu

SEQ ID NO: 464056 - RNA, 64 nt, Human
cuuguagaaauuuguagcaugguagaucagaaaauccucuuagguuuuaggcaggaaggaauau

SEQ ID NO: 464057 - RNA, 64 nt, Human
auuuucaaguuuauucuggaaugugaugucuugguccucuuaaaagcagaucagccaugacuga

SEQ ID NO: 464058 - RNA, 64 nt, Human
uuccugcacccaguaguuucauauccuguagacauccucuuaggacauucucaaauuucaaaau

SEQ ID NO: 464059 - RNA, 64 nt, Human
cuuuccuuauccccuucccuucccuucacccccauccucuuacuccuuucaugucccauuucag

SEQ ID NO: 464060 - RNA, 64 nt, Human
gccacagaguuccccgcugacccuugguuagggguccucuuaguccacaagguccggaugucac

SEQ ID NO: 464061 - RNA, 64 nt, Human
aaggucagagauguugaagauuccagcaaauuucuccucuuauuucuaccaagccuuugugaac

SEQ ID NO: 464062 - RNA, 64 nt, Human
aaauaagagauagcagaggaaaaagaaaaacauuuccucuuauaacuucugaaguaauuuguaa

SEQ ID NO: 464063 - RNA, 64 nt, Human
uauucauaaauguauaccccuuacuguaauuuguuccucuuagaagucagaucaucugauuuau

SEQ ID NO: 464064 - RNA, 64 nt, Human
guggaaucuaggaggccacuuagucgucuuuuuuuccucuuagaagaaaagccugaaacugagu

SEQ ID NO: 464065 - RNA, 64 nt, Human
cggggccaugggcauuuguuuagagccaaauucauccucuuaccagauccuuuuccagaaauac

SEQ ID NO: 464066 - RNA, 64 nt, Human
ccaucccucggacccaccaaacugcacacacagcuccucuuaccguagccuccguuuaugggcc

SEQ ID NO: 464067 - RNA, 61 nt, Human; identical to SEQ ID NO: 456216

SEQ ID NO: 464068 - RNA, 61 nt, Human; identical to SEQ ID NO: 456217

SEQ ID NO: 464069 - RNA, 61 nt, Human; identical to SEQ ID NO: 456218

SEQ ID NO: 464070 - RNA, 64 nt, Human
ccuccuguggauucucccaucagccaucugguucuccucuuaaggccaguugaagauggucccu

SEQ ID NO: 464071 - RNA, 64 nt, Human
cuaagaucugcuuuuucuauuucucccaaccaaauccucuuaaagacccuuugcuauguagucu

SEQ ID NO: 464072 - RNA, 64 nt, Human
gaguugugauaggugguauuuuuguuuauuuucuuccucuuacuccuuaggauaaagguaaguu

SEQ ID NO: 464073 - RNA, 64 nt, Human
augaaaauaauggauucuuguaccuaacauuuuauccucuuagaucuaagagccgaagcuauag

SEQ ID NO: 464074 - RNA, 64 nt, Human
uguuuggauggaaacaaaagcacuagacugaguuuccucuuauagguauuaaaaauagcacuuu

SEQ ID NO: 464075 - RNA, 64 nt, Human
acucacugugggcagaugcaccaauacaugguaauccucuuacucauuuuaagacguaggaaac

SEQ ID NO: 464076 - RNA, 64 nt, Human
uaagcaauuggcugugaugcucaaauccauugcauccucuuauugaauuugccaauuuguaauu

SEQ ID NO: 464077 - RNA, 64 nt, Human
guaggggucucucagagguucuuuccacaggccauccucuuauuccguucuggggcccaggaag

SEQ ID NO: 464078 - RNA, 64 nt, Human
agcauacauagucacugagcaccugcgguccauuuccucuuaaaaguuuuguuuugauuuguuu

SEQ ID NO: 464079 - RNA, 64 nt, Human
accccaggcccugccagagcagggggaccuaggcuccucuuacccccgucuaggugcuuucccu

SEQ ID NO: 464080 - RNA, 64 nt, Human
agaacuggaccaucuccaaguauauaacgaugaguccucuuaaugcuaggaguagaaaaugguc

SEQ ID NO: 464081 - RNA, 64 nt, Human
cccauauacaugauuucagaagaugacauaagauuccucuuaaagaggaaaugucaggaaucaa

SEQ ID NO: 464082 - RNA, 64 nt, Human
gucucaguuggauuuuuuuuuccuguuuucuauuuccucuuaaguacaccuucaacuauauucc

SEQ ID NO: 464083 - RNA, 64 nt, Human
ucagguaaaccucagcucaggacugcuauuuagcuccucuuaagaagauuaaaagagaaaaaaa

SEQ ID NO: 464084 - RNA, 64 nt, Human
ugggagguggugguugcagugagcugagauugugucauugcacuccagccugggcaacaagagc

SEQ ID NO: 464085 - RNA, 64 nt, Human
acuaaaaaucucaaaucacacugaacccuaaaugucauugcaagaaauaaaaauuuaagaauua

SEQ ID NO: 464086 - RNA, 64 nt, Human
aaaaaaggcauaaaucuuuauugcagauuuauuuucauugcaaacuuuagacauugugauucac

SEQ ID NO: 464087 - RNA, 64 nt, Human
uuggugcaucacaauggacacagaaugcugcugcuccucuuaaaaauuaaaugugucauauuau

SEQ ID NO: 464088 - RNA, 64 nt, Human
uuauuuucucucugcccaccuugacacaguaacuuccucuuauagucaagaugaugauuaagug

SEQ ID NO: 464089 - RNA, 64 nt, Human
cucuaacaaacgcagaaggcuuuggcucgucauuuccucuuaaaaaggaggagcugggcuucag

SEQ ID NO: 464090 - RNA, 64 nt, Human
aaugcauuacuaaaugacauuuguaguuccuagcuccucuuaggaaaacaguucuuguggccuu

SEQ ID NO: 464091 - RNA, 64 nt, Human
uuguaauucuuccucuucguucuucaccuggguuuccucuuaucuacccaccaccuaggacaga

SEQ ID NO: 464092 - RNA, 64 nt, Human
aaguaucugugcuuuugaauuacuuauuuaccuguccucuuaccguugguaaauaauaauuggc

SEQ ID NO: 464093 - RNA, 64 nt, Human
acacacccuccagcacagacuguucccuccaagguccucuuaggucccgggaggaacgugguuc

SEQ ID NO: 464094 - RNA, 64 nt, Human
ccucauguguuggguucucuccccuccuuccuguuccucuuauauaccaguuuauccccauucu

SEQ ID NO: 464095 - RNA, 64 nt, Human
aguaaguagcauuuucggcuacuuaacuuuacauuccucuuauuuuucaguuuccagucaagau

SEQ ID NO: 464096 - RNA, 64 nt, Human
cucacauaugaaaagugaaaguugugaguuguuuuccucuuauuuaaacauuggccuauuauaa

SEQ ID NO: 464097 - RNA, 64 nt, Human
gaaaggcacuacugacuuuguucuuauuggauacuccucuuauuauuuuuccauuaaaaauaau

SEQ ID NO: 464098 - RNA, 64 nt, Human
ugugguccucgccgccccuggccacaucgcccucuccucuuacaccuggugaccuucgaauguu

SEQ ID NO: 464099 - RNA, 64 nt, Human
ucuggcccucagagagggguguuucuguggguacuccucuuaccccagcaaauaaaaggaauug

SEQ ID NO: 464100 - RNA, 64 nt, Human
aaaaaccaaguaugcuugaguuuugcgaauguucuccucuuaaagaauagcuucaaauuuugag

SEQ ID NO: 464101 - RNA, 64 nt, Human
uaagucugaacccaucuuuugaaauguauuuucuucauugcagguccaccuaaucauccuguga

SEQ ID NO: 464102 - RNA, 64 nt, Human
cacccaggcuggagugcaguggcacgauuauggcucauugcagccucgacuucucggggccaag

SEQ ID NO: 464103 - RNA, 64 nt, Human
ggcugugucagaugcuaaugugcugaaucaacagucauugcagaucacgaaguguccaucauaa

SEQ ID NO: 464104 - RNA, 64 nt, Human
ccccuuucccugagaggaagagcacauguuggucuccucuuagugugaacgagauugccaggcc

SEQ ID NO: 464105 - RNA, 64 nt, Human
ccucuuaagggacucuaauauaugcuaacgcugguccucuuagcucugugcucucaccagacaa

SEQ ID NO: 464106 - RNA, 64 nt, Human
uuucuuuuucauuuugugaaaaacuccauguuaguccucuuagaugacugcuuauuuaugugua

SEQ ID NO: 464107 - RNA, 64 nt, Human
agcaguauggacagcuggaccccugaacuuccucuccucuuaccugggcagaguguugucucuc

SEQ ID NO: 464108 - RNA, 64 nt, Human
cgaaaugaucagucuguugccugaaacagcccaguccucuuaacugaaacagcauucuacuucu

SEQ ID NO: 464109 - RNA, 64 nt, Human
ggaaacuuaaaacauacuguuugauuuuuuuauuuccucuuacaauccauguuuucagguagaa

SEQ ID NO: 464110 - RNA, 64 nt, Human
uuggcaaugcauuugauggccaccagcuucugcguccucuuaucuucugccaggaucaccuccg

SEQ ID NO: 464111 - RNA, 64 nt, Human
gaaaaaguaggagaggcagauucccucagugucuuccucuuaaaccucaaucaucgagacauua

SEQ ID NO: 464112 - RNA, 64 nt, Human
aucauuauuuuuguuugguuugguuuugcuuuuuuccucuuacuuuaauugaaauacucugaau

SEQ ID NO: 464113 - RNA, 64 nt, Human
agguggagaagcucccugaaguaagcaaagacuuuccucuuagucgagccaaguuaagaauguu

SEQ ID NO: 464114 - RNA, 64 nt, Human
ccaauaccagguuuaaggguauuuuaaacacagcuccucuuaaauccuccaaucucaguaccca

SEQ ID NO: 464115 - RNA, 64 nt, Human
acagcaugguccugcccuguugucccgucugcucuccucuuacccacccccaugcuguaaauac

SEQ ID NO: 464116 - RNA, 64 nt, Human
acaacaaugguuucaacuguaugcccaugccugauccucuuauuugaacaucuaucaacauugu

SEQ ID NO: 464117 - RNA, 64 nt, Human
cauuuugcacuguuuuuauauacuuguauucauauccucuuaucaccucagacucagacacaag

SEQ ID NO: 464118 - RNA, 64 nt, Human
gcagacauagauuuuucuguucauuuauuuuucuucauugcaguggauugauuugauaaauaga

SEQ ID NO: 464119 - RNA, 64 nt, Human
gggucucuacugcccaugccgggcggccuuccagucauugcacagcaaagccaugugcagggcg

SEQ ID NO: 464120 - RNA, 64 nt, Human
uauuugacuguuacuguccuuggcgaaucgauaaucauugcauagugacugaaaagccuaagug

SEQ ID NO: 464121 - RNA, 64 nt, Human
aguuguaaaacaaguuuuagcuuuuuuuuuuaauuccucuuaacagauuuuucuaauauccaag

SEQ ID NO: 464122 - RNA, 64 nt, Human
gacuacuacucaauggccccugcacuacucuacuuccucuuaccuaugucccuucucaugccuu

SEQ ID NO: 464123 - RNA, 64 nt, Human
uaccccacucuccccguccccuuuuauucccuuuuccucuuaaagagcugcucugagcuguggg

SEQ ID NO: 464124 - RNA, 64 nt, Human
cugcaauuugcucuuaaacucuagcagggaacucuccucuuaccacaucagcauguaaggugaa

SEQ ID NO: 464125 - RNA, 64 nt, Human
uaauguacagaugguuuuauaaucugauuuguuuuccucuuaacguuagaccacaaauagugcu

SEQ ID NO: 464126 - RNA, 64 nt, Human
gaaacaggagagacugaauuaauaauucucucuuuccucuuaagcacuuuuaaaauaauaaagu

SEQ ID NO: 464127 - RNA, 64 nt, Human
cacagcuccaagcacgugucccgugccuccccacuccucuuaccaccccucucucugacacuuu

SEQ ID NO: 464128 - RNA, 64 nt, Human
ccuguuguaaggaagccaggucuucucucuucauuccucuuaggagagugccaaacucagggac

SEQ ID NO: 464129 - RNA, 64 nt, Human
ugucugaguuaaaugcacuuaugugacucauguguccucuuagaaucccaaauagggggaaaaa

SEQ ID NO: 464130 - RNA, 64 nt, Human
caguucaaaacuacugucuucugucaaaguuuucuccucuuaaauguuauuuugcuuuuacguc

SEQ ID NO: 464131 - RNA, 64 nt, Human
caagcuccuccugugaguagggccuguacucacuuccucuuagaucauaauuccaucuucaaga

SEQ ID NO: 464132 - RNA, 64 nt, Human
aaaggucagaacaguuaaacacugccuuuccuccuccucuuauuuuaugauaaaagcaaaugug

SEQ ID NO: 464133 - RNA, 64 nt, Human
cucuguuuuaugcuuuaucugaugaagccaaauauccucuuauuguugaucaaaggaggcaaaa

SEQ ID NO: 464134 - RNA, 64 nt, Human
agugcaaucagaguguacaaauugucguuuuuauuccucuuauugggauaucauuuuaaaaacu

SEQ ID NO: 464135 - RNA, 64 nt, Human
ugggaggcggagguugcagugagccaagaucacgucauugcacuccagccuggucaacaagagu

SEQ ID NO: 464136 - RNA, 64 nt, Human
cacacaggacacauauauuaaacagauuguuucaucauugcaucuauuuuccauauagucauca

SEQ ID NO: 464137 - RNA, 64 nt, Human
ugucuaaaauaggcaaguaguaccuuuuguucuuucauugcaauuugauacaguauaggcuaca

SEQ ID NO: 464138 - RNA, 64 nt, Human
auuugacuuuaaaaggaaguuucauucauauuuauccucuuauguaaaauugcgguauaaaguc

SEQ ID NO: 464139 - RNA, 64 nt, Human
uuuccuguguuuccacuucugcuuccaaagauuuuccucuuaguuguuugaaauaauacuuugc

SEQ ID NO: 464140 - RNA, 64 nt, Human
guuauuaguguccuuuuuuauuucuaaugccuuguccucuuaaaaguuauuuuauuuguuauua

SEQ ID NO: 464141 - RNA, 64 nt, Human
acauuuauauauugucuguaaaaaauguaugcuauccucuuauuccuuuaaagugaguacuguu

SEQ ID NO: 464142 - RNA, 64 nt, Human
uagacaccaagauauuucagccagccuuuaucauuccucuuacuuuauccuuuuuccuuaagua

SEQ ID NO: 464143 - RNA, 64 nt, Human
auuuguaccuugaauuuagcuaucaaccuaauuuuccucuuaguugggcuguaugcuguguggu

SEQ ID NO: 464144 - RNA, 64 nt, Human
ugaugagcaauuguguugauuuucuuugcuuuuuuccucuuauggagcucucagugugugaaag

SEQ ID NO: 464145 - RNA, 64 nt, Human
ggaaauacacuacaaauguuaaaguacguggcuguccucuuaagacacuaguagagcaaagacu

SEQ ID NO: 464146 - RNA, 64 nt, Human
uuuuucuucagcuucuaugcauuaagaguaaaauuccucuuacuguaauaaaaacaauugaaga

SEQ ID NO: 464147 - RNA, 64 nt, Human
ccauuuucaccuauuaccaguguucccuggggacuccucuuaauguuuccaaaugggaaggaca

SEQ ID NO: 464148 - RNA, 64 nt, Human
acaggaggaggagauggccauaggagaggaggguuccucuuaggucagauggagguucucagag

SEQ ID NO: 464149 - RNA, 64 nt, Human
ggucaauuuuuuucuucauuuucagcacaagaaguccucuuauauccuacuaaauacauuccua

SEQ ID NO: 464150 - RNA, 64 nt, Human
accuuucagcugugaacauggacucuucccccacuccucuuauuugcucacacgggguauuuua

SEQ ID NO: 464151 - RNA, 64 nt, Human
ucacaaccucugaucucagaccgugcaugccuuguccucuuaagacaacuccuguggcaccguu

SEQ ID NO: 464152 - RNA, 64 nt, Human
gccuugccuguuuccgaagcccccacacugccuuucgcccuacugagacugguccccucaaaag

SEQ ID NO: 464153 - RNA, 64 nt, Human
ccccuucucagccccaaaaccugaaggaggaauuucgcccuacucuggccccuuuguugugggc

SEQ ID NO: 464154 - RNA, 64 nt, Human
gccauauucugugaucacggauguuggcucccccucgcccuaugcaagcaaacacacucucacc

SEQ ID NO: 464155 - RNA, 64 nt, Human
cagccagucaguaguagugggaggaagcccuuccuccucuuaugcaagcagcucgcagccagcc

SEQ ID NO: 464156 - RNA, 64 nt, Human
ggaucucauccuaggagaaaacccaaaacuggauuccucuuaagaccucugucaacccuccugc

SEQ ID NO: 464157 - RNA, 64 nt, Human
ccccugucccucuucuuugaucguaauucaauuuuccucuuauucauucaguucccguguauuu

SEQ ID NO: 464158 - RNA, 64 nt, Human
uccccaagaagggcccuagaaauugauguggcuuuccucuuaaauauuaauuauuaguccugaa

SEQ ID NO: 464159 - RNA, 64 nt, Human
ggccuugguaaagcagaggagggcacacccacaguccucuuauucucuguuuuacugcuuguuu

SEQ ID NO: 464160 - RNA, 64 nt, Human
ucugaggacuuguuuucuuuuucuuuauuuuuaauccucuuaguuuuaaauauauugccuagag

SEQ ID NO: 464161 - RNA, 64 nt, Human
uuaaugaacccuauuugaauugcagggcugugauuccucuuaccuuuaacgugaacucacaggc

SEQ ID NO: 464162 - RNA, 64 nt, Human
gaguuuuaauagauucuguccaaaagggguuuguuccucuuauuuccucuauguaggaaguugu

SEQ ID NO: 464163 - RNA, 64 nt, Human
ccuuaaaugcaauacagccucugauuauugagcuuccucuuaaaaagauuuuuuuauuuuaugu

SEQ ID NO: 464164 - RNA, 64 nt, Human
uccagguagugcugcuucugaaguuaucucuuaauccucuuaaguaauuuggugucuguccaga

SEQ ID NO: 464165 - RNA, 64 nt, Human
auguaauguucucaguuuuguuccauauuugcauuccucuuaugcuuuaccuguauuuuaucau

SEQ ID NO: 464166 - RNA, 64 nt, Human
cuaccaccucaacaggacuuuguccagacucuccuccucuuaccuuugugccuugacugugguu

SEQ ID NO: 464167 - RNA, 64 nt, Human
uucuggugcccauuccauuuguccaguuaauacuuccucuuaaaaaucuccaagaagcuggguc

SEQ ID NO: 464168 - RNA, 64 nt, Human
aagauguuuuaccaaagccucuaguguaccuuccuccucuuacucauccaucccagucaacaug

SEQ ID NO: 464169 - RNA, 64 nt, Human
cccagggcaacuugaggucugacuuuuggcucccucgcccuaagaggcucuuccucucuuuugc

SEQ ID NO: 464170 - RNA, 64 nt, Human
uuuuagacgucauagcuccuuaguucugcuccugucgcccuaacuuggcaugggcaaguugaag

SEQ ID NO: 464171 - RNA, 64 nt, Human
ggagccaucuugcugccgacacccugcuuuccccucgcccuagggcucccuugccgcccuccug

SEQ ID NO: 464172 - RNA, 64 nt, Human
agugcagaauugaauauggaggcaugcauaaccuuccucuuagaaaauggcagguguuguaauu

SEQ ID NO: 464173 - RNA, 64 nt, Human
gaccaggugucuccccacgcuuaccuuaaggggcuccucuuaucuccccuucacaugauuccuu

SEQ ID NO: 464174 - RNA, 64 nt, Human
uguguguauauauauauauauauuuuuacuuuuauccucuuaccgaagguuacacuguugugcc

SEQ ID NO: 464175 - RNA, 64 nt, Human
acauuccccuuacgaggguguaacaucuauuuguuccucuuaccaaagcaaaaggauuggcuuc

SEQ ID NO: 464176 - RNA, 64 nt, Human
cugugaugcaugugaguguuccgacuucaucuguuccucuuaacuacgguguuucccuuaccau

SEQ ID NO: 464177 - RNA, 64 nt, Human
aacauugggacaauuggucguucaaaaacauucauccucuuacugcaaguuuaucuggguacuu

SEQ ID NO: 464178 - RNA, 64 nt, Human
gacuggaaccaaaauuaaauuguacuucauaaaauccucuuauagaguuacucuugcccuagau

SEQ ID NO: 464179 - RNA, 64 nt, Human
ucucuuuugaauccaugcuuggguguaacaggucuccucuuaaaaaauaaaaacugacuccuua

SEQ ID NO: 464180 - RNA, 64 nt, Human
ggaugcucagauuucucacauccugcccaggaucuccucuuaggguagaagucucugggacauc

SEQ ID NO: 464181 - RNA, 64 nt, Human
guaguggcuaccucucagccccaauagucccugcuccucuuagaaucuucaccaaguggcaggc

SEQ ID NO: 464182 - RNA, 64 nt, Human
gaagcaaggaguggacaagccucuugguuaaggcuccucuuaccucccaagcucauggacaagu

SEQ ID NO: 464183 - RNA, 64 nt, Human
uucuauucucagacacugcucuaguaccauuccuuccucuuagccccaggagcaaauuaaaagg

SEQ ID NO: 464184 - RNA, 64 nt, Human
gggagggggcguuucgcuuuccuucuucuuggcuuccucuuauucuuccacaaaccauucucaa

SEQ ID NO: 464185 - RNA, 64 nt, Human
ucuuuauugucuguaaaucuaacauuauuacuuuuccucuuagaagaauauuguauuguuagau

SEQ ID NO: 464186 - RNA, 64 nt, Human
ccucuccuguguguucuguuaucucuugaugagaucauugcaccaugucagacuuuuguauaug

SEQ ID NO: 464187 - RNA, 64 nt, Human
aaaacaaugaucacagcaauacuuguaugcauguucauugcaacuuaaaagcguaaaaacccca

SEQ ID NO: 464188 - RNA, 64 nt, Human
ccacugacaccagcuggcgucauagguagcuagaucauugcauuuguuuugaaauguuaauaug

SEQ ID NO: 464189 - RNA, 64 nt, Human
caguugcaguuuuuguagaauggcuuuuucuuuuuccucuuaagaguucuauucuucagguaga

SEQ ID NO: 464190 - RNA, 64 nt, Human
gggcaccucucccagcguuucuccgguuugccaauccucuuaaguauuccugucuccaaaggac

SEQ ID NO: 464191 - RNA, 64 nt, Human
uuuuccaucuguuagcauuucagacauuuuauguuccucuuacucaauugauaccaacagaaau

SEQ ID NO: 464192 - RNA, 64 nt, Human
ugaaaauuccauuugagacaaagucaggguuuucuccucuuauauuuuaucacaagcaacucuu

SEQ ID NO: 464193 - RNA, 64 nt, Human
guggacacaguuuaaaaucuuaaacuugucuuuuuccucuuaauguaucagcaugcuacccuuu

SEQ ID NO: 464194 - RNA, 64 nt, Human
auucuacugaauugcaauuuauuaaauauucuuauccucuuaaauaaaacugcucaacaguuaa

SEQ ID NO: 464195 - RNA, 64 nt, Human
cuucuguggucccucugugucugcucucauccauuccucuuacuggggccuggggcucuagccc

SEQ ID NO: 464196 - RNA, 64 nt, Human
gauuuucucaaagaacauagaaaagucaauaaaauccucuuaauuuccacauaucacguuugga

SEQ ID NO: 464197 - RNA, 64 nt, Human
aucuccguauguuauacaggcuggccucaagugauccucuuaccuuggccucccaaacaccggg

SEQ ID NO: 464198 - RNA, 64 nt, Human
auguguccuagcauuuacaagaaaaugaaaagcguccucuuaauuggcacccgaauguugcugu

SEQ ID NO: 464199 - RNA, 64 nt, Human
auuuuuuccccuugguuugagucuuuuuuuucccuccucuuauuuguuauuguugcccuaagau

SEQ ID NO: 464200 - RNA, 64 nt, Human
guggcugugggauuuuuuuuuuuugguccuucuuuccucuuaacguaaauccaccaccaaaauu

SEQ ID NO: 464201 - RNA, 64 nt, Human
uagcucuucagaucuguacaugcaguauuuaauuuccucuuaaacauguuaugaguucuacaaa

SEQ ID NO: 464202 - RNA, 64 nt, Human
aaguaaugaaauugucucugguuucagaaacuuuuccucuuaccuuccuuucucuuuccuaacu

SEQ ID NO: 464203 - RNA, 64 nt, Human
ccuaaaccucuagccugauuguucuuucccuaauucauugcacaagcuccuuugcuuuuagugu

SEQ ID NO: 464204 - RNA, 64 nt, Human
ucaggagucaccagaugaugcagaguugagaucaucauugcaaaguucucuguuccugaggaac

SEQ ID NO: 464205 - RNA, 64 nt, Human
cuggcgcucuggagugcaguggugugauuagggaucauugcagacucugccucucaggcucagg

SEQ ID NO: 464206 - RNA, 64 nt, Human
aagaguuuaguuuuccucuccagagggaucaggguccucuuagggagugacgggcuuuucauau

SEQ ID NO: 464207 - RNA, 64 nt, Human
gauaaauuguaucauauuuaaguuccacugcuguuccucuuaccuugauuaaaugccuaugcau

SEQ ID NO: 464208 - RNA, 64 nt, Human
cauuucuuuaucaaggaugguauuuagauuuuuuuccucuuaaccuuuuuucaaaaacuauuuu

SEQ ID NO: 464209 - RNA, 64 nt, Human
gaugacagagggagcacuugagccuugccuucccuccucuuaaaucaggguguguuccgagauu

SEQ ID NO: 464210 - RNA, 64 nt, Human
cacauauuauacauauuuugugcuaaucuuguuuuccucuuaguauuccuuuguauaaauuagu

SEQ ID NO: 464211 - RNA, 64 nt, Human
gaguuaaguugcauuucuuugggcuaugaaggaguccucuuaaguuugauagaaaugaauuucu

SEQ ID NO: 464212 - RNA, 64 nt, Human
auucuggauguuucgggagaguuggggaaacuccuccucuuaggaaaggcuaauacuaggguau

SEQ ID NO: 464213 - RNA, 64 nt, Human
uccuuggagugaaagacucuuuuuaccagagguuuccucuuagguguuaggaguuaauacauau

SEQ ID NO: 464214 - RNA, 64 nt, Human
ccccagagagggucaggccgaaccccauuucuccuccucuuaggucauuuucagcaaacuugaa

SEQ ID NO: 464215 - RNA, 64 nt, Human
cuuuauucaauuugaggaacuuggugaaagccccuccucuuaugacagccagguuccugcuggc

SEQ ID NO: 464216 - RNA, 64 nt, Human
cacucaccuuccccagcuacaaaaaucuguauuauccucuuaaaguaaaacuggaguuacaaau

SEQ ID NO: 464217 - RNA, 64 nt, Human
uaaauuuucucuaaaauuuuccccaaagauaauauccucuuagggaacauaagaaaaauguaua

SEQ ID NO: 464218 - RNA, 64 nt, Human
uuguuuaaacaauguuucuucugcaacuggcuacuccucuuauauuaaugcauacacuuuugua

SEQ ID NO: 464219 - RNA, 64 nt, Human
ucuucaguucagggcaaaauguucaugaaguuauuccucuuaaacaugguuaggaagcugauga

SEQ ID NO: 464220 - RNA, 64 nt, Human
guaccuguaccugcacggucacccgcuccgugugucgcccuauauugagggcucaagcuuuccc

SEQ ID NO: 464221 - RNA, 64 nt, Human
ucugcaaugaccuucaacaaccggccaccagaugucgcccuacucaccugagcgcucagcuuca

SEQ ID NO: 464222 - RNA, 64 nt, Human
acaggaggggccggaucuuucuccgauaaaaccgucgcccuacagacccagcuguccccacgcc

SEQ ID NO: 464223 - RNA, 50 nt, Human
aacuggaaacgaaaaguuaauccucuuagaauaccuauaaaaagauguaa

SEQ ID NO: 464224 - RNA, 64 nt, Human
aaugcagaagcaaacaagcuugauuuuucuagcauccucuuaaugugcagcaaaagcaggcgac

SEQ ID NO: 464225 - RNA, 64 nt, Human
ugggcucccacaggagucauggugauggaugauauccucuuagccuggugggcguggcaugugc

SEQ ID NO: 464226 - RNA, 64 nt, Human
ccuucucaggaggugucuccuacccucuuauuguuccucuuacgcucugcucaaugaaaccuuc

SEQ ID NO: 464227 - RNA, 64 nt, Human
ugaaugucuccagagacauccugagaggcaagauuccucuuaauugauaaccaggacaaccagg

SEQ ID NO: 464228 - RNA, 64 nt, Human
aucacugaauucugcuaguccaguagcaaugucuuccucuuaugaccagaguucugugcauaac

SEQ ID NO: 464229 - RNA, 64 nt, Human
aguagcccccuccuuauuucuuuuuucuaucuguuccucuuagcccccaaacucccagguucuc

SEQ ID NO: 464230 - RNA, 64 nt, Human
ccacccugugccccggcaggccuggggucugcaguccucuuaccugcugugcccaccugcucuc

SEQ ID NO: 464231 - RNA, 64 nt, Human
accugaaguguugguaucugagaauaucugucacuccucuuaucugagaagugaccuuuuauuu

SEQ ID NO: 464232 - RNA, 64 nt, Human
caugagacagcuugagccucaggauucuuguucuuccucuuaucuuccuuuugugguuuuuaau

SEQ ID NO: 464233 - RNA, 64 nt, Human
guagcaguuuaaucaguggauaacugagccuguuuccucuuagcuuucuagacuucuuaacaga

SEQ ID NO: 464234 - RNA, 64 nt, Human
ugcaagcuaaaugaaguaggcucagcgauagugguccucuuacagagaaacggggagcaggacg

SEQ ID NO: 464235 - RNA, 64 nt, Human
accuucugggugaaguuucuaaggucaacaugaauccucuuaccucucucacugcucguguucu

SEQ ID NO: 464236 - RNA, 64 nt, Human
cagggaaguuuugcgauccuuuaggaagacacuguccucuuauuacagauuguguauuuccgua

SEQ ID NO: 464237 - RNA, 64 nt, Human
ccuuccuggagccuccagccaguccuguccucccucgcccuaccaagagggcaccugaggagac

SEQ ID NO: 464238 - RNA, 64 nt, Human
agccccggcccccggcuucugucuggacauugcaucgcccuaguuuucuuucuuuaaaaaaaaa

SEQ ID NO: 464239 - RNA, 64 nt, Human
ggugaucccagccgccccugucccgucgcuguccucgcccuacauugaguacacgccggccagc

SEQ ID NO: 464240 - RNA, 64 nt, Human
uucauccaaguugugcaauguaucagcauaaaguuccucuuauuuucaguaucuuuaggauccg

SEQ ID NO: 464241 - RNA, 64 nt, Human
uuucaaugcucgaaacuaagcaaguauaaauuuuuccucuuauuugcaugaaaggacaagacac

SEQ ID NO: 464242 - RNA, 64 nt, Human
auaaucaaaaugcaacacaugcacuuugugugucuccucuuaauugaagggagggcugagggau

SEQ ID NO: 464243 - RNA, 64 nt, Human
gcgagccuuucagaagccagggucugguccuggcuccucuuacugagauacagggcagcacugg

SEQ ID NO: 464244 - RNA, 64 nt, Human
ucauuuguacaguucagugaucuaguuugguguguccucuuaucaguuaguggaaauagaacgg

SEQ ID NO: 464245 - RNA, 64 nt, Human
auugaaaaaugauguuccagaaagauuacuuuuuuccucuuauuuuuacugccauugucgaccu

SEQ ID NO: 464246 - RNA, 64 nt, Human
ccaacugaaaaagacuagagggauuaguacaaacuccucuuauacagaaggcaaaucugagguu

SEQ ID NO: 464247 - RNA, 64 nt, Human
cuaacuggacuucccaagauaaaugguaccagcguccucuuaaaagaugccuuaauccauuccu

SEQ ID NO: 464248 - RNA, 64 nt, Human
cuucagaucaucucccacacccuggaucucacucuccucuuaguaacagagacacuccugaggu

SEQ ID NO: 464249 - RNA, 64 nt, Human
caaggcagcgggaucucguaucuuuaaaaagcaguccucuuauuccuaagguaauccuauuaaa

SEQ ID NO: 464250 - RNA, 64 nt, Human
cccagccaccaggacagcaggaaccagggccuacuccucuuauggucccuucuagauccagagg

SEQ ID NO: 464251 - RNA, 64 nt, Human
uagaaugucuguugcuauucacugcuccccucgcuccucuuaacagcuuggggaggugaccagu

SEQ ID NO: 464252 - RNA, 64 nt, Human
uuguuaugucaguauuguuauuggcuuuucguauuccucuuaacgugaaccgucuguucauugu

SEQ ID NO: 464253 - RNA, 64 nt, Human
acugacaacaauggaaaagaaaugauaagcaaaauccucuuauuuucuauaaggaaaauacaca

SEQ ID NO: 464254 - RNA, 64 nt, Human
aaacaucaucgcucccaaaggaaagagcagucuaucauugcaggagccauaugacaagccuuug

SEQ ID NO: 464255 - RNA, 64 nt, Human
gguggucguuuguggucaguuaccucaauucuguucauugcagugcccguaaaccauguagaaa

SEQ ID NO: 464256 - RNA, 64 nt, Human
ucugugacauccugcuucuucuuccaaaugcaguucauugcagacaccaccauauugcuaucua

SEQ ID NO: 464257 - RNA, 64 nt, Human
accagccaaggcauugauaaccaaguagccauuuuccucuuaagguuuccucuacaaccccaag

SEQ ID NO: 464258 - RNA, 64 nt, Human
ucaaauauguuuuuaaaaaauaucauuguccuccuccucuuaagauuuuuuuaaguuauuuugc

SEQ ID NO: 464259 - RNA, 64 nt, Human
uuuaauuucuuuuuuauauauacucucagagaauuccucuuaauuuuuaaagaugcuggugaua

SEQ ID NO: 464260 - RNA, 64 nt, Human
auguuuuccaggcccccagccucccacucgacuuuccucuuaggaaccuggccugggccagggg

SEQ ID NO: 464261 - RNA, 64 nt, Human
auucacagguuucucagugggaagcaggcccagguccucuuacauuugacauaagcaauuuacc

SEQ ID NO: 464262 - RNA, 64 nt, Human
cuugcugcuccugucugaagaaaucagacugauuuccucuuaagacuccuagggauguggugaa

SEQ ID NO: 464263 - RNA, 64 nt, Human
aucccugccauucagggcuguuccagagauucgauccucuuaaggcauuaucagugagcaaaug

SEQ ID NO: 464264 - RNA, 64 nt, Human
uuuugauggcuggguccuugggccuggccagucuuccucuuagccucuggaucuagaagggacc

SEQ ID NO: 464265 - RNA, 64 nt, Human
ccuccuuccugauuuggauauucccucaaaucccuccucuuacuccaugcugaaggagaaguac

SEQ ID NO: 464266 - RNA, 64 nt, Human
guuguccccccgccccccgucacugcauaauuucuccucuuacaagcugcuuuuggcuuucauu

SEQ ID NO: 464267 - RNA, 64 nt, Human
gggaaggggguauggugagugcggcaaucccucauccucuuagaagcaccugugaaugggaauu

SEQ ID NO: 464268 - RNA, 64 nt, Human
aaacucaagugucagaugaagggagguggaguuauccucuuauaguacaguggccuguuaucuu

SEQ ID NO: 464269 - RNA, 64 nt, Human
aaguuguucuagucuccaggaggcugccagccccuccucuuauuuaauucugaguuuugggggc

SEQ ID NO: 464270 - RNA, 64 nt, Human
cuuagaucuuccagcagccccagggguaggaagcuccucuuaguacuaagagacuucaagcuuc

SEQ ID NO: 464271 - RNA, 64 nt, Human
auuuuauaguaauggagguuagcccuuaaucucuucauugcauuucauuucuguaaaucagauu

SEQ ID NO: 464272 - RNA, 64 nt, Human
auuuauuguaauucugaauuuucugcccuuuuauucauugcauauuaaaguauuagaguauaaa

SEQ ID NO: 464273 - RNA, 64 nt, Human
guaaugauacugauuaugaaauguccccucaaacucauugcagcagauaacuuuuuugagucau

SEQ ID NO: 464274 - RNA, 64 nt, Human
accaguugaguuuuuuaaagcauugaggauuuuuuccucuuaccaacuccucuucagguuuuua

SEQ ID NO: 464275 - RNA, 64 nt, Human
ccgaaacuauuauacuuuuauaagaugagcugaauccucuuacuuuaaaaacuggucuuuuuau

SEQ ID NO: 464276 - RNA, 64 nt, Human
aacuauugcugcaacagguuuuucuuaaugguuauccucuuaaauacaccugcugguacuuggu

SEQ ID NO: 464277 - RNA, 64 nt, Human
aaaaaacuuucagccuagccaguucuagccccuguccucuuagauauaucccccuuucugggug

SEQ ID NO: 464278 - RNA, 64 nt, Human
gggcccacuuuuuuguacauguaccaccucccuuuccucuuacuguacauaaaccucagacucu

SEQ ID NO: 464279 - RNA, 64 nt, Human
ucagaguuggaagggucauacaggacccagaagcuccucuuacuggacagagcaguagaauccc

SEQ ID NO: 464280 - RNA, 64 nt, Human
ugauuuuugaccuugcccuuggcagugccccacauccucuuauuccuacaucccuuucucccuu

SEQ ID NO: 464281 - RNA, 64 nt, Human
uguuccagccuucauccuuccuggcuguugcuuuuccucuuaagggccucagaacucuugcucu

SEQ ID NO: 464282 - RNA, 64 nt, Human
acagaguaguaaccugugaaacaaacauagaauauccucuuagacauuguuccucauaaugcac

SEQ ID NO: 464283 - RNA, 64 nt, Human
uuuauacacuaaaagcaugcaucuaaucuaauaguccucuuauuaugcuuuuaguuguaugagu

SEQ ID NO: 464284 - RNA, 64 nt, Human
uacaauugagggcagucuagcccuuuggaugaaauccucuuaguuacugguguauggccugugg

SEQ ID NO: 464285 - RNA, 64 nt, Human
gucauaguccuuuucucucaacucaugguuuguuuccucuuagagcuggccugguacucagaaa

SEQ ID NO: 464286 - RNA, 64 nt, Human
uuucuagaccgauucugugugaacaucaguuuuguccucuuauugcaagacucccucauacaca

SEQ ID NO: 464287 - RNA, 64 nt, Human
ugaauaaguccaucucaaaaguuugggauuuuccuccucuuaacuuucuuaauauuuggacaug

SEQ ID NO: 464288 - RNA, 64 nt, Human
ugcccaggcuggagcauaguggcaagaucauagcucauugcaagcucaagugauccuccugacu

SEQ ID NO: 464289 - RNA, 64 nt, Human
acuuuauaagaaaguguauuuaacuaaaaagucaucauugcaaauaauacuuucuucuucuuua

SEQ ID NO: 464290 - RNA, 64 nt, Human
cacccaggcuggagugcaguggcauaaucauaccucauugcagccucagacuccuggguucaag

SEQ ID NO: 464291 - RNA, 64 nt, Human
cuuguagagcugugggugggacugcacauucuuuuccucuuaguaaaagauaggcccacuuuau

SEQ ID NO: 464292 - RNA, 64 nt, Human
aggaaaaugaaacaauuuuaacaacaguuuuuuuuccucuuaugucgaagaucuaguuuuagac

SEQ ID NO: 464293 - RNA, 64 nt, Human
accucccaacucuaaagccaagcacuuuauauuuuccucuuagauauucacuaaggacuuaaaa

SEQ ID NO: 464294 - RNA, 64 nt, Human
aaauuuuaaauggugugaaaaucgaugacaacaguccucuuacagauagcuugcuguauucugu

SEQ ID NO: 464295 - RNA, 64 nt, Human
uauaguccccccucuguggacgugcuuuaguagcuccucuuaccuagagggcuuuuacagagaa

SEQ ID NO: 464296 - RNA, 64 nt, Human
uuugagugccucauuccacugaauauuuaaauuuuccucuuaaaugguaaacugacuuauugca

SEQ ID NO: 464297 - RNA, 50 nt, Human
aaccagacuguccuggcuaguccucuuagucacacagcgaguaggccucu

SEQ ID NO: 464298 - RNA, 64 nt, Human
gucaccauagagcaacaaagguauagggcugccuuccucuuauuuauuuggggacauuauuuug

SEQ ID NO: 464299 - RNA, 64 nt, Human
agacugaaauguggggauccaggauggccuuccuuccucuuacccuuccucccucagccugcaa

SEQ ID NO: 464300 - RNA, 64 nt, Human
cugcuaagauaacauuucugaggauucuagaugauccucuuaaagaauaaaagcacauccgugg

SEQ ID NO: 464301 - RNA, 64 nt, Human
uuugguccaagccucuggugcagauucaagcuccuccucuuagaggaagcagcuccuuccuccc

SEQ ID NO: 464302 - RNA, 64 nt, Human
uucuacugccauuaauuuuuuagauggauuuguuuccucuuacacaacuagaauuaauguauuu

SEQ ID NO: 464303 - RNA, 64 nt, Human
agauugauugauagucaugaauaauaacgucugcuccucuuacauagaaaaacgauauuaaaag

SEQ ID NO: 464304 - RNA, 64 nt, Human
ggggucucccuggcucucccaggauaccaugcuguccucuuagugaccucgucgcccugcaacc

SEQ ID NO: 464305 - RNA, 64 nt, Human
cacguaggcuggagugcaauggcacgaucgugucucauugcaacuuccgccuccuggauucagg

SEQ ID NO: 464306 - RNA, 64 nt, Human
acguuccuggccuguguucaagggaaaugaucagucauugcauuguuauuccaaagagcagcca

SEQ ID NO: 464307 - RNA, 64 nt, Human
cucacccgcuauuagaguauggaggaagggguuuucauugcauugcauuucugaaacauuccua

SEQ ID NO: 464308 - RNA, 64 nt, Human
ucuccccuuggcagugucccagggcccuggaugguccucuuaccaacaucuggucuuccaggca

SEQ ID NO: 464309 - RNA, 64 nt, Human
ucaguuugguaauuccugcuccacaccccuauuuuccucuuaauaauacguuugggugaagaca

SEQ ID NO: 464310 - RNA, 64 nt, Human
aaaaugcagcugcauaauuaacacauuaucaaaguccucuuacaauuuauuuuccgcagcaugu

SEQ ID NO: 464311 - RNA, 64 nt, Human
ggaggccgcagccuuccaucaccggaucaguuuuuccucuuaggaaagcugcaggaaccucgug

SEQ ID NO: 464312 - RNA, 64 nt, Human
aaaauauucuucauccagagauagaggugguucuuccucuuacggacugcaaccuucaaauuca

SEQ ID NO: 464313 - RNA, 64 nt, Human; identical to SEQ ID NO: 464312

SEQ ID NO: 464314 - RNA, 64 nt, Human
aguaugaggaccggguucguguacucucuguaucuccucuuaagcuucguccaggguucuuuau

SEQ ID NO: 464315 - RNA, 64 nt, Human
caauacuaugagagcuucuuuguucaaauguauuuccucuuauuauaaauaaaacaaauauuac

SEQ ID NO: 464316 - RNA, 64 nt, Human
cguucucaguuccacugguuuaaaccacagcacauccucuuagaaucaaacacauuaaagacca

SEQ ID NO: 464317 - RNA, 64 nt, Human
ucugugagggggaaaagagguugaaaagaggguuuccucuuauuucuucccugugcguaaacau

SEQ ID NO: 464318 - RNA, 64 nt, Human
ugaggauagggaaaggauuaaggauuuuuccaccuccucuuaguaacuccugaauuaccaacau

SEQ ID NO: 464319 - RNA, 64 nt, Human
aagauguuggcacgugucauuuuagugguuuaaauccucuuauuuaugguuuuaacucuaagaa

SEQ ID NO: 464320 - RNA, 64 nt, Human
aauuaaaaaaaaaauaauauaauaauaauucuuguccucuuauuuuacacucauaaugagaaau

SEQ ID NO: 464321 - RNA, 64 nt, Human
agggccacauguagacagcuaggccagugcuuuuuccucuuaggguuucuuugcagaaagaaac

SEQ ID NO: 464322 - RNA, 64 nt, Human
cgggacgcagggguugcagugagcggagaucgcaucauugcacucuagccugggccacagggcg

SEQ ID NO: 464323 - RNA, 64 nt, Human
guucaugccauaaaaaguaggauuuaauuaaaagucauugcagcccaauaaaauggagccuggc

SEQ ID NO: 464324 - RNA, 64 nt, Human
cacauucucuuuuagaaagcuguggcaugcagucucauugcaggacuccuggaauauugucugg

SEQ ID NO: 464325 - RNA, 64 nt, Human
ggacucucuguuggccugcaaacacauuuacuucuccucuuaugagacuauuuaucuuuaauaa

SEQ ID NO: 464326 - RNA, 64 nt, Human
cugccucucccccauccuaucagggacauuuggcuccucuuagcuggcucugcucauccagagg

SEQ ID NO: 464327 - RNA, 64 nt, Human
aaauuacacaacccagcaacaacaaaagaacuaguccucuuagaauuucuugcgcuuugauuuu

SEQ ID NO: 464328 - RNA, 64 nt, Human
cuacuccgcagcucuaguccuuuauaaguugcuuuccucuuacuuucaguuuuggugauaaucg

SEQ ID NO: 464329 - RNA, 64 nt, Human
guugagcaccuccugagggcgccguuuccuucauuccucuuagauuccauaguugccgccauga

SEQ ID NO: 464330 - RNA, 64 nt, Human
ggcugccaacaugauccccgucucugcccugggcuccucuuagcucagcugagcauggagacag

SEQ ID NO: 464331 - RNA, 64 nt, Human
augcagaggcccuuccucucugugccgugcuugcuccucuuaccugcccgggugguuugggggu

SEQ ID NO: 464332 - RNA, 64 nt, Human
cugauauucugagcagagaaaaggcacuaacgguuccucuuagcuauuuaauuaucagaagcaa

SEQ ID NO: 464333 - RNA, 64 nt, Human
aucaucuuacuuaacucgcagccuguggcugugguccucuuauagauacuuucaccguuugcag

SEQ ID NO: 464334 - RNA, 64 nt, Human
ucggugccaaccucccucccccaagcucagauccuccucuuaugcccuugauugugccagccca

SEQ ID NO: 464335 - RNA, 64 nt, Human
agagcucugggaagugaagucaugagugcccgauuccucuuagagaaaauccauagcuacugua

SEQ ID NO: 464336 - RNA, 64 nt, Human
acacacaacauauucgaauugagucaagcccauuuccucuuagccacauaggacucuggacugg

SEQ ID NO: 464337 - RNA, 64 nt, Human
agcagguuugucuuuaaauguuaaagaugcacuauccucuuagagaaacaaucaguucaacuau

SEQ ID NO: 464338 - RNA, 64 nt, Human
cuuaaagaguacagaggccauugaagccuuuugcuccucuuaccgugaaaaugaaauguuagcc

SEQ ID NO: 464339 - RNA, 64 nt, Human
ugaacugucaugauacgcuuaagguggaaaguguucauugcacaauauauuuuuacugcuuucu

SEQ ID NO: 464340 - RNA, 64 nt, Human
uccuuauuacguccuuuccuacagaugaaggcucucauugcaaacaugcggacuguucaagaga

SEQ ID NO: 464341 - RNA, 64 nt, Human
uugcaauauguuuuugguuuuuuucauuuuuuaaucauugcaguuaagagaaauggaaauuagu

SEQ ID NO: 464342 - RNA, 64 nt, Human
gcaagcccagggcacagaugcugcgauggccucuuccucuuaaguguggggccucaccccugcu

SEQ ID NO: 464343 - RNA, 64 nt, Human
agagggucuuccuaagaagagugcugucauuauuuccucuuaucaacaacuugugacaugagau

SEQ ID NO: 464344 - RNA, 64 nt, Human
gaugguggggggucuuggagccaagcucuuagguuccucuuauuuggggcaguaccaguccaua

SEQ ID NO: 464345 - RNA, 64 nt, Human
uaggaugacauaaaaagcaaguguuuuccccauuuccucuuaugaaacaccgucugagcccaag

SEQ ID NO: 464346 - RNA, 64 nt, Human
gucaccuuuagugcugcagaacagcagaacuucuuccucuuaucuaccuguacuuuugcaucca

SEQ ID NO: 464347 - RNA, 64 nt, Human
aaaggucuaugaucuugagggcagacagcagaauuccucuuauaaagaaaacuguuugggaaaa

SEQ ID NO: 464348 - RNA, 64 nt, Human
guugggccaccuguacugaacgcugaaucguuuuuccucuuaaguugaaaaugguuuuaaugca

SEQ ID NO: 464349 - RNA, 64 nt, Human
cacauuuuuaugcaacuaaucuccagaacauuuuuccucuuaccaagaaguaaaaugcuguacc

SEQ ID NO: 464350 - RNA, 64 nt, Human
aacaugcauuuagguaaaaugucaggaacaacuuuccucuuauuaauacuauaaauccaucuca

SEQ ID NO: 464351 - RNA, 63 nt, Human
uucuagaauuuucugacugauguaauaaaguguuuccucuuauaaucccugggugcucuccug

SEQ ID NO: 464352 - RNA, 64 nt, Human
gaauaaauuaccugugaaugaacaaugaagucguuccucuuaagacugaaacaagcaggccaga

SEQ ID NO: 464353 - RNA, 64 nt, Human
uuguuugguuggaaagcagaauuaugcauaaauuuccucuuacaguucgaugcccauuaguuuu

SEQ ID NO: 464354 - RNA, 64 nt, Human
cuaacuuagugaaugacccuaagcaaguuccuucuccucuuagggccuugugccaagccuauga

SEQ ID NO: 464355 - RNA, 64 nt, Human
uaaagugauaacaagaguuauuuuuaaacagaacuccucuuaccccccaaaacagauaaaccuc

SEQ ID NO: 464356 - RNA, 64 nt, Human
uaucgauauaauugucucuaaguguugacugucuucauugcaauaugaaauucauuaaaauguc

SEQ ID NO: 464357 - RNA, 64 nt, Human
gggaaaaacaauguucuuguuugaacagaggguaucauugcagucaguauucacguguauauug

SEQ ID NO: 464358 - RNA, 64 nt, Human
aaaaaugcauuuauauagucuuacuuuguuucuuucauugcacucuauaaugauuuuuaaauua

SEQ ID NO: 464359 - RNA, 64 nt, Human
agaccagaaaauuauuuuuucaaccuagagaaucuccucuuacagggggaugcauauaacagau

SEQ ID NO: 464360 - RNA, 64 nt, Human
uaugugggcugguguccuucuugaaguugucaauuccucuuauucuuaaauaucuaaagggaaa

SEQ ID NO: 464361 - RNA, 64 nt, Human
cugcagcuguuucccugaaagccagagaagaccuuccucuuacaucacauuaaggucucacccu

SEQ ID NO: 464362 - RNA, 64 nt, Human
caggaguccuggacucucagauccuccucuccccuccucuuagccacaaaagaggggggagacu

SEQ ID NO: 464363 - RNA, 64 nt, Human
gaaaaagcccucuucaauccccauaaugcuucuuuccucuuaaugucucaaaauaaaaccagaa

SEQ ID NO: 464364 - RNA, 64 nt, Human
cugacaccuuuucagguuggagugcauucauucauccucuuauaugugccccuuccccaugcuc

SEQ ID NO: 464365 - RNA, 64 nt, Human
agaugcgcuuggaaaggccuagucagaagccauuuccucuuaucauuucccucuccuaugcacc

SEQ ID NO: 464366 - RNA, 64 nt, Human
ucugucaaauaccuggccccauuuguguugaguuuccucuuagugugcccaggagucugaucug

SEQ ID NO: 464367 - RNA, 64 nt, Human
gcuccucauggccuuggcccuuucugaagcugcuuccucuuauaaaauagcuuuugccgaaaca

SEQ ID NO: 464368 - RNA, 64 nt, Human
uuaaaucauaggggaaaagcaguccuguucuaaauccucuuauucuuuugguuugucacaaaga

SEQ ID NO: 464369 - RNA, 64 nt, Human
uauuuaucuagacgcaaaugcuuauccaugaauguccucuuagaccauuuggggaugaagccau

SEQ ID NO: 464370 - RNA, 64 nt, Human
gaauuauuacaugagacuggcagauagcuauuaauccucuuacagauuugagaaaguugauucu

SEQ ID NO: 464371 - RNA, 64 nt, Human
ugcaccuucuccuucauuguuuucuuuaaaucuguccucuuaaaaagcuucuuaagagcucagu

SEQ ID NO: 464372 - RNA, 64 nt, Human
guaacaaauagacagcaagaaagguuuugcaccauccucuuacggccuagagaguugacaaguu

SEQ ID NO: 464373 - RNA, 64 nt, Human
cugacaagagacagcuguuaauuucccacagcaaucauugcagacuaacuuuauuaggagaagc

SEQ ID NO: 464374 - RNA, 64 nt, Human
guaaaacacuggcccaagauuugguaaagagauuucauugcaauguaauaacuacaguuuuuua

SEQ ID NO: 464375 - RNA, 64 nt, Human
gucuaaguuuccccuuuuaagguuucaacaaauuucauugcacuuuccuuucaauaaaguuguu

SEQ ID NO: 464376 - RNA, 64 nt, Human
cuaaauauuacaguuauugugcauaacagauuguuccucuuauauuuguguguauacaggcaau

SEQ ID NO: 464377 - RNA, 64 nt, Human
ugagaugaaauaugugauuuucucuaauguaacuuccucuuaggauguuucaccaaggaaauau

SEQ ID NO: 464378 - RNA, 64 nt, Human
ugagcaagucaaccccaaucuggaacaaugucccuccucuuagaaugucccaacuaaagaccag

SEQ ID NO: 464379 - RNA, 64 nt, Human
ucucccuuuaaaaaaaaaaaaaaacuucuacuuuuccucuuaaaggcacuuuacucucucccca

SEQ ID NO: 464380 - RNA, 64 nt, Human
cucacuguagccacaaccucucaggcucaagugauccucuuaccuuagccuccugcguggcugg

SEQ ID NO: 464381 - RNA, 64 nt, Human
aguugcuuuugucugcagcagcaggacacaucuuuccucuuacucagcccuuuauggcccaugg

SEQ ID NO: 464382 - RNA, 64 nt, Human
uuccuggcgcccugguugcccaccuugccgugcuuccucuuacgugcuagcuuuguaccuaucg

SEQ ID NO: 464383 - RNA, 64 nt, Human
aagaauacucagauuuccauaagcucuucucaccuccucuuagcccaacucaaacuccaucaga

SEQ ID NO: 464384 - RNA, 64 nt, Human
aauaauacauucggauggauuuggaaguuggaauuccucuuaacaaccaagggguuuauuuuca

SEQ ID NO: 464385 - RNA, 64 nt, Human
gaacugcuugugcacuggauguggccccacccuuuccucuuaauucccaaucccauuccugggc

SEQ ID NO: 464386 - RNA, 64 nt, Human
guuuucuucuguugucuguuauuuccuucuuguauccucuuaacuggccauuaucuuguaugug

SEQ ID NO: 464387 - RNA, 64 nt, Human
aauaaggaacuauuuacuggcaugauauuugcauuccucuuaucaggcauuuucauuuggaaau

SEQ ID NO: 464388 - RNA, 64 nt, Human
ugauggccugaauauaugucugcacuuuuaaugcuccucuuaaccaguuguaacaucuuaccau

SEQ ID NO: 464389 - RNA, 64 nt, Human
gaaggcuuucuaccuaaauuuauuucaucugugguccucuuauucucuuccauugcuuuugaca

SEQ ID NO: 464390 - RNA, 64 nt, Human
aauuacgguuugaagugauuucugugggagggaaucauugcaauguauauucuaaauaaaguca

SEQ ID NO: 464391 - RNA, 64 nt, Human
uucugugucugucaccacaucuugucuuuuccccucauugcauuuauugcaguuuauauauaug

SEQ ID NO: 464392 - RNA, 64 nt, Human
gugaacuucgcucuuugccuuaaaccucuuuauuucauugcaguaauaguuuuacguuguacau

SEQ ID NO: 464393 - RNA, 64 nt, Human
uuuuuuccuaccauuauggcuuugugcuuguucuuccucuuaccuguaauagccucaccuuccc

SEQ ID NO: 464394 - RNA, 64 nt, Human
cucugucaaaaucugagguauuugaaaauaauuauccucuuaaccuucucuucccagugaacuu

SEQ ID NO: 464395 - RNA, 64 nt, Human
guuuucuccuguugucuguuauuuccuucuuuuauccucuuaacuggccauuaucuuguaugug

SEQ ID NO: 464396 - RNA, 64 nt, Human
guccugcuggaaagauagcaguguucuccugacuucgcccuacugcaugcagccaaauaaaagg

SEQ ID NO: 464397 - RNA, 64 nt, Human
uuacguguuggaaaaaccaaguggcuuugggguuucgcccuaucccacucccucucuuuccugc

SEQ ID NO: 464398 - RNA, 64 nt, Human
uuugugauaguucagucccagggaaagagaaaacucgcccuaggcccuaggugggaagaugguu

SEQ ID NO: 464399 - RNA, 64 nt, Human
gucaggaguauauaaaaaagaaagaaaacaaaacucgcccuacaggaagaaaaggauucuccuc

SEQ ID NO: 464400 - RNA, 64 nt, Human
uaguuuccaaaacauuuacauauugaucuacuccucgcccuagaccaaaccuaauuccauucuu

SEQ ID NO: 464401 - RNA, 64 nt, Human
gcugaguucacgaauuaggggcaggagcuggaagucgcccuaggaacaccagauuuccugguuc

SEQ ID NO: 464402 - RNA, 64 nt, Human
ggaaacuagcuggagcuuggaugaaacucaguagucgcccuaagcaugguuaaaccgcgcccug

SEQ ID NO: 464403 - RNA, 64 nt, Human
gccccugaguccugagcgaaaacaggagaguuagucgcccuacagaaaacccagcuagacuauu

SEQ ID NO: 464404 - RNA, 64 nt, Human
gagccucugcuccccaggggaguugugucuguaaucgcccuacuauucaguggcgagaaauaaa

SEQ ID NO: 464405 - RNA, 64 nt, Human
ccuccuuccccaagagaggaaauaaaagccaccuucgcccuagggccaagaguugggccccguc

SEQ ID NO: 464406 - RNA, 64 nt, Human
uaaccuucccguuggucggaaacuuuuccaucugucgcccuagaaaaagagaaagcuuaccauc

SEQ ID NO: 464407 - RNA, 64 nt, Human; identical to SEQ ID NO: 58652

SEQ ID NO: 464408 - RNA, 64 nt, Human; identical to SEQ ID NO: 58653

SEQ ID NO: 464409 - RNA, 64 nt, Human; identical to SEQ ID NO: 58654

SEQ ID NO: 464410 - RNA, 64 nt, Human; identical to SEQ ID NO: 58655

SEQ ID NO: 464411 - RNA, 64 nt, Human; identical to SEQ ID NO: 58656

SEQ ID NO: 464412 - RNA, 64 nt, Human; identical to SEQ ID NO: 58657

SEQ ID NO: 464413 - RNA, 64 nt, Human; identical to SEQ ID NO: 58658

SEQ ID NO: 464414 - RNA, 64 nt, Human; identical to SEQ ID NO: 58659

SEQ ID NO: 464415 - RNA, 64 nt, Human; identical to SEQ ID NO: 58660

SEQ ID NO: 464416 - RNA, 64 nt, Human; identical to SEQ ID NO: 58661

SEQ ID NO: 464417 - RNA, 64 nt, Human; identical to SEQ ID NO: 58662

SEQ ID NO: 464418 - RNA, 64 nt, Human; identical to SEQ ID NO: 58663

SEQ ID NO: 464419 - RNA, 64 nt, Human; identical to SEQ ID NO: 58664

SEQ ID NO: 464420 - RNA, 64 nt, Human; identical to SEQ ID NO: 58665

SEQ ID NO: 464421 - RNA, 64 nt, Human; identical to SEQ ID NO: 58666

SEQ ID NO: 464422 - RNA, 64 nt, Human; identical to SEQ ID NO: 58667

SEQ ID NO: 464423 - RNA, 64 nt, Human
guaauauuguucauucauauugaccugcaucucaucauugcauguuuuauguuuucaaacaugc

SEQ ID NO: 464424 - RNA, 64 nt, Human
uuuuaguccuaggccaguagauggcagcagcuuuucauugcagacaaaaccucuugaaacccuu

SEQ ID NO: 464425 - RNA, 64 nt, Human
uuguguuggugguauguuccacaaauggaagagaucauugcauuuugcuuugguaaugaguuua

SEQ ID NO: 464426 - RNA, 64 nt, Human
aacagcacgcugucuuccuauuggaccuucuaucucauugcauugccuuucaugaguuacuugu

SEQ ID NO: 464427 - RNA, 64 nt, Human; identical to SEQ ID NO: 58668

SEQ ID NO: 464428 - RNA, 64 nt, Human; identical to SEQ ID NO: 58669

SEQ ID NO: 464429 - RNA, 64 nt, Human; identical to SEQ ID NO: 58670

SEQ ID NO: 464430 - RNA, 64 nt, Human; identical to SEQ ID NO: 58671

SEQ ID NO: 464431 - RNA, 64 nt, Human; identical to SEQ ID NO: 58672

SEQ ID NO: 464432 - RNA, 64 nt, Human; identical to SEQ ID NO: 58673

SEQ ID NO: 464433 - RNA, 64 nt, Human; identical to SEQ ID NO: 58674

SEQ ID NO: 464434 - RNA, 64 nt, Human; identical to SEQ ID NO: 58675

SEQ ID NO: 464435 - RNA, 64 nt, Human; identical to SEQ ID NO: 58676

SEQ ID NO: 464436 - RNA, 64 nt, Human; identical to SEQ ID NO: 58677

SEQ ID NO: 464437 - RNA, 64 nt, Human; identical to SEQ ID NO: 58678

SEQ ID NO: 464438 - RNA, 64 nt, Human; identical to SEQ ID NO: 58679

SEQ ID NO: 464439 - RNA, 64 nt, Human; identical to SEQ ID NO: 58680

SEQ ID NO: 464440 - RNA, 64 nt, Human; identical to SEQ ID NO: 58681

SEQ ID NO: 464441 - RNA, 64 nt, Human; identical to SEQ ID NO: 58682

SEQ ID NO: 464442 - RNA, 64 nt, Human; identical to SEQ ID NO: 58683

SEQ ID NO: 464443 - RNA, 64 nt, Human
gaaugaaauaccgugauuaacucauagcuacauaucauugcauaaaugggauuuaucuuuuuuc

SEQ ID NO: 464444 - RNA, 64 nt, Human
aaacuagaaggccagaggauaauggaauaaaagaucauugcaauuacuuauccuuccuaaaaau

SEQ ID NO: 464445 - RNA, 64 nt, Human
aggauaauuuuugcagugauuauauugcuaacucucauugcaugauaccuuuaauaaaaugaac

SEQ ID NO: 464446 - RNA, 62 nt, Human
gaauauuggaaagaagaugaccugucaggaguucauugcaaaucugcaagggguaaaugagg

SEQ ID NO: 464447 - RNA, 64 nt, Human; identical to SEQ ID NO: 58684

SEQ ID NO: 464448 - RNA, 64 nt, Human; identical to SEQ ID NO: 58685

SEQ ID NO: 464449 - RNA, 64 nt, Human; identical to SEQ ID NO: 58652

SEQ ID NO: 464450 - RNA, 64 nt, Human; identical to SEQ ID NO: 58653

SEQ ID NO: 464451 - RNA, 64 nt, Human; identical to SEQ ID NO: 58654

SEQ ID NO: 464452 - RNA, 64 nt, Human; identical to SEQ ID NO: 58655

SEQ ID NO: 464453 - RNA, 64 nt, Human; identical to SEQ ID NO: 58656

SEQ ID NO: 464454 - RNA, 64 nt, Human; identical to SEQ ID NO: 58657

SEQ ID NO: 464455 - RNA, 64 nt, Human; identical to SEQ ID NO: 58658

SEQ ID NO: 464456 - RNA, 64 nt, Human; identical to SEQ ID NO: 58659

SEQ ID NO: 464457 - RNA, 64 nt, Human; identical to SEQ ID NO: 58660

SEQ ID NO: 464458 - RNA, 64 nt, Human; identical to SEQ ID NO: 58661

SEQ ID NO: 464459 - RNA, 64 nt, Human; identical to SEQ ID NO: 58662

SEQ ID NO: 464460 - RNA, 64 nt, Human; identical to SEQ ID NO: 58663

SEQ ID NO: 464461 - RNA, 64 nt, Human; identical to SEQ ID NO: 58664

SEQ ID NO: 464462 - RNA, 64 nt, Human; identical to SEQ ID NO: 58665

SEQ ID NO: 464463 - RNA, 64 nt, Human
uuaacaugcgucuuuaaaggacuguaaugaaagaucauugcauauuuauugaauuguuuauauc

SEQ ID NO: 464464 - RNA, 64 nt, Human
cauguugccuguaugcaguugaacuauauaaaguucauugcaaagcagauuaucuuguuuuuuu

SEQ ID NO: 464465 - RNA, 64 nt, Human
auuauguaaauguuaauguauuauguuuuuuaaaucauugcauucaauuuuuaaugucaagaau

SEQ ID NO: 464466 - RNA, 64 nt, Human; identical to SEQ ID NO: 58666

SEQ ID NO: 464467 - RNA, 64 nt, Human; identical to SEQ ID NO: 58667

SEQ ID NO: 464468 - RNA, 64 nt, Human; identical to SEQ ID NO: 58668

SEQ ID NO: 464469 - RNA, 64 nt, Human; identical to SEQ ID NO: 58669

SEQ ID NO: 464470 - RNA, 64 nt, Human; identical to SEQ ID NO: 58670

SEQ ID NO: 464471 - RNA, 64 nt, Human; identical to SEQ ID NO: 58671

SEQ ID NO: 464472 - RNA, 64 nt, Human; identical to SEQ ID NO: 58672

SEQ ID NO: 464473 - RNA, 64 nt, Human; identical to SEQ ID NO: 58673

SEQ ID NO: 464474 - RNA, 64 nt, Human; identical to SEQ ID NO: 58674

SEQ ID NO: 464475 - RNA, 64 nt, Human; identical to SEQ ID NO: 58675

SEQ ID NO: 464476 - RNA, 64 nt, Human; identical to SEQ ID NO: 58676

SEQ ID NO: 464477 - RNA, 64 nt, Human; identical to SEQ ID NO: 58677

SEQ ID NO: 464478 - RNA, 64 nt, Human; identical to SEQ ID NO: 58678

SEQ ID NO: 464479 - RNA, 64 nt, Human; identical to SEQ ID NO: 58679

SEQ ID NO: 464480 - RNA, 64 nt, Human; identical to SEQ ID NO: 58680

SEQ ID NO: 464481 - RNA, 64 nt, Human; identical to SEQ ID NO: 58681

SEQ ID NO: 464482 - RNA, 64 nt, Human
auguaacaauuguuuguucuguuuucaggcuuugucauugcaucuuuuuuucauuuuuaaaugu

SEQ ID NO: 464483 - RNA, 64 nt, Human
gcugagccgaucuggucucguguucgcuggcugaucauugcaguaucagaggguggagauguca

SEQ ID NO: 464484 - RNA, 64 nt, Human
ggcaccugauacuucuguugcccuugugcuccagucauugcacaaggcagaaaacagcucuggc

SEQ ID NO: 464485 - RNA, 64 nt, Human
cuugcuaagucuuaccauguaccugcuuuggcaaucauugcaacucugagauuauaaaaugccu

SEQ ID NO: 464486 - RNA, 64 nt, Human; identical to SEQ ID NO: 58682

SEQ ID NO: 464487 - RNA, 64 nt, Human; identical to SEQ ID NO: 58683

SEQ ID NO: 464488 - RNA, 64 nt, Human; identical to SEQ ID NO: 58684

SEQ ID NO: 464489 - RNA, 64 nt, Human; identical to SEQ ID NO: 58685

SEQ ID NO: 464490 - RNA, 64 nt, Human
uccacguucagcagauacuguccaaggcagggguacggcugaccaggaaugaagguugaacucu

SEQ ID NO: 464491 - RNA, 64 nt, Human
cagcaugccuggccugggcgggcuaccucugagaacggcugaaauggugcccaguccaucagca

SEQ ID NO: 464492 - RNA, 64 nt, Human
ucacuuccauccagggccacuggcagcaucuggaacggcugaauuccagcugauauuagcccac

SEQ ID NO: 464493 - RNA, 64 nt, Human
aggaaauaaggaaauucaacccaaauuucccaagacggcugaaagacagguuuuuuggaaacug

SEQ ID NO: 464494 - RNA, 64 nt, Human
uccagagaugcccaagacccccgcuuccauagcgacggcugauggaaccgccccugguaccugc

SEQ ID NO: 464495 - RNA, 64 nt, Human
ucauuccuggccaugggugaggacuuggucugucacggcugaugaggacucccacaaccggcca

SEQ ID NO: 464496 - RNA, 64 nt, Human
ggugcuuacaggaccgcgcuguuccggcuucuucacggcugacauucggcuaacgagggauuac

SEQ ID NO: 464497 - RNA, 64 nt, Human
acacugaaccuggauggauuauagaggagcccucacggcugaucaauaauguugcaaagggaga

SEQ ID NO: 464498 - RNA, 64 nt, Human
agcccacugauccccaacgggagcaagacuucuaacggcugauugguauggaccgagauuaucu

SEQ ID NO: 464499 - RNA, 64 nt, Human
ugggggcugggcuggcuucuacauguuuagcaacacggcugaucuuucaguguuuccagcaaca

SEQ ID NO: 464500 - RNA, 64 nt, Human
cauccugauggcuccgacaggccugcuccagagcacggcugaccauuucugcuccgggaucuca

SEQ ID NO: 464501 - RNA, 64 nt, Human
aacuugagcugugacggguucugcaaggggugacucauugcauagaggugguagugaguaaugu

SEQ ID NO: 464502 - RNA, 64 nt, Human
agggagguggagguugcagugagcugagaucacaucauugcacuccagccugggcaacgggcga

SEQ ID NO: 464503 - RNA, 64 nt, Human
aaaaagauuugauuaucaucacagcagaaaaaagucauugcauaucugaucaauaacuucagau

SEQ ID NO: 464504 - RNA, 64 nt, Human
gauuucaucagacaguccuaacaauauugucugaacggcugaauaugaauagauacagcagagg

SEQ ID NO: 464505 - RNA, 64 nt, Human
aagaguugugcaugaacucgguaauacacaucacacggcugagaguccccuuuccaggcagggc

SEQ ID NO: 464506 - RNA, 64 nt, Human
cgcucccacucccacgggccaucgagggcccagcacggcugagcggcugaaaaaccguagccau

SEQ ID NO: 464507 - RNA, 64 nt, Human
gaguagcugggauuacaggcgcacgccaccacgcacggcugauuuuugcauuuuuaguagagau

SEQ ID NO: 464508 - RNA, 64 nt, Human
uaauuugaggaugggauuauucuaauguacaaccacggcugagaaccacugccgcugacguuuc

SEQ ID NO: 464509 - RNA, 64 nt, Human
ccaccagccuguccccacuaucccucuugucagcacggcugaaaggagcugccugggcaccuga

SEQ ID NO: 464510 - RNA, 64 nt, Human
caucuguggcugggacagcccagggggugugcccacggcugacccaggggugugcacacggcug

SEQ ID NO: 464511 - RNA, 64 nt, Human
ggggugugcccacggcugacccaggggugugcacacggcugagcugggagucccgcuggucucc

SEQ ID NO: 464512 - RNA, 64 nt, Human
cuuaagucaucauucagagugagagagagaaagcacggcugaggcugagucaguugaccguuga

SEQ ID NO: 464513 - RNA, 64 nt, Human
uuaccccugcugcugcaguggugugagucguuucacggcugaugucccucgggggauuaaagga

SEQ ID NO: 464514 - RNA, 64 nt, Human
agucaguguccccaucaugguggcuaugaagcucacggcugaagauuccagaagguccuggucu

SEQ ID NO: 464515 - RNA, 64 nt, Human
gaguaaacggcccaggccaggugcccaggaaaggacggcugagcauguggagcgagagggaggc

SEQ ID NO: 464516 - RNA, 64 nt, Human
acuucaagaaaagaguaaacauccauuggagaacacggcugaaaauuauugugcuguucuagga

SEQ ID NO: 464517 - RNA, 64 nt, Human
gcugcuggcccgggcgaccugggacucagcaccaacggcugaaguuucucagcugggcucugac

SEQ ID NO: 464518 - RNA, 64 nt, Human
gugccccagacugagcucuccaggccaggugggaacggcugauguggacugucuuuuucauuuu

SEQ ID NO: 464519 - RNA, 64 nt, Human
gucauagccccaaguacgacucacugagccaugcucauugcaggggaggcugggucugggggug

SEQ ID NO: 464520 - RNA, 64 nt, Human
aaacauuauuuggaaaaauuaacuuugcuuuucuucauugcauuuugugaauucaaacuucuua

SEQ ID NO: 464521 - RNA, 64 nt, Human
uuaugaaauuguuaauacauagucccaaucuuuuucauugcacaaaaaucuaggguugacuugg

SEQ ID NO: 464522 - RNA, 64 nt, Human
uugguuauuugguacguguagauuuaacacccagacggcugacuuguaacccuccccacuagcc

SEQ ID NO: 464523 - RNA, 64 nt, Human
gaaucagugugggcuccugcagugggcgcgggucacggcugacuccaacuuccaauacaacagc

SEQ ID NO: 464524 - RNA, 64 nt, Human
gaccacaguauucaccugguguuguggaaggagcacggcugacaccaugagccaccaccgcuga

SEQ ID NO: 464525 - RNA, 64 nt, Human
agcaaacauucuggggcugcuuuuuauuguucccacggcugacagcguggcagcggagacugug

SEQ ID NO: 464526 - RNA, 64 nt, Human
acuuuuuuccugugaacaguauugaaaaaccccaacggcugauaauuaagugaauuaacugugu

SEQ ID NO: 464527 - RNA, 64 nt, Human
uuggaaaacugguguguaccgaggcgcugacugcacggcugaccgccugcucgugccuucauuc

SEQ ID NO: 464528 - RNA, 64 nt, Human
cuacgccuagggcacacaggccagccccagucucacggcugaagugcgcaauaaaagaugguuu

SEQ ID NO: 464529 - RNA, 64 nt, Human
uaguggccuuagaaaacaugggcuuuuaagaaacacggcugauaucuuugagggcugacaaggc

SEQ ID NO: 464530 - RNA, 64 nt, Human
ucagacccuguucuuggccuuccauccucuccccacggcugauggucccuccaaggccgacucc

SEQ ID NO: 464531 - RNA, 64 nt, Human
gcgucauuuauacguaguuuggcagaaaccacuuacggcugaugaugcgcaacccugcugacug

SEQ ID NO: 464532 - RNA, 64 nt, Human
ggccgagucuguccuggaaccaggcuugccugggacggcugagcugggcagcuggaaguggcuc

SEQ ID NO: 464533 - RNA, 64 nt, Human
ucucuugagaauuugccaauaggaaggaguggccacggcugaaaggaacaagacagauccugac

SEQ ID NO: 464534 - RNA, 64 nt, Human
agacuauaaagauuucacaaaacaggaccugccuacggcugaacggagccaggaggccacgugu

SEQ ID NO: 464535 - RNA, 64 nt, Human
aaaaguaaagagucuauuuauggcugacauauuuacggcugacaaacuccuggaagaagcuaug

SEQ ID NO: 464536 - RNA, 64 nt, Human
gccuuagccaagacaaagcaguguuuuucagcagacggcugaugggacaggaauugaagaagag

SEQ ID NO: 464537 - RNA, 64 nt, Human
cauccccgcaucuaaaaccaaggauuucagauacucauugcaguuguggaguuuaauccccuuu

SEQ ID NO: 464538 - RNA, 64 nt, Human
ucccuccccgucucauuccguugucuguggauggucauugcaguuuaagagcagaacagaucuu

SEQ ID NO: 464539 - RNA, 64 nt, Human
cagcuggaauuacccaaccccaugacggacccuuucauugcagcgaucugcacacgugugggug

SEQ ID NO: 464540 - RNA, 64 nt, Human
cccaaagugcugaauuaagcagcucaccauccacacggcugaccucauacaucaagccaauacc

SEQ ID NO: 464541 - RNA, 64 nt, Human
cuuggugcaaagccagagacugauccuggcucugacggcugaagagggaagacccaaggcuggg

SEQ ID NO: 464542 - RNA, 64 nt, Human
cuccugggucccuggccaagaagccaggagagggacggcugauggacucagcaucggaaggugg

SEQ ID NO: 464543 - RNA, 64 nt, Human
uuuucuaaacgaagauuuauggaacacuuaccacacggcugacgcugcgcgaggcuaagguucu

SEQ ID NO: 464544 - RNA, 64 nt, Human
gaaacugccaugguggaaagguggcgcgcuucucacggcugaguugcugcgccugcagacggaa

SEQ ID NO: 464545 - RNA, 64 nt, Human
cccuucgggagcagggcugugucccagaugggccacggcugagccuucagaguacguccugccu

SEQ ID NO: 464546 - RNA, 64 nt, Human
uaacccacguuugucugucacguccagucccgagacggcugagugaccccaagaaaggcuuccc

SEQ ID NO: 464547 - RNA, 64 nt, Human; identical to SEQ ID NO: 314187

SEQ ID NO: 464548 - RNA, 64 nt, Human; identical to SEQ ID NO: 314188

SEQ ID NO: 464549 - RNA, 64 nt, Human; identical to SEQ ID NO: 314237

SEQ ID NO: 464550 - RNA, 64 nt, Human; identical to SEQ ID NO: 314238

SEQ ID NO: 464551 - RNA, 64 nt, Human; identical to SEQ ID NO: 313194

SEQ ID NO: 464552 - RNA, 64 nt, Human; identical to SEQ ID NO: 314220

SEQ ID NO: 464553 - RNA, 64 nt, Human; identical to SEQ ID NO: 314221

SEQ ID NO: 464554 - RNA, 64 nt, Human; identical to SEQ ID NO: 314222

SEQ ID NO: 464555 - RNA, 64 nt, Human
gugcuuguagaaugaugagcuuagagguaccaggucauugcaguuguuugcuuaaagacuuauu

SEQ ID NO: 464556 - RNA, 64 nt, Human
ugcccacauuggagugcaguggcacgaucucagcucauugcagccuccgccaccuggguucaag

SEQ ID NO: 464557 - RNA, 64 nt, Human
ccugucuacacugcaggggaaccucaagaacuuuucauugcacuucuaaaauucagccuuguuc

SEQ ID NO: 464558 - RNA, 64 nt, Human; identical to SEQ ID NO: 313997

SEQ ID NO: 464559 - RNA, 64 nt, Human; identical to SEQ ID NO: 313195

SEQ ID NO: 464560 - RNA, 64 nt, Human; identical to SEQ ID NO: 314256

SEQ ID NO: 464561 - RNA, 64 nt, Human; identical to SEQ ID NO: 314271

SEQ ID NO: 464562 - RNA, 64 nt, Human; identical to SEQ ID NO: 314272

SEQ ID NO: 464563 - RNA, 64 nt, Human; identical to SEQ ID NO: 313196

SEQ ID NO: 464564 - RNA, 64 nt, Human; identical to SEQ ID NO: 314273

SEQ ID NO: 464565 - RNA, 64 nt, Human; identical to SEQ ID NO: 314118

SEQ ID NO: 464566 - RNA, 64 nt, Human; identical to SEQ ID NO: 314119

SEQ ID NO: 464567 - RNA, 64 nt, Human; identical to SEQ ID NO: 313212

SEQ ID NO: 464568 - RNA, 64 nt, Human; identical to SEQ ID NO: 314319

SEQ ID NO: 464569 - RNA, 64 nt, Human; identical to SEQ ID NO: 314320

SEQ ID NO: 464570 - RNA, 64 nt, Human; identical to SEQ ID NO: 314321

SEQ ID NO: 464571 - RNA, 64 nt, Human; identical to SEQ ID NO: 314029

SEQ ID NO: 464572 - RNA, 64 nt, Human; identical to SEQ ID NO: 314030

SEQ ID NO: 464573 - RNA, 64 nt, Human
ccuuuucucaugguggacauacaauuuuacuguuucauugcauaacaugguagcaucugugacu

SEQ ID NO: 464574 - RNA, 64 nt, Human
uguuacugaaacuuaauucuaucaagaaucuuuuucauugcacugaaugauuucuuuugccccu

SEQ ID NO: 464575 - RNA, 64 nt, Human
gaauguuuauuaauauuuggaaaauauacuuccaucauugcaauguggagcuucauucauaagu

SEQ ID NO: 464576 - RNA, 64 nt, Human
cugguuuucacccacgcuuuugugggagagaaaaucauugcaaaaucauuuuuuuuguucggua

SEQ ID NO: 464577 - RNA, 64 nt, Human; identical to SEQ ID NO: 313213

SEQ ID NO: 464578 - RNA, 64 nt, Human; identical to SEQ ID NO: 313214

SEQ ID NO: 464579 - RNA, 64 nt, Human; identical to SEQ ID NO: 314031

SEQ ID NO: 464580 - RNA, 64 nt, Human; identical to SEQ ID NO: 313945

SEQ ID NO: 464581 - RNA, 64 nt, Human; identical to SEQ ID NO: 313960

SEQ ID NO: 464582 - RNA, 64 nt, Human; identical to SEQ ID NO: 313961

SEQ ID NO: 464583 - RNA, 64 nt, Human; identical to SEQ ID NO: 313962

SEQ ID NO: 464584 - RNA, 64 nt, Human; identical to SEQ ID NO: 313963

SEQ ID NO: 464585 - RNA, 56 nt, Human; identical to SEQ ID NO: 313978

SEQ ID NO: 464586 - RNA, 64 nt, Human; identical to SEQ ID NO: 313979

SEQ ID NO: 464587 - RNA, 64 nt, Human; identical to SEQ ID NO: 313980

SEQ ID NO: 464588 - RNA, 64 nt, Human; identical to SEQ ID NO: 314012

SEQ ID NO: 464589 - RNA, 64 nt, Human; identical to SEQ ID NO: 314013

SEQ ID NO: 464590 - RNA, 64 nt, Human; identical to SEQ ID NO: 314014

SEQ ID NO: 464591 - RNA, 64 nt, Human; identical to SEQ ID NO: 314120

SEQ ID NO: 464592 - RNA, 64 nt, Human
uauuggauuuaccuuuaaaaaaaaaaccugaguaucauugcaugaauuuuuaucucccuauggu

SEQ ID NO: 464593 - RNA, 64 nt, Human
cuguauuuggacaacuaaaaaacaccaaacuaucucauugcaauuuguauuuuagcagauuuca

SEQ ID NO: 464594 - RNA, 64 nt, Human
aaaaggaaagaaggaauggaggaggucaguuaguucauugcaauaaauuaccucuucaguucuu

SEQ ID NO: 464595 - RNA, 64 nt, Human
agcacuacuuagaauuaaauuaggaagucuuuuaucauugcaggauuguacauacuacuuuaua

SEQ ID NO: 464596 - RNA, 64 nt, Human; identical to SEQ ID NO: 314203

SEQ ID NO: 464597 - RNA, 64 nt, Human; identical to SEQ ID NO: 314204

SEQ ID NO: 464598 - RNA, 64 nt, Human; identical to SEQ ID NO: 314205

SEQ ID NO: 464599 - RNA, 64 nt, Human; identical to SEQ ID NO: 314342

SEQ ID NO: 464600 - RNA, 53 nt, Human; identical to SEQ ID NO: 314343

SEQ ID NO: 464601 - RNA, 64 nt, Human; identical to SEQ ID NO: 314344

SEQ ID NO: 464602 - RNA, 64 nt, Human; identical to SEQ ID NO: 314345

SEQ ID NO: 464603 - RNA, 64 nt, Human; identical to SEQ ID NO: 314346

SEQ ID NO: 464604 - RNA, 64 nt, Human; identical to SEQ ID NO: 314347

SEQ ID NO: 464605 - RNA, 64 nt, Human; identical to SEQ ID NO: 314348

SEQ ID NO: 464606 - RNA, 64 nt, Human; identical to SEQ ID NO: 314349

SEQ ID NO: 464607 - RNA, 64 nt, Human; identical to SEQ ID NO: 314350

SEQ ID NO: 464608 - RNA, 64 nt, Human; identical to SEQ ID NO: 314351

SEQ ID NO: 464609 - RNA, 64 nt, Human; identical to SEQ ID NO: 314352

SEQ ID NO: 464610 - RNA, 64 nt, Human; identical to SEQ ID NO: 314353

SEQ ID NO: 464611 - RNA, 64 nt, Human
cuuucucuguuuugguaaggauuuaaaauuuuuuucauugcaauuuuaagugguuuucaauaag

SEQ ID NO: 464612 - RNA, 64 nt, Human
ggcccaggcuggagugcaguggcaugaucauagcucauugcauccuugaaauccugggcucagg

SEQ ID NO: 464613 - RNA, 64 nt, Human
gcgcaaaggucucgaugccuuuugguaacauccgucauugcagaagaaaguuuacacgacguca

SEQ ID NO: 464614 - RNA, 64 nt, Human
cgcuugugagcgaggcccuccccucugcaccagcucauugcaaagcgaacauccucuccuuucc

SEQ ID NO: 464615 - RNA, 64 nt, Human; identical to SEQ ID NO: 314354

SEQ ID NO: 464616 - RNA, 64 nt, Human; identical to SEQ ID NO: 314355

SEQ ID NO: 464617 - RNA, 64 nt, Human; identical to SEQ ID NO: 314356

SEQ ID NO: 464618 - RNA, 64 nt, Human; identical to SEQ ID NO: 314357

SEQ ID NO: 464619 - RNA, 64 nt, Human; identical to SEQ ID NO: 314358

SEQ ID NO: 464620 - RNA, 64 nt, Human; identical to SEQ ID NO: 314359

SEQ ID NO: 464621 - RNA, 64 nt, Human; identical to SEQ ID NO: 314360

SEQ ID NO: 464622 - RNA, 64 nt, Human; identical to SEQ ID NO: 314361

SEQ ID NO: 464623 - RNA, 64 nt, Human; identical to SEQ ID NO: 314362

SEQ ID NO: 464624 - RNA, 64 nt, Human; identical to SEQ ID NO: 314363

SEQ ID NO: 464625 - RNA, 64 nt, Human; identical to SEQ ID NO: 314364

SEQ ID NO: 464626 - RNA, 64 nt, Human; identical to SEQ ID NO: 314365

SEQ ID NO: 464627 - RNA, 64 nt, Human; identical to SEQ ID NO: 314366

SEQ ID NO: 464628 - RNA, 64 nt, Human; identical to SEQ ID NO: 314367

SEQ ID NO: 464629 - RNA, 64 nt, Human; identical to SEQ ID NO: 314368

SEQ ID NO: 464630 - RNA, 64 nt, Human
auaauuauuccuauucuuauuucuucauuuuaagucauugcaauggaaaguaauauuauaaaau

SEQ ID NO: 464631 - RNA, 64 nt, Human
acauuuccaguaguauggcaguacagugcucuguucauugcaagcuggcaaauuuauguagcua

SEQ ID NO: 464632 - RNA, 64 nt, Human
aaacuuacauguuagcauaaaacagacuucucucucauugcaugcacuagaucaauauuaucau

SEQ ID NO: 464633 - RNA, 64 nt, Human
uauacacugagaacuagccucaggcuuaauauucucauugcauuugcaagaucugagcaaauaa

SEQ ID NO: 464634 - RNA, 64 nt, Human; identical to SEQ ID NO: 314369

SEQ ID NO: 464635 - RNA, 64 nt, Human; identical to SEQ ID NO: 314370

SEQ ID NO: 464636 - RNA, 64 nt, Human; identical to SEQ ID NO: 314371

SEQ ID NO: 464637 - RNA, 64 nt, Human; identical to SEQ ID NO: 314372

SEQ ID NO: 464638 - RNA, 64 nt, Human; identical to SEQ ID NO: 314373

SEQ ID NO: 464639 - RNA, 64 nt, Human; identical to SEQ ID NO: 314374

SEQ ID NO: 464640 - RNA, 64 nt, Human; identical to SEQ ID NO: 314375

SEQ ID NO: 464641 - RNA, 64 nt, Human; identical to SEQ ID NO: 314376

SEQ ID NO: 464642 - RNA, 58 nt, Human; identical to SEQ ID NO: 314377

SEQ ID NO: 464643 - RNA, 64 nt, Human; identical to SEQ ID NO: 314378

SEQ ID NO: 464644 - RNA, 64 nt, Human; identical to SEQ ID NO: 314379

SEQ ID NO: 464645 - RNA, 64 nt, Human; identical to SEQ ID NO: 314380

SEQ ID NO: 464646 - RNA, 64 nt, Human; identical to SEQ ID NO: 314381

SEQ ID NO: 464647 - RNA, 64 nt, Human; identical to SEQ ID NO: 314382

SEQ ID NO: 464648 - RNA, 64 nt, Human; identical to SEQ ID NO: 314383

SEQ ID NO: 464649 - RNA, 64 nt, Human
cuuuugggaaacaaacugccccguuaacuccagaucauugcacuggaauguaaucaagaaaguu

SEQ ID NO: 464650 - RNA, 64 nt, Human
agacuaaagacuugucaaauauaucaagaguauaucauugcaagggcagcacuuguccugugga

SEQ ID NO: 464651 - RNA, 64 nt, Human
ugcccccaacucaaaauagcugucuguguugcaaucauugcaaaaucuaaauucuuuuguuacu

SEQ ID NO: 464652 - RNA, 64 nt, Human
cuaaaggagaacauuggagaaaacagcgggaacuucauugcaggccgugugucacccugaccac

SEQ ID NO: 464653 - RNA, 64 nt, Human; identical to SEQ ID NO: 314384

SEQ ID NO: 464654 - RNA, 64 nt, Human; identical to SEQ ID NO: 314385

SEQ ID NO: 464655 - RNA, 64 nt, Human; identical to SEQ ID NO: 314386

SEQ ID NO: 464656 - RNA, 64 nt, Human; identical to SEQ ID NO: 314387

SEQ ID NO: 464657 - RNA, 64 nt, Human; identical to SEQ ID NO: 314388

SEQ ID NO: 464658 - RNA, 64 nt, Human; identical to SEQ ID NO: 314389

SEQ ID NO: 464659 - RNA, 64 nt, Human; identical to SEQ ID NO: 314390

SEQ ID NO: 464660 - RNA, 64 nt, Human; identical to SEQ ID NO: 314391

SEQ ID NO: 464661 - RNA, 64 nt, Human; identical to SEQ ID NO: 314392

SEQ ID NO: 464662 - RNA, 64 nt, Human; identical to SEQ ID NO: 314393

SEQ ID NO: 464663 - RNA, 64 nt, Human; identical to SEQ ID NO: 314394

SEQ ID NO: 464664 - RNA, 64 nt, Human; identical to SEQ ID NO: 314395

SEQ ID NO: 464665 - RNA, 64 nt, Human; identical to SEQ ID NO: 314396

SEQ ID NO: 464666 - RNA, 64 nt, Human; identical to SEQ ID NO: 314397

SEQ ID NO: 464667 - RNA, 64 nt, Human; identical to SEQ ID NO: 314398

SEQ ID NO: 464668 - RNA, 64 nt, Human
uggaguucuuuagcaacaaaguauagaaacauguucauugcacacacccaaggagaagagcuca

SEQ ID NO: 464669 - RNA, 64 nt, Human
caugcuguccaaguguugaaaagucaauuuuauuucauugcauuuauuuacauagugucauucc

SEQ ID NO: 464670 - RNA, 64 nt, Human
caacagaguuauccguaucuuccacaugugaaugucauugcaagggugacucuagacaaacuac

SEQ ID NO: 464671 - RNA, 64 nt, Human
ucugcagguuucuccuugaagcaaaugugugggaucauugcauuuccagaaaucugccuccuuc

SEQ ID NO: 464672 - RNA, 64 nt, Human; identical to SEQ ID NO: 314399

SEQ ID NO: 464673 - RNA, 53 nt, Human; identical to SEQ ID NO: 314400

SEQ ID NO: 464674 - RNA, 64 nt, Human; identical to SEQ ID NO: 314401

SEQ ID NO: 464675 - RNA, 64 nt, Human; identical to SEQ ID NO: 314402

SEQ ID NO: 464676 - RNA, 64 nt, Human; identical to SEQ ID NO: 314403

SEQ ID NO: 464677 - RNA, 64 nt, Human; identical to SEQ ID NO: 314404

SEQ ID NO: 464678 - RNA, 64 nt, Human; identical to SEQ ID NO: 314405

SEQ ID NO: 464679 - RNA, 64 nt, Human; identical to SEQ ID NO: 314406

SEQ ID NO: 464680 - RNA, 64 nt, Human; identical to SEQ ID NO: 314407

SEQ ID NO: 464681 - RNA, 64 nt, Human; identical to SEQ ID NO: 314408

SEQ ID NO: 464682 - RNA, 64 nt, Human; identical to SEQ ID NO: 314409

SEQ ID NO: 464683 - RNA, 64 nt, Human; identical to SEQ ID NO: 314410

SEQ ID NO: 464684 - RNA, 64 nt, Human; identical to SEQ ID NO: 314411

SEQ ID NO: 464685 - RNA, 64 nt, Human; identical to SEQ ID NO: 314412

SEQ ID NO: 464686 - RNA, 64 nt, Human; identical to SEQ ID NO: 314413

SEQ ID NO: 464687 - RNA, 64 nt, Human
auauaaauggugagaauuaaaauaaaacguuaucucauugcaaaaauauuuuauuuuuauccca

SEQ ID NO: 464688 - RNA, 64 nt, Human
ggaaaugaaaaaaaaaaaaaaaaaaagucugcguucauugcaguuccaguuucucuuccauucu

SEQ ID NO: 464689 - RNA, 64 nt, Human
gcucuggacuguguggagcucgcuaaagucauggucauugcaggaauccaaguggcaguccuuc

SEQ ID NO: 464690 - RNA, 64 nt, Human
agcagaaggcuuuuuuaacucauccguuugccaaucauugcaaacaacugaaauguggauguga

SEQ ID NO: 464691 - RNA, 64 nt, Human; identical to SEQ ID NO: 314414

SEQ ID NO: 464692 - RNA, 64 nt, Human; identical to SEQ ID NO: 314415

SEQ ID NO: 464693 - RNA, 64 nt, Human; identical to SEQ ID NO: 314416

SEQ ID NO: 464694 - RNA, 64 nt, Human; identical to SEQ ID NO: 314417

SEQ ID NO: 464695 - RNA, 64 nt, Human; identical to SEQ ID NO: 314418

SEQ ID NO: 464696 - RNA, 64 nt, Human; identical to SEQ ID NO: 314419

SEQ ID NO: 464697 - RNA, 64 nt, Human; identical to SEQ ID NO: 314420

SEQ ID NO: 464698 - RNA, 64 nt, Human; identical to SEQ ID NO: 314421

SEQ ID NO: 464699 - RNA, 64 nt, Human; identical to SEQ ID NO: 314422

SEQ ID NO: 464700 - RNA, 64 nt, Human; identical to SEQ ID NO: 314423

SEQ ID NO: 464701 - RNA, 64 nt, Human; identical to SEQ ID NO: 314424

SEQ ID NO: 464702 - RNA, 64 nt, Human; identical to SEQ ID NO: 314425

SEQ ID NO: 464703 - RNA, 64 nt, Human; identical to SEQ ID NO: 314426

SEQ ID NO: 464704 - RNA, 64 nt, Human; identical to SEQ ID NO: 314427

SEQ ID NO: 464705 - RNA, 64 nt, Human; identical to SEQ ID NO: 314428

SEQ ID NO: 464706 - RNA, 64 nt, Human
uccauaucgggugcaacacuucaguuaccaaauuucauugcacauagauuaucuuagguacccu

SEQ ID NO: 464707 - RNA, 64 nt, Human
uucuguuaguacuuauuagaggaggagaugguuuucauugcauagugacauuuucuuagccuua

SEQ ID NO: 464708 - RNA, 64 nt, Human
caccuaggcuggagugcaguggcuuaaucauggcucauugcagucuccaucuccugggcucgag

SEQ ID NO: 464709 - RNA, 64 nt, Human
uguauugauuagccuguauguagcagggcucccuucauugcaucugaggacuuguuuucuuuuu

SEQ ID NO: 464710 - RNA, 64 nt, Human; identical to SEQ ID NO: 314429

SEQ ID NO: 464711 - RNA, 64 nt, Human; identical to SEQ ID NO: 314430

SEQ ID NO: 464712 - RNA, 64 nt, Human; identical to SEQ ID NO: 314431

SEQ ID NO: 464713 - RNA, 64 nt, Human; identical to SEQ ID NO: 314432

SEQ ID NO: 464714 - RNA, 64 nt, Human; identical to SEQ ID NO: 314433

SEQ ID NO: 464715 - RNA, 64 nt, Human; identical to SEQ ID NO: 314434

SEQ ID NO: 464716 - RNA, 64 nt, Human; identical to SEQ ID NO: 314435

SEQ ID NO: 464717 - RNA, 64 nt, Human; identical to SEQ ID NO: 314436

SEQ ID NO: 464718 - RNA, 64 nt, Human; identical to SEQ ID NO: 314437

SEQ ID NO: 464719 - RNA, 64 nt, Human; identical to SEQ ID NO: 314438

SEQ ID NO: 464720 - RNA, 64 nt, Human; identical to SEQ ID NO: 314439

SEQ ID NO: 464721 - RNA, 64 nt, Human; identical to SEQ ID NO: 314440

SEQ ID NO: 464722 - RNA, 64 nt, Human; identical to SEQ ID NO: 314441

SEQ ID NO: 464723 - RNA, 64 nt, Human; identical to SEQ ID NO: 314442

SEQ ID NO: 464724 - RNA, 64 nt, Human; identical to SEQ ID NO: 314443

SEQ ID NO: 464725 - RNA, 64 nt, Human
auuuuuuaugcuaaaacuggcucaauccuucugaucauugcaguuuucucucaaauaugaacac

SEQ ID NO: 464726 - RNA, 64 nt, Human
agugacacugauaggcggaucaucuugaaucugcucauugcaugagucaagucggccacagacu

SEQ ID NO: 464727 - RNA, 64 nt, Human
acuguacggacaauacagaagacuauucuuauccucauugcauuucuaugcauauacaaaaaaa

SEQ ID NO: 464728 - RNA, 64 nt, Human
uuuagauggaguuuugcaguggugcaaucauagcucauugcagccuucaauuccugggcucagg

SEQ ID NO: 464729 - RNA, 64 nt, Human; identical to SEQ ID NO: 314444

SEQ ID NO: 464730 - RNA, 64 nt, Human; identical to SEQ ID NO: 314445

SEQ ID NO: 464731 - RNA, 64 nt, Human; identical to SEQ ID NO: 314446

SEQ ID NO: 464732 - RNA, 64 nt, Human; identical to SEQ ID NO: 314447

SEQ ID NO: 464733 - RNA, 64 nt, Human; identical to SEQ ID NO: 314448

SEQ ID NO: 464734 - RNA, 64 nt, Human; identical to SEQ ID NO: 314449

SEQ ID NO: 464735 - RNA, 64 nt, Human; identical to SEQ ID NO: 314450

SEQ ID NO: 464736 - RNA, 64 nt, Human; identical to SEQ ID NO: 314451

SEQ ID NO: 464737 - RNA, 64 nt, Human; identical to SEQ ID NO: 314452

SEQ ID NO: 464738 - RNA, 64 nt, Human; identical to SEQ ID NO: 314453

SEQ ID NO: 464739 - RNA, 64 nt, Human; identical to SEQ ID NO: 314454

SEQ ID NO: 464740 - RNA, 64 nt, Human; identical to SEQ ID NO: 314455

SEQ ID NO: 464741 - RNA, 64 nt, Human; identical to SEQ ID NO: 314456

SEQ ID NO: 464742 - RNA, 64 nt, Human; identical to SEQ ID NO: 314457

SEQ ID NO: 464743 - RNA, 64 nt, Human; identical to SEQ ID NO: 314458

SEQ ID NO: 464744 - RNA, 64 nt, Human
uuugcucaccagauccaagcacugcuucucggugucauugcagugugcugcuugucacccagaa

SEQ ID NO: 464745 - RNA, 64 nt, Human
agaagaugagauuaagguuaggagaaaaccucagucauugcaugcuuuuuaguaugggccaaua

SEQ ID NO: 464746 - RNA, 64 nt, Human
gguguuuagagauuuuuuuuguuguuguuaacauucauugcaaaaguacuagaugguguauaac

SEQ ID NO: 464747 - RNA, 64 nt, Human
gagcagaagagaguggggccugcccucugccccaucauugcaccugcaggcuuagguccucacu

SEQ ID NO: 464748 - RNA, 64 nt, Human; identical to SEQ ID NO: 314459

SEQ ID NO: 464749 - RNA, 64 nt, Human; identical to SEQ ID NO: 314460

SEQ ID NO: 464750 - RNA, 64 nt, Human; identical to SEQ ID NO: 314461

SEQ ID NO: 464751 - RNA, 64 nt, Human; identical to SEQ ID NO: 314462

SEQ ID NO: 464752 - RNA, 64 nt, Human; identical to SEQ ID NO: 314463

SEQ ID NO: 464753 - RNA, 64 nt, Human; identical to SEQ ID NO: 314464

SEQ ID NO: 464754 - RNA, 64 nt, Human; identical to SEQ ID NO: 314465

SEQ ID NO: 464755 - RNA, 64 nt, Human; identical to SEQ ID NO: 314466

SEQ ID NO: 464756 - RNA, 64 nt, Human; identical to SEQ ID NO: 314467

SEQ ID NO: 464757 - RNA, 64 nt, Human; identical to SEQ ID NO: 314468

SEQ ID NO: 464758 - RNA, 64 nt, Human; identical to SEQ ID NO: 314469

SEQ ID NO: 464759 - RNA, 64 nt, Human; identical to SEQ ID NO: 314470

SEQ ID NO: 464760 - RNA, 64 nt, Human; identical to SEQ ID NO: 314471

SEQ ID NO: 464761 - RNA, 64 nt, Human; identical to SEQ ID NO: 314472

SEQ ID NO: 464762 - RNA, 64 nt, Human; identical to SEQ ID NO: 314473

SEQ ID NO: 464763 - RNA, 64 nt, Human
ccuagcaagaugauccuuccuaaucaaauucuucucauugcagaacuuuaucccuggaagccuu

SEQ ID NO: 464764 - RNA, 64 nt, Human
cuuuccaggcauagcaguucuuuagccauacauaucauugcaugaacuauuucgaaagcccuuc

SEQ ID NO: 464765 - RNA, 64 nt, Human
cagauuucagaguaagauaaagcagauucugucuucauugcaaaaaguuauucucaauggaaga

SEQ ID NO: 464766 - RNA, 64 nt, Human
acgacguuuuguguguguauuucacguuagcauuucauugcauaggcaaaacacuagucacaau

SEQ ID NO: 464767 - RNA, 64 nt, Human; identical to SEQ ID NO: 314474

SEQ ID NO: 464768 - RNA, 64 nt, Human; identical to SEQ ID NO: 314475

SEQ ID NO: 464769 - RNA, 64 nt, Human; identical to SEQ ID NO: 314476

SEQ ID NO: 464770 - RNA, 64 nt, Human; identical to SEQ ID NO: 314477

SEQ ID NO: 464771 - RNA, 64 nt, Human; identical to SEQ ID NO: 314478

SEQ ID NO: 464772 - RNA, 64 nt, Human; identical to SEQ ID NO: 314479

SEQ ID NO: 464773 - RNA, 64 nt, Human; identical to SEQ ID NO: 314480

SEQ ID NO: 464774 - RNA, 64 nt, Human; identical to SEQ ID NO: 314481

SEQ ID NO: 464775 - RNA, 64 nt, Human; identical to SEQ ID NO: 314482

SEQ ID NO: 464776 - RNA, 64 nt, Human; identical to SEQ ID NO: 314483

SEQ ID NO: 464777 - RNA, 64 nt, Human; identical to SEQ ID NO: 314484

SEQ ID NO: 464778 - RNA, 64 nt, Human; identical to SEQ ID NO: 314485

SEQ ID NO: 464779 - RNA, 64 nt, Human; identical to SEQ ID NO: 314486

SEQ ID NO: 464780 - RNA, 64 nt, Human; identical to SEQ ID NO: 314487

SEQ ID NO: 464781 - RNA, 64 nt, Human; identical to SEQ ID NO: 314488

SEQ ID NO: 464782 - RNA, 64 nt, Human
gacauuccauguuaaacuacggucauguucagcuucauugcauguaauguagaccuaguccauc

SEQ ID NO: 464783 - RNA, 64 nt, Human
auggggaccugagagggaaggggacagauguuucucauugcauaaugucacaguugccucaaau

SEQ ID NO: 464784 - RNA, 64 nt, Human
uguacuauacuguuugcuuuacuaaucaccuaauucauugcaguucauacuuauugacucagag

SEQ ID NO: 464785 - RNA, 64 nt, Human
caaaauuuuuuaaauguuagaaaaagcagaucugucauugcaaaguaacaaaaauuuuaagcuu

SEQ ID NO: 464786 - RNA, 64 nt, Human; identical to SEQ ID NO: 314489

SEQ ID NO: 464787 - RNA, 64 nt, Human; identical to SEQ ID NO: 313213

SEQ ID NO: 464788 - RNA, 64 nt, Human; identical to SEQ ID NO: 314491

SEQ ID NO: 464789 - RNA, 64 nt, Human; identical to SEQ ID NO: 314492

SEQ ID NO: 464790 - RNA, 64 nt, Human; identical to SEQ ID NO: 314493

SEQ ID NO: 464791 - RNA, 64 nt, Human; identical to SEQ ID NO: 314494

SEQ ID NO: 464792 - RNA, 64 nt, Human; identical to SEQ ID NO: 314495

SEQ ID NO: 464793 - RNA, 64 nt, Human; identical to SEQ ID NO: 314496

SEQ ID NO: 464794 - RNA, 64 nt, Human; identical to SEQ ID NO: 314497

SEQ ID NO: 464795 - RNA, 64 nt, Human
uuuuuuguuuuuguauccauggcuggcacuuuacucauugcacuugaguuuauugccccauaac

SEQ ID NO: 464796 - RNA, 64 nt, Human
auguuuauauauauggaaggaauauaguuucauuucauugcaaaggcaguauaaaagauauaua

SEQ ID NO: 464797 - RNA, 64 nt, Human
gagacagugggagaggacaaugacuauugcaucuucauugcaaaagcacuggcucauccgcccu

SEQ ID NO: 464798 - RNA, 64 nt, Human
aaacagcuucacuccucaggaaguaccauggacagacgccuaccaggggugacaaagcagugca

SEQ ID NO: 464799 - RNA, 64 nt, Human
agaggcaccaggcaguaacuuccaugaugacacugacgccuauaccugagcucuaggcugccug

SEQ ID NO: 464800 - RNA, 64 nt, Human
guauuugaacuuagggcaaaucagagucuacacagacgccuacagaaaguuucaggaagaggca

SEQ ID NO: 464801 - RNA, 54 nt, Human
ucgcagccuaucgcuccugacacggacgccuauccagaagccagccggcuggca

SEQ ID NO: 464802 - RNA, 64 nt, Human
gccccucaggugcccccacacacagccuucccuugacgccuacauuucuaggcacaugugaggc

SEQ ID NO: 464803 - RNA, 64 nt, Human
gaccaagaaaucaggagaguucaagugaugagcagacgccuagucgggaugaugauagccaguc

SEQ ID NO: 464804 - RNA, 64 nt, Human
gcccaggccacagccagccugucguguccagccugacgccuacuggggcagggcagcaggcuuu

SEQ ID NO: 464805 - RNA, 64 nt, Human
gugcuaagugcuuacuucgggauagcaggggccggacgccuauacaccugucugcugccugugg

SEQ ID NO: 464806 - RNA, 64 nt, Human
guuuguaaacaugaggucagacauguguaagguagacgccuauggccacuggcuugaccaccuu

SEQ ID NO: 464807 - RNA, 64 nt, Human
ugacgggcggcguucccacccacaccuucgacgcgacgccuacgaccccccucgcccgccgccu

SEQ ID NO: 464808 - RNA, 64 nt, Human
uacuaguaguccaggcuugauuuggagggugaaugacgccuagcaagauguauuguacuugugu

SEQ ID NO: 464809 - RNA, 64 nt, Human
uuucuggcuucuuaugcuuuccugcaagcagauuucauugcauuuauuguguucauaucauuuu

SEQ ID NO: 464810 - RNA, 64 nt, Human
aggaaaccaagaaguuugacugggagcguguguuucauugcacugggcuuagcauacggcuggc

SEQ ID NO: 464811 - RNA, 64 nt, Human
uuucauaaugauuccuuuauauuuucacuuugugucauugcagaauuuuagacucucauucaca

SEQ ID NO: 464812 - RNA, 64 nt, Human
uguccaggccucagagucccgcucuguucauacagacgccuauggcccugcuucuuccucccag

SEQ ID NO: 464813 - RNA, 64 nt, Human
auuucucaguccugaagaauaaggaaaacaaagcgacgccuauuuuguauaaaguuuccgacuc

SEQ ID NO: 464814 - RNA, 64 nt, Human
guguggcugcaucuugcugcuaaugugugauguugacgccuaacugaauuugaacagcucacca

SEQ ID NO: 464815 - RNA, 64 nt, Human
acugguuuuacagcucuggugugugauguuaccagacgccuaggcccucuccuguugcucuguc

SEQ ID NO: 464816 - RNA, 64 nt, Human
agucgaaguugaaaggaagcuuucccccgccaaggacgccuaccccgaaaccggccccgacgcc

SEQ ID NO: 464817 - RNA, 64 nt, Human
cugugacacaguggccauuguaguuuaucccgaagacgccuauguacguaaguuugcauuuccu

SEQ ID NO: 464818 - RNA, 64 nt, Human
gggccccccucagccccugccuccaucugccugagacgccuauuuuuuuuuuuuuuuuuuaaac

SEQ ID NO: 464819 - RNA, 64 nt, Human
agucggggcuggauggccgggggcuucugggcccgacgccuagugcagccccuggggucguggu

SEQ ID NO: 464820 - RNA, 64 nt, Human
ggacuccuccgcgagccccaucgucgcgccuguggacgccuaggcaagagcggcccucugcagc

SEQ ID NO: 464821 - RNA, 64 nt, Human
cugucgaggcgggccgagucuucccuuauccccagacgccuagcgggcaggguugggcugaauc

SEQ ID NO: 464822 - RNA, 64 nt, Human
cuccaagcaaggaagaaaaaacaaacucugcucagacgccuaugaaacaccugaaugaacuuug

SEQ ID NO: 464823 - RNA, 64 nt, Human
caguagccuaguuuccacagcacgauaacaccaugacgccuacugcuguucccaccuugggauu

SEQ ID NO: 464824 - RNA, 64 nt, Human
gagcucaagaucaauuggucauagaacagcauuugacgccuagaacuaugaccaccucaugguc

SEQ ID NO: 464825 - RNA, 64 nt, Human
ggcgugugcaggaguuugacaguggccugcugcacuggcggauuggugggggggacaccacuga

SEQ ID NO: 464826 - RNA, 64 nt, Human
gcagcaagucaauuguauuagcagaauauuguccucauugcauguguaguuugagcacagaucc

SEQ ID NO: 464827 - RNA, 64 nt, Human
aucaacagccgugaccacuuuagaaugaaccaguucauugcaugcugaagcgacauuguugguc

SEQ ID NO: 464828 - RNA, 64 nt, Human
gcccgggaggaacaaugagcuugguggacacauuucauugcaguguugcuccauuccuagcuug

SEQ ID NO: 464829 - RNA, 64 nt, Human
cagcgccccgccugggagccgcgggcaggcgagacuggcggagcccccagaccucccagugggg

SEQ ID NO: 464830 - RNA, 64 nt, Human
uuuuuccguuaucacccaggccugauucacuggccuggcggagaugcuucuaaggcauggucgg

SEQ ID NO: 464831 - RNA, 64 nt, Human
caccucuuccccuaaaacuucugcagggaagccccuggcggaggcgccauugaaagcauggucu

SEQ ID NO: 464832 - RNA, 64 nt, Human
ccuggagcgacggcugcugaaagaggcuguccaccuggcggaaccaccggagcccggaggcuug

SEQ ID NO: 464833 - RNA, 64 nt, Human
cccagugugagaccccaaagacucuggaggucaucuggcggaggucucugggagcccagaaccc

SEQ ID NO: 464834 - RNA, 64 nt, Human
gaggucuuugcauauagaugaaauguauauuugccuggcggacuauuugcguuguguggccuua

SEQ ID NO: 464835 - RNA, 64 nt, Human
ccgucuccucagugagccagcauuucagggggagcuggcggacucccacuccccgcucccuucc

SEQ ID NO: 464836 - RNA, 64 nt, Human
gcccagcaaccggccccagcagcagguccuggugcuggcggagcccaggcgcaagccaucuacc

SEQ ID NO: 464837 - RNA, 64 nt, Human
caccucugcgagagauccggggaccugugggcagcuggcggaggggagacucagcagacggacc

SEQ ID NO: 464838 - RNA, 64 nt, Human
acauucucuuaagcacccgguggcccuccgaggccuggcggaaugguggugcccacgggguugg

SEQ ID NO: 464839 - RNA, 64 nt, Human
gcugggagaauuaagcucauccucugugauuccacuggcggaggauucuuggaagcuugcacuu

SEQ ID NO: 464840 - RNA, 64 nt, Human
ugccaugcagggauauucuugaagccacacauggcuggcggaacccagagcccccaccccagcc

SEQ ID NO: 464841 - RNA, 64 nt, Human
uuccccuggguguguucuggggaccugugguuugcuggcggaaacaagugaugaggcugguuag

SEQ ID NO: 464842 - RNA, 50 nt, Human
uggaagacagcuuccuguaacuggcggauucgagggguuccuuccacuuc

SEQ ID NO: 464843 - RNA, 64 nt, Human
ggagccugcaacaugccagccacugugauagaggcuggcggauccaagcaaauggccaaugaga

SEQ ID NO: 464844 - RNA, 64 nt, Human
gcgaccuuccucauccaccccaucccuccccaguucauugcacuuugauuagcagcggaacaag

SEQ ID NO: 464845 - RNA, 64 nt, Human
aguccuuuuacagaauugaugugcuaacugaauaucauugcagcaacuagacuaagauauucaa

SEQ ID NO: 464846 - RNA, 64 nt, Human
caauaaucuauuuuaauuauuccucauuaacaagucauugcaugagaugagaaagaaggacaaa

SEQ ID NO: 464847 - RNA, 64 nt, Human
ggaggagccugguggcugccucagggcagggugccuggcggagaaggccugggcccucccacug

SEQ ID NO: 464848 - RNA, 64 nt, Human
ucagagauauaauaagcccaacaaguugaagaagcuggcggaucuagugaccagauauauagaa

SEQ ID NO: 464849 - RNA, 64 nt, Human
uugcccuggcugggguugggcuggugcagcccagcuggcggaggggcgaagcuuuggugacaga

SEQ ID NO: 464850 - RNA, 64 nt, Human
auggcugcuccccccaacaucuggaccagcugcccuggcggagagacagcaaggggccggcagg

SEQ ID NO: 464851 - RNA, 64 nt, Human
gccgagugacuuucuuagucacucccuuacucugcuggcggaguuugguuauccauuuauccuc

SEQ ID NO: 464852 - RNA, 64 nt, Human
cgcagaugagcugccccgcucccgugcccgaaaacuggcggaugaacagcucaguucugucauc

SEQ ID NO: 464853 - RNA, 64 nt, Human
cucugcacuggggcguuuccuacugcgccucgugcuggcggacgcagcugggugcagaagcugu

SEQ ID NO: 464854 - RNA, 64 nt, Human
uggcagggcugaggacccaaagucauuucccaggcuggcggagagugaguaaaugagauucuaa

SEQ ID NO: 464855 - RNA, 64 nt, Human
acccagacgauuaccggcccagcaaagucugcaucuggcggauccaggugucugagggcuucca

SEQ ID NO: 464856 - RNA, 64 nt, Human
gggagggaccgcgcaggcuccuuuguucuguauucuggcggagauggguccuggccuuguguca

SEQ ID NO: 464857 - RNA, 64 nt, Human
ucucccagugcugagugaaacgcagcacaagcugcuggcggaggcgcuggagucgcagacccug

SEQ ID NO: 464858 - RNA, 64 nt, Human
uguguuugggaaggugggugaggcugggcagggccuggcggagguggaguggccacuggcacuu

SEQ ID NO: 464859 - RNA, 64 nt, Human
gcccgaaaacuucgauauccacccugugggcagccuggcggaaaagauccaggcccuccacuuc

SEQ ID NO: 464860 - RNA, 64 nt, Human
aaaaauggcuuccaggacagagcaugcucauuugcuggcggacaguuccagaaacagacccugu

SEQ ID NO: 464861 - RNA, 64 nt, Human
cacucuuucgugaauguucuccacccaccugugccuggcggacccacucuccaguagggagggg

SEQ ID NO: 464862 - RNA, 64 nt, Human
uauacucuaaaacaugcuugaugccuugucagcaucauugcacacauugacucuguauuuacau

SEQ ID NO: 464863 - RNA, 64 nt, Human
acaccaagcuggggguggacagggcauggauucuucauugcaagugaaggagccucccagcuca

SEQ ID NO: 464864 - RNA, 64 nt, Human
aauaugugauguuaaaugcuuuaucugaguuauaucauugcauucucacaaaaaugguacauuu

SEQ ID NO: 464865 - RNA, 64 nt, Human
gcauagccaguaaugugcuaaguucauccaaaagcuggcggaccaaagucuaaauagggcucag

SEQ ID NO: 464866 - RNA, 64 nt, Human
gaaaagagagauaaagucccugccugcaugcauucuggcggaagagacaagcaagcaaugaaca

SEQ ID NO: 464867 - RNA, 64 nt, Human
aggagcuuuaaaacuaucuaucuugcauuugugucuggcggagaacuagccaucagccuccuga

SEQ ID NO: 464868 - RNA, 64 nt, Human
ugcucacuccuggcaggagaagcaucugcagcaucuggcggagguuucugcagaggugagggag

SEQ ID NO: 464869 - RNA, 64 nt, Human
accugccauggggcugcuucccucccucgcagggcuggcggaggcuccgcaucgccucucuccu

SEQ ID NO: 464870 - RNA, 64 nt, Human
gaugcagauuuagguggcagggagcgcggcagcccuggcggagggaugcaggugggccggaaga

SEQ ID NO: 464871 - RNA, 64 nt, Human
ggcggugccccugagccccccgcagcggcccgagcuggcggaagccccacggcggugaggucca

SEQ ID NO: 464872 - RNA, 54 nt, Human
gguccaacgaagccccaugagcuccuggcggaaggaacgaggcgccacaccccu

SEQ ID NO: 464873 - RNA, 64 nt, Human
agacaaacuacccagcacaggcggggcuggaauucuggcggagggcaugagccugggacuccau

SEQ ID NO: 464874 - RNA, 64 nt, Human
ucacccgcuguagccgccgagagcccaggauguacuggcggauggggccugccugcaccccggg

SEQ ID NO: 464875 - RNA, 64 nt, Human
aaccccgucucuacaauaaauacaaaaaauuauccuggcggaguuaugcacgcuuguaguccca

SEQ ID NO: 464876 - RNA, 64 nt, Human
acaccuguaaucccagcacuuugggaggcccagacuggcggaucaccugaggucaggagaucga

SEQ ID NO: 464877 - RNA, 64 nt, Human
cgcuuauuugccgugaguuuggacggcaccccugcuggcggauagcaagacucuguggaguuug

SEQ ID NO: 464878 - RNA, 64 nt, Human
gaaaugucuuuggaaugguguuuaacuaaugcugcuggcggacauccuaaaaccagaugcaucc

SEQ ID NO: 464879 - RNA, 64 nt, Human
gucuccugugcucugaugcuacuucugccuagcccuggcggaggugcaggcccugucagcugga

SEQ ID NO: 464880 - RNA, 64 nt, Human
cuguaacaauucaggguuuucccuuguuuuccucucauugcauguuucccuccaauauugguuc

SEQ ID NO: 464881 - RNA, 64 nt, Human
uggcacuauuuuuauauaugguuaaagagaccugucauugcaauaaaagccagcauucacaaaa

SEQ ID NO: 464882 - RNA, 64 nt, Human
cagugaaagaaaguucuucauauuaggacagauaucauugcaucacauuuauuuaucuuucugg

SEQ ID NO: 464883 - RNA, 64 nt, Human
acugaggggggagugcagcaguuggccugcuugucuggcggagaaagccagcucccugcacccu

SEQ ID NO: 464884 - RNA, 64 nt, Human
acuggagaaggggcugccggacccagugcucuaccuggcggagaaguucacaccgaguagcccu

SEQ ID NO: 464885 - RNA, 64 nt, Human
ccucuggugugagccguggcagccgcagcgcagacuggcggagaaggagaggaacgggcagccu

SEQ ID NO: 464886 - RNA, 64 nt, Human
auggggcccagggcagaccuucagggccagagcccuggcggaggagaggcccuuugccaggagc

SEQ ID NO: 464887 - RNA, 64 nt, Human
ggcagaccacacagaccgucugaaaugcgcccgccuggcggacagcucccuucugaagcagaga

SEQ ID NO: 464888 - RNA, 64 nt, Human
accagcgauugugguguggggcggguggaggcggcuggcggagguggcgucccggcgugcaggg

SEQ ID NO: 464889 - RNA, 64 nt, Human
gcauuucugucugaacacaaagccuguucuaguccuggcggaacacacugggggugggggcggg

SEQ ID NO: 464890 - RNA, 64 nt, Human
gcagcuccuccuacaccagcacacuggugggaggcuggcggagucagugacuauggcccccacg

SEQ ID NO: 464891 - RNA, 64 nt, Human
ggacacacaguggagacccuuuucugaaaggcaucuggcggaggaguugauguggcugcugucg

SEQ ID NO: 464892 - RNA, 64 nt, Human
ucaggaggagggcgcauguguguaucacccucagcuggcggaaccuggcugcgaacugugcagu

SEQ ID NO: 464893 - RNA, 64 nt, Human
gcugugucacuuccccaggggaggccacgugcagcuggcggacggcucugaccugagcuaugug

SEQ ID NO: 464894 - RNA, 64 nt, Human
agcauuagcugcagaaaaaccccccgacagagcccuggcggagaggcaggcgcuggggcuccua

SEQ ID NO: 464895 - RNA, 64 nt, Human
guaucgcuucuauuuugguuacuacgguaggugccuggcggaagggagugggcggagauaugua

SEQ ID NO: 464896 - RNA, 64 nt, Human
gcacaugcagucugcacgccacucuugggcucugcuggcggagauccccuuccuucugggugca

SEQ ID NO: 464897 - RNA, 64 nt, Human
aggcauguaggccugggcagguggcucggggccacuggcggagccagccuguggauccaagaga

SEQ ID NO: 464898 - RNA, 64 nt, Human
aucaagaaaccaaggagcuaauuauuaauaacaaucauugcacacugagucuuagcguuucuga

SEQ ID NO: 464899 - RNA, 64 nt, Human
acuguacagacaauacagaagauuauucuuauccucauugcauuucuaugcauaugcguaagaa

SEQ ID NO: 464900 - RNA, 64 nt, Human
gacaacaaaaguaucuucauacuuccucauccccucauugcaacaaaaccuuaaacugggagaa

SEQ ID NO: 464901 - RNA, 64 nt, Human
uugugaaucuaguuugugaggcuguggccccgagcuggcggagggagggaagaggagggaguga

SEQ ID NO: 464902 - RNA, 64 nt, Human
ccggccgaccuagugccuuguucucacccccgugcuggcggagcggacgccgcgcucugggucc

SEQ ID NO: 464903 - RNA, 64 nt, Human
ccauagccaggucuuccuggcccuugaggcugggcuggcggacaggcaccuaccucuuccuuaa

SEQ ID NO: 464904 - RNA, 56 nt, Human
ucucucuucccccagacugagcccugcuggcggacuucaaggagaagcccccacag

SEQ ID NO: 464905 - RNA, 64 nt, Human
gccaggccuccucuuccccaggcugccacccacgcuggcggagcucagggcuggggacuugucc

SEQ ID NO: 464906 - RNA, 64 nt, Human
cacggggcccugugaggcugccccacauccccaccuggcggagcucuccuccgccuugcugaga

SEQ ID NO: 464907 - RNA, 64 nt, Human
uggccccguccugggcgugugcuggguuugaauccuggcggagaccuggggggaaauugaggga

SEQ ID NO: 464908 - RNA, 64 nt, Human
uccaugggauugcaacaagcuaguuuaggaaccgcuggcggacuagaaagaauguugucgucug

SEQ ID NO: 464909 - RNA, 64 nt, Human
aaccccucucugggugguuuggggcuggugcugccuggcggaaggacagugagggcggcccuag

SEQ ID NO: 464910 - RNA, 54 nt, Human
aucugggcacuuacuacuaaagaccuggcggaggcuuuucccaucagcgugcau

SEQ ID NO: 464911 - RNA, 64 nt, Human
ugggcuucugagcugguggcccuggcccagaggucuggcggaggcccaggcagcagccauggcg

SEQ ID NO: 464912 - RNA, 64 nt, Human
uagagcccaggcuccagcccugagugcuuccgagcuggcggacugcccaggggccaucagagga

SEQ ID NO: 464913 - RNA, 64 nt, Human
ccguccccacccaccugccuuccggcccggcucccuggcggagccagaacccagggaguugccc

SEQ ID NO: 464914 - RNA, 64 nt, Human
acuugggaggcugcagcuguggcuguggcugaagcuggcggaucgcuugaggcccagagucuaa

SEQ ID NO: 464915 - RNA, 64 nt, Human
ugggcuucaacagccaagcuggcacaaaagacagcuggcggaggcugcucggcuacugguuacc

SEQ ID NO: 464916 - RNA, 64 nt, Human
aaaagauacuuuaccagguauguauugcauuauaucauugcaauaauuauuggaagucuagaua

SEQ ID NO: 464917 - RNA, 64 nt, Human
aacaaaaugccacguaaccaaagcaucagagccaucauugcacgugucuuuuuuucuuuuuucu

SEQ ID NO: 464918 - RNA, 64 nt, Human
cagaguaguucaugauaaauugaaaauauaauggucauugcagaaaaugauugauguuguaacu

SEQ ID NO: 464919 - RNA, 64 nt, Human
agcuggugccuggagugggcccugugcaccucaccuggcggaggcuggggggggcucugucagc

SEQ ID NO: 464920 - RNA, 64 nt, Human
cucugggccugugugagcucucugugagcucuggcuggcggagaagggcagguguccggagcug

SEQ ID NO: 464921 - RNA, 64 nt, Human
ggaugauuacccuccuaggaccgcgguggcuaagucauugcaggaacggggcuguguucucugc

SEQ ID NO: 464922 - RNA, 64 nt, Human
ugccaaggcuggagugcaguggcgcaaucuuaacucauugcaaccuccaccuucuggguucaag

SEQ ID NO: 464923 - RNA, 64 nt, Human
auucauagcauucaggccuuccaugaacagaucgucauugcaguuaaagcuccagcagaaacca

SEQ ID NO: 464924 - RNA, 64 nt, Human
guggggucgcggaagggaauggauagacuggugugcucaaaagagagagaucacucaaaugauu

SEQ ID NO: 464925 - RNA, 64 nt, Human
cagugagacccugucucaaaaaaaggaaaaaaaagcucaaaaaguucuguguugccuuucucuu

SEQ ID NO: 464926 - RNA, 64 nt, Human
uuaucuagacagcagugcacuccccuaagucucugcucaaaaaaaaaacaauucucggcccaaa

SEQ ID NO: 464927 - RNA, 64 nt, Human
caagagaaucacaugcagcucugcaacaguuuuugcucaaaaauguuacugacuaaagcaacug

SEQ ID NO: 464928 - RNA, 64 nt, Human
uuuuuuuccaauaccugugcaagauacauguguagcucaaaacuauuugugaucuacuguuugc

SEQ ID NO: 464929 - RNA, 64 nt, Human
cuugaugcugcugccaugaucccuuugagagguggcucaaaagcuacagggaacuccagguccu

SEQ ID NO: 464930 - RNA, 64 nt, Human
uggguuuacucuuagaaucgcaugcuguagaaaugcucaaaagugcauaugggacucaguccuu

SEQ ID NO: 464931 - RNA, 64 nt, Human
caucuacgcaugugggacccucguuaucgcuguugcucaaaauguauuuuaugaaucauccuaa

SEQ ID NO: 464932 - RNA, 64 nt, Human
ggguggccacaggcuagauccccggugguuuugugcucaaaauaaaaagccucagugacccaug

SEQ ID NO: 464933 - RNA, 64 nt, Human
guuucugauguguuccaugagaaaaggauuguuugcucaaaaagcuuggaaaauacuacacacu

SEQ ID NO: 464934 - RNA, 64 nt, Human
gucccuuacacguaccucucaucaguguccucuugcucaaaaaucuguuugaucccuguuaccc

SEQ ID NO: 464935 - RNA, 64 nt, Human
ucaacauuuuaggaauuuauuucugcugucuagugcucaaaacuugcagcuagaauugagggaa

SEQ ID NO: 464936 - RNA, 64 nt, Human
aggucacugcgaggcacuuaccauguagauacgggcucaaaagucaccucucagagaccuacgu

SEQ ID NO: 464937 - RNA, 64 nt, Human
cuucuugggccucugggcacagagccaauguucgucauugcagcucucagcaaacugggucaua

SEQ ID NO: 464938 - RNA, 64 nt, Human
uagaaaagugaauugaaguuucaaguuuuaaaguucauugcaauuaaacuuccaaagaaaguuc

SEQ ID NO: 464939 - RNA, 64 nt, Human
gaaaugccacacacauagaacuccaacaucaauuucauugcacagacugacuguaguuaauuuu

SEQ ID NO: 464940 - RNA, 64 nt, Human
gcccuaugcaguucugagaagguggaggcaccaggcucaaaagaggaaauuuagaauuucucau

SEQ ID NO: 464941 - RNA, 64 nt, Human
aucucuagcauuucucuagccuuccuuuucugcugcucaaaaauaaucguuacaaagcuuaggu

SEQ ID NO: 464942 - RNA, 64 nt, Human
cauuucccuugaguuucauugaugucgaugcagugcucaaaaucucagauuuuggagcauuuug

SEQ ID NO: 464943 - RNA, 64 nt, Human
ugcucaggagccuggcaacaagagcaaaacuccagcucaaaaaaaaaaagaaagaaaagaaagc

SEQ ID NO: 464944 - RNA, 64 nt, Human
cucacaguuguuagaaguaguaaguuaguuacuggcucaaaaaugauucuguugaaaggauguc

SEQ ID NO: 464945 - RNA, 64 nt, Human
uuuaauuguauauuauucaagcaccuuuguugaagcucaaaaaaaaugaugccucuuuaaacuu

SEQ ID NO: 464946 - RNA, 64 nt, Human
acaucauauguacacuuauaaauguauauagaaugcucaaaaauaaaauucuuaauaauagaac

SEQ ID NO: 464947 - RNA, 64 nt, Human
gcaauccccuuuugguagaauugccacaaacaaggcucaaaauucucaucaucucuguuauaca

SEQ ID NO: 464948 - RNA, 64 nt, Human
cacacuuaguuuguuggucuuauguaaaacauuggcucaaaauaaaguacacacugauuuauuu

SEQ ID NO: 464949 - RNA, 64 nt, Human
uccuuacuuuuaaggauaaaucauaaagucaguugcucaaaaagaaaucaauaguugaauuagu

SEQ ID NO: 464950 - RNA, 64 nt, Human
ugucaucaaggaggcaaauugucuccccaagacagcucaaaauauccacaccucggcaacaguc

SEQ ID NO: 464951 - RNA, 64 nt, Human
ggagacuaauccuuuuagauaguagcuuuuugaugcucaaaacaucacauuuaaauuuaguuua

SEQ ID NO: 464952 - RNA, 64 nt, Human
guuucaagggguuggguauuacugacgagcuuuggcucaaaauauagcaggaccaggucuuuug

SEQ ID NO: 464953 - RNA, 64 nt, Human
gacaaagguguuuugccagagagauaaaauuuuugcucaaaaccagaaaaagaauuguaauggc

SEQ ID NO: 464954 - RNA, 64 nt, Human
ggcauccccgccauccccccacuuagagcuaugugcucaaaaagccaacaugaaugcaguggua

SEQ ID NO: 464955 - RNA, 64 nt, Human
augcuuggcuggaacuuuguguucacagacuuagucauugcauaccaaaaccauauuuacugga

SEQ ID NO: 464956 - RNA, 64 nt, Human
uauuuuuuauauuacauuaaaauagaguugucagucauugcaucugcccauacaucuucugaga

SEQ ID NO: 464957 - RNA, 64 nt, Human
caggaggcagagguugcagugagcugagaucgcaucauugcacugcagucugagugacagagug

SEQ ID NO: 464958 - RNA, 64 nt, Human
cauguucuaauuauaaaugaccaaaaucaagauugcucaaaaggguaaaugauagccacaguau

SEQ ID NO: 464959 - RNA, 64 nt, Human
uuaaagaguuaggaugagccaccagaauaugccugcucaaaauuaauagcacagcaguuuggag

SEQ ID NO: 464960 - RNA, 64 nt, Human
ucaggccuauguuuugcuuauauuguuuucaggugcucaaaaugcaaaacacaaaacaaauccu

SEQ ID NO: 464961 - RNA, 64 nt, Human
auuccuuauccuagccuuugggcacaauuccugugcucaaaaaugagagugacggcuggcaugg

SEQ ID NO: 464962 - RNA, 64 nt, Human
auacacauacacgguauucccaagagugguggcagcucaaaaugauauguuugaguagacgaac

SEQ ID NO: 464963 - RNA, 64 nt, Human
auguaguggguguaaaaccagagauuauuuguaugcucaaaauaguuauauauucauuaaugaa

SEQ ID NO: 464964 - RNA, 64 nt, Human
uauuuucacauaguauaguacucuggauguaaaagcucaaaaauugugauuccuugaacguuca

SEQ ID NO: 464965 - RNA, 64 nt, Human
ccaugccaauuguucuuauauucuauagaaguucgcucaaaauacucaacaggggaauaggcag

SEQ ID NO: 464966 - RNA, 64 nt, Human
gagaguaagaaacagcauggagaaaacccgguacgcucaaaaagaaaaaggaaaaaaaaaaauc

SEQ ID NO: 464967 - RNA, 64 nt, Human
gguuugggauuuuuuuuguuuuuguuuuuuugaggcucaaaaaaugcugggagaaaugaaaaug

SEQ ID NO: 464968 - RNA, 64 nt, Human
aguuguucugucuuuagauaagguuugaaccaaagcucaaaacaaucaagacccuuuucuguau

SEQ ID NO: 464969 - RNA, 64 nt, Human
guuuuccuuuagaaacacacacacccuuccucuugcucaaaagaucucacuccaugauacugug

SEQ ID NO: 464970 - RNA, 64 nt, Human
cacaaaacaacccuagaguguuguugagaauugugcucaaaauuugaagaaugaacaaauugaa

SEQ ID NO: 464971 - RNA, 64 nt, Human
aggacaccacguggccauuuuccuucaacugagggcucaaaacuccuggacaaguugcuggcuc

SEQ ID NO: 464972 - RNA, 64 nt, Human
uuuugaacuuugaggacuguuggucagaaaaugggcucaaaagugaguuugcuuaaugaagaca

SEQ ID NO: 464973 - RNA, 64 nt, Human
augcaguuuuaauuaucuuagucuauagaaaugaucauugcauggaggcauguauagguaugau

SEQ ID NO: 464974 - RNA, 64 nt, Human
gaccggaucauuuuagugucuuugcguuaaaaaaucauugcaaaaguauucugaacugucaagc

SEQ ID NO: 464975 - RNA, 64 nt, Human
cugcgcuguauuuuggcguuucuaauaaugacguucauugcacagaaguccuucuggcugcagg

SEQ ID NO: 464976 - RNA, 64 nt, Human
aagugaccaccaaauuguuauuugcacuaacaaagcucaaaacacgauaaguuuacuccuccau

SEQ ID NO: 464977 - RNA, 64 nt, Human
aaaaugacaggucucagaaagggggagcucaauagcucaaaagugacaaguccuuuucacagca

SEQ ID NO: 464978 - RNA, 64 nt, Human
aagcacaaaauguuguauauagagucaaagucaggcucaaaagaagaauuaagagacucaagac

SEQ ID NO: 464979 - RNA, 64 nt, Human
auacaaaguggaggccacugccuucugacaucuggcucaaaagcccagugucuguuuccauuua

SEQ ID NO: 464980 - RNA, 64 nt, Human
auagaaaaccacagaucagggauucauauauguagcucaaaaauucccaaaaguuuacuguuag

SEQ ID NO: 464981 - RNA, 64 nt, Human
caaagauuuucaguuaaaguagcauuauguaaaggcucaaaacauuacccuaacaaaguaaagu

SEQ ID NO: 464982 - RNA, 64 nt, Human
agcgagaacgaaaucucucauugugugccguguggcucaaaaccgaaaacaaugaagcuugguu

SEQ ID NO: 464983 - RNA, 64 nt, Human
uuuuguuuuaauaaaaugugucacugauuuuuuagcucaaaaucaucacuguuaauuuccaguc

SEQ ID NO: 464984 - RNA, 64 nt, Human
uauguaucucccaaauauguucaauucuuaugucgcucaaaaaauaaaauuuaauuuaaaaagu

SEQ ID NO: 464985 - RNA, 64 nt, Human
cuucauucaguaugcuucauucaccgaacuuugugcucaaaaugcguauauaccauuuuauguu

SEQ ID NO: 464986 - RNA, 64 nt, Human
auccuuggucccagagauguuuagacaauuuuaggcucaaaaauuaaagcuaacacaggaaaag

SEQ ID NO: 464987 - RNA, 64 nt, Human
uucacauaaacacauacauugccaauuuuccagggcucaaaaaguuuccuuuuauucauauuuu

SEQ ID NO: 464988 - RNA, 64 nt, Human
ugucaguaugacauuucacgggagauuucuuguugcucaaaaaaugagcucgcauuugucaaug

SEQ ID NO: 464989 - RNA, 64 nt, Human
gugugggggguuucaaggguguguuaggaacaacgcucaaaauccuaaggaaacugaacacucg

SEQ ID NO: 464990 - RNA, 64 nt, Human
aaggaauuauaaaaacaaaugaguucuuccuucugcucaaaaauauugaauuucuuguccuugu

SEQ ID NO: 464991 - RNA, 64 nt, Human
auaauaggacuuuaaaauagguucaagauauuauucauugcaguaugaguugccacuggauuga

SEQ ID NO: 464992 - RNA, 64 nt, Human
ccgcucgucugugugggugaugauuaaagcauucucauugcacaguucuguuuuuaaauacaga

SEQ ID NO: 464993 - RNA, 64 nt, Human
ugcccaggauggagugcaguggugagaucacggcucauugcagccucgaccucccaggugaucc

SEQ ID NO: 464994 - RNA, 64 nt, Human
ccuggagcauuguguguggugaaguaaaauaaaggcucaaaacgugacggcaacccggcaaaag

SEQ ID NO: 464995 - RNA, 64 nt, Human
auugggagguuuugaaaaaccaguuaauuuaauagcucaaaauugucccugauuuuauuuucuu

SEQ ID NO: 464996 - RNA, 64 nt, Human
uauuaaaccuauugguauaucauaggucauguuagcucaaaaaaacuuuacugcacacuacuga

SEQ ID NO: 464997 - RNA, 64 nt, Human
uacccccuccuucagacacccucaaccucuucuggcucaaaaagagaauugggggcuuaggguc

SEQ ID NO: 464998 - RNA, 64 nt, Human
auguuuuucccaccugucagaugaaaaaacugaagcucaaaaaggguugacuugaccauacagc

SEQ ID NO: 464999 - RNA, 64 nt, Human
ugcucagcgccgggccugaggaccuggagccgccgcucaaaaggaggugccuccgaauuagaaa

SEQ ID NO: 465000 - RNA, 64 nt, Human
ccugcaggcccccaggcacuuuuuuuuuuggauggcucaaaauauggugcugcuuuauauaaac

SEQ ID NO: 465001 - RNA, 64 nt, Human
aaaaaaaaaaaaaaagaacuaccuugugaguuuugcucaaaauguggccuaaguagccauuggc

SEQ ID NO: 465002 - RNA, 64 nt, Human
aagaaaauauaauggaugggcuccauuaaaaccagcucaaaaauaaauucuugucaguaaagau

SEQ ID NO: 465003 - RNA, 64 nt, Human
agcgagagaacucugcacuaugaacccaaacccagcucaaaaagauaaaaucuagucauuuaag

SEQ ID NO: 465004 - RNA, 64 nt, Human
uaguuaugugaaaggcaaauagagucauacaguagcucaaaaggcaaccauaauucucuuuggu

SEQ ID NO: 465005 - RNA, 64 nt, Human
agaccucaccuggucuccacguuuccacgucccugcucaaaaccaaauccauuccugccuucug

SEQ ID NO: 465006 - RNA, 64 nt, Human
gguuggagcaggggcccucaaaggcccagcuccugcucaaaaaaaaaaaaaaaaaaaaauuaaa

SEQ ID NO: 465007 - RNA, 64 nt, Human
auguaugccgguccuacucacgcgacacccgugugcucaaaaaaguuauuuguuuuuguuacgu

SEQ ID NO: 465008 - RNA, 64 nt, Human
cacucagugcaacauugagaauuuuuuuuuaauggcucaaaaauggaaacugaaagcaagucau

SEQ ID NO: 465009 - RNA, 64 nt, Human
uucccaagcuucuguauugaaaaacaauuaggaaucauugcagauuuuuuuuuauucugcuccc

SEQ ID NO: 465010 - RNA, 64 nt, Human
auuuaacugcaaggaauuagaagcauauuugcaaucauugcagcuucuucuuucuucugcucau

SEQ ID NO: 465011 - RNA, 64 nt, Human
cuaucagcacugaaaacucuuuugcauuaagggaucauugcaagagcagcgugacugacauuau

SEQ ID NO: 465012 - RNA, 64 nt, Human
agaaacagaauuugaaauauuucauccuugucaugcucaaaauuuuguuacaugcuuguuauuc

SEQ ID NO: 465013 - RNA, 64 nt, Human
ccuggcagcacaggaaaagaauuuuuuuuuuuaagcucaaaaucuagaagagucuauugucucc

SEQ ID NO: 465014 - RNA, 64 nt, Human
guacuuuuuaagguuuuaugggaggcugugcauugcucaaaagcuguugggaacgccuucugaa

SEQ ID NO: 465015 - RNA, 64 nt, Human
gacugcuauaaauuucuugugauacucuuuuagagcucaaaauaucucugagcuuuagacaugg

SEQ ID NO: 465016 - RNA, 64 nt, Human
guauuaaauauuuuacuucuuuccauaaagaguagcucaaaauaugcaauuaauuuaauaauuu

SEQ ID NO: 465017 - RNA, 64 nt, Human
cuugguccugucccuuggaaccuuuguacgcuuugcucaaaaaaaaacaaaaaaaaaaaacaaa

SEQ ID NO: 465018 - RNA, 64 nt, Human
gacaguucauacaguaugaugccauuuuuauaaagcucaaaaccaaauauguguggaauucaua

SEQ ID NO: 465019 - RNA, 64 nt, Human
acacugggcuguuugcacagcuccaacugugcaugcucaaaaugugcacuuuuuaaaauuguua

SEQ ID NO: 465020 - RNA, 64 nt, Human
gugggaaaccuacaucuggcuagugcuuacauuugcucaaaaagcauguuguaugaagcugacu

SEQ ID NO: 465021 - RNA, 64 nt, Human
ggcuacuggugagauugagaucugagcaggcaaagcucaaaagagaguuuggagguuaaaaaua

SEQ ID NO: 465022 - RNA, 64 nt, Human
aaaauguauuuccccuuguggcuuucaaccaccugcucaaaaaaagagacuuguuacaugaaag

SEQ ID NO: 465023 - RNA, 64 nt, Human
aaucucagaaaagcauuauauuaauuuucuucaugcucaaaaccaguuuuuuuuuccugaugaa

SEQ ID NO: 465024 - RNA, 64 nt, Human
uauuggcuguuaaauuggccugcuccagagacuggcucaaaaaagaaagaagcaacgaaaacaa

SEQ ID NO: 465025 - RNA, 64 nt, Human
aagaggguucacacagcccaguucccgugacgaggcucaaaaacuugaucacaugcuugaaugg

SEQ ID NO: 465026 - RNA, 64 nt, Human
uaauuaauuuauguagaguccuuuuuuccaaagagcucaaaacacuacauccacauuauugacu

SEQ ID NO: 465027 - RNA, 64 nt, Human
cugaaaucuucccaugcauucuggucaagggcugucauugcacauaagcuuccauuuuaauuuu

SEQ ID NO: 465028 - RNA, 64 nt, Human
uaauauaaagcauaucaaguuuaugugauacguaucauugcaagagaauuuguuucaagauuuu

SEQ ID NO: 465029 - RNA, 64 nt, Human
uagcuauuugaugcuuuucauauaggccaagaacucauugcaaaacauuuuugcaaggaugaau

SEQ ID NO: 465030 - RNA, 64 nt, Human
uauguucagaacucuuuccacuggacugguauuugcucaaaaauaaauaaugguagagaagaaa

SEQ ID NO: 465031 - RNA, 64 nt, Human
cuuugcccuguugguaaggauuuuaaauaaccaugcucaaaagagcuguucuaaucugcguuuu

SEQ ID NO: 465032 - RNA, 64 nt, Human
gguuaauguagaaauguuuguuuauucuguuacagcucaaaauggaggcugagaaucucuacca

SEQ ID NO: 465033 - RNA, 64 nt, Human
uacuggaauucaaugucaagagaaaaugaccucugcucaaaagggagaagagucucaauuucag

SEQ ID NO: 465034 - RNA, 64 nt, Human
guuagaguuaguggauuucuaguuuaggagaggagcucaaaacuauaaucuuuaacaaauugaa

SEQ ID NO: 465035 - RNA, 64 nt, Human
cccacaauaacuucucccccucucuuuuuacucugcucaaaaagcaucucuccucccauuaccc

SEQ ID NO: 465036 - RNA, 64 nt, Human
aaagguaacaaagggcagcucagugguuacucaagcucaaaaggguuuuuuuaagagcaagcau

SEQ ID NO: 465037 - RNA, 64 nt, Human
agucuuaauguuucugguuaugacagauaaguuugcucaaaaaauguggaugaagccauuauug

SEQ ID NO: 465038 - RNA, 64 nt, Human
uaacauggaauacaagcuugaaucugggaaacaagcucaaaaaacagugaaaaaaaaaguacug

SEQ ID NO: 465039 - RNA, 64 nt, Human
uucugcugcugagcuugcagaaaaagaaaaaugagcucaaaauuugcuuugagagcuacaggga

SEQ ID NO: 465040 - RNA, 64 nt, Human; identical to SEQ ID NO: 465039

SEQ ID NO: 465041 - RNA, 64 nt, Human
gugcuaguuuuacagauugccuccuuaugacgcggcucaaaaggaaaccaaguggucaggaguu

SEQ ID NO: 465042 - RNA, 64 nt, Human
gcaucauauuuucauucacaacuaugaaaucgcugcucaaaaaugauuuuauuaccuuguuccu

SEQ ID NO: 465043 - RNA, 64 nt, Human
gugaaagcuccgucuucugaauucaucucuacaggcucaaaacuccucuuugauaucagaccug

SEQ ID NO: 465044 - RNA, 64 nt, Human
aauucucagguaggaagcaacagcuucagaaagagcucaaaauaaauuggaaaugugaaucgca

SEQ ID NO: 465045 - RNA, 64 nt, Human
guggaucugcagugcuucacuggaaauaauuuauucauugcagauacuuuuuagguggcauuuu

SEQ ID NO: 465046 - RNA, 64 nt, Human
ccagcgcaugcaggacuggucucuaaugcuguggucauugcacagaagggaaaggucucaagga

SEQ ID NO: 465047 - RNA, 64 nt, Human
uauacauauauauaaauauaaauauaaauauaucucauugcagccagugauuuagauuuacagu

SEQ ID NO: 465048 - RNA, 64 nt, Human
aggaaaauggacaucaaaaucaacuuaaggguaggcucaaaacaggguuguuguuguuuuuuua

SEQ ID NO: 465049 - RNA, 64 nt, Human
agccaguugcuucuucagcugaccgggcucacuugcucaaaacacuuccagucuggagagcugu

SEQ ID NO: 465050 - RNA, 64 nt, Human
uaugagagccaaguagucaguggaagagaguagagcucaaaacuggauuaucaccuuagcaacu

SEQ ID NO: 465051 - RNA, 64 nt, Human
augcuguagugacauccuuuauaggcaccuuacagcucaaaacuuuuguuucauuucaugccuu

SEQ ID NO: 465052 - RNA, 64 nt, Human
uagaauugggaacugauacaugugucccuuauaggcucaaaaauuauaucuuacaauuucuuau

SEQ ID NO: 465053 - RNA, 64 nt, Human
auuuuaaguauauccuuuaaaggacuggggguuugcucaaaaggaaauccaaaaccuauucuaa

SEQ ID NO: 465054 - RNA, 64 nt, Human
caugaugcuagccagcaaagaugugaaaauaucugcucaaaacuuucaaaguuuaguaaguuuu

SEQ ID NO: 465055 - RNA, 64 nt, Human
ugaaggaaaauauaaaaaaaaagucgacugcuaugcucaaaaaguaaaaaaagcucaacaguua

SEQ ID NO: 465056 - RNA, 64 nt, Human
ucagcucugccucuguucuuucaacuccuuugaggcucaaaaaaaacacaaagaucagaagccu

SEQ ID NO: 465057 - RNA, 64 nt, Human
gugucugcugacuguuucauucacugugcacuuugcucaaaauuuuaaaaauaccaaucacaag

SEQ ID NO: 465058 - RNA, 64 nt, Human
guuugacuauuauauauguguaugcauuuuacuggcucaaaacuaccuacuucuuucucaggca

SEQ ID NO: 465059 - RNA, 64 nt, Human
uuaacugagagauuaaaggaacagcagcacuuaggcucaaaaucgccccuacaaagcaguaguu

SEQ ID NO: 465060 - RNA, 64 nt, Human
cucaagaaaacuugaauuauuugggggaaaguaggcucaaaagagaauauaucuuucacauuca

SEQ ID NO: 465061 - RNA, 64 nt, Human
gaccugaaaggaucacacugcauccuaggacaaagcucaaaaguaccucugggacuacaaaaau

SEQ ID NO: 465062 - RNA, 64 nt, Human
ggagcggcaaacugggacaugcagaauugaauuugcucaaaaaagaugaaaggaaaugcaaacu

SEQ ID NO: 465063 - RNA, 64 nt, Human
aaauaauucaucuguuguauuuagagaaccauauucauugcaugcaaauuuuauuguuaguguu

SEQ ID NO: 465064 - RNA, 64 nt, Human
uucucuguuuacccuaaauccucccagaauggagucauugcacugagugaccugcuuccugauu

SEQ ID NO: 465065 - RNA, 64 nt, Human
uaaccauacugauugaauccccagggacauuccaucauugcaauagcucagauuuuucuuccuu

SEQ ID NO: 465066 - RNA, 64 nt, Human
ccauuuucauguuacuuuguagccuuggccagaggcucaaaaaggacacaaccaguuuggggaa

SEQ ID NO: 465067 - RNA, 64 nt, Human
acaaagcacucuaagggagauggggcugaggacagcucaaaaaggagaggacaggccuggcagg

SEQ ID NO: 465068 - RNA, 64 nt, Human
ggaaguaagaaguuuuauuuuaaguacuuucagugcucaaaaaaaugcaaucacuguguuguau

SEQ ID NO: 465069 - RNA, 64 nt, Human
auccaguugauugcuccucuggcagagagaaggagcucaaaagauacuugaugucuuucaugua

SEQ ID NO: 465070 - RNA, 63 nt, Human
guacugaugcagggguauagcuugcccucacuugcucaaaaacaacuaccuggagaaaacagu

SEQ ID NO: 465071 - RNA, 64 nt, Human
aauaaggugagagaccauuucagaaugcacuguugcucaaaaaggugaucugguucuuucuuca

SEQ ID NO: 465072 - RNA, 59 nt, Human
ucaaagccagccaggacuagugaaccacagcucaaaaggcaaaagaagacaaaagcccc

SEQ ID NO: 465073 - RNA, 64 nt, Human
auagccucaggccuucauuucugaaaagaaaaaagcucaaaaagcugcugaauuucucugggag

SEQ ID NO: 465074 - RNA, 64 nt, Human
guucucuuacugucagaaucucucuugcaguacagcucaaaauaguggaugcauuucaaacuug

SEQ ID NO: 465075 - RNA, 64 nt, Human
guauugauuuaaauauauuuuauuuaacccaauagcucaaaaacacuaucauuucaacauagga

SEQ ID NO: 465076 - RNA, 64 nt, Human
cacacuccagccuggguggcaaagugagacucuggcucaaaaaaaaaaacaaaaaacaaaacca

SEQ ID NO: 465077 - RNA, 64 nt, Human
cuccagacugcuucccguccaaguuaccaggacagcucaaaaacaugcugacagaaaacuccca

SEQ ID NO: 465078 - RNA, 64 nt, Human
uagaccucucacaugcagcucagagcucccaagagcucaaaagcagaaauggccaggccuucug

SEQ ID NO: 465079 - RNA, 64 nt, Human
uauuggcuagguagggucaccuagggaagcacuugcucaaaaucugugaccugucagaauaaaa

SEQ ID NO: 465080 - RNA, 64 nt, Human
uggaugcccacuuuccaugcagcagcauuucauugcucaaaaccauccuuccuuuccuuucgcc

SEQ ID NO: 465081 - RNA, 64 nt, Human
agauuucagaguacaggucugguacaaucacaguucauugcagccucaaccuccuggguuuaag

SEQ ID NO: 465082 - RNA, 64 nt, Human
caguguaaaccuuuuuaaugcaaauuuauuuuuuucauugcauauuuugcagauuuuauccaca

SEQ ID NO: 465083 - RNA, 64 nt, Human
ucauuuuuuacugucagaaaagauaccccuuuugucauugcaacuauuuuuuaaauccagaaau

SEQ ID NO: 465084 - RNA, 64 nt, Human
auggucuagcauuaggaacaugugaagcuaaucugcucaaaaagaucaacaaauuaauauuguu

SEQ ID NO: 465085 - RNA, 64 nt, Human
uguauauguuuaauaacucaccuucucuauccuugcucaaaaugugggauaacgcgaugacugu

SEQ ID NO: 465086 - RNA, 64 nt, Human
uuggcuaagaacaccuaaauuuuuauguuucuuggcucaaaaaccaguuccauuucuaauguug

SEQ ID NO: 465087 - RNA, 64 nt, Human
aaaucucauauaauguuucucaaucuuguuaaaagcucaaaauuuugggccuauuuguaaugcc

SEQ ID NO: 465088 - RNA, 64 nt, Human
guagaaagaaaaccaacuguggucauccagagaagcucaaaaacucuuguacucagguucucuu

SEQ ID NO: 465089 - RNA, 64 nt, Human
ucaucugugaacugcuuucugcuauauagaacuagcucaaaagacuguacauauuuacaagaaa

SEQ ID NO: 465090 - RNA, 64 nt, Human
uuccuuuaauuuuuuaauucuuuacuguggaauagcucaaaauguccauucuguuuuaaguaac

SEQ ID NO: 465091 - RNA, 64 nt, Human
uuucauuggagaauuuacaaaaauaucaucuacagcucaaaagucccacuaacggcuuauauga

SEQ ID NO: 465092 - RNA, 64 nt, Human
cuuugagaugcacuaaaguuuuguuucagcaguggcucaaaaaauuucagaaauuacuuuugua

SEQ ID NO: 465093 - RNA, 64 nt, Human
uccuaagccaagagucaugucaaauugcaaucaggcucaaaaccagagaccaggcugugaaauc

SEQ ID NO: 465094 - RNA, 64 nt, Human
ucagccaauuuuguagcuaagauuguucugaucagcucaaaaagauuuggcuuaguguuuucau

SEQ ID NO: 465095 - RNA, 64 nt, Human
ucacaguacuccauuuugggguccaaacuguaaugcucaaaauaauaaaugcuuacacgaaaau

SEQ ID NO: 465096 - RNA, 64 nt, Human
uuacugccuuaauaaaaaaugaaaagagaaugaugcucaaaaucuuuccaaauaaaauguuccc

SEQ ID NO: 465097 - RNA, 64 nt, Human
gcagcaaagaaaagugacuucuuuucauuucucagcucaaaacuucuuaagccgugucucuucc

SEQ ID NO: 465098 - RNA, 64 nt, Human
aacagacaaaauuauuguuaacauggauguuacagcucaaaagauuuauaaaagauuuuaaccu

SEQ ID NO: 465099 - RNA, 64 nt, Human
uacuuugcuaacugugcuccucacuuccucuucuucauugcaguuauuuagauccccccuuucc

SEQ ID NO: 465100 - RNA, 64 nt, Human
cagacccauaaaccaccucccaaaggcugucauuucauugcacuggaauuuugcuuuaucagaa

SEQ ID NO: 465101 - RNA, 64 nt, Human
uuggucaaggcaggcaucucuguucucugaacauucauugcacuuucccaccucuauaccuugc

SEQ ID NO: 465102 - RNA, 64 nt, Human
aauagaaagguugcaauuauauaggccauggguggcucaaaacuuugaacauuugagcuuaaac

SEQ ID NO: 465103 - RNA, 64 nt, Human
caggaguguaacagauaccagugguguguugcaugcucaaaacagcagcgucgucauugaaguc

SEQ ID NO: 465104 - RNA, 64 nt, Human
gaaaucaucugauguuucuauagucacuuugccagcucaaaagaaaacaauacccuauguaguu

SEQ ID NO: 465105 - RNA, 64 nt, Human
gcauucuuagcaaaauugccuaguauguuaauuugcucaaaauacaauguuugauuuuaugcac

SEQ ID NO: 465106 - RNA, 64 nt, Human
uacuaugaagaucaaagucuuaaguguguuugcagcucaaaaauaaagauguauuaagggggga

SEQ ID NO: 465107 - RNA, 64 nt, Human
cauugcuuucuuuuuaacuugaaguagcaugaaggcucaaaaguuuuguuggguacuuuuaauu

SEQ ID NO: 465108 - RNA, 64 nt, Human
augugaacauacauuuucauuuucugggauaaaugcucaaaagggcaacuguuggguuguaugg

SEQ ID NO: 465109 - RNA, 64 nt, Human
cauauuuuauaaacuuaugcagagcacuuuuauugcucaaaaguucugaauucauacagaaaac

SEQ ID NO: 465110 - RNA, 64 nt, Human
cacaagagugcuuuaaugaugacauuuagcaagugcucaaaauaauugacagguuuuguuuuuu

SEQ ID NO: 465111 - RNA, 64 nt, Human
aguaccgggaggcugcccggcuagaaaucaacgugcucaaaaaaaucaaggagaaggacaaaga

SEQ ID NO: 465112 - RNA, 64 nt, Human
uuugugguaguaaucuaauaccuuaaccccacaugcucaaaaucaaaugauacauauuccugag

SEQ ID NO: 465113 - RNA, 64 nt, Human
cuguucuggaggcaccagaccuugaaaagaacaugcucaaaauaaaauguuaucuguuauuuuu

SEQ ID NO: 465114 - RNA, 64 nt, Human
ugacaagcaagacccucccuccaaagaaaauaaagcucaaaauaaaauaugauuuguguucaug

SEQ ID NO: 465115 - RNA, 64 nt, Human
uuaaaggccugaaaugcuaccauuucuuccucuggcucaaaauucuucccuggggagagaguua

SEQ ID NO: 465116 - RNA, 64 nt, Human
aaugcaggcuggauucuuauuauauacagagauggcucaaaaaugggguuucagaucuuuguga

SEQ ID NO: 465117 - RNA, 64 nt, Human
uauuuccguuuucccccuaaagaacauaucauaaucauugcacaaauaaccauguucuuuggua

SEQ ID NO: 465118 - RNA, 64 nt, Human
aaacuugaacaaugaaaagcagaaugaaaaugagucauugcaacgacuuucacaaaauucagcu

SEQ ID NO: 465119 - RNA, 64 nt, Human
ucaguguaaagagguaacauaaacggauacugccucauugcacuccccaaaagagagucaggag

SEQ ID NO: 465120 - RNA, 64 nt, Human
ggcucccaacacauccccagcaggccucucuugggcucaaaagccaagcugugcccagccacgu

SEQ ID NO: 465121 - RNA, 64 nt, Human
gccucuuccugaggcagaaaauuggauuacuaaggcucaaaacuaaaagagaugucagcauugu

SEQ ID NO: 465122 - RNA, 64 nt, Human
aguguggggguuucaaggguguauuaggaauaacgcucaaaauccuaaggaaauugaauacucu

SEQ ID NO: 465123 - RNA, 64 nt, Human
aagaugguguauguuuguaaaaauauucuucugggcucaaaagcuagcuugagggggcagaugc

SEQ ID NO: 465124 - RNA, 64 nt, Human
acuucuaaaccaucaggucggugccauaagagaugcucaaaaaagcauggucagggcuuagcaa

SEQ ID NO: 465125 - RNA, 64 nt, Human
uggcaccuagcauggugcacagcacauuagaagugcucaaaaacaucugaugacugacuaaaga

SEQ ID NO: 465126 - RNA, 64 nt, Human
caucuaccugcugacagagcaugacaaagaugacgcucaaaaguaaugccauuacuucuuuuuu

SEQ ID NO: 465127 - RNA, 64 nt, Human
guacgugguguuauuauugaaauguauuguuugagcucaaaaggcccgaccaccccccuucggg

SEQ ID NO: 465128 - RNA, 64 nt, Human
uaguauuagcauagcauucuuaaaggaaugcagugcucaaaaccuacccaaauucccgcaggau

SEQ ID NO: 465129 - RNA, 64 nt, Human
ucaccuuuauuucaucuucauaagaaugagaaaggcucaaaaggaagcacuuuuagaaaucuuc

SEQ ID NO: 465130 - RNA, 64 nt, Human
aaccacuacaucccagcuaccuauaaugcugucagcucaaaaucauagccagguaguucuugaa

SEQ ID NO: 465131 - RNA, 64 nt, Human
ugugagggguuuucccauuuuuugucuuguuggugcucaaaaaguuuuggauuuuggagcauuu

SEQ ID NO: 465132 - RNA, 64 nt, Human
agccuuugugguuuaguuauaaaaggcuuuaguagcucaaaaauacucuugauuucacauuucu

SEQ ID NO: 465133 - RNA, 64 nt, Human
uugaucauaaaaccuuuaggaaauguauuugaaagcucaaaauagaaauuagguuaaaaugcca

SEQ ID NO: 465134 - RNA, 64 nt, Human
aggaaacccaucucacgugcagagacacacauaggcucaaaauaaaaggauggaggaagaucua

SEQ ID NO: 465135 - RNA, 64 nt, Human
aagugugaaagaaacagcagaguaaaagccagacucauugcaccuucaaugucugcauagaucc

SEQ ID NO: 465136 - RNA, 64 nt, Human
gagagaguggguguaguuaucauuuauacaguaaucauugcauuuuaaaaucuucucuugaaag

SEQ ID NO: 465137 - RNA, 64 nt, Human
uauggccgcuuugugcuacaguagcagaguugagucauugcaagggagaccauauggcccaggu

SEQ ID NO: 465138 - RNA, 64 nt, Human
caacccauguuuuacuuaaaauaucuuggcauaagcucaaaaaagccaggaucuuuauggaaaa

SEQ ID NO: 465139 - RNA, 64 nt, Human
auccgcgaaggcuuuuaaugggaggggcgucaaagcucaaaacuguuuuccucucuccuccccc

SEQ ID NO: 465140 - RNA, 64 nt, Human
gggaaacugaggaaaucuuccauuccucccaacagcucaaaauuaggccuugggcaggggcagg

SEQ ID NO: 465141 - RNA, 64 nt, Human
aguuccugggcaucuccguguuucucuuuguggggcucaaaaccuccaaggaccucucucaaug

SEQ ID NO: 465142 - RNA, 64 nt, Human
aauuuuuauuuguuaaauuuuuaaaaauuacuuagcucaaaaugucagugguaaauuuuuaaau

SEQ ID NO: 465143 - RNA, 64 nt, Human
gaggugagacguugucccggagaucaaaacguccgcucaaaacguuacccugucgcucgaaccc

SEQ ID NO: 465144 - RNA, 64 nt, Human
ggaaugugggaaagccuucaguuaccacuguacugcucaaaaacaugagaggaaucacacugca

SEQ ID NO: 465145 - RNA, 64 nt, Human
agaauguggaaaagcauuccgauaccaccaaucugcucaaaaacaugaaaaggcucauacugga

SEQ ID NO: 465146 - RNA, 64 nt, Human
aaacaucauucuauaagucaguauacuuuuggaugcucaaaaugccauaucuucaaccaguagg

SEQ ID NO: 465147 - RNA, 64 nt, Human
auauaugaaauguguagggaggcuuuuaauuauggcucaaaacagaauuuaucuuguuaauaau

SEQ ID NO: 465148 - RNA, 64 nt, Human
aaauacucucuguaugaagaacauucaaaagugugcucaaaaaugaaacccaugcucuuacuau

SEQ ID NO: 465149 - RNA, 64 nt, Human
aagguacuucacuuccacuuuaaaauucuuuagugcucaaaaccaacuauuguggguuuuuguc

SEQ ID NO: 465150 - RNA, 64 nt, Human
gcuccacagauccauuuuuagggaagggauuuuggcucaaaacgaucugaccaccucugcccug

SEQ ID NO: 465151 - RNA, 64 nt, Human
cuaaggguuucuaaaacccuuaacacugguaagggcucaaaaauaaacguauguguucauauuc

SEQ ID NO: 465152 - RNA, 64 nt, Human
uacacuucauaccuaaaggagauucagagcuaucgcucaaaaccaaaagucuugguuuuuaaau

SEQ ID NO: 465153 - RNA, 64 nt, Human
uuaaauaaaacauucacuuuaguuucucacagaaucauugcaauuauguuaaaagaaaucucua

SEQ ID NO: 465154 - RNA, 64 nt, Human
ccccaaggcgggucccaaguucucuccucuacgcucauugcagaaauacuuugaaauagguucu

SEQ ID NO: 465155 - RNA, 64 nt, Human
cagcuuuggguaggaggaaucuugguguaugaaaucauugcaaauuuacuucaucuuuucugga

SEQ ID NO: 465156 - RNA, 64 nt, Human
aaacaugacugaaaguccagaguguuagcuuagagcucaaaauacuagcugcuguuucaagcug

SEQ ID NO: 465157 - RNA, 64 nt, Human
guaauaaacgcucuaucuaguuuaccuagcaaaagcucaaaacugcgcuaguauggacuuuuug

SEQ ID NO: 465158 - RNA, 64 nt, Human
uucccaccucuaaauucuguaaaauuauagacuugcucaaaagauuccuuuuuaucauccccac

SEQ ID NO: 465159 - RNA, 64 nt, Human
augccucuauuuuccccaauacagucacacaucagcucaaaauuugcaauauuguaguucauau

SEQ ID NO: 465160 - RNA, 64 nt, Human
gaaaauggcauccagggcugccaggagauucagagcucaaaacaaggcgagcuugaguucugca

SEQ ID NO: 465161 - RNA, 64 nt, Human
gacugcaguacacaaucaaggacacaguggccuggcucaaaauggacaagaagguugggcuaga

SEQ ID NO: 465162 - RNA, 64 nt, Human
ccugggggacgagucacccagcucacccccacaugcucaaaacagucaccaaguccucugggcu

SEQ ID NO: 465163 - RNA, 64 nt, Human
uuaaugccuagagaaugggaugugugaugcaaaugcucaaaaccucuuaaaucauagcugucug

SEQ ID NO: 465164 - RNA, 64 nt, Human
uguucuaauauuuugcuccuuuuuaaauuuuguagcucaaaagaccuuaaaggucuguaggguu

SEQ ID NO: 465165 - RNA, 64 nt, Human
ucagucuggaaacuuaacauuaugagccuuuucugcucaaaaaauuuucaaagauuaaaacuau

SEQ ID NO: 465166 - RNA, 64 nt, Human
aguaaagaauguguauauugugaacagccuuuuagcucaaaauguugagucauuuacauaugac

SEQ ID NO: 465167 - RNA, 64 nt, Human
cuuuuuuagguaaaucuauaugcugaaaaguagagcucaaaaacaguaguucaauuugcuuaau

SEQ ID NO: 465168 - RNA, 64 nt, Human
ucaccagaagugucccgaaaucggcucagauagggcucaaaacaagagauuccucuccuuuuac

SEQ ID NO: 465169 - RNA, 64 nt, Human
acagguuaaauauauaaacaaacaaacaaaaauugcucaaaaaagaggagaaaagcucaagagg

SEQ ID NO: 465170 - RNA, 64 nt, Human
uguaaaacuacuacuuuguuuuaguuagaacaaagcucaaaacuacuuuaguuaacuuggucau

SEQ ID NO: 465171 - RNA, 64 nt, Human
agcucagaagcuaagaauaagccuuugaaauaccucauugcauuucccuuugggcuucggcuug

SEQ ID NO: 465172 - RNA, 64 nt, Human
ucugcuucaauaucuaauuccuguguagcuuuguucauugcauuuauuaaacaaauguuguaua

SEQ ID NO: 465173 - RNA, 64 nt, Human
gcuaggccagaucaaugcuacaaucaugaaguucucauugcaugcaauuguguaggauugacaa

SEQ ID NO: 465174 - RNA, 64 nt, Human
uuucauucacucgaaguaacugcacucaagcugugcucaaaaucggcaacgcauuuauuuacac

SEQ ID NO: 465175 - RNA, 64 nt, Human
uguaugguaucuuuagauauuugccugucuguuugcucaaaauugcuucuaaaacaauaaagau

SEQ ID NO: 465176 - RNA, 53 nt, Human
guguagagaaauggcguuaaauggcucaaaaaggccuguacauacuucuccca

SEQ ID NO: 465177 - RNA, 64 nt, Human
auaagagacuuaucuuuuagcauaaauacuuauggcucaaaauccacugacgaucauucuccua

SEQ ID NO: 465178 - RNA, 64 nt, Human
gaucagcugcaggauuuuaacaggaauguuuuggucauugcauuugcacuuucauggacaacuu

SEQ ID NO: 465179 - RNA, 64 nt, Human
aguguguauuuacuguaguuuugccugaucucacucauugcacuuccuggaguuaaauuuucca

SEQ ID NO: 465180 - RNA, 64 nt, Human
cacacccucccuuuuccucacuggaauggacaguucauugcacugacucugggaucucagcccu

SEQ ID NO: 465181 - RNA, 64 nt, Human
caggaggcagagguugcagugagcugagaucacgucauugcacuccauccugagccacaagagc

SEQ ID NO: 465182 - RNA, 64 nt, Human
gcuggggaagcaggugcuugcuggccauggagccucauugcaaguuguucuugaacaccugagg

SEQ ID NO: 465183 - RNA, 64 nt, Human
aaguaacauuugcacaugauacagcaaaaggaguucauugcaauacugucuuuggauauuguuu

SEQ ID NO: 465184 - RNA, 64 nt, Human
cccaucggucaccuuguuucucaacuaccucgcaucauugcagaugcuagcgcguugccugucg

SEQ ID NO: 465185 - RNA, 64 nt, Human
uccaucccccucugucugcccucacaauuaggcuucauugcacugaucuuacucuacugcugcu

SEQ ID NO: 465186 - RNA, 64 nt, Human
gucuguuuucuauuuguuaagaaaaacuacagcaucauugcauaauucuugaugguaauaaauu

SEQ ID NO: 465187 - RNA, 64 nt, Human
ugaaauaaccgacccaucaucuucucacccacccucauugcauuccgcuguagugaaaggacga

SEQ ID NO: 465188 - RNA, 64 nt, Human
uuuucauaguuauuuguuuaaaaagauuuaaaaaucauugcacuuuggucagaaaaauaauaaa

SEQ ID NO: 465189 - RNA, 64 nt, Human
uuuguucuuaaugcagccacuauaacuugauaagucauugcacuauuuaaaaaguuuuaguaau

SEQ ID NO: 465190 - RNA, 64 nt, Human
aacaaaucauaauguauuauuuaaauguuuaacaucauugcauaacagcguuuauuauacagug

SEQ ID NO: 465191 - RNA, 64 nt, Human
gaugacaagggccagggagccuggcccgggugugagaauucagagauucuggccuccagcuguc

SEQ ID NO: 465192 - RNA, 64 nt, Human
aauaugugucuuuguuuugcagcccugaaugcaaagaauucauagcaguuaauuccccuuuuuu

SEQ ID NO: 465193 - RNA, 64 nt, Human
gcuaguagcggcuacuuuaaaaugcuucuuucucagaauucaaaggagacgagucagccaacca

SEQ ID NO: 465194 - RNA, 64 nt, Human
ucaguacuggguguuuaaaggacaaauagcugcuagaauucagggguaaauguaaguguucaga

SEQ ID NO: 465195 - RNA, 64 nt, Human
uaagugcuauauucuguuugcaguuaggaaaugcagaauucaaagugaucuccuagcuuguaag

SEQ ID NO: 465196 - RNA, 64 nt, Human
auaguaaaggguugauuugcugcaagaguagcugagaauucaaaaacauccuugcagaaugauu

SEQ ID NO: 465197 - RNA, 64 nt, Human
agccucaauuaacacaugcauggucaugacacccagaauucaugaugguuuguuauaacaaccu

SEQ ID NO: 465198 - RNA, 64 nt, Human
gggggcuuuaaaauacagcaugcagugaaagaucagaauucacugaauauuucuucugagagca

SEQ ID NO: 465199 - RNA, 64 nt, Human
cucucucacugugcguugcuaccuugcuucugugagaauucaggaagcaggugagaggagucaa

SEQ ID NO: 465200 - RNA, 64 nt, Human
aggucuuaguaccagagcuaguuuucagcugcucagaauucaucugaagagagacuuaagauga

SEQ ID NO: 465201 - RNA, 64 nt, Human
gccuaagggcacagguauuagugucauauugaucagaauucaaccuuuguucuaacacauacua

SEQ ID NO: 465202 - RNA, 64 nt, Human
gagguugagagagauucagcaucuuucugggauuagaauucaagucucuuuacuccuacagcag

SEQ ID NO: 465203 - RNA, 64 nt, Human
aaaaacaauucucggcccaaagaaaacaaucagaagaauucacugauuugacuagaaacaucaa

SEQ ID NO: 465204 - RNA, 64 nt, Human
uuuguaaccgcaagcauucucuuugaauucucacagaauucagcaagaaguagaaaccuguuau

SEQ ID NO: 465205 - RNA, 64 nt, Human
ugccuugguggcaggcagagaacugucucguacuagaauucaaggaggaaagaagaagaaauaa

SEQ ID NO: 465206 - RNA, 61 nt, Human; identical to SEQ ID NO: 456219

SEQ ID NO: 465207 - RNA, 61 nt, Human; identical to SEQ ID NO: 456220

SEQ ID NO: 465208 - RNA, 61 nt, Human; identical to SEQ ID NO: 456221

SEQ ID NO: 465209 - RNA, 61 nt, Human; identical to SEQ ID NO: 456222

SEQ ID NO: 465210 - RNA, 64 nt, Human
aucuucuggggauguuugaaggcugaguuccaacagaauucacaaagggaauaaaacaggauug

SEQ ID NO: 465211 - RNA, 64 nt, Human
uuggucccugaauaguccuagauuacuuauuuugagaauucauuguuaaaaauuacagggaauu

SEQ ID NO: 465212 - RNA, 64 nt, Human
caggucacugaauccaaggcaaccuguggaaagaagaauucagaugucagugggagccuccagg

SEQ ID NO: 465213 - RNA, 64 nt, Human
uucugagaauuguucacacuuucuaaccagagacagaauucagagcucuuuuugaaagaacuag

SEQ ID NO: 465214 - RNA, 64 nt, Human
aaagaaaaaagaaucaaauugaauauaucuuuuaagaauucaaaacuaguguauucacuuaccc

SEQ ID NO: 465215 - RNA, 64 nt, Human
acaacuugcuuccaauauacccaauucuauaugaagaauucauggagaguguacuggcacugga

SEQ ID NO: 465216 - RNA, 64 nt, Human
auguaucuguagaaauaacuuuuuaguuaauggaagaauucaccaauuuuaaaguuuugcaaca

SEQ ID NO: 465217 - RNA, 64 nt, Human
caugagucaagcccccuccccacaccuggacuccagaauucacccucuccccugcagucugggu

SEQ ID NO: 465218 - RNA, 64 nt, Human
uguaaguggauaacuuuucuuuuucccaggccagagaauucaaauuguuaaaacauuggcauuu

SEQ ID NO: 465219 - RNA, 64 nt, Human
guauaaacaugacccugggcuucuguaccacacuagaauucaugugagaaagcuaaaauggugg

SEQ ID NO: 465220 - RNA, 64 nt, Human
uuaaccuauggaaaaagccuuggaagagaaaaguagaauucaguauguauggaggcacaguuuu

SEQ ID NO: 465221 - RNA, 64 nt, Human
uucucagacuguagccauugaaaauuagaugcagagaauucagagauuucuucuuaauggaagu

SEQ ID NO: 465222 - RNA, 64 nt, Human
aauuaaguuauuuuccuaaaaaaaaaagaaaaaaagaauucagaacuacuuuccucugugacac

SEQ ID NO: 465223 - RNA, 57 nt, Human
auccaccgaagagcaaguaacagcuucagaauucaucaggaccaagaaaggauaagg

SEQ ID NO: 465224 - RNA, 57 nt, Human
auccacccaagagcaaguaacaucacuagaauucaucaggaccaugaaacaacaaga

SEQ ID NO: 465225 - RNA, 61 nt, Human; identical to SEQ ID NO: 456223

SEQ ID NO: 465226 - RNA, 61 nt, Human; identical to SEQ ID NO: 456224

SEQ ID NO: 465227 - RNA, 61 nt, Human; identical to SEQ ID NO: 456225

SEQ ID NO: 465228 - RNA, 61 nt, Human; identical to SEQ ID NO: 454614

SEQ ID NO: 465229 - RNA, 64 nt, Human
cagggaagggugugaggaggaggccaccagauucagaauucagaauuuuagacccuuuggccuu

SEQ ID NO: 465230 - RNA, 64 nt, Human
aggauugguaccaguuauucuuucugcaucuuguagaauucagcuaugaauccaucuggucuag

SEQ ID NO: 465231 - RNA, 64 nt, Human
cccucaccucccuuugagauguaaguuucauuccagaauucauuccccaggcaauuguauucuc

SEQ ID NO: 465232 - RNA, 64 nt, Human
ucaaauucucuacuguaugaauuaugcuuuaaguagaauucagugccaaggagaacuuggugaa

SEQ ID NO: 465233 - RNA, 64 nt, Human
auugcuauuuacauggaaacaaauaaaagaucucagaauucacuacuggugagaguguuggagu

SEQ ID NO: 465234 - RNA, 64 nt, Human
acucaaggaacuguuggcuguuuucccgauacugagaauucaacagcuccagagcagaagccac

SEQ ID NO: 465235 - RNA, 64 nt, Human
ccaaagggauaucuguucccuguuaccuuuuuggagaauucauaacauuugaagaucaaaaaau

SEQ ID NO: 465236 - RNA, 64 nt, Human
uuuaguaaguagaucuaacccgagucucacccacagaauucauauaaauucauauaugccuucu

SEQ ID NO: 465237 - RNA, 64 nt, Human
ucugaguugucuguuucuagaagaaaccucuuagagaauucaguaccaaccaagcuucagccca

SEQ ID NO: 465238 - RNA, 64 nt, Human
uuuuagagguuuucuaguuggaguuguguccaacagaauucauuaacaccagccugggcuuguu

SEQ ID NO: 465239 - RNA, 64 nt, Human
uccuuccaucaaaagauguauuugaauucauacuagaauucaggugcuuugcuagaugcuguga

SEQ ID NO: 465240 - RNA, 64 nt, Human
aacacaccgguaaauaaaacauaguccaaguggaagaauucauuaauaaggaacuuuuaauuau

SEQ ID NO: 465241 - RNA, 64 nt, Human
ugaagaaugucucuagaagagaaugaaggauugaagaauucaccauuagaggacauuuagcgug

SEQ ID NO: 465242 - RNA, 64 nt, Human
uuuggaaguuuauaguauaauugaaauuauuagaagaauucagcagguuacagacauacuuaaa

SEQ ID NO: 465243 - RNA, 64 nt, Human
uaaaguaaugugaauuaaaaauuuuggaacaauuagaauucauucacuauuguauagaagaugc

SEQ ID NO: 465244 - RNA, 61 nt, Human; identical to SEQ ID NO: 456212

SEQ ID NO: 465245 - RNA, 61 nt, Human; identical to SEQ ID NO: 456213

SEQ ID NO: 465246 - RNA, 61 nt, Human; identical to SEQ ID NO: 456214

SEQ ID NO: 465247 - RNA, 61 nt, Human; identical to SEQ ID NO: 456215

SEQ ID NO: 465248 - RNA, 64 nt, Human
caacacacuaauuuucuuauagaguaaaugaguaagaauucaucauuuuuuccaucucccuucu

SEQ ID NO: 465249 - RNA, 64 nt, Human
aagaaagaagcucuaggugauugggggaaaggaaagaauucacuagaaauuuguuuagggucca

SEQ ID NO: 465250 - RNA, 64 nt, Human
ugugauuuguauaaugaaaugcauuucauuuggaagaauucaaugaaccauuuuuccaagugac

SEQ ID NO: 465251 - RNA, 64 nt, Human
ucaacaaaaaaguuuggauguagaagcagcuguaagaauucaacuguuuauuauaacaagauac

SEQ ID NO: 465252 - RNA, 64 nt, Human
uaauggaacaaaaauuacagacuuuggugaaccaagaauucaacaagaggaagggcaaaaucaa

SEQ ID NO: 465253 - RNA, 64 nt, Human
cacgaguuuucuagcccucacaguaacagagcuaagaauucagaugucaggaagucugugaauc

SEQ ID NO: 465254 - RNA, 64 nt, Human
acugauguaaauuacuuagaucuucuuugaggucagaauucagcgaucacgguaggcagugcuu

SEQ ID NO: 465255 - RNA, 64 nt, Human
uaguaauagaucacggcauguuucccgcuccaagagaauucacuuuaccuucagcaguuaccga

SEQ ID NO: 465256 - RNA, 64 nt, Human
cuuauuugguuccuaacacaaacugggaagagauagaauucaucuauacuuucuuuuuucuugg

SEQ ID NO: 465257 - RNA, 64 nt, Human
aacacagcuuaaaaauaaaauaacugaaagaaauagaauucagcaaauaguuauuuuuugcacu

SEQ ID NO: 465258 - RNA, 64 nt, Human
caugugggcuuucucuugaucuuugugucauuucagaauucaaagacugugcuacgggaguucu

SEQ ID NO: 465259 - RNA, 64 nt, Human
gaagaccaucuucaugacugcucauuguagauggagaauucaacauaaauacagcaagaaaaug

SEQ ID NO: 465260 - RNA, 64 nt, Human
ugugguggggugggggacaacguugguaacucugagaauucagcuuuggagucccgggugaggg

SEQ ID NO: 465261 - RNA, 64 nt, Human
ucuucuuucccuuuccugucucaggaaucagcugagaauucauucgauugucaugccucuagcc

SEQ ID NO: 465262 - RNA, 64 nt, Human
cucugacgucuuggaggcagcuggaauggaaaggagaauucagguuaaagugggaggggugggu

SEQ ID NO: 465263 - RNA, 61 nt, Human; identical to SEQ ID NO: 454615

SEQ ID NO: 465264 - RNA, 61 nt, Human; identical to SEQ ID NO: 454616

SEQ ID NO: 465265 - RNA, 61 nt, Human; identical to SEQ ID NO: 448961

SEQ ID NO: 465266 - RNA, 61 nt, Human; identical to SEQ ID NO: 454632

SEQ ID NO: 465267 - RNA, 64 nt, Human
ucaguacaauuuggacuauugaacuguucuucaaagaauucauuuucuucuuuuuuguguauca

SEQ ID NO: 465268 - RNA, 64 nt, Human
uuucagcuggagugcagacaucacuggaacuuaaagaauucauaucagagagagauccuaaagg

SEQ ID NO: 465269 - RNA, 64 nt, Human
cugaagacgagcaggggcaaccugccagcaucacagaauucaguguaguuuauacauuucgauu

SEQ ID NO: 465270 - RNA, 64 nt, Human
uucaguuaucauuugacagauucuuaucuguacuagaauucagauaugucaguuuucugcaaaa

SEQ ID NO: 465271 - RNA, 64 nt, Human
ucaaagacuaauaauucaugacgugaaaauuaucagaauucacaaauaaagcuuuauuggaacu

SEQ ID NO: 465272 - RNA, 64 nt, Human
uucuuuccuuauugauaaaacaagauaaucgaugagaauucauguugcaugaguucgagauaac

SEQ ID NO: 465273 - RNA, 64 nt, Human
ugcucuagaauguauuacuuuguucucccaugaaagaauucaguuuguuaguaccuauauuuuu

SEQ ID NO: 465274 - RNA, 64 nt, Human
caaagagcuuggauuagaagggcuggacaaagagagaauucaauggggcccaaauuagaaugcu

SEQ ID NO: 465275 - RNA, 64 nt, Human
acucagagcuaagaaugaaauaggagaccaaguuagaauucaugauacugguuuauggggaggc

SEQ ID NO: 465276 - RNA, 64 nt, Human
acugccagugcaccagcaguuuaggugugaugagagaauucagauauacuuuaucuuuuuaaaa

SEQ ID NO: 465277 - RNA, 64 nt, Human
cuugcugcauucuccuuuggcaaacaucagggucagaauucaggauagcccuuccuagggcacu

SEQ ID NO: 465278 - RNA, 64 nt, Human
uuuucuaacggcaaggaagauaugugcccuuuugagaauucaagauggcacugacacgggaagg

SEQ ID NO: 465279 - RNA, 64 nt, Human
uaaaaauaaaugauuuugaaauuaaauauaauauagaauucacauuuuauauagcucucucaaa

SEQ ID NO: 465280 - RNA, 64 nt, Human
aaguguuguacaugucucugguuucagaauuaaaagaauucagaguuaccuugugagauaaaug

SEQ ID NO: 465281 - RNA, 64 nt, Human
auucuaaagaacugauacaggaguaacaauaugaagaauucauuaauaucucaguacuugauaa

SEQ ID NO: 465282 - RNA, 61 nt, Human; identical to SEQ ID NO: 454633

SEQ ID NO: 465283 - RNA, 61 nt, Human; identical to SEQ ID NO: 454634

SEQ ID NO: 465284 - RNA, 61 nt, Human; identical to SEQ ID NO: 454650

SEQ ID NO: 465285 - RNA, 61 nt, Human; identical to SEQ ID NO: 454651

SEQ ID NO: 465286 - RNA, 64 nt, Human
cucuuggucuauuaaggaaagaagcaaucaguagagaauucaggauaguuuuguuuaaauucuu

SEQ ID NO: 465287 - RNA, 64 nt, Human
uuuuuauuuuaaaaagguaugucuuugguuuggcagaauucaugcagggcuaucaagugguguu

SEQ ID NO: 465288 - RNA, 64 nt, Human
uuuucaucuggguuccaauuucuuaacuuccuaaagaauucaucuguuuauacaagucuaccac

SEQ ID NO: 465289 - RNA, 64 nt, Human
caucagugacuuuaacuucugcagaguuugccccagaauucagaguucuauuuagaggaaguua

SEQ ID NO: 465290 - RNA, 64 nt, Human
ucagauuaacuucacuauuaaguguucaauaugaagaauucaaguauucugacugagugauugg

SEQ ID NO: 465291 - RNA, 64 nt, Human
caagucuagcagauucucagcagugcugauggccagaauucaggagcaggggccuggccuccug

SEQ ID NO: 465292 - RNA, 64 nt, Human
guuagaacaagcccaaauuuaauuugcaaccaucagaauucagaaucuauagugaccagugauc

SEQ ID NO: 465293 - RNA, 64 nt, Human
auaaaauaguaagucaauccaggaacaguuauuuagaauucauauugaauuaaauuaauugcua

SEQ ID NO: 465294 - RNA, 64 nt, Human
uucuaggagaguuuuguuuaacuaagaaauugacagaauucauagguguggguguagaguucac

SEQ ID NO: 465295 - RNA, 64 nt, Human
ucugugggggagacagggacuauaacagggaggcagaauucagguuggcuugacaacacaccuu

SEQ ID NO: 465296 - RNA, 64 nt, Human
gugugggucacacaaggucuacauuacaaaagacagaauucagggauggaaaggagaaugaaca

SEQ ID NO: 465297 - RNA, 64 nt, Human
cuguuggccugagccaccagauuaugauguugccagaauucacucaauuugaauaaagaugaac

SEQ ID NO: 465298 - RNA, 64 nt, Human
auuuacaaaaugagauaguugaaaaagcacaucuagaauucagcuucugacuaccaaucuuuuu

SEQ ID NO: 465299 - RNA, 64 nt, Human
cucauuagaauuuccucucacaucagugggauacagaauucaguuucucccuugccagguccuu

SEQ ID NO: 465300 - RNA, 64 nt, Human
uuugagacaaggguuguaaaauguauuugcucucagaauucauccccuucuuaguauuagguca

SEQ ID NO: 465301 - RNA, 64 nt, Human; identical to SEQ ID NO: 72787

SEQ ID NO: 465302 - RNA, 64 nt, Human; identical to SEQ ID NO: 72794

SEQ ID NO: 465303 - RNA, 64 nt, Human; identical to SEQ ID NO: 72801

SEQ ID NO: 465304 - RNA, 64 nt, Human; identical to SEQ ID NO: 72808

SEQ ID NO: 465305 - RNA, 64 nt, Human
uaucauugcccaagaaugaggauaugcaguaaacagaauucaggcaagauaccucuaagcuguu

SEQ ID NO: 465306 - RNA, 64 nt, Human
uccaggcugugagggacacguauggagcagauaaagaauucacucaagcaguccuaagaggcac

SEQ ID NO: 465307 - RNA, 64 nt, Human
cuuuaccucauucucaaaccuugauaaacauaagagaauucauaccggagagaaacuguacaaa

SEQ ID NO: 465308 - RNA, 64 nt, Human
aacuuacauugagaagauaugaaagaugaauauaagaauucauccuagauauaaaaccauagaa

SEQ ID NO: 465309 - RNA, 64 nt, Human
ugaauagagaauauuuauaacuuuuguaugagagagaauucacacucaacaagacacuaccagc

SEQ ID NO: 465310 - RNA, 64 nt, Human
aguuuacccuucugaaggagcagggacucagcacagaauucacuuuagacggggcugaaggagu

SEQ ID NO: 465311 - RNA, 64 nt, Human
ggaaauacugauuaugacuggaaacaguuugaacagaauucaaaguaugagcaaggauaccaaa

SEQ ID NO: 465312 - RNA, 64 nt, Human
ucuuaguggcacuggggaaaucuuggcacccagaagaauucaacugcgcucacugcaaaaauac

SEQ ID NO: 465313 - RNA, 64 nt, Human
gcccaaugcaucugauccuugaauauacucucaaagaauucacucucuuuuuauuaagagaacu

SEQ ID NO: 465314 - RNA, 64 nt, Human
auaguaccauaguuuuaaggaccaaggugugcccagaauucaaguuucacaaaucccaaugcug

SEQ ID NO: 465315 - RNA, 64 nt, Human
caaucaaugugauaguucauuuuuaacucuuagaagaauucagaggaaauuaacccagcuaagu

SEQ ID NO: 465316 - RNA, 64 nt, Human
ccauccaaaccuuggaaauacgacagggugugguagaauucagcaauaugagaaaaccagcccc

SEQ ID NO: 465317 - RNA, 64 nt, Human
cugcgcccggccuuuuuaacuuuaaacauguuuuagaauucaccuaaagaucaaaauaucaugg

SEQ ID NO: 465318 - RNA, 64 nt, Human
acaaagaaagcuguaugcaggucauauaugcaugagaauucaacuauuuaguggguguaguaca

SEQ ID NO: 465319 - RNA, 64 nt, Human
cucuccagggaguagauguaaaguacuuguacauagaauucagaacugaagauauuuauuaaaa

SEQ ID NO: 465320 - RNA, 61 nt, Human; identical to SEQ ID NO: 448943

SEQ ID NO: 465321 - RNA, 64 nt, Human; identical to SEQ ID NO: 72815

SEQ ID NO: 465322 - RNA, 64 nt, Human; identical to SEQ ID NO: 72822

SEQ ID NO: 465323 - RNA, 64 nt, Human; identical to SEQ ID NO: 72829

SEQ ID NO: 465324 - RNA, 64 nt, Human
cauccuccuuuuguucugcauugacucauuuaccagaauucauuggaagaaaucaccaaagauu

SEQ ID NO: 465325 - RNA, 64 nt, Human
aauccuaacaaggaaaggcaggaaugaggguuucagaauucacuggagaaggugugguugcagc

SEQ ID NO: 465326 - RNA, 64 nt, Human
agggaauugggagccaucauaugucacaguguucagaauucaagcauauuuaagggcauuuucu

SEQ ID NO: 465327 - RNA, 64 nt, Human
aagcucucguucauuaauuuuaguccuguguagcagaauucaauuacgggaacuaccauaauuu

SEQ ID NO: 465328 - RNA, 64 nt, Human
aagaaauuguucugauuauuuacgucaacucauuagaauucagugaaaaguaacagucuuuugu

SEQ ID NO: 465329 - RNA, 64 nt, Human
aaagacaucaaugaaacagaaggggcguucuugaagaauucauaauuuuaagcaguuaguaauu

SEQ ID NO: 465330 - RNA, 64 nt, Human
ucagugauuaucuuuuucuaaauaaaauaucaccagaauucaucaguuaauuucugauuucuuu

SEQ ID NO: 465331 - RNA, 64 nt, Human
uugucgggagauugaaccacuaaaauguuagagcagaauucauuaugcuguggucacaggggug

SEQ ID NO: 465332 - RNA, 52 nt, Human
agaauguugacaugauguaauaagaauucauuucugacauauuuuacauuuc

SEQ ID NO: 465333 - RNA, 64 nt, Human
uaaugaaagugucacccuuuuggugcuaagcaggagaauucacaauuaaagcaguguguauaga

SEQ ID NO: 465334 - RNA, 64 nt, Human
guaacuuaaaacauuacccuuaugaauuuagaugagaauucacuuguucugucaguaauccaua

SEQ ID NO: 465335 - RNA, 64 nt, Human
uaugaauacaauuccccuaaacucuccucaaaagagaauucagucuacagccauuuaaaugauc

SEQ ID NO: 465336 - RNA, 64 nt, Human
gguaugugauggguuguagaagcguguguuugagagaauucagagacauuugaaggcugcugug

SEQ ID NO: 465337 - RNA, 64 nt, Human
gugcaugcaacacacuuaggggaggaguggccccagaauucagcacgcacacaacacacaaggg

SEQ ID NO: 465338 - RNA, 64 nt, Human
gguuagaaggaugggguguaggguugguaagaaaagaauucagggaagagcagcgaucagauua

SEQ ID NO: 465339 - RNA, 64 nt, Human; identical to SEQ ID NO: 72836

SEQ ID NO: 465340 - RNA, 64 nt, Human; identical to SEQ ID NO: 72843

SEQ ID NO: 465341 - RNA, 64 nt, Human; identical to SEQ ID NO: 72850

SEQ ID NO: 465342 - RNA, 64 nt, Human; identical to SEQ ID NO: 72857

SEQ ID NO: 465343 - RNA, 64 nt, Human
uaacuuuguuuuucaaaauuagucuuuguaacauagaauucaugaguguuuacuugauuagguu

SEQ ID NO: 465344 - RNA, 64 nt, Human
gaacaaaaaucacucaaaaccuguuuauaaccaaagaauucaugaaaaagaaagccuuugccau

SEQ ID NO: 465345 - RNA, 64 nt, Human
cagcauacacagaugaaggugggaaggaugguccagaauucacuuuuacuaccccaaaguuugg

SEQ ID NO: 465346 - RNA, 64 nt, Human
gaauuucaaaacaggaucuaagaugguauguaguagaauucaaaguaauaucauuuuaaaguua

SEQ ID NO: 465347 - RNA, 64 nt, Human
guucgaucuucuggguuuaguuuugucuuuaaaaagaauucaaaaaaagacugacaaugacagu

SEQ ID NO: 465348 - RNA, 64 nt, Human
uaaaaucaagaaaauuuaaaaagacaaaaaaaaaagaauucauugauaauucuaacucagacuu

SEQ ID NO: 465349 - RNA, 64 nt, Human
ugauuuuggaauucuaugagucaaucuuuuuggcagaauucagaauauuaaaaaguucauacau

SEQ ID NO: 465350 - RNA, 64 nt, Human
uuaaggccaaguagguuaacuggugaacauuucuagaauucaaaaguuucuaaauguuuuacau

SEQ ID NO: 465351 - RNA, 64 nt, Human
agagaauagcaacguuuauggauaucacaaauaaagaauucaauucuuuacaugauugagugag

SEQ ID NO: 465352 - RNA, 64 nt, Human
aggagucuacacagcucugaaccuucuuuguuaaagaauucagaccucauggaacucuggguuc

SEQ ID NO: 465353 - RNA, 64 nt, Human
uuuugucauaguauuuaagucauaaugucauuucagaauucaguucuguaggauuuucuuuucu

SEQ ID NO: 465354 - RNA, 64 nt, Human
uugcuuuugguuaccgauuagaucuauccauuguagaauucauguaaauagaauacuguaguau

SEQ ID NO: 465355 - RNA, 64 nt, Human
agucauuaacaagaaacaggauaugcuuuaagacagaauucacugucuguugcuucaguaaaag

SEQ ID NO: 465356 - RNA, 64 nt, Human
auuuaaagcuuaagcuuucaggaaaaagaaaauaagaauucagugugugcaugacaacucgugu

SEQ ID NO: 465357 - RNA, 64 nt, Human
uguggccugcacagugaagugcuggcaaccacuaagaauucaaacuggggccuccagaacucac

SEQ ID NO: 465358 - RNA, 61 nt, Human; identical to SEQ ID NO: 448924

SEQ ID NO: 465359 - RNA, 61 nt, Human; identical to SEQ ID NO: 455010

SEQ ID NO: 465360 - RNA, 61 nt, Human; identical to SEQ ID NO: 455011

SEQ ID NO: 465361 - RNA, 61 nt, Human; identical to SEQ ID NO: 455947

SEQ ID NO: 465362 - RNA, 64 nt, Human
uucuccuuaugugggaaaugggccuaguagaugcagaauucaaagaugucgguugggagaaacu

SEQ ID NO: 465363 - RNA, 64 nt, Human
uguuacuccaaaacuucguuuaaugaaugcuuaaagaauucaaauuuuaucugccucucuugua

SEQ ID NO: 465364 - RNA, 64 nt, Human
aguuucauuaaugucuucuguacuagugggguagagaauucaagauuuuuuagaaauauaguaa

SEQ ID NO: 465365 - RNA, 64 nt, Human
ucguauuacaaauugacaucagcaaaauucaaaaagaauucaguaaaaagggcauagauccagc

SEQ ID NO: 465366 - RNA, 64 nt, Human
uuauugauauuuucuauacaguaguuuugugauuagaauucaccuggggacacacacucacacg

SEQ ID NO: 465367 - RNA, 64 nt, Human
caaugaauuuacaauaacuaucaaauuggcuaucagaauucacuguaauggaauuuugccucua

SEQ ID NO: 465368 - RNA, 64 nt, Human
ugaaaucauauuuggaauaaaaauuccagaaugaagaauucagauugcugaauggaguuaaacu

SEQ ID NO: 465369 - RNA, 64 nt, Human
gcaaucccacuacucgggauauacccacaggaaaagaauucauuuuaucaaaaagacaccugca

SEQ ID NO: 465370 - RNA, 64 nt, Human
ugacuucaacguucacuuuaugcaccaaagugaaagaauucaguguauccguuauuuuaaugca

SEQ ID NO: 465371 - RNA, 64 nt, Human
uagaggagacaaucagaaauuuaccauagucccaagaauucagcuacaugaugacucgaauuua

SEQ ID NO: 465372 - RNA, 64 nt, Human
uuaacagccagagucauaaaugaaaugaaauugaagaauucauucaaaugcucuuuucccuaua

SEQ ID NO: 465373 - RNA, 64 nt, Human
accugauauuuuuagugggugcauucuuccagaaagaauucagcaauguuaucagaauuaauuc

SEQ ID NO: 465374 - RNA, 64 nt, Human
uaucuuuagguauggcuuucccaacgaaaggcuaagaauucaagaacggucuuaacugaacccu

SEQ ID NO: 465375 - RNA, 64 nt, Human
gagacaaugaagugacuuccaaccgacaguugcuagaauucacagggcagaaaagggguugacc

SEQ ID NO: 465376 - RNA, 64 nt, Human
ugauauauucauuugcuacaccaacuauguuuucagaauucaucuuuugaacaacuugguuuca

SEQ ID NO: 465377 - RNA, 64 nt, Human; identical to SEQ ID NO: 72864

SEQ ID NO: 465378 - RNA, 64 nt, Human; identical to SEQ ID NO: 72871

SEQ ID NO: 465379 - RNA, 64 nt, Human; identical to SEQ ID NO: 72878

SEQ ID NO: 465380 - RNA, 64 nt, Human; identical to SEQ ID NO: 72885

SEQ ID NO: 465381 - RNA, 64 nt, Human
agaaaaaccaacuaugauuuaugguuguguuuucagaauucaacauuaaagauuaauguuuauu

SEQ ID NO: 465382 - RNA, 64 nt, Human
cuuucuacuaaugcucagcccuucucguuguaagagaauucacaccggagaacaacuuuuuaaa

SEQ ID NO: 465383 - RNA, 64 nt, Human
gaugaggacaaaucucagacuuugcucagagcucagaauucaguggggaccagagagccugcaa

SEQ ID NO: 465384 - RNA, 64 nt, Human
augaugaauguggagaugcuugcuucagcauuggagaauucacaguaaagggaaacccugccag

SEQ ID NO: 465385 - RNA, 64 nt, Human
aggcagagggcacagcgugcuuaggcccaagcuuagaauucaauugagaaguucuguuguucau

SEQ ID NO: 465386 - RNA, 64 nt, Human
uuuauuuauaaagcacauauucauaauaacgagaagaauucagaaaaccacuuaagcaagaccc

SEQ ID NO: 465387 - RNA, 64 nt, Human
cacaacucuauagaaagaaaggagauuauuacccagaauucacauguagugauuauuaaggaca

SEQ ID NO: 465388 - RNA, 64 nt, Human
acaagaagaauuugaagacuucaaaauauugagcagaauucauucauacuuaaaaauuuauuag

SEQ ID NO: 465389 - RNA, 58 nt, Human
aaguccaucagcugccuugaucagagagagaauucagguuaccaagacggaagguguc

SEQ ID NO: 465390 - RNA, 64 nt, Human
caaaaauaccaaauuuguguccugugcaguaugaagaauucagugaauauucauuaauguauua

SEQ ID NO: 465391 - RNA, 64 nt, Human
uuuaacagauaaaacuuacagaaaccuaugauauagaauucauauagucuauucuguugugucu

SEQ ID NO: 465392 - RNA, 64 nt, Human
uuuauuugcuguuuagguuugugacugaauugugagaauucaguugugauuuuuaacauguguc

SEQ ID NO: 465393 - RNA, 64 nt, Human
uuuuauuugauauuucaucuauguuugaaaugugagaauucagauguaauuuuuuaccuugauu

SEQ ID NO: 465394 - RNA, 64 nt, Human
auuuaauccaaaauuaagucuauauaaauaucagagaauucacaguagaaauaucuaagguacu

SEQ ID NO: 465395 - RNA, 64 nt, Human
aaaugauccaaaguuagguuuauauaaauaucagagaauucacaauacagauaucuaagauacu

SEQ ID NO: 465396 - RNA, 62 nt, Human; identical to SEQ ID NO: 456185

SEQ ID NO: 465397 - RNA, 62 nt, Human; identical to SEQ ID NO: 456186

SEQ ID NO: 465398 - RNA, 62 nt, Human; identical to SEQ ID NO: 456187

SEQ ID NO: 465399 - RNA, 62 nt, Human; identical to SEQ ID NO: 454991

SEQ ID NO: 465400 - RNA, 64 nt, Human
auauuuaaucccaaauuaagucuauguaaauaucagaauucacaguagaaaucauaaggcauaa

SEQ ID NO: 465401 - RNA, 64 nt, Human
cauaauaagaggccuguuguauaugaaauugucuagaauucaggugcaggucuuugccgguuaa

SEQ ID NO: 465402 - RNA, 64 nt, Human
gaugacaaugauaaguaugacaugagcuucaaccagaauucagccucugguaaacaugaacacu

SEQ ID NO: 465403 - RNA, 64 nt, Human
cuucagauugaauucacaucuuauucagcaucaaagaauucacacaggagagaaagcacaugaa

SEQ ID NO: 465404 - RNA, 64 nt, Human
gcuauuaguauuuucauaccuuagucacauuuggagaauucacaugggaauaaaauuccauugc

SEQ ID NO: 465405 - RNA, 64 nt, Human
gaagagaauaggcuacuggaaaaccaaacccaacagaauucacguccaaaaauccacauucucc

SEQ ID NO: 465406 - RNA, 64 nt, Human
uuauaucuaauugacauauugacuaauguuugaaagaauucaaccauaaguuaaaaucugaagg

SEQ ID NO: 465407 - RNA, 64 nt, Human
uauaaaugaggucucguugaugcuggacaauucaagaauucagacuugaaccuuaaaccuagga

SEQ ID NO: 465408 - RNA, 64 nt, Human
aacuccaagccuuuucuccacuacuauacaagaaagaauucagcaagcugcuucuccaaucaaa

SEQ ID NO: 465409 - RNA, 64 nt, Human
uuguauccuggaccacaaguuccuaaguagagcaagaauucaucaaccagcugccucuuguuuc

SEQ ID NO: 465410 - RNA, 64 nt, Human
uguauguacaauuuaaagagugaauaagauuauuagaauucagcaauagagauauaucuauuuu

SEQ ID NO: 465411 - RNA, 64 nt, Human
ccuguucucccugcaaauccaauuccuguuaucaagaauucaguaaaacagguugaaugguuaa

SEQ ID NO: 465412 - RNA, 64 nt, Human
aagccuuguuccuuucugcaugagaaucuaggagagaauucauaaccacaccaauaacgaaaua

SEQ ID NO: 465413 - RNA, 64 nt, Human
uauguguaccauccuuuaauagaucucauacaccagaauucagaucaugaaugacugacagaau

SEQ ID NO: 465414 - RNA, 64 nt, Human
uuauaguuuuuauuuacccauuugauuugugugaagaauucaucacuauuuuauacguaacaua

SEQ ID NO: 465415 - RNA, 62 nt, Human; identical to SEQ ID NO: 456181

SEQ ID NO: 465416 - RNA, 62 nt, Human; identical to SEQ ID NO: 456178

SEQ ID NO: 465417 - RNA, 62 nt, Human; identical to SEQ ID NO: 456183

SEQ ID NO: 465418 - RNA, 62 nt, Human; identical to SEQ ID NO: 454992

SEQ ID NO: 465419 - RNA, 64 nt, Human
ucuggugggccuuaacaucccuccugcuuuuaggagaauucacagaaccuacuguuccuuucag

SEQ ID NO: 465420 - RNA, 64 nt, Human
acugggugaugcacccauugugauuguggaagauagaauucaauuugaacucagguuguuuaug

SEQ ID NO: 465421 - RNA, 64 nt, Human
uuuuugaaaauguuuacaucaucagaugauccacagaauucacuuuaugugagaucucccgaga

SEQ ID NO: 465422 - RNA, 64 nt, Human
cuuuaaccgaucuucaacccuuauuggacauaagagaauucauacuggagagaaacccuacaaa

SEQ ID NO: 465423 - RNA, 64 nt, Human
cauauguaaccauuugaauguuuuugcuguuuuuagaauucagagcccuugcuggggggugccu

SEQ ID NO: 465424 - RNA, 64 nt, Human
cagcuugcauagcacagagaauauucuugguuacagaauucauaugggaacuaggcuuuuaaga

SEQ ID NO: 465425 - RNA, 64 nt, Human
uuuucuuaauacagcagcacuucuauaauagaucagaauucacaugguguagaacucucaauga

SEQ ID NO: 465426 - RNA, 64 nt, Human
aaaacuguuaugcccacugugcucaauuugaagcagaauucagugaaaaauuauuuuuccacau

SEQ ID NO: 465427 - RNA, 64 nt, Human
gaugggugaaggcuuuggcaauagaaagaagaauagaauucagguuuuauguuauuccucugug

SEQ ID NO: 465428 - RNA, 64 nt, Human
gagaaacaacuuauuucuguuaauauuuaccgguagaauucacacccucuaucauaaacauaug

SEQ ID NO: 465429 - RNA, 64 nt, Human
uuguguugaacgaaaacauugugguuuggaaaggagaauucaacaauuaauaguugaaauugug

SEQ ID NO: 465430 - RNA, 64 nt, Human
cuaacccaaaacaguucuacucacuuccuuuuacagaauucaccggccauuuuccuguuaccug

SEQ ID NO: 465431 - RNA, 64 nt, Human
ugucauuuaaacauaaaccuggaguacucgaaauagaauucagguuuacaagaugaaagcgugu

SEQ ID NO: 465432 - RNA, 64 nt, Human
uuucaaauauauuuauuauuaauaaaauaauaaaagaauucaugggcuacaacuagcacaggga

SEQ ID NO: 465433 - RNA, 64 nt, Human
uuguauuauacaguaccuuucucagacauuuuguagaauucauuucggcagcucacuaggauuu

SEQ ID NO: 465434 - RNA, 64 nt, Human; identical to SEQ ID NO: 72892

SEQ ID NO: 465435 - RNA, 64 nt, Human; identical to SEQ ID NO: 72899

SEQ ID NO: 465436 - RNA, 64 nt, Human; identical to SEQ ID NO: 72906

SEQ ID NO: 465437 - RNA, 64 nt, Human; identical to SEQ ID NO: 72913

SEQ ID NO: 465438 - RNA, 64 nt, Human
uuguguuugagggaaauaugucccuagcaggaaaagaauucaaagagguucaaagaauauguca

SEQ ID NO: 465439 - RNA, 64 nt, Human
gauaacuucuuuaggggaaguaaaacagucaucuagaauucacugaguuuuguuucacuuugac

SEQ ID NO: 465440 - RNA, 64 nt, Human
cgggaacgcaagcugucaguggaacugucccacaagaauucacaggucucaaagcaggaacagu

SEQ ID NO: 465441 - RNA, 64 nt, Human
acugucgccaaauagcugagccaaaaggcugaucagaauucacuuuuuggaauguggcaguuaa

SEQ ID NO: 465442 - RNA, 64 nt, Human
gauccagggcccuucuacuggagauaggaaaaguagaauucaggaauuaaaagaauuacucuuu

SEQ ID NO: 465443 - RNA, 64 nt, Human
uaccuguggguuagcaucaaguucuccccaggguagaauucaaucagagcuccaguuugcauuu

SEQ ID NO: 465444 - RNA, 64 nt, Human
agguacuguguguuacaaaaauuuuuuuaaauaaagaauucagugucacuaguucuaagccuuu

SEQ ID NO: 465445 - RNA, 64 nt, Human
acccuggcucuugucccaagugggcuacauuugaagaauucacccaggcuccagcuagaucauc

SEQ ID NO: 465446 - RNA, 64 nt, Human
ugacacugguuucauguaguuuucaagaaauaaaagaauucauucaagugaagccauuugugug

SEQ ID NO: 465447 - RNA, 64 nt, Human
guuaguaaauccaugguguuauuuucugagagacagaauucaaguggguauucuggggccaucc

SEQ ID NO: 465448 - RNA, 64 nt, Human
gcaaaacacguuuggucuguuuuuagauucuugaagaauucaauagucuuucaagauguuuaau

SEQ ID NO: 465449 - RNA, 64 nt, Human
gucaucuuuacucagaauccuagggauagguagaagaauucaucuuuucaagaaaguguuuuaa

SEQ ID NO: 465450 - RNA, 64 nt, Human
uugacacaguuguaggguuacagagaccuauguaagaauucagaagaccccugacucaucauuu

SEQ ID NO: 465451 - RNA, 64 nt, Human
ucaaaccgcagaaaggcuuuaauacuggaaaaaaagaauucaagacuacaggcagcuccccucu

SEQ ID NO: 465452 - RNA, 64 nt, Human
ucugcuuucaccucagucuguacaguuggaaaugagaauucauaauuaacagcaaaaucuaagg

SEQ ID NO: 465453 - RNA, 62 nt, Human; identical to SEQ ID NO: 455009

SEQ ID NO: 465454 - RNA, 62 nt, Human; identical to SEQ ID NO: 456188

SEQ ID NO: 465455 - RNA, 62 nt, Human; identical to SEQ ID NO: 456189

SEQ ID NO: 465456 - RNA, 52 nt, Human; identical to SEQ ID NO: 456190

SEQ ID NO: 465457 - RNA, 64 nt, Human
gacagagaggucaaggggaaguauuuucuaguucagaauucagaauucuuaggcaaccuucaua

SEQ ID NO: 465458 - RNA, 64 nt, Human
uggaucaugcauaauuucucaggagaauaaaaugagaauucauauauacguucaucuuucaagu

SEQ ID NO: 465459 - RNA, 64 nt, Human
uuuuaguuucucuuaaucaaaauuacuagaugauagaauucaagaacuuguuacauguauuacu

SEQ ID NO: 465460 - RNA, 64 nt, Human
gguugaaauaaaacagggugacugggaguuacuuagaauucaugaagauuuuaaaauggcuuug

SEQ ID NO: 465461 - RNA, 64 nt, Human
uuuugaugauuauucacauugaaugcacagaccaagaauucagugaaugucauuuuuuaaaaaa

SEQ ID NO: 465462 - RNA, 64 nt, Human
cgggcacagggaggaggagaggaagagaaaaggaagaauucauuuuuaauuuagguuucuuuuu

SEQ ID NO: 465463 - RNA, 64 nt, Human
uuaaagugaaaaagaagaaauagagaauuccagcagaauucagugguugucuacuauccauacu

SEQ ID NO: 465464 - RNA, 64 nt, Human
uuguguccaaaaugcaaccuucagaguguaucaaagaauucagacaggcuucuguuuucagagu

SEQ ID NO: 465465 - RNA, 64 nt, Human
acagucccagaaguaaacccucacugugaaucagagaauucacauaggaaagaaaccagaugaa

SEQ ID NO: 465466 - RNA, 64 nt, Human; identical to SEQ ID NO: 465382

SEQ ID NO: 465467 - RNA, 64 nt, Human; identical to SEQ ID NO: 465383

SEQ ID NO: 465468 - RNA, 64 nt, Human
cccagacaguggauaugacccacacugccagaagagaauucaguauuuuuuacuuuucacacug

SEQ ID NO: 465469 - RNA, 64 nt, Human
agagugacuuuuuaauacaacaagaucaacuagaagaauucaacugucucaagaaucaagguac

SEQ ID NO: 465470 - RNA, 64 nt, Human
augccugagccuuuguccaaagugaggucacucgagaauucauggacacggcccccagucaggg

SEQ ID NO: 465471 - RNA, 64 nt, Human
uuguuuguuggugacacaguuguucagaguggggagaauucaccccauucugucccugccccua

SEQ ID NO: 465472 - RNA, 62 nt, Human; identical to SEQ ID NO: 456191

SEQ ID NO: 465473 - RNA, 62 nt, Human; identical to SEQ ID NO: 456192

SEQ ID NO: 465474 - RNA, 62 nt, Human; identical to SEQ ID NO: 456193

SEQ ID NO: 465475 - RNA, 64 nt, Human
gacguuucaaguggcauuuuguacaaugcagguuagaauucaggaauuucaaguaugugcccgg

SEQ ID NO: 465476 - RNA, 64 nt, Human
aguguuccuuaccuuucaugggcccagcgaggguagaauucagaauagagaguuauacuccugc

SEQ ID NO: 465477 - RNA, 64 nt, Human
auuuugcccaaugccacucuucauuaaacaucagagaauucacacggggugaaaccugggucag

SEQ ID NO: 465478 - RNA, 64 nt, Human
gucuuagaguaggguuaagguucucagugacacaagaauucaguauuaaguacauagguauuua

SEQ ID NO: 465479 - RNA, 64 nt, Human
agguucuaauaggccauguuuaugacuguugcauagaauucacaaugcauuuuucaagagaaau

SEQ ID NO: 465480 - RNA, 64 nt, Human
aaaucucuuuacacaauuggagcucauguacuagagaauucaaagggauaacugcaaagacacu

SEQ ID NO: 465481 - RNA, 64 nt, Human
caacacucaggguguaaauucuaaaaucacaccuagaauucagcugugugggucuaaaaaguua

SEQ ID NO: 465482 - RNA, 64 nt, Human
uccucccccaugaacuagaaaaccacuuacucccagaauucaggucgugcuuguuaguacuaua

SEQ ID NO: 465483 - RNA, 64 nt, Human
aagugcuacugucccuuuguaauuggcuucuaacagaauucaaccagaaauaauugauaaugug

SEQ ID NO: 465484 - RNA, 64 nt, Human
uucaaaaccuaauucccccagauuaguauacucgagaauucaaagggacauuuaagguggggua

SEQ ID NO: 465485 - RNA, 64 nt, Human
aacagcaccacccauucaagcauccuguggauaaagaauucagggaaccauccacacaccugcc

SEQ ID NO: 465486 - RNA, 64 nt, Human
guuucguuuugcuggcuugaagacaaauggucuuagaauucauugagacccauagcuucauaug

SEQ ID NO: 465487 - RNA, 64 nt, Human
cuuggucugugagaugcuagaacucccuuucaacagaauucacuuguggcuauuagagcuggag

SEQ ID NO: 465488 - RNA, 64 nt, Human
aucuucaagucuugaagaaguugauguuaauugaagaauucacuugucugguugaaauaaagcc

SEQ ID NO: 465489 - RNA, 64 nt, Human
gguucuagacuucagcuuuuggaaauugcuaaauagaauucaaaaaucucugcauccugaggug

SEQ ID NO: 465490 - RNA, 62 nt, Human; identical to SEQ ID NO: 454993

SEQ ID NO: 465491 - RNA, 61 nt, Human; identical to SEQ ID NO: 456198

SEQ ID NO: 465492 - RNA, 61 nt, Human; identical to SEQ ID NO: 456199

SEQ ID NO: 465493 - RNA, 61 nt, Human; identical to SEQ ID NO: 456200

SEQ ID NO: 465494 - RNA, 64 nt, Human
ugauuaacuaguauucaaucaccaacuugcaaacagaauucauaacacuuggcacuuguucuag

SEQ ID NO: 465495 - RNA, 64 nt, Human
caucagaguauuugaccugcaguauugaaaaaggagaauucagaaugauacaguauuuuaacaa

SEQ ID NO: 465496 - RNA, 64 nt, Human
auuggucaauaggggaggguagauuagcugcuccagaauucaauaaaguguaauauuucuaacg

SEQ ID NO: 465497 - RNA, 64 nt, Human
aacauuuguuuuagucugaacaauauauacuuauagaauucagucaaagauacacaaucugaaa

SEQ ID NO: 465498 - RNA, 64 nt, Human
uguugccaauagcaaacugcuuuuccauuaauggagaauucaugccuuucaagcauuuuaaaua

SEQ ID NO: 465499 - RNA, 64 nt, Human
ucuauccgaggccauuggagaccccaguuucucaagaauucagcucugcucugagcguccugga

SEQ ID NO: 465500 - RNA, 64 nt, Human
uauggggauaauucaguuguugcaaaaaaagggcagaauucaguagaauaaaguccuuuucucu

SEQ ID NO: 465501 - RNA, 64 nt, Human
uuaggcccauuccacaaagcccaucucugguuugagaauucauuuugaucuguaucuacaccac

SEQ ID NO: 465502 - RNA, 64 nt, Human
gaugcccuguaguuugaaagugaaguaaagauuuagaauucaccuaaguccaaaggaaaacacg

SEQ ID NO: 465503 - RNA, 64 nt, Human
agaauagauuaguuucauuauaccuauaagaacaagaauucaaaagugagguagucauccaggu

SEQ ID NO: 465504 - RNA, 64 nt, Human
ugcuucauaacuuguauggagaacucaccaagaaagaauucaauacugugaaauaugcagcaag

SEQ ID NO: 465505 - RNA, 64 nt, Human
uugggggcaaguuuuuuucuucaccuucaauaugagaauucagcgaacuugaaagaaaaaucau

SEQ ID NO: 465506 - RNA, 64 nt, Human
agcacaccucauagguaugauuuuuuuaaauuaaagaauucagaauaaacauuuuuugauccac

SEQ ID NO: 465507 - RNA, 64 nt, Human
gugacuuggccaacaagggaagccuuggggccucagaauucauugaagauuuguuuugggacaa

SEQ ID NO: 465508 - RNA, 64 nt, Human
caggaauuauuccuucuuguuccucuguauucuaagaauucauguggguguuucuuauccuuac

SEQ ID NO: 465509 - RNA, 61 nt, Human; identical to SEQ ID NO: 456205

SEQ ID NO: 465510 - RNA, 61 nt, Human; identical to SEQ ID NO: 455027

SEQ ID NO: 465511 - RNA, 61 nt, Human; identical to SEQ ID NO: 455028

SEQ ID NO: 465512 - RNA, 61 nt, Human; identical to SEQ ID NO: 455029

SEQ ID NO: 465513 - RNA, 64 nt, Human
cucuuaauuccuauuucaauauguguuuccuugaagaauucaggauacaacuucuuguguauga

SEQ ID NO: 465514 - RNA, 64 nt, Human
ggguucccgugugccugagcggaccuucccagcuagaauucacuccacuuggacaugggcccca

SEQ ID NO: 465515 - RNA, 64 nt, Human
ugcccaguuuuuuuggugcugaaguacuguaaguagaauucaucaacggucuccuaauuuuugc

SEQ ID NO: 465516 - RNA, 64 nt, Human
agcuugugaguagagcaaacaaacguuuuuccaaagaauucacagugcuccuuugcaauuuaua

SEQ ID NO: 465517 - RNA, 64 nt, Human
gaaacuauuggaugaaaugaggaaaaacaggaaaagaauucacuuuuuaaaugaagaaauuagu

SEQ ID NO: 465518 - RNA, 64 nt, Human
gacugaaaaauaacaguaauuaauuguguaauucagaauucauaccaaucaguguugaaacuca

SEQ ID NO: 465519 - RNA, 64 nt, Human
auauuuauuuaaacaaauguguaauuuugaguacagaauucaacaguuaccuccaaaaaagaaa

SEQ ID NO: 465520 - RNA, 64 nt, Human
uaauuguaagcaaaacuuuggggaaaggaugaauagaauucauuugauuauuucuucaugugug

SEQ ID NO: 465521 - RNA, 64 nt, Human
cacuuggaugaaaacccuucaaggauuacuggauagaauucaggcuuuccccuccagcccccaa

SEQ ID NO: 465522 - RNA, 64 nt, Human
cugaagguguacuucaccagcaagagucaacucuagaauucaggauguuccuucuauuguuuuc

SEQ ID NO: 465523 - RNA, 64 nt, Human
cggaauucucgggaaauuauuaugacucaauaaaagaauucacaccuuaggugugggaguaaga

SEQ ID NO: 465524 - RNA, 64 nt, Human
agagggauucuuccaaaggccuucaaaucaaauuagaauucacugagaauaauaauacuuccaa

SEQ ID NO: 465525 - RNA, 64 nt, Human
uaauaucuaaguaaaauaugaugaaauuuaauagagaauucacuccucccaaaagcaccuucau

SEQ ID NO: 465526 - RNA, 64 nt, Human
aagugcuuuacuugccuugguuguuaauugaaauagaauucagcucaagcaguuguuuucagug

SEQ ID NO: 465527 - RNA, 64 nt, Human
gaucugauaaauccugauggaaacugguaugaucagaauucaguaccauccacauuggaauaua

SEQ ID NO: 465528 - RNA, 62 nt, Human; identical to SEQ ID NO: 456156

SEQ ID NO: 465529 - RNA, 62 nt, Human; identical to SEQ ID NO: 456157

SEQ ID NO: 465530 - RNA, 62 nt, Human; identical to SEQ ID NO: 456158

SEQ ID NO: 465531 - RNA, 64 nt, Human; identical to SEQ ID NO: 72920

SEQ ID NO: 465532 - RNA, 64 nt, Human
cagugacccaggagucugggccagcccaccgcaaagaauucaccaugaccugucgaguggagcg

SEQ ID NO: 465533 - RNA, 64 nt, Human
gccauuaaugggauuauaauaaauauaaugugguagaauucaaguuuuguuugccaauucaaca

SEQ ID NO: 465534 - RNA, 64 nt, Human
ucccugcuccaagugcaccaggaugcaaaugcacagaauucaccaggggcuuggacgcucuccu

SEQ ID NO: 465535 - RNA, 64 nt, Human
uguuuaaaaagccucuuccugaugaucccaacucagaauucacuguuuaccaaacaccuugguc

SEQ ID NO: 465536 - RNA, 64 nt, Human
gugcaacaaguaacgagacuauuuuguauuuuggagaauucauauuauggagaaccuaacaauu

SEQ ID NO: 465537 - RNA, 64 nt, Human
aucugcucacaguugagugggggaagaaacagccagaauucaauacaacaaagagcgggaguua

SEQ ID NO: 465538 - RNA, 54 nt, Human
agauggaggaggaggacugagcccagaauucacuagguucgaauccagagagca

SEQ ID NO: 465539 - RNA, 53 nt, Human
aggagcaaccacucugguaaucuagaauucaguggcagguaugauuccaguuc

SEQ ID NO: 465540 - RNA, 64 nt, Human
auuuugauauuuuggauacauuaacucacuuaggagaauucagaaaagaaugggugauuaaagu

SEQ ID NO: 465541 - RNA, 64 nt, Human
agcaucuucucacuaauguuuuucacuauaacagagaauucauuucaauuugaguugguucucu

SEQ ID NO: 465542 - RNA, 64 nt, Human
uaccccacagcugguuacugacaacacaagcucuagaauucauguuuguuuguuuguuuuauuu

SEQ ID NO: 465543 - RNA, 64 nt, Human
aguccauuuaugguugauauuagguuuaauagcuagaauucaaauugauuauugcuaguggcca

SEQ ID NO: 465544 - RNA, 64 nt, Human
cauaggcuccauuagaacugugacccuagucaccagaauucaggacugucuccuccaggaccaa

SEQ ID NO: 465545 - RNA, 64 nt, Human
uccucuuagacauuguuccucauaaugcacugacagaauucacauagcucuuaaugaaacaauu

SEQ ID NO: 465546 - RNA, 64 nt, Human
uauuauucugaucaugauaugaccauuuaaccucagaauucauaauuccugagggguguuaaga

SEQ ID NO: 465547 - RNA, 61 nt, Human; identical to SEQ ID NO: 456195

SEQ ID NO: 465548 - RNA, 61 nt, Human; identical to SEQ ID NO: 456196

SEQ ID NO: 465549 - RNA, 61 nt, Human; identical to SEQ ID NO: 455154

SEQ ID NO: 465550 - RNA, 64 nt, Human
auacuauaaauaauccuaaaugguuauauuugauagaauucauaacacauuaaagagaaaauuu

SEQ ID NO: 465551 - RNA, 64 nt, Human
caaaguaagauacucugccaaguuuccucuguagagaauucacuuuucucaaauuuuaaaauuu

SEQ ID NO: 465552 - RNA, 64 nt, Human
ugcuuaguaaaugccuguugaugguuuuugcaagagaauucagcagcucaacaguaaugaaagu

SEQ ID NO: 465553 - RNA, 64 nt, Human
cgggcccagaaacucuggaaagauuuuguccagaagaauucaccguguguacugagugcaguuu

SEQ ID NO: 465554 - RNA, 61 nt, Human
augacagcucagaaguuugaugacugcagguagaauucaaccuuuuccguaagugccucgg

SEQ ID NO: 465555 - RNA, 64 nt, Human
ugcugcuucucccauaacugcugccaccaccaucagaauucauaaucaaaccuaaccuuuuugu

SEQ ID NO: 465556 - RNA, 64 nt, Human
aaagauacccucucauggaauaaacaccuugcuuagaauucauauaacaaagaaguaaccuuau

SEQ ID NO: 465557 - RNA, 64 nt, Human
cucguuuggcacgcauguuagauggcagagaccaagaauucaagaugguugguggccagauuuu

SEQ ID NO: 465558 - RNA, 64 nt, Human
cuaugugauaugguacugaaauuuugaucccaauagaauucauuucucuuacguugaaucccca

SEQ ID NO: 465559 - RNA, 64 nt, Human
aguacugauuauuaaaaugacauguauuuaucagagaauucacugacguguggcuuaauacaug

SEQ ID NO: 465560 - RNA, 64 nt, Human
ugucacuggaguaauuacgcuguaauaccuguugagaauucauaccaucugaugcuuauauauu

SEQ ID NO: 465561 - RNA, 64 nt, Human
aaugcaacuuucuaaacagccccaagcaaacagcagaauucaacuuuuuaaacaauaaacacca

SEQ ID NO: 465562 - RNA, 64 nt, Human
uucaaggagagugaugauucugugaauauugcugagaauucaaauaaaaagaggacugagaacu

SEQ ID NO: 465563 - RNA, 64 nt, Human
agucuuccacuaaccuuugugaguuuauauuuucagaauucagacuuaguuguuaaaauguuac

SEQ ID NO: 465564 - RNA, 64 nt, Human
aagaaaaggggcaacuuucuguccacuauaggagagaauucagccgaagauaugagaguaauga

SEQ ID NO: 465565 - RNA, 62 nt, Human; identical to SEQ ID NO: 454955

SEQ ID NO: 465566 - RNA, 62 nt, Human; identical to SEQ ID NO: 454956

SEQ ID NO: 465567 - RNA, 62 nt, Human; identical to SEQ ID NO: 454957

SEQ ID NO: 465568 - RNA, 61 nt, Human; identical to SEQ ID NO: 455317

SEQ ID NO: 465569 - RNA, 64 nt, Human
cauugaacagccuuggaccuguucacguugccacagaauucacaugagaaccaaguagccuguu

SEQ ID NO: 465570 - RNA, 64 nt, Human
acucaacuguuucucuuuguuaucuaaauguuucagaauucaaucgugaaggaacaggcauuuu

SEQ ID NO: 465571 - RNA, 64 nt, Human
cauuccugggucuuccuacacuugcuccguaaugagaauucagagaagcagccagaaggagacu

SEQ ID NO: 465572 - RNA, 64 nt, Human
cauucuccuaagccaguuaccuuugcacugaaguagaauucaaaaggagauagagguucugaau

SEQ ID NO: 465573 - RNA, 64 nt, Human
agucuucugacugucaccucgugggguucaguagagaauucaugugacuagcgccuggccuugu

SEQ ID NO: 465574 - RNA, 64 nt, Human
ugucuugagaguauuacagguagacuugguuuuuagaauucauaaaacugacaggcaggggaau

SEQ ID NO: 465575 - RNA, 64 nt, Human
auguugaguuuggucucagacuaaguaaugcaucagaauucaucuguuugaagccugaaauaau

SEQ ID NO: 465576 - RNA, 64 nt, Human
caaaagcagaaaugagaggaaauuauuacaaaauagaauucaauaaccauauuggaugcaggcu

SEQ ID NO: 465577 - RNA, 64 nt, Human
cuuuuauguaauuucuuuaaauguguauuucuuaagaauucaaauuuguaauaaaacuauuugu

SEQ ID NO: 465578 - RNA, 64 nt, Human
uugacauguaauuguuuuguucagaaaaguuuauagaauucacauaauucuguauaaacuaugg

SEQ ID NO: 465579 - RNA, 64 nt, Human
acacaucaucaacucuaaauccuauaguaacaugagaauucacuucuucuuguaaaaauaagua

SEQ ID NO: 465580 - RNA, 64 nt, Human
ggcaguccugcacuccuucuggaggcucuaggggagaauucauuucuggccuuuucauuuuuag

SEQ ID NO: 465581 - RNA, 64 nt, Human
acaggauccagguuuuuauagcuugauauaaaacagaauucaaaaguggcuguggagugauuua

SEQ ID NO: 465582 - RNA, 64 nt, Human
uggguagaacaagacugagaaauccacaugcuucagaauucagaggguucagggaaugguuucg

SEQ ID NO: 465583 - RNA, 64 nt, Human
uggguuauauugcaaaugaucuguacuuuaggguagaauucaauauuuucugcagcuggaaaca

SEQ ID NO: 465584 - RNA, 61 nt, Human; identical to SEQ ID NO: 454722

SEQ ID NO: 465585 - RNA, 61 nt, Human; identical to SEQ ID NO: 456206

SEQ ID NO: 465586 - RNA, 61 nt, Human; identical to SEQ ID NO: 456207

SEQ ID NO: 465587 - RNA, 61 nt, Human; identical to SEQ ID NO: 456208

SEQ ID NO: 465588 - RNA, 64 nt, Human
uuuaauuaucaaucaguagauugauuccaaguggagaauucacugcuucccuaaaaugcguuuu

SEQ ID NO: 465589 - RNA, 64 nt, Human
uuuuauauuaaaauuuacaucagcaacugucuugagaauucagggaaauagaauggaauuuaaa

SEQ ID NO: 465590 - RNA, 64 nt, Human
gagaccucaugcagauuugcauuguuuuggaguaagaauucaaugcagcagcuuaauuuuucug

SEQ ID NO: 465591 - RNA, 64 nt, Human
gagcauagacaguguggagacauugggcaaggggagaauucacauccugggugggacagagcag

SEQ ID NO: 465592 - RNA, 64 nt, Human
aaccacagacaauuuaaauuuuauagaugcacuaagaauucacugcagcagcagguuacauagc

SEQ ID NO: 465593 - RNA, 64 nt, Human
ccuauuguggguauagguauuuucuuccuggggaagaauucaguucccgucucagcuguacuuu

SEQ ID NO: 465594 - RNA, 64 nt, Human
uuuuuaauguuauugaagcauguauauucauuacagaauucagauaaaauuugccuauguucug

SEQ ID NO: 465595 - RNA, 64 nt, Human
ugggaggcugaagugggaggacugcuugggcccaagaauucaggaccagucugggcaacagagc

SEQ ID NO: 465596 - RNA, 64 nt, Human
uuuuuaauguuauugcagcauguauauucauuccagaauucagauaaaaugugcuuauguucug

SEQ ID NO: 465597 - RNA, 64 nt, Human
aacgguguuauggacugaauguucauguuccuccagaauucauaugcugaagccucuguccaca

SEQ ID NO: 465598 - RNA, 64 nt, Human
ggagagauuucgugacaauguacgccuuucccucagaauucagggaagagacugucgccugccu

SEQ ID NO: 465599 - RNA, 64 nt, Human
uuuuuaauguuauugcagcauguauauucauuacagaauucagauaaaaugugccuauguucug

SEQ ID NO: 465600 - RNA, 64 nt, Human
uuucuaauguuauugcagcauggauguccauuacagaauucagauaaaauuugcuaauguucug

SEQ ID NO: 465601 - RNA, 64 nt, Human
auaccuuauaccauuauguugugggcaauuccagagaauucaguaccugcuuggucaggaggau

SEQ ID NO: 465602 - RNA, 64 nt, Human
uauauacuuaguggaaugguuuauuuuauggaagagaauucauuggaggugagauugaaguaua

SEQ ID NO: 465603 - RNA, 61 nt, Human; identical to SEQ ID NO: 456025

SEQ ID NO: 465604 - RNA, 61 nt, Human; identical to SEQ ID NO: 456026

SEQ ID NO: 465605 - RNA, 61 nt, Human; identical to SEQ ID NO: 456027

SEQ ID NO: 465606 - RNA, 61 nt, Human; identical to SEQ ID NO: 456046

SEQ ID NO: 465607 - RNA, 64 nt, Human
cuaaaugaaaugaggugugugggcuugucaacacagaauucaagccucauuugcuaucccagca

SEQ ID NO: 465608 - RNA, 64 nt, Human
acuugacagaguacgugucuuaaaggaagcaucaagaauucaauauuugcauuuaaaaauacuu

SEQ ID NO: 465609 - RNA, 64 nt, Human
gaauugguuguuaauuucuguuacuggcuuugcuagaauucauaugugcauaaauaacacuaau

SEQ ID NO: 465610 - RNA, 64 nt, Human
uuccuucgugaacaaaaauaaaauaggcacauuuagaauucagagccaauaugugcuugcuuau

SEQ ID NO: 465611 - RNA, 64 nt, Human
aauuauaguagccucaacucauucugucaccaguagaauucagcaguuaauauauuccauauua

SEQ ID NO: 465612 - RNA, 64 nt, Human
cucacagugacaaugcugcuccuguaauuuuguaagaauucacacacaccagcuguauuuggaa

SEQ ID NO: 465613 - RNA, 64 nt, Human
ccguuucuaagaguugugcuuuauggccacugagagaauucagaauaaauugaaagauggaguc

SEQ ID NO: 465614 - RNA, 64 nt, Human
ucugaaaucuaagcuuuguauuuaauuaaaaaacagaauucaacaucuauugauaaaacaaaau

SEQ ID NO: 465615 - RNA, 64 nt, Human
agaacuguugaugcuuucuaacauuuguauaaauagaauucagugcaaguuacaaaaauucugu

SEQ ID NO: 465616 - RNA, 64 nt, Human
ccuguguagguacaaggacauugauuuuguauucagaauucaaguuaacuaucuuuuaaauucg

SEQ ID NO: 465617 - RNA, 64 nt, Human
uugauaaaucuagaaaaugcauucauacaauuacagaauucaaauauugcaaaaggaugugugu

SEQ ID NO: 465618 - RNA, 62 nt, Human
ucagaacugaauuaaaauggcauuaugucaauagagaauucagcuaccaaacaagaaguauu

SEQ ID NO: 465619 - RNA, 64 nt, Human
gagagugcuacagucuguaugucugugucucccuagaauucauacgaugaaaucuucacucuca

SEQ ID NO: 465620 - RNA, 64 nt, Human
agaauuucucaaucuucaaggcucuaagugcuuaagaauucacuaacagacagaccaucuggag

SEQ ID NO: 465621 - RNA, 64 nt, Human
caaugagcgccugauaaccaggguugguuccuggagaauucacucauugauucauuuguucaca

SEQ ID NO: 465622 - RNA, 61 nt, Human; identical to SEQ ID NO: 455155

SEQ ID NO: 465623 - RNA, 61 nt, Human; identical to SEQ ID NO: 448925

SEQ ID NO: 465624 - RNA, 61 nt, Human; identical to SEQ ID NO: 455315

SEQ ID NO: 465625 - RNA, 61 nt, Human; identical to SEQ ID NO: 456047

SEQ ID NO: 465626 - RNA, 64 nt, Human
gccaagaauuuuuagaauuuuugagaauuuuuuaagaauucauugguuauaagcaacaguugcc

SEQ ID NO: 465627 - RNA, 64 nt, Human
gccauagugguaccuauuuugaagacuaaguaaaagaauucaaauaaagagacuuggcacagag

SEQ ID NO: 465628 - RNA, 64 nt, Human
ucugaauacugaaugugacuguuugaaagcugguagaauucaucccucuuacuguagauaacac

SEQ ID NO: 465629 - RNA, 64 nt, Human
auacaauuggacgcauuuugguuuuuccucauugagaauucaaauccucuuuuguauuguuucu

SEQ ID NO: 465630 - RNA, 64 nt, Human
agcaaaccaccuaucuggccccaacacaccugagagaauucagcagcccagacugagggucugg

SEQ ID NO: 465631 - RNA, 64 nt, Human
aaacucccuuuccaggacucucaucccugggcacagaauucaggaaacugcuagacagccuggu

SEQ ID NO: 465632 - RNA, 64 nt, Human
agcuggacaggagagguggauauuuguugauggaagaauucaaguuuauaaucaauucccacuu

SEQ ID NO: 465633 - RNA, 64 nt, Human
guaaguugcauucauuuaaacuaauagagcagacagaauucagcacuacuuaauaguuuauaaa

SEQ ID NO: 465634 - RNA, 64 nt, Human
cuuggcaugaacugaaacaggcuuucauuuccacagaauucacaggagcaugguuccuaauaau

SEQ ID NO: 465635 - RNA, 64 nt, Human
gcuuuuucuccgucucccacaacaucgaggaggaagaauucaaugacuaugaggccaacgaccc

SEQ ID NO: 465636 - RNA, 64 nt, Human
uauccuaugauuuuuagacuaggcucuaguguucagaauucaugaaauuauccaugguaaaaac

SEQ ID NO: 465637 - RNA, 64 nt, Human
aaugaauaguuuguucuuuugugaaaccagaaugagaauucagguucuaaggacuagaggucuc

SEQ ID NO: 465638 - RNA, 64 nt, Human
cugugcccucucaagccaguucuucucuuccagaagaauucagaguaugugucucagaaaaucu

SEQ ID NO: 465639 - RNA, 64 nt, Human
uggugcuguuuaaagucacaucccuguaaauugcagaauucaaaagugauuaucucuuugaucu

SEQ ID NO: 465640 - RNA, 64 nt, Human
uccuguuaacagcagcuucuugaaacauuugcauagaauucacuggacgaauuaagccugcacu

SEQ ID NO: 465641 - RNA, 62 nt, Human; identical to SEQ ID NO: 456168

SEQ ID NO: 465642 - RNA, 62 nt, Human; identical to SEQ ID NO: 456176

SEQ ID NO: 465643 - RNA, 62 nt, Human; identical to SEQ ID NO: 456177

SEQ ID NO: 465644 - RNA, 62 nt, Human; identical to SEQ ID NO: 456178

SEQ ID NO: 465645 - RNA, 64 nt, Human
uuuuuuagacacaaacccauaaacuaacugcuuaagaauucauacugcuugaauuauguaaaau

SEQ ID NO: 465646 - RNA, 64 nt, Human
guuuucauuccuuuuuguuuggcuuggccaaaccagaauucagcuuaucugaauuauuuuccaa

SEQ ID NO: 465647 - RNA, 64 nt, Human
gcaacagccgaguggauagaugcccugcuagaugagaauucagcugcccccgcucaugggcccc

SEQ ID NO: 465648 - RNA, 64 nt, Human
uauaaaugaggucucguugauguuggacaauucaagaauucagacuugaaccuuaaaccuagga

SEQ ID NO: 465649 - RNA, 64 nt, Human
ggaacaaccauuuaaaugaaggauuuugugagauagaauucaauuaaagcgauuugaaugcaca

SEQ ID NO: 465650 - RNA, 64 nt, Human
gggcuggcugaagcaaccuaccucaagucucaggagaauucaugucugccuggggcccuuccga

SEQ ID NO: 465651 - RNA, 64 nt, Human
cuuuggguuugaccugcacaucugcagugagggcagaauucaacaagcacaacucacuggucuu

SEQ ID NO: 465652 - RNA, 64 nt, Human
cauucccucuuaaucuaguuaagccaggacauccagaauucauugcuuuaauaaagaacccagg

SEQ ID NO: 465653 - RNA, 64 nt, Human
aaaaaguuuggcaccagccaccugggaccaaauaagaauucaauugugcuuguccagauaugaa

SEQ ID NO: 465654 - RNA, 64 nt, Human
auauuuuacuugauuguauacauagacccuuuccagaauucacauguaaucuccagugaacuuu

SEQ ID NO: 465655 - RNA, 64 nt, Human
cauccaugggacuuuuuaucaucuaaguaaccuaagaauucaaaagcuggauagaauuuuagaa

SEQ ID NO: 465656 - RNA, 64 nt, Human
gcaguugcauugauucagugccaaggucacuuccagaauucagaguugugaugcucucuucuga

SEQ ID NO: 465657 - RNA, 64 nt, Human
auugguguugaaaacuggaaaaaauaacucauccagaauucauauugucuugacaagaacuaug

SEQ ID NO: 465658 - RNA, 64 nt, Human
agaugguugaaagauagcuugaauuuaaugaaauagaauucagugugccaggaguuagguucau

SEQ ID NO: 465659 - RNA, 64 nt, Human
aaaagguuuggcaccagccaccugggaccaaauaagaauucaauugugcuuguccagauaugaa

SEQ ID NO: 465660 - RNA, 62 nt, Human; identical to SEQ ID NO: 456125

SEQ ID NO: 465661 - RNA, 62 nt, Human; identical to SEQ ID NO: 456126

SEQ ID NO: 465662 - RNA, 59 nt, Human; identical to SEQ ID NO: 456127

SEQ ID NO: 465663 - RNA, 62 nt, Human; identical to SEQ ID NO: 456128

SEQ ID NO: 465664 - RNA, 64 nt, Human
aaacaacagcucgauccaaauugugcuucuccccagaauucacgccucucccuaggagaagagu

SEQ ID NO: 465665 - RNA, 64 nt, Human
cuuauuuuuucugauuuaugaggguuugaaagaaagaauucaccuaaaagauuccauuuccagu

SEQ ID NO: 465666 - RNA, 64 nt, Human
uuuagccaaaucccguuuuaugggaaugcucuuuagaauucauuuuguucagccccuuuguucu

SEQ ID NO: 465667 - RNA, 64 nt, Human
uucagaacagcgauugaccaguaacugugagaucagaauucacccaaaggaagacauuuucauc

SEQ ID NO: 465668 - RNA, 64 nt, Human
gaagcauguguaaaauuauacuuucaguaauuggagaauucagagauugcauuucuagcagaga

SEQ ID NO: 465669 - RNA, 64 nt, Human
ugccccauucucuccaauggcugggugaaaaccaagaauucaucggaagauggcuuuggccugg

SEQ ID NO: 465670 - RNA, 64 nt, Human
uaaaauaaugccuuuuuuaguguuuuuaauuuuuagaauucacuacauaaauuguaaguaauug

SEQ ID NO: 465671 - RNA, 64 nt, Human
cuaguaagcgaugcugcaacuuguuaucuuaacaagaauucaagucguuuuaauuaaaucccac

SEQ ID NO: 465672 - RNA, 64 nt, Human
uagauaauaauuucuaugggaccaaagacuagacagaauucaguaagucacaugaaguaauggu

SEQ ID NO: 465673 - RNA, 64 nt, Human
cuaaugagugaaugguacuaguuuauauaaaaggagaauucauugagcuaaccuugguuuuaaa

SEQ ID NO: 465674 - RNA, 64 nt, Human
cccagccacuaccucccagcuuggagaacaccucagaauucagaagauaugaacgcauugggaa

SEQ ID NO: 465675 - RNA, 64 nt, Human
uacugcuggcaccaguuaauucugggauacaguaagaauucauauggagaaagucccuuugucu

SEQ ID NO: 465676 - RNA, 64 nt, Human
ccaacuuuaucauggaauuuaaugcugaauauauagaauucagaaaauuguugggaggacagcc

SEQ ID NO: 465677 - RNA, 64 nt, Human
cuagaauacaaagcuaauacugcuaauuggcaugagaauucaacauaaaauugugagcucugau

SEQ ID NO: 465678 - RNA, 64 nt, Human
aauaacuccuguuaaacuuucugacaauaucauaagaauucauauuaaagguguuauucuuucu

SEQ ID NO: 465679 - RNA, 62 nt, Human; identical to SEQ ID NO: 456132

SEQ ID NO: 465680 - RNA, 62 nt, Human; identical to SEQ ID NO: 456133

SEQ ID NO: 465681 - RNA, 62 nt, Human; identical to SEQ ID NO: 456134

SEQ ID NO: 465682 - RNA, 62 nt, Human; identical to SEQ ID NO: 456135

SEQ ID NO: 465683 - RNA, 64 nt, Human
uccucauuaggagcccccaucccuguguuccccaagaauucagagaacagcacuggggcuggaa

SEQ ID NO: 465684 - RNA, 64 nt, Human
aagugaaaacacugggcucccuguuaaacgaugaagaauucaagacagugacagcauuacguca

SEQ ID NO: 465685 - RNA, 64 nt, Human
ccggccugggacucagcauuucugauaugccuuaagaauucauucuguuuuguacaauuauuuu

SEQ ID NO: 465686 - RNA, 64 nt, Human
caccugcuuuccuguccguuggugaaggaauuucagaauucauuuuauauccaagacuggcuuu

SEQ ID NO: 465687 - RNA, 64 nt, Human
cuuuaauuaguucucaucccuuacuaaacauaagagaauucauaccauagagaaauccuacaaa

SEQ ID NO: 465688 - RNA, 64 nt, Human
cuucagcuguaguucaaaccuuacuguacaucagagaauucauacuggagaaaagccauauaaa

SEQ ID NO: 465689 - RNA, 64 nt, Human
guguggcagaaguuuauuuauuuuuauccaguauagaauucaauuauaugauuauaucacaauu

SEQ ID NO: 465690 - RNA, 64 nt, Human
uaaauuuuaucaauauggugcugguucaaaccagagaauucaugcugcagggaaacucaaucaa

SEQ ID NO: 465691 - RNA, 64 nt, Human
uuuuauucagaugucaaaccucauucgacaccagagaauucauacgggugagaaacccuaugca

SEQ ID NO: 465692 - RNA, 64 nt, Human
ugggaggcugaggcaggaggaucacucgagcucaagaauucaagaccugggcaagagagagaga

SEQ ID NO: 465693 - RNA, 64 nt, Human
acagcacagaauauuuauaaaaugucauguuuuaagaauucaugagcugaguuuuuauaguuau

SEQ ID NO: 465694 - RNA, 64 nt, Human
ccugccccagcccuucgagcccccuccccaauaaagaauucacauccuccaaugacauuccccc

SEQ ID NO: 465695 - RNA, 64 nt, Human
guauguaugcccucagugcagugggguuugcugcagaauucacugcauagcaggagauguaagc

SEQ ID NO: 465696 - RNA, 64 nt, Human
uacagauggaaugaauguggcaaaaucuuuaguuagaauucacaccuagcacaacauuggagga

SEQ ID NO: 465697 - RNA, 64 nt, Human
uuucagucacagaucacgccuuaaaagacauaggagaauucauacuggagagaaaccuuacaag

SEQ ID NO: 465698 - RNA, 62 nt, Human; identical to SEQ ID NO: 456136

SEQ ID NO: 465699 - RNA, 62 nt, Human; identical to SEQ ID NO: 456137

SEQ ID NO: 465700 - RNA, 62 nt, Human; identical to SEQ ID NO: 456138

SEQ ID NO: 465701 - RNA, 50 nt, Human; identical to SEQ ID NO: 456140

SEQ ID NO: 465702 - RNA, 64 nt, Human
cuucagucaagcuucauccuaugcaaaacauaggagaauucaugcaggagagaaaugucacaag

SEQ ID NO: 465703 - RNA, 64 nt, Human
aaaaccuucagccagauugaaugcuuuacagggaagaauucauacugcagagcggucuuaacaa

SEQ ID NO: 465704 - RNA, 64 nt, Human
aauugaaccagccuggagucuuauucuccaccugagaauucacccaugagagagacccaguggu

SEQ ID NO: 465705 - RNA, 64 nt, Human
auguagguacagcucuccagucgcuauguaucagagaauucacacugcagaaauguguguucag

SEQ ID NO: 465706 - RNA, 64 nt, Human
cuuuagaugucgcuccacacuugauacacaucagagaauucacacuggugaaaggccuuaugag

SEQ ID NO: 465707 - RNA, 64 nt, Human
cuuuagauacaacuccagccucauuaaacaucggagaauucacacuggagagagaccuuaucag

SEQ ID NO: 465708 - RNA, 64 nt, Human
cuuuagccaacggugucaacuuacuaggcagcagagaauucauacuggagagaagcccugugaa

SEQ ID NO: 465709 - RNA, 64 nt, Human
ggccccauagccucuggaacugugcguucugcauagaauucaaacgagauucacccagcgcgag

SEQ ID NO: 465710 - RNA, 64 nt, Human
ccacaaaucaucauuuuccaccgagccacugggcagaauucacacugaagcugucguccugcgu

SEQ ID NO: 465711 - RNA, 64 nt, Human
uucgcagccuuccuguguuggaugaaagagaauaagaauucagcugacaggaggccucuauccu

SEQ ID NO: 465712 - RNA, 64 nt, Human
uucucuuucucaaggauguuccuugcugagaaaaagaauucagugauauuucucccauuugcuu

SEQ ID NO: 465713 - RNA, 64 nt, Human
auuugcucuuuccucaugccuaaguaugcaugaaagaauucacacuggggagaaauacuaugaa

SEQ ID NO: 465714 - RNA, 64 nt, Human
auucucuuggcucacuugccuucuacaacaugaaagaauucacacucgagagaaaccuuaugaa

SEQ ID NO: 465715 - RNA, 64 nt, Human
cauuuaauccaaaauaagucuauguaaauaucagagaauucacaguggaaauaucuaagguagg

SEQ ID NO: 465716 - RNA, 64 nt, Human
cuucaacuguuccucacaccuuacuacucauaaaagaauucauacuggaggaaaagcccuacaa

SEQ ID NO: 465717 - RNA, 62 nt, Human; identical to SEQ ID NO: 456145

SEQ ID NO: 465718 - RNA, 62 nt, Human; identical to SEQ ID NO: 456145

SEQ ID NO: 465719 - RNA, 62 nt, Human; identical to SEQ ID NO: 456147

SEQ ID NO: 465720 - RNA, 62 nt, Human; identical to SEQ ID NO: 454920

SEQ ID NO: 465721 - RNA, 64 nt, Human
cuucaaccgguccucaaaccuuguggaacauaagagaauucauacuggagagaaacccuacaaa

SEQ ID NO: 465722 - RNA, 64 nt, Human
uuuccagguuuggcuaauaaucauuccuuaaccuagaauucagaugauccuggaauuaaggcag

SEQ ID NO: 465723 - RNA, 64 nt, Human
aauccuuuauugauuguucaacucuuaacaccagagaauucacacuggugagaaacccuuugaa

SEQ ID NO: 465724 - RNA, 64 nt, Human
gccuuugcuuguuuccuaccuuaauagaaaucagagaauucacacuagugagaaaccguaucag

SEQ ID NO: 465725 - RNA, 64 nt, Human
uuuuaauaauuauccaacucuuacucaacaucaaagaauucauaccagugugaaacccuaugaa

SEQ ID NO: 465726 - RNA, 64 nt, Human
cuucauuuguuuuuuugauuuuaauagacaucagagaauucacaaaggagagaaacccuaucag

SEQ ID NO: 465727 - RNA, 61 nt, Human
caagcauaaugcacaucuaaugagacaucagagaauucacaguggggagaaacccuaugaa

SEQ ID NO: 465728 - RNA, 64 nt, Human
uggugagagagaaaauccgugcauuguuuucaaaagaauucauuaacguaucaauucaauuucu

SEQ ID NO: 465729 - RNA, 64 nt, Human
agcgcaaugaaugcucaaguugggguugggcguuagaauucauaaaagucuuuauaugcucaga

SEQ ID NO: 465730 - RNA, 64 nt, Human
cuucagucaagcuucauccuaugcaaaacauaggagaauucauacaggagagaaaccucacaug

SEQ ID NO: 465731 - RNA, 64 nt, Human
uuuugggagugauucacaccuggcacaccauacuagaauucacacuggagagaaaccuuacaag

SEQ ID NO: 465732 - RNA, 64 nt, Human
guugucagucacaaaucacagcuugaaagacaggagaauucauacuggagaaaaaacauacaaa

SEQ ID NO: 465733 - RNA, 64 nt, Human
uuuugaauauaauucauaccuggcaaaacauauuagaauucaaacuggagagaaaccuuacaaa

SEQ ID NO: 465734 - RNA, 64 nt, Human
uuuuaaucaaaaaacaacccuugcacgucaucauagaauucauacugcagagaaacuuuacaaa

SEQ ID NO: 465735 - RNA, 64 nt, Human
uuucgggaaugauucacacguggcaccccauacuagaauucacacuggagagaaaccuuacaag

SEQ ID NO: 465736 - RNA, 61 nt, Human; identical to SEQ ID NO: 456201

SEQ ID NO: 465737 - RNA, 61 nt, Human; identical to SEQ ID NO: 456202

SEQ ID NO: 465738 - RNA, 61 nt, Human; identical to SEQ ID NO: 456203

SEQ ID NO: 465739 - RNA, 61 nt, Human; identical to SEQ ID NO: 456086

SEQ ID NO: 465740 - RNA, 64 nt, Human
uuuucauucacaaauccagcuucaaauacauaggagaauucacacuggagaaaagccauagaaa

SEQ ID NO: 465741 - RNA, 64 nt, Human
uuuugcauauaaugcauaucuggcaaaacauacuagaauucacacuggagagaaacucauuaua

SEQ ID NO: 465742 - RNA, 64 nt, Human
aaccuuacaaaugaaggugguaacuuuugcaguuagaauucauuccuuugacaacgucagagaa

SEQ ID NO: 465743 - RNA, 64 nt, Human
aguuuuucagccacaaauucuuucacaacaucagagaauucauucuugagacaauucuuacaaa

SEQ ID NO: 465744 - RNA, 64 nt, Human
uuggauguuauuauuaagaaccaaaugucaauacagaauucauguugccgguuucccacuuuuc

SEQ ID NO: 465745 - RNA, 64 nt, Human
agugcauucccauauuaggccauccccuucacgaagaauucaggggaugugggaaguggggagg

SEQ ID NO: 465746 - RNA, 64 nt, Human
guguauuuuucuaagucaucaagauaaauccuuaagaauucagucuaaauuagcaaccaggaag

SEQ ID NO: 465747 - RNA, 60 nt, Human
ccucugaacgggagccguagcucaggaggcagaauucaguguguuaucauugggcagaac

SEQ ID NO: 465748 - RNA, 64 nt, Human
guuagaucaaacacuuaaaacuuuuuguuauggaagaauucaaauauaaauaaaaaauugugag

SEQ ID NO: 465749 - RNA, 64 nt, Human
auggaagcaaaggaauccugccugccuucagcagagaauucaccgaauccuagaacuguggcuc

SEQ ID NO: 465750 - RNA, 62 nt, Human
ggucgagcauccuguuugcugauaaauauuaaggagaauucaugacucuugacagcuuuucu

SEQ ID NO: 465751 - RNA, 64 nt, Human
aucacaaagcaaguuagcguuaagagcugagacuagaauucaggguccucacucccaggccacc

SEQ ID NO: 465752 - RNA, 64 nt, Human
uuauagggcaagagaagucacacuccggccucucagaauucacuugagguucaauuaaauacag

SEQ ID NO: 465753 - RNA, 64 nt, Human
ugugagacccccacaccucaguucccuuggccucagaauucacaaaauuuccacaaaaucuguc

SEQ ID NO: 465754 - RNA, 64 nt, Human
agucccuuauguauauagcuuuuuuucuuucuugagaauucaucuugaguuaucuuuuauuuag

SEQ ID NO: 465755 - RNA, 62 nt, Human; identical to SEQ ID NO: 456141

SEQ ID NO: 465756 - RNA, 62 nt, Human; identical to SEQ ID NO: 456142

SEQ ID NO: 465757 - RNA, 62 nt, Human; identical to SEQ ID NO: 456143

SEQ ID NO: 465758 - RNA, 62 nt, Human; identical to SEQ ID NO: 454939

SEQ ID NO: 465759 - RNA, 64 nt, Human
gcuggucuagccccagacagggcaugaggggcagagaauucaagaagguacagcuuuggcccuc

SEQ ID NO: 465760 - RNA, 58 nt, Human
gggccuguggcugccacuagcuccuccgagaauucagacccuuuggggccaaguuuuu

SEQ ID NO: 465761 - RNA, 64 nt, Human
gggaugaauauaauuaaaauauguuuaauaacuuagaauucaacuaauaaaaauuuagccacac

SEQ ID NO: 465762 - RNA, 64 nt, Human
aauuuaaaauaauuauauaacuguauuugaaauaagaauucagacaucugagguuuuauuucau

SEQ ID NO: 465763 - RNA, 64 nt, Human
uuuuguggguuucucugugcucugaaugggagccagaauucacuaggaggucaucaaccgaugg

SEQ ID NO: 465764 - RNA, 64 nt, Human
ugacuaauauuaacaaaacuugagccaagaguaaagaauucagaaggccugucaggugaagucu

SEQ ID NO: 465765 - RNA, 64 nt, Human
aauuuuuuuaaucgucaaccacuuuuaaacauaaagaauucacacaacuacuuucaugaauuuu

SEQ ID NO: 465766 - RNA, 64 nt, Human
uccauuguugcaucuugaauuuuuuaaaaugucuagaauucaggaugcuaggggcuacuucuuu

SEQ ID NO: 465767 - RNA, 64 nt, Human
gguuuauuaaaucgauauauucucauggcuuuucagaauucagaauauggagaugacagcauca

SEQ ID NO: 465768 - RNA, 64 nt, Human
aaggacacagcguaauggagaaaggggaaguaguagaauucagaaacaaaaaugcgcaucucuu

SEQ ID NO: 465769 - RNA, 64 nt, Human
accaaaguauuuuacuguaaaucuuuaaaauaacagaauucagugcucuuucauuuguuaaugc

SEQ ID NO: 465770 - RNA, 64 nt, Human
acuccuaagcuugaaagcucuuuuuucuauauacagaauucauagaauuuuugaaauacuuagu

SEQ ID NO: 465771 - RNA, 64 nt, Human
aucccuuuauaaaagcucugggggcugagcccugagaauucagugacaacaggaccaaccugcg

SEQ ID NO: 465772 - RNA, 64 nt, Human
cagacacguaacaggaacucggaagguagaacuuagaauucagaacuuggguuucaauuguaga

SEQ ID NO: 465773 - RNA, 64 nt, Human
accaucgugauuugucuuuucaugcagauuaguuagaauucacugccagguuucuucugcccac

SEQ ID NO: 465774 - RNA, 62 nt, Human; identical to SEQ ID NO: 454973

SEQ ID NO: 465775 - RNA, 62 nt, Human; identical to SEQ ID NO: 456148

SEQ ID NO: 465776 - RNA, 62 nt, Human; identical to SEQ ID NO: 456149

SEQ ID NO: 465777 - RNA, 62 nt, Human; identical to SEQ ID NO: 456150

SEQ ID NO: 465778 - RNA, 64 nt, Human
cucaucauacuggcacuguugcuggggugacggcagaauucagaacuucaauuucagugacgcc

SEQ ID NO: 465779 - RNA, 64 nt, Human
uuaaaggucugauaacuugaaauagguuuuuaggagaauucaucuacuuagacuuuuuaaaugc

SEQ ID NO: 465780 - RNA, 64 nt, Human
accuuagccccauugcuccauucacucccaggugagaauucaggcaaacguccacaaaggucac

SEQ ID NO: 465781 - RNA, 64 nt, Human
gccaucauuucauucgugggccugcugcucucuaagaauucaguagcauuuuaauaguuucuaa

SEQ ID NO: 465782 - RNA, 64 nt, Human
ugcccauuucacacaacuguggauaaauuuuggaagaauucaugaugcuaguucuuacgcuuga

SEQ ID NO: 465783 - RNA, 64 nt, Human
ucaguuuuucuauaaguuuccauauccaaaguucagaauucaugugaaauacuucuuuggggca

SEQ ID NO: 465784 - RNA, 64 nt, Human
acauuuccucuguauguaaauuagaugggauaauagaauucauaacccauaauauucuuugaaa

SEQ ID NO: 465785 - RNA, 64 nt, Human
gauugauuauaugucacuuugcuacagggcucacagaauucauucacucaacaaacauaauagg

SEQ ID NO: 465786 - RNA, 64 nt, Human
guuugcaaucuacagcuaguagagacuuugaggaagaauucaacagugugucuucagcaguguu

SEQ ID NO: 465787 - RNA, 64 nt, Human
acaaaacugcuaccuucucauccaaguggucuguagaauucaugucccuuacaguggucauuua

SEQ ID NO: 465788 - RNA, 64 nt, Human
uuauauaaauaucuaaaugucucaguagaggaguagaauucaucugguuaucaccugguccucu

SEQ ID NO: 465789 - RNA, 64 nt, Human
ccagauuggaagagggucguaaaugcauggcuacagaauucagauuuguuuuguaggacagugu

SEQ ID NO: 465790 - RNA, 64 nt, Human
cuuuacagagaauccauuguuaucaaucuagugaagaauucaaggaagacacaagacucuuacc

SEQ ID NO: 465791 - RNA, 64 nt, Human
uaagaaaaaauaauuguugaagaaagaaguugauagaauucaaaaaggccaucuuuuugcuuuc

SEQ ID NO: 465792 - RNA, 64 nt, Human
gauaaguaaguaccauacacaccuaaaagaugagagaauucauccagacauauuacagccaguu

SEQ ID NO: 465793 - RNA, 62 nt, Human; identical to SEQ ID NO: 456151

SEQ ID NO: 465794 - RNA, 62 nt, Human; identical to SEQ ID NO: 456152

SEQ ID NO: 465795 - RNA, 62 nt, Human; identical to SEQ ID NO: 456153

SEQ ID NO: 465796 - RNA, 62 nt, Human; identical to SEQ ID NO: 456155

SEQ ID NO: 465797 - RNA, 64 nt, Human
aauaaguucuagaaaauuuaaaaaucauuuuaguagaauucaguaccauugucacugcaauaag

SEQ ID NO: 465798 - RNA, 64 nt, Human; identical to SEQ ID NO: 250067

SEQ ID NO: 465799 - RNA, 64 nt, Human; identical to SEQ ID NO: 250068

SEQ ID NO: 465800 - RNA, 64 nt, Human; identical to SEQ ID NO: 250069

SEQ ID NO: 465801 - RNA, 53 nt, Human; identical to SEQ ID NO: 250070

SEQ ID NO: 465802 - RNA, 64 nt, Human; identical to SEQ ID NO: 250071

SEQ ID NO: 465803 - RNA, 64 nt, Human; identical to SEQ ID NO: 250072

SEQ ID NO: 465804 - RNA, 64 nt, Human; identical to SEQ ID NO: 250073

SEQ ID NO: 465805 - RNA, 64 nt, Human; identical to SEQ ID NO: 250077

SEQ ID NO: 465806 - RNA, 64 nt, Human; identical to SEQ ID NO: 250078

SEQ ID NO: 465807 - RNA, 64 nt, Human; identical to SEQ ID NO: 250079

SEQ ID NO: 465808 - RNA, 54 nt, Human; identical to SEQ ID NO: 250080

SEQ ID NO: 465809 - RNA, 64 nt, Human; identical to SEQ ID NO: 250081

SEQ ID NO: 465810 - RNA, 64 nt, Human; identical to SEQ ID NO: 250082

SEQ ID NO: 465811 - RNA, 64 nt, Human; identical to SEQ ID NO: 250083

SEQ ID NO: 465812 - RNA, 62 nt, Human; identical to SEQ ID NO: 456160

SEQ ID NO: 465813 - RNA, 62 nt, Human; identical to SEQ ID NO: 456161

SEQ ID NO: 465814 - RNA, 62 nt, Human; identical to SEQ ID NO: 456162

SEQ ID NO: 465815 - RNA, 62 nt, Human; identical to SEQ ID NO: 456163

SEQ ID NO: 465816 - RNA, 64 nt, Human; identical to SEQ ID NO: 250084

SEQ ID NO: 465817 - RNA, 64 nt, Human; identical to SEQ ID NO: 250085

SEQ ID NO: 465818 - RNA, 64 nt, Human; identical to SEQ ID NO: 250086

SEQ ID NO: 465819 - RNA, 64 nt, Human; identical to SEQ ID NO: 250087

SEQ ID NO: 465820 - RNA, 64 nt, Human; identical to SEQ ID NO: 250088

SEQ ID NO: 465821 - RNA, 64 nt, Human; identical to SEQ ID NO: 250089

SEQ ID NO: 465822 - RNA, 64 nt, Human; identical to SEQ ID NO: 250090

SEQ ID NO: 465823 - RNA, 64 nt, Human; identical to SEQ ID NO: 250091

SEQ ID NO: 465824 - RNA, 64 nt, Human; identical to SEQ ID NO: 250095

SEQ ID NO: 465825 - RNA, 64 nt, Human; identical to SEQ ID NO: 250096

SEQ ID NO: 465826 - RNA, 64 nt, Human; identical to SEQ ID NO: 250097

SEQ ID NO: 465827 - RNA, 64 nt, Human; identical to SEQ ID NO: 250098

SEQ ID NO: 465828 - RNA, 64 nt, Human; identical to SEQ ID NO: 250099

SEQ ID NO: 465829 - RNA, 64 nt, Human; identical to SEQ ID NO: 250100

SEQ ID NO: 465830 - RNA, 64 nt, Human; identical to SEQ ID NO: 250101

SEQ ID NO: 465831 - RNA, 62 nt, Human; identical to SEQ ID NO: 454921

SEQ ID NO: 465832 - RNA, 62 nt, Human; identical to SEQ ID NO: 448905

SEQ ID NO: 465833 - RNA, 62 nt, Human; identical to SEQ ID NO: 454937

SEQ ID NO: 465834 - RNA, 62 nt, Human; identical to SEQ ID NO: 456164

SEQ ID NO: 465835 - RNA, 64 nt, Human; identical to SEQ ID NO: 250102

SEQ ID NO: 465836 - RNA, 64 nt, Human; identical to SEQ ID NO: 250103

SEQ ID NO: 465837 - RNA, 64 nt, Human; identical to SEQ ID NO: 250104

SEQ ID NO: 465838 - RNA, 64 nt, Human; identical to SEQ ID NO: 250105

SEQ ID NO: 465839 - RNA, 64 nt, Human; identical to SEQ ID NO: 250106

SEQ ID NO: 465840 - RNA, 64 nt, Human; identical to SEQ ID NO: 250107

SEQ ID NO: 465841 - RNA, 64 nt, Human; identical to SEQ ID NO: 250108

SEQ ID NO: 465842 - RNA, 64 nt, Human; identical to SEQ ID NO: 250109

SEQ ID NO: 465843 - RNA, 64 nt, Human; identical to SEQ ID NO: 250113

SEQ ID NO: 465844 - RNA, 64 nt, Human; identical to SEQ ID NO: 250114

SEQ ID NO: 465845 - RNA, 64 nt, Human; identical to SEQ ID NO: 250115

SEQ ID NO: 465846 - RNA, 64 nt, Human; identical to SEQ ID NO: 250116

SEQ ID NO: 465847 - RNA, 64 nt, Human; identical to SEQ ID NO: 250117

SEQ ID NO: 465848 - RNA, 64 nt, Human; identical to SEQ ID NO: 250118

SEQ ID NO: 465849 - RNA, 64 nt, Human; identical to SEQ ID NO: 250119

SEQ ID NO: 465850 - RNA, 51 nt, Human; identical to SEQ ID NO: 456087

SEQ ID NO: 465851 - RNA, 61 nt, Human; identical to SEQ ID NO: 456107

SEQ ID NO: 465852 - RNA, 61 nt, Human; identical to SEQ ID NO: 454883

SEQ ID NO: 465853 - RNA, 64 nt, Human; identical to SEQ ID NO: 72924

SEQ ID NO: 465854 - RNA, 64 nt, Human; identical to SEQ ID NO: 250120

SEQ ID NO: 465855 - RNA, 61 nt, Human; identical to SEQ ID NO: 250121

SEQ ID NO: 465856 - RNA, 64 nt, Human; identical to SEQ ID NO: 250122

SEQ ID NO: 465857 - RNA, 64 nt, Human; identical to SEQ ID NO: 250123

SEQ ID NO: 465858 - RNA, 64 nt, Human; identical to SEQ ID NO: 250124

SEQ ID NO: 465859 - RNA, 64 nt, Human; identical to SEQ ID NO: 250125

SEQ ID NO: 465860 - RNA, 64 nt, Human; identical to SEQ ID NO: 250126

SEQ ID NO: 465861 - RNA, 64 nt, Human; identical to SEQ ID NO: 250127

SEQ ID NO: 465862 - RNA, 64 nt, Human; identical to SEQ ID NO: 250131

SEQ ID NO: 465863 - RNA, 64 nt, Human; identical to SEQ ID NO: 250132

SEQ ID NO: 465864 - RNA, 51 nt, Human; identical to SEQ ID NO: 250133

SEQ ID NO: 465865 - RNA, 64 nt, Human; identical to SEQ ID NO: 250134

SEQ ID NO: 465866 - RNA, 64 nt, Human; identical to SEQ ID NO: 250135

SEQ ID NO: 465867 - RNA, 64 nt, Human; identical to SEQ ID NO: 250136

SEQ ID NO: 465868 - RNA, 64 nt, Human; identical to SEQ ID NO: 250137

SEQ ID NO: 465869 - RNA, 62 nt, Human; identical to SEQ ID NO: 456098

SEQ ID NO: 465870 - RNA, 62 nt, Human; identical to SEQ ID NO: 456099

SEQ ID NO: 465871 - RNA, 62 nt, Human; identical to SEQ ID NO: 456100

SEQ ID NO: 465872 - RNA, 62 nt, Human; identical to SEQ ID NO: 456170

SEQ ID NO: 465873 - RNA, 64 nt, Human; identical to SEQ ID NO: 250138

SEQ ID NO: 465874 - RNA, 64 nt, Human; identical to SEQ ID NO: 250139

SEQ ID NO: 465875 - RNA, 64 nt, Human; identical to SEQ ID NO: 250140

SEQ ID NO: 465876 - RNA, 64 nt, Human; identical to SEQ ID NO: 250141

SEQ ID NO: 465877 - RNA, 64 nt, Human; identical to SEQ ID NO: 250142

SEQ ID NO: 465878 - RNA, 64 nt, Human; identical to SEQ ID NO: 250143

SEQ ID NO: 465879 - RNA, 64 nt, Human; identical to SEQ ID NO: 250144

SEQ ID NO: 465880 - RNA, 64 nt, Human; identical to SEQ ID NO: 250145

SEQ ID NO: 465881 - RNA, 64 nt, Human; identical to SEQ ID NO: 250149

SEQ ID NO: 465882 - RNA, 64 nt, Human; identical to SEQ ID NO: 250150

SEQ ID NO: 465883 - RNA, 64 nt, Human; identical to SEQ ID NO: 250151

SEQ ID NO: 465884 - RNA, 64 nt, Human; identical to SEQ ID NO: 250152

SEQ ID NO: 465885 - RNA, 64 nt, Human; identical to SEQ ID NO: 250153

SEQ ID NO: 465886 - RNA, 64 nt, Human; identical to SEQ ID NO: 250154

SEQ ID NO: 465887 - RNA, 64 nt, Human; identical to SEQ ID NO: 250155

SEQ ID NO: 465888 - RNA, 62 nt, Human; identical to SEQ ID NO: 456171

SEQ ID NO: 465889 - RNA, 62 nt, Human; identical to SEQ ID NO: 456172

SEQ ID NO: 465890 - RNA, 62 nt, Human; identical to SEQ ID NO: 456173

SEQ ID NO: 465891 - RNA, 62 nt, Human; identical to SEQ ID NO: 456175

SEQ ID NO: 465892 - RNA, 64 nt, Human; identical to SEQ ID NO: 250156

SEQ ID NO: 465893 - RNA, 64 nt, Human; identical to SEQ ID NO: 250157

SEQ ID NO: 465894 - RNA, 64 nt, Human; identical to SEQ ID NO: 250158

SEQ ID NO: 465895 - RNA, 64 nt, Human; identical to SEQ ID NO: 250159

SEQ ID NO: 465896 - RNA, 50 nt, Human; identical to SEQ ID NO: 250160

SEQ ID NO: 465897 - RNA, 64 nt, Human; identical to SEQ ID NO: 250161

SEQ ID NO: 465898 - RNA, 64 nt, Human; identical to SEQ ID NO: 250162

SEQ ID NO: 465899 - RNA, 64 nt, Human; identical to SEQ ID NO: 250163

SEQ ID NO: 465900 - RNA, 64 nt, Human; identical to SEQ ID NO: 250167

SEQ ID NO: 465901 - RNA, 64 nt, Human; identical to SEQ ID NO: 250168

SEQ ID NO: 465902 - RNA, 64 nt, Human; identical to SEQ ID NO: 250169

SEQ ID NO: 465903 - RNA, 64 nt, Human; identical to SEQ ID NO: 250170

SEQ ID NO: 465904 - RNA, 64 nt, Human; identical to SEQ ID NO: 250171

SEQ ID NO: 465905 - RNA, 64 nt, Human; identical to SEQ ID NO: 250172

SEQ ID NO: 465906 - RNA, 64 nt, Human; identical to SEQ ID NO: 250173

SEQ ID NO: 465907 - RNA, 62 nt, Human; identical to SEQ ID NO: 456067

SEQ ID NO: 465908 - RNA, 62 nt, Human; identical to SEQ ID NO: 456068

SEQ ID NO: 465909 - RNA, 62 nt, Human; identical to SEQ ID NO: 456069

SEQ ID NO: 465910 - RNA, 62 nt, Human; identical to SEQ ID NO: 456070

SEQ ID NO: 465911 - RNA, 64 nt, Human; identical to SEQ ID NO: 250174

SEQ ID NO: 465912 - RNA, 64 nt, Human; identical to SEQ ID NO: 250175

SEQ ID NO: 465913 - RNA, 64 nt, Human; identical to SEQ ID NO: 250176

SEQ ID NO: 465914 - RNA, 64 nt, Human; identical to SEQ ID NO: 250177

SEQ ID NO: 465915 - RNA, 64 nt, Human; identical to SEQ ID NO: 250178

SEQ ID NO: 465916 - RNA, 64 nt, Human; identical to SEQ ID NO: 250179

SEQ ID NO: 465917 - RNA, 64 nt, Human; identical to SEQ ID NO: 250180

SEQ ID NO: 465918 - RNA, 64 nt, Human; identical to SEQ ID NO: 250181

SEQ ID NO: 465919 - RNA, 64 nt, Human; identical to SEQ ID NO: 250185

SEQ ID NO: 465920 - RNA, 64 nt, Human; identical to SEQ ID NO: 250186

SEQ ID NO: 465921 - RNA, 64 nt, Human; identical to SEQ ID NO: 250187

SEQ ID NO: 465922 - RNA, 64 nt, Human; identical to SEQ ID NO: 250188

SEQ ID NO: 465923 - RNA, 64 nt, Human; identical to SEQ ID NO: 250189

SEQ ID NO: 465924 - RNA, 64 nt, Human; identical to SEQ ID NO: 250190

SEQ ID NO: 465925 - RNA, 64 nt, Human; identical to SEQ ID NO: 250191

SEQ ID NO: 465926 - RNA, 62 nt, Human; identical to SEQ ID NO: 456063

SEQ ID NO: 465927 - RNA, 62 nt, Human; identical to SEQ ID NO: 456064

SEQ ID NO: 465928 - RNA, 62 nt, Human; identical to SEQ ID NO: 456065

SEQ ID NO: 465929 - RNA, 62 nt, Human; identical to SEQ ID NO: 456071

SEQ ID NO: 465930 - RNA, 64 nt, Human; identical to SEQ ID NO: 250192

SEQ ID NO: 465931 - RNA, 64 nt, Human; identical to SEQ ID NO: 250193

SEQ ID NO: 465932 - RNA, 64 nt, Human; identical to SEQ ID NO: 250194

SEQ ID NO: 465933 - RNA, 64 nt, Human; identical to SEQ ID NO: 250195

SEQ ID NO: 465934 - RNA, 64 nt, Human; identical to SEQ ID NO: 250196

SEQ ID NO: 465935 - RNA, 64 nt, Human; identical to SEQ ID NO: 250197

SEQ ID NO: 465936 - RNA, 64 nt, Human; identical to SEQ ID NO: 250198

SEQ ID NO: 465937 - RNA, 64 nt, Human; identical to SEQ ID NO: 250199

SEQ ID NO: 465938 - RNA, 64 nt, Human; identical to SEQ ID NO: 249744

SEQ ID NO: 465939 - RNA, 64 nt, Human; identical to SEQ ID NO: 249745

SEQ ID NO: 465940 - RNA, 64 nt, Human; identical to SEQ ID NO: 249746

SEQ ID NO: 465941 - RNA, 64 nt, Human; identical to SEQ ID NO: 249747

SEQ ID NO: 465942 - RNA, 64 nt, Human; identical to SEQ ID NO: 249748

SEQ ID NO: 465943 - RNA, 64 nt, Human; identical to SEQ ID NO: 249749

SEQ ID NO: 465944 - RNA, 64 nt, Human; identical to SEQ ID NO: 249750

SEQ ID NO: 465945 - RNA, 62 nt, Human; identical to SEQ ID NO: 456121

SEQ ID NO: 465946 - RNA, 62 nt, Human; identical to SEQ ID NO: 456122

SEQ ID NO: 465947 - RNA, 62 nt, Human; identical to SEQ ID NO: 456123

SEQ ID NO: 465948 - RNA, 62 nt, Human; identical to SEQ ID NO: 456129

SEQ ID NO: 465949 - RNA, 64 nt, Human; identical to SEQ ID NO: 249751

SEQ ID NO: 465950 - RNA, 64 nt, Human; identical to SEQ ID NO: 249752

SEQ ID NO: 465951 - RNA, 64 nt, Human; identical to SEQ ID NO: 249753

SEQ ID NO: 465952 - RNA, 64 nt, Human; identical to SEQ ID NO: 249754

SEQ ID NO: 465953 - RNA, 64 nt, Human; identical to SEQ ID NO: 249755

SEQ ID NO: 465954 - RNA, 64 nt, Human; identical to SEQ ID NO: 249756

SEQ ID NO: 465955 - RNA, 64 nt, Human; identical to SEQ ID NO: 249757

SEQ ID NO: 465956 - RNA, 64 nt, Human; identical to SEQ ID NO: 250203

SEQ ID NO: 465957 - RNA, 64 nt, Human; identical to SEQ ID NO: 250223

SEQ ID NO: 465958 - RNA, 64 nt, Human; identical to SEQ ID NO: 250224

SEQ ID NO: 465959 - RNA, 64 nt, Human; identical to SEQ ID NO: 250225

SEQ ID NO: 465960 - RNA, 64 nt, Human; identical to SEQ ID NO: 250226

SEQ ID NO: 465961 - RNA, 64 nt, Human; identical to SEQ ID NO: 250227

SEQ ID NO: 465962 - RNA, 64 nt, Human; identical to SEQ ID NO: 250228

SEQ ID NO: 465963 - RNA, 64 nt, Human; identical to SEQ ID NO: 250229

SEQ ID NO: 465964 - RNA, 62 nt, Human; identical to SEQ ID NO: 456074

SEQ ID NO: 465965 - RNA, 62 nt, Human; identical to SEQ ID NO: 456075

SEQ ID NO: 465966 - RNA, 62 nt, Human; identical to SEQ ID NO: 456076

SEQ ID NO: 465967 - RNA, 62 nt, Human; identical to SEQ ID NO: 456077

SEQ ID NO: 465968 - RNA, 64 nt, Human; identical to SEQ ID NO: 250230

SEQ ID NO: 465969 - RNA, 64 nt, Human; identical to SEQ ID NO: 250231

SEQ ID NO: 465970 - RNA, 64 nt, Human; identical to SEQ ID NO: 250232

SEQ ID NO: 465971 - RNA, 64 nt, Human; identical to SEQ ID NO: 250233

SEQ ID NO: 465972 - RNA, 64 nt, Human; identical to SEQ ID NO: 250234

SEQ ID NO: 465973 - RNA, 64 nt, Human; identical to SEQ ID NO: 250235

SEQ ID NO: 465974 - RNA, 64 nt, Human; identical to SEQ ID NO: 250236

SEQ ID NO: 465975 - RNA, 64 nt, Human; identical to SEQ ID NO: 250237

SEQ ID NO: 465976 - RNA, 64 nt, Human; identical to SEQ ID NO: 250241

SEQ ID NO: 465977 - RNA, 64 nt, Human; identical to SEQ ID NO: 250242

SEQ ID NO: 465978 - RNA, 64 nt, Human; identical to SEQ ID NO: 250243

SEQ ID NO: 465979 - RNA, 64 nt, Human; identical to SEQ ID NO: 250244

SEQ ID NO: 465980 - RNA, 64 nt, Human; identical to SEQ ID NO: 250245

SEQ ID NO: 465981 - RNA, 64 nt, Human; identical to SEQ ID NO: 250246

SEQ ID NO: 465982 - RNA, 64 nt, Human; identical to SEQ ID NO: 250247

SEQ ID NO: 465983 - RNA, 62 nt, Human; identical to SEQ ID NO: 456078

SEQ ID NO: 465984 - RNA, 62 nt, Human; identical to SEQ ID NO: 456079

SEQ ID NO: 465985 - RNA, 62 nt, Human; identical to SEQ ID NO: 456080

SEQ ID NO: 465986 - RNA, 55 nt, Human; identical to SEQ ID NO: 456082

SEQ ID NO: 465987 - RNA, 64 nt, Human; identical to SEQ ID NO: 250248

SEQ ID NO: 465988 - RNA, 64 nt, Human; identical to SEQ ID NO: 250249

SEQ ID NO: 465989 - RNA, 64 nt, Human; identical to SEQ ID NO: 250250

SEQ ID NO: 465990 - RNA, 64 nt, Human; identical to SEQ ID NO: 250251

SEQ ID NO: 465991 - RNA, 52 nt, Human; identical to SEQ ID NO: 250252

SEQ ID NO: 465992 - RNA, 64 nt, Human; identical to SEQ ID NO: 250253

SEQ ID NO: 465993 - RNA, 64 nt, Human; identical to SEQ ID NO: 250254

SEQ ID NO: 465994 - RNA, 64 nt, Human; identical to SEQ ID NO: 250255

SEQ ID NO: 465995 - RNA, 64 nt, Human; identical to SEQ ID NO: 250259

SEQ ID NO: 465996 - RNA, 64 nt, Human; identical to SEQ ID NO: 250260

SEQ ID NO: 465997 - RNA, 64 nt, Human; identical to SEQ ID NO: 250261

SEQ ID NO: 465998 - RNA, 64 nt, Human; identical to SEQ ID NO: 250262

SEQ ID NO: 465999 - RNA, 64 nt, Human; identical to SEQ ID NO: 250263

SEQ ID NO: 466000 - RNA, 64 nt, Human; identical to SEQ ID NO: 250264

SEQ ID NO: 466001 - RNA, 64 nt, Human; identical to SEQ ID NO: 250265

SEQ ID NO: 466002 - RNA, 62 nt, Human; identical to SEQ ID NO: 456051

SEQ ID NO: 466003 - RNA, 62 nt, Human; identical to SEQ ID NO: 456052

SEQ ID NO: 466004 - RNA, 62 nt, Human; identical to SEQ ID NO: 456053

SEQ ID NO: 466005 - RNA, 62 nt, Human; identical to SEQ ID NO: 456090

SEQ ID NO: 466006 - RNA, 64 nt, Human; identical to SEQ ID NO: 250266

SEQ ID NO: 466007 - RNA, 64 nt, Human; identical to SEQ ID NO: 250267

SEQ ID NO: 466008 - RNA, 64 nt, Human; identical to SEQ ID NO: 250268

SEQ ID NO: 466009 - RNA, 64 nt, Human; identical to SEQ ID NO: 250269

SEQ ID NO: 466010 - RNA, 64 nt, Human; identical to SEQ ID NO: 250270

SEQ ID NO: 466011 - RNA, 64 nt, Human; identical to SEQ ID NO: 250271

SEQ ID NO: 466012 - RNA, 61 nt, Human; identical to SEQ ID NO: 250272

SEQ ID NO: 466013 - RNA, 64 nt, Human; identical to SEQ ID NO: 250273

SEQ ID NO: 466014 - RNA, 64 nt, Human; identical to SEQ ID NO: 250277

SEQ ID NO: 466015 - RNA, 64 nt, Human; identical to SEQ ID NO: 250278

SEQ ID NO: 466016 - RNA, 64 nt, Human; identical to SEQ ID NO: 250279

SEQ ID NO: 466017 - RNA, 64 nt, Human; identical to SEQ ID NO: 250280

SEQ ID NO: 466018 - RNA, 64 nt, Human; identical to SEQ ID NO: 250281

SEQ ID NO: 466019 - RNA, 64 nt, Human; identical to SEQ ID NO: 250282

SEQ ID NO: 466020 - RNA, 64 nt, Human; identical to SEQ ID NO: 250283

SEQ ID NO: 466021 - RNA, 62 nt, Human; identical to SEQ ID NO: 456072

SEQ ID NO: 466022 - RNA, 62 nt, Human; identical to SEQ ID NO: 456095

SEQ ID NO: 466023 - RNA, 62 nt, Human; identical to SEQ ID NO: 456096

SEQ ID NO: 466024 - RNA, 62 nt, Human; identical to SEQ ID NO: 456097

SEQ ID NO: 466025 - RNA, 64 nt, Human; identical to SEQ ID NO: 250284

SEQ ID NO: 466026 - RNA, 64 nt, Human; identical to SEQ ID NO: 250285

SEQ ID NO: 466027 - RNA, 64 nt, Human; identical to SEQ ID NO: 250286

SEQ ID NO: 466028 - RNA, 64 nt, Human; identical to SEQ ID NO: 250287

SEQ ID NO: 466029 - RNA, 64 nt, Human; identical to SEQ ID NO: 250288

SEQ ID NO: 466030 - RNA, 64 nt, Human; identical to SEQ ID NO: 250289

SEQ ID NO: 466031 - RNA, 64 nt, Human; identical to SEQ ID NO: 250290

SEQ ID NO: 466032 - RNA, 64 nt, Human; identical to SEQ ID NO: 250291

SEQ ID NO: 466033 - RNA, 64 nt, Human; identical to SEQ ID NO: 250295

SEQ ID NO: 466034 - RNA, 64 nt, Human; identical to SEQ ID NO: 250296

SEQ ID NO: 466035 - RNA, 64 nt, Human; identical to SEQ ID NO: 250297

SEQ ID NO: 466036 - RNA, 64 nt, Human; identical to SEQ ID NO: 250298

SEQ ID NO: 466037 - RNA, 64 nt, Human; identical to SEQ ID NO: 250299

SEQ ID NO: 466038 - RNA, 64 nt, Human; identical to SEQ ID NO: 250300

SEQ ID NO: 466039 - RNA, 64 nt, Human; identical to SEQ ID NO: 250301

SEQ ID NO: 466040 - RNA, 58 nt, Human; identical to SEQ ID NO: 456060

SEQ ID NO: 466041 - RNA, 62 nt, Human; identical to SEQ ID NO: 456130

SEQ ID NO: 466042 - RNA, 57 nt, Human; identical to SEQ ID NO: 456165

SEQ ID NO: 466043 - RNA, 61 nt, Human; identical to SEQ ID NO: 456166

SEQ ID NO: 466044 - RNA, 64 nt, Human; identical to SEQ ID NO: 250302

SEQ ID NO: 466045 - RNA, 64 nt, Human; identical to SEQ ID NO: 250303

SEQ ID NO: 466046 - RNA, 64 nt, Human; identical to SEQ ID NO: 250304

SEQ ID NO: 466047 - RNA, 64 nt, Human; identical to SEQ ID NO: 250305

SEQ ID NO: 466048 - RNA, 64 nt, Human; identical to SEQ ID NO: 250306

SEQ ID NO: 466049 - RNA, 64 nt, Human; identical to SEQ ID NO: 250307

SEQ ID NO: 466050 - RNA, 64 nt, Human; identical to SEQ ID NO: 250308

SEQ ID NO: 466051 - RNA, 64 nt, Human; identical to SEQ ID NO: 250309

SEQ ID NO: 466052 - RNA, 64 nt, Human; identical to SEQ ID NO: 250313

SEQ ID NO: 466053 - RNA, 64 nt, Human; identical to SEQ ID NO: 250314

SEQ ID NO: 466054 - RNA, 64 nt, Human; identical to SEQ ID NO: 250315

SEQ ID NO: 466055 - RNA, 64 nt, Human; identical to SEQ ID NO: 250316

SEQ ID NO: 466056 - RNA, 64 nt, Human; identical to SEQ ID NO: 250317

SEQ ID NO: 466057 - RNA, 64 nt, Human; identical to SEQ ID NO: 250318

SEQ ID NO: 466058 - RNA, 64 nt, Human; identical to SEQ ID NO: 250319

SEQ ID NO: 466059 - RNA, 62 nt, Human; identical to SEQ ID NO: 456083

SEQ ID NO: 466060 - RNA, 60 nt, Human; identical to SEQ ID NO: 456084

SEQ ID NO: 466061 - RNA, 62 nt, Human; identical to SEQ ID NO: 456088

SEQ ID NO: 466062 - RNA, 62 nt, Human; identical to SEQ ID NO: 456102

SEQ ID NO: 466063 - RNA, 64 nt, Human; identical to SEQ ID NO: 250320

SEQ ID NO: 466064 - RNA, 64 nt, Human; identical to SEQ ID NO: 250321

SEQ ID NO: 466065 - RNA, 64 nt, Human; identical to SEQ ID NO: 250322

SEQ ID NO: 466066 - RNA, 64 nt, Human; identical to SEQ ID NO: 250323

SEQ ID NO: 466067 - RNA, 64 nt, Human; identical to SEQ ID NO: 250324

SEQ ID NO: 466068 - RNA, 64 nt, Human; identical to SEQ ID NO: 250325

SEQ ID NO: 466069 - RNA, 64 nt, Human; identical to SEQ ID NO: 250326

SEQ ID NO: 466070 - RNA, 64 nt, Human; identical to SEQ ID NO: 250327

SEQ ID NO: 466071 - RNA, 64 nt, Human; identical to SEQ ID NO: 250331

SEQ ID NO: 466072 - RNA, 64 nt, Human; identical to SEQ ID NO: 250332

SEQ ID NO: 466073 - RNA, 64 nt, Human; identical to SEQ ID NO: 250333

SEQ ID NO: 466074 - RNA, 64 nt, Human; identical to SEQ ID NO: 250334

SEQ ID NO: 466075 - RNA, 64 nt, Human; identical to SEQ ID NO: 250335

SEQ ID NO: 466076 - RNA, 64 nt, Human; identical to SEQ ID NO: 250336

SEQ ID NO: 466077 - RNA, 64 nt, Human; identical to SEQ ID NO: 250337

SEQ ID NO: 466078 - RNA, 62 nt, Human; identical to SEQ ID NO: 456041

SEQ ID NO: 466079 - RNA, 62 nt, Human; identical to SEQ ID NO: 456042

SEQ ID NO: 466080 - RNA, 62 nt, Human; identical to SEQ ID NO: 456043

SEQ ID NO: 466081 - RNA, 62 nt, Human; identical to SEQ ID NO: 456108

SEQ ID NO: 466082 - RNA, 64 nt, Human; identical to SEQ ID NO: 250338

SEQ ID NO: 466083 - RNA, 64 nt, Human; identical to SEQ ID NO: 250339

SEQ ID NO: 466084 - RNA, 64 nt, Human; identical to SEQ ID NO: 250340

SEQ ID NO: 466085 - RNA, 64 nt, Human; identical to SEQ ID NO: 250341

SEQ ID NO: 466086 - RNA, 64 nt, Human; identical to SEQ ID NO: 250342

SEQ ID NO: 466087 - RNA, 64 nt, Human; identical to SEQ ID NO: 250343

SEQ ID NO: 466088 - RNA, 64 nt, Human; identical to SEQ ID NO: 250344

SEQ ID NO: 466089 - RNA, 64 nt, Human; identical to SEQ ID NO: 250345

SEQ ID NO: 466090 - RNA, 64 nt, Human; identical to SEQ ID NO: 250349

SEQ ID NO: 466091 - RNA, 55 nt, Human; identical to SEQ ID NO: 250350

SEQ ID NO: 466092 - RNA, 64 nt, Human; identical to SEQ ID NO: 250351

SEQ ID NO: 466093 - RNA, 64 nt, Human; identical to SEQ ID NO: 250352

SEQ ID NO: 466094 - RNA, 64 nt, Human; identical to SEQ ID NO: 250353

SEQ ID NO: 466095 - RNA, 64 nt, Human; identical to SEQ ID NO: 250354

SEQ ID NO: 466096 - RNA, 64 nt, Human; identical to SEQ ID NO: 250355

SEQ ID NO: 466097 - RNA, 62 nt, Human; identical to SEQ ID NO: 456021

SEQ ID NO: 466098 - RNA, 62 nt, Human; identical to SEQ ID NO: 456022

SEQ ID NO: 466099 - RNA, 62 nt, Human; identical to SEQ ID NO: 456023

SEQ ID NO: 466100 - RNA, 62 nt, Human; identical to SEQ ID NO: 456109

SEQ ID NO: 466101 - RNA, 64 nt, Human; identical to SEQ ID NO: 250356

SEQ ID NO: 466102 - RNA, 64 nt, Human; identical to SEQ ID NO: 250357

SEQ ID NO: 466103 - RNA, 64 nt, Human; identical to SEQ ID NO: 250358

SEQ ID NO: 466104 - RNA, 64 nt, Human; identical to SEQ ID NO: 250359

SEQ ID NO: 466105 - RNA, 64 nt, Human; identical to SEQ ID NO: 250360

SEQ ID NO: 466106 - RNA, 64 nt, Human; identical to SEQ ID NO: 250361

SEQ ID NO: 466107 - RNA, 64 nt, Human; identical to SEQ ID NO: 250362

SEQ ID NO: 466108 - RNA, 64 nt, Human; identical to SEQ ID NO: 250363

SEQ ID NO: 466109 - RNA, 64 nt, Human; identical to SEQ ID NO: 250367

SEQ ID NO: 466110 - RNA, 64 nt, Human; identical to SEQ ID NO: 250368

SEQ ID NO: 466111 - RNA, 64 nt, Human; identical to SEQ ID NO: 250369

SEQ ID NO: 466112 - RNA, 64 nt, Human; identical to SEQ ID NO: 250370

SEQ ID NO: 466113 - RNA, 64 nt, Human; identical to SEQ ID NO: 250371

SEQ ID NO: 466114 - RNA, 64 nt, Human; identical to SEQ ID NO: 250372

SEQ ID NO: 466115 - RNA, 64 nt, Human; identical to SEQ ID NO: 250373

SEQ ID NO: 466116 - RNA, 62 nt, Human; identical to SEQ ID NO: 456112

SEQ ID NO: 466117 - RNA, 62 nt, Human; identical to SEQ ID NO: 456113

SEQ ID NO: 466118 - RNA, 62 nt, Human; identical to SEQ ID NO: 456114

SEQ ID NO: 466119 - RNA, 62 nt, Human; identical to SEQ ID NO: 456115

SEQ ID NO: 466120 - RNA, 64 nt, Human; identical to SEQ ID NO: 250374

SEQ ID NO: 466121 - RNA, 64 nt, Human; identical to SEQ ID NO: 250375

SEQ ID NO: 466122 - RNA, 64 nt, Human; identical to SEQ ID NO: 250376

SEQ ID NO: 466123 - RNA, 64 nt, Human; identical to SEQ ID NO: 250377

SEQ ID NO: 466124 - RNA, 64 nt, Human; identical to SEQ ID NO: 250378

SEQ ID NO: 466125 - RNA, 64 nt, Human; identical to SEQ ID NO: 250379

SEQ ID NO: 466126 - RNA, 64 nt, Human; identical to SEQ ID NO: 250380

SEQ ID NO: 466127 - RNA, 64 nt, Human; identical to SEQ ID NO: 250381

SEQ ID NO: 466128 - RNA, 64 nt, Human; identical to SEQ ID NO: 250385

SEQ ID NO: 466129 - RNA, 64 nt, Human; identical to SEQ ID NO: 250386

SEQ ID NO: 466130 - RNA, 64 nt, Human; identical to SEQ ID NO: 250387

SEQ ID NO: 466131 - RNA, 64 nt, Human; identical to SEQ ID NO: 250388

SEQ ID NO: 466132 - RNA, 64 nt, Human; identical to SEQ ID NO: 250389

SEQ ID NO: 466133 - RNA, 64 nt, Human; identical to SEQ ID NO: 250390

SEQ ID NO: 466134 - RNA, 64 nt, Human; identical to SEQ ID NO: 250391

SEQ ID NO: 466135 - RNA, 62 nt, Human; identical to SEQ ID NO: 456030

SEQ ID NO: 466136 - RNA, 62 nt, Human; identical to SEQ ID NO: 456103

SEQ ID NO: 466137 - RNA, 62 nt, Human; identical to SEQ ID NO: 456104

SEQ ID NO: 466138 - RNA, 62 nt, Human; identical to SEQ ID NO: 456105

SEQ ID NO: 466139 - RNA, 64 nt, Human; identical to SEQ ID NO: 250392

SEQ ID NO: 466140 - RNA, 64 nt, Human; identical to SEQ ID NO: 250393

SEQ ID NO: 466141 - RNA, 64 nt, Human; identical to SEQ ID NO: 250394

SEQ ID NO: 466142 - RNA, 64 nt, Human; identical to SEQ ID NO: 250395

SEQ ID NO: 466143 - RNA, 64 nt, Human; identical to SEQ ID NO: 250396

SEQ ID NO: 466144 - RNA, 64 nt, Human; identical to SEQ ID NO: 250397

SEQ ID NO: 466145 - RNA, 64 nt, Human; identical to SEQ ID NO: 250398

SEQ ID NO: 466146 - RNA, 64 nt, Human; identical to SEQ ID NO: 250399

SEQ ID NO: 466147 - RNA, 59 nt, Human; identical to SEQ ID NO: 250403

SEQ ID NO: 466148 - RNA, 64 nt, Human; identical to SEQ ID NO: 250404

SEQ ID NO: 466149 - RNA, 64 nt, Human; identical to SEQ ID NO: 250405

SEQ ID NO: 466150 - RNA, 64 nt, Human; identical to SEQ ID NO: 250406

SEQ ID NO: 466151 - RNA, 64 nt, Human; identical to SEQ ID NO: 250407

SEQ ID NO: 466152 - RNA, 64 nt, Human; identical to SEQ ID NO: 250408

SEQ ID NO: 466153 - RNA, 64 nt, Human; identical to SEQ ID NO: 250409

SEQ ID NO: 466154 - RNA, 62 nt, Human; identical to SEQ ID NO: 456091

SEQ ID NO: 466155 - RNA, 62 nt, Human; identical to SEQ ID NO: 456092

SEQ ID NO: 466156 - RNA, 62 nt, Human; identical to SEQ ID NO: 456093

SEQ ID NO: 466157 - RNA, 62 nt, Human; identical to SEQ ID NO: 456110

SEQ ID NO: 466158 - RNA, 64 nt, Human; identical to SEQ ID NO: 250410

SEQ ID NO: 466159 - RNA, 64 nt, Human; identical to SEQ ID NO: 250411

SEQ ID NO: 466160 - RNA, 64 nt, Human; identical to SEQ ID NO: 250412

SEQ ID NO: 466161 - RNA, 64 nt, Human; identical to SEQ ID NO: 250413

SEQ ID NO: 466162 - RNA, 64 nt, Human; identical to SEQ ID NO: 250414

SEQ ID NO: 466163 - RNA, 64 nt, Human; identical to SEQ ID NO: 250415

SEQ ID NO: 466164 - RNA, 64 nt, Human; identical to SEQ ID NO: 250416

SEQ ID NO: 466165 - RNA, 64 nt, Human; identical to SEQ ID NO: 250417

SEQ ID NO: 466166 - RNA, 64 nt, Human; identical to SEQ ID NO: 250421

SEQ ID NO: 466167 - RNA, 64 nt, Human; identical to SEQ ID NO: 250422

SEQ ID NO: 466168 - RNA, 64 nt, Human; identical to SEQ ID NO: 250423

SEQ ID NO: 466169 - RNA, 64 nt, Human; identical to SEQ ID NO: 250424

SEQ ID NO: 466170 - RNA, 64 nt, Human; identical to SEQ ID NO: 250425

SEQ ID NO: 466171 - RNA, 64 nt, Human; identical to SEQ ID NO: 250426

SEQ ID NO: 466172 - RNA, 64 nt, Human; identical to SEQ ID NO: 250427

SEQ ID NO: 466173 - RNA, 62 nt, Human; identical to SEQ ID NO: 454919

SEQ ID NO: 466174 - RNA, 62 nt, Human; identical to SEQ ID NO: 455988

SEQ ID NO: 466175 - RNA, 62 nt, Human; identical to SEQ ID NO: 455989

SEQ ID NO: 466176 - RNA, 62 nt, Human; identical to SEQ ID NO: 455991

SEQ ID NO: 466177 - RNA, 64 nt, Human; identical to SEQ ID NO: 250428

SEQ ID NO: 466178 - RNA, 64 nt, Human; identical to SEQ ID NO: 250429

SEQ ID NO: 466179 - RNA, 64 nt, Human; identical to SEQ ID NO: 250430

SEQ ID NO: 466180 - RNA, 64 nt, Human; identical to SEQ ID NO: 250431

SEQ ID NO: 466181 - RNA, 64 nt, Human; identical to SEQ ID NO: 250432

SEQ ID NO: 466182 - RNA, 64 nt, Human; identical to SEQ ID NO: 250433

SEQ ID NO: 466183 - RNA, 64 nt, Human; identical to SEQ ID NO: 250434

SEQ ID NO: 466184 - RNA, 64 nt, Human; identical to SEQ ID NO: 250435

SEQ ID NO: 466185 - RNA, 64 nt, Human; identical to SEQ ID NO: 250439

SEQ ID NO: 466186 - RNA, 64 nt, Human; identical to SEQ ID NO: 250440

SEQ ID NO: 466187 - RNA, 64 nt, Human; identical to SEQ ID NO: 250441

SEQ ID NO: 466188 - RNA, 64 nt, Human; identical to SEQ ID NO: 250442

SEQ ID NO: 466189 - RNA, 64 nt, Human; identical to SEQ ID NO: 250443

SEQ ID NO: 466190 - RNA, 64 nt, Human; identical to SEQ ID NO: 250444

SEQ ID NO: 466191 - RNA, 64 nt, Human; identical to SEQ ID NO: 250445

SEQ ID NO: 466192 - RNA, 62 nt, Human; identical to SEQ ID NO: 455992

SEQ ID NO: 466193 - RNA, 62 nt, Human; identical to SEQ ID NO: 455993

SEQ ID NO: 466194 - RNA, 62 nt, Human; identical to SEQ ID NO: 455994

SEQ ID NO: 466195 - RNA, 62 nt, Human; identical to SEQ ID NO: 455996

SEQ ID NO: 466196 - RNA, 64 nt, Human; identical to SEQ ID NO: 250446

SEQ ID NO: 466197 - RNA, 64 nt, Human; identical to SEQ ID NO: 250447

SEQ ID NO: 466198 - RNA, 64 nt, Human; identical to SEQ ID NO: 250448

SEQ ID NO: 466199 - RNA, 64 nt, Human; identical to SEQ ID NO: 250449

SEQ ID NO: 466200 - RNA, 64 nt, Human; identical to SEQ ID NO: 250450

SEQ ID NO: 466201 - RNA, 64 nt, Human; identical to SEQ ID NO: 250451

SEQ ID NO: 466202 - RNA, 64 nt, Human; identical to SEQ ID NO: 250452

SEQ ID NO: 466203 - RNA, 64 nt, Human; identical to SEQ ID NO: 250453

SEQ ID NO: 466204 - RNA, 64 nt, Human; identical to SEQ ID NO: 250457

SEQ ID NO: 466205 - RNA, 64 nt, Human; identical to SEQ ID NO: 250458

SEQ ID NO: 466206 - RNA, 64 nt, Human; identical to SEQ ID NO: 250459

SEQ ID NO: 466207 - RNA, 64 nt, Human; identical to SEQ ID NO: 250460

SEQ ID NO: 466208 - RNA, 64 nt, Human; identical to SEQ ID NO: 250461

SEQ ID NO: 466209 - RNA, 64 nt, Human; identical to SEQ ID NO: 250462

SEQ ID NO: 466210 - RNA, 64 nt, Human; identical to SEQ ID NO: 250463

SEQ ID NO: 466211 - RNA, 62 nt, Human; identical to SEQ ID NO: 456001

SEQ ID NO: 466212 - RNA, 62 nt, Human; identical to SEQ ID NO: 456002

SEQ ID NO: 466213 - RNA, 62 nt, Human; identical to SEQ ID NO: 456003

SEQ ID NO: 466214 - RNA, 62 nt, Human; identical to SEQ ID NO: 456004

SEQ ID NO: 466215 - RNA, 64 nt, Human; identical to SEQ ID NO: 250464

SEQ ID NO: 466216 - RNA, 64 nt, Human; identical to SEQ ID NO: 250465

SEQ ID NO: 466217 - RNA, 64 nt, Human; identical to SEQ ID NO: 250466

SEQ ID NO: 466218 - RNA, 64 nt, Human; identical to SEQ ID NO: 250467

SEQ ID NO: 466219 - RNA, 64 nt, Human; identical to SEQ ID NO: 250468

SEQ ID NO: 466220 - RNA, 64 nt, Human; identical to SEQ ID NO: 250469

SEQ ID NO: 466221 - RNA, 64 nt, Human; identical to SEQ ID NO: 250470

SEQ ID NO: 466222 - RNA, 64 nt, Human; identical to SEQ ID NO: 250471

SEQ ID NO: 466223 - RNA, 64 nt, Human; identical to SEQ ID NO: 250475

SEQ ID NO: 466224 - RNA, 64 nt, Human; identical to SEQ ID NO: 250476

SEQ ID NO: 466225 - RNA, 64 nt, Human; identical to SEQ ID NO: 250477

SEQ ID NO: 466226 - RNA, 64 nt, Human; identical to SEQ ID NO: 250478

SEQ ID NO: 466227 - RNA, 64 nt, Human; identical to SEQ ID NO: 250479

SEQ ID NO: 466228 - RNA, 64 nt, Human; identical to SEQ ID NO: 250480

SEQ ID NO: 466229 - RNA, 64 nt, Human; identical to SEQ ID NO: 250481

SEQ ID NO: 466230 - RNA, 62 nt, Human; identical to SEQ ID NO: 455997

SEQ ID NO: 466231 - RNA, 62 nt, Human; identical to SEQ ID NO: 455998

SEQ ID NO: 466232 - RNA, 62 nt, Human; identical to SEQ ID NO: 455999

SEQ ID NO: 466233 - RNA, 62 nt, Human; identical to SEQ ID NO: 456012

SEQ ID NO: 466234 - RNA, 64 nt, Human; identical to SEQ ID NO: 250482

SEQ ID NO: 466235 - RNA, 64 nt, Human; identical to SEQ ID NO: 250483

SEQ ID NO: 466236 - RNA, 64 nt, Human; identical to SEQ ID NO: 250484

SEQ ID NO: 466237 - RNA, 64 nt, Human; identical to SEQ ID NO: 250485

SEQ ID NO: 466238 - RNA, 64 nt, Human; identical to SEQ ID NO: 250486

SEQ ID NO: 466239 - RNA, 64 nt, Human; identical to SEQ ID NO: 250487

SEQ ID NO: 466240 - RNA, 64 nt, Human; identical to SEQ ID NO: 250488

SEQ ID NO: 466241 - RNA, 64 nt, Human; identical to SEQ ID NO: 250489

SEQ ID NO: 466242 - RNA, 64 nt, Human; identical to SEQ ID NO: 250493

SEQ ID NO: 466243 - RNA, 64 nt, Human; identical to SEQ ID NO: 250494

SEQ ID NO: 466244 - RNA, 64 nt, Human; identical to SEQ ID NO: 250495

SEQ ID NO: 466245 - RNA, 64 nt, Human; identical to SEQ ID NO: 250496

SEQ ID NO: 466246 - RNA, 64 nt, Human; identical to SEQ ID NO: 250497

SEQ ID NO: 466247 - RNA, 64 nt, Human; identical to SEQ ID NO: 250498

SEQ ID NO: 466248 - RNA, 64 nt, Human; identical to SEQ ID NO: 250499

SEQ ID NO: 466249 - RNA, 62 nt, Human; identical to SEQ ID NO: 456116

SEQ ID NO: 466250 - RNA, 62 nt, Human; identical to SEQ ID NO: 456117

SEQ ID NO: 466251 - RNA, 62 nt, Human; identical to SEQ ID NO: 456118

SEQ ID NO: 466252 - RNA, 62 nt, Human; identical to SEQ ID NO: 456120

SEQ ID NO: 466253 - RNA, 64 nt, Human; identical to SEQ ID NO: 250500

SEQ ID NO: 466254 - RNA, 64 nt, Human; identical to SEQ ID NO: 250501

SEQ ID NO: 466255 - RNA, 64 nt, Human; identical to SEQ ID NO: 250502

SEQ ID NO: 466256 - RNA, 64 nt, Human; identical to SEQ ID NO: 250503

SEQ ID NO: 466257 - RNA, 64 nt, Human; identical to SEQ ID NO: 250504

SEQ ID NO: 466258 - RNA, 64 nt, Human; identical to SEQ ID NO: 250505

SEQ ID NO: 466259 - RNA, 64 nt, Human; identical to SEQ ID NO: 250506

SEQ ID NO: 466260 - RNA, 64 nt, Human; identical to SEQ ID NO: 250507

SEQ ID NO: 466261 - RNA, 64 nt, Human; identical to SEQ ID NO: 250511

SEQ ID NO: 466262 - RNA, 50 nt, Human; identical to SEQ ID NO: 250512

SEQ ID NO: 466263 - RNA, 64 nt, Human; identical to SEQ ID NO: 250513

SEQ ID NO: 466264 - RNA, 64 nt, Human; identical to SEQ ID NO: 250514

SEQ ID NO: 466265 - RNA, 64 nt, Human; identical to SEQ ID NO: 250515

SEQ ID NO: 466266 - RNA, 64 nt, Human; identical to SEQ ID NO: 250516

SEQ ID NO: 466267 - RNA, 64 nt, Human; identical to SEQ ID NO: 250517

SEQ ID NO: 466268 - RNA, 62 nt, Human; identical to SEQ ID NO: 456017

SEQ ID NO: 466269 - RNA, 62 nt, Human; identical to SEQ ID NO: 456018

SEQ ID NO: 466270 - RNA, 62 nt, Human; identical to SEQ ID NO: 456019

SEQ ID NO: 466271 - RNA, 62 nt, Human; identical to SEQ ID NO: 456020

SEQ ID NO: 466272 - RNA, 64 nt, Human; identical to SEQ ID NO: 250518

SEQ ID NO: 466273 - RNA, 64 nt, Human; identical to SEQ ID NO: 250519

SEQ ID NO: 466274 - RNA, 64 nt, Human; identical to SEQ ID NO: 250520

SEQ ID NO: 466275 - RNA, 64 nt, Human; identical to SEQ ID NO: 250521

SEQ ID NO: 466276 - RNA, 64 nt, Human; identical to SEQ ID NO: 250522

SEQ ID NO: 466277 - RNA, 64 nt, Human; identical to SEQ ID NO: 250523

SEQ ID NO: 466278 - RNA, 64 nt, Human; identical to SEQ ID NO: 250524

SEQ ID NO: 466279 - RNA, 64 nt, Human; identical to SEQ ID NO: 250525

SEQ ID NO: 466280 - RNA, 64 nt, Human; identical to SEQ ID NO: 250529

SEQ ID NO: 466281 - RNA, 64 nt, Human; identical to SEQ ID NO: 250530

SEQ ID NO: 466282 - RNA, 64 nt, Human; identical to SEQ ID NO: 250531

SEQ ID NO: 466283 - RNA, 64 nt, Human; identical to SEQ ID NO: 250532

SEQ ID NO: 466284 - RNA, 64 nt, Human; identical to SEQ ID NO: 250533

SEQ ID NO: 466285 - RNA, 64 nt, Human; identical to SEQ ID NO: 250534

SEQ ID NO: 466286 - RNA, 64 nt, Human; identical to SEQ ID NO: 250535

SEQ ID NO: 466287 - RNA, 62 nt, Human; identical to SEQ ID NO: 456008

SEQ ID NO: 466288 - RNA, 62 nt, Human; identical to SEQ ID NO: 456009

SEQ ID NO: 466289 - RNA, 62 nt, Human; identical to SEQ ID NO: 456010

SEQ ID NO: 466290 - RNA, 62 nt, Human; identical to SEQ ID NO: 456028

SEQ ID NO: 466291 - RNA, 64 nt, Human; identical to SEQ ID NO: 250536

SEQ ID NO: 466292 - RNA, 64 nt, Human; identical to SEQ ID NO: 250537

SEQ ID NO: 466293 - RNA, 64 nt, Human; identical to SEQ ID NO: 250538

SEQ ID NO: 466294 - RNA, 64 nt, Human; identical to SEQ ID NO: 250539

SEQ ID NO: 466295 - RNA, 64 nt, Human; identical to SEQ ID NO: 250540

SEQ ID NO: 466296 - RNA, 64 nt, Human; identical to SEQ ID NO: 250541

SEQ ID NO: 466297 - RNA, 64 nt, Human; identical to SEQ ID NO: 250542

SEQ ID NO: 466298 - RNA, 64 nt, Human; identical to SEQ ID NO: 250543

SEQ ID NO: 466299 - RNA, 64 nt, Human; identical to SEQ ID NO: 250547

SEQ ID NO: 466300 - RNA, 64 nt, Human; identical to SEQ ID NO: 250548

SEQ ID NO: 466301 - RNA, 64 nt, Human; identical to SEQ ID NO: 250549

SEQ ID NO: 466302 - RNA, 64 nt, Human; identical to SEQ ID NO: 250550

SEQ ID NO: 466303 - RNA, 64 nt, Human; identical to SEQ ID NO: 250551

SEQ ID NO: 466304 - RNA, 64 nt, Human; identical to SEQ ID NO: 250552

SEQ ID NO: 466305 - RNA, 64 nt, Human; identical to SEQ ID NO: 250553

SEQ ID NO: 466306 - RNA, 62 nt, Human; identical to SEQ ID NO: 456032

SEQ ID NO: 466307 - RNA, 62 nt, Human; identical to SEQ ID NO: 456033

SEQ ID NO: 466308 - RNA, 62 nt, Human; identical to SEQ ID NO: 456034

SEQ ID NO: 466309 - RNA, 62 nt, Human; identical to SEQ ID NO: 456035

SEQ ID NO: 466310 - RNA, 64 nt, Human; identical to SEQ ID NO: 250554

SEQ ID NO: 466311 - RNA, 64 nt, Human; identical to SEQ ID NO: 250555

SEQ ID NO: 466312 - RNA, 64 nt, Human; identical to SEQ ID NO: 250556

SEQ ID NO: 466313 - RNA, 64 nt, Human; identical to SEQ ID NO: 250557

SEQ ID NO: 466314 - RNA, 64 nt, Human; identical to SEQ ID NO: 250558

SEQ ID NO: 466315 - RNA, 64 nt, Human; identical to SEQ ID NO: 250559

SEQ ID NO: 466316 - RNA, 64 nt, Human; identical to SEQ ID NO: 250560

SEQ ID NO: 466317 - RNA, 64 nt, Human; identical to SEQ ID NO: 250561

SEQ ID NO: 466318 - RNA, 64 nt, Human; identical to SEQ ID NO: 250564

SEQ ID NO: 466319 - RNA, 64 nt, Human; identical to SEQ ID NO: 250565

SEQ ID NO: 466320 - RNA, 64 nt, Human; identical to SEQ ID NO: 250566

SEQ ID NO: 466321 - RNA, 64 nt, Human; identical to SEQ ID NO: 250567

SEQ ID NO: 466322 - RNA, 64 nt, Human; identical to SEQ ID NO: 250568

SEQ ID NO: 466323 - RNA, 64 nt, Human; identical to SEQ ID NO: 250569

SEQ ID NO: 466324 - RNA, 64 nt, Human; identical to SEQ ID NO: 250570

SEQ ID NO: 466325 - RNA, 64 nt, Human
uguccacucuagcaaguaaaaaaacuacuguuacacguuccaguaacucugucaauauuuucuu

SEQ ID NO: 466326 - RNA, 64 nt, Human
ucagauucacugguucuguaacccaguagcugugacguuccaucucuucuaaccagccauggcc

SEQ ID NO: 466327 - RNA, 64 nt, Human
aacuucucuuuucccucccaacuuggccucccacacguuccauuucauuuuggccauuauaguc

SEQ ID NO: 466328 - RNA, 64 nt, Human
aaugaucugaggcaguuuuuuccugggaauccacacguuccaugcuuuuucagaaauguuaggc

SEQ ID NO: 466329 - RNA, 64 nt, Human; identical to SEQ ID NO: 250571

SEQ ID NO: 466330 - RNA, 64 nt, Human; identical to SEQ ID NO: 250572

SEQ ID NO: 466331 - RNA, 64 nt, Human; identical to SEQ ID NO: 250573

SEQ ID NO: 466332 - RNA, 64 nt, Human; identical to SEQ ID NO: 250574

SEQ ID NO: 466333 - RNA, 64 nt, Human; identical to SEQ ID NO: 250575

SEQ ID NO: 466334 - RNA, 64 nt, Human; identical to SEQ ID NO: 250576

SEQ ID NO: 466335 - RNA, 64 nt, Human; identical to SEQ ID NO: 250577

SEQ ID NO: 466336 - RNA, 64 nt, Human; identical to SEQ ID NO: 250578

SEQ ID NO: 466337 - RNA, 64 nt, Human; identical to SEQ ID NO: 250582

SEQ ID NO: 466338 - RNA, 64 nt, Human; identical to SEQ ID NO: 250583

SEQ ID NO: 466339 - RNA, 64 nt, Human; identical to SEQ ID NO: 250584

SEQ ID NO: 466340 - RNA, 64 nt, Human; identical to SEQ ID NO: 250585

SEQ ID NO: 466341 - RNA, 64 nt, Human; identical to SEQ ID NO: 250586

SEQ ID NO: 466342 - RNA, 64 nt, Human; identical to SEQ ID NO: 250587

SEQ ID NO: 466343 - RNA, 64 nt, Human; identical to SEQ ID NO: 250588

SEQ ID NO: 466344 - RNA, 64 nt, Human
aggccccgaggacccagacccaguggggaggcggacguuccagccggcauggcugggaacugca

SEQ ID NO: 466345 - RNA, 64 nt, Human
aguucugcggcccagcauauagaaauggcucagaacguuccaggccuuggugagacacagcagc

SEQ ID NO: 466346 - RNA, 64 nt, Human
acaucacaacaaaugugaaagccuucauuauuacacguuccaguuugucucgcuguguaggcau

SEQ ID NO: 466347 - RNA, 64 nt, Human
agcugcaccagagcaaccucucacuccccaugccacguuccacaguugccaccaccucuguggc

SEQ ID NO: 466348 - RNA, 64 nt, Human; identical to SEQ ID NO: 250589

SEQ ID NO: 466349 - RNA, 64 nt, Human; identical to SEQ ID NO: 250590

SEQ ID NO: 466350 - RNA, 64 nt, Human; identical to SEQ ID NO: 250591

SEQ ID NO: 466351 - RNA, 64 nt, Human; identical to SEQ ID NO: 250592

SEQ ID NO: 466352 - RNA, 64 nt, Human; identical to SEQ ID NO: 250593

SEQ ID NO: 466353 - RNA, 64 nt, Human; identical to SEQ ID NO: 250594

SEQ ID NO: 466354 - RNA, 64 nt, Human; identical to SEQ ID NO: 250595

SEQ ID NO: 466355 - RNA, 64 nt, Human; identical to SEQ ID NO: 250596

SEQ ID NO: 466356 - RNA, 64 nt, Human; identical to SEQ ID NO: 250600

SEQ ID NO: 466357 - RNA, 64 nt, Human; identical to SEQ ID NO: 250601

SEQ ID NO: 466358 - RNA, 64 nt, Human; identical to SEQ ID NO: 250602

SEQ ID NO: 466359 - RNA, 64 nt, Human; identical to SEQ ID NO: 250603

SEQ ID NO: 466360 - RNA, 64 nt, Human; identical to SEQ ID NO: 250604

SEQ ID NO: 466361 - RNA, 58 nt, Human; identical to SEQ ID NO: 250605

SEQ ID NO: 466362 - RNA, 64 nt, Human; identical to SEQ ID NO: 250606

SEQ ID NO: 466363 - RNA, 64 nt, Human
uauguaauauuuuuauugaugaauacaucucugaacguuccagaagucuuaagguuccaaaggg

SEQ ID NO: 466364 - RNA, 64 nt, Human
gaaaagugggacuuucacauuuucauauuuaggcacguuccaauuuaauuccaaaaauacucug

SEQ ID NO: 466365 - RNA, 64 nt, Human
uaaguuggagcuugcacauuuaaaccagcagcauacguuccagaagagcaucucaaguuaccaa

SEQ ID NO: 466366 - RNA, 64 nt, Human
uaacauaaaucaugcaugucuguuuacuuuagugacguuccacagaauaaaaggaaacaaguuu

SEQ ID NO: 466367 - RNA, 64 nt, Human; identical to SEQ ID NO: 250607

SEQ ID NO: 466368 - RNA, 64 nt, Human; identical to SEQ ID NO: 250608

SEQ ID NO: 466369 - RNA, 64 nt, Human; identical to SEQ ID NO: 250609

SEQ ID NO: 466370 - RNA, 64 nt, Human; identical to SEQ ID NO: 250610

SEQ ID NO: 466371 - RNA, 64 nt, Human; identical to SEQ ID NO: 250611

SEQ ID NO: 466372 - RNA, 64 nt, Human; identical to SEQ ID NO: 250612

SEQ ID NO: 466373 - RNA, 64 nt, Human; identical to SEQ ID NO: 250613

SEQ ID NO: 466374 - RNA, 64 nt, Human; identical to SEQ ID NO: 250614

SEQ ID NO: 466375 - RNA, 64 nt, Human; identical to SEQ ID NO: 250618

SEQ ID NO: 466376 - RNA, 64 nt, Human; identical to SEQ ID NO: 250619

SEQ ID NO: 466377 - RNA, 64 nt, Human; identical to SEQ ID NO: 250620

SEQ ID NO: 466378 - RNA, 64 nt, Human; identical to SEQ ID NO: 250621

SEQ ID NO: 466379 - RNA, 64 nt, Human; identical to SEQ ID NO: 250622

SEQ ID NO: 466380 - RNA, 64 nt, Human; identical to SEQ ID NO: 250623

SEQ ID NO: 466381 - RNA, 64 nt, Human; identical to SEQ ID NO: 250624

SEQ ID NO: 466382 - RNA, 64 nt, Human
ggaacuguagggccaggggauugucucagggccgacguuccaccuggggcuucccuccccaccc

SEQ ID NO: 466383 - RNA, 64 nt, Human
agccccccuccuuccagccuuugcuccccaucccacguuccacucgcccugccuguuguucagu

SEQ ID NO: 466384 - RNA, 64 nt, Human
cguagggcagcuauggaaaccacuggguucuggaacguuccagccaggcagugguuguuccuca

SEQ ID NO: 466385 - RNA, 64 nt, Human
aagcggaaccagaacaaggucccgacagggguagacguuccaccuggggagaucccaccugccg

SEQ ID NO: 466386 - RNA, 64 nt, Human; identical to SEQ ID NO: 250625

SEQ ID NO: 466387 - RNA, 64 nt, Human; identical to SEQ ID NO: 250626

SEQ ID NO: 466388 - RNA, 64 nt, Human; identical to SEQ ID NO: 250627

SEQ ID NO: 466389 - RNA, 64 nt, Human; identical to SEQ ID NO: 250628

SEQ ID NO: 466390 - RNA, 64 nt, Human; identical to SEQ ID NO: 250629

SEQ ID NO: 466391 - RNA, 64 nt, Human; identical to SEQ ID NO: 250630

SEQ ID NO: 466392 - RNA, 64 nt, Human; identical to SEQ ID NO: 250631

SEQ ID NO: 466393 - RNA, 64 nt, Human; identical to SEQ ID NO: 250632

SEQ ID NO: 466394 - RNA, 64 nt, Human; identical to SEQ ID NO: 250636

SEQ ID NO: 466395 - RNA, 64 nt, Human; identical to SEQ ID NO: 250637

SEQ ID NO: 466396 - RNA, 64 nt, Human; identical to SEQ ID NO: 250638

SEQ ID NO: 466397 - RNA, 64 nt, Human; identical to SEQ ID NO: 250639

SEQ ID NO: 466398 - RNA, 64 nt, Human; identical to SEQ ID NO: 250640

SEQ ID NO: 466399 - RNA, 64 nt, Human; identical to SEQ ID NO: 250641

SEQ ID NO: 466400 - RNA, 63 nt, Human; identical to SEQ ID NO: 250642

SEQ ID NO: 466401 - RNA, 64 nt, Human
ucacuuuuaaaaugauaaacugcacaauaauuacacguuccaauaugguaaaacuuaagacauu

SEQ ID NO: 466402 - RNA, 64 nt, Human
cuuucaucccaucugauuuuaacccaugguugagacguuccaaguuagaucugcugcucuuagg

SEQ ID NO: 466403 - RNA, 64 nt, Human
gaaaucgggcuucacgcgucuugccuuguccccaacguuccacaacagucccgcugggggauug

SEQ ID NO: 466404 - RNA, 64 nt, Human
gcccuugcgcucccguuucucucucucuccguccacguuccagccgagucacugccugaccggc

SEQ ID NO: 466405 - RNA, 64 nt, Human; identical to SEQ ID NO: 250643

SEQ ID NO: 466406 - RNA, 64 nt, Human; identical to SEQ ID NO: 250644

SEQ ID NO: 466407 - RNA, 64 nt, Human; identical to SEQ ID NO: 250645

SEQ ID NO: 466408 - RNA, 64 nt, Human; identical to SEQ ID NO: 250646

SEQ ID NO: 466409 - RNA, 64 nt, Human; identical to SEQ ID NO: 250647

SEQ ID NO: 466410 - RNA, 64 nt, Human; identical to SEQ ID NO: 250648

SEQ ID NO: 466411 - RNA, 64 nt, Human; identical to SEQ ID NO: 250649

SEQ ID NO: 466412 - RNA, 64 nt, Human; identical to SEQ ID NO: 250650

SEQ ID NO: 466413 - RNA, 64 nt, Human; identical to SEQ ID NO: 250654

SEQ ID NO: 466414 - RNA, 64 nt, Human; identical to SEQ ID NO: 250655

SEQ ID NO: 466415 - RNA, 64 nt, Human; identical to SEQ ID NO: 250656

SEQ ID NO: 466416 - RNA, 64 nt, Human; identical to SEQ ID NO: 250657

SEQ ID NO: 466417 - RNA, 64 nt, Human; identical to SEQ ID NO: 250658

SEQ ID NO: 466418 - RNA, 64 nt, Human; identical to SEQ ID NO: 250659

SEQ ID NO: 466419 - RNA, 64 nt, Human; identical to SEQ ID NO: 250660

SEQ ID NO: 466420 - RNA, 62 nt, Human; identical to SEQ ID NO: 455971

SEQ ID NO: 466421 - RNA, 62 nt, Human; identical to SEQ ID NO: 455972

SEQ ID NO: 466422 - RNA, 62 nt, Human; identical to SEQ ID NO: 455973

SEQ ID NO: 466423 - RNA, 62 nt, Human; identical to SEQ ID NO: 456029

SEQ ID NO: 466424 - RNA, 64 nt, Human; identical to SEQ ID NO: 250661

SEQ ID NO: 466425 - RNA, 64 nt, Human; identical to SEQ ID NO: 250662

SEQ ID NO: 466426 - RNA, 64 nt, Human; identical to SEQ ID NO: 250663

SEQ ID NO: 466427 - RNA, 64 nt, Human; identical to SEQ ID NO: 250664

SEQ ID NO: 466428 - RNA, 64 nt, Human; identical to SEQ ID NO: 250665

SEQ ID NO: 466429 - RNA, 64 nt, Human; identical to SEQ ID NO: 250666

SEQ ID NO: 466430 - RNA, 64 nt, Human; identical to SEQ ID NO: 250667

SEQ ID NO: 466431 - RNA, 64 nt, Human; identical to SEQ ID NO: 250668

SEQ ID NO: 466432 - RNA, 55 nt, Human; identical to SEQ ID NO: 250672

SEQ ID NO: 466433 - RNA, 64 nt, Human; identical to SEQ ID NO: 250673

SEQ ID NO: 466434 - RNA, 64 nt, Human; identical to SEQ ID NO: 250674

SEQ ID NO: 466435 - RNA, 64 nt, Human; identical to SEQ ID NO: 250675

SEQ ID NO: 466436 - RNA, 64 nt, Human; identical to SEQ ID NO: 250676

SEQ ID NO: 466437 - RNA, 56 nt, Human; identical to SEQ ID NO: 250677

SEQ ID NO: 466438 - RNA, 64 nt, Human; identical to SEQ ID NO: 250678

SEQ ID NO: 466439 - RNA, 52 nt, Human
gccagccuucuugcugcugaucacguuccaagagaaccaccauccucacaca

SEQ ID NO: 466440 - RNA, 64 nt, Human
cugcaaacaaucccuuucauaccacaaagccaagacguuccaugguauuugugcaaaagagaug

SEQ ID NO: 466441 - RNA, 64 nt, Human
auuaagaucagcaaagggaggaggugcacagcacacguuccacgacagaugaggcgacggcuuc

SEQ ID NO: 466442 - RNA, 62 nt, Human
cccucccgagaagagaagccacagaugagugggccagcgaggccagucuucaauguccacua

SEQ ID NO: 466443 - RNA, 64 nt, Human; identical to SEQ ID NO: 250679

SEQ ID NO: 466444 - RNA, 64 nt, Human; identical to SEQ ID NO: 250680

SEQ ID NO: 466445 - RNA, 64 nt, Human; identical to SEQ ID NO: 250681

SEQ ID NO: 466446 - RNA, 64 nt, Human; identical to SEQ ID NO: 250682

SEQ ID NO: 466447 - RNA, 64 nt, Human; identical to SEQ ID NO: 250683

SEQ ID NO: 466448 - RNA, 64 nt, Human; identical to SEQ ID NO: 250684

SEQ ID NO: 466449 - RNA, 64 nt, Human; identical to SEQ ID NO: 250685

SEQ ID NO: 466450 - RNA, 64 nt, Human; identical to SEQ ID NO: 250686

SEQ ID NO: 466451 - RNA, 64 nt, Human; identical to SEQ ID NO: 250690

SEQ ID NO: 466452 - RNA, 64 nt, Human; identical to SEQ ID NO: 250691

SEQ ID NO: 466453 - RNA, 64 nt, Human; identical to SEQ ID NO: 250692

SEQ ID NO: 466454 - RNA, 64 nt, Human; identical to SEQ ID NO: 250693

SEQ ID NO: 466455 - RNA, 64 nt, Human; identical to SEQ ID NO: 250694

SEQ ID NO: 466456 - RNA, 64 nt, Human; identical to SEQ ID NO: 250695

SEQ ID NO: 466457 - RNA, 64 nt, Human; identical to SEQ ID NO: 250696

SEQ ID NO: 466458 - RNA, 62 nt, Human; identical to SEQ ID NO: 456036

SEQ ID NO: 466459 - RNA, 62 nt, Human; identical to SEQ ID NO: 456037

SEQ ID NO: 466460 - RNA, 62 nt, Human; identical to SEQ ID NO: 456038

SEQ ID NO: 466461 - RNA, 62 nt, Human; identical to SEQ ID NO: 456040

SEQ ID NO: 466462 - RNA, 64 nt, Human; identical to SEQ ID NO: 250697

SEQ ID NO: 466463 - RNA, 64 nt, Human; identical to SEQ ID NO: 250698

SEQ ID NO: 466464 - RNA, 64 nt, Human; identical to SEQ ID NO: 250699

SEQ ID NO: 466465 - RNA, 62 nt, Human; identical to SEQ ID NO: 250700

SEQ ID NO: 466466 - RNA, 64 nt, Human; identical to SEQ ID NO: 250701

SEQ ID NO: 466467 - RNA, 61 nt, Human; identical to SEQ ID NO: 250702

SEQ ID NO: 466468 - RNA, 64 nt, Human; identical to SEQ ID NO: 250703

SEQ ID NO: 466469 - RNA, 64 nt, Human; identical to SEQ ID NO: 250704

SEQ ID NO: 466470 - RNA, 64 nt, Human; identical to SEQ ID NO: 250708

SEQ ID NO: 466471 - RNA, 64 nt, Human; identical to SEQ ID NO: 250709

SEQ ID NO: 466472 - RNA, 64 nt, Human; identical to SEQ ID NO: 250710

SEQ ID NO: 466473 - RNA, 64 nt, Human; identical to SEQ ID NO: 250711

SEQ ID NO: 466474 - RNA, 64 nt, Human; identical to SEQ ID NO: 250712

SEQ ID NO: 466475 - RNA, 64 nt, Human; identical to SEQ ID NO: 250713

SEQ ID NO: 466476 - RNA, 64 nt, Human; identical to SEQ ID NO: 250714

SEQ ID NO: 466477 - RNA, 62 nt, Human; identical to SEQ ID NO: 456013

SEQ ID NO: 466478 - RNA, 62 nt, Human; identical to SEQ ID NO: 456014

SEQ ID NO: 466479 - RNA, 62 nt, Human; identical to SEQ ID NO: 456015

SEQ ID NO: 466480 - RNA, 62 nt, Human; identical to SEQ ID NO: 456180

SEQ ID NO: 466481 - RNA, 64 nt, Human; identical to SEQ ID NO: 250715

SEQ ID NO: 466482 - RNA, 64 nt, Human; identical to SEQ ID NO: 250716

SEQ ID NO: 466483 - RNA, 64 nt, Human; identical to SEQ ID NO: 250717

SEQ ID NO: 466484 - RNA, 64 nt, Human; identical to SEQ ID NO: 250718

SEQ ID NO: 466485 - RNA, 64 nt, Human; identical to SEQ ID NO: 250719

SEQ ID NO: 466486 - RNA, 64 nt, Human; identical to SEQ ID NO: 250720

SEQ ID NO: 466487 - RNA, 64 nt, Human; identical to SEQ ID NO: 250721

SEQ ID NO: 466488 - RNA, 64 nt, Human; identical to SEQ ID NO: 250722

SEQ ID NO: 466489 - RNA, 64 nt, Human; identical to SEQ ID NO: 250726

SEQ ID NO: 466490 - RNA, 64 nt, Human; identical to SEQ ID NO: 250727

SEQ ID NO: 466491 - RNA, 64 nt, Human; identical to SEQ ID NO: 250728

SEQ ID NO: 466492 - RNA, 64 nt, Human; identical to SEQ ID NO: 250729

SEQ ID NO: 466493 - RNA, 64 nt, Human; identical to SEQ ID NO: 250730

SEQ ID NO: 466494 - RNA, 64 nt, Human; identical to SEQ ID NO: 250731

SEQ ID NO: 466495 - RNA, 64 nt, Human; identical to SEQ ID NO: 250732

SEQ ID NO: 466496 - RNA, 62 nt, Human; identical to SEQ ID NO: 456045

SEQ ID NO: 466497 - RNA, 62 nt, Human; identical to SEQ ID NO: 456048

SEQ ID NO: 466498 - RNA, 62 nt, Human; identical to SEQ ID NO: 456049

SEQ ID NO: 466499 - RNA, 62 nt, Human; identical to SEQ ID NO: 456050

SEQ ID NO: 466500 - RNA, 64 nt, Human; identical to SEQ ID NO: 250733

SEQ ID NO: 466501 - RNA, 64 nt, Human; identical to SEQ ID NO: 250734

SEQ ID NO: 466502 - RNA, 64 nt, Human; identical to SEQ ID NO: 250735

SEQ ID NO: 466503 - RNA, 64 nt, Human; identical to SEQ ID NO: 250736

SEQ ID NO: 466504 - RNA, 64 nt, Human; identical to SEQ ID NO: 250737

SEQ ID NO: 466505 - RNA, 64 nt, Human; identical to SEQ ID NO: 250738

SEQ ID NO: 466506 - RNA, 64 nt, Human; identical to SEQ ID NO: 250739

SEQ ID NO: 466507 - RNA, 64 nt, Human; identical to SEQ ID NO: 250740

SEQ ID NO: 466508 - RNA, 64 nt, Human; identical to SEQ ID NO: 250744

SEQ ID NO: 466509 - RNA, 64 nt, Human; identical to SEQ ID NO: 250745

SEQ ID NO: 466510 - RNA, 64 nt, Human; identical to SEQ ID NO: 250746

SEQ ID NO: 466511 - RNA, 64 nt, Human; identical to SEQ ID NO: 250747

SEQ ID NO: 466512 - RNA, 64 nt, Human; identical to SEQ ID NO: 250748

SEQ ID NO: 466513 - RNA, 64 nt, Human; identical to SEQ ID NO: 250749

SEQ ID NO: 466514 - RNA, 64 nt, Human; identical to SEQ ID NO: 250750

SEQ ID NO: 466515 - RNA, 64 nt, Human
cugcagcgggaucuccaaccagccgcuggaauucacguuccagaaaagagagcugccucagaug

SEQ ID NO: 466516 - RNA, 64 nt, Human
cucuucugcucccugaaccucuuaacuuaauaaaacguuccagcagcucugguguccuagaugg

SEQ ID NO: 466517 - RNA, 64 nt, Human
agaauauuuugacuuaguguccugucccccuuggacguuccaacuugacuuaguguccagugcc

SEQ ID NO: 466518 - RNA, 64 nt, Human
guggggcagguugugggagggccugggccagugcacguuccagggccacauccaccacuuuccc

SEQ ID NO: 466519 - RNA, 64 nt, Human; identical to SEQ ID NO: 250751

SEQ ID NO: 466520 - RNA, 64 nt, Human; identical to SEQ ID NO: 250752

SEQ ID NO: 466521 - RNA, 64 nt, Human; identical to SEQ ID NO: 250753

SEQ ID NO: 466522 - RNA, 64 nt, Human; identical to SEQ ID NO: 250754

SEQ ID NO: 466523 - RNA, 64 nt, Human; identical to SEQ ID NO: 250755

SEQ ID NO: 466524 - RNA, 64 nt, Human; identical to SEQ ID NO: 250756

SEQ ID NO: 466525 - RNA, 64 nt, Human; identical to SEQ ID NO: 250757

SEQ ID NO: 466526 - RNA, 64 nt, Human; identical to SEQ ID NO: 250758

SEQ ID NO: 466527 - RNA, 64 nt, Human; identical to SEQ ID NO: 250762

SEQ ID NO: 466528 - RNA, 64 nt, Human; identical to SEQ ID NO: 250763

SEQ ID NO: 466529 - RNA, 64 nt, Human; identical to SEQ ID NO: 250764

SEQ ID NO: 466530 - RNA, 64 nt, Human; identical to SEQ ID NO: 250765

SEQ ID NO: 466531 - RNA, 64 nt, Human; identical to SEQ ID NO: 250766

SEQ ID NO: 466532 - RNA, 64 nt, Human; identical to SEQ ID NO: 250767

SEQ ID NO: 466533 - RNA, 64 nt, Human; identical to SEQ ID NO: 250768

SEQ ID NO: 466534 - RNA, 62 nt, Human; identical to SEQ ID NO: 456055

SEQ ID NO: 466535 - RNA, 62 nt, Human; identical to SEQ ID NO: 456056

SEQ ID NO: 466536 - RNA, 62 nt, Human; identical to SEQ ID NO: 456057

SEQ ID NO: 466537 - RNA, 62 nt, Human; identical to SEQ ID NO: 456058

SEQ ID NO: 466538 - RNA, 64 nt, Human; identical to SEQ ID NO: 250769

SEQ ID NO: 466539 - RNA, 64 nt, Human; identical to SEQ ID NO: 250770

SEQ ID NO: 466540 - RNA, 64 nt, Human; identical to SEQ ID NO: 250771

SEQ ID NO: 466541 - RNA, 64 nt, Human; identical to SEQ ID NO: 250772

SEQ ID NO: 466542 - RNA, 64 nt, Human; identical to SEQ ID NO: 250773

SEQ ID NO: 466543 - RNA, 64 nt, Human; identical to SEQ ID NO: 250774

SEQ ID NO: 466544 - RNA, 64 nt, Human; identical to SEQ ID NO: 250775

SEQ ID NO: 466545 - RNA, 64 nt, Human; identical to SEQ ID NO: 250776

SEQ ID NO: 466546 - RNA, 64 nt, Human; identical to SEQ ID NO: 250780

SEQ ID NO: 466547 - RNA, 64 nt, Human; identical to SEQ ID NO: 250781

SEQ ID NO: 466548 - RNA, 64 nt, Human; identical to SEQ ID NO: 250782

SEQ ID NO: 466549 - RNA, 64 nt, Human; identical to SEQ ID NO: 250783

SEQ ID NO: 466550 - RNA, 64 nt, Human; identical to SEQ ID NO: 250784

SEQ ID NO: 466551 - RNA, 64 nt, Human; identical to SEQ ID NO: 250785

SEQ ID NO: 466552 - RNA, 64 nt, Human; identical to SEQ ID NO: 250786

SEQ ID NO: 466553 - RNA, 62 nt, Human
auaauacaaaaauaguaaaggucuugaagaaugccagcgaagcaauucuuuuuuauuugagg

SEQ ID NO: 466554 - RNA, 62 nt, Human; identical to SEQ ID NO: 455932

SEQ ID NO: 466555 - RNA, 62 nt, Human; identical to SEQ ID NO: 455933

SEQ ID NO: 466556 - RNA, 62 nt, Human; identical to SEQ ID NO: 455934

SEQ ID NO: 466557 - RNA, 64 nt, Human; identical to SEQ ID NO: 250787

SEQ ID NO: 466558 - RNA, 64 nt, Human; identical to SEQ ID NO: 250788

SEQ ID NO: 466559 - RNA, 64 nt, Human; identical to SEQ ID NO: 250789

SEQ ID NO: 466560 - RNA, 64 nt, Human; identical to SEQ ID NO: 250790

SEQ ID NO: 466561 - RNA, 64 nt, Human; identical to SEQ ID NO: 250791

SEQ ID NO: 466562 - RNA, 64 nt, Human; identical to SEQ ID NO: 250792

SEQ ID NO: 466563 - RNA, 64 nt, Human; identical to SEQ ID NO: 250793

SEQ ID NO: 466564 - RNA, 64 nt, Human; identical to SEQ ID NO: 250794

SEQ ID NO: 466565 - RNA, 64 nt, Human; identical to SEQ ID NO: 250798

SEQ ID NO: 466566 - RNA, 64 nt, Human; identical to SEQ ID NO: 250799

SEQ ID NO: 466567 - RNA, 64 nt, Human; identical to SEQ ID NO: 250800

SEQ ID NO: 466568 - RNA, 64 nt, Human; identical to SEQ ID NO: 250801

SEQ ID NO: 466569 - RNA, 64 nt, Human; identical to SEQ ID NO: 250802

SEQ ID NO: 466570 - RNA, 64 nt, Human; identical to SEQ ID NO: 250803

SEQ ID NO: 466571 - RNA, 64 nt, Human; identical to SEQ ID NO: 250804

SEQ ID NO: 466572 - RNA, 62 nt, Human; identical to SEQ ID NO: 455935

SEQ ID NO: 466573 - RNA, 62 nt, Human; identical to SEQ ID NO: 455936

SEQ ID NO: 466574 - RNA, 62 nt, Human; identical to SEQ ID NO: 455937

SEQ ID NO: 466575 - RNA, 62 nt, Human; identical to SEQ ID NO: 455939

SEQ ID NO: 466576 - RNA, 64 nt, Human; identical to SEQ ID NO: 250805

SEQ ID NO: 466577 - RNA, 64 nt, Human; identical to SEQ ID NO: 250806

SEQ ID NO: 466578 - RNA, 64 nt, Human; identical to SEQ ID NO: 250807

SEQ ID NO: 466579 - RNA, 64 nt, Human; identical to SEQ ID NO: 250808

SEQ ID NO: 466580 - RNA, 64 nt, Human; identical to SEQ ID NO: 250809

SEQ ID NO: 466581 - RNA, 64 nt, Human; identical to SEQ ID NO: 250810

SEQ ID NO: 466582 - RNA, 64 nt, Human; identical to SEQ ID NO: 250811

SEQ ID NO: 466583 - RNA, 64 nt, Human; identical to SEQ ID NO: 250812

SEQ ID NO: 466584 - RNA, 64 nt, Human; identical to SEQ ID NO: 250816

SEQ ID NO: 466585 - RNA, 64 nt, Human; identical to SEQ ID NO: 250817

SEQ ID NO: 466586 - RNA, 64 nt, Human; identical to SEQ ID NO: 250818

SEQ ID NO: 466587 - RNA, 64 nt, Human; identical to SEQ ID NO: 250819

SEQ ID NO: 466588 - RNA, 64 nt, Human; identical to SEQ ID NO: 250820

SEQ ID NO: 466589 - RNA, 64 nt, Human; identical to SEQ ID NO: 250821

SEQ ID NO: 466590 - RNA, 64 nt, Human; identical to SEQ ID NO: 250822

SEQ ID NO: 466591 - RNA, 62 nt, Human; identical to SEQ ID NO: 455940

SEQ ID NO: 466592 - RNA, 62 nt, Human; identical to SEQ ID NO: 455941

SEQ ID NO: 466593 - RNA, 62 nt, Human; identical to SEQ ID NO: 455942

SEQ ID NO: 466594 - RNA, 62 nt, Human; identical to SEQ ID NO: 456062

SEQ ID NO: 466595 - RNA, 64 nt, Human; identical to SEQ ID NO: 250823

SEQ ID NO: 466596 - RNA, 64 nt, Human; identical to SEQ ID NO: 250824

SEQ ID NO: 466597 - RNA, 64 nt, Human; identical to SEQ ID NO: 250825

SEQ ID NO: 466598 - RNA, 64 nt, Human; identical to SEQ ID NO: 250826

SEQ ID NO: 466599 - RNA, 64 nt, Human; identical to SEQ ID NO: 250827

SEQ ID NO: 466600 - RNA, 64 nt, Human; identical to SEQ ID NO: 250828

SEQ ID NO: 466601 - RNA, 64 nt, Human; identical to SEQ ID NO: 250829

SEQ ID NO: 466602 - RNA, 64 nt, Human; identical to SEQ ID NO: 250830

SEQ ID NO: 466603 - RNA, 64 nt, Human; identical to SEQ ID NO: 250834

SEQ ID NO: 466604 - RNA, 64 nt, Human; identical to SEQ ID NO: 250835

SEQ ID NO: 466605 - RNA, 64 nt, Human; identical to SEQ ID NO: 250836

SEQ ID NO: 466606 - RNA, 64 nt, Human; identical to SEQ ID NO: 250837

SEQ ID NO: 466607 - RNA, 64 nt, Human; identical to SEQ ID NO: 250838

SEQ ID NO: 466608 - RNA, 64 nt, Human; identical to SEQ ID NO: 250839

SEQ ID NO: 466609 - RNA, 64 nt, Human
uucuucacacguuagccauuccuuacggcucuucacguuccacgccuagaugugaagugggaca

SEQ ID NO: 466610 - RNA, 64 nt, Human
uccuuauccgagugccgccucuauccccuuccccacguuccagccccugcagcccacauuuuaa

SEQ ID NO: 466611 - RNA, 64 nt, Human
gaucuaaaauggcugacacauuuguccuugugucacguuccauuauuuuauuuaaaaaccucag

SEQ ID NO: 466612 - RNA, 64 nt, Human
cuuuccaggucagccggacagcuccagcagcuccacguuccaggcagccucgcccgccggcugc

SEQ ID NO: 466613 - RNA, 64 nt, Human
gccuucuugagugaggugcugcggcggaccugccacguuccaggugccgaggggccacugcugg

SEQ ID NO: 466614 - RNA, 64 nt, Human
caagugccugaugccucaggugacagaaggcaggacguuccaugccgaggcugcccccucaccc

SEQ ID NO: 466615 - RNA, 64 nt, Human
uauaaacuuucauccaguuagcuucauaacuuuuacguuccagaauuuuguuuauuuuccuguc

SEQ ID NO: 466616 - RNA, 64 nt, Human
ccugaaugaguuucacagugcuguaggggccuacacguuccaggccaguggccaggccuugugc

SEQ ID NO: 466617 - RNA, 64 nt, Human
cugagguccugcauuucucagucgguguguaaucacguuccagggcccaaagcccagcucuuug

SEQ ID NO: 466618 - RNA, 64 nt, Human
uggcaaaggcuugccccaaaucucaacuucucagacguuccauacccccacaugccaauuucag

SEQ ID NO: 466619 - RNA, 64 nt, Human
uucaaugguuuacugucauuguguuuaaaucucaacguuccauuauuuuaauacuugcaaaaac

SEQ ID NO: 466620 - RNA, 64 nt, Human
gaauaagaaauuaacagaacauuguucgguucacacguuccaaacuuugagugauuucuggagu

SEQ ID NO: 466621 - RNA, 64 nt, Human
caauaauaauuauugcuacuauuuuuuaaaauucacguuccaagcacucuuagaugcuggaaau

SEQ ID NO: 466622 - RNA, 64 nt, Human
aaaaaauuaaugguuuuaaauauaugcuauagggacguuccaugcccagguuaacaaagaacug

SEQ ID NO: 466623 - RNA, 64 nt, Human
cugcuggccgcggugguggaggcguucuuauaccacguuccacggaggagugaggagcccagga

SEQ ID NO: 466624 - RNA, 64 nt, Human
aacaggacuauauuucaugaaauaauuucauguuacguuccaccuaaaauugucauugguacaa

SEQ ID NO: 466625 - RNA, 64 nt, Human
agauacaggucuuggaauucacuuuuuaaauguuacguuccaaccuuauauguuccaaggugca

SEQ ID NO: 466626 - RNA, 64 nt, Human
acuauagaagacauugcguuaucuuauuuccaaaacguuccaacuaaaaaacauuuuccuauua

SEQ ID NO: 466627 - RNA, 64 nt, Human
ucaaguggagaacuaaccuuuaccuaccaaagccacguuccacggcccgaggcuuaaacaggac

SEQ ID NO: 466628 - RNA, 64 nt, Human
ccuggguggggacugggcugugcccagggccucugucccccaggaugucuuguggugcgggucg

SEQ ID NO: 466629 - RNA, 64 nt, Human
uuuucuacuggccaaguucaagugaguaagccgcgucccccaacuacagcuggagacggggcca

SEQ ID NO: 466630 - RNA, 64 nt, Human
uuuuaaauguguggguuauguugcagcuguugcagucccccagauaccuauuauuuuacacaau

SEQ ID NO: 466631 - RNA, 64 nt, Human
gaggcucaaguguguuugaaaccaagagccaguugucccccaugcagaaagaaauccuguguga

SEQ ID NO: 466632 - RNA, 64 nt, Human
ggggccuuugguggccacccuggugaggacaccugucccccagggcaggcaccuucucuuuucc

SEQ ID NO: 466633 - RNA, 64 nt, Human
accuuucaaugcccagcccugacaccugcccuuugucccccaggccuaggaucagggaccagag

SEQ ID NO: 466634 - RNA, 64 nt, Human
uucugaggccuuaucugaugccucugcaguucaugucccccaccaggccucgaggcucagggug

SEQ ID NO: 466635 - RNA, 64 nt, Human
uguugcccgccaccgccccgcccugcccccuccagucccccacccugccgagaggacuaguaug

SEQ ID NO: 466636 - RNA, 64 nt, Human
cauccggcacugaagcccugguguuccuggucacgucccccaggggacccugcccacuuccugg

SEQ ID NO: 466637 - RNA, 64 nt, Human
ugaaccugacuagagguucuggagauacccagaggucccccaggucaucacuuggcucagugga

SEQ ID NO: 466638 - RNA, 64 nt, Human
accaccagccagaaaucucugauaucaaccucaugucccccaccccucaccccaucuugucaca

SEQ ID NO: 466639 - RNA, 64 nt, Human
ugcugcugcugacucugugcagcugcgcaccugugucccccaccuccacccucaacccaucuuc

SEQ ID NO: 466640 - RNA, 64 nt, Human
cuccuggacucaaacuccugcuacauccuucuccgucccccaucccuggggaggcucccaccau

SEQ ID NO: 466641 - RNA, 64 nt, Human
cagcagguucugcagcauccugccuugcugcucugucccccacaucuuccuggccacagccccu

SEQ ID NO: 466642 - RNA, 64 nt, Human
ggggaccugaauuggugagauggaaucuuagaucgucccccaugugccagccucauucgaauuc

SEQ ID NO: 466643 - RNA, 64 nt, Human
uggacugaguucccuggauuauggaaacuucgcugucccccaacacugagcaaguaugcugugg

SEQ ID NO: 466644 - RNA, 62 nt, Human
cuccuggacgaucgcgggucgcagaagcccaggccagcgagcccuacagagugaggacacug

SEQ ID NO: 466645 - RNA, 62 nt, Human
aaggggccggggaggugggcgugugugugcgugccagcgaaggcugcugugggcgugugugu

SEQ ID NO: 466646 - RNA, 62 nt, Human
gggggcgugugcucugcgggacaguccccacggccagcgacguccaggucaccaaugggauu

SEQ ID NO: 466647 - RNA, 62 nt, Human
aguauggcauccccuccccaggaucucgggcugccagcgaugggcaggcgagaccccuccag

SEQ ID NO: 466648 - RNA, 64 nt, Human
ccccagugcuuguuccucucaucuccccaccggugucccccagcagccuggggucugacaauac

SEQ ID NO: 466649 - RNA, 64 nt, Human
gccccuggaaaugugcuaaaguuggaaaguccccgucccccagaaccucaagucuagaaaccag

SEQ ID NO: 466650 - RNA, 64 nt, Human
ugucaaugguuaucaccuucaauaguuucaauaugucccccaaaguuauguguuugaaacuugc

SEQ ID NO: 466651 - RNA, 64 nt, Human
uggggcgaugcugcagcggcugaaaccacgucaagucccccagagcccggcauucuauguaagc

SEQ ID NO: 466652 - RNA, 64 nt, Human
ggcccucaacuggggcaagugaagccagaggagggucccccagcugggugggcuggaauggaac

SEQ ID NO: 466653 - RNA, 64 nt, Human
aguucuccuuccucuaggagccauguuauccucugucccccauagagucaagccuagugcuuga

SEQ ID NO: 466654 - RNA, 64 nt, Human
acaguaggugcugagaguuaggacaggucaggaagucccccaggguccacaaaggugccugagg

SEQ ID NO: 466655 - RNA, 64 nt, Human
gaaaaacacagaccgcuuuaaccucuuuauuucugucccccacugcaugaacaucuauacaauu

SEQ ID NO: 466656 - RNA, 64 nt, Human
uuccugagacugguuuggaucucccugcaugacagucccccagaaacuuagugaguccuggacu

SEQ ID NO: 466657 - RNA, 64 nt, Human
cugaggaguauuaagaaugcagauuccugggccugucccccaagguuuuggagucaguaggucc

SEQ ID NO: 466658 - RNA, 64 nt, Human
ccaaagcaucggggugggggaggggucugccgcugucccccaccugcuggcccccuuguccuuc

SEQ ID NO: 466659 - RNA, 64 nt, Human
cuuagggcaucucauccagggauucucaaaccaugucccccagaggccuugggcugcaguugca

SEQ ID NO: 466660 - RNA, 64 nt, Human
gcauuuacacagauuugagucagaacuggaaagugucccccacccccaccacccucgagcgggg

SEQ ID NO: 466661 - RNA, 64 nt, Human
gcaugaacaggaccugcagguggcuggacugagugucccccaggcccagccaggacuuugccua

SEQ ID NO: 466662 - RNA, 64 nt, Human
caauacucuagccccgcucucuuccccucuuucugucccccauuuuccaggggguauaugguca

SEQ ID NO: 466663 - RNA, 64 nt, Human
ucugcccaccuucccuucuucccaccugccugcugucccccagucugccugcccuucucucucu

SEQ ID NO: 466664 - RNA, 62 nt, Human
cguugucuuugaccagugguccccaguaccaggccagcgaagacaacuuuauaaugucauuu

SEQ ID NO: 466665 - RNA, 62 nt, Human
agagcucugacuccuauggugaccucucagaugccagcgaccugaagacgccagagaagcag

SEQ ID NO: 466666 - RNA, 62 nt, Human
aagcucuugcuaacuugaaaaaucccuguucugccagcgaagcuuccuccuccucuccagcu

SEQ ID NO: 466667 - RNA, 62 nt, Human
uuuccaaaagaaaaacuaguugcagucagggagccagcgaaaagacaaaaaaaaaaaaaaaa

SEQ ID NO: 466668 - RNA, 64 nt, Human
uuacugaguagauuggauuuaagacaaaaagcaagucccccaugaguguccacuucuuugcccu

SEQ ID NO: 466669 - RNA, 64 nt, Human
ccaucucauucucgccccuccagaagaagcaguugucccccaaauacucugcucccucacugcu

SEQ ID NO: 466670 - RNA, 64 nt, Human
caggcaugggguguggcccucggagaaguuaggagucccccagcucaagauacaguggcaaaga

SEQ ID NO: 466671 - RNA, 64 nt, Human
augagcagagcccggagcuccggccugcugucaagucccccagcagaaccagccucaaaaacgc

SEQ ID NO: 466672 - RNA, 64 nt, Human
cccccuggcuuugugccaggccuggaggagggcagucccccauggggugccgagccaacgccuc

SEQ ID NO: 466673 - RNA, 64 nt, Human
uuuuucuuuuuuuuuugagacagagucucguucggucccccagcuuggagugcaguggcgcgau

SEQ ID NO: 466674 - RNA, 64 nt, Human
cuccugccgacuccuggguugagcuguugccucagucccccaacagaugcuuuucugucucugc

SEQ ID NO: 466675 - RNA, 64 nt, Human
gcugcgugcccggcacuggcagcgaggcucgugugucccccaggcagaucugggcacuuuccca

SEQ ID NO: 466676 - RNA, 64 nt, Human
caccuccagcuuuucuuuuucuguauauacucaugucccccagauuccaacauuucucacugaa

SEQ ID NO: 466677 - RNA, 64 nt, Human
uuuuuuuuucuuuuugagacggaguuucgcuuuugucccccaagcuggaguacaaugacaggau

SEQ ID NO: 466678 - RNA, 64 nt, Human
cagaggaauuuacagaaacuugcccugugccugugucccccaugcuaggggcggaggggucuuu

SEQ ID NO: 466679 - RNA, 64 nt, Human
caaauuacuuuugcuaucauaaauaagcuccaaagucccccauuuaauuuuuuuuuaauuuugu

SEQ ID NO: 466680 - RNA, 64 nt, Human
gcauccucuaccccaagcccaaagccugcugggugucccccauggccaaggucccagccgagag

SEQ ID NO: 466681 - RNA, 64 nt, Human
cuagucagacaugauccuccagauugacagacaagucccccaaaugaguacacaucuccagcua

SEQ ID NO: 466682 - RNA, 64 nt, Human
caagcuggcuuggggagcccucucuuguguaaaugucccccauguuucugaaaagugcuguagu

SEQ ID NO: 466683 - RNA, 64 nt, Human
acgacucuuaagagaacacugcacagcacucaaagucccccacuggacugcuuccuccuuagcc

SEQ ID NO: 466684 - RNA, 62 nt, Human
ucuaaauccugcuuagccuaaacauaucuauagccagcgaugggcaaauuauauuugcuguc

SEQ ID NO: 466685 - RNA, 62 nt, Human
cauguggauauguuuagcuacguuuacucacagccagcgaacugacauuaaaauaacuaaca

SEQ ID NO: 466686 - RNA, 64 nt, Human
cuaaggaagaccaagcaggccuggacccagagacgucccccaucgugggacacgacacacccag

SEQ ID NO: 466687 - RNA, 64 nt, Human
auaggcgaggaaaaugcccgaggcgcugucuucugucccccacacguaccagaaagugaaaaau

SEQ ID NO: 466688 - RNA, 64 nt, Human
cagcccccacuaccucucuguguacugccgcugugucccccacagaccugcacauuguugucac

SEQ ID NO: 466689 - RNA, 64 nt, Human
caccucuucugucuccucucaaaguccggcuggcgucccccaagcccugagaugcucugucacc

SEQ ID NO: 466690 - RNA, 64 nt, Human
cucacuauucaaaaccaaucaugccuuccuaacagucccccaaagucuuaacucuuuucagcau

SEQ ID NO: 466691 - RNA, 64 nt, Human
uguaaaugcagaugugugauaaagcauuuagucagucccccaaacagucaugccaacugugaag

SEQ ID NO: 466692 - RNA, 64 nt, Human
ccccauucacccacaaaaugcagcccaccacccagucccccaauuccagagagaaacacaucac

SEQ ID NO: 466693 - RNA, 64 nt, Human
gcacacucccuuacccccggugccgggccgugcggucccccagacggacagcagcuguggcgac

SEQ ID NO: 466694 - RNA, 64 nt, Human
aaugacagacccugggagaaguaaugccccaguugucccccacuccuaaugccaggcagagaag

SEQ ID NO: 466695 - RNA, 64 nt, Human
cuuggcagcagcaguaggacuauaaaccacagcugucccccaggaucccacuccuuuccugucu

SEQ ID NO: 466696 - RNA, 64 nt, Human
ggugcugagggaggggagugagucacaggagccugucccccaacaggugugacugcucugacaa

SEQ ID NO: 466697 - RNA, 64 nt, Human
caaguccaaauguuuacagggagccuccugcccagucccccaaccccagccgcucggaggcccc

SEQ ID NO: 466698 - RNA, 64 nt, Human
gugcacaaccagggcaaggcuccccacuuccuuagucccccaugcucacagaccuuugccugcu

SEQ ID NO: 466699 - RNA, 64 nt, Human
gcagcuugccaaucacuccaggucugaaaagcaagucccccagccccaccccagggagccagag

SEQ ID NO: 466700 - RNA, 64 nt, Human
auguugugaauagagcuugcuaugguaugaaugugucccccacagcucaugcguuggaaacuua

SEQ ID NO: 466701 - RNA, 64 nt, Human
uuguuguuguuguuuugagacagggucucacugugucccccaggcuggagugcaguggcacaau

SEQ ID NO: 466702 - RNA, 62 nt, Human
aggcaauuugguuaccugcaauggcugcuuuugccagcgaggccaccauucauuggucaucu

SEQ ID NO: 466703 - RNA, 62 nt, Human
guucuccucgaguccuuggggacguggcagaugccagcgaccaucagacaacguggaggccc

SEQ ID NO: 466704 - RNA, 62 nt, Human; identical to SEQ ID NO: 463043

SEQ ID NO: 466705 - RNA, 62 nt, Human; identical to SEQ ID NO: 455944

SEQ ID NO: 466706 - RNA, 64 nt, Human
caaccucaggaagaaggcccuacagauuugccaugucccccagacccugcuucugauacuaagg

SEQ ID NO: 466707 - RNA, 64 nt, Human
guuugguuucauuuuuaauuuuaugguucugugcgucccccauauuuaauauuuauuauucaaa

SEQ ID NO: 466708 - RNA, 61 nt, Human
uacuggguaaagacauguagcuguggcuuuggucccccagaggcauagauccuauccuggg

SEQ ID NO: 466709 - RNA, 64 nt, Human
gccaaaugcacugccuuucucuguccccaugacugucccccacucugcaccccaaaugggaagc

SEQ ID NO: 466710 - RNA, 64 nt, Human
ugacuucuacugaccgcuagauaaacgugugccugucccccagguggugggaauaauuuacaau

SEQ ID NO: 466711 - RNA, 64 nt, Human
agauauggccucaugggaagggaaagaccugacugucccccagcccgacaccuguaaagggucg

SEQ ID NO: 466712 - RNA, 64 nt, Human
ggguacgugaggggucugagaggagugggugcuugucccccaaaccugcaugaagcaagaacaa

SEQ ID NO: 466713 - RNA, 64 nt, Human
auguucaggugucucuugaucacaguaacccauagucccccacuggggggacggugggggaaga

SEQ ID NO: 466714 - RNA, 64 nt, Human
cgcugggcccucaugugggagagaggugaaaagcgucccccacuagggggcuggcagugcaugu

SEQ ID NO: 466715 - RNA, 64 nt, Human
caauccaccaguuuuucuaagcuagaaccuuugagucccccaaacugccugaagacuuaaguuu

SEQ ID NO: 466716 - RNA, 64 nt, Human
uuucugugguauaauaaugugucucuuacuagaagucccccacgaccaaguuaaagauacuuuu

SEQ ID NO: 466717 - RNA, 64 nt, Human
ugccagcaucuggccucccacuguuuucagcugugucccccaguccgugucuuuuuagaaugug

SEQ ID NO: 466718 - RNA, 64 nt, Human
uugcucaauucucagggcuggaaugagccggcuggucccccagaaagcuggagugggguacaga

SEQ ID NO: 466719 - RNA, 64 nt, Human
aaggggcucagaacaccccgcucuggcaguaggugucccccacccccaaagaccugccugugug

SEQ ID NO: 466720 - RNA, 64 nt, Human
cacaggcguggagguguccccaccccuuccaccugucccccagacccaaagcucucuccccacc

SEQ ID NO: 466721 - RNA, 64 nt, Human
gaugaagccaaccugcaguauuaaccucaguccugucccccaaggucuugacucaaucaacucu

SEQ ID NO: 466722 - RNA, 62 nt, Human
uauguccguuaauuugauaauuaugaaaucuagccagcgauuucaaaauuuuaaucuccaac

SEQ ID NO: 466723 - RNA, 62 nt, Human; identical to SEQ ID NO: 463042

SEQ ID NO: 466724 - RNA, 62 nt, Human
agggagcagaacugaaccggcuuuaccaaaccgccagcgaacuugacaauuguauugcgaug

SEQ ID NO: 466725 - RNA, 62 nt, Human
ccccucggccgccgacuggacgcgcgggccuugccagcgagcacccucaucgggcugucgcc

SEQ ID NO: 466726 - RNA, 64 nt, Human
gaggcuccacgacugagcucugaggccagugccugucccccaggcccacuuguauucuuucuac

SEQ ID NO: 466727 - RNA, 64 nt, Human
ggcuucucuguguccauggggugggcgggagggggucccccagcaggugcggccccugcaccug

SEQ ID NO: 466728 - RNA, 64 nt, Human
acaaaagagacagagccucagccagggagagugagucccccagaagaggcugggugguugcaca

SEQ ID NO: 466729 - RNA, 64 nt, Human
ucaaacacacaguauucgugaauaaguugauucugucccccacguggacucugugcucacccau

SEQ ID NO: 466730 - RNA, 64 nt, Human
ugcuaggagcuccccuguuugcaugagaaaaguagucccccaaauuaacaucagugucuguuuc

SEQ ID NO: 466731 - RNA, 64 nt, Human
cuugaaaaggccccuaauaaggcuagaggucuaagucccccaccccuuuccccacuccccucua

SEQ ID NO: 466732 - RNA, 64 nt, Human
agaggcuaugggggggccugccauagggaugccagucccccagugggggucccuucugcagccu

SEQ ID NO: 466733 - RNA, 64 nt, Human
uacugcacaguucacuuuauuuaacaauuuucaugucccccaccucauguuuucaccuuuucug

SEQ ID NO: 466734 - RNA, 64 nt, Human
uugggaccugaggacuggaugguagaauacuggggucccccagcucuuagcaggaugcaggcua

SEQ ID NO: 466735 - RNA, 64 nt, Human
auguugggucuggagcaagaucugagacugagaugucccccaagggugacaggucagauuuauu

SEQ ID NO: 466736 - RNA, 64 nt, Human
aaacucuccucugggacgucugggacuggcauuugucccccacucaaauuaucaaagcuuucug

SEQ ID NO: 466737 - RNA, 64 nt, Human
ucagcucauccaggcuggacaaaccaguuccugggucccccagccggcuggguggcucuggggc

SEQ ID NO: 466738 - RNA, 64 nt, Human
cauagcgccaucaugggcugauuuuuauuaccaggucccccagaagcaggugggaggcucugcu

SEQ ID NO: 466739 - RNA, 64 nt, Human
gcuuggcccagggaaacagacggcagacacaccugucccccagugaugccgcccaagcugccca

SEQ ID NO: 466740 - RNA, 54 nt, Human
cagcaaaggcaucugccuaauagggucccccagggccccaccugucucacaaga

SEQ ID NO: 466741 - RNA, 64 nt, Human
cuagauguguucuaagcaaugcaaaugucuaauugucccccagugggcauagucagugucguuu

SEQ ID NO: 466742 - RNA, 64 nt, Human
ccucccccagaccccugaccacccccuggguccugucccccaccagagccccagcuccugucug

SEQ ID NO: 466743 - RNA, 64 nt, Human
guaauauagcucuuucuuuuauuaacuguucucugucccccaaccaucuccugauauuugguag

SEQ ID NO: 466744 - RNA, 64 nt, Human
gggccuggcguggggggagcucuggugggaaaaugucccccaccucuuuuccuaguuuuauguu

SEQ ID NO: 466745 - RNA, 64 nt, Human
uuuguuuuuuuuuuccagauggaguuucgcucuugucccccaggcuggaguggugcaguggcac

SEQ ID NO: 466746 - RNA, 64 nt, Human
auggccacacugcaccuccuucgcugucaagugggucccccacgaagauacugcacggagagca

SEQ ID NO: 466747 - RNA, 64 nt, Human
ucccuguguccuggucuaucaccccagcuucuuugucccccaguacccccagcccagccagcca

SEQ ID NO: 466748 - RNA, 64 nt, Human
cggucacccuccucccccauggagguuuccaggggucccccagacaugaaagaggggugagcug

SEQ ID NO: 466749 - RNA, 64 nt, Human
uggacgcuuguguagggccuggggugaauucccugucccccaugguaccucgagaggggcuggg

SEQ ID NO: 466750 - RNA, 64 nt, Human
uggggccagauaaugacgcccgcugcucuccgcggucccccacccucaccccggccccccaccc

SEQ ID NO: 466751 - RNA, 64 nt, Human
uaggagauaaaaacaccuuuggggacugguuaaagucccccagaaacuacaauaaagaacaacu

SEQ ID NO: 466752 - RNA, 64 nt, Human
auaucaugcuuauuucauuggguuguuuuggaaugucccccacuuggagaguuugaggaaugga

SEQ ID NO: 466753 - RNA, 64 nt, Human
uaaagacugucaauccauugauuuaucuccuccugucccccaucuaaaauacccaugcugcuuu

SEQ ID NO: 466754 - RNA, 64 nt, Human
cagccagguggccacuuuauggaaaggaugcagggucccccagaccccuccucuagcccagcag

SEQ ID NO: 466755 - RNA, 64 nt, Human
uuuucgucaugccuuugagacugagucuuacuccgucccccagcgugguggcgcgcugggauua

SEQ ID NO: 466756 - RNA, 64 nt, Human
gggaggggagcuaagauugcaguccuguccuucggucccccagggccugccggucagaagccug

SEQ ID NO: 466757 - RNA, 64 nt, Human
gcauuucucuuugaaauuuauuagauacuguuaugucccccaaggguacaggaggggcaucccu

SEQ ID NO: 466758 - RNA, 62 nt, Human
ugagaccaggucccugcucugaggagacgugugccagcgaaguuucucucccacgugagugu

SEQ ID NO: 466759 - RNA, 62 nt, Human
gccugaguauucauguaacauucuaaaauugugccagcgagcaccgugaacgacugcaaugc

SEQ ID NO: 466760 - RNA, 62 nt, Human
cagugagguugguccgaggcugugugcccucugccagcgaccccgaagcagauaucucagug

SEQ ID NO: 466761 - RNA, 62 nt, Human; identical to SEQ ID NO: 463044

SEQ ID NO: 466762 - RNA, 64 nt, Human
ccagacugaaugugggcguaagaaagcgggaagggucccccacagcaagagagagacccuccca

SEQ ID NO: 466763 - RNA, 64 nt, Human
uuuguuuuguuuguuugagacggggucucgcucugucccccaggcuggagugcaguggugcgau

SEQ ID NO: 466764 - RNA, 64 nt, Human
acacuuuccuccugcagcacccccugcugaaggggucccccauuguuuugcuuccccagcgccc

SEQ ID NO: 466765 - RNA, 64 nt, Human
ccaguacaggggugcugcagguggcagagugaaugucccccaucauguggcccaacucuccugg

SEQ ID NO: 466766 - RNA, 64 nt, Human
cagcagcaucuugucacugcacaacaguggccuggucccccacaggcaguuagggccccagguc

SEQ ID NO: 466767 - RNA, 64 nt, Human
gaugagccuucgugcccccccuucccccuuuuuugucccccaacuugagauguaugaaggcuuu

SEQ ID NO: 466768 - RNA, 64 nt, Human
agcagguccccagcuuuggcuaugagggccuugagucccccaaaacaccggguuccagcaccac

SEQ ID NO: 466769 - RNA, 60 nt, Human
cagagcagagaaacgccugagccugccugugucccccacuuccacucaggaaauugggcu

SEQ ID NO: 466770 - RNA, 64 nt, Human
aacuuuuuuuuuuuuugaaacggagucuugcucugucccccaggcuggagugcaguggcaugau

SEQ ID NO: 466771 - RNA, 64 nt, Human
caacuucugaggcccuggggauccucacauccccgucccccagucaagagcuccucugcuccuc

SEQ ID NO: 466772 - RNA, 64 nt, Human
gaucuggccugccuuucuuuggucagucccuguggucccccaccagcucccccucccauagggc

SEQ ID NO: 466773 - RNA, 64 nt, Human
accaagggcugggggcaaaggggcaugauccagggucccccagggugggcucagcuccagggag

SEQ ID NO: 466774 - RNA, 64 nt, Human
uuagacuguuaaaagcagguuucuguacuuaagagucccccagaccuccugugaggugaggcuc

SEQ ID NO: 466775 - RNA, 64 nt, Human
cacucacuccagccuuuggcaaccauuguuccaggucccccagggcuuccucccacagcagcug

SEQ ID NO: 466776 - RNA, 64 nt, Human
accauuuccaggccuuauugagaccagaccccaagucccccacccccauccugcuccagcguuu

SEQ ID NO: 466777 - RNA, 64 nt, Human
uaacgcaagucugaccauguaugucugcgccccugucccccacccugacccucccauggcccuc

SEQ ID NO: 466778 - RNA, 62 nt, Human
cguccgcuggaaaaacguuucgaagcacaguggccagcgagcgagcacguggcuacucccug

SEQ ID NO: 466779 - RNA, 64 nt, Human; identical to SEQ ID NO: 270466

SEQ ID NO: 466780 - RNA, 64 nt, Human; identical to SEQ ID NO: 274744

SEQ ID NO: 466781 - RNA, 64 nt, Human
gccuccuaccugcccccaacccacccuccaccccgucccccacggugggcacugcccagcaccg

SEQ ID NO: 466782 - RNA, 64 nt, Human
uuauuuuuaauuuuaugagacagggucuugcucugucccccaggcuggagugcaguggcaugau

SEQ ID NO: 466783 - RNA, 64 nt, Human
caggggccagggcuggaggcgccuuccccucgcggucccccacuuagccaaggcgugggggcgg

SEQ ID NO: 466784 - RNA, 64 nt, Human
cacaaggaaaggaaagcaaaggcuucccacccaagucccccaucugcuaaaacugauggcuaca

SEQ ID NO: 466785 - RNA, 62 nt, Human
aggaugacaucaccuucugauacccugcccuagucccccaccuuugacuuaagaucccacac

SEQ ID NO: 466786 - RNA, 64 nt, Human
ucacugaaccuguucaguaacaaucaguuuggccgucccccaugaugguaggaaauauagagag

SEQ ID NO: 466787 - RNA, 64 nt, Human
acugccauaugauuuacauuuccucaccauaagggucccccacucuaaagcaaauuuaucgcug

SEQ ID NO: 466788 - RNA, 64 nt, Human
guggaggaccgaggcuacagcuccacacgccccggucccccagagcaucugccccagguacacc

SEQ ID NO: 466789 - RNA, 64 nt, Human
aaauaauucuuuucugcuucaaugccagcagaaggucccccagguagacauggagaagcacuuu

SEQ ID NO: 466790 - RNA, 64 nt, Human
uggggcuggccccuuuucucccucugagacucacgucccccagggcaagugcuuguggaggaga

SEQ ID NO: 466791 - RNA, 64 nt, Human
uagggcuguuccugggccuggcucuuacaggcucgucccccaggccugcccuucuccacugccc

SEQ ID NO: 466792 - RNA, 64 nt, Human
uggcagugccucugccagucacugucaucguugugucccccacaacuguccucuugcuagcucg

SEQ ID NO: 466793 - RNA, 64 nt, Human
uucugccagugggggauguuucuggaggcagcuggucccccacaccgcguccugcugagccugc

SEQ ID NO: 466794 - RNA, 64 nt, Human
uggcugugaggucccuccgcaucacccagcucacgucccccaaaacgugcauggugagaaccug

SEQ ID NO: 466795 - RNA, 64 nt, Human
ccggauuggcaagaaacagggugucuuggagguggucccccagaucugcgccugggggucagga

SEQ ID NO: 466796 - RNA, 64 nt, Human
gaugagagggggcuuggccuucuuaggugacaaugucccccauaucuguaugucaccaggaugg

SEQ ID NO: 466797 - RNA, 62 nt, Human; identical to SEQ ID NO: 455950

SEQ ID NO: 466798 - RNA, 62 nt, Human; identical to SEQ ID NO: 455951

SEQ ID NO: 466799 - RNA, 62 nt, Human; identical to SEQ ID NO: 455952

SEQ ID NO: 466800 - RNA, 62 nt, Human; identical to SEQ ID NO: 455953

SEQ ID NO: 466801 - RNA, 64 nt, Human
cccuccugaagauagccagagagcccaugagaccgucccccagcaucccccacuugccugaagc

SEQ ID NO: 466802 - RNA, 64 nt, Human
ugguuagaugguuuuugaucugcagucuucccuagucccccaaauaaguaauaauaacuuccau

SEQ ID NO: 466803 - RNA, 64 nt, Human
gacaagaaaggccuacgguuucuggagcaaaccugucccccaccugugaccagucacucugggg

SEQ ID NO: 466804 - RNA, 64 nt, Human
ggacaguccgcugucuccagugggggcagcagcugucccccagccucgauggagacacuggggc

SEQ ID NO: 466805 - RNA, 64 nt, Human
cccugcgcuaguccucaucugagucucagccugggucccccaugguuuuagcaacacggguggc

SEQ ID NO: 466806 - RNA, 64 nt, Human
guccuggccgaguuuccucugccccuucuugcuggucccccaaagggcgcuccgcucccugccc

SEQ ID NO: 466807 - RNA, 64 nt, Human
ccgguggcggccccagcaccucagccugcacagugucccccagguuccgaagaagaugcuccag

SEQ ID NO: 466808 - RNA, 64 nt, Human
gagcugggccagggacucaacaauggggacagaagucccccagugccugccagggccuggagug

SEQ ID NO: 466809 - RNA, 64 nt, Human
gaucuuccugauggaagcugacuugggcguggaagucccccaugaagugagugggggccaaggc

SEQ ID NO: 466810 - RNA, 64 nt, Human
gcccugccacuuugcaugguuugauuuugaccuggucccccacgugugaaguguaguggcaucc

SEQ ID NO: 466811 - RNA, 64 nt, Human
ugcuguucuaugucaccaucuuuugucuccccuagucccccaggagcucuuuccuuuccccucu

SEQ ID NO: 466812 - RNA, 64 nt, Human
ggagagguuauaggucacuccuggggccucuugggucccccacgugacagugccugggaaugua

SEQ ID NO: 466813 - RNA, 64 nt, Human
auuuuuuuuuuuuuuuuugagacagucucgcucugucccccaggcuggagugcaguggcucgau

SEQ ID NO: 466814 - RNA, 64 nt, Human
cucacauuucaaaaccaaucaugccuucccaacagucccccaaagucuuaacucauuucagcau

SEQ ID NO: 466815 - RNA, 64 nt, Human
gugccucuuuccagaucgcuggccccagaacccugucccccacacccaggggcacaugcacugu

SEQ ID NO: 466816 - RNA, 64 nt, Human
uaacuugcauauuuuuaauuuccuuugguuaaaggucccccauacuucucuguucggagacaug

SEQ ID NO: 466817 - RNA, 62 nt, Human
uauucugggggcugcaguucgacucugugcuggccagcgagcgcccagcuccugacacugcu

SEQ ID NO: 466818 - RNA, 62 nt, Human; identical to SEQ ID NO: 463040

SEQ ID NO: 466819 - RNA, 62 nt, Human
ggagcccacuaugcagaggccaaaggucggcagccagcgaggcuaugaauuggaccuuuuug

SEQ ID NO: 466820 - RNA, 64 nt, Human
caguucugauuguugaggugucgcgucguuccaggucccccaguccccucuuucuccuguccuc

SEQ ID NO: 466821 - RNA, 64 nt, Human
ccucccagaguuucucucggcucuuuuuuuaaaagucccccaacaaauaggauucuugcuggga

SEQ ID NO: 466822 - RNA, 64 nt, Human
ugagcuaccaagacugucccuagacaaagguggagucccccacacugcccaagaccaaaucccu

SEQ ID NO: 466823 - RNA, 64 nt, Human
agcucucaguuucuuagggauggacuauggcccagucccccaucuaaguggugcuuugcaaaug

SEQ ID NO: 466824 - RNA, 64 nt, Human
ugguggagugcugggcaaaaugccaccaggcuuugucccccauggcucugcagguaccccuucu

SEQ ID NO: 466825 - RNA, 64 nt, Human
guuugcuuucugaucaaggccuuauuggaaagcagucccccaacuacccccagcugugcuuaug

SEQ ID NO: 466826 - RNA, 64 nt, Human
uuacuuuuucgccucccagggccugugggaucuggucccccagccucucuugggcuuucuuaca

SEQ ID NO: 466827 - RNA, 64 nt, Human
ugcaggugaggauggugcaccagacaggguagcugucccccaaaaugugcccugugcgggcagu

SEQ ID NO: 466828 - RNA, 64 nt, Human
aacuucaaguucucuugauuucuuuguucccacugucccccaagaaacuaguaucucuggccuc

SEQ ID NO: 466829 - RNA, 64 nt, Human
uuucagauguaugguguuuuuacacuacaaagaagucccccauguggauauuucuuauacuaau

SEQ ID NO: 466830 - RNA, 64 nt, Human
cuaccuggaguagcugugcagccccgcccucugcgucccccagcccucaggccagugccaggac

SEQ ID NO: 466831 - RNA, 64 nt, Human
uuaagagcagucucuucugagccagccucugcgggucccccaauaagguucaucuccucacagc

SEQ ID NO: 466832 - RNA, 64 nt, Human
cgucuggugcuuguugauccaaguccccugccuggucccccacaaggacucccauccaggcccc

SEQ ID NO: 466833 - RNA, 64 nt, Human
aguggcugaggcugauaccccugaccuaucugcagucccccagcacacaaggaagaccagaugu

SEQ ID NO: 466834 - RNA, 64 nt, Human
gcuuaugccgugaaacagcccccagcccccgucugucccccaacccaggcuagccagccuuuua

SEQ ID NO: 466835 - RNA, 64 nt, Human
uuugccuucuggugcccauaguccccuggacugagucccccaggccuuccuucacccgacuucc

SEQ ID NO: 466836 - RNA, 62 nt, Human; identical to SEQ ID NO: 455945

SEQ ID NO: 466837 - RNA, 62 nt, Human; identical to SEQ ID NO: 455946

SEQ ID NO: 466838 - RNA, 62 nt, Human; identical to SEQ ID NO: 455948

SEQ ID NO: 466839 - RNA, 64 nt, Human
ggacacccgcuucugagaggaccauggacuuagugucccccagucucaauugccugauggcuga

SEQ ID NO: 466840 - RNA, 64 nt, Human
ggggaagguagggugugagcugcugcugaaggcugucccccaaccccacuccugagacauaggg

SEQ ID NO: 466841 - RNA, 64 nt, Human
uuccagccuagccaguuucucacccuggguuggggucccccagcauccagacuggaaaccuacc

SEQ ID NO: 466842 - RNA, 64 nt, Human
uugaauccuaaguucuuagcugcugaugcaaguugucccccaaggccaucacaaagcagugggg

SEQ ID NO: 466843 - RNA, 64 nt, Human
ccguucaguucccuccuuuucuugcauguaaguugucccccaucccaaaguauuccaucuacuu

SEQ ID NO: 466844 - RNA, 64 nt, Human
aggggaaaaagcuauuuucauugguacauuuaaagucccccaacuauggggagguaccaauucu

SEQ ID NO: 466845 - RNA, 64 nt, Human
cugggaaaauaccagaaaaugagggccgcuuugagucccccagagaugucaucagagcuccucu

SEQ ID NO: 466846 - RNA, 64 nt, Human
cggggcagggacagggagccgagugccccucagagucccccaaacacaagcacaucacaccucc

SEQ ID NO: 466847 - RNA, 64 nt, Human
uaccccaaggccugauggccacugggcucagccugucccccacuccugccugcuucccggugag

SEQ ID NO: 466848 - RNA, 64 nt, Human
ggggagccuuucggaucuauuuggucuuucucaugucccccacuggucuguaccccagggagcg

SEQ ID NO: 466849 - RNA, 64 nt, Human
agcggcacggagacccugccagcagcucccucccgucccccaaccucuccugcucauaaaucca

SEQ ID NO: 466850 - RNA, 64 nt, Human
gacagaggcuacagguuggagcuuuuuuuccccugucccccaaccccauccccaccuccacuuc

SEQ ID NO: 466851 - RNA, 64 nt, Human
gcagaccccuccagaggcccgccaggugggcauggucccccauuuucuuuaaggcagcaccugg

SEQ ID NO: 466852 - RNA, 64 nt, Human
uuuuuuuuuuuuuuuugagacagagucucacucugucccccaggcuggagugcaguggcgcgau

SEQ ID NO: 466853 - RNA, 64 nt, Human
cggaccgcuuguggggacccaggcuccgcccuuagucccccaacucugagcccauguucugccc

SEQ ID NO: 466854 - RNA, 64 nt, Human
uuuucuuuuuuuaaugaaucaauagcagcguccagucccccagggcugcuuccugccugcaccu

SEQ ID NO: 466855 - RNA, 62 nt, Human; identical to SEQ ID NO: 455954

SEQ ID NO: 466856 - RNA, 62 nt, Human; identical to SEQ ID NO: 455955

SEQ ID NO: 466857 - RNA, 62 nt, Human; identical to SEQ ID NO: 455956

SEQ ID NO: 466858 - RNA, 51 nt, Human; identical to SEQ ID NO: 455958

SEQ ID NO: 466859 - RNA, 64 nt, Human
aaauguagaugauauguuucguggguugaauugugucccccauaaaagauauguugaaguucua

SEQ ID NO: 466860 - RNA, 64 nt, Human
uccucaucucucuugggccaagccagcugccuaggucccccaagcaugggggaccccuucccac

SEQ ID NO: 466861 - RNA, 64 nt, Human
agcccuuuccccaggagaagccaagaacuugugugucccccacccuauccccucuaacaccauu

SEQ ID NO: 466862 - RNA, 64 nt, Human
agaccagaggagugugcugugcuggcaaguguaagucccccaguugcucugguccaggagccca

SEQ ID NO: 466863 - RNA, 64 nt, Human
gagggccaacuggcagcugcgggacccuuggcuugucccccaccgacaagucccaccugcuggg

SEQ ID NO: 466864 - RNA, 64 nt, Human
gacccucacugcuggggagucccugccacacucagucccccaccacacugaaucuccccuccuc

SEQ ID NO: 466865 - RNA, 64 nt, Human
auuuuuugcuuucugcuuuauugaucuuuugcaugucccccaaagccagaaucugcucauggag

SEQ ID NO: 466866 - RNA, 64 nt, Human
ucugccuggcauuuaggcagcagagccccugaccgucccccacagggcucugccucacguccuc

SEQ ID NO: 466867 - RNA, 64 nt, Human
uaauaccugugccauauugacagccuccaucccugucccccaucuuggugcugaaccaacgcua

SEQ ID NO: 466868 - RNA, 64 nt, Human
guccaggagggucaggccuguaccccagccuccugucccccaggaaccucacagggguaucaaa

SEQ ID NO: 466869 - RNA, 64 nt, Human
ccacugcucuccagccugggaggcacagcaaacugucccccaaaaaaaaaaaagaguccuuacc

SEQ ID NO: 466870 - RNA, 64 nt, Human
aacuaaagguggccacaaauucuuugacacucaagucccccaagaccuaaggguuuuaucuccu

SEQ ID NO: 466871 - RNA, 64 nt, Human
ggcacugugcccaggaagagccugcggccucggcgucccccagucuccaggagccucucccucc

SEQ ID NO: 466872 - RNA, 64 nt, Human
uuguauuuaaggacuggggcauagcaugggggcagucccccagaccucuucauucccccuccug

SEQ ID NO: 466873 - RNA, 64 nt, Human
gcacagcccuaccccgccccaguaucaugcgauggucccccacaccgguucccugaaccccucu

SEQ ID NO: 466874 - RNA, 64 nt, Human
uagauugcacuuuauauguccagccucuuccucagucccccaaaccaaagcuacacagccagau

SEQ ID NO: 466875 - RNA, 62 nt, Human; identical to SEQ ID NO: 455963

SEQ ID NO: 466876 - RNA, 62 nt, Human; identical to SEQ ID NO: 455964

SEQ ID NO: 466877 - RNA, 62 nt, Human; identical to SEQ ID NO: 455965

SEQ ID NO: 466878 - RNA, 62 nt, Human; identical to SEQ ID NO: 455966

SEQ ID NO: 466879 - RNA, 64 nt, Human
uguaguucccuauuuuaaccucaauuaugcauuugucccccaaccccacugagaacuaaaugcu

SEQ ID NO: 466880 - RNA, 64 nt, Human
gcugcaauauuuuaguaauaccuucgggaucacugucccccaucuuccguguuagagcaaagug

SEQ ID NO: 466881 - RNA, 64 nt, Human
cccagcagcccccuccuccuggcugggaagaauggucccccagcaagcacuugccuguucauuc

SEQ ID NO: 466882 - RNA, 64 nt, Human
uguauuauucccccagcucucagggacaagaccagucccccagcgugguggucagcacggaagc

SEQ ID NO: 466883 - RNA, 64 nt, Human
ucccuguacacacccuauuaacuccuuggcuguggucccccagcuacaccaccagcccaggucc

SEQ ID NO: 466884 - RNA, 64 nt, Human
gggagugguccccaaagacccuucaaccuccccagucccccaccagacccacccucucccugaa

SEQ ID NO: 466885 - RNA, 64 nt, Human
aaucugcaccaagcaugaacaauugggagcaucagucccccacuugggccacacuacccaccuu

SEQ ID NO: 466886 - RNA, 64 nt, Human
cugcuuugccugguguggggaaggauugggucuugucccccaacacagcuucuguggcugacug

SEQ ID NO: 466887 - RNA, 64 nt, Human
ccauuuacuugagacagauucucuccuuuuuccugucccccaucuucucugggucccucuaaca

SEQ ID NO: 466888 - RNA, 64 nt, Human
ugugaaucaagucggugaacugccccuggccugugucccccagagcagcccaggguccugccag

SEQ ID NO: 466889 - RNA, 64 nt, Human
cuguggcugaggugggagggggagggugggguaggucccccagcaagaaagagggacaggagca

SEQ ID NO: 466890 - RNA, 64 nt, Human
ggaaaauacuggagacgaacgccgggugacgcgugucccccacucaccuuccccggagacccug

SEQ ID NO: 466891 - RNA, 64 nt, Human
auuaagguagaacuugagaacucaaguuuaaauugucccccaccaccuucuucuauaaaugcaa

SEQ ID NO: 466892 - RNA, 64 nt, Human
caugugacggaugauaaauugauucgaaaagcuggucccccaggaucuaauuucagaauuuacc

SEQ ID NO: 466893 - RNA, 64 nt, Human
cuucacacguagcuccucaggccauuccccaugagucccccacacccaccccauccucggucuu

SEQ ID NO: 466894 - RNA, 64 nt, Human
ccucccacuugcccugaaaggccaagaucaagaugucccccaggcaucuugaucccagccugac

SEQ ID NO: 466895 - RNA, 62 nt, Human
cugggacacucagcgggaagggggcuggcaucgccagcgacccacacauuccucacguagcu

SEQ ID NO: 466896 - RNA, 62 nt, Human
aaacuuccccucuaccagccuccaagccccacgccagcgagcaggcugccugcccaccccgu

SEQ ID NO: 466897 - RNA, 64 nt, Human
agucuggccugcccacaaacugacuuugugaccugucccccaggagucaauaaacaugauggaa

SEQ ID NO: 466898 - RNA, 64 nt, Human
gcccagggagccgcugauguacaauaaccuugaggucccccauacugaaaacugaccaaggccu

SEQ ID NO: 466899 - RNA, 64 nt, Human
gauauucugugauugauuuugguccuccuccgcugucccccaacacccaggaaugggaaucugg

SEQ ID NO: 466900 - RNA, 64 nt, Human
ucuggcuguguaggggaggaaggggugcaugcaugucccccacccuccacagucuuccuugccu

SEQ ID NO: 466901 - RNA, 64 nt, Human
gagaaguagaaaugcaggggccgugcugucccuggucccccagggaacagcaaggaaggaacug

SEQ ID NO: 466902 - RNA, 64 nt, Human
ugucaccugaccaagccuaaagaccuccagcucagucccccaccuucaucccaccccacagaug

SEQ ID NO: 466903 - RNA, 64 nt, Human
ugugagcccgggcugccuccuggugguggccauugucccccaucggccccucagccuugcaccc

SEQ ID NO: 466904 - RNA, 64 nt, Human
cucuccuccccagcccuguaggccugaggggagggucccccacaccacgguguccacccggccc

SEQ ID NO: 466905 - RNA, 64 nt, Human
uccccacagcccugggccccucgugucucuuugugucccccacuguagaggacggugagccgca

SEQ ID NO: 466906 - RNA, 64 nt, Human
aaaguuuggaaacaaugaccacuucucuaccauugucccccacccccaccccccagaauaacgc

SEQ ID NO: 466907 - RNA, 64 nt, Human
ccuuccaaaccaaacugccccucaugagguuagggucccccacccuccaccugcccagaggcca

SEQ ID NO: 466908 - RNA, 64 nt, Human
acuguccccaccuugcuagggcccagaaccaagcgucccccagccccgagagggagccugucgu

SEQ ID NO: 466909 - RNA, 64 nt, Human
ggugaucccguuuuccccaugacaauguuguagugucccccacccccaccccccaggccuuggu

SEQ ID NO: 466910 - RNA, 64 nt, Human
gacucuuggcagcagaccagugggggauggcugggucccccagccccugccagcagcugccugg

SEQ ID NO: 466911 - RNA, 64 nt, Human
ccaccucuccaagggcuucugcacccuccacccugucccccagcucuggugagucuuggcggca

SEQ ID NO: 466912 - RNA, 64 nt, Human
ugugcacauaccaguuacuuaagcagccacgagugucccccaugccuuggugcggguccuggag

SEQ ID NO: 466913 - RNA, 64 nt, Human
uuuuuccuuuucuucuuggcugguucuuuguucugucccccaugcucugaugcagugcccuaga

SEQ ID NO: 466914 - RNA, 64 nt, Human
cugcaccucggccagcaucuccuaugcucccugggucccccagaccucucuguguugugugcgu

SEQ ID NO: 466915 - RNA, 64 nt, Human
cguagaaagaaccaggguguccccgggacaggccgucccccaccccauccuguagaaguccauu

SEQ ID NO: 466916 - RNA, 64 nt, Human
uagaaguccauuccccuuuucccuccugugcucugucccccaaggagucauggaacucagggua

SEQ ID NO: 466917 - RNA, 64 nt, Human
auaaggucaguuuucccccagagcccgggucccugucccccacagggcaggcggggucccugga

SEQ ID NO: 466918 - RNA, 64 nt, Human
ugcuguaaaauuauaaacuuuuauacuuggguaagucccccaggggcgaguuccucgcucuggg

SEQ ID NO: 466919 - RNA, 64 nt, Human
ugcaaauguaagaaagaaccacuuggccagaagugucccccagaugcuuuuuuuuuuuuuuuuu

SEQ ID NO: 466920 - RNA, 64 nt, Human
aaggggcaggaguuggaauuaguuggucccuacugucccccaugagguugugaaccccuccccc

SEQ ID NO: 466921 - RNA, 64 nt, Human
ugugcuccugggugcugaagccucgcuccugucugucccccaccaccuggcccucagcuucuga

SEQ ID NO: 466922 - RNA, 64 nt, Human
agaaguaaguuuguguguaagguggagucucaccgucccccaggcuggagugccguggcgugau

SEQ ID NO: 466923 - RNA, 64 nt, Human
cuucaggcagagcuguggcacagacccccguccugucccccacacccgugucaugugucuguuu

SEQ ID NO: 466924 - RNA, 64 nt, Human
ggcugggcguggggggggcuguccuggcucugcugucccccaagagggugcuucgagggugagg

SEQ ID NO: 466925 - RNA, 64 nt, Human
cuucaauagagaagaaaucccuuugcuagauagggucccccaggcaguccccaguggcgggaca

SEQ ID NO: 466926 - RNA, 64 nt, Human
cucucugcaacaggagaaaaccuggagcuacagugucccccaccuuccuugccccaugggaacc

SEQ ID NO: 466927 - RNA, 64 nt, Human
gauacaugaccccagguuccaguguagaaccugagucccccauuccccaaagccaucccugcau

SEQ ID NO: 466928 - RNA, 64 nt, Human
agaguggacucuucccucucgcuccccucugccggucccccaugccaccacccaccccaaacuu

SEQ ID NO: 466929 - RNA, 62 nt, Human
cgaguccaggagccccagccagcccuucccaggccagcgaggcgaggcugccucugggugag

SEQ ID NO: 466930 - RNA, 62 nt, Human
cuucaguuuucggccagcgcgucgagggaggggccagcgacacauggccuaguaaccguccg

SEQ ID NO: 466931 - RNA, 62 nt, Human
ucucaugcccccucugcauuuuguccuggagugccagcgagugugcacccccaguuuccuuc

SEQ ID NO: 466932 - RNA, 62 nt, Human
agacguaaccccugccccaccucagcccggcagccagcgagguacaccagguggugcuugga

SEQ ID NO: 466933 - RNA, 64 nt, Human
ggaucaugagaggagggacuccaucuugagccaugucccccagccauggcauggcugcacugua

SEQ ID NO: 466934 - RNA, 64 nt, Human
caggcacauggcccaggcagcugucaauucucaugucccccacauggcccaaggugggcaucuu

SEQ ID NO: 466935 - RNA, 64 nt, Human
cagguuagaagacauacagaaacagggcuggugugucccccauagucugcaugcugugccggaa

SEQ ID NO: 466936 - RNA, 64 nt, Human
uggccuugcuccccaucccccaagugccucaccagucccccagacugggugaagguacagcugg

SEQ ID NO: 466937 - RNA, 64 nt, Human
cccgggcagggcccagugggauugagggggcugggucccccaggacacgggcccagaagagccc

SEQ ID NO: 466938 - RNA, 64 nt, Human
gggagcugugggucugccaggucccaccuccucugucccccaugccacaaccugggcuccuggc

SEQ ID NO: 466939 - RNA, 64 nt, Human
caaggcccugagccccaugcccagcccugccuuggucccccaacccccagagcuuggagucugg

SEQ ID NO: 466940 - RNA, 64 nt, Human
gcgggcugugcccggccccacccccugggcagaugucccccacugcuaaggcugcuggcuucag

SEQ ID NO: 466941 - RNA, 64 nt, Human
uuuuuugguagggccaccacucacuggguuuagggucccccaauacacugugaccucaucuuaa

SEQ ID NO: 466942 - RNA, 64 nt, Human
ccccccuuuuuuuuuugagacggggccuugcugugucccccaggcgggaauacagugccaugau

SEQ ID NO: 466943 - RNA, 64 nt, Human
uuuauuuaaggggacaugcacuggaauaggaaaugucccccaucucccuuccugcacccugcug

SEQ ID NO: 466944 - RNA, 64 nt, Human
gacacugcguccccacggccugcguggcgcugccgucccccacguguacuguagaguuuuuuuu

SEQ ID NO: 466945 - RNA, 64 nt, Human
cccacccaggcaucuccagugcucaugaucaugugucccccaacuccaccccucacaguuuggg

SEQ ID NO: 466946 - RNA, 64 nt, Human
uggugccugaugguagguaugguguguuuguucugucccccaggggcuggagucaccuggugcc

SEQ ID NO: 466947 - RNA, 64 nt, Human
gggcucuucuuaggaaauggcucucccucccccugucccccacccucauggcccaccuccaacc

SEQ ID NO: 466948 - RNA, 64 nt, Human
ucuuagguuacuacaugaagguaagacugccacagucccccagggaggcacacuguguuuuacu

SEQ ID NO: 466949 - RNA, 62 nt, Human; identical to SEQ ID NO: 455967

SEQ ID NO: 466950 - RNA, 62 nt, Human; identical to SEQ ID NO: 454867

SEQ ID NO: 466951 - RNA, 62 nt, Human; identical to SEQ ID NO: 455968

SEQ ID NO: 466952 - RNA, 62 nt, Human; identical to SEQ ID NO: 456059

SEQ ID NO: 466953 - RNA, 64 nt, Human
uggggcacacagcggggggcgccagguuuuccuugucccccagcugcucugccccuuuccccuu

SEQ ID NO: 466954 - RNA, 64 nt, Human
gcaggugggagggguuacccaucagcccuugcaagucccccacucaggccucuggaagguccag

SEQ ID NO: 466955 - RNA, 64 nt, Human
cuguggagccugggguuggauagggccauggcuggucccccaccauaccuccccuccacaucac

SEQ ID NO: 466956 - RNA, 50 nt, Human
ggggcacccaggagcagugagucccccaggacagggacccucaucugccu

SEQ ID NO: 466957 - RNA, 64 nt, Human
uguuugggaugaaauaacuaucuccccuuccucugucccccaacuggggagucuccccaggcug

SEQ ID NO: 466958 - RNA, 64 nt, Human
ggguggaccaggccuggagggcacuuccuccacagucccccacccaccuccugcggcucagccu

SEQ ID NO: 466959 - RNA, 64 nt, Human
auggauucugagacugcgacggcaaggcuguccugucccccaggcacccaaggauccugccaga

SEQ ID NO: 466960 - RNA, 64 nt, Human
aaggccaacugcggcgggaggcccugaagaugcagucccccaccuguguccucccugggccccu

SEQ ID NO: 466961 - RNA, 64 nt, Human
ggccacaggagcuuauuggccaggagggaauaaugucccccaauacugccuguugagggaccag

SEQ ID NO: 466962 - RNA, 64 nt, Human
cauucuguuugcaggcaaaugcuucagcucacaugucccccaagacucaauagucuugguuggg

SEQ ID NO: 466963 - RNA, 64 nt, Human
cgaagggcuccugacaguggccagggaccccugggucccccaggccugcagauguuucuaugag

SEQ ID NO: 466964 - RNA, 64 nt, Human
ggacugaaacgcuuacaccucugccucagaaggagucccccaugcccugccugaaaugacuuca

SEQ ID NO: 466965 - RNA, 64 nt, Human
gaccuacccagcucgcucacuucgcucgcuccgcgucccccaugccagcccccaacgcagggcg

SEQ ID NO: 466966 - RNA, 64 nt, Human
auaccaaucccccuguccccgaccccccauccccgucccccaucuccguccccguccccccugc

SEQ ID NO: 466967 - RNA, 64 nt, Human
uuuucuugggauucuuuuagcccuugacauucuugucccccaaaccuguaaguaggugaauucc

SEQ ID NO: 466968 - RNA, 64 nt, Human
uuuuuuuuuuuuuuuugagacagaaucucccucugucccccaggcuggagugcaguggugcgau

SEQ ID NO: 466969 - RNA, 62 nt, Human
caaggaaaagaaacuaucucggucacgugagcgccagcgaaaagaaacuguaucagucaucc

SEQ ID NO: 466970 - RNA, 62 nt, Human; identical to SEQ ID NO: 466442

SEQ ID NO: 466971 - RNA, 62 nt, Human; identical to SEQ ID NO: 466553

SEQ ID NO: 466972 - RNA, 62 nt, Human; identical to SEQ ID NO: 463037

SEQ ID NO: 466973 - RNA, 64 nt, Human
ccucaucauccacccgcugccccuccccgucccugucccccagcaucgggggccugcaaaucua

SEQ ID NO: 466974 - RNA, 64 nt, Human
cagaggcccccaguggggacagggagggggaccugucccccacucucucacccaccagcuccac

SEQ ID NO: 466975 - RNA, 64 nt, Human
uuauauguaaaucaagacucacaucccuuuccuagucccccacauccaaagccccucagccugc

SEQ ID NO: 466976 - RNA, 64 nt, Human
uaaaagaaaaacaaugaauuagaagagaucccccgucccccagucugacauauuucauacagaa

SEQ ID NO: 466977 - RNA, 64 nt, Human
cugcccuccuugcugguagaagcugaagagcacggucccccaggaggcagcucaggauaggugg

SEQ ID NO: 466978 - RNA, 64 nt, Human
aacgggccaagacugggacuauuccccacccccggucccccauugaggcccgccacccccauaa

SEQ ID NO: 466979 - RNA, 64 nt, Human
cuccggccgcucugcacaaacugggauggcccaggucccccagcaaggguacccagcaagggua

SEQ ID NO: 466980 - RNA, 64 nt, Human
cuaaggauggggaggugggggggcaggagcuucugucccccacauuccaugcaccuccccucug

SEQ ID NO: 466981 - RNA, 64 nt, Human
agggagucaaguauguacuuaaggugacucgacagucccccaacuccuauguggugaucaugaa

SEQ ID NO: 466982 - RNA, 64 nt, Human
cuguuccuccaguuucccauccuuugucccugcugucccccacuuuuaaagaugggucucaacc

SEQ ID NO: 466983 - RNA, 64 nt, Human
cgcugcuggaagacagccuggauuuccuuucuuugucccccacucccgauacccagcgaaagca

SEQ ID NO: 466984 - RNA, 64 nt, Human
uccccaagcgccuggcugcugcuucuugcuucccgucccccagccccaugcucccuuuuacauu

SEQ ID NO: 466985 - RNA, 64 nt, Human
ccucacuugguggaaaacacccagaaggucuugagucccccaccccugggugucaguccaaaug

SEQ ID NO: 466986 - RNA, 64 nt, Human
gggcuaucaggagagugggggaugguggccacaugucccccagguggucucccggugcauagcu

SEQ ID NO: 466987 - RNA, 64 nt, Human
uggguaaauggagacuuccggauccugucagggugucccccaugccuggaagaggagcuggugg

SEQ ID NO: 466988 - RNA, 64 nt, Human
cccaggcagcccggcagaggacgggaggagaccagucccccacccagccguaccagaaauaaag

SEQ ID NO: 466989 - RNA, 62 nt, Human
cacucagcagugggacagcaaccuguagaguggccagcgagggcgugucuagcuugauguug

SEQ ID NO: 466990 - RNA, 62 nt, Human
ccuggugggcuguucagcuuccugcugcuggggccagcgauuuuugaggauuuaucuuuagg

SEQ ID NO: 466991 - RNA, 62 nt, Human
cuucuguauuaugcacgugaagccuucccggagccagcgagcauaugcugcaugaggaccuu

SEQ ID NO: 466992 - RNA, 62 nt, Human; identical to SEQ ID NO: 463038

SEQ ID NO: 466993 - RNA, 64 nt, Human
auuucaaaggcacagauguuggaaaugguuuaaggucccccacugcacaccuuccucaagucau

SEQ ID NO: 466994 - RNA, 64 nt, Human
cggcauggccaccuaagucuucauuuaauuuauugucccccagaaaagauuaagaugcuacuug

SEQ ID NO: 466995 - RNA, 64 nt, Human
uuuuuuucuuuuuuuugagacagagucucucucugucccccaggcugaagugcagcggcaugau

SEQ ID NO: 466996 - RNA, 64 nt, Human
cucgggaggggagcugagcccgacuucuaccggggucccccagcuuccggacuggccgcacccc

SEQ ID NO: 466997 - RNA, 64 nt, Human
ccuccacagugggguucacacccagggcuccuuggucccccacaaccugccccggccaggccug

SEQ ID NO: 466998 - RNA, 64 nt, Human
caccccaccugucggucuuguccuggcucugccugucccccaccguuguucucguaggugaacc

SEQ ID NO: 466999 - RNA, 64 nt, Human
cggucuggcugccccaugggccugcgcuguagacgucccccauaggucgccccagggccucugc

SEQ ID NO: 467000 - RNA, 64 nt, Human
gggccagcguccuccuucccugcgcaagacuugcgucccccaugccugcuggguggcugggucc

SEQ ID NO: 467001 - RNA, 64 nt, Human
acccggacugcugcucccugccccucccuugcgggucccccaggaagccaggugaccccaggug

SEQ ID NO: 467002 - RNA, 64 nt, Human
ccuugcccuauuccucuccuccuccuccuccugggucccccaggguggcugggcuugggcuaug

SEQ ID NO: 467003 - RNA, 64 nt, Human
aaaauaaaggagcaauaaagucacgagaacuuucgucccccaaucgagagcccgaggggcaccc

SEQ ID NO: 467004 - RNA, 64 nt, Human
ccuccgcccucccugcugaauggaggagccgggggucccccaggccaacuggaaaaucucccag

SEQ ID NO: 467005 - RNA, 64 nt, Human
uuuguccagcucucacugccuuccuugguucccggucccccagcccauccgccauccccagccc

SEQ ID NO: 467006 - RNA, 64 nt, Human
acucaggaauggggguagauccauguccuccacugucccccauuaguucuguccccuucacaau

SEQ ID NO: 467007 - RNA, 64 nt, Human
gacuucauuuccaggggccacagccaagcccagagucccccagcggcucgcaugucagcccaga

SEQ ID NO: 467008 - RNA, 64 nt, Human
ugccucagccucuggaggagcugguaucacaggcgucccccaccacgccuggcuaaauuuugua

SEQ ID NO: 467009 - RNA, 62 nt, Human
aguauagcguaucgcaaggguuugacacggcugccagcgacucuaggcuuccagucuguguu

SEQ ID NO: 467010 - RNA, 62 nt, Human
acguucagugaaagaaauuucaacccuucauagccagcgaagaaauuugccuuggaagccaa

SEQ ID NO: 467011 - RNA, 62 nt, Human
aggaauaacacugcagcccucuccacccuccggccagcgaguggucaaggauuuuuauaaaa

SEQ ID NO: 467012 - RNA, 52 nt, Human
caccaccuuauucaccuuaagagccagcgagacaccugagacaugcugaaau

SEQ ID NO: 467013 - RNA, 64 nt, Human
ugaaaggcaggcucuggccccuuuccaugccaaagucccccaagaucuggauaucuggggacaa

SEQ ID NO: 467014 - RNA, 59 nt, Human
guccccaagauccuccuuagaaucccacagucccccagacccuccuuagaaugccacag

SEQ ID NO: 467015 - RNA, 64 nt, Human
ccacagucccccagacccuccuuagaaugccacagucccccaacccuccacagagcccccagac

SEQ ID NO: 467016 - RNA, 64 nt, Human
agagcugccggcgccggacccugcgacaaccggggucccccaggacaguaggcccggcucugcc

SEQ ID NO: 467017 - RNA, 64 nt, Human
caggaugcucgcugggauucccacgcccaccacugucccccaccccauggcugggaggggccuc

SEQ ID NO: 467018 - RNA, 64 nt, Human
agcucagcuguguuguguggcaguuuauuaaacugucccccagaucgacacgcagcuagccucc

SEQ ID NO: 467019 - RNA, 64 nt, Human
cugaaagcugauuaauuacaggagguuuguucaggucccccaaaccaccgucagauuugaugau

SEQ ID NO: 467020 - RNA, 64 nt, Human
uggggcccccccaccacgcggugccaggcccagugucccccaggccgucuguccacuccaugcc

SEQ ID NO: 467021 - RNA, 64 nt, Human
acccucccaucuccccucuguacauaggucacccgucccccaaucaaaucuaaagguuuuuuaa

SEQ ID NO: 467022 - RNA, 64 nt, Human
acccaccguccagagggcucccugcaggccaggggucccccagcgucacccuguuggggagaga

SEQ ID NO: 467023 - RNA, 64 nt, Human
cccccgcgagggaggcugcuggacccaccccgcugucccccaugauagaagucuguaaauaccu

SEQ ID NO: 467024 - RNA, 64 nt, Human
agcguugagcaggcacagcucugucgaggucccugucccccaccugugguucuggccucugagg

SEQ ID NO: 467025 - RNA, 64 nt, Human
ccaugggcaggguggguggagggacugaugcgaggucccccaggccucagccuggagcuccuga

SEQ ID NO: 467026 - RNA, 64 nt, Human
gcagcagggcguccgagcaauaagggcuggguuugucccccacccuggggggggccaggcucca

SEQ ID NO: 467027 - RNA, 64 nt, Human
uggagaggcgggucccaggcccggcccggagcgagucccccagggccugucgacacggcggggc

SEQ ID NO: 467028 - RNA, 64 nt, Human
uauuauuguagcuauuuauuuauuuauugaagaugucccccaggggcccaggcuccccugcccg

SEQ ID NO: 467029 - RNA, 62 nt, Human
ucacccuggccccuugggcuggacccuccaaugccagcgacucccaggagcccuugggggac

SEQ ID NO: 467030 - RNA, 62 nt, Human
ggguugcaacaauaauucaucaaguaaucauggccagcgauuauugaucaaaaucaaaaggu

SEQ ID NO: 467031 - RNA, 62 nt, Human
ucaguccccaggagcaggagcugcugcucacggccagcgacgacgccaccaucaaagccugg

SEQ ID NO: 467032 - RNA, 62 nt, Human; identical to SEQ ID NO: 463039

SEQ ID NO: 467033 - RNA, 64 nt, Human
ccaauugcugcucuguugcugugccuagucuagugucccccaaagcaucggggggccacgcaag

SEQ ID NO: 467034 - RNA, 64 nt, Human
ccagccccuccggccugggcugcccacaaggcuugucccccagaggcccuggcuccuggucggg

SEQ ID NO: 467035 - RNA, 64 nt, Human
aauguauaauuuuuuugagacagggugucacuuugucccccaggcuggagugcagugguacaag

SEQ ID NO: 467036 - RNA, 64 nt, Human
gccugcuguggaggccccagccgugggaauccaggucccccagguggagcugccugccuugccc

SEQ ID NO: 467037 - RNA, 64 nt, Human
gguugggccgcggcugccaggggcggaggugggugucccccaggucucagcccccaaggcugcc

SEQ ID NO: 467038 - RNA, 64 nt, Human
accucagccccaccacaucgcccaucucuuccccgucccccaggcccaggaccgccccugucag

SEQ ID NO: 467039 - RNA, 64 nt, Human
uguaagggccagaagugagggcccagaggucugggucccccagggggcaggggccaaaggucca

SEQ ID NO: 467040 - RNA, 64 nt, Human
ugauuuuguuguuguugugacagaguuucacucugucccccaggcuggagugcaaauaagcaac

SEQ ID NO: 467041 - RNA, 64 nt, Human
uauuggaaaagcucccugccuucccuugccgcuggucccccaccaggcuugggagcccuggcau

SEQ ID NO: 467042 - RNA, 64 nt, Human
ucaugaggccgguuucucucucucucccacuuuugucccccagccaagcucuaaagcacaugua

SEQ ID NO: 467043 - RNA, 64 nt, Human
gguccccuagggccauguugggucaaguuagauggucccccauggcauuguugagaucgaaugu

SEQ ID NO: 467044 - RNA, 60 nt, Human
gccugucuacaccccgcugagcccaaaugugucccccaacuucaucuggaaguuaaagug

SEQ ID NO: 467045 - RNA, 64 nt, Human
aacucaugaccccaggccccugcuccaccaggaugucccccagguccugccagcugggaagugc

SEQ ID NO: 467046 - RNA, 64 nt, Human
ucccccuccuaaagcuuuagacucagagcccagggucccccacaagccucaagguagccucagg

SEQ ID NO: 467047 - RNA, 64 nt, Human
cacugccccaacucuuuucccgggaccauacugagucccccagccacgcugcugacauuaccau

SEQ ID NO: 467048 - RNA, 64 nt, Human
ggcuggugugggucuuuuggcugcuuuucaaggugucccccaauguggcccucaagagccaucc

SEQ ID NO: 467049 - RNA, 62 nt, Human
cucucuuguccaauggggcuuggagcaccgaggccagcgaagccaucgcgcuccuugcggag

SEQ ID NO: 467050 - RNA, 62 nt, Human
uauuauaccaguugcuucugcagcccgcagaugccagcgaugccaggaaacaaguugaaauc

SEQ ID NO: 467051 - RNA, 62 nt, Human
aucuucuaccagcguagaguugacagaagcaggccagcgaggaggugugggacauaauagcc

SEQ ID NO: 467052 - RNA, 62 nt, Human
uccugauggugucauucugccugcuccaucgcgccagcgaccucucugccucucuucuuccc

SEQ ID NO: 467053 - RNA, 64 nt, Human
uccucugucuccucuuucucccuggccugugguugucccccagccucugccacccuccaccucc

SEQ ID NO: 467054 - RNA, 64 nt, Human
cauauuuaacauguaaaaaugucccccccgcuccgucccccaaacauguuguacauuucaccau

SEQ ID NO: 467055 - RNA, 64 nt, Human
caauaggaauucgucuccaggauuuuucccaugugucccccaguacuuauaaaagggagugaaa

SEQ ID NO: 467056 - RNA, 64 nt, Human
caugugacccucuuuccuugcaucccuauuccuugucccccacccacucuuccccccaucaaga

SEQ ID NO: 467057 - RNA, 64 nt, Human
ucuguuauggagccuuaguacccaccccgucugugucccccaugaaggcagcugagcuuucaga

SEQ ID NO: 467058 - RNA, 64 nt, Human
cuaauggcaccaacuuugugauugguuugucagugucccccaucgacucucuggggcugaucac

SEQ ID NO: 467059 - RNA, 64 nt, Human
guguccucucccuuaggggaagccccgagugagagucccccagcacacacuccccaacccccuc

SEQ ID NO: 467060 - RNA, 64 nt, Human
agagaaagacuucggacagucuagguccucaaaugucccccauugaggacaacagccccagcuc

SEQ ID NO: 467061 - RNA, 64 nt, Human
guccuuuguguccauugaugucauucagcagucagucccccaauaauccuuaaacuagcuaaaa

SEQ ID NO: 467062 - RNA, 64 nt, Human
uggacagccccagccaccaccuucagccuagccugucccccaaggauggugaagcucagcaggg

SEQ ID NO: 467063 - RNA, 64 nt, Human
ccaagaggagguggguagaugggaguggggcucggucccccaggcccaggggacucucuccacu

SEQ ID NO: 467064 - RNA, 64 nt, Human
ggagagaaggggaggaggacuccagcugggcucggucccccacagucagggacccccauaaagg

SEQ ID NO: 467065 - RNA, 64 nt, Human
cugcauggucuagagguugugggcagcauggacagucccccacucagaagugcaagaguuccaa

SEQ ID NO: 467066 - RNA, 64 nt, Human
cucuuaccgagcaagguggguggcucuggcacgagucccccagggggagagcauggcuaccagg

SEQ ID NO: 467067 - RNA, 64 nt, Human
uguuuauuuacauuccccucuccacgugaugucggucccccaucgccugcugagucacuugucu

SEQ ID NO: 467068 - RNA, 64 nt, Human
aucugacaaugaggcaaggggcugauagagaagagucccccaugacaggaguuugugugcaaca

SEQ ID NO: 467069 - RNA, 62 nt, Human; identical to SEQ ID NO: 467049

SEQ ID NO: 467070 - RNA, 62 nt, Human; identical to SEQ ID NO: 467050

SEQ ID NO: 467071 - RNA, 62 nt, Human; identical to SEQ ID NO: 467051

SEQ ID NO: 467072 - RNA, 62 nt, Human; identical to SEQ ID NO: 463065

SEQ ID NO: 467073 - RNA, 64 nt, Human
cauccgguuccccaaagcccugcugcauucgagugucccccaaccccgggcagguggcaccugg

SEQ ID NO: 467074 - RNA, 64 nt, Human
gugguuuagggauaaauguuucuggaacccuguggucccccauaauguugauagaauaucauau

SEQ ID NO: 467075 - RNA, 64 nt, Human
ugcucaggccaggaguccagcugcugaugggcacgucccccagggccagccggcuccgguccug

SEQ ID NO: 467076 - RNA, 57 nt, Human
gccagaaguccagcugcugacggucaugucccccagggccagccgggcucaggcccc

SEQ ID NO: 467077 - RNA, 64 nt, Human
ugcucaggccagaaguccagcugcugccaggcaugucccccagggccacugggcacuaugaguc

SEQ ID NO: 467078 - RNA, 64 nt, Human
caggcaugucccccagggccacugggcacuaugagucccccaccucucccacuacuggccccuc

SEQ ID NO: 467079 - RNA, 64 nt, Human
uuuugugcugaaagguuuucucgggguccguggugucccccaaaggugccaccgugcgggucuc

SEQ ID NO: 467080 - RNA, 64 nt, Human
uaaauccagaagagagaaauguuucacgcaagcagucccccaacucccaacacacacucccuuu

SEQ ID NO: 467081 - RNA, 64 nt, Human
ggggagcacaggccacagagcgcagccucugggggucccccaaggcacagcauauacagcaugg

SEQ ID NO: 467082 - RNA, 57 nt, Human
gccaaaagucuagcugcugauggccaugucccccagggccagccgggcucaggcccc

SEQ ID NO: 467083 - RNA, 64 nt, Human
agcacauucggcuucagaauaaagggcgcccgcggucccccagcaccugcccaagccacacccc

SEQ ID NO: 467084 - RNA, 64 nt, Human
ggccccagacccgccaaggaucauccugccuacggucccccagccuccugccaccaucauucag

SEQ ID NO: 467085 - RNA, 64 nt, Human
aucugaagcaagaguccagcguucugccgugucugucccccaccaugcccccuacaggcgguac

SEQ ID NO: 467086 - RNA, 64 nt, Human
gcccugacugacuguauucucuggccacauucaagucccccauuggugggggcagagaaguagg

SEQ ID NO: 467087 - RNA, 64 nt, Human
aauccaggggcagaaaacagggggccuaaagaaugucccccaccccuuggccucugccuccuug

SEQ ID NO: 467088 - RNA, 64 nt, Human
uucccuggaaucugcucaauaaagccugggguuggucccccacccgccacguuccucggcauca

SEQ ID NO: 467089 - RNA, 62 nt, Human; identical to SEQ ID NO: 467029

SEQ ID NO: 467090 - RNA, 62 nt, Human; identical to SEQ ID NO: 467030

SEQ ID NO: 467091 - RNA, 62 nt, Human; identical to SEQ ID NO: 467031

SEQ ID NO: 467092 - RNA, 62 nt, Human; identical to SEQ ID NO: 467052

SEQ ID NO: 467093 - RNA, 64 nt, Human
gccucucuguccuggccagggguggacaacuggggucccccaaaacucaguccuggcaccucaa

SEQ ID NO: 467094 - RNA, 64 nt, Human
uaugaggagugaaggggcccaacgcaauaaccacgucccccacccgggccccccgccgcggcug

SEQ ID NO: 467095 - RNA, 64 nt, Human
cuggacuccagcgguggcuucuugaugcugcgcggucccccacucccuacaucagaaugcaucc

SEQ ID NO: 467096 - RNA, 64 nt, Human
cagaaauuuucagugcaagucuugaugcugcgccgucccccacucccuacaucagaacgcaucc

SEQ ID NO: 467097 - RNA, 64 nt, Human
guggccagugagggcccgaggaccacgcagcagagucccccacgggccugagccugagagcuca

SEQ ID NO: 467098 - RNA, 64 nt, Human
ccguucccugggggcugggacuaaagaaaugggugucccccaccccaucagcugggaaagccca

SEQ ID NO: 467099 - RNA, 64 nt, Human
uaucucagugguggggguggccgcccgcccccuugucccccaugcaacaggcccaguggcuucc

SEQ ID NO: 467100 - RNA, 64 nt, Human
gaccucagcugucccuccuucuacccaagguggagucccccaaagucccuucugucuggccuau

SEQ ID NO: 467101 - RNA, 64 nt, Human
guuuucucuucaccgccgugggguguauugacuggucccccaugggcugcuggaaaggcccgga

SEQ ID NO: 467102 - RNA, 64 nt, Human
uuccaguugagcagaggaaaauaguggcaggacugucccccaggaggacucccugcuuagcucu

SEQ ID NO: 467103 - RNA, 64 nt, Human
ccauugcgguauucuuugcgguauucuuguccccgucccccagaaggcucgccucuccccgugg

SEQ ID NO: 467104 - RNA, 64 nt, Human
ccuaugacugagucuccaaacugguuuccuaguagucccccaucccuuccucccuuacccagcu

SEQ ID NO: 467105 - RNA, 64 nt, Human
caagggugccagaugccugggucucccaagaggggucccccaacucaccguucccgggacaggc

SEQ ID NO: 467106 - RNA, 64 nt, Human
guguguguucuucucugagcagcuccuccccggagucccccagcacagucccaggagaugacag

SEQ ID NO: 467107 - RNA, 64 nt, Human
agaacgaggagcgccuccgggcccccccgcccccgucccccaaccagaacaacaacgccauaga

SEQ ID NO: 467108 - RNA, 64 nt, Human
gucacgugcccccuagccuuacugggaaccuucugucccccaagauccccugugcuaucaggaa

SEQ ID NO: 467109 - RNA, 62 nt, Human; identical to SEQ ID NO: 466819

SEQ ID NO: 467110 - RNA, 62 nt, Human; identical to SEQ ID NO: 463082

SEQ ID NO: 467111 - RNA, 62 nt, Human
ccagccugcagcugacugaggaccacgagugagccagcgagggggcgggagaccucagccgc

SEQ ID NO: 467112 - RNA, 62 nt, Human
accacaccauccugcaguacuaucgcugcauggccagcgagcuuguccgugucaacaucacc

SEQ ID NO: 467113 - RNA, 64 nt, Human
cacacagcuuccacaacuucucuguuuucugucagucccccaguggccgcccuuacacgucucc

SEQ ID NO: 467114 - RNA, 64 nt, Human
aguggaagaagcugcagugggagacaaagccucggucccccacccauccacacacaccuacacu

SEQ ID NO: 467115 - RNA, 64 nt, Human
aacucaaaugucaaccccaccgaggcacccccccgucccccagaaucuuggcuguuuacaaauc

SEQ ID NO: 467116 - RNA, 64 nt, Human
auauccuuccucgacaacgugcgagaacccugacgucccccagcaaaggaagacguugcaagca

SEQ ID NO: 467117 - RNA, 64 nt, Human
uggacuugcggggaggaaacuccagggcacugcaucuggcgaucagacucugagcacugccccu

SEQ ID NO: 467118 - RNA, 64 nt, Human
uuaauucaaaugaacccaucaacuggaugccaacucuggcgaauguaggaccucugaguggcug

SEQ ID NO: 467119 - RNA, 64 nt, Human
gagggaagguuuccgacgcaggcaggugggguugucuggcgagcccgggggcucgcagggggga

SEQ ID NO: 467120 - RNA, 64 nt, Human
agacuuaguucuuggacguuggggcaacuacagcucuggcgauugcuuuauuuuggcuucagau

SEQ ID NO: 467121 - RNA, 64 nt, Human
aacacaguauagagcaugaauuuuuuucaucuucucuggcgacaguuuuccuucucaucuguga

SEQ ID NO: 467122 - RNA, 64 nt, Human
uucagaaaaggcaauaaacggcccaacuagugcuucuggcgaugacauuucuaagcuacagcgu

SEQ ID NO: 467123 - RNA, 64 nt, Human
augaugcuggcacagaaggcauuguucccuacccucuggcgagugcaugcagcagagaguuaga

SEQ ID NO: 467124 - RNA, 64 nt, Human
ggccuaaccaugacugcagcacaaaauuaucgacucuggcgagauuuaaaaucaggugcuacag

SEQ ID NO: 467125 - RNA, 64 nt, Human
cacagcuauggcucacuaccaggugcuugaugaaucuggcgaggggcucaagacagaccucaug

SEQ ID NO: 467126 - RNA, 62 nt, Human; identical to SEQ ID NO: 466758

SEQ ID NO: 467127 - RNA, 62 nt, Human; identical to SEQ ID NO: 466759

SEQ ID NO: 467128 - RNA, 62 nt, Human; identical to SEQ ID NO: 466760

SEQ ID NO: 467129 - RNA, 62 nt, Human
ucccggagcagcauuccagagccuccugcagagccagcgaaggaaagcucuagagggagacg

SEQ ID NO: 467130 - RNA, 64 nt, Human
auaaacaggcccacaaaacaugugcugacugcacucuggcgacccuuuuccaguugauguuuuu

SEQ ID NO: 467131 - RNA, 64 nt, Human
gcaaaguucuucuagaauuccacaugcaauucacucuggcgacccugugcuuuccugacacugc

SEQ ID NO: 467132 - RNA, 64 nt, Human
cuuggacacgaacaaagccacacuucuaacugcuucuggcgaacugauuuuauuuuuaauuuuu

SEQ ID NO: 467133 - RNA, 64 nt, Human
ugcuggguggaccuaagguuccuucccgccccauucuggcgacacuuggagccaucucaggccu

SEQ ID NO: 467134 - RNA, 64 nt, Human
ucuccgcguggguacuuggggguggggccacaaaucuggcgaaaaacuucaugcuggccgccgu

SEQ ID NO: 467135 - RNA, 64 nt, Human
aacugcccugaugggccaugagaugcuggggagaucuggcgaugacuguggcucccgcucucug

SEQ ID NO: 467136 - RNA, 64 nt, Human
cagaauuucauucagucuacacuuuggcauucucucuggcgauggaguguggcugggcugaccg

SEQ ID NO: 467137 - RNA, 64 nt, Human
cuuggugggugggagacagggcuuuuucucucccucuggcgaggacucucaggauguagggacu

SEQ ID NO: 467138 - RNA, 64 nt, Human
aauguucucaacuccugaacugcagcgucucaucucuggcgacaaugcugagauugaucuggaa

SEQ ID NO: 467139 - RNA, 59 nt, Human
cgaaaucaaguggggcaugagccggaagaucuggcgaagcucaggcaaaaacaccacca

SEQ ID NO: 467140 - RNA, 64 nt, Human
ucgacccccgcaaugagugggcaccaggggacgcucuggcgagggcagaccccaggggaaagca

SEQ ID NO: 467141 - RNA, 64 nt, Human
ggcagugcccaccaugcaccccugauguucgccgucuggcgagcccuuagccuugcuguagaga

SEQ ID NO: 467142 - RNA, 64 nt, Human
aaagucugaauccugaccccuugagagagagugaucuggcgagggccgaugaaggggcugggcc

SEQ ID NO: 467143 - RNA, 64 nt, Human
ggaguccaggggccccuucuggacgccccgcgacucuggcgaaauaaagcgagugcugcggccg

SEQ ID NO: 467144 - RNA, 64 nt, Human
ugaauucagaucaucucagaagucuggagggaaaucuggcgaaaccuucguuugagggacugau

SEQ ID NO: 467145 - RNA, 64 nt, Human
guuggaaugaauuaaauaaacccuuccuggggcaucuggcgaaucccagcuguguguccggugu

SEQ ID NO: 467146 - RNA, 62 nt, Human; identical to SEQ ID NO: 466724

SEQ ID NO: 467147 - RNA, 62 nt, Human; identical to SEQ ID NO: 463084

SEQ ID NO: 467148 - RNA, 62 nt, Human
cucuguaauuuguugagguucucaaacugacagccagcgagacugggugggaggcccuggau

SEQ ID NO: 467149 - RNA, 62 nt, Human
ugcugggccccccgaucagaccucaaggacaggccagcgagagauggagcuaccguguccag

SEQ ID NO: 467150 - RNA, 64 nt, Human
ccgacgccaagugagccgacuggcgccggcgcguucuggcgacaggggagccaggggccgcggg

SEQ ID NO: 467151 - RNA, 64 nt, Human
agcggacaucccuggagucccagcagcgagcuggucuggcgagggcaccucggcagcccccacg

SEQ ID NO: 467152 - RNA, 64 nt, Human
ugacuagcucagccagcggcucuuucugcuuuguucuggcgacuuuccugggcaggccuuucca

SEQ ID NO: 467153 - RNA, 64 nt, Human
auuugguaccaugguguaagcugauagcacaaguucuggcgacagguagcacguaucugagaga

SEQ ID NO: 467154 - RNA, 64 nt, Human
cugcuuuauuucagacucugccccagguuccaggaauccgaaccccggagugcugacgcgguuc

SEQ ID NO: 467155 - RNA, 64 nt, Human
gaacugagguuuuuaccgauuuauagagcagucaaauccgaagugcucgagugcuuagaaaccc

SEQ ID NO: 467156 - RNA, 64 nt, Human
aguggcuuccccggcagcagccccaugauggcugaauccgaaauccucgauggguccagcuuga

SEQ ID NO: 467157 - RNA, 64 nt, Human
ucuacaggucaaauuaauuugaacaguucuugucaauccgaauuguugauucuguuuaaaugac

SEQ ID NO: 467158 - RNA, 64 nt, Human
aagucaaggaaaccagaauuugacacacuccaacaauccgaaggggcauguugcuccugagcag

SEQ ID NO: 467159 - RNA, 64 nt, Human
ucuuuucuuaauaauccugcaaaucucugcccugaauccgaaaucugaaaauguacuggcuuga

SEQ ID NO: 467160 - RNA, 64 nt, Human
aucaaagagagaucaagcgaacuauuuuagguuaaauccgaauaaaagaacuuuacuggagacu

SEQ ID NO: 467161 - RNA, 64 nt, Human
ccuaaaaccuaguaucuuuuucucuucuauggaaaauccgaaggucuaaacuugacuuuuuuga

SEQ ID NO: 467162 - RNA, 64 nt, Human
aauuccagcugccauuugcaaaaacaaggaaaaaaauccgaaacuuucuuuuguugcacugaca

SEQ ID NO: 467163 - RNA, 64 nt, Human
gaaauuauaugguucugucacuacucuguaaauuaauccgaaacuuuuaagguaacugggauga

SEQ ID NO: 467164 - RNA, 64 nt, Human
uguaauaucaacagaaccuugugguccagcaggaaauccgaauugcccauaugcucuugggccu

SEQ ID NO: 467165 - RNA, 62 nt, Human; identical to SEQ ID NO: 463101

SEQ ID NO: 467166 - RNA, 62 nt, Human; identical to SEQ ID NO: 466644

SEQ ID NO: 467167 - RNA, 62 nt, Human; identical to SEQ ID NO: 466645

SEQ ID NO: 467168 - RNA, 62 nt, Human; identical to SEQ ID NO: 466646

SEQ ID NO: 467169 - RNA, 64 nt, Human
aaaucaccguacgacucuuuuccaaacacaggcaaauccgaaaucagcaggacgacuguuuucc

SEQ ID NO: 467170 - RNA, 64 nt, Human
gggcgacagauucaugccacggauaaaugaggcaaauccgaagaaaaggaaaaucgaauaaaaa

SEQ ID NO: 467171 - RNA, 64 nt, Human
aucuuuguaucugaacuuugcacgucugccgaaaaauccgaaccuguugacugggauuuuuaag

SEQ ID NO: 467172 - RNA, 64 nt, Human
uauauauuaaaauugcaugggacagagacuuugcaauccgaaagaauagacugugaaaugaguu

SEQ ID NO: 467173 - RNA, 64 nt, Human
uuauauguguauaguuaccaaccuaaaaauaaaaaauccgaacagcauacuugaagaauguaau

SEQ ID NO: 467174 - RNA, 64 nt, Human
agagcccuggcuggugacaugcuggcugggggugaauccgaaugacagugcagacguucuccca

SEQ ID NO: 467175 - RNA, 64 nt, Human
cauaauaaauuccacuucuugaccugaauuuggaaauccgaaauuacuaauccaggccaggugu

SEQ ID NO: 467176 - RNA, 64 nt, Human
augcuguauuucucuucuuacgccagucagaaccaauccgaaaagaauguguguugacucaggu

SEQ ID NO: 467177 - RNA, 64 nt, Human
aucuucgcaguuuaagaaaccacguuuccuauccaauccgaagggaaggugcuguacaguucau

SEQ ID NO: 467178 - RNA, 64 nt, Human
cuucuaacugugacuccccgcacuccccaaaaagaauccgaaaaaccacaaagaaacaccaggc

SEQ ID NO: 467179 - RNA, 64 nt, Human
cuuccauggcccucauuaaugacacuuguccccaaauccgaaccuccucugugaagcauucgag

SEQ ID NO: 467180 - RNA, 64 nt, Human
ugcacuugagacuaugguugacuaaugcucuauaaauccgaagagaguucggacuauaaguauu

SEQ ID NO: 467181 - RNA, 64 nt, Human
augaccuccauuuugauacuuguagaccagaucuaauccgaagauuaaucuuuagguaacagau

SEQ ID NO: 467182 - RNA, 64 nt, Human
aaucuuuagggaaugagaguuccuucucacuuagaauccgaagggaauuaaaaagaagaugaau

SEQ ID NO: 467183 - RNA, 64 nt, Human
cuuggaauguauuuauuuauauuuauuuuuucaaaauccgaaaucauuugcgagccgcaaucgu

SEQ ID NO: 467184 - RNA, 64 nt, Human
ccgcccuccuacccucgccucgcauccucugccaaauccgaauucuuccagcccagcuucccgg

SEQ ID NO: 467185 - RNA, 62 nt, Human
ugcccauccccaucucuaaaaccaguaaaucagccagcgaauacccggaagcaagaugcaca

SEQ ID NO: 467186 - RNA, 62 nt, Human
ugcaaggaaauagaugcugaggcagucuuccugccagcgagcccacuguaucugggcccaag

SEQ ID NO: 467187 - RNA, 62 nt, Human; identical to SEQ ID NO: 466722

SEQ ID NO: 467188 - RNA, 62 nt, Human; identical to SEQ ID NO: 466647

SEQ ID NO: 467189 - RNA, 64 nt, Human
gagagccucuuguggaccccgccugcccgaaugaaauccgaacaguuggggcuguucauggcaa

SEQ ID NO: 467190 - RNA, 64 nt, Human
caauaaagugaaaauaaauaaaaauccuugaacaaauccgaaaaggcuuggaguccucgcccag

SEQ ID NO: 467191 - RNA, 64 nt, Human
uauuaggaagaaacaaggacaaauuuagaccuugaauccgaagagauaaagcuuacuugacuuu

SEQ ID NO: 467192 - RNA, 64 nt, Human
acagucuuccauuugcaagggaaaagucucuuguaauccgaaucucuuuuugcuuucgaacugc

SEQ ID NO: 467193 - RNA, 64 nt, Human
aacaacugauggagaucagagcaaauuaugccagaauccgaaggcagcagggcccucaagccac

SEQ ID NO: 467194 - RNA, 64 nt, Human
ugcuuuuccccuuuuugcaaaaaaccacuggccaaauccgaaccauugcccuuguuucccccac

SEQ ID NO: 467195 - RNA, 64 nt, Human
caucacaacaaccugcuuguuuucaugagacaauaauccgaaaaguucgcuuugauauauuccu

SEQ ID NO: 467196 - RNA, 64 nt, Human
gucauuucuucaaaugcugauagggguauguuggaauccgaagccacuuccccgccuucaagcc

SEQ ID NO: 467197 - RNA, 64 nt, Human
cuguuggcaacuccauaaaaacauuucagauuuuaauccgaauuuagcuaaugagacuggauuu

SEQ ID NO: 467198 - RNA, 64 nt, Human
aggucccuagccugcaacauuuaugucgcaugucaauccgaagagugaugcccacccaagaagu

SEQ ID NO: 467199 - RNA, 64 nt, Human
aaauggcguucagcagcggguuuggaacauagcgaauccgaauggaucugaugaaaccuguacc

SEQ ID NO: 467200 - RNA, 64 nt, Human
uacugucagcccuucgcuuacaaacugcaggcucaauccgaaggggacggccggcgggggcucu

SEQ ID NO: 467201 - RNA, 64 nt, Human
ucugccgauagcugguguugucacaacugccuggaauccgaagguggaggacaggcagccccgc

SEQ ID NO: 467202 - RNA, 64 nt, Human
uuuucgguaucugcuguucacagcucuccacuguaauccgaauacuuugccagugcacuaaucu

SEQ ID NO: 467203 - RNA, 64 nt, Human
gcccacucuaccacuuuuuacuuaucugguuaauaauccgaaauguuaccgggguugacucacg

SEQ ID NO: 467204 - RNA, 64 nt, Human
uaccaaguucaaaauauaucuaagaaagauuguaaauccgaaaacuuccauuguaguggccugu

SEQ ID NO: 467205 - RNA, 62 nt, Human; identical to SEQ ID NO: 463102

SEQ ID NO: 467206 - RNA, 62 nt, Human; identical to SEQ ID NO: 466664

SEQ ID NO: 467207 - RNA, 62 nt, Human; identical to SEQ ID NO: 466665

SEQ ID NO: 467208 - RNA, 62 nt, Human; identical to SEQ ID NO: 466666

SEQ ID NO: 467209 - RNA, 64 nt, Human
uaacaauaccccccccccacggcaagaaugcccaaauccgaaugaccccaguuuuccuaaugag

SEQ ID NO: 467210 - RNA, 64 nt, Human
uuugugcauuuucucaacuaaaaauagagaugauaauccgaauucuccauauauucacuaauca

SEQ ID NO: 467211 - RNA, 64 nt, Human
acacuucacuaaagugucauccaccaguguguugaauccgaagaaugacaauuuucuaccacug

SEQ ID NO: 467212 - RNA, 64 nt, Human
gacugacccccaagaucuccuucccguggaaugaaauccgaaacaucucguacagugacaagga

SEQ ID NO: 467213 - RNA, 64 nt, Human
cucaacucuggccccaggcccuguucuguuauccaauccgaaacacggaacaugcugcaauuca

SEQ ID NO: 467214 - RNA, 64 nt, Human
caggguacacacguuagguauugugaagaacaucaauccgaacuuuucuucuguuguuugcacu

SEQ ID NO: 467215 - RNA, 64 nt, Human
uggugcacacacacaacauugcuguucagucacaaauccgaacaacuuaauauaauaaauugua

SEQ ID NO: 467216 - RNA, 64 nt, Human
uuaaauugucuuuuugggguuggacuaaauaugaaauccgaaagccaaaccagacucaccagaa

SEQ ID NO: 467217 - RNA, 53 nt, Human
acgaaucuaauguauuguaacagaauccgaaucuugaacugccuauguuauug

SEQ ID NO: 467218 - RNA, 64 nt, Human
cuggggucuaugauuucucaaaauuuucauucggaauccgaaggauacagucuuuaaacuuuag

SEQ ID NO: 467219 - RNA, 64 nt, Human; identical to SEQ ID NO: 467218

SEQ ID NO: 467220 - RNA, 64 nt, Human; identical to SEQ ID NO: 431212

SEQ ID NO: 467221 - RNA, 64 nt, Human; identical to SEQ ID NO: 431213

SEQ ID NO: 467222 - RNA, 64 nt, Human; identical to SEQ ID NO: 431214

SEQ ID NO: 467223 - RNA, 64 nt, Human; identical to SEQ ID NO: 431215

SEQ ID NO: 467224 - RNA, 64 nt, Human; identical to SEQ ID NO: 431216

SEQ ID NO: 467225 - RNA, 62 nt, Human; identical to SEQ ID NO: 466667

SEQ ID NO: 467226 - RNA, 62 nt, Human; identical to SEQ ID NO: 466684

SEQ ID NO: 467227 - RNA, 62 nt, Human; identical to SEQ ID NO: 466685

SEQ ID NO: 467228 - RNA, 62 nt, Human; identical to SEQ ID NO: 455970

SEQ ID NO: 467229 - RNA, 64 nt, Human; identical to SEQ ID NO: 431217

SEQ ID NO: 467230 - RNA, 64 nt, Human; identical to SEQ ID NO: 431218

SEQ ID NO: 467231 - RNA, 64 nt, Human; identical to SEQ ID NO: 431219

SEQ ID NO: 467232 - RNA, 64 nt, Human; identical to SEQ ID NO: 431220

SEQ ID NO: 467233 - RNA, 64 nt, Human; identical to SEQ ID NO: 431221

SEQ ID NO: 467234 - RNA, 64 nt, Human; identical to SEQ ID NO: 431222

SEQ ID NO: 467235 - RNA, 64 nt, Human; identical to SEQ ID NO: 431226

SEQ ID NO: 467236 - RNA, 64 nt, Human; identical to SEQ ID NO: 431227

SEQ ID NO: 467237 - RNA, 64 nt, Human; identical to SEQ ID NO: 431228

SEQ ID NO: 467238 - RNA, 64 nt, Human; identical to SEQ ID NO: 431229

SEQ ID NO: 467239 - RNA, 64 nt, Human; identical to SEQ ID NO: 431230

SEQ ID NO: 467240 - RNA, 64 nt, Human; identical to SEQ ID NO: 431231

SEQ ID NO: 467241 - RNA, 64 nt, Human; identical to SEQ ID NO: 431232

SEQ ID NO: 467242 - RNA, 64 nt, Human; identical to SEQ ID NO: 431233

SEQ ID NO: 467243 - RNA, 64 nt, Human; identical to SEQ ID NO: 431234

SEQ ID NO: 467244 - RNA, 64 nt, Human; identical to SEQ ID NO: 431235

SEQ ID NO: 467245 - RNA, 64 nt, Human; identical to SEQ ID NO: 431236

SEQ ID NO: 467246 - RNA, 64 nt, Human; identical to SEQ ID NO: 431237

SEQ ID NO: 467247 - RNA, 64 nt, Human; identical to SEQ ID NO: 431238

SEQ ID NO: 467248 - RNA, 64 nt, Human; identical to SEQ ID NO: 431239

SEQ ID NO: 467249 - RNA, 64 nt, Human; identical to SEQ ID NO: 431243

SEQ ID NO: 467250 - RNA, 64 nt, Human; identical to SEQ ID NO: 431244

SEQ ID NO: 467251 - RNA, 64 nt, Human; identical to SEQ ID NO: 431245

SEQ ID NO: 467252 - RNA, 64 nt, Human; identical to SEQ ID NO: 431246

SEQ ID NO: 467253 - RNA, 64 nt, Human; identical to SEQ ID NO: 431247

SEQ ID NO: 467254 - RNA, 64 nt, Human; identical to SEQ ID NO: 431248

SEQ ID NO: 467255 - RNA, 64 nt, Human; identical to SEQ ID NO: 431249

SEQ ID NO: 467256 - RNA, 64 nt, Human; identical to SEQ ID NO: 431250

SEQ ID NO: 467257 - RNA, 64 nt, Human; identical to SEQ ID NO: 431251

SEQ ID NO: 467258 - RNA, 64 nt, Human; identical to SEQ ID NO: 431252

SEQ ID NO: 467259 - RNA, 64 nt, Human; identical to SEQ ID NO: 431253

SEQ ID NO: 467260 - RNA, 64 nt, Human; identical to SEQ ID NO: 431254

SEQ ID NO: 467261 - RNA, 62 nt, Human
gccacaagaggaagcugaaugaagaggacgccgccagcgaguccagcagggaguccagcaac

SEQ ID NO: 467262 - RNA, 62 nt, Human; identical to SEQ ID NO: 466702

SEQ ID NO: 467263 - RNA, 62 nt, Human; identical to SEQ ID NO: 466703

SEQ ID NO: 467264 - RNA, 64 nt, Human; identical to SEQ ID NO: 431255

SEQ ID NO: 467265 - RNA, 64 nt, Human; identical to SEQ ID NO: 431256

SEQ ID NO: 467266 - RNA, 64 nt, Human; identical to SEQ ID NO: 431260

SEQ ID NO: 467267 - RNA, 64 nt, Human; identical to SEQ ID NO: 431261

SEQ ID NO: 467268 - RNA, 64 nt, Human; identical to SEQ ID NO: 431262

SEQ ID NO: 467269 - RNA, 64 nt, Human; identical to SEQ ID NO: 431263

SEQ ID NO: 467270 - RNA, 64 nt, Human; identical to SEQ ID NO: 431264

SEQ ID NO: 467271 - RNA, 64 nt, Human; identical to SEQ ID NO: 431265

SEQ ID NO: 467272 - RNA, 64 nt, Human; identical to SEQ ID NO: 431266

SEQ ID NO: 467273 - RNA, 64 nt, Human; identical to SEQ ID NO: 431267

SEQ ID NO: 467274 - RNA, 64 nt, Human; identical to SEQ ID NO: 431268

SEQ ID NO: 467275 - RNA, 64 nt, Human; identical to SEQ ID NO: 431269

SEQ ID NO: 467276 - RNA, 64 nt, Human; identical to SEQ ID NO: 431270

SEQ ID NO: 467277 - RNA, 64 nt, Human; identical to SEQ ID NO: 431271

SEQ ID NO: 467278 - RNA, 64 nt, Human; identical to SEQ ID NO: 431272

SEQ ID NO: 467279 - RNA, 64 nt, Human; identical to SEQ ID NO: 431273

SEQ ID NO: 467280 - RNA, 62 nt, Human; identical to SEQ ID NO: 466817

SEQ ID NO: 467281 - RNA, 62 nt, Human; identical to SEQ ID NO: 467111

SEQ ID NO: 467282 - RNA, 62 nt, Human; identical to SEQ ID NO: 467112

SEQ ID NO: 467283 - RNA, 64 nt, Human; identical to SEQ ID NO: 431277

SEQ ID NO: 467284 - RNA, 64 nt, Human; identical to SEQ ID NO: 431278

SEQ ID NO: 467285 - RNA, 64 nt, Human; identical to SEQ ID NO: 431279

SEQ ID NO: 467286 - RNA, 64 nt, Human; identical to SEQ ID NO: 431280

SEQ ID NO: 467287 - RNA, 64 nt, Human; identical to SEQ ID NO: 431281

SEQ ID NO: 467288 - RNA, 64 nt, Human; identical to SEQ ID NO: 431282

SEQ ID NO: 467289 - RNA, 64 nt, Human; identical to SEQ ID NO: 431283

SEQ ID NO: 467290 - RNA, 64 nt, Human; identical to SEQ ID NO: 431284

SEQ ID NO: 467291 - RNA, 64 nt, Human; identical to SEQ ID NO: 431285

SEQ ID NO: 467292 - RNA, 64 nt, Human; identical to SEQ ID NO: 431286

SEQ ID NO: 467293 - RNA, 64 nt, Human; identical to SEQ ID NO: 431287

SEQ ID NO: 467294 - RNA, 64 nt, Human; identical to SEQ ID NO: 431288

SEQ ID NO: 467295 - RNA, 64 nt, Human; identical to SEQ ID NO: 431289

SEQ ID NO: 467296 - RNA, 64 nt, Human; identical to SEQ ID NO: 431290

SEQ ID NO: 467297 - RNA, 64 nt, Human; identical to SEQ ID NO: 431294

SEQ ID NO: 467298 - RNA, 64 nt, Human; identical to SEQ ID NO: 431295

SEQ ID NO: 467299 - RNA, 62 nt, Human; identical to SEQ ID NO: 467129

SEQ ID NO: 467300 - RNA, 62 nt, Human; identical to SEQ ID NO: 467185

SEQ ID NO: 467301 - RNA, 62 nt, Human; identical to SEQ ID NO: 467186

SEQ ID NO: 467302 - RNA, 64 nt, Human; identical to SEQ ID NO: 431296

SEQ ID NO: 467303 - RNA, 64 nt, Human; identical to SEQ ID NO: 431297

SEQ ID NO: 467304 - RNA, 64 nt, Human; identical to SEQ ID NO: 431298

SEQ ID NO: 467305 - RNA, 64 nt, Human; identical to SEQ ID NO: 431299

SEQ ID NO: 467306 - RNA, 64 nt, Human; identical to SEQ ID NO: 431300

SEQ ID NO: 467307 - RNA, 64 nt, Human; identical to SEQ ID NO: 431301

SEQ ID NO: 467308 - RNA, 61 nt, Human; identical to SEQ ID NO: 431302

SEQ ID NO: 467309 - RNA, 64 nt, Human; identical to SEQ ID NO: 431303

SEQ ID NO: 467310 - RNA, 64 nt, Human; identical to SEQ ID NO: 431304

SEQ ID NO: 467311 - RNA, 64 nt, Human; identical to SEQ ID NO: 431305

SEQ ID NO: 467312 - RNA, 60 nt, Human; identical to SEQ ID NO: 431306

SEQ ID NO: 467313 - RNA, 64 nt, Human; identical to SEQ ID NO: 431307

SEQ ID NO: 467314 - RNA, 64 nt, Human; identical to SEQ ID NO: 431311

SEQ ID NO: 467315 - RNA, 63 nt, Human; identical to SEQ ID NO: 431312

SEQ ID NO: 467316 - RNA, 64 nt, Human; identical to SEQ ID NO: 431313

SEQ ID NO: 467317 - RNA, 64 nt, Human; identical to SEQ ID NO: 431314

SEQ ID NO: 467318 - RNA, 62 nt, Human; identical to SEQ ID NO: 466725

SEQ ID NO: 467319 - RNA, 62 nt, Human
aguuuaugauggaaccuuaaauauauaauguugccagcgauuuuaguucaauauuuguuacu

SEQ ID NO: 467320 - RNA, 62 nt, Human
uugugcucccagggacuauuuucuccucguaagccagcgaccugccuaaagcuugggcugug

SEQ ID NO: 467321 - RNA, 64 nt, Human; identical to SEQ ID NO: 431315

SEQ ID NO: 467322 - RNA, 64 nt, Human; identical to SEQ ID NO: 431316

SEQ ID NO: 467323 - RNA, 64 nt, Human; identical to SEQ ID NO: 431317

SEQ ID NO: 467324 - RNA, 64 nt, Human; identical to SEQ ID NO: 431318

SEQ ID NO: 467325 - RNA, 64 nt, Human; identical to SEQ ID NO: 431319

SEQ ID NO: 467326 - RNA, 64 nt, Human; identical to SEQ ID NO: 431320

SEQ ID NO: 467327 - RNA, 64 nt, Human; identical to SEQ ID NO: 431321

SEQ ID NO: 467328 - RNA, 64 nt, Human; identical to SEQ ID NO: 431322

SEQ ID NO: 467329 - RNA, 64 nt, Human; identical to SEQ ID NO: 431323

SEQ ID NO: 467330 - RNA, 64 nt, Human; identical to SEQ ID NO: 431324

SEQ ID NO: 467331 - RNA, 64 nt, Human; identical to SEQ ID NO: 431326

SEQ ID NO: 467332 - RNA, 55 nt, Human; identical to SEQ ID NO: 431327

SEQ ID NO: 467333 - RNA, 64 nt, Human; identical to SEQ ID NO: 431328

SEQ ID NO: 467334 - RNA, 64 nt, Human; identical to SEQ ID NO: 431329

SEQ ID NO: 467335 - RNA, 64 nt, Human; identical to SEQ ID NO: 431330

SEQ ID NO: 467336 - RNA, 64 nt, Human; identical to SEQ ID NO: 431330

SEQ ID NO: 467337 - RNA, 62 nt, Human; identical to SEQ ID NO: 467148

SEQ ID NO: 467338 - RNA, 62 nt, Human; identical to SEQ ID NO: 467149

SEQ ID NO: 467339 - RNA, 62 nt, Human; identical to SEQ ID NO: 467261

SEQ ID NO: 467340 - RNA, 64 nt, Human; identical to SEQ ID NO: 431332

SEQ ID NO: 467341 - RNA, 64 nt, Human; identical to SEQ ID NO: 431333

SEQ ID NO: 467342 - RNA, 64 nt, Human; identical to SEQ ID NO: 431334

SEQ ID NO: 467343 - RNA, 64 nt, Human; identical to SEQ ID NO: 431335

SEQ ID NO: 467344 - RNA, 64 nt, Human; identical to SEQ ID NO: 431336

SEQ ID NO: 467345 - RNA, 64 nt, Human; identical to SEQ ID NO: 431337

SEQ ID NO: 467346 - RNA, 64 nt, Human; identical to SEQ ID NO: 431338

SEQ ID NO: 467347 - RNA, 64 nt, Human; identical to SEQ ID NO: 431339

SEQ ID NO: 467348 - RNA, 64 nt, Human; identical to SEQ ID NO: 428934

SEQ ID NO: 467349 - RNA, 64 nt, Human; identical to SEQ ID NO: 428935

SEQ ID NO: 467350 - RNA, 64 nt, Human; identical to SEQ ID NO: 428936

SEQ ID NO: 467351 - RNA, 64 nt, Human; identical to SEQ ID NO: 428937

SEQ ID NO: 467352 - RNA, 64 nt, Human; identical to SEQ ID NO: 428938

SEQ ID NO: 467353 - RNA, 64 nt, Human; identical to SEQ ID NO: 428939

SEQ ID NO: 467354 - RNA, 64 nt, Human; identical to SEQ ID NO: 428940

SEQ ID NO: 467355 - RNA, 64 nt, Human; identical to SEQ ID NO: 428941

SEQ ID NO: 467356 - RNA, 62 nt, Human; identical to SEQ ID NO: 467319

SEQ ID NO: 467357 - RNA, 62 nt, Human; identical to SEQ ID NO: 467320

SEQ ID NO: 467358 - RNA, 62 nt, Human; identical to SEQ ID NO: 463063

SEQ ID NO: 467359 - RNA, 64 nt, Human; identical to SEQ ID NO: 428942

SEQ ID NO: 467360 - RNA, 64 nt, Human; identical to SEQ ID NO: 428943

SEQ ID NO: 467361 - RNA, 64 nt, Human; identical to SEQ ID NO: 428944

SEQ ID NO: 467362 - RNA, 64 nt, Human; identical to SEQ ID NO: 428945

SEQ ID NO: 467363 - RNA, 64 nt, Human; identical to SEQ ID NO: 428946

SEQ ID NO: 467364 - RNA, 64 nt, Human; identical to SEQ ID NO: 431341

SEQ ID NO: 467365 - RNA, 64 nt, Human; identical to SEQ ID NO: 431360

SEQ ID NO: 467366 - RNA, 64 nt, Human; identical to SEQ ID NO: 431361

SEQ ID NO: 467367 - RNA, 64 nt, Human; identical to SEQ ID NO: 431362

SEQ ID NO: 467368 - RNA, 64 nt, Human; identical to SEQ ID NO: 431363

SEQ ID NO: 467369 - RNA, 64 nt, Human; identical to SEQ ID NO: 431364

SEQ ID NO: 467370 - RNA, 64 nt, Human; identical to SEQ ID NO: 431365

SEQ ID NO: 467371 - RNA, 64 nt, Human; identical to SEQ ID NO: 431366

SEQ ID NO: 467372 - RNA, 64 nt, Human; identical to SEQ ID NO: 431367

SEQ ID NO: 467373 - RNA, 64 nt, Human; identical to SEQ ID NO: 431368

SEQ ID NO: 467374 - RNA, 64 nt, Human; identical to SEQ ID NO: 431369

SEQ ID NO: 467375 - RNA, 62 nt, Human; identical to SEQ ID NO: 466989

SEQ ID NO: 467376 - RNA, 62 nt, Human; identical to SEQ ID NO: 466990

SEQ ID NO: 467377 - RNA, 62 nt, Human; identical to SEQ ID NO: 466991

SEQ ID NO: 467378 - RNA, 64 nt, Human; identical to SEQ ID NO: 431370

SEQ ID NO: 467379 - RNA, 64 nt, Human; identical to SEQ ID NO: 431371

SEQ ID NO: 467380 - RNA, 64 nt, Human; identical to SEQ ID NO: 431372

SEQ ID NO: 467381 - RNA, 64 nt, Human; identical to SEQ ID NO: 431373

SEQ ID NO: 467382 - RNA, 64 nt, Human; identical to SEQ ID NO: 431377

SEQ ID NO: 467383 - RNA, 64 nt, Human; identical to SEQ ID NO: 431378

SEQ ID NO: 467384 - RNA, 64 nt, Human; identical to SEQ ID NO: 431379

SEQ ID NO: 467385 - RNA, 64 nt, Human; identical to SEQ ID NO: 431380

SEQ ID NO: 467386 - RNA, 64 nt, Human; identical to SEQ ID NO: 431381

SEQ ID NO: 467387 - RNA, 64 nt, Human; identical to SEQ ID NO: 431382

SEQ ID NO: 467388 - RNA, 64 nt, Human; identical to SEQ ID NO: 431383

SEQ ID NO: 467389 - RNA, 64 nt, Human; identical to SEQ ID NO: 431384

SEQ ID NO: 467390 - RNA, 64 nt, Human; identical to SEQ ID NO: 431385

SEQ ID NO: 467391 - RNA, 64 nt, Human; identical to SEQ ID NO: 431386

SEQ ID NO: 467392 - RNA, 64 nt, Human; identical to SEQ ID NO: 431387

SEQ ID NO: 467393 - RNA, 64 nt, Human; identical to SEQ ID NO: 431388

SEQ ID NO: 467394 - RNA, 52 nt, Human; identical to SEQ ID NO: 467012

SEQ ID NO: 467395 - RNA, 62 nt, Human; identical to SEQ ID NO: 466778

SEQ ID NO: 467396 - RNA, 62 nt, Human; identical to SEQ ID NO: 463064

SEQ ID NO: 467397 - RNA, 64 nt, Human; identical to SEQ ID NO: 431389

SEQ ID NO: 467398 - RNA, 64 nt, Human; identical to SEQ ID NO: 431390

SEQ ID NO: 467399 - RNA, 64 nt, Human; identical to SEQ ID NO: 431394

SEQ ID NO: 467400 - RNA, 64 nt, Human; identical to SEQ ID NO: 431395

SEQ ID NO: 467401 - RNA, 64 nt, Human; identical to SEQ ID NO: 431396

SEQ ID NO: 467402 - RNA, 62 nt, Human; identical to SEQ ID NO: 466895

SEQ ID NO: 467403 - RNA, 62 nt, Human; identical to SEQ ID NO: 466896

SEQ ID NO: 467404 - RNA, 62 nt, Human; identical to SEQ ID NO: 466929

SEQ ID NO: 467405 - RNA, 62 nt, Human; identical to SEQ ID NO: 466930

SEQ ID NO: 467406 - RNA, 62 nt, Human; identical to SEQ ID NO: 466931

SEQ ID NO: 467407 - RNA, 62 nt, Human; identical to SEQ ID NO: 463045

SEQ ID NO: 467408 - RNA, 62 nt, Human; identical to SEQ ID NO: 466932

SEQ ID NO: 467409 - RNA, 62 nt, Human; identical to SEQ ID NO: 467009

SEQ ID NO: 467410 - RNA, 62 nt, Human; identical to SEQ ID NO: 467010

SEQ ID NO: 467411 - RNA, 62 nt, Human; identical to SEQ ID NO: 467011

SEQ ID NO: 467412 - RNA, 62 nt, Human; identical to SEQ ID NO: 463062

SEQ ID NO: 467413 - RNA, 62 nt, Human; identical to SEQ ID NO: 466969

SEQ ID NO: 467414 - RNA, 64 nt, Human; identical to SEQ ID NO: 388109

SEQ ID NO: 467415 - RNA, 64 nt, Human; identical to SEQ ID NO: 388113

SEQ ID NO: 467416 - RNA, 64 nt, Human; identical to SEQ ID NO: 388114

SEQ ID NO: 467417 - RNA, 64 nt, Human; identical to SEQ ID NO: 388115

SEQ ID NO: 467418 - RNA, 64 nt, Human; identical to SEQ ID NO: 388116

SEQ ID NO: 467419 - RNA, 64 nt, Human; identical to SEQ ID NO: 388117

SEQ ID NO: 467420 - RNA, 64 nt, Human; identical to SEQ ID NO: 388118

SEQ ID NO: 467421 - RNA, 64 nt, Human; identical to SEQ ID NO: 388119

SEQ ID NO: 467422 - RNA, 64 nt, Human; identical to SEQ ID NO: 388120

SEQ ID NO: 467423 - RNA, 64 nt, Human; identical to SEQ ID NO: 388121

SEQ ID NO: 467424 - RNA, 64 nt, Human; identical to SEQ ID NO: 388122

SEQ ID NO: 467425 - RNA, 64 nt, Human; identical to SEQ ID NO: 388123

SEQ ID NO: 467426 - RNA, 64 nt, Human; identical to SEQ ID NO: 388124

SEQ ID NO: 467427 - RNA, 64 nt, Human; identical to SEQ ID NO: 388125

SEQ ID NO: 467428 - RNA, 62 nt, Human; identical to SEQ ID NO: 455975

SEQ ID NO: 467429 - RNA, 62 nt, Human; identical to SEQ ID NO: 455976

SEQ ID NO: 467430 - RNA, 62 nt, Human; identical to SEQ ID NO: 455977

SEQ ID NO: 467431 - RNA, 64 nt, Human; identical to SEQ ID NO: 388126

SEQ ID NO: 467432 - RNA, 57 nt, Human; identical to SEQ ID NO: 388127

SEQ ID NO: 467433 - RNA, 64 nt, Human; identical to SEQ ID NO: 388131

SEQ ID NO: 467434 - RNA, 64 nt, Human; identical to SEQ ID NO: 388132

SEQ ID NO: 467435 - RNA, 64 nt, Human; identical to SEQ ID NO: 388133

SEQ ID NO: 467436 - RNA, 64 nt, Human; identical to SEQ ID NO: 388134

SEQ ID NO: 467437 - RNA, 64 nt, Human; identical to SEQ ID NO: 388135

SEQ ID NO: 467438 - RNA, 64 nt, Human; identical to SEQ ID NO: 388136

SEQ ID NO: 467439 - RNA, 64 nt, Human; identical to SEQ ID NO: 388137

SEQ ID NO: 467440 - RNA, 64 nt, Human; identical to SEQ ID NO: 388138

SEQ ID NO: 467441 - RNA, 64 nt, Human; identical to SEQ ID NO: 388139

SEQ ID NO: 467442 - RNA, 64 nt, Human; identical to SEQ ID NO: 388140

SEQ ID NO: 467443 - RNA, 64 nt, Human; identical to SEQ ID NO: 388141

SEQ ID NO: 467444 - RNA, 64 nt, Human; identical to SEQ ID NO: 388142

SEQ ID NO: 467445 - RNA, 62 nt, Human; identical to SEQ ID NO: 455982

SEQ ID NO: 467446 - RNA, 62 nt, Human; identical to SEQ ID NO: 455983

SEQ ID NO: 467447 - RNA, 62 nt, Human; identical to SEQ ID NO: 455984

SEQ ID NO: 467448 - RNA, 64 nt, Human; identical to SEQ ID NO: 388143

SEQ ID NO: 467449 - RNA, 64 nt, Human; identical to SEQ ID NO: 388144

SEQ ID NO: 467450 - RNA, 64 nt, Human; identical to SEQ ID NO: 388145

SEQ ID NO: 467451 - RNA, 64 nt, Human; identical to SEQ ID NO: 388149

SEQ ID NO: 467452 - RNA, 64 nt, Human; identical to SEQ ID NO: 388150

SEQ ID NO: 467453 - RNA, 64 nt, Human; identical to SEQ ID NO: 388151

SEQ ID NO: 467454 - RNA, 64 nt, Human; identical to SEQ ID NO: 388152

SEQ ID NO: 467455 - RNA, 58 nt, Human; identical to SEQ ID NO: 388153

SEQ ID NO: 467456 - RNA, 64 nt, Human; identical to SEQ ID NO: 388154

SEQ ID NO: 467457 - RNA, 64 nt, Human; identical to SEQ ID NO: 388155

SEQ ID NO: 467458 - RNA, 64 nt, Human; identical to SEQ ID NO: 388156

SEQ ID NO: 467459 - RNA, 59 nt, Human; identical to SEQ ID NO: 388157

SEQ ID NO: 467460 - RNA, 64 nt, Human; identical to SEQ ID NO: 388158

SEQ ID NO: 467461 - RNA, 64 nt, Human; identical to SEQ ID NO: 388159

SEQ ID NO: 467462 - RNA, 62 nt, Human; identical to SEQ ID NO: 455959

SEQ ID NO: 467463 - RNA, 62 nt, Human; identical to SEQ ID NO: 455960

SEQ ID NO: 467464 - RNA, 62 nt, Human; identical to SEQ ID NO: 455961

SEQ ID NO: 467465 - RNA, 64 nt, Human; identical to SEQ ID NO: 388160

SEQ ID NO: 467466 - RNA, 64 nt, Human; identical to SEQ ID NO: 388161

SEQ ID NO: 467467 - RNA, 64 nt, Human; identical to SEQ ID NO: 388162

SEQ ID NO: 467468 - RNA, 64 nt, Human; identical to SEQ ID NO: 388163

SEQ ID NO: 467469 - RNA, 64 nt, Human; identical to SEQ ID NO: 388167

SEQ ID NO: 467470 - RNA, 64 nt, Human; identical to SEQ ID NO: 388168

SEQ ID NO: 467471 - RNA, 64 nt, Human; identical to SEQ ID NO: 388169

SEQ ID NO: 467472 - RNA, 64 nt, Human; identical to SEQ ID NO: 388170

SEQ ID NO: 467473 - RNA, 64 nt, Human; identical to SEQ ID NO: 388171

SEQ ID NO: 467474 - RNA, 64 nt, Human; identical to SEQ ID NO: 388172

SEQ ID NO: 467475 - RNA, 64 nt, Human; identical to SEQ ID NO: 388173

SEQ ID NO: 467476 - RNA, 64 nt, Human; identical to SEQ ID NO: 388174

SEQ ID NO: 467477 - RNA, 64 nt, Human; identical to SEQ ID NO: 388175

SEQ ID NO: 467478 - RNA, 64 nt, Human; identical to SEQ ID NO: 388176

SEQ ID NO: 467479 - RNA, 58 nt, Human; identical to SEQ ID NO: 455985

SEQ ID NO: 467480 - RNA, 62 nt, Human; identical to SEQ ID NO: 455986

SEQ ID NO: 467481 - RNA, 62 nt, Human; identical to SEQ ID NO: 455987

SEQ ID NO: 467482 - RNA, 64 nt, Human; identical to SEQ ID NO: 388177

SEQ ID NO: 467483 - RNA, 64 nt, Human; identical to SEQ ID NO: 388178

SEQ ID NO: 467484 - RNA, 64 nt, Human; identical to SEQ ID NO: 388179

SEQ ID NO: 467485 - RNA, 64 nt, Human; identical to SEQ ID NO: 388180

SEQ ID NO: 467486 - RNA, 64 nt, Human; identical to SEQ ID NO: 388181

SEQ ID NO: 467487 - RNA, 64 nt, Human; identical to SEQ ID NO: 388184

SEQ ID NO: 467488 - RNA, 64 nt, Human; identical to SEQ ID NO: 388185

SEQ ID NO: 467489 - RNA, 64 nt, Human; identical to SEQ ID NO: 388186

SEQ ID NO: 467490 - RNA, 64 nt, Human; identical to SEQ ID NO: 388187

SEQ ID NO: 467491 - RNA, 64 nt, Human; identical to SEQ ID NO: 388188

SEQ ID NO: 467492 - RNA, 64 nt, Human; identical to SEQ ID NO: 388189

SEQ ID NO: 467493 - RNA, 64 nt, Human; identical to SEQ ID NO: 388190

SEQ ID NO: 467494 - RNA, 64 nt, Human; identical to SEQ ID NO: 388191

SEQ ID NO: 467495 - RNA, 64 nt, Human; identical to SEQ ID NO: 388192

SEQ ID NO: 467496 - RNA, 62 nt, Human; identical to SEQ ID NO: 455898

SEQ ID NO: 467497 - RNA, 62 nt, Human; identical to SEQ ID NO: 455899

SEQ ID NO: 467498 - RNA, 62 nt, Human; identical to SEQ ID NO: 455900

SEQ ID NO: 467499 - RNA, 64 nt, Human; identical to SEQ ID NO: 388193

SEQ ID NO: 467500 - RNA, 64 nt, Human; identical to SEQ ID NO: 388194

SEQ ID NO: 467501 - RNA, 64 nt, Human; identical to SEQ ID NO: 388195

SEQ ID NO: 467502 - RNA, 64 nt, Human; identical to SEQ ID NO: 388196

SEQ ID NO: 467503 - RNA, 64 nt, Human; identical to SEQ ID NO: 388197

SEQ ID NO: 467504 - RNA, 64 nt, Human; identical to SEQ ID NO: 388198

SEQ ID NO: 467505 - RNA, 64 nt, Human; identical to SEQ ID NO: 388202

SEQ ID NO: 467506 - RNA, 64 nt, Human; identical to SEQ ID NO: 388203

SEQ ID NO: 467507 - RNA, 64 nt, Human; identical to SEQ ID NO: 388204

SEQ ID NO: 467508 - RNA, 64 nt, Human; identical to SEQ ID NO: 388205

SEQ ID NO: 467509 - RNA, 64 nt, Human; identical to SEQ ID NO: 388206

SEQ ID NO: 467510 - RNA, 64 nt, Human; identical to SEQ ID NO: 388207

SEQ ID NO: 467511 - RNA, 64 nt, Human; identical to SEQ ID NO: 388208

SEQ ID NO: 467512 - RNA, 64 nt, Human; identical to SEQ ID NO: 388209

SEQ ID NO: 467513 - RNA, 62 nt, Human; identical to SEQ ID NO: 455901

SEQ ID NO: 467514 - RNA, 62 nt, Human; identical to SEQ ID NO: 455902

SEQ ID NO: 467515 - RNA, 62 nt, Human; identical to SEQ ID NO: 455903

SEQ ID NO: 467516 - RNA, 64 nt, Human; identical to SEQ ID NO: 388210

SEQ ID NO: 467517 - RNA, 64 nt, Human; identical to SEQ ID NO: 388211

SEQ ID NO: 467518 - RNA, 64 nt, Human; identical to SEQ ID NO: 388212

SEQ ID NO: 467519 - RNA, 64 nt, Human; identical to SEQ ID NO: 388213

SEQ ID NO: 467520 - RNA, 64 nt, Human; identical to SEQ ID NO: 388214

SEQ ID NO: 467521 - RNA, 64 nt, Human; identical to SEQ ID NO: 388215

SEQ ID NO: 467522 - RNA, 64 nt, Human; identical to SEQ ID NO: 388216

SEQ ID NO: 467523 - RNA, 64 nt, Human; identical to SEQ ID NO: 388220

SEQ ID NO: 467524 - RNA, 64 nt, Human; identical to SEQ ID NO: 388221

SEQ ID NO: 467525 - RNA, 64 nt, Human; identical to SEQ ID NO: 388222

SEQ ID NO: 467526 - RNA, 64 nt, Human; identical to SEQ ID NO: 388223

SEQ ID NO: 467527 - RNA, 64 nt, Human; identical to SEQ ID NO: 388224

SEQ ID NO: 467528 - RNA, 64 nt, Human; identical to SEQ ID NO: 388225

SEQ ID NO: 467529 - RNA, 64 nt, Human; identical to SEQ ID NO: 388226

SEQ ID NO: 467530 - RNA, 62 nt, Human; identical to SEQ ID NO: 454901

SEQ ID NO: 467531 - RNA, 62 nt, Human; identical to SEQ ID NO: 454902

SEQ ID NO: 467532 - RNA, 62 nt, Human; identical to SEQ ID NO: 454903

SEQ ID NO: 467533 - RNA, 64 nt, Human; identical to SEQ ID NO: 388227

SEQ ID NO: 467534 - RNA, 59 nt, Human; identical to SEQ ID NO: 388228

SEQ ID NO: 467535 - RNA, 64 nt, Human; identical to SEQ ID NO: 388229

SEQ ID NO: 467536 - RNA, 64 nt, Human; identical to SEQ ID NO: 388230

SEQ ID NO: 467537 - RNA, 64 nt, Human; identical to SEQ ID NO: 388231

SEQ ID NO: 467538 - RNA, 64 nt, Human; identical to SEQ ID NO: 388232

SEQ ID NO: 467539 - RNA, 64 nt, Human; identical to SEQ ID NO: 388233

SEQ ID NO: 467540 - RNA, 64 nt, Human; identical to SEQ ID NO: 388234

SEQ ID NO: 467541 - RNA, 64 nt, Human; identical to SEQ ID NO: 388238

SEQ ID NO: 467542 - RNA, 64 nt, Human; identical to SEQ ID NO: 388239

SEQ ID NO: 467543 - RNA, 64 nt, Human; identical to SEQ ID NO: 388240

SEQ ID NO: 467544 - RNA, 64 nt, Human; identical to SEQ ID NO: 388241

SEQ ID NO: 467545 - RNA, 64 nt, Human; identical to SEQ ID NO: 388242

SEQ ID NO: 467546 - RNA, 64 nt, Human; identical to SEQ ID NO: 388243

SEQ ID NO: 467547 - RNA, 62 nt, Human; identical to SEQ ID NO: 455905

SEQ ID NO: 467548 - RNA, 62 nt, Human; identical to SEQ ID NO: 455906

SEQ ID NO: 467549 - RNA, 59 nt, Human; identical to SEQ ID NO: 455907

SEQ ID NO: 467550 - RNA, 64 nt, Human; identical to SEQ ID NO: 388244

SEQ ID NO: 467551 - RNA, 64 nt, Human; identical to SEQ ID NO: 388245

SEQ ID NO: 467552 - RNA, 64 nt, Human; identical to SEQ ID NO: 388246

SEQ ID NO: 467553 - RNA, 64 nt, Human; identical to SEQ ID NO: 388247

SEQ ID NO: 467554 - RNA, 64 nt, Human; identical to SEQ ID NO: 388248

SEQ ID NO: 467555 - RNA, 64 nt, Human; identical to SEQ ID NO: 388249

SEQ ID NO: 467556 - RNA, 64 nt, Human; identical to SEQ ID NO: 388250

SEQ ID NO: 467557 - RNA, 64 nt, Human; identical to SEQ ID NO: 388251

SEQ ID NO: 467558 - RNA, 64 nt, Human; identical to SEQ ID NO: 388252

SEQ ID NO: 467559 - RNA, 64 nt, Human; identical to SEQ ID NO: 388256

SEQ ID NO: 467560 - RNA, 64 nt, Human; identical to SEQ ID NO: 388257

SEQ ID NO: 467561 - RNA, 64 nt, Human; identical to SEQ ID NO: 388258

SEQ ID NO: 467562 - RNA, 64 nt, Human; identical to SEQ ID NO: 388259

SEQ ID NO: 467563 - RNA, 64 nt, Human; identical to SEQ ID NO: 388260

SEQ ID NO: 467564 - RNA, 62 nt, Human; identical to SEQ ID NO: 455866

SEQ ID NO: 467565 - RNA, 62 nt, Human; identical to SEQ ID NO: 455867

SEQ ID NO: 467566 - RNA, 62 nt, Human; identical to SEQ ID NO: 448886

SEQ ID NO: 467567 - RNA, 64 nt, Human; identical to SEQ ID NO: 388261

SEQ ID NO: 467568 - RNA, 64 nt, Human; identical to SEQ ID NO: 388262

SEQ ID NO: 467569 - RNA, 64 nt, Human; identical to SEQ ID NO: 388263

SEQ ID NO: 467570 - RNA, 64 nt, Human; identical to SEQ ID NO: 388264

SEQ ID NO: 467571 - RNA, 64 nt, Human; identical to SEQ ID NO: 388265

SEQ ID NO: 467572 - RNA, 64 nt, Human; identical to SEQ ID NO: 388266

SEQ ID NO: 467573 - RNA, 64 nt, Human; identical to SEQ ID NO: 388267

SEQ ID NO: 467574 - RNA, 64 nt, Human; identical to SEQ ID NO: 388268

SEQ ID NO: 467575 - RNA, 64 nt, Human; identical to SEQ ID NO: 388269

SEQ ID NO: 467576 - RNA, 64 nt, Human; identical to SEQ ID NO: 388270

SEQ ID NO: 467577 - RNA, 64 nt, Human; identical to SEQ ID NO: 388274

SEQ ID NO: 467578 - RNA, 64 nt, Human; identical to SEQ ID NO: 388275

SEQ ID NO: 467579 - RNA, 64 nt, Human; identical to SEQ ID NO: 388276

SEQ ID NO: 467580 - RNA, 64 nt, Human; identical to SEQ ID NO: 388277

SEQ ID NO: 467581 - RNA, 62 nt, Human; identical to SEQ ID NO: 454812

SEQ ID NO: 467582 - RNA, 62 nt, Human; identical to SEQ ID NO: 454813

SEQ ID NO: 467583 - RNA, 62 nt, Human; identical to SEQ ID NO: 454829

SEQ ID NO: 467584 - RNA, 64 nt, Human; identical to SEQ ID NO: 388278

SEQ ID NO: 467585 - RNA, 64 nt, Human; identical to SEQ ID NO: 388279

SEQ ID NO: 467586 - RNA, 64 nt, Human; identical to SEQ ID NO: 388280

SEQ ID NO: 467587 - RNA, 64 nt, Human; identical to SEQ ID NO: 388281

SEQ ID NO: 467588 - RNA, 64 nt, Human; identical to SEQ ID NO: 388282

SEQ ID NO: 467589 - RNA, 64 nt, Human; identical to SEQ ID NO: 388283

SEQ ID NO: 467590 - RNA, 64 nt, Human; identical to SEQ ID NO: 388284

SEQ ID NO: 467591 - RNA, 64 nt, Human; identical to SEQ ID NO: 388285

SEQ ID NO: 467592 - RNA, 64 nt, Human; identical to SEQ ID NO: 388286

SEQ ID NO: 467593 - RNA, 64 nt, Human; identical to SEQ ID NO: 388287

SEQ ID NO: 467594 - RNA, 64 nt, Human; identical to SEQ ID NO: 388288

SEQ ID NO: 467595 - RNA, 64 nt, Human; identical to SEQ ID NO: 388292

SEQ ID NO: 467596 - RNA, 64 nt, Human; identical to SEQ ID NO: 388293

SEQ ID NO: 467597 - RNA, 64 nt, Human; identical to SEQ ID NO: 388294

SEQ ID NO: 467598 - RNA, 62 nt, Human; identical to SEQ ID NO: 454830

SEQ ID NO: 467599 - RNA, 62 nt, Human; identical to SEQ ID NO: 454831

SEQ ID NO: 467600 - RNA, 62 nt, Human; identical to SEQ ID NO: 455908

SEQ ID NO: 467601 - RNA, 64 nt, Human; identical to SEQ ID NO: 388295

SEQ ID NO: 467602 - RNA, 64 nt, Human; identical to SEQ ID NO: 388296

SEQ ID NO: 467603 - RNA, 64 nt, Human; identical to SEQ ID NO: 388297

SEQ ID NO: 467604 - RNA, 64 nt, Human; identical to SEQ ID NO: 388298

SEQ ID NO: 467605 - RNA, 64 nt, Human; identical to SEQ ID NO: 388299

SEQ ID NO: 467606 - RNA, 64 nt, Human; identical to SEQ ID NO: 388300

SEQ ID NO: 467607 - RNA, 64 nt, Human; identical to SEQ ID NO: 388301

SEQ ID NO: 467608 - RNA, 64 nt, Human; identical to SEQ ID NO: 388302

SEQ ID NO: 467609 - RNA, 64 nt, Human; identical to SEQ ID NO: 388303

SEQ ID NO: 467610 - RNA, 64 nt, Human; identical to SEQ ID NO: 388304

SEQ ID NO: 467611 - RNA, 64 nt, Human; identical to SEQ ID NO: 388305

SEQ ID NO: 467612 - RNA, 64 nt, Human; identical to SEQ ID NO: 388306

SEQ ID NO: 467613 - RNA, 64 nt, Human; identical to SEQ ID NO: 388310

SEQ ID NO: 467614 - RNA, 64 nt, Human; identical to SEQ ID NO: 388311

SEQ ID NO: 467615 - RNA, 62 nt, Human; identical to SEQ ID NO: 455910

SEQ ID NO: 467616 - RNA, 62 nt, Human; identical to SEQ ID NO: 455911

SEQ ID NO: 467617 - RNA, 62 nt, Human; identical to SEQ ID NO: 455912

SEQ ID NO: 467618 - RNA, 64 nt, Human; identical to SEQ ID NO: 388312

SEQ ID NO: 467619 - RNA, 64 nt, Human; identical to SEQ ID NO: 388313

SEQ ID NO: 467620 - RNA, 64 nt, Human; identical to SEQ ID NO: 388314

SEQ ID NO: 467621 - RNA, 64 nt, Human; identical to SEQ ID NO: 388315

SEQ ID NO: 467622 - RNA, 64 nt, Human; identical to SEQ ID NO: 388316

SEQ ID NO: 467623 - RNA, 64 nt, Human; identical to SEQ ID NO: 388317

SEQ ID NO: 467624 - RNA, 64 nt, Human; identical to SEQ ID NO: 388318

SEQ ID NO: 467625 - RNA, 64 nt, Human; identical to SEQ ID NO: 388319

SEQ ID NO: 467626 - RNA, 64 nt, Human; identical to SEQ ID NO: 388320

SEQ ID NO: 467627 - RNA, 64 nt, Human; identical to SEQ ID NO: 388321

SEQ ID NO: 467628 - RNA, 64 nt, Human; identical to SEQ ID NO: 388322

SEQ ID NO: 467629 - RNA, 64 nt, Human; identical to SEQ ID NO: 388323

SEQ ID NO: 467630 - RNA, 64 nt, Human; identical to SEQ ID NO: 388324

SEQ ID NO: 467631 - RNA, 64 nt, Human; identical to SEQ ID NO: 388328

SEQ ID NO: 467632 - RNA, 62 nt, Human; identical to SEQ ID NO: 455913

SEQ ID NO: 467633 - RNA, 62 nt, Human; identical to SEQ ID NO: 455914

SEQ ID NO: 467634 - RNA, 62 nt, Human; identical to SEQ ID NO: 455915

SEQ ID NO: 467635 - RNA, 64 nt, Human; identical to SEQ ID NO: 388329

SEQ ID NO: 467636 - RNA, 64 nt, Human; identical to SEQ ID NO: 388330

SEQ ID NO: 467637 - RNA, 64 nt, Human; identical to SEQ ID NO: 388331

SEQ ID NO: 467638 - RNA, 64 nt, Human; identical to SEQ ID NO: 388332

SEQ ID NO: 467639 - RNA, 64 nt, Human; identical to SEQ ID NO: 388333

SEQ ID NO: 467640 - RNA, 64 nt, Human; identical to SEQ ID NO: 388334

SEQ ID NO: 467641 - RNA, 64 nt, Human; identical to SEQ ID NO: 388335

SEQ ID NO: 467642 - RNA, 64 nt, Human; identical to SEQ ID NO: 388336

SEQ ID NO: 467643 - RNA, 64 nt, Human; identical to SEQ ID NO: 388337

SEQ ID NO: 467644 - RNA, 64 nt, Human; identical to SEQ ID NO: 388338

SEQ ID NO: 467645 - RNA, 64 nt, Human; identical to SEQ ID NO: 388339

SEQ ID NO: 467646 - RNA, 64 nt, Human; identical to SEQ ID NO: 388340

SEQ ID NO: 467647 - RNA, 64 nt, Human; identical to SEQ ID NO: 388341

SEQ ID NO: 467648 - RNA, 64 nt, Human; identical to SEQ ID NO: 388342

SEQ ID NO: 467649 - RNA, 62 nt, Human; identical to SEQ ID NO: 455917

SEQ ID NO: 467650 - RNA, 62 nt, Human; identical to SEQ ID NO: 455918

SEQ ID NO: 467651 - RNA, 62 nt, Human; identical to SEQ ID NO: 455919

SEQ ID NO: 467652 - RNA, 64 nt, Human; identical to SEQ ID NO: 388345

SEQ ID NO: 467653 - RNA, 64 nt, Human; identical to SEQ ID NO: 388346

SEQ ID NO: 467654 - RNA, 64 nt, Human; identical to SEQ ID NO: 388347

SEQ ID NO: 467655 - RNA, 64 nt, Human; identical to SEQ ID NO: 388348

SEQ ID NO: 467656 - RNA, 64 nt, Human; identical to SEQ ID NO: 388349

SEQ ID NO: 467657 - RNA, 64 nt, Human; identical to SEQ ID NO: 388350

SEQ ID NO: 467658 - RNA, 64 nt, Human; identical to SEQ ID NO: 388351

SEQ ID NO: 467659 - RNA, 64 nt, Human; identical to SEQ ID NO: 388352

SEQ ID NO: 467660 - RNA, 64 nt, Human; identical to SEQ ID NO: 388353

SEQ ID NO: 467661 - RNA, 64 nt, Human; identical to SEQ ID NO: 388354

SEQ ID NO: 467662 - RNA, 64 nt, Human; identical to SEQ ID NO: 388355

SEQ ID NO: 467663 - RNA, 64 nt, Human; identical to SEQ ID NO: 388356

SEQ ID NO: 467664 - RNA, 64 nt, Human; identical to SEQ ID NO: 388357

SEQ ID NO: 467665 - RNA, 64 nt, Human; identical to SEQ ID NO: 388358

SEQ ID NO: 467666 - RNA, 62 nt, Human; identical to SEQ ID NO: 455920

SEQ ID NO: 467667 - RNA, 62 nt, Human; identical to SEQ ID NO: 455921

SEQ ID NO: 467668 - RNA, 62 nt, Human; identical to SEQ ID NO: 455922

SEQ ID NO: 467669 - RNA, 64 nt, Human; identical to SEQ ID NO: 388359

SEQ ID NO: 467670 - RNA, 64 nt, Human; identical to SEQ ID NO: 388363

SEQ ID NO: 467671 - RNA, 64 nt, Human; identical to SEQ ID NO: 388364

SEQ ID NO: 467672 - RNA, 64 nt, Human; identical to SEQ ID NO: 388365

SEQ ID NO: 467673 - RNA, 64 nt, Human; identical to SEQ ID NO: 388366

SEQ ID NO: 467674 - RNA, 64 nt, Human; identical to SEQ ID NO: 388367

SEQ ID NO: 467675 - RNA, 64 nt, Human; identical to SEQ ID NO: 388368

SEQ ID NO: 467676 - RNA, 64 nt, Human; identical to SEQ ID NO: 388369

SEQ ID NO: 467677 - RNA, 64 nt, Human; identical to SEQ ID NO: 388370

SEQ ID NO: 467678 - RNA, 64 nt, Human; identical to SEQ ID NO: 388371

SEQ ID NO: 467679 - RNA, 64 nt, Human; identical to SEQ ID NO: 388372

SEQ ID NO: 467680 - RNA, 64 nt, Human; identical to SEQ ID NO: 388373

SEQ ID NO: 467681 - RNA, 64 nt, Human; identical to SEQ ID NO: 388374

SEQ ID NO: 467682 - RNA, 64 nt, Human; identical to SEQ ID NO: 388375

SEQ ID NO: 467683 - RNA, 62 nt, Human; identical to SEQ ID NO: 455978

SEQ ID NO: 467684 - RNA, 62 nt, Human; identical to SEQ ID NO: 455979

SEQ ID NO: 467685 - RNA, 62 nt, Human; identical to SEQ ID NO: 455980

SEQ ID NO: 467686 - RNA, 63 nt, Human; identical to SEQ ID NO: 388376

SEQ ID NO: 467687 - RNA, 64 nt, Human; identical to SEQ ID NO: 388377

SEQ ID NO: 467688 - RNA, 64 nt, Human; identical to SEQ ID NO: 388381

SEQ ID NO: 467689 - RNA, 64 nt, Human; identical to SEQ ID NO: 388382

SEQ ID NO: 467690 - RNA, 64 nt, Human; identical to SEQ ID NO: 388383

SEQ ID NO: 467691 - RNA, 64 nt, Human; identical to SEQ ID NO: 388384

SEQ ID NO: 467692 - RNA, 64 nt, Human; identical to SEQ ID NO: 388385

SEQ ID NO: 467693 - RNA, 64 nt, Human; identical to SEQ ID NO: 388386

SEQ ID NO: 467694 - RNA, 64 nt, Human; identical to SEQ ID NO: 388387

SEQ ID NO: 467695 - RNA, 64 nt, Human; identical to SEQ ID NO: 388388

SEQ ID NO: 467696 - RNA, 64 nt, Human; identical to SEQ ID NO: 388389

SEQ ID NO: 467697 - RNA, 64 nt, Human; identical to SEQ ID NO: 388390

SEQ ID NO: 467698 - RNA, 64 nt, Human; identical to SEQ ID NO: 388391

SEQ ID NO: 467699 - RNA, 64 nt, Human; identical to SEQ ID NO: 388392

SEQ ID NO: 467700 - RNA, 62 nt, Human; identical to SEQ ID NO: 455924

SEQ ID NO: 467701 - RNA, 62 nt, Human; identical to SEQ ID NO: 455925

SEQ ID NO: 467702 - RNA, 62 nt, Human; identical to SEQ ID NO: 455926

SEQ ID NO: 467703 - RNA, 64 nt, Human; identical to SEQ ID NO: 388393

SEQ ID NO: 467704 - RNA, 64 nt, Human; identical to SEQ ID NO: 388394

SEQ ID NO: 467705 - RNA, 64 nt, Human; identical to SEQ ID NO: 388395

SEQ ID NO: 467706 - RNA, 64 nt, Human; identical to SEQ ID NO: 388399

SEQ ID NO: 467707 - RNA, 64 nt, Human; identical to SEQ ID NO: 388400

SEQ ID NO: 467708 - RNA, 64 nt, Human; identical to SEQ ID NO: 388401

SEQ ID NO: 467709 - RNA, 64 nt, Human; identical to SEQ ID NO: 388402

SEQ ID NO: 467710 - RNA, 64 nt, Human; identical to SEQ ID NO: 388403

SEQ ID NO: 467711 - RNA, 64 nt, Human; identical to SEQ ID NO: 388404

SEQ ID NO: 467712 - RNA, 64 nt, Human; identical to SEQ ID NO: 388405

SEQ ID NO: 467713 - RNA, 64 nt, Human; identical to SEQ ID NO: 388406

SEQ ID NO: 467714 - RNA, 57 nt, Human; identical to SEQ ID NO: 388407

SEQ ID NO: 467715 - RNA, 64 nt, Human; identical to SEQ ID NO: 388408

SEQ ID NO: 467716 - RNA, 64 nt, Human; identical to SEQ ID NO: 388409

SEQ ID NO: 467717 - RNA, 62 nt, Human; identical to SEQ ID NO: 455927

SEQ ID NO: 467718 - RNA, 62 nt, Human; identical to SEQ ID NO: 448887

SEQ ID NO: 467719 - RNA, 62 nt, Human; identical to SEQ ID NO: 454847

SEQ ID NO: 467720 - RNA, 64 nt, Human; identical to SEQ ID NO: 388410

SEQ ID NO: 467721 - RNA, 64 nt, Human; identical to SEQ ID NO: 388411

SEQ ID NO: 467722 - RNA, 64 nt, Human; identical to SEQ ID NO: 388412

SEQ ID NO: 467723 - RNA, 64 nt, Human; identical to SEQ ID NO: 388413

SEQ ID NO: 467724 - RNA, 64 nt, Human; identical to SEQ ID NO: 388417

SEQ ID NO: 467725 - RNA, 64 nt, Human; identical to SEQ ID NO: 388418

SEQ ID NO: 467726 - RNA, 64 nt, Human; identical to SEQ ID NO: 388419

SEQ ID NO: 467727 - RNA, 64 nt, Human; identical to SEQ ID NO: 388420

SEQ ID NO: 467728 - RNA, 64 nt, Human; identical to SEQ ID NO: 388421

SEQ ID NO: 467729 - RNA, 55 nt, Human; identical to SEQ ID NO: 388422

SEQ ID NO: 467730 - RNA, 64 nt, Human; identical to SEQ ID NO: 388423

SEQ ID NO: 467731 - RNA, 64 nt, Human; identical to SEQ ID NO: 388424

SEQ ID NO: 467732 - RNA, 64 nt, Human; identical to SEQ ID NO: 388425

SEQ ID NO: 467733 - RNA, 64 nt, Human; identical to SEQ ID NO: 388426

SEQ ID NO: 467734 - RNA, 62 nt, Human; identical to SEQ ID NO: 454849

SEQ ID NO: 467735 - RNA, 62 nt, Human; identical to SEQ ID NO: 454865

SEQ ID NO: 467736 - RNA, 62 nt, Human; identical to SEQ ID NO: 454866

SEQ ID NO: 467737 - RNA, 64 nt, Human; identical to SEQ ID NO: 388427

SEQ ID NO: 467738 - RNA, 64 nt, Human; identical to SEQ ID NO: 388428

SEQ ID NO: 467739 - RNA, 64 nt, Human; identical to SEQ ID NO: 388429

SEQ ID NO: 467740 - RNA, 64 nt, Human; identical to SEQ ID NO: 388430

SEQ ID NO: 467741 - RNA, 64 nt, Human; identical to SEQ ID NO: 388431

SEQ ID NO: 467742 - RNA, 64 nt, Human; identical to SEQ ID NO: 388435

SEQ ID NO: 467743 - RNA, 64 nt, Human; identical to SEQ ID NO: 388436

SEQ ID NO: 467744 - RNA, 64 nt, Human; identical to SEQ ID NO: 388437

SEQ ID NO: 467745 - RNA, 64 nt, Human; identical to SEQ ID NO: 388438

SEQ ID NO: 467746 - RNA, 64 nt, Human; identical to SEQ ID NO: 388439

SEQ ID NO: 467747 - RNA, 64 nt, Human; identical to SEQ ID NO: 388440

SEQ ID NO: 467748 - RNA, 64 nt, Human; identical to SEQ ID NO: 388441

SEQ ID NO: 467749 - RNA, 64 nt, Human; identical to SEQ ID NO: 388442

SEQ ID NO: 467750 - RNA, 64 nt, Human; identical to SEQ ID NO: 388443

SEQ ID NO: 467751 - RNA, 62 nt, Human; identical to SEQ ID NO: 455857

SEQ ID NO: 467752 - RNA, 62 nt, Human; identical to SEQ ID NO: 455858

SEQ ID NO: 467753 - RNA, 62 nt, Human; identical to SEQ ID NO: 455859

SEQ ID NO: 467754 - RNA, 64 nt, Human; identical to SEQ ID NO: 388444

SEQ ID NO: 467755 - RNA, 64 nt, Human; identical to SEQ ID NO: 388445

SEQ ID NO: 467756 - RNA, 64 nt, Human; identical to SEQ ID NO: 388446

SEQ ID NO: 467757 - RNA, 64 nt, Human; identical to SEQ ID NO: 388447

SEQ ID NO: 467758 - RNA, 64 nt, Human; identical to SEQ ID NO: 388448

SEQ ID NO: 467759 - RNA, 64 nt, Human; identical to SEQ ID NO: 388449

SEQ ID NO: 467760 - RNA, 64 nt, Human; identical to SEQ ID NO: 388453

SEQ ID NO: 467761 - RNA, 64 nt, Human; identical to SEQ ID NO: 388454

SEQ ID NO: 467762 - RNA, 64 nt, Human; identical to SEQ ID NO: 388455

SEQ ID NO: 467763 - RNA, 64 nt, Human; identical to SEQ ID NO: 388456

SEQ ID NO: 467764 - RNA, 64 nt, Human; identical to SEQ ID NO: 388457

SEQ ID NO: 467765 - RNA, 64 nt, Human; identical to SEQ ID NO: 388458

SEQ ID NO: 467766 - RNA, 64 nt, Human; identical to SEQ ID NO: 388459

SEQ ID NO: 467767 - RNA, 64 nt, Human; identical to SEQ ID NO: 388460

SEQ ID NO: 467768 - RNA, 62 nt, Human; identical to SEQ ID NO: 455861

SEQ ID NO: 467769 - RNA, 62 nt, Human; identical to SEQ ID NO: 455862

SEQ ID NO: 467770 - RNA, 62 nt, Human; identical to SEQ ID NO: 455863

SEQ ID NO: 467771 - RNA, 64 nt, Human; identical to SEQ ID NO: 388461

SEQ ID NO: 467772 - RNA, 64 nt, Human; identical to SEQ ID NO: 388462

SEQ ID NO: 467773 - RNA, 64 nt, Human; identical to SEQ ID NO: 388463

SEQ ID NO: 467774 - RNA, 64 nt, Human; identical to SEQ ID NO: 388464

SEQ ID NO: 467775 - RNA, 57 nt, Human; identical to SEQ ID NO: 388465

SEQ ID NO: 467776 - RNA, 64 nt, Human; identical to SEQ ID NO: 388466

SEQ ID NO: 467777 - RNA, 64 nt, Human; identical to SEQ ID NO: 388467

SEQ ID NO: 467778 - RNA, 64 nt, Human; identical to SEQ ID NO: 388471

SEQ ID NO: 467779 - RNA, 64 nt, Human; identical to SEQ ID NO: 388472

SEQ ID NO: 467780 - RNA, 64 nt, Human; identical to SEQ ID NO: 388473

SEQ ID NO: 467781 - RNA, 64 nt, Human; identical to SEQ ID NO: 388474

SEQ ID NO: 467782 - RNA, 64 nt, Human; identical to SEQ ID NO: 388475

SEQ ID NO: 467783 - RNA, 64 nt, Human; identical to SEQ ID NO: 388476

SEQ ID NO: 467784 - RNA, 64 nt, Human; identical to SEQ ID NO: 388477

SEQ ID NO: 467785 - RNA, 62 nt, Human; identical to SEQ ID NO: 455864

SEQ ID NO: 467786 - RNA, 62 nt, Human; identical to SEQ ID NO: 455868

SEQ ID NO: 467787 - RNA, 62 nt, Human; identical to SEQ ID NO: 455869

SEQ ID NO: 467788 - RNA, 64 nt, Human; identical to SEQ ID NO: 388478

SEQ ID NO: 467789 - RNA, 64 nt, Human; identical to SEQ ID NO: 388479

SEQ ID NO: 467790 - RNA, 64 nt, Human; identical to SEQ ID NO: 388480

SEQ ID NO: 467791 - RNA, 64 nt, Human; identical to SEQ ID NO: 388481

SEQ ID NO: 467792 - RNA, 64 nt, Human; identical to SEQ ID NO: 388482

SEQ ID NO: 467793 - RNA, 64 nt, Human; identical to SEQ ID NO: 388483

SEQ ID NO: 467794 - RNA, 64 nt, Human; identical to SEQ ID NO: 388484

SEQ ID NO: 467795 - RNA, 64 nt, Human; identical to SEQ ID NO: 388485

SEQ ID NO: 467796 - RNA, 64 nt, Human; identical to SEQ ID NO: 388489

SEQ ID NO: 467797 - RNA, 64 nt, Human; identical to SEQ ID NO: 388490

SEQ ID NO: 467798 - RNA, 64 nt, Human; identical to SEQ ID NO: 388491

SEQ ID NO: 467799 - RNA, 64 nt, Human; identical to SEQ ID NO: 388492

SEQ ID NO: 467800 - RNA, 64 nt, Human; identical to SEQ ID NO: 388493

SEQ ID NO: 467801 - RNA, 64 nt, Human; identical to SEQ ID NO: 388494

SEQ ID NO: 467802 - RNA, 62 nt, Human; identical to SEQ ID NO: 455871

SEQ ID NO: 467803 - RNA, 62 nt, Human; identical to SEQ ID NO: 455872

SEQ ID NO: 467804 - RNA, 62 nt, Human; identical to SEQ ID NO: 455873

SEQ ID NO: 467805 - RNA, 64 nt, Human; identical to SEQ ID NO: 388495

SEQ ID NO: 467806 - RNA, 64 nt, Human; identical to SEQ ID NO: 388496

SEQ ID NO: 467807 - RNA, 64 nt, Human; identical to SEQ ID NO: 388497

SEQ ID NO: 467808 - RNA, 64 nt, Human; identical to SEQ ID NO: 388498

SEQ ID NO: 467809 - RNA, 64 nt, Human; identical to SEQ ID NO: 388499

SEQ ID NO: 467810 - RNA, 64 nt, Human; identical to SEQ ID NO: 388500

SEQ ID NO: 467811 - RNA, 64 nt, Human; identical to SEQ ID NO: 388501

SEQ ID NO: 467812 - RNA, 64 nt, Human; identical to SEQ ID NO: 388502

SEQ ID NO: 467813 - RNA, 64 nt, Human; identical to SEQ ID NO: 388503

SEQ ID NO: 467814 - RNA, 64 nt, Human; identical to SEQ ID NO: 388505

SEQ ID NO: 467815 - RNA, 64 nt, Human; identical to SEQ ID NO: 388506

SEQ ID NO: 467816 - RNA, 64 nt, Human; identical to SEQ ID NO: 388507

SEQ ID NO: 467817 - RNA, 64 nt, Human; identical to SEQ ID NO: 388508

SEQ ID NO: 467818 - RNA, 64 nt, Human; identical to SEQ ID NO: 388509

SEQ ID NO: 467819 - RNA, 62 nt, Human; identical to SEQ ID NO: 455874

SEQ ID NO: 467820 - RNA, 62 nt, Human; identical to SEQ ID NO: 455875

SEQ ID NO: 467821 - RNA, 62 nt, Human; identical to SEQ ID NO: 455876

SEQ ID NO: 467822 - RNA, 59 nt, Human; identical to SEQ ID NO: 388510

SEQ ID NO: 467823 - RNA, 64 nt, Human; identical to SEQ ID NO: 388511

SEQ ID NO: 467824 - RNA, 64 nt, Human; identical to SEQ ID NO: 388512

SEQ ID NO: 467825 - RNA, 64 nt, Human; identical to SEQ ID NO: 388513

SEQ ID NO: 467826 - RNA, 64 nt, Human; identical to SEQ ID NO: 388514

SEQ ID NO: 467827 - RNA, 64 nt, Human; identical to SEQ ID NO: 388515

SEQ ID NO: 467828 - RNA, 64 nt, Human; identical to SEQ ID NO: 388516

SEQ ID NO: 467829 - RNA, 64 nt, Human; identical to SEQ ID NO: 388517

SEQ ID NO: 467830 - RNA, 64 nt, Human; identical to SEQ ID NO: 388518

SEQ ID NO: 467831 - RNA, 64 nt, Human; identical to SEQ ID NO: 388519

SEQ ID NO: 467832 - RNA, 64 nt, Human; identical to SEQ ID NO: 388523

SEQ ID NO: 467833 - RNA, 64 nt, Human; identical to SEQ ID NO: 388524

SEQ ID NO: 467834 - RNA, 64 nt, Human; identical to SEQ ID NO: 388525

SEQ ID NO: 467835 - RNA, 64 nt, Human; identical to SEQ ID NO: 388526

SEQ ID NO: 467836 - RNA, 62 nt, Human; identical to SEQ ID NO: 455878

SEQ ID NO: 467837 - RNA, 62 nt, Human; identical to SEQ ID NO: 455879

SEQ ID NO: 467838 - RNA, 62 nt, Human; identical to SEQ ID NO: 455880

SEQ ID NO: 467839 - RNA, 64 nt, Human; identical to SEQ ID NO: 388527

SEQ ID NO: 467840 - RNA, 64 nt, Human; identical to SEQ ID NO: 388528

SEQ ID NO: 467841 - RNA, 58 nt, Human; identical to SEQ ID NO: 388529

SEQ ID NO: 467842 - RNA, 64 nt, Human; identical to SEQ ID NO: 388530

SEQ ID NO: 467843 - RNA, 64 nt, Human; identical to SEQ ID NO: 388531

SEQ ID NO: 467844 - RNA, 64 nt, Human; identical to SEQ ID NO: 388532

SEQ ID NO: 467845 - RNA, 64 nt, Human; identical to SEQ ID NO: 388533

SEQ ID NO: 467846 - RNA, 64 nt, Human; identical to SEQ ID NO: 388534

SEQ ID NO: 467847 - RNA, 64 nt, Human; identical to SEQ ID NO: 388109

SEQ ID NO: 467848 - RNA, 62 nt, Human; identical to SEQ ID NO: 455881

SEQ ID NO: 467849 - RNA, 62 nt, Human; identical to SEQ ID NO: 455882

SEQ ID NO: 467850 - RNA, 62 nt, Human; identical to SEQ ID NO: 455883

SEQ ID NO: 467851 - RNA, 62 nt, Human; identical to SEQ ID NO: 455885

SEQ ID NO: 467852 - RNA, 64 nt, Human; identical to SEQ ID NO: 388113

SEQ ID NO: 467853 - RNA, 64 nt, Human; identical to SEQ ID NO: 388114

SEQ ID NO: 467854 - RNA, 64 nt, Human; identical to SEQ ID NO: 388115

SEQ ID NO: 467855 - RNA, 64 nt, Human; identical to SEQ ID NO: 388116

SEQ ID NO: 467856 - RNA, 64 nt, Human; identical to SEQ ID NO: 388117

SEQ ID NO: 467857 - RNA, 64 nt, Human; identical to SEQ ID NO: 388118

SEQ ID NO: 467858 - RNA, 64 nt, Human; identical to SEQ ID NO: 388119

SEQ ID NO: 467859 - RNA, 64 nt, Human; identical to SEQ ID NO: 388120

SEQ ID NO: 467860 - RNA, 64 nt, Human; identical to SEQ ID NO: 388121

SEQ ID NO: 467861 - RNA, 64 nt, Human; identical to SEQ ID NO: 388122

SEQ ID NO: 467862 - RNA, 64 nt, Human; identical to SEQ ID NO: 388123

SEQ ID NO: 467863 - RNA, 64 nt, Human; identical to SEQ ID NO: 388124

SEQ ID NO: 467864 - RNA, 64 nt, Human; identical to SEQ ID NO: 388125

SEQ ID NO: 467865 - RNA, 64 nt, Human; identical to SEQ ID NO: 388126

SEQ ID NO: 467866 - RNA, 62 nt, Human; identical to SEQ ID NO: 455928

SEQ ID NO: 467867 - RNA, 62 nt, Human; identical to SEQ ID NO: 455929

SEQ ID NO: 467868 - RNA, 62 nt, Human; identical to SEQ ID NO: 455930

SEQ ID NO: 467869 - RNA, 57 nt, Human; identical to SEQ ID NO: 388127

SEQ ID NO: 467870 - RNA, 64 nt, Human; identical to SEQ ID NO: 388131

SEQ ID NO: 467871 - RNA, 64 nt, Human; identical to SEQ ID NO: 388132

SEQ ID NO: 467872 - RNA, 64 nt, Human; identical to SEQ ID NO: 388133

SEQ ID NO: 467873 - RNA, 64 nt, Human; identical to SEQ ID NO: 388134

SEQ ID NO: 467874 - RNA, 64 nt, Human; identical to SEQ ID NO: 388135

SEQ ID NO: 467875 - RNA, 64 nt, Human; identical to SEQ ID NO: 388136

SEQ ID NO: 467876 - RNA, 64 nt, Human; identical to SEQ ID NO: 388137

SEQ ID NO: 467877 - RNA, 64 nt, Human; identical to SEQ ID NO: 388138

SEQ ID NO: 467878 - RNA, 64 nt, Human; identical to SEQ ID NO: 388139

SEQ ID NO: 467879 - RNA, 64 nt, Human; identical to SEQ ID NO: 388140

SEQ ID NO: 467880 - RNA, 64 nt, Human; identical to SEQ ID NO: 388141

SEQ ID NO: 467881 - RNA, 64 nt, Human; identical to SEQ ID NO: 388142

SEQ ID NO: 467882 - RNA, 64 nt, Human; identical to SEQ ID NO: 388143

SEQ ID NO: 467883 - RNA, 62 nt, Human; identical to SEQ ID NO: 455227

SEQ ID NO: 467884 - RNA, 62 nt, Human; identical to SEQ ID NO: 445592

SEQ ID NO: 467885 - RNA, 62 nt, Human; identical to SEQ ID NO: 455209

SEQ ID NO: 467886 - RNA, 64 nt, Human; identical to SEQ ID NO: 388144

SEQ ID NO: 467887 - RNA, 64 nt, Human; identical to SEQ ID NO: 388145

SEQ ID NO: 467888 - RNA, 64 nt, Human; identical to SEQ ID NO: 388149

SEQ ID NO: 467889 - RNA, 64 nt, Human; identical to SEQ ID NO: 388150

SEQ ID NO: 467890 - RNA, 64 nt, Human; identical to SEQ ID NO: 388151

SEQ ID NO: 467891 - RNA, 64 nt, Human; identical to SEQ ID NO: 388152

SEQ ID NO: 467892 - RNA, 58 nt, Human; identical to SEQ ID NO: 388153

SEQ ID NO: 467893 - RNA, 64 nt, Human; identical to SEQ ID NO: 388154

SEQ ID NO: 467894 - RNA, 64 nt, Human; identical to SEQ ID NO: 388155

SEQ ID NO: 467895 - RNA, 64 nt, Human; identical to SEQ ID NO: 388156

SEQ ID NO: 467896 - RNA, 59 nt, Human; identical to SEQ ID NO: 388157

SEQ ID NO: 467897 - RNA, 64 nt, Human; identical to SEQ ID NO: 388158

SEQ ID NO: 467898 - RNA, 64 nt, Human; identical to SEQ ID NO: 388159

SEQ ID NO: 467899 - RNA, 64 nt, Human; identical to SEQ ID NO: 388160

SEQ ID NO: 467900 - RNA, 62 nt, Human; identical to SEQ ID NO: 455243

SEQ ID NO: 467901 - RNA, 62 nt, Human; identical to SEQ ID NO: 455244

SEQ ID NO: 467902 - RNA, 62 nt, Human; identical to SEQ ID NO: 455245

SEQ ID NO: 467903 - RNA, 64 nt, Human; identical to SEQ ID NO: 388161

SEQ ID NO: 467904 - RNA, 64 nt, Human; identical to SEQ ID NO: 388162

SEQ ID NO: 467905 - RNA, 64 nt, Human; identical to SEQ ID NO: 388163

SEQ ID NO: 467906 - RNA, 64 nt, Human; identical to SEQ ID NO: 388167

SEQ ID NO: 467907 - RNA, 64 nt, Human; identical to SEQ ID NO: 388168

SEQ ID NO: 467908 - RNA, 64 nt, Human; identical to SEQ ID NO: 388169

SEQ ID NO: 467909 - RNA, 64 nt, Human; identical to SEQ ID NO: 388170

SEQ ID NO: 467910 - RNA, 64 nt, Human; identical to SEQ ID NO: 388171

SEQ ID NO: 467911 - RNA, 64 nt, Human; identical to SEQ ID NO: 388172

SEQ ID NO: 467912 - RNA, 64 nt, Human; identical to SEQ ID NO: 388173

SEQ ID NO: 467913 - RNA, 64 nt, Human; identical to SEQ ID NO: 388174

SEQ ID NO: 467914 - RNA, 64 nt, Human; identical to SEQ ID NO: 388175

SEQ ID NO: 467915 - RNA, 64 nt, Human; identical to SEQ ID NO: 388176

SEQ ID NO: 467916 - RNA, 64 nt, Human; identical to SEQ ID NO: 388177

SEQ ID NO: 467917 - RNA, 62 nt, Human; identical to SEQ ID NO: 455441

SEQ ID NO: 467918 - RNA, 62 nt, Human; identical to SEQ ID NO: 455442

SEQ ID NO: 467919 - RNA, 62 nt, Human; identical to SEQ ID NO: 455443

SEQ ID NO: 467920 - RNA, 64 nt, Human; identical to SEQ ID NO: 388178

SEQ ID NO: 467921 - RNA, 64 nt, Human; identical to SEQ ID NO: 388179

SEQ ID NO: 467922 - RNA, 64 nt, Human; identical to SEQ ID NO: 388180

SEQ ID NO: 467923 - RNA, 64 nt, Human; identical to SEQ ID NO: 388181

SEQ ID NO: 467924 - RNA, 64 nt, Human; identical to SEQ ID NO: 388184

SEQ ID NO: 467925 - RNA, 64 nt, Human; identical to SEQ ID NO: 388185

SEQ ID NO: 467926 - RNA, 64 nt, Human; identical to SEQ ID NO: 388186

SEQ ID NO: 467927 - RNA, 64 nt, Human; identical to SEQ ID NO: 388187

SEQ ID NO: 467928 - RNA, 64 nt, Human; identical to SEQ ID NO: 388188

SEQ ID NO: 467929 - RNA, 64 nt, Human; identical to SEQ ID NO: 388189

SEQ ID NO: 467930 - RNA, 64 nt, Human; identical to SEQ ID NO: 388190

SEQ ID NO: 467931 - RNA, 64 nt, Human; identical to SEQ ID NO: 388191

SEQ ID NO: 467932 - RNA, 64 nt, Human; identical to SEQ ID NO: 388192

SEQ ID NO: 467933 - RNA, 64 nt, Human; identical to SEQ ID NO: 388193

SEQ ID NO: 467934 - RNA, 62 nt, Human; identical to SEQ ID NO: 455865

SEQ ID NO: 467935 - RNA, 62 nt, Human; identical to SEQ ID NO: 455888

SEQ ID NO: 467936 - RNA, 62 nt, Human; identical to SEQ ID NO: 455889

SEQ ID NO: 467937 - RNA, 64 nt, Human; identical to SEQ ID NO: 388194

SEQ ID NO: 467938 - RNA, 64 nt, Human; identical to SEQ ID NO: 388195

SEQ ID NO: 467939 - RNA, 64 nt, Human; identical to SEQ ID NO: 388196

SEQ ID NO: 467940 - RNA, 64 nt, Human; identical to SEQ ID NO: 388197

SEQ ID NO: 467941 - RNA, 64 nt, Human; identical to SEQ ID NO: 388198

SEQ ID NO: 467942 - RNA, 64 nt, Human; identical to SEQ ID NO: 388202

SEQ ID NO: 467943 - RNA, 64 nt, Human; identical to SEQ ID NO: 388203

SEQ ID NO: 467944 - RNA, 64 nt, Human; identical to SEQ ID NO: 388204

SEQ ID NO: 467945 - RNA, 64 nt, Human; identical to SEQ ID NO: 388205

SEQ ID NO: 467946 - RNA, 64 nt, Human; identical to SEQ ID NO: 388206

SEQ ID NO: 467947 - RNA, 64 nt, Human; identical to SEQ ID NO: 388207

SEQ ID NO: 467948 - RNA, 64 nt, Human; identical to SEQ ID NO: 388208

SEQ ID NO: 467949 - RNA, 64 nt, Human; identical to SEQ ID NO: 388209

SEQ ID NO: 467950 - RNA, 64 nt, Human; identical to SEQ ID NO: 388210

SEQ ID NO: 467951 - RNA, 62 nt, Human; identical to SEQ ID NO: 455891

SEQ ID NO: 467952 - RNA, 62 nt, Human; identical to SEQ ID NO: 455892

SEQ ID NO: 467953 - RNA, 62 nt, Human; identical to SEQ ID NO: 455893

SEQ ID NO: 467954 - RNA, 64 nt, Human; identical to SEQ ID NO: 388211

SEQ ID NO: 467955 - RNA, 64 nt, Human; identical to SEQ ID NO: 388212

SEQ ID NO: 467956 - RNA, 64 nt, Human; identical to SEQ ID NO: 388213

SEQ ID NO: 467957 - RNA, 64 nt, Human; identical to SEQ ID NO: 388214

SEQ ID NO: 467958 - RNA, 64 nt, Human; identical to SEQ ID NO: 388215

SEQ ID NO: 467959 - RNA, 64 nt, Human; identical to SEQ ID NO: 388216

SEQ ID NO: 467960 - RNA, 64 nt, Human; identical to SEQ ID NO: 388220

SEQ ID NO: 467961 - RNA, 64 nt, Human; identical to SEQ ID NO: 388221

SEQ ID NO: 467962 - RNA, 64 nt, Human; identical to SEQ ID NO: 388222

SEQ ID NO: 467963 - RNA, 64 nt, Human; identical to SEQ ID NO: 388223

SEQ ID NO: 467964 - RNA, 64 nt, Human; identical to SEQ ID NO: 388224

SEQ ID NO: 467965 - RNA, 64 nt, Human; identical to SEQ ID NO: 388225

SEQ ID NO: 467966 - RNA, 64 nt, Human; identical to SEQ ID NO: 388226

SEQ ID NO: 467967 - RNA, 64 nt, Human; identical to SEQ ID NO: 388227

SEQ ID NO: 467968 - RNA, 62 nt, Human; identical to SEQ ID NO: 455886

SEQ ID NO: 467969 - RNA, 62 nt, Human; identical to SEQ ID NO: 455887

SEQ ID NO: 467970 - RNA, 62 nt, Human; identical to SEQ ID NO: 455225

SEQ ID NO: 467971 - RNA, 59 nt, Human; identical to SEQ ID NO: 388228

SEQ ID NO: 467972 - RNA, 64 nt, Human; identical to SEQ ID NO: 388229

SEQ ID NO: 467973 - RNA, 64 nt, Human; identical to SEQ ID NO: 388230

SEQ ID NO: 467974 - RNA, 64 nt, Human; identical to SEQ ID NO: 388231

SEQ ID NO: 467975 - RNA, 64 nt, Human; identical to SEQ ID NO: 388232

SEQ ID NO: 467976 - RNA, 64 nt, Human; identical to SEQ ID NO: 388233

SEQ ID NO: 467977 - RNA, 64 nt, Human; identical to SEQ ID NO: 388234

SEQ ID NO: 467978 - RNA, 64 nt, Human; identical to SEQ ID NO: 388238

SEQ ID NO: 467979 - RNA, 64 nt, Human; identical to SEQ ID NO: 388239

SEQ ID NO: 467980 - RNA, 64 nt, Human; identical to SEQ ID NO: 388240

SEQ ID NO: 467981 - RNA, 64 nt, Human; identical to SEQ ID NO: 388241

SEQ ID NO: 467982 - RNA, 64 nt, Human; identical to SEQ ID NO: 388242

SEQ ID NO: 467983 - RNA, 64 nt, Human; identical to SEQ ID NO: 388243

SEQ ID NO: 467984 - RNA, 64 nt, Human; identical to SEQ ID NO: 388244

SEQ ID NO: 467985 - RNA, 60 nt, Human; identical to SEQ ID NO: 455461

SEQ ID NO: 467986 - RNA, 60 nt, Human; identical to SEQ ID NO: 455477

SEQ ID NO: 467987 - RNA, 60 nt, Human; identical to SEQ ID NO: 455478

SEQ ID NO: 467988 - RNA, 64 nt, Human; identical to SEQ ID NO: 388245

SEQ ID NO: 467989 - RNA, 64 nt, Human; identical to SEQ ID NO: 388246

SEQ ID NO: 467990 - RNA, 64 nt, Human; identical to SEQ ID NO: 388247

SEQ ID NO: 467991 - RNA, 64 nt, Human; identical to SEQ ID NO: 388248

SEQ ID NO: 467992 - RNA, 64 nt, Human; identical to SEQ ID NO: 388249

SEQ ID NO: 467993 - RNA, 64 nt, Human; identical to SEQ ID NO: 388250

SEQ ID NO: 467994 - RNA, 64 nt, Human; identical to SEQ ID NO: 388251

SEQ ID NO: 467995 - RNA, 64 nt, Human; identical to SEQ ID NO: 388252

SEQ ID NO: 467996 - RNA, 64 nt, Human; identical to SEQ ID NO: 388256

SEQ ID NO: 467997 - RNA, 64 nt, Human; identical to SEQ ID NO: 388257

SEQ ID NO: 467998 - RNA, 64 nt, Human; identical to SEQ ID NO: 388258

SEQ ID NO: 467999 - RNA, 64 nt, Human; identical to SEQ ID NO: 388259

SEQ ID NO: 468000 - RNA, 64 nt, Human; identical to SEQ ID NO: 388260

SEQ ID NO: 468001 - RNA, 64 nt, Human; identical to SEQ ID NO: 388261

SEQ ID NO: 468002 - RNA, 60 nt, Human; identical to SEQ ID NO: 455479

SEQ ID NO: 468003 - RNA, 60 nt, Human; identical to SEQ ID NO: 445396

SEQ ID NO: 468004 - RNA, 60 nt, Human; identical to SEQ ID NO: 455560

SEQ ID NO: 468005 - RNA, 64 nt, Human; identical to SEQ ID NO: 388262

SEQ ID NO: 468006 - RNA, 64 nt, Human; identical to SEQ ID NO: 388263

SEQ ID NO: 468007 - RNA, 64 nt, Human; identical to SEQ ID NO: 388264

SEQ ID NO: 468008 - RNA, 64 nt, Human; identical to SEQ ID NO: 388265

SEQ ID NO: 468009 - RNA, 64 nt, Human; identical to SEQ ID NO: 388266

SEQ ID NO: 468010 - RNA, 64 nt, Human; identical to SEQ ID NO: 388267

SEQ ID NO: 468011 - RNA, 64 nt, Human; identical to SEQ ID NO: 388268

SEQ ID NO: 468012 - RNA, 64 nt, Human; identical to SEQ ID NO: 388269

SEQ ID NO: 468013 - RNA, 64 nt, Human; identical to SEQ ID NO: 388270

SEQ ID NO: 468014 - RNA, 64 nt, Human; identical to SEQ ID NO: 388274

SEQ ID NO: 468015 - RNA, 64 nt, Human; identical to SEQ ID NO: 388275

SEQ ID NO: 468016 - RNA, 64 nt, Human; identical to SEQ ID NO: 388276

SEQ ID NO: 468017 - RNA, 64 nt, Human; identical to SEQ ID NO: 388277

SEQ ID NO: 468018 - RNA, 64 nt, Human; identical to SEQ ID NO: 388278

SEQ ID NO: 468019 - RNA, 60 nt, Human; identical to SEQ ID NO: 455562

SEQ ID NO: 468020 - RNA, 60 nt, Human; identical to SEQ ID NO: 455681

SEQ ID NO: 468021 - RNA, 60 nt, Human; identical to SEQ ID NO: 455682

SEQ ID NO: 468022 - RNA, 64 nt, Human; identical to SEQ ID NO: 388279

SEQ ID NO: 468023 - RNA, 64 nt, Human; identical to SEQ ID NO: 388280

SEQ ID NO: 468024 - RNA, 64 nt, Human; identical to SEQ ID NO: 388281

SEQ ID NO: 468025 - RNA, 64 nt, Human; identical to SEQ ID NO: 388282

SEQ ID NO: 468026 - RNA, 64 nt, Human; identical to SEQ ID NO: 388283

SEQ ID NO: 468027 - RNA, 64 nt, Human; identical to SEQ ID NO: 388284

SEQ ID NO: 468028 - RNA, 64 nt, Human; identical to SEQ ID NO: 388285

SEQ ID NO: 468029 - RNA, 64 nt, Human; identical to SEQ ID NO: 388286

SEQ ID NO: 468030 - RNA, 64 nt, Human; identical to SEQ ID NO: 388287

SEQ ID NO: 468031 - RNA, 64 nt, Human; identical to SEQ ID NO: 388288

SEQ ID NO: 468032 - RNA, 64 nt, Human; identical to SEQ ID NO: 388292

SEQ ID NO: 468033 - RNA, 64 nt, Human; identical to SEQ ID NO: 388293

SEQ ID NO: 468034 - RNA, 64 nt, Human; identical to SEQ ID NO: 388294

SEQ ID NO: 468035 - RNA, 64 nt, Human; identical to SEQ ID NO: 388295

SEQ ID NO: 468036 - RNA, 60 nt, Human; identical to SEQ ID NO: 455683

SEQ ID NO: 468037 - RNA, 60 nt, Human; identical to SEQ ID NO: 445413

SEQ ID NO: 468038 - RNA, 60 nt, Human; identical to SEQ ID NO: 455045

SEQ ID NO: 468039 - RNA, 64 nt, Human; identical to SEQ ID NO: 388296

SEQ ID NO: 468040 - RNA, 64 nt, Human; identical to SEQ ID NO: 388297

SEQ ID NO: 468041 - RNA, 64 nt, Human; identical to SEQ ID NO: 388298

SEQ ID NO: 468042 - RNA, 64 nt, Human; identical to SEQ ID NO: 388299

SEQ ID NO: 468043 - RNA, 64 nt, Human; identical to SEQ ID NO: 388300

SEQ ID NO: 468044 - RNA, 64 nt, Human; identical to SEQ ID NO: 388301

SEQ ID NO: 468045 - RNA, 64 nt, Human; identical to SEQ ID NO: 388302

SEQ ID NO: 468046 - RNA, 64 nt, Human; identical to SEQ ID NO: 388303

SEQ ID NO: 468047 - RNA, 64 nt, Human; identical to SEQ ID NO: 388304

SEQ ID NO: 468048 - RNA, 64 nt, Human; identical to SEQ ID NO: 388305

SEQ ID NO: 468049 - RNA, 64 nt, Human; identical to SEQ ID NO: 388306

SEQ ID NO: 468050 - RNA, 64 nt, Human; identical to SEQ ID NO: 388310

SEQ ID NO: 468051 - RNA, 64 nt, Human; identical to SEQ ID NO: 388311

SEQ ID NO: 468052 - RNA, 64 nt, Human; identical to SEQ ID NO: 388312

SEQ ID NO: 468053 - RNA, 60 nt, Human; identical to SEQ ID NO: 455047

SEQ ID NO: 468054 - RNA, 60 nt, Human; identical to SEQ ID NO: 455063

SEQ ID NO: 468055 - RNA, 60 nt, Human; identical to SEQ ID NO: 455064

SEQ ID NO: 468056 - RNA, 64 nt, Human; identical to SEQ ID NO: 388313

SEQ ID NO: 468057 - RNA, 64 nt, Human; identical to SEQ ID NO: 388314

SEQ ID NO: 468058 - RNA, 64 nt, Human; identical to SEQ ID NO: 388315

SEQ ID NO: 468059 - RNA, 64 nt, Human; identical to SEQ ID NO: 388316

SEQ ID NO: 468060 - RNA, 64 nt, Human; identical to SEQ ID NO: 388317

SEQ ID NO: 468061 - RNA, 64 nt, Human; identical to SEQ ID NO: 388318

SEQ ID NO: 468062 - RNA, 64 nt, Human; identical to SEQ ID NO: 388319

SEQ ID NO: 468063 - RNA, 64 nt, Human; identical to SEQ ID NO: 388320

SEQ ID NO: 468064 - RNA, 64 nt, Human; identical to SEQ ID NO: 388321

SEQ ID NO: 468065 - RNA, 64 nt, Human; identical to SEQ ID NO: 388322

SEQ ID NO: 468066 - RNA, 64 nt, Human; identical to SEQ ID NO: 388323

SEQ ID NO: 468067 - RNA, 64 nt, Human; identical to SEQ ID NO: 388324

SEQ ID NO: 468068 - RNA, 64 nt, Human; identical to SEQ ID NO: 388328

SEQ ID NO: 468069 - RNA, 64 nt, Human; identical to SEQ ID NO: 388329

SEQ ID NO: 468070 - RNA, 60 nt, Human; identical to SEQ ID NO: 455065

SEQ ID NO: 468071 - RNA, 60 nt, Human; identical to SEQ ID NO: 445414

SEQ ID NO: 468072 - RNA, 60 nt, Human; identical to SEQ ID NO: 455081

SEQ ID NO: 468073 - RNA, 64 nt, Human; identical to SEQ ID NO: 388330

SEQ ID NO: 468074 - RNA, 64 nt, Human; identical to SEQ ID NO: 388331

SEQ ID NO: 468075 - RNA, 64 nt, Human; identical to SEQ ID NO: 388332

SEQ ID NO: 468076 - RNA, 64 nt, Human; identical to SEQ ID NO: 388333

SEQ ID NO: 468077 - RNA, 64 nt, Human; identical to SEQ ID NO: 388334

SEQ ID NO: 468078 - RNA, 64 nt, Human; identical to SEQ ID NO: 388335

SEQ ID NO: 468079 - RNA, 64 nt, Human; identical to SEQ ID NO: 388336

SEQ ID NO: 468080 - RNA, 64 nt, Human; identical to SEQ ID NO: 388337

SEQ ID NO: 468081 - RNA, 64 nt, Human; identical to SEQ ID NO: 388338

SEQ ID NO: 468082 - RNA, 64 nt, Human; identical to SEQ ID NO: 388339

SEQ ID NO: 468083 - RNA, 64 nt, Human; identical to SEQ ID NO: 388340

SEQ ID NO: 468084 - RNA, 64 nt, Human; identical to SEQ ID NO: 388341

SEQ ID NO: 468085 - RNA, 64 nt, Human; identical to SEQ ID NO: 388342

SEQ ID NO: 468086 - RNA, 64 nt, Human; identical to SEQ ID NO: 388345

SEQ ID NO: 468087 - RNA, 60 nt, Human; identical to SEQ ID NO: 455083

SEQ ID NO: 468088 - RNA, 60 nt, Human; identical to SEQ ID NO: 455099

SEQ ID NO: 468089 - RNA, 60 nt, Human; identical to SEQ ID NO: 455100

SEQ ID NO: 468090 - RNA, 64 nt, Human; identical to SEQ ID NO: 388346

SEQ ID NO: 468091 - RNA, 64 nt, Human; identical to SEQ ID NO: 388347

SEQ ID NO: 468092 - RNA, 64 nt, Human; identical to SEQ ID NO: 388348

SEQ ID NO: 468093 - RNA, 64 nt, Human; identical to SEQ ID NO: 388349

SEQ ID NO: 468094 - RNA, 64 nt, Human; identical to SEQ ID NO: 388350

SEQ ID NO: 468095 - RNA, 64 nt, Human; identical to SEQ ID NO: 388351

SEQ ID NO: 468096 - RNA, 64 nt, Human; identical to SEQ ID NO: 388352

SEQ ID NO: 468097 - RNA, 64 nt, Human; identical to SEQ ID NO: 388353

SEQ ID NO: 468098 - RNA, 64 nt, Human; identical to SEQ ID NO: 388354

SEQ ID NO: 468099 - RNA, 64 nt, Human; identical to SEQ ID NO: 388355

SEQ ID NO: 468100 - RNA, 64 nt, Human; identical to SEQ ID NO: 388356

SEQ ID NO: 468101 - RNA, 64 nt, Human; identical to SEQ ID NO: 388357

SEQ ID NO: 468102 - RNA, 64 nt, Human; identical to SEQ ID NO: 388358

SEQ ID NO: 468103 - RNA, 64 nt, Human; identical to SEQ ID NO: 388359

SEQ ID NO: 468104 - RNA, 60 nt, Human; identical to SEQ ID NO: 455101

SEQ ID NO: 468105 - RNA, 60 nt, Human; identical to SEQ ID NO: 445415

SEQ ID NO: 468106 - RNA, 60 nt, Human; identical to SEQ ID NO: 455117

SEQ ID NO: 468107 - RNA, 64 nt, Human; identical to SEQ ID NO: 388363

SEQ ID NO: 468108 - RNA, 64 nt, Human; identical to SEQ ID NO: 388364

SEQ ID NO: 468109 - RNA, 64 nt, Human; identical to SEQ ID NO: 388365

SEQ ID NO: 468110 - RNA, 64 nt, Human; identical to SEQ ID NO: 388366

SEQ ID NO: 468111 - RNA, 64 nt, Human; identical to SEQ ID NO: 388367

SEQ ID NO: 468112 - RNA, 64 nt, Human; identical to SEQ ID NO: 388368

SEQ ID NO: 468113 - RNA, 64 nt, Human; identical to SEQ ID NO: 388369

SEQ ID NO: 468114 - RNA, 64 nt, Human; identical to SEQ ID NO: 388370

SEQ ID NO: 468115 - RNA, 64 nt, Human; identical to SEQ ID NO: 388371

SEQ ID NO: 468116 - RNA, 64 nt, Human; identical to SEQ ID NO: 388372

SEQ ID NO: 468117 - RNA, 64 nt, Human; identical to SEQ ID NO: 388373

SEQ ID NO: 468118 - RNA, 64 nt, Human; identical to SEQ ID NO: 388374

SEQ ID NO: 468119 - RNA, 64 nt, Human; identical to SEQ ID NO: 388375

SEQ ID NO: 468120 - RNA, 63 nt, Human; identical to SEQ ID NO: 388376

SEQ ID NO: 468121 - RNA, 62 nt, Human; identical to SEQ ID NO: 455894

SEQ ID NO: 468122 - RNA, 62 nt, Human; identical to SEQ ID NO: 455895

SEQ ID NO: 468123 - RNA, 62 nt, Human; identical to SEQ ID NO: 455896

SEQ ID NO: 468124 - RNA, 64 nt, Human; identical to SEQ ID NO: 388377

SEQ ID NO: 468125 - RNA, 64 nt, Human; identical to SEQ ID NO: 388381

SEQ ID NO: 468126 - RNA, 64 nt, Human; identical to SEQ ID NO: 388382

SEQ ID NO: 468127 - RNA, 64 nt, Human; identical to SEQ ID NO: 388383

SEQ ID NO: 468128 - RNA, 64 nt, Human; identical to SEQ ID NO: 388384

SEQ ID NO: 468129 - RNA, 64 nt, Human; identical to SEQ ID NO: 388385

SEQ ID NO: 468130 - RNA, 64 nt, Human; identical to SEQ ID NO: 388386

SEQ ID NO: 468131 - RNA, 64 nt, Human; identical to SEQ ID NO: 388387

SEQ ID NO: 468132 - RNA, 64 nt, Human; identical to SEQ ID NO: 388388

SEQ ID NO: 468133 - RNA, 64 nt, Human; identical to SEQ ID NO: 388389

SEQ ID NO: 468134 - RNA, 64 nt, Human; identical to SEQ ID NO: 388390

SEQ ID NO: 468135 - RNA, 64 nt, Human; identical to SEQ ID NO: 388391

SEQ ID NO: 468136 - RNA, 64 nt, Human; identical to SEQ ID NO: 388392

SEQ ID NO: 468137 - RNA, 64 nt, Human; identical to SEQ ID NO: 388393

SEQ ID NO: 468138 - RNA, 60 nt, Human; identical to SEQ ID NO: 455119

SEQ ID NO: 468139 - RNA, 60 nt, Human; identical to SEQ ID NO: 455135

SEQ ID NO: 468140 - RNA, 60 nt, Human; identical to SEQ ID NO: 455136

SEQ ID NO: 468141 - RNA, 64 nt, Human; identical to SEQ ID NO: 388394

SEQ ID NO: 468142 - RNA, 64 nt, Human; identical to SEQ ID NO: 388395

SEQ ID NO: 468143 - RNA, 64 nt, Human; identical to SEQ ID NO: 388399

SEQ ID NO: 468144 - RNA, 64 nt, Human; identical to SEQ ID NO: 388400

SEQ ID NO: 468145 - RNA, 64 nt, Human; identical to SEQ ID NO: 388401

SEQ ID NO: 468146 - RNA, 64 nt, Human; identical to SEQ ID NO: 388402

SEQ ID NO: 468147 - RNA, 64 nt, Human; identical to SEQ ID NO: 388403

SEQ ID NO: 468148 - RNA, 64 nt, Human; identical to SEQ ID NO: 388404

SEQ ID NO: 468149 - RNA, 64 nt, Human; identical to SEQ ID NO: 388405

SEQ ID NO: 468150 - RNA, 64 nt, Human; identical to SEQ ID NO: 388406

SEQ ID NO: 468151 - RNA, 57 nt, Human; identical to SEQ ID NO: 388407

SEQ ID NO: 468152 - RNA, 64 nt, Human; identical to SEQ ID NO: 388408

SEQ ID NO: 468153 - RNA, 64 nt, Human; identical to SEQ ID NO: 388409

SEQ ID NO: 468154 - RNA, 64 nt, Human; identical to SEQ ID NO: 388410

SEQ ID NO: 468155 - RNA, 60 nt, Human; identical to SEQ ID NO: 455845

SEQ ID NO: 468156 - RNA, 60 nt, Human; identical to SEQ ID NO: 455137

SEQ ID NO: 468157 - RNA, 60 nt, Human; identical to SEQ ID NO: 445590

SEQ ID NO: 468158 - RNA, 64 nt, Human; identical to SEQ ID NO: 388411

SEQ ID NO: 468159 - RNA, 64 nt, Human; identical to SEQ ID NO: 388412

SEQ ID NO: 468160 - RNA, 64 nt, Human; identical to SEQ ID NO: 388413

SEQ ID NO: 468161 - RNA, 64 nt, Human; identical to SEQ ID NO: 388417

SEQ ID NO: 468162 - RNA, 64 nt, Human; identical to SEQ ID NO: 388418

SEQ ID NO: 468163 - RNA, 64 nt, Human; identical to SEQ ID NO: 388419

SEQ ID NO: 468164 - RNA, 64 nt, Human; identical to SEQ ID NO: 388420

SEQ ID NO: 468165 - RNA, 64 nt, Human; identical to SEQ ID NO: 388421

SEQ ID NO: 468166 - RNA, 55 nt, Human; identical to SEQ ID NO: 388422

SEQ ID NO: 468167 - RNA, 64 nt, Human; identical to SEQ ID NO: 388423

SEQ ID NO: 468168 - RNA, 64 nt, Human; identical to SEQ ID NO: 388424

SEQ ID NO: 468169 - RNA, 64 nt, Human; identical to SEQ ID NO: 388425

SEQ ID NO: 468170 - RNA, 64 nt, Human; identical to SEQ ID NO: 388426

SEQ ID NO: 468171 - RNA, 64 nt, Human; identical to SEQ ID NO: 388427

SEQ ID NO: 468172 - RNA, 60 nt, Human; identical to SEQ ID NO: 455172

SEQ ID NO: 468173 - RNA, 60 nt, Human; identical to SEQ ID NO: 455173

SEQ ID NO: 468174 - RNA, 60 nt, Human; identical to SEQ ID NO: 455189

SEQ ID NO: 468175 - RNA, 64 nt, Human; identical to SEQ ID NO: 388428

SEQ ID NO: 468176 - RNA, 64 nt, Human; identical to SEQ ID NO: 388429

SEQ ID NO: 468177 - RNA, 64 nt, Human; identical to SEQ ID NO: 388430

SEQ ID NO: 468178 - RNA, 64 nt, Human; identical to SEQ ID NO: 388431

SEQ ID NO: 468179 - RNA, 64 nt, Human; identical to SEQ ID NO: 388435

SEQ ID NO: 468180 - RNA, 64 nt, Human; identical to SEQ ID NO: 388436

SEQ ID NO: 468181 - RNA, 64 nt, Human; identical to SEQ ID NO: 388437

SEQ ID NO: 468182 - RNA, 64 nt, Human; identical to SEQ ID NO: 388438

SEQ ID NO: 468183 - RNA, 64 nt, Human; identical to SEQ ID NO: 388439

SEQ ID NO: 468184 - RNA, 64 nt, Human; identical to SEQ ID NO: 388440

SEQ ID NO: 468185 - RNA, 64 nt, Human; identical to SEQ ID NO: 388441

SEQ ID NO: 468186 - RNA, 64 nt, Human; identical to SEQ ID NO: 388442

SEQ ID NO: 468187 - RNA, 64 nt, Human; identical to SEQ ID NO: 388443

SEQ ID NO: 468188 - RNA, 64 nt, Human; identical to SEQ ID NO: 388444

SEQ ID NO: 468189 - RNA, 64 nt, Human; identical to SEQ ID NO: 388445

SEQ ID NO: 468190 - RNA, 64 nt, Human; identical to SEQ ID NO: 388446

SEQ ID NO: 468191 - RNA, 64 nt, Human; identical to SEQ ID NO: 388447

SEQ ID NO: 468192 - RNA, 64 nt, Human; identical to SEQ ID NO: 388448

SEQ ID NO: 468193 - RNA, 64 nt, Human; identical to SEQ ID NO: 388449

SEQ ID NO: 468194 - RNA, 64 nt, Human; identical to SEQ ID NO: 388453

SEQ ID NO: 468195 - RNA, 64 nt, Human; identical to SEQ ID NO: 388454

SEQ ID NO: 468196 - RNA, 64 nt, Human; identical to SEQ ID NO: 388455

SEQ ID NO: 468197 - RNA, 64 nt, Human; identical to SEQ ID NO: 388456

SEQ ID NO: 468198 - RNA, 64 nt, Human; identical to SEQ ID NO: 388457

SEQ ID NO: 468199 - RNA, 64 nt, Human; identical to SEQ ID NO: 388458

SEQ ID NO: 468200 - RNA, 64 nt, Human; identical to SEQ ID NO: 388459

SEQ ID NO: 468201 - RNA, 64 nt, Human; identical to SEQ ID NO: 388460

SEQ ID NO: 468202 - RNA, 64 nt, Human; identical to SEQ ID NO: 388461

SEQ ID NO: 468203 - RNA, 60 nt, Human; identical to SEQ ID NO: 445224

SEQ ID NO: 468204 - RNA, 60 nt, Human; identical to SEQ ID NO: 455495

SEQ ID NO: 468205 - RNA, 64 nt, Human; identical to SEQ ID NO: 388462

SEQ ID NO: 468206 - RNA, 64 nt, Human; identical to SEQ ID NO: 388463

SEQ ID NO: 468207 - RNA, 64 nt, Human; identical to SEQ ID NO: 388464

SEQ ID NO: 468208 - RNA, 57 nt, Human; identical to SEQ ID NO: 388465

SEQ ID NO: 468209 - RNA, 64 nt, Human; identical to SEQ ID NO: 388466

SEQ ID NO: 468210 - RNA, 64 nt, Human; identical to SEQ ID NO: 388467

SEQ ID NO: 468211 - RNA, 64 nt, Human; identical to SEQ ID NO: 388471

SEQ ID NO: 468212 - RNA, 64 nt, Human; identical to SEQ ID NO: 388472

SEQ ID NO: 468213 - RNA, 64 nt, Human; identical to SEQ ID NO: 388473

SEQ ID NO: 468214 - RNA, 64 nt, Human; identical to SEQ ID NO: 388474

SEQ ID NO: 468215 - RNA, 64 nt, Human; identical to SEQ ID NO: 388475

SEQ ID NO: 468216 - RNA, 64 nt, Human; identical to SEQ ID NO: 388476

SEQ ID NO: 468217 - RNA, 64 nt, Human; identical to SEQ ID NO: 388477

SEQ ID NO: 468218 - RNA, 64 nt, Human; identical to SEQ ID NO: 388478

SEQ ID NO: 468219 - RNA, 60 nt, Human; identical to SEQ ID NO: 455190

SEQ ID NO: 468220 - RNA, 60 nt, Human; identical to SEQ ID NO: 455191

SEQ ID NO: 468221 - RNA, 60 nt, Human; identical to SEQ ID NO: 445591

SEQ ID NO: 468222 - RNA, 64 nt, Human; identical to SEQ ID NO: 388479

SEQ ID NO: 468223 - RNA, 64 nt, Human; identical to SEQ ID NO: 388480

SEQ ID NO: 468224 - RNA, 64 nt, Human; identical to SEQ ID NO: 388481

SEQ ID NO: 468225 - RNA, 64 nt, Human; identical to SEQ ID NO: 388482

SEQ ID NO: 468226 - RNA, 64 nt, Human; identical to SEQ ID NO: 388483

SEQ ID NO: 468227 - RNA, 64 nt, Human; identical to SEQ ID NO: 388484

SEQ ID NO: 468228 - RNA, 64 nt, Human; identical to SEQ ID NO: 388485

SEQ ID NO: 468229 - RNA, 64 nt, Human; identical to SEQ ID NO: 388489

SEQ ID NO: 468230 - RNA, 64 nt, Human; identical to SEQ ID NO: 388490

SEQ ID NO: 468231 - RNA, 64 nt, Human; identical to SEQ ID NO: 388491

SEQ ID NO: 468232 - RNA, 64 nt, Human; identical to SEQ ID NO: 388492

SEQ ID NO: 468233 - RNA, 64 nt, Human; identical to SEQ ID NO: 388493

SEQ ID NO: 468234 - RNA, 64 nt, Human; identical to SEQ ID NO: 388494

SEQ ID NO: 468235 - RNA, 64 nt, Human; identical to SEQ ID NO: 388495

SEQ ID NO: 468236 - RNA, 60 nt, Human; identical to SEQ ID NO: 455208

SEQ ID NO: 468237 - RNA, 60 nt, Human; identical to SEQ ID NO: 455849

SEQ ID NO: 468238 - RNA, 60 nt, Human; identical to SEQ ID NO: 455850

SEQ ID NO: 468239 - RNA, 64 nt, Human; identical to SEQ ID NO: 388496

SEQ ID NO: 468240 - RNA, 64 nt, Human; identical to SEQ ID NO: 388497

SEQ ID NO: 468241 - RNA, 64 nt, Human; identical to SEQ ID NO: 388498

SEQ ID NO: 468242 - RNA, 64 nt, Human; identical to SEQ ID NO: 388499

SEQ ID NO: 468243 - RNA, 64 nt, Human; identical to SEQ ID NO: 388500

SEQ ID NO: 468244 - RNA, 64 nt, Human; identical to SEQ ID NO: 388501

SEQ ID NO: 468245 - RNA, 64 nt, Human; identical to SEQ ID NO: 388502

SEQ ID NO: 468246 - RNA, 64 nt, Human; identical to SEQ ID NO: 388503

SEQ ID NO: 468247 - RNA, 64 nt, Human; identical to SEQ ID NO: 388505

SEQ ID NO: 468248 - RNA, 64 nt, Human; identical to SEQ ID NO: 388506

SEQ ID NO: 468249 - RNA, 64 nt, Human; identical to SEQ ID NO: 388507

SEQ ID NO: 468250 - RNA, 64 nt, Human; identical to SEQ ID NO: 388508

SEQ ID NO: 468251 - RNA, 64 nt, Human; identical to SEQ ID NO: 388509

SEQ ID NO: 468252 - RNA, 59 nt, Human; identical to SEQ ID NO: 388510

SEQ ID NO: 468253 - RNA, 60 nt, Human; identical to SEQ ID NO: 455263

SEQ ID NO: 468254 - RNA, 60 nt, Human; identical to SEQ ID NO: 455297

SEQ ID NO: 468255 - RNA, 60 nt, Human; identical to SEQ ID NO: 455298

SEQ ID NO: 468256 - RNA, 64 nt, Human; identical to SEQ ID NO: 388511

SEQ ID NO: 468257 - RNA, 64 nt, Human; identical to SEQ ID NO: 388512

SEQ ID NO: 468258 - RNA, 64 nt, Human; identical to SEQ ID NO: 388513

SEQ ID NO: 468259 - RNA, 64 nt, Human; identical to SEQ ID NO: 388514

SEQ ID NO: 468260 - RNA, 64 nt, Human; identical to SEQ ID NO: 388515

SEQ ID NO: 468261 - RNA, 64 nt, Human; identical to SEQ ID NO: 388516

SEQ ID NO: 468262 - RNA, 64 nt, Human; identical to SEQ ID NO: 388517

SEQ ID NO: 468263 - RNA, 64 nt, Human; identical to SEQ ID NO: 388518

SEQ ID NO: 468264 - RNA, 64 nt, Human; identical to SEQ ID NO: 388519

SEQ ID NO: 468265 - RNA, 64 nt, Human; identical to SEQ ID NO: 388523

SEQ ID NO: 468266 - RNA, 64 nt, Human; identical to SEQ ID NO: 388524

SEQ ID NO: 468267 - RNA, 64 nt, Human; identical to SEQ ID NO: 388525

SEQ ID NO: 468268 - RNA, 64 nt, Human; identical to SEQ ID NO: 388526

SEQ ID NO: 468269 - RNA, 64 nt, Human; identical to SEQ ID NO: 388527

SEQ ID NO: 468270 - RNA, 60 nt, Human; identical to SEQ ID NO: 455299

SEQ ID NO: 468271 - RNA, 60 nt, Human; identical to SEQ ID NO: 445375

SEQ ID NO: 468272 - RNA, 60 nt, Human; identical to SEQ ID NO: 455333

SEQ ID NO: 468273 - RNA, 64 nt, Human; identical to SEQ ID NO: 388528

SEQ ID NO: 468274 - RNA, 58 nt, Human; identical to SEQ ID NO: 388529

SEQ ID NO: 468275 - RNA, 64 nt, Human; identical to SEQ ID NO: 388530

SEQ ID NO: 468276 - RNA, 64 nt, Human; identical to SEQ ID NO: 388531

SEQ ID NO: 468277 - RNA, 64 nt, Human; identical to SEQ ID NO: 388532

SEQ ID NO: 468278 - RNA, 64 nt, Human; identical to SEQ ID NO: 388533

SEQ ID NO: 468279 - RNA, 64 nt, Human; identical to SEQ ID NO: 388534

SEQ ID NO: 468280 - RNA, 64 nt, Human
uuagaauggaacugccggcccuggcaacugucacgugugcuagaagguucgaugccucuggaau

SEQ ID NO: 468281 - RNA, 64 nt, Human
guagacaugguucugguuuaacuaauauuugucugugugcuacuaacagauuauaauaaauugu

SEQ ID NO: 468282 - RNA, 64 nt, Human
gaagaucacuugaggccaggaguucaaggcuauagugugcuaugaucaugccugugaauagcca

SEQ ID NO: 468283 - RNA, 60 nt, Human; identical to SEQ ID NO: 455335

SEQ ID NO: 468284 - RNA, 60 nt, Human; identical to SEQ ID NO: 455351

SEQ ID NO: 468285 - RNA, 60 nt, Human; identical to SEQ ID NO: 455352

SEQ ID NO: 468286 - RNA, 64 nt, Human
uguacuuguaagcauuuuaagaaacauuuuuaaagugugcuacaaauucauuugguguacuaac

SEQ ID NO: 468287 - RNA, 64 nt, Human
uucuagggaugucugcuauuaaguuucaucuauugugugcuauacauguaaaaacugucucuuu

SEQ ID NO: 468288 - RNA, 64 nt, Human
auuauacuugggggguugggggauggugggaugugugugcuacuggcauccaguaaauagaagc

SEQ ID NO: 468289 - RNA, 64 nt, Human
auguaggaaacagccagaagccaacuggaauuuugugugcuaacuguucccagacagcagagca

SEQ ID NO: 468290 - RNA, 64 nt, Human
uuuauuuccagugagggcugcaggcuuccuagaggugugcuauaccaugcgucugucguugugc

SEQ ID NO: 468291 - RNA, 64 nt, Human
agguuuaugaaugguguuuguguagcaacacauugugugcuauguuuauuaaaaugcagcgaca

SEQ ID NO: 468292 - RNA, 64 nt, Human
uuguacuauugguguguuggugaauuuuuaaacugugugcuaacugcaauaaauuauaugaacu

SEQ ID NO: 468293 - RNA, 64 nt, Human
uuuuaacacagcuauccaguaaggcuaucaugaugugugcuaaaauuuuauuuacuugaauuuu

SEQ ID NO: 468294 - RNA, 64 nt, Human
ccccuuuccccucccacaauaagaccauuuaagugugugcuaaacaacuacggaauacuaaaua

SEQ ID NO: 468295 - RNA, 64 nt, Human
ugcaaauuuguauuaaauguauacagacuuccaagugugcuaauucuuuaccuccuaaacuuuu

SEQ ID NO: 468296 - RNA, 64 nt, Human
gugcaguguaacgaugcacuuuggaagggaguuggugugcuauuuuugaagcagauguggugau

SEQ ID NO: 468297 - RNA, 64 nt, Human
aaaauauugguauuacaaaaaugcagaauauuuagugugcuacagaucugaauuauaguucuaa

SEQ ID NO: 468298 - RNA, 64 nt, Human
uccucugguaguucugugugugccccucaccccugugugcuagugucugggaaguuucccugaa

SEQ ID NO: 468299 - RNA, 64 nt, Human
agaaacuccacagcuguuuacaaauuugguuacagugugcuacggugcauuuguaacacucaga

SEQ ID NO: 468300 - RNA, 60 nt, Human; identical to SEQ ID NO: 455353

SEQ ID NO: 468301 - RNA, 60 nt, Human; identical to SEQ ID NO: 445376

SEQ ID NO: 468302 - RNA, 100 nt, Human
uugaucauaccaaacauuucuugaucauaccaaacauuuccuaaacucucuaguuagauaucugacuugggaguauuaaaucugacuugggaguauuaaa

SEQ ID NO: 468303 - RNA, 64 nt, Human
cugggacggcuccugcuuuuggggcucuugaucagugugcuaaccucacugccucauggcauca

SEQ ID NO: 468304 - RNA, 64 nt, Human
uugugccaguuaaucauaggaucccauuaaauaagugugcuaacaucgaauauagagaaaacug

SEQ ID NO: 468305 - RNA, 64 nt, Human
aaaugaggcaguuaaauaauaauaguuaaugaaggugugcuacagaaaauaaucugguguucuu

SEQ ID NO: 468306 - RNA, 64 nt, Human
auugaaaauugaaaaguacaacuaacgcaaccaagugugcuaaaaaugagcuugauuaaaucaa

SEQ ID NO: 468307 - RNA, 64 nt, Human
cuaaaaguuguacuucauuucuuuuccauacacugugugcuauuuguguuaacauggaagagga

SEQ ID NO: 468308 - RNA, 64 nt, Human
gcaccuuuccuaauuggcaaaugaucagacuaaugugugcuaauguuuuucuuccaugcuuuca

SEQ ID NO: 468309 - RNA, 64 nt, Human
gguguacacaucuuauaacacagauaaaguuuuggugugcuaccuauucuugagagagugagug

SEQ ID NO: 468310 - RNA, 64 nt, Human
cauucuuucaguaaauauuuauugaguaccuacugugugcuaggcauugaccugggaacuagag

SEQ ID NO: 468311 - RNA, 64 nt, Human
aucgccucgaucaaguguggagucacaugcuaaugugugcuaaagaacuguaaguguuuuuuca

SEQ ID NO: 468312 - RNA, 64 nt, Human
augugcauuuccagaucugauuuucugcuaacuugugugcuaugauccacuccugauggggguc

SEQ ID NO: 468313 - RNA, 64 nt, Human
aaugccugcccaccugccccucuuccauccaggagugugcuacugaggggcuggcuggaccaac

SEQ ID NO: 468314 - RNA, 64 nt, Human
ucaugcuuucagccucucugcaaacauuuauuuugugugcuagauacuggagauauguugcugg

SEQ ID NO: 468315 - RNA, 64 nt, Human
ucuggccuuccaaaacucacccccuuauuuaaaugugugcuaugacccacuaugaccacagcau

SEQ ID NO: 468316 - RNA, 64 nt, Human
cugcacaggacccaaaggccccaggcccugcaaggugugcuaguuccugcuuucccgcggacuu

SEQ ID NO: 468317 - RNA, 100 nt, Human
aagagcugugcauuauaaaaaagagcugugcauuauaaaaucaguuagaauaguuagaacaauucuuauuuaugcccacaaauucuuauuuaugcccaca

SEQ ID NO: 468318 - RNA, 100 nt, Human
cuggaucagcaguaucacuacuggaucagcaguaucacuaucacuugggcuaguuagagauccagauucuggauccauacuccagauucuggauccauac

SEQ ID NO: 468319 - RNA, 100 nt, Human
cuucaugaaaugaaacuuugcuucaugaaaugaaacuuuguaacuuauuguaguuagaaauuguaacuuugauauugaauuuguaacuuugauauugaau

SEQ ID NO: 468320 - RNA, 64 nt, Human
ucaccaaugguauaaagcaaaaccuagguuuagagugugcuaggauaccugaaaccugaugguu

SEQ ID NO: 468321 - RNA, 64 nt, Human
ccucucuuggagcuuuuuugcauagcaauuaaaggugugcuauuugucaguagccauuuuuuug

SEQ ID NO: 468322 - RNA, 64 nt, Human
cugaagaaauucuaauuguuguuuaaguuccaaggugugcuacaauauaggaggcacagucauc

SEQ ID NO: 468323 - RNA, 64 nt, Human
ggcuuacuugcccuucagcucauaaaagcagaaggugugcuauucacaguaccaugcgaguagc

SEQ ID NO: 468324 - RNA, 64 nt, Human
guaccuuaguccaggaagaaauuaauggaauauggugugcuaauuaucacuaccuauaacauga

SEQ ID NO: 468325 - RNA, 64 nt, Human
uuaacaccuauacuguucuauacuacuccuacccgugugcuaggaaugugcacuagcucuuuuu

SEQ ID NO: 468326 - RNA, 64 nt, Human
cagcacuguauuucuguguugacauuuguuggcagugugcuaaguaauguuuuuuaaagcacag

SEQ ID NO: 468327 - RNA, 64 nt, Human
cuacaguugaauuggacaaggcuaaaauucuguagugugcuaaaaugcucaaguuggcacauaa

SEQ ID NO: 468328 - RNA, 64 nt, Human
aguauuaccaaaccuaaacugguugaaggugaaagugugcuauggccuuuucaagccuaagaag

SEQ ID NO: 468329 - RNA, 64 nt, Human
uguuuugcuaaauaacuccuguggauuuaggaaugugugcuaauagcaaucuuccuaauuuuca

SEQ ID NO: 468330 - RNA, 64 nt, Human
gugaaauucuacaagugucccuuuuaaaaauagugugugcuaacuaagggcuauucauucugcc

SEQ ID NO: 468331 - RNA, 64 nt, Human
auuuuucaaucuacuaauucugugacuugucuuggugugcuagccuacaccuucucuuugguuu

SEQ ID NO: 468332 - RNA, 64 nt, Human
uuuuacucuuuuaaaugcuuguagguggcuuggggugugcuaucgugcuguuccuacucaguaa

SEQ ID NO: 468333 - RNA, 64 nt, Human
ggugguguauuuggguugaaauugugucauaugugugugcuauccaucucguguuuagaggcug

SEQ ID NO: 468334 - RNA, 100 nt, Human
acugggaguguuauuagaauacugggaguguuauuagaaugaaaaguaauuaguuagaagggcauacaucucaguggcauggcauacaucucaguggcau

SEQ ID NO: 468335 - RNA, 100 nt, Human
uggucaacaggaaguugacuuggucaacaggaaguugacuguaugucugcuaguuagauucaaaacaucauaaagaugaucaaaacaucauaaagaugau

SEQ ID NO: 468336 - RNA, 100 nt, Human
auugagugccaaagagaagaauugagugccaaagagaagagcuuacuggguaguuagaguucaucaggagacccaacccuucaucaggagacccaacccu

SEQ ID NO: 468337 - RNA, 64 nt, Human
ggucucuucacugaucaucgauaagcauuuaagagugugcuaacaccauucacagaggucccug

SEQ ID NO: 468338 - RNA, 64 nt, Human
ugucucuaaggcugcauccuauuaccacaauggggugugcuauaacugcugguauuagagaggg

SEQ ID NO: 468339 - RNA, 64 nt, Human
uauuugccuuggauucuguggauucuuuaaaccugugugcuaauaauucaaacaauguugcauu

SEQ ID NO: 468340 - RNA, 64 nt, Human
gaacagaaaacuauaaacuuacuggggacaggaugugugcuaaagggcacagcaagacacuguc

SEQ ID NO: 468341 - RNA, 64 nt, Human
uuacuaguuuuuuuuuuuuucuugcagugugugugugugcuauaccuuaauggggaaggggggu

SEQ ID NO: 468342 - RNA, 64 nt, Human
cugagguuucuuucucuaauccacugaaauuauugugugcuaaauuugggaaacagaucuauuc

SEQ ID NO: 468343 - RNA, 64 nt, Human
gcuggaaaauucucgaagcugcaccguguccucugugugcuagaauaagggacaaauggguucc

SEQ ID NO: 468344 - RNA, 64 nt, Human
gauguugggaacacagugggcaaacucacaaauggugugcuauucuugggcaagaacagggacg

SEQ ID NO: 468345 - RNA, 64 nt, Human
uguuuuguauauauacaauggauaaauuuuaagugugugcuaaggcacauggaagaccgauuuu

SEQ ID NO: 468346 - RNA, 64 nt, Human
uacucugaaauuggucacuuuccuauuacacggagugugcuaaaacuaaaaagcauuuugaaac

SEQ ID NO: 468347 - RNA, 64 nt, Human
caugcccuaucaauuacuauaauccugagccauggugugcuacugaaaccaauuuuuauccacc

SEQ ID NO: 468348 - RNA, 64 nt, Human
gugcaauacuuucugugccaauagagucugaccagugugcuauauaguuaaagcucauucccuu

SEQ ID NO: 468349 - RNA, 64 nt, Human
uucguggggagagggcguaaauugucuugugaaugugugcuaaccaaaacccaaaggcucuuuu

SEQ ID NO: 468350 - RNA, 64 nt, Human
ggggucagcuuaggcucugcuucccaguggacgggugugcuaaggguuuauuuuauguaaaaaa

SEQ ID NO: 468351 - RNA, 60 nt, Human; identical to SEQ ID NO: 455851

SEQ ID NO: 468352 - RNA, 60 nt, Human; identical to SEQ ID NO: 455852

SEQ ID NO: 468353 - RNA, 60 nt, Human; identical to SEQ ID NO: 455853

SEQ ID NO: 468354 - RNA, 64 nt, Human
auuuauacuccuguucccaggaucuugagcuuuagugugcuauaccuaugugucuuaucguggg

SEQ ID NO: 468355 - RNA, 64 nt, Human
agaaauccccaccaccucaaccucugcugagauugugugcuaggaacagccuucccuccguuuc

SEQ ID NO: 468356 - RNA, 64 nt, Human
gagggauuuauuuuuguauguuuauaugucacuugugugcuaugugaauagcuauguuuguuau

SEQ ID NO: 468357 - RNA, 64 nt, Human
cagccaggguggccgggcccugccagugggcggcgugugcuagcaaggccugccgggugugccg

SEQ ID NO: 468358 - RNA, 64 nt, Human
caauguuacugcacugaaaaacguguauguauuagugugcuagauuauuuagcagaauauucac

SEQ ID NO: 468359 - RNA, 64 nt, Human
ccaaacaucuccuuagugucugcagguguuaguggugugcuaaaagcaaggaaagcgaguuagu

SEQ ID NO: 468360 - RNA, 64 nt, Human
aguauuuauggaaacuaguggaaaagagaaauuagugugcuauauaaaucaggcauucaaguaa

SEQ ID NO: 468361 - RNA, 64 nt, Human
uuaauaauguaaguaaauuauuuaugcacuccuggugugcuaugaauauuauuccaguuagccu

SEQ ID NO: 468362 - RNA, 64 nt, Human
cugcaugcauggugacaucuuuggaaauucauuugugugcuaaacugaagucugcacuagaagu

SEQ ID NO: 468363 - RNA, 64 nt, Human
ugccucagcuuccugaguagcuggaaccacaggugugugcuaccgugccuggcacuuuuuugcc

SEQ ID NO: 468364 - RNA, 64 nt, Human
cuuccaagcgcagggacgccggccuccagcuggugugugcuaaggcuccguccugacugcccug

SEQ ID NO: 468365 - RNA, 64 nt, Human
gcacaucacugaaauaaugagauuuucuucuacggugugcuacccuuucuaaacuguucuaaga

SEQ ID NO: 468366 - RNA, 64 nt, Human
augcauucaugaguccauguggccaagucagccugugugcuacugaacugucgaaggaaauagc

SEQ ID NO: 468367 - RNA, 64 nt, Human
gagcugggaagugccacauggauaaugucaacuugugugcuauaucucugaggaauggugaggu

SEQ ID NO: 468368 - RNA, 100 nt, Human
ugccaaagugauagagaugaugccaaagugauagagaugaaucaugucaguaguuagaauaacauuucaacuguuuucuuaacauuucaacuguuuucuu

SEQ ID NO: 468369 - RNA, 100 nt, Human
cugaauacaguguuuucaaucugaauacaguguuuucaauuuguacagaauaguuagaauauucuauuaaaguggugaaaauucuauuaaaguggugaaa

SEQ ID NO: 468370 - RNA, 100 nt, Human
agggagaggauauagaccuuagggagaggauauagaccuuuuuaacuuuauaguuagaaaaauuggccucagugugaaauaauuggccucagugugaaau

SEQ ID NO: 468371 - RNA, 64 nt, Human
aggacuggugcuaaccaccugccaucaugaggaugugugcuagagugugggacccuggccaagu

SEQ ID NO: 468372 - RNA, 64 nt, Human
gcuccucccccgacaauccuguccuuguguuugugugugcuaacagaaauaaguugcaguaugg

SEQ ID NO: 468373 - RNA, 64 nt, Human
gguuuuaaaacagucuacauugagcauuugaaaggugugcuagaacaaggucuccugauccguc

SEQ ID NO: 468374 - RNA, 64 nt, Human
ucaagagaguccuuggcuuaaagcuguagcaagggugugcuaggugggggauuuggagcaaaac

SEQ ID NO: 468375 - RNA, 64 nt, Human
acacaaauggcauguaugcuaaugagauuuacccgugugcuaucuguauuucccuuguacagaa

SEQ ID NO: 468376 - RNA, 64 nt, Human
agugaccaaaguguagccaguuuucugaguucccgugugcuagacuggccagaagagagggucu

SEQ ID NO: 468377 - RNA, 64 nt, Human
cuaauccuuugauuauuaaugagguugaauauuugugugcuaucgguagcuguguuucuuugau

SEQ ID NO: 468378 - RNA, 64 nt, Human
ucaucaggaaucaaaacccacaguccauugugaagugugcuauauuuagaacagucuuaaaaug

SEQ ID NO: 468379 - RNA, 64 nt, Human
auucauggccugugcucggugagccuuaccuucugugugcuacugacguacccaucaggacagu

SEQ ID NO: 468380 - RNA, 64 nt, Human
auguaugucaguauggaaguaguuauagcauacugugugcuaauugaaaagaaugagguggagc

SEQ ID NO: 468381 - RNA, 64 nt, Human
gcaguauauuuaguuuuccauuugcaugauguuugugugcuauagaugauauuuuaaauugaaa

SEQ ID NO: 468382 - RNA, 64 nt, Human
ugccucagucucccgaguaguggaaauuacaggugugugcuaccacaucuugcuaguuuuguau

SEQ ID NO: 468383 - RNA, 64 nt, Human
gucuguuagcauauaggauuuugugcguaugugagugugcuauaacauguaacuugcggauguu

SEQ ID NO: 468384 - RNA, 64 nt, Human
agaauuaaacgugagugugugugugugugugugugugugcuaugcaugcucuaagucugcaugg

SEQ ID NO: 468385 - RNA, 60 nt, Human; identical to SEQ ID NO: 455837

SEQ ID NO: 468386 - RNA, 60 nt, Human; identical to SEQ ID NO: 455838

SEQ ID NO: 468387 - RNA, 60 nt, Human; identical to SEQ ID NO: 455839

SEQ ID NO: 468388 - RNA, 64 nt, Human
gaaauaauaguuuaaaacaaguagcuguuacuaagugugcuaaaaauacucauuuuauaauuaa

SEQ ID NO: 468389 - RNA, 64 nt, Human
uccaguucccacuuggaggccuuucaucccucgggugugcuauggauggcuucuaacaaaaacu

SEQ ID NO: 468390 - RNA, 64 nt, Human
aaagacuaaaaagagaaaucccuuccuauauacagugugcuacauuuacaaaaaauuucuccuu

SEQ ID NO: 468391 - RNA, 64 nt, Human
uacuuuuuggguggcuugugcauucuuaucaguugugugcuaauuuauuguauuguuccuuugu

SEQ ID NO: 468392 - RNA, 64 nt, Human
uaucaagggcaaccuuggugaaagcagaaagggugugugcuauugcauauauaugggggaaaag

SEQ ID NO: 468393 - RNA, 64 nt, Human
uuuuuccaguuucuuagaauauaaugacauaacugugugcuauuuccauuugauuauuuucacu

SEQ ID NO: 468394 - RNA, 64 nt, Human
uaaaguuauaauuguucaauauguuuuuugaacagugugcuaaaucaauagcaaacccacugcc

SEQ ID NO: 468395 - RNA, 64 nt, Human
cggauucaugacucgugcuucacguaucccagaagugugcuauuaucacauuuuaaugcaugcc

SEQ ID NO: 468396 - RNA, 64 nt, Human
aguuguugccacugcuguuuuccaaauguccgaugugugcuaugacuaaaaauugaaaaauuaa

SEQ ID NO: 468397 - RNA, 64 nt, Human
aaaaaucaaaaucuauguuaaacacauuuuggcagugugcuauaauaaaaaaaaguguuguguc

SEQ ID NO: 468398 - RNA, 64 nt, Human
gcugagugagaagucuuuuguaaauuaauucggcgugugcuacaugagccauaauuauuaacag

SEQ ID NO: 468399 - RNA, 64 nt, Human
ccucugaguuagcucuuuggaaucgugaacacaggugugcuauauuguccuuguccuaacuguc

SEQ ID NO: 468400 - RNA, 64 nt, Human
gaaaacccaacuacauaugcacuuucuugguugugugugcuauagagagguuggaagggguggu

SEQ ID NO: 468401 - RNA, 64 nt, Human
gcugauggagccugggggaaccaucacuuuuuuugugugcuacauucaaggagaucaaaaaaac

SEQ ID NO: 468402 - RNA, 60 nt, Human; identical to SEQ ID NO: 455841

SEQ ID NO: 468403 - RNA, 60 nt, Human; identical to SEQ ID NO: 455842

SEQ ID NO: 468404 - RNA, 60 nt, Human; identical to SEQ ID NO: 455843

SEQ ID NO: 468405 - RNA, 64 nt, Human
acaucugcgaucaacucuagccaaauuugccccugugugcuacaugauggaugauuauuauuuu

SEQ ID NO: 468406 - RNA, 64 nt, Human
aagggcugcaucuagcuucuuuuauuagaagugugugugcuaaauuccuuauuaauguguaauc

SEQ ID NO: 468407 - RNA, 64 nt, Human
acaauuaaacccuuucaauuacaguacagauucugugugcuacuugaugagauguuacccaagg

SEQ ID NO: 468408 - RNA, 64 nt, Human
agcucuaggguggcugguuaguauuaauacauuggugugcuaacagggcauauaggauguggcu

SEQ ID NO: 468409 - RNA, 64 nt, Human
uggugccuaaugcugugugaugcaccugcagggugugugcuagccucugugccccguccuugug

SEQ ID NO: 468410 - RNA, 64 nt, Human
gcuaagguuggaugcaugguugcauggauuuggggugugcuaugaggggugguguauccuuggg

SEQ ID NO: 468411 - RNA, 64 nt, Human
ucaccacagaauggauugggacacagcagcauaagugugcuacuuggcagcuaguaaguuuaaa

SEQ ID NO: 468412 - RNA, 64 nt, Human
cccugaaguuaguugcauauucagagguaaaguugugugcuaucuuggcagcaucuuagagaug

SEQ ID NO: 468413 - RNA, 64 nt, Human
gauuucucaccugcugugguaucuugcaggaacugugugcuaaaauugaacaauuuuuuugaga

SEQ ID NO: 468414 - RNA, 64 nt, Human
guugaaugaguaggagguguucacacauccucuugugugcuagguaguggcgugcaucugaucu

SEQ ID NO: 468415 - RNA, 64 nt, Human
uuuuauaacucaaauuugaaugucauaguacauugugugcuaaccauggcaagcaaacauuuac

SEQ ID NO: 468416 - RNA, 64 nt, Human
uuucucagcuguugugaauuauguguaucugugugugugcuaaguacagucucuuuaccaaagg

SEQ ID NO: 468417 - RNA, 64 nt, Human
agacgugugccagcgaaguuucucucccacgugagugugcuacaagaaaaucugaacccgagaa

SEQ ID NO: 468418 - RNA, 64 nt, Human
aaggaauuaguaguguucccaucacuuguuuggagugugcuauucuaaaagauuuugauuuccu

SEQ ID NO: 468419 - RNA, 64 nt, Human; identical to SEQ ID NO: 270484

SEQ ID NO: 468420 - RNA, 64 nt, Human; identical to SEQ ID NO: 274898

SEQ ID NO: 468421 - RNA, 64 nt, Human; identical to SEQ ID NO: 274913

SEQ ID NO: 468422 - RNA, 64 nt, Human
auuuccaauggcuaaugauguugaguaucuuuuugugugcuaauuugccaucuauguauccucu

SEQ ID NO: 468423 - RNA, 64 nt, Human
acuggccaaaagcaaaauuauuuuauguuaaaaugugugcuaaacuaucccaggaaaguauuua

SEQ ID NO: 468424 - RNA, 64 nt, Human
agaccacugaacaaauacacauacuaggccucaagugugcuauucccauguggcuuuauccugu

SEQ ID NO: 468425 - RNA, 64 nt, Human
cauguucaaggaacccauagagauccugcccaaugugugcuacacagcaugugcaacacucaaa

SEQ ID NO: 468426 - RNA, 64 nt, Human
uugugcaauaggucuuaugcuguuuucacucaaugugugcuaagaucuagccccauugacucuu

SEQ ID NO: 468427 - RNA, 64 nt, Human
uuccuauuuuacugggcaccuaugaauguaugcugugugcuagaaauagacuaaaacauauucc

SEQ ID NO: 468428 - RNA, 64 nt, Human
caaguuuauaaucaauucccacuuagcaccuacugugugcuaggaacuugaauguguauguuug

SEQ ID NO: 468429 - RNA, 64 nt, Human
acaggaacacgcauguguguauauauguguucacgugugcuauguguguuaagccugcaugcau

SEQ ID NO: 468430 - RNA, 64 nt, Human
aacacuccuguuguugguauuaugcugcagaguugugugcuacauaagcuauuauuaaauguga

SEQ ID NO: 468431 - RNA, 64 nt, Human
augcuucugugcucuaagauauauaugugugugugugugcuacauauauauuuuuaagaaagga

SEQ ID NO: 468432 - RNA, 64 nt, Human
uauugcuuccugauuaccagucugauuauaccaugugugcuaauauacuuuuuuuguuauagau

SEQ ID NO: 468433 - RNA, 64 nt, Human
caagcguggaggaugauggagaaucgugugaucagugugcuaaaucucucugccuguuuggacu

SEQ ID NO: 468434 - RNA, 64 nt, Human
uuccucacuguggaccccugucugggccacccuagugugcuaagcugagcagugcagugugaac

SEQ ID NO: 468435 - RNA, 64 nt, Human
ccaaaaugguuggccgagcucccagugggaaaacgugugcuagaguuggggagugagaugagug

SEQ ID NO: 468436 - RNA, 64 nt, Human; identical to SEQ ID NO: 274864

SEQ ID NO: 468437 - RNA, 64 nt, Human; identical to SEQ ID NO: 270483

SEQ ID NO: 468438 - RNA, 56 nt, Human; identical to SEQ ID NO: 274865

SEQ ID NO: 468439 - RNA, 64 nt, Human
cacuggagauggguuuauuucacgcucugugcuugugugcuagcggagggagagcucagggugg

SEQ ID NO: 468440 - RNA, 64 nt, Human
uuaggauuggugcucagaaaugguuaaucaugcugugugcuagccagggccagcugguaccuuc

SEQ ID NO: 468441 - RNA, 64 nt, Human
ucuuccccccagcccccacccacugcuguguugugugugcuagagagacuuacagggcugugaa

SEQ ID NO: 468442 - RNA, 64 nt, Human
uucaauaccguguacugccugaguugugccucuugugugcuagauuaaaagugagacagagacu

SEQ ID NO: 468443 - RNA, 64 nt, Human
augguagaugcuugauuguuuuggucucaaaauggugugcuauaaagauaaaggugaggggaag

SEQ ID NO: 468444 - RNA, 64 nt, Human
uacauaucccugcagaguuggccuuuugcccguggugugcuaguagcuuuggcugaugcuaagc

SEQ ID NO: 468445 - RNA, 64 nt, Human
uuuuuuuuaagaaaugaggcuuucacugagauuugugugcuauucauaauuuuaggaauuacug

SEQ ID NO: 468446 - RNA, 64 nt, Human
aucaagagaauccagguucugucagauuaguaaggugugcuaaucuaaauuuuaaaaaaucucu

SEQ ID NO: 468447 - RNA, 64 nt, Human
ucuuggagaggugaaagaggugaaagaacaaguugugugcuagaaaacuuuugaggaauucuua

SEQ ID NO: 468448 - RNA, 64 nt, Human
agugugugagccuccaucuccuguccaaugacaugugugcuagagcuuacucugagaaggugac

SEQ ID NO: 468449 - RNA, 64 nt, Human
ucucacaaaaacagauaaauauuugcacagaugggugugcuaaucauugugccuugaugguucc

SEQ ID NO: 468450 - RNA, 64 nt, Human
uggcaggguuuucaguaaaauguuuugccucaucgugugcuaggaaauaaugcagaaaaaacuu

SEQ ID NO: 468451 - RNA, 64 nt, Human
agaguuuuuaugucuuaauguaacucuacagugggugugcuauguucuuauuacccugauuaaa

SEQ ID NO: 468452 - RNA, 64 nt, Human
accaguaccaccugccggguguuguggccuagcugugugcuaagugccauguugggcuccucac

SEQ ID NO: 468453 - RNA, 64 nt, Human; identical to SEQ ID NO: 274914

SEQ ID NO: 468454 - RNA, 64 nt, Human; identical to SEQ ID NO: 270485

SEQ ID NO: 468455 - RNA, 64 nt, Human; identical to SEQ ID NO: 274915

SEQ ID NO: 468456 - RNA, 64 nt, Human
ccagcccuuuccucaggagguaccgcucuccaaggugugcuagcagugggcccugcccaacuuc

SEQ ID NO: 468457 - RNA, 64 nt, Human
aaggucggcuggcagcacuggccaaggugauggggugugcuacacaguguaugucacuguguag

SEQ ID NO: 468458 - RNA, 64 nt, Human
cauuucuaccuagaguaccaguaaacaucucccagugugcuauaguagaaaaugucuacuccuc

SEQ ID NO: 468459 - RNA, 64 nt, Human
auaccuuguuuaaagaauaauggcuuguucacgugugugcuaugaaaaaugaugucccauguuc

SEQ ID NO: 468460 - RNA, 64 nt, Human
gaaaguuuauuuacuccagggccugacacggggugugugcuacagucuaagggcucccacucau

SEQ ID NO: 468461 - RNA, 64 nt, Human
gcuguauugcaacgugcaggaccauuuuaaaccugugugcuaaaaauuuuccagauacuugcuu

SEQ ID NO: 468462 - RNA, 64 nt, Human
agggugcacucaggguguuguuagagcgucucgugugugcuagacgcaccccuacucguuccua

SEQ ID NO: 468463 - RNA, 64 nt, Human
ucacugcucuucagaauacacucuagacccaaaggugugcuaaucacuucacagugaccacuac

SEQ ID NO: 468464 - RNA, 64 nt, Human
guuuaagcaaaugauagaaagggaaguaaggcgugugugcuaguuaauagguuuaguagcuuuu

SEQ ID NO: 468465 - RNA, 64 nt, Human
cuguuauauuauccaguagaaaauguuaggauaugugugcuauauaaaaaaaaaaaaagacuug

SEQ ID NO: 468466 - RNA, 64 nt, Human
uaauaguacccaaccugguaauuauccucaaguugugugcuauucguaaguucugugcaguuug

SEQ ID NO: 468467 - RNA, 64 nt, Human
auaggcucuuuugggauuuuugaagcuguauacugugugcuaaaacaagcacuaaacaaagagu

SEQ ID NO: 468468 - RNA, 64 nt, Human
aguaccaguucucgugaugugaauuaauuuuuuugugugcuaggggagggagagugaggaggga

SEQ ID NO: 468469 - RNA, 64 nt, Human
aauggaguuggaguucauucauauuacaauauuugugugcuaaacguguauguuuuucaguuca

SEQ ID NO: 468470 - RNA, 64 nt, Human; identical to SEQ ID NO: 274796

SEQ ID NO: 468471 - RNA, 64 nt, Human; identical to SEQ ID NO: 270499

SEQ ID NO: 468472 - RNA, 64 nt, Human; identical to SEQ ID NO: 274455

SEQ ID NO: 468473 - RNA, 64 nt, Human
cacccaccgcuagccguuguuccugugcaaaguagugugcuaugcacccacccagguggccgcc

SEQ ID NO: 468474 - RNA, 64 nt, Human
agauuugccuuuucuuaaucaaagaaaggucuuugugugcuagaauauuauugguaauguuuua

SEQ ID NO: 468475 - RNA, 64 nt, Human
uauccuuuccaaaaagaguaauaguuguuuacuagugugcuagaugaaaagcgugcaauaugcu

SEQ ID NO: 468476 - RNA, 64 nt, Human
uaaaauaauagcaaguauuuacugagagcuuacugugugcuaggcauuuucuuaauauuucaau

SEQ ID NO: 468477 - RNA, 64 nt, Human
caaauuagacaaccaaguaugaaucuauuugugggugugcuauagcuuuagccgugucacgggc

SEQ ID NO: 468478 - RNA, 64 nt, Human
caaguagugauaucugugaaaucacagguuugaugugugcuaauuauguauucuucuaauacau

SEQ ID NO: 468479 - RNA, 64 nt, Human
uuuugguguuucgcuuuucuguaaggauuaagcagauagggagaagggaaaaggggccucacuu

SEQ ID NO: 468480 - RNA, 64 nt, Human
ggagggugccaaccccaccucuaguauuuugggagauagggaaagugaaccgacuuccccuucc

SEQ ID NO: 468481 - RNA, 64 nt, Human
auccccagaauuuccagcuuuugaaaguggccuggauagggaaguuguuuuccuuuuaaagaag

SEQ ID NO: 468482 - RNA, 64 nt, Human
ccugcuuugguguugagugaugagcugagucagggauagggaguccccuggugcuaaccgugaa

SEQ ID NO: 468483 - RNA, 64 nt, Human
uuuaggccacauugacaguggugggcggggagaagauagggaacacucaucccuggucgucuau

SEQ ID NO: 468484 - RNA, 64 nt, Human
uggaccugcccuuucugcuccagacuuggggcuagauagggaccacuccuuuuaggcgaugccu

SEQ ID NO: 468485 - RNA, 64 nt, Human
ccagcuggucuggguguagcucuuagaggaaggagauagggaaaaggggcuccuugcuccacag

SEQ ID NO: 468486 - RNA, 64 nt, Human; identical to SEQ ID NO: 274456

SEQ ID NO: 468487 - RNA, 64 nt, Human; identical to SEQ ID NO: 274457

SEQ ID NO: 468488 - RNA, 64 nt, Human; identical to SEQ ID NO: 274797

SEQ ID NO: 468489 - RNA, 64 nt, Human; identical to SEQ ID NO: 274472

SEQ ID NO: 468490 - RNA, 64 nt, Human
gguauagcuaaaaacaaaagcccauaaaguuggagauagggaccagaguuuaacauagcgaucu

SEQ ID NO: 468491 - RNA, 64 nt, Human
gcccuuugaacccccuuccugcccuguguuaggagauagggauauuggccccucacugcagcug

SEQ ID NO: 468492 - RNA, 64 nt, Human
agggcuugcuaagaaaaaagggaguaaaaaugaugauagggaagugucuaauguaugugcacau

SEQ ID NO: 468493 - RNA, 64 nt, Human
ggagucauaggaaaagcccccaucucccaucugggauagggaccuuccaucagccuuaacccug

SEQ ID NO: 468494 - RNA, 64 nt, Human
ucuuccagcaucgauguucuguagcucugaccuugauagggauacagcuuugauccaaggaugu

SEQ ID NO: 468495 - RNA, 64 nt, Human
guagcuuuuaggaauaacuuuuacacgaccauuugauagggaacuggggaaugggguauggaag

SEQ ID NO: 468496 - RNA, 64 nt, Human
uuucuaauucugugaagaaugucauugguaguuugauagggauagcauugaacuauuugcucaa

SEQ ID NO: 468497 - RNA, 64 nt, Human
cgcugaaauugcuuauuuuugguguuggauagaggauagggagaauauuuacuaacuaaauacc

SEQ ID NO: 468498 - RNA, 64 nt, Human
acugggcuuuacauggugacagacauuuccgugggauagggaagauagcaggaagaaaaguaaa

SEQ ID NO: 468499 - RNA, 64 nt, Human
cucccuaccucuacuccccaaaauggaaucaugggauagggaaggcccccauggggucagaagg

SEQ ID NO: 468500 - RNA, 64 nt, Human
aggagagggaagccuauuuuguuaacugguuugggauagggaaugggguuucuuuuucuuuaau

SEQ ID NO: 468501 - RNA, 64 nt, Human
cccuugucauuccauugagaaagcugacaacugggauagggaggggauuagauaauagaugggg

SEQ ID NO: 468502 - RNA, 64 nt, Human
auugcugcucuuggugguguuaucuaauuuuugugauagggaaacaaauucuuuugaauaaaaa

SEQ ID NO: 468503 - RNA, 64 nt, Human
guuccauucuguguagcaccauucaccacagcaggauagggagccucgacucuuucucgguaac

SEQ ID NO: 468504 - RNA, 64 nt, Human
uacacacccauagugcacacuuguauauugaaaagauagggaagagagaaacauuuauggaauc

SEQ ID NO: 468505 - RNA, 64 nt, Human; identical to SEQ ID NO: 274660

SEQ ID NO: 468506 - RNA, 64 nt, Human; identical to SEQ ID NO: 274661

SEQ ID NO: 468507 - RNA, 64 nt, Human; identical to SEQ ID NO: 274712

SEQ ID NO: 468508 - RNA, 64 nt, Human
ucugauguguuucacaagcacguaguucaacccagauagggaccacagagauucuggggccagc

SEQ ID NO: 468509 - RNA, 64 nt, Human
uugucccuuuacuggguuugggggguuguuaaaagauagggaaugaagaaugcaaaaugguuua

SEQ ID NO: 468510 - RNA, 64 nt, Human
uagugcaaaaugcuucuacucucugugucuuccugauagggauguuuaauguaaguaggauauu

SEQ ID NO: 468511 - RNA, 64 nt, Human
ugcucuuuaauucagcuacauauauucauguggugauagggaucaacuugacacaacuuugaaa

SEQ ID NO: 468512 - RNA, 64 nt, Human
gaucaucuugugccaagauaugcuguuggugccugauagggauuagucuuuuaggugcccuguu

SEQ ID NO: 468513 - RNA, 64 nt, Human
gggacagccagggucccagccccaaugucagcaggauagggagagccccaggacucaggagugc

SEQ ID NO: 468514 - RNA, 64 nt, Human
accauauguaugaauuuguauaauuucauuuuuggauagggauaaacuuuugcuucugauaaaa

SEQ ID NO: 468515 - RNA, 64 nt, Human
uauuuuauaaguaucuucauguaucccuguuacugauagggauacaugcucuuagaaaauucac

SEQ ID NO: 468516 - RNA, 64 nt, Human
acuaccuaggcuuuacucuugagugucuccuuuugauagggauuguuucuggaccaguuugucu

SEQ ID NO: 468517 - RNA, 64 nt, Human
acacacccagaagagagaugcacuaacaacuggggauagggauggggucagggggagcccaaga

SEQ ID NO: 468518 - RNA, 64 nt, Human
uagcaggugaagacuucauagaaggcgacagauugauagggaggcuauugaagcaguuuuucug

SEQ ID NO: 468519 - RNA, 64 nt, Human
agugaaaccagcuuccuucaucucuaaggcuaaggauagggaaaggguggaugcucucaggcug

SEQ ID NO: 468520 - RNA, 64 nt, Human
gaagaugccucugucuuucccacgacugccaggagauagggaagcccagccaggacugacccuc

SEQ ID NO: 468521 - RNA, 64 nt, Human
guuccauuccugaauaugcaggcuaauuuguacagauagggauuaaggaauacagacuauuaga

SEQ ID NO: 468522 - RNA, 64 nt, Human
uuggccacuuggcuguucauuuuauucuaagugggauagggacauaccuaccuggauuuacaug

SEQ ID NO: 468523 - RNA, 64 nt, Human; identical to SEQ ID NO: 270501

SEQ ID NO: 468524 - RNA, 64 nt, Human; identical to SEQ ID NO: 274491

SEQ ID NO: 468525 - RNA, 64 nt, Human; identical to SEQ ID NO: 274540

SEQ ID NO: 468526 - RNA, 64 nt, Human
ggguucaucacaguguugccuuuugucuccuaaagauagggaucuacuuuugaagggaauuguu

SEQ ID NO: 468527 - RNA, 64 nt, Human
aaacugcaaguguuagcacugaaauauugucauugauagggaaaauaucuauucuuugagucau

SEQ ID NO: 468528 - RNA, 64 nt, Human
cucugcugcccuuugaaccaguguacagucgccagauagggaccggugaacaccugauuccaaa

SEQ ID NO: 468529 - RNA, 64 nt, Human
aauagucuauaccugaacugcuauaagcaaggucgauagggaaguggauagauugcuucagcaa

SEQ ID NO: 468530 - RNA, 64 nt, Human
cucuccagaugguuuuacuaaguccccucucccugauagggaauccugcuggaccagcgcagcc

SEQ ID NO: 468531 - RNA, 64 nt, Human
agcaggaggcuguuuccaaaaaccaguguaguaggauagggauuuuuuuuuuuuuuuuuugccc

SEQ ID NO: 468532 - RNA, 64 nt, Human
cccaaauccauuaaaagugacuucagaggucccagauagggaccaacauuuguuuaaaccuuuu

SEQ ID NO: 468533 - RNA, 64 nt, Human
ugcccuaggggcaguccugcuuccucauuuuauagauagggaaacugaggcuuugggaggacuc

SEQ ID NO: 468534 - RNA, 64 nt, Human
uguuuacuuccaaauuaggaugugacagagaagggauagggaaauccucucugcucauugggcc

SEQ ID NO: 468535 - RNA, 64 nt, Human
cacacaagacugaggcaggagaauaggguacagagauagggaucuaaggaugacuuggacacac

SEQ ID NO: 468536 - RNA, 64 nt, Human
cuuccuuucuggaguuugcagaguucagcaauaugauagggaacaggugcugaugggcccaaga

SEQ ID NO: 468537 - RNA, 64 nt, Human
agguuuccagugugucaccaacaaaaagugcauugauagggaccuuugucucuuccucccuuug

SEQ ID NO: 468538 - RNA, 64 nt, Human
uguagcauauucacuaaacaauguuuuauaugaggauagggaccuuuaaauauguguuuuauag

SEQ ID NO: 468539 - RNA, 64 nt, Human
ugaagaagaauaaaugaggguaaggggcuagugugauagggagaggggugggaugccaucauau

SEQ ID NO: 468540 - RNA, 64 nt, Human
ccgaccucuuaggcuuggugugaggaugaaaugagauagggaauauaaagcaagcagauagugg

SEQ ID NO: 468541 - RNA, 64 nt, Human; identical to SEQ ID NO: 274541

SEQ ID NO: 468542 - RNA, 64 nt, Human; identical to SEQ ID NO: 270502

SEQ ID NO: 468543 - RNA, 64 nt, Human; identical to SEQ ID NO: 274506

SEQ ID NO: 468544 - RNA, 64 nt, Human
aaauaauuuuaauaguauauucaguggcugaagugauagggaguauuaaucauuauuucuucag

SEQ ID NO: 468545 - RNA, 64 nt, Human
guuguguuuuuuuuuuguuguuguuuauuuuuuggauagggaagucauuggcuuaauuagagcc

SEQ ID NO: 468546 - RNA, 64 nt, Human
uggccagugacaaauccaggaaaugaauguugcugauagggauaaaucuugaggcugagggcgg

SEQ ID NO: 468547 - RNA, 64 nt, Human
aaugccucugaguguccuaccuccuuggagaugagauagggaaggagcagggaugagacuggca

SEQ ID NO: 468548 - RNA, 64 nt, Human
uuuaagaaccauuugcugccgcauagugccauuggauagggaagaacuucagaaaucuguggua

SEQ ID NO: 468549 - RNA, 64 nt, Human
ggaucaagauccaguuuaggguugggaaauaaaggauagggauaaaagaggcaccccauucagu

SEQ ID NO: 468550 - RNA, 64 nt, Human
aaguuauaccauuuaaagcuggcaccagagacccgauagggacuuauuaacuauauugaacauu

SEQ ID NO: 468551 - RNA, 64 nt, Human
uuuaaugcagucaaaucuaacgggacuagggugggauagggaggaaggugguaucaaauuguug

SEQ ID NO: 468552 - RNA, 64 nt, Human
auggcucauuugagggguggcuacuuggcuaugggauagggaggagggaauuacuagggaggag

SEQ ID NO: 468553 - RNA, 64 nt, Human
gacugagaagaugugaauccauggucucaaaggugauagggacgauuagauagguguuuuaagg

SEQ ID NO: 468554 - RNA, 64 nt, Human
gucuucaggccugugugucccuggaacauguaaugauagggaacaggaccccagucccuuuccc

SEQ ID NO: 468555 - RNA, 64 nt, Human
ggagcccaauggccuggggugggaguggggaguagauagggaauaugugggauuugguuuaagu

SEQ ID NO: 468556 - RNA, 64 nt, Human
guaauaaacagguuuuuaguuuguucuucagauugauagggaguuuuaaagaaauuuuaguagu

SEQ ID NO: 468557 - RNA, 64 nt, Human
acuaggcuaaacucaagauuugaccaaaucgagugauagggauccuggugggaggagagagggc

SEQ ID NO: 468558 - RNA, 64 nt, Human
agggugggcggcuuaccauagcaagugauccugcgauagggaacgcgcccuugccccgaggcug

SEQ ID NO: 468559 - RNA, 64 nt, Human; identical to SEQ ID NO: 274473

SEQ ID NO: 468560 - RNA, 64 nt, Human; identical to SEQ ID NO: 274474

SEQ ID NO: 468561 - RNA, 64 nt, Human; identical to SEQ ID NO: 274489

SEQ ID NO: 468562 - RNA, 64 nt, Human
ccaugucuugugcccucccacacagaaaguguuagauagggaaauuggcaaaaagaauaguuaa

SEQ ID NO: 468563 - RNA, 64 nt, Human
gcugaagacaccauauuuaacacuauaucucagugauagggaaauagcugcauugaucuuacau

SEQ ID NO: 468564 - RNA, 64 nt, Human; identical to SEQ ID NO: 468510

SEQ ID NO: 468565 - RNA, 64 nt, Human
gugcccccgcaugcccuccugcaguugcuggauggauagggacaccaggaagaggacaaacugc

SEQ ID NO: 468566 - RNA, 64 nt, Human; identical to SEQ ID NO: 468510

SEQ ID NO: 468567 - RNA, 64 nt, Human
aauaccaaccucccagucuuccacugcccacagggauagggaggguguugagaauccuaaacuc

SEQ ID NO: 468568 - RNA, 64 nt, Human
ucuaacacgggacuuuuaguuugcgaagggccuagauagggagagagguaacaugaaucuggac

SEQ ID NO: 468569 - RNA, 64 nt, Human
gaagagaacuuaaagagggaaaaaacaauaugaagauagggaaugcaggaaaacauuauucugg

SEQ ID NO: 468570 - RNA, 64 nt, Human
uauaguauuuucuguuguccagaaaaucuucccagauagggaaacugaggcagagagugccgug

SEQ ID NO: 468571 - RNA, 64 nt, Human
gaccaagaccuguuggucugggaagcauuucauggauagggagagcuccucucggugaacaguc

SEQ ID NO: 468572 - RNA, 64 nt, Human
ccuuuuuuuuuaaaguaagaaaauaguugcuaccgauagggacuuugccaaguccaauuaucuu

SEQ ID NO: 468573 - RNA, 64 nt, Human
gaugagauccacauccuaaaaauaccaugucugugauagggaagaaggccugcucaccaaugau

SEQ ID NO: 468574 - RNA, 64 nt, Human
uuuguuuuguuucuuccuuuuuuaguucuucaaagauagggagggaagggggaacaugagccuu

SEQ ID NO: 468575 - RNA, 64 nt, Human
aagucuguaguagcagcagcugacuaacgagggagauagggagauucugacaaacuucuacucu

SEQ ID NO: 468576 - RNA, 64 nt, Human
gauuugcuuuuuacacacuuucaugugaaagagugauagggagagggagcgaggcuggugccgc

SEQ ID NO: 468577 - RNA, 64 nt, Human; identical to SEQ ID NO: 274508

SEQ ID NO: 468578 - RNA, 64 nt, Human; identical to SEQ ID NO: 274608

SEQ ID NO: 468579 - RNA, 64 nt, Human; identical to SEQ ID NO: 274609

SEQ ID NO: 468580 - RNA, 64 nt, Human
agaaaagaucuacauuucuuuggacacugcacuugauagggacucaaagaauguuauauuuuua

SEQ ID NO: 468581 - RNA, 64 nt, Human
caggcuggcuugguuagguuuuacuggggcagaggauagggaaucucuuauuaaaacuaacaug

SEQ ID NO: 468582 - RNA, 64 nt, Human
auggggagaggaaaaaagagcuggcaaagaaauggauagggaauauuuuaguucuuuaaauaua

SEQ ID NO: 468583 - RNA, 64 nt, Human
uacuagguggcugugauuaaaugucccaagcaaggauagggaaggggaaugguugagccucugg

SEQ ID NO: 468584 - RNA, 64 nt, Human
aaaagaccuuggcucauagaaagucacuuuaauagauagggacaguaauaaauaaauguacaau

SEQ ID NO: 468585 - RNA, 64 nt, Human
acucaucuguguuuuacuugagacauguaaauaugauagggaaggaacugaauuucuccauuca

SEQ ID NO: 468586 - RNA, 64 nt, Human
uggaggggcuuuggaccaccugaaagaccaaggggauagggaggaggaggcuucagccaucagc

SEQ ID NO: 468587 - RNA, 64 nt, Human
uaaguggaaacugcaugaauuaaaagagggguaugauagggacauuguccuuugggcuagguag

SEQ ID NO: 468588 - RNA, 64 nt, Human
agggcgugacucaccgcugggugcuugccaaagagauagggacgcauaugcuuuuuaaagcaau

SEQ ID NO: 468589 - RNA, 64 nt, Human
uugcuguccugugguuucauuagucugauaggaagauagggauuuccucagucacagaugauau

SEQ ID NO: 468590 - RNA, 64 nt, Human
caguuuauauuaaggagacccuuuucuccuugaggauagggauagguaagguaaacuuguaaaa

SEQ ID NO: 468591 - RNA, 64 nt, Human
gggugguauuugcuuuguaacuccccccagguacgauagggacugaauauggacccugcugaaa

SEQ ID NO: 468592 - RNA, 64 nt, Human
ucccuuuggaauggaagcuuagggguucucaggugauagggagagguggcuguuaacagugggc

SEQ ID NO: 468593 - RNA, 64 nt, Human
aaaugcccugcaacgguggcuccugacaccaggggauagggagaugugccagaguccuuccucc

SEQ ID NO: 468594 - RNA, 64 nt, Human
gaggccaaaccuuaaauccagagauagcagccucgauagggaccuuaaaaggauucacaaaaac

SEQ ID NO: 468595 - RNA, 64 nt, Human; identical to SEQ ID NO: 270516

SEQ ID NO: 468596 - RNA, 64 nt, Human; identical to SEQ ID NO: 274542

SEQ ID NO: 468597 - RNA, 64 nt, Human; identical to SEQ ID NO: 274371

SEQ ID NO: 468598 - RNA, 64 nt, Human
gacuaauguaaaguaaaugccaaacuaccgacuugauagggauguuuuuguaaguuaauuuucu

SEQ ID NO: 468599 - RNA, 64 nt, Human
ggauaagccaauccucacuccccagccuccucuggauagggaugaagaccccacugggguugga

SEQ ID NO: 468600 - RNA, 64 nt, Human
aacuuucucacuaagugagaaugagaacugcugugauagggagagugaaggagggauauguggu

SEQ ID NO: 468601 - RNA, 64 nt, Human
uuaggccugcuccuggaccucuuuaugauauugugauagggaaaaaaaucauugacgucauaga

SEQ ID NO: 468602 - RNA, 64 nt, Human
uuucaagauacuauuuuaaaaacaccaugaaucagauagggaaagaaaguugauuggaauagca

SEQ ID NO: 468603 - RNA, 64 nt, Human
caguuagaaauaauacagucacaugucacuuaaugauagggaaacauucugagaaaugcauugu

SEQ ID NO: 468604 - RNA, 64 nt, Human
ugauuccuccaauaugggccagaugcuuuugaaugauagggaaaucuacauaaaauccaguguc

SEQ ID NO: 468605 - RNA, 64 nt, Human
ugccuggccuguauguguguguuuuaaagcacuagauagggauggacauuaaaucuguguugca

SEQ ID NO: 468606 - RNA, 64 nt, Human
guugggucaucuuguuggauaguaguaccacugagauagggaauucaagguuuggggcaagggu

SEQ ID NO: 468607 - RNA, 64 nt, Human
caauguucuaccucucccugucccucuuguaggggauagggaggcagagagagccagccccuac

SEQ ID NO: 468608 - RNA, 64 nt, Human
gaagauuuguucauuuaaaagucugcccacugaggauagggaaaggauuaaggauuuuuccacc

SEQ ID NO: 468609 - RNA, 64 nt, Human
gccuguguccuuccugaagcuucucgacugcccagauagggaggugaguccucucuaucuccuc

SEQ ID NO: 468610 - RNA, 64 nt, Human
uuuuuuacacuggguguucaaauuuauuuuaagagauagggagggaggggacauaaagggaaug

SEQ ID NO: 468611 - RNA, 64 nt, Human
caugcuuuugcaguuaaauggcgaugguggaggugauagggacuucaagaguaaaaugcaccuu

SEQ ID NO: 468612 - RNA, 64 nt, Human
aaaaaauacauacuguggucggcaaggugagggagauagggauauccaggggaagaggguguug

SEQ ID NO: 468613 - RNA, 62 nt, Human; identical to SEQ ID NO: 270517

SEQ ID NO: 468614 - RNA, 64 nt, Human; identical to SEQ ID NO: 274557

SEQ ID NO: 468615 - RNA, 64 nt, Human; identical to SEQ ID NO: 274558

SEQ ID NO: 468616 - RNA, 64 nt, Human
ucucauugcugcaccugggaccauaggaugggaggauagggagccccucaugacugagggcaga

SEQ ID NO: 468617 - RNA, 64 nt, Human
cuguugaggugcccauaagaaaaucauaggccaagauagggaggggcauuccagcaaaccccgu

SEQ ID NO: 468618 - RNA, 64 nt, Human
cuagagggaccucucccagggucccugggguggggauagggagcagaugcaaugacucaggaca

SEQ ID NO: 468619 - RNA, 64 nt, Human
ggggcgaguagggaaguccucuucuaaaaugagagauagggauuuggugggguauggaaggaac

SEQ ID NO: 468620 - RNA, 64 nt, Human
cuggaucauuggauucaaaucauaauguggauaggauagggaggaugaauuaccaggauucaug

SEQ ID NO: 468621 - RNA, 64 nt, Human
cugaagcuuuuggagacuuuuggauggaagauaagauagggaagauuaaguuccagcauuucug

SEQ ID NO: 468622 - RNA, 64 nt, Human
uggcccaccaggugggccaugaaaggagaggauggauagggauggcugggaaauggagaucacu

SEQ ID NO: 468623 - RNA, 64 nt, Human
guacaaaguucuguucaucaaaugaugcuguuaagauagggaaaagacaagaaacaggacugga

SEQ ID NO: 468624 - RNA, 64 nt, Human
uuuacuuuuuuuuuuuuuuuuuaaguuuuccugggauagggaugauaguguaauuguucaugcc

SEQ ID NO: 468625 - RNA, 64 nt, Human
gguuuguccugaguccguuuucaaaugaccuugugauagggaaaugguuuuguccauguucuug

SEQ ID NO: 468626 - RNA, 64 nt, Human
ugaaccgcgacccccacuaaauuucuagauuggggauagggagaaagggaggcccaggaagguc

SEQ ID NO: 468627 - RNA, 64 nt, Human
aaguaagaggagguagaguugagaagguguggaagauagggacagcugcccccagaacucccuu

SEQ ID NO: 468628 - RNA, 64 nt, Human
aaaaaaaaaaaaagaaagaaaagaguaacagaaagauagggauuuuuaggagacaauuagauaa

SEQ ID NO: 468629 - RNA, 64 nt, Human
ccaagcuuggcuaauuuaaaaaaaaaauuauauagauagggacuugcuauguugccuaggcuga

SEQ ID NO: 468630 - RNA, 64 nt, Human
ccuucccagcucucauuuuuguuaggugauuugggauagggauaguguuuugggguaugggggg

SEQ ID NO: 468631 - RNA, 64 nt, Human; identical to SEQ ID NO: 274559

SEQ ID NO: 468632 - RNA, 64 nt, Human; identical to SEQ ID NO: 274574

SEQ ID NO: 468633 - RNA, 64 nt, Human; identical to SEQ ID NO: 274575

SEQ ID NO: 468634 - RNA, 64 nt, Human
uuuauaugcacugaugaggaaagacauacugugugauagggagaaaaagcagcuuauaaaauaa

SEQ ID NO: 468635 - RNA, 64 nt, Human
ggcugaaagucacucgacauuggucucuuguguugauagggaaggaaaucaggcauuccuauuu

SEQ ID NO: 468636 - RNA, 64 nt, Human
uguaagaauagccuuaguguuuagauuuuuuuaugauagggaagaugcggccaucacugggaua

SEQ ID NO: 468637 - RNA, 64 nt, Human
ccaauuggcucuagucacuggcaucucacuuuaugauagggaaggcuacuaccuagggcacuuu

SEQ ID NO: 468638 - RNA, 64 nt, Human
cagcagguuuucugcauggaagggaagguggggugauagggagggcagccagaaaagacagcug

SEQ ID NO: 468639 - RNA, 64 nt, Human
aaagaauuuucugcuauuguguucacuacaacaggauagggacaucagacagccccagaaaccc

SEQ ID NO: 468640 - RNA, 64 nt, Human
gggcugggggaagaggcuggcagaaguuacccuggauagggaagggggaggaggggacuuuuag

SEQ ID NO: 468641 - RNA, 64 nt, Human
uguuuucuuuugggcuuggggugggacuuccagagauagggauggguugggggcgggguaauua

SEQ ID NO: 468642 - RNA, 64 nt, Human
gggccccuaauaugugacaugacgauuuggcauagauagggaugugagaguggaguaccuuccu

SEQ ID NO: 468643 - RNA, 64 nt, Human
uauugaaaugaagaacagauuaaugguugccagggauagggacuggagggggugugggguaugu

SEQ ID NO: 468644 - RNA, 64 nt, Human
uauugucagagcagcaugagaaauaugauauuuggauagggauuucagcaacuaaacauucucu

SEQ ID NO: 468645 - RNA, 51 nt, Human
cagggucuucgugcuguuaaagauagggagccuuuuaaaaaugugccccaa

SEQ ID NO: 468646 - RNA, 64 nt, Human
gggagaaagugggggauggcuaagaaagcugggagauagggaacagaagaggguaguggguggg

SEQ ID NO: 468647 - RNA, 64 nt, Human
ggguguguguaugucuccguggaucagccacagggauagggauuuuguuuuuaagggaaagcau

SEQ ID NO: 468648 - RNA, 64 nt, Human
auugaaaggaaccacguacagcaaugcggagugggauagggauaaaauacccaccccaaaauga

SEQ ID NO: 468649 - RNA, 64 nt, Human; identical to SEQ ID NO: 274576

SEQ ID NO: 468650 - RNA, 64 nt, Human; identical to SEQ ID NO: 274337

SEQ ID NO: 468651 - RNA, 64 nt, Human; identical to SEQ ID NO: 274338

SEQ ID NO: 468652 - RNA, 64 nt, Human
gggaccaacaccccucccacacucccccagacugcucgucuaucaccaggaucgcuuuguacuu

SEQ ID NO: 468653 - RNA, 64 nt, Human
aguugcuuuugacuccucuauuucuguuucaacucucgucuaauccaacagcaaauccccuuga

SEQ ID NO: 468654 - RNA, 64 nt, Human
ucuaaguuucugcaguguuacuguaagagagugucucgucuacacuucaguucuucucucaugu

SEQ ID NO: 468655 - RNA, 64 nt, Human
uuguucuagcaguggagguguuauagugucgccacucgucuaauuugaccaguguuaagaauuu

SEQ ID NO: 468656 - RNA, 64 nt, Human
caugugcgggggagguccacacuacagcuguccucucgucuagaaggcaccaccucgcuuucau

SEQ ID NO: 468657 - RNA, 64 nt, Human
agaaauauguaaguagaaaaacauucauccuuuccucgucuaauuaugauccugccauauucca

SEQ ID NO: 468658 - RNA, 64 nt, Human
ucaccuuucugccuuuggaacacaugaagaucaucucgucuauggaucauguugacaaacuaag

SEQ ID NO: 468659 - RNA, 64 nt, Human
ccuggacugagggggaccaggucuucuugcugaccucgucuacaaaggcaaaggaaggcaaagg

SEQ ID NO: 468660 - RNA, 64 nt, Human
cagaggauggaggcuccuucaucaacaagcgacccucgucuaaagaggcagcugagugagagac

SEQ ID NO: 468661 - RNA, 64 nt, Human
gggacuucuuuaaugcuacguuaauguuucacugcucgucuagaaacuccuaaauccagcuuuc

SEQ ID NO: 468662 - RNA, 64 nt, Human
cucauacaagccccuuuauugccacuaccccacgcucgucuaguccugaaacugcaggaccagu

SEQ ID NO: 468663 - RNA, 64 nt, Human
ucaguagagacgggguuuccccauguugguuaggcucgucuagaaccucugaccucaggugauc

SEQ ID NO: 468664 - RNA, 64 nt, Human; identical to SEQ ID NO: 270519

SEQ ID NO: 468665 - RNA, 64 nt, Human; identical to SEQ ID NO: 274591

SEQ ID NO: 468666 - RNA, 64 nt, Human; identical to SEQ ID NO: 274592

SEQ ID NO: 468667 - RNA, 60 nt, Human; identical to SEQ ID NO: 455844

SEQ ID NO: 468668 - RNA, 64 nt, Human
ugacucccgaugcaggggaugguguggucaagcccucgucuagagcagacccagcccagaccuc

SEQ ID NO: 468669 - RNA, 64 nt, Human
cugcauggaaaggcaauaucucugguggaaaaaacucgucuacaucgaccuccguuuguacauu

SEQ ID NO: 468670 - RNA, 64 nt, Human
ggcgccuccuugcgcaggcccagccuccacucuccucgucuagguuucuuuaccuccagggauc

SEQ ID NO: 468671 - RNA, 64 nt, Human
caaacacguggaucaacagaaaaggaaaauuucacucgucuaaacacuuucaauuuucaguuuu

SEQ ID NO: 468672 - RNA, 64 nt, Human
cgcagagagugacggugucuccuugcaucccagccucgucuaugcagcaagagaccagggacuu

SEQ ID NO: 468673 - RNA, 64 nt, Human
uggacccaggacccucgcguccugguccacccaccucgucuacuagugucccacagugcugcgc

SEQ ID NO: 468674 - RNA, 64 nt, Human
gcuuccacgucuccaaaagcgccuuccugucacccucgucuaucccugcgccugggggcugggg

SEQ ID NO: 468675 - RNA, 64 nt, Human
ggacagcaauguauggcacgacaucucagacuuccucgucuauaacaagagccgucccuccaau

SEQ ID NO: 468676 - RNA, 64 nt, Human
guggucucugucacuuugaaugccaggcuggcuucucgucuagcaguauucagauaccccuucu

SEQ ID NO: 468677 - RNA, 64 nt, Human
uauauauuauuugauauucagagaaucuaaagcacucgucuacuguuuuaaugagauuuaacag

SEQ ID NO: 468678 - RNA, 64 nt, Human
uuuauguaaauacuucgcaugacaaauucaguaacucgucuauuucagcaugcauaagacuuuu

SEQ ID NO: 468679 - RNA, 64 nt, Human; identical to SEQ ID NO: 468652

SEQ ID NO: 468680 - RNA, 64 nt, Human; identical to SEQ ID NO: 468653

SEQ ID NO: 468681 - RNA, 64 nt, Human; identical to SEQ ID NO: 468654

SEQ ID NO: 468682 - RNA, 64 nt, Human; identical to SEQ ID NO: 468655

SEQ ID NO: 468683 - RNA, 64 nt, Human; identical to SEQ ID NO: 468656

SEQ ID NO: 468684 - RNA, 64 nt, Human; identical to SEQ ID NO: 274746

SEQ ID NO: 468685 - RNA, 64 nt, Human; identical to SEQ ID NO: 274880

SEQ ID NO: 468686 - RNA, 64 nt, Human; identical to SEQ ID NO: 274881

SEQ ID NO: 468687 - RNA, 64 nt, Human; identical to SEQ ID NO: 468657

SEQ ID NO: 468688 - RNA, 64 nt, Human; identical to SEQ ID NO: 468658

SEQ ID NO: 468689 - RNA, 64 nt, Human; identical to SEQ ID NO: 468659

SEQ ID NO: 468690 - RNA, 64 nt, Human; identical to SEQ ID NO: 468660

SEQ ID NO: 468691 - RNA, 64 nt, Human; identical to SEQ ID NO: 468661

SEQ ID NO: 468692 - RNA, 64 nt, Human; identical to SEQ ID NO: 468662

SEQ ID NO: 468693 - RNA, 64 nt, Human; identical to SEQ ID NO: 468663

SEQ ID NO: 468694 - RNA, 64 nt, Human; identical to SEQ ID NO: 468668

SEQ ID NO: 468695 - RNA, 64 nt, Human; identical to SEQ ID NO: 468669

SEQ ID NO: 468696 - RNA, 64 nt, Human; identical to SEQ ID NO: 468670

SEQ ID NO: 468697 - RNA, 64 nt, Human; identical to SEQ ID NO: 468671

SEQ ID NO: 468698 - RNA, 64 nt, Human; identical to SEQ ID NO: 468672

SEQ ID NO: 468699 - RNA, 64 nt, Human; identical to SEQ ID NO: 468673

SEQ ID NO: 468700 - RNA, 64 nt, Human; identical to SEQ ID NO: 468674

SEQ ID NO: 468701 - RNA, 64 nt, Human; identical to SEQ ID NO: 468675

SEQ ID NO: 468702 - RNA, 64 nt, Human; identical to SEQ ID NO: 468676

SEQ ID NO: 468703 - RNA, 64 nt, Human; identical to SEQ ID NO: 270467

SEQ ID NO: 468704 - RNA, 64 nt, Human; identical to SEQ ID NO: 274761

SEQ ID NO: 468705 - RNA, 64 nt, Human; identical to SEQ ID NO: 274762

SEQ ID NO: 468706 - RNA, 64 nt, Human; identical to SEQ ID NO: 468677

SEQ ID NO: 468707 - RNA, 64 nt, Human; identical to SEQ ID NO: 468678

SEQ ID NO: 468708 - RNA, 64 nt, Human
acuuucugcuacccuagggaggccaggaggagcuucggaggaccaucgccccacuggucuagcc

SEQ ID NO: 468709 - RNA, 64 nt, Human
cacaaauucggguaggauggagccuguguggcccucggaggacugaagaacgagggcugacagc

SEQ ID NO: 468710 - RNA, 64 nt, Human
cauaccauuguggaauugagcagagaaccugcucucggaggaugccuaggagauguugggaaca

SEQ ID NO: 468711 - RNA, 64 nt, Human
gaaauucgugugaaagaggagggaaugagauuauucggaggaagggaaugggggagacagccug

SEQ ID NO: 468712 - RNA, 64 nt, Human
ccuaugcuacugauaggaccaggaagagaggaacucggaggacaauagggaggggaagucuugg

SEQ ID NO: 468713 - RNA, 64 nt, Human
cuggacaacagaagccccaugccgccuguccaguucggaggagaacuagcugcugccuugccuu

SEQ ID NO: 468714 - RNA, 64 nt, Human
cccccccaguccgagggcugggcccgagguauggucggaggaggagcuccugccugcgguuuug

SEQ ID NO: 468715 - RNA, 64 nt, Human
ucccucgcccucugaaaguccucaugccuggcagucggaggagagcgcccagacucugaacuca

SEQ ID NO: 468716 - RNA, 64 nt, Human
cucuugaacccagaaggaggacuuugggccaauuucggaggagagaagaaagugcaacgugggg

SEQ ID NO: 468717 - RNA, 64 nt, Human
uaauuuccagccaucaccuuugguggggugggcuucggaggacagucugucugaaccugccagu

SEQ ID NO: 468718 - RNA, 64 nt, Human
guugaauuuuggaaauuggcacugggugaaaaggucggaggacuggcucuuguagucacagagu

SEQ ID NO: 468719 - RNA, 64 nt, Human
gacugcuauuguucaaaaaaagccuuugcugcauucggaggacugccccgugcccugaggugac

SEQ ID NO: 468720 - RNA, 64 nt, Human
guugcuucagccuggccugggcagcccuggaagcucggaggagaggccaccuucuuaggugccu

SEQ ID NO: 468721 - RNA, 64 nt, Human
ugcucuuugauuccuggaagcaaacgugggacugucggaggaaagggauuguucuggucuuacu

SEQ ID NO: 468722 - RNA, 64 nt, Human; identical to SEQ ID NO: 274625

SEQ ID NO: 468723 - RNA, 64 nt, Human; identical to SEQ ID NO: 274626

SEQ ID NO: 468724 - RNA, 64 nt, Human; identical to SEQ ID NO: 270468

SEQ ID NO: 468725 - RNA, 64 nt, Human
agcagucuucucuguaguccccggaggggacuccucggaggaaggaugagucugaggguuccgg

SEQ ID NO: 468726 - RNA, 64 nt, Human
cugccucggccuuuaaaugcugacucaccuccucucggaggaggcguccugucuucacgggggg

SEQ ID NO: 468727 - RNA, 64 nt, Human
caagggaagggugcuguguuuucauagcauggagucggaggagagggccauuuagcagggggag

SEQ ID NO: 468728 - RNA, 64 nt, Human
aauggcugcuugucaacaagcccaaagaugcuugucggaggacgguuauggaagcccuuaauuc

SEQ ID NO: 468729 - RNA, 64 nt, Human
aaggccccugggcagggaugccaccccugcuccuucggaggacgugcccucaccccucacuggu

SEQ ID NO: 468730 - RNA, 64 nt, Human
cccacuuggagaguuugaggaauggaaaugagaaucggaggagaaauaaggccagaggcucaca

SEQ ID NO: 468731 - RNA, 64 nt, Human
caccccagaaaguggagguuuccucuuggcauuuucggaggaaacuuguaggacacccaaggcg

SEQ ID NO: 468732 - RNA, 64 nt, Human
aauccugucuuuccaaaaguccaaggagcgcgggucggaggagacaaacucuuuggaaauaacc

SEQ ID NO: 468733 - RNA, 64 nt, Human
ugaagaacugcggguucacgagccauuugucucuucggaggagcuagcuaugagaugucugcga

SEQ ID NO: 468734 - RNA, 64 nt, Human
agcuccgugucaccaggauggaagggggugccucucggaggagccuguguccaccuccagucuc

SEQ ID NO: 468735 - RNA, 64 nt, Human
ugcuccuuguuuucccagcagcacaugggguuccucggaggagcagagguggccgccguggggg

SEQ ID NO: 468736 - RNA, 64 nt, Human
auagaacauucugaagagaacacagccuggcuccucggaggaggcagaggccacgaaggcacac

SEQ ID NO: 468737 - RNA, 64 nt, Human
ucuagcuccgggccugaguuuccccgaggcugcgucggaggagcugcagggcgagcccggacgg

SEQ ID NO: 468738 - RNA, 64 nt, Human
gggagcuggggaaacgacugcccgaggaaugcggucggaggauuguguugcuguggacgugguu

SEQ ID NO: 468739 - RNA, 64 nt, Human
agacaaccccucgcuagacgugaacucagaacugucggaggaaagacaacacaaccaacgcgaa

SEQ ID NO: 468740 - RNA, 64 nt, Human
cacaccaugaugccccaccccugccaggcuuggaucggaggagugaaccugggcuaagaguuug

SEQ ID NO: 468741 - RNA, 64 nt, Human; identical to SEQ ID NO: 274780

SEQ ID NO: 468742 - RNA, 64 nt, Human; identical to SEQ ID NO: 274848

SEQ ID NO: 468743 - RNA, 64 nt, Human; identical to SEQ ID NO: 270482

SEQ ID NO: 468744 - RNA, 64 nt, Human
gacgccaaguagccgccgcacuuuccagcagggaucggaggacgacccgagucccaagaguggg

SEQ ID NO: 468745 - RNA, 61 nt, Human
cccaagauguaaaaaucugaugguuaaaccaucggaggagaaacucuagacugcaagaacu

SEQ ID NO: 468746 - RNA, 64 nt, Human
guugagaaaggaaguucucgacaccagaaaugcaucggaggaccacaaucaguucuaugcugcc

SEQ ID NO: 468747 - RNA, 64 nt, Human
cuguguaguucuucacuaucuguuccagggcuagucggaggaucauaagcaagcucagaccugc

SEQ ID NO: 468748 - RNA, 64 nt, Human
ggcccuugggccacgcucuugaggaagcccaggcucggaggacccuggaaaacagacgggucug

SEQ ID NO: 468749 - RNA, 64 nt, Human
cagcaagagcaccccaucuucagguggcggccccucggaggacaagcgcuucucggugguggau

SEQ ID NO: 468750 - RNA, 64 nt, Human
cuccuccccuguccaggucccgcucccgguccccucggaggagagcccacuccccugagagacg

SEQ ID NO: 468751 - RNA, 64 nt, Human
gcggcaggcggccccacccugcacugguccaaggucggaggagacaggggaugaggaaggccuc

SEQ ID NO: 468752 - RNA, 64 nt, Human
aacaucaucauccgccaaaguuguuccucccuuuucggaggaucuagggggaaagaggagcauu

SEQ ID NO: 468753 - RNA, 64 nt, Human
agguagacgcagacgugugcagagaaugugcucuucggaggaagaacacugaugagcgagcucu

SEQ ID NO: 468754 - RNA, 64 nt, Human
aggccugugaggcugggcagcccuucaccagaguucggaggagcaguguguggcgccacguccc

SEQ ID NO: 468755 - RNA, 64 nt, Human
cccauggggucaggaacagggagcgaggagccccucggaggagccuccagaggaggaaaucccc

SEQ ID NO: 468756 - RNA, 64 nt, Human
cccguuucaugcagcgucucccuuggcaccgcguucggaggacgcacccucacuccccugcugc

SEQ ID NO: 468757 - RNA, 64 nt, Human
gccuuacuuugcacuuaauuuaauaagggcauucucggaggaguagacguuuaauacgaagugg

SEQ ID NO: 468758 - RNA, 64 nt, Human
cuuauugugaugagucucgacugucaaaucuucuucggaggaucacccgggaagacgacagaga

SEQ ID NO: 468759 - RNA, 64 nt, Human
ggccuucagugaggagcaaaaauacuaucagcugucggaggaaggggagaucguagauuugcug

SEQ ID NO: 468760 - RNA, 64 nt, Human; identical to SEQ ID NO: 274610

SEQ ID NO: 468761 - RNA, 64 nt, Human; identical to SEQ ID NO: 270533

SEQ ID NO: 468762 - RNA, 64 nt, Human; identical to SEQ ID NO: 274659

SEQ ID NO: 468763 - RNA, 64 nt, Human
ggccauuccaagcccuuccgggcuggaacuggugucggaggagccucggguguaucguacgccc

SEQ ID NO: 468764 - RNA, 64 nt, Human
uccuucucuuucuccguauuuauuuuuuuauucuucggaggagguggacauuucggaaguggug

SEQ ID NO: 468765 - RNA, 64 nt, Human
agcacaaaggcucagcuggggaugguguuugacuucggaggaaaaaaguugcuauugcccguua

SEQ ID NO: 468766 - RNA, 58 nt, Human
gcaccgugguucuggaguagccuccagcucggaggacuuguguucagggguccugggc

SEQ ID NO: 468767 - RNA, 64 nt, Human
cauuccuggacuccucccaccucucaccccugugucggaggaacaggccuugggcuguuuccgu

SEQ ID NO: 468768 - RNA, 64 nt, Human
ucaugccgggggagccaccagccccucacuggguucggaggagagucaggaagggccacgacaa

SEQ ID NO: 468769 - RNA, 64 nt, Human
guagaugagggacacuggccuggcccucgggucuucggaggacguagggggcuggcaugggugc

SEQ ID NO: 468770 - RNA, 64 nt, Human
uuuucccuagaguccagcacacugcaggaggcguucggaggaggaguuccgccccacccucuac

SEQ ID NO: 468771 - RNA, 64 nt, Human
cucaacuguccuggagagcagaggcuauuuggggucggaggagcccucgauaccugcgaauaca

SEQ ID NO: 468772 - RNA, 64 nt, Human
ccgggcaggaccgugccacaccagcuguccagagucggaggaccccagcuccucagcuugcaug

SEQ ID NO: 468773 - RNA, 64 nt, Human
ccugccccggcccugcuccagaacccagcccagaucggaggacaaguuccucucuagaacccaa

SEQ ID NO: 468774 - RNA, 64 nt, Human
ggagggggggucuccugggggcagaccgagggucucggaggauagaaugagagguuuccagggc

SEQ ID NO: 468775 - RNA, 64 nt, Human
ugcccaguccuugacucguccauggagcugagggucggaggaaccuuccuugggggcagcagcc

SEQ ID NO: 468776 - RNA, 64 nt, Human
ggcucugagguguaacgggggugggcucccucccucggaggacaucgucuguguccaggucaga

SEQ ID NO: 468777 - RNA, 64 nt, Human
aggccagcugacguuggagagccagccagacuccucggaggagaagucagcauuuuugaagccc

SEQ ID NO: 468778 - RNA, 64 nt, Human
cuugguauguuguuugguagagagaucuugauuuucggaggaucuugcauuuuucuagggaaua

SEQ ID NO: 468779 - RNA, 64 nt, Human; identical to SEQ ID NO: 274813

SEQ ID NO: 468780 - RNA, 64 nt, Human; identical to SEQ ID NO: 274814

SEQ ID NO: 468781 - RNA, 64 nt, Human; identical to SEQ ID NO: 274863

SEQ ID NO: 468782 - RNA, 64 nt, Human
ugcuuggagcugcagaaggguugccuucuguaggucggaggaauggaggcuuacuaaccaggua

SEQ ID NO: 468783 - RNA, 64 nt, Human
ucuccuccugggagucaaaguccauagccugagcucggaggaaggccucuguaucaccccagua

SEQ ID NO: 468784 - RNA, 64 nt, Human
gccuggaugcggauggccggagaggaccggcggcucggaggaagcccccaccgugggcagggag

SEQ ID NO: 468785 - RNA, 64 nt, Human
ggaggccuccaccccaggagcaccccgcgcacccucggaggacgggcuucggcugcgcggaggc

SEQ ID NO: 468786 - RNA, 64 nt, Human
cugugccuuuccugggguuucuuuucuguucuuuucggaggagagggcccgagaaggggccaua

SEQ ID NO: 468787 - RNA, 64 nt, Human
gccccgcagagcuggacagcgacacgcagggggcucggaggacucaggccgcagcccccgcgac

SEQ ID NO: 468788 - RNA, 64 nt, Human; identical to SEQ ID NO: 274710

SEQ ID NO: 468789 - RNA, 64 nt, Human; identical to SEQ ID NO: 274711

SEQ ID NO: 468790 - RNA, 64 nt, Human; identical to SEQ ID NO: 270465

SEQ ID NO: 468791 - RNA, 64 nt, Human; identical to SEQ ID NO: 274727

SEQ ID NO: 468792 - RNA, 54 nt, Human; identical to SEQ ID NO: 274728

SEQ ID NO: 468793 - RNA, 64 nt, Human; identical to SEQ ID NO: 274729

SEQ ID NO: 468794 - RNA, 64 nt, Human; identical to SEQ ID NO: 274778

SEQ ID NO: 468795 - RNA, 64 nt, Human; identical to SEQ ID NO: 274779

SEQ ID NO: 468796 - RNA, 64 nt, Human
agugaagaucuuugauaaagauuuuuuugugguucgacuggacugugcugagugcgggcacugg

SEQ ID NO: 468797 - RNA, 64 nt, Human
uuccucagcgcaggauguaaauagcacuaacgaucgacuggaacaaagugaccgcuguguaaaa

SEQ ID NO: 468798 - RNA, 64 nt, Human
gugauauuaguaaguaaaggucuuaaaagucugacgacuggaauagauauaaaguccuguuuaa

SEQ ID NO: 468799 - RNA, 64 nt, Human
gcagcuucugacacaccagccccaggaccuggggcgacuggaggaagccaggcgaguggggccc

SEQ ID NO: 468800 - RNA, 64 nt, Human
ucucucccauagagauggaaggcacagaaaggugcgacuggaaacuuuccuuucuguugugaaa

SEQ ID NO: 468801 - RNA, 64 nt, Human
agaucagaccgagaagcagggugagagauucuaacgacuggaugcugcuaguaacacauuguuu

SEQ ID NO: 468802 - RNA, 64 nt, Human
caugccucugugccuucgcucaugcuguuucuuccgacuggaaugccuuccccugcuccuccug

SEQ ID NO: 468803 - RNA, 52 nt, Human
ucuagauucuucugauguagagcgacuggaaagauucuucgacucagaagau

SEQ ID NO: 468804 - RNA, 64 nt, Human
caaacaaaaacagaaacuucucaggaaauuagaucgacuggagaagaaaaaaaagaaaaaagau

SEQ ID NO: 468805 - RNA, 64 nt, Human
auccccaauguuagagguggggccggcugggaggcgacuggaucaugggugugaagccuucaug

SEQ ID NO: 468806 - RNA, 64 nt, Human
aguggacaaugggaauaaagcauuucuaaagcaccgacuggagaggaaggcaacagagacaagg

SEQ ID NO: 468807 - RNA, 64 nt, Human
uggccauggaggaaggaucccgcuaggcuggucccgacuggagaagcugcucugccaggugugc

SEQ ID NO: 468808 - RNA, 64 nt, Human
ugguuuauugacaucacaguaaaaaggcuacugucgacuggacacaguggcucacacauguaau

SEQ ID NO: 468809 - RNA, 64 nt, Human
cgugauggcagcgcugccgaggacauaggaaccacgacuggaaagauaauuuaucguguuagga

SEQ ID NO: 468810 - RNA, 64 nt, Human
cgcaaggcagaaggaggcugggucccugaaucaccgacuggaggagaguuaccuacaagagccu

SEQ ID NO: 468811 - RNA, 64 nt, Human
agaacugguuuugguuacaggagucacuggaauccgacuggagaugauuuggcccccuguccug

SEQ ID NO: 468812 - RNA, 60 nt, Human; identical to SEQ ID NO: 455847

SEQ ID NO: 468813 - RNA, 60 nt, Human; identical to SEQ ID NO: 455848

SEQ ID NO: 468814 - RNA, 60 nt, Human; identical to SEQ ID NO: 455388

SEQ ID NO: 468815 - RNA, 64 nt, Human
agaagaaaccaaacguguuuaaacuuaaaacugccgacuggagggucuugcuuuuucaaacuca

SEQ ID NO: 468816 - RNA, 64 nt, Human
accaaggaucggacucugccccuggaccugggaacgacuggacugucacgggguucccuccuag

SEQ ID NO: 468817 - RNA, 64 nt, Human
ucuucagaaguucuggcagggauaagcaggacaucgacuggaacguaugcuaaaugaaagcaga

SEQ ID NO: 468818 - RNA, 64 nt, Human
cagccgcuuccucggcagccuugggaagcacgggcgacuggacagcagccgccgggcacgguua

SEQ ID NO: 468819 - RNA, 64 nt, Human
gugaccacaccgauggagauacagaaaaaguuaacgacuggauucuaucuucauuuuagacuuu

SEQ ID NO: 468820 - RNA, 64 nt, Human
ugccuacauuaucuaacugugcucaagagguucucgacuggaggaccacacucaagccgacuua

SEQ ID NO: 468821 - RNA, 64 nt, Human
caaucuuuacagauugauauuuucaguuuuuaaucgacuggacugcagauguuuuuucuuuuaa

SEQ ID NO: 468822 - RNA, 64 nt, Human
uacuggggauuacucgaccucauuacuuagcuaacgacuggauaaaauuucuuaauuguuugaa

SEQ ID NO: 468823 - RNA, 64 nt, Human
uguauaugagauaacuagauguccuguuuucgugcgacuggaggaggcagcuugcagcccuaca

SEQ ID NO: 468824 - RNA, 64 nt, Human
uuguggggcauguuuguauuuauugcuucauggccgacuggaauccugaguccugggaagcugg

SEQ ID NO: 468825 - RNA, 64 nt, Human
gcugagauauggggcugugggcagcagacgaugccgacuggaagggagggagagggagggggag

SEQ ID NO: 468826 - RNA, 64 nt, Human
ugguguauaccauaaccgaugugcuggagcuacacgacuggaugugcacucauuucgaagagca

SEQ ID NO: 468827 - RNA, 64 nt, Human
ggcagcccgggcgucagagcucaagcaccugccccgacuggagacuucagggcuugucacuuuc

SEQ ID NO: 468828 - RNA, 64 nt, Human
aauccacgcgcuccagggacucugcccgcccccgcgacuggagacggcaucucguucacagcac

SEQ ID NO: 468829 - RNA, 64 nt, Human
aggccuggacaaggagugaacacgggaacugucacgacuggaagggcgugaggccucccagcag

SEQ ID NO: 468830 - RNA, 64 nt, Human
ucuuccaggccaccugagccuucguucuucagcccgacuggaggaacagcagcucugggaggca

SEQ ID NO: 468831 - RNA, 60 nt, Human; identical to SEQ ID NO: 455389

SEQ ID NO: 468832 - RNA, 60 nt, Human; identical to SEQ ID NO: 445377

SEQ ID NO: 468833 - RNA, 60 nt, Human; identical to SEQ ID NO: 455405

SEQ ID NO: 468834 - RNA, 64 nt, Human
aguauggcuuuucacacgggcuucuauaccgcuucgacuggaagauccaccuccccacugccuu

SEQ ID NO: 468835 - RNA, 64 nt, Human
caggccuaggagggagaacaaguuccaaaggugccgacuggaagaaggggguaaaaguuugcuu

SEQ ID NO: 468836 - RNA, 64 nt, Human
agaucaacaaugugcagugggcaucaacucagcccgacuggaucgccaucugcuacaacaacug

SEQ ID NO: 468837 - RNA, 64 nt, Human
ccuggcugggagcaucucugaugaggcaugcuggcgacuggauggauaauccugugcaucacca

SEQ ID NO: 468838 - RNA, 64 nt, Human
gcccgcugcccccgccuccuccgccugaaugacccgacuggaauccacucuaaccaaucgcacu

SEQ ID NO: 468839 - RNA, 64 nt, Human
ccccagcaggucacccacggccccggaaccgcggcgacuggaggcuggauucgaggccggaaac

SEQ ID NO: 468840 - RNA, 64 nt, Human
ccaucuggaaacuuguggacagagaagaagaccacgacuggagaagcccccuuucugagugcag

SEQ ID NO: 468841 - RNA, 63 nt, Human
agccuccaggcucuggcagaaauaaacuccaacccgacuggaccaucucuguggcugugugug

SEQ ID NO: 468842 - RNA, 64 nt, Human
caaaaccacggugaagauacuaggguccagaggccgacuggagcaagguuugcuggcagaugag

SEQ ID NO: 468843 - RNA, 50 nt, Human
ucaggauccgucuguccuagcgacuggacuacugccugacguugucaguc

SEQ ID NO: 468844 - RNA, 64 nt, Human
uggacgaccuccagcucucaguuacaagugcaggcgacuggaggcaggacuccugggucccugg

SEQ ID NO: 468845 - RNA, 64 nt, Human
agugccagaucgugguacagaagaaggacggcugcgacuggauccgcugcaccgucugccacac

SEQ ID NO: 468846 - RNA, 64 nt, Human
ggagagggagcgccccuggcugccccucggccgccgacuggacgcgcgggccuugccagcgagc

SEQ ID NO: 468847 - RNA, 64 nt, Human
ucugcaccuccgcuugccagaggcccucggucagcgacuggaugcucgccaucaagguccagug

SEQ ID NO: 468848 - RNA, 64 nt, Human
uuaaaauccuucagaauacauuuaugaaccaaugcgacuggacuuagccacacacaauggaaau

SEQ ID NO: 468849 - RNA, 64 nt, Human
caacaagaagccgccuuaucaaugccagcauuagcgacuggacuguuuuuguuuuuuugguuac

SEQ ID NO: 468850 - RNA, 60 nt, Human; identical to SEQ ID NO: 455407

SEQ ID NO: 468851 - RNA, 60 nt, Human; identical to SEQ ID NO: 455423

SEQ ID NO: 468852 - RNA, 60 nt, Human; identical to SEQ ID NO: 455424

SEQ ID NO: 468853 - RNA, 64 nt, Human
gguaucaguggaagcuguguugccaauggacaaacgacuggacagacuuauuucucacugcggc

SEQ ID NO: 468854 - RNA, 64 nt, Human
auaacaguguaaggccuugggucuaaggcauccacgacuggaagggacuacugauguucuguga

SEQ ID NO: 468855 - RNA, 64 nt, Human
ugaaagcaagauuauccaguggguaaaugagagucgacuggauucugucaguucaaaaaaggaa

SEQ ID NO: 468856 - RNA, 64 nt, Human
gucccaaaaagaagagaaaaaaaaugcccaaguugcccuuuaaaaaaaaagagcguaaauacaa

SEQ ID NO: 468857 - RNA, 64 nt, Human
ggagggagcccucuccguugggugacucuugugugcccuuuagacaggcuggccugccgguucc

SEQ ID NO: 468858 - RNA, 64 nt, Human
ccccacccacuaggcuugauugcaucccuguugugcccuuuaagagacauguuuccaccccacc

SEQ ID NO: 468859 - RNA, 64 nt, Human
aagaaacaggccguugaccccaucuuuggaaguagcccuuuaccaugcauggucaguuucuuag

SEQ ID NO: 468860 - RNA, 64 nt, Human
ugugcguguguggagaacuuagaaacugacuguugcccuuuauuuaugcaaaaccaccucagaa

SEQ ID NO: 468861 - RNA, 64 nt, Human
aggaacaagcugaacugucuucagggacuguccugcccuuuagcuggcagcagcaggaggagug

SEQ ID NO: 468862 - RNA, 64 nt, Human
ugcccaccaguaugaguugccauuaagaccucaagcccuuuauucuuaaaaggguuuuuaauaa

SEQ ID NO: 468863 - RNA, 64 nt, Human
auaucuugcuccccuccugagucagccugguguugcccuuuauuccccuuaugugcauaugauu

SEQ ID NO: 468864 - RNA, 64 nt, Human
gccugugacaccucuaagcucuggcaccugugaagcccuuuaaacacccuuaagccccaggcuc

SEQ ID NO: 468865 - RNA, 60 nt, Human; identical to SEQ ID NO: 455497

SEQ ID NO: 468866 - RNA, 60 nt, Human; identical to SEQ ID NO: 455513

SEQ ID NO: 468867 - RNA, 60 nt, Human; identical to SEQ ID NO: 455514

SEQ ID NO: 468868 - RNA, 64 nt, Human
gggggcugggguggggguuugucaugggggaacugcccuuuaaauuuuaagugacacuacagaa

SEQ ID NO: 468869 - RNA, 64 nt, Human
cuuauuuauacccauacaucugcuacuuugggaggcccuuuacauagaaaacagcauucuuuuu

SEQ ID NO: 468870 - RNA, 64 nt, Human
auuaccauucgcuuagucaaaacauucgguuacugcccuuuaauacacuccuaucaucagcacu

SEQ ID NO: 468871 - RNA, 64 nt, Human
cagagaagguuuuucccaggacgucucauguuuggcccuuuagaauugggguagaaaucagaaa

SEQ ID NO: 468872 - RNA, 64 nt, Human
cgguugguaccaugcuaagcccuugccaugcuaagcccuuuacagucauauccuauaaucccca

SEQ ID NO: 468873 - RNA, 64 nt, Human
uuuuccuauagaaaacauucuuccuccaucaguagcccuuuauuugauauucagaaguggaaag

SEQ ID NO: 468874 - RNA, 64 nt, Human
cugccuuuugcuaagcgaucucuaugccugggaugcccuuuauuccaggaggcaucaagccucu

SEQ ID NO: 468875 - RNA, 64 nt, Human
acucugugugccaaaaccaaucaugccuuucacggcccuuuaguucagagaaguucugcacuga

SEQ ID NO: 468876 - RNA, 64 nt, Human
caggaauggggucuccccucacauuggggagcuugcccuuuaccuccagggcugcugcugccug

SEQ ID NO: 468877 - RNA, 64 nt, Human
ccaggcucccuccucagccuccugcccacccagggcccuuuacucucuucucccuccagaccuu

SEQ ID NO: 468878 - RNA, 64 nt, Human
cuuggaggagaggcugcagccacagcacccuacugcccuuuaaauaaaggagggcugugggcag

SEQ ID NO: 468879 - RNA, 64 nt, Human
agcaaaguuuuuauacugaaacuugauuauugcugcccuuuauaauuuccucuucaaugauauu

SEQ ID NO: 468880 - RNA, 64 nt, Human
ggggaggcggcucuggcucuugccuucccagcaugcccuuuacuacaaagggcuauuuuucuuu

SEQ ID NO: 468881 - RNA, 64 nt, Human
aggacauuaaauucuuucccugguaaugaaaagagcccuuuaucaauacagugcugcaauuucu

SEQ ID NO: 468882 - RNA, 64 nt, Human
aauuucagaucguguuuccaaacacccuugcugugcccuuuaaugggauugaaagcacuuuuac

SEQ ID NO: 468883 - RNA, 64 nt, Human
gccugugauauguggaugcagcuguccagccacugcccuuuaacaugcccagcacacaugggag

SEQ ID NO: 468884 - RNA, 60 nt, Human; identical to SEQ ID NO: 455515

SEQ ID NO: 468885 - RNA, 60 nt, Human; identical to SEQ ID NO: 445225

SEQ ID NO: 468886 - RNA, 60 nt, Human; identical to SEQ ID NO: 455531

SEQ ID NO: 468887 - RNA, 64 nt, Human
aaguggagaaauagcaguccauuuucucuugcaagcccuuuaccauugaguugaaauucuugaa

SEQ ID NO: 468888 - RNA, 64 nt, Human
gaguugcaagcugaauuggcuguguucaaggcaugcccuuuagaauugaaagaacuagcagauu

SEQ ID NO: 468889 - RNA, 64 nt, Human
acuguugcaaaguauuuaagcaccccccaucucagcccuuuauuuuaucuuucaugugggcuaa

SEQ ID NO: 468890 - RNA, 64 nt, Human
aauuuucuaacgaguggaccauuaucacuuuaaagcccuuuauuuauaauacauuuccuacggg

SEQ ID NO: 468891 - RNA, 64 nt, Human
gguaauaugcuauaccccacugcugcccgacacugcccuuuagcugcagagcuggauuagcugu

SEQ ID NO: 468892 - RNA, 64 nt, Human
caaaguuaagacagauuuuugcuaagugcaggaggcccuuuauuauugcugcagaaaacaaaag

SEQ ID NO: 468893 - RNA, 64 nt, Human
gcuggaccugagcuugggcaacagcauuagguaugcccuuuacuuuuuuuguucugacuuuccu

SEQ ID NO: 468894 - RNA, 64 nt, Human
cuaauccaucucugcaagcucccuguguuuccuugcccuuuagaaaaugaauuguucacuacaa

SEQ ID NO: 468895 - RNA, 64 nt, Human
acagagacacaucuuaaggggacccacaaguauugcccuuuaacaagacuucaaaguuuucugc

SEQ ID NO: 468896 - RNA, 64 nt, Human
uugcacaaagcuuuauaaagggaauucaaaggaagcccuuuagaauuagagucuugagggacag

SEQ ID NO: 468897 - RNA, 64 nt, Human
cugugucugggcacagacaaucacaauaaaugcagcccuuuauuacuguuaaggaucauacugu

SEQ ID NO: 468898 - RNA, 64 nt, Human
gaugggcugugggucccuggaaagggggagaguugcccuuuacagaaucacucgagcccuuucc

SEQ ID NO: 468899 - RNA, 64 nt, Human
ugcuccaggccucuugcuaagccuucuccucacugcccuuuaggcucccagggccagaggagcc

SEQ ID NO: 468900 - RNA, 64 nt, Human
gugaugaggaagcauuuagcugaauaaguuuaaagcccuuuauacagagaauucuacaaguuug

SEQ ID NO: 468901 - RNA, 64 nt, Human
uacuaagcuggugcuuugcaugguagcaagugcugcccuuuaucagcacccugggucauagugu

SEQ ID NO: 468902 - RNA, 64 nt, Human
uuuguuuuuuuuugaaggggguggugugggaguggcccuuuaacucuauuuggcuaucugagga

SEQ ID NO: 468903 - RNA, 60 nt, Human; identical to SEQ ID NO: 455533

SEQ ID NO: 468904 - RNA, 60 nt, Human; identical to SEQ ID NO: 455543

SEQ ID NO: 468905 - RNA, 60 nt, Human; identical to SEQ ID NO: 455544

SEQ ID NO: 468906 - RNA, 64 nt, Human
uaaacaugaguaggucccuugguugcugucacuugcccuuuaauaguguugauguagucagugc

SEQ ID NO: 468907 - RNA, 64 nt, Human
guuucacucagccuacauacauaauaaaaucuaagcccuuuaauuagagauagcaacuuuccca

SEQ ID NO: 468908 - RNA, 64 nt, Human
aagauccuuccagacucaucugucagagccccaagcccuuuagacccagagcccaaggaccaug

SEQ ID NO: 468909 - RNA, 64 nt, Human
cauggcaauaacucauaaucugauuuggagguuugcccuuuacaggggcagauuuucugcucag

SEQ ID NO: 468910 - RNA, 64 nt, Human
aggccagagggcaguggcccuccaccuuguuccugcccuuuaacuuucagaggcaauagguaaa

SEQ ID NO: 468911 - RNA, 64 nt, Human
gaacuuccucagauggacaagauuaccccaccuugcccuuuacguaucugcucuuaggugcuuc

SEQ ID NO: 468912 - RNA, 64 nt, Human
uuuccaaacugcaaacuuugcuuugaaaaguuuagcccuuuaaggaaugaaaucauguagaauu

SEQ ID NO: 468913 - RNA, 64 nt, Human
cucaccccuaccucuuuuguuuuguuuuguuuuugcccuuuauguacuacauucuuauuuucua

SEQ ID NO: 468914 - RNA, 64 nt, Human
agaaguaacuaauccgggaaaagugaacauaugggcccuuuaaagacuacaagauuugcuagau

SEQ ID NO: 468915 - RNA, 64 nt, Human
guucugucauugucucccaaaguauuuaggagaagcccuuuaaaaagcugccuuccucuaccac

SEQ ID NO: 468916 - RNA, 64 nt, Human
cacuaucuaucuuucucucuccaaaugucacugagcccuuuagauguuuauauucaccacgaga

SEQ ID NO: 468917 - RNA, 64 nt, Human
guaggcucauaaaguugugaaaaggguuucauaugcccuuuaguuuucauuugggauucaucca

SEQ ID NO: 468918 - RNA, 64 nt, Human
gaugccucaagguauugguagcaagcaagauuuugcccuuuaguuuucgaagacaccuuucuuu

SEQ ID NO: 468919 - RNA, 64 nt, Human
uuuuuuuuggaccuaaauaauaauaaaaaaaaaagcccuuuaaacuuuguaaggaaauauuuuu

SEQ ID NO: 468920 - RNA, 64 nt, Human
uaacauagauuauccaggcugagauggaaaacaagcccuuuauugaauuuucaacacagacucc

SEQ ID NO: 468921 - RNA, 64 nt, Human
uagguaaaaugggcuauuaggaugauccuugaaagcccuuuagaagggugccauguuggaaacc

SEQ ID NO: 468922 - RNA, 60 nt, Human; identical to SEQ ID NO: 455545

SEQ ID NO: 468923 - RNA, 60 nt, Human; identical to SEQ ID NO: 445337

SEQ ID NO: 468924 - RNA, 60 nt, Human; identical to SEQ ID NO: 455578

SEQ ID NO: 468925 - RNA, 64 nt, Human
aguaggagacaguaucccaggcugacaagggcuugcccuuuaccuugggcaccuuguuaauuuu

SEQ ID NO: 468926 - RNA, 64 nt, Human
uguuucuugggauuggugggaaaugucaaaacaugcccuuuauuuuuaaaggcauucacaaacu

SEQ ID NO: 468927 - RNA, 64 nt, Human
uuaugaccccuauggaugaucuuuaggaaaagcagcccuuuacuuuuaauacaggcuuuaauga

SEQ ID NO: 468928 - RNA, 64 nt, Human
uuugcauuacauaauaauuuuguggaagcauuuugcccuuuagaauaaauauuagauugauaua

SEQ ID NO: 468929 - RNA, 64 nt, Human
uguuuuugauaauccaaagcgaucaugucaguuggcccuuuaauauuuccaaugugaaagauua

SEQ ID NO: 468930 - RNA, 64 nt, Human
agacauugucuggaaaucuagaaaucaucuccuugcccuuuaagguauuuuaacccucgcauuc

SEQ ID NO: 468931 - RNA, 64 nt, Human
gcuggucugcaaagccuaaaauauguccuguguggcccuuuacagaaaaaguuuucuaaccccu

SEQ ID NO: 468932 - RNA, 64 nt, Human
uuuuugauccuccuggaauaugagaggaugggaggcccuuuagaaccugccucaaugccaucuc

SEQ ID NO: 468933 - RNA, 64 nt, Human
aacucuuccaaugggacauugaugaucacauucugcccuuuacuacaggacagaaaccacuuag

SEQ ID NO: 468934 - RNA, 64 nt, Human
ggggagggugacccacagcucugggccucuuuuugcccuuuagggcuguugcuagggagaggga

SEQ ID NO: 468935 - RNA, 64 nt, Human
ucccauucuaguuacagaggagcuuuccuuaaaugcccuuuaacuucuagguuuuguucaagaa

SEQ ID NO: 468936 - RNA, 64 nt, Human
ugcacgagagugguuugguuuagcugccucugcugcccuuuacugugacaagcaaggagggguu

SEQ ID NO: 468937 - RNA, 64 nt, Human
cucauggguuugugacagccccugcgugcucagugcccuuuaagugcaucccgcugugcugacu

SEQ ID NO: 468938 - RNA, 64 nt, Human
cuacuuuaggugggcauuuucuucccuagaauaugcccuuuauuaugcuaucauugcuagauuu

SEQ ID NO: 468939 - RNA, 64 nt, Human
caguguauuagccggcuguggcuccagagucugugcccuuuaccaccgugcccaacuguuucac

SEQ ID NO: 468940 - RNA, 64 nt, Human
caaccaccaccacaaugacagaaaugacaacaaggcccuuuaacuugucuucuaguuuagagac

SEQ ID NO: 468941 - RNA, 60 nt, Human; identical to SEQ ID NO: 455425

SEQ ID NO: 468942 - RNA, 60 nt, Human; identical to SEQ ID NO: 445395

SEQ ID NO: 468943 - RNA, 60 nt, Human; identical to SEQ ID NO: 455459

SEQ ID NO: 468944 - RNA, 64 nt, Human
uuucuguguuuuauauuaucuugcaaauccuuuugcccuuuaaaaagcugaaaaucuugccauc

SEQ ID NO: 468945 - RNA, 64 nt, Human
auacauguguuucauaaccugccuccuuugcuuggcccuuuauugagauaaguuuuccugucaa

SEQ ID NO: 468946 - RNA, 64 nt, Human
aaaauaggucauauccugccacucccgucgcagagcccuuuaaugguuccaaacccuaagucca

SEQ ID NO: 468947 - RNA, 64 nt, Human
ccugaacagacaguucuggggccggcagugcugggcccuuuagcuccuuggcacuuccaagcug

SEQ ID NO: 468948 - RNA, 64 nt, Human
gaacccuuagccuucuucuguuuugccuuuucacgcccuuuauagugugaaaugaaaaauuagu

SEQ ID NO: 468949 - RNA, 64 nt, Human
guugaaacaggaaaaccaccagacucuaaucucagcccuuuaacgacauacgcauuggagcgca

SEQ ID NO: 468950 - RNA, 64 nt, Human
cacacgagggcuuuuguauuguucuacuuuuucagcccuuuacuuucuggcugaagcauccccu

SEQ ID NO: 468951 - RNA, 64 nt, Human
cugucccuggaugaagagcugucaccucugccuugcccuuuaacucaacccgcuucccagcaca

SEQ ID NO: 468952 - RNA, 64 nt, Human
uuaaaaaauaauauaagcuacagaaaccagguaagcccuuuauuuccuuaaauguuuugccagc

SEQ ID NO: 468953 - RNA, 64 nt, Human
uguuagcccacaguucucugcaguggugccgucagcccuuuaaauggcccaccccaggcagacu

SEQ ID NO: 468954 - RNA, 64 nt, Human
gcacuuccugcaugcgcccccggcaccugacucugcccuuuauguauuauccacacgauguuuu

SEQ ID NO: 468955 - RNA, 63 nt, Human
accgagguucauuugauugauuguaugcaaauagcccuuuauuuacaugccacuauuaagcug

SEQ ID NO: 468956 - RNA, 64 nt, Human
ucauucauuuagugcuaccaaaggggauacacaagcccuuuaggaagcaguaccucucgccugg

SEQ ID NO: 468957 - RNA, 64 nt, Human
ugaguugaccuguggccucgcacagugauucugggcccuuuaugcuugcugucucucagaauug

SEQ ID NO: 468958 - RNA, 64 nt, Human
uauaaaacuuucuguguuagcgacgguaucuauagcccuuuauacgagcgauggaucuugagcu

SEQ ID NO: 468959 - RNA, 64 nt, Human
uuccuaguggccacugaguuccaggcacacuggugcccuuuacugccacagcugcucaccuugu

SEQ ID NO: 468960 - RNA, 60 nt, Human; identical to SEQ ID NO: 455580

SEQ ID NO: 468961 - RNA, 60 nt, Human; identical to SEQ ID NO: 455595

SEQ ID NO: 468962 - RNA, 60 nt, Human; identical to SEQ ID NO: 455596

SEQ ID NO: 468963 - RNA, 64 nt, Human
ucaugucuaggagcccucugucagaauccuugaagcccuuuaauggucuaacuggcaucucuug

SEQ ID NO: 468964 - RNA, 64 nt, Human
aagacucuccccuccacuguccgggacagcguucgcccuuuagcggggaggucauuacagccuc

SEQ ID NO: 468965 - RNA, 64 nt, Human
aauccuguccacaaggcaacuccagaagaaagaagcccuuuacauuuccauaaaacacuuuaga

SEQ ID NO: 468966 - RNA, 64 nt, Human
gcaaguauuaccuuuaacuugccucuuacucuuugcccuuuagcuaacuaauaaaguuugauau

SEQ ID NO: 468967 - RNA, 64 nt, Human
ccucgcccuguccccacagccgaguccugcaucagcccuuuauccucacacgcuuuucuacaau

SEQ ID NO: 468968 - RNA, 64 nt, Human
acucugccucuguucucuugcauucuguuugguugcccuuuaguuuccuaguaaaugcuccuuu

SEQ ID NO: 468969 - RNA, 64 nt, Human
ccaccaggucucugagcucaguguuaccaaauucgcccuuuaacagcuugcucuggcaacccca

SEQ ID NO: 468970 - RNA, 64 nt, Human
ucggggacacagguggggccacucacugguacuggcccuuuagugcuuugccugaaagagacac

SEQ ID NO: 468971 - RNA, 64 nt, Human
aaagucaguguuaauucuaaagaugaucauuucugcccuuuagaauggcuugucccaucagcag

SEQ ID NO: 468972 - RNA, 64 nt, Human
uuagguuauauuuucagcagugguuuuuuccuuugcccuuuaaggaguggggauaauguccacg

SEQ ID NO: 468973 - RNA, 64 nt, Human
acucuguagaagauguaugcaaagugaaaugccagcccuuuaaagagacauuaguuaguguaaa

SEQ ID NO: 468974 - RNA, 64 nt, Human
ccucgcccugcccccggagccgaguccuguaucagcccuuuauccucacacgcuuuucuacaau

SEQ ID NO: 468975 - RNA, 64 nt, Human
caguaccagcccuuguccucugccuguggacugagcccuuuauucccucucacaccacccuccg

SEQ ID NO: 468976 - RNA, 64 nt, Human
cuuuuuguguuuuuauauugacucugcggcgcgggcccuuuaauaaagcuaggauacgccuuug

SEQ ID NO: 468977 - RNA, 64 nt, Human
uuuuccccaaaccccuccaucggcaagucuaguugcccuuuagcaccuaaagaucugcacccca

SEQ ID NO: 468978 - RNA, 64 nt, Human
agugccuaucuaaaagcaauuaaagacugugucugcccuuuagaagcuaagaauuugauucaug

SEQ ID NO: 468979 - RNA, 60 nt, Human; identical to SEQ ID NO: 455597

SEQ ID NO: 468980 - RNA, 60 nt, Human; identical to SEQ ID NO: 445338

SEQ ID NO: 468981 - RNA, 60 nt, Human; identical to SEQ ID NO: 455612

SEQ ID NO: 468982 - RNA, 64 nt, Human
gguagagaggacaaagaauguggggcugguuucugcccuuuaagagcacccggucagucagaga

SEQ ID NO: 468983 - RNA, 64 nt, Human
gccugggccuggaaaaagaaaucucuacguuccugcccuuuacuauugcugauggagccugggg

SEQ ID NO: 468984 - RNA, 64 nt, Human
gaucauaguccaacagggccagcuucccuugggggcccuuuaaggaauggggugaaugaaauug

SEQ ID NO: 468985 - RNA, 64 nt, Human
gaauaagguggaagacaaaugucucuguucuuuggcccuuuaagaguuagcuuuuuaccugcac

SEQ ID NO: 468986 - RNA, 64 nt, Human
gccaugcccuccugcuccccccaccccagcccuagcccuuuagccuuucacccugugcucugga

SEQ ID NO: 468987 - RNA, 64 nt, Human
gggcaggcugggaacagagcggagaaugcccauggcccuuuauuccuucuucccucgguccacg

SEQ ID NO: 468988 - RNA, 64 nt, Human
aauuuuugugaauacuuaaaaguccuuucuuuuugcccuuuauucaauuaguccuaauguuuca

SEQ ID NO: 468989 - RNA, 64 nt, Human
uuuuuauuguacauucuauuccuguaauuauugugcccuuuaaguguuguaaaaucguuuugga

SEQ ID NO: 468990 - RNA, 64 nt, Human
aaaucuaggaaaauauuuugaucuucaacaaauugcccuuuagucuccccguaugaguuagaau

SEQ ID NO: 468991 - RNA, 64 nt, Human
gauuuuuaaaauuauuagcacacaacuauuuucagcccuuuaauaauggagcaucaaaaacauc

SEQ ID NO: 468992 - RNA, 64 nt, Human
auccguucauagaaauuguguuugcuaacaaggugcccuuuagccagaugcuaggcugucugcg

SEQ ID NO: 468993 - RNA, 64 nt, Human
aaagaucgugacgcugguuggaauuucugacugugcccuuuagggccuccugaguuucaaaagg

SEQ ID NO: 468994 - RNA, 64 nt, Human
guuuuguguaagaggaaauacaaauaaaguuauagcccuuuacugcacgaccaugcugcccccu

SEQ ID NO: 468995 - RNA, 64 nt, Human
cguccucaccuaagaggcccugcccccuacccuugcccuuuaacuuauugggacugaauaaaga

SEQ ID NO: 468996 - RNA, 64 nt, Human
gcuuuauucuaaacucugaggguaauaugccucugcccuuuagucagacucugugcaaauugug

SEQ ID NO: 468997 - RNA, 64 nt, Human
uaaccccauauggcccaagaguagcucguaggaggcccuuuaaagacggaacaaguaauuuacc

SEQ ID NO: 468998 - RNA, 60 nt, Human; identical to SEQ ID NO: 455614

SEQ ID NO: 468999 - RNA, 60 nt, Human; identical to SEQ ID NO: 455629

SEQ ID NO: 469000 - RNA, 60 nt, Human; identical to SEQ ID NO: 455630

SEQ ID NO: 469001 - RNA, 64 nt, Human
gcacaaaaugaagggacuaguuaaggauuaacuagcccuuuaaggauuaacuaguuaaggauua

SEQ ID NO: 469002 - RNA, 64 nt, Human
agccaaggagccggcgucauccgacguaacuuccgcccuuuaacgcuccugcggacgcccccuu

SEQ ID NO: 469003 - RNA, 64 nt, Human
cuuuucucugcagcacgauuucucuuuugauaaugcccuuuagggcacaacuaguuaucaguaa

SEQ ID NO: 469004 - RNA, 64 nt, Human
ucauccuuagcaccacagacuucugagguccugugcccuuuacuugcuggugaggugucauagg

SEQ ID NO: 469005 - RNA, 64 nt, Human
cuccuucuccccauuucugucccacaggccuucagcccuuuaacgucucugccaaaaaccagca

SEQ ID NO: 469006 - RNA, 64 nt, Human
uggugauuuguacugcuuuauggucauuugaagggcccuuuaguuuuuaugauaauuuuuaaaa

SEQ ID NO: 469007 - RNA, 64 nt, Human
ccuuuugcagugaguacaguuuauuaaguugucagcccuuuaauauuggggaaacuuaaugagu

SEQ ID NO: 469008 - RNA, 64 nt, Human
uuuagacaacuuccuuuuuguaguggugaaccuugcccuuuaguacaguucaagugaaucugga

SEQ ID NO: 469009 - RNA, 64 nt, Human
aaaacuacuguuaacacugcuaaugaaagaaaaugcccuuuaacuuucuaaugauuauagauaa

SEQ ID NO: 469010 - RNA, 64 nt, Human
cucagccucugacccauuuuauaacugaaauuuagcccuuuagagcuuguuauaucugguuuuc

SEQ ID NO: 469011 - RNA, 64 nt, Human
ugacugguuuggcuggagucccaugaggaugugggcccuuuaauaaaggauagcaaacagggag

SEQ ID NO: 469012 - RNA, 64 nt, Human
cacucaucccuggucugguccccuguugccuauagcccuuuacccugagcaccaccccaacaga

SEQ ID NO: 469013 - RNA, 64 nt, Human
gcucuggacaccccaaagagcuccugcccucucagcccuuuauucaagccucagauuucugcuc

SEQ ID NO: 469014 - RNA, 64 nt, Human
caggccugggcggugcagcuuccagagagcgagcgcccuuuagcggccugccaccacagcacgc

SEQ ID NO: 469015 - RNA, 64 nt, Human
ucacucuuccgcuagggauaaagcagauguggaugcccuuuaagagauauuaaaugcuuuuauu

SEQ ID NO: 469016 - RNA, 64 nt, Human
caagucuuauuuccucaacguugcuccccaucaagcccuuuacuugaccuccuaacaaguagca

SEQ ID NO: 469017 - RNA, 60 nt, Human; identical to SEQ ID NO: 455631

SEQ ID NO: 469018 - RNA, 60 nt, Human; identical to SEQ ID NO: 445339

SEQ ID NO: 469019 - RNA, 60 nt, Human; identical to SEQ ID NO: 455643

SEQ ID NO: 469020 - RNA, 64 nt, Human
aagucagagggcucucagccuucauccagccgcagcccuuuagaguuccugaaggaggcagguu

SEQ ID NO: 469021 - RNA, 64 nt, Human
auugcccugugagggcucacucggcuuccagggagcccuuuacccuauuugucuccuucccucu

SEQ ID NO: 469022 - RNA, 64 nt, Human
aagcuaacacauuuugagcuagacaguauucuaggcccuuuaugauuguugagcauuaauccuc

SEQ ID NO: 469023 - RNA, 64 nt, Human
cacuguuuacaugaccuauuugugugguuauauagcccuuuauuuaaaagagagaaguuccuuu

SEQ ID NO: 469024 - RNA, 64 nt, Human
acugcaucagcccuagacccccagagccagucccgcccuuuacagagcagcccuuagccugggg

SEQ ID NO: 469025 - RNA, 64 nt, Human
uuuagucucaaucucaccuaaaugaaucaggucugcccuuuaucuugcccuuuucauucuacca

SEQ ID NO: 469026 - RNA, 64 nt, Human
guaugaaggaaucauuccagugcuagaaaauuuagcccuuuaaaacgucuuagagccuuuuauc

SEQ ID NO: 469027 - RNA, 64 nt, Human
uggugggggaauggcaaacuggacccaggacuccgcccuuuaaaacacccugaacuuacuggaa

SEQ ID NO: 469028 - RNA, 64 nt, Human
uguaaaaauucccccaagagccgcauaugaaucugcccuuuaauaaagcauuauugagauugcu

SEQ ID NO: 469029 - RNA, 64 nt, Human
uuggagaauaguuuuaauauaguaaauguaggaagcccuuuagccauauugaaaacaaauaucu

SEQ ID NO: 469030 - RNA, 64 nt, Human
aagccguugccaaaccccacccauaaaucaaugggcccuuuauuuaugacgacuuuauuuauuc

SEQ ID NO: 469031 - RNA, 64 nt, Human
uaauguaaagagaauacgauggccuuuagaaaaugcccuuuagcagagaauuuguaauuuaaga

SEQ ID NO: 469032 - RNA, 64 nt, Human
cgucccccuaccacacucccccuccuagaccgccgcccuuuaacacagucuggauuuaauaaau

SEQ ID NO: 469033 - RNA, 64 nt, Human
caaaugucaucucccaggaguuauucaagggugagcccuuuacuugggauguacaggcuuugag

SEQ ID NO: 469034 - RNA, 64 nt, Human
cacuucauuuuguuuuuaguuggagaacucuauagcccuuuaguuauuuuucuuuucacuuuuu

SEQ ID NO: 469035 - RNA, 64 nt, Human
gaaaagcggcaugcagugaaaugagcagugagcagcccuuuagcaaaaucgcccuccaguccuu

SEQ ID NO: 469036 - RNA, 60 nt, Human; identical to SEQ ID NO: 455645

SEQ ID NO: 469037 - RNA, 60 nt, Human; identical to SEQ ID NO: 455662

SEQ ID NO: 469038 - RNA, 60 nt, Human; identical to SEQ ID NO: 455663

SEQ ID NO: 469039 - RNA, 64 nt, Human
ugggguggccuggccccuucucugcuuaaagaaugcccuuuaugaugcacugauuccaucccag

SEQ ID NO: 469040 - RNA, 64 nt, Human
gcagucuuugagauaauuuguuuuuaccuguauugcccuuuaucuuuuuuagguaauucuuugu

SEQ ID NO: 469041 - RNA, 64 nt, Human
gaaggcuggagccagggagcgcuggaggaaaccagcccuuuagccagcagccccuccaccacag

SEQ ID NO: 469042 - RNA, 64 nt, Human
gaagcauggcggccuccagacugacccauugguugcccuuuagauuuuguaaggaugcggugcu

SEQ ID NO: 469043 - RNA, 64 nt, Human
gccacagcccaacauugaggagcccucgaugacugcccuuuacaacucauauucaguucugccu

SEQ ID NO: 469044 - RNA, 51 nt, Human
ugcagacuaaagggagcuagagcccuuuauuucuuccaaccuugcaaggac

SEQ ID NO: 469045 - RNA, 64 nt, Human
cuguucuauagaguuaaaccuuuuaacuuccauggcccuuuagaucucuuucaagcacauucca

SEQ ID NO: 469046 - RNA, 64 nt, Human
cgguccugggugcucgcugcugugcaagacauuagcccuuuaguuaugagccugugggaacuuc

SEQ ID NO: 469047 - RNA, 64 nt, Human
gugcugggauuacugacaugagccaccacacucagcccuuuaaaccuuucccuggccuuuccca

SEQ ID NO: 469048 - RNA, 64 nt, Human
cugcagcagcaggacacaucuuuccucuuacucagcccuuuauggcccauggggaacuccgugg

SEQ ID NO: 469049 - RNA, 64 nt, Human
ugggcugggaggauuugacagcauuuccccaguugcccuuuaaguucuucuauuucaaacguua

SEQ ID NO: 469050 - RNA, 64 nt, Human
caccaaugccuucuuaguguggaaucauuuuucugcccuuuagucguuuuuguuuuguagaaag

SEQ ID NO: 469051 - RNA, 64 nt, Human
ccccagcauuaaguaaaucagucucaggcagacagcccuuuauagguguuugggccaggugcgg

SEQ ID NO: 469052 - RNA, 64 nt, Human
cugagaaacggucaucacugacgacugccgcccugcccuuuacacaguccauccucacucaggu

SEQ ID NO: 469053 - RNA, 64 nt, Human
gaaauguucccuuuaaucuucaaguucgagaucagcccuuuaaguaccuuucuguugcagccca

SEQ ID NO: 469054 - RNA, 64 nt, Human
gaaccauugcuagagaaugaucuuuacugaauuugcccuuuauaagaaacccagugaauuucua

SEQ ID NO: 469055 - RNA, 60 nt, Human; identical to SEQ ID NO: 455664

SEQ ID NO: 469056 - RNA, 60 nt, Human; identical to SEQ ID NO: 445356

SEQ ID NO: 469057 - RNA, 60 nt, Human; identical to SEQ ID NO: 455700

SEQ ID NO: 469058 - RNA, 64 nt, Human
uagggaccccaaaugaccacaacacaguacaauugcccuuuaccuagggcuaccauuuccuagc

SEQ ID NO: 469059 - RNA, 64 nt, Human
cauaucaucugggauuuugccaauauacgucaaagcccuuuaagagucaugguaaggagauggg

SEQ ID NO: 469060 - RNA, 64 nt, Human
ugaagcaauuuggcuggcaucuagaucauucacagcccuuuaaaggucaccuuugcuguucucc

SEQ ID NO: 469061 - RNA, 64 nt, Human
auuguaauguuuccaguugggccaacuauuucuagcccuuuaguucuuuuucauguugacagau

SEQ ID NO: 469062 - RNA, 64 nt, Human
cccuugagcuccuuaccaccccuuuuccugcucggcccuuuaaucccugacagaccuggacugu

SEQ ID NO: 469063 - RNA, 64 nt, Human
ccccugugucccgaacccggagcggaggcgcccaacccggcagacgggugcaggcccggccuuu

SEQ ID NO: 469064 - RNA, 64 nt, Human
aacccugcuuccagccauggccaggggccacggaacccggcaggggugucugaggccgcccugu

SEQ ID NO: 469065 - RNA, 64 nt, Human
cacguucugagaaggggccggccggagggaggggacccggcagggagauuucgguuuugagguu

SEQ ID NO: 469066 - RNA, 64 nt, Human
ggugcaugcacugucucagccaacccgcuccacuacccggcaggguacacauucgcaccccuac

SEQ ID NO: 469067 - RNA, 64 nt, Human
cuuucacuucuucagagaagcagggaugguaccuacccggcagguagguuagauguggguggug

SEQ ID NO: 469068 - RNA, 64 nt, Human
uuuugccaacuuaaacgagaaaaagaccccccgcacccggcacacucccccuuccuccagcccc

SEQ ID NO: 469069 - RNA, 64 nt, Human
cuuggaguccuuucuguuuugaagcaugggccagacccggcacugcgcucggagagccgguggg

SEQ ID NO: 469070 - RNA, 64 nt, Human
aggagggaccagaaugaggauacgugagaaauagacccggcaggcagucagacugaaugggagc

SEQ ID NO: 469071 - RNA, 64 nt, Human
aacaaaaagcccguggcaauuaaugguaaaggaaacccggcauuucaguguaaagagguaacau

SEQ ID NO: 469072 - RNA, 64 nt, Human
uuaagggagcugcucaagcaauagcagagguuucacccggcaggaugacacagaccacuuccca

SEQ ID NO: 469073 - RNA, 60 nt, Human; identical to SEQ ID NO: 455702

SEQ ID NO: 469074 - RNA, 60 nt, Human; identical to SEQ ID NO: 455719

SEQ ID NO: 469075 - RNA, 60 nt, Human; identical to SEQ ID NO: 455720

SEQ ID NO: 469076 - RNA, 64 nt, Human
augacagguauggaguucacacugugugcugccgacccggcaaguuugacagcacccaaacugg

SEQ ID NO: 469077 - RNA, 64 nt, Human
ggacaagcacggcuucuccuuucgguucccauggacccggcaccccaccugcaugacgauuuau

SEQ ID NO: 469078 - RNA, 64 nt, Human
ucgugcuaagauaacagacuccagcuccugguccacccggcaugucagucagcacucuggccuu

SEQ ID NO: 469079 - RNA, 64 nt, Human
cugcuucucccaccuugggaaggagaaaugugaaacccggcagcggccgaccuaggcggucuug

SEQ ID NO: 469080 - RNA, 64 nt, Human
gccugugcugggccaguggcugggggugcuagacacccggcaccauucucccuucucucuuuuc

SEQ ID NO: 469081 - RNA, 64 nt, Human
caggcccgcccugcccgcgcccgccgccucccucacccggcaaggggcgcgcgcccccaggacc

SEQ ID NO: 469082 - RNA, 64 nt, Human
gugaaguaaaauaaaggcucaaaacgugacggcaacccggcaaaaggguagggagccaggccga

SEQ ID NO: 469083 - RNA, 64 nt, Human
gggacgacgcugacugcccuggaggccgcagccaacccggcacugcccucagacuucaagacca

SEQ ID NO: 469084 - RNA, 64 nt, Human
ccaaagugcugggauuaccggcuugagccaccacacccggcacaucuucauucuuuuuauguag

SEQ ID NO: 469085 - RNA, 64 nt, Human
gcgcuaugccccggacaaaacgagcacagugcugacccggcacagccagccggccacgcccacg

SEQ ID NO: 469086 - RNA, 64 nt, Human
guuuuucccuaccugcccgguuccuuuccugaggacccggcagaaaugcagaaccauccaugga

SEQ ID NO: 469087 - RNA, 64 nt, Human
agcggggguggggcugcacccaguggauugggucacccggcagaccuagggaaggugaggcgag

SEQ ID NO: 469088 - RNA, 64 nt, Human
gccccggccugacccggggaccuucagccuggacacccggcagcuucuggaguuugucagugga

SEQ ID NO: 469089 - RNA, 64 nt, Human
uuccucccagccgggaucacagugggcagccggcacccggcaccacuuuggcgagcguccugcu

SEQ ID NO: 469090 - RNA, 64 nt, Human
cggacuuguacucggggccgugggcucggcccggacccggcauucggacuuggacucgggaagg

SEQ ID NO: 469091 - RNA, 64 nt, Human
ccagcuggguacggugccacguucaggcacgugcacccggcaagguucagggcacauaccuacc

SEQ ID NO: 469092 - RNA, 60 nt, Human; identical to SEQ ID NO: 455721

SEQ ID NO: 469093 - RNA, 60 nt, Human; identical to SEQ ID NO: 445357

SEQ ID NO: 469094 - RNA, 60 nt, Human; identical to SEQ ID NO: 455776

SEQ ID NO: 469095 - RNA, 64 nt, Human
gcccauuccccgagagcugucggaaccagaugcaacccggcagcccagagaacucuccugggag

SEQ ID NO: 469096 - RNA, 64 nt, Human
cccugacccucccauggcccucuccaggacucccacccggcagaucggcucuauugacacagau

SEQ ID NO: 469097 - RNA, 64 nt, Human
ggaggaacacgagacuuucuuugacacccagaagacccggcaacgaggaggaaggccucgcggu

SEQ ID NO: 469098 - RNA, 64 nt, Human
caggcucucccggggucucaugcuuugcccacugacccggcaguucugagccuggcuuuggcac

SEQ ID NO: 469099 - RNA, 64 nt, Human
ugccccaggcacccucugcccugcccggccaaauacccggcauuauggggacagagagcagggg

SEQ ID NO: 469100 - RNA, 64 nt, Human
gagucgagcuggggcacacacacaccuggccgggacccggcagggacaaggcgggccguggccu

SEQ ID NO: 469101 - RNA, 64 nt, Human
guggaauaacgccagcccugcugugccccaucacacccggcaucuacacaagauccgccgggcc

SEQ ID NO: 469102 - RNA, 64 nt, Human
uccacugcaagagucuggcucucccuucucugugacccggcaugacugggcgccuggagcaguu

SEQ ID NO: 469103 - RNA, 59 nt, Human
acagccuggagcagggcugaggacgcugcacccggcaggaggagggcgacugggggccc

SEQ ID NO: 469104 - RNA, 64 nt, Human
uggagaggaaaggagccacaggagcgggugcuacacccggcaagacagagcgucuccaucuaaa

SEQ ID NO: 469105 - RNA, 64 nt, Human
cagcguucaaucaagcucaccaugcagggcagucacccggcaguucucaaacuuuagcauguga

SEQ ID NO: 469106 - RNA, 64 nt, Human
agggucauaggccccaagaaggcuuccagacagaacccggcacuguagagcuacagaguuccuu

SEQ ID NO: 469107 - RNA, 64 nt, Human
cucgguggcccaauagcucguguaucuaaguugaacccggcaguaugcaugauugccuuuuucu

SEQ ID NO: 469108 - RNA, 64 nt, Human
gauguagcuagcauuuugaaaccauaugggcaaaacccggcaaccagaaggggacagauaagga

SEQ ID NO: 469109 - RNA, 64 nt, Human
gucuacccugggauucaggaaaaggccuggggugacccggcacccccugcagcuuguagccagc

SEQ ID NO: 469110 - RNA, 64 nt, Human
aagaaaguggcgcuguguagggcuauuuccacccacccggcagcucuuaggacacauucccaga

SEQ ID NO: 469111 - RNA, 60 nt, Human; identical to SEQ ID NO: 455855

SEQ ID NO: 469112 - RNA, 62 nt, Human; identical to SEQ ID NO: 455856

SEQ ID NO: 469113 - RNA, 64 nt, Human
acuguugcaccaagccacugcaagagaaacccccacccggcaagcccgccccaucccagacagg

SEQ ID NO: 469114 - RNA, 64 nt, Human
uccaucuacaucagaaccaaacuacuucuccaacacccggcagcacuuggcccugcaagcuuag

SEQ ID NO: 469115 - RNA, 64 nt, Human
ugcaaaaaaugggaaguaagguccuggcaggcagacccggcauguagccgcuggccaucuugaa

SEQ ID NO: 469116 - RNA, 64 nt, Human
ccugucauuucgugaaugaaucucagacgcuguaacccggcaucgagugcugaccuuguaaugu

SEQ ID NO: 469117 - RNA, 64 nt, Human
agcaagcagcguggcuggaagcugaugggaaacgacccggcacgggcauccugugugcggcccg

SEQ ID NO: 469118 - RNA, 64 nt, Human
uagaaccuguagagcuagaacauggagagcuagaacccggcaggcuagaaccuggcaagcuaga

SEQ ID NO: 469119 - RNA, 64 nt, Human
cuagaguugaaaggauugacauuucucaguaacuacccggcaaaauauauauuuucauaauguu

SEQ ID NO: 469120 - RNA, 64 nt, Human
gccauggagucccaccugugccaggucagagcccacccggcagguuucagaguggucagcccag

SEQ ID NO: 469121 - RNA, 64 nt, Human
ucaucucccuuugggauuggaacgagccacaccuacccggcagaccccucuuccuacagccccc

SEQ ID NO: 469122 - RNA, 64 nt, Human
uugggcaucaauggcaccuccacacagccgaagcacccggcaucuuggugggggcaccuuuuua

SEQ ID NO: 469123 - RNA, 64 nt, Human
ugaagcugugcaaacccacccuuuaaaccauuccacccggcaguauucagcuucuuaaccaguc

SEQ ID NO: 469124 - RNA, 64 nt, Human
caccaucccacugcccccucgcucccauguuuccacccggcacccugauccucacccgaaucuc

SEQ ID NO: 469125 - RNA, 64 nt, Human
cagcugguguuaagaauguagguuaccgggcaugacccggcagaugcuugcccaguaguucugg

SEQ ID NO: 469126 - RNA, 64 nt, Human
uuccagacccugagaaaaaagccacccugaauuuacccggcaugcacucuucagauaagccaug

SEQ ID NO: 469127 - RNA, 64 nt, Human
gcugcauccugagccccugcaugcacccagggccacccggcagcacacucaucccgcgccucca

SEQ ID NO: 469128 - RNA, 64 nt, Human
cugccacagacacuucuccugccuucccacccugacccggcagaacccaccaagugccugugug

SEQ ID NO: 469129 - RNA, 60 nt, Human; identical to SEQ ID NO: 455778

SEQ ID NO: 469130 - RNA, 60 nt, Human; identical to SEQ ID NO: 455279

SEQ ID NO: 469131 - RNA, 60 nt, Human; identical to SEQ ID NO: 455280

SEQ ID NO: 469132 - RNA, 64 nt, Human
ccucaggccagauacugauugcuaguagagagacacccggcacccaguccgaagcccucccuca

SEQ ID NO: 469133 - RNA, 64 nt, Human
acccagggaucgaucgguacagucgaggaagaccacccggcauucucugcccacuuugccuucc

SEQ ID NO: 469134 - RNA, 64 nt, Human
guggccgcgucccaccugcggcuggguacccugcacccggcacuguaggagucacgugcagccu

SEQ ID NO: 469135 - RNA, 64 nt, Human
gugggcacggagcuuccugccucucugcuccgacacccggcaagcagccggagacaaaacgccu

SEQ ID NO: 469136 - RNA, 64 nt, Human
ggaacauuccagcaagcuucuugcgcuucucugcacccggcaggcccacuuuccuggcacccuc

SEQ ID NO: 469137 - RNA, 64 nt, Human
ugaacccuccugaugaccccuauggccaacaucaacccggcaccaccccaaggcuggcugggga

SEQ ID NO: 469138 - RNA, 64 nt, Human
caaggaauccgagaccccgcacagcccccugggcacccggcauggggccuggggcccgauccga

SEQ ID NO: 469139 - RNA, 64 nt, Human
acagaggccaggagccagcccugcagcccuccccacccggcauccaccugcauccccucugggg

SEQ ID NO: 469140 - RNA, 64 nt, Human
gcaagcagaagagaaaauguuguauaugucuuuuacccggcacauuccccuugccuaaauacaa

SEQ ID NO: 469141 - RNA, 64 nt, Human
ugccugagagcagaaugaauaauugagguuaggaacccggcaugccgagugccccagaaaugcc

SEQ ID NO: 469142 - RNA, 64 nt, Human
uggagcccggcagugcacccccuaaagauggcgcacccggcagccccccaguguccccaggggc

SEQ ID NO: 469143 - RNA, 64 nt, Human
auugaugagaagacccccagcagggguacuggguacccggcaggccagugcccucacaguugac

SEQ ID NO: 469144 - RNA, 64 nt, Human
cacuugccucgggcuaaucccucccucuuccuccacccggcacuggggaagucaagaauggggc

SEQ ID NO: 469145 - RNA, 64 nt, Human
guuaagucuguuaaacuugagucaaauuaagcagacccggcauuggcaauguagcuguaauuuu

SEQ ID NO: 469146 - RNA, 60 nt, Human; identical to SEQ ID NO: 455281

SEQ ID NO: 469147 - RNA, 60 nt, Human; identical to SEQ ID NO: 445358

SEQ ID NO: 469148 - RNA, 60 nt, Human; identical to SEQ ID NO: 455261

SEQ ID NO: 469149 - RNA, 60 nt, Human; identical to SEQ ID NO: 455825

SEQ ID NO: 469150 - RNA, 60 nt, Human; identical to SEQ ID NO: 455826

SEQ ID NO: 469151 - RNA, 60 nt, Human; identical to SEQ ID NO: 455827

SEQ ID NO: 469152 - RNA, 60 nt, Human; identical to SEQ ID NO: 455828

SEQ ID NO: 469153 - RNA, 60 nt, Human; identical to SEQ ID NO: 448847

SEQ ID NO: 469154 - RNA, 60 nt, Human; identical to SEQ ID NO: 448848

SEQ ID NO: 469155 - RNA, 60 nt, Human; identical to SEQ ID NO: 448849

SEQ ID NO: 469156 - RNA, 60 nt, Human; identical to SEQ ID NO: 445209

SEQ ID NO: 469157 - RNA, 60 nt, Human; identical to SEQ ID NO: 455738

SEQ ID NO: 469158 - RNA, 60 nt, Human; identical to SEQ ID NO: 455739

SEQ ID NO: 469159 - RNA, 60 nt, Human; identical to SEQ ID NO: 455740

SEQ ID NO: 469160 - RNA, 60 nt, Human; identical to SEQ ID NO: 455757

SEQ ID NO: 469161 - RNA, 60 nt, Human; identical to SEQ ID NO: 455758

SEQ ID NO: 469162 - RNA, 60 nt, Human; identical to SEQ ID NO: 455759

SEQ ID NO: 469163 - RNA, 60 nt, Human; identical to SEQ ID NO: 445223

SEQ ID NO: 469164 - RNA, 60 nt, Human; identical to SEQ ID NO: 455795

SEQ ID NO: 469165 - RNA, 60 nt, Human; identical to SEQ ID NO: 455796

SEQ ID NO: 469166 - RNA, 60 nt, Human; identical to SEQ ID NO: 455797

SEQ ID NO: 469167 - RNA, 60 nt, Human; identical to SEQ ID NO: 455814

SEQ ID NO: 469168 - RNA, 60 nt, Human; identical to SEQ ID NO: 455815

SEQ ID NO: 469169 - RNA, 60 nt, Human; identical to SEQ ID NO: 455816

SEQ ID NO: 469170 - RNA, 61 nt, Human; identical to SEQ ID NO: 454652

SEQ ID NO: 469171 - RNA, 61 nt, Human; identical to SEQ ID NO: 448962

SEQ ID NO: 469172 - RNA, 61 nt, Human; identical to SEQ ID NO: 454668

SEQ ID NO: 469173 - RNA, 61 nt, Human; identical to SEQ ID NO: 454669

SEQ ID NO: 469174 - RNA, 61 nt, Human; identical to SEQ ID NO: 454670

SEQ ID NO: 469175 - RNA, 61 nt, Human; identical to SEQ ID NO: 454686

SEQ ID NO: 469176 - RNA, 61 nt, Human; identical to SEQ ID NO: 454687

SEQ ID NO: 469177 - RNA, 61 nt, Human; identical to SEQ ID NO: 454688

SEQ ID NO: 469178 - RNA, 61 nt, Human; identical to SEQ ID NO: 448963

SEQ ID NO: 469179 - RNA, 61 nt, Human; identical to SEQ ID NO: 454704

SEQ ID NO: 469180 - RNA, 61 nt, Human; identical to SEQ ID NO: 454705

SEQ ID NO: 469181 - RNA, 61 nt, Human; identical to SEQ ID NO: 454706

SEQ ID NO: 469182 - RNA, 61 nt, Human; identical to SEQ ID NO: 454723

SEQ ID NO: 469183 - RNA, 61 nt, Human; identical to SEQ ID NO: 454724

SEQ ID NO: 469184 - RNA, 61 nt, Human; identical to SEQ ID NO: 448980

SEQ ID NO: 469185 - RNA, 61 nt, Human; identical to SEQ ID NO: 454758

SEQ ID NO: 469186 - RNA, 61 nt, Human; identical to SEQ ID NO: 454759

SEQ ID NO: 469187 - RNA, 61 nt, Human; identical to SEQ ID NO: 456226

SEQ ID NO: 469188 - RNA, 61 nt, Human; identical to SEQ ID NO: 456227

SEQ ID NO: 469189 - RNA, 61 nt, Human; identical to SEQ ID NO: 456228

SEQ ID NO: 469190 - RNA, 61 nt, Human; identical to SEQ ID NO: 456229

SEQ ID NO: 469191 - RNA, 61 nt, Human; identical to SEQ ID NO: 456230

SEQ ID NO: 469192 - RNA, 61 nt, Human; identical to SEQ ID NO: 456231

SEQ ID NO: 469193 - RNA, 61 nt, Human; identical to SEQ ID NO: 456232

SEQ ID NO: 469194 - RNA, 61 nt, Human; identical to SEQ ID NO: 456233

SEQ ID NO: 469195 - RNA, 61 nt, Human; identical to SEQ ID NO: 456234

SEQ ID NO: 469196 - RNA, 61 nt, Human; identical to SEQ ID NO: 456235

SEQ ID NO: 469197 - RNA, 61 nt, Human; identical to SEQ ID NO: 456236

SEQ ID NO: 469198 - RNA, 61 nt, Human; identical to SEQ ID NO: 456237

SEQ ID NO: 469199 - RNA, 61 nt, Human; identical to SEQ ID NO: 456238

SEQ ID NO: 469200 - RNA, 61 nt, Human; identical to SEQ ID NO: 456239

SEQ ID NO: 469201 - RNA, 61 nt, Human; identical to SEQ ID NO: 456240

SEQ ID NO: 469202 - RNA, 61 nt, Human; identical to SEQ ID NO: 456241

SEQ ID NO: 469203 - RNA, 61 nt, Human; identical to SEQ ID NO: 456242

SEQ ID NO: 469204 - RNA, 61 nt, Human; identical to SEQ ID NO: 456243

SEQ ID NO: 469205 - RNA, 61 nt, Human; identical to SEQ ID NO: 456244

SEQ ID NO: 469206 - RNA, 61 nt, Human; identical to SEQ ID NO: 456245

SEQ ID NO: 469207 - RNA, 61 nt, Human; identical to SEQ ID NO: 454776

SEQ ID NO: 469208 - RNA, 61 nt, Human; identical to SEQ ID NO: 454777

SEQ ID NO: 469209 - RNA, 61 nt, Human; identical to SEQ ID NO: 454778

SEQ ID NO: 469210 - RNA, 61 nt, Human; identical to SEQ ID NO: 456246

SEQ ID NO: 469211 - RNA, 61 nt, Human; identical to SEQ ID NO: 456247

SEQ ID NO: 469212 - RNA, 61 nt, Human; identical to SEQ ID NO: 456248

SEQ ID NO: 469213 - RNA, 61 nt, Human; identical to SEQ ID NO: 456249

SEQ ID NO: 469214 - RNA, 61 nt, Human; identical to SEQ ID NO: 456250

SEQ ID NO: 469215 - RNA, 61 nt, Human; identical to SEQ ID NO: 456251

SEQ ID NO: 469216 - RNA, 61 nt, Human; identical to SEQ ID NO: 456252

SEQ ID NO: 469217 - RNA, 61 nt, Human; identical to SEQ ID NO: 456253

SEQ ID NO: 469218 - RNA, 61 nt, Human; identical to SEQ ID NO: 456254

SEQ ID NO: 469219 - RNA, 61 nt, Human; identical to SEQ ID NO: 456255

SEQ ID NO: 469220 - RNA, 61 nt, Human; identical to SEQ ID NO: 456256

SEQ ID NO: 469221 - RNA, 61 nt, Human; identical to SEQ ID NO: 456257

SEQ ID NO: 469222 - RNA, 61 nt, Human; identical to SEQ ID NO: 456258

SEQ ID NO: 469223 - RNA, 61 nt, Human; identical to SEQ ID NO: 456259

SEQ ID NO: 469224 - RNA, 61 nt, Human; identical to SEQ ID NO: 456260

SEQ ID NO: 469225 - RNA, 61 nt, Human; identical to SEQ ID NO: 456261

SEQ ID NO: 469226 - RNA, 61 nt, Human; identical to SEQ ID NO: 456262

SEQ ID NO: 469227 - RNA, 61 nt, Human; identical to SEQ ID NO: 456263

SEQ ID NO: 469228 - RNA, 61 nt, Human; identical to SEQ ID NO: 456264

SEQ ID NO: 469229 - RNA, 61 nt, Human; identical to SEQ ID NO: 456265

SEQ ID NO: 469230 - RNA, 61 nt, Human; identical to SEQ ID NO: 448981

SEQ ID NO: 469231 - RNA, 61 nt, Human; identical to SEQ ID NO: 454760

SEQ ID NO: 469232 - RNA, 61 nt, Human; identical to SEQ ID NO: 454794

SEQ ID NO: 469233 - RNA, 61 nt, Human; identical to SEQ ID NO: 454795

SEQ ID NO: 469234 - RNA, 61 nt, Human; identical to SEQ ID NO: 454796

SEQ ID NO: 469235 - RNA, 61 nt, Human; identical to SEQ ID NO: 456266

SEQ ID NO: 469236 - RNA, 61 nt, Human; identical to SEQ ID NO: 456267

SEQ ID NO: 469237 - RNA, 61 nt, Human; identical to SEQ ID NO: 456268

SEQ ID NO: 469238 - RNA, 61 nt, Human; identical to SEQ ID NO: 456269

SEQ ID NO: 469239 - RNA, 61 nt, Human; identical to SEQ ID NO: 456270

SEQ ID NO: 469240 - RNA, 61 nt, Human; identical to SEQ ID NO: 456271

SEQ ID NO: 469241 - RNA, 61 nt, Human; identical to SEQ ID NO: 456272

SEQ ID NO: 469242 - RNA, 61 nt, Human; identical to SEQ ID NO: 456273

SEQ ID NO: 469243 - RNA, 61 nt, Human; identical to SEQ ID NO: 456274

SEQ ID NO: 469244 - RNA, 61 nt, Human; identical to SEQ ID NO: 456275

SEQ ID NO: 469245 - RNA, 61 nt, Human; identical to SEQ ID NO: 456276

SEQ ID NO: 469246 - RNA, 61 nt, Human; identical to SEQ ID NO: 456277

SEQ ID NO: 469247 - RNA, 61 nt, Human; identical to SEQ ID NO: 456278

SEQ ID NO: 469248 - RNA, 61 nt, Human; identical to SEQ ID NO: 456279

SEQ ID NO: 469249 - RNA, 61 nt, Human; identical to SEQ ID NO: 456280

SEQ ID NO: 469250 - RNA, 61 nt, Human; identical to SEQ ID NO: 456281

SEQ ID NO: 469251 - RNA, 61 nt, Human; identical to SEQ ID NO: 456282

SEQ ID NO: 469252 - RNA, 61 nt, Human; identical to SEQ ID NO: 456283

SEQ ID NO: 469253 - RNA, 61 nt, Human; identical to SEQ ID NO: 456284

SEQ ID NO: 469254 - RNA, 61 nt, Human; identical to SEQ ID NO: 456285

SEQ ID NO: 469255 - RNA, 61 nt, Human; identical to SEQ ID NO: 448982

SEQ ID NO: 469256 - RNA, 61 nt, Human; identical to SEQ ID NO: 454884

SEQ ID NO: 469257 - RNA, 61 nt, Human; identical to SEQ ID NO: 454885

SEQ ID NO: 469258 - RNA, 61 nt, Human; identical to SEQ ID NO: 454974

SEQ ID NO: 469259 - RNA, 61 nt, Human; identical to SEQ ID NO: 454975

SEQ ID NO: 469260 - RNA, 61 nt, Human; identical to SEQ ID NO: 448984

SEQ ID NO: 469261 - RNA, 61 nt, Human; identical to SEQ ID NO: 456167

SEQ ID NO: 469262 - RNA, 61 nt, Human; identical to SEQ ID NO: 454400

SEQ ID NO: 469263 - RNA, 61 nt, Human; identical to SEQ ID NO: 454401

SEQ ID NO: 469264 - RNA, 61 nt, Human; identical to SEQ ID NO: 454402

SEQ ID NO: 469265 - RNA, 61 nt, Human; identical to SEQ ID NO: 448985

SEQ ID NO: 469266 - RNA, 61 nt, Human; identical to SEQ ID NO: 448985

SEQ ID NO: 469267 - RNA, 61 nt, Human; identical to SEQ ID NO: 454383

SEQ ID NO: 469268 - RNA, 61 nt, Human; identical to SEQ ID NO: 454384

SEQ ID NO: 469269 - RNA, 61 nt, Human; identical to SEQ ID NO: 454418

SEQ ID NO: 469270 - RNA, 61 nt, Human; identical to SEQ ID NO: 454419

SEQ ID NO: 469271 - RNA, 61 nt, Human; identical to SEQ ID NO: 454420

SEQ ID NO: 469272 - RNA, 61 nt, Human; identical to SEQ ID NO: 448986

SEQ ID NO: 469273 - RNA, 61 nt, Human; identical to SEQ ID NO: 454436

SEQ ID NO: 469274 - RNA, 61 nt, Human; identical to SEQ ID NO: 454437

SEQ ID NO: 469275 - RNA, 61 nt, Human; identical to SEQ ID NO: 454438

SEQ ID NO: 469276 - RNA, 61 nt, Human; identical to SEQ ID NO: 454454

SEQ ID NO: 469277 - RNA, 61 nt, Human; identical to SEQ ID NO: 454455

SEQ ID NO: 469278 - RNA, 61 nt, Human; identical to SEQ ID NO: 454456

SEQ ID NO: 469279 - RNA, 61 nt, Human; identical to SEQ ID NO: 448987

SEQ ID NO: 469280 - RNA, 61 nt, Human; identical to SEQ ID NO: 454472

SEQ ID NO: 469281 - RNA, 61 nt, Human; identical to SEQ ID NO: 454473

SEQ ID NO: 469282 - RNA, 61 nt, Human; identical to SEQ ID NO: 454474

SEQ ID NO: 469283 - RNA, 61 nt, Human; identical to SEQ ID NO: 454490

SEQ ID NO: 469284 - RNA, 61 nt, Human; identical to SEQ ID NO: 454491

SEQ ID NO: 469285 - RNA, 61 nt, Human; identical to SEQ ID NO: 454492

SEQ ID NO: 469286 - RNA, 61 nt, Human; identical to SEQ ID NO: 448988

SEQ ID NO: 469287 - RNA, 61 nt, Human; identical to SEQ ID NO: 454508

SEQ ID NO: 469288 - RNA, 61 nt, Human; identical to SEQ ID NO: 454509

SEQ ID NO: 469289 - RNA, 61 nt, Human; identical to SEQ ID NO: 454510

SEQ ID NO: 469290 - RNA, 61 nt, Human; identical to SEQ ID NO: 454526

SEQ ID NO: 469291 - RNA, 61 nt, Human; identical to SEQ ID NO: 454527

SEQ ID NO: 469292 - RNA, 61 nt, Human; identical to SEQ ID NO: 454528

SEQ ID NO: 469293 - RNA, 61 nt, Human; identical to SEQ ID NO: 448989

SEQ ID NO: 469294 - RNA, 61 nt, Human; identical to SEQ ID NO: 454544

SEQ ID NO: 469295 - RNA, 61 nt, Human; identical to SEQ ID NO: 454545

SEQ ID NO: 469296 - RNA, 61 nt, Human; identical to SEQ ID NO: 454546

SEQ ID NO: 469297 - RNA, 61 nt, Human; identical to SEQ ID NO: 454562

SEQ ID NO: 469298 - RNA, 61 nt, Human; identical to SEQ ID NO: 454563

SEQ ID NO: 469299 - RNA, 61 nt, Human; identical to SEQ ID NO: 454564

SEQ ID NO: 469300 - RNA, 61 nt, Human; identical to SEQ ID NO: 448990

SEQ ID NO: 469301 - RNA, 61 nt, Human; identical to SEQ ID NO: 454580

SEQ ID NO: 469302 - RNA, 61 nt, Human; identical to SEQ ID NO: 454581

SEQ ID NO: 469303 - RNA, 61 nt, Human; identical to SEQ ID NO: 454582

SEQ ID NO: 469304 - RNA, 61 nt, Human; identical to SEQ ID NO: 454596

SEQ ID NO: 469305 - RNA, 61 nt, Human; identical to SEQ ID NO: 454597

SEQ ID NO: 469306 - RNA, 61 nt, Human; identical to SEQ ID NO: 454598

SEQ ID NO: 469307 - RNA, 61 nt, Human; identical to SEQ ID NO: 448991

SEQ ID NO: 469308 - RNA, 61 nt, Human; identical to SEQ ID NO: 454740

SEQ ID NO: 469309 - RNA, 61 nt, Human; identical to SEQ ID NO: 454741

SEQ ID NO: 469310 - RNA, 61 nt, Human; identical to SEQ ID NO: 454742

SEQ ID NO: 469311 - RNA, 61 nt, Human; identical to SEQ ID NO: 456005

SEQ ID NO: 469312 - RNA, 61 nt, Human; identical to SEQ ID NO: 456006

SEQ ID NO: 469313 - RNA, 61 nt, Human; identical to SEQ ID NO: 456007

SEQ ID NO: 469314 - RNA, 61 nt, Human; identical to SEQ ID NO: 448992

SEQ ID NO: 469315 - RNA, 61 nt, Human; identical to SEQ ID NO: 454112

SEQ ID NO: 469316 - RNA, 61 nt, Human; identical to SEQ ID NO: 454113

SEQ ID NO: 469317 - RNA, 61 nt, Human; identical to SEQ ID NO: 454114

SEQ ID NO: 469318 - RNA, 61 nt, Human; identical to SEQ ID NO: 454130

SEQ ID NO: 469319 - RNA, 61 nt, Human; identical to SEQ ID NO: 454131

SEQ ID NO: 469320 - RNA, 61 nt, Human; identical to SEQ ID NO: 454132

SEQ ID NO: 469321 - RNA, 61 nt, Human; identical to SEQ ID NO: 448993

SEQ ID NO: 469322 - RNA, 61 nt, Human; identical to SEQ ID NO: 454148

SEQ ID NO: 469323 - RNA, 61 nt, Human; identical to SEQ ID NO: 454149

SEQ ID NO: 469324 - RNA, 61 nt, Human; identical to SEQ ID NO: 454150

SEQ ID NO: 469325 - RNA, 61 nt, Human; identical to SEQ ID NO: 454166

SEQ ID NO: 469326 - RNA, 61 nt, Human; identical to SEQ ID NO: 454167

SEQ ID NO: 469327 - RNA, 61 nt, Human; identical to SEQ ID NO: 454168

SEQ ID NO: 469328 - RNA, 61 nt, Human; identical to SEQ ID NO: 448994

SEQ ID NO: 469329 - RNA, 61 nt, Human; identical to SEQ ID NO: 454184

SEQ ID NO: 469330 - RNA, 61 nt, Human; identical to SEQ ID NO: 454185

SEQ ID NO: 469331 - RNA, 61 nt, Human; identical to SEQ ID NO: 454186

SEQ ID NO: 469332 - RNA, 61 nt, Human; identical to SEQ ID NO: 454202

SEQ ID NO: 469333 - RNA, 61 nt, Human; identical to SEQ ID NO: 454203

SEQ ID NO: 469334 - RNA, 61 nt, Human; identical to SEQ ID NO: 454204

SEQ ID NO: 469335 - RNA, 61 nt, Human; identical to SEQ ID NO: 448995

SEQ ID NO: 469336 - RNA, 61 nt, Human; identical to SEQ ID NO: 454220

SEQ ID NO: 469337 - RNA, 61 nt, Human; identical to SEQ ID NO: 454221

SEQ ID NO: 469338 - RNA, 61 nt, Human; identical to SEQ ID NO: 454222

SEQ ID NO: 469339 - RNA, 61 nt, Human; identical to SEQ ID NO: 454238

SEQ ID NO: 469340 - RNA, 61 nt, Human; identical to SEQ ID NO: 454239

SEQ ID NO: 469341 - RNA, 61 nt, Human; identical to SEQ ID NO: 454240

SEQ ID NO: 469342 - RNA, 61 nt, Human; identical to SEQ ID NO: 448996

SEQ ID NO: 469343 - RNA, 61 nt, Human; identical to SEQ ID NO: 454256

SEQ ID NO: 469344 - RNA, 61 nt, Human; identical to SEQ ID NO: 454257

SEQ ID NO: 469345 - RNA, 61 nt, Human; identical to SEQ ID NO: 454258

SEQ ID NO: 469346 - RNA, 61 nt, Human; identical to SEQ ID NO: 454274

SEQ ID NO: 469347 - RNA, 61 nt, Human; identical to SEQ ID NO: 454275

SEQ ID NO: 469348 - RNA, 61 nt, Human; identical to SEQ ID NO: 454276

SEQ ID NO: 469349 - RNA, 61 nt, Human; identical to SEQ ID NO: 448997

SEQ ID NO: 469350 - RNA, 61 nt, Human; identical to SEQ ID NO: 454292

SEQ ID NO: 469351 - RNA, 61 nt, Human; identical to SEQ ID NO: 454293

SEQ ID NO: 469352 - RNA, 61 nt, Human; identical to SEQ ID NO: 454294

SEQ ID NO: 469353 - RNA, 61 nt, Human; identical to SEQ ID NO: 454310

SEQ ID NO: 469354 - RNA, 61 nt, Human; identical to SEQ ID NO: 454311

SEQ ID NO: 469355 - RNA, 61 nt, Human; identical to SEQ ID NO: 454312

SEQ ID NO: 469356 - RNA, 61 nt, Human; identical to SEQ ID NO: 448998

SEQ ID NO: 469357 - RNA, 61 nt, Human; identical to SEQ ID NO: 454328

SEQ ID NO: 469358 - RNA, 61 nt, Human; identical to SEQ ID NO: 454329

SEQ ID NO: 469359 - RNA, 61 nt, Human; identical to SEQ ID NO: 456286

SEQ ID NO: 469360 - RNA, 61 nt, Human; identical to SEQ ID NO: 456287

SEQ ID NO: 469361 - RNA, 61 nt, Human; identical to SEQ ID NO: 456288

SEQ ID NO: 469362 - RNA, 61 nt, Human; identical to SEQ ID NO: 456289

SEQ ID NO: 469363 - RNA, 61 nt, Human; identical to SEQ ID NO: 456290

SEQ ID NO: 469364 - RNA, 61 nt, Human; identical to SEQ ID NO: 456291

SEQ ID NO: 469365 - RNA, 61 nt, Human; identical to SEQ ID NO: 456292

SEQ ID NO: 469366 - RNA, 61 nt, Human; identical to SEQ ID NO: 456293

SEQ ID NO: 469367 - RNA, 61 nt, Human; identical to SEQ ID NO: 456294

SEQ ID NO: 469368 - RNA, 61 nt, Human; identical to SEQ ID NO: 456295

SEQ ID NO: 469369 - RNA, 61 nt, Human; identical to SEQ ID NO: 456296

SEQ ID NO: 469370 - RNA, 61 nt, Human; identical to SEQ ID NO: 456297

SEQ ID NO: 469371 - RNA, 61 nt, Human; identical to SEQ ID NO: 456298

SEQ ID NO: 469372 - RNA, 61 nt, Human; identical to SEQ ID NO: 456299

SEQ ID NO: 469373 - RNA, 61 nt, Human; identical to SEQ ID NO: 456300

SEQ ID NO: 469374 - RNA, 61 nt, Human; identical to SEQ ID NO: 456301

SEQ ID NO: 469375 - RNA, 61 nt, Human; identical to SEQ ID NO: 456302

SEQ ID NO: 469376 - RNA, 61 nt, Human; identical to SEQ ID NO: 456303

SEQ ID NO: 469377 - RNA, 61 nt, Human; identical to SEQ ID NO: 456304

SEQ ID NO: 469378 - RNA, 61 nt, Human; identical to SEQ ID NO: 456305

SEQ ID NO: 469379 - RNA, 61 nt, Human; identical to SEQ ID NO: 454346

SEQ ID NO: 469380 - RNA, 61 nt, Human; identical to SEQ ID NO: 454347

SEQ ID NO: 469381 - RNA, 61 nt, Human; identical to SEQ ID NO: 454348

SEQ ID NO: 469382 - RNA, 61 nt, Human; identical to SEQ ID NO: 448999

SEQ ID NO: 469383 - RNA, 61 nt, Human; identical to SEQ ID NO: 454330

SEQ ID NO: 469384 - RNA, 61 nt, Human; identical to SEQ ID NO: 454364

SEQ ID NO: 469385 - RNA, 61 nt, Human; identical to SEQ ID NO: 454365

SEQ ID NO: 469386 - RNA, 61 nt, Human; identical to SEQ ID NO: 454366

SEQ ID NO: 469387 - RNA, 61 nt, Human; identical to SEQ ID NO: 456306

SEQ ID NO: 469388 - RNA, 61 nt, Human; identical to SEQ ID NO: 456307

SEQ ID NO: 469389 - RNA, 61 nt, Human; identical to SEQ ID NO: 456308

SEQ ID NO: 469390 - RNA, 61 nt, Human; identical to SEQ ID NO: 456309

SEQ ID NO: 469391 - RNA, 61 nt, Human; identical to SEQ ID NO: 456310

SEQ ID NO: 469392 - RNA, 61 nt, Human; identical to SEQ ID NO: 456311

SEQ ID NO: 469393 - RNA, 61 nt, Human; identical to SEQ ID NO: 456312

SEQ ID NO: 469394 - RNA, 61 nt, Human; identical to SEQ ID NO: 456313

SEQ ID NO: 469395 - RNA, 61 nt, Human; identical to SEQ ID NO: 456314

SEQ ID NO: 469396 - RNA, 61 nt, Human; identical to SEQ ID NO: 456315

SEQ ID NO: 469397 - RNA, 61 nt, Human; identical to SEQ ID NO: 456316

SEQ ID NO: 469398 - RNA, 61 nt, Human; identical to SEQ ID NO: 456317

SEQ ID NO: 469399 - RNA, 61 nt, Human; identical to SEQ ID NO: 456318

SEQ ID NO: 469400 - RNA, 61 nt, Human; identical to SEQ ID NO: 456319

SEQ ID NO: 469401 - RNA, 61 nt, Human; identical to SEQ ID NO: 456320

SEQ ID NO: 469402 - RNA, 61 nt, Human; identical to SEQ ID NO: 456321

SEQ ID NO: 469403 - RNA, 61 nt, Human; identical to SEQ ID NO: 456322

SEQ ID NO: 469404 - RNA, 61 nt, Human; identical to SEQ ID NO: 456323

SEQ ID NO: 469405 - RNA, 61 nt, Human; identical to SEQ ID NO: 456324

SEQ ID NO: 469406 - RNA, 61 nt, Human; identical to SEQ ID NO: 456325

SEQ ID NO: 469407 - RNA, 61 nt, Human; identical to SEQ ID NO: 449000

SEQ ID NO: 469408 - RNA, 61 nt, Human; identical to SEQ ID NO: 453882

SEQ ID NO: 469409 - RNA, 61 nt, Human; identical to SEQ ID NO: 453883

SEQ ID NO: 469410 - RNA, 61 nt, Human; identical to SEQ ID NO: 453884

SEQ ID NO: 469411 - RNA, 61 nt, Human; identical to SEQ ID NO: 453900

SEQ ID NO: 469412 - RNA, 61 nt, Human; identical to SEQ ID NO: 453901

SEQ ID NO: 469413 - RNA, 61 nt, Human; identical to SEQ ID NO: 453902

SEQ ID NO: 469414 - RNA, 61 nt, Human; identical to SEQ ID NO: 449001

SEQ ID NO: 469415 - RNA, 61 nt, Human; identical to SEQ ID NO: 453864

SEQ ID NO: 469416 - RNA, 54 nt, Human; identical to SEQ ID NO: 453865

SEQ ID NO: 469417 - RNA, 61 nt, Human; identical to SEQ ID NO: 453866

SEQ ID NO: 469418 - RNA, 61 nt, Human; identical to SEQ ID NO: 453918

SEQ ID NO: 469419 - RNA, 61 nt, Human; identical to SEQ ID NO: 453919

SEQ ID NO: 469420 - RNA, 61 nt, Human; identical to SEQ ID NO: 453920

SEQ ID NO: 469421 - RNA, 61 nt, Human; identical to SEQ ID NO: 449002

SEQ ID NO: 469422 - RNA, 61 nt, Human; identical to SEQ ID NO: 453936

SEQ ID NO: 469423 - RNA, 61 nt, Human; identical to SEQ ID NO: 453937

SEQ ID NO: 469424 - RNA, 61 nt, Human; identical to SEQ ID NO: 453938

SEQ ID NO: 469425 - RNA, 61 nt, Human; identical to SEQ ID NO: 453954

SEQ ID NO: 469426 - RNA, 61 nt, Human; identical to SEQ ID NO: 453955

SEQ ID NO: 469427 - RNA, 61 nt, Human; identical to SEQ ID NO: 453956

SEQ ID NO: 469428 - RNA, 61 nt, Human; identical to SEQ ID NO: 449019

SEQ ID NO: 469429 - RNA, 61 nt, Human; identical to SEQ ID NO: 453987

SEQ ID NO: 469430 - RNA, 61 nt, Human; identical to SEQ ID NO: 453988

SEQ ID NO: 469431 - RNA, 61 nt, Human; identical to SEQ ID NO: 453989

SEQ ID NO: 469432 - RNA, 61 nt, Human; identical to SEQ ID NO: 454005

SEQ ID NO: 469433 - RNA, 61 nt, Human; identical to SEQ ID NO: 454006

SEQ ID NO: 469434 - RNA, 61 nt, Human; identical to SEQ ID NO: 454007

SEQ ID NO: 469435 - RNA, 61 nt, Human; identical to SEQ ID NO: 449020

SEQ ID NO: 469436 - RNA, 61 nt, Human; identical to SEQ ID NO: 454023

SEQ ID NO: 469437 - RNA, 61 nt, Human; identical to SEQ ID NO: 454024

SEQ ID NO: 469438 - RNA, 61 nt, Human; identical to SEQ ID NO: 456326

SEQ ID NO: 469439 - RNA, 61 nt, Human; identical to SEQ ID NO: 456327

SEQ ID NO: 469440 - RNA, 61 nt, Human; identical to SEQ ID NO: 456328

SEQ ID NO: 469441 - RNA, 61 nt, Human; identical to SEQ ID NO: 456329

SEQ ID NO: 469442 - RNA, 61 nt, Human; identical to SEQ ID NO: 456330

SEQ ID NO: 469443 - RNA, 61 nt, Human; identical to SEQ ID NO: 456331

SEQ ID NO: 469444 - RNA, 61 nt, Human; identical to SEQ ID NO: 456332

SEQ ID NO: 469445 - RNA, 61 nt, Human; identical to SEQ ID NO: 456333

SEQ ID NO: 469446 - RNA, 61 nt, Human; identical to SEQ ID NO: 456334

SEQ ID NO: 469447 - RNA, 61 nt, Human; identical to SEQ ID NO: 456335

SEQ ID NO: 469448 - RNA, 61 nt, Human; identical to SEQ ID NO: 456336

SEQ ID NO: 469449 - RNA, 61 nt, Human; identical to SEQ ID NO: 456337

SEQ ID NO: 469450 - RNA, 61 nt, Human; identical to SEQ ID NO: 456338

SEQ ID NO: 469451 - RNA, 61 nt, Human; identical to SEQ ID NO: 456339

SEQ ID NO: 469452 - RNA, 61 nt, Human; identical to SEQ ID NO: 456340

SEQ ID NO: 469453 - RNA, 61 nt, Human; identical to SEQ ID NO: 456341

SEQ ID NO: 469454 - RNA, 61 nt, Human; identical to SEQ ID NO: 456342

SEQ ID NO: 469455 - RNA, 61 nt, Human; identical to SEQ ID NO: 456343

SEQ ID NO: 469456 - RNA, 63 nt, Human; identical to SEQ ID NO: 456346

SEQ ID NO: 469457 - RNA, 63 nt, Human; identical to SEQ ID NO: 456347

SEQ ID NO: 469458 - RNA, 63 nt, Human; identical to SEQ ID NO: 456348

SEQ ID NO: 469459 - RNA, 63 nt, Human; identical to SEQ ID NO: 456349

SEQ ID NO: 469460 - RNA, 63 nt, Human; identical to SEQ ID NO: 456350

SEQ ID NO: 469461 - RNA, 63 nt, Human; identical to SEQ ID NO: 456351

SEQ ID NO: 469462 - RNA, 63 nt, Human; identical to SEQ ID NO: 456352

SEQ ID NO: 469463 - RNA, 63 nt, Human; identical to SEQ ID NO: 456353

SEQ ID NO: 469464 - RNA, 63 nt, Human; identical to SEQ ID NO: 456354

SEQ ID NO: 469465 - RNA, 63 nt, Human; identical to SEQ ID NO: 456355

SEQ ID NO: 469466 - RNA, 63 nt, Human; identical to SEQ ID NO: 456356

SEQ ID NO: 469467 - RNA, 63 nt, Human; identical to SEQ ID NO: 456357

SEQ ID NO: 469468 - RNA, 63 nt, Human; identical to SEQ ID NO: 456358

SEQ ID NO: 469469 - RNA, 63 nt, Human; identical to SEQ ID NO: 456359

SEQ ID NO: 469470 - RNA, 63 nt, Human; identical to SEQ ID NO: 456362

SEQ ID NO: 469471 - RNA, 63 nt, Human; identical to SEQ ID NO: 456363

SEQ ID NO: 469472 - RNA, 63 nt, Human; identical to SEQ ID NO: 456364

SEQ ID NO: 469473 - RNA, 63 nt, Human; identical to SEQ ID NO: 456365

SEQ ID NO: 469474 - RNA, 63 nt, Human; identical to SEQ ID NO: 456366

SEQ ID NO: 469475 - RNA, 63 nt, Human; identical to SEQ ID NO: 456367

SEQ ID NO: 469476 - RNA, 63 nt, Human; identical to SEQ ID NO: 456368

SEQ ID NO: 469477 - RNA, 63 nt, Human; identical to SEQ ID NO: 456369

SEQ ID NO: 469478 - RNA, 56 nt, Human; identical to SEQ ID NO: 456370

SEQ ID NO: 469479 - RNA, 63 nt, Human; identical to SEQ ID NO: 456371

SEQ ID NO: 469480 - RNA, 63 nt, Human; identical to SEQ ID NO: 456372

SEQ ID NO: 469481 - RNA, 63 nt, Human; identical to SEQ ID NO: 456373

SEQ ID NO: 469482 - RNA, 63 nt, Human; identical to SEQ ID NO: 456374

SEQ ID NO: 469483 - RNA, 63 nt, Human; identical to SEQ ID NO: 456375

SEQ ID NO: 469484 - RNA, 63 nt, Human; identical to SEQ ID NO: 456376

SEQ ID NO: 469485 - RNA, 63 nt, Human; identical to SEQ ID NO: 456377

SEQ ID NO: 469486 - RNA, 63 nt, Human; identical to SEQ ID NO: 456378

SEQ ID NO: 469487 - RNA, 63 nt, Human; identical to SEQ ID NO: 456379

SEQ ID NO: 469488 - RNA, 63 nt, Human; identical to SEQ ID NO: 456380

SEQ ID NO: 469489 - RNA, 63 nt, Human; identical to SEQ ID NO: 456381

SEQ ID NO: 469490 - RNA, 63 nt, Human; identical to SEQ ID NO: 456382

SEQ ID NO: 469491 - RNA, 63 nt, Human; identical to SEQ ID NO: 456383

SEQ ID NO: 469492 - RNA, 63 nt, Human; identical to SEQ ID NO: 456384

SEQ ID NO: 469493 - RNA, 63 nt, Human; identical to SEQ ID NO: 456385

SEQ ID NO: 469494 - RNA, 63 nt, Human; identical to SEQ ID NO: 456386

SEQ ID NO: 469495 - RNA, 63 nt, Human; identical to SEQ ID NO: 456387

SEQ ID NO: 469496 - RNA, 63 nt, Human; identical to SEQ ID NO: 456388

SEQ ID NO: 469497 - RNA, 63 nt, Human; identical to SEQ ID NO: 456389

SEQ ID NO: 469498 - RNA, 63 nt, Human; identical to SEQ ID NO: 456390

SEQ ID NO: 469499 - RNA, 62 nt, Human; identical to SEQ ID NO: 456391

SEQ ID NO: 469500 - RNA, 63 nt, Human; identical to SEQ ID NO: 456392

SEQ ID NO: 469501 - RNA, 63 nt, Human; identical to SEQ ID NO: 456393

SEQ ID NO: 469502 - RNA, 63 nt, Human; identical to SEQ ID NO: 456394

SEQ ID NO: 469503 - RNA, 63 nt, Human; identical to SEQ ID NO: 456395

SEQ ID NO: 469504 - RNA, 63 nt, Human; identical to SEQ ID NO: 456396

SEQ ID NO: 469505 - RNA, 63 nt, Human; identical to SEQ ID NO: 456397

SEQ ID NO: 469506 - RNA, 63 nt, Human; identical to SEQ ID NO: 456398

SEQ ID NO: 469507 - RNA, 63 nt, Human; identical to SEQ ID NO: 456399

SEQ ID NO: 469508 - RNA, 63 nt, Human; identical to SEQ ID NO: 456400

SEQ ID NO: 469509 - RNA, 63 nt, Human; identical to SEQ ID NO: 456401

SEQ ID NO: 469510 - RNA, 63 nt, Human; identical to SEQ ID NO: 456402

SEQ ID NO: 469511 - RNA, 63 nt, Human; identical to SEQ ID NO: 456403

SEQ ID NO: 469512 - RNA, 63 nt, Human; identical to SEQ ID NO: 456404

SEQ ID NO: 469513 - RNA, 63 nt, Human; identical to SEQ ID NO: 456405

SEQ ID NO: 469514 - RNA, 63 nt, Human; identical to SEQ ID NO: 456406

SEQ ID NO: 469515 - RNA, 63 nt, Human; identical to SEQ ID NO: 456407

SEQ ID NO: 469516 - RNA, 63 nt, Human; identical to SEQ ID NO: 456408

SEQ ID NO: 469517 - RNA, 63 nt, Human; identical to SEQ ID NO: 456409

SEQ ID NO: 469518 - RNA, 63 nt, Human; identical to SEQ ID NO: 456410

SEQ ID NO: 469519 - RNA, 63 nt, Human; identical to SEQ ID NO: 456411

SEQ ID NO: 469520 - RNA, 63 nt, Human; identical to SEQ ID NO: 456412

SEQ ID NO: 469521 - RNA, 63 nt, Human; identical to SEQ ID NO: 456413

SEQ ID NO: 469522 - RNA, 63 nt, Human; identical to SEQ ID NO: 456414

SEQ ID NO: 469523 - RNA, 63 nt, Human; identical to SEQ ID NO: 456415

SEQ ID NO: 469524 - RNA, 63 nt, Human; identical to SEQ ID NO: 456416

SEQ ID NO: 469525 - RNA, 61 nt, Human; identical to SEQ ID NO: 456417

SEQ ID NO: 469526 - RNA, 63 nt, Human; identical to SEQ ID NO: 456418

SEQ ID NO: 469527 - RNA, 63 nt, Human; identical to SEQ ID NO: 456419

SEQ ID NO: 469528 - RNA, 63 nt, Human; identical to SEQ ID NO: 456420

SEQ ID NO: 469529 - RNA, 63 nt, Human; identical to SEQ ID NO: 456421

SEQ ID NO: 469530 - RNA, 63 nt, Human; identical to SEQ ID NO: 456422

SEQ ID NO: 469531 - RNA, 63 nt, Human; identical to SEQ ID NO: 456423

SEQ ID NO: 469532 - RNA, 63 nt, Human; identical to SEQ ID NO: 456424

SEQ ID NO: 469533 - RNA, 56 nt, Human; identical to SEQ ID NO: 456425

SEQ ID NO: 469534 - RNA, 63 nt, Human; identical to SEQ ID NO: 456426

SEQ ID NO: 469535 - RNA, 63 nt, Human; identical to SEQ ID NO: 456427

SEQ ID NO: 469536 - RNA, 63 nt, Human; identical to SEQ ID NO: 456428

SEQ ID NO: 469537 - RNA, 63 nt, Human; identical to SEQ ID NO: 456429

SEQ ID NO: 469538 - RNA, 63 nt, Human; identical to SEQ ID NO: 456430

SEQ ID NO: 469539 - RNA, 63 nt, Human; identical to SEQ ID NO: 456432

SEQ ID NO: 469540 - RNA, 63 nt, Human; identical to SEQ ID NO: 456433

SEQ ID NO: 469541 - RNA, 63 nt, Human; identical to SEQ ID NO: 456434

SEQ ID NO: 469542 - RNA, 63 nt, Human; identical to SEQ ID NO: 456435

SEQ ID NO: 469543 - RNA, 63 nt, Human; identical to SEQ ID NO: 456436

SEQ ID NO: 469544 - RNA, 63 nt, Human; identical to SEQ ID NO: 456437

SEQ ID NO: 469545 - RNA, 63 nt, Human; identical to SEQ ID NO: 456438

SEQ ID NO: 469546 - RNA, 63 nt, Human; identical to SEQ ID NO: 456439

SEQ ID NO: 469547 - RNA, 63 nt, Human; identical to SEQ ID NO: 456440

SEQ ID NO: 469548 - RNA, 63 nt, Human; identical to SEQ ID NO: 456441

SEQ ID NO: 469549 - RNA, 63 nt, Human; identical to SEQ ID NO: 456442

SEQ ID NO: 469550 - RNA, 63 nt, Human; identical to SEQ ID NO: 456443

SEQ ID NO: 469551 - RNA, 63 nt, Human; identical to SEQ ID NO: 456444

SEQ ID NO: 469552 - RNA, 63 nt, Human; identical to SEQ ID NO: 456445

SEQ ID NO: 469553 - RNA, 63 nt, Human; identical to SEQ ID NO: 456446

SEQ ID NO: 469554 - RNA, 63 nt, Human; identical to SEQ ID NO: 456447

SEQ ID NO: 469555 - RNA, 63 nt, Human; identical to SEQ ID NO: 456448

SEQ ID NO: 469556 - RNA, 63 nt, Human; identical to SEQ ID NO: 456449

SEQ ID NO: 469557 - RNA, 63 nt, Human; identical to SEQ ID NO: 456450

SEQ ID NO: 469558 - RNA, 63 nt, Human; identical to SEQ ID NO: 456451

SEQ ID NO: 469559 - RNA, 63 nt, Human; identical to SEQ ID NO: 456452

SEQ ID NO: 469560 - RNA, 63 nt, Human; identical to SEQ ID NO: 456453

SEQ ID NO: 469561 - RNA, 63 nt, Human; identical to SEQ ID NO: 456454

SEQ ID NO: 469562 - RNA, 63 nt, Human; identical to SEQ ID NO: 456455

SEQ ID NO: 469563 - RNA, 63 nt, Human; identical to SEQ ID NO: 456456

SEQ ID NO: 469564 - RNA, 63 nt, Human; identical to SEQ ID NO: 456457

SEQ ID NO: 469565 - RNA, 63 nt, Human; identical to SEQ ID NO: 456458

SEQ ID NO: 469566 - RNA, 63 nt, Human; identical to SEQ ID NO: 456459

SEQ ID NO: 469567 - RNA, 63 nt, Human; identical to SEQ ID NO: 456460

SEQ ID NO: 469568 - RNA, 63 nt, Human; identical to SEQ ID NO: 456461

SEQ ID NO: 469569 - RNA, 63 nt, Human; identical to SEQ ID NO: 456462

SEQ ID NO: 469570 - RNA, 63 nt, Human; identical to SEQ ID NO: 456463

SEQ ID NO: 469571 - RNA, 63 nt, Human; identical to SEQ ID NO: 456464

SEQ ID NO: 469572 - RNA, 63 nt, Human; identical to SEQ ID NO: 456465

SEQ ID NO: 469573 - RNA, 63 nt, Human; identical to SEQ ID NO: 456470

SEQ ID NO: 469574 - RNA, 63 nt, Human; identical to SEQ ID NO: 456471

SEQ ID NO: 469575 - RNA, 63 nt, Human; identical to SEQ ID NO: 456472

SEQ ID NO: 469576 - RNA, 63 nt, Human; identical to SEQ ID NO: 456473

SEQ ID NO: 469577 - RNA, 63 nt, Human; identical to SEQ ID NO: 456474

SEQ ID NO: 469578 - RNA, 63 nt, Human; identical to SEQ ID NO: 456475

SEQ ID NO: 469579 - RNA, 63 nt, Human; identical to SEQ ID NO: 456476

SEQ ID NO: 469580 - RNA, 63 nt, Human; identical to SEQ ID NO: 456477

SEQ ID NO: 469581 - RNA, 63 nt, Human; identical to SEQ ID NO: 456478

SEQ ID NO: 469582 - RNA, 63 nt, Human; identical to SEQ ID NO: 456479

SEQ ID NO: 469583 - RNA, 63 nt, Human; identical to SEQ ID NO: 456480

SEQ ID NO: 469584 - RNA, 63 nt, Human; identical to SEQ ID NO: 456481

SEQ ID NO: 469585 - RNA, 63 nt, Human; identical to SEQ ID NO: 456482

SEQ ID NO: 469586 - RNA, 63 nt, Human; identical to SEQ ID NO: 456483

SEQ ID NO: 469587 - RNA, 63 nt, Human; identical to SEQ ID NO: 456484

SEQ ID NO: 469588 - RNA, 63 nt, Human; identical to SEQ ID NO: 456485

SEQ ID NO: 469589 - RNA, 63 nt, Human; identical to SEQ ID NO: 456486

SEQ ID NO: 469590 - RNA, 63 nt, Human; identical to SEQ ID NO: 456487

SEQ ID NO: 469591 - RNA, 63 nt, Human; identical to SEQ ID NO: 456490

SEQ ID NO: 469592 - RNA, 63 nt, Human; identical to SEQ ID NO: 456491

SEQ ID NO: 469593 - RNA, 63 nt, Human; identical to SEQ ID NO: 456492

SEQ ID NO: 469594 - RNA, 63 nt, Human; identical to SEQ ID NO: 456493

SEQ ID NO: 469595 - RNA, 63 nt, Human; identical to SEQ ID NO: 456494

SEQ ID NO: 469596 - RNA, 63 nt, Human; identical to SEQ ID NO: 456495

SEQ ID NO: 469597 - RNA, 63 nt, Human; identical to SEQ ID NO: 456496

SEQ ID NO: 469598 - RNA, 63 nt, Human; identical to SEQ ID NO: 456497

SEQ ID NO: 469599 - RNA, 63 nt, Human; identical to SEQ ID NO: 456498

SEQ ID NO: 469600 - RNA, 63 nt, Human; identical to SEQ ID NO: 456499

SEQ ID NO: 469601 - RNA, 63 nt, Human; identical to SEQ ID NO: 456500

SEQ ID NO: 469602 - RNA, 63 nt, Human; identical to SEQ ID NO: 456501

SEQ ID NO: 469603 - RNA, 63 nt, Human; identical to SEQ ID NO: 456502

SEQ ID NO: 469604 - RNA, 63 nt, Human; identical to SEQ ID NO: 456503

SEQ ID NO: 469605 - RNA, 63 nt, Human; identical to SEQ ID NO: 456504

SEQ ID NO: 469606 - RNA, 63 nt, Human; identical to SEQ ID NO: 456505

SEQ ID NO: 469607 - RNA, 63 nt, Human; identical to SEQ ID NO: 456506

SEQ ID NO: 469608 - RNA, 63 nt, Human; identical to SEQ ID NO: 456510

SEQ ID NO: 469609 - RNA, 63 nt, Human; identical to SEQ ID NO: 456511

SEQ ID NO: 469610 - RNA, 63 nt, Human; identical to SEQ ID NO: 456512

SEQ ID NO: 469611 - RNA, 63 nt, Human; identical to SEQ ID NO: 456513

SEQ ID NO: 469612 - RNA, 63 nt, Human; identical to SEQ ID NO: 456514

SEQ ID NO: 469613 - RNA, 63 nt, Human; identical to SEQ ID NO: 456515

SEQ ID NO: 469614 - RNA, 63 nt, Human; identical to SEQ ID NO: 456516

SEQ ID NO: 469615 - RNA, 63 nt, Human; identical to SEQ ID NO: 456517

SEQ ID NO: 469616 - RNA, 63 nt, Human; identical to SEQ ID NO: 456518

SEQ ID NO: 469617 - RNA, 63 nt, Human; identical to SEQ ID NO: 456519

SEQ ID NO: 469618 - RNA, 63 nt, Human; identical to SEQ ID NO: 456520

SEQ ID NO: 469619 - RNA, 63 nt, Human; identical to SEQ ID NO: 456521

SEQ ID NO: 469620 - RNA, 63 nt, Human; identical to SEQ ID NO: 456522

SEQ ID NO: 469621 - RNA, 63 nt, Human; identical to SEQ ID NO: 456523

SEQ ID NO: 469622 - RNA, 63 nt, Human; identical to SEQ ID NO: 456524

SEQ ID NO: 469623 - RNA, 63 nt, Human; identical to SEQ ID NO: 456525

SEQ ID NO: 469624 - RNA, 63 nt, Human; identical to SEQ ID NO: 456526

SEQ ID NO: 469625 - RNA, 63 nt, Human; identical to SEQ ID NO: 456527

SEQ ID NO: 469626 - RNA, 63 nt, Human; identical to SEQ ID NO: 456530

SEQ ID NO: 469627 - RNA, 63 nt, Human; identical to SEQ ID NO: 456531

SEQ ID NO: 469628 - RNA, 51 nt, Human; identical to SEQ ID NO: 456532

SEQ ID NO: 469629 - RNA, 63 nt, Human; identical to SEQ ID NO: 456533

SEQ ID NO: 469630 - RNA, 63 nt, Human; identical to SEQ ID NO: 456534

SEQ ID NO: 469631 - RNA, 63 nt, Human; identical to SEQ ID NO: 456535

SEQ ID NO: 469632 - RNA, 63 nt, Human; identical to SEQ ID NO: 456536

SEQ ID NO: 469633 - RNA, 63 nt, Human; identical to SEQ ID NO: 456537

SEQ ID NO: 469634 - RNA, 63 nt, Human; identical to SEQ ID NO: 456538

SEQ ID NO: 469635 - RNA, 63 nt, Human; identical to SEQ ID NO: 456539

SEQ ID NO: 469636 - RNA, 63 nt, Human; identical to SEQ ID NO: 456540

SEQ ID NO: 469637 - RNA, 63 nt, Human; identical to SEQ ID NO: 456541

SEQ ID NO: 469638 - RNA, 63 nt, Human; identical to SEQ ID NO: 456542

SEQ ID NO: 469639 - RNA, 52 nt, Human; identical to SEQ ID NO: 456543

SEQ ID NO: 469640 - RNA, 63 nt, Human; identical to SEQ ID NO: 456544

SEQ ID NO: 469641 - RNA, 63 nt, Human; identical to SEQ ID NO: 456545

SEQ ID NO: 469642 - RNA, 63 nt, Human; identical to SEQ ID NO: 456546

SEQ ID NO: 469643 - RNA, 63 nt, Human; identical to SEQ ID NO: 456547

SEQ ID NO: 469644 - RNA, 63 nt, Human; identical to SEQ ID NO: 456548

SEQ ID NO: 469645 - RNA, 63 nt, Human; identical to SEQ ID NO: 456549

SEQ ID NO: 469646 - RNA, 63 nt, Human; identical to SEQ ID NO: 456550

SEQ ID NO: 469647 - RNA, 63 nt, Human; identical to SEQ ID NO: 456551

SEQ ID NO: 469648 - RNA, 63 nt, Human; identical to SEQ ID NO: 456552

SEQ ID NO: 469649 - RNA, 63 nt, Human; identical to SEQ ID NO: 456553

SEQ ID NO: 469650 - RNA, 63 nt, Human; identical to SEQ ID NO: 456554

SEQ ID NO: 469651 - RNA, 63 nt, Human; identical to SEQ ID NO: 456555

SEQ ID NO: 469652 - RNA, 63 nt, Human; identical to SEQ ID NO: 456556

SEQ ID NO: 469653 - RNA, 63 nt, Human; identical to SEQ ID NO: 456557

SEQ ID NO: 469654 - RNA, 63 nt, Human; identical to SEQ ID NO: 456558

SEQ ID NO: 469655 - RNA, 63 nt, Human; identical to SEQ ID NO: 456559

SEQ ID NO: 469656 - RNA, 63 nt, Human; identical to SEQ ID NO: 456560

SEQ ID NO: 469657 - RNA, 63 nt, Human; identical to SEQ ID NO: 456561

SEQ ID NO: 469658 - RNA, 63 nt, Human; identical to SEQ ID NO: 456562

SEQ ID NO: 469659 - RNA, 63 nt, Human; identical to SEQ ID NO: 456563

SEQ ID NO: 469660 - RNA, 63 nt, Human; identical to SEQ ID NO: 456564

SEQ ID NO: 469661 - RNA, 63 nt, Human; identical to SEQ ID NO: 456565

SEQ ID NO: 469662 - RNA, 63 nt, Human; identical to SEQ ID NO: 456566

SEQ ID NO: 469663 - RNA, 63 nt, Human; identical to SEQ ID NO: 456567

SEQ ID NO: 469664 - RNA, 63 nt, Human; identical to SEQ ID NO: 456568

SEQ ID NO: 469665 - RNA, 63 nt, Human; identical to SEQ ID NO: 456569

SEQ ID NO: 469666 - RNA, 63 nt, Human; identical to SEQ ID NO: 456570

SEQ ID NO: 469667 - RNA, 63 nt, Human; identical to SEQ ID NO: 456571

SEQ ID NO: 469668 - RNA, 63 nt, Human; identical to SEQ ID NO: 456572

SEQ ID NO: 469669 - RNA, 63 nt, Human; identical to SEQ ID NO: 456573

SEQ ID NO: 469670 - RNA, 63 nt, Human; identical to SEQ ID NO: 456574

SEQ ID NO: 469671 - RNA, 63 nt, Human; identical to SEQ ID NO: 456575

SEQ ID NO: 469672 - RNA, 63 nt, Human; identical to SEQ ID NO: 456576

SEQ ID NO: 469673 - RNA, 63 nt, Human; identical to SEQ ID NO: 456577

SEQ ID NO: 469674 - RNA, 63 nt, Human; identical to SEQ ID NO: 456578

SEQ ID NO: 469675 - RNA, 63 nt, Human; identical to SEQ ID NO: 456579

SEQ ID NO: 469676 - RNA, 63 nt, Human; identical to SEQ ID NO: 456580

SEQ ID NO: 469677 - RNA, 63 nt, Human; identical to SEQ ID NO: 456581

SEQ ID NO: 469678 - RNA, 63 nt, Human; identical to SEQ ID NO: 456582

SEQ ID NO: 469679 - RNA, 63 nt, Human; identical to SEQ ID NO: 456583

SEQ ID NO: 469680 - RNA, 63 nt, Human; identical to SEQ ID NO: 456584

SEQ ID NO: 469681 - RNA, 63 nt, Human; identical to SEQ ID NO: 456585

SEQ ID NO: 469682 - RNA, 63 nt, Human; identical to SEQ ID NO: 456586

SEQ ID NO: 469683 - RNA, 63 nt, Human; identical to SEQ ID NO: 456587

SEQ ID NO: 469684 - RNA, 63 nt, Human; identical to SEQ ID NO: 456588

SEQ ID NO: 469685 - RNA, 63 nt, Human; identical to SEQ ID NO: 456589

SEQ ID NO: 469686 - RNA, 63 nt, Human; identical to SEQ ID NO: 456590

SEQ ID NO: 469687 - RNA, 63 nt, Human; identical to SEQ ID NO: 456591

SEQ ID NO: 469688 - RNA, 63 nt, Human; identical to SEQ ID NO: 456592

SEQ ID NO: 469689 - RNA, 63 nt, Human; identical to SEQ ID NO: 456593

SEQ ID NO: 469690 - RNA, 63 nt, Human; identical to SEQ ID NO: 456594

SEQ ID NO: 469691 - RNA, 63 nt, Human; identical to SEQ ID NO: 456595

SEQ ID NO: 469692 - RNA, 63 nt, Human; identical to SEQ ID NO: 456596

SEQ ID NO: 469693 - RNA, 63 nt, Human; identical to SEQ ID NO: 456600

SEQ ID NO: 469694 - RNA, 63 nt, Human; identical to SEQ ID NO: 456601

SEQ ID NO: 469695 - RNA, 63 nt, Human; identical to SEQ ID NO: 456602

SEQ ID NO: 469696 - RNA, 63 nt, Human; identical to SEQ ID NO: 456603

SEQ ID NO: 469697 - RNA, 63 nt, Human; identical to SEQ ID NO: 456604

SEQ ID NO: 469698 - RNA, 63 nt, Human; identical to SEQ ID NO: 456605

SEQ ID NO: 469699 - RNA, 63 nt, Human; identical to SEQ ID NO: 456606

SEQ ID NO: 469700 - RNA, 63 nt, Human; identical to SEQ ID NO: 456607

SEQ ID NO: 469701 - RNA, 63 nt, Human; identical to SEQ ID NO: 456608

SEQ ID NO: 469702 - RNA, 63 nt, Human; identical to SEQ ID NO: 456609

SEQ ID NO: 469703 - RNA, 63 nt, Human; identical to SEQ ID NO: 456610

SEQ ID NO: 469704 - RNA, 63 nt, Human; identical to SEQ ID NO: 456611

SEQ ID NO: 469705 - RNA, 63 nt, Human; identical to SEQ ID NO: 456612

SEQ ID NO: 469706 - RNA, 63 nt, Human; identical to SEQ ID NO: 456613

SEQ ID NO: 469707 - RNA, 63 nt, Human; identical to SEQ ID NO: 456614

SEQ ID NO: 469708 - RNA, 63 nt, Human; identical to SEQ ID NO: 456615

SEQ ID NO: 469709 - RNA, 63 nt, Human; identical to SEQ ID NO: 456616

SEQ ID NO: 469710 - RNA, 63 nt, Human; identical to SEQ ID NO: 456617

SEQ ID NO: 469711 - RNA, 63 nt, Human; identical to SEQ ID NO: 456618

SEQ ID NO: 469712 - RNA, 63 nt, Human; identical to SEQ ID NO: 456619

SEQ ID NO: 469713 - RNA, 63 nt, Human; identical to SEQ ID NO: 456620

SEQ ID NO: 469714 - RNA, 63 nt, Human; identical to SEQ ID NO: 456621

SEQ ID NO: 469715 - RNA, 63 nt, Human; identical to SEQ ID NO: 456622

SEQ ID NO: 469716 - RNA, 63 nt, Human; identical to SEQ ID NO: 456623

SEQ ID NO: 469717 - RNA, 63 nt, Human; identical to SEQ ID NO: 456624

SEQ ID NO: 469718 - RNA, 63 nt, Human; identical to SEQ ID NO: 456625

SEQ ID NO: 469719 - RNA, 63 nt, Human; identical to SEQ ID NO: 456626

SEQ ID NO: 469720 - RNA, 63 nt, Human; identical to SEQ ID NO: 456627

SEQ ID NO: 469721 - RNA, 63 nt, Human; identical to SEQ ID NO: 456628

SEQ ID NO: 469722 - RNA, 63 nt, Human; identical to SEQ ID NO: 456629

SEQ ID NO: 469723 - RNA, 63 nt, Human; identical to SEQ ID NO: 456630

SEQ ID NO: 469724 - RNA, 63 nt, Human; identical to SEQ ID NO: 456631

SEQ ID NO: 469725 - RNA, 63 nt, Human; identical to SEQ ID NO: 456632

SEQ ID NO: 469726 - RNA, 63 nt, Human; identical to SEQ ID NO: 456633

SEQ ID NO: 469727 - RNA, 63 nt, Human; identical to SEQ ID NO: 456634

SEQ ID NO: 469728 - RNA, 63 nt, Human; identical to SEQ ID NO: 456636

SEQ ID NO: 469729 - RNA, 63 nt, Human; identical to SEQ ID NO: 456637

SEQ ID NO: 469730 - RNA, 62 nt, Human; identical to SEQ ID NO: 456638

SEQ ID NO: 469731 - RNA, 63 nt, Human; identical to SEQ ID NO: 456639

SEQ ID NO: 469732 - RNA, 63 nt, Human; identical to SEQ ID NO: 456640

SEQ ID NO: 469733 - RNA, 63 nt, Human; identical to SEQ ID NO: 456641

SEQ ID NO: 469734 - RNA, 63 nt, Human; identical to SEQ ID NO: 456642

SEQ ID NO: 469735 - RNA, 63 nt, Human; identical to SEQ ID NO: 456643

SEQ ID NO: 469736 - RNA, 63 nt, Human; identical to SEQ ID NO: 456644

SEQ ID NO: 469737 - RNA, 63 nt, Human; identical to SEQ ID NO: 456645

SEQ ID NO: 469738 - RNA, 63 nt, Human; identical to SEQ ID NO: 456646

SEQ ID NO: 469739 - RNA, 63 nt, Human; identical to SEQ ID NO: 456647

SEQ ID NO: 469740 - RNA, 63 nt, Human; identical to SEQ ID NO: 456648

SEQ ID NO: 469741 - RNA, 63 nt, Human; identical to SEQ ID NO: 456649

SEQ ID NO: 469742 - RNA, 63 nt, Human; identical to SEQ ID NO: 456650

SEQ ID NO: 469743 - RNA, 63 nt, Human; identical to SEQ ID NO: 456651

SEQ ID NO: 469744 - RNA, 54 nt, Human; identical to SEQ ID NO: 456652

SEQ ID NO: 469745 - RNA, 63 nt, Human; identical to SEQ ID NO: 456656

SEQ ID NO: 469746 - RNA, 63 nt, Human; identical to SEQ ID NO: 456657

SEQ ID NO: 469747 - RNA, 63 nt, Human; identical to SEQ ID NO: 456658

SEQ ID NO: 469748 - RNA, 63 nt, Human; identical to SEQ ID NO: 456659

SEQ ID NO: 469749 - RNA, 63 nt, Human; identical to SEQ ID NO: 456660

SEQ ID NO: 469750 - RNA, 63 nt, Human; identical to SEQ ID NO: 456661

SEQ ID NO: 469751 - RNA, 63 nt, Human; identical to SEQ ID NO: 456662

SEQ ID NO: 469752 - RNA, 63 nt, Human; identical to SEQ ID NO: 456663

SEQ ID NO: 469753 - RNA, 63 nt, Human; identical to SEQ ID NO: 456664

SEQ ID NO: 469754 - RNA, 63 nt, Human; identical to SEQ ID NO: 456665

SEQ ID NO: 469755 - RNA, 63 nt, Human; identical to SEQ ID NO: 456666

SEQ ID NO: 469756 - RNA, 63 nt, Human; identical to SEQ ID NO: 456667

SEQ ID NO: 469757 - RNA, 63 nt, Human; identical to SEQ ID NO: 456668

SEQ ID NO: 469758 - RNA, 63 nt, Human; identical to SEQ ID NO: 456669

SEQ ID NO: 469759 - RNA, 63 nt, Human; identical to SEQ ID NO: 456670

SEQ ID NO: 469760 - RNA, 63 nt, Human; identical to SEQ ID NO: 456671

SEQ ID NO: 469761 - RNA, 63 nt, Human; identical to SEQ ID NO: 456672

SEQ ID NO: 469762 - RNA, 63 nt, Human; identical to SEQ ID NO: 456676

SEQ ID NO: 469763 - RNA, 63 nt, Human; identical to SEQ ID NO: 456677

SEQ ID NO: 469764 - RNA, 63 nt, Human; identical to SEQ ID NO: 456678

SEQ ID NO: 469765 - RNA, 63 nt, Human; identical to SEQ ID NO: 456679

SEQ ID NO: 469766 - RNA, 63 nt, Human; identical to SEQ ID NO: 456680

SEQ ID NO: 469767 - RNA, 63 nt, Human; identical to SEQ ID NO: 456681

SEQ ID NO: 469768 - RNA, 63 nt, Human; identical to SEQ ID NO: 456682

SEQ ID NO: 469769 - RNA, 63 nt, Human; identical to SEQ ID NO: 456683

SEQ ID NO: 469770 - RNA, 63 nt, Human; identical to SEQ ID NO: 456684

SEQ ID NO: 469771 - RNA, 63 nt, Human; identical to SEQ ID NO: 456685

SEQ ID NO: 469772 - RNA, 63 nt, Human; identical to SEQ ID NO: 456686

SEQ ID NO: 469773 - RNA, 63 nt, Human; identical to SEQ ID NO: 456687

SEQ ID NO: 469774 - RNA, 63 nt, Human; identical to SEQ ID NO: 456688

SEQ ID NO: 469775 - RNA, 63 nt, Human; identical to SEQ ID NO: 456689

SEQ ID NO: 469776 - RNA, 63 nt, Human; identical to SEQ ID NO: 456690

SEQ ID NO: 469777 - RNA, 63 nt, Human; identical to SEQ ID NO: 456691

SEQ ID NO: 469778 - RNA, 63 nt, Human; identical to SEQ ID NO: 456692

SEQ ID NO: 469779 - RNA, 63 nt, Human; identical to SEQ ID NO: 456696

SEQ ID NO: 469780 - RNA, 63 nt, Human; identical to SEQ ID NO: 456697

SEQ ID NO: 469781 - RNA, 63 nt, Human; identical to SEQ ID NO: 456698

SEQ ID NO: 469782 - RNA, 63 nt, Human; identical to SEQ ID NO: 456699

SEQ ID NO: 469783 - RNA, 63 nt, Human; identical to SEQ ID NO: 456700

SEQ ID NO: 469784 - RNA, 54 nt, Human; identical to SEQ ID NO: 456701

SEQ ID NO: 469785 - RNA, 63 nt, Human; identical to SEQ ID NO: 456702

SEQ ID NO: 469786 - RNA, 63 nt, Human; identical to SEQ ID NO: 456703

SEQ ID NO: 469787 - RNA, 63 nt, Human; identical to SEQ ID NO: 456704

SEQ ID NO: 469788 - RNA, 63 nt, Human; identical to SEQ ID NO: 456705

SEQ ID NO: 469789 - RNA, 63 nt, Human; identical to SEQ ID NO: 456706

SEQ ID NO: 469790 - RNA, 63 nt, Human; identical to SEQ ID NO: 456707

SEQ ID NO: 469791 - RNA, 63 nt, Human; identical to SEQ ID NO: 456708

SEQ ID NO: 469792 - RNA, 63 nt, Human; identical to SEQ ID NO: 456709

SEQ ID NO: 469793 - RNA, 63 nt, Human; identical to SEQ ID NO: 456710

SEQ ID NO: 469794 - RNA, 63 nt, Human; identical to SEQ ID NO: 456711

SEQ ID NO: 469795 - RNA, 63 nt, Human; identical to SEQ ID NO: 456712

SEQ ID NO: 469796 - RNA, 63 nt, Human; identical to SEQ ID NO: 456716

SEQ ID NO: 469797 - RNA, 63 nt, Human; identical to SEQ ID NO: 456717

SEQ ID NO: 469798 - RNA, 63 nt, Human; identical to SEQ ID NO: 456718

SEQ ID NO: 469799 - RNA, 63 nt, Human; identical to SEQ ID NO: 456719

SEQ ID NO: 469800 - RNA, 63 nt, Human; identical to SEQ ID NO: 456720

SEQ ID NO: 469801 - RNA, 63 nt, Human; identical to SEQ ID NO: 456721

SEQ ID NO: 469802 - RNA, 63 nt, Human; identical to SEQ ID NO: 456722

SEQ ID NO: 469803 - RNA, 63 nt, Human; identical to SEQ ID NO: 456723

SEQ ID NO: 469804 - RNA, 63 nt, Human; identical to SEQ ID NO: 456724

SEQ ID NO: 469805 - RNA, 63 nt, Human; identical to SEQ ID NO: 456725

SEQ ID NO: 469806 - RNA, 63 nt, Human; identical to SEQ ID NO: 456726

SEQ ID NO: 469807 - RNA, 63 nt, Human; identical to SEQ ID NO: 456727

SEQ ID NO: 469808 - RNA, 63 nt, Human; identical to SEQ ID NO: 456728

SEQ ID NO: 469809 - RNA, 63 nt, Human; identical to SEQ ID NO: 456729

SEQ ID NO: 469810 - RNA, 63 nt, Human; identical to SEQ ID NO: 456730

SEQ ID NO: 469811 - RNA, 63 nt, Human; identical to SEQ ID NO: 456731

SEQ ID NO: 469812 - RNA, 61 nt, Human; identical to SEQ ID NO: 456732

SEQ ID NO: 469813 - RNA, 63 nt, Human; identical to SEQ ID NO: 456736

SEQ ID NO: 469814 - RNA, 63 nt, Human; identical to SEQ ID NO: 456737

SEQ ID NO: 469815 - RNA, 63 nt, Human; identical to SEQ ID NO: 456738

SEQ ID NO: 469816 - RNA, 63 nt, Human; identical to SEQ ID NO: 456739

SEQ ID NO: 469817 - RNA, 63 nt, Human; identical to SEQ ID NO: 456740

SEQ ID NO: 469818 - RNA, 63 nt, Human; identical to SEQ ID NO: 456741

SEQ ID NO: 469819 - RNA, 63 nt, Human; identical to SEQ ID NO: 456742

SEQ ID NO: 469820 - RNA, 63 nt, Human; identical to SEQ ID NO: 456743

SEQ ID NO: 469821 - RNA, 63 nt, Human; identical to SEQ ID NO: 456744

SEQ ID NO: 469822 - RNA, 63 nt, Human; identical to SEQ ID NO: 456745

SEQ ID NO: 469823 - RNA, 63 nt, Human; identical to SEQ ID NO: 456746

SEQ ID NO: 469824 - RNA, 63 nt, Human; identical to SEQ ID NO: 456747

SEQ ID NO: 469825 - RNA, 63 nt, Human; identical to SEQ ID NO: 456748

SEQ ID NO: 469826 - RNA, 63 nt, Human; identical to SEQ ID NO: 456749

SEQ ID NO: 469827 - RNA, 63 nt, Human; identical to SEQ ID NO: 456750

SEQ ID NO: 469828 - RNA, 63 nt, Human; identical to SEQ ID NO: 456751

SEQ ID NO: 469829 - RNA, 63 nt, Human; identical to SEQ ID NO: 456752

SEQ ID NO: 469830 - RNA, 63 nt, Human; identical to SEQ ID NO: 456756

SEQ ID NO: 469831 - RNA, 63 nt, Human; identical to SEQ ID NO: 456757

SEQ ID NO: 469832 - RNA, 63 nt, Human; identical to SEQ ID NO: 456758

SEQ ID NO: 469833 - RNA, 63 nt, Human; identical to SEQ ID NO: 456759

SEQ ID NO: 469834 - RNA, 51 nt, Human; identical to SEQ ID NO: 456760

SEQ ID NO: 469835 - RNA, 63 nt, Human; identical to SEQ ID NO: 456761

SEQ ID NO: 469836 - RNA, 63 nt, Human; identical to SEQ ID NO: 456762

SEQ ID NO: 469837 - RNA, 63 nt, Human; identical to SEQ ID NO: 456763

SEQ ID NO: 469838 - RNA, 63 nt, Human; identical to SEQ ID NO: 456764

SEQ ID NO: 469839 - RNA, 63 nt, Human; identical to SEQ ID NO: 456765

SEQ ID NO: 469840 - RNA, 63 nt, Human; identical to SEQ ID NO: 456766

SEQ ID NO: 469841 - RNA, 63 nt, Human; identical to SEQ ID NO: 456767

SEQ ID NO: 469842 - RNA, 63 nt, Human; identical to SEQ ID NO: 456768

SEQ ID NO: 469843 - RNA, 63 nt, Human; identical to SEQ ID NO: 456769

SEQ ID NO: 469844 - RNA, 63 nt, Human; identical to SEQ ID NO: 456770

SEQ ID NO: 469845 - RNA, 63 nt, Human; identical to SEQ ID NO: 456771

SEQ ID NO: 469846 - RNA, 63 nt, Human; identical to SEQ ID NO: 456772

SEQ ID NO: 469847 - RNA, 63 nt, Human; identical to SEQ ID NO: 456776

SEQ ID NO: 469848 - RNA, 63 nt, Human; identical to SEQ ID NO: 456777

SEQ ID NO: 469849 - RNA, 63 nt, Human; identical to SEQ ID NO: 456778

SEQ ID NO: 469850 - RNA, 63 nt, Human; identical to SEQ ID NO: 456779

SEQ ID NO: 469851 - RNA, 63 nt, Human; identical to SEQ ID NO: 456780

SEQ ID NO: 469852 - RNA, 63 nt, Human; identical to SEQ ID NO: 456781

SEQ ID NO: 469853 - RNA, 63 nt, Human; identical to SEQ ID NO: 456782

SEQ ID NO: 469854 - RNA, 63 nt, Human; identical to SEQ ID NO: 456783

SEQ ID NO: 469855 - RNA, 63 nt, Human; identical to SEQ ID NO: 456784

SEQ ID NO: 469856 - RNA, 63 nt, Human; identical to SEQ ID NO: 456785

SEQ ID NO: 469857 - RNA, 63 nt, Human; identical to SEQ ID NO: 456786

SEQ ID NO: 469858 - RNA, 63 nt, Human; identical to SEQ ID NO: 456787

SEQ ID NO: 469859 - RNA, 63 nt, Human; identical to SEQ ID NO: 456788

SEQ ID NO: 469860 - RNA, 63 nt, Human; identical to SEQ ID NO: 456789

SEQ ID NO: 469861 - RNA, 63 nt, Human; identical to SEQ ID NO: 456790

SEQ ID NO: 469862 - RNA, 63 nt, Human; identical to SEQ ID NO: 456791

SEQ ID NO: 469863 - RNA, 63 nt, Human; identical to SEQ ID NO: 456792

SEQ ID NO: 469864 - RNA, 63 nt, Human; identical to SEQ ID NO: 456796

SEQ ID NO: 469865 - RNA, 63 nt, Human; identical to SEQ ID NO: 456797

SEQ ID NO: 469866 - RNA, 63 nt, Human; identical to SEQ ID NO: 456798

SEQ ID NO: 469867 - RNA, 63 nt, Human; identical to SEQ ID NO: 456799

SEQ ID NO: 469868 - RNA, 63 nt, Human; identical to SEQ ID NO: 456800

SEQ ID NO: 469869 - RNA, 63 nt, Human; identical to SEQ ID NO: 456801

SEQ ID NO: 469870 - RNA, 63 nt, Human; identical to SEQ ID NO: 456802

SEQ ID NO: 469871 - RNA, 63 nt, Human; identical to SEQ ID NO: 456803

SEQ ID NO: 469872 - RNA, 63 nt, Human; identical to SEQ ID NO: 456804

SEQ ID NO: 469873 - RNA, 63 nt, Human; identical to SEQ ID NO: 456805

SEQ ID NO: 469874 - RNA, 63 nt, Human; identical to SEQ ID NO: 456806

SEQ ID NO: 469875 - RNA, 63 nt, Human; identical to SEQ ID NO: 456807

SEQ ID NO: 469876 - RNA, 63 nt, Human; identical to SEQ ID NO: 456808

SEQ ID NO: 469877 - RNA, 63 nt, Human; identical to SEQ ID NO: 456809

SEQ ID NO: 469878 - RNA, 63 nt, Human; identical to SEQ ID NO: 456810

SEQ ID NO: 469879 - RNA, 63 nt, Human; identical to SEQ ID NO: 456811

SEQ ID NO: 469880 - RNA, 63 nt, Human; identical to SEQ ID NO: 456812

SEQ ID NO: 469881 - RNA, 63 nt, Human; identical to SEQ ID NO: 456813

SEQ ID NO: 469882 - RNA, 63 nt, Human; identical to SEQ ID NO: 456816

SEQ ID NO: 469883 - RNA, 63 nt, Human; identical to SEQ ID NO: 456817

SEQ ID NO: 469884 - RNA, 63 nt, Human; identical to SEQ ID NO: 456818

SEQ ID NO: 469885 - RNA, 63 nt, Human; identical to SEQ ID NO: 456819

SEQ ID NO: 469886 - RNA, 63 nt, Human; identical to SEQ ID NO: 456820

SEQ ID NO: 469887 - RNA, 63 nt, Human; identical to SEQ ID NO: 456821

SEQ ID NO: 469888 - RNA, 63 nt, Human; identical to SEQ ID NO: 456822

SEQ ID NO: 469889 - RNA, 63 nt, Human; identical to SEQ ID NO: 456823

SEQ ID NO: 469890 - RNA, 63 nt, Human; identical to SEQ ID NO: 456824

SEQ ID NO: 469891 - RNA, 63 nt, Human; identical to SEQ ID NO: 456825

SEQ ID NO: 469892 - RNA, 63 nt, Human; identical to SEQ ID NO: 456826

SEQ ID NO: 469893 - RNA, 63 nt, Human; identical to SEQ ID NO: 456827

SEQ ID NO: 469894 - RNA, 63 nt, Human; identical to SEQ ID NO: 456828

SEQ ID NO: 469895 - RNA, 63 nt, Human; identical to SEQ ID NO: 456829

SEQ ID NO: 469896 - RNA, 63 nt, Human; identical to SEQ ID NO: 456830

SEQ ID NO: 469897 - RNA, 63 nt, Human; identical to SEQ ID NO: 456831

SEQ ID NO: 469898 - RNA, 63 nt, Human; identical to SEQ ID NO: 456832

SEQ ID NO: 469899 - RNA, 63 nt, Human; identical to SEQ ID NO: 456836

SEQ ID NO: 469900 - RNA, 63 nt, Human; identical to SEQ ID NO: 456837

SEQ ID NO: 469901 - RNA, 63 nt, Human; identical to SEQ ID NO: 456838

SEQ ID NO: 469902 - RNA, 63 nt, Human; identical to SEQ ID NO: 456839

SEQ ID NO: 469903 - RNA, 63 nt, Human; identical to SEQ ID NO: 456840

SEQ ID NO: 469904 - RNA, 63 nt, Human; identical to SEQ ID NO: 456841

SEQ ID NO: 469905 - RNA, 63 nt, Human; identical to SEQ ID NO: 456842

SEQ ID NO: 469906 - RNA, 63 nt, Human; identical to SEQ ID NO: 456843

SEQ ID NO: 469907 - RNA, 63 nt, Human; identical to SEQ ID NO: 456844

SEQ ID NO: 469908 - RNA, 63 nt, Human; identical to SEQ ID NO: 456845

SEQ ID NO: 469909 - RNA, 63 nt, Human; identical to SEQ ID NO: 456846

SEQ ID NO: 469910 - RNA, 63 nt, Human; identical to SEQ ID NO: 456847

SEQ ID NO: 469911 - RNA, 63 nt, Human; identical to SEQ ID NO: 456848

SEQ ID NO: 469912 - RNA, 63 nt, Human; identical to SEQ ID NO: 456849

SEQ ID NO: 469913 - RNA, 63 nt, Human; identical to SEQ ID NO: 456850

SEQ ID NO: 469914 - RNA, 63 nt, Human; identical to SEQ ID NO: 456851

SEQ ID NO: 469915 - RNA, 63 nt, Human; identical to SEQ ID NO: 456852

SEQ ID NO: 469916 - RNA, 63 nt, Human; identical to SEQ ID NO: 456856

SEQ ID NO: 469917 - RNA, 63 nt, Human; identical to SEQ ID NO: 456857

SEQ ID NO: 469918 - RNA, 63 nt, Human; identical to SEQ ID NO: 456858

SEQ ID NO: 469919 - RNA, 63 nt, Human; identical to SEQ ID NO: 456859

SEQ ID NO: 469920 - RNA, 63 nt, Human; identical to SEQ ID NO: 456860

SEQ ID NO: 469921 - RNA, 63 nt, Human; identical to SEQ ID NO: 456861

SEQ ID NO: 469922 - RNA, 63 nt, Human; identical to SEQ ID NO: 456862

SEQ ID NO: 469923 - RNA, 63 nt, Human; identical to SEQ ID NO: 456863

SEQ ID NO: 469924 - RNA, 60 nt, Human; identical to SEQ ID NO: 456864

SEQ ID NO: 469925 - RNA, 63 nt, Human; identical to SEQ ID NO: 456865

SEQ ID NO: 469926 - RNA, 63 nt, Human; identical to SEQ ID NO: 456866

SEQ ID NO: 469927 - RNA, 63 nt, Human; identical to SEQ ID NO: 456867

SEQ ID NO: 469928 - RNA, 63 nt, Human; identical to SEQ ID NO: 456868

SEQ ID NO: 469929 - RNA, 63 nt, Human; identical to SEQ ID NO: 456869

SEQ ID NO: 469930 - RNA, 63 nt, Human; identical to SEQ ID NO: 456870

SEQ ID NO: 469931 - RNA, 59 nt, Human; identical to SEQ ID NO: 456871

SEQ ID NO: 469932 - RNA, 63 nt, Human; identical to SEQ ID NO: 456872

SEQ ID NO: 469933 - RNA, 63 nt, Human; identical to SEQ ID NO: 456876

SEQ ID NO: 469934 - RNA, 63 nt, Human; identical to SEQ ID NO: 456877

SEQ ID NO: 469935 - RNA, 63 nt, Human; identical to SEQ ID NO: 456878

SEQ ID NO: 469936 - RNA, 63 nt, Human; identical to SEQ ID NO: 456879

SEQ ID NO: 469937 - RNA, 63 nt, Human; identical to SEQ ID NO: 456880

SEQ ID NO: 469938 - RNA, 63 nt, Human; identical to SEQ ID NO: 456881

SEQ ID NO: 469939 - RNA, 63 nt, Human; identical to SEQ ID NO: 456882

SEQ ID NO: 469940 - RNA, 63 nt, Human; identical to SEQ ID NO: 456883

SEQ ID NO: 469941 - RNA, 63 nt, Human; identical to SEQ ID NO: 456884

SEQ ID NO: 469942 - RNA, 63 nt, Human; identical to SEQ ID NO: 456885

SEQ ID NO: 469943 - RNA, 63 nt, Human; identical to SEQ ID NO: 456886

SEQ ID NO: 469944 - RNA, 63 nt, Human; identical to SEQ ID NO: 456887

SEQ ID NO: 469945 - RNA, 63 nt, Human; identical to SEQ ID NO: 456888

SEQ ID NO: 469946 - RNA, 63 nt, Human; identical to SEQ ID NO: 456889

SEQ ID NO: 469947 - RNA, 63 nt, Human; identical to SEQ ID NO: 456890

SEQ ID NO: 469948 - RNA, 63 nt, Human; identical to SEQ ID NO: 456891

SEQ ID NO: 469949 - RNA, 63 nt, Human; identical to SEQ ID NO: 456892

SEQ ID NO: 469950 - RNA, 63 nt, Human; identical to SEQ ID NO: 456896

SEQ ID NO: 469951 - RNA, 63 nt, Human; identical to SEQ ID NO: 456897

SEQ ID NO: 469952 - RNA, 63 nt, Human; identical to SEQ ID NO: 456898

SEQ ID NO: 469953 - RNA, 63 nt, Human; identical to SEQ ID NO: 456899

SEQ ID NO: 469954 - RNA, 63 nt, Human; identical to SEQ ID NO: 456900

SEQ ID NO: 469955 - RNA, 63 nt, Human; identical to SEQ ID NO: 456901

SEQ ID NO: 469956 - RNA, 63 nt, Human; identical to SEQ ID NO: 456902

SEQ ID NO: 469957 - RNA, 63 nt, Human; identical to SEQ ID NO: 456903

SEQ ID NO: 469958 - RNA, 63 nt, Human; identical to SEQ ID NO: 456904

SEQ ID NO: 469959 - RNA, 63 nt, Human; identical to SEQ ID NO: 456905

SEQ ID NO: 469960 - RNA, 63 nt, Human; identical to SEQ ID NO: 456906

SEQ ID NO: 469961 - RNA, 63 nt, Human; identical to SEQ ID NO: 456907

SEQ ID NO: 469962 - RNA, 63 nt, Human; identical to SEQ ID NO: 456908

SEQ ID NO: 469963 - RNA, 63 nt, Human; identical to SEQ ID NO: 456909

SEQ ID NO: 469964 - RNA, 63 nt, Human; identical to SEQ ID NO: 456910

SEQ ID NO: 469965 - RNA, 63 nt, Human; identical to SEQ ID NO: 456911

SEQ ID NO: 469966 - RNA, 63 nt, Human; identical to SEQ ID NO: 456912

SEQ ID NO: 469967 - RNA, 63 nt, Human; identical to SEQ ID NO: 456916

SEQ ID NO: 469968 - RNA, 63 nt, Human; identical to SEQ ID NO: 456917

SEQ ID NO: 469969 - RNA, 63 nt, Human; identical to SEQ ID NO: 456918

SEQ ID NO: 469970 - RNA, 63 nt, Human; identical to SEQ ID NO: 456919

SEQ ID NO: 469971 - RNA, 63 nt, Human; identical to SEQ ID NO: 456920

SEQ ID NO: 469972 - RNA, 63 nt, Human; identical to SEQ ID NO: 456921

SEQ ID NO: 469973 - RNA, 63 nt, Human; identical to SEQ ID NO: 456922

SEQ ID NO: 469974 - RNA, 63 nt, Human; identical to SEQ ID NO: 456923

SEQ ID NO: 469975 - RNA, 63 nt, Human; identical to SEQ ID NO: 456924

SEQ ID NO: 469976 - RNA, 63 nt, Human; identical to SEQ ID NO: 456925

SEQ ID NO: 469977 - RNA, 63 nt, Human; identical to SEQ ID NO: 456926

SEQ ID NO: 469978 - RNA, 63 nt, Human; identical to SEQ ID NO: 456927

SEQ ID NO: 469979 - RNA, 63 nt, Human; identical to SEQ ID NO: 456928

SEQ ID NO: 469980 - RNA, 63 nt, Human; identical to SEQ ID NO: 456929

SEQ ID NO: 469981 - RNA, 63 nt, Human; identical to SEQ ID NO: 456930

SEQ ID NO: 469982 - RNA, 63 nt, Human; identical to SEQ ID NO: 456931

SEQ ID NO: 469983 - RNA, 63 nt, Human; identical to SEQ ID NO: 456932

SEQ ID NO: 469984 - RNA, 63 nt, Human; identical to SEQ ID NO: 456936

SEQ ID NO: 469985 - RNA, 63 nt, Human; identical to SEQ ID NO: 456937

SEQ ID NO: 469986 - RNA, 63 nt, Human; identical to SEQ ID NO: 456938

SEQ ID NO: 469987 - RNA, 63 nt, Human; identical to SEQ ID NO: 456939

SEQ ID NO: 469988 - RNA, 63 nt, Human; identical to SEQ ID NO: 456940

SEQ ID NO: 469989 - RNA, 63 nt, Human; identical to SEQ ID NO: 456941

SEQ ID NO: 469990 - RNA, 63 nt, Human; identical to SEQ ID NO: 456942

SEQ ID NO: 469991 - RNA, 63 nt, Human; identical to SEQ ID NO: 456943

SEQ ID NO: 469992 - RNA, 63 nt, Human; identical to SEQ ID NO: 456944

SEQ ID NO: 469993 - RNA, 63 nt, Human; identical to SEQ ID NO: 456945

SEQ ID NO: 469994 - RNA, 63 nt, Human; identical to SEQ ID NO: 456946

SEQ ID NO: 469995 - RNA, 63 nt, Human; identical to SEQ ID NO: 456947

SEQ ID NO: 469996 - RNA, 63 nt, Human; identical to SEQ ID NO: 456948

SEQ ID NO: 469997 - RNA, 63 nt, Human; identical to SEQ ID NO: 456949

SEQ ID NO: 469998 - RNA, 63 nt, Human; identical to SEQ ID NO: 456950

SEQ ID NO: 469999 - RNA, 63 nt, Human; identical to SEQ ID NO: 456951

SEQ ID NO: 470000 - RNA, 63 nt, Human; identical to SEQ ID NO: 456952

SEQ ID NO: 470001 - RNA, 63 nt, Human; identical to SEQ ID NO: 456953

SEQ ID NO: 470002 - RNA, 55 nt, Human; identical to SEQ ID NO: 456954

SEQ ID NO: 470003 - RNA, 63 nt, Human; identical to SEQ ID NO: 456955

SEQ ID NO: 470004 - RNA, 63 nt, Human; identical to SEQ ID NO: 456956

SEQ ID NO: 470005 - RNA, 63 nt, Human; identical to SEQ ID NO: 456957

SEQ ID NO: 470006 - RNA, 63 nt, Human; identical to SEQ ID NO: 456958

SEQ ID NO: 470007 - RNA, 63 nt, Human; identical to SEQ ID NO: 456959

SEQ ID NO: 470008 - RNA, 63 nt, Human; identical to SEQ ID NO: 456960

SEQ ID NO: 470009 - RNA, 63 nt, Human; identical to SEQ ID NO: 456961

SEQ ID NO: 470010 - RNA, 63 nt, Human; identical to SEQ ID NO: 456962

SEQ ID NO: 470011 - RNA, 63 nt, Human; identical to SEQ ID NO: 456963

SEQ ID NO: 470012 - RNA, 63 nt, Human; identical to SEQ ID NO: 456964

SEQ ID NO: 470013 - RNA, 63 nt, Human; identical to SEQ ID NO: 456965

SEQ ID NO: 470014 - RNA, 63 nt, Human; identical to SEQ ID NO: 456966

SEQ ID NO: 470015 - RNA, 63 nt, Human; identical to SEQ ID NO: 456967

SEQ ID NO: 470016 - RNA, 63 nt, Human; identical to SEQ ID NO: 456968

SEQ ID NO: 470017 - RNA, 63 nt, Human; identical to SEQ ID NO: 456969

SEQ ID NO: 470018 - RNA, 63 nt, Human; identical to SEQ ID NO: 456970

SEQ ID NO: 470019 - RNA, 63 nt, Human; identical to SEQ ID NO: 456971

SEQ ID NO: 470020 - RNA, 63 nt, Human; identical to SEQ ID NO: 456972

SEQ ID NO: 470021 - RNA, 63 nt, Human; identical to SEQ ID NO: 456976

SEQ ID NO: 470022 - RNA, 63 nt, Human; identical to SEQ ID NO: 456977

SEQ ID NO: 470023 - RNA, 63 nt, Human; identical to SEQ ID NO: 456978

SEQ ID NO: 470024 - RNA, 63 nt, Human; identical to SEQ ID NO: 456979

SEQ ID NO: 470025 - RNA, 63 nt, Human; identical to SEQ ID NO: 456980

SEQ ID NO: 470026 - RNA, 63 nt, Human; identical to SEQ ID NO: 456981

SEQ ID NO: 470027 - RNA, 63 nt, Human; identical to SEQ ID NO: 456982

SEQ ID NO: 470028 - RNA, 63 nt, Human; identical to SEQ ID NO: 456983

SEQ ID NO: 470029 - RNA, 63 nt, Human; identical to SEQ ID NO: 456984

SEQ ID NO: 470030 - RNA, 63 nt, Human; identical to SEQ ID NO: 456971

SEQ ID NO: 470031 - RNA, 63 nt, Human; identical to SEQ ID NO: 456986

SEQ ID NO: 470032 - RNA, 63 nt, Human; identical to SEQ ID NO: 456987

SEQ ID NO: 470033 - RNA, 63 nt, Human; identical to SEQ ID NO: 456988

SEQ ID NO: 470034 - RNA, 63 nt, Human; identical to SEQ ID NO: 456989

SEQ ID NO: 470035 - RNA, 63 nt, Human; identical to SEQ ID NO: 456990

SEQ ID NO: 470036 - RNA, 63 nt, Human; identical to SEQ ID NO: 456991

SEQ ID NO: 470037 - RNA, 63 nt, Human; identical to SEQ ID NO: 456992

SEQ ID NO: 470038 - RNA, 63 nt, Human; identical to SEQ ID NO: 456996

SEQ ID NO: 470039 - RNA, 63 nt, Human; identical to SEQ ID NO: 456997

SEQ ID NO: 470040 - RNA, 50 nt, Human; identical to SEQ ID NO: 456998

SEQ ID NO: 470041 - RNA, 63 nt, Human; identical to SEQ ID NO: 456999

SEQ ID NO: 470042 - RNA, 63 nt, Human; identical to SEQ ID NO: 457000

SEQ ID NO: 470043 - RNA, 57 nt, Human; identical to SEQ ID NO: 457001

SEQ ID NO: 470044 - RNA, 63 nt, Human; identical to SEQ ID NO: 457002

SEQ ID NO: 470045 - RNA, 63 nt, Human; identical to SEQ ID NO: 457003

SEQ ID NO: 470046 - RNA, 63 nt, Human; identical to SEQ ID NO: 457004

SEQ ID NO: 470047 - RNA, 63 nt, Human; identical to SEQ ID NO: 457005

SEQ ID NO: 470048 - RNA, 63 nt, Human; identical to SEQ ID NO: 457006

SEQ ID NO: 470049 - RNA, 63 nt, Human; identical to SEQ ID NO: 457007

SEQ ID NO: 470050 - RNA, 63 nt, Human; identical to SEQ ID NO: 457008

SEQ ID NO: 470051 - RNA, 63 nt, Human; identical to SEQ ID NO: 457009

SEQ ID NO: 470052 - RNA, 63 nt, Human; identical to SEQ ID NO: 457010

SEQ ID NO: 470053 - RNA, 63 nt, Human; identical to SEQ ID NO: 457011

SEQ ID NO: 470054 - RNA, 63 nt, Human; identical to SEQ ID NO: 457012

SEQ ID NO: 470055 - RNA, 63 nt, Human; identical to SEQ ID NO: 457016

SEQ ID NO: 470056 - RNA, 63 nt, Human; identical to SEQ ID NO: 457017

SEQ ID NO: 470057 - RNA, 63 nt, Human; identical to SEQ ID NO: 457018

SEQ ID NO: 470058 - RNA, 63 nt, Human; identical to SEQ ID NO: 457019

SEQ ID NO: 470059 - RNA, 63 nt, Human; identical to SEQ ID NO: 457020

SEQ ID NO: 470060 - RNA, 63 nt, Human; identical to SEQ ID NO: 457021

SEQ ID NO: 470061 - RNA, 63 nt, Human; identical to SEQ ID NO: 457022

SEQ ID NO: 470062 - RNA, 63 nt, Human; identical to SEQ ID NO: 457023

SEQ ID NO: 470063 - RNA, 63 nt, Human; identical to SEQ ID NO: 457024

SEQ ID NO: 470064 - RNA, 63 nt, Human; identical to SEQ ID NO: 457025

SEQ ID NO: 470065 - RNA, 63 nt, Human; identical to SEQ ID NO: 457026

SEQ ID NO: 470066 - RNA, 63 nt, Human; identical to SEQ ID NO: 457027

SEQ ID NO: 470067 - RNA, 63 nt, Human; identical to SEQ ID NO: 457028

SEQ ID NO: 470068 - RNA, 63 nt, Human; identical to SEQ ID NO: 457029

SEQ ID NO: 470069 - RNA, 63 nt, Human; identical to SEQ ID NO: 457030

SEQ ID NO: 470070 - RNA, 63 nt, Human; identical to SEQ ID NO: 457031

SEQ ID NO: 470071 - RNA, 63 nt, Human; identical to SEQ ID NO: 457032

SEQ ID NO: 470072 - RNA, 63 nt, Human; identical to SEQ ID NO: 457036

SEQ ID NO: 470073 - RNA, 63 nt, Human; identical to SEQ ID NO: 457037

SEQ ID NO: 470074 - RNA, 63 nt, Human; identical to SEQ ID NO: 457038

SEQ ID NO: 470075 - RNA, 63 nt, Human; identical to SEQ ID NO: 457039

SEQ ID NO: 470076 - RNA, 63 nt, Human; identical to SEQ ID NO: 457040

SEQ ID NO: 470077 - RNA, 63 nt, Human; identical to SEQ ID NO: 457041

SEQ ID NO: 470078 - RNA, 63 nt, Human; identical to SEQ ID NO: 457042

SEQ ID NO: 470079 - RNA, 63 nt, Human; identical to SEQ ID NO: 457043

SEQ ID NO: 470080 - RNA, 63 nt, Human; identical to SEQ ID NO: 457044

SEQ ID NO: 470081 - RNA, 63 nt, Human; identical to SEQ ID NO: 457045

SEQ ID NO: 470082 - RNA, 63 nt, Human; identical to SEQ ID NO: 457046

SEQ ID NO: 470083 - RNA, 63 nt, Human; identical to SEQ ID NO: 457047

SEQ ID NO: 470084 - RNA, 63 nt, Human; identical to SEQ ID NO: 457048

SEQ ID NO: 470085 - RNA, 63 nt, Human; identical to SEQ ID NO: 457049

SEQ ID NO: 470086 - RNA, 63 nt, Human; identical to SEQ ID NO: 457050

SEQ ID NO: 470087 - RNA, 63 nt, Human; identical to SEQ ID NO: 457051

SEQ ID NO: 470088 - RNA, 63 nt, Human; identical to SEQ ID NO: 457052

SEQ ID NO: 470089 - RNA, 63 nt, Human; identical to SEQ ID NO: 457056

SEQ ID NO: 470090 - RNA, 63 nt, Human; identical to SEQ ID NO: 457057

SEQ ID NO: 470091 - RNA, 63 nt, Human; identical to SEQ ID NO: 457058

SEQ ID NO: 470092 - RNA, 63 nt, Human; identical to SEQ ID NO: 457059

SEQ ID NO: 470093 - RNA, 63 nt, Human; identical to SEQ ID NO: 457060

SEQ ID NO: 470094 - RNA, 63 nt, Human; identical to SEQ ID NO: 457061

SEQ ID NO: 470095 - RNA, 63 nt, Human; identical to SEQ ID NO: 457062

SEQ ID NO: 470096 - RNA, 63 nt, Human; identical to SEQ ID NO: 457063

SEQ ID NO: 470097 - RNA, 63 nt, Human; identical to SEQ ID NO: 457064

SEQ ID NO: 470098 - RNA, 63 nt, Human; identical to SEQ ID NO: 457065

SEQ ID NO: 470099 - RNA, 63 nt, Human; identical to SEQ ID NO: 457066

SEQ ID NO: 470100 - RNA, 63 nt, Human; identical to SEQ ID NO: 457067

SEQ ID NO: 470101 - RNA, 63 nt, Human; identical to SEQ ID NO: 457068

SEQ ID NO: 470102 - RNA, 63 nt, Human; identical to SEQ ID NO: 457069

SEQ ID NO: 470103 - RNA, 63 nt, Human; identical to SEQ ID NO: 457070

SEQ ID NO: 470104 - RNA, 63 nt, Human; identical to SEQ ID NO: 457071

SEQ ID NO: 470105 - RNA, 63 nt, Human; identical to SEQ ID NO: 457072

SEQ ID NO: 470106 - RNA, 63 nt, Human; identical to SEQ ID NO: 457073

SEQ ID NO: 470107 - RNA, 63 nt, Human; identical to SEQ ID NO: 457074

SEQ ID NO: 470108 - RNA, 63 nt, Human; identical to SEQ ID NO: 454040

SEQ ID NO: 470109 - RNA, 63 nt, Human; identical to SEQ ID NO: 457075

SEQ ID NO: 470110 - RNA, 63 nt, Human; identical to SEQ ID NO: 457076

SEQ ID NO: 470111 - RNA, 63 nt, Human; identical to SEQ ID NO: 457077

SEQ ID NO: 470112 - RNA, 63 nt, Human; identical to SEQ ID NO: 457078

SEQ ID NO: 470113 - RNA, 63 nt, Human; identical to SEQ ID NO: 457079

SEQ ID NO: 470114 - RNA, 63 nt, Human; identical to SEQ ID NO: 457080

SEQ ID NO: 470115 - RNA, 63 nt, Human; identical to SEQ ID NO: 457081

SEQ ID NO: 470116 - RNA, 63 nt, Human; identical to SEQ ID NO: 457082

SEQ ID NO: 470117 - RNA, 63 nt, Human; identical to SEQ ID NO: 457083

SEQ ID NO: 470118 - RNA, 63 nt, Human; identical to SEQ ID NO: 457084

SEQ ID NO: 470119 - RNA, 63 nt, Human; identical to SEQ ID NO: 457085

SEQ ID NO: 470120 - RNA, 63 nt, Human; identical to SEQ ID NO: 457086

SEQ ID NO: 470121 - RNA, 63 nt, Human; identical to SEQ ID NO: 457087

SEQ ID NO: 470122 - RNA, 63 nt, Human; identical to SEQ ID NO: 457088

SEQ ID NO: 470123 - RNA, 63 nt, Human; identical to SEQ ID NO: 457089

SEQ ID NO: 470124 - RNA, 63 nt, Human; identical to SEQ ID NO: 457090

SEQ ID NO: 470125 - RNA, 63 nt, Human; identical to SEQ ID NO: 457091

SEQ ID NO: 470126 - RNA, 63 nt, Human; identical to SEQ ID NO: 457095

SEQ ID NO: 470127 - RNA, 63 nt, Human; identical to SEQ ID NO: 457096

SEQ ID NO: 470128 - RNA, 63 nt, Human; identical to SEQ ID NO: 457097

SEQ ID NO: 470129 - RNA, 63 nt, Human; identical to SEQ ID NO: 457098

SEQ ID NO: 470130 - RNA, 63 nt, Human; identical to SEQ ID NO: 457099

SEQ ID NO: 470131 - RNA, 63 nt, Human; identical to SEQ ID NO: 457100

SEQ ID NO: 470132 - RNA, 63 nt, Human; identical to SEQ ID NO: 457101

SEQ ID NO: 470133 - RNA, 63 nt, Human; identical to SEQ ID NO: 457102

SEQ ID NO: 470134 - RNA, 63 nt, Human; identical to SEQ ID NO: 457103

SEQ ID NO: 470135 - RNA, 63 nt, Human; identical to SEQ ID NO: 457104

SEQ ID NO: 470136 - RNA, 63 nt, Human; identical to SEQ ID NO: 457105

SEQ ID NO: 470137 - RNA, 63 nt, Human; identical to SEQ ID NO: 457106

SEQ ID NO: 470138 - RNA, 63 nt, Human; identical to SEQ ID NO: 457107

SEQ ID NO: 470139 - RNA, 63 nt, Human; identical to SEQ ID NO: 457108

SEQ ID NO: 470140 - RNA, 63 nt, Human; identical to SEQ ID NO: 457109

SEQ ID NO: 470141 - RNA, 63 nt, Human; identical to SEQ ID NO: 457110

SEQ ID NO: 470142 - RNA, 63 nt, Human; identical to SEQ ID NO: 457111

SEQ ID NO: 470143 - RNA, 63 nt, Human; identical to SEQ ID NO: 457115

SEQ ID NO: 470144 - RNA, 63 nt, Human; identical to SEQ ID NO: 457116

SEQ ID NO: 470145 - RNA, 63 nt, Human; identical to SEQ ID NO: 457117

SEQ ID NO: 470146 - RNA, 63 nt, Human; identical to SEQ ID NO: 457118

SEQ ID NO: 470147 - RNA, 63 nt, Human; identical to SEQ ID NO: 457119

SEQ ID NO: 470148 - RNA, 63 nt, Human; identical to SEQ ID NO: 457120

SEQ ID NO: 470149 - RNA, 63 nt, Human; identical to SEQ ID NO: 457121

SEQ ID NO: 470150 - RNA, 63 nt, Human; identical to SEQ ID NO: 457122

SEQ ID NO: 470151 - RNA, 63 nt, Human; identical to SEQ ID NO: 457123

SEQ ID NO: 470152 - RNA, 63 nt, Human; identical to SEQ ID NO: 457124

SEQ ID NO: 470153 - RNA, 63 nt, Human; identical to SEQ ID NO: 457125

SEQ ID NO: 470154 - RNA, 63 nt, Human; identical to SEQ ID NO: 457126

SEQ ID NO: 470155 - RNA, 63 nt, Human; identical to SEQ ID NO: 457127

SEQ ID NO: 470156 - RNA, 63 nt, Human; identical to SEQ ID NO: 457128

SEQ ID NO: 470157 - RNA, 63 nt, Human; identical to SEQ ID NO: 457129

SEQ ID NO: 470158 - RNA, 63 nt, Human; identical to SEQ ID NO: 457130

SEQ ID NO: 470159 - RNA, 63 nt, Human; identical to SEQ ID NO: 457131

SEQ ID NO: 470160 - RNA, 63 nt, Human; identical to SEQ ID NO: 457135

SEQ ID NO: 470161 - RNA, 63 nt, Human; identical to SEQ ID NO: 457136

SEQ ID NO: 470162 - RNA, 63 nt, Human; identical to SEQ ID NO: 457137

SEQ ID NO: 470163 - RNA, 63 nt, Human; identical to SEQ ID NO: 457138

SEQ ID NO: 470164 - RNA, 63 nt, Human; identical to SEQ ID NO: 457139

SEQ ID NO: 470165 - RNA, 63 nt, Human; identical to SEQ ID NO: 457140

SEQ ID NO: 470166 - RNA, 63 nt, Human; identical to SEQ ID NO: 457141

SEQ ID NO: 470167 - RNA, 63 nt, Human; identical to SEQ ID NO: 457142

SEQ ID NO: 470168 - RNA, 63 nt, Human; identical to SEQ ID NO: 457143

SEQ ID NO: 470169 - RNA, 63 nt, Human; identical to SEQ ID NO: 457144

SEQ ID NO: 470170 - RNA, 58 nt, Human; identical to SEQ ID NO: 457145

SEQ ID NO: 470171 - RNA, 63 nt, Human; identical to SEQ ID NO: 457146

SEQ ID NO: 470172 - RNA, 55 nt, Human; identical to SEQ ID NO: 457147

SEQ ID NO: 470173 - RNA, 63 nt, Human; identical to SEQ ID NO: 457148

SEQ ID NO: 470174 - RNA, 63 nt, Human; identical to SEQ ID NO: 457149

SEQ ID NO: 470175 - RNA, 63 nt, Human; identical to SEQ ID NO: 457150

SEQ ID NO: 470176 - RNA, 63 nt, Human; identical to SEQ ID NO: 457151

SEQ ID NO: 470177 - RNA, 63 nt, Human; identical to SEQ ID NO: 457155

SEQ ID NO: 470178 - RNA, 63 nt, Human; identical to SEQ ID NO: 457156

SEQ ID NO: 470179 - RNA, 63 nt, Human; identical to SEQ ID NO: 457157

SEQ ID NO: 470180 - RNA, 63 nt, Human; identical to SEQ ID NO: 457158

SEQ ID NO: 470181 - RNA, 63 nt, Human; identical to SEQ ID NO: 457159

SEQ ID NO: 470182 - RNA, 63 nt, Human; identical to SEQ ID NO: 457160

SEQ ID NO: 470183 - RNA, 63 nt, Human; identical to SEQ ID NO: 457161

SEQ ID NO: 470184 - RNA, 63 nt, Human; identical to SEQ ID NO: 457162

SEQ ID NO: 470185 - RNA, 63 nt, Human; identical to SEQ ID NO: 457163

SEQ ID NO: 470186 - RNA, 63 nt, Human; identical to SEQ ID NO: 457164

SEQ ID NO: 470187 - RNA, 63 nt, Human; identical to SEQ ID NO: 457165

SEQ ID NO: 470188 - RNA, 63 nt, Human; identical to SEQ ID NO: 457166

SEQ ID NO: 470189 - RNA, 63 nt, Human; identical to SEQ ID NO: 457167

SEQ ID NO: 470190 - RNA, 63 nt, Human; identical to SEQ ID NO: 457168

SEQ ID NO: 470191 - RNA, 63 nt, Human; identical to SEQ ID NO: 457169

SEQ ID NO: 470192 - RNA, 63 nt, Human; identical to SEQ ID NO: 457170

SEQ ID NO: 470193 - RNA, 63 nt, Human; identical to SEQ ID NO: 457171

SEQ ID NO: 470194 - RNA, 63 nt, Human; identical to SEQ ID NO: 457172

SEQ ID NO: 470195 - RNA, 63 nt, Human; identical to SEQ ID NO: 457175

SEQ ID NO: 470196 - RNA, 63 nt, Human; identical to SEQ ID NO: 457176

SEQ ID NO: 470197 - RNA, 63 nt, Human; identical to SEQ ID NO: 457177

SEQ ID NO: 470198 - RNA, 63 nt, Human; identical to SEQ ID NO: 457178

SEQ ID NO: 470199 - RNA, 63 nt, Human; identical to SEQ ID NO: 457179

SEQ ID NO: 470200 - RNA, 63 nt, Human; identical to SEQ ID NO: 457180

SEQ ID NO: 470201 - RNA, 63 nt, Human; identical to SEQ ID NO: 457181

SEQ ID NO: 470202 - RNA, 63 nt, Human; identical to SEQ ID NO: 457182

SEQ ID NO: 470203 - RNA, 63 nt, Human; identical to SEQ ID NO: 457183

SEQ ID NO: 470204 - RNA, 63 nt, Human; identical to SEQ ID NO: 457184

SEQ ID NO: 470205 - RNA, 63 nt, Human; identical to SEQ ID NO: 457185

SEQ ID NO: 470206 - RNA, 57 nt, Human; identical to SEQ ID NO: 457186

SEQ ID NO: 470207 - RNA, 63 nt, Human; identical to SEQ ID NO: 457187

SEQ ID NO: 470208 - RNA, 63 nt, Human; identical to SEQ ID NO: 457188

SEQ ID NO: 470209 - RNA, 63 nt, Human; identical to SEQ ID NO: 457189

SEQ ID NO: 470210 - RNA, 63 nt, Human; identical to SEQ ID NO: 457190

SEQ ID NO: 470211 - RNA, 63 nt, Human; identical to SEQ ID NO: 457191

SEQ ID NO: 470212 - RNA, 63 nt, Human; identical to SEQ ID NO: 457192

SEQ ID NO: 470213 - RNA, 63 nt, Human; identical to SEQ ID NO: 457193

SEQ ID NO: 470214 - RNA, 63 nt, Human; identical to SEQ ID NO: 457195

SEQ ID NO: 470215 - RNA, 63 nt, Human; identical to SEQ ID NO: 457196

SEQ ID NO: 470216 - RNA, 63 nt, Human; identical to SEQ ID NO: 457197

SEQ ID NO: 470217 - RNA, 63 nt, Human; identical to SEQ ID NO: 457198

SEQ ID NO: 470218 - RNA, 63 nt, Human; identical to SEQ ID NO: 457199

SEQ ID NO: 470219 - RNA, 63 nt, Human; identical to SEQ ID NO: 457200

SEQ ID NO: 470220 - RNA, 63 nt, Human; identical to SEQ ID NO: 457201

SEQ ID NO: 470221 - RNA, 63 nt, Human; identical to SEQ ID NO: 457202

SEQ ID NO: 470222 - RNA, 63 nt, Human; identical to SEQ ID NO: 457203

SEQ ID NO: 470223 - RNA, 63 nt, Human; identical to SEQ ID NO: 457204

SEQ ID NO: 470224 - RNA, 63 nt, Human; identical to SEQ ID NO: 457205

SEQ ID NO: 470225 - RNA, 63 nt, Human; identical to SEQ ID NO: 457206

SEQ ID NO: 470226 - RNA, 63 nt, Human; identical to SEQ ID NO: 457207

SEQ ID NO: 470227 - RNA, 63 nt, Human; identical to SEQ ID NO: 457208

SEQ ID NO: 470228 - RNA, 63 nt, Human; identical to SEQ ID NO: 457209

SEQ ID NO: 470229 - RNA, 63 nt, Human; identical to SEQ ID NO: 457210

SEQ ID NO: 470230 - RNA, 63 nt, Human; identical to SEQ ID NO: 457211

SEQ ID NO: 470231 - RNA, 63 nt, Human; identical to SEQ ID NO: 457215

SEQ ID NO: 470232 - RNA, 63 nt, Human; identical to SEQ ID NO: 457216

SEQ ID NO: 470233 - RNA, 63 nt, Human; identical to SEQ ID NO: 457217

SEQ ID NO: 470234 - RNA, 63 nt, Human; identical to SEQ ID NO: 457218

SEQ ID NO: 470235 - RNA, 63 nt, Human; identical to SEQ ID NO: 457219

SEQ ID NO: 470236 - RNA, 63 nt, Human; identical to SEQ ID NO: 457220

SEQ ID NO: 470237 - RNA, 63 nt, Human; identical to SEQ ID NO: 457221

SEQ ID NO: 470238 - RNA, 63 nt, Human; identical to SEQ ID NO: 457222

SEQ ID NO: 470239 - RNA, 63 nt, Human; identical to SEQ ID NO: 457223

SEQ ID NO: 470240 - RNA, 63 nt, Human; identical to SEQ ID NO: 457224

SEQ ID NO: 470241 - RNA, 63 nt, Human; identical to SEQ ID NO: 457225

SEQ ID NO: 470242 - RNA, 63 nt, Human; identical to SEQ ID NO: 457226

SEQ ID NO: 470243 - RNA, 63 nt, Human; identical to SEQ ID NO: 457227

SEQ ID NO: 470244 - RNA, 63 nt, Human; identical to SEQ ID NO: 457228

SEQ ID NO: 470245 - RNA, 63 nt, Human; identical to SEQ ID NO: 457229

SEQ ID NO: 470246 - RNA, 63 nt, Human; identical to SEQ ID NO: 457230

SEQ ID NO: 470247 - RNA, 63 nt, Human; identical to SEQ ID NO: 457231

SEQ ID NO: 470248 - RNA, 63 nt, Human; identical to SEQ ID NO: 457235

SEQ ID NO: 470249 - RNA, 63 nt, Human; identical to SEQ ID NO: 457236

SEQ ID NO: 470250 - RNA, 63 nt, Human; identical to SEQ ID NO: 457237

SEQ ID NO: 470251 - RNA, 63 nt, Human; identical to SEQ ID NO: 457238

SEQ ID NO: 470252 - RNA, 63 nt, Human; identical to SEQ ID NO: 457239

SEQ ID NO: 470253 - RNA, 63 nt, Human; identical to SEQ ID NO: 457240

SEQ ID NO: 470254 - RNA, 63 nt, Human; identical to SEQ ID NO: 457241

SEQ ID NO: 470255 - RNA, 63 nt, Human; identical to SEQ ID NO: 457242

SEQ ID NO: 470256 - RNA, 63 nt, Human; identical to SEQ ID NO: 457243

SEQ ID NO: 470257 - RNA, 63 nt, Human; identical to SEQ ID NO: 457244

SEQ ID NO: 470258 - RNA, 63 nt, Human; identical to SEQ ID NO: 457245

SEQ ID NO: 470259 - RNA, 63 nt, Human; identical to SEQ ID NO: 457246

SEQ ID NO: 470260 - RNA, 63 nt, Human; identical to SEQ ID NO: 457247

SEQ ID NO: 470261 - RNA, 63 nt, Human; identical to SEQ ID NO: 457248

SEQ ID NO: 470262 - RNA, 63 nt, Human; identical to SEQ ID NO: 457249

SEQ ID NO: 470263 - RNA, 63 nt, Human; identical to SEQ ID NO: 457250

SEQ ID NO: 470264 - RNA, 63 nt, Human; identical to SEQ ID NO: 457251

SEQ ID NO: 470265 - RNA, 63 nt, Human; identical to SEQ ID NO: 457252

SEQ ID NO: 470266 - RNA, 64 nt, Human; identical to SEQ ID NO: 189042

SEQ ID NO: 470267 - RNA, 64 nt, Human; identical to SEQ ID NO: 189043

SEQ ID NO: 470268 - RNA, 64 nt, Human
cggaccccaccucuucccugccgcccgccaccggccgaccgaccgcggcugccccaguugauga

SEQ ID NO: 470269 - RNA, 64 nt, Human
ggggggugacaugggcccuaggcagacugcaagcccgaccgagcacuuggacucgaacucugug

SEQ ID NO: 470270 - RNA, 64 nt, Human
aaggggccuuaugggaauagugaaaaggcucagaccgaccgauggcaagaucugcaagcgucuc

SEQ ID NO: 470271 - RNA, 64 nt, Human
aggggcugugaacccuaagugggugucaucuccuccgaccgaggcuucucacccuggagauggc

SEQ ID NO: 470272 - RNA, 64 nt, Human
aaccgucuguggaggaggcaagauacaacagcugccgaccgaacauggcccugggacacccaca

SEQ ID NO: 470273 - RNA, 64 nt, Human
aagagccagucgggcauaugucaugaagguuucuccgaccgauuaaugguuugcugcuugacua

SEQ ID NO: 470274 - RNA, 64 nt, Human
guugcccgccgcugacugcgccaggaugcacagaccgaccgacagaccucagugcccaccacgg

SEQ ID NO: 470275 - RNA, 64 nt, Human
ucacucgcccccggguuuggcgggccaaggacugccgaccgaggcuggagcuggcgucugucuu

SEQ ID NO: 470276 - RNA, 64 nt, Human
aaguucuuuggccagauagugcaauguugugacaccgaccgaagccuuuguucuggaucuuucu

SEQ ID NO: 470277 - RNA, 64 nt, Human
gggcacgucuagaaucgaggaggcaagccugugcccgaccgacgacacagagacucuucugauc

SEQ ID NO: 470278 - RNA, 64 nt, Human
cgaguucgcccuucccccaccuccuugucuuuccccgaccgagcaccagacugcagaaugaggc

SEQ ID NO: 470279 - RNA, 64 nt, Human
aaagugcugggauuacaggugugagccacugcacccgaccgauacucacauuuuuaaacuuuuu

SEQ ID NO: 470280 - RNA, 64 nt, Human
ucuauacugacucuuauuucucagggagaucacagcaaccuaaauaaaccagauaccuuuucuc

SEQ ID NO: 470281 - RNA, 64 nt, Human
gagucagauuugagcugagccaggggaggccuuggcaaccuacuucuacucagauuucauugcu

SEQ ID NO: 470282 - RNA, 64 nt, Human
caccgaggacguggcugcucugacaccaccuagggcaaccuacuuguuuuacagauggggcaaa

SEQ ID NO: 470283 - RNA, 64 nt, Human; identical to SEQ ID NO: 189044

SEQ ID NO: 470284 - RNA, 64 nt, Human; identical to SEQ ID NO: 189048

SEQ ID NO: 470285 - RNA, 64 nt, Human; identical to SEQ ID NO: 189049

SEQ ID NO: 470286 - RNA, 64 nt, Human
guuggccaggcuggucuugaacuccuggacucaagcaaccuacccagcguggccucccaaagug

SEQ ID NO: 470287 - RNA, 64 nt, Human
gguaccuaagcuguggauuugcuaaaugaauuaagcaaccuagaagauacagagcuaaugaauu

SEQ ID NO: 470288 - RNA, 64 nt, Human
acuccaagcuguaacuuccuagaguugcacccuagcaaccuagccagaaaagcaaguggcaaga

SEQ ID NO: 470289 - RNA, 64 nt, Human
uuguucuugugagaugcaaaacagcugcuagucugcaaccuaguuuucccucucaccuuuaacu

SEQ ID NO: 470290 - RNA, 64 nt, Human
caauacacuguaauaucagaaaugguuggccugagcaaccuaguaagaccucgucucuacuaau

SEQ ID NO: 470291 - RNA, 64 nt, Human
gcacagcaaaagaaacuaccaucagagugaacaggcaaccuacaaaaugggagaaaauuuucgc

SEQ ID NO: 470292 - RNA, 64 nt, Human
gaacaggcaaccuacaaaaugggagaaaauuuucgcaaccuacucaucugacaaagggcuaaua

SEQ ID NO: 470293 - RNA, 64 nt, Human
aggacaguccucaucucauugcuuggcccuucaagcaaccuagcuaaaaggugcugauauuuua

SEQ ID NO: 470294 - RNA, 64 nt, Human
ugucacacccuuggugugaaugguagcuuagugagcaaccuagcucaaggauuugcaaaguuag

SEQ ID NO: 470295 - RNA, 64 nt, Human
cauuaauacaccuacacccuuucuuugaaaguuugcaaccuaauugcaucuaaaacuaugaaua

SEQ ID NO: 470296 - RNA, 64 nt, Human
auaaucaaacggugauucaucuaaaugacuucuagcaaccuaaguaaaaacauuccccuccuau

SEQ ID NO: 470297 - RNA, 64 nt, Human
aggcuggagugcaguggugcaaucuuggcucacugcaaccuacaccucccggguucaagugauu

SEQ ID NO: 470298 - RNA, 64 nt, Human
uacuaaccaucccccugccugcugccucaguccugcaaccuaaagcuguagucgccuccaauag

SEQ ID NO: 470299 - RNA, 64 nt, Human
caguggcccccugcauuaguuuucuguugccacugcaaccuauuacuugguagcuuaaaaacaa

SEQ ID NO: 470300 - RNA, 64 nt, Human
gagauucuggcaaccuuugaacagcccagagcuugcaaccuagccucacccaagaagacuggaa

SEQ ID NO: 470301 - RNA, 64 nt, Human; identical to SEQ ID NO: 189050

SEQ ID NO: 470302 - RNA, 55 nt, Human; identical to SEQ ID NO: 189045

SEQ ID NO: 470303 - RNA, 64 nt, Human; identical to SEQ ID NO: 189051

SEQ ID NO: 470304 - RNA, 60 nt, Human; identical to SEQ ID NO: 189052

SEQ ID NO: 470305 - RNA, 64 nt, Human
guggaacaguagaaaaccauauggggacuauagugcaaccuauuuggguaaagaaaccauuugc

SEQ ID NO: 470306 - RNA, 64 nt, Human
ccuuccaaauaaaccuugcuaaguccaacucugugcaaccuacauggaggugggggcagccgau

SEQ ID NO: 470307 - RNA, 64 nt, Human
cugcagcacuauucacaauagccaagauauaggagcaaccuagguguccaacaacagaugaaug

SEQ ID NO: 470308 - RNA, 64 nt, Human
uuuuuuagugaaagaaugugccauauuacauauugcaaccuaauuuguuaaaacuaacuccagc

SEQ ID NO: 470309 - RNA, 64 nt, Human
aggcuggagugcaauggugcaauuucggcucaccgcaaccuacgccucccggguucaagugauu

SEQ ID NO: 470310 - RNA, 63 nt, Human
acagacucccagaauuagaaaguguuauuuuaaugcaaccuagguaacuuggggaguaaggaa

SEQ ID NO: 470311 - RNA, 64 nt, Human
gcacacaugccuacaggccagcucugugccaagggcaaccuagguaaaacgaaagccgucaggg

SEQ ID NO: 470312 - RNA, 64 nt, Human
uaaggcagaggcaaaaguuucacacaaaguuucugcaaccuaacguuuaauaguccgggucuac

SEQ ID NO: 470313 - RNA, 64 nt, Human
caucaggcauuaguuagauucucauaaggagagugcaaccuagaucccuugcaugugcaguucc

SEQ ID NO: 470314 - RNA, 64 nt, Human
aaaaugaagagacagacaugauuacucagggucagcaaccuagugaguuagaaaaaaaauuaac

SEQ ID NO: 470315 - RNA, 64 nt, Human
gcaacauggaugcaacuagaggcuauuauccuaagcaaccuaaugcaagaacagaaaaccacau

SEQ ID NO: 470316 - RNA, 64 nt, Human
uuaccuuuaaaaaagaguaguuuugccccucccagcaaccuaagaccagucugaacucacacug

SEQ ID NO: 470317 - RNA, 64 nt, Human
acuggcuuguacauuuuuaaauucuuacucuggagcaaccuacugucuaagcaguuuuguaaau

SEQ ID NO: 470318 - RNA, 64 nt, Human
uugugugacaauggagagccugcccaaggacugugcaaccuaucuguuccucuccaccagugua

SEQ ID NO: 470319 - RNA, 64 nt, Human
ccaucuguacuuugguccucugauuucacauauugcaaccuaguacuuuauuaguuuaaaaaga

SEQ ID NO: 470320 - RNA, 64 nt, Human; identical to SEQ ID NO: 189053

SEQ ID NO: 470321 - RNA, 64 nt, Human; identical to SEQ ID NO: 189054

SEQ ID NO: 470322 - RNA, 64 nt, Human; identical to SEQ ID NO: 189055

SEQ ID NO: 470323 - RNA, 64 nt, Human; identical to SEQ ID NO: 189056

SEQ ID NO: 470324 - RNA, 64 nt, Human
uaugcggugccgcccaaagguggcuuugccucaagcaaccuacccugauguuuuacucauugga

SEQ ID NO: 470325 - RNA, 64 nt, Human
cagcccaguggaaagcacaggugucucccacuuugcaaccuauguggcagccaugagggccauc

SEQ ID NO: 470326 - RNA, 64 nt, Human
cuacacucauuuuauuuguauuuaaauguuuuaggcaaccuaagaacaaauguaaaaguaaaga

SEQ ID NO: 470327 - RNA, 64 nt, Human
ucacagugcuauuuggaaaacggaaaauuuacaagcaaccuagagguccagcaaugugaaaaga

SEQ ID NO: 470328 - RNA, 64 nt, Human
augguugauucccagcauucagugguccugucaagcaaccuaacaggcuaguucuaauucccua

SEQ ID NO: 470329 - RNA, 64 nt, Human
uugcagcacuguucacaacagccaagauuuggaagcaaccuaaguguccaucaacagaugaaug

SEQ ID NO: 470330 - RNA, 64 nt, Human
cuucccucucguggcccacaaggaggaaggaagggcaaccuaaaagcccacuuagaaacuuuuu

SEQ ID NO: 470331 - RNA, 64 nt, Human
uuuuaaauauugucugagaaaagccaaaguuaaugcaaccuaguggaaacuguaagaccauuug

SEQ ID NO: 470332 - RNA, 56 nt, Human
cggaggcggccccuuugugaacgugagcaaccuaggaggcuucggcagcggcggca

SEQ ID NO: 470333 - RNA, 64 nt, Human
aggggccuuggugggcagauggcaauugaggguagcaaccuauuagggugggggagggaccucc

SEQ ID NO: 470334 - RNA, 64 nt, Human
uaugaauuaagaguacaaaauccucugagaugaagcaaccuauccaguucuauggaaugaaugg

SEQ ID NO: 470335 - RNA, 64 nt, Human
aggcuggagugcaguggcacgaucucagcucacugcaaccuacgccuucuggguucacgugauu

SEQ ID NO: 470336 - RNA, 64 nt, Human
uuuaacagagucugaaccuauuucuuaaacacuugcaaccuaccuguugagcaucacagaaugu

SEQ ID NO: 470337 - RNA, 64 nt, Human
ccuuggggacugcuaggaugaagcccuaaagaaugcaaccuagucagguuagcugaaccgacac

SEQ ID NO: 470338 - RNA, 64 nt, Human
cccuucugauaaauaaagcccugcugaaggaaaagcaaccuagaucaccuuauggaugucgcaa

SEQ ID NO: 470339 - RNA, 64 nt, Human; identical to SEQ ID NO: 189057

SEQ ID NO: 470340 - RNA, 64 nt, Human; identical to SEQ ID NO: 189058

SEQ ID NO: 470341 - RNA, 64 nt, Human; identical to SEQ ID NO: 189059

SEQ ID NO: 470342 - RNA, 54 nt, Human; identical to SEQ ID NO: 189046

SEQ ID NO: 470343 - RNA, 64 nt, Human
aaaguaaaaggccaacauuuaauuauuuugcaaagcaaccuaagagcuaaagauguaauuuuuc

SEQ ID NO: 470344 - RNA, 64 nt, Human
aaaaacaauuugcaagaaaauguguuucaagagagcaaccuaagcuaagucacucugcgauauu

SEQ ID NO: 470345 - RNA, 64 nt, Human
ugcauuuacucucugccgugggucugcagucgcugcaaccuacccucucucugccucagccuua

SEQ ID NO: 470346 - RNA, 64 nt, Human
ggcggaauaaugggcauugagaucuacugggacugcaaccuagaccguugguuccaucacugcc

SEQ ID NO: 470347 - RNA, 64 nt, Human
uuuucaaagaagugaggaugcaguuucucacguugcaaccuauucugaagugguuuaaauggua

SEQ ID NO: 470348 - RNA, 64 nt, Human
cucaaaagaguuccuucaaaugaugaguuaaugugcaaccuaauuaguaacuuuccucuuuuua

SEQ ID NO: 470349 - RNA, 64 nt, Human
ucuaaauuccuuaaugaaauaaacaacaaacccugcaaccuagaauucuguuacugucaaaaac

SEQ ID NO: 470350 - RNA, 64 nt, Human
uggcuuaagaauuugaaaauuucuuuagccuguagcaaccuaaacuguaauuccuaucauuaug

SEQ ID NO: 470351 - RNA, 64 nt, Human
ucacugacauuuuaaucauuauuuuaaaagcuuugcaaccuauauauuuauauaacuuuguaau

SEQ ID NO: 470352 - RNA, 64 nt, Human
gauuacuaaauaauaauuauuauauguaacugaagcaaccuacuuuugaaaaucaacuguauug

SEQ ID NO: 470353 - RNA, 60 nt, Human
ucgauauugaugccauuuaaagggauggaugcaaccuagcuuaacaguauaaugcugcaa

SEQ ID NO: 470354 - RNA, 64 nt, Human
auuugggagaaacaaggaagggugcacuuaacuagcaaccuaagcaugauuuuucagcuuuugc

SEQ ID NO: 470355 - RNA, 64 nt, Human
ccuuuuuucuacgaaugcacuacauuaaagaugugcaaccuaugcgcccccugcccuacuuccg

SEQ ID NO: 470356 - RNA, 64 nt, Human
augucuucuguaaccuuuccucucccggacuugagcaaccuacacacucacauguuuacuggua

SEQ ID NO: 470357 - RNA, 64 nt, Human
guuacugugaauagagcacauauuacucuuuuuagcaaccuagcaugaugccaacaagacuauu

SEQ ID NO: 470358 - RNA, 64 nt, Human
cgggccucaagcaguccccaccuccaagugccuggcaaccuaggcccuccuugaaguuuacacu

SEQ ID NO: 470359 - RNA, 64 nt, Human
gcagggaaacuaaacagagguuuccaaacugaaggcaaccuaauuguaaaugccuguguuaaag

SEQ ID NO: 470360 - RNA, 64 nt, Human
aauaacuuuuuuaaaacaaccucagauugaaaaagcaaccuaaauuacuuucgcucucuaauca

SEQ ID NO: 470361 - RNA, 64 nt, Human
uuaaauuuuaaagagauacugguauuuugaaaaugcaaccuauauauauucuuaauauccuuuu

SEQ ID NO: 470362 - RNA, 64 nt, Human
ggcugcggcuuguacugaccucuuguccuguauagcaaccuauuugguaaugauuccagcaccc

SEQ ID NO: 470363 - RNA, 64 nt, Human
ugccaggacagcugugcucucagauguaaauagagcaaccuauauaaaccuggauuuuuuuuuu

SEQ ID NO: 470364 - RNA, 64 nt, Human
uaaaaucuguuaucccaggacuguguacagaggggcaaccuacccauucaggaaggucagggcu

SEQ ID NO: 470365 - RNA, 51 nt, Human
ucuccgcccgggcuggcugaagcaaccuaccucaagucucaggagaauuca

SEQ ID NO: 470366 - RNA, 64 nt, Human
accccuguguucuuggguaggaaugggaaaaggggcaaccuacaaagauuguuggggcaaggga

SEQ ID NO: 470367 - RNA, 64 nt, Human
ccagauuagaaaaauuucaacuguaggugccuuugcaaccuauccugggagacccuaaaacaua

SEQ ID NO: 470368 - RNA, 64 nt, Human
aaucauuaacaaaaauauuagcaaacugaauccagcaaccuauaaaaaggauucuauaucauga

SEQ ID NO: 470369 - RNA, 64 nt, Human
gacggcaacauuagaaagugauuguaaauaacaugcaaccuaaguguaauauauuuguucaguu

SEQ ID NO: 470370 - RNA, 64 nt, Human
aaccaaaccaaaucauacuuucucuucaaauuuagcaaccuagaaacacacauuucuuugaauu

SEQ ID NO: 470371 - RNA, 64 nt, Human
aaccaaaccaaaucauacuuuuucuuugaauuuagcaaccuagaaacacacauuucuuugaauu

SEQ ID NO: 470372 - RNA, 64 nt, Human
gcacagcaaaagaaacuaccaucagagucaacaggcaaccuacaaaaugggagaaaauuuucgc

SEQ ID NO: 470373 - RNA, 64 nt, Human
caacaggcaaccuacaaaaugggagaaaauuuucgcaaccuacucaucugacaaagggcuaaua

SEQ ID NO: 470374 - RNA, 64 nt, Human
gcacaccgggccaagugaagaaucuaaugaaugugcaaccuaauuguagcaucuaaugaauguu

SEQ ID NO: 470375 - RNA, 64 nt, Human
aucaauuagcacucacuaauguacuacuaauugagcaaccuacgcacucaguugacuacguaaa

SEQ ID NO: 470376 - RNA, 64 nt, Human
caaggggcuccacaccuuugcuguguguucuggggcaaccuacuaauccucucugcaagucggu

SEQ ID NO: 470377 - RNA, 64 nt, Human
ccuucugauaaauaaagcccuugcugaaggaaaagcaaccuagaucaccuuauggaugucgcaa

SEQ ID NO: 470378 - RNA, 64 nt, Human
guggcucuccccuuuggagagagcuaguggcagagcaaccuagcuagguccuccuugggcuuug

SEQ ID NO: 470379 - RNA, 64 nt, Human
uaauuuuugacuuuucacaaaugaguaaauaagagcaaccuauuuuucaagcagauugcacauu

SEQ ID NO: 470380 - RNA, 64 nt, Human
cuucauuugauacuguuuuucauguucuuguauugcaaccuaaaauaaauaaauauuaaagugu

SEQ ID NO: 470381 - RNA, 64 nt, Human
gcugcugcccugaucucagugggaaauccacccagcaaccuaauacagccccuuuucccugcau

SEQ ID NO: 470382 - RNA, 64 nt, Human
ggugaauaauucuuucccuaacucugguccaccugcaaccuaggaguuaaaauaaguaucuugc

SEQ ID NO: 470383 - RNA, 64 nt, Human
gaucccugcugccugcacugggggugccaauucagaccgacaagauggagcauugaugggggag

SEQ ID NO: 470384 - RNA, 64 nt, Human
aaugggccugcagcccaacaaacaagggaacuaggaccgacagugacuucaccagcuugcuagg

SEQ ID NO: 470385 - RNA, 64 nt, Human
uccucuuguucuaaucuugucaaccagugcaagugaccgacaaaauuccaguuauuuauuucca

SEQ ID NO: 470386 - RNA, 50 nt, Human
ccaaaacagaagcaguauaggaccgacaaguguaccucugcacucaaugc

SEQ ID NO: 470387 - RNA, 64 nt, Human
gacagcuaaagccaagccacagagggggccucuugaccgacaaaggacacugugaaucacagua

SEQ ID NO: 470388 - RNA, 64 nt, Human
cguuucuucauggggugcuccagggggugccacagaccgacaggcagcccaagggccuggacac

SEQ ID NO: 470389 - RNA, 64 nt, Human
ccuccuuugagguccaagaugcuccuggggaguugaccgacauuugggaagauaauaggaggca

SEQ ID NO: 470390 - RNA, 64 nt, Human
guguggaugcugcaauucccaaugcagagaagcggaccgacagcggcagccgggugaugucuga

SEQ ID NO: 470391 - RNA, 64 nt, Human
ggcuaauaacaaacuagucagguuuucgaaccuugaccgacaugaacuguacacagaauuguuc

SEQ ID NO: 470392 - RNA, 64 nt, Human
ggguuucagagcagagcuccuggccagagcguuugaccgacagacaauucacauccauaugcca

SEQ ID NO: 470393 - RNA, 64 nt, Human
uggugugcacauguggccagaggugugugcgcgagaccgacacugugaucccugugcugggucc

SEQ ID NO: 470394 - RNA, 64 nt, Human
gagaaucacucgcuaaccccuaugcccggucccggaccgacauccuggagccgccugugcagcc

SEQ ID NO: 470395 - RNA, 64 nt, Human
aaggugggaguaucgcuugagcccaggaguuugagaccgacaugggcaacaugacaagacccca

SEQ ID NO: 470396 - RNA, 64 nt, Human
gaucacuccuuaggggugaguccuauugcaauaugaccgacaaagaagacaaaauagcauugaa

SEQ ID NO: 470397 - RNA, 64 nt, Human
ggauuggcaggaacuuaaggagccuuaaaaagaugaccgacagcuaagugugggaacucugccg

SEQ ID NO: 470398 - RNA, 64 nt, Human
uaaaauacaaugauuaccuagaagugcaagaaaugaccgacaucacguggcucaacucccccag

SEQ ID NO: 470399 - RNA, 64 nt, Human
guuggccccaggccaguacuaagcaaauuaaaaagaccgacaugggcuuccucccucauaucau

SEQ ID NO: 470400 - RNA, 63 nt, Human
cucccagcccuagcccgugacugccucccuccggaccgacacucccucagccucucagugagu

SEQ ID NO: 470401 - RNA, 64 nt, Human
ugcccgccgcugacugcgccaggaugcacagaccgaccgacagaccucagugcccaccacgggc

SEQ ID NO: 470402 - RNA, 64 nt, Human
ggucgggggcucagucugggagguaauaaaagcagaccgacacgcagauguugcucgggaagca

SEQ ID NO: 470403 - RNA, 64 nt, Human
ggcggcagcuagccuggccaguggcugucccguggaccgacaccugcgcccccuucugcaagca

SEQ ID NO: 470404 - RNA, 64 nt, Human
gccagggccaggggacucugugagucuggcucaagaccgacauugccuugguuuguuacaugac

SEQ ID NO: 470405 - RNA, 64 nt, Human
ggaaucaugugggccuguguuaaaucaaauagcugaccgacaguuaucccuuccucccuauuca

SEQ ID NO: 470406 - RNA, 64 nt, Human
aacaggucuuccacuggcucgaggcugcgaggcugaccgacaggggcgcccaauagaguuugug

SEQ ID NO: 470407 - RNA, 64 nt, Human
agagagagcgcuggcagaucugggagcuccugucgaccgacaaccccgaugcccugcccgagac

SEQ ID NO: 470408 - RNA, 64 nt, Human
ggccucuuucagugaauuugugaacagcagaauugaccgacagcuuuccaguacccauggggcu

SEQ ID NO: 470409 - RNA, 64 nt, Human
cggccgguccucucucagucaggaaaauugcacagaccgacagucgugaggauggcagagcugc

SEQ ID NO: 470410 - RNA, 64 nt, Human
gccucucaccccacuucccaucuccagggaagcgucgccccaguggcacugaaguggcccuccc

SEQ ID NO: 470411 - RNA, 64 nt, Human
aucggaugggugugggagugagggguuaccucccucgccccaagguuccagaggcccuaggcgg

SEQ ID NO: 470412 - RNA, 64 nt, Human
ucucccaauggccuuccaauccuuaaacugccaaucgccccacccguuccuaccuggugccuug

SEQ ID NO: 470413 - RNA, 64 nt, Human
ucucugaccuggcuagguagggagggggugguuaucgccccaagaugggguccaggcuccaucc

SEQ ID NO: 470414 - RNA, 64 nt, Human
cccuagggaggccaggaggagcuucggaggaccaucgccccacuggucuagccaucaugacacc

SEQ ID NO: 470415 - RNA, 64 nt, Human
cgcagcguggagccuaccucccgacauucacgcuucgccccacgcugcuccgacuggcugcagc

SEQ ID NO: 470416 - RNA, 64 nt, Human
acugugagguguuugacuaaacuguuucucugacucgccccagaggucguggcucaaaggcacu

SEQ ID NO: 470417 - RNA, 64 nt, Human
gccaacucuguccuggucuugcuguggcaccccaucgccccacagcucguaccuucucaccaga

SEQ ID NO: 470418 - RNA, 64 nt, Human
agcagcccggggaggaacugggugacuggaggccucgccccaacacuguccuucccugccacuu

SEQ ID NO: 470419 - RNA, 51 nt, Human
gggcugauucccaagugugagucgccccagaucaccagcccggccugcucc

SEQ ID NO: 470420 - RNA, 64 nt, Human
ggaugagaaacauacucucccuggcguccucccuucgccccagcuagcuugagcuucugcccua

SEQ ID NO: 470421 - RNA, 64 nt, Human
ggucuaggugagagcaggccccucuccccacaccucgccccacagagcucuguucuuagccucc

SEQ ID NO: 470422 - RNA, 64 nt, Human
cagaguguguggcugugugucuguucgacuccccucgccccauuuucaccccacccccgccucu

SEQ ID NO: 470423 - RNA, 64 nt, Human
ucccagguauccagacagccaccaggauggucccucgccccacccccaccgccucuccccaccu

SEQ ID NO: 470424 - RNA, 64 nt, Human
cagagagguuucuuggggucccagggaagaggaaucgccccagacuccuuuccucugaggaaga

SEQ ID NO: 470425 - RNA, 64 nt, Human
ucugcgcggccgaggccggagcaccacauccaccucgccccagagaggcucugcucccuccuau

SEQ ID NO: 470426 - RNA, 64 nt, Human
uugcccccaccucugguccacacuagaaagaagcucgccccaccuccaccugugagauccguga

SEQ ID NO: 470427 - RNA, 56 nt, Human
aaaccaaugaugucagguagcagccuucgccccaguguucugcauggauucagcau

SEQ ID NO: 470428 - RNA, 64 nt, Human
acuugcugcuuuuuuucauauugaaaagaugacaucgccccaagagccaaaaauaaaugggaau

SEQ ID NO: 470429 - RNA, 64 nt, Human
cccauugcaggaguauuaauagcaacccacauuuucgccccaaaauaaugagaccucaccuggu

SEQ ID NO: 470430 - RNA, 64 nt, Human
cugaaccugggaaucggagguugcagagccaagaucgccccacugcacuccagccuggcaauag

SEQ ID NO: 470431 - RNA, 64 nt, Human
gagcaugaugggaggugugccagaaaguccccccucgccccaaaguugcucaccgacucaccug

SEQ ID NO: 470432 - RNA, 64 nt, Human
guuuggcaacaacccaagugagccugaagcagauucgccccagagccuccaggcgugaguggag

SEQ ID NO: 470433 - RNA, 64 nt, Human
gagcacaggagacggagguugcugugagcugagaucgccccacugcuuuucaaccugggugaca

SEQ ID NO: 470434 - RNA, 64 nt, Human
ucuuucaugugcaaucuuugcuucuuguaggcuaucgccccauuccagcggagacuuauguagg

SEQ ID NO: 470435 - RNA, 64 nt, Human
uggcggugagccagagggucgggagaaacgcugcucgccccacaccccguccugccucccacca

SEQ ID NO: 470436 - RNA, 64 nt, Human
uggugcaccuuguccuuggcccugcuggucccugucgccccauccccgaccccaccucacucuu

SEQ ID NO: 470437 - RNA, 64 nt, Human
cuuucugaucaggaggcuucuuuaugaauuaaacucgccccaccacccccuccucgguagucuu

SEQ ID NO: 470438 - RNA, 64 nt, Human
caugaaaccugagacaagugcaauuccuuccaugucgccccagagugcccaggaggcaggcagu

SEQ ID NO: 470439 - RNA, 64 nt, Human
uggccgcucccaucccggcagcccuggcugcugcucgccccacccucgcuuaucuguagauuca

SEQ ID NO: 470440 - RNA, 64 nt, Human
uucagugucaccuugucagcaacacugugucccuucgccccaccguucuucucugcugcauuug

SEQ ID NO: 470441 - RNA, 64 nt, Human
uugacacugcccugggcagacaagacaggagcugucgccccaggccugugcugcccagccagga

SEQ ID NO: 470442 - RNA, 64 nt, Human
caagguucaaaaugguuacaacagccucuaccugucgccccagggagaaagggguagugauaca

SEQ ID NO: 470443 - RNA, 64 nt, Human
auccaguagaggguauggccugaagccugaagacucgccccacccaccacugcccagcacccag

SEQ ID NO: 470444 - RNA, 64 nt, Human
uugcuuuccucccgggucuccagccuccgaccccucgccccaugaaggagcuggcagguggaaa

SEQ ID NO: 470445 - RNA, 64 nt, Human
cccggguaccacaguccaccuuuagacccuacugucgccccaucuucuccguggaugggccaug

SEQ ID NO: 470446 - RNA, 64 nt, Human
cucguggggacauuaaagggcgcgguggcuccacucgccccauuucugcucuuugcguaccccc

SEQ ID NO: 470447 - RNA, 64 nt, Human
ggucuugcacuggcagcuguaauacaaagggaacucgccccacuucucccagccuggugcuguc

SEQ ID NO: 470448 - RNA, 64 nt, Human
ccuguauaagacacuuugccaaggcucuccccucucgccccaucccugcuugcccgcucccaca

SEQ ID NO: 470449 - RNA, 64 nt, Human
uugucccuuccuuuuguuuccucugaggggcuguucgccccaggcaggguccaucuuucugauc

SEQ ID NO: 470450 - RNA, 64 nt, Human
aagaaaaucauuaggaagugguagaaacuuuaaaucgccccagaguuugccuguuuccauauuu

SEQ ID NO: 470451 - RNA, 64 nt, Human
gaaccauccccugcagagcauccagggagguuucucgccccaauagccucacggcacaguacuc

SEQ ID NO: 470452 - RNA, 64 nt, Human
uucuaacauguaggcuaauuuacaugacuuguuaucgccccaauaacaauguuauuagaaaugg

SEQ ID NO: 470453 - RNA, 64 nt, Human
ucagaggcccugccgggcaccagggcuugugccaucgccccaaggggaugaaucugccacacug

SEQ ID NO: 470454 - RNA, 64 nt, Human
cacuugaccuuuucgacgcuuaaccuuuccgcugucgccccaggcccucccugacucccugugg

SEQ ID NO: 470455 - RNA, 64 nt, Human
aaacgggcugaaaauaccaccccaggagaggaccucgccccaagcaagccagugagcagcccug

SEQ ID NO: 470456 - RNA, 64 nt, Human
ggugggggggaccgggccccucucuagggaccccucgccccagccucauuccccauucuguguc

SEQ ID NO: 470457 - RNA, 64 nt, Human
gucccacggaggguguuacugggcaccaguggacucgccccauggcccguuccugggagaugag

SEQ ID NO: 470458 - RNA, 64 nt, Human
cugcuccacgacccuuccaggcagagccgagaguucgccccaacccuuccccaggcccagugug

SEQ ID NO: 470459 - RNA, 64 nt, Human
aggacaaagcgggggcaggggaaagacaccacccucgccccaagacuggggauccuggccacug

SEQ ID NO: 470460 - RNA, 64 nt, Human
acacacacacacacacacacacacacacaggcucucgccccaggauagaagcugcccagaaacu

SEQ ID NO: 470461 - RNA, 64 nt, Human
gccccaucgccccaacuccaaccucucggccccaucgccccaccgcagcuacuccccuuucuuc

SEQ ID NO: 470462 - RNA, 64 nt, Human
ccccucaccccagcuccgaccucucucagccccaucgccccaacuccaaccucucggccccauc

SEQ ID NO: 470463 - RNA, 64 nt, Human
ggacagaacuguauuuccugucaccucaggagaaucgccccagccucuuuggaaugccauugau

SEQ ID NO: 470464 - RNA, 64 nt, Human
ccuguccagucacugguucucuccucauguccucucgccccaugagguuguguugugucuucua

SEQ ID NO: 470465 - RNA, 64 nt, Human
ccuucacugucucccgcucuccaggagcuuaucuucgccccaucucccaaauaagugggcccuu

SEQ ID NO: 470466 - RNA, 64 nt, Human
accccugccuccccuucacuggggacugggguuuucgccccaugcugcaucguguuguauuggg

SEQ ID NO: 470467 - RNA, 64 nt, Human
uugcccgcucugaaucucucugcagucuacaaaaucgccccagucaacucuccacuuggaggga

SEQ ID NO: 470468 - RNA, 64 nt, Human
agggggagacgaccuucucuaagaugaacaggguucgccccaguccuccugccuggagacaguu

SEQ ID NO: 470469 - RNA, 58 nt, Human
agcacccaggccaggagugagagccaggucgccccaugaccugggugcaggcucccug

SEQ ID NO: 470470 - RNA, 64 nt, Human
uguugggauuggucaguucggcggugacguggggucgccccaaccccuuuuguaccagggccau

SEQ ID NO: 470471 - RNA, 64 nt, Human
ggugguauuuucaguuccuugguguguggauacuucgccccaucucugccuucaccuguguccu

SEQ ID NO: 470472 - RNA, 64 nt, Human
cccaugggccugcgcuguagacgucccccauaggucgccccagggccucugcccacccgagccc

SEQ ID NO: 470473 - RNA, 64 nt, Human
gcgccccuucccauauuuauucggaccccaagcaucgccccaauaaagaccagcaagcaaccgg

SEQ ID NO: 470474 - RNA, 64 nt, Human
agcuugcccucccugggccccccaccuuggugacucgccccaccacccccagcccugucccugc

SEQ ID NO: 470475 - RNA, 64 nt, Human
ccgggcgccccucccuggggcccagcaccccuccucgccccauccccguccggguacgggggcg

SEQ ID NO: 470476 - RNA, 64 nt, Human
gaggguccaggccccgcccccaaaggaccaggacucgccccaaagaucccgagggcauaggcca

SEQ ID NO: 470477 - RNA, 64 nt, Human
gccucagugagucggccggucagggcccgcagccucgccccauccacuccggugccuccauuua

SEQ ID NO: 470478 - RNA, 64 nt, Human
cgcagagggaaggggccuacacccgucuuggggcucgccccacccagggcucccuccuggagca

SEQ ID NO: 470479 - RNA, 59 nt, Human
cccagcccgacgccuacugagccccgcgcucgccccaccggcgcgcucuucgcgcccgc

SEQ ID NO: 470480 - RNA, 64 nt, Human
gguaucaaggagccugggacgugaggccccacucucgccccauucccagcuccccccaacccug

SEQ ID NO: 470481 - RNA, 64 nt, Human
guuggaaaccaagacggagcucagacccaccacaucgccccagaggcuuuuccagcacccauga

SEQ ID NO: 470482 - RNA, 64 nt, Human
uuucuccaggauuuccugcuuugggaagccgugcucgccccagcaggugcugacuucaucuccc

SEQ ID NO: 470483 - RNA, 64 nt, Human
uggaaaggaugcugccaggugacccgaggugcacucgccccagggagauggaguagacagccug

SEQ ID NO: 470484 - RNA, 64 nt, Human
agguuggggucaaugccuccugggcacccuugccucgccccagaccggcccguccaguccccau

SEQ ID NO: 470485 - RNA, 64 nt, Human
cccauccuugaccacagggacaagaggggcccccucgccccagccccaccccacauggagcuca

SEQ ID NO: 470486 - RNA, 64 nt, Human
uuggagcccccuggcggcagggguuggcagcgccucgccccagccaagccugacuuuggggaca

SEQ ID NO: 470487 - RNA, 64 nt, Human
aaacguagaguauagaaauccaccuuaaagccccucgccccaacuucuccaccaacgccuucug

SEQ ID NO: 470488 - RNA, 64 nt, Human
uugccucugcccuuggggaaaugcuaucagaaauucgccccauuuucuuuacagucuuuugugu

SEQ ID NO: 470489 - RNA, 50 nt, Human
ggcuguggaugaaccagugaucgccccagcgcggccuccguauuggagcc

SEQ ID NO: 470490 - RNA, 64 nt, Human
cauaaccacccaaagagccaguugcucuguguauucgccccacucaugaucaccauuuuauuuu

SEQ ID NO: 470491 - RNA, 60 nt, Human
aguguacagugggcuugcauuggggauggggguguguacagaugaagucaguggcuuguc

SEQ ID NO: 470492 - RNA, 64 nt, Human
augaaaccacgcugcgcuuccgaugcccccgcuugccguguaaugguucagcuaaucccauggc

SEQ ID NO: 470493 - RNA, 64 nt, Human
aggguauuccagaguggggauaugauuuaaaucagccguguaaccauggacccaauauuuacca

SEQ ID NO: 470494 - RNA, 64 nt, Human
aaacaaaacuagcagaauguuuuuaaaacuuuuugccguguaugaggagugcuagaaaaugcaa

SEQ ID NO: 470495 - RNA, 64 nt, Human
agucuacuuguuacuauccaucuccaggcucugggccguguagacacuaaaccucaugcccuaa

SEQ ID NO: 470496 - RNA, 64 nt, Human
ccuuagaugcccaucuggacgugaugccgcgccugccguguaagaaggugcaauccuagauaac

SEQ ID NO: 470497 - RNA, 64 nt, Human
gggggccaugggccuugugggaggauaucuuuuggccguguacccucagguccagugcuugguc

SEQ ID NO: 470498 - RNA, 64 nt, Human
auagaggcaacucccaggccagugagcuuuacuugccguguaaaaggaggaaagggguggaaaa

SEQ ID NO: 470499 - RNA, 64 nt, Human
ugauauuuucacagauggaagaaguuuuaacuaugccguguaguuucugguaucguucgcuugu

SEQ ID NO: 470500 - RNA, 64 nt, Human
auccacucacguucauaaagagaauguugauggcgccguguagaagccgcucuguauccaucca

SEQ ID NO: 470501 - RNA, 64 nt, Human
uaaacuuuuuuuugccauccauccugugcaauaugccguguagaauauuugucuuaaaauucaa

SEQ ID NO: 470502 - RNA, 64 nt, Human
gcaugcuacaauccaggacugugguguucuaugugccguguauggucauauuaguagcuauuug

SEQ ID NO: 470503 - RNA, 64 nt, Human
cccgggcacugucgcgcuugcugcaggcggcccagccguguauuuauuuuucaccuaucuccuu

SEQ ID NO: 470504 - RNA, 64 nt, Human
cacauucuaacugugcaaaauuaucuuggccuuggccguguaaugugagguuuaccugauucuc

SEQ ID NO: 470505 - RNA, 64 nt, Human
gccuaggcaaacuacuaacaugcauugugagaaugccguguauaccucacguacuguguacuuu

SEQ ID NO: 470506 - RNA, 64 nt, Human
cacuggggggcugugacagcagcugggccaggaggccguguaaugaccacacacuccucucaag

SEQ ID NO: 470507 - RNA, 60 nt, Human
cuagagauaaacuuuccaauuuuuaagcuugguguguacccagggaaguuaucuugguau

SEQ ID NO: 470508 - RNA, 60 nt, Human
gugaggaugaaauaaugaccuugauuuuuggguguguauugcagaagccucgucgcuuuc

SEQ ID NO: 470509 - RNA, 60 nt, Human
aagaaagcaaguacaguguggauuucaaaugguguguaacuucagcuccagcugguuuuu

SEQ ID NO: 470510 - RNA, 64 nt, Human
cagcacugcugcugcccugaggggaaacgccugggccguguaguggggacgcucugggaauggu

SEQ ID NO: 470511 - RNA, 64 nt, Human
gcccagaagagaggccgggcugcugcagaaccccgccguguaaagaggcagaaaaguugguuug

SEQ ID NO: 470512 - RNA, 64 nt, Human
aauuuauuuccaggaagguguguggaagacaugagccguguauaauauuuuuuuuaacauuuuc

SEQ ID NO: 470513 - RNA, 64 nt, Human
ugcuccucugggcucuugaguugcugcuugaauugccguguagacauuugcuuggagaguccac

SEQ ID NO: 470514 - RNA, 64 nt, Human
aucuaucuaucuaucuauauaacuauaaccacacgccguguagacacccgcugccacacacuac

SEQ ID NO: 470515 - RNA, 64 nt, Human
uuaagcuaacaaagaucauaauuuucaaugauuagccguguaacuccugcaaugaauguuuaug

SEQ ID NO: 470516 - RNA, 64 nt, Human
gcagguauggaucacauaggaugcgauaccuguggccguguauguccacaugugugccuguaga

SEQ ID NO: 470517 - RNA, 64 nt, Human
ccagcccaccacagccacuguagaccacaggcaggccguguacugcaccacugggaggacgugg

SEQ ID NO: 470518 - RNA, 64 nt, Human
guacuacucaguaugcaccacagaauaagaguuugccguguaaagacaauauccccauucguca

SEQ ID NO: 470519 - RNA, 64 nt, Human
caguauuaaugguguaacuuuguuggcaauauuugccguguagaauuuuuuuuagauauccauu

SEQ ID NO: 470520 - RNA, 64 nt, Human
gggucccuccguggggggcugggugcggcccccugccguguauuuccuccccagggaguggggc

SEQ ID NO: 470521 - RNA, 64 nt, Human
uuuauauuaaaaggggccuccuuuuuaaauauaugccguguaaaaaauguacuuauaggaacau

SEQ ID NO: 470522 - RNA, 64 nt, Human
gggguggguguaagggugaggugggggugugugugccguguauguguguagggguguggugggg

SEQ ID NO: 470523 - RNA, 64 nt, Human
ccuguggcuuuguuuucuuaguuacuuuuuccgugccguguauuuuuuaauugauuuuucuucu

SEQ ID NO: 470524 - RNA, 64 nt, Human
caagccugaguguuaauuuaacucuauguuguccgccguguagacauccgaggucauuuguugc

SEQ ID NO: 470525 - RNA, 60 nt, Human
uauaugggaauuaaaauauguuuaggcagggguguguaaaaagguuaaguuuuuguuucu

SEQ ID NO: 470526 - RNA, 60 nt, Human
cauccagcagccacuaacaaacacacaacugguguguaaaaggcaggccuuacauuagaa

SEQ ID NO: 470527 - RNA, 60 nt, Human
aagauauuuggggaauaaaaauaacagcuugguguguagcaucugcagccacuuggcaaa

SEQ ID NO: 470528 - RNA, 64 nt, Human
ggagggggugccgaggcuacgcauguccucgagggccguguacacucuccaggcaccaugggcg

SEQ ID NO: 470529 - RNA, 64 nt, Human
uucugcccaccccuuccguugucacgagugccgugccguguaauaaagucccagugcucaucca

SEQ ID NO: 470530 - RNA, 64 nt, Human
gacaaaucaaaauacggaugacaaagaggauauagccguguauaccccagggagaggaggcgcc

SEQ ID NO: 470531 - RNA, 64 nt, Human
cugccugcguugcaaacugggcuuuguagcgucugccguguaacacccuuccucugaucgcacc

SEQ ID NO: 470532 - RNA, 64 nt, Human
ccugcugugggcuuggugcaccgucaacaccagagccguguaccugaggcccaggcagcgggaa

SEQ ID NO: 470533 - RNA, 64 nt, Human
cagugauaaagcgugcaccgugcagcccgccauggccguguagacccuaacccggagggaaccc

SEQ ID NO: 470534 - RNA, 64 nt, Human
cagguuuggguacaaguggcaaccugcuuccauggccguguagaagcauggugcccuggcuucu

SEQ ID NO: 470535 - RNA, 64 nt, Human
gaacguuuuaccgaaguguugugacucaauaauugccguguaguucaucaaaaccuacauauua

SEQ ID NO: 470536 - RNA, 60 nt, Human
uaugggugugugugggugggugugaguguggguguguacguaccaauaaacaaccugguu

SEQ ID NO: 470537 - RNA, 60 nt, Human
cccuccaugcugucgucaucgacauauacagguguguacguagguguauguguguacucu

SEQ ID NO: 470538 - RNA, 60 nt, Human
ccccuccccgccacgaucgucgcugugcuugguguguaggacccuaggcuccccgcccac

SEQ ID NO: 470539 - RNA, 60 nt, Human
auagggaccagucuacuacccacugggccugguguguagagggggagaggguagcaaggu

SEQ ID NO: 470540 - RNA, 60 nt, Human
aggguuccuaacccaaccuacuccccuuaggguguguauccaacccagugcuuccuaaga

SEQ ID NO: 470541 - RNA, 60 nt, Human
agacuugcugaugugcauguggggggaugagguguguauaugccuuucuccugacuggcc

SEQ ID NO: 470542 - RNA, 60 nt, Human
gacuguccguggaggggugacuguguccgugguguguauuaugcugucauaucagaguca

SEQ ID NO: 470543 - RNA, 60 nt, Human
gcagccuaaaguacagccuggaccaccccugguguguagcuaguaagauuacccugagcu

SEQ ID NO: 470544 - RNA, 60 nt, Human
agggugugggugugcgugugugcaugugcugguguguaagggggaaagggucuuuccugg

SEQ ID NO: 470545 - RNA, 60 nt, Human
ccccacccugagguccugcauuucucagucgguguguaaucacguuccagggcccaaagc

SEQ ID NO: 470546 - RNA, 60 nt, Human
ugugcagaauauucuaagaggucagaaauugguguguauaacuacauuuuuagugaugca

SEQ ID NO: 470547 - RNA, 60 nt, Human
ugcugccucugacuacucagccuuguuuucgguguguaggccccagcugcccacuggaac

SEQ ID NO: 470548 - RNA, 60 nt, Human
cuggcugaggcaucgcucaagcuggggggugguguguaagaagcacguggagccacaaga

SEQ ID NO: 470549 - RNA, 60 nt, Human
uucacuuucauuugcuggugugagccaugggguguguauuuguauguggggaguaggugu

SEQ ID NO: 470550 - RNA, 60 nt, Human
aguugaaacuguagaaagggucagguuggagguguguaauaaaaaagaauuaccuagguu

SEQ ID NO: 470551 - RNA, 60 nt, Human
cuuccacuucaaugcacauggugcaguuuugguguguaacuuagaaggauugaacuucuu

SEQ ID NO: 470552 - RNA, 60 nt, Human
uuaaaucuuuuuuuaacuaauaagauuuacgguguguauuuuauacagaaaugcauuaua

SEQ ID NO: 470553 - RNA, 60 nt, Human
aauugccugccuuguacuuuaugggcuugggguguguagaaugauuuugcgggggagugg

SEQ ID NO: 470554 - RNA, 60 nt, Human
uguggccccugcaggggcagaguauccuaggguguguauccaucuggcugucuguccauu

SEQ ID NO: 470555 - RNA, 60 nt, Human
uggaaacccuucucccugugccuuagagcagguguguacaucucucacuaccuuucucau

SEQ ID NO: 470556 - RNA, 60 nt, Human
uuauuuuuuuuuggcugaguaguauucugugguguguauguguguguguguaugcauaua

SEQ ID NO: 470557 - RNA, 60 nt, Human
uuauagaaguuugaaaauuuaaugcaggcagguguguaauaaauuauuuuugaauugaac

SEQ ID NO: 470558 - RNA, 60 nt, Human
aaggguaccaguaauacacuaaauuuucaagguguguagagaaauaauauggaauuagca

SEQ ID NO: 470559 - RNA, 60 nt, Human
ugaaaguuuacauuuuuuaugcuuuguguugguguguaauuuuuguacucuugguggcua

SEQ ID NO: 470560 - RNA, 60 nt, Human
ucguaggccuuaugauaauuaccccgcggugguguguagaaaaguauguaaauuugcucu

SEQ ID NO: 470561 - RNA, 60 nt, Human
uuuucuuuaguuuaaucuuggucauguuuugguguguauuuuuaauuuuuuucuuaaauu

SEQ ID NO: 470562 - RNA, 60 nt, Human
cuaaaaauacaaaaauuagcuggguguggugguguguaccuguagucccagcuacccagg

SEQ ID NO: 470563 - RNA, 60 nt, Human
gugagccgaagaucaauucgacagacagaugguguguaugccccucccuguuugacuuca

SEQ ID NO: 470564 - RNA, 60 nt, Human
aaauuuguaagguugccccuuuguggcacugguguguaaaauacacagacuaucacuaaa

SEQ ID NO: 470565 - RNA, 60 nt, Human
uggauucccacaguaauauagacugugcaugguguguauauuucauugcgauuuccuguu

SEQ ID NO: 470566 - RNA, 60 nt, Human
gucaauucagaagaaagugucucugccauagguguguauguguauaugugugcguguggu

SEQ ID NO: 470567 - RNA, 60 nt, Human
gccuaagccuccugaguagcugggaucacagguguguaccaccacgcccagcugauuuuu

SEQ ID NO: 470568 - RNA, 60 nt, Human
cuuuuagcuucauucucccauauuuugaaggguguguaacuucagcucugcaggauugca

SEQ ID NO: 470569 - RNA, 60 nt, Human
ugagcagauccagggaucagugagaggagugguguguaccccuaaauccucccaccccag

SEQ ID NO: 470570 - RNA, 60 nt, Human
uaaggaaaaaaaauagccugccuugggacagguguguaauguuagugugcaugacuaaug

SEQ ID NO: 470571 - RNA, 60 nt, Human
uauuuggaaacucuuggugagagaaugaaugguguguauacauacucuguacauuuuucu

SEQ ID NO: 470572 - RNA, 60 nt, Human
cccuaauugaugagaggcucgcugcuugaugguguguacaaacucaccugaaugggacuu

SEQ ID NO: 470573 - RNA, 60 nt, Human
cucccagggaaaaacgaagugcauuugauugguguguauuggccaaguuuugcuuguugu

SEQ ID NO: 470574 - RNA, 60 nt, Human
gacugauuacacugaggugaggcuacaagggguguguaaccguguaacacgugaaggcaa

SEQ ID NO: 470575 - RNA, 60 nt, Human
ggccccuuugguuuccgugucauccuuuuugguguguaggacaaggagccagggaauugg

SEQ ID NO: 470576 - RNA, 60 nt, Human
agguuagggugaggggucaggguuuaggaggguguguauguugggaggacaggcuaguug

SEQ ID NO: 470577 - RNA, 60 nt, Human
aguaaaacuagccuuucacauuaagguuuugguguguauuuuguuaaauaacuaacaugc

SEQ ID NO: 470578 - RNA, 60 nt, Human
acagcagaaguucugagccugaccacagaugguguguaaucuaucaaacacaccccuggc

SEQ ID NO: 470579 - RNA, 60 nt, Human
auaccugagcccaguacaacaaaggugacggguguguagguacacacccagagauggagc

SEQ ID NO: 470580 - RNA, 60 nt, Human
uucuucuguuuuuauugaggguggggguuggguguguaauuuguaaguacuuuugugcau

SEQ ID NO: 470581 - RNA, 60 nt, Human
cuuggcaugaaagggugcccuggauaggaggguguguacagggcaaaaugccaaaaagca

SEQ ID NO: 470582 - RNA, 60 nt, Human
ugugaauuaucugcaugugugcuuuuuuuugguguguauuucauuaaaaaauauaaauau

SEQ ID NO: 470583 - RNA, 60 nt, Human
aggaugcucacuguaagacuguuggacagugguguguauugaggggaugaaucggaacga

SEQ ID NO: 470584 - RNA, 60 nt, Human
ucucuuuuucauacuaagcuuucgaaaucugguguguauuuuacacuuucugcacaucuc

SEQ ID NO: 470585 - RNA, 60 nt, Human
aaagcuguuuaagaaggccaugacucuuuagguguguauguguaccuuucagcauccuag

SEQ ID NO: 470586 - RNA, 60 nt, Human
uugaccuguucagugucugucuuccagcacgguguguacacuucuucaaaauuguacaca

SEQ ID NO: 470587 - RNA, 60 nt, Human
uggauuaguuuuccugacaaagcauguuuugguguguagucuuacuuuuuagaaauagcu

SEQ ID NO: 470588 - RNA, 60 nt, Human
caaagauguguucaggcauuccagguaacagguguguauguaaaguuaaaaauaggcuuu

SEQ ID NO: 470589 - RNA, 60 nt, Human
aagaagaaaguuguauaagcuauugauaaggguguguaucuuaauguuguugaguuuugu

SEQ ID NO: 470590 - RNA, 60 nt, Human
cccuucuuuccacagaagcuccagguagaggguguguaaguagauaggccaugggcacug

SEQ ID NO: 470591 - RNA, 60 nt, Human
gcaguugaaggaagagagugcauggcaccugguguguaacgacacaaucagcacaacugg

SEQ ID NO: 470592 - RNA, 60 nt, Human
acuggacaggguucucuaagcagugaggcugguguguaugauugucuuaaaauuuuuuaa

SEQ ID NO: 470593 - RNA, 60 nt, Human
acauccccaggcaggacagaucggggaagggguguguaccaggcuaugauuucucuugca

SEQ ID NO: 470594 - RNA, 60 nt, Human
uuacauuguacagaaucuguacuuauguuugguguguaauauaccaauuaguuuuauaua

SEQ ID NO: 470595 - RNA, 60 nt, Human
aaaaagaaaaaagaaaaagccgggugaggugguguguaccuguagucacagguacuuggg

SEQ ID NO: 470596 - RNA, 60 nt, Human
gcaccaacacugucguauccuuguuaaaaugguguguaccuuacaaauuauaauuuaugu

SEQ ID NO: 470597 - RNA, 60 nt, Human
agggagcugcgccuuccuggggugcccggugguguguagagaaaagcugcuuguuuacuc

SEQ ID NO: 470598 - RNA, 60 nt, Human
aucuucuauuguguggaaaauguugugaaggguguguaggugugguacauguguauguca

SEQ ID NO: 470599 - RNA, 60 nt, Human
acgagaaaaagaaggggaaugguggggaaugguguguaccgauauauaguauuucuuuag

SEQ ID NO: 470600 - RNA, 60 nt, Human
agggacauggacuuggguguucuuauuuaugguguguauguaaagagauaggggagaaaa

SEQ ID NO: 470601 - RNA, 60 nt, Human
auggaacaaaacucaucuggcugcaucccagguguguagcaaaguccacauguaaauuua

SEQ ID NO: 470602 - RNA, 60 nt, Human
ggccugggcuguggacagaaggaugucccggguguguacaccaagguuaccaacuaccua

SEQ ID NO: 470603 - RNA, 60 nt, Human
agguaauauaauuuuagguuuaccaaauaugguguguauucaaauaauacuugaccagcu

SEQ ID NO: 470604 - RNA, 60 nt, Human
caguauuuuuccuuuuuaaccauuccaaucgguguguagugauguuucauuuugguuuua

SEQ ID NO: 470605 - RNA, 60 nt, Human
agaguugggagauaagauaguuuccaugaagguguguauguuuuauacgauguuuguuau

SEQ ID NO: 470606 - RNA, 60 nt, Human
gagucccuaacuuucuuaucccaugagagagguguguaaaggagaaagcuagaggugaac

SEQ ID NO: 470607 - RNA, 60 nt, Human
aaucuuuauuaauguuuagauuuuucauuugguguguaagaaaauauucuuuguaugauu

SEQ ID NO: 470608 - RNA, 60 nt, Human
uaguugacuuucuaucuuuuggcauucuuugguguguagaauuacuguaauacuucugca

SEQ ID NO: 470609 - RNA, 60 nt, Human
caucugugcauaaggagaggaaaguuccaggguguguauguuucaggggcuucacaugga

SEQ ID NO: 470610 - RNA, 60 nt, Human
ggauaauagguuuuucauaaagaaacguaggguguguaugugaaaguggggugagguucc

SEQ ID NO: 470611 - RNA, 60 nt, Human
gaggaggugcuggcggccccagggaaggaggguguguaccccaaggcccccuggcugugc

SEQ ID NO: 470612 - RNA, 60 nt, Human
ugaaugcugguacuauugugaccacaggcugguguguaggugguaaaaccuguucuccau

SEQ ID NO: 470613 - RNA, 60 nt, Human
uagccuugcuggggccauaauaugcuucaggguguguaaaagaagaaaucucuuuguggc

SEQ ID NO: 470614 - RNA, 60 nt, Human; identical to SEQ ID NO: 470613

SEQ ID NO: 470615 - RNA, 60 nt, Human
auuuuguuaaugcacauucuguuuguuuaagguguguaagauacacacccuucuagauga

SEQ ID NO: 470616 - RNA, 60 nt, Human
gcugauugcauuuccucucauuaacaauuggguguguaauaaaaagcauuguacuucauc

SEQ ID NO: 470617 - RNA, 60 nt, Human
gcccauuagguuaaacaccaaagaaagacugguguguacugaauaggaaagggaaguuuu

SEQ ID NO: 470618 - RNA, 60 nt, Human
uaguuugcacauccagaacggcgaaggcuggguguguauuccacuaacugaaauauggca

SEQ ID NO: 470619 - RNA, 60 nt, Human
auaccagauuugauauaauguuguaacauagguguguagauaguggauccuggauggaac

SEQ ID NO: 470620 - RNA, 60 nt, Human
acuuaacauucuuguaauagaaaccagcaggguguguacacuuuugugugugugcgcagg

SEQ ID NO: 470621 - RNA, 60 nt, Human
cugcugagcucugguuagguuacagcuggagguguguauauauacacacacacacaugua

SEQ ID NO: 470622 - RNA, 60 nt, Human
cuuuaaagauacagugugaaaauuugcucggguguguagcaguaauuacacgaggcaaac

SEQ ID NO: 470623 - RNA, 60 nt, Human
acaggugaauaccugcuccucgccuggauggguguguauuuugaucugcauugacaccag

SEQ ID NO: 470624 - RNA, 60 nt, Human
uaaaacuugaagccauaaaaauauuaguuugguguguauuggggaaaauagcuaaaaguc

SEQ ID NO: 470625 - RNA, 60 nt, Human
cuguguugugcaaaagaauuggaaggaugugguguguaccuguagccugaagaacuggag

SEQ ID NO: 470626 - RNA, 60 nt, Human
uuccuaauaucaggcgccuacuuaaccuaugguguguacuuuuuguaaguuguaacuuga

SEQ ID NO: 470627 - RNA, 60 nt, Human
aggugggcuggacuucuaccugcccucaaggguguguauauuguauaggggcaacuguau

SEQ ID NO: 470628 - RNA, 60 nt, Human
gccugcugcugugacccguuuuggaaaacugguguguaccgaggcgcugacugcacggcu

SEQ ID NO: 470629 - RNA, 60 nt, Human
gacagcuuuccuucacacacuauuuuuguggguguguauauaucugauuugggaagaauu

SEQ ID NO: 470630 - RNA, 60 nt, Human
gaggccaguguuggggagccuguggaggcagguguguagaauuguguucgggaggugggg

SEQ ID NO: 470631 - RNA, 60 nt, Human
uucugugccaucugaacaugcucuccuguugguguguaugucacuagggcaguggggaga

SEQ ID NO: 470632 - RNA, 60 nt, Human
cuguggcaaagcgugucccauagaaaauuggguguguauacuuguauaacuuuguaaaua

SEQ ID NO: 470633 - RNA, 60 nt, Human
auacauauguguguauauaugguuuugucagguguguaaauuugcaaauuguuuccuuua

SEQ ID NO: 470634 - RNA, 60 nt, Human
uguguaauccaguaaaaucucccuuuuucggguguguaugugggcaugugcccauuucua

SEQ ID NO: 470635 - RNA, 60 nt, Human
auucugaagaauaaaccuagcuggcaugcugguguguaccuguaguccuagcuauuuggg

SEQ ID NO: 470636 - RNA, 60 nt, Human
auaaugaauauaauuuacccaguggacaaagguguguaccaagugaauuuaaauaauugg

SEQ ID NO: 470637 - RNA, 60 nt, Human
ugacgucgggcauucauauaggaagaacgcgguguguaacacuguguacaccucaaauac

SEQ ID NO: 470638 - RNA, 60 nt, Human
cugcgucuguccacacucgauugggccccagguguguaugaggcgcucugguaaggugcu

SEQ ID NO: 470639 - RNA, 60 nt, Human
ugucuuuauuccuuauuucacaauguauuugguguguaggggaggggggagaacuaaaug

SEQ ID NO: 470640 - RNA, 60 nt, Human
acaaaaaugggaggagguguccacauuuaugguguguauagguaacauggggaaaaugcu

SEQ ID NO: 470641 - RNA, 60 nt, Human
cccuaugugggauuuuuuaaaaagcaaacugguguguauucucaugugguuugcacagcc

SEQ ID NO: 470642 - RNA, 60 nt, Human
uguguuguguguuucugucugaggacaguggguguguacuggccucccgggagccacugu

SEQ ID NO: 470643 - RNA, 60 nt, Human
acaucucuuccagaguuaucccacuggcuugguguguauacauuaggggaggauaaucug

SEQ ID NO: 470644 - RNA, 60 nt, Human
ccuguguauguguggguguguguguauuuggguguguaaauguugguucuuccacuacug

SEQ ID NO: 470645 - RNA, 60 nt, Human
uagggggcacagaacaccagaaagaguguugguguguagguagauuccauauuaaugagg

SEQ ID NO: 470646 - RNA, 60 nt, Human
cccuuuccccuagacaucuacccaaaugcagguguguagguugagucuuuaacaaaguga

SEQ ID NO: 470647 - RNA, 60 nt, Human
ugugaggagugagugagacaggacaugaaagguguguaugaacugugauaacuguugccc

SEQ ID NO: 470648 - RNA, 60 nt, Human
cuuccaaggaaaaacauaauucuuucaaacgguguguauuuggcaaagagcucuucaaau

SEQ ID NO: 470649 - RNA, 60 nt, Human
guugguuugaaguguuagacuauagccccugguguguaaauaauguacauagagugagaa

SEQ ID NO: 470650 - RNA, 60 nt, Human
auugaugauaguugaaauauucuuagaagggguguguaugucuagcugugucuaccaugu

SEQ ID NO: 470651 - RNA, 60 nt, Human
aaggagaugaaggaguguguguagcauggggguguguacaacuuaacaccuggacuuuua

SEQ ID NO: 470652 - RNA, 60 nt, Human
cuggggggguuggggugggcuuggaacacagguguguacagcgugcuguaguggaaguuu

SEQ ID NO: 470653 - RNA, 60 nt, Human
uuucaagcaaaaugccugggcuugggggaagguguguaucuguccauguguggauguugg

SEQ ID NO: 470654 - RNA, 60 nt, Human
aauuaauagcccuuagcaacgacugcugcugguguguauuuuuguaaauguuaugcacuc

SEQ ID NO: 470655 - RNA, 60 nt, Human
gccagccucucacaucuugcacacuuuuuggguguguaaaugacacaaaaguuauuuaca

SEQ ID NO: 470656 - RNA, 60 nt, Human
ccaaaaauacaaaauguauccagacauggugguguguaccuguagucccagcuacucagg

SEQ ID NO: 470657 - RNA, 60 nt, Human
agcuugugcugcuugcacaacugagcugcugguguguaccccuuagcagggugucugggg

SEQ ID NO: 470658 - RNA, 60 nt, Human
accucuucuuggucagaauucuauucucaggguguguaccaugauuugucugcuaagaag

SEQ ID NO: 470659 - RNA, 60 nt, Human
gcaucugaauacaggaguaggggggguguggguguguaaccagagaccgagagcaugagu

SEQ ID NO: 470660 - RNA, 60 nt, Human
gugcucccuucccagaggaggggccccaucgguguguaagguggccuauuccucugugug

SEQ ID NO: 470661 - RNA, 60 nt, Human
ccuggggggcccuuccccagcauaccugcugguguguaaguguggacuaacccgccgcca

SEQ ID NO: 470662 - RNA, 60 nt, Human
gguggccuguuugaaaguaaaaaccugcuugguguguagguuccguaucucccuggagaa

SEQ ID NO: 470663 - RNA, 60 nt, Human
ucuucugcuaauggugaugugaauucuuaggguguguacguacgcagccuccagggcacc

SEQ ID NO: 470664 - RNA, 60 nt, Human
gacagagugaagcuggcuggggggcacagugguguguagugcugcuguguaucaaaagac

SEQ ID NO: 470665 - RNA, 60 nt, Human
gaugguggagugagagccuuugccuuuagggguguguauucacauaguccucagggcuca

SEQ ID NO: 470666 - RNA, 60 nt, Human
agugucgggcuuccggggaaagcaaucauugguguguauguguaugugcaugcacacacg

SEQ ID NO: 470667 - RNA, 60 nt, Human
accucagccgccgaaguagcugggacuauagguguguaccaucacaccuggcuaauuuuu

SEQ ID NO: 470668 - RNA, 60 nt, Human
agugagcgcugggaacagaguggagucuccgguguguaccucagacugauggugcccaug

SEQ ID NO: 470669 - RNA, 60 nt, Human
gcacggggaagguuuuggaguagaaccagggguguguaugaaggggggugacaagguccc

SEQ ID NO: 470670 - RNA, 60 nt, Human
uaccccccaaccuccaggagcuaguggagggguguguaacagggucauacccccucccuc

SEQ ID NO: 470671 - RNA, 60 nt, Human
ugaccucugguucagccaaggaccaaagaagguguguaagugaagugguucucagucccc

SEQ ID NO: 470672 - RNA, 60 nt, Human
cuccaauuuggcugggauuauucaaaguaggguguguauguaacuuaucacuggaccacu

SEQ ID NO: 470673 - RNA, 60 nt, Human
uguguggaugcgugugaacgcaugugguaagguguguacucagggcauucuguuggccua

SEQ ID NO: 470674 - RNA, 60 nt, Human
cuccucucagccugaguaacugggacuacagguguguaccacuacauccagcuaaaggag

SEQ ID NO: 470675 - RNA, 60 nt, Human
ggggguguguguaguguguguugggugugggguguguacaccuggcaucuguggcaugug

SEQ ID NO: 470676 - RNA, 60 nt, Human
augccuguccugccucuggccuguguccuggguguguaccauaccugcugggccaguccc

SEQ ID NO: 470677 - RNA, 60 nt, Human
gcaguacuagaaacuuuccaaggagucuuggguguguagccaagaggagccaugagcuau

SEQ ID NO: 470678 - RNA, 60 nt, Human
ugugugcucacccacagagcaugggguaaugguguguagacacaggcccucugcagaagc

SEQ ID NO: 470679 - RNA, 60 nt, Human
uugaauaguucuauacaaaugaaguauggagguguguauguuuauauguauauaacaaaa

SEQ ID NO: 470680 - RNA, 60 nt, Human
ugugaaagcaacaugaaaugaacuguaguagguguguaguuuggggaagucaaauggcca

SEQ ID NO: 470681 - RNA, 60 nt, Human
uuuuagcaagauugaccaaaacaggugguagguguguaauuuuuaacugucaugaaauac

SEQ ID NO: 470682 - RNA, 60 nt, Human
acauuauuaagacacagcugagaguugauggguguguaaugcauaugccaaggaaauguc

SEQ ID NO: 470683 - RNA, 60 nt, Human
gcuaauaaaauguguugcgaggcugacgcugguguguaugcgagcgcccgccucccagcc

SEQ ID NO: 470684 - RNA, 60 nt, Human
ugcuuuucucagccccaagccucuagucuggguguguacggagggucuagccugggugug

SEQ ID NO: 470685 - RNA, 60 nt, Human
agucuggguguguacggagggucuagccuggguguguacggagggucuagccugggugag

SEQ ID NO: 470686 - RNA, 60 nt, Human
agccugggugaguacggagggucuagccuggguguguauggaggaucuagccugggugag

SEQ ID NO: 470687 - RNA, 60 nt, Human
agccugggugaguauggagggucuagccuggguguguauggagggucuagccugggugag

SEQ ID NO: 470688 - RNA, 60 nt, Human; identical to SEQ ID NO: 470687

SEQ ID NO: 470689 - RNA, 60 nt, Human
agccugggugaguauggagggucuagccuggguguguacggagggucuagucugagugcg

SEQ ID NO: 470690 - RNA, 60 nt, Human
gcuggggggcaggcugaauguguguguguggguguguauguguggagugugugugugugu

SEQ ID NO: 470691 - RNA, 60 nt, Human
ugaaaaagaaacuuuagagaaagcaucagggguguguacucaguauuucaaaucagaaca

SEQ ID NO: 470692 - RNA, 60 nt, Human
gauggagguguaggcuggagagacauuguggguguguaucuucuuaucucauuucacaag

SEQ ID NO: 470693 - RNA, 60 nt, Human
gagccuugacuggauggagguggggagugugguguguaaagucucuggccucauaaaagg

SEQ ID NO: 470694 - RNA, 60 nt, Human
uuuucuauaauuuuauaaaugaaaccauaugguguguacuuuuuaggggguggggcucug

SEQ ID NO: 470695 - RNA, 60 nt, Human
ucagucccccuccagguauuugaaacuacagguguguaccaccacaccgggcuaauuuuu

SEQ ID NO: 470696 - RNA, 60 nt, Human
gcaaacaugagcagaaaauauuuucccacugguguguagccugcuacaaggaguuguugg

SEQ ID NO: 470697 - RNA, 60 nt, Human
gcauggcuuuauuuucuuaauggaugucuugguguguaggagcaugcauuuguaggcacc

SEQ ID NO: 470698 - RNA, 60 nt, Human
aaacuuccaaacgcagugcccuguucugccgguguguacagccucagcgcaccaggagac

SEQ ID NO: 470699 - RNA, 60 nt, Human
gaggaaacauuauucauuggaaaagugcaugguguguauuuuagggauuaugagcuucuu

SEQ ID NO: 470700 - RNA, 60 nt, Human
uuaaguccuguauauguauguaguaguuuggguguguauauauaguagcauuucaaaaug

SEQ ID NO: 470701 - RNA, 60 nt, Human
ccuguaagcccagcauuugagagaagguaggguguguauauauaaaagguuguguacaac

SEQ ID NO: 470702 - RNA, 60 nt, Human
agaaaaauuuuaaaauuagcugggcguggugguguguaccuguaggccuagcugcucagg

SEQ ID NO: 470703 - RNA, 60 nt, Human
gagcaagccaggaagggaaggagucugugugguguguaugugcaugcagccuacacccac

SEQ ID NO: 470704 - RNA, 60 nt, Human
acauaaauauagcgagcucuacuaaguacagguguguauaauguaucagggaccauggcc

SEQ ID NO: 470705 - RNA, 60 nt, Human
agcauggcggggcggggggcggggggcggggguguguaugggaaucccucccccucuuac

SEQ ID NO: 470706 - RNA, 60 nt, Human
aaggaggaugaaacgccggaacaaaaaugagguguguagaacagggucccacagguuugg

SEQ ID NO: 470707 - RNA, 60 nt, Human
aucugcuauuuccugugguguucugggcaugguguguaagacccacagaggcuccgggug

SEQ ID NO: 470708 - RNA, 60 nt, Human
ccuaacauuguucaggcgcauggccccugcgguguguacacgaacucggcuucuuuuguc

SEQ ID NO: 470709 - RNA, 60 nt, Human
ggcaugagcagaggugagcgugagcgagcggguguguauguacgagugugcacgugugug

SEQ ID NO: 470710 - RNA, 60 nt, Human
cuagccuuuguccucaccuacccuaaggcagguguguaugcuugaauuccuuccguaugg

SEQ ID NO: 470711 - RNA, 60 nt, Human
cagccacgacugccauguaagguugugcaggguguguacugcacaaggacauuguaugca

SEQ ID NO: 470712 - RNA, 60 nt, Human
gccggcuggaagaagaaccucgcaucuuuugguguguaugcaccuuggcagccagcagga

SEQ ID NO: 470713 - RNA, 60 nt, Human
ucuaagggcuuuacaaggaucaaauaagaugguguguauguaagaaauuuguaaaaugug

SEQ ID NO: 470714 - RNA, 60 nt, Human
guguguguguguguguguguguguguguaugguguguauuccauaucuauucccauguaa

SEQ ID NO: 470715 - RNA, 60 nt, Human
uguuuguuucuuuuucaugguauuacugaagguguguauacucccuaauacacauuuaug

SEQ ID NO: 470716 - RNA, 60 nt, Human
auggguuuuuuaaccccaaauuauccacaugguguguauuaugaauucuuugaacucuua

SEQ ID NO: 470717 - RNA, 60 nt, Human
gucaguuaugauugucuggagagaagcugugguguguaugcuguagaguuuccacauuuc

SEQ ID NO: 470718 - RNA, 60 nt, Human
ggguucauguuguaauaaaagaagauuguugguguguaauuaauuuguucaaaagaaaaa

SEQ ID NO: 470719 - RNA, 60 nt, Human
guaaucagauuuauuuaauuggguggggcagguguguauuuacuuuagaaaaaaugaaaa

SEQ ID NO: 470720 - RNA, 60 nt, Human
aaguauagauuaaggcaacaaacauauuuggguguguaauuugaaguuuuggacugaaau

SEQ ID NO: 470721 - RNA, 60 nt, Human
ccccaguacuuuuagccaaccuuaccaagugguguguaaacuaguauguaugugcuuugc

SEQ ID NO: 470722 - RNA, 58 nt, Human
guuucucuugagggcaauaaaaguugucaugguguguacguggugcggugugugacug

SEQ ID NO: 470723 - RNA, 60 nt, Human
aaauuguggacucaggauuuuuugaaacuugguguguaacucuaaaucuuguauaugcau

SEQ ID NO: 470724 - RNA, 60 nt, Human; identical to SEQ ID NO: 470715

SEQ ID NO: 470725 - RNA, 60 nt, Human
acuggcaucuguuaucuaguaugcauuucugguguguaucugaaaggaagacauuuucua

SEQ ID NO: 470726 - RNA, 64 nt, Human
ggguguccugacccucagcuggcccugcccagccacccuggacgugaccguaucccucugccac

SEQ ID NO: 470727 - RNA, 64 nt, Human
gucuccacaguagccucccugcccgggucccagcacccuggaugcccgucucugucccaggcgg

SEQ ID NO: 470728 - RNA, 64 nt, Human
ccagccauuaccauggagacaagaaggguuuuccacccuggaaucaagaugucagacuggcugg

SEQ ID NO: 470729 - RNA, 64 nt, Human
cacauuaccugcucccaucaccauccagcccagcacccuggacuucagucgccuggcccaaccc

SEQ ID NO: 470730 - RNA, 64 nt, Human; identical to SEQ ID NO: 72926

SEQ ID NO: 470731 - RNA, 64 nt, Human; identical to SEQ ID NO: 72932

SEQ ID NO: 470732 - RNA, 64 nt, Human; identical to SEQ ID NO: 72933

SEQ ID NO: 470733 - RNA, 64 nt, Human
ucccacucaccagcccuagcugucccauggggaaacccuggagccaucccuucggagccaacaa

SEQ ID NO: 470734 - RNA, 64 nt, Human
caaccucccaucccccugccaagauccuugaaggacccuggaaggagggagagcaggcagcccu

SEQ ID NO: 470735 - RNA, 64 nt, Human
ggugaagcagggggucuuuauauucccugcagaaacccuggaucccacuccacugaggaaaauc

SEQ ID NO: 470736 - RNA, 64 nt, Human
gacucaggggguaguucuuuacucucccuuuacuacccuggagggacagcucugcccuugaggc

SEQ ID NO: 470737 - RNA, 64 nt, Human
agaugggagggaggagccaaccuugcugccugcgacccuggaggacagccugacucccuggacc

SEQ ID NO: 470738 - RNA, 64 nt, Human
ccugacauuauggaccucagaccugagaaccuggacccuggaaucagcauggaugagaccagag

SEQ ID NO: 470739 - RNA, 64 nt, Human
gcuaugauuaggacaacccucacuucacucauggacccuggagccagccacugaccccgccugg

SEQ ID NO: 470740 - RNA, 64 nt, Human
gggugagaaaagcaaaaaacaaacaaaaaacaaaacccuggaguguuaggaggagagugaaggu

SEQ ID NO: 470741 - RNA, 64 nt, Human
ugaaccugcaucauuccccgacacugccaagccaacccuggaaaaggaguucgcuggccauugg

SEQ ID NO: 470742 - RNA, 64 nt, Human
cuacuugggaggcugaggcaggagaauugcuugaacccuggaggcagaaguugcagugagccga

SEQ ID NO: 470743 - RNA, 64 nt, Human
ugagagcaagaagagacauggcauguucucugggacccuggaauccuagguacccacaugugug

SEQ ID NO: 470744 - RNA, 64 nt, Human
cugagccacccagaucugaauaaaacagaugcuuacccuggaagagcaaaugccuccuguuguc

SEQ ID NO: 470745 - RNA, 64 nt, Human
cuauucuggagguggagacaggagaauugcuugaacccuggaggcggagguugcagugagccaa

SEQ ID NO: 470746 - RNA, 64 nt, Human
gacccugacacugcacgugggcguaguggggagcacccuggaguggagaugauugucagcgggc

SEQ ID NO: 470747 - RNA, 64 nt, Human
agaccggaggcaguagcugcaaagcccuuggaacacccuggaugcuguugagggccaagagauc

SEQ ID NO: 470748 - RNA, 64 nt, Human
cuggggcaugugugccuguggcagaaaagaggagacccuggaauucagcacccugggugccauu

SEQ ID NO: 470749 - RNA, 64 nt, Human; identical to SEQ ID NO: 72763

SEQ ID NO: 470750 - RNA, 64 nt, Human; identical to SEQ ID NO: 72764

SEQ ID NO: 470751 - RNA, 64 nt, Human; identical to SEQ ID NO: 72765

SEQ ID NO: 470752 - RNA, 64 nt, Human
agcuggaaggcagggcagagggaauguucccugcacccuggaaaggggaguugagucacaagag

SEQ ID NO: 470753 - RNA, 64 nt, Human
ggcccuucugacuguuuauuuaaggauggauggcacccuggaaccgggaaggguggccuguucc

SEQ ID NO: 470754 - RNA, 64 nt, Human
aaaauuauagauguuuguuguaaaauuuuggaaaacccuggaaauuauagagaaaauaaacaua

SEQ ID NO: 470755 - RNA, 64 nt, Human
gggguccugaguggcuuccaggagagcgggaugaacccuggaccuggaguaggagacccggaug

SEQ ID NO: 470756 - RNA, 64 nt, Human
ucaggcccucgcccugccgccaucuaugccaguuacccuggagaggacuccugccguguccuga

SEQ ID NO: 470757 - RNA, 64 nt, Human
caucaaaaacaggcugaucaccaaagucagugucacccuggaugcccagcagcccuguccugug

SEQ ID NO: 470758 - RNA, 64 nt, Human
auggaaacgcaaaugaguauuucggagcaugaagacccuggaguucaaaaaacucuugauauga

SEQ ID NO: 470759 - RNA, 64 nt, Human
aacagccuaggucuaacugcagaguagaagcuggacccuggaguuaccaacacuccuccccaac

SEQ ID NO: 470760 - RNA, 64 nt, Human
gguucccugauauaaaucauucauaagacuuccuacccuggaaaaugaguaaugucucauucuu

SEQ ID NO: 470761 - RNA, 64 nt, Human
cccguuccacccucacccuuuuccuuucccaugaacccuggagggugguccccaccagcucuuu

SEQ ID NO: 470762 - RNA, 64 nt, Human
ccaugcucacuuccuuccccagcucaccuggaacacccuggauacacuggagugggaaaaugcu

SEQ ID NO: 470763 - RNA, 64 nt, Human
agccugcccacgauuccuaggaaggcuggcagacacccuggaacccuggggagcuacuggcaaa

SEQ ID NO: 470764 - RNA, 64 nt, Human
uccuaauucccagacuguucugggcacggaagggacccuggauguggagucuuccccuuuggcc

SEQ ID NO: 470765 - RNA, 64 nt, Human
aaaacaaaacaaaaaaacacuaggaguccacucaacccuggaggucuuugcuaauuggaauuau

SEQ ID NO: 470766 - RNA, 64 nt, Human
auaagccagcauaacguguaaagcucacucuuucacccuggaacagacaagaggugggcuuaau

SEQ ID NO: 470767 - RNA, 64 nt, Human
cccaccuguaaaggauggaaacccagaagacguaacccuggaaugcaaggucugcacccauuuc

SEQ ID NO: 470768 - RNA, 64 nt, Human; identical to SEQ ID NO: 72934

SEQ ID NO: 470769 - RNA, 64 nt, Human; identical to SEQ ID NO: 72935

SEQ ID NO: 470770 - RNA, 64 nt, Human; identical to SEQ ID NO: 72936

SEQ ID NO: 470771 - RNA, 64 nt, Human
acacugugcacggaaaagacaagagccuucaacgacccuggacagugacgaggacucucccuug

SEQ ID NO: 470772 - RNA, 64 nt, Human
aacaacuuuucccucacuguuccccaaaacaugcacccuggacuucucuaauagaaaagucucc

SEQ ID NO: 470773 - RNA, 64 nt, Human
acagaaagccacuguuagaucugcagaaggggacacccuggaaggucaacaucucauuuuaugg

SEQ ID NO: 470774 - RNA, 64 nt, Human
cacccaacagugaugaugcauggaggaccgccccacccuggaaugccaaugucagcaucaagcc

SEQ ID NO: 470775 - RNA, 64 nt, Human
cuauaggagacugggcaaaaccuguacaaugacaacccuggaaguugcuuuuuuuaaaaaaaua

SEQ ID NO: 470776 - RNA, 64 nt, Human
cuacuugggaggcugaggcgcgagaaucgcuugaacccuggagauggagguugcagugagcaga

SEQ ID NO: 470777 - RNA, 64 nt, Human
gcucaucauggacaugagaccagugugaagacucacccuggaagagaauauucuccccaaacug

SEQ ID NO: 470778 - RNA, 64 nt, Human
auuggccaagaagagcccacggcggcugcucaagacccuggagcuguacuuggccaggguguca

SEQ ID NO: 470779 - RNA, 64 nt, Human
ccuauuucaaccucugguuccugggaugagccauacccuggaacuggcccacccacugugucuu

SEQ ID NO: 470780 - RNA, 64 nt, Human
cuaugccuugucuggggacccuguagagucacugacccuggagcggcucuccugagaggugcug

SEQ ID NO: 470781 - RNA, 64 nt, Human
ccuggagaagucgucaggaaccagacuacaguggacccuggagaaccuugaagaacauuuuucc

SEQ ID NO: 470782 - RNA, 64 nt, Human
ugggcgggguggggccuccagagcuuugcagggaacccuggaacccuaggaacaaggagccuuu

SEQ ID NO: 470783 - RNA, 64 nt, Human
aaaaaaugaagaaauuaaugcuuaauagggugguacccuggaaaggaucugggaagugguagaa

SEQ ID NO: 470784 - RNA, 64 nt, Human
gugagccccgugcgagggcccugcuuguagcuggacccuggaaccuucuguagcuaagagggaa

SEQ ID NO: 470785 - RNA, 64 nt, Human
cuccaucguuuccaccuugcagugaugcagcuugacccuggaacggucagacaaccuccucaaa

SEQ ID NO: 470786 - RNA, 64 nt, Human
cuggguggcuuaugagagaguagagaacaacaugacccuggauggcuacuaagaggauagagaa

SEQ ID NO: 470787 - RNA, 64 nt, Human; identical to SEQ ID NO: 72937

SEQ ID NO: 470788 - RNA, 64 nt, Human; identical to SEQ ID NO: 72938

SEQ ID NO: 470789 - RNA, 64 nt, Human; identical to SEQ ID NO: 72939

SEQ ID NO: 470790 - RNA, 64 nt, Human
cugcaagcacagggcuaaggagggauagaguaggacccuggaccacauucggaaggggaacuua

SEQ ID NO: 470791 - RNA, 64 nt, Human
cugcagaaccagucccucugagugaaguccagugacccuggagcuagggucccccuucguggag

SEQ ID NO: 470792 - RNA, 64 nt, Human
gauuuagaagcccaaaguuuagggucaaauguaaacccuggaaccugagucccaagaaauggua

SEQ ID NO: 470793 - RNA, 64 nt, Human
acucaucaugggcaugagaccagugugaggacucacccuggaagagaauauucgcuuaauuccc

SEQ ID NO: 470794 - RNA, 64 nt, Human
uauagaccuaaaauaaaaugaaguggugagcuuaacccuggaaaaugaaucccucuaucucuaa

SEQ ID NO: 470795 - RNA, 64 nt, Human
acgauguggaaaaaugagagaagggacacauucaacccuggagaguucaauggcugcugaagcu

SEQ ID NO: 470796 - RNA, 64 nt, Human
accacucuccugccuccagagaaagcucugcuucacccuggaagcugguaccuuuaccuccucc

SEQ ID NO: 470797 - RNA, 64 nt, Human
ugauagacuauuacuaaugucaauauugaacacuacccuggaauuccugccugguuuuccuacc

SEQ ID NO: 470798 - RNA, 64 nt, Human
ccacugcuucugcuuuaagccagaggcaccuggaacccuggacuucacugggagggccaacuug

SEQ ID NO: 470799 - RNA, 64 nt, Human
uuuaacagcuuucuccagaaccagugucugaaccacccuggaaauucugccuuauuauuucuua

SEQ ID NO: 470800 - RNA, 64 nt, Human
agaccgcagaauuuucacagcaggggcucuuggaacccuggaaacccccuucuuaaauuuggga

SEQ ID NO: 470801 - RNA, 64 nt, Human
ggggcggucucagaaaugcagguucccaggucccacccuggacuucugaagggguguggcaucu

SEQ ID NO: 470802 - RNA, 56 nt, Human
cccagcucagcaucagcuaaaccacaacccuggaagaggcggccuaaggagauucc

SEQ ID NO: 470803 - RNA, 64 nt, Human
ggggucaaaucagcuccuucucuccaagugcacuacccuggagagugguggccacucaauaccu

SEQ ID NO: 470804 - RNA, 64 nt, Human
acuccaaaacucaaccaucaccuucuggaauaucacccuggaggaugaaggguguuacaugugu

SEQ ID NO: 470805 - RNA, 64 nt, Human
gcaaagcucuuucuuauuuuccucauaaucagcuacccuggaggggagggagaacucauuuuac

SEQ ID NO: 470806 - RNA, 64 nt, Human; identical to SEQ ID NO: 72940

SEQ ID NO: 470807 - RNA, 64 nt, Human; identical to SEQ ID NO: 72941

SEQ ID NO: 470808 - RNA, 64 nt, Human; identical to SEQ ID NO: 72942

SEQ ID NO: 470809 - RNA, 64 nt, Human
uggcagcugucuucaaggguaggcugagcuccccacccuggagccccugagggcggccccugag

SEQ ID NO: 470810 - RNA, 64 nt, Human
ucccuggugcacugaccuaucugggauaggcaguacccuggaggggggccuggggcagaggagg

SEQ ID NO: 470811 - RNA, 64 nt, Human
aguagcuguaugagcagagcaguucaagggccaaacccuggaacgguagcaaugggauauaaua

SEQ ID NO: 470812 - RNA, 64 nt, Human
cacagcucagcccaccccaucuguacuggaagggacccuggagcccugggaccacccccuuuca

SEQ ID NO: 470813 - RNA, 64 nt, Human
ugagccugagagagggggucacagugauagggccacccuggaugggaagaccuggagggcagcc

SEQ ID NO: 470814 - RNA, 64 nt, Human
caucuucaagagagauggaauuaaugauggauggacccuggagggaaucuccccagccgacuuc

SEQ ID NO: 470815 - RNA, 64 nt, Human
cagcaaggggagugcuggccugacacaucagaagacccuggacuugucauuauuugucuggggg

SEQ ID NO: 470816 - RNA, 64 nt, Human
guacggggcaaucugcccacccucacccagucgcacccuggaggggacaucagccccagcugga

SEQ ID NO: 470817 - RNA, 64 nt, Human
acaagacccacuccuguuucuggcgguaccagcuacccuggaaugguggcguguccugcuguac

SEQ ID NO: 470818 - RNA, 64 nt, Human
aucgauaugaaaaauaaauaaauaaaacuaaggaacccuggaaacuaccagugggcauguauua

SEQ ID NO: 470819 - RNA, 64 nt, Human
ccaaggaugggucaucuaagugcuguccauaugaacccuggacuuucuguccuuagauccucac

SEQ ID NO: 470820 - RNA, 64 nt, Human
caggaaucacuguuuuccuugaccagggucucacacccuggaggaauguuaaguaagagaaaga

SEQ ID NO: 470821 - RNA, 64 nt, Human
uuaagagauauucauuggcagcucaaagacuuccacccuggagaccacacugcacacagugacu

SEQ ID NO: 470822 - RNA, 64 nt, Human
ccauccucuaaccuagguggcauacagacuggggacccuggacaugcgggccuuucuccgcaac

SEQ ID NO: 470823 - RNA, 64 nt, Human
uuaaugaacaugagaaaauuuauacuguagagaaacccuggaaaugugaagaacguggcaaagu

SEQ ID NO: 470824 - RNA, 64 nt, Human
aggaaauaaggggccugcuccucucccuacugugacccuggaggcucuuaagaugaugaugguu

SEQ ID NO: 470825 - RNA, 62 nt, Human
gcuugcuuuguugcacgccugggcaauuucagccaggacauuaggaccacuuguuguacauc

SEQ ID NO: 470826 - RNA, 62 nt, Human
agcaacuaccccaagacauaccaacagugaagccaggacagcaccaugccaucggcgcucca

SEQ ID NO: 470827 - RNA, 62 nt, Human
agcaaagccucgcuaaccccauuacaacagcuccaggacaucucagcccagguucuagcccc

SEQ ID NO: 470828 - RNA, 64 nt, Human
auggauucuggucaacugguggagauuggcugacacccuggagaagccgaaaccagagagccuu

SEQ ID NO: 470829 - RNA, 64 nt, Human
ggcuuaaugaccaccacagggagcucagaccccaacccuggaucccaggagaaaggaguggacc

SEQ ID NO: 470830 - RNA, 64 nt, Human
cuagguugucuucacccauguauuuugcgaugucacccuggagaauguccaccuuguguucaga

SEQ ID NO: 470831 - RNA, 64 nt, Human
caggcuggcugcucugggcagcgccuucacucugacccuggagaaccauuucauuucauccugg

SEQ ID NO: 470832 - RNA, 64 nt, Human
accuauguaacaaaccugcacauccugcacauguacccuggaacuuaauaaaaguuggaaauuu

SEQ ID NO: 470833 - RNA, 64 nt, Human
uacuuucuuuucuuuauuuuacaaagcuuuaaaaacccuggaaacaacuuacuucuugcuugug

SEQ ID NO: 470834 - RNA, 64 nt, Human
cagaggcucauaggggacagccccugccaaggagacccuggaggggcucugaggauagcaauca

SEQ ID NO: 470835 - RNA, 64 nt, Human
gcuuuguuuugguguuucuacagggacaauacagacccuggagugugugugugugugugugugu

SEQ ID NO: 470836 - RNA, 64 nt, Human
uuccuuggguccuuguguuccuugccccuguccaacccuggacaguuggcucuaccucaguaac

SEQ ID NO: 470837 - RNA, 64 nt, Human
cgccagccugaagcugccaggcccugagguucagacccuggaccccauagcuggaggccugugg

SEQ ID NO: 470838 - RNA, 64 nt, Human
agggucccaggagaggggcauuucuagagcagugacccuggaaaaccaggaacaauugacuccc

SEQ ID NO: 470839 - RNA, 64 nt, Human
cucauccuacucaauuuuucaaaggcagaaaccaacccuggagcaauugagaggacuguuuaaa

SEQ ID NO: 470840 - RNA, 64 nt, Human
cagcaggcagggcacccaggccuuauaggaauucacccuggaccaugcccuaaaauaaccucac

SEQ ID NO: 470841 - RNA, 61 nt, Human
caggaggucuuuucauguaacugccucaaggacccuggacucugcucacccccccaccacu

SEQ ID NO: 470842 - RNA, 64 nt, Human
gcggaaacgggaucauucaaccuauacaaaggggacccuggauaggcugcaaggaaagaggcca

SEQ ID NO: 470843 - RNA, 64 nt, Human
gugcugcaaucacacauccauucugcccugggggacccuggagccuacuugugcgcuuugcauu

SEQ ID NO: 470844 - RNA, 62 nt, Human
cuggaacuggauaauaaaaaucagacugaaagccaggacaucugaguaccuaucucacacac

SEQ ID NO: 470845 - RNA, 62 nt, Human
gcuuucagaaucuuuuaggaaauaaauccucuccaggacaaaaaugaacaugaauggagugg

SEQ ID NO: 470846 - RNA, 62 nt, Human
agaagcagcgaaagcagaucugagugucugacccaggacagcugugguuugucacucugaaa

SEQ ID NO: 470847 - RNA, 64 nt, Human
cugcccauccugcaccuguccaccccaccccaacacccuggaagccacugucaaugauuagauc

SEQ ID NO: 470848 - RNA, 64 nt, Human
uaccucuccacacuuccccagaagggaaaagggcacccuggauuacucuuuggaaaucacuccu

SEQ ID NO: 470849 - RNA, 64 nt, Human
cuacucaggaggcugaggcaggagaaucacuugaacccuggagguggagguugcagugagccga

SEQ ID NO: 470850 - RNA, 64 nt, Human
uauaugcuauucagauuucaaaucuuuccaauuuacccuggaaucaguuuugagggagcugaua

SEQ ID NO: 470851 - RNA, 64 nt, Human
agaagcacuagugcugccauuaaugaauuguuuaacccuggauaagucacuuaaacucaucuau

SEQ ID NO: 470852 - RNA, 64 nt, Human
aacauuggugcucauuugucacugaacugaagccacccuggagcccuuaaugguuacagaaauu

SEQ ID NO: 470853 - RNA, 64 nt, Human
aggaagaaaagaaggaguggaggaagacucuggaacccuggaagcuguaugccacagugggccu

SEQ ID NO: 470854 - RNA, 64 nt, Human
cccaccuccugcugguuucccgagggaacuucugacccuggaguccaugagggcuccuuuccuu

SEQ ID NO: 470855 - RNA, 64 nt, Human
agagacuacucugccugaacacugcuucuccuggacccuggaagcagggacugguugagggagu

SEQ ID NO: 470856 - RNA, 64 nt, Human
aaaguuguauucucauaugacuaaguucacuaaaacccuggauugaaagugaaaauuauguucc

SEQ ID NO: 470857 - RNA, 64 nt, Human
cgccccguggugucacccucagccggcgccgggcacccuggacagugcggugggcgauggccca

SEQ ID NO: 470858 - RNA, 64 nt, Human
aaucugggagagaaggugacacagcugggcccagacccuggagagacagcucugcaguuuccca

SEQ ID NO: 470859 - RNA, 64 nt, Human
agacgugacucugguggacgcagagcacuuaguuacccuggacgcuccccacauccuuccagaa

SEQ ID NO: 470860 - RNA, 64 nt, Human
gcagccccacucccucaggguccagccaugccccacccuggacugaaguucugcaaaguccucc

SEQ ID NO: 470861 - RNA, 64 nt, Human
cccucaggcauucagcugcccacaaguuuccugcacccuggaaaagccccccacccuuccucug

SEQ ID NO: 470862 - RNA, 64 nt, Human
cuacucaggaggcugaggcagaagaaucgcuugaacccuggaggcggagguugccgugagccaa

SEQ ID NO: 470863 - RNA, 62 nt, Human
gggccaggaucgugccacugcacuuuauuuagccaggacaacacucugucuccaaaaaaaag

SEQ ID NO: 470864 - RNA, 62 nt, Human
ggcuggggacucuggcacagugaugccgggcgccaggacagcagcacucccgcugcacacag

SEQ ID NO: 470865 - RNA, 62 nt, Human
gauaggguagcgauauaaauuuaucauauaaaccaggacaucucggaauaaaaggggcucug

SEQ ID NO: 470866 - RNA, 64 nt, Human
gucguggcugcucuggcugaggcuggcgcgcuccacccuggacucuggacuucgcagguuccug

SEQ ID NO: 470867 - RNA, 64 nt, Human
aaaaaccaaacaccauaucugaugugugaaaauaauggaggaaaaccucuuguguauauucuua

SEQ ID NO: 470868 - RNA, 64 nt, Human
guagcccaagcccuauucugcacuguucaguuuuauggaggaaaaauaaaucuaccauaggaau

SEQ ID NO: 470869 - RNA, 64 nt, Human
cugcaagacgcccauccggaacagggccuucuacauggaggagggcgugcccuauugcgagcga

SEQ ID NO: 470870 - RNA, 64 nt, Human
guagugcuuuuguuaaagccccuauaugggcagcauggaggaucauaagauagcaaaaccauuu

SEQ ID NO: 470871 - RNA, 64 nt, Human
ugguuucaugauaucuugagacgccuuacaaaugauggaggauuccaaagaguuuuuguuuauu

SEQ ID NO: 470872 - RNA, 64 nt, Human
ggccuagauccacacacagaggaagagcaggcacauggaggagcuugggggaugacuagaggca

SEQ ID NO: 470873 - RNA, 64 nt, Human
auuuaugaaggcaaaaaaauuaaauuauuuauuuauggaggauggagagaggggaauaauagaa

SEQ ID NO: 470874 - RNA, 64 nt, Human
agugagggguagcuuuuuaaaaccauuauucuagauggaggaggcacugaugcuuguaacucug

SEQ ID NO: 470875 - RNA, 64 nt, Human
gcccaugauuacugaucaaaauacugguagagucauggaggaaguaaguuaaauguggaaaaaa

SEQ ID NO: 470876 - RNA, 64 nt, Human
agcagagcaggcaagggaaacuggggagauggggauggaggaggaaggcugauauccucugggg

SEQ ID NO: 470877 - RNA, 64 nt, Human
aauuuuugugucauuguauguaaguuuacuuuuuauggaggaaggauucuagauaaugacaaau

SEQ ID NO: 470878 - RNA, 64 nt, Human
aggccgcuucgcggguggagcccucugccuggccauggaggaaggaucccgcuaggcugguccc

SEQ ID NO: 470879 - RNA, 64 nt, Human
acuucggugacuucauccaccugucuauuugcacauggaggacuuuucaagaugucaggauacc

SEQ ID NO: 470880 - RNA, 62 nt, Human
gaggaagaauuccugccaugccccagccuucuccaggacaaccugcuggaacgcaguggugu

SEQ ID NO: 470881 - RNA, 62 nt, Human
gcaccccuccuauaccauaugucugcuucuguccaggacaugauacugaugccauguuuaga

SEQ ID NO: 470882 - RNA, 62 nt, Human
uaggggaaaggaucuacccuucuccuggcuccccaggacacucaguucuuucaaagaccagg

SEQ ID NO: 470883 - RNA, 58 nt, Human
ucaucuuucauuacauuuaaaucucuggacccuggagcacuucuaauguaucacccca

SEQ ID NO: 470884 - RNA, 64 nt, Human
cuacugagguggcugaggcacaagaauugcuuggacccuggagguagaggcugcagugagccaa

SEQ ID NO: 470885 - RNA, 64 nt, Human
ccgcccugguucauauuugaguuuaauuguacugacccuggacccagauaagcagcaacuuugu

SEQ ID NO: 470886 - RNA, 64 nt, Human
ucggaaaaagcggugccccuauacaaaacaccagacccuggaacuggagaaagaguuucuguuc

SEQ ID NO: 470887 - RNA, 64 nt, Human
cugucuggugggugauucucugcccugagccaccacccuggacuggcccagucuccagagcugg

SEQ ID NO: 470888 - RNA, 64 nt, Human
ucuguucguggucaaagguuugggggaauuugugacccuggaacauccccagagugaaagaugg

SEQ ID NO: 470889 - RNA, 64 nt, Human
cuacucuggaggcugaggcaggagaaucacuugaacccuggaggcagagguugcaaugagccga

SEQ ID NO: 470890 - RNA, 64 nt, Human
uuaauuauguuaguauagaaacuacagaauauuuacccuggaaagaaaauauuggaauguuauu

SEQ ID NO: 470891 - RNA, 64 nt, Human
uggguggaugugagcagaagacuauuuaccagggacccuggaguauuuggaagcaacguguuaa

SEQ ID NO: 470892 - RNA, 64 nt, Human
ccucuugagagcccccagugccggagcagaaaggacccuggacccagaggcagauacugcgggg

SEQ ID NO: 470893 - RNA, 64 nt, Human
ucagauggggucagucccgucgcuuugcagacugacccuggaaaucuacaaaaugcagauuuuc

SEQ ID NO: 470894 - RNA, 64 nt, Human
gaaauaauaauucaauuaagcaaccacgaauuucacccuggagauauuuuuucuuauuugaguc

SEQ ID NO: 470895 - RNA, 64 nt, Human
aggccccaugcggucccggcucugugcgggccgcacccuggacggccccauccggacgcugaag

SEQ ID NO: 470896 - RNA, 64 nt, Human
gagggaaauauggauuuucacaccuugccuggccacccuggaaaaacaagccaaggaggauuuc

SEQ ID NO: 470897 - RNA, 64 nt, Human
cacaggcuuuggggaagcccuggagccugugaagacccuggaaaccucaugaggcuguggccaa

SEQ ID NO: 470898 - RNA, 64 nt, Human
cccugcccuggccacuggcccuguuucuccccacacccuggaguggcaugguccugugccccga

SEQ ID NO: 470899 - RNA, 62 nt, Human
uguguuugcaugcuggaugcuauacuguccagccaggacacaagacuucugauuucuacccu

SEQ ID NO: 470900 - RNA, 60 nt, Human
uacagcaauaugacugcuaaaagaaccaacccaggacagagccacaaucuuccucuauuu

SEQ ID NO: 470901 - RNA, 62 nt, Human
uucccccaggaacuccauguaacagaacagacccaggacagggaaaagcagugcggagggau

SEQ ID NO: 470902 - RNA, 64 nt, Human
gcucgagcaugcccugagcucucugaaaguugucacccuggaauaggguccugcaggguagaau

SEQ ID NO: 470903 - RNA, 64 nt, Human
gcucgagcaugcccugagcucucugaaaguugucacccuggaauacgauccugcaggguagacu

SEQ ID NO: 470904 - RNA, 64 nt, Human
agccaucuucauucguggagacuguggcccugcaacccuggagaaggacuugcugguacuuaaa

SEQ ID NO: 470905 - RNA, 50 nt, Human
uccgagagacuguccugugaacccuggaagacagaaggccacuccaaggg

SEQ ID NO: 470906 - RNA, 64 nt, Human
cuacucaggaggcugaggcaggaggauugcuugaacccuggaggcggagauugaagugagcuga

SEQ ID NO: 470907 - RNA, 64 nt, Human
cuuccuggcagaugaccuaggggggcucugacagacccuggacccagggccucaccugccacuc

SEQ ID NO: 470908 - RNA, 64 nt, Human
ucuccuccuagccugggggaccaggcucgaacugacccuggacaucaaaggagggauuaugugg

SEQ ID NO: 470909 - RNA, 64 nt, Human
gugagaaguuaaguuuccuguaagugggccucucacccuggaaaggaguugagggacaucagau

SEQ ID NO: 470910 - RNA, 64 nt, Human
gcggccccaggaccaucaccaggaaugcgaggccacccuggaccagagguaggagcccaagguc

SEQ ID NO: 470911 - RNA, 64 nt, Human
cuuauggacucgcaggauuuuagaacccuaaugcacccuggaggguagcugggccagacuucuc

SEQ ID NO: 470912 - RNA, 64 nt, Human
cauggcugagagggugugggugcccuguugaccuacccuggaccgaguggaccacgaccucguc

SEQ ID NO: 470913 - RNA, 64 nt, Human
acccuggggccugugucagccgccggcccuccgcacccuggaagcacacggccucugggaagga

SEQ ID NO: 470914 - RNA, 64 nt, Human
gccauucguucgugagugucccgugcacguccugacccuggacagugaaggcuucucccucccc

SEQ ID NO: 470915 - RNA, 64 nt, Human
aaugggggcaaggcuggggcaucccagcccacacacccuggaugcccagcaaggccacagaaag

SEQ ID NO: 470916 - RNA, 64 nt, Human
cagccagcucccgagcacagccgcacuccuguugacccuggaucccacccuuugagccugaccc

SEQ ID NO: 470917 - RNA, 64 nt, Human
agcaggacuguccccuugaaggagaaucaucaggacccuggaccugauacggcuccccaguaca

SEQ ID NO: 470918 - RNA, 62 nt, Human
auuucacauuuuaccccaacugaccugcaugcccaggacacaaguaaaacauuugugagaua

SEQ ID NO: 470919 - RNA, 62 nt, Human
ccgacucagcccucugacagcuacccaacaguccaggacagcugcauggcacccggcgggcc

SEQ ID NO: 470920 - RNA, 62 nt, Human
ucucugccagcagggggcugagcagagcccauccaggacacuccacacugccaggacacacc

SEQ ID NO: 470921 - RNA, 60 nt, Human
acauggcaccccagcaguaggacacccaggacccuggauguugccugcccugcaacucag

SEQ ID NO: 470922 - RNA, 64 nt, Human
ccgcagggaggcagggauggcaaggcgugaagccacccuggaaggaacuggaccaaggucuuca

SEQ ID NO: 470923 - RNA, 64 nt, Human
uuuaguccuuuaaaaugaguagaagcaaccuguuacccuggaaagagcacuggacauagaccua

SEQ ID NO: 470924 - RNA, 64 nt, Human
ucacaaauguagaccuccaugaacucauuggaugacccuggacagagcggggcuauucccauuu

SEQ ID NO: 470925 - RNA, 64 nt, Human
gcagcuuuaccuuugucauuucauccucauggccacccuggagguggcauuguguaaccucauc

SEQ ID NO: 470926 - RNA, 64 nt, Human
uuagauaacaccuagugauuaauuggcugagaaaacccuggaguggagggaggcucagagauac

SEQ ID NO: 470927 - RNA, 64 nt, Human
cugggcccuaggccauggagaaaaccuuaaacaaacccuggagacagggagccccuucuuucuc

SEQ ID NO: 470928 - RNA, 64 nt, Human
aacagagcccagugaaauggcagucagaauguuaacccuggauccaucucuaaguagagagagg

SEQ ID NO: 470929 - RNA, 64 nt, Human
aguuuuucuaucaauuuucccccaucccauccccacccuggacucauuugagaagacuugagaa

SEQ ID NO: 470930 - RNA, 64 nt, Human
cuuguggagcgcaggggccuggggagcagcgcuaacccuggaggcagccuuugggugauggcuu

SEQ ID NO: 470931 - RNA, 64 nt, Human
uucucacaggucccaaauggcccugggucccaggacccuggacccagccagaacuugugcccuc

SEQ ID NO: 470932 - RNA, 64 nt, Human
cugcguauuaaucagccauuuuugugagaguuugacccuggaaagggugcuuuguauauguucu

SEQ ID NO: 470933 - RNA, 64 nt, Human
auucgaaucugggcucuuucacauacuagcugugacccuggacaaagagcuuuaaccugcugag

SEQ ID NO: 470934 - RNA, 64 nt, Human
cuuuacagucaagaagacuuggguucauauccuaacccuggaacuuacuagcauuauaaugcuu

SEQ ID NO: 470935 - RNA, 57 nt, Human
agaaggaccgaaccaagugagccugccacccuggagugagccccaggccaggaggcu

SEQ ID NO: 470936 - RNA, 64 nt, Human
cuccaaauuaagugggaauuagauccucuggggaacccuggagcuuggugagagugacgcugcc

SEQ ID NO: 470937 - RNA, 62 nt, Human
agccugauguaggacuuggaaaacacaucaauccaggacaaaagugacgcuaaaauaccuua

SEQ ID NO: 470938 - RNA, 62 nt, Human
agaggccagcccacaaccuaugacccccucccccaggacaccaccucccacccacagaccuu

SEQ ID NO: 470939 - RNA, 62 nt, Human
ccauugcuugggaaggcugggaggccucccauccaggacacugggggcaggagugucaucuu

SEQ ID NO: 470940 - RNA, 64 nt, Human
guggaaaaaacuaacuuauaauuuuguaucacacacccuggauauguguucuguuucuaagcga

SEQ ID NO: 470941 - RNA, 64 nt, Human
cuacucaggaggcugaggcaggagaaugcugugaacccuggaggcagagcuugcagugagccga

SEQ ID NO: 470942 - RNA, 64 nt, Human
cgacucuuccuacguaaacucccaccccugacuuacccuggaggaggggugaccgccaccugau

SEQ ID NO: 470943 - RNA, 64 nt, Human
acuuccccuuauuuugacccaucacagguuuuugacccuggaugucagaguugaucuaagacgu

SEQ ID NO: 470944 - RNA, 64 nt, Human
ccacccagcaaggggcagaggccacaggccuggaacccuggaagggagggaggcccaugggagg

SEQ ID NO: 470945 - RNA, 64 nt, Human
ugcuauuaaaaacuacauggggaaacaggugcaaacccuggagauggauuguaagagccaguuu

SEQ ID NO: 470946 - RNA, 64 nt, Human
uuagguguugagauggggcagcucugaauccuagacccuggaauagccugucccuuuucucugg

SEQ ID NO: 470947 - RNA, 64 nt, Human
ccacacugcaagaggggaccccuccacccccaguacccuggacccccuccgcagagucucggca

SEQ ID NO: 470948 - RNA, 64 nt, Human
uauuuuagagccagggggagcugggccuggucucacccuggaggcaccugguggccaugcuccu

SEQ ID NO: 470949 - RNA, 64 nt, Human
cacccuuucuggugucuauaggaaugcaugagagacccuggacguuuuucugcucucuucuggc

SEQ ID NO: 470950 - RNA, 64 nt, Human
uauaaggaauuaagucuccgauuauuaggugaucacccuggaugaucaguuuucugcugaaggc

SEQ ID NO: 470951 - RNA, 64 nt, Human
aguaaacuauuuaucuguguuuuugaaauauuaaacccuggaucaguccuuugaucaguauaau

SEQ ID NO: 470952 - RNA, 64 nt, Human
cuccccacccauagaccuucagaucaucucccacacccuggaucucacucuccucuuaguaaca

SEQ ID NO: 470953 - RNA, 61 nt, Human
agagcgccaugggggugugagcaccacaggcacccuggauggcccggccccggggcccgua

SEQ ID NO: 470954 - RNA, 64 nt, Human
agaccaccuaagaugccacuuugaauucucuaagacccuggagaauugcauuucuuucacugug

SEQ ID NO: 470955 - RNA, 64 nt, Human
cauuaaguaguggggggacaguccaugccaggacacccuggaguagccuucccccuuggccgug

SEQ ID NO: 470956 - RNA, 62 nt, Human
agaugacauuugcuuugggcagaggcagcuagccaggacacauuuccacuauaauuuuacaa

SEQ ID NO: 470957 - RNA, 62 nt, Human
aaauguuugaauucugcuccucucucaucaauccaggacaguauuugaagugugagggcuuu

SEQ ID NO: 470958 - RNA, 62 nt, Human
uaaaugacacccuuggaucugaacaauacacaccaggacaauugugugcaacaguucuacaa

SEQ ID NO: 470959 - RNA, 64 nt, Human
gggaaacuugggcccugccaaggggcagagcuugacccuggaaauucugggccaucccccucca

SEQ ID NO: 470960 - RNA, 64 nt, Human
aucacuaagaaccagcuucucaaccaccauugggacccuggauccuccagggccgcucgcugcc

SEQ ID NO: 470961 - RNA, 64 nt, Human
gggugggggacaugugggcugaccaggaccucugacccuggagcuucuaccaaagacacagcug

SEQ ID NO: 470962 - RNA, 64 nt, Human
uucaauuuugccauacuuuuguucuuccuaccggacccuggaaugucuuuggauauugcuaaaa

SEQ ID NO: 470963 - RNA, 64 nt, Human
acaagacuugcuccuacuucuaugcugaaaauugacccuggauagaauacuauaagguuuugag

SEQ ID NO: 470964 - RNA, 64 nt, Human
caacauguaguugcccacgccgguuuuaauggauacccuggaacacugccucauugucuuguua

SEQ ID NO: 470965 - RNA, 64 nt, Human
auggauucacugaggggagacaaagggagccgagacccuggauggggcuuccagcucagaaccc

SEQ ID NO: 470966 - RNA, 64 nt, Human
ucaccauggauggucuuccuaguugccuggggaaacccuggaaugggcaucaggagaaagcaac

SEQ ID NO: 470967 - RNA, 64 nt, Human
gggccacgcucuugaggaagcccaggcucggaggacccuggaaaacagacgggucugagacuga

SEQ ID NO: 470968 - RNA, 64 nt, Human
aagugggugucaucuccuccgaccgaggcuucucacccuggagauggcaguuacuccuggccau

SEQ ID NO: 470969 - RNA, 64 nt, Human
gacggaggcagacguggucguucucaacgcgcccacccuggacguggauggcgccagugacucc

SEQ ID NO: 470970 - RNA, 64 nt, Human
aucacuaagaaccagcuucucaaccaccaucaggacccuggauccuccugggccgcugccuguu

SEQ ID NO: 470971 - RNA, 64 nt, Human
agugaugccagaagcccuggggggaagcccugcuacccuggaccuuacaccgggugugggaauc

SEQ ID NO: 470972 - RNA, 64 nt, Human
aggguuggccagacccagucacaggggcagugucacccuggaaaauacagugcccugccuucuu

SEQ ID NO: 470973 - RNA, 64 nt, Human
ggguccuggguccuagaccaggacuuccugugugacccuggacaaguacuaccuuccugggccu

SEQ ID NO: 470974 - RNA, 64 nt, Human
cacuuggaagccaccaggaacagaaggucuggccacccuggaaggagggcaggacaucaaagga

SEQ ID NO: 470975 - RNA, 64 nt, Human; identical to SEQ ID NO: 72879

SEQ ID NO: 470976 - RNA, 53 nt, Human; identical to SEQ ID NO: 72880

SEQ ID NO: 470977 - RNA, 64 nt, Human; identical to SEQ ID NO: 72881

SEQ ID NO: 470978 - RNA, 64 nt, Human
cacuuaacaaugaaaaaaguuuuuccuccacugaacccuggaaacaugguccaguuuugugugu

SEQ ID NO: 470979 - RNA, 64 nt, Human
gcagcucaagaacacaugugcagucacuggugucacccuggauaggcaagggauaacucuucua

SEQ ID NO: 470980 - RNA, 64 nt, Human
ugggaggauccguaagggauguccuaagagcugcacccuggagaugggguguaggaagaagugg

SEQ ID NO: 470981 - RNA, 64 nt, Human
gaaaggagcaugggcuugaugucagacagcugugacccuggacagggccccccccaccaucugu

SEQ ID NO: 470982 - RNA, 64 nt, Human
aagcaucuaaacugaacugagagcacagcgggcuacccuggacaaaguaaagguggaaacuagg

SEQ ID NO: 470983 - RNA, 55 nt, Human
ugcauaucaccaaaccaugacuuccacccuggagcuugaauccagcacccaccuc

SEQ ID NO: 470984 - RNA, 64 nt, Human
gccaccuugcaggacguuuuccccaaccucuuacacccuggaugucacuuuggaaaccaagccc

SEQ ID NO: 470985 - RNA, 64 nt, Human
ccccaaggagucccacggaauggggaaagcgggaacccuggaguucuugggaaucuuggagccu

SEQ ID NO: 470986 - RNA, 64 nt, Human
caugucccaccucccacuuuccaucauggccugaacccuggaggaagaggaaguccauucagau

SEQ ID NO: 470987 - RNA, 64 nt, Human
auggcagggacacuucucuugcagaccaagagggacccuggagcaccuuagacaaacuacccag

SEQ ID NO: 470988 - RNA, 64 nt, Human
guagagauagcccccacccaggggauggaggucuacccuggacacuaagccaagugugucagag

SEQ ID NO: 470989 - RNA, 64 nt, Human
cccaugugcuuuugccuguggaauggagacgcggacccuggauagugguucuaugacucugcga

SEQ ID NO: 470990 - RNA, 64 nt, Human
ucuacauccugugcuuuucuccuaguuucucuccacccuggaacauucgagagcaaaucaaaac

SEQ ID NO: 470991 - RNA, 64 nt, Human
cccccacgcucuccauccccggaaucuagucacaacccuggauccuuccucugcccuucuccug

SEQ ID NO: 470992 - RNA, 64 nt, Human
uuccuggacuggcuugccuccuccccaccuccccacccuggaaccccugagggccaaacagcag

SEQ ID NO: 470993 - RNA, 64 nt, Human
caaaguguugguccagagucccaucucuuccccaacccuggauaccaguagcuucccacccagu

SEQ ID NO: 470994 - RNA, 64 nt, Human; identical to SEQ ID NO: 72882

SEQ ID NO: 470995 - RNA, 64 nt, Human; identical to SEQ ID NO: 72883

SEQ ID NO: 470996 - RNA, 64 nt, Human; identical to SEQ ID NO: 72884

SEQ ID NO: 470997 - RNA, 64 nt, Human
uuuuggagagaaagacaaguuaugaguagcugcuacccuggaacggugggcagagagccuacua

SEQ ID NO: 470998 - RNA, 64 nt, Human
uguuuuuuauauuuuaagacuuuaaguagaauaaacccuggaaaaaagaucaagaguaaaaaua

SEQ ID NO: 470999 - RNA, 64 nt, Human
acugugaaguaauauggcccacacuuuauucaccacccuggagaaaaaaaaacccaggaauaug

SEQ ID NO: 471000 - RNA, 64 nt, Human
gaaagcugagaacuucggaaaaggcucaucugucacccuggagaagggaaacuguacuuuuccc

SEQ ID NO: 471001 - RNA, 64 nt, Human
gaguuuacacaugaaaaggugaacaucaucaaaaacccuggacacaguucccugagaacugccu

SEQ ID NO: 471002 - RNA, 64 nt, Human
cucuggguuuaggggcccccuccaucccucagcuacccuggaucuuugcccaccucuuccucag

SEQ ID NO: 471003 - RNA, 64 nt, Human
gaaugggcguacaguauauaccgugacauccugaacccuggauagaaagccugagcccauugga

SEQ ID NO: 471004 - RNA, 64 nt, Human
agguagaaguuagugacccugagaccaucuuaccacccuggaccugguccaaauacagacuuac

SEQ ID NO: 471005 - RNA, 64 nt, Human
cucugcuucuugccaggugggagggccuguccacacccuggauccccguaccacagugccagcc

SEQ ID NO: 471006 - RNA, 64 nt, Human
uucauaccccaggaccccuuccccagcagcagagacccuggagcacaggagaguagggaggagg

SEQ ID NO: 471007 - RNA, 64 nt, Human
uaaugaauuaaaacuagaaaacaaauugaugcaaacccuggaagucaguugauuacuauauacu

SEQ ID NO: 471008 - RNA, 64 nt, Human
cuuccaccccacugggcccaaccaugggcucaggacccuggaauuccguuuucugauuugcuuu

SEQ ID NO: 471009 - RNA, 64 nt, Human
gcagaaaaaauggcuucucaguuguuaaaaguauacccuggaccacccaucugaccaucuccuu

SEQ ID NO: 471010 - RNA, 64 nt, Human
caaggguuuggguagagguagaaagguuuaauuaacccuggagaucugcaaauggagggagggg

SEQ ID NO: 471011 - RNA, 64 nt, Human
uucaucugagauaaaaauauaaaaagaauuauggacccuggauggcaauuugcuugauagcauc

SEQ ID NO: 471012 - RNA, 64 nt, Human
ggagggaggaggaagggaagaccccaguggugggacccuggaccaggccauggaugaaggacaa

SEQ ID NO: 471013 - RNA, 64 nt, Human; identical to SEQ ID NO: 72886

SEQ ID NO: 471014 - RNA, 64 nt, Human; identical to SEQ ID NO: 72887

SEQ ID NO: 471015 - RNA, 64 nt, Human; identical to SEQ ID NO: 72888

SEQ ID NO: 471016 - RNA, 64 nt, Human
acucucagucuggccccugugcuccccuguguguacccuggaguuucuguguccaauuguuggc

SEQ ID NO: 471017 - RNA, 64 nt, Human
gugcaaauuuuuuuuauuauugcauuuuauuuugacccuggacugcugcuaugaacaauagaau

SEQ ID NO: 471018 - RNA, 64 nt, Human
ccccagguuuccuuuacaugagaucccauuucucacccuggacuaagacaaagauauuuagguu

SEQ ID NO: 471019 - RNA, 64 nt, Human
caggagucagagcagccacauugcuugccuucauacccuggagguggggaaguuaucccucuuc

SEQ ID NO: 471020 - RNA, 64 nt, Human
ggggcuuauccuggacaggcaccuccaggcgccuacccuggagcaccuggagcuuaucccggag

SEQ ID NO: 471021 - RNA, 64 nt, Human
guugaucucuuucuuuuuaaaaauauuugccaccacccuggagucuagaccaacacacaaagau

SEQ ID NO: 471022 - RNA, 64 nt, Human
auccuaaacauggaagaugauuuaaaaaugauucacccuggaauacaugcuuccaguugcuucu

SEQ ID NO: 471023 - RNA, 64 nt, Human
uuauggccacagagggauaggcacagucuccaccacccuggagccaagggucuuucacaucacc

SEQ ID NO: 471024 - RNA, 64 nt, Human
gucaucucaagcagccccuguccccagcccguccacccuggaguggucuucuucagccuguuuc

SEQ ID NO: 471025 - RNA, 64 nt, Human
accaggccuuggaugcccucuaguugagucagagacccuggaaacacacugagaucuccaauug

SEQ ID NO: 471026 - RNA, 64 nt, Human
aacacagccgauucaccugagcaggaccucugaaacccuggaccaguggucucacauggugcua

SEQ ID NO: 471027 - RNA, 64 nt, Human
cauggugcuaggaagaggagugggguggugucagacccuggaggccccaacccuguccucccga

SEQ ID NO: 471028 - RNA, 64 nt, Human
ccuuuccucagccccuuguucuucccuguccuccacccuggaccccagccggcugcuggagccc

SEQ ID NO: 471029 - RNA, 64 nt, Human
cuacucgggagguuuaggcaggagaaucgcuugaacccuggagguggagguggagguugcagug

SEQ ID NO: 471030 - RNA, 64 nt, Human
aagcccccuuccuugcucuggaccccuuagguauacccuggaagagcuggggugggggaggagg

SEQ ID NO: 471031 - RNA, 64 nt, Human
uuuucccuauuccucccacuaaguacaguuaacaacccuggauguuacauauaaaacaaacaaa

SEQ ID NO: 471032 - RNA, 64 nt, Human; identical to SEQ ID NO: 72889

SEQ ID NO: 471033 - RNA, 64 nt, Human; identical to SEQ ID NO: 72890

SEQ ID NO: 471034 - RNA, 64 nt, Human; identical to SEQ ID NO: 72891

SEQ ID NO: 471035 - RNA, 64 nt, Human
aggcucugcccccagugugagugugaccgguuguacccuggaguagugucugcccugagcugcc

SEQ ID NO: 471036 - RNA, 64 nt, Human
ugagcaucugggcugugcccuggcucugcuuuucacccuggacaaagucgcuguggacuucaau

SEQ ID NO: 471037 - RNA, 64 nt, Human
ccugaccccacuguuugaagaagaaaaggugcuuacccuggagaugcuacagagacacagugga

SEQ ID NO: 471038 - RNA, 64 nt, Human
ccagccaugaugaugcacggaggacccccuacccacccuggaaugacuaugucagcacagagcc

SEQ ID NO: 471039 - RNA, 64 nt, Human
ccuaauuugcaaaggugccauaugggcucacagcacccuggaggagaagggccucaaacugugc

SEQ ID NO: 471040 - RNA, 64 nt, Human
cuacucaggaggcugagacaggagaaucacuugaacccuggagguagaaguugcagugagccaa

SEQ ID NO: 471041 - RNA, 64 nt, Human
ugagaaguggcccugccuugggcauugcaccagaacccuggacccccgccucacgaggaggccc

SEQ ID NO: 471042 - RNA, 64 nt, Human
cugugggcaagccuaagggauccugccugccccuacccuggacuugccucugcacacccuccag

SEQ ID NO: 471043 - RNA, 64 nt, Human
cccacagaugagggaaucucgcugggaagcugacacccuggacaaagagggacugucggaaucu

SEQ ID NO: 471044 - RNA, 64 nt, Human
aaccuccuaccuguuggccagccuuccuuaaacuacccuggacaccgcugagccuauagguugc

SEQ ID NO: 471045 - RNA, 64 nt, Human
aagguccagccugagcuggauucgggacuccaacacccuggagugguuccgucagaccaugagg

SEQ ID NO: 471046 - RNA, 64 nt, Human
acauugaccacucaaaacucagaucaucucgcccacccuggagagugcagagcuaucuguagac

SEQ ID NO: 471047 - RNA, 64 nt, Human
ccagccgacuccaagcccgcagagggcagacgccacccuggacugcucucccugcccagcuggg

SEQ ID NO: 471048 - RNA, 64 nt, Human
uucugcagcagggcucagccucaggggcguuaagacccuggaugacaucaauaaagggacagga

SEQ ID NO: 471049 - RNA, 64 nt, Human
gcuccaaaaccagggagcagaccaugcccucccaacccuggaguugucagggagggccugccca

SEQ ID NO: 471050 - RNA, 64 nt, Human
cccuucuauccccaagaaccccuucccugcuugcacccuggagagaacagcuugacucccauca

SEQ ID NO: 471051 - RNA, 64 nt, Human; identical to SEQ ID NO: 72925

SEQ ID NO: 471052 - RNA, 64 nt, Human; identical to SEQ ID NO: 72927

SEQ ID NO: 471053 - RNA, 64 nt, Human; identical to SEQ ID NO: 72928

SEQ ID NO: 471054 - RNA, 64 nt, Human
ugaggauaaugguggcuccagcgacaggaggccaacccuggagaccaagaacagggcgccuggc

SEQ ID NO: 471055 - RNA, 64 nt, Human
uauucuggcuguacuaaugacaagcugagucaagacccuggagggucauaggcuuguaaaggcc

SEQ ID NO: 471056 - RNA, 64 nt, Human
uucauguuauuuucccugcccaagacuuuauuuaacccuggacuccguuuacacagacaaagug

SEQ ID NO: 471057 - RNA, 64 nt, Human
aggaacagccugucaccacacaauuacuuuuauaacccuggagaugaaaaucuccuuguccuca

SEQ ID NO: 471058 - RNA, 64 nt, Human
augagcugggcagggcagggguggguggagccugacccuggagggcacugagcuggaggccccu

SEQ ID NO: 471059 - RNA, 64 nt, Human
auacagcacauccacccaggucccgagcccucacacccuggacgggaagggacagcugcauucc

SEQ ID NO: 471060 - RNA, 64 nt, Human
ggggacccuccuucagccaguuugcuccuuggucacccuggaggcuucuggaugggacccuuga

SEQ ID NO: 471061 - RNA, 64 nt, Human
ucagcccuaaucugcccuuaggaguccaggcugcacccuggagaucccaaaccuagcccccuag

SEQ ID NO: 471062 - RNA, 64 nt, Human
gggagcaaccaccuuuguuuuuuaccuucugucuacccuggaaaugugugugggggugugucug

SEQ ID NO: 471063 - RNA, 64 nt, Human
uuucccuaggcuguuccgcguggguuaccuuaucacccuggagcacuugguauuccagaccccu

SEQ ID NO: 471064 - RNA, 64 nt, Human
aggcccuccuggugcaggcaggcgggucacagggacccuggaccggcacaagaaacugcuuucu

SEQ ID NO: 471065 - RNA, 64 nt, Human
aauaauuuauaauuuugaucgaguuucuuaaaagacccuggagaaagaguggcauuucuucugu

SEQ ID NO: 471066 - RNA, 64 nt, Human
ggccgggugacaccggggggcucccagcccgugcacccuggaagggcaggucuggcggcuccau

SEQ ID NO: 471067 - RNA, 64 nt, Human
gggcccuagaaauuccacagcucccguccuggccacccuggaagcucaucaggccaagacccgg

SEQ ID NO: 471068 - RNA, 64 nt, Human
agugggggugcuccugucuguccuuuucccccacacccuggacugugcuuggcuguuggugcac

SEQ ID NO: 471069 - RNA, 64 nt, Human
ucuauagugaacucugugggcgucucccaguauuacccuggaugauaggaauugacuccggcgu

SEQ ID NO: 471070 - RNA, 64 nt, Human; identical to SEQ ID NO: 72893

SEQ ID NO: 471071 - RNA, 64 nt, Human; identical to SEQ ID NO: 72894

SEQ ID NO: 471072 - RNA, 64 nt, Human; identical to SEQ ID NO: 72895

SEQ ID NO: 471073 - RNA, 64 nt, Human
gcaggugcgccuagagcggauccgccaggcugagacccuggagcaagugcgcagcaucauggau

SEQ ID NO: 471074 - RNA, 64 nt, Human
uaaauguaggggggguggggauugcuggauggaaacccuggaauaggcuacuugauggcucuca

SEQ ID NO: 471075 - RNA, 64 nt, Human
cguugcugcagaccaucuggggucuugcccaagcacccuggagacuuugcucccugguuuccug

SEQ ID NO: 471076 - RNA, 64 nt, Human
gugugaaggugcuguaucccggaaaucuaucuggacccuggacugcagugcaggagaugacaga

SEQ ID NO: 471077 - RNA, 64 nt, Human
ugugucugggcugcuccaaguccuugugcugggcacccuggacacguccugcuggugagggacc

SEQ ID NO: 471078 - RNA, 64 nt, Human
ucuccagcucuucaccuuccucaccucacaucugacccuggagcuugggguuggcaccucugcc

SEQ ID NO: 471079 - RNA, 64 nt, Human
ggaacaucucuuuacccagacuagaccuagcaaaacccuggaaggauauugaggucuggggaaa

SEQ ID NO: 471080 - RNA, 64 nt, Human
uuuucccaugugcagggugagguuuuuuuuugccacccuggacacauguuggcccccucaaaga

SEQ ID NO: 471081 - RNA, 64 nt, Human
ucucccaccuccuccccucucccucccccuggagacccuggaagugguguguucacauacagug

SEQ ID NO: 471082 - RNA, 64 nt, Human
cuccacccuccccaccuggcucauuuccccgaugacccuggauuguaggaaaguuaagcaggca

SEQ ID NO: 471083 - RNA, 64 nt, Human
auguccuugucugguccugcuucuggcuacagccacccuggaacggagaaggcagcugacgggg

SEQ ID NO: 471084 - RNA, 64 nt, Human
gaccacgcccaccucauuuacauguucacucccgacccuggaaacccggauuucgccuccggac

SEQ ID NO: 471085 - RNA, 64 nt, Human
uuugugugauacaggaugaacuugggauguuugaacccuggacauuccaaauaaagaauaggcc

SEQ ID NO: 471086 - RNA, 64 nt, Human
gaacaggagccugagccagggcaauggcccugccacccuggaggccaccucuucuaagaguccc

SEQ ID NO: 471087 - RNA, 64 nt, Human
gggguccuagccuggagcaggcgccugcgcccagacccuggagagccuugacccagagccugug

SEQ ID NO: 471088 - RNA, 64 nt, Human
gacaccacugggaaccaagggcccucacucaggaacccuggagacagaagucaggugucaucau

SEQ ID NO: 471089 - RNA, 64 nt, Human; identical to SEQ ID NO: 72896

SEQ ID NO: 471090 - RNA, 64 nt, Human; identical to SEQ ID NO: 72897

SEQ ID NO: 471091 - RNA, 64 nt, Human; identical to SEQ ID NO: 72898

SEQ ID NO: 471092 - RNA, 64 nt, Human
acaaugcauauuagccagguaaugcacuuuagcuacccuggacaaugcuaucaagugugcuggg

SEQ ID NO: 471093 - RNA, 64 nt, Human
gggggccuuguggcacuccaaguaugagucggauacccuggagcaagaccuggagcggcuauuc

SEQ ID NO: 471094 - RNA, 64 nt, Human
aaauuguuucuuauuuuuugagacuccuugauccacccuggaacagucgccuguaguccuggua

SEQ ID NO: 471095 - RNA, 64 nt, Human
cagaggggucaagacccccccccgcccccgcuccacccuggagcccacccccaugggcaccgcg

SEQ ID NO: 471096 - RNA, 64 nt, Human
ccuuguuuuuauaugcaacacaagccugucugccacccuggagcgcccugucaccccugcuguc

SEQ ID NO: 471097 - RNA, 64 nt, Human
gcagaucccagcccacccugccccuuucuuccccacccuggaggcucucucugccuagucuaca

SEQ ID NO: 471098 - RNA, 64 nt, Human
caaagagagaaaggagguaguuuaagagucccugacccuggaggacugagaucccaccuccuuc

SEQ ID NO: 471099 - RNA, 64 nt, Human
uuaguaccuaaaaggaaaucucaccccaucccacacccuggaggauuucaucucuuguauauga

SEQ ID NO: 471100 - RNA, 64 nt, Human
cugccccagugccuuggaaccugcugccuuggggacccuggacgugccgacauauggccauuga

SEQ ID NO: 471101 - RNA, 64 nt, Human
uucucucgacucugauuuuauuaaauauuucuccacccuggaaaugugcugagcccuguuuuca

SEQ ID NO: 471102 - RNA, 64 nt, Human
aucaagcccuuuacuugaccuccuaacaaguagcacccuggauugaucggagccuccucucuca

SEQ ID NO: 471103 - RNA, 64 nt, Human
ggccauggguccccuacccuuccccguaggauauacccuggagaauggcaaaaugauuuaaaga

SEQ ID NO: 471104 - RNA, 64 nt, Human
gaccagauuccagguccaaagucaccaugaggccacccuggaaucagaacugcacaaucaagag

SEQ ID NO: 471105 - RNA, 64 nt, Human
ucucuuuguccucucuccccuccugcccgcccgcacccuggaauugccacucaguuccucuggg

SEQ ID NO: 471106 - RNA, 64 nt, Human
ggagggcugcugggugagggccuggagauguggaacccuggaguggaagguucuccagugacag

SEQ ID NO: 471107 - RNA, 64 nt, Human
uuucgaccuggaggaguacagccucucacagucuacccuggagcaggugggucauuuuuaguga

SEQ ID NO: 471108 - RNA, 64 nt, Human; identical to SEQ ID NO: 72900

SEQ ID NO: 471109 - RNA, 64 nt, Human; identical to SEQ ID NO: 72901

SEQ ID NO: 471110 - RNA, 64 nt, Human; identical to SEQ ID NO: 72902

SEQ ID NO: 471111 - RNA, 64 nt, Human
caggggcagccaggacccuugauucagaccauggacccuggaccuuguagaugagggacacugg

SEQ ID NO: 471112 - RNA, 64 nt, Human
ucacuguggaugacuagcuuucacgagggucucgacccuggaccuccugagggaaacauggaaa

SEQ ID NO: 471113 - RNA, 64 nt, Human
gcugucuggccgucucgccccgccccuccacaggacccuggaccagggcggugcagggcgcagc

SEQ ID NO: 471114 - RNA, 64 nt, Human
uggaagaggcagagccugaggugguaggaggaggacccuggaaauggacugguuugagauugcc

SEQ ID NO: 471115 - RNA, 64 nt, Human
agagauuggcuuggggccagaaggacccuccccaacccuggagacacccugaagguucacuggc

SEQ ID NO: 471116 - RNA, 64 nt, Human
gacccacccaauggaaggauucuucucagccuugacccuggagcacugggaacaacuggucucc

SEQ ID NO: 471117 - RNA, 64 nt, Human
acaccuuucccuccuuguuccucgcugaccgaugacccuggaacuccacggugccucucugaau

SEQ ID NO: 471118 - RNA, 64 nt, Human
gcauauuaaucaaacuguugaauuguuuucuuacacccuggaaaucuuucuaucaacuauaaug

SEQ ID NO: 471119 - RNA, 64 nt, Human
agaugaguuucuagacacgcugucaugaaaugagacccuggauuuugaugcucuuguacauaug

SEQ ID NO: 471120 - RNA, 64 nt, Human
gacagugcugcuggaaaggcuagugaugagcuucacccuggagcuccucccgggaccuugcaag

SEQ ID NO: 471121 - RNA, 64 nt, Human
uugccuuaaccgcaucacuccccacccgccacccacccuggagcccgccggccugggcaggggg

SEQ ID NO: 471122 - RNA, 64 nt, Human
ggggcuucugacgccaaaugggcuucccauggucacccuggacaaggaggcaaccaccccaccu

SEQ ID NO: 471123 - RNA, 64 nt, Human
cagcccacaugcuuucaacaacauguaagaauguacccuggaucaaaacacuauaaaugugaaa

SEQ ID NO: 471124 - RNA, 64 nt, Human
gccuccagagggaaccagcccugccaccaccuugacccuggacuucuggccugcagaacuguga

SEQ ID NO: 471125 - RNA, 64 nt, Human
cacuguuuuugaacuugacaacagcucucccuuuacccuggacuucagcccaaguuccgucuuu

SEQ ID NO: 471126 - RNA, 64 nt, Human
ccuuguucagccccugccggcacacgggcggcucacccuggacacugugaugcgcaugggcaag

SEQ ID NO: 471127 - RNA, 64 nt, Human; identical to SEQ ID NO: 72903

SEQ ID NO: 471128 - RNA, 59 nt, Human; identical to SEQ ID NO: 72904

SEQ ID NO: 471129 - RNA, 64 nt, Human; identical to SEQ ID NO: 72905

SEQ ID NO: 471130 - RNA, 64 nt, Human
ucuaaccagauggaacacuggaacauuccaguggacccuggaccauuccaggaaaacugggaca

SEQ ID NO: 471131 - RNA, 64 nt, Human
augugggucccuaaccuauaaucucagcuucccuacccuggacugaagggucugcccauccccc

SEQ ID NO: 471132 - RNA, 64 nt, Human
cagaccucauuucaggcaccagauuggucgcuacacccuggacaagugacugcccgucucugag

SEQ ID NO: 471133 - RNA, 64 nt, Human
uuuguggggugcagagaugggagggguggggcccacccuggaagaguggacagugacacaaggu

SEQ ID NO: 471134 - RNA, 64 nt, Human
gagggagcugacccuugacuccagcauagcucugacccuggaaugggguugguuuggacacccc

SEQ ID NO: 471135 - RNA, 64 nt, Human
uccaguagcugcauggugagugagcguagggcgcacccuggaaggcugccaagcccaaaguugu

SEQ ID NO: 471136 - RNA, 64 nt, Human
caacccagucaacaccacagaaccucagcuuugaacccuggagugaggacggugaugcccugug

SEQ ID NO: 471137 - RNA, 64 nt, Human
cuccucuugaaggacacaagcuguuucucggaagacccuggacaccugcuccgaagccaagcac

SEQ ID NO: 471138 - RNA, 64 nt, Human
guauguuuacauggaugucuccccagcagcuugaacccuggagagcaagaauaaucugauuuuc

SEQ ID NO: 471139 - RNA, 64 nt, Human
uguugggaccagugaccccuggcauggggaccacacccuggagcccggugcuggggaccuccug

SEQ ID NO: 471140 - RNA, 64 nt, Human
ucaccugcuaggagccucaccugcuggggaccucacccuggagggcacugggcccugggaacug

SEQ ID NO: 471141 - RNA, 64 nt, Human
cuugccacacugaaucucaccugcuggggaccucacccuggagggcccugggcccuggggaacu

SEQ ID NO: 471142 - RNA, 64 nt, Human
ucugauagugccuguggauguguugcgaugccucacccuggagggcacugggcccugagaacgg

SEQ ID NO: 471143 - RNA, 64 nt, Human
guuccuuauucuggacaaacccuccucugcuggaacccuggacuuuggccccagucccuuuaag

SEQ ID NO: 471144 - RNA, 64 nt, Human
gccagaccugccccuccaaacuccacaguaugggacccuggagggcuaggccaaggccuucuca

SEQ ID NO: 471145 - RNA, 63 nt, Human
cgccaggccuguccucuuaggacucaaacccagacccuggacugauuuuccaguccccaccgu

SEQ ID NO: 471146 - RNA, 64 nt, Human; identical to SEQ ID NO: 72907

SEQ ID NO: 471147 - RNA, 64 nt, Human; identical to SEQ ID NO: 72908

SEQ ID NO: 471148 - RNA, 64 nt, Human; identical to SEQ ID NO: 72909

SEQ ID NO: 471149 - RNA, 64 nt, Human
aaugcauuacaacagaacauucuugaaucacccaacccuggaucagaaaccuccccauuaacaa

SEQ ID NO: 471150 - RNA, 64 nt, Human
gacccgggaaggggcugugucgguaguggugcccacccuggauguggcagcaccgacugugggg

SEQ ID NO: 471151 - RNA, 64 nt, Human
ccucugcccccaaggucuacucccuccucaccccacccuggagggccaggggaguggagagagc

SEQ ID NO: 471152 - RNA, 64 nt, Human
caggucugagauaaaacgaucuaaagguaggcagacccuggacccagccucagauccaggcagg

SEQ ID NO: 471153 - RNA, 64 nt, Human
cuggugcggggcagcccuggcccuaggcuuccuaacccuggaagcgagaggaugagaggaggcc

SEQ ID NO: 471154 - RNA, 64 nt, Human
ccuuaugaguggcaaauguggaaaaucuguuagcacccuggagaaaguccuugaguacacagug

SEQ ID NO: 471155 - RNA, 64 nt, Human
gguggguggcuuacaaggucaggaguucaagaccacccuggacaauauggugaaacccugucuc

SEQ ID NO: 471156 - RNA, 64 nt, Human
aauaguucccauuuccccauggagaauuugacauacccuggacuccugugugccuccugccauc

SEQ ID NO: 471157 - RNA, 64 nt, Human
aaucacgguucugccccucucucccuguccucagacccuggaaaagugaaccacaagacucccu

SEQ ID NO: 471158 - RNA, 64 nt, Human
gcuaugcagaagcugaagcacaagaauugcuugaacccuggagguggagguugcagugagcuga

SEQ ID NO: 471159 - RNA, 64 nt, Human
agagacuugcagugaacuguuuuugugccaagaaacccuggaccuggggccaaguauuucccaa

SEQ ID NO: 471160 - RNA, 64 nt, Human
gcaucgcugccccaggccucaagccgggcacccaacccuggaugccaccccccagcggguacca

SEQ ID NO: 471161 - RNA, 64 nt, Human
cagacuuaggcgcgcccgguagccccggcugcccacccuggagggcugcgcccgcgccaggcgc

SEQ ID NO: 471162 - RNA, 64 nt, Human
ccaggcauagggggcaagcucuuggggcaucaggacccuggagcaccagguccuuccuggaaua

SEQ ID NO: 471163 - RNA, 64 nt, Human
ccuccagaugagguccagcccagaucugagaggaacccuggaaaugugaagucucuguugguuu

SEQ ID NO: 471164 - RNA, 64 nt, Human
cagaaacaguucaccuugaagaaccucucacuucacccuggagcccauccagucucccaacuug

SEQ ID NO: 471165 - RNA, 64 nt, Human; identical to SEQ ID NO: 72910

SEQ ID NO: 471166 - RNA, 64 nt, Human; identical to SEQ ID NO: 72911

SEQ ID NO: 471167 - RNA, 64 nt, Human; identical to SEQ ID NO: 72912

SEQ ID NO: 471168 - RNA, 64 nt, Human
guuacauuuuuauacuuuagcagcacugauaggcacccuggaauccucacuugguauccgaggg

SEQ ID NO: 471169 - RNA, 64 nt, Human
uguucucagugcuggaacuugaccauccuggaacacccuggaagaaaaaggagcgcaggguggg

SEQ ID NO: 471170 - RNA, 56 nt, Human
uucgagggccacggagaugagccuggacccuggagaaggaggccaggagccagcca

SEQ ID NO: 471171 - RNA, 64 nt, Human
agaacugacuuccugaacucccagucauguugguacccuggacagugccuaacuccuuacagaa

SEQ ID NO: 471172 - RNA, 64 nt, Human
ucucaagcuggcucacucagacacauugggacaaacccuggacagccaugccagagagaggccu

SEQ ID NO: 471173 - RNA, 64 nt, Human
gccauuccuucgugaccugugcacgccuucugcaacccuggagcucugcucggcuagucugacu

SEQ ID NO: 471174 - RNA, 64 nt, Human
gaggugagggaggccugaaauguuuccaggcaugacccuggagcccggcagugcacccccuaaa

SEQ ID NO: 471175 - RNA, 64 nt, Human
uccccaguuccgucucagcuaccuggacuccaggacccuggagaagggagaccuggcaguggag

SEQ ID NO: 471176 - RNA, 64 nt, Human
cucggggguuggggggugccggggcgaugcuuccacccuggacugaguguucggggcagccugc

SEQ ID NO: 471177 - RNA, 64 nt, Human
ccaucugagccagccccacaucuagaacucccagacccuggacuuagccaccagagagcuacau

SEQ ID NO: 471178 - RNA, 64 nt, Human
cugugccccaccaaaugcccaggggcaagaggccacccuggaagcugccaaucuuccaaggugg

SEQ ID NO: 471179 - RNA, 64 nt, Human
gaaggaccucuaggcuguggcuggccuugugcagacccuggacugcauccgguuccccaaagcc

SEQ ID NO: 471180 - RNA, 64 nt, Human
gaaggacgcggccgccauggaccccaugggagacacccuggagccacuguccacgauccaguac

SEQ ID NO: 471181 - RNA, 64 nt, Human
cuuccuccucauccucccugacccugcuccuagcacccuggagagugcacaugccccuuggucc

SEQ ID NO: 471182 - RNA, 64 nt, Human
agguggggcgggaccccagcaccucccccaacugacccuggacguccaggugggcccagccuag

SEQ ID NO: 471183 - RNA, 64 nt, Human
gggucaauuucaggaggccacccucaugcacauaacccuggaagggucuuccagucauggccau

SEQ ID NO: 471184 - RNA, 64 nt, Human; identical to SEQ ID NO: 72914

SEQ ID NO: 471185 - RNA, 64 nt, Human; identical to SEQ ID NO: 72915

SEQ ID NO: 471186 - RNA, 64 nt, Human; identical to SEQ ID NO: 72916

SEQ ID NO: 471187 - RNA, 64 nt, Human
agccuccugcucaugcugcacgggccuccccuccacccuggacccgcucuguuucugccugguc

SEQ ID NO: 471188 - RNA, 64 nt, Human
ggucaugaagggaccucuguggcuccagcugccaacccuggagcccagaccgagguggccaugg

SEQ ID NO: 471189 - RNA, 64 nt, Human
cacuggaccgaggaaaagucagauuucauuuucuacccuggauguacuugaagaaaaagaauua

SEQ ID NO: 471190 - RNA, 64 nt, Human
caaaccucgggccacaagacaccacuuccccuuuacccuggacagcaggaaaccuguauauuca

SEQ ID NO: 471191 - RNA, 64 nt, Human
aaaagcagucuuugugcuuguggcugaacgcaucacccuggacucugcuagugucuucugagga

SEQ ID NO: 471192 - RNA, 64 nt, Human
cagggggugcagaaaaugauugaugggcuggggaacccuggagagccucgacuccggaagucuc

SEQ ID NO: 471193 - RNA, 64 nt, Human
ugccccagacacagugcccaacaccccgucguauacccuggaugaacgaauuaauuaccuggca

SEQ ID NO: 471194 - RNA, 64 nt, Human
ucacagacccacaagagaagcugauggggaguaaacccuggaguccgaggcccaggcagcagcc

SEQ ID NO: 471195 - RNA, 64 nt, Human
uggugggggcugggggaagaggcuggcagaaguuacccuggauagggaagggggaggaggggac

SEQ ID NO: 471196 - RNA, 64 nt, Human
uaguuggggucccagaaagccggggguaggggccacccuggaauggggcaggggaagggcacac

SEQ ID NO: 471197 - RNA, 64 nt, Human
ccaccuccugggccucucugaccucagcuccuagacccuggacccuuggcugggacucagcauu

SEQ ID NO: 471198 - RNA, 64 nt, Human
gcaagugaggccaggcccggaggcggccgcgggcacccuggaacccggcggcauuuugcacauc

SEQ ID NO: 471199 - RNA, 64 nt, Human
ucccccuugaugcaagagguaggcuccccgaaagacccuggaaagucccugccaccuguaccac

SEQ ID NO: 471200 - RNA, 64 nt, Human
caaauuucuuuugcugaacaggaaagagcuaggaacccuggagguaaacaaagacuuugaucca

SEQ ID NO: 471201 - RNA, 64 nt, Human
aaagaaggacccuuuuuggacuagccagaauucuacccuggaaaaguguuagggauuccuucca

SEQ ID NO: 471202 - RNA, 64 nt, Human
acaguugcacagcaucucagcucaucuucacugcacccuggauuugcauacauucuucaagauc

SEQ ID NO: 471203 - RNA, 64 nt, Human; identical to SEQ ID NO: 72917

SEQ ID NO: 471204 - RNA, 64 nt, Human; identical to SEQ ID NO: 72918

SEQ ID NO: 471205 - RNA, 64 nt, Human; identical to SEQ ID NO: 72919

SEQ ID NO: 471206 - RNA, 64 nt, Human
aguuccaccucuaagguccgaaaauguucccuuuacccuggagugggagugaggggucauacac

SEQ ID NO: 471207 - RNA, 57 nt, Human
gcucucucaggaguagaugagugcuagacccuggaccuccugacuccgaguucaugu

SEQ ID NO: 471208 - RNA, 64 nt, Human
cuacacugcacuaggggagccccaggaaggcagcacccuggaggcccugugccagugaggacag

SEQ ID NO: 471209 - RNA, 64 nt, Human
agggcuggcagucuuugcagcguggggccgucucacccuggagccuggagaggaucuaugcuug

SEQ ID NO: 471210 - RNA, 64 nt, Human
ucccacccugugcggggcacacccccaggaagggacccuggacacggcucccacguccaggcuu

SEQ ID NO: 471211 - RNA, 63 nt, Human
agagaggucaccuuccuucuauggccuugaagaaacccuggagaggaccaacgaggcugcaga

SEQ ID NO: 471212 - RNA, 64 nt, Human
uaauuugauaacuucaagaaguuauaacuuugcuacccuggauucugaugcaauuucaauauaa

SEQ ID NO: 471213 - RNA, 64 nt, Human
cuggggccuggagcaaggcacucucaaaucuugaacccuggaccaaagcuuuuccagaccccac

SEQ ID NO: 471214 - RNA, 64 nt, Human
gccccuuuucucuggaucucaagaaugguggaggacccuggaaggacagcaaggcagcucccca

SEQ ID NO: 471215 - RNA, 64 nt, Human
ccgggccucuccaaggcugcccgugcguccugggacccuggagaaggguaaacccccgccuggc

SEQ ID NO: 471216 - RNA, 64 nt, Human
uuguugguuuuuuuuuuuuuuuuuuuaacuugggaccaccaaguuguaaagauguauguuuuua

SEQ ID NO: 471217 - RNA, 64 nt, Human; identical to SEQ ID NO: 72929

SEQ ID NO: 471218 - RNA, 64 nt, Human; identical to SEQ ID NO: 72930

SEQ ID NO: 471219 - RNA, 64 nt, Human; identical to SEQ ID NO: 72931

SEQ ID NO: 471220 - RNA, 64 nt, Human
ccaggccccagcucccuccgggggcccuccaggaaccaccaagcucucucacgaccuucccaau

SEQ ID NO: 471221 - RNA, 64 nt, Human
cagagagguccagcuagaaaaaguggcaguuuuaaccaccaacguagaagcuuuuuuuucccca

SEQ ID NO: 471222 - RNA, 64 nt, Human
aguuuugcccugagauucaugguuauggcuggguaccaccaaauagaagaauggcuuaggggag

SEQ ID NO: 471223 - RNA, 64 nt, Human
aauaguccagugauuaaacuacaguccagugauuaccaccaacuuucugacuaagcuaaaaaug

SEQ ID NO: 471224 - RNA, 64 nt, Human
uacaaauauaaguagucauuagaaguuugcaaccaccaccaagucugagagaacucugggauau

SEQ ID NO: 471225 - RNA, 64 nt, Human
aauaaauaaaaccauuggccugguugagggcgugaccaccaagacauauauguugugcccgugu

SEQ ID NO: 471226 - RNA, 64 nt, Human
uuuuuuuuuguaaucugugccaugaaauuugaaaaccaccaaaaaucaagggaacuuuuauaua

SEQ ID NO: 471227 - RNA, 64 nt, Human
cuuuaguugugcccuucccaggcaucauccuccuaccaccaaccuggggccccaucuuggaaug

SEQ ID NO: 471228 - RNA, 64 nt, Human
ggaaguauuuggacaaaaaccuaauagaagagucaccaccaaaugaagaauaaaacucccaggg

SEQ ID NO: 471229 - RNA, 64 nt, Human
ugaggucaggucacugcggacaucaagggcggacaccaccaaggggcccucuggaacuugagac

SEQ ID NO: 471230 - RNA, 64 nt, Human
uuuccugaaggacaccgaauucuccauuagauaaaccaccaagacuguucacaucaucucucua

SEQ ID NO: 471231 - RNA, 64 nt, Human
aggagggauccuuggcugaggauuguauuucagaaccaccaacugcucuugacaauuguuaacc

SEQ ID NO: 471232 - RNA, 64 nt, Human
aagugcaauaguugacuuuuaaccaaccaccaccaccaccaaaaccaguuuaugcaguuggacu

SEQ ID NO: 471233 - RNA, 58 nt, Human
ccgcgucaccaggaccauaaccguacaaaccaccaaauccucugcguccccacuccuc

SEQ ID NO: 471234 - RNA, 64 nt, Human
agaaacacaaaauuuugaggcuagacccaugaucaccaccaacuauaauugcacaaggucuugu

SEQ ID NO: 471235 - RNA, 64 nt, Human
ugggcugaauucucccucuggaaacugaguuacaaccaccaauacuggcagguucccuggaucc

SEQ ID NO: 471236 - RNA, 64 nt, Human; identical to SEQ ID NO: 72833

SEQ ID NO: 471237 - RNA, 64 nt, Human; identical to SEQ ID NO: 72834

SEQ ID NO: 471238 - RNA, 64 nt, Human; identical to SEQ ID NO: 72835

SEQ ID NO: 471239 - RNA, 64 nt, Human
uaaaaagagguugagcaccagaaucucagaauuuaccaccaaagaacucauccauguaaccaaa

SEQ ID NO: 471240 - RNA, 64 nt, Human
cagcugguaggaucccugagccccuugcgauaucaccaccaagagccugauaacugagcagggu

SEQ ID NO: 471241 - RNA, 64 nt, Human
uuuuaaacucaauaauuuugugaaaaaaaaaaccaccaccaaacuuuugguuguaaaagagaac

SEQ ID NO: 471242 - RNA, 64 nt, Human
acacaccuccacagugaccucugugcacacgguuaccaccaacuggcuggcccuccuccucuuc

SEQ ID NO: 471243 - RNA, 64 nt, Human
auggagaaauaucuaggaaagugucuucucagaaaccaccaaccuugaagguaaugaaacuccc

SEQ ID NO: 471244 - RNA, 64 nt, Human
ucagccuccugaguagcugagacuacaggugcacaccaccaagccuggcuuuauguauuuauuu

SEQ ID NO: 471245 - RNA, 64 nt, Human
aaaaagaccuccagauaggcagacagacagauggaccaccaaccuggacagacagccaaagcuu

SEQ ID NO: 471246 - RNA, 64 nt, Human
gccaacagcuugauagaccagugcagccagagagaccaccaaacagagcccccaaaagacagac

SEQ ID NO: 471247 - RNA, 64 nt, Human
ucuccaccugaagugaugauggaugagaaaaaacaccaccaaaugacaagucacacccucccca

SEQ ID NO: 471248 - RNA, 64 nt, Human
caguauuccagagauggucauagcucauuacucuaccaccaagaaccuaaaaggaauuagaaua

SEQ ID NO: 471249 - RNA, 64 nt, Human
ugguuuuauauguguuaaauaaauguguaaaguaaccaccaaauguuauuagaauuuuucuucu

SEQ ID NO: 471250 - RNA, 64 nt, Human
gaugugcuuuaucaucuccaucuuuagccuuuacaccaccaaucaaaacucuagguacaccaac

SEQ ID NO: 471251 - RNA, 64 nt, Human
ucuaauuuacuguugcccauugcacuuacauaccaccaccaagaaagccuucaagaugucaaau

SEQ ID NO: 471252 - RNA, 64 nt, Human
cagcccagcccacuccccgcauggggaggccgccaccaccaacaccucaucauccuucucaucg

SEQ ID NO: 471253 - RNA, 64 nt, Human
ccaguugaagcgcuggauguuuccuagaacaagaaccaccaaagccuguucgcacagaagggcg

SEQ ID NO: 471254 - RNA, 64 nt, Human
ccgagaggugggccagucuguggaucagagaugcaccaccaagccaagggaaccuguguccggu

SEQ ID NO: 471255 - RNA, 64 nt, Human; identical to SEQ ID NO: 72837

SEQ ID NO: 471256 - RNA, 64 nt, Human; identical to SEQ ID NO: 72838

SEQ ID NO: 471257 - RNA, 64 nt, Human; identical to SEQ ID NO: 72839

SEQ ID NO: 471258 - RNA, 64 nt, Human
ucacguuuuguuuugugccaaccuauuuugaaguaccaccaaaaaagcuguauuuugaaaaugc

SEQ ID NO: 471259 - RNA, 64 nt, Human
uacguacuucaaugccaccgguaacuuagguuuuaccaccaaaugcuguuaacguuaaaucauu

SEQ ID NO: 471260 - RNA, 64 nt, Human
gccucagggcuugugggggguaggcugagaccccaccaccaaagguuaagugagguccccuuga

SEQ ID NO: 471261 - RNA, 64 nt, Human
aaacugcagccuuuucugucgccagcaauuaaagaccaccaaucuuguuuguccaucuacaugg

SEQ ID NO: 471262 - RNA, 64 nt, Human
uaauguauagugggagugguuguguaaugaaaggaccaccaaaauaauaaaaggcagcuaaugg

SEQ ID NO: 471263 - RNA, 64 nt, Human
ucaucacugcacacaagugccaugcuuugccaccaccaccaagcacaucugugauccugaaggg

SEQ ID NO: 471264 - RNA, 64 nt, Human
agggucaggaaggaugagcauuuagggcaaggagaccaccaacagcccucaggucagggugagg

SEQ ID NO: 471265 - RNA, 64 nt, Human
uugguucauuuggguggggaucaaaguccuguccaccaccaaaacuaaguucuuagauuuuggg

SEQ ID NO: 471266 - RNA, 64 nt, Human
uuaaaggcagaaugacugcguuuguaaaagaaggaccaccaacuauacugacauuuauaaauga

SEQ ID NO: 471267 - RNA, 64 nt, Human
ucguaaggaagcuguuucuuuuaaaacacaaaccaccaccaaaaauuuaaauguacauauugcu

SEQ ID NO: 471268 - RNA, 64 nt, Human
uaacccuucugagguaacuagacugcagcuaaccaccaccaacagccauucaucaucugaucuc

SEQ ID NO: 471269 - RNA, 64 nt, Human
gucacuuuuuuauuuaguaaaucgcauugcuggaaccaccaaggaguguggaauguccuugagu

SEQ ID NO: 471270 - RNA, 64 nt, Human
gcaccuggcaaaaggcauggccucccugaugaucaccaccaaggguagccccagaggggagcuc

SEQ ID NO: 471271 - RNA, 64 nt, Human
auuugcuuuugucacuaaacgguuuuguguuagaaccaccaaaauuauagcuuuuaagagcuuc

SEQ ID NO: 471272 - RNA, 64 nt, Human
cccaaacccaccacacaccagcagccacaaccucaccaccaacaaagaggacuuuuguggggcc

SEQ ID NO: 471273 - RNA, 64 nt, Human
agcacuucggcuccucuaaccugugccacaggugaccaccaauaaaauccucugcugagaagug

SEQ ID NO: 471274 - RNA, 64 nt, Human; identical to SEQ ID NO: 72840

SEQ ID NO: 471275 - RNA, 64 nt, Human; identical to SEQ ID NO: 72841

SEQ ID NO: 471276 - RNA, 64 nt, Human; identical to SEQ ID NO: 72842

SEQ ID NO: 471277 - RNA, 64 nt, Human
uuuuuucaggaugcuauagucaauuuaguaagugaccaccaaauuguuauuugcacuaacaaag

SEQ ID NO: 471278 - RNA, 64 nt, Human
gucauuuauuauuuuauaaauugagaacaaccacaccaccaaaugucacaccuucuuauaaagu

SEQ ID NO: 471279 - RNA, 64 nt, Human
uccagauaccaacugcugauguugcucuagaaaaaccaccaaacaugacuguucuuuccgugua

SEQ ID NO: 471280 - RNA, 64 nt, Human
uuggcuggggagugggaacagggaggggcagaaaaccaccaaaaggccagugccucaacucuug

SEQ ID NO: 471281 - RNA, 64 nt, Human
cccgcuccacaagacaccugugaucuggaaaucuaccaccaaucccgaucggcucuuauuagcu

SEQ ID NO: 471282 - RNA, 64 nt, Human
cccgcuccacaagacaccugugcuuuggaaauccaccaccaaucccgaucggcucuuauuagcu

SEQ ID NO: 471283 - RNA, 64 nt, Human
cuuauguagcuuuuuauuauuuuaaguaacuagaaccaccaaauaucaaauaaaauuauuuggu

SEQ ID NO: 471284 - RNA, 64 nt, Human
uuauuuuggcucuaauuugaauaagcugaguaaaaccaccaaagaucaguuauaggauaaaaug

SEQ ID NO: 471285 - RNA, 64 nt, Human
caacuggcaaaaaagcaagcaucuaagaaaaaaaaccaccaaaguucuugaauuuacuauauuu

SEQ ID NO: 471286 - RNA, 64 nt, Human
uaauuuuuuuuucauuucaaauaaauaccuauuuaccaccaaaagaaagaaaaagaaaaguugu

SEQ ID NO: 471287 - RNA, 64 nt, Human
aggguuucuauguguaucaguguaauaguguuuuaccaccaacugccuuucuuuguuccuaguu

SEQ ID NO: 471288 - RNA, 64 nt, Human
uuuacauuauaaagcaauguagagagaguuccaaaccaccaauuuuauaauuucccuuguugaa

SEQ ID NO: 471289 - RNA, 64 nt, Human
gauugucuuguugauuaaauuguucaugcucaccaccaccaauaagguauuuuucucugauugu

SEQ ID NO: 471290 - RNA, 64 nt, Human
ccaauggcacagauuacaaaaguaaagaacaaccaccaccaacaucgguaacucccuguauucu

SEQ ID NO: 471291 - RNA, 64 nt, Human
agugccaaaaacaacaacaaaaugaaacgcaaccaccaccaaccacugcgaccacaagaaggau

SEQ ID NO: 471292 - RNA, 64 nt, Human
gauuuuuauauuuggggcaucucuauagaaagugaccaccaaggccaguaaguacgggaaaaaa

SEQ ID NO: 471293 - RNA, 64 nt, Human; identical to SEQ ID NO: 72844

SEQ ID NO: 471294 - RNA, 64 nt, Human; identical to SEQ ID NO: 72845

SEQ ID NO: 471295 - RNA, 64 nt, Human; identical to SEQ ID NO: 72846

SEQ ID NO: 471296 - RNA, 64 nt, Human
cuaccuucuagguuccugaaguauuuucaaacaaaccaccaacaggagauauugaggauauuua

SEQ ID NO: 471297 - RNA, 64 nt, Human
aacaaaacaaaacaaaacacaguccugcauacucaccaccaagcucaagaaauaaaucaucacc

SEQ ID NO: 471298 - RNA, 64 nt, Human
aagcaacaaagauugagaagccauguacucaaguaccaccaagggaucugccauugggacccuc

SEQ ID NO: 471299 - RNA, 64 nt, Human
agggccccgcaccaguuggagcagaugccuccccaccaccaauugccaaagguccaauaaaaug

SEQ ID NO: 471300 - RNA, 64 nt, Human
uuuccccuggggcuccaggaccuucccuaccuccaccaccaaaccaagggauuuauagcaaagg

SEQ ID NO: 471301 - RNA, 64 nt, Human
ggacuuacaucacuugcugcucuauggaguugagaccaccaaguaaagcauccugggcuagccu

SEQ ID NO: 471302 - RNA, 62 nt, Human
cauccaaguccuggaacugaggucaaacaaguaccaccaaggugauccccagccugcggccc

SEQ ID NO: 471303 - RNA, 64 nt, Human
guggggaggugugcuuuagauuucucauuagaagaccaccaaacugguaauauuuuuauagcau

SEQ ID NO: 471304 - RNA, 64 nt, Human
cuacagugaaaugagcagcccuuacaguauuguuaccaccaagggcagguagguauuaguguuu

SEQ ID NO: 471305 - RNA, 64 nt, Human
caagaacugcuucuucaauuccuuaacaaaugcaaccaccaacacccagaucucucucucucuu

SEQ ID NO: 471306 - RNA, 64 nt, Human
ccaaugaucaugcuuccauuuuuuuuaguuuuaaaccaccaaaccaauauuuuuccuuuaaauu

SEQ ID NO: 471307 - RNA, 50 nt, Human
cagcagcuggaggcacuuaaaccaccaaugugggagggggugcuaaaacu

SEQ ID NO: 471308 - RNA, 64 nt, Human
uaauccacuuacuccaucuuuacaaucccuuuuuaccaccaauaaaaggauuuuucuugcuguu

SEQ ID NO: 471309 - RNA, 64 nt, Human
acucuccauuccuuccuuccuccagcccccagcaaccaccaaucugcuuucugucucuauggau

SEQ ID NO: 471310 - RNA, 64 nt, Human
augugaauuaugaacuaguaugugacaauaaaugaccaccaaguacuaccugacgggaggcacu

SEQ ID NO: 471311 - RNA, 64 nt, Human
auuaaaaggacagugaguuuucgccuucccuuacaccaccaacuuuacuuuccaacauuuguug

SEQ ID NO: 471312 - RNA, 64 nt, Human; identical to SEQ ID NO: 72847

SEQ ID NO: 471313 - RNA, 64 nt, Human; identical to SEQ ID NO: 72848

SEQ ID NO: 471314 - RNA, 64 nt, Human; identical to SEQ ID NO: 72849

SEQ ID NO: 471315 - RNA, 64 nt, Human
cccggccaucaacccaaauuggacauuccagacuaccaccaacuggaucccagcugccuuccug

SEQ ID NO: 471316 - RNA, 64 nt, Human
ugaaacauuuccgaguuaauuucccauaggcuucaccaccaagaaaguaagaauugcaucuuua

SEQ ID NO: 471317 - RNA, 64 nt, Human
ucauuaugcauuuguccaaacccacaggagguguaccaccaagagugaacccuaaugccagcua

SEQ ID NO: 471318 - RNA, 64 nt, Human
uuuguccacacaagacagcagagccaucugcgacaccaccaacaggcguucucagccuccggau

SEQ ID NO: 471319 - RNA, 64 nt, Human
aucugcaugagugacaaacuuucugaacaccaccaccaccaauaauacuuaucagcaucauaaa

SEQ ID NO: 471320 - RNA, 64 nt, Human
aaaauauuauaagauccauugauguccaaauaauaccaccaagcaucucuucaccucuccuccu

SEQ ID NO: 471321 - RNA, 64 nt, Human
cauuuucuauuuugaaucuccuuguuaguuaauaaccaccaaauggaaaggucauucuuucugc

SEQ ID NO: 471322 - RNA, 64 nt, Human
uucagcagcacauucugaggggggaacaauucacaccaccaauaauaaccugguaagauuucag

SEQ ID NO: 471323 - RNA, 64 nt, Human
uaaaaaguauagauaauuuaauuaacuuagugacaccaccaaguguuuugauauaacuaaauuu

SEQ ID NO: 471324 - RNA, 52 nt, Human
uaccaacaaauauguccuaaaaaccaccaaggaaaccuacuccaaaaaugaa

SEQ ID NO: 471325 - RNA, 64 nt, Human
uuuccaaaacugaacucaucaccccucuucccccaccaccaaaacugcuccuccuccuguauuc

SEQ ID NO: 471326 - RNA, 64 nt, Human
acacaaagcuuccaaucuuaaggaugugaauaaaaccaccaaauggcauuucuagacaguuuga

SEQ ID NO: 471327 - RNA, 64 nt, Human
gggacagacgcagggagaccccaccaccaccaccaccaccaacaccaccaccaccaccgcgagc

SEQ ID NO: 471328 - RNA, 64 nt, Human
uuuuuugguccuucuuuccucuuaacguaaauccaccaccaaaauuauuaauccucuugagaga

SEQ ID NO: 471329 - RNA, 64 nt, Human
cagaauaggaucugaagagaucaaagcaauggagaccaccaaacugucuugaaggcaugucuau

SEQ ID NO: 471330 - RNA, 64 nt, Human
ucuucggaggcugaguuugcccaacucagguuuaaccaccaaggacucugagagcuggcagguc

SEQ ID NO: 471331 - RNA, 64 nt, Human; identical to SEQ ID NO: 72851

SEQ ID NO: 471332 - RNA, 64 nt, Human; identical to SEQ ID NO: 72852

SEQ ID NO: 471333 - RNA, 64 nt, Human; identical to SEQ ID NO: 72853

SEQ ID NO: 471334 - RNA, 64 nt, Human
ucauugggguuuguagucccaacuugcugcugucaccaccaaacucaaucauuuuuuucccuug

SEQ ID NO: 471335 - RNA, 64 nt, Human
aagauagaccuguacauguauuuuaagcaggaaaaccaccaaaauucaaacgaacccuuaaagg

SEQ ID NO: 471336 - RNA, 64 nt, Human
cucagugcugggaguaguccccaguuauuaugaaaccaccaauaacccacugaccacagugaga

SEQ ID NO: 471337 - RNA, 64 nt, Human
aagugauuuuagcaauuaaacuuuguauuaauuuaccaccaauauuucuucacaaaggaacuuu

SEQ ID NO: 471338 - RNA, 64 nt, Human
uauacucuuaaaaaaaaacaauaauuugugaauuaccaccaaaaggcaauggcaguccuacauu

SEQ ID NO: 471339 - RNA, 64 nt, Human
caguggaaaaagccauggugugugguuucugggaaccaccaacacuugcagguuuagcuuuuuc

SEQ ID NO: 471340 - RNA, 64 nt, Human
cucccuucccccaauacacagaaccaccgccaccaccaccaacaccgccacaccaacaccacca

SEQ ID NO: 471341 - RNA, 64 nt, Human
gaaaaagcaauaguugcuugaauuaugaucaucuaccaccaacucugcucagcccuguaacagg

SEQ ID NO: 471342 - RNA, 64 nt, Human
ugaucauuucugccaugauguuuacaagauggcgaccaccaaagucaaacgacuaaccuaucua

SEQ ID NO: 471343 - RNA, 64 nt, Human
ccuacaaaagugccuacagccccagcccaguggaaccaccaagcaaggacuucuguaauuuuuu

SEQ ID NO: 471344 - RNA, 64 nt, Human
auccauggugccuccccaaaucauaagaccaaagaccaccaaacgcaggguggacucugcucau

SEQ ID NO: 471345 - RNA, 64 nt, Human
acccaccccagcgcugaagauccaugucuccucuaccaccaaggaugcccuagaugagcuagga

SEQ ID NO: 471346 - RNA, 64 nt, Human
cgccuuccuuccauguagucccucuugguaaucuaccaccaagcuuguggacuucaccccaaca

SEQ ID NO: 471347 - RNA, 64 nt, Human
uagaguuugggcuaaaaugagcaaggagaaaaaaaccaccaagaacauuuccuggggcauguuc

SEQ ID NO: 471348 - RNA, 64 nt, Human
aagaggagcuggcuagucaggaacuuauucauuaaccaccaaaccucuaccucuucucuccuug

SEQ ID NO: 471349 - RNA, 64 nt, Human
aaguacuuuuauacauaagauaaacaaaaaccuuaccaccaaacauaccaaaaugcaccucuuu

SEQ ID NO: 471350 - RNA, 64 nt, Human; identical to SEQ ID NO: 72854

SEQ ID NO: 471351 - RNA, 64 nt, Human; identical to SEQ ID NO: 72855

SEQ ID NO: 471352 - RNA, 64 nt, Human; identical to SEQ ID NO: 72856

SEQ ID NO: 471353 - RNA, 64 nt, Human
agucuuagaguaccuggaauccggucccaucucuaccaccaacuggcuguuugaccuugggcaa

SEQ ID NO: 471354 - RNA, 64 nt, Human
cauccguccuuggcucaggauuuggagagcuugcaccaccaaaaauggcaaacaucaccagcuc

SEQ ID NO: 471355 - RNA, 64 nt, Human
uaccauucucguuuuggaggaaacaaucucugccaccaccaagucauugacuuugcucgaggca

SEQ ID NO: 471356 - RNA, 64 nt, Human
gaugcguccuauuguccuuaagagggcguuucacaccaccaacaguaagccacccacucuggag

SEQ ID NO: 471357 - RNA, 64 nt, Human
aagcugcuuguccugggccugccccuguguauucaccaccaauaaaucagaccaugaaaccagu

SEQ ID NO: 471358 - RNA, 64 nt, Human
gggcaggucucuugugcccuguucucuuguccccaccaccaaccuauagcaggcaccaaagcaa

SEQ ID NO: 471359 - RNA, 64 nt, Human
uaggcagggcugggaugaggcuuguacaacccccaccaccaauuucccagggacuccagggucc

SEQ ID NO: 471360 - RNA, 64 nt, Human
agcagcacccaguguuggucuguguccaucagugaccaccaacauucuguguucacaugugugg

SEQ ID NO: 471361 - RNA, 64 nt, Human
uaggacagggagacagcacagccaucccuugcaaaccaccaagguguguggcugaccuccaggg

SEQ ID NO: 471362 - RNA, 64 nt, Human
gaaccauggugggggcugccuagugggaguuaggaccaccaauggauuguggaaaauggagcca

SEQ ID NO: 471363 - RNA, 64 nt, Human
cgucagugcacuuguccuuacgucaguuccuuacaccaccaaagcacuucaccuuucuggaaau

SEQ ID NO: 471364 - RNA, 64 nt, Human
uugaagaugacacugacgugaaccaguaucuuuuaccaccaaagucauugcugcgauaugcucu

SEQ ID NO: 471365 - RNA, 64 nt, Human
uagaggugguuaugcugugacgcugcugucucuaaccaccaaguauuuucugcuuaaaaagaaa

SEQ ID NO: 471366 - RNA, 64 nt, Human
ggaaauaucagugaaagcuggacuugagcuguguaccaccaagucaaugauuaugucaugugaa

SEQ ID NO: 471367 - RNA, 64 nt, Human
ccaaaauccagugaagaaacaccacccguccaguaccaccaaaguaguucucugucaugugugu

SEQ ID NO: 471368 - RNA, 64 nt, Human
cauuggagggucuguaaaauauuuuuguucuuuuaccaccaacuuaggggacuguuuuaaagag

SEQ ID NO: 471369 - RNA, 64 nt, Human; identical to SEQ ID NO: 72858

SEQ ID NO: 471370 - RNA, 64 nt, Human; identical to SEQ ID NO: 72859

SEQ ID NO: 471371 - RNA, 64 nt, Human; identical to SEQ ID NO: 72860

SEQ ID NO: 471372 - RNA, 64 nt, Human
accuagguaguccauaggaaccacccccaugaccaccaccaacaucaacuaaagguucuuggag

SEQ ID NO: 471373 - RNA, 64 nt, Human
agcaauuauaagcacaccagauucagggagacugaccaccaagggauaguguaaaaggacauuu

SEQ ID NO: 471374 - RNA, 64 nt, Human
cguccuacuccucacacugcucuacugcucagaaaccaccaagacuguugaugccuuagccuug

SEQ ID NO: 471375 - RNA, 64 nt, Human
cucagccucucaaguagcgggauuacaggcgcccaccaccaaaaauuagcccagcuaauuuuug

SEQ ID NO: 471376 - RNA, 64 nt, Human
acuuccccacccgggaaaggcugccgccaccaccaccaccaacacaacagcaauggcaacaccg

SEQ ID NO: 471377 - RNA, 64 nt, Human
aaaauagcugaggguuguuggcuuguuguagcugaccaccaaaagcagucacugcaaaucuuuu

SEQ ID NO: 471378 - RNA, 64 nt, Human
uaccagucucacaugauuccagccaucaccuuagaccaccaagccuugauugguguugccaguu

SEQ ID NO: 471379 - RNA, 64 nt, Human
ggaaaggcaauaaauccaagaaauugucccaacaaccaccaauucuuacggaggaauauuauuu

SEQ ID NO: 471380 - RNA, 64 nt, Human
accacugaugccucccacugugacaggcccugucaccaccaauaucuuauuucaaccucacagu

SEQ ID NO: 471381 - RNA, 64 nt, Human
ggugggcagcaggggacagggaugggauggcaaaaccaccaacugcccuugguggcaggugggu

SEQ ID NO: 471382 - RNA, 64 nt, Human
cuccuagccccaugugaugugaaaacuaaaaggcaccaccaacuagacauguguucauaaauuc

SEQ ID NO: 471383 - RNA, 64 nt, Human
cuguuauuuugcauauauguucuucauaagcugaaccaccaacagagaaaagcaggccuuugca

SEQ ID NO: 471384 - RNA, 64 nt, Human
auggcuggugccugaagaccccagaugugagggcaccaccaagaauuuguggccuaccuuguga

SEQ ID NO: 471385 - RNA, 64 nt, Human
gguucauggaauucugaucuuggcccauaggugaaccaccaaaauagugcucgagucuuagguu

SEQ ID NO: 471386 - RNA, 63 nt, Human
ucuggguagggaaacaaccaacuaauugacuaacaccaccaacaacaaaaaacaaacccaauc

SEQ ID NO: 471387 - RNA, 64 nt, Human
agaggucgggacagacgacgcuaccugcccagacaccaccaaguucucugccugcaaaaccugg

SEQ ID NO: 471388 - RNA, 64 nt, Human; identical to SEQ ID NO: 72861

SEQ ID NO: 471389 - RNA, 64 nt, Human; identical to SEQ ID NO: 72862

SEQ ID NO: 471390 - RNA, 64 nt, Human; identical to SEQ ID NO: 72863

SEQ ID NO: 471391 - RNA, 64 nt, Human
cccacccucucccaccucaugcuccugcaccugcaccaccaagguugaugccggauucgaagcc

SEQ ID NO: 471392 - RNA, 64 nt, Human
uuccuccaacccauucucucccuaaucccuagaaaccaccaaucugcuguguauuucaucuauu

SEQ ID NO: 471393 - RNA, 64 nt, Human
ccuugggaagaggcaucagccaucuugcuugagaaccaccaagccaaaagcaaaagcuuuuauc

SEQ ID NO: 471394 - RNA, 64 nt, Human
ucccaaauacaguuuccgucgccuugacgacaagaccaccaacguguccuuguacccuggcuac

SEQ ID NO: 471395 - RNA, 64 nt, Human
gagccggaagaucuggcgaagcucaggcaaaaacaccaccaaucacguggaaguuaauuuuaua

SEQ ID NO: 471396 - RNA, 64 nt, Human
cacaaugcuccuccugaugacuccuccccagaaaaccaccaaucggcuuucauuuugcauuuug

SEQ ID NO: 471397 - RNA, 64 nt, Human
aaaaagcaugagcuggccacacauguaauccauaaccaccaaaaauacuauggagagcuacacu

SEQ ID NO: 471398 - RNA, 64 nt, Human
ucuuccugcugcauucucucucucaauuacugggaccaccaagcuaggaaccugggagucaucc

SEQ ID NO: 471399 - RNA, 64 nt, Human
aguggauguauauugcuuuaagcaaucacucauuaccaccaaucugugaaaguaaagcaaaaaa

SEQ ID NO: 471400 - RNA, 64 nt, Human
gccaucuucacuggaggguggggagcuccgugugaccaccaagaugccagcaggauauaccgua

SEQ ID NO: 471401 - RNA, 64 nt, Human
gcuuuuuauagcccagcacagaauuuaaagccauaccaccaaaaguaccuguguguguuaauau

SEQ ID NO: 471402 - RNA, 64 nt, Human
cagcacauugacccauagcacacacauacacaccaccaccaacaacgcuugugaauguauuuuu

SEQ ID NO: 471403 - RNA, 64 nt, Human
uucagacgcugaaacugcugccuuucaggaaagcaccaccaacgcuggaggaggagccggcccu

SEQ ID NO: 471404 - RNA, 64 nt, Human
auguaauuuuguguaagaaauacagacuggauguaccaccaacuacuaccuguaaugacaggcc

SEQ ID NO: 471405 - RNA, 64 nt, Human
uuagugucaucaucuguaagucaggaauaaucauaccaccaacuuccuaugguaauuaggagca

SEQ ID NO: 471406 - RNA, 64 nt, Human
gaccaaggaacuauguacaaaaacaaaccuaccaaccaccaaaaacuagacaaauaaagacaaa

SEQ ID NO: 471407 - RNA, 64 nt, Human; identical to SEQ ID NO: 72921

SEQ ID NO: 471408 - RNA, 64 nt, Human; identical to SEQ ID NO: 72922

SEQ ID NO: 471409 - RNA, 64 nt, Human; identical to SEQ ID NO: 72923

SEQ ID NO: 471410 - RNA, 64 nt, Human
ugccugacagaaagcccguauuuguaagaugcuuaccaccaaauaaauguacauagacugugcu

SEQ ID NO: 471411 - RNA, 64 nt, Human
gacuguguugcuuaaauaucaaguauuguuuauaaccaccaaaaaaaaaaagcccugguaguuu

SEQ ID NO: 471412 - RNA, 64 nt, Human
caagcaaaugcacucugcuuuuugcugcuguaagaccaccaaaaaugagucagaaacacagaag

SEQ ID NO: 471413 - RNA, 64 nt, Human
gguuggguugggcuggauaucuuuguagauguggaccaccaagggguuguugaaaacuaauugu

SEQ ID NO: 471414 - RNA, 64 nt, Human
ugaucaaaagcauucuagccaugugcaaccaaacaccaccaaaaauaaaaucaaacaaaacuaa

SEQ ID NO: 471415 - RNA, 64 nt, Human
uugaacaccacgcuguagucuccaacagaaaaacaccaccaaaacagauacccauguugagggg

SEQ ID NO: 471416 - RNA, 64 nt, Human
ggucauugccuccaugcccuugcuuggcucaagcaccaccaaucgcuuuaaugcuucagccacc

SEQ ID NO: 471417 - RNA, 64 nt, Human
uugcaaaaccucucccacccuuguguuucacuccaccaccaaccccagguaaaaaagucucccu

SEQ ID NO: 471418 - RNA, 64 nt, Human
ccaugugcauaguuucuuuauuuuguguaaaaaaaccaccaaaaacaaaaaccaaauguuuauu

SEQ ID NO: 471419 - RNA, 64 nt, Human
auuauguuuauaaauagacuaacugcuggauguuaccaccaaguaagaaagcaacagguaagau

SEQ ID NO: 471420 - RNA, 64 nt, Human
ugagucaccaucuuaagagaugccucauuuuagaaccaccaacaagcaagcucccaagggaugg

SEQ ID NO: 471421 - RNA, 64 nt, Human
aaaauuucagugacuccagaagaaaugagccuccaccaccaagaaaugaacuuagagaaucaga

SEQ ID NO: 471422 - RNA, 64 nt, Human
cuaucguggaacagccuagaaaccaagggacuccaccaccaagucacuuccccugcucgugcag

SEQ ID NO: 471423 - RNA, 64 nt, Human
gggguggggaggaagccggggcagucaccgagugaccaccaagaggaagacccaccccacggcg

SEQ ID NO: 471424 - RNA, 64 nt, Human
cuaguuuguuauuuuuaaaauguuuauacauaaaaccaccaaaauacauagcuucgacaagaug

SEQ ID NO: 471425 - RNA, 64 nt, Human
agguggaaggggcggggggcggggcagacagcagaccaccaaggguucagggaacaaagaccag

SEQ ID NO: 471426 - RNA, 64 nt, Human; identical to SEQ ID NO: 72865

SEQ ID NO: 471427 - RNA, 64 nt, Human; identical to SEQ ID NO: 72866

SEQ ID NO: 471428 - RNA, 64 nt, Human; identical to SEQ ID NO: 72867

SEQ ID NO: 471429 - RNA, 64 nt, Human
gggcucuaacagugcuuacugcagccuuguguccaccaccaacuucucagcauguuucucuccu

SEQ ID NO: 471430 - RNA, 64 nt, Human
aagagcacaccuaugcugcuuguugcaguaacuaaccaccaauguuaacaucuucauauuuuau

SEQ ID NO: 471431 - RNA, 64 nt, Human
acggucucuuccccugccccaacuggcccucuccaccaccaacuucucuacuuuggguuuguuu

SEQ ID NO: 471432 - RNA, 64 nt, Human
agccaaggaggugaggagcagagcaggcaauuucaccaccaaaugccaagaaaagggcugacau

SEQ ID NO: 471433 - RNA, 64 nt, Human
aauucggucagccugucaggucgugaguccaguuaccaccaaacaucugggaaacuucugggug

SEQ ID NO: 471434 - RNA, 64 nt, Human
cagggcagaagacacugcucuuuguaacccagccaccaccaaaaagcaaacagaaagaaggaag

SEQ ID NO: 471435 - RNA, 64 nt, Human
cggagugugaauuacugaccccaccacacaccggaccaccaagagagccagggcugcuguuucg

SEQ ID NO: 471436 - RNA, 60 nt, Human
cugccgaguuuuucgguugaagugaugcacaccaccaacauucuuggcauuacgcaggcc

SEQ ID NO: 471437 - RNA, 64 nt, Human
ccgugcugggagcagccuccuugggccucaggaaaccaccaagugccucggaugguggcugccc

SEQ ID NO: 471438 - RNA, 64 nt, Human
aacccuccacguagcgaggggcucccugcuggucaccaccaaggguaugagcucucugccucac

SEQ ID NO: 471439 - RNA, 64 nt, Human
uaaauucuccauaaaaguaggaccaacuuacauuaccaccaauaguguaugugagccuuauuuu

SEQ ID NO: 471440 - RNA, 64 nt, Human
cucaggaauucugccuaaguugucugccuuuucuaccaccaaaaagacuuuuaguuuucuaugc

SEQ ID NO: 471441 - RNA, 64 nt, Human
cugaaauuuuauucaaaggaauuguaaaccuuaaaccaccaauuuauuuccaugugaaaaagug

SEQ ID NO: 471442 - RNA, 64 nt, Human
cccacccuuuggaaacuccccauugucacugagaaccaccaaaucugacuuuuacauuuggucu

SEQ ID NO: 471443 - RNA, 64 nt, Human
caccacacagugccagagccagagaaggggccccaccaccaaggccaagcuugaccaggucagc

SEQ ID NO: 471444 - RNA, 64 nt, Human
ccuccugaagccucugggaacuccuccuguggccaccaccaaaggaugaggaaucugaguugcc

SEQ ID NO: 471445 - RNA, 64 nt, Human; identical to SEQ ID NO: 72868

SEQ ID NO: 471446 - RNA, 64 nt, Human; identical to SEQ ID NO: 72869

SEQ ID NO: 471447 - RNA, 64 nt, Human; identical to SEQ ID NO: 72870

SEQ ID NO: 471448 - RNA, 64 nt, Human
uucacaccccaaaaugacccaacgauguccacacaccaccaaaacccagccaaugggccaccuc

SEQ ID NO: 471449 - RNA, 64 nt, Human
gggggaagguaggaggcacaucaauaaagaggaaaccaccaagcugaacugaauuuugccuugu

SEQ ID NO: 471450 - RNA, 64 nt, Human
cauguagaauacccugccuucuugaagcaguuccaccaccaauaugauggggaagggcaggaac

SEQ ID NO: 471451 - RNA, 64 nt, Human
gaauauucucacagagcuaacucaacucaguaagaccaccaaugccaaaguagcacuucgagca

SEQ ID NO: 471452 - RNA, 64 nt, Human
uuuguguauuaauuuuuuuucuuguccauaucacaccaccaaaggcuuuuggaccauuuagcau

SEQ ID NO: 471453 - RNA, 64 nt, Human
aagcagaaaucaccaaguuucccccuuuugaauuaccaccaagaaguguugaaacaccaaauag

SEQ ID NO: 471454 - RNA, 64 nt, Human
uccaucucgcugccgucugucccguucugugucgaccaccaagccucuggcuaccucugucccc

SEQ ID NO: 471455 - RNA, 64 nt, Human
uuaaauaccccacagcaaauagaguaacugacaaaccaccaaaaacugaaaccccagacccacc

SEQ ID NO: 471456 - RNA, 64 nt, Human
acaauauucucucucagaaaucaauggcauuugaaccaccaaaaagaaauaaagggcugagugc

SEQ ID NO: 471457 - RNA, 64 nt, Human
uggccuuacauuaaaaaauuguaaagaaauguauaccaccaauuuagaaauuguugccuuuucu

SEQ ID NO: 471458 - RNA, 64 nt, Human
cccugauaggaagaggggaagcagaaauccaagcaccaccaaacacaguguaugaaggggggcg

SEQ ID NO: 471459 - RNA, 64 nt, Human
ggggagggucguccgguaucccccagugcccaccaccaccaaccagaaucacuucucagacugc

SEQ ID NO: 471460 - RNA, 64 nt, Human
cuguccuggcagggaaacauacaccccuugucucaccaccaaccuugcuuguguagucagcagg

SEQ ID NO: 471461 - RNA, 64 nt, Human
uccuuugugaagaacguagagagaaugcggcauaaccaccaauaaaggagucuugauuuaaccc

SEQ ID NO: 471462 - RNA, 64 nt, Human
aaaaaacacaaucagaaaugacaaaggggacauuaccaccaaccccacagaaauacgaaaaacc

SEQ ID NO: 471463 - RNA, 64 nt, Human
aaggggagaaaacuucagcacgucucaacagaagaccaccaaauggccaauaaguaagugaaaa

SEQ ID NO: 471464 - RNA, 64 nt, Human; identical to SEQ ID NO: 72872

SEQ ID NO: 471465 - RNA, 64 nt, Human; identical to SEQ ID NO: 72873

SEQ ID NO: 471466 - RNA, 64 nt, Human; identical to SEQ ID NO: 72874

SEQ ID NO: 471467 - RNA, 64 nt, Human
cagagaguucacacugaugggaaaugaccaugggaccaccaagcucuaggucauccaucucugc

SEQ ID NO: 471468 - RNA, 64 nt, Human
cacccaaugaugcaaaaaacaaaaacaaaaaaaaaccaccaaauccccaaauucauuccagauc

SEQ ID NO: 471469 - RNA, 64 nt, Human
uuuaaguguaaagaauguggaaaagcauuccgauaccaccaaucugcucaaaaacaugaaaagg

SEQ ID NO: 471470 - RNA, 51 nt, Human
agaucgaccucagugccugagaccaccaacgggacucugggcauggcuggg

SEQ ID NO: 471471 - RNA, 64 nt, Human
ggcccaggggguccagggcggaccuggggccccgaccaccaaggacagcucacgacugccccuu

SEQ ID NO: 471472 - RNA, 64 nt, Human
acugagaugaaaugugguaaaucaacuccacagaaccaccaaaaagaaaaugaggguaauucag

SEQ ID NO: 471473 - RNA, 64 nt, Human
ugugagcuugugcuugugaaagcuaaccaugcuaaccaccaaggcaaagcagcacagugugaau

SEQ ID NO: 471474 - RNA, 64 nt, Human
cauuguguccuggggugacgucccuugugacaacaccaccaagccuggugucuauaccaaaguc

SEQ ID NO: 471475 - RNA, 64 nt, Human
ggcugccagcagcucucuggugcaucgucucaacaccaccaaguuuguaggaccugcccaaguu

SEQ ID NO: 471476 - RNA, 64 nt, Human
ucauccucccaaguaggugggauuacaggugcccaccaccaagcccugcaaauuuuuuuguauu

SEQ ID NO: 471477 - RNA, 64 nt, Human
uggcccaggcuggcccccacccaccuuccuugcgaccaccaacacacaggaacucugugugaga

SEQ ID NO: 471478 - RNA, 64 nt, Human
acgaaugaacgaaacauuggggaucucugccgaaaccaccaaagggcaugucugaugggcacag

SEQ ID NO: 471479 - RNA, 64 nt, Human
agggucuuggugucacugccgcucaugcauagaaaccaccaaaagccccaauaaagcauccagg

SEQ ID NO: 471480 - RNA, 64 nt, Human
caagugguaauucaugaaaaauauccccacuaccaccaccaaggggaagaaaggacucagaaga

SEQ ID NO: 471481 - RNA, 64 nt, Human
acccucuguggcuccccugcaucagcaccgucccaccaccaaguucaccagguucaccagacac

SEQ ID NO: 471482 - RNA, 64 nt, Human
cucuuaagaaaagggaauucucuuuaaagaaaccaccaccaacaacaaaacaaccaaaaaccau

SEQ ID NO: 471483 - RNA, 64 nt, Human; identical to SEQ ID NO: 72788

SEQ ID NO: 471484 - RNA, 64 nt, Human; identical to SEQ ID NO: 72789

SEQ ID NO: 471485 - RNA, 64 nt, Human; identical to SEQ ID NO: 72790

SEQ ID NO: 471486 - RNA, 64 nt, Human
auuacuucuguuuggcuaguuugcuuagcugaucaccaccaacaucauaggucuauaaaucacc

SEQ ID NO: 471487 - RNA, 64 nt, Human
cagcccagagccugccgcuacccucggccugcccaccaccaagcaagcagcaagcaagaugggg

SEQ ID NO: 471488 - RNA, 64 nt, Human
cccccugcggcggaggccaacgcagggcaccaccaccaccaacuugaauuccgucaucaaugcu

SEQ ID NO: 471489 - RNA, 64 nt, Human
uaaagugcucuauuuauuaagaacuauauuuaauaccaccaacaaauauagggguuaaggaaaa

SEQ ID NO: 471490 - RNA, 64 nt, Human
aagcacuauggccuuauaugcagggaaggcacauaccaccaaguucaaugagaaauauuagagc

SEQ ID NO: 471491 - RNA, 64 nt, Human
ucagccuccugaguagcugggacuacaggcaugcaccaccaagcuuggcuaauuuaaaaaaaaa

SEQ ID NO: 471492 - RNA, 64 nt, Human
cauacccacuucacacacacacaucccaaauaccaccaccaaccaccuucuuccucucaacucu

SEQ ID NO: 471493 - RNA, 64 nt, Human
ggccggccccacugcccccccauucuaugccccaaccaccaaggcuuucccaucuuggggccuu

SEQ ID NO: 471494 - RNA, 64 nt, Human
uucuugcugcuccuggcguggaaacuuaagugagaccaccaaauacauugguccuguccaauuc

SEQ ID NO: 471495 - RNA, 64 nt, Human
cuguucuuaugcucucugcucacugguuuucaauaccaccaagaggaaaauauugacaaguuua

SEQ ID NO: 471496 - RNA, 64 nt, Human
ccccgaaagacccuggaaagucccugccaccuguaccaccaaugggccugcccccaccccagga

SEQ ID NO: 471497 - RNA, 64 nt, Human
cuggcuugaaccuucaaagcuuuuguaaaauaaaaccaccaaaguccugaaauugugggugugu

SEQ ID NO: 471498 - RNA, 64 nt, Human
cauccaucaucuccuuuggcugcuguaacaaauuaccaccaauaauaugauggcuuaacacaac

SEQ ID NO: 471499 - RNA, 64 nt, Human
acccccaaaagaugugcaauagcuguuguuacaaaccaccaaauaauacaguugugagccugaa

SEQ ID NO: 471500 - RNA, 64 nt, Human
ccaccuugaugucugcugugacaucagaggugccaccaccaaagcacucuucccacccuagucu

SEQ ID NO: 471501 - RNA, 64 nt, Human
guugggaccugagggacagaggaucggaauggaaaccaccaacgugcacuggcacccucagaag

SEQ ID NO: 471502 - RNA, 64 nt, Human; identical to SEQ ID NO: 72791

SEQ ID NO: 471503 - RNA, 64 nt, Human; identical to SEQ ID NO: 72792

SEQ ID NO: 471504 - RNA, 64 nt, Human; identical to SEQ ID NO: 72793

SEQ ID NO: 471505 - RNA, 64 nt, Human
aauuuggacauuauuucguguuguguucuuuauaaccaccaaguauuaaacuguaaaucauaau

SEQ ID NO: 471506 - RNA, 64 nt, Human
uuaaacauggagaaaccaaauuggacaaauccucaccaccaacggugaugauuacaauaaaauc

SEQ ID NO: 471507 - RNA, 64 nt, Human
uaaguccccaacccuuacagacaccacugccaccaccaccaaccacgaccaccaccaccaccac

SEQ ID NO: 471508 - RNA, 64 nt, Human
ucacuuaaaaauuaaaaacaucaguacuaccaccaccaccaacaacaucaacacagaucuucac

SEQ ID NO: 471509 - RNA, 64 nt, Human; identical to SEQ ID NO: 420012

SEQ ID NO: 471510 - RNA, 64 nt, Human; identical to SEQ ID NO: 420013

SEQ ID NO: 471511 - RNA, 64 nt, Human; identical to SEQ ID NO: 420032

SEQ ID NO: 471512 - RNA, 64 nt, Human; identical to SEQ ID NO: 420033

SEQ ID NO: 471513 - RNA, 64 nt, Human; identical to SEQ ID NO: 72795

SEQ ID NO: 471514 - RNA, 64 nt, Human; identical to SEQ ID NO: 72796

SEQ ID NO: 471515 - RNA, 64 nt, Human; identical to SEQ ID NO: 72797

SEQ ID NO: 471516 - RNA, 64 nt, Human; identical to SEQ ID NO: 419450

SEQ ID NO: 471517 - RNA, 64 nt, Human; identical to SEQ ID NO: 420071

SEQ ID NO: 471518 - RNA, 64 nt, Human; identical to SEQ ID NO: 420072

SEQ ID NO: 471519 - RNA, 64 nt, Human; identical to SEQ ID NO: 420089

SEQ ID NO: 471520 - RNA, 64 nt, Human; identical to SEQ ID NO: 420090

SEQ ID NO: 471521 - RNA, 64 nt, Human; identical to SEQ ID NO: 419451

SEQ ID NO: 471522 - RNA, 64 nt, Human; identical to SEQ ID NO: 420091

SEQ ID NO: 471523 - RNA, 64 nt, Human; identical to SEQ ID NO: 420092

SEQ ID NO: 471524 - RNA, 64 nt, Human; identical to SEQ ID NO: 420189

SEQ ID NO: 471525 - RNA, 64 nt, Human; identical to SEQ ID NO: 420190

SEQ ID NO: 471526 - RNA, 64 nt, Human; identical to SEQ ID NO: 419452

SEQ ID NO: 471527 - RNA, 64 nt, Human; identical to SEQ ID NO: 420109

SEQ ID NO: 471528 - RNA, 64 nt, Human; identical to SEQ ID NO: 420110

SEQ ID NO: 471529 - RNA, 64 nt, Human; identical to SEQ ID NO: 420111

SEQ ID NO: 471530 - RNA, 64 nt, Human; identical to SEQ ID NO: 420112

SEQ ID NO: 471531 - RNA, 64 nt, Human; identical to SEQ ID NO: 72798

SEQ ID NO: 471532 - RNA, 64 nt, Human; identical to SEQ ID NO: 72799

SEQ ID NO: 471533 - RNA, 64 nt, Human; identical to SEQ ID NO: 72800

SEQ ID NO: 471534 - RNA, 64 nt, Human; identical to SEQ ID NO: 419934

SEQ ID NO: 471535 - RNA, 64 nt, Human; identical to SEQ ID NO: 419935

SEQ ID NO: 471536 - RNA, 64 nt, Human; identical to SEQ ID NO: 419469

SEQ ID NO: 471537 - RNA, 64 nt, Human; identical to SEQ ID NO: 420149

SEQ ID NO: 471538 - RNA, 64 nt, Human; identical to SEQ ID NO: 420150

SEQ ID NO: 471539 - RNA, 64 nt, Human; identical to SEQ ID NO: 420151

SEQ ID NO: 471540 - RNA, 58 nt, Human; identical to SEQ ID NO: 420152

SEQ ID NO: 471541 - RNA, 64 nt, Human; identical to SEQ ID NO: 420191

SEQ ID NO: 471542 - RNA, 64 nt, Human; identical to SEQ ID NO: 420192

SEQ ID NO: 471543 - RNA, 64 nt, Human; identical to SEQ ID NO: 419470

SEQ ID NO: 471544 - RNA, 64 nt, Human; identical to SEQ ID NO: 420169

SEQ ID NO: 471545 - RNA, 64 nt, Human; identical to SEQ ID NO: 420170

SEQ ID NO: 471546 - RNA, 64 nt, Human; identical to SEQ ID NO: 420171

SEQ ID NO: 471547 - RNA, 64 nt, Human; identical to SEQ ID NO: 420172

SEQ ID NO: 471548 - RNA, 64 nt, Human; identical to SEQ ID NO: 420209

SEQ ID NO: 471549 - RNA, 64 nt, Human; identical to SEQ ID NO: 72802

SEQ ID NO: 471550 - RNA, 64 nt, Human; identical to SEQ ID NO: 72803

SEQ ID NO: 471551 - RNA, 64 nt, Human; identical to SEQ ID NO: 72804

SEQ ID NO: 471552 - RNA, 64 nt, Human; identical to SEQ ID NO: 420210

SEQ ID NO: 471553 - RNA, 64 nt, Human; identical to SEQ ID NO: 419471

SEQ ID NO: 471554 - RNA, 64 nt, Human; identical to SEQ ID NO: 420211

SEQ ID NO: 471555 - RNA, 64 nt, Human; identical to SEQ ID NO: 420212

SEQ ID NO: 471556 - RNA, 64 nt, Human; identical to SEQ ID NO: 419970

SEQ ID NO: 471557 - RNA, 64 nt, Human; identical to SEQ ID NO: 419971

SEQ ID NO: 471558 - RNA, 64 nt, Human; identical to SEQ ID NO: 419488

SEQ ID NO: 471559 - RNA, 64 nt, Human; identical to SEQ ID NO: 420412

SEQ ID NO: 471560 - RNA, 64 nt, Human; identical to SEQ ID NO: 419936

SEQ ID NO: 471561 - RNA, 64 nt, Human; identical to SEQ ID NO: 419489

SEQ ID NO: 471562 - RNA, 64 nt, Human; identical to SEQ ID NO: 419782

SEQ ID NO: 471563 - RNA, 50 nt, Human; identical to SEQ ID NO: 419783

SEQ ID NO: 471564 - RNA, 64 nt, Human; identical to SEQ ID NO: 419784

SEQ ID NO: 471565 - RNA, 64 nt, Human; identical to SEQ ID NO: 419801

SEQ ID NO: 471566 - RNA, 64 nt, Human; identical to SEQ ID NO: 419802

SEQ ID NO: 471567 - RNA, 64 nt, Human; identical to SEQ ID NO: 72805

SEQ ID NO: 471568 - RNA, 64 nt, Human; identical to SEQ ID NO: 72806

SEQ ID NO: 471569 - RNA, 64 nt, Human; identical to SEQ ID NO: 72807

SEQ ID NO: 471570 - RNA, 64 nt, Human; identical to SEQ ID NO: 419490

SEQ ID NO: 471571 - RNA, 64 nt, Human; identical to SEQ ID NO: 419803

SEQ ID NO: 471572 - RNA, 64 nt, Human; identical to SEQ ID NO: 419820

SEQ ID NO: 471573 - RNA, 64 nt, Human; identical to SEQ ID NO: 419821

SEQ ID NO: 471574 - RNA, 64 nt, Human; identical to SEQ ID NO: 419507

SEQ ID NO: 471575 - RNA, 64 nt, Human; identical to SEQ ID NO: 419839

SEQ ID NO: 471576 - RNA, 64 nt, Human; identical to SEQ ID NO: 419840

SEQ ID NO: 471577 - RNA, 64 nt, Human; identical to SEQ ID NO: 419841

SEQ ID NO: 471578 - RNA, 64 nt, Human; identical to SEQ ID NO: 419877

SEQ ID NO: 471579 - RNA, 64 nt, Human; identical to SEQ ID NO: 419878

SEQ ID NO: 471580 - RNA, 64 nt, Human; identical to SEQ ID NO: 419508

SEQ ID NO: 471581 - RNA, 64 nt, Human; identical to SEQ ID NO: 419858

SEQ ID NO: 471582 - RNA, 64 nt, Human; identical to SEQ ID NO: 419859

SEQ ID NO: 471583 - RNA, 64 nt, Human; identical to SEQ ID NO: 419860

SEQ ID NO: 471584 - RNA, 64 nt, Human; identical to SEQ ID NO: 419972

SEQ ID NO: 471585 - RNA, 64 nt, Human; identical to SEQ ID NO: 72809

SEQ ID NO: 471586 - RNA, 64 nt, Human; identical to SEQ ID NO: 72810

SEQ ID NO: 471587 - RNA, 64 nt, Human; identical to SEQ ID NO: 72811

SEQ ID NO: 471588 - RNA, 64 nt, Human; identical to SEQ ID NO: 419973

SEQ ID NO: 471589 - RNA, 64 nt, Human; identical to SEQ ID NO: 419509

SEQ ID NO: 471590 - RNA, 64 nt, Human; identical to SEQ ID NO: 419879

SEQ ID NO: 471591 - RNA, 64 nt, Human; identical to SEQ ID NO: 419896

SEQ ID NO: 471592 - RNA, 64 nt, Human; identical to SEQ ID NO: 419897

SEQ ID NO: 471593 - RNA, 64 nt, Human; identical to SEQ ID NO: 419526

SEQ ID NO: 471594 - RNA, 64 nt, Human; identical to SEQ ID NO: 419915

SEQ ID NO: 471595 - RNA, 64 nt, Human; identical to SEQ ID NO: 419916

SEQ ID NO: 471596 - RNA, 64 nt, Human; identical to SEQ ID NO: 419917

SEQ ID NO: 471597 - RNA, 64 nt, Human; identical to SEQ ID NO: 419674

SEQ ID NO: 471598 - RNA, 64 nt, Human; identical to SEQ ID NO: 419675

SEQ ID NO: 471599 - RNA, 64 nt, Human; identical to SEQ ID NO: 419527

SEQ ID NO: 471600 - RNA, 64 nt, Human; identical to SEQ ID NO: 419951

SEQ ID NO: 471601 - RNA, 64 nt, Human; identical to SEQ ID NO: 419952

SEQ ID NO: 471602 - RNA, 64 nt, Human; identical to SEQ ID NO: 419953

SEQ ID NO: 471603 - RNA, 64 nt, Human; identical to SEQ ID NO: 72812

SEQ ID NO: 471604 - RNA, 64 nt, Human; identical to SEQ ID NO: 72813

SEQ ID NO: 471605 - RNA, 50 nt, Human; identical to SEQ ID NO: 72814

SEQ ID NO: 471606 - RNA, 64 nt, Human; identical to SEQ ID NO: 419990

SEQ ID NO: 471607 - RNA, 64 nt, Human; identical to SEQ ID NO: 419991

SEQ ID NO: 471608 - RNA, 64 nt, Human; identical to SEQ ID NO: 419528

SEQ ID NO: 471609 - RNA, 64 nt, Human; identical to SEQ ID NO: 419992

SEQ ID NO: 471610 - RNA, 64 nt, Human; identical to SEQ ID NO: 419993

SEQ ID NO: 471611 - RNA, 64 nt, Human; identical to SEQ ID NO: 419725

SEQ ID NO: 471612 - RNA, 64 nt, Human; identical to SEQ ID NO: 419726

SEQ ID NO: 471613 - RNA, 64 nt, Human; identical to SEQ ID NO: 419545

SEQ ID NO: 471614 - RNA, 64 nt, Human; identical to SEQ ID NO: 420131

SEQ ID NO: 471615 - RNA, 64 nt, Human; identical to SEQ ID NO: 420132

SEQ ID NO: 471616 - RNA, 64 nt, Human; identical to SEQ ID NO: 419676

SEQ ID NO: 471617 - RNA, 64 nt, Human; identical to SEQ ID NO: 419546

SEQ ID NO: 471618 - RNA, 64 nt, Human; identical to SEQ ID NO: 420451

SEQ ID NO: 471619 - RNA, 64 nt, Human; identical to SEQ ID NO: 420452

SEQ ID NO: 471620 - RNA, 64 nt, Human; identical to SEQ ID NO: 419582

SEQ ID NO: 471621 - RNA, 64 nt, Human; identical to SEQ ID NO: 72875

SEQ ID NO: 471622 - RNA, 64 nt, Human; identical to SEQ ID NO: 72876

SEQ ID NO: 471623 - RNA, 64 nt, Human; identical to SEQ ID NO: 72877

SEQ ID NO: 471624 - RNA, 64 nt, Human; identical to SEQ ID NO: 419583

SEQ ID NO: 471625 - RNA, 64 nt, Human; identical to SEQ ID NO: 419547

SEQ ID NO: 471626 - RNA, 64 nt, Human; identical to SEQ ID NO: 419584

SEQ ID NO: 471627 - RNA, 64 nt, Human; identical to SEQ ID NO: 419601

SEQ ID NO: 471628 - RNA, 64 nt, Human; identical to SEQ ID NO: 419602

SEQ ID NO: 471629 - RNA, 64 nt, Human; identical to SEQ ID NO: 419603

SEQ ID NO: 471630 - RNA, 64 nt, Human; identical to SEQ ID NO: 419620

SEQ ID NO: 471631 - RNA, 64 nt, Human; identical to SEQ ID NO: 419621

SEQ ID NO: 471632 - RNA, 64 nt, Human; identical to SEQ ID NO: 419622

SEQ ID NO: 471633 - RNA, 64 nt, Human; identical to SEQ ID NO: 419639

SEQ ID NO: 471634 - RNA, 64 nt, Human; identical to SEQ ID NO: 419640

SEQ ID NO: 471635 - RNA, 64 nt, Human; identical to SEQ ID NO: 419641

SEQ ID NO: 471636 - RNA, 64 nt, Human; identical to SEQ ID NO: 72816

SEQ ID NO: 471637 - RNA, 64 nt, Human; identical to SEQ ID NO: 72817

SEQ ID NO: 471638 - RNA, 64 nt, Human; identical to SEQ ID NO: 72818

SEQ ID NO: 471639 - RNA, 64 nt, Human
ugcuaaagaaucuuuuuuccccucucccccuuccugacccuacuugcacugcuguggauuuuuu

SEQ ID NO: 471640 - RNA, 64 nt, Human
guuaucuauauuuuaaaugcuuuuugcccaacacugacccuauguucaacuuugugucauuuac

SEQ ID NO: 471641 - RNA, 64 nt, Human
cacaggacagugggaguuacaguucauaucaggaugacccuacauacccaggucagauugacgg

SEQ ID NO: 471642 - RNA, 64 nt, Human
aucuucacuucucagugggauuuuguccuuugcaugacccuacuuucagcagggcuuugaggcu

SEQ ID NO: 471643 - RNA, 64 nt, Human
ggaggaugugucucuucugaccugcacucuugccugacccuagaauggggacagggaaagugaa

SEQ ID NO: 471644 - RNA, 64 nt, Human
uaauaguaaaucguucuccuuacaaucaaguucuugacccuauucggccuuauacaucuggucu

SEQ ID NO: 471645 - RNA, 64 nt, Human
cuuguccagccucuggucagaggauguggccaccugacccuaaauagguuccccagaguccugc

SEQ ID NO: 471646 - RNA, 64 nt, Human
uguugaugaaugagagacucccugacugcucagaugacccuagccacacugaaagggcaccuac

SEQ ID NO: 471647 - RNA, 64 nt, Human
cuuuuuuaggauguugguuccugcaaacaagaacugacccuaucaccucugccucacagugggu

SEQ ID NO: 471648 - RNA, 53 nt, Human; identical to SEQ ID NO: 72819

SEQ ID NO: 471649 - RNA, 64 nt, Human; identical to SEQ ID NO: 72820

SEQ ID NO: 471650 - RNA, 64 nt, Human; identical to SEQ ID NO: 72821

SEQ ID NO: 471651 - RNA, 64 nt, Human
guaacccaguauaauuuucugacagguuggacuuugacccuaauggacuuacuggugaacuuuu

SEQ ID NO: 471652 - RNA, 64 nt, Human
gggaucuccauguuuggacuaugggacagagaauugacccuaacuaacuaacuaugaacuauuu

SEQ ID NO: 471653 - RNA, 64 nt, Human
gugaacccaaccaacaaugucgucaucuaagcccugacccuagccagggacucccaugcugcug

SEQ ID NO: 471654 - RNA, 64 nt, Human
cucaggagccccuuccuggggacagugaggacaaugacccuacagaugcucagcuacauccggc

SEQ ID NO: 471655 - RNA, 64 nt, Human
uuaguguuuagcauuaaaaauaaaaguuguaccuugacccuagaauuccuuuuauaagauuuaa

SEQ ID NO: 471656 - RNA, 64 nt, Human
ccgccuuugaacaaucaugcuucagaaaucugccugacccuagcugcugcugcugcucacuuua

SEQ ID NO: 471657 - RNA, 64 nt, Human
uaugugacuuuuuaaaaaagcugucaaauaggugugacccuacuaauaauuauuagaaauacau

SEQ ID NO: 471658 - RNA, 64 nt, Human
aagagggcugugaaagauuuuugauagugaaucaugacccuaagggagagauuugugugauaaa

SEQ ID NO: 471659 - RNA, 64 nt, Human
ccugcuuacgaaguauucccaaucacuggucaucugacccuacuugaacacuccugaacaguca

SEQ ID NO: 471660 - RNA, 64 nt, Human
acuccucuuaccccagcaaauaaaaggaauugucugacccuagaggcagaugcugcacugcacu

SEQ ID NO: 471661 - RNA, 64 nt, Human
cucagcuguacgaaaaagagcauauacugguuauugacccuaucuucucauuguuuguuuguaa

SEQ ID NO: 471662 - RNA, 64 nt, Human
uuacacacuagcauauaggaaauauuucugcacuugacccuauuugaauucugagcauuauuua

SEQ ID NO: 471663 - RNA, 64 nt, Human
auucaccauuugugaggagaaauacuaacuggacugacccuauugcuaggcuuaaauacuuauu

SEQ ID NO: 471664 - RNA, 64 nt, Human
aauuugucacucggaacuucaggauggaggacccugacccuaaaccuccuucagaucucuggcc

SEQ ID NO: 471665 - RNA, 64 nt, Human
ggggaaggaggguacagcugggcuggggaggaccugacccuacucccuugcccuagauaguuua

SEQ ID NO: 471666 - RNA, 64 nt, Human; identical to SEQ ID NO: 72823

SEQ ID NO: 471667 - RNA, 64 nt, Human; identical to SEQ ID NO: 72824

SEQ ID NO: 471668 - RNA, 64 nt, Human; identical to SEQ ID NO: 72825

SEQ ID NO: 471669 - RNA, 64 nt, Human
caugacaaaaaggccaagagaaucacagagucauugacccuaucauuauuucaccaagccaaua

SEQ ID NO: 471670 - RNA, 64 nt, Human
aaaaacaagaugaccagauuugaucucagccugaugacccuacaggucgugcuaugauauggag

SEQ ID NO: 471671 - RNA, 64 nt, Human
guucuagaacuagcucugcccuuagcccccuguaugacccuaugcaaguccuccucccucaucu

SEQ ID NO: 471672 - RNA, 64 nt, Human
cauccccaugugaccaucucaccucauaaucaaaugacccuaaaucccucauuaaccuaccccu

SEQ ID NO: 471673 - RNA, 64 nt, Human
gguucaagucccaccucugccacuaacuggcaugugacccuaucuauccuucacugcucugagc

SEQ ID NO: 471674 - RNA, 64 nt, Human
auugacuauaacauguaaguaaauagcuuucuacugacccuaaguuaucaagguggaaaaaaaa

SEQ ID NO: 471675 - RNA, 64 nt, Human
gcacuuacauuuaucccuuacauuuuguuuuuagugacccuacaugacauuaaauuuaaaguaa

SEQ ID NO: 471676 - RNA, 56 nt, Human
cagaugaggcuaagcugugagcacccugacccuauucagcagagaugcagcucugg

SEQ ID NO: 471677 - RNA, 64 nt, Human
aguugaaggcagcauuccucagcucugugacuugugacccuauuugaaguuucaggauuugggu

SEQ ID NO: 471678 - RNA, 64 nt, Human
aauuuaagggaagaagcaaaagcuaaacugucuuugacccuaagauagauagaaagcuauuuau

SEQ ID NO: 471679 - RNA, 64 nt, Human
accuuuuccugcuuugugccuugauuaaggcuacugacccuaaauuucugaagcacagccaaga

SEQ ID NO: 471680 - RNA, 64 nt, Human
auuguacuguauguggcuuuuugaagucuucccuugacccuaguaaaauauagcuugaaacuug

SEQ ID NO: 471681 - RNA, 64 nt, Human
uccagcaacuauagaccaaaguuugcuuaagguuugacccuagagcagaggugggcaaacuaug

SEQ ID NO: 471682 - RNA, 64 nt, Human
cugcuuuacugagacccuaggccggucuccuugcugacccuagcgcugcugccuaggugccauu

SEQ ID NO: 471683 - RNA, 64 nt, Human
augggaccuuuccccuccuccaucagaggugcucugacccuagguuacacgggaaagugcccca

SEQ ID NO: 471684 - RNA, 64 nt, Human; identical to SEQ ID NO: 72767

SEQ ID NO: 471685 - RNA, 64 nt, Human; identical to SEQ ID NO: 72768

SEQ ID NO: 471686 - RNA, 64 nt, Human; identical to SEQ ID NO: 72769

SEQ ID NO: 471687 - RNA, 64 nt, Human
auagauccuguuuuuccaucugugucccagauugugacccuagacuuucaauugacaaguaaaa

SEQ ID NO: 471688 - RNA, 64 nt, Human
auguagguaugcugcaaggcuuuuacauugaauuugacccuacaucacuucaagacuaaugcau

SEQ ID NO: 471689 - RNA, 64 nt, Human
aucucuaggaccggaacuaccuucucuucugucaugacccuaucuaggguggugaaaugccuga

SEQ ID NO: 471690 - RNA, 64 nt, Human
caggaaugcugaauaugggaagcaggggugcuugugacccuaauaaauuccaaguccucuuccc

SEQ ID NO: 471691 - RNA, 64 nt, Human
gauaagaggacugggaauaaagucagauguaaugugacccuagaaaacuguagcaagcuucaga

SEQ ID NO: 471692 - RNA, 64 nt, Human
aucacuggcucucuaauuccacuuguucauucugugacccuaguuauuuucugaaaaauugguu

SEQ ID NO: 471693 - RNA, 63 nt, Human
acaugaaccucgaguucugacuuugguaaagucugacccuagucugcugcugaagucugaacu

SEQ ID NO: 471694 - RNA, 64 nt, Human
ucguagugguggaguuggaguuugaacacaggccugacccuagaguccacacccugacccaauc

SEQ ID NO: 471695 - RNA, 64 nt, Human
ugcccaguuccccccauccuacuccuaacagaugugacccuacuugaggccgccuuggcuuuug

SEQ ID NO: 471696 - RNA, 64 nt, Human
uuucauccccuauggaugacggagagcuuacagaugacccuauugaaugcaagcaccuuuggug

SEQ ID NO: 471697 - RNA, 64 nt, Human
aguuauguuauggaccaaaagccaaaucuccaucugacccuacauaauuuuagcaauagaacuu

SEQ ID NO: 471698 - RNA, 64 nt, Human
uauuaacuauauugaacauuuuuuccuuugccuuugacccuauguauaguuacgaugccagauu

SEQ ID NO: 471699 - RNA, 64 nt, Human
gcauauacaauaauguaauuuagucuaacacaguugacccuauuuuuugacacuuccauuguuu

SEQ ID NO: 471700 - RNA, 64 nt, Human
gaggacccaguguucuuagcugaacaaugaaugcugacccuaaauguggacaucaugaagcauc

SEQ ID NO: 471701 - RNA, 64 nt, Human
cagauauccacacaccccagcccugcaguguagcugacccuaaugugacggucauacugucggu

SEQ ID NO: 471702 - RNA, 64 nt, Human; identical to SEQ ID NO: 72770

SEQ ID NO: 471703 - RNA, 64 nt, Human; identical to SEQ ID NO: 72771

SEQ ID NO: 471704 - RNA, 58 nt, Human; identical to SEQ ID NO: 72772

SEQ ID NO: 471705 - RNA, 64 nt, Human
cuaaguaacuaacucuuuggaucucccuuuaaagugacccuaaucuggcugcauugauggccag

SEQ ID NO: 471706 - RNA, 64 nt, Human
aaaugucuaguuuuauuuguauaggaaauuucccugacccuaaauaauacauuuugaaaugaaa

SEQ ID NO: 471707 - RNA, 64 nt, Human
uggauuguacuucucuucugaaaagugugcuuuuugacccuacuggacauuuauugacuuaauu

SEQ ID NO: 471708 - RNA, 64 nt, Human
agcccauagagugcauucccaaauucuaaauagcugacccuaaauucauuuuucaugcuuaaaa

SEQ ID NO: 471709 - RNA, 64 nt, Human
uuggauugagaauugcagaugugacagaauggauugacccuaguugguugguauugaugacuuc

SEQ ID NO: 471710 - RNA, 64 nt, Human
ugaggagagcuagagucccagcaaagggugcagcugacccuagcacuggcugugacaugcugcu

SEQ ID NO: 471711 - RNA, 64 nt, Human
ugccuuuaaaauuaaauaauauaacgugaauaaaugacccuaucuuuguaacugcaggugguuu

SEQ ID NO: 471712 - RNA, 64 nt, Human
aaguaggcuaucacccaaagcaaacauccuuaacugacccuaacguguauggauucaacuuuga

SEQ ID NO: 471713 - RNA, 64 nt, Human
gaaaacuaggucauuaucuagaugauuucagacuugacccuaauugaccauauaugaccaggaa

SEQ ID NO: 471714 - RNA, 64 nt, Human
agcaauaaucucaaaaagcaauuaaauaguuaaaugacccuaauuguaauuacuguggaugguu

SEQ ID NO: 471715 - RNA, 64 nt, Human
uugauucuuggccugggugguagaggagauauccugacccuaaagucuuccagccccgggucau

SEQ ID NO: 471716 - RNA, 64 nt, Human
gaugacuaaauuucaguagcuacuuucauuggauugacccuacaacugcccugggacauuucac

SEQ ID NO: 471717 - RNA, 64 nt, Human
uuguaaucgugugccauggaucugaucuguaccaugacccuacauaaggcuggauggcaccuca

SEQ ID NO: 471718 - RNA, 64 nt, Human
uacuugcaugccaugguuguacaguagcagacuaugacccuauugugauauuaaguguuuauuu

SEQ ID NO: 471719 - RNA, 64 nt, Human
caaacagcagaagaccaaggcaucagaucuguaaugacccuaaaguuaguguggugcuccaagc

SEQ ID NO: 471720 - RNA, 64 nt, Human; identical to SEQ ID NO: 72826

SEQ ID NO: 471721 - RNA, 64 nt, Human; identical to SEQ ID NO: 72827

SEQ ID NO: 471722 - RNA, 64 nt, Human; identical to SEQ ID NO: 72828

SEQ ID NO: 471723 - RNA, 64 nt, Human
gaucauacaaauaaucuaagauuuuacagucuggugacccuagauuacacaaguaaucuaagcu

SEQ ID NO: 471724 - RNA, 64 nt, Human
aagaccauugaauucuugguugaggaaacaaacaugacccuaaaucuugacuacagucaggaaa

SEQ ID NO: 471725 - RNA, 64 nt, Human
augucuacuuuuccuguuuucucuuggggacuuuugacccuagaguagcccugguguuauauuu

SEQ ID NO: 471726 - RNA, 64 nt, Human
auggggaaucccagcuuucuuuucuacuagcaaaugacccuaccauuuauuucugccuuuuucu

SEQ ID NO: 471727 - RNA, 64 nt, Human
uugcuuuuaaaaucagaaggcuauauuauucuaaugacccuauucgaucuaaauggguuugaga

SEQ ID NO: 471728 - RNA, 64 nt, Human
gguggcccuccucagacaauuuaucucccagcaaugacccuacuacacucgcguacugugaauu

SEQ ID NO: 471729 - RNA, 64 nt, Human
accaguccccacuuacuguccuaacucuccucgcugacccuaucugggagcccggaaccguuag

SEQ ID NO: 471730 - RNA, 64 nt, Human
ccuuuucuggcaaaaaggagccuuuugcucucugugacccuaagagcacacugcacagggaaaa

SEQ ID NO: 471731 - RNA, 64 nt, Human
cacugccgcagcucuuuccacacggggccgugauugacccuaaaaauugcagaccagcacauac

SEQ ID NO: 471732 - RNA, 64 nt, Human
cccuugugucucauauacccuauccugguggaaaugacccuauuugauaugcugucccuuaaaa

SEQ ID NO: 471733 - RNA, 64 nt, Human
uuuuuguuuuguuuuuuuccuuuuuccuccccuuugacccuauucaugucucuacccacuaugc

SEQ ID NO: 471734 - RNA, 64 nt, Human
cugcugugccagaccagaguuuccugaggggcccugacccuaacccuccagcucagcccuguac

SEQ ID NO: 471735 - RNA, 64 nt, Human
augacugcauucaacggggccauggcaggaaagcugacccuacccaggaaaguaauagcuucuu

SEQ ID NO: 471736 - RNA, 64 nt, Human
ugauggauugaaaaauauaaguaauuuggcauauugacccuauauaaaaaagugggcauuuugu

SEQ ID NO: 471737 - RNA, 64 nt, Human
gagaugcuaaagcugacccacugguugaaaauguugacccuauccuguuauuuaaaugugaaca

SEQ ID NO: 471738 - RNA, 64 nt, Human; identical to SEQ ID NO: 72830

SEQ ID NO: 471739 - RNA, 64 nt, Human; identical to SEQ ID NO: 72831

SEQ ID NO: 471740 - RNA, 64 nt, Human; identical to SEQ ID NO: 72832

SEQ ID NO: 471741 - RNA, 64 nt, Human
augcacugugauaccuaccagucuccagggacuaugacccuaaaccagggccugcggcacuugc

SEQ ID NO: 471742 - RNA, 64 nt, Human
uguuuagaaggguucaggacuuugugaguuagcaugacccuaaaauucuaggggauuucuggug

SEQ ID NO: 471743 - RNA, 64 nt, Human
ggaugauguguuuucagauuuccaggugaaguucugacccuaccuguuuggccaaagacguaaa

SEQ ID NO: 471744 - RNA, 64 nt, Human
auguaagucucaacucuguccccaggaaguugugugacccuaggccucucaccucugugccucu

SEQ ID NO: 471745 - RNA, 55 nt, Human
guuuccauaggcuccauuagaacugugacccuagucaccagaauucaggacuguc

SEQ ID NO: 471746 - RNA, 64 nt, Human
gacuaucuugaagaacccuuucaacucuaaaaauugacccuaucaacuggagagcccacaaggc

SEQ ID NO: 471747 - RNA, 64 nt, Human
acaaaaaagaaaaaaacaauccccagggguucuaugacccuauugacuccuacaguucuuuccc

SEQ ID NO: 471748 - RNA, 64 nt, Human
aaauccucuccagaaucuuggaacaccuggcaugugacccuagugacgucacagaccugagaug

SEQ ID NO: 471749 - RNA, 64 nt, Human
uggagggcugguauugaguuguggacaucacuguugacccuaccucacgugccgagacucucau

SEQ ID NO: 471750 - RNA, 64 nt, Human
ucccagaacaggacgacagugaaaagaacacucuugacccuacacugaaggcugaaggcagaag

SEQ ID NO: 471751 - RNA, 64 nt, Human
ucccuggauuucagggacuuggugggccucccguugacccuauguagcugcuauaaaguuaagu

SEQ ID NO: 471752 - RNA, 64 nt, Human
gccuuuugcucaguuccauggcaauuuuguaaauugacccuagccagagaauagaucaguauuu

SEQ ID NO: 471753 - RNA, 64 nt, Human
ugaguagaccagugaugaguggcccaggacucuaugacccuacaaccaucaugaaugcagauau

SEQ ID NO: 471754 - RNA, 60 nt, Human
uugcauuuaagcaggaguaaaggaagaaagugacccuagggaaguaauggauuuuuuuuu

SEQ ID NO: 471755 - RNA, 64 nt, Human
cggggcuuugcccugcugcuguccucucgugugaugacccuauugaguaucaguagccacuacu

SEQ ID NO: 471756 - RNA, 64 nt, Human; identical to SEQ ID NO: 72774

SEQ ID NO: 471757 - RNA, 64 nt, Human; identical to SEQ ID NO: 72775

SEQ ID NO: 471758 - RNA, 64 nt, Human; identical to SEQ ID NO: 72776

SEQ ID NO: 471759 - RNA, 64 nt, Human
uauuuuauuucguugaugcuuuuguucccaagugugacccuaaacuuaagcuuuguaggaguug

SEQ ID NO: 471760 - RNA, 64 nt, Human
uuauuuugcaaccauucuacuugugaaaucacgcugacccuagccugucucuggcuaaccacac

SEQ ID NO: 471761 - RNA, 64 nt, Human
gcuucccuuggcacaccaguguucuccugccaaaugacccuagacccucuguccugcagaguca

SEQ ID NO: 471762 - RNA, 64 nt, Human
uguauugcauuucuuugcacauauuaugggcuugugacccuaaacuugcaggcaagguuagcug

SEQ ID NO: 471763 - RNA, 64 nt, Human
ucagaagaccaugcagaaguuacuguaucucuugugacccuaaugaaagaauguauaugauccu

SEQ ID NO: 471764 - RNA, 64 nt, Human
uugaaaaaucaagaccuccuguuaagggcccacuugacccuagaauaaggcaggagagugucua

SEQ ID NO: 471765 - RNA, 64 nt, Human
auugaagauacagauccuaauugguuacccaguuugacccuaaucauauguauauuuuauugau

SEQ ID NO: 471766 - RNA, 64 nt, Human
ugcccaccaccuggcucaucccucaggcccacccugacccuacauuacauagguuacgucagcc

SEQ ID NO: 471767 - RNA, 64 nt, Human
gguagucucacugcuugaacuaggcugagcaaucugacccuaugggucuaggacacaguuccug

SEQ ID NO: 471768 - RNA, 64 nt, Human
ugucccccucacccccguagcuugcacccuucagugacccuagaagaaugauuggacagaugug

SEQ ID NO: 471769 - RNA, 64 nt, Human
gucaccuucuaaaagauauauucauaguuauuaaugacccuauucccaccacaaauuuuaaagu

SEQ ID NO: 471770 - RNA, 64 nt, Human
auuaucaucaagcaggaauuaugucguaagucacugacccuaacugcagaccaugaaguaaauu

SEQ ID NO: 471771 - RNA, 64 nt, Human
acauguaucuauccacacacugcugaagggaacuugacccuacgcauuccaaaagccuuccuca

SEQ ID NO: 471772 - RNA, 64 nt, Human
uuuucuuuuuuauaagcaaccacacuguauuggaugacccuagaucuucuuugagacaaggcag

SEQ ID NO: 471773 - RNA, 64 nt, Human
gaggccaguguuauuucccgggaguguucagucuugacccuagucacugauuuuuucuaguugu

SEQ ID NO: 471774 - RNA, 64 nt, Human; identical to SEQ ID NO: 72777

SEQ ID NO: 471775 - RNA, 64 nt, Human; identical to SEQ ID NO: 72778

SEQ ID NO: 471776 - RNA, 64 nt, Human; identical to SEQ ID NO: 72779

SEQ ID NO: 471777 - RNA, 64 nt, Human
gaaucagaucagauauuuuccugacaaaaaaaaaugacccuacagagagcaucaaaauguggug

SEQ ID NO: 471778 - RNA, 64 nt, Human
ucuuggagacuaaaaagcaguggacuuaaucgguugacccuacuguggauugguggguuucggg

SEQ ID NO: 471779 - RNA, 64 nt, Human
gccuucgcgguggaaggcccgaggggcgcgaucuugacccuaagaccggcggccaugauggugc

SEQ ID NO: 471780 - RNA, 64 nt, Human
auucauauuucaacagaaaguauuuuuuuauucuugacccuacgugagucacccaugaaaucca

SEQ ID NO: 471781 - RNA, 64 nt, Human
uucuuaaaguuaaaacgucaaacuaaaguguuauugacccuauuauugguauuuggaaucgcaa

SEQ ID NO: 471782 - RNA, 64 nt, Human
caucuucucccugcccccaccccacuaugaccuuugacccuacggcgcaggggcagccaggacc

SEQ ID NO: 471783 - RNA, 64 nt, Human
uugaggagaagggcuuuagggcuaaccagaggucugacccuagaaugccaaggaacugagaaug

SEQ ID NO: 471784 - RNA, 64 nt, Human
ugcaucgccacaauccaguuuuagaauauuuccaugacccuaagaaguuuccucaugucuauua

SEQ ID NO: 471785 - RNA, 64 nt, Human
ucugauuuauuccuacauuuucuguuuucuaauuugacccuaaaaucuauguguuuuagacuua

SEQ ID NO: 471786 - RNA, 64 nt, Human
agcuuuauucccuauuaauagaaaaccgucacagugacccuagaucccuccgaguuaaugaguu

SEQ ID NO: 471787 - RNA, 64 nt, Human
uugaggucaugaccucccacugccgcucaggggcugacccuauuuaggaaaccaaagagggugg

SEQ ID NO: 471788 - RNA, 64 nt, Human
aauaaauuuaagagagucccccccuccccaaugcugacccuaggauuuuccuucccugcccuca

SEQ ID NO: 471789 - RNA, 64 nt, Human
cuauaaugccaaguuaguuuuguggcuuuccaucugacccuaugugaauguaaggugaugugac

SEQ ID NO: 471790 - RNA, 64 nt, Human
acagcagcccuugggucauuggccccucuaggagugacccuagugacuuccccugggagccgca

SEQ ID NO: 471791 - RNA, 64 nt, Human
gagccccgcuuucccuccaaggcugacuccccgcugacccuaacaauaccuuuggagcucgcuu

SEQ ID NO: 471792 - RNA, 64 nt, Human; identical to SEQ ID NO: 72781

SEQ ID NO: 471793 - RNA, 64 nt, Human; identical to SEQ ID NO: 72782

SEQ ID NO: 471794 - RNA, 64 nt, Human; identical to SEQ ID NO: 72783

SEQ ID NO: 471795 - RNA, 64 nt, Human
ggucuaauuggaggcaccuggcugggguccacucugacccuagacuugccuaaaagagcucucu

SEQ ID NO: 471796 - RNA, 64 nt, Human
uggacuucuacgagccgcggcggccagaggacgaugacccuacagaacaggugggcccccagac

SEQ ID NO: 471797 - RNA, 64 nt, Human
augacaaaaggaaggacaaaaauauauauguaugugacccuacccauaaaaaaugaaauauuca

SEQ ID NO: 471798 - RNA, 64 nt, Human
accccagagacuuugcuguaauuaucugcccugcugacccuaaagaccuuccuagaagucaaga

SEQ ID NO: 471799 - RNA, 64 nt, Human
aggcuaaucuuauuuuugccacuaacuuagugaaugacccuaagcaaguuccuucuccucuuag

SEQ ID NO: 471800 - RNA, 64 nt, Human
gcauucccaugagggcaaaggcagcugcccucccugacccuauagccccaggccucaugggggg

SEQ ID NO: 471801 - RNA, 64 nt, Human
ugggccaacucaccugagucacccuaccugugccugacccuacuucuuuugcucuuagcugucu

SEQ ID NO: 471802 - RNA, 64 nt, Human
acacaccaagaaacccgacggcuuccauauuuucugacccuacaaacaggucccuaauacugau

SEQ ID NO: 471803 - RNA, 64 nt, Human
ccuaguuugaauacuggcuuugucacuagcugugugacccuaagcaaaugaccuaaccugucug

SEQ ID NO: 471804 - RNA, 64 nt, Human
ccacucuaguugaguucugcagcaugcagcgguaugacccuacgggggucaggagagcccugcg

SEQ ID NO: 471805 - RNA, 64 nt, Human
cuugaacaacacuacgaagaguauuuggauugcgugacccuaugaccaaaacuauuccauugac

SEQ ID NO: 471806 - RNA, 64 nt, Human
cccgacccggagacgcggggccacagcccccagcugacccuaauuuauucucagcaccaccccc

SEQ ID NO: 471807 - RNA, 64 nt, Human
gcccuaccccacuuccagggagcacagcagccucugacccuagcccugcccuggcagcauggga

SEQ ID NO: 471808 - RNA, 64 nt, Human
ggagaauauuucugaguugcugaagaagagcaggugacccuaggcgcagccugucccgcagggc

SEQ ID NO: 471809 - RNA, 64 nt, Human
gaaagcugccuccgagugguuggggaugguuuucugacccuacgguaacuagaucuaauauaua

SEQ ID NO: 471810 - RNA, 64 nt, Human; identical to SEQ ID NO: 72784

SEQ ID NO: 471811 - RNA, 64 nt, Human; identical to SEQ ID NO: 72785

SEQ ID NO: 471812 - RNA, 64 nt, Human; identical to SEQ ID NO: 72786

SEQ ID NO: 471813 - RNA, 64 nt, Human
uuggggaaagugaaaaauguaaucugcaaguuaaugacccuauuggcuuguguacaucuauaug

SEQ ID NO: 471814 - RNA, 64 nt, Human
ggcagugaugggagaaggggaggcaugauucuucugacccuagaaauguucccuuuaaucuuca

SEQ ID NO: 471815 - RNA, 64 nt, Human
aguaagagggaaugcggugaggcacucuggaauaugacccuaccagagguuggagaacaaacuu

SEQ ID NO: 471816 - RNA, 64 nt, Human
uuuucaauaaugcuaaaauuagcuacaauucugcugacccuacuauuaaagaaucuggaugcug

SEQ ID NO: 471817 - RNA, 64 nt, Human
ccacaacuaaaucgcucuggacggugccgccaggugacccuacauguccggagcaacacuuuga

SEQ ID NO: 471818 - RNA, 64 nt, Human
cuagcccacccugugcuaguuuucauguucacacugacccuauuugaauuaauauccuuuguua

SEQ ID NO: 471819 - RNA, 64 nt, Human; identical to SEQ ID NO: 72753

SEQ ID NO: 471820 - RNA, 64 nt, Human; identical to SEQ ID NO: 72754

SEQ ID NO: 471821 - RNA, 64 nt, Human; identical to SEQ ID NO: 72755

SEQ ID NO: 471822 - RNA, 64 nt, Human; identical to SEQ ID NO: 72756

SEQ ID NO: 471823 - RNA, 64 nt, Human; identical to SEQ ID NO: 72757

SEQ ID NO: 471824 - RNA, 64 nt, Human; identical to SEQ ID NO: 72758

SEQ ID NO: 471825 - RNA, 64 nt, Human; identical to SEQ ID NO: 72759

SEQ ID NO: 471826 - RNA, 64 nt, Human; identical to SEQ ID NO: 72760

SEQ ID NO: 471827 - RNA, 64 nt, Human; identical to SEQ ID NO: 72761

SEQ ID NO: 471828 - RNA, 64 nt, Human; identical to SEQ ID NO: 72762

SEQ ID NO: 471829 - RNA, 64 nt, Human; identical to SEQ ID NO: 72943

SEQ ID NO: 471830 - RNA, 64 nt, Human; identical to SEQ ID NO: 72944

SEQ ID NO: 471831 - RNA, 64 nt, Human; identical to SEQ ID NO: 72945

SEQ ID NO: 471832 - RNA, 64 nt, Human; identical to SEQ ID NO: 72946

SEQ ID NO: 471833 - RNA, 64 nt, Human; identical to SEQ ID NO: 72947

SEQ ID NO: 471834 - RNA, 64 nt, Human; identical to SEQ ID NO: 72948

SEQ ID NO: 471835 - RNA, 64 nt, Human; identical to SEQ ID NO: 72949

SEQ ID NO: 471836 - RNA, 64 nt, Human; identical to SEQ ID NO: 72950

SEQ ID NO: 471837 - RNA, 64 nt, Human; identical to SEQ ID NO: 72951

SEQ ID NO: 471838 - RNA, 64 nt, Human; identical to SEQ ID NO: 72952

SEQ ID NO: 471839 - RNA, 64 nt, Human; identical to SEQ ID NO: 72953

SEQ ID NO: 471840 - RNA, 64 nt, Human; identical to SEQ ID NO: 72954

SEQ ID NO: 471841 - RNA, 64 nt, Human; identical to SEQ ID NO: 72955

SEQ ID NO: 471842 - RNA, 64 nt, Human; identical to SEQ ID NO: 72956

SEQ ID NO: 471843 - RNA, 64 nt, Human; identical to SEQ ID NO: 72957

SEQ ID NO: 471844 - RNA, 64 nt, Human; identical to SEQ ID NO: 72958

SEQ ID NO: 471845 - RNA, 64 nt, Human; identical to SEQ ID NO: 72959

SEQ ID NO: 471846 - RNA, 64 nt, Human; identical to SEQ ID NO: 72960

SEQ ID NO: 471847 - RNA, 64 nt, Human; identical to SEQ ID NO: 72961

SEQ ID NO: 471848 - RNA, 64 nt, Human; identical to SEQ ID NO: 72962

SEQ ID NO: 471849 - RNA, 64 nt, Human; identical to SEQ ID NO: 72963

SEQ ID NO: 471850 - RNA, 62 nt, Human; identical to SEQ ID NO: 72964

SEQ ID NO: 471851 - RNA, 64 nt, Human; identical to SEQ ID NO: 72965

SEQ ID NO: 471852 - RNA, 59 nt, Human; identical to SEQ ID NO: 72966

SEQ ID NO: 471853 - RNA, 64 nt, Human; identical to SEQ ID NO: 72967

SEQ ID NO: 471854 - RNA, 64 nt, Human; identical to SEQ ID NO: 72968

SEQ ID NO: 471855 - RNA, 64 nt, Human; identical to SEQ ID NO: 72969

SEQ ID NO: 471856 - RNA, 64 nt, Human; identical to SEQ ID NO: 72970

SEQ ID NO: 471857 - RNA, 64 nt, Human; identical to SEQ ID NO: 72971

SEQ ID NO: 471858 - RNA, 64 nt, Human; identical to SEQ ID NO: 72972

SEQ ID NO: 471859 - RNA, 64 nt, Human; identical to SEQ ID NO: 72973

SEQ ID NO: 471860 - RNA, 64 nt, Human; identical to SEQ ID NO: 72974

SEQ ID NO: 471861 - RNA, 64 nt, Human; identical to SEQ ID NO: 72975

SEQ ID NO: 471862 - RNA, 64 nt, Human; identical to SEQ ID NO: 72976

SEQ ID NO: 471863 - RNA, 64 nt, Human; identical to SEQ ID NO: 72977

SEQ ID NO: 471864 - RNA, 64 nt, Human; identical to SEQ ID NO: 72978

SEQ ID NO: 471865 - RNA, 64 nt, Human; identical to SEQ ID NO: 72979

SEQ ID NO: 471866 - RNA, 64 nt, Human; identical to SEQ ID NO: 72980

SEQ ID NO: 471867 - RNA, 64 nt, Human; identical to SEQ ID NO: 72981

SEQ ID NO: 471868 - RNA, 64 nt, Human; identical to SEQ ID NO: 72982

SEQ ID NO: 471869 - RNA, 64 nt, Human; identical to SEQ ID NO: 72983

SEQ ID NO: 471870 - RNA, 64 nt, Human; identical to SEQ ID NO: 72984

SEQ ID NO: 471871 - RNA, 64 nt, Human; identical to SEQ ID NO: 72985

SEQ ID NO: 471872 - RNA, 64 nt, Human; identical to SEQ ID NO: 72986

SEQ ID NO: 471873 - RNA, 64 nt, Human; identical to SEQ ID NO: 72987

SEQ ID NO: 471874 - RNA, 64 nt, Human; identical to SEQ ID NO: 72988

SEQ ID NO: 471875 - RNA, 64 nt, Human; identical to SEQ ID NO: 72989

SEQ ID NO: 471876 - RNA, 64 nt, Human; identical to SEQ ID NO: 72990

SEQ ID NO: 471877 - RNA, 64 nt, Human; identical to SEQ ID NO: 72991

SEQ ID NO: 471878 - RNA, 64 nt, Human; identical to SEQ ID NO: 72992

SEQ ID NO: 471879 - RNA, 64 nt, Human; identical to SEQ ID NO: 72993

SEQ ID NO: 471880 - RNA, 64 nt, Human; identical to SEQ ID NO: 72994

SEQ ID NO: 471881 - RNA, 64 nt, Human; identical to SEQ ID NO: 72995

SEQ ID NO: 471882 - RNA, 64 nt, Human; identical to SEQ ID NO: 72996

SEQ ID NO: 471883 - RNA, 64 nt, Human; identical to SEQ ID NO: 72997

SEQ ID NO: 471884 - RNA, 62 nt, Human; identical to SEQ ID NO: 72998

SEQ ID NO: 471885 - RNA, 64 nt, Human; identical to SEQ ID NO: 72999

SEQ ID NO: 471886 - RNA, 64 nt, Human; identical to SEQ ID NO: 73000

SEQ ID NO: 471887 - RNA, 64 nt, Human; identical to SEQ ID NO: 73001

SEQ ID NO: 471888 - RNA, 64 nt, Human; identical to SEQ ID NO: 73002

SEQ ID NO: 471889 - RNA, 64 nt, Human; identical to SEQ ID NO: 73003

SEQ ID NO: 471890 - RNA, 64 nt, Human; identical to SEQ ID NO: 73004

SEQ ID NO: 471891 - RNA, 64 nt, Human; identical to SEQ ID NO: 73005

SEQ ID NO: 471892 - RNA, 64 nt, Human; identical to SEQ ID NO: 73006

SEQ ID NO: 471893 - RNA, 64 nt, Human; identical to SEQ ID NO: 73007

SEQ ID NO: 471894 - RNA, 64 nt, Human; identical to SEQ ID NO: 73008

SEQ ID NO: 471895 - RNA, 64 nt, Human; identical to SEQ ID NO: 73009

SEQ ID NO: 471896 - RNA, 64 nt, Human; identical to SEQ ID NO: 73010

SEQ ID NO: 471897 - RNA, 64 nt, Human; identical to SEQ ID NO: 73011

SEQ ID NO: 471898 - RNA, 64 nt, Human; identical to SEQ ID NO: 73012

SEQ ID NO: 471899 - RNA, 64 nt, Human; identical to SEQ ID NO: 73013

SEQ ID NO: 471900 - RNA, 64 nt, Human; identical to SEQ ID NO: 73014

SEQ ID NO: 471901 - RNA, 64 nt, Human; identical to SEQ ID NO: 73015

SEQ ID NO: 471902 - RNA, 64 nt, Human; identical to SEQ ID NO: 73016

SEQ ID NO: 471903 - RNA, 64 nt, Human; identical to SEQ ID NO: 73017

SEQ ID NO: 471904 - RNA, 64 nt, Human; identical to SEQ ID NO: 73018

SEQ ID NO: 471905 - RNA, 64 nt, Human; identical to SEQ ID NO: 73019

SEQ ID NO: 471906 - RNA, 64 nt, Human; identical to SEQ ID NO: 73020

SEQ ID NO: 471907 - RNA, 64 nt, Human; identical to SEQ ID NO: 73021

SEQ ID NO: 471908 - RNA, 64 nt, Human; identical to SEQ ID NO: 73022

SEQ ID NO: 471909 - RNA, 64 nt, Human; identical to SEQ ID NO: 73023

SEQ ID NO: 471910 - RNA, 64 nt, Human; identical to SEQ ID NO: 73024

SEQ ID NO: 471911 - RNA, 64 nt, Human; identical to SEQ ID NO: 73025

SEQ ID NO: 471912 - RNA, 64 nt, Human; identical to SEQ ID NO: 73026

SEQ ID NO: 471913 - RNA, 64 nt, Human; identical to SEQ ID NO: 73027

SEQ ID NO: 471914 - RNA, 64 nt, Human; identical to SEQ ID NO: 73028

SEQ ID NO: 471915 - RNA, 64 nt, Human; identical to SEQ ID NO: 73029

SEQ ID NO: 471916 - RNA, 64 nt, Human; identical to SEQ ID NO: 73030

SEQ ID NO: 471917 - RNA, 64 nt, Human; identical to SEQ ID NO: 73031

SEQ ID NO: 471918 - RNA, 64 nt, Human; identical to SEQ ID NO: 73032

SEQ ID NO: 471919 - RNA, 64 nt, Human; identical to SEQ ID NO: 73033

SEQ ID NO: 471920 - RNA, 64 nt, Human; identical to SEQ ID NO: 73034

SEQ ID NO: 471921 - RNA, 64 nt, Human; identical to SEQ ID NO: 73035

SEQ ID NO: 471922 - RNA, 64 nt, Human; identical to SEQ ID NO: 73036

SEQ ID NO: 471923 - RNA, 64 nt, Human; identical to SEQ ID NO: 73037

SEQ ID NO: 471924 - RNA, 64 nt, Human; identical to SEQ ID NO: 73038

SEQ ID NO: 471925 - RNA, 64 nt, Human; identical to SEQ ID NO: 73039

SEQ ID NO: 471926 - RNA, 64 nt, Human; identical to SEQ ID NO: 73040

SEQ ID NO: 471927 - RNA, 64 nt, Human; identical to SEQ ID NO: 73041

SEQ ID NO: 471928 - RNA, 64 nt, Human; identical to SEQ ID NO: 73042

SEQ ID NO: 471929 - RNA, 64 nt, Human; identical to SEQ ID NO: 73043

SEQ ID NO: 471930 - RNA, 64 nt, Human; identical to SEQ ID NO: 73044

SEQ ID NO: 471931 - RNA, 64 nt, Human; identical to SEQ ID NO: 73045

SEQ ID NO: 471932 - RNA, 64 nt, Human; identical to SEQ ID NO: 73046

SEQ ID NO: 471933 - RNA, 64 nt, Human; identical to SEQ ID NO: 73047

SEQ ID NO: 471934 - RNA, 64 nt, Human; identical to SEQ ID NO: 73048

SEQ ID NO: 471935 - RNA, 64 nt, Human; identical to SEQ ID NO: 73049

SEQ ID NO: 471936 - RNA, 64 nt, Human; identical to SEQ ID NO: 73050

SEQ ID NO: 471937 - RNA, 64 nt, Human; identical to SEQ ID NO: 73051

SEQ ID NO: 471938 - RNA, 64 nt, Human; identical to SEQ ID NO: 73052

SEQ ID NO: 471939 - RNA, 64 nt, Human; identical to SEQ ID NO: 73053

SEQ ID NO: 471940 - RNA, 59 nt, Human; identical to SEQ ID NO: 73054

SEQ ID NO: 471941 - RNA, 64 nt, Human; identical to SEQ ID NO: 73055

SEQ ID NO: 471942 - RNA, 64 nt, Human; identical to SEQ ID NO: 73056

SEQ ID NO: 471943 - RNA, 64 nt, Human; identical to SEQ ID NO: 73057

SEQ ID NO: 471944 - RNA, 64 nt, Human; identical to SEQ ID NO: 73058

SEQ ID NO: 471945 - RNA, 64 nt, Human; identical to SEQ ID NO: 73059

SEQ ID NO: 471946 - RNA, 64 nt, Human; identical to SEQ ID NO: 73060

SEQ ID NO: 471947 - RNA, 64 nt, Human; identical to SEQ ID NO: 73061

SEQ ID NO: 471948 - RNA, 64 nt, Human; identical to SEQ ID NO: 73062

SEQ ID NO: 471949 - RNA, 64 nt, Human; identical to SEQ ID NO: 73063

SEQ ID NO: 471950 - RNA, 64 nt, Human; identical to SEQ ID NO: 73064

SEQ ID NO: 471951 - RNA, 64 nt, Human; identical to SEQ ID NO: 73065

SEQ ID NO: 471952 - RNA, 64 nt, Human; identical to SEQ ID NO: 73066

SEQ ID NO: 471953 - RNA, 64 nt, Human; identical to SEQ ID NO: 73067

SEQ ID NO: 471954 - RNA, 64 nt, Human; identical to SEQ ID NO: 73068

SEQ ID NO: 471955 - RNA, 64 nt, Human; identical to SEQ ID NO: 73069

SEQ ID NO: 471956 - RNA, 64 nt, Human; identical to SEQ ID NO: 73070

SEQ ID NO: 471957 - RNA, 64 nt, Human; identical to SEQ ID NO: 73071

SEQ ID NO: 471958 - RNA, 64 nt, Human; identical to SEQ ID NO: 73056

SEQ ID NO: 471959 - RNA, 64 nt, Human; identical to SEQ ID NO: 73073

SEQ ID NO: 471960 - RNA, 64 nt, Human; identical to SEQ ID NO: 73074

SEQ ID NO: 471961 - RNA, 54 nt, Human; identical to SEQ ID NO: 73075

SEQ ID NO: 471962 - RNA, 64 nt, Human; identical to SEQ ID NO: 73076

SEQ ID NO: 471963 - RNA, 64 nt, Human; identical to SEQ ID NO: 73077

SEQ ID NO: 471964 - RNA, 64 nt, Human; identical to SEQ ID NO: 73078

SEQ ID NO: 471965 - RNA, 64 nt, Human; identical to SEQ ID NO: 73079

SEQ ID NO: 471966 - RNA, 62 nt, Human
gggccucgccuggcgggaccccgcagcagccccggccccauccccgcccagagccgggcguc

SEQ ID NO: 471967 - RNA, 62 nt, Human
gacacguuggagccgagccugaacaugccccucggccccagcacauggaaaacccccuuccu

SEQ ID NO: 471968 - RNA, 62 nt, Human
aguagcgggggcugcagccgaccgcccugcuccggccccaguguggugggcgaggguggcgc

SEQ ID NO: 471969 - RNA, 62 nt, Human
cagaggacgugaggggcuggcagcaggcagggcggccccaggccucugcccuccucucaggu

SEQ ID NO: 471970 - RNA, 62 nt, Human
auuugccuuucugggagcagaaacagccauugcggccccaggaggggaacugagucacgcug

SEQ ID NO: 471971 - RNA, 62 nt, Human
uuuguauacaucaucucauuuaaucuucacaacggccccaggagauaaguacuaacuuucuc

SEQ ID NO: 471972 - RNA, 62 nt, Human
caaaugaucauggaagcuuggcucugaccccacggccccagcuggagcuggcugagagcagu

SEQ ID NO: 471973 - RNA, 62 nt, Human
aauuuuccuuuaccuacccaaauccuauaaaacggccccaccccuaucucccuucgcugaca

SEQ ID NO: 471974 - RNA, 62 nt, Human
gcaggguaaugcucauaaaaggacuguucccgcggccccaaggugccuguuguucacacuua

SEQ ID NO: 471975 - RNA, 62 nt, Human
ccacggucacugcuguguucagccccucagcucggccccagccuauuucccgccuccauuug

SEQ ID NO: 471976 - RNA, 62 nt, Human
cuucagccagugcagugagaacagcagccccacggccccaugggaggcggcgcugcucuccc

SEQ ID NO: 471977 - RNA, 62 nt, Human
ccgcuggcacggcccugcguagcagcaccagccggccccaccccugcucgccccuaucgcuc

SEQ ID NO: 471978 - RNA, 62 nt, Human
uucaucuccauuuuuuaaaaagguuucucugacggccccacggcccgagccgcggugagcgu

SEQ ID NO: 471979 - RNA, 62 nt, Human
ugcgcauugucacuuggaucuuguggugaggacggccccaucuuucuugccacagauugagg

SEQ ID NO: 471980 - RNA, 62 nt, Human
gugaggcuuccaggcucuuccuggaccugagucggccccacaugggaaccuaguacucucug

SEQ ID NO: 471981 - RNA, 62 nt, Human
gugcugcaggaguguccugcccaugccccagucggccccaucucucauccuuuuggauaagu

SEQ ID NO: 471982 - RNA, 62 nt, Human
gccccaucugucccuccguccaggagcucucacggccccaucuguuguaccuucccauguau

SEQ ID NO: 471983 - RNA, 62 nt, Human
gagcccggugagggcggcaggcagggguuauccggccccacuuucuggaugacagacuugag

SEQ ID NO: 471984 - RNA, 62 nt, Human
uuuaauggucugugcuuuaaaugguaacgcuacggccccaggucacugcgaggcacuuacca

SEQ ID NO: 471985 - RNA, 62 nt, Human
cagggccagggccuaacaguguuucuuccccucggccccacggcccauacucaccccuucac

SEQ ID NO: 471986 - RNA, 62 nt, Human
ucccuucacaaucccagaguggcaggcgggaccggccccauggucuggcuccugucaccugg

SEQ ID NO: 471987 - RNA, 62 nt, Human
ucuccauucugcuuucuugccacacagugggccggccccaggcuccccuggucuccuccccg

SEQ ID NO: 471988 - RNA, 62 nt, Human
uaccucgucagggcccugcagugacggcgccccggccccacacucgccucccgggccccacg

SEQ ID NO: 471989 - RNA, 62 nt, Human
gugcugggauuacaggcaugagccaccgcgcccggccccaaucaucuguuuuuaaacaaucg

SEQ ID NO: 471990 - RNA, 62 nt, Human
cgcgccagaagcacccagcccugcccagcaaccggccccagcagcagguccuggugcuggcg

SEQ ID NO: 471991 - RNA, 62 nt, Human
gaugcccuccccucagcgcaggcugcagagcccggccccaccucccugcgcccuugaggggc

SEQ ID NO: 471992 - RNA, 62 nt, Human
aggcuggcgugagaggagcggcagccacacugcggccccacgcccaaggacugggcugcucu

SEQ ID NO: 471993 - RNA, 62 nt, Human
ggucucggaccagaccccccuccacagcugcccggccccagacccaucucuuggauugaggg

SEQ ID NO: 471994 - RNA, 62 nt, Human
gaguggcgguguccaggggcgccccgccccugcggccccaccagguacugaaagacccgcag

SEQ ID NO: 471995 - RNA, 62 nt, Human
accucuaaggacaaaaccgagucggucaccagcggccccauguccccagagggcucaccuuc

SEQ ID NO: 471996 - RNA, 62 nt, Human
caugcuguccugugagagccccugccccagagcggccccacuaagcgcauguggcuccuggg

SEQ ID NO: 471997 - RNA, 56 nt, Human; identical to SEQ ID NO: 313978

SEQ ID NO: 471998 - RNA, 62 nt, Human
aagcgguugagccuggcagaguaccaugcgcucggccccagcugcaggaaacagcaggcccc

SEQ ID NO: 471999 - RNA, 62 nt, Human
ccgacaagacccccggggaaugcaggugcugccggccccaggaccccucuucaagagccacu

SEQ ID NO: 472000 - RNA, 62 nt, Human
ccauguccuuggccaggcccaaggagaggacucggccccauggggugugccagucuugcagu

SEQ ID NO: 472001 - RNA, 62 nt, Human
acacuggaacaagccccuccagaugagugccccggccccaggccagcuucacugccgucucu

SEQ ID NO: 472002 - RNA, 62 nt, Human
uucugauaaaagauggccauauuaccccuuuucggccccauguaucucaguaccccauggag

SEQ ID NO: 472003 - RNA, 62 nt, Human
ugugugaguggugggcaggccaguggcagggccggccccagccccugcauggauuccuugug

SEQ ID NO: 472004 - RNA, 62 nt, Human
agcccuaccucugugcccuguaccagcagaggcggccccacgugggcugugcuacauacagg

SEQ ID NO: 472005 - RNA, 62 nt, Human
cugaaauguaucccuugaccaacaucacugcccggccccagccccagguaaacaccauucua

SEQ ID NO: 472006 - RNA, 62 nt, Human
cggcagcuugagccugucacguggucaaggcccggccccaucagaggcugggggaggcggca

SEQ ID NO: 472007 - RNA, 62 nt, Human
uuucaacagcagugagcccugggcagaugccccggccccagggcuucccccaggaacuccau

SEQ ID NO: 472008 - RNA, 53 nt, Human; identical to SEQ ID NO: 314343

SEQ ID NO: 472009 - RNA, 62 nt, Human
ugguugugaggaggccugucugcaucuccuuccggccccacugggguccaggggugcccaga

SEQ ID NO: 472010 - RNA, 62 nt, Human
gacccaugugagccuuugcuuuccucuggccccggccccacccugaacacagcucauacaca

SEQ ID NO: 472011 - RNA, 62 nt, Human
uguccugcucacucaugggggcuuccagaccccggccccaccagggcuugugucauagggag

SEQ ID NO: 472012 - RNA, 62 nt, Human
caaucaguggggaaaagggcagaaccagugcccggccccacacugccucuguggccuggacu

SEQ ID NO: 472013 - RNA, 62 nt, Human
ucagcagaacucucugacuggggccccuggcccggccccacccagccgacauguuuucuuug

SEQ ID NO: 472014 - RNA, 62 nt, Human
ugccuagccaggcuggcacugccacucacacucggccccagggcccaggagggacagugccu

SEQ ID NO: 472015 - RNA, 62 nt, Human
gugcaagagucgagccggcagagcaaggggcgcggccccagggcccugcgcccacuuugcac

SEQ ID NO: 472016 - RNA, 62 nt, Human
accucucuugucucucccucugaagauggacucggccccacauacacauuuuuguguuacag

SEQ ID NO: 472017 - RNA, 62 nt, Human
uccccagcaccugcccucccagucucccaccccggccccaggcuggaagcccucccuccacu

SEQ ID NO: 472018 - RNA, 62 nt, Human
cacagccuuacgcgcccgacgcgcgccacccgcggccccagcuuuccgccugcacccgcgag

SEQ ID NO: 472019 - RNA, 62 nt, Human
aacuacugggaucccuaaaaacgccccugguccggccccacucugcgccccucgaucuccca

SEQ ID NO: 472020 - RNA, 62 nt, Human
caagaaccugcgucuuggaccauugccccucccggccccaaaccacaggggcucaggucgug

SEQ ID NO: 472021 - RNA, 62 nt, Human
agcugcagauuccuccaugucagcucccaucacggccccaaagacagagucacuugguugcu

SEQ ID NO: 472022 - RNA, 62 nt, Human
agucacuuggucaucugagccuugaguguguccggccccagccaccagccuguccccacuau

SEQ ID NO: 472023 - RNA, 62 nt, Human
uccgcguccucugugggggcugccggaagacacggccccaggagucaggccccuguggucag

SEQ ID NO: 472024 - RNA, 62 nt, Human
gggaagcggcagcaucggaugucagcccccugcggccccagcuggagauggauaugagacua

SEQ ID NO: 472025 - RNA, 62 nt, Human
ucaugcuagccuagucccuggaggagggaguccggccccaggccagggacuaaggagcaaug

SEQ ID NO: 472026 - RNA, 62 nt, Human
cucuuucuccaugggagcuccuggugccgccucggccccagccuguccccagccccucaauc

SEQ ID NO: 472027 - RNA, 62 nt, Human
gcccagcucccacccagccugacggcgccucccggccccaagcugccuuccucgauguggcc

SEQ ID NO: 472028 - RNA, 62 nt, Human
ucucuugcaggcuagcucccgcccugccugcccggccccaccgaggccugagcacguucccg

SEQ ID NO: 472029 - RNA, 62 nt, Human
ccugggccucagcuucccuucccacauuccuccggccccaggagcaaccccuugggcuaggu

SEQ ID NO: 472030 - RNA, 62 nt, Human
guuugugcgaguucccuugccacgcggggccccggccccaucaagucccucuggggacgucc

SEQ ID NO: 472031 - RNA, 62 nt, Human
cggucccggcucugugcgggccgcacccuggacggccccauccggacgcugaagcugccguu

SEQ ID NO: 472032 - RNA, 62 nt, Human
ucccaccgcucagggcagggaggucugaacugcggccccagagccuuuggccuaagcuggac

SEQ ID NO: 472033 - RNA, 62 nt, Human
guuuguggggcuugugggaggggcacauacaucggccccaggauucuaacaucuccuggucu

SEQ ID NO: 472034 - RNA, 62 nt, Human
uagggguuuugaacuagguggauacuaaaucucggccccacucuucauuggcuuaaccuaaa

SEQ ID NO: 472035 - RNA, 62 nt, Human
agccucaggugccacagccugguucggccuggcggccccaggaggcagcagcaaccuugggc

SEQ ID NO: 472036 - RNA, 62 nt, Human
cuggaggaugugggagggcccuggacauggcccggccccacugcugagugcccgugucccca

SEQ ID NO: 472037 - RNA, 62 nt, Human
gcuuccagcggugccugccacugaggcaggugcggccccaggaccaucaccaggaaugcgag

SEQ ID NO: 472038 - RNA, 62 nt, Human
uacagcgccaacgagcagugccgcguggccuucggccccaaggcugucgccugcaccuucgc

SEQ ID NO: 472039 - RNA, 62 nt, Human
ggacagcacuuuuuauacagaggacaccgccucggccccacguccuuagaggccagagcaca

SEQ ID NO: 472040 - RNA, 62 nt, Human
ccccauccgggauagggcagaggaggugcuggcggccccagggaaggaggguguguacccca

SEQ ID NO: 472041 - RNA, 62 nt, Human
gagguuuuaugggccuguguauccccuucucccggccccagccugccucccuccugcccgcc

SEQ ID NO: 472042 - RNA, 58 nt, Human; identical to SEQ ID NO: 314377

SEQ ID NO: 472043 - RNA, 62 nt, Human
ugaacccgauucuggggagcaucuucccgcuccggccccacgaccuccacaggguuacauug

SEQ ID NO: 472044 - RNA, 62 nt, Human
gggaaagacacugccugggcugaccccgguggcggccccagcaccucagccugcacaguguc

SEQ ID NO: 472045 - RNA, 62 nt, Human
agggcccccagccagcgcuccagccaaagcggcggccccaggguuaauugcggagaacagga

SEQ ID NO: 472046 - RNA, 62 nt, Human
ugugcugcugcaccaaccucacugcccucccucggccccacccacccucugguccuucugac

SEQ ID NO: 472047 - RNA, 62 nt, Human
ggauguguggauguggcccgagcaggcucaggcggccccacucacccacagcauccgccgcc

SEQ ID NO: 472048 - RNA, 62 nt, Human
aacacacauggccucgccaucguggguaaaaucggccccacagcacgucugcaccagcgggc

SEQ ID NO: 472049 - RNA, 62 nt, Human
ccucugcagcugggugaccagagccccgggcacggccccagcuccguggggcucucacggug

SEQ ID NO: 472050 - RNA, 62 nt, Human
gcaaacggaguacagacgucucaagacugaaacggccccauugccuggucuaguagcggauc

SEQ ID NO: 472051 - RNA, 62 nt, Human
aacauuguucucuauccuccccugacccccgacggccccaugcuaggugcaccaucuuccuc

SEQ ID NO: 472052 - RNA, 62 nt, Human
gcacacauucugggaagcaucaaauagacacacggccccagccaccugcaacuuaugugcac

SEQ ID NO: 472053 - RNA, 62 nt, Human
auuguuugcuugcuugaaaccuaaucuauagacggccccacagcucgugcacacacugcuuc

SEQ ID NO: 472054 - RNA, 62 nt, Human
caaacacugguuccccacugcccugugccuuccggccccagaaggaucuuccuggaugccaa

SEQ ID NO: 472055 - RNA, 62 nt, Human
ggcugcucuggugaggcagccucuguuuaaaccggccccacaugaagagaacaucccuugag

SEQ ID NO: 472056 - RNA, 62 nt, Human
aucaagccaaaccugcugccacagcccucccccggccccagauagcagccccagggaggaug

SEQ ID NO: 472057 - RNA, 62 nt, Human
gugacaguuaccagcuuuccugaauggauucccggccccaucccucacccccacccucacuu

SEQ ID NO: 472058 - RNA, 62 nt, Human
accuggccugccguugcccugagcugcagccucggccccaggauccugcucacagucaccgc

SEQ ID NO: 472059 - RNA, 62 nt, Human
gaggcuccaggagggaauaucuguugccccugcggccccagacaccagccagacccaggcug

SEQ ID NO: 472060 - RNA, 62 nt, Human
ggcgccaccgccacccgcagcgagggcggagccggccccaggugcuccccugacagucccuc

SEQ ID NO: 472061 - RNA, 62 nt, Human
ccagcccgcggcacuaacgacaggcgaggccgcggccccagaguccccgcaccaggcagagc

SEQ ID NO: 472062 - RNA, 62 nt, Human
aaccaaauucaccguuaggaaacagugagcuccggccccaccucgugaacacaaagccucgg

SEQ ID NO: 472063 - RNA, 62 nt, Human
cccggccagcccuguugucuuucaaagaaccucggccccagugauggcugaucucacuccca

SEQ ID NO: 472064 - RNA, 62 nt, Human
uuucuauauuguagcuuugcuuaaaauggggucggccccaacugcauccuccucuuuggcgg

SEQ ID NO: 472065 - RNA, 53 nt, Human; identical to SEQ ID NO: 314400

SEQ ID NO: 472066 - RNA, 62 nt, Human
ggaugaacuggcucugagcacccugccgcccgcggccccagcuucaggacaagccccugcuu

SEQ ID NO: 472067 - RNA, 62 nt, Human
aggucacugccugaccuggacuaagaaccccacggccccacuguccacacacugccucccca

SEQ ID NO: 472068 - RNA, 62 nt, Human
aaaaaguaaaacuguacuguugcgugugcaagcggccccacuagagccuuccagccuucugg

SEQ ID NO: 472069 - RNA, 62 nt, Human
aaccugauaauucauuuuggauaggccuuucucggccccagacugagguaccauggcucugg

SEQ ID NO: 472070 - RNA, 62 nt, Human
guacacgugguguugggacuggaaccauuaugcggccccauaggccucaggagucaucccag

SEQ ID NO: 472071 - RNA, 62 nt, Human
cgccccuccugccgcccagcuucgugacuccacggccccacgcgccccuugcugccuuccgc

SEQ ID NO: 472072 - RNA, 62 nt, Human
gugggcuggggggcggggcggggagcggcaggcggccccacccugcacugguccaaggucgg

SEQ ID NO: 472073 - RNA, 62 nt, Human
caggacgugcugcucccuugugugagugaccacggccccaagcccagggcuggaggcagguc

SEQ ID NO: 472074 - RNA, 62 nt, Human
ugccugcguccucucggugagcugugcagugccggccccagauccucacacccagggagcag

SEQ ID NO: 472075 - RNA, 62 nt, Human
ggaaaacacuagagcugcagguaccagccacucggccccaggggguuauggccacagaggga

SEQ ID NO: 472076 - RNA, 62 nt, Human
cuggcucgccccuugacuggcuaaguggggcccggccccagcuggaucgaagggcggguugc

SEQ ID NO: 472077 - RNA, 62 nt, Human
gguccacguccugccucucccugggguuuacacggccccaauaaagccugcucuggccuacg

SEQ ID NO: 472078 - RNA, 62 nt, Human
cccuugcugccacaccacauugccucaacaaccggccccagagugcccaggcacuccugagg

SEQ ID NO: 472079 - RNA, 62 nt, Human
cccacugcuccucagcguccaguccuccugggcggccccagguccuggacaauaagcaacag

SEQ ID NO: 472080 - RNA, 62 nt, Human
agugaaaccuuuagggcagcuugccccggccccggccccagccagaguuccugcggagugaa

SEQ ID NO: 472081 - RNA, 62 nt, Human
cccugggugcccccccucucccuucuccuucccggccccaccaacacucugagauccgagag

SEQ ID NO: 472082 - RNA, 62 nt, Human
acacucagcuauuacugcgcuuucccuccccacggccccaacuccagggcaggagcaacugg

SEQ ID NO: 472083 - RNA, 62 nt, Human
ucuccggcuccuccuugcggcgcugacccggccggccccacacccgcucuuccucuucuuug

SEQ ID NO: 472084 - RNA, 62 nt, Human
ggcucggcggggccccacucagagcagcuggccggccccaggcagugagggccuuagcaccu

SEQ ID NO: 472085 - RNA, 62 nt, Human
uuccugccggggugggaagaguuucucuccaucggccccaugcgggucaccucccuaguccc

SEQ ID NO: 472086 - RNA, 62 nt, Human
gccccacucacaccauccuaugagcccacgcccggccccacucccaccauccugugaacccc

SEQ ID NO: 472087 - RNA, 62 nt, Human
gccccauucacuccauccugugagaccacgcccggccccacucacucuauccugugagacca

SEQ ID NO: 472088 - RNA, 62 nt, Human
gccccacucacaacaucuuguaagacugugcccggccccauucacuccauccugugagacca

SEQ ID NO: 472089 - RNA, 62 nt, Human
ccccacucacaccaaccugugagccccacucccggccccacucacaacaucuuguaagacug

SEQ ID NO: 472090 - RNA, 62 nt, Human
ccccacucccaccauccugugagccccacucccggccccacucacuccauccugugagcccc

SEQ ID NO: 472091 - RNA, 62 nt, Human
ccccacucacaccaaccugugagccccacucccggccccacucacuccaucuuguaagacua

SEQ ID NO: 472092 - RNA, 62 nt, Human
gccccacucccaccauccugugagcccaugcccggccccacucacaccaaccugugagcccc

SEQ ID NO: 472093 - RNA, 62 nt, Human
gccccucucacaccauccugugagaccacgcccggccccacucccaccaucuuguaagacug

SEQ ID NO: 472094 - RNA, 62 nt, Human
uccccgaguccucagguacagcgggcugugcccggccccacccccugggcagauguccccca

SEQ ID NO: 472095 - RNA, 62 nt, Human
cccaaccccauugcuaacaacaugguacauuccggccccaccacucagagccuuccgaagcc

SEQ ID NO: 472096 - RNA, 62 nt, Human
aucaucugcacacccgggcagugcucagagcccggccccaggcccccgcgcuccucacuccu

SEQ ID NO: 472097 - RNA, 62 nt, Human
aggcugcugcccugcccagcccgacccugccccggccccacuuccaccuugcgcauuuggua

SEQ ID NO: 472098 - RNA, 62 nt, Human
cucucagccccaucgccccaacuccaaccucucggccccaucgccccaccgcagcuacuccc

SEQ ID NO: 472099 - RNA, 62 nt, Human
ccuuaccuaaagguuccuugauauguccucuccggccccacuucguucucaguuccacuggu

SEQ ID NO: 472100 - RNA, 62 nt, Human
cugccucuggggagggggccaucugcugcgcccggccccacugacagaucugaagagcacag

SEQ ID NO: 472101 - RNA, 62 nt, Human
cagaccauuggggcucccagccaggcccuugucggccccaccagugccucucccugcugcuc

SEQ ID NO: 472102 - RNA, 62 nt, Human
gguucuugcaacacugugaggggcagccagggcggccccaauaaagcccuugaauacuuuga

SEQ ID NO: 472103 - RNA, 62 nt, Human
uugcccccaggaaaggacgcauccaccgguagcggccccagcugacugucgccgugugcugg

SEQ ID NO: 472104 - RNA, 62 nt, Human
gccgaccccucccgggaccccucccggcugggcggccccacagacccgcuggaacccagcag

SEQ ID NO: 472105 - RNA, 62 nt, Human
gagcaccacccuccccgacacacagguucaugcggccccaggggccucccuccuguugaaga

SEQ ID NO: 472106 - RNA, 62 nt, Human
cgggacaaguggucugggacagggaggagcaacggccccagcgcgcaacgcucugcgcguuc

SEQ ID NO: 472107 - RNA, 62 nt, Human
ucaaguauccucagaaauguauucugcacccccggccccacccaugcugagggaaggggagc

SEQ ID NO: 472108 - RNA, 62 nt, Human
ccgggccgggagagcuucccugacgggagucgcggccccaccgaggcgucggccgcccgaag

SEQ ID NO: 472109 - RNA, 62 nt, Human
ccggacucccuuucugccaccccaggcugguccggccccaggugugggguccgcucucucca

SEQ ID NO: 472110 - RNA, 62 nt, Human
ucuuccuccaccacccuacaccccccuccccccggccccaagccccugugucuccuuguuac

SEQ ID NO: 472111 - RNA, 62 nt, Human
augacuccgaugagcugcucaucgaccuggagcggccccagagcaacagcagcgcugucaca

SEQ ID NO: 472112 - RNA, 62 nt, Human
guccucccgagcuccgacagcauuaccucacccggccccaucuguugccccgguccagcccu

SEQ ID NO: 472113 - RNA, 62 nt, Human
acgcagacugcaggggccgcgccuggcucaggcggccccacccccgggacguggggucacuu

SEQ ID NO: 472114 - RNA, 62 nt, Human
cccagcccaucccuccggccccugugccucugcggccccagcccagcucccagggccgucac

SEQ ID NO: 472115 - RNA, 62 nt, Human
uagggcgacaggagccagcgggacgccgcacgcggccccagacucagggagcagggccaggc

SEQ ID NO: 472116 - RNA, 62 nt, Human
ucaaaagcucaagagugacgugaggugggcaccggccccaagugcagagucaaggcagggag

SEQ ID NO: 472117 - RNA, 62 nt, Human
cugccauguuuacagagggccccugggcugcgcggccccagccugggcacccugauuuuuaa

SEQ ID NO: 472118 - RNA, 62 nt, Human
cccccagcccuggaccccagcagaugaggaaacggccccauuuacugaccccgcccccuuuu

SEQ ID NO: 472119 - RNA, 62 nt, Human
cccagaauggaggcaacgccagaauccagcaccggccccauuuacccaacucuguacaaagc

SEQ ID NO: 472120 - RNA, 62 nt, Human
ccaccuguguaaugucaaaaaaaaucaauaugcggccccauuuuguaaaggaucauuaaaau

SEQ ID NO: 472121 - RNA, 62 nt, Human
ugccugcuggagccgccugcagacgcgguccucggccccacgugaaccaggcucggcggcga

SEQ ID NO: 472122 - RNA, 62 nt, Human
agagggaggagggggcacagcugugccaagcccggccccacugguguguccucacaauguga

SEQ ID NO: 472123 - RNA, 62 nt, Human
aguagaauaaaacuagccuaguccugucccuccggccccaguggagacaggcgucuaagaac

SEQ ID NO: 472124 - RNA, 62 nt, Human
cggcgaagguggguggggccccucuguaaauacggccccaggguggugagagagucccaugc

SEQ ID NO: 472125 - RNA, 62 nt, Human
aguagaaggggaaagccuucaucuuggcgaaccggccccaccacccccuccuacccgggccu

SEQ ID NO: 472126 - RNA, 62 nt, Human
ggagcccucgcaccgcuccccaccccacucagcggccccaucggaacugagaauugcaaaac

SEQ ID NO: 472127 - RNA, 62 nt, Human
gggacugacagccugcaggguuuccuugggcgcggccccaaaauugccuucaaaacaaaccc

SEQ ID NO: 472128 - RNA, 62 nt, Human
uucugaaccccucggccccgcccccguggacccggccccaccccgaauaccccggccacgcu

SEQ ID NO: 472129 - RNA, 62 nt, Human
ucccgccccgccccgccccgccccggcaggcccggccccaccccgccccgcccccgcugccu

SEQ ID NO: 472130 - RNA, 62 nt, Human
gagcggccugccucaccccugaauagcuccuucggccccaucuccauccucagcagaugaca

SEQ ID NO: 472131 - RNA, 62 nt, Human
aggucaggcuccuggggcccuagaagccggggcggccccagcggggaggaggagcaaggaca

SEQ ID NO: 472132 - RNA, 62 nt, Human
cugguguccacacggugcauuccugucccccucggccccaggcuggcucagcucuccagugc

SEQ ID NO: 472133 - RNA, 62 nt, Human
ggacuuggugagcgccgccccaacgagacucgcggccccaggcccaggccccaccccggcgg

SEQ ID NO: 472134 - RNA, 62 nt, Human
gucccagacuaccccggacccugucccugccgcggccccagccuugaccuguuugacuugag

SEQ ID NO: 472135 - RNA, 62 nt, Human
acucagcgugacccaacuuuucuagugugccacggccccaccaccuccugcaguacccacac

SEQ ID NO: 472136 - RNA, 62 nt, Human
cuggacagccaugccagagagaggccuuugaccggccccagagcuaaaagcaccagagaaaa

SEQ ID NO: 472137 - RNA, 62 nt, Human
cugcauucccacccagcgcgcagucuccaccucggccccagcaaagcgcuaagcagccggag

SEQ ID NO: 472138 - RNA, 62 nt, Human
ggaggacugaggucgccgggaccacccugagccggccccaggcucguggacugagugggaag

SEQ ID NO: 472139 - RNA, 62 nt, Human
ucagggcugcccagcgcccagcgugcacgggacggccccacgacagagggagucagcccggg

SEQ ID NO: 472140 - RNA, 62 nt, Human
uguccgaggcgacgcaccucgaggguguccgccggccccagcacccaggggacgcgcuggaa

SEQ ID NO: 472141 - RNA, 62 nt, Human
cgugcugggauuauaggcaugagccaccaggccggccccaggauuuuauauuaagccuucuu

SEQ ID NO: 472142 - RNA, 62 nt, Human
cugggcauggccugggucgcacccccuccccacggccccacccacagggaccucaacuucug

SEQ ID NO: 472143 - RNA, 62 nt, Human
cagagcggaaggagggacuucccaccggcauccggccccagugccauguuuuaucaucugga

SEQ ID NO: 472144 - RNA, 62 nt, Human
acaggugcugggcuuuagagaacaugggaaggcggccccagaccugcgggaacgccuuuccc

SEQ ID NO: 472145 - RNA, 62 nt, Human
agaaaucagccgggaugccugcaucccacccccggccccagggcccaccacauaaaaucugg

SEQ ID NO: 472146 - RNA, 62 nt, Human
acuaaagugcugcacucaaaugaugggaaguccggccccaguacacaggggcuugacuuuuu

SEQ ID NO: 472147 - RNA, 62 nt, Human
gccuccuguugaauugccccugggccugcccccggccccauuugugccauaaaggguugcuu

SEQ ID NO: 472148 - RNA, 62 nt, Human
gcaaggcagucccaggccugccgucuccagcacggccccaagguggacacuagccccugcug

SEQ ID NO: 472149 - RNA, 62 nt, Human
uguucacauaccaccuucguccccccaggccccggccccacuccuggcucucauuauuuuua

SEQ ID NO: 472150 - RNA, 62 nt, Human
ugcucucacccugaggguccccagccucucaccggccccagcugaccucguccauucagccc

SEQ ID NO: 472151 - RNA, 62 nt, Human
acccucacauucaaggcccuuccugucuuggccggccccacugcccccccauucuaugcccc

SEQ ID NO: 472152 - RNA, 62 nt, Human
cccauccccuagacacccucuguuuccuuucccggccccaccuggccggcccucugccccug

SEQ ID NO: 472153 - RNA, 62 nt, Human
ggggcggcgacugccgagcuccgcccuccaggcggccccacccgccugccguccuggggcgc

SEQ ID NO: 472154 - RNA, 62 nt, Human
ccgacgcggacaacugacccgccaggcgggagcggccccacacguguuugcuuaaagucugc

SEQ ID NO: 472155 - RNA, 62 nt, Human; identical to SEQ ID NO: 471989

SEQ ID NO: 472156 - RNA, 62 nt, Human
aggcuguucagggaggcagcucauuuccaccccggccccaggacacccagccugugccccac

SEQ ID NO: 472157 - RNA, 62 nt, Human
gcaucuugaucaggcuuucucaagcccuccaucggccccaccagaucuccauucuuugccau

SEQ ID NO: 472158 - RNA, 62 nt, Human
gucaccuccgcugucaccacauccugagcacucggccccauccccccacaggagggaagcug

SEQ ID NO: 472159 - RNA, 62 nt, Human
cccauuugcccuccuccucagcuagggccacgcggccccacauugcacuucuggggggugac

SEQ ID NO: 472160 - RNA, 62 nt, Human
aggaggaaugggccccucgaagugggccgggccggccccaccugccucugcccagauuugcc

SEQ ID NO: 472161 - RNA, 62 nt, Human
uccugccucucccauggcuuacagcuucuacccggccccaaggcuacccaguauuuuaucgu

SEQ ID NO: 472162 - RNA, 62 nt, Human
aucccccaauccaucagugccaaacuagccaacggccccagcuucucagcucgcuggauggc

SEQ ID NO: 472163 - RNA, 64 nt, Human; identical to SEQ ID NO: 72753

SEQ ID NO: 472164 - RNA, 64 nt, Human; identical to SEQ ID NO: 72754

SEQ ID NO: 472165 - RNA, 64 nt, Human; identical to SEQ ID NO: 72755

SEQ ID NO: 472166 - RNA, 64 nt, Human; identical to SEQ ID NO: 72756

SEQ ID NO: 472167 - RNA, 64 nt, Human; identical to SEQ ID NO: 72757

SEQ ID NO: 472168 - RNA, 64 nt, Human; identical to SEQ ID NO: 72758

SEQ ID NO: 472169 - RNA, 64 nt, Human; identical to SEQ ID NO: 72759

SEQ ID NO: 472170 - RNA, 64 nt, Human; identical to SEQ ID NO: 72760

SEQ ID NO: 472171 - RNA, 64 nt, Human; identical to SEQ ID NO: 72761

SEQ ID NO: 472172 - RNA, 64 nt, Human; identical to SEQ ID NO: 72762

SEQ ID NO: 472173 - RNA, 64 nt, Human; identical to SEQ ID NO: 72763

SEQ ID NO: 472174 - RNA, 64 nt, Human; identical to SEQ ID NO: 72764

SEQ ID NO: 472175 - RNA, 64 nt, Human; identical to SEQ ID NO: 72765

SEQ ID NO: 472176 - RNA, 64 nt, Human; identical to SEQ ID NO: 72766

SEQ ID NO: 472177 - RNA, 64 nt, Human; identical to SEQ ID NO: 72767

SEQ ID NO: 472178 - RNA, 64 nt, Human; identical to SEQ ID NO: 72768

SEQ ID NO: 472179 - RNA, 64 nt, Human; identical to SEQ ID NO: 72769

SEQ ID NO: 472180 - RNA, 64 nt, Human; identical to SEQ ID NO: 72770

SEQ ID NO: 472181 - RNA, 64 nt, Human; identical to SEQ ID NO: 72771

SEQ ID NO: 472182 - RNA, 58 nt, Human; identical to SEQ ID NO: 72772

SEQ ID NO: 472183 - RNA, 64 nt, Human; identical to SEQ ID NO: 72773

SEQ ID NO: 472184 - RNA, 64 nt, Human; identical to SEQ ID NO: 72774

SEQ ID NO: 472185 - RNA, 64 nt, Human; identical to SEQ ID NO: 72775

SEQ ID NO: 472186 - RNA, 64 nt, Human; identical to SEQ ID NO: 72776

SEQ ID NO: 472187 - RNA, 64 nt, Human; identical to SEQ ID NO: 72777

SEQ ID NO: 472188 - RNA, 64 nt, Human; identical to SEQ ID NO: 72778

SEQ ID NO: 472189 - RNA, 64 nt, Human; identical to SEQ ID NO: 72779

SEQ ID NO: 472190 - RNA, 64 nt, Human; identical to SEQ ID NO: 72780

SEQ ID NO: 472191 - RNA, 64 nt, Human; identical to SEQ ID NO: 72781

SEQ ID NO: 472192 - RNA, 64 nt, Human; identical to SEQ ID NO: 72782

SEQ ID NO: 472193 - RNA, 64 nt, Human; identical to SEQ ID NO: 72783

SEQ ID NO: 472194 - RNA, 64 nt, Human; identical to SEQ ID NO: 72784

SEQ ID NO: 472195 - RNA, 64 nt, Human; identical to SEQ ID NO: 72785

SEQ ID NO: 472196 - RNA, 64 nt, Human; identical to SEQ ID NO: 72786

SEQ ID NO: 472197 - RNA, 64 nt, Human; identical to SEQ ID NO: 72787

SEQ ID NO: 472198 - RNA, 64 nt, Human; identical to SEQ ID NO: 72788

SEQ ID NO: 472199 - RNA, 64 nt, Human; identical to SEQ ID NO: 72789

SEQ ID NO: 472200 - RNA, 64 nt, Human; identical to SEQ ID NO: 72790

SEQ ID NO: 472201 - RNA, 64 nt, Human; identical to SEQ ID NO: 72791

SEQ ID NO: 472202 - RNA, 64 nt, Human; identical to SEQ ID NO: 72792

SEQ ID NO: 472203 - RNA, 64 nt, Human; identical to SEQ ID NO: 72793

SEQ ID NO: 472204 - RNA, 64 nt, Human; identical to SEQ ID NO: 72794

SEQ ID NO: 472205 - RNA, 64 nt, Human; identical to SEQ ID NO: 72795

SEQ ID NO: 472206 - RNA, 64 nt, Human; identical to SEQ ID NO: 72796

SEQ ID NO: 472207 - RNA, 64 nt, Human; identical to SEQ ID NO: 72797

SEQ ID NO: 472208 - RNA, 64 nt, Human; identical to SEQ ID NO: 72798

SEQ ID NO: 472209 - RNA, 64 nt, Human; identical to SEQ ID NO: 72799

SEQ ID NO: 472210 - RNA, 64 nt, Human; identical to SEQ ID NO: 72800

SEQ ID NO: 472211 - RNA, 64 nt, Human; identical to SEQ ID NO: 72801

SEQ ID NO: 472212 - RNA, 64 nt, Human; identical to SEQ ID NO: 72802

SEQ ID NO: 472213 - RNA, 64 nt, Human; identical to SEQ ID NO: 72803

SEQ ID NO: 472214 - RNA, 64 nt, Human; identical to SEQ ID NO: 72804

SEQ ID NO: 472215 - RNA, 64 nt, Human; identical to SEQ ID NO: 72805

SEQ ID NO: 472216 - RNA, 64 nt, Human; identical to SEQ ID NO: 72806

SEQ ID NO: 472217 - RNA, 64 nt, Human; identical to SEQ ID NO: 72807

SEQ ID NO: 472218 - RNA, 64 nt, Human; identical to SEQ ID NO: 72808

SEQ ID NO: 472219 - RNA, 64 nt, Human; identical to SEQ ID NO: 72809

SEQ ID NO: 472220 - RNA, 64 nt, Human; identical to SEQ ID NO: 72810

SEQ ID NO: 472221 - RNA, 64 nt, Human; identical to SEQ ID NO: 72811

SEQ ID NO: 472222 - RNA, 64 nt, Human; identical to SEQ ID NO: 72812

SEQ ID NO: 472223 - RNA, 64 nt, Human; identical to SEQ ID NO: 72813

SEQ ID NO: 472224 - RNA, 50 nt, Human; identical to SEQ ID NO: 72814

SEQ ID NO: 472225 - RNA, 64 nt, Human; identical to SEQ ID NO: 72815

SEQ ID NO: 472226 - RNA, 64 nt, Human; identical to SEQ ID NO: 72816

SEQ ID NO: 472227 - RNA, 64 nt, Human; identical to SEQ ID NO: 72817

SEQ ID NO: 472228 - RNA, 64 nt, Human; identical to SEQ ID NO: 72818

SEQ ID NO: 472229 - RNA, 53 nt, Human; identical to SEQ ID NO: 72819

SEQ ID NO: 472230 - RNA, 64 nt, Human; identical to SEQ ID NO: 72820

SEQ ID NO: 472231 - RNA, 64 nt, Human; identical to SEQ ID NO: 72821

SEQ ID NO: 472232 - RNA, 64 nt, Human; identical to SEQ ID NO: 72822

SEQ ID NO: 472233 - RNA, 64 nt, Human; identical to SEQ ID NO: 72823

SEQ ID NO: 472234 - RNA, 64 nt, Human; identical to SEQ ID NO: 72824

SEQ ID NO: 472235 - RNA, 64 nt, Human; identical to SEQ ID NO: 72825

SEQ ID NO: 472236 - RNA, 64 nt, Human; identical to SEQ ID NO: 72826

SEQ ID NO: 472237 - RNA, 64 nt, Human; identical to SEQ ID NO: 72827

SEQ ID NO: 472238 - RNA, 64 nt, Human; identical to SEQ ID NO: 72828

SEQ ID NO: 472239 - RNA, 64 nt, Human; identical to SEQ ID NO: 72829

SEQ ID NO: 472240 - RNA, 64 nt, Human; identical to SEQ ID NO: 72830

SEQ ID NO: 472241 - RNA, 64 nt, Human; identical to SEQ ID NO: 72831

SEQ ID NO: 472242 - RNA, 64 nt, Human; identical to SEQ ID NO: 72832

SEQ ID NO: 472243 - RNA, 64 nt, Human; identical to SEQ ID NO: 72833

SEQ ID NO: 472244 - RNA, 64 nt, Human; identical to SEQ ID NO: 72834

SEQ ID NO: 472245 - RNA, 64 nt, Human; identical to SEQ ID NO: 72835

SEQ ID NO: 472246 - RNA, 64 nt, Human; identical to SEQ ID NO: 72836

SEQ ID NO: 472247 - RNA, 64 nt, Human; identical to SEQ ID NO: 72837

SEQ ID NO: 472248 - RNA, 64 nt, Human; identical to SEQ ID NO: 72838

SEQ ID NO: 472249 - RNA, 64 nt, Human; identical to SEQ ID NO: 72839

SEQ ID NO: 472250 - RNA, 64 nt, Human; identical to SEQ ID NO: 72840

SEQ ID NO: 472251 - RNA, 64 nt, Human; identical to SEQ ID NO: 72841

SEQ ID NO: 472252 - RNA, 64 nt, Human; identical to SEQ ID NO: 72842

SEQ ID NO: 472253 - RNA, 64 nt, Human; identical to SEQ ID NO: 72843

SEQ ID NO: 472254 - RNA, 64 nt, Human; identical to SEQ ID NO: 72844

SEQ ID NO: 472255 - RNA, 64 nt, Human; identical to SEQ ID NO: 72845

SEQ ID NO: 472256 - RNA, 64 nt, Human; identical to SEQ ID NO: 72846

SEQ ID NO: 472257 - RNA, 64 nt, Human; identical to SEQ ID NO: 72847

SEQ ID NO: 472258 - RNA, 64 nt, Human; identical to SEQ ID NO: 72848

SEQ ID NO: 472259 - RNA, 64 nt, Human; identical to SEQ ID NO: 72849

SEQ ID NO: 472260 - RNA, 64 nt, Human; identical to SEQ ID NO: 72850

SEQ ID NO: 472261 - RNA, 64 nt, Human; identical to SEQ ID NO: 72851

SEQ ID NO: 472262 - RNA, 64 nt, Human; identical to SEQ ID NO: 72852

SEQ ID NO: 472263 - RNA, 64 nt, Human; identical to SEQ ID NO: 72853

SEQ ID NO: 472264 - RNA, 64 nt, Human; identical to SEQ ID NO: 72854

SEQ ID NO: 472265 - RNA, 64 nt, Human; identical to SEQ ID NO: 72855

SEQ ID NO: 472266 - RNA, 64 nt, Human; identical to SEQ ID NO: 72856

SEQ ID NO: 472267 - RNA, 64 nt, Human; identical to SEQ ID NO: 72857

SEQ ID NO: 472268 - RNA, 64 nt, Human; identical to SEQ ID NO: 72858

SEQ ID NO: 472269 - RNA, 64 nt, Human; identical to SEQ ID NO: 72859

SEQ ID NO: 472270 - RNA, 64 nt, Human; identical to SEQ ID NO: 72860

SEQ ID NO: 472271 - RNA, 64 nt, Human; identical to SEQ ID NO: 72861

SEQ ID NO: 472272 - RNA, 64 nt, Human; identical to SEQ ID NO: 72862

SEQ ID NO: 472273 - RNA, 64 nt, Human; identical to SEQ ID NO: 72863

SEQ ID NO: 472274 - RNA, 64 nt, Human; identical to SEQ ID NO: 72864

SEQ ID NO: 472275 - RNA, 64 nt, Human; identical to SEQ ID NO: 72865

SEQ ID NO: 472276 - RNA, 64 nt, Human; identical to SEQ ID NO: 72866

SEQ ID NO: 472277 - RNA, 64 nt, Human; identical to SEQ ID NO: 72867

SEQ ID NO: 472278 - RNA, 64 nt, Human; identical to SEQ ID NO: 72868

SEQ ID NO: 472279 - RNA, 64 nt, Human; identical to SEQ ID NO: 72869

SEQ ID NO: 472280 - RNA, 64 nt, Human; identical to SEQ ID NO: 72870

SEQ ID NO: 472281 - RNA, 64 nt, Human; identical to SEQ ID NO: 72871

SEQ ID NO: 472282 - RNA, 64 nt, Human; identical to SEQ ID NO: 72872

SEQ ID NO: 472283 - RNA, 64 nt, Human; identical to SEQ ID NO: 72873

SEQ ID NO: 472284 - RNA, 64 nt, Human; identical to SEQ ID NO: 72874

SEQ ID NO: 472285 - RNA, 64 nt, Human; identical to SEQ ID NO: 72875

SEQ ID NO: 472286 - RNA, 64 nt, Human; identical to SEQ ID NO: 72876

SEQ ID NO: 472287 - RNA, 64 nt, Human; identical to SEQ ID NO: 72877

SEQ ID NO: 472288 - RNA, 64 nt, Human; identical to SEQ ID NO: 72878

SEQ ID NO: 472289 - RNA, 64 nt, Human; identical to SEQ ID NO: 72879

SEQ ID NO: 472290 - RNA, 53 nt, Human; identical to SEQ ID NO: 72880

SEQ ID NO: 472291 - RNA, 64 nt, Human; identical to SEQ ID NO: 72881

SEQ ID NO: 472292 - RNA, 64 nt, Human; identical to SEQ ID NO: 72882

SEQ ID NO: 472293 - RNA, 64 nt, Human; identical to SEQ ID NO: 72883

SEQ ID NO: 472294 - RNA, 64 nt, Human; identical to SEQ ID NO: 72884

SEQ ID NO: 472295 - RNA, 64 nt, Human; identical to SEQ ID NO: 72885

SEQ ID NO: 472296 - RNA, 64 nt, Human; identical to SEQ ID NO: 72886

SEQ ID NO: 472297 - RNA, 64 nt, Human; identical to SEQ ID NO: 72887

SEQ ID NO: 472298 - RNA, 64 nt, Human; identical to SEQ ID NO: 72888

SEQ ID NO: 472299 - RNA, 64 nt, Human; identical to SEQ ID NO: 72889

SEQ ID NO: 472300 - RNA, 64 nt, Human; identical to SEQ ID NO: 72890

SEQ ID NO: 472301 - RNA, 64 nt, Human; identical to SEQ ID NO: 72891

SEQ ID NO: 472302 - RNA, 64 nt, Human; identical to SEQ ID NO: 72892

SEQ ID NO: 472303 - RNA, 64 nt, Human; identical to SEQ ID NO: 72893

SEQ ID NO: 472304 - RNA, 64 nt, Human; identical to SEQ ID NO: 72894

SEQ ID NO: 472305 - RNA, 64 nt, Human; identical to SEQ ID NO: 72895

SEQ ID NO: 472306 - RNA, 64 nt, Human; identical to SEQ ID NO: 72896

SEQ ID NO: 472307 - RNA, 64 nt, Human; identical to SEQ ID NO: 72897

SEQ ID NO: 472308 - RNA, 64 nt, Human; identical to SEQ ID NO: 72898

SEQ ID NO: 472309 - RNA, 64 nt, Human; identical to SEQ ID NO: 72899

SEQ ID NO: 472310 - RNA, 64 nt, Human; identical to SEQ ID NO: 72900

SEQ ID NO: 472311 - RNA, 64 nt, Human; identical to SEQ ID NO: 72901

SEQ ID NO: 472312 - RNA, 64 nt, Human; identical to SEQ ID NO: 72902

SEQ ID NO: 472313 - RNA, 64 nt, Human; identical to SEQ ID NO: 72903

SEQ ID NO: 472314 - RNA, 59 nt, Human; identical to SEQ ID NO: 72904

SEQ ID NO: 472315 - RNA, 64 nt, Human; identical to SEQ ID NO: 72905

SEQ ID NO: 472316 - RNA, 64 nt, Human; identical to SEQ ID NO: 72906

SEQ ID NO: 472317 - RNA, 64 nt, Human; identical to SEQ ID NO: 72907

SEQ ID NO: 472318 - RNA, 64 nt, Human; identical to SEQ ID NO: 72908

SEQ ID NO: 472319 - RNA, 64 nt, Human; identical to SEQ ID NO: 72909

SEQ ID NO: 472320 - RNA, 64 nt, Human; identical to SEQ ID NO: 72910

SEQ ID NO: 472321 - RNA, 64 nt, Human; identical to SEQ ID NO: 72911

SEQ ID NO: 472322 - RNA, 64 nt, Human; identical to SEQ ID NO: 72912

SEQ ID NO: 472323 - RNA, 64 nt, Human; identical to SEQ ID NO: 72913

SEQ ID NO: 472324 - RNA, 64 nt, Human; identical to SEQ ID NO: 72914

SEQ ID NO: 472325 - RNA, 64 nt, Human; identical to SEQ ID NO: 72915

SEQ ID NO: 472326 - RNA, 64 nt, Human; identical to SEQ ID NO: 72916

SEQ ID NO: 472327 - RNA, 64 nt, Human; identical to SEQ ID NO: 72917

SEQ ID NO: 472328 - RNA, 64 nt, Human; identical to SEQ ID NO: 72918

SEQ ID NO: 472329 - RNA, 64 nt, Human; identical to SEQ ID NO: 72919

SEQ ID NO: 472330 - RNA, 64 nt, Human; identical to SEQ ID NO: 72920

SEQ ID NO: 472331 - RNA, 64 nt, Human; identical to SEQ ID NO: 72921

SEQ ID NO: 472332 - RNA, 64 nt, Human; identical to SEQ ID NO: 72922

SEQ ID NO: 472333 - RNA, 64 nt, Human; identical to SEQ ID NO: 72923

SEQ ID NO: 472334 - RNA, 64 nt, Human; identical to SEQ ID NO: 72924

SEQ ID NO: 472335 - RNA, 64 nt, Human; identical to SEQ ID NO: 72925

SEQ ID NO: 472336 - RNA, 64 nt, Human; identical to SEQ ID NO: 72926

SEQ ID NO: 472337 - RNA, 64 nt, Human; identical to SEQ ID NO: 72927

SEQ ID NO: 472338 - RNA, 64 nt, Human; identical to SEQ ID NO: 72928

SEQ ID NO: 472339 - RNA, 64 nt, Human; identical to SEQ ID NO: 72929

SEQ ID NO: 472340 - RNA, 64 nt, Human; identical to SEQ ID NO: 72930

SEQ ID NO: 472341 - RNA, 64 nt, Human; identical to SEQ ID NO: 72931

SEQ ID NO: 472342 - RNA, 64 nt, Human; identical to SEQ ID NO: 72932

SEQ ID NO: 472343 - RNA, 64 nt, Human; identical to SEQ ID NO: 72933

SEQ ID NO: 472344 - RNA, 64 nt, Human; identical to SEQ ID NO: 72934

SEQ ID NO: 472345 - RNA, 64 nt, Human; identical to SEQ ID NO: 72935

SEQ ID NO: 472346 - RNA, 64 nt, Human; identical to SEQ ID NO: 72936

SEQ ID NO: 472347 - RNA, 64 nt, Human; identical to SEQ ID NO: 72937

SEQ ID NO: 472348 - RNA, 64 nt, Human; identical to SEQ ID NO: 72938

SEQ ID NO: 472349 - RNA, 64 nt, Human; identical to SEQ ID NO: 72939

SEQ ID NO: 472350 - RNA, 64 nt, Human; identical to SEQ ID NO: 72940

SEQ ID NO: 472351 - RNA, 64 nt, Human; identical to SEQ ID NO: 72941

SEQ ID NO: 472352 - RNA, 64 nt, Human; identical to SEQ ID NO: 72942

SEQ ID NO: 472353 - RNA, 64 nt, Human; identical to SEQ ID NO: 72943

SEQ ID NO: 472354 - RNA, 64 nt, Human; identical to SEQ ID NO: 72944

SEQ ID NO: 472355 - RNA, 64 nt, Human; identical to SEQ ID NO: 72945

SEQ ID NO: 472356 - RNA, 64 nt, Human; identical to SEQ ID NO: 72946

SEQ ID NO: 472357 - RNA, 64 nt, Human; identical to SEQ ID NO: 72947

SEQ ID NO: 472358 - RNA, 64 nt, Human; identical to SEQ ID NO: 72948

SEQ ID NO: 472359 - RNA, 64 nt, Human; identical to SEQ ID NO: 72949

SEQ ID NO: 472360 - RNA, 64 nt, Human; identical to SEQ ID NO: 72950

SEQ ID NO: 472361 - RNA, 64 nt, Human; identical to SEQ ID NO: 72951

SEQ ID NO: 472362 - RNA, 64 nt, Human; identical to SEQ ID NO: 72952

SEQ ID NO: 472363 - RNA, 64 nt, Human; identical to SEQ ID NO: 72953

SEQ ID NO: 472364 - RNA, 64 nt, Human; identical to SEQ ID NO: 72954

SEQ ID NO: 472365 - RNA, 64 nt, Human; identical to SEQ ID NO: 72955

SEQ ID NO: 472366 - RNA, 64 nt, Human; identical to SEQ ID NO: 72956

SEQ ID NO: 472367 - RNA, 64 nt, Human; identical to SEQ ID NO: 72957

SEQ ID NO: 472368 - RNA, 64 nt, Human; identical to SEQ ID NO: 72958

SEQ ID NO: 472369 - RNA, 64 nt, Human; identical to SEQ ID NO: 72959

SEQ ID NO: 472370 - RNA, 64 nt, Human; identical to SEQ ID NO: 72960

SEQ ID NO: 472371 - RNA, 64 nt, Human; identical to SEQ ID NO: 72961

SEQ ID NO: 472372 - RNA, 64 nt, Human; identical to SEQ ID NO: 72962

SEQ ID NO: 472373 - RNA, 64 nt, Human; identical to SEQ ID NO: 72963

SEQ ID NO: 472374 - RNA, 62 nt, Human; identical to SEQ ID NO: 72964

SEQ ID NO: 472375 - RNA, 64 nt, Human; identical to SEQ ID NO: 72965

SEQ ID NO: 472376 - RNA, 59 nt, Human; identical to SEQ ID NO: 72966

SEQ ID NO: 472377 - RNA, 64 nt, Human; identical to SEQ ID NO: 72967

SEQ ID NO: 472378 - RNA, 64 nt, Human; identical to SEQ ID NO: 72968

SEQ ID NO: 472379 - RNA, 64 nt, Human; identical to SEQ ID NO: 72969

SEQ ID NO: 472380 - RNA, 64 nt, Human; identical to SEQ ID NO: 72970

SEQ ID NO: 472381 - RNA, 64 nt, Human; identical to SEQ ID NO: 72971

SEQ ID NO: 472382 - RNA, 64 nt, Human; identical to SEQ ID NO: 72972

SEQ ID NO: 472383 - RNA, 64 nt, Human; identical to SEQ ID NO: 72973

SEQ ID NO: 472384 - RNA, 64 nt, Human; identical to SEQ ID NO: 72974

SEQ ID NO: 472385 - RNA, 64 nt, Human; identical to SEQ ID NO: 72975

SEQ ID NO: 472386 - RNA, 64 nt, Human; identical to SEQ ID NO: 72976

SEQ ID NO: 472387 - RNA, 64 nt, Human; identical to SEQ ID NO: 72977

SEQ ID NO: 472388 - RNA, 64 nt, Human; identical to SEQ ID NO: 72978

SEQ ID NO: 472389 - RNA, 64 nt, Human; identical to SEQ ID NO: 72979

SEQ ID NO: 472390 - RNA, 64 nt, Human; identical to SEQ ID NO: 72980

SEQ ID NO: 472391 - RNA, 64 nt, Human; identical to SEQ ID NO: 72981

SEQ ID NO: 472392 - RNA, 64 nt, Human; identical to SEQ ID NO: 72982

SEQ ID NO: 472393 - RNA, 64 nt, Human; identical to SEQ ID NO: 72983

SEQ ID NO: 472394 - RNA, 64 nt, Human; identical to SEQ ID NO: 72984

SEQ ID NO: 472395 - RNA, 64 nt, Human; identical to SEQ ID NO: 72985

SEQ ID NO: 472396 - RNA, 64 nt, Human; identical to SEQ ID NO: 72986

SEQ ID NO: 472397 - RNA, 64 nt, Human; identical to SEQ ID NO: 72987

SEQ ID NO: 472398 - RNA, 64 nt, Human; identical to SEQ ID NO: 72988

SEQ ID NO: 472399 - RNA, 64 nt, Human; identical to SEQ ID NO: 72989

SEQ ID NO: 472400 - RNA, 64 nt, Human; identical to SEQ ID NO: 72990

SEQ ID NO: 472401 - RNA, 64 nt, Human; identical to SEQ ID NO: 72991

SEQ ID NO: 472402 - RNA, 64 nt, Human; identical to SEQ ID NO: 72992

SEQ ID NO: 472403 - RNA, 64 nt, Human; identical to SEQ ID NO: 72993

SEQ ID NO: 472404 - RNA, 64 nt, Human; identical to SEQ ID NO: 72994

SEQ ID NO: 472405 - RNA, 64 nt, Human; identical to SEQ ID NO: 72995

SEQ ID NO: 472406 - RNA, 64 nt, Human; identical to SEQ ID NO: 72996

SEQ ID NO: 472407 - RNA, 64 nt, Human; identical to SEQ ID NO: 72997

SEQ ID NO: 472408 - RNA, 62 nt, Human; identical to SEQ ID NO: 72998

SEQ ID NO: 472409 - RNA, 64 nt, Human; identical to SEQ ID NO: 72999

SEQ ID NO: 472410 - RNA, 64 nt, Human; identical to SEQ ID NO: 73000

SEQ ID NO: 472411 - RNA, 64 nt, Human; identical to SEQ ID NO: 73001

SEQ ID NO: 472412 - RNA, 64 nt, Human; identical to SEQ ID NO: 73002

SEQ ID NO: 472413 - RNA, 64 nt, Human; identical to SEQ ID NO: 73003

SEQ ID NO: 472414 - RNA, 64 nt, Human; identical to SEQ ID NO: 73004

SEQ ID NO: 472415 - RNA, 64 nt, Human; identical to SEQ ID NO: 73005

SEQ ID NO: 472416 - RNA, 64 nt, Human; identical to SEQ ID NO: 73006

SEQ ID NO: 472417 - RNA, 64 nt, Human; identical to SEQ ID NO: 73007

SEQ ID NO: 472418 - RNA, 64 nt, Human; identical to SEQ ID NO: 73008

SEQ ID NO: 472419 - RNA, 64 nt, Human; identical to SEQ ID NO: 73009

SEQ ID NO: 472420 - RNA, 64 nt, Human; identical to SEQ ID NO: 73010

SEQ ID NO: 472421 - RNA, 64 nt, Human; identical to SEQ ID NO: 73011

SEQ ID NO: 472422 - RNA, 64 nt, Human; identical to SEQ ID NO: 73012

SEQ ID NO: 472423 - RNA, 64 nt, Human; identical to SEQ ID NO: 73013

SEQ ID NO: 472424 - RNA, 64 nt, Human; identical to SEQ ID NO: 73014

SEQ ID NO: 472425 - RNA, 64 nt, Human; identical to SEQ ID NO: 73015

SEQ ID NO: 472426 - RNA, 64 nt, Human; identical to SEQ ID NO: 73016

SEQ ID NO: 472427 - RNA, 64 nt, Human; identical to SEQ ID NO: 73017

SEQ ID NO: 472428 - RNA, 64 nt, Human; identical to SEQ ID NO: 73018

SEQ ID NO: 472429 - RNA, 64 nt, Human; identical to SEQ ID NO: 73019

SEQ ID NO: 472430 - RNA, 64 nt, Human; identical to SEQ ID NO: 73020

SEQ ID NO: 472431 - RNA, 64 nt, Human; identical to SEQ ID NO: 73021

SEQ ID NO: 472432 - RNA, 64 nt, Human; identical to SEQ ID NO: 73022

SEQ ID NO: 472433 - RNA, 64 nt, Human; identical to SEQ ID NO: 73023

SEQ ID NO: 472434 - RNA, 64 nt, Human; identical to SEQ ID NO: 73024

SEQ ID NO: 472435 - RNA, 64 nt, Human; identical to SEQ ID NO: 73025

SEQ ID NO: 472436 - RNA, 64 nt, Human; identical to SEQ ID NO: 73026

SEQ ID NO: 472437 - RNA, 64 nt, Human; identical to SEQ ID NO: 73027

SEQ ID NO: 472438 - RNA, 64 nt, Human; identical to SEQ ID NO: 73028

SEQ ID NO: 472439 - RNA, 64 nt, Human; identical to SEQ ID NO: 73029

SEQ ID NO: 472440 - RNA, 64 nt, Human; identical to SEQ ID NO: 73030

SEQ ID NO: 472441 - RNA, 64 nt, Human; identical to SEQ ID NO: 73031

SEQ ID NO: 472442 - RNA, 64 nt, Human; identical to SEQ ID NO: 73032

SEQ ID NO: 472443 - RNA, 64 nt, Human; identical to SEQ ID NO: 73033

SEQ ID NO: 472444 - RNA, 64 nt, Human; identical to SEQ ID NO: 73034

SEQ ID NO: 472445 - RNA, 64 nt, Human; identical to SEQ ID NO: 73035

SEQ ID NO: 472446 - RNA, 64 nt, Human; identical to SEQ ID NO: 73036

SEQ ID NO: 472447 - RNA, 64 nt, Human; identical to SEQ ID NO: 73037

SEQ ID NO: 472448 - RNA, 64 nt, Human; identical to SEQ ID NO: 73038

SEQ ID NO: 472449 - RNA, 64 nt, Human; identical to SEQ ID NO: 73039

SEQ ID NO: 472450 - RNA, 64 nt, Human; identical to SEQ ID NO: 73040

SEQ ID NO: 472451 - RNA, 64 nt, Human; identical to SEQ ID NO: 73041

SEQ ID NO: 472452 - RNA, 64 nt, Human; identical to SEQ ID NO: 73042

SEQ ID NO: 472453 - RNA, 64 nt, Human; identical to SEQ ID NO: 73043

SEQ ID NO: 472454 - RNA, 64 nt, Human; identical to SEQ ID NO: 73044

SEQ ID NO: 472455 - RNA, 64 nt, Human; identical to SEQ ID NO: 73045

SEQ ID NO: 472456 - RNA, 64 nt, Human; identical to SEQ ID NO: 73046

SEQ ID NO: 472457 - RNA, 64 nt, Human; identical to SEQ ID NO: 73047

SEQ ID NO: 472458 - RNA, 64 nt, Human; identical to SEQ ID NO: 73048

SEQ ID NO: 472459 - RNA, 64 nt, Human; identical to SEQ ID NO: 73049

SEQ ID NO: 472460 - RNA, 64 nt, Human; identical to SEQ ID NO: 73050

SEQ ID NO: 472461 - RNA, 64 nt, Human; identical to SEQ ID NO: 73051

SEQ ID NO: 472462 - RNA, 64 nt, Human; identical to SEQ ID NO: 73052

SEQ ID NO: 472463 - RNA, 64 nt, Human; identical to SEQ ID NO: 73053

SEQ ID NO: 472464 - RNA, 59 nt, Human; identical to SEQ ID NO: 73054

SEQ ID NO: 472465 - RNA, 64 nt, Human; identical to SEQ ID NO: 73055

SEQ ID NO: 472466 - RNA, 64 nt, Human; identical to SEQ ID NO: 73056

SEQ ID NO: 472467 - RNA, 64 nt, Human; identical to SEQ ID NO: 73057

SEQ ID NO: 472468 - RNA, 64 nt, Human; identical to SEQ ID NO: 73058

SEQ ID NO: 472469 - RNA, 64 nt, Human; identical to SEQ ID NO: 73059

SEQ ID NO: 472470 - RNA, 64 nt, Human; identical to SEQ ID NO: 73060

SEQ ID NO: 472471 - RNA, 64 nt, Human; identical to SEQ ID NO: 73061

SEQ ID NO: 472472 - RNA, 64 nt, Human; identical to SEQ ID NO: 73062

SEQ ID NO: 472473 - RNA, 64 nt, Human; identical to SEQ ID NO: 73063

SEQ ID NO: 472474 - RNA, 64 nt, Human; identical to SEQ ID NO: 73064

SEQ ID NO: 472475 - RNA, 64 nt, Human; identical to SEQ ID NO: 73065

SEQ ID NO: 472476 - RNA, 64 nt, Human; identical to SEQ ID NO: 73066

SEQ ID NO: 472477 - RNA, 64 nt, Human; identical to SEQ ID NO: 73067

SEQ ID NO: 472478 - RNA, 64 nt, Human; identical to SEQ ID NO: 73068

SEQ ID NO: 472479 - RNA, 64 nt, Human; identical to SEQ ID NO: 73069

SEQ ID NO: 472480 - RNA, 64 nt, Human; identical to SEQ ID NO: 73070

SEQ ID NO: 472481 - RNA, 64 nt, Human; identical to SEQ ID NO: 73071

SEQ ID NO: 472482 - RNA, 64 nt, Human; identical to SEQ ID NO: 73056

SEQ ID NO: 472483 - RNA, 64 nt, Human; identical to SEQ ID NO: 73073

SEQ ID NO: 472484 - RNA, 64 nt, Human; identical to SEQ ID NO: 73074

SEQ ID NO: 472485 - RNA, 54 nt, Human; identical to SEQ ID NO: 73075

SEQ ID NO: 472486 - RNA, 64 nt, Human; identical to SEQ ID NO: 73076

SEQ ID NO: 472487 - RNA, 64 nt, Human; identical to SEQ ID NO: 73077

SEQ ID NO: 472488 - RNA, 64 nt, Human; identical to SEQ ID NO: 73078

SEQ ID NO: 472489 - RNA, 64 nt, Human; identical to SEQ ID NO: 73079

SEQ ID NO: 472490 - RNA, 62 nt, Human; identical to SEQ ID NO: 471966

SEQ ID NO: 472491 - RNA, 62 nt, Human; identical to SEQ ID NO: 471967

SEQ ID NO: 472492 - RNA, 62 nt, Human; identical to SEQ ID NO: 471968

SEQ ID NO: 472493 - RNA, 62 nt, Human; identical to SEQ ID NO: 471969

SEQ ID NO: 472494 - RNA, 62 nt, Human; identical to SEQ ID NO: 471970

SEQ ID NO: 472495 - RNA, 62 nt, Human; identical to SEQ ID NO: 471971

SEQ ID NO: 472496 - RNA, 62 nt, Human; identical to SEQ ID NO: 471972

SEQ ID NO: 472497 - RNA, 62 nt, Human; identical to SEQ ID NO: 471973

SEQ ID NO: 472498 - RNA, 62 nt, Human; identical to SEQ ID NO: 471974

SEQ ID NO: 472499 - RNA, 62 nt, Human; identical to SEQ ID NO: 471975

SEQ ID NO: 472500 - RNA, 62 nt, Human; identical to SEQ ID NO: 471976

SEQ ID NO: 472501 - RNA, 62 nt, Human; identical to SEQ ID NO: 471977

SEQ ID NO: 472502 - RNA, 62 nt, Human; identical to SEQ ID NO: 471978

SEQ ID NO: 472503 - RNA, 62 nt, Human; identical to SEQ ID NO: 471979

SEQ ID NO: 472504 - RNA, 62 nt, Human; identical to SEQ ID NO: 471980

SEQ ID NO: 472505 - RNA, 62 nt, Human; identical to SEQ ID NO: 471981

SEQ ID NO: 472506 - RNA, 62 nt, Human; identical to SEQ ID NO: 471982

SEQ ID NO: 472507 - RNA, 62 nt, Human; identical to SEQ ID NO: 471983

SEQ ID NO: 472508 - RNA, 62 nt, Human; identical to SEQ ID NO: 471984

SEQ ID NO: 472509 - RNA, 62 nt, Human; identical to SEQ ID NO: 471985

SEQ ID NO: 472510 - RNA, 62 nt, Human; identical to SEQ ID NO: 471986

SEQ ID NO: 472511 - RNA, 62 nt, Human; identical to SEQ ID NO: 471987

SEQ ID NO: 472512 - RNA, 62 nt, Human; identical to SEQ ID NO: 471988

SEQ ID NO: 472513 - RNA, 62 nt, Human; identical to SEQ ID NO: 471989

SEQ ID NO: 472514 - RNA, 62 nt, Human; identical to SEQ ID NO: 471990

SEQ ID NO: 472515 - RNA, 62 nt, Human; identical to SEQ ID NO: 471991

SEQ ID NO: 472516 - RNA, 62 nt, Human; identical to SEQ ID NO: 471992

SEQ ID NO: 472517 - RNA, 62 nt, Human; identical to SEQ ID NO: 471993

SEQ ID NO: 472518 - RNA, 62 nt, Human; identical to SEQ ID NO: 471994

SEQ ID NO: 472519 - RNA, 62 nt, Human; identical to SEQ ID NO: 471995

SEQ ID NO: 472520 - RNA, 62 nt, Human; identical to SEQ ID NO: 471996

SEQ ID NO: 472521 - RNA, 56 nt, Human; identical to SEQ ID NO: 313978

SEQ ID NO: 472522 - RNA, 62 nt, Human; identical to SEQ ID NO: 471998

SEQ ID NO: 472523 - RNA, 62 nt, Human; identical to SEQ ID NO: 471999

SEQ ID NO: 472524 - RNA, 62 nt, Human; identical to SEQ ID NO: 472000

SEQ ID NO: 472525 - RNA, 62 nt, Human; identical to SEQ ID NO: 472001

SEQ ID NO: 472526 - RNA, 62 nt, Human; identical to SEQ ID NO: 472002

SEQ ID NO: 472527 - RNA, 62 nt, Human; identical to SEQ ID NO: 472003

SEQ ID NO: 472528 - RNA, 62 nt, Human; identical to SEQ ID NO: 472004

SEQ ID NO: 472529 - RNA, 62 nt, Human; identical to SEQ ID NO: 472005

SEQ ID NO: 472530 - RNA, 62 nt, Human; identical to SEQ ID NO: 472006

SEQ ID NO: 472531 - RNA, 62 nt, Human; identical to SEQ ID NO: 472007

SEQ ID NO: 472532 - RNA, 53 nt, Human; identical to SEQ ID NO: 314343

SEQ ID NO: 472533 - RNA, 62 nt, Human; identical to SEQ ID NO: 472009

SEQ ID NO: 472534 - RNA, 62 nt, Human; identical to SEQ ID NO: 472010

SEQ ID NO: 472535 - RNA, 62 nt, Human; identical to SEQ ID NO: 472011

SEQ ID NO: 472536 - RNA, 62 nt, Human; identical to SEQ ID NO: 472012

SEQ ID NO: 472537 - RNA, 62 nt, Human; identical to SEQ ID NO: 472013

SEQ ID NO: 472538 - RNA, 62 nt, Human; identical to SEQ ID NO: 472014

SEQ ID NO: 472539 - RNA, 62 nt, Human; identical to SEQ ID NO: 472015

SEQ ID NO: 472540 - RNA, 62 nt, Human; identical to SEQ ID NO: 472016

SEQ ID NO: 472541 - RNA, 62 nt, Human; identical to SEQ ID NO: 472017

SEQ ID NO: 472542 - RNA, 62 nt, Human; identical to SEQ ID NO: 472018

SEQ ID NO: 472543 - RNA, 62 nt, Human; identical to SEQ ID NO: 472019

SEQ ID NO: 472544 - RNA, 62 nt, Human; identical to SEQ ID NO: 472020

SEQ ID NO: 472545 - RNA, 62 nt, Human; identical to SEQ ID NO: 472021

SEQ ID NO: 472546 - RNA, 62 nt, Human; identical to SEQ ID NO: 472022

SEQ ID NO: 472547 - RNA, 62 nt, Human; identical to SEQ ID NO: 472023

SEQ ID NO: 472548 - RNA, 62 nt, Human; identical to SEQ ID NO: 472024

SEQ ID NO: 472549 - RNA, 62 nt, Human; identical to SEQ ID NO: 472025

SEQ ID NO: 472550 - RNA, 62 nt, Human; identical to SEQ ID NO: 472026

SEQ ID NO: 472551 - RNA, 62 nt, Human; identical to SEQ ID NO: 472027

SEQ ID NO: 472552 - RNA, 62 nt, Human; identical to SEQ ID NO: 472028

SEQ ID NO: 472553 - RNA, 62 nt, Human; identical to SEQ ID NO: 472029

SEQ ID NO: 472554 - RNA, 62 nt, Human; identical to SEQ ID NO: 472030

SEQ ID NO: 472555 - RNA, 62 nt, Human; identical to SEQ ID NO: 472031

SEQ ID NO: 472556 - RNA, 62 nt, Human; identical to SEQ ID NO: 472032

SEQ ID NO: 472557 - RNA, 62 nt, Human; identical to SEQ ID NO: 472033

SEQ ID NO: 472558 - RNA, 62 nt, Human; identical to SEQ ID NO: 472034

SEQ ID NO: 472559 - RNA, 62 nt, Human; identical to SEQ ID NO: 472035

SEQ ID NO: 472560 - RNA, 62 nt, Human; identical to SEQ ID NO: 472036

SEQ ID NO: 472561 - RNA, 62 nt, Human; identical to SEQ ID NO: 472037

SEQ ID NO: 472562 - RNA, 62 nt, Human; identical to SEQ ID NO: 472038

SEQ ID NO: 472563 - RNA, 62 nt, Human; identical to SEQ ID NO: 472039

SEQ ID NO: 472564 - RNA, 62 nt, Human; identical to SEQ ID NO: 472040

SEQ ID NO: 472565 - RNA, 62 nt, Human; identical to SEQ ID NO: 472041

SEQ ID NO: 472566 - RNA, 58 nt, Human; identical to SEQ ID NO: 314377

SEQ ID NO: 472567 - RNA, 62 nt, Human; identical to SEQ ID NO: 472043

SEQ ID NO: 472568 - RNA, 62 nt, Human; identical to SEQ ID NO: 472044

SEQ ID NO: 472569 - RNA, 62 nt, Human; identical to SEQ ID NO: 472045

SEQ ID NO: 472570 - RNA, 62 nt, Human; identical to SEQ ID NO: 472046

SEQ ID NO: 472571 - RNA, 62 nt, Human; identical to SEQ ID NO: 472047

SEQ ID NO: 472572 - RNA, 62 nt, Human; identical to SEQ ID NO: 472048

SEQ ID NO: 472573 - RNA, 62 nt, Human; identical to SEQ ID NO: 472049

SEQ ID NO: 472574 - RNA, 62 nt, Human; identical to SEQ ID NO: 472050

SEQ ID NO: 472575 - RNA, 62 nt, Human; identical to SEQ ID NO: 472051

SEQ ID NO: 472576 - RNA, 62 nt, Human; identical to SEQ ID NO: 472052

SEQ ID NO: 472577 - RNA, 62 nt, Human; identical to SEQ ID NO: 472053

SEQ ID NO: 472578 - RNA, 62 nt, Human; identical to SEQ ID NO: 472054

SEQ ID NO: 472579 - RNA, 62 nt, Human; identical to SEQ ID NO: 472055

SEQ ID NO: 472580 - RNA, 62 nt, Human; identical to SEQ ID NO: 472056

SEQ ID NO: 472581 - RNA, 62 nt, Human; identical to SEQ ID NO: 472057

SEQ ID NO: 472582 - RNA, 62 nt, Human; identical to SEQ ID NO: 472058

SEQ ID NO: 472583 - RNA, 62 nt, Human; identical to SEQ ID NO: 472059

SEQ ID NO: 472584 - RNA, 62 nt, Human; identical to SEQ ID NO: 472060

SEQ ID NO: 472585 - RNA, 62 nt, Human; identical to SEQ ID NO: 472061

SEQ ID NO: 472586 - RNA, 62 nt, Human; identical to SEQ ID NO: 472062

SEQ ID NO: 472587 - RNA, 62 nt, Human; identical to SEQ ID NO: 472063

SEQ ID NO: 472588 - RNA, 62 nt, Human; identical to SEQ ID NO: 472064

SEQ ID NO: 472589 - RNA, 53 nt, Human; identical to SEQ ID NO: 314400

SEQ ID NO: 472590 - RNA, 62 nt, Human; identical to SEQ ID NO: 472066

SEQ ID NO: 472591 - RNA, 62 nt, Human; identical to SEQ ID NO: 472067

SEQ ID NO: 472592 - RNA, 62 nt, Human; identical to SEQ ID NO: 472068

SEQ ID NO: 472593 - RNA, 62 nt, Human; identical to SEQ ID NO: 472069

SEQ ID NO: 472594 - RNA, 62 nt, Human; identical to SEQ ID NO: 472070

SEQ ID NO: 472595 - RNA, 62 nt, Human; identical to SEQ ID NO: 472071

SEQ ID NO: 472596 - RNA, 62 nt, Human; identical to SEQ ID NO: 472072

SEQ ID NO: 472597 - RNA, 62 nt, Human; identical to SEQ ID NO: 472073

SEQ ID NO: 472598 - RNA, 62 nt, Human; identical to SEQ ID NO: 472074

SEQ ID NO: 472599 - RNA, 62 nt, Human; identical to SEQ ID NO: 472075

SEQ ID NO: 472600 - RNA, 62 nt, Human; identical to SEQ ID NO: 472076

SEQ ID NO: 472601 - RNA, 62 nt, Human; identical to SEQ ID NO: 472077

SEQ ID NO: 472602 - RNA, 62 nt, Human; identical to SEQ ID NO: 472078

SEQ ID NO: 472603 - RNA, 62 nt, Human; identical to SEQ ID NO: 472079

SEQ ID NO: 472604 - RNA, 62 nt, Human; identical to SEQ ID NO: 472080

SEQ ID NO: 472605 - RNA, 62 nt, Human; identical to SEQ ID NO: 472081

SEQ ID NO: 472606 - RNA, 62 nt, Human; identical to SEQ ID NO: 472082

SEQ ID NO: 472607 - RNA, 62 nt, Human; identical to SEQ ID NO: 472083

SEQ ID NO: 472608 - RNA, 62 nt, Human; identical to SEQ ID NO: 472084

SEQ ID NO: 472609 - RNA, 62 nt, Human; identical to SEQ ID NO: 472085

SEQ ID NO: 472610 - RNA, 62 nt, Human; identical to SEQ ID NO: 472086

SEQ ID NO: 472611 - RNA, 62 nt, Human; identical to SEQ ID NO: 472087

SEQ ID NO: 472612 - RNA, 62 nt, Human; identical to SEQ ID NO: 472088

SEQ ID NO: 472613 - RNA, 62 nt, Human; identical to SEQ ID NO: 472089

SEQ ID NO: 472614 - RNA, 62 nt, Human; identical to SEQ ID NO: 472090

SEQ ID NO: 472615 - RNA, 62 nt, Human; identical to SEQ ID NO: 472091

SEQ ID NO: 472616 - RNA, 62 nt, Human; identical to SEQ ID NO: 472092

SEQ ID NO: 472617 - RNA, 62 nt, Human; identical to SEQ ID NO: 472093

SEQ ID NO: 472618 - RNA, 62 nt, Human; identical to SEQ ID NO: 472094

SEQ ID NO: 472619 - RNA, 62 nt, Human; identical to SEQ ID NO: 472095

SEQ ID NO: 472620 - RNA, 62 nt, Human; identical to SEQ ID NO: 472096

SEQ ID NO: 472621 - RNA, 62 nt, Human; identical to SEQ ID NO: 472097

SEQ ID NO: 472622 - RNA, 62 nt, Human; identical to SEQ ID NO: 472098

SEQ ID NO: 472623 - RNA, 62 nt, Human; identical to SEQ ID NO: 472099

SEQ ID NO: 472624 - RNA, 62 nt, Human; identical to SEQ ID NO: 472100

SEQ ID NO: 472625 - RNA, 62 nt, Human; identical to SEQ ID NO: 472101

SEQ ID NO: 472626 - RNA, 62 nt, Human; identical to SEQ ID NO: 472102

SEQ ID NO: 472627 - RNA, 62 nt, Human; identical to SEQ ID NO: 472103

SEQ ID NO: 472628 - RNA, 62 nt, Human; identical to SEQ ID NO: 472104

SEQ ID NO: 472629 - RNA, 62 nt, Human; identical to SEQ ID NO: 472105

SEQ ID NO: 472630 - RNA, 62 nt, Human; identical to SEQ ID NO: 472106

SEQ ID NO: 472631 - RNA, 62 nt, Human; identical to SEQ ID NO: 472107

SEQ ID NO: 472632 - RNA, 62 nt, Human; identical to SEQ ID NO: 472108

SEQ ID NO: 472633 - RNA, 62 nt, Human; identical to SEQ ID NO: 472109

SEQ ID NO: 472634 - RNA, 62 nt, Human; identical to SEQ ID NO: 472110

SEQ ID NO: 472635 - RNA, 62 nt, Human; identical to SEQ ID NO: 472111

SEQ ID NO: 472636 - RNA, 62 nt, Human; identical to SEQ ID NO: 472112

SEQ ID NO: 472637 - RNA, 62 nt, Human; identical to SEQ ID NO: 472113

SEQ ID NO: 472638 - RNA, 62 nt, Human; identical to SEQ ID NO: 472114

SEQ ID NO: 472639 - RNA, 62 nt, Human; identical to SEQ ID NO: 472115

SEQ ID NO: 472640 - RNA, 62 nt, Human; identical to SEQ ID NO: 472116

SEQ ID NO: 472641 - RNA, 62 nt, Human; identical to SEQ ID NO: 472117

SEQ ID NO: 472642 - RNA, 62 nt, Human; identical to SEQ ID NO: 472118

SEQ ID NO: 472643 - RNA, 62 nt, Human; identical to SEQ ID NO: 472119

SEQ ID NO: 472644 - RNA, 62 nt, Human; identical to SEQ ID NO: 472120

SEQ ID NO: 472645 - RNA, 62 nt, Human; identical to SEQ ID NO: 472121

SEQ ID NO: 472646 - RNA, 62 nt, Human; identical to SEQ ID NO: 472122

SEQ ID NO: 472647 - RNA, 62 nt, Human; identical to SEQ ID NO: 472123

SEQ ID NO: 472648 - RNA, 62 nt, Human; identical to SEQ ID NO: 472124

SEQ ID NO: 472649 - RNA, 62 nt, Human; identical to SEQ ID NO: 472125

SEQ ID NO: 472650 - RNA, 62 nt, Human; identical to SEQ ID NO: 472126

SEQ ID NO: 472651 - RNA, 62 nt, Human; identical to SEQ ID NO: 472127

SEQ ID NO: 472652 - RNA, 62 nt, Human; identical to SEQ ID NO: 472128

SEQ ID NO: 472653 - RNA, 62 nt, Human; identical to SEQ ID NO: 472129

SEQ ID NO: 472654 - RNA, 62 nt, Human; identical to SEQ ID NO: 472130

SEQ ID NO: 472655 - RNA, 62 nt, Human; identical to SEQ ID NO: 472131

SEQ ID NO: 472656 - RNA, 62 nt, Human; identical to SEQ ID NO: 472132

SEQ ID NO: 472657 - RNA, 62 nt, Human; identical to SEQ ID NO: 472133

SEQ ID NO: 472658 - RNA, 62 nt, Human; identical to SEQ ID NO: 472134

SEQ ID NO: 472659 - RNA, 62 nt, Human; identical to SEQ ID NO: 472135

SEQ ID NO: 472660 - RNA, 62 nt, Human; identical to SEQ ID NO: 472136

SEQ ID NO: 472661 - RNA, 62 nt, Human; identical to SEQ ID NO: 472137

SEQ ID NO: 472662 - RNA, 62 nt, Human; identical to SEQ ID NO: 472138

SEQ ID NO: 472663 - RNA, 62 nt, Human; identical to SEQ ID NO: 472139

SEQ ID NO: 472664 - RNA, 62 nt, Human; identical to SEQ ID NO: 472140

SEQ ID NO: 472665 - RNA, 62 nt, Human; identical to SEQ ID NO: 472141

SEQ ID NO: 472666 - RNA, 62 nt, Human; identical to SEQ ID NO: 472142

SEQ ID NO: 472667 - RNA, 62 nt, Human; identical to SEQ ID NO: 472143

SEQ ID NO: 472668 - RNA, 62 nt, Human; identical to SEQ ID NO: 472144

SEQ ID NO: 472669 - RNA, 62 nt, Human; identical to SEQ ID NO: 472145

SEQ ID NO: 472670 - RNA, 62 nt, Human; identical to SEQ ID NO: 472146

SEQ ID NO: 472671 - RNA, 62 nt, Human; identical to SEQ ID NO: 472147

SEQ ID NO: 472672 - RNA, 62 nt, Human; identical to SEQ ID NO: 472148

SEQ ID NO: 472673 - RNA, 62 nt, Human; identical to SEQ ID NO: 472149

SEQ ID NO: 472674 - RNA, 62 nt, Human; identical to SEQ ID NO: 472150

SEQ ID NO: 472675 - RNA, 62 nt, Human; identical to SEQ ID NO: 472151

SEQ ID NO: 472676 - RNA, 62 nt, Human; identical to SEQ ID NO: 472152

SEQ ID NO: 472677 - RNA, 62 nt, Human; identical to SEQ ID NO: 472153

SEQ ID NO: 472678 - RNA, 62 nt, Human; identical to SEQ ID NO: 472154

SEQ ID NO: 472679 - RNA, 62 nt, Human; identical to SEQ ID NO: 471989

SEQ ID NO: 472680 - RNA, 62 nt, Human; identical to SEQ ID NO: 472156

SEQ ID NO: 472681 - RNA, 62 nt, Human; identical to SEQ ID NO: 472157

SEQ ID NO: 472682 - RNA, 62 nt, Human; identical to SEQ ID NO: 472158

SEQ ID NO: 472683 - RNA, 62 nt, Human; identical to SEQ ID NO: 472159

SEQ ID NO: 472684 - RNA, 62 nt, Human; identical to SEQ ID NO: 472160

SEQ ID NO: 472685 - RNA, 62 nt, Human; identical to SEQ ID NO: 472161

SEQ ID NO: 472686 - RNA, 62 nt, Human; identical to SEQ ID NO: 472162

SEQ ID NO: 472687 - RNA, 62 nt, Human
gcugaguccccugccaagcgcucggagcccccccaggacacucugcacccccucaccccggu

SEQ ID NO: 472688 - RNA, 64 nt, Human
acuggaaaacuucuuacuccauaccuuguucgauauggaggacaaauaauuggauugucugaua

SEQ ID NO: 472689 - RNA, 64 nt, Human
ugguccucucagcccugggcccuucagcagcagcauggaggagggugcugaaccucgggaacga

SEQ ID NO: 472690 - RNA, 64 nt, Human
gccuuuacugaaugugugucuugagaguagaaaaauggaggauacaagaaaaggagcaggaaga

SEQ ID NO: 472691 - RNA, 64 nt, Human
gguccagaagcuucgggcaccacgcacucaggccauggaggagcagcuggucagcaccuuggug

SEQ ID NO: 472692 - RNA, 64 nt, Human
uaaaaagauugccaauuuucuucaucuuugccauauggaggacugugacagacuuuggacagug

SEQ ID NO: 472693 - RNA, 64 nt, Human
ggugacucugcuaguaauuuaaacuuggcauuucauggaggaugguugugcucaugauguucuu

SEQ ID NO: 472694 - RNA, 64 nt, Human
aaaauacuuggaaacaaagaaagucacagcaucaauggaggagguuuuaacaaaacuucgagaa

SEQ ID NO: 472695 - RNA, 64 nt, Human
acgaugugcucuguauccagaacacacuuggcagauggaggaagcaucugaguuugagaccaug

SEQ ID NO: 472696 - RNA, 64 nt, Human
ucuuggaauuuaugucuuaccacaugguggagggauggaggaacuacaggaugcaauucuucuu

SEQ ID NO: 472697 - RNA, 64 nt, Human
uccucaacucaccuaauguuuaugagccagacaaauggaggaauaugacggaagaacauagaac

SEQ ID NO: 472698 - RNA, 64 nt, Human
uguaaaaaguaaagcauacaaauacuagaagaaaauggaggaaaacgacauuauaugugacuua

SEQ ID NO: 472699 - RNA, 64 nt, Human
ucaugcuacaugaaauguaaaagggagcccagaaauggaggacauuucauucuuuuuccugagg

SEQ ID NO: 472700 - RNA, 64 nt, Human
uucacacauacacaccacucccaccaccgucaugauggaggaauuacguuauacauucauauuu

SEQ ID NO: 472701 - RNA, 64 nt, Human
cgcagugucucgggcacucuaaauauugaguguuauggaggacacagagguagcagaaucccag

SEQ ID NO: 472702 - RNA, 62 nt, Human
caaguaccacuaacacagaugauugaucguuuccaggacaauaaaaguuucggaguugaacu

SEQ ID NO: 472703 - RNA, 62 nt, Human
agaaaugcagaaucugaagccccacucuggacccaggacauuuugaugagauccaaaggagu

SEQ ID NO: 472704 - RNA, 64 nt, Human
ugggacaaaaagggaaaccuaguaaugccaucacauggaggacgaggcccagcucagcugggcc

SEQ ID NO: 472705 - RNA, 64 nt, Human
uguacugcuuugauuuuuuuuccuuugaugaaagauggaggauaaaggggaagugaggagaauu

SEQ ID NO: 472706 - RNA, 64 nt, Human
gagugggagaggggaaagagaaaaaaaggugaucauggaggaaaaagguacuggauaaaaguaa

SEQ ID NO: 472707 - RNA, 64 nt, Human
acuacucccuccuguuccuccuucuccaucccccauggaggaggcaucgcacuuuaccaagcug

SEQ ID NO: 472708 - RNA, 64 nt, Human
ggaccggggcugaggccacacagauaggggccugauggaggagaggauagaaguugaauguccu

SEQ ID NO: 472709 - RNA, 64 nt, Human
aagucuggcuguguccaggcgguccauguugaaaauggaggauggcugcugacuucugacuggc

SEQ ID NO: 472710 - RNA, 64 nt, Human
ucaccaggaguuuaggcugaaugccuuccacgugauggaggaaaaggccaacucuguccugguc

SEQ ID NO: 472711 - RNA, 64 nt, Human
gcaguuccuacagagacacugaggugucuugauuauggaggaaauaaccauuccuuugcacuug

SEQ ID NO: 472712 - RNA, 64 nt, Human
ucauuuuuuagacuugaugaugaaugaagaaugcauggaggacugcaaacuuggauaauaauuu

SEQ ID NO: 472713 - RNA, 64 nt, Human
ccuccccuaaucugguuucuguguugagccugggauggaggagcccuaggccagccugggauaa

SEQ ID NO: 472714 - RNA, 64 nt, Human
guuucagcaacaaacaaacuuuguuugggaagcuauggaggaggacuuuuagauuuagugaaga

SEQ ID NO: 472715 - RNA, 64 nt, Human
caucaccccgucauugggcaccgcugacuccagcauggaggacaccagggagcagggccugggc

SEQ ID NO: 472716 - RNA, 64 nt, Human
gucucccauuugugaccuaugccauccaucuauaauggaggauaccaacauuucuuccuaauau

SEQ ID NO: 472717 - RNA, 64 nt, Human
aaaguucauuacugaagauggaauauuauauaagauggaggaaggguaauuaauagacaugaga

SEQ ID NO: 472718 - RNA, 62 nt, Human
acucugcagagucacucacaccguucguacgcccaggacagcugguucgugguuuuuacauu

SEQ ID NO: 472719 - RNA, 62 nt, Human
ccuugcaggcugccugcgugggaggcgaagucccaggacagcccagaggggggcuacagaga

SEQ ID NO: 472720 - RNA, 62 nt, Human
gguccuuucugugcacuaugaacgcuucuuucccaggacagaaaauguguagucuaccuuua

SEQ ID NO: 472721 - RNA, 64 nt, Human
ggggcacagugggugaggagauggggacaggugaauggaggaguuaggggagaggaaaagugga

SEQ ID NO: 472722 - RNA, 64 nt, Human
caagaaauaaauucacauccucagaaagugcagcauggaggaaaaucugaacucuaagcagaag

SEQ ID NO: 472723 - RNA, 64 nt, Human
gaggaugauuucccuaaugcuucugcuuggccuuauggaggagcugcuccuuccuuacagccuu

SEQ ID NO: 472724 - RNA, 64 nt, Human
aaacugugucuugaagcuaauguauuaaugugacauggaggaacucaauaaaacuccugcuuca

SEQ ID NO: 472725 - RNA, 64 nt, Human
ccuggacacccucaccacccaacagugaugaugcauggaggaccgccccacccuggaaugccaa

SEQ ID NO: 472726 - RNA, 64 nt, Human
uuaaccuagugauuaauaugggagacauuaccauauggaggauggaugcuucacuuugucaagc

SEQ ID NO: 472727 - RNA, 64 nt, Human
uccccucccucaucccuuaggguccagaagagcaauggaggaagugacagcuaauguugcaguu

SEQ ID NO: 472728 - RNA, 64 nt, Human
gcacacuguaauaauaaaugcaauuauaaacuauauggaggagggugcagaggagggaaugugu

SEQ ID NO: 472729 - RNA, 64 nt, Human
gagggcguuugggcacugauaugugggugagggcauggaggagggugaguucuccaaggcccau

SEQ ID NO: 472730 - RNA, 64 nt, Human
gcuugguuuaaugaguguguucaugaaauaaauaauggaggaauugucauguguugcuuuuguc

SEQ ID NO: 472731 - RNA, 64 nt, Human
accacagguauugaagccccugggugauaauuugauggaggaaaacauaaggcagucuguaaca

SEQ ID NO: 472732 - RNA, 64 nt, Human
gguagagaagacagggauugggaaguggugggugauggaggaccuggauauauuuaucaaauaa

SEQ ID NO: 472733 - RNA, 64 nt, Human
ucugcugccaggauggagcagaggagcgccacacauggaggaaagccccuguaacguuaccuac

SEQ ID NO: 472734 - RNA, 64 nt, Human
auuuuucagaggccuuaaaauucuggauaagagaauggaggaaaauacucagaguacuugauua

SEQ ID NO: 472735 - RNA, 62 nt, Human
ucagaugccccaagauguccguugggaagcucccaggacagcacuuuuuauacagaggacac

SEQ ID NO: 472736 - RNA, 62 nt, Human
ucccaaaauuuaaaaacaaauuggaagaauaaccaggacagccaagugaagcagccacaggg

SEQ ID NO: 472737 - RNA, 64 nt, Human
cuggagaaguggccaucccaugcccaccugugccauggaggagugggcccugccagcugccaca

SEQ ID NO: 472738 - RNA, 64 nt, Human
aacagauaguaugagaaauaucuuugaaagaaauauggaggaagguuaaaaggggauuaguaaa

SEQ ID NO: 472739 - RNA, 64 nt, Human
gaggauucuguuccuggaauugugugagcuaggaauggaggaggggagacuuucaaugguuaag

SEQ ID NO: 472740 - RNA, 64 nt, Human
uggaggaauggaaauaaaauugggaugagcccuaauggaggaagucgggcaaauugaaaguaua

SEQ ID NO: 472741 - RNA, 64 nt, Human
auguugcacaaggguugugaaugugaaagggggaauggaggaauggaaauaaaauugggaugag

SEQ ID NO: 472742 - RNA, 64 nt, Human
agagagagagagagagagagagagagagagaaagauggaggagaagaacuuggauuccccuggg

SEQ ID NO: 472743 - RNA, 64 nt, Human
acaacuuuaaaacugcucauuucaugaagcaagaauggaggaauccuugacucuuacacacugg

SEQ ID NO: 472744 - RNA, 64 nt, Human
caggccaagucauugcucagccaggacucaguucauggaggaaacuuguccugcugcagucccu

SEQ ID NO: 472745 - RNA, 64 nt, Human
acucggguuucauauuuugcuguuuuugauggacauggaggaauucgagccucaaaauuugcug

SEQ ID NO: 472746 - RNA, 64 nt, Human
uuaaaauuguacaugaacauguuuuagaaacaauauggaggaugaugcauacaugucggucaag

SEQ ID NO: 472747 - RNA, 64 nt, Human
ccugguuaucuaaccuguuccauuccauggaaccauggaggaggaagacccucaguuauuuugu

SEQ ID NO: 472748 - RNA, 64 nt, Human
gacuccuguugccugagcacaaaaaugggcaccaauggaggaaaaugacccuugggcuggcagg

SEQ ID NO: 472749 - RNA, 64 nt, Human
gaugaaacgauagaauaaaguaacauuucccagaauggaggaauacauuauuuuaucguauauu

SEQ ID NO: 472750 - RNA, 64 nt, Human
uguuguguuuuaauuugucacucggaacuucaggauggaggacccugacccuaaaccuccuuca

SEQ ID NO: 472751 - RNA, 62 nt, Human
uugggaagcccguuagcccagggugggucccaccaggacaguagggaaacaguuguuucccu

SEQ ID NO: 472752 - RNA, 62 nt, Human
cucuaugacacagcuuuaaccuucuucucuggccaggacagucgcaaucuuuguuuuaaguu

SEQ ID NO: 472753 - RNA, 64 nt, Human
auuugagauugcuuuugggaagaucacuagauuuauggaggaauuagucacaaaugacuuguag

SEQ ID NO: 472754 - RNA, 59 nt, Human
cucaugaugugaucucauaaacaagacguauggaggaguucucuuaauaucagcaaggu

SEQ ID NO: 472755 - RNA, 64 nt, Human
cacacaaagaacuauuggguggguggauggauggauggaggaauggagacaguuggcuuaacca

SEQ ID NO: 472756 - RNA, 64 nt, Human
gugcuuaauaaaugcuggauggaugcaggaaggaauggaggaaugaaugggaagggagaacaua

SEQ ID NO: 472757 - RNA, 64 nt, Human
uuuuuugcccaagaggcaucucaguacuccagcaauggaggaagaauagagaauuuugccuggc

SEQ ID NO: 472758 - RNA, 64 nt, Human
uguuagcuuuuuaaaacauuaggcucccaucccuauggaggaacaacucuccagugccuggauc

SEQ ID NO: 472759 - RNA, 64 nt, Human
augagaagagaaagucagccuuucuggggcuuucauggaggagacuugcccaaggggcuucccu

SEQ ID NO: 472760 - RNA, 64 nt, Human
caagaagguagcuugagccugaaaugcaaaacccauggaggaauucugaagccauugucuccuu

SEQ ID NO: 472761 - RNA, 64 nt, Human
ccucuuuaauagaaagucaccaucaucuguagugauggaggaagggggucacuuauauaaagau

SEQ ID NO: 472762 - RNA, 64 nt, Human
ccacugugugcauuagcagggagguuuguaggccauggaggaaaugaggagacaccaccuagug

SEQ ID NO: 472763 - RNA, 64 nt, Human
cuugccugcuggggggccuagccaugggccagagauggaggagccccaguggcugacaggccag

SEQ ID NO: 472764 - RNA, 64 nt, Human
uucuaggcauagccugggccaagcaggguggggaauggaggauagcaugggauguauggagagg

SEQ ID NO: 472765 - RNA, 64 nt, Human
aaggcaucucugagaaaguggccccagggagagaauggaggacugggaggagaagcauuaacug

SEQ ID NO: 472766 - RNA, 64 nt, Human
ucagcccacggugccuuggucucuccacaaucaaauggaggaucccccaagcagcuucauuaca

SEQ ID NO: 472767 - RNA, 62 nt, Human
ugaaaguuauggagcaugaaaagacugaagggccaggacaguuugcaugggcugaguuauac

SEQ ID NO: 472768 - RNA, 62 nt, Human
cugcuggggagugggguuuggggggcccucucccaggacacugccucuucugggcagaaggc

SEQ ID NO: 472769 - RNA, 62 nt, Human
accccuagacccuggcugacuuggacaaucugccaggacagaagcuggguuuucugucuagg

SEQ ID NO: 472770 - RNA, 64 nt, Human
uacaucaaacuuaguuaaauaauuccauccacuuauggaggaggaggagaauguggaagaggua

SEQ ID NO: 472771 - RNA, 64 nt, Human
agccaccugcacagcagagcucauuguggaaacgauggaggaaggugaaggggaaggggaagag

SEQ ID NO: 472772 - RNA, 64 nt, Human
uauguguuagugucggggaaauaguuugcagauaauggaggaguaacccuacaacuauaugucc

SEQ ID NO: 472773 - RNA, 64 nt, Human
ugggccugaggucaaugggagaugugcccucccuauggaggauguaagaagcagaggccauuuc

SEQ ID NO: 472774 - RNA, 64 nt, Human
uggcccucugccuucucuaaagugcuguuggagcauggaggagcuggaggagauggggauggac

SEQ ID NO: 472775 - RNA, 64 nt, Human
acgggggggccggccagacaggcagacugggaggauggaggacggagcugcagacgaaggcagg

SEQ ID NO: 472776 - RNA, 64 nt, Human
ucucucccucccuaaguauucuacaauggaaagaauggaggaagcacuucaaguagccaucaac

SEQ ID NO: 472777 - RNA, 64 nt, Human
uagcugugcuuucuugaugcguagaaacacgugcauggaggaucaaacacugucagaauugcug

SEQ ID NO: 472778 - RNA, 64 nt, Human
uuuugcaacaugguuugcaaauaaugcugguggaauggaggaguuguuuggggagggaaaggag

SEQ ID NO: 472779 - RNA, 64 nt, Human
cuguggccucggcacacugcuuaucacuugaaaaauggaggaacaaguguuauauuuaucugug

SEQ ID NO: 472780 - RNA, 64 nt, Human
auagaaacggcuucugucggggggagaguauauaauggaggaaauauuauguauugagauuaua

SEQ ID NO: 472781 - RNA, 64 nt, Human
agccucuugucuuaaauguacuccccauggcagcauggaggaggcaagaccugugggucaauuu

SEQ ID NO: 472782 - RNA, 64 nt, Human
gacuccuccuuuauuccagcauggaggguuuuaaauggaggauuuccuuuuuccugcgacaaaa

SEQ ID NO: 472783 - RNA, 64 nt, Human
gacuccuccuuuauuucagcauggaggguuuuaaauggaggauuuccuuuuuccugugacaaaa

SEQ ID NO: 472784 - RNA, 62 nt, Human
ucugcuucaagaggggguuuuacacucugauuccaggacaagcacucugaggcggguggggg

SEQ ID NO: 472785 - RNA, 62 nt, Human
cacugccaggagggacaaaggagccugugaacccaggacaagcauggucccacaucccuggg

SEQ ID NO: 472786 - RNA, 64 nt, Human
gaggugcaaaacgagacagaagagugagaagcagauggaggagaagagaagagccaaccagaag

SEQ ID NO: 472787 - RNA, 64 nt, Human
uugggagaauacauuaguuaauauaugugaaaguauggaggagaugugcaauaaauauuugugu

SEQ ID NO: 472788 - RNA, 64 nt, Human
uugguuaauuuuaguuauguaacaaccugacaugauggaggaaaacaaccuuuaaagggauugu

SEQ ID NO: 472789 - RNA, 64 nt, Human
auaauuaguuacagugggaaauucacucauauuaauggaggauuguacauauaaauacuauuua

SEQ ID NO: 472790 - RNA, 64 nt, Human
aaaaaaaucuuucagauaagagguguucuccagaauggaggaacuacuuggcauguaagaaaua

SEQ ID NO: 472791 - RNA, 64 nt, Human
ggcuauuccugagagcugcauguguccgcccccgauggaggacuccaggcagcagacacaugcc

SEQ ID NO: 472792 - RNA, 64 nt, Human
cauuccuuuuucuucacuuacaagaaaggccugaauggaggacuuuucuguaaccaggaacauu

SEQ ID NO: 472793 - RNA, 64 nt, Human
gacugaguaccaggccacgggcugcagauccugaauggaggaaggauauguccucauuccauag

SEQ ID NO: 472794 - RNA, 64 nt, Human
uuuuuuccaucccuuuuuaauuuuuuuaacagcaauggaggaaguuaacaauuuuuaauggaaa

SEQ ID NO: 472795 - RNA, 64 nt, Human
agaggaggagcacuuacucauguuguauuuguuaauggaggaugucaucuuuucauagaugcug

SEQ ID NO: 472796 - RNA, 64 nt, Human
guguccugcuugguuuagcugugcagaaggugaaauggaggaaaccacaaauucaugcaaaguc

SEQ ID NO: 472797 - RNA, 64 nt, Human
gggucacaggugauggcaaauagaaaagaagcaaauggaggaaauagucggauaaguaggugac

SEQ ID NO: 472798 - RNA, 64 nt, Human
guagaguaacacauaacauuguaugcauggaaacauggaggaacaguauuacaguguccuacca

SEQ ID NO: 472799 - RNA, 64 nt, Human
cuagggguuucuguuggauaauuagcaguuuagaauggaggaagaacaacaaagacaugcuuuc

SEQ ID NO: 472800 - RNA, 62 nt, Human
gacaaggaacuuuccuaagaaaccgcugauaaccaggacaaaacacaaccaaggguacacgc

SEQ ID NO: 472801 - RNA, 62 nt, Human
uuuaguagucuggagaaaucuacuccccuuggccaggacaugcugcugcuacugcuaacagc

SEQ ID NO: 472802 - RNA, 62 nt, Human
caauuuuaaugaugguguuaaagcuguacaccccaggacaguuuauccugucugaggaguaa

SEQ ID NO: 472803 - RNA, 64 nt, Human
aaaauaauaaauuauuugucucaaauauaccuugauggaggacuuuuuuauucuuauggaaaua

SEQ ID NO: 472804 - RNA, 62 nt, Human
cccauccucaaaggaugaagacucaccaccauccaggacauucagaagaguucacugcagau

SEQ ID NO: 472805 - RNA, 62 nt, Human
uccugagaguugaggccuguaaauacaagggcccaggacagagugugugcgugcgugugggu

SEQ ID NO: 472806 - RNA, 62 nt, Human
uaugggaaaaggaaaggucgagagaaucuuguccaggacacugaaaugcauccacacuuccu

SEQ ID NO: 472807 - RNA, 62 nt, Human
gugaagaaaagaagcgaauaaguuccaagaguccaggacauaugguaauacuagaccaaacu

SEQ ID NO: 472808 - RNA, 62 nt, Human
agaaguaccgcugagcgccgccuccgggacccccaggacaggcugcggccccucccccgucc

SEQ ID NO: 472809 - RNA, 62 nt, Human
ccgggggguggaggugcuccccacaguccgggccaggacagccucaggggagagugaaggcc

SEQ ID NO: 472810 - RNA, 62 nt, Human
aaucaucacgcccuggcuuaucccuggucgagccaggacacggggugcuucagugggucugu

SEQ ID NO: 472811 - RNA, 62 nt, Human
ggugagcuuguaggugccugccuucaucugguccaggacagugaccaucugggucuguguag

SEQ ID NO: 472812 - RNA, 62 nt, Human
aagcugcggaugggcuuuccugccaccaccuuccaggacauccagcgcggggugacaagugc

SEQ ID NO: 472813 - RNA, 62 nt, Human
agcagugcagcaggaacuggaagugccuucauccaggacaggaaguagcacuucugaaacag

SEQ ID NO: 472814 - RNA, 55 nt, Human
ggggcacccaggagcagugagucccccaggacagggacccucaucugccuuacug

SEQ ID NO: 472815 - RNA, 62 nt, Human
agcaccaacaugugaggggugaaccuuggccuccaggacaucugcacccccuccccaccucc

SEQ ID NO: 472816 - RNA, 62 nt, Human
aagaagcuucauucccucuuaaucuaguuaagccaggacauccagaauucauugcuuuaaua

SEQ ID NO: 472817 - RNA, 62 nt, Human
ccccuaaccuuggugccugauccauccccagaccaggacagcagccacucaguucuuccucc

SEQ ID NO: 472818 - RNA, 62 nt, Human
ccgcugcuggccgcucucuucucugccucucaccaggacagccgccccccaggguacuccug

SEQ ID NO: 472819 - RNA, 62 nt, Human
gcuuucgccuguaaucccaacacuuugggaggccaggacagaucacuugaggucaggaguuc

SEQ ID NO: 472820 - RNA, 62 nt, Human
ugccauaauggauuguucugauuucugaggagccaggacaaguuggcgaccuuacuccucca

SEQ ID NO: 472821 - RNA, 62 nt, Human
cuggcgucucuagaaacugcugcugauggagaccaggacagagcccgcccccacccggcccg

SEQ ID NO: 472822 - RNA, 62 nt, Human
aagaacaagccacagaaacgggcucgcucgugccaggacacagcagugucuuucaaaaaauc

SEQ ID NO: 472823 - RNA, 62 nt, Human
acacucuggggagccaggggccccagcacccuccaggacaggagaucugggaugccuggcug

SEQ ID NO: 472824 - RNA, 64 nt, Human
gcguggaggaggagggaggccgggcggucacagcauggaggaggagggaggcgcugcugguguu

SEQ ID NO: 472825 - RNA, 64 nt, Human
aagcuccuagcugaccauucauucugaagauugcauggaggaugaacaucugggaauccuguua

SEQ ID NO: 472826 - RNA, 64 nt, Human
ucacucacuaggcaguucccacuuucuuuagcaaauggaggaaauuaagcaccgauguagcacu

SEQ ID NO: 472827 - RNA, 64 nt, Human
ccgacuucccguggaaauucccaacucgguucucauggaggaguggguggagacaaggagggag

SEQ ID NO: 472828 - RNA, 64 nt, Human
ucuauuaccccauuaggggagacagagagagugaauggaggaguaccgagcuggcuauggacuu

SEQ ID NO: 472829 - RNA, 64 nt, Human
agauuuggagucauuguggguuauuuuuggugggauggaggaucuuaaaaaugccuaauuguga

SEQ ID NO: 472830 - RNA, 64 nt, Human
cauugagggaggguggauauuuuuauuccuagauauggaggaaacauaagucuguaguauuaua

SEQ ID NO: 472831 - RNA, 64 nt, Human
agcaacacuccaguggucagaugcucacagucuuauggaggagcccaaauaauaucuggggaag

SEQ ID NO: 472832 - RNA, 64 nt, Human
agguuuccagucaggacucgcuguaccaauauccauggaggaauaugggagcguuucgcucucc

SEQ ID NO: 472833 - RNA, 64 nt, Human
ucuccacuucugaaaguaugaugauguauuaaggauggaggaguuauuaaaaaugucucuucug

SEQ ID NO: 472834 - RNA, 64 nt, Human
ggcaaucccgacugcauuucccuccugcuggaauauggaggaagcggaaauguaccuaaccgag

SEQ ID NO: 472835 - RNA, 64 nt, Human
guauaaaaaccaagagccagacaauuagacaacuauggaggaaugaaaggcaauucaaacaucu

SEQ ID NO: 472836 - RNA, 64 nt, Human
ccuguucaggcuggcucguaggccugccgcuuugauggaggagguauuguaagcuuuccauuuu

SEQ ID NO: 472837 - RNA, 64 nt, Human
uugcaucgugcggggcaaaaugaggagcagaggcauggaggagggaggcgugggaugggaauag

SEQ ID NO: 472838 - RNA, 62 nt, Human
caccugucugccugggcuccaagugggcaggaccaggacagaaccacaggcacacacugagg

SEQ ID NO: 472839 - RNA, 62 nt, Human
auccucacccaggccaaggcccaggggcucugccaggacaccacaugggagggggcucaggc

SEQ ID NO: 472840 - RNA, 64 nt, Human
ucaagaggcccagggagcaaugggagggggcuccauggaggaggugucccaagcuuugaauacc

SEQ ID NO: 472841 - RNA, 64 nt, Human
ugagcacaaguaaaacuaaggcuucagccauaauauggaggagggagcagauguaagcucccaa

SEQ ID NO: 472842 - RNA, 64 nt, Human
ccccugccccaucuccucaucauccccagccuugauggaggagggagggcuucaggacggggcg

SEQ ID NO: 472843 - RNA, 64 nt, Human
cuagcugaucccucaggucugcugcaaacacagcauggaggacacagaugacucuuugguguug

SEQ ID NO: 472844 - RNA, 64 nt, Human
guuggcauugaccuaaacggacagagaaaugcacauggaggagaacuacguugaaaucaagauc

SEQ ID NO: 472845 - RNA, 64 nt, Human
aaauggagaaacaaucauaucuuucuaagcgguaauggaggaagacuagugcuuugugcauuuu

SEQ ID NO: 472846 - RNA, 64 nt, Human
auucuuggcuuagaguagagguuuuuuuuaaguuauggaggaaacauuuuuguaaaaguuuaau

SEQ ID NO: 472847 - RNA, 64 nt, Human
uccuuguuccugaacuaauacuacuguaccuguuauggaggacugcaaagggaagagaaaagca

SEQ ID NO: 472848 - RNA, 64 nt, Human
aaaugucaugagaaguuugauucaguaacuugugauggaggauucuuugguaucuuacuguuug

SEQ ID NO: 472849 - RNA, 64 nt, Human
ucacugucauuccaaagguacaguguaacucuggauggaggaauaacuuaccuaucacuacaac

SEQ ID NO: 472850 - RNA, 64 nt, Human
gugcugcaaguuagugaaacagcugucuccguaaauggaggaaauguggggaagccuuggaaug

SEQ ID NO: 472851 - RNA, 64 nt, Human
uugcugucagucuugaccucugccuuuguggugaauggaggaccacgucuauuucaucagaaca

SEQ ID NO: 472852 - RNA, 64 nt, Human
gcccugaagaaauaaguccuuccacuuugaccccauggaggauugccugugaggaacuuaaacg

SEQ ID NO: 472853 - RNA, 64 nt, Human
uauguauuuaaguggauugaauaacugagucuacauggaggaggaaaugcuagagaacagcagg

SEQ ID NO: 472854 - RNA, 62 nt, Human
gauucaaaagcugcauuccuuccuccaaaggcccaggacaggacagugcuacccuagauucu

SEQ ID NO: 472855 - RNA, 53 nt, Human
aaacggaaaaggauaauugagccccaggacauucugagacuccaaagucuuuc

SEQ ID NO: 472856 - RNA, 62 nt, Human
uccugaccuuggccagugaaccugccagccuuccaggacaggcggccggagagcugccccug

SEQ ID NO: 472857 - RNA, 64 nt, Human
uagucuuacuuguaacagcguaauuaaacacaucauggaggagagaaacuuaaaauuaaaauag

SEQ ID NO: 472858 - RNA, 64 nt, Human
ugaccagauuuuugccauacugggggguggcgggauggaggauggguacucaggcaugacugcg

SEQ ID NO: 472859 - RNA, 64 nt, Human
agucucaucgucccaaggcuugaaauccagcaggauggaggacuuggccaccaguucaggcuuc

SEQ ID NO: 472860 - RNA, 64 nt, Human
uauauagagauaguauagacuccuccgcggaagcauggaggagguuguaaaauagacuccaugg

SEQ ID NO: 472861 - RNA, 64 nt, Human
uuccuucuuccuuuauuuuaacaaauggugaaagauggaggauuaccuacaaaucagacauggc

SEQ ID NO: 472862 - RNA, 56 nt, Human
aaaacaaaacaaaaccuugacugccuauggaggaagacuguguucgggggagcugg

SEQ ID NO: 472863 - RNA, 64 nt, Human
ucagucaggugcauucuggcaacugacauacuugauggaggauugauucgguagagagcaguag

SEQ ID NO: 472864 - RNA, 64 nt, Human
uguguggucugguagaaguggggaaauaugagagauggaggaaaaacuugauuaugucuuccau

SEQ ID NO: 472865 - RNA, 64 nt, Human
uaacaaaaaaggguggcuagauuuaucuugggugauggaggaaaugagagaggaaugcucuuga

SEQ ID NO: 472866 - RNA, 64 nt, Human
aaguuccaggguguguauguuucaggggcuucacauggaggagcugcagauagauauguguuuc

SEQ ID NO: 472867 - RNA, 64 nt, Human
uucaagggagacaucucagggcaaagcuuucgugauggaggaggcaaagacaguagcccccucc

SEQ ID NO: 472868 - RNA, 64 nt, Human
gacccuggcaggugcgcucagagcuguccucaagauggaggaugcugcccuugggccccagccu

SEQ ID NO: 472869 - RNA, 64 nt, Human
uuacaucugaccgcggccacacgcgguggcaugcauggaggacucuccucuucgugguuguguu

SEQ ID NO: 472870 - RNA, 64 nt, Human
uaaugccacugguguuaagauauauuuugaguggauggaggagaaauaaacuuauuccuccuua

SEQ ID NO: 472871 - RNA, 62 nt, Human
ugaccaugagacuuugcugagaaguggaggccccaggacaggcuggcuggcuggcuggcugc

SEQ ID NO: 472872 - RNA, 62 nt, Human
cggggaaguucaccagauuucggcugcuggggccaggacaggcgucuccuagguugugccaa

SEQ ID NO: 472873 - RNA, 62 nt, Human
uucauucuuucaacaaacaugccaucuaucucccaggacauuuauucccuucuauucaaggc

SEQ ID NO: 472874 - RNA, 64 nt, Human
gguaguaaaauucaugucaaaaaggaaagaaggaauggaggaggucaguuaguucauugcaaua

SEQ ID NO: 472875 - RNA, 64 nt, Human
ccaaccuauuuaacuuuuuguggaggaauuuuacauggaggaagugagcacaugucaugcuagc

SEQ ID NO: 472876 - RNA, 64 nt, Human
cuucaggaggaggcugugaggcuggagggaccagauggaggaggccagcagcuagccauugcac

SEQ ID NO: 472877 - RNA, 64 nt, Human
cagucccaguccucugaaugggucagccccuuagauggaggaggugggacguuugggcuugggg

SEQ ID NO: 472878 - RNA, 64 nt, Human
ggacuugacccaacugagaaggaaaaacuucuguauggaggaaaagacaguaaacaugacagac

SEQ ID NO: 472879 - RNA, 64 nt, Human
ggauccuuucacuuuccgcuuccccuucugaugcauggaggauggugugagcuuuucagcaggc

SEQ ID NO: 472880 - RNA, 64 nt, Human
aagaugagaagagagugcaggagggcugggggccauggaggaaaggccuaaaguuucacuuggg

SEQ ID NO: 472881 - RNA, 64 nt, Human
ucauggcaauaauagaagauuaugaaggauuucuauggaggacauaaaugcugcaucuuucaua

SEQ ID NO: 472882 - RNA, 64 nt, Human
cagauaccuggaaccaccuaaagaacuuccauuuauggaggauuuuuuugccccuuguguuugg

SEQ ID NO: 472883 - RNA, 64 nt, Human
gucucaccaacaagugaggauauagccuuaucucauggaggacgagcuccguauuuacucagga

SEQ ID NO: 472884 - RNA, 64 nt, Human
acucaggagcagucaggguacauuacauaaaacaauggaggaugccucauuuuagcaaacuagg

SEQ ID NO: 472885 - RNA, 57 nt, Human
caacggccacauccugcuaaaacugggauggaggaaucggcccagccccaagagcaa

SEQ ID NO: 472886 - RNA, 64 nt, Human
ugcuggcugcugcugccucgcgcgcugggguuccauggaggaacugggccugccgccccggccu

SEQ ID NO: 472887 - RNA, 64 nt, Human
ccggccucaccugcugcccgcaugcuggggucccauggaggaaccaggccuggcgccccggccu

SEQ ID NO: 472888 - RNA, 62 nt, Human
auuuguuuuacauguuagucaacucugaucuuccaggacaggugguauuagcuccacugucu

SEQ ID NO: 472889 - RNA, 62 nt, Human
ugcgguccuugccaaaguaaaaugaagcugccccaggacaagggguuaccaugagcucccug

SEQ ID NO: 472890 - RNA, 62 nt, Human
ccgcccagaaaaggggcagggcucugcagccgccaggacagacgagcaccccaugccuauac

SEQ ID NO: 472891 - RNA, 64 nt, Human
caguuugaaauauuuauuugguuaucaacugcccauggaggaggcucuugaugaucccaggucu

SEQ ID NO: 472892 - RNA, 64 nt, Human
caacagucacucugaagauuuugccaacucaugaauggaggacacuucaguagucaucuagauc

SEQ ID NO: 472893 - RNA, 64 nt, Human
caucaaaauuggccucaccaaggcccugacucagauggaggaagcccagaggaaacggacacaa

SEQ ID NO: 472894 - RNA, 64 nt, Human
agaucuauacccuaagcagauagcaaagaagauaauggaggagcaauuggucauggccuugguu

SEQ ID NO: 472895 - RNA, 64 nt, Human
cuuagaaugagugucaaggaggaaagagagggagauggaggauguguuugugcgccugugugug

SEQ ID NO: 472896 - RNA, 64 nt, Human
uggccugcuggcaaugccacaggugcccaagaagauggaggaucccugugccaggagccaaccu

SEQ ID NO: 472897 - RNA, 64 nt, Human
uugagaagagagcccgcucuccguggggcaccccauggaggacacaguaccagaguuuacagag

SEQ ID NO: 472898 - RNA, 64 nt, Human
cacaaaagaaaucccuaccuauguaaauguuugaauggaggacgccaguaaaaaaacaaaaaca

SEQ ID NO: 472899 - RNA, 64 nt, Human
gggcauuucccgugggcccccgagacccgccuagauggaggaagcgcugcugggcgcccucuua

SEQ ID NO: 472900 - RNA, 64 nt, Human
uuauugaaaccucuggaacauuucaccuuuagagauggaggauggaaggauugguaccagaaga

SEQ ID NO: 472901 - RNA, 64 nt, Human
ggccuguggcgucuggguccguuggggcagaaccauggaggaaaagccuucgaaaguaagacgu

SEQ ID NO: 472902 - RNA, 64 nt, Human
uggggggugcgaagagacgcuacguuccuuuccgauggaggaaggcagaccugccgucacacgu

SEQ ID NO: 472903 - RNA, 64 nt, Human
aacuuaccagaucaagaaagggagcucaggcuggauggaggaagccacgcaaguguggcuucaa

SEQ ID NO: 472904 - RNA, 64 nt, Human
guccuccgugguacauacugggucaggcacuagcauggaggagggucacagaguggggcacgug

SEQ ID NO: 472905 - RNA, 62 nt, Human
cuggucuuggaaacccucagcaaacucagcauccaggacaacaauguggaccugauucuggc

SEQ ID NO: 472906 - RNA, 62 nt, Human; identical to SEQ ID NO: 472703

SEQ ID NO: 472907 - RNA, 64 nt, Human
ccagggcccgguggguccuggguuuucugcaaacauggaggaccacuuucugauaggacauuuu

SEQ ID NO: 472908 - RNA, 64 nt, Human
ccuuugugauaaugaugacacaaaaugaauauuaauggaggauauuccucggaaaaacagacuu

SEQ ID NO: 472909 - RNA, 64 nt, Human
cucuuaagaaaaugaugcaucaggaagcaacgugauggaggacuugggggaaaaggaucacaua

SEQ ID NO: 472910 - RNA, 64 nt, Human
uguguuauuuuauaaaaccuucuaaaauuauuaaauggaggauauaaucuauaauugguuugua

SEQ ID NO: 472911 - RNA, 64 nt, Human
uggucuuacuuuccaacucuguacagauuuauuuauggaggagcuagguccauaaauguuguaa

SEQ ID NO: 472912 - RNA, 64 nt, Human
uccugauucuagagcaaaggugugggaaggggaaauggaggaaugcccuccugucugugucguu

SEQ ID NO: 472913 - RNA, 64 nt, Human
uggagcugagacuuuauuuauuggggguagggggauggaggaggucccuccaacauguuuggac

SEQ ID NO: 472914 - RNA, 64 nt, Human
ggcuguauuuaauggcauaggcugacuuuugcagauggaggaauuucuugauuaauguugaaaa

SEQ ID NO: 472915 - RNA, 64 nt, Human
ccucgagacuugucucaugccuccaugcuugccgauggaggacagacugcaggaacuuggccca

SEQ ID NO: 472916 - RNA, 64 nt, Human
aaauaauguaaccuuugcgguuuaagaggauaaaauggaggauauuauuauguggguauuuaua

SEQ ID NO: 472917 - RNA, 64 nt, Human
gucuauuuucauauuacucugcuuugugcacuuuauggaggaggaagcuagaggaaaaauggaa

SEQ ID NO: 472918 - RNA, 64 nt, Human
gaaaaaauaaaaauaaaagccuuuggguucuugaauggaggaucauggaacacauuugcugcca

SEQ ID NO: 472919 - RNA, 64 nt, Human
ccuagugcaaagugaauuuagagugagccagauuauggaggauucugugacucuugccaaauaa

SEQ ID NO: 472920 - RNA, 64 nt, Human
aggcauacagaagguuuguccugcucugggaagcauggaggauguuguacuucacuccucucug

SEQ ID NO: 472921 - RNA, 62 nt, Human
ccccgguccagacagcagccuguacauccaucccaggacacagcccagccccuccccacacc

SEQ ID NO: 472922 - RNA, 62 nt, Human
cggugacaccugcagcccucacuccugucaucccaggacacuugaggcccaaggagguggag

SEQ ID NO: 472923 - RNA, 64 nt, Human
auaugauuggauguauguaacacauacauggaguauggaggaaauuuucugaaaaauacauuua

SEQ ID NO: 472924 - RNA, 64 nt, Human
cuggaaccacauugaagaauguuagaguaaugaaauggaggaucucuaaagagcaucugauucu

SEQ ID NO: 472925 - RNA, 64 nt, Human
agaaggugaccuccugacagcguucacucucaauauggaggaaaagaccacaacaacuguccuu

SEQ ID NO: 472926 - RNA, 64 nt, Human
cucaugcuuccuggggccuccagcagcuccacuaauggaggagaggcaguagccuccgacacag

SEQ ID NO: 472927 - RNA, 64 nt, Human
cagaaaauaggguggacagaagcuugugggguacauggaggaauugggaccugguuauguuguu

SEQ ID NO: 472928 - RNA, 64 nt, Human
ccguggauguuccuacaggaguguccauagauggauggaggagguggagcccagagcccaagga

SEQ ID NO: 472929 - RNA, 62 nt, Human
cggauuucaugucccugugacugguggggcccauggaggagacaggaagccucaaguuccag

SEQ ID NO: 472930 - RNA, 64 nt, Human
ccaccacggccuggaggagggagguugugguuggauggaggagaugaucuugucuggaagucua

SEQ ID NO: 472931 - RNA, 64 nt, Human
acuccuagcagcugguaaaggggugcuggaggccauggaggagcucuagaaacauuagcauggg

SEQ ID NO: 472932 - RNA, 64 nt, Human
acggcugcauucuguaagugggcauggucuccuaauggaggaguguucauuguauaauaaguua

SEQ ID NO: 472933 - RNA, 64 nt, Human
ccuucugucuguaacaaaaauguacuuuauagagauggaggaaaaggucuaauacuacauagcc

SEQ ID NO: 472934 - RNA, 64 nt, Human
auuuuaccagaguguuuccauucauauccgcgguauggaggauuugaggaacaguaaccaggau

SEQ ID NO: 472935 - RNA, 64 nt, Human
auguucauuguaguuuauuuauuugguucuuuagauggaggaauuuaaaaaaucaaauuuuucu

SEQ ID NO: 472936 - RNA, 64 nt, Human
ucuuuugcaugucccccaaagccagaaucugcucauggaggaaggaaggcuaagaacuguccuu

SEQ ID NO: 472937 - RNA, 62 nt, Human
aagucuuuuguaaaggcaagaauaaauaauauccaggacaauuuauuaguuuucucaguauu

SEQ ID NO: 472938 - RNA, 62 nt, Human
uuugcuaggggaaggucacagcacaacuaaauccaggacaggacauugugaccaugacccag

SEQ ID NO: 472939 - RNA, 64 nt, Human
uucuuugcuuaugcuaaauuaauuacaauuaugaauggaggauauucuacuguacuuuuuuaaa

SEQ ID NO: 472940 - RNA, 64 nt, Human
gagaaaucguagagcagugaggcaggcugggagcauggaggacagcuuauggaaaaaguuaggg

SEQ ID NO: 472941 - RNA, 64 nt, Human
aaugaaaguuugucuucacaaauaucaaaacaaaauggaggaaaacuaagcauuggccucaugu

SEQ ID NO: 472942 - RNA, 64 nt, Human
aaucaaagaggccaacugcccagagccacagaaaauggaggauaauugaggcuaaguaaccuga

SEQ ID NO: 472943 - RNA, 64 nt, Human
gugucuaaaagagguuguccaggacuuccuuuuaauggaggaugggcuuuuaaaccacaucauc

SEQ ID NO: 472944 - RNA, 64 nt, Human
guggaagagucagcuacucacccgcuauuagaguauggaggaagggguuuucauugcauugcau

SEQ ID NO: 472945 - RNA, 64 nt, Human
cugagggggaaggggugggagagaagauacagacauggaggaggggaggcugcucuggcaaagu

SEQ ID NO: 472946 - RNA, 64 nt, Human
agugagccgcaucuucuccaucuggcagggugggauggaggagaagaauuuucagaccccagcg

SEQ ID NO: 472947 - RNA, 64 nt, Human
auaaagauauuuuuauucaccuguuccgugcuauauggaggaggccaaguccauuuagugacau

SEQ ID NO: 472948 - RNA, 64 nt, Human
gcugacuuggaggcccuggcucaggagcucauagauggaggaggugugggcugacuaccuccca

SEQ ID NO: 472949 - RNA, 64 nt, Human
uuuauccccugaaagugguuuuggaggaaccgggauggaggaggccuuccccugugggaauaga

SEQ ID NO: 472950 - RNA, 64 nt, Human
auuguuugacccuuaagcuuuuacaucucuuagcauggaggacgaagaaagcuguacauuguug

SEQ ID NO: 472951 - RNA, 50 nt, Human
agcgagccagcucccaauaaauggaggaggggaaagggacugucacagaa

SEQ ID NO: 472952 - RNA, 64 nt, Human
uagagagcaaaacuaugaucaaauaguggguauuauggaggagguugugauggugguaagccuu

SEQ ID NO: 472953 - RNA, 62 nt, Human
aagaggaguaaaggucaugacagaauuuacucccaggacaaucuaaguucugccacaaguac

SEQ ID NO: 472954 - RNA, 62 nt, Human
ucucacacccugcauggaaucaggcuccucagccaggacacagggugaggccccccagccag

SEQ ID NO: 472955 - RNA, 62 nt, Human
ccuucccuggaccccugcagagcucacagggcccaggacaccaacgccgcauaggacugccc

SEQ ID NO: 472956 - RNA, 64 nt, Human
uugugugugugggggggggugggggugugggugcauggaggacaaccugcaacucugagcuccc

SEQ ID NO: 472957 - RNA, 64 nt, Human
gagcaguuucugggggcucuuccaagucagaagaauggaggaagguggacaagcaacccagcau

SEQ ID NO: 472958 - RNA, 64 nt, Human
aagaaaugaauuugaugaggaaauuaagcauccaauggaggauuggucuugaagaccuuaaagg

SEQ ID NO: 472959 - RNA, 64 nt, Human
uggaaccuuaaauacuucugguaaaccauagagaauggaggauggcugugaugaagcugcuuag

SEQ ID NO: 472960 - RNA, 64 nt, Human
acuuacuggaaucuuuuauaauaauguaaguggaauggaggauucuaggaacugagaacuguau

SEQ ID NO: 472961 - RNA, 64 nt, Human
aaucacacagguuugugaucuaagugccagaaccauggaggagacucuggccuuaucuguaggg

SEQ ID NO: 472962 - RNA, 64 nt, Human
gagaggaguuuucuccauaucaaaacgagggcugauggaggaaaaaggucaauaaggucaaggg

SEQ ID NO: 472963 - RNA, 64 nt, Human
cugcaggucagcaguaagguuucaagguacaguuauggaggaaagaagaaaaugacacauugau

SEQ ID NO: 472964 - RNA, 64 nt, Human
ucucaugagaccggcucacuaucacaggaacagcauggaggaaaccgcccccaugauccaguua

SEQ ID NO: 472965 - RNA, 64 nt, Human
ggauaacguggggcuaggacacugacagccuuugauggaggaacccaagaaaggcgcgcgacaa

SEQ ID NO: 472966 - RNA, 64 nt, Human
gccuccagcguuggcuggccauggccacagccagauggaggagcccauccccaggagacucagg

SEQ ID NO: 472967 - RNA, 64 nt, Human
agagauccauugaguccagaagccagaucagcaaauggaggaaccucggaggugaccagaaaga

SEQ ID NO: 472968 - RNA, 64 nt, Human
ccaggaguggaugcugggcagaggccagaguagaauggaggaugauugccgcccaggggacgag

SEQ ID NO: 472969 - RNA, 64 nt, Human
cuugaauaaaggaagauauguuccacauuccuggauggaggacuacacacauuauggaaagacc

SEQ ID NO: 472970 - RNA, 62 nt, Human; identical to SEQ ID NO: 470864

SEQ ID NO: 472971 - RNA, 62 nt, Human
cggccaggcuucgugcuggggugggccaugugccaggacaggagggucccggcggaaagcca

SEQ ID NO: 472972 - RNA, 64 nt, Human
ccccugguccccgccccaagagccugcugucuguauggaggaggugcuagcccgguccaccggg

SEQ ID NO: 472973 - RNA, 64 nt, Human
gggcagccaguguugguggagcugccucuagcacauggaggagagugaaagucagccugccccu

SEQ ID NO: 472974 - RNA, 64 nt, Human
aacugccauguugugaggacacucaagcagcccuauggaggagcccacauggugagguacugag

SEQ ID NO: 472975 - RNA, 64 nt, Human
aauagcaaaagauauuaaauaugcuaacauagcuauggaggaauugagggcaagcacccaggac

SEQ ID NO: 472976 - RNA, 64 nt, Human
uaacugaaagggcaaagucuuaaucaaucaaacaauggaggaaucaccgacuuuacacaguauu

SEQ ID NO: 472977 - RNA, 64 nt, Human
agauggcugaagaggggaagccuaggcugccucaauggaggagucgcugggggcauuuucaccc

SEQ ID NO: 472978 - RNA, 64 nt, Human
aaaaaggcuuccgggcuguccucugcccagugagauggaggacgcuagagaaagugcugagugu

SEQ ID NO: 472979 - RNA, 64 nt, Human
ggcuggaaguccaugggccacccuguucuuguccauggaggacuccgaggguuccaaguauacu

SEQ ID NO: 472980 - RNA, 64 nt, Human
cacagccacaucuuccuagaccuaagaguaaauuauggaggauuuuauuuaugucuauuuauau

SEQ ID NO: 472981 - RNA, 64 nt, Human
uauggaaucuugccugguaucauugagcccacacauggaggaagcagaacucaucaguucuugg

SEQ ID NO: 472982 - RNA, 64 nt, Human
gggcgcauacccgagacgauuguaugaagaaaauauggaggaacuguuacauguucgguacuaa

SEQ ID NO: 472983 - RNA, 64 nt, Human
cgaagcucugaaaggugggaacaccacagaggccauggaggacuucacaggagggguggcagag

SEQ ID NO: 472984 - RNA, 64 nt, Human
uggaagccaggccagaggacuuggggaaaaugagauggaggaaggaaaaagggagaagcugagc

SEQ ID NO: 472985 - RNA, 64 nt, Human
ccagggggcagugccaaacacgcggcaccaggagauggaggaugucaucaggcuggcccagaag

SEQ ID NO: 472986 - RNA, 62 nt, Human
cauccuggacugggagguggaggcagagccccccaggacaggagcaacugucucagggagga

SEQ ID NO: 472987 - RNA, 64 nt, Human
aagaauaaaaagauaaucugaagguguuugagucagaggcuacuuuuccccuuuauauuuuaua

SEQ ID NO: 472988 - RNA, 64 nt, Human
ggaauauuugaguucuauuuccauacuugaaaacauggaggauuuuagagaugccugaacaaua

SEQ ID NO: 472989 - RNA, 64 nt, Human
uuguaaugaacuucuggaucuccagucagauacuauggaggagagagugauggagggcugagga

SEQ ID NO: 472990 - RNA, 64 nt, Human
uuucugauuaguuaguaaauaacaccuggauucuauggaggaccucggucuucauccaaguggc

SEQ ID NO: 472991 - RNA, 64 nt, Human
ccuuggaauucgcuuucuaaaggaaaucaaaugaauggaggaacuuuccaaacaccacuuuacu

SEQ ID NO: 472992 - RNA, 64 nt, Human
cuccaaggccuggagcuauucugguaccuuccccauggaggacacugaaaaggcuggguugggg

SEQ ID NO: 472993 - RNA, 64 nt, Human
caucucugacccagucuucggacucauucuguaaauggaggagcugaggucagaggggggcugu

SEQ ID NO: 472994 - RNA, 64 nt, Human
uagccaggacugauggagccccugggggugugggauggaggagggucugcagccaguucauucc

SEQ ID NO: 472995 - RNA, 64 nt, Human
ccgggacugggcuaggaguuggacggaauggaggauggaggacagcgagaagaaaggaagagaa

SEQ ID NO: 472996 - RNA, 64 nt, Human
ggcgcccccgggacugggcuaggaguuggacggaauggaggauggaggacagcgagaagaaagg

SEQ ID NO: 472997 - RNA, 64 nt, Human
gaaaccaaaacagccuguccacugcugcugugggauggaggaggcguaagcagaaacacuaaca

SEQ ID NO: 472998 - RNA, 64 nt, Human
gugccugcuagaggagcucuguguucccaaggagauggaggaagaccuggggugggggugguac

SEQ ID NO: 472999 - RNA, 64 nt, Human
cagaggcugugaacagggagaugggggaggggggauggaggacucaagggauguaagggauaug

SEQ ID NO: 473000 - RNA, 64 nt, Human
uggccagaacuccuauuccuaaaaggauuuugagauggaggaacacauauuuaauuccccuuua

SEQ ID NO: 473001 - RNA, 64 nt, Human
ugcguacugauuacaugagucuuuggagucggggauggaggagguucugccccugugagguguu

SEQ ID NO: 473002 - RNA, 64 nt, Human
aggaaugcagcagaagacacaagaaaagcauuucagaggcuaauuuaaaacaaaaaguaagcac

SEQ ID NO: 473003 - RNA, 64 nt, Human
ccuaccacaccuuccugccacugacucccacaggagaggcuacaaaaugaucuggcgcacaggg

SEQ ID NO: 473004 - RNA, 64 nt, Human
aucauuuaaaaaaaauguaaaagacaaaaaaaaaauggaggaugauuuaaaagaugcuuucuau

SEQ ID NO: 473005 - RNA, 64 nt, Human
gcuuaggcaaacagguggaucccauggcauccccauggaggaaccaggcccaucugggcagcag

SEQ ID NO: 473006 - RNA, 64 nt, Human
uggcaagggaggaggcugagcagaaggagucaucauggaggagcggugagaacauggaaccgga

SEQ ID NO: 473007 - RNA, 64 nt, Human
uuagcaugucccuaccgagucucuucuccacuggauggaggaaaaccaagccguggcuucccgc

SEQ ID NO: 473008 - RNA, 64 nt, Human
ccuaggcugaggaucgcccacuggagccaguggcauggaggauuucgguagcuuugaaagcuug

SEQ ID NO: 473009 - RNA, 64 nt, Human
uccuccuccagggcccucugcagaccaggcugagauggaggaaccugcuaaaaucgauggagau

SEQ ID NO: 473010 - RNA, 64 nt, Human
aguggcagcagccccaccccgagcgcacacugugauggaggagacugagcucccuggggcgggc

SEQ ID NO: 473011 - RNA, 64 nt, Human
gacguuagagugguggcuuccuuagccuuucaggauggaggaaugugggcaguuugacuucagc

SEQ ID NO: 473012 - RNA, 64 nt, Human
ugggucuaccucaucucugaaaauucuggaaggaauggaggagucucaacauguguuucugaca

SEQ ID NO: 473013 - RNA, 64 nt, Human
cuggccaagaaguuaaacuauuuugagcauuagaauggaggaaauccggucagccaagugcaga

SEQ ID NO: 473014 - RNA, 64 nt, Human
gggcuggaggcugagcugcaucccugcuccccacauggaggacccaacaggaggccguggcucu

SEQ ID NO: 473015 - RNA, 64 nt, Human
uacacauugcuguuuguagguggcuacagugucaauggaggaucuggggaaaauacuuaugguc

SEQ ID NO: 473016 - RNA, 64 nt, Human
ccccaaaggaguggacauuuccuaacaauucuguauggaggaaggugggguaauugcauucguc

SEQ ID NO: 473017 - RNA, 64 nt, Human
uaccaugcaggagcuaauuggcuuauauguuaccauggaggaguacuucaugagggagacuguc

SEQ ID NO: 473018 - RNA, 64 nt, Human
uuuuuguugaauaggaaauaaaauuaaugaagacagaggcuagaaagcauccauuaauuaauga

SEQ ID NO: 473019 - RNA, 55 nt, Human
ucuuuccaaaaucuaauuaauuaauagaggcuaucuaauuuuacacucuguauug

SEQ ID NO: 473020 - RNA, 64 nt, Human
ucaagaaaaguagauuuucuagaaauaaacaguuauggaggacuuguauggagaaauuuaaguc

SEQ ID NO: 473021 - RNA, 64 nt, Human
guggagaggguguggaaaguuaucacauuaaaagauggaggauuugcucuguuuuuuuucuuuc

SEQ ID NO: 473022 - RNA, 64 nt, Human
gcgguaccuuuccuacugucuuuucuuugacuccauggaggaauuuguaacgaucggugugacc

SEQ ID NO: 473023 - RNA, 64 nt, Human
uuccaccuggggagaucccaccugccguaggcacauggaggaggagcccagaguugggcacugg

SEQ ID NO: 473024 - RNA, 64 nt, Human
gaaugggcacaaaguauaaauauuuuguuucuuuauggaggacauguggaaggaguuugagggu

SEQ ID NO: 473025 - RNA, 64 nt, Human
gugggcgccuuggcuggugcggcugcugguccagauggaggaaaccagugacuuuauggggcug

SEQ ID NO: 473026 - RNA, 64 nt, Human
agguacccuuagauccuuuucuacccacuuuccuauggaggauuccaagucaccacuucucuca

SEQ ID NO: 473027 - RNA, 64 nt, Human
cucacugagcaccacuuguccuggaggcuggaugauggaggacaucugguuauagguacuguag

SEQ ID NO: 473028 - RNA, 64 nt, Human
auuaagaguuguucaguaugcaaaacuuggaaagauggaggagaaaaagaaaaggaagaaaaaa

SEQ ID NO: 473029 - RNA, 64 nt, Human
ggacgcuaacuccccuugauaaagucucgguuccauggaggacuugaguggccccaaaggcugc

SEQ ID NO: 473030 - RNA, 64 nt, Human
cuuauuccaagaggcugagccaauggggagaaagauggaggacucacugcacagccgcuuccua

SEQ ID NO: 473031 - RNA, 64 nt, Human
ugaucacgggaaggacugcucugagccggguaggauggaggacuuuggaagaggcgcuccuugg

SEQ ID NO: 473032 - RNA, 64 nt, Human
agaagcuggccuuucagccugcuucacccaaguuauggaggagguuaagucuacauuuccacca

SEQ ID NO: 473033 - RNA, 64 nt, Human
cucugcauuaucugaggucacagggccuggggagauggaggaaagugauaucccccagccucaa

SEQ ID NO: 473034 - RNA, 64 nt, Human
agagaaaacacugaaaauugaauucuuaucuuccagaggcuacaauuauuauaauggacaauac

SEQ ID NO: 473035 - RNA, 64 nt, Human
gaaucucucagcgaccaggugcugcugcuggaggagaggcuaggugccugugaguccucacacu

SEQ ID NO: 473036 - RNA, 64 nt, Human
ccacagccucuccaaguucagagugagauucugcauggaggaaaaaugacuaaggacugagccc

SEQ ID NO: 473037 - RNA, 64 nt, Human
ugccccgugcagacuggaggggacgcugguagagauggaggaggaggcaauugggauggcgcua

SEQ ID NO: 473038 - RNA, 64 nt, Human
ucccauucccacacaugugcccagaguagggggcauggaggagauggucccuguccuacugcag

SEQ ID NO: 473039 - RNA, 64 nt, Human
uaccuuccuguaccuggguggauggagcgggaggauggaggagacgggacaucuuucaccucag

SEQ ID NO: 473040 - RNA, 64 nt, Human
uauguauaucuuuuuuagauaccuuugucuggauauggaggaacaagcaaucuuauuuuggaag

SEQ ID NO: 473041 - RNA, 64 nt, Human
aacacagccaacccuccuccacagcgccauauuaauggaggaggggaggaaggugaaaucuacu

SEQ ID NO: 473042 - RNA, 64 nt, Human
agcaaggcagcaagacuuccugcuauccaagcccauggaggaaaguuacugcugaggacccacc

SEQ ID NO: 473043 - RNA, 64 nt, Human
cugggugaguacggagggucuagccuggguguguauggaggaucuagccugggugaguauggag

SEQ ID NO: 473044 - RNA, 64 nt, Human
caguggccuuguuggugcccacagggcuguguggauggaggaagcugucccugcccagugcauc

SEQ ID NO: 473045 - RNA, 64 nt, Human
uccccaccuuagcugucuccugccccagggagggauggaggagauaauuugcuuauauuaaaaa

SEQ ID NO: 473046 - RNA, 64 nt, Human
uauuuucaggguuuuuuuuuuuuuuuuuuugcauauggaggacagguggacaugguccugagcu

SEQ ID NO: 473047 - RNA, 64 nt, Human
cacgccuauaaucucagcacucugggaggccaagauggaggauugcuugaagccaggaguuugg

SEQ ID NO: 473048 - RNA, 64 nt, Human
gacuuccaagcaggcccuccgcccucccugcugaauggaggagccgggggucccccaggccaac

SEQ ID NO: 473049 - RNA, 64 nt, Human
cgugcagagacacacauaggcucaaaauaaaaggauggaggaagaucuacgaagcaaauggaaa

SEQ ID NO: 473050 - RNA, 64 nt, Human
auuuguaaaacuguuaaccuaugauuauauguacagaggcuaaggcuucugcaggauuuauuau

SEQ ID NO: 473051 - RNA, 64 nt, Human
uauuaaaaagccuuagaaaguuacauauugguuuagaggcuaaaauuguguugaugcuguuuac

SEQ ID NO: 473052 - RNA, 64 nt, Human
cagacagugauggcccaaaauggucaggacuuuaauggaggaggugagguguugaaagcacagg

SEQ ID NO: 473053 - RNA, 64 nt, Human
gccccaacacugcccucauagagcucacaguccaauggaggaggcagauguguccucaggcagc

SEQ ID NO: 473054 - RNA, 64 nt, Human
caggggccccuggggacuucaacugcccagcaacauggaggaugguguccugaggccuccaagg

SEQ ID NO: 473055 - RNA, 64 nt, Human
ucccgcugcugugcucuggggauuucugggauauauggaggauucuuuccccagaggcucccaa

SEQ ID NO: 473056 - RNA, 64 nt, Human
agauacggaaaccugccccacucacacccaucugauggaggaacuuuaaacgcuguuuucucag

SEQ ID NO: 473057 - RNA, 64 nt, Human
cuguuagaucuauuucauguuuuuauuauggauaauggaggagguaaagguugaauuauauuuu

SEQ ID NO: 473058 - RNA, 64 nt, Human
ugcgacaggagccacaccagagugugcaggcuucauggaggacagaagcgacuuuugugccggg

SEQ ID NO: 473059 - RNA, 64 nt, Human
aagaacauugagaacaaucagcugguaauuauggauggaggaagagggagaggaaaaaaauauu

SEQ ID NO: 473060 - RNA, 64 nt, Human
agcaacccaagcuaagacacaauccaauuuuaaaauggaggaaaggacuugaauagacauuucu

SEQ ID NO: 473061 - RNA, 64 nt, Human
ggcagaaggaggccccgaguuagaaaaaguagcuauggaggacuacaaggauaacccagcauuu

SEQ ID NO: 473062 - RNA, 64 nt, Human
aauccaucucaagcauauuuuaaaauaaugagagauggaggaaacaaucuagaagauaaaagaa

SEQ ID NO: 473063 - RNA, 64 nt, Human
caggaaacccaaucaugagguccuugugccugguauggaggagacugcagucaggauaugcauu

SEQ ID NO: 473064 - RNA, 64 nt, Human
aagacagacaaugucgagggacaaaagauagaagauggaggaggaaagacauuauacgugggcu

SEQ ID NO: 473065 - RNA, 50 nt, Human
ccagcccaggugggccuuaaauggaggacuuggcgggcagcaggaggcaa

SEQ ID NO: 473066 - RNA, 64 nt, Human
cuaaguauagaugaaagaugaagaggcagaauugagaggcuaacauauuuacucuugucuaacu

SEQ ID NO: 473067 - RNA, 64 nt, Human
gauuuccaauucccugcuccuucccacuccauuaagaggcuaggugaggcgcuucuagguugcu

SEQ ID NO: 473068 - RNA, 62 nt, Human
guuugagugcagagacacuggucuggggugauccauggaggaccauuaaaaugugacaccuu

SEQ ID NO: 473069 - RNA, 64 nt, Human
uccgccgcuccgccugagcuccccgguuugcagaauggaggagggaaguugaaggagccaccuc

SEQ ID NO: 473070 - RNA, 64 nt, Human
gagcagcacaaagaaacagccuuacacugggcacauggaggagacguccacccugcagccagga

SEQ ID NO: 473071 - RNA, 60 nt, Human
gcuguugccguaucuccuagucuccgugugauggaggagggagaugccuggggaggggcu

SEQ ID NO: 473072 - RNA, 64 nt, Human
gcuguguaucacuaguauauaauagagcaauauuauggaggaauauguagauccaaucacuuua

SEQ ID NO: 473073 - RNA, 64 nt, Human
ucuagcugccuauuuuguguuuagggaagggaaaauggaggaaaggggagaagagcaaagggcg

SEQ ID NO: 473074 - RNA, 64 nt, Human
uuaagcagcaauggcugcaguguccuucucaguuauggaggacaucgucucauuagggaacuuu

SEQ ID NO: 473075 - RNA, 64 nt, Human
gccuuucaaccuuguuuuacaguucugcaguguaauggaggacgggcaacgugcaugugcaggc

SEQ ID NO: 473076 - RNA, 64 nt, Human
aaucgggguauaauaggcucugccugacagagggauggaggaagaacugaaaggcuuuucaacc

SEQ ID NO: 473077 - RNA, 61 nt, Human
gcagccacgggacgggguagagccaggggugauggaggaaccaccacagcagugccuucuc

SEQ ID NO: 473078 - RNA, 64 nt, Human
aaccaagaugggggaccagcaaccccccagggucauggaggacccaggacccuccaaccuugac

SEQ ID NO: 473079 - RNA, 64 nt, Human
cuggcucugggacaucugucccuggcugccuuucauggaggaaggacacuggccuuucugguug

SEQ ID NO: 473080 - RNA, 60 nt, Human
gauuuucucucacagcuugauuccugccauauggaggaggcucuggaguccugcucugug

SEQ ID NO: 473081 - RNA, 64 nt, Human
gcuggggcuggccggggguccuguggaggaguacauggaggacuccagguacagcgcaggaguc

SEQ ID NO: 473082 - RNA, 64 nt, Human
aaaaagcuguaaauggcaauagaguuuugguaccagaggcuagaguggacaaaugagggccagg

SEQ ID NO: 473083 - RNA, 64 nt, Human
gccugaggcugggaauaccugucucugcucuagcagaggcuaaagcaggcuagagcaguggagg

SEQ ID NO: 473084 - RNA, 64 nt, Human
acacauacacacauguauauauauauucuucauaauggaggacaauguuuugcaauauauaaau

SEQ ID NO: 473085 - RNA, 64 nt, Human
guucuuuauuagugccucucacaaaagauccuggauggaggaguaagaugaaauauuaugcuau

SEQ ID NO: 473086 - RNA, 64 nt, Human
gccccagacuugucgcacggaugcagaaaacuuaauggaggaggcugaggucagaaugggaaga

SEQ ID NO: 473087 - RNA, 64 nt, Human
ccaaacugacugaggagugggacgguucguuugaauggaggagguguugagugagcaacacgca

SEQ ID NO: 473088 - RNA, 64 nt, Human
ccacauuauuuuaauugcaaaaaagcaucuauauauggaggagggugggaaaauagagguagga

SEQ ID NO: 473089 - RNA, 64 nt, Human
ugccacccauggggagcgccaggagaggagggucauggaggauguuggggcucugaccccagga

SEQ ID NO: 473090 - RNA, 64 nt, Human
aaucuagaaagaacuugcuuuguacagggcugagauggaggagaaaaaaaugcccccuucagaa

SEQ ID NO: 473091 - RNA, 64 nt, Human
ugcagguucacugcaucuccccccaaaccucaggauggaggaagaguaaugaauauggcaguuc

SEQ ID NO: 473092 - RNA, 64 nt, Human
cccugccuggggaucucaaggaugaggccccagcauggaggauuggggguagaauuccacccuu

SEQ ID NO: 473093 - RNA, 64 nt, Human
ucacuuuucacagccuccaagggcagcagugcacauggaggagacgucucccacgaggccaagg

SEQ ID NO: 473094 - RNA, 64 nt, Human
ggcccugucuuuuucaggaaaauuacauccucccauggaggaugagagacugaggcucagggag

SEQ ID NO: 473095 - RNA, 64 nt, Human
cccuuccccucucugguccucagcuuccuccaucauggaggagaugggaucauggauuuucugg

SEQ ID NO: 473096 - RNA, 64 nt, Human
ugccccucugagucaggagccugguggggacaagauggaggauguccacagaggcugaccugug

SEQ ID NO: 473097 - RNA, 64 nt, Human
ugcaagaauauucauauuauaaaugucucaucugauggaggaacgugugcauuuagagagaggg

SEQ ID NO: 473098 - RNA, 62 nt, Human
ccccccaauucccccccccaucaccuuaucucccaggacacacuugagaaguagcuuuuuau

SEQ ID NO: 473099 - RNA, 62 nt, Human
ugcacccacccugcuugaucccaccugggaggccaggacacugaggagcucugaacccagcc

SEQ ID NO: 473100 - RNA, 64 nt, Human
auaguagaugcucaguguauauuuguggcauugaauggaggaccagaagguagggugcagguga

SEQ ID NO: 473101 - RNA, 64 nt, Human
gcuuauuacagguagguagugcuuaagaaaagucauggaggacuaaagccuaaguccuuuucac

SEQ ID NO: 473102 - RNA, 64 nt, Human
acuacacaauuauucaugaaauggcuguuuuccaauggaggaacagcauuugaugcauuauaac

SEQ ID NO: 473103 - RNA, 64 nt, Human
gggcgccuagcagugcuguguggggagccgagguauggaggagcuggggagcagcuaugcaaau

SEQ ID NO: 473104 - RNA, 64 nt, Human
augccugugguccuggcuacuugggaggcugaggauggaggaucauuugagcccaggaggucga

SEQ ID NO: 473105 - RNA, 64 nt, Human
ggcgcacuaugaggcacugcggcacuuccugcugauggaggacggcgaguucgcccagucccuc

SEQ ID NO: 473106 - RNA, 64 nt, Human
cccacggccaugccucugcucuugggcgcccaucauggaggagcaccugaacuuucuggacaag

SEQ ID NO: 473107 - RNA, 64 nt, Human
ccuggcaaaggccaaaacccuuacucacaugaggauggaggaacagaacagaggacuugggaaa

SEQ ID NO: 473108 - RNA, 64 nt, Human
cuagcuuauuuguauuuuuccucuuucacuucuuauggaggagaguguuuaacugaguuagaau

SEQ ID NO: 473109 - RNA, 64 nt, Human
aguuucuucuguaaauaacuugcaaggaugaaagauggaggaugaaccuauagauuuaaagaga

SEQ ID NO: 473110 - RNA, 64 nt, Human
guaaucuaggcaccuuugccaacaccucccaaggauggaggacugggcgagggacugggaaaga

SEQ ID NO: 473111 - RNA, 64 nt, Human
gaaguugaaauacccaguaaaauguugaagaaggauggaggauuucuucauaucugacguuucu

SEQ ID NO: 473112 - RNA, 64 nt, Human
caaggcuuucuuaucuuuugguugucucugcuuaauggaggagccuggccuaggauggaggccu

SEQ ID NO: 473113 - RNA, 64 nt, Human
uuuuuuuauuuuuuaaagaaaucuauuucauaccauggaggaaggcucuguuccacauauauuu

SEQ ID NO: 473114 - RNA, 64 nt, Human
aaauuuguauguacuugacaauuccuuagaaaaaagaggcuaaaauaaaauagaucuaugucau

SEQ ID NO: 473115 - RNA, 64 nt, Human
ugagaaaaaugugggaaguaacuuuucuguacccagaggcuaaguauaagucugugaucugccu

SEQ ID NO: 473116 - RNA, 64 nt, Human
cucauuuauaaagcagcuuaggaacuaauuaaacauggaggaugaauuaccuuccuaucccuug

SEQ ID NO: 473117 - RNA, 64 nt, Human
ucagcugauuuugaaaaagugaaaaagcaauucaauggaggaagaauagccuuucugacaaauu

SEQ ID NO: 473118 - RNA, 64 nt, Human
aucauuuuuggugaacuguuguguccuuuaaaaaauggaggaggauagguucuuuggguaaauu

SEQ ID NO: 473119 - RNA, 64 nt, Human
cccuuccccugggaacucuccuggccuucuaggaauggaggagccaggccccaccccuucccua

SEQ ID NO: 473120 - RNA, 64 nt, Human
ggaugaagaccuagacucaucugaaggaucuuugauggaggaagaagacccagacucaucugaa

SEQ ID NO: 473121 - RNA, 64 nt, Human
uccaucuagcugcuaaugccaagugucccuaaagauggaggaauaaagccaccaauucuguugu

SEQ ID NO: 473122 - RNA, 64 nt, Human
agccacagugguuucuacuguauguaugaaccgaauggaggaauguuuucaaagauugauuugg

SEQ ID NO: 473123 - RNA, 64 nt, Human
gccccccacugaaugcuugccuugcccaaauggaauggaggaagauugauuuucuccaucaguu

SEQ ID NO: 473124 - RNA, 64 nt, Human
ccacccucuggcuggugcugggccggagguggcuauggaggauuuuggcaugcguggccugucg

SEQ ID NO: 473125 - RNA, 62 nt, Human
cauccugaaaagcaugccugugggcuguccucccaggacaagccaaggagccaacgagggcu

SEQ ID NO: 473126 - RNA, 62 nt, Human
ggguagugcuaagaggaucuccuguccaucagccaggacagucagcucucuccuuucagggc

SEQ ID NO: 473127 - RNA, 62 nt, Human; identical to SEQ ID NO: 470865

SEQ ID NO: 473128 - RNA, 64 nt, Human
gggccacggaacccggcaggggugucugaggccgcccugucagcuggccgguccaagccugugg

SEQ ID NO: 473129 - RNA, 64 nt, Human
cuccucacuggggguuucacgggguuggacugagcccugucaccucugugauagucuucacucu

SEQ ID NO: 473130 - RNA, 64 nt, Human
agucugcucauuccgagggugaaacaaaauccaacccugucagaaucaugcuguucucuuugcu

SEQ ID NO: 473131 - RNA, 64 nt, Human
cucgaggcucagggugggagagggccccgggcugcccugucacuccucuaacacuucccucccc

SEQ ID NO: 473132 - RNA, 64 nt, Human
cuucaccuggccaugaaggaccuuuugaccaacucccugucauuccuaaccuaaccuuagaguc

SEQ ID NO: 473133 - RNA, 64 nt, Human
gggacugacacuccaggcagcuuugccuucucuccccugucauuuccagauuucauuaccuccu

SEQ ID NO: 473134 - RNA, 64 nt, Human
uugaucgcacagacagagcuugugccggauuuggcccugucaaggggacuggugccuuguuuuc

SEQ ID NO: 473135 - RNA, 64 nt, Human
aggugccugucaccugucuucacugccuccuuuucccugucaugcucaucagcuuauggcuucu

SEQ ID NO: 473136 - RNA, 64 nt, Human
cauuaguuccauuuguaccagccaguuacugagccccugucacccuugaagugaguuccaccug

SEQ ID NO: 473137 - RNA, 64 nt, Human
uggcuggcuggguccagccaucuccggccagcaacccugucaguguuccacccugucccaggcc

SEQ ID NO: 473138 - RNA, 64 nt, Human
gcucuggggccgucugcugacgaagaacuggagacccugucaaauaugacagguaaaccuuugg

SEQ ID NO: 473139 - RNA, 62 nt, Human
gcaacuuucccaacuacccaaccccaccauggccaggacaugugcaaugccagccccuucuu

SEQ ID NO: 473140 - RNA, 62 nt, Human
ccucaguacugcaucacuguguugggaucauaccaggacaauagggucauuccauaugauaa

SEQ ID NO: 473141 - RNA, 62 nt, Human
uaaaguguaauucucugccuucauuaucaaguccaggacaguguuuauuuugaaucguuaac

SEQ ID NO: 473142 - RNA, 64 nt, Human
ggguagucccaggcuccugucuuggggauguuuccccugucagcaaguaaccuggugaagucua

SEQ ID NO: 473143 - RNA, 64 nt, Human
uuuuguucaagggacuaaauugcuuauguuuauucccugucagcggaguggagaaugucauuca

SEQ ID NO: 473144 - RNA, 64 nt, Human
cgcuguccaggcauuccuggugaggggaaggggacccugucauccugcuuuauuuauuuggguc

SEQ ID NO: 473145 - RNA, 64 nt, Human
auaaauauguuuuugauauguuggacaugaauuacccugucaugaagcguuuaaauuguuaaaa

SEQ ID NO: 473146 - RNA, 64 nt, Human
cuccccagaguaagagcuggggcugacagucccacccugucauuccuaauagcccaaacgcaga

SEQ ID NO: 473147 - RNA, 64 nt, Human
gacgaugcccucucagccaacacugccaaccugacccugucaucccgauugacagcgccacuuc

SEQ ID NO: 473148 - RNA, 64 nt, Human
ucucauucucuccuuccccgcucugucucucucucccugucacucucucucucuuguuccuuau

SEQ ID NO: 473149 - RNA, 64 nt, Human
uauugccuggccggugacucgggggaggaggcgacccugucaucugucccaccugcugcugccc

SEQ ID NO: 473150 - RNA, 64 nt, Human
cauuuuuuuuuguuuguuuugagauggagucuugcccugucacccaggcuggagugcaauggug

SEQ ID NO: 473151 - RNA, 64 nt, Human
ugggugggugcuacuucugauucauuguccuugucccugucauaaguaccucccuauuguagau

SEQ ID NO: 473152 - RNA, 64 nt, Human
uugccuggcuguggaggccugaugcugccccguucccugucagaggcuaagaugagauuugcca

SEQ ID NO: 473153 - RNA, 64 nt, Human
ggagagucuccuggccuccccuccugucucaccccccugucacccucccaguggcauccagggu

SEQ ID NO: 473154 - RNA, 64 nt, Human
ccuuuucaaagcaauagccgccgggucugcaaagcccugucagacagacugggcccuuccaagg

SEQ ID NO: 473155 - RNA, 64 nt, Human
ugaccacaucacuccauauggggaggagaaggaucccugucaccuucuccucucuucacggggc

SEQ ID NO: 473156 - RNA, 62 nt, Human
aggcaaauagugcuucacccugaccucucacuccaggacagccucuaagggauuugaucugc

SEQ ID NO: 473157 - RNA, 62 nt, Human
gcuucaacugguaucuaugagguccuagagcuccaggacaaugauaagacucgcuauauggg

SEQ ID NO: 473158 - RNA, 62 nt, Human
ggcaucuccuuuacgccagggugaggaagacaccaggacaaugacagcaucggguguuguug

SEQ ID NO: 473159 - RNA, 64 nt, Human
aguauccaccaaaguccuaaucuaaaguccugcucccugucacuuuuuaaaagccaggguagca

SEQ ID NO: 473160 - RNA, 64 nt, Human
ggucaugggggccaaggagaaaggcaugaaucuucccugucaggcucuuacagccacaggcacu

SEQ ID NO: 473161 - RNA, 64 nt, Human
guucuguuucucucugaccaccagugcaugcagccccugucauguaccgccuguuugcucaaau

SEQ ID NO: 473162 - RNA, 64 nt, Human
ucagugaucagcagaugguacuucaacagcaauccccugucaaaccucagaacuugaggcugaa

SEQ ID NO: 473163 - RNA, 64 nt, Human
gaagccccagguccuucugagacugcuuucccuccccugucaggucucuccuguccuaaccauc

SEQ ID NO: 473164 - RNA, 64 nt, Human
ucauuuccuccaugauaaaaggauccaagugaggcccugucacagccuguggguaggggaugcg

SEQ ID NO: 473165 - RNA, 64 nt, Human
uuuuguuuaauagagaauuuuuuuuuuccuguuccccugucagcuggucugacagauuuaagaa

SEQ ID NO: 473166 - RNA, 64 nt, Human
uguucacggucccaggagcuguccuugcugcaugcccugucacaguucccucgacucuuucaaa

SEQ ID NO: 473167 - RNA, 64 nt, Human
ucuccugaggacauaaucacuuggucaccuuggacccugucacuuccuaaaauuacucguucug

SEQ ID NO: 473168 - RNA, 64 nt, Human
ugacaagguuaacauaaggacaacaaauacuccacccugucaugguaugugaggugugggugug

SEQ ID NO: 473169 - RNA, 64 nt, Human
aguagucuguugaaucauuacaucaaggagcugccccugucagggugaguguaauuaggaacga

SEQ ID NO: 473170 - RNA, 64 nt, Human
gggggugaagucaugagguccugaaggcuuaggccccugucauucccacccucacucuugcugc

SEQ ID NO: 473171 - RNA, 64 nt, Human
uuccacuuauagccucugucuggcaaugccacagcccugucagcaugaauuuguaaugucuuga

SEQ ID NO: 473172 - RNA, 64 nt, Human
gcaauaucagguaaaccaaguugcuuuccucacucccugucaugagacuucaguguuaauguuc

SEQ ID NO: 473173 - RNA, 62 nt, Human
caggcaagggcagcugccagcauggugcucugccaggacagguuucccugaaggaagcugcu

SEQ ID NO: 473174 - RNA, 62 nt, Human
cauuucauuaucuaacaaaauuaauauaaauuccaggacaugguaaaauguguuuuaauaac

SEQ ID NO: 473175 - RNA, 62 nt, Human; identical to SEQ ID NO: 470826

SEQ ID NO: 473176 - RNA, 64 nt, Human
gucacauugaaguacuguguggacuagaaauguacccugucaucaugcaaugaaauauuguuau

SEQ ID NO: 473177 - RNA, 64 nt, Human
ugagagcucccccagucagaucucaggcuugucccccugucagcugccuccagaagggaaggua

SEQ ID NO: 473178 - RNA, 64 nt, Human
ugugggaaaggagaagagaaguugucucugaguccccugucaccaguuggauucauuucuugga

SEQ ID NO: 473179 - RNA, 64 nt, Human
gggcaauccaaguacauguggcuucauacccacucccugucaaugcaggacaacucuguaauca

SEQ ID NO: 473180 - RNA, 64 nt, Human
uguuccacaucaggcaauaauuacuaaagagaaucccugucaaugucaagagggggugggcuuc

SEQ ID NO: 473181 - RNA, 64 nt, Human
gaccgcuuccugagcuccugcugccgcauuuaggcccugucagcugugaggccacuggugcuga

SEQ ID NO: 473182 - RNA, 64 nt, Human
aagucagacaguuuuuaauuuuucuugcuuugaacccugucauaaugacugugcaauacaugug

SEQ ID NO: 473183 - RNA, 64 nt, Human
auaacaauacuuagguucaagaucacuguucaaacccugucaugcuuuaaaacugaugcgagau

SEQ ID NO: 473184 - RNA, 64 nt, Human
cccccacccaggacggcugugaugagguggcccucccugucaacccuggucccuggagucccca

SEQ ID NO: 473185 - RNA, 64 nt, Human
ucagccgauggaccauaggucacgaggaauuucucccugucaagcaguggaaaacugcauggga

SEQ ID NO: 473186 - RNA, 64 nt, Human
uuccacuuagagaagcugaagcugugccucccuccccugucaagccaguucuuuccucuucagg

SEQ ID NO: 473187 - RNA, 64 nt, Human
gucugaugccccaacacugcccuugcuuuguuuucccugucaccucccuauuauuaaauguuuu

SEQ ID NO: 473188 - RNA, 64 nt, Human
uccuaggaauccugccugucacaagcucccaguucccugucauuuuaucuucaugauuagaacu

SEQ ID NO: 473189 - RNA, 64 nt, Human
cagaaaccagucaggcucucagucagccuuguggcccugucaaccgccucauuuuuaacccagu

SEQ ID NO: 473190 - RNA, 62 nt, Human
ggugaaccugcagggaggguaugauugccugaccaggacagccagucuuuacucuuuuucuc

SEQ ID NO: 473191 - RNA, 62 nt, Human
ccccucugcagacaccaauguccgagggccacccaggacaggacgggggucagccccaagcu

SEQ ID NO: 473192 - RNA, 62 nt, Human
ccugcaucagguucuccuuugaggguacccacccaggacaguccccuaccacuucugucuug

SEQ ID NO: 473193 - RNA, 64 nt, Human
cugcagcuacuuggugacuuaacaacuccaggagcccugucagcugcccuccuccaccuaaacc

SEQ ID NO: 473194 - RNA, 64 nt, Human
agggauucuacccugaacauaccucacagauccucccugucaugccacauuucacugauuggaa

SEQ ID NO: 473195 - RNA, 64 nt, Human
ggagaacgcacacccucccgugguggcuguuccucccugucaccugccuccucaucauggaagg

SEQ ID NO: 473196 - RNA, 64 nt, Human
gggagaggaaauccugugggccuuucugucccaccccugucagcacugugcuacugaugauaca

SEQ ID NO: 473197 - RNA, 61 nt, Human
cucugcacuaugagcugugacaaggcagccacccugucaccuagcucaauggagccccgga

SEQ ID NO: 473198 - RNA, 64 nt, Human
cggccuugcccugagagcugguccuccagcgaggcccugucagcggucuuaggcuccugcacau

SEQ ID NO: 473199 - RNA, 64 nt, Human
caccuccauaucccggcccacauccagcuggacccccugucauacagcagccaacaacacccau

SEQ ID NO: 473200 - RNA, 64 nt, Human
uucccuuuuuuuuuuuuuuugagacagagucucgcccugucacccaggcuggaguccaguggca

SEQ ID NO: 473201 - RNA, 64 nt, Human
gaguucgaguuacagccugggcaauaaagugagacccugucacuaacaaaauuaaaaaauaaaa

SEQ ID NO: 473202 - RNA, 64 nt, Human
ucguucuccacccaccagucagggacagcagccucccugucacucagcugagaaggccagcccu

SEQ ID NO: 473203 - RNA, 64 nt, Human
ugcagaucugugcucaucggagacugccccacggcccugucagagccgccacuccuauccccag

SEQ ID NO: 473204 - RNA, 64 nt, Human
uaggagucaccacaugcuccaaccucccacugcucccugucaggggcccaggcugccaucacug

SEQ ID NO: 473205 - RNA, 64 nt, Human
uacauauugccucuuccagcuccaaaguuuuggacccugucaguuuugcaacuacauuauacau

SEQ ID NO: 473206 - RNA, 64 nt, Human
gccaccacuccaaauacuccuccacaaccagcgucccugucacuaauugcgagaaugauggaau

SEQ ID NO: 473207 - RNA, 62 nt, Human
auuccauacaaauaacucagcacacaagugacccaggacauaugccugccaaagggaugugu

SEQ ID NO: 473208 - RNA, 62 nt, Human
uauugucagaaacacaaggcuugauuugguucccaggacagugaaacauaguaauaccacgu

SEQ ID NO: 473209 - RNA, 62 nt, Human; identical to SEQ ID NO: 470827

SEQ ID NO: 473210 - RNA, 64 nt, Human
ugcuuagagacuucaaaccagcagaggugaaagucccugucaucccuucagauuccagagcugg

SEQ ID NO: 473211 - RNA, 64 nt, Human
ugcuacacagacauuaagaagagcagagcuggcacccugucaucaccaguggccuugguccuua

SEQ ID NO: 473212 - RNA, 64 nt, Human
ggcccgggcaccacccgaccucgcagggagcaggcccugucaccgacgggucaccucgcccaca

SEQ ID NO: 473213 - RNA, 64 nt, Human
cgcccacagccaggccgagagcagacaccagcagcccugucacgccgggcucuacgucccaggg

SEQ ID NO: 473214 - RNA, 64 nt, Human
caacuuaagggaagccggcauguacccuucaaggcccugucaccaccuauuuccugaucaguug

SEQ ID NO: 473215 - RNA, 64 nt, Human
uuguaaggagcagauuuuuuuguucucaguggaacccugucaaaucgcauaaaagaggaaaaaa

SEQ ID NO: 473216 - RNA, 64 nt, Human
agcugaaauucaucuccuagugacagugccccggcccugucaagaaucacauacucagcauuuu

SEQ ID NO: 473217 - RNA, 64 nt, Human
uaccccuuucccucagucucuuccucucucuuuccccugucacuauuugucuuucuaaucuccu

SEQ ID NO: 473218 - RNA, 64 nt, Human
acuuugaaaaguuccugguggggccugauggaaucccugucaugcgcuggucccaccgggcuac

SEQ ID NO: 473219 - RNA, 64 nt, Human
ccuggagagguggcugcgcccccagcuucucucucccugucacacacuggaccccacuggcuga

SEQ ID NO: 473220 - RNA, 64 nt, Human
aaagagagcaaacuaccacaaccaaugguugagccccugucaagugccagucaugauaguagua

SEQ ID NO: 473221 - RNA, 64 nt, Human
guugggaugggauaggacuagcaccauuuuaagucccugucaccucuuccgacucuuucugagu

SEQ ID NO: 473222 - RNA, 64 nt, Human
acaugggauucccauuugagagccaaaggauaugcccugucaugguuucuguuuggccuguguu

SEQ ID NO: 473223 - RNA, 64 nt, Human
cccagagucacggggcugagggggcgggagcugccccugucauagggagggggauucccagcgu

SEQ ID NO: 473224 - RNA, 62 nt, Human
agugggagaaacagaccugggcgcaaacaacuccaggacaaggcaggacaugauaaagauua

SEQ ID NO: 473225 - RNA, 62 nt, Human
ccaucuugcugauggaaggaacaacagguggcccaggacaugcuccugcauacuccugggug

SEQ ID NO: 473226 - RNA, 62 nt, Human
ccacucuccugugauccaggugguccaggagcccaggacaggccuuuucugugggcccuggc

SEQ ID NO: 473227 - RNA, 64 nt, Human
uuauuuuucugacuucucgccuccacuccacuuacccugucaggaaaaaauaauucacaaggaa

SEQ ID NO: 473228 - RNA, 64 nt, Human
uuuauaagaaauugaaagagcagaagaauuacagcccugucacaugugcccagcacuccgcccc

SEQ ID NO: 473229 - RNA, 64 nt, Human
aggagacauagcaggucucagaaaccuucuaugacccugucaucuaaccaucagggaauucccu

SEQ ID NO: 473230 - RNA, 64 nt, Human
ucuccuccacacaccccuccguuccgcuagccuacccugucagccuuucaauaaaaguuaugca

SEQ ID NO: 473231 - RNA, 64 nt, Human
agccaaggagacccgggggaggaaccgcaguguccccugucaccacacggaauagugaaugugg

SEQ ID NO: 473232 - RNA, 64 nt, Human
gggcuccuuucuaacaaccuagacuggaauaaggcccugucagcauggcucccuuuaucccagu

SEQ ID NO: 473233 - RNA, 64 nt, Human
cuugccagcgugaaggaggcuuccagguacuucacccugucaaccaccucugaauccccaccag

SEQ ID NO: 473234 - RNA, 64 nt, Human
uucagugucuggccgaugugggucccucucuugacccugucacuugcuggcugugaaaccagga

SEQ ID NO: 473235 - RNA, 64 nt, Human
uggcagaugggggccucucuggaagagggaggggcccugucacuguccagagucucuuuuuaca

SEQ ID NO: 473236 - RNA, 64 nt, Human
ugcagguuugacacgcaguugcucgcuuuuccugcccugucaagcuucucuguucuggcgugag

SEQ ID NO: 473237 - RNA, 64 nt, Human
auggugauguuuacauccagggacaguuucgucucccugucaauggccucgugucccccccuac

SEQ ID NO: 473238 - RNA, 64 nt, Human
ccaagcagaagaccagauccaagauguuuggacacccugucagacguuggucccaaguuuaauu

SEQ ID NO: 473239 - RNA, 64 nt, Human
auugccaaauuugauauguugcacugaagacagacccugucauauauuuaauggcuucaagcag

SEQ ID NO: 473240 - RNA, 64 nt, Human
uuuccucagcauauaauuauuugucugucauuuacccugucaggugucaugccagguuauguau

SEQ ID NO: 473241 - RNA, 62 nt, Human; identical to SEQ ID NO: 470880

SEQ ID NO: 473242 - RNA, 62 nt, Human
gugaguggcauguccacuugcuggauuaucagccaggacacuauagaacaggaccagcugag

SEQ ID NO: 473243 - RNA, 62 nt, Human
gagaaggugccauggucuuaggugucugugccccaggacagacccuaggacccuaaauccaa

SEQ ID NO: 473244 - RNA, 64 nt, Human
uaaauuuaaagguguguguauucuguuugcaucucccugucacugugacacaccuagaugugug

SEQ ID NO: 473245 - RNA, 64 nt, Human
cucuguccuugcagaaagcccgugucugcagaaccccugucagaaugacgggcagugucgggag

SEQ ID NO: 473246 - RNA, 64 nt, Human
cguucuugccgagggugcagugguggcguggaagcccugucaccccaccccaggccacccucuc

SEQ ID NO: 473247 - RNA, 64 nt, Human
gggggcaccggcacgggggcagcgugcagcccugcccugucaggcugucagacaagccccgggg

SEQ ID NO: 473248 - RNA, 64 nt, Human
agggcgugucuagcuugauguuggaucucaagagcccugucaguagaguagaagucucuuccag

SEQ ID NO: 473249 - RNA, 64 nt, Human
cagcuuuuacuguuuuugaaaaauuacagcuucacccugucaaguuaacaaggaaugccugugc

SEQ ID NO: 473250 - RNA, 64 nt, Human
ugucacucgugguugguguccuuucaugcuucugcccugucaaaggucccuauuugaaaugugu

SEQ ID NO: 473251 - RNA, 64 nt, Human
uuugaucagacagcuugaaucagcaucucuucuucccugucagccugacucuucccuuccccuc

SEQ ID NO: 473252 - RNA, 64 nt, Human
ugcacgaagccuggccucuugcuuggcgugauaacccugucaucuucccaaagcucauuuauga

SEQ ID NO: 473253 - RNA, 64 nt, Human
acagaggaggcggguccccuugugcggcuuagggcccugucaggaaacacacggggaccucucu

SEQ ID NO: 473254 - RNA, 64 nt, Human
aagcggugggcaagggcuggccgcagcuccugugcccugucaggacgacugagggcucaaacac

SEQ ID NO: 473255 - RNA, 64 nt, Human
agcuuuucuccaaaaagcagccaacaucagccuccccugucaacucaacaguuuuguaucucau

SEQ ID NO: 473256 - RNA, 64 nt, Human
ugcuggggcucauggugcucugagcuggccuggacccugucaggaugggccccaccucagaacc

SEQ ID NO: 473257 - RNA, 64 nt, Human
cagugccaccgcuggccuccgcugcuuccaucagcccugucaccaccugguccuucaugaagag

SEQ ID NO: 473258 - RNA, 62 nt, Human
guggcugaguucggcugucauuuaagagaacuccaggacacaauucagcccggguuccgcaa

SEQ ID NO: 473259 - RNA, 62 nt, Human
cccugcaucuuuuauagcaguggguguccaguccaggacacuggugcuuuuuuauacaagag

SEQ ID NO: 473260 - RNA, 62 nt, Human; identical to SEQ ID NO: 470844

SEQ ID NO: 473261 - RNA, 64 nt, Human
ucggcccagcuuugucccuggagcccgaugcuaccccugucagacagaggcugcggccugggcc

SEQ ID NO: 473262 - RNA, 64 nt, Human
cccugacccugcuccuaucccacaguauuuaaugcccugucagucccuucuagucugacucaau

SEQ ID NO: 473263 - RNA, 64 nt, Human
guagaguagcugccaggaggacuuggccacccggcccugucacacugcagccccuuccccuucc

SEQ ID NO: 473264 - RNA, 64 nt, Human
cccccaacacccccaaauucaagaguggauguggcccugucacagguagaaaaaccuauuuagu

SEQ ID NO: 473265 - RNA, 64 nt, Human
aaacauaagagacuucccuaauaaauuaccagggcccugucacaacaaaauggauaucauuucu

SEQ ID NO: 473266 - RNA, 64 nt, Human
agaccacuugccacgcuguuguaaaaacccaagucccugucauuugaaccuggauccagcacug

SEQ ID NO: 473267 - RNA, 64 nt, Human
cuucacuagcgugcagaccagcccugucccgccucccugucagucaggcgaauucaaccggaaa

SEQ ID NO: 473268 - RNA, 64 nt, Human
uuugggaaauuauauauauuaauauacaucuuuccccugucacuuuugcagauauucuucgguu

SEQ ID NO: 473269 - RNA, 64 nt, Human
gauuaugcugugagccugcaggcuuuggaaguggcccugucacccgugcugcacgggauucaca

SEQ ID NO: 473270 - RNA, 64 nt, Human
cuggcucagguugcagacagcugagaaaagauggcccugucagccacccucucucagucugaaa

SEQ ID NO: 473271 - RNA, 64 nt, Human
uugcauacacaagaaaaacagagaaaagccugaucccugucaguggaaaagggguucaaugaau

SEQ ID NO: 473272 - RNA, 64 nt, Human
cuucuggaaaguuuucuguaccucauucuuuagucccugucaagguuaguaaauaaaauaagug

SEQ ID NO: 473273 - RNA, 64 nt, Human
uguggggggaacauuacuugaauggggauauuuacccugucacaagagccacugguauuuuagu

SEQ ID NO: 473274 - RNA, 64 nt, Human
guuuguuuguuuauuuauuuuugagacagucucgcccugucacccaggcuggagugcaguggca

SEQ ID NO: 473275 - RNA, 62 nt, Human
aagaucuugccuguuggugaucaugcuccucaccaggacagagacuguauaggcugaccaga

SEQ ID NO: 473276 - RNA, 62 nt, Human
acagggaaggagcagcaucugguaugcagccaccaggacaaggacugaaaauaaugucuaca

SEQ ID NO: 473277 - RNA, 62 nt, Human
uagcugaggagaggucgaauuuacugcuuuuuccaggacaauucuggaaguaaagaaaaugu

SEQ ID NO: 473278 - RNA, 64 nt, Human
guuccuaaaguugcuucuccuacccuaucccauccccugucacgcaucuggaagcuaaauugcc

SEQ ID NO: 473279 - RNA, 64 nt, Human
cuuccuugcagaaaccacgagaacaaagccaguucccugucagugacagggcuucuuguaauuu

SEQ ID NO: 473280 - RNA, 64 nt, Human
gcagaaagacugcugagguaacacggaccccagccccugucagggccucugccaaggaaauaau

SEQ ID NO: 473281 - RNA, 64 nt, Human
ccagaagaagagaucagaaugaugaguccagaaccccugucacacagggaauaggugaaggaac

SEQ ID NO: 473282 - RNA, 64 nt, Human
cauucauaggaagguguuucauuuuggugugcaacccugucauuacgucaacgcaacgucuaac

SEQ ID NO: 473283 - RNA, 64 nt, Human
agguaaauacacuagagugcuagaugccuuuuuccccugucaguuugacuuucauuuaaauccu

SEQ ID NO: 473284 - RNA, 64 nt, Human
cuggucagccccguggccucuggcccaccaagcucccugucacccagccauggugugguccagg

SEQ ID NO: 473285 - RNA, 64 nt, Human
uugggagggugguggggacagguaaguggcaggacccugucaggauugcaggugccuggcuugc

SEQ ID NO: 473286 - RNA, 63 nt, Human
gaagcagauuggagcagugaggaagaaccucugcccugucagacaggacuuugagagcaaugc

SEQ ID NO: 473287 - RNA, 64 nt, Human
ugcuuggcacccgcuccggcgacccuccccgcuccccugucauuucaucgcggacugugcggcc

SEQ ID NO: 473288 - RNA, 64 nt, Human
uccccagccaugcugugguuaccucuccuugccgcccugucaccuucaccucccggaguaagca

SEQ ID NO: 473289 - RNA, 64 nt, Human
gagggcugucugauugccccugcccugcucaccacccugucacagccacucccaagcccacacc

SEQ ID NO: 473290 - RNA, 64 nt, Human
ccagccagguuucccuccagcaggcuccuucccucccugucaccucccucucaccaacccgggg

SEQ ID NO: 473291 - RNA, 64 nt, Human
gccccauacccgucacuacagccucaccucccaccccugucacuacggccucaccucccacccc

SEQ ID NO: 473292 - RNA, 62 nt, Human
ucguuccaggugggugaccaagcugcggaagcccaggacaguucgcugggaccagugcuaau

SEQ ID NO: 473293 - RNA, 62 nt, Human
ccccucaccuugguacugaucagcgcccccacccaggacauaccuuccccaggauagagagc

SEQ ID NO: 473294 - RNA, 62 nt, Human; identical to SEQ ID NO: 470845

SEQ ID NO: 473295 - RNA, 64 nt, Human
cucccaccccugucacuacggccucaccucccaccccugucacuacagccucaccuccuacagc

SEQ ID NO: 473296 - RNA, 64 nt, Human
cagaaagacaagaacaauuagucaagagcaguagcccugucagagccucggagcaauaccuuuc

SEQ ID NO: 473297 - RNA, 64 nt, Human
gucucaggagggauaaccggauuucugcucuuuccccugucacucccacaucacacagaaaaau

SEQ ID NO: 473298 - RNA, 64 nt, Human
agcuucacccuacccuucuuacacaccuccccaccccugucagucugcuccccaucccccagcc

SEQ ID NO: 473299 - RNA, 64 nt, Human
ugugcucccugaccaaugacagagccugaaaaugcccugucagccaauggcagcucuucucgga

SEQ ID NO: 473300 - RNA, 64 nt, Human
gggacuuuccccucuccugucucagguggcccagcccugucagccugucuggccaacucagccu

SEQ ID NO: 473301 - RNA, 64 nt, Human
cggggcuguuuccuccuccucccccagauguccccccugucaccgggcagcucacccucaucuc

SEQ ID NO: 473302 - RNA, 53 nt, Human
agagcucugggccugcaugaggucccugucaguauacacccugggguguaccc

SEQ ID NO: 473303 - RNA, 64 nt, Human
ggaagccaccacugaugccucccacugugacaggcccugucaccaccaauaucuuauuucaacc

SEQ ID NO: 473304 - RNA, 64 nt, Human
caccgcacuguagaggccggucuuggugucccaucccugucacagccgcucacuccccgugccu

SEQ ID NO: 473305 - RNA, 64 nt, Human
gggucuggcccgcccuaagcagccccuggcuucacccugucaggccagcuccacuccaggacug

SEQ ID NO: 473306 - RNA, 64 nt, Human
cugcccacacuggugagcaggaggucuucccacgcccugucauuaggcugcauuuacucuugcu

SEQ ID NO: 473307 - RNA, 64 nt, Human
uuuucagagaguuuggggucuaccucagagcucucccugucaaaaagcagcugcaagccucgca

SEQ ID NO: 473308 - RNA, 64 nt, Human
gucaugcacuuugggauacagcguauaggugcagcccugucacaacaccaacagaaguagcagc

SEQ ID NO: 473309 - RNA, 62 nt, Human
ucaccgcccucugccccagccacucccggccaccaggacaugcuucaaugccuggugccaua

SEQ ID NO: 473310 - RNA, 62 nt, Human
acaagcaaaguaugcaggcccccugcagccucccaggacaggcuggcaagggaggagggccg

SEQ ID NO: 473311 - RNA, 62 nt, Human
ccuuuauugccaaucuuugaacucauucaacuccaggacauggaagaggccucucucugccc

SEQ ID NO: 473312 - RNA, 64 nt, Human
ggugaccacccccuguucccuguucugguauuuccccugucaguuuccccucucggccagguug

SEQ ID NO: 473313 - RNA, 64 nt, Human
ccagcagaucucagcagcccaguccaaauaaacucccugucagcagcaagccugagucuggcuc

SEQ ID NO: 473314 - RNA, 64 nt, Human
uuagaaggagggcccaggcacuuucuguuugaaccccugucaugaucacagugucagagacgcg

SEQ ID NO: 473315 - RNA, 64 nt, Human
guauuuucacuaaaccacugccaguauaaaagcacccugucaagggcccugacccagaguugug

SEQ ID NO: 473316 - RNA, 64 nt, Human
gccaaagcacuuaccaaagugaugaugacuaagacccugucauuaauuccaugugucaauacug

SEQ ID NO: 473317 - RNA, 64 nt, Human
cucugcagcacacgcagcuggagagggcuucugucccugucagcggcagagggcguuggggcug

SEQ ID NO: 473318 - RNA, 64 nt, Human
ggagcucugacugccguuuccccaaaacaauguccccugucagcaggaagcaguuaaaucuguc

SEQ ID NO: 473319 - RNA, 64 nt, Human
cugccacauuuccuuauugaugcaucuuuucccacccugucacucaacguggucccuagaacaa

SEQ ID NO: 473320 - RNA, 64 nt, Human
caaaaacagccucacagaagaauaugacagcugucccugucaccaagcucacaguuccucgccc

SEQ ID NO: 473321 - RNA, 64 nt, Human
guugagggcuccccaaggcagggcaagauagcggcccugucacugacccuggccuguggugguc

SEQ ID NO: 473322 - RNA, 64 nt, Human
acccugugcccuccguuauaagucccucccccagcccugucaugugccuugggcuccuccugcc

SEQ ID NO: 473323 - RNA, 64 nt, Human
ugaguuuuggagucuuguaugauuaucaguauuccccugucaaaaucaaaucuauucagguuuc

SEQ ID NO: 473324 - RNA, 64 nt, Human
aaacugagaugccuuuuauuccaacguguuugaucccugucacucauuauucuguacuuuuuau

SEQ ID NO: 473325 - RNA, 64 nt, Human
cuuuucaauauugugaggucugaauggaucugaccccugucagaugaaaaugauucacagcucu

SEQ ID NO: 473326 - RNA, 62 nt, Human
ccugcuaggaauuagaagacagacaccaugucccaggacaguguuacuucuucugcaugaug

SEQ ID NO: 473327 - RNA, 52 nt, Human
cuaaagagucaagcaucuaagcccaggacaugagugucuguccagacucagu

SEQ ID NO: 473328 - RNA, 62 nt, Human
aaggcccccacauacccugcaguuuucucuguccaggacagcagguaaaaaggaauccccag

SEQ ID NO: 473329 - RNA, 64 nt, Human
cugacaaacaucaggggacaucuggggaggagaucccugucaugucucuugugccauggagcua

SEQ ID NO: 473330 - RNA, 64 nt, Human
ccuaccuuugagccuuugccuugcaaacuuccaucccugucaugucuucaguuaucucucgagu

SEQ ID NO: 473331 - RNA, 64 nt, Human
ggugugcuuuuuauuucccuuguuucucauuuugcccugucaguggaugguagaugcuuuguau

SEQ ID NO: 473332 - RNA, 63 nt, Human
ugaagaaaacggccccuugaagagcuccccggccccugucacagucagucgucucauuugucc

SEQ ID NO: 473333 - RNA, 64 nt, Human
ccagguugguagcuucuuuggagacuugugauaacccugucaucaagguccugugagaacggga

SEQ ID NO: 473334 - RNA, 64 nt, Human
cacugucuuguacauaggcaucuuauucacugcacccugucacacccagcaccccccgccccgc

SEQ ID NO: 473335 - RNA, 64 nt, Human
aacuuuugagccucaccugcuugaguggcugccgcccugucagcuccagccgccuccagcucag

SEQ ID NO: 473336 - RNA, 64 nt, Human
gguuuaauaauuuaaaaguuauguuuguuaaacacccugucagaacagucauuuucaguauuag

SEQ ID NO: 473337 - RNA, 64 nt, Human
aacuccugaaaucauauagaaaggcuggggugggcccugucauucgugguugauuucaauacac

SEQ ID NO: 473338 - RNA, 64 nt, Human
ugcuacuucugccuagcccuggcggaggugcaggcccugucagcuggaacuggacagaccuugg

SEQ ID NO: 473339 - RNA, 64 nt, Human
ccuggguccuagucccagcucuuccaugggaucccccugucacccugagcaaaucaguugcuuc

SEQ ID NO: 473340 - RNA, 64 nt, Human
uugccuccaguuugggggcuccucucaggguucacccugucaccggggcgugggaccgaccugg

SEQ ID NO: 473341 - RNA, 64 nt, Human
uuuaaguaagccuuguuauaccauugucauggaccccugucauaaagccauuucuugguuuguu

SEQ ID NO: 473342 - RNA, 64 nt, Human
uuccccguggacagagccagagggcaguggcgcucccugucagagcuggaucaggccccccauc

SEQ ID NO: 473343 - RNA, 62 nt, Human
cugccagggggcucugaacuagugccugcuacccaggacacccgggccaugccccuggcugg

SEQ ID NO: 473344 - RNA, 62 nt, Human
guaacuggagcucggagcugcaccgagggcaaccaggacagcugugugugcagaccucaugu

SEQ ID NO: 473345 - RNA, 62 nt, Human; identical to SEQ ID NO: 470846

SEQ ID NO: 473346 - RNA, 64 nt, Human
cgcuucuccgugucccagcagaaggcaugcaggacccugucacuacuauaccugggccucugau

SEQ ID NO: 473347 - RNA, 64 nt, Human
agggggacccggggaggcuggacagggcgcggaacccugucauggaugacaaggcaagggcagc

SEQ ID NO: 473348 - RNA, 64 nt, Human
caauuccacccccugccucuagcaccucuucugucccugucauuccccacacacguccuguuca

SEQ ID NO: 473349 - RNA, 64 nt, Human
gaaguuuugccaaacugaauggucucuuugacagcccugucaaggaauaccaacagaauauuga

SEQ ID NO: 473350 - RNA, 64 nt, Human
aagccucagcuccagugggaccuuguaaaaugcucccugucagagcucuccagaauaugcuugu

SEQ ID NO: 473351 - RNA, 64 nt, Human
uuccgaccuccauucaccucaagccccaacaggccccugucauuccacuucauggaagagacgg

SEQ ID NO: 473352 - RNA, 64 nt, Human
gagaguaccuguucaauagcucauauaucgaguacccugucauacaggaacaaguuaaaggaca

SEQ ID NO: 473353 - RNA, 64 nt, Human
guuuuuaccagccugccugacuucugcaaaccuacccugucaaggagaucaaagggacgcaggu

SEQ ID NO: 473354 - RNA, 64 nt, Human
aaaaugugauauaaacaggaucuaagacuggauucccugucacuaaacugcaccacuauaccug

SEQ ID NO: 473355 - RNA, 64 nt, Human
ccacuuucucucacaggcugcuagaacagcccagcccugucaguguugugaucaugguccaguc

SEQ ID NO: 473356 - RNA, 64 nt, Human
ugaugguucuguugcuaugaacacagcagucggucccugucauuguccacccaggaguggccuu

SEQ ID NO: 473357 - RNA, 64 nt, Human
cugguguucugucugggcucagacauccacauaacccugucacccacagaccgccgucuaacuc

SEQ ID NO: 473358 - RNA, 64 nt, Human
ucuagcucagggaucguaaacgcaccaaucagcacccugucaaaacagaccacuugacucucug

SEQ ID NO: 473359 - RNA, 64 nt, Human
aaagagcuguuccccacccccagggagcuccugucccugucagccuuugcuguccccugucccc

SEQ ID NO: 473360 - RNA, 62 nt, Human
uucugggcagaagucuguuuuuuuucauuuuuccaggacaguuggauauugucaggccacuu

SEQ ID NO: 473361 - RNA, 62 nt, Human
cacaguacagugauccaaggcaggcaaggcagccaggacaggggagcccgaccccagauaau

SEQ ID NO: 473362 - RNA, 62 nt, Human
cugaaggugacaccuagaaccaggggcuugacccaggacaugauggaaugagcaucaaauuu

SEQ ID NO: 473363 - RNA, 64 nt, Human
gcagugucacugugcuagcaauaguuggcuucuccccugucaguggaaaccccacuucugcccg

SEQ ID NO: 473364 - RNA, 64 nt, Human
gagggccugggcuggcccugcuaggcuggagaagcccugucaccugugcacaucuugcuggugg

SEQ ID NO: 473365 - RNA, 64 nt, Human
caugcccaggagggaagaagccauccacagccuucccugucaccggcuccucuguccugccuac

SEQ ID NO: 473366 - RNA, 64 nt, Human
caucccugaggagccaggccgggccgaauccccucccugucaaagcugucacuucgcgugcccu

SEQ ID NO: 473367 - RNA, 64 nt, Human
guucccacucccggccuaggcaccuccccgcucucccugucacgcucauguccuguccuggucc

SEQ ID NO: 473368 - RNA, 64 nt, Human
guucuguuccacucugaccaucggugcaugcagccccugucaccuacccccugcuugcucaauc

SEQ ID NO: 473369 - RNA, 64 nt, Human
cuccuggauguugaugagcaaggaagagcaacggcccugucagcuggcagugguccucacagcc

SEQ ID NO: 473370 - RNA, 64 nt, Human
agggauuacaacacagugguuuccuggucucucucccugucaucaaucaggguaguaacuugac

SEQ ID NO: 473371 - RNA, 64 nt, Human
agauucuuuacccccugggagccccaauucgauccccugucacgugugggcaauguucccccuc

SEQ ID NO: 473372 - RNA, 64 nt, Human
gcuggacccaacuaggccaucaugaguggcuucucccugucauccccaggggucauaggauauc

SEQ ID NO: 473373 - RNA, 64 nt, Human
cuccauuagcuaacauacccucccucuccacaaccccugucacauaccuuucaggaggugacag

SEQ ID NO: 473374 - RNA, 64 nt, Human
caccaugggagguggggccucaaucuaaggccuucccugucagaaggggguuguggcaaaagcc

SEQ ID NO: 473375 - RNA, 64 nt, Human
aucgucuccaauucgaaaacaaccguccugcugucccugucaggacacauggauuuuggcaggg

SEQ ID NO: 473376 - RNA, 64 nt, Human
gcaggaccucagaguccaggccccaaaaccacagcccugucagugcagcccguguggccccuuc

SEQ ID NO: 473377 - RNA, 62 nt, Human; identical to SEQ ID NO: 470863

SEQ ID NO: 473378 - RNA, 62 nt, Human
cccagcagguuuuugccuuagacgugcuggccccaggacagugaugaagacagagccugucu

SEQ ID NO: 473379 - RNA, 62 nt, Human
auaaaaguugugccucaccauacuugaagcucccaggacaaggguugagaggcucaaccccu

SEQ ID NO: 473380 - RNA, 64 nt, Human
ccaaggacaucuaugucguugaugagguucuggccccugucauccucaugcugcucaauuccuu

SEQ ID NO: 473381 - RNA, 64 nt, Human
cagggagcagaaguccuucuggacagugugaugccccugucagacgaugaccaguuuucaccgg

SEQ ID NO: 473382 - RNA, 64 nt, Human
ccagagcucaaggccuucaccugcucuaggccagcccugucaccaccuccacugccaugaccag

SEQ ID NO: 473383 - RNA, 64 nt, Human
cuggcguaagaugauggauuugauucgcccuccucccugucauagagcugcaggguggauuguu

SEQ ID NO: 473384 - RNA, 64 nt, Human
uaugcaacacaagccugucugccacccuggagcgcccugucaccccugcugucguagcuguugg

SEQ ID NO: 473385 - RNA, 64 nt, Human
gaaagcucagggguaggcccaggugggaugcucacccugucacugaggguuuugguuggcaucg

SEQ ID NO: 473386 - RNA, 64 nt, Human
ccaguaaaggagccuccugguccucagugcgugacccugucagugcuuucaggagacauguaag

SEQ ID NO: 473387 - RNA, 54 nt, Human
cccuucaaucugucgccugauggucccugucauucacucgggugcguguguuug

SEQ ID NO: 473388 - RNA, 64 nt, Human
agcaaggaagggaaaccaucagggcugggcucggcccugucagguuuggggccugugugcuucc

SEQ ID NO: 473389 - RNA, 64 nt, Human
caagggggccuuguggcucucagccaugccacaucccugucacacacccagggcauccauuccu

SEQ ID NO: 473390 - RNA, 64 nt, Human
cauugugcuagaucuugggaaaccagaugacucucccugucaaaacuauggcuacgucacugua

SEQ ID NO: 473391 - RNA, 64 nt, Human
aagaugacaagaacuaacgcuccugaguaccagccccugucacaucugacuguggguuucaagu

SEQ ID NO: 473392 - RNA, 64 nt, Human
gccaccuugagucaagccgacuaaggccccucaacccugucacuaagcagcacgugacacuggc

SEQ ID NO: 473393 - RNA, 64 nt, Human
cggagggagagcucaggguggcuuaauccagaggcccugucauggcccgcccccagccauggga

SEQ ID NO: 473394 - RNA, 62 nt, Human
cucugaucgauguagauuccaggaagggguguccaggacaauuaccuuccuucuggagaaac

SEQ ID NO: 473395 - RNA, 62 nt, Human
gcagccaccaggagagauaugccuggcaggggccaggacaaaaugcaaacuuuuuuuuuuuu

SEQ ID NO: 473396 - RNA, 62 nt, Human
cucagcacccccucccuccccaccuggcccucccaggacagcucucgccccccacaaagggg

SEQ ID NO: 473397 - RNA, 64 nt, Human
gcgacuucccugggucuaggggaguguuccuguccccugucaggucagcccugcggagccacuc

SEQ ID NO: 473398 - RNA, 64 nt, Human
aacagagccgacguguccucgcccaggagggcuucccugucagcaauaaccggcauccguuuug

SEQ ID NO: 473399 - RNA, 64 nt, Human
gggaaaccugugcuucccucuccauggcuuaacucccugucagugucggaguguauaagaaugc

SEQ ID NO: 473400 - RNA, 64 nt, Human
ugcaagccuugcuagacagccagguuagccuuugcccugucacccccgaaucaugacccaccca

SEQ ID NO: 473401 - RNA, 64 nt, Human
uaaaggguguaggaaagguuuugucaucacacaacccugucacacaugaauguguaguggagag

SEQ ID NO: 473402 - RNA, 64 nt, Human
gccuguggacacaugaaucacuucuaaccugccucccugucagccuccaggcugccagcuggcu

SEQ ID NO: 473403 - RNA, 64 nt, Human
acuccccauaccccauucucuuuuucaucucggccccugucaaucugguuuuugucacuaugga

SEQ ID NO: 473404 - RNA, 64 nt, Human
guuagagaccaaguaggggccaguuuccaauucacccugucagggagugagccggaucugacgu

SEQ ID NO: 473405 - RNA, 64 nt, Human
accacugcacuccagucugggcaacagugcaagacccugucacuuaaaaaaaaaaaaaaggaaa

SEQ ID NO: 473406 - RNA, 64 nt, Human
ggggcugggcccugggacccagugugccccacagcccugucagcugaggggguagcgcagccca

SEQ ID NO: 473407 - RNA, 64 nt, Human
ugggcucucagggacccccugggucggcuucugucccugucacacccccaaccccagggagggg

SEQ ID NO: 473408 - RNA, 64 nt, Human
cuuaggucucaucucaguggccgcuccugggccacccugucacccaagcuuuccugauugccca

SEQ ID NO: 473409 - RNA, 64 nt, Human
cauggaggcagugggcuggcagcuuccugcugcucccugucagagucaaagcacaaauccucag

SEQ ID NO: 473410 - RNA, 64 nt, Human
agcucccccauaucagcagcccagaguguggguccccugucaggccacagugugaccagcccug

SEQ ID NO: 473411 - RNA, 62 nt, Human
ucuguccucgcacagcgaaccugggcuccugcccaggacaggcaccagggucauggccuggg

SEQ ID NO: 473412 - RNA, 62 nt, Human
agaugagaaccagggaagcugugauccacuggccaggacaagucaacaugggugaggguugg

SEQ ID NO: 473413 - RNA, 62 nt, Human
aguuguguuccugugcaagggggagcuuugcuccaggacaggaugacugucuucccuauucu

SEQ ID NO: 473414 - RNA, 64 nt, Human
ggcggggggaggaggauggugaccuugggagucgcccugucagcacgcacaugcuugggaccca

SEQ ID NO: 473415 - RNA, 64 nt, Human
uaguaaagcuggaaggccaggugcagugucucaccccugucaucccagcacuuugagaggccaa

SEQ ID NO: 473416 - RNA, 64 nt, Human
gaucccggccugaagcgcaaguccccuccugaggcccugucaggguccuuacccccagccacca

SEQ ID NO: 473417 - RNA, 64 nt, Human
ccaucucuuccccgucccccaggcccaggaccgccccugucaguccccccaauuuuguauucug

SEQ ID NO: 473418 - RNA, 64 nt, Human
cccagggccggacuuccagcccccagagcccucucccugucacucccugaaacacuauuaauag

SEQ ID NO: 473419 - RNA, 64 nt, Human
cccacugucguuccccguguguccccagcccggucccugucacauuuguuaaaugaaagaacaa

SEQ ID NO: 473420 - RNA, 64 nt, Human
gauccugagaaagauuuauugugcauuauuugaacccugucaauaucuuuuugaguaauuguuu

SEQ ID NO: 473421 - RNA, 64 nt, Human
uuuuagaauuaaaacaaaauccaaguccucacaccccugucaucccaggagaucuuuccuugug

SEQ ID NO: 473422 - RNA, 64 nt, Human
caucucaggacacuuccguagacuguuuagguuccccugucaaauaucaguuacccacucgguc

SEQ ID NO: 473423 - RNA, 64 nt, Human
auguuugcaggugaauuccucugcuugacauccucccugucacuuuggacccuaugggaguggg

SEQ ID NO: 473424 - RNA, 64 nt, Human
gaugcugccauuugcccagccucuuccaucccagcccugucagugagcccaggucuggugcaac

SEQ ID NO: 473425 - RNA, 64 nt, Human
uucuucccuagccuggugcuucuccucuccuagccccugucaugguguccagacagagcccugu

SEQ ID NO: 473426 - RNA, 64 nt, Human
gaaugccgcccucucuacugucugaaccccuugucccugucaaauaaaccagaacaaaugccca

SEQ ID NO: 473427 - RNA, 64 nt, Human
gaggauacuccagacaguugacaagcaucgcagccccugucaggucaaggaauuuuaaccuggg

SEQ ID NO: 473428 - RNA, 62 nt, Human
cccgcaggcccuuguuauugccucgcuuagauccaggacagagaggaaacaagcuucccacg

SEQ ID NO: 473429 - RNA, 62 nt, Human
gcagccaccagggcagaaaugccgggcacaggccaggacaaaaugcagacuuuuuuuuuuuu

SEQ ID NO: 473430 - RNA, 62 nt, Human
ugcccacaagagccucugccgggggugggaugccaggacacccccucccacacucaggacag

SEQ ID NO: 473431 - RNA, 64 nt, Human
uggugagugugggggcuggugauucccaccuucacccugucauggucucagggaacagccugcu

SEQ ID NO: 473432 - RNA, 64 nt, Human
uguaggcuggggccugacuguaaagcccccgucucccugucaggaggcaucuugguuguaaguc

SEQ ID NO: 473433 - RNA, 64 nt, Human
cugaggcuaaacucugucccuacuucugguuuugcccugucaugucguaacgaggugggccuuu

SEQ ID NO: 473434 - RNA, 64 nt, Human
aacaaaacaucaaauccugcccccgugaagaguucccugucaccucaaguuugaggauaguccu

SEQ ID NO: 473435 - RNA, 64 nt, Human
gggggaugugggauggcagcagccagguauguagcccugucacaggacagcucacugugguuuu

SEQ ID NO: 473436 - RNA, 64 nt, Human
gaaugccacccuccccagugucugaacucccugucccugucaaauaaaccagaacaaaugccca

SEQ ID NO: 473437 - RNA, 64 nt, Human
aauauauauguagccagacaguuuaugagaaugacccugucaagcuucauuauuacguggcaaa

SEQ ID NO: 473438 - RNA, 64 nt, Human
acgugaaugcccggcaccuccucuaccccaacugcccugucacgcgcuuccccgugcccaacga

SEQ ID NO: 473439 - RNA, 64 nt, Human
cugaggagcagacucccagcaugguguagcguggcccugucaugcacauggggucccgcagcag

SEQ ID NO: 473440 - RNA, 64 nt, Human
uucagcuucccucgcuccuguuguuaagaagcgucccugucagcacaggugugcauugaggaag

SEQ ID NO: 473441 - RNA, 64 nt, Human
cucacugcuaugaaccagccccacagccccaggccccugucaccuggcuaugcccacucauccc

SEQ ID NO: 473442 - RNA, 64 nt, Human
uucuccuauagcaggccuggcccccucagugucucccugucaauuucuaccccuuguagcaguc

SEQ ID NO: 473443 - RNA, 63 nt, Human
cgggaagacaccgacaaugagaagaguuggucacccugucaccacugaaccuugauuuaacag

SEQ ID NO: 473444 - RNA, 64 nt, Human
cuuggccugacccagccagguggccuuauuucuucccugucaccuccccuccuugaaaucuggg

SEQ ID NO: 473445 - RNA, 62 nt, Human
guuccaugccuggcccagccccaccucagucuccaggacauuccuuucccagcuccagccug

SEQ ID NO: 473446 - RNA, 62 nt, Human
gggaaaaggcugugggccguuaggaccauccuccaggacaggugaccucuaugaggucaccu

SEQ ID NO: 473447 - RNA, 62 nt, Human
aggcagaaagagccaggagaaagcugauggagccaggacagagaucugguuccagcuuucag

SEQ ID NO: 473448 - RNA, 64 nt, Human
agugggguccuaagaagaagggucccaccucaaccccugucaguguccacuguggggugggggc

SEQ ID NO: 473449 - RNA, 64 nt, Human
guguguguguggugcaggagugccacccccagggcccugucaaccucucuuuucuccuccaugg

SEQ ID NO: 473450 - RNA, 64 nt, Human
gcuuggaaggcuggagcuucggaccaaggcccagcccugucaccuccucuucaugugaugugga

SEQ ID NO: 473451 - RNA, 64 nt, Human
cagcggcugaugcucagucacuccugcuucuacccccugucacugauggcgagccuugcccagc

SEQ ID NO: 473452 - RNA, 64 nt, Human
ccgaguacuguaauguucacacuuguacaaucuucccugucaugacuuuaaguucuacuuuuca

SEQ ID NO: 473453 - RNA, 64 nt, Human
aguuggaaacacuaaauguuaaagauguagcaaacccugucaaacauuaguacuuuauagaaga

SEQ ID NO: 473454 - RNA, 64 nt, Human
aagaauccuugauucagcguuccaaguuccccaucccugucauuuuuaacagcaugcugcuuug

SEQ ID NO: 473455 - RNA, 64 nt, Human
cuuuggauguuuuccccaauuauccuccuucacucccugucauaguuaccgauggugucccguu

SEQ ID NO: 473456 - RNA, 64 nt, Human
ucagcacuacagcauaccccucuacaacauacagcccugucacauugagaucauaaucccuccu

SEQ ID NO: 473457 - RNA, 64 nt, Human
uuuuuuuugugugucuguaacugagcuccuccaccccugucauucacuuccaauuuuacccaau

SEQ ID NO: 473458 - RNA, 64 nt, Human
uccugguaagaggagugcguggcccaccaggccccccugucacccaugacaguucauucagggc

SEQ ID NO: 473459 - RNA, 64 nt, Human
uggaagacucagaaguuuuguguggccuauuucucccugucagguugcacagaugcauguagag

SEQ ID NO: 473460 - RNA, 64 nt, Human
uacuucaauuuuuguuuguuuuuuguuuuuuugucccugucauaaaauauuuuggugcuucaaa

SEQ ID NO: 473461 - RNA, 62 nt, Human
gcaagacuaggaucagggacagaucuggaggcccaggacauggcugagagguggucagcagg

SEQ ID NO: 473462 - RNA, 62 nt, Human
guucucuuucuucucucugggaaaaugaacguccaggacacaccuguaucccagagagcaaa

SEQ ID NO: 473463 - RNA, 62 nt, Human
uaugggagaggaaaagcguaucugaaaaugguccaggacaggaggaugaaaugagaucccag

SEQ ID NO: 473464 - RNA, 64 nt, Human
ggagauugcugcugcuuucugagcccgcaccugugcgccuaaacugcugauuggccucaacugc

SEQ ID NO: 473465 - RNA, 64 nt, Human
aaagagagacacagcugcagaggccaccuggauugcgccuaauguguuugagcaucacuuagga

SEQ ID NO: 473466 - RNA, 64 nt, Human
agaagaagcuuugccgcuuuugugccucucacaggcgccuaaagucauugccaugggaggaaga

SEQ ID NO: 473467 - RNA, 64 nt, Human
uaaaauuuaguggacagguaugaaaaguguaauugcgccuaacuaccagauggagagcuucaga

SEQ ID NO: 473468 - RNA, 64 nt, Human
ccccggccccuuuucgcccccugccugccauacugcgccuaacucgguauuaauccaaagcuua

SEQ ID NO: 473469 - RNA, 64 nt, Human
uugcuuugguguuugccgcagcauggaaaacagggcgccuaaggcugggagcuggaagaagggg

SEQ ID NO: 473470 - RNA, 64 nt, Human
uggggucugccagccagcccuccuccccgacccagcgccuaagcucacagagugucgucgccca

SEQ ID NO: 473471 - RNA, 64 nt, Human
uaaaaauacaaaaauuagccgggcaugguggcgggcgccuaaaaucccagcuacucgggagacu

SEQ ID NO: 473472 - RNA, 64 nt, Human
uagcucucuacccaagcuguuacucccucauggggcgccuaaggagacucaaguggacccauca

SEQ ID NO: 473473 - RNA, 62 nt, Human
uauuaccgcauggaguugcuggccaaagaauuccaggacaagacugcccccaggcugcagaa

SEQ ID NO: 473474 - RNA, 62 nt, Human
guucagggaggcagcucauuuccaccccggccccaggacacccagccugugccccacaagga

SEQ ID NO: 473475 - RNA, 62 nt, Human
auuaauaaaaauccuuaaaucacuuuuguaauccaggacaagaaaauguggcauuagaguag

SEQ ID NO: 473476 - RNA, 64 nt, Human
ucuuaugcugggcucccuggcagcagguaguggcagccucuauggcuucuuuggggaacccaca

SEQ ID NO: 473477 - RNA, 64 nt, Human
aggcacuuuguuucucccaaguaggccaccaggcagccucuagaguugcuuuacccaaauccuu

SEQ ID NO: 473478 - RNA, 64 nt, Human
uucucagggaauccgacaccagccaaccauuuuaagccucuaaaagaccucgggcaagucucac

SEQ ID NO: 473479 - RNA, 64 nt, Human
cagcauuugcaaauguccauagggagcagguggcagccucuacucccagcaacaaguuuguguu

SEQ ID NO: 473480 - RNA, 64 nt, Human
ccauugguggguggauggguggggggcauuccagagccucuaagguagccaguucuguugccca

SEQ ID NO: 473481 - RNA, 64 nt, Human
caaguagggggaauaucucccccuuuucccucauagccucuagggagggagagugacuucauuc

SEQ ID NO: 473482 - RNA, 64 nt, Human
uaugaguggaaggugauggagagccugauccugaagccucuacuugaugagagacagaguuuug

SEQ ID NO: 473483 - RNA, 64 nt, Human
auuuuugcaucuucccauugucgaauuagucuccagccucuaaauaaugcccagucuucucccc

SEQ ID NO: 473484 - RNA, 64 nt, Human
ggauguggaugacuucccuucaugccuaucaggaagccucuaaaaugggguguaggaucuggcc

SEQ ID NO: 473485 - RNA, 64 nt, Human
cccaaugaccccaaucccaaccucaggugagcagagccucuacuugagggacuauuguuacuau

SEQ ID NO: 473486 - RNA, 64 nt, Human
guuucagcugggggcucucaccagcccuccuuucagccucuacaacagagcagcuucccagacu

SEQ ID NO: 473487 - RNA, 64 nt, Human
caucagaugcuggccccuuggucuugaauuuccuagccucuacaacuaagccaaauaaauuucu

SEQ ID NO: 473488 - RNA, 64 nt, Human
ccagaggggcguggcacacucgcuuguguggaaaagccucuaaaugcaucccuuccuuucuuuc

SEQ ID NO: 473489 - RNA, 64 nt, Human
aauagugcuucacccugaccucucacuccaggacagccucuaagggauuugaucugcucaucuu

SEQ ID NO: 473490 - RNA, 64 nt, Human
uaaaauggacuuccauaguauugacuguagaaggagccucuacaauauugacuauauauuuuua

SEQ ID NO: 473491 - RNA, 62 nt, Human
ucacugcucccugaagccagccuucuuccaucccaggacaccacacccagccucaguccucc

SEQ ID NO: 473492 - RNA, 62 nt, Human
aucaguagagugaggugauccuuagcaacgugccaggacacuuccugugugccugcaguugu

SEQ ID NO: 473493 - RNA, 62 nt, Human
gaacaaacauuagcuauuuuaugcugcaagaaccaggacacacaauucgccaaucaucccac

SEQ ID NO: 473494 - RNA, 64 nt, Human
augccugggaugcccuuuauuccaggaggcaucaagccucuaaagaaugucucaccuccucugc

SEQ ID NO: 473495 - RNA, 64 nt, Human
acggaguuagcucccaggcuccuaucucugccugagccucuauucuuauauuaucagagaaagg

SEQ ID NO: 473496 - RNA, 64 nt, Human
gaggacagaccauauacugcacuguguuugcaugagccucuaccaccuuccucuaucuaccaga

SEQ ID NO: 473497 - RNA, 64 nt, Human
uccagcuugcugacugcagaucuugagauaugucagccucuacagucacaagagcuaauucauu

SEQ ID NO: 473498 - RNA, 64 nt, Human
uuccccugcugucuauucuaagcccccagacucaagccucuagacucuuggaugaaacagugag

SEQ ID NO: 473499 - RNA, 64 nt, Human
uggguaccucagucacacacccccaaccccaggcagccucuagagccuucuugcuuucauuuuc

SEQ ID NO: 473500 - RNA, 64 nt, Human
guugcuuugcuacuuuaagugguauugcgugccaagccucuauuauacaaaccaugcagacucg

SEQ ID NO: 473501 - RNA, 64 nt, Human
auugacugagugcaguauuagauuucaugggagcagccucuaauuagacaacuuaagcaacguu

SEQ ID NO: 473502 - RNA, 64 nt, Human
ccaccucagaucucuauuauuaggcuagauguauagccucuacucccccagcuucuugcucuug

SEQ ID NO: 473503 - RNA, 64 nt, Human
auucucuguaaaugcuuauuuuaucauagucuuuagccucuacuaugaguaaaauguucucuuc

SEQ ID NO: 473504 - RNA, 64 nt, Human
uucagcugcuaguaucagaaccacaugaaguuauagccucuaaagccugugguauuuuauauaa

SEQ ID NO: 473505 - RNA, 64 nt, Human
caggacgguguucaucgcauucucuucugugaccagccucuaggcuagcggcugcauucguggu

SEQ ID NO: 473506 - RNA, 64 nt, Human
gcuagaguggaguggcaugaacacaacgcacugcagccucuaccuccugggcucaagcaguccu

SEQ ID NO: 473507 - RNA, 64 nt, Human
uuucuaccaugagaccucuugcuacagcauacaaagccucuacuagugauuaucagguauuuua

SEQ ID NO: 473508 - RNA, 64 nt, Human
ucaugaucuggccucugcccccuucucuagccacagccucuaguacacuuuagcaauaccacca

SEQ ID NO: 473509 - RNA, 62 nt, Human
ucuuggaaguugguauggaccagaaagcauucccaggacauuuaggcuauggcugaguucuc

SEQ ID NO: 473510 - RNA, 62 nt, Human
agaaaaguguuaaaauuuuuaaaauauguuuuccaggacacuucacuuccaagucagguagg

SEQ ID NO: 473511 - RNA, 62 nt, Human
auagcagcaccacuuuggauugauuuugcucuccaggacaucagcacauggcccugaucagc

SEQ ID NO: 473512 - RNA, 64 nt, Human
uggcuacccggucacggaggccggccaccugcagagccucuacacagguagugccccgaggggc

SEQ ID NO: 473513 - RNA, 64 nt, Human
ugcgccucguggaaaauuaccuugguacaaugguagccucuaaauagacugccucgcaagcuau

SEQ ID NO: 473514 - RNA, 64 nt, Human
gaucgagaccauccuggcuaacacggugaaacccagccucuacuaaaaauacaaaaaaaaaaaa

SEQ ID NO: 473515 - RNA, 57 nt, Human
ugagaaagaaugcagugugacaguggcagccucuagcccucagcuucccacggaauc

SEQ ID NO: 473516 - RNA, 64 nt, Human
gauauccuaauagaaauugauguuacuaacaauuagccucuagggcuuuaaaagucaagaugaa

SEQ ID NO: 473517 - RNA, 64 nt, Human
cagacuagauuucaagcuaauuuucuuuuucugaagccucuaacaaaugaucuaguucagaagg

SEQ ID NO: 473518 - RNA, 64 nt, Human
auaccucucuauuccuugcucaaauuauugcaaaagccucuauagaaaguccucugugaucuga

SEQ ID NO: 473519 - RNA, 64 nt, Human
cuuucccuuaauggccaugugauguuauuaagucagccucuaaagcuuuaguuuccugucaguc

SEQ ID NO: 473520 - RNA, 64 nt, Human
cucuagcaccugggucccagcaucuagagcauggagccucuagaagccaugcucacccgcccac

SEQ ID NO: 473521 - RNA, 64 nt, Human
guagaacugauauuuuucauuuauaugaaguauaagccucuacugggucuauauugugaaucau

SEQ ID NO: 473522 - RNA, 64 nt, Human
uuccugguuuuuguuugguuuucguuuugcuuuuagccucuacaugcuaggaucacaggaagac

SEQ ID NO: 473523 - RNA, 64 nt, Human
cugcagugggcugcccuguacccugaaccucaugagccucuaagggaaaggaggaacaauuagg

SEQ ID NO: 473524 - RNA, 64 nt, Human
cagauuauuuugucucucauuauuaauuugaaagagccucuaaacuuuugagaaaucaaugugu

SEQ ID NO: 473525 - RNA, 64 nt, Human
agaagaaggaacgaugacaggucgcaugaagaucagccucuaguacugaugaucuuuacuuaug

SEQ ID NO: 473526 - RNA, 64 nt, Human
uuuuuacaauacccugagacuuuucagguguuggagccucuaaaauaugagauauaaacagaaa

SEQ ID NO: 473527 - RNA, 62 nt, Human
cuuuaauaagcucagcuugagcauuaccauuuccaggacacuuuccaugaauuguugagaag

SEQ ID NO: 473528 - RNA, 62 nt, Human
aaagaaggccguguuuccaacauccucucaucccaggacauuuggggcaagugaguuagggg

SEQ ID NO: 473529 - RNA, 56 nt, Human
cugccguggcccuagaauaguggaguccaggacaggagaugcugugccccuggccu

SEQ ID NO: 473530 - RNA, 64 nt, Human
uuuagagucugacaacauauucaaaauauuuuucagccucuacugauaguggauaacaaauaua

SEQ ID NO: 473531 - RNA, 64 nt, Human
uuugaauagaauacauuauaccucauaggugucuagccucuacaguucuggcuguaguuaugac

SEQ ID NO: 473532 - RNA, 64 nt, Human
gggagagggaaggaggaagucaguuauuugaguaagccucuaguugacuuuucucuuagccuga

SEQ ID NO: 473533 - RNA, 64 nt, Human
cauggauaaagagccccauuauuuucacagugccagccucuaccuaaggaaacccuagaccuug

SEQ ID NO: 473534 - RNA, 64 nt, Human
aggaccaaauuacagauaaacuaguuagcuucacagccucuauggcuacaugguucuucuggcc

SEQ ID NO: 473535 - RNA, 64 nt, Human
gcagcugccacuggugcaaggccuuaccagcccuagccucuagcacuucucuaagugccaaaaa

SEQ ID NO: 473536 - RNA, 64 nt, Human
aggaacccaguugaauaggauccaaucccugguuagccucuacacaauaauagggagacaagga

SEQ ID NO: 473537 - RNA, 64 nt, Human
accauuugggcuaucagagguaccccugggcaggagccucuacauccccuucccccuccucucu

SEQ ID NO: 473538 - RNA, 64 nt, Human
uuccuauuagacuucuugaaaaacauucucacauagccucuauguaaucagacaaaugacauuu

SEQ ID NO: 473539 - RNA, 64 nt, Human
cagauagugcaauggcgcaauccuggcucacugcagccucuaauuccugggcucaagucaagug

SEQ ID NO: 473540 - RNA, 64 nt, Human
gcuggagugcaguggugugaucucggcucacugcagccucuaacucccagguucaagcuauucu

SEQ ID NO: 473541 - RNA, 64 nt, Human
ggguggagccagagaaggaaggcagucccagaugagccucuauuuucaucagcuucuucucucu

SEQ ID NO: 473542 - RNA, 64 nt, Human
ccucugcgugccacaggccuccgagggguugugcagccucuagggcuguugcguccccgucuuu

SEQ ID NO: 473543 - RNA, 64 nt, Human
ccuaaccaaaugagaauaaugacauauugaaaacagccucuagcuucaggcugggcacgguggc

SEQ ID NO: 473544 - RNA, 64 nt, Human
aucuucacccucuggagagaagauguuuuaccaaagccucuaguguaccuuccuccucuuacuc

SEQ ID NO: 473545 - RNA, 62 nt, Human
accugcuggggacgguggcccugccuucaugcccaggacaccagcuggguccagcuagcagc

SEQ ID NO: 473546 - RNA, 62 nt, Human
ccccagcggugacgggagguguccuggcugcuccaggacaaaagacaaucgucucugugggu

SEQ ID NO: 473547 - RNA, 62 nt, Human
ggagggcaaggcucuccucccagccagggacgccaggacauagcugcuccuggucaguggag

SEQ ID NO: 473548 - RNA, 64 nt, Human
acagccugggccucggcgucaaucaucgauaagaagccucuacagcaccccugcccccuaauuu

SEQ ID NO: 473549 - RNA, 64 nt, Human
cagcccagcuggccaccuagaagucucccugcacagccucuaguguccggggaccuugugggac

SEQ ID NO: 473550 - RNA, 64 nt, Human
ggaagauggggaccagcagccccacaccagggccagccucuagagcagacuacagcuggggugc

SEQ ID NO: 473551 - RNA, 64 nt, Human
uccagcuccugggcucaagugauccucuagacucagccucuagaauagcugggacuacaggcac

SEQ ID NO: 473552 - RNA, 64 nt, Human
gugacagucacuagauccucacaugcugagaaacagccucuacucucucugccccuuuuacuuu

SEQ ID NO: 473553 - RNA, 64 nt, Human
uauuuccagcaugcuaaaucccuacccacguuccagccucuaggugagucagugcgucacucug

SEQ ID NO: 473554 - RNA, 64 nt, Human
uuguuguugaucccauuucuaacuuggaauugugagccucuauguuuucuguuaggugagugug

SEQ ID NO: 473555 - RNA, 64 nt, Human
cugccucccacccacugacucagggcucagacucagccucuauuguccagagcacuggcuuggc

SEQ ID NO: 473556 - RNA, 64 nt, Human
cuuugauaaugaacagugagagauuuuuaaauaaagccucuaaauauguuuugucauuuaauaa

SEQ ID NO: 473557 - RNA, 64 nt, Human
gaauagaagaaagagaaguguuuuuuuaauugagagccucuaugugcaaggugauauauaauca

SEQ ID NO: 473558 - RNA, 64 nt, Human
auauacugugucaaaaugauaauuuuguuauguuagccucuagaaaauuuaaguucagaaaaau

SEQ ID NO: 473559 - RNA, 64 nt, Human
gauuuuuacacacacaauccagaacuuauuauauagccucuaagucuuuauucuucacaguaga

SEQ ID NO: 473560 - RNA, 64 nt, Human
cugcacaaugaggcuguugaaaggaaaaaaagugagccucuaggaauuauucaaaaaaagucug

SEQ ID NO: 473561 - RNA, 64 nt, Human
aagcaggaaaaauuaacuacuuucauucagagauagccucuaucaauaguuugacauuuuuccc

SEQ ID NO: 473562 - RNA, 64 nt, Human
gauguauauacucccacagcucgcaugaaggaacagccucuauugauacuugguuguaaaguga

SEQ ID NO: 473563 - RNA, 62 nt, Human
cucaucacuaaacagaguaaaaucuuggaaagccaggacacaacgcugcugccugcuuugug

SEQ ID NO: 473564 - RNA, 62 nt, Human
aaguucuccaaacccauuuauuacuggcuugaccaggacaaauccuuucagugacaggacug

SEQ ID NO: 473565 - RNA, 62 nt, Human
agcaucaucaugggcuggggugguggcugcccccaggacaugcaggauuucugcagggggca

SEQ ID NO: 473566 - RNA, 64 nt, Human
gaucuaugcuuuaaaccggcaagguuauagauacagccucuagcucuucagaucuguacaugca

SEQ ID NO: 473567 - RNA, 64 nt, Human
gggagccagggcagggguggcugaccccaugcucagccucuaggggacggcaggccaucaggcu

SEQ ID NO: 473568 - RNA, 64 nt, Human
uugcccaguuuugaucccuucaagacuuugucacagccucuaucacacaucuguuuuucucgaa

SEQ ID NO: 473569 - RNA, 64 nt, Human
uaaaugaaaaagaccuaaaaacagaaccaaagacagccucuagauuucuuacccucaagucucc

SEQ ID NO: 473570 - RNA, 64 nt, Human
auaguuguaaaagcugaugaaccugaaauuguguagccucuacaggcugcugagguucuaaaua

SEQ ID NO: 473571 - RNA, 64 nt, Human
ucguaccaucuagaacuauacuguccaguaccauagccucuagccguauguagcuauuuguauu

SEQ ID NO: 473572 - RNA, 64 nt, Human
agcagcacaaacauugcugccuuuguccccacacagccucuaagcgugcugacaucagauuguu

SEQ ID NO: 473573 - RNA, 64 nt, Human
aauguaaagaauuguagucucaguuaaaagggguagccucuacuccagccaacauuuuaaaauu

SEQ ID NO: 473574 - RNA, 64 nt, Human
uccccucuacuuuuagccuuccacccaaacuggaagccucuaggugcuaucaauuauuuauauc

SEQ ID NO: 473575 - RNA, 64 nt, Human
aaauuucaggaaccaaggacugccagaaaauauuagccucuacauuacgcaugcauuuagaagc

SEQ ID NO: 473576 - RNA, 64 nt, Human
uuuuuaaagugucuuucuucaaguuucuucaagaagccucuauuguuccccagauaauguuccc

SEQ ID NO: 473577 - RNA, 64 nt, Human
cggccucuaaaguuuggucccagcagcccuucccagccucuaaaguuuggucugguaugaaaug

SEQ ID NO: 473578 - RNA, 64 nt, Human
acuugugcacuguuguaaagcugaaaaaccguuaagccucuacgauuuuuaaguaaguugggga

SEQ ID NO: 473579 - RNA, 64 nt, Human
uccuccaaguccuaccacacaaaggaaagucucaagccucuauucaccccuucucaauccucac

SEQ ID NO: 473580 - RNA, 64 nt, Human
cacugguuaaauaaaaaacuaaauuaauaacuggagccucuaaauuuauuauccauuauccagu

SEQ ID NO: 473581 - RNA, 62 nt, Human
augacuuauaaagcagcaacagcugaggcgcaccaggacacagcuuccauuucuuuaacguc

SEQ ID NO: 473582 - RNA, 62 nt, Human
gcugcuccugucacccuccacgauuccacagaccaggacauuccaugugccucauggcacug

SEQ ID NO: 473583 - RNA, 62 nt, Human
gggaacagauggcugaggcugcagacucaggcccaggacacucaaccccaggaggggagccg

SEQ ID NO: 473584 - RNA, 64 nt, Human
guguggaugggauagcccugggauggaaaggacuagccucuacugaugcaaaaaaacaaaaagc

SEQ ID NO: 473585 - RNA, 64 nt, Human
ugacuccugccacuagguuucaccucccaaacccagccucuagaacagccagacccugcagauc

SEQ ID NO: 473586 - RNA, 64 nt, Human
uguggaugcccugcccuguauccacuugggagagagccucuacaacaugcuggcaacuuccccc

SEQ ID NO: 473587 - RNA, 64 nt, Human
cccuuaggccacaugggagcaguccaugcaugacagccucuauccuacaaggccuaugaguaug

SEQ ID NO: 473588 - RNA, 64 nt, Human
aaggucuuaguccagcucugugaucugaaggcaaagccucuaugugugaaacacagggguaccu

SEQ ID NO: 473589 - RNA, 64 nt, Human
uggaccaagcugcaaugcaguauugacuugacagagccucuacuucugucucaaaauggcucca

SEQ ID NO: 473590 - RNA, 64 nt, Human
uuauuguuugaaugauuccggcuuguaauauaucagccucuacaaugaaaugcagaagaguuca

SEQ ID NO: 473591 - RNA, 64 nt, Human
gaaacuguuggugcacauuaucuacauuuuccucagccucuaucugaaggacaaaacucauuuu

SEQ ID NO: 473592 - RNA, 64 nt, Human
aagaauaagccugccuuagggcuggcaacaucuaagccucuaacagcacagggaagcaaauauc

SEQ ID NO: 473593 - RNA, 64 nt, Human
uuuauauauccuauuuuuuauguaguguaugcguagccucuaucucguauuuuuuucuauuucu

SEQ ID NO: 473594 - RNA, 64 nt, Human
auuuauaaaugaacauacuaaaauagucauguauagccucuagcauuuuaaauuauuuuuauuu

SEQ ID NO: 473595 - RNA, 64 nt, Human
ugauuuuacaaguauaacaguuuugaguaauucaagccucuaaacagacaggaauuuagaaaaa

SEQ ID NO: 473596 - RNA, 64 nt, Human
gaggcacgggauaaggggccagggucagagguccagccucuauacccgugccccaacgucagcc

SEQ ID NO: 473597 - RNA, 64 nt, Human
cuugugaaugguaguugaggucuucauacaguucagccucuagaaugguaacaaaucagccaau

SEQ ID NO: 473598 - RNA, 64 nt, Human
acagcagccugcagauaacacuuggggggaccucagccucuauucgcaacucauaauccguaga

SEQ ID NO: 473599 - RNA, 62 nt, Human
gcacuuugcaaacauccuggccaccaugggcaccaggacacagggauggauaccaccuaccc

SEQ ID NO: 473600 - RNA, 62 nt, Human
uucaccuaaaaugacacugaguugggcaaaacccaggacaucuccuggcuaagccucugcuu

SEQ ID NO: 473601 - RNA, 62 nt, Human
gaggcaucagcugcuagacagugucugccuuuccaggacauucuucuugguauuccuuaccu

SEQ ID NO: 473602 - RNA, 64 nt, Human
uacuuccuaaggugaaaugcaucuauauacagacagccucuaaaucaaguccuucaguauaauu

SEQ ID NO: 473603 - RNA, 64 nt, Human
uggcaccacaugcccgguguggccgagggcacacagccucuauagcaggccuuccuguggaagg

SEQ ID NO: 473604 - RNA, 64 nt, Human
aaauacccaaagauaauagugcauagcuccuuucagccucuagccuucacuccugggcuccaaa

SEQ ID NO: 473605 - RNA, 64 nt, Human
gccacuccaggacaagguucaaaaugguuacaacagccucuaccugucgccccagggagaaagg

SEQ ID NO: 473606 - RNA, 64 nt, Human
gccuuuucaacagagaaggcucccacuugagagcagccucuaccugacccccuggaccacagag

SEQ ID NO: 473607 - RNA, 64 nt, Human
cagcagccucagccucugccuguccagcgccaacagccucuaugacgacaucgagugcuuccuu

SEQ ID NO: 473608 - RNA, 64 nt, Human
agugccgcucugcgugugcgugugcgcgugugugagccucuacacauauauauacguacagagc

SEQ ID NO: 473609 - RNA, 58 nt, Human
cgagaagcagucugguguagagauggacagccucuacuuccaucagauauauguggcu

SEQ ID NO: 473610 - RNA, 64 nt, Human
ucucgccuuguuaugcacaagagauucuauuaaaagccucuagaaguaacuccccuuaaaaugu

SEQ ID NO: 473611 - RNA, 64 nt, Human
cucugcuguuauccugccccaagggccugggccgagccucuaccugaagcaacucugcucuucc

SEQ ID NO: 473612 - RNA, 64 nt, Human
cuagucuucucaagcaaugaggaugacuacaagcagccucuaacuggaucuuaaggacuaaagc

SEQ ID NO: 473613 - RNA, 64 nt, Human
uucccagcuccuugucuggggagccuuggcucugagccucuagcaugguucaguccuugaaagu

SEQ ID NO: 473614 - RNA, 60 nt, Human
ccgaacagucauugaucuagcagcaguucuagccucuaaagauaguaaggaagccugcag

SEQ ID NO: 473615 - RNA, 64 nt, Human
agagcauucaguaggacauggugaucccuauuucagccucuaagaugacugguauucuaucuga

SEQ ID NO: 473616 - RNA, 64 nt, Human
cccaaaaacuaaaugugaaaucccuaccauuucuagccucuauugcccagauuggagucagagg

SEQ ID NO: 473617 - RNA, 62 nt, Human
gggcaggcucauuucugcccccaacccgggccccaggacaggucagcgcgcccugccccggu

SEQ ID NO: 473618 - RNA, 62 nt, Human
ccccugggacgguaagaccgguaggcguggggccaggacagccagccagcccagcgcccgcu

SEQ ID NO: 473619 - RNA, 62 nt, Human
aaucuaaaccucuuuuauagggggauguuuuuccaggacaagugaagagaaaauauuaaaac

SEQ ID NO: 473620 - RNA, 64 nt, Human
ccccucauaauuacuaauagcuggaacuggcagcagccucuacugggcuuuuacugugaugugu

SEQ ID NO: 473621 - RNA, 64 nt, Human
uucugaaaucucuuacucagguaaggccucgccaagccucuaugcaccccacaaaguuucugcc

SEQ ID NO: 473622 - RNA, 64 nt, Human
aagggggcuucacucucuagaucagccugcuaggagccucuaccagcaucauccuggggcccag

SEQ ID NO: 473623 - RNA, 64 nt, Human
aaucaggagacuugagaacuacgaggaacauggcagccucuagcucauacuugucguuguacaa

SEQ ID NO: 473624 - RNA, 64 nt, Human
uggauagaaagccugagcccauuggaucugugaaagccucuagcuucacuggugcagaaaauuu

SEQ ID NO: 473625 - RNA, 64 nt, Human
agggacuuaagcuagacucaagaaagcagcuuggagccucuagguugagaagagaggcaaaacc

SEQ ID NO: 473626 - RNA, 64 nt, Human
ugcugcuuagcugaucccgcccugacccagaggaagccucuauuuauuuauuagcuuuuguuua

SEQ ID NO: 473627 - RNA, 64 nt, Human
gcauugucaccguggguggccacucaaggguccaagccucuagggccauccuugggcuaacaac

SEQ ID NO: 473628 - RNA, 64 nt, Human
caccacccugugagcacucuacuggcugucccugagccucuaguuccucacucuuccuuuucag

SEQ ID NO: 473629 - RNA, 64 nt, Human
uugcaguuuuuuccuugaaggacaaccgaaccauagccucuaaaguucaagugcacugaggugu

SEQ ID NO: 473630 - RNA, 64 nt, Human
cagggugaauuucuuucacuuaaguuggaaaaccagccucuaaaaaauuaggugcugguaauga

SEQ ID NO: 473631 - RNA, 64 nt, Human
gcuggagugcagugaugcaaucuuggcucacugcagccucuaccucccagguucaagugauuau

SEQ ID NO: 473632 - RNA, 64 nt, Human
guuauagguugauuuccuaaguguggcugaugguagccucuaguuugaagugagggaagaauga

SEQ ID NO: 473633 - RNA, 64 nt, Human
gcuugagacauagggaugggacaggggcaaugacagccucuaacauggccacuucucagcacgu

SEQ ID NO: 473634 - RNA, 64 nt, Human
uaaaaagaaagcuaaaagcauacuucuaagucagagccucuauuuugguguaagacuugggaua

SEQ ID NO: 473635 - RNA, 62 nt, Human
gaggcuggcccagagcugucaggaccaugaagccaggacagaggccaggagccagcccugca

SEQ ID NO: 473636 - RNA, 62 nt, Human
gggccagggcuaccccagaacuuuuaacucuuccaggacagggagcuucgggcccccacucu

SEQ ID NO: 473637 - RNA, 62 nt, Human
aacaccauaacuagagacacucaaauugccaaccaggacaagaaguugaugacuucaugcug

SEQ ID NO: 473638 - RNA, 64 nt, Human
ccuucucucuccagugcugcccgcugugucuagcagccucuaggaucuugucagagcugcaccu

SEQ ID NO: 473639 - RNA, 64 nt, Human
ccguggccccugcuggggcagcccguguugccggagccucuaagccaaagagcccguuggccgu

SEQ ID NO: 473640 - RNA, 64 nt, Human
acucagaaguccaaaguucauucuucuuuaaaguagccucuauaacucuguuuauuuuauaaau

SEQ ID NO: 473641 - RNA, 64 nt, Human
cuacccugauuuuuuucuuuucauggguaucugaagccucuaaguuuuuucaaaaauggaguau

SEQ ID NO: 473642 - RNA, 64 nt, Human
aauuccggucuucacauauucuaaaaaauuuuaaagccucuaaguauaaaaucagugaguugaa

SEQ ID NO: 473643 - RNA, 64 nt, Human
ccaacugcagaccaacuaccccuccucagacaacagccucuacaccaacgccaagggcagcacc

SEQ ID NO: 473644 - RNA, 64 nt, Human
ccuugcaugagggugaggaaggagaagcccagccagccucuacccaucccucccucccaauuag

SEQ ID NO: 473645 - RNA, 64 nt, Human
uauauuuuauaaucagaauauguugcuuugaaaaagccucuaauggacugaccuuaaaacucau

SEQ ID NO: 473646 - RNA, 64 nt, Human
uuuuccaggaaaauauauugaaaucaugcugcugagccucuauuuucuuucuuugauguuuuga

SEQ ID NO: 473647 - RNA, 64 nt, Human
ccagccggccuucucuggggccuccccgucgucaagccucuauccugucuguccccaccccagc

SEQ ID NO: 473648 - RNA, 64 nt, Human
ucauucuaagggugccaagagacugguuagucaaagccucuagaaggggauccucguugaaagg

SEQ ID NO: 473649 - RNA, 64 nt, Human
caaaaucagccagcacuuugaucacggacuucccagccucuaggacugugagcaauaaauguuu

SEQ ID NO: 473650 - RNA, 64 nt, Human
uggaguguagggucacugggagagcagaggucacagccucuagagaagggagaggggcgugugc

SEQ ID NO: 473651 - RNA, 64 nt, Human
uucccguucacucugcccccacccccaaaggcucagccucuaaaucucagacuccaccaccucu

SEQ ID NO: 473652 - RNA, 64 nt, Human
agagaaagcagaagaggccgaggagugaggcagcagccucuaugcugugauuuccacaccgggu

SEQ ID NO: 473653 - RNA, 62 nt, Human
guccccagaagauggcggcuagggccucgccgccaggacagagaagggacgggguggcuggg

SEQ ID NO: 473654 - RNA, 62 nt, Human
ucacugagccucaauuuccucaucugggucucccaggacacaucacauacccacccuuacuu

SEQ ID NO: 473655 - RNA, 62 nt, Human
auccacccugacuaugaugccgccagccaugaccaggacaucaugcuguugcgccuggcacg

SEQ ID NO: 473656 - RNA, 64 nt, Human
accaagguuucuagcuaaguuacucuagucuccaagccucuagcauagagcacugcagacaggc

SEQ ID NO: 473657 - RNA, 64 nt, Human
gugggugacuggccacaggccgagaaaaggguacagccucuaggugggguucccaaagacgccu

SEQ ID NO: 473658 - RNA, 64 nt, Human
accagcacuaagguggacagcagacaagagggcaagccucuaguguaccaagugcuuccuacaa

SEQ ID NO: 473659 - RNA, 64 nt, Human
ugaaauccagcauuuuuacauaggagaugcacuuagccucuaagccucguuuuacucaucugug

SEQ ID NO: 473660 - RNA, 64 nt, Human
ucagccaugcucaggaccccucggcuccucccccagccucuagcuacccuguaucgaggcaagg

SEQ ID NO: 473661 - RNA, 64 nt, Human
cuguggagaacauugcauaggaaugucuggaaaaagccucuacaacuuguuacagccuucacau

SEQ ID NO: 473662 - RNA, 64 nt, Human
ccuuacuacucucuuugacagaagacucaaacacagccucuaagaaacaaggcagcuguuagug

SEQ ID NO: 473663 - RNA, 64 nt, Human
aggaaauucugaggaauauagcucuuaggcuuccagccucuaccaugcaggagagaacacagaa

SEQ ID NO: 473664 - RNA, 64 nt, Human
cucccacaagcaccugcucaacauaggccugcucagccucuagcaccaggacucaggugaugag

SEQ ID NO: 473665 - RNA, 64 nt, Human
acaguaacuuaauggaagugcugacucuagcaucagccucuaccgauugauuuuccucccuucu

SEQ ID NO: 473666 - RNA, 64 nt, Human
gugcucccuccuagcgcaguggccaagccgggaaagccucuaacuugccuuugcugcugcugcc

SEQ ID NO: 473667 - RNA, 64 nt, Human
caucgugccucacauccgcuccacauggugcaagagccucuagcggcuuccaguuccccgcucc

SEQ ID NO: 473668 - RNA, 64 nt, Human
auucagaccucagaugcaugaugcaguuagacuaagccucuaaguuucugacuguuaugcuuga

SEQ ID NO: 473669 - RNA, 64 nt, Human
ccuuaacauguggaguguaccguggggccucacuagccucuaacucccugugucugcaugagca

SEQ ID NO: 473670 - RNA, 64 nt, Human
cucccacccuugacugguugggauuugcucguccagccucuagacacuucccaaagcaagacug

SEQ ID NO: 473671 - RNA, 62 nt, Human
ccccagccagccuggaccccuaacaaagaccaccaggacauccugggaacucugggacucac

SEQ ID NO: 473672 - RNA, 62 nt, Human
ccaccaccagggcacucacucgcagcuauagcccaggacagaaaaacugugcuuuggacagg

SEQ ID NO: 473673 - RNA, 62 nt, Human
aagcuguuacuggugauuauagaugaguauuuccaggacaacguucuaaaaguacaauuauu

SEQ ID NO: 473674 - RNA, 64 nt, Human
gcuagagugcaguggugcgauuauagcccggugcagccucuaacuccugggcucaagcaaucca

SEQ ID NO: 473675 - RNA, 64 nt, Human
acagaugggaugcuucagguaggacaucaaggaaagccucuaaggaaaggaugcaugagcuaac

SEQ ID NO: 473676 - RNA, 64 nt, Human
ucaguuucaucuucugggauuauuguucaagaccagccucuaaugggaggugaaacgguacgau

SEQ ID NO: 473677 - RNA, 64 nt, Human
cuggacugggcucagcagucccauuugggauguaagccucuauugccucuaagaugacccuuuu

SEQ ID NO: 473678 - RNA, 64 nt, Human
uccugaagaggcaugacugcuuuucucagccccaagccucuagucuggguguguacggaggguc

SEQ ID NO: 473679 - RNA, 62 nt, Human
gagaaacccuacaaaugugaagauuguggcaaagccucuaacccguccugaauucuuacuaa

SEQ ID NO: 473680 - RNA, 64 nt, Human
cugaaccguuugugauugccauuugagcucuggaagccucuauugccaugagaguucugucacg

SEQ ID NO: 473681 - RNA, 64 nt, Human
cucccaagcguuccuggccuucugaacuccauacagccucuacagccgucccgcguucaagacu

SEQ ID NO: 473682 - RNA, 64 nt, Human
aaagcacacauucuucaaaauagccuaaaaaccuagccucuaacaccuuguuccagguuaccuu

SEQ ID NO: 473683 - RNA, 64 nt, Human
ugguuucaugugacaccuccauggauuuuuuuccagccucuaagucaccaacuugggaacugcu

SEQ ID NO: 473684 - RNA, 64 nt, Human
accuuauuuccagcuugcacaucagaauuuuuccagccucuacucauuugucaguuucaaagcu

SEQ ID NO: 473685 - RNA, 64 nt, Human
uuccuuggugagcaacagaaagggaaggguuccaagccucuaaaaaugugcuuugugaucagga

SEQ ID NO: 473686 - RNA, 64 nt, Human
agugcggggauuacaggcuugagccacugcaccuagccucuauuuguuuuacaaaagagaaauu

SEQ ID NO: 473687 - RNA, 64 nt, Human
aaucauuagaaaggaggcuguagaauauuugccgagccucuacuguauaccaggggcuaacuca

SEQ ID NO: 473688 - RNA, 64 nt, Human
uucuaucccugugaggagaggugcugucugcuggagccucuaguccacccucuccaguggucac

SEQ ID NO: 473689 - RNA, 62 nt, Human
ggaugagacagaaaaugaaagcauguuguuugccaggacacuguggguuuauauugaugugu

SEQ ID NO: 473690 - RNA, 62 nt, Human
gagggccaccucaaccccagcuucugacguguccaggacagagcaucccuggauucuguuca

SEQ ID NO: 473691 - RNA, 62 nt, Human
uuggcauuuuaaaggaguaugaggugggugacccaggacagagaacgcuacuggauccuggg

SEQ ID NO: 473692 - RNA, 64 nt, Human
gagagaaaccaugcaugugugaagaaugugggaaagccucuaacagauccucaauucuuaagaa

SEQ ID NO: 473693 - RNA, 64 nt, Human
cccagauaccccuucuccucacagucagaacagcagccucuacacauguuguccugccccuggc

SEQ ID NO: 473694 - RNA, 64 nt, Human
uccuccccacucugucuccaggcugccucuggguagccucuagucugcuguucuucaggaggcc

SEQ ID NO: 473695 - RNA, 64 nt, Human
acucacguaauuuacugaguagcugcaacaugccagccucuacguuagguucugcggauaaagg

SEQ ID NO: 473696 - RNA, 64 nt, Human
ugucuugauuugcauuuuacagcaaagugcugagagccucuagucgccuccugccaucugaucu

SEQ ID NO: 473697 - RNA, 64 nt, Human
cugaaucugcuggugccuugaucuuggacuucccagccucuagaacuguaagaaauaaauauuu

SEQ ID NO: 473698 - RNA, 64 nt, Human
ccuuugugggugcagggcuuuuguggaaauugucagccucuacgggcagaguccggcauccccu

SEQ ID NO: 473699 - RNA, 64 nt, Human
aagaugggaacagaauuucagucuugcagccaugagccucuauuucucauuccuaagccuuacc

SEQ ID NO: 473700 - RNA, 64 nt, Human
uuccuuuguaguuaaaggguccaguucugacuggagccucuagagagcugggcuuguauguucu

SEQ ID NO: 473701 - RNA, 64 nt, Human
cuacuccuaugaccccgaagaugaggccagccucagccucuauggcaaggcccugcuacauggc

SEQ ID NO: 473702 - RNA, 64 nt, Human
uugaacuccuaggcucaagcaguccuccugccuuagccucuagaguagcuggggcuacaggugc

SEQ ID NO: 473703 - RNA, 59 nt, Human
acgaauuugagucuauguaaugggcacccagccucuagggaccccuccucccuuuuucc

SEQ ID NO: 473704 - RNA, 64 nt, Human
ucauguucauuguuccugguuuuuuccagccagcagccucuacacuccaucauaggacaucgag

SEQ ID NO: 473705 - RNA, 64 nt, Human
ugggggccggccccuggagucuucccucccugguagccucuaaccagcauucccagacaccuga

SEQ ID NO: 473706 - RNA, 64 nt, Human
gaguugcauggggccuaguaacaccaagccagugagccucuaaugcuacugcgcccugggggcu

SEQ ID NO: 473707 - RNA, 62 nt, Human
cccgaaguccagacucccaggggaaucagcagccaggacagacauccuagcagccgccuccc

SEQ ID NO: 473708 - RNA, 62 nt, Human
gcugcgcuaggcgcaguggggugggccaggccccaggacagccggagcucggccugcggugg

SEQ ID NO: 473709 - RNA, 62 nt, Human
caucccuuccccagccacaggugucccugcccccaggacaguccagggccaggggcuucugu

SEQ ID NO: 473710 - RNA, 64 nt, Human
cacaccuacccuugcuaaauaaacgcugcuggucagccucuagcccacaagccccucuuggucc

SEQ ID NO: 473711 - RNA, 64 nt, Human
cccucaaccccucugcucagugccuguggggagcagccucuacccucagcauccuggccacaag

SEQ ID NO: 473712 - RNA, 64 nt, Human
ucuaaauuuguaagcauucauaaaacaggaaaaaguaaacuaucauucggaagcacagcccauu

SEQ ID NO: 473713 - RNA, 64 nt, Human
ucaggaacugugaauggcuagaagaaggagcucaguaaacuagaaguccaggguugcuugguuu

SEQ ID NO: 473714 - RNA, 64 nt, Human
gucaauuauacuuuuguuguucauuagcaucuuuguaaacuauaagacguaguuuuaauuaaua

SEQ ID NO: 473715 - RNA, 64 nt, Human
gugccaguguauguauguuauacuugauuugguuguaaacuauauuucaaaguaaacccuagug

SEQ ID NO: 473716 - RNA, 64 nt, Human
gaucaagccuucucagcggugggucuggauguggguaaacuaagguaaaggggaugauauucca

SEQ ID NO: 473717 - RNA, 64 nt, Human
auauucuauacaaagguacuuguccuuucccuuuguaaacuacauuugacauggauuaaaccag

SEQ ID NO: 473718 - RNA, 64 nt, Human
ugacuugauucaaaagaaaauguuauaagaugcaguaaacuaauaacagaauuauuaaaauaua

SEQ ID NO: 473719 - RNA, 64 nt, Human
uagucugugcuacuuuaugucaauauaaaaauugguaaacuagaaguaacuuguccacaacccu

SEQ ID NO: 473720 - RNA, 64 nt, Human
cuacuugcuaauauuuguauagaauagaauuuauguaaacuaguaaccaguugaucucugugcc

SEQ ID NO: 473721 - RNA, 64 nt, Human
caauagcuuuguaguuuuuuuucaaaaucuuaauguaaacuaggauuggaguaugauuuaccuc

SEQ ID NO: 473722 - RNA, 64 nt, Human
gacccaagaacaugcugaccaauguguucuauauguaaacuacaaauucuaugguagcuuuguu

SEQ ID NO: 473723 - RNA, 62 nt, Human
guguagaaaugggggaauugguuccccauggcccaggacagcugagaggagguggaggggcc

SEQ ID NO: 473724 - RNA, 62 nt, Human
cccuccggggaacaccgggaaggcucgacgcuccaggacaggaccagccacgcagacagguc

SEQ ID NO: 473725 - RNA, 62 nt, Human
agggaguggcagcuauagucuggcaccaaaguccaggacacccagugggguggagucggagc

SEQ ID NO: 473726 - RNA, 62 nt, Human
gcacagggguuuccccauacuaccuccccuccccaggacacucccaggcuuggguuuuuucu

SEQ ID NO: 473727 - RNA, 64 nt, Human
auuaugugugaaauguaggaaaaugcuugccccuguaaacuagugaguugauggagcauuugcu

SEQ ID NO: 473728 - RNA, 64 nt, Human
aaagccguuagacacacaggaaaaauccagaaggguaaacuaaacuaaagcuacaauuaauaug

SEQ ID NO: 473729 - RNA, 64 nt, Human
ugacccuguuauauuucaguguugugacaaauguguaaacuagcgggggaagacaguauuguau

SEQ ID NO: 473730 - RNA, 64 nt, Human
uggauucuauagccaagaacucaugaaaguaaguguaaacuauccuagguaauuucagguacuu

SEQ ID NO: 473731 - RNA, 64 nt, Human
uuaggugugacugucacaacuguuauguuuuccaguaaacuagaaguacgauauuugauaauua

SEQ ID NO: 473732 - RNA, 64 nt, Human
gcacaauucccauugagagaaagaucucugugcuguaaacuaaaacaaauugugcauuccuucc

SEQ ID NO: 473733 - RNA, 64 nt, Human
accauaaauuugcaugaauuaaucuccacguuugguaaacuaauaccucugguugacugagaau

SEQ ID NO: 473734 - RNA, 64 nt, Human
gccuuuugugcuuguuuccuauaacuucaguauuguaaacuaguuuuugguuugcaguuuuugu

SEQ ID NO: 473735 - RNA, 64 nt, Human
ugggacagcaccugguauagaauaaauaauaaauguaaacuauuauuuuugguuaucaugucgu

SEQ ID NO: 473736 - RNA, 64 nt, Human
uaugagggagauucugaucauauuaaaaaucuggguaaacuaaaaccugcucauaaccucauag

SEQ ID NO: 473737 - RNA, 64 nt, Human
uauugcuuuauuacuuucauuuucugacccugcuguaaacuacugcaacccucacauccucaaa

SEQ ID NO: 473738 - RNA, 64 nt, Human
aaugaauaguugguuuccaaugcacaaauaucauguaaacuaaucuaaagaugguuugcuuaau

SEQ ID NO: 473739 - RNA, 64 nt, Human
gcucagagaaagcaagcauaagggaaaaugucacguaaacuagaucagggaacaaaauccucuc

SEQ ID NO: 473740 - RNA, 64 nt, Human
uagugugcucuucauguuaauauggcagaguuuuguaaacuaaauuaaaacuuacugauauauu

SEQ ID NO: 473741 - RNA, 62 nt, Human
ccggcgccggacccugcgacaaccggggucccccaggacaguaggcccggcucugcccguag

SEQ ID NO: 473742 - RNA, 62 nt, Human
ggcagggaugaggcccgaggugggggcgguggccaggacaacgggcuggagggucugggcaa

SEQ ID NO: 473743 - RNA, 62 nt, Human
cugggcccugcugggggccucccccacgccccccaggacaguguccccccgagugacuccgc

SEQ ID NO: 473744 - RNA, 62 nt, Human
ucaaaacugcauuugcaaagcccuccccugucccaggacaaagcugagacugacgggugaug

SEQ ID NO: 473745 - RNA, 64 nt, Human
aaaagacggaagacgacuaaaucugcucuaaaaaguaaacuagaauuugugcacuugcuuagug

SEQ ID NO: 473746 - RNA, 64 nt, Human
cugccuucaggaagcuaaaguauuguuggaccuaguaaacuagucaguguuggaaacggccuug

SEQ ID NO: 473747 - RNA, 64 nt, Human
agcucgaauuauuccucauuguauagccugcuuuguaaacuaguuuacaauuugcaggcugauc

SEQ ID NO: 473748 - RNA, 64 nt, Human
gauuuuggguuuuuaauacuauaaauacuugauuguaaacuaaauucaagaucauuuauaggaa

SEQ ID NO: 473749 - RNA, 64 nt, Human
cauuuuuguuuauuuuaaaaagugaucagaaguaguaaacuaucuuugaggaaauacuguaacc

SEQ ID NO: 473750 - RNA, 64 nt, Human
cagccagaccucaggucuucacucuuucuucuuuguaaacuaugucauguggaaagauuuccuc

SEQ ID NO: 473751 - RNA, 64 nt, Human
aauucagcuaauaauagcauuucgaguauauuucguaaacuaaggaaauacacaaaaggcuguu

SEQ ID NO: 473752 - RNA, 64 nt, Human
aaaaacaaaaaaagcguuuaccagcucuuaggauguaaacuagcuuuguggaagauaaaucgug

SEQ ID NO: 473753 - RNA, 64 nt, Human
cugugucaaguauuugugcagucagagcugacuuguaaacuauucuuguaauagcucauuauuu

SEQ ID NO: 473754 - RNA, 64 nt, Human
aaauagugaucuucuuuugcuaacauaaaaaugaguaaacuacagcagagaaauaagaauaaaa

SEQ ID NO: 473755 - RNA, 64 nt, Human
auugauggauccuuuagaauugccuaccuaaaagguaaacuauacuauccuuauaaauacugau

SEQ ID NO: 473756 - RNA, 64 nt, Human
uaugcuacagucacuuaagcauaagcuacaguauguaaacuaaaagggggaauauaugcaaugg

SEQ ID NO: 473757 - RNA, 64 nt, Human
uccuacucuuggaacuuggauguauucuaauguaguaaacuauucuaaguuuucauucuuugaa

SEQ ID NO: 473758 - RNA, 64 nt, Human
ugugaccuguuuuccuuugucuuauauaacuuuaguaaacuaaccacugucaaugauugagggc

SEQ ID NO: 473759 - RNA, 62 nt, Human
agccuucaaggcuucauggccauaucaugaacccaggacaggcacaguggggguggugagga

SEQ ID NO: 473760 - RNA, 62 nt, Human
ugugagcgugccgucaucgacuuuguggcuuuccaggacaucuccaucaagaggcugcagcg

SEQ ID NO: 473761 - RNA, 62 nt, Human
uucuccugcugcucuuggaugcagggaucacaccaggacagccugggguuccccugaggggc

SEQ ID NO: 473762 - RNA, 62 nt, Human
acugaggccaugagaaccugaggggcaucugcccaggacaggagccauggcauaugacaaag

SEQ ID NO: 473763 - RNA, 64 nt, Human
uauaguuaacuaguaucacauguuuaguugguauguaaacuaauguauccagaagauuggaaga

SEQ ID NO: 473764 - RNA, 64 nt, Human
aauauaaaaguaauaauauaaggaaaaagggaaaguaaacuauuuagaauguaguuuuguuaua

SEQ ID NO: 473765 - RNA, 64 nt, Human
ccaugccaaggagcgagccuuuaaacagcaguuuguaaacuaugcaacugaaaaacugaggaug

SEQ ID NO: 473766 - RNA, 64 nt, Human
gacaccuagcuuagucauggcaaguugccauuuuguaaacuaaggauuuuggacugagauuucu

SEQ ID NO: 473767 - RNA, 64 nt, Human
gacuugcuuuuaaaggguuauauuucucuuugguguaaacuaaaagaaauguuuuuagcuguag

SEQ ID NO: 473768 - RNA, 64 nt, Human
uuaucucacaauuuuugucuccacuaagcaagaaguaaacuaacacuucgucacucuaaagaaa

SEQ ID NO: 473769 - RNA, 64 nt, Human
aguuuaagauaaguuuagacaggagaaaguguauguaaacuaccugaaaggaugacaaucaaua

SEQ ID NO: 473770 - RNA, 64 nt, Human
aguggaauugcaggaucaaaagguacaugcauuuguaaacuauuauuguuuagugagggucuuu

SEQ ID NO: 473771 - RNA, 64 nt, Human
cccuauuuauccuuguuaaguaucagcuacaauuguaaacuaguuacuaaacauguauguaaau

SEQ ID NO: 473772 - RNA, 64 nt, Human
ucuguuuauguagaaugauuuuguuaagaguaauguaaacuauuauugaguagaggccuaaaga

SEQ ID NO: 473773 - RNA, 64 nt, Human
uuucuauuagauuaucuacaaaaacaagcuuucaguaaacuaccaaaaaaaaagugggggugga

SEQ ID NO: 473774 - RNA, 64 nt, Human
ggggguaggacuacacugaaucauuaacagugcuguaaacuaccauguggccauuaacaaugac

SEQ ID NO: 473775 - RNA, 64 nt, Human
gcugacuugauggaaucauguucaaguggcaucuguaaacuauuaucccccacccuccacuccc

SEQ ID NO: 473776 - RNA, 64 nt, Human
agauacguuuaauguaauaagaacaagggaacauguaaacuaacauaaccaauugucaguucuc

SEQ ID NO: 473777 - RNA, 62 nt, Human
cucuccuggggcgccuggccagagccgggguuccaggacagggaagggagcaggagccugca

SEQ ID NO: 473778 - RNA, 62 nt, Human
ugaaggaacggaaucgcaaguaugaccagaagccaggacaaagcuggcagggggagauccca

SEQ ID NO: 473779 - RNA, 57 nt, Human
ccaaggugcugugcuugugaggcacccccaggacagcacacggugagggugcggggc

SEQ ID NO: 473780 - RNA, 62 nt, Human
ucucuguuagggcaaccaccaccaccugucuuccaggacacauuuuuagauacucugacagg

SEQ ID NO: 473781 - RNA, 64 nt, Human
agaggaccuugcuguccgccugcacugcuuccugguaaacuauaacaaacuuaugcugccaaaa

SEQ ID NO: 473782 - RNA, 64 nt, Human
acuggauauguguauauagaguaguuuuucaaaaguaaacuaaaaaugagaagcauauuucaag

SEQ ID NO: 473783 - RNA, 64 nt, Human
auuaguuuaguuuguggcuucauggaaacucccuguaaacuaaaagcuucaggguuaugucuau

SEQ ID NO: 473784 - RNA, 64 nt, Human
uugguacuacauaaugacuugcuccacacaugcaguaaacuacauaaugauguacugguaaacu

SEQ ID NO: 473785 - RNA, 64 nt, Human
ccacacaugcaguaaacuacauaaugauguacugguaaacuagaaacaaagaaugcagcaggau

SEQ ID NO: 473786 - RNA, 64 nt, Human
gcaauuuuaugguccagaauuaauauuauuauucguaaacuagcuauaauagaguauauacagu

SEQ ID NO: 473787 - RNA, 64 nt, Human
caaagguuaauuuaaggacaaagaugaagucacuguaaacuaaucugucauuguuuuuaccuuc

SEQ ID NO: 473788 - RNA, 64 nt, Human
ucuuuuaugacagaggguggugaaggcagauauuguaaacuacaaccaggaaccuaugucaagg

SEQ ID NO: 473789 - RNA, 64 nt, Human
agaauaauacgaaguauauauaaaaggaauuacuguaaacuacauugccauagcaauuuacaua

SEQ ID NO: 473790 - RNA, 64 nt, Human
aaaaaaagaacucuuagacacugcuggugggaauguaaacuagagcagccauguggagaacaac

SEQ ID NO: 473791 - RNA, 64 nt, Human
cuguggcuuugggaucuuuuuauuuugauuguugguaaacuaaucauuuuauuauauauaaaaa

SEQ ID NO: 473792 - RNA, 64 nt, Human
cagaaugugcaagaacuuuugcauuuuaaucguuguaaacuaacagcuuaaacuauugacucua

SEQ ID NO: 473793 - RNA, 64 nt, Human
uaaauauuuacacuaauaucaauuacauauuuugguaaacuagagagacauaauuagagaugca

SEQ ID NO: 473794 - RNA, 64 nt, Human
uaaaauggaauuauaugcaacauucuuucauucuguaaacuaauuccauuugcauuccucauaa

SEQ ID NO: 473795 - RNA, 62 nt, Human
ucauuaugccccuccugggggagauugcaucuccaggacaagcaucuaaaggaggccccugc

SEQ ID NO: 473796 - RNA, 62 nt, Human
auauuaguuagagacugauuaucucaugugagccaggacauucuuccagcaagguuggccuc

SEQ ID NO: 473797 - RNA, 62 nt, Human
cugggcaagaugagccaagcagaacauuccauccaggacacuggaaguucuccaggauccag

SEQ ID NO: 473798 - RNA, 62 nt, Human
aggaaccgcagguggugagcggcuggggagggccaggacagccggggcugggugcugcaggg

SEQ ID NO: 473799 - RNA, 64 nt, Human
auugguucugaauuaugcaacuguuugcuauuuaguaaacuagcaaaugaugcauguauuuugu

SEQ ID NO: 473800 - RNA, 64 nt, Human
ugucauguaguuucaacaagugcuaccuuugaguguaaacuaagguagacuacuuugggaauga

SEQ ID NO: 473801 - RNA, 64 nt, Human
accuacuuuaaaaguuuuaauggauugcaccucuguaaacuauuccuaaaauguguaugauaua

SEQ ID NO: 473802 - RNA, 64 nt, Human
uuuuaaaucccauauuuuuuuuaucaugucguagguaaacuaaccugguauuuuaagagaaaac

SEQ ID NO: 473803 - RNA, 64 nt, Human
gccauuuacguaagccaaagaaagucacucaugaguaaacuauagaaaacguucagacccaucc

SEQ ID NO: 473804 - RNA, 64 nt, Human
ccaguguugaacuauuaaaagcacacaauguguaguaaacuaucauaggauucccauaauuuca

SEQ ID NO: 473805 - RNA, 64 nt, Human
gacugauguauguaaucaacuucauugggcugcaguaaacuaguggaaauuagagaguuguuuu

SEQ ID NO: 473806 - RNA, 64 nt, Human
uggucuggucaguauugccuggcugacgugaaauguaaacuaguaggcguguuauugaucugcu

SEQ ID NO: 473807 - RNA, 64 nt, Human
aaguuaccuuuuuuccccccuucuuuuccuaauuguaaacuaggccaaccugaaagccauggcu

SEQ ID NO: 473808 - RNA, 58 nt, Human
agaauaauuuggguuucugauaaagaauguaaacuaaauccgcgucugugaauacguu

SEQ ID NO: 473809 - RNA, 64 nt, Human
auuagacaacaaauuaccuuucuggguguuucuuguaaacuauacuccuguuugaauguuaaac

SEQ ID NO: 473810 - RNA, 64 nt, Human
aggguuauacagaugucagagagcuaacugcucuguaaacuacuuuccaugaguaaauuggucc

SEQ ID NO: 473811 - RNA, 64 nt, Human
ugaauacaucauuguuaauuuugaguuggcagagguaaacuaaccaacuaccauuauguuuuag

SEQ ID NO: 473812 - RNA, 64 nt, Human
gcagggggacggggccaugauauggggaaaugguguaaacuaauguauuucuuuauuggcuguu

SEQ ID NO: 473813 - RNA, 62 nt, Human
caugggugcagguaguuuguuugagagauuucccaggacauacaagauggggagugagauga

SEQ ID NO: 473814 - RNA, 62 nt, Human
cuguugggguuaggggcagccaugggccccagccaggacaugcugggugccccagccugcag

SEQ ID NO: 473815 - RNA, 62 nt, Human
ggcugcucacccgcccagcacacgccggggccccaggacaacgcguuucccccgcggacccc

SEQ ID NO: 473816 - RNA, 62 nt, Human
ugugguuagacauuuuuauuucauugacuaacccaggacaguuucagugaugcaaauugugu

SEQ ID NO: 473817 - RNA, 64 nt, Human
uaaggcuaaccaucgaaaagaacaugggccgcggguaaacuagcuuugcucuuuagaugcaagu

SEQ ID NO: 473818 - RNA, 64 nt, Human
ccaguguucuauuugcuuuaaugagaauagaaacguaaacuaugaccuagggguuucuguugga

SEQ ID NO: 473819 - RNA, 64 nt, Human
ugagccuucaaacuuguaguuauccuauuauauuguaaacuaauacauugucuagcauugauuu

SEQ ID NO: 473820 - RNA, 64 nt, Human
cuauuuuugcaauggcuauauggcaagaaagcugguaaacuauuugucuuucaggaccuuuuga

SEQ ID NO: 473821 - RNA, 64 nt, Human
acaauacucaucuaggauguaacagugaagcugaguaaacuauaacuguuaaacuuaaguucca

SEQ ID NO: 473822 - RNA, 64 nt, Human
uuccuaccuucuuccuccaagagaguaucaugaaguaaacuacaaacuucagaagaaagcugac

SEQ ID NO: 473823 - RNA, 64 nt, Human
uuuuuuucccucuccuguccuuguguugaaggcaguaaacuaagggugucaagccccauucccu

SEQ ID NO: 473824 - RNA, 64 nt, Human
gucugguuuucuagcaaacaguaaauuuaaacaaguaaacuauuaugguuuccauugcuuacaa

SEQ ID NO: 473825 - RNA, 64 nt, Human
auaucuugaguugaugguuuugugauuuagcuggguaaacuaucuuuguaacagauaaguuauu

SEQ ID NO: 473826 - RNA, 64 nt, Human
gucuccuuaacaucaucuguuuacucugcucaguguaaacuacaaugcucugucaucucccuac

SEQ ID NO: 473827 - RNA, 64 nt, Human
aagauccuuuuccacaggaagcuaucaaagaaaaguaaacuagacaccaaguaauaucacucuc

SEQ ID NO: 473828 - RNA, 64 nt, Human
ugaaguauaccacagacaaaaaguuguuacuaugguaaacuaagcuaguuuaacacuugagcaa

SEQ ID NO: 473829 - RNA, 64 nt, Human
gaaguguguuuucaaaaagauauuuacauagucuguaaacuagaaaguguuagguaaagcucua

SEQ ID NO: 473830 - RNA, 64 nt, Human
guuuauccauucuuuuauccuuuauauuucauuuguaaacuauauuugaacgacauuccccccg

SEQ ID NO: 473831 - RNA, 62 nt, Human
gacaacacuaugaugucauuuggaaggauuugccaggacagacugauucugaguccugggug

SEQ ID NO: 473832 - RNA, 62 nt, Human
caccugcacaccgucccucuccccggacaagcccaggacacugccuuugcugccuucugucu

SEQ ID NO: 473833 - RNA, 62 nt, Human
cucugccucucaccaggagacacucugggccuccaggacaauugcugcuugccggcucuuau

SEQ ID NO: 473834 - RNA, 62 nt, Human
cugccccucacguucucuuggggacacccgagccaggacacuacgcaucccugcugagugug

SEQ ID NO: 473835 - RNA, 64 nt, Human
cagaucuugaaagguuugagaacuuggaaacaaaguaaacuauaaacuuguacaaauugguuuu

SEQ ID NO: 473836 - RNA, 64 nt, Human
auaagaucacucauaaaacaguuggaauaagaaaguaaacuagucuaguuuuauaugaccuggu

SEQ ID NO: 473837 - RNA, 64 nt, Human
aucagaaaauacgagauuugcaggggaaacaucaguaaacuaccauuaaugucaaugcccaguu

SEQ ID NO: 473838 - RNA, 64 nt, Human
uuaaaucucugguauaaguuuacuccauaccagaguaaacuauauauuacucuauauaagcagu

SEQ ID NO: 473839 - RNA, 64 nt, Human
aaaugauugacucauucauaguaaauaugggcauguaaacuaauaaauaugcacuggauacaua

SEQ ID NO: 473840 - RNA, 64 nt, Human
cacacacuccauucacugucuccaugacucuggaguaaacuaacgucucgaguugccauuggaa

SEQ ID NO: 473841 - RNA, 64 nt, Human
guacauauacacuacaauggauaguauauuugcuguaaacuacaauguaaaaccucaauaaaag

SEQ ID NO: 473842 - RNA, 64 nt, Human
aacacaaaauuucacucucuaaaagcaacagcauguaaacuagaaugaaagaaggaaauuaugu

SEQ ID NO: 473843 - RNA, 64 nt, Human
auacauaccagauuuuaaagauguaccaaaaaauguaaacuaucucaauuuuuauauuggugaa

SEQ ID NO: 473844 - RNA, 64 nt, Human
cagauuguuucauaucauuuauacuuggguaagaguaaacuagauaacugggcgucguggugca

SEQ ID NO: 473845 - RNA, 64 nt, Human
caaguaguuaaugaugauaacaaugguguaacuuguaaacuaaauauuugguaacugaagcaau

SEQ ID NO: 473846 - RNA, 64 nt, Human
auuuuuugggcagcaauuuaaauguuaugacuauguaaacuacuucucuuguuagguaauuuuu

SEQ ID NO: 473847 - RNA, 64 nt, Human
uuauuucuuucucgucucaucaaaaugaugacagguaaacuauauuuuuccuuaaacaccuauu

SEQ ID NO: 473848 - RNA, 64 nt, Human
cuaaacacaguauuucuuuuuaacuuuuuuauuuguaaacuaauaaagguaaucacagccacca

SEQ ID NO: 473849 - RNA, 62 nt, Human
agggcccagugggauugagggggcugggucccccaggacacgggcccagaagagccccacgg

SEQ ID NO: 473850 - RNA, 62 nt, Human
ccaggagccugcgcggcucgccuggaaacgugccaggacacuguccuggugcccagcccaac

SEQ ID NO: 473851 - RNA, 62 nt, Human
ccucuugguuggccaggcccaccaggaagucaccaggacaguccacccgcccuguuggcaca

SEQ ID NO: 473852 - RNA, 62 nt, Human
uccagcacugcacccucaggaagucgcccgccccaggacacgcagggaccacccuaagggcu

SEQ ID NO: 473853 - RNA, 64 nt, Human
aguuuccuaugacuaauucacaaaaaaaguaauuguaaacuaguacuauuauggaauuacucua

SEQ ID NO: 473854 - RNA, 64 nt, Human
cuucauuuuauuuuugacgucacuuuuuggccauguaaacuauuuguggcaauuuuauguuuuu

SEQ ID NO: 473855 - RNA, 64 nt, Human
acaggguaaacaguguuauguagaauagaauuguguaaacuagaucuuuagagaaguugccauu

SEQ ID NO: 473856 - RNA, 64 nt, Human
acauaccucucucucuacauauaaauaccauaaaguaaacuaaaaugacacagaggaaaguaga

SEQ ID NO: 473857 - RNA, 64 nt, Human
aaauccuuauuuuguauaaaggacuucccuuuuuguaaacuaauccuuuuuauugguaaaaauu

SEQ ID NO: 473858 - RNA, 64 nt, Human
aaaguuaauccucuuagaauaccuauaaaaagauguaaacuaauguaccucaguaauuaaauau

SEQ ID NO: 473859 - RNA, 64 nt, Human
gucuuuuuuuuuuuuuccucucuugggagucguuguaaacuacuguguacaagucauuuuguga

SEQ ID NO: 473860 - RNA, 64 nt, Human
auauuaaacacaucugcaggacacauuuugccauguaaacuaacauucacugguuccagggauu

SEQ ID NO: 473861 - RNA, 64 nt, Human
uggcagggccaagguccccacuuucuugcugacuguaaacuaaggccacuuccagcuuguagag

SEQ ID NO: 473862 - RNA, 64 nt, Human
gagaaauuauauaauuuauuuaguaaauacuacuguaaacuauaguuuugugagagaaauaaaa

SEQ ID NO: 473863 - RNA, 64 nt, Human
cacgcuuaaaagcaauggugugaguuauuaauggguaaacuaagaaguguuauaggcaaugacu

SEQ ID NO: 473864 - RNA, 64 nt, Human
auugacaauggaccaucuuccuaggaacucccaaguaaacuauuucaggacauguaucugcuga

SEQ ID NO: 473865 - RNA, 64 nt, Human
ggugcuugcugugagacugagcugggcucugaguguaaacuacaugguagguugugaaggaugc

SEQ ID NO: 473866 - RNA, 64 nt, Human
uauaaauuuaagcaaacgucuauuuuguauauuuguaaacuacaaaguaaaaugaacauuuugu

SEQ ID NO: 473867 - RNA, 62 nt, Human
caauagagacgggacugcggaggaaggaggacccaggacaggauccaggccggcuugccaca

SEQ ID NO: 473868 - RNA, 62 nt, Human
ugugucaggcugcuggaaagaagacuccauucccaggacagaggcccuugaguacaggggcu

SEQ ID NO: 473869 - RNA, 62 nt, Human
ugucaucuuguggccuggagucgaggucuuggccaggacauaacaagcuguggucuggggua

SEQ ID NO: 473870 - RNA, 62 nt, Human
uggacgaugaggaggauacuguggccccgcugccaggacaucuguugggcccagguaaugug

SEQ ID NO: 473871 - RNA, 64 nt, Human
ccccauagagaccaggagggagagccucuguuuuguaaacuaaggauaaccgaguuugcuaaau

SEQ ID NO: 473872 - RNA, 64 nt, Human
agggaaagucaguugagggacacaaaaguguuuuguaaacuauaaaguacguggcauguguagg

SEQ ID NO: 473873 - RNA, 64 nt, Human
uuaccugcaaggaaagugaacauuuuguauuuaaguaaacuauaaugugcacauuuuaauaaag

SEQ ID NO: 473874 - RNA, 64 nt, Human
ucauguucaggauuaggauuaguagucaguugcuguaaacuauuuugaacaaacagaaaagaac

SEQ ID NO: 473875 - RNA, 64 nt, Human
uuuuaaguguuguuagucugcaugcacauuggcaguaaacuaguuacuuguguacucuguaaua

SEQ ID NO: 473876 - RNA, 64 nt, Human
gcuuuguagucucuaacucugaaauuuaaaauauguaaacuaaagugguuuuauuugugcuuaa

SEQ ID NO: 473877 - RNA, 64 nt, Human
agucccuuccacuuaugaaccuguaaaaucaaaaguaaacuaguuacuuccuagauacaauggg

SEQ ID NO: 473878 - RNA, 64 nt, Human
ucaugcaaaauuuucuucuagcaugugauaaugaguaaacuaaaacuauuuucagcuuuucuca

SEQ ID NO: 473879 - RNA, 64 nt, Human
aauucagcuaauaauagcauuuucaguacuuuucguaaacuaaguaaauacacaaaauguugau

SEQ ID NO: 473880 - RNA, 64 nt, Human
uugaaucagagaauacuuggccaagcucguauuuguaaacuaaaaccccuuguuauuuguaucu

SEQ ID NO: 473881 - RNA, 64 nt, Human
ggagacacccaaagggugaagcuauuuaucuguaguaaacuauuuaucuguguuuuugaaauau

SEQ ID NO: 473882 - RNA, 64 nt, Human
guaaucuaaaucagaauuuugauaaauuuuuuuuguaaacuaaguauguuuauucaagacauug

SEQ ID NO: 473883 - RNA, 64 nt, Human
auaagcacaucaguacuuuucucuggcuggaauaguaaacuaaaguaugguacaucuaccuaaa

SEQ ID NO: 473884 - RNA, 64 nt, Human
uuaaggucaaacuaauucucacaucccucuaaaaguaaacuacuguuaggaacagcaguguucu

SEQ ID NO: 473885 - RNA, 62 nt, Human
gggacaccccugcagggucucgggcucugagcccaggacauucccugccccuuacucaccuu

SEQ ID NO: 473886 - RNA, 62 nt, Human
aucucucgaggacucuggucccaggaugucucccaggacaagccagucugccucuuccuccu

SEQ ID NO: 473887 - RNA, 62 nt, Human
cacacacacacacgcuuguucacacucagaacccaggacagccacagccaccgcuuagggga

SEQ ID NO: 473888 - RNA, 62 nt, Human
ccaggugggggcuccugcccuccuccaacaacccaggacacccacgccucaccccucggugc

SEQ ID NO: 473889 - RNA, 64 nt, Human
uguagaauuucucauucugugguacaacccagggguaaacuauuauuccaguagucaguacacu

SEQ ID NO: 473890 - RNA, 64 nt, Human
uuuacaagauugaaaaaguacuaaaauuguuaaaguaaacuaucuuauccauauuauuucauac

SEQ ID NO: 473891 - RNA, 64 nt, Human
ccaaguucauuaccucccuaucaguucuagcauaguaaacuacgguaccaguguuagugggaag

SEQ ID NO: 473892 - RNA, 64 nt, Human
cuacauauauauauauauuuuugugaccuuuuuuguaaacuaagugccguuucaacguuacaau

SEQ ID NO: 473893 - RNA, 64 nt, Human
gacauucccaucacaacauuccucagacaagccuguaaacuaaaaucuguuaccauucugaugg

SEQ ID NO: 473894 - RNA, 64 nt, Human
uauguauuuuuauuucagugagagaaggaaaguuguaaacuagcccauagucaccuauauuuua

SEQ ID NO: 473895 - RNA, 64 nt, Human
auaauacauauuauuuaccccacuguaacaucauguaaacuaaguauguuuuuaaacaauuuuu

SEQ ID NO: 473896 - RNA, 64 nt, Human
uugggguuuuuuuuuucuuuuuuuuuuuuuuaauguaaacuaaccuccugcaugacagagguua

SEQ ID NO: 473897 - RNA, 64 nt, Human
accuaauguuacaacuacuuugagguggccaaauguaaacuaaaagccuuaauuaaaguggugc

SEQ ID NO: 473898 - RNA, 64 nt, Human
auagaacaccuuucccaauaggaaaccccaacagguaaacuagaaauuuccccuucaugaaggu

SEQ ID NO: 473899 - RNA, 64 nt, Human
gauuacuauaauggcuguuauuauacacagcucuguaaacuaccacucagcccuguguuggggu

SEQ ID NO: 473900 - RNA, 64 nt, Human
uucucuguuaauacauaauugcuccaagcuuccuguaaacuauaagaauauauuuaguuuacag

SEQ ID NO: 473901 - RNA, 64 nt, Human
cuugcagugucuuucggaauuuuuaaaauaaacuguaaacuaauaggcugggguuuuuguuuug

SEQ ID NO: 473902 - RNA, 64 nt, Human
uucuuucugcaaccuguacuuacagauucuuccuguaaacuaaauaaaaaaaaaaugauagugc

SEQ ID NO: 473903 - RNA, 62 nt, Human
aauggaagguaaggggaaggucugucaucuacccaggacauucccaugaugaguacagguca

SEQ ID NO: 473904 - RNA, 52 nt, Human
agugcagcugcugcgacugaugccaggacaaccuuucucccagauguaaaca

SEQ ID NO: 473905 - RNA, 52 nt, Human
agugcagcugcugugccugaugccaggacagcugugcucucagauguaaaua

SEQ ID NO: 473906 - RNA, 62 nt, Human
gaagugaccagccccucccugucccuucgaguccaggacaacaacgggcagaaaucgagagu

SEQ ID NO: 473907 - RNA, 64 nt, Human
uaaggagaaugaauuccaaucugugauuaaaaguguaaacuauagacucuacuguaguacauuu

SEQ ID NO: 473908 - RNA, 64 nt, Human
ccaguguggucuuguuuaauauuuguuccucuagguaaacuagcaaaaggaugauuuaacauua

SEQ ID NO: 473909 - RNA, 64 nt, Human
uagaauucuguuucuuuaacaguagcagggaaauguaaacuacaggugacaaaaaauacccagg

SEQ ID NO: 473910 - RNA, 64 nt, Human
ugagugugucaucaaucagaaccuaagcacagcaguaaacuauggggaaaaaaaaagaagaaga

SEQ ID NO: 473911 - RNA, 64 nt, Human
gggacauggaugaaauuggaaaucuucauucucaguaaacuaucgcaaggacaaaaaaccaaac

SEQ ID NO: 473912 - RNA, 64 nt, Human
gcaauuuucauugaacuuaaagagugaaaaccauguaaacuauugaaacuauuguaauccauua

SEQ ID NO: 473913 - RNA, 64 nt, Human
acuauuuuagauaaauguacuguuauauauauauguaaacuacuauugcucucuuuauaaugau

SEQ ID NO: 473914 - RNA, 64 nt, Human
uucuggucccaaagcaauucugaaagccagugugguaaacuagagagagcagcaaaaacaccag

SEQ ID NO: 473915 - RNA, 64 nt, Human
acuccguaacucaacauggcaugccuuucucuccguaaacuauuuagugagauuuuuagggacu

SEQ ID NO: 473916 - RNA, 64 nt, Human
gaaccaaaccagcacuggguucuacugcugugggguaaacuaacucaguggaauagggcugguu

SEQ ID NO: 473917 - RNA, 64 nt, Human
aaaaugcacuucuauuuagccagcguuuauuguaguaaacuauucuuaauaaaacucacucacu

SEQ ID NO: 473918 - RNA, 64 nt, Human
uuugcauuucauugcuuuuggaugaacaaaggaaguaaacuaauccuuuauaaaugaaaaccca

SEQ ID NO: 473919 - RNA, 64 nt, Human
uuuaacucuucauguuccaucuuucucuucugaaguaaacuauuuugaaaguucucuuuuugaa

SEQ ID NO: 473920 - RNA, 64 nt, Human
uuaguggccuguccuugaccugccgugguccuuuguaaacuauggcuccaugcugugugacaga

SEQ ID NO: 473921 - RNA, 62 nt, Human
cugggauuacaggcaugagccaccaugccuggccaggacauauuugaaauggggagauuuua

SEQ ID NO: 473922 - RNA, 62 nt, Human
aauaauguagugcagucacccuguggcaaaugccaggacagcugcaggugcccauuagcaac

SEQ ID NO: 473923 - RNA, 61 nt, Human
aauaccuauuucccuguuaagggggagggccccaggacaccccucaccuacuuucagcuuc

SEQ ID NO: 473924 - RNA, 62 nt, Human
ugugggcugggcucuggugcccucuucccuggccaggacaccucuccuccugauucccuugg

SEQ ID NO: 473925 - RNA, 64 nt, Human
cacuuggaaagauuuuccacauguagaccaacugguaaacuaacagagugauuaagcauggugu

SEQ ID NO: 473926 - RNA, 64 nt, Human
gcacuggugaagaggacauguuagagcaacauaaguaaacuacuugaaaauaguuguauauauu

SEQ ID NO: 473927 - RNA, 64 nt, Human
cugaaauuuggaaaaagaaauacuuuacuauugaguaaacuacaauauauuuagugcuacucgc

SEQ ID NO: 473928 - RNA, 64 nt, Human
uugaggaaaagcacuugugugauugaauugugagguaaacuaccugauuuuuuuuuguuguuac

SEQ ID NO: 473929 - RNA, 64 nt, Human
aguuucuguauuagucaccugccgugcacucacaguaaacuacauuacucaacugaguauuacc

SEQ ID NO: 473930 - RNA, 64 nt, Human
gguacauuuuaaacaaugcuucaguguagaagguguaaacuauuuugggcuugaugugcuguga

SEQ ID NO: 473931 - RNA, 64 nt, Human
ggacgugaguuaugucuggucccaaaacccuugaguaaacuagcugagccauugcaaaugaagg

SEQ ID NO: 473932 - RNA, 64 nt, Human
gaccaaggacaacaguuuuaggcuuccaaaggugguaaacuaugggaugguaaauauccgagag

SEQ ID NO: 473933 - RNA, 64 nt, Human
uuuauuuggugugcgugugucuuuauuauuuuguguaaacuauauucugcuuauagagagucuc

SEQ ID NO: 473934 - RNA, 64 nt, Human
uuuaaauuugcugauaacaaauguucugaaagaaguaaacuagccgggcacaguggcgugcgcc

SEQ ID NO: 473935 - RNA, 64 nt, Human
cuuuuaaguauagcuuccucccuugaaaaaaaauguaaacuaugacugcugagugauaaaacac

SEQ ID NO: 473936 - RNA, 64 nt, Human
caugugggcguagucaggcaaugcugugugcgaaguaaacuaccucaagguaugaaguuaccuc

SEQ ID NO: 473937 - RNA, 64 nt, Human
aaaugggugcuagugguaauugcuuuguggcuuaguaaacuacucuguggaugauuuccaaaca

SEQ ID NO: 473938 - RNA, 64 nt, Human
uugguacuugcugcuauuuuacugucuuaauuaaguaaacuaaugaguuucuuuuauaaaaaaa

SEQ ID NO: 473939 - RNA, 62 nt, Human
acucccuccaaacagaccuugaggcccaagacccaggacaaggaacagcaagcucagguggg

SEQ ID NO: 473940 - RNA, 62 nt, Human
gguccccuucuguuaccaccccccacccuccuccaggacaccacuagguggugcuggaugcu

SEQ ID NO: 473941 - RNA, 62 nt, Human
aggggagacagaggcagcuagggcuuggucucccaggacagagaguuacagaaaugggagac

SEQ ID NO: 473942 - RNA, 62 nt, Human
ggcugucuggacacguccuuagcgccugggaaccaggacauaaaagcgccuccggagccgcc

SEQ ID NO: 473943 - RNA, 64 nt, Human
auucuaauuguuuuuguuuguuuguuuuugccuuguaaacuagcgccaaggaacugcagcaaau

SEQ ID NO: 473944 - RNA, 64 nt, Human
gucacgccgcagcauggaugugucgcgccagagaguaaacuacaaauucuugugaguccuaauu

SEQ ID NO: 473945 - RNA, 64 nt, Human
uuagagaguggcaauaggaugagguuucuucaggguaaacuagcaaugccugagccugaaccuu

SEQ ID NO: 473946 - RNA, 64 nt, Human
cauaugcacacauauaaaaguugauacuguggcaguaaacuauuaaaaguuuucacuguucuuu

SEQ ID NO: 473947 - RNA, 64 nt, Human
auuuuaacacguuuuuaccaagaaagguggcaagguaaacuaacagcucaaauucccaauauaa

SEQ ID NO: 473948 - RNA, 64 nt, Human
aggcaacaugaccagaaaggauggaauggcuuaaguaaacuaaggguucacuucuagagcugag

SEQ ID NO: 473949 - RNA, 52 nt, Human
acuggagagaaacaauaugaauguaaacuauuauaaagccuucuauauuucc

SEQ ID NO: 473950 - RNA, 64 nt, Human
cccaggcccauuguaagccuaggucacaacaucuguaaacuaggagaacuggagaagacuccac

SEQ ID NO: 473951 - RNA, 64 nt, Human
uauacagucuauguguuuagaauuuguguuguaaguaaacuacagcuuugaguuggaaagaagu

SEQ ID NO: 473952 - RNA, 64 nt, Human
ucacugagggggagcugucuugucaucuuuuagaguaaacuauucuauaaacauaugcaaacag

SEQ ID NO: 473953 - RNA, 64 nt, Human
ucccagcaugggcggaugccgggcaugagcugcuguaaacuauuuguggcugugcugcuugagu

SEQ ID NO: 473954 - RNA, 64 nt, Human
uuuuuauuguaguuuuuuugggugggugggggaaguaaacuagacugaagcgauggauuuuuuu

SEQ ID NO: 473955 - RNA, 64 nt, Human
cuugaagcuuuuucugccuccugauucucucuuuguaaacuauuuucaaauuguuuuucaacuc

SEQ ID NO: 473956 - RNA, 64 nt, Human
cucucucuacaaacucccacuugucaugugacagguaaacuaucuuggugaauuuuuuuuuccu

SEQ ID NO: 473957 - RNA, 62 nt, Human
agcugcccucuacgaucaggugcaggggcugcccaggacaaagcgggggcaggggaaagaca

SEQ ID NO: 473958 - RNA, 62 nt, Human
uccuguccccgcaggugcacguucaucgggaaccaggacacuuacgagacccaccuggagac

SEQ ID NO: 473959 - RNA, 62 nt, Human
gacguggccugcggccgggcugcccuucgcugccaggacaccugccccagcgcggcuuggcc

SEQ ID NO: 473960 - RNA, 62 nt, Human
ccuaccccagaugcuaaagugauucaaggacuccaggacaccucuuaagagccuuucuaaga

SEQ ID NO: 473961 - RNA, 64 nt, Human
ucacaacccaauaaauggggcacuuucuucuuuuguaaacuauuaucauuuugguuucugugac

SEQ ID NO: 473962 - RNA, 62 nt, Human
aacgugcaaugcaucagaauaaaagacaugcaaaguaaacuacccugggcuaccucuuuuuu

SEQ ID NO: 473963 - RNA, 64 nt, Human
cauaacuuuuggcacaugacauagaaauggcuauguaaacuauaauuauuuugcuaagagacug

SEQ ID NO: 473964 - RNA, 64 nt, Human
uggagcuuucagcuuugaacaaaaucccuucauuguaaacuagcaccaucuuuauccaggucuu

SEQ ID NO: 473965 - RNA, 64 nt, Human
cgggguuggggggcauggugcagucggccuucacguaaacuaaguaggcagguaggaucugaag

SEQ ID NO: 473966 - RNA, 64 nt, Human
aaaaggaugguuugggcauauugguauaguuugaguaaacuaagguuaauguucauauaacauu

SEQ ID NO: 473967 - RNA, 64 nt, Human
uugggaucuaacuguuguuacuggaagacgaaguguaaacuaaggggcuuugcuuuucaaacca

SEQ ID NO: 473968 - RNA, 64 nt, Human
agaguugaaaggaaagauugaacuggaauauuguguaaacuaucugucuuacauuaguguagca

SEQ ID NO: 473969 - RNA, 64 nt, Human
gcauccaaagcacgagucacuuaaaauaucgacgguaaacuacuauuuuguagagaaacucagg

SEQ ID NO: 473970 - RNA, 64 nt, Human
accuugauuuuguaauuuagaagcaacacacauuguaaacuauucauuuucuccaccuuguuua

SEQ ID NO: 473971 - RNA, 64 nt, Human
uuaucuuaaaaucauauuugaagacaguaagacaguaaacuauuuuaggaagucaacccccauu

SEQ ID NO: 473972 - RNA, 64 nt, Human
cucucccaagauucauuuaguucaaacaguauccguaaacuaggaauaaugccacaugcauuca

SEQ ID NO: 473973 - RNA, 64 nt, Human
ggcugaagccaaaaguaaggaggguggccaaaugguaaacuauugguacuuguuuucuaccucc

SEQ ID NO: 473974 - RNA, 64 nt, Human
uucuguucuguaagucuagaccuucaaaccauuuguaaacuaaccccugggaaauuugaaauua

SEQ ID NO: 473975 - RNA, 62 nt, Human
cuccacagccagccuguccaacagaggggcagccaggacaucucugcccucuucucaucccc

SEQ ID NO: 473976 - RNA, 62 nt, Human
aggcagaagagucuaauugugccuggauuucuccaggacagcaguggccccucguuuuauca

SEQ ID NO: 473977 - RNA, 62 nt, Human
uggaagggacuucucccgcaccccacucugucccaggacauagggcagggggccucacugcc

SEQ ID NO: 473978 - RNA, 62 nt, Human
gguucugcccaugcuagggggugggggagcucccaggacagaccagccuuguuucucaugua

SEQ ID NO: 473979 - RNA, 64 nt, Human
uauguuauaugauacgagcacaacuugagcuacaguaaacuacaugacaguguuuugauaauug

SEQ ID NO: 473980 - RNA, 64 nt, Human
uauguuauaugauacaagcacaacuugagcuacaguaaacuacaugacaguguuuugauaauug

SEQ ID NO: 473981 - RNA, 64 nt, Human
cuggccccuaaagagaccgcuucuuaccaagccuguaaacuaugcaugauggaaauucuuguau

SEQ ID NO: 473982 - RNA, 64 nt, Human
guuuaaaaauuuauaacaguuauaaagaaagauuguaaacuaaagugugcuuuauaaaaaaaag

SEQ ID NO: 473983 - RNA, 64 nt, Human
uugaaaaaguuucuucaucuuauauuguguaauuguaaacuaaagauaccguguuuucuuugua

SEQ ID NO: 473984 - RNA, 64 nt, Human
cccaguacuuuuagccaaccuuaccaagugguguguaaacuaguauguaugugcuuugcuuacu

SEQ ID NO: 473985 - RNA, 64 nt, Human
ggccuacgagguuuuugccccauuuuacagaauaguaaacuaagagccaugaaaaucacuuggc

SEQ ID NO: 473986 - RNA, 64 nt, Human; identical to SEQ ID NO: 473969

SEQ ID NO: 473987 - RNA, 64 nt, Human; identical to SEQ ID NO: 473712

SEQ ID NO: 473988 - RNA, 64 nt, Human; identical to SEQ ID NO: 473713

SEQ ID NO: 473989 - RNA, 64 nt, Human; identical to SEQ ID NO: 473714

SEQ ID NO: 473990 - RNA, 64 nt, Human; identical to SEQ ID NO: 473715

SEQ ID NO: 473991 - RNA, 64 nt, Human; identical to SEQ ID NO: 473716

SEQ ID NO: 473992 - RNA, 64 nt, Human; identical to SEQ ID NO: 473717

SEQ ID NO: 473993 - RNA, 62 nt, Human
cacuguugccucccagugacccugcugggacaccaggacaaggaagacaguuucgccucucg

SEQ ID NO: 473994 - RNA, 62 nt, Human
cuuuggugacacacucacuucuuucucagccuccaggacacuauggccuguuuuaagagaca

SEQ ID NO: 473995 - RNA, 62 nt, Human
acaguagcaaaacauaaauuaaaacucaaaugccaggacaaaauaaaacaauauaccagaug

SEQ ID NO: 473996 - RNA, 62 nt, Human
ccuuccaugggggucugggcuauuggcuggagccaggacaugagucaggggcaccauggacc

SEQ ID NO: 473997 - RNA, 64 nt, Human; identical to SEQ ID NO: 473718

SEQ ID NO: 473998 - RNA, 64 nt, Human; identical to SEQ ID NO: 473719

SEQ ID NO: 473999 - RNA, 64 nt, Human; identical to SEQ ID NO: 473720

SEQ ID NO: 474000 - RNA, 64 nt, Human; identical to SEQ ID NO: 473721

SEQ ID NO: 474001 - RNA, 64 nt, Human; identical to SEQ ID NO: 473722

SEQ ID NO: 474002 - RNA, 64 nt, Human; identical to SEQ ID NO: 473727

SEQ ID NO: 474003 - RNA, 64 nt, Human; identical to SEQ ID NO: 473728

SEQ ID NO: 474004 - RNA, 64 nt, Human; identical to SEQ ID NO: 473729

SEQ ID NO: 474005 - RNA, 64 nt, Human; identical to SEQ ID NO: 473730

SEQ ID NO: 474006 - RNA, 64 nt, Human; identical to SEQ ID NO: 473731

SEQ ID NO: 474007 - RNA, 64 nt, Human; identical to SEQ ID NO: 473732

SEQ ID NO: 474008 - RNA, 64 nt, Human; identical to SEQ ID NO: 473733

SEQ ID NO: 474009 - RNA, 64 nt, Human; identical to SEQ ID NO: 473734

SEQ ID NO: 474010 - RNA, 64 nt, Human; identical to SEQ ID NO: 473735

SEQ ID NO: 474011 - RNA, 62 nt, Human
caugaaggaugagagauguuuugaaaaacuagccaggacacacccacaggauccuacuggcu

SEQ ID NO: 474012 - RNA, 62 nt, Human
caccugcugcccuucgauccuuccacacauggccaggacacugccacaauccucggggugug

SEQ ID NO: 474013 - RNA, 62 nt, Human
cuucugcacauacuggggcccugcuuauucucccaggacaggcuccuuaaagcagaggagcc

SEQ ID NO: 474014 - RNA, 51 nt, Human
augcccccuuccacaugugagccaggacaugaggcuucccugaagcaagga

SEQ ID NO: 474015 - RNA, 64 nt, Human; identical to SEQ ID NO: 473736

SEQ ID NO: 474016 - RNA, 64 nt, Human; identical to SEQ ID NO: 473737

SEQ ID NO: 474017 - RNA, 64 nt, Human; identical to SEQ ID NO: 473738

SEQ ID NO: 474018 - RNA, 64 nt, Human; identical to SEQ ID NO: 473739

SEQ ID NO: 474019 - RNA, 64 nt, Human; identical to SEQ ID NO: 473740

SEQ ID NO: 474020 - RNA, 64 nt, Human; identical to SEQ ID NO: 473745

SEQ ID NO: 474021 - RNA, 64 nt, Human; identical to SEQ ID NO: 473746

SEQ ID NO: 474022 - RNA, 64 nt, Human; identical to SEQ ID NO: 473747

SEQ ID NO: 474023 - RNA, 64 nt, Human; identical to SEQ ID NO: 473748

SEQ ID NO: 474024 - RNA, 64 nt, Human; identical to SEQ ID NO: 473749

SEQ ID NO: 474025 - RNA, 64 nt, Human; identical to SEQ ID NO: 473750

SEQ ID NO: 474026 - RNA, 64 nt, Human; identical to SEQ ID NO: 473751

SEQ ID NO: 474027 - RNA, 64 nt, Human; identical to SEQ ID NO: 473752

SEQ ID NO: 474028 - RNA, 64 nt, Human; identical to SEQ ID NO: 473753

SEQ ID NO: 474029 - RNA, 62 nt, Human
aggcuccagaggagacuuugaguugaugggggccaggacaccaguccagguaguguugagac

SEQ ID NO: 474030 - RNA, 62 nt, Human
gccugacacuacuaaaugauuugguagugaagccaggacaucuacccuugacuauuuuuuau

SEQ ID NO: 474031 - RNA, 62 nt, Human
cguguccaagugcuggcagacacccuggucacccaggacagagcggaaaaaaaaaaaagagg

SEQ ID NO: 474032 - RNA, 62 nt, Human
gccucuggcgcccccacucaagacuaccaaagccaggacaccucaagucuccagccccacua

SEQ ID NO: 474033 - RNA, 64 nt, Human; identical to SEQ ID NO: 473754

SEQ ID NO: 474034 - RNA, 64 nt, Human; identical to SEQ ID NO: 473755

SEQ ID NO: 474035 - RNA, 64 nt, Human; identical to SEQ ID NO: 473756

SEQ ID NO: 474036 - RNA, 64 nt, Human; identical to SEQ ID NO: 473757

SEQ ID NO: 474037 - RNA, 64 nt, Human; identical to SEQ ID NO: 473758

SEQ ID NO: 474038 - RNA, 64 nt, Human; identical to SEQ ID NO: 473763

SEQ ID NO: 474039 - RNA, 64 nt, Human; identical to SEQ ID NO: 473764

SEQ ID NO: 474040 - RNA, 64 nt, Human; identical to SEQ ID NO: 473765

SEQ ID NO: 474041 - RNA, 64 nt, Human; identical to SEQ ID NO: 473766

SEQ ID NO: 474042 - RNA, 64 nt, Human; identical to SEQ ID NO: 473767

SEQ ID NO: 474043 - RNA, 64 nt, Human; identical to SEQ ID NO: 473768

SEQ ID NO: 474044 - RNA, 64 nt, Human; identical to SEQ ID NO: 473769

SEQ ID NO: 474045 - RNA, 64 nt, Human; identical to SEQ ID NO: 473770

SEQ ID NO: 474046 - RNA, 64 nt, Human; identical to SEQ ID NO: 473771

SEQ ID NO: 474047 - RNA, 62 nt, Human
acugugcugugugcuggaaaaugaucccggggccaggacagacaaaccagagccucugcgcc

SEQ ID NO: 474048 - RNA, 62 nt, Human
auagggaaaggcuucucuccaagugugccaggccaggacagcccucccagccaugaauccuu

SEQ ID NO: 474049 - RNA, 62 nt, Human
gaagcccuggggcaaccuccucggccaccccuccaggacagucccucucuguggagaacuga

SEQ ID NO: 474050 - RNA, 62 nt, Human
gggcugaauggucgcugagacagagauggaagccaggacaagggagcccaccgggcccagau

SEQ ID NO: 474051 - RNA, 64 nt, Human; identical to SEQ ID NO: 473772

SEQ ID NO: 474052 - RNA, 64 nt, Human; identical to SEQ ID NO: 473773

SEQ ID NO: 474053 - RNA, 64 nt, Human; identical to SEQ ID NO: 473774

SEQ ID NO: 474054 - RNA, 64 nt, Human; identical to SEQ ID NO: 473775

SEQ ID NO: 474055 - RNA, 64 nt, Human; identical to SEQ ID NO: 473776

SEQ ID NO: 474056 - RNA, 64 nt, Human; identical to SEQ ID NO: 473781

SEQ ID NO: 474057 - RNA, 64 nt, Human; identical to SEQ ID NO: 473782

SEQ ID NO: 474058 - RNA, 64 nt, Human; identical to SEQ ID NO: 473783

SEQ ID NO: 474059 - RNA, 64 nt, Human; identical to SEQ ID NO: 473784

SEQ ID NO: 474060 - RNA, 64 nt, Human; identical to SEQ ID NO: 473785

SEQ ID NO: 474061 - RNA, 64 nt, Human; identical to SEQ ID NO: 473786

SEQ ID NO: 474062 - RNA, 64 nt, Human; identical to SEQ ID NO: 473787

SEQ ID NO: 474063 - RNA, 64 nt, Human; identical to SEQ ID NO: 473788

SEQ ID NO: 474064 - RNA, 64 nt, Human; identical to SEQ ID NO: 473789

SEQ ID NO: 474065 - RNA, 62 nt, Human
ggcuuuuguguguuuugggagaugucaccuaaccaggacauugauauucaaucccauccccc

SEQ ID NO: 474066 - RNA, 62 nt, Human
gagccaggcgcuuagaggaagaccaaaugcugccaggacacggauuguccagggauuacauu

SEQ ID NO: 474067 - RNA, 62 nt, Human
auggggagcccucuggggaugagcaaggccuuccaggacaggcucgguucugguccccugcu

SEQ ID NO: 474068 - RNA, 62 nt, Human
ggaggaagcugcucacuucucccuggaaguccccaggacagaccgaugccccugacagcccc

SEQ ID NO: 474069 - RNA, 64 nt, Human; identical to SEQ ID NO: 473790

SEQ ID NO: 474070 - RNA, 64 nt, Human; identical to SEQ ID NO: 473791

SEQ ID NO: 474071 - RNA, 64 nt, Human; identical to SEQ ID NO: 473792

SEQ ID NO: 474072 - RNA, 64 nt, Human; identical to SEQ ID NO: 473793

SEQ ID NO: 474073 - RNA, 64 nt, Human; identical to SEQ ID NO: 473794

SEQ ID NO: 474074 - RNA, 64 nt, Human; identical to SEQ ID NO: 473799

SEQ ID NO: 474075 - RNA, 64 nt, Human; identical to SEQ ID NO: 473800

SEQ ID NO: 474076 - RNA, 64 nt, Human; identical to SEQ ID NO: 473801

SEQ ID NO: 474077 - RNA, 64 nt, Human; identical to SEQ ID NO: 473802

SEQ ID NO: 474078 - RNA, 64 nt, Human; identical to SEQ ID NO: 473803

SEQ ID NO: 474079 - RNA, 64 nt, Human; identical to SEQ ID NO: 473804

SEQ ID NO: 474080 - RNA, 64 nt, Human; identical to SEQ ID NO: 473805

SEQ ID NO: 474081 - RNA, 64 nt, Human; identical to SEQ ID NO: 473806

SEQ ID NO: 474082 - RNA, 64 nt, Human; identical to SEQ ID NO: 473807

SEQ ID NO: 474083 - RNA, 62 nt, Human
ugaauaccugucaguauuuuaaaguuggcaauccaggacauuauaaguaggauggagcagga

SEQ ID NO: 474084 - RNA, 62 nt, Human
agcccagaguuuacugacuuguaauucucuauccaggacaucaggagugagggauggaaaag

SEQ ID NO: 474085 - RNA, 62 nt, Human; identical to SEQ ID NO: 472702

SEQ ID NO: 474086 - RNA, 62 nt, Human; identical to SEQ ID NO: 470825

SEQ ID NO: 474087 - RNA, 58 nt, Human; identical to SEQ ID NO: 473808

SEQ ID NO: 474088 - RNA, 64 nt, Human; identical to SEQ ID NO: 473809

SEQ ID NO: 474089 - RNA, 64 nt, Human; identical to SEQ ID NO: 473810

SEQ ID NO: 474090 - RNA, 64 nt, Human; identical to SEQ ID NO: 473811

SEQ ID NO: 474091 - RNA, 64 nt, Human; identical to SEQ ID NO: 473812

SEQ ID NO: 474092 - RNA, 64 nt, Human; identical to SEQ ID NO: 473817

SEQ ID NO: 474093 - RNA, 64 nt, Human; identical to SEQ ID NO: 473818

SEQ ID NO: 474094 - RNA, 64 nt, Human; identical to SEQ ID NO: 473819

SEQ ID NO: 474095 - RNA, 64 nt, Human; identical to SEQ ID NO: 473820

SEQ ID NO: 474096 - RNA, 64 nt, Human; identical to SEQ ID NO: 473821

SEQ ID NO: 474097 - RNA, 64 nt, Human; identical to SEQ ID NO: 473822

SEQ ID NO: 474098 - RNA, 64 nt, Human; identical to SEQ ID NO: 473823

SEQ ID NO: 474099 - RNA, 64 nt, Human; identical to SEQ ID NO: 473824

SEQ ID NO: 474100 - RNA, 64 nt, Human; identical to SEQ ID NO: 473825

SEQ ID NO: 474101 - RNA, 62 nt, Human
acguguucaaguccugaaacaggcuccccucaccaggacagucacccccaaacuugaccccc

SEQ ID NO: 474102 - RNA, 62 nt, Human
ccagagauuagcccucauuccgcaucugucaaccaggacagaaagcauggacaagggaugag

SEQ ID NO: 474103 - RNA, 62 nt, Human
uccauaggaaacugggaaucucauaggaagagccaggacaugaagaaaaggaaauaugaucc

SEQ ID NO: 474104 - RNA, 62 nt, Human
caacaagagcgaaacuccgucuuagaaguggaccaggacaggaccagauuuuggagucaugg

SEQ ID NO: 474105 - RNA, 64 nt, Human; identical to SEQ ID NO: 473826

SEQ ID NO: 474106 - RNA, 64 nt, Human; identical to SEQ ID NO: 473827

SEQ ID NO: 474107 - RNA, 64 nt, Human; identical to SEQ ID NO: 473828

SEQ ID NO: 474108 - RNA, 64 nt, Human; identical to SEQ ID NO: 473829

SEQ ID NO: 474109 - RNA, 64 nt, Human; identical to SEQ ID NO: 473830

SEQ ID NO: 474110 - RNA, 64 nt, Human; identical to SEQ ID NO: 473835

SEQ ID NO: 474111 - RNA, 64 nt, Human; identical to SEQ ID NO: 473836

SEQ ID NO: 474112 - RNA, 64 nt, Human; identical to SEQ ID NO: 473837

SEQ ID NO: 474113 - RNA, 64 nt, Human; identical to SEQ ID NO: 473838

SEQ ID NO: 474114 - RNA, 64 nt, Human; identical to SEQ ID NO: 473839

SEQ ID NO: 474115 - RNA, 64 nt, Human; identical to SEQ ID NO: 473840

SEQ ID NO: 474116 - RNA, 64 nt, Human; identical to SEQ ID NO: 473841

SEQ ID NO: 474117 - RNA, 64 nt, Human; identical to SEQ ID NO: 473842

SEQ ID NO: 474118 - RNA, 64 nt, Human; identical to SEQ ID NO: 473843

SEQ ID NO: 474119 - RNA, 62 nt, Human
cacccaagcauauauaacuagcuagaagugggccaggacaggcccggcgcgguggcucacgc

SEQ ID NO: 474120 - RNA, 62 nt, Human
ggaggggguggagugaagcucagggcuugcagccaggacacugcccacuggagccugucauc

SEQ ID NO: 474121 - RNA, 62 nt, Human
cuagacugcauuagauucauucaucucauuugccaggacauguuggccagaggucugggccc

SEQ ID NO: 474122 - RNA, 62 nt, Human
auucuuaccuccccaaaagcagcauauuaggcccaggacauaccugaaggcuggucgacuuu

SEQ ID NO: 474123 - RNA, 64 nt, Human; identical to SEQ ID NO: 473844

SEQ ID NO: 474124 - RNA, 64 nt, Human; identical to SEQ ID NO: 473845

SEQ ID NO: 474125 - RNA, 64 nt, Human; identical to SEQ ID NO: 473846

SEQ ID NO: 474126 - RNA, 64 nt, Human; identical to SEQ ID NO: 473847

SEQ ID NO: 474127 - RNA, 64 nt, Human; identical to SEQ ID NO: 473848

SEQ ID NO: 474128 - RNA, 64 nt, Human; identical to SEQ ID NO: 473853

SEQ ID NO: 474129 - RNA, 64 nt, Human; identical to SEQ ID NO: 473854

SEQ ID NO: 474130 - RNA, 64 nt, Human; identical to SEQ ID NO: 473855

SEQ ID NO: 474131 - RNA, 64 nt, Human; identical to SEQ ID NO: 473856

SEQ ID NO: 474132 - RNA, 64 nt, Human; identical to SEQ ID NO: 473857

SEQ ID NO: 474133 - RNA, 64 nt, Human; identical to SEQ ID NO: 473858

SEQ ID NO: 474134 - RNA, 64 nt, Human; identical to SEQ ID NO: 473859

SEQ ID NO: 474135 - RNA, 64 nt, Human; identical to SEQ ID NO: 473860

SEQ ID NO: 474136 - RNA, 64 nt, Human; identical to SEQ ID NO: 473861

SEQ ID NO: 474137 - RNA, 62 nt, Human
gcagacacagcaggacagggcucuaugugcggccaggacagcagaggcugaggggccggggu

SEQ ID NO: 474138 - RNA, 62 nt, Human
cgcggccccgagccuggggcuggacgcaggucccaggacaugcugcucccuugugugaguga

SEQ ID NO: 474139 - RNA, 62 nt, Human
gaagcagcuguaacugcccuaguguaguuugaccaggacauugucgugcuccuuccaauugu

SEQ ID NO: 474140 - RNA, 62 nt, Human
agcugcugcccugggcagaggggaggagaauuccaggacaagagugucaaggacagggauuu

SEQ ID NO: 474141 - RNA, 64 nt, Human; identical to SEQ ID NO: 473862

SEQ ID NO: 474142 - RNA, 64 nt, Human; identical to SEQ ID NO: 473863

SEQ ID NO: 474143 - RNA, 64 nt, Human; identical to SEQ ID NO: 473864

SEQ ID NO: 474144 - RNA, 64 nt, Human; identical to SEQ ID NO: 473865

SEQ ID NO: 474145 - RNA, 64 nt, Human; identical to SEQ ID NO: 473866

SEQ ID NO: 474146 - RNA, 64 nt, Human; identical to SEQ ID NO: 473871

SEQ ID NO: 474147 - RNA, 64 nt, Human; identical to SEQ ID NO: 473872

SEQ ID NO: 474148 - RNA, 64 nt, Human; identical to SEQ ID NO: 473873

SEQ ID NO: 474149 - RNA, 64 nt, Human; identical to SEQ ID NO: 473874

SEQ ID NO: 474150 - RNA, 64 nt, Human; identical to SEQ ID NO: 473875

SEQ ID NO: 474151 - RNA, 64 nt, Human; identical to SEQ ID NO: 473876

SEQ ID NO: 474152 - RNA, 64 nt, Human; identical to SEQ ID NO: 473877

SEQ ID NO: 474153 - RNA, 64 nt, Human; identical to SEQ ID NO: 473878

SEQ ID NO: 474154 - RNA, 64 nt, Human; identical to SEQ ID NO: 473879

SEQ ID NO: 474155 - RNA, 62 nt, Human
caucauccaccauuuaguaaaauguagcuggcccaggacauguaaaaaaaaaaaaaaaacaa

SEQ ID NO: 474156 - RNA, 62 nt, Human
uuugauuauuaaagugagcuauguguuaagugccaggacauuucuagcuuuugugagaaugu

SEQ ID NO: 474157 - RNA, 62 nt, Human
uucagguuuuggucaauacuugacaagggugcccaggacaggaagacguguacugcugagug

SEQ ID NO: 474158 - RNA, 62 nt, Human
cggugccaagagccauccccgccaacagccagccaggacacggggccucaguccacagccac

SEQ ID NO: 474159 - RNA, 64 nt, Human; identical to SEQ ID NO: 473880

SEQ ID NO: 474160 - RNA, 64 nt, Human; identical to SEQ ID NO: 473881

SEQ ID NO: 474161 - RNA, 64 nt, Human; identical to SEQ ID NO: 473882

SEQ ID NO: 474162 - RNA, 64 nt, Human; identical to SEQ ID NO: 473883

SEQ ID NO: 474163 - RNA, 64 nt, Human; identical to SEQ ID NO: 473884

SEQ ID NO: 474164 - RNA, 64 nt, Human; identical to SEQ ID NO: 473889

SEQ ID NO: 474165 - RNA, 64 nt, Human; identical to SEQ ID NO: 473890

SEQ ID NO: 474166 - RNA, 64 nt, Human; identical to SEQ ID NO: 473891

SEQ ID NO: 474167 - RNA, 64 nt, Human; identical to SEQ ID NO: 473892

SEQ ID NO: 474168 - RNA, 64 nt, Human; identical to SEQ ID NO: 473893

SEQ ID NO: 474169 - RNA, 64 nt, Human; identical to SEQ ID NO: 473894

SEQ ID NO: 474170 - RNA, 64 nt, Human; identical to SEQ ID NO: 473895

SEQ ID NO: 474171 - RNA, 64 nt, Human; identical to SEQ ID NO: 473896

SEQ ID NO: 474172 - RNA, 64 nt, Human; identical to SEQ ID NO: 473897

SEQ ID NO: 474173 - RNA, 62 nt, Human
ggggacaaggaugacaccgaagguccaggaguccaggacagcaggugcuggccgguggggag

SEQ ID NO: 474174 - RNA, 62 nt, Human
uggaccaaucuacucggggaauuccaggcccaccaggacacgugccaauggccccauucaga

SEQ ID NO: 474175 - RNA, 62 nt, Human
uggaucuuuagauggaugaccaccugaccauuccaggacaauuuuuggucccauuuugagga

SEQ ID NO: 474176 - RNA, 62 nt, Human
uuuggugcucccucagaggaacucucccucacccaggacagccuguggccuuugugagccag

SEQ ID NO: 474177 - RNA, 64 nt, Human; identical to SEQ ID NO: 473898

SEQ ID NO: 474178 - RNA, 64 nt, Human; identical to SEQ ID NO: 473899

SEQ ID NO: 474179 - RNA, 64 nt, Human; identical to SEQ ID NO: 473900

SEQ ID NO: 474180 - RNA, 64 nt, Human; identical to SEQ ID NO: 473901

SEQ ID NO: 474181 - RNA, 64 nt, Human; identical to SEQ ID NO: 473902

SEQ ID NO: 474182 - RNA, 64 nt, Human; identical to SEQ ID NO: 473907

SEQ ID NO: 474183 - RNA, 64 nt, Human; identical to SEQ ID NO: 473908

SEQ ID NO: 474184 - RNA, 64 nt, Human; identical to SEQ ID NO: 473909

SEQ ID NO: 474185 - RNA, 64 nt, Human; identical to SEQ ID NO: 473910

SEQ ID NO: 474186 - RNA, 64 nt, Human; identical to SEQ ID NO: 473911

SEQ ID NO: 474187 - RNA, 64 nt, Human; identical to SEQ ID NO: 473912

SEQ ID NO: 474188 - RNA, 64 nt, Human; identical to SEQ ID NO: 473913

SEQ ID NO: 474189 - RNA, 64 nt, Human; identical to SEQ ID NO: 473914

SEQ ID NO: 474190 - RNA, 64 nt, Human; identical to SEQ ID NO: 473915

SEQ ID NO: 474191 - RNA, 62 nt, Human
ccuuuggcuuggcgagauuugggggugcuaauccaggacagcauuacacgccacaacuccag

SEQ ID NO: 474192 - RNA, 62 nt, Human
caugccacagucuggcuuucccuccaucugccccaggacaagagcaagaaggacaucaguug

SEQ ID NO: 474193 - RNA, 62 nt, Human
cuucucccuuaccagugaccccagagacagagccaggacaggagugggggccagccugagga

SEQ ID NO: 474194 - RNA, 62 nt, Human
gaacuuggacuuuuccccugugaagggggcugccaggacaucucagcacucccgccuggagc

SEQ ID NO: 474195 - RNA, 64 nt, Human; identical to SEQ ID NO: 473916

SEQ ID NO: 474196 - RNA, 64 nt, Human; identical to SEQ ID NO: 473917

SEQ ID NO: 474197 - RNA, 64 nt, Human; identical to SEQ ID NO: 473918

SEQ ID NO: 474198 - RNA, 64 nt, Human; identical to SEQ ID NO: 473919

SEQ ID NO: 474199 - RNA, 64 nt, Human; identical to SEQ ID NO: 473920

SEQ ID NO: 474200 - RNA, 64 nt, Human; identical to SEQ ID NO: 473925

SEQ ID NO: 474201 - RNA, 64 nt, Human; identical to SEQ ID NO: 473926

SEQ ID NO: 474202 - RNA, 64 nt, Human; identical to SEQ ID NO: 473927

SEQ ID NO: 474203 - RNA, 64 nt, Human; identical to SEQ ID NO: 473928

SEQ ID NO: 474204 - RNA, 64 nt, Human; identical to SEQ ID NO: 473929

SEQ ID NO: 474205 - RNA, 64 nt, Human; identical to SEQ ID NO: 473930

SEQ ID NO: 474206 - RNA, 64 nt, Human; identical to SEQ ID NO: 473931

SEQ ID NO: 474207 - RNA, 64 nt, Human; identical to SEQ ID NO: 473932

SEQ ID NO: 474208 - RNA, 64 nt, Human; identical to SEQ ID NO: 473933

SEQ ID NO: 474209 - RNA, 62 nt, Human
uccuuccaucuuuuagggaacggggaguggauccaggacaggggagguuguaaccccugaga

SEQ ID NO: 474210 - RNA, 62 nt, Human
uuccggugcuuucccauccugggccacuguauccaggacaucacucccaugccagcccuccc

SEQ ID NO: 474211 - RNA, 62 nt, Human
uugccucucaagguggacuauucuguuuucugccaggacacugccauucaugcauugucaga

SEQ ID NO: 474212 - RNA, 62 nt, Human
ucccaccagcagcccggucagacugaaguguuccaggacaugcugcccaugccaggagaucc

SEQ ID NO: 474213 - RNA, 64 nt, Human; identical to SEQ ID NO: 473934

SEQ ID NO: 474214 - RNA, 64 nt, Human; identical to SEQ ID NO: 473935

SEQ ID NO: 474215 - RNA, 64 nt, Human; identical to SEQ ID NO: 473936

SEQ ID NO: 474216 - RNA, 64 nt, Human; identical to SEQ ID NO: 473937

SEQ ID NO: 474217 - RNA, 64 nt, Human; identical to SEQ ID NO: 473938

SEQ ID NO: 474218 - RNA, 64 nt, Human; identical to SEQ ID NO: 473943

SEQ ID NO: 474219 - RNA, 64 nt, Human; identical to SEQ ID NO: 473944

SEQ ID NO: 474220 - RNA, 64 nt, Human; identical to SEQ ID NO: 473945

SEQ ID NO: 474221 - RNA, 64 nt, Human; identical to SEQ ID NO: 473946

SEQ ID NO: 474222 - RNA, 64 nt, Human; identical to SEQ ID NO: 473947

SEQ ID NO: 474223 - RNA, 64 nt, Human; identical to SEQ ID NO: 473948

SEQ ID NO: 474224 - RNA, 52 nt, Human; identical to SEQ ID NO: 473949

SEQ ID NO: 474225 - RNA, 64 nt, Human; identical to SEQ ID NO: 473950

SEQ ID NO: 474226 - RNA, 64 nt, Human; identical to SEQ ID NO: 473951

SEQ ID NO: 474227 - RNA, 62 nt, Human
uucagguucucucuggagaaagguuagagaccccaggacaaucaacaugugcaccguucccc

SEQ ID NO: 474228 - RNA, 62 nt, Human
agacuugggccguugcucugacauggacacagccaggacaagcugcucagaccuacuuccuu

SEQ ID NO: 474229 - RNA, 62 nt, Human; identical to SEQ ID NO: 474191

SEQ ID NO: 474230 - RNA, 62 nt, Human
ccuuuuucauaccuagugggauacagaagaagccaggacaguggcuuugccagcuaagugac

SEQ ID NO: 474231 - RNA, 64 nt, Human; identical to SEQ ID NO: 473952

SEQ ID NO: 474232 - RNA, 64 nt, Human; identical to SEQ ID NO: 473953

SEQ ID NO: 474233 - RNA, 64 nt, Human; identical to SEQ ID NO: 473954

SEQ ID NO: 474234 - RNA, 64 nt, Human; identical to SEQ ID NO: 473955

SEQ ID NO: 474235 - RNA, 64 nt, Human; identical to SEQ ID NO: 473956

SEQ ID NO: 474236 - RNA, 64 nt, Human; identical to SEQ ID NO: 473961

SEQ ID NO: 474237 - RNA, 62 nt, Human; identical to SEQ ID NO: 473962

SEQ ID NO: 474238 - RNA, 64 nt, Human; identical to SEQ ID NO: 473963

SEQ ID NO: 474239 - RNA, 64 nt, Human; identical to SEQ ID NO: 473964

SEQ ID NO: 474240 - RNA, 64 nt, Human; identical to SEQ ID NO: 473965

SEQ ID NO: 474241 - RNA, 64 nt, Human; identical to SEQ ID NO: 473966

SEQ ID NO: 474242 - RNA, 64 nt, Human; identical to SEQ ID NO: 473967

SEQ ID NO: 474243 - RNA, 64 nt, Human; identical to SEQ ID NO: 473968

SEQ ID NO: 474244 - RNA, 64 nt, Human; identical to SEQ ID NO: 473969

SEQ ID NO: 474245 - RNA, 62 nt, Human
gaaggcugggguggugcaggggccuugggcucccaggacaggugaacagggagggaccuccc

SEQ ID NO: 474246 - RNA, 62 nt, Human
ucuuuagucuugauaucuaccugucuguucagccaggacaacaaauggcuuccaagccugaa

SEQ ID NO: 474247 - RNA, 62 nt, Human
cccuuguaacaaaauauguuuugguauaguuaccaggacacuuacugauuaauuuuuaacaa

SEQ ID NO: 474248 - RNA, 62 nt, Human
gccuugguggcaaauaucucaucugccggcccccaggacaagugguaugaccagugauaaug

SEQ ID NO: 474249 - RNA, 64 nt, Human; identical to SEQ ID NO: 473970

SEQ ID NO: 474250 - RNA, 64 nt, Human; identical to SEQ ID NO: 473971

SEQ ID NO: 474251 - RNA, 64 nt, Human; identical to SEQ ID NO: 473972

SEQ ID NO: 474252 - RNA, 64 nt, Human; identical to SEQ ID NO: 473973

SEQ ID NO: 474253 - RNA, 64 nt, Human; identical to SEQ ID NO: 473974

SEQ ID NO: 474254 - RNA, 64 nt, Human; identical to SEQ ID NO: 473979

SEQ ID NO: 474255 - RNA, 64 nt, Human; identical to SEQ ID NO: 473980

SEQ ID NO: 474256 - RNA, 64 nt, Human; identical to SEQ ID NO: 473981

SEQ ID NO: 474257 - RNA, 64 nt, Human; identical to SEQ ID NO: 473982

SEQ ID NO: 474258 - RNA, 64 nt, Human; identical to SEQ ID NO: 473983

SEQ ID NO: 474259 - RNA, 64 nt, Human; identical to SEQ ID NO: 473984

SEQ ID NO: 474260 - RNA, 64 nt, Human; identical to SEQ ID NO: 473985

SEQ ID NO: 474261 - RNA, 64 nt, Human; identical to SEQ ID NO: 473969

SEQ ID NO: 474262 - RNA, 64 nt, Human; identical to SEQ ID NO: 473712

SEQ ID NO: 474263 - RNA, 62 nt, Human
ugccagagucuuccccuugcucauccucauuuccaggacacugucauuuuaguggucugagu

SEQ ID NO: 474264 - RNA, 62 nt, Human
ggccaacuuggcaggacuuggccagcagcugcccaggacacagugcaggccagagcgggcuu

SEQ ID NO: 474265 - RNA, 62 nt, Human
cuacugcagacggcccaacauccagucuuuccccaggacagagcuaacaagggccccuuugc

SEQ ID NO: 474266 - RNA, 62 nt, Human
ccagagccuguugugucucaguugggugguccccaggacacugccuguggggaccugcccug

SEQ ID NO: 474267 - RNA, 64 nt, Human; identical to SEQ ID NO: 473713

SEQ ID NO: 474268 - RNA, 64 nt, Human; identical to SEQ ID NO: 473714

SEQ ID NO: 474269 - RNA, 64 nt, Human; identical to SEQ ID NO: 473715

SEQ ID NO: 474270 - RNA, 64 nt, Human; identical to SEQ ID NO: 473716

SEQ ID NO: 474271 - RNA, 64 nt, Human; identical to SEQ ID NO: 473717

SEQ ID NO: 474272 - RNA, 64 nt, Human; identical to SEQ ID NO: 473718

SEQ ID NO: 474273 - RNA, 64 nt, Human; identical to SEQ ID NO: 473719

SEQ ID NO: 474274 - RNA, 64 nt, Human; identical to SEQ ID NO: 473720

SEQ ID NO: 474275 - RNA, 64 nt, Human; identical to SEQ ID NO: 473721

SEQ ID NO: 474276 - RNA, 64 nt, Human; identical to SEQ ID NO: 473722

SEQ ID NO: 474277 - RNA, 64 nt, Human; identical to SEQ ID NO: 473727

SEQ ID NO: 474278 - RNA, 64 nt, Human; identical to SEQ ID NO: 473728

SEQ ID NO: 474279 - RNA, 64 nt, Human; identical to SEQ ID NO: 473729

SEQ ID NO: 474280 - RNA, 64 nt, Human; identical to SEQ ID NO: 473730

SEQ ID NO: 474281 - RNA, 64 nt, Human; identical to SEQ ID NO: 473731

SEQ ID NO: 474282 - RNA, 62 nt, Human
ggccacuugacuuguggaaggccaucuugaugccaggacacacaggaagccccugugugaca

SEQ ID NO: 474283 - RNA, 62 nt, Human
acccaccuccagacugcuucccguccaaguuaccaggacagcucaaaaacaugcugacagaa

SEQ ID NO: 474284 - RNA, 62 nt, Human
ggacaaagcuccucagugagcugguguauaauccaggacagaacccaggucuccugacuccu

SEQ ID NO: 474285 - RNA, 64 nt, Human; identical to SEQ ID NO: 473732

SEQ ID NO: 474286 - RNA, 64 nt, Human; identical to SEQ ID NO: 473733

SEQ ID NO: 474287 - RNA, 64 nt, Human; identical to SEQ ID NO: 473734

SEQ ID NO: 474288 - RNA, 64 nt, Human; identical to SEQ ID NO: 473735

SEQ ID NO: 474289 - RNA, 64 nt, Human; identical to SEQ ID NO: 473736

SEQ ID NO: 474290 - RNA, 64 nt, Human; identical to SEQ ID NO: 473737

SEQ ID NO: 474291 - RNA, 64 nt, Human; identical to SEQ ID NO: 473738

SEQ ID NO: 474292 - RNA, 64 nt, Human; identical to SEQ ID NO: 473739

SEQ ID NO: 474293 - RNA, 64 nt, Human; identical to SEQ ID NO: 473740

SEQ ID NO: 474294 - RNA, 64 nt, Human; identical to SEQ ID NO: 473745

SEQ ID NO: 474295 - RNA, 64 nt, Human; identical to SEQ ID NO: 473746

SEQ ID NO: 474296 - RNA, 64 nt, Human; identical to SEQ ID NO: 473747

SEQ ID NO: 474297 - RNA, 64 nt, Human; identical to SEQ ID NO: 473748

SEQ ID NO: 474298 - RNA, 64 nt, Human; identical to SEQ ID NO: 473749

SEQ ID NO: 474299 - RNA, 64 nt, Human; identical to SEQ ID NO: 473750

SEQ ID NO: 474300 - RNA, 62 nt, Human
ccaccuccccaguaauuguuuccuuccguugcccaggacacuggcuggccuuccuucucuuc

SEQ ID NO: 474301 - RNA, 62 nt, Human
caaaaugaucucuuuaguucugucuccaaggcccaggacacuugucagaaggaugcaaaaaa

SEQ ID NO: 474302 - RNA, 62 nt, Human
aauaccaaacauggggguuugguaaugagaaaccaggacaggccaucugcagugacccagcc

SEQ ID NO: 474303 - RNA, 64 nt, Human; identical to SEQ ID NO: 473751

SEQ ID NO: 474304 - RNA, 64 nt, Human; identical to SEQ ID NO: 473752

SEQ ID NO: 474305 - RNA, 64 nt, Human; identical to SEQ ID NO: 473753

SEQ ID NO: 474306 - RNA, 64 nt, Human; identical to SEQ ID NO: 473754

SEQ ID NO: 474307 - RNA, 64 nt, Human; identical to SEQ ID NO: 473755

SEQ ID NO: 474308 - RNA, 64 nt, Human; identical to SEQ ID NO: 473756

SEQ ID NO: 474309 - RNA, 64 nt, Human; identical to SEQ ID NO: 473757

SEQ ID NO: 474310 - RNA, 64 nt, Human; identical to SEQ ID NO: 473758

SEQ ID NO: 474311 - RNA, 64 nt, Human; identical to SEQ ID NO: 473763

SEQ ID NO: 474312 - RNA, 64 nt, Human; identical to SEQ ID NO: 473764

SEQ ID NO: 474313 - RNA, 64 nt, Human; identical to SEQ ID NO: 473765

SEQ ID NO: 474314 - RNA, 64 nt, Human; identical to SEQ ID NO: 473766

SEQ ID NO: 474315 - RNA, 64 nt, Human; identical to SEQ ID NO: 473767

SEQ ID NO: 474316 - RNA, 64 nt, Human; identical to SEQ ID NO: 473768

SEQ ID NO: 474317 - RNA, 64 nt, Human; identical to SEQ ID NO: 473769

SEQ ID NO: 474318 - RNA, 62 nt, Human
cucacggcccugcagcagagcagggcgcaaacccaggacaucugugccaggcuucccaugcc

SEQ ID NO: 474319 - RNA, 62 nt, Human
ccccuugccagggagacccccgaaccuuugugccaggacaccuccugguccccugcaccucu

SEQ ID NO: 474320 - RNA, 62 nt, Human
accuggaggugccaaaaaagccagcugcgggcccaggacagcugccgugagacucccgaugu

SEQ ID NO: 474321 - RNA, 62 nt, Human
gguuucugcccugcagaugucuaacacauaagccaggacauucugcugugagugacuuauug

SEQ ID NO: 474322 - RNA, 64 nt, Human; identical to SEQ ID NO: 473770

SEQ ID NO: 474323 - RNA, 64 nt, Human; identical to SEQ ID NO: 473771

SEQ ID NO: 474324 - RNA, 64 nt, Human; identical to SEQ ID NO: 473772

SEQ ID NO: 474325 - RNA, 64 nt, Human; identical to SEQ ID NO: 473773

SEQ ID NO: 474326 - RNA, 64 nt, Human; identical to SEQ ID NO: 473774

SEQ ID NO: 474327 - RNA, 64 nt, Human; identical to SEQ ID NO: 473775

SEQ ID NO: 474328 - RNA, 64 nt, Human; identical to SEQ ID NO: 473776

SEQ ID NO: 474329 - RNA, 64 nt, Human; identical to SEQ ID NO: 473781

SEQ ID NO: 474330 - RNA, 64 nt, Human; identical to SEQ ID NO: 473782

SEQ ID NO: 474331 - RNA, 64 nt, Human; identical to SEQ ID NO: 473783

SEQ ID NO: 474332 - RNA, 64 nt, Human; identical to SEQ ID NO: 473784

SEQ ID NO: 474333 - RNA, 64 nt, Human; identical to SEQ ID NO: 473785

SEQ ID NO: 474334 - RNA, 64 nt, Human; identical to SEQ ID NO: 473786

SEQ ID NO: 474335 - RNA, 64 nt, Human; identical to SEQ ID NO: 473787

SEQ ID NO: 474336 - RNA, 64 nt, Human; identical to SEQ ID NO: 473788

SEQ ID NO: 474337 - RNA, 62 nt, Human
aaacagcuaaaagaaaacaucggggaaucucuccaggacauuggagugggcaaagauuucuu

SEQ ID NO: 474338 - RNA, 62 nt, Human
cauuccugcuuggggacugguggggaagagggccaggacaucuucugagccaggacgucccu

SEQ ID NO: 474339 - RNA, 62 nt, Human
gggcagcccuuaucagcuugugacaaccuuccccaggacagaagucauacaaggccucuggg

SEQ ID NO: 474340 - RNA, 64 nt, Human; identical to SEQ ID NO: 473789

SEQ ID NO: 474341 - RNA, 64 nt, Human; identical to SEQ ID NO: 473790

SEQ ID NO: 474342 - RNA, 64 nt, Human; identical to SEQ ID NO: 473791

SEQ ID NO: 474343 - RNA, 64 nt, Human; identical to SEQ ID NO: 473792

SEQ ID NO: 474344 - RNA, 64 nt, Human; identical to SEQ ID NO: 473793

SEQ ID NO: 474345 - RNA, 64 nt, Human; identical to SEQ ID NO: 473794

SEQ ID NO: 474346 - RNA, 64 nt, Human; identical to SEQ ID NO: 473799

SEQ ID NO: 474347 - RNA, 64 nt, Human; identical to SEQ ID NO: 473800

SEQ ID NO: 474348 - RNA, 64 nt, Human; identical to SEQ ID NO: 473801

SEQ ID NO: 474349 - RNA, 64 nt, Human; identical to SEQ ID NO: 473802

SEQ ID NO: 474350 - RNA, 64 nt, Human; identical to SEQ ID NO: 473803

SEQ ID NO: 474351 - RNA, 64 nt, Human; identical to SEQ ID NO: 473804

SEQ ID NO: 474352 - RNA, 64 nt, Human; identical to SEQ ID NO: 473805

SEQ ID NO: 474353 - RNA, 64 nt, Human; identical to SEQ ID NO: 473806

SEQ ID NO: 474354 - RNA, 64 nt, Human; identical to SEQ ID NO: 473807

SEQ ID NO: 474355 - RNA, 62 nt, Human
uguaccuuccucugggcagcugcagcccugagccaggacauguggccuggcuagugcagcau

SEQ ID NO: 474356 - RNA, 62 nt, Human
ccuauucauuaacagugugugcaaaugcaaccccaggacacauuauuguucugauagaugcu

SEQ ID NO: 474357 - RNA, 62 nt, Human
aaaaaaaucagggugguucccagcuccccaguccaggacaaccauuaguccugaugagugag

SEQ ID NO: 474358 - RNA, 58 nt, Human; identical to SEQ ID NO: 473808

SEQ ID NO: 474359 - RNA, 64 nt, Human; identical to SEQ ID NO: 473809

SEQ ID NO: 474360 - RNA, 64 nt, Human; identical to SEQ ID NO: 473810

SEQ ID NO: 474361 - RNA, 64 nt, Human; identical to SEQ ID NO: 473811

SEQ ID NO: 474362 - RNA, 64 nt, Human; identical to SEQ ID NO: 473812

SEQ ID NO: 474363 - RNA, 64 nt, Human; identical to SEQ ID NO: 473817

SEQ ID NO: 474364 - RNA, 64 nt, Human; identical to SEQ ID NO: 473818

SEQ ID NO: 474365 - RNA, 64 nt, Human; identical to SEQ ID NO: 473819

SEQ ID NO: 474366 - RNA, 64 nt, Human; identical to SEQ ID NO: 473820

SEQ ID NO: 474367 - RNA, 64 nt, Human; identical to SEQ ID NO: 473821

SEQ ID NO: 474368 - RNA, 64 nt, Human; identical to SEQ ID NO: 473822

SEQ ID NO: 474369 - RNA, 64 nt, Human; identical to SEQ ID NO: 473823

SEQ ID NO: 474370 - RNA, 64 nt, Human; identical to SEQ ID NO: 473824

SEQ ID NO: 474371 - RNA, 64 nt, Human; identical to SEQ ID NO: 473825

SEQ ID NO: 474372 - RNA, 64 nt, Human; identical to SEQ ID NO: 473826

SEQ ID NO: 474373 - RNA, 62 nt, Human
gucuuuuccauuuauagagaaugauguaacugccaggacacuuuuguguuugcccaggacuc

SEQ ID NO: 474374 - RNA, 62 nt, Human
caggcaacagggugaccagcuguccugguuucccaggacauggaacuuucaaugcuaaaacu

SEQ ID NO: 474375 - RNA, 62 nt, Human
cgugagcaaauggugucuugggcaaucugaggccaggacagauguugccccacccacuggag

SEQ ID NO: 474376 - RNA, 64 nt, Human; identical to SEQ ID NO: 473827

SEQ ID NO: 474377 - RNA, 64 nt, Human; identical to SEQ ID NO: 473828

SEQ ID NO: 474378 - RNA, 64 nt, Human; identical to SEQ ID NO: 473829

SEQ ID NO: 474379 - RNA, 64 nt, Human; identical to SEQ ID NO: 473830

SEQ ID NO: 474380 - RNA, 64 nt, Human; identical to SEQ ID NO: 473835

SEQ ID NO: 474381 - RNA, 64 nt, Human; identical to SEQ ID NO: 473836

SEQ ID NO: 474382 - RNA, 64 nt, Human; identical to SEQ ID NO: 473837

SEQ ID NO: 474383 - RNA, 64 nt, Human; identical to SEQ ID NO: 473838

SEQ ID NO: 474384 - RNA, 64 nt, Human; identical to SEQ ID NO: 473839

SEQ ID NO: 474385 - RNA, 64 nt, Human; identical to SEQ ID NO: 473840

SEQ ID NO: 474386 - RNA, 64 nt, Human; identical to SEQ ID NO: 473841

SEQ ID NO: 474387 - RNA, 64 nt, Human; identical to SEQ ID NO: 473842

SEQ ID NO: 474388 - RNA, 64 nt, Human; identical to SEQ ID NO: 473843

SEQ ID NO: 474389 - RNA, 64 nt, Human; identical to SEQ ID NO: 473844

SEQ ID NO: 474390 - RNA, 64 nt, Human; identical to SEQ ID NO: 473845

SEQ ID NO: 474391 - RNA, 62 nt, Human
cuuccugucucccaccucagcacuaguccaugccaggacaccagcugacaauuucuugguuu

SEQ ID NO: 474392 - RNA, 62 nt, Human
uacaucuaggccaccccagccuggccacgcagccaggacaccgggcagggccgcccgggccc

SEQ ID NO: 474393 - RNA, 62 nt, Human
cacugacugcagggacacgggcagccuggcucccaggacacgacuuguaaugaaaguuuggg

SEQ ID NO: 474394 - RNA, 64 nt, Human; identical to SEQ ID NO: 473846

SEQ ID NO: 474395 - RNA, 64 nt, Human; identical to SEQ ID NO: 473847

SEQ ID NO: 474396 - RNA, 64 nt, Human; identical to SEQ ID NO: 473848

SEQ ID NO: 474397 - RNA, 64 nt, Human; identical to SEQ ID NO: 473853

SEQ ID NO: 474398 - RNA, 64 nt, Human; identical to SEQ ID NO: 473854

SEQ ID NO: 474399 - RNA, 64 nt, Human; identical to SEQ ID NO: 473855

SEQ ID NO: 474400 - RNA, 64 nt, Human; identical to SEQ ID NO: 473856

SEQ ID NO: 474401 - RNA, 64 nt, Human; identical to SEQ ID NO: 473857

SEQ ID NO: 474402 - RNA, 64 nt, Human; identical to SEQ ID NO: 473858

SEQ ID NO: 474403 - RNA, 64 nt, Human; identical to SEQ ID NO: 473859

SEQ ID NO: 474404 - RNA, 64 nt, Human; identical to SEQ ID NO: 473860

SEQ ID NO: 474405 - RNA, 64 nt, Human; identical to SEQ ID NO: 473861

SEQ ID NO: 474406 - RNA, 64 nt, Human; identical to SEQ ID NO: 473862

SEQ ID NO: 474407 - RNA, 64 nt, Human; identical to SEQ ID NO: 473863

SEQ ID NO: 474408 - RNA, 64 nt, Human; identical to SEQ ID NO: 473864

SEQ ID NO: 474409 - RNA, 62 nt, Human
ggcaccuucccauccuagcccuuaucagggucccaggacacagaauauaagugacuacaggg

SEQ ID NO: 474410 - RNA, 62 nt, Human
uuacuucuugucuuguucuucuaaagcuuucuccaggacagauauuuucccugucuuaacca

SEQ ID NO: 474411 - RNA, 62 nt, Human
caagcucuuuaacugaaaagcaacaagccacuccaggacaagguucaaaaugguuacaacag

SEQ ID NO: 474412 - RNA, 64 nt, Human; identical to SEQ ID NO: 473865

SEQ ID NO: 474413 - RNA, 64 nt, Human; identical to SEQ ID NO: 473866

SEQ ID NO: 474414 - RNA, 64 nt, Human; identical to SEQ ID NO: 473871

SEQ ID NO: 474415 - RNA, 64 nt, Human; identical to SEQ ID NO: 473872

SEQ ID NO: 474416 - RNA, 64 nt, Human; identical to SEQ ID NO: 473873

SEQ ID NO: 474417 - RNA, 64 nt, Human; identical to SEQ ID NO: 473874

SEQ ID NO: 474418 - RNA, 64 nt, Human; identical to SEQ ID NO: 473875

SEQ ID NO: 474419 - RNA, 64 nt, Human; identical to SEQ ID NO: 473876

SEQ ID NO: 474420 - RNA, 64 nt, Human; identical to SEQ ID NO: 473877

SEQ ID NO: 474421 - RNA, 64 nt, Human; identical to SEQ ID NO: 473878

SEQ ID NO: 474422 - RNA, 64 nt, Human; identical to SEQ ID NO: 473879

SEQ ID NO: 474423 - RNA, 64 nt, Human; identical to SEQ ID NO: 473880

SEQ ID NO: 474424 - RNA, 64 nt, Human; identical to SEQ ID NO: 473881

SEQ ID NO: 474425 - RNA, 64 nt, Human; identical to SEQ ID NO: 473882

SEQ ID NO: 474426 - RNA, 64 nt, Human; identical to SEQ ID NO: 473883

SEQ ID NO: 474427 - RNA, 62 nt, Human
gcccucugcgucccccagcccucaggccagugccaggacagcuggcugcugacaggaugugg

SEQ ID NO: 474428 - RNA, 62 nt, Human
caccaucaaacucuccuaggccaugccaagacccaggacauaggacggaccccugguaccca

SEQ ID NO: 474429 - RNA, 62 nt, Human
cccuccaugggggcauucuggcacccccugcuccaggacaggccaugggcaagcugccuccc

SEQ ID NO: 474430 - RNA, 64 nt, Human; identical to SEQ ID NO: 473884

SEQ ID NO: 474431 - RNA, 64 nt, Human; identical to SEQ ID NO: 473889

SEQ ID NO: 474432 - RNA, 64 nt, Human; identical to SEQ ID NO: 473890

SEQ ID NO: 474433 - RNA, 64 nt, Human; identical to SEQ ID NO: 473891

SEQ ID NO: 474434 - RNA, 64 nt, Human; identical to SEQ ID NO: 473892

SEQ ID NO: 474435 - RNA, 64 nt, Human; identical to SEQ ID NO: 473893

SEQ ID NO: 474436 - RNA, 64 nt, Human; identical to SEQ ID NO: 473894

SEQ ID NO: 474437 - RNA, 64 nt, Human; identical to SEQ ID NO: 473895

SEQ ID NO: 474438 - RNA, 64 nt, Human; identical to SEQ ID NO: 473896

SEQ ID NO: 474439 - RNA, 64 nt, Human; identical to SEQ ID NO: 473897

SEQ ID NO: 474440 - RNA, 64 nt, Human; identical to SEQ ID NO: 473898

SEQ ID NO: 474441 - RNA, 64 nt, Human; identical to SEQ ID NO: 473899

SEQ ID NO: 474442 - RNA, 64 nt, Human; identical to SEQ ID NO: 473900

SEQ ID NO: 474443 - RNA, 64 nt, Human; identical to SEQ ID NO: 473901

SEQ ID NO: 474444 - RNA, 64 nt, Human; identical to SEQ ID NO: 473902

SEQ ID NO: 474445 - RNA, 62 nt, Human
acugacauuaaguaguggggggacaguccaugccaggacacccuggaguagccuucccccuu

SEQ ID NO: 474446 - RNA, 62 nt, Human
ucugcuccugcugaggaccagcuguggcugggccaggacagaggacucaacccugcuccucc

SEQ ID NO: 474447 - RNA, 62 nt, Human
cccccuaacugcaugacauguuaacugugugcccaggacagccgugguggggaccggguaug

SEQ ID NO: 474448 - RNA, 62 nt, Human
ucauuuuaagugguguggagauuccagcacucccaggacaguggagucagcaguaagcccug

SEQ ID NO: 474449 - RNA, 64 nt, Human; identical to SEQ ID NO: 473907

SEQ ID NO: 474450 - RNA, 64 nt, Human; identical to SEQ ID NO: 473908

SEQ ID NO: 474451 - RNA, 64 nt, Human; identical to SEQ ID NO: 473909

SEQ ID NO: 474452 - RNA, 64 nt, Human; identical to SEQ ID NO: 473910

SEQ ID NO: 474453 - RNA, 64 nt, Human; identical to SEQ ID NO: 473911

SEQ ID NO: 474454 - RNA, 64 nt, Human; identical to SEQ ID NO: 473912

SEQ ID NO: 474455 - RNA, 64 nt, Human; identical to SEQ ID NO: 473913

SEQ ID NO: 474456 - RNA, 64 nt, Human; identical to SEQ ID NO: 473914

SEQ ID NO: 474457 - RNA, 64 nt, Human; identical to SEQ ID NO: 473915

SEQ ID NO: 474458 - RNA, 64 nt, Human; identical to SEQ ID NO: 473916

SEQ ID NO: 474459 - RNA, 64 nt, Human; identical to SEQ ID NO: 473917

SEQ ID NO: 474460 - RNA, 64 nt, Human; identical to SEQ ID NO: 473918

SEQ ID NO: 474461 - RNA, 64 nt, Human; identical to SEQ ID NO: 473919

SEQ ID NO: 474462 - RNA, 64 nt, Human; identical to SEQ ID NO: 473920

SEQ ID NO: 474463 - RNA, 64 nt, Human; identical to SEQ ID NO: 473925

SEQ ID NO: 474464 - RNA, 62 nt, Human
cccucgugcccaucaagugcagucgggaccucccaggacaagcacgaggccucaggucggcc

SEQ ID NO: 474465 - RNA, 62 nt, Human
uguguguucuuccccaagguccccccacagcuccaggacaccgcuguccuggcauuuguggc

SEQ ID NO: 474466 - RNA, 62 nt, Human
ucaagagugagggccccugcugggcccagccaccaggacagcaggaaccagggccuacuccu

SEQ ID NO: 474467 - RNA, 64 nt, Human; identical to SEQ ID NO: 473926

SEQ ID NO: 474468 - RNA, 64 nt, Human; identical to SEQ ID NO: 473927

SEQ ID NO: 474469 - RNA, 64 nt, Human; identical to SEQ ID NO: 473928

SEQ ID NO: 474470 - RNA, 64 nt, Human; identical to SEQ ID NO: 473929

SEQ ID NO: 474471 - RNA, 64 nt, Human; identical to SEQ ID NO: 473930

SEQ ID NO: 474472 - RNA, 64 nt, Human; identical to SEQ ID NO: 473931

SEQ ID NO: 474473 - RNA, 64 nt, Human; identical to SEQ ID NO: 473932

SEQ ID NO: 474474 - RNA, 64 nt, Human; identical to SEQ ID NO: 473933

SEQ ID NO: 474475 - RNA, 64 nt, Human; identical to SEQ ID NO: 473934

SEQ ID NO: 474476 - RNA, 64 nt, Human; identical to SEQ ID NO: 473935

SEQ ID NO: 474477 - RNA, 64 nt, Human; identical to SEQ ID NO: 473936

SEQ ID NO: 474478 - RNA, 64 nt, Human; identical to SEQ ID NO: 473937

SEQ ID NO: 474479 - RNA, 64 nt, Human; identical to SEQ ID NO: 473938

SEQ ID NO: 474480 - RNA, 64 nt, Human; identical to SEQ ID NO: 473943

SEQ ID NO: 474481 - RNA, 64 nt, Human; identical to SEQ ID NO: 473944

SEQ ID NO: 474482 - RNA, 62 nt, Human
ccuccuaccccuguggccauccugccauacauccaggacauugaguuggaagacuaugaucu

SEQ ID NO: 474483 - RNA, 62 nt, Human
augguauguuccgugauauuaacaacucuaacccaggacagaccacaagccacacucagagg

SEQ ID NO: 474484 - RNA, 62 nt, Human
caucccccagccuggggccagaacagccuaccccaggacaggagucccucuaguugucuccc

SEQ ID NO: 474485 - RNA, 62 nt, Human
gcucacccuaaccuggagaagcuggguuauacccaggacaugauuuucaccuacuaacaccu

SEQ ID NO: 474486 - RNA, 64 nt, Human; identical to SEQ ID NO: 473945

SEQ ID NO: 474487 - RNA, 64 nt, Human; identical to SEQ ID NO: 473946

SEQ ID NO: 474488 - RNA, 64 nt, Human; identical to SEQ ID NO: 473947

SEQ ID NO: 474489 - RNA, 64 nt, Human; identical to SEQ ID NO: 473948

SEQ ID NO: 474490 - RNA, 52 nt, Human; identical to SEQ ID NO: 473949

SEQ ID NO: 474491 - RNA, 64 nt, Human; identical to SEQ ID NO: 473950

SEQ ID NO: 474492 - RNA, 64 nt, Human; identical to SEQ ID NO: 473951

SEQ ID NO: 474493 - RNA, 64 nt, Human; identical to SEQ ID NO: 473952

SEQ ID NO: 474494 - RNA, 64 nt, Human; identical to SEQ ID NO: 473953

SEQ ID NO: 474495 - RNA, 64 nt, Human; identical to SEQ ID NO: 473954

SEQ ID NO: 474496 - RNA, 64 nt, Human; identical to SEQ ID NO: 473955

SEQ ID NO: 474497 - RNA, 64 nt, Human; identical to SEQ ID NO: 473956

SEQ ID NO: 474498 - RNA, 64 nt, Human; identical to SEQ ID NO: 473961

SEQ ID NO: 474499 - RNA, 62 nt, Human; identical to SEQ ID NO: 473962

SEQ ID NO: 474500 - RNA, 64 nt, Human; identical to SEQ ID NO: 473963

SEQ ID NO: 474501 - RNA, 62 nt, Human
agcugcuagcucagacaccaaagggguaaggcccaggacauucauaucuuuaaaagcugcaa

SEQ ID NO: 474502 - RNA, 62 nt, Human
agacuugaaggugccuugcucaauggaagaggccaggacagagcugacaaaauuuugcuccc

SEQ ID NO: 474503 - RNA, 62 nt, Human
cugaucaauguuaaauguaagcaccccugaucccaggacauaaggaaagaugcccaauugua

SEQ ID NO: 474504 - RNA, 62 nt, Human
ccccucccuuggaucugaccuuacauuugcuaccaggacaggcucucgacagggcauugaga

SEQ ID NO: 474505 - RNA, 64 nt, Human; identical to SEQ ID NO: 473964

SEQ ID NO: 474506 - RNA, 64 nt, Human; identical to SEQ ID NO: 473965

SEQ ID NO: 474507 - RNA, 64 nt, Human; identical to SEQ ID NO: 473966

SEQ ID NO: 474508 - RNA, 64 nt, Human; identical to SEQ ID NO: 473967

SEQ ID NO: 474509 - RNA, 64 nt, Human; identical to SEQ ID NO: 473968

SEQ ID NO: 474510 - RNA, 64 nt, Human; identical to SEQ ID NO: 473969

SEQ ID NO: 474511 - RNA, 64 nt, Human; identical to SEQ ID NO: 473970

SEQ ID NO: 474512 - RNA, 64 nt, Human; identical to SEQ ID NO: 473971

SEQ ID NO: 474513 - RNA, 64 nt, Human; identical to SEQ ID NO: 473972

SEQ ID NO: 474514 - RNA, 64 nt, Human; identical to SEQ ID NO: 473973

SEQ ID NO: 474515 - RNA, 64 nt, Human; identical to SEQ ID NO: 473974

SEQ ID NO: 474516 - RNA, 64 nt, Human; identical to SEQ ID NO: 473979

SEQ ID NO: 474517 - RNA, 64 nt, Human; identical to SEQ ID NO: 473980

SEQ ID NO: 474518 - RNA, 64 nt, Human; identical to SEQ ID NO: 473981

SEQ ID NO: 474519 - RNA, 64 nt, Human; identical to SEQ ID NO: 473982

SEQ ID NO: 474520 - RNA, 62 nt, Human
agccagcgugcaacugcccaagcuccaggucuccaggacaagagcaguugucugccaugagc

SEQ ID NO: 474521 - RNA, 62 nt, Human
ggaucccagaacucuggucuccaaauuacagcccaggacaccuuucucugccgccugcugca

SEQ ID NO: 474522 - RNA, 62 nt, Human
cuuucuuaauaucacuuuggucuccauuuuucccaggacaggaaauaugucccccccuaacu

SEQ ID NO: 474523 - RNA, 62 nt, Human
caucaaaauaaagaggcugggccgcuguguagccaggacaugcccaugccaccgccuauuga

SEQ ID NO: 474524 - RNA, 64 nt, Human; identical to SEQ ID NO: 473983

SEQ ID NO: 474525 - RNA, 64 nt, Human; identical to SEQ ID NO: 473984

SEQ ID NO: 474526 - RNA, 64 nt, Human; identical to SEQ ID NO: 473985

SEQ ID NO: 474527 - RNA, 64 nt, Human; identical to SEQ ID NO: 473969

SEQ ID NO: 474528 - RNA, 64 nt, Human
ccuuugccagccagagcugcugccagagcugcguucccugcaguggagguggacuggacaccca

SEQ ID NO: 474529 - RNA, 64 nt, Human
cuuucccccuucccgacaucagcagaaggcagcaucccugcaugccguccguauacaaccccuc

SEQ ID NO: 474530 - RNA, 64 nt, Human
uuuuuuccccucugucucuuuuugccauggcuaaucccugcauuuccauucagggaaaaggugg

SEQ ID NO: 474531 - RNA, 64 nt, Human
gcugugauuuguugcugggagcggcggcagcgagucccugcaacagcaauaaacuuccuucucc

SEQ ID NO: 474532 - RNA, 52 nt, Human
cauggagggcagcccugugaugucccugcauggagcuggugaauuacuaaaa

SEQ ID NO: 474533 - RNA, 64 nt, Human
ggggggcugggcccugccuccccguuacccuccuucccugcaggccuggagccuguagggcugg

SEQ ID NO: 474534 - RNA, 64 nt, Human
aagcaaccggcacccccuuccggccugaaagcccucccugcaagaaggugugcaggagagaaga

SEQ ID NO: 474535 - RNA, 64 nt, Human
uguugcucauuaagcugagugcagacguccuuaaucccugcagauagugggaugaaagcaaguu

SEQ ID NO: 474536 - RNA, 64 nt, Human
uggacuuaugaauggcugcuaggaccuuuagugcucccugcaccaaccucccaucccccugcca

SEQ ID NO: 474537 - RNA, 64 nt, Human
ccuuagccuuucagaggcuugguguucagggcccucccugcacuccccucuugcugcguguuga

SEQ ID NO: 474538 - RNA, 62 nt, Human
uugugagcaucagagggcugauggauuccaaaccaggacacuacccugagaucugcacaguc

SEQ ID NO: 474539 - RNA, 62 nt, Human
augugcucggcccccagugcucugugggagccccaggacaagugagcuggugucaccuccug

SEQ ID NO: 474540 - RNA, 62 nt, Human
ucacugccucuccagggacccuccucuccugcccaggacagacccagccagaaccacugcua

SEQ ID NO: 474541 - RNA, 62 nt, Human
ucagaaucugacaccuugccuugcucuugccaccaggacaccuaugucaacaggccaaacag

SEQ ID NO: 474542 - RNA, 64 nt, Human
uaggaccguaaccgccuccgugcguggcauauggucccugcaugcuguucacucuguauaguac

SEQ ID NO: 474543 - RNA, 64 nt, Human
ugccccacucccaucucuucuucccugccaccccucccugcagccuccgcggcucacuccagcc

SEQ ID NO: 474544 - RNA, 64 nt, Human
cuccuucuauucccuuccuucugcccugccugccucccugcaccugcggccucucuaggaagcu

SEQ ID NO: 474545 - RNA, 64 nt, Human
cugaacggagaggugaagcagggggucuuuauauucccugcagaaacccuggaucccacuccac

SEQ ID NO: 474546 - RNA, 64 nt, Human
gagccugacacugcucccacuuuggagaccacauucccugcacacggucuuugagagagcaguu

SEQ ID NO: 474547 - RNA, 64 nt, Human
ugagaaagcugccuugcaaucugaacuuggguuuucccugcaauagaaauugaauucugccucu

SEQ ID NO: 474548 - RNA, 64 nt, Human
ccagcugaguuucuauuucuucuauaaauguuuuucccugcacaacaaaaacagugaaagaaau

SEQ ID NO: 474549 - RNA, 64 nt, Human
uccuucaugaacaucccccucccaacacuacccuucccugcacuaaagccagccugaccuuccu

SEQ ID NO: 474550 - RNA, 64 nt, Human
auccuucgugaacauccccucccaucauuacccuucccugcacuaaagccagccugaccuuccu

SEQ ID NO: 474551 - RNA, 64 nt, Human; identical to SEQ ID NO: 474550

SEQ ID NO: 474552 - RNA, 64 nt, Human
ccuccaucaaagucccccuccuaacgucuuccuuucccugcacuaacgccaaccugacugcuuu

SEQ ID NO: 474553 - RNA, 64 nt, Human
aacuuguuuuuaaauccaaagacuugaaccacauucccugcacaugaacauguuugcuuuuauc

SEQ ID NO: 474554 - RNA, 64 nt, Human
uaaccaucuuuuuauggguggagcagagagucaaucccugcagccacccugcagccagccaucu

SEQ ID NO: 474555 - RNA, 64 nt, Human
ugaggaagagcagauugcuuaugccaugcagaugucccugcagggagcaggugagccagagccu

SEQ ID NO: 474556 - RNA, 62 nt, Human
auaguucauuggaugaggcugggugacauuucccaggacagcauggugaacauuaccaggca

SEQ ID NO: 474557 - RNA, 62 nt, Human
aaaacacaccucacuuauuguacauguuggaaccaggacaugagagacauagaaaaacagaa

SEQ ID NO: 474558 - RNA, 62 nt, Human
ccaaaagucugcuucacugagaugcuaccuugccaggacaagaaccaagaacucuaacuguc

SEQ ID NO: 474559 - RNA, 64 nt, Human
uagcucuguugcccacuuuccuugggccauaccuucccugcagaucuccagcccagaaccaucu

SEQ ID NO: 474560 - RNA, 64 nt, Human
ugguuauucaccacuucuacagcucuccugccgcucccugcagaggaugcucguuuugcagaga

SEQ ID NO: 474561 - RNA, 64 nt, Human
ugucuacccucugagugggaacauacuucuaaguucccugcagucucuguccugugguagacca

SEQ ID NO: 474562 - RNA, 64 nt, Human
gggacccaggacuguaaccuggggaggacgcgggucccugcaaggaagaguagauuuggagagg

SEQ ID NO: 474563 - RNA, 64 nt, Human
cuguggagcccuggaugcuauccacacccaccuaucccugcagcuaauuuagcugaucucuaau

SEQ ID NO: 474564 - RNA, 64 nt, Human
cgacccaccucccagagccuggcugaaacgucacucccugcauccaacaucugaucugcugaga

SEQ ID NO: 474565 - RNA, 64 nt, Human
ugcccaggcuggaguacauuugccugaugucagcucccugcaaccuccgccuccuggguucaag

SEQ ID NO: 474566 - RNA, 64 nt, Human
ggcggcaaucaacagucuuacacagagaggguauucccugcaaguuucuggcuugccugugaug

SEQ ID NO: 474567 - RNA, 64 nt, Human
gguccucugggaugccagcucuccccuuugugcuucccugcagcaacccauggagggcccaggg

SEQ ID NO: 474568 - RNA, 64 nt, Human
caguuggugggggugcgggggugcguguccccauucccugcaacagcaaauggggcuccuucuu

SEQ ID NO: 474569 - RNA, 64 nt, Human
uccaaauuaguauauacuauuggaaacuugucuuucccugcaguaaggcugguuuccccacccc

SEQ ID NO: 474570 - RNA, 64 nt, Human
uccuccuaugcugguggaaggcggaggaccggagucccugcagaaggccccgugcacucggggg

SEQ ID NO: 474571 - RNA, 64 nt, Human
guuugccacgccaggaaugcugcacgcugggcagucccugcagaucuuccggaaaugggccgga

SEQ ID NO: 474572 - RNA, 64 nt, Human
ugagagccugaaucagaggccgucgggaacgcccucccugcaguugaggaagagccacuuuccu

SEQ ID NO: 474573 - RNA, 62 nt, Human
agguggcuggacccaucgcaucuaaaacuggcccaggacacuugguguaugcgugacuuggc

SEQ ID NO: 474574 - RNA, 62 nt, Human
agaagguggccuucaguguccaccuguggaacccaggacacagcaccugacugcacacagug

SEQ ID NO: 474575 - RNA, 62 nt, Human
ugccucagugcuacaccacagugggccuggucccaggacaggaaugcgguucaaacccagug

SEQ ID NO: 474576 - RNA, 64 nt, Human
ugaguccuggacuggacugaacauccagaaagcuucccugcaaucuugggguuuggcuuuaguu

SEQ ID NO: 474577 - RNA, 64 nt, Human
uugucgagaggauuuccugagacugguuuggaucucccugcaugacagucccccagaaacuuag

SEQ ID NO: 474578 - RNA, 64 nt, Human
gagggcgugagcuuggacuggacccacugcugauucccugcaccuagcacagugcuugccacaa

SEQ ID NO: 474579 - RNA, 64 nt, Human
uggccagagcuggaaggcagggcagagggaauguucccugcacccuggaaaggggaguugaguc

SEQ ID NO: 474580 - RNA, 64 nt, Human
uccacuccuagagccagucucagggucugggauuucccugcaggagcucagccaccacugugcc

SEQ ID NO: 474581 - RNA, 64 nt, Human
gccaugugacccucuccccaggcaagcucugaagucccugcagguggaggccaugccugucuua

SEQ ID NO: 474582 - RNA, 64 nt, Human
cauacgacacacaccugugucuccccagggguuuucccugcagugaggcuuguccagaugauug

SEQ ID NO: 474583 - RNA, 64 nt, Human
aaacagucuccaucuccucaaaauaguugcugacucccugcacccaaggggccucuccaugccu

SEQ ID NO: 474584 - RNA, 64 nt, Human
ggaggaguucuaugccuaguggagccacagugccucccugcagccucaacaccacccugcuguc

SEQ ID NO: 474585 - RNA, 64 nt, Human
ccccuuucucucccuaacccaccaccccugcgucucccugcaggcagucaccuucuuaggcccg

SEQ ID NO: 474586 - RNA, 64 nt, Human
cguggccuuggcccgaggagacuaacuugcuuucucccugcaugcaggcugagauuguuucugg

SEQ ID NO: 474587 - RNA, 64 nt, Human
acugauuuucauaugacaauguuaggcaaaggccucccugcauuugaagagcagguuuucauuu

SEQ ID NO: 474588 - RNA, 64 nt, Human
gcagcagacacccacccucucacugacuaacaggucccugcacacagcuggccugguaaaccca

SEQ ID NO: 474589 - RNA, 64 nt, Human
uggcccugccuugagaagagacacaggucucccgucccugcaccagcugagagagacuugccgc

SEQ ID NO: 474590 - RNA, 62 nt, Human
acugcuugauuuuaauacauugaucaggccauccaggacaccacgauucucccaaaguaccu

SEQ ID NO: 474591 - RNA, 62 nt, Human
uuuguaaccaaucgauaggacaguucugccacccaggacauuccccucuguuccucuguucc

SEQ ID NO: 474592 - RNA, 62 nt, Human
gcugcaagcucugccuucaccaguagcuggugccaggacagagcucugggacagcaggcaga

SEQ ID NO: 474593 - RNA, 64 nt, Human
ucuggugaaaagcuuuucacuaagugagguuccuucccugcaaaugcugaaucuagccuaauuc

SEQ ID NO: 474594 - RNA, 64 nt, Human
uucauucugucccacuuucuucauagacuccuuuucccugcaauggguuuuugguaugaaaaag

SEQ ID NO: 474595 - RNA, 64 nt, Human
gauaagggaagugagacaaaggagaagaaauuacucccugcaacaggaggaauagaaaugaagc

SEQ ID NO: 474596 - RNA, 64 nt, Human
aagguuucuggccagaggaauuggggucuugccaucccugcaauagcccuuuuaugggcucugg

SEQ ID NO: 474597 - RNA, 64 nt, Human
augcacuggccacccaacagcaccaauuguacauucccugcauccaaucugcucagcaggcccu

SEQ ID NO: 474598 - RNA, 64 nt, Human
guuggggggauuggcaguuagcccucugugcuucucccugcagcccuaccucugccaaggucuc

SEQ ID NO: 474599 - RNA, 64 nt, Human
gaugcuuucuuuaacacuaacucaccacugugcuucccugcagacaccuagagcucaggacugg

SEQ ID NO: 474600 - RNA, 64 nt, Human
cugggcuuuacucaauugcagagaaaaaacuuucucccugcaucucauaccuuuaccucuggcc

SEQ ID NO: 474601 - RNA, 64 nt, Human
gacaaaagaaaguggaagugguauuccccaccccucccugcacccaugugccugggcuuccccu

SEQ ID NO: 474602 - RNA, 64 nt, Human
uauuuagcuccaaaccuucacacacagacuguugucccugcacucuuuaagggaguguacuccc

SEQ ID NO: 474603 - RNA, 64 nt, Human
gcaacaucgaaaccagggagaaagugauccuugcucccugcagaacuucuucaguaugauguuc

SEQ ID NO: 474604 - RNA, 64 nt, Human
gcccccaggaagccuagacggugucgccgccugcucccugcacccaugacaaucaccuucagaa

SEQ ID NO: 474605 - RNA, 64 nt, Human
uccuccugggagcuccaggaccagccagcuguguucccugcagacugggcucagcccgacaucc

SEQ ID NO: 474606 - RNA, 64 nt, Human
gggcagccggcucuccuugcacgccucggccacgucccugcacucucagcccccgcccgucacc

SEQ ID NO: 474607 - RNA, 62 nt, Human
ugccucuugcaaugacagcugaucugucggaaccaggacacaaaagcagcaagaagcgggga

SEQ ID NO: 474608 - RNA, 62 nt, Human
uuuauauuguuuuuguauuuauuaauuugaaaccaggacauuaaaaauguuaguauuuuaau

SEQ ID NO: 474609 - RNA, 62 nt, Human
aauuaauuuuaacuuagcuaaugaacucaucaccaggacaguuggaggggguaggccgaggu

SEQ ID NO: 474610 - RNA, 64 nt, Human
ccucuccuggaucaaaaaugaaucacuucugaagucccugcagcccuuugccaaguggcauuac

SEQ ID NO: 474611 - RNA, 64 nt, Human
cugggcccgcugggguuuuaguagggcagccccuucccugcaggagugaggcauggugacagca

SEQ ID NO: 474612 - RNA, 64 nt, Human
auaugugggagggccauuaaggaguggguuucacucccugcaugugggcaggugucccaucuag

SEQ ID NO: 474613 - RNA, 64 nt, Human
ucaggcuggggcugcccauugggggccccacaugucccugcaggguuggcagggacagagccca

SEQ ID NO: 474614 - RNA, 64 nt, Human
cauuucuucuccuuggccacuucuuccuugcgucucccugcaugcugcuuuauuugcuucuccc

SEQ ID NO: 474615 - RNA, 64 nt, Human
gauuauuacaucaucagaucagcaugugcuauacucccugcaagaaauauacugacaugaacag

SEQ ID NO: 474616 - RNA, 52 nt, Human
ccaguuuuggcaaaccuuaaucucccugcacauuggaaaugaauuacaggca

SEQ ID NO: 474617 - RNA, 64 nt, Human
caccucugcuuucccuuagcaacccucauauaccucccugcaccguuacgcugugauggcaacu

SEQ ID NO: 474618 - RNA, 64 nt, Human
gccuguugcaccugcuccacaccuccccacagccucccugcaggugcuguguggccgugaugug

SEQ ID NO: 474619 - RNA, 64 nt, Human
cagagcaggaaacaugacucguauaugucucaggucccugcagggccaagcaccuagccucgcu

SEQ ID NO: 474620 - RNA, 64 nt, Human
ugaauccugcuggagagcaaacacgaacuucuguucccugcaaaaugguuagaaagaaacagcu

SEQ ID NO: 474621 - RNA, 56 nt, Human
agaagagcugggcaccuuagcgacccucccugcagggcugggcuuuugcauggcaa

SEQ ID NO: 474622 - RNA, 64 nt, Human
gggaaacugaaacucacaguaaugugucauaucaucccugcaaaaauuaauacacaaauagaaa

SEQ ID NO: 474623 - RNA, 64 nt, Human
aaaggcaaggggaucuuuggggcuaacuucgggaucccugcacuuuauguaagaauguaaaccu

SEQ ID NO: 474624 - RNA, 62 nt, Human
ggcuugaggucugggaggguggcccuggccagccaggacacaugcagaccccuggcuuuagu

SEQ ID NO: 474625 - RNA, 62 nt, Human
ccagcuggugacugcucaggaguuugggggcuccaggacagugggcccggggccuggcaggc

SEQ ID NO: 474626 - RNA, 62 nt, Human
auuguauauuuauucaacaacuguuuauguuuccaggacaacugcaaagaaaacaagcugag

SEQ ID NO: 474627 - RNA, 64 nt, Human
ccuaaccacaagaggcuggugcuuaguacuguuuucccugcacguaggggucuuuuaaaaauau

SEQ ID NO: 474628 - RNA, 64 nt, Human
agcagaugcucugaacccugagcaggcacccacuucccugcaggacaguauuccugccgaggcu

SEQ ID NO: 474629 - RNA, 64 nt, Human
cugcccucuucccacagccucccugccccacccaucccugcaaagccauuuuucagacagagcc

SEQ ID NO: 474630 - RNA, 64 nt, Human
ugcagcuucuccagggccgacagcugagggcugcucccugcaucauccaagcaaugaccucaga

SEQ ID NO: 474631 - RNA, 64 nt, Human
uucuucccuucacucucccacuucuguggucaacucccugcagaacucccaaacugccguucuu

SEQ ID NO: 474632 - RNA, 64 nt, Human
cuuggggugugagugagacagcuugccagcugcaucccugcagacagaggauguguguccacau

SEQ ID NO: 474633 - RNA, 64 nt, Human
cuaacacaggagaugaugggaaccugucccgcagucccugcaugaccauuggcccugcuggccu

SEQ ID NO: 474634 - RNA, 64 nt, Human
gggcugauaggggcuuucagggaggcugguuagcucccugcacucuggcucuuuacuggcuuac

SEQ ID NO: 474635 - RNA, 64 nt, Human
ggggcaccuccggcugccuagcccuccccccagcucccugcaccgccgcagaagcagccccucg

SEQ ID NO: 474636 - RNA, 64 nt, Human
gccuuaaugucugccgggggcccaggcugugcugucccugcagcacgccuccuugcagggaucu

SEQ ID NO: 474637 - RNA, 64 nt, Human
ucaagaggcugcuccugccugcuucgaucauuucucccugcagcugccuagaccccguucacag

SEQ ID NO: 474638 - RNA, 64 nt, Human
uccccaugguucauguggagccacgaacauccuuucccugcaguccauuugucuguguggcagg

SEQ ID NO: 474639 - RNA, 64 nt, Human
ucuacccccggccccgcuccugcccauuccucugucccugcagacucagugcagcacuuccaca

SEQ ID NO: 474640 - RNA, 64 nt, Human
cucucucuccuccccuucccuucucccaucucugucccugcaagcacagggcuaaggagggaua

SEQ ID NO: 474641 - RNA, 62 nt, Human
acaccaaugggaccaaguccaaauggauuaauccaggacagaauagccacuugcuuaauuuu

SEQ ID NO: 474642 - RNA, 62 nt, Human
acccuaagcacugcugcccauggggacacggcccaggacagcccgggggcccugcagcuuca

SEQ ID NO: 474643 - RNA, 62 nt, Human
aaaaaaaaaaaaagguagcugugauacaaaccccaggacacccacccacccaaagagccaaa

SEQ ID NO: 474644 - RNA, 64 nt, Human
ccuggaagaaaacuggaaccaacucugcccuaccucccugcacuaaccagcuuugaggauggca

SEQ ID NO: 474645 - RNA, 64 nt, Human
agcuuccaaauacaacuccaguaagacaucccuuucccugcaggaguguggucuauauucuuua

SEQ ID NO: 474646 - RNA, 64 nt, Human
cccaccccagggcaaugcugcugugaugugccuuucccugcaguccuuccaugugggagcagag

SEQ ID NO: 474647 - RNA, 64 nt, Human
ucucuuuguugaaggguucauagcagcccugccaucccugcagcagaaugagagagggugaaca

SEQ ID NO: 474648 - RNA, 64 nt, Human
cugacagcugcagcugccuugccuugccgccgccucccugcagggccccuguuccaaugaaaaa

SEQ ID NO: 474649 - RNA, 64 nt, Human
gggcucagugguuuuuggagugaagaagccuuacucccugcacauucccucaugcucccacaca

SEQ ID NO: 474650 - RNA, 62 nt, Human
ccccauagaaacauaauaaauauacaaguuguguucccugcacuaaguggcucuuguuuauc

SEQ ID NO: 474651 - RNA, 64 nt, Human
cgagucuuuccagcucuuccuccauucuggccagucccugcauccucccugggguggaggaugg

SEQ ID NO: 474652 - RNA, 64 nt, Human
gcacugucuggcuguguggguagagaccauccuuucccugcauauuaggccagcuugugccaua

SEQ ID NO: 474653 - RNA, 64 nt, Human
uagcagcauccucuacugaggugauuucauuuauucccugcagcccacugauaaauaucucacu

SEQ ID NO: 474654 - RNA, 64 nt, Human
uggaggaugaccuucggucggucugucuggguucucccugcagacagcuuccuagcucaugccc

SEQ ID NO: 474655 - RNA, 64 nt, Human
acaaguaguccuugaaacugagccccauucugaaucccugcaggccaagucauugcucagccag

SEQ ID NO: 474656 - RNA, 64 nt, Human
uauauauauauaaaaugaaugcagauugcgaaggucccugcaaauggauggcuugugaauuugc

SEQ ID NO: 474657 - RNA, 64 nt, Human
gaagugacccaaggcugcccacuggagacgccucucccugcagucccccgagaggugggagacu

SEQ ID NO: 474658 - RNA, 62 nt, Human
uccugagaggcaagauuccucuuaauugauaaccaggacaaccagguagucacccaguccuc

SEQ ID NO: 474659 - RNA, 62 nt, Human
ucaguuugaaaaggguuuauucccaucacugcccaggacacccuguggcuuuacuugcucau

SEQ ID NO: 474660 - RNA, 62 nt, Human
caggccuagcuucucccagaacucccggacagccaggacagccucguggcugggcaggagcc

SEQ ID NO: 474661 - RNA, 64 nt, Human
auucccagcauccagcuccuauucuagugccucuucccugcagggcagggaccccuugggaaau

SEQ ID NO: 474662 - RNA, 64 nt, Human
uuuauuucauguugcccaguaaaaguauacaaauucccugcacuagcagaagagaauucuguau

SEQ ID NO: 474663 - RNA, 64 nt, Human
ucugacaccacguccucacucaccugcacaagaaucccugcaucagguucuccuuugaggguac

SEQ ID NO: 474664 - RNA, 64 nt, Human
aucuuugucuugcaaauccuaagggaaaagcaagucccugcagugagcacuagggacagucuaa

SEQ ID NO: 474665 - RNA, 64 nt, Human
cucuaaacccgguuuggcugccuugugaaaugauucccugcaguaaacggacuuuucauuuauu

SEQ ID NO: 474666 - RNA, 64 nt, Human
ggaaaaugucacugugacaaaagccagcauacuuucccugcacccaucugcucaccagaucuca

SEQ ID NO: 474667 - RNA, 57 nt, Human
agacggagcacacuuguuagcgaauccucccugcacugcauucgcacaaacugcuuc

SEQ ID NO: 474668 - RNA, 64 nt, Human
gccuguguguaguuuaaccugggcaggacacaucucccugcauuuuuuuuuuuuuuuugagaga

SEQ ID NO: 474669 - RNA, 64 nt, Human
cuccacuuacguuuagcgcgcauccugggacuugucccugcagcucaccggguuagccguggca

SEQ ID NO: 474670 - RNA, 64 nt, Human
uguguaugcguuugugugcagcucuucuuccugcucccugcacauugagggcuucauggggggu

SEQ ID NO: 474671 - RNA, 64 nt, Human
cccaaccagccacgccucagccucucccagucucucccugcaguccugcagcagcagcccccac

SEQ ID NO: 474672 - RNA, 64 nt, Human
uccuccccccaccauccaagacuauuagguuuugucccugcacccuucacuggcauccucaauc

SEQ ID NO: 474673 - RNA, 64 nt, Human
uuuuaauuaucuaaguuuuaauacaagaacgauuucccugcauaauuuuaguacuugaauaagu

SEQ ID NO: 474674 - RNA, 64 nt, Human
uaaaaaaaucucuucaucguugaacugugcauuuucccugcauuuuuucccaacaaaauuuugu

SEQ ID NO: 474675 - RNA, 62 nt, Human
ccccagacccuuauuccagaugcugagagugaccaggacagcagcuccugaggcccaguggu

SEQ ID NO: 474676 - RNA, 62 nt, Human
acagugccauggcuccagugcucuggugucacccaggacacagccacucggggccccgcugc

SEQ ID NO: 474677 - RNA, 62 nt, Human
gagauugaggugaaagcuucguccgagaaacgccaggacagacgauggcagaggagagggcu

SEQ ID NO: 474678 - RNA, 64 nt, Human
caagguaaucaaacuaauaaaauuccauauaucuucccugcaucuugucacuguguaccauuca

SEQ ID NO: 474679 - RNA, 64 nt, Human
augugggaggauaaauccucaagucccuugacuuucccugcaaaagggucuuuauauuugcuac

SEQ ID NO: 474680 - RNA, 64 nt, Human
ucccaaacuccuucccugcuuuccagguugccagucccugcacucuuccuuucuggccaaggau

SEQ ID NO: 474681 - RNA, 64 nt, Human
uuuccauauaccucaugcauuguggguuaaaaagucccugcaucacuucuguucucacagguac

SEQ ID NO: 474682 - RNA, 64 nt, Human
cuucaagaguccugaagaucaagccaguucuccuucccugcagagcuuuggccauuaccaccug

SEQ ID NO: 474683 - RNA, 64 nt, Human
ggcacccaccaugccaauaaggcucuccgcuggcucccugcaguuggcuggguguuuaauaguc

SEQ ID NO: 474684 - RNA, 64 nt, Human
uaggaugugcauuuucaccugagguuucccugcaucccugcagugccaaagccccaccuucagg

SEQ ID NO: 474685 - RNA, 64 nt, Human
aaggaauuuaggaugugcauuuucaccugagguuucccugcaucccugcagugccaaagcccca

SEQ ID NO: 474686 - RNA, 64 nt, Human
agugaaggaacaaauguuaaaggguaagauaauuucccugcaaaaggacacagaaggcagucuu

SEQ ID NO: 474687 - RNA, 64 nt, Human
cagaaggugaguagcuccccgaggcacccuccucucccugcacacagauggggaaaccgagggc

SEQ ID NO: 474688 - RNA, 64 nt, Human
cagggcuccuguccaccagcacacucaguucucuucccugcaguguuuucauuuuauuuuagcc

SEQ ID NO: 474689 - RNA, 64 nt, Human
ggaggcucccagcuagcaccuugcuguccucccuucccugcagcuccagucagugugcagggga

SEQ ID NO: 474690 - RNA, 64 nt, Human
ccuugcucggcacuccguggugguccugcccuucucccugcaugccugugggucugcucuggug

SEQ ID NO: 474691 - RNA, 64 nt, Human
gggggcccggacacuugggacccugaccccuuugucccugcacucagcccuguggccccuuccu

SEQ ID NO: 474692 - RNA, 62 nt, Human
uacaggugcuacgccaccuggcgcuucggcucccaggacauggcugacuuugccaaccugcc

SEQ ID NO: 474693 - RNA, 62 nt, Human
ggcaaaauaguggagaacgcaggacacaguuuccaggacauggccguggaggugggugcggg

SEQ ID NO: 474694 - RNA, 62 nt, Human
uuugcucagaagccuccugucuccagcucucuccaggacaggcccaguccucugaggcacgg

SEQ ID NO: 474695 - RNA, 64 nt, Human
uaaagaguacacucagccacugucacaggcauauucccugcacacacaugcauacuuacagacu

SEQ ID NO: 474696 - RNA, 64 nt, Human
cgggcuggcauuuugugacccuucccuguugcugucccugcaucucgucugugugcccagggug

SEQ ID NO: 474697 - RNA, 64 nt, Human
cagaccuuaaaaacagcuaaguaccuagaagagcucccugcaaguguaaauauuaaggaugacc

SEQ ID NO: 474698 - RNA, 64 nt, Human
gcccuccugcuccaagagggauaaccugcaccccucccugcaagggguucagagcccagcacag

SEQ ID NO: 474699 - RNA, 64 nt, Human
cugugaugacauauauguagcaugugcucugcgcucccugcaagcugagcagauacaaccaaug

SEQ ID NO: 474700 - RNA, 64 nt, Human
aagucccuccagcuuaucucccacaacaacccuuucccugcagagcaugguuuguauaccacaa

SEQ ID NO: 474701 - RNA, 64 nt, Human
cuccaggaccaagccggguucuugguccccacccucccugcacuccgcaucuccuccccagcag

SEQ ID NO: 474702 - RNA, 64 nt, Human
acaaauuccuaugaccaaauugcuugccuacaguucccugcaguaauuguaugaucucacccag

SEQ ID NO: 474703 - RNA, 64 nt, Human
aaaacaaaucuuguugcugauuuguccauuucuuucccugcacuuuguuacaucugggauacag

SEQ ID NO: 474704 - RNA, 64 nt, Human
ucaucuuucagaaguuugguaaacauugggauugucccugcaucugaacaucuuucccagugcu

SEQ ID NO: 474705 - RNA, 64 nt, Human
gccgacaucagcauugucucguguacagcucccuucccugcagggcgccccugggagacaacug

SEQ ID NO: 474706 - RNA, 64 nt, Human
cccugcccugcccaucccuccugcaccagcgcugucccugcacacuuugguucagucccggugc

SEQ ID NO: 474707 - RNA, 64 nt, Human
gagcuagaaggcccugcagcuacagcugcuucauucccugcauuagugccugguuacuggguac

SEQ ID NO: 474708 - RNA, 64 nt, Human
gagcuagaaggcccugcagcuacagcugcuucauucccugcauuagcgagcaguuauuggguac

SEQ ID NO: 474709 - RNA, 62 nt, Human
caccuaaacguuucagggcugaaaugggguugccaggacaacaagcauggcaggggcgaaug

SEQ ID NO: 474710 - RNA, 62 nt, Human
ugcuaagagcucacaaaaauaagauagaauuuccaggacaaacaucuuuggaauugugagug

SEQ ID NO: 474711 - RNA, 62 nt, Human
gucuguauuuuccaccuuuuguuuuuccaguuccaggacacagauuaucaacuggggggacc

SEQ ID NO: 474712 - RNA, 64 nt, Human
ucugaucuaucucuggaaaaccagccauuccuccucccugcagucagaauucuuugcccugucu

SEQ ID NO: 474713 - RNA, 64 nt, Human
auaccaggugauacuauucaaaaaccccguugucucccugcaagugcugauuugaaaugcagaa

SEQ ID NO: 474714 - RNA, 64 nt, Human
aguguaagauagauuccaugugugcuuauauaggucccugcacagauuggacuugaaccaaaau

SEQ ID NO: 474715 - RNA, 64 nt, Human
ucuuuuccuguggccccagugaaaccuccugcccucccugcacgucugugucuucauuucuaaa

SEQ ID NO: 474716 - RNA, 64 nt, Human
aaucuaggccgggugcaguggcucaugccuauauucccugcacuuugggaggccaaagcaggag

SEQ ID NO: 474717 - RNA, 64 nt, Human
agaggcuuggcgcaugcggcacccagcggcugcuucccugcaagccagcgacuugccgagcaga

SEQ ID NO: 474718 - RNA, 64 nt, Human
gagccuugagggccucaugguugcagggcaggcuucccugcagauggguggcagccccugguag

SEQ ID NO: 474719 - RNA, 64 nt, Human
agcauccagagccucuguccugcccacgcuagccucccugcagggaccccgggccggcugcagg

SEQ ID NO: 474720 - RNA, 64 nt, Human
aaugcugacuucgccucuuccugcuguaugcucaucccugcacugagcacagauaugacaagca

SEQ ID NO: 474721 - RNA, 64 nt, Human
uaugcgucagagcuuccuccuucuacaagcuaacucccugcaucugggcaucaggacugcucca

SEQ ID NO: 474722 - RNA, 64 nt, Human
ugguacuuuuuuguuuuauuuuuucucuagcuuaucccugcacaauuauuagagugaaugaaaa

SEQ ID NO: 474723 - RNA, 64 nt, Human
auuuuguuucuggagaaggcagcaaacuuuuacuucccugcagaaguaguuaaguacauagugu

SEQ ID NO: 474724 - RNA, 64 nt, Human
guuaccauaaagcuaaugcucuggcacaagcgagucccugcaaacuaccacugcugaggacagu

SEQ ID NO: 474725 - RNA, 64 nt, Human
ugcccaggcuggagcgcaguggggugaucucaucucccugcaaccuccgccuccuggguucaag

SEQ ID NO: 474726 - RNA, 62 nt, Human
gcuuccagcuccucugcaccagaccugaccagccaggacagggccuggggugugugugagug

SEQ ID NO: 474727 - RNA, 62 nt, Human
ggugccgaguauguuucgguccccuccagacuccaggacacgcccauguauguccccugcgu

SEQ ID NO: 474728 - RNA, 62 nt, Human
acugguuggaguuauggaaaagaugcccugugccaggacagcaguucauuguuacuguaacc

SEQ ID NO: 474729 - RNA, 64 nt, Human
uaugcaaggugaauauguacugagcuaggagacuucccugcaaaaucucuguucacccuggguu

SEQ ID NO: 474730 - RNA, 64 nt, Human
uucaaacauagaaagggagcugcuuuuaaagaauucccugcaaauacugaaagcagucaugcga

SEQ ID NO: 474731 - RNA, 64 nt, Human
acuaggagcuggccucccaccucugcaggguuauucccugcaccucgaggccgcugcgggccaa

SEQ ID NO: 474732 - RNA, 64 nt, Human
gggccucagcuucccagcugcccuggcuuagccuucccugcagccccuccccaacaggcuuggu

SEQ ID NO: 474733 - RNA, 64 nt, Human
gacccaaggcucacugcagcgcgcuccugaccccucccugcaggggcuacguuagcagcccagc

SEQ ID NO: 474734 - RNA, 64 nt, Human
guagaucugugcagcgagguccaccccguuguugucccugcagggcagaaaaacgucuaacuuc

SEQ ID NO: 474735 - RNA, 64 nt, Human
cuucccacccacccaguccauucacccucaccucucccugcauggaggcaacagcauuucaaga

SEQ ID NO: 474736 - RNA, 64 nt, Human
acuuagcguuuggauagacuccaugccuucucucucccugcaaagaaaaaucuugaacauuuau

SEQ ID NO: 474737 - RNA, 64 nt, Human
aaauacuaaguggccaaaugauaaaaaaaacugcucccugcacaugaguguaaaaacauguuug

SEQ ID NO: 474738 - RNA, 64 nt, Human
uugaguuacuuuuucuuuuccauuuuacuuugcuucccugcauuucgaagcugcucuuucuggu

SEQ ID NO: 474739 - RNA, 64 nt, Human
auauaccccacaggcuguguacuuuacugggcucucccugcacgcauuuucucuguaguuacau

SEQ ID NO: 474740 - RNA, 64 nt, Human
gugaguccauucaucuaucagagcuggaaccucaucccugcacagaugaggaaaccaaggcaug

SEQ ID NO: 474741 - RNA, 64 nt, Human
gguuuugggacuagaggcucaguggugggagagaucccugcagaacccaccaaccagaacgugg

SEQ ID NO: 474742 - RNA, 64 nt, Human
cggagacccucaguuguccuauuccuuccuagcuucccugcaauaaaaucaagcugcuuuuguu

SEQ ID NO: 474743 - RNA, 62 nt, Human
uccuccuguagggguguggccacuuccccaccccaggacagcgcuucuccguccaaugccaa

SEQ ID NO: 474744 - RNA, 62 nt, Human
ggucucagagaggguccuacuuuuagguuuucccaggacaggacaguccccauuuauacuua

SEQ ID NO: 474745 - RNA, 62 nt, Human
aguuuuuacccggcuuugccugccaccucugcccaggacacucuucccucucgggaugugug

SEQ ID NO: 474746 - RNA, 64 nt, Human
auuucgcuguauaacaagcauagacaaaugagugucccugcacuaagaagaaucacuuuaaaaa

SEQ ID NO: 474747 - RNA, 64 nt, Human
gagcaggugagggggucugcgguggcuccugucuucccugcagcagggaaggagggccgugugg

SEQ ID NO: 474748 - RNA, 64 nt, Human
ucauccgggcuggaauucuugguuuuucagccauucccugcagagucacucaaucaucaagucc

SEQ ID NO: 474749 - RNA, 64 nt, Human
ccagagcuggugccagggucagcccagcgaggagucccugcaauaagccccugcauuugccaag

SEQ ID NO: 474750 - RNA, 64 nt, Human
ugacaaaugagggauguuagcuuuguggcagaauucccugcaugugugauaacugaucuuguuu

SEQ ID NO: 474751 - RNA, 55 nt, Human
aguacaccagcuccaaguaaacuugucccugcaacugccuuaguaaacccaaagg

SEQ ID NO: 474752 - RNA, 64 nt, Human
cauggacucauguggaugugguuuggcucagaugucccugcaauaaacaaggggucaguacuua

SEQ ID NO: 474753 - RNA, 64 nt, Human
uugcuaggcuggagugcaguggugcgaucucagcucccugcaaccuccaccuccuggguucaaa

SEQ ID NO: 474754 - RNA, 64 nt, Human
cauggaugcacguggauguaguuuggcucaggugucccugcaguuggcaaggagucaguacuca

SEQ ID NO: 474755 - RNA, 64 nt, Human
gaggcugaagaacuuugugacacaauaguccaccucccugcaaaggcucugucagagacucaca

SEQ ID NO: 474756 - RNA, 64 nt, Human
uaagggugaagucugaaucucauacccuuuccacucccugcauggucaccucaguccuggacau

SEQ ID NO: 474757 - RNA, 64 nt, Human
uacaaggacauguacuaacggcggcacccaggccucccugcagacuccaauggggccagcacug

SEQ ID NO: 474758 - RNA, 64 nt, Human
cccuuuacucagcccagcuggccaccuagaagucucccugcacagccucuaguguccggggacc

SEQ ID NO: 474759 - RNA, 64 nt, Human
ugucuguuucccaugucacaaguccucuggccucucccugcaugucuuaaguaucuuucccuuc

SEQ ID NO: 474760 - RNA, 62 nt, Human
cacuggacuaaaggcuucaguggcugcgugucccaggacaggucauggccccucucugggcc

SEQ ID NO: 474761 - RNA, 62 nt, Human
guuggcagcuucaagaagagaagaccuucuugccaggacauaaaaugauacccuccucuggg

SEQ ID NO: 474762 - RNA, 62 nt, Human
uccugcuuuuccaguuuggcuccacaaguccuccaggacagagcccucaaagcaacucccaa

SEQ ID NO: 474763 - RNA, 64 nt, Human
aacaaaauacuagguaagucacugcagaccgaccucccugcaguuugggaaagaagcuggguuu

SEQ ID NO: 474764 - RNA, 64 nt, Human
ccggcuggagcuucgggauggaaagugcuaugugucccugcauauaagaaucaccaggccagug

SEQ ID NO: 474765 - RNA, 64 nt, Human
uccauguagcugauucuguuuuucacaucuauacucccugcacccuucugacugacaguucauc

SEQ ID NO: 474766 - RNA, 64 nt, Human
cagcgcugcggucuggucucagggcgcaaacacaucccugcacccggugguggugauguuggga

SEQ ID NO: 474767 - RNA, 64 nt, Human
agacuaccacaaucaagcuaaaccuacauuacugucccugcauuaguuuacuguugaauacuag

SEQ ID NO: 474768 - RNA, 64 nt, Human
uuuggcuguggugccgccuaguggaaaaaggaagucccugcagcaguccccgcacucuuuaagc

SEQ ID NO: 474769 - RNA, 64 nt, Human
augucugcauuucgguggcuagucaagcuccuccucccugcaucugaccagcagcgccuuuccc

SEQ ID NO: 474770 - RNA, 64 nt, Human
gccuuccccauauuuucaaccacucugauuaucuucccugcacaacuaacauccaguaauaauu

SEQ ID NO: 474771 - RNA, 64 nt, Human
aagggaaagaagguguggagaagacacaggugcuucccugcaaucugaaagugaugcucaucac

SEQ ID NO: 474772 - RNA, 64 nt, Human
agaaaucuccauuccacacaugacugaguuccuaucccugcacugguacuggcucuuuucuccu

SEQ ID NO: 474773 - RNA, 64 nt, Human
aagaagauucuugugaaguuuccccagcaccccuucccugcauguguuccauugugacuucucu

SEQ ID NO: 474774 - RNA, 64 nt, Human
aucgauggcuuaacauauacaacagcauuucuucucccugcaccuuuucgugaaccugacauuu

SEQ ID NO: 474775 - RNA, 64 nt, Human
aaauaucuucuaauaaaaauauauuuggcucuuaucccugcacauguagaggcauaaaaauugg

SEQ ID NO: 474776 - RNA, 64 nt, Human
cauuuacuuagcagaaccacauauuuuagacacuucccugcauuaacugcacaaacaauauguu

SEQ ID NO: 474777 - RNA, 62 nt, Human
aacuggugcuguacuggguacacaguaggcgcccaggacaaguggguugcaagacaggaaga

SEQ ID NO: 474778 - RNA, 62 nt, Human
cuuuccuucacaccagacagccccucaugucuccaggacaggacaggacuacagacaacucu

SEQ ID NO: 474779 - RNA, 62 nt, Human
aucagcaagcgacucaagagcaggcaccgccuccaggacaacgugcgcgaggaccucuauga

SEQ ID NO: 474780 - RNA, 64 nt, Human
cagucugacccaaagccauggccaccacccucagucccugcagccuccuccucauccuccccug

SEQ ID NO: 474781 - RNA, 64 nt, Human
agauaagguguuaggugcaaaggaugucuaauaaucccugcacacguuuugaacuugcagugaa

SEQ ID NO: 474782 - RNA, 64 nt, Human
cuagcuuugauggcagcaagaccaaaaguagaaaucccugcacucaucacaaagcccauacaac

SEQ ID NO: 474783 - RNA, 64 nt, Human
ccuuccuggguguuaacuggggacucucuugaccucccugcaucaaccugcagaauaaaugaga

SEQ ID NO: 474784 - RNA, 64 nt, Human
aguuuagcauugugucacuacaaggguacaguaaucccugcacuggacaugugaggaaaaaaau

SEQ ID NO: 474785 - RNA, 64 nt, Human
ugauuuuggucaauuuuauuauuaauucuuaaauucccugcagagaaugcccccuuuauugcug

SEQ ID NO: 474786 - RNA, 64 nt, Human
uggcauugcucccacugagcccuacuccacccugucccugcacucccuugguugccaaaaaaau

SEQ ID NO: 474787 - RNA, 64 nt, Human
cagauuaacagaaagacacucaacuggacucaugucccugcaauuaaacuuacuucaaccuuuu

SEQ ID NO: 474788 - RNA, 64 nt, Human
auacauacaugauuuuucuucugaaugucucuucucccugcaucacuguucauucacaaugaaa

SEQ ID NO: 474789 - RNA, 64 nt, Human
guauuuuuugaaaaagggacauguguccugugggucccugcagucgacaucauguuuggcuggg

SEQ ID NO: 474790 - RNA, 64 nt, Human
agccagcucccuggagucguguguccuggcagugucccugcaagaacugguucugccagccugc

SEQ ID NO: 474791 - RNA, 64 nt, Human
ugauuauuagugccuggugcuucugcaccgggcgucccugcaucugacugcuggaagaagaacc

SEQ ID NO: 474792 - RNA, 64 nt, Human
gggccagaaggacuccauggcccaaagacccuccucccugcaggcacugugggaacagacacag

SEQ ID NO: 474793 - RNA, 64 nt, Human
cacggaguagaauuccagggcugccuugacuucuucccugcaugcucccucccagugacuuucc

SEQ ID NO: 474794 - RNA, 62 nt, Human
gcugucuccgcggaagucagggcggcuggauuccaggacaggagugaauguaaaaauaaaua

SEQ ID NO: 474795 - RNA, 62 nt, Human
ugaggagcaccugaagaaaucaagccaggugcccaggacagaagccccagccccagccucau

SEQ ID NO: 474796 - RNA, 62 nt, Human
aagagcccacauguagcccugagguuuccuucccaggacagcugcaggguagagaucauuuu

SEQ ID NO: 474797 - RNA, 64 nt, Human
aacaucaguauagaucuuuccgguaucccuguucucccugcaaauccaauuccuguuaucaaga

SEQ ID NO: 474798 - RNA, 64 nt, Human
ccugacgcgcgcccgcaggguggagaucgcugcaucccugcagcucaacgagacccaagugaag

SEQ ID NO: 474799 - RNA, 64 nt, Human
uuugaccagagaggcccagauggaggcuguucauucccugcagugucggcauuguaaauaaagc

SEQ ID NO: 474800 - RNA, 64 nt, Human
aggcagagccuuauccucggcugcccuucuuggcucccugcauuccagggacuugcucgucuug

SEQ ID NO: 474801 - RNA, 64 nt, Human
cugggggaggggccaaagcagggacaguggccccucccugcagcuggaaccagcaucucugauu

SEQ ID NO: 474802 - RNA, 64 nt, Human
cuuuacaggaguucaaaugcaaauaagcuccaccucccugcacuuguagucuaaaaaguaaaag

SEQ ID NO: 474803 - RNA, 64 nt, Human
ucccacguggucgccugcauuucuccgugcguccucccugcacucauacccccccuucaacccg

SEQ ID NO: 474804 - RNA, 64 nt, Human
aaagaggacaugagcaagcguaucacaucugcccucccugcaauugggcagcuccccuggaaga

SEQ ID NO: 474805 - RNA, 64 nt, Human
uuaguggcuucagauuggagaccagccugggacuucccugcagugagagagcaucucccccugg

SEQ ID NO: 474806 - RNA, 64 nt, Human
ggugugagugugugggugugugauaagcuucucaucccugcauagaugcaguauucuuagccuu

SEQ ID NO: 474807 - RNA, 64 nt, Human
ggugcuguuucaggcugggcaucgccaggcggccucccugcaaaccaagggcugggggcaaagg

SEQ ID NO: 474808 - RNA, 64 nt, Human
gcucggcauuugguuucacuaagggccaugugguucccugcagccucaugccuggccccuugac

SEQ ID NO: 474809 - RNA, 64 nt, Human
cuaccuuccuucucgggucucuggggccuucuccucccugcagugccaacaugcacugcccaca

SEQ ID NO: 474810 - RNA, 64 nt, Human
cgcccaggcuggacugcaguggccugaucucugcucccugcaagcuccgccucccggguucacg

SEQ ID NO: 474811 - RNA, 62 nt, Human
aagcauuugcuguguuucguuagcaucuggcuccaggacagaccuucaacuuccaaauugga

SEQ ID NO: 474812 - RNA, 62 nt, Human
ugcccucucuuugacccccagggacccuugccccaggacaccgccuaccccguacagacccc

SEQ ID NO: 474813 - RNA, 62 nt, Human
cuguuauccccugguguacacauggaagaggaccaggacauaccaccuggggaugggcugac

SEQ ID NO: 474814 - RNA, 64 nt, Human
aaggcugggggccuccugcucucgucccuggcccucccugcacagggcaaagccagucugggcu

SEQ ID NO: 474815 - RNA, 64 nt, Human
gcugcggcccaggcagccaguccuggugguguucucccugcaugcccuccguggcugggcugcc

SEQ ID NO: 474816 - RNA, 64 nt, Human
cuggcagcugguggcccccacccaguaccgcaucucccugcaguuugacuucuuugagacagag

SEQ ID NO: 474817 - RNA, 64 nt, Human
cacgcguaugcugcccucuacaggcugcucggccucccugcagcucagcgcagcccagggcucc

SEQ ID NO: 474818 - RNA, 61 nt, Human
ccgagccuggaucccaguaaggaucuugcccucccugcaacaccgagugccuuagacagcu

SEQ ID NO: 474819 - RNA, 64 nt, Human
gagcucaagccaagcccagaggcaguggcuggggucccugcaggucaugaggggccuaugccuu

SEQ ID NO: 474820 - RNA, 64 nt, Human
gcgcuugcucugaagccuugugagcaaggaaggcucccugcauguccugcuugcugcacgccac

SEQ ID NO: 474821 - RNA, 64 nt, Human
cuucugccuaacaacauggaaaaggguuuucuuuucccugcaagcuacauccuacugcuuugaa

SEQ ID NO: 474822 - RNA, 64 nt, Human
cgcauagguacaagugcugcuuugucagccucacucccugcagcucucagcucccuguucccug

SEQ ID NO: 474823 - RNA, 64 nt, Human
cucuggggccgagugugguggcuuaugccuguaaucccugcacuuugggaagccaaggcgggca

SEQ ID NO: 474824 - RNA, 64 nt, Human
agguggaaggaagaacuguugcuuuaucucccccucccugcaugugucaacauugugaugucag

SEQ ID NO: 474825 - RNA, 64 nt, Human
uggcuggaggagcagcagcuuggggagagggauuucccugcagaccucaagccaucaugcggug

SEQ ID NO: 474826 - RNA, 64 nt, Human
aaccaaccaguucagaaugauacggaacagcauuucccugcagcuaaugcuuucuuggucacuc

SEQ ID NO: 474827 - RNA, 64 nt, Human
cggcaugcuuaucgaugucugcaaguaccugggcucccugcaguaccgcgucuggaagaagaug

SEQ ID NO: 474828 - RNA, 62 nt, Human
gacagaucacagggacaucuguggcucccaguccaggacaggaaggacugagggucuggcug

SEQ ID NO: 474829 - RNA, 62 nt, Human
caauggcacaauuguuugcuaugugcacccguccaggacagaaccgugcauaggcaaaagga

SEQ ID NO: 474830 - RNA, 62 nt, Human
agacucaugaugcugcuaucucaaccagaugcccaggacaggugcucuagccauuaggacca

SEQ ID NO: 474831 - RNA, 64 nt, Human
augucaaguccagagucaguuucuaucccaauucucccugcagccugaagaacggauccuuguc

SEQ ID NO: 474832 - RNA, 64 nt, Human
agaaaauguauauaggaauaugcuacuugccuccucccugcauuuccucguggggcacuauuug

SEQ ID NO: 474833 - RNA, 64 nt, Human
uuuuuuuuuaauugccuuguauuguaaguauucuucccugcaguccaagugacuuuucauuuuu

SEQ ID NO: 474834 - RNA, 64 nt, Human
agguucagucugugucacgaaccauuucucugguucccugcagacaggaaagguugucccuaag

SEQ ID NO: 474835 - RNA, 64 nt, Human
cuaaguuuuuauaccagcuuaauagcuguaguuuucccugcacugugucaucuuuucaaggcau

SEQ ID NO: 474836 - RNA, 64 nt, Human
ugaacuuggaaauuagguucuacucacuuggacaucccugcaucauggacuguugcugcucccu

SEQ ID NO: 474837 - RNA, 64 nt, Human
ccaggcuggugcagccuacauggcacaggauauuucccugcaccaguuucccaccugucacuug

SEQ ID NO: 474838 - RNA, 64 nt, Human
auaaauguuaggaagggggagguauggggugacuucccugcaguccugggggccuagaugggcc

SEQ ID NO: 474839 - RNA, 64 nt, Human
gucaucgcacaugacucucccguuugucucagugucccugcaacaagcagcaccgcagacugua

SEQ ID NO: 474840 - RNA, 64 nt, Human
gcagaguauuauuuuguauauguaugccauuuucucccugcaaagcagcucaacaagagaaaaa

SEQ ID NO: 474841 - RNA, 64 nt, Human
ucagaguggcucgggucagcgcagccagcccagcucccugcagcccaagucucaagccuccaaa

SEQ ID NO: 474842 - RNA, 64 nt, Human
agugagacuguuggcuuaggaagggugguaccucucccugcaucauacccaggaacugccagcu

SEQ ID NO: 474843 - RNA, 64 nt, Human
acagccacgaagaacaugcagccacugggccccaucccugcaggcaucaugguaacuucuaggg

SEQ ID NO: 474844 - RNA, 64 nt, Human
ucacugcucuuuggucaauauucugauuuuccucucccugcauuguuuuuaaaaagcacauugu

SEQ ID NO: 474845 - RNA, 62 nt, Human
gccagguccuugaucauggaacuauagagcuaccaggacauauccugcucucuaagggaauu

SEQ ID NO: 474846 - RNA, 62 nt, Human
ucucuugacccugucacuugcuggcugugaaaccaggacaagcuacuuaacuugguagccuc

SEQ ID NO: 474847 - RNA, 62 nt, Human
ccgggcggggacuuguucccggucagccugucccaggacagcccacuccagaggcacaggag

SEQ ID NO: 474848 - RNA, 55 nt, Human
uaguucuccacaaggucuaacucuuucccugcagugucuuugaaacuugaacaua

SEQ ID NO: 474849 - RNA, 64 nt, Human
ccccaggagucgccauaccugugagguguccaccucccugcacauggcacuacccagacugcca

SEQ ID NO: 474850 - RNA, 64 nt, Human
uguuacagacaagaagucagaggaaagggcggggucccugcagggcugaagccuaagcuacugu

SEQ ID NO: 474851 - RNA, 64 nt, Human
ugccucuuccugcuaccugugggucugcccagagucccugcaggccuguccaugcauuaaaaau

SEQ ID NO: 474852 - RNA, 64 nt, Human
ugucuaaacauuguuuacaagacuaaggcccacuucccugcaggcugaccugaaccucaggggg

SEQ ID NO: 474853 - RNA, 64 nt, Human
gaggggaugcuguguuugggggguuguuuccaagucccugcaaagaagcaccacucuagacugg

SEQ ID NO: 474854 - RNA, 64 nt, Human
cuuccuccuggaguccggagccgccuacaacugcucccugcacggugcguccugcuggucuggc

SEQ ID NO: 474855 - RNA, 64 nt, Human
acacagggugagaagagucagggccgcaccucugucccugcaaaccaacaggugcauggugagu

SEQ ID NO: 474856 - RNA, 64 nt, Human
cgcucaggguugcggcagagccauggacuuccggucccugcaacgggugaccuaagcguggugc

SEQ ID NO: 474857 - RNA, 64 nt, Human
ggauaggaagacgcagagcaaaugagcuccggagucccugcaggugaauaaacacacagaucug

SEQ ID NO: 474858 - RNA, 64 nt, Human
gcucccgggucacucuuguggccccaguggguggucccugcagucauggccugagugcgcaggg

SEQ ID NO: 474859 - RNA, 64 nt, Human
cccugcucgaugcucacagggcccccagcgagagucccugcagucccuuucgacuugcauuuuu

SEQ ID NO: 474860 - RNA, 64 nt, Human
guuuguuuugggguguuuccaauuuggauuuuuuucccugcaucuauccucuaaguuguuucgg

SEQ ID NO: 474861 - RNA, 64 nt, Human
ugaagggcuuggggacuuguggaucauuccuuccucccugcaggagcuucccaagcuggucaca

SEQ ID NO: 474862 - RNA, 62 nt, Human
auagggaggauaccagcaggcccuuaagccuuccaggacacuaaggucgugggagcgggacu

SEQ ID NO: 474863 - RNA, 62 nt, Human
agacugaggcugaagaauugacggcucuggacccaggacagacagacagacagacagacaga

SEQ ID NO: 474864 - RNA, 62 nt, Human
ggucucacucaguccucugcaucccaacauucccaggacaugcaugaucaccagcauuuauu

SEQ ID NO: 474865 - RNA, 64 nt, Human
auucaaauaugucaccaaaguugguggugguccuucccugcacccuugcguuaagccauuaugu

SEQ ID NO: 474866 - RNA, 64 nt, Human
gacugggaggacuaguucguagccauaccucgagucccugcauuggacggcucugcucuuugga

SEQ ID NO: 474867 - RNA, 64 nt, Human
aucaaugggaaauacuacuccuguaauuccuaccucccugcaaccaacuacaaccaagcucucu

SEQ ID NO: 474868 - RNA, 64 nt, Human
auccacggcuuuccagugcggagagucgagaugcucccugcagcccaggccccgggcaccuccu

SEQ ID NO: 474869 - RNA, 64 nt, Human
aagaagagcagauggccuggcugcugcugugcagucccugcagcucucuuuccucuggggcauu

SEQ ID NO: 474870 - RNA, 64 nt, Human
guaaaaguuguauguaugauauuugaaaaugcuaucccugcacucaaaaguuuugaaagaaacu

SEQ ID NO: 474871 - RNA, 64 nt, Human
acaggaugcuuggugaauguacccuuucuuucccucccugcagcucugagggagccccugaccu

SEQ ID NO: 474872 - RNA, 64 nt, Human
uuauuuucuguccguuugaaauauuuuguaauauucccugcauucucugucgucugccucuucc

SEQ ID NO: 474873 - RNA, 64 nt, Human
caugcggggggaacccagguggagccugccagccucccugcaguaggaaaacaaugccagggau

SEQ ID NO: 474874 - RNA, 64 nt, Human
agaccaggucacccgauucccgccaagccggaagucccugcagcaccaccuuuggcuaggaggg

SEQ ID NO: 474875 - RNA, 64 nt, Human
acugggggcgaccuggaccugcuggcucagccccucccugcagacggcgccggcgcccagguau

SEQ ID NO: 474876 - RNA, 64 nt, Human
cacgacaccaggcaggagugagccucaggccccgucccugcaccccaccccugcgugcgccucu

SEQ ID NO: 474877 - RNA, 64 nt, Human
cgugucuggggggcgacguggcgggucggccgguucccugcauucguuuuacuuugguguccca

SEQ ID NO: 474878 - RNA, 64 nt, Human
agcaagaagacuaugcaaaucuuagggcgcucgcucccugcacacggaaagaacucuguuuaaa

SEQ ID NO: 474879 - RNA, 62 nt, Human
uucucaugccuguagguuuccauugcucugucccaggacacuugcgugccagagacgccaca

SEQ ID NO: 474880 - RNA, 62 nt, Human
agccacuggcuuuccugcccaggcuuggccucccaggacaucuggccugaggggauuugaau

SEQ ID NO: 474881 - RNA, 62 nt, Human
uuucgucaguugcucccaguauacaauauccuccaggacauagccagaaaucuccauuccac

SEQ ID NO: 474882 - RNA, 64 nt, Human
aguguccccaccaacaccaggaauuuagaccuuuucccugcaccacucucuucauccugggggc

SEQ ID NO: 474883 - RNA, 64 nt, Human
ugugcuuagugagcaauagugauugagcucauguucccugcaagugccauuuccucuccaggau

SEQ ID NO: 474884 - RNA, 64 nt, Human
cacaaugcaugugggcccuaauauugaggccuuaucccugcagcuaggagggggagggguuguu

SEQ ID NO: 474885 - RNA, 64 nt, Human
agcguaggcaaaaugagcuuccaccucuguccacucccugcagagccaauauagucgugcuucc

SEQ ID NO: 474886 - RNA, 64 nt, Human
cuuugcucugagccaaagcucuggggccuugcauucccugcauuggguugaugacugucagcau

SEQ ID NO: 474887 - RNA, 64 nt, Human
ugcuaggaggccacuucugcuguuacauaacuccucccugcagaagaggggacuucugcaacag

SEQ ID NO: 474888 - RNA, 64 nt, Human
ccgaccuaccccguguggcugcuuuuggcuggauucccugcacccagugcaacacacccuuucc

SEQ ID NO: 474889 - RNA, 64 nt, Human
ccacccgugcacgacuuccucaccacccccagguucccugcagaugucguguguguccugagug

SEQ ID NO: 474890 - RNA, 64 nt, Human
ugcaaaaagggucacgccucccacccccgcccccucccugcaccuccuguccucucccaguuca

SEQ ID NO: 474891 - RNA, 64 nt, Human
cuggacgcgggcacccagccaacugccaugguguucccugcacuuggguguggaccaucuucuu

SEQ ID NO: 474892 - RNA, 64 nt, Human
cacccaggcuggagugcaguggggcaaucuuggcucccugcaaccucugcuuccuggguucagg

SEQ ID NO: 474893 - RNA, 64 nt, Human
gaaaaguaccacucccacucugaacaucuggccgucccugcaaagaguguacugugcuugaagc

SEQ ID NO: 474894 - RNA, 64 nt, Human
gggcuccuuaggcccaaggauggcaugugacuggucccugcaaggguccuuucuuugucaccag

SEQ ID NO: 474895 - RNA, 64 nt, Human
uccacgguggcccagccucuugcugauggcaccuucccugcauugcugccucccgaugaugugg

SEQ ID NO: 474896 - RNA, 62 nt, Human
aaacucugucucaaaaaaaaaaaaaauggcuuccaggacagagcaugcucauuugcuggcgg

SEQ ID NO: 474897 - RNA, 62 nt, Human
caaacuguucugagaaggugaacuguuacgacccaggacaauuagaaaaauucacccaccau

SEQ ID NO: 474898 - RNA, 62 nt, Human
ccuggggccgccgucuuccguccuaggagacuccaggacacccucugaguccuugacgcugg

SEQ ID NO: 474899 - RNA, 64 nt, Human
uuauacauuagacauuggcacuuguguaaaacugucccugcagauugagcaggaaguaaaaaca

SEQ ID NO: 474900 - RNA, 64 nt, Human
acucuguggguugcuaggauguaauuuuaaugcuucccugcaguccaaagaugauuuuuucacc

SEQ ID NO: 474901 - RNA, 64 nt, Human
cagccagugucuuguccuuaguaauuauuugcuuucccugcaguucaauuucuccuuggaacuc

SEQ ID NO: 474902 - RNA, 64 nt, Human
cuggacgcaggcacccagccgacugccacgauguucccugcacuuggguguggaccaucuucuu

SEQ ID NO: 474903 - RNA, 64 nt, Human
ggguccucaccccuguccacccugugccuggcugucccugcacccagauacagcaacauggccu

SEQ ID NO: 474904 - RNA, 64 nt, Human
uacccuaggacacuggaaugcccugggagcccccucccugcaaccagccugaguucagccccac

SEQ ID NO: 474905 - RNA, 64 nt, Human
cuccccuccucugcuugccaucccucccuccaccucccugcaauaaaauggguuuuacugaaau

SEQ ID NO: 474906 - RNA, 64 nt, Human
ggaagcagugugauguucaacagcaucgccauggucccugcauucacagguuucucagugggaa

SEQ ID NO: 474907 - RNA, 64 nt, Human
caguucaaagguucagccaucccugcccuuguucucccugcaacccaggcccugccauucuucu

SEQ ID NO: 474908 - RNA, 64 nt, Human
ggguaccuuaggccuuggcuagucugcguuccucucccugcaugcuguguauccuaacucccua

SEQ ID NO: 474909 - RNA, 64 nt, Human
ccuacaccuucugaggagcaggagggagccacccucccugcagcuacccuagcugaggagccug

SEQ ID NO: 474910 - RNA, 64 nt, Human
acccuccucgcuuugugaggcgccugagcccuacucccugcagaugccacccuagccaaugucu

SEQ ID NO: 474911 - RNA, 64 nt, Human
gcagagggcacugggcuggggcacagccccugcuucccugcaccccauucccacccugaaguuc

SEQ ID NO: 474912 - RNA, 64 nt, Human
ugcaggagguguucuucccuggacgccaugguguucccugcacuuggguguggaccaucuucuu

SEQ ID NO: 474913 - RNA, 62 nt, Human
ucaaggaucuuccaugggaagaugugacagaaccaggacacuacugcuuaauauuuaauauc

SEQ ID NO: 474914 - RNA, 62 nt, Human
ccgugcgagcugccguguggguuagucgggugccaggacaaugaaauacuccagcaccugug

SEQ ID NO: 474915 - RNA, 62 nt, Human
caggccuccucagaggucuucccuuugccuccccaggacagggugagucagagcucagcauu

SEQ ID NO: 474916 - RNA, 53 nt, Human
uggcugaggcgaaagaguaaauuucccugcacuuuccuuuuacucuucucucu

SEQ ID NO: 474917 - RNA, 64 nt, Human
gugaaaugcucucggcuauguagcagcuuuugauucccugcauacccuaggcugcugccccuau

SEQ ID NO: 474918 - RNA, 64 nt, Human
ccaucuuguuaacuauugauuccagugaccugacucccugcaagucaucgccuguaacauuugu

SEQ ID NO: 474919 - RNA, 64 nt, Human
ucuacagcccagcucauccagaugcagacuacagucccugcaauugggucucuggcaggcaaua

SEQ ID NO: 474920 - RNA, 64 nt, Human
ucccugcugauguggcugaccccucucccaccccucccugcaggcggcuggccaggugggcagg

SEQ ID NO: 474921 - RNA, 64 nt, Human
uauggagccucucuauuuuaccucuuuccgugcaucccugcacccgccacacccccuucagcua

SEQ ID NO: 474922 - RNA, 64 nt, Human
gcauccuaccccauccccaccugaagugaggcuaucccugcagcugcagggcacuaaugacccu

SEQ ID NO: 474923 - RNA, 64 nt, Human
accaaauaccuggacuaucaaccuuguugcuuaaucccugcagcauucaagguuaauccaucua

SEQ ID NO: 474924 - RNA, 64 nt, Human
agcauaacccacaggcguuuuuucugccaccccaucccugcaugccugauccccaguuccuaua

SEQ ID NO: 474925 - RNA, 64 nt, Human
gugugacaucaggagcagaacagcaagcucucugucccugcacccccaccaucuuggggaccua

SEQ ID NO: 474926 - RNA, 64 nt, Human
gacuaagcagcccagaagcccaguaacugcccuuucccugcauaugcuucugauggugucaucu

SEQ ID NO: 474927 - RNA, 64 nt, Human
acuuugaugcucccuugaugggguccagagagccucccugcagccaccagacuuggccuccagc

SEQ ID NO: 474928 - RNA, 64 nt, Human
cgggccugucccuauuacgggagccgccuugccaucccugcagcccaggugagggcccugcagg

SEQ ID NO: 474929 - RNA, 64 nt, Human
uuacuuaugcccuccggaaaucaugcaagacugcucccugcaaaggggggcgacaauguucauu

SEQ ID NO: 474930 - RNA, 62 nt, Human
acucugcagggucacacgcaccguguccccacccaggacagcagacacccgccagagugugc

SEQ ID NO: 474931 - RNA, 62 nt, Human
agcuguccguuuugcagauggacaggaaggagccaggacacagcucagcuugcucacgccca

SEQ ID NO: 474932 - RNA, 62 nt, Human
agggagggagcuggggcacuggagccuggcccccaggacauggcugcuccccccaacaucug

SEQ ID NO: 474933 - RNA, 64 nt, Human
ccaacccaaucccucuccacucuucucuccuuucucccugcagccuuuucuggucccucuucuc

SEQ ID NO: 474934 - RNA, 64 nt, Human
gggaguuaggcgaccaaaccagugagagccccaaucccugcaguuuuguggcuucaaguguggg

SEQ ID NO: 474935 - RNA, 64 nt, Human
ucacccucucccccaacccgggcacccucggcccucccugcagccuuaacauucucuuccccug

SEQ ID NO: 474936 - RNA, 64 nt, Human
cuggcaauaagacuaguauacauugaccucccguucccugcaugagggcggggaguucccccug

SEQ ID NO: 474937 - RNA, 64 nt, Human
cgugccuuguccugggggauugaccaucaugucuucccugcaaacuaugaccuggugcuggggg

SEQ ID NO: 474938 - RNA, 64 nt, Human
uuuuaccugaaacuguuaagccgaccaagaucccucccugcaagacagaugggaauguguauaa

SEQ ID NO: 474939 - RNA, 64 nt, Human
agcaggccugggcugcaggcuuccccccgaccauucccugcagccaugcggcagagcuggcauu

SEQ ID NO: 474940 - RNA, 64 nt, Human
cccacccccaggaaggccacagugcugggcggcaucccugcagaggaaagacaggacccggggc

SEQ ID NO: 474941 - RNA, 64 nt, Human
gcccugggccccacggacagucagccugccggccucccugcagcucacggggcagaaccagcac

SEQ ID NO: 474942 - RNA, 64 nt, Human
augauuccuagacuucacaaacacucggcaugccucccugcacuguccguuccucugcccaagg

SEQ ID NO: 474943 - RNA, 64 nt, Human
ugcaccaucgugcaggcagcucugggugagguugucccugcaguacuccuugucacagaaaaca

SEQ ID NO: 474944 - RNA, 64 nt, Human
uucccuuccugucuuugccuuccuuuuaccccuuucccugcaaccuccuugacucuggccugaa

SEQ ID NO: 474945 - RNA, 61 nt, Human
cccugaacaagagacgauagaggagacgaggucccugcagcucacuguguccagcugggcc

SEQ ID NO: 474946 - RNA, 64 nt, Human
ucuguagcgaccucacacagccucugcagauggaucccugcacgccucuuucugaugaagugau

SEQ ID NO: 474947 - RNA, 62 nt, Human
ugagcucacucggcacccugcaaaauuugaugccaggacacgcuuuggaggcgauuuaccug

SEQ ID NO: 474948 - RNA, 62 nt, Human
aggagcagaaaugcaaggggcugcaugaccuaccaggacagaacuuuccccaauuacagggu

SEQ ID NO: 474949 - RNA, 62 nt, Human
caugccccguaagagguggaagacgcuuccuuccaggacagcaggcuuugaguccagcaccc

SEQ ID NO: 474950 - RNA, 64 nt, Human
uuaggugcugguaaugagagcuuaauaccaugguucccugcaggucucagaaacauuaguaguu

SEQ ID NO: 474951 - RNA, 64 nt, Human
gugugccuggcccugugcugggcacugggggcacucccugcaggagccaucaucugugaaaagg

SEQ ID NO: 474952 - RNA, 64 nt, Human
gaaaagcacuuguucucucuggcucaguuccuucucccugcaaccucaguccaaggaaccugcu

SEQ ID NO: 474953 - RNA, 64 nt, Human
ugugugugaugggccaggucucuguccguccucuucccugcacaagugugucgaucuuagauug

SEQ ID NO: 474954 - RNA, 64 nt, Human
gagcugucagcgcccggugccugcccugggcaccucccugcagucaucucuuugcacuuuguua

SEQ ID NO: 474955 - RNA, 64 nt, Human
aaagguugugucuugcuuuugucucucucuucccucccugcaacucucucuccccuccucccac

SEQ ID NO: 474956 - RNA, 64 nt, Human
augaccauuguacugacaacaauugaaugcagucucccugcagggcagauuaugccaggcacuu

SEQ ID NO: 474957 - RNA, 64 nt, Human
cuuggucauucugacaggugcuggaugccacaguucccugcagccaaucaggcugaaaaugcag

SEQ ID NO: 474958 - RNA, 64 nt, Human
uuugccccaugggaaacguaugugugcaggagccucccugcacggcccaaggggcuucguuuuc

SEQ ID NO: 474959 - RNA, 64 nt, Human
aacugugaaaaaucagaugaauugauaaaagaguucccugcaaccaauugaaaaguguucugug

SEQ ID NO: 474960 - RNA, 64 nt, Human
ugcaauaggugcucccuuaccaauuucagaagcuucccugcaaguagauaucgagagagcacac

SEQ ID NO: 474961 - RNA, 64 nt, Human
gaaauguccagagccuaacugcagggugaaaaagucccugcacggccaccacccucgagacugc

SEQ ID NO: 474962 - RNA, 64 nt, Human
gaggggugcggugccaacagggaaacucuucaccucccugcaaaccuaccagugaggcucccag

SEQ ID NO: 474963 - RNA, 64 nt, Human
cccacagggccauugcccaggagaaugaggagccucccugcaguguugucggccgaggccugag

SEQ ID NO: 474964 - RNA, 62 nt, Human
gagucugcaccuccuggaaauccugccaccaaccaggacacagcagccaccguauugaucag

SEQ ID NO: 474965 - RNA, 62 nt, Human
gcugugcaaugccuuaggacuuuguuuguguuccaggacaaguguucacucacaucuguaaa

SEQ ID NO: 474966 - RNA, 62 nt, Human
ccaguuuccuuucaguaaucuuucugaaggagccaggacaauagggccuguuguuuagugaa

SEQ ID NO: 474967 - RNA, 64 nt, Human
ucacuggcaagagucccaggcuccaaggacacccucccugcacaugauuggguguuaauggugg

SEQ ID NO: 474968 - RNA, 64 nt, Human
ccugcccgccgcaggaaggagcaguccccugcuaucccugcagccacucccagcacacccgcac

SEQ ID NO: 474969 - RNA, 64 nt, Human
cggagccgaacgccuggaacgcucuccguccgccucccugcagccccaucuccuugggcgccag

SEQ ID NO: 474970 - RNA, 64 nt, Human
uaaaaguguuaacauuaaugcucaauaaacaaauucccugcaguuguuuuuuuuauuucacucu

SEQ ID NO: 474971 - RNA, 64 nt, Human
ucacuuccaccaucaaguuaugagugugauuguuucccugcaguuuugccaauagagugauuuu

SEQ ID NO: 474972 - RNA, 64 nt, Human
augaucccugaagaucaaaacagggguaaaugacucccugcaaaacccaacccaugcugcuggc

SEQ ID NO: 474973 - RNA, 64 nt, Human
agcuggcgcagccccgcccuccauccuccccacaucccugcagccaccucccagcagagcaggc

SEQ ID NO: 474974 - RNA, 64 nt, Human
cucugagaaggggcgcagccugacaccugugcugucccugcagucucuaggccugucugagcug

SEQ ID NO: 474975 - RNA, 64 nt, Human
gguuccccaagggcccuggcacccccacaagcugucccugcagggccaucugacugccaagcca

SEQ ID NO: 474976 - RNA, 64 nt, Human
accuugucacugccgucugugcacugauucacacucccugcaaaauggucacucugccaucuug

SEQ ID NO: 474977 - RNA, 64 nt, Human
gccuguaucuguuguagcccaggcuccccaagcuucccugcaucuugguccuuguccccuuggc

SEQ ID NO: 474978 - RNA, 64 nt, Human
cuguuacauuuccacaguguggaugcagucagaaucccugcacauucuggucauaaggauuaga

SEQ ID NO: 474979 - RNA, 64 nt, Human
caguuggccugcuugucuggcggagaaagccagcucccugcacccucggggcugagucagaucu

SEQ ID NO: 474980 - RNA, 64 nt, Human
uuccaaguauuuugccacguucuggacugucuucucccugcacaagccagggugugucucggua

SEQ ID NO: 474981 - RNA, 62 nt, Human
agauugcuucagcaaagugaacugugagaucuccaggacagagggagaaagaucugauccaa

SEQ ID NO: 474982 - RNA, 62 nt, Human
cuuccucuagggccaccaggcugaggacucgcccaggacauggacuggucucucagaccccu

SEQ ID NO: 474983 - RNA, 62 nt, Human
ccagaagccaaucuacaaucucuuuuuguuugccaggacaugcaauaaaauuuaaaaaauaa

SEQ ID NO: 474984 - RNA, 64 nt, Human
ugccuacgccaggagaaguugaggggagcaugcuucccugcagcugaccgggucacacaaaggc

SEQ ID NO: 474985 - RNA, 64 nt, Human
cccagccggcugcuggagcccagaggccaccuucucccugcauccugaaugaugcuuagucaga

SEQ ID NO: 474986 - RNA, 64 nt, Human
gcuuuccuggaggaaaagguuaaugaacuucaggucccugcaacucagcccccaccacaaacac

SEQ ID NO: 474987 - RNA, 64 nt, Human
aagagacauuuucuucuuucccuuuccugguccaucccugcacccugguccucucccagccucu

SEQ ID NO: 474988 - RNA, 64 nt, Human
aauaucugaaggugcaaacaggcccuacggcuguucccugcacaacucucaugguuuuaauugu

SEQ ID NO: 474989 - RNA, 64 nt, Human
gaccccucccugccagcccgcggaccucgcaugcucccugcaugagacucacccaugcucaggc

SEQ ID NO: 474990 - RNA, 64 nt, Human
ccauggauaaagugaagaggccuacucaccauuaucccugcagcgugacaccuuuugauuguca

SEQ ID NO: 474991 - RNA, 64 nt, Human
agaccugaaagaauguucagcaucuagcuccaugucccugcaaccacucucuguuugccuucug

SEQ ID NO: 474992 - RNA, 64 nt, Human
cuccuggguggccuguuaugccagcggccucuguucccugcagucugugcugugugucugggcc

SEQ ID NO: 474993 - RNA, 64 nt, Human
uccaacuacggagugucacugcuuucuaggucagucccugcagacucuucucaacucuuucccu

SEQ ID NO: 474994 - RNA, 64 nt, Human
cgcccagugcggguguggagaagaucuucuggcuucccugcaucuugccuuugggauugggauc

SEQ ID NO: 474995 - RNA, 64 nt, Human
augccuuuggcuauuaugaaagagguuaguguguucccugcaauaaacuuguuccugagaaacu

SEQ ID NO: 474996 - RNA, 64 nt, Human
cuuaaaugcuuccuugggcaagagcugucuguccucccugcaggaggcugaguguaaagaguau

SEQ ID NO: 474997 - RNA, 64 nt, Human
agcuucagacaguucaauucuggccugucuuccuucccugcaccgggcaauggggauaaagaug

SEQ ID NO: 474998 - RNA, 62 nt, Human
gcagcacucugugccgccaccucuaccuguucccaggacacccucccacaugaugucaccuc

SEQ ID NO: 474999 - RNA, 62 nt, Human
uguacucugcuugcggagggcugggagacccuccaggacauucccacccucccccaugcugc

SEQ ID NO: 475000 - RNA, 62 nt, Human
ugcgaccaucccggcgccccuagggggagaagccaggacagcagcuuccgcugucuccacag

SEQ ID NO: 475001 - RNA, 64 nt, Human
gggucccugcucuguguccucccugugguggggcucccugcacucugguguucaugccgccccc

SEQ ID NO: 475002 - RNA, 64 nt, Human
cgugggcagcgggcccugcgccucacugcaccccucccugcagagaggagccggugcgcaaguu

SEQ ID NO: 475003 - RNA, 64 nt, Human
ucuggguggggcuuccaugguaagggggccugcgucccugcacacugcgaggacugccuuggcc

SEQ ID NO: 475004 - RNA, 64 nt, Human
cccagcaguggacagcaugguccucacacccagcucccugcacacccaggccagccaccccucc

SEQ ID NO: 475005 - RNA, 64 nt, Human
ggggaggggagggaagggcugguguugauuuuccucccugcagagccaauggugcacauugguu

SEQ ID NO: 475006 - RNA, 64 nt, Human
gccauccagguucagcuuguaaauagcucaggugucccugcacuugcagacucuacagaggcca

SEQ ID NO: 475007 - RNA, 64 nt, Human
ugauguccuccuuuccuucagccccucugcccugucccugcacaccuccacugccucccagcag

SEQ ID NO: 475008 - RNA, 64 nt, Human
uuuggccugcucacccgaccagccugggccgcauucccugcaggaccucccgggucaggcaggg

SEQ ID NO: 475009 - RNA, 64 nt, Human
cagcgaaucggaggccaggccaggacguccuugcucccugcacccucacuguucugugcacuuu

SEQ ID NO: 475010 - RNA, 64 nt, Human
agcauuagccuggugugguggcucaugccuguaaucccugcaauuugggagaccgaaugagaag

SEQ ID NO: 475011 - RNA, 64 nt, Human
cccccugaccccucuaacccauccucugccucccucccugcagucagaggguccuguucccauc

SEQ ID NO: 475012 - RNA, 64 nt, Human
cacacaugagcaucaggccaggcccucugcccacucccugcaaccugauugugucucuuggucc

SEQ ID NO: 475013 - RNA, 64 nt, Human
acuacuaaauggccucucuccacuaccccgacuaucccugcacauaaacuccguuuuuuuuuuu

SEQ ID NO: 475014 - RNA, 64 nt, Human
gagacaagcaguuaaccuagcaccauccucauccucccugcagaagccauuagcagaccuuugg

SEQ ID NO: 475015 - RNA, 62 nt, Human
ugaguccaucgugugagccucggccuggcuggccaggacacacugaaaagcagccuuuuuca

SEQ ID NO: 475016 - RNA, 62 nt, Human
aaaagguuuucuggggaggaggaggcuggaggccaggacacuguuuguuguggaacuaggag

SEQ ID NO: 475017 - RNA, 62 nt, Human
aguuuucucaguggggcagucucauaaaaucaccaggacauugaccaccugaccuccccuaa

SEQ ID NO: 475018 - RNA, 64 nt, Human
guguagaaccugagucccccauuccccaaagccaucccugcauugauaugucuugacucuccug

SEQ ID NO: 475019 - RNA, 64 nt, Human
gcugccacucacgguggguggccgugggccaccuucccugcaaugggugcacacgcggcuccca

SEQ ID NO: 475020 - RNA, 64 nt, Human
uugaagcgcggacccuucuggguccagggaggggucccugcaaaacuccaggcaggacuucuca

SEQ ID NO: 475021 - RNA, 64 nt, Human
uggccuaguggaccuggcccaucugccacucuagucccugcagcucaacguccugcgugaaugc

SEQ ID NO: 475022 - RNA, 64 nt, Human
cccuaaguuauuaccucuccaguuccuaccguacucccugcaccgucucacugugugucucgug

SEQ ID NO: 475023 - RNA, 64 nt, Human
gcaccgcgccccgugggcugugggugagccgcgcucccugcacugagcggguuuaggggcucgc

SEQ ID NO: 475024 - RNA, 64 nt, Human
auggauguuuacaggaacccagccagaguuugccucccugcacuucaucccggagcgcaccugc

SEQ ID NO: 475025 - RNA, 64 nt, Human
cugccuuuggcaagcugcgggugggauggcucagucccugcacugugacugucucaccucuucu

SEQ ID NO: 475026 - RNA, 64 nt, Human
acuagauaaaaaaaaaaauuguuugaguacauuuucccugcauuuuagagauuaggacaguggu

SEQ ID NO: 475027 - RNA, 64 nt, Human
uucacauaugcaaaccuccugccugacucgcuagucccugcaaauaugcaaaccccccaucauc

SEQ ID NO: 475028 - RNA, 64 nt, Human
caccucccagccauacuugacuguccccaaacucucccugcagccacauguuucccaugaccug

SEQ ID NO: 475029 - RNA, 64 nt, Human
ccuugucauuguuucuuaucccccaacuucauguucccugcaauuuauuuaaagaaacuuugua

SEQ ID NO: 475030 - RNA, 64 nt, Human
aaaguggguugauugcugacagcauggucuucccucccugcauuucagacauaccaguuacuga

SEQ ID NO: 475031 - RNA, 64 nt, Human
uaggccagacuucacugccacugugccagacagcucccugcagcugggcccuagccacucuuag

SEQ ID NO: 475032 - RNA, 62 nt, Human
aggacauaaaauagaggcugaccuuaaaagggccaggacagaagcggcugccagcucugaau

SEQ ID NO: 475033 - RNA, 62 nt, Human
caucuggagcugaagcguuacuacagcaucugccaggacacugccuuggguggaccaggcuu

SEQ ID NO: 475034 - RNA, 62 nt, Human
ucccacaaggguuccaggaauuccugguguucccaggacaccagacugcaauaacuggaggc

SEQ ID NO: 475035 - RNA, 64 nt, Human
guucucugaugaccugggaugccuaacugucuacucccugcaagccucagagcagccaagucau

SEQ ID NO: 475036 - RNA, 64 nt, Human
agauugggggaaccuggauuguggagucacauccucccugcaaagcaagcagggcaagggagau

SEQ ID NO: 475037 - RNA, 64 nt, Human
gaugccaaugaugcaaagguccccggccucaguuucccugcagugcucagugucugggccaguc

SEQ ID NO: 475038 - RNA, 64 nt, Human
uccagacagggcguuuguuuuguccaugccuuccucccugcacgcacacggcgucaaaaccaag

SEQ ID NO: 475039 - RNA, 64 nt, Human
aggccuggccaaguaguacagcuagagcccagggucccugcagggccuggccucgccucccagg

SEQ ID NO: 475040 - RNA, 64 nt, Human
uuuuaaaagcugggucugugaccuggucuucccaucccugcauuccugucuggaaccagugaau

SEQ ID NO: 475041 - RNA, 64 nt, Human
ccucucuucccuauuauuuccggguggaaaagaaucccugcagccugguagaauugggaagcug

SEQ ID NO: 475042 - RNA, 64 nt, Human
cugcccccugaaauguagucccuggacuggagguucccugcacucccagugagccagccaccac

SEQ ID NO: 475043 - RNA, 64 nt, Human
uggggaggaaagagguggagccuccccagccguuucccugcagaaucagcucugucucaugugg

SEQ ID NO: 475044 - RNA, 64 nt, Human
ccuugacccaugucuuucuacccuaauccccacuucccugcagaaucaaucugagggaggggau

SEQ ID NO: 475045 - RNA, 64 nt, Human
ccuuuccauccccucaaacgagaacaaaaaguauucccugcaagcacuaugaauggaccuuacu

SEQ ID NO: 475046 - RNA, 64 nt, Human
aguuuacuccacuuugacaaaagauacgcccuucucccugcacauaaagcagguuguagaacgu

SEQ ID NO: 475047 - RNA, 64 nt, Human
aagagcagaacggagccccaggccucuguguccuucccugcauuucugaguuucauucuccugc

SEQ ID NO: 475048 - RNA, 64 nt, Human
gcccccucccugcuacugcugaugcacucuccucucccugcagccccuggcuucccagccuucc

SEQ ID NO: 475049 - RNA, 62 nt, Human
ggauacauuauuagaaacuguuagggucuuucccaggacauuuuuuuuucuguaucaugucu

SEQ ID NO: 475050 - RNA, 56 nt, Human
gcccagaguugcaguuguaacuguugccaggacacauggccauaaauaauagaaag

SEQ ID NO: 475051 - RNA, 62 nt, Human
cgugugaaagaagaacuccaaguuacuggacaccaggacaaaccagguagaucacugcaucc

SEQ ID NO: 475052 - RNA, 64 nt, Human
gagcacccaugccauucacaucuagacuuugaguucccugcaucugccaccguaguuucuagca

SEQ ID NO: 475053 - RNA, 64 nt, Human
cucucugggcacuguacucucucuccuaccugccucccugcagucccucccauggaugacucag

SEQ ID NO: 475054 - RNA, 64 nt, Human
aaagcagcgcggggggcaaauaagaccccaccccucccugcagcuucacagggacgcuuccuuc

SEQ ID NO: 475055 - RNA, 64 nt, Human
cuugaugucuugagagcgcuggccucuuccucccucccugcaggguagggggccugaguugagg

SEQ ID NO: 475056 - RNA, 64 nt, Human
cacugggggagggaggcaucuuguuucuugugguucccugcaggccaguccuguccuccuuucc

SEQ ID NO: 475057 - RNA, 64 nt, Human
gucccgcucuuauccaacucuuccaggccccaccucccugcaccccuccccucuauagagcagg

SEQ ID NO: 475058 - RNA, 64 nt, Human
uuacacguggaggaaugcucccccauccuccccuucccugcaaacaugggguuggcugggccca

SEQ ID NO: 475059 - RNA, 64 nt, Human
cgaggugggagaggccucauccagggcccagcggucccugcagaagccagaaggugcaggggcc

SEQ ID NO: 475060 - RNA, 64 nt, Human
uauuuccgcagguggugauucuagauguccggguucccugcacaccugucgccagguuaaacaa

SEQ ID NO: 475061 - RNA, 64 nt, Human
guuuuagcugaaucccuugcuucugugcuuucccucccugcacaugggcacuguaucagauaga

SEQ ID NO: 475062 - RNA, 64 nt, Human
gacaucgagacuccaggggguccuggcuccccugucccugcagcccugcaggucagugcaugau

SEQ ID NO: 475063 - RNA, 64 nt, Human
cugccuguuuaaagcaggcagcaggcuuaggccuucccugcaaccccaacacccacaaguuugu

SEQ ID NO: 475064 - RNA, 64 nt, Human
agacgaccccucuguccucguucccuguccucguucccugcagguaacaugagaagggcugauc

SEQ ID NO: 475065 - RNA, 64 nt, Human
uuagccuccucuugcccugauuucauccucccuaucccugcacacuuuccccuggcugcuguug

SEQ ID NO: 475066 - RNA, 62 nt, Human
gccuggggugcugagcuagugaguggugcaguccaggacaccuuugcuuuaugucacuuaca

SEQ ID NO: 475067 - RNA, 62 nt, Human
gcaugggaggggcuaccuggucccuuucacagccaggacacgccuggaugagaaagccugag

SEQ ID NO: 475068 - RNA, 62 nt, Human
cugagucaaagggugccuugcccuggucuaauccaggacauagccguggauacguccaaaaa

SEQ ID NO: 475069 - RNA, 64 nt, Human
uggagcucgccccuccccucagccugcccaccucucccugcauccugaggccaguggcccccgg

SEQ ID NO: 475070 - RNA, 64 nt, Human
cacccaggcuggaaugcaguggcacaauuuuggcucccugcaaccuccgccuccuggauuccag

SEQ ID NO: 475071 - RNA, 64 nt, Human
aagcauccaguacagaaccaggcaucgagcuagcucccugcacggccgcacccucccagagaac

SEQ ID NO: 475072 - RNA, 64 nt, Human
uuuaaaaauccauauucaaaaauacccucacacaucccugcaucagugauucuaaugaucagcu

SEQ ID NO: 475073 - RNA, 64 nt, Human
cagggugccggacaaaggccuccuggucacucugucccugcacuccauguauaguccucuuggg

SEQ ID NO: 475074 - RNA, 64 nt, Human
uggaugaaacauuucucuacuucaagaccaccucucccugcaaacaccacacacacauggcaug

SEQ ID NO: 475075 - RNA, 64 nt, Human
cggcggcaccuuuccucuaauccagcaaagugauucccugcacaccagagacaagcagaguaac

SEQ ID NO: 475076 - RNA, 64 nt, Human
acaaggagaaacaugcaaauguuuuagccaggggucccugcagccauuccccaagaacguacaa

SEQ ID NO: 475077 - RNA, 64 nt, Human
cacccuuguacagagaugguggcugaugucaaucucccugcagcacagcuccaggugagucucc

SEQ ID NO: 475078 - RNA, 64 nt, Human
caauaucuucgcugagguuuccuccucccccuccucccugcaggcccaaggcguugguaagggg

SEQ ID NO: 475079 - RNA, 64 nt, Human
uuugaaagaaauuuggcuauaaucuuaucuuugcucccugcaagaaaucagccauaagaaagca

SEQ ID NO: 475080 - RNA, 64 nt, Human
caguguuucagaaucuccaaaaauguaacuggguucccugcauuaaauggucaauaaaccuccu

SEQ ID NO: 475081 - RNA, 64 nt, Human
ucuucagcacccagaggaggagagagccggcaguucccugcaggagagaggaggggcugcugga

SEQ ID NO: 475082 - RNA, 64 nt, Human
cugcuggcacagccugggcaaggggagaagguggucccugcagaggggcuccaggcuggugaga

SEQ ID NO: 475083 - RNA, 62 nt, Human
aaugcaaagcauauuuggcaagcaguucaucaccaggacacuagcuaugauucuagaaguca

SEQ ID NO: 475084 - RNA, 62 nt, Human
ccaaacucuaaaaaagaagcaccacgagauggccaggacauuuguccacuuaaacucucaac

SEQ ID NO: 475085 - RNA, 62 nt, Human
agaccugcacucuggccaaugauugguucauuccaggacauucauuugcauaaggagucaaa

SEQ ID NO: 475086 - RNA, 64 nt, Human
uuaauuucaguuaacaaaauguaaaacaugacauucccugcagauauuguuguauaccaguaug

SEQ ID NO: 475087 - RNA, 64 nt, Human
gccugccagugcccauuccacugugaggugucauucccugcaucuagugacaacugucuggauu

SEQ ID NO: 475088 - RNA, 64 nt, Human
augggugccgacuggcugccugacuucaucaugcucccugcacuuaggcugcgugggacaaggg

SEQ ID NO: 475089 - RNA, 64 nt, Human
gccgucagcaauaccucugagugcccggaugcccucccugcacccuuccauuucuccaggagcc

SEQ ID NO: 475090 - RNA, 64 nt, Human
auucagucuccacugagaggugccgucuggcccuucccugcaggccagcugccccaagcggggu

SEQ ID NO: 475091 - RNA, 64 nt, Human
uuccagggccugccgcggggcucucugggccgguucccugcagacccgcaggagagcacaugug

SEQ ID NO: 475092 - RNA, 64 nt, Human
gaaagagggcggacaggccccucccucugcccucucccugcagaauguggcaggcggaccugga

SEQ ID NO: 475093 - RNA, 64 nt, Human
cucuuuccucccucucuuccccacccuucucucuucccugcaaagcacaaccuguaccccaggg

SEQ ID NO: 475094 - RNA, 64 nt, Human
cguccugccugccgcaguggcccagccccuucucucccugcaggugacccgcgccgcccccgcc

SEQ ID NO: 475095 - RNA, 64 nt, Human
uaucaugaacauuaaaugugaugaugauuucuuuucccugcacacaucuuuccggugcaauauc

SEQ ID NO: 475096 - RNA, 64 nt, Human
accuaacuuguuauggagguugauugauaucugaucccugcaaaauacuuugacuugucauuuu

SEQ ID NO: 475097 - RNA, 64 nt, Human
aguuuagcuugccagggugaugauaaagcccaggucccugcauguauagugcucuucuaaagaa

SEQ ID NO: 475098 - RNA, 64 nt, Human
uuauauggauuauccauaaaaugaccuuuacauaucccugcagaguuggccuuuugcccguggu

SEQ ID NO: 475099 - RNA, 64 nt, Human
cagcagugugggccgauccuguuuaccucauacaucccugcacuguguguuuucauuuuugucu

SEQ ID NO: 475100 - RNA, 62 nt, Human
aacucagcuuugggacaaacccagccaagugaccaggacacuuuagugcaaagagcugagca

SEQ ID NO: 475101 - RNA, 62 nt, Human
uaucagaaauaguauuauuacagaagcuuuacccaggacauuuuauuucucuuugaauaaau

SEQ ID NO: 475102 - RNA, 62 nt, Human
uaucgcugccugaaugcaacaguaauuuauauccaggacaaauacagucugggcgucacuau

SEQ ID NO: 475103 - RNA, 64 nt, Human
cucccccgcccgccuggccuguccugagugcauuucccugcacugugucgucacugcacagcca

SEQ ID NO: 475104 - RNA, 64 nt, Human
aaacagcagcagggaagccauucucacugcauccucccugcaguagccacggccaggcccuuag

SEQ ID NO: 475105 - RNA, 64 nt, Human
uccccacgccucugucuuuugggucaagucuuaaucccugcaccugaguugguccucccucugc

SEQ ID NO: 475106 - RNA, 64 nt, Human
ucgccuuucccacccacagcgcuggccacagggcucccugcagggucagggaccagaccacgcc

SEQ ID NO: 475107 - RNA, 64 nt, Human
uggcuggacccagccaggcccagccgacccccucucccugcauggcauccuccagccccuguag

SEQ ID NO: 475108 - RNA, 64 nt, Human
uuagagcccagcccccuaaggacagggaaccaggucccugcacggcacccacgcaggugucccg

SEQ ID NO: 475109 - RNA, 64 nt, Human
aauagugaagcaacacagcugagagguagugagaucccugcagggacucccuggagauucaggc

SEQ ID NO: 475110 - RNA, 64 nt, Human
gaaguggugaaaauuuuuuuuucucccauuuuccucccugcaucuggggacacagcugccguga

SEQ ID NO: 475111 - RNA, 64 nt, Human
ucggaggccgugagccucccgccccugcagacccucccugcacuggcucccucgcccccagccc

SEQ ID NO: 475112 - RNA, 64 nt, Human
ccagcacuuuucccagcuuucucuccagcaucagucccugcagcagcuggggccucuggucagg

SEQ ID NO: 475113 - RNA, 64 nt, Human
acuuuauuacaagaucuuuccaaauacccaaaugucccugcaagcccguuaaauaauucccuau

SEQ ID NO: 475114 - RNA, 64 nt, Human
gggcccucucucaguucugggaggaugacuccagucccugcacgcccuggcacacccuucacgg

SEQ ID NO: 475115 - RNA, 64 nt, Human
gagaaaucacccugcuguggggguuggggaccacucccugcauccccucuccacugagagcugu

SEQ ID NO: 475116 - RNA, 64 nt, Human
gucugcccucaucccucuggcagucacgcugucuucccugcaugcugugccugccgcgugcccu

SEQ ID NO: 475117 - RNA, 62 nt, Human
ccacaagagagguaugucacucaucuuacuucccaggacauccacccugagaauaauuugac

SEQ ID NO: 475118 - RNA, 62 nt, Human
aggaaggaggaauggcuugcuggggagcccauccaggacacugggagcacauagagauucac

SEQ ID NO: 475119 - RNA, 62 nt, Human
aaacuggcggaugaacagcucaguucugucauccaggacauggccgugcggcagcaccugcu

SEQ ID NO: 475120 - RNA, 64 nt, Human
cgggccucgggacccuuucucuucugaaucugcuucccugcaguuuagaucccgggauggcauu

SEQ ID NO: 475121 - RNA, 64 nt, Human
cuccaaguggagacuuacggacagcauauaauucucccugcaaggauguaugauaauauguaca

SEQ ID NO: 475122 - RNA, 64 nt, Human
ccugccuccuccuccuccucgucuuaggggggucucccugcaaugcagcgcccccuuccguccu

SEQ ID NO: 475123 - RNA, 64 nt, Human
ugggagucaccugauucugcaaagauaaauaauaucccugcauuaucaaaauaaaguagcagac

SEQ ID NO: 475124 - RNA, 64 nt, Human
gcgugagggccuuccuaucccuccacccaccguuucccugcagugcacgcuggcagccaccaag

SEQ ID NO: 475125 - RNA, 64 nt, Human
cuagaucccagaacucaggcgcauaugcauauuuucccugcaagauuagaauggugcucuucac

SEQ ID NO: 475126 - RNA, 64 nt, Human
aaguaucaguguacuauaaacagguuuuuaguuaucccugcauuauuuuugcaauuaaucuuua

SEQ ID NO: 475127 - RNA, 64 nt, Human
ugccggccggccucagcccggcucugccuggugcucccugcagugccuucuccauggccccgcc

SEQ ID NO: 475128 - RNA, 64 nt, Human
cuagccccuagaggcggacacacagcgacccccaucccugcaggacaaacgccccugcccugcc

SEQ ID NO: 475129 - RNA, 64 nt, Human
cuagcugggggccuucaugugcccuucaugccccucccugcauugaggccuuguggaccccugg

SEQ ID NO: 475130 - RNA, 64 nt, Human
cccgcuguccagccucccuggacggcccucgcggucccugcagcccaagaugggacucagaccc

SEQ ID NO: 475131 - RNA, 64 nt, Human
agugaccccaguuagcacccaccguccagagggcucccugcaggccaggggucccccagcguca

SEQ ID NO: 475132 - RNA, 64 nt, Human
ccuguggggaaacuguucccuggaaccacuccacucccugcauccccacacuucacagcaucuu

SEQ ID NO: 475133 - RNA, 64 nt, Human
cacugggucucagauccuucugcugacugccagaucccugcauuucaagcacuacgccuuccac

SEQ ID NO: 475134 - RNA, 62 nt, Human
uuuacuuuuuuguuucucacccgcaacuugagccaggacagcugguccaaguggccacagug

SEQ ID NO: 475135 - RNA, 62 nt, Human
ggcuggcugguccugaggccacccaccuuguuccaggacaugggcccgggcccggugugggg

SEQ ID NO: 475136 - RNA, 62 nt, Human
guggugagaugcgcagggaagaccagcucucuccaggacaucgggcugcgugaaguccagug

SEQ ID NO: 475137 - RNA, 64 nt, Human
gcacucaguacacauuccauaaauuagcugggugucccugcacgcccaccccaugaaacucgag

SEQ ID NO: 475138 - RNA, 64 nt, Human
cguccagccuucccucagcugaguggggagggcaucccugcaaaagggaacagaagaggccaag

SEQ ID NO: 475139 - RNA, 64 nt, Human
cgcccccaaccacccagggccaccaucagacaacucccugcaugcaaaccccuaguacccucuc

SEQ ID NO: 475140 - RNA, 64 nt, Human
uguccucacuccaggggagccccagacgcuccgcucccugcauguguaacaccccuucuugcug

SEQ ID NO: 475141 - RNA, 59 nt, Human
ugcauuggccuggcaucuaggacccuggcucccugcaguggggacuucgugggaggcac

SEQ ID NO: 475142 - RNA, 64 nt, Human
ccucuggccugaaaggucugccucacacaggccuucccugcagggcagcccaugguggcagccg

SEQ ID NO: 475143 - RNA, 64 nt, Human
acucuacuauuagagggacgacugccuucaagcaucccugcaacugccacagcaggugggggca

SEQ ID NO: 475144 - RNA, 64 nt, Human
gccacuggcugcccuuccaggugcuuaacuccugucccugcaaguguuacugccaccaccagcc

SEQ ID NO: 475145 - RNA, 64 nt, Human
gccuguacugggcgugcaccucaaggaccuggugucccugcaugaggcacagcccgacagguug

SEQ ID NO: 475146 - RNA, 64 nt, Human
aguuuggaucaggcaggguggcucacaccuguaaucccugcacuuugggaggccaaggugggag

SEQ ID NO: 475147 - RNA, 64 nt, Human
cagaacaauccugaaccaggccugucaccuacccucccugcagcucaggaaggcugucagacag

SEQ ID NO: 475148 - RNA, 64 nt, Human
uccauccccacaacagccugccaaucgaagcccgucccugcauccaggaugguaccagcucccg

SEQ ID NO: 475149 - RNA, 64 nt, Human
aaaaaaaaggauaucaaagcuggaugguggcucaucccugcaaucacaacacuuugguagacug

SEQ ID NO: 475150 - RNA, 64 nt, Human
gggauggaaggaaucuguggagaccccauccuccucccugcacacuguggaugacaugguaccc

SEQ ID NO: 475151 - RNA, 62 nt, Human
cuugccuuagguggcuguagcaucccuaccacccaggacacuggugcgaaugacacaacuca

SEQ ID NO: 475152 - RNA, 57 nt, Human
ucaguagcaguguugaauagcuugcggccaggacaaccugaauucuauaaguucuug

SEQ ID NO: 475153 - RNA, 62 nt, Human
uggguccaugucccagaccccucuauucugcuccaggacagcaggacuucaggucuuccugg

SEQ ID NO: 475154 - RNA, 64 nt, Human
ucgucugcucuccucucucuuccaacacagcccaucccugcacugcuccuggggccaaauaaau

SEQ ID NO: 475155 - RNA, 64 nt, Human
uaacacacauagggcuguuacggacugagaagugucccugcaaaauucacagacauaaauaaau

SEQ ID NO: 475156 - RNA, 64 nt, Human
ugacauacccuggacuccugugugccuccugccaucccugcacacagccuggggagaagccugu

SEQ ID NO: 475157 - RNA, 64 nt, Human
caguugucaaugcacacagaauacaaccucaugcucccugcagcaagaccccugaaagugauuc

SEQ ID NO: 475158 - RNA, 64 nt, Human
acucuguccagcucccgcuguggccgcacgccucucccugcacucccuccuggagcucuguggg

SEQ ID NO: 475159 - RNA, 64 nt, Human
ugacaucucacaggucuugccuuuaaauuaccccucccugcacacacauacacagauacacaca

SEQ ID NO: 475160 - RNA, 64 nt, Human
cuucuuugaguaaaggcagccucaccucgggcagucccugcaggucccucacccuccgggcuga

SEQ ID NO: 475161 - RNA, 64 nt, Human
aggugggaggcagggaaaggagcgccaaugagguucccugcaacccccgcccuccagcccaccg

SEQ ID NO: 475162 - RNA, 56 nt, Human
gcauggaguguuucugcugauuucugucccugcaucuccccuggccccguucccug

SEQ ID NO: 475163 - RNA, 64 nt, Human
guuaguaauuuuaauaauguggcccuuuuccuagucccugcaaccuguuucauaaagugcaaug

SEQ ID NO: 475164 - RNA, 64 nt, Human
guucuggugugucuuaaaauuccaaacaaaaugaucccugcauuuccugaagauguuuaaacgu

SEQ ID NO: 475165 - RNA, 64 nt, Human
ccagccuucugauaaucacuggccugcugacacuucccugcaacccauccaccccugguuucuc

SEQ ID NO: 475166 - RNA, 64 nt, Human
uugcugaggauaacggcuuccagcuucauccaugucccugcaaaggacgugaucucauuucuuu

SEQ ID NO: 475167 - RNA, 64 nt, Human
ggcccauacagauaucagagcagacggaaauuucucccugcaagcgcucagucucaucccagca

SEQ ID NO: 475168 - RNA, 62 nt, Human
ccacccggccgccaaggcaggcuugggcugggccaggacacguggggugccugggacgcugc

SEQ ID NO: 475169 - RNA, 62 nt, Human
gccgugggcuggguagggugccuuggcaggagccaggacaaggcccuccuggcagaggagca

SEQ ID NO: 475170 - RNA, 62 nt, Human
ggagagagggacagguucuguugggggugacaccaggacacaggaauagguucugucgggag

SEQ ID NO: 475171 - RNA, 64 nt, Human
cuccuuuucuugagcugguggagagccacugucuucccugcaguaacuaucuauacaccuaccu

SEQ ID NO: 475172 - RNA, 64 nt, Human
cugccuucuccccuuacccucccgccucccacccucccugcaacaacagcccucuagccugggg

SEQ ID NO: 475173 - RNA, 64 nt, Human
ccagccuccccugguagagaggagguuuacccacucccugcacgccugccgucccugccccgcu

SEQ ID NO: 475174 - RNA, 64 nt, Human
gccaggagcggcgggcuuucccgaggggccacugucccugcagaguggaugcuucugccuagug

SEQ ID NO: 475175 - RNA, 64 nt, Human
ccccugcucgggaguaaggcugguccugggguccucccugcacggaccccacugggccugccga

SEQ ID NO: 475176 - RNA, 64 nt, Human
ugcaucuccggcuaggccgccggcgccgcccgggucccugcagcgcuuccucccgcagcccccg

SEQ ID NO: 475177 - RNA, 64 nt, Human
ccaguauucccuuuugcugccucuaaaaggccugucccugcagacaugagagacagcaggucuc

SEQ ID NO: 475178 - RNA, 64 nt, Human
uaauuuucuugacaagaaagaauguauagaagucucccugcaauuaauuuccaauguuuacauu

SEQ ID NO: 475179 - RNA, 64 nt, Human
ucccuguauuaagcaagaauuaggagaauggcugucccugcaggcgccucccguaaauccugag

SEQ ID NO: 475180 - RNA, 64 nt, Human
gcgugauugguaacugccuggccuggcaccguuaucccugcacacggcacagagcauccgucuc

SEQ ID NO: 475181 - RNA, 64 nt, Human
ccugcccaagccacaccccuagcuucccucccuaucccugcagccugagggucccuucagccac

SEQ ID NO: 475182 - RNA, 64 nt, Human
uggcgacacucagggcagcugccuggccaugcugucccugcacugugccccgcgggcuuuguug

SEQ ID NO: 475183 - RNA, 64 nt, Human
gggcuuggucagcugccuguucagugucaacacuucccugcacaucuuaaaacugggcuuuauu

SEQ ID NO: 475184 - RNA, 64 nt, Human
cagaaaggcuccugaggucccagguuggcacuucucccugcagccauuguagaagaucugcugg

SEQ ID NO: 475185 - RNA, 62 nt, Human; identical to SEQ ID NO: 473275

SEQ ID NO: 475186 - RNA, 62 nt, Human; identical to SEQ ID NO: 473276

SEQ ID NO: 475187 - RNA, 62 nt, Human; identical to SEQ ID NO: 473277

SEQ ID NO: 475188 - RNA, 64 nt, Human
gcugcuaacuggggccugcguggaaggccuccgcucccugcacacacacggacaggaauuuccg

SEQ ID NO: 475189 - RNA, 64 nt, Human
ugggaaggagcuggccuggcucagcccuaggcugucccugcagccaggguguccgggggcuggc

SEQ ID NO: 475190 - RNA, 64 nt, Human
ccaccuguccauauuccacauuugcugacugugcucccugcacuccacucaaguugagaguuca

SEQ ID NO: 475191 - RNA, 64 nt, Human
cggccagaggcaggucagggguccccucucccucucccugcaauguccuugccaaaugacugcc

SEQ ID NO: 475192 - RNA, 56 nt, Human
ugacaggcugcugaggguaagcgccaucccugcaggccagggcacacggugcgccc

SEQ ID NO: 475193 - RNA, 64 nt, Human
augggucauuuucaaaggggcaacagugauaccaucccugcacuccuggguccugcucuuccaa

SEQ ID NO: 475194 - RNA, 64 nt, Human
cugggaauaaacagcugcccuagccccagagggaucccugcacccaggaggccuccugacacca

SEQ ID NO: 475195 - RNA, 64 nt, Human
ggguuggagcucuggcacccggggagguagcauuucccugcagaugguacagauguuccugccu

SEQ ID NO: 475196 - RNA, 64 nt, Human
uuugguagguucuucguucucuuccccgugaucuucccugcagccugggauggccagggucuga

SEQ ID NO: 475197 - RNA, 64 nt, Human
gucccaccgcccagcggcuugccugccugcucgcucccugcagaggggcugagcaggacgccgc

SEQ ID NO: 475198 - RNA, 64 nt, Human
ggguccagcccaggccagcacugccagccuccucucccugcaguaggcaccagcucuaccuccc

SEQ ID NO: 475199 - RNA, 64 nt, Human
aggcccaggcucagcccgccguggcugggaagguucccugcagugccagugcugcagcagggag

SEQ ID NO: 475200 - RNA, 64 nt, Human
acugugcccuggcccaggcaucaccaacacggccucccugcagcugcccugccaccgacagacc

SEQ ID NO: 475201 - RNA, 64 nt, Human
acagaagcaccuuugguucugcaggucaugccccucccugcagggaagggaaagcuggugguag

SEQ ID NO: 475202 - RNA, 62 nt, Human; identical to SEQ ID NO: 472938

SEQ ID NO: 475203 - RNA, 62 nt, Human; identical to SEQ ID NO: 473292

SEQ ID NO: 475204 - RNA, 62 nt, Human; identical to SEQ ID NO: 473293

SEQ ID NO: 475205 - RNA, 64 nt, Human
ugcacugugcuuaggguagggaugguaaauauccucccugcauggcuuuauccucccucucauc

SEQ ID NO: 475206 - RNA, 64 nt, Human
agugcugguaugcacuuaggaccuucuugauagcucccugcacuuuggaacacggagcagauga

SEQ ID NO: 475207 - RNA, 64 nt, Human
gcagaccccacccugucugcaggccacccccaccucccugcagcuuugaggcuggcggggucug

SEQ ID NO: 475208 - RNA, 64 nt, Human
gguacucagucagcccagugggaucuuacccacuucccugcaaggugcaccugccccaggcuca

SEQ ID NO: 475209 - RNA, 64 nt, Human
gccuuauuuauugcaggcuuucuuucccccauucucccugcauccuuguccuugcaggugcuuu

SEQ ID NO: 475210 - RNA, 64 nt, Human
agggagauagccugaccucuguccuugcuccuucucccugcagccuacgggucuguuuucugug

SEQ ID NO: 475211 - RNA, 64 nt, Human
aggaacacagggcuucuuggccccagauggcaccucccugcaccccgggguuguauaccacacc

SEQ ID NO: 475212 - RNA, 64 nt, Human
gacaacacuuggucuaagacacggcagcaagacaucccugcauauuguuccagauaaaaaugaa

SEQ ID NO: 475213 - RNA, 64 nt, Human
ugaagccauguuguuaauauggcugaugggagcaucccugcagcugaacccagcacuuuuuaug

SEQ ID NO: 475214 - RNA, 64 nt, Human
cuuuuucuaacaugucuucugaaugcuuccuuuuucccugcacacgcauguacuucgagcaccg

SEQ ID NO: 475215 - RNA, 64 nt, Human
uuguauuauuaguuagaaggcaugaagacuuuuuucccugcauggagagugucauaaguuauug

SEQ ID NO: 475216 - RNA, 64 nt, Human
ucuugagugggcccccucucuuaccccgucccuuucccugcaucccuuggccccucucuguuua

SEQ ID NO: 475217 - RNA, 64 nt, Human
ggaaauccacccagcaaccuaauacagccccuuuucccugcauucaccugguucccauccacau

SEQ ID NO: 475218 - RNA, 64 nt, Human
uagaaaaaacaauuuuugaaaaagagauuuuuuuucccugcagguaguugaguuggaacaacau

SEQ ID NO: 475219 - RNA, 62 nt, Human; identical to SEQ ID NO: 473309

SEQ ID NO: 475220 - RNA, 62 nt, Human; identical to SEQ ID NO: 473310

SEQ ID NO: 475221 - RNA, 62 nt, Human; identical to SEQ ID NO: 473311

SEQ ID NO: 475222 - RNA, 64 nt, Human
cagggucaaugcaagaguucucauuuccuacccaucccugcaugaagcagcuuugagagaggag

SEQ ID NO: 475223 - RNA, 64 nt, Human
ccccgcggcggccugggcagcgccugugcagaccucccugcaggccgcacugccaacugcugca

SEQ ID NO: 475224 - RNA, 64 nt, Human
ucagauguuuuggggaaaguuggagaagccguggccuugcgagaggugguuacaccagaaccug

SEQ ID NO: 475225 - RNA, 64 nt, Human
uaugcagccaagcucggcacuuuguagcagccggccuugcgaagccuccucagcucggggggcc

SEQ ID NO: 475226 - RNA, 64 nt, Human
caacagaguggcugaaagucacaccucuccagcuccuugcgaguggguuugauugauuuugaca

SEQ ID NO: 475227 - RNA, 64 nt, Human
gggugcacaucucacuaucucuggcaugaaccagccuugcgaacuuauacagucucagccacuc

SEQ ID NO: 475228 - RNA, 64 nt, Human
augcccaacugagauugucuuccaagccgggcauccuugcgagccccccaagcuggccacagau

SEQ ID NO: 475229 - RNA, 64 nt, Human
gaaauagugauguuguccuaacugggacaggaagccuugcgagaagggacguaccuaugcccca

SEQ ID NO: 475230 - RNA, 64 nt, Human
uggaaccaaugccagcugguaggaucccugagccccuugcgauaucaccaccaagagccugaua

SEQ ID NO: 475231 - RNA, 62 nt, Human; identical to SEQ ID NO: 472953

SEQ ID NO: 475232 - RNA, 62 nt, Human; identical to SEQ ID NO: 473343

SEQ ID NO: 475233 - RNA, 62 nt, Human; identical to SEQ ID NO: 473344

SEQ ID NO: 475234 - RNA, 62 nt, Human; identical to SEQ ID NO: 473360

SEQ ID NO: 475235 - RNA, 64 nt, Human
agcucaggccugaaugagcaggaaacaaaaaaggccuugcgacccagcugccauaaccaccuua

SEQ ID NO: 475236 - RNA, 64 nt, Human
aaaaccacagaggcggaaauaccggagggcuuugccuugcgaaaaggguuggacaucaucuccu

SEQ ID NO: 475237 - RNA, 64 nt, Human
gcaccuuuggggucaugcuuuguagcagugucucccuugcgaccucgcaauaaauuggccccac

SEQ ID NO: 475238 - RNA, 64 nt, Human
aaauggcgaaugucauacacaugagaugguauauccuugcgauguacaguaucagaaggugguu

SEQ ID NO: 475239 - RNA, 64 nt, Human
cugugcccacgugugcagacuguggcugcagagaccuugcgaccauguguagauugcguggacc

SEQ ID NO: 475240 - RNA, 64 nt, Human
uacaguggagauuccauacaggccuuacuuagcuccuugcgauacugugagccagagagaaagu

SEQ ID NO: 475241 - RNA, 64 nt, Human
aguguuuuucuuuuuaagaugaacuuuuaaagaaccuugcgauuugcacauauugaguuuauaa

SEQ ID NO: 475242 - RNA, 64 nt, Human
uacaucguaaacuccgccuccacggaacgucucgccuugcgagcaagcucggaauccaguuccu

SEQ ID NO: 475243 - RNA, 64 nt, Human
cacagugggcccacaccacacccugccccuuagcccuugcgaggguuggucucgaggcagaggu

SEQ ID NO: 475244 - RNA, 64 nt, Human
gcccugugcuacuggacauuucacaauucuggcaccuugcgauuggucagucaaccucagaaag

SEQ ID NO: 475245 - RNA, 64 nt, Human
gguguccucccagggagcuucucuucucaacaggccuugcgaggcuggggugagaggugauaga

SEQ ID NO: 475246 - RNA, 64 nt, Human
uucccaccucccugcccaggccggccagccucacccuugcgaaccgugagcaggaaggccuggg

SEQ ID NO: 475247 - RNA, 64 nt, Human
acacauguauguuuguuaccaagaacuggucagaccuugcgaguuuauuuguaaacacuggaca

SEQ ID NO: 475248 - RNA, 64 nt, Human
ugaaugcugcaugaaucucguggggggucccugcccuugcgacccccagauaccuccacuugcu

SEQ ID NO: 475249 - RNA, 64 nt, Human
auggagaugaugcagaaaacuccaauucaggagcccuugcgaguauaucugaagcacuuauuug

SEQ ID NO: 475250 - RNA, 64 nt, Human
caccaucuggcccaggcuggcccccacccaccuuccuugcgaccaccaacacacaggaacucug

SEQ ID NO: 475251 - RNA, 62 nt, Human
ggacacagggacagguucugucgggggugacaccaggacacagggacagguucugucauggg

SEQ ID NO: 475252 - RNA, 62 nt, Human
ggagagagggacagguucugucaggggugacaccaggacacagggacagguucugucggggg

SEQ ID NO: 475253 - RNA, 62 nt, Human
ugagcagagcccauccaggacacuccacacugccaggacacacccaggcggcccgcccuugc

SEQ ID NO: 475254 - RNA, 64 nt, Human
gcugccuuccaacuaccacucucccagaugugacccuugcgauuauuuccucugagguuugagg

SEQ ID NO: 475255 - RNA, 64 nt, Human
gcacaccuuccacagggucaggauggaguagcugccuugcgagguggugagacuccugucucug

SEQ ID NO: 475256 - RNA, 64 nt, Human
ugcacggagcucugccauuccggugcagugcaggccuugcgaaggguuuaucugcguucgucuc

SEQ ID NO: 475257 - RNA, 64 nt, Human
ccaaccagucucccaaagcuccuugcuccccaccccuugcgaacaggaccagauuuuguuugga

SEQ ID NO: 475258 - RNA, 64 nt, Human
aaagcauguguggcugcagacguguccacaugggccuugcgaaccuggguuagaaacccuggcc

SEQ ID NO: 475259 - RNA, 64 nt, Human
aauccguauguuucccuuucaucuuucuuuuuuuccuugcgauuuuguuuaugaaaugagguug

SEQ ID NO: 475260 - RNA, 64 nt, Human
uacccugaauuuaaaagguaauugcuuuuuuccuccuugcgaaaucauaccuuaauuuuuuuuu

SEQ ID NO: 475261 - RNA, 64 nt, Human; identical to SEQ ID NO: 35241

SEQ ID NO: 475262 - RNA, 64 nt, Human; identical to SEQ ID NO: 35242

SEQ ID NO: 475263 - RNA, 64 nt, Human; identical to SEQ ID NO: 35243

SEQ ID NO: 475264 - RNA, 64 nt, Human; identical to SEQ ID NO: 35244

SEQ ID NO: 475265 - RNA, 64 nt, Human; identical to SEQ ID NO: 35245

SEQ ID NO: 475266 - RNA, 64 nt, Human; identical to SEQ ID NO: 35246

SEQ ID NO: 475267 - RNA, 64 nt, Human; identical to SEQ ID NO: 35247

SEQ ID NO: 475268 - RNA, 64 nt, Human; identical to SEQ ID NO: 35248

SEQ ID NO: 475269 - RNA, 62 nt, Human; identical to SEQ ID NO: 473378

SEQ ID NO: 475270 - RNA, 62 nt, Human; identical to SEQ ID NO: 473379

SEQ ID NO: 475271 - RNA, 62 nt, Human; identical to SEQ ID NO: 473491

SEQ ID NO: 475272 - RNA, 62 nt, Human; identical to SEQ ID NO: 473492

SEQ ID NO: 475273 - RNA, 64 nt, Human; identical to SEQ ID NO: 35249

SEQ ID NO: 475274 - RNA, 64 nt, Human; identical to SEQ ID NO: 35250

SEQ ID NO: 475275 - RNA, 64 nt, Human; identical to SEQ ID NO: 35251

SEQ ID NO: 475276 - RNA, 64 nt, Human; identical to SEQ ID NO: 35252

SEQ ID NO: 475277 - RNA, 64 nt, Human; identical to SEQ ID NO: 35253

SEQ ID NO: 475278 - RNA, 64 nt, Human; identical to SEQ ID NO: 35254

SEQ ID NO: 475279 - RNA, 64 nt, Human; identical to SEQ ID NO: 35255

SEQ ID NO: 475280 - RNA, 64 nt, Human; identical to SEQ ID NO: 35256

SEQ ID NO: 475281 - RNA, 64 nt, Human; identical to SEQ ID NO: 35257

SEQ ID NO: 475282 - RNA, 64 nt, Human
gcaaauaauguacgaauguuuuuugcauucaaaggacauccacaucuguuggaagacuuuuaag

SEQ ID NO: 475283 - RNA, 64 nt, Human
cugccuuuagcugguccagauuaaucauuucaaagacauccauuuuagaucacaagcaggaagu

SEQ ID NO: 475284 - RNA, 62 nt, Human; identical to SEQ ID NO: 473361

SEQ ID NO: 475285 - RNA, 62 nt, Human; identical to SEQ ID NO: 473362

SEQ ID NO: 475286 - RNA, 62 nt, Human; identical to SEQ ID NO: 472954

SEQ ID NO: 475287 - RNA, 64 nt, Human
auuuucugccccaccuuacuucuccucccugacagacauccagccccuaguaauacuuaaggca

SEQ ID NO: 475288 - RNA, 64 nt, Human
ggugcuaaccgugaacguagagacuuguucugaggacauccacacaauaguaggaaucucccca

SEQ ID NO: 475289 - RNA, 64 nt, Human
cuguguuacuaguggccccaguauaccugggauggacauccaggugcccuucauccaagcuccu

SEQ ID NO: 475290 - RNA, 64 nt, Human
aauuauauaacuuaggauacuucugacugguuuugacauccauuaacaguaauuuuaauuucuu

SEQ ID NO: 475291 - RNA, 64 nt, Human
uuaccucgggaugguugguuagugcaugucacaugacauccacaugcacauguauucuguuggc

SEQ ID NO: 475292 - RNA, 64 nt, Human
caugugaaacaaaaucauuugaaauuuugauucagacauccauuuccaguggcaaacagcaaag

SEQ ID NO: 475293 - RNA, 64 nt, Human
cuuaacaagugugugcaagccccucagaacucaagacauccaaauuuuauugcgucucuacuua

SEQ ID NO: 475294 - RNA, 64 nt, Human
uaccugucuaggaaggugugaugucagaaacaaugacauccagaaagcugaggaacagguuccu

SEQ ID NO: 475295 - RNA, 64 nt, Human
caggcaggagcccuucuauacccacccagaaugagacauccagcagauuuccagccuucuacug

SEQ ID NO: 475296 - RNA, 64 nt, Human
guucucuugggaagucaggguaucagaugggauggacauccaggucuucucucugccuaauugu

SEQ ID NO: 475297 - RNA, 64 nt, Human
gcugaaggcuggguuugaaaaggcaaaaagacaagacauccaggcagggcuucucuuuucuuuc

SEQ ID NO: 475298 - RNA, 64 nt, Human
cuccaacuccuaccccauugcauggguuguugcggacauccaauaaagauuuuuuuagugcuuc

SEQ ID NO: 475299 - RNA, 64 nt, Human
auuaaaaagugauuaucaaagaauaucagggccugacauccacaaaaaacaaacuuaauuuuga

SEQ ID NO: 475300 - RNA, 64 nt, Human
ugugcugagaucaagaggcagguuagaagaaccugacauccacuguuugccuuggauaguaugg

SEQ ID NO: 475301 - RNA, 55 nt, Human
uguccagguuccucaguuaaauuaggacauccauuacauuauuaaagcaagcuga

SEQ ID NO: 475302 - RNA, 64 nt, Human
cuaaaagcaaauuuaugaaacuaaaagggugauugacauccauguuuacacuccgcucuaaugu

SEQ ID NO: 475303 - RNA, 62 nt, Human; identical to SEQ ID NO: 473493

SEQ ID NO: 475304 - RNA, 62 nt, Human; identical to SEQ ID NO: 472955

SEQ ID NO: 475305 - RNA, 62 nt, Human; identical to SEQ ID NO: 473798

SEQ ID NO: 475306 - RNA, 64 nt, Human
ggauaaagggaaccaugaaaaugagaggaggaaagacauccagaucagcuguuuugccuguugc

SEQ ID NO: 475307 - RNA, 64 nt, Human
gccagcuguguucccugcagacugggcucagcccgacauccaacaggcgccaaacucacagagc

SEQ ID NO: 475308 - RNA, 64 nt, Human
ccuccuacgggggcagcacacuuagauauuccuggacauccagauagcucacaugugcugacca

SEQ ID NO: 475309 - RNA, 64 nt, Human
uucuggcucugcgccccauauucccagcaucauagacauccaacagcaccagcaggagaguggg

SEQ ID NO: 475310 - RNA, 64 nt, Human
ccuucccaguuucuguguaagucuuugcauuuaagacauccaaucaauaaugaaggaaauuuuu

SEQ ID NO: 475311 - RNA, 64 nt, Human
cuuguuuaaauggugcagagagaaagguugcccagacauccaccagcuuacuguguugacagau

SEQ ID NO: 475312 - RNA, 64 nt, Human
uuuuuuuuuugaacaaaugaugguguaacauuuugacauccauaaggacaaauguagauauuuu

SEQ ID NO: 475313 - RNA, 64 nt, Human
cauuaacguuacuuguacaaugcugucacugugugacauccauaugaauuuugguauauaucaa

SEQ ID NO: 475314 - RNA, 64 nt, Human
auuucucuuuuauaauaaacuaaugauaacuaaugacauccagugucuccaaaauuguuuccuu

SEQ ID NO: 475315 - RNA, 64 nt, Human
uaacuaagauuauaauuuccaccaacauugcugagacauccauaaccaucgaugauguugucua

SEQ ID NO: 475316 - RNA, 64 nt, Human
cucacugcagacacagguggagugguuccuacaagacauccaguuuuaacaacaaaagaguuau

SEQ ID NO: 475317 - RNA, 64 nt, Human
uccuuaguucccgugugaaagcagaggaacccaugacauccaagggcgugaaaggaucagagcu

SEQ ID NO: 475318 - RNA, 64 nt, Human
uuucaacaugaauuuuuuuauuucugucaguuaugacauccacaagcaucacuuuuugugucug

SEQ ID NO: 475319 - RNA, 64 nt, Human
uguggucccuacccugugugaaugugaggauguagacauccaucagugcaacucgagcuccauc

SEQ ID NO: 475320 - RNA, 64 nt, Human
uuugugugucuauacauugcuuuccgcauuucaagacauccagacgcuauuaccaacauuuucc

SEQ ID NO: 475321 - RNA, 64 nt, Human
aggcuccucacucaccugggacagccugagaagggacauccaccaagaccuacugaucuggagu

SEQ ID NO: 475322 - RNA, 62 nt, Human; identical to SEQ ID NO: 472971

SEQ ID NO: 475323 - RNA, 62 nt, Human; identical to SEQ ID NO: 472986

SEQ ID NO: 475324 - RNA, 62 nt, Human; identical to SEQ ID NO: 473098

SEQ ID NO: 475325 - RNA, 64 nt, Human
ucaagcaacacacacaaaaguuccucagccacaagacauccacauauugcauguuaaccagaag

SEQ ID NO: 475326 - RNA, 64 nt, Human
auucggcuguauaauacauaaccacagcaagacugacauccacuuaggaugauacaaagcagug

SEQ ID NO: 475327 - RNA, 64 nt, Human
gaugaaagagagucgcguuuuguuuacaguuaaagacauccaauaucuuaaaaaggaguuuucc

SEQ ID NO: 475328 - RNA, 64 nt, Human
agaauuuccagcuguggguuugaagacuuagggggacauccagaacgugcuuccucuuucagac

SEQ ID NO: 475329 - RNA, 64 nt, Human
ggaugcauuacgaggacuggggacaggguagagggacauccagggaucagggcaugaguggggg

SEQ ID NO: 475330 - RNA, 64 nt, Human
ugucuagagguugacucuuaguucuguaaauaaagacauccauuucaaacagccuuuauugagu

SEQ ID NO: 475331 - RNA, 64 nt, Human
auccucucaccauuuugccaagauacucuaaaaugacauccaaguuuaccaguagaaagacaca

SEQ ID NO: 475332 - RNA, 64 nt, Human
ucuugccccuggaaaaaauucaggugaugucuuugacauccagggauuucucaaaggcagugag

SEQ ID NO: 475333 - RNA, 64 nt, Human
ucuauuuaguccuacaaaucaggagugguguagagacauccaaauuuaaagaaaaaaaaacaca

SEQ ID NO: 475334 - RNA, 64 nt, Human
cuuagacccgccaggucaaguuagccgcgugacggacauccaggcgugggacguggucagggca

SEQ ID NO: 475335 - RNA, 64 nt, Human
ggugucuguucccaacuaguuuauguggcacugagacauccaucccugaccaaggaugcugcga

SEQ ID NO: 475336 - RNA, 64 nt, Human
uagagucccacugugagucauggucagccugucugacauccagguugugcuauuaaccaagaag

SEQ ID NO: 475337 - RNA, 64 nt, Human
cacaccagcauccgugacgccagcuucccacuaggacauccaggcaggucgggcggggacgcca

SEQ ID NO: 475338 - RNA, 64 nt, Human
auuuauccuuacacaaauuuguccucauugaguugacauccaaaauuugucaggaauuaaagaa

SEQ ID NO: 475339 - RNA, 64 nt, Human
ugugcuugguugauauguauaguacauauacacagacauccauaugcagcguuuccuuugaagg

SEQ ID NO: 475340 - RNA, 64 nt, Human
uucagcaucgugugggucccuaagcacaauaaaagacauccacaauggaaaaacugccucagcc

SEQ ID NO: 475341 - RNA, 62 nt, Human; identical to SEQ ID NO: 473099

SEQ ID NO: 475342 - RNA, 62 nt, Human; identical to SEQ ID NO: 473125

SEQ ID NO: 475343 - RNA, 62 nt, Human; identical to SEQ ID NO: 473126

SEQ ID NO: 475344 - RNA, 64 nt, Human
guuuuuaauacauuagcaaucuauugggucaacugacauccauuguauauacuaguuucuuuca

SEQ ID NO: 475345 - RNA, 64 nt, Human
gcuacugauuuuugugauuuagaacuguaugucagacauccauguuuguaaaacuacacauccc

SEQ ID NO: 475346 - RNA, 64 nt, Human
ucagcauuagacauggucacuguucaaguuucaagacauccauucuuaacuauagagaagaguu

SEQ ID NO: 475347 - RNA, 64 nt, Human
acuauuccccagcagggucuuuucaucugggaaagacauccauaaagaagcaauaaagaagagu

SEQ ID NO: 475348 - RNA, 64 nt, Human
gcaggguucuuuuaccugugccaccagcucuggagacauccacacccauucccagguguccuuc

SEQ ID NO: 475349 - RNA, 64 nt, Human
ucuguccuucccugagucacagagagcaagccaagacauccagggaaagaggaagaaaggccuu

SEQ ID NO: 475350 - RNA, 64 nt, Human
aaaaaauaaugccuauaaaucuucagaguauaaagacauccauucagaaacaaaaauuagcacu

SEQ ID NO: 475351 - RNA, 64 nt, Human
gccaauaauccacccaaaaauuagaauguucugagacauccauuugggucuauuugugacuuau

SEQ ID NO: 475352 - RNA, 64 nt, Human
auaggcaaaacacuagucacaauuggguagaugugacauccauauacuuguuuacauuuuaucu

SEQ ID NO: 475353 - RNA, 64 nt, Human
aaugacuuauaaaaauauuaccucaaugguaggagacauccagacuuguauauuucaguggaaa

SEQ ID NO: 475354 - RNA, 64 nt, Human
cuuguuagaaucaaagacucucaggccucaccuagacauccagaaucaaaaucugcauuuuaac

SEQ ID NO: 475355 - RNA, 64 nt, Human
uaaugagcuagaaacuaaaguacaaacuagaugggacauccagucccuuugauagauaaugcug

SEQ ID NO: 475356 - RNA, 64 nt, Human
accucagaaugucaaauuuuggucuugaaccacagacauccaauuacagaaagaauauaagcaa

SEQ ID NO: 475357 - RNA, 64 nt, Human
guuugcuaccgaaaaaaggcuuaaacuaaaccuugacauccacaguagcaucaggaauagaaau

SEQ ID NO: 475358 - RNA, 64 nt, Human
aggaggugcuugcagggccucucgcugcuacugggacauccacaggaccuaauguuuaugugga

SEQ ID NO: 475359 - RNA, 64 nt, Human
aaauauaccauugaugauucuucuuccauucagugacauccacagauuaugcagcuauacuugu

SEQ ID NO: 475360 - RNA, 62 nt, Human; identical to SEQ ID NO: 473139

SEQ ID NO: 475361 - RNA, 62 nt, Human; identical to SEQ ID NO: 473140

SEQ ID NO: 475362 - RNA, 62 nt, Human; identical to SEQ ID NO: 473141

SEQ ID NO: 475363 - RNA, 64 nt, Human
ggagcggcgccccugcgcccucagcccgagcagcgacauccacucgccauuugcugacaugaga

SEQ ID NO: 475364 - RNA, 64 nt, Human
uccaguucccauccuuugauugaucacucucccugacauccaccuguaugacuuugucaccaaa

SEQ ID NO: 475365 - RNA, 64 nt, Human
aaguccagccacuugacuggcacacaccccuccggacauccagcgugacggagcccacacugcc

SEQ ID NO: 475366 - RNA, 64 nt, Human
gcaacucaaguuccacaggauggucaagcugucagacauccaaguuuacaucauuguaauuauu

SEQ ID NO: 475367 - RNA, 64 nt, Human
acaagagagguaugucacucaucuuacuucccaggacauccacccugagaauaauuugacaagc

SEQ ID NO: 475368 - RNA, 64 nt, Human
gauacacaauugcaggagauuuuauuggccccaugacauccagugacagugugggagcaggcua

SEQ ID NO: 475369 - RNA, 64 nt, Human
ucuaucacgagccuaacccgcgggaggcggaagagacauccauucgagaacugaagcggccucc

SEQ ID NO: 475370 - RNA, 64 nt, Human
gauacuguuuguuuacaaagaguuuaguuuuuaagacauccaaaacucuaugcuagagcaaaaa

SEQ ID NO: 475371 - RNA, 64 nt, Human
caccccaaccccagcgucucgugaguccgacccagacauccaaacuaaaaggaagucauccagu

SEQ ID NO: 475372 - RNA, 64 nt, Human
ucugucaugccaaaaguaaaucauuguauagacugacauccaguuuucuucaacuguacacuuu

SEQ ID NO: 475373 - RNA, 64 nt, Human
uauauuauuucauaaauaauuucaagcaaauacagacauccacaauguagaacaugagagaccc

SEQ ID NO: 475374 - RNA, 64 nt, Human
uccaaauccaaggaaacaugcagcucuucaacaugacauccagagaugacuauuacuuuucugu

SEQ ID NO: 475375 - RNA, 64 nt, Human
uacgcuuuuuucuuucauuacacccuagcugaaggacauccaguuccccagcuguaguuaugua

SEQ ID NO: 475376 - RNA, 64 nt, Human
cuuccucauucugcuacaacacccaggcccucuggacauccagaaaaccaaguguccggauggc

SEQ ID NO: 475377 - RNA, 64 nt, Human
uuccagguguagggaccccuugaggggccgagcugacauccaaggcugaggaccccagugggga

SEQ ID NO: 475378 - RNA, 64 nt, Human
uucauuucggauccuguuuaacaaagauacuugagacauccauuuguuuuaaugaaaucuguau

SEQ ID NO: 475379 - RNA, 62 nt, Human; identical to SEQ ID NO: 473190

SEQ ID NO: 475380 - RNA, 62 nt, Human; identical to SEQ ID NO: 473191

SEQ ID NO: 475381 - RNA, 62 nt, Human; identical to SEQ ID NO: 473192

SEQ ID NO: 475382 - RNA, 64 nt, Human
aaguucaaaaagcauuauccuguggcguugccuggacauccacucccugacagcccagagcagc

SEQ ID NO: 475383 - RNA, 64 nt, Human
gauccgcaucuggggaccccuccaggaagaugcugacauccaggugggaggugucagagcccag

SEQ ID NO: 475384 - RNA, 64 nt, Human
ucguuguuacuuacucagcugaugucacagugcagacauccaccguuccaccacagaaccagug

SEQ ID NO: 475385 - RNA, 64 nt, Human
agaccaccccagacaaggccccgcuuccucacgugacauccagcacuuggucagacccuagcca

SEQ ID NO: 475386 - RNA, 64 nt, Human
caucagagacgucacaugaagaagaaaacuugucgacauccaggaugaucaggagccuucauua

SEQ ID NO: 475387 - RNA, 64 nt, Human
gcuuucacacugguauuugugaucucaccauuaugacauccaucccccuagcucaccacauagc

SEQ ID NO: 475388 - RNA, 64 nt, Human
aguaggaaugugaagccagagguuucggauucgugacauccacccccugggcaagugagagcau

SEQ ID NO: 475389 - RNA, 64 nt, Human
ugaagccaugggaagccauguguaacagagcuuagacauccaaaacuaaucaaugcugaggugg

SEQ ID NO: 475390 - RNA, 64 nt, Human
uauuauuuuuguuacugacaguuaacaguggugugacauccagagagcagcugggcugcucccg

SEQ ID NO: 475391 - RNA, 64 nt, Human
uuuuugugucuggucuucccuuucuggcuucuaggacauccaugccaggugaggugccuggguc

SEQ ID NO: 475392 - RNA, 64 nt, Human
uggagaccagaagcugaggcccucucagggaggagacauccaagcaaaucauuuggaaaaguua

SEQ ID NO: 475393 - RNA, 64 nt, Human
ugccuucccuggggaaacauucaggcaguaaaaugacauccacguguuccugucggacgcagcg

SEQ ID NO: 475394 - RNA, 64 nt, Human
gucaagacauuuucugucagggcagccagcuguagacauccaaaagcucacaaaugagaagcuc

SEQ ID NO: 475395 - RNA, 64 nt, Human
cacgucugauugugugcggguugucauuuuccuggacauccaugaagagcugaaggaaauuguu

SEQ ID NO: 475396 - RNA, 64 nt, Human
uacauuuuuuacagguuauuuucauuguguuauugacauccaugucucucguaaaacagauggc

SEQ ID NO: 475397 - RNA, 64 nt, Human
uggaggcacuugccguggcacaccuggacuccuugacauccaauucaaacugcauuugcaaaau

SEQ ID NO: 475398 - RNA, 62 nt, Human; identical to SEQ ID NO: 473795

SEQ ID NO: 475399 - RNA, 62 nt, Human; identical to SEQ ID NO: 473796

SEQ ID NO: 475400 - RNA, 62 nt, Human; identical to SEQ ID NO: 473797

SEQ ID NO: 475401 - RNA, 64 nt, Human
auuauaguuuauuguguggucauguuuacauugugacauccagccccaaggauggcugggaguu

SEQ ID NO: 475402 - RNA, 64 nt, Human
agacaaagggaaaugcagccauagagggccugaugacauccaauacagaguucugguaaagaua

SEQ ID NO: 475403 - RNA, 64 nt, Human
auguggccacaggggaccuuuuuuuguuucuccugacauccagacuuggaaauaucuaacuacu

SEQ ID NO: 475404 - RNA, 64 nt, Human
uggcugcccccacacaauaaaugguaacauaggagacauccacaucccaauucugacaagaccu

SEQ ID NO: 475405 - RNA, 64 nt, Human
accucuacugucaccguuuacucuuuccuacccugacauccagaaacaauggccuccagugcau

SEQ ID NO: 475406 - RNA, 64 nt, Human
ucuuauaaaguggaaguauguauauuaaaaaagagacauccaaauuuuuuuuuaaagcagucua

SEQ ID NO: 475407 - RNA, 64 nt, Human
aaggaugggccagcuugcagggguuggggagggagacauccagcuugggcuuuccccuuuggaa

SEQ ID NO: 475408 - RNA, 64 nt, Human
cgccccguggagauaccgccccagcgggggcugcgacauccauggccaccauggggcaccuggc

SEQ ID NO: 475409 - RNA, 64 nt, Human
aaaacaauuuuaguggcuguuuuacuaauuaaaggacauccacaauucaauguauaacagaaaa

SEQ ID NO: 475410 - RNA, 64 nt, Human
uuugaauggggaaaauacccuuuaaauuaugacggacauccacuagagauggguuugaggauuu

SEQ ID NO: 475411 - RNA, 64 nt, Human
ucacuaguuagaaaccugugggccauggaggucagacauccaucuuguccaucuauaggcaaga

SEQ ID NO: 475412 - RNA, 64 nt, Human
aguggaagagccgggaccuucccccugcacccccgacauccagggacggggugugaggaagacg

SEQ ID NO: 475413 - RNA, 64 nt, Human
aaaguuuuguagugggaccagaaauuacuuaccugacauccacccccauucccccucauccugc

SEQ ID NO: 475414 - RNA, 64 nt, Human
ggcucugcacgaaggagaaccacgcauuuaugaagacauccaggacuacgaggcggccaaggcu

SEQ ID NO: 475415 - RNA, 64 nt, Human
gaaaguuugcaucuaugaaaagccaauaggcugagacauccaauugcugcauggaaauugaugu

SEQ ID NO: 475416 - RNA, 64 nt, Human
cuaaaaaauaaagacacacacagagcauuuuagugacauccacuacuuauugccgcuaugaguu

SEQ ID NO: 475417 - RNA, 62 nt, Human; identical to SEQ ID NO: 472921

SEQ ID NO: 475418 - RNA, 62 nt, Human; identical to SEQ ID NO: 473173

SEQ ID NO: 475419 - RNA, 62 nt, Human; identical to SEQ ID NO: 473174

SEQ ID NO: 475420 - RNA, 60 nt, Human
cccccagccacaagcauuagcaugauccgagacauccaggagacagagccccugccccau

SEQ ID NO: 475421 - RNA, 64 nt, Human
ugagaaaaugagguugucaguuuccagcaaggcugacauccaccagacugauuucuccgauguu

SEQ ID NO: 475422 - RNA, 64 nt, Human
ccccaucuccagcuggaacgugaagagggcacgagacauccacuugacaguggagcagaggggu

SEQ ID NO: 475423 - RNA, 64 nt, Human
gcuguggcuucaguucccccggcuccccaccccugacauccauacuuauguugucuggaagagc

SEQ ID NO: 475424 - RNA, 64 nt, Human
gugaguccugaagcacuuucagugcugugagaacgacauccacuuuggguuucauucguuugua

SEQ ID NO: 475425 - RNA, 64 nt, Human
aaacacguuaaauguccuucagccucccuaccacgacauccaacagcuggaacuuccauccagu

SEQ ID NO: 475426 - RNA, 64 nt, Human
ugacacacaguugcucagcuacuucucuacccuugacauccagcuucgcgagagccuagagcca

SEQ ID NO: 475427 - RNA, 64 nt, Human
aaccacugggucugggcuccauccugcgcccaaagacauccacccagaccucauuauuucuugc

SEQ ID NO: 475428 - RNA, 64 nt, Human
cacacugcaggaagucaaacacgaacucaaagaggacauccagcugcucagcugcagaaugacu

SEQ ID NO: 475429 - RNA, 64 nt, Human
gugcccccuccugacugggucccaaagccaauaugacauccaugcaggcagcagugcugaaucc

SEQ ID NO: 475430 - RNA, 64 nt, Human
aaucaaaugaagaaauaaacccagcacaaccuuggacauccauuagcugaauuauccucagccc

SEQ ID NO: 475431 - RNA, 64 nt, Human
ugacccaaauaguaaccccaaagccaucaugggagacauccagauggcacaccagaacuuaaug

SEQ ID NO: 475432 - RNA, 64 nt, Human
uuauuauuugcuuuucauguagaacucagcaguugacauccaaaucuagccagagcccuucacu

SEQ ID NO: 475433 - RNA, 64 nt, Human
agcccaagcuagaacucacugucuauggcagaaggacauccagagcccauucuggaguuuuguu

SEQ ID NO: 475434 - RNA, 52 nt, Human
ugguggugggauggaauuaauagacauccaucuauugcucgaagacuaaagg

SEQ ID NO: 475435 - RNA, 64 nt, Human
auguagaagugugccuguuuauuauguagauacagacauccagcaaaaacaggagaaucacaug

SEQ ID NO: 475436 - RNA, 62 nt, Human
gggucucuccuccagccccugcacacucccacccaggacagcccccagcccaacuaggaaag

SEQ ID NO: 475437 - RNA, 62 nt, Human
gggcccaggaggcauuccacacaggcacugccccaggacaacacaacaaggacagucacaac

SEQ ID NO: 475438 - RNA, 62 nt, Human
augguggguggaguggggguggcugggcucccccaggacagaggggacccugagguuggcaa

SEQ ID NO: 475439 - RNA, 64 nt, Human
uuuuaaggugcagaaacugcaggggggccucagugacauccaugaggccuuauuagcaaaggac

SEQ ID NO: 475440 - RNA, 64 nt, Human
cagcggcucugcagacugcaccaucauugugugggacauccagaaccugcagaaggugaacacc

SEQ ID NO: 475441 - RNA, 64 nt, Human
cuccaauuuucugugccauuuuaaauuuaacuuugacauccagcuauagacagaaauaauaagc

SEQ ID NO: 475442 - RNA, 64 nt, Human
uggcaaauccaggcugguguucugucugggcucagacauccacauaacccugucacccacagac

SEQ ID NO: 475443 - RNA, 64 nt, Human
gcagcuguaauuggggaacauuaaaacaguaacugacauccaguuaaagccacgaucgucagca

SEQ ID NO: 475444 - RNA, 64 nt, Human
caagacaguagaugagucugguuaagcgaggucagacauccaccagaaucaacucagccucagg

SEQ ID NO: 475445 - RNA, 64 nt, Human
gcugcggaugggcuuuccugccaccaccuuccaggacauccagcgcggggugacaagugccgug

SEQ ID NO: 475446 - RNA, 64 nt, Human
cuguggcucuggacaccuaugagaagggccagcugacauccagcaugguggaugaugucuucua

SEQ ID NO: 475447 - RNA, 64 nt, Human
uauacaaaauaugguagcauuuuuauacaccaacgacauccaagcugagagccaaaucaagaau

SEQ ID NO: 475448 - RNA, 64 nt, Human
ugccaggccaaagauccccccagacccccauucugacauccacaugcucugcaguccuggcccc

SEQ ID NO: 475449 - RNA, 64 nt, Human
ugacaaugagcugaauauaugguuuuacaaaguagacauccacuugcaaaauguuuggauguaa

SEQ ID NO: 475450 - RNA, 64 nt, Human
ggcccaggaccugccccccacucugcacagccuagacauccaggucccgaaaggggcacuggug

SEQ ID NO: 475451 - RNA, 64 nt, Human
cacacuaccacauccuuucuaagcauguuugccugacauccagcucacucgucugcuuccuuuc

SEQ ID NO: 475452 - RNA, 64 nt, Human
gucccuagcggaugaccaccaggcucucaucugggacauccagcaaaugccccgagccauugag

SEQ ID NO: 475453 - RNA, 64 nt, Human
gaagcuucauucccucuuaaucuaguuaagccaggacauccagaauucauugcuuuaauaaaga

SEQ ID NO: 475454 - RNA, 64 nt, Human
agcauccuagaaaggagauggggcuucaaccagggacauccaaaccggaagcacaaauccagga

SEQ ID NO: 475455 - RNA, 62 nt, Human; identical to SEQ ID NO: 473242

SEQ ID NO: 475456 - RNA, 62 nt, Human; identical to SEQ ID NO: 473243

SEQ ID NO: 475457 - RNA, 62 nt, Human; identical to SEQ ID NO: 473326

SEQ ID NO: 475458 - RNA, 64 nt, Human
acauacuccuggcauugcacuuuuuaaccuugcugacauccaaauagaagauaggacuaucuaa

SEQ ID NO: 475459 - RNA, 64 nt, Human
uucucccacuggaagggguucugccuucugaggugacauccaggaagcuguccccauucccuuc

SEQ ID NO: 475460 - RNA, 64 nt, Human
acccagggacacuccaacucuacacagcucagcagacauccacacacaguaauggggugagcuc

SEQ ID NO: 475461 - RNA, 64 nt, Human
agcuaaacaguuguauuagauaauccuuaaaucugacauccagccuguuacgcucuagggcucg

SEQ ID NO: 475462 - RNA, 64 nt, Human
uuagacagcaaggccagaugcacaucccuggaaggacauccauguuccgagaagaacagauaau

SEQ ID NO: 475463 - RNA, 64 nt, Human
gccugcaccucaccacgauauugaggaagcacaggacauccaaggguacucuccaguuuggcug

SEQ ID NO: 475464 - RNA, 64 nt, Human
gacagagaggacgugggcggcagagaggacuguugacauccaagcuuccuuuguuuuuuuuucc

SEQ ID NO: 475465 - RNA, 64 nt, Human
cuaagaccucauccugcuggggaccccacgaggggacauccacccucugggguguggccaggaa

SEQ ID NO: 475466 - RNA, 64 nt, Human
aaaacuaacaggaauauaaucaacaucaacaaaggacauccacacagaaaccccaucugaaggu

SEQ ID NO: 475467 - RNA, 64 nt, Human
accuggauuuucagugggagguuuuugguuuggagacauccaaagccugaagccaggugggugu

SEQ ID NO: 475468 - RNA, 64 nt, Human
ccaaccucugcccugcccgccccaggggcaccccgacauccaggccacccccucauggugcuac

SEQ ID NO: 475469 - RNA, 64 nt, Human
agagggagaggcaccugcugaacccugucuucuugacauccaccaagauaccagacauuugagu

SEQ ID NO: 475470 - RNA, 64 nt, Human
uguggcaaacuccucaugaguucaaguauuaauagacauccaagaguccauaauaaugagaaau

SEQ ID NO: 475471 - RNA, 64 nt, Human
gcccacccacccuuuccugccuccuccgugugaagacauccaacauccacgugacuuuuccagc

SEQ ID NO: 475472 - RNA, 64 nt, Human
agaggacaagauggguaaacccucacaucagagugacauccaggaggaauaagcucccagggcc

SEQ ID NO: 475473 - RNA, 64 nt, Human
aaauugacgcucauucuucuuccuauuguucccugacauccagcaaauugugaauuugaaaaau

SEQ ID NO: 475474 - RNA, 62 nt, Human; identical to SEQ ID NO: 473156

SEQ ID NO: 475475 - RNA, 62 nt, Human; identical to SEQ ID NO: 473157

SEQ ID NO: 475476 - RNA, 62 nt, Human; identical to SEQ ID NO: 473158

SEQ ID NO: 475477 - RNA, 64 nt, Human
gugggaaggcuuuagcaauaaucaacauuuaccagacauccaaugacagccucaggggaaagca

SEQ ID NO: 475478 - RNA, 64 nt, Human
agcaaaacugcugucgcugcaguaucugauaccagacauccacauauccacaagaagugccucu

SEQ ID NO: 475479 - RNA, 64 nt, Human
uaucuugaaagccuuacugcaaaugaguauuauagacauccagcagagucugguuuucuuuguu

SEQ ID NO: 475480 - RNA, 64 nt, Human
uauccaaauaaauugcaagcauucuauccaaauggacauccauaaaaauucaucagagagcauu

SEQ ID NO: 475481 - RNA, 64 nt, Human
uacuccaauccccgccaagagacuggcauagcuggacauccaacauaccaauuuucugcuaaua

SEQ ID NO: 475482 - RNA, 64 nt, Human
gggacuccccauagcaaagggucuguggccaguugacauccaggauggcugcaagcgcacuuga

SEQ ID NO: 475483 - RNA, 64 nt, Human
uguuaaaagcucuaauaaugcuaguggagcaguugacauccaggguuuuuuuuccugccuguca

SEQ ID NO: 475484 - RNA, 64 nt, Human
agguggggccaucugcggcccugguucgggcagggacauccauccaccucugaguccuucugag

SEQ ID NO: 475485 - RNA, 64 nt, Human
aacugugugacucacuugaggcaggaccgagagugacauccaguugcaccuuucucaccuacuu

SEQ ID NO: 475486 - RNA, 64 nt, Human
gugaauccaguggccccguggcacccuccuuuaugacauccauccaucuguggugaaccaagug

SEQ ID NO: 475487 - RNA, 64 nt, Human
ggcccaugcacacccgucuuuccaugauggcagagacauccagucaggaccugacccgucucug

SEQ ID NO: 475488 - RNA, 64 nt, Human
agaucucauagaugacccccagguauugucuuuugacauccagcaguccaagguauugagacau

SEQ ID NO: 475489 - RNA, 64 nt, Human
gucuaccccaucgccagucgucuucugccacaaugacauccaggaagguaggagaaggcaucug

SEQ ID NO: 475490 - RNA, 64 nt, Human
agacuugagacuguccucauucccauauguaauagacauccaaagaauuucaauugcuuuguug

SEQ ID NO: 475491 - RNA, 64 nt, Human
auccugggugucucugagacccaucuccugccuagacauccaccuccagagcaacacuggcccc

SEQ ID NO: 475492 - RNA, 64 nt, Human
caugggacagaguuagaaaacugggaaugaauaagacauccauaacuacuauucuuuuuucacu

SEQ ID NO: 475493 - RNA, 62 nt, Human; identical to SEQ ID NO: 472922

SEQ ID NO: 475494 - RNA, 62 nt, Human; identical to SEQ ID NO: 473207

SEQ ID NO: 475495 - RNA, 62 nt, Human; identical to SEQ ID NO: 473208

SEQ ID NO: 475496 - RNA, 64 nt, Human
cuuauauaucugaagcagcaaccccacugaugcagacauccagagaguccuaugaaaagacaag

SEQ ID NO: 475497 - RNA, 64 nt, Human
augggcaguuucaguuucagccuaagagacuggugacauccacaaaugcaguuuuagaagcaga

SEQ ID NO: 475498 - RNA, 64 nt, Human
gcaguugucagaaauacugugcugaaaguuuuaugacauccaucuuuuaaauuuucaggcccug

SEQ ID NO: 475499 - RNA, 64 nt, Human; identical to SEQ ID NO: 203629

SEQ ID NO: 475500 - RNA, 64 nt, Human; identical to SEQ ID NO: 203630

SEQ ID NO: 475501 - RNA, 64 nt, Human; identical to SEQ ID NO: 203631

SEQ ID NO: 475502 - RNA, 64 nt, Human; identical to SEQ ID NO: 203632

SEQ ID NO: 475503 - RNA, 64 nt, Human; identical to SEQ ID NO: 203633

SEQ ID NO: 475504 - RNA, 64 nt, Human; identical to SEQ ID NO: 203634

SEQ ID NO: 475505 - RNA, 64 nt, Human; identical to SEQ ID NO: 203635

SEQ ID NO: 475506 - RNA, 52 nt, Human; identical to SEQ ID NO: 203636

SEQ ID NO: 475507 - RNA, 64 nt, Human; identical to SEQ ID NO: 203637

SEQ ID NO: 475508 - RNA, 64 nt, Human; identical to SEQ ID NO: 203638

SEQ ID NO: 475509 - RNA, 64 nt, Human; identical to SEQ ID NO: 203639

SEQ ID NO: 475510 - RNA, 62 nt, Human; identical to SEQ ID NO: 473224

SEQ ID NO: 475511 - RNA, 62 nt, Human; identical to SEQ ID NO: 473225

SEQ ID NO: 475512 - RNA, 62 nt, Human; identical to SEQ ID NO: 473226

SEQ ID NO: 475513 - RNA, 64 nt, Human; identical to SEQ ID NO: 203640

SEQ ID NO: 475514 - RNA, 64 nt, Human; identical to SEQ ID NO: 203641

SEQ ID NO: 475515 - RNA, 64 nt, Human; identical to SEQ ID NO: 203642

SEQ ID NO: 475516 - RNA, 64 nt, Human; identical to SEQ ID NO: 203643

SEQ ID NO: 475517 - RNA, 64 nt, Human; identical to SEQ ID NO: 203644

SEQ ID NO: 475518 - RNA, 64 nt, Human; identical to SEQ ID NO: 203645

SEQ ID NO: 475519 - RNA, 64 nt, Human; identical to SEQ ID NO: 203646

SEQ ID NO: 475520 - RNA, 64 nt, Human; identical to SEQ ID NO: 203647

SEQ ID NO: 475521 - RNA, 64 nt, Human; identical to SEQ ID NO: 203648

SEQ ID NO: 475522 - RNA, 64 nt, Human; identical to SEQ ID NO: 203649

SEQ ID NO: 475523 - RNA, 64 nt, Human; identical to SEQ ID NO: 203650

SEQ ID NO: 475524 - RNA, 64 nt, Human; identical to SEQ ID NO: 203651

SEQ ID NO: 475525 - RNA, 64 nt, Human; identical to SEQ ID NO: 203652

SEQ ID NO: 475526 - RNA, 64 nt, Human; identical to SEQ ID NO: 203653

SEQ ID NO: 475527 - RNA, 64 nt, Human; identical to SEQ ID NO: 203654

SEQ ID NO: 475528 - RNA, 64 nt, Human; identical to SEQ ID NO: 203655

SEQ ID NO: 475529 - RNA, 62 nt, Human; identical to SEQ ID NO: 472937

SEQ ID NO: 475530 - RNA, 62 nt, Human; identical to SEQ ID NO: 473258

SEQ ID NO: 475531 - RNA, 62 nt, Human; identical to SEQ ID NO: 473259

SEQ ID NO: 475532 - RNA, 64 nt, Human; identical to SEQ ID NO: 203656

SEQ ID NO: 475533 - RNA, 64 nt, Human; identical to SEQ ID NO: 203657

SEQ ID NO: 475534 - RNA, 52 nt, Human; identical to SEQ ID NO: 473327

SEQ ID NO: 475535 - RNA, 62 nt, Human; identical to SEQ ID NO: 473328

SEQ ID NO: 475536 - RNA, 62 nt, Human
gccuguagggaguuuuccaggcagguccuuugccaggacagcaugguccugcccuguugucc

SEQ ID NO: 475537 - RNA, 62 nt, Human
agggguagccagcuugggcuguccccuugagaccaggacaagaggcugggggugucagcauu

SEQ ID NO: 475538 - RNA, 62 nt, Human; identical to SEQ ID NO: 472889

SEQ ID NO: 475539 - RNA, 62 nt, Human; identical to SEQ ID NO: 473545

SEQ ID NO: 475540 - RNA, 62 nt, Human; identical to SEQ ID NO: 473546

SEQ ID NO: 475541 - RNA, 62 nt, Human; identical to SEQ ID NO: 473547

SEQ ID NO: 475542 - RNA, 62 nt, Human; identical to SEQ ID NO: 473581

SEQ ID NO: 475543 - RNA, 62 nt, Human; identical to SEQ ID NO: 473582

SEQ ID NO: 475544 - RNA, 62 nt, Human; identical to SEQ ID NO: 473583

SEQ ID NO: 475545 - RNA, 62 nt, Human; identical to SEQ ID NO: 472890

SEQ ID NO: 475546 - RNA, 62 nt, Human; identical to SEQ ID NO: 473599

SEQ ID NO: 475547 - RNA, 62 nt, Human; identical to SEQ ID NO: 473600

SEQ ID NO: 475548 - RNA, 62 nt, Human; identical to SEQ ID NO: 473601

SEQ ID NO: 475549 - RNA, 62 nt, Human; identical to SEQ ID NO: 473689

SEQ ID NO: 475550 - RNA, 62 nt, Human; identical to SEQ ID NO: 473690

SEQ ID NO: 475551 - RNA, 62 nt, Human; identical to SEQ ID NO: 473691

SEQ ID NO: 475552 - RNA, 62 nt, Human; identical to SEQ ID NO: 472905

SEQ ID NO: 475553 - RNA, 62 nt, Human; identical to SEQ ID NO: 474032

SEQ ID NO: 475554 - RNA, 62 nt, Human; identical to SEQ ID NO: 474083

SEQ ID NO: 475555 - RNA, 62 nt, Human; identical to SEQ ID NO: 474084

SEQ ID NO: 475556 - RNA, 62 nt, Human; identical to SEQ ID NO: 475536

SEQ ID NO: 475557 - RNA, 62 nt, Human; identical to SEQ ID NO: 470881

SEQ ID NO: 475558 - RNA, 62 nt, Human; identical to SEQ ID NO: 475537

SEQ ID NO: 475559 - RNA, 62 nt, Human; identical to SEQ ID NO: 475436

SEQ ID NO: 475560 - RNA, 62 nt, Human; identical to SEQ ID NO: 475437

SEQ ID NO: 475561 - RNA, 62 nt, Human; identical to SEQ ID NO: 475438

SEQ ID NO: 475562 - RNA, 62 nt, Human; identical to SEQ ID NO: 470882

SEQ ID NO: 475563 - RNA, 62 nt, Human; identical to SEQ ID NO: 474964

SEQ ID NO: 475564 - RNA, 62 nt, Human; identical to SEQ ID NO: 474965

SEQ ID NO: 475565 - RNA, 62 nt, Human; identical to SEQ ID NO: 474966

SEQ ID NO: 475566 - RNA, 62 nt, Human; identical to SEQ ID NO: 474981

SEQ ID NO: 475567 - RNA, 62 nt, Human; identical to SEQ ID NO: 474982

SEQ ID NO: 475568 - RNA, 62 nt, Human; identical to SEQ ID NO: 474983

SEQ ID NO: 475569 - RNA, 62 nt, Human; identical to SEQ ID NO: 470899

SEQ ID NO: 475570 - RNA, 62 nt, Human; identical to SEQ ID NO: 475015

SEQ ID NO: 475571 - RNA, 62 nt, Human; identical to SEQ ID NO: 475016

SEQ ID NO: 475572 - RNA, 62 nt, Human; identical to SEQ ID NO: 475017

SEQ ID NO: 475573 - RNA, 62 nt, Human; identical to SEQ ID NO: 475032

SEQ ID NO: 475574 - RNA, 62 nt, Human; identical to SEQ ID NO: 475033

SEQ ID NO: 475575 - RNA, 62 nt, Human; identical to SEQ ID NO: 475034

SEQ ID NO: 475576 - RNA, 60 nt, Human; identical to SEQ ID NO: 470900

SEQ ID NO: 475577 - RNA, 62 nt, Human; identical to SEQ ID NO: 475049

SEQ ID NO: 475578 - RNA, 56 nt, Human; identical to SEQ ID NO: 475050

SEQ ID NO: 475579 - RNA, 62 nt, Human; identical to SEQ ID NO: 475051

SEQ ID NO: 475580 - RNA, 62 nt, Human; identical to SEQ ID NO: 475066

SEQ ID NO: 475581 - RNA, 62 nt, Human; identical to SEQ ID NO: 475067

SEQ ID NO: 475582 - RNA, 62 nt, Human; identical to SEQ ID NO: 475068

SEQ ID NO: 475583 - RNA, 62 nt, Human; identical to SEQ ID NO: 470901

SEQ ID NO: 475584 - RNA, 62 nt, Human; identical to SEQ ID NO: 475083

SEQ ID NO: 475585 - RNA, 62 nt, Human; identical to SEQ ID NO: 475084

SEQ ID NO: 475586 - RNA, 62 nt, Human; identical to SEQ ID NO: 475085

SEQ ID NO: 475587 - RNA, 62 nt, Human; identical to SEQ ID NO: 475100

SEQ ID NO: 475588 - RNA, 62 nt, Human; identical to SEQ ID NO: 475101

SEQ ID NO: 475589 - RNA, 62 nt, Human; identical to SEQ ID NO: 475102

SEQ ID NO: 475590 - RNA, 62 nt, Human; identical to SEQ ID NO: 470918

SEQ ID NO: 475591 - RNA, 62 nt, Human; identical to SEQ ID NO: 475134

SEQ ID NO: 475592 - RNA, 62 nt, Human; identical to SEQ ID NO: 475135

SEQ ID NO: 475593 - RNA, 62 nt, Human; identical to SEQ ID NO: 475136

SEQ ID NO: 475594 - RNA, 62 nt, Human; identical to SEQ ID NO: 475151

SEQ ID NO: 475595 - RNA, 57 nt, Human; identical to SEQ ID NO: 475152

SEQ ID NO: 475596 - RNA, 62 nt, Human; identical to SEQ ID NO: 475153

SEQ ID NO: 475597 - RNA, 62 nt, Human; identical to SEQ ID NO: 470919

SEQ ID NO: 475598 - RNA, 62 nt, Human; identical to SEQ ID NO: 475168

SEQ ID NO: 475599 - RNA, 62 nt, Human; identical to SEQ ID NO: 475169

SEQ ID NO: 475600 - RNA, 62 nt, Human; identical to SEQ ID NO: 475170

SEQ ID NO: 475601 - RNA, 62 nt, Human; identical to SEQ ID NO: 475251

SEQ ID NO: 475602 - RNA, 62 nt, Human; identical to SEQ ID NO: 475252

SEQ ID NO: 475603 - RNA, 62 nt, Human; identical to SEQ ID NO: 475253

SEQ ID NO: 475604 - RNA, 62 nt, Human; identical to SEQ ID NO: 470920

SEQ ID NO: 475605 - RNA, 62 nt, Human; identical to SEQ ID NO: 474743

SEQ ID NO: 475606 - RNA, 62 nt, Human; identical to SEQ ID NO: 474744

SEQ ID NO: 475607 - RNA, 62 nt, Human; identical to SEQ ID NO: 474745

SEQ ID NO: 475608 - RNA, 62 nt, Human; identical to SEQ ID NO: 474760

SEQ ID NO: 475609 - RNA, 62 nt, Human; identical to SEQ ID NO: 474761

SEQ ID NO: 475610 - RNA, 62 nt, Human; identical to SEQ ID NO: 474762

SEQ ID NO: 475611 - RNA, 62 nt, Human; identical to SEQ ID NO: 470937

SEQ ID NO: 475612 - RNA, 62 nt, Human; identical to SEQ ID NO: 474794

SEQ ID NO: 475613 - RNA, 62 nt, Human; identical to SEQ ID NO: 474795

SEQ ID NO: 475614 - RNA, 62 nt, Human; identical to SEQ ID NO: 474796

SEQ ID NO: 475615 - RNA, 62 nt, Human; identical to SEQ ID NO: 474811

SEQ ID NO: 475616 - RNA, 62 nt, Human; identical to SEQ ID NO: 474812

SEQ ID NO: 475617 - RNA, 62 nt, Human; identical to SEQ ID NO: 474813

SEQ ID NO: 475618 - RNA, 62 nt, Human; identical to SEQ ID NO: 470938

SEQ ID NO: 475619 - RNA, 62 nt, Human; identical to SEQ ID NO: 474828

SEQ ID NO: 475620 - RNA, 62 nt, Human; identical to SEQ ID NO: 474829

SEQ ID NO: 475621 - RNA, 62 nt, Human; identical to SEQ ID NO: 474830

SEQ ID NO: 475622 - RNA, 62 nt, Human; identical to SEQ ID NO: 474845

SEQ ID NO: 475623 - RNA, 62 nt, Human; identical to SEQ ID NO: 474846

SEQ ID NO: 475624 - RNA, 62 nt, Human; identical to SEQ ID NO: 474847

SEQ ID NO: 475625 - RNA, 62 nt, Human; identical to SEQ ID NO: 470939

SEQ ID NO: 475626 - RNA, 62 nt, Human; identical to SEQ ID NO: 474862

SEQ ID NO: 475627 - RNA, 62 nt, Human; identical to SEQ ID NO: 474863

SEQ ID NO: 475628 - RNA, 62 nt, Human; identical to SEQ ID NO: 474864

SEQ ID NO: 475629 - RNA, 62 nt, Human; identical to SEQ ID NO: 474879

SEQ ID NO: 475630 - RNA, 62 nt, Human; identical to SEQ ID NO: 474880

SEQ ID NO: 475631 - RNA, 62 nt, Human; identical to SEQ ID NO: 474881

SEQ ID NO: 475632 - RNA, 62 nt, Human; identical to SEQ ID NO: 470956

SEQ ID NO: 475633 - RNA, 62 nt, Human; identical to SEQ ID NO: 474913

SEQ ID NO: 475634 - RNA, 62 nt, Human; identical to SEQ ID NO: 474914

SEQ ID NO: 475635 - RNA, 62 nt, Human; identical to SEQ ID NO: 474915

SEQ ID NO: 475636 - RNA, 62 nt, Human; identical to SEQ ID NO: 474930

SEQ ID NO: 475637 - RNA, 62 nt, Human; identical to SEQ ID NO: 474931

SEQ ID NO: 475638 - RNA, 62 nt, Human; identical to SEQ ID NO: 474932

SEQ ID NO: 475639 - RNA, 62 nt, Human; identical to SEQ ID NO: 470957

SEQ ID NO: 475640 - RNA, 62 nt, Human; identical to SEQ ID NO: 474947

SEQ ID NO: 475641 - RNA, 62 nt, Human; identical to SEQ ID NO: 474948

SEQ ID NO: 475642 - RNA, 62 nt, Human; identical to SEQ ID NO: 474949

SEQ ID NO: 475643 - RNA, 62 nt, Human; identical to SEQ ID NO: 474998

SEQ ID NO: 475644 - RNA, 62 nt, Human; identical to SEQ ID NO: 474999

SEQ ID NO: 475645 - RNA, 62 nt, Human; identical to SEQ ID NO: 475000

SEQ ID NO: 475646 - RNA, 62 nt, Human; identical to SEQ ID NO: 470958

SEQ ID NO: 475647 - RNA, 62 nt, Human; identical to SEQ ID NO: 475117

SEQ ID NO: 475648 - RNA, 62 nt, Human; identical to SEQ ID NO: 475118

SEQ ID NO: 475649 - RNA, 62 nt, Human; identical to SEQ ID NO: 475119

SEQ ID NO: 475650 - RNA, 62 nt, Human; identical to SEQ ID NO: 474538

SEQ ID NO: 475651 - RNA, 62 nt, Human; identical to SEQ ID NO: 474539

SEQ ID NO: 475652 - RNA, 62 nt, Human; identical to SEQ ID NO: 474540

SEQ ID NO: 475653 - RNA, 62 nt, Human; identical to SEQ ID NO: 472687

SEQ ID NO: 475654 - RNA, 62 nt, Human; identical to SEQ ID NO: 474541

SEQ ID NO: 475655 - RNA, 62 nt, Human; identical to SEQ ID NO: 474556

SEQ ID NO: 475656 - RNA, 62 nt, Human; identical to SEQ ID NO: 474557

SEQ ID NO: 475657 - RNA, 62 nt, Human; identical to SEQ ID NO: 474558

SEQ ID NO: 475658 - RNA, 62 nt, Human; identical to SEQ ID NO: 472718

SEQ ID NO: 475659 - RNA, 62 nt, Human; identical to SEQ ID NO: 474590

SEQ ID NO: 475660 - RNA, 62 nt, Human; identical to SEQ ID NO: 474591

SEQ ID NO: 475661 - RNA, 62 nt, Human; identical to SEQ ID NO: 474592

SEQ ID NO: 475662 - RNA, 62 nt, Human; identical to SEQ ID NO: 474607

SEQ ID NO: 475663 - RNA, 62 nt, Human; identical to SEQ ID NO: 474608

SEQ ID NO: 475664 - RNA, 62 nt, Human; identical to SEQ ID NO: 474609

SEQ ID NO: 475665 - RNA, 62 nt, Human; identical to SEQ ID NO: 472719

SEQ ID NO: 475666 - RNA, 62 nt, Human; identical to SEQ ID NO: 474624

SEQ ID NO: 475667 - RNA, 62 nt, Human; identical to SEQ ID NO: 474625

SEQ ID NO: 475668 - RNA, 62 nt, Human; identical to SEQ ID NO: 474626

SEQ ID NO: 475669 - RNA, 62 nt, Human; identical to SEQ ID NO: 474641

SEQ ID NO: 475670 - RNA, 62 nt, Human; identical to SEQ ID NO: 474642

SEQ ID NO: 475671 - RNA, 62 nt, Human; identical to SEQ ID NO: 474643

SEQ ID NO: 475672 - RNA, 62 nt, Human; identical to SEQ ID NO: 472720

SEQ ID NO: 475673 - RNA, 62 nt, Human; identical to SEQ ID NO: 474658

SEQ ID NO: 475674 - RNA, 62 nt, Human; identical to SEQ ID NO: 474659

SEQ ID NO: 475675 - RNA, 62 nt, Human; identical to SEQ ID NO: 474660

SEQ ID NO: 475676 - RNA, 62 nt, Human; identical to SEQ ID NO: 474675

SEQ ID NO: 475677 - RNA, 62 nt, Human; identical to SEQ ID NO: 474676

SEQ ID NO: 475678 - RNA, 62 nt, Human; identical to SEQ ID NO: 474677

SEQ ID NO: 475679 - RNA, 62 nt, Human; identical to SEQ ID NO: 472735

SEQ ID NO: 475680 - RNA, 62 nt, Human; identical to SEQ ID NO: 474709

SEQ ID NO: 475681 - RNA, 62 nt, Human; identical to SEQ ID NO: 474710

SEQ ID NO: 475682 - RNA, 62 nt, Human; identical to SEQ ID NO: 474711

SEQ ID NO: 475683 - RNA, 62 nt, Human; identical to SEQ ID NO: 474726

SEQ ID NO: 475684 - RNA, 62 nt, Human; identical to SEQ ID NO: 474727

SEQ ID NO: 475685 - RNA, 62 nt, Human; identical to SEQ ID NO: 474728

SEQ ID NO: 475686 - RNA, 62 nt, Human; identical to SEQ ID NO: 472736

SEQ ID NO: 475687 - RNA, 62 nt, Human; identical to SEQ ID NO: 474777

SEQ ID NO: 475688 - RNA, 62 nt, Human; identical to SEQ ID NO: 474778

SEQ ID NO: 475689 - RNA, 62 nt, Human; identical to SEQ ID NO: 474779

SEQ ID NO: 475690 - RNA, 62 nt, Human; identical to SEQ ID NO: 474896

SEQ ID NO: 475691 - RNA, 62 nt, Human; identical to SEQ ID NO: 474897

SEQ ID NO: 475692 - RNA, 62 nt, Human; identical to SEQ ID NO: 474898

SEQ ID NO: 475693 - RNA, 62 nt, Human; identical to SEQ ID NO: 472751

SEQ ID NO: 475694 - RNA, 62 nt, Human; identical to SEQ ID NO: 474318

SEQ ID NO: 475695 - RNA, 62 nt, Human; identical to SEQ ID NO: 474319

SEQ ID NO: 475696 - RNA, 62 nt, Human; identical to SEQ ID NO: 474320

SEQ ID NO: 475697 - RNA, 62 nt, Human; identical to SEQ ID NO: 474321

SEQ ID NO: 475698 - RNA, 62 nt, Human; identical to SEQ ID NO: 474337

SEQ ID NO: 475699 - RNA, 62 nt, Human; identical to SEQ ID NO: 474338

SEQ ID NO: 475700 - RNA, 62 nt, Human; identical to SEQ ID NO: 474339

SEQ ID NO: 475701 - RNA, 62 nt, Human; identical to SEQ ID NO: 472752

SEQ ID NO: 475702 - RNA, 62 nt, Human; identical to SEQ ID NO: 474355

SEQ ID NO: 475703 - RNA, 62 nt, Human; identical to SEQ ID NO: 474356

SEQ ID NO: 475704 - RNA, 62 nt, Human; identical to SEQ ID NO: 474357

SEQ ID NO: 475705 - RNA, 62 nt, Human; identical to SEQ ID NO: 474373

SEQ ID NO: 475706 - RNA, 62 nt, Human; identical to SEQ ID NO: 474374

SEQ ID NO: 475707 - RNA, 62 nt, Human; identical to SEQ ID NO: 474375

SEQ ID NO: 475708 - RNA, 62 nt, Human; identical to SEQ ID NO: 472767

SEQ ID NO: 475709 - RNA, 62 nt, Human; identical to SEQ ID NO: 474409

SEQ ID NO: 475710 - RNA, 62 nt, Human; identical to SEQ ID NO: 474410

SEQ ID NO: 475711 - RNA, 62 nt, Human; identical to SEQ ID NO: 474411

SEQ ID NO: 475712 - RNA, 62 nt, Human; identical to SEQ ID NO: 474427

SEQ ID NO: 475713 - RNA, 62 nt, Human; identical to SEQ ID NO: 474428

SEQ ID NO: 475714 - RNA, 62 nt, Human; identical to SEQ ID NO: 474429

SEQ ID NO: 475715 - RNA, 62 nt, Human; identical to SEQ ID NO: 472768

SEQ ID NO: 475716 - RNA, 62 nt, Human; identical to SEQ ID NO: 474445

SEQ ID NO: 475717 - RNA, 62 nt, Human; identical to SEQ ID NO: 474446

SEQ ID NO: 475718 - RNA, 62 nt, Human; identical to SEQ ID NO: 474447

SEQ ID NO: 475719 - RNA, 62 nt, Human; identical to SEQ ID NO: 474448

SEQ ID NO: 475720 - RNA, 62 nt, Human; identical to SEQ ID NO: 474464

SEQ ID NO: 475721 - RNA, 62 nt, Human; identical to SEQ ID NO: 474465

SEQ ID NO: 475722 - RNA, 62 nt, Human; identical to SEQ ID NO: 474466

SEQ ID NO: 475723 - RNA, 62 nt, Human; identical to SEQ ID NO: 472769

SEQ ID NO: 475724 - RNA, 62 nt, Human; identical to SEQ ID NO: 474482

SEQ ID NO: 475725 - RNA, 62 nt, Human; identical to SEQ ID NO: 474483

SEQ ID NO: 475726 - RNA, 62 nt, Human; identical to SEQ ID NO: 474484

SEQ ID NO: 475727 - RNA, 62 nt, Human; identical to SEQ ID NO: 474485

SEQ ID NO: 475728 - RNA, 62 nt, Human; identical to SEQ ID NO: 474501

SEQ ID NO: 475729 - RNA, 62 nt, Human; identical to SEQ ID NO: 474502

SEQ ID NO: 475730 - RNA, 62 nt, Human; identical to SEQ ID NO: 474503

SEQ ID NO: 475731 - RNA, 62 nt, Human; identical to SEQ ID NO: 472784

SEQ ID NO: 475732 - RNA, 62 nt, Human; identical to SEQ ID NO: 474520

SEQ ID NO: 475733 - RNA, 62 nt, Human; identical to SEQ ID NO: 474521

SEQ ID NO: 475734 - RNA, 62 nt, Human; identical to SEQ ID NO: 474522

SEQ ID NO: 475735 - RNA, 62 nt, Human; identical to SEQ ID NO: 474523

SEQ ID NO: 475736 - RNA, 62 nt, Human; identical to SEQ ID NO: 474282

SEQ ID NO: 475737 - RNA, 62 nt, Human; identical to SEQ ID NO: 474283

SEQ ID NO: 475738 - RNA, 62 nt, Human; identical to SEQ ID NO: 474284

SEQ ID NO: 475739 - RNA, 62 nt, Human; identical to SEQ ID NO: 472785

SEQ ID NO: 475740 - RNA, 62 nt, Human; identical to SEQ ID NO: 474692

SEQ ID NO: 475741 - RNA, 62 nt, Human; identical to SEQ ID NO: 474693

SEQ ID NO: 475742 - RNA, 62 nt, Human; identical to SEQ ID NO: 474694

SEQ ID NO: 475743 - RNA, 62 nt, Human; identical to SEQ ID NO: 474101

SEQ ID NO: 475744 - RNA, 62 nt, Human; identical to SEQ ID NO: 474102

SEQ ID NO: 475745 - RNA, 62 nt, Human; identical to SEQ ID NO: 474103

SEQ ID NO: 475746 - RNA, 62 nt, Human; identical to SEQ ID NO: 472800

SEQ ID NO: 475747 - RNA, 62 nt, Human; identical to SEQ ID NO: 474104

SEQ ID NO: 475748 - RNA, 62 nt, Human; identical to SEQ ID NO: 474119

SEQ ID NO: 475749 - RNA, 62 nt, Human; identical to SEQ ID NO: 474120

SEQ ID NO: 475750 - RNA, 62 nt, Human; identical to SEQ ID NO: 474121

SEQ ID NO: 475751 - RNA, 62 nt, Human; identical to SEQ ID NO: 472801

SEQ ID NO: 475752 - RNA, 62 nt, Human; identical to SEQ ID NO: 474122

SEQ ID NO: 475753 - RNA, 62 nt, Human; identical to SEQ ID NO: 474155

SEQ ID NO: 475754 - RNA, 62 nt, Human; identical to SEQ ID NO: 474156

SEQ ID NO: 475755 - RNA, 62 nt, Human; identical to SEQ ID NO: 474157

SEQ ID NO: 475756 - RNA, 62 nt, Human; identical to SEQ ID NO: 472802

SEQ ID NO: 475757 - RNA, 62 nt, Human; identical to SEQ ID NO: 474137

SEQ ID NO: 475758 - RNA, 62 nt, Human; identical to SEQ ID NO: 474138

SEQ ID NO: 475759 - RNA, 62 nt, Human; identical to SEQ ID NO: 474139

SEQ ID NO: 475760 - RNA, 62 nt, Human; identical to SEQ ID NO: 474140

SEQ ID NO: 475761 - RNA, 62 nt, Human; identical to SEQ ID NO: 474209

SEQ ID NO: 475762 - RNA, 62 nt, Human; identical to SEQ ID NO: 474210

SEQ ID NO: 475763 - RNA, 62 nt, Human; identical to SEQ ID NO: 474211

SEQ ID NO: 475764 - RNA, 62 nt, Human; identical to SEQ ID NO: 472804

SEQ ID NO: 475765 - RNA, 62 nt, Human; identical to SEQ ID NO: 474173

SEQ ID NO: 475766 - RNA, 62 nt, Human; identical to SEQ ID NO: 474174

SEQ ID NO: 475767 - RNA, 62 nt, Human; identical to SEQ ID NO: 474175

SEQ ID NO: 475768 - RNA, 62 nt, Human; identical to SEQ ID NO: 474176

SEQ ID NO: 475769 - RNA, 62 nt, Human; identical to SEQ ID NO: 474391

SEQ ID NO: 475770 - RNA, 62 nt, Human; identical to SEQ ID NO: 474392

SEQ ID NO: 475771 - RNA, 62 nt, Human; identical to SEQ ID NO: 474393

SEQ ID NO: 475772 - RNA, 62 nt, Human; identical to SEQ ID NO: 472805

SEQ ID NO: 475773 - RNA, 62 nt, Human; identical to SEQ ID NO: 474191

SEQ ID NO: 475774 - RNA, 62 nt, Human; identical to SEQ ID NO: 474192

SEQ ID NO: 475775 - RNA, 62 nt, Human; identical to SEQ ID NO: 474193

SEQ ID NO: 475776 - RNA, 62 nt, Human; identical to SEQ ID NO: 474194

SEQ ID NO: 475777 - RNA, 62 nt, Human; identical to SEQ ID NO: 474212

SEQ ID NO: 475778 - RNA, 62 nt, Human; identical to SEQ ID NO: 474263

SEQ ID NO: 475779 - RNA, 62 nt, Human; identical to SEQ ID NO: 472806

SEQ ID NO: 475780 - RNA, 62 nt, Human; identical to SEQ ID NO: 474227

SEQ ID NO: 475781 - RNA, 62 nt, Human; identical to SEQ ID NO: 474228

SEQ ID NO: 475782 - RNA, 62 nt, Human; identical to SEQ ID NO: 474191

SEQ ID NO: 475783 - RNA, 62 nt, Human; identical to SEQ ID NO: 474230

SEQ ID NO: 475784 - RNA, 62 nt, Human; identical to SEQ ID NO: 474245

SEQ ID NO: 475785 - RNA, 62 nt, Human; identical to SEQ ID NO: 474246

SEQ ID NO: 475786 - RNA, 62 nt, Human; identical to SEQ ID NO: 474247

SEQ ID NO: 475787 - RNA, 62 nt, Human; identical to SEQ ID NO: 472807

SEQ ID NO: 475788 - RNA, 62 nt, Human; identical to SEQ ID NO: 474248

SEQ ID NO: 475789 - RNA, 62 nt, Human; identical to SEQ ID NO: 474029

SEQ ID NO: 475790 - RNA, 62 nt, Human; identical to SEQ ID NO: 474030

SEQ ID NO: 475791 - RNA, 62 nt, Human; identical to SEQ ID NO: 474031

SEQ ID NO: 475792 - RNA, 62 nt, Human; identical to SEQ ID NO: 472808

SEQ ID NO: 475793 - RNA, 62 nt, Human; identical to SEQ ID NO: 474264

SEQ ID NO: 475794 - RNA, 62 nt, Human; identical to SEQ ID NO: 474265

SEQ ID NO: 475795 - RNA, 62 nt, Human; identical to SEQ ID NO: 474266

SEQ ID NO: 475796 - RNA, 62 nt, Human; identical to SEQ ID NO: 473957

SEQ ID NO: 475797 - RNA, 62 nt, Human; identical to SEQ ID NO: 473958

SEQ ID NO: 475798 - RNA, 62 nt, Human; identical to SEQ ID NO: 473959

SEQ ID NO: 475799 - RNA, 62 nt, Human; identical to SEQ ID NO: 472809

SEQ ID NO: 475800 - RNA, 62 nt, Human; identical to SEQ ID NO: 474300

SEQ ID NO: 475801 - RNA, 62 nt, Human; identical to SEQ ID NO: 474301

SEQ ID NO: 475802 - RNA, 62 nt, Human; identical to SEQ ID NO: 474302

SEQ ID NO: 475803 - RNA, 62 nt, Human; identical to SEQ ID NO: 473903

SEQ ID NO: 475804 - RNA, 52 nt, Human; identical to SEQ ID NO: 473904

SEQ ID NO: 475805 - RNA, 52 nt, Human; identical to SEQ ID NO: 473905

SEQ ID NO: 475806 - RNA, 62 nt, Human; identical to SEQ ID NO: 472810

SEQ ID NO: 475807 - RNA, 62 nt, Human; identical to SEQ ID NO: 474504

SEQ ID NO: 475808 - RNA, 62 nt, Human; identical to SEQ ID NO: 474573

SEQ ID NO: 475809 - RNA, 62 nt, Human; identical to SEQ ID NO: 474574

SEQ ID NO: 475810 - RNA, 62 nt, Human; identical to SEQ ID NO: 474575

SEQ ID NO: 475811 - RNA, 62 nt, Human; identical to SEQ ID NO: 472811

SEQ ID NO: 475812 - RNA, 62 nt, Human; identical to SEQ ID NO: 473849

SEQ ID NO: 475813 - RNA, 62 nt, Human; identical to SEQ ID NO: 473850

SEQ ID NO: 475814 - RNA, 62 nt, Human; identical to SEQ ID NO: 473851

SEQ ID NO: 475815 - RNA, 62 nt, Human; identical to SEQ ID NO: 473852

SEQ ID NO: 475816 - RNA, 62 nt, Human; identical to SEQ ID NO: 473867

SEQ ID NO: 475817 - RNA, 62 nt, Human; identical to SEQ ID NO: 473868

SEQ ID NO: 475818 - RNA, 62 nt, Human; identical to SEQ ID NO: 473869

SEQ ID NO: 475819 - RNA, 62 nt, Human; identical to SEQ ID NO: 472812

SEQ ID NO: 475820 - RNA, 62 nt, Human; identical to SEQ ID NO: 473870

SEQ ID NO: 475821 - RNA, 62 nt, Human; identical to SEQ ID NO: 473885

SEQ ID NO: 475822 - RNA, 62 nt, Human; identical to SEQ ID NO: 473886

SEQ ID NO: 475823 - RNA, 62 nt, Human; identical to SEQ ID NO: 473887

SEQ ID NO: 475824 - RNA, 62 nt, Human; identical to SEQ ID NO: 472813

SEQ ID NO: 475825 - RNA, 62 nt, Human; identical to SEQ ID NO: 473888

SEQ ID NO: 475826 - RNA, 62 nt, Human; identical to SEQ ID NO: 473921

SEQ ID NO: 475827 - RNA, 62 nt, Human; identical to SEQ ID NO: 473922

SEQ ID NO: 475828 - RNA, 61 nt, Human; identical to SEQ ID NO: 473923

SEQ ID NO: 475829 - RNA, 55 nt, Human; identical to SEQ ID NO: 472814

SEQ ID NO: 475830 - RNA, 62 nt, Human; identical to SEQ ID NO: 473906

SEQ ID NO: 475831 - RNA, 62 nt, Human; identical to SEQ ID NO: 473975

SEQ ID NO: 475832 - RNA, 62 nt, Human; identical to SEQ ID NO: 473976

SEQ ID NO: 475833 - RNA, 62 nt, Human; identical to SEQ ID NO: 473977

SEQ ID NO: 475834 - RNA, 62 nt, Human; identical to SEQ ID NO: 472815

SEQ ID NO: 475835 - RNA, 62 nt, Human; identical to SEQ ID NO: 473924

SEQ ID NO: 475836 - RNA, 62 nt, Human; identical to SEQ ID NO: 474047

SEQ ID NO: 475837 - RNA, 62 nt, Human; identical to SEQ ID NO: 474048

SEQ ID NO: 475838 - RNA, 62 nt, Human; identical to SEQ ID NO: 474049

SEQ ID NO: 475839 - RNA, 62 nt, Human; identical to SEQ ID NO: 472816

SEQ ID NO: 475840 - RNA, 62 nt, Human; identical to SEQ ID NO: 473939

SEQ ID NO: 475841 - RNA, 62 nt, Human; identical to SEQ ID NO: 473940

SEQ ID NO: 475842 - RNA, 62 nt, Human; identical to SEQ ID NO: 473941

SEQ ID NO: 475843 - RNA, 62 nt, Human; identical to SEQ ID NO: 473942

SEQ ID NO: 475844 - RNA, 62 nt, Human; identical to SEQ ID NO: 473777

SEQ ID NO: 475845 - RNA, 62 nt, Human; identical to SEQ ID NO: 473778

SEQ ID NO: 475846 - RNA, 57 nt, Human; identical to SEQ ID NO: 473779

SEQ ID NO: 475847 - RNA, 62 nt, Human; identical to SEQ ID NO: 472817

SEQ ID NO: 475848 - RNA, 62 nt, Human; identical to SEQ ID NO: 473960

SEQ ID NO: 475849 - RNA, 62 nt, Human; identical to SEQ ID NO: 473993

SEQ ID NO: 475850 - RNA, 62 nt, Human; identical to SEQ ID NO: 473994

SEQ ID NO: 475851 - RNA, 62 nt, Human; identical to SEQ ID NO: 473995

SEQ ID NO: 475852 - RNA, 62 nt, Human; identical to SEQ ID NO: 472818

SEQ ID NO: 475853 - RNA, 62 nt, Human; identical to SEQ ID NO: 473978

SEQ ID NO: 475854 - RNA, 62 nt, Human; identical to SEQ ID NO: 473723

SEQ ID NO: 475855 - RNA, 62 nt, Human; identical to SEQ ID NO: 473724

SEQ ID NO: 475856 - RNA, 62 nt, Human; identical to SEQ ID NO: 473725

SEQ ID NO: 475857 - RNA, 62 nt, Human; identical to SEQ ID NO: 472819

SEQ ID NO: 475858 - RNA, 62 nt, Human; identical to SEQ ID NO: 473996

SEQ ID NO: 475859 - RNA, 62 nt, Human; identical to SEQ ID NO: 474011

SEQ ID NO: 475860 - RNA, 62 nt, Human; identical to SEQ ID NO: 474012

SEQ ID NO: 475861 - RNA, 62 nt, Human; identical to SEQ ID NO: 474013

SEQ ID NO: 475862 - RNA, 62 nt, Human; identical to SEQ ID NO: 472820

SEQ ID NO: 475863 - RNA, 51 nt, Human; identical to SEQ ID NO: 474014

SEQ ID NO: 475864 - RNA, 62 nt, Human; identical to SEQ ID NO: 473741

SEQ ID NO: 475865 - RNA, 62 nt, Human; identical to SEQ ID NO: 473742

SEQ ID NO: 475866 - RNA, 62 nt, Human; identical to SEQ ID NO: 473743

SEQ ID NO: 475867 - RNA, 62 nt, Human; identical to SEQ ID NO: 472821

SEQ ID NO: 475868 - RNA, 62 nt, Human; identical to SEQ ID NO: 474158

SEQ ID NO: 475869 - RNA, 62 nt, Human; identical to SEQ ID NO: 473707

SEQ ID NO: 475870 - RNA, 62 nt, Human; identical to SEQ ID NO: 473708

SEQ ID NO: 475871 - RNA, 62 nt, Human; identical to SEQ ID NO: 473709

SEQ ID NO: 475872 - RNA, 62 nt, Human; identical to SEQ ID NO: 472822

SEQ ID NO: 475873 - RNA, 62 nt, Human; identical to SEQ ID NO: 473617

SEQ ID NO: 475874 - RNA, 62 nt, Human; identical to SEQ ID NO: 473618

SEQ ID NO: 475875 - RNA, 62 nt, Human; identical to SEQ ID NO: 473619

SEQ ID NO: 475876 - RNA, 62 nt, Human; identical to SEQ ID NO: 473635

SEQ ID NO: 475877 - RNA, 62 nt, Human; identical to SEQ ID NO: 473636

SEQ ID NO: 475878 - RNA, 62 nt, Human; identical to SEQ ID NO: 473637

SEQ ID NO: 475879 - RNA, 62 nt, Human; identical to SEQ ID NO: 472823

SEQ ID NO: 475880 - RNA, 62 nt, Human; identical to SEQ ID NO: 473653

SEQ ID NO: 475881 - RNA, 62 nt, Human; identical to SEQ ID NO: 473654

SEQ ID NO: 475882 - RNA, 62 nt, Human; identical to SEQ ID NO: 473655

SEQ ID NO: 475883 - RNA, 62 nt, Human; identical to SEQ ID NO: 473671

SEQ ID NO: 475884 - RNA, 62 nt, Human; identical to SEQ ID NO: 473672

SEQ ID NO: 475885 - RNA, 62 nt, Human; identical to SEQ ID NO: 473673

SEQ ID NO: 475886 - RNA, 62 nt, Human; identical to SEQ ID NO: 472838

SEQ ID NO: 475887 - RNA, 62 nt, Human; identical to SEQ ID NO: 473726

SEQ ID NO: 475888 - RNA, 62 nt, Human; identical to SEQ ID NO: 473744

SEQ ID NO: 475889 - RNA, 62 nt, Human; identical to SEQ ID NO: 473759

SEQ ID NO: 475890 - RNA, 62 nt, Human; identical to SEQ ID NO: 472839

SEQ ID NO: 475891 - RNA, 62 nt, Human; identical to SEQ ID NO: 473760

SEQ ID NO: 475892 - RNA, 62 nt, Human; identical to SEQ ID NO: 473761

SEQ ID NO: 475893 - RNA, 62 nt, Human; identical to SEQ ID NO: 473762

SEQ ID NO: 475894 - RNA, 62 nt, Human; identical to SEQ ID NO: 473780

SEQ ID NO: 475895 - RNA, 62 nt, Human; identical to SEQ ID NO: 474065

SEQ ID NO: 475896 - RNA, 62 nt, Human; identical to SEQ ID NO: 472854

SEQ ID NO: 475897 - RNA, 62 nt, Human; identical to SEQ ID NO: 473813

SEQ ID NO: 475898 - RNA, 62 nt, Human; identical to SEQ ID NO: 473814

SEQ ID NO: 475899 - RNA, 62 nt, Human; identical to SEQ ID NO: 473815

SEQ ID NO: 475900 - RNA, 62 nt, Human; identical to SEQ ID NO: 473816

SEQ ID NO: 475901 - RNA, 62 nt, Human; identical to SEQ ID NO: 473831

SEQ ID NO: 475902 - RNA, 62 nt, Human; identical to SEQ ID NO: 473832

SEQ ID NO: 475903 - RNA, 62 nt, Human; identical to SEQ ID NO: 473833

SEQ ID NO: 475904 - RNA, 53 nt, Human; identical to SEQ ID NO: 472855

SEQ ID NO: 475905 - RNA, 62 nt, Human; identical to SEQ ID NO: 473834

SEQ ID NO: 475906 - RNA, 62 nt, Human; identical to SEQ ID NO: 473563

SEQ ID NO: 475907 - RNA, 62 nt, Human; identical to SEQ ID NO: 473564

SEQ ID NO: 475908 - RNA, 62 nt, Human; identical to SEQ ID NO: 473565

SEQ ID NO: 475909 - RNA, 62 nt, Human; identical to SEQ ID NO: 472856

SEQ ID NO: 475910 - RNA, 62 nt, Human; identical to SEQ ID NO: 474050

SEQ ID NO: 475911 - RNA, 62 nt, Human; identical to SEQ ID NO: 474066

SEQ ID NO: 475912 - RNA, 62 nt, Human; identical to SEQ ID NO: 474067

SEQ ID NO: 475913 - RNA, 62 nt, Human; identical to SEQ ID NO: 474068

SEQ ID NO: 475914 - RNA, 62 nt, Human; identical to SEQ ID NO: 472871

SEQ ID NO: 475915 - RNA, 62 nt, Human; identical to SEQ ID NO: 473394

SEQ ID NO: 475916 - RNA, 62 nt, Human; identical to SEQ ID NO: 473395

SEQ ID NO: 475917 - RNA, 62 nt, Human; identical to SEQ ID NO: 473396

SEQ ID NO: 475918 - RNA, 62 nt, Human; identical to SEQ ID NO: 473411

SEQ ID NO: 475919 - RNA, 62 nt, Human; identical to SEQ ID NO: 473412

SEQ ID NO: 475920 - RNA, 62 nt, Human; identical to SEQ ID NO: 473413

SEQ ID NO: 475921 - RNA, 62 nt, Human; identical to SEQ ID NO: 472872

SEQ ID NO: 475922 - RNA, 62 nt, Human; identical to SEQ ID NO: 473428

SEQ ID NO: 475923 - RNA, 62 nt, Human; identical to SEQ ID NO: 473429

SEQ ID NO: 475924 - RNA, 62 nt, Human; identical to SEQ ID NO: 473430

SEQ ID NO: 475925 - RNA, 62 nt, Human; identical to SEQ ID NO: 473445

SEQ ID NO: 475926 - RNA, 62 nt, Human; identical to SEQ ID NO: 473446

SEQ ID NO: 475927 - RNA, 62 nt, Human; identical to SEQ ID NO: 473447

SEQ ID NO: 475928 - RNA, 62 nt, Human; identical to SEQ ID NO: 472873

SEQ ID NO: 475929 - RNA, 62 nt, Human; identical to SEQ ID NO: 473461

SEQ ID NO: 475930 - RNA, 62 nt, Human; identical to SEQ ID NO: 473462

SEQ ID NO: 475931 - RNA, 62 nt, Human; identical to SEQ ID NO: 473463

SEQ ID NO: 475932 - RNA, 62 nt, Human; identical to SEQ ID NO: 473473

SEQ ID NO: 475933 - RNA, 62 nt, Human; identical to SEQ ID NO: 473474

SEQ ID NO: 475934 - RNA, 62 nt, Human; identical to SEQ ID NO: 473475

SEQ ID NO: 475935 - RNA, 62 nt, Human; identical to SEQ ID NO: 472888

SEQ ID NO: 475936 - RNA, 62 nt, Human; identical to SEQ ID NO: 473509

SEQ ID NO: 475937 - RNA, 62 nt, Human; identical to SEQ ID NO: 473510

SEQ ID NO: 475938 - RNA, 62 nt, Human; identical to SEQ ID NO: 473511

SEQ ID NO: 475939 - RNA, 62 nt, Human; identical to SEQ ID NO: 473527

SEQ ID NO: 475940 - RNA, 62 nt, Human; identical to SEQ ID NO: 473528

SEQ ID NO: 475941 - RNA, 56 nt, Human; identical to SEQ ID NO: 473529

SEQ ID NO: 475942 - RNA, 62 nt, Human; identical to SEQ ID NO: 472889

SEQ ID NO: 475943 - RNA, 62 nt, Human; identical to SEQ ID NO: 473545

SEQ ID NO: 475944 - RNA, 62 nt, Human; identical to SEQ ID NO: 473546

SEQ ID NO: 475945 - RNA, 62 nt, Human; identical to SEQ ID NO: 473547

SEQ ID NO: 475946 - RNA, 62 nt, Human; identical to SEQ ID NO: 473581

SEQ ID NO: 475947 - RNA, 62 nt, Human; identical to SEQ ID NO: 473582

SEQ ID NO: 475948 - RNA, 62 nt, Human; identical to SEQ ID NO: 473583

SEQ ID NO: 475949 - RNA, 62 nt, Human; identical to SEQ ID NO: 472890

SEQ ID NO: 475950 - RNA, 62 nt, Human; identical to SEQ ID NO: 473599

SEQ ID NO: 475951 - RNA, 62 nt, Human; identical to SEQ ID NO: 473600

SEQ ID NO: 475952 - RNA, 62 nt, Human; identical to SEQ ID NO: 473601

SEQ ID NO: 475953 - RNA, 62 nt, Human; identical to SEQ ID NO: 473689

SEQ ID NO: 475954 - RNA, 62 nt, Human; identical to SEQ ID NO: 473690

SEQ ID NO: 475955 - RNA, 62 nt, Human; identical to SEQ ID NO: 473691

SEQ ID NO: 475956 - RNA, 62 nt, Human; identical to SEQ ID NO: 472905

SEQ ID NO: 475957 - RNA, 62 nt, Human; identical to SEQ ID NO: 474032

SEQ ID NO: 475958 - RNA, 62 nt, Human; identical to SEQ ID NO: 474083

SEQ ID NO: 475959 - RNA, 62 nt, Human; identical to SEQ ID NO: 474084

SEQ ID NO: 475960 - RNA, 62 nt, Human; identical to SEQ ID NO: 472702

SEQ ID NO: 475961 - RNA, 62 nt, Human; identical to SEQ ID NO: 472703

SEQ ID NO: 475962 - RNA, 62 nt, Human; identical to SEQ ID NO: 470825

SEQ ID NO: 475963 - RNA, 62 nt, Human; identical to SEQ ID NO: 473795

SEQ ID NO: 475964 - RNA, 62 nt, Human; identical to SEQ ID NO: 473796

SEQ ID NO: 475965 - RNA, 62 nt, Human; identical to SEQ ID NO: 473797

SEQ ID NO: 475966 - RNA, 62 nt, Human; identical to SEQ ID NO: 472921

SEQ ID NO: 475967 - RNA, 62 nt, Human; identical to SEQ ID NO: 473173

SEQ ID NO: 475968 - RNA, 62 nt, Human; identical to SEQ ID NO: 473174

SEQ ID NO: 475969 - RNA, 62 nt, Human; identical to SEQ ID NO: 470826

SEQ ID NO: 475970 - RNA, 62 nt, Human; identical to SEQ ID NO: 473156

SEQ ID NO: 475971 - RNA, 62 nt, Human; identical to SEQ ID NO: 473157

SEQ ID NO: 475972 - RNA, 62 nt, Human; identical to SEQ ID NO: 473158

SEQ ID NO: 475973 - RNA, 62 nt, Human; identical to SEQ ID NO: 472922

SEQ ID NO: 475974 - RNA, 62 nt, Human; identical to SEQ ID NO: 473207

SEQ ID NO: 475975 - RNA, 62 nt, Human; identical to SEQ ID NO: 473208

SEQ ID NO: 475976 - RNA, 62 nt, Human; identical to SEQ ID NO: 470827

SEQ ID NO: 475977 - RNA, 62 nt, Human; identical to SEQ ID NO: 473224

SEQ ID NO: 475978 - RNA, 62 nt, Human; identical to SEQ ID NO: 473225

SEQ ID NO: 475979 - RNA, 62 nt, Human; identical to SEQ ID NO: 473226

SEQ ID NO: 475980 - RNA, 62 nt, Human; identical to SEQ ID NO: 472937

SEQ ID NO: 475981 - RNA, 62 nt, Human; identical to SEQ ID NO: 473258

SEQ ID NO: 475982 - RNA, 62 nt, Human; identical to SEQ ID NO: 473259

SEQ ID NO: 475983 - RNA, 62 nt, Human; identical to SEQ ID NO: 470844

SEQ ID NO: 475984 - RNA, 62 nt, Human; identical to SEQ ID NO: 473275

SEQ ID NO: 475985 - RNA, 62 nt, Human; identical to SEQ ID NO: 473276

SEQ ID NO: 475986 - RNA, 62 nt, Human; identical to SEQ ID NO: 473277

SEQ ID NO: 475987 - RNA, 62 nt, Human; identical to SEQ ID NO: 472938

SEQ ID NO: 475988 - RNA, 62 nt, Human; identical to SEQ ID NO: 473292

SEQ ID NO: 475989 - RNA, 62 nt, Human; identical to SEQ ID NO: 473293

SEQ ID NO: 475990 - RNA, 62 nt, Human; identical to SEQ ID NO: 470845

SEQ ID NO: 475991 - RNA, 62 nt, Human; identical to SEQ ID NO: 473309

SEQ ID NO: 475992 - RNA, 62 nt, Human; identical to SEQ ID NO: 473310

SEQ ID NO: 475993 - RNA, 62 nt, Human; identical to SEQ ID NO: 473311

SEQ ID NO: 475994 - RNA, 62 nt, Human; identical to SEQ ID NO: 472953

SEQ ID NO: 475995 - RNA, 62 nt, Human; identical to SEQ ID NO: 473343

SEQ ID NO: 475996 - RNA, 62 nt, Human; identical to SEQ ID NO: 473344

SEQ ID NO: 475997 - RNA, 62 nt, Human; identical to SEQ ID NO: 470846

SEQ ID NO: 475998 - RNA, 62 nt, Human; identical to SEQ ID NO: 473360

SEQ ID NO: 475999 - RNA, 62 nt, Human; identical to SEQ ID NO: 473361

SEQ ID NO: 476000 - RNA, 62 nt, Human; identical to SEQ ID NO: 473362

SEQ ID NO: 476001 - RNA, 62 nt, Human; identical to SEQ ID NO: 472954

SEQ ID NO: 476002 - RNA, 62 nt, Human; identical to SEQ ID NO: 470863

SEQ ID NO: 476003 - RNA, 62 nt, Human; identical to SEQ ID NO: 473378

SEQ ID NO: 476004 - RNA, 62 nt, Human; identical to SEQ ID NO: 473379

SEQ ID NO: 476005 - RNA, 62 nt, Human; identical to SEQ ID NO: 473491

SEQ ID NO: 476006 - RNA, 62 nt, Human; identical to SEQ ID NO: 473492

SEQ ID NO: 476007 - RNA, 62 nt, Human; identical to SEQ ID NO: 473493

SEQ ID NO: 476008 - RNA, 62 nt, Human; identical to SEQ ID NO: 472955

SEQ ID NO: 476009 - RNA, 62 nt, Human; identical to SEQ ID NO: 473798

SEQ ID NO: 476010 - RNA, 62 nt, Human; identical to SEQ ID NO: 470864

SEQ ID NO: 476011 - RNA, 62 nt, Human; identical to SEQ ID NO: 472971

SEQ ID NO: 476012 - RNA, 62 nt, Human; identical to SEQ ID NO: 472986

SEQ ID NO: 476013 - RNA, 62 nt, Human; identical to SEQ ID NO: 473098

SEQ ID NO: 476014 - RNA, 62 nt, Human; identical to SEQ ID NO: 473099

SEQ ID NO: 476015 - RNA, 62 nt, Human; identical to SEQ ID NO: 473125

SEQ ID NO: 476016 - RNA, 62 nt, Human; identical to SEQ ID NO: 473126

SEQ ID NO: 476017 - RNA, 62 nt, Human; identical to SEQ ID NO: 470865

SEQ ID NO: 476018 - RNA, 62 nt, Human; identical to SEQ ID NO: 473139

SEQ ID NO: 476019 - RNA, 62 nt, Human; identical to SEQ ID NO: 473140

SEQ ID NO: 476020 - RNA, 62 nt, Human; identical to SEQ ID NO: 473141

SEQ ID NO: 476021 - RNA, 62 nt, Human; identical to SEQ ID NO: 473190

SEQ ID NO: 476022 - RNA, 62 nt, Human; identical to SEQ ID NO: 473191

SEQ ID NO: 476023 - RNA, 62 nt, Human; identical to SEQ ID NO: 473192

SEQ ID NO: 476024 - RNA, 62 nt, Human; identical to SEQ ID NO: 470880

SEQ ID NO: 476025 - RNA, 62 nt, Human; identical to SEQ ID NO: 473242

SEQ ID NO: 476026 - RNA, 62 nt, Human; identical to SEQ ID NO: 473243

SEQ ID NO: 476027 - RNA, 62 nt, Human; identical to SEQ ID NO: 473326

SEQ ID NO: 476028 - RNA, 52 nt, Human; identical to SEQ ID NO: 473327

SEQ ID NO: 476029 - RNA, 62 nt, Human; identical to SEQ ID NO: 473328

SEQ ID NO: 476030 - RNA, 62 nt, Human; identical to SEQ ID NO: 475536

SEQ ID NO: 476031 - RNA, 62 nt, Human; identical to SEQ ID NO: 470881

SEQ ID NO: 476032 - RNA, 62 nt, Human; identical to SEQ ID NO: 475537

SEQ ID NO: 476033 - RNA, 62 nt, Human; identical to SEQ ID NO: 475436

SEQ ID NO: 476034 - RNA, 62 nt, Human; identical to SEQ ID NO: 475437

SEQ ID NO: 476035 - RNA, 62 nt, Human; identical to SEQ ID NO: 475438

SEQ ID NO: 476036 - RNA, 62 nt, Human; identical to SEQ ID NO: 470882

SEQ ID NO: 476037 - RNA, 62 nt, Human; identical to SEQ ID NO: 474964

SEQ ID NO: 476038 - RNA, 62 nt, Human; identical to SEQ ID NO: 474965

SEQ ID NO: 476039 - RNA, 62 nt, Human; identical to SEQ ID NO: 474966

SEQ ID NO: 476040 - RNA, 62 nt, Human; identical to SEQ ID NO: 474981

SEQ ID NO: 476041 - RNA, 62 nt, Human; identical to SEQ ID NO: 474982

SEQ ID NO: 476042 - RNA, 62 nt, Human; identical to SEQ ID NO: 474983

SEQ ID NO: 476043 - RNA, 62 nt, Human; identical to SEQ ID NO: 470899

SEQ ID NO: 476044 - RNA, 62 nt, Human; identical to SEQ ID NO: 475015

SEQ ID NO: 476045 - RNA, 62 nt, Human; identical to SEQ ID NO: 475016

SEQ ID NO: 476046 - RNA, 62 nt, Human; identical to SEQ ID NO: 475017

SEQ ID NO: 476047 - RNA, 62 nt, Human; identical to SEQ ID NO: 475032

SEQ ID NO: 476048 - RNA, 62 nt, Human; identical to SEQ ID NO: 475033

SEQ ID NO: 476049 - RNA, 62 nt, Human; identical to SEQ ID NO: 475034

SEQ ID NO: 476050 - RNA, 60 nt, Human; identical to SEQ ID NO: 470900

SEQ ID NO: 476051 - RNA, 62 nt, Human; identical to SEQ ID NO: 475049

SEQ ID NO: 476052 - RNA, 56 nt, Human; identical to SEQ ID NO: 475050

SEQ ID NO: 476053 - RNA, 62 nt, Human; identical to SEQ ID NO: 475051

SEQ ID NO: 476054 - RNA, 62 nt, Human; identical to SEQ ID NO: 475066

SEQ ID NO: 476055 - RNA, 62 nt, Human; identical to SEQ ID NO: 475067

SEQ ID NO: 476056 - RNA, 62 nt, Human; identical to SEQ ID NO: 475068

SEQ ID NO: 476057 - RNA, 62 nt, Human; identical to SEQ ID NO: 470901

SEQ ID NO: 476058 - RNA, 62 nt, Human; identical to SEQ ID NO: 475083

SEQ ID NO: 476059 - RNA, 62 nt, Human; identical to SEQ ID NO: 475084

SEQ ID NO: 476060 - RNA, 62 nt, Human; identical to SEQ ID NO: 475085

SEQ ID NO: 476061 - RNA, 62 nt, Human; identical to SEQ ID NO: 475100

SEQ ID NO: 476062 - RNA, 62 nt, Human; identical to SEQ ID NO: 475101

SEQ ID NO: 476063 - RNA, 62 nt, Human; identical to SEQ ID NO: 475102

SEQ ID NO: 476064 - RNA, 62 nt, Human; identical to SEQ ID NO: 470918

SEQ ID NO: 476065 - RNA, 62 nt, Human; identical to SEQ ID NO: 475134

SEQ ID NO: 476066 - RNA, 62 nt, Human; identical to SEQ ID NO: 475135

SEQ ID NO: 476067 - RNA, 62 nt, Human; identical to SEQ ID NO: 475136

SEQ ID NO: 476068 - RNA, 62 nt, Human; identical to SEQ ID NO: 475151

SEQ ID NO: 476069 - RNA, 57 nt, Human; identical to SEQ ID NO: 475152

SEQ ID NO: 476070 - RNA, 62 nt, Human; identical to SEQ ID NO: 475153

SEQ ID NO: 476071 - RNA, 62 nt, Human; identical to SEQ ID NO: 470919

SEQ ID NO: 476072 - RNA, 62 nt, Human; identical to SEQ ID NO: 475168

SEQ ID NO: 476073 - RNA, 62 nt, Human; identical to SEQ ID NO: 475169

SEQ ID NO: 476074 - RNA, 62 nt, Human; identical to SEQ ID NO: 475170

SEQ ID NO: 476075 - RNA, 62 nt, Human; identical to SEQ ID NO: 475251

SEQ ID NO: 476076 - RNA, 62 nt, Human; identical to SEQ ID NO: 475252

SEQ ID NO: 476077 - RNA, 62 nt, Human; identical to SEQ ID NO: 475253

SEQ ID NO: 476078 - RNA, 62 nt, Human; identical to SEQ ID NO: 470920

SEQ ID NO: 476079 - RNA, 62 nt, Human; identical to SEQ ID NO: 474743

SEQ ID NO: 476080 - RNA, 62 nt, Human; identical to SEQ ID NO: 474744

SEQ ID NO: 476081 - RNA, 62 nt, Human; identical to SEQ ID NO: 474745

SEQ ID NO: 476082 - RNA, 62 nt, Human; identical to SEQ ID NO: 474760

SEQ ID NO: 476083 - RNA, 62 nt, Human; identical to SEQ ID NO: 474761

SEQ ID NO: 476084 - RNA, 62 nt, Human; identical to SEQ ID NO: 474762

SEQ ID NO: 476085 - RNA, 62 nt, Human; identical to SEQ ID NO: 470937

SEQ ID NO: 476086 - RNA, 62 nt, Human; identical to SEQ ID NO: 474794

SEQ ID NO: 476087 - RNA, 62 nt, Human; identical to SEQ ID NO: 474795

SEQ ID NO: 476088 - RNA, 62 nt, Human; identical to SEQ ID NO: 474796

SEQ ID NO: 476089 - RNA, 62 nt, Human; identical to SEQ ID NO: 474811

SEQ ID NO: 476090 - RNA, 62 nt, Human; identical to SEQ ID NO: 474812

SEQ ID NO: 476091 - RNA, 62 nt, Human; identical to SEQ ID NO: 474813

SEQ ID NO: 476092 - RNA, 62 nt, Human; identical to SEQ ID NO: 470938

SEQ ID NO: 476093 - RNA, 62 nt, Human; identical to SEQ ID NO: 474828

SEQ ID NO: 476094 - RNA, 62 nt, Human; identical to SEQ ID NO: 474829

SEQ ID NO: 476095 - RNA, 62 nt, Human; identical to SEQ ID NO: 474830

SEQ ID NO: 476096 - RNA, 62 nt, Human; identical to SEQ ID NO: 474845

SEQ ID NO: 476097 - RNA, 62 nt, Human; identical to SEQ ID NO: 474846

SEQ ID NO: 476098 - RNA, 62 nt, Human; identical to SEQ ID NO: 474847

SEQ ID NO: 476099 - RNA, 62 nt, Human; identical to SEQ ID NO: 470939

SEQ ID NO: 476100 - RNA, 62 nt, Human; identical to SEQ ID NO: 474862

SEQ ID NO: 476101 - RNA, 62 nt, Human; identical to SEQ ID NO: 474863

SEQ ID NO: 476102 - RNA, 62 nt, Human; identical to SEQ ID NO: 474864

SEQ ID NO: 476103 - RNA, 62 nt, Human; identical to SEQ ID NO: 474879

SEQ ID NO: 476104 - RNA, 62 nt, Human; identical to SEQ ID NO: 474880

SEQ ID NO: 476105 - RNA, 62 nt, Human; identical to SEQ ID NO: 474881

SEQ ID NO: 476106 - RNA, 62 nt, Human; identical to SEQ ID NO: 470956

SEQ ID NO: 476107 - RNA, 62 nt, Human; identical to SEQ ID NO: 474913

SEQ ID NO: 476108 - RNA, 62 nt, Human; identical to SEQ ID NO: 474914

SEQ ID NO: 476109 - RNA, 62 nt, Human; identical to SEQ ID NO: 474915

SEQ ID NO: 476110 - RNA, 62 nt, Human; identical to SEQ ID NO: 474930

SEQ ID NO: 476111 - RNA, 62 nt, Human; identical to SEQ ID NO: 474931

SEQ ID NO: 476112 - RNA, 62 nt, Human; identical to SEQ ID NO: 474932

SEQ ID NO: 476113 - RNA, 62 nt, Human; identical to SEQ ID NO: 470957

SEQ ID NO: 476114 - RNA, 62 nt, Human; identical to SEQ ID NO: 474947

SEQ ID NO: 476115 - RNA, 62 nt, Human; identical to SEQ ID NO: 474948

SEQ ID NO: 476116 - RNA, 62 nt, Human; identical to SEQ ID NO: 474949

SEQ ID NO: 476117 - RNA, 62 nt, Human; identical to SEQ ID NO: 474998

SEQ ID NO: 476118 - RNA, 62 nt, Human; identical to SEQ ID NO: 474999

SEQ ID NO: 476119 - RNA, 62 nt, Human; identical to SEQ ID NO: 475000

SEQ ID NO: 476120 - RNA, 62 nt, Human; identical to SEQ ID NO: 470958

SEQ ID NO: 476121 - RNA, 62 nt, Human; identical to SEQ ID NO: 475117

SEQ ID NO: 476122 - RNA, 62 nt, Human; identical to SEQ ID NO: 475118

SEQ ID NO: 476123 - RNA, 62 nt, Human; identical to SEQ ID NO: 475119

SEQ ID NO: 476124 - RNA, 62 nt, Human; identical to SEQ ID NO: 474538

SEQ ID NO: 476125 - RNA, 62 nt, Human; identical to SEQ ID NO: 474539

SEQ ID NO: 476126 - RNA, 62 nt, Human; identical to SEQ ID NO: 474540

SEQ ID NO: 476127 - RNA, 62 nt, Human; identical to SEQ ID NO: 472687

SEQ ID NO: 476128 - RNA, 62 nt, Human; identical to SEQ ID NO: 474541

SEQ ID NO: 476129 - RNA, 62 nt, Human; identical to SEQ ID NO: 474556

SEQ ID NO: 476130 - RNA, 62 nt, Human; identical to SEQ ID NO: 474557

SEQ ID NO: 476131 - RNA, 62 nt, Human; identical to SEQ ID NO: 474558

SEQ ID NO: 476132 - RNA, 62 nt, Human; identical to SEQ ID NO: 472718

SEQ ID NO: 476133 - RNA, 62 nt, Human; identical to SEQ ID NO: 474590

SEQ ID NO: 476134 - RNA, 62 nt, Human; identical to SEQ ID NO: 474591

SEQ ID NO: 476135 - RNA, 62 nt, Human; identical to SEQ ID NO: 474592

SEQ ID NO: 476136 - RNA, 62 nt, Human; identical to SEQ ID NO: 474607

SEQ ID NO: 476137 - RNA, 62 nt, Human; identical to SEQ ID NO: 474608

SEQ ID NO: 476138 - RNA, 62 nt, Human; identical to SEQ ID NO: 474609

SEQ ID NO: 476139 - RNA, 62 nt, Human; identical to SEQ ID NO: 472719

SEQ ID NO: 476140 - RNA, 62 nt, Human; identical to SEQ ID NO: 474624

SEQ ID NO: 476141 - RNA, 62 nt, Human; identical to SEQ ID NO: 474625

SEQ ID NO: 476142 - RNA, 62 nt, Human; identical to SEQ ID NO: 474626

SEQ ID NO: 476143 - RNA, 62 nt, Human; identical to SEQ ID NO: 474641

SEQ ID NO: 476144 - RNA, 62 nt, Human; identical to SEQ ID NO: 474642

SEQ ID NO: 476145 - RNA, 62 nt, Human; identical to SEQ ID NO: 474643

SEQ ID NO: 476146 - RNA, 62 nt, Human; identical to SEQ ID NO: 472720

SEQ ID NO: 476147 - RNA, 62 nt, Human; identical to SEQ ID NO: 474658

SEQ ID NO: 476148 - RNA, 62 nt, Human; identical to SEQ ID NO: 474659

SEQ ID NO: 476149 - RNA, 62 nt, Human; identical to SEQ ID NO: 474660

SEQ ID NO: 476150 - RNA, 62 nt, Human; identical to SEQ ID NO: 474675

SEQ ID NO: 476151 - RNA, 62 nt, Human; identical to SEQ ID NO: 474676

SEQ ID NO: 476152 - RNA, 62 nt, Human; identical to SEQ ID NO: 474677

SEQ ID NO: 476153 - RNA, 62 nt, Human; identical to SEQ ID NO: 472735

SEQ ID NO: 476154 - RNA, 62 nt, Human; identical to SEQ ID NO: 474709

SEQ ID NO: 476155 - RNA, 62 nt, Human; identical to SEQ ID NO: 474710

SEQ ID NO: 476156 - RNA, 62 nt, Human; identical to SEQ ID NO: 474711

SEQ ID NO: 476157 - RNA, 62 nt, Human; identical to SEQ ID NO: 474726

SEQ ID NO: 476158 - RNA, 62 nt, Human; identical to SEQ ID NO: 474727

SEQ ID NO: 476159 - RNA, 62 nt, Human; identical to SEQ ID NO: 474728

SEQ ID NO: 476160 - RNA, 62 nt, Human; identical to SEQ ID NO: 472736

SEQ ID NO: 476161 - RNA, 62 nt, Human; identical to SEQ ID NO: 474777

SEQ ID NO: 476162 - RNA, 62 nt, Human; identical to SEQ ID NO: 474778

SEQ ID NO: 476163 - RNA, 62 nt, Human; identical to SEQ ID NO: 474779

SEQ ID NO: 476164 - RNA, 62 nt, Human; identical to SEQ ID NO: 474896

SEQ ID NO: 476165 - RNA, 62 nt, Human; identical to SEQ ID NO: 474897

SEQ ID NO: 476166 - RNA, 62 nt, Human; identical to SEQ ID NO: 474898

SEQ ID NO: 476167 - RNA, 62 nt, Human; identical to SEQ ID NO: 472751

SEQ ID NO: 476168 - RNA, 62 nt, Human; identical to SEQ ID NO: 474318

SEQ ID NO: 476169 - RNA, 62 nt, Human; identical to SEQ ID NO: 474319

SEQ ID NO: 476170 - RNA, 62 nt, Human; identical to SEQ ID NO: 474320

SEQ ID NO: 476171 - RNA, 62 nt, Human; identical to SEQ ID NO: 474321

SEQ ID NO: 476172 - RNA, 62 nt, Human; identical to SEQ ID NO: 474337

SEQ ID NO: 476173 - RNA, 62 nt, Human; identical to SEQ ID NO: 474338

SEQ ID NO: 476174 - RNA, 62 nt, Human; identical to SEQ ID NO: 474339

SEQ ID NO: 476175 - RNA, 62 nt, Human; identical to SEQ ID NO: 472752

SEQ ID NO: 476176 - RNA, 62 nt, Human; identical to SEQ ID NO: 474355

SEQ ID NO: 476177 - RNA, 62 nt, Human; identical to SEQ ID NO: 474356

SEQ ID NO: 476178 - RNA, 62 nt, Human; identical to SEQ ID NO: 474357

SEQ ID NO: 476179 - RNA, 62 nt, Human; identical to SEQ ID NO: 474373

SEQ ID NO: 476180 - RNA, 62 nt, Human; identical to SEQ ID NO: 474374

SEQ ID NO: 476181 - RNA, 62 nt, Human; identical to SEQ ID NO: 474375

SEQ ID NO: 476182 - RNA, 62 nt, Human; identical to SEQ ID NO: 472767

SEQ ID NO: 476183 - RNA, 62 nt, Human; identical to SEQ ID NO: 474409

SEQ ID NO: 476184 - RNA, 62 nt, Human; identical to SEQ ID NO: 474410

SEQ ID NO: 476185 - RNA, 62 nt, Human; identical to SEQ ID NO: 474411

SEQ ID NO: 476186 - RNA, 62 nt, Human; identical to SEQ ID NO: 474427

SEQ ID NO: 476187 - RNA, 62 nt, Human; identical to SEQ ID NO: 474428

SEQ ID NO: 476188 - RNA, 62 nt, Human; identical to SEQ ID NO: 474429

SEQ ID NO: 476189 - RNA, 62 nt, Human; identical to SEQ ID NO: 472768

SEQ ID NO: 476190 - RNA, 62 nt, Human; identical to SEQ ID NO: 474445

SEQ ID NO: 476191 - RNA, 62 nt, Human; identical to SEQ ID NO: 474446

SEQ ID NO: 476192 - RNA, 62 nt, Human; identical to SEQ ID NO: 474447

SEQ ID NO: 476193 - RNA, 62 nt, Human; identical to SEQ ID NO: 474448

SEQ ID NO: 476194 - RNA, 62 nt, Human; identical to SEQ ID NO: 474464

SEQ ID NO: 476195 - RNA, 62 nt, Human; identical to SEQ ID NO: 474465

SEQ ID NO: 476196 - RNA, 62 nt, Human; identical to SEQ ID NO: 474466

SEQ ID NO: 476197 - RNA, 62 nt, Human; identical to SEQ ID NO: 472769

SEQ ID NO: 476198 - RNA, 62 nt, Human; identical to SEQ ID NO: 474482

SEQ ID NO: 476199 - RNA, 62 nt, Human; identical to SEQ ID NO: 474483

SEQ ID NO: 476200 - RNA, 62 nt, Human; identical to SEQ ID NO: 474484

SEQ ID NO: 476201 - RNA, 62 nt, Human; identical to SEQ ID NO: 474485

SEQ ID NO: 476202 - RNA, 62 nt, Human; identical to SEQ ID NO: 474501

SEQ ID NO: 476203 - RNA, 62 nt, Human; identical to SEQ ID NO: 474502

SEQ ID NO: 476204 - RNA, 62 nt, Human; identical to SEQ ID NO: 474503

SEQ ID NO: 476205 - RNA, 62 nt, Human; identical to SEQ ID NO: 472784

SEQ ID NO: 476206 - RNA, 62 nt, Human; identical to SEQ ID NO: 474520

SEQ ID NO: 476207 - RNA, 62 nt, Human; identical to SEQ ID NO: 474521

SEQ ID NO: 476208 - RNA, 62 nt, Human; identical to SEQ ID NO: 474522

SEQ ID NO: 476209 - RNA, 62 nt, Human; identical to SEQ ID NO: 474523

SEQ ID NO: 476210 - RNA, 62 nt, Human; identical to SEQ ID NO: 474282

SEQ ID NO: 476211 - RNA, 62 nt, Human; identical to SEQ ID NO: 474283

SEQ ID NO: 476212 - RNA, 62 nt, Human; identical to SEQ ID NO: 474284

SEQ ID NO: 476213 - RNA, 62 nt, Human; identical to SEQ ID NO: 472785

SEQ ID NO: 476214 - RNA, 62 nt, Human; identical to SEQ ID NO: 474692

SEQ ID NO: 476215 - RNA, 62 nt, Human; identical to SEQ ID NO: 474693

SEQ ID NO: 476216 - RNA, 62 nt, Human; identical to SEQ ID NO: 474694

SEQ ID NO: 476217 - RNA, 62 nt, Human; identical to SEQ ID NO: 474101

SEQ ID NO: 476218 - RNA, 62 nt, Human; identical to SEQ ID NO: 474102

SEQ ID NO: 476219 - RNA, 62 nt, Human; identical to SEQ ID NO: 474103

SEQ ID NO: 476220 - RNA, 62 nt, Human; identical to SEQ ID NO: 472800

SEQ ID NO: 476221 - RNA, 62 nt, Human; identical to SEQ ID NO: 474104

SEQ ID NO: 476222 - RNA, 62 nt, Human; identical to SEQ ID NO: 474119

SEQ ID NO: 476223 - RNA, 62 nt, Human; identical to SEQ ID NO: 474120

SEQ ID NO: 476224 - RNA, 62 nt, Human; identical to SEQ ID NO: 474121

SEQ ID NO: 476225 - RNA, 62 nt, Human; identical to SEQ ID NO: 472801

SEQ ID NO: 476226 - RNA, 62 nt, Human; identical to SEQ ID NO: 474122

SEQ ID NO: 476227 - RNA, 62 nt, Human; identical to SEQ ID NO: 474155

SEQ ID NO: 476228 - RNA, 62 nt, Human; identical to SEQ ID NO: 474156

SEQ ID NO: 476229 - RNA, 62 nt, Human; identical to SEQ ID NO: 474157

SEQ ID NO: 476230 - RNA, 62 nt, Human; identical to SEQ ID NO: 472802

SEQ ID NO: 476231 - RNA, 62 nt, Human; identical to SEQ ID NO: 474137

SEQ ID NO: 476232 - RNA, 62 nt, Human; identical to SEQ ID NO: 474138

SEQ ID NO: 476233 - RNA, 62 nt, Human; identical to SEQ ID NO: 474139

SEQ ID NO: 476234 - RNA, 62 nt, Human; identical to SEQ ID NO: 474140

SEQ ID NO: 476235 - RNA, 62 nt, Human; identical to SEQ ID NO: 474209

SEQ ID NO: 476236 - RNA, 62 nt, Human; identical to SEQ ID NO: 474210

SEQ ID NO: 476237 - RNA, 62 nt, Human; identical to SEQ ID NO: 474211

SEQ ID NO: 476238 - RNA, 62 nt, Human; identical to SEQ ID NO: 472804

SEQ ID NO: 476239 - RNA, 62 nt, Human; identical to SEQ ID NO: 474173

SEQ ID NO: 476240 - RNA, 62 nt, Human; identical to SEQ ID NO: 474174

SEQ ID NO: 476241 - RNA, 62 nt, Human; identical to SEQ ID NO: 474175

SEQ ID NO: 476242 - RNA, 62 nt, Human; identical to SEQ ID NO: 474176

SEQ ID NO: 476243 - RNA, 62 nt, Human; identical to SEQ ID NO: 474391

SEQ ID NO: 476244 - RNA, 62 nt, Human; identical to SEQ ID NO: 474392

SEQ ID NO: 476245 - RNA, 62 nt, Human; identical to SEQ ID NO: 474393

SEQ ID NO: 476246 - RNA, 62 nt, Human; identical to SEQ ID NO: 472805

SEQ ID NO: 476247 - RNA, 62 nt, Human; identical to SEQ ID NO: 474191

SEQ ID NO: 476248 - RNA, 62 nt, Human; identical to SEQ ID NO: 474192

SEQ ID NO: 476249 - RNA, 62 nt, Human; identical to SEQ ID NO: 474193

SEQ ID NO: 476250 - RNA, 62 nt, Human; identical to SEQ ID NO: 474194

SEQ ID NO: 476251 - RNA, 62 nt, Human; identical to SEQ ID NO: 474212

SEQ ID NO: 476252 - RNA, 62 nt, Human; identical to SEQ ID NO: 474263

SEQ ID NO: 476253 - RNA, 62 nt, Human; identical to SEQ ID NO: 472806

SEQ ID NO: 476254 - RNA, 62 nt, Human; identical to SEQ ID NO: 474227

SEQ ID NO: 476255 - RNA, 62 nt, Human; identical to SEQ ID NO: 474228

SEQ ID NO: 476256 - RNA, 62 nt, Human; identical to SEQ ID NO: 474191

SEQ ID NO: 476257 - RNA, 62 nt, Human; identical to SEQ ID NO: 474230

SEQ ID NO: 476258 - RNA, 62 nt, Human; identical to SEQ ID NO: 474245

SEQ ID NO: 476259 - RNA, 62 nt, Human; identical to SEQ ID NO: 474246

SEQ ID NO: 476260 - RNA, 62 nt, Human; identical to SEQ ID NO: 474247

SEQ ID NO: 476261 - RNA, 62 nt, Human; identical to SEQ ID NO: 472807

SEQ ID NO: 476262 - RNA, 62 nt, Human; identical to SEQ ID NO: 474248

SEQ ID NO: 476263 - RNA, 62 nt, Human; identical to SEQ ID NO: 474029

SEQ ID NO: 476264 - RNA, 62 nt, Human; identical to SEQ ID NO: 474030

SEQ ID NO: 476265 - RNA, 62 nt, Human; identical to SEQ ID NO: 474031

SEQ ID NO: 476266 - RNA, 62 nt, Human; identical to SEQ ID NO: 472808

SEQ ID NO: 476267 - RNA, 62 nt, Human; identical to SEQ ID NO: 474264

SEQ ID NO: 476268 - RNA, 62 nt, Human; identical to SEQ ID NO: 474265

SEQ ID NO: 476269 - RNA, 62 nt, Human; identical to SEQ ID NO: 474266

SEQ ID NO: 476270 - RNA, 62 nt, Human; identical to SEQ ID NO: 473957

SEQ ID NO: 476271 - RNA, 62 nt, Human; identical to SEQ ID NO: 473958

SEQ ID NO: 476272 - RNA, 62 nt, Human; identical to SEQ ID NO: 473959

SEQ ID NO: 476273 - RNA, 62 nt, Human; identical to SEQ ID NO: 472809

SEQ ID NO: 476274 - RNA, 62 nt, Human; identical to SEQ ID NO: 474300

SEQ ID NO: 476275 - RNA, 62 nt, Human; identical to SEQ ID NO: 474301

SEQ ID NO: 476276 - RNA, 62 nt, Human; identical to SEQ ID NO: 474302

SEQ ID NO: 476277 - RNA, 62 nt, Human; identical to SEQ ID NO: 473903

SEQ ID NO: 476278 - RNA, 52 nt, Human; identical to SEQ ID NO: 473904

SEQ ID NO: 476279 - RNA, 52 nt, Human; identical to SEQ ID NO: 473905

SEQ ID NO: 476280 - RNA, 62 nt, Human; identical to SEQ ID NO: 472810

SEQ ID NO: 476281 - RNA, 62 nt, Human; identical to SEQ ID NO: 474504

SEQ ID NO: 476282 - RNA, 62 nt, Human; identical to SEQ ID NO: 474573

SEQ ID NO: 476283 - RNA, 62 nt, Human; identical to SEQ ID NO: 474574

SEQ ID NO: 476284 - RNA, 62 nt, Human; identical to SEQ ID NO: 474575

SEQ ID NO: 476285 - RNA, 62 nt, Human; identical to SEQ ID NO: 472811

SEQ ID NO: 476286 - RNA, 62 nt, Human; identical to SEQ ID NO: 473849

SEQ ID NO: 476287 - RNA, 62 nt, Human; identical to SEQ ID NO: 473850

SEQ ID NO: 476288 - RNA, 62 nt, Human; identical to SEQ ID NO: 473851

SEQ ID NO: 476289 - RNA, 62 nt, Human; identical to SEQ ID NO: 473852

SEQ ID NO: 476290 - RNA, 62 nt, Human; identical to SEQ ID NO: 473867

SEQ ID NO: 476291 - RNA, 62 nt, Human; identical to SEQ ID NO: 473868

SEQ ID NO: 476292 - RNA, 62 nt, Human; identical to SEQ ID NO: 473869

SEQ ID NO: 476293 - RNA, 62 nt, Human; identical to SEQ ID NO: 472812

SEQ ID NO: 476294 - RNA, 62 nt, Human; identical to SEQ ID NO: 473870

SEQ ID NO: 476295 - RNA, 62 nt, Human; identical to SEQ ID NO: 473885

SEQ ID NO: 476296 - RNA, 62 nt, Human; identical to SEQ ID NO: 473886

SEQ ID NO: 476297 - RNA, 62 nt, Human; identical to SEQ ID NO: 473887

SEQ ID NO: 476298 - RNA, 62 nt, Human; identical to SEQ ID NO: 472813

SEQ ID NO: 476299 - RNA, 62 nt, Human; identical to SEQ ID NO: 473888

SEQ ID NO: 476300 - RNA, 62 nt, Human; identical to SEQ ID NO: 473921

SEQ ID NO: 476301 - RNA, 62 nt, Human; identical to SEQ ID NO: 473922

SEQ ID NO: 476302 - RNA, 61 nt, Human; identical to SEQ ID NO: 473923

SEQ ID NO: 476303 - RNA, 55 nt, Human; identical to SEQ ID NO: 472814

SEQ ID NO: 476304 - RNA, 62 nt, Human; identical to SEQ ID NO: 473906

SEQ ID NO: 476305 - RNA, 62 nt, Human; identical to SEQ ID NO: 473975

SEQ ID NO: 476306 - RNA, 62 nt, Human; identical to SEQ ID NO: 473976

SEQ ID NO: 476307 - RNA, 62 nt, Human; identical to SEQ ID NO: 473977

SEQ ID NO: 476308 - RNA, 62 nt, Human; identical to SEQ ID NO: 472815

SEQ ID NO: 476309 - RNA, 62 nt, Human; identical to SEQ ID NO: 473924

SEQ ID NO: 476310 - RNA, 62 nt, Human; identical to SEQ ID NO: 474047

SEQ ID NO: 476311 - RNA, 62 nt, Human; identical to SEQ ID NO: 474048

SEQ ID NO: 476312 - RNA, 62 nt, Human; identical to SEQ ID NO: 474049

SEQ ID NO: 476313 - RNA, 62 nt, Human; identical to SEQ ID NO: 472816

SEQ ID NO: 476314 - RNA, 62 nt, Human; identical to SEQ ID NO: 473939

SEQ ID NO: 476315 - RNA, 62 nt, Human; identical to SEQ ID NO: 473940

SEQ ID NO: 476316 - RNA, 62 nt, Human; identical to SEQ ID NO: 473941

SEQ ID NO: 476317 - RNA, 62 nt, Human; identical to SEQ ID NO: 473942

SEQ ID NO: 476318 - RNA, 62 nt, Human; identical to SEQ ID NO: 473777

SEQ ID NO: 476319 - RNA, 62 nt, Human; identical to SEQ ID NO: 473778

SEQ ID NO: 476320 - RNA, 57 nt, Human; identical to SEQ ID NO: 473779

SEQ ID NO: 476321 - RNA, 62 nt, Human; identical to SEQ ID NO: 472817

SEQ ID NO: 476322 - RNA, 62 nt, Human; identical to SEQ ID NO: 473960

SEQ ID NO: 476323 - RNA, 62 nt, Human; identical to SEQ ID NO: 473993

SEQ ID NO: 476324 - RNA, 62 nt, Human; identical to SEQ ID NO: 473994

SEQ ID NO: 476325 - RNA, 62 nt, Human; identical to SEQ ID NO: 473995

SEQ ID NO: 476326 - RNA, 62 nt, Human; identical to SEQ ID NO: 472818

SEQ ID NO: 476327 - RNA, 62 nt, Human; identical to SEQ ID NO: 473978

SEQ ID NO: 476328 - RNA, 62 nt, Human; identical to SEQ ID NO: 473723

SEQ ID NO: 476329 - RNA, 62 nt, Human; identical to SEQ ID NO: 473724

SEQ ID NO: 476330 - RNA, 62 nt, Human; identical to SEQ ID NO: 473725

SEQ ID NO: 476331 - RNA, 62 nt, Human; identical to SEQ ID NO: 472819

SEQ ID NO: 476332 - RNA, 62 nt, Human; identical to SEQ ID NO: 473996

SEQ ID NO: 476333 - RNA, 62 nt, Human; identical to SEQ ID NO: 474011

SEQ ID NO: 476334 - RNA, 62 nt, Human; identical to SEQ ID NO: 474012

SEQ ID NO: 476335 - RNA, 62 nt, Human; identical to SEQ ID NO: 474013

SEQ ID NO: 476336 - RNA, 62 nt, Human; identical to SEQ ID NO: 472820

SEQ ID NO: 476337 - RNA, 51 nt, Human; identical to SEQ ID NO: 474014

SEQ ID NO: 476338 - RNA, 62 nt, Human; identical to SEQ ID NO: 473741

SEQ ID NO: 476339 - RNA, 62 nt, Human; identical to SEQ ID NO: 473742

SEQ ID NO: 476340 - RNA, 62 nt, Human; identical to SEQ ID NO: 473743

SEQ ID NO: 476341 - RNA, 62 nt, Human; identical to SEQ ID NO: 472821

SEQ ID NO: 476342 - RNA, 62 nt, Human; identical to SEQ ID NO: 474158

SEQ ID NO: 476343 - RNA, 62 nt, Human; identical to SEQ ID NO: 473707

SEQ ID NO: 476344 - RNA, 62 nt, Human; identical to SEQ ID NO: 473708

SEQ ID NO: 476345 - RNA, 62 nt, Human; identical to SEQ ID NO: 473709

SEQ ID NO: 476346 - RNA, 62 nt, Human; identical to SEQ ID NO: 472822

SEQ ID NO: 476347 - RNA, 62 nt, Human; identical to SEQ ID NO: 473617

SEQ ID NO: 476348 - RNA, 62 nt, Human; identical to SEQ ID NO: 473618

SEQ ID NO: 476349 - RNA, 62 nt, Human; identical to SEQ ID NO: 473619

SEQ ID NO: 476350 - RNA, 62 nt, Human; identical to SEQ ID NO: 473635

SEQ ID NO: 476351 - RNA, 62 nt, Human; identical to SEQ ID NO: 473636

SEQ ID NO: 476352 - RNA, 62 nt, Human; identical to SEQ ID NO: 473637

SEQ ID NO: 476353 - RNA, 62 nt, Human; identical to SEQ ID NO: 472823

SEQ ID NO: 476354 - RNA, 62 nt, Human; identical to SEQ ID NO: 473653

SEQ ID NO: 476355 - RNA, 62 nt, Human; identical to SEQ ID NO: 473654

SEQ ID NO: 476356 - RNA, 62 nt, Human; identical to SEQ ID NO: 473655

SEQ ID NO: 476357 - RNA, 62 nt, Human; identical to SEQ ID NO: 473671

SEQ ID NO: 476358 - RNA, 62 nt, Human; identical to SEQ ID NO: 473672

SEQ ID NO: 476359 - RNA, 62 nt, Human; identical to SEQ ID NO: 473673

SEQ ID NO: 476360 - RNA, 62 nt, Human; identical to SEQ ID NO: 472838

SEQ ID NO: 476361 - RNA, 62 nt, Human; identical to SEQ ID NO: 473726

SEQ ID NO: 476362 - RNA, 62 nt, Human; identical to SEQ ID NO: 473744

SEQ ID NO: 476363 - RNA, 62 nt, Human; identical to SEQ ID NO: 473759

SEQ ID NO: 476364 - RNA, 62 nt, Human; identical to SEQ ID NO: 472839

SEQ ID NO: 476365 - RNA, 62 nt, Human; identical to SEQ ID NO: 473760

SEQ ID NO: 476366 - RNA, 62 nt, Human; identical to SEQ ID NO: 473761

SEQ ID NO: 476367 - RNA, 62 nt, Human; identical to SEQ ID NO: 473762

SEQ ID NO: 476368 - RNA, 62 nt, Human; identical to SEQ ID NO: 473780

SEQ ID NO: 476369 - RNA, 62 nt, Human; identical to SEQ ID NO: 474065

SEQ ID NO: 476370 - RNA, 62 nt, Human; identical to SEQ ID NO: 472854

SEQ ID NO: 476371 - RNA, 62 nt, Human; identical to SEQ ID NO: 473813

SEQ ID NO: 476372 - RNA, 62 nt, Human; identical to SEQ ID NO: 473814

SEQ ID NO: 476373 - RNA, 62 nt, Human; identical to SEQ ID NO: 473815

SEQ ID NO: 476374 - RNA, 62 nt, Human; identical to SEQ ID NO: 473816

SEQ ID NO: 476375 - RNA, 62 nt, Human; identical to SEQ ID NO: 473831

SEQ ID NO: 476376 - RNA, 62 nt, Human; identical to SEQ ID NO: 473832

SEQ ID NO: 476377 - RNA, 62 nt, Human; identical to SEQ ID NO: 473833

SEQ ID NO: 476378 - RNA, 53 nt, Human; identical to SEQ ID NO: 472855

SEQ ID NO: 476379 - RNA, 62 nt, Human; identical to SEQ ID NO: 473834

SEQ ID NO: 476380 - RNA, 62 nt, Human; identical to SEQ ID NO: 473563

SEQ ID NO: 476381 - RNA, 62 nt, Human; identical to SEQ ID NO: 473564

SEQ ID NO: 476382 - RNA, 62 nt, Human; identical to SEQ ID NO: 473565

SEQ ID NO: 476383 - RNA, 62 nt, Human; identical to SEQ ID NO: 472856

SEQ ID NO: 476384 - RNA, 62 nt, Human; identical to SEQ ID NO: 474050

SEQ ID NO: 476385 - RNA, 62 nt, Human; identical to SEQ ID NO: 474066

SEQ ID NO: 476386 - RNA, 62 nt, Human; identical to SEQ ID NO: 474067

SEQ ID NO: 476387 - RNA, 62 nt, Human; identical to SEQ ID NO: 474068

SEQ ID NO: 476388 - RNA, 62 nt, Human; identical to SEQ ID NO: 472871

SEQ ID NO: 476389 - RNA, 62 nt, Human; identical to SEQ ID NO: 473394

SEQ ID NO: 476390 - RNA, 62 nt, Human; identical to SEQ ID NO: 473395

SEQ ID NO: 476391 - RNA, 62 nt, Human; identical to SEQ ID NO: 473396

SEQ ID NO: 476392 - RNA, 62 nt, Human; identical to SEQ ID NO: 473411

SEQ ID NO: 476393 - RNA, 62 nt, Human; identical to SEQ ID NO: 473412

SEQ ID NO: 476394 - RNA, 62 nt, Human; identical to SEQ ID NO: 473413

SEQ ID NO: 476395 - RNA, 62 nt, Human; identical to SEQ ID NO: 472872

SEQ ID NO: 476396 - RNA, 62 nt, Human; identical to SEQ ID NO: 473428

SEQ ID NO: 476397 - RNA, 62 nt, Human; identical to SEQ ID NO: 473429

SEQ ID NO: 476398 - RNA, 62 nt, Human; identical to SEQ ID NO: 473430

SEQ ID NO: 476399 - RNA, 62 nt, Human; identical to SEQ ID NO: 473445

SEQ ID NO: 476400 - RNA, 62 nt, Human; identical to SEQ ID NO: 473446

SEQ ID NO: 476401 - RNA, 62 nt, Human; identical to SEQ ID NO: 473447

SEQ ID NO: 476402 - RNA, 62 nt, Human; identical to SEQ ID NO: 472873

SEQ ID NO: 476403 - RNA, 62 nt, Human; identical to SEQ ID NO: 473461

SEQ ID NO: 476404 - RNA, 62 nt, Human; identical to SEQ ID NO: 473462

SEQ ID NO: 476405 - RNA, 62 nt, Human; identical to SEQ ID NO: 473463

SEQ ID NO: 476406 - RNA, 62 nt, Human; identical to SEQ ID NO: 473473

SEQ ID NO: 476407 - RNA, 62 nt, Human; identical to SEQ ID NO: 473474

SEQ ID NO: 476408 - RNA, 62 nt, Human; identical to SEQ ID NO: 473475

SEQ ID NO: 476409 - RNA, 62 nt, Human; identical to SEQ ID NO: 472888

SEQ ID NO: 476410 - RNA, 62 nt, Human; identical to SEQ ID NO: 473509

SEQ ID NO: 476411 - RNA, 62 nt, Human; identical to SEQ ID NO: 473510

SEQ ID NO: 476412 - RNA, 62 nt, Human; identical to SEQ ID NO: 473511

SEQ ID NO: 476413 - RNA, 62 nt, Human; identical to SEQ ID NO: 473527

SEQ ID NO: 476414 - RNA, 62 nt, Human; identical to SEQ ID NO: 473528

SEQ ID NO: 476415 - RNA, 56 nt, Human; identical to SEQ ID NO: 473529

SEQ ID NO: 476416 - RNA, 64 nt, Human
cagagccuaauuuauauucacuauccuuccaagucccggguagcagaaggguugccauagaucu

SEQ ID NO: 476417 - RNA, 64 nt, Human
gagaagugcuaagcuacuuguuuucucacuugagcccggguaggcuguguuggcccucacuugg

SEQ ID NO: 476418 - RNA, 64 nt, Human
gcggcguggcuggaggggccgugucuggcugcugcccggguaggggaugcccagugaaugugca

SEQ ID NO: 476419 - RNA, 64 nt, Human
uccccggcaccagacaucgcccuggcccugcuggcccggguaucgggaaggaggagcgagggaa

SEQ ID NO: 476420 - RNA, 64 nt, Human
cucgcucucugccuucaucugggcccugggcucucccggguaaugggauggcugcggucccgcc

SEQ ID NO: 476421 - RNA, 64 nt, Human
cgggagcuugauaucccuugucuguaacauagaccccggguacugcgggaggggagggcugcug

SEQ ID NO: 476422 - RNA, 64 nt, Human
gagcuucucugcagacugacacacccucccccaccccggguaguggagaugcuggugucugggu

SEQ ID NO: 476423 - RNA, 64 nt, Human
caucaucucuuccccuucucucugggaacaguuacccggguauucuuugggaagcuauccuuuc

SEQ ID NO: 476424 - RNA, 64 nt, Human
gccgccugcuuuuuguccuccaggaaaccagaagcccggguaauuagguaggccggggagcagc

SEQ ID NO: 476425 - RNA, 61 nt, Human
cccuguguggcuaucacuagcaaggccaagccccggguacccucagugauggcagaggcca

SEQ ID NO: 476426 - RNA, 64 nt, Human
uauucuguguuuucucuuggcucuuugggucuuucccggguacacuagauggcuccaucccaag

SEQ ID NO: 476427 - RNA, 64 nt, Human
gugugcguguguguguguguguacugcaugcccacccggguagcaggcugcugggcaguucugc

SEQ ID NO: 476428 - RNA, 64 nt, Human
caacacccugggcagcuacaagugcagcugugaccccggguacgagcuggccccagacaagcgc

SEQ ID NO: 476429 - RNA, 64 nt, Human
ucccugggccucuggaagcuuuguuucuucuguacccggguaaagugggggccucaacugugcc

SEQ ID NO: 476430 - RNA, 64 nt, Human
caguaaauauuugcaagaaaucccacucaucgaccccggguaaaauguuaugguaagcaugcac

SEQ ID NO: 476431 - RNA, 64 nt, Human
caggacgguuaggccagccgaugagggacugcagagaggcuacuggaagguuaaggacccagag

SEQ ID NO: 476432 - RNA, 64 nt, Human
ucaaggagagcaggguaggugaaagucuagagaaagaggcuaccugcccagggucacagcaagg

SEQ ID NO: 476433 - RNA, 64 nt, Human
ugcaguggggauuuauuuuuccaaagcagguaacagaggcuagugagaaagaaaagcuccucuc

SEQ ID NO: 476434 - RNA, 64 nt, Human
cuuacaucuaggccuaacugucccucuuccugcccccggguaccacaguccaccuuuagacccu

SEQ ID NO: 476435 - RNA, 64 nt, Human
caaauguccucuucauuuguucuuuaugagaaaacccggguagugccagcaccuggauacagua

SEQ ID NO: 476436 - RNA, 64 nt, Human
uucccugacucccgagggcuagggcuagagcagacccggguaaguaaaggcagacccagggcuc

SEQ ID NO: 476437 - RNA, 64 nt, Human
uuguccuccccuggccuccagucuccccugcccucccggguagagcugggaugcccucacuuuu

SEQ ID NO: 476438 - RNA, 64 nt, Human
guuuuagaaacccaaguuccucuaagcacagccucccggguauguaacugaacuuggugccaaa

SEQ ID NO: 476439 - RNA, 64 nt, Human
cuccccaggagcagggaaccuguguggcaggugccccggguauuuuggcagaacuaguugauua

SEQ ID NO: 476440 - RNA, 64 nt, Human
uggacaguaugugggggcaggaagguuaucuccucccggguaaagccauuucguccucuccagu

SEQ ID NO: 476441 - RNA, 64 nt, Human
augugcuguccuauccagccucucacagcugccacccggguauagacaccugggaaguggggcc

SEQ ID NO: 476442 - RNA, 64 nt, Human
ugaguagcugggacuacaggugcgugccaccaugcccggguaauuuuuuguauuuuuaguagag

SEQ ID NO: 476443 - RNA, 64 nt, Human
uccgccguggugagagaacuggccguggcucagccccggguagcaccuguaguuucagugccac

SEQ ID NO: 476444 - RNA, 64 nt, Human
ccguagacgugcacgcacacugucugcccccguucccggguagccacuggacugacgacuugag

SEQ ID NO: 476445 - RNA, 64 nt, Human
aaaguuagcuaccguuccaugguucuuugcucuccccggguagugaugaacauuuacuacuaua

SEQ ID NO: 476446 - RNA, 64 nt, Human
uguccccacuguguggcuggacuguacucugcugcccggguagccaggagucucucccucucuc

SEQ ID NO: 476447 - RNA, 64 nt, Human
gaccgggcuuccucccuccacgcuuagggucugucccggguacucagucagcccagugggaucu

SEQ ID NO: 476448 - RNA, 51 nt, Human
aaagcuggcgugauuguugaccccggguacaguuuaaagaagcuggccaua

SEQ ID NO: 476449 - RNA, 64 nt, Human
uaauuuuagcuaucuguaaccaagauggaugcaaagaggcuagugccucagagagaacuguacg

SEQ ID NO: 476450 - RNA, 64 nt, Human
acaauuauuuaauugccuauaaguuugcuguuucagaggcuagcccaaaggcaucaaauuuaau

SEQ ID NO: 476451 - RNA, 64 nt, Human
cuaacuccucugcgcuuguucacuaguaaccuaaagaggcuauauucauucuuuaugcaaugag

SEQ ID NO: 476452 - RNA, 64 nt, Human
cauucugacaaguuugguccacuuggcucuuuaccccggguaauaagacccuuauugacuuuga

SEQ ID NO: 476453 - RNA, 64 nt, Human
ggaaaagggaaacccucuggcuguaggggccucucggccaaaacuaaaacagcccugagcaugg

SEQ ID NO: 476454 - RNA, 64 nt, Human
auccauugucucuucaugucuauuccauucccuucggccaaacagacagguggaaaaacugaga

SEQ ID NO: 476455 - RNA, 64 nt, Human
gagugaugagagucaagaagaggggauguaugaacggccaaauucccaugugagaggaagauga

SEQ ID NO: 476456 - RNA, 64 nt, Human
aagugcugggauuacagacaugaacugccaggcccggccaaaauaaugcaccacuuuuaacaga

SEQ ID NO: 476457 - RNA, 64 nt, Human
uuaauagccagauaguagaaccagugaggagaugcggccaaagauucuuuauaucugaaccaag

SEQ ID NO: 476458 - RNA, 64 nt, Human
uguaucauaugcucaacucugaaaaccuugaacacggccaaaauccauaaagauuauaaaagca

SEQ ID NO: 476459 - RNA, 64 nt, Human
aaauuaaaaguuuucuuucuccaaccugagggcacggccaaaaagaucugguuauuuuuuagcc

SEQ ID NO: 476460 - RNA, 64 nt, Human
gugacaugucuacuuuuuaauuuuuaagagcauccggccaaaugcaaaauuaguaccucaaagu

SEQ ID NO: 476461 - RNA, 64 nt, Human
aaaugcugggauuacaggugugagccacugugcccggccaaaagaacagaaauuauuuuauccu

SEQ ID NO: 476462 - RNA, 64 nt, Human
caaagucaucaacuggaaaaaaagcaaaaacccacggccaaaauaaauugguacuguuuguuac

SEQ ID NO: 476463 - RNA, 64 nt, Human
ggauauuuauuuccuucucuguuuuugggaaaugagaggcuacaaccaagacagcugaaggaga

SEQ ID NO: 476464 - RNA, 64 nt, Human
aacagucaugucuuaagcugcauuuccauaggauagaggcuauugcagggaguggcuuguauca

SEQ ID NO: 476465 - RNA, 64 nt, Human
uccauucagguccugcuguacucugggggcagggagaggcuagaggggcaggacagacagcguu

SEQ ID NO: 476466 - RNA, 64 nt, Human
aguguuaccaccagcacccagaccgaacccccaccggccaaauguggugaugccgaagauguuu

SEQ ID NO: 476467 - RNA, 64 nt, Human
aaaaacagaacauuccauauguuucuuucuccaucggccaaaaacauuuugacacaauguuugu

SEQ ID NO: 476468 - RNA, 64 nt, Human
auccacuggcgucaucaagucaccaagcuggcaacggccaaaccaaggagguagcccagagaaa

SEQ ID NO: 476469 - RNA, 64 nt, Human
aagugcugggauuacaggcgugagccacugcgcccggccaaaaagaacauuuugucaaucugaa

SEQ ID NO: 476470 - RNA, 64 nt, Human
uuuucuaguauguggcuuucuguagccgugguaacggccaaacuguucauccuagcuacccaug

SEQ ID NO: 476471 - RNA, 64 nt, Human
aacugugcuuccaacugccaccuggacggggaggcggccaaaaagcugaugggcgaggaggccc

SEQ ID NO: 476472 - RNA, 64 nt, Human
uugccuuggacuaucaugcuaccuuacgccuccccggccaaauucccuccucuccuccgggggg

SEQ ID NO: 476473 - RNA, 64 nt, Human
cccacacccccagggacgccgcuuuccgggaucccggccaaacgccggacccucagucgcucca

SEQ ID NO: 476474 - RNA, 64 nt, Human
gcugugaacccagcagggucgccucccucugcaucggccaaauuggggagggcauggaagaucc

SEQ ID NO: 476475 - RNA, 64 nt, Human
guugucagguucccgggagaaggcggugaggacucggccaaacaccccgcgcugcugggcguuc

SEQ ID NO: 476476 - RNA, 64 nt, Human
ugaaugccaaccuuaugauggaugugaaaaucuacggccaaauacuuuugaaaacaccuuucua

SEQ ID NO: 476477 - RNA, 64 nt, Human
agcuggaagacacucagcucucuaagcaggggcucggccaaacaugggaguuaagugcugcuug

SEQ ID NO: 476478 - RNA, 64 nt, Human
gguggagucugccccaggcacccucugcccugcccggccaaauacccggcauuauggggacaga

SEQ ID NO: 476479 - RNA, 64 nt, Human
aaagucccuagugacaugauugagcaguaaagaacggccaaaucacacagucagcuaaaagcac

SEQ ID NO: 476480 - RNA, 64 nt, Human
cagggcagguaucagggugaacugaucuuagcaccggccaaauaaauggaaccugcugagagag

SEQ ID NO: 476481 - RNA, 64 nt, Human
acaguggcaagacaacauuacccaacuauagaagagaggcuaacuagcaacaauaauagaugau

SEQ ID NO: 476482 - RNA, 64 nt, Human
uugacucagauggaccccugguuuccaaguagaaagaggcuagauuugggccuugucuagcugu

SEQ ID NO: 476483 - RNA, 64 nt, Human
gcgucugaagaguaaggagaaaccaccgaugccgagaggcuaguggugccccagggacccaaga

SEQ ID NO: 476484 - RNA, 64 nt, Human
accaaacacuacccaugggggguugggagucagccggccaaacuaacacucccccuccuccacc

SEQ ID NO: 476485 - RNA, 64 nt, Human
ugauugcugcugaaucagcuacaugcugaggaaacggccaaacaaguguuaaagagagacggug

SEQ ID NO: 476486 - RNA, 64 nt, Human
ggcacuuccaaaaaauuggcaaagcggaaugcggcggccaaaaugcugcuucgagugcacacgg

SEQ ID NO: 476487 - RNA, 64 nt, Human
uuaaucgauuccuuuauguuuuauaagaguuuaccggccaaagcauauugucaucuuuggucau

SEQ ID NO: 476488 - RNA, 64 nt, Human
caaugccauucccacuugccccagagaagcuacucggccaaaccuagccagggucuguucuugu

SEQ ID NO: 476489 - RNA, 64 nt, Human
auucguccacggugccccguagcagcagguccugcggccaaaucugucucccuucaugggccuc

SEQ ID NO: 476490 - RNA, 64 nt, Human
aagccgauuguauuuguguugcacacguuuuuaucggccaaagucacucguaugggacugcuug

SEQ ID NO: 476491 - RNA, 64 nt, Human
uaaaggcauuuuucccagacccugcucaggcagucggccaaaugagugcaaagucuguuuuccc

SEQ ID NO: 476492 - RNA, 64 nt, Human
gagugaacaagaacaccccugccgacucccagcccggccaaaaagacaaaacacauagacgcac

SEQ ID NO: 476493 - RNA, 64 nt, Human
ugguccagucccacucggggauggagugggccggcggccaaaccagucacucggggaggaaugc

SEQ ID NO: 476494 - RNA, 64 nt, Human
ugugaacugguuacuuucugucucugugcucuaccggccaaacaagggguuuggaccagaccug

SEQ ID NO: 476495 - RNA, 64 nt, Human
cugcaggggccccacacaggcaugagggauggcccggccaaagucuaggcagaagccuccuaua

SEQ ID NO: 476496 - RNA, 64 nt, Human
uggacucuagccccugaccccagacucccgagaccggccaaagccaagccagccccacccuuaa

SEQ ID NO: 476497 - RNA, 64 nt, Human
ucuguuuccagauagcugccuggugcggcagcggcggccaaaucuuccguccucccguggaucu

SEQ ID NO: 476498 - RNA, 64 nt, Human
ggacaggugcagcucuugcagcucugcgggugugcggccaaaggcaaggcccacgggcuggaug

SEQ ID NO: 476499 - RNA, 64 nt, Human
gugcaccaaucuacaguauauauagcagagaaucagaggcuaaaaauauuaccccauauguucc

SEQ ID NO: 476500 - RNA, 64 nt, Human
ggagauaaaagaaccccagaccucugaaugucccagaggcuagucucuucucagagcagcacug

SEQ ID NO: 476501 - RNA, 64 nt, Human
gagccaggacacuacgcaucccugcugagugugcagaggcuagaggcuucucgggcagccccug

SEQ ID NO: 476502 - RNA, 64 nt, Human
aggagcugagauuacgaguacaccacaccaugcccggccaaauacuugguuuucaguaccacaa

SEQ ID NO: 476503 - RNA, 64 nt, Human
caggcgcacaggggccgccgguaacaggggccgccggccaaaggccccuuuccagucauagcac

SEQ ID NO: 476504 - RNA, 64 nt, Human
ucuacaugaacaaggcaauuucagugucuuacagcggccaaaccaugacgugaagaaugagaua

SEQ ID NO: 476505 - RNA, 64 nt, Human
aagugcugggauuacaggcgugagccacugagcccggccaaaaaaaaauguauuuauuaaaaaa

SEQ ID NO: 476506 - RNA, 64 nt, Human
ucucugaacccacuguggugagaagaauuugcuccggccaaauuggccguuagccaccuggguc

SEQ ID NO: 476507 - RNA, 51 nt, Human
ugguggaauaucucaucuaaacggccaaaucaagagcugcagauuaucagc

SEQ ID NO: 476508 - RNA, 64 nt, Human
uaaaauacaaaaaaauuagccaggcauaguggcgcgcgccuauaaucccagcuacugggaggcu

SEQ ID NO: 476509 - RNA, 64 nt, Human
cccgaaacggacggcccggagcccgcaccagccccgcgccuacccgggccgcccccgcggccug

SEQ ID NO: 476510 - RNA, 64 nt, Human
ccuccuccgaggagcccgagggguguccugggugcgcgccuagcuccgcacgggggaccucgga

SEQ ID NO: 476511 - RNA, 64 nt, Human
cuccugaguagcugggacuagaggcacgcaccaccgcgccuaccuuuuuauuuuuuuuguagag

SEQ ID NO: 476512 - RNA, 64 nt, Human
guccuccacucgacccagaauggagccugcucuccgcgccuacccuucccgccucccucucaga

SEQ ID NO: 476513 - RNA, 64 nt, Human
caugcgggaggugaggcgggcucugcgugcgcaccgcgccuacacgcccaacgacgagugcuuc

SEQ ID NO: 476514 - RNA, 64 nt, Human
ggaucuguucuuuuuuuaaaaaaacuuccuucaccgcgccuauaauccuagcacuuugggaggc

SEQ ID NO: 476515 - RNA, 64 nt, Human
gaguuauuauucaacucaaucucccagagaacucagaggcuacaguuucuacaggcaauuuggc

SEQ ID NO: 476516 - RNA, 64 nt, Human
acauaacacaucuaugaugcugcuuuaaguuuuuagaggcuauaccucaaaguagcugcggauu

SEQ ID NO: 476517 - RNA, 64 nt, Human
uccaaguguuucuuguuaagugcuuuuaaacuggagaggcuaaccucaaaauauuuuuuuuaac

SEQ ID NO: 476518 - RNA, 64 nt, Human
uuguccuucccauguucauuaauucauauugccccgcgccuagucccauuuucacuuccuuuga

SEQ ID NO: 476519 - RNA, 64 nt, Human
agcagaguacagucuguugugguuucccggauuccgcgccuagcucagccaauuaagcaugaga

SEQ ID NO: 476520 - RNA, 64 nt, Human
ggacgcgcgaccguugugcaccaccagggaccgccgcgccuacucugcacgggagcagggacag

SEQ ID NO: 476521 - RNA, 64 nt, Human
uuuggggguuaauucgguuuuuucucuguugcaucgcgccuacugugcgugugcgauagcgugu

SEQ ID NO: 476522 - RNA, 64 nt, Human
cugguccuguuguuuuaccccaucccuucucucgcgcgccuauugauuuguuucugaggagagu

SEQ ID NO: 476523 - RNA, 64 nt, Human; identical to SEQ ID NO: 114502

SEQ ID NO: 476524 - RNA, 64 nt, Human; identical to SEQ ID NO: 114503

SEQ ID NO: 476525 - RNA, 64 nt, Human; identical to SEQ ID NO: 114504

SEQ ID NO: 476526 - RNA, 64 nt, Human
gugcagugcuaagugucacaugucugcuuccaccagaggcuaggaauagugauccugcuauaau

SEQ ID NO: 476527 - RNA, 64 nt, Human
gaugagugcggugggugagaaucccggugcccugagaggcuauacgugacaaaugaccaaaagc

SEQ ID NO: 476528 - RNA, 64 nt, Human
aaaaaaagguagugaacuuucagcuaccuuuuaaagaggcuaaguuaucuuugauaacaucaua

SEQ ID NO: 476529 - RNA, 64 nt, Human; identical to SEQ ID NO: 114505

SEQ ID NO: 476530 - RNA, 64 nt, Human; identical to SEQ ID NO: 114506

SEQ ID NO: 476531 - RNA, 64 nt, Human; identical to SEQ ID NO: 114507

SEQ ID NO: 476532 - RNA, 64 nt, Human; identical to SEQ ID NO: 114508

SEQ ID NO: 476533 - RNA, 64 nt, Human; identical to SEQ ID NO: 114509

SEQ ID NO: 476534 - RNA, 54 nt, Human; identical to SEQ ID NO: 114510

SEQ ID NO: 476535 - RNA, 64 nt, Human; identical to SEQ ID NO: 114511

SEQ ID NO: 476536 - RNA, 64 nt, Human; identical to SEQ ID NO: 114512

SEQ ID NO: 476537 - RNA, 64 nt, Human; identical to SEQ ID NO: 114513

SEQ ID NO: 476538 - RNA, 64 nt, Human; identical to SEQ ID NO: 114514

SEQ ID NO: 476539 - RNA, 64 nt, Human; identical to SEQ ID NO: 114515

SEQ ID NO: 476540 - RNA, 64 nt, Human; identical to SEQ ID NO: 114516

SEQ ID NO: 476541 - RNA, 64 nt, Human; identical to SEQ ID NO: 114517

SEQ ID NO: 476542 - RNA, 64 nt, Human; identical to SEQ ID NO: 114518

SEQ ID NO: 476543 - RNA, 64 nt, Human; identical to SEQ ID NO: 114519

SEQ ID NO: 476544 - RNA, 64 nt, Human
ugcccuaggcuuaauggaugggcagucauuuugcagaggcuaugggaagagggugauaauagaa

SEQ ID NO: 476545 - RNA, 64 nt, Human
uccuggcauauguuaccgaaucaaauagccuuccagaggcuaagaaauuucuguuaguaaaaga

SEQ ID NO: 476546 - RNA, 64 nt, Human
aaugguuuauagcccugugaaguucuuaaaguuuagaggcuaacuuacagaaaugaauaaguug

SEQ ID NO: 476547 - RNA, 64 nt, Human; identical to SEQ ID NO: 114520

SEQ ID NO: 476548 - RNA, 64 nt, Human
ggugugauuugugcaagccagguucaacccuugccucaagaaaucagaugggaccaauuuagug

SEQ ID NO: 476549 - RNA, 64 nt, Human
ggaagauggcuggugaggagcuuaacagaggaaccucaagaagauucugaaaauccuaccccca

SEQ ID NO: 476550 - RNA, 64 nt, Human
ggcaauacugaagggguuaaacagguuuuugcuccucaagaauuuguuugccugggcccaggau

SEQ ID NO: 476551 - RNA, 64 nt, Human
gauaacacuuaccaaaagaucacugcaaaccugccucaagaagcugaugguggcacuucaauuu

SEQ ID NO: 476552 - RNA, 64 nt, Human
gaaguccuuuuuuuuuuuuuuuuuuuuuuaauugcucaagaaaugauucucucacaggcuuggg

SEQ ID NO: 476553 - RNA, 64 nt, Human
gacugaugacaucugacuuuugucgaugggacuucucaagaagccauuccuuggagcuucuguu

SEQ ID NO: 476554 - RNA, 64 nt, Human
cauacugccaugaagacggucucuguguccucagcucaagaauccuguagcuugucccaucaua

SEQ ID NO: 476555 - RNA, 58 nt, Human
caaaccccaaaaacaacugauauaauuacucaagaaauauuugcaacauuaguuuuuu

SEQ ID NO: 476556 - RNA, 64 nt, Human
gauuccuccaugguaaagcugaacugaaacaauucucaagaaugcaucagcuguaccuacaaua

SEQ ID NO: 476557 - RNA, 64 nt, Human
caaucugaagauguaagacuuccugaaacaaguucucaagaagucuuuacauuauauuuauaac

SEQ ID NO: 476558 - RNA, 64 nt, Human
uuugaauauuggggaaggaagaugauacuucuuucucaagaaaagaaaauuggauuauuaggaa

SEQ ID NO: 476559 - RNA, 64 nt, Human
ugucauaagcgaucacuuccuauaugcacuuauucucaagaagaacaucuuuaugguaaagaug

SEQ ID NO: 476560 - RNA, 64 nt, Human
ugugaaugcugaacugaaggcucagauugaggagcucaagaacgagaagcagcauuugauauac

SEQ ID NO: 476561 - RNA, 64 nt, Human
uuuguauuucaccaccuaaauguaauguugauuccucaagaaugaaaugaaggcacuacauuga

SEQ ID NO: 476562 - RNA, 64 nt, Human
uucaagacaaaacagauugcgucgcugacaaguucucaagaagaacuuaugaguaagcagucug

SEQ ID NO: 476563 - RNA, 64 nt, Human
acuugcacugcuguggauuuuuuuaagagaagcaaaaacaaaaguaaacuccuuucccuggccc

SEQ ID NO: 476564 - RNA, 64 nt, Human
gcugagggcuuauagggaagugauuuaaaaagaaaaaacaaacaacaacaaaaaaaacucuucg

SEQ ID NO: 476565 - RNA, 64 nt, Human
acagagcaagacucugucucaaacaaaacaaaacaaaacaaaaacacacuacuguauuuuggau

SEQ ID NO: 476566 - RNA, 64 nt, Human; identical to SEQ ID NO: 114521

SEQ ID NO: 476567 - RNA, 64 nt, Human; identical to SEQ ID NO: 114522

SEQ ID NO: 476568 - RNA, 64 nt, Human; identical to SEQ ID NO: 120388

SEQ ID NO: 476569 - RNA, 64 nt, Human; identical to SEQ ID NO: 120389

SEQ ID NO: 476570 - RNA, 64 nt, Human; identical to SEQ ID NO: 120390

SEQ ID NO: 476571 - RNA, 64 nt, Human; identical to SEQ ID NO: 120391

SEQ ID NO: 476572 - RNA, 64 nt, Human; identical to SEQ ID NO: 120392

SEQ ID NO: 476573 - RNA, 64 nt, Human
aagagucaggcagagcugauggauccaguuugaaaaaacaaaaugccauucaaccguauuuccu

SEQ ID NO: 476574 - RNA, 64 nt, Human
agguuaaaacaaaaacaaaaaaccacaaaaauaaaaaacaaaaaaaacaaaaaacccaagaaaa

SEQ ID NO: 476575 - RNA, 64 nt, Human
agcauuuuuauuaauauggugacuuuuuaaaauaaaaacaaacaaacguuguccuaacucuugc

SEQ ID NO: 476576 - RNA, 64 nt, Human; identical to SEQ ID NO: 120393

SEQ ID NO: 476577 - RNA, 64 nt, Human; identical to SEQ ID NO: 120394

SEQ ID NO: 476578 - RNA, 64 nt, Human; identical to SEQ ID NO: 120395

SEQ ID NO: 476579 - RNA, 64 nt, Human; identical to SEQ ID NO: 120396

SEQ ID NO: 476580 - RNA, 64 nt, Human; identical to SEQ ID NO: 120397

SEQ ID NO: 476581 - RNA, 64 nt, Human; identical to SEQ ID NO: 120398

SEQ ID NO: 476582 - RNA, 64 nt, Human; identical to SEQ ID NO: 120399

SEQ ID NO: 476583 - RNA, 64 nt, Human; identical to SEQ ID NO: 120400

SEQ ID NO: 476584 - RNA, 64 nt, Human; identical to SEQ ID NO: 120401

SEQ ID NO: 476585 - RNA, 64 nt, Human; identical to SEQ ID NO: 120402

SEQ ID NO: 476586 - RNA, 64 nt, Human; identical to SEQ ID NO: 120403

SEQ ID NO: 476587 - RNA, 64 nt, Human; identical to SEQ ID NO: 120404

SEQ ID NO: 476588 - RNA, 64 nt, Human; identical to SEQ ID NO: 120405

SEQ ID NO: 476589 - RNA, 64 nt, Human; identical to SEQ ID NO: 120406

SEQ ID NO: 476590 - RNA, 64 nt, Human; identical to SEQ ID NO: 120407

SEQ ID NO: 476591 - RNA, 64 nt, Human; identical to SEQ ID NO: 120408

SEQ ID NO: 476592 - RNA, 64 nt, Human
gaaaaaagaaagggcuuuaacguuuuuuccagugaaaacaaauccucuuauauuaaaucuaagc

SEQ ID NO: 476593 - RNA, 64 nt, Human
aagauuaucaaauaagcuuaugcuuuggagagguaaaacaaaguggcacagucauccacaccau

SEQ ID NO: 476594 - RNA, 64 nt, Human
ucugaauaauuauggaaguugggacauguuaaggaaaacaaauauguucaucaccaacaaucag

SEQ ID NO: 476595 - RNA, 64 nt, Human; identical to SEQ ID NO: 120409

SEQ ID NO: 476596 - RNA, 64 nt, Human; identical to SEQ ID NO: 120410

SEQ ID NO: 476597 - RNA, 64 nt, Human; identical to SEQ ID NO: 120411

SEQ ID NO: 476598 - RNA, 64 nt, Human; identical to SEQ ID NO: 120412

SEQ ID NO: 476599 - RNA, 64 nt, Human; identical to SEQ ID NO: 120413

SEQ ID NO: 476600 - RNA, 64 nt, Human; identical to SEQ ID NO: 120414

SEQ ID NO: 476601 - RNA, 50 nt, Human; identical to SEQ ID NO: 120415

SEQ ID NO: 476602 - RNA, 64 nt, Human; identical to SEQ ID NO: 120416

SEQ ID NO: 476603 - RNA, 64 nt, Human; identical to SEQ ID NO: 120417

SEQ ID NO: 476604 - RNA, 64 nt, Human; identical to SEQ ID NO: 120418

SEQ ID NO: 476605 - RNA, 64 nt, Human; identical to SEQ ID NO: 120419

SEQ ID NO: 476606 - RNA, 64 nt, Human; identical to SEQ ID NO: 120420

SEQ ID NO: 476607 - RNA, 64 nt, Human; identical to SEQ ID NO: 120421

SEQ ID NO: 476608 - RNA, 64 nt, Human; identical to SEQ ID NO: 120422

SEQ ID NO: 476609 - RNA, 64 nt, Human; identical to SEQ ID NO: 120423

SEQ ID NO: 476610 - RNA, 64 nt, Human; identical to SEQ ID NO: 120424

SEQ ID NO: 476611 - RNA, 64 nt, Human
caaggaaguggggcagggcuuuucugauccaaagaaaacaaaguuucucugguuaccccucuuc

SEQ ID NO: 476612 - RNA, 64 nt, Human
auuuuauuucuuuauuugcaaaagaaucuuuauuaaaacaaacaaucuuaacuaugcacaugau

SEQ ID NO: 476613 - RNA, 64 nt, Human
uguuagcuuccaguaaaaauauuuguuuuuaguaaaaacaaauuuaaauauauuuacauguuug

SEQ ID NO: 476614 - RNA, 64 nt, Human; identical to SEQ ID NO: 120425

SEQ ID NO: 476615 - RNA, 64 nt, Human; identical to SEQ ID NO: 120426

SEQ ID NO: 476616 - RNA, 64 nt, Human; identical to SEQ ID NO: 120427

SEQ ID NO: 476617 - RNA, 64 nt, Human; identical to SEQ ID NO: 120428

SEQ ID NO: 476618 - RNA, 64 nt, Human; identical to SEQ ID NO: 120429

SEQ ID NO: 476619 - RNA, 64 nt, Human; identical to SEQ ID NO: 120430

SEQ ID NO: 476620 - RNA, 64 nt, Human; identical to SEQ ID NO: 120431

SEQ ID NO: 476621 - RNA, 64 nt, Human; identical to SEQ ID NO: 120432

SEQ ID NO: 476622 - RNA, 64 nt, Human; identical to SEQ ID NO: 120433

SEQ ID NO: 476623 - RNA, 64 nt, Human; identical to SEQ ID NO: 120434

SEQ ID NO: 476624 - RNA, 64 nt, Human; identical to SEQ ID NO: 120435

SEQ ID NO: 476625 - RNA, 64 nt, Human; identical to SEQ ID NO: 120436

SEQ ID NO: 476626 - RNA, 64 nt, Human; identical to SEQ ID NO: 120437

SEQ ID NO: 476627 - RNA, 64 nt, Human; identical to SEQ ID NO: 120438

SEQ ID NO: 476628 - RNA, 64 nt, Human; identical to SEQ ID NO: 120439

SEQ ID NO: 476629 - RNA, 64 nt, Human; identical to SEQ ID NO: 120440

SEQ ID NO: 476630 - RNA, 64 nt, Human
aacaauugggggaaggggaaggaagaaaacucugaaaacaaaaucuuguucuaugcaaaagccu

SEQ ID NO: 476631 - RNA, 64 nt, Human; identical to SEQ ID NO: 206294

SEQ ID NO: 476632 - RNA, 64 nt, Human; identical to SEQ ID NO: 206295

SEQ ID NO: 476633 - RNA, 64 nt, Human; identical to SEQ ID NO: 120441

SEQ ID NO: 476634 - RNA, 64 nt, Human; identical to SEQ ID NO: 120442

SEQ ID NO: 476635 - RNA, 64 nt, Human; identical to SEQ ID NO: 120443

SEQ ID NO: 476636 - RNA, 64 nt, Human; identical to SEQ ID NO: 120444

SEQ ID NO: 476637 - RNA, 64 nt, Human; identical to SEQ ID NO: 120445

SEQ ID NO: 476638 - RNA, 64 nt, Human; identical to SEQ ID NO: 120446

SEQ ID NO: 476639 - RNA, 64 nt, Human; identical to SEQ ID NO: 120447

SEQ ID NO: 476640 - RNA, 64 nt, Human; identical to SEQ ID NO: 120448

SEQ ID NO: 476641 - RNA, 64 nt, Human; identical to SEQ ID NO: 120449

SEQ ID NO: 476642 - RNA, 64 nt, Human; identical to SEQ ID NO: 120450

SEQ ID NO: 476643 - RNA, 64 nt, Human; identical to SEQ ID NO: 120451

SEQ ID NO: 476644 - RNA, 64 nt, Human; identical to SEQ ID NO: 120447

SEQ ID NO: 476645 - RNA, 64 nt, Human; identical to SEQ ID NO: 120453

SEQ ID NO: 476646 - RNA, 64 nt, Human; identical to SEQ ID NO: 120454

SEQ ID NO: 476647 - RNA, 64 nt, Human; identical to SEQ ID NO: 120455

SEQ ID NO: 476648 - RNA, 64 nt, Human; identical to SEQ ID NO: 120456

SEQ ID NO: 476649 - RNA, 64 nt, Human; identical to SEQ ID NO: 206298

SEQ ID NO: 476650 - RNA, 64 nt, Human; identical to SEQ ID NO: 206306

SEQ ID NO: 476651 - RNA, 64 nt, Human; identical to SEQ ID NO: 206307

SEQ ID NO: 476652 - RNA, 64 nt, Human; identical to SEQ ID NO: 120457

SEQ ID NO: 476653 - RNA, 64 nt, Human; identical to SEQ ID NO: 120458

SEQ ID NO: 476654 - RNA, 64 nt, Human; identical to SEQ ID NO: 120459

SEQ ID NO: 476655 - RNA, 64 nt, Human; identical to SEQ ID NO: 449614

SEQ ID NO: 476656 - RNA, 64 nt, Human; identical to SEQ ID NO: 449615

SEQ ID NO: 476657 - RNA, 54 nt, Human; identical to SEQ ID NO: 380960

SEQ ID NO: 476658 - RNA, 64 nt, Human; identical to SEQ ID NO: 449617

SEQ ID NO: 476659 - RNA, 64 nt, Human; identical to SEQ ID NO: 449618

SEQ ID NO: 476660 - RNA, 64 nt, Human; identical to SEQ ID NO: 449619

SEQ ID NO: 476661 - RNA, 64 nt, Human; identical to SEQ ID NO: 449620

SEQ ID NO: 476662 - RNA, 64 nt, Human; identical to SEQ ID NO: 449621

SEQ ID NO: 476663 - RNA, 64 nt, Human; identical to SEQ ID NO: 449622

SEQ ID NO: 476664 - RNA, 64 nt, Human; identical to SEQ ID NO: 449623

SEQ ID NO: 476665 - RNA, 64 nt, Human; identical to SEQ ID NO: 449624

SEQ ID NO: 476666 - RNA, 57 nt, Human; identical to SEQ ID NO: 206303

SEQ ID NO: 476667 - RNA, 64 nt, Human; identical to SEQ ID NO: 206304

SEQ ID NO: 476668 - RNA, 64 nt, Human; identical to SEQ ID NO: 206305

SEQ ID NO: 476669 - RNA, 64 nt, Human; identical to SEQ ID NO: 206313

SEQ ID NO: 476670 - RNA, 64 nt, Human; identical to SEQ ID NO: 449625

SEQ ID NO: 476671 - RNA, 64 nt, Human; identical to SEQ ID NO: 449626

SEQ ID NO: 476672 - RNA, 64 nt, Human; identical to SEQ ID NO: 449630

SEQ ID NO: 476673 - RNA, 64 nt, Human; identical to SEQ ID NO: 449631

SEQ ID NO: 476674 - RNA, 64 nt, Human; identical to SEQ ID NO: 449632

SEQ ID NO: 476675 - RNA, 64 nt, Human; identical to SEQ ID NO: 449633

SEQ ID NO: 476676 - RNA, 64 nt, Human; identical to SEQ ID NO: 449634

SEQ ID NO: 476677 - RNA, 64 nt, Human; identical to SEQ ID NO: 449635

SEQ ID NO: 476678 - RNA, 64 nt, Human; identical to SEQ ID NO: 449636

SEQ ID NO: 476679 - RNA, 64 nt, Human; identical to SEQ ID NO: 449637

SEQ ID NO: 476680 - RNA, 64 nt, Human; identical to SEQ ID NO: 449638

SEQ ID NO: 476681 - RNA, 64 nt, Human; identical to SEQ ID NO: 449639

SEQ ID NO: 476682 - RNA, 64 nt, Human; identical to SEQ ID NO: 449640

SEQ ID NO: 476683 - RNA, 64 nt, Human; identical to SEQ ID NO: 449641

SEQ ID NO: 476684 - RNA, 64 nt, Human; identical to SEQ ID NO: 44744

SEQ ID NO: 476685 - RNA, 64 nt, Human; identical to SEQ ID NO: 44751

SEQ ID NO: 476686 - RNA, 64 nt, Human; identical to SEQ ID NO: 44759

SEQ ID NO: 476687 - RNA, 64 nt, Human; identical to SEQ ID NO: 449642

SEQ ID NO: 476688 - RNA, 64 nt, Human; identical to SEQ ID NO: 449643

SEQ ID NO: 476689 - RNA, 64 nt, Human; identical to SEQ ID NO: 449644

SEQ ID NO: 476690 - RNA, 64 nt, Human; identical to SEQ ID NO: 449648

SEQ ID NO: 476691 - RNA, 64 nt, Human; identical to SEQ ID NO: 449649

SEQ ID NO: 476692 - RNA, 64 nt, Human; identical to SEQ ID NO: 449650

SEQ ID NO: 476693 - RNA, 64 nt, Human; identical to SEQ ID NO: 449651

SEQ ID NO: 476694 - RNA, 64 nt, Human; identical to SEQ ID NO: 449652

SEQ ID NO: 476695 - RNA, 64 nt, Human; identical to SEQ ID NO: 449653

SEQ ID NO: 476696 - RNA, 64 nt, Human; identical to SEQ ID NO: 449654

SEQ ID NO: 476697 - RNA, 64 nt, Human; identical to SEQ ID NO: 449655

SEQ ID NO: 476698 - RNA, 64 nt, Human; identical to SEQ ID NO: 449656

SEQ ID NO: 476699 - RNA, 64 nt, Human; identical to SEQ ID NO: 449657

SEQ ID NO: 476700 - RNA, 64 nt, Human; identical to SEQ ID NO: 449658

SEQ ID NO: 476701 - RNA, 64 nt, Human; identical to SEQ ID NO: 44767

SEQ ID NO: 476702 - RNA, 64 nt, Human; identical to SEQ ID NO: 44774

SEQ ID NO: 476703 - RNA, 64 nt, Human; identical to SEQ ID NO: 206286

SEQ ID NO: 476704 - RNA, 64 nt, Human; identical to SEQ ID NO: 449659

SEQ ID NO: 476705 - RNA, 64 nt, Human; identical to SEQ ID NO: 449660

SEQ ID NO: 476706 - RNA, 64 nt, Human; identical to SEQ ID NO: 449661

SEQ ID NO: 476707 - RNA, 64 nt, Human; identical to SEQ ID NO: 449662

SEQ ID NO: 476708 - RNA, 64 nt, Human; identical to SEQ ID NO: 449666

SEQ ID NO: 476709 - RNA, 64 nt, Human; identical to SEQ ID NO: 449667

SEQ ID NO: 476710 - RNA, 64 nt, Human; identical to SEQ ID NO: 449668

SEQ ID NO: 476711 - RNA, 64 nt, Human; identical to SEQ ID NO: 449669

SEQ ID NO: 476712 - RNA, 64 nt, Human; identical to SEQ ID NO: 449670

SEQ ID NO: 476713 - RNA, 64 nt, Human; identical to SEQ ID NO: 449671

SEQ ID NO: 476714 - RNA, 64 nt, Human; identical to SEQ ID NO: 449672

SEQ ID NO: 476715 - RNA, 64 nt, Human; identical to SEQ ID NO: 449673

SEQ ID NO: 476716 - RNA, 64 nt, Human; identical to SEQ ID NO: 449674

SEQ ID NO: 476717 - RNA, 64 nt, Human; identical to SEQ ID NO: 449675

SEQ ID NO: 476718 - RNA, 64 nt, Human; identical to SEQ ID NO: 206297

SEQ ID NO: 476719 - RNA, 64 nt, Human; identical to SEQ ID NO: 206304

SEQ ID NO: 476720 - RNA, 64 nt, Human; identical to SEQ ID NO: 206314

SEQ ID NO: 476721 - RNA, 64 nt, Human; identical to SEQ ID NO: 449676

SEQ ID NO: 476722 - RNA, 64 nt, Human; identical to SEQ ID NO: 449677

SEQ ID NO: 476723 - RNA, 64 nt, Human; identical to SEQ ID NO: 449678

SEQ ID NO: 476724 - RNA, 64 nt, Human; identical to SEQ ID NO: 449679

SEQ ID NO: 476725 - RNA, 64 nt, Human; identical to SEQ ID NO: 449680

SEQ ID NO: 476726 - RNA, 64 nt, Human; identical to SEQ ID NO: 449684

SEQ ID NO: 476727 - RNA, 64 nt, Human; identical to SEQ ID NO: 449685

SEQ ID NO: 476728 - RNA, 64 nt, Human; identical to SEQ ID NO: 449686

SEQ ID NO: 476729 - RNA, 64 nt, Human; identical to SEQ ID NO: 449687

SEQ ID NO: 476730 - RNA, 64 nt, Human; identical to SEQ ID NO: 449688

SEQ ID NO: 476731 - RNA, 64 nt, Human; identical to SEQ ID NO: 449689

SEQ ID NO: 476732 - RNA, 64 nt, Human; identical to SEQ ID NO: 449690

SEQ ID NO: 476733 - RNA, 64 nt, Human; identical to SEQ ID NO: 449691

SEQ ID NO: 476734 - RNA, 64 nt, Human; identical to SEQ ID NO: 449692

SEQ ID NO: 476735 - RNA, 64 nt, Human
cauagauggaagagcauuggcaggaaaaagcucuagaggcuauacagagaagaaaaaaagagca

SEQ ID NO: 476736 - RNA, 64 nt, Human
ucaacagagauauauucuagaauacuuuuuuagaagaggcuaauaaagggaagaauuauauuga

SEQ ID NO: 476737 - RNA, 64 nt, Human
ccuggagaacuagaaccuggagggcuagaacuggagaggcuagaaccaagaagggcuagaaccu

SEQ ID NO: 476738 - RNA, 64 nt, Human; identical to SEQ ID NO: 449693

SEQ ID NO: 476739 - RNA, 64 nt, Human; identical to SEQ ID NO: 449694

SEQ ID NO: 476740 - RNA, 64 nt, Human; identical to SEQ ID NO: 449695

SEQ ID NO: 476741 - RNA, 58 nt, Human; identical to SEQ ID NO: 381028

SEQ ID NO: 476742 - RNA, 64 nt, Human; identical to SEQ ID NO: 449697

SEQ ID NO: 476743 - RNA, 64 nt, Human; identical to SEQ ID NO: 449698

SEQ ID NO: 476744 - RNA, 64 nt, Human; identical to SEQ ID NO: 449702

SEQ ID NO: 476745 - RNA, 64 nt, Human; identical to SEQ ID NO: 449703

SEQ ID NO: 476746 - RNA, 64 nt, Human; identical to SEQ ID NO: 449704

SEQ ID NO: 476747 - RNA, 64 nt, Human; identical to SEQ ID NO: 449705

SEQ ID NO: 476748 - RNA, 64 nt, Human; identical to SEQ ID NO: 449706

SEQ ID NO: 476749 - RNA, 64 nt, Human; identical to SEQ ID NO: 449707

SEQ ID NO: 476750 - RNA, 64 nt, Human; identical to SEQ ID NO: 449708

SEQ ID NO: 476751 - RNA, 64 nt, Human; identical to SEQ ID NO: 449709

SEQ ID NO: 476752 - RNA, 64 nt, Human
gucuuguccugauucacugucauaaagcaugagcagaggcuagaaguaucaucuggauuguugu

SEQ ID NO: 476753 - RNA, 64 nt, Human
cucauuuuuucaugaguaugcagaggaguuuucaagaggcuaucuggugugauauuguaauagg

SEQ ID NO: 476754 - RNA, 64 nt, Human
aguuuugagaaaugucauuguauuuuggaguaaaagaggcuaucuuaguaauaagaaauaaacu

SEQ ID NO: 476755 - RNA, 64 nt, Human; identical to SEQ ID NO: 449710

SEQ ID NO: 476756 - RNA, 64 nt, Human; identical to SEQ ID NO: 449711

SEQ ID NO: 476757 - RNA, 64 nt, Human; identical to SEQ ID NO: 449712

SEQ ID NO: 476758 - RNA, 64 nt, Human; identical to SEQ ID NO: 449713

SEQ ID NO: 476759 - RNA, 64 nt, Human; identical to SEQ ID NO: 449714

SEQ ID NO: 476760 - RNA, 64 nt, Human; identical to SEQ ID NO: 449715

SEQ ID NO: 476761 - RNA, 64 nt, Human; identical to SEQ ID NO: 449716

SEQ ID NO: 476762 - RNA, 64 nt, Human; identical to SEQ ID NO: 449720

SEQ ID NO: 476763 - RNA, 64 nt, Human; identical to SEQ ID NO: 449721

SEQ ID NO: 476764 - RNA, 64 nt, Human; identical to SEQ ID NO: 449722

SEQ ID NO: 476765 - RNA, 64 nt, Human; identical to SEQ ID NO: 449723

SEQ ID NO: 476766 - RNA, 64 nt, Human; identical to SEQ ID NO: 449724

SEQ ID NO: 476767 - RNA, 64 nt, Human; identical to SEQ ID NO: 449725

SEQ ID NO: 476768 - RNA, 64 nt, Human; identical to SEQ ID NO: 449726

SEQ ID NO: 476769 - RNA, 62 nt, Human
ucuuaaguccucgaaggugaccuuauccuggcagaggcuauaaaagauucaccaggcacugg

SEQ ID NO: 476770 - RNA, 64 nt, Human
acuuguggaaaagaaaagguguagcacuuucagaagaggcuaucaaagaaaagagaugaacuug

SEQ ID NO: 476771 - RNA, 64 nt, Human
uccaccaucauccugacgaucccacaacugggacagaggcuacaucugcccuagggagguccuu

SEQ ID NO: 476772 - RNA, 64 nt, Human; identical to SEQ ID NO: 449727

SEQ ID NO: 476773 - RNA, 64 nt, Human; identical to SEQ ID NO: 449728

SEQ ID NO: 476774 - RNA, 64 nt, Human; identical to SEQ ID NO: 449729

SEQ ID NO: 476775 - RNA, 64 nt, Human; identical to SEQ ID NO: 449730

SEQ ID NO: 476776 - RNA, 64 nt, Human; identical to SEQ ID NO: 449731

SEQ ID NO: 476777 - RNA, 64 nt, Human; identical to SEQ ID NO: 449732

SEQ ID NO: 476778 - RNA, 64 nt, Human; identical to SEQ ID NO: 449733

SEQ ID NO: 476779 - RNA, 64 nt, Human; identical to SEQ ID NO: 449734

SEQ ID NO: 476780 - RNA, 64 nt, Human; identical to SEQ ID NO: 449738

SEQ ID NO: 476781 - RNA, 64 nt, Human; identical to SEQ ID NO: 449739

SEQ ID NO: 476782 - RNA, 64 nt, Human; identical to SEQ ID NO: 449740

SEQ ID NO: 476783 - RNA, 64 nt, Human; identical to SEQ ID NO: 449741

SEQ ID NO: 476784 - RNA, 64 nt, Human; identical to SEQ ID NO: 449742

SEQ ID NO: 476785 - RNA, 64 nt, Human; identical to SEQ ID NO: 449743

SEQ ID NO: 476786 - RNA, 64 nt, Human
accaaccaaagugugucaacccuguuuccuuaaaagaggcuaugaaucccaaaggccacaucca

SEQ ID NO: 476787 - RNA, 64 nt, Human
gucucaaggaauagcuuccuaaaguguugaguaaagaggcuaaauaaaaugagacuaguuuaau

SEQ ID NO: 476788 - RNA, 64 nt, Human
gaucucagggcacuuccguaaggcaaguccuuuuagaggcuaugaagaaaacagcugcauggca

SEQ ID NO: 476789 - RNA, 64 nt, Human; identical to SEQ ID NO: 449744

SEQ ID NO: 476790 - RNA, 64 nt, Human; identical to SEQ ID NO: 449745

SEQ ID NO: 476791 - RNA, 64 nt, Human; identical to SEQ ID NO: 449746

SEQ ID NO: 476792 - RNA, 64 nt, Human; identical to SEQ ID NO: 449747

SEQ ID NO: 476793 - RNA, 64 nt, Human; identical to SEQ ID NO: 449748

SEQ ID NO: 476794 - RNA, 64 nt, Human; identical to SEQ ID NO: 449749

SEQ ID NO: 476795 - RNA, 64 nt, Human; identical to SEQ ID NO: 449750

SEQ ID NO: 476796 - RNA, 64 nt, Human; identical to SEQ ID NO: 449751

SEQ ID NO: 476797 - RNA, 64 nt, Human; identical to SEQ ID NO: 449752

SEQ ID NO: 476798 - RNA, 64 nt, Human; identical to SEQ ID NO: 449756

SEQ ID NO: 476799 - RNA, 64 nt, Human; identical to SEQ ID NO: 449757

SEQ ID NO: 476800 - RNA, 64 nt, Human; identical to SEQ ID NO: 449758

SEQ ID NO: 476801 - RNA, 64 nt, Human; identical to SEQ ID NO: 449759

SEQ ID NO: 476802 - RNA, 64 nt, Human; identical to SEQ ID NO: 449760

SEQ ID NO: 476803 - RNA, 64 nt, Human
ugcuaucuuucucaaaauaauuuaaaaguaggcgagaggcuaggauguaccuauauuuaccaug

SEQ ID NO: 476804 - RNA, 64 nt, Human
acugcgagagaugguggaggccgcuaagcaugguagaggcuagaggaagucuauccacaggcag

SEQ ID NO: 476805 - RNA, 64 nt, Human
cuggagcaagaggagagguugcuggagcaagaggagaggcuacuggagcugcaggagagccugc

SEQ ID NO: 476806 - RNA, 64 nt, Human; identical to SEQ ID NO: 449761

SEQ ID NO: 476807 - RNA, 64 nt, Human; identical to SEQ ID NO: 449762

SEQ ID NO: 476808 - RNA, 64 nt, Human; identical to SEQ ID NO: 449763

SEQ ID NO: 476809 - RNA, 64 nt, Human; identical to SEQ ID NO: 449764

SEQ ID NO: 476810 - RNA, 64 nt, Human; identical to SEQ ID NO: 449765

SEQ ID NO: 476811 - RNA, 64 nt, Human; identical to SEQ ID NO: 449766

SEQ ID NO: 476812 - RNA, 64 nt, Human; identical to SEQ ID NO: 449767

SEQ ID NO: 476813 - RNA, 64 nt, Human; identical to SEQ ID NO: 449768

SEQ ID NO: 476814 - RNA, 64 nt, Human; identical to SEQ ID NO: 449769

SEQ ID NO: 476815 - RNA, 64 nt, Human; identical to SEQ ID NO: 449770

SEQ ID NO: 476816 - RNA, 64 nt, Human; identical to SEQ ID NO: 449774

SEQ ID NO: 476817 - RNA, 64 nt, Human; identical to SEQ ID NO: 449775

SEQ ID NO: 476818 - RNA, 64 nt, Human; identical to SEQ ID NO: 449776

SEQ ID NO: 476819 - RNA, 64 nt, Human; identical to SEQ ID NO: 449777

SEQ ID NO: 476820 - RNA, 64 nt, Human
aaagcaggugauuugucuuaaucagauaaaagauagaggcuaugggggccucaagauuuuugga

SEQ ID NO: 476821 - RNA, 64 nt, Human
gaauuauacuguggggccuugugagcugcuucuaagaggcuaaccuggaaacuaagcucagagg

SEQ ID NO: 476822 - RNA, 64 nt, Human
caguaauugcagguuguccagagguugguuugucagaggcuauugggaacagcugggcccaggg

SEQ ID NO: 476823 - RNA, 64 nt, Human; identical to SEQ ID NO: 449778

SEQ ID NO: 476824 - RNA, 64 nt, Human; identical to SEQ ID NO: 449779

SEQ ID NO: 476825 - RNA, 64 nt, Human; identical to SEQ ID NO: 449780

SEQ ID NO: 476826 - RNA, 64 nt, Human; identical to SEQ ID NO: 449781

SEQ ID NO: 476827 - RNA, 64 nt, Human; identical to SEQ ID NO: 449782

SEQ ID NO: 476828 - RNA, 64 nt, Human; identical to SEQ ID NO: 449783

SEQ ID NO: 476829 - RNA, 64 nt, Human; identical to SEQ ID NO: 449784

SEQ ID NO: 476830 - RNA, 64 nt, Human; identical to SEQ ID NO: 449785

SEQ ID NO: 476831 - RNA, 64 nt, Human; identical to SEQ ID NO: 449786

SEQ ID NO: 476832 - RNA, 64 nt, Human; identical to SEQ ID NO: 449787

SEQ ID NO: 476833 - RNA, 64 nt, Human; identical to SEQ ID NO: 449788

SEQ ID NO: 476834 - RNA, 64 nt, Human; identical to SEQ ID NO: 449792

SEQ ID NO: 476835 - RNA, 64 nt, Human; identical to SEQ ID NO: 449793

SEQ ID NO: 476836 - RNA, 64 nt, Human; identical to SEQ ID NO: 449794

SEQ ID NO: 476837 - RNA, 64 nt, Human
acucccugcuuccccugaacccccagcaaguugcagaggcuacugcccuugggaggcacucaug

SEQ ID NO: 476838 - RNA, 60 nt, Human
cuuugguuauggacacauaacuccugggccagaggcuaaaaccccaggaccccugcuguc

SEQ ID NO: 476839 - RNA, 64 nt, Human
cuguugauuuaaaauaucuugugguuaugauaucagaggcuaaauuuugaaauaaaauauuugg

SEQ ID NO: 476840 - RNA, 64 nt, Human; identical to SEQ ID NO: 449795

SEQ ID NO: 476841 - RNA, 64 nt, Human; identical to SEQ ID NO: 449796

SEQ ID NO: 476842 - RNA, 64 nt, Human; identical to SEQ ID NO: 449797

SEQ ID NO: 476843 - RNA, 64 nt, Human; identical to SEQ ID NO: 449798

SEQ ID NO: 476844 - RNA, 64 nt, Human; identical to SEQ ID NO: 449799

SEQ ID NO: 476845 - RNA, 64 nt, Human; identical to SEQ ID NO: 449800

SEQ ID NO: 476846 - RNA, 64 nt, Human; identical to SEQ ID NO: 449801

SEQ ID NO: 476847 - RNA, 64 nt, Human; identical to SEQ ID NO: 449802

SEQ ID NO: 476848 - RNA, 64 nt, Human; identical to SEQ ID NO: 449803

SEQ ID NO: 476849 - RNA, 64 nt, Human; identical to SEQ ID NO: 449804

SEQ ID NO: 476850 - RNA, 64 nt, Human; identical to SEQ ID NO: 449805

SEQ ID NO: 476851 - RNA, 64 nt, Human; identical to SEQ ID NO: 449806

SEQ ID NO: 476852 - RNA, 64 nt, Human; identical to SEQ ID NO: 449810

SEQ ID NO: 476853 - RNA, 63 nt, Human; identical to SEQ ID NO: 381122

SEQ ID NO: 476854 - RNA, 64 nt, Human
guucccagccugacaagcuuuccacucacaggggagaggcuacugcagaaccugacgguucagg

SEQ ID NO: 476855 - RNA, 64 nt, Human
uccaauaauccauauugaaagagucagcaccagcagaggcuacucgacuuaggacgcaacagag

SEQ ID NO: 476856 - RNA, 64 nt, Human
aguaggauauauuuguuuuggcagccuaucacgcagaggcuagugguauauuuauguaagaaaa

SEQ ID NO: 476857 - RNA, 64 nt, Human; identical to SEQ ID NO: 449812

SEQ ID NO: 476858 - RNA, 64 nt, Human; identical to SEQ ID NO: 449813

SEQ ID NO: 476859 - RNA, 64 nt, Human; identical to SEQ ID NO: 449814

SEQ ID NO: 476860 - RNA, 64 nt, Human; identical to SEQ ID NO: 449815

SEQ ID NO: 476861 - RNA, 64 nt, Human; identical to SEQ ID NO: 449816

SEQ ID NO: 476862 - RNA, 64 nt, Human; identical to SEQ ID NO: 449817

SEQ ID NO: 476863 - RNA, 64 nt, Human; identical to SEQ ID NO: 449818

SEQ ID NO: 476864 - RNA, 64 nt, Human; identical to SEQ ID NO: 449819

SEQ ID NO: 476865 - RNA, 64 nt, Human; identical to SEQ ID NO: 449820

SEQ ID NO: 476866 - RNA, 64 nt, Human; identical to SEQ ID NO: 449821

SEQ ID NO: 476867 - RNA, 64 nt, Human; identical to SEQ ID NO: 449822

SEQ ID NO: 476868 - RNA, 64 nt, Human; identical to SEQ ID NO: 449823

SEQ ID NO: 476869 - RNA, 64 nt, Human; identical to SEQ ID NO: 449824

SEQ ID NO: 476870 - RNA, 64 nt, Human; identical to SEQ ID NO: 449828

SEQ ID NO: 476871 - RNA, 64 nt, Human
cugauugacuuucagccuuuuuggcuagauccugagaggcuauuuuucuuacgaauauaccaac

SEQ ID NO: 476872 - RNA, 64 nt, Human
agagggggcagccagagcggcagcccccggccucagaggcuaucacaggcucagggcaaagaag

SEQ ID NO: 476873 - RNA, 64 nt, Human
uugcuguccuccuuacggaccaguuaccagauucagaggcuaacaguuaguuacuuguuaaugc

SEQ ID NO: 476874 - RNA, 64 nt, Human; identical to SEQ ID NO: 449829

SEQ ID NO: 476875 - RNA, 64 nt, Human; identical to SEQ ID NO: 449830

SEQ ID NO: 476876 - RNA, 64 nt, Human; identical to SEQ ID NO: 449831

SEQ ID NO: 476877 - RNA, 64 nt, Human; identical to SEQ ID NO: 449832

SEQ ID NO: 476878 - RNA, 64 nt, Human; identical to SEQ ID NO: 449833

SEQ ID NO: 476879 - RNA, 64 nt, Human; identical to SEQ ID NO: 449834

SEQ ID NO: 476880 - RNA, 64 nt, Human; identical to SEQ ID NO: 449835

SEQ ID NO: 476881 - RNA, 64 nt, Human; identical to SEQ ID NO: 449836

SEQ ID NO: 476882 - RNA, 64 nt, Human; identical to SEQ ID NO: 449837

SEQ ID NO: 476883 - RNA, 64 nt, Human; identical to SEQ ID NO: 449838

SEQ ID NO: 476884 - RNA, 64 nt, Human; identical to SEQ ID NO: 449839

SEQ ID NO: 476885 - RNA, 64 nt, Human; identical to SEQ ID NO: 449840

SEQ ID NO: 476886 - RNA, 64 nt, Human; identical to SEQ ID NO: 449841

SEQ ID NO: 476887 - RNA, 64 nt, Human; identical to SEQ ID NO: 449842

SEQ ID NO: 476888 - RNA, 64 nt, Human
uuguugcaggcuguggguuuuggugugguuugucagaggcuaauucugcagaguuuccaaaacc

SEQ ID NO: 476889 - RNA, 64 nt, Human
uaaaaaaaaagaaagaaaguuaucucuucccaggagaggcuagaaguagcuuuucugucuuuug

SEQ ID NO: 476890 - RNA, 64 nt, Human
cgaagaagagaauuaggaccugcuauccacugggagaggcuaucagccaguccugggacuugga

SEQ ID NO: 476891 - RNA, 64 nt, Human; identical to SEQ ID NO: 449846

SEQ ID NO: 476892 - RNA, 64 nt, Human; identical to SEQ ID NO: 449847

SEQ ID NO: 476893 - RNA, 64 nt, Human; identical to SEQ ID NO: 449848

SEQ ID NO: 476894 - RNA, 64 nt, Human; identical to SEQ ID NO: 449849

SEQ ID NO: 476895 - RNA, 64 nt, Human; identical to SEQ ID NO: 449850

SEQ ID NO: 476896 - RNA, 64 nt, Human; identical to SEQ ID NO: 449851

SEQ ID NO: 476897 - RNA, 64 nt, Human; identical to SEQ ID NO: 449852

SEQ ID NO: 476898 - RNA, 64 nt, Human; identical to SEQ ID NO: 449853

SEQ ID NO: 476899 - RNA, 64 nt, Human; identical to SEQ ID NO: 449854

SEQ ID NO: 476900 - RNA, 64 nt, Human; identical to SEQ ID NO: 449855

SEQ ID NO: 476901 - RNA, 64 nt, Human; identical to SEQ ID NO: 449856

SEQ ID NO: 476902 - RNA, 64 nt, Human; identical to SEQ ID NO: 449857

SEQ ID NO: 476903 - RNA, 64 nt, Human; identical to SEQ ID NO: 449858

SEQ ID NO: 476904 - RNA, 64 nt, Human; identical to SEQ ID NO: 449859

SEQ ID NO: 476905 - RNA, 64 nt, Human
auaagcuaacaccagacagacaacacugggaaacagaggcuauuguccccuaaaccaaaaacug

SEQ ID NO: 476906 - RNA, 64 nt, Human
acucccuuucucccuggacuugaucugcuguuucagaggcuagguuguuucugugggugccuua

SEQ ID NO: 476907 - RNA, 64 nt, Human
uccuugugaguagcucucaacuguccuggagagcagaggcuauuuggggucggaggagcccucg

SEQ ID NO: 476908 - RNA, 64 nt, Human; identical to SEQ ID NO: 449860

SEQ ID NO: 476909 - RNA, 64 nt, Human; identical to SEQ ID NO: 449864

SEQ ID NO: 476910 - RNA, 64 nt, Human; identical to SEQ ID NO: 449865

SEQ ID NO: 476911 - RNA, 64 nt, Human; identical to SEQ ID NO: 449866

SEQ ID NO: 476912 - RNA, 64 nt, Human; identical to SEQ ID NO: 449867

SEQ ID NO: 476913 - RNA, 64 nt, Human; identical to SEQ ID NO: 449868

SEQ ID NO: 476914 - RNA, 64 nt, Human; identical to SEQ ID NO: 449869

SEQ ID NO: 476915 - RNA, 64 nt, Human; identical to SEQ ID NO: 449870

SEQ ID NO: 476916 - RNA, 64 nt, Human; identical to SEQ ID NO: 449871

SEQ ID NO: 476917 - RNA, 64 nt, Human; identical to SEQ ID NO: 449872

SEQ ID NO: 476918 - RNA, 64 nt, Human; identical to SEQ ID NO: 449873

SEQ ID NO: 476919 - RNA, 64 nt, Human; identical to SEQ ID NO: 449874

SEQ ID NO: 476920 - RNA, 64 nt, Human; identical to SEQ ID NO: 449875

SEQ ID NO: 476921 - RNA, 64 nt, Human; identical to SEQ ID NO: 449876

SEQ ID NO: 476922 - RNA, 64 nt, Human
uaugauggggagggggugccccuacccaccuccaagaggcuacagcccugugucuggccaugug

SEQ ID NO: 476923 - RNA, 64 nt, Human
uuuagauccaaauaaccauguccuccuagaguuuagaggcuagagggagcugaggggaggaucu

SEQ ID NO: 476924 - RNA, 64 nt, Human
aagugucacaacugcacuaaagacaaauagcacuagaggcuauugccacugugacgcuuuugag

SEQ ID NO: 476925 - RNA, 64 nt, Human; identical to SEQ ID NO: 449877

SEQ ID NO: 476926 - RNA, 64 nt, Human; identical to SEQ ID NO: 449878

SEQ ID NO: 476927 - RNA, 64 nt, Human; identical to SEQ ID NO: 449879

SEQ ID NO: 476928 - RNA, 64 nt, Human; identical to SEQ ID NO: 449880

SEQ ID NO: 476929 - RNA, 64 nt, Human; identical to SEQ ID NO: 449881

SEQ ID NO: 476930 - RNA, 64 nt, Human; identical to SEQ ID NO: 449882

SEQ ID NO: 476931 - RNA, 64 nt, Human; identical to SEQ ID NO: 449883

SEQ ID NO: 476932 - RNA, 64 nt, Human; identical to SEQ ID NO: 449884

SEQ ID NO: 476933 - RNA, 64 nt, Human; identical to SEQ ID NO: 449885

SEQ ID NO: 476934 - RNA, 64 nt, Human; identical to SEQ ID NO: 449886

SEQ ID NO: 476935 - RNA, 64 nt, Human; identical to SEQ ID NO: 449887

SEQ ID NO: 476936 - RNA, 64 nt, Human; identical to SEQ ID NO: 449888

SEQ ID NO: 476937 - RNA, 64 nt, Human; identical to SEQ ID NO: 449889

SEQ ID NO: 476938 - RNA, 64 nt, Human; identical to SEQ ID NO: 449890

SEQ ID NO: 476939 - RNA, 64 nt, Human
aagggccaagaaaaauaugcaucuugauuuggagagaggcuaauauuaugcacacuguaagaga

SEQ ID NO: 476940 - RNA, 64 nt, Human
ccacacucaugaagaaagaacacaggaguagcugagaggcuaaaacucaucaaaaacacuacuc

SEQ ID NO: 476941 - RNA, 64 nt, Human
uagacaggagaagaaagaacuaucuucaucugagagaggcuaaaauguuuucagcuaggaacaa

SEQ ID NO: 476942 - RNA, 64 nt, Human; identical to SEQ ID NO: 449891

SEQ ID NO: 476943 - RNA, 64 nt, Human; identical to SEQ ID NO: 449892

SEQ ID NO: 476944 - RNA, 64 nt, Human; identical to SEQ ID NO: 449893

SEQ ID NO: 476945 - RNA, 64 nt, Human; identical to SEQ ID NO: 449896

SEQ ID NO: 476946 - RNA, 64 nt, Human; identical to SEQ ID NO: 449897

SEQ ID NO: 476947 - RNA, 64 nt, Human; identical to SEQ ID NO: 449898

SEQ ID NO: 476948 - RNA, 64 nt, Human; identical to SEQ ID NO: 449899

SEQ ID NO: 476949 - RNA, 64 nt, Human; identical to SEQ ID NO: 449900

SEQ ID NO: 476950 - RNA, 64 nt, Human; identical to SEQ ID NO: 449901

SEQ ID NO: 476951 - RNA, 64 nt, Human; identical to SEQ ID NO: 449902

SEQ ID NO: 476952 - RNA, 64 nt, Human; identical to SEQ ID NO: 449903

SEQ ID NO: 476953 - RNA, 64 nt, Human; identical to SEQ ID NO: 449904

SEQ ID NO: 476954 - RNA, 64 nt, Human; identical to SEQ ID NO: 449905

SEQ ID NO: 476955 - RNA, 53 nt, Human; identical to SEQ ID NO: 381206

SEQ ID NO: 476956 - RNA, 64 nt, Human
aacaaauuuauauuugccaaggauauuaggcaaaagaggcuacuugauugguggccaaccucgu

SEQ ID NO: 476957 - RNA, 64 nt, Human
uuaacuuuuaauguggcaaguuugcagaugucauagaggcuauccuggagacuuaauagacauu

SEQ ID NO: 476958 - RNA, 64 nt, Human
auauuucuaguuaucacuuaagcacucaaucauuagaggcuacaagaauaauauuuuuaaaguu

SEQ ID NO: 476959 - RNA, 64 nt, Human; identical to SEQ ID NO: 449907

SEQ ID NO: 476960 - RNA, 64 nt, Human; identical to SEQ ID NO: 449908

SEQ ID NO: 476961 - RNA, 64 nt, Human; identical to SEQ ID NO: 449909

SEQ ID NO: 476962 - RNA, 64 nt, Human; identical to SEQ ID NO: 449910

SEQ ID NO: 476963 - RNA, 64 nt, Human; identical to SEQ ID NO: 449914

SEQ ID NO: 476964 - RNA, 64 nt, Human; identical to SEQ ID NO: 449915

SEQ ID NO: 476965 - RNA, 64 nt, Human; identical to SEQ ID NO: 449916

SEQ ID NO: 476966 - RNA, 64 nt, Human; identical to SEQ ID NO: 449917

SEQ ID NO: 476967 - RNA, 59 nt, Human; identical to SEQ ID NO: 381215

SEQ ID NO: 476968 - RNA, 64 nt, Human; identical to SEQ ID NO: 449919

SEQ ID NO: 476969 - RNA, 64 nt, Human; identical to SEQ ID NO: 449920

SEQ ID NO: 476970 - RNA, 64 nt, Human; identical to SEQ ID NO: 449921

SEQ ID NO: 476971 - RNA, 64 nt, Human; identical to SEQ ID NO: 449922

SEQ ID NO: 476972 - RNA, 64 nt, Human; identical to SEQ ID NO: 449923

SEQ ID NO: 476973 - RNA, 64 nt, Human
gaauucugucucaucaguucuucacagugagaaaagaggcuagaugauggugugggggguugga

SEQ ID NO: 476974 - RNA, 64 nt, Human
uaaaacaucagacucaccauccaggugcagcuccagaggcuacaaaaggcuucaugggacuuga

SEQ ID NO: 476975 - RNA, 64 nt, Human
ucgucaugauugagugaucuuuacauuugauuccagaggcuauguucaguuguuaguugggaaa

SEQ ID NO: 476976 - RNA, 64 nt, Human; identical to SEQ ID NO: 449924

SEQ ID NO: 476977 - RNA, 64 nt, Human; identical to SEQ ID NO: 449925

SEQ ID NO: 476978 - RNA, 64 nt, Human; identical to SEQ ID NO: 449926

SEQ ID NO: 476979 - RNA, 64 nt, Human; identical to SEQ ID NO: 449927

SEQ ID NO: 476980 - RNA, 64 nt, Human; identical to SEQ ID NO: 449928

SEQ ID NO: 476981 - RNA, 64 nt, Human; identical to SEQ ID NO: 449931

SEQ ID NO: 476982 - RNA, 64 nt, Human; identical to SEQ ID NO: 449932

SEQ ID NO: 476983 - RNA, 64 nt, Human; identical to SEQ ID NO: 449933

SEQ ID NO: 476984 - RNA, 64 nt, Human; identical to SEQ ID NO: 449934

SEQ ID NO: 476985 - RNA, 64 nt, Human; identical to SEQ ID NO: 449935

SEQ ID NO: 476986 - RNA, 64 nt, Human; identical to SEQ ID NO: 449936

SEQ ID NO: 476987 - RNA, 64 nt, Human; identical to SEQ ID NO: 449937

SEQ ID NO: 476988 - RNA, 64 nt, Human; identical to SEQ ID NO: 449938

SEQ ID NO: 476989 - RNA, 64 nt, Human; identical to SEQ ID NO: 449939

SEQ ID NO: 476990 - RNA, 64 nt, Human
agggaggaaggccuuucuucuguguuaauugcguagaggcuacagggguuagccuggacuaaag

SEQ ID NO: 476991 - RNA, 64 nt, Human
uuccuuaguuucuguaagccuguuaacagaaaguagaggcuauucaagguuaucaagaaagugc

SEQ ID NO: 476992 - RNA, 64 nt, Human
aagagcucaauugcucugagcucagccaaguaggagaggcuaggccaucacucuuaggaagcug

SEQ ID NO: 476993 - RNA, 64 nt, Human; identical to SEQ ID NO: 449940

SEQ ID NO: 476994 - RNA, 64 nt, Human; identical to SEQ ID NO: 449941

SEQ ID NO: 476995 - RNA, 64 nt, Human; identical to SEQ ID NO: 449942

SEQ ID NO: 476996 - RNA, 64 nt, Human; identical to SEQ ID NO: 449943

SEQ ID NO: 476997 - RNA, 64 nt, Human; identical to SEQ ID NO: 449944

SEQ ID NO: 476998 - RNA, 64 nt, Human; identical to SEQ ID NO: 449945

SEQ ID NO: 476999 - RNA, 64 nt, Human; identical to SEQ ID NO: 449948

SEQ ID NO: 477000 - RNA, 64 nt, Human; identical to SEQ ID NO: 449949

SEQ ID NO: 477001 - RNA, 64 nt, Human; identical to SEQ ID NO: 449950

SEQ ID NO: 477002 - RNA, 64 nt, Human; identical to SEQ ID NO: 449951

SEQ ID NO: 477003 - RNA, 64 nt, Human; identical to SEQ ID NO: 449952

SEQ ID NO: 477004 - RNA, 64 nt, Human; identical to SEQ ID NO: 449953

SEQ ID NO: 477005 - RNA, 64 nt, Human; identical to SEQ ID NO: 449954

SEQ ID NO: 477006 - RNA, 64 nt, Human; identical to SEQ ID NO: 449955

SEQ ID NO: 477007 - RNA, 64 nt, Human
gaggacugucuccaaggaggccaaauggaaaaggagaggcuacuucaagugguguuggcccauu

SEQ ID NO: 477008 - RNA, 64 nt, Human
uguaaaaugucuguucuacuucacacaguggucgagaggcuaaaauaaaaugaaaagcauaaaa

SEQ ID NO: 477009 - RNA, 64 nt, Human
cccaucugcagggcugagucaguuggggaacaccagaggcuacacaguagcucuuccugcuacu

SEQ ID NO: 477010 - RNA, 64 nt, Human; identical to SEQ ID NO: 449956

SEQ ID NO: 477011 - RNA, 64 nt, Human; identical to SEQ ID NO: 449957

SEQ ID NO: 477012 - RNA, 64 nt, Human; identical to SEQ ID NO: 449958

SEQ ID NO: 477013 - RNA, 64 nt, Human; identical to SEQ ID NO: 449959

SEQ ID NO: 477014 - RNA, 64 nt, Human; identical to SEQ ID NO: 449960

SEQ ID NO: 477015 - RNA, 64 nt, Human; identical to SEQ ID NO: 449961

SEQ ID NO: 477016 - RNA, 64 nt, Human; identical to SEQ ID NO: 449962

SEQ ID NO: 477017 - RNA, 64 nt, Human; identical to SEQ ID NO: 449966

SEQ ID NO: 477018 - RNA, 50 nt, Human; identical to SEQ ID NO: 381257

SEQ ID NO: 477019 - RNA, 64 nt, Human; identical to SEQ ID NO: 449968

SEQ ID NO: 477020 - RNA, 64 nt, Human; identical to SEQ ID NO: 449969

SEQ ID NO: 477021 - RNA, 64 nt, Human; identical to SEQ ID NO: 449970

SEQ ID NO: 477022 - RNA, 64 nt, Human; identical to SEQ ID NO: 449971

SEQ ID NO: 477023 - RNA, 64 nt, Human; identical to SEQ ID NO: 449972

SEQ ID NO: 477024 - RNA, 64 nt, Human
auggcuuuucagacucagcagggugacuugccucagaggcuauaucccagugggggaacaaaga

SEQ ID NO: 477025 - RNA, 64 nt, Human
agggccuacuccucuuauggucccuucuagauccagaggcuaagaggaagacuggccaggccca

SEQ ID NO: 477026 - RNA, 64 nt, Human
ggcaaacugcaaggcaguugagauaguuggauuaagaggcuagacgagacauagaauacuauug

SEQ ID NO: 477027 - RNA, 64 nt, Human; identical to SEQ ID NO: 449973

SEQ ID NO: 477028 - RNA, 64 nt, Human; identical to SEQ ID NO: 449974

SEQ ID NO: 477029 - RNA, 64 nt, Human; identical to SEQ ID NO: 449975

SEQ ID NO: 477030 - RNA, 64 nt, Human; identical to SEQ ID NO: 449976

SEQ ID NO: 477031 - RNA, 64 nt, Human; identical to SEQ ID NO: 449977

SEQ ID NO: 477032 - RNA, 64 nt, Human; identical to SEQ ID NO: 449978

SEQ ID NO: 477033 - RNA, 64 nt, Human; identical to SEQ ID NO: 449979

SEQ ID NO: 477034 - RNA, 64 nt, Human; identical to SEQ ID NO: 449980

SEQ ID NO: 477035 - RNA, 64 nt, Human; identical to SEQ ID NO: 449983

SEQ ID NO: 477036 - RNA, 64 nt, Human; identical to SEQ ID NO: 449984

SEQ ID NO: 477037 - RNA, 64 nt, Human; identical to SEQ ID NO: 449985

SEQ ID NO: 477038 - RNA, 64 nt, Human; identical to SEQ ID NO: 449986

SEQ ID NO: 477039 - RNA, 64 nt, Human; identical to SEQ ID NO: 449987

SEQ ID NO: 477040 - RNA, 64 nt, Human; identical to SEQ ID NO: 449988

SEQ ID NO: 477041 - RNA, 64 nt, Human
gacuggcguguguggagcguggaagcaggagggcagaggcuacagcuguggaaacgaggccaug

SEQ ID NO: 477042 - RNA, 64 nt, Human
gguuacacccaucugguugucccacccacucuucagaggcuaggccccaccucuggggguugga

SEQ ID NO: 477043 - RNA, 64 nt, Human
ucaucaguaagugccaugucucuaccaugccaucagaggcuaauuuccuguaaaaguuguggaa

SEQ ID NO: 477044 - RNA, 64 nt, Human; identical to SEQ ID NO: 449989

SEQ ID NO: 477045 - RNA, 64 nt, Human; identical to SEQ ID NO: 449990

SEQ ID NO: 477046 - RNA, 64 nt, Human; identical to SEQ ID NO: 449991

SEQ ID NO: 477047 - RNA, 64 nt, Human; identical to SEQ ID NO: 449992

SEQ ID NO: 477048 - RNA, 64 nt, Human; identical to SEQ ID NO: 449993

SEQ ID NO: 477049 - RNA, 64 nt, Human; identical to SEQ ID NO: 449994

SEQ ID NO: 477050 - RNA, 64 nt, Human; identical to SEQ ID NO: 449995

SEQ ID NO: 477051 - RNA, 64 nt, Human; identical to SEQ ID NO: 449996

SEQ ID NO: 477052 - RNA, 64 nt, Human; identical to SEQ ID NO: 449997

SEQ ID NO: 477053 - RNA, 64 nt, Human; identical to SEQ ID NO: 450000

SEQ ID NO: 477054 - RNA, 64 nt, Human; identical to SEQ ID NO: 450001

SEQ ID NO: 477055 - RNA, 64 nt, Human; identical to SEQ ID NO: 450002

SEQ ID NO: 477056 - RNA, 64 nt, Human; identical to SEQ ID NO: 450003

SEQ ID NO: 477057 - RNA, 64 nt, Human; identical to SEQ ID NO: 450004

SEQ ID NO: 477058 - RNA, 64 nt, Human
ccguggacuaccaagcuggcuuguuucuuaugccagaggcuaacagauccaaugggaguccaug

SEQ ID NO: 477059 - RNA, 64 nt, Human
uuuacucagcucugguauugcucauaacuuaccaagaggcuaauacuaaacuuggaaaauuguu

SEQ ID NO: 477060 - RNA, 64 nt, Human
ccugagugcugccacaagccuggaacaguccugcagaggcuacaauccccggauggggacccuu

SEQ ID NO: 477061 - RNA, 64 nt, Human; identical to SEQ ID NO: 450005

SEQ ID NO: 477062 - RNA, 64 nt, Human; identical to SEQ ID NO: 450006

SEQ ID NO: 477063 - RNA, 64 nt, Human; identical to SEQ ID NO: 450007

SEQ ID NO: 477064 - RNA, 64 nt, Human; identical to SEQ ID NO: 450008

SEQ ID NO: 477065 - RNA, 64 nt, Human; identical to SEQ ID NO: 450009

SEQ ID NO: 477066 - RNA, 64 nt, Human; identical to SEQ ID NO: 450010

SEQ ID NO: 477067 - RNA, 64 nt, Human; identical to SEQ ID NO: 450011

SEQ ID NO: 477068 - RNA, 64 nt, Human; identical to SEQ ID NO: 450012

SEQ ID NO: 477069 - RNA, 64 nt, Human; identical to SEQ ID NO: 450013

SEQ ID NO: 477070 - RNA, 64 nt, Human; identical to SEQ ID NO: 450014

SEQ ID NO: 477071 - RNA, 64 nt, Human; identical to SEQ ID NO: 450018

SEQ ID NO: 477072 - RNA, 64 nt, Human; identical to SEQ ID NO: 450019

SEQ ID NO: 477073 - RNA, 64 nt, Human; identical to SEQ ID NO: 450020

SEQ ID NO: 477074 - RNA, 64 nt, Human; identical to SEQ ID NO: 450021

SEQ ID NO: 477075 - RNA, 64 nt, Human
agggaacuaaagggugugggucagggaggggucuagaggcuauuccuaggccucaggccuccca

SEQ ID NO: 477076 - RNA, 64 nt, Human
accuacagggagccucugagccuacucuaguucaagaggcuaccugaaaaaaaauaaauaagau

SEQ ID NO: 477077 - RNA, 64 nt, Human
cccgcaggauuggagaggcacauucccuugggacagaggcuacagguuggagcuuuuuuucccc

SEQ ID NO: 477078 - RNA, 64 nt, Human; identical to SEQ ID NO: 450022

SEQ ID NO: 477079 - RNA, 64 nt, Human; identical to SEQ ID NO: 450023

SEQ ID NO: 477080 - RNA, 64 nt, Human; identical to SEQ ID NO: 450024

SEQ ID NO: 477081 - RNA, 64 nt, Human; identical to SEQ ID NO: 450025

SEQ ID NO: 477082 - RNA, 64 nt, Human; identical to SEQ ID NO: 450026

SEQ ID NO: 477083 - RNA, 64 nt, Human; identical to SEQ ID NO: 450027

SEQ ID NO: 477084 - RNA, 64 nt, Human; identical to SEQ ID NO: 450028

SEQ ID NO: 477085 - RNA, 64 nt, Human; identical to SEQ ID NO: 450029

SEQ ID NO: 477086 - RNA, 64 nt, Human; identical to SEQ ID NO: 450030

SEQ ID NO: 477087 - RNA, 64 nt, Human; identical to SEQ ID NO: 450031

SEQ ID NO: 477088 - RNA, 64 nt, Human; identical to SEQ ID NO: 450032

SEQ ID NO: 477089 - RNA, 64 nt, Human; identical to SEQ ID NO: 450036

SEQ ID NO: 477090 - RNA, 64 nt, Human; identical to SEQ ID NO: 450037

SEQ ID NO: 477091 - RNA, 64 nt, Human; identical to SEQ ID NO: 450038

SEQ ID NO: 477092 - RNA, 64 nt, Human
cuaaaauagcucuaucgcucugcggagucccagcagaggcuauggaauguuucugcaacccuaa

SEQ ID NO: 477093 - RNA, 59 nt, Human
ugaauguucagacggucugaggcagucucagaggcuaguauggggcuagaugaagccca

SEQ ID NO: 477094 - RNA, 64 nt, Human
auuuccuguuucugaaccaaguaaaaucaguccuagaggcuaugguucuuaaucuauggagcuu

SEQ ID NO: 477095 - RNA, 64 nt, Human; identical to SEQ ID NO: 450039

SEQ ID NO: 477096 - RNA, 64 nt, Human; identical to SEQ ID NO: 450040

SEQ ID NO: 477097 - RNA, 64 nt, Human; identical to SEQ ID NO: 450041

SEQ ID NO: 477098 - RNA, 64 nt, Human; identical to SEQ ID NO: 450042

SEQ ID NO: 477099 - RNA, 64 nt, Human; identical to SEQ ID NO: 450043

SEQ ID NO: 477100 - RNA, 64 nt, Human; identical to SEQ ID NO: 450044

SEQ ID NO: 477101 - RNA, 64 nt, Human; identical to SEQ ID NO: 450045

SEQ ID NO: 477102 - RNA, 64 nt, Human; identical to SEQ ID NO: 450046

SEQ ID NO: 477103 - RNA, 64 nt, Human; identical to SEQ ID NO: 450047

SEQ ID NO: 477104 - RNA, 64 nt, Human; identical to SEQ ID NO: 450048

SEQ ID NO: 477105 - RNA, 64 nt, Human; identical to SEQ ID NO: 450049

SEQ ID NO: 477106 - RNA, 64 nt, Human; identical to SEQ ID NO: 450050

SEQ ID NO: 477107 - RNA, 64 nt, Human; identical to SEQ ID NO: 450054

SEQ ID NO: 477108 - RNA, 64 nt, Human; identical to SEQ ID NO: 450055

SEQ ID NO: 477109 - RNA, 64 nt, Human
agggggucuguggaagauucaggagaaagaaaggagaggcuagggugguguggaggggcugguc

SEQ ID NO: 477110 - RNA, 64 nt, Human
gaggcucuaagcuucucaugugguacguuuagacagaggcuaaaucugcacacuagaaucuuga

SEQ ID NO: 477111 - RNA, 64 nt, Human
caucuccaguuuauagaccagaaccagagcucagagaggcuagaugauugauuaccaagugccg

SEQ ID NO: 477112 - RNA, 64 nt, Human; identical to SEQ ID NO: 450056

SEQ ID NO: 477113 - RNA, 64 nt, Human; identical to SEQ ID NO: 450057

SEQ ID NO: 477114 - RNA, 64 nt, Human; identical to SEQ ID NO: 450058

SEQ ID NO: 477115 - RNA, 64 nt, Human; identical to SEQ ID NO: 450059

SEQ ID NO: 477116 - RNA, 64 nt, Human; identical to SEQ ID NO: 450060

SEQ ID NO: 477117 - RNA, 64 nt, Human; identical to SEQ ID NO: 450061

SEQ ID NO: 477118 - RNA, 64 nt, Human; identical to SEQ ID NO: 450062

SEQ ID NO: 477119 - RNA, 64 nt, Human; identical to SEQ ID NO: 450063

SEQ ID NO: 477120 - RNA, 64 nt, Human; identical to SEQ ID NO: 450064

SEQ ID NO: 477121 - RNA, 64 nt, Human; identical to SEQ ID NO: 450065

SEQ ID NO: 477122 - RNA, 64 nt, Human; identical to SEQ ID NO: 450066

SEQ ID NO: 477123 - RNA, 52 nt, Human; identical to SEQ ID NO: 381344

SEQ ID NO: 477124 - RNA, 64 nt, Human; identical to SEQ ID NO: 450068

SEQ ID NO: 477125 - RNA, 64 nt, Human; identical to SEQ ID NO: 450072

SEQ ID NO: 477126 - RNA, 64 nt, Human
acccccgcuccccaacccuucuugccuggguaggagaggcuaaagaucacccuaaauuuacuca

SEQ ID NO: 477127 - RNA, 64 nt, Human
uaaagucuauuguuuguugugcuugcugguacuaagaggcuauuuaaaaguauaaaacugcuuu

SEQ ID NO: 477128 - RNA, 64 nt, Human
ggagacuccuaccucaauaguuaauggaauaauaagaggcuacuguugugucuaauguucuuca

SEQ ID NO: 477129 - RNA, 64 nt, Human; identical to SEQ ID NO: 450073

SEQ ID NO: 477130 - RNA, 64 nt, Human; identical to SEQ ID NO: 450074

SEQ ID NO: 477131 - RNA, 64 nt, Human; identical to SEQ ID NO: 450075

SEQ ID NO: 477132 - RNA, 64 nt, Human; identical to SEQ ID NO: 450076

SEQ ID NO: 477133 - RNA, 64 nt, Human; identical to SEQ ID NO: 450077

SEQ ID NO: 477134 - RNA, 64 nt, Human; identical to SEQ ID NO: 450078

SEQ ID NO: 477135 - RNA, 52 nt, Human; identical to SEQ ID NO: 381351

SEQ ID NO: 477136 - RNA, 64 nt, Human; identical to SEQ ID NO: 450080

SEQ ID NO: 477137 - RNA, 64 nt, Human; identical to SEQ ID NO: 450081

SEQ ID NO: 477138 - RNA, 64 nt, Human; identical to SEQ ID NO: 450082

SEQ ID NO: 477139 - RNA, 64 nt, Human; identical to SEQ ID NO: 450083

SEQ ID NO: 477140 - RNA, 64 nt, Human; identical to SEQ ID NO: 450084

SEQ ID NO: 477141 - RNA, 64 nt, Human; identical to SEQ ID NO: 450085

SEQ ID NO: 477142 - RNA, 64 nt, Human; identical to SEQ ID NO: 450086

SEQ ID NO: 477143 - RNA, 64 nt, Human
uauaauaguccuagaguuugcagcugguaaaaccagaggcuacauccaguauuacugcuaagag

SEQ ID NO: 477144 - RNA, 64 nt, Human
uggguugaugaggcagaggggauucaaaugugugagaggcuagauucaaagacccucaguguuc

SEQ ID NO: 477145 - RNA, 64 nt, Human
gggaguuuagaucagcuuuacagauacaucgaucagaggcuaaaaugaaaccucagccuaaaac

SEQ ID NO: 477146 - RNA, 64 nt, Human; identical to SEQ ID NO: 450090

SEQ ID NO: 477147 - RNA, 64 nt, Human; identical to SEQ ID NO: 450091

SEQ ID NO: 477148 - RNA, 64 nt, Human; identical to SEQ ID NO: 450092

SEQ ID NO: 477149 - RNA, 64 nt, Human; identical to SEQ ID NO: 450093

SEQ ID NO: 477150 - RNA, 64 nt, Human; identical to SEQ ID NO: 450094

SEQ ID NO: 477151 - RNA, 64 nt, Human; identical to SEQ ID NO: 450095

SEQ ID NO: 477152 - RNA, 54 nt, Human; identical to SEQ ID NO: 381367

SEQ ID NO: 477153 - RNA, 64 nt, Human; identical to SEQ ID NO: 450097

SEQ ID NO: 477154 - RNA, 64 nt, Human; identical to SEQ ID NO: 450098

SEQ ID NO: 477155 - RNA, 64 nt, Human; identical to SEQ ID NO: 450099

SEQ ID NO: 477156 - RNA, 64 nt, Human; identical to SEQ ID NO: 450100

SEQ ID NO: 477157 - RNA, 64 nt, Human; identical to SEQ ID NO: 450101

SEQ ID NO: 477158 - RNA, 64 nt, Human; identical to SEQ ID NO: 450102

SEQ ID NO: 477159 - RNA, 64 nt, Human; identical to SEQ ID NO: 450103

SEQ ID NO: 477160 - RNA, 64 nt, Human
uggguuuggauacccuuagugggaugauguaaauagaggcuagcuaccuaggcuugucuauagc

SEQ ID NO: 477161 - RNA, 64 nt, Human
ugaugaacaucgaacauaucuacuucauuagagcagaggcuauuuuucugcauucuugucccua

SEQ ID NO: 477162 - RNA, 64 nt, Human
guaauucuaaaccugcacuugucccucuccagcaagaggcuagcacugaauucauucuacucau

SEQ ID NO: 477163 - RNA, 64 nt, Human; identical to SEQ ID NO: 450104

SEQ ID NO: 477164 - RNA, 64 nt, Human; identical to SEQ ID NO: 450108

SEQ ID NO: 477165 - RNA, 64 nt, Human; identical to SEQ ID NO: 450109

SEQ ID NO: 477166 - RNA, 64 nt, Human; identical to SEQ ID NO: 450110

SEQ ID NO: 477167 - RNA, 64 nt, Human; identical to SEQ ID NO: 450111

SEQ ID NO: 477168 - RNA, 64 nt, Human; identical to SEQ ID NO: 450112

SEQ ID NO: 477169 - RNA, 64 nt, Human; identical to SEQ ID NO: 450113

SEQ ID NO: 477170 - RNA, 64 nt, Human; identical to SEQ ID NO: 450114

SEQ ID NO: 477171 - RNA, 64 nt, Human; identical to SEQ ID NO: 450115

SEQ ID NO: 477172 - RNA, 64 nt, Human; identical to SEQ ID NO: 450116

SEQ ID NO: 477173 - RNA, 64 nt, Human; identical to SEQ ID NO: 450117

SEQ ID NO: 477174 - RNA, 64 nt, Human; identical to SEQ ID NO: 450118

SEQ ID NO: 477175 - RNA, 64 nt, Human; identical to SEQ ID NO: 450119

SEQ ID NO: 477176 - RNA, 64 nt, Human; identical to SEQ ID NO: 450120

SEQ ID NO: 477177 - RNA, 64 nt, Human
gcauuuuuauugaaagauacucacaggauuuuccagaggcuaaauaacaugcaauugcauaauu

SEQ ID NO: 477178 - RNA, 64 nt, Human
gcaccuaugagcaguugccuaccauguguccaccagaggcuauuuaauucaugccaacuugaaa

SEQ ID NO: 477179 - RNA, 64 nt, Human
cacaguuuacugggggaaaaggcuucaguaaagcagaggcuagaauuacaguauuuauacauag

SEQ ID NO: 477180 - RNA, 64 nt, Human; identical to SEQ ID NO: 450121

SEQ ID NO: 477181 - RNA, 64 nt, Human; identical to SEQ ID NO: 450122

SEQ ID NO: 477182 - RNA, 64 nt, Human; identical to SEQ ID NO: 450126

SEQ ID NO: 477183 - RNA, 64 nt, Human; identical to SEQ ID NO: 450127

SEQ ID NO: 477184 - RNA, 64 nt, Human; identical to SEQ ID NO: 450128

SEQ ID NO: 477185 - RNA, 64 nt, Human; identical to SEQ ID NO: 450129

SEQ ID NO: 477186 - RNA, 64 nt, Human; identical to SEQ ID NO: 450130

SEQ ID NO: 477187 - RNA, 64 nt, Human; identical to SEQ ID NO: 450131

SEQ ID NO: 477188 - RNA, 64 nt, Human; identical to SEQ ID NO: 450132

SEQ ID NO: 477189 - RNA, 64 nt, Human; identical to SEQ ID NO: 450133

SEQ ID NO: 477190 - RNA, 64 nt, Human; identical to SEQ ID NO: 450134

SEQ ID NO: 477191 - RNA, 64 nt, Human; identical to SEQ ID NO: 450135

SEQ ID NO: 477192 - RNA, 64 nt, Human; identical to SEQ ID NO: 450136

SEQ ID NO: 477193 - RNA, 64 nt, Human; identical to SEQ ID NO: 450137

SEQ ID NO: 477194 - RNA, 64 nt, Human
aaaucauguccuuuucagcaacauggaugcaacuagaggcuauuauccuaagcaaccuaaugca

SEQ ID NO: 477195 - RNA, 64 nt, Human
aaugauucuauaaugccaucaugcagcaauuaugagaggcuaggucauccaaagagaagacccu

SEQ ID NO: 477196 - RNA, 64 nt, Human
cagccaucaggacuaauccaucgaugacuggaaaagaggcuagcuuugaggaaaacagccuggg

SEQ ID NO: 477197 - RNA, 64 nt, Human; identical to SEQ ID NO: 450138

SEQ ID NO: 477198 - RNA, 64 nt, Human; identical to SEQ ID NO: 450139

SEQ ID NO: 477199 - RNA, 64 nt, Human; identical to SEQ ID NO: 450140

SEQ ID NO: 477200 - RNA, 64 nt, Human; identical to SEQ ID NO: 450144

SEQ ID NO: 477201 - RNA, 64 nt, Human; identical to SEQ ID NO: 450145

SEQ ID NO: 477202 - RNA, 64 nt, Human; identical to SEQ ID NO: 450146

SEQ ID NO: 477203 - RNA, 64 nt, Human; identical to SEQ ID NO: 450147

SEQ ID NO: 477204 - RNA, 64 nt, Human; identical to SEQ ID NO: 450148

SEQ ID NO: 477205 - RNA, 64 nt, Human; identical to SEQ ID NO: 450149

SEQ ID NO: 477206 - RNA, 64 nt, Human; identical to SEQ ID NO: 450150

SEQ ID NO: 477207 - RNA, 64 nt, Human; identical to SEQ ID NO: 450151

SEQ ID NO: 477208 - RNA, 64 nt, Human; identical to SEQ ID NO: 450152

SEQ ID NO: 477209 - RNA, 64 nt, Human; identical to SEQ ID NO: 450153

SEQ ID NO: 477210 - RNA, 64 nt, Human; identical to SEQ ID NO: 450154

SEQ ID NO: 477211 - RNA, 64 nt, Human
uucaaucuguauuacucuuugccgucuuguauguagaggcuauuuuuaaaucauuaaauuuuua

SEQ ID NO: 477212 - RNA, 64 nt, Human
uuuuaggaacaguuuggggugggccugcaaauuuagaggcuauugcuaagaaaggaaaauuuaa

SEQ ID NO: 477213 - RNA, 64 nt, Human
uuuuuucuagagcucugucacuaucugaaaagaaagaggcuaugggaaacauagaaaugguaug

SEQ ID NO: 477214 - RNA, 64 nt, Human; identical to SEQ ID NO: 450155

SEQ ID NO: 477215 - RNA, 64 nt, Human; identical to SEQ ID NO: 450156

SEQ ID NO: 477216 - RNA, 64 nt, Human; identical to SEQ ID NO: 450157

SEQ ID NO: 477217 - RNA, 64 nt, Human; identical to SEQ ID NO: 450158

SEQ ID NO: 477218 - RNA, 51 nt, Human; identical to SEQ ID NO: 381423

SEQ ID NO: 477219 - RNA, 64 nt, Human; identical to SEQ ID NO: 450163

SEQ ID NO: 477220 - RNA, 64 nt, Human; identical to SEQ ID NO: 450164

SEQ ID NO: 477221 - RNA, 64 nt, Human; identical to SEQ ID NO: 450165

SEQ ID NO: 477222 - RNA, 64 nt, Human; identical to SEQ ID NO: 450166

SEQ ID NO: 477223 - RNA, 64 nt, Human; identical to SEQ ID NO: 450167

SEQ ID NO: 477224 - RNA, 64 nt, Human; identical to SEQ ID NO: 450168

SEQ ID NO: 477225 - RNA, 64 nt, Human; identical to SEQ ID NO: 450169

SEQ ID NO: 477226 - RNA, 64 nt, Human; identical to SEQ ID NO: 450170

SEQ ID NO: 477227 - RNA, 64 nt, Human; identical to SEQ ID NO: 450171

SEQ ID NO: 477228 - RNA, 64 nt, Human
uucauauuuucuuuauaauaauuucuuauggagaagaggcuauauuucaaaggaauugagacau

SEQ ID NO: 477229 - RNA, 64 nt, Human
gguggcaccaucucugauuuucaaagcuuuuuccagaggcuauuauuuucacuguagaaugauu

SEQ ID NO: 477230 - RNA, 64 nt, Human
cauccauuggaggucccaggagugucacccauggagaggcuaugcgacauggcuagggcugguu

SEQ ID NO: 477231 - RNA, 64 nt, Human; identical to SEQ ID NO: 450172

SEQ ID NO: 477232 - RNA, 64 nt, Human; identical to SEQ ID NO: 450173

SEQ ID NO: 477233 - RNA, 64 nt, Human; identical to SEQ ID NO: 450174

SEQ ID NO: 477234 - RNA, 64 nt, Human; identical to SEQ ID NO: 450175

SEQ ID NO: 477235 - RNA, 64 nt, Human; identical to SEQ ID NO: 450176

SEQ ID NO: 477236 - RNA, 64 nt, Human; identical to SEQ ID NO: 450180

SEQ ID NO: 477237 - RNA, 64 nt, Human; identical to SEQ ID NO: 450181

SEQ ID NO: 477238 - RNA, 64 nt, Human; identical to SEQ ID NO: 450182

SEQ ID NO: 477239 - RNA, 64 nt, Human; identical to SEQ ID NO: 450183

SEQ ID NO: 477240 - RNA, 56 nt, Human; identical to SEQ ID NO: 381440

SEQ ID NO: 477241 - RNA, 64 nt, Human; identical to SEQ ID NO: 450185

SEQ ID NO: 477242 - RNA, 64 nt, Human; identical to SEQ ID NO: 450186

SEQ ID NO: 477243 - RNA, 64 nt, Human; identical to SEQ ID NO: 450187

SEQ ID NO: 477244 - RNA, 64 nt, Human; identical to SEQ ID NO: 450188

SEQ ID NO: 477245 - RNA, 64 nt, Human
uaauggaaaaucagguguuuacaggaaagaucucagaggcuaugagcucugaauaaaucuucau

SEQ ID NO: 477246 - RNA, 64 nt, Human
uaaaagcagcaggccccaggugaguccugaaggaagaggcuagcacucuguaaggccuccagug

SEQ ID NO: 477247 - RNA, 64 nt, Human
guugcuuuguuacccagccuaauugaagaguggcagaggcuacuacaaaaagcaaccuuuucau

SEQ ID NO: 477248 - RNA, 64 nt, Human; identical to SEQ ID NO: 450189

SEQ ID NO: 477249 - RNA, 64 nt, Human; identical to SEQ ID NO: 450190

SEQ ID NO: 477250 - RNA, 64 nt, Human; identical to SEQ ID NO: 450191

SEQ ID NO: 477251 - RNA, 64 nt, Human; identical to SEQ ID NO: 450192

SEQ ID NO: 477252 - RNA, 64 nt, Human; identical to SEQ ID NO: 450193

SEQ ID NO: 477253 - RNA, 64 nt, Human; identical to SEQ ID NO: 450194

SEQ ID NO: 477254 - RNA, 64 nt, Human; identical to SEQ ID NO: 450196

SEQ ID NO: 477255 - RNA, 64 nt, Human; identical to SEQ ID NO: 450197

SEQ ID NO: 477256 - RNA, 64 nt, Human; identical to SEQ ID NO: 450198

SEQ ID NO: 477257 - RNA, 64 nt, Human; identical to SEQ ID NO: 450199

SEQ ID NO: 477258 - RNA, 53 nt, Human; identical to SEQ ID NO: 381453

SEQ ID NO: 477259 - RNA, 64 nt, Human; identical to SEQ ID NO: 450201

SEQ ID NO: 477260 - RNA, 64 nt, Human; identical to SEQ ID NO: 450202

SEQ ID NO: 477261 - RNA, 64 nt, Human; identical to SEQ ID NO: 450203

SEQ ID NO: 477262 - RNA, 64 nt, Human
ccaacugccaacaauaaaaagacuuuuauuuaguagaggcuaccuuucccaccagugacucuuu

SEQ ID NO: 477263 - RNA, 64 nt, Human
ccaaacauaggcgcuccuagucuggucagugccaagaggcuaccagaacauggggcagguggcu

SEQ ID NO: 477264 - RNA, 64 nt, Human
acugguguagguuugguaggccucacugcucuccagaggcuaguguuccuaucccaggauggcu

SEQ ID NO: 477265 - RNA, 53 nt, Human; identical to SEQ ID NO: 381459

SEQ ID NO: 477266 - RNA, 64 nt, Human; identical to SEQ ID NO: 450205

SEQ ID NO: 477267 - RNA, 64 nt, Human; identical to SEQ ID NO: 450206

SEQ ID NO: 477268 - RNA, 64 nt, Human; identical to SEQ ID NO: 450207

SEQ ID NO: 477269 - RNA, 64 nt, Human; identical to SEQ ID NO: 450208

SEQ ID NO: 477270 - RNA, 64 nt, Human; identical to SEQ ID NO: 450209

SEQ ID NO: 477271 - RNA, 64 nt, Human; identical to SEQ ID NO: 450210

SEQ ID NO: 477272 - RNA, 64 nt, Human; identical to SEQ ID NO: 450213

SEQ ID NO: 477273 - RNA, 64 nt, Human; identical to SEQ ID NO: 450214

SEQ ID NO: 477274 - RNA, 64 nt, Human; identical to SEQ ID NO: 450215

SEQ ID NO: 477275 - RNA, 64 nt, Human; identical to SEQ ID NO: 450216

SEQ ID NO: 477276 - RNA, 64 nt, Human; identical to SEQ ID NO: 450217

SEQ ID NO: 477277 - RNA, 64 nt, Human; identical to SEQ ID NO: 450218

SEQ ID NO: 477278 - RNA, 64 nt, Human; identical to SEQ ID NO: 450219

SEQ ID NO: 477279 - RNA, 64 nt, Human
uuggauucucucuuggugccaaucaguggcuguuagaggcuacucagguguaccccaaacagaa

SEQ ID NO: 477280 - RNA, 64 nt, Human
gcaacaugcuagaaaauccucacugcacuccagcagaggcuagaggaaugccaguguuaccuua

SEQ ID NO: 477281 - RNA, 64 nt, Human
ugaaugcugugggaaggcaauuucucugcacacaagaggcuacguuuuggaagugauguauguu

SEQ ID NO: 477282 - RNA, 64 nt, Human; identical to SEQ ID NO: 450220

SEQ ID NO: 477283 - RNA, 64 nt, Human; identical to SEQ ID NO: 450221

SEQ ID NO: 477284 - RNA, 64 nt, Human; identical to SEQ ID NO: 450222

SEQ ID NO: 477285 - RNA, 64 nt, Human; identical to SEQ ID NO: 450223

SEQ ID NO: 477286 - RNA, 64 nt, Human; identical to SEQ ID NO: 450224

SEQ ID NO: 477287 - RNA, 64 nt, Human; identical to SEQ ID NO: 450225

SEQ ID NO: 477288 - RNA, 64 nt, Human; identical to SEQ ID NO: 450226

SEQ ID NO: 477289 - RNA, 64 nt, Human; identical to SEQ ID NO: 450227

SEQ ID NO: 477290 - RNA, 64 nt, Human; identical to SEQ ID NO: 450231

SEQ ID NO: 477291 - RNA, 64 nt, Human; identical to SEQ ID NO: 450232

SEQ ID NO: 477292 - RNA, 64 nt, Human; identical to SEQ ID NO: 450233

SEQ ID NO: 477293 - RNA, 64 nt, Human; identical to SEQ ID NO: 450234

SEQ ID NO: 477294 - RNA, 64 nt, Human; identical to SEQ ID NO: 450235

SEQ ID NO: 477295 - RNA, 64 nt, Human; identical to SEQ ID NO: 450236

SEQ ID NO: 477296 - RNA, 64 nt, Human
guuaugugcuuugucauuuucuuugcuaaacaaaagaggcuaugaaagaacuaaauaugaguac

SEQ ID NO: 477297 - RNA, 64 nt, Human
gucauaacgguuaagaaagcacuuaaacagaagcagaggcuaauucagugucacaugaggaagu

SEQ ID NO: 477298 - RNA, 64 nt, Human
uacuccccuccuugaacuaggauuguagucccaaagaggcuacuguaaggcaaucauggugcuc

SEQ ID NO: 477299 - RNA, 64 nt, Human; identical to SEQ ID NO: 450237

SEQ ID NO: 477300 - RNA, 64 nt, Human; identical to SEQ ID NO: 450238

SEQ ID NO: 477301 - RNA, 64 nt, Human; identical to SEQ ID NO: 450239

SEQ ID NO: 477302 - RNA, 64 nt, Human; identical to SEQ ID NO: 450240

SEQ ID NO: 477303 - RNA, 64 nt, Human; identical to SEQ ID NO: 450241

SEQ ID NO: 477304 - RNA, 64 nt, Human; identical to SEQ ID NO: 450242

SEQ ID NO: 477305 - RNA, 64 nt, Human; identical to SEQ ID NO: 450243

SEQ ID NO: 477306 - RNA, 64 nt, Human; identical to SEQ ID NO: 450244

SEQ ID NO: 477307 - RNA, 64 nt, Human; identical to SEQ ID NO: 450245

SEQ ID NO: 477308 - RNA, 64 nt, Human; identical to SEQ ID NO: 450249

SEQ ID NO: 477309 - RNA, 64 nt, Human; identical to SEQ ID NO: 450250

SEQ ID NO: 477310 - RNA, 64 nt, Human; identical to SEQ ID NO: 450251

SEQ ID NO: 477311 - RNA, 64 nt, Human; identical to SEQ ID NO: 450252

SEQ ID NO: 477312 - RNA, 64 nt, Human; identical to SEQ ID NO: 450253

SEQ ID NO: 477313 - RNA, 64 nt, Human
cgucaucaucugcucugaguggaaggccguucagagaggcuagagguucuuauucuggcuauaa

SEQ ID NO: 477314 - RNA, 64 nt, Human
uuaagccaacauccgucucuugagcaugguuuuuagaggcuacgaauaaggcuaugaauaaggg

SEQ ID NO: 477315 - RNA, 64 nt, Human
auauccucuuugagugaagcugggagaaccaaaaagaggcuaugugagcacaaagguagcuuuu

SEQ ID NO: 477316 - RNA, 64 nt, Human; identical to SEQ ID NO: 450254

SEQ ID NO: 477317 - RNA, 64 nt, Human; identical to SEQ ID NO: 450255

SEQ ID NO: 477318 - RNA, 64 nt, Human; identical to SEQ ID NO: 450256

SEQ ID NO: 477319 - RNA, 64 nt, Human; identical to SEQ ID NO: 450257

SEQ ID NO: 477320 - RNA, 64 nt, Human; identical to SEQ ID NO: 450258

SEQ ID NO: 477321 - RNA, 64 nt, Human; identical to SEQ ID NO: 450259

SEQ ID NO: 477322 - RNA, 64 nt, Human; identical to SEQ ID NO: 450260

SEQ ID NO: 477323 - RNA, 64 nt, Human; identical to SEQ ID NO: 450261

SEQ ID NO: 477324 - RNA, 64 nt, Human; identical to SEQ ID NO: 450262

SEQ ID NO: 477325 - RNA, 64 nt, Human; identical to SEQ ID NO: 450263

SEQ ID NO: 477326 - RNA, 64 nt, Human; identical to SEQ ID NO: 450267

SEQ ID NO: 477327 - RNA, 64 nt, Human; identical to SEQ ID NO: 450268

SEQ ID NO: 477328 - RNA, 64 nt, Human; identical to SEQ ID NO: 450269

SEQ ID NO: 477329 - RNA, 64 nt, Human; identical to SEQ ID NO: 450270

SEQ ID NO: 477330 - RNA, 64 nt, Human
ugccaaaaugauaguggcaauaauauuuuucuucagaggcuaaggggaagauagaccuguacau

SEQ ID NO: 477331 - RNA, 64 nt, Human
guacaguuuauccugauguugcuuguaaugcaguagaggcuauuucgccuucgcuuuucuuucu

SEQ ID NO: 477332 - RNA, 64 nt, Human
acugaaauaggaaacagucauuggaauguugcacagaggcuaauaacuauagacuguuggauac

SEQ ID NO: 477333 - RNA, 64 nt, Human; identical to SEQ ID NO: 450271

SEQ ID NO: 477334 - RNA, 64 nt, Human; identical to SEQ ID NO: 450272

SEQ ID NO: 477335 - RNA, 64 nt, Human; identical to SEQ ID NO: 450273

SEQ ID NO: 477336 - RNA, 64 nt, Human; identical to SEQ ID NO: 450274

SEQ ID NO: 477337 - RNA, 64 nt, Human; identical to SEQ ID NO: 450275

SEQ ID NO: 477338 - RNA, 64 nt, Human; identical to SEQ ID NO: 450276

SEQ ID NO: 477339 - RNA, 64 nt, Human; identical to SEQ ID NO: 450277

SEQ ID NO: 477340 - RNA, 64 nt, Human; identical to SEQ ID NO: 450278

SEQ ID NO: 477341 - RNA, 64 nt, Human; identical to SEQ ID NO: 450279

SEQ ID NO: 477342 - RNA, 64 nt, Human; identical to SEQ ID NO: 450280

SEQ ID NO: 477343 - RNA, 64 nt, Human; identical to SEQ ID NO: 450281

SEQ ID NO: 477344 - RNA, 64 nt, Human; identical to SEQ ID NO: 450285

SEQ ID NO: 477345 - RNA, 64 nt, Human; identical to SEQ ID NO: 450286

SEQ ID NO: 477346 - RNA, 64 nt, Human; identical to SEQ ID NO: 450287

SEQ ID NO: 477347 - RNA, 64 nt, Human
uuguaaugaguagguuuggauuuaagagccgauuagaggcuacuuccuguaaacaaguacagga

SEQ ID NO: 477348 - RNA, 64 nt, Human
auaaauaugaaaugauaaagaugucaaauaucucagaggcuauagcugggaacccgacugugaa

SEQ ID NO: 477349 - RNA, 64 nt, Human
gcggggaucaucugccgugccuggauccugaaauagaggcuaaauuacucaggaagaacacccu

SEQ ID NO: 477350 - RNA, 64 nt, Human; identical to SEQ ID NO: 450288

SEQ ID NO: 477351 - RNA, 64 nt, Human; identical to SEQ ID NO: 450289

SEQ ID NO: 477352 - RNA, 64 nt, Human; identical to SEQ ID NO: 450290

SEQ ID NO: 477353 - RNA, 64 nt, Human; identical to SEQ ID NO: 450291

SEQ ID NO: 477354 - RNA, 64 nt, Human; identical to SEQ ID NO: 450292

SEQ ID NO: 477355 - RNA, 64 nt, Human; identical to SEQ ID NO: 450293

SEQ ID NO: 477356 - RNA, 64 nt, Human; identical to SEQ ID NO: 450294

SEQ ID NO: 477357 - RNA, 64 nt, Human; identical to SEQ ID NO: 450295

SEQ ID NO: 477358 - RNA, 64 nt, Human; identical to SEQ ID NO: 450296

SEQ ID NO: 477359 - RNA, 64 nt, Human; identical to SEQ ID NO: 450297

SEQ ID NO: 477360 - RNA, 64 nt, Human; identical to SEQ ID NO: 450298

SEQ ID NO: 477361 - RNA, 64 nt, Human; identical to SEQ ID NO: 450299

SEQ ID NO: 477362 - RNA, 64 nt, Human; identical to SEQ ID NO: 450303

SEQ ID NO: 477363 - RNA, 64 nt, Human; identical to SEQ ID NO: 450304

SEQ ID NO: 477364 - RNA, 64 nt, Human
gcccucugggguuugaguggagguauggagccagagaggcuauccuagcuaccuuccuccuagg

SEQ ID NO: 477365 - RNA, 64 nt, Human
cuaauugcaguaagacaaaaauucuagggcaccaagaggcuaaagucagcacagcuuuucuugu

SEQ ID NO: 477366 - RNA, 64 nt, Human
uuccaccauaaaacagcugaguuauuuaugaauuagaggcuauagcucacauuuucaauccucu

SEQ ID NO: 477367 - RNA, 64 nt, Human; identical to SEQ ID NO: 450305

SEQ ID NO: 477368 - RNA, 64 nt, Human; identical to SEQ ID NO: 450306

SEQ ID NO: 477369 - RNA, 64 nt, Human; identical to SEQ ID NO: 450307

SEQ ID NO: 477370 - RNA, 64 nt, Human; identical to SEQ ID NO: 450308

SEQ ID NO: 477371 - RNA, 64 nt, Human; identical to SEQ ID NO: 450309

SEQ ID NO: 477372 - RNA, 64 nt, Human; identical to SEQ ID NO: 450310

SEQ ID NO: 477373 - RNA, 64 nt, Human; identical to SEQ ID NO: 450311

SEQ ID NO: 477374 - RNA, 64 nt, Human; identical to SEQ ID NO: 450312

SEQ ID NO: 477375 - RNA, 64 nt, Human; identical to SEQ ID NO: 450313

SEQ ID NO: 477376 - RNA, 64 nt, Human; identical to SEQ ID NO: 450314

SEQ ID NO: 477377 - RNA, 64 nt, Human; identical to SEQ ID NO: 450315

SEQ ID NO: 477378 - RNA, 64 nt, Human; identical to SEQ ID NO: 450316

SEQ ID NO: 477379 - RNA, 64 nt, Human; identical to SEQ ID NO: 450317

SEQ ID NO: 477380 - RNA, 64 nt, Human; identical to SEQ ID NO: 450321

SEQ ID NO: 477381 - RNA, 64 nt, Human
ucaauuggccuaacuaagcaggauugaauuuaccagaggcuaaguucagauaguaagaauaaug

SEQ ID NO: 477382 - RNA, 64 nt, Human
ccucuugucugauuucuuaggggaaggagaaguaagaggcuaccucuuaccuaacaucugaccu

SEQ ID NO: 477383 - RNA, 64 nt, Human
cugagaacccaccugacccaggcuugccccaagcagaggcuagagaagaggcuccucuucucag

SEQ ID NO: 477384 - RNA, 64 nt, Human; identical to SEQ ID NO: 450322

SEQ ID NO: 477385 - RNA, 64 nt, Human; identical to SEQ ID NO: 450323

SEQ ID NO: 477386 - RNA, 64 nt, Human; identical to SEQ ID NO: 450324

SEQ ID NO: 477387 - RNA, 64 nt, Human; identical to SEQ ID NO: 450325

SEQ ID NO: 477388 - RNA, 64 nt, Human; identical to SEQ ID NO: 450326

SEQ ID NO: 477389 - RNA, 64 nt, Human; identical to SEQ ID NO: 450327

SEQ ID NO: 477390 - RNA, 64 nt, Human; identical to SEQ ID NO: 450328

SEQ ID NO: 477391 - RNA, 64 nt, Human; identical to SEQ ID NO: 450329

SEQ ID NO: 477392 - RNA, 64 nt, Human; identical to SEQ ID NO: 450330

SEQ ID NO: 477393 - RNA, 64 nt, Human; identical to SEQ ID NO: 450331

SEQ ID NO: 477394 - RNA, 64 nt, Human; identical to SEQ ID NO: 450332

SEQ ID NO: 477395 - RNA, 64 nt, Human; identical to SEQ ID NO: 450333

SEQ ID NO: 477396 - RNA, 64 nt, Human; identical to SEQ ID NO: 450334

SEQ ID NO: 477397 - RNA, 64 nt, Human; identical to SEQ ID NO: 450335

SEQ ID NO: 477398 - RNA, 64 nt, Human
uuucuuccaaguuugccuggggccuagcccugcuagaggcuacagcacuuuacaagcaagguau

SEQ ID NO: 477399 - RNA, 64 nt, Human
uuucuaaaauuaaaagaaaaaaaaacuauagcagagaggcuaaaaucuauuuaucgaaaccagc

SEQ ID NO: 477400 - RNA, 64 nt, Human
aguucuggugccuuaacgcauggcuggaauuuauagaggcuacaaccacauuuguucacaggag

SEQ ID NO: 477401 - RNA, 64 nt, Human; identical to SEQ ID NO: 450339

SEQ ID NO: 477402 - RNA, 64 nt, Human; identical to SEQ ID NO: 450340

SEQ ID NO: 477403 - RNA, 64 nt, Human; identical to SEQ ID NO: 450341

SEQ ID NO: 477404 - RNA, 64 nt, Human; identical to SEQ ID NO: 450342

SEQ ID NO: 477405 - RNA, 64 nt, Human; identical to SEQ ID NO: 450343

SEQ ID NO: 477406 - RNA, 64 nt, Human; identical to SEQ ID NO: 450344

SEQ ID NO: 477407 - RNA, 64 nt, Human; identical to SEQ ID NO: 450345

SEQ ID NO: 477408 - RNA, 64 nt, Human; identical to SEQ ID NO: 450346

SEQ ID NO: 477409 - RNA, 64 nt, Human; identical to SEQ ID NO: 450347

SEQ ID NO: 477410 - RNA, 64 nt, Human; identical to SEQ ID NO: 450348

SEQ ID NO: 477411 - RNA, 64 nt, Human; identical to SEQ ID NO: 450349

SEQ ID NO: 477412 - RNA, 64 nt, Human; identical to SEQ ID NO: 450350

SEQ ID NO: 477413 - RNA, 64 nt, Human; identical to SEQ ID NO: 450351

SEQ ID NO: 477414 - RNA, 64 nt, Human; identical to SEQ ID NO: 450352

SEQ ID NO: 477415 - RNA, 64 nt, Human
aagaguuuucagagauuucauauauaucuuuuacagaggcuauuuuaaucuuuagugcaugguu

SEQ ID NO: 477416 - RNA, 64 nt, Human
caaaacuucaagugucuagcacauacuacaucuaagaggcuaaacucugauaggaaaagcacuu

SEQ ID NO: 477417 - RNA, 64 nt, Human
cuucuaguuuacaggugagggaaccaaguuucacagaggcuaaguggcgugccccugaucacuc

SEQ ID NO: 477418 - RNA, 64 nt, Human; identical to SEQ ID NO: 450353

SEQ ID NO: 477419 - RNA, 64 nt, Human; identical to SEQ ID NO: 450357

SEQ ID NO: 477420 - RNA, 64 nt, Human; identical to SEQ ID NO: 450358

SEQ ID NO: 477421 - RNA, 64 nt, Human; identical to SEQ ID NO: 450359

SEQ ID NO: 477422 - RNA, 64 nt, Human; identical to SEQ ID NO: 450360

SEQ ID NO: 477423 - RNA, 64 nt, Human; identical to SEQ ID NO: 450361

SEQ ID NO: 477424 - RNA, 64 nt, Human; identical to SEQ ID NO: 450362

SEQ ID NO: 477425 - RNA, 64 nt, Human; identical to SEQ ID NO: 450363

SEQ ID NO: 477426 - RNA, 64 nt, Human; identical to SEQ ID NO: 450364

SEQ ID NO: 477427 - RNA, 64 nt, Human; identical to SEQ ID NO: 450365

SEQ ID NO: 477428 - RNA, 64 nt, Human; identical to SEQ ID NO: 450366

SEQ ID NO: 477429 - RNA, 64 nt, Human; identical to SEQ ID NO: 450367

SEQ ID NO: 477430 - RNA, 64 nt, Human; identical to SEQ ID NO: 450368

SEQ ID NO: 477431 - RNA, 64 nt, Human; identical to SEQ ID NO: 450369

SEQ ID NO: 477432 - RNA, 64 nt, Human
gguaagauguuaaucucccagcccaccucaacccagaggcuacucuugacuuagaccuauacug

SEQ ID NO: 477433 - RNA, 64 nt, Human
uggacauuuuaccccacugagugguaaaaaggacagaggcuacagauggaguugcuuuguuuau

SEQ ID NO: 477434 - RNA, 57 nt, Human
agccaauggaucacucuugauuuaauuagaggcuaauaaaggcagaauguuuauugu

SEQ ID NO: 477435 - RNA, 64 nt, Human; identical to SEQ ID NO: 450370

SEQ ID NO: 477436 - RNA, 64 nt, Human; identical to SEQ ID NO: 450371

SEQ ID NO: 477437 - RNA, 64 nt, Human; identical to SEQ ID NO: 450375

SEQ ID NO: 477438 - RNA, 64 nt, Human; identical to SEQ ID NO: 450376

SEQ ID NO: 477439 - RNA, 64 nt, Human; identical to SEQ ID NO: 450377

SEQ ID NO: 477440 - RNA, 58 nt, Human; identical to SEQ ID NO: 381604

SEQ ID NO: 477441 - RNA, 64 nt, Human; identical to SEQ ID NO: 450379

SEQ ID NO: 477442 - RNA, 64 nt, Human; identical to SEQ ID NO: 450380

SEQ ID NO: 477443 - RNA, 64 nt, Human; identical to SEQ ID NO: 450381

SEQ ID NO: 477444 - RNA, 64 nt, Human; identical to SEQ ID NO: 450382

SEQ ID NO: 477445 - RNA, 64 nt, Human; identical to SEQ ID NO: 450383

SEQ ID NO: 477446 - RNA, 64 nt, Human; identical to SEQ ID NO: 450384

SEQ ID NO: 477447 - RNA, 64 nt, Human; identical to SEQ ID NO: 450384

SEQ ID NO: 477448 - RNA, 64 nt, Human; identical to SEQ ID NO: 450386

SEQ ID NO: 477449 - RNA, 64 nt, Human
ucagugaacaagaaacaugaaaucugcuucuuagagaggcuauauuuuucugcuacaaauauuu

SEQ ID NO: 477450 - RNA, 64 nt, Human
uaaauacuguggagugacaccagaacacagccaaagaggcuagaagcaagaaaggaucugcaug

SEQ ID NO: 477451 - RNA, 64 nt, Human
ucugauggaaauguacagcagaaacucuugagagagaggcuaaaagcaacucuguucucccccu

SEQ ID NO: 477452 - RNA, 64 nt, Human; identical to SEQ ID NO: 450387

SEQ ID NO: 477453 - RNA, 64 nt, Human; identical to SEQ ID NO: 450388

SEQ ID NO: 477454 - RNA, 64 nt, Human; identical to SEQ ID NO: 450389

SEQ ID NO: 477455 - RNA, 64 nt, Human; identical to SEQ ID NO: 450393

SEQ ID NO: 477456 - RNA, 64 nt, Human; identical to SEQ ID NO: 450394

SEQ ID NO: 477457 - RNA, 64 nt, Human; identical to SEQ ID NO: 450395

SEQ ID NO: 477458 - RNA, 64 nt, Human; identical to SEQ ID NO: 450396

SEQ ID NO: 477459 - RNA, 64 nt, Human; identical to SEQ ID NO: 450397

SEQ ID NO: 477460 - RNA, 64 nt, Human; identical to SEQ ID NO: 450398

SEQ ID NO: 477461 - RNA, 64 nt, Human; identical to SEQ ID NO: 450399

SEQ ID NO: 477462 - RNA, 64 nt, Human; identical to SEQ ID NO: 450400

SEQ ID NO: 477463 - RNA, 64 nt, Human; identical to SEQ ID NO: 450401

SEQ ID NO: 477464 - RNA, 64 nt, Human; identical to SEQ ID NO: 450402

SEQ ID NO: 477465 - RNA, 64 nt, Human; identical to SEQ ID NO: 450403

SEQ ID NO: 477466 - RNA, 64 nt, Human
aaauacacuuuagaaguaaaaauaugaaguaccgagaggcuaaacccacuggccuaagaucuca

SEQ ID NO: 477467 - RNA, 64 nt, Human
uuuugauacaucuccaugaaguucuuuugagaggagaggcuauuuugauguuuuuauacaacug

SEQ ID NO: 477468 - RNA, 64 nt, Human
ugauguauuacauuauuugcuuuucucaacugcuagaggcuaccccauuuuccuuuccacaauc

SEQ ID NO: 477469 - RNA, 64 nt, Human; identical to SEQ ID NO: 450404

SEQ ID NO: 477470 - RNA, 64 nt, Human; identical to SEQ ID NO: 450405

SEQ ID NO: 477471 - RNA, 64 nt, Human; identical to SEQ ID NO: 450406

SEQ ID NO: 477472 - RNA, 64 nt, Human; identical to SEQ ID NO: 450407

SEQ ID NO: 477473 - RNA, 64 nt, Human; identical to SEQ ID NO: 450411

SEQ ID NO: 477474 - RNA, 64 nt, Human; identical to SEQ ID NO: 450412

SEQ ID NO: 477475 - RNA, 64 nt, Human; identical to SEQ ID NO: 450413

SEQ ID NO: 477476 - RNA, 64 nt, Human; identical to SEQ ID NO: 450414

SEQ ID NO: 477477 - RNA, 64 nt, Human; identical to SEQ ID NO: 450415

SEQ ID NO: 477478 - RNA, 64 nt, Human; identical to SEQ ID NO: 450416

SEQ ID NO: 477479 - RNA, 64 nt, Human; identical to SEQ ID NO: 450417

SEQ ID NO: 477480 - RNA, 64 nt, Human; identical to SEQ ID NO: 450418

SEQ ID NO: 477481 - RNA, 64 nt, Human; identical to SEQ ID NO: 450419

SEQ ID NO: 477482 - RNA, 64 nt, Human; identical to SEQ ID NO: 450420

SEQ ID NO: 477483 - RNA, 64 nt, Human
ugccuggccauuuuccauuuauauauauuuuuuaagaggcuagagugcuuuuagccuuuuuuaa

SEQ ID NO: 477484 - RNA, 64 nt, Human
uggggcacccccuucccuccccggguuugcaaauagaggcuaccgggugcuguauucagcaaca

SEQ ID NO: 477485 - RNA, 64 nt, Human
auaagaccacuacagucuggcuagguuaaaggccagaggcuauggaacuuaacacuccccauug

SEQ ID NO: 477486 - RNA, 64 nt, Human; identical to SEQ ID NO: 450421

SEQ ID NO: 477487 - RNA, 64 nt, Human; identical to SEQ ID NO: 450422

SEQ ID NO: 477488 - RNA, 64 nt, Human; identical to SEQ ID NO: 450423

SEQ ID NO: 477489 - RNA, 64 nt, Human; identical to SEQ ID NO: 450424

SEQ ID NO: 477490 - RNA, 64 nt, Human; identical to SEQ ID NO: 450425

SEQ ID NO: 477491 - RNA, 64 nt, Human; identical to SEQ ID NO: 450429

SEQ ID NO: 477492 - RNA, 64 nt, Human; identical to SEQ ID NO: 450430

SEQ ID NO: 477493 - RNA, 64 nt, Human; identical to SEQ ID NO: 450431

SEQ ID NO: 477494 - RNA, 64 nt, Human; identical to SEQ ID NO: 450432

SEQ ID NO: 477495 - RNA, 64 nt, Human; identical to SEQ ID NO: 450433

SEQ ID NO: 477496 - RNA, 64 nt, Human; identical to SEQ ID NO: 450434

SEQ ID NO: 477497 - RNA, 64 nt, Human; identical to SEQ ID NO: 450435

SEQ ID NO: 477498 - RNA, 64 nt, Human; identical to SEQ ID NO: 450436

SEQ ID NO: 477499 - RNA, 64 nt, Human
cauaugcccuacuugaaacuugccuguauuauuaagaggcuauaugcaucuuuuugguuuguca

SEQ ID NO: 477500 - RNA, 64 nt, Human
ugucugacuugcuccuggaugggcacccacacucagaggcuacauauggcccuagagcaccacc

SEQ ID NO: 477501 - RNA, 55 nt, Human
auuugauugaggaaaacuaaaacugagaggcuacuuccuggggccacacagacug

SEQ ID NO: 477502 - RNA, 50 nt, Human; identical to SEQ ID NO: 58964

SEQ ID NO: 477503 - RNA, 64 nt, Human; identical to SEQ ID NO: 58965

SEQ ID NO: 477504 - RNA, 64 nt, Human; identical to SEQ ID NO: 58966

SEQ ID NO: 477505 - RNA, 64 nt, Human; identical to SEQ ID NO: 58967

SEQ ID NO: 477506 - RNA, 64 nt, Human; identical to SEQ ID NO: 58968

SEQ ID NO: 477507 - RNA, 64 nt, Human; identical to SEQ ID NO: 58969

SEQ ID NO: 477508 - RNA, 64 nt, Human; identical to SEQ ID NO: 58970

SEQ ID NO: 477509 - RNA, 64 nt, Human; identical to SEQ ID NO: 58971

SEQ ID NO: 477510 - RNA, 64 nt, Human; identical to SEQ ID NO: 58972

SEQ ID NO: 477511 - RNA, 64 nt, Human; identical to SEQ ID NO: 58973

SEQ ID NO: 477512 - RNA, 64 nt, Human; identical to SEQ ID NO: 58974

SEQ ID NO: 477513 - RNA, 64 nt, Human; identical to SEQ ID NO: 58975

SEQ ID NO: 477514 - RNA, 64 nt, Human; identical to SEQ ID NO: 58976

SEQ ID NO: 477515 - RNA, 64 nt, Human; identical to SEQ ID NO: 58977

SEQ ID NO: 477516 - RNA, 64 nt, Human
aacaaggagucagacauuuuaagaugguggcaguagaggcuauggacagggcaugccacguggg

SEQ ID NO: 477517 - RNA, 64 nt, Human
cucacccccuccuucauaugaaaggugccauggaagaggcuacagggccaaacgcugagccacc

SEQ ID NO: 477518 - RNA, 64 nt, Human
ugugguggcgcgugccuguagucccagcuacucgagaggcuaaggcaggaaaaucgcuugaacc

SEQ ID NO: 477519 - RNA, 64 nt, Human; identical to SEQ ID NO: 58978

SEQ ID NO: 477520 - RNA, 64 nt, Human; identical to SEQ ID NO: 58979

SEQ ID NO: 477521 - RNA, 64 nt, Human; identical to SEQ ID NO: 58980

SEQ ID NO: 477522 - RNA, 64 nt, Human; identical to SEQ ID NO: 58981

SEQ ID NO: 477523 - RNA, 64 nt, Human; identical to SEQ ID NO: 58982

SEQ ID NO: 477524 - RNA, 64 nt, Human; identical to SEQ ID NO: 58983

SEQ ID NO: 477525 - RNA, 64 nt, Human; identical to SEQ ID NO: 58984

SEQ ID NO: 477526 - RNA, 64 nt, Human; identical to SEQ ID NO: 58985

SEQ ID NO: 477527 - RNA, 64 nt, Human; identical to SEQ ID NO: 58986

SEQ ID NO: 477528 - RNA, 59 nt, Human; identical to SEQ ID NO: 58987

SEQ ID NO: 477529 - RNA, 64 nt, Human; identical to SEQ ID NO: 58988

SEQ ID NO: 477530 - RNA, 64 nt, Human; identical to SEQ ID NO: 58989

SEQ ID NO: 477531 - RNA, 64 nt, Human; identical to SEQ ID NO: 58990

SEQ ID NO: 477532 - RNA, 64 nt, Human; identical to SEQ ID NO: 58991

SEQ ID NO: 477533 - RNA, 64 nt, Human; identical to SEQ ID NO: 58992

SEQ ID NO: 477534 - RNA, 64 nt, Human
ccugcaaaggucagcugugcccucugggauucugagaggcuaugggggggccugccauagggau

SEQ ID NO: 477535 - RNA, 64 nt, Human
aagauguauguucacaccaauaauugccugcuucagaggcuaauauaacaaaaccaauaaaacc

SEQ ID NO: 477536 - RNA, 64 nt, Human
aagucaguguaucagaaaagaaagcagccauguaagaggcuaacuuaaauagaagugcuagaaa

SEQ ID NO: 477537 - RNA, 64 nt, Human
cccccaccacugagaagcuagacuuucaugcgggagaggcuacuuuuaugugucgucuuccggg

SEQ ID NO: 477538 - RNA, 64 nt, Human; identical to SEQ ID NO: 58993

SEQ ID NO: 477539 - RNA, 64 nt, Human; identical to SEQ ID NO: 58994

SEQ ID NO: 477540 - RNA, 64 nt, Human; identical to SEQ ID NO: 58995

SEQ ID NO: 477541 - RNA, 64 nt, Human; identical to SEQ ID NO: 58996

SEQ ID NO: 477542 - RNA, 64 nt, Human; identical to SEQ ID NO: 58997

SEQ ID NO: 477543 - RNA, 64 nt, Human; identical to SEQ ID NO: 58998

SEQ ID NO: 477544 - RNA, 64 nt, Human; identical to SEQ ID NO: 58999

SEQ ID NO: 477545 - RNA, 64 nt, Human; identical to SEQ ID NO: 59000

SEQ ID NO: 477546 - RNA, 64 nt, Human; identical to SEQ ID NO: 59001

SEQ ID NO: 477547 - RNA, 64 nt, Human; identical to SEQ ID NO: 59002

SEQ ID NO: 477548 - RNA, 64 nt, Human; identical to SEQ ID NO: 59003

SEQ ID NO: 477549 - RNA, 64 nt, Human; identical to SEQ ID NO: 59004

SEQ ID NO: 477550 - RNA, 64 nt, Human; identical to SEQ ID NO: 59005

SEQ ID NO: 477551 - RNA, 64 nt, Human; identical to SEQ ID NO: 59006

SEQ ID NO: 477552 - RNA, 64 nt, Human; identical to SEQ ID NO: 59007

SEQ ID NO: 477553 - RNA, 64 nt, Human
aacaagguacccagaauuuuuagaagccuucagaagaggcuaaaauauccagcuuugggggacc

SEQ ID NO: 477554 - RNA, 64 nt, Human
aaucacaucagauaaguaaccuauuuuacauaguagaggcuaaauacauaucuaauuuuuacca

SEQ ID NO: 477555 - RNA, 64 nt, Human
cuccaggucuuggaagacagaggggagcugcuuuagaggcuaaguugcuuugagcccacaaggu

SEQ ID NO: 477556 - RNA, 64 nt, Human
uagagauacauuugauuuacagcuuaaguaauucagaggcuaagcucuaagcuuuuuucucuca

SEQ ID NO: 477557 - RNA, 64 nt, Human; identical to SEQ ID NO: 59008

SEQ ID NO: 477558 - RNA, 64 nt, Human; identical to SEQ ID NO: 59009

SEQ ID NO: 477559 - RNA, 64 nt, Human; identical to SEQ ID NO: 59010

SEQ ID NO: 477560 - RNA, 64 nt, Human; identical to SEQ ID NO: 59011

SEQ ID NO: 477561 - RNA, 64 nt, Human; identical to SEQ ID NO: 59012

SEQ ID NO: 477562 - RNA, 64 nt, Human; identical to SEQ ID NO: 59013

SEQ ID NO: 477563 - RNA, 64 nt, Human; identical to SEQ ID NO: 59014

SEQ ID NO: 477564 - RNA, 64 nt, Human; identical to SEQ ID NO: 59015

SEQ ID NO: 477565 - RNA, 64 nt, Human; identical to SEQ ID NO: 59016

SEQ ID NO: 477566 - RNA, 64 nt, Human; identical to SEQ ID NO: 59017

SEQ ID NO: 477567 - RNA, 64 nt, Human; identical to SEQ ID NO: 59018

SEQ ID NO: 477568 - RNA, 64 nt, Human; identical to SEQ ID NO: 59019

SEQ ID NO: 477569 - RNA, 64 nt, Human; identical to SEQ ID NO: 59020

SEQ ID NO: 477570 - RNA, 64 nt, Human; identical to SEQ ID NO: 59021

SEQ ID NO: 477571 - RNA, 64 nt, Human; identical to SEQ ID NO: 59022

SEQ ID NO: 477572 - RNA, 64 nt, Human
ucagggcuggcccggggaguccccgugugccccaagaggcuagccccagggugagcagggcccu

SEQ ID NO: 477573 - RNA, 64 nt, Human
uacguuguaucucaguuugaugaaccaauucacaagaggcuaggcccucucuagcaaaguuaug

SEQ ID NO: 477574 - RNA, 64 nt, Human
ucuacucucauuuugauuacuuccuuaugguuugagaggcuagaaacugagccucucuacuuuu

SEQ ID NO: 477575 - RNA, 64 nt, Human
uauuuuuuucccccuuuucuuuauuuugcuggggagaggcuaaagggaaagguaguaggggcgg

SEQ ID NO: 477576 - RNA, 64 nt, Human; identical to SEQ ID NO: 59023

SEQ ID NO: 477577 - RNA, 64 nt, Human; identical to SEQ ID NO: 59024

SEQ ID NO: 477578 - RNA, 64 nt, Human; identical to SEQ ID NO: 59025

SEQ ID NO: 477579 - RNA, 64 nt, Human; identical to SEQ ID NO: 59026

SEQ ID NO: 477580 - RNA, 64 nt, Human; identical to SEQ ID NO: 59027

SEQ ID NO: 477581 - RNA, 64 nt, Human; identical to SEQ ID NO: 59028

SEQ ID NO: 477582 - RNA, 64 nt, Human; identical to SEQ ID NO: 59029

SEQ ID NO: 477583 - RNA, 64 nt, Human
agugccccucacuuacauguuuaucuuuguuuguagaggcuauguuuaggauauuuugccugca

SEQ ID NO: 477584 - RNA, 64 nt, Human
uaaaugaaaacgucuuuauuuaucaaaaaaacacagaggcuauuuuuauauccuugguaugaaa

SEQ ID NO: 477585 - RNA, 64 nt, Human
ccucacuggccuggccuugugggggcuccagaaaagaggcuaggagaggccagagucuaccugg

SEQ ID NO: 477586 - RNA, 64 nt, Human
ugggaauuagucuaaacaggaaauggugguacacagaggcuaggagaggcugggcccggugaaa

SEQ ID NO: 477587 - RNA, 64 nt, Human
auaggaaguccccagaucuugcccuucucacuccagaggcuaguggucacagacagcugggaau

SEQ ID NO: 477588 - RNA, 64 nt, Human
ccugcccagcccagacgggguugcuccugguccaagaggcuaccugcuccaaggcggagggugg

SEQ ID NO: 477589 - RNA, 64 nt, Human
ccuuucuccacugcacuggagcuuugaagaccuaagaggcuagugguuccuggagcuagugguu

SEQ ID NO: 477590 - RNA, 64 nt, Human
cuucagucguuuuuacugauccaccaacaccuaaagaggcuaugcuacagucucuagcuaaaug

SEQ ID NO: 477591 - RNA, 64 nt, Human
guauuuuugcccucuuuaguaaauuuagaacuguagaggcuaauaaacugcgaugagacauuua

SEQ ID NO: 477592 - RNA, 64 nt, Human
cuagggaggccuccaucuggaaaugggaggaugaagaggcuagaaucaucuuuccuagugaucc

SEQ ID NO: 477593 - RNA, 64 nt, Human
uccucuagaagccaagggaaaggggugcuuuuauagaggcuagcuucugcuuuucugcccuggc

SEQ ID NO: 477594 - RNA, 64 nt, Human
agcugguuuggcauaggaccuaaccagugaagcuagaggcuacagccacuaaacuugcuucagg

SEQ ID NO: 477595 - RNA, 64 nt, Human
gacuggauuuaaugucaguggugugccacagugcagaggcuagacaacugaaaggggcuaccaa

SEQ ID NO: 477596 - RNA, 64 nt, Human
gcuguggaggccugaugcugccccguucccugucagaggcuaagaugagauuugccagcacagg

SEQ ID NO: 477597 - RNA, 64 nt, Human
aaacacuuuucaugcuuaaagcuuuguguuagggagaggcuauggggguauagggagucaucag

SEQ ID NO: 477598 - RNA, 64 nt, Human
gacgaccagggccagcuguucuagagcgggaauuagaggcuagagcggcugaaaugguuguuug

SEQ ID NO: 477599 - RNA, 64 nt, Human
uuccacgugagguuuuguuuagagggauccacuacucaagaaaaaguuagcaaaccacuccuuu

SEQ ID NO: 477600 - RNA, 64 nt, Human
caccaaaagcuugauaugacagagaagaagaaggcucaagaauuuauucaccaguuccucugca

SEQ ID NO: 477601 - RNA, 64 nt, Human
gauccacuggucacagguagacauguggagucaacucaagaaaaagcugagugaacagcaugau

SEQ ID NO: 477602 - RNA, 64 nt, Human
ccuugugaccacaucucccaccacguccccagaucucaagaacgcagcucagcuucuccuucga

SEQ ID NO: 477603 - RNA, 64 nt, Human
agaagagggccugugggagccugcaaacucacugcucaagaagacauggagacuccugcccugu

SEQ ID NO: 477604 - RNA, 64 nt, Human
aaugagauccugucucuuaaagaaaaaaaauaaacucaagaaugauuuuucuaaaaauaugagu

SEQ ID NO: 477605 - RNA, 64 nt, Human
gcuuacugaucacuauaguauugcauaagcacagcucaagaacugagcuuuguauguguccuuu

SEQ ID NO: 477606 - RNA, 64 nt, Human
agcagugggcuacauacaaugagagcccugagcccucaagaacucaugccagcucagcccuaca

SEQ ID NO: 477607 - RNA, 64 nt, Human
uauugacaauggcagagaacaauuaaaggguugacucaagaacuaguuccaaaccuagcagaau

SEQ ID NO: 477608 - RNA, 64 nt, Human
ugagggcauccgacaaggcccaucuccuucccuccucaagaagcagaggccuccucuggaguga

SEQ ID NO: 477609 - RNA, 64 nt, Human
uuguauggcaguauguauauauuguguuaaguuccucaagaaucuccuuaaaaacuuugaaguu

SEQ ID NO: 477610 - RNA, 64 nt, Human
ugggauuuaaggacuucugggggaccaagacauccucaagaaaacaggggcauccagggcuccc

SEQ ID NO: 477611 - RNA, 64 nt, Human
caagucccccagcagaaccagccucaaaaacgcccucaagaacaugaugggccugaacucggac

SEQ ID NO: 477612 - RNA, 51 nt, Human
cuucugggaaguucucuugaacucaagaacucuuuauuuucuaucauucuu

SEQ ID NO: 477613 - RNA, 64 nt, Human
uccugcucacauccacagucagggcacggcgccccucaagaacuccagagucaccugucucauc

SEQ ID NO: 477614 - RNA, 64 nt, Human
cgaaggcccucucuuccucucauaccacguuuugcucaagaagcugggcuguaacaauucaggg

SEQ ID NO: 477615 - RNA, 64 nt, Human; identical to SEQ ID NO: 206314

SEQ ID NO: 477616 - RNA, 64 nt, Human; identical to SEQ ID NO: 206315

SEQ ID NO: 477617 - RNA, 64 nt, Human; identical to SEQ ID NO: 206316

SEQ ID NO: 477618 - RNA, 64 nt, Human
auauuuuguaucagugcuguuaauuugcuguugccucaagaaaaagugcuuuuucuccauggau

SEQ ID NO: 477619 - RNA, 64 nt, Human
ggaaaaccuuauggaaaauaauuauaguacaauucucaagaaaauucacuaugugaaugagaug

SEQ ID NO: 477620 - RNA, 64 nt, Human
uugacccugauuugaccccucuucuuauaaggaucucaagaaucucuucagaagcacugaugac

SEQ ID NO: 477621 - RNA, 64 nt, Human
uucaaggcaaagcaaggaacaucuugagauaugucucaagaauauaaagauguauuauuuuaag

SEQ ID NO: 477622 - RNA, 64 nt, Human
ggcucacaugggaguuguccucacccuuguuaaucucaagaaacucuuauuuauaauagguugc

SEQ ID NO: 477623 - RNA, 64 nt, Human
gaucuguuuggaaacaaccccuugagcugccaggcucaagaaaucauggacucacaggguccug

SEQ ID NO: 477624 - RNA, 64 nt, Human
caauggccuguguguuacaaugauaugaucauuucucaagaauaagucccuuuuuguauguguu

SEQ ID NO: 477625 - RNA, 64 nt, Human
ugucuucugugucacaaacagcacuccaggccagcucaagaagcaaagcaggccaauagaaaug

SEQ ID NO: 477626 - RNA, 64 nt, Human
gccuaugugugcuccauuccucauuucuacuuggcucaagaaaacauuucugcagucaggugag

SEQ ID NO: 477627 - RNA, 64 nt, Human
aaaggcagugaaaauggccagccagagaaaagaucucaagaaccagaaauaaauaaggauggug

SEQ ID NO: 477628 - RNA, 64 nt, Human
guaaagacauacucauuaaguguuauuuauuuuacucaagaacuggaaaccaacuaaaugccuu

SEQ ID NO: 477629 - RNA, 64 nt, Human
caguauguucccaggcuaguguugaacuccugagcucaagaaauccuccugccugagucucuga

SEQ ID NO: 477630 - RNA, 64 nt, Human
uagguuucugauuacauaaaauuugaauagaacacucaagaaguauguagauuuuugaaaaacc

SEQ ID NO: 477631 - RNA, 64 nt, Human
ugugaauguuccaacaccugccuccacuucuccccucaagaaauuuucaacgccaggaaucaug

SEQ ID NO: 477632 - RNA, 64 nt, Human
augaagagacuucugcuuuucaacccccacccuccucaagaaguaauaauuuguuuacuuguaa

SEQ ID NO: 477633 - RNA, 64 nt, Human
aaguuggaugcggccauucaaggggagccaaaaucucaagaaauucccagcagguuaccuggag

SEQ ID NO: 477634 - RNA, 64 nt, Human
guuggugaaccuguaaaaacaaaacaaacaaaacaaaacaaaaaagacaaaaccuaaaacugag

SEQ ID NO: 477635 - RNA, 64 nt, Human
ugauagaugaaauucacaccccugcagaucagaaaaaacaaauagaagaaaaugaggguuacag

SEQ ID NO: 477636 - RNA, 64 nt, Human
uguguuuucuuuggucagaggucaaaauuuaugaaaaacaaaaugcuguaugaauggaaaucau

SEQ ID NO: 477637 - RNA, 64 nt, Human
ccuccccagacaucuggacacugggcauagauuucucaagaaggaagacuccccugccucccca

SEQ ID NO: 477638 - RNA, 64 nt, Human
cauuugaaaacacugcaacagugaacuuuugcaucucaagaaaacauugaaaaauucuaugaau

SEQ ID NO: 477639 - RNA, 64 nt, Human
cgugucuuucucuaggacaagcucccagugaucacucaagaaucuggcucucauucuaagaggc

SEQ ID NO: 477640 - RNA, 64 nt, Human
uugcauucaucuuguguuuuauaugagaaggugccucaagaauuuccuguuggauuuguuuaaa

SEQ ID NO: 477641 - RNA, 64 nt, Human
ccugguucucaauuugacacccuaagcgaucauacucaagaauaguacagauguguggaauacg

SEQ ID NO: 477642 - RNA, 64 nt, Human
agaagugacuuauuaaacuauugaaggaaaaggacucaagaaaaauaauaaaagaccauaaaua

SEQ ID NO: 477643 - RNA, 64 nt, Human
uuuuugaaccuuauuucucaaaacuuauaguagccucaagaagucuauugauauuggucauguu

SEQ ID NO: 477644 - RNA, 58 nt, Human
agcacaucaugucuaucugaauggagcucucaagaacaagcauuguuuaggaagacug

SEQ ID NO: 477645 - RNA, 64 nt, Human
uuuugugcucugaguuuugcuguugaaagucucccucaagaauagcuucagauccucuugugua

SEQ ID NO: 477646 - RNA, 64 nt, Human
caauaucauuuuaauguaauugauuguauauagucucaagaaugguuggugggcaugaguuccu

SEQ ID NO: 477647 - RNA, 64 nt, Human
aacuuuuguagcaaucuggucuauagacuuuuaacucaagaagcuaaggcuagacuuguuaccu

SEQ ID NO: 477648 - RNA, 64 nt, Human
gaaaugucucuccucuagguaucguauuuuguugcucaagaauccaaaaugggucuguggacau

SEQ ID NO: 477649 - RNA, 64 nt, Human
gcugcuuaguuuuuggacugaaaagauauuaaaacucaagaaggaccaagaaguuuucauaugu

SEQ ID NO: 477650 - RNA, 64 nt, Human
gaggaguaacaauacaaauggauuuugggagugacucaagaagugaagaaugcacaagaaugga

SEQ ID NO: 477651 - RNA, 64 nt, Human
caagacacagaacaaggucugucuccuauagucacucaagaagucgaucgagaaguuccacauc

SEQ ID NO: 477652 - RNA, 64 nt, Human
aauuaauuagacuuuuguauaagagaugucaugccucaagaaagccauaaaccugguaggaaca

SEQ ID NO: 477653 - RNA, 64 nt, Human
ucuguauauaacauaagaaacuuugaaagucaaaaaaacaaaaaauuuuaauuccucguagauu

SEQ ID NO: 477654 - RNA, 64 nt, Human
agcaauuggggcaagaagaggacagugauauuuuaaaacaaaguguguuacacuaaaaaccagu

SEQ ID NO: 477655 - RNA, 64 nt, Human
aaaaaaaaaugaccuuuucuugaaauguaacuugaaaacaaaauaaaauguggaacauaauguu

SEQ ID NO: 477656 - RNA, 64 nt, Human
cucccugaagcagacugcugaggaauuacauuugcucaagaauuuuuuccgucaaauugugaac

SEQ ID NO: 477657 - RNA, 64 nt, Human
gccuuaauuauuuaucuuuaguuccuuauuaguucucaagaaacaaaugcuagcuucauaugua

SEQ ID NO: 477658 - RNA, 64 nt, Human
gugggucccuuccuuucuccuuuccucucuacugcucaagaacagauuugaggccaggugcggu

SEQ ID NO: 477659 - RNA, 64 nt, Human
uuauaagcaauguaauuaugcuauucacaggggccucaagaauugguauguaugaugugaucug

SEQ ID NO: 477660 - RNA, 64 nt, Human
auccuuauguagaaaggacuuugaaauuuuucuucucaagaaaugguuuguauaagaauaacaa

SEQ ID NO: 477661 - RNA, 64 nt, Human
augauacugacugauuaauuauuccugauaacaucucaagaaaaggagaaggaaaguguuucug

SEQ ID NO: 477662 - RNA, 64 nt, Human
cuauaaaauugucagcguauuuuuacacuauuggcucaagaauguuauaaugcuaagggacaua

SEQ ID NO: 477663 - RNA, 64 nt, Human
gaagaaaagauuaauaccuuaaaagaagaaaacacucaagaagcagcaguccugaaugguguuu

SEQ ID NO: 477664 - RNA, 64 nt, Human
cugcacuccagccugggccacagagcaagacugucucaagaaaaaaaauuuuuuaaauaaguuu

SEQ ID NO: 477665 - RNA, 64 nt, Human
uauauuuuauacaaauagauugcuuagaaugguucucaagaauuauaagagaaaugaacucaca

SEQ ID NO: 477666 - RNA, 64 nt, Human
agauaagcaccuggcaucuaauggcaggcaggcacucaagaaaugaauuaacuacauaauggaa

SEQ ID NO: 477667 - RNA, 64 nt, Human
cguuucugugaauuucaugaagagcagaacauuucucaagaauccucuugagccaguaaucaau

SEQ ID NO: 477668 - RNA, 64 nt, Human
uuggagaauagaaaugaaaagccacgucauauaacucaagaauaaaugguguuuuggaaauuuu

SEQ ID NO: 477669 - RNA, 64 nt, Human
aucccugcugggcacaccccacaaaccccacucccucaagaagggccagggccagggcuguaug

SEQ ID NO: 477670 - RNA, 64 nt, Human
ugugcaggacaguaaauaaugaaaaccaaauuuccucaagaaauaacugaagaaggagcaagug

SEQ ID NO: 477671 - RNA, 64 nt, Human
ucagauguggucaguagggagcuccaugcccaagcucaagaacgacugcaacacuacuuuaugg

SEQ ID NO: 477672 - RNA, 64 nt, Human
aagauccuguuuuuauacaaauauccuuaguacaaaaacaaaagaaggaaaacuguagggggga

SEQ ID NO: 477673 - RNA, 64 nt, Human
ugguaaucaucuuaccauagcuguaaauuguaucaaaacaaaaaauuaguagauggauuuagga

SEQ ID NO: 477674 - RNA, 64 nt, Human
gaggggggaacucgagaauguauggauuuaccugaaaacaaauuauucauuuaaucaacaggug

SEQ ID NO: 477675 - RNA, 64 nt, Human
acaauuuaauugcucaaccaugcauuuaaaacuccucaagaaaggauugguacugcaacuguag

SEQ ID NO: 477676 - RNA, 64 nt, Human
uucuaaauuugaguaaauacaauuuuuuagguuacucaagaaccagcauuaguaauuucuagua

SEQ ID NO: 477677 - RNA, 64 nt, Human
uaagggaacacacaaagaauuacacaacguuuuccucaagaaaaugguacaaaacacaaccgag

SEQ ID NO: 477678 - RNA, 64 nt, Human
ucuauaauggguuugggggauaauaauggugaagcucaagaacagaugucuauugaguagaacc

SEQ ID NO: 477679 - RNA, 64 nt, Human
caggugaauuguggaaaaugucauguagcugacacucaagaaauagggauuccuaauaauggca

SEQ ID NO: 477680 - RNA, 64 nt, Human
cuggcuuuccugcuauacacauauucacauggcgcucaagaaguuaggcucauggcaacgugug

SEQ ID NO: 477681 - RNA, 64 nt, Human
ucuucaucaaguggaagccaacuguccugccugccucaagaauauguguuuucuuuagcuuccc

SEQ ID NO: 477682 - RNA, 64 nt, Human
uguaaauuugcucuguuuuaagacuuugaacuaccucaagaagaggaaucuaauacaauauuug

SEQ ID NO: 477683 - RNA, 64 nt, Human
cacaaguuuucacugaaugagcauggcagugccacucaagaaaaugaaucuccaaaguaucuuc

SEQ ID NO: 477684 - RNA, 64 nt, Human
cagugcuuagaaguaagcaauucccaggucauagcucaagaauuguuagcaaaugacagauuuc

SEQ ID NO: 477685 - RNA, 64 nt, Human
cuagugccaggucacuauuguaagauguuaaaaucucaagaaaauuucacagagcuaaagaaau

SEQ ID NO: 477686 - RNA, 64 nt, Human
agauaagaaaggacuacagcauuugauguguguccucaagaacuugucuugggucugaaaaagc

SEQ ID NO: 477687 - RNA, 64 nt, Human
cccuauggccuucuugucaaaaccuucacuggagcucaagaaaagcauuucuguuguguuauuu

SEQ ID NO: 477688 - RNA, 64 nt, Human
uugcuuaugggaauccugagcugcuuuucaccaucucaagaagccuaagaaguuauauauuuaa

SEQ ID NO: 477689 - RNA, 64 nt, Human
uuguagauaaaaguguuccaguaaucagaaaauccucaagaaaauugacuucauuauuuggaag

SEQ ID NO: 477690 - RNA, 64 nt, Human
ugcccauuaccuuuccucugccugaaagacgugucucaagaaaaauaaauucuauuuuagaugc

SEQ ID NO: 477691 - RNA, 64 nt, Human
auaaagcuuuuuuauuuaccucaaucaaaaaaagaaaacaaaaaugaacucauugcucuugcug

SEQ ID NO: 477692 - RNA, 64 nt, Human
ccagccuggcgacacagugagacucugucucaaaaaaacaaaacaaacaaacaaaaauacaaaa

SEQ ID NO: 477693 - RNA, 64 nt, Human
cuggcgacacagugagacucugucucaaaaaaacaaaacaaacaaacaaaaauacaaaaaauua

SEQ ID NO: 477694 - RNA, 64 nt, Human
uaguauaucaucauaaaauagacaauguuuuugucucaagaacaagaauaaaauugaaaucugc

SEQ ID NO: 477695 - RNA, 64 nt, Human
gaauaaaaagguaaaacuacauuuagacuucuuucucaagaaaucaaauacagcuuuuuuucaa

SEQ ID NO: 477696 - RNA, 64 nt, Human
aaacgaacaagauuaauuaccugucuuccuguuucucaagaauauuuacguaguuuuucauagg

SEQ ID NO: 477697 - RNA, 64 nt, Human
aucuuuagacuacaauaauacuuuuauccaugugcucaagaaagggccccuuuuuccaacuuau

SEQ ID NO: 477698 - RNA, 64 nt, Human
agauauguauuugcuacucaaguguacagaucuccucaagaaacaucaagggacuccuguguca

SEQ ID NO: 477699 - RNA, 64 nt, Human
uaaauaaccgauuauugauuacuguauuuuuuuucucaagaacagugauagguagaaacuaauu

SEQ ID NO: 477700 - RNA, 64 nt, Human
aaagucaucauugcuguuuagcuugacuguuuuccucaagaacaucgaucugaaggauucauaa

SEQ ID NO: 477701 - RNA, 64 nt, Human
agaugcucuguagagaauuugcuaccgaaguuggcucaagaauuuguuuuuaguguuauuuacc

SEQ ID NO: 477702 - RNA, 64 nt, Human
cuggcaaaggccuuccugcauuuaugaauucucucucaagaagcaagagaacaccugcaggaag

SEQ ID NO: 477703 - RNA, 64 nt, Human
augagaauuaagaauggacaggaccaagacagaacucaagaaagccacuggggaaaacucgaga

SEQ ID NO: 477704 - RNA, 64 nt, Human
aauauguucaacauuuacuucuauuugauaucugcucaagaagucauagaagucuugggaaacu

SEQ ID NO: 477705 - RNA, 64 nt, Human
aguaacauugucagaaauaaauaaaaccacaagucucaagaauuugccacguauguucaagggu

SEQ ID NO: 477706 - RNA, 64 nt, Human
uuucuucagguaacacuacagaguacgugaaaugcucaagaauguagucagacugacacuacua

SEQ ID NO: 477707 - RNA, 64 nt, Human
aaacaaaacacaguccugcauacucaccaccaagcucaagaaauaaaucaucaccaauaccuuu

SEQ ID NO: 477708 - RNA, 64 nt, Human
agccaacucauuggguuguagccaaagguucacucucaagaagcuuuaauauuuaaauaaaauc

SEQ ID NO: 477709 - RNA, 64 nt, Human
aauaucaccuagaaaaguagccucacucuuauuccucaagaauuaauauccaauguuuaugagu

SEQ ID NO: 477710 - RNA, 64 nt, Human
ucagaguaugguacuauaggaaucagaaaaauucaaaacaaauguggauuaaguguuuaggcuc

SEQ ID NO: 477711 - RNA, 64 nt, Human
aaccucauuuuaguuguagaagaaaauuucuuacaaaacaaauuccacaaagaacacccuauau

SEQ ID NO: 477712 - RNA, 64 nt, Human
uggagaggcaggagcccuggggugagaaaagcaaaaaacaaacaaaaaacaaaacccuggagug

SEQ ID NO: 477713 - RNA, 64 nt, Human
acaucagcauuguauacacauauuuucacuuuaacucaagaauuccaggagguaauuuguugau

SEQ ID NO: 477714 - RNA, 64 nt, Human
aucacaaauggcaauguaaaaaucaagacauuuucucaagaacuguguaccacuaaaaguaaua

SEQ ID NO: 477715 - RNA, 64 nt, Human
caagaagcaugcagagaagaauugguuuguuggccucaagaagaaugggagcugcaaacgcggu

SEQ ID NO: 477716 - RNA, 64 nt, Human
ggaaccaugccccuuccccaggcccccagcaagucucaagaacacagcugcacaggccuugacu

SEQ ID NO: 477717 - RNA, 64 nt, Human
aagaaauacaguuuguuuguauaaaauaaacuaucucaagaaaguuuucaacgacagugauagu

SEQ ID NO: 477718 - RNA, 64 nt, Human
ccuuugagaaauccuuuugugaagucauugccugcucaagaauguacaguggcuccccaaugcc

SEQ ID NO: 477719 - RNA, 64 nt, Human
uacagaguguguucgcacuuagccaugggcugggcucaagaaccugauaccuggguugaugugg

SEQ ID NO: 477720 - RNA, 64 nt, Human
gaaaacugccuaacugaagggaaugggggcccugcucaagaagggggccaggcagcuggaauca

SEQ ID NO: 477721 - RNA, 64 nt, Human
ugggguaugagcugccaagucuauuuuaaagacgcucaagaauccucugggguucaucuaggga

SEQ ID NO: 477722 - RNA, 64 nt, Human
ucauucagccaacccagaggauguagacccuguccucaagaagugcagggcgaguucugccgug

SEQ ID NO: 477723 - RNA, 64 nt, Human
gcuguggaacgagacuucugcagagguggcugaccucaagaagcagguacaggcccuucagccc

SEQ ID NO: 477724 - RNA, 64 nt, Human
agacuagauuauauuuaguaggggaaaaauugggcucaagaaccauucaucaguacgugagaca

SEQ ID NO: 477725 - RNA, 64 nt, Human
ugacuuguaagcaguucauagaagcugcucaauacucaagaaucuugcaagacaguuauuaaac

SEQ ID NO: 477726 - RNA, 64 nt, Human
aucuuguuuugaucauuuccacugcacauuucuccucaagaaaagcgaaaggacagacuguugg

SEQ ID NO: 477727 - RNA, 64 nt, Human
ucagcaauuugaacacuaaccucuccccuccuggcucaagaauuacuccgaagucagucugcag

SEQ ID NO: 477728 - RNA, 64 nt, Human
uucugagcaaauaacuacagggugcccauuaccacucaagaagacacuucacguauucuuguau

SEQ ID NO: 477729 - RNA, 64 nt, Human
gagcccuggggugagaaaagcaaaaaacaaacaaaaaacaaaacccuggaguguuaggaggaga

SEQ ID NO: 477730 - RNA, 64 nt, Human
uuucucccucccugugugucacuagagaaaaaaaaaaacaaaaaccuagauuccggauuagggg

SEQ ID NO: 477731 - RNA, 64 nt, Human
cucuacucugccccuuguuguaaauaguuugaguaaaacaaaacuaguuaccuuugaaauauau

SEQ ID NO: 477732 - RNA, 64 nt, Human
accgguagccuucaagcuuguccagcagaaccagcucaagaaaggagaugcccuagugguggcc

SEQ ID NO: 477733 - RNA, 64 nt, Human
guuuuacuccgugccuuacuggauuuggccuguccucaagaaugguaauuaugaagaguggaga

SEQ ID NO: 477734 - RNA, 64 nt, Human
aacagcguccauuuuuucauauuagagguggaaccucaagaaugacuuuauucuuguaucucau

SEQ ID NO: 477735 - RNA, 64 nt, Human
gcauugucuugcccuauagacucaggaguugcuucucaagaaagagccagcaaguauucucagc

SEQ ID NO: 477736 - RNA, 64 nt, Human
uuuuaaacauuaaguuugaaauaggaaugguuuucucaagaauagauuuggugugauaccuugu

SEQ ID NO: 477737 - RNA, 64 nt, Human
ugagugaugagcagacauguuuaagggucuaagucucaagaaucuguuauguguguuugcugcg

SEQ ID NO: 477738 - RNA, 64 nt, Human
auauuuaaucuauuuaaucuucuugcauuuauuucucaagaauuacuggcuuuaaaagaagcca

SEQ ID NO: 477739 - RNA, 64 nt, Human
agcccucaauauuugguaaugcuauuuaaagugacucaagaagcaugugcuaucuggcuuugaa

SEQ ID NO: 477740 - RNA, 64 nt, Human
aaagaaauauuguugcucaguguuguuaauauagcucaagaauugaguuuauauuugcaguaug

SEQ ID NO: 477741 - RNA, 64 nt, Human
ggacgagaagacucagccugagggccugcggagccucaagaagccagaccgcaagaagcgcuac

SEQ ID NO: 477742 - RNA, 64 nt, Human
uguggaacuuccucuuucauuggaaacuuucuuacucaagaaugacggcaguauuguuuucuua

SEQ ID NO: 477743 - RNA, 64 nt, Human
gacugucuucaucaaguauuucccuacagaacuccucaagaaaacagagaucauuuggcuagag

SEQ ID NO: 477744 - RNA, 64 nt, Human
ggacucugggccccuccccagcuccacucccuaccucaagaaugugaccauuuggaaaaggcaa

SEQ ID NO: 477745 - RNA, 64 nt, Human
gccauguugccaaggcugguuucaaacuccuggacucaagaaauccacccaccucagccuccca

SEQ ID NO: 477746 - RNA, 64 nt, Human
ugugacaguuccaggucuugaagcuaaucagcaucucaagaaaguauccagaaagaacaucugc

SEQ ID NO: 477747 - RNA, 64 nt, Human
auccuaagcucucaaaauagcauauucccuagagcucaagaaagcugguccaggagguugaaaa

SEQ ID NO: 477748 - RNA, 64 nt, Human
uggccaccuuggcacaaaagccuugugguauagaaaaacaaauuuguuuuuauguccucuucuc

SEQ ID NO: 477749 - RNA, 64 nt, Human
cuccagccugggugacaaagccagacucucuccaaaaacaaaccagaaacagaaaagaaaugac

SEQ ID NO: 477750 - RNA, 64 nt, Human
agcauacuucuuuugcguauuauguuuaacucacaaaacaaagcucaucaugcguuugauucug

SEQ ID NO: 477751 - RNA, 64 nt, Human
cguugugcuccagccugggcgacagaagucuugucucaagaagaaaacgaacugggaaaauuuc

SEQ ID NO: 477752 - RNA, 64 nt, Human
ucccaugcccguucugaccucagccuuggaacuccucaagaaccugaagauuccaguggucagu

SEQ ID NO: 477753 - RNA, 64 nt, Human
gagauugggaaacuuaaccguuacccaggcaauacucaagaaggagaauccauuuagcaccucc

SEQ ID NO: 477754 - RNA, 64 nt, Human
uuuuugcuguuguaaaaguguuuucauaaguucacucaagaaaaaugcagcuguucugaacugg

SEQ ID NO: 477755 - RNA, 64 nt, Human
uaugucuguuuaaaaauuacuaauucucaaauggcucaagaacauuagaauuuaaguaccuuuu

SEQ ID NO: 477756 - RNA, 64 nt, Human
uguuagugucuucuuccugcccucagcaccacagcucaagaaaaccuaaaguuucaauacaagc

SEQ ID NO: 477757 - RNA, 64 nt, Human
cuacacccacgcacccccccacacacuaugcucucucaagaauguaauuuauuggggccccccc

SEQ ID NO: 477758 - RNA, 64 nt, Human
uuagaguccugccguggcucagguggaucuaaaacucaagaacaaauucuauuuauuuauuauu

SEQ ID NO: 477759 - RNA, 64 nt, Human
auauacuaucuaucucaccaguauuugcucucgacucaagaagguuaacauuuucugauucaug

SEQ ID NO: 477760 - RNA, 64 nt, Human
augacagcugucuguuguuuuaugaaguuuauuucucaagaaaaugggaauaaauuugggauuu

SEQ ID NO: 477761 - RNA, 64 nt, Human
ccacucuagcuugggcaauagagcaaggcuccgucucaagaaaagaaggucauuucccaagacu

SEQ ID NO: 477762 - RNA, 64 nt, Human
aguggaagcauguguguuucuaaaaaguaaaaaucucaagaaaacagaaauggcaugcuuuacc

SEQ ID NO: 477763 - RNA, 64 nt, Human
aauaaugcagagauaauuagacaugguucccgcccucaagaagcucacaaaaguauucaggaaa

SEQ ID NO: 477764 - RNA, 64 nt, Human
aaguucuuuuggaacuuguuucaagccaaaaacucucaagaaagcaaauugcaccucagcugga

SEQ ID NO: 477765 - RNA, 57 nt, Human
cuaccagagggaaaauguaaccugucacucaagaagcacaccuacagagcaccugua

SEQ ID NO: 477766 - RNA, 64 nt, Human
cccuaaauuaucccauuauguaauucuuggucagcucaagaacuggguucuuuuucuaauaauu

SEQ ID NO: 477767 - RNA, 64 nt, Human
aggcaucauuuucgagggucuaaaauuaucugguaaaacaaaugaaauuaagugauccaaagcu

SEQ ID NO: 477768 - RNA, 64 nt, Human
cagccugguuacagagcaagacucugucucaaacaaaacaaaacaaaacaaaaacacacuacug

SEQ ID NO: 477769 - RNA, 64 nt, Human
ugguuacagagcaagacucugucucaaacaaaacaaaacaaaacaaaaacacacuacuguauuu

SEQ ID NO: 477770 - RNA, 64 nt, Human
gagcuggaacaguaggggcagggagaagacaggucucaagaaaagguuuuuaagaaguuucauc

SEQ ID NO: 477771 - RNA, 64 nt, Human
cuuccucuacucucccgugcacugccggccagagcucaagaagcugcugcacgggcugggccuu

SEQ ID NO: 477772 - RNA, 64 nt, Human
auuuuacucugaucaaauaaauaaugcuggaauacucaagaauugcauccucugaccuacuuca

SEQ ID NO: 477773 - RNA, 64 nt, Human
cgggaggaagcacugaaacaacacaaaacccuaucucaagaacuuguuaaccuccggggagagc

SEQ ID NO: 477774 - RNA, 64 nt, Human
uaaccacagggccugagaagucuugcuuuaugggcucaagaaugccaugcgcuggcaguacaug

SEQ ID NO: 477775 - RNA, 64 nt, Human
ucccugauauuauuucuauuuaauacucuuuucucucaagaaaaaaaaaaaaguuuguuuuuuc

SEQ ID NO: 477776 - RNA, 64 nt, Human
auggugggagggaauguuuucaaauuucccauuucucaagaaauguucauauuaauugaggauu

SEQ ID NO: 477777 - RNA, 64 nt, Human
cauuuugaugauucugagaagaaacuuguccuuccucaagaacacagcccugcuucugacauaa

SEQ ID NO: 477778 - RNA, 64 nt, Human
aaaauaaccaaaaaaugugagcuauaauguuucccucaagaacaaacagaaacgagauuugcca

SEQ ID NO: 477779 - RNA, 64 nt, Human
gucagccccaguuggcuuccuggucaacaaggaccucaagaacugccuguggaccgaggccccc

SEQ ID NO: 477780 - RNA, 64 nt, Human
augcagagguaacucucaggcagcuaagcagcaccucaagaaaacauguuaaauuaaugcuucu

SEQ ID NO: 477781 - RNA, 64 nt, Human
cugagaguagcugcugcuuucccugacuuccuuccucaagaauacagucuauucugggggguug

SEQ ID NO: 477782 - RNA, 64 nt, Human
agauuuuccucugacaccagagaacaauaguagucucaagaauggaaaccugaaugucugaggg

SEQ ID NO: 477783 - RNA, 64 nt, Human
aaaaacuucaguuacugaccagucaagagaauuucucaagaaaaaucccagcaacguucccucu

SEQ ID NO: 477784 - RNA, 64 nt, Human
ucaagcacaaagugaugaaugacugccuucaagucucaagaaaacacuuuucccuaacuuuuag

SEQ ID NO: 477785 - RNA, 64 nt, Human
auuugggugagcugcaccugauuaguugaaaggccucaagaacaaacacugcaguuuccuggaa

SEQ ID NO: 477786 - RNA, 64 nt, Human
agaggugggaggugggaggggaagggagaaauccaaaacaaaguguucuugcucugacagaaua

SEQ ID NO: 477787 - RNA, 64 nt, Human
ccagccugggcuacagagcgagacacggucucaaaaaacaaauguguggcuaaggaguuaccug

SEQ ID NO: 477788 - RNA, 64 nt, Human
cucuagugguuaacaugguauucuuuaagaagaaaaaacaaagccaaagaaaacucauuaucug

SEQ ID NO: 477789 - RNA, 64 nt, Human
caacuguggaguugguagcugguaacauuguugucucaagaacaacucaccucucucccuagga

SEQ ID NO: 477790 - RNA, 64 nt, Human
acaacuaaaccuucuuaauauccgccacagaaggcucaagaauccagcccuaaaauucucucca

SEQ ID NO: 477791 - RNA, 64 nt, Human
aacuaccucauaugcaggaugagccaauggcagucucaagaaauguacucgggcgacaccuuac

SEQ ID NO: 477792 - RNA, 64 nt, Human
cuuuucugacauuccuagacagguucauucuuugcucaagaaaggccugaaugacaauguccag

SEQ ID NO: 477793 - RNA, 64 nt, Human
aauacaacaagaucaacuagaagaauucaacugucucaagaaucaagguaccccaauauaucuc

SEQ ID NO: 477794 - RNA, 64 nt, Human
auugaagggagaaaggcaagaugugcacucuggacucaagaaacucuuaguucaguggaggaaa

SEQ ID NO: 477795 - RNA, 64 nt, Human
gucacugugagcucccaggugcagccagaggcaccucaagaagaagaggggcauaaacuuuccu

SEQ ID NO: 477796 - RNA, 64 nt, Human
auucagaugaguuagaagcuuuuuaucccuuccucucaagaaaauauucuuucacccugucucu

SEQ ID NO: 477797 - RNA, 64 nt, Human
aagugacauaauuuacaugcaauauguuuaucaacucaagaauuuaauauaguugguacacaac

SEQ ID NO: 477798 - RNA, 64 nt, Human
uggauacauuaggagcuucaaacacauauaauuucucaagaaauuuccagaugucucaugcugc

SEQ ID NO: 477799 - RNA, 64 nt, Human
uauuaaggaagaacaaggaagggaaugaucuuuacucaagaauuucagaaagucagcacugaag

SEQ ID NO: 477800 - RNA, 57 nt, Human
guccugaauguuuguuuuaaaguggagcucaagaauagcuuuuaaaaguucuuauuu

SEQ ID NO: 477801 - RNA, 64 nt, Human
agaaggcugcuaauuggauuuugguaguucuuaccucaagaaaacuugaauuauuugggggaaa

SEQ ID NO: 477802 - RNA, 64 nt, Human
uaagcuuaugaaggaaugccuccuuuguuacacacucaagaauuugucagcacacaauuaauug

SEQ ID NO: 477803 - RNA, 64 nt, Human
aauaauucagaaauuggguuuugguucagugauucucaagaaaaagaucucuugcccauuaaga

SEQ ID NO: 477804 - RNA, 64 nt, Human
cacaaaauccaaggugcuacaggaaacaagcacacucaagaaaguuuuuuucugaauaacauuu

SEQ ID NO: 477805 - RNA, 64 nt, Human
gaaugauugugugcaugaauuugggagauuguauaaaacaaaacuagcagaauguuuuuaaaac

SEQ ID NO: 477806 - RNA, 64 nt, Human
ccacuagccauuuaauaaguuaaaaaaagauacaaaaacaaaaaccuacuagucuugaacaaac

SEQ ID NO: 477807 - RNA, 64 nt, Human
uacuguuucuguuauaauaaaaggguauguuagaaaaacaaaaaggaggcugggcaugguggcu

SEQ ID NO: 477808 - RNA, 64 nt, Human
uaaagaaaacugaacugaggaaaaugguguuuuccucaagaagacuacuggaacuggaugaccu

SEQ ID NO: 477809 - RNA, 64 nt, Human
auuuuccaucuccaaauagccaggcccucucucccucaagaaaugcccagauguagaaauucau

SEQ ID NO: 477810 - RNA, 64 nt, Human
gaaaguucauuucaucacuuagaaaauaugucuucucaagaacaaaacugugcuguuacaacuc

SEQ ID NO: 477811 - RNA, 64 nt, Human
cuggcucucucucugcugccucuucauacguuuucucaagaacuucaguuuauaauuggaagag

SEQ ID NO: 477812 - RNA, 64 nt, Human
cuccucuauccgaggccauuggagaccccaguuucucaagaauucagcucugcucugagcgucc

SEQ ID NO: 477813 - RNA, 64 nt, Human
agguugaguccagaugcuucucaccuucuuucuccucaagaaagaugcuuuuugggaaacguug

SEQ ID NO: 477814 - RNA, 64 nt, Human
uuccacagacagaugaggcaggagugauggggcacucaagaaaguucagaggaggcauaagcua

SEQ ID NO: 477815 - RNA, 64 nt, Human
uuggaucuuggcaugcacccaccuaacccacuuucucaagaacaagaaccuagaaugaauaucc

SEQ ID NO: 477816 - RNA, 64 nt, Human
acucccagaagaccaaacugccuuccccucagggcucaagaauguguacagucuguggggccgg

SEQ ID NO: 477817 - RNA, 64 nt, Human
uucuccuuuuguguuuuucccacuuuccaauguacucaagaaaauugaacaaauguaauggauc

SEQ ID NO: 477818 - RNA, 64 nt, Human
ccugacuaaggagcugcagcgauacaucgaagggcucaagaagcgccggagcaagaggcuguac

SEQ ID NO: 477819 - RNA, 64 nt, Human
gccccagagggcuuuguggaggacaggccuugcccucaagaacgucguaccugacgcugagccu

SEQ ID NO: 477820 - RNA, 64 nt, Human
uugagcuuuuuggaaggauaauucugauaaggcacucaagaaacguacaaccacagugcuuucu

SEQ ID NO: 477821 - RNA, 64 nt, Human
gagacccgccaccguggaggcagggggcaagaaacucaagaacgcaucaagagcaccagcccug

SEQ ID NO: 477822 - RNA, 54 nt, Human
cuaucacuauguuguuguaacuaacucaagaauuucuaaacucucccaggucac

SEQ ID NO: 477823 - RNA, 64 nt, Human
aaccucacgcaccucccauccuaaucauccaaugcucaagaaacaacuucuacuucugcccuug

SEQ ID NO: 477824 - RNA, 64 nt, Human
acacuaacauuuuccccuucuguaguuguaugaaaaaacaaauauuguuagcauaguagauaaa

SEQ ID NO: 477825 - RNA, 64 nt, Human
aaaacucuuaggucuaaaaugagaaaaaagagagaaaacaaaauguuauuuuuauaccauaacu

SEQ ID NO: 477826 - RNA, 64 nt, Human
cauuuaauuugggaaacuuugauucuugaaagagaaaacaaaagcaugugaauaaacuuugaag

SEQ ID NO: 477827 - RNA, 64 nt, Human
cacuuuucagagucaucuacaaaauuuuucuuuccucaagaaaagaguuccuuuugccuuauuc

SEQ ID NO: 477828 - RNA, 64 nt, Human
gcugacuuaggaucaugcuggaaggaagccaagucucaagaacugucagcaacagaaaaugaga

SEQ ID NO: 477829 - RNA, 64 nt, Human
agccccuggaucuuugggguaaaaggaggguggccucaagaaacaaugucuggggacaggccuu

SEQ ID NO: 477830 - RNA, 64 nt, Human
cucaugccuaacaguggucuguuuuuauaugagacucaagaacaggccucauuccagggcacag

SEQ ID NO: 477831 - RNA, 64 nt, Human
agaggaggagggauucuggucuucacugccaugccucaagaacaccuuuguuuugcacugacaa

SEQ ID NO: 477832 - RNA, 64 nt, Human
cugggaaugcugggaaaugagauacauucccgcccucaagaaucucccagucugguaggagaga

SEQ ID NO: 477833 - RNA, 64 nt, Human
caggagacaugagucuuugccggaggaaaagcagcucaagaacacaugugcagucacugguguc

SEQ ID NO: 477834 - RNA, 64 nt, Human
auauuccuauugaucucauuuuauuuagcaucagcucaagaaacuaagucuuagugcacaguau

SEQ ID NO: 477835 - RNA, 64 nt, Human
ccauaaugagauaaugcauguaggggaaaaguuucucaagaagguggaagaggcagcaggacuu

SEQ ID NO: 477836 - RNA, 64 nt, Human
cauuuauggcaugauuagauugcaaagcaaugaacucaagaaggaauugaaauaaggagggaca

SEQ ID NO: 477837 - RNA, 64 nt, Human
cuaguuuggauaucuuuaggguuuagaaucuaaccucaagaauaagaaauacaaguacaaauug

SEQ ID NO: 477838 - RNA, 64 nt, Human
acccaucuuuuuucuucccucauuuucugggauucucaagaaagaaaaaguaacccauuaucac

SEQ ID NO: 477839 - RNA, 64 nt, Human
cccuuuuggacuaauguuacuguccaaguucuuucucaagaaaccacaucugguucagaagagu

SEQ ID NO: 477840 - RNA, 64 nt, Human
uuuuuaaauuuuuuuauaggcccauaugcucuaucucaagaaacaagaugauuguaacaugucc

SEQ ID NO: 477841 - RNA, 64 nt, Human
uaacuuuccuuuauuucacuuguacccaguuucacucaagaaaucuugaugaauauuuauguug

SEQ ID NO: 477842 - RNA, 64 nt, Human
agacccucucuauagccaugagacuccuuguggccucaagaaauuuagacgcccacgacagcac

SEQ ID NO: 477843 - RNA, 64 nt, Human
uacaguucuugaaaugcagauaauguuuacuuugaaaacaaaugucaugaaugauuuccaguuu

SEQ ID NO: 477844 - RNA, 64 nt, Human
ggcauuccucaucaccaucguguuugcaaagguuaaaacaaaaacaaaaaaccacaaaaauaaa

SEQ ID NO: 477845 - RNA, 64 nt, Human
ccucaucaccaucguguuugcaaagguuaaaacaaaaacaaaaaaccacaaaaauaaaaaacaa

SEQ ID NO: 477846 - RNA, 64 nt, Human
cagccgcacccgugugcacuguaacuuuugugugcucaagaaauuauacagaaaccuacagcug

SEQ ID NO: 477847 - RNA, 64 nt, Human
ccacuccuggagaaagacuuccuugcaggagugacucaagaauuaaucaguaaauaccuugaaa

SEQ ID NO: 477848 - RNA, 51 nt, Human
ggcuggucuugaacuccugagcucaagaaaucaacacaucuuggccuccca

SEQ ID NO: 477849 - RNA, 64 nt, Human
auuuccuucauaaagaaugccacccaucugauuccucaagaaucuagaccuagaaauaccauuu

SEQ ID NO: 477850 - RNA, 64 nt, Human
uuaggaaaaaaaaauccaagaaauguauugaauacucaagaaaaugccacauuucaauuacaua

SEQ ID NO: 477851 - RNA, 64 nt, Human
aucucauaugaucuucuucaagccauuauuuuaacucaagaaaacucuagagaagaaaagugaa

SEQ ID NO: 477852 - RNA, 64 nt, Human
gcacuccacugcagcaggagggacuuaagcuagacucaagaaagcagcuuggagccucuagguu

SEQ ID NO: 477853 - RNA, 64 nt, Human
uuaaaaauaguaagccucccuccucguccccugccucaagaaauugccuccuuauuuaucaaca

SEQ ID NO: 477854 - RNA, 64 nt, Human
gcaugguaugagcacaggucauggacagccccugcucaagaaaaagcaugagcuggccacacau

SEQ ID NO: 477855 - RNA, 64 nt, Human
uuuuugaaaaauagucaccaacuguauauacuuccucaagaacugauaauucauuauaucauca

SEQ ID NO: 477856 - RNA, 64 nt, Human
gcucugccauucaacucggaaacuauaaguaauucucaagaaagcccucauuuuuauaaccugg

SEQ ID NO: 477857 - RNA, 64 nt, Human
acuuuuuacuguuugccaaaacacuugaaugugccucaagaaaagguaccuacuacaugcugua

SEQ ID NO: 477858 - RNA, 64 nt, Human
guucuauacuggauccuuucuuucucuaauaauccucaagaaauccuuacagguaaguauugcu

SEQ ID NO: 477859 - RNA, 64 nt, Human
guacuggagagaugggauccuucuagauacagggcucaagaagucugcugggaguccccugagu

SEQ ID NO: 477860 - RNA, 64 nt, Human
aucaggguccucagugcagagcaacuuacgcauccucaagaauccacugcuuuucaggcaagga

SEQ ID NO: 477861 - RNA, 64 nt, Human
cccacgugggcaauaccagggacccauggggaaacucaagaaugacagcuucuauauuuuguaa

SEQ ID NO: 477862 - RNA, 64 nt, Human
caaaaacaaaaaaccacaaaaauaaaaaacaaaaaaaacaaaaaacccaagaaaaaaaaaaaga

SEQ ID NO: 477863 - RNA, 64 nt, Human
gggcgacugagcgagacucuaucucaaaacaaucaaaacaaaaaagaccuguggacucuaguag

SEQ ID NO: 477864 - RNA, 64 nt, Human
cuacaucucaauuaguggcuggaaaguacaugguaaaacaaaguaaauuuuuuuauguucuuuu

SEQ ID NO: 477865 - RNA, 64 nt, Human
ccacuaagaaggccugucuacacugcaggggaaccucaagaacuuuucauugcacuucuaaaau

SEQ ID NO: 477866 - RNA, 64 nt, Human
caaaaggaagagccuuuuaaaaacauuugccaaccucaagaauaaauacugaaagucuugaaag

SEQ ID NO: 477867 - RNA, 64 nt, Human
uuaggauucugacuaagaggcaaaagagaaaagacucaagaaacugauccuggagaucgagacc

SEQ ID NO: 477868 - RNA, 64 nt, Human
gggagccaggaguaagacaagugggauuuggggccucaagaaauauacucucccagauuuuuac

SEQ ID NO: 477869 - RNA, 64 nt, Human
uuuuguuuuaacaaaauuagcugaagaaguuauucucaagaaaauuggauguuuucauuggccu

SEQ ID NO: 477870 - RNA, 64 nt, Human
guuauaugacaucauccugaagaacuucgagaagcucaagaagcccaggggagaaacaaaggga

SEQ ID NO: 477871 - RNA, 64 nt, Human
aaagauuacauacauuugagaauaagaaauuacucucaagaacuucagaaaucugcaacauaau

SEQ ID NO: 477872 - RNA, 64 nt, Human
gauauuucccauaaaugggaaguuugcccauugucucaagaaauguguauuucagugacaauuu

SEQ ID NO: 477873 - RNA, 64 nt, Human
uaacauuuugggaaguaacugccucugacuucaacucaagaaaacacuuuuuuguugcuaaugu

SEQ ID NO: 477874 - RNA, 64 nt, Human
aaagaagacugacuggguggaggcucugccuugccucaagaaccauccccugcagagcauccag

SEQ ID NO: 477875 - RNA, 64 nt, Human
guaggccuugcaucucgccaccuccacuucuguccucaagaacaaguccuaggucaagggaaac

SEQ ID NO: 477876 - RNA, 64 nt, Human
aaaggaagugaaaauagccagccagaggaaaugucucaagaaccagaaauaaauaaggguggug

SEQ ID NO: 477877 - RNA, 64 nt, Human
gaauuagugcuggauuugaagcuacgcacucagccucaagaacucccuggaauaucccugagaa

SEQ ID NO: 477878 - RNA, 64 nt, Human
gauggcccugggaaucaauuccucaggaauugcccucaagaacucugcuucuugcuuugcagag

SEQ ID NO: 477879 - RNA, 64 nt, Human
aaaucuuagaguucauaaauuuacuugagguugccucaagaacucagggaacaauacuguaaac

SEQ ID NO: 477880 - RNA, 64 nt, Human
aaugaagaauggaaauggaaaaggguggcugcgacucaagaauaauaugggagcccaugaggag

SEQ ID NO: 477881 - RNA, 64 nt, Human
uuaaugauaaauuuuucaacauacuugccauuagaaaacaaaguauugcuaaguacuauaacau

SEQ ID NO: 477882 - RNA, 64 nt, Human
acaaguuuaauuugagacagcuaugguauagcuaaaaacaaaagcccauaaaguuggagauagg

SEQ ID NO: 477883 - RNA, 64 nt, Human
uccggccugggcgacagagcgagacugucucaaaaaaacaaaaaagaaaaaaaaacuggggccu

SEQ ID NO: 477884 - RNA, 64 nt, Human
gaaggagauaaacaugaccaucgucaaagaccugcucaagaaauuuuuaaaaaagaaacaaagu

SEQ ID NO: 477885 - RNA, 64 nt, Human
aauuucuuauuugcuagggaacugguaaucuaggcucaagaaguguguggagaagguuuauuuu

SEQ ID NO: 477886 - RNA, 64 nt, Human
gcaucaguguggacuccuagaacgugcgaccugccucaagaaaaugcaguuuucaaaaacagac

SEQ ID NO: 477887 - RNA, 64 nt, Human
uccuccucaggacauggagaucugugcagaugagcucaagaagguccuuaacacagucgugaac

SEQ ID NO: 477888 - RNA, 64 nt, Human
aguacaccuguagauauuacuguacuuuuauguucucaagaaauaaguuguugccuauucagug

SEQ ID NO: 477889 - RNA, 64 nt, Human
uacugauucauacauuaucucacuugugccaacacucaagaagcaggcuacacugacacuggua

SEQ ID NO: 477890 - RNA, 56 nt, Human
cuuuugaccugcugaguugauaaacacucaagaaccucaggagcgcugccagcuug

SEQ ID NO: 477891 - RNA, 64 nt, Human
ggcuccacuucauccagaugaaggaaaggaagaccucaagaaaaauucacaguugagugcaucc

SEQ ID NO: 477892 - RNA, 64 nt, Human
gaaggagauaaacaccaccaucaucaaagagcugcucaagaaauuuuuaaaaacgaaacaaagu

SEQ ID NO: 477893 - RNA, 64 nt, Human
aggaacuuuauaaugaaacgguucggaauacuggcucaagaaccuaugucaagaugagcugaau

SEQ ID NO: 477894 - RNA, 64 nt, Human
gaugugagcugcuaaauugacuggccuugcagagcucaagaagggggcuuccaaugcugugaga

SEQ ID NO: 477895 - RNA, 64 nt, Human
gccccucucucacacaucacauucccaugguggccucaagaaaggcccggaagcgccaggcugg

SEQ ID NO: 477896 - RNA, 64 nt, Human
guguucuuagugauucacauccacgggacaaaaacucaagaagaaauaagagcugacgccacac

SEQ ID NO: 477897 - RNA, 64 nt, Human
agagggagugugcgaaucuacccugaccaaugggcucaagaauaaaguaugauuuuugagucag

SEQ ID NO: 477898 - RNA, 64 nt, Human
auugagggcuaaaucccaagugucucuugacuggcucaagaauuagggccccaacuacacaccc

SEQ ID NO: 477899 - RNA, 64 nt, Human
accuacuuguggcgaucugaguacucuacucuugcucaagaaguaauacgacaaucagaauaca

SEQ ID NO: 477900 - RNA, 64 nt, Human
uuuccaggggcacacaaugcuauugaaauuacugaaaacaaaauaucugacaucuuauuuacuu

SEQ ID NO: 477901 - RNA, 64 nt, Human
aacaagcagacaccugaaacaaucaacgcccaauaaaacaaaguaggaugaaaauucucuuagu

SEQ ID NO: 477902 - RNA, 64 nt, Human
gcaucuuuucuaguugaaauggugaacugauaggaaaacaaaugaguagaaagaguucaugaag

SEQ ID NO: 477903 - RNA, 64 nt, Human
agagggagugugcgaaucaaaccugaccaagcggcucaagaauaaaauaugaauugagggcccg

SEQ ID NO: 477904 - RNA, 64 nt, Human
uacaaauuuggccuuaagaacugugucuggcguucucaagaaucuagaagauguguaaacaggu

SEQ ID NO: 477905 - RNA, 64 nt, Human
gaugaaugcccgcagugagcuauacuuacgcuuccucaagaagaggauuagcucugauuuugag

SEQ ID NO: 477906 - RNA, 64 nt, Human
acuacaaaauuaugucugcaccagugaauccauucucaagaaaagucuuaacuaggaaacuaaa

SEQ ID NO: 477907 - RNA, 64 nt, Human
ggaacacaggcaaauuauuuguggggguaggaaucucaagaauugcgaaagucaaauauggaga

SEQ ID NO: 477908 - RNA, 64 nt, Human
ccucaccaagcucauuacaucugccagggccugccucaagaagcccagcccagccuuuuccugg

SEQ ID NO: 477909 - RNA, 64 nt, Human
agugguauauuuauguaagaaaaugacuguaaaucucaagaaaaaucucagcagcuaauagcaa

SEQ ID NO: 477910 - RNA, 64 nt, Human
uguaaccauuuguuaacuguacugaagguguguccucaagaagaaaguguucaaauuaaaaaag

SEQ ID NO: 477911 - RNA, 64 nt, Human
ucucuaccaaaaguuaaaaaaaaaaaaaaaaaagcucaagaaccugcacgagggccuaaaacag

SEQ ID NO: 477912 - RNA, 64 nt, Human
cuucucuguuuaguaguugguuggggaaguggggcucaagaaggauuuugggguucaccagaug

SEQ ID NO: 477913 - RNA, 64 nt, Human
gaaaaggggcuggaaaggggggaauggcccacaucucaagaagcaagauauuguuugugguggu

SEQ ID NO: 477914 - RNA, 64 nt, Human
gaacagcauggauuccguggauagcuguugcagucucaagaagacugagagcuuccaaaaugcc

SEQ ID NO: 477915 - RNA, 64 nt, Human
acaccaacauuuugcugccuaccuuguuauccuucucaagaagcugaaguguacgcccucuccc

SEQ ID NO: 477916 - RNA, 64 nt, Human
guauauaccaccuaggaggagaugccaccaagcccucaagaaguugugcccuuccccgccugcg

SEQ ID NO: 477917 - RNA, 64 nt, Human
gccacgugucccagcccagcguccaguggugccucucaagaaaccccgaacgaauguucggaug

SEQ ID NO: 477918 - RNA, 64 nt, Human
guacaucauuauuaauauaaaaauaacaggcagccucaagaaugugcugagauuucucuggaaa

SEQ ID NO: 477919 - RNA, 64 nt, Human
ccuggacugaguauaacagcuuuaugauuaugagaaaacaaauucuuuauuuuuuuuuucuguu

SEQ ID NO: 477920 - RNA, 64 nt, Human
gcucuagauggcuccuagauuauugagagccuucaaaacaaaucaaccuaguucuauagaugaa

SEQ ID NO: 477921 - RNA, 64 nt, Human
cuucauuuuuuguaaaacuuauguuuacaagaagaaaacaaaucaaaacauuuuuuguauuguc

SEQ ID NO: 477922 - RNA, 64 nt, Human
cccugaagcuggauucuuucauacgauacucuuucucaagaagggggcucccugggaucuccag

SEQ ID NO: 477923 - RNA, 64 nt, Human
caggccugcaggguguggggaaggaggacacaaccucaagaaaggaagcgugaaccccagggaa

SEQ ID NO: 477924 - RNA, 64 nt, Human
guuugacacaaacucacacaaccaugacgcacugcucaagaacuacgggcugcucuacugcuuc

SEQ ID NO: 477925 - RNA, 64 nt, Human
guuugacacaaaaucgcacaacgaugacgcacugcucaagaacuacgggcugcucuacugcuuc

SEQ ID NO: 477926 - RNA, 64 nt, Human
guuugacacaaacucgcacaaccaugacgcacugcucaagaacuacgggcugcucuacugcuuc

SEQ ID NO: 477927 - RNA, 57 nt, Human
acaaacucacacaacgaugacgcacuacucaagaacuacgggcugcucuacugcuuc

SEQ ID NO: 477928 - RNA, 64 nt, Human
uugugagugcuuuggaauuuaaaugauuguauaacucaagaagauuacuuuucuauguugcuca

SEQ ID NO: 477929 - RNA, 64 nt, Human
uccagacgaugcauuucuuggccaaaguggcuuccucaagaaagcagcacuuaccuuugaaaaa

SEQ ID NO: 477930 - RNA, 64 nt, Human
caaauggcuucacaguccuuacuucucuaccugccucaagaaggggcucagagcagagacuugu

SEQ ID NO: 477931 - RNA, 64 nt, Human
gcaaacauucuuccuaaaaggaagacuucauuuucucaagaaaugggauuaguuggggguauua

SEQ ID NO: 477932 - RNA, 64 nt, Human
auaacuuuaaaaauaauacuuuuagcucuaauagcucaagaacacaauauucguuaauguucag

SEQ ID NO: 477933 - RNA, 64 nt, Human
gagggcacugaagaccugaaucuacacuaguaaucucaagaaagauuauucauucuaucucaga

SEQ ID NO: 477934 - RNA, 64 nt, Human
caugacgagcucuagcuggaugggcgcagagaaccucaagaaggcaugaagccagccccugcag

SEQ ID NO: 477935 - RNA, 64 nt, Human
gcgcuccagccuggucgacagagugagacuccaucucaagaaaaaauaaaaauaaaguuguucu

SEQ ID NO: 477936 - RNA, 64 nt, Human
gcuuugggaggcugaggcaggaggaucacucgagcucaagaauucaagaccugggcaagagaga

SEQ ID NO: 477937 - RNA, 64 nt, Human
gcacuccagccugggcgacagagcaagacucugucucaagaagaaaaaaaaaauacauauacac

SEQ ID NO: 477938 - RNA, 64 nt, Human; identical to SEQ ID NO: 206317

SEQ ID NO: 477939 - RNA, 64 nt, Human; identical to SEQ ID NO: 206318

SEQ ID NO: 477940 - RNA, 64 nt, Human; identical to SEQ ID NO: 206319

SEQ ID NO: 477941 - RNA, 64 nt, Human
auuuauaugcaugaaguuaaaacaacugacguuacucaagaauuagaaaacuuugcaagauuug

SEQ ID NO: 477942 - RNA, 64 nt, Human
gcacuucagccugggcgacacagcgagacccugucucaagaaagaaaagaaaaagagacaaauu

SEQ ID NO: 477943 - RNA, 64 nt, Human
cuucuccagcgcugggcccucccuugcccccaagcucaagaagggggcacugcccggcccggcu

SEQ ID NO: 477944 - RNA, 64 nt, Human
cgaccuacgccacuggaaacacacccaccgcaaccucaagaaccagacugugcagagggcauug

SEQ ID NO: 477945 - RNA, 64 nt, Human
gcauuccagccugugcgacagaaugagacacugucucaagaaaaaauaaaagugggaaaaucuu

SEQ ID NO: 477946 - RNA, 64 nt, Human
acaggaccccccaagucuuccuacccucugcacccucaagaaacccccagugccuuguaugaag

SEQ ID NO: 477947 - RNA, 64 nt, Human
cuuccuucauuaacaaagacccuuguucuuaucccucaagaagaaacccaccauaaccagccca

SEQ ID NO: 477948 - RNA, 64 nt, Human
cauguaccuauugacuguauccucaugcauuuuccucaagaaugucugaagaagguaguaauau

SEQ ID NO: 477949 - RNA, 64 nt, Human
ccgccgggcuacgaugacauguaccugugaaggccucaagaauguaacaucccaggcuucccuc

SEQ ID NO: 477950 - RNA, 62 nt, Human
gcacuccagcccgggcaacagaguaagacccugccucaagaaaaaaaaaaaaaaaaaaaauc

SEQ ID NO: 477951 - RNA, 64 nt, Human
uggccaggugccggcacagugccucucccagagccucaagaagggccauuuaggagcuugcuuc

SEQ ID NO: 477952 - RNA, 64 nt, Human
gcaccgugccugacucauccaguggggaaggugacucaagaaguuguuuaagccuaggccuagg

SEQ ID NO: 477953 - RNA, 64 nt, Human
aaaagcuguugcuggaaacuugcuuuaggaacagcucaagaaccuuggaguucauauuucacaa

SEQ ID NO: 477954 - RNA, 64 nt, Human
gagagaagaggaguggaugagccugcggguuugccucaagaaacuucaugagggucucuuacua

SEQ ID NO: 477955 - RNA, 64 nt, Human
ucucuauggcgcuuccuugaguggaaggaaaugucucaagaaacaaagaucucgcuggugcgua

SEQ ID NO: 477956 - RNA, 52 nt, Human
aggucaucuugaaaggaugagacucaagaaccaagaugggggaccagcaacc

SEQ ID NO: 477957 - RNA, 64 nt, Human
aaggacaaaauugaaaaccaaaaacuauguuauuaaaacaaaaaaaugcuaacaagagaaauuu

SEQ ID NO: 477958 - RNA, 64 nt, Human
auguugauuucuauggccaacuuucucucuuuguaaaacaaagauugauugauuuucuuguaug

SEQ ID NO: 477959 - RNA, 64 nt, Human
uguguuuucauuguuuuaaguuuuucuucugaguaaaacaaaauuauagaaaacaaaugcaaca

SEQ ID NO: 477960 - RNA, 64 nt, Human
gaaaaucuugcuuuuauggucuuccccccucgcccucaagaacaagggccuugugcgugggccu

SEQ ID NO: 477961 - RNA, 64 nt, Human
acuuguuuauuuucuaguagcuuuuauaaguacacucaagaauuugucagggagaauaauucug

SEQ ID NO: 477962 - RNA, 64 nt, Human
gauccagguuuacuuucuaucagcugagcaaccucucaagaaaaaauaaauaaauaaauaaacc

SEQ ID NO: 477963 - RNA, 64 nt, Human
auguguucuguauaaacaaaugcagcuggaaucgcucaagaaucuuauuuuucuaaauccaaca

SEQ ID NO: 477964 - RNA, 64 nt, Human
gguccugaagacuccggccaagaggcacaagcagcucaagaacaagcuggagaagaacgaggag

SEQ ID NO: 477965 - RNA, 64 nt, Human
auacuuuccuguauaguucacguuucauguaauccucaagaaauaaaaggaagccaaagagugu

SEQ ID NO: 477966 - RNA, 64 nt, Human
uuuacuguaggugaaggcuguauuuguaguaguacucaagaaucaccugauguuuucuuauucu

SEQ ID NO: 477967 - RNA, 64 nt, Human
ggggauuuggcuggugccgaaguguuucugaagucucaagaacugccauaaaaucucacgcugc

SEQ ID NO: 477968 - RNA, 64 nt, Human
aggucgggacauauauuuacauagaucccagacacucaagaauuagcacagcugauguaaaauu

SEQ ID NO: 477969 - RNA, 64 nt, Human
gauguccauuucggggagaggagcaggugggacccucaagaaaaugacggagaacaucccagac

SEQ ID NO: 477970 - RNA, 64 nt, Human
ggcuuuugaaacuuagguauuuuauauuuuuccccucaagaacuuuuuuuuaagagacagauuu

SEQ ID NO: 477971 - RNA, 64 nt, Human
uccucccagcggccuccggcgucuugcccagcagcucaagaagaaaaagaaggacugaacucca

SEQ ID NO: 477972 - RNA, 64 nt, Human
cuuucucgaaauugccaguguguacuuggcuuaacucaagaacaguuucuucuggauuccuuau

SEQ ID NO: 477973 - RNA, 64 nt, Human
ccuuucuacaaagcaaggcccacagacuaccccacucaagaacagcagguaugugggccagagg

SEQ ID NO: 477974 - RNA, 64 nt, Human
ggaggcucccuguacuggagucgucccacuauuccucaagaaaucuuagaaccagcuugugagg

SEQ ID NO: 477975 - RNA, 64 nt, Human
ugaucuguacaaguauguggagcaugaaugcugacucaagaaacuuuuacuccuucugcucaag

SEQ ID NO: 477976 - RNA, 64 nt, Human
uuaaguuuuucuucugaguaaaacaaaauuauagaaaacaaaugcaacaaugugcacaucugac

SEQ ID NO: 477977 - RNA, 64 nt, Human
uucugcugcuguuuagagaaauugugaaacaagcaaaacaaaacuuuccagccauuuuacugca

SEQ ID NO: 477978 - RNA, 64 nt, Human
aaaaucuucaaguagaccuagaagagaguuuuaaaaaacaaaacaauguaaguaaaggauauuu

SEQ ID NO: 477979 - RNA, 64 nt, Human
ugugagcgaauuagcaauaacauacaugagauaacucaagaaaucaaaagauaguugauucuug

SEQ ID NO: 477980 - RNA, 64 nt, Human
uuauaaaaauguauaggcaguauacacagcacuacucaagaagccaaagaaacacuugugcagu

SEQ ID NO: 477981 - RNA, 64 nt, Human
cucaccccucucugaagggcuguuguucugcuuccucaagaaauuaaacauuuguuucugugug

SEQ ID NO: 477982 - RNA, 64 nt, Human
gcacuccagccugggugacagagugagacucugucucaagaaggaaaaaaaaaaaaaagaaugu

SEQ ID NO: 477983 - RNA, 64 nt, Human
ugccagaggaugagugaccaguugcuaaguggggcucaagaagcaccgccuuccccacccccug

SEQ ID NO: 477984 - RNA, 64 nt, Human
ucugucacaaauguuccugaaagcaccacagcuacucaagaagaucaaauucaggacauaaacu

SEQ ID NO: 477985 - RNA, 64 nt, Human
gucaaucugaaagauuuuucaagaaucuuaaaaucucaagaagugaagcagauucauacagccu

SEQ ID NO: 477986 - RNA, 64 nt, Human
agugaugcagacuuguucuucuuuuuaaagcagucucaagaauaagcauuucuuuaaaauguuu

SEQ ID NO: 477987 - RNA, 64 nt, Human
gagaacacaagaacuuaagagaaaaagaaaccuacucaagaaaagacagaagagacagugauuu

SEQ ID NO: 477988 - RNA, 64 nt, Human
gaaugacaaacacaagugccccuuuucucuggaucucaagaaugguggaggacccuggaaggac

SEQ ID NO: 477989 - RNA, 64 nt, Human
uucuugcacuaucacaauugcuuuuuaguuauuucucaagaagcauguucguauuagagacaaa

SEQ ID NO: 477990 - RNA, 64 nt, Human
aaaaccuucgucucuuugugcuuuguaaagcaaacucaagaaaacugguacaccuguaccagcu

SEQ ID NO: 477991 - RNA, 64 nt, Human
aaagaauuagcaguaaaauacaugagauaaagaccucaagaaguuaaaagauacuuaauucuug

SEQ ID NO: 477992 - RNA, 64 nt, Human; identical to SEQ ID NO: 477979

SEQ ID NO: 477993 - RNA, 64 nt, Human
cagacagacugcaccaccccuucccccccugcaucucaagaauaaagcaagcugccuuuguacu

SEQ ID NO: 477994 - RNA, 64 nt, Human
uauuuuagguauuaagacugagaaauauuuaaagcucaagaagaacacagaagcacacaucccu

SEQ ID NO: 477995 - RNA, 64 nt, Human
aaaauaaaguugagcuuaguuuuuuuuaaaaaaaaaaacaaagcaacaaauuaacuagauacag

SEQ ID NO: 477996 - RNA, 64 nt, Human
aaagcaaaccaauaccauugauaagaagaagauaaaaacaaaauauuuuggaguguuuuccaac

SEQ ID NO: 477997 - RNA, 64 nt, Human
ccucugcauguauauuugauaacaugucuuuuguaaaacaaaaauuacaaaaaaauuuguuuac

SEQ ID NO: 477998 - RNA, 64 nt, Human
gucuaacgagagacaucaguuucucaggaugauccucaagaacguuauggaguccauguugcaa

SEQ ID NO: 477999 - RNA, 64 nt, Human
ccaagagcgucagguggcaaaaguccuucuguuacucaagaaaaugcucugaaaaauuccuuuu

SEQ ID NO: 478000 - RNA, 64 nt, Human; identical to SEQ ID NO: 42743

SEQ ID NO: 478001 - RNA, 62 nt, Human; identical to SEQ ID NO: 42744

SEQ ID NO: 478002 - RNA, 64 nt, Human; identical to SEQ ID NO: 42745

SEQ ID NO: 478003 - RNA, 64 nt, Human; identical to SEQ ID NO: 42746

SEQ ID NO: 478004 - RNA, 64 nt, Human; identical to SEQ ID NO: 42747

SEQ ID NO: 478005 - RNA, 64 nt, Human; identical to SEQ ID NO: 42748

SEQ ID NO: 478006 - RNA, 64 nt, Human; identical to SEQ ID NO: 42749

SEQ ID NO: 478007 - RNA, 53 nt, Human; identical to SEQ ID NO: 42750

SEQ ID NO: 478008 - RNA, 64 nt, Human; identical to SEQ ID NO: 42751

SEQ ID NO: 478009 - RNA, 64 nt, Human; identical to SEQ ID NO: 42752

SEQ ID NO: 478010 - RNA, 64 nt, Human; identical to SEQ ID NO: 42753

SEQ ID NO: 478011 - RNA, 64 nt, Human; identical to SEQ ID NO: 42754

SEQ ID NO: 478012 - RNA, 64 nt, Human; identical to SEQ ID NO: 42755

SEQ ID NO: 478013 - RNA, 64 nt, Human
auacagcgagaccuugucucaaaaaaagacaaaaaaaacaaaaagaaauguagauucuugggcc

SEQ ID NO: 478014 - RNA, 64 nt, Human
uggugcucaaugcaguguagacauguuuucaaauaaaacaaaugauuguguacaacaaugaguc

SEQ ID NO: 478015 - RNA, 64 nt, Human
ugucugagcuucucaaauuagcugcaauaggaaaaaaacaaauugggaaaugaaaaaaaaaugg

SEQ ID NO: 478016 - RNA, 64 nt, Human; identical to SEQ ID NO: 42756

SEQ ID NO: 478017 - RNA, 64 nt, Human; identical to SEQ ID NO: 42757

SEQ ID NO: 478018 - RNA, 64 nt, Human; identical to SEQ ID NO: 42758

SEQ ID NO: 478019 - RNA, 64 nt, Human; identical to SEQ ID NO: 42759

SEQ ID NO: 478020 - RNA, 64 nt, Human; identical to SEQ ID NO: 42760

SEQ ID NO: 478021 - RNA, 64 nt, Human; identical to SEQ ID NO: 42761

SEQ ID NO: 478022 - RNA, 64 nt, Human; identical to SEQ ID NO: 42762

SEQ ID NO: 478023 - RNA, 64 nt, Human; identical to SEQ ID NO: 42763

SEQ ID NO: 478024 - RNA, 63 nt, Human; identical to SEQ ID NO: 42764

SEQ ID NO: 478025 - RNA, 64 nt, Human; identical to SEQ ID NO: 42765

SEQ ID NO: 478026 - RNA, 64 nt, Human; identical to SEQ ID NO: 42766

SEQ ID NO: 478027 - RNA, 64 nt, Human; identical to SEQ ID NO: 42767

SEQ ID NO: 478028 - RNA, 64 nt, Human; identical to SEQ ID NO: 42768

SEQ ID NO: 478029 - RNA, 64 nt, Human; identical to SEQ ID NO: 42769

SEQ ID NO: 478030 - RNA, 64 nt, Human; identical to SEQ ID NO: 42770

SEQ ID NO: 478031 - RNA, 64 nt, Human
ucaccucagugaaucuucccagggcucugcaguaaaaacaaaggacaacccagccaagcagagg

SEQ ID NO: 478032 - RNA, 64 nt, Human
ccugauaaccccuugucaguugucagcucuucccaaaacaaagcucuggaguuucugcuggaag

SEQ ID NO: 478033 - RNA, 64 nt, Human
gggaguugcagugaaugucauuaaaauuucuuccaaaacaaaacuagaaauaauugcugagggc

SEQ ID NO: 478034 - RNA, 64 nt, Human; identical to SEQ ID NO: 42771

SEQ ID NO: 478035 - RNA, 64 nt, Human; identical to SEQ ID NO: 42772

SEQ ID NO: 478036 - RNA, 64 nt, Human; identical to SEQ ID NO: 42773

SEQ ID NO: 478037 - RNA, 64 nt, Human; identical to SEQ ID NO: 42774

SEQ ID NO: 478038 - RNA, 64 nt, Human; identical to SEQ ID NO: 42775

SEQ ID NO: 478039 - RNA, 64 nt, Human; identical to SEQ ID NO: 42776

SEQ ID NO: 478040 - RNA, 64 nt, Human; identical to SEQ ID NO: 42777

SEQ ID NO: 478041 - RNA, 64 nt, Human; identical to SEQ ID NO: 42778

SEQ ID NO: 478042 - RNA, 64 nt, Human; identical to SEQ ID NO: 42779

SEQ ID NO: 478043 - RNA, 64 nt, Human
ucauuauuugugaaaaauucccaaaaagcuggggaaaacaaauguguaacuuuuccaguuacuu

SEQ ID NO: 478044 - RNA, 64 nt, Human
gucaaauaauucaaagccuuaaugcagaugcacuaaaacaaagaaaugguaaaugaauuguuug

SEQ ID NO: 478045 - RNA, 64 nt, Human
auaauugauggucagagccagcacuggaauuuugaaaacaaauaaggugauuaucuauuuuagg

SEQ ID NO: 478046 - RNA, 64 nt, Human
cugccuuuggcaagggaagagacccccaacucugcgccccuacuccaugcugcugauccccacc

SEQ ID NO: 478047 - RNA, 64 nt, Human
cugcguagcagcaccagccggccccaccccugcucgccccuaucgcuccagccaaggcgaagaa

SEQ ID NO: 478048 - RNA, 64 nt, Human
ugcccagguuuucuuggaguuauccaagcagcugcgccccuagcugggaucugguaccuggacu

SEQ ID NO: 478049 - RNA, 64 nt, Human
agagugcauccugcucauugucaguguagccccucgccccuauauucauccaggauacuuggaa

SEQ ID NO: 478050 - RNA, 64 nt, Human
ccuucugcuccugaccccaccuccuugcucuuggcgccccuauugucucuggcuaccuccuugu

SEQ ID NO: 478051 - RNA, 64 nt, Human
cccguccgggagguuaggggcgccucugcccggccgccccuacugggaagugaggagccccucu

SEQ ID NO: 478052 - RNA, 64 nt, Human
cccccaggugggguacuggcaucagagccuggugcgccccuaggggagccucccacuggagugc

SEQ ID NO: 478053 - RNA, 64 nt, Human
cacuauugcccacacaugggauggacucuccuaccgccccuacccccuugguacauggcuggcu

SEQ ID NO: 478054 - RNA, 64 nt, Human
ugagggcuuugaaaggccuuccaaacagcuccgucgccccuagcaacuccaccauugggcacug

SEQ ID NO: 478055 - RNA, 64 nt, Human
gcugaggcaggggacaguguccccugcuaccgcccgccccuacccauggcccguugcuggauga

SEQ ID NO: 478056 - RNA, 64 nt, Human
uucacagaaaauaaaagguguuaauuugcuuuuuaaaacaaauuuaauuaucacauuuuaaauu

SEQ ID NO: 478057 - RNA, 64 nt, Human
aggauccuugguguccuaggagaaacagacaagcaaaacaaagugaaaaccgaauggauuaacu

SEQ ID NO: 478058 - RNA, 64 nt, Human
aaggcugcgacagccccccaaacaggaaagacaaaaaacaaacaaaucaaccgaccuaaaaaca

SEQ ID NO: 478059 - RNA, 64 nt, Human
agccugucaccgugagcgccccagaagagcgcggcgccccuagccaucuuuauacagccaugua

SEQ ID NO: 478060 - RNA, 64 nt, Human
ggcauacacagggagccucccuucaaaaagacagcgccccuagucagggaggggauggcggucc

SEQ ID NO: 478061 - RNA, 64 nt, Human
uuacauaguuauagguggagaggguggggugcaccgccccuaucucucacccacguaagugggg

SEQ ID NO: 478062 - RNA, 64 nt, Human
uuucuccggcccucagcccagcgccccuccugcccgccccuagacggccuuuccuuuugcacuu

SEQ ID NO: 478063 - RNA, 64 nt, Human
uggaaaccccagagaaaacggugcccccaccugucgccccuauggacuccccacucuccccucc

SEQ ID NO: 478064 - RNA, 64 nt, Human
acucagccagccucgcuccucgcuccucgcuccucgccccuaggacgccaagggggaaaggaga

SEQ ID NO: 478065 - RNA, 64 nt, Human
caugccugcggggugucuguauccugcaggaggacgccccuacagacccagcaacccaaguugc

SEQ ID NO: 478066 - RNA, 64 nt, Human
cgguuuuaaccacuaggcucuagagcucccgccgcgccccuaugcauuauguucacaaugccaa

SEQ ID NO: 478067 - RNA, 64 nt, Human
ggcugcagagcucugcagguguggauucaccuuacgccccuacagcaggcucagcccuucccac

SEQ ID NO: 478068 - RNA, 64 nt, Human
guccagaagcauuuccuuccugcgaccaucccggcgccccuagggggagaagccaggacagcag

SEQ ID NO: 478069 - RNA, 64 nt, Human
ccuguacaccuuccacgcccgcuuuggggagguucgccccuacuucuaccuggggggugcacgg

SEQ ID NO: 478070 - RNA, 64 nt, Human
cccuucccagcucgucugccugcccccggccccgcgccccuacagccgccaaccucguauaaca

SEQ ID NO: 478071 - RNA, 64 nt, Human
caccccgcgcaggccacugagacggugggacacacgccccuaccugcuccuuccugggcccuca

SEQ ID NO: 478072 - RNA, 64 nt, Human
guacucggccaugcccuguggucacugcgguugccgccccuaauugugccaaaggcugacccgg

SEQ ID NO: 478073 - RNA, 64 nt, Human
gcucagaagcuccaggcauuuuguuucuggugaccgccccuaaugggauaucggugaucacugg

SEQ ID NO: 478074 - RNA, 64 nt, Human
agauuaaaggaacagcagcacuuaggcucaaaaucgccccuacaaagcaguaguuguuucuuaa

SEQ ID NO: 478075 - RNA, 64 nt, Human
ggugaccuggccagagccaagaaacacuuucagaaaaacaaaugugaaggggagagacaggggc

SEQ ID NO: 478076 - RNA, 64 nt, Human
ugcugugcuuuauuugugaaacuuuaaugaggaaaaaacaaauaauaaauguucucguuuugaa

SEQ ID NO: 478077 - RNA, 64 nt, Human
aaaucaugcacuuucuaaaauggugucauccugaaaaacaaaacccaguguuugcacacacaca

SEQ ID NO: 478078 - RNA, 64 nt, Human
cagacuaggagccuuccaccccagcugugucuggcgccccuagaucucugcaagggagguguua

SEQ ID NO: 478079 - RNA, 64 nt, Human
cccgcagacccucccggcgccuugagacccgaggcgccccuaccggccccccuccccgguuagc

SEQ ID NO: 478080 - RNA, 64 nt, Human
cucuuuagaggcagcgggggaggcccgcagagcgcgccccuagccgguuccugucccugcgccu

SEQ ID NO: 478081 - RNA, 64 nt, Human
ugguaugggcagcccaagguugcaugggaaaacacgccccuacagaagugcacuuccuugagag

SEQ ID NO: 478082 - RNA, 64 nt, Human
gacugcggcggcgccucggacaccucagccucgccgccccuacuccugcugccugugugugccu

SEQ ID NO: 478083 - RNA, 64 nt, Human
uuauuuaagguacauuucuuuggguuucuagagacgccccuaagucaccugcuucauuagacgg

SEQ ID NO: 478084 - RNA, 64 nt, Human
cucagagcgggaggccccacccacuggagagccccgccccuaagguacuaugaguccucagggg

SEQ ID NO: 478085 - RNA, 64 nt, Human
uccuccuccaucacuccagggguggugucucggccgccccuaccagcuggcugagcccccuggc

SEQ ID NO: 478086 - RNA, 64 nt, Human
ggggggcgccucugcccggccgccccugcccggccgccccuacugggaagugaggagccccucu

SEQ ID NO: 478087 - RNA, 64 nt, Human
guccucuugguucugccugcagccugccuggcuccgccccuagugcccccuccucaccacacug

SEQ ID NO: 478088 - RNA, 64 nt, Human
acgugcucacccucacacucgccccggcccgcugcgccccuaauugccaaaggguagggaaaug

SEQ ID NO: 478089 - RNA, 64 nt, Human
ggcgcaggagcuucaguggucuggggcccuccgccgccccuaugcugggaccaggcucccagug

SEQ ID NO: 478090 - RNA, 64 nt, Human
aucacaagcccaccugacccaccugaccacugaccgccccuauuuauucguccgcucggacacc

SEQ ID NO: 478091 - RNA, 64 nt, Human
gaugaugaggcccaugccccucacccccacgccccgccccuacaaccuaagucauaaauccucu

SEQ ID NO: 478092 - RNA, 64 nt, Human
cucccaccgcuuuauuucuuucgguuucggaugcaaaacaaaaaauuuuaaaagaaaaugugac

SEQ ID NO: 478093 - RNA, 64 nt, Human
ucuuuccacacaggauuccguuggugaaccuguaaaaacaaaacaaacaaaacaaaacaaaaaa

SEQ ID NO: 478094 - RNA, 64 nt, Human
ccacacaggauuccguuggugaaccuguaaaaacaaaacaaacaaaacaaaacaaaaaagacaa

SEQ ID NO: 478095 - RNA, 64 nt, Human
auuccguuggugaaccuguaaaaacaaaacaaacaaaacaaaacaaaaaagacaaaaccuaaaa

SEQ ID NO: 478096 - RNA, 64 nt, Human
cuaaauggaaaacuguuaagcaaacauccauaguaaaacaaauaaucuucagugagaucuuuuu

SEQ ID NO: 478097 - RNA, 64 nt, Human
uaaccaccagaagacuugaaaaucuuaaaaaaaaaaaacaaaaaaacaagaaaaggcaacaucu

SEQ ID NO: 478098 - RNA, 64 nt, Human
uguaggaaauguucuuuuuuaaaaaaaaauaacaaaaacaaaacaaaacuauuuauuuugugau

SEQ ID NO: 478099 - RNA, 64 nt, Human
gaaauguucuuuuuuaaaaaaaaauaacaaaaacaaaacaaaacuauuuauuuugugauuguuu

SEQ ID NO: 478100 - RNA, 64 nt, Human
cugcauuauguuuaguguucucugugugggcaugaaaacaaagaaaugccccuacugaagacug

SEQ ID NO: 478101 - RNA, 64 nt, Human
uuuucuucugguuuaauuuuaauuuucuauuuucaaaacaaauauuuacuucauuugccaauca

SEQ ID NO: 478102 - RNA, 64 nt, Human
aagagggacuuuaugggauaguauggacuauggaaaaacaaauuugcacaauggccugggaagu

SEQ ID NO: 478103 - RNA, 64 nt, Human
uguuucuuaaugaacuugcaaaggaauauugcuaaaaacaaacaaaaaaaacuguuaucgaacu

SEQ ID NO: 478104 - RNA, 64 nt, Human
guacuuuauuuuuuugugccuucugaaaggaucuaaaacaaaaauauuuugccuuuuuuucccc

SEQ ID NO: 478105 - RNA, 64 nt, Human
gaaauaugucaugugaaauuauuuuaaaaauguaaaaacaaaacuuucugcuaacaaaauacau

SEQ ID NO: 478106 - RNA, 64 nt, Human
aauuugcaacuuaauauauucucaaaaauauauuaaaacaaacuaaauuauugcuuaugcuugu

SEQ ID NO: 478107 - RNA, 64 nt, Human
aauuugcaacuuaauauguucucaaaaauauguuaaaacaaacuaaauuauugcuuaugcuugu

SEQ ID NO: 478108 - RNA, 64 nt, Human
agcauaaguuacaaccccuaggagcucugcuuucaaaacaaaaagagauugggggaguggggag

SEQ ID NO: 478109 - RNA, 64 nt, Human
uauaacuauuuggagggucuuuaacauugccaaaaaaacaaauauguugauuuuuauuuuauuu

SEQ ID NO: 478110 - RNA, 64 nt, Human
aauguuuaaaucaaucuguaaaagguaaaaaugaaaaacaaaaacaagcaaacaaacaaaaaac

SEQ ID NO: 478111 - RNA, 64 nt, Human
ccucucucccccucggugaaugauggcugcuucuaaaacaaauacaaccaaaacucagcagugu

SEQ ID NO: 478112 - RNA, 64 nt, Human
ccuggugacagagcgagacucccucucaaaaaaaaaaacaaacaaaaaagaagugugggcaacc

SEQ ID NO: 478113 - RNA, 64 nt, Human
guauauguucagcaauguugaucucauaaaaggaaaaacaaaagauuuaaguauucuauauacc

SEQ ID NO: 478114 - RNA, 64 nt, Human
guuaacuaaaaaugcugagaccccuuuuuauagaaaaacaaaaagacaucaagucuucuuaauu

SEQ ID NO: 478115 - RNA, 64 nt, Human
uuuuguaugcuuuuuugaaauauguaaaaauuacaaaacaaaccucaucaguauaauauaauua

SEQ ID NO: 478116 - RNA, 64 nt, Human
gauuuucagccaugaccauguucacuuuauaaucaaaacaaaaauaaaggucccauuuuuacaa

SEQ ID NO: 478117 - RNA, 64 nt, Human
gaaauaaaugauucacuggaacaauucuacugucaaaacaaaggggguuuacaacuuguccuaa

SEQ ID NO: 478118 - RNA, 64 nt, Human
ucugagcacagaaauuaaggcaaaaaaccaaagcaaaacaaauacauggugcugaaauuaacuu

SEQ ID NO: 478119 - RNA, 64 nt, Human
gggccccuauaacaaaagacagauugacaagagaaaaacaaacauaaauuuauuagcggguaua

SEQ ID NO: 478120 - RNA, 64 nt, Human
ucgacaaagaacaguaaauuuuuagagaaacaacaaaacaaagaaaaagagcuuugagucugua

SEQ ID NO: 478121 - RNA, 64 nt, Human
ucccauugagagaaagaucucugugcuguaaacuaaaacaaauugugcauuccuuccggggcca

SEQ ID NO: 478122 - RNA, 64 nt, Human
cugagaucgcgguauuaaaucugugaaagaaaacaaaacaaaacaaaaacggcuucuuggcguu

SEQ ID NO: 478123 - RNA, 64 nt, Human
uuuggcugagaucgcgguauuaaaucugugaaagaaaacaaaacaaaacaaaaacggcuucuug

SEQ ID NO: 478124 - RNA, 64 nt, Human
acucuguucguuaugauuugucuguuuaagagagaaaacaaaguggacuugauuuuuauuaagg

SEQ ID NO: 478125 - RNA, 64 nt, Human
ccagccugggugacagagcgagacuccgucucaaaaaacaaaaagcccguggcaauuaauggua

SEQ ID NO: 478126 - RNA, 64 nt, Human
cuagccaaggcuaguuccuuucaauuccauuuaaaaaacaaaaaccagcaggugugguggcuca

SEQ ID NO: 478127 - RNA, 64 nt, Human
gaaacaaagcgagacccugucuccacuaaacauaaaaacaaaauuacuggggccccauggcaca

SEQ ID NO: 478128 - RNA, 64 nt, Human
uaaggcuuguaaauacauagaacaaauauuuaaaaaaacaaaaagaaauugacucaguacuauu

SEQ ID NO: 478129 - RNA, 64 nt, Human
cagaggcagccccacuguaaagaagggucagauuaaaacaaaaaacugccaaaagcauccccuc

SEQ ID NO: 478130 - RNA, 64 nt, Human
ugcuugcuguaaauuaagcaaacaugcuauaauaaaaacaaaaugaaggaaauaaugauuaacu

SEQ ID NO: 478131 - RNA, 64 nt, Human
agcaaaaaaaaaaaaaaaacaaaaaaacaaaaaaaaaacaaaacaguuuuuaaaacugauuuua

SEQ ID NO: 478132 - RNA, 64 nt, Human
aaauaguccugagcaaaaaaaaaaaaaaaacaaaaaaacaaaaaaaaaacaaaacaguuuuuaa

SEQ ID NO: 478133 - RNA, 64 nt, Human
cugaaagcaaauaguccugagcaaaaaaaaaaaaaaaacaaaaaaacaaaaaaaaaacaaaaca

SEQ ID NO: 478134 - RNA, 64 nt, Human
uuccccaccuccucauuuuaguaaaaaacaaacaaaaacaaaaaaaccugagaaguuugaauug

SEQ ID NO: 478135 - RNA, 64 nt, Human
caaauagcucuuccccaccuccucauuuuaguaaaaaacaaacaaaaacaaaaaaaccugagaa

SEQ ID NO: 478136 - RNA, 64 nt, Human
ucuguagauucucuccucucccaucccagaaaacaaaacaaaauaaugcuuuucgaaauuguuu

SEQ ID NO: 478137 - RNA, 64 nt, Human
gcaaaucuguagauucucuccucucccaucccagaaaacaaaacaaaauaaugcuuuucgaaau

SEQ ID NO: 478138 - RNA, 64 nt, Human
gcccaccugggcacuuuuagauaaaaaaaaaaaaaaaacaaaaaacaacaccaaaaaaacagca

SEQ ID NO: 478139 - RNA, 64 nt, Human
aaagcaacucuuaucaaggauuaauuuaauuuuuaaaacaaauacaaguuauugauucacucuu

SEQ ID NO: 478140 - RNA, 64 nt, Human
gcguguaagauguuaccugguuugucucuuuuggaaaacaaaaaucagaaggcugcauucuaga

SEQ ID NO: 478141 - RNA, 64 nt, Human
cccaucaccaucccaugaggaaaaaaaaaaaaguaaaacaaagacaaaaaaaaucuuuuguaca

SEQ ID NO: 478142 - RNA, 64 nt, Human
gaccuuuucaauuacaaagaaccuccuggaaaaaaaaacaaaagcugaacagaggcggccgugg

SEQ ID NO: 478143 - RNA, 64 nt, Human
acuuugaaaacugcuuaaagguuuauuucaaauuaaaacaaaaaaaucaacgacagcaguagac

SEQ ID NO: 478144 - RNA, 64 nt, Human
ccauuuuaaggaacuauucuuuggaaaaaaacaaaaaacaaaaaaaacaacaaaaaaagcuaag

SEQ ID NO: 478145 - RNA, 64 nt, Human
ggagcauccauuuuaaggaacuauucuuuggaaaaaaacaaaaaacaaaaaaaacaacaaaaaa

SEQ ID NO: 478146 - RNA, 64 nt, Human
aaccuaucuuuguuuuuggucaaaacacacauagaaaacaaaaugauccaaugaaaacugguuu

SEQ ID NO: 478147 - RNA, 64 nt, Human
gagcgacacucggucucaaaaaacaaaacaaaacaaaacaaaauuagagauugggucuuuccca

SEQ ID NO: 478148 - RNA, 64 nt, Human
ugacagagcgacacucggucucaaaaaacaaaacaaaacaaaacaaaauuagagauugggucuu

SEQ ID NO: 478149 - RNA, 64 nt, Human
cugggugacagagcgacacucggucucaaaaaacaaaacaaaacaaaacaaaauuagagauugg

SEQ ID NO: 478150 - RNA, 64 nt, Human
ccagccugggugacagagcgacacucggucucaaaaaacaaaacaaaacaaaacaaaauuagag

SEQ ID NO: 478151 - RNA, 64 nt, Human
cuuuccuuccagcgagcaucauucggcuguuaccaaaacaaacaucuuaaucugcaccuuucuc

SEQ ID NO: 478152 - RNA, 64 nt, Human
cuuuuucuacaccuuuuguugcuuaaaaagaaacaaaacaaaucacauacauacauuuaaaaaa

SEQ ID NO: 478153 - RNA, 64 nt, Human
agugaagggaaagguuuaagagaauccaguugagaaaacaaacuugcuaaucacuuuaccaaug

SEQ ID NO: 478154 - RNA, 64 nt, Human
acaagaugguacaaccuuuauucuuuuccaaaauaaaacaaagggcacagcaucuguagucagc

SEQ ID NO: 478155 - RNA, 64 nt, Human
ucuguacaaaggggaaagaacauaaagguaaaacaaaacaaaacaacauuuugagaacaaagau

SEQ ID NO: 478156 - RNA, 64 nt, Human
uagcaucuguacaaaggggaaagaacauaaagguaaaacaaaacaaaacaacauuuugagaaca

SEQ ID NO: 478157 - RNA, 64 nt, Human
uucuuuccauuacacaauuagacuccuacaguuuaaaacaaacuuuaaaccacuaucuugcacu

SEQ ID NO: 478158 - RNA, 64 nt, Human
cuccagccugggcgacagagcaagacucugucucaaaacaaacacaaauacaguauccaaacau

SEQ ID NO: 478159 - RNA, 64 nt, Human
gccuggccaacauggugaaaccccgucuccacuaaaaacaaaaacaauuagcugggcauggugg

SEQ ID NO: 478160 - RNA, 64 nt, Human
cauucagcagaaaaagugacauuuaauggaaagcaaaacaaaucagguccugauuuaaaauuuu

SEQ ID NO: 478161 - RNA, 64 nt, Human
cauaaucagccaccauuuaacccuuccuuguucuaaaacaaaaaccaaagggcgcugguuggua

SEQ ID NO: 478162 - RNA, 64 nt, Human
agucuuugacucuuuaaauuccaauacugauuccaaaacaaauaaauauuuugaagacucaaug

SEQ ID NO: 478163 - RNA, 64 nt, Human
ccuguuuguggcuauuuuaaauucauauuauuaaaaaacaaaaaaaacccaccuauuuguguug

SEQ ID NO: 478164 - RNA, 64 nt, Human
agugggccauuagccagauuugucuuuuuguuguaaaacaaaauuugacuaauuuuacauguuu

SEQ ID NO: 478165 - RNA, 64 nt, Human
uauacaaaaugcuggguugagccuuucaugaggaaaaacaaaagacaugguacgcauuccaggg

SEQ ID NO: 478166 - RNA, 64 nt, Human
aaauuucaaagaauauuauggccugaaguucauaaaaacaaacuuaauuuugacuaaaguaaua

SEQ ID NO: 478167 - RNA, 64 nt, Human
auuaucaaagaauaucagggccugacauccacaaaaaacaaacuuaauuuugauugaacuaaua

SEQ ID NO: 478168 - RNA, 64 nt, Human
uguucuagcucgaguggaagaacucauugaaauaaaaacaaagucuaccucugaagaaaauauu

SEQ ID NO: 478169 - RNA, 64 nt, Human
ggacuggccagcguaaaugaccccacugcagcagaaaacaaacacacgaggagcaugcagcgaa

SEQ ID NO: 478170 - RNA, 64 nt, Human
uccgcacucaaggaguaaccaggucguccaagcaaaaacaaaugggaaaaugucuuaaaaaauc

SEQ ID NO: 478171 - RNA, 64 nt, Human
aaucaugauccuuguguucagcucuuuccaaauuaaaacaaauauacauuuucuaaauaaaaau

SEQ ID NO: 478172 - RNA, 64 nt, Human
aacuuggguugauuucaauguuaauaaacuaggcaaaacaaauaacuguuagaagguacaauuu

SEQ ID NO: 478173 - RNA, 64 nt, Human
gggcgacagagcaagacgccaucucaaaaacaaaaaaacaaaauucauguuacuaaaagacagg

SEQ ID NO: 478174 - RNA, 64 nt, Human
uccagccugggcgacagagcaagacgccaucucaaaaacaaaaaaacaaaauucauguuacuaa

SEQ ID NO: 478175 - RNA, 64 nt, Human
uaugugucuuaaugcagucagauuguaaaaaacaaaaacaaagaaacuaagaaucuuacuaaaa

SEQ ID NO: 478176 - RNA, 64 nt, Human
agaguauaugugucuuaaugcagucagauuguaaaaaacaaaaacaaagaaacuaagaaucuua

SEQ ID NO: 478177 - RNA, 64 nt, Human
acuacaaaagaaaaauauaaaaguaaaacaaacaaaaacaaaccugaaaacugcuuggcauuug

SEQ ID NO: 478178 - RNA, 54 nt, Human
acuacaaaagaaaaauauaaaaguaaaacaaacaaaaacaaaccugaaaacugc

SEQ ID NO: 478179 - RNA, 64 nt, Human
uacaauuuaaaaaguauauucuauaauaaauaauaaaacaaauuguuuuaaauguuuaguuuca

SEQ ID NO: 478180 - RNA, 64 nt, Human
uuugugguuucaaaaguguaaauaaccaauucagaaaacaaaauggaaaaacgaccccuuguua

SEQ ID NO: 478181 - RNA, 64 nt, Human
uccuuuuccuauuugaauuucuuuggugcuguagaaaacaaaaaaagaaaaauauauauucaua

SEQ ID NO: 478182 - RNA, 64 nt, Human
acagaaaauuguauuuuccugucuuucauggcugaaaacaaaaguaaugggaauuuuaaauacg

SEQ ID NO: 478183 - RNA, 64 nt, Human
ucuaggacccgguuucuuuuacugauuuaaaaacaaaacaaaaaaaaauaaaaaaguugugccu

SEQ ID NO: 478184 - RNA, 64 nt, Human
cagcuucuaggacccgguuucuuuuacugauuuaaaaacaaaacaaaaaaaaauaaaaaaguug

SEQ ID NO: 478185 - RNA, 64 nt, Human
gccagcagugugauaauuuaaacauauuuaaacaaaaacaaaaaaaaugaaugcacaaacuugc

SEQ ID NO: 478186 - RNA, 64 nt, Human
uuaagaacuacaguuuucaccacuuaacauaaguaaaacaaaguccuucauaauuuaaccauua

SEQ ID NO: 478187 - RNA, 64 nt, Human
augaugaauagcccaacuccaaacaauucugaugaaaacaaaaucacagcacccacuaccauac

SEQ ID NO: 478188 - RNA, 64 nt, Human
accuucguucauucuaaagagacugauagaauuaaaaacaaagugccuuaucuugcacuggagu

SEQ ID NO: 478189 - RNA, 64 nt, Human
caauuuuaggacaggaaaguaacauuaaauguagaaaacaaaaauggaacauuuauucgcaacu

SEQ ID NO: 478190 - RNA, 64 nt, Human
cacugaggccaguggaauuuccccaggccuuguuaaaacaaagaaagcauuguaccucucagau

SEQ ID NO: 478191 - RNA, 64 nt, Human
ucugucucucuaccuggucaucuucaaggcuaagaaaacaaacaagcuacauucuguauuugcc

SEQ ID NO: 478192 - RNA, 64 nt, Human
acaaucuuuuaaauucucuuccuaaauuucuacaaaaacaaauaauaaaauauucagcaguggg

SEQ ID NO: 478193 - RNA, 64 nt, Human
ggugauuccaggaggaguuagccaaacaacaacaaaaacaaaaaaugugcuguucaaguuuuca

SEQ ID NO: 478194 - RNA, 64 nt, Human
ggacaaugauggcuauucuaaacgcuaaggaaaaaaaacaaacacagaacuguuucaaguacuc

SEQ ID NO: 478195 - RNA, 64 nt, Human
ggggagaugccccuucuuauagcacuggaggaggaaaacaaauucuugucccccucagaaugag

SEQ ID NO: 478196 - RNA, 64 nt, Human
guuagagaagugcuuacuaagggguuuucuaauaaaaacaaaugccacauugacuugucuguuu

SEQ ID NO: 478197 - RNA, 64 nt, Human
auuuauuuugagucacuguuaccaaauuagaacuaaaacaaaguuacauaaaaaguuauuguga

SEQ ID NO: 478198 - RNA, 64 nt, Human
ugaucucuccucgaacucaacuaacuauaucuugaaaacaaagacccuucgguguccaucuaca

SEQ ID NO: 478199 - RNA, 64 nt, Human
cagaauugaguuuucuauuaaggauccaaaaagaaaaacaaaaugcuaaugaagccaucaguca

SEQ ID NO: 478200 - RNA, 64 nt, Human
aaaugguuuuuaaacaaccaaacaaaaagcaggaaaaacaaaugggaaaugggggggcgggggg

SEQ ID NO: 478201 - RNA, 64 nt, Human
gcuucacuugccuagucuugaagaaaaaaaacaaaaaacaaaaaaaaaccuuguuccuuuauag

SEQ ID NO: 478202 - RNA, 64 nt, Human
ucccacugcuucacuugccuagucuugaagaaaaaaaacaaaaaacaaaaaaaaaccuuguucc

SEQ ID NO: 478203 - RNA, 64 nt, Human
gauuaguuaaguucagguaauguuuauguaaugaaaaacaaauagcauccuucuuguuucauuu

SEQ ID NO: 478204 - RNA, 64 nt, Human
aauaaagccccucuuugcauuuaaaaccaaagucaaaacaaaacucuuguaaugcaauuaauua

SEQ ID NO: 478205 - RNA, 64 nt, Human
cacaaaacugaaugcugaaaagcuacuagacuggaaaacaaacacugcauuauguauguuaagu

SEQ ID NO: 478206 - RNA, 64 nt, Human
cuaaguguuuucuuguccauccuuaagggacuuuaaaacaaauuaugccucuuuaaguccuuga

SEQ ID NO: 478207 - RNA, 64 nt, Human
ugauuauaaaagaugaaauaauuaacugaauaauaaaacaaagcuauuaguaagcauuggguau

SEQ ID NO: 478208 - RNA, 64 nt, Human
caaguauuagugcaugcucagaacaggugggacuaaaacaaacucaaggaacuguuggcuguuu

SEQ ID NO: 478209 - RNA, 64 nt, Human
gcuucaccuuguacugcaagaugaauuuguaaacaaaacaaaauuggacugucuggaaagcuaa

SEQ ID NO: 478210 - RNA, 64 nt, Human
cacaucgugcagucgugucauaaaaaaacaaaacaaaacaaaaaaacacuaggaguccacucaa

SEQ ID NO: 478211 - RNA, 64 nt, Human
agauccacaucgugcagucgugucauaaaaaaacaaaacaaaacaaaaaaacacuaggagucca

SEQ ID NO: 478212 - RNA, 64 nt, Human
ggaccagauccacaucgugcagucgugucauaaaaaaacaaaacaaaacaaaaaaacacuagga

SEQ ID NO: 478213 - RNA, 64 nt, Human
ugcuuauaaaaaguuauaaauaucgaguagcucuaaaacaaaccaccugaccaagagggaagug

SEQ ID NO: 478214 - RNA, 64 nt, Human
cguucccauucuaauuaaugcccuuucuuauuuaaaaacaaaaccaaaugauaucuaaguaguu

SEQ ID NO: 478215 - RNA, 64 nt, Human
caaugcacuuuuaugaaguuuuuaaaaauaaaggaaaacaaaaaacuuuacugaguguuauaag

SEQ ID NO: 478216 - RNA, 64 nt, Human
ugagcuauacuuuaacauuaugagagaaaagcauaaaacaaaaauagguaguucuuggcuuuua

SEQ ID NO: 478217 - RNA, 64 nt, Human
uaguuucaguggaugauugaaaacaacaacaacaaaaacaaaaugaaacuaaucugcugccucu

SEQ ID NO: 478218 - RNA, 64 nt, Human
acuuuacagcaacauucgccauacuagcggagguaaaacaaaagaaauauugaaaacugaggca

SEQ ID NO: 478219 - RNA, 64 nt, Human
gugacauaacucauacaucggcacugaauuaaacaaaacaaaauacaacuguugcuauaucuuu

SEQ ID NO: 478220 - RNA, 64 nt, Human
auguugguuucaguggcuggaauuaaaacaaaacaaaacaaacuuccaaacaguguguuggugc

SEQ ID NO: 478221 - RNA, 64 nt, Human
cuucuauguugguuucaguggcuggaauuaaaacaaaacaaaacaaacuuccaaacaguguguu

SEQ ID NO: 478222 - RNA, 64 nt, Human
aauaacuucuauguugguuucaguggcuggaauuaaaacaaaacaaaacaaacuuccaaacagu

SEQ ID NO: 478223 - RNA, 64 nt, Human
cauacacuaccucuuaccugagaggugucuuuuaaaaacaaaucuuggcagcuguccuuugaca

SEQ ID NO: 478224 - RNA, 64 nt, Human
cuguggucagucauuugaaaauugacuuuaauuuaaaacaaaggccugugccucccacccagga

SEQ ID NO: 478225 - RNA, 64 nt, Human
acucuaucucaaaaaaaaacaaaaaaaaaaacaaaaaacaaagaugagucgcacaucugcugcu

SEQ ID NO: 478226 - RNA, 64 nt, Human
gagcgagacucuaucucaaaaaaaaacaaaaaaaaaaacaaaaaacaaagaugagucgcacauc

SEQ ID NO: 478227 - RNA, 64 nt, Human
gccugggcaacagagcgagacucuaucucaaaaaaaaacaaaaaaaaaaacaaaaaacaaagau

SEQ ID NO: 478228 - RNA, 64 nt, Human
uuaguagauuuuucacacaccucauuauuaaaaaaaaacaaacaugcuggugucuugguuaccc

SEQ ID NO: 478229 - RNA, 64 nt, Human
ucucucggucuuauaaaacucguuggugucuuauaaaacaaacagugauaaucucaaguuagaa

SEQ ID NO: 478230 - RNA, 64 nt, Human
acuaaucacacaacaauuuugagaaguaggcuauaaaacaaaaaaagguugcuguuuucuauuu

SEQ ID NO: 478231 - RNA, 64 nt, Human
uugacauuggcacuaaaugcauuuggggaugguuaaaacaaauuacuauagaacauuuaaauga

SEQ ID NO: 478232 - RNA, 64 nt, Human
ugcagauauagcaaaggauuaguaauauagccugaaaacaaaugggagcauagcagugugugag

SEQ ID NO: 478233 - RNA, 64 nt, Human
uuguacuaaagcauuugcuauaauuauuuuuaaaaaaacaaacagaugaaaaccucagagaagg

SEQ ID NO: 478234 - RNA, 64 nt, Human
aggaguaaacagcuuauuuauacauuuugaggagaaaacaaaguguuucacuaggaacaccucu

SEQ ID NO: 478235 - RNA, 64 nt, Human
gugacaggaguuaagcccugucucagaaaaaaaaaaaacaaaaacccaaaaaguacuuaaaguu

SEQ ID NO: 478236 - RNA, 64 nt, Human
caaggccugggaucaaccugggcuguccacacagaaaacaaaaacccaaccaaaccaagcccug

SEQ ID NO: 478237 - RNA, 64 nt, Human
ugacgggaagagguacaucuuuuuuuccuuacugaaaacaaauauggauuaauugccucaaauu

SEQ ID NO: 478238 - RNA, 64 nt, Human
uacacaauuuauaaaguaaaaagauuuuauaaggaaaacaaauauaauaaccagugcugugaaa

SEQ ID NO: 478239 - RNA, 64 nt, Human
cucaacaacuaaaauauaauacugaagaugaacaaaaacaaaaccaaauaggaguguuuguauu

SEQ ID NO: 478240 - RNA, 64 nt, Human
acaugaauauaaugcuuacuucaaauuguuuaguaaaacaaaauaacuaaagaaaugugagcuu

SEQ ID NO: 478241 - RNA, 64 nt, Human
guaacaaagugaaaacaggugagacaaugugcccaaaacaaagggaagaagagaaccuucugug

SEQ ID NO: 478242 - RNA, 64 nt, Human
aaauggugccugaauauuaacaguguucugauuaaaaacaaaaaaaagauacauaugccuugua

SEQ ID NO: 478243 - RNA, 64 nt, Human
caucccuggauguggauuucacaccccauucucaaaaacaaagaguaucaucaacgggaaguga

SEQ ID NO: 478244 - RNA, 64 nt, Human
cauaugcucuugggccucaggaagagguugaacaaaaacaaauucuuuuaauucaacgggugcu

SEQ ID NO: 478245 - RNA, 64 nt, Human
uaauaaagaugcaaaaaaacuuuauagagauguaaaaacaaaacuauaauggaucuccuauuuu

SEQ ID NO: 478246 - RNA, 64 nt, Human
cuguugugucccuuucucuucaaagauccugagcaaaacaaagauacgcuuuccauuugaugau

SEQ ID NO: 478247 - RNA, 64 nt, Human
gcuaugaugaccuucauauaaucagcauaaacauaaaacaaauuuuuuacuuaacaugagugca

SEQ ID NO: 478248 - RNA, 64 nt, Human
uuuaaaaaucuuguuaaacauucuauaaagaaguaaaacaaaauccuuuuaucucaguuauuug

SEQ ID NO: 478249 - RNA, 64 nt, Human
ucuuucauauguaaaaauauaaaaguauuaguagaaaacaaauaugaaugcuuugaugaucuug

SEQ ID NO: 478250 - RNA, 64 nt, Human
agacugacaugaaaccugggugcuacaguaaaagaaaacaaaaguccaguuugugucucuuaau

SEQ ID NO: 478251 - RNA, 64 nt, Human
augucauuugcuaaugaauuuuaaaagcauauauaaaacaaaacaaacaaccugccacaaugug

SEQ ID NO: 478252 - RNA, 64 nt, Human
auuugcuaaugaauuuuaaaagcauauauaaaacaaaacaaacaaccugccacaaugugauaug

SEQ ID NO: 478253 - RNA, 64 nt, Human
gagaaauccaucuuuucccaggucuccuucacugaaaacaaaaaucuacuuacauacacuguca

SEQ ID NO: 478254 - RNA, 64 nt, Human
augugcaaagcaagcaaggaacauuugggguaagaaaacaaacaugaggcaaaagaaaaaauac

SEQ ID NO: 478255 - RNA, 64 nt, Human
cagcagacauucacucuggcugcugggacaucagaaaacaaagucuucaucucucucuccaguu

SEQ ID NO: 478256 - RNA, 64 nt, Human
aaucacuuuguaugcuaugcuccuacugugauggaaaacaaaaugaguauaacuuauuuuauau

SEQ ID NO: 478257 - RNA, 64 nt, Human
uuaauucaaguuuugacgguuaacauuuagcagaaaaacaaaccauugaauaagcuacuaggug

SEQ ID NO: 478258 - RNA, 64 nt, Human
auaggaguauuuauguaacuaucuuaugcuucaaaaaacaaaaguauuugugugcauguguaua

SEQ ID NO: 478259 - RNA, 64 nt, Human
uuuuucauauguggaaaucuauuacauguaauacaaaacaaacauguaguuugaaggcggucag

SEQ ID NO: 478260 - RNA, 64 nt, Human
acuggaaacaaaaacagcaguugcauugauuuugaaaacaaacccccuuguuaucugaacaugu

SEQ ID NO: 478261 - RNA, 64 nt, Human
ucauuuugaccuugcuuuguuaauaauaucuuuaaaaacaaagacaauccuuaaagcuuugcuc

SEQ ID NO: 478262 - RNA, 64 nt, Human
cucucucaaagaaaaaaaaaaugggagugcaaaaaaaacaaagccaaaaaauauaugaaggaua

SEQ ID NO: 478263 - RNA, 64 nt, Human
aacuauuuaguaagcccggauagacuuauugccaaaaacaaaaaauagcuuucaaaagaaauuu

SEQ ID NO: 478264 - RNA, 64 nt, Human
uuuauagguaaugaagcaguucaaaacuugaaagaaaacaaaaccuguccucagaauucuauaa

SEQ ID NO: 478265 - RNA, 64 nt, Human
gaaaucuauauuccagguauuguuuuuagucugaaaaacaaacucccccaugugguauuaauau

SEQ ID NO: 478266 - RNA, 64 nt, Human
auguuguaaucauuguauagagcuaaaaaaauugaaaacaaacaaaaaaauugucuuguauuuu

SEQ ID NO: 478267 - RNA, 64 nt, Human
aacuggacacucuguaaaaugcugcacugcagcaaaaacaaaaccaccaccaccccagagaaaa

SEQ ID NO: 478268 - RNA, 64 nt, Human
uuuagcacacuaggugguaugccuuuauuagcauaaaacaaaaaaaacuuuaacaggagcuuuu

SEQ ID NO: 478269 - RNA, 64 nt, Human
ucagcugaaagaaacagauauuuuaaauugccagaaaacaaaugaugaggcaacuacagucaga

SEQ ID NO: 478270 - RNA, 64 nt, Human
ugaacccuacuugcuaucucuaucuuagaaagcaaaaacaaacaggaguuuccagggagaaugg

SEQ ID NO: 478271 - RNA, 64 nt, Human
uaaaagcauuacaugcaaaaaaaagaucucagagaaaacaaaaguaaaagaaaagcagaaaauc

SEQ ID NO: 478272 - RNA, 64 nt, Human
cuggcaacagagcgagacucugucucagaaaaaaaaaacaaaaaccaguuuaggcuggguaugg

SEQ ID NO: 478273 - RNA, 64 nt, Human
gaaggagucuuuugcuuccuuucuccuuuuuacaaaaacaaacauagaagaaaauaaaugcacu

SEQ ID NO: 478274 - RNA, 64 nt, Human
aguuucuuugguguaucuuaaaaccuauuuuugaaaaacaaacuuggcuugauaaucauuuggg

SEQ ID NO: 478275 - RNA, 64 nt, Human
uuggaaucugcugcaggggccuuugugugcccuaaaaacaaauccuguucauguuuguuuaaag

SEQ ID NO: 478276 - RNA, 64 nt, Human
auguaaccaguagcugaucuuaaggcuuuuuuaaaaaacaaaacaaaacaacaaaaaaaaaucu

SEQ ID NO: 478277 - RNA, 64 nt, Human
accaguagcugaucuuaaggcuuuuuuaaaaaacaaaacaaaacaacaaaaaaaaaucuuuaua

SEQ ID NO: 478278 - RNA, 64 nt, Human
ugggaauggaaagaacuacagagggacgauguccaaaacaaaaaauggcaucaccugucaaaaa

SEQ ID NO: 478279 - RNA, 64 nt, Human
aauuuguggaaagcccuuagcaguggccuggcacaaaacaaaugcucaguggauggaagcugcc

SEQ ID NO: 478280 - RNA, 64 nt, Human
aaagcucacagauugcagaaauuagcuuuuuuaaaaaacaaaccccaguaaauauaauuucauu

SEQ ID NO: 478281 - RNA, 64 nt, Human
aacauugaacuguuagaggagugcucuuccaaacaaaacaaaaaugucucuagguuuagucaga

SEQ ID NO: 478282 - RNA, 64 nt, Human
ccccgugaacuuccuuugacuuauuguccccacuaaaacaaaacaaaaaacuuuuaaugccuuc

SEQ ID NO: 478283 - RNA, 64 nt, Human
ugaacuuccuuugacuuauuguccccacuaaaacaaaacaaaaaacuuuuaaugccuuccacau

SEQ ID NO: 478284 - RNA, 64 nt, Human
ccacaacaccuccugauaguaguaaaauuagaaaaaaacaaacucuacuaauuuuuagauauuc

SEQ ID NO: 478285 - RNA, 64 nt, Human
guauaaguccaaauauuagguuauaucuauauuaaaaacaaaauuucugucaucuguccuggcc

SEQ ID NO: 478286 - RNA, 64 nt, Human
cuccaguuuggacuacagagugagacuccaucucaaaacaaaacaaaacaacaacagcaaaaaa

SEQ ID NO: 478287 - RNA, 64 nt, Human
guuuggacuacagagugagacuccaucucaaaacaaaacaaaacaacaacagcaaaaaacaaca

SEQ ID NO: 478288 - RNA, 64 nt, Human
aaaacaaaacaaaacaacaacagcaaaaaacaacaaaacaaaacacaaauacucucacagggca

SEQ ID NO: 478289 - RNA, 64 nt, Human
uaauuuuauauuuucuuauagccacguugaaguaaaaacaaacagguacaguguuuuuuaccag

SEQ ID NO: 478290 - RNA, 64 nt, Human
caguauugcaguucuguagugucauuucuuauaaaaaacaaaacaacaacaauaauuuaucaaa

SEQ ID NO: 478291 - RNA, 64 nt, Human
uuuuuuuuucagaaauaauguuuuuuaaaagacaaaaacaaagggaagaauauuuaauuacuga

SEQ ID NO: 478292 - RNA, 64 nt, Human
guagacuuagugaaauaaaauaagaggaaagccaaaaacaaacaaacaaaaagcauauggggag

SEQ ID NO: 478293 - RNA, 64 nt, Human
uuuagagcuuucaaacuggaaaaaaaaaugaaacaaaacaaauacaccaagaccaaaauaggca

SEQ ID NO: 478294 - RNA, 64 nt, Human
ccugggcaacaaagugagacuccaucucuauauaaaaacaaaaaccacgaaagcacacacaaaa

SEQ ID NO: 478295 - RNA, 64 nt, Human
uccguguucuuaccuagccuccccccacuuccucaaaacaaacaagagauggcaaagcagcagu

SEQ ID NO: 478296 - RNA, 64 nt, Human
uuuauuuuaucuugucagaguccaucacuaaucuaaaacaaagguggcacuuuuuuauguuaac

SEQ ID NO: 478297 - RNA, 64 nt, Human
uagcaaacuacuauuaaacaacagaacaacuuguaaaacaaauuguguuugcuuuaagaaaaau

SEQ ID NO: 478298 - RNA, 64 nt, Human
cuugaaaagagauuugaagaaacugacaacuucaaaaacaaaugagaagcccaaggaacuguga

SEQ ID NO: 478299 - RNA, 64 nt, Human
uuguaaauagaacuauuucaauguaguuaaucuaaaaacaaaaaagaaaaccccagucacgauu

SEQ ID NO: 478300 - RNA, 64 nt, Human
uguucuuucaaggagaaauaagccuaaaagaagaaaaacaaaaaaaauucuguauaaaacugua

SEQ ID NO: 478301 - RNA, 64 nt, Human
auaaaacaugacaaauugcagugugauguaaucaaaaacaaagaagcccuauaagaccauuucu

SEQ ID NO: 478302 - RNA, 64 nt, Human
ucuuuauaauucaugugguaguuaccuauaaauaaaaacaaauaugcguuaacuuuucaaauuu

SEQ ID NO: 478303 - RNA, 64 nt, Human
aucugaagcccugcuggggucgcgcggcuuuggaaaaacaaauccuggcccuggacucgguuuc

SEQ ID NO: 478304 - RNA, 64 nt, Human
ccgccgaccuucagcuuugugggacuaucaggaaaaaacaaaacaaaaacaaaauguagaaaaa

SEQ ID NO: 478305 - RNA, 64 nt, Human
gaccuucagcuuugugggacuaucaggaaaaaacaaaacaaaaacaaaauguagaaaaagcaaa

SEQ ID NO: 478306 - RNA, 64 nt, Human
cagcuuugugggacuaucaggaaaaaacaaaacaaaaacaaaauguagaaaaagcaaaagcucu

SEQ ID NO: 478307 - RNA, 64 nt, Human
cuucugauuaaugcaaggggaaauuuuuauacugaaaacaaacaaacaaacuagcagcuacuaa

SEQ ID NO: 478308 - RNA, 64 nt, Human
cuagccugggcaagagaacaagauccugucucaaaaaacaaaaaaaagaaagaauugauaguac

SEQ ID NO: 478309 - RNA, 64 nt, Human
auauaaaauccaaagucugaccaguuuguaaagaaaaacaaaugguaacuggugcuuaaagcug

SEQ ID NO: 478310 - RNA, 64 nt, Human
cacuuuauagaauguuguaaaacagacaaacaagaaaacaaaccacauacuuuugaaguguauu

SEQ ID NO: 478311 - RNA, 64 nt, Human
aguuuuguuuaagguuuuggauaaggagcacuuuaaaacaaacugguguguuguuuuuaaguua

SEQ ID NO: 478312 - RNA, 64 nt, Human
aaucuacaaugaacucaaacaaauuuacaagaaaaaaacaaacaaccccaucaaaaagugggug

SEQ ID NO: 478313 - RNA, 64 nt, Human
uacccuuuaccuaacagacuaauuuguacucaguaaaacaaaaauuuauggucaaaauuucuaa

SEQ ID NO: 478314 - RNA, 64 nt, Human
uaguacucuucuuuccuccuacucuaugaacuucaaaacaaaaacaaaacuuugagagcagcac

SEQ ID NO: 478315 - RNA, 64 nt, Human
ucuucuuuccuccuacucuaugaacuucaaaacaaaaacaaaacuuugagagcagcacaugcau

SEQ ID NO: 478316 - RNA, 64 nt, Human
gaaacuucugcauuuaguuucuaucuuuccaggcaaaacaaauggguauucuuuucauacaacc

SEQ ID NO: 478317 - RNA, 64 nt, Human
aagaccccgucucaaaaaaaauuuuuuuuuuaauaaaacaaaauuuguuugaaaucuuuuaaaa

SEQ ID NO: 478318 - RNA, 64 nt, Human
acugaauaguuuacuauuucauucaagcauguuuaaaacaaauaauuuccuuucaccaguuuuu

SEQ ID NO: 478319 - RNA, 64 nt, Human
uggcccauuccuaaaggucauuguauccauuuuuaaaacaaacuaaaaugagaacauuagguuc

SEQ ID NO: 478320 - RNA, 64 nt, Human
uacacuuuuuuuuuugguuuauuccccaguauuaaaaacaaagcaagcugagucugaacaaaug

SEQ ID NO: 478321 - RNA, 64 nt, Human
uguacuuagugacuugacugagaaguuaggguagaaaacaaaaagggaguggauucugggagcc

SEQ ID NO: 478322 - RNA, 64 nt, Human
uuaacagacugccuugguacugccgaguccucucaaaacaaacacccucuugcaaccagcuuug

SEQ ID NO: 478323 - RNA, 64 nt, Human
cuccacaucugcuccuagcagugcaucagccaguaaaacaaacacauuuacaagaaaaauguuu

SEQ ID NO: 478324 - RNA, 64 nt, Human
gucagcaugaacagcucuuucuuguaugcgauuuaaaacaaacuggaaaggaaacuucacacgu

SEQ ID NO: 478325 - RNA, 64 nt, Human
uuccagccugggcaacagagcaagacugucucaaaaaacaaaacgaaacaaaaaaagaaaguua

SEQ ID NO: 478326 - RNA, 64 nt, Human
uaaugucuaaggagggcauauuagcuacacuacaaaaacaaauuuugucuguacuucugaaaag

SEQ ID NO: 478327 - RNA, 64 nt, Human
aagcacuuuaacacagugucuggcacuugggacaaaaacaaacaaacgaaaaacauuucaaaag

SEQ ID NO: 478328 - RNA, 64 nt, Human
uguaggcaucaaaaggcaaaaaucaaaaaaaaaaaaaacaaaaacaaaaaaaaagaugaaccua

SEQ ID NO: 478329 - RNA, 64 nt, Human
caucaaaaggcaaaaaucaaaaaaaaaaaaaacaaaaacaaaaaaaaagaugaaccuaggucug

SEQ ID NO: 478330 - RNA, 64 nt, Human
ugacuuaguacaaaguuucaauuuguuuccccacaaaacaaagcaauucuuucaagucaguucu

SEQ ID NO: 478331 - RNA, 64 nt, Human
agaggcuuuucucugagccucccucaucugcccaaaaacaaauccucaaaagaaauuugaucau

SEQ ID NO: 478332 - RNA, 64 nt, Human
aacuuaaaagaaagagaaguuuucuugacuuuugaaaacaaaauaugaaaagaaucggcaaugu

SEQ ID NO: 478333 - RNA, 64 nt, Human
guguguguuuucuguacccaaccagacuuuaaauaaaacaaacaugaaaccuaauguacguauu

SEQ ID NO: 478334 - RNA, 64 nt, Human
cugaguauuauuugacuccggucuccuuggugcaaaaacaaaaugggaaaaauaaauaagaaua

SEQ ID NO: 478335 - RNA, 64 nt, Human
caauauuuuugcuuuuugaaaugcucuugguugcaaaacaaaauguugguugcuguuugucagc

SEQ ID NO: 478336 - RNA, 64 nt, Human
uuuuuuuuuuuuuuuuuuuuuuugccuucaacuaaaaacaaaggagauaaaucuaguauacauu

SEQ ID NO: 478337 - RNA, 64 nt, Human
auuuuuuucaaagucucagcccugucuguauuaaaaaacaaaaaaagcguuuaccagcucuuag

SEQ ID NO: 478338 - RNA, 64 nt, Human
cugauuuuucaauguuauucuucaguccuauuuaaaaacaaaaccaagcucccuucccuuccuc

SEQ ID NO: 478339 - RNA, 64 nt, Human
gaaguaucagcacccagaagagaaaaaggaauuuaaaacaaaaaccacagaggcggaaauaccg

SEQ ID NO: 478340 - RNA, 64 nt, Human
aaacuaguggcaauauccaaauaaugaguaguguaaaacaaagagaauuaaugaugagguuaca

SEQ ID NO: 478341 - RNA, 64 nt, Human
gcuaagugcaggaggcccuuuauuauugcugcagaaaacaaaagccuggcugaguugauguuuu

SEQ ID NO: 478342 - RNA, 64 nt, Human
aaguauagcaauucaaacugaccugcauccauccaaaacaaauuccuccuucaaccuuauuuuu

SEQ ID NO: 478343 - RNA, 64 nt, Human
acuucacgcagcugcuuuugcagaagcacuaauaaaaacaaauauuuuguacccuagaaguccu

SEQ ID NO: 478344 - RNA, 64 nt, Human
augccaacuuuuuuccuuugggguaaaagguacaaaaacaaacuaaccacaguugaagagaagg

SEQ ID NO: 478345 - RNA, 64 nt, Human
aagcuuugacucuauaagcaaauugcuuuuuuccaaaacaaaaagaugucucagguuuguuuug

SEQ ID NO: 478346 - RNA, 64 nt, Human
aauaugcuuauaaccuaguuaaagaaaggaaaagaaaacaaaaaacgaaugaaaauaacugaau

SEQ ID NO: 478347 - RNA, 64 nt, Human
acuauguuuuaaguacacuuuagaaagucucuucaaaacaaacaguccuguauuugaacucugu

SEQ ID NO: 478348 - RNA, 64 nt, Human
uuuuaaugagacuuccuaggaagggaugcacuguaaaacaaaaguauucuuguaacucaguuuu

SEQ ID NO: 478349 - RNA, 64 nt, Human
gugaaauauaaggcacguuuucacacaaaauuucaaaacaaaaacaagagggcauagaugcaau

SEQ ID NO: 478350 - RNA, 64 nt, Human
ucucaugcucuuguuucucaaaaaagaaaaacaaaaaacaaaaaacaggggccaauaaauuccc

SEQ ID NO: 478351 - RNA, 64 nt, Human
acaaguaucucaugcucuuguuucucaaaaaagaaaaacaaaaaacaaaaaacaggggccaaua

SEQ ID NO: 478352 - RNA, 64 nt, Human
aucucucauaaaucucuucugucuuccuuuaaaaaaaacaaaaguaguaguucagaaacauccg

SEQ ID NO: 478353 - RNA, 64 nt, Human
uagaauaggcugcaucuuuuuaacaacucauuaaaaaacaaaacaacucuggcuuuugagauga

SEQ ID NO: 478354 - RNA, 64 nt, Human
agucuauuucagccuagaagaaaagauaaugaguaaaacaaauugcguuguuuaaaggauuaua

SEQ ID NO: 478355 - RNA, 64 nt, Human
cugaaccuacuuuggcuugggaggcugcccaguuaaaacaaaaauaaguuaaugguacagaaag

SEQ ID NO: 478356 - RNA, 64 nt, Human
acaaaacuguucugaauuuucuuuugguuuuuaaaaaacaaaacuuguugcuuagaagccauga

SEQ ID NO: 478357 - RNA, 64 nt, Human
cucuuauguauuuguaaggcugggcuucaaaaucaaaacaaaaaccccaaaaacagcaggcaaa

SEQ ID NO: 478358 - RNA, 64 nt, Human
uacagauucugcaguuuaugauauuguuuuucuaaaaacaaaugcuguuuauacauaugagaua

SEQ ID NO: 478359 - RNA, 64 nt, Human
acagcaaugaauuugcaaucugaacccaagugaaaaaacaaaauugccugaauuguacuguaug

SEQ ID NO: 478360 - RNA, 64 nt, Human
ucgugauaaacuuugcuguguaccaggaacuauaaaaacaaaaacuuguuacuaaagaaaauau

SEQ ID NO: 478361 - RNA, 64 nt, Human
ucaccugucucagucucuagagcccugaaaaauaaaaacaaacuuauuuuuauccaguguucug

SEQ ID NO: 478362 - RNA, 64 nt, Human
cagagacuugacauuuuagcuuuauugugucuuaaaaacaaaagcgaauuaaaacacaacaaaa

SEQ ID NO: 478363 - RNA, 64 nt, Human
ugagagaaaaggguguuuuaaauuuaaaaaaauaaaaacaaaaaaguuugauugagacaaugaa

SEQ ID NO: 478364 - RNA, 64 nt, Human
uagcgaacucuagcaaaacuuguuuagcuuagcaaaaacaaacacacaaaaaacugagaacucu

SEQ ID NO: 478365 - RNA, 64 nt, Human
gcugccagagguucugauauguaagaaaacugcaaaaacaaauauagacaaauauuuugauucu

SEQ ID NO: 478366 - RNA, 64 nt, Human
ugugccauguugcagugaucugagaugacuuauaaaaacaaaaauguauauggcucuuucuauc

SEQ ID NO: 478367 - RNA, 64 nt, Human
ucccugauggcaggucuguguuuauuacuacauuaaaacaaagucucugacuuauaaagcgagg

SEQ ID NO: 478368 - RNA, 64 nt, Human
aaaggaagcaaggccuguauugcagucuucauacaaaacaaaaggaauaagaacagaaaagagc

SEQ ID NO: 478369 - RNA, 64 nt, Human
ucugugugcuguuugaaaauaaaucuuaguguucaaaacaaaaugaaacaaaaaaaaaaugaua

SEQ ID NO: 478370 - RNA, 64 nt, Human
cuacagacaucauguucucaagauaaaagccuuuaaaacaaaaagccaucguagguaucaaguc

SEQ ID NO: 478371 - RNA, 64 nt, Human
caauuacgugaacgcauccucuuugcuaggucaaaaaacaaagggcaaagcagacauuuuagua

SEQ ID NO: 478372 - RNA, 64 nt, Human
uucuauaagaagaaaaauuaagaccacuuauuugaaaacaaagaugaagucucaccuuccaguu

SEQ ID NO: 478373 - RNA, 64 nt, Human
uuggucaguacuguuagcucauuugaaguuggcaaaaacaaauacaaacaagcaaaaaaccuca

SEQ ID NO: 478374 - RNA, 64 nt, Human
ucuguaacccuccuagcccccuugaucccuaaagaaaacaaacaaacaaacaaaaacuguugcu

SEQ ID NO: 478375 - RNA, 64 nt, Human
ggucugucuuuggauaauaggaauucaauuuggcaaaacaaaauguaaugucagacuuugcugc

SEQ ID NO: 478376 - RNA, 64 nt, Human
aaaucuugaaaauacaaggaauguuuuaaaauauaaaacaaagccaaguuaaacuguuuacacu

SEQ ID NO: 478377 - RNA, 64 nt, Human
ugucuuuuaaaauaaucccagaacaccaaaaauaaaaacaaacaauaacauguuuaucuuuacc

SEQ ID NO: 478378 - RNA, 64 nt, Human
guuuauuuuaguaaaaaaaaaaaaacaaaaaacaaaaacaaaagauuuuuaucaaauguuauga

SEQ ID NO: 478379 - RNA, 64 nt, Human
gaacagguuuauuuuaguaaaaaaaaaaaaacaaaaaacaaaaacaaaagauuuuuaucaaaug

SEQ ID NO: 478380 - RNA, 64 nt, Human
uucccccgaacagguuuauuuuaguaaaaaaaaaaaaacaaaaaacaaaaacaaaagauuuuua

SEQ ID NO: 478381 - RNA, 64 nt, Human
aaaacuaaugaaggguuuuuuaaaagaacuaaauaaaacaaauaaaacuaggcuacagguauag

SEQ ID NO: 478382 - RNA, 64 nt, Human
aagauggaagcuagugcagaaaccucuuguuuaaaaaacaaaaaaggcaagaugggcuugagcg

SEQ ID NO: 478383 - RNA, 64 nt, Human
uuuuuuuuuuagcuauuuacuguacuuuauguauaaaacaaagucacuuuucuccaaguuguau

SEQ ID NO: 478384 - RNA, 64 nt, Human
auaaauuuuucaaggucuuaaauaaaaggaagcaaaaacaaaauuauugaaaaauuuuuuuugu

SEQ ID NO: 478385 - RNA, 64 nt, Human
ccuauugaucuuaagguauuuacauguauguggaaaaacaaaacacuuaacuagaauucucuaa

SEQ ID NO: 478386 - RNA, 64 nt, Human
gcuaauuuauuuuuuugcaucuuaguuauuuuuaaaaacaaauucuucaaguaugaagacuaaa

SEQ ID NO: 478387 - RNA, 64 nt, Human
cuauauacuacuuugagaaguaaacaugucaaaaaaaacaaaguucagauaugggacaaaauuu

SEQ ID NO: 478388 - RNA, 64 nt, Human
aaguuucaguugauuuuacaauugaaaugacuaaaaaacaaagaagacaacauuaaaacaauau

SEQ ID NO: 478389 - RNA, 64 nt, Human
auuucccgccuuuuuuuuuuuuugugaaaugaaaaaaacaaauuguguuuuauugcgguaucaa

SEQ ID NO: 478390 - RNA, 64 nt, Human
ucucucaauaaaauuuuucuaaauaaauuccacaaaaacaaagggugaagauggucucucccuu

SEQ ID NO: 478391 - RNA, 64 nt, Human
ggguccccuuuccauguauguuuucuugucacugaaaacaaacaacgcugaguuuaucaagaaa

SEQ ID NO: 478392 - RNA, 64 nt, Human
uacacauccugugccccaauauggugcauuaugaaaaacaaaaucauuuucuaaaaugcauuuu

SEQ ID NO: 478393 - RNA, 64 nt, Human
guauucauggcacaaagcuuucccaagcugaauaaaaacaaacauuaacaaauuuuuaccuugu

SEQ ID NO: 478394 - RNA, 64 nt, Human
uaguuuuacuguacauuuauuuuuaaagaaaaagaaaacaaaagccagacaaacccaaguuguc

SEQ ID NO: 478395 - RNA, 64 nt, Human
acaaacucuccagaucuguuuaccaucauucaggaaaacaaagcaaucuggacgguucaagacu

SEQ ID NO: 478396 - RNA, 64 nt, Human
gugagacugcaucucaaaaaaaacccaaaaaacaaaaacaaacaacaacaacaaaauuauaaag

SEQ ID NO: 478397 - RNA, 64 nt, Human
uacagagugagacugcaucucaaaaaaaacccaaaaaacaaaaacaaacaacaacaacaaaauu

SEQ ID NO: 478398 - RNA, 64 nt, Human
caugguaaaacccugucucuacugaaaaacaacaaaaacaaaaacacaaauuagucgggugugg

SEQ ID NO: 478399 - RNA, 64 nt, Human
uaaaaacuaaaaugcauuccauuccucugaaagcaaaacaaauucauaauugagugauauuaaa

SEQ ID NO: 478400 - RNA, 64 nt, Human
gugagacuccaucucauuaaaaaaaacgaaaacaaaaacaaaaaaaacacaaaccaucaucaca

SEQ ID NO: 478401 - RNA, 64 nt, Human
gacagagugagacuccaucucauuaaaaaaaacgaaaacaaaaacaaaaaaaacacaaaccauc

SEQ ID NO: 478402 - RNA, 64 nt, Human
auauggaccccugagaaugagcaauugagaaaacaaaacaaaaggaacaauccaugaacuuaga

SEQ ID NO: 478403 - RNA, 64 nt, Human
cuuguauauggaccccugagaaugagcaauugagaaaacaaaacaaaaggaacaauccaugaac

SEQ ID NO: 478404 - RNA, 64 nt, Human
cuuacuauggacaccaggucaggugcaaccacacaaaacaaagccaguuccaugagcugccuau

SEQ ID NO: 478405 - RNA, 64 nt, Human
gucuucgcagccuagauaugaagaaucugcucugaaaacaaaaaaaaauuacccuuuuguuggg

SEQ ID NO: 478406 - RNA, 64 nt, Human
accaucuuggccaauauagcaagacccugugucuaaaacaaacaaaaaaauuuuuaauuggauu

SEQ ID NO: 478407 - RNA, 64 nt, Human
uuucugcagcuuuuaguuuggaaaaaauauuuuaaaaacaaaauuugugaaaccuauagacgau

SEQ ID NO: 478408 - RNA, 64 nt, Human
ucuacugggacuaggguuuuaaauacagcuuuuaaaaacaaaaacagggaauaaaagcuuuuca

SEQ ID NO: 478409 - RNA, 64 nt, Human
uuucaauaaaaaaaagagaaacuguccuuaaaacaaaacaaaaaccaaaaaagucacccuauca

SEQ ID NO: 478410 - RNA, 64 nt, Human
uuucauuucaauaaaaaaaagagaaacuguccuuaaaacaaaacaaaaaccaaaaaagucaccc

SEQ ID NO: 478411 - RNA, 64 nt, Human
cauuugcagauacaaaagauggaaauuuuucuguaaaacaaaaccuugaaggagaggagggcgg

SEQ ID NO: 478412 - RNA, 64 nt, Human
guuuucugaagucugaggaacaaugccuuaagaaaaaacaaacagcaggaaucggugggacagu

SEQ ID NO: 478413 - RNA, 64 nt, Human
ugcacccgggugggggacagagggaccuuuaaagaaaacaaaacuggacagaaacaggaaugug

SEQ ID NO: 478414 - RNA, 64 nt, Human
gcacagaaaacaaauaucaaagaucuaauaauacaaaacaaacuugauuaaaacuggugcuuaa

SEQ ID NO: 478415 - RNA, 64 nt, Human
ccgagcugccgaauucaguugacacgaggcacagaaaacaaauaucaaagaucuaauaauacaa

SEQ ID NO: 478416 - RNA, 64 nt, Human
uauauuguuuucaggugcucaaaaugcaaaacacaaaacaaauccugcauuuagauacaccuca

SEQ ID NO: 478417 - RNA, 64 nt, Human
auuuaggaauuuaauaaccuuuaagucagaaacuaaaacaaauacugaaauauuagcucuuccu

SEQ ID NO: 478418 - RNA, 64 nt, Human
uuuuccugugaacacauaaauauauuuuuauagaaaaacaaaucuacauaaaauaaaucuacug

SEQ ID NO: 478419 - RNA, 64 nt, Human
acuauugagccuauuaauuaauuauuguuuuaauaaaacaaacauugguauuggaagauaaaua

SEQ ID NO: 478420 - RNA, 64 nt, Human
uuucucuuugauaaauuuuuuuugucuguugacaaaaacaaaaaucuuuuuucaaauguagugc

SEQ ID NO: 478421 - RNA, 64 nt, Human
uugguuuucuccuucccaaggcagcuggauugaaaaaacaaaacaaaacaaaaaaacccagggg

SEQ ID NO: 478422 - RNA, 64 nt, Human
uuucuccuucccaaggcagcuggauugaaaaaacaaaacaaaacaaaaaaacccaggggcguca

SEQ ID NO: 478423 - RNA, 64 nt, Human
ccuucccaaggcagcuggauugaaaaaacaaaacaaaacaaaaaaacccaggggcgucagucga

SEQ ID NO: 478424 - RNA, 64 nt, Human
gugguuaauuuuucaaagcagaaauuuuaagccaaaaacaaacgaaaggaaagcggggagggga

SEQ ID NO: 478425 - RNA, 64 nt, Human
caaacacccaaacuguuuggauugauugcuuuaaaaaacaaaccuggcucuuaccuuugaucuu

SEQ ID NO: 478426 - RNA, 64 nt, Human
accaucagauaacuguauuuugucaggugcaauaaaaacaaaauuaaaacccaaaucaucaaga

SEQ ID NO: 478427 - RNA, 64 nt, Human
uaccccaagaggaaguuuucugaaauaagauuuaaaaacaaaacaaaaaaaacacuuaauauuu

SEQ ID NO: 478428 - RNA, 64 nt, Human
caagaggaaguuuucugaaauaagauuuaaaaacaaaacaaaaaaaacacuuaauauuucagac

SEQ ID NO: 478429 - RNA, 64 nt, Human
acucaauuuguauuuagaaauucucaaagggcaaaaaacaaaaaaaaagguuuuauaaugucag

SEQ ID NO: 478430 - RNA, 64 nt, Human
aacaaaucucucaguaugcgauuggucucaagcuaaaacaaaaauaaaugucaguuuauauuuu

SEQ ID NO: 478431 - RNA, 64 nt, Human
gagacuuguaaauguaauaauuagcacuuuugaaaaaacaaaaaaccuccuuuuagcuuuucag

SEQ ID NO: 478432 - RNA, 64 nt, Human
guaaagucccucuaagacuacauacuuuuuguuuaaaacaaaauuggaauuuguuuucccuucu

SEQ ID NO: 478433 - RNA, 64 nt, Human
aaaaaauuuccagaagaggaaaaaaaaacuacaaaaaacaaaacauugaagguugauauuuuau

SEQ ID NO: 478434 - RNA, 64 nt, Human
aaggcucucgaggcaagcugucaacgucuuguugaaaacaaaaaucaagaaagaauugaaauac

SEQ ID NO: 478435 - RNA, 64 nt, Human
agauaggagcuuauggucaaaaagugcaaaaaaaaaaacaaaaaaaaagcaauagauagagaaa

SEQ ID NO: 478436 - RNA, 64 nt, Human
uucuauuucaaaggaaaccaaaccuuaaaaaaaaaaaacaaaaacugggcugggucuuccaaac

SEQ ID NO: 478437 - RNA, 64 nt, Human
auugguucagccucaagucuggcccgucuucgaaaaaacaaacacauuuguaagcuuuguggga

SEQ ID NO: 478438 - RNA, 64 nt, Human
ucugucaacuugucauauacaccuccagggaccaaaaacaaaagcagcucggagucuguguugc

SEQ ID NO: 478439 - RNA, 64 nt, Human
guagaagguaggaguaagaaaagcuaagagaagcaaaacaaacaaagcaauauuaaaggaagag

SEQ ID NO: 478440 - RNA, 64 nt, Human
guauauuuauaaauaaaaauauuaaauagaagguaaaacaaaucagacauacacacauuagaua

SEQ ID NO: 478441 - RNA, 64 nt, Human
agccuggggguauauucaagguuauaugucuuagaaaacaaaaauacuuguuuggguucaguuu

SEQ ID NO: 478442 - RNA, 64 nt, Human
uuuggcuuuuuguucuguuggugugauucaaagcaaaacaaacaaacaaaaacaaauuuuaaga

SEQ ID NO: 478443 - RNA, 64 nt, Human
cuguuggugugauucaaagcaaaacaaacaaacaaaaacaaauuuuaagaacacaacaaaaaag

SEQ ID NO: 478444 - RNA, 64 nt, Human
aacaugaagucucuuuaugguuagagaagaccaaaaaacaaacaaacaaacuuagaaacauaaa

SEQ ID NO: 478445 - RNA, 64 nt, Human
aaaaaaugagacccuaaaaaguuucuagagagagaaaacaaaagaucagaaaugaaagcggggc

SEQ ID NO: 478446 - RNA, 64 nt, Human
auauacaaugaucaucaaacacagaacaaagcaaaaaacaaacuccccaaacccaaguugaaac

SEQ ID NO: 478447 - RNA, 64 nt, Human
uuccuguuuuacuagcuuuuacaucuuuuuauuuaaaacaaaacaacacaaaaaaacaaugugc

SEQ ID NO: 478448 - RNA, 64 nt, Human
cagaaaugcccucccuagguccaggaccaaagauaaaacaaacacgaggaacauguagcgucua

SEQ ID NO: 478449 - RNA, 64 nt, Human
auacccacaccuguuugucuuaagcuauaguguaaaaacaaaguuugggcucugaaaauuuaac

SEQ ID NO: 478450 - RNA, 64 nt, Human
gaagacacaagaaaagcauuucagaggcuaauuuaaaacaaaaaguaagcaccuaaaggcaagg

SEQ ID NO: 478451 - RNA, 64 nt, Human
uuccauuuccuagguaauuuuuuaaaagccagucaaaacaaaaacuuuacugaaaauggacaga

SEQ ID NO: 478452 - RNA, 64 nt, Human
aucaaggaccaacuuaaacguuaauuuuugugcaaaaacaaaccugaaaaauaugcuucggaaa

SEQ ID NO: 478453 - RNA, 64 nt, Human
aggaaagaggaagcaaauagaagagagagguugaaaaacaaaauggguuacuugauuggugauu

SEQ ID NO: 478454 - RNA, 64 nt, Human
cagaccaggaacacaaugagacugacauuucaaaaaaacaaaacuggcuagccugagcugcugg

SEQ ID NO: 478455 - RNA, 64 nt, Human
uauaauucccaaguguacugucuaccagaaaaaaaaaacaaaacuaauaaaaaaugaaauauga

SEQ ID NO: 478456 - RNA, 64 nt, Human
ccuugacuaacaagcuccagguguagaaaaauucaaaacaaaaugucaggaaucuagcaguguu

SEQ ID NO: 478457 - RNA, 64 nt, Human
gacggacuuauuaaaauacaaacagacaaaaaauaaaacaaaacuugaguucuauuuaccuugc

SEQ ID NO: 478458 - RNA, 64 nt, Human
acucuuucuugucaggaguauauaaaaaagaaagaaaacaaaacucgcccuacaggaagaaaag

SEQ ID NO: 478459 - RNA, 64 nt, Human
aaaucccauuuacaagcauugcaccuuuaagaagaaaacaaauaugacaguaugguagcuauac

SEQ ID NO: 478460 - RNA, 64 nt, Human
uuuaauaauagauucauaauguuacauuuaauugaaaacaaaccuuuauauccaaugaaaauag

SEQ ID NO: 478461 - RNA, 57 nt, Human
auuuauuguaucccauguaaaaacaaaaaaacaaaaaacaaagaaaagaaagagauu

SEQ ID NO: 478462 - RNA, 64 nt, Human
auuuauuguaucccauguaaaaacaaaaaaacaaaaaacaaagaaaagaaagagauuuuauaga

SEQ ID NO: 478463 - RNA, 64 nt, Human
agcugucacagguuuucagagaauuaucucaaguaaaacaaaugaaauuuaauuacaaacaaua

SEQ ID NO: 478464 - RNA, 64 nt, Human
aaacuaguuucauauauuaccuaguuauucuuucaaaacaaaacaaaaaaaaaacaaaaacuga

SEQ ID NO: 478465 - RNA, 64 nt, Human
aguuucauauauuaccuaguuauucuuucaaaacaaaacaaaaaaaaaacaaaaacugacgcac

SEQ ID NO: 478466 - RNA, 64 nt, Human
cagaaucaauaauccguggcaacauaucucuguaaaaacaaacacuguaacuucuaaauaaaug

SEQ ID NO: 478467 - RNA, 64 nt, Human
auuuguuucccuguuuuuuugguaggucuuauauaaaacaaacauuccuuuguucuaguguugu

SEQ ID NO: 478468 - RNA, 64 nt, Human
cuccauccuggaugaaagagccagacucugucucaaaacaaacaaaaaagcguggggacuucug

SEQ ID NO: 478469 - RNA, 64 nt, Human
aaugaauuuauagaggaaaauguaugcuacucugaaaacaaagcuuauguuagagaauaucuua

SEQ ID NO: 478470 - RNA, 64 nt, Human
uauagauccugagcucacagaguuuauaguuaaaaaaacaaacagaaacacaaacgauuuggau

SEQ ID NO: 478471 - RNA, 64 nt, Human
caugaguaaaauuggaaaacacuuuuaacugaaaaaaacaaaagcacaacaaaccaaaacaugg

SEQ ID NO: 478472 - RNA, 64 nt, Human
cguguuuaggaaacaaaguaugcgcuacugucugaaaacaaauaaagcagaugccuuuguuuuc

SEQ ID NO: 478473 - RNA, 64 nt, Human
uaaauaaauaaauaaauaaauaaauaaauaaauaaaaacaaaguugauuaagaaaggaaguaua

SEQ ID NO: 478474 - RNA, 64 nt, Human
uaaaauccaccuccuccaaaaaagcaauaaaaaaaaaacaaacuauaauaagcuuuucugauuc

SEQ ID NO: 478475 - RNA, 64 nt, Human
uuacuuuuagaugccugucuuagaugucaagcugaaaacaaacaagaggacuguguugguaugu

SEQ ID NO: 478476 - RNA, 64 nt, Human
auuauuuugaaaggugauauacaguggggcacagaaaacaaaugaaaaccuucaguuucucaca

SEQ ID NO: 478477 - RNA, 64 nt, Human
uuuuaucaguuuccagucucaaaaauacaaaauaaaaacaaacguuuuuaauacuauugcuuuu

SEQ ID NO: 478478 - RNA, 64 nt, Human
auacuaacaaguuuuguuccauuuguuauucaauaaaacaaaaauuucuagguauuugcuuuau

SEQ ID NO: 478479 - RNA, 64 nt, Human
uaugauaccaguuauuaaauaguguuuuauuuuaaaaacaaaauaauuccaagaaguuuuuaua

SEQ ID NO: 478480 - RNA, 64 nt, Human
uaauauguuucucuuaacaccugaaacuuguuuuaaaacaaaaagcaguauucacuucaaauca

SEQ ID NO: 478481 - RNA, 64 nt, Human
aaaaaaugaauuguauauauacaaaucaacuuuaaaaacaaauuucaauugcuugaagcaauug

SEQ ID NO: 478482 - RNA, 64 nt, Human
gccuuagcaaaggcucaugcugaaauuugccaguaaaacaaagaaguuuaaagacuggcaggua

SEQ ID NO: 478483 - RNA, 64 nt, Human
uuuguauauguaaucagauguacauuuauauugaaaaacaaaugagauggacuuaaagagcaca

SEQ ID NO: 478484 - RNA, 64 nt, Human
uguucauuccaguuauucacuuacagaugaaacuaaaacaaauaaaggcaagcuauuaucaguu

SEQ ID NO: 478485 - RNA, 64 nt, Human
guaaacuuugaagauuguuuguaucuuuuuuuaaaaaacaaaacaaaacaaaaauccccaaaau

SEQ ID NO: 478486 - RNA, 64 nt, Human
cuuugaagauuguuuguaucuuuuuuuaaaaaacaaaacaaaacaaaaauccccaaaauauaua

SEQ ID NO: 478487 - RNA, 64 nt, Human
aagauuguuuguaucuuuuuuuaaaaaacaaaacaaaacaaaaauccccaaaauauauagaaau

SEQ ID NO: 478488 - RNA, 64 nt, Human
uaauaaauauauucuguauuuuugcucuccgugaaaaacaaaagagccucugacauuacugucu

SEQ ID NO: 478489 - RNA, 64 nt, Human
aauuuguauuuagaaaagguuuauauuauuagugaaaacaaaacuaaagggaaguucaaguucu

SEQ ID NO: 478490 - RNA, 64 nt, Human
ugucucauauaauaaggugaugucggaaacacgcaaaacaaaacgaaaaaagauuucucaguau

SEQ ID NO: 478491 - RNA, 64 nt, Human
auuagccagacaugguggcaugcgcuuguuuaaaaaaacaaauaaauaaauaaucgacucaaaa

SEQ ID NO: 478492 - RNA, 64 nt, Human
cugggcgacagaacgagacccugucuccaaaggaaaaacaaaaaagaagaauaaaauaauuugg

SEQ ID NO: 478493 - RNA, 64 nt, Human
uuagaucugaucagguaguagcuaaaauuagaaaaaaacaaaauagaugcuuaaagaauuugca

SEQ ID NO: 478494 - RNA, 64 nt, Human
ugaagauugcuaaauuaaauaauuuauagcuccaaaaacaaaaauauacuuguauaugucacag

SEQ ID NO: 478495 - RNA, 64 nt, Human
ccaaaucuuugcaccuaguagauagaucaauguaaaaacaaauaccuaacuguacagugagugu

SEQ ID NO: 478496 - RNA, 64 nt, Human
guguuaugccagaacucugagggcaaacugcugaaaaacaaaggguuuaaggaugacauuucug

SEQ ID NO: 478497 - RNA, 64 nt, Human
cuuuucuauuuauaaauguauuuugaugggcaguaaaacaaagugucuuaaaaguuuuaaauag

SEQ ID NO: 478498 - RNA, 64 nt, Human
aguaauuguacugcaauaauuuuucaaaaaacaaaaaacaaaacaaacaaaagagaacuaugca

SEQ ID NO: 478499 - RNA, 64 nt, Human
aaauaggaguaauuguacugcaauaauuuuucaaaaaacaaaaaacaaaacaaacaaaagagaa

SEQ ID NO: 478500 - RNA, 64 nt, Human
ccaaacuucauguauaaauaaaauacauauuuuuaaaacaaaccaauaaauggcuuacaugacc

SEQ ID NO: 478501 - RNA, 64 nt, Human
gaaguuggauggguggguacuauucugauuacacaaaacaaaugccacacaucacccuuaccau

SEQ ID NO: 478502 - RNA, 64 nt, Human
cuguuuuaaaugaaaguuuuaguaaaaaaaauacaaaacaaaaagauuaaauugcuauugcugu

SEQ ID NO: 478503 - RNA, 64 nt, Human
ugauauauaauuauuucauguuacauaauaacccaaaacaaauaauuacuugaauauguuugua

SEQ ID NO: 478504 - RNA, 64 nt, Human
uaacaauauuauuauuguuauaacuaaaaaaaaaaaaacaaaaacaagcagcuuuugugacuaa

SEQ ID NO: 478505 - RNA, 64 nt, Human
ccugggugacagagugagacccugucucaaaagcaaaacaaacagcaauaacaauauuauuauu

SEQ ID NO: 478506 - RNA, 64 nt, Human
uacuuugacccacguuuuuuugaaauaccaguaaaaaacaaaguucuugaaauaaaacuuuuua

SEQ ID NO: 478507 - RNA, 64 nt, Human
gguaccuggcagcugugaccacagcucaaguaaaaaaacaaaaacaggcaaauaaauaaacaug

SEQ ID NO: 478508 - RNA, 64 nt, Human
auaagaagaaaagcauuuccagugguguggccugaaaacaaagaauaaccuaggcugcuggaaa

SEQ ID NO: 478509 - RNA, 64 nt, Human
cucaucuuuauauucacgaaaaagcaaucugaagaaaacaaauaaaagccuguguauuuagcac

SEQ ID NO: 478510 - RNA, 64 nt, Human
ugucuugcgugauuuguauauuucacugguuuaaaaaacaaacaucgaaaggcuuaugccaaau

SEQ ID NO: 478511 - RNA, 64 nt, Human
caagauaaaaggucuugggaaaacaaaacaaaacaaaacaaaccucccuuccccagcagggcug

SEQ ID NO: 478512 - RNA, 64 nt, Human
uggugcaagauaaaaggucuugggaaaacaaaacaaaacaaaacaaaccucccuuccccagcag

SEQ ID NO: 478513 - RNA, 64 nt, Human
uucucuggugcaagauaaaaggucuugggaaaacaaaacaaaacaaaacaaaccucccuucccc

SEQ ID NO: 478514 - RNA, 64 nt, Human
guaaauucucuggugcaagauaaaaggucuugggaaaacaaaacaaaacaaaacaaaccucccu

SEQ ID NO: 478515 - RNA, 64 nt, Human
agaucugcuuuguguuuuuauuuuuauuuuuugaaaaacaaaaggcaagucuccaacaauuaac

SEQ ID NO: 478516 - RNA, 64 nt, Human
guuguaaaaaauauccaucagaaaaaugacacacaaaacaaaauaucuggaccuuuacagaaga

SEQ ID NO: 478517 - RNA, 64 nt, Human
gagaauuuuucccugugaaaaguaagaccaagaaaaaacaaacuaaagacaugugacuuauuca

SEQ ID NO: 478518 - RNA, 64 nt, Human
auagauagauaaguaucaggucugaccccaguggaaaacaaagccaaacaaaacugaaccacaa

SEQ ID NO: 478519 - RNA, 64 nt, Human
auguuaauggaaaacacaaaacuuaagauggcccaaaacaaaagccacaaacaguucaucauuu

SEQ ID NO: 478520 - RNA, 64 nt, Human
augggaaguuaggaaagauaugggaagaaugggaaaaacaaacugacacuccaaacccccacuu

SEQ ID NO: 478521 - RNA, 64 nt, Human
gaggagacaauuugaaugaauccucaugaucuacaaaacaaaaucauagugacuaggacuccac

SEQ ID NO: 478522 - RNA, 64 nt, Human
caccacaauguuuucaagaaacaucugaaaagauaaaacaaagaacaaauaacuuauaauacuu

SEQ ID NO: 478523 - RNA, 64 nt, Human
guuuucuagaaguuaaacaagagcuaagacaaacaaaacaaaacacagcuuaucuaaucuaaug

SEQ ID NO: 478524 - RNA, 64 nt, Human
ucucuuucuuaugaacaaaacaaaacaacaacaaaaaacaaacaaacaaaaaagcuauggcacu

SEQ ID NO: 478525 - RNA, 64 nt, Human
ggauaaguaguaucuuucucucuuucuuaugaacaaaacaaaacaacaacaaaaaacaaacaaa

SEQ ID NO: 478526 - RNA, 64 nt, Human
aaagaacagagauuacccuuucaccuaccucagcaaaacaaacuuucaagucuugauagacuua

SEQ ID NO: 478527 - RNA, 64 nt, Human
caaguccccauuacuaaaaaacccaaaaggccaaaaaacaaaaaaguuagaguucgaggaauua

SEQ ID NO: 478528 - RNA, 64 nt, Human
guaagaacuauuuuuaaaauauucaaacaaaacuaaaacaaaaauccagugucacaugggccug

SEQ ID NO: 478529 - RNA, 64 nt, Human
auuugaauaguuccugcuuucugcaccucccaccaaaacaaacuuuucaaugaucaaaaaaugc

SEQ ID NO: 478530 - RNA, 64 nt, Human
augcccucccgaagacuggcugggagaagguuuaaaaacaaaaaauccaggaguaagagccuua

SEQ ID NO: 478531 - RNA, 64 nt, Human
auuuuccacaaagaaugugcuaaaauguccacugaaaacaaagccaagccucugcccugccucu

SEQ ID NO: 478532 - RNA, 64 nt, Human
uuaaaaaaagaaaacuuuaaaaaaacucccauuaaaaacaaaacaucuuuguguuuugaacaaa

SEQ ID NO: 478533 - RNA, 64 nt, Human
gggcugggagagaagacggggaagugugugagacaaaacaaagccggcuuguuuccuccccuug

SEQ ID NO: 478534 - RNA, 64 nt, Human
aaaaaaaaauuagaaccaauucauguucaugccaaaaacaaauuguccccaagccuauauguau

SEQ ID NO: 478535 - RNA, 64 nt, Human
ccugggugaccgagugagacuguuucuaaaaauaaaaacaaaaaauaaauuucuucuugaggug

SEQ ID NO: 478536 - RNA, 64 nt, Human
guuucacccucucccuaucugaagaaaaaaaucaaaaacaaauguccccggaucuuucgaugca

SEQ ID NO: 478537 - RNA, 64 nt, Human
uauuccccuccuuugaaaccuagcauuaaauggaaaaacaaaaauuacucccauauuuugaaac

SEQ ID NO: 478538 - RNA, 64 nt, Human
ucugucucuuggcuuugucacuuuuccuuuucuuaaaacaaagccaugccaauaaagugaucug

SEQ ID NO: 478539 - RNA, 64 nt, Human
aaaaacuuuuuaaguacuugaauuuuauaucaggaaaacaaaguuguugagccuugcuucuucc

SEQ ID NO: 478540 - RNA, 64 nt, Human
uauuuuguuguguaaaauugaucggauugauuaaaaaacaaauucucuggaauuugugcguuca

SEQ ID NO: 478541 - RNA, 64 nt, Human
gacaaacuuguuucaaugauagucuucauuuuuaaaaacaaaaaggcaggcagacagaaauaau

SEQ ID NO: 478542 - RNA, 64 nt, Human
gcugcagaauuuggguugacuccugagcauauuuaaaacaaagaagcuagaaauuuagcaguca

SEQ ID NO: 478543 - RNA, 64 nt, Human
auuguuugggccuuguggauaauguacagauuuaaaaacaaaucuuguugcugauuuguccauu

SEQ ID NO: 478544 - RNA, 64 nt, Human
aagauaucaaaggcacauggaauauauuuuaauaaaaacaaauaauaucucuaauauauccaca

SEQ ID NO: 478545 - RNA, 64 nt, Human
aaguuaauuauagcuuugaaagauaaaaaaaaaaaaaacaaaaaaaaacucaguaugaaaaaau

SEQ ID NO: 478546 - RNA, 64 nt, Human
caaccccuaucccccugccccacccuccucauuaaaaacaaauacuucuacuguuugggugugu

SEQ ID NO: 478547 - RNA, 64 nt, Human
gaaaacuaaucuaaacuguagcuguauuagcagcaaaacaaacgacauccaauugucaugcugc

SEQ ID NO: 478548 - RNA, 64 nt, Human
uuggcagaagcugaaauuggagaaccaaggagcaaaaacaaauuuuaaaauuaaaguauuuuau

SEQ ID NO: 478549 - RNA, 64 nt, Human
cccaaaguuauuaccacauaaucuuuuaaacaauaaaacaaauaccccuuagaaagucuucugc

SEQ ID NO: 478550 - RNA, 64 nt, Human
augagaucauaaguguuaauguacacuggacaugaaaacaaagacugguuuagcagcagacauu

SEQ ID NO: 478551 - RNA, 64 nt, Human
ggguguuacugaguuauaagcucacuaggcuguaaaaacaaaacaauguagaguuuuauuuauu

SEQ ID NO: 478552 - RNA, 64 nt, Human
uuggcaugccaaauuaacuugcauguuuguuaaaaaaacaaacacauguuuugaagagaaacca

SEQ ID NO: 478553 - RNA, 64 nt, Human
gauuuauuaaauuuccuucaaacuguuuaucuuuaaaacaaauauaagguuuuaauuauacugc

SEQ ID NO: 478554 - RNA, 64 nt, Human
ccagauuacuuguauuuaauacacaaugcaucauaaaacaaaucccucauccugacaggaagaa

SEQ ID NO: 478555 - RNA, 64 nt, Human
agcuaauguggguuaccaaaaggccuguaccuguaaaacaaaaugcagguguaaugauuauaca

SEQ ID NO: 478556 - RNA, 64 nt, Human
aaaaaucugaccaaaacaaacaaacagaaaacagaaaacaaaaaaaccucuaugcaaucugagu

SEQ ID NO: 478557 - RNA, 64 nt, Human
gauacacuaugaagauguuucaaaaaaucugaccaaaacaaacaaacagaaaacagaaaacaaa

SEQ ID NO: 478558 - RNA, 64 nt, Human
acagauacugaaagugccuccuuuugugguguaaaaaacaaauuauggugcaaaaaguaaucac

SEQ ID NO: 478559 - RNA, 64 nt, Human
cucuuuccaccaugcugccuaucucagagcaggaaaaacaaacaaaaaacaacaacaaaaccug

SEQ ID NO: 478560 - RNA, 64 nt, Human
guauuuaaagcaaaaaaacgaaaaacaaaaaacaaaaacaaaccuuuugguaacugugcacugu

SEQ ID NO: 478561 - RNA, 64 nt, Human
guuuugguauuuaaagcaaaaaaacgaaaaacaaaaaacaaaaacaaaccuuuugguaacugug

SEQ ID NO: 478562 - RNA, 64 nt, Human
uuuuguaguuuugguauuuaaagcaaaaaaacgaaaaacaaaaaacaaaaacaaaccuuuuggu

SEQ ID NO: 478563 - RNA, 64 nt, Human
ugaagguuuacaauuuacaaaguguguauuaaaaaaaacaaaaagaacaaaaaaaucugcagaa

SEQ ID NO: 478564 - RNA, 64 nt, Human
ugcauacguuuugguguugcuuuucaaauguuugaaaacaaaaaaaauguuaagaaauggguuu

SEQ ID NO: 478565 - RNA, 64 nt, Human
auuuuggguauuguaaucugaaguaugguauuacaaaacaaacaaacaaacaaaaaacccaugu

SEQ ID NO: 478566 - RNA, 64 nt, Human
ccaaccaagugcuugugagaucacugacacugcaaaaacaaagcaaacugcuccggguaccagg

SEQ ID NO: 478567 - RNA, 64 nt, Human
uuccaucugagugauugucaguguaaggccuuuuaaaacaaaagcaaguucuuuguuaggaauu

SEQ ID NO: 478568 - RNA, 64 nt, Human
cugugaagaaguuuucacaacuauuuaugcugguaaaacaaaugcuguuaaaucaccuuaugcg

SEQ ID NO: 478569 - RNA, 64 nt, Human
aucguucaguugaaagaaguacugaugacuuuucaaaacaaaugaaccaccguagcugacagag

SEQ ID NO: 478570 - RNA, 64 nt, Human
uaacaaauauuugaggucagaacccuaccauguuaaaacaaacaaaaacuuaccauguuaauaa

SEQ ID NO: 478571 - RNA, 64 nt, Human
aguuugauuccuaacacuggaguuggccuuaaacaaaacaaacacaaaaacuuuuaaagaauua

SEQ ID NO: 478572 - RNA, 64 nt, Human
ugaauuuuuccugaaaaaucuaguggcuaaaagaaaaacaaaagaccucuaaaacuucaacaag

SEQ ID NO: 478573 - RNA, 64 nt, Human
acagauaacaaaauacacuuuacugguaaaauuuaaaacaaaaaaggcaaaacaaaacaaacuc

SEQ ID NO: 478574 - RNA, 64 nt, Human
acacuuuacugguaaaauuuaaaacaaaaaaggcaaaacaaaacaaacucauuuuccccuuagu

SEQ ID NO: 478575 - RNA, 64 nt, Human
uuacugguaaaauuuaaaacaaaaaaggcaaaacaaaacaaacucauuuuccccuuaguuccca

SEQ ID NO: 478576 - RNA, 64 nt, Human
uuuuauuacugcaccauguuuacuucaaaaagacaaaacaaaaaaaaaauuauuuuuccagucu

SEQ ID NO: 478577 - RNA, 64 nt, Human
agccuggauauuauucuuguaguuuaccucuuuaaaaacaaaacaaaacaaaacaaaaaacucc

SEQ ID NO: 478578 - RNA, 64 nt, Human
ggauauuauucuuguaguuuaccucuuuaaaaacaaaacaaaacaaaacaaaaaacuccccuuc

SEQ ID NO: 478579 - RNA, 64 nt, Human
uuauucuuguaguuuaccucuuuaaaaacaaaacaaaacaaaacaaaaaacuccccuuccucac

SEQ ID NO: 478580 - RNA, 64 nt, Human
cuuguaguuuaccucuuuaaaaacaaaacaaaacaaaacaaaaaacuccccuuccucacugccc

SEQ ID NO: 478581 - RNA, 64 nt, Human
caaccugaauucaccacagcuggaauagcuguggaaaacaaaauaaaacaacaaaauuaauaau

SEQ ID NO: 478582 - RNA, 64 nt, Human
uuucuaguaaugcaaacaaauuauuuuuuacaaaaaaacaaaauaaauaaaauuagacuuccuu

SEQ ID NO: 478583 - RNA, 64 nt, Human
uccuugaagaaucaaaauuccuguuaauaaaagaaaaacaaauguaauugaaauagcacacagc

SEQ ID NO: 478584 - RNA, 64 nt, Human
cuggggagaggacuuaacugacuuaagaaguaggaaaacaaaaaccucucuccucagccuucca

SEQ ID NO: 478585 - RNA, 64 nt, Human
uacuugaaauguauugacugcugacuauauuuuaaaaacaaaaugaaauaauuugaguuguauu

SEQ ID NO: 478586 - RNA, 64 nt, Human
uacugucuguuggauaauggcuguaaaauguuuaaaaacaaaacaaaacaaaaaagaggcacua

SEQ ID NO: 478587 - RNA, 64 nt, Human
ucuguuggauaauggcuguaaaauguuuaaaaacaaaacaaaacaaaaaagaggcacuagucua

SEQ ID NO: 478588 - RNA, 64 nt, Human
uggauaauggcuguaaaauguuuaaaaacaaaacaaaacaaaaaagaggcacuagucuaucugc

SEQ ID NO: 478589 - RNA, 64 nt, Human
aagcagcaucuuauguccugauuucauauaguagaaaacaaacauuggguccgacuucaaaaug

SEQ ID NO: 478590 - RNA, 64 nt, Human
gauugguuuucuuuuuguuuuaagcuaaacaucuaaaacaaauuucaaguuaacaguucauaca

SEQ ID NO: 478591 - RNA, 64 nt, Human
uuuucuuuugaaugcacgcauuuucacuuuccccaaaacaaagguacauuuuuuaaaaugucau

SEQ ID NO: 478592 - RNA, 64 nt, Human
cucauccagaaagcuauaugaugcacuaguaaaaaaaacaaagauauucaaacugcuuggguuc

SEQ ID NO: 478593 - RNA, 64 nt, Human
gaguucuugauccuaaagaaauuuaguggcacagaaaacaaagugaauuuguuagcauaauuau

SEQ ID NO: 478594 - RNA, 64 nt, Human
cuguguucucaacucaaggaggaauaaaacucauaaaacaaaagccuuguaagcauuuauuaaa

SEQ ID NO: 478595 - RNA, 64 nt, Human
uaguuauucucuaagaggaaacuaguguuuguuaaaaacaaaaauaaaaacaaaaccacacaag

SEQ ID NO: 478596 - RNA, 64 nt, Human
aagaggaaacuaguguuuguuaaaaacaaaaauaaaaacaaaaccacacaaggagaacccaauu

SEQ ID NO: 478597 - RNA, 64 nt, Human
cuucaaaugaaaaccgacuaaggauuuucuuucaaaaacaaaucagaagcagaugcugauuggg

SEQ ID NO: 478598 - RNA, 64 nt, Human
uagccugggugacagagucagacuccgucccaaaaaaacaaacaaacaaaacaaaacaaaaaaa

SEQ ID NO: 478599 - RNA, 64 nt, Human
agagucagacuccgucccaaaaaaacaaacaaacaaaacaaaacaaaaaaaaacagaaguuaca

SEQ ID NO: 478600 - RNA, 64 nt, Human
cagacuccgucccaaaaaaacaaacaaacaaaacaaaacaaaaaaaaacagaaguuacaaauga

SEQ ID NO: 478601 - RNA, 64 nt, Human
uuuuaguaaugcaggucugugauuugggggauagaaaacaaaguaccuaugaaacgggauaucu

SEQ ID NO: 478602 - RNA, 64 nt, Human
guugugcaaaaaugacucauugcuccgaaugucaaaaacaaaugcgacaaacaauggcacuuca

SEQ ID NO: 478603 - RNA, 64 nt, Human
guaacuggggaguacaugcuuuaggacacaaacaaaaacaaagggcaugaaaguaucugaaagc

SEQ ID NO: 478604 - RNA, 64 nt, Human
ucaguuuuaccuggaaauuuguggugugguuuaaaaaacaaauguuuagcuuuuucauuugcga

SEQ ID NO: 478605 - RNA, 64 nt, Human
cagaagcauagauuuaauugcaucuuuauuuugaaaaacaaaugaaaauugaugggguuuaaag

SEQ ID NO: 478606 - RNA, 64 nt, Human
uuucuaguuauuguauugcuacaauuuaaauauuaaaacaaauaagagcuuucucaacaaauua

SEQ ID NO: 478607 - RNA, 64 nt, Human
ugcauuugcaagaucugagcaaauaagauuaaguaaaacaaaucaauuguauauauaauugacc

SEQ ID NO: 478608 - RNA, 64 nt, Human
gcccugucucaggaacaucuuaacagauggcaaaaaaacaaaaacuuuuuuucaacuccuauga

SEQ ID NO: 478609 - RNA, 64 nt, Human
auuaagaagcaaacaaaaagagagcaacccaaccaaaacaaaucacauucuugcacaaaaguga

SEQ ID NO: 478610 - RNA, 64 nt, Human
agccuggaugacagagugagaccuugucucaaacaaaacaaaacaaaaaugaaauguucuaguu

SEQ ID NO: 478611 - RNA, 64 nt, Human
ggaugacagagugagaccuugucucaaacaaaacaaaacaaaaaugaaauguucuaguuuuggu

SEQ ID NO: 478612 - RNA, 64 nt, Human
ugaaugguagcuuuugcacagaacuuccaaaagcaaaacaaaaacaaaaucuauuguaguuaua

SEQ ID NO: 478613 - RNA, 64 nt, Human
guagcuuuugcacagaacuuccaaaagcaaaacaaaaacaaaaucuauuguaguuauauacuuc

SEQ ID NO: 478614 - RNA, 64 nt, Human
agucagaaaauggccuucugugcuuucaaaaaaaaaaacaaaaaaaaaaccacacacacacaua

SEQ ID NO: 478615 - RNA, 64 nt, Human
uaacuuuacuguaaauuuacuuuguuucauugaaaaaacaaauugauaaacauauuaaacugga

SEQ ID NO: 478616 - RNA, 64 nt, Human
ccaaaugacauuaucugcacguuuuuaaaauuuaaaaacaaaggacuauuuaaaaauacaguuu

SEQ ID NO: 478617 - RNA, 64 nt, Human
augaacaguuaaaaaugcucauugaaaauuaaauaaaacaaaaaggcaguuauuucaugcuugg

SEQ ID NO: 478618 - RNA, 64 nt, Human
agccugggcaacaaagagcgaaacucugucucaaaaaacaaaccaacaaaaaccacaauugauu

SEQ ID NO: 478619 - RNA, 64 nt, Human
uaugucaaucuguauauauuguaccuuaauaugaaaaacaaauuuuuuaauucauaaaaguauu

SEQ ID NO: 478620 - RNA, 64 nt, Human
gggaaagguuaaugggcuacuuaauauuaugaacaaaacaaaaaaacaaggcugccacagugga

SEQ ID NO: 478621 - RNA, 64 nt, Human
aaggggcuugguguuuguaagaaaaugcuagaagaaaacaaacugucacaaguuguuaugucca

SEQ ID NO: 478622 - RNA, 64 nt, Human
ugcuugucuuauuuuuagaauaauuuagaaaaacaaaacaaaggcuguuuuuccuaauuuuggc

SEQ ID NO: 478623 - RNA, 64 nt, Human
cuaccugcuugucuuauuuuuagaauaauuuagaaaaacaaaacaaaggcuguuuuuccuaauu

SEQ ID NO: 478624 - RNA, 64 nt, Human
agucaaaaguauaauaaguguuaauuugccuugaaaaacaaagaccuaaaaagccuuuuuuaag

SEQ ID NO: 478625 - RNA, 64 nt, Human
aaagauguaagacuuugguucccaacuuuguuaaaaaacaaaaaaagugauggaaagguguuug

SEQ ID NO: 478626 - RNA, 64 nt, Human
aguagaugauaagccuaaaaaaagcacaauuauuaaaacaaacagauccauguuaggacauuuc

SEQ ID NO: 478627 - RNA, 64 nt, Human
agcugaacuuacugcuuauauauauuugauuguaaaaacaaaaagacagugugugugucuguug

SEQ ID NO: 478628 - RNA, 64 nt, Human
aauuucuccuacuuuacacucucuguacaaaaacaaaacaaaacaacaacaauacaacaagaac

SEQ ID NO: 478629 - RNA, 64 nt, Human
uuaggaauuucuccuacuuuacacucucuguacaaaaacaaaacaaaacaacaacaauacaaca

SEQ ID NO: 478630 - RNA, 64 nt, Human
uucgucuugauaggcuguaguguacaugggauguaaaacaaacaaguguaucaaagguggauga

SEQ ID NO: 478631 - RNA, 64 nt, Human
caagaguguaccauuaacuugauuguugauaauaaaaacaaaaagcaagucuagcaauugaacu

SEQ ID NO: 478632 - RNA, 64 nt, Human
aaaaacaaaaaaguuggaaggcagaaaccauuaaaaaacaaaaagccaacaacccagaaagguu

SEQ ID NO: 478633 - RNA, 64 nt, Human
uuguuuagaaaaaaaagacaaaaaaguaaaaauaaaaacaaaaaaguuggaaggcagaaaccau

SEQ ID NO: 478634 - RNA, 64 nt, Human
accccacuccuacccccuuccucaacccccaaacaaaacaaacaaacuucccuggcuucgcacc

SEQ ID NO: 478635 - RNA, 64 nt, Human
caacuggauauguuugucauuuuguaacuuaccaaaaacaaaccaucauaucauaccaacuaaa

SEQ ID NO: 478636 - RNA, 64 nt, Human
auauugaauacuuugggauguuaaauucauuggaaaaacaaaccauuuguaaccucaguuaacu

SEQ ID NO: 478637 - RNA, 64 nt, Human
aauagauuucagcugaaaauaaucaguucuuaugaaaacaaauagagaaauaucaguaagucaa

SEQ ID NO: 478638 - RNA, 64 nt, Human
auauacuuauuugucuucuuuuugcauugugaaaaaaacaaaauaaauuuugugugauaauuuu

SEQ ID NO: 478639 - RNA, 64 nt, Human
uaaauccauauuucauaaauaacugagaauaauuaaaacaaaauuaagcaaaugcacaagcaaa

SEQ ID NO: 478640 - RNA, 64 nt, Human
aaauaccuucagccuaaggcacaaggaugccaaaaaaacaaaggugagaaaccacaacacaggu

SEQ ID NO: 478641 - RNA, 64 nt, Human
gaaauauuucaugucaaggaggaaaacauuagggaaaacaaaaaugauauaaagccauaugagg

SEQ ID NO: 478642 - RNA, 64 nt, Human
uuugauuacuuagagauaggaauuuuuaaaaaucaaaacaaaaaauaccacagcuuaguguaaa

SEQ ID NO: 478643 - RNA, 64 nt, Human
cagaauaggauucugugauaauauuuaaauggcaaaaacaaaacauaauuuugugcaauuaaca

SEQ ID NO: 478644 - RNA, 64 nt, Human
gaccagagagagcuuggaauguuaaaaacaaaacaaaacaaaaaaaaacaaggagaaguugucc

SEQ ID NO: 478645 - RNA, 64 nt, Human
uaggggaccagagagagcuuggaauguuaaaaacaaaacaaaacaaaaaaaaacaaggagaagu

SEQ ID NO: 478646 - RNA, 64 nt, Human
uuggauaggggaccagagagagcuuggaauguuaaaaacaaaacaaaacaaaaaaaaacaagga

SEQ ID NO: 478647 - RNA, 64 nt, Human
cugugaggauaggaguuauauauucuuauaagacaaaacaaaacaggacaauguuacaagagua

SEQ ID NO: 478648 - RNA, 64 nt, Human
ugcuuuugcauggacuauccucuuguuuuuauuaaaaacaaaugauuuuuuuaaaagucacaaa

SEQ ID NO: 478649 - RNA, 64 nt, Human
ugcuguggauuuuguggcuucaaucuacgauguuaaaacaaauuaaaaacaccuaagugacuac

SEQ ID NO: 478650 - RNA, 64 nt, Human
uuuagccauauucugauuuuuaaaaaggaaaauaaaaacaaaucuuucuucaguaucuuuuucu

SEQ ID NO: 478651 - RNA, 64 nt, Human
ugauuaagacuuacauuuucugcacaggucugcaaaaacaaaaauuauaaacuaguccauccaa

SEQ ID NO: 478652 - RNA, 64 nt, Human
auagaaacacauuuucuggcuagcagaaaaaaacaaaacaaaacuguuguuucucuuucuugcu

SEQ ID NO: 478653 - RNA, 64 nt, Human
aaugaauagaaacacauuuucuggcuagcagaaaaaaacaaaacaaaacuguuguuucucuuuc

SEQ ID NO: 478654 - RNA, 64 nt, Human
uggcacaaggaaucacacguggugcagcuaaaacaaaacaaaacaugagcaaacacaaaaccca

SEQ ID NO: 478655 - RNA, 64 nt, Human
gaaaauggcacaaggaaucacacguggugcagcuaaaacaaaacaaaacaugagcaaacacaaa

SEQ ID NO: 478656 - RNA, 64 nt, Human
cagaagccuauuuuuaaagcagaagcaaaaaagaaaaacaaaauaacaaaaacaacccuuccuc

SEQ ID NO: 478657 - RNA, 64 nt, Human
ugucuuccuccaaggaguuagaauuucccaguuuaaaacaaaaagggaaauguccuagguuuuc

SEQ ID NO: 478658 - RNA, 64 nt, Human
uauauauuuacuaaaagaauuugugacauuuuaaaaaacaaaaauaaauauugcguccauguug

SEQ ID NO: 478659 - RNA, 64 nt, Human
cauaaugcaguuuuauuuuuaucauucugguaaaaaaacaaaaaauagaagcaaaacacauugu

SEQ ID NO: 478660 - RNA, 64 nt, Human
uucccccaugcuuuucuguuuucaaaaaaauugaaaaacaaaucaacucuuauccccaacagcu

SEQ ID NO: 478661 - RNA, 64 nt, Human
acauauauauauaucauauagcuuaagcugauuuaaaacaaaggccuuagacuaauuuucgauu

SEQ ID NO: 478662 - RNA, 64 nt, Human
uuuacauuugaauacaaggauaauggguuuuaucaaaacaaaaugauguacagauuuuuuuuca

SEQ ID NO: 478663 - RNA, 64 nt, Human
uuuaccagaauacaguuuauuucgugaauucuaaaaaacaaaaagaugaaucugucagugauau

SEQ ID NO: 478664 - RNA, 64 nt, Human
gcgccacugacuccuccuucagucggcuuugcccaaaacaaauuuuaguauuacugguauuaag

SEQ ID NO: 478665 - RNA, 64 nt, Human
uuuuaaaaccagauaccacauuuucuuccuauugaaaacaaaaugccaguugcauugguuuccc

SEQ ID NO: 478666 - RNA, 64 nt, Human
cucauuuguaguaaaacuuaaaaagcaaaaacaaaaaacaaaaaagaccuuccugugauacuuu

SEQ ID NO: 478667 - RNA, 64 nt, Human
gcugucacucauuuguaguaaaacuuaaaaagcaaaaacaaaaaacaaaaaagaccuuccugug

SEQ ID NO: 478668 - RNA, 64 nt, Human
uuuauccuucccugugauuagauaaacaaaauaaaaaacaaaaugcuguauuucucuucuuacg

SEQ ID NO: 478669 - RNA, 64 nt, Human
auuuuuccugacuuuguucaaagaggaaaggagaaaaacaaacagaccaaaugcccaggagccc

SEQ ID NO: 478670 - RNA, 64 nt, Human
agucaggauaacagagagauaccacauggcaagaaaaacaaagugacaauuguagaguccucaa

SEQ ID NO: 478671 - RNA, 64 nt, Human
cggugccacgcagucauggaucuggguaguccggaaaacaaaaggagggaagacagccugguaa

SEQ ID NO: 478672 - RNA, 64 nt, Human
cuagguuguaaucuugauagucuaaaaaaugaucaaaacaaaugauuuucaaggaauauucaau

SEQ ID NO: 478673 - RNA, 64 nt, Human
guuuagaauauuaaguuuuccucugugcaaauuuaaaacaaauaacaagagaucguguuacagu

SEQ ID NO: 478674 - RNA, 64 nt, Human
uuaacuaagggccauccaaccauccaaccuuuaaaaaacaaaacgaaagugcuucucaucaaug

SEQ ID NO: 478675 - RNA, 64 nt, Human
uuagaaauaagauaaucaacguacaacucuuuguaaaacaaaagcaacuuugggugaguuuuau

SEQ ID NO: 478676 - RNA, 64 nt, Human
agaaggcaacucuucagccuuuguuaucuagcugaaaacaaaugacaacuuucaaaacauuggc

SEQ ID NO: 478677 - RNA, 64 nt, Human
gcuaauuuuuaaugaaauugguuuacagaaguaaaaaacaaaaauuggaaagcaaaguaauaaa

SEQ ID NO: 478678 - RNA, 64 nt, Human
uuuaaguguuggcuauuucuauguuuuauaaaccaaaacaaaauuuccaaaaacaaugaaggaa

SEQ ID NO: 478679 - RNA, 64 nt, Human
aacaacugcuacauacauaugcagaauguguaauaaaacaaaaagcaauugcuauaugaaaaua

SEQ ID NO: 478680 - RNA, 64 nt, Human
cagugucuaauucccuguuauaauuugcacaaacaaaacaaaauguuaugauaaucuuucucca

SEQ ID NO: 478681 - RNA, 64 nt, Human
caccaacacaccacucauuggaaaauggaaaaaaaaaacaaaaaaaaaacaaaaaaauguacaa

SEQ ID NO: 478682 - RNA, 64 nt, Human
cacucauuggaaaauggaaaaaaaaaacaaaaaaaaaacaaaaaaauguacaauggaugcauug

SEQ ID NO: 478683 - RNA, 64 nt, Human
caucauuaaaaaacaacaaugacaacgacaacaaaaaacaaaacuaaaacgacuuauuauuuau

SEQ ID NO: 478684 - RNA, 64 nt, Human
uugaugagcacuauuaacuaaaauaugaaacuuaaaaacaaaagcaaguuguccuuaaaaguuc

SEQ ID NO: 478685 - RNA, 64 nt, Human
gaaaacaauauguacuaccuuauacccuuccccaaaaacaaagggauuaaagaccuaaauauga

SEQ ID NO: 478686 - RNA, 64 nt, Human
ccaugaaaguaaaagacuacugucauuagcauguaaaacaaagaaagauauacaugacugaauu

SEQ ID NO: 478687 - RNA, 64 nt, Human
ugaccuuuuauuuauuccuuauuucucuuucaucaaaacaaaacagcagcugugggaggagaaa

SEQ ID NO: 478688 - RNA, 64 nt, Human
gcugguuuaauguuuuggccaaugcaccuaaagaaaaacaaacucguuuuuuacaaagcccuuu

SEQ ID NO: 478689 - RNA, 64 nt, Human
agaaagcauuuucauuucacugcacaucuagagaaaaacaaaaauagaaaauuuucuaguccau

SEQ ID NO: 478690 - RNA, 64 nt, Human
auauuuuaaugaauauugauguuaacaagaggggaaaacaaaacacagguuuuuucaauuuaug

SEQ ID NO: 478691 - RNA, 64 nt, Human
auuuuuuuaacuuauugcauaacagcagaugccaaaaacaaaaaaagcaucucacugcaaguca

SEQ ID NO: 478692 - RNA, 64 nt, Human
uaugcuguuuacauuuauuuucuucagccugugcaaaacaaagcaauggaaaaggaaacuaaaa

SEQ ID NO: 478693 - RNA, 64 nt, Human
uguuagguuuuuaaacauagcaaucaaggcuacaaaaacaaaccuguguuguuuuuguauagau

SEQ ID NO: 478694 - RNA, 64 nt, Human
cauagaaagugccagaaaguguuuaacuugucaaaaaacaaaaacccagcaacagaaaaaugga

SEQ ID NO: 478695 - RNA, 64 nt, Human
uauaugcacauauauauauguauuuaaaaaaaucaaaacaaaaaaaaacucauuuauaccugug

SEQ ID NO: 478696 - RNA, 64 nt, Human
augcaauauguuugaaacuaguuaaggaauuauaaaaacaaaugaguucuuccuucugcucaaa

SEQ ID NO: 478697 - RNA, 64 nt, Human
uugacauuaaccucaucaaaagugugugaauuuuaaaacaaauucuaaaaaaacuauagugcua

SEQ ID NO: 478698 - RNA, 64 nt, Human
uaauguguuaaacaugcuaaauaguucuaucaggaaaacaaaucacuguauuuaucuccgcagg

SEQ ID NO: 478699 - RNA, 64 nt, Human
aaaaaaaaaaagacacaucacuauaaauagcaaaaaaacaaaucuaacuuauuaauacuaggaa

SEQ ID NO: 478700 - RNA, 64 nt, Human
aguguaauaauuuacacuauuuugugcuccaaacaaaacaaaaaucuguguaacuguaaaacau

SEQ ID NO: 478701 - RNA, 64 nt, Human
ucauauguguuguuguaacuuuagauuacuaaacaaaacaaacuguuuuuuuguuugaagguau

SEQ ID NO: 478702 - RNA, 64 nt, Human
uuuuagaagagucaacucuuaagauuaucauuagaaaacaaauacgucaacaccuaugaaaaga

SEQ ID NO: 478703 - RNA, 64 nt, Human
auaaucccacagaauuuacuuuaaaugucacguaaaaacaaauucaccuaagauagucuugcuu

SEQ ID NO: 478704 - RNA, 64 nt, Human
uuguauaaguuaaggcagccauaaaugaaaauacaaaacaaacguuugcuuuuguauuugauuc

SEQ ID NO: 478705 - RNA, 64 nt, Human
gccacaggagauuccugggagcacuggguguagcaaaacaaagccacucucugcuucagucgca

SEQ ID NO: 478706 - RNA, 64 nt, Human
aaggaauacuuuuguuagaaugagaauuaaagagaaaacaaaagaaucuuggcaaaauuuuccc

SEQ ID NO: 478707 - RNA, 64 nt, Human
uucaacuguuuuuauuucuagucucuuccacuuuaaaacaaaaugaacacugcuugucuucuuc

SEQ ID NO: 478708 - RNA, 64 nt, Human
gcucuucuaaggaaauggagaagcucuguuuauaaaaacaaaaacaaaaccagcugcuacucau

SEQ ID NO: 478709 - RNA, 64 nt, Human
cuaaggaaauggagaagcucuguuuauaaaaacaaaaacaaaaccagcugcuacucauaaguug

SEQ ID NO: 478710 - RNA, 64 nt, Human
guuucacuuuuuagaaguauguuuuaagcaagcaaaaacaaaaugggaugugaagaauugaggc

SEQ ID NO: 478711 - RNA, 64 nt, Human
aaaaauaaauaaauaaaagcauacuauaguuguaaaaacaaauaauuuuaauaguauauucagu

SEQ ID NO: 478712 - RNA, 64 nt, Human
uuguaucuuugguuuuuguguuuugcugcacacaaaaacaaaagauauaaaaauggaucauaaa

SEQ ID NO: 478713 - RNA, 64 nt, Human
ccagccugggcgacagagcgagacucugccucaaaaaacaaaacaaaacaaaacacucacccau

SEQ ID NO: 478714 - RNA, 64 nt, Human
cugggcgacagagcgagacucugccucaaaaaacaaaacaaaacaaaacacucacccaucaacg

SEQ ID NO: 478715 - RNA, 64 nt, Human
cgacagagcgagacucugccucaaaaaacaaaacaaaacaaaacacucacccaucaacgaauau

SEQ ID NO: 478716 - RNA, 64 nt, Human
ggcugagcugagcuucgguucuccagaauguaagaaaacaaaaucuaaaacaaaaucugaacuc

SEQ ID NO: 478717 - RNA, 64 nt, Human
cuucgguucuccagaauguaagaaaacaaaaucuaaaacaaaaucugaacucucaaaagucuau

SEQ ID NO: 478718 - RNA, 64 nt, Human
uggaagaaccuguuugaugcaaaaaagaaaaugaaaaacaaaacaaaaaauccccaaaaccuua

SEQ ID NO: 478719 - RNA, 64 nt, Human
gaaccuguuugaugcaaaaaagaaaaugaaaaacaaaacaaaaaauccccaaaaccuuauuaug

SEQ ID NO: 478720 - RNA, 64 nt, Human
aaaauaacuaugaaaaugccaguaacguuuauuuaaaacaaaauauuuuaauuuuuaaauuuuc

SEQ ID NO: 478721 - RNA, 64 nt, Human
gccagcuuagacuaauugguacaaggaaggcaagaaaacaaagacaaauaaacagcggaaguua

SEQ ID NO: 478722 - RNA, 64 nt, Human
uuacuaaugcucugaucuguccaaacucaagcggaaaacaaaauugaaagggcaaccugugccu

SEQ ID NO: 478723 - RNA, 64 nt, Human
uaacccuguaaguuacuuuaaagcuaauacaagaaaaacaaagacaagugaaaguaaggaaaca

SEQ ID NO: 478724 - RNA, 64 nt, Human
uacuaaugcucugaucugcccaaaucuuaaguaaaaaacaaaauugaaagagcaaccuaugccu

SEQ ID NO: 478725 - RNA, 64 nt, Human
ugaaaaggagccugguggggagaccacugcacccaaaacaaauccuuucuucuucugagaaugu

SEQ ID NO: 478726 - RNA, 64 nt, Human
aguaguuuuuucauguuuaauuuguauuuguaaaaaaacaaaaagcaaaaaaauucccaaaacc

SEQ ID NO: 478727 - RNA, 64 nt, Human
caaacccauguugaaacuaguacuuuucccuuuaaaaacaaaccaaaaaaaaaaacaaaaaaaa

SEQ ID NO: 478728 - RNA, 64 nt, Human
uaguacuuuucccuuuaaaaacaaaccaaaaaaaaaaacaaaaaaaaacuuuuuaauuaaagaa

SEQ ID NO: 478729 - RNA, 64 nt, Human
gagaauauacuuccacugaugcccuuacugugccaaaacaaaaaucuuaagaaaagcaaguaga

SEQ ID NO: 478730 - RNA, 64 nt, Human
uuuggguccuacuguuguuauuaaaaacagaacaaaaacaaaacacacacacacacaaaaacag

SEQ ID NO: 478731 - RNA, 64 nt, Human
guguuguuuguuuucuuauuuucuuuuuaauuaaaaaacaaacaaacauguggugcagaagcgu

SEQ ID NO: 478732 - RNA, 64 nt, Human
cuuugcucuaaugaucaggaaugaugcuuauuagaaaacaaacugcuugacccaggaacaagug

SEQ ID NO: 478733 - RNA, 64 nt, Human
uggugaaacccugccucuacuaaaaauacaaaaaaaaacaaaauuagccgggcgugguugcggg

SEQ ID NO: 478734 - RNA, 64 nt, Human
cuccagucugggcgacagagugagacuccaucucaaaacaaacaaaaaaaggauggggcugggc

SEQ ID NO: 478735 - RNA, 64 nt, Human
ugauuuuuacgggauuauugacuucugcuuauggaaaacaaagaaacagacacaaugcacacag

SEQ ID NO: 478736 - RNA, 64 nt, Human
uuaauucccuucccaacacuugccugauggaaaaaaaacaaaggaauuaaaacucuccucaggc

SEQ ID NO: 478737 - RNA, 64 nt, Human
guuuucagaaggaacaacaccagggaaugccaaaaaaacaaagggcaagucaaccaaggcauuu

SEQ ID NO: 478738 - RNA, 64 nt, Human
ucagaaaagaaaaagaaugaugcuucuugcaacaaaaacaaaagugauuaugucacgagaggag

SEQ ID NO: 478739 - RNA, 64 nt, Human
uugccuuuccaggguuauuuaguaaaguuuguugaaaacaaaaacgccuuuucuugguucuuuu

SEQ ID NO: 478740 - RNA, 64 nt, Human
aauggcuuuuuaaaaucauauuuaccugugaaucaaaacaaauucaagaaugcaguauccgcga

SEQ ID NO: 478741 - RNA, 64 nt, Human
ggaccuagugaauggucuuuacuguugcuauguaaaaacaaacgaaacaacugacuucauaccc

SEQ ID NO: 478742 - RNA, 64 nt, Human
uuuggagucuuucaugucuaaaagauuuaaguuaaaaacaaaguguuacuuggaagguuagcuu

SEQ ID NO: 478743 - RNA, 64 nt, Human
ggccuaggcuggcuccagugugccaugcccagccaaaacaaacacagagcugcccaggcuuucu

SEQ ID NO: 478744 - RNA, 64 nt, Human
gugaugguauugcgggauucagagauaaagacauaaaacaaagacaccgucuuuaugucaagaa

SEQ ID NO: 478745 - RNA, 64 nt, Human
uuacaguauauccuguucuguacauuaaauuaaaaaaacaaaaauguacaugugauguuaguag

SEQ ID NO: 478746 - RNA, 64 nt, Human
aguggaacccugucaaaucgcauaaaagaggaaaaaaacaaaacucauuagaauguuuuaaauu

SEQ ID NO: 478747 - RNA, 64 nt, Human
auuucaaggcuaauaccuacuuguacguacauguaaaacaaaucccgccgcaacuguuuucugu

SEQ ID NO: 478748 - RNA, 64 nt, Human
ucuaacaguacauacucauucccaaagcaauccaaaaacaaaaugugaaccauuuggguuucaa

SEQ ID NO: 478749 - RNA, 64 nt, Human
uuaucccacggaaaaugccaaucucuucuaaaaaaaaacaaaauuaaauuaaaaacagaauguu

SEQ ID NO: 478750 - RNA, 64 nt, Human
uccagaggaauaaaaagguuggccuuaguagucaaaaacaaagcugauagccagacacguucug

SEQ ID NO: 478751 - RNA, 64 nt, Human
uugguggaaaccauuugugaauuuacagacuccaaaaacaaaaagauaauuuagagucucaaag

SEQ ID NO: 478752 - RNA, 64 nt, Human
auuucacaaguccugugaggcaaaaaaacaaaacaaaacaaaacaaccaaacaaauacaaucua

SEQ ID NO: 478753 - RNA, 64 nt, Human
agacuauuucacaaguccugugaggcaaaaaaacaaaacaaaacaaaacaaccaaacaaauaca

SEQ ID NO: 478754 - RNA, 64 nt, Human
ucuuaagacuauuucacaaguccugugaggcaaaaaaacaaaacaaaacaaaacaaccaaacaa

SEQ ID NO: 478755 - RNA, 64 nt, Human
aacuuuguccuauuugucaacuggguucuggaaaaaaacaaacaugaugaagcuuuugaauaau

SEQ ID NO: 478756 - RNA, 64 nt, Human
aaaaugugauacgcacaaacccuuugaaaauagcaaaacaaacaugcccuuuuucuaaaauuga

SEQ ID NO: 478757 - RNA, 64 nt, Human
uuugaagaccaaaugugaugcaugguggauccagaaaacaaaaaguaggauacuuacaauccau

SEQ ID NO: 478758 - RNA, 64 nt, Human
agaaagacuuuggugguggaagaaagaaaagcauaaaacaaagacuacugaaauauagauaaag

SEQ ID NO: 478759 - RNA, 64 nt, Human
aucuauuuuuguuuaaaaacaauacaaguuuuagaaaacaaagcauuaaaaaaaaagccuauca

SEQ ID NO: 478760 - RNA, 64 nt, Human
caguucaaguuggaagugugucuuuugaaugcagaaaacaaagucguggacaaccaggcuggga

SEQ ID NO: 478761 - RNA, 64 nt, Human
guuuuacuuucgugccugcauuauuuuucuauuuaaaacaaaaauaaaucuaguuuagcacuaa

SEQ ID NO: 478762 - RNA, 64 nt, Human
gcaacagagcaagacccugucugucucaaaacaaaaaacaaaaccacuuauauugcuagcuaca

SEQ ID NO: 478763 - RNA, 64 nt, Human
agccugggcaacagagcaagacccugucugucucaaaacaaaaaacaaaaccacuuauauugcu

SEQ ID NO: 478764 - RNA, 64 nt, Human
aagaaaauguguaaggcuugcuaaaaaacaaaacaaaacaaaacacaguccugcauacucacca

SEQ ID NO: 478765 - RNA, 64 nt, Human
uacaaaagaaaauguguaaggcuugcuaaaaaacaaaacaaaacaaaacacaguccugcauacu

SEQ ID NO: 478766 - RNA, 64 nt, Human
uugcauacaaaagaaaauguguaaggcuugcuaaaaaacaaaacaaaacaaaacacaguccugc

SEQ ID NO: 478767 - RNA, 64 nt, Human
caggcaugagucaccaugccuggccucauuuuuuaaaacaaaugaauaaauggacaaaugagua

SEQ ID NO: 478768 - RNA, 64 nt, Human
uuuaguaacaaaugcauucgguucuugacagcugaaaacaaauuaauaaauuaucuuuuacaua

SEQ ID NO: 478769 - RNA, 64 nt, Human
cuaggcucccccuccccucucuaaaccaaaguauaaaacaaaaucuagccccuucuucagggcc

SEQ ID NO: 478770 - RNA, 64 nt, Human
ccuuacucgauguuuucuuucaacugagaagccuaaaacaaacaaaaaccuuguguguuauccu

SEQ ID NO: 478771 - RNA, 64 nt, Human
uucaauuaggaaaaguaaaauccaaaauguuagcaaaacaaagugcaauauuaaauguuugcuu

SEQ ID NO: 478772 - RNA, 64 nt, Human
uugaccugguuaaauacugucuuaaagcucauacaaaacaaauaggcuuuuccauaaguggccu

SEQ ID NO: 478773 - RNA, 64 nt, Human
uuaaaacuuguuuguggucagcacaacaaggaacaaaacaaagcuuugaaaaaacuuuaacaug

SEQ ID NO: 478774 - RNA, 64 nt, Human
aagcgaauguguacaaaguguaaaugcauuaggaaaaacaaacuacccgcaucuucuguuaggc

SEQ ID NO: 478775 - RNA, 64 nt, Human
uuuacagcaaaauacuguguauccuuuuauggguaaaacaaaagugaacauugcaugcauguaa

SEQ ID NO: 478776 - RNA, 64 nt, Human
uuuauuuuuugccacuggugaugauagauuucaaaaaacaaaagguggcagcagcacaauguuc

SEQ ID NO: 478777 - RNA, 64 nt, Human
guaacugaauuauuucaggaaggucuucaaucuuaaaacaaauucauuauucuuuuucaguuuu

SEQ ID NO: 478778 - RNA, 64 nt, Human
cuaagcaaugugucuugcauuuguuuucaauaggaaaacaaaguucuagauagguuaaaagaaa

SEQ ID NO: 478779 - RNA, 64 nt, Human
aaaaugcauauauauacuucuugcauggaagagcaaaacaaauucaaguugucaugccugauaa

SEQ ID NO: 478780 - RNA, 64 nt, Human
uuaguauuuauuuaauguuauguuguguucuaauaaaacaaaaauagacaacuguucaauuugc

SEQ ID NO: 478781 - RNA, 64 nt, Human
aauaacuuuuuuucuuaugcaaacgucaugcaauaaaacaaacucuaauguuuggcauccuugu

SEQ ID NO: 478782 - RNA, 64 nt, Human
ucucuuguguccuguagauguugugaaaaagaaaaaaacaaaaaauacaccacacuguacuuuu

SEQ ID NO: 478783 - RNA, 64 nt, Human
gaaaaacaaaacaaaacaaaacaaaaacaggaaaaaaacaaaaaaccaaagugguaaggauuca

SEQ ID NO: 478784 - RNA, 64 nt, Human
aagccucggguaacacugaaaaacaaaacaaaacaaaacaaaaacaggaaaaaaacaaaaaacc

SEQ ID NO: 478785 - RNA, 64 nt, Human
cagagaagccucggguaacacugaaaaacaaaacaaaacaaaacaaaaacaggaaaaaaacaaa

SEQ ID NO: 478786 - RNA, 64 nt, Human
cucuucagagaagccucggguaacacugaaaaacaaaacaaaacaaaacaaaaacaggaaaaaa

SEQ ID NO: 478787 - RNA, 64 nt, Human
acuagcucuucagagaagccucggguaacacugaaaaacaaaacaaaacaaaacaaaaacagga

SEQ ID NO: 478788 - RNA, 64 nt, Human
ucucauuuuguacuugguuguggugccacuaaacaaaacaaaugaugggagaguaaguaggccc

SEQ ID NO: 478789 - RNA, 64 nt, Human
ccaagagaaaugguuuuugccaaacucuuuuuaaaaaacaaauuguugcuauuuccuagaaguu

SEQ ID NO: 478790 - RNA, 64 nt, Human
cuaguccugauaauaaacaucauuuuaaaagaucaaaacaaacaaacaaaaaaaacaagggugg

SEQ ID NO: 478791 - RNA, 64 nt, Human
ucuuugcaugacuuuauacgcaguaaguauguugaaaacaaacaaaaagaagaaaacacucaac

SEQ ID NO: 478792 - RNA, 64 nt, Human
agaauuuuuuuuuaagggccuuggagccaucucuaaaacaaaccucaagggauuuagugcccug

SEQ ID NO: 478793 - RNA, 64 nt, Human
guaaaggugaaaacauccccuuucaccccucugcaaaacaaacaagcaacauccucaaaaccca

SEQ ID NO: 478794 - RNA, 64 nt, Human
gaagaagaaaaagugcucagggauuuauaauuuuaaaacaaauaugcacagaaaauaaacauuu

SEQ ID NO: 478795 - RNA, 64 nt, Human
augacagcuuuguacuguggaaugugcuuaauaaaaaacaaaaaaguuugacuuuuguccagua

SEQ ID NO: 478796 - RNA, 64 nt, Human
guacagauccguguggacauuuuuaauuuuuguaaaaacaaaacaguaauauauugaucuuuuu

SEQ ID NO: 478797 - RNA, 64 nt, Human
ugggugacagagcgagacucugucucaaaaaaacaaaacaaaaaaacaccaaaaaaacccccaa

SEQ ID NO: 478798 - RNA, 64 nt, Human
cagccugggugacagagcgagacucugucucaaaaaaacaaaacaaaaaaacaccaaaaaaacc

SEQ ID NO: 478799 - RNA, 64 nt, Human
uugugugcucucuucuucacguaggcuccuguuaaaaacaaagugcagucagauucuaagcccu

SEQ ID NO: 478800 - RNA, 64 nt, Human
uuuuggcacacuauuaaaugcaaaaacuccuuucaaaacaaaaaagaacuaccuuauauucaac

SEQ ID NO: 478801 - RNA, 64 nt, Human
ggguguuguauuuuuccaaaaugacuucuuaaacaaaacaaauauuauaaugaauugucuggag

SEQ ID NO: 478802 - RNA, 64 nt, Human
cuccagccugggugacagagcgagacuuugucccaaaacaaaauaggugaggggauagcgaaug

SEQ ID NO: 478803 - RNA, 64 nt, Human
acuuuucagguuuguacuacaagguuuaauaauaaaaacaaaguuuuuuggacauuugucuguc

SEQ ID NO: 478804 - RNA, 64 nt, Human
aguuugccaucgagauuauuuucauuuauacuauaaaacaaaagcaaacuaguccaguuuaauu

SEQ ID NO: 478805 - RNA, 64 nt, Human
gacuuggagucuguacuuugaaagaggccuuugaaaaacaaauaauucugugugaauuuucuug

SEQ ID NO: 478806 - RNA, 64 nt, Human
uguguggguaugcguggguguauguuugggaagaaaaacaaaggugcagacuaucuuccuuuuu

SEQ ID NO: 478807 - RNA, 64 nt, Human
uuuaaaaaagaaaauauguaauauaauguaaaaaaaaacaaaaaaaagcuuuuaugauggauuu

SEQ ID NO: 478808 - RNA, 64 nt, Human
uuuauauuuaaauguagacuuuugacacuuuuaaaaaacaaaaaaagacaagagagaugaaaac

SEQ ID NO: 478809 - RNA, 64 nt, Human
aggagaauuagccaaacacuguaagcuuuuaagaaaaacaaaguuuuaaacgaaauacugcucu

SEQ ID NO: 478810 - RNA, 64 nt, Human
ccagcaauuuauacaacgcugucauauuuuuaaaaaaacaaaaguaagccauccucaaauaagg

SEQ ID NO: 478811 - RNA, 64 nt, Human
aguuuuuacagcucaucauucaaauaacgcacaaaaaacaaaagccgcuaugaccggcguugcc

SEQ ID NO: 478812 - RNA, 64 nt, Human
gaaagaaagcugcaauuauccgccaacugcauuuaaaacaaaacaaaacagaaaaaucaaaaua

SEQ ID NO: 478813 - RNA, 64 nt, Human
aaagcugcaauuauccgccaacugcauuuaaaacaaaacaaaacagaaaaaucaaaauaacauu

SEQ ID NO: 478814 - RNA, 64 nt, Human
aaucuaagaauacgcggucuccugagaacuucaaaaaacaaaaacaaaaaaacccaaaggcccu

SEQ ID NO: 478815 - RNA, 64 nt, Human
agaauacgcggucuccugagaacuucaaaaaacaaaaacaaaaaaacccaaaggcccuuuucag

SEQ ID NO: 478816 - RNA, 64 nt, Human
uuugugaaaaagcaaucuauuguguccaaauaaaaaaacaaaaagugugacacugguuaacuuu

SEQ ID NO: 478817 - RNA, 64 nt, Human
aaggccaaauaaggagcgagguugugaaaacuggaaaacaaaggcucuuuucagagccauucua

SEQ ID NO: 478818 - RNA, 64 nt, Human
cuugcccccacccccauuuuuuuaaugaaaaaaaaaaacaaaaaaaacggauccaagaagaaaa

SEQ ID NO: 478819 - RNA, 64 nt, Human
caagcuuuuauuuuuuuaaaagucaaaacagaacaaaacaaaguaugcagagacagagcauuug

SEQ ID NO: 478820 - RNA, 64 nt, Human
cauaaugcucccaucuccugauuucucugaacagaaaacaaaagagagaaugagggaaauugcu

SEQ ID NO: 478821 - RNA, 64 nt, Human
cccgggcaacaagagcgaaaccccaucucgaaaaaaaacaaaacaaaacuagacaagugagugc

SEQ ID NO: 478822 - RNA, 64 nt, Human
gcaacaagagcgaaaccccaucucgaaaaaaaacaaaacaaaacuagacaagugagugccuacg

SEQ ID NO: 478823 - RNA, 64 nt, Human
ugauuuugaacuuuuuauuugaggagacgaagugaaaacaaaucuauaaauauauauuuuuaaa

SEQ ID NO: 478824 - RNA, 64 nt, Human
gagcgagacuccaucucaaacaaaaacaagaacaaaaacaaacauaaaguuggcacagaaaagg

SEQ ID NO: 478825 - RNA, 64 nt, Human
uuuuuguucuuuuuuguuuuuuuccuuuaaaauaaaaacaaagaaaagcucugaggcagguguc

SEQ ID NO: 478826 - RNA, 64 nt, Human
uuuuaaagugcugccugugaguaacucuugaauaaaaacaaaauauaaaaaauugagaauguag

SEQ ID NO: 478827 - RNA, 64 nt, Human
aaguugucauuuucaaaaacuucuauauagguggaaaacaaauuaggucucagguugauggugg

SEQ ID NO: 478828 - RNA, 64 nt, Human
guuucuccuucugacuuuuaauaaugguaauaggaaaacaaaacccaaagcuuuucagaacuuc

SEQ ID NO: 478829 - RNA, 64 nt, Human
aaaucuuacuuucuuuuaaugaccaaccuuagguaaaacaaaaauauuguaauccuagaaauua

SEQ ID NO: 478830 - RNA, 64 nt, Human
accaaaucucuacccuuccccaacccuccauaaaaaaacaaaaauggaaaugaaaaaugaaaca

SEQ ID NO: 478831 - RNA, 64 nt, Human
uauugggaagaguuaugcaaauucuccuauaagcaaaacaaagcaugucuuugaguaacaauga

SEQ ID NO: 478832 - RNA, 64 nt, Human
cacuauucuguggaugaauacauaguuuguggggaaaacaaacguucagcuaggggcaaaaagc

SEQ ID NO: 478833 - RNA, 64 nt, Human
ucacccucagacuuuaagacaagaagccaccaucaaaacaaaggaugggauacguauagaaugg

SEQ ID NO: 478834 - RNA, 64 nt, Human
uuuucugcacuauaugcaaacaggguaacuaacuaaaacaaagccacuuucaaucuucaauccu

SEQ ID NO: 478835 - RNA, 64 nt, Human
caucagaugacaagaaaggcugcuguacugaaguaaaacaaacaauaccugaaugcucuguagc

SEQ ID NO: 478836 - RNA, 64 nt, Human
ucuguuuauuguauguaaggaaaaauuuuaccugaaaacaaacaaacaaacccuaaaacucagc

SEQ ID NO: 478837 - RNA, 64 nt, Human
ucuuucugcuacugaugacacucauugucauaauaaaacaaauaauuuccucaaauaacaaaga

SEQ ID NO: 478838 - RNA, 64 nt, Human
uccuuuuuuucacacauacugacuguagaauuaaaaaacaaagcuacaauuugcccucauacac

SEQ ID NO: 478839 - RNA, 64 nt, Human
ggauucgagguagauaggcucaggccacacuuuaaaaacaaacacacaaacaacaaaaaacggg

SEQ ID NO: 478840 - RNA, 64 nt, Human
uauaaugggggaagaaugcccuauguuucaauucaaaacaaagacaguuuuccaaucugauaua

SEQ ID NO: 478841 - RNA, 64 nt, Human
ccagcaggguguuuuuaacugugacuauuguauaaaaacaaaucuugauauccagaagcacaug

SEQ ID NO: 478842 - RNA, 64 nt, Human
acugugggaugaguaucucaggguaaguaacaaaaaaacaaacaaaaaaaaucacugaaauuuu

SEQ ID NO: 478843 - RNA, 64 nt, Human
auuauuaaaccuuuguucugggauuuacuguuaaaaaacaaacaaaaaacaacaaaaaagcggu

SEQ ID NO: 478844 - RNA, 64 nt, Human
caucugcaaccauaugcuauuaauaaaauggaaaaaaacaaaauggucauuuugcauauacuuc

SEQ ID NO: 478845 - RNA, 64 nt, Human
uaguucugcaaauucaaagauacaguaucccuucaaaacaaauaggaguucagggaagagaaac

SEQ ID NO: 478846 - RNA, 64 nt, Human
caaccuguaaacaugugccuguaacuuacuuccaaaaacaaaaucauacuuauuagaagaaaau

SEQ ID NO: 478847 - RNA, 64 nt, Human
ccaggaagagucugucaaaacaaguauaucaaguaaaacaaacaaauauauuuuaccuauauau

SEQ ID NO: 478848 - RNA, 64 nt, Human
gucugaacauaagguauagcauuugguuuuuaagaaaacaaaacauuaagacgcaacucauuuu

SEQ ID NO: 478849 - RNA, 64 nt, Human
gauugaacauuuuauaauauuucaucuacuuauuaaaacaaauaauuucccuuggguuggaggg

SEQ ID NO: 478850 - RNA, 64 nt, Human
cacaacacaguguuugucuuccacagggaagcuuaaaacaaaagauauuuuuaacccacugaca

SEQ ID NO: 478851 - RNA, 64 nt, Human
agaugaauaaauaaaauaaaaugacacaaggccaaaaacaaauggguuuaacugaccagagcga

SEQ ID NO: 478852 - RNA, 64 nt, Human
agccugggcaacagagcgagaaccugucucaaaaaaaacaaaaacaaaguuacuaaaaugucac

SEQ ID NO: 478853 - RNA, 64 nt, Human
ggcaacagagcgagaaccugucucaaaaaaaacaaaaacaaaguuacuaaaaugucaccuucac

SEQ ID NO: 478854 - RNA, 64 nt, Human
uuauacuuagauuuucuuuuaaaaaaauuaaaauaaaacaaaaaaaaauuucuaggacuagacg

SEQ ID NO: 478855 - RNA, 64 nt, Human
gccauaucuccaaaaaaagaaagaaaaaauacaaaaaacaaaaacaaaaaaaaaagaggguaau

SEQ ID NO: 478856 - RNA, 64 nt, Human
ucuccaaaaaaagaaagaaaaaauacaaaaaacaaaaacaaaaaaaaaagaggguaauguacaa

SEQ ID NO: 478857 - RNA, 64 nt, Human
aagauauauugcagauuacuuaaauauggccaucaaaacaaaaguuacaacacguaucucuuuu

SEQ ID NO: 478858 - RNA, 64 nt, Human
caugggaaauuucccucaccaaagagcaauuaagaaaacaaaaacagaaacacauaguauuugc

SEQ ID NO: 478859 - RNA, 64 nt, Human
ugacaguuuguuaaaaagcuuuagaggaggaaugaaaacaaagugaaguacacuuagaaaaggg

SEQ ID NO: 478860 - RNA, 64 nt, Human
uaaauugguuuggcuacagaacagaaagaaaacaaaaacaaaccucguaagggaaguaucacac

SEQ ID NO: 478861 - RNA, 64 nt, Human
ggcugguaaauugguuuggcuacagaacagaaagaaaacaaaaacaaaccucguaagggaagua

SEQ ID NO: 478862 - RNA, 64 nt, Human
uaaccuccccuaugcucaugcccacacagacaaaaaaacaaaacgaaauacacacagaaaaaag

SEQ ID NO: 478863 - RNA, 64 nt, Human
uguaucucacuuuaaacucuuuggggaaaaaacaaaaacaaaaaaaacuaaguugcuuucuuuu

SEQ ID NO: 478864 - RNA, 64 nt, Human
aaguacuguaucucacuuuaaacucuuuggggaaaaaacaaaaacaaaaaaaacuaaguugcuu

SEQ ID NO: 478865 - RNA, 64 nt, Human
gguugucauugguaaaaagacuucugugucagaaaaaacaaaaggcucuuuucagagccaccua

SEQ ID NO: 478866 - RNA, 64 nt, Human
aagacuaaguaaagaccgaguugaaaagcgcauaaaaacaaaggcucuuuucagagccacuuca

SEQ ID NO: 478867 - RNA, 64 nt, Human
gaaggaaacuaaggacuuggcuccaaaacaaaacaaaacaaaaucuggagaugcugaauuuugu

SEQ ID NO: 478868 - RNA, 64 nt, Human
acugagaaggaaacuaaggacuuggcuccaaaacaaaacaaaacaaaaucuggagaugcugaau

SEQ ID NO: 478869 - RNA, 64 nt, Human
guguuacugagaaggaaacuaaggacuuggcuccaaaacaaaacaaaacaaaaucuggagaugc

SEQ ID NO: 478870 - RNA, 64 nt, Human
caguguaguagguucaagaaacacaggagcaagcaaaacaaauuccauaaugucaucaaacaua

SEQ ID NO: 478871 - RNA, 64 nt, Human
cuccaaccugggugacagacucugucuccaaaacaaaacaaacaaacaaaaagauuuuauuaaa

SEQ ID NO: 478872 - RNA, 64 nt, Human
cugcacuccaaccugggugacagacucugucuccaaaacaaaacaaacaaacaaaaagauuuua

SEQ ID NO: 478873 - RNA, 64 nt, Human
ccucacuuguaaacuuguguaguuucacagaaaaaaaacaaaaugcaguuuuaaauaaagaaau

SEQ ID NO: 478874 - RNA, 64 nt, Human
ggaaaaaaaaucaaaacacaaaaaagccaaaacgaaaacaaaucucgaguguguugccaagugc

SEQ ID NO: 478875 - RNA, 64 nt, Human
aauuuugacuuuuuaguacuaagcuuaauuuuuaaaaacaaaaucuguaggguugacaaauaaa

SEQ ID NO: 478876 - RNA, 64 nt, Human
cuuuaugucucuuaacauucacaccuacuuuuuaaaaacaaauauuauuacuauuuuuauuauu

SEQ ID NO: 478877 - RNA, 64 nt, Human
uauuuugcuugggcaccaacagaauuaaaaacgaaaaacaaaaaaaaacucgaaugacuuaggc

SEQ ID NO: 478878 - RNA, 64 nt, Human
uagcaccaguuaaggugaauauguauuguaucacaaaacaaacccaauauccagaugaauaucc

SEQ ID NO: 478879 - RNA, 64 nt, Human
ugcuaaggguuuauuuuauguaaaaaaaaaaaaaaaaacaaaaaaaaacccugagaccaugagu

SEQ ID NO: 478880 - RNA, 64 nt, Human
cagccuggacaacaagagcgaaauucugucuaaaaaaacaaaagucccaauuaagaaccuccga

SEQ ID NO: 478881 - RNA, 64 nt, Human
uuauugugaggaccuucucauggaagccauuaggaaaacaaacuagagguaaauaucacauuaa

SEQ ID NO: 478882 - RNA, 64 nt, Human
ugacugagaaccugcagccauuucuuguuacaugaaaacaaaaugcuacuuguuaccucuauuu

SEQ ID NO: 478883 - RNA, 64 nt, Human
gcugaugugcaguugagaaaacuagaggacugaaaaaacaaauuuuaacuagcaaaugcuguga

SEQ ID NO: 478884 - RNA, 64 nt, Human
uagacauguaauuguuacuuaaagcuaaucuaccaaaacaaaaagacugaacuuuuguaauuaa

SEQ ID NO: 478885 - RNA, 64 nt, Human
gcuaucacagggccuggaccucuaaaauuuugcaaaaacaaaagguucuaagaugauuucagga

SEQ ID NO: 478886 - RNA, 64 nt, Human
uguuugguuuguuucugaguguuuaaauuuugcaaaaacaaauguuaaauuugugcuucaguac

SEQ ID NO: 478887 - RNA, 64 nt, Human
uuuuuagagguacauguuuuaaguaaauguauuuaaaacaaauuuucauggucugaauuguaua

SEQ ID NO: 478888 - RNA, 64 nt, Human
uggauuuccuacauuucugagaucccuguauucaaaaacaaaugacaggguuguuaaguuguac

SEQ ID NO: 478889 - RNA, 64 nt, Human
cgccugguacaggaacauaaaaagcuuuuagaugaaaacaaaagccuuucuacuuacuaccagc

SEQ ID NO: 478890 - RNA, 64 nt, Human
cacagaauaucaccauugcaguucaaaacaaaacaaaacaaaaagucuuuuguuugugaacacu

SEQ ID NO: 478891 - RNA, 64 nt, Human
ugcugcacagaauaucaccauugcaguucaaaacaaaacaaaacaaaaagucuuuuguuuguga

SEQ ID NO: 478892 - RNA, 64 nt, Human
aaauuugcugcacagaauaucaccauugcaguucaaaacaaaacaaaacaaaaagucuuuuguu

SEQ ID NO: 478893 - RNA, 64 nt, Human
aagauuaaugagggaaaucuuuauauucuguauaaaaacaaaagcaaauuuauauacuaaaauc

SEQ ID NO: 478894 - RNA, 64 nt, Human
aacacuggagaagaauaucaaauaauaaaguagcaaaacaaauucaaauaauccauuccaaaau

SEQ ID NO: 478895 - RNA, 64 nt, Human
aaagaaguccugcuauguuaaaaacaaacaacaaaaaacaaacaacaaaaaaaaaauuaaaaaa

SEQ ID NO: 478896 - RNA, 64 nt, Human
uaaaaaauaucaccaaagaaguccugcuauguuaaaaacaaacaacaaaaaacaaacaacaaaa

SEQ ID NO: 478897 - RNA, 64 nt, Human
cuuucacucugaagcaguuuuagcuuauuaacagaaaacaaaacuggcaaagcaggcuuuuugu

SEQ ID NO: 478898 - RNA, 64 nt, Human
uauucucugcucuauaguugugaaaugaagaguaaaaacaaauuuguuugacuauuuuaaaauu

SEQ ID NO: 478899 - RNA, 64 nt, Human
gacugggacuccagaaccauuaauaaaacaaaacaaaacaaagcaaaauauugaugaucaggca

SEQ ID NO: 478900 - RNA, 64 nt, Human
guagggacugggacuccagaaccauuaauaaaacaaaacaaaacaaagcaaaauauugaugauc

SEQ ID NO: 478901 - RNA, 64 nt, Human
cagggguagggacugggacuccagaaccauuaauaaaacaaaacaaaacaaagcaaaauauuga

SEQ ID NO: 478902 - RNA, 64 nt, Human
auauuaaguaugaaaggaguaauuaaaaacaagcaaaacaaaacaagacuuaguuuuuaaauga

SEQ ID NO: 478903 - RNA, 64 nt, Human
agcucuacuaaauguaucuguacaaggaugaagaaaaacaaaauaacuacuacuuuuggaggaa

SEQ ID NO: 478904 - RNA, 64 nt, Human
uuaauaguguaaauguagguguaaaauacaaugcaaaacaaaauaaugaaguaagugaauuaaa

SEQ ID NO: 478905 - RNA, 64 nt, Human
cagccugggggacagagcaagacucuaucuccaaaaaacaaaaaagauaagcagcuuuagaaua

SEQ ID NO: 478906 - RNA, 64 nt, Human
aaugcaauucaguaguccugaagccugacuuaauaaaacaaaauucauuuaugguuguuucaug

SEQ ID NO: 478907 - RNA, 64 nt, Human
ucgcuuuggaaaaagacggccaucccuuuugugcaaaacaaauguaaauauuuucuugagaugg

SEQ ID NO: 478908 - RNA, 64 nt, Human
cugccaugaggauuucucuuuaggccagaaguacaaaacaaaaaaaccaauggauuuuaaccaa

SEQ ID NO: 478909 - RNA, 64 nt, Human
uuagguaaauuaacaagucaucaugagccugaccaaaacaaaauuugaaauuaaccuauugggu

SEQ ID NO: 478910 - RNA, 64 nt, Human
cucaucgcaguguguuauaugacaggacaaagcaaaaacaaacaaaaagcaagccugugaauau

SEQ ID NO: 478911 - RNA, 64 nt, Human
gacaguuauuuguuucuucugcaucuugcuacugaaaacaaaaacaaugaaaauauucauauuu

SEQ ID NO: 478912 - RNA, 64 nt, Human
aagagaaaucaucaguuaagaaaucuacuuuaacaaaacaaaaaggagaaaaaguaauaaugug

SEQ ID NO: 478913 - RNA, 64 nt, Human
aacaaacaaaaaacaaccuuagcauuaagaaauaaaaacaaaaaacaagaagcaaguuguacug

SEQ ID NO: 478914 - RNA, 64 nt, Human
gaauuguuuuaauaucuuuacucaaaaaaacaaaaaaacaaaaacccauggaagcaacaaaaga

SEQ ID NO: 478915 - RNA, 64 nt, Human
uggcaucugaauuguuuuaauaucuuuacucaaaaaaacaaaaaaacaaaaacccauggaagca

SEQ ID NO: 478916 - RNA, 64 nt, Human
cguccaguacuucugcacagaauuugguaaaguuaaaacaaaauaucuuucaauaaaacauaau

SEQ ID NO: 478917 - RNA, 64 nt, Human
auacuucaaaaaugucucugacacagaaagaaaaaaaacaaaaagggagcuauuccagauuuua

SEQ ID NO: 478918 - RNA, 64 nt, Human
uuauaguggucauaugaccugauacuggguaaacaaaacaaagauggacuuguucugggaaaag

SEQ ID NO: 478919 - RNA, 64 nt, Human
gucccuuggaaccuuuguacgcuuugcucaaaaaaaaacaaaaaaaaaaaacaaaaaaaaaaaa

SEQ ID NO: 478920 - RNA, 64 nt, Human
uuuguacgcuuugcucaaaaaaaaacaaaaaaaaaaaacaaaaaaaaaaaacaacgguggagcc

SEQ ID NO: 478921 - RNA, 64 nt, Human
acaagauauuuguuuuauuaauauuugcuggcuaaaaacaaaugugguuuuuauauauuuuugu

SEQ ID NO: 478922 - RNA, 64 nt, Human
aucccaaagccugcuacaccaauuacuucuaaagaaaacaaauucacuguuauuuugaguuuau

SEQ ID NO: 478923 - RNA, 64 nt, Human
gaaacuuaugacuuggauauaugguugaagaaucaaaacaaaagcaaaaaaaaaaagcaaaaaa

SEQ ID NO: 478924 - RNA, 64 nt, Human
uucgucuucaguugaauuggugaaaacaucaacaaaaacaaaacccacugugucuuaaaauaaa

SEQ ID NO: 478925 - RNA, 64 nt, Human
aaaauuuagccauuucuuuacuaaaaaaaaccaaaaaacaaaucuguuuuauaaucacagauuu

SEQ ID NO: 478926 - RNA, 64 nt, Human
cagccaaagcaacaagagcaaaaacuucgucucaaaaacaaaacaaaaaaagaguauucauugu

SEQ ID NO: 478927 - RNA, 64 nt, Human
aaagcaacaagagcaaaaacuucgucucaaaaacaaaacaaaaaaagaguauucauugugagga

SEQ ID NO: 478928 - RNA, 64 nt, Human
acaaaaucagagugcugaguacagaaaguuauccaaaacaaaaguugguagauaacuaauagug

SEQ ID NO: 478929 - RNA, 64 nt, Human
uguauguuucaggauauuugaccugucauuaaaaaaaacaaacaguuuuacagugccuacuugu

SEQ ID NO: 478930 - RNA, 64 nt, Human
uuggugacagggucugacauggucagucuacuaaaaaacaaaaaaaaaaaacaaaaaaaaaaaa

SEQ ID NO: 478931 - RNA, 64 nt, Human
cugacauggucagucuacuaaaaaacaaaaaaaaaaaacaaaaaaaaaaaaacaaaagaaaaaa

SEQ ID NO: 478932 - RNA, 64 nt, Human
cuacuaaaaaacaaaaaaaaaaaacaaaaaaaaaaaaacaaaagaaaaaaauaaaaauacggug

SEQ ID NO: 478933 - RNA, 64 nt, Human
cuguuacagauaaauggggccuuuaaaaauaugaaaaacaaacuugugaaaauguauaaaagau

SEQ ID NO: 478934 - RNA, 64 nt, Human
gagacacccuaccuucaauuguucaucaguggguaaaacaaauucugauguacauucaggacaa

SEQ ID NO: 478935 - RNA, 64 nt, Human
uguaucagauuugguuuauccagccaugggagagaaaacaaaccuaaguuuacuuuacuuguac

SEQ ID NO: 478936 - RNA, 64 nt, Human
auauuggaaauguacauauccaauaugaaauacuaaaacaaacaaacaaacaaaaaaccagaau

SEQ ID NO: 478937 - RNA, 64 nt, Human
gacagagcaggacucucucucaaaaaaacacaaaaaaacaaaaacaaaaaaccauacacacaca

SEQ ID NO: 478938 - RNA, 64 nt, Human
gcaggacucucucucaaaaaaacacaaaaaaacaaaaacaaaaaaccauacacacacacacaca

SEQ ID NO: 478939 - RNA, 64 nt, Human
ggagggaaaaagaaauacagccucaacagauuaaaaaacaaaagucacacuuaaggauccuucu

SEQ ID NO: 478940 - RNA, 64 nt, Human
cauccugcuuauuucucaaaaaagagggacagugaaaacaaaaacgacauugggacaugcugcu

SEQ ID NO: 478941 - RNA, 54 nt, Human
gccaauauucucuagaaugagcacaaaacaaaucgaauaacagcuaaacaaauc

SEQ ID NO: 478942 - RNA, 64 nt, Human
gagguuuguaaacuguccuuuuuaaaucaaacugaaaacaaaaagcuuuaaccuuucaacagaa

SEQ ID NO: 478943 - RNA, 64 nt, Human
aaaaaaaaaaaagcgaaagacugcaguugugcuaaaaacaaaacaaaacaaacaaacaaacaaa

SEQ ID NO: 478944 - RNA, 64 nt, Human
aaaaaaagcgaaagacugcaguugugcuaaaaacaaaacaaaacaaacaaacaaacaaaaaagu

SEQ ID NO: 478945 - RNA, 64 nt, Human
aagcgaaagacugcaguugugcuaaaaacaaaacaaaacaaacaaacaaacaaaaaaguaaaaa

SEQ ID NO: 478946 - RNA, 64 nt, Human
gcacacaacgauuauaguaacuauaagauacaauaaaacaaauaaauaugaaaguagauucaug

SEQ ID NO: 478947 - RNA, 64 nt, Human
auaaaucguugaacauaauguuccaguugaaugcaaaacaaaaaaaauauggaaaacauuuuga

SEQ ID NO: 478948 - RNA, 64 nt, Human
uauuagaucagcaauaaugacuauguaaucucaaaaaacaaauaaaauauucuuaacauggacu

SEQ ID NO: 478949 - RNA, 64 nt, Human
uccggccugggugaaagagcgagacuccgucucaaaaacaaaaaaaaaagaaaagaaauauauu

SEQ ID NO: 478950 - RNA, 64 nt, Human
gaggauagaaaaaggauggaagaaagaagcauugaaaacaaagacauucuucccacuucuugga

SEQ ID NO: 478951 - RNA, 64 nt, Human
uauuucuuuauagcugaguuuucccuucuguaucaaaacaaaauaauacaaaaaaugcuuuuag

SEQ ID NO: 478952 - RNA, 54 nt, Human
caucugugaacagccugugaaaggaaaacaaaucacuuucauuaauaaaggguu

SEQ ID NO: 478953 - RNA, 64 nt, Human
agauuuuuaaaaauagggcuguguuuaaaaaaaaaaaacaaaacaagaaaagcagcagugauua

SEQ ID NO: 478954 - RNA, 64 nt, Human
uaauaguguaaaccuuuuuaaaaaggaaaguauaaaaacaaaaguuguaauuuaaaagucugaa

SEQ ID NO: 478955 - RNA, 64 nt, Human
ucuauaaacaaucccauuuuuauauuuuauuauuaaaacaaaaauaccucucuuugcuagagag

SEQ ID NO: 478956 - RNA, 64 nt, Human
gcugaaugacacuuuuaagacaaugaacauuaucaaaacaaaauguauaauuucuuaauuugaa

SEQ ID NO: 478957 - RNA, 64 nt, Human
gcuccauauucucuuguccucaaucauuaguccuaaaacaaaaaagcuuuuugccucccucucu

SEQ ID NO: 478958 - RNA, 64 nt, Human
auuuacaguggucacagggcccaauucuagacauaaaacaaaggauauaccugacagacuacuu

SEQ ID NO: 478959 - RNA, 64 nt, Human
ggugcaaagcgaaacugguugcucaaguugauagaaaacaaaauucugaauaucuucaaauuaa

SEQ ID NO: 478960 - RNA, 64 nt, Human
agagucugauaggacauauucuuguaccacagacaaaacaaaucuuauguugcauuuacuauca

SEQ ID NO: 478961 - RNA, 64 nt, Human
guuaauucuuuuuuucauccuuccucugaggggaaaaacaaaaaaaaacuuaaaauacaaaaaa

SEQ ID NO: 478962 - RNA, 54 nt, Human
agcugguagaagacaauuaagaggaaaacaaacagaaccagccaccucaccaua

SEQ ID NO: 478963 - RNA, 64 nt, Human
uuuaugcucucugaaauguaugacacccagcuuuaaaacaaacaaacaaacaaacaaaaaaagg

SEQ ID NO: 478964 - RNA, 64 nt, Human
uccagagacuggcucaaaaaagaaagaagcaacgaaaacaaaaugcacagccugaauggacgua

SEQ ID NO: 478965 - RNA, 64 nt, Human
gaagcaggcuguagauuuaagggcacucaaggggaaaacaaauguaguuuccacagugugagga

SEQ ID NO: 478966 - RNA, 64 nt, Human
agaaauuuuguuuucuggcaagaugugagauggaaaaacaaauucuggggcaaauccauggaaa

SEQ ID NO: 478967 - RNA, 62 nt, Human
ugcagcaucugaauuacuaaaaacauuaaagcaaaacaaagcaucaccaaacaaaaacuccu

SEQ ID NO: 478968 - RNA, 64 nt, Human
uaagauucauguguuuucuaagcuuuucauuaagaaaacaaaaguccucuggauugagauacuu

SEQ ID NO: 478969 - RNA, 64 nt, Human
uccaccccuccccaucuggaccauaauagacaccaaaacaaacccaaauuggugaaaagaauaa

SEQ ID NO: 478970 - RNA, 64 nt, Human
ggaaaaauaaaagaaaauguaaaaaacaaaaacaaaaacaaaaaagcaacccaguccccaaccu

SEQ ID NO: 478971 - RNA, 64 nt, Human
aaaaugggaaaaauaaaagaaaauguaaaaaacaaaaacaaaaacaaaaaagcaacccaguccc

SEQ ID NO: 478972 - RNA, 64 nt, Human
cuuacaaaaaugggaaaaauaaaagaaaauguaaaaaacaaaaacaaaaacaaaaaagcaaccc

SEQ ID NO: 478973 - RNA, 64 nt, Human
uauauauuuuuaaaaaucuaccuguuccugacuuaaaacaaaaggaaagaaacuaccuuuuuau

SEQ ID NO: 478974 - RNA, 64 nt, Human
aauaaaaaaugcuuugagauagcuaacugcccauaaaacaaacucaaauugcuuauaaaguuuc

SEQ ID NO: 478975 - RNA, 64 nt, Human
ugcauucucauuggaaaugucuguuuagcuuuauaaaacaaacacuuugcugaaauaggaaaau

SEQ ID NO: 478976 - RNA, 64 nt, Human
aaaaaagcucuagguucuucagcacauuucccccaaaacaaaauaaaauugagggcauguugca

SEQ ID NO: 478977 - RNA, 64 nt, Human
uauuuaagacuucccaccuuacuaaauuaccagcaaaacaaaccacucuccuguuugaguaaaa

SEQ ID NO: 478978 - RNA, 64 nt, Human
aggucuuagaacucugggggauauuccccugagcaaaacaaacaacgugagauuuuuacucaaa

SEQ ID NO: 478979 - RNA, 64 nt, Human
augacuucagcucuguuuuuagcuagaaacucuaaaaacaaaaauaauaauaaagaaaaauaaa

SEQ ID NO: 478980 - RNA, 64 nt, Human
aaaaaaaaaaacaaaaaaaaacaaaaguaaauuaaaaacaaaaccugaugaaacagaugaagga

SEQ ID NO: 478981 - RNA, 64 nt, Human
gaaauuaaaaacaaaacaaaaaaaaaaacaaaaaaaaacaaaaguaaauuaaaaacaaaaccug

SEQ ID NO: 478982 - RNA, 64 nt, Human
cagaaaaauagaaauuaaaaacaaaacaaaaaaaaaaacaaaaaaaaacaaaaguaaauuaaaa

SEQ ID NO: 478983 - RNA, 64 nt, Human
uucugaguuaaccagaaaaauagaaauuaaaaacaaaacaaaaaaaaaaacaaaaaaaaacaaa

SEQ ID NO: 478984 - RNA, 64 nt, Human
aagguuucugaguuaaccagaaaaauagaaauuaaaaacaaaacaaaaaaaaaaacaaaaaaaa

SEQ ID NO: 478985 - RNA, 64 nt, Human
cagaaaaacaagaccagaugugauuuguuaaaaaaaaacaaaaaaaaaaaaaaaaaaaacaaga

SEQ ID NO: 478986 - RNA, 64 nt, Human
aggucuuuuaagagauuuaagcuucaguuuucucaaaacaaaacaauuauccugucuuaucuga

SEQ ID NO: 478987 - RNA, 64 nt, Human
aguggagagggagcaagggaggccgcagagggaaaaaacaaaacguaacacaguuaagagaaau

SEQ ID NO: 478988 - RNA, 64 nt, Human
ccccccaaaaaauaaaaaaaccacaaaaaacaaaaaaacaaaacuaaggcacuucacuuagaga

SEQ ID NO: 478989 - RNA, 64 nt, Human
ccucccacccccccaaaaaauaaaaaaaccacaaaaaacaaaaaaacaaaacuaaggcacuuca

SEQ ID NO: 478990 - RNA, 64 nt, Human
aggcaacagagcaagacucugucucaaaaaaaacaaaacaaaaaggaggcacaaaaccccaggc

SEQ ID NO: 478991 - RNA, 64 nt, Human
agccuaggcaacagagcaagacucugucucaaaaaaaacaaaacaaaaaggaggcacaaaaccc

SEQ ID NO: 478992 - RNA, 64 nt, Human
cacaaccugagauuucuaagcuugcagguuacaaaaaacaaaaaaaacagagaagcugccugcg

SEQ ID NO: 478993 - RNA, 64 nt, Human
agccugagugacagagcgagacuccaucucuuuaaaaacaaacaaaaaauuaucugaaugaucc

SEQ ID NO: 478994 - RNA, 64 nt, Human
caucauagcaagaccucaucucuacuaaaauucaaaaacaaaauuagccgggcaugauggugca

SEQ ID NO: 478995 - RNA, 64 nt, Human
acugucauaauggugaauguucaaucuguguaagaaaacaaacuaaauguaguugucacacuaa

SEQ ID NO: 478996 - RNA, 64 nt, Human
aaacaaguagaaacuugccuagacaauaacuggaaaaacaaaugcaauauacaugaacuuuuuu

SEQ ID NO: 478997 - RNA, 64 nt, Human
aaauuuuuauaauuguauggcaaaaggcuauguaaaaacaaaucuugcaucuuaagacaaauau

SEQ ID NO: 478998 - RNA, 64 nt, Human
acuagaaaaagcauugaauggaaaaucaauauuuaaaacaaaguucaauuuagcuggauuucug

SEQ ID NO: 478999 - RNA, 64 nt, Human
uugaaauuuucucuuguaaaacauuuagaaaacaaaaacaaaaaaaaugugauuuguuucuguc

SEQ ID NO: 479000 - RNA, 64 nt, Human
augcuuuugaaauuuucucuuguaaaacauuuagaaaacaaaaacaaaaaaaaugugauuuguu

SEQ ID NO: 479001 - RNA, 64 nt, Human
ggcugccaaaaccauuaaguggaaagcugauuaaaaaacaaaaauuucuaauggauuuaucaaa

SEQ ID NO: 479002 - RNA, 64 nt, Human
agauguuauuaugcuaauauaguagggguugaagaaaacaaaauagcuuauuauagaauugcac

SEQ ID NO: 479003 - RNA, 64 nt, Human
ccugaauguuugugugugaacccuuguuuccuccaaaacaaacgacagcaacgaaaacuccuua

SEQ ID NO: 479004 - RNA, 64 nt, Human
uauuuaaugugguuauggaaccagcuggaaacacaaaacaaacagugauuguacagcaggcugg

SEQ ID NO: 479005 - RNA, 64 nt, Human
acuccagccugggugacgagcaaaacuccaucucaaaacaaaaguuccacaaccagccuggagu

SEQ ID NO: 479006 - RNA, 64 nt, Human
gccugggcaacguggcgaaauccccgucuuuacaaaaacaaacaaacaaacaaaaaagauauug

SEQ ID NO: 479007 - RNA, 64 nt, Human
gauauuuaggugacuuacagcaaccaauugcaacaaaacaaaauguuaagaaaugaucuuuuua

SEQ ID NO: 479008 - RNA, 64 nt, Human
caguuuuagaaucuacugcugcuaaagcacauuaaaaacaaauccugguuuuuaauguaugcau

SEQ ID NO: 479009 - RNA, 64 nt, Human
uuaucuacauuuugaaggguuuaugugcaaagugaaaacaaauuuugaaaaauaagacaaaucc

SEQ ID NO: 479010 - RNA, 64 nt, Human
gcgacaaaucaagaccccgucuccaaaaaaaaaaaaaacaaaacuugauugggauccaaaauca

SEQ ID NO: 479011 - RNA, 64 nt, Human
guauacaacaaugcauuuuaagagcaaaugcaacaaaacaaaucuggacuauggauaaauaauu

SEQ ID NO: 479012 - RNA, 64 nt, Human
gcauuucggcauuugugccauacugaaagaaucaaaaacaaaucauccaaauuaaauuucaaac

SEQ ID NO: 479013 - RNA, 64 nt, Human
uaccaaaucuucuccuaugcauuuuuaauaugacaaaacaaauuuuaaaagauuugaaauaauu

SEQ ID NO: 479014 - RNA, 64 nt, Human
gcauuccaaaauucagcuaaaggaaaaaugaucaaaaacaaaguaaggugcacaguuagcaaaa

SEQ ID NO: 479015 - RNA, 64 nt, Human
gucaagcuaaaguauugcuuauucaugagcaguuaaaacaaaucacaaaaggaaaacuaauguu

SEQ ID NO: 479016 - RNA, 64 nt, Human
aacagauuauauuaaaauuuaaagacaaaaagucaaaacaaaaauauuuucuaacuuguaaguu

SEQ ID NO: 479017 - RNA, 64 nt, Human
cacgcacaagcgccagugcgcacguguacacagaaaaacaaaaggacaagcuuucugugaaaca

SEQ ID NO: 479018 - RNA, 64 nt, Human
ucaggaaugucuuuuuuaauuagaagacaggaagaaaacaaaaaccagacugugucccacaauc

SEQ ID NO: 479019 - RNA, 64 nt, Human
aagguucuuguacccagagugauucuacaugggaaaaacaaaccagcuuuuuucagagagugac

SEQ ID NO: 479020 - RNA, 64 nt, Human
uggguauuuuagacccaacacagguucuaaauuuaaaacaaauaauaauuggaacaaauaaagg

SEQ ID NO: 479021 - RNA, 64 nt, Human
caaaaauuaucuauagcuaaguacacaauaagcaaaaacaaaaagaaaagaaaauuuuuguagu

SEQ ID NO: 479022 - RNA, 64 nt, Human
aauaggacaagacaaauuacagauugucucagagaaaacaaaugaguuacucucucggacaagc

SEQ ID NO: 479023 - RNA, 64 nt, Human
uccuuggaucccacccauucuuucacuuuaagaaaaaacaaauaauuguugcagaggucucugu

SEQ ID NO: 479024 - RNA, 64 nt, Human
ggaacuugcucucauuuuccugggugcaucaaacaaaacaaaaaccaaacacccagaggucuca

SEQ ID NO: 479025 - RNA, 64 nt, Human
caaguucuucccaucucaaaaaaaaauuaaaaaaaaaacaaaaaacaaaaaacaacucuacuug

SEQ ID NO: 479026 - RNA, 64 nt, Human
uuuucaggguauccuuaaaaaaaaacacacacgaaaaacaaaaguuugcuuguuuaaaaugaca

SEQ ID NO: 479027 - RNA, 64 nt, Human
uuuuuuaaagcugaguaguuaagaauucccuguaaaaacaaaacccuguaaauugagccucaug

SEQ ID NO: 479028 - RNA, 64 nt, Human
ugacgcuucuuccuauauccacucuuauuauguuaaaacaaauguauuugcgaguauuggcauu

SEQ ID NO: 479029 - RNA, 64 nt, Human
cuggccaacauggugaaaccccaucucuacuaaaaaaacaaaacuagcugggggugguggugca

SEQ ID NO: 479030 - RNA, 58 nt, Human
uuauuauuuuuuuuaauuagauacuccuaaaacaaaguuuaaaggauuacuaucugug

SEQ ID NO: 479031 - RNA, 64 nt, Human
cugaguagcauagcaagacccugucucuacaaaaaaaacaaaaauuagcugggcaugguggcau

SEQ ID NO: 479032 - RNA, 64 nt, Human
augaaggguaugaccuuaaugauguacauaaaauaaaacaaaugaagaaauggaaaacuuuuag

SEQ ID NO: 479033 - RNA, 64 nt, Human
uuguguuggaguuuaccauguuacccuguaauuaaaaacaaagaauagguaacauauugugcca

SEQ ID NO: 479034 - RNA, 64 nt, Human
ccaaagagauggcaauaugcugggcaucuacuuuaaaacaaaguugucugauuuuugcaagaga

SEQ ID NO: 479035 - RNA, 64 nt, Human
agagagagaggaccugucuguugaaaaaaacacaaaaacaaaugaaugcauguggccagugcca

SEQ ID NO: 479036 - RNA, 64 nt, Human
cacugcuuuuuauaggguggggcaaaauuagcaaaaaacaaaaaccaaugacaaccaaacugaa

SEQ ID NO: 479037 - RNA, 64 nt, Human
aaaucuguaauaggaauugauucauucucuaaugaaaacaaaacauaaaaacaucacacuaauc

SEQ ID NO: 479038 - RNA, 64 nt, Human
uuucccuaaguuugaguugauaguuauuaaaaagaaaacaaaacaaaaaaaaaaggcaaggcac

SEQ ID NO: 479039 - RNA, 64 nt, Human
cuaaguuugaguugauaguuauuaaaaagaaaacaaaacaaaaaaaaaaggcaaggcacaacaa

SEQ ID NO: 479040 - RNA, 64 nt, Human
uuuuuucccagcugacaugauuucucaguguuagaaaacaaacccuuagaacuuuccuuucugc

SEQ ID NO: 479041 - RNA, 64 nt, Human
uucuugaaaagccuuucuguugcaacuaugaaugaaaacaaaacaccacaaaacagacuucacu

SEQ ID NO: 479042 - RNA, 64 nt, Human
uuccauugucucguggucuuguaaugcacugguaaaaacaaaauaaauagaugaauaaauaaag

SEQ ID NO: 479043 - RNA, 64 nt, Human
uguguaucagagcgggagugcgggggagggaaagaaaacaaacaguuucagaauugaauaggca

SEQ ID NO: 479044 - RNA, 64 nt, Human
acagcgagacccuaguuaagagaaaaaaaaaguaaaaacaaauugugggucaaaguaaauguau

SEQ ID NO: 479045 - RNA, 64 nt, Human
auuugcacugcugaagagucacuaugagcaaaauaaaacaaauaagacucaaacugcucaaagu

SEQ ID NO: 479046 - RNA, 64 nt, Human
uugaguagaggaaaagggaaagaagggaaagcagaaaacaaauuuuuagcaucugcugugcuuu

SEQ ID NO: 479047 - RNA, 64 nt, Human
caugugacuaguuacaaaagcaauaaauugaaacaaaacaaaacaaaacaaaacuuguuucuua

SEQ ID NO: 479048 - RNA, 64 nt, Human
gacuaguuacaaaagcaauaaauugaaacaaaacaaaacaaaacaaaacuuguuucuuaaaaau

SEQ ID NO: 479049 - RNA, 64 nt, Human
guuacaaaagcaauaaauugaaacaaaacaaaacaaaacaaaacuuguuucuuaaaaaugcggu

SEQ ID NO: 479050 - RNA, 64 nt, Human
uaaaagauucaccggauggauucugaugaaaacgaaaacaaaguaaaaugacuggcuuagcaga

SEQ ID NO: 479051 - RNA, 64 nt, Human
cucucugauaucacuuaaagcuggaguuuauuuuaaaacaaaugaagcaugggccaccucauga

SEQ ID NO: 479052 - RNA, 64 nt, Human
gcucagcacugcccccuucucugauugcuuaugaaaaacaaaaugauguacauuacugugaauu

SEQ ID NO: 479053 - RNA, 64 nt, Human
aauacuuucuuuacuucacaaaacuucaaccauaaaaacaaagggcucugauugcuuuagggga

SEQ ID NO: 479054 - RNA, 64 nt, Human
ugaacucccccaaacauggcuguggagagacaacaaaacaaaacaaagcacaaaagucucugcc

SEQ ID NO: 479055 - RNA, 64 nt, Human
ucccccaaacauggcuguggagagacaacaaaacaaaacaaagcacaaaagucucugccaacaa

SEQ ID NO: 479056 - RNA, 64 nt, Human
gcuuacauuuccauuccauuauuacaagugaugaaaaacaaaaaauugcaaguaguaugcaaau

SEQ ID NO: 479057 - RNA, 64 nt, Human
guacagaguuuuauauaaauuuaaaccaauuuuuaaaacaaaacugcggacaccaccauaaaaa

SEQ ID NO: 479058 - RNA, 64 nt, Human
aaggauaugaugagauuuugcucacagucaugugaaaacaaaaucucagcucuuuauccauugc

SEQ ID NO: 479059 - RNA, 64 nt, Human
ucuuuauccauugcuuucacuuaguuuuaguaccaaaacaaagagaaugcaaaguuaagcagac

SEQ ID NO: 479060 - RNA, 64 nt, Human
ucaauuacuaaugcuaagauguguuggacucugaaaaacaaaauucuguggcuacacuguacug

SEQ ID NO: 479061 - RNA, 64 nt, Human
aaguaccuugaacucuuagugauugagacucaaaaaaacaaaaaagacuugagacaauguuuuc

SEQ ID NO: 479062 - RNA, 64 nt, Human
ugugauaaaaauauaaagacagaagacaugaggaaaaacaaaagguuugaggaaaucaggcaua

SEQ ID NO: 479063 - RNA, 64 nt, Human
uaaaauuguccuuucauucuuuugaagauauuacaaaacaaaaauaguuuuuuuuaaauuguuu

SEQ ID NO: 479064 - RNA, 64 nt, Human
uggagcuuaauggagaaauugcaacuuucauuaaaaaacaaauucagaugaaauaucaguaacu

SEQ ID NO: 479065 - RNA, 64 nt, Human
ugaagaacaacuuuaucaaggaagcuaguauuuaaaaacaaauucaugagcaagcugcaaauga

SEQ ID NO: 479066 - RNA, 64 nt, Human
gaaagaucuauguuuauaaaccagcacuuggccaaaaacaaaauuguaaaggaaauuuaaauuc

SEQ ID NO: 479067 - RNA, 64 nt, Human
uguggaauucuuacuucauuaugaauguauuuaaaaaacaaacaccaaauaauuggaauauauu

SEQ ID NO: 479068 - RNA, 64 nt, Human
uaauuggaauauauugcaggcauuaagcucauuaaaaacaaacuggcuugcagaaggguccgau

SEQ ID NO: 479069 - RNA, 64 nt, Human
ggggagcugagaaaucagacucaaaguuccaccaaaaacaaauacaaggggacuucaaaaguuc

SEQ ID NO: 479070 - RNA, 64 nt, Human
cacauucguuucccagugaaaagcaaaccagaacaaaacaaaaagccaccgcaauaauucggua

SEQ ID NO: 479071 - RNA, 64 nt, Human
aauuauucuuccuaucugauuauuuguauugaagaaaacaaauuuaccaaaagcaaaagcauaa

SEQ ID NO: 479072 - RNA, 64 nt, Human
gggauuggugcugauugaaagaacaaaacaaaacaaaacaaacacaaacaaacaaaaaaccuuc

SEQ ID NO: 479073 - RNA, 64 nt, Human
uuuaugggauuggugcugauugaaagaacaaaacaaaacaaaacaaacacaaacaaacaaaaaa

SEQ ID NO: 479074 - RNA, 64 nt, Human
gaucauuuaugggauuggugcugauugaaagaacaaaacaaaacaaaacaaacacaaacaaaca

SEQ ID NO: 479075 - RNA, 64 nt, Human
uguauacaaagauauucucuauguuuuguaaguaaaaacaaaaagaaaaccuuucuuuuguuuu

SEQ ID NO: 479076 - RNA, 64 nt, Human
aguguguguguauuuucucuggcuuuaaaauuuuaaaacaaacaaacaaaaaagccauagagag

SEQ ID NO: 479077 - RNA, 64 nt, Human
uaaauucaauacaugguuuuuaacaaaacagaacaaaacaaaacaauacagaaucucucccuga

SEQ ID NO: 479078 - RNA, 64 nt, Human
auguguaaauguagaacccuaauuuuucuauaaaaaaacaaacuaacuaacuaacuguguaaag

SEQ ID NO: 479079 - RNA, 64 nt, Human
gcccccugagaaaacacuugaauugacgcaauauaaaacaaaaugugaaaaccaaaguggauuu

SEQ ID NO: 479080 - RNA, 64 nt, Human
aaaggcaguaacuaaguuuauguuucagaacugcaaaacaaacaggauaguuaccaauauggcc

SEQ ID NO: 479081 - RNA, 64 nt, Human
uguuuuuucuuucccuuuuuuguuccuccaaacaaaaacaaaaugcaggccgagcgcgguggcu

SEQ ID NO: 479082 - RNA, 64 nt, Human
agacuuugagccugcaucuucuugcaucuaaugaaaaacaaaaagcuaacaucuuuacguacug

SEQ ID NO: 479083 - RNA, 64 nt, Human
aaguauaccuggcuuuuuaaaauauauguauuuaaaaacaaaaagcaacaguaaucuauguguu

SEQ ID NO: 479084 - RNA, 64 nt, Human
cuuugugcccaaguguuucccucucucccucaccaaaacaaaagggccaucucugcccugcacu

SEQ ID NO: 479085 - RNA, 64 nt, Human
cugguggcugggaggcaucaguugcuauauauuaaaaacaaaaaagaaaaaaaaggaaaauguu

SEQ ID NO: 479086 - RNA, 55 nt, Human
cccaaaggcuaacuagaugaaaaagaaaacaaaacugaguuuacuaggauaucug

SEQ ID NO: 479087 - RNA, 64 nt, Human
gucaguucauaguugaagauuuuguuuuauuucaaaaacaaaguacauuuuugaaauaauguuu

SEQ ID NO: 479088 - RNA, 64 nt, Human
ucaaaauuuccagauuacugguaaaaauuauuugaaaacaaacuuauggguaauaaaggcuagu

SEQ ID NO: 479089 - RNA, 64 nt, Human
uaaguugaguuuguagaggguaacaaaguaaaguaaaacaaaccuaucuugguuaacaugaaaa

SEQ ID NO: 479090 - RNA, 64 nt, Human
auauguuuuucuuucccuuaagaaucaaaagcagaaaacaaaaacaacaguccuacuccgaugu

SEQ ID NO: 479091 - RNA, 64 nt, Human
aaauauuugccaucuuuauuaugagccuuuaaggaaaacaaacccuaaacacaaagcaucagua

SEQ ID NO: 479092 - RNA, 64 nt, Human
uagagaguguugaaauucaauaccaaauacaguaaaaacaaauguaaauaaaagaaaacacauc

SEQ ID NO: 479093 - RNA, 64 nt, Human
aaaauaaaaaguauucccaagugauuuuaauuuaaaaacaaauuggcuuugucucauugaucag

SEQ ID NO: 479094 - RNA, 64 nt, Human
uaaauccagauacauauuaauguugauaugaguaaaaacaaauaggaagaaauugaaauuucuu

SEQ ID NO: 479095 - RNA, 64 nt, Human
augguaguaaagaaacugacaaacugaaaauaagaaaacaaaaaucaaaugccuauaauaccau

SEQ ID NO: 479096 - RNA, 64 nt, Human
agguagugguuauuaguauuacauccccauuuuaaaaacaaaaacauaauaaucguuacaacac

SEQ ID NO: 479097 - RNA, 64 nt, Human
aaggcuuucagguaugaauuaaaagcaaaaacaaaaaacaaaacaauucauuagccucagauuc

SEQ ID NO: 479098 - RNA, 60 nt, Human
uucaaggcuuucagguaugaauuaaaagcaaaaacaaaaaacaaaacaauucauuagccu

SEQ ID NO: 479099 - RNA, 64 nt, Human
uuuuuaugugcgaacauguaacaagaauccaaagaaaacaaaauggugguaucaugguaagcag

SEQ ID NO: 479100 - RNA, 64 nt, Human
uuuauaaauauauguaugauuuauaagcuuuuuuaaaacaaagcucaaauuguugguauuuuuc

SEQ ID NO: 479101 - RNA, 64 nt, Human
ugauguugaugggagucaggauguucacuauggaaaaacaaauauacaaauaugaaaugaggga

SEQ ID NO: 479102 - RNA, 64 nt, Human
auagcaccuggcccauuacauaucuaggcaacuaaaaacaaacauuguaagaaugaauauuuuu

SEQ ID NO: 479103 - RNA, 64 nt, Human
gauuggaacuucuuguuuaaaauuaagcuuuaguaaaacaaagugaugagguuaggaaggcaga

SEQ ID NO: 479104 - RNA, 64 nt, Human
accaacaauaagcuagaaaagacaaaaaaaacaaaaaacaaaaaaacguguaauaaaguuagug

SEQ ID NO: 479105 - RNA, 64 nt, Human
uuuuucuaccaacaauaagcuagaaaagacaaaaaaaacaaaaaacaaaaaaacguguaauaaa

SEQ ID NO: 479106 - RNA, 64 nt, Human
uuuuucuuuuuuucuuuuuuucuuuuuuugcuuuaaaacaaagggaaaaaagaguuuaaacaaa

SEQ ID NO: 479107 - RNA, 64 nt, Human
uaccuggggcuaguuuuuuaugcuuuguaccuagaaaacaaaaaauuacauucguugggcuuuu

SEQ ID NO: 479108 - RNA, 64 nt, Human
aauauacauacuccugugcuaacauguauacuagaaaacaaaaagauguuagaaaaauaaaagu

SEQ ID NO: 479109 - RNA, 64 nt, Human
aaaacaaaaaaacacaaaaaaauaguaaaauauaaaaacaaauuaauguuuuauagacccuggg

SEQ ID NO: 479110 - RNA, 64 nt, Human
acauaaugcuaguccuagauuacuuauugauuuaaaaacaaaaaaacacaaaaaaauaguaaaa

SEQ ID NO: 479111 - RNA, 64 nt, Human
uauucauuacuucauguauaucaagcacagcaguaaaacaaaaacccauguauuuaacuuuuuu

SEQ ID NO: 479112 - RNA, 64 nt, Human
uguagauuucugacaucaaaacuuggacccuuggaaaacaaaaguuuuaauuaaaaaaaauccu

SEQ ID NO: 479113 - RNA, 64 nt, Human
auucuguuauauaguggaugauauacacaguggcaaaacaaaaguacauugcuuaaaauauaua

SEQ ID NO: 479114 - RNA, 64 nt, Human
ugaaauuuaggcagaguucgauaaauuacuggcaaaaacaaaacucuuuuauaaagauuuucua

SEQ ID NO: 479115 - RNA, 57 nt, Human
ugauuacgcuacucaagugaaccuucaaaaacaaaagccaaauuuggcccacuaugg

SEQ ID NO: 479116 - RNA, 64 nt, Human
ggauaaagaauacuauuuccaaacucauauuacaaaaacaaaauaaaauaauaaaaaaagaaag

SEQ ID NO: 479117 - RNA, 64 nt, Human
uuaaaacuaugguguaagucuuugacaagaaaaaaaaacaaacaaacacuucuuuccaucagua

SEQ ID NO: 479118 - RNA, 64 nt, Human
accuaauuugucuugauccauuccacucuauaauaaaacaaaagauuuuguaggcaacucggaa

SEQ ID NO: 479119 - RNA, 64 nt, Human
uuucacuauguauaaauuuuacuucaaaauaauaaaaacaaauacugacucuaguuaauggugu

SEQ ID NO: 479120 - RNA, 64 nt, Human
uaaacugguuuuuuucaaaaaaaaaaaaaaaacaaaaacaaaaaaaaaacacaaaagcugcaug

SEQ ID NO: 479121 - RNA, 64 nt, Human
ucaaaauaaacugguuuuuuucaaaaaaaaaaaaaaaacaaaaacaaaaaaaaaacacaaaagc

SEQ ID NO: 479122 - RNA, 64 nt, Human
uacacuuugcuaaaucauguauuuauuccugauuaaaacaaaccuaauaaauauuuaacccuug

SEQ ID NO: 479123 - RNA, 64 nt, Human
uauauauuuuuuagaguuccguuuuuauuuauuaaaaacaaaagccccagcccugccgaggccu

SEQ ID NO: 479124 - RNA, 64 nt, Human
acaaaaauuaaaauuggaacgaaguaagauaauuaaaacaaaaaacuuauagauguuaggaaac

SEQ ID NO: 479125 - RNA, 64 nt, Human
cuucauagauuugcaucauucaagcauaucuuguaaaacaaacacauauuaugggacuaggaaa

SEQ ID NO: 479126 - RNA, 64 nt, Human
acuggguagcaaaagaaaauggaaaaaaacccacaaaacaaacuuuaaaaaaaaaaaaaaacaa

SEQ ID NO: 479127 - RNA, 64 nt, Human
aaaaaacccacaaaacaaacuuuaaaaaaaaaaaaaaacaaauuugccaagguuuagcugcuca

SEQ ID NO: 479128 - RNA, 64 nt, Human
cuggaaaggaacucuccaccccucccauccugauaaaacaaacaagguuuacauuuacaacuaa

SEQ ID NO: 479129 - RNA, 64 nt, Human
cugggugcccaguacccuugggugcagaucuuugaaaacaaaggugccaugaugggcuguucua

SEQ ID NO: 479130 - RNA, 64 nt, Human
cuuccuuuggacaaaacaucacuagcugacuauaaaaacaaaagugucaucauugaagcccuga

SEQ ID NO: 479131 - RNA, 64 nt, Human
uagacgaaaaccauaccucucuucaaucaaaaugaaaacaaagcaaaugaauacuggacagucu

SEQ ID NO: 479132 - RNA, 64 nt, Human
aaugauuucaaguacccuguauucuggaugcuaaaaaacaaaaacaaacaaaaaaacaaaaaca

SEQ ID NO: 479133 - RNA, 64 nt, Human
uucaaguacccuguauucuggaugcuaaaaaacaaaaacaaacaaaaaaacaaaaacaaaaaaa

SEQ ID NO: 479134 - RNA, 64 nt, Human
guauucuggaugcuaaaaaacaaaaacaaacaaaaaaacaaaaacaaaaaaacaaaaccagaau

SEQ ID NO: 479135 - RNA, 64 nt, Human
uggaugcuaaaaaacaaaaacaaacaaaaaaacaaaaacaaaaaaacaaaaccagaaucaggua

SEQ ID NO: 479136 - RNA, 64 nt, Human
aaaaaacaaaaacaaacaaaaaaacaaaaacaaaaaaacaaaaccagaaucagguaaaacagcu

SEQ ID NO: 479137 - RNA, 64 nt, Human
auguuaaggauugucuuaaaguuccuuagccagcaaaacaaaacaaaacaaaacaaacaaauga

SEQ ID NO: 479138 - RNA, 64 nt, Human
aaggauugucuuaaaguuccuuagccagcaaaacaaaacaaaacaaaacaaacaaaugaaaaac

SEQ ID NO: 479139 - RNA, 64 nt, Human
uugucuuaaaguuccuuagccagcaaaacaaaacaaaacaaaacaaacaaaugaaaaacguuua

SEQ ID NO: 479140 - RNA, 64 nt, Human
uuaaaguuccuuagccagcaaaacaaaacaaaacaaaacaaacaaaugaaaaacguuuaaaaag

SEQ ID NO: 479141 - RNA, 64 nt, Human
ucugaggcuaagaaagguucaucucacaacaggaaaaacaaaucucaacacacauuagagauaa

SEQ ID NO: 479142 - RNA, 64 nt, Human
uaguuuuaaccaguuguagucaaaaugcuacaauaaaacaaaaaagagaaagaaaaugaagagc

SEQ ID NO: 479143 - RNA, 64 nt, Human
aaaagccuuuaguuguguuucuugaacuauaaagaaaacaaauuuuggcagucuuuaaguauau

SEQ ID NO: 479144 - RNA, 64 nt, Human
uuucuuccauucuuaacaguaugugcccauuugcaaaacaaaaaugcuaauaaucaguaauagu

SEQ ID NO: 479145 - RNA, 64 nt, Human
ugaacgcaucccaacauagguuaagagcaaguugaaaacaaaggccauggcauucugccacugc

SEQ ID NO: 479146 - RNA, 64 nt, Human
auccuuguuuuugucgugucuauaaaggaagaacaaaacaaaauaaaaacagagcccuagagaa

SEQ ID NO: 479147 - RNA, 64 nt, Human
acugcccacugauaggauguuuuguuuccuugauaaaacaaauguaaaugaggaauuuuauuug

SEQ ID NO: 479148 - RNA, 64 nt, Human
aaugucugagggaaugggcugguagacuuuuucgaaaacaaauuagagaaaguaacuuacaacc

SEQ ID NO: 479149 - RNA, 64 nt, Human
uuucaagaccuaacugcagccgcuuugggaaaaaaaaacaaaaaacaaaaaacagaaaacaaaa

SEQ ID NO: 479150 - RNA, 64 nt, Human
accuaacugcagccgcuuugggaaaaaaaaacaaaaaacaaaaaacagaaaacaaaaaaaaaaa

SEQ ID NO: 479151 - RNA, 64 nt, Human
auucuacaugaggaggcugagaaaggggaagagaaaaacaaaccaaauggaugauguuagcuuu

SEQ ID NO: 479152 - RNA, 64 nt, Human
uguauuccauuuaaaaauauguuuaaauuguccuaaaacaaaauaauuuucucccuaggaguau

SEQ ID NO: 479153 - RNA, 64 nt, Human
uagaugaaaagaugguuguaagcuuugggaauuaaaaacaaacaaauacauuuuaguaaauaua

SEQ ID NO: 479154 - RNA, 64 nt, Human
guggagagguggacacauuuucauguucauuacuaaaacaaacagcaaaacuauugguuuguua

SEQ ID NO: 479155 - RNA, 64 nt, Human
ucucuguauauuuaugaccagagcaaaaauguaaaaaacaaaaaaaacaacaaaaaaaguuugu

SEQ ID NO: 479156 - RNA, 64 nt, Human
agggaccacauuuuucaaguauuucuaaguauaaaaaacaaaacaaaaaucucuuaggaaaugu

SEQ ID NO: 479157 - RNA, 64 nt, Human
ccacauuuuucaaguauuucuaaguauaaaaaacaaaacaaaaaucucuuaggaaaugucuaga

SEQ ID NO: 479158 - RNA, 64 nt, Human
uccuugacaaaauuuaagcugagcuuaaaagcaaaaaacaaaaaguacacagaaauauuuauua

SEQ ID NO: 479159 - RNA, 64 nt, Human
caucauuuuuacauaucaagugguuucauguuaaaaaacaaacuccuaguccuuuagaaauaac

SEQ ID NO: 479160 - RNA, 62 nt, Human
aaucuuguugaguuuaaaaaauaaacagcaaaaaaaaacaaaacaaaacaaaaaaaaacacc

SEQ ID NO: 479161 - RNA, 64 nt, Human
gcaacaguaugcggaaaguacguuuuuuaaguaaaaaacaaaggcaaacuuuguacuauccagu

SEQ ID NO: 479162 - RNA, 64 nt, Human
accauuacugaacauuaggacaaacacaaaauaaaaaacaaaacacagacaacggugcugauuc

SEQ ID NO: 479163 - RNA, 64 nt, Human
uacuuagugggacuauuacacacaaaacaaauuaaaaacaaauuauuccagguggaccaagaau

SEQ ID NO: 479164 - RNA, 64 nt, Human
uagcuaacaacuacuuagugggacuauuacacacaaaacaaauuaaaaacaaauuauuccaggu

SEQ ID NO: 479165 - RNA, 64 nt, Human
uuuauucacaggaucugugaauauugcuccauagaaaacaaauuguuaugauugaguggguaua

SEQ ID NO: 479166 - RNA, 64 nt, Human
uccuucuugcuuauacguuaaguuacauaaaaggaaaacaaaauuauguggugugaaacagcca

SEQ ID NO: 479167 - RNA, 64 nt, Human
aaauccccgggaagaguuagccuggauagccuugaaaacaaacaaaucaaacacaacacaagaa

SEQ ID NO: 479168 - RNA, 64 nt, Human
uuccuuuauauacuuguuuaucuggacugccaguaaaacaaauguguauucaacaaaagaaaaa

SEQ ID NO: 479169 - RNA, 64 nt, Human
gacucuggacaggggguuucuguugcaaaaauacaaaacaaaagcgauaaaauaaaagcgauuu

SEQ ID NO: 479170 - RNA, 64 nt, Human
ucuacuccagcaugaucugucaucuaaagacuugaaaacaaaaaacaguuacuuauagucaaug

SEQ ID NO: 479171 - RNA, 64 nt, Human
uugcaaucgaaaugaaagaagaguugauguuaaaaaaacaaaagucaagugauuuauuauauac

SEQ ID NO: 479172 - RNA, 64 nt, Human
auauuucagguuucuguaaaagaaagggaaaccuaaaacaaauacccuuccauauauaauauau

SEQ ID NO: 479173 - RNA, 64 nt, Human
ccucaauuaucaguggcuuuaugaaguaaaguuaaaaacaaacauaggaaaugugaaaauauuu

SEQ ID NO: 479174 - RNA, 64 nt, Human
cauuuuucuuugguucuuuuuuccuuuuuuaggaaaaacaaaacaacagacuucauccuuaggu

SEQ ID NO: 479175 - RNA, 64 nt, Human
uucugucucucucucuuuuucuuuucuauggagcaaaacaaagcugauuucccuuuuuucuucc

SEQ ID NO: 479176 - RNA, 64 nt, Human
uauaguguaguaaagaaguaucauucaggggugaaaaacaaagagccguuuuaaugauguugag

SEQ ID NO: 479177 - RNA, 64 nt, Human
cagaucugugccuacuuuauuacuggaguaaaagaaaacaaaguucauugaugucgaaggauau

SEQ ID NO: 479178 - RNA, 64 nt, Human
ccaagaaaagcaagaagcagauuagguuuuugacaaaacaaacaggccaaaagggggcugaccu

SEQ ID NO: 479179 - RNA, 64 nt, Human
agccuggggacagagcaagacucuugucucaaaaaaaacaaaaaaaacauauauacugcuguau

SEQ ID NO: 479180 - RNA, 64 nt, Human
caaggacaaccacuauuucuauauuuuuuaccagaaaacaaaacucuccaucgcugaaagagau

SEQ ID NO: 479181 - RNA, 64 nt, Human
aauaccuguagaaauauuauuccagcauagcaggaaaacaaacaaaaguauuggacugucggag

SEQ ID NO: 479182 - RNA, 64 nt, Human
auaucaaacuugcaaaaaaaaaaaaaaaaaaaaaaaaacaaaaaaacuagacaaggagagaggc

SEQ ID NO: 479183 - RNA, 64 nt, Human
aagcuaaccaaacuggacauggugaauaaaucauaaaacaaaucauuuuacuuauuauuuacau

SEQ ID NO: 479184 - RNA, 64 nt, Human
agguggaggagaaaggggaaucucccaaaauuuaaaaacaaauuggaagaauaaccaggacagc

SEQ ID NO: 479185 - RNA, 64 nt, Human
acagacuuucugaccugagaacuggagaauuuuuaaaacaaaaucucucauuccagcccaaccu

SEQ ID NO: 479186 - RNA, 64 nt, Human
gauacuauucaaugcaaugcaauucaaugcaaugaaaacaaaauuccauuacaggggcagugcc

SEQ ID NO: 479187 - RNA, 64 nt, Human
ugugacagaaugagaccuugucuugaaaaaaaaaaaaacaaaaaaccacauacaggaaaaaaga

SEQ ID NO: 479188 - RNA, 64 nt, Human
uuauacaaagagaauuggggagacagcuaagaagaaaacaaagaaauaaagcaguuacaaauug

SEQ ID NO: 479189 - RNA, 64 nt, Human
uguacacacacaacagaacaaaaugaagcaaaacaaaacaaaaaaacccacaaaaauuuguaaa

SEQ ID NO: 479190 - RNA, 64 nt, Human
guuguuguacacacacaacagaacaaaaugaagcaaaacaaaacaaaaaaacccacaaaaauuu

SEQ ID NO: 479191 - RNA, 64 nt, Human
ugaccugcugguguguguguauauuuacaaaaacaaaacaaacaaaccacccauugggauauaa

SEQ ID NO: 479192 - RNA, 64 nt, Human
gaccaugaccugcugguguguguguauauuuacaaaaacaaaacaaacaaaccacccauuggga

SEQ ID NO: 479193 - RNA, 64 nt, Human
gcuaguguuugccgaaugaaacucaacucaauaaaaaacaaaaaccaaauugggcagcugaggu

SEQ ID NO: 479194 - RNA, 64 nt, Human
uuuucuaaugucuuccauuccuaccccccacccaaaaacaaaagaaauauuuguagcuugcuau

SEQ ID NO: 479195 - RNA, 64 nt, Human
aagugugaaguuuuguguguaugauuucugugcaaaaacaaaagcaacacuccugaguccuugc

SEQ ID NO: 479196 - RNA, 64 nt, Human
ggauuggaagaaacacguggucaugaauagaaaaaaaacaaacccaaagguaggaaggucaagg

SEQ ID NO: 479197 - RNA, 64 nt, Human
ccuaacaugagugcuuguaacaaaauaaacaacaaaaacaaagccaaaaacuaccuuuauccau

SEQ ID NO: 479198 - RNA, 64 nt, Human
uuucaaacuuuacauugaaacauaauuuccuuggaaaacaaaccauaagccugaggagguuuuu

SEQ ID NO: 479199 - RNA, 64 nt, Human
uguggcuuaaaaauuuaucaggaccacaaaaaagaaaacaaaaauauuugguacugagguucau

SEQ ID NO: 479200 - RNA, 64 nt, Human
uguguuuuguauaaaucccuaauauuuaaaaaaaaaaacaaaacaaaaaaagguuacaaaguuu

SEQ ID NO: 479201 - RNA, 64 nt, Human
uuuguauaaaucccuaauauuuaaaaaaaaaaacaaaacaaaaaaagguuacaaaguuuguuaa

SEQ ID NO: 479202 - RNA, 64 nt, Human
ugggauggaaaggacuagccucuacugaugcaaaaaaacaaaaagcaacacaaacguuuccuuc

SEQ ID NO: 479203 - RNA, 64 nt, Human
uguauuguccauugauuccugauugacgccgucaaaaacaaaugcuuguuaagcccauaagcuu

SEQ ID NO: 479204 - RNA, 64 nt, Human
uuaagguaauuauacuauccuuuuaaacuucaagaaaacaaaguuguuagcguauuuacaugaa

SEQ ID NO: 479205 - RNA, 64 nt, Human
uuuuuugaagucuuguauaacuaacagcauccccaaaacaaagucuuuggggucuacacugcaa

SEQ ID NO: 479206 - RNA, 63 nt, Human
agaugugaauuguaucuguuguaauaaacauguuaaaacaaacaaaaauuguuauuuuucuuu

SEQ ID NO: 479207 - RNA, 64 nt, Human
uuuugccauuuagcgaacaaccacaggaauuuuaaaaacaaaaacaucccaagauuuuuucauu

SEQ ID NO: 479208 - RNA, 64 nt, Human
gacugcaucucaaaaaauaauaaugaaacuuuccaaaacaaagugccaggaccagcuggguuca

SEQ ID NO: 479209 - RNA, 64 nt, Human
ugcacuccagccugagugacagagagagauucaaaaaacaaaaaaaaagcaaaaauauacuuug

SEQ ID NO: 479210 - RNA, 64 nt, Human
auuacuuuagcaauucaacuugaugugagaagaaaaaacaaauguuucaacacaaaaucucugu

SEQ ID NO: 479211 - RNA, 64 nt, Human
uuuucugcacugguuuaaucaugcuuaauacuacaaaacaaaaauaaauauuucacagugguug

SEQ ID NO: 479212 - RNA, 64 nt, Human; identical to SEQ ID NO: 479211

SEQ ID NO: 479213 - RNA, 64 nt, Human
uuuacccauuuuaaauguguuucugaagcaagacaaaacaaacuuccaaaaauacccuuaagac

SEQ ID NO: 479214 - RNA, 64 nt, Human
uaaacuuuuuucuuacugucuuuuuucuaaaguaaaaacaaagaaauuaugugccagauuuaug

SEQ ID NO: 479215 - RNA, 64 nt, Human
uuuuccacugaagcaugcacaugccacugucaccaaaacaaacaacuaccacuuuccaaauuuc

SEQ ID NO: 479216 - RNA, 64 nt, Human
gcaaauacuuggugagugauuuaaaaauaaaaccaaaacaaaacacaaaaagauauuccacagg

SEQ ID NO: 479217 - RNA, 64 nt, Human
uuaugaagaaaggaaccaaauuauuaugcuuuuuaaaacaaauuaccaguuuacauaauuaauc

SEQ ID NO: 479218 - RNA, 64 nt, Human
caaaaugaggaagauguguucauuguggacucuaaaaacaaaacaaaacacaaaauccccuguu

SEQ ID NO: 479219 - RNA, 64 nt, Human
ugaggaagauguguucauuguggacucuaaaaacaaaacaaaacacaaaauccccuguucaaau

SEQ ID NO: 479220 - RNA, 64 nt, Human
gcaaugucuauauuggcucauaaaacuaaccugaaaaacaaauaaaugcuuuggaaauguuuca

SEQ ID NO: 479221 - RNA, 64 nt, Human
auuagaaaaaaaaaauucuuguugaaauauuuugaaaacaaauucccuacuaucaucacaugcc

SEQ ID NO: 479222 - RNA, 64 nt, Human
uucuuccuauuacuuuauugacucauuuuauugcaaaacaaaaaggauuacccaaacaacaugu

SEQ ID NO: 479223 - RNA, 64 nt, Human
cuaauccaaguaaaggaauaugaagggauuguaaaaaacaaaauguccauugauagaccaucgu

SEQ ID NO: 479224 - RNA, 64 nt, Human
uugugaauuauaaugauaugccccuuuucuuauaaaaacaaaaaaaaaaauaaugaaacacagu

SEQ ID NO: 479225 - RNA, 64 nt, Human
cagcagcaggcuuuuuucccccaagaagaugaucaaaacaaaggaugaucucaacaagagcugu

SEQ ID NO: 479226 - RNA, 64 nt, Human
augacaaagaccgagucuucuuuuuuuuuaaacaaaaacaaaaaaagcaaccagggcuauuugu

SEQ ID NO: 479227 - RNA, 64 nt, Human
ucuuggaauguguauuguuuuuauuuugcgaaacaaaacaaaacaaaaaaaaaagcuuggaacu

SEQ ID NO: 479228 - RNA, 64 nt, Human
gaauguguauuguuuuuauuuugcgaaacaaaacaaaacaaaaaaaaaagcuuggaacuccauc

SEQ ID NO: 479229 - RNA, 64 nt, Human
uucugccuccaaggauguuuaaaaucuaguugggaaaacaaacuucaucaagaguaaaugcagu

SEQ ID NO: 479230 - RNA, 64 nt, Human
aaaauagugagucucaaauuguucucuuuuaacuaaaacaaaucugcaaugaaucuagaugcaa

SEQ ID NO: 479231 - RNA, 64 nt, Human
aacuuggcuacguauuggaaucaccuaaaaaguuaaaacaaaacauggaugucugggucccgcc

SEQ ID NO: 479232 - RNA, 64 nt, Human
uccagccugggcaacagagcaagacucggucucaaaaacaaaauuuaaaaaagauauaaggcag

SEQ ID NO: 479233 - RNA, 64 nt, Human
aaacaagccaaaccaaaugaacucuggaaaaccuaaaacaaauguacauuuuccuuuguguaug

SEQ ID NO: 479234 - RNA, 64 nt, Human
aucuacugcugaguugucaguauguuaucacuagaaaacaaagaaaaaugauuaauaaaugaca

SEQ ID NO: 479235 - RNA, 64 nt, Human
uucauugugaucagauuaaaauuacuauuugugcaaaacaaauuccacaccacauguacuguau

SEQ ID NO: 479236 - RNA, 64 nt, Human
gaaagguggucaggcccuucuaaaugcuuaaccaaaaacaaacauuauuggaguuucaguguaa

SEQ ID NO: 479237 - RNA, 64 nt, Human
ucuauuauuuguuuugguuagaaagugaauuuaaaaaacaaaccaaacucuaaacuuucucaga

SEQ ID NO: 479238 - RNA, 64 nt, Human
ucuauugcaauucccuauuauauucugcaucagaaaaacaaacaaaacaaaaacaacuuuaaau

SEQ ID NO: 479239 - RNA, 64 nt, Human
auucccuauuauauucugcaucagaaaaacaaacaaaacaaaaacaacuuuaaaugcuuguagc

SEQ ID NO: 479240 - RNA, 64 nt, Human
uggaacuucaggucuuaagugcaaaucaaagcaaaaaacaaacaaaacuuacauggaaaaacug

SEQ ID NO: 479241 - RNA, 64 nt, Human
aagguucucaaaggucucagaccuacaaagaguuaaaacaaacagacaaacaaaaaaaaacacu

SEQ ID NO: 479242 - RNA, 64 nt, Human
gccuagggcagacaauaguauagaagucuggaaaaaaacaaaaacagaauuugagaaccuugga

SEQ ID NO: 479243 - RNA, 64 nt, Human
cugccuuuucuuuguuuguuuguuuuuuucucuaaaaacaaacagcaaaagacagcugaaaaca

SEQ ID NO: 479244 - RNA, 64 nt, Human
gauaggaaaaucugaauggaggcagcaaacagccaaaacaaacauuccccacccggcccugugc

SEQ ID NO: 479245 - RNA, 64 nt, Human
guuuuuuucuuuuuucuuuuuuuuugcaauaaagaaaacaaauuaaucauaaacaucuuugaau

SEQ ID NO: 479246 - RNA, 64 nt, Human
ucuuaaauuggguucaugaugcagucuccucuuuaaaacaaaacaaaacaaaacaaaacuauac

SEQ ID NO: 479247 - RNA, 64 nt, Human
aauuggguucaugaugcagucuccucuuuaaaacaaaacaaaacaaaacaaaacuauacuugaa

SEQ ID NO: 479248 - RNA, 64 nt, Human
gguucaugaugcagucuccucuuuaaaacaaaacaaaacaaaacaaaacuauacuugaacaaaa

SEQ ID NO: 479249 - RNA, 64 nt, Human
augaugcagucuccucuuuaaaacaaaacaaaacaaaacaaaacuauacuugaacaaaaggguc

SEQ ID NO: 479250 - RNA, 64 nt, Human
gacuguuuuuuucugccuaauaguaacugguuaaaaaacaaauguucauauuuauugauuaaaa

SEQ ID NO: 479251 - RNA, 64 nt, Human
agacagggagagguggagaaggaaaaaacccuacaaaacaaaaacaaaccgcauacacguucac

SEQ ID NO: 479252 - RNA, 64 nt, Human
ggagagguggagaaggaaaaaacccuacaaaacaaaaacaaaccgcauacacguucaccgagaa

SEQ ID NO: 479253 - RNA, 64 nt, Human
uuucccccccaucuuuaaaaauaauuaguaauaaaaaacaaaaauuccauaucuagccccaucc

SEQ ID NO: 479254 - RNA, 64 nt, Human
guauucuacuacuugugcaauauauauguuuuaaaaaacaaauuugagaauacauuuaaucaua

SEQ ID NO: 479255 - RNA, 64 nt, Human
uggccaacagaauccuucuugauaguuugcaggcaaaacaaauguaauguugcagauccgcagg

SEQ ID NO: 479256 - RNA, 64 nt, Human
ugaugagagcaccacucaucugcgaaacgcacguaaaacaaagugaaccgugacuguuaaacua

SEQ ID NO: 479257 - RNA, 64 nt, Human
uggaaacagcauuaagaauacugaaucaaauggaaaaacaaaugaauacaggaagauaaguguu

SEQ ID NO: 479258 - RNA, 64 nt, Human
ccauuuuuuaaagucccaccuuucaauguuuaauaaaacaaaaagagaaauccuuaaucuaaaa

SEQ ID NO: 479259 - RNA, 64 nt, Human
gacagagccaaacuccgucaaaaaaaaacaaaacaaaacaaaaaaaagacaugggagagauggu

SEQ ID NO: 479260 - RNA, 64 nt, Human
ggagugacagagccaaacuccgucaaaaaaaaacaaaacaaaacaaaaaaaagacaugggagag

SEQ ID NO: 479261 - RNA, 64 nt, Human
cagcuggagugacagagccaaacuccgucaaaaaaaaacaaaacaaaacaaaaaaaagacaugg

SEQ ID NO: 479262 - RNA, 64 nt, Human
agacucuacuguguuaggguauauucuuuuguauaaaacaaacagguuuuugaaaauauuacug

SEQ ID NO: 479263 - RNA, 64 nt, Human
ccauguuucaguuucugcauguagauuuaaauaaaaaacaaaacuuguaaaguuguaacauuuc

SEQ ID NO: 479264 - RNA, 64 nt, Human
agggaucuaggugagcccauuguaaguaucauugaaaacaaaacaugcccgucaacaugucaca

SEQ ID NO: 479265 - RNA, 64 nt, Human
caagcacuugcaaacucuuuaucccuauuucuuuaaaacaaaauaaggugaaauacgaaguccu

SEQ ID NO: 479266 - RNA, 64 nt, Human
gugggaaagcagaacugaaguuagcuuaagcauaaaaacaaagaaaaaucuucgcuuuucaugu

SEQ ID NO: 479267 - RNA, 64 nt, Human
uuuucuuugaagacuuucuaaauuaggaagcagaaaaacaaaucucuaggagauucugccaaag

SEQ ID NO: 479268 - RNA, 64 nt, Human
aaggaacaguuugauacacuuuuaaaagguucugaaaacaaagcuguauagggauccucucucu

SEQ ID NO: 479269 - RNA, 64 nt, Human
gcuuacacugguuuuuauccucuggacaacauaaaaaacaaaauaugggagucuuucaggcuuu

SEQ ID NO: 479270 - RNA, 64 nt, Human
cagucauuauuuaaaauauguaaacuuacaguuaaaaacaaagguaauaaauacucagcacuca

SEQ ID NO: 479271 - RNA, 64 nt, Human
aaaaacaguaguauuuauuacaaucuccacaaugaaaacaaauagugcaauguaagaaauauua

SEQ ID NO: 479272 - RNA, 64 nt, Human
ccaacuuuuuaccuuuugaaauauggcuacauuuaaaacaaaaucucacagcucgguuuuucuu

SEQ ID NO: 479273 - RNA, 64 nt, Human
aucuguuuuauuugacugcagucuccuuggugcaaaaacaaaaugggaaaaauaaggauaacuc

SEQ ID NO: 479274 - RNA, 64 nt, Human
gcccaucauucauacccacuguucugaaggcuugaaaacaaaacauauccacaacauuggcuug

SEQ ID NO: 479275 - RNA, 64 nt, Human
uauuguacaucucggucugaacuucauccuggcaaaaacaaaguugcaggcacaacaguuuaag

SEQ ID NO: 479276 - RNA, 64 nt, Human
uguauaugcaaaacugcuagcuugauuuuaaaaaaaaacaaaucuuuaaaaucugcugcaaauu

SEQ ID NO: 479277 - RNA, 64 nt, Human
caucuccagcaguggccugaagaggaagagaaaaaaaacaaaaaacagaaaccaaucgguaauc

SEQ ID NO: 479278 - RNA, 64 nt, Human
aagaacucuauuuggaucagaacuacauuauuacaaaacaaaaugaacacuugaccaaaaaacc

SEQ ID NO: 479279 - RNA, 64 nt, Human
ccaaugaugugguggcuagaaaugcaacuuguauaaaacaaaaaugggagagagagagguauua

SEQ ID NO: 479280 - RNA, 64 nt, Human
acuccagccuggggacggagcaaaacuuugccucaaaacaaauuuuaaaaagaaagaaagaagg

SEQ ID NO: 479281 - RNA, 64 nt, Human
cgcuuuccugggccucucaguugaacaaagcagcaaaacaaaggcaguuuuauaugaaagauua

SEQ ID NO: 479282 - RNA, 64 nt, Human
ucucaguaauuuuagaugucuuuuaaaaaauugaaaaacaaaguguuagacugugugcgugugc

SEQ ID NO: 479283 - RNA, 64 nt, Human
cuccagccugggcgacggagcgagacucugucucaaaacaaacaaacaaacaaaagacccaauc

SEQ ID NO: 479284 - RNA, 64 nt, Human
ggaaaaauuuuaaaacuugaggguaaaaauguggaaaacaaacccucccaucccuuguagauua

SEQ ID NO: 479285 - RNA, 64 nt, Human
guugccguuguaauaaugaauuguucuggacuagaaaacaaaaugaggcauuuuguuaaggggg

SEQ ID NO: 479286 - RNA, 64 nt, Human
gcuuuguuacugccaaacucacuccuuuuuagaaaaaacaaaaaaaaagggccagaaagucauu

SEQ ID NO: 479287 - RNA, 64 nt, Human
ggcgucuucaaaaacaaauugcacugauaaaacaaaaacaaaaguauguuuuaaaugcuuugaa

SEQ ID NO: 479288 - RNA, 64 nt, Human
uuuuccggcgucuucaaaaacaaauugcacugauaaaacaaaaacaaaaguauguuuuaaaugc

SEQ ID NO: 479289 - RNA, 64 nt, Human
ucagguuaaaugaaauaguuuuccggcgucuucaaaaacaaauugcacugauaaaacaaaaaca

SEQ ID NO: 479290 - RNA, 64 nt, Human
uggcucucaagcuauaguuuguuuucaaaaaggaaaaacaaaauaguuuuuuacuggauuaaaa

SEQ ID NO: 479291 - RNA, 64 nt, Human
uaugaauuauuuugucguccuacccuuuuccuccaaaacaaaaauuagaggauuauuuuaauac

SEQ ID NO: 479292 - RNA, 64 nt, Human
auuucuuuuucauagggguggaacuugcacagcaaaaacaaacaaacgcaagaagagauuuggg

SEQ ID NO: 479293 - RNA, 64 nt, Human
uugacuuuuucuucguugaggcuucugaggaggaaaaacaaaccuaaaauagaaauacagucag

SEQ ID NO: 479294 - RNA, 64 nt, Human
cagcuuaaugcagugugaacaauagaugguuaggaaaacaaaacugcuuagaagccccuuucuc

SEQ ID NO: 479295 - RNA, 64 nt, Human
acauugacaugcgaucaguuugggaaaugugaugaaaacaaagacuagauggguauguguguuu

SEQ ID NO: 479296 - RNA, 64 nt, Human
uuguaaacaagauucuaaauuuaaaaaggaaaacaaaacaaacuuguucuuugcagcuuaucac

SEQ ID NO: 479297 - RNA, 64 nt, Human
auguguuguaaacaagauucuaaauuuaaaaaggaaaacaaaacaaacuuguucuuugcagcuu

SEQ ID NO: 479298 - RNA, 64 nt, Human
gguuuuugcuguuuuuuuuuuuuuuuuuuuuuuuaaaacaaaagagaggcucuauuuuuguauu

SEQ ID NO: 479299 - RNA, 64 nt, Human
ccugaaaaaggcagaguuugaaagcucccauuuaaaaacaaaauacuuuuuaaagcccucuugc

SEQ ID NO: 479300 - RNA, 64 nt, Human
cagaguugcuguggacagaccuguaaggacuugcaaaacaaaagaaagugagggguuuuuuuaa

SEQ ID NO: 479301 - RNA, 64 nt, Human
aggaaaaccagaucggacuaaaaaaggaaaaagaaaaacaaaaucuccgcaguguccaaaccua

SEQ ID NO: 479302 - RNA, 64 nt, Human
uggaggacgccaguaaaaaaacaaaaacaaaaacaaaacaaaacauaaaauauaaacaaucaaa

SEQ ID NO: 479303 - RNA, 64 nt, Human
uugaauggaggacgccaguaaaaaaacaaaaacaaaaacaaaacaaaacauaaaauauaaacaa

SEQ ID NO: 479304 - RNA, 64 nt, Human
aaauguuugaauggaggacgccaguaaaaaaacaaaaacaaaaacaaaacaaaacauaaaauau

SEQ ID NO: 479305 - RNA, 64 nt, Human
cuauguaaauguuugaauggaggacgccaguaaaaaaacaaaaacaaaaacaaaacaaaacaua

SEQ ID NO: 479306 - RNA, 64 nt, Human
gaggagggaaguugugcacucugaaaaugcaugaaaaacaaaggcaaaaacuagugggaaaugu

SEQ ID NO: 479307 - RNA, 64 nt, Human
aacucauucuucagugccucaugacugaaaacaaaaaacaaaaaaacgaaagcaucuucacaau

SEQ ID NO: 479308 - RNA, 64 nt, Human
ucagcacaacucauucuucagugccucaugacugaaaacaaaaaacaaaaaaacgaaagcaucu

SEQ ID NO: 479309 - RNA, 58 nt, Human
gggagaagaaaaauagauagcugcuguuaaaacaaaauuauccuuuaagucugcuuaa

SEQ ID NO: 479310 - RNA, 64 nt, Human
ccagccuaggcaacagagcaagacccugucucuuaaaacaaaaaaccucacacauaccuaaaau

SEQ ID NO: 479311 - RNA, 64 nt, Human
aguaauacgcuauuucuccaacaucaagacaacuaaaacaaaugauaaaaauguuuauuuuuac

SEQ ID NO: 479312 - RNA, 64 nt, Human
auaucauucauggccaaaaaaaaccaaaaagcaaaaaacaaaaacaagucccauguccuacuga

SEQ ID NO: 479313 - RNA, 64 nt, Human
gugcuuauucuuuaacaaagagaaucuaaaaaaaaaaacaaaaaacuguugucuaauauaucua

SEQ ID NO: 479314 - RNA, 64 nt, Human
cauauuuucauaaucagucaaaauaauaaaacuaaaaacaaaaaguaaaaauuaguucccaagu

SEQ ID NO: 479315 - RNA, 64 nt, Human
ggacuuauguuuaacauagaaaaugaaugcguuuaaaacaaaaccacuuucugcauuuaaccag

SEQ ID NO: 479316 - RNA, 64 nt, Human
uaaauaaaggggaaguccacauuaaaaagaaaacaaaacaaacccuaacuaacuuccaaauggg

SEQ ID NO: 479317 - RNA, 64 nt, Human
aaauuuaaauaaaggggaaguccacauuaaaaagaaaacaaaacaaacccuaacuaacuuccaa

SEQ ID NO: 479318 - RNA, 64 nt, Human
aaauauguaccaagaaucuugguuugccuuccagaaaacaaaacugcauuucacuuucccggug

SEQ ID NO: 479319 - RNA, 64 nt, Human
aaacauuuugcaaacugcagcagaaaucgaauuuaaaacaaaaaggagggacuuuaaaauaccu

SEQ ID NO: 479320 - RNA, 64 nt, Human
aaauacuuuugaaaaaaaaguuuguuguauagucaaaacaaaucggugccacccggccgugaca

SEQ ID NO: 479321 - RNA, 64 nt, Human
auauuuucacauuucucaguccugaagaauaaggaaaacaaagcgacgccuauuuuguauaaag

SEQ ID NO: 479322 - RNA, 64 nt, Human
acaagcucgguggugacucuucggccccuggggaaaaacaaaaagauauugcugagaugaccuc

SEQ ID NO: 479323 - RNA, 64 nt, Human
aaaaaaaaauacgucuuucaaauuaauugcaguaaaaacaaaagaguaguggggagagaaaaac

SEQ ID NO: 479324 - RNA, 64 nt, Human
ucucaugccaagaaccaagaucggacuaugaacaaaaacaaaugauagauauagugacaguacc

SEQ ID NO: 479325 - RNA, 64 nt, Human
cuccagcuugggcaacagagugagacuccaucucaaaacaaaacaaaacaaaacaaaacaaaaa

SEQ ID NO: 479326 - RNA, 64 nt, Human
gcuugggcaacagagugagacuccaucucaaaacaaaacaaaacaaaacaaaacaaaaaaaccc

SEQ ID NO: 479327 - RNA, 64 nt, Human
ggcaacagagugagacuccaucucaaaacaaaacaaaacaaaacaaaacaaaaaaacccggcuu

SEQ ID NO: 479328 - RNA, 64 nt, Human
cagagugagacuccaucucaaaacaaaacaaaacaaaacaaaacaaaaaaacccggcuuugcug

SEQ ID NO: 479329 - RNA, 64 nt, Human
ugagacuccaucucaaaacaaaacaaaacaaaacaaaacaaaaaaacccggcuuugcugcuuuu

SEQ ID NO: 479330 - RNA, 64 nt, Human
agugccacacggaacccuguauuuugcacacagcaaaacaaacaauguuuagcuuuauuuaugg

SEQ ID NO: 479331 - RNA, 64 nt, Human
acuuugaaaggcaaaagaggaaucaagaauaaauaaaacaaacuuaaucuucaucuuuaaaaaa

SEQ ID NO: 479332 - RNA, 64 nt, Human
uaucagcaacauacguguuuuuugacagaaagugaaaacaaauuccguaaaacuguuaguauca

SEQ ID NO: 479333 - RNA, 64 nt, Human
uuuuauaugcagagagaaaaaguuaccgagacagaaaacaaaucuaagggaaaggaauauuaug

SEQ ID NO: 479334 - RNA, 64 nt, Human
aaacuuuaaacacuuuuuaaaucuucaaauauuuaaaacaaauuuaaagggucuguuaauucuu

SEQ ID NO: 479335 - RNA, 64 nt, Human
uuugaaaguauuuucauuugaucuuuaaaaaauaaaaacaaauuggagaccugugacauaacuc

SEQ ID NO: 479336 - RNA, 64 nt, Human
gcauaucaaccaggcaagucuugcuguaaaaaugaaaacaaaacaaacccaugagguuaccauc

SEQ ID NO: 479337 - RNA, 64 nt, Human
ucaaccaggcaagucuugcuguaaaaaugaaaacaaaacaaacccaugagguuaccaucaagug

SEQ ID NO: 479338 - RNA, 64 nt, Human
cuccucucuguagucacccugacauccucacaagaaaacaaaucuagccauugcccaaacuuua

SEQ ID NO: 479339 - RNA, 64 nt, Human
cacggacaguaguuucaguucugaugguauaagcaaaacaaauaaaacguuuauaaaaguugua

SEQ ID NO: 479340 - RNA, 64 nt, Human
ccaggaauucuuccaguaggugcucagcuauuuaaaaacaaaacuauucucaaacauucaucau

SEQ ID NO: 479341 - RNA, 64 nt, Human
aaaaguuuuuuuucaaucauuguaccuugauauuaaaacaaauauccuuuaaguauuucuaauc

SEQ ID NO: 479342 - RNA, 64 nt, Human
auuuguagccuugugcuucuugcuaagagaaagaaaaacaaaaucagagggcauuaaauguuuu

SEQ ID NO: 479343 - RNA, 64 nt, Human
gcuucuggcuuuuaauuuugccagcuaaggacauaaaacaaaaauaaacaaacaaaaacaaaua

SEQ ID NO: 479344 - RNA, 64 nt, Human
ccagcuaaggacauaaaacaaaaauaaacaaacaaaaacaaauagccaucugcuaucagcauca

SEQ ID NO: 479345 - RNA, 64 nt, Human
agaagggccaggggaauagagcuauuuuuuuaacaaaacaaaaugaagacaaaaauauggacug

SEQ ID NO: 479346 - RNA, 64 nt, Human
uuucucuuuucuuucugucuuguuaaugcuuuuaaaaacaaaugaguuuuuuauauaaauaaag

SEQ ID NO: 479347 - RNA, 64 nt, Human
caggcccuuuggcuucugauuuuucucuuuuuuaaaaacaaacaaacaaacuguugcagauuau

SEQ ID NO: 479348 - RNA, 64 nt, Human
acccuggccaacauggugaaacccugucucuacuaaaacaaauacaaaacuucgcugggcacag

SEQ ID NO: 479349 - RNA, 64 nt, Human
uucuuugaacaaucauguagucgauuaaaaaaaaaaaacaaacuuuuuuuuccuaggcugaagc

SEQ ID NO: 479350 - RNA, 64 nt, Human
aggcccccaucagggaccagacuguuccaaaaaaaaaacaaaaaacaaaaacaaacaaaaaaac

SEQ ID NO: 479351 - RNA, 64 nt, Human
caucagggaccagacuguuccaaaaaaaaaacaaaaaacaaaaacaaacaaaaaaacacuuaaa

SEQ ID NO: 479352 - RNA, 64 nt, Human
ggaccagacuguuccaaaaaaaaaacaaaaaacaaaaacaaacaaaaaaacacuuaaaagccca

SEQ ID NO: 479353 - RNA, 63 nt, Human
ccauucuccacaaaaaggaaaaauaaaagacaaaaaaacaaacaaaaaaccaaaaaacccaag

SEQ ID NO: 479354 - RNA, 64 nt, Human
uucagaccuaaaggaaauguuuggucauguuaagaaaacaaauuauucauucauaugaugcuuu

SEQ ID NO: 479355 - RNA, 64 nt, Human
cucucaggaagcauugaugaaucauuccaccaagaaaacaaacaagcaccuaccauagaccugg

SEQ ID NO: 479356 - RNA, 64 nt, Human
cuccuuuacaaugcaugaaugccuaucccccuacaaaacaaagauuaaaugugaugauguaugc

SEQ ID NO: 479357 - RNA, 64 nt, Human
uguuaaguaacuggccuuuagcagaucuguuucaaaaacaaauacaaaaaugagaaugaaaagu

SEQ ID NO: 479358 - RNA, 64 nt, Human
ccauccugggcagcauacugagacccugccuuuaaaaacaaacagaacaaaaacaaaacaccag

SEQ ID NO: 479359 - RNA, 64 nt, Human
uacugagacccugccuuuaaaaacaaacagaacaaaaacaaaacaccagggacacauuucucug

SEQ ID NO: 479360 - RNA, 64 nt, Human
agguaggucauuaugauugcagagccaaaauagcaaaacaaacauauuaaguguguuuacuaaa

SEQ ID NO: 479361 - RNA, 64 nt, Human
aguucauaaaauaaucucuaaaccauguuagguuaaaacaaaaugaccaucucacaaaaacgag

SEQ ID NO: 479362 - RNA, 64 nt, Human
auugguaaacauuuuggagugcuuaaaaaugccaaaaacaaaaugguaauuucuacuuugauaa

SEQ ID NO: 479363 - RNA, 63 nt, Human
auguaccccagaaucuaaaauaaaaauaaaaagaaaaacaaagaauguacucuauacaaaaga

SEQ ID NO: 479364 - RNA, 64 nt, Human
caaauuuggggguuucucaaauaaaauaaaaauaaaaacaaauacuguguuucagaagcgccac

SEQ ID NO: 479365 - RNA, 64 nt, Human
uguuauucguuugucugguuuuacuaccuuugcaaaaacaaaauaccccaaagauauuuaaaca

SEQ ID NO: 479366 - RNA, 64 nt, Human
guaugacagccacuccuaaaaauaaacaacaacaaaaacaaaaaaagaagaaaacuaaauaaaa

SEQ ID NO: 479367 - RNA, 64 nt, Human
uguaaaacugucccugcagauugagcaggaaguaaaaacaaauggaaaugcuucggauaguggc

SEQ ID NO: 479368 - RNA, 64 nt, Human
uuugaguugcaauauguuauuuuuauaugggccaaaaacaaaaaacaaaaaaaaaaaaaaggaa

SEQ ID NO: 479369 - RNA, 64 nt, Human
gcugguucuuuuugaucugaagcugaugcuuauuaaaacaaaugauguauggggagaggagaag

SEQ ID NO: 479370 - RNA, 64 nt, Human
uuucuuucuuuuuccaccugagacuuguuuauaaaaaacaaaacaauaaaaagagucugaucag

SEQ ID NO: 479371 - RNA, 64 nt, Human
caggauacuuccaggagacagagccaccagcagcaaaacaaauauucccaugccuggagcaugg

SEQ ID NO: 479372 - RNA, 64 nt, Human
aagcacccagacgccacaggcucugucgcauuucaaaacaaaccaugauggaguggcggccagu

SEQ ID NO: 479373 - RNA, 64 nt, Human
auuucccacccuccaucuaccccuuccagaagcaaaaacaaaccaugacugaggcaggcaugga

SEQ ID NO: 479374 - RNA, 64 nt, Human
uguauauuuauuauuugucaauuaaaagcaaaauaaaacaaaaaaccuucaucuaauacuuugg

SEQ ID NO: 479375 - RNA, 64 nt, Human
aacucuaagguucccuccaguguuggacaguacaaaaacaaagcugcucuuguuagcacuuuga

SEQ ID NO: 479376 - RNA, 64 nt, Human
caggauucauacaugggacuaaagguucaagaauaaaacaaagcaugacccacuuuguuccuuc

SEQ ID NO: 479377 - RNA, 64 nt, Human
uaacaugcaaaaaaagcugaaugcacuaacucacaaaacaaacacuugcacugaauucccaaug

SEQ ID NO: 479378 - RNA, 64 nt, Human
ugcacuuuuaaaccucucuucuaccuuaaaauguaaaacaaaaauguaaugaucauaagucuaa

SEQ ID NO: 479379 - RNA, 64 nt, Human
uaaaagcugcaaaccugguaaccuuuaaacuuuuaaaacaaaugucauaugggguaacacugac

SEQ ID NO: 479380 - RNA, 64 nt, Human
accagucugggugacagagaaagacccugucucaaaaacaaauuaaauaaaauaucuucauaua

SEQ ID NO: 479381 - RNA, 64 nt, Human
acuuacuaauggcugcaaugccaaugauuguaagaaaacaaacaaauuuaucaugaaauucucc

SEQ ID NO: 479382 - RNA, 64 nt, Human
guucucucuaugguaaagauauuauucaccauguaaaacaaaaaacaauauuuauuguauuuua

SEQ ID NO: 479383 - RNA, 64 nt, Human
aacuuuaugcagcuuccuuuugagggacaaauuuaaaacaaacaaccccccaucacaaacuuaa

SEQ ID NO: 479384 - RNA, 64 nt, Human
gucauuggugccucuaucacaugguucuugagaaaaaacaaaccaaccugugugaauuuuagaa

SEQ ID NO: 479385 - RNA, 64 nt, Human
ugaagaaaucaguuucugccucuuuuuggaaaagaaaacaaagugcaauuguuuuuuacuggaa

SEQ ID NO: 479386 - RNA, 64 nt, Human
cuuccuccucagucuucucaguagaaaggaacagaaaacaaacaucugugcaaaacccuauaaa

SEQ ID NO: 479387 - RNA, 64 nt, Human
uaaaucuacuguuucaaaaaagugucuuuacaaaaaaacaaaaaagaaaagaaauuuauuuauu

SEQ ID NO: 479388 - RNA, 64 nt, Human
gagacucaaaucuaaaacauuuacagaguuacaaaaaacaaacaaucaaaaaaaaagacaguuu

SEQ ID NO: 479389 - RNA, 64 nt, Human
cugguuucuucucuuugguugguguggguaaaagaaaacaaaacauuuccuauaagcugaaagc

SEQ ID NO: 479390 - RNA, 64 nt, Human
auaguguucaaaaccuguaggcacucucuggcuaaaaacaaacucugaggccaccagcagauca

SEQ ID NO: 479391 - RNA, 64 nt, Human
uguauuaaugucuccauugucuuaacccuguuccaaaacaaaauucaccuccuuucuuuaugug

SEQ ID NO: 479392 - RNA, 64 nt, Human
guuuagaaucuuucagguggaauaaagucacaugaaaacaaaacacaacuauauauauuuucag

SEQ ID NO: 479393 - RNA, 64 nt, Human
guauguucuugagugcaaguguuuuauaaaaaauaaaacaaaaacccaccaucacaaaaaaaaa

SEQ ID NO: 479394 - RNA, 64 nt, Human
uugagaauaaguuuauauucuugcuagguaaaacaaaacaaaaacgacaguaauaccaaggaau

SEQ ID NO: 479395 - RNA, 64 nt, Human
ggauuuugagaauaaguuuauauucuugcuagguaaaacaaaacaaaaacgacaguaauaccaa

SEQ ID NO: 479396 - RNA, 64 nt, Human
aaacaccccaaccccggaaaugugugggaaaaagaaaacaaaaacuuuccaaauuccaacgguc

SEQ ID NO: 479397 - RNA, 64 nt, Human
gcuggcucuuuaauauaugacuaaacaauaauuuaaaacaaaucauaguagcagcauauuaagg

SEQ ID NO: 479398 - RNA, 64 nt, Human
uguguuuuuuaauuuucuggggggaaaaaaagacaaaacaaaaaaccaacucugacuuuucugg

SEQ ID NO: 479399 - RNA, 64 nt, Human
uacaauucauaaugcagcaguuucuccaaaaacaaaaacaaaacacacaccacacacacgcgcu

SEQ ID NO: 479400 - RNA, 64 nt, Human
agugguuacaauucauaaugcagcaguuucuccaaaaacaaaaacaaaacacacaccacacaca

SEQ ID NO: 479401 - RNA, 64 nt, Human
auauuuuuuggaagagcugcuaauuuuauuuuaaaaaacaaaguugugaaaacaugccuccuuu

SEQ ID NO: 479402 - RNA, 64 nt, Human
uagaaguagaagaacauaagauguauuucugacuaaaacaaauggcucuuucacaugugcuuua

SEQ ID NO: 479403 - RNA, 64 nt, Human
acccuauucuuaccuagccucccccgacuuccucaaaacaaacaagagauggcaaagcagcagu

SEQ ID NO: 479404 - RNA, 64 nt, Human
ucucagcugucuuguuccaccaguauuuaccaggaaaacaaagaauguguuaagggaugcuccc

SEQ ID NO: 479405 - RNA, 64 nt, Human
gagcaaggcucugucucaaaaaaaaacaaaaacaaaaacaaaaaagacugauaucgcaccuaaa

SEQ ID NO: 479406 - RNA, 64 nt, Human
gugacagagcaaggcucugucucaaaaaaaaacaaaaacaaaaacaaaaaagacugauaucgca

SEQ ID NO: 479407 - RNA, 64 nt, Human
gccugggugacagagcaaggcucugucucaaaaaaaaacaaaaacaaaaacaaaaaagacugau

SEQ ID NO: 479408 - RNA, 64 nt, Human
auugugacgugcuuguggucugugcuugcucagaaaaacaaacaaacaaacaguuuuuccaauu

SEQ ID NO: 479409 - RNA, 64 nt, Human
ggauuguuuaaucacaaccucaaguguuaaaacaaaaacaaacaaacacguuuguagguucuua

SEQ ID NO: 479410 - RNA, 64 nt, Human
aguuggggauuguuuaaucacaaccucaaguguuaaaacaaaaacaaacaaacacguuuguagg

SEQ ID NO: 479411 - RNA, 64 nt, Human
gagacugaaacuacugguguuuuucugccuugagaaaacaaacaguuaaaacaagccucaaaug

SEQ ID NO: 479412 - RNA, 64 nt, Human
uauccagauaagaaaggaccaacuuggguuccuuaaaacaaagggaaauuauuauugccacuua

SEQ ID NO: 479413 - RNA, 64 nt, Human
uugcauuccuugagaauguauuuaucugaagaucaaaacaaacaauccagauguauaaguacua

SEQ ID NO: 479414 - RNA, 64 nt, Human
uuacucagauuuggggaaaugacauuuuuauacuaaaacaaacaccaaaauauuuuagaauaaa

SEQ ID NO: 479415 - RNA, 64 nt, Human
aggaauaaaaagcuggccguacaaauuacauuucaaaacaaacccuaauaaauccacauuuccg

SEQ ID NO: 479416 - RNA, 64 nt, Human
caagggagaagauauucucgugaaagaaaaaaacaaaacaaaacaacagugcuuuuuucaaacc

SEQ ID NO: 479417 - RNA, 64 nt, Human
ucuuccaagggagaagauauucucgugaaagaaaaaaacaaaacaaaacaacagugcuuuuuuc

SEQ ID NO: 479418 - RNA, 64 nt, Human
aguggaggcuuuuguuuguguguguguggcuuugaaaacaaauuauuugagaaagaccauaaca

SEQ ID NO: 479419 - RNA, 64 nt, Human
uuuaaagaguuaguguuaauggcuuucugguuugaaaacaaaaaugcaucuaugugguugaaag

SEQ ID NO: 479420 - RNA, 64 nt, Human
uuaaaaguuuuguucuuuuauagacugauuuagaaaaacaaaugauuaguuaaaaaaagaaaau

SEQ ID NO: 479421 - RNA, 64 nt, Human
guucacauguaucuauaacaacauuuauauuucuaaaacaaacuuuucaugaaacaagauauac

SEQ ID NO: 479422 - RNA, 64 nt, Human
cuucagggugauuucuggagccugaaaagaauaaaaaacaaaaccaaaccuauccuuuugcuaa

SEQ ID NO: 479423 - RNA, 64 nt, Human
ggagagaggaagggugacggcuucuggcacuuagaaaacaaaaagaacaaaaaaagagaaaccc

SEQ ID NO: 479424 - RNA, 64 nt, Human
auauucaacugacagacaaaaaccaaccaacgacaaaacaaaaacccccaaucaugaacgccug

SEQ ID NO: 479425 - RNA, 64 nt, Human
auauaaaaauacaauuaauuuuugaauauuaaucaaaacaaaaagcaaaacugcuacacucacu

SEQ ID NO: 479426 - RNA, 64 nt, Human
caggaggcaucuggaaagggggggaaaaaagcaaaaaacaaaauuaaaaaaaauugauuuccau

SEQ ID NO: 479427 - RNA, 64 nt, Human
aacaacaacaacaacacacaaaccugacaagagaaaaacaaaccugaagcugccgagcaggagu

SEQ ID NO: 479428 - RNA, 64 nt, Human
gguggccccgcucccuaaauuuuuuaaaaagacaaaaacaaaacaacaacaacaacacacaaac

SEQ ID NO: 479429 - RNA, 64 nt, Human
aaacuggcuaguuaaaaguaaauggcauuuaauuaaaacaaaucuugcaaauucaugaaaaaac

SEQ ID NO: 479430 - RNA, 64 nt, Human
gagaguucucccuccacgauugugaaaacaaaugaaaacaaaauuagagcaaagcugaccugga

SEQ ID NO: 479431 - RNA, 64 nt, Human
caagccuccagagaguucucccuccacgauugugaaaacaaaugaaaacaaaauuagagcaaag

SEQ ID NO: 479432 - RNA, 64 nt, Human
gauuucauauuguauuuuaaacugugugaaauuaaaaacaaagaauuucauucauaaugcugug

SEQ ID NO: 479433 - RNA, 64 nt, Human
ccugggcgacagagagagacuccaucucaaaacaaaaacaaacaaacaaacagaaagcaccguc

SEQ ID NO: 479434 - RNA, 64 nt, Human
cuccagccugggcgacagagagagacuccaucucaaaacaaaaacaaacaaacaaacagaaagc

SEQ ID NO: 479435 - RNA, 64 nt, Human
caguggcucugcgugguacaugacugagaagagaaaaacaaaaauaaaucauaccucaaaggau

SEQ ID NO: 479436 - RNA, 64 nt, Human
ugggaagaucugaaucuggggccguuugaaagcaaaaacaaaccacugucucugcuucugaaac

SEQ ID NO: 479437 - RNA, 64 nt, Human
gauauuagguuugcuaaauucuuucacagacuauaaaacaaaaaauuuugaggaacaccucuca

SEQ ID NO: 479438 - RNA, 64 nt, Human
caguaauaacuauaaaucucacuuuaaauaauuuaaaacaaauuaaagugauauaugaguuaaa

SEQ ID NO: 479439 - RNA, 64 nt, Human
guaccuuuugaauucccccagaagaguuguuuucaaaacaaacauuccagaaugaaugucgcuc

SEQ ID NO: 479440 - RNA, 64 nt, Human
aguaucauuuuaguuaagugggucaaacagaaucaaaacaaaacccaaagaaauaaauaaaaaa

SEQ ID NO: 479441 - RNA, 64 nt, Human
acagaaucaaaacaaaacccaaagaaauaaauaaaaaacaaaauggcuaaauaguuuaaaauag

SEQ ID NO: 479442 - RNA, 64 nt, Human
cacuuugagaaucgguuugacuuugcuuucaaacaaaacaaaaaccucuugcuuuuagggguuc

SEQ ID NO: 479443 - RNA, 64 nt, Human
aaauguuacugcuuaucuuuucuuaaaaaaaaaaaaaacaaaguguagguauuuugaaguacug

SEQ ID NO: 479444 - RNA, 64 nt, Human
ugauuguagaccuugcuugaguauuuuuucuaauaaaacaaagcaaaucacauuuagcuucaaa

SEQ ID NO: 479445 - RNA, 64 nt, Human
gguggaaguauaaauaagccuaugaacuuauaauaaaacaaacuguagguagaaaaaaugagag

SEQ ID NO: 479446 - RNA, 64 nt, Human
aaaaauacuuguucagguaauucuaauucuuaauaaaacaaaugaguaucauacagguagaggu

SEQ ID NO: 479447 - RNA, 64 nt, Human
caguauauuucugaaaugacagaaugcuguuuuaaaaacaaagaaauaaaauccugcuccugac

SEQ ID NO: 479448 - RNA, 64 nt, Human
uccaaacuauauaaggaacucacagaacuuaaagaaaacaaauaauccaauuaaaaauggucaa

SEQ ID NO: 479449 - RNA, 64 nt, Human
aaaauaauuacauuaugcuucuauucuaucaucuaaaacaaaucauuaaaacuaauuucuagcu

SEQ ID NO: 479450 - RNA, 64 nt, Human
ugauauauucauauuacucguuuauaaaaaaucaaaaacaaaaggaaagaaaacaaaaaaaacu

SEQ ID NO: 479451 - RNA, 64 nt, Human
acucguuuauaaaaaaucaaaaacaaaaggaaagaaaacaaaaaaaacuugcacaaaaauacug

SEQ ID NO: 479452 - RNA, 64 nt, Human
guucaguuccuuuagucaagaugucacaaguuuaaaaacaaaacuugagaaacuaccaaaggcu

SEQ ID NO: 479453 - RNA, 64 nt, Human
cagacccagagauuagccucccacuucggcgcagaaaacaaaagcccuuugugggacccgggcc

SEQ ID NO: 479454 - RNA, 64 nt, Human
accaucuccugaagaccuuucuuaccuuuuuuuaaaaacaaaaaaugaaauuauuuugcaugcu

SEQ ID NO: 479455 - RNA, 64 nt, Human
auugaaaggguuuuucuuucuuuuuuaaaaaagaaaaacaaacuauugauuguagauaaugaaa

SEQ ID NO: 479456 - RNA, 64 nt, Human
cuacccagccugcugccucagcacagccaagggaaaaacaaaaaccccacaaaauaccccaaca

SEQ ID NO: 479457 - RNA, 64 nt, Human
uaucacuggcacaauugauguguuuugauucccuaaaacaaaauuagggagucaaacguggacc

SEQ ID NO: 479458 - RNA, 64 nt, Human
gcgggggcuaaguuggugcuuuugagaaccaaguaaaacaaaaccacugggaggagucuauuuu

SEQ ID NO: 479459 - RNA, 64 nt, Human
cuugggggucaacuccccccaggacuuaccuuccaaaacaaacuuucuucacuuuguauuauag

SEQ ID NO: 479460 - RNA, 64 nt, Human
uaucuauggaaaugaugaaguuacccaccacauuaaaacaaaagucugagauggggaguuucag

SEQ ID NO: 479461 - RNA, 64 nt, Human
auaaauuuucucauuuaaaaaucaaaaaucuugcaaaacaaaaaccauguuucuuuuucuugua

SEQ ID NO: 479462 - RNA, 64 nt, Human
uuguaaauaauaauuuuuaaaacuugcacaaaucaaaacaaacacaaacaaaauuguauuuuau

SEQ ID NO: 479463 - RNA, 64 nt, Human
agacaguauuguaaucccaucaaaagaugaaagaaaaacaaaaacaaaaaccaacaacaauuag

SEQ ID NO: 479464 - RNA, 64 nt, Human
uauuguaaucccaucaaaagaugaaagaaaaacaaaaacaaaaaccaacaacaauuagccauag

SEQ ID NO: 479465 - RNA, 64 nt, Human
ugcucugaaaugaaaguuugucuucacaaauaucaaaacaaaauggaggaaaacuaagcauugg

SEQ ID NO: 479466 - RNA, 64 nt, Human
cuacagcaaagccuagccugcauaucauucacccaaaacaaaguaauagcgccucuuuuauuau

SEQ ID NO: 479467 - RNA, 64 nt, Human
uaaaaauggaaaaaaugaucauggcuuuaaaaaaaaaacaaaaacacacacacaugaacucaga

SEQ ID NO: 479468 - RNA, 64 nt, Human
guuccauguauuuuuguuacaaaucuucugaaaaaaaacaaaacaaugugaaacauuaaaauua

SEQ ID NO: 479469 - RNA, 64 nt, Human
agcugccucuacugcucccacguguuccuguugaaaaacaaaggacuuuccacuggucugcaga

SEQ ID NO: 479470 - RNA, 64 nt, Human
ggggugggaacuuuuuuaaauguucauuuaaaaaaaaacaaaaacagggcagucuuguaguuua

SEQ ID NO: 479471 - RNA, 64 nt, Human
cuggguggcaaagugagacucuggcucaaaaaaaaaaacaaaaaacaaaaccaucugcccuccu

SEQ ID NO: 479472 - RNA, 64 nt, Human
gcaaagugagacucuggcucaaaaaaaaaaacaaaaaacaaaaccaucugcccuccuccccuag

SEQ ID NO: 479473 - RNA, 64 nt, Human
cuccugaauuuacuuggauuuaaagagguuaauaaaaacaaacuauaaacucucuagacugggc

SEQ ID NO: 479474 - RNA, 64 nt, Human
caugcugcauuuguguuaguguucuuuauaauaaaaaacaaagcagccuccuggcuggcugugu

SEQ ID NO: 479475 - RNA, 64 nt, Human
uauccccauauggaauuuauccaucaaccacauaaaaacaaacagugccuucugcccucugccc

SEQ ID NO: 479476 - RNA, 64 nt, Human
ugguuucuguauuuuucacaaugauuaaugaacaaaaacaaagagaaaaaaacacacaucaauu

SEQ ID NO: 479477 - RNA, 64 nt, Human
cauuaugaggucagacuaggauaauguccaacuaaaaacaaacccuuuucauccuggcuggaga

SEQ ID NO: 479478 - RNA, 64 nt, Human
gggaacacagcgagacccucucauuaaaaacaacaaaacaaaacaauuccagucuuggaguagu

SEQ ID NO: 479479 - RNA, 64 nt, Human
gguauuagauacuuauuuccuuuaaacuuuauuuaaaacaaacaacagaguuaaucugucaccu

SEQ ID NO: 479480 - RNA, 64 nt, Human
gccaugaaagagggacgcuacacuguccuggcagaaaacaaaagugacgagaaaaaaaguaggu

SEQ ID NO: 479481 - RNA, 64 nt, Human
ccagccugggugaaggagugagacccugucuccaaaaacaaacaaaaaaggagcagagaaagac

SEQ ID NO: 479482 - RNA, 64 nt, Human
uagguucgaauccagagagcaguguggaaaaaaaaaaacaaaaaacaacugaccaguuguugau

SEQ ID NO: 479483 - RNA, 64 nt, Human
caucaccuuuuguacaaaaacucuuaaugauuaaaaaacaaacaaaacauauuggccuugucau

SEQ ID NO: 479484 - RNA, 64 nt, Human
agagacuaggacucagucugaacugaaaucugucaaaacaaagggggguggggcuuuaagagug

SEQ ID NO: 479485 - RNA, 64 nt, Human
aauuuuggguaaucugucucuaaaauauuagcuaaaaacaaagcucuauguaaaguaauaaagu

SEQ ID NO: 479486 - RNA, 64 nt, Human
aacacucuuccccuucuguuccccuuucaaaaauaaaacaaaauauugcauucuuuguuuggau

SEQ ID NO: 479487 - RNA, 64 nt, Human
uaagcugaaaauaaugcugguguggauuuguuuuaaaacaaagcuuuauuaugaacaugcaugu

SEQ ID NO: 479488 - RNA, 64 nt, Human
ucacucuggaaaugcaaauagaauaggaggggaaaaaacaaaaucauguuaaugcguuuuguac

SEQ ID NO: 479489 - RNA, 64 nt, Human
uaauagaccucagccucaaaaggcuuggaaagaaaaaacaaauacaacaagcaaacaacaauau

SEQ ID NO: 479490 - RNA, 64 nt, Human
uguaagaaaaaauguaagacaaaaaaaaaaaaaaaaaacaaacagaggcagaggcaggcaguag

SEQ ID NO: 479491 - RNA, 64 nt, Human
gcagaaauaaaucuuuuuuuuuuuuuuuugguagaaaacaaagaggcauacucugauuuuuaua

SEQ ID NO: 479492 - RNA, 64 nt, Human
ugacaaaucaagagcauugcuuuuguuucuuaagaaaacaaacucuuuuuuaaaaauuacuuuu

SEQ ID NO: 479493 - RNA, 64 nt, Human
uuacuguaaaaaaaagugcacugaacuucaaaacaaaacaaaaaacaacaacaacaaaaaacaa

SEQ ID NO: 479494 - RNA, 64 nt, Human
uaaucuuacuguaaaaaaaagugcacugaacuucaaaacaaaacaaaaaacaacaacaacaaaa

SEQ ID NO: 479495 - RNA, 64 nt, Human
gaaaaauaaaaugugcaagucuucaggauggcacaaaacaaagguuaaugcuucuuggggcaca

SEQ ID NO: 479496 - RNA, 64 nt, Human
auccuucucuauuuccgugguccccugaauccagaaaacaaauagaacauaauuuuaugagucu

SEQ ID NO: 479497 - RNA, 64 nt, Human
agauuuuuaaauuuagcuuuauuuaucaacccaaaaaacaaauaaauaagaucaauauucuuuu

SEQ ID NO: 479498 - RNA, 64 nt, Human
agaucugacagucauuauuacagacuuuaaggagaaaacaaagucaccgccugcaucuagugcu

SEQ ID NO: 479499 - RNA, 64 nt, Human
uuuguuuacaugaggacuucugaaauuaauccuuaaaacaaacuuccugaagaccgaaaaguug

SEQ ID NO: 479500 - RNA, 64 nt, Human
aguacccucucugaaccuagguucccucaucuguaaaacaaagguuucagaccagaugguguuu

SEQ ID NO: 479501 - RNA, 64 nt, Human
uccugaugaugagucauuccaauuuacuggauuuaaaacaaaaaguuguuacgguuucaugggg

SEQ ID NO: 479502 - RNA, 64 nt, Human
ucaaacuucccuccaagggagauauuguaaggggaaaacaaaguguuuauuuccccaaaacaac

SEQ ID NO: 479503 - RNA, 64 nt, Human
ggccauguuauaaauauuguuauuuaaaaaacaaaaaacaaaacacacguacauuagguccugg

SEQ ID NO: 479504 - RNA, 64 nt, Human
agucacuggccauguuauaaauauuguuauuuaaaaaacaaaaaacaaaacacacguacauuag

SEQ ID NO: 479505 - RNA, 64 nt, Human
cuuuggaaaagaauuccuucuuaaaaucaaaaacaaaacaaaaaaacacaaaaaacacauucua

SEQ ID NO: 479506 - RNA, 64 nt, Human
aguaacuuuggaaaagaauuccuucuuaaaaucaaaaacaaaacaaaaaaacacaaaaaacaca

SEQ ID NO: 479507 - RNA, 64 nt, Human
cuuuaauuucucaguggaaguuaagaggggugagaaaacaaagaaggggaaaaacugacaacua

SEQ ID NO: 479508 - RNA, 64 nt, Human
cuauuuauucccuuauuuuaucuaacaccauuucaaaacaaaacuguagaagcagcugcugcuc

SEQ ID NO: 479509 - RNA, 64 nt, Human
agccugggcaacagguaagacucugucucaaaaaaaaacaaaaaagaagaagaaaaguacuucu

SEQ ID NO: 479510 - RNA, 64 nt, Human
ugaaugcucuaagugcuugcacaccucacccagcaaaacaaaagcuguguggcuccccagcuuc

SEQ ID NO: 479511 - RNA, 64 nt, Human
gauaauaggcaauuuuaaaacagacuccuuuaaaaaaacaaacaaacaaaaaaaacauagacuu

SEQ ID NO: 479512 - RNA, 64 nt, Human
gguaucaaaugccuuggaagcucccugauccuacaaaacaaaaaaaugcuuauuuuuaccacug

SEQ ID NO: 479513 - RNA, 64 nt, Human
uuauauuugggguccuuuuuuauacaggaaaaacaaaacaaagaaauaauggucuuuuuuuuuu

SEQ ID NO: 479514 - RNA, 64 nt, Human
uaccuuuauauuugggguccuuuuuuauacaggaaaaacaaaacaaagaaauaauggucuuuuu

SEQ ID NO: 479515 - RNA, 64 nt, Human
ggcuccucucaccuugucccuccacugccaacagaaaacaaagcagcugacugagauggucaaa

SEQ ID NO: 479516 - RNA, 64 nt, Human
cagaguaagacucugucucaaaaaaaaaaaaacaaaaacaaacaaacaaaaaaaacaccucacc

SEQ ID NO: 479517 - RNA, 64 nt, Human
gggcaacagaguaagacucugucucaaaaaaaaaaaaacaaaaacaaacaaacaaaaaaaacac

SEQ ID NO: 479518 - RNA, 64 nt, Human
uuccacaucgugagucauuuuacuuuaaaagggaaaaacaaauuuguagcaacucugaaguauc

SEQ ID NO: 479519 - RNA, 64 nt, Human
aauggauuuuuaacagagaagucuuuguuuuugaaaaacaaaaaucaaaaacaguaacuauuuu

SEQ ID NO: 479520 - RNA, 64 nt, Human
uuuuguucacaccacgcuuugauaacuaaacuggaaaacaaagguguuaaguaccucuguucug

SEQ ID NO: 479521 - RNA, 64 nt, Human
uuaacuuucugaagaauaucugucaaaauuuaagaaaacaaauguauaaaauuccauuuuuucc

SEQ ID NO: 479522 - RNA, 64 nt, Human
ugguuuggucuuuauuaaaaaucacaauauuccgaaaacaaaaaaaccuaggagauaaauguag

SEQ ID NO: 479523 - RNA, 64 nt, Human
augacccugaacuaaaacugauggguucccuaucaaaacaaauaaaaauauaccuuuuucaggu

SEQ ID NO: 479524 - RNA, 64 nt, Human
uaaugcagaguaggcuacuccaugauaguguuaaaaaacaaaauuugcuaacaaugugauauaa

SEQ ID NO: 479525 - RNA, 64 nt, Human
agaaagagcaguaugccacuucuuaaaacagaacaaaacaaaaaaagaaaauugugcucuuuuc

SEQ ID NO: 479526 - RNA, 64 nt, Human
caucaucaucuuccuauuuaaugaauugugauuuaaaacaaaaugaaaauaagccagguauucu

SEQ ID NO: 479527 - RNA, 64 nt, Human
aaugcuuuguuuaaaaaaacgaaaaaaacaaaacaaaacaaaaaaacaugagcagugguguucu

SEQ ID NO: 479528 - RNA, 64 nt, Human
acacuaaugcuuuguuuaaaaaaacgaaaaaaacaaaacaaaacaaaaaaacaugagcaguggu

SEQ ID NO: 479529 - RNA, 64 nt, Human
agauaacacuaaugcuuuguuuaaaaaaacgaaaaaaacaaaacaaaacaaaaaaacaugagca

SEQ ID NO: 479530 - RNA, 64 nt, Human
uguuuuugaauuugucuuuguuauaaagaagaguaaaacaaagauguguaagugugagucugug

SEQ ID NO: 479531 - RNA, 64 nt, Human
uacuauaaauaaaccauucuuacugcucucuuccaaaacaaaacucagcaugauacuuugagau

SEQ ID NO: 479532 - RNA, 64 nt, Human
auauuuagaauauuugacaaugguuugagaauguaaaacaaaaaggaacuaguuagagucaagu

SEQ ID NO: 479533 - RNA, 64 nt, Human
ucugugagggacugcaaagcuuacucaggaaaugaaaacaaaugauggucauguugcaguuuuu

SEQ ID NO: 479534 - RNA, 64 nt, Human
ugauuaucuaaacuaagcgcucauucuauuuuauaaaacaaauaaauuagucucuuuuuucuga

SEQ ID NO: 479535 - RNA, 64 nt, Human
uaggggaagacuuuuauuuucaugaaaagacaauaaaacaaaauggaaugugaugaagugguga

SEQ ID NO: 479536 - RNA, 64 nt, Human
uguaucaugaguguuugggggauaaguuuuuguuaaaacaaagucuggacuaucuucauuuacu

SEQ ID NO: 479537 - RNA, 62 nt, Human
acacaguaggcacucaauaaauauguauugauuaaaaacaaagacgucuucaauaugccaga

SEQ ID NO: 479538 - RNA, 64 nt, Human
ugaaaagaaaucacuuccuugaaaauuuuauuaaaaaacaaacaaacaaacaaaaagccugucc

SEQ ID NO: 479539 - RNA, 64 nt, Human
uucacuauuuuauuuuuuaaugaauuaaaacuagaaaacaaauugaugcaaacccuggaaguca

SEQ ID NO: 479540 - RNA, 64 nt, Human
uucuauauuuuacauucuuggaaagucuauaugaaaaacaaaaauaacaucuucaguuuuucuc

SEQ ID NO: 479541 - RNA, 64 nt, Human
aagugaaaagagagaaaggaaaagaaaaaggagaaaaacaaagagauuucuaccagugaaaggg

SEQ ID NO: 479542 - RNA, 64 nt, Human
uuaauaauguccucaucuccuacucuccauuuaaaaaacaaacuucauuguaguaaauucaaau

SEQ ID NO: 479543 - RNA, 64 nt, Human
cuuaucuuaaaaaguaaacaaaacaaaacaaaacaaaacaaaaaacuagauauguaauuucuaa

SEQ ID NO: 479544 - RNA, 64 nt, Human
ggacucuuaucuuaaaaaguaaacaaaacaaaacaaaacaaaacaaaaaacuagauauguaauu

SEQ ID NO: 479545 - RNA, 64 nt, Human
cggcaggacucuuaucuuaaaaaguaaacaaaacaaaacaaaacaaaacaaaaaacuagauaug

SEQ ID NO: 479546 - RNA, 64 nt, Human
aggugcggcaggacucuuaucuuaaaaaguaaacaaaacaaaacaaaacaaaacaaaaaacuag

SEQ ID NO: 479547 - RNA, 64 nt, Human
cuacuuuuaaaaucccagauacucugaauuuuagaaaacaaacuaauucugauugugucgugcc

SEQ ID NO: 479548 - RNA, 64 nt, Human
cuuuauucugcggugaaguugaggcuuauaaguuaaaacaaaggaacuaacuuacuguccacca

SEQ ID NO: 479549 - RNA, 64 nt, Human
aaugugacuuucuuguuuugucucaaaacuuaaaaaaacaaacacaaaaagaugagucccaccc

SEQ ID NO: 479550 - RNA, 64 nt, Human
auauauuuuuccuucacugugucaaguggaaacaaaaacaaaaucuuucaaaaaaaaaaucggg

SEQ ID NO: 479551 - RNA, 64 nt, Human
aaggcuuuacuucuuuugcaugcacuuuaaaaacaaaacaaaacauuuuucagguuccaaggaa

SEQ ID NO: 479552 - RNA, 64 nt, Human
aaaaaaaggcuuuacuucuuuugcaugcacuuuaaaaacaaaacaaaacauuuuucagguucca

SEQ ID NO: 479553 - RNA, 64 nt, Human
uuauuuuuuugguauuuauucaucaggaauaaaaaaaacaaaguuuuauuaaagauugaaaauu

SEQ ID NO: 479554 - RNA, 64 nt, Human
ccacaagcugcagucuguagcacugaacaaacaaaaaacaaaacgcucaagccuuacgaccaga

SEQ ID NO: 479555 - RNA, 64 nt, Human
cccacaaccgaguucuaguucccugaggucuuuaaaaacaaaaacagaauguuguacgugaaga

SEQ ID NO: 479556 - RNA, 64 nt, Human
ucauuuguggcuuucugcaucacccaaucaauaaaaaacaaauauauauauguauauauaugua

SEQ ID NO: 479557 - RNA, 64 nt, Human
ugugugaaaaugagccuuuggaccagucuuuauuaaaacaaacaaacaugaguagucugcauau

SEQ ID NO: 479558 - RNA, 64 nt, Human
auauaaugcuaguccuagauuacuuauugauuuaaaaacaaaaaaaagauuacuuaauuuugau

SEQ ID NO: 479559 - RNA, 64 nt, Human
aaaaacaaaaaaaagauuacuuaauuuugauuuaaaaacaaaaaaucguaaaauacaaaaacca

SEQ ID NO: 479560 - RNA, 64 nt, Human
gaauuuucaguuucauuuucaaaaacuauuuaccaaaacaaauggagaagaaacauccaaaagc

SEQ ID NO: 479561 - RNA, 64 nt, Human
ugcacauaggaaacuuuugauaaguaucugcggaaaaacaaacaugaauccugugauauugggc

SEQ ID NO: 479562 - RNA, 64 nt, Human
ugcagaagguguauguuggggagaacugaaagggaaaacaaaauacuugacauagucuuaagua

SEQ ID NO: 479563 - RNA, 64 nt, Human
ugacauagucuuaaguagaagaaggcaguuagagaaaacaaaguaucuacuggccuugucaaca

SEQ ID NO: 479564 - RNA, 64 nt, Human
cugaggugugcuucaagggagcauuauagggcagaaaacaaauuaaaaugaaauguuguuguua

SEQ ID NO: 479565 - RNA, 64 nt, Human
gaauuauuuuuaaaaagaaaucuggucuuguuagaaaacaaaauuuuauuuugugcucauuuaa

SEQ ID NO: 479566 - RNA, 64 nt, Human
aguugaaggaagagauugagcuacuucaggacuuaaaacaaaccuugugcucuuuucaagaaaa

SEQ ID NO: 479567 - RNA, 64 nt, Human
ggaugaagggugggugaaguugacaucacgauagaaaacaaaacuggaaugggaguuuaggucc

SEQ ID NO: 479568 - RNA, 64 nt, Human
uauaaacacaaggaacauuccauaucauuagucgaaaacaaaaacaaaaaaaaaaccuuugguc

SEQ ID NO: 479569 - RNA, 64 nt, Human
cacaaggaacauuccauaucauuagucgaaaacaaaaacaaaaaaaaaaccuuuggucauuugu

SEQ ID NO: 479570 - RNA, 64 nt, Human
ccauuauauacuccugaaguucuuuuucugauggaaaacaaaauucagcuuaaucguguacuca

SEQ ID NO: 479571 - RNA, 64 nt, Human
ugacagaccuaacuauuccuguguaaaaacaacaaaaacaaacaaaagcaagaaaaccacaacu

SEQ ID NO: 479572 - RNA, 64 nt, Human
aaagcaaagaaacucucuuggagcuuuugcauuuaaaacaaacaagcaagcagacacacacagu

SEQ ID NO: 479573 - RNA, 64 nt, Human
cuuaaucaggauuaaauuuucuaugaauaauugaaaaacaaaacacucacuggauuuguuauaa

SEQ ID NO: 479574 - RNA, 64 nt, Human
acaguaccuacauaguuuuuaaauuauuguuuaaaaaacaaaacagcuguuauaaaugaauauu

SEQ ID NO: 479575 - RNA, 64 nt, Human
ugaugaauaaaucuuaaaugcuuuguuuaauuaaaaaacaaaaaucaccaauauccaagacaug

SEQ ID NO: 479576 - RNA, 64 nt, Human
acagaaaacccuucaaaaguucagucuagucuggaaaacaaacaugaagcaaagaaggcacaac

SEQ ID NO: 479577 - RNA, 64 nt, Human
auaucccuuccggagucuuugaagcugaaaauauaaaacaaauaaaaaauaaaaaaauaaaaac

SEQ ID NO: 479578 - RNA, 64 nt, Human
uuuaaaaaaggaaguuuuauagugaauggguauaaaaacaaauuuguggcauuuuuagucuaau

SEQ ID NO: 479579 - RNA, 64 nt, Human
uuugagacuguuuccuuagauggguaagagguggaaaacaaacuuaguaucagggguccaugaa

SEQ ID NO: 479580 - RNA, 64 nt, Human
auauccuguucgugaccuaggagaaacaagacagaaaacaaaucuuucuucauuuaugaauuuc

SEQ ID NO: 479581 - RNA, 64 nt, Human
augccacaauggagcucugcuccccuaaagccucaaaacaaaggccuaauucuaugccugucuu

SEQ ID NO: 479582 - RNA, 64 nt, Human
uuuuucuauuaaaacuguuguuaaaauauuuuuuaaaacaaaaacauuauuugugcccucuuuu

SEQ ID NO: 479583 - RNA, 64 nt, Human
ugugcucuauuaaucuugucagaaaacugucaccaaaacaaaacuugaguuuguccuuguucua

SEQ ID NO: 479584 - RNA, 64 nt, Human
agacacucuaauaugauaugcuuucuggaaggauaaaacaaauacauaugggaaaaaguacuug

SEQ ID NO: 479585 - RNA, 64 nt, Human
cucuuuccuuuccaguuaaaaaaaaacaaaaacaaaaacaaaacccuuugcuguaucacugugu

SEQ ID NO: 479586 - RNA, 64 nt, Human
ucuuuccucuuuccuuuccaguuaaaaaaaaacaaaaacaaaaacaaaacccuuugcuguauca

SEQ ID NO: 479587 - RNA, 64 nt, Human
uucccuucuuuccucuuuccuuuccaguuaaaaaaaaacaaaaacaaaaacaaaacccuuugcu

SEQ ID NO: 479588 - RNA, 64 nt, Human
uucacauuuuacuuugaauguuuuucuucuggauaaaacaaauggaaucaaguuguaguuguuu

SEQ ID NO: 479589 - RNA, 64 nt, Human
aaauaaccuuccuuaaguacaauuuaacuucaagaaaacaaaauuugacaacauaguuucuuaa

SEQ ID NO: 479590 - RNA, 64 nt, Human
augcauugaagaucuguuucuaccaauaaacauuaaaacaaagacuguaugugaacuauguuuu

SEQ ID NO: 479591 - RNA, 64 nt, Human
guuaaguucacuuggaggcuaaaaaucuccagugaaaacaaaacgaaaaccuuuaagagaaugu

SEQ ID NO: 479592 - RNA, 64 nt, Human
guaccugaaguacaguauauucuuguaaauacauaaaacaaaagcauuuugcuaaggagaagcu

SEQ ID NO: 479593 - RNA, 64 nt, Human
uugggcaauuaaacaauuuauggcucuauuuuguaaaacaaacuacugguaauuauuuuuaaua

SEQ ID NO: 479594 - RNA, 64 nt, Human
acugagugugacuauuuucacugcaacaaaugaaaaaacaaaaugugccuguuuaaagcacuca

SEQ ID NO: 479595 - RNA, 64 nt, Human
cauucuaaacaaguccacucucuguggcuaacgcaaaacaaaugaaaucuuuauuguuuuccaa

SEQ ID NO: 479596 - RNA, 64 nt, Human
aauuauucaauuuauuugaaugauuuuucuuuacaaaacaaacucauucauuagucauguuuau

SEQ ID NO: 479597 - RNA, 64 nt, Human
gacuuuuugcuuugauauuaaaaauucaaugaguaaaacaaaagcuagucaaauguguuagcag

SEQ ID NO: 479598 - RNA, 64 nt, Human
ccauaauuuaccuuuugggcaaugcuuugugagcaaaacaaagucacuucugccauaacaucuu

SEQ ID NO: 479599 - RNA, 64 nt, Human
acauccccucccccaccugccaaauaaccuguucaaaacaaagaaggcauagaauauaaaugaa

SEQ ID NO: 479600 - RNA, 64 nt, Human
accaacucccuuuuaguuuucuugguuaaaaaaaaaaacaaaaaaaaaaacccuccuuuuuucc

SEQ ID NO: 479601 - RNA, 64 nt, Human
gcuuuggcaacagaacgagaucccaucucuuagaaaaacaaaguugauaguuaaagaacauaag

SEQ ID NO: 479602 - RNA, 64 nt, Human
aggugacagagcaagacccugucucaaaaaaaaaaaaacaaauuaaccaauaaguucuaauauc

SEQ ID NO: 479603 - RNA, 64 nt, Human
caaauuucuagauaugagaaauauaaaaauaauuaaaacaaaauccuugccuucaaacgaaaug

SEQ ID NO: 479604 - RNA, 64 nt, Human
aacaagaaugagauaaauuuguacuuuuuagaucaaaacaaauuaccuaauugcaaaagagaaa

SEQ ID NO: 479605 - RNA, 64 nt, Human
aagcaagagucccugaguauaaaggaaaaacagcaaaacaaaaagcaaacaaaaaaaaacugca

SEQ ID NO: 479606 - RNA, 64 nt, Human
guugauucaacauacuguuuaaaccucaaggaaaaaaacaaacgcagaauugggauauuggccu

SEQ ID NO: 479607 - RNA, 64 nt, Human
gaaguuauugccaaaggaacugucuguaagacaaaaaacaaaacauguuggaauuacuuaauug

SEQ ID NO: 479608 - RNA, 64 nt, Human
ucaccaucaauuuaaaaguaaaaaaaacaaaaaaaaaacaaaaaauuuaaaaaaaagguuugcu

SEQ ID NO: 479609 - RNA, 64 nt, Human
aaugccacgguucaccaucaauuuaaaaguaaaaaaaacaaaaaaaaaacaaaaaauuuaaaaa

SEQ ID NO: 479610 - RNA, 64 nt, Human
uacauuauuuuaagccacauguuuguaauuguuuaaaacaaaguggaaacauuacacaaugucc

SEQ ID NO: 479611 - RNA, 64 nt, Human
gagaaacagauucaugcuuguaucuugcauucagaaaacaaacuguccuacuaaucaaagcugc

SEQ ID NO: 479612 - RNA, 64 nt, Human
uauauguuaacgucauauuauguuaauguugcugaaaacaaaaccuaacaaaccuugauguacc

SEQ ID NO: 479613 - RNA, 64 nt, Human
agucauuaaaacaaaaugaaacauuugccaaaacaaaacaaaaaacuauguauuugcacagcac

SEQ ID NO: 479614 - RNA, 64 nt, Human
accgaagucauuaaaacaaaaugaaacauuugccaaaacaaaacaaaaaacuauguauuugcac

SEQ ID NO: 479615 - RNA, 64 nt, Human
uauuucauuuucuuuauauuggaccgaagucauuaaaacaaaaugaaacauuugccaaaacaaa

SEQ ID NO: 479616 - RNA, 64 nt, Human
caaccaccaaaaacuagacaaauaaagacaaacuaaaacaaaacagaacaaaagcaaaggaaaa

SEQ ID NO: 479617 - RNA, 64 nt, Human
ccuaaauauccuggggaccaaggaacuauguacaaaaacaaaccuaccaaccaccaaaaacuag

SEQ ID NO: 479618 - RNA, 64 nt, Human
uguauuguaaauaaguaacuuugacuucugacaaaaaacaaaaagugcugcauggcucgcaugg

SEQ ID NO: 479619 - RNA, 64 nt, Human
accuuuuuaaauaaauguuguagaauacuuaaaaaaaacaaacuagaauuugccugugugcagc

SEQ ID NO: 479620 - RNA, 64 nt, Human
aaacaacccuugaaauauuucauuuacuuaaccaaaaacaaauacuugcugauacuuuaccuag

SEQ ID NO: 479621 - RNA, 64 nt, Human
gugcacauauuccaggaaagugucuuuaaaaacaaaaacaaacccugaaauguauauuugggau

SEQ ID NO: 479622 - RNA, 64 nt, Human
accauagugcacauauuccaggaaagugucuuuaaaaacaaaaacaaacccugaaauguauauu

SEQ ID NO: 479623 - RNA, 64 nt, Human
ggcaauuaaguggucccaaugcucagcgcuuaaaaaaacaaauuggacagcuacuucugggaaa

SEQ ID NO: 479624 - RNA, 64 nt, Human
auuaugucaaccagugaggcugcccugaacaaaaaaaacaaaaagaaaaaaaaaaaaggaaaga

SEQ ID NO: 479625 - RNA, 64 nt, Human
uuauuccccauuaucacaucaguacacugcuuugaaaacaaaacuuuucaacaugggcauacug

SEQ ID NO: 479626 - RNA, 64 nt, Human
gguucuagaaaaugcacuugguauacuaaguauuaaaacaaacaaaaaggaaaguuguuucagu

SEQ ID NO: 479627 - RNA, 64 nt, Human
aaagaguuuaggaacugguuucugcuuuaauacaaaaacaaaaucuuguaaaagguguccaaau

SEQ ID NO: 479628 - RNA, 64 nt, Human
cuauuauuaaaguuuacucugguuccuaagauuaaaaacaaaugcuuacugaauuugaaaauga

SEQ ID NO: 479629 - RNA, 64 nt, Human
uaaacucaucugaaauguuacaaaaauaaacuauaaaacaaaaauuugaaaauggaguaguauu

SEQ ID NO: 479630 - RNA, 64 nt, Human
augcucagaagcagauuccaguguaaaaacgagaaaaacaaaaugaaagaggggaagaagauga

SEQ ID NO: 479631 - RNA, 64 nt, Human
uggauugcagacagugccgcugcugaucgcaucaaaaacaaagucaaaggccaucucacauuuu

SEQ ID NO: 479632 - RNA, 64 nt, Human
uugugauauguacaacucagauguuucucauuaaaaaacaaaauuagccagacuucuguuguac

SEQ ID NO: 479633 - RNA, 64 nt, Human
aaauacaugugaauucuacugcuuuaagagaaauaaaacaaauaagccuagggaaauauuagag

SEQ ID NO: 479634 - RNA, 64 nt, Human
aacauggugcaaccucgucuuuacuaaaaauacaaaaacaaaaauuagccagggguggugguau

SEQ ID NO: 479635 - RNA, 64 nt, Human
uccagccugggagacagagcaagacuccaucucaaaaacaaaaacaaaacaaaacaacaacaaa

SEQ ID NO: 479636 - RNA, 64 nt, Human
cugggagacagagcaagacuccaucucaaaaacaaaaacaaaacaaaacaacaacaaaaaaaga

SEQ ID NO: 479637 - RNA, 64 nt, Human
agacagagcaagacuccaucucaaaaacaaaaacaaaacaaaacaacaacaaaaaaagaaguua

SEQ ID NO: 479638 - RNA, 64 nt, Human
ucaucagagauacuuuccuaaaaaggaaaaauaaaaaacaaaauggugccacuuuggguugaag

SEQ ID NO: 479639 - RNA, 64 nt, Human
cuugaauucauuuauaugucuuuugauucuuaaaaaaacaaaaaacauuccauuagaagcacca

SEQ ID NO: 479640 - RNA, 64 nt, Human
ucuagacagguuguagacacacccuccccuaacaaaaacaaaacgaaagaguucauacucugau

SEQ ID NO: 479641 - RNA, 64 nt, Human
cuguaaauaacuugcccugggggccuuuuuuuaaaaaacaaaaaccacaaaaauucccaaacca

SEQ ID NO: 479642 - RNA, 64 nt, Human
aucaacaaucaucaccugccuuuuguagaaaagaaaaacaaaaaaaguaaauaaaaauuuuaaa

SEQ ID NO: 479643 - RNA, 64 nt, Human
aucauaccaaaaaguguaagugaaaacccccuuuaaaacaaaacaaaaaaaugaaauaaaauua

SEQ ID NO: 479644 - RNA, 64 nt, Human
accaaaaaguguaagugaaaacccccuuuaaaacaaaacaaaaaaaugaaauaaaauuaggcaa

SEQ ID NO: 479645 - RNA, 64 nt, Human
cagccugggcgacaagagugaaauuccaucucaaaaaacaaaaacagauugacaacaaagacag

SEQ ID NO: 479646 - RNA, 64 nt, Human
acuguaaccauguuuuuucuguuuaauuauguaaaaaacaaaacuacaacaacaaaaaaagaaa

SEQ ID NO: 479647 - RNA, 64 nt, Human
aaaagaaaaaaguuaaaaaagaaaaaaacaccaaaaaacaaaaacaaacaaaaaaaaaaaccca

SEQ ID NO: 479648 - RNA, 64 nt, Human
aaaaaguuaaaaaagaaaaaaacaccaaaaaacaaaaacaaacaaaaaaaaaaacccacaaccc

SEQ ID NO: 479649 - RNA, 64 nt, Human
auaaugacuggacaucagaagaggaaaaaaacucaaaacaaaagcgagagagacuauugccaua

SEQ ID NO: 479650 - RNA, 64 nt, Human
auuugcucacuucucucuucacccaucuuuuuuaaaaacaaauaaaugaauaaagcugcuguga

SEQ ID NO: 479651 - RNA, 64 nt, Human
guugaaaauauauuagacauucucccugagguuaaaaacaaaaaguacgugaccagucugguaa

SEQ ID NO: 479652 - RNA, 64 nt, Human
gaguuuuguauaugucugauaccguuguuauaacaaaacaaauuuuuuuacuauaguuuuuugu

SEQ ID NO: 479653 - RNA, 64 nt, Human
auccuuauucuuuaagucuaaauucagucuuuucaaaacaaaucacaaaagcagcauuagacau

SEQ ID NO: 479654 - RNA, 64 nt, Human
uuacuuaccucuugcaaaaaaaaugaaaaaugaaaaaacaaauucaaaaccuauucaaaugggu

SEQ ID NO: 479655 - RNA, 64 nt, Human
uuguuuaguauaaauugucauagcugguuuacugaaaacaaacacauuuaaaauugguuuaccu

SEQ ID NO: 479656 - RNA, 64 nt, Human
ugagaauuauuuagaaaagacaugcuccaaaaaaaaaacaaaacugauaaaacaguuuuucgaa

SEQ ID NO: 479657 - RNA, 64 nt, Human
ccuguguuaaacuguuuagugcucuguuuuuaagaaaacaaauguugaaccucacacuuuuaug

SEQ ID NO: 479658 - RNA, 64 nt, Human
gugucaacacucugguuuagcaauaauggguuuaaaaacaaacaauuugauccaagcagguugg

SEQ ID NO: 479659 - RNA, 64 nt, Human
ccaauccuuaaaucaacugcuugaugaaggaggcaaaacaaaggcagcaggagauaaugugauu

SEQ ID NO: 479660 - RNA, 64 nt, Human
cucuguguucuuuugccuucaaucuguugucuucaaaacaaacaaacaaaaaaagcuucuugcg

SEQ ID NO: 479661 - RNA, 64 nt, Human
ugauuuaaaccaguaguauaggaaaaaacuuaaaaaaacaaaaaaaccauguaguauuuucuga

SEQ ID NO: 479662 - RNA, 64 nt, Human
cccuugucuuuucaaguaauuuucauauuaaacaaaaacaaagaaaaaaaaucuuauaaaaagg

SEQ ID NO: 479663 - RNA, 64 nt, Human
gaaaaagaaagcccaaggcaaagaagggggaaggaaaacaaacuucgccacucucucuucuccu

SEQ ID NO: 479664 - RNA, 64 nt, Human
aacauguggaauaaguuuuuuagcugcuaaugacaaaacaaauccuguaacuacccagccagca

SEQ ID NO: 479665 - RNA, 64 nt, Human
cugacuuuguccuucuaaaggauauauuugaagaaaaacaaauuguucaugaaaauggaacauu

SEQ ID NO: 479666 - RNA, 64 nt, Human
uccagacauucuaguuuguggaggguuauuuaaaaaaacaaaaaaggaagauggucaaguuugu

SEQ ID NO: 479667 - RNA, 64 nt, Human
ggcucagucagcaaccucagaacucugaaaaaacaaaacaaaaaaaaaaaaaaaagaaaaaaaa

SEQ ID NO: 479668 - RNA, 64 nt, Human
gcuguggcucagucagcaaccucagaacucugaaaaaacaaaacaaaaaaaaaaaaaaaagaaa

SEQ ID NO: 479669 - RNA, 64 nt, Human
uauuuuaccaagauuauaaaaacacuuuuacaaaaaaacaaaaaccuguaaaaauaauuuugag

SEQ ID NO: 479670 - RNA, 64 nt, Human
cuccacugacuacugacucaaaaauaaaauaauaaaaacaaauuuuuuuaagcacuggggauaa

SEQ ID NO: 479671 - RNA, 64 nt, Human
gaccuugucucaaaaaauaaaaaauaaaaaaauaaaaacaaaauaaggaauccuuuuaaagcau

SEQ ID NO: 479672 - RNA, 64 nt, Human
agccuggcgacagagagagacuccaucucaaaacaaaacaaaaaaaauuagccuacuuaaaggc

SEQ ID NO: 479673 - RNA, 64 nt, Human
acuccagccuggcgacagagagagacuccaucucaaaacaaaacaaaaaaaauuagccuacuua

SEQ ID NO: 479674 - RNA, 64 nt, Human
uaaagcgaggauucugauauuuggcauacuuguaaaaacaaauacauaaguaaccauugaacau

SEQ ID NO: 479675 - RNA, 64 nt, Human
aaauuuccuccauuggggcagcgugggccaaauuaaaacaaacaaaaccgcaacuccuccacag

SEQ ID NO: 479676 - RNA, 64 nt, Human
auaacuuaaaauaauuaaauaaaugaauaaauccaaaacaaacaugcaguacuuuuguuguaug

SEQ ID NO: 479677 - RNA, 64 nt, Human
uggccaccuuggcacaaaagccuugugguauggaaaaacaaauucguuuuuaugucuucuuuuc

SEQ ID NO: 479678 - RNA, 64 nt, Human
ucgugaccaaauuguuuaagaaaaaaaaacaaaaaaaacaaaaucuagggcuguauuuuauaua

SEQ ID NO: 479679 - RNA, 64 nt, Human
aaaggugcaucgugaccaaauuguuuaagaaaaaaaaacaaaaaaaacaaaaucuagggcugua

SEQ ID NO: 479680 - RNA, 64 nt, Human
guauuccagcaaaagaggauguagccucugggaaaaaacaaacauguuacaguguuuuuuguag

SEQ ID NO: 479681 - RNA, 64 nt, Human
cagcacuguauauaccugucucuaaguaaaggaaaaaacaaaauaaggacuucaauccaaaguu

SEQ ID NO: 479682 - RNA, 64 nt, Human
agccacacauuagcugcacugcguggcugcagccaaaacaaagaacuggguguugaguauucau

SEQ ID NO: 479683 - RNA, 64 nt, Human
aaaaaaaaaaaaaaaaaaaaaaaaaaaaauccuaaaaacaaacaaacaaaaaaaacaauucuuc

SEQ ID NO: 479684 - RNA, 63 nt, Human
agaagaaauuaaaaacaugauaaauacaaagggaaaacaaaaagcuacaaaaguagccuuaca

SEQ ID NO: 479685 - RNA, 64 nt, Human
guacuucuaguacuugaguuacuuaauauuuuuaaaaacaaaccuuuuaaguuuaaauggauuu

SEQ ID NO: 479686 - RNA, 64 nt, Human
aaagguggcucuaaauuccuuaagaaagauauccaaaacaaauuaaggggaaaagggaggguug

SEQ ID NO: 479687 - RNA, 64 nt, Human
gaagccagaggauggacuaagugggagaaauuagaaaacaaaacgaacucugguugggguacua

SEQ ID NO: 479688 - RNA, 64 nt, Human
uguguuuaacuuuguauuuugauuguugagaacaaaaacaaaaaguaucaauguguauguggcu

SEQ ID NO: 479689 - RNA, 64 nt, Human
aauaugaucuuccauccaaguggagggaaacuuuaaaacaaaaacacccaguacuguggcucag

SEQ ID NO: 479690 - RNA, 64 nt, Human
ugaagaaaaaaaagaaaaagagaaaaaaaucacaaaaacaaacuuuuuuuauucaaaaguaaca

SEQ ID NO: 479691 - RNA, 64 nt, Human
aguaaaagaaagugaggaaaaggaagugcuucugaaaacaaaccuuucuggacggcagagccca

SEQ ID NO: 479692 - RNA, 64 nt, Human
auaugaaucagaauuauauugauucugugcaaucaaaacaaaaggcagaauagaaugcugagau

SEQ ID NO: 479693 - RNA, 64 nt, Human
ugcugccuuuaauugucuugcucucuaugggaaaaaaacaaaagggcuucagucucauggaugu

SEQ ID NO: 479694 - RNA, 64 nt, Human
uuuuaaaaaaccuuaauguaagauaugaccaguuaaaacaaagcaauucuugaauuauauaacu

SEQ ID NO: 479695 - RNA, 64 nt, Human
cugaaaccgcuuuuuaaaauucaaaacaagaaacaaaacaaaaaaaauuaaggggaaaauuauu

SEQ ID NO: 479696 - RNA, 64 nt, Human
uagugaauuuggaaauaaaaagaaaaaaaaaacaaaaacaaacaggcugccauaauauauuuuu

SEQ ID NO: 479697 - RNA, 64 nt, Human
uuuuguuagugaauuuggaaauaaaaagaaaaaaaaaacaaaaacaaacaggcugccauaauau

SEQ ID NO: 479698 - RNA, 64 nt, Human
acaaguuacaaguugauaucguugaaugaaaagcaaaacaaaaacaauucaggaacaacggcua

SEQ ID NO: 479699 - RNA, 64 nt, Human
cuuuuugauuaagauugccaucuugcuuuuaggcaaaacaaaccaauuaacaaacaaccacaag

SEQ ID NO: 479700 - RNA, 64 nt, Human
ggcaggaaauacuuuguaacuuuguauaugaaucaaaacaaacgagcaggcauuucugugaugu

SEQ ID NO: 479701 - RNA, 64 nt, Human
uuugguuuguccuuuuuuuugcguuuuuaaucagaaaacaaaauagaggcagcuuuuguagauu

SEQ ID NO: 479702 - RNA, 64 nt, Human
cauaguuucuuuauuuuguguaaaaaaaccaccaaaaacaaaaaccaaauguuuauuuucuacg

SEQ ID NO: 479703 - RNA, 64 nt, Human
uuuucaccucaggugucaaaguaaauuuguuaaaaaaacaaaaaaaacacaaaaauuucaaaaa

SEQ ID NO: 479704 - RNA, 64 nt, Human
acuaaauccuuuccaauaauugacugguggaaggaaaacaaaaaacaaaaacuaaaaaccucuu

SEQ ID NO: 479705 - RNA, 64 nt, Human
ccuuuccaauaauugacugguggaaggaaaacaaaaaacaaaaacuaaaaaccucuuagcuuuu

SEQ ID NO: 479706 - RNA, 64 nt, Human
ucucagccuccuagccaaguccuauguaauauggaaaacaaacacugcagacuugagauucagu

SEQ ID NO: 479707 - RNA, 64 nt, Human
uugcaaggacuuuuuuuuaagggucagaguuuucaaaacaaaagcaucuucccuagaaauuuuu

SEQ ID NO: 479708 - RNA, 64 nt, Human
uuuaaagcacuuuuaaaucuuauccugcccccuaaaaacaaaagguuuugaucacaaggggaaa

SEQ ID NO: 479709 - RNA, 64 nt, Human
gauccaggauaauuuuuaaaccaaucaaaugaaaaaaacaaacaaacaaaaaaggaaaugucau

SEQ ID NO: 479710 - RNA, 64 nt, Human
aauuuguguuuauauuuccuguaagugaauaaauaaaacaaaacaaaacaaaaaaaacuugugc

SEQ ID NO: 479711 - RNA, 64 nt, Human
guguuuauauuuccuguaagugaauaaauaaaacaaaacaaaacaaaaaaaacuugugccugau

SEQ ID NO: 479712 - RNA, 64 nt, Human
uauauuuccuguaagugaauaaauaaaacaaaacaaaacaaaaaaaacuugugccugauaagcu

SEQ ID NO: 479713 - RNA, 64 nt, Human
uggccaccuugguauaaaagccuugugguauggaaaaacaaauucguuuuuuauguccucuucu

SEQ ID NO: 479714 - RNA, 64 nt, Human
cugguuagcuaauugaacuuuugugaccuguuuaaaaacaaaucaaauuuauugaacaaaugac

SEQ ID NO: 479715 - RNA, 64 nt, Human
ccagcccguaugacagagugagacccuguuucuaaaaacaaaacaaacaaacaaacaaacaacg

SEQ ID NO: 479716 - RNA, 64 nt, Human
ccguaugacagagugagacccuguuucuaaaaacaaaacaaacaaacaaacaaacaacguaucu

SEQ ID NO: 479717 - RNA, 64 nt, Human
agcuacugcagcaaggcuucuguguacuugccugaaaacaaaggaaggugcuggucauuccauu

SEQ ID NO: 479718 - RNA, 64 nt, Human
uuuaacuccuccuaccccccaagguaagaaacaaaaaacaaacaaacaaacaaaaauagaagac

SEQ ID NO: 479719 - RNA, 64 nt, Human
aaucuagacacuaaaugugugugaauguacaaagaaaacaaaccauugcuuaugcuguuauaua

SEQ ID NO: 479720 - RNA, 64 nt, Human
gagaagugaaguuucacugugguauggccauugaaaaacaaaaacucuucuucuuccccaucag

SEQ ID NO: 479721 - RNA, 64 nt, Human
gucugaugugacguagcaacacccaggucuucuuaaaacaaagucaucagcuuugccagguuac

SEQ ID NO: 479722 - RNA, 64 nt, Human
cuccuagaagucuuaauuguguuuauuuuuuaaaaaaacaaauguuagacuugugugcauggaa

SEQ ID NO: 479723 - RNA, 64 nt, Human
ucugaagacacaaaccugacaggagggagaagaaaaaacaaaacacuugaaccaagaaacucaa

SEQ ID NO: 479724 - RNA, 64 nt, Human
cuaaaacuguucuaaaauagaaagucugugaaaaaaaacaaaaguaaaguuauaaaaggaaaag

SEQ ID NO: 479725 - RNA, 64 nt, Human
uccccucuucucacuacugcacuugacuagucuuaaaacaaagaaagaacgaaugaaugaauga

SEQ ID NO: 479726 - RNA, 64 nt, Human
auuggcuuauucuggaggaaaagcagugaucuguaaaacaaaucaagaauauauuaaaucuaga

SEQ ID NO: 479727 - RNA, 64 nt, Human
ugaaaacuuuaccaucuagagugcucaugcaauuaaaacaaaacaaacacaaacaaggaggcac

SEQ ID NO: 479728 - RNA, 64 nt, Human
acuuuaccaucuagagugcucaugcaauuaaaacaaaacaaacacaaacaaggaggcacuaagc

SEQ ID NO: 479729 - RNA, 64 nt, Human
aauccaacuuuaauaguauacauuuaaaagaaaaaaaacaaaagcccuggaaguugaggccaag

SEQ ID NO: 479730 - RNA, 64 nt, Human
aauuuuauuugugucuuauuuuauuuuaccuucaaaaacaaaaacgccauccaaaaccaaggaa

SEQ ID NO: 479731 - RNA, 64 nt, Human
cugagugacagagcaagaccccaucucaaaaaaaaaaacaaacaaacaaaaaaaaaaccauaua

SEQ ID NO: 479732 - RNA, 64 nt, Human
cuaaguacaguuaacaacccuggauguuacauauaaaacaaacaaaaagacuccgagcgaugga

SEQ ID NO: 479733 - RNA, 64 nt, Human
aauguagauuauaauuuuggucuuuuaggaaaaaaaaacaaaaaucugauauuuauuucaaaau

SEQ ID NO: 479734 - RNA, 64 nt, Human
aaguccucuggguaggaaucagcaagaagauccuaaaacaaaagcucauccauuugcguuccau

SEQ ID NO: 479735 - RNA, 64 nt, Human
uauuuuauacuguuucuacaaaauauuccuuauaaaaacaaagaacaaaaauugaauauuuaau

SEQ ID NO: 479736 - RNA, 64 nt, Human
guguucagggagauaauucugccuuuaauugucuaaaacaaaaacaaaaccagccaaccuaugu

SEQ ID NO: 479737 - RNA, 64 nt, Human
agggagauaauucugccuuuaauugucuaaaacaaaaacaaaaccagccaaccuauguuacacg

SEQ ID NO: 479738 - RNA, 64 nt, Human
agccugggugacagagcgagacuaucucagaaacaaaacaaaacaaaacaacaaaaaaagaaaa

SEQ ID NO: 479739 - RNA, 64 nt, Human
gggugacagagcgagacuaucucagaaacaaaacaaaacaaaacaacaaaaaaagaaaaggcag

SEQ ID NO: 479740 - RNA, 64 nt, Human
ugguuauuccccucuugcucuucuuuaguuugaaaaaacaaaaacguggccuuggaauuuucau

SEQ ID NO: 479741 - RNA, 64 nt, Human
caaaggggugcaugggaaagggcuguugauauuaaaaacaaacaaaacaaaaaagccccacaca

SEQ ID NO: 479742 - RNA, 64 nt, Human
gcaugggaaagggcuguugauauuaaaaacaaacaaaacaaaaaagccccacacauaacuguuu

SEQ ID NO: 479743 - RNA, 64 nt, Human
uugguuuaacucuuuaguuuuauuuuaagaggggaaaacaaaaauaucuugcaagcagaaccuu

SEQ ID NO: 479744 - RNA, 64 nt, Human
cuugggaaacugaaaguguucccauauagcuucaaaaacaaaaacaaauguguuauccgacgga

SEQ ID NO: 479745 - RNA, 64 nt, Human
aaacugaaaguguucccauauagcuucaaaaacaaaaacaaauguguuauccgacggauacuuu

SEQ ID NO: 479746 - RNA, 64 nt, Human
acuaaguuacugaaugaaggaaccucuuucuuacaaaacaaaaaaaagggcagaaaucacccca

SEQ ID NO: 479747 - RNA, 64 nt, Human
uacccgaugaucuucucuauaauauucuuagaguaaaacaaaaucucaaaaguauuaauagcuc

SEQ ID NO: 479748 - RNA, 64 nt, Human
uuucaaaaacauucacaaauauagaaaaguauacaaaacaaaacaguaagauugucuguaauca

SEQ ID NO: 479749 - RNA, 64 nt, Human
gcccucagaacuuuaguaacagcacaacaaauuaaaaacaaaaacaacucaugccacaguaugu

SEQ ID NO: 479750 - RNA, 64 nt, Human
auuuggcaugcuguaaaacaaaacaaaacaaaauaaaacaaaaaaaaggaaggaaaaaaaaaga

SEQ ID NO: 479751 - RNA, 58 nt, Human
aaggauuuggcaugcuguaaaacaaaacaaaacaaaauaaaacaaaaaaaaggaagga

SEQ ID NO: 479752 - RNA, 53 nt, Human
aaggauuuggcaugcuguaaaacaaaacaaaacaaaauaaaacaaaaaaaagg

SEQ ID NO: 479753 - RNA, 64 nt, Human; identical to SEQ ID NO: 479705

SEQ ID NO: 479754 - RNA, 64 nt, Human; identical to SEQ ID NO: 479704

SEQ ID NO: 479755 - RNA, 64 nt, Human
ugucucaaaauguauaauauagaaaugcaagaaaaaaacaaauguacagauuguaaaguuuuuu

SEQ ID NO: 479756 - RNA, 64 nt, Human
ugcagccugaguaacaaaaugagacccuaucucaaaaacaaaaaggaaaagaaaauauacauga

SEQ ID NO: 479757 - RNA, 64 nt, Human
uuagucuuaaacucaaauuacuauaugaugauuuaaaacaaaauaaaagagcgaggaugggggu

SEQ ID NO: 479758 - RNA, 64 nt, Human
gcgggggagggggaacguucauuaaucucugaggaaaacaaaaccuguuuucuacuugagucua

SEQ ID NO: 479759 - RNA, 64 nt, Human
uaauucaccauccagagaccaaauaauuaaaagaaaaacaaauauagauagguagaacuauauu

SEQ ID NO: 479760 - RNA, 64 nt, Human
uuccugcuaaaaagacaaaaaacaaaaaacaaaaaaaacaaaaaaaaccucaugagugcaugga

SEQ ID NO: 479761 - RNA, 64 nt, Human
cucccccucuuccugcuaaaaagacaaaaaacaaaaaacaaaaaaaacaaaaaaaaccucauga

SEQ ID NO: 479762 - RNA, 64 nt, Human
uuauauucucccccucuuccugcuaaaaagacaaaaaacaaaaaacaaaaaaaacaaaaaaaac

SEQ ID NO: 479763 - RNA, 64 nt, Human
ccacagaaaugaugaaagugaccagaaaaaaacaaaaacaaaaccccuuuacucuguaggucau

SEQ ID NO: 479764 - RNA, 64 nt, Human
uuucucccacagaaaugaugaaagugaccagaaaaaaacaaaaacaaaaccccuuuacucugua

SEQ ID NO: 479765 - RNA, 64 nt, Human
ucuuuaaaguauuuacaauaucacuccagaaaagaaaacaaaucaaauaaauauugacucaaaa

SEQ ID NO: 479766 - RNA, 64 nt, Human
gaaaacauuccuucauaguucaguuaguuaaaaaaaaacaaacauuuuuuccuauuacaaaaaa

SEQ ID NO: 479767 - RNA, 64 nt, Human
gugaucggggucaggcaaaggaggggaaacaaugaaaacaaauaaaaguugaacuuguuuuucu

SEQ ID NO: 479768 - RNA, 64 nt, Human
aagcacuucuagaaugucugaaguacaaacaugaaaaacaaacaaaaaaauuaaccgagacacu

SEQ ID NO: 479769 - RNA, 64 nt, Human
cuuuguugcacuuuuaguuuuuuuaaaaaaaacaaaaacaaaaacauggcagaugcauauugug

SEQ ID NO: 479770 - RNA, 64 nt, Human
aacugacuuuguugcacuuuuaguuuuuuuaaaaaaaacaaaaacaaaaacauggcagaugcau

SEQ ID NO: 479771 - RNA, 64 nt, Human
ggcgacacagcgagacuccaucucaaaacaaaacaaaacaaaauuagcugagcaugguggugug

SEQ ID NO: 479772 - RNA, 64 nt, Human
gccugggcgacacagcgagacuccaucucaaaacaaaacaaaacaaaauuagcugagcauggug

SEQ ID NO: 479773 - RNA, 64 nt, Human
cuugagccugggcgacacagcgagacuccaucucaaaacaaaacaaaacaaaauuagcugagca

SEQ ID NO: 479774 - RNA, 64 nt, Human
gccagggccaaaggaaaaagcccugcugcauuuaaaaacaaaguguccaagcugucaguggugu

SEQ ID NO: 479775 - RNA, 64 nt, Human
ucacugugcagagggauuguaccuuguacaaaauaaaacaaauuucucaaacuaauuuaacaag

SEQ ID NO: 479776 - RNA, 64 nt, Human
ccaagcccuaaagagaaccuucucacaagaauuaaaaacaaaaagggcaaaccuaggaagcuaa

SEQ ID NO: 479777 - RNA, 64 nt, Human
ugcuuuuuuaagaauauauauaucuauauaaauuaaaacaaagaaacaaacaaacaaaaaacaa

SEQ ID NO: 479778 - RNA, 64 nt, Human
aguaauaauuauuuaaaaaaccacacacaccagaaaaacaaaagacagcagaaaauaaccaggu

SEQ ID NO: 479779 - RNA, 64 nt, Human
gacagggaauuuuuucccccucuauguacaaaaaaaaacaaagcucucuuuccuucucugguga

SEQ ID NO: 479780 - RNA, 64 nt, Human
ugagcuuaaauguacuuuacugagcaaaguuuaaaaaacaaaguauauuuuauuuuaugauaaa

SEQ ID NO: 479781 - RNA, 64 nt, Human
aaauuuuuuucauguaggagcugaaagaucuccgaaaacaaagugaaaucauaccucagcucau

SEQ ID NO: 479782 - RNA, 64 nt, Human
guuuguaguugaaaaguuuacuguaaaaaaaucaaaaacaaaaaaauguauuguuuuuacagaa

SEQ ID NO: 479783 - RNA, 64 nt, Human
ccagcugaccaggcuugugcucagagaagcagacaaaacaaagauucaagguuuuaauuaauuc

SEQ ID NO: 479784 - RNA, 64 nt, Human
ugcauucggugccaacauuuuuuagagcuguaccaaaacaaaaagccuguacucacaucacaau

SEQ ID NO: 479785 - RNA, 64 nt, Human
cucccccuugggacgcgcucuaaauaauugcaauaaaacaaaccuuucucugcaaaccauuucc

SEQ ID NO: 479786 - RNA, 64 nt, Human
cugucuuauuucuaaauuuccuucuuccaagaugaaaacaaaagaaaaacuuaaaacagaaggu

SEQ ID NO: 479787 - RNA, 64 nt, Human
caagagauucccaccauuauuuagguucaccugcaaaacaaaaaucuuacuccagccccucaau

SEQ ID NO: 479788 - RNA, 64 nt, Human
acauccaauagaaacauuggcagcauggucuuccaaaacaaaaagcaguaacaugcauguuuaa

SEQ ID NO: 479789 - RNA, 64 nt, Human
ugaaccugccaauccgcuguaacaacucugcuuuaaaacaaaaccaaacaaaacuuuaaaaaaa

SEQ ID NO: 479790 - RNA, 64 nt, Human
uuuuucaaggguuucccugugcuagcugagaugcaaaacaaaucauggaagauugcauaccugu

SEQ ID NO: 479791 - RNA, 64 nt, Human
aguagugauaaacaccuuaaucauaaaaugaauaaaaacaaaaaaaccauggggcuugucugca

SEQ ID NO: 479792 - RNA, 64 nt, Human
gacuucaguaaagaaugaaaaguaccuuuagauaaaaacaaagaagaguaauauaugcagcaca

SEQ ID NO: 479793 - RNA, 64 nt, Human
ugugcacuuuuuguguguguaaugcaaauuaguuaaaacaaauaguuuuggagaaaguuaaaac

SEQ ID NO: 479794 - RNA, 64 nt, Human
aauuuaaaguuguuucauuaauuaccauaucuauaaaacaaacauaguaucugucaaucucuag

SEQ ID NO: 479795 - RNA, 64 nt, Human
cuauccugacuuaauauccaguugugggguuugcaaaacaaaacagcuguauguaaucauugcc

SEQ ID NO: 479796 - RNA, 64 nt, Human
agccugggcagcauagcaagauccccaucuuuuaaaaacaaaauaaaacaauaaagacugcaag

SEQ ID NO: 479797 - RNA, 64 nt, Human
auuggccgggacacacgguuuuguaaaaaauuaaaaaacaaaaaaagagcauagaaagcccugu

SEQ ID NO: 479798 - RNA, 64 nt, Human
acagaauggaucaugaagacugacaacugcaaaaaaaacaaaacaaaacaaaaaaaaaagcaag

SEQ ID NO: 479799 - RNA, 64 nt, Human
gugaugauccuucagaaaaggaugccucuguuuaaaaacaaauugcuuuugugucccugaagua

SEQ ID NO: 479800 - RNA, 64 nt, Human
uguuuuguggucagcuguaguccucauaaaaagcaaaacaaaaauuagguauuuuguccuaaaa

SEQ ID NO: 479801 - RNA, 64 nt, Human
aacucaccauuucauccauauuucuuuuucuugcaaaacaaacauacccaucugcaccgacgcc

SEQ ID NO: 479802 - RNA, 64 nt, Human
aaaaaaauuuuuaaauaccacaagauggaaaaaaaaaacaaaaaaauuuaaaaagauggaaugu

SEQ ID NO: 479803 - RNA, 64 nt, Human
uucugguggcugcugucaugagaugauaaaauguaaaacaaaacucuagucaacguagaaagag

SEQ ID NO: 479804 - RNA, 64 nt, Human
gauuuaauuugcuaaauagacuaacaggaggaaaaaaacaaacagccuagcuuuaaaaaacagu

SEQ ID NO: 479805 - RNA, 64 nt, Human
ucaucuuaccccuuuaugccaccuacugaaaagaaaaacaaauagcuagguuugguuuccuguu

SEQ ID NO: 479806 - RNA, 64 nt, Human
agugaggaguaaaaaagauuuuuaaaaagcaaagaaaacaaaauauaagggaaaaauaugagaa

SEQ ID NO: 479807 - RNA, 64 nt, Human
agucagacuaaaguuuucacuguguuuguuuggcaaaacaaauuaaacaaaaaguaagguuuuu

SEQ ID NO: 479808 - RNA, 64 nt, Human
gagaucuugugguuccaugagaauuauuacuuuaaaaacaaaacaaaauauaaaaaacuguguu

SEQ ID NO: 479809 - RNA, 64 nt, Human
cuugugguuccaugagaauuauuacuuuaaaaacaaaacaaaauauaaaaaacuguguuugagu

SEQ ID NO: 479810 - RNA, 64 nt, Human
guaucauguuauuuagccaaugcaaaucuguuuuaaaacaaauaguuuaaaaaaagaacaaguu

SEQ ID NO: 479811 - RNA, 64 nt, Human
gagcuggaugcccuuuugaaggaucuguacgagaaaaacaaaaaggugagcagccaagccugag

SEQ ID NO: 479812 - RNA, 64 nt, Human
agcuugggcgacagaucaagacucugucacacacaaaacaaacaaacaaauuuucccguuucuc

SEQ ID NO: 479813 - RNA, 64 nt, Human
cuaauguauauuguauuuuuugguaaggaccaaaaaaacaaacaaaaaaaagaccaucaguaag

SEQ ID NO: 479814 - RNA, 64 nt, Human
caaauaauaaaggucugcuguggcuaaaaaagcaaaaacaaaaaagcuauccagacaaaauaca

SEQ ID NO: 479815 - RNA, 64 nt, Human
cuaauaaaugcagaaucugaagguaaauagguuuaaaacaaaacaaaaacccaccccuuuaagg

SEQ ID NO: 479816 - RNA, 64 nt, Human
aaaugcagaaucugaagguaaauagguuuaaaacaaaacaaaaacccaccccuuuaaggaguug

SEQ ID NO: 479817 - RNA, 64 nt, Human
cuucagccuuguacuguguauauauauuaaaaaaaaaacaaaguuuuguauguuuuuauuacuu

SEQ ID NO: 479818 - RNA, 64 nt, Human
cauuguaaauuugaaacaaagaccgaucuguguaaaaacaaauuuccauauguuuuauauaaau

SEQ ID NO: 479819 - RNA, 64 nt, Human
acgacuguaggaggaaaaauuaaggggagagaggaaaacaaaaccaaccaaccccuaaaaucau

SEQ ID NO: 479820 - RNA, 64 nt, Human
ucaggucucuggagcuccucucuucaccccuggaaaaacaaaugaucuguuaacaaaggacugc

SEQ ID NO: 479821 - RNA, 64 nt, Human
cagaauaggauugugugauaauguuuaaauggcaaaaacaaaacaugauuuugugcaauuaaca

SEQ ID NO: 479822 - RNA, 64 nt, Human
cuaaacagaggaagucuucagaagaccucgcuuuaaaacaaauuugugcaaacacugcuagagu

SEQ ID NO: 479823 - RNA, 64 nt, Human
acaguuuugcaccacggcaagaaaaccaaaaaccaaaacaaacaaacaaaaaaaacccaacaac

SEQ ID NO: 479824 - RNA, 64 nt, Human
aggcuucagagguaccuggcaccuuacucaagcaaaaacaaaaaacagcuuuacuucaaaagca

SEQ ID NO: 479825 - RNA, 64 nt, Human
auuccaccugacccuguguguacaauccaggaaaaaaacaaaccccacucagaaacagagaaaa

SEQ ID NO: 479826 - RNA, 64 nt, Human
uuuacaugggaaggaaaucaugccaaaaaaauccaaaacaaagaaguaccuggaguggagagag

SEQ ID NO: 479827 - RNA, 64 nt, Human
cagaggaggagaaugucucaaaaaaaaaggacaaaaaacaaacccagagccacuccuuuaauac

SEQ ID NO: 479828 - RNA, 64 nt, Human
cuaugugccagggacaguuccaggcacuggagauaaaacaaacaaagcaaaccaaagccccggc

SEQ ID NO: 479829 - RNA, 64 nt, Human
uauauguuucaauugaucuguuagaauaaccaagaaaacaaaaugcuggaguuucucuauaaau

SEQ ID NO: 479830 - RNA, 64 nt, Human
ucucuccucauccuaguucuuuaaaaaaaacaaaaaaacaaaaaaaacuuuuuuuaaucguugu

SEQ ID NO: 479831 - RNA, 60 nt, Human
cggcucucuccucauccuaguucuuuaaaaaaaacaaaaaaacaaaaaaaacuuuuuuua

SEQ ID NO: 479832 - RNA, 64 nt, Human
ucuuuacacuucguauguauuuuaaagaagaaaaaaaacaaaaaaaauucccuggcuauuccuc

SEQ ID NO: 479833 - RNA, 64 nt, Human
cuauuuuuuuccuuuuuuaauucaguuuuuuaaaaaaacaaauguauuguggcuuccaguuacc

SEQ ID NO: 479834 - RNA, 64 nt, Human
caaguuggugauagcuuauuauuuucauaaguaaaaaacaaaugagauuauauauauauauaua

SEQ ID NO: 479835 - RNA, 64 nt, Human
ucuuuguucaaauguauuuccucuuauuauaaauaaaacaaauauuacauggaguuuggaaaau

SEQ ID NO: 479836 - RNA, 64 nt, Human
cagcuacuccccuuucuuccaaacuuuugcagaaaaaacaaaaaaacuacaaacaaaagcagcc

SEQ ID NO: 479837 - RNA, 64 nt, Human
uuuuacaguaagauuuguugcucucagacuguguaaaacaaaauuuauucauguuuucugcaua

SEQ ID NO: 479838 - RNA, 62 nt, Human
gucucuauuuuuuuaaauaaauaaacuacaugugaaaacaaacguuuauauuuauaaacccu

SEQ ID NO: 479839 - RNA, 64 nt, Human
acaaauauuaaagauuuccuuggagucagaggaaaaaacaaacaauuauaauguugucuaggga

SEQ ID NO: 479840 - RNA, 64 nt, Human
guugggcuuuaaaagaaaagguuuggcagaacuaaaaacaaaacucacguaucaucucaauaga

SEQ ID NO: 479841 - RNA, 64 nt, Human
cuccaucucuucagaccccuuugccuuuaaaaaaaaaacaaaaacaaaaacaaaaaaacccaua

SEQ ID NO: 479842 - RNA, 64 nt, Human
cucuucagaccccuuugccuuuaaaaaaaaaacaaaaacaaaaacaaaaaaacccauaaugccc

SEQ ID NO: 479843 - RNA, 64 nt, Human
agaccccuuugccuuuaaaaaaaaaacaaaaacaaaaacaaaaaaacccauaaugcccacagaa

SEQ ID NO: 479844 - RNA, 64 nt, Human
cauuggaauucuacuggaaaaaaauacaaaaagcaaaacaaaacccucagcacuguuacaagag

SEQ ID NO: 479845 - RNA, 64 nt, Human
aagggcaaggaguuuauuacaauguaucuuuauuaaaacaaaaggguguauaguguucacaaac

SEQ ID NO: 479846 - RNA, 64 nt, Human
uucuauuuuuucuucuccccuaccuguuauauuuaaaacaaagaaaagcacaacuugagauuuu

SEQ ID NO: 479847 - RNA, 64 nt, Human
agcuucuuccccugggaaaaaacccaaagaaccaaaaacaaaccaccccaaggauaauaauagc

SEQ ID NO: 479848 - RNA, 64 nt, Human
cuuuauacuagauucuaucaaaaucuugcaaaggaaaacaaaaugaacaacuucuacccuuaaa

SEQ ID NO: 479849 - RNA, 64 nt, Human
ccugcacuggacaguaaaaaaauaauaaaagacaaaaacaaauuuaaaaaaaaauuuaagccac

SEQ ID NO: 479850 - RNA, 64 nt, Human
cgacagaaccagacuccgucucaaaaaaaaaaaaaaaacaaaaaaggcugaaggcagcuguagc

SEQ ID NO: 479851 - RNA, 64 nt, Human
cugggcaaaaagagugagacucugucucaaaaaaaaaacaaaacaaaaaaaaccucuuugcugg

SEQ ID NO: 479852 - RNA, 64 nt, Human
caaaaagagugagacucugucucaaaaaaaaaacaaaacaaaaaaaaccucuuugcugguauau

SEQ ID NO: 479853 - RNA, 64 nt, Human
agaccccaaacaguacuuuuacuuuguuuguacaaaaacaaagacauauagccaauacaaauca

SEQ ID NO: 479854 - RNA, 64 nt, Human
gggcaacaaagugagacucugucucaaaaaaaaaaaaacaaaaaaaaaccuuuaaugucuggcu

SEQ ID NO: 479855 - RNA, 64 nt, Human
acaugcacuuuugggccuuuuuuuauagcuggaaaaaacaaaauaccacccuacaaaccuguau

SEQ ID NO: 479856 - RNA, 64 nt, Human
gucuucauuuuagugcuuuacacauucgggccugaaaacaaauaugaccuuuuuuacuugaagc

SEQ ID NO: 479857 - RNA, 64 nt, Human
cuccuuucccuaaggaaccauagaagagaggaagaaaacaaagggcaugugugagggaagcugc

SEQ ID NO: 479858 - RNA, 64 nt, Human
cuuuuuuuuuucuuuuuuaauaaaguuaaacaguaaaacaaaaauucacaagcugccucccugu

SEQ ID NO: 479859 - RNA, 64 nt, Human
ggacuuggaggguugguccucuugccuccuggaaaaaacaaaaacaaaaaacugcagugaaaga

SEQ ID NO: 479860 - RNA, 64 nt, Human
ggaggguugguccucuugccuccuggaaaaaacaaaaacaaaaaacugcagugaaagacaagcu

SEQ ID NO: 479861 - RNA, 64 nt, Human
ccugggcgauagagcuagacucugucucaaaaaaaaaacaaaaaacaaguaacucuuuauuccu

SEQ ID NO: 479862 - RNA, 64 nt, Human
accuaauuguccaauucuacgugcucucuauaccaaaacaaaaaaaaaaagcuauccaccuuuc

SEQ ID NO: 479863 - RNA, 64 nt, Human
uucccuucugugugaccgaccccuuggccaaaaaaaaacaaaaagcaaaaaacaaaaaccuacc

SEQ ID NO: 479864 - RNA, 64 nt, Human
accgaccccuuggccaaaaaaaaacaaaaagcaaaaaacaaaaaccuacccuguucugguuuuu

SEQ ID NO: 479865 - RNA, 64 nt, Human
gcagggcuuaauacauuagugguaacugguuuaaaaaacaaagacuguaagccugugugugcca

SEQ ID NO: 479866 - RNA, 64 nt, Human
auaaguacaauuguuacaaauaacgcagacuucaaaaacaaaaaaaucacaacccaaacaaacc

SEQ ID NO: 479867 - RNA, 64 nt, Human
agcuuuccaucucuggcucuauaugcuuuaucccaaaacaaagcagauaacguucagacgucgg

SEQ ID NO: 479868 - RNA, 64 nt, Human
agagggguuuuuuguguauugcgugaaaacuuauaaaacaaauguuaacagaauggaauuuuuu

SEQ ID NO: 479869 - RNA, 64 nt, Human
gcuugaagaguuuucuaauucguuucuagugagcaaaacaaagaaggugcuugagucacugaaa

SEQ ID NO: 479870 - RNA, 64 nt, Human
auuuucccuaccuaagaauuucacugucuuuuaaaaaacaaaaaguaaaguaaugcauuugagc

SEQ ID NO: 479871 - RNA, 64 nt, Human
gucaguuucaaaucaaauuaucuaagaaaacaagaaaacaaaggcagcagacuauugguacaca

SEQ ID NO: 479872 - RNA, 64 nt, Human
auucugaucugcaaauagcuuaaaugucucuugcaaaacaaaguaagauaccaccaguauuaca

SEQ ID NO: 479873 - RNA, 64 nt, Human
auccuggcuucucucucuguucuaguuuuggcugaaaacaaaacaacaaaaggaacagauccuu

SEQ ID NO: 479874 - RNA, 64 nt, Human
cauauuuuugcacaguggagcuuacacuuaaaagaaaacaaagccccaugggcugccuugaaau

SEQ ID NO: 479875 - RNA, 64 nt, Human
aaaauuauuuauuuuguaaggagagguuuuaauuaaaacaaaaaaaaauucuuuuuuuuuuuuu

SEQ ID NO: 479876 - RNA, 64 nt, Human
uuguccaucccuuuuuucuuuguuguuuuuguugaaaacaaacuggaaacuuguuucuuuuuuu

SEQ ID NO: 479877 - RNA, 64 nt, Human
agaaaaacaggaaaaaggacuuuuuuuuuccugaaaaacaaaaaccgaucugcauggacuccgg

SEQ ID NO: 479878 - RNA, 64 nt, Human
gaaacacagcauggaauuaacauuaaacuuaaauaaaacaaaccuaaauuaaaaaugccaaaua

SEQ ID NO: 479879 - RNA, 64 nt, Human
gcugaacuaaggauuguauuggugauuucuagcaaaaacaaagugauagaauuuuugucuagaa

SEQ ID NO: 479880 - RNA, 64 nt, Human
guauuccuaacagucuuuuguugucguuguuuuuaaaacaaagguacggaccaugugcuauaua

SEQ ID NO: 479881 - RNA, 64 nt, Human
ugcacauuuaaagagaagcaucuaccacggcuuuaaaacaaaacaacucugagaugaacaauau

SEQ ID NO: 479882 - RNA, 64 nt, Human
guuuaaugucucucugaaugcaguuuuaaaauagaaaacaaaacugacuucuguagaaguuucc

SEQ ID NO: 479883 - RNA, 64 nt, Human
aacaagaguaaaacuucaucucaaaaaacaaaacaaaacaaaaacaacaacaaaaaacaaaaga

SEQ ID NO: 479884 - RNA, 64 nt, Human
uggucaacaagaguaaaacuucaucucaaaaaacaaaacaaaacaaaaacaacaacaaaaaaca

SEQ ID NO: 479885 - RNA, 64 nt, Human
cagccuggucaacaagaguaaaacuucaucucaaaaaacaaaacaaaacaaaaacaacaacaaa

SEQ ID NO: 479886 - RNA, 64 nt, Human
uaugaucugucaugugccaccugagccuccaguaaaaacaaaaacaggcuuuccuguggucuug

SEQ ID NO: 479887 - RNA, 64 nt, Human
cuccccuuauucccgaggcccagaaaagaaaacaaaaacaaaaacccagcacauacaagaaaca

SEQ ID NO: 479888 - RNA, 64 nt, Human
acucuccuccccuuauucccgaggcccagaaaagaaaacaaaaacaaaaacccagcacauacaa

SEQ ID NO: 479889 - RNA, 64 nt, Human
uccccauucugugcccuacuauuuucaacaaaacaaaacaaacaagcaaaaaacacaaaaaccu

SEQ ID NO: 479890 - RNA, 64 nt, Human
uccucuccccauucugugcccuacuauuuucaacaaaacaaaacaaacaagcaaaaaacacaaa

SEQ ID NO: 479891 - RNA, 64 nt, Human
agaccauuuuauaaaacaugguaagacccuuuuuaaaacaaacuccaggcccuugguugcgggu

SEQ ID NO: 479892 - RNA, 64 nt, Human
ugauggaaguucauuuggagagucaaaugggaaaaaaacaaacaaaaaacugccuuugauacag

SEQ ID NO: 479893 - RNA, 64 nt, Human
guuuacaugugagugaaacugcacaaaggaacacaaaacaaaacuugcacuuuaacgguaguuc

SEQ ID NO: 479894 - RNA, 64 nt, Human
acaaauauuaaagauuuccuuggagucaaaguaaaaaacaaaaaauuguaauguugucuaggga

SEQ ID NO: 479895 - RNA, 64 nt, Human
ucuuuggcauuaaucuaauuuuaauguacugauaaaaacaaacaugguuuuccuuuacuuugac

SEQ ID NO: 479896 - RNA, 64 nt, Human
aucaagagauacucuugauaauuugaauagggccaaaacaaaguuggugaccuaaaggcuuguu

SEQ ID NO: 479897 - RNA, 64 nt, Human
ugaacugaaaauuucgcuuuuauaguaggaaggcaaaacaaaaaaaagccucucaaaaccaaaa

SEQ ID NO: 479898 - RNA, 64 nt, Human
gguaaaggggcagaugcuuuuuauuaguacugauaaaacaaacugagggaaacaucccucuuag

SEQ ID NO: 479899 - RNA, 64 nt, Human
ugaauugaguauauauuugaaaaggaaaaaacaaaaaacaaacccagaccccaccugaauuggg

SEQ ID NO: 479900 - RNA, 64 nt, Human
cagagguugaauugaguauauauuugaaaaggaaaaaacaaaaaacaaacccagaccccaccug

SEQ ID NO: 479901 - RNA, 64 nt, Human
ugugguuugaauccagagagauacuucuuauagaaaaacaaauguuuaugcuaaaaauaacacc

SEQ ID NO: 479902 - RNA, 64 nt, Human
acuuagggaacuugaaaccaacuggcucauggagaaaacaaauuugacuugggaaagggauuau

SEQ ID NO: 479903 - RNA, 64 nt, Human
auuuuguucauguuuuacaugaacuaauggauaaaaaacaaaguauacauauaugucuauauau

SEQ ID NO: 479904 - RNA, 62 nt, Human
uauaaagggggaaauuguuuggcagcaccaacagaaaacaaacaaacaaaaaacagcuaccu

SEQ ID NO: 479905 - RNA, 64 nt, Human
cccuucacacagaccauuauuuacagaugcauggaaaacaaagucuccaagaaaacacuucugu

SEQ ID NO: 479906 - RNA, 64 nt, Human
gcucuccaacucugcagcaguggcagcagcagucaaaacaaacacggggggcggugggugggau

SEQ ID NO: 479907 - RNA, 64 nt, Human
aaguuugcuggggaguuugauaaaaguauaaaacaaaacaaaaaaagccucgguauaauuuugu

SEQ ID NO: 479908 - RNA, 64 nt, Human
ucagcaaguuugcuggggaguuugauaaaaguauaaaacaaaacaaaaaaagccucgguauaau

SEQ ID NO: 479909 - RNA, 64 nt, Human
agugaugaauauuacuaauaguggucaugagaauaaaacaaaaggugauucuauucagaaugag

SEQ ID NO: 479910 - RNA, 64 nt, Human
aguugugaugcucucuucugacagccaaagaugaaaaacaaacagaaaaaaaaaaguaaagagu

SEQ ID NO: 479911 - RNA, 64 nt, Human
uucaccauugugauuuuguuuauuuuuucuauuaaaaacaaaaagucacacauucaacaaggug

SEQ ID NO: 479912 - RNA, 64 nt, Human
aguugaauuaagaaacucuaaagguuauaaaaugaaaacaaaaaauaaaauauuuguuuucugc

SEQ ID NO: 479913 - RNA, 64 nt, Human
cugaauaacccuuuuagcauugaaaaaaaaaacaaaaacaaaaaauggaaaaaaaaaaccuugu

SEQ ID NO: 479914 - RNA, 64 nt, Human
aaaauucugaauaacccuuuuagcauugaaaaaaaaaacaaaaacaaaaaauggaaaaaaaaaa

SEQ ID NO: 479915 - RNA, 64 nt, Human
auccucugcaugucuacacuugcacauaaugcaaaaaacaaaauaaaauaaucuuccuguuuug

SEQ ID NO: 479916 - RNA, 64 nt, Human
uacuaccuagaaguaagaagaggagccucagaagaaaacaaaguucuauuuuauuaauuuucua

SEQ ID NO: 479917 - RNA, 64 nt, Human
auagggaaguaaaaaaacaaaacaaaaaacaaaaaaaacaaaaaaaaaacccuauuuaaaugaa

SEQ ID NO: 479918 - RNA, 64 nt, Human
ucaaaucgaauagggaaguaaaaaaacaaaacaaaaaacaaaaaaaacaaaaaaaaaacccuau

SEQ ID NO: 479919 - RNA, 64 nt, Human
aggaaacucaaaucgaauagggaaguaaaaaaacaaaacaaaaaacaaaaaaaacaaaaaaaaa

SEQ ID NO: 479920 - RNA, 64 nt, Human
gaaucaggaaacucaaaucgaauagggaaguaaaaaaacaaaacaaaaaacaaaaaaaacaaaa

SEQ ID NO: 479921 - RNA, 64 nt, Human
uuuuucuaaaaaacaaacaaaaaaaaaaacacacaaaacaaaaacagaacaaaagaagagagaa

SEQ ID NO: 479922 - RNA, 64 nt, Human
gauuuuauuucuucucccccaccccuuuuucuaaaaaacaaacaaaaaaaaaaacacacaaaac

SEQ ID NO: 479923 - RNA, 64 nt, Human
acaacuuugguuuuaaaagcuguugaaaaauaggaaaacaaagggcauuguucacagauagggc

SEQ ID NO: 479924 - RNA, 64 nt, Human
auaguaaaucaguaagucacuucuaaauuuaaagaaaacaaaauuggaguugaagaauaaguag

SEQ ID NO: 479925 - RNA, 64 nt, Human
gagcuacaccuugauccucuccuggcaugaaaauaaaacaaagguuuucguuguuguuguucca

SEQ ID NO: 479926 - RNA, 64 nt, Human
acaaauauuaaagauuuccuuggagucagaguaaaaaacaaacaauuauaauguugucuaggga

SEQ ID NO: 479927 - RNA, 64 nt, Human
ugugggguagugauuuggcaaguguuuuuuaaauaaaacaaaucucauuguaaagcuaucaguc

SEQ ID NO: 479928 - RNA, 64 nt, Human
uuuaagcuuuuuuuuuuugcuuguuuuuaaagccaaaacaaaaaacaaccaagcacucuuccau

SEQ ID NO: 479929 - RNA, 64 nt, Human
uccacagguaacaccaugauguaggcauaaauggaaaacaaaaacccuacuauuucaaauauau

SEQ ID NO: 479930 - RNA, 64 nt, Human
gcccauagaugcauuggcuccauccaacaccugaaaaacaaacuuggcaaggauuacauucuag

SEQ ID NO: 479931 - RNA, 64 nt, Human
acucaucacauccccgaugcuaaauuaaaaacagaaaacaaagaaaagcuuguauauacuuugc

SEQ ID NO: 479932 - RNA, 64 nt, Human
cauuugguuuauuuagaaaaaggaagaaaaacaaaaaacaaaaaacuaaagggugagaauuugc

SEQ ID NO: 479933 - RNA, 64 nt, Human
caccaagcauuugguuuauuuagaaaaaggaagaaaaacaaaaaacaaaaaacuaaagggugag

SEQ ID NO: 479934 - RNA, 64 nt, Human
cuccuccuucaccccuccucucacugccugccagaaaacaaaaacaccaagaaaccaagucaac

SEQ ID NO: 479935 - RNA, 64 nt, Human
ggcaaucugucuuuaaguagggauaaauuacucuaaaacaaaaaagaauccuagauaguuuucc

SEQ ID NO: 479936 - RNA, 64 nt, Human
gaguuguuuuuuuuuuaacaacugggaaaaaacaaaaacaaaaaacuauaguuagaaaaaugga

SEQ ID NO: 479937 - RNA, 64 nt, Human
aacugugaguuguuuuuuuuuuaacaacugggaaaaaacaaaaacaaaaaacuauaguuagaaa

SEQ ID NO: 479938 - RNA, 64 nt, Human
ccacacacguuggucuuuuaaccgugcugagcagaaaacaaaacagguuaagaagagccgggug

SEQ ID NO: 479939 - RNA, 64 nt, Human
cuccaaguagcuccaaaugcaauuuuuaaaauggaaaacaaaaaucugaaagaaacgucuuuag

SEQ ID NO: 479940 - RNA, 64 nt, Human
aaaaaguuccaugacucgaauaucugaaaugaagaaaacaaaccgacucacaaaccuccaagua

SEQ ID NO: 479941 - RNA, 64 nt, Human
cggaagacaaaccccacacacacucaaggggucgaaaacaaaccccacacgagggcucucaccu

SEQ ID NO: 479942 - RNA, 64 nt, Human
cuuuaaugaucucuuacgguuagaaaacacaauaaaaacaaacuguucggcuacuggacagguu

SEQ ID NO: 479943 - RNA, 64 nt, Human
agcauuauggaugaccucaucagcuccccaggcaaaaacaaaagugggaggggacacaugcuca

SEQ ID NO: 479944 - RNA, 64 nt, Human
uaaagucaaagugcuccaacagaaggaggaagugaaaacaaacuauuaguauuuauugauauuc

SEQ ID NO: 479945 - RNA, 64 nt, Human
aauuaauguuuucaaaugugcaacucuaguuuuuaaaacaaaauuugguucuuuacauucauua

SEQ ID NO: 479946 - RNA, 64 nt, Human
uagagcaaaugcuagagcgauuucagcugauagaaaaacaaaaaugaaaaaaaaaacacaaaaa

SEQ ID NO: 479947 - RNA, 64 nt, Human
ugauagaaaaacaaaaaugaaaaaaaaaacacaaaaaacaaaaaacauggcacguugcuaguuu

SEQ ID NO: 479948 - RNA, 64 nt, Human
gucaccuccaaaugaggacaacagauaccaaaagaaaacaaaggaaaaagacaccggauuccua

SEQ ID NO: 479949 - RNA, 64 nt, Human
cagcaaugauaaugauggccucucucaaaagagaaaaacaaaaccccuaagagacugcguucug

SEQ ID NO: 479950 - RNA, 64 nt, Human
ucacgggguucggaagccacaccucuacaugucuaaaacaaaaaacaacaacaacagauacccc

SEQ ID NO: 479951 - RNA, 64 nt, Human
aauggcuaauauuuuggugcaguguuugauguucaaaacaaaauguuacaacaauaaacgaaca

SEQ ID NO: 479952 - RNA, 64 nt, Human
aacuugcuuccaaaguaagugaauagaauacaauaaaacaaaacaaugacacaaaaccacaauc

SEQ ID NO: 479953 - RNA, 64 nt, Human
uguagaaaucaaauuacuaucauuuuuuguugccaaaacaaagucuuacauuuaaccccccuuu

SEQ ID NO: 479954 - RNA, 64 nt, Human
uacaugaaauugcacuuaaccaaaacuauuguguaaaacaaauuuuaauuccucaggguuuuaa

SEQ ID NO: 479955 - RNA, 64 nt, Human
uuugucuuucuuuuuccuuuuuuuuuaaaaaaacaaaacaaacaaaacaccuugaaucaaguuu

SEQ ID NO: 479956 - RNA, 64 nt, Human
uuuccuuugucuuucuuuuuccuuuuuuuuuaaaaaaacaaaacaaacaaaacaccuugaauca

SEQ ID NO: 479957 - RNA, 64 nt, Human
gaaaugagccaaacuauuuaaauuuuaaaacaguaaaacaaaaugaaacuuaauagcucacaaa

SEQ ID NO: 479958 - RNA, 64 nt, Human
uucuauuuuuauaaagauaaauacuuaguagauaaaaacaaauuuuaaguuuaguuuucagaca

SEQ ID NO: 479959 - RNA, 64 nt, Human
ucauuucuguguccucaauuuuaucugaaagauuaaaacaaaauauauuaugucacuauucagu

SEQ ID NO: 479960 - RNA, 64 nt, Human
augguaaauuuuauauuuguauauuuacaguuacaaaacaaauguacuuuuaccuuuuauuucu

SEQ ID NO: 479961 - RNA, 64 nt, Human
gcccuugucaauuuaagacuaagacuuugaagguaaaacaaacaaacaaacaucagucuuaguc

SEQ ID NO: 479962 - RNA, 64 nt, Human
ccauggaauaacugauggaugguuagaaauguuaaaaacaaagcaaaugcaaacaucucugcuu

SEQ ID NO: 479963 - RNA, 64 nt, Human
gagguuucagcauucccaauuaucaaaaaacagaaaaacaaaaaaaagaaagaaaaaagugcaa

SEQ ID NO: 479964 - RNA, 64 nt, Human
aauucuuugauuuauuuuauugcaucaaugaauuaaaacaaaaaucuugggggaagaaauuggc

SEQ ID NO: 479965 - RNA, 64 nt, Human
aaagauuaugaaaggaacaggcucuuuaaaaaagaaaacaaaaagccagaaucuuccuuuuuuu

SEQ ID NO: 479966 - RNA, 64 nt, Human
cacuucgagcuauuuagcuaaagcccaccaaaccaaaacaaaauacugauuuuuuuuuuuuuuu

SEQ ID NO: 479967 - RNA, 64 nt, Human
uauuuagggaagaagauuaaacucucuuuucaaaaaaacaaagugaaaugccuggauucacauu

SEQ ID NO: 479968 - RNA, 64 nt, Human
uaugcauauaaaagugauggaauuaaugugaaauaaaacaaaaauauaauggcuagaauacaaa

SEQ ID NO: 479969 - RNA, 64 nt, Human
uugcuaaggcuuuuaauacauuuugaauggcaccaaaacaaaauaagucaaaauggacagucau

SEQ ID NO: 479970 - RNA, 64 nt, Human
gcaaauagucucuauuuguaauugaacuuauccuaaaacaaauaguuuauaaaugugaacuuaa

SEQ ID NO: 479971 - RNA, 64 nt, Human
gccugggcgacugaauaaaacucugucucaaaaaaaaacaaaaacgguaagcuuuuauauuuaa

SEQ ID NO: 479972 - RNA, 64 nt, Human
auucuauuugugcuuuuaaagugugucuguugggaaaacaaaauguguaggugguuuguaagug

SEQ ID NO: 479973 - RNA, 64 nt, Human
agagaaaauauagaauuccuggauaagaccaaacaaaacaaaacauuaaaauaccuguauguuu

SEQ ID NO: 479974 - RNA, 64 nt, Human
uauaucucuuucuuuuucuuccgacauuagaaacaaaacaaaaagaacuguccuuucugcgcuc

SEQ ID NO: 479975 - RNA, 64 nt, Human
uuauuuuuaguugguaauggauauaauauuucuuaaaacaaaaguaagguguuaaugaauaggu

SEQ ID NO: 479976 - RNA, 64 nt, Human
caggucuguacuucugccacuuucuccuuuuaaaaaaacaaaacuaugcauauuauguauuaaa

SEQ ID NO: 479977 - RNA, 64 nt, Human
uccaaucugugcgacagagugagacccugucucaaaaacaaaacaacaacaacaaaaaaaaaac

SEQ ID NO: 479978 - RNA, 64 nt, Human
aacacauagacgcacacacucaggaggaaaagaaaaaacaaaggcagaagaagaagaagaagaa

SEQ ID NO: 479979 - RNA, 64 nt, Human
uacauauuguuuaaaaaaaagcaagaaaaaaaggaaaacaaaggaaaauauccccaaaguuguu

SEQ ID NO: 479980 - RNA, 64 nt, Human
cccaaaguuguuuucuagauuuguggcuuuaagaaaaacaaaacaaaacaaacacauuguuuuu

SEQ ID NO: 479981 - RNA, 64 nt, Human
aguuguuuucuagauuuguggcuuuaagaaaaacaaaacaaaacaaacacauuguuuuucucag

SEQ ID NO: 479982 - RNA, 64 nt, Human
uuuucuagauuuguggcuuuaagaaaaacaaaacaaaacaaacacauuguuuuucucagaacca

SEQ ID NO: 479983 - RNA, 64 nt, Human
agggagggauggaggagauaauuugcuuauauuaaaaacaaaaaauggcugaggcaggaguuug

SEQ ID NO: 479984 - RNA, 64 nt, Human
ggcuaagcaucaaaaucaccuagggagucggugcaaaacaaaauaucccaguccccuccccuga

SEQ ID NO: 479985 - RNA, 64 nt, Human
uugcaugcaaaucaaguggacaagaaaaaauaacaaaacaaaaaacaagaaaaaaaaaacacaa

SEQ ID NO: 479986 - RNA, 64 nt, Human
uccucaggccgccagugucgcccugccccuuuuuaaaacaaaaugcccucguuuguaaacccuu

SEQ ID NO: 479987 - RNA, 64 nt, Human
cuggggggagccccaggcugaaaaggguccaauuaaaacaaauggagccaaauuuucugccuga

SEQ ID NO: 479988 - RNA, 64 nt, Human
caucugaauuaagcugaauguagacaaauaaagaaaaacaaaacugcgcccgucuuaggccugg

SEQ ID NO: 479989 - RNA, 64 nt, Human
ugggcgacagagcgagacuccgucucaaaaaaaaaaaacaaaaaaaaaccaugcauggugcauc

SEQ ID NO: 479990 - RNA, 64 nt, Human
gagauguggggacguguuaggagagaaaaaaaaaaaaacaaaaauauauaugggggaaauuaac

SEQ ID NO: 479991 - RNA, 64 nt, Human
uagcaagaccccucacuacaaaaauaaaacaucaaaaacaaaaacaauuagcugggcaugaugg

SEQ ID NO: 479992 - RNA, 64 nt, Human
cugggggagggggacauagcgagacucggucucaaaaacaaaacaaaacaaaacaaaacaaaac

SEQ ID NO: 479993 - RNA, 64 nt, Human
ggagggggacauagcgagacucggucucaaaaacaaaacaaaacaaaacaaaacaaaacaaaaa

SEQ ID NO: 479994 - RNA, 64 nt, Human
gggacauagcgagacucggucucaaaaacaaaacaaaacaaaacaaaacaaaacaaaaacaaaa

SEQ ID NO: 479995 - RNA, 64 nt, Human
auagcgagacucggucucaaaaacaaaacaaaacaaaacaaaacaaaacaaaaacaaaacaaaa

SEQ ID NO: 479996 - RNA, 64 nt, Human
gagacucggucucaaaaacaaaacaaaacaaaacaaaacaaaacaaaacaaaacaaaacaaaac

SEQ ID NO: 479997 - RNA, 64 nt, Human
ucggucucaaaaacaaaacaaaacaaaacaaaacaaaacaaaacaaaacaaaacaaaacacugc

SEQ ID NO: 479998 - RNA, 64 nt, Human
cucaaaaacaaaacaaaacaaaacaaaacaaaacaaaacaaaacaaaacaaaacacugccaaac

SEQ ID NO: 479999 - RNA, 64 nt, Human
aaacaaaacaaaacaaaacaaaacaaaacaaaacaaaacaaaacaaaacacugccaaacuguuu

SEQ ID NO: 480000 - RNA, 64 nt, Human
aacaaaacaaaacaaaacaaaaacaaaacaaaacaaaacaaaacacugccaaacuguuuccaaa

SEQ ID NO: 480001 - RNA, 64 nt, Human
caugcucuguuuacaucgauaaaugcacuuaaggaaaacaaacaaauuaaagcucaucuuaaag

SEQ ID NO: 480002 - RNA, 64 nt, Human
aucacacaguguccuguagcuaagugucuaggaaaaaacaaaaacuccaaacccuucaguggau

SEQ ID NO: 480003 - RNA, 64 nt, Human
uaaaaggauggaggaagaucuacgaagcaaauggaaaacaaacaaaaaaagaggcagggguugc

SEQ ID NO: 480004 - RNA, 64 nt, Human
uggagagcugucuugcaaauguaauaaauuugggaaaacaaauuuucaaaaacuacagcuuaga

SEQ ID NO: 480005 - RNA, 64 nt, Human
uauaguaaauguaggaagcccuuuagccauauugaaaacaaauaucuuuuucaacguuaucuua

SEQ ID NO: 480006 - RNA, 64 nt, Human
aaaacaacaaaaaccaaaaaaaaaaaaaaucacaaaaacaaaaaaacuauaaaaaagaaagaau

SEQ ID NO: 480007 - RNA, 64 nt, Human
cuuuccugaguucaggugacugaggaagagccacaaaacaaaacacaacaaaaccaaaccacag

SEQ ID NO: 480008 - RNA, 64 nt, Human
ugaaaaaucuguuauccaauagcuaccauagaugaaaacaaacuuggauuuuuuucuuugucca

SEQ ID NO: 480009 - RNA, 64 nt, Human
aaguuauggaagaaccgggacauuuuacagaaaaaaaacaaaaaacaacaaaaaauauacgugg

SEQ ID NO: 480010 - RNA, 64 nt, Human
cagccugggcaacacagcgagaucucuuggggguaaaacaaaaagaaaaaaaaaaguucauacu

SEQ ID NO: 480011 - RNA, 64 nt, Human
cucccuccucgcucugugaacucuuuagacacacaaaacaaacaaacacaugggggagagagac

SEQ ID NO: 480012 - RNA, 64 nt, Human
ccacacacaccaucuuuccaucccaggcuuuugaaaaacaaacagaaacccguguaucugggau

SEQ ID NO: 480013 - RNA, 64 nt, Human
ugaccgagggaggcucugucucaaaagcaaagcaaaaacaaaaacaaaaacaccuaaaaaaccu

SEQ ID NO: 480014 - RNA, 64 nt, Human
agggaggcucugucucaaaagcaaagcaaaaacaaaaacaaaaacaccuaaaaaaccugcaguu

SEQ ID NO: 480015 - RNA, 64 nt, Human
ggcuuccagacuugaaggaaaagguuuaagaaagaaaacaaaaccaacaguuaguggagucaaa

SEQ ID NO: 480016 - RNA, 64 nt, Human
ugauuccccaaaucugcauccuuuucaaaaccuaaaaacaaaaagaaaaacaaauaaaacaaaa

SEQ ID NO: 480017 - RNA, 64 nt, Human
ucugcauccuuuucaaaaccuaaaaacaaaaagaaaaacaaauaaaacaaaaccaacucagacc

SEQ ID NO: 480018 - RNA, 64 nt, Human
uuuucaaaaccuaaaaacaaaaagaaaaacaaauaaaacaaaaccaacucagaccagaacuguu

SEQ ID NO: 480019 - RNA, 64 nt, Human
ucaauaaaugugauuuaucacauacacagaacuaaaaacaaaaaccacaugaccaugaucaucu

SEQ ID NO: 480020 - RNA, 64 nt, Human
acuuaaugaugaacaccccaaagcaauugcaacaaaaacaaaaauugacaagugggaccuaauu

SEQ ID NO: 480021 - RNA, 64 nt, Human
agcagaccucucaauucacaaugaguuaacugauaaaacaaaacagaagucagacaauguuuua

SEQ ID NO: 480022 - RNA, 64 nt, Human
augagggcaauacaacugucacaucagaaacaagaaaacaaaugauaaaggaacucauuuauca

SEQ ID NO: 480023 - RNA, 64 nt, Human
uggauugcagugaucauuaaucaaaaauauuuggaaaacaaaaaggguaguugcaucuguacua

SEQ ID NO: 480024 - RNA, 64 nt, Human
cacagccugaaauuaccuuuauucaauuaaugcaaaaacaaaaggggagauguuggaggccgaa

SEQ ID NO: 480025 - RNA, 64 nt, Human
caccccuccccuccagggugaucuuuaaaaaagcaaaacaaaaaacacgacuuuuccagcgcuc

SEQ ID NO: 480026 - RNA, 64 nt, Human
gaaaauccacaaauuccaaugucacaaaagcaauaaaacaaacuagaaaaaaaaaagguuuuac

SEQ ID NO: 480027 - RNA, 64 nt, Human
cacuuuuuagauuuuuuuuucucuuuccuccuuaaaaacaaaauuuauauauagauauauauau

SEQ ID NO: 480028 - RNA, 64 nt, Human
guguggucucagaggcucugcuuccuuagguuacaaaacaaaacagggagagaaaaagcaaacc

SEQ ID NO: 480029 - RNA, 64 nt, Human
caagacugucucaaaaaaauuaaaauuaaaauuaaaaacaaauaauccugccuuuuacagguga

SEQ ID NO: 480030 - RNA, 64 nt, Human
gucuuuucaucuguucaagaggagauugaaacugaaaacaaaaugagaacaacaaaaaaaauug

SEQ ID NO: 480031 - RNA, 64 nt, Human
cccuaaacccaagcacccaaugaugcaaaaaacaaaaacaaaaaaaaaccaccaaauccccaaa

SEQ ID NO: 480032 - RNA, 64 nt, Human
acccuucccuaaacccaagcacccaaugaugcaaaaaacaaaaacaaaaaaaaaccaccaaauc

SEQ ID NO: 480033 - RNA, 63 nt, Human
aacuuccuguuuguggaacaaaaguucgaaagaaaaaacaaaacaaaaacacccagcccuguu

SEQ ID NO: 480034 - RNA, 64 nt, Human
gacaucguucagguuucuuucuuggccauuuaaaaaaacaaauuuuuuuuuucucacuuguaag

SEQ ID NO: 480035 - RNA, 64 nt, Human
auagauagaugguguuugcauguaaauugcagagaaaacaaaaccaaagcugauuggaaacaau

SEQ ID NO: 480036 - RNA, 64 nt, Human
gcuugcuuugauuuuuagugaagggaauguacguaaaacaaaauagggcuuggcuggucaaagg

SEQ ID NO: 480037 - RNA, 64 nt, Human
aaaaaacuguaaaaaaaaaaaaaaaaaaaaagacaaaacaaaagacaaaaaaaaaaaaaaaacc

SEQ ID NO: 480038 - RNA, 64 nt, Human
gggaaaccuucaggaaccuggccacuauaggaacaaaacaaaaagaauggaacauugaagagca

SEQ ID NO: 480039 - RNA, 64 nt, Human
caaaaggcucauaacaacaagaacguuucagaaaaaaacaaaaaguuuuaaaaaaauuguugag

SEQ ID NO: 480040 - RNA, 64 nt, Human
aaccaauuuugggucgagugcauuuaacgagaacaaaacaaaaggcucauaacaacaagaacgu

SEQ ID NO: 480041 - RNA, 64 nt, Human
gccgccagagcagcuuuuuacaauccagagacagaaaacaaaaucuagaugcaacagcgaaaca

SEQ ID NO: 480042 - RNA, 64 nt, Human
acccuggccaacauggugaaaccccaucucuacuaaaacaaaaauuagccaggcaugguggcac

SEQ ID NO: 480043 - RNA, 64 nt, Human
uaacagagcgagacuccaucucaaaaaaaaaaacaaaacaaaaccaaguucccacuggugaugc

SEQ ID NO: 480044 - RNA, 64 nt, Human
cuggguaacagagcgagacuccaucucaaaaaaaaaaacaaaacaaaaccaaguucccacuggu

SEQ ID NO: 480045 - RNA, 64 nt, Human
augcaucgaaaaucuuuuuguuuguaaacguuuaaaaacaaaguuccccggccaggcacagugg

SEQ ID NO: 480046 - RNA, 64 nt, Human
ggcccuucgcuuccucucuuguguuauggaaauaaaaacaaauaaaacuacacacugcacaucc

SEQ ID NO: 480047 - RNA, 64 nt, Human
ggguuuccuugggcgcggccccaaaauugccuucaaaacaaacccgggacgguugaaagccuuc

SEQ ID NO: 480048 - RNA, 64 nt, Human
cuccagccgggugacagagugagacuccaucucaaaaacaaacaaacuaagguauggaugcuuc

SEQ ID NO: 480049 - RNA, 64 nt, Human
uaccuguuuuccgaagaaaaaagcaauacugaacaaaacaaaucauuuuaacaagaugacuacu

SEQ ID NO: 480050 - RNA, 64 nt, Human
aaauugaguuacuguauacaaagcuguucauagaaaaacaaauguuaccaagaaauacuuaccu

SEQ ID NO: 480051 - RNA, 64 nt, Human
aggaaguaaagguaaaaucacuucagaucucuaaaaaacaaagaauuacaugaguuaguacaug

SEQ ID NO: 480052 - RNA, 64 nt, Human
ugggcagaagacauugcuuauuggagacaaauuaaaaacaaaaacaacuaacaauccggucugg

SEQ ID NO: 480053 - RNA, 64 nt, Human
cuucuccugcaaggaucucgguggacucagucacaaaacaaaggcuaaaccaggauuuauaaga

SEQ ID NO: 480054 - RNA, 64 nt, Human
gaaccagaggugaaaaacaaacaaaaaaaaaccaaaaacaaaccaaaaaaaaaaaaaacccaca

SEQ ID NO: 480055 - RNA, 64 nt, Human
cagaaaccagcugccccaaaggaaccagaggugaaaaacaaacaaaaaaaaaccaaaaacaaac

SEQ ID NO: 480056 - RNA, 64 nt, Human
ugcccccuuuuucuuguuaaaaaacaaaaaacaaaaaacaaaaaaccacacacacauuuuguac

SEQ ID NO: 480057 - RNA, 64 nt, Human
uggcuuuugcccccuuuuucuuguuaaaaaacaaaaaacaaaaaacaaaaaaccacacacacau

SEQ ID NO: 480058 - RNA, 64 nt, Human
ccauuccuggcuuuugcccccuuuuucuuguuaaaaaacaaaaaacaaaaaacaaaaaaccaca

SEQ ID NO: 480059 - RNA, 64 nt, Human
guuugguacauaucuuuuuaaagaucgcuuuauaaaaacaaaaagauaacauuaacauuuauug

SEQ ID NO: 480060 - RNA, 64 nt, Human
aacaguuguuagauguucucagugauucaacuuuaaaacaaauuucucgugaugauucauuuca

SEQ ID NO: 480061 - RNA, 64 nt, Human
cagccugggcagcagagugagacucucucucaaaaaaacaaaacuuggcuguuaaugucugccc

SEQ ID NO: 480062 - RNA, 64 nt, Human
aggccuucaaaauaagaauuuugaaagaauacagaaaacaaacuuuuauauccuucucaugucu

SEQ ID NO: 480063 - RNA, 64 nt, Human
uaagccuccccacaaggcgaggggaguuaccccuaaaacaaagcuauuaaagggacagaauacu

SEQ ID NO: 480064 - RNA, 64 nt, Human
gaauguuccaccauugcuggaaaaauugagauggaaaacaaaccaucucuaguuggccagcguc

SEQ ID NO: 480065 - RNA, 64 nt, Human
gauaaaccaaucaaauugguaaagaccuaaaaccaaaacaaauaaagaaacacaaaacccucag

SEQ ID NO: 480066 - RNA, 64 nt, Human
acagagcgagacuccaacucagaaaaagcaaaacaaaacaaacaaacaagcaaaaaaccacaau

SEQ ID NO: 480067 - RNA, 64 nt, Human
gggcaacagagcgagacuccaacucagaaaaagcaaaacaaaacaaacaaacaagcaaaaaacc

SEQ ID NO: 480068 - RNA, 64 nt, Human
auuugaguguucauuugcguccuuuauaaccaguaaaacaaaguacgcuguuuucuugaguuuu

SEQ ID NO: 480069 - RNA, 64 nt, Human
cagccugggcaccaggaacgaaacucguucucaaaaaacaaaacaaaaaaaaaaaaaacguugg

SEQ ID NO: 480070 - RNA, 64 nt, Human
cugugcaacauggugaaaccucaucucuaccaacaaaacaaaaaaacacaaaaauuagccaggu

SEQ ID NO: 480071 - RNA, 64 nt, Human
cccaauuuuguguuuuucuuucuauauauggauuaaaacaaaaauccuaaagggaaauacgcca

SEQ ID NO: 480072 - RNA, 64 nt, Human
acagcaaguucuuguuuccaaacaacaacaaaacaaaacaaaaaaaaaaccggauagaauaaug

SEQ ID NO: 480073 - RNA, 64 nt, Human
gcgacacagcaaguucuuguuuccaaacaacaacaaaacaaaacaaaaaaaaaaccggauagaa

SEQ ID NO: 480074 - RNA, 64 nt, Human
acaacauauagcaagacucugccucuauuauaaaaaaacaaaauaaaugaaaaggacuguagga

SEQ ID NO: 480075 - RNA, 64 nt, Human
gaaaagauaguuauauacaaaauucuguuuucugaaaacaaaauugugauucaccuucagaauu

SEQ ID NO: 480076 - RNA, 64 nt, Human
ugacauuucccacccugugccguguuccccaauaaaaacaaauucacaagaguugguucauguu

SEQ ID NO: 480077 - RNA, 64 nt, Human
gaaaacuguucuugggacugucucaacugugcaaaaaacaaaagauggaguguuuacaaguaga

SEQ ID NO: 480078 - RNA, 64 nt, Human
uagugacugagauguaaaaauagauuuuagaauuaaaacaaaauccaaguccucacaccccugu

SEQ ID NO: 480079 - RNA, 64 nt, Human
cuuauuuuuggacuuagugcaacagguugaggcuaaaacaaaucucagaacagucugaaauacc

SEQ ID NO: 480080 - RNA, 64 nt, Human
guucccaucccugaaacauugcauguauuuaagaaaaacaaaauguuaguggcauauuugcuuc

SEQ ID NO: 480081 - RNA, 64 nt, Human
aagucacggguuguaaaaccauuuggauuuuuuuaaaacaaaaguauuaauaaucuggaagaca

SEQ ID NO: 480082 - RNA, 64 nt, Human
ugugaugccuuaggacauguuugaacugcagcaaaaaacaaaaacaaaaaacagugcauuagca

SEQ ID NO: 480083 - RNA, 64 nt, Human
gccuuaggacauguuugaacugcagcaaaaaacaaaaacaaaaaacagugcauuagcaauuuca

SEQ ID NO: 480084 - RNA, 64 nt, Human
aacauccacgaaccaggaaguggguccucaccagaaaacaaaucuguaagcaccuugaucuugg

SEQ ID NO: 480085 - RNA, 64 nt, Human
guugcaauaaaagcacccguaguagcaaaaacauaaaacaaauaaaacuucccccacaucacag

SEQ ID NO: 480086 - RNA, 64 nt, Human
uuuuuuuuuuuuuacugcauguuacauugaaauaaaaacaaaguaaaaugagcaauugccuuau

SEQ ID NO: 480087 - RNA, 64 nt, Human
gccugggcaacauagcaagacccugucucuuaaaaaaacaaaaagacauauucagguacugauu

SEQ ID NO: 480088 - RNA, 64 nt, Human
auuccucuaugggagaaaaaaauuaauauaaagaaaaacaaauaaaaauauauuuaaagcacau

SEQ ID NO: 480089 - RNA, 64 nt, Human
uaaaagagagagaggaagcgagagagagagagaaaaaacaaaaaacagaaaacacgaaugccuu

SEQ ID NO: 480090 - RNA, 64 nt, Human
uugggugaggaucccugaaggccuucaacccgagaaaacaaacccagguuggcgacugcaacag

SEQ ID NO: 480091 - RNA, 64 nt, Human
ugggcaacauagcgagaccucaucuccaaaaaagaaaacaaaaaacaaaaaaaggaaugauguu

SEQ ID NO: 480092 - RNA, 64 nt, Human
cauagcgagaccucaucuccaaaaaagaaaacaaaaaacaaaaaaaggaaugauguucuguaga

SEQ ID NO: 480093 - RNA, 64 nt, Human
ugaaaugagaaaagaaaaauuuaugcacugauuuaaaacaaaccaaaaaaaaagaaaaaaacaa

SEQ ID NO: 480094 - RNA, 64 nt, Human
ugcacugauuuaaaacaaaccaaaaaaaaagaaaaaaacaaaaaaaaaaaucccuccuuucuag

SEQ ID NO: 480095 - RNA, 64 nt, Human
aaugauuuaaauuuauaauuaaguaaauuacauuaaaacaaaaaaauuauacucaaaauucauu

SEQ ID NO: 480096 - RNA, 64 nt, Human
gcucuuaucuuucuugacuuuaaaaaaauuauuaaaaacaaaaaaaaaauaaauuuuuuugcaa

SEQ ID NO: 480097 - RNA, 64 nt, Human
uaggaaaucacaggcuucugagcacagcugcauuaaaacaaaggaaguucuccuuuugaacuug

SEQ ID NO: 480098 - RNA, 64 nt, Human
ggcuggucugucuuuucuccauuuguuuaaaaaaaaaacaaaaacaaaaaacaacacuuuggug

SEQ ID NO: 480099 - RNA, 64 nt, Human
ucugucuuuucuccauuuguuuaaaaaaaaaacaaaaacaaaaaacaacacuuugguguggugg

SEQ ID NO: 480100 - RNA, 64 nt, Human
uaaaauaacuuuccguuaauuauauauuuuugucaaaacaaaugcuguacuccaauuuucuuug

SEQ ID NO: 480101 - RNA, 64 nt, Human
gccccuucaucuuucucuauauauuuuccaguugaaaacaaacuaagaaguccuuuaagaauuu

SEQ ID NO: 480102 - RNA, 64 nt, Human
guccucuccacaaaaauaccugguccaaacaagaaaaacaaaaagacaagcaaaacuaaagaac

SEQ ID NO: 480103 - RNA, 64 nt, Human
ccagccugagugacagagcgagacccugucucaaaaaacaaacaaacaaacaaacaaaaacaga

SEQ ID NO: 480104 - RNA, 64 nt, Human
cgcccacccccacucccaccaucugcagguggugaaaacaaaccccguguaucucucaauaaag

SEQ ID NO: 480105 - RNA, 64 nt, Human
ucuggcuggucagagacaaggcagaacuuuuggaaaaacaaagacuguuggugacagggugugu

SEQ ID NO: 480106 - RNA, 64 nt, Human
ccaaagaaauaaacaagugugacaaaaaaaaaaaaaaacaaaccuaaaugcuacuguuccaaag

SEQ ID NO: 480107 - RNA, 64 nt, Human
ccuuagcuuuucauaguugucugacauuuccaugaaaacaaaggaaccaacuuuguuuuaacca

SEQ ID NO: 480108 - RNA, 64 nt, Human
uuucuggcaaaaaaaaaaaaaaaagaaagaaaggaaaacaaaaagcacuuuuuucuuaauggua

SEQ ID NO: 480109 - RNA, 64 nt, Human
gucuguagcacauauauauucuuuccccucuuuuaaaacaaaugguagcaaaccaaccacacac

SEQ ID NO: 480110 - RNA, 64 nt, Human
auagaacauccaguuaaguuccguaagugccugaaaaacaaacacaaguuucaacauucaaucu

SEQ ID NO: 480111 - RNA, 64 nt, Human
acauaaauucauguaaagccauuuucucuuaaacaaaacaaaacuuucuaaguacagucauucu

SEQ ID NO: 480112 - RNA, 64 nt, Human
aaguuaaagguuaaccaguuacagaggguguuagaaaacaaagggcagagaguccuggagaagg

SEQ ID NO: 480113 - RNA, 64 nt, Human
caauacggaaggggagauaggugagaugauaugaaaaacaaauuuucucacugucauaaaaggc

SEQ ID NO: 480114 - RNA, 64 nt, Human
guuuuagacacgcuuucuuguagugcuucugcaaaaaacaaaaaagggacuuauuuugcauucu

SEQ ID NO: 480115 - RNA, 64 nt, Human
uagaaauugacauugucauugacaaacauggcuaaaaacaaaacaucaaauccugcccccguga

SEQ ID NO: 480116 - RNA, 64 nt, Human
augguugaaaauacauauauucauuucuuuauaaaaaacaaaaaccuuaccgguaguaauauaa

SEQ ID NO: 480117 - RNA, 64 nt, Human
cuuguucugaauauccuugacauuacagcugucaaaaacaaaaacugguauuucagaucuguuu

SEQ ID NO: 480118 - RNA, 58 nt, Human
ccgacuccauuccagauuagugcuuaaaaaaacaaaaggagugggggaaaggaauuga

SEQ ID NO: 480119 - RNA, 64 nt, Human
aguggcggggggguuuugccuaaauuaguauauaaaaacaaaaaugcuaaauuauaucugugaa

SEQ ID NO: 480120 - RNA, 64 nt, Human
acuauuguuugugagcaacuuuuuuauaacuuccaaaacaaaaaccugagcacaguuuugaagu

SEQ ID NO: 480121 - RNA, 64 nt, Human
auauaggauugaaagaaaauuaacuccuuuauuaaaaacaaauuuaucuguauuuguuuugccu

SEQ ID NO: 480122 - RNA, 64 nt, Human
gucuaauuuuuuuuccuguugaauggguaaaaacaaaacaaaacuuuuuuuagaagaugaauuu

SEQ ID NO: 480123 - RNA, 64 nt, Human
ugugugucuaauuuuuuuuccuguugaauggguaaaaacaaaacaaaacuuuuuuuagaagaug

SEQ ID NO: 480124 - RNA, 64 nt, Human
cagacugaucuaaugugaaauguaaguauccuuaaaaacaaagcaucuauuuuggcagaaauug

SEQ ID NO: 480125 - RNA, 64 nt, Human
ugacagagcgagacccugucuuaaaaaaaaaaacaaaacaaaaccagcaucuguuacuggaaca

SEQ ID NO: 480126 - RNA, 64 nt, Human
cugggugacagagcgagacccugucuuaaaaaaaaaaacaaaacaaaaccagcaucuguuacug

SEQ ID NO: 480127 - RNA, 64 nt, Human
cacguggucugcagaaccaaagagaggaaucgccaaaacaaaucacgagaagagagaaggggac

SEQ ID NO: 480128 - RNA, 64 nt, Human
guucuaggucgacugcggggacagaacaaaaaucaaaacaaagaaccugcucugaugacacuua

SEQ ID NO: 480129 - RNA, 64 nt, Human
cuaguauaacaaugauaugggucaaagaaaaaugaaaacaaauuuuaaaaacguugcaacauga

SEQ ID NO: 480130 - RNA, 64 nt, Human
agccuaaagucuaaauauuuguguuggcaucagaaaaacaaaugaggcagaauugcuaugugug

SEQ ID NO: 480131 - RNA, 64 nt, Human
acuauagcaaauaauucguuaaauugucauauucaaaacaaauguggauacagucuugguucuc

SEQ ID NO: 480132 - RNA, 64 nt, Human
ucgcagagaguguaucaucuguuuuauuuuuguaaaaacaaagugcuaaauaauauuuauuacu

SEQ ID NO: 480133 - RNA, 64 nt, Human
ggagaauggguuccuguggagaaaaauggugaagaaaacaaagaugaugauaauguuuucagca

SEQ ID NO: 480134 - RNA, 64 nt, Human
aaaaugggcuggagagaaggagaaggauuaggaaaaaacaaagaaggcaauaaggaacccaucc

SEQ ID NO: 480135 - RNA, 64 nt, Human
uugagugagcaaggauacgaaaacaguguguuugaaaacaaauuagguuuggguucaauuccuu

SEQ ID NO: 480136 - RNA, 64 nt, Human
uccgaagaaugacaauuuucuaccacugguguaaaaaacaaacauuugaagacccuugugcauu

SEQ ID NO: 480137 - RNA, 64 nt, Human
uguguguuuuuauagaagugguguuuuuuuuccaaaaacaaagugcaaagcugcuugaaucagg

SEQ ID NO: 480138 - RNA, 64 nt, Human
auuuaauauuuaugcucuuuagaauggaacacagaaaacaaaccuuauaaguccugauuaaucu

SEQ ID NO: 480139 - RNA, 64 nt, Human
guuaugccaaagugucuacaugugccaccaacauaaaacaaaaccaagccuuggcucguucucu

SEQ ID NO: 480140 - RNA, 64 nt, Human
guucugaauagagguagguugaguuuucuaggggaaaacaaauggagaaaagaggcaugaagaa

SEQ ID NO: 480141 - RNA, 64 nt, Human
ucucugccacagggacuugccucacugugucccaaaaacaaaucgcagccagcuuuuccagaaa

SEQ ID NO: 480142 - RNA, 64 nt, Human
ccagucuggucggcaagagugagacuccgucucaaaaacaaaacaaaacaaaaaaaccacauaa

SEQ ID NO: 480143 - RNA, 64 nt, Human
cuggucggcaagagugagacuccgucucaaaaacaaaacaaaacaaaaaaaccacauaacauaa

SEQ ID NO: 480144 - RNA, 64 nt, Human
cggcaagagugagacuccgucucaaaaacaaaacaaaacaaaaaaaccacauaacauaaauuua

SEQ ID NO: 480145 - RNA, 64 nt, Human
guggagacugcacauccggaccugcccaugucucaaaacaaacacauguacaguggcucuuuuu

SEQ ID NO: 480146 - RNA, 64 nt, Human
uaacguguacagauggaaacuucauuuaaaaauaaaaacaaaacaacucaaaaaggaauaaaau

SEQ ID NO: 480147 - RNA, 64 nt, Human
cagccugggugacagcacgagaugccgucuuaaaaaaacaaaaaagaggugugcugcuugucag

SEQ ID NO: 480148 - RNA, 64 nt, Human
auuuggcuuuauuuuacaaguacaguaucugcaaaaaacaaaguaaccuuuuuucauaccugcc

SEQ ID NO: 480149 - RNA, 64 nt, Human
uaugacuuuccucagaacaugagacuguaaaacaaaaacaaaaaacuaugugaugccucuauuu

SEQ ID NO: 480150 - RNA, 64 nt, Human
augacuuaugacuuuccucagaacaugagacuguaaaacaaaaacaaaaaacuaugugaugccu

SEQ ID NO: 480151 - RNA, 64 nt, Human
uauuucuuuuguuacaucuauuacaaguuuagaaaaaacaaagcaauugucaaaaaaaguuaga

SEQ ID NO: 480152 - RNA, 64 nt, Human
gcuguuuucaguauuuucuuaagaaauugcuuuuaaaacaaauaauuguuuuacaaaaccaaua

SEQ ID NO: 480153 - RNA, 64 nt, Human
guauguauuuuucuaauugaagagaauaaagauuaaaacaaagugcuuuaagauugauuuuuac

SEQ ID NO: 480154 - RNA, 56 nt, Human
aggagcaaccaucaggguaacagguaaaaacaaauggaaucucugauggcaaaaga

SEQ ID NO: 480155 - RNA, 64 nt, Human
gaaaugaggcuucaauuagaauuauuuuucucaaaaaacaaacaaacaaaaaacacaaaaaaaa

SEQ ID NO: 480156 - RNA, 64 nt, Human
uuaguagugcagaccuuuaccccuagucuaugaaaaaacaaaccaaaauaugcucuugcgccca

SEQ ID NO: 480157 - RNA, 64 nt, Human
uuuauuuguuuauauuuaauuuuuacaugaccagaaaacaaaucuucaagguguaaaauaucua

SEQ ID NO: 480158 - RNA, 64 nt, Human
ucaaaacagaagggcaaauggaaaaggggaauauaaaacaaaccaauaaaaauaccaucugagg

SEQ ID NO: 480159 - RNA, 64 nt, Human
cugcacuugaaguucaacuuaaugguguaugugaaaaacaaaaacuacuuugguuguguauguc

SEQ ID NO: 480160 - RNA, 64 nt, Human
cauacauggauuuugccaagugcugccaguagccaaaacaaagucuuuuuagggcaauagagga

SEQ ID NO: 480161 - RNA, 64 nt, Human
uggguuucuuccaaccaucucgucauuuaaagggaaaacaaaaucugagucuccagccaggagg

SEQ ID NO: 480162 - RNA, 64 nt, Human
ucacaaauugaaaaucugaguguaguuaggacaaaaaacaaagcuaaccauauggcacuaauuu

SEQ ID NO: 480163 - RNA, 64 nt, Human
uggcagagcgagacccugucucaaaaaauaaacaaaaacaaaaugcuucugucaguuaacaauc

SEQ ID NO: 480164 - RNA, 64 nt, Human
cccggggcacccuuaaaacuuccacuaccuuuaaaaaacaaagccuuauccagcauuauuugaa

SEQ ID NO: 480165 - RNA, 64 nt, Human
auaguuggagccacaaggcccuugucuuuuuaaaaaaacaaaauauuuugaagauggugaaagu

SEQ ID NO: 480166 - RNA, 64 nt, Human
gacuccaguuuauaacauccuuuuaaaaaauuuaaaaacaaacagccacaccccuccuccaguc

SEQ ID NO: 480167 - RNA, 64 nt, Human
auccuggggaggccaaauaagcccccacugcaaaaaaacaaaaaacagguuaagaaaauuacuu

SEQ ID NO: 480168 - RNA, 64 nt, Human
acacauaaaauacaguaaccauagcugaugagcuaaaacaaaaaacaaugguuugugcaaaaau

SEQ ID NO: 480169 - RNA, 64 nt, Human
uucuucgugauaauauaaucucuauuuuuuuaggaaaacaaaaaugaaaaacuacuccauuuga

SEQ ID NO: 480170 - RNA, 64 nt, Human
gagacaaacauuauaaaaaucugauggcaaaagcaaaacaaaauggaaaguaggggagguggau

SEQ ID NO: 480171 - RNA, 64 nt, Human
caguguucugcauuccacauguaagugaauugcaaaaacaaaacaaaacucacucucuuguagg

SEQ ID NO: 480172 - RNA, 64 nt, Human
uucugcauuccacauguaagugaauugcaaaaacaaaacaaaacucacucucuuguagguuuau

SEQ ID NO: 480173 - RNA, 64 nt, Human
gaauuuaggcagucacuuugagauccaucagccuaaaacaaaggauugggucuauguacuucuu

SEQ ID NO: 480174 - RNA, 64 nt, Human
ccuguuucucagucucacauuucucaacaaggcaaaaacaaagagcguugaaguugacucugcu

SEQ ID NO: 480175 - RNA, 64 nt, Human
cagccugggugacugagcaagacucugccucaaaaaaacaaauaaauaaauaaaauccugacau

SEQ ID NO: 480176 - RNA, 64 nt, Human
ccuguccauuaucugucuccuuuccuugugucccaaaacaaagcuguuugccucacucaggaga

SEQ ID NO: 480177 - RNA, 64 nt, Human
gagugaaagucugacucaaaaaaaaaaaauuuaaaaaacaaaauaaucuagugugcagggcauu

SEQ ID NO: 480178 - RNA, 64 nt, Human
ccagagauuuugcacaauucguguugaaccuuccaaaacaaaaauaaagaccuguccaaaaguu

SEQ ID NO: 480179 - RNA, 64 nt, Human
cuccagccuggugacagaacgagacucugucuuaaaaacaaacaaacaaaaaaaaaaucuguua

SEQ ID NO: 480180 - RNA, 64 nt, Human
cuguucuuuaagaguuuaaaaucaucagaaaggaaaaacaaacucuauauuguucagcaugcaa

SEQ ID NO: 480181 - RNA, 64 nt, Human
guuuuaauagcuaaaaaacuacaaauuaagcucuaaaacaaacaaacuacagaaauguaaaccu

SEQ ID NO: 480182 - RNA, 64 nt, Human
agcaaguauuucaaaccaaauuaaaaaaccucauaaaacaaaaaauacaaaccauacauuauuc

SEQ ID NO: 480183 - RNA, 64 nt, Human
uccuuaaaggaaauguuaaaaaaaaaaaaacaaaaaaacaaaaaaacaacuguucuuugccuaa

SEQ ID NO: 480184 - RNA, 64 nt, Human
agccaccuuccuuaaaggaaauguuaaaaaaaaaaaaacaaaaaaacaaaaaaacaacuguucu

SEQ ID NO: 480185 - RNA, 64 nt, Human
aguuuacuugccagucucuuguguaaauuacaguaaaacaaaguaaaugaaauuuaaacaaaaa

SEQ ID NO: 480186 - RNA, 64 nt, Human
cugcuggagaaaagccuggaacugccaaaacaaaaaaacaaauacaaacaaaccucgucaccac

SEQ ID NO: 480187 - RNA, 64 nt, Human
agucccuccugcuggagaaaagccuggaacugccaaaacaaaaaaacaaauacaaacaaaccuc

SEQ ID NO: 480188 - RNA, 64 nt, Human
aauggcucuuucuccugcgacauggcaguccccaaaaacaaaauggagucugauggggagaaga

SEQ ID NO: 480189 - RNA, 64 nt, Human
guccuggggaggccaaauaagcccucacuccaaaaaaacaaaaaacaggguaagaaaauuacuu

SEQ ID NO: 480190 - RNA, 64 nt, Human
cuaguagaggaacucuauagcaagaugaagaggaaaaacaaacaaacaaacaaaaaaaaacaca

SEQ ID NO: 480191 - RNA, 64 nt, Human
aacaggaaaugugggaaaauauaaacgagggaagaaaacaaacuuuaaaaaaaagcgagaggga

SEQ ID NO: 480192 - RNA, 64 nt, Human
gcaaaaacaaaaaacaaaaaaaacaaaaaaacaaaaaacaaaaaaacacacacacacaaaaaaa

SEQ ID NO: 480193 - RNA, 64 nt, Human
uccaaaagcaaaaacaaaaaacaaaaaaaacaaaaaaacaaaaaacaaaaaaacacacacacac

SEQ ID NO: 480194 - RNA, 64 nt, Human
ggagaccuuccaaaagcaaaaacaaaaaacaaaaaaaacaaaaaaacaaaaaacaaaaaaacac

SEQ ID NO: 480195 - RNA, 64 nt, Human
ccuccgcugggagaccuuccaaaagcaaaaacaaaaaacaaaaaaaacaaaaaaacaaaaaaca

SEQ ID NO: 480196 - RNA, 64 nt, Human
cccagacccuccgcugggagaccuuccaaaagcaaaaacaaaaaacaaaaaaaacaaaaaaaca

SEQ ID NO: 480197 - RNA, 64 nt, Human
cucuggccucaguucuccucuuuuggaacaacauaaaacaaauuuaauuuucuacgccucuggg

SEQ ID NO: 480198 - RNA, 64 nt, Human
caucugugcuuuaaauuucucauuacuggguuagaaaacaaagagggauugcccugcacauuuu

SEQ ID NO: 480199 - RNA, 64 nt, Human
uaugacaggaaagugaaagaauuaguuuugcaaaaaaacaaaaacaaaaaaagaggaaaaaaaa

SEQ ID NO: 480200 - RNA, 64 nt, Human
aacuuuaaacacuuuuuaaaucuucaaaauauuuaaaacaaauuuaaagggccuguuaauucuu

SEQ ID NO: 480201 - RNA, 64 nt, Human
acauugguguguuuagagauuuuaguuuaaaaacaaaacaaaaagauugaucaaaucuguacag

SEQ ID NO: 480202 - RNA, 64 nt, Human
augggacauugguguguuuagagauuuuaguuuaaaaacaaaacaaaaagauugaucaaaucug

SEQ ID NO: 480203 - RNA, 64 nt, Human
cuuaaaaagaugagagaaacauauuuuuucaggaaaaacaaacuuuaaaaaaaaaagaggagaa

SEQ ID NO: 480204 - RNA, 64 nt, Human
gcuguuucacaaacaguuuuauuuaaaaaaacaaaaaacaaaaaaaaucaaaaaaucaaaaaaa

SEQ ID NO: 480205 - RNA, 64 nt, Human
uaaaauagcuguuucacaaacaguuuuauuuaaaaaaacaaaaaacaaaaaaaaucaaaaaauc

SEQ ID NO: 480206 - RNA, 64 nt, Human
agguaaguaugugaugagcaaugaggaggaguggaaaacaaaacccagaaagugcggcaggacc

SEQ ID NO: 480207 - RNA, 64 nt, Human
ggauguacaaagaacucucaaaccggauaguaagaaaacaaacagcccaagugaaaagcaggca

SEQ ID NO: 480208 - RNA, 64 nt, Human
guuucaaucuguccaucuaccaggccucgcgauaaaaacaaaacaaaaaaacgcugccagguuu

SEQ ID NO: 480209 - RNA, 64 nt, Human
aaucuguccaucuaccaggccucgcgauaaaaacaaaacaaaaaaacgcugccagguuuuagaa

SEQ ID NO: 480210 - RNA, 64 nt, Human
uuuggaaaggcggggaagaaggaugaaaccuuuaaaaacaaaaacaaaaacaucaaugaguagg

SEQ ID NO: 480211 - RNA, 64 nt, Human
aaggcggggaagaaggaugaaaccuuuaaaaacaaaaacaaaaacaucaaugaguaggcauuuu

SEQ ID NO: 480212 - RNA, 64 nt, Human
ccuuuaagagaagcccuuugaauaaucaagugcuaaaacaaaaucaggugcuuuuuuaaaacag

SEQ ID NO: 480213 - RNA, 64 nt, Human
gaaaccauaucauucauauuuagaaguaaaacacaaaacaaaaaagagagagaaaagaaaagaa

SEQ ID NO: 480214 - RNA, 64 nt, Human
aaauuuacaaaauacuagaguaucuagaagggugaaaacaaaaaaaaauaaaaagaaacacaga

SEQ ID NO: 480215 - RNA, 55 nt, Human
uaaaaaagauaucccagugaaggagaaaacaaaauagaacccugagcacuggagg

SEQ ID NO: 480216 - RNA, 64 nt, Human
aaauuacucuggauguuugguauuuuuuuacauuaaaacaaacuaaagcaaaauuuagaagaaa

SEQ ID NO: 480217 - RNA, 64 nt, Human
uaaccaaucugaaaguuacgguuugggaauuaauaaaacaaagucauacaacacauuuucuuug

SEQ ID NO: 480218 - RNA, 64 nt, Human
uauauauauaaauauaaauauauauaaaaacaacaaaacaaaacaaaaaaagaaaaaaaaacaa

SEQ ID NO: 480219 - RNA, 64 nt, Human
auauaaauauaaauauauauaaaaacaacaaaacaaaacaaaaaaagaaaaaaaaacaaaaaac

SEQ ID NO: 480220 - RNA, 64 nt, Human
uucacacugcagagcuagguuguccuauuggcauaaaacaaaccagcaacuuuucucauguguu

SEQ ID NO: 480221 - RNA, 64 nt, Human
uuggcaguguagccauaacuuucugauguuaguaaaaacaaaauuggcgacuugaaauuaaauc

SEQ ID NO: 480222 - RNA, 64 nt, Human
guuccuggggucugagauguguuaggaggcguuuaaaacaaagauccaguucauuuacuccaca

SEQ ID NO: 480223 - RNA, 64 nt, Human
cuuuggcuaaaucugacaauuuuauauauagcuuaaaacaaagaauauacauucuuuucacccc

SEQ ID NO: 480224 - RNA, 64 nt, Human
auauauauuaaaagugguuguauucauuuagugaaaaacaaaaaguagauguacuucuguaaau

SEQ ID NO: 480225 - RNA, 64 nt, Human
gaaguuuagagagcuaagauuaucuggggaaaucaaaacaaaaacaagcaaacaaaaaaaaaaa

SEQ ID NO: 480226 - RNA, 64 nt, Human
gggaaagagcacaggaacugaguugcugggccucaaaacaaaaggcugcaggcacaugguuaga

SEQ ID NO: 480227 - RNA, 64 nt, Human
cuaaucuuccuggggcaaugucacccuuugauuuaaaacaaagcaacccccuuuccccuaccac

SEQ ID NO: 480228 - RNA, 64 nt, Human
uugguaaaauauguuaugugcauuuugaaaacagaaaacaaauugcguuggcauguacgugggu

SEQ ID NO: 480229 - RNA, 64 nt, Human
auuucccaagauugguuucccuugaguuuuugcuaaaacaaaucuuaguaguuuugcccguuua

SEQ ID NO: 480230 - RNA, 64 nt, Human
auaaacaaauaucguuaaguuaaacaaguuuucaaaaacaaaacaauuuuuaaaguaccuuaaa

SEQ ID NO: 480231 - RNA, 64 nt, Human
uccugaugccaaagaauaugaaaauauuuaaguaaaaacaaaaugaugcauuuugagaagaaca

SEQ ID NO: 480232 - RNA, 64 nt, Human
uuuaaaaucuuaaauguguaagucacccccaccaaaaacaaaagagaagaaaaagaauagaaag

SEQ ID NO: 480233 - RNA, 64 nt, Human
ucccuuuauagauugauuccagcaaaggcggaauaaaacaaauuuccuaugaagagaauccuga

SEQ ID NO: 480234 - RNA, 64 nt, Human
acaacuuuuugaaugcaguaguuuuuuuuuuuuaaaaacaaacuuuuaugucaaauuuuuuuuc

SEQ ID NO: 480235 - RNA, 64 nt, Human
uuguuguugauaaugggcuuuguuagcacuuuuuaaaacaaacaaacaaacaaaacaaaaaagc

SEQ ID NO: 480236 - RNA, 64 nt, Human
cuuuguuagcacuuuuuaaaacaaacaaacaaacaaaacaaaaaagcaaaccacauuuguuauc

SEQ ID NO: 480237 - RNA, 64 nt, Human
uccaaccugggugacagagugagauuccaucugaaaaacaaaaacaaaaacagaaaacaaacaa

SEQ ID NO: 480238 - RNA, 64 nt, Human
cugggugacagagugagauuccaucugaaaaacaaaaacaaaaacagaaaacaaacaaacaaaa

SEQ ID NO: 480239 - RNA, 64 nt, Human
ugagauuccaucugaaaaacaaaaacaaaaacagaaaacaaacaaacaaaaaacaaaaaauccc

SEQ ID NO: 480240 - RNA, 64 nt, Human
aaaacaaaaacaaaaacagaaaacaaacaaacaaaaaacaaaaaauccccacaacuuugucaaa

SEQ ID NO: 480241 - RNA, 64 nt, Human
gcaaucaugacugagccaaucacuguuucucagaaaaacaaaacaaaacaaaacaaaugacagu

SEQ ID NO: 480242 - RNA, 64 nt, Human
caugacugagccaaucacuguuucucagaaaaacaaaacaaaacaaaacaaaugacaguaaccc

SEQ ID NO: 480243 - RNA, 64 nt, Human
cugagccaaucacuguuucucagaaaaacaaaacaaaacaaaacaaaugacaguaacccuuccc

SEQ ID NO: 480244 - RNA, 64 nt, Human
ccaaucacuguuucucagaaaaacaaaacaaaacaaaacaaaugacaguaacccuuccccggaa

SEQ ID NO: 480245 - RNA, 64 nt, Human
uuuaucccguaaguucuguuuugauuuuuuuuaaaaaacaaacccuuuuagucacuuuaaucag

SEQ ID NO: 480246 - RNA, 64 nt, Human
cuaaugucaaacuugagucacaaagaacauguagaaaacaaaauggauaaaaucugauauguau

SEQ ID NO: 480247 - RNA, 64 nt, Human
ucuagccugggugacagagcaagacucugucuaaaaaacaaaacaaaacaaaacaaaacaaaaa

SEQ ID NO: 480248 - RNA, 64 nt, Human
ccugggugacagagcaagacucugucuaaaaaacaaaacaaaacaaaacaaaacaaaaaaaccu

SEQ ID NO: 480249 - RNA, 64 nt, Human
gugacagagcaagacucugucuaaaaaacaaaacaaaacaaaacaaaacaaaaaaaccucuuaa

SEQ ID NO: 480250 - RNA, 64 nt, Human
agagcaagacucugucuaaaaaacaaaacaaaacaaaacaaaacaaaaaaaccucuuaauauuc

SEQ ID NO: 480251 - RNA, 64 nt, Human
aagacucugucuaaaaaacaaaacaaaacaaaacaaaacaaaaaaaccucuuaauauucuggag

SEQ ID NO: 480252 - RNA, 64 nt, Human
gugaacuguguuuuaugauuuuaccucaaaucagaaaacaaaaugaugugcuuuggucaguuaa

SEQ ID NO: 480253 - RNA, 64 nt, Human
uuggaugauggggcagggguuucagaagaucuguaaaacaaauuaaggugcgaacaaguuaauu

SEQ ID NO: 480254 - RNA, 64 nt, Human
uaggaucuucuauaguagguuaauggaaaauacaaaaacaaacaaacauacaaugaaacugccu

SEQ ID NO: 480255 - RNA, 64 nt, Human
ucgauuauuucaugcuuuuuuuuaaaaaaaaaaaaaaacaaaauaacaaucugaagaggcauuu

SEQ ID NO: 480256 - RNA, 64 nt, Human
cauuuugcgaggcuuaggcagcuagacaucguuuaaaacaaaauauuaacuuauauuacaugug

SEQ ID NO: 480257 - RNA, 64 nt, Human
ccuuaaaaaacucagccaacagguaguauugguaaaaacaaacaaacaaaaauccuuugcccuc

SEQ ID NO: 480258 - RNA, 64 nt, Human
auugaugaagcagaugaguuuguagcagggccacaaaacaaagugaaacguccaggggaaccca

SEQ ID NO: 480259 - RNA, 64 nt, Human
gauguugauuuugaccuguucaugauucagaagaaaaacaaacuuuuuuggauuuuuuuucccu

SEQ ID NO: 480260 - RNA, 64 nt, Human
cuaaucuguguacacaucuccaagcaaggaagaaaaaacaaacucugcucagacgccuaugaaa

SEQ ID NO: 480261 - RNA, 64 nt, Human
uaccuguuccaccaaaaccuauggaaauuuaaaaaaaacaaaaauaaaaagcaaaacaaaaauc

SEQ ID NO: 480262 - RNA, 64 nt, Human
cuauggaaauuuaaaaaaaacaaaaauaaaaagcaaaacaaaaaucccaaaaugaauuccauuc

SEQ ID NO: 480263 - RNA, 64 nt, Human
uucugguuuaagaguaacaguuugauauuuuguaaaaacaaaaacacacccaaacacaccacau

SEQ ID NO: 480264 - RNA, 64 nt, Human
aaaaaggaaaaaaaacaccaaaauaagauaaaauaaaacaaauuuaaacaccaaaauaagauau

SEQ ID NO: 480265 - RNA, 64 nt, Human
gucccuacaauauuguuuuaagcccacacuacccaaaacaaagaaugggaagcacuugugauaa

SEQ ID NO: 480266 - RNA, 64 nt, Human
ggagugugaauuuauagaucuaacuuucauaggcaaaacaaaagcuucgagcuguugcgugugu

SEQ ID NO: 480267 - RNA, 64 nt, Human
uguccccuuccccacccucuaguguauuucacagaaaacaaaaccucccaauaaaacgguugaa

SEQ ID NO: 480268 - RNA, 64 nt, Human
cauuuuuuaaauccccucuguuuaaaagguuuguaaaacaaaaacaaaaaacuaagucugcuca

SEQ ID NO: 480269 - RNA, 64 nt, Human
uuaaauccccucuguuuaaaagguuuguaaaacaaaaacaaaaaacuaagucugcucagugaaa

SEQ ID NO: 480270 - RNA, 64 nt, Human
caaaaaaaaaaaaaggccacaaaacucaacaauaaaaacaaacaguccaauuagaaaaugggca

SEQ ID NO: 480271 - RNA, 64 nt, Human
uaagaaaagauaaacaccauuuuauuuauuuauaaaaacaaaauuaguuucaaauauuuuugac

SEQ ID NO: 480272 - RNA, 64 nt, Human
accuucauuucaucacaaucugugggcuuacaaaaaaacaaaaacuuuuguaguuuuguauguu

SEQ ID NO: 480273 - RNA, 64 nt, Human
uauguauaaucauauaugauauauucacaaagagaaaacaaaaggaacuuuuaaaaaaaaaauc

SEQ ID NO: 480274 - RNA, 64 nt, Human
agaauaagguuccauugcguagccagccuuaggaaaaacaaacagaacccaaaccagauggcaa

SEQ ID NO: 480275 - RNA, 64 nt, Human
gggaaaggugcauugguuuuauaaaaaggcauuuaaaacaaauuaucuuuguuaauuauuuugg

SEQ ID NO: 480276 - RNA, 64 nt, Human
uuuaaacaauacacuaagaaugacuccuauaaagaaaacaaaaaaagguagugaacuuucagcu

SEQ ID NO: 480277 - RNA, 64 nt, Human
ugugaaccuaccauguugccucccaucuucugaaaaaacaaaaaaauugagaggcugggcgugg

SEQ ID NO: 480278 - RNA, 64 nt, Human
uaaaaaaaaguuguuuauaaaaaccccuaaaaacaaaacaaacacacacacacacacauacaca

SEQ ID NO: 480279 - RNA, 64 nt, Human
cuuuauaaaaaaaaguuguuuauaaaaaccccuaaaaacaaaacaaacacacacacacacacau

SEQ ID NO: 480280 - RNA, 64 nt, Human
accaaaugcgaagucaaucugcuacuuaacccugaaaacaaaaucaguuuugcauauuaccacu

SEQ ID NO: 480281 - RNA, 64 nt, Human
ucuauuuuguuuuuuaaguaagacuuuuauuaauaaaacaaaauguuuuggagcaaauuuagua

SEQ ID NO: 480282 - RNA, 64 nt, Human
aggaagcaauauuuaauaaaacuaggucaaaaacaaaacaaaacagugacacucacuugugugu

SEQ ID NO: 480283 - RNA, 64 nt, Human
ccccaaggaagcaauauuuaauaaaacuaggucaaaaacaaaacaaaacagugacacucacuug

SEQ ID NO: 480284 - RNA, 64 nt, Human
ugccacauuuacuuuaguagauauaauuucauuaaaaacaaaaaagaaacaagguuuauauuaa

SEQ ID NO: 480285 - RNA, 64 nt, Human
ugaacauacaguauucauuaaugcagcguuugugaaaacaaaagauuggaagcuguuuaaauga

SEQ ID NO: 480286 - RNA, 64 nt, Human
ugguaaaacuccgacucuauuuaaaaaaaaaacaaaaacaaaaaaaccuuaaaugucaaaaaaa

SEQ ID NO: 480287 - RNA, 64 nt, Human
gaaaugugguaaaacuccgacucuauuuaaaaaaaaaacaaaaacaaaaaaaccuuaaauguca

SEQ ID NO: 480288 - RNA, 64 nt, Human
caguaugcaugaagacaugaaggcaagaaacagcaaaacaaauacugaagcaugaagauuccug

SEQ ID NO: 480289 - RNA, 64 nt, Human
auucuucuaauacauauuaaaagacauaacuaucaaaacaaaauaaauuugucuguuuucaacc

SEQ ID NO: 480290 - RNA, 64 nt, Human
agaucagcaaguuuggcagaguuuugguuuaagaaaaacaaaccacuacuaccuagcacaaguu

SEQ ID NO: 480291 - RNA, 64 nt, Human
uacaggaguuaaauaacaaugacacacacacaacaaaacaaacacaaaaccacugaucugugau

SEQ ID NO: 480292 - RNA, 64 nt, Human
cacuaaugguucauccucuauaaggccaacaaagaaaacaaauuaaugugauguaacuugcauu

SEQ ID NO: 480293 - RNA, 64 nt, Human
uuagcugacuuuucccuguagcccuaucauauuaaaaacaaaaagugguccacuugaagcagca

SEQ ID NO: 480294 - RNA, 64 nt, Human
ucuuuuucuuaaaaaaauaauaaaacuacagacaaaaacaaagugcaaacaacugagacagcaa

SEQ ID NO: 480295 - RNA, 64 nt, Human
guaagguauaucauucuaaagauagaguaaaaagaaaacaaaaccaaaaguuauuaaaauuguu

SEQ ID NO: 480296 - RNA, 64 nt, Human
uaagaauguaggccuuaacuauuucacaugagucaaaacaaagcagcuuuaaaaaaauaauugg

SEQ ID NO: 480297 - RNA, 64 nt, Human
aaaaacgaaacuccaucucaaaacaaaacaaaacaaaacaaacaaacaaacaaaacuugcaucu

SEQ ID NO: 480298 - RNA, 64 nt, Human
gcgacaaaaacgaaacuccaucucaaaacaaaacaaaacaaaacaaacaaacaaacaaaacuug

SEQ ID NO: 480299 - RNA, 64 nt, Human
ccugggcgacaaaaacgaaacuccaucucaaaacaaaacaaaacaaaacaaacaaacaaacaaa

SEQ ID NO: 480300 - RNA, 64 nt, Human
uccagccugggcgacaaaaacgaaacuccaucucaaaacaaaacaaaacaaaacaaacaaacaa

SEQ ID NO: 480301 - RNA, 64 nt, Human
uccaauucugcuuaagagguaauucacaauaaaaaaaacaaagaccaaaaauagcacauucuga

SEQ ID NO: 480302 - RNA, 64 nt, Human
uauugggaaccaagguuacuuucuuguuuuuggaaaaacaaaauuucuacaauuacaguuccca

SEQ ID NO: 480303 - RNA, 64 nt, Human
auggauugcuaguguuggugaguaaaaacaaaaaaaaacaaaugacaaagaaugugauagcuca

SEQ ID NO: 480304 - RNA, 64 nt, Human
ggaaaacagaauggauugcuaguguuggugaguaaaaacaaaaaaaaacaaaugacaaagaaug

SEQ ID NO: 480305 - RNA, 64 nt, Human
gcuuuagucauuugaacaugcuucuaaauaaaauaaaacaaaaccaaaacuauacuuuugaucu

SEQ ID NO: 480306 - RNA, 64 nt, Human
ugccuuucaauucaguguuauacuguguguagguaaaacaaaucucaauauggaauuaaauugu

SEQ ID NO: 480307 - RNA, 64 nt, Human
gagucuuuuucuuaccuagcccccucuuaucaguaaaacaaaggacuugccaugguucacagca

SEQ ID NO: 480308 - RNA, 64 nt, Human
guauuucauauaggaauuauuuuuuuuuucauuuaaaacaaauccacaucuuuuguaaaagcca

SEQ ID NO: 480309 - RNA, 64 nt, Human
accuagguaacagagagacaccucugucucugaaaaaacaaaacuugaaguuugaaacccccag

SEQ ID NO: 480310 - RNA, 64 nt, Human
cacaauuguucuucaaaaacaaacaaaacaaaacaaaacaaaauuaacugcuuaaauguuuugu

SEQ ID NO: 480311 - RNA, 64 nt, Human
aagaccacaauuguucuucaaaaacaaacaaaacaaaacaaaacaaaauuaacugcuuaaaugu

SEQ ID NO: 480312 - RNA, 64 nt, Human
uguaaaagaccacaauuguucuucaaaaacaaacaaaacaaaacaaaacaaaauuaacugcuua

SEQ ID NO: 480313 - RNA, 64 nt, Human
ccaagaaaauguaaaagaccacaauuguucuucaaaaacaaacaaaacaaaacaaaacaaaauu

SEQ ID NO: 480314 - RNA, 64 nt, Human
uguucugguagcccguauuugagguaagcugcugaaaacaaaagucucuauauucuuugccuau

SEQ ID NO: 480315 - RNA, 64 nt, Human
gaugugugcauuuggacaaauaguacuuaaaaacaaaacaaacaagcacucagcccagcuccuc

SEQ ID NO: 480316 - RNA, 64 nt, Human
ccacagaugugugcauuuggacaaauaguacuuaaaaacaaaacaaacaagcacucagcccagc

SEQ ID NO: 480317 - RNA, 64 nt, Human
uauuugcacuauugagucuucauguucccacuucaaaacaaacagaugcucugagagcaaacug

SEQ ID NO: 480318 - RNA, 64 nt, Human
caucuacagauauuuucagggauugcuucagaugaaaacaaaucacacaccguuucccaaacca

SEQ ID NO: 480319 - RNA, 64 nt, Human
cuguuauugucggcaggcggugagggguagaaaaaaaacaaacaaacaaacagaaaaaaaaacc

SEQ ID NO: 480320 - RNA, 64 nt, Human
guacugauuuuguggccagaugcaaugaucuuuaaaaacaaaucuuuucaauggcauaagaagu

SEQ ID NO: 480321 - RNA, 64 nt, Human
cacacacacagacacacacaaagaaucagcagagaaaacaaaauacaaguccuguucuguaguu

SEQ ID NO: 480322 - RNA, 64 nt, Human
caccaaccugcgugacagagcaagauugcaucucaaaacaaacaauaauaauaaauaauaaaaa

SEQ ID NO: 480323 - RNA, 64 nt, Human
uguaggagccaagucguguucuaaguauuuauuuaaaacaaaagaaucacguuuucccauuugu

SEQ ID NO: 480324 - RNA, 64 nt, Human
gccuggaggccagagugagacuccgucucaaaacaaaacaaaaguggguggcucacggguccgg

SEQ ID NO: 480325 - RNA, 64 nt, Human
cuccagccuggaggccagagugagacuccgucucaaaacaaaacaaaaguggguggcucacggg

SEQ ID NO: 480326 - RNA, 64 nt, Human
gcagccgccaucucacacgccucccuccuguggccgccggcagcauggacaaaggucuccaugc

SEQ ID NO: 480327 - RNA, 64 nt, Human
accgcaggugcaucgcgucgagguggggcacggccgccggcaagaaacccacccuguccggagg

SEQ ID NO: 480328 - RNA, 64 nt, Human
ugcacacgugccgaugaccgccugccuagcccugcgccggcaaccaccuaguggcccagggaag

SEQ ID NO: 480329 - RNA, 64 nt, Human
aguccgcggaauuccguucugggaagccaauggucgccggcaccccuugcuuccucccucuguu

SEQ ID NO: 480330 - RNA, 64 nt, Human
agaaaaauccuagcaguauugucaggugguggugcgccggcauugauuuuagggcagauaaaag

SEQ ID NO: 480331 - RNA, 64 nt, Human
aguacuucccgcuguuccucgccacgcucugggucgccggcaucuucuuucaugaaggucgggg

SEQ ID NO: 480332 - RNA, 64 nt, Human
cuggugcuacgcaucccgcggagcuucugcugagcgccggcaggucgucggcugcaaccacaca

SEQ ID NO: 480333 - RNA, 64 nt, Human
gggacuggccugucuguccacugcuguaaccccgcgccggcauagggaccuaaggcccacugga

SEQ ID NO: 480334 - RNA, 60 nt, Human
caugugggaacggacccugaccaucggcagcgccggcaagaccuucagcgccacuggcug

SEQ ID NO: 480335 - RNA, 64 nt, Human
gcagggcaggaccagcccacgcugacuacagggccgccggcaauaaaagcccaggagcccauuu

SEQ ID NO: 480336 - RNA, 64 nt, Human
ggagaaggcagugccacgugggaggacaaggccacgccggcagcuuccagcccugccgcagaag

SEQ ID NO: 480337 - RNA, 64 nt, Human
ucaccuccuccaagaagcccuccuugccaccccccgccggcaggggccccuccucugugcuccc

SEQ ID NO: 480338 - RNA, 64 nt, Human
acgaggacagccggcugcugacccguggcaagggcgccggcaugcccaaccucaucagcaccga

SEQ ID NO: 480339 - RNA, 64 nt, Human
ucgccaaacgcguuccagaauuuguccacaggugcgccggcaccugcuuucccaccucgaggcc

SEQ ID NO: 480340 - RNA, 64 nt, Human
aggcgugauuacacaugcacaccaacaugcaugccgccggcacaugcucgagacguguggacac

SEQ ID NO: 480341 - RNA, 64 nt, Human
gggacuuaguggcucugccgccagugagacuucccgccggcagcugugcgcaccaaagacucgg

SEQ ID NO: 480342 - RNA, 64 nt, Human
uuguccaggacucagccaugcacaccuugagcagcgccggcaggaggcacggaaggaacugugc

SEQ ID NO: 480343 - RNA, 64 nt, Human
ggcugagaccuuccaggcccugaggaaucccgggcgccggcaaggccccccucagcccgccagc

SEQ ID NO: 480344 - RNA, 56 nt, Human
ugcuggggccugauggcugaaggagacgccggcauccucgggggccuggggaaguu

SEQ ID NO: 480345 - RNA, 57 nt, Human
uccggauggaccgccugugagcgggcacgccggcacccugccgcucagccgucccga

SEQ ID NO: 480346 - RNA, 64 nt, Human
cuccucccccagaaaggaccucaaccacacuccacgccggcagccaacgcacaggaugggggcg

SEQ ID NO: 480347 - RNA, 64 nt, Human
cacagccuugccugaccacccuccagcagauagacgccggcaccccuuccucuuccuagggugg

SEQ ID NO: 480348 - RNA, 64 nt, Human
cccgcgcccgcgcccucgcccccgcccccggcggcgccggcaaaacuuuggcacuggggcacuu

SEQ ID NO: 480349 - RNA, 57 nt, Human
acuucgccuggcucuccuaggcccgcccgccggcagggucgguggcugccucgcucc

SEQ ID NO: 480350 - RNA, 61 nt, Human
ggaagguggcgcugggcuagcccacccugcacgccggcaccaaacccuguccucccacccc

SEQ ID NO: 480351 - RNA, 64 nt, Human
acccgccugccguccuggggcgccgccgccccgccgccggcaguggaccgcugugcgcgaaccc

SEQ ID NO: 480352 - RNA, 64 nt, Human
agacccuucugcagccacgaauguccacggagcccgccggcaggaaggaagacaccaugcuuua

SEQ ID NO: 480353 - RNA, 64 nt, Human; identical to SEQ ID NO: 480326

SEQ ID NO: 480354 - RNA, 64 nt, Human; identical to SEQ ID NO: 480327

SEQ ID NO: 480355 - RNA, 64 nt, Human; identical to SEQ ID NO: 480328

SEQ ID NO: 480356 - RNA, 64 nt, Human; identical to SEQ ID NO: 480329

SEQ ID NO: 480357 - RNA, 64 nt, Human; identical to SEQ ID NO: 480330

SEQ ID NO: 480358 - RNA, 64 nt, Human; identical to SEQ ID NO: 480331

SEQ ID NO: 480359 - RNA, 64 nt, Human; identical to SEQ ID NO: 480332

SEQ ID NO: 480360 - RNA, 64 nt, Human; identical to SEQ ID NO: 480333

SEQ ID NO: 480361 - RNA, 60 nt, Human; identical to SEQ ID NO: 480334

SEQ ID NO: 480362 - RNA, 64 nt, Human; identical to SEQ ID NO: 480335

SEQ ID NO: 480363 - RNA, 64 nt, Human; identical to SEQ ID NO: 480336

SEQ ID NO: 480364 - RNA, 64 nt, Human; identical to SEQ ID NO: 480337

SEQ ID NO: 480365 - RNA, 64 nt, Human; identical to SEQ ID NO: 480338

SEQ ID NO: 480366 - RNA, 64 nt, Human; identical to SEQ ID NO: 480339

SEQ ID NO: 480367 - RNA, 64 nt, Human; identical to SEQ ID NO: 480340

SEQ ID NO: 480368 - RNA, 64 nt, Human; identical to SEQ ID NO: 480341

SEQ ID NO: 480369 - RNA, 64 nt, Human; identical to SEQ ID NO: 480342

SEQ ID NO: 480370 - RNA, 64 nt, Human; identical to SEQ ID NO: 480343

SEQ ID NO: 480371 - RNA, 56 nt, Human; identical to SEQ ID NO: 480344

SEQ ID NO: 480372 - RNA, 57 nt, Human; identical to SEQ ID NO: 480345

SEQ ID NO: 480373 - RNA, 64 nt, Human; identical to SEQ ID NO: 480346

SEQ ID NO: 480374 - RNA, 64 nt, Human; identical to SEQ ID NO: 480347

SEQ ID NO: 480375 - RNA, 64 nt, Human; identical to SEQ ID NO: 480348

SEQ ID NO: 480376 - RNA, 57 nt, Human; identical to SEQ ID NO: 480349

SEQ ID NO: 480377 - RNA, 61 nt, Human; identical to SEQ ID NO: 480350

SEQ ID NO: 480378 - RNA, 64 nt, Human; identical to SEQ ID NO: 480351

SEQ ID NO: 480379 - RNA, 64 nt, Human; identical to SEQ ID NO: 480352

SEQ ID NO: 480380 - RNA, 64 nt, Human
ugcaucagccugcggguggccucuggauccuccguggaccgaaccguccccccaggaacacacc

SEQ ID NO: 480381 - RNA, 64 nt, Human
gaagcaccagggaaaguuuagagauuugcggcaauggaccgaagaacgggccaggaaguccucc

SEQ ID NO: 480382 - RNA, 64 nt, Human
gggagcaaaggggcguuccacauggacagaggcuuggaccgaggccuggucacagcagcgagca

SEQ ID NO: 480383 - RNA, 64 nt, Human
uuuauuuaagagucaauugcuuucuaaugcucuauggaccgacuaucaagauauuaguaagaaa

SEQ ID NO: 480384 - RNA, 64 nt, Human
auaaaggcaaaugauuugugagucuucuaguuacuggaccgaguuuucugcuggaucugguggg

SEQ ID NO: 480385 - RNA, 64 nt, Human
caacgggagcaagacuucuaacggcugauugguauggaccgagauuaucuuucaauugaaguga

SEQ ID NO: 480386 - RNA, 64 nt, Human
gaccuucggaaauagcgcuacuaguuggaagccauggaccgacuaugaauguguacauagccaa

SEQ ID NO: 480387 - RNA, 64 nt, Human
uuaacgauucaggcuuugaauuacucugucccucuggaccgaaucucuuuaacugcuggauagu

SEQ ID NO: 480388 - RNA, 64 nt, Human
ucagaccccaacccuggaucccaggagaaaggaguggaccgaggaaggaaggaaggcaaggcug

SEQ ID NO: 480389 - RNA, 64 nt, Human
ucaccuacugaggagccccacccccgccucuggauggaccgaaucagggacuagaguuuaacug

SEQ ID NO: 480390 - RNA, 64 nt, Human
ccacagagugauacaugcuaagguggguugggcuuggaccgauguccccauauguacagaacug

SEQ ID NO: 480391 - RNA, 64 nt, Human
cuuuacauccuuuuuccuacuuguuaugguuguuuggaccgauaagugugcuuaauccugaggc

SEQ ID NO: 480392 - RNA, 64 nt, Human
ucagcaaauggacaggaaauaaguccuuauugauuggaccgagccagggauggcgccagggcgg

SEQ ID NO: 480393 - RNA, 64 nt, Human
uucacauuauaguagcaaggaauuggugguauuauggaccgaacugaaaauuuuauguugaagc

SEQ ID NO: 480394 - RNA, 64 nt, Human
aacagauacgggcagcuaggaacaggggacaaaauggaccgaggggaacccacacaggugagac

SEQ ID NO: 480395 - RNA, 64 nt, Human
cccugggcuguaggccagggcagccacagcggcguggaccgagggucccagccugcaggcuccc

SEQ ID NO: 480396 - RNA, 64 nt, Human
uuugaagcaucaaauccugaucaaaugcucaagcuggaccgagcugcaagccugccuuggacaa

SEQ ID NO: 480397 - RNA, 64 nt, Human
cuuccuggucaacaaggaccucaagaacugccuguggaccgaggcccccuaccagugcaugaga

SEQ ID NO: 480398 - RNA, 64 nt, Human
gaacacugcagucagauccuguuacuugcuucaguggaccgaaaucuguauucuguuugcguac

SEQ ID NO: 480399 - RNA, 64 nt, Human
aaaaagaagugugcgcccggcuaaugcagcgguguggaccgaggaacaacuuggaagaucuacc

SEQ ID NO: 480400 - RNA, 64 nt, Human
gcugagagggugugggugcccuguugaccuacccuggaccgaguggaccacgaccucguccauu

SEQ ID NO: 480401 - RNA, 64 nt, Human
gcccuccuggcccugcuccuuccgcaguuagggguggaccgagccucgcuuuccccacuguucu

SEQ ID NO: 480402 - RNA, 64 nt, Human
ucacuauggacaacuaaugagaugcaaagucuuuuggaccgaugaugucucuacuacuggaucu

SEQ ID NO: 480403 - RNA, 64 nt, Human
acgagaggacacuucgugagccucccuguagccguggaccgaauacgcacucuugaaagcugca

SEQ ID NO: 480404 - RNA, 64 nt, Human
caagccucucacuuguuguaggacugcaagacacuggaccgaaagccuccaacacaaacccuag

SEQ ID NO: 480405 - RNA, 64 nt, Human
gagcccugugcagcccguggugguugaaggaggcuggaccgaacagacucaacaggaaauuaaa

SEQ ID NO: 480406 - RNA, 64 nt, Human
gguucuggauaaggucacuguccuaggugcuagguggaccgagcaaaagacucaguggaugaac

SEQ ID NO: 480407 - RNA, 64 nt, Human
gugcuggcacuuacacccacaacccggaaggcuguggaccgauuccucuaggguggugaccucc

SEQ ID NO: 480408 - RNA, 64 nt, Human
uaaaauuuagucgaggcaguuucaauuguuacuguggaccgaauuaggaucacaauaaacgaua

SEQ ID NO: 480409 - RNA, 64 nt, Human
gaaugcuaacaguucacuugcaguggaagauacuuggaccgaguagaggcauuuaggaacuugg

SEQ ID NO: 480410 - RNA, 64 nt, Human
uggggguuaugggguggggguggggacucagggcuggaccgacguccuaguggaccugauguga

SEQ ID NO: 480411 - RNA, 64 nt, Human
acagaaacugaacaaaaugagaugaaagccgagcuggaccgauuuuaacauucacauugcccug

SEQ ID NO: 480412 - RNA, 64 nt, Human
ggacaccacccgucccccgcccugcuccagagcguggaccgaggaggucuuugugcccugagca

SEQ ID NO: 480413 - RNA, 64 nt, Human
aagaacuauucacuguauuucauuuucuuuauauuggaccgaagucauuaaaacaaaaugaaac

SEQ ID NO: 480414 - RNA, 64 nt, Human
ggaauggauuaaacuuacaaaaaguaucuauaacuggaccgaagaauauggaagguaugaacag

SEQ ID NO: 480415 - RNA, 64 nt, Human
ggucacaccuucuggcaaauucaagaggcaugaguggaccgagagcacauccagcauuugcauc

SEQ ID NO: 480416 - RNA, 64 nt, Human
uaagcccaugugauguccaccaguggaugaaugcuggaccgagagcccuagcuucuggauccag

SEQ ID NO: 480417 - RNA, 64 nt, Human
agcagugugaaggagaagaggcaagaacgaccccuggaccgaccaaagcccgcgcgcugcugcg

SEQ ID NO: 480418 - RNA, 64 nt, Human
auuugcucaugggcacuucuggcaacuugacaaauggaccgaugcagauuuuagagagugacga

SEQ ID NO: 480419 - RNA, 64 nt, Human
gcccacuggaaaaaugaaucuauauuuugguuccuggaccgaaguucagucgcagccuucugug

SEQ ID NO: 480420 - RNA, 64 nt, Human
gcagggaaggagacaccaagcucacccuucgucauggaccgagguucccacucugggcaaagcc

SEQ ID NO: 480421 - RNA, 64 nt, Human
gacagccucuuacuugccaagaaaaugaagggauuggaccgagcuggaaaaccuccuuuaccag

SEQ ID NO: 480422 - RNA, 64 nt, Human
gaggcggcagcuagccuggccaguggcugucccguggaccgacaccugcgcccccuucugcaag

SEQ ID NO: 480423 - RNA, 64 nt, Human
aagcuggaacuuacugacuguaagagguuagagguggaccgagaaggacuuuucccagucuuca

SEQ ID NO: 480424 - RNA, 64 nt, Human
caccuguuuaugauccuggccucaccaagguauguggaccgagugacugaauuccuccagcaaa

SEQ ID NO: 480425 - RNA, 64 nt, Human
acuuggauggacuuguauagugagagaggaggccuggaccgagaugugaguccuguugaagacu

SEQ ID NO: 480426 - RNA, 64 nt, Human
acuuaaauccugcacguggcacuccaccacugacuggaccgagcuggcauauguuguuucuuug

SEQ ID NO: 480427 - RNA, 64 nt, Human
gcagacguuucccagggcguucaggcagcccugauggaccgaaggcucuggugucugguuuggc

SEQ ID NO: 480428 - RNA, 64 nt, Human
ccuccuccccucgcccucggccugguucugcagcuggaccgaccucauucaucgccugcccccu

SEQ ID NO: 480429 - RNA, 63 nt, Human
ucugcagagacacaauaaaagccagcagacccuuuggaccgaccaaggcugguggggacacug

SEQ ID NO: 480430 - RNA, 64 nt, Human
ugaguggcugguccaugucuauagaguaacacacuggaccgaggaaaagucagauuucauuuuc

SEQ ID NO: 480431 - RNA, 64 nt, Human
ucugcaguggaccaagcaccaguggcuucagcgguggaccgagcacaggagcuggcuucggcgg

SEQ ID NO: 480432 - RNA, 64 nt, Human
gcgguggaccaaacacuggugcuggcuuuggugguggaccgagcaccagugcuggcuuuggcag

SEQ ID NO: 480433 - RNA, 64 nt, Human
cauuugguagagcuuggggguguguguguggggguggaccgaauuuggcaagaaugaaauggug

SEQ ID NO: 480434 - RNA, 61 nt, Human
cuuaaaguuguguaauacuaaaaucacgagaacaccuaaacaacaaccaaaaaucuauugu

SEQ ID NO: 480435 - RNA, 61 nt, Human
agaagucacacuauuacuccaaugucaucagacaccuaaggucugccagccaggcuccugg

SEQ ID NO: 480436 - RNA, 61 nt, Human
guggaaacagugguccugaaucauugugcucacaccuaacuugaaaucuggucuuacuuuc

SEQ ID NO: 480437 - RNA, 61 nt, Human
gaaauguuacuuuuguuaaucuuuaaaaaauacaccuaaugaaagacauuccacuauuaug

SEQ ID NO: 480438 - RNA, 61 nt, Human
ugaaaagauauuacuguuaauuuuuuauuuaacaccuaaagcauuuccaacaucacuuugc

SEQ ID NO: 480439 - RNA, 61 nt, Human
ucuugcuuacaaggagggguuaccauguaucacaccuaaucuucccaauguuugggauauu

SEQ ID NO: 480440 - RNA, 61 nt, Human
ugguacuucagucguuuuuacugauccaccaacaccuaaagaggcuaugcuacagucucua

SEQ ID NO: 480441 - RNA, 61 nt, Human
uguuuuucaauuuuucccacuuugaaaacuuacaccuaaaggccuguaggccucuaacucu

SEQ ID NO: 480442 - RNA, 61 nt, Human
ugauuccuugaaaauguaauuuuccagaaaaacaccuaaagaaaauaaaacauggacaugc

SEQ ID NO: 480443 - RNA, 61 nt, Human
aucauugcucagccccaaugagaaagcagauacaccuaagccaucaucaaccacuaacauc

SEQ ID NO: 480444 - RNA, 61 nt, Human
aaaaaaaaaaagacugucauucauaccauucacaccuaaagacugaauuuuaucuguuuua

SEQ ID NO: 480445 - RNA, 61 nt, Human
aggauuagaaacauagacucccaaguuuuaaacaccuaaaugugaauaacccauauauaca

SEQ ID NO: 480446 - RNA, 52 nt, Human; identical to SEQ ID NO: 458606

SEQ ID NO: 480447 - RNA, 61 nt, Human
ccuuuuguuuauuaauggaagaguacuccccacaccuaagaccagauucuuauaucucccu

SEQ ID NO: 480448 - RNA, 61 nt, Human
cuucggacuuaaaccugccuaccugagucaaacaccuaaggauaacaucauuuccagcaug

SEQ ID NO: 480449 - RNA, 61 nt, Human
cucaaucuuuuugcuccacccugaauuccucacaccuaacccugauaguuaccuaaaguga

SEQ ID NO: 480450 - RNA, 61 nt, Human
guguacgaguguaagauacacuuuaagccagacaccuaauucuucaguucacugcccaugu

SEQ ID NO: 480451 - RNA, 61 nt, Human
uuggaaacuguuaagauaaacuguaauccagacaccuaauucuucaguucacuacucaugu

SEQ ID NO: 480452 - RNA, 61 nt, Human
ggaugacuuggugucuaauguguagugcuacacaccuaacuuauggggccaaaauagcaug

SEQ ID NO: 480453 - RNA, 61 nt, Human
ccaugggaggaggagguggggcccacucaacacaccuaagccaguggcccucuaggagggg

SEQ ID NO: 480454 - RNA, 61 nt, Human
cugguagacaguauaaaagcagugcaaauaaacaccuaaccuucugcaaacuucaggcuuu

SEQ ID NO: 480455 - RNA, 61 nt, Human
cgcagccaauuuuuuuaagcagaauaugagaacaccuaaguauucucuucauagcaguucc

SEQ ID NO: 480456 - RNA, 61 nt, Human
uguaguaguuugaugaauaauuuaaagaaaaacaccuaaaauuugaaaaaugauuguagga

SEQ ID NO: 480457 - RNA, 61 nt, Human
guuuucacccaaauuugaguagauauuuuaaacaccuaacaaaguaaagggcuaaaagcca

SEQ ID NO: 480458 - RNA, 61 nt, Human
uucccuuuuucuucuguuaauacuuaugguaacaccuaacugagccucacucacauuaaau

SEQ ID NO: 480459 - RNA, 61 nt, Human
cuuugcuuccuugcuuuuauguuuguacacaacaccuaaaaccaguuuugcugcuauaauu

SEQ ID NO: 480460 - RNA, 61 nt, Human
ggggaccggggccggcgggcuccaggccagcacaccuaacccauggauguggaaccuacgg

SEQ ID NO: 480461 - RNA, 61 nt, Human
uucugagcaagaggaagucaaaauuuauuuaacaccuaagccuuuuuguagacucuuuucu

SEQ ID NO: 480462 - RNA, 61 nt, Human
gcuuuaaauuaucuggcuguauucuaaaucaacaccuaaccccucaaggaaacugaagaau

SEQ ID NO: 480463 - RNA, 61 nt, Human
cagcuacggauauaaugaaaauuaucugcaaacaccuaaauuaaagagaaaaaaaaguagu

SEQ ID NO: 480464 - RNA, 61 nt, Human
uccgcacugaucugagagcugggcggcguccacaccuaagaacagcagcuccaccaaauga

SEQ ID NO: 480465 - RNA, 61 nt, Human
uuccaguugcacuauucugagggaaaaucugacaccuaagaaauuuacugugaaaaagcau

SEQ ID NO: 480466 - RNA, 61 nt, Human
uuacuuuaaaaggagguaacagccagccauuacaccuaaauuuaauuuauuuuauuaaaau

SEQ ID NO: 480467 - RNA, 61 nt, Human
uagcuuuagucuuccuaaauaagauccacccacaccuaagucacagaauuucuaaguuccc

SEQ ID NO: 480468 - RNA, 61 nt, Human
uucacaaauuauacuuuauauaaggcauuccacaccuaagaacuaguuuugggaaauguag

SEQ ID NO: 480469 - RNA, 61 nt, Human
uuuacaucuggauuuuuagucauucuaaaaaacaccuaauuauuaaaacauuuauagagug

SEQ ID NO: 480470 - RNA, 61 nt, Human
aacacauaaaaaaauggaagaaacugauaccacaccuaaggaccaaagauaagaaagacuu

SEQ ID NO: 480471 - RNA, 61 nt, Human
auggccaucccauuggccagaauccacagacacaccuaagccuguggcacugggacagaau

SEQ ID NO: 480472 - RNA, 61 nt, Human
guuuuagcaagaguccugagggcggggccgaacaccuaacuccgggaggcucccaggcgcc

SEQ ID NO: 480473 - RNA, 61 nt, Human
caguagugucuuuuacaugaagagaugauuuacaccuaauagacauugaauaugauagaca

SEQ ID NO: 480474 - RNA, 61 nt, Human
uucucacacuuggauccuucuguucuuccuuacaccuaaauaauacaagagauuaaugaau

SEQ ID NO: 480475 - RNA, 61 nt, Human
ggauuggaaaaaaauguuaaagguuuaggacacaccuaauaguauguccuuugaaugggaa

SEQ ID NO: 480476 - RNA, 61 nt, Human
uuucagugcacuguauauagaagucuaaaacacaccuaagagaaaaagaucgaauuuuuca

SEQ ID NO: 480477 - RNA, 61 nt, Human
uauuauuuuacuuauuuggaauuuacagagcacaccuaagcaauuaggauauaacaaaacu

SEQ ID NO: 480478 - RNA, 61 nt, Human
cuucaaucuacgauguuaaaacaaauuaaaaacaccuaagugacuaccacuuauuucuaaa

SEQ ID NO: 480479 - RNA, 61 nt, Human
ucaaaacaucucauguaccccauaaauauauacaccuaauacccacaaaacuuaaaauaua

SEQ ID NO: 480480 - RNA, 61 nt, Human
ccccuccacaccauccuagcgaggcaccagcacaccuaaucacagcaaagcccagaucccc

SEQ ID NO: 480481 - RNA, 61 nt, Human
gaacuaaaagucugagggggacacaaaugucacaccuaagaggacaaucaaucauuuugua

SEQ ID NO: 480482 - RNA, 61 nt, Human
uggcuacaugguucuucuggccgaugguaugacaccuaaguuagaacacagccuuggcugg

SEQ ID NO: 480483 - RNA, 61 nt, Human
guuauauuuaaaaaagcaaguuuggauuuuuacaccuaauuuacuaggaaaauauuuuauu

SEQ ID NO: 480484 - RNA, 61 nt, Human
aguucuccacuccaaugauaauaguucacuuacaccuaaacccaaaggaaaaaccagcucu

SEQ ID NO: 480485 - RNA, 61 nt, Human
uuguacacagguguacaccaugcaugcaccaacaccuaaaacucaaaacuaaauggcuauu

SEQ ID NO: 480486 - RNA, 61 nt, Human
uagacaugauugguggccaaguuauuuggggacaccuaaacagaucagugaccugaaugac

SEQ ID NO: 480487 - RNA, 61 nt, Human
gcacuuggcgagccuccugcccacccuguccacaccuaauaagugcaaucauuuugagucu

SEQ ID NO: 480488 - RNA, 61 nt, Human
uauauuauuuuagguauaauuuacaaaugucacaccuaauaaucuuuuauaauauaccaua

SEQ ID NO: 480489 - RNA, 61 nt, Human
uugaucaaguucgggggaauaaagacagaccacaccuaaaacugccuuucugcuucucuua

SEQ ID NO: 480490 - RNA, 61 nt, Human
caaagaugucaauggaaacuaaucgagucuuacaccuaauuuucaguuuacaguaaauaca

SEQ ID NO: 480491 - RNA, 61 nt, Human
cuccaaguaaacauuccaaguaagcgucuuaacaccuaaccccaaaggcucuuuuaagagc

SEQ ID NO: 480492 - RNA, 61 nt, Human
agauaacagaagugaccaauguaauuucacaacaccuaaggauuuuuugguugaucagguu

SEQ ID NO: 480493 - RNA, 61 nt, Human
uuacaaaauccuagauggcauagccuacuacacaccuaauguguaugguauagacuguugc

SEQ ID NO: 480494 - RNA, 61 nt, Human
uaguuuagcaguaaaaaaaaaaaaaaaaaccacaccuaaaauagaccacugaggagaccau

SEQ ID NO: 480495 - RNA, 61 nt, Human
gugguaaaacuuacaauccucaaaacuucuuacaccuaaaauucaugcaggagagaaacac

SEQ ID NO: 480496 - RNA, 61 nt, Human
ccagcacagugcuggacauagugaguacugaacaccuaagaggcacucauucagacugacu

SEQ ID NO: 480497 - RNA, 61 nt, Human
auccgacauuuuuuguauucuuuaagauuuuacaccuaaaaaaucucuccuaucccaaaaa

SEQ ID NO: 480498 - RNA, 61 nt, Human
aaaauccgagugaugauguugugaauacggaacaccuaaucacacagcuugcuuugcuuuu

SEQ ID NO: 480499 - RNA, 61 nt, Human
cgugugugaugucauucuucccuaaucgcuuacaccuaauauaagcuuguccucccuccca

SEQ ID NO: 480500 - RNA, 61 nt, Human
uauguagaaauaaaaauguugccauaaaauaacaccuaagcauauacuauucuaugcuuua

SEQ ID NO: 480501 - RNA, 61 nt, Human
ugguucaggcaguaugggccgcugugacaaaacaccuaagacuggguaguuuauaaagaac

SEQ ID NO: 480502 - RNA, 61 nt, Human
uacuacuuugguuuuccuagcuccauaccacacaccuaaaccuguauuaugaauuacauau

SEQ ID NO: 480503 - RNA, 61 nt, Human
gcaaucagcaugaacaccaggcaccccugggacaccuaacgcccaguucccgugaccccaa

SEQ ID NO: 480504 - RNA, 61 nt, Human
aaauacuuuuagauuugauuauguauacaugacaccuaaagagggaacaaaaguuaguuuu

SEQ ID NO: 480505 - RNA, 61 nt, Human
uuacuguagcagcaaaagcaaauuggucuccacaccuaaaaucgucugccuguguacuuug

SEQ ID NO: 480506 - RNA, 61 nt, Human
uuuccuuuuuuuaaaagccaauugacagauuacaccuaaauacuccuccuuuuguaucauu

SEQ ID NO: 480507 - RNA, 61 nt, Human
gauaucagggugguuuauaaagccuguaaacacaccuaagaaaauaaacauuuuacaaaug

SEQ ID NO: 480508 - RNA, 61 nt, Human
uggagggucccuuuuacgcaccccaaggcccacaccuaagcuuccauguagcccucaucca

SEQ ID NO: 480509 - RNA, 61 nt, Human
aaaaaagauuuaagauguacgacauuaccgaacaccuaaaauagaaccagagaaacgaaag

SEQ ID NO: 480510 - RNA, 61 nt, Human
ccaggugggcagcuguggcagagcagucccgacaccuaaauaaaagucuugcugcaggaga

SEQ ID NO: 480511 - RNA, 61 nt, Human
aacaaucuucacacgaaaccaaaaauagcauacaccuaauguuggguuagggaauugcaau

SEQ ID NO: 480512 - RNA, 61 nt, Human
ucaaaugaauauagaacuaauauugucgggaacaccuaauagaaaggaauacuauuauagc

SEQ ID NO: 480513 - RNA, 61 nt, Human
gacuccucuaguacuuggagaucuuggacguacaccuaaucccauggggccucggcuuccu

SEQ ID NO: 480514 - RNA, 61 nt, Human
gcuacuucugcaugcaucuacagggcaucugacaccuaacaugagacguggcaugugagau

SEQ ID NO: 480515 - RNA, 61 nt, Human
auaccacuuaaaaucucuagagaacuacugaacaccuaaagauuuucuguagcguagauau

SEQ ID NO: 480516 - RNA, 61 nt, Human
aauaucuagaaauuuuuaauugaguguaaacacaccuaacuuuaagaaaaagaaccgcuug

SEQ ID NO: 480517 - RNA, 61 nt, Human
auucuuuaaaaguguguuccuaaguagaaauacaccuaaaugaagauucucuuauuuuauc

SEQ ID NO: 480518 - RNA, 61 nt, Human
gggcagagcccauguuuccugacauagcucuacaccuaaauaagggacugaacccucccaa

SEQ ID NO: 480519 - RNA, 61 nt, Human
ugguagaaauguguuuauuuaacacacacacacaccuaauacuacauucaaaguauuuuau

SEQ ID NO: 480520 - RNA, 61 nt, Human
gaacgcuaugacaccaugaguggaaaauuccacaccuaacaaacacauuugcuuucuuaug

SEQ ID NO: 480521 - RNA, 61 nt, Human
cauuuaaggggauggcauucuuuauaccuaaacaccuaagagcugaagucaggucuuuuaa

SEQ ID NO: 480522 - RNA, 61 nt, Human
gacaugcaugcuauggggacccucuuguuggacaccuaauuggaugccucuucaugagagg

SEQ ID NO: 480523 - RNA, 61 nt, Human
aauagccauggguucuuuugggguaauguacacaccuaacugcauuuguuuugacuucuuu

SEQ ID NO: 480524 - RNA, 61 nt, Human
uacaggcaugagccaccacgcuuggcuaagaacaccuaaauuuuuauguuucuuggcucaa

SEQ ID NO: 480525 - RNA, 61 nt, Human
caaaucuauucagguuucuucacuguugagaacaccuaaauguuuuuauuuuugagaagug

SEQ ID NO: 480526 - RNA, 61 nt, Human
auuuuuuucugaaauguuuuaaaauagaaguacaccuaauuguuauugguuaaaaaaaaag

SEQ ID NO: 480527 - RNA, 61 nt, Human
cucacuuggccaaguuugcagccuugagccaacaccuaaaagggagaggugggcucuucug

SEQ ID NO: 480528 - RNA, 61 nt, Human
cagcagucaauuaacaauaagccaguauaaaacaccuaaauaaccaaucuacaaucucccu

SEQ ID NO: 480529 - RNA, 61 nt, Human
auuagaaaaagaggcgcuucuccccuccccuacaccuaaagguguauuuaaacuaucuugu

SEQ ID NO: 480530 - RNA, 61 nt, Human
uaugaugaauaacaacacuuaaaaacucaucacaccuaaagacauggaaagcugccaauua

SEQ ID NO: 480531 - RNA, 61 nt, Human
ucuacauaaaaacugcuacaugacaaaaaccacaccuaaagaaauuuuaagaauuuggcac

SEQ ID NO: 480532 - RNA, 61 nt, Human
gacccuggugguaccugugcuuucccagaggacaccuaaugucccgaugccucccuugagg

SEQ ID NO: 480533 - RNA, 61 nt, Human
ugaaaauugagauuacuucagagccuuagccacaccuaaaauaccuccuaguuaauagugg

SEQ ID NO: 480534 - RNA, 61 nt, Human
aaaugaauuuaaauaucuuuuaaagaaaaaaacaccuaaaaauaaaucuuaacagaaaauu

SEQ ID NO: 480535 - RNA, 61 nt, Human
gagaguccagggaggcaggauggaucaccagacaccuaaccuucagcguugcccauggccc

SEQ ID NO: 480536 - RNA, 61 nt, Human
uucuaggaagaauuuuaaaaaugaauccuacacaccuaagggacauguuuugauaaaguag

SEQ ID NO: 480537 - RNA, 61 nt, Human
acuugauaguuuuuuaaauuaaaaaauguauacaccuaacauagaaaauuaaagauagcug

SEQ ID NO: 480538 - RNA, 61 nt, Human
ucuucaucugaggagcaucuauauguuuaauacaccuaauguauuaugcuggaguauuuaa

SEQ ID NO: 480539 - RNA, 61 nt, Human
ccuccuugccucugcucugaccucagcagcuacaccuaaccccaccgcacccuacccagug

SEQ ID NO: 480540 - RNA, 61 nt, Human
uugcucuaacaaaauaaaccuuagacauaucacaccuaaaauaugcugcagauuuuauaau

SEQ ID NO: 480541 - RNA, 61 nt, Human
cauuuguagucuaggaaauugagauuuugauacaccuaaggucacgcagcuggguagauau

SEQ ID NO: 480542 - RNA, 61 nt, Human
ggccugauggagcuuguggcuggccucagauacaccuaagaagcuuaggggcaagguucau

SEQ ID NO: 480543 - RNA, 61 nt, Human
aggccugugcugagagccgcagccccugugcacaccuaacacagggcgcucccccugcugc

SEQ ID NO: 480544 - RNA, 61 nt, Human
agaaguagggagcuguucguuuaagcagcauacaccuaaauuggggguuuaaacauuaagu

SEQ ID NO: 480545 - RNA, 61 nt, Human
auggcccuauguggcucugcauucuagucagacaccuaacaccuccccaagcuucugcuau

SEQ ID NO: 480546 - RNA, 61 nt, Human
uuugagggaggugcuucgaagaauguugcccacaccuaaguguuagaagccuauguccguu

SEQ ID NO: 480547 - RNA, 61 nt, Human
uguguuggcaauacuuuucaaauggcugaaaacaccuaaaaauuguucauucagaaauauc

SEQ ID NO: 480548 - RNA, 61 nt, Human
uguaaucggcagugaacucagaacgcacugcacaccuaaggcaaaucccuggccacuuuag

SEQ ID NO: 480549 - RNA, 61 nt, Human
cugggaugcucugugaccccagcuggagcccacaccuaagggcuggcauccacaucauuuc

SEQ ID NO: 480550 - RNA, 61 nt, Human
acccaggucaccucauuccccuucucuguucacaccuaaugucuugaagaguagguagcag

SEQ ID NO: 480551 - RNA, 61 nt, Human
cauccuuaucccucuucuggcuugggcccugacaccuaagucuuucccacgguuuaugugu

SEQ ID NO: 480552 - RNA, 61 nt, Human
gacaaagaugucuuaaccucagggagugcagacaccuaaccccagggcacugccagcccac

SEQ ID NO: 480553 - RNA, 61 nt, Human
auaugauaaauauaacaucuaugaaaagcccacaccuaacauuauacuucauggugauaga

SEQ ID NO: 480554 - RNA, 61 nt, Human
ccgucauaacccaagguaccauccuaggcugacaccuaacucuucuuucauuucuucuaca

SEQ ID NO: 480555 - RNA, 61 nt, Human
auacaacagcauuuggggccaugguaccugcacaccuaaaacacuaggccacgcaucugau

SEQ ID NO: 480556 - RNA, 61 nt, Human
aaacuugaaagaugugacagugcuuuugacaacaccuaaaacuuuuaaacauaaaaaauca

SEQ ID NO: 480557 - RNA, 61 nt, Human
gcuucuugguaccucagcuguaaaaugaaacacaccuaaaagugugguuguuuccaacaug

SEQ ID NO: 480558 - RNA, 61 nt, Human
aguucucaauggccaacgaaggugcuuggaaacaccuaaccuugcaaguuuuaccgccuuu

SEQ ID NO: 480559 - RNA, 61 nt, Human
ucucaaaagcaaagcaaaaacaaaaacaaaaacaccuaaaaaaccugcaguuuuguuugua

SEQ ID NO: 480560 - RNA, 61 nt, Human
caaguagcugggacuacaggcaugugccaccacaccuaauuucuauauuuuuuguagagac

SEQ ID NO: 480561 - RNA, 61 nt, Human
uguguuugcaugaggaacucuuuaguggcagacaccuaagagacggcugcggucaccccac

SEQ ID NO: 480562 - RNA, 61 nt, Human
caucagaguccaugcuaaagagaaaucauauacaccuaacuguguggcagaggcuucauuu

SEQ ID NO: 480563 - RNA, 61 nt, Human
ucuucaucauggaaaccucaguuuuguucauacaccuaaauacuucaguaugucuuuccua

SEQ ID NO: 480564 - RNA, 61 nt, Human
ggacuuuuuaauuaaccacaauaccacuaucacaccuaauaauaguaauuccuuauggauc

SEQ ID NO: 480565 - RNA, 61 nt, Human
aagccaugugauucccagagccaggcgcuuuacaccuaaaguaguuugacuuucuucugua

SEQ ID NO: 480566 - RNA, 61 nt, Human
aacuuacucuugguuuagagcauguguagaaacaccuaagguagcucuaugcuaaauaaug

SEQ ID NO: 480567 - RNA, 61 nt, Human
ccacaucuggucucugccuucgguggcccacacaccuaagcgucaucgucauugccauagc

SEQ ID NO: 480568 - RNA, 61 nt, Human
cccuaggccacaagagaggccccccauccucacaccuaaccugcauggggcuucgcccaca

SEQ ID NO: 480569 - RNA, 61 nt, Human
cuggccccaguggucuggggagcccccaggcacaccuaagcgucguggagcauuguucugc

SEQ ID NO: 480570 - RNA, 61 nt, Human
gccgcgcggggaccggccaccuggagccuccacaccuaagcugcgccuccugucauuuccc

SEQ ID NO: 480571 - RNA, 61 nt, Human
aacuugcuauuuuaaacaaauaguucugucgacaccuaaaauauaaucuggcuucuugugu

SEQ ID NO: 480572 - RNA, 61 nt, Human
uaguuagacauggaaauuauuuuauaagcacacaccuaaagauaucuuuuuagaugauaaa

SEQ ID NO: 480573 - RNA, 61 nt, Human
uaaaaauaagccaaaauaagacuauugguaaacaccuaaauuuuuguaagaaaauuuaaaa

SEQ ID NO: 480574 - RNA, 61 nt, Human
gccugccccugaagaccuuugaguucagucuacaccuaagcagguagacauccgcgagguc

SEQ ID NO: 480575 - RNA, 61 nt, Human
gcaagaagucuauuaggucaguuuagcaagaacaccuaacccccccauaucuguucaaccu

SEQ ID NO: 480576 - RNA, 61 nt, Human
cugauauuggauauaaugcugcuuuuuagagacaccuaaauugcaguaucagaaugaaugu

SEQ ID NO: 480577 - RNA, 61 nt, Human
cuccucccuuuuuccuuguccccacacuccuacaccuaacucaccuaacucauacugugcu

SEQ ID NO: 480578 - RNA, 61 nt, Human
uagagaauuucuguuauaccaagcauaaaguacaccuaauaacguuguguuaaaaaagugu

SEQ ID NO: 480579 - RNA, 61 nt, Human
ggcucucuaguucagcaguucuuccccuccuacaccuaaguuagcguucaauauacgagac

SEQ ID NO: 480580 - RNA, 61 nt, Human
ugaggcacaugacagugguuauauuucaaccacaccuaaauuaacaaauucaguggacauu

SEQ ID NO: 480581 - RNA, 61 nt, Human
uagauugucuaucuguauaacacacacacacacaccuaagagucucuauuucacaauuaua

SEQ ID NO: 480582 - RNA, 61 nt, Human
cauacuuuaagucaucucucgauuauuuguaacaccuaauacaaugucagugcuauguaaa

SEQ ID NO: 480583 - RNA, 61 nt, Human
uacacaggcuaucaacauguuauucaaugugacaccuaacucuuuucuauuuuguuuuuua

SEQ ID NO: 480584 - RNA, 57 nt, Human; identical to SEQ ID NO: 458771

SEQ ID NO: 480585 - RNA, 61 nt, Human
gggcaagaggaaagauaaguaaguaccauacacaccuaaaagaugagagaauucauccaga

SEQ ID NO: 480586 - RNA, 61 nt, Human
guagcuucuccuuugucucccauccacucugacaccuaagccccacucuuuucccauuaga

SEQ ID NO: 480587 - RNA, 61 nt, Human
gguguaccaaugccccucaucucccacuuucacaccuaacccugacuccuucaccaagaag

SEQ ID NO: 480588 - RNA, 64 nt, Human; identical to SEQ ID NO: 242542

SEQ ID NO: 480589 - RNA, 64 nt, Human; identical to SEQ ID NO: 242543

SEQ ID NO: 480590 - RNA, 64 nt, Human; identical to SEQ ID NO: 242544

SEQ ID NO: 480591 - RNA, 64 nt, Human; identical to SEQ ID NO: 242545

SEQ ID NO: 480592 - RNA, 64 nt, Human; identical to SEQ ID NO: 242546

SEQ ID NO: 480593 - RNA, 64 nt, Human; identical to SEQ ID NO: 242547

SEQ ID NO: 480594 - RNA, 64 nt, Human; identical to SEQ ID NO: 242548

SEQ ID NO: 480595 - RNA, 64 nt, Human; identical to SEQ ID NO: 242549

SEQ ID NO: 480596 - RNA, 64 nt, Human; identical to SEQ ID NO: 242550

SEQ ID NO: 480597 - RNA, 64 nt, Human; identical to SEQ ID NO: 242551

SEQ ID NO: 480598 - RNA, 64 nt, Human; identical to SEQ ID NO: 242552

SEQ ID NO: 480599 - RNA, 64 nt, Human; identical to SEQ ID NO: 242553

SEQ ID NO: 480600 - RNA, 64 nt, Human; identical to SEQ ID NO: 242554

SEQ ID NO: 480601 - RNA, 64 nt, Human; identical to SEQ ID NO: 242555

SEQ ID NO: 480602 - RNA, 64 nt, Human; identical to SEQ ID NO: 242556

SEQ ID NO: 480603 - RNA, 64 nt, Human; identical to SEQ ID NO: 242557

SEQ ID NO: 480604 - RNA, 64 nt, Human; identical to SEQ ID NO: 240726

SEQ ID NO: 480605 - RNA, 64 nt, Human; identical to SEQ ID NO: 240123

SEQ ID NO: 480606 - RNA, 64 nt, Human; identical to SEQ ID NO: 242436

SEQ ID NO: 480607 - RNA, 64 nt, Human; identical to SEQ ID NO: 242437

SEQ ID NO: 480608 - RNA, 64 nt, Human; identical to SEQ ID NO: 242438

SEQ ID NO: 480609 - RNA, 64 nt, Human; identical to SEQ ID NO: 242470

SEQ ID NO: 480610 - RNA, 64 nt, Human; identical to SEQ ID NO: 240124

SEQ ID NO: 480611 - RNA, 54 nt, Human; identical to SEQ ID NO: 242453

SEQ ID NO: 480612 - RNA, 64 nt, Human; identical to SEQ ID NO: 242454

SEQ ID NO: 480613 - RNA, 64 nt, Human; identical to SEQ ID NO: 242455

SEQ ID NO: 480614 - RNA, 64 nt, Human; identical to SEQ ID NO: 242351

SEQ ID NO: 480615 - RNA, 64 nt, Human; identical to SEQ ID NO: 240125

SEQ ID NO: 480616 - RNA, 64 nt, Human; identical to SEQ ID NO: 242471

SEQ ID NO: 480617 - RNA, 64 nt, Human; identical to SEQ ID NO: 242472

SEQ ID NO: 480618 - RNA, 64 nt, Human; identical to SEQ ID NO: 242276

SEQ ID NO: 480619 - RNA, 64 nt, Human; identical to SEQ ID NO: 240126

SEQ ID NO: 480620 - RNA, 64 nt, Human; identical to SEQ ID NO: 242487

SEQ ID NO: 480621 - RNA, 64 nt, Human; identical to SEQ ID NO: 242488

SEQ ID NO: 480622 - RNA, 64 nt, Human; identical to SEQ ID NO: 242489

SEQ ID NO: 480623 - RNA, 64 nt, Human; identical to SEQ ID NO: 242504

SEQ ID NO: 480624 - RNA, 64 nt, Human; identical to SEQ ID NO: 240127

SEQ ID NO: 480625 - RNA, 64 nt, Human; identical to SEQ ID NO: 242505

SEQ ID NO: 480626 - RNA, 64 nt, Human; identical to SEQ ID NO: 242506

SEQ ID NO: 480627 - RNA, 64 nt, Human; identical to SEQ ID NO: 242385

SEQ ID NO: 480628 - RNA, 64 nt, Human; identical to SEQ ID NO: 240128

SEQ ID NO: 480629 - RNA, 64 nt, Human; identical to SEQ ID NO: 242521

SEQ ID NO: 480630 - RNA, 64 nt, Human; identical to SEQ ID NO: 242522

SEQ ID NO: 480631 - RNA, 64 nt, Human; identical to SEQ ID NO: 242523

SEQ ID NO: 480632 - RNA, 64 nt, Human; identical to SEQ ID NO: 242352

SEQ ID NO: 480633 - RNA, 64 nt, Human; identical to SEQ ID NO: 240129

SEQ ID NO: 480634 - RNA, 64 nt, Human; identical to SEQ ID NO: 242538

SEQ ID NO: 480635 - RNA, 64 nt, Human; identical to SEQ ID NO: 242539

SEQ ID NO: 480636 - RNA, 64 nt, Human; identical to SEQ ID NO: 242540

SEQ ID NO: 480637 - RNA, 64 nt, Human; identical to SEQ ID NO: 242334

SEQ ID NO: 480638 - RNA, 64 nt, Human; identical to SEQ ID NO: 240130

SEQ ID NO: 480639 - RNA, 64 nt, Human; identical to SEQ ID NO: 242182

SEQ ID NO: 480640 - RNA, 64 nt, Human; identical to SEQ ID NO: 242183

SEQ ID NO: 480641 - RNA, 64 nt, Human; identical to SEQ ID NO: 242184

SEQ ID NO: 480642 - RNA, 64 nt, Human; identical to SEQ ID NO: 242335

SEQ ID NO: 480643 - RNA, 64 nt, Human; identical to SEQ ID NO: 240131

SEQ ID NO: 480644 - RNA, 64 nt, Human; identical to SEQ ID NO: 242201

SEQ ID NO: 480645 - RNA, 64 nt, Human; identical to SEQ ID NO: 242202

SEQ ID NO: 480646 - RNA, 64 nt, Human; identical to SEQ ID NO: 242203

SEQ ID NO: 480647 - RNA, 64 nt, Human; identical to SEQ ID NO: 242353

SEQ ID NO: 480648 - RNA, 64 nt, Human; identical to SEQ ID NO: 240132

SEQ ID NO: 480649 - RNA, 64 nt, Human; identical to SEQ ID NO: 242220

SEQ ID NO: 480650 - RNA, 64 nt, Human; identical to SEQ ID NO: 242221

SEQ ID NO: 480651 - RNA, 64 nt, Human; identical to SEQ ID NO: 242222

SEQ ID NO: 480652 - RNA, 64 nt, Human; identical to SEQ ID NO: 242240

SEQ ID NO: 480653 - RNA, 64 nt, Human; identical to SEQ ID NO: 240133

SEQ ID NO: 480654 - RNA, 64 nt, Human; identical to SEQ ID NO: 242241

SEQ ID NO: 480655 - RNA, 64 nt, Human; identical to SEQ ID NO: 242305

SEQ ID NO: 480656 - RNA, 64 nt, Human; identical to SEQ ID NO: 240134

SEQ ID NO: 480657 - RNA, 64 nt, Human; identical to SEQ ID NO: 242257

SEQ ID NO: 480658 - RNA, 64 nt, Human; identical to SEQ ID NO: 242258

SEQ ID NO: 480659 - RNA, 64 nt, Human; identical to SEQ ID NO: 242259

SEQ ID NO: 480660 - RNA, 64 nt, Human; identical to SEQ ID NO: 242260

SEQ ID NO: 480661 - RNA, 64 nt, Human; identical to SEQ ID NO: 242402

SEQ ID NO: 480662 - RNA, 64 nt, Human; identical to SEQ ID NO: 240135

SEQ ID NO: 480663 - RNA, 64 nt, Human; identical to SEQ ID NO: 242277

SEQ ID NO: 480664 - RNA, 64 nt, Human; identical to SEQ ID NO: 242278

SEQ ID NO: 480665 - RNA, 64 nt, Human; identical to SEQ ID NO: 242144

SEQ ID NO: 480666 - RNA, 64 nt, Human; identical to SEQ ID NO: 240136

SEQ ID NO: 480667 - RNA, 64 nt, Human; identical to SEQ ID NO: 242368

SEQ ID NO: 480668 - RNA, 64 nt, Human; identical to SEQ ID NO: 242369

SEQ ID NO: 480669 - RNA, 64 nt, Human; identical to SEQ ID NO: 242370

SEQ ID NO: 480670 - RNA, 64 nt, Human; identical to SEQ ID NO: 242049

SEQ ID NO: 480671 - RNA, 64 nt, Human; identical to SEQ ID NO: 240137

SEQ ID NO: 480672 - RNA, 64 nt, Human; identical to SEQ ID NO: 242336

SEQ ID NO: 480673 - RNA, 64 nt, Human; identical to SEQ ID NO: 242403

SEQ ID NO: 480674 - RNA, 64 nt, Human; identical to SEQ ID NO: 240138

SEQ ID NO: 480675 - RNA, 64 nt, Human; identical to SEQ ID NO: 242386

SEQ ID NO: 480676 - RNA, 64 nt, Human; identical to SEQ ID NO: 242387

SEQ ID NO: 480677 - RNA, 64 nt, Human; identical to SEQ ID NO: 242306

SEQ ID NO: 480678 - RNA, 64 nt, Human; identical to SEQ ID NO: 240154

SEQ ID NO: 480679 - RNA, 64 nt, Human; identical to SEQ ID NO: 242419

SEQ ID NO: 480680 - RNA, 64 nt, Human; identical to SEQ ID NO: 242420

SEQ ID NO: 480681 - RNA, 64 nt, Human; identical to SEQ ID NO: 242421

SEQ ID NO: 480682 - RNA, 64 nt, Human; identical to SEQ ID NO: 242289

SEQ ID NO: 480683 - RNA, 64 nt, Human; identical to SEQ ID NO: 240155

SEQ ID NO: 480684 - RNA, 64 nt, Human; identical to SEQ ID NO: 241969

SEQ ID NO: 480685 - RNA, 64 nt, Human; identical to SEQ ID NO: 241970

SEQ ID NO: 480686 - RNA, 64 nt, Human; identical to SEQ ID NO: 241971

SEQ ID NO: 480687 - RNA, 64 nt, Human; identical to SEQ ID NO: 242290

SEQ ID NO: 480688 - RNA, 64 nt, Human; identical to SEQ ID NO: 240156

SEQ ID NO: 480689 - RNA, 64 nt, Human; identical to SEQ ID NO: 241979

SEQ ID NO: 480690 - RNA, 64 nt, Human; identical to SEQ ID NO: 241980

SEQ ID NO: 480691 - RNA, 64 nt, Human; identical to SEQ ID NO: 241981

SEQ ID NO: 480692 - RNA, 64 nt, Human; identical to SEQ ID NO: 242307

SEQ ID NO: 480693 - RNA, 64 nt, Human; identical to SEQ ID NO: 240172

SEQ ID NO: 480694 - RNA, 64 nt, Human; identical to SEQ ID NO: 242011

SEQ ID NO: 480695 - RNA, 64 nt, Human; identical to SEQ ID NO: 242012

SEQ ID NO: 480696 - RNA, 64 nt, Human; identical to SEQ ID NO: 242013

SEQ ID NO: 480697 - RNA, 64 nt, Human; identical to SEQ ID NO: 242030

SEQ ID NO: 480698 - RNA, 64 nt, Human; identical to SEQ ID NO: 240173

SEQ ID NO: 480699 - RNA, 64 nt, Human; identical to SEQ ID NO: 242031

SEQ ID NO: 480700 - RNA, 64 nt, Human; identical to SEQ ID NO: 242032

SEQ ID NO: 480701 - RNA, 64 nt, Human; identical to SEQ ID NO: 242125

SEQ ID NO: 480702 - RNA, 64 nt, Human; identical to SEQ ID NO: 240174

SEQ ID NO: 480703 - RNA, 64 nt, Human; identical to SEQ ID NO: 242050

SEQ ID NO: 480704 - RNA, 64 nt, Human; identical to SEQ ID NO: 242051

SEQ ID NO: 480705 - RNA, 64 nt, Human; identical to SEQ ID NO: 241281

SEQ ID NO: 480706 - RNA, 64 nt, Human; identical to SEQ ID NO: 240190

SEQ ID NO: 480707 - RNA, 64 nt, Human; identical to SEQ ID NO: 242106

SEQ ID NO: 480708 - RNA, 64 nt, Human; identical to SEQ ID NO: 242107

SEQ ID NO: 480709 - RNA, 64 nt, Human; identical to SEQ ID NO: 242108

SEQ ID NO: 480710 - RNA, 64 nt, Human; identical to SEQ ID NO: 242126

SEQ ID NO: 480711 - RNA, 64 nt, Human; identical to SEQ ID NO: 240191

SEQ ID NO: 480712 - RNA, 64 nt, Human; identical to SEQ ID NO: 242127

SEQ ID NO: 480713 - RNA, 64 nt, Human; identical to SEQ ID NO: 241908

SEQ ID NO: 480714 - RNA, 64 nt, Human; identical to SEQ ID NO: 240192

SEQ ID NO: 480715 - RNA, 64 nt, Human; identical to SEQ ID NO: 242145

SEQ ID NO: 480716 - RNA, 64 nt, Human; identical to SEQ ID NO: 242146

SEQ ID NO: 480717 - RNA, 64 nt, Human; identical to SEQ ID NO: 240869

SEQ ID NO: 480718 - RNA, 64 nt, Human; identical to SEQ ID NO: 240208

SEQ ID NO: 480719 - RNA, 64 nt, Human; identical to SEQ ID NO: 242291

SEQ ID NO: 480720 - RNA, 64 nt, Human; identical to SEQ ID NO: 242323

SEQ ID NO: 480721 - RNA, 64 nt, Human; identical to SEQ ID NO: 240209

SEQ ID NO: 480722 - RNA, 64 nt, Human; identical to SEQ ID NO: 242324

SEQ ID NO: 480723 - RNA, 57 nt, Human; identical to SEQ ID NO: 242325

SEQ ID NO: 480724 - RNA, 64 nt, Human; identical to SEQ ID NO: 242087

SEQ ID NO: 480725 - RNA, 64 nt, Human; identical to SEQ ID NO: 240210

SEQ ID NO: 480726 - RNA, 64 nt, Human; identical to SEQ ID NO: 242404

SEQ ID NO: 480727 - RNA, 64 nt, Human; identical to SEQ ID NO: 242068

SEQ ID NO: 480728 - RNA, 64 nt, Human; identical to SEQ ID NO: 240226

SEQ ID NO: 480729 - RNA, 64 nt, Human; identical to SEQ ID NO: 240817

SEQ ID NO: 480730 - RNA, 64 nt, Human; identical to SEQ ID NO: 240818

SEQ ID NO: 480731 - RNA, 64 nt, Human; identical to SEQ ID NO: 242088

SEQ ID NO: 480732 - RNA, 64 nt, Human; identical to SEQ ID NO: 240227

SEQ ID NO: 480733 - RNA, 64 nt, Human; identical to SEQ ID NO: 240834

SEQ ID NO: 480734 - RNA, 64 nt, Human; identical to SEQ ID NO: 240835

SEQ ID NO: 480735 - RNA, 64 nt, Human; identical to SEQ ID NO: 240836

SEQ ID NO: 480736 - RNA, 64 nt, Human; identical to SEQ ID NO: 240780

SEQ ID NO: 480737 - RNA, 64 nt, Human; identical to SEQ ID NO: 240228

SEQ ID NO: 480738 - RNA, 64 nt, Human; identical to SEQ ID NO: 240852

SEQ ID NO: 480739 - RNA, 64 nt, Human; identical to SEQ ID NO: 240853

SEQ ID NO: 480740 - RNA, 64 nt, Human; identical to SEQ ID NO: 240870

SEQ ID NO: 480741 - RNA, 64 nt, Human; identical to SEQ ID NO: 240244

SEQ ID NO: 480742 - RNA, 64 nt, Human; identical to SEQ ID NO: 240887

SEQ ID NO: 480743 - RNA, 64 nt, Human; identical to SEQ ID NO: 240888

SEQ ID NO: 480744 - RNA, 64 nt, Human; identical to SEQ ID NO: 240889

SEQ ID NO: 480745 - RNA, 64 nt, Human; identical to SEQ ID NO: 241909

SEQ ID NO: 480746 - RNA, 64 nt, Human; identical to SEQ ID NO: 240245

SEQ ID NO: 480747 - RNA, 64 nt, Human; identical to SEQ ID NO: 240959

SEQ ID NO: 480748 - RNA, 64 nt, Human; identical to SEQ ID NO: 240960

SEQ ID NO: 480749 - RNA, 64 nt, Human; identical to SEQ ID NO: 240961

SEQ ID NO: 480750 - RNA, 64 nt, Human; identical to SEQ ID NO: 242163

SEQ ID NO: 480751 - RNA, 64 nt, Human; identical to SEQ ID NO: 240246

SEQ ID NO: 480752 - RNA, 64 nt, Human; identical to SEQ ID NO: 241029

SEQ ID NO: 480753 - RNA, 64 nt, Human; identical to SEQ ID NO: 241030

SEQ ID NO: 480754 - RNA, 64 nt, Human; identical to SEQ ID NO: 240871

SEQ ID NO: 480755 - RNA, 64 nt, Human; identical to SEQ ID NO: 240262

SEQ ID NO: 480756 - RNA, 64 nt, Human; identical to SEQ ID NO: 241931

SEQ ID NO: 480757 - RNA, 64 nt, Human; identical to SEQ ID NO: 241949

SEQ ID NO: 480758 - RNA, 64 nt, Human; identical to SEQ ID NO: 240263

SEQ ID NO: 480759 - RNA, 64 nt, Human; identical to SEQ ID NO: 241950

SEQ ID NO: 480760 - RNA, 51 nt, Human; identical to SEQ ID NO: 241951

SEQ ID NO: 480761 - RNA, 64 nt, Human; identical to SEQ ID NO: 240762

SEQ ID NO: 480762 - RNA, 64 nt, Human; identical to SEQ ID NO: 240264

SEQ ID NO: 480763 - RNA, 64 nt, Human; identical to SEQ ID NO: 241992

SEQ ID NO: 480764 - RNA, 64 nt, Human; identical to SEQ ID NO: 241993

SEQ ID NO: 480765 - RNA, 64 nt, Human; identical to SEQ ID NO: 241994

SEQ ID NO: 480766 - RNA, 64 nt, Human; identical to SEQ ID NO: 240672

SEQ ID NO: 480767 - RNA, 64 nt, Human; identical to SEQ ID NO: 240280

SEQ ID NO: 480768 - RNA, 64 nt, Human; identical to SEQ ID NO: 242089

SEQ ID NO: 480769 - RNA, 50 nt, Human; identical to SEQ ID NO: 240636

SEQ ID NO: 480770 - RNA, 64 nt, Human; identical to SEQ ID NO: 240281

SEQ ID NO: 480771 - RNA, 64 nt, Human; identical to SEQ ID NO: 242164

SEQ ID NO: 480772 - RNA, 64 nt, Human; identical to SEQ ID NO: 242165

SEQ ID NO: 480773 - RNA, 64 nt, Human; identical to SEQ ID NO: 240618

SEQ ID NO: 480774 - RNA, 64 nt, Human; identical to SEQ ID NO: 240282

SEQ ID NO: 480775 - RNA, 64 nt, Human; identical to SEQ ID NO: 240564

SEQ ID NO: 480776 - RNA, 64 nt, Human; identical to SEQ ID NO: 240565

SEQ ID NO: 480777 - RNA, 64 nt, Human; identical to SEQ ID NO: 240566

SEQ ID NO: 480778 - RNA, 64 nt, Human; identical to SEQ ID NO: 240619

SEQ ID NO: 480779 - RNA, 64 nt, Human; identical to SEQ ID NO: 240298

SEQ ID NO: 480780 - RNA, 58 nt, Human; identical to SEQ ID NO: 240600

SEQ ID NO: 480781 - RNA, 64 nt, Human; identical to SEQ ID NO: 240601

SEQ ID NO: 480782 - RNA, 64 nt, Human; identical to SEQ ID NO: 240602

SEQ ID NO: 480783 - RNA, 64 nt, Human; identical to SEQ ID NO: 240654

SEQ ID NO: 480784 - RNA, 64 nt, Human; identical to SEQ ID NO: 240299

SEQ ID NO: 480785 - RNA, 64 nt, Human; identical to SEQ ID NO: 240620

SEQ ID NO: 480786 - RNA, 64 nt, Human; identical to SEQ ID NO: 240727

SEQ ID NO: 480787 - RNA, 64 nt, Human; identical to SEQ ID NO: 240300

SEQ ID NO: 480788 - RNA, 64 nt, Human; identical to SEQ ID NO: 240637

SEQ ID NO: 480789 - RNA, 64 nt, Human; identical to SEQ ID NO: 240638

SEQ ID NO: 480790 - RNA, 64 nt, Human; identical to SEQ ID NO: 240798

SEQ ID NO: 480791 - RNA, 64 nt, Human; identical to SEQ ID NO: 240316

SEQ ID NO: 480792 - RNA, 64 nt, Human; identical to SEQ ID NO: 240673

SEQ ID NO: 480793 - RNA, 64 nt, Human; identical to SEQ ID NO: 240674

SEQ ID NO: 480794 - RNA, 64 nt, Human; identical to SEQ ID NO: 240529

SEQ ID NO: 480795 - RNA, 64 nt, Human; identical to SEQ ID NO: 240317

SEQ ID NO: 480796 - RNA, 64 nt, Human; identical to SEQ ID NO: 240710

SEQ ID NO: 480797 - RNA, 64 nt, Human; identical to SEQ ID NO: 240763

SEQ ID NO: 480798 - RNA, 64 nt, Human; identical to SEQ ID NO: 240318

SEQ ID NO: 480799 - RNA, 64 nt, Human; identical to SEQ ID NO: 240728

SEQ ID NO: 480800 - RNA, 64 nt, Human; identical to SEQ ID NO: 240493

SEQ ID NO: 480801 - RNA, 52 nt, Human; identical to SEQ ID NO: 240334

SEQ ID NO: 480802 - RNA, 64 nt, Human; identical to SEQ ID NO: 240764

SEQ ID NO: 480803 - RNA, 64 nt, Human; identical to SEQ ID NO: 241889

SEQ ID NO: 480804 - RNA, 64 nt, Human; identical to SEQ ID NO: 240335

SEQ ID NO: 480805 - RNA, 64 nt, Human; identical to SEQ ID NO: 240781

SEQ ID NO: 480806 - RNA, 64 nt, Human; identical to SEQ ID NO: 240782

SEQ ID NO: 480807 - RNA, 64 nt, Human; identical to SEQ ID NO: 240582

SEQ ID NO: 480808 - RNA, 64 nt, Human; identical to SEQ ID NO: 240336

SEQ ID NO: 480809 - RNA, 64 nt, Human; identical to SEQ ID NO: 240799

SEQ ID NO: 480810 - RNA, 57 nt, Human; identical to SEQ ID NO: 240800

SEQ ID NO: 480811 - RNA, 64 nt, Human; identical to SEQ ID NO: 240494

SEQ ID NO: 480812 - RNA, 64 nt, Human; identical to SEQ ID NO: 240352

SEQ ID NO: 480813 - RNA, 64 nt, Human; identical to SEQ ID NO: 241910

SEQ ID NO: 480814 - RNA, 64 nt, Human; identical to SEQ ID NO: 241911

SEQ ID NO: 480815 - RNA, 64 nt, Human; identical to SEQ ID NO: 240457

SEQ ID NO: 480816 - RNA, 64 nt, Human; identical to SEQ ID NO: 240353

SEQ ID NO: 480817 - RNA, 64 nt, Human; identical to SEQ ID NO: 242069

SEQ ID NO: 480818 - RNA, 64 nt, Human; identical to SEQ ID NO: 242070

SEQ ID NO: 480819 - RNA, 64 nt, Human; identical to SEQ ID NO: 240439

SEQ ID NO: 480820 - RNA, 64 nt, Human; identical to SEQ ID NO: 240354

SEQ ID NO: 480821 - RNA, 64 nt, Human; identical to SEQ ID NO: 240440

SEQ ID NO: 480822 - RNA, 64 nt, Human; identical to SEQ ID NO: 240441

SEQ ID NO: 480823 - RNA, 64 nt, Human; identical to SEQ ID NO: 241890

SEQ ID NO: 480824 - RNA, 64 nt, Human; identical to SEQ ID NO: 241891

SEQ ID NO: 480825 - RNA, 64 nt, Human; identical to SEQ ID NO: 240367

SEQ ID NO: 480826 - RNA, 64 nt, Human; identical to SEQ ID NO: 240368

SEQ ID NO: 480827 - RNA, 64 nt, Human; identical to SEQ ID NO: 240369

SEQ ID NO: 480828 - RNA, 64 nt, Human; identical to SEQ ID NO: 240385

SEQ ID NO: 480829 - RNA, 64 nt, Human; identical to SEQ ID NO: 240386

SEQ ID NO: 480830 - RNA, 64 nt, Human; identical to SEQ ID NO: 240387

SEQ ID NO: 480831 - RNA, 63 nt, Human
cauggacagcugcuuaucaagacacuccaucaaccccuacaguaacagggagagcaggauccu

SEQ ID NO: 480832 - RNA, 63 nt, Human
ccagaaacagaaaagaaaugacgacccaagaccccccuacaagcauacuucuuuugcguauua

SEQ ID NO: 480833 - RNA, 63 nt, Human
caagguacagccguuagagacuaucuaauugagccccuacauuuuguaguuaaggaaaacuga

SEQ ID NO: 480834 - RNA, 63 nt, Human
uauauaggaaccauguacagagcccagagaagcccccuacauccccccgggaaaaaaaagaaa

SEQ ID NO: 480835 - RNA, 63 nt, Human
gcgccuccuggccaggcagggcgccugggagaaccccuacacugcccuggccuuugcagagua

SEQ ID NO: 480836 - RNA, 64 nt, Human; identical to SEQ ID NO: 206311

SEQ ID NO: 480837 - RNA, 64 nt, Human; identical to SEQ ID NO: 206312

SEQ ID NO: 480838 - RNA, 63 nt, Human
acgacucacugcggcugcgccacugggaccccuccccuacaugcaccaaugcacucucucccc

SEQ ID NO: 480839 - RNA, 63 nt, Human
cuguccacaguaggaaacauaaagaaacaauguccccuacauauccccaugacuacauaaucc

SEQ ID NO: 480840 - RNA, 63 nt, Human
ccccaagcacuauuucuuccuuuuccacuuaggccccuacaugccuguagccuuucucacucc

SEQ ID NO: 480841 - RNA, 63 nt, Human
uucagccuguuucugcagcagccaggguucuccccccuacacccucugcagguggagagagag

SEQ ID NO: 480842 - RNA, 63 nt, Human
gcccccucccuucacagggguacagaaauuaucccccuacaaccccagccuccugagggcucc

SEQ ID NO: 480843 - RNA, 63 nt, Human
aaccuaggauggauagaaggaaacauauguucuccccuacauuaguaaaaauaaaaauggaau

SEQ ID NO: 480844 - RNA, 63 nt, Human
cagggucuugcuuucuuugaccucuucucuccuccccuacaccaacaaagaggaauggcugca

SEQ ID NO: 480845 - RNA, 63 nt, Human
uauuaaugcgaucuggcaucuucucccacaagcccccuacagggaacaacuacccccuaccuu

SEQ ID NO: 480846 - RNA, 63 nt, Human
auccuacaaacaacaacuguucacaacagcaaaccccuacauuuaugagcuguaagaagaaaa

SEQ ID NO: 480847 - RNA, 63 nt, Human
gcacccuggacuucucuaauagaaaagucuccaccccuacacaaggacagaacccuccacccc

SEQ ID NO: 480848 - RNA, 63 nt, Human
aacucccauauauuugcuucccccaaauugcugccccuacagacucaaagcucuuuuucuuug

SEQ ID NO: 480849 - RNA, 63 nt, Human
aaccccaucaaaauagauuucaauugacuguuuccccuacaucuuuugagccacagucgccca

SEQ ID NO: 480850 - RNA, 63 nt, Human
gaguaagcagggagagaagcaauauuacucccuccccuacaccagggacuugccccagggcag

SEQ ID NO: 480851 - RNA, 63 nt, Human
auucuuagcuuggacagcaccuuuaagcucuacccccuacaucaaaaugcacuuuagugcccc

SEQ ID NO: 480852 - RNA, 63 nt, Human
uuauaaacaaauacuuuuccugccuccaccaaaccccuacagaacaucaccuggaauugccac

SEQ ID NO: 480853 - RNA, 63 nt, Human
gacaagcuguuuucuuuucuagguuacugauaaccccuacaauuuucgacuuaacuucaaaac

SEQ ID NO: 480854 - RNA, 64 nt, Human; identical to SEQ ID NO: 206288

SEQ ID NO: 480855 - RNA, 64 nt, Human; identical to SEQ ID NO: 206289

SEQ ID NO: 480856 - RNA, 64 nt, Human; identical to SEQ ID NO: 206293

SEQ ID NO: 480857 - RNA, 64 nt, Human; identical to SEQ ID NO: 206296

SEQ ID NO: 480858 - RNA, 63 nt, Human
agguucuauuugauuacuaagcaaaaucuguuaccccuacaggguuuagaaccuaaguauuag

SEQ ID NO: 480859 - RNA, 63 nt, Human
gagccucugcaauauucuggcaauuuaauauacccccuacaaaagcacuccacagcuuuuaca

SEQ ID NO: 480860 - RNA, 63 nt, Human
aggaaggucguuucacauucuguaguaaaaauaccccuacaaucauuuugguagggucuucug

SEQ ID NO: 480861 - RNA, 63 nt, Human
uaaagggguaggccuuauguugauugggaugcuccccuacagccuuacagguagaauagaagg

SEQ ID NO: 480862 - RNA, 63 nt, Human
ggcccagugcacucacuucacagugacagcccuccccuacaauccuugggcagagcauguggu

SEQ ID NO: 480863 - RNA, 63 nt, Human
guagcugcccugaccucggagcagucugucgccccccuacaccucagccaguccuggcuuccc

SEQ ID NO: 480864 - RNA, 63 nt, Human
gacauggacagaaacugacuuagugcucacaagccccuacaccuucugggcugaagaucaccc

SEQ ID NO: 480865 - RNA, 63 nt, Human
aggacucuguggccgacuauaggcgucucccauccccuacaccuucccccagccacagccauc

SEQ ID NO: 480866 - RNA, 63 nt, Human
aaaaugauacacuaucucugugaaauagccucaccccuacauguggauagaaggaaaugaaaa

SEQ ID NO: 480867 - RNA, 63 nt, Human
cucaggguggggcugucccuuccaggaguuuugccccuacaagggguuagucaagaagcugag

SEQ ID NO: 480868 - RNA, 63 nt, Human
ucaggccugugcccacucccuaucuccuucccaccccuacacacacacucccugcuugcagga

SEQ ID NO: 480869 - RNA, 63 nt, Human
cuacucagcucucuugcacugaggaaauuuuucccccuacauugacuccuggccuacaucagc

SEQ ID NO: 480870 - RNA, 63 nt, Human
agcacuaucaugugucacguuucccggacucugccccuacaucucagcugaaucuccagggag

SEQ ID NO: 480871 - RNA, 63 nt, Human
aaggagugaaagaaaauauaagaagaaaaaaauccccuacauuuuauuggcacagaaaaguau

SEQ ID NO: 480872 - RNA, 63 nt, Human
gcuucggaguuucuuagucauuacuguccuuuuccccuacagaauuuucccucuuggugugau

SEQ ID NO: 480873 - RNA, 63 nt, Human
cgggacagcggccccgcggagcccccgccccucccccuacagauccuccgcggaggccccuga

SEQ ID NO: 480874 - RNA, 64 nt, Human; identical to SEQ ID NO: 206297

SEQ ID NO: 480875 - RNA, 64 nt, Human; identical to SEQ ID NO: 206320

SEQ ID NO: 480876 - RNA, 64 nt, Human; identical to SEQ ID NO: 206321

SEQ ID NO: 480877 - RNA, 64 nt, Human; identical to SEQ ID NO: 206322

SEQ ID NO: 480878 - RNA, 61 nt, Human
ucagcuucuuccgagggugacaggugaaagaccccuacagaucugaccucucccugacaga

SEQ ID NO: 480879 - RNA, 63 nt, Human
cagaacaauaaaugucacaaucccuucuauagcccccuacagugaucucuucaaggucaacug

SEQ ID NO: 480880 - RNA, 63 nt, Human
uuucaucagaaguuuucauuuuuucuaaauccuccccuacaaaauuuucagauuggaaauuac

SEQ ID NO: 480881 - RNA, 63 nt, Human
aaucuugacugaauggagaaaguuucugugcuaccccuacaaacccaugccucacugacagac

SEQ ID NO: 480882 - RNA, 63 nt, Human
gcagccucugccucuccugaaaccucugacaacccccuacacacacacacaggcauacucaga

SEQ ID NO: 480883 - RNA, 63 nt, Human
cuggguucaagucccagcucuaccccuucuuggccccuacaagucacuugacccaucuuaggc

SEQ ID NO: 480884 - RNA, 63 nt, Human
augaaauguaaaacaucugauaaaacuuacagcccccuacaccaagaguguaucugugaaaga

SEQ ID NO: 480885 - RNA, 63 nt, Human
caggcagucuuuggguucuguucuuugucacguccccuacaaguaaauuuuguuucuuugaac

SEQ ID NO: 480886 - RNA, 63 nt, Human
uggacaguacuguugcccucuuccaauccucuuccccuacaucccuggcacugguuguuuucu

SEQ ID NO: 480887 - RNA, 63 nt, Human
cuuuuguauggacaguuccccuucagucccaucccccuacacauacacccagccggggccaaa

SEQ ID NO: 480888 - RNA, 63 nt, Human
gccagacagugaccucaaauguugccuuggaguccccuacagccccucagcagagggcagcac

SEQ ID NO: 480889 - RNA, 63 nt, Human
cauuccugccuucuggcucucagaaucuucucuccccuacagcuacuacaguacuuccugacu

SEQ ID NO: 480890 - RNA, 63 nt, Human
cagcaaugaaggcuggagaaugcagccuggauuccccuacacacacacacacacacacacaca

SEQ ID NO: 480891 - RNA, 63 nt, Human
ucguuucuggugccucaucuaaaggugaaaccuccccuacauucaccagccggaugucccaaa

SEQ ID NO: 480892 - RNA, 63 nt, Human
gccugcggggugucuguauccugcaggaggacgccccuacagacccagcaacccaaguugcca

SEQ ID NO: 480893 - RNA, 63 nt, Human
uaaaguaauuuuugacucccagaucagucagagccccuacagcauuguuaagaaaguauuuga

SEQ ID NO: 480894 - RNA, 64 nt, Human; identical to SEQ ID NO: 206323

SEQ ID NO: 480895 - RNA, 64 nt, Human; identical to SEQ ID NO: 206324

SEQ ID NO: 480896 - RNA, 64 nt, Human; identical to SEQ ID NO: 206325

SEQ ID NO: 480897 - RNA, 64 nt, Human; identical to SEQ ID NO: 206329

SEQ ID NO: 480898 - RNA, 63 nt, Human
gggcucaggcuggggccucccauugacauccucccccuacacucccucucugagccuccgucg

SEQ ID NO: 480899 - RNA, 63 nt, Human
uugagcugagcugaagcugaugcuggggucagaccccuacagagaaccagugcuuccuucguc

SEQ ID NO: 480900 - RNA, 63 nt, Human
ugcagagcucugcagguguggauucaccuuacgccccuacagcaggcucagcccuucccaccc

SEQ ID NO: 480901 - RNA, 62 nt, Human
aggagguggaugaggauugaaacgggcagcuuccccuacaggccuccacccaaccaccaucc

SEQ ID NO: 480902 - RNA, 63 nt, Human
cucagaacuaccccuuccagggccucagaacuaccccuacaguuucuccugcguaaccuucug

SEQ ID NO: 480903 - RNA, 63 nt, Human
ccuggaagaggagggggccccgggaaggggccuccccuacaucgcugcugucguccacgcccu

SEQ ID NO: 480904 - RNA, 63 nt, Human
guccaccucucauugcugaucaauuucucauuaccccuacacaucucuccacggagcccagac

SEQ ID NO: 480905 - RNA, 63 nt, Human
ucuguuagauauguccagagauggaaacucacuccccuacaaaagauggagcuuaauggagaa

SEQ ID NO: 480906 - RNA, 63 nt, Human
accugggcauuguugagguuaaguuucucuucaccccuacacugugaaggguacagauuaggu

SEQ ID NO: 480907 - RNA, 63 nt, Human
gucagcucagggcccugugcccgcuugccuguuccccuacaucugugccugcacauccagaac

SEQ ID NO: 480908 - RNA, 63 nt, Human
cccucacccagcccggcccccacccuguccagaccccuacagcugugucuaagcucaggagga

SEQ ID NO: 480909 - RNA, 63 nt, Human
ccaucugcuuccugaaagacuucagugucagcuccccuacacacaccccacaccuucaccccu

SEQ ID NO: 480910 - RNA, 63 nt, Human
acaacuuuggacuguccaacuugcuucccgaggccccuacaagccgguggccucuguaggacc

SEQ ID NO: 480911 - RNA, 63 nt, Human
gagcaggagaggagauucuaagaaggauaguccccccuacaacauacugucauacugcugggu

SEQ ID NO: 480912 - RNA, 63 nt, Human
ucucccacagucacaaagcuguuuucacuguggccccuacaucucuuaacuuuugcuauuacu

SEQ ID NO: 480913 - RNA, 63 nt, Human
uucccagcucgucugccugcccccggccccgcgccccuacagccgccaaccucguauaacagu

SEQ ID NO: 480914 - RNA, 64 nt, Human; identical to SEQ ID NO: 206330

SEQ ID NO: 480915 - RNA, 64 nt, Human; identical to SEQ ID NO: 206331

SEQ ID NO: 480916 - RNA, 64 nt, Human; identical to SEQ ID NO: 206332

SEQ ID NO: 480917 - RNA, 64 nt, Human; identical to SEQ ID NO: 206333

SEQ ID NO: 480918 - RNA, 63 nt, Human
uuguucggucagcccuucccuaauuacaccuauccccuacacauacaugcacauagacacaca

SEQ ID NO: 480919 - RNA, 63 nt, Human
uuuccagugcggagucugagacccuuuccaccuccccuacaagugcccucgggucuguccucc

SEQ ID NO: 480920 - RNA, 63 nt, Human
ccucugcuggcguccccggagcccagugcuggcccccuacagguggcagccccugcccacucc

SEQ ID NO: 480921 - RNA, 63 nt, Human
aagagccagauggaccugagugucggucacagcccccuacacucaaggcugagaggccucagg

SEQ ID NO: 480922 - RNA, 63 nt, Human
uuaaaggaacagcagcacuuaggcucaaaaucgccccuacaaagcaguaguuguuucuuaauu

SEQ ID NO: 480923 - RNA, 63 nt, Human
uaacuuguuuccgaacuagaaaagucugugagaccccuacaucauucugguuuuuuugcuuga

SEQ ID NO: 480924 - RNA, 63 nt, Human
acagcccgugcuuggagaaccauggaagcuacaccccuacaggugcauacuguucugcuuuuc

SEQ ID NO: 480925 - RNA, 63 nt, Human
uagaaucuguaccacucagugcuaccauccccaccccuacaccacuuccacacaggggccuca

SEQ ID NO: 480926 - RNA, 63 nt, Human
gcucagaucccagagggaugcaggagcccuauaccccuacacaggggcccccuaacuccuguc

SEQ ID NO: 480927 - RNA, 63 nt, Human
uggacacucccacgaggcucagcucucaggcacccccuacacuucaguugagggaaaagcuca

SEQ ID NO: 480928 - RNA, 63 nt, Human
gcugaucguaauguuuaucauguuacuuccccaccccuacauuuuuugaaauaaaauaaggaa

SEQ ID NO: 480929 - RNA, 63 nt, Human
ugcuguugccucuaggugacuuuccaagaugccccccuacacaccuuucuuuggaacgagggc

SEQ ID NO: 480930 - RNA, 63 nt, Human
agcuuucuccuuuacaaugcaugaaugccuaucccccuacaaaacaaagauuaaaugugauga

SEQ ID NO: 480931 - RNA, 63 nt, Human
gaacaggccaucucagcccuacacacuugccauccccuacagcacagaggaagagugauggug

SEQ ID NO: 480932 - RNA, 63 nt, Human
uuugugcuuuuuguguuuuacucaggaaguccuccccuacaucuguuuucuucuguauuucuu

SEQ ID NO: 480933 - RNA, 63 nt, Human
cucugcccagcccugaaugugugccuuaaaggcccccuacaaggggccccauacgacagagcu

SEQ ID NO: 480934 - RNA, 64 nt, Human; identical to SEQ ID NO: 206334

SEQ ID NO: 480935 - RNA, 64 nt, Human; identical to SEQ ID NO: 206335

SEQ ID NO: 480936 - RNA, 64 nt, Human; identical to SEQ ID NO: 206336

SEQ ID NO: 480937 - RNA, 64 nt, Human; identical to SEQ ID NO: 206337

SEQ ID NO: 480938 - RNA, 63 nt, Human
uuuuguucccuucuccauucuggagagggacuuccccuacauagagcccugauuuuuguggcu

SEQ ID NO: 480939 - RNA, 63 nt, Human
agaaaaggcugcuugaugucagcagaaucuaaaccccuacauuaaagcuuugccucccauucu

SEQ ID NO: 480940 - RNA, 63 nt, Human
ucacucuagcuucaguugacuucuugacucucuccccuacacccacuaccuggcauccaggac

SEQ ID NO: 480941 - RNA, 63 nt, Human
aaaagcuggaauuccguaaaagcauugacgcagccccuacacuccaucccaaccaagaaacug

SEQ ID NO: 480942 - RNA, 63 nt, Human
ucuccauucuguuugugguugcccccucaaccuccccuacacccuuccuauucuuuuucauuc

SEQ ID NO: 480943 - RNA, 63 nt, Human
uaugggcagcccaagguugcaugggaaaacacgccccuacagaagugcacuuccuugagagga

SEQ ID NO: 480944 - RNA, 63 nt, Human
uacuccccacucagagcacaaaugcaacuccuuccccuacaaucccauccugagccauugcag

SEQ ID NO: 480945 - RNA, 63 nt, Human
ggauuuccuucucccuuucccugcccacccuguccccuacaauuugugcuucugaguugagga

SEQ ID NO: 480946 - RNA, 63 nt, Human
ugggcuccagucagucuuacacugcccuucugaccccuacaaauggguccuuugcuauccagg

SEQ ID NO: 480947 - RNA, 63 nt, Human
uucugguauuucugagguuaacacuugauuuagccccuacauaucuuuccauauauccuauua

SEQ ID NO: 480948 - RNA, 63 nt, Human
cucaaaugccucagucccugagagccauuucuuccccuacaucgucucacuuugcuuccuauu

SEQ ID NO: 480949 - RNA, 63 nt, Human
cccuccaucugguccguacccucgccagaggccccccuacaucaaccuccuggcgaugcccug

SEQ ID NO: 480950 - RNA, 63 nt, Human
ugcagcgcccguggugaucugggguagggggcaccccuacagugggaccccucccccauuauu

SEQ ID NO: 480951 - RNA, 63 nt, Human
gaaagggaccgugaguaguggaaaccaggacguccccuacaccuacccauggguggaagcuaa

SEQ ID NO: 480952 - RNA, 63 nt, Human
aauacaguuuuauuucaugaagagaaaugaaaaccccuacacugauaucuguuuucuauggga

SEQ ID NO: 480953 - RNA, 63 nt, Human
ggcaaagauagcagccugaaggucccacccccaccccuacagaaaaaaugggagcaagaacuu

SEQ ID NO: 480954 - RNA, 64 nt, Human; identical to SEQ ID NO: 206322

SEQ ID NO: 480955 - RNA, 64 nt, Human; identical to SEQ ID NO: 206332

SEQ ID NO: 480956 - RNA, 58 nt, Human; identical to SEQ ID NO: 206339

SEQ ID NO: 480957 - RNA, 64 nt, Human; identical to SEQ ID NO: 206347

SEQ ID NO: 480958 - RNA, 63 nt, Human
cagaaaaagaaaaaaaacacaaaaaauaaaaaaccccuacaaaaaaacuuuaaaaaaaauggc

SEQ ID NO: 480959 - RNA, 63 nt, Human
aggccuggccgcugggccugaccggccccccagccccuacaccccgcuucucccggacucucc

SEQ ID NO: 480960 - RNA, 63 nt, Human
cagcugcauuagaaaaagaggcgcuucuccccuccccuacaccuaaagguguauuuaaacuau

SEQ ID NO: 480961 - RNA, 63 nt, Human
caaauaucacucagaugaaacaaagcagugaaaccccuacaguuuaaaugaugucacuuuuag

SEQ ID NO: 480962 - RNA, 63 nt, Human
ccuucaauucccucuccaggacuccgcaccacuccccuacacccagagcauucucuuccccuc

SEQ ID NO: 480963 - RNA, 63 nt, Human
agcauuagacgucacauccagguggccccacggccccuacaggcuggcccugcaauggggccc

SEQ ID NO: 480964 - RNA, 63 nt, Human
ccagccccauggccacccccaccccugccucgcccccuacaggccucugggcccagcuccugg

SEQ ID NO: 480965 - RNA, 63 nt, Human
aagccauuuaccucaaaggacccagcagcuacaccccuacaggcuuccaggcaccucaucagu

SEQ ID NO: 480966 - RNA, 63 nt, Human
cuucaaauccuuugggaagggugacuguuguuuccccuacacacaguguaagccggaauggga

SEQ ID NO: 480967 - RNA, 63 nt, Human
ggguggccaaguggaucucaccggggccaccugccccuacacccuguccaacaugaccuacaa

SEQ ID NO: 480968 - RNA, 63 nt, Human
cucuacugcccuggcccguucauccuguguaucccccuacaagaaugggcaccuccugcccgc

SEQ ID NO: 480969 - RNA, 63 nt, Human
uuuaacacagaccccuagggauuuaaagggacaccccuacacacacccaggcccaugccaagg

SEQ ID NO: 480970 - RNA, 63 nt, Human
gcaggaggcugaguccggcugccaugcacgucuccccuacagugguucucuggacaaggcuuu

SEQ ID NO: 480971 - RNA, 63 nt, Human
guaacgcgcccggccccgaugcgaaucaggccuccccuacaucugggggcguuggccgcgaga

SEQ ID NO: 480972 - RNA, 63 nt, Human
caguuucucaccccguucugcucccacaaggccccccuacagucacugccacacuggugggga

SEQ ID NO: 480973 - RNA, 63 nt, Human
acacagacaccuggccucacugccagcccaccuccccuacagcccuguuuguuccugcuucuc

SEQ ID NO: 480974 - RNA, 64 nt, Human; identical to SEQ ID NO: 206354

SEQ ID NO: 480975 - RNA, 64 nt, Human; identical to SEQ ID NO: 206365

SEQ ID NO: 480976 - RNA, 64 nt, Human; identical to SEQ ID NO: 206370

SEQ ID NO: 480977 - RNA, 64 nt, Human; identical to SEQ ID NO: 206376

SEQ ID NO: 480978 - RNA, 63 nt, Human
caugaacaagggucagguagaagagaaaggcuuccccuacaccccagccuccugcuguccccu

SEQ ID NO: 480979 - RNA, 64 nt, Human
ugggggagggcaaggcucuccucccagccagggacgccaggacauagcugcuccuggucagugg

SEQ ID NO: 480980 - RNA, 64 nt, Human
acugccgcccagaaaaggggcagggcucugcagccgccaggacagacgagcaccccaugccuau

SEQ ID NO: 480981 - RNA, 64 nt, Human
uccuggugcucuauccacugcagggccagccacucgccaggaggccacgggccacgggaagaac

SEQ ID NO: 480982 - RNA, 64 nt, Human
uggaauacacugugaccccaguuaagugucccuucgccaggaagcugccgcaacguccagaccu

SEQ ID NO: 480983 - RNA, 64 nt, Human
cugcgugggaugcacacggaugacagaaucaaggcgccaggaugggcacucugcccuggauaca

SEQ ID NO: 480984 - RNA, 64 nt, Human
gcugacaacccaggaccgaugguuguguuugccacgccaggaaugcugcacgcugggcaguccc

SEQ ID NO: 480985 - RNA, 64 nt, Human
ggcaaagggagggcccugggcugggugcaaggcgcgccaggagucccagccaggguggccccgg

SEQ ID NO: 480986 - RNA, 64 nt, Human
ccauccgagcuugagcugggcgcacagaggugcccgccaggaucuguggcccuguaacauuccc

SEQ ID NO: 480987 - RNA, 64 nt, Human
ugccuggcaucugucugcugacgccucuggcuugcgccaggacuuggcgugggcaccgggcgcc

SEQ ID NO: 480988 - RNA, 64 nt, Human
guguguggagauggcgcccuguccugccaaggggcgccaggagcagagccagggccuggcgagc

SEQ ID NO: 480989 - RNA, 64 nt, Human
ccugccuccacuucuccccucaagaaauuuucaacgccaggaaucaugaagagacuucugcuuu

SEQ ID NO: 480990 - RNA, 64 nt, Human
ggugggcuggggacucuggcacagugaugccgggcgccaggacagcagcacucccgcugcacac

SEQ ID NO: 480991 - RNA, 64 nt, Human
uuauauucuuuccauuugcuaucaugucagugaacgccaggagugcuuucuuugcaacuugugu

SEQ ID NO: 480992 - RNA, 52 nt, Human
ugggccaagcugcucaaugaaccgccaggaacugaccugcugacugcacucu

SEQ ID NO: 480993 - RNA, 64 nt, Human; identical to SEQ ID NO: 206384

SEQ ID NO: 480994 - RNA, 64 nt, Human; identical to SEQ ID NO: 206391

SEQ ID NO: 480995 - RNA, 64 nt, Human; identical to SEQ ID NO: 206402

SEQ ID NO: 480996 - RNA, 63 nt, Human
ugaguugcagagggggcugcggacacagcaggcccccuacagccucagguucugccugagccc

SEQ ID NO: 480997 - RNA, 63 nt, Human
ccuggggguugccuggggaccucucccacccgaccccuacagagcuugagagccacagacgcc

SEQ ID NO: 480998 - RNA, 63 nt, Human
ccagacucagagaccgugagcgccccgcccccaccccuacagccugcacacaccugccugcag

SEQ ID NO: 480999 - RNA, 63 nt, Human
gcccaagaaacaccgagugaggccauagcaacuccccuacaucaaaugcucaagcccugaguu

SEQ ID NO: 481000 - RNA, 63 nt, Human
ucgcccgaaacaccaagugaggccauagcaauuccccuacaucaaaugcucaagcccccagcu

SEQ ID NO: 481001 - RNA, 63 nt, Human
cugcuaaggcucuauuuccucccccaguuaaacccccuacauuaguaucccacuagcccaggg

SEQ ID NO: 481002 - RNA, 63 nt, Human
agaccccaauucagcaauaagucucacccuucuccccuacaggucaggccaagaagggugaag

SEQ ID NO: 481003 - RNA, 63 nt, Human
cacacagcccaggcuguucugagucagaauaggccccuacagguauauuuuaaaacucuucgu

SEQ ID NO: 481004 - RNA, 63 nt, Human
gcccaucagcugaggacagcaaacucccagcagccccuacagagguggcacaugcuuggccac

SEQ ID NO: 481005 - RNA, 63 nt, Human
agugcccuuagcuagccugacuaagucccagauccccuacagcuuccuucggugugguaucuu

SEQ ID NO: 481006 - RNA, 63 nt, Human
aaugugggcugggggaagaugcccucaacucacccccuacacacacaugagagagagccccca

SEQ ID NO: 481007 - RNA, 63 nt, Human
ccuguagcucugccucccucuccauaucuccuuccccuacaccucccuccccacaccucccua

SEQ ID NO: 481008 - RNA, 63 nt, Human
caaagggugggcaucaaagaugagaagccaaagccccuacaacuccagccacccagccaggag

SEQ ID NO: 481009 - RNA, 63 nt, Human
accgcgcggcgcuuuccuccgcccgggguggggccccuacagacuccguauuuuauuuuuuua

SEQ ID NO: 481010 - RNA, 63 nt, Human
uacuaagguggaugccaaccagagaagcugcuaccccuacaucaucuccaaccggucagaagc

SEQ ID NO: 481011 - RNA, 63 nt, Human
cccagggcauccauuccuaagccagacccggcuccccuacaccugaaguuacacugccagcag

SEQ ID NO: 481012 - RNA, 64 nt, Human; identical to SEQ ID NO: 206407

SEQ ID NO: 481013 - RNA, 64 nt, Human; identical to SEQ ID NO: 206415

SEQ ID NO: 481014 - RNA, 64 nt, Human; identical to SEQ ID NO: 206237

SEQ ID NO: 481015 - RNA, 63 nt, Human
uccagccuaggucagagguggggacagagaacuccccuacagcccagagauguggcagggcuc

SEQ ID NO: 481016 - RNA, 63 nt, Human
ggacaccaggaugggacugcaaccucaggucucccccuacauauuaauaccagucaccaggag

SEQ ID NO: 481017 - RNA, 63 nt, Human
aaacccagggaaccucucugaagugacaccucaccccuacacaccguccguucacccccgucu

SEQ ID NO: 481018 - RNA, 63 nt, Human
uuuugaccaauuuuauuccuaagaauaaacaaaccccuacaguuaaaaugcaaagaugccugu

SEQ ID NO: 481019 - RNA, 63 nt, Human
auuaaauuuuaaaauguaauaucuguuucccacccccuacauuaggaggauaauuucuuaaac

SEQ ID NO: 481020 - RNA, 63 nt, Human
caugaaaugaaugaaagcuuuagcacuuuuuugccccuacauaugagacaacauauuuuguau

SEQ ID NO: 481021 - RNA, 63 nt, Human
auguauagguaaggguacuauaaauaugagauuccccuacauucuccuugucugguauaacuu

SEQ ID NO: 481022 - RNA, 63 nt, Human
cuagcuccaccuugaaggagccccccacauccuccccuacaucccagagaugccaccacuugu

SEQ ID NO: 481023 - RNA, 63 nt, Human
accugcuaacagaauaaucccugcucacauuuuccccuacacuuugucauuaaaacagcacga

SEQ ID NO: 481024 - RNA, 63 nt, Human
gccuacuaacagaauaaucccuccucaccccuuccccuacacuugaucauuaaaacagcacca

SEQ ID NO: 481025 - RNA, 63 nt, Human
augcacugcaucccaaaccaucaagggccuuuuccccuacaaacuguuguugaacagugcuuc

SEQ ID NO: 481026 - RNA, 63 nt, Human
uccuccguguucuggagcugagaugggaaugagccccuacacagaauggaguccucuagccua

SEQ ID NO: 481027 - RNA, 63 nt, Human
gucggugacagccacaguuccuucccaugggggccccuacacgaagcugcuugagcauccuca

SEQ ID NO: 481028 - RNA, 63 nt, Human
aggggcagguguccucccaggaaguacagcuccccccuacaccuagcucaucauuuucuaugg

SEQ ID NO: 481029 - RNA, 63 nt, Human
gagagaagaaaggggguucagaggccgguaccuccccuacagcagcccuugggucauuggccc

SEQ ID NO: 481030 - RNA, 63 nt, Human
acucccucuguccccagggccucccuucugggcccccuacagcccacccuaccccuccuccau

SEQ ID NO: 481031 - RNA, 64 nt, Human; identical to SEQ ID NO: 345499

SEQ ID NO: 481032 - RNA, 64 nt, Human; identical to SEQ ID NO: 345447

SEQ ID NO: 481033 - RNA, 63 nt, Human
ugggugcaggugauggugcugagccgucccgggccccuacagcgugcacaggugcuggacaag

SEQ ID NO: 481034 - RNA, 63 nt, Human
aaggggccgcucccauugccuccacccacucacccccuacagccugaagcaaaccagcagccc

SEQ ID NO: 481035 - RNA, 63 nt, Human
agccucucgaguagccgggaccacaggugcgagccccuacaccuggauaauuuuuguauuuuu

SEQ ID NO: 481036 - RNA, 63 nt, Human
gccuggaggaucccuccauccggcuccugucauccccuacacuuuggccaagcaagagguggu

SEQ ID NO: 481037 - RNA, 63 nt, Human
cauccacuucauugugcuguucacucccauucuccccuacaguuuuaugcucagacauggagg

SEQ ID NO: 481038 - RNA, 63 nt, Human
uucuuuugcucuuagcugucugcucagacagaaccccuacaugaaacagaaacaaaaacacua

SEQ ID NO: 481039 - RNA, 63 nt, Human
cagcuuucuagcagcugcaaaaugguuuaaugcccccuacauauuuccaucaccuugaacaau

SEQ ID NO: 481040 - RNA, 63 nt, Human
uaagugaaagacaccuccccucacccuucuagcccccuacaaggugccagguugggguaaaga

SEQ ID NO: 481041 - RNA, 63 nt, Human
ugugucauacacagggccuaguacauagugggcccccuacauacgcauggauucugggucucc

SEQ ID NO: 481042 - RNA, 63 nt, Human
auuaaaaccagggauccgugacccccugccaugccccuacaguagagauuccuccccugcuaa

SEQ ID NO: 481043 - RNA, 63 nt, Human
cauucuucgcuaauuuguauuuguauucccuucccccuacaagauuaugagaccccagagggg

SEQ ID NO: 481044 - RNA, 63 nt, Human
caacccggagcacugcagccccaauggcaccgaccccuacaagccuaagugccccgagagcga

SEQ ID NO: 481045 - RNA, 63 nt, Human
aagaccugggaaaugaaaacaauuuauggaaguccccuacagucaguuuauaagggcuucagu

SEQ ID NO: 481046 - RNA, 63 nt, Human
ccagcguucugccgugucugucccccaccaugcccccuacaggcgguacugauggcgcuuuuu

SEQ ID NO: 481047 - RNA, 63 nt, Human
cagcucgugccccaaaugaaaugccaucucgagccccuacagcucuacgggaggccucccgga

SEQ ID NO: 481048 - RNA, 56 nt, Human
cugggauaagguuccuguagccgacaccccuacaggagaagcucugggacuggggc

SEQ ID NO: 481049 - RNA, 64 nt, Human; identical to SEQ ID NO: 206299

SEQ ID NO: 481050 - RNA, 64 nt, Human; identical to SEQ ID NO: 206300

SEQ ID NO: 481051 - RNA, 64 nt, Human; identical to SEQ ID NO: 206301

SEQ ID NO: 481052 - RNA, 64 nt, Human; identical to SEQ ID NO: 206302

SEQ ID NO: 481053 - RNA, 63 nt, Human
uugcaauggguaggagaucuggggaggcccugcccccuacaccauacuuaucaccacccuccu

SEQ ID NO: 481054 - RNA, 63 nt, Human
augcuuucuacucauguccuucacaaggcacauccccuacauuuggaagaauccccaaucuug

SEQ ID NO: 481055 - RNA, 63 nt, Human
ggaaguccuuccugacuaccugugcccagagugccccuacaugagacuguaugcccugcuauc

SEQ ID NO: 481056 - RNA, 63 nt, Human
uuuccauuaauuucucaacaucaauuauucaggccccuacaguugugguauugaggccccuaa

SEQ ID NO: 481057 - RNA, 63 nt, Human
aaaagugauuuaacuuaccucaucaagaaugugccccuacaggccgggcgcaguggcucacgc

SEQ ID NO: 481058 - RNA, 63 nt, Human
uaggagacaggaggaacuucuccuccuccuccuccccuacaauuccuuuucacauauuccuuu

SEQ ID NO: 481059 - RNA, 63 nt, Human
gaugaggcccaugccccucacccccacgccccgccccuacaaccuaagucauaaauccucuuc

SEQ ID NO: 481060 - RNA, 63 nt, Human
aacaccacgucuaaagcaguuucacagcaugguccccuacaauguuauaccaaggcucugaug

SEQ ID NO: 481061 - RNA, 64 nt, Human; identical to SEQ ID NO: 206279

SEQ ID NO: 481062 - RNA, 64 nt, Human; identical to SEQ ID NO: 206280

SEQ ID NO: 481063 - RNA, 64 nt, Human; identical to SEQ ID NO: 206281

SEQ ID NO: 481064 - RNA, 64 nt, Human; identical to SEQ ID NO: 206282

SEQ ID NO: 481065 - RNA, 64 nt, Human; identical to SEQ ID NO: 206283

SEQ ID NO: 481066 - RNA, 64 nt, Human; identical to SEQ ID NO: 206284

SEQ ID NO: 481067 - RNA, 64 nt, Human; identical to SEQ ID NO: 206285

SEQ ID NO: 481068 - RNA, 64 nt, Human; identical to SEQ ID NO: 206286

SEQ ID NO: 481069 - RNA, 64 nt, Human; identical to SEQ ID NO: 206287

SEQ ID NO: 481070 - RNA, 64 nt, Human; identical to SEQ ID NO: 206338

SEQ ID NO: 481071 - RNA, 58 nt, Human; identical to SEQ ID NO: 206339

SEQ ID NO: 481072 - RNA, 51 nt, Human; identical to SEQ ID NO: 206340

SEQ ID NO: 481073 - RNA, 64 nt, Human; identical to SEQ ID NO: 206341

SEQ ID NO: 481074 - RNA, 64 nt, Human; identical to SEQ ID NO: 206342

SEQ ID NO: 481075 - RNA, 64 nt, Human; identical to SEQ ID NO: 206343

SEQ ID NO: 481076 - RNA, 64 nt, Human; identical to SEQ ID NO: 206347

SEQ ID NO: 481077 - RNA, 59 nt, Human; identical to SEQ ID NO: 206348

SEQ ID NO: 481078 - RNA, 64 nt, Human; identical to SEQ ID NO: 206349

SEQ ID NO: 481079 - RNA, 50 nt, Human; identical to SEQ ID NO: 206350

SEQ ID NO: 481080 - RNA, 64 nt, Human; identical to SEQ ID NO: 206351

SEQ ID NO: 481081 - RNA, 64 nt, Human; identical to SEQ ID NO: 206352

SEQ ID NO: 481082 - RNA, 50 nt, Human; identical to SEQ ID NO: 206353

SEQ ID NO: 481083 - RNA, 64 nt, Human; identical to SEQ ID NO: 206354

SEQ ID NO: 481084 - RNA, 64 nt, Human; identical to SEQ ID NO: 206355

SEQ ID NO: 481085 - RNA, 64 nt, Human; identical to SEQ ID NO: 206356

SEQ ID NO: 481086 - RNA, 64 nt, Human; identical to SEQ ID NO: 206357

SEQ ID NO: 481087 - RNA, 64 nt, Human; identical to SEQ ID NO: 206358

SEQ ID NO: 481088 - RNA, 64 nt, Human; identical to SEQ ID NO: 206359

SEQ ID NO: 481089 - RNA, 64 nt, Human; identical to SEQ ID NO: 206360

SEQ ID NO: 481090 - RNA, 64 nt, Human; identical to SEQ ID NO: 206361

SEQ ID NO: 481091 - RNA, 64 nt, Human; identical to SEQ ID NO: 206365

SEQ ID NO: 481092 - RNA, 64 nt, Human; identical to SEQ ID NO: 206366

SEQ ID NO: 481093 - RNA, 64 nt, Human; identical to SEQ ID NO: 206367

SEQ ID NO: 481094 - RNA, 64 nt, Human; identical to SEQ ID NO: 206368

SEQ ID NO: 481095 - RNA, 64 nt, Human; identical to SEQ ID NO: 206369

SEQ ID NO: 481096 - RNA, 64 nt, Human; identical to SEQ ID NO: 206370

SEQ ID NO: 481097 - RNA, 64 nt, Human; identical to SEQ ID NO: 206371

SEQ ID NO: 481098 - RNA, 64 nt, Human; identical to SEQ ID NO: 206372

SEQ ID NO: 481099 - RNA, 51 nt, Human; identical to SEQ ID NO: 206373

SEQ ID NO: 481100 - RNA, 64 nt, Human; identical to SEQ ID NO: 206374

SEQ ID NO: 481101 - RNA, 64 nt, Human; identical to SEQ ID NO: 206375

SEQ ID NO: 481102 - RNA, 64 nt, Human; identical to SEQ ID NO: 206376

SEQ ID NO: 481103 - RNA, 64 nt, Human; identical to SEQ ID NO: 206377

SEQ ID NO: 481104 - RNA, 64 nt, Human; identical to SEQ ID NO: 206378

SEQ ID NO: 481105 - RNA, 50 nt, Human; identical to SEQ ID NO: 206379

SEQ ID NO: 481106 - RNA, 64 nt, Human; identical to SEQ ID NO: 206383

SEQ ID NO: 481107 - RNA, 64 nt, Human; identical to SEQ ID NO: 206384

SEQ ID NO: 481108 - RNA, 64 nt, Human; identical to SEQ ID NO: 206385

SEQ ID NO: 481109 - RNA, 64 nt, Human; identical to SEQ ID NO: 206386

SEQ ID NO: 481110 - RNA, 64 nt, Human; identical to SEQ ID NO: 206387

SEQ ID NO: 481111 - RNA, 64 nt, Human; identical to SEQ ID NO: 206388

SEQ ID NO: 481112 - RNA, 64 nt, Human; identical to SEQ ID NO: 206389

SEQ ID NO: 481113 - RNA, 52 nt, Human; identical to SEQ ID NO: 206390

SEQ ID NO: 481114 - RNA, 64 nt, Human; identical to SEQ ID NO: 206391

SEQ ID NO: 481115 - RNA, 64 nt, Human; identical to SEQ ID NO: 206392

SEQ ID NO: 481116 - RNA, 64 nt, Human; identical to SEQ ID NO: 206393

SEQ ID NO: 481117 - RNA, 64 nt, Human; identical to SEQ ID NO: 206394

SEQ ID NO: 481118 - RNA, 64 nt, Human; identical to SEQ ID NO: 206395

SEQ ID NO: 481119 - RNA, 64 nt, Human; identical to SEQ ID NO: 206396

SEQ ID NO: 481120 - RNA, 64 nt, Human; identical to SEQ ID NO: 206397

SEQ ID NO: 481121 - RNA, 64 nt, Human; identical to SEQ ID NO: 206401

SEQ ID NO: 481122 - RNA, 64 nt, Human; identical to SEQ ID NO: 206402

SEQ ID NO: 481123 - RNA, 64 nt, Human; identical to SEQ ID NO: 206403

SEQ ID NO: 481124 - RNA, 64 nt, Human; identical to SEQ ID NO: 206404

SEQ ID NO: 481125 - RNA, 64 nt, Human; identical to SEQ ID NO: 206405

SEQ ID NO: 481126 - RNA, 64 nt, Human; identical to SEQ ID NO: 206406

SEQ ID NO: 481127 - RNA, 64 nt, Human; identical to SEQ ID NO: 206407

SEQ ID NO: 481128 - RNA, 64 nt, Human; identical to SEQ ID NO: 206408

SEQ ID NO: 481129 - RNA, 64 nt, Human; identical to SEQ ID NO: 206409

SEQ ID NO: 481130 - RNA, 64 nt, Human; identical to SEQ ID NO: 206410

SEQ ID NO: 481131 - RNA, 64 nt, Human; identical to SEQ ID NO: 206411

SEQ ID NO: 481132 - RNA, 64 nt, Human; identical to SEQ ID NO: 206412

SEQ ID NO: 481133 - RNA, 64 nt, Human; identical to SEQ ID NO: 206413

SEQ ID NO: 481134 - RNA, 64 nt, Human; identical to SEQ ID NO: 206414

SEQ ID NO: 481135 - RNA, 64 nt, Human; identical to SEQ ID NO: 206415

SEQ ID NO: 481136 - RNA, 64 nt, Human; identical to SEQ ID NO: 206230

SEQ ID NO: 481137 - RNA, 64 nt, Human; identical to SEQ ID NO: 206231

SEQ ID NO: 481138 - RNA, 53 nt, Human; identical to SEQ ID NO: 206232

SEQ ID NO: 481139 - RNA, 64 nt, Human; identical to SEQ ID NO: 206233

SEQ ID NO: 481140 - RNA, 64 nt, Human; identical to SEQ ID NO: 206234

SEQ ID NO: 481141 - RNA, 64 nt, Human; identical to SEQ ID NO: 206235

SEQ ID NO: 481142 - RNA, 64 nt, Human; identical to SEQ ID NO: 206236

SEQ ID NO: 481143 - RNA, 64 nt, Human; identical to SEQ ID NO: 206237

SEQ ID NO: 481144 - RNA, 64 nt, Human; identical to SEQ ID NO: 206279

SEQ ID NO: 481145 - RNA, 64 nt, Human; identical to SEQ ID NO: 206280

SEQ ID NO: 481146 - RNA, 64 nt, Human; identical to SEQ ID NO: 206281

SEQ ID NO: 481147 - RNA, 64 nt, Human; identical to SEQ ID NO: 206282

SEQ ID NO: 481148 - RNA, 64 nt, Human; identical to SEQ ID NO: 206283

SEQ ID NO: 481149 - RNA, 64 nt, Human; identical to SEQ ID NO: 206284

SEQ ID NO: 481150 - RNA, 64 nt, Human; identical to SEQ ID NO: 206285

SEQ ID NO: 481151 - RNA, 64 nt, Human; identical to SEQ ID NO: 206286

SEQ ID NO: 481152 - RNA, 64 nt, Human; identical to SEQ ID NO: 206287

SEQ ID NO: 481153 - RNA, 64 nt, Human; identical to SEQ ID NO: 206288

SEQ ID NO: 481154 - RNA, 64 nt, Human; identical to SEQ ID NO: 206289

SEQ ID NO: 481155 - RNA, 64 nt, Human; identical to SEQ ID NO: 206293

SEQ ID NO: 481156 - RNA, 64 nt, Human; identical to SEQ ID NO: 206294

SEQ ID NO: 481157 - RNA, 64 nt, Human; identical to SEQ ID NO: 206295

SEQ ID NO: 481158 - RNA, 64 nt, Human; identical to SEQ ID NO: 206296

SEQ ID NO: 481159 - RNA, 64 nt, Human; identical to SEQ ID NO: 206297

SEQ ID NO: 481160 - RNA, 64 nt, Human; identical to SEQ ID NO: 206298

SEQ ID NO: 481161 - RNA, 64 nt, Human; identical to SEQ ID NO: 206299

SEQ ID NO: 481162 - RNA, 64 nt, Human; identical to SEQ ID NO: 206300

SEQ ID NO: 481163 - RNA, 64 nt, Human; identical to SEQ ID NO: 206301

SEQ ID NO: 481164 - RNA, 64 nt, Human; identical to SEQ ID NO: 206302

SEQ ID NO: 481165 - RNA, 57 nt, Human; identical to SEQ ID NO: 206303

SEQ ID NO: 481166 - RNA, 64 nt, Human; identical to SEQ ID NO: 206304

SEQ ID NO: 481167 - RNA, 64 nt, Human; identical to SEQ ID NO: 206305

SEQ ID NO: 481168 - RNA, 64 nt, Human; identical to SEQ ID NO: 206306

SEQ ID NO: 481169 - RNA, 64 nt, Human; identical to SEQ ID NO: 206307

SEQ ID NO: 481170 - RNA, 64 nt, Human; identical to SEQ ID NO: 206311

SEQ ID NO: 481171 - RNA, 64 nt, Human; identical to SEQ ID NO: 206312

SEQ ID NO: 481172 - RNA, 64 nt, Human; identical to SEQ ID NO: 206313

SEQ ID NO: 481173 - RNA, 64 nt, Human; identical to SEQ ID NO: 206314

SEQ ID NO: 481174 - RNA, 64 nt, Human; identical to SEQ ID NO: 206315

SEQ ID NO: 481175 - RNA, 64 nt, Human; identical to SEQ ID NO: 206316

SEQ ID NO: 481176 - RNA, 64 nt, Human; identical to SEQ ID NO: 206317

SEQ ID NO: 481177 - RNA, 64 nt, Human; identical to SEQ ID NO: 206318

SEQ ID NO: 481178 - RNA, 64 nt, Human; identical to SEQ ID NO: 206319

SEQ ID NO: 481179 - RNA, 64 nt, Human; identical to SEQ ID NO: 206320

SEQ ID NO: 481180 - RNA, 64 nt, Human; identical to SEQ ID NO: 206321

SEQ ID NO: 481181 - RNA, 64 nt, Human; identical to SEQ ID NO: 206322

SEQ ID NO: 481182 - RNA, 64 nt, Human; identical to SEQ ID NO: 206323

SEQ ID NO: 481183 - RNA, 64 nt, Human; identical to SEQ ID NO: 206324

SEQ ID NO: 481184 - RNA, 64 nt, Human; identical to SEQ ID NO: 206325

SEQ ID NO: 481185 - RNA, 64 nt, Human; identical to SEQ ID NO: 206329

SEQ ID NO: 481186 - RNA, 64 nt, Human; identical to SEQ ID NO: 206330

SEQ ID NO: 481187 - RNA, 64 nt, Human; identical to SEQ ID NO: 206331

SEQ ID NO: 481188 - RNA, 64 nt, Human; identical to SEQ ID NO: 206332

SEQ ID NO: 481189 - RNA, 64 nt, Human; identical to SEQ ID NO: 206333

SEQ ID NO: 481190 - RNA, 64 nt, Human; identical to SEQ ID NO: 206334

SEQ ID NO: 481191 - RNA, 64 nt, Human; identical to SEQ ID NO: 206335

SEQ ID NO: 481192 - RNA, 64 nt, Human; identical to SEQ ID NO: 206336

SEQ ID NO: 481193 - RNA, 64 nt, Human; identical to SEQ ID NO: 206337

SEQ ID NO: 481194 - RNA, 64 nt, Human; identical to SEQ ID NO: 206338

SEQ ID NO: 481195 - RNA, 58 nt, Human; identical to SEQ ID NO: 206339

SEQ ID NO: 481196 - RNA, 51 nt, Human; identical to SEQ ID NO: 206340

SEQ ID NO: 481197 - RNA, 64 nt, Human; identical to SEQ ID NO: 206341

SEQ ID NO: 481198 - RNA, 64 nt, Human; identical to SEQ ID NO: 206342

SEQ ID NO: 481199 - RNA, 64 nt, Human; identical to SEQ ID NO: 206343

SEQ ID NO: 481200 - RNA, 64 nt, Human; identical to SEQ ID NO: 206347

SEQ ID NO: 481201 - RNA, 59 nt, Human; identical to SEQ ID NO: 206348

SEQ ID NO: 481202 - RNA, 64 nt, Human; identical to SEQ ID NO: 206349

SEQ ID NO: 481203 - RNA, 50 nt, Human; identical to SEQ ID NO: 206350

SEQ ID NO: 481204 - RNA, 64 nt, Human; identical to SEQ ID NO: 206351

SEQ ID NO: 481205 - RNA, 64 nt, Human; identical to SEQ ID NO: 206352

SEQ ID NO: 481206 - RNA, 50 nt, Human; identical to SEQ ID NO: 206353

SEQ ID NO: 481207 - RNA, 64 nt, Human; identical to SEQ ID NO: 206354

SEQ ID NO: 481208 - RNA, 64 nt, Human; identical to SEQ ID NO: 206355

SEQ ID NO: 481209 - RNA, 64 nt, Human; identical to SEQ ID NO: 206356

SEQ ID NO: 481210 - RNA, 64 nt, Human; identical to SEQ ID NO: 206357

SEQ ID NO: 481211 - RNA, 64 nt, Human; identical to SEQ ID NO: 206358

SEQ ID NO: 481212 - RNA, 64 nt, Human; identical to SEQ ID NO: 206359

SEQ ID NO: 481213 - RNA, 64 nt, Human; identical to SEQ ID NO: 206360

SEQ ID NO: 481214 - RNA, 64 nt, Human; identical to SEQ ID NO: 206361

SEQ ID NO: 481215 - RNA, 64 nt, Human; identical to SEQ ID NO: 206365

SEQ ID NO: 481216 - RNA, 64 nt, Human; identical to SEQ ID NO: 206366

SEQ ID NO: 481217 - RNA, 64 nt, Human; identical to SEQ ID NO: 206367

SEQ ID NO: 481218 - RNA, 64 nt, Human; identical to SEQ ID NO: 206368

SEQ ID NO: 481219 - RNA, 64 nt, Human; identical to SEQ ID NO: 206369

SEQ ID NO: 481220 - RNA, 64 nt, Human; identical to SEQ ID NO: 206370

SEQ ID NO: 481221 - RNA, 64 nt, Human; identical to SEQ ID NO: 206371

SEQ ID NO: 481222 - RNA, 64 nt, Human; identical to SEQ ID NO: 206372

SEQ ID NO: 481223 - RNA, 51 nt, Human; identical to SEQ ID NO: 206373

SEQ ID NO: 481224 - RNA, 64 nt, Human; identical to SEQ ID NO: 206374

SEQ ID NO: 481225 - RNA, 64 nt, Human; identical to SEQ ID NO: 206375

SEQ ID NO: 481226 - RNA, 64 nt, Human; identical to SEQ ID NO: 206376

SEQ ID NO: 481227 - RNA, 64 nt, Human; identical to SEQ ID NO: 206377

SEQ ID NO: 481228 - RNA, 64 nt, Human; identical to SEQ ID NO: 206378

SEQ ID NO: 481229 - RNA, 50 nt, Human; identical to SEQ ID NO: 206379

SEQ ID NO: 481230 - RNA, 64 nt, Human; identical to SEQ ID NO: 206383

SEQ ID NO: 481231 - RNA, 64 nt, Human; identical to SEQ ID NO: 206384

SEQ ID NO: 481232 - RNA, 64 nt, Human; identical to SEQ ID NO: 206385

SEQ ID NO: 481233 - RNA, 64 nt, Human; identical to SEQ ID NO: 206386

SEQ ID NO: 481234 - RNA, 64 nt, Human; identical to SEQ ID NO: 206387

SEQ ID NO: 481235 - RNA, 64 nt, Human; identical to SEQ ID NO: 206388

SEQ ID NO: 481236 - RNA, 64 nt, Human; identical to SEQ ID NO: 206389

SEQ ID NO: 481237 - RNA, 52 nt, Human; identical to SEQ ID NO: 206390

SEQ ID NO: 481238 - RNA, 64 nt, Human; identical to SEQ ID NO: 206391

SEQ ID NO: 481239 - RNA, 64 nt, Human; identical to SEQ ID NO: 206392

SEQ ID NO: 481240 - RNA, 64 nt, Human; identical to SEQ ID NO: 206393

SEQ ID NO: 481241 - RNA, 64 nt, Human; identical to SEQ ID NO: 206394

SEQ ID NO: 481242 - RNA, 64 nt, Human; identical to SEQ ID NO: 206395

SEQ ID NO: 481243 - RNA, 64 nt, Human; identical to SEQ ID NO: 206396

SEQ ID NO: 481244 - RNA, 64 nt, Human; identical to SEQ ID NO: 206397

SEQ ID NO: 481245 - RNA, 64 nt, Human; identical to SEQ ID NO: 206401

SEQ ID NO: 481246 - RNA, 64 nt, Human; identical to SEQ ID NO: 206402

SEQ ID NO: 481247 - RNA, 64 nt, Human; identical to SEQ ID NO: 206403

SEQ ID NO: 481248 - RNA, 64 nt, Human; identical to SEQ ID NO: 206404

SEQ ID NO: 481249 - RNA, 64 nt, Human; identical to SEQ ID NO: 206405

SEQ ID NO: 481250 - RNA, 64 nt, Human; identical to SEQ ID NO: 206406

SEQ ID NO: 481251 - RNA, 64 nt, Human; identical to SEQ ID NO: 206407

SEQ ID NO: 481252 - RNA, 64 nt, Human; identical to SEQ ID NO: 206408

SEQ ID NO: 481253 - RNA, 64 nt, Human; identical to SEQ ID NO: 206409

SEQ ID NO: 481254 - RNA, 64 nt, Human; identical to SEQ ID NO: 206410

SEQ ID NO: 481255 - RNA, 64 nt, Human; identical to SEQ ID NO: 206411

SEQ ID NO: 481256 - RNA, 64 nt, Human; identical to SEQ ID NO: 206412

SEQ ID NO: 481257 - RNA, 64 nt, Human; identical to SEQ ID NO: 206413

SEQ ID NO: 481258 - RNA, 64 nt, Human; identical to SEQ ID NO: 206414

SEQ ID NO: 481259 - RNA, 64 nt, Human; identical to SEQ ID NO: 206415

SEQ ID NO: 481260 - RNA, 64 nt, Human; identical to SEQ ID NO: 206230

SEQ ID NO: 481261 - RNA, 64 nt, Human; identical to SEQ ID NO: 206231

SEQ ID NO: 481262 - RNA, 53 nt, Human; identical to SEQ ID NO: 206232

SEQ ID NO: 481263 - RNA, 64 nt, Human; identical to SEQ ID NO: 206233

SEQ ID NO: 481264 - RNA, 64 nt, Human; identical to SEQ ID NO: 206234

SEQ ID NO: 481265 - RNA, 64 nt, Human; identical to SEQ ID NO: 206235

SEQ ID NO: 481266 - RNA, 64 nt, Human; identical to SEQ ID NO: 206236

SEQ ID NO: 481267 - RNA, 64 nt, Human; identical to SEQ ID NO: 206237

SEQ ID NO: 481268 - RNA, 64 nt, Human
gcaagucuccuagaagcccucugagcuccagaggggugcgcagagcugacccccugcugccauc

SEQ ID NO: 481269 - RNA, 64 nt, Human
cucggaauguaguugcucgagguaaccgcuagagggugcgcaccuggaugcuggauggggacgg

SEQ ID NO: 481270 - RNA, 64 nt, Human
uucuggaaaaugacaguauuuuuggcagggagaaggugcgcaggccuccuugcugcucucuggu

SEQ ID NO: 481271 - RNA, 64 nt, Human
ucccagucuguguugcagcagcauucucaucgggggugcgcacaccaucguuacugucgggcag

SEQ ID NO: 481272 - RNA, 64 nt, Human
guggcucggccagcagcgguuccaggagaguggcggugcgcacgggccuccagccgugccuucc

SEQ ID NO: 481273 - RNA, 64 nt, Human
ugcacagugcagaggggccguggccccaugugauggugcgcagagaggaaccucuugggauuca

SEQ ID NO: 481274 - RNA, 64 nt, Human
gucugccucagccucccgaguagcugggauuacaggugcgcacuaccacgccaagcuaauuuuu

SEQ ID NO: 481275 - RNA, 64 nt, Human
ucuaguaaaaauacaaaaauuagcugggcguggcggugcgcaacuguagucccagcuacucggg

SEQ ID NO: 481276 - RNA, 64 nt, Human
agugcuccugguagugccacuaagggaaaaccaaggugcgcauuccuucucccuggacuuuacc

SEQ ID NO: 481277 - RNA, 64 nt, Human
acuguagaucauuaaaguuccuccuugagaggcugagccguagccaggauuggggagagcccuu

SEQ ID NO: 481278 - RNA, 64 nt, Human
ugccucgcuggugcugggucucugguuugcugcagagccguaggacacuccuggcuccucagua

SEQ ID NO: 481279 - RNA, 64 nt, Human
gacaguccccauagaccuucagacauuaaaaagggagccguacaguuuguuugaagcacuucgu

SEQ ID NO: 481280 - RNA, 64 nt, Human
guuuauuaaagcgagcaaagucugcauuuuaccuggugcgcaugaguggggucuuuaagaguuu

SEQ ID NO: 481281 - RNA, 64 nt, Human
uccugccucaggcuucugaguagcugggauuauaggugcgcaccaccacacccggcuaguuucu

SEQ ID NO: 481282 - RNA, 64 nt, Human
aagcaauccucccgcuucagccuccugaguagcuggugcgcacgaccauacccagcuaauguuu

SEQ ID NO: 481283 - RNA, 64 nt, Human
auccaacauacaaacuuucccaugcagcuucucuggugcgcaguugguuuugaccgugggacua

SEQ ID NO: 481284 - RNA, 64 nt, Human
gaucagccacuuccugauaagaucucaggaguugggugcgcaggcucaagcaugcacccuaaga

SEQ ID NO: 481285 - RNA, 64 nt, Human
acuugcuuggguuccuggggguuuucugaucacuggugcgcauugauguacauauuuuccucca

SEQ ID NO: 481286 - RNA, 64 nt, Human
uccugccucagccuccugaauagcugggguuacaggugcgcaccaccacgcccggcuaauuuuu

SEQ ID NO: 481287 - RNA, 64 nt, Human
ccuccagcggcucccucuggcaggaaauccccguggugcgcaacagcaccgugcugcucuccau

SEQ ID NO: 481288 - RNA, 64 nt, Human
uugaagacagguggucaccuggaccugggguaagggugcgcagggaggccgggcuugggggcag

SEQ ID NO: 481289 - RNA, 64 nt, Human
uuggagaguacggcuaccugggucaacccaacgcggugcgcaccaacuucacuaccaagcagcu

SEQ ID NO: 481290 - RNA, 64 nt, Human
cuucccugcaggugugcaaguacgacuucguggaggugcgcaguggacucacagcugacuccaa

SEQ ID NO: 481291 - RNA, 64 nt, Human
ucuucagguugauacugccuggauggucaccucuggugcgcagcaagugcaaagccaguggggg

SEQ ID NO: 481292 - RNA, 64 nt, Human
cuacuaaaaauacaaaaaauuagccaggcaugguggugcgcaccuguaguuccagcuacuuggg

SEQ ID NO: 481293 - RNA, 64 nt, Human
ucuacuaaaaaugcaaaaauuagccaggcguaguggugcgcaccuguagucucagauacuuggg

SEQ ID NO: 481294 - RNA, 64 nt, Human
uacacgugcgugugagugugugugugugucuguaggugcgcacuuaccugcuugagcuuucugu

SEQ ID NO: 481295 - RNA, 64 nt, Human
aggugauaccggguccuagguagguagggcugauggugcgcacuccuuaaagaggacuauuuag

SEQ ID NO: 481296 - RNA, 64 nt, Human
ccccguaaugugucucuacagcuaccuuaccacugagccguaagacaaauguauaggaagaagc

SEQ ID NO: 481297 - RNA, 64 nt, Human
uuuaccauugaguugaaauucuugaauugccagagagccguauccuccaggucccacuccuguu

SEQ ID NO: 481298 - RNA, 64 nt, Human
aauauugucacaaucuaaauuucuguaguagagagagccguagcccuuuguaaaggcuuucguu

SEQ ID NO: 481299 - RNA, 64 nt, Human
auuaggaagaccucuuucccugucccaauccccaggugcgcacgcuccuguuacccuuucucuu

SEQ ID NO: 481300 - RNA, 64 nt, Human
uccugucucagccucccaaguagcugggauuacaggugcgcaccaccaugccuggcuguguuuu

SEQ ID NO: 481301 - RNA, 64 nt, Human
ugugugccuugccuuccuucagcaggaccgucuaggugcgcagccaccuauggaugcgucccag

SEQ ID NO: 481302 - RNA, 64 nt, Human
cgccucacugcaccccucccugcagagaggagccggugcgcaaguucacgggcaaggcgguccc

SEQ ID NO: 481303 - RNA, 64 nt, Human
gugcauaugcaugugugugugugugugugucuuaggugcgcaguggcauguccacgugugugug

SEQ ID NO: 481304 - RNA, 64 nt, Human
cccugagcccaggcggagggcggaaggcugcuggggugcgcaggugggcgcucgcgucucccca

SEQ ID NO: 481305 - RNA, 64 nt, Human
aagugaaccccugugggugcgggggaggguauccggugcgcagggagguggccagcgcccccgg

SEQ ID NO: 481306 - RNA, 64 nt, Human
ccauggccugacugcacagccugccuggaggaugggugcgcagcucugcccucccugaggccca

SEQ ID NO: 481307 - RNA, 64 nt, Human
ggguuauuuacauagcugagcaguguccaggggaggugcgcagugaacugucaaggacuuucca

SEQ ID NO: 481308 - RNA, 64 nt, Human
agcaugggccugggugugugugagcucaggccuaggugcgcaguguggagacggguguugucgg

SEQ ID NO: 481309 - RNA, 64 nt, Human
gaauacauguacaacuuuggucauaugagaagcaggugcgcagagaauuccuugaaagaucuga

SEQ ID NO: 481310 - RNA, 64 nt, Human
uggcuccugcccgugacgccuugcccagcagcaaggugcgcaacauggcugccagccccgccuc

SEQ ID NO: 481311 - RNA, 64 nt, Human
acuacaaauuuuuuacaaauuagcuaggugugguggugcgcaccuguggucccagcuacucggg

SEQ ID NO: 481312 - RNA, 64 nt, Human
gcccucugagauaucccgaugggcacaaauggaaggugcgcacuugccccuacuauugcccuuu

SEQ ID NO: 481313 - RNA, 64 nt, Human
ucuacuaaaauacaaaaacuuagccaggcaugguggugcgcaccuguagucccagcuacucugg

SEQ ID NO: 481314 - RNA, 64 nt, Human
gaugcagugggcacugccggugggccagggggcgggugcgcaugugguagaaggugugcgcucg

SEQ ID NO: 481315 - RNA, 64 nt, Human
gugugugugugugugguuacccauuuuuuagaaggagccguacagaagaaaaauuauucuacau

SEQ ID NO: 481316 - RNA, 64 nt, Human
gcugaacugugagguuuccuaguaauugccaaaugagccguaagucugcagaauucccuucuac

SEQ ID NO: 481317 - RNA, 64 nt, Human
guaucagccucccuacgcaaggaccuaugcacuggagccguaggaggcucuucaguugggcccc

SEQ ID NO: 481318 - RNA, 64 nt, Human
ccagcaccugcccgaguggccguggccaggauggggugcgcauuccgugugcuuugcuuguggc

SEQ ID NO: 481319 - RNA, 64 nt, Human
guuguccccagcaucucacaucagaccuggggcaggugcgcaguguggggaggggauggggugc

SEQ ID NO: 481320 - RNA, 64 nt, Human
agcgaugcacuugaccugacacuccccauguccuggugcgcacagcccuugucggugccccggc

SEQ ID NO: 481321 - RNA, 64 nt, Human
uuuuggggcacaacaucccaccgcagucccccucacccgacaacaccuccuaccuggccccuug

SEQ ID NO: 481322 - RNA, 64 nt, Human
ugguucagcggaaaugggaugugagaaugaugaaacccgacagaaguaucucagccugcaguca

SEQ ID NO: 481323 - RNA, 64 nt, Human
gcacugacuugaccccacaaguggaaaauuccccacccgacaccuuugcuuucugaugguucag

SEQ ID NO: 481324 - RNA, 64 nt, Human
ggaggccuacaucuagggugggggccacucaccgacccgacacucucaccccccgaccuggcug

SEQ ID NO: 481325 - RNA, 64 nt, Human
gcaggcucugggucagguucugcuccuuuaugggacccgacauuuuucagcucuuugcuauuga

SEQ ID NO: 481326 - RNA, 64 nt, Human
aggacagagacuugggggccauccugccccuccaacccgacauguguaccucagcuuuuucccu

SEQ ID NO: 481327 - RNA, 64 nt, Human; identical to SEQ ID NO: 481326

SEQ ID NO: 481328 - RNA, 64 nt, Human
cacgaaaggaaagaaauguauaccguaucuaucuacccgacagcagcgaccgagacccgguggg

SEQ ID NO: 481329 - RNA, 64 nt, Human
ugaggaagcgugaaggccgagaagcaagaaagaaacccgacagagggaagaaaagagcuuucuu

SEQ ID NO: 481330 - RNA, 64 nt, Human
aucucuacuuuaguauacucauuggauccucaaagagccguaagcuuuuuggaaaaaaacauuu

SEQ ID NO: 481331 - RNA, 64 nt, Human
aggaagggcugggugagacacacagcuauccuaggagccguaggaagacaaaacuucccuuuug

SEQ ID NO: 481332 - RNA, 64 nt, Human
auugauacugacuugaauuauuuucuaaaauuaagagccguauaccuaccuguaagucuuuuca

SEQ ID NO: 481333 - RNA, 64 nt, Human
uuugguugggaccccagacgugucaagacuuuuaacccgacagccccaagcacugcugaguaaa

SEQ ID NO: 481334 - RNA, 61 nt, Human
gguauuucuucuuauuguagagacugcaucaacccgacauuccuuucuuauaccaauguga

SEQ ID NO: 481335 - RNA, 64 nt, Human
agucuuugucuuucaugcugcugggacagaaaagacccgacauugcuucagaaaccguucagaa

SEQ ID NO: 481336 - RNA, 62 nt, Human
ucaugccugcccagaaaugaagcccggcccacacccgacaccagcccugcugcuuccuaacu

SEQ ID NO: 481337 - RNA, 64 nt, Human
gcuggcagcgcugccuccugcccacauuccugccacccgacaucaaagcuggcgugugaccuuu

SEQ ID NO: 481338 - RNA, 64 nt, Human
aagagguccagggacuuaacagccaagccacaccacccgacagguucuucugugacaccgagag

SEQ ID NO: 481339 - RNA, 64 nt, Human
cagcgcuggggcaggugccucugcugucagcuccacccgacaggcagacgaaggccaguggggc

SEQ ID NO: 481340 - RNA, 64 nt, Human
guaccaucaucacugccagagcucaagaucccacacccgacaugacauaaauaaaaaaauaaau

SEQ ID NO: 481341 - RNA, 64 nt, Human
auagcuauuuagagauauuuuccauuuuaagaaaacccgacaacauuucugccagguuuguuag

SEQ ID NO: 481342 - RNA, 64 nt, Human
cuacugaggaggauccuccagggccgcuccccggacccgacaggcgcggguggaugcagguucu

SEQ ID NO: 481343 - RNA, 64 nt, Human
uuaaaauguguuucuccugagcuaggaagagucuacccgacauaagucgagggacuuuauguuu

SEQ ID NO: 481344 - RNA, 64 nt, Human
ugaaucuggugaccuccaucugcuugcugucauaacccgacacggacuuauuuuugucauuagc

SEQ ID NO: 481345 - RNA, 64 nt, Human
aaugcaguaccguguggaaaaugcuuugguguuuacccgacagaggcuuuauuugugcuguauc

SEQ ID NO: 481346 - RNA, 64 nt, Human
gggugcuaaggguaagggagagggagggagccgggagccguagaggguggccgacggcggcggc

SEQ ID NO: 481347 - RNA, 64 nt, Human
cgaggccgcggccccagaguccccgcaccaggcagagccguaccugucacccuccccaagcgcc

SEQ ID NO: 481348 - RNA, 64 nt, Human
cggccaucacgucaagcuuuggauaacgaugaaugagccguauacaaggaauaugacauacagu

SEQ ID NO: 481349 - RNA, 64 nt, Human
gugcaugucaguuguggagaaaacauagcaaaaagagccguacgcucuuuacagauacuaaugu

SEQ ID NO: 481350 - RNA, 64 nt, Human
uuaucccagagacacccaauucuagagcuuuauggagccguacuucccccugaauccuagcucu

SEQ ID NO: 481351 - RNA, 64 nt, Human
uaaguuguucccgguaggucugcuuucccuggaagagccguauguacucagccuuuccuauugg

SEQ ID NO: 481352 - RNA, 64 nt, Human
uaacuccuaguagggguaccacugaaucuguacagagccguaaaaacugaaguucugccucuga

SEQ ID NO: 481353 - RNA, 64 nt, Human
ccacggaaacagaacucgaugcacugaccugcuccgccaggaaagugagcguguagcguccuga

SEQ ID NO: 481354 - RNA, 64 nt, Human; identical to SEQ ID NO: 480979

SEQ ID NO: 481355 - RNA, 64 nt, Human; identical to SEQ ID NO: 480980

SEQ ID NO: 481356 - RNA, 64 nt, Human; identical to SEQ ID NO: 480981

SEQ ID NO: 481357 - RNA, 64 nt, Human; identical to SEQ ID NO: 480982

SEQ ID NO: 481358 - RNA, 64 nt, Human; identical to SEQ ID NO: 480983

SEQ ID NO: 481359 - RNA, 64 nt, Human; identical to SEQ ID NO: 480984

SEQ ID NO: 481360 - RNA, 64 nt, Human; identical to SEQ ID NO: 480985

SEQ ID NO: 481361 - RNA, 64 nt, Human; identical to SEQ ID NO: 480986

SEQ ID NO: 481362 - RNA, 64 nt, Human; identical to SEQ ID NO: 331625

SEQ ID NO: 481363 - RNA, 64 nt, Human; identical to SEQ ID NO: 345319

SEQ ID NO: 481364 - RNA, 64 nt, Human; identical to SEQ ID NO: 345591

SEQ ID NO: 481365 - RNA, 64 nt, Human; identical to SEQ ID NO: 480987

SEQ ID NO: 481366 - RNA, 64 nt, Human; identical to SEQ ID NO: 480988

SEQ ID NO: 481367 - RNA, 64 nt, Human; identical to SEQ ID NO: 480989

SEQ ID NO: 481368 - RNA, 64 nt, Human; identical to SEQ ID NO: 480990

SEQ ID NO: 481369 - RNA, 64 nt, Human; identical to SEQ ID NO: 480991

SEQ ID NO: 481370 - RNA, 52 nt, Human; identical to SEQ ID NO: 480992

SEQ ID NO: 481371 - RNA, 64 nt, Human
cugugagcgcagccgaggcgcaggccgagugggccgccaggaccaagcgagguggaccccgaaa

SEQ ID NO: 481372 - RNA, 64 nt, Human
uggggaugcggggagauuugagaggggaaaaccccgccaggagggagagagaggcaccccucug

SEQ ID NO: 481373 - RNA, 64 nt, Human
agcaccccggugcggaccacagagcagacccuggcgccaggaaggagcauguguuagcgucucg

SEQ ID NO: 481374 - RNA, 64 nt, Human
ggagagaaacuuccagaccagccccucacaccaccgccaggagaggccuuucccaccgggagag

SEQ ID NO: 481375 - RNA, 64 nt, Human
uggcugcucaaguacuagccccggccccagcacccgccaggauguggagaccgaggcccaucuc

SEQ ID NO: 481376 - RNA, 64 nt, Human
ccuuccucucccaguacuuuaccaaaggaacccccgccaggacccacauggggccacguguugg

SEQ ID NO: 481377 - RNA, 64 nt, Human
ccaaccgcacugaaggaguggggagaagagcauacgccaggagccuccugccucaaagugcucc

SEQ ID NO: 481378 - RNA, 64 nt, Human
auugugucccauucccccagugcggccagcuccgcgccaggauggcgcaggaacucaauaaagu

SEQ ID NO: 481379 - RNA, 64 nt, Human
uggguacucgcaccucuuggcuuuguugaugcuccgccaggaaggccacuugugugugcguguc

SEQ ID NO: 481380 - RNA, 64 nt, Human; identical to SEQ ID NO: 344326

SEQ ID NO: 481381 - RNA, 64 nt, Human; identical to SEQ ID NO: 344344

SEQ ID NO: 481382 - RNA, 55 nt, Human; identical to SEQ ID NO: 331663

SEQ ID NO: 481383 - RNA, 64 nt, Human
agcagaaguucuucggcccgggccugucgaugcccgccaggacuguuuucaugcugccugugcc

SEQ ID NO: 481384 - RNA, 64 nt, Human
guacucugacugcaacaucuuucaccccauugaucgccaggauugauuugguugaucuggcuga

SEQ ID NO: 481385 - RNA, 64 nt, Human
agugacaaauaagauuaauaagauuuuucaaaaucgccaggacuggugaauauaaaugaugauu

SEQ ID NO: 481386 - RNA, 64 nt, Human
aaggagggucucuugcccaucucuccggccaccccgccaggaaacgacgagaaggccgaggaau

SEQ ID NO: 481387 - RNA, 64 nt, Human
cucacccaccugugauagugggcuuggggcuacgcgccaggagagucuccccccacccaccuuu

SEQ ID NO: 481388 - RNA, 64 nt, Human
ccaugagcagcaguucauuuaauugucacagcgucgccaggaagaagaucugauaaaccuaggu

SEQ ID NO: 481389 - RNA, 64 nt, Human
ugcuuuaaugguuuuguuuucuaaugcaauaaaucgccaggauuuccaaauuauugcuucaacc

SEQ ID NO: 481390 - RNA, 64 nt, Human
cgccagcgucgccgcgaggccucugggguggguucgccaggagggcacguucgcgccgcgccgc

SEQ ID NO: 481391 - RNA, 64 nt, Human
cgccggccucguccagcuccaugucgcccuccgucgccaggaugcgcugcacggucugcaggac

SEQ ID NO: 481392 - RNA, 64 nt, Human
guucugauuuccucaguccuuuagguuaaagcagcgccaggaggaagcugacagaagcagcguu

SEQ ID NO: 481393 - RNA, 64 nt, Human
gaacucuccccauuggcaaaccggacccggccgccgccaggacuguguuuccaaagguuccccg

SEQ ID NO: 481394 - RNA, 64 nt, Human
cccagcagcccagcccccacccuccuggcagcagcgccaggaaggcuuugacaauuaccuccgu

SEQ ID NO: 481395 - RNA, 64 nt, Human
cuggguuucuagaggucaggacggcuccucagagcgccaggaagccagagccccaagcaggacg

SEQ ID NO: 481396 - RNA, 64 nt, Human
gcugcagagcuggagggugggcgugguacgugugcgccaggacucgggcgcugagggccacuca

SEQ ID NO: 481397 - RNA, 64 nt, Human
cuccucuaccccgcccugggcuggugaaggugcgcgccaggauguggacuacugagcccugaag

SEQ ID NO: 481398 - RNA, 64 nt, Human; identical to SEQ ID NO: 44741

SEQ ID NO: 481399 - RNA, 64 nt, Human; identical to SEQ ID NO: 44742

SEQ ID NO: 481400 - RNA, 64 nt, Human; identical to SEQ ID NO: 44743

SEQ ID NO: 481401 - RNA, 64 nt, Human
ucagcauggagagccccugcuaauggaguacagccgccaggagcuacucaggaaggugggagag

SEQ ID NO: 481402 - RNA, 64 nt, Human
aaggaaggacaagaaguugucaaagaauucccaacgccaggacccacaucccuuugguauugau

SEQ ID NO: 481403 - RNA, 64 nt, Human
agaagacccagcuggaguucaugucgcaacagugcgccaggaccgacggccagccgcugcgcuc

SEQ ID NO: 481404 - RNA, 64 nt, Human
ucuagagauugaggugaaagcuucguccgagaaacgccaggacagacgauggcagaggagaggg

SEQ ID NO: 481405 - RNA, 64 nt, Human
gggccgaagacccuucuucccuggcugccaggcucgccaggagcccacuggaaacgcccaccac

SEQ ID NO: 481406 - RNA, 64 nt, Human
uuucaccugucucagucuuccgcaggcuuaccugcgccaggaagucuaaccaaggaacaagaau

SEQ ID NO: 481407 - RNA, 64 nt, Human
cggccccacucuccggaucuggacgaugggcucacgccaggaacgccgguucccccgggcccgg

SEQ ID NO: 481408 - RNA, 64 nt, Human
ugcccgccgugauggccuugaggcugccugcccgcgccaggauguuuggcacaaagagcagccc

SEQ ID NO: 481409 - RNA, 64 nt, Human
uuccagggccguaggugccuuucugcacacaggccgccaggacucguggugucuccaggcugug

SEQ ID NO: 481410 - RNA, 64 nt, Human
ugcccaggccaggggggcugcagcccucagcccccgccaggauucccgcaggcuccuggacugg

SEQ ID NO: 481411 - RNA, 64 nt, Human
uuuccagaauccugcaugggccaugugagaagaucgccaggaucuuccugauggaagcugacuu

SEQ ID NO: 481412 - RNA, 64 nt, Human
ggacucaggggcgaggaggaugacuggguccggucgccaggacugucucugaggcagaaacgcc

SEQ ID NO: 481413 - RNA, 64 nt, Human
gcccagccccgggcacccgccucggacgcucgggcgccaggaggcuucgcuggaggggcugggc

SEQ ID NO: 481414 - RNA, 64 nt, Human
ugugcuaucuucucuucuauccaaguagaauguacgccaggagcuccuucccucuagcaauuuc

SEQ ID NO: 481415 - RNA, 64 nt, Human
acagcccguucgaaggugugcagagggcucugagcgccaggauggccagggcuguuuuugcuac

SEQ ID NO: 481416 - RNA, 64 nt, Human; identical to SEQ ID NO: 344415

SEQ ID NO: 481417 - RNA, 64 nt, Human; identical to SEQ ID NO: 344574

SEQ ID NO: 481418 - RNA, 64 nt, Human; identical to SEQ ID NO: 345338

SEQ ID NO: 481419 - RNA, 64 nt, Human
ugacaacagucuucugcccaugucugggaacacacgccaggaggaaugucugauacccucugca

SEQ ID NO: 481420 - RNA, 64 nt, Human
uuggucuuuguucaucugaguugugcuggggcaacgccaggaagugcccuggguaccucugcug

SEQ ID NO: 481421 - RNA, 64 nt, Human
ggggaaggccaggguggaagggcggcuugagggacgccaggagaagacugaaugccaggcuagg

SEQ ID NO: 481422 - RNA, 64 nt, Human
ugggaaggaaggcagugccugcucugcugugagccgccaggaacccuccuccugucaauggggg

SEQ ID NO: 481423 - RNA, 64 nt, Human
gagaaauacuaugcauagcaaggagaugcagagccgccaggaaaauucugaguuccagcacaau

SEQ ID NO: 481424 - RNA, 64 nt, Human
cccuccuucccucucaccccuccucucccggccucgccaggagucuuggcuguuggcagcucag

SEQ ID NO: 481425 - RNA, 64 nt, Human
cacccaacucccuuugccucuccccaaaccgggccgccaggaucccuccccgcggcggcgaugg

SEQ ID NO: 481426 - RNA, 64 nt, Human
uugcagggguccuaagaaacuccacucuggacagcgccaggaggcccuggguuccauuccuaac

SEQ ID NO: 481427 - RNA, 64 nt, Human
caaucaacacacugccaaugcgggugggcuaagccgccaggaugccugcagcagauggacgcug

SEQ ID NO: 481428 - RNA, 50 nt, Human
gcccgcccucccgaauguagcgccaggagccacgucccuucucccuuccc

SEQ ID NO: 481429 - RNA, 64 nt, Human
uccagcccgugauugacaagcuggccgaguaugucgccaggaacggccugaaguucgagaccag

SEQ ID NO: 481430 - RNA, 64 nt, Human
gggacauuguaguucgcaugguucucuggaaacgcgccaggaaaagcuuccgugccagugauuc

SEQ ID NO: 481431 - RNA, 64 nt, Human
ggucuccauggugcuaggccaggguggccagccccgccaggaggccuggccugggcacacgcac

SEQ ID NO: 481432 - RNA, 64 nt, Human
gcuguaccugacaggccuucugaggaagccaagacgccaggagaggcucaggccugggagucag

SEQ ID NO: 481433 - RNA, 64 nt, Human
cgcuuccucccgcaagcagcccggguccgcacugcgccaggagccgccugcgaccgcccgggcg

SEQ ID NO: 481434 - RNA, 64 nt, Human; identical to SEQ ID NO: 331683

SEQ ID NO: 481435 - RNA, 64 nt, Human; identical to SEQ ID NO: 344231

SEQ ID NO: 481436 - RNA, 64 nt, Human; identical to SEQ ID NO: 345746

SEQ ID NO: 481437 - RNA, 64 nt, Human
ugaucagguuauuggugacuuacuggacuggcaccgccaggagaaaauucuccugcuaacuuuu

SEQ ID NO: 481438 - RNA, 64 nt, Human
ucuucaccaucuuucugauuccgcacccugccuacgccaggagaaguugaggggagcaugcuuc

SEQ ID NO: 481439 - RNA, 64 nt, Human
gcggaguuugguggagcugcgggaaauguugaagcgccaggagagacuuuugcgcaacgaguaa

SEQ ID NO: 481440 - RNA, 64 nt, Human
gaguaccgagagacacggucuggacagcccaaggcgccaggaugcaaccugcuuucaccagacu

SEQ ID NO: 481441 - RNA, 53 nt, Human
agcggguugcccgccgcugacugcgccaggaugcacagaccgaccgacagacc

SEQ ID NO: 481442 - RNA, 64 nt, Human
ccccccagcgacacuaugcaaauccuggagugcccgccaggaucgaagccaugacugggugcag

SEQ ID NO: 481443 - RNA, 64 nt, Human
ucaccaaacccacccgcgcccugggacgcagccacgccaggaggaggacacggccgccgagagc

SEQ ID NO: 481444 - RNA, 64 nt, Human
gaagacuuaaccgguggccucaucaccagagcaucgccaggauuucuaaugcacucaguuuccc

SEQ ID NO: 481445 - RNA, 64 nt, Human
caugauggaccggugauggcggagccuugugcgucgccaggacuucucugggcuguguuuaaac

SEQ ID NO: 481446 - RNA, 64 nt, Human
cgccgaggaacagugcugggcaccccgccuggcccgccaggacccacccugccaacaucaaguu

SEQ ID NO: 481447 - RNA, 64 nt, Human
ccagccagguugaacuguagcgaggcccccaggccgccaggaauggaccaugcagaucacuguc

SEQ ID NO: 481448 - RNA, 64 nt, Human
aagcugggcccucacuggccugucccugcugcagcgccaggacccccggagguagaggcgagag

SEQ ID NO: 481449 - RNA, 64 nt, Human
cugcccagcucaccacaucuucaucaccagcaaacgccaggacuuggcucccccauccucagaa

SEQ ID NO: 481450 - RNA, 64 nt, Human
gaacagcaggcccaccuaccuucaaagcugaagccgccaggaccgccaaagaaugccuugaaga

SEQ ID NO: 481451 - RNA, 64 nt, Human
ggugccauaucacguacaccauaugcaaguuucccgccaggagguccuccucucucuacuugaa

SEQ ID NO: 481452 - RNA, 64 nt, Human; identical to SEQ ID NO: 344117

SEQ ID NO: 481453 - RNA, 64 nt, Human; identical to SEQ ID NO: 344167

SEQ ID NO: 481454 - RNA, 64 nt, Human; identical to SEQ ID NO: 344183

SEQ ID NO: 481455 - RNA, 64 nt, Human
aggugguuacaaaucauaacuuccugcaaaucaacgccaggagagcaacuuaccuucauuucuu

SEQ ID NO: 481456 - RNA, 64 nt, Human
auguauccccgcaccccagaacugggcuccugaacgccaggaaccuggggucugggggggagcu

SEQ ID NO: 481457 - RNA, 58 nt, Human
gcgcccuggcccuggccugagcccacgccgccaggaggcagggagggcuccgccgcgg

SEQ ID NO: 481458 - RNA, 54 nt, Human
cggcgggagacgagcugugagccccgccaggacuaugcucccaggccccucugc

SEQ ID NO: 481459 - RNA, 64 nt, Human
caacagcucccaaacccugagcaaggcaaccgaucgccaggaccaggaagcaucacccaggaga

SEQ ID NO: 481460 - RNA, 64 nt, Human
cuggcaugucauccucagggcgcuuccucgcucacgccaggagggacuuggaguggcgagcugg

SEQ ID NO: 481461 - RNA, 64 nt, Human
auggaccacaaagcagaaguggcuucuuagcuuccgccaggagcugcuccuguggguugaugga

SEQ ID NO: 481462 - RNA, 64 nt, Human
acuccacgccggcagccaacgcacaggaugggggcgccaggagaggggccccucucuccucuau

SEQ ID NO: 481463 - RNA, 64 nt, Human
cgggguucagcggcucccccagugcugcaggugccgccaggacgggccacgugggcccccagcc

SEQ ID NO: 481464 - RNA, 64 nt, Human
aggccuguagggcccucgugcagcccacccugaccgccaggaugcuucugccauccaggggugu

SEQ ID NO: 481465 - RNA, 64 nt, Human
aacuggccuggcaccuggugccacgugcugcugccgccaggauaugcgccuucccacaggugcc

SEQ ID NO: 481466 - RNA, 64 nt, Human
gagaaaggagaucggacugggguucccgguggggcgccaggauggcuccugggggugcuccugc

SEQ ID NO: 481467 - RNA, 64 nt, Human
ucccuaccucccaccaccuaguggccaaacaccccgccaggaguucaaugcugggagaggucca

SEQ ID NO: 481468 - RNA, 64 nt, Human
cuugguccccagaagauggcggcuagggccucgccgccaggacagagaagggacgggguggcug

SEQ ID NO: 481469 - RNA, 64 nt, Human
ccuuguggcaauuugagagucuggcaucguuuuccgccaggacccaaagauccaggaggcacuu

SEQ ID NO: 481470 - RNA, 64 nt, Human
ucuaagcaaagugccccugcaggccggguucugccgccaggacugcccccuucccagagcccug

SEQ ID NO: 481471 - RNA, 64 nt, Human
acaagacagaggggagcaguggccaucauccucccgccaggagcuucuucguuccugcgcauau

SEQ ID NO: 481472 - RNA, 64 nt, Human
gggacagcugcuuugcugcccggagaguaguccgcgccaggaagagagcaacgaggaaaggaga

SEQ ID NO: 481473 - RNA, 64 nt, Human
caaaccacccaccccauugggagaaaaacccagacgccaggaaaagaagaaacaacaaaggcag

SEQ ID NO: 481474 - RNA, 64 nt, Human
caucaccaacgggaggugacccgcuggccgcccgcgccaggagccuggacccggccucccgggg

SEQ ID NO: 481475 - RNA, 64 nt, Human
ggaaagugacgcgcauggacggggcccagcuaggcgccaggacuuggccucacccucuggcuga

SEQ ID NO: 481476 - RNA, 64 nt, Human
gggacguggcucagccagcacuuguccagcugagcgccaggauggaacacggccacaucaaaga

SEQ ID NO: 481477 - RNA, 64 nt, Human
aucgggggguggcucuccugccacccauggggagcgccaggagaggagggucauggaggauguu

SEQ ID NO: 481478 - RNA, 64 nt, Human
guuggggcagauguuacugaaccugugaaucagacgccaggagugagggcuggggagggaccua

SEQ ID NO: 481479 - RNA, 64 nt, Human
gcaaccugugcagccggcagugugccuggugucacgccaggaggcuguggcugcugugggcccu

SEQ ID NO: 481480 - RNA, 64 nt, Human
gcacgccgccacccccuccccgcagcccucaccccgccaggagccacugcucucccccuugccc

SEQ ID NO: 481481 - RNA, 64 nt, Human; identical to SEQ ID NO: 481353

SEQ ID NO: 481482 - RNA, 64 nt, Human
ccuucguccuaugucagccuucccuuugauccucaggcccuaccuguagagaccuccacuccua

SEQ ID NO: 481483 - RNA, 64 nt, Human
uaguucagucccagggaaagagaaaacucgcccuaggcccuaggugggaagaugguuugaaauu

SEQ ID NO: 481484 - RNA, 64 nt, Human
ucacauaaaggagacuggcugaagcugaaugaggaggcccuauagcagaagucugauucuaaga

SEQ ID NO: 481485 - RNA, 64 nt, Human; identical to SEQ ID NO: 481371

SEQ ID NO: 481486 - RNA, 64 nt, Human
cccuaggcaggcccugcaggucccacacucucccaggcccuaaacuugggcggccuugcccuga

SEQ ID NO: 481487 - RNA, 64 nt, Human
gacucacaaugucccagugccaugcuuccuccuuaggcccuaggaaagaauacuuccuagccuc

SEQ ID NO: 481488 - RNA, 64 nt, Human
caacagguuacuggcaaugccagugaguuucuguaggcccuaagcugaagaagugaggcaguga

SEQ ID NO: 481489 - RNA, 64 nt, Human
gcuugggccggccugggguccgccgcuggcccggaggcccuaggagcuggugcugcccccgccc

SEQ ID NO: 481490 - RNA, 64 nt, Human
cuggugauauuaaggugaaauaacaaaacacaaaaggcccuauuuuaacaguugaugugacagu

SEQ ID NO: 481491 - RNA, 64 nt, Human
uccaauuauuucuaaagacacacuacauagaaagaggcccuauaaacucaaaaagucauuggga

SEQ ID NO: 481492 - RNA, 64 nt, Human
ggcugugaguuccaggucugugcucauggccaccaggcccuacugcucagggugaaugcagcug

SEQ ID NO: 481493 - RNA, 64 nt, Human
cccugagaagaagcuggauuugaaaaucccucacaggcccuaacauguuuccugggugggcagg

SEQ ID NO: 481494 - RNA, 64 nt, Human
agggccuuccccucccagcccugagggguggacuaggcccuacacacagaccgcgccccuggga

SEQ ID NO: 481495 - RNA, 64 nt, Human
agagcccucugggagcuauauacauuguaaaugcaggcccuagcuuuggaacgaggaauuggga

SEQ ID NO: 481496 - RNA, 64 nt, Human
gaggacugccugugauccuggccacuaggccaagaggcccuaugaagguggcgggaacucagcu

SEQ ID NO: 481497 - RNA, 64 nt, Human
uuaucuuagcauguuucaguaucuucucuaucauaggcccuaaguucauugggggaaaaaaaau

SEQ ID NO: 481498 - RNA, 64 nt, Human
auacccucuucucccuacccaucccauuccccacaggcccuacauuaacaagguuaagcucaac

SEQ ID NO: 481499 - RNA, 64 nt, Human
uguccagcacgucguggccucugguccgaccaccaggcccuagucucggucagggagucugcuc

SEQ ID NO: 481500 - RNA, 64 nt, Human
ggaucacccucagccuuggugcucaguggucccgaggcccuagacccccaccccccgccaguug

SEQ ID NO: 481501 - RNA, 64 nt, Human
aaaaauccaagcacauuccccuugcaguuaggggaggcccuacugccuucucaaagcagagagg

SEQ ID NO: 481502 - RNA, 64 nt, Human
ccucgaaacccuccagaagacaucuguccugcagaggcccuaccacugcgaggccugcgggaag

SEQ ID NO: 481503 - RNA, 64 nt, Human
cucaucgggcugucgccugacagcauaccucaaaaggcccuagcuaauaaaccuguaagcccag

SEQ ID NO: 481504 - RNA, 64 nt, Human
aaaauaaggauccuaggacagcaccucgaacuacaggcccuaaagagaaauugccucaaaccac

SEQ ID NO: 481505 - RNA, 64 nt, Human; identical to SEQ ID NO: 314338

SEQ ID NO: 481506 - RNA, 64 nt, Human; identical to SEQ ID NO: 481372

SEQ ID NO: 481507 - RNA, 64 nt, Human; identical to SEQ ID NO: 481373

SEQ ID NO: 481508 - RNA, 64 nt, Human; identical to SEQ ID NO: 481374

SEQ ID NO: 481509 - RNA, 64 nt, Human; identical to SEQ ID NO: 481375

SEQ ID NO: 481510 - RNA, 64 nt, Human; identical to SEQ ID NO: 481376

SEQ ID NO: 481511 - RNA, 64 nt, Human; identical to SEQ ID NO: 481377

SEQ ID NO: 481512 - RNA, 64 nt, Human; identical to SEQ ID NO: 481378

SEQ ID NO: 481513 - RNA, 64 nt, Human; identical to SEQ ID NO: 481379

SEQ ID NO: 481514 - RNA, 64 nt, Human; identical to SEQ ID NO: 481383

SEQ ID NO: 481515 - RNA, 64 nt, Human; identical to SEQ ID NO: 481384

SEQ ID NO: 481516 - RNA, 64 nt, Human; identical to SEQ ID NO: 481385

SEQ ID NO: 481517 - RNA, 64 nt, Human; identical to SEQ ID NO: 481386

SEQ ID NO: 481518 - RNA, 64 nt, Human; identical to SEQ ID NO: 481387

SEQ ID NO: 481519 - RNA, 64 nt, Human; identical to SEQ ID NO: 481388

SEQ ID NO: 481520 - RNA, 64 nt, Human; identical to SEQ ID NO: 481389

SEQ ID NO: 481521 - RNA, 64 nt, Human; identical to SEQ ID NO: 314305

SEQ ID NO: 481522 - RNA, 64 nt, Human; identical to SEQ ID NO: 314047

SEQ ID NO: 481523 - RNA, 64 nt, Human; identical to SEQ ID NO: 314085

SEQ ID NO: 481524 - RNA, 64 nt, Human; identical to SEQ ID NO: 481390

SEQ ID NO: 481525 - RNA, 64 nt, Human; identical to SEQ ID NO: 481391

SEQ ID NO: 481526 - RNA, 64 nt, Human; identical to SEQ ID NO: 481392

SEQ ID NO: 481527 - RNA, 64 nt, Human; identical to SEQ ID NO: 481393

SEQ ID NO: 481528 - RNA, 64 nt, Human; identical to SEQ ID NO: 481394

SEQ ID NO: 481529 - RNA, 64 nt, Human; identical to SEQ ID NO: 481395

SEQ ID NO: 481530 - RNA, 64 nt, Human; identical to SEQ ID NO: 481396

SEQ ID NO: 481531 - RNA, 64 nt, Human; identical to SEQ ID NO: 481397

SEQ ID NO: 481532 - RNA, 64 nt, Human; identical to SEQ ID NO: 481401

SEQ ID NO: 481533 - RNA, 64 nt, Human; identical to SEQ ID NO: 481402

SEQ ID NO: 481534 - RNA, 64 nt, Human; identical to SEQ ID NO: 481403

SEQ ID NO: 481535 - RNA, 64 nt, Human; identical to SEQ ID NO: 481404

SEQ ID NO: 481536 - RNA, 64 nt, Human; identical to SEQ ID NO: 481405

SEQ ID NO: 481537 - RNA, 64 nt, Human; identical to SEQ ID NO: 481406

SEQ ID NO: 481538 - RNA, 64 nt, Human; identical to SEQ ID NO: 481407

SEQ ID NO: 481539 - RNA, 64 nt, Human; identical to SEQ ID NO: 314153

SEQ ID NO: 481540 - RNA, 64 nt, Human; identical to SEQ ID NO: 313178

SEQ ID NO: 481541 - RNA, 64 nt, Human; identical to SEQ ID NO: 481408

SEQ ID NO: 481542 - RNA, 64 nt, Human; identical to SEQ ID NO: 481409

SEQ ID NO: 481543 - RNA, 64 nt, Human; identical to SEQ ID NO: 481410

SEQ ID NO: 481544 - RNA, 64 nt, Human; identical to SEQ ID NO: 481411

SEQ ID NO: 481545 - RNA, 64 nt, Human; identical to SEQ ID NO: 481412

SEQ ID NO: 481546 - RNA, 64 nt, Human; identical to SEQ ID NO: 481413

SEQ ID NO: 481547 - RNA, 64 nt, Human; identical to SEQ ID NO: 481414

SEQ ID NO: 481548 - RNA, 64 nt, Human; identical to SEQ ID NO: 481415

SEQ ID NO: 481549 - RNA, 64 nt, Human; identical to SEQ ID NO: 481419

SEQ ID NO: 481550 - RNA, 64 nt, Human; identical to SEQ ID NO: 481420

SEQ ID NO: 481551 - RNA, 64 nt, Human; identical to SEQ ID NO: 481421

SEQ ID NO: 481552 - RNA, 64 nt, Human; identical to SEQ ID NO: 481422

SEQ ID NO: 481553 - RNA, 64 nt, Human; identical to SEQ ID NO: 481423

SEQ ID NO: 481554 - RNA, 64 nt, Human; identical to SEQ ID NO: 481424

SEQ ID NO: 481555 - RNA, 64 nt, Human; identical to SEQ ID NO: 481425

SEQ ID NO: 481556 - RNA, 58 nt, Human
ugagggugaaagucucccacgaguacacuaaaccuaggucuggucaccaauaggguuu

SEQ ID NO: 481557 - RNA, 58 nt, Human
aacguaucauccuagcuuccucucuuaauaaaccuagaaaaacggguaguaaacugug

SEQ ID NO: 481558 - RNA, 58 nt, Human
cucucuuuuguuauagagaucucagcccuaaaccuaggauggauagaaggaaacauau

SEQ ID NO: 481559 - RNA, 64 nt, Human; identical to SEQ ID NO: 481426

SEQ ID NO: 481560 - RNA, 64 nt, Human; identical to SEQ ID NO: 481427

SEQ ID NO: 481561 - RNA, 50 nt, Human; identical to SEQ ID NO: 481428

SEQ ID NO: 481562 - RNA, 64 nt, Human; identical to SEQ ID NO: 481429

SEQ ID NO: 481563 - RNA, 64 nt, Human; identical to SEQ ID NO: 481430

SEQ ID NO: 481564 - RNA, 64 nt, Human; identical to SEQ ID NO: 481431

SEQ ID NO: 481565 - RNA, 64 nt, Human; identical to SEQ ID NO: 481432

SEQ ID NO: 481566 - RNA, 64 nt, Human; identical to SEQ ID NO: 481433

SEQ ID NO: 481567 - RNA, 64 nt, Human; identical to SEQ ID NO: 481437

SEQ ID NO: 481568 - RNA, 64 nt, Human; identical to SEQ ID NO: 481438

SEQ ID NO: 481569 - RNA, 64 nt, Human; identical to SEQ ID NO: 481439

SEQ ID NO: 481570 - RNA, 64 nt, Human; identical to SEQ ID NO: 481440

SEQ ID NO: 481571 - RNA, 53 nt, Human; identical to SEQ ID NO: 481441

SEQ ID NO: 481572 - RNA, 64 nt, Human; identical to SEQ ID NO: 481442

SEQ ID NO: 481573 - RNA, 64 nt, Human; identical to SEQ ID NO: 481443

SEQ ID NO: 481574 - RNA, 58 nt, Human
gauguuaagcuuuuugaaaaguuuagguuaaaccuacuguuguuagauuaauguauuu

SEQ ID NO: 481575 - RNA, 58 nt, Human
uaaacaaaccagccagccgccaccuugcuaaaccuauaagcuuuuuaaaauccaauau

SEQ ID NO: 481576 - RNA, 58 nt, Human
ggauuucaaaaacuuucuauuccuuucuuaaaccuaccagcaaacuaggauugugaua

SEQ ID NO: 481577 - RNA, 64 nt, Human; identical to SEQ ID NO: 481444

SEQ ID NO: 481578 - RNA, 64 nt, Human; identical to SEQ ID NO: 481445

SEQ ID NO: 481579 - RNA, 64 nt, Human; identical to SEQ ID NO: 481446

SEQ ID NO: 481580 - RNA, 64 nt, Human; identical to SEQ ID NO: 481447

SEQ ID NO: 481581 - RNA, 64 nt, Human; identical to SEQ ID NO: 481448

SEQ ID NO: 481582 - RNA, 64 nt, Human; identical to SEQ ID NO: 481449

SEQ ID NO: 481583 - RNA, 64 nt, Human; identical to SEQ ID NO: 481450

SEQ ID NO: 481584 - RNA, 64 nt, Human; identical to SEQ ID NO: 481451

SEQ ID NO: 481585 - RNA, 64 nt, Human; identical to SEQ ID NO: 481455

SEQ ID NO: 481586 - RNA, 64 nt, Human; identical to SEQ ID NO: 481456

SEQ ID NO: 481587 - RNA, 58 nt, Human; identical to SEQ ID NO: 481457

SEQ ID NO: 481588 - RNA, 54 nt, Human; identical to SEQ ID NO: 481458

SEQ ID NO: 481589 - RNA, 64 nt, Human; identical to SEQ ID NO: 481459

SEQ ID NO: 481590 - RNA, 64 nt, Human; identical to SEQ ID NO: 481460

SEQ ID NO: 481591 - RNA, 64 nt, Human; identical to SEQ ID NO: 481461

SEQ ID NO: 481592 - RNA, 58 nt, Human
uucagccaagccaagaggaugguuucaauaaaccuaauaaucugaaguucaguaucau

SEQ ID NO: 481593 - RNA, 58 nt, Human
guugaauuccaaauugugaccccaacacuaaaccuaaggacagcuacaaaggaaagac

SEQ ID NO: 481594 - RNA, 58 nt, Human
gucuuuggugaaugguuuuauauauacauaaaccuaaagcauauaagacaaaaauuua

SEQ ID NO: 481595 - RNA, 64 nt, Human; identical to SEQ ID NO: 481462

SEQ ID NO: 481596 - RNA, 64 nt, Human; identical to SEQ ID NO: 481463

SEQ ID NO: 481597 - RNA, 64 nt, Human; identical to SEQ ID NO: 481464

SEQ ID NO: 481598 - RNA, 64 nt, Human; identical to SEQ ID NO: 481465

SEQ ID NO: 481599 - RNA, 64 nt, Human; identical to SEQ ID NO: 481466

SEQ ID NO: 481600 - RNA, 64 nt, Human; identical to SEQ ID NO: 481467

SEQ ID NO: 481601 - RNA, 64 nt, Human; identical to SEQ ID NO: 481468

SEQ ID NO: 481602 - RNA, 64 nt, Human; identical to SEQ ID NO: 481469

SEQ ID NO: 481603 - RNA, 64 nt, Human; identical to SEQ ID NO: 481470

SEQ ID NO: 481604 - RNA, 64 nt, Human; identical to SEQ ID NO: 481471

SEQ ID NO: 481605 - RNA, 64 nt, Human; identical to SEQ ID NO: 481472

SEQ ID NO: 481606 - RNA, 64 nt, Human; identical to SEQ ID NO: 481473

SEQ ID NO: 481607 - RNA, 64 nt, Human; identical to SEQ ID NO: 481474

SEQ ID NO: 481608 - RNA, 64 nt, Human; identical to SEQ ID NO: 481475

SEQ ID NO: 481609 - RNA, 64 nt, Human; identical to SEQ ID NO: 481476

SEQ ID NO: 481610 - RNA, 58 nt, Human
caucuguuuaucaaaugacauaaauacguaaaccuauaagaauuaaguuuauuaauua

SEQ ID NO: 481611 - RNA, 58 nt, Human
aaugggagaaauaguuuguucuaugaaauaaaccuaguuuagaaauagggaagcugag

SEQ ID NO: 481612 - RNA, 58 nt, Human
agagccccaauucugcuuucccacaaaauaaaccuaaugccaucaggcaaaacauuuc

SEQ ID NO: 481613 - RNA, 64 nt, Human; identical to SEQ ID NO: 481477

SEQ ID NO: 481614 - RNA, 64 nt, Human; identical to SEQ ID NO: 481478

SEQ ID NO: 481615 - RNA, 64 nt, Human; identical to SEQ ID NO: 481479

SEQ ID NO: 481616 - RNA, 64 nt, Human; identical to SEQ ID NO: 481480

SEQ ID NO: 481617 - RNA, 64 nt, Human
gucaggcuggucucaaacuccugaccucaggugauccgcccaccucagccucccaaagugcugg

SEQ ID NO: 481618 - RNA, 64 nt, Human
cgaccugacuuacuugcacugugaucccccuugcuccgcccacugugaccuugaaccccaugca

SEQ ID NO: 481619 - RNA, 64 nt, Human
uuggcuacucuagcguggugcgcccuaguacgacuccgcccaguguguggaccaaccaaauagc

SEQ ID NO: 481620 - RNA, 64 nt, Human
ggcuggaauggaacuccucacuagcugcuggggcuccgcccacccugcucccuuccggacaaug

SEQ ID NO: 481621 - RNA, 64 nt, Human
gggcagggacugccuccucccggaauuccuaagauccgcccagcugccaccauuuucauugcuu

SEQ ID NO: 481622 - RNA, 64 nt, Human
ugaacagaugaguccugggagagacccucagagauccgcccagaccccucuccugcccucugca

SEQ ID NO: 481623 - RNA, 64 nt, Human
guuaggcuggucucgaacucccaaccucaggugauccgcccaccucagcucucaaagugcuggg

SEQ ID NO: 481624 - RNA, 64 nt, Human
cucccucuuuguguccauuccccaaauuaaccucuccgcccaggcccagaggaggggcugccug

SEQ ID NO: 481625 - RNA, 58 nt, Human
uuuucuugaacugaucauugaaaacuuauaaaccuaacagaaaagccacauaauauuu

SEQ ID NO: 481626 - RNA, 58 nt, Human
ucuuuaauaaaucuuucagcagagagauuaaaccuagguucagagcaugggugcucug

SEQ ID NO: 481627 - RNA, 58 nt, Human
gcagcaucaaccuacgugguggaaauaguaaaccuauauuuucauaauucuaugugua

SEQ ID NO: 481628 - RNA, 64 nt, Human
gggguccccuccagcaugggacuggccugccuccuccgcccagcucggcgagcuccuccagacc

SEQ ID NO: 481629 - RNA, 64 nt, Human
gccaggcuggucucgaacugcuggauucaagugauccgcccaucuccgucucccaaagugcugg

SEQ ID NO: 481630 - RNA, 64 nt, Human
accaccccuccugcuuccccgagccugacccuguuccgcccacuggcaaucagggcugcgcacu

SEQ ID NO: 481631 - RNA, 64 nt, Human
uaugaggugugcagggggagcuggguggcuucacuccgcccauuccaaagagggcucucccucc

SEQ ID NO: 481632 - RNA, 64 nt, Human
cgucugacagccauguccaccugugcccacagcuuccgcccacagaccuccagggacaggagca

SEQ ID NO: 481633 - RNA, 64 nt, Human
gccaggcugguuucaaacuccugaccucaggugauccgcccaccucagccucccaaaauggugg

SEQ ID NO: 481634 - RNA, 64 nt, Human
guugauuccagugcuaaaagggaaaaaccugugguccgcccagaagagauuccuccagugccug

SEQ ID NO: 481635 - RNA, 64 nt, Human
gucaggcuggucucgaacuccagaccucaggugauccgcccaccucggccucccaaacugcugg

SEQ ID NO: 481636 - RNA, 64 nt, Human
gaaaugaaauauguugcugggugcguuaaucaccuccgcccaggauuuagucacuugcaggacc

SEQ ID NO: 481637 - RNA, 64 nt, Human
ugggacugucauguuauccagaagggcugguacauccgcccaccaugucccccugcugggucag

SEQ ID NO: 481638 - RNA, 64 nt, Human
gccaggcuggucuugaacuccugaccucaacugauccgcccaccuuggccucccaagugcuggg

SEQ ID NO: 481639 - RNA, 64 nt, Human
caaguccucgccccccgcccggccuccuagccucuccgcccacgcggcugcugcuucucccugg

SEQ ID NO: 481640 - RNA, 64 nt, Human
uguccccagggaagagaaugaggaccacguggacuccgcccacacagagcuggcugcugugccc

SEQ ID NO: 481641 - RNA, 64 nt, Human
uaaaauaaaccuucacugcuccacuccaggugaauccgcccacucccacugaccuaguagaauu

SEQ ID NO: 481642 - RNA, 64 nt, Human
gucaggcuggucuugaacucccgaccucaggugauccgcccaccuaggccucucaaaguguugg

SEQ ID NO: 481643 - RNA, 58 nt, Human
aggauuaugggcuggaaagcauuuguuauaaaccuauagugcacauuuuaacugcccc

SEQ ID NO: 481644 - RNA, 58 nt, Human
gcuucaaacggaagacaggaccuagaucuaaaccuagauacuagcauuuugugggauu

SEQ ID NO: 481645 - RNA, 58 nt, Human
aguaaucauaacucuuuaccaguagugguaaaccuaugaaaaauccuugcuuuuaagu

SEQ ID NO: 481646 - RNA, 58 nt, Human
uucaacagugccagcauuccaacuuuguuaaaccuaccaacaucuuaaauggacuuuc

SEQ ID NO: 481647 - RNA, 64 nt, Human
cauuaucugcacuauaagcucaaagaaugucacauccgcccagacagcucuuugaugaggguga

SEQ ID NO: 481648 - RNA, 64 nt, Human
cgccgcuaaccggccgcucguccccgcgccacgguccgcccaccgccgccgccgcugucccaga

SEQ ID NO: 481649 - RNA, 50 nt, Human
ucuccaagaggaagcccuaauccgcccacaggaagccugcaguccuggaa

SEQ ID NO: 481650 - RNA, 64 nt, Human
uuuggcacuugaggcacggagaagggaagggaaguccgcccagccagaacucccagacccgcuc

SEQ ID NO: 481651 - RNA, 64 nt, Human
cuuaggcuggucuugaacuccugaacucaagugauccgcccaccucagccucccaaaguguugg

SEQ ID NO: 481652 - RNA, 64 nt, Human
uuuuuuuuuuuuuuuugagacggagucucacucuuccgcccaggcugcagugcaguggcaugau

SEQ ID NO: 481653 - RNA, 56 nt, Human
augcccucagccagcucugacccagguccgcccagggacccacauggacuaaaggc

SEQ ID NO: 481654 - RNA, 64 nt, Human
uagccaggauggucucgaucuccugaccucgugauccgcccaccuuggccucccagagugcugg

SEQ ID NO: 481655 - RNA, 64 nt, Human
gaguggcacugauaacuggugaagccuacagccauccgcccaaaagucuguucugauggcacug

SEQ ID NO: 481656 - RNA, 64 nt, Human
ggcugcuggaaggcagcuuguggaggccguugguuccgcccacucauuccuucucgugcacugc

SEQ ID NO: 481657 - RNA, 64 nt, Human
guuggccaggauggucucaaucucgaccucgugauccgcccaccuuggccucccaaaguguugg

SEQ ID NO: 481658 - RNA, 64 nt, Human
aggccagccugcucccuggcugaggcucaggcuauccgcccaagcucuuugcucauucuagggc

SEQ ID NO: 481659 - RNA, 64 nt, Human
ccugaggaccaucuuagcggcccuguccucuuuuuccgcccauucucccucgggucuccccaga

SEQ ID NO: 481660 - RNA, 64 nt, Human
guuggccaggauggucucaaucucgaccucgugauccgcccaccucggccucccaaaguguugg

SEQ ID NO: 481661 - RNA, 64 nt, Human
ucucaggaagcucccggaguccccgccucucuccuccgcccacagggguucgugggcacagggc

SEQ ID NO: 481662 - RNA, 58 nt, Human
cccugaacaucugggcuucuguucaaaauaaaccuacucuguucauggauuauagcaa

SEQ ID NO: 481663 - RNA, 58 nt, Human
uaaauuuuuuuauuuuaauauagcccaauaaaccuagaguauacauguacaaaauaca

SEQ ID NO: 481664 - RNA, 58 nt, Human
uaaaggaaaagcaguauuguccugguuuuaaaccuaugauggaauucuaaugucauua

SEQ ID NO: 481665 - RNA, 58 nt, Human
uuucaguuuuccaaaauucuaucaucuuuaaaccuaaauaauucaauuucauggaugc

SEQ ID NO: 481666 - RNA, 64 nt, Human
gggucucuggugugaacacccccgacagcagcccuccgcccacucugcccccugggagcccucg

SEQ ID NO: 481667 - RNA, 64 nt, Human
caaguaaccaggccccagccuccaggcccccaacuccgcccagccucuccccgcucuggauccu

SEQ ID NO: 481668 - RNA, 64 nt, Human
gucaggcuggucucaaacucccaccuucaggugauccgcccaccucggccuccugaggugcuga

SEQ ID NO: 481669 - RNA, 64 nt, Human
cccacgcuggccccaacugcugcagcucucggcuuccgcccaacagccucuggaggugaggcgg

SEQ ID NO: 481670 - RNA, 64 nt, Human
uggccaggauggucucgaucuccugaccucgugauccgcccaccucggccucccaaaucgcuag

SEQ ID NO: 481671 - RNA, 64 nt, Human
gaagcgcuuccgagcugugcccagucccgggaauuccgcccagucugcccacacuucccucggu

SEQ ID NO: 481672 - RNA, 64 nt, Human
gugggaccucaggagggucagaggagaagcagccuccgcccagccgcuaggccagggaccaucu

SEQ ID NO: 481673 - RNA, 62 nt, Human
acuuugacgacguccugugaggggcagaggccuccgcccagucaccaucaggccacucccuc

SEQ ID NO: 481674 - RNA, 64 nt, Human
cccguccucuguuaaagggagccagccccgcggcuccgcccaggcaugguagccugagcgcgcc

SEQ ID NO: 481675 - RNA, 64 nt, Human
cagugccaaacuugggccgcugcaccgcggcgccuccgcccaaaucaauaaacugugucugucc

SEQ ID NO: 481676 - RNA, 64 nt, Human
ggcauggcguucaagauuuuggagaugaacugauuccgcccaaauagaaucauguuuauuuuuu

SEQ ID NO: 481677 - RNA, 64 nt, Human
gccgggcuggucuugaacuccugaccucagguaauccgcccaucucggcuucccaaagugcuga

SEQ ID NO: 481678 - RNA, 64 nt, Human
gccaggcuggucucaaacuccugacucgaagugauccgcccaccuuggccucccaaagcguugg

SEQ ID NO: 481679 - RNA, 64 nt, Human
guuuuguuuuguuuugagacaaagacucacucuguccgcccaggcugggugcagucacggcuca

SEQ ID NO: 481680 - RNA, 64 nt, Human
cccaggcuggucgcgaacuccugagcucaggcaauccgcccaccucagccucccaaaguguugg

SEQ ID NO: 481681 - RNA, 58 nt, Human
gucuuugcugaguaaaaggggaaauuucuaaaccuagugcacuguuuggccagugucc

SEQ ID NO: 481682 - RNA, 58 nt, Human
gauuuuguuacuuggcaaacagcugguguaaaccuacagccagcagcagucuggagcc

SEQ ID NO: 481683 - RNA, 58 nt, Human
ggauuccacacuuccgcuccuuuggggauaaaccuauuaauuauugcuacuaucaaga

SEQ ID NO: 481684 - RNA, 58 nt, Human
ccuuagaugcaucccgagggucugaaauuaaaccuacagguucugaauacaacaucau

SEQ ID NO: 481685 - RNA, 64 nt, Human
cccucucaggggcacuggccucucugcagggccuuccgcccagcgcuggccuuaaugcuaaagc

SEQ ID NO: 481686 - RNA, 64 nt, Human
ccuccugcaggucagcagcugauccugauccaccuccgcccaggcccuccaagcucuacucacc

SEQ ID NO: 481687 - RNA, 64 nt, Human
uggucucgaucuucugacagaucugaccucgugauccgcccaucuccaccucccgcagugcugg

SEQ ID NO: 481688 - RNA, 64 nt, Human
cggaaggcuuggucccaucggaaguuuuggguuuuccgcccacagccgccggaaguggcuccgu

SEQ ID NO: 481689 - RNA, 64 nt, Human
gcgccuguaucaugacugaggugccucccaacgcuccgcccacgcugacaauaaaguugcucug

SEQ ID NO: 481690 - RNA, 64 nt, Human
gcaggcagcgcgagggaggagcugcgccgccggcuccgcccaaccagguggugcugagcuuccg

SEQ ID NO: 481691 - RNA, 64 nt, Human
uagccaggauggucucgaucuccugaccucgugauccgcccaccucggccucccaaagugcugg

SEQ ID NO: 481692 - RNA, 64 nt, Human
ggguaagagcacagguuagggcauggaaggcuucuccgcccauucugacccagggccuaggacg

SEQ ID NO: 481693 - RNA, 64 nt, Human
ggucccgcccaccagcggacucggcccccaaggcuccgcccacacugaccacgccccucggcgg

SEQ ID NO: 481694 - RNA, 64 nt, Human
agcacaagaugcccugugcagcugcccgagggucuccgcccaccccggccggacuuugaucccc

SEQ ID NO: 481695 - RNA, 64 nt, Human
gccaggcuagucucgaacuccugaccucagaugauccgcccacauuggccucccaaagugcugg

SEQ ID NO: 481696 - RNA, 64 nt, Human
uucucccccuccaguaguagcugggugagaccuguccgcccaccuucccuccacuacagaaccu

SEQ ID NO: 481697 - RNA, 64 nt, Human
cugcaggaacugcaugcugcagguguccugcccuuccgcccacgagugcgccauguuucagcgg

SEQ ID NO: 481698 - RNA, 64 nt, Human
uagccaggauggucuugaucuccugaccucaugauccgcccaccuuggccucccaaagugcugg

SEQ ID NO: 481699 - RNA, 64 nt, Human
accuugugguguagugggggcugggugggguggcuccgcccaggaggcggcugcacgguucucu

SEQ ID NO: 481700 - RNA, 58 nt, Human
ggcugccgugcccuuccuggcccagcccuaaaccuaaauucaaaucuccuccaugccu

SEQ ID NO: 481701 - RNA, 58 nt, Human
auguaggauauuuccuggcacaugcaaauaaaccuaaucauuguuucuuuaaaaauca

SEQ ID NO: 481702 - RNA, 64 nt, Human
caaccacgccggacgugcccccucgccaccuuuuccagacgacuucuuagaagagauuucauuu

SEQ ID NO: 481703 - RNA, 64 nt, Human
guauuuuauacauuuaaaaauauggaaaaacaacccagacgauucucgagagacuggggggagu

SEQ ID NO: 481704 - RNA, 64 nt, Human
uuuauacgucuaaagaaaauauucaguagcugaauccgcccagugauagccugugggcaccagc

SEQ ID NO: 481705 - RNA, 64 nt, Human
ucggaaaaacagaaagauccauaaagaugcagaguccgcccagucaugcacagacuccagugga

SEQ ID NO: 481706 - RNA, 64 nt, Human
uguccauccauuccuccauccacccaucuguccauccgcccaucugcccguccauccauccauc

SEQ ID NO: 481707 - RNA, 64 nt, Human
uggccaggauggccucgaucucuugaccucgugauccgcccaccucagccucccaaagugcuag

SEQ ID NO: 481708 - RNA, 64 nt, Human
gccaggcuagucucgaacucaugaccucaagugauccgcccacuucggucucccaaagugcugg

SEQ ID NO: 481709 - RNA, 64 nt, Human
gccaggcuggucucgaacuccuguccucagguaauccgcccaccucagccucccaaagugcugg

SEQ ID NO: 481710 - RNA, 64 nt, Human
cgccugcccugggagcaccggcucugcuuaccuguccgcccaccugucuggaacaagggccagg

SEQ ID NO: 481711 - RNA, 64 nt, Human
caggggccaaccucaggcuccuaaagagacauuuuccgcccacuccugggacacuccgucugcu

SEQ ID NO: 481712 - RNA, 64 nt, Human
ggaaauaacaggcgggcuucacggugcggcucuguccgcccaugccccgcugggucugcaggga

SEQ ID NO: 481713 - RNA, 64 nt, Human
cugccaggggcgccuggcaagugcugugcccacguccgcccaggacccagccguguugagugaa

SEQ ID NO: 481714 - RNA, 64 nt, Human
ugucugucuuugccuggugucuuccuuucccguguccgcccaccccagcgucuguugguacuua

SEQ ID NO: 481715 - RNA, 64 nt, Human
ucugucacguucuccacacgggggagagacgcaguccgcccagguccccgcuuucuuuggaggc

SEQ ID NO: 481716 - RNA, 64 nt, Human
cggugcccuguggcuucaccgcccuacuuccaccuccgcccagccuguaauguuuauauaagca

SEQ ID NO: 481717 - RNA, 64 nt, Human
gccaggcuggucucgaacuccugaccucaggugauccgcccaccucggccucccaaagugcugg

SEQ ID NO: 481718 - RNA, 64 nt, Human
cuguaaauaaacgcugggcuccccagagcaccuguccgcccacugcccuugcuguucugggauc

SEQ ID NO: 481719 - RNA, 64 nt, Human
aucagcauuuagucacaugucugaauuucuguguccagacgagccccaucaaacuaguugggaa

SEQ ID NO: 481720 - RNA, 64 nt, Human
uggcacuuuaaaaaggaagcugaccgcacaguguccagacgaauuggcccccagaagaugggga

SEQ ID NO: 481721 - RNA, 64 nt, Human
gcugacagaacugcuggauuugguucucauugguccagacgaggaagguauccagccucaaguc

SEQ ID NO: 481722 - RNA, 64 nt, Human
ggacucacaucuucacuccugggccuuugcacuuccagacgacaggucaucguucaagcagaau

SEQ ID NO: 481723 - RNA, 64 nt, Human
gccucgaccugccgcagggguccgggauugggaauccgcccaucugggggccucuucugcuuuc

SEQ ID NO: 481724 - RNA, 64 nt, Human
gugcugcacggcgagguggugucccccuuuguccuccgcccagggcagggaaagugcuuaguau

SEQ ID NO: 481725 - RNA, 64 nt, Human
uggccaggcuggucucaaacuccugaccuugugauccgcccaccucagccuccgaaagugcugg

SEQ ID NO: 481726 - RNA, 64 nt, Human
gccaggcucgucucgaacuccugaccucaggugauccgcccaccuuggccucccaaagugcugg

SEQ ID NO: 481727 - RNA, 64 nt, Human
gugaugggcaccucucacugaccucacagcgcaguccgcccaucugagcacagggucuguccuu

SEQ ID NO: 481728 - RNA, 64 nt, Human
ugcugagccuccuggccuggcccccaccggugcauccgcccagugcguccaccugcccuggcua

SEQ ID NO: 481729 - RNA, 64 nt, Human
uuucacuuauucuuagaaaacaagcaugaaagauuccgcccauucagauaaugccaaaaauaug

SEQ ID NO: 481730 - RNA, 64 nt, Human
caaagccaugccauugcgcugccccggccgccaguccgcccagaagccauagacgagacguagg

SEQ ID NO: 481731 - RNA, 64 nt, Human
gacgccgggacccccugcccgaucgcgcgcggccuccgcccaccgccuccugccgcaaggggcc

SEQ ID NO: 481732 - RNA, 64 nt, Human
uauuuaacuuuauuuucuguuuuaugaguguguguccgcccacccccacccccuucaguguuaa

SEQ ID NO: 481733 - RNA, 64 nt, Human
gugaauaucgagaacugccauugucgucuuuauguccgcccaccuagugcuuccacuucuaugc

SEQ ID NO: 481734 - RNA, 64 nt, Human
ccugacagucccagccgccacccaaggagccccauccgcccacccacccugggacccacgcggc

SEQ ID NO: 481735 - RNA, 64 nt, Human
caaggggcuggaaucucaugauuccaugcccgaguccgcccaucccugaccaugguuuuggcuc

SEQ ID NO: 481736 - RNA, 64 nt, Human
gaaugucaccgucucccucuucuaccgcaaugacuccgcccaccugccccugccucucagccuc

SEQ ID NO: 481737 - RNA, 64 nt, Human
ggacaggacagugaccuugggaggaaggggcuacuccgcccacgucagggagagaugugagcau

SEQ ID NO: 481738 - RNA, 59 nt, Human
ucgagccacaaccgaccagaugccagggacccacggagcccuuaugacaucagcaauac

SEQ ID NO: 481739 - RNA, 59 nt, Human
ugauugucuuagacacugugguugcaaaacccacggaaagccucauuuguguggaaagu

SEQ ID NO: 481740 - RNA, 59 nt, Human
cagcauuccagccccucuggucgcuccugcccacggagucguggggugugcugggagcu

SEQ ID NO: 481741 - RNA, 64 nt, Human
cgccagcuuuaggccccgcccuccucccaauggcuccgcccacagacucccuuauuucaauggc

SEQ ID NO: 481742 - RNA, 64 nt, Human
gcacggucugguucauuucuguaucuaccccccuuccgcccacgcccccgacccuuugcucaau

SEQ ID NO: 481743 - RNA, 64 nt, Human
ccccuuccaaagaccccugggggggguggggcauuccgcccaccccuuucccccaucacuucuc

SEQ ID NO: 481744 - RNA, 64 nt, Human
uggccaggccgcucucaaacuccugaccucgggauccgcccaccucggccucccaaagugcugg

SEQ ID NO: 481745 - RNA, 64 nt, Human
cuccucaggcucccucuauuaaagccgaucugacuccgcccagccagaugucccgagugcgcca

SEQ ID NO: 481746 - RNA, 64 nt, Human
caaaggcuggucuugaacucccgaccucaggugauccgcccaccuuggccucccgaagugcugg

SEQ ID NO: 481747 - RNA, 64 nt, Human
gccugccaguucacaaccgcuccgagcgugggucuccgcccagcuccaguccugugauccgggc

SEQ ID NO: 481748 - RNA, 64 nt, Human
aucuuggcccccagccccucgucgcggguucagguccgcccauuacuccuugucgugcggucaa

SEQ ID NO: 481749 - RNA, 50 nt, Human
ugcuacaauccagcuucuaauccgcccaaaagcggcagccaaucggagcg

SEQ ID NO: 481750 - RNA, 64 nt, Human
aucucgccccucgugaugucaggggcgcaguagcuccgcccacguggagcucgggcgguguaga

SEQ ID NO: 481751 - RNA, 64 nt, Human
uggccaggcuggucuugaacuccugaccucaugauccgcccaccucagccucccaaaguguugg

SEQ ID NO: 481752 - RNA, 64 nt, Human
uugugaggcuggcgauuacauaaguauaagcagguccgcccagggcuuggcuacuguagguguc

SEQ ID NO: 481753 - RNA, 64 nt, Human
cccagaaccaagcucucggugucucgggccaccauccgcccaccucgggcugaccccaccuccu

SEQ ID NO: 481754 - RNA, 64 nt, Human
ccuggcucuggacuguggccaaccuucuccacauuccgcccaaucuguaccggaugcuggcagg

SEQ ID NO: 481755 - RNA, 64 nt, Human
cccaggcuggucucgaacuccuggacucaagcaauccgcccaccuugacuucccaaagugcugg

SEQ ID NO: 481756 - RNA, 59 nt, Human
uacagggcaguguuucagauggcccugagcccacggaaaaggccagguagaccuccaaa

SEQ ID NO: 481757 - RNA, 59 nt, Human
cccuagcaguguuaacaaauugcugagaucccacggagucuuucaaaaaucucuguaga

SEQ ID NO: 481758 - RNA, 59 nt, Human
aaguccaaauccugaaggagacgcgggagcccacggagaacgcuccaggagggccuguc

SEQ ID NO: 481759 - RNA, 59 nt, Human
cggcugcugccccagcccgcgccagacagcccacggauccguucucagcggagccagau

SEQ ID NO: 481760 - RNA, 64 nt, Human
cugccaccugaagccgagcuccuccagagcuuucuccgcccaccucacugcaucccaaguggag

SEQ ID NO: 481761 - RNA, 64 nt, Human
ccgcuacuccggggacagugacuccucagccuccuccgcccagagcggcccccuugguacccgc

SEQ ID NO: 481762 - RNA, 64 nt, Human
ccccacucuccgggcaccgucuccugccugugcguccgcccaccgcugcccugucuguugcgac

SEQ ID NO: 481763 - RNA, 64 nt, Human
gcucuugcugccauggucucaagccugaagaggcuccgcccacaagcuggcccaugaaguuagc

SEQ ID NO: 481764 - RNA, 64 nt, Human
gguggccugcccuucuccccagagggaggcggccuccgcccauuggugcucaugcagacucugg

SEQ ID NO: 481765 - RNA, 64 nt, Human
uagccaggauggucuccaucuccugaccucaugauccgcccaccuuggccucccaaaaugcugg

SEQ ID NO: 481766 - RNA, 64 nt, Human
uacuucaagggccaagcugccccuuucccuccucuccgcccaugaaaaugccuccaaacugaga

SEQ ID NO: 481767 - RNA, 64 nt, Human
gucaggcuggucucaaacuccugaccucaggugauccgcccaccucggccuugcaaaaugcugg

SEQ ID NO: 481768 - RNA, 64 nt, Human; identical to SEQ ID NO: 329520

SEQ ID NO: 481769 - RNA, 64 nt, Human; identical to SEQ ID NO: 329521

SEQ ID NO: 481770 - RNA, 64 nt, Human; identical to SEQ ID NO: 329522

SEQ ID NO: 481771 - RNA, 64 nt, Human; identical to SEQ ID NO: 329120

SEQ ID NO: 481772 - RNA, 64 nt, Human; identical to SEQ ID NO: 329121

SEQ ID NO: 481773 - RNA, 59 nt, Human
aaaaacugucacgguacgaaaucuuagugcccacggaggccucgagcagagagaaugaa

SEQ ID NO: 481774 - RNA, 59 nt, Human
ccccucccugcaaccagccugaguucagccccacggacaaagggacacacagcccccaa

SEQ ID NO: 481775 - RNA, 59 nt, Human
guggugcccggcauguaagccccgcccaccccacggaggccacagccacacagccacgc

SEQ ID NO: 481776 - RNA, 59 nt, Human
gagaggggccgaugcccagagacacagcccccacggacaaaaccccccagauaucaucu

SEQ ID NO: 481777 - RNA, 64 nt, Human; identical to SEQ ID NO: 327944

SEQ ID NO: 481778 - RNA, 64 nt, Human; identical to SEQ ID NO: 329122

SEQ ID NO: 481779 - RNA, 64 nt, Human; identical to SEQ ID NO: 329491

SEQ ID NO: 481780 - RNA, 64 nt, Human; identical to SEQ ID NO: 329492

SEQ ID NO: 481781 - RNA, 64 nt, Human; identical to SEQ ID NO: 328043

SEQ ID NO: 481782 - RNA, 64 nt, Human; identical to SEQ ID NO: 329157

SEQ ID NO: 481783 - RNA, 64 nt, Human; identical to SEQ ID NO: 329158

SEQ ID NO: 481784 - RNA, 64 nt, Human; identical to SEQ ID NO: 329159

SEQ ID NO: 481785 - RNA, 64 nt, Human; identical to SEQ ID NO: 329160

SEQ ID NO: 481786 - RNA, 64 nt, Human; identical to SEQ ID NO: 329101

SEQ ID NO: 481787 - RNA, 56 nt, Human; identical to SEQ ID NO: 329102

SEQ ID NO: 481788 - RNA, 64 nt, Human; identical to SEQ ID NO: 328294

SEQ ID NO: 481789 - RNA, 64 nt, Human; identical to SEQ ID NO: 329233

SEQ ID NO: 481790 - RNA, 64 nt, Human; identical to SEQ ID NO: 329234

SEQ ID NO: 481791 - RNA, 64 nt, Human; identical to SEQ ID NO: 329235

SEQ ID NO: 481792 - RNA, 59 nt, Human
gcaggcagcccauccaccccaguggaguucccacggacgcuucugcucaugguccaagg

SEQ ID NO: 481793 - RNA, 59 nt, Human
ccggcugucccagccagccccgcagagcgcccacggacaguguccacucuggcaaggug

SEQ ID NO: 481794 - RNA, 59 nt, Human
cagaaaagcuccagcaggcgcugccuucacccacggaucugcccaggcugaaggcacac

SEQ ID NO: 481795 - RNA, 59 nt, Human
ggacagggcugugccggccugggccagggcccacggacccgcagcucagggcgccugcc

SEQ ID NO: 481796 - RNA, 64 nt, Human; identical to SEQ ID NO: 328895

SEQ ID NO: 481797 - RNA, 64 nt, Human; identical to SEQ ID NO: 328896

SEQ ID NO: 481798 - RNA, 64 nt, Human; identical to SEQ ID NO: 328799

SEQ ID NO: 481799 - RNA, 64 nt, Human; identical to SEQ ID NO: 329423

SEQ ID NO: 481800 - RNA, 64 nt, Human; identical to SEQ ID NO: 329472

SEQ ID NO: 481801 - RNA, 64 nt, Human; identical to SEQ ID NO: 329473

SEQ ID NO: 481802 - RNA, 64 nt, Human; identical to SEQ ID NO: 328816

SEQ ID NO: 481803 - RNA, 64 nt, Human; identical to SEQ ID NO: 329493

SEQ ID NO: 481804 - RNA, 64 nt, Human; identical to SEQ ID NO: 329199

SEQ ID NO: 481805 - RNA, 64 nt, Human; identical to SEQ ID NO: 329200

SEQ ID NO: 481806 - RNA, 64 nt, Human; identical to SEQ ID NO: 328817

SEQ ID NO: 481807 - RNA, 64 nt, Human; identical to SEQ ID NO: 328818

SEQ ID NO: 481808 - RNA, 64 nt, Human; identical to SEQ ID NO: 328819

SEQ ID NO: 481809 - RNA, 64 nt, Human; identical to SEQ ID NO: 328836

SEQ ID NO: 481810 - RNA, 64 nt, Human; identical to SEQ ID NO: 328837

SEQ ID NO: 481811 - RNA, 59 nt, Human
gauugucugaaugacacauauacagagcccccacggauuucugcacacucugggucugu

SEQ ID NO: 481812 - RNA, 59 nt, Human
gagagagcucagcacacacacagcucagacccacggacaggaccccgggacagaacccc

SEQ ID NO: 481813 - RNA, 62 nt, Human
aagcaugagacuguuugacuaguccuaccuggguuccggaaauacaugcaucaucuguacuu

SEQ ID NO: 481814 - RNA, 64 nt, Human; identical to SEQ ID NO: 328838

SEQ ID NO: 481815 - RNA, 64 nt, Human; identical to SEQ ID NO: 328915

SEQ ID NO: 481816 - RNA, 64 nt, Human; identical to SEQ ID NO: 328916

SEQ ID NO: 481817 - RNA, 64 nt, Human; identical to SEQ ID NO: 328917

SEQ ID NO: 481818 - RNA, 64 nt, Human; identical to SEQ ID NO: 328934

SEQ ID NO: 481819 - RNA, 64 nt, Human; identical to SEQ ID NO: 328935

SEQ ID NO: 481820 - RNA, 64 nt, Human; identical to SEQ ID NO: 328936

SEQ ID NO: 481821 - RNA, 64 nt, Human; identical to SEQ ID NO: 328970

SEQ ID NO: 481822 - RNA, 64 nt, Human; identical to SEQ ID NO: 328971

SEQ ID NO: 481823 - RNA, 64 nt, Human; identical to SEQ ID NO: 328972

SEQ ID NO: 481824 - RNA, 64 nt, Human; identical to SEQ ID NO: 328989

SEQ ID NO: 481825 - RNA, 64 nt, Human; identical to SEQ ID NO: 328990

SEQ ID NO: 481826 - RNA, 64 nt, Human; identical to SEQ ID NO: 328991

SEQ ID NO: 481827 - RNA, 64 nt, Human; identical to SEQ ID NO: 329048

SEQ ID NO: 481828 - RNA, 64 nt, Human; identical to SEQ ID NO: 329049

SEQ ID NO: 481829 - RNA, 62 nt, Human
cugcugagcagcccuccugccaaggaggcucgguuccggaccgccaagaagcucuauggcag

SEQ ID NO: 481830 - RNA, 62 nt, Human
ggccacccgugggcauccacaguuugcaggguguuccggaagguucuugucacugugauugg

SEQ ID NO: 481831 - RNA, 62 nt, Human
ugggggccggcuggugggugggauagaccugcguuccggacacugagcgccugauuuagggc

SEQ ID NO: 481832 - RNA, 62 nt, Human
cagugaaggaagaaccuguagaagaugaccucguuccggagcuggguaucucaaaucugcuu

SEQ ID NO: 481833 - RNA, 64 nt, Human; identical to SEQ ID NO: 329050

SEQ ID NO: 481834 - RNA, 64 nt, Human; identical to SEQ ID NO: 329103

SEQ ID NO: 481835 - RNA, 64 nt, Human; identical to SEQ ID NO: 329523

SEQ ID NO: 481836 - RNA, 64 nt, Human; identical to SEQ ID NO: 329524

SEQ ID NO: 481837 - RNA, 64 nt, Human; identical to SEQ ID NO: 329525

SEQ ID NO: 481838 - RNA, 64 nt, Human; identical to SEQ ID NO: 329526

SEQ ID NO: 481839 - RNA, 64 nt, Human; identical to SEQ ID NO: 329527

SEQ ID NO: 481840 - RNA, 64 nt, Human; identical to SEQ ID NO: 329528

SEQ ID NO: 481841 - RNA, 64 nt, Human; identical to SEQ ID NO: 329529

SEQ ID NO: 481842 - RNA, 64 nt, Human; identical to SEQ ID NO: 329530

SEQ ID NO: 481843 - RNA, 64 nt, Human; identical to SEQ ID NO: 329531

SEQ ID NO: 481844 - RNA, 64 nt, Human; identical to SEQ ID NO: 329532

SEQ ID NO: 481845 - RNA, 64 nt, Human; identical to SEQ ID NO: 329533

SEQ ID NO: 481846 - RNA, 64 nt, Human; identical to SEQ ID NO: 329534

SEQ ID NO: 481847 - RNA, 64 nt, Human; identical to SEQ ID NO: 329535

SEQ ID NO: 481848 - RNA, 64 nt, Human; identical to SEQ ID NO: 389828

SEQ ID NO: 481849 - RNA, 64 nt, Human; identical to SEQ ID NO: 389835

SEQ ID NO: 481850 - RNA, 64 nt, Human; identical to SEQ ID NO: 389842

SEQ ID NO: 481851 - RNA, 64 nt, Human; identical to SEQ ID NO: 329536

SEQ ID NO: 481852 - RNA, 64 nt, Human; identical to SEQ ID NO: 329537

SEQ ID NO: 481853 - RNA, 64 nt, Human; identical to SEQ ID NO: 329538

SEQ ID NO: 481854 - RNA, 64 nt, Human; identical to SEQ ID NO: 428635

SEQ ID NO: 481855 - RNA, 64 nt, Human; identical to SEQ ID NO: 428636

SEQ ID NO: 481856 - RNA, 64 nt, Human; identical to SEQ ID NO: 389851

SEQ ID NO: 481857 - RNA, 64 nt, Human; identical to SEQ ID NO: 389858

SEQ ID NO: 481858 - RNA, 64 nt, Human; identical to SEQ ID NO: 389868

SEQ ID NO: 481859 - RNA, 64 nt, Human; identical to SEQ ID NO: 428637

SEQ ID NO: 481860 - RNA, 64 nt, Human; identical to SEQ ID NO: 428653

SEQ ID NO: 481861 - RNA, 64 nt, Human; identical to SEQ ID NO: 428654

SEQ ID NO: 481862 - RNA, 64 nt, Human; identical to SEQ ID NO: 428655

SEQ ID NO: 481863 - RNA, 64 nt, Human; identical to SEQ ID NO: 428671

SEQ ID NO: 481864 - RNA, 64 nt, Human; identical to SEQ ID NO: 428672

SEQ ID NO: 481865 - RNA, 64 nt, Human; identical to SEQ ID NO: 428673

SEQ ID NO: 481866 - RNA, 64 nt, Human; identical to SEQ ID NO: 428689

SEQ ID NO: 481867 - RNA, 64 nt, Human; identical to SEQ ID NO: 428690

SEQ ID NO: 481868 - RNA, 64 nt, Human; identical to SEQ ID NO: 428691

SEQ ID NO: 481869 - RNA, 64 nt, Human; identical to SEQ ID NO: 428707

SEQ ID NO: 481870 - RNA, 64 nt, Human; identical to SEQ ID NO: 428708

SEQ ID NO: 481871 - RNA, 64 nt, Human; identical to SEQ ID NO: 428709

SEQ ID NO: 481872 - RNA, 64 nt, Human; identical to SEQ ID NO: 428720

SEQ ID NO: 481873 - RNA, 64 nt, Human; identical to SEQ ID NO: 428721

SEQ ID NO: 481874 - RNA, 64 nt, Human; identical to SEQ ID NO: 428722

SEQ ID NO: 481875 - RNA, 64 nt, Human; identical to SEQ ID NO: 389875

SEQ ID NO: 481876 - RNA, 64 nt, Human; identical to SEQ ID NO: 389885

SEQ ID NO: 481877 - RNA, 64 nt, Human; identical to SEQ ID NO: 389891

SEQ ID NO: 481878 - RNA, 64 nt, Human; identical to SEQ ID NO: 428738

SEQ ID NO: 481879 - RNA, 64 nt, Human; identical to SEQ ID NO: 428739

SEQ ID NO: 481880 - RNA, 64 nt, Human; identical to SEQ ID NO: 428740

SEQ ID NO: 481881 - RNA, 64 nt, Human; identical to SEQ ID NO: 428756

SEQ ID NO: 481882 - RNA, 64 nt, Human; identical to SEQ ID NO: 428757

SEQ ID NO: 481883 - RNA, 64 nt, Human; identical to SEQ ID NO: 428758

SEQ ID NO: 481884 - RNA, 64 nt, Human; identical to SEQ ID NO: 428759

SEQ ID NO: 481885 - RNA, 64 nt, Human; identical to SEQ ID NO: 428760

SEQ ID NO: 481886 - RNA, 64 nt, Human; identical to SEQ ID NO: 428761

SEQ ID NO: 481887 - RNA, 64 nt, Human; identical to SEQ ID NO: 428762

SEQ ID NO: 481888 - RNA, 64 nt, Human; identical to SEQ ID NO: 428763

SEQ ID NO: 481889 - RNA, 64 nt, Human; identical to SEQ ID NO: 428764

SEQ ID NO: 481890 - RNA, 64 nt, Human; identical to SEQ ID NO: 428765

SEQ ID NO: 481891 - RNA, 64 nt, Human; identical to SEQ ID NO: 428766

SEQ ID NO: 481892 - RNA, 64 nt, Human; identical to SEQ ID NO: 428767

SEQ ID NO: 481893 - RNA, 64 nt, Human; identical to SEQ ID NO: 428768

SEQ ID NO: 481894 - RNA, 64 nt, Human; identical to SEQ ID NO: 389901

SEQ ID NO: 481895 - RNA, 64 nt, Human; identical to SEQ ID NO: 389908

SEQ ID NO: 481896 - RNA, 64 nt, Human; identical to SEQ ID NO: 389914

SEQ ID NO: 481897 - RNA, 64 nt, Human; identical to SEQ ID NO: 428769

SEQ ID NO: 481898 - RNA, 64 nt, Human; identical to SEQ ID NO: 428770

SEQ ID NO: 481899 - RNA, 64 nt, Human; identical to SEQ ID NO: 428771

SEQ ID NO: 481900 - RNA, 64 nt, Human; identical to SEQ ID NO: 428772

SEQ ID NO: 481901 - RNA, 52 nt, Human; identical to SEQ ID NO: 428773

SEQ ID NO: 481902 - RNA, 64 nt, Human; identical to SEQ ID NO: 428774

SEQ ID NO: 481903 - RNA, 64 nt, Human; identical to SEQ ID NO: 428775

SEQ ID NO: 481904 - RNA, 64 nt, Human; identical to SEQ ID NO: 428776

SEQ ID NO: 481905 - RNA, 64 nt, Human; identical to SEQ ID NO: 428777

SEQ ID NO: 481906 - RNA, 64 nt, Human; identical to SEQ ID NO: 428778

SEQ ID NO: 481907 - RNA, 64 nt, Human; identical to SEQ ID NO: 428779

SEQ ID NO: 481908 - RNA, 64 nt, Human; identical to SEQ ID NO: 428780

SEQ ID NO: 481909 - RNA, 59 nt, Human; identical to SEQ ID NO: 428781

SEQ ID NO: 481910 - RNA, 64 nt, Human; identical to SEQ ID NO: 428782

SEQ ID NO: 481911 - RNA, 64 nt, Human; identical to SEQ ID NO: 428783

SEQ ID NO: 481912 - RNA, 64 nt, Human; identical to SEQ ID NO: 428784

SEQ ID NO: 481913 - RNA, 64 nt, Human; identical to SEQ ID NO: 389921

SEQ ID NO: 481914 - RNA, 64 nt, Human; identical to SEQ ID NO: 389928

SEQ ID NO: 481915 - RNA, 64 nt, Human; identical to SEQ ID NO: 389935

SEQ ID NO: 481916 - RNA, 64 nt, Human; identical to SEQ ID NO: 428785

SEQ ID NO: 481917 - RNA, 63 nt, Human
ccuuccuccgggugaccccacagggccuuuccaagcccccauuugagcugcuccuuccugugu

SEQ ID NO: 481918 - RNA, 63 nt, Human
cucgcaccugcccuccgcugcuccucagaccccagcccccagcgagccgacguccccacccgu

SEQ ID NO: 481919 - RNA, 63 nt, Human
gaagccaugggccagcaauaccugcuuuucugaagcccccaaggagggcucugacauucuuuu

SEQ ID NO: 481920 - RNA, 59 nt, Human; identical to SEQ ID NO: 207819

SEQ ID NO: 481921 - RNA, 63 nt, Human
ggcccggcccccucuggcuuggagagcauuccaagcccccaccccaccccuagaacugccauu

SEQ ID NO: 481922 - RNA, 63 nt, Human
cagcucagggauugccugaaccaagaggccaggagcccccaugggccgcccaguaccaugcac

SEQ ID NO: 481923 - RNA, 63 nt, Human
ggccucguucugcgaggggcucaugggucugagagcccccacccacuaggcuugauugcaucc

SEQ ID NO: 481924 - RNA, 63 nt, Human
accucauucuucccuggccucuuucccacccacagcccccagaggcucuagaucaacaauguu

SEQ ID NO: 481925 - RNA, 63 nt, Human
gauauuccaaaagggacuuuacauuaaaggagaagcccccaagauguggccacccuuaaccau

SEQ ID NO: 481926 - RNA, 63 nt, Human
auuaaggucuugaagucaggcugcccccuccccagcccccaguucucuccccacccccucacc

SEQ ID NO: 481927 - RNA, 63 nt, Human
gauugagaagccaaucagugaacccuuuggcaaagcccccauccacaccuggcacuccccucu

SEQ ID NO: 481928 - RNA, 63 nt, Human
ggaccaauuuaguguccuuccaccugugagccaagcccccauuugaggacaucuaucguauuc

SEQ ID NO: 481929 - RNA, 63 nt, Human
gacucugccacucuacccccagcccuacccaccagcccccaggugaggcuuccagcugggacc

SEQ ID NO: 481930 - RNA, 64 nt, Human; identical to SEQ ID NO: 389942

SEQ ID NO: 481931 - RNA, 64 nt, Human; identical to SEQ ID NO: 389952

SEQ ID NO: 481932 - RNA, 64 nt, Human; identical to SEQ ID NO: 389985

SEQ ID NO: 481933 - RNA, 63 nt, Human
ccugcccccuccccacaccaaucagccaggcugagcccccaccccugccccagcuccaggacc

SEQ ID NO: 481934 - RNA, 63 nt, Human
cgccugggagccgcgggcaggcgagacuggcggagcccccagaccucccaguggggacggggc

SEQ ID NO: 481935 - RNA, 63 nt, Human
gggaggcaggucccaggagcagacccugcccccagcccccacagacacaccccaaucugaaag

SEQ ID NO: 481936 - RNA, 63 nt, Human
gagagggaaggagggaggaggcaucuucccugaagcccccaaucuggccccccccuccccaga

SEQ ID NO: 481937 - RNA, 63 nt, Human
gguuguccccgccaggccggggaagguuggagcagcccccagggaggggggcacuagguguca

SEQ ID NO: 481938 - RNA, 63 nt, Human
ugggggaguaguggggcacggcuccuaagauccagcccccauacugacagacggacagacaga

SEQ ID NO: 481939 - RNA, 63 nt, Human
cccucuuaccacacuuuaccaguuaaccacugaagcccccaauucccacagcuuuuccauuaa

SEQ ID NO: 481940 - RNA, 63 nt, Human
acaugggagaccccaacccagcugacaauguggagcccccagaacuucagaacuguguggagg

SEQ ID NO: 481941 - RNA, 63 nt, Human
cucuccccaccagcaccauggcuggcaucgcucagcccccagcccaauugccaucaagacucc

SEQ ID NO: 481942 - RNA, 63 nt, Human
ggcacuccaaaccugucuuggggccacuuucagagcccccagcccugggaaccacucccacca

SEQ ID NO: 481943 - RNA, 63 nt, Human
auaaguggacugugccaguacaauacaugccucagcccccaagccuagaaggaccucuagucu

SEQ ID NO: 481944 - RNA, 63 nt, Human
uguacaaagcucaccaagccccugcccauguacagcccccagacccucugcaauaucacuuuu

SEQ ID NO: 481945 - RNA, 63 nt, Human
cacuuuaccucucugaaagccccagaggaccagagcccccagccuuaccucucaaccuguccc

SEQ ID NO: 481946 - RNA, 63 nt, Human
ucugauacuaauggagcuucaugacccacggucagcccccaaaccaaaguugucccaacagag

SEQ ID NO: 481947 - RNA, 63 nt, Human
gggcauccaaagcggccacgcccacaauccgacagcccccaggagcagguccagggaugaugc

SEQ ID NO: 481948 - RNA, 63 nt, Human
uaaacagggcuauuagggguaucagccacgucgagcccccagacucugugcacuucagaccag

SEQ ID NO: 481949 - RNA, 64 nt, Human; identical to SEQ ID NO: 389992

SEQ ID NO: 481950 - RNA, 64 nt, Human; identical to SEQ ID NO: 389999

SEQ ID NO: 481951 - RNA, 64 nt, Human; identical to SEQ ID NO: 390009

SEQ ID NO: 481952 - RNA, 63 nt, Human
agggaccaggugucuagaggcaacaguguucugagcccccaccugccugaccaucccaugagc

SEQ ID NO: 481953 - RNA, 63 nt, Human
cugugucugcccccgucuucucuccauccucaaagcccccacuucucuccaggcuguuucuuu

SEQ ID NO: 481954 - RNA, 63 nt, Human
cacuggcacugcgaucaggaagacuggacccccagcccccagggccccccuccccccacuuag

SEQ ID NO: 481955 - RNA, 63 nt, Human
ggcccuaccuggggaaagccugaagggccucccagcccccaaccccaagaccaagcuuagucc

SEQ ID NO: 481956 - RNA, 63 nt, Human
gcuguggagugcaggccagagcagggugugcguagcccccagcacccagguucuucugucaga

SEQ ID NO: 481957 - RNA, 63 nt, Human
gucuuccacaggauuugagaauaguuucaucucagcccccauuagagagaaguuggggugaau

SEQ ID NO: 481958 - RNA, 63 nt, Human
cacaccccucucccaggggcuugguggcagcauagcccccaccccugcggccuuugcucacgg

SEQ ID NO: 481959 - RNA, 63 nt, Human
ugcccucgggggccucucccaggguccagccugagcccccaccaggggucucugcccagcaca

SEQ ID NO: 481960 - RNA, 63 nt, Human
ugcagaaccagcugcaacagcugcgugcacaggagcccccaggcagucagcagccccugcaga

SEQ ID NO: 481961 - RNA, 63 nt, Human
cacagcugcagcugggccccaugcucugccccaagcccccaaccccgcggugcucuggcggcu

SEQ ID NO: 481962 - RNA, 63 nt, Human
uccagcugggggaugggggggagucauaggaaaagcccccaucucccaucugggauagggacc

SEQ ID NO: 481963 - RNA, 63 nt, Human
acaacagcuccaggacaucucagcccagguucuagcccccacgcaccccagaccccaggugga

SEQ ID NO: 481964 - RNA, 63 nt, Human
ccccuaccuuggaccaucccgcguagggguggcagcccccagcuccccucagugcugcuguca

SEQ ID NO: 481965 - RNA, 63 nt, Human
aggccaaggcagacauuggcccucccuucucccagcccccagaggccuggccuuggguucguc

SEQ ID NO: 481966 - RNA, 63 nt, Human
aacugcccccacugucccccuacccaccgauggagcccccagauagagcuggguggccuguuu

SEQ ID NO: 481967 - RNA, 63 nt, Human
cugugguucccacaggaacaggguugucuuuugagcccccagugucugguuucauucaucuca

SEQ ID NO: 481968 - RNA, 64 nt, Human; identical to SEQ ID NO: 390016

SEQ ID NO: 481969 - RNA, 64 nt, Human; identical to SEQ ID NO: 390026

SEQ ID NO: 481970 - RNA, 64 nt, Human; identical to SEQ ID NO: 390033

SEQ ID NO: 481971 - RNA, 63 nt, Human
ccccucccccuaccgcauggcagcugggcccacagcccccaccccagcacagcuccuccccug

SEQ ID NO: 481972 - RNA, 63 nt, Human
aguccuugccaauccccagagcuguucuuccaaagcccccaggcuggcuuagaaccccauaga

SEQ ID NO: 481973 - RNA, 63 nt, Human
agguggcgaguguggacacccugccaggacugcagcccccauggugaugcuguggcaucagac

SEQ ID NO: 481974 - RNA, 63 nt, Human
agacaggagccaggguugagcaauggagagcccagcccccacgucuuacagucgccauccucc

SEQ ID NO: 481975 - RNA, 63 nt, Human
gcaggcauuaggacuguccugagcaaggucugcagcccccagcucugcucaccccgaauccug

SEQ ID NO: 481976 - RNA, 60 nt, Human; identical to SEQ ID NO: 207877

SEQ ID NO: 481977 - RNA, 53 nt, Human; identical to SEQ ID NO: 207824

SEQ ID NO: 481978 - RNA, 63 nt, Human
guucuggaggcugcgagagcagcuggcacugucagcccccagcagggaacacguuacaggguc

SEQ ID NO: 481979 - RNA, 63 nt, Human
gaagccauucccaguuugagucuucauccuguaagcccccaggggcagucccugcuuuacuga

SEQ ID NO: 481980 - RNA, 63 nt, Human
gccuggugagccuuccccuggugucugccuggcagcccccaccucccaccuaucaccccucac

SEQ ID NO: 481981 - RNA, 63 nt, Human
ccacucagguucuucagggccaguccuccugggagcccccaccacaaacuucugcuggggauu

SEQ ID NO: 481982 - RNA, 63 nt, Human
uagaaaaagaucaguaagccccaguguccccccagcccccaugcuuaugugaacaugcgcugu

SEQ ID NO: 481983 - RNA, 63 nt, Human
uccagccacaggcaccagcugguugggaccagcagcccccagcauccucuugcacuggcuggc

SEQ ID NO: 481984 - RNA, 63 nt, Human
uuucaguggaacccuugcccccaaaugucgaccagcccccaaaugucgaagaauuuucuucuu

SEQ ID NO: 481985 - RNA, 63 nt, Human
cgucuuuguucagaagggaucagguuggggggcagcccccagucccuuucugucccagcucag

SEQ ID NO: 481986 - RNA, 63 nt, Human
cucacagccuguagccaccaauguuucaagaggagcccccacccuguuccugcugcugucugg

SEQ ID NO: 481987 - RNA, 64 nt, Human; identical to SEQ ID NO: 390043

SEQ ID NO: 481988 - RNA, 64 nt, Human; identical to SEQ ID NO: 390050

SEQ ID NO: 481989 - RNA, 64 nt, Human; identical to SEQ ID NO: 390060

SEQ ID NO: 481990 - RNA, 64 nt, Human; identical to SEQ ID NO: 390067

SEQ ID NO: 481991 - RNA, 63 nt, Human
cacugggcuuaugccuuacucucagggacaagcagcccccauugcugccuguagaugugagcu

SEQ ID NO: 481992 - RNA, 63 nt, Human
ugcuuucuucccauuccccugcugucuauucuaagcccccagacucaagccucuagacucuug

SEQ ID NO: 481993 - RNA, 63 nt, Human
gguaggucaugaacagucacccgugcuggcuguagcccccacagaggcaaucaugcccaauag

SEQ ID NO: 481994 - RNA, 63 nt, Human
caaagugcgguuucccaagccuuuguccaucucagcccccagaguauaucugugcuuggggaa

SEQ ID NO: 481995 - RNA, 63 nt, Human
cccagccucccgcucugggcgagccuccuccccagcccccaccccugggaugcgaagccagca

SEQ ID NO: 481996 - RNA, 63 nt, Human
uuuugucugccauucuugaaagugcaucuugagagcccccauuuguuguguagagauauagca

SEQ ID NO: 481997 - RNA, 63 nt, Human
agcgggagagcagcugguccagaccagcccugcagcccccacucagccggcagccagauggcc

SEQ ID NO: 481998 - RNA, 63 nt, Human
uuggcuaggugucucucacggcugcuccauccuagcccccacaagcuggggcuuccuccugua

SEQ ID NO: 481999 - RNA, 63 nt, Human
ggaagguuuuacaagaagacugauagucuuucaagcccccacaucacaggcuuagggacggca

SEQ ID NO: 482000 - RNA, 63 nt, Human
cagagaggaggcgcaggcaggccccugcccggcagcccccaucuucaagggcugcuucuacac

SEQ ID NO: 482001 - RNA, 63 nt, Human
cuuccccugugaagaaacagguguucucggcugagcccccaacccucugcagaaccagguuga

SEQ ID NO: 482002 - RNA, 63 nt, Human
uagaccagugcagccagagagaccaccaaacagagcccccaaaagacagacaucucugcuagc

SEQ ID NO: 482003 - RNA, 63 nt, Human
cacggacgccuauccagaagccagccggcuggcagcccccaucugcucaauaucacugcucug

SEQ ID NO: 482004 - RNA, 63 nt, Human
uccacugguucuucuuggucucagugucaaugcagcccccauuguggucacaggaaguagagg

SEQ ID NO: 482005 - RNA, 63 nt, Human
gacccgucccagccuccccuccccaccccaugcagcccccagggggauagcccaugggccccu

SEQ ID NO: 482006 - RNA, 63 nt, Human
caggcugguuauaagccggaggcagcuuuaaccagcccccagggaugauugugaaggaggccc

SEQ ID NO: 482007 - RNA, 64 nt, Human
auuggaccucugggagcuaauacuccucuuugcucaccaccaugugaucauugaucagaugugg

SEQ ID NO: 482008 - RNA, 64 nt, Human
cucagccucccgaguagcugggguuacaggcaugcaccaccaugccuggcuaauuuucuguauu

SEQ ID NO: 482009 - RNA, 64 nt, Human
auaccguacccuccugugagacagugugugcaggcaccaccaccuuaauccugcuguugccuga

SEQ ID NO: 482010 - RNA, 63 nt, Human
cugggccuccucaccaacggcagugccaaaaucagcccccacaucaaggugguguucucugug

SEQ ID NO: 482011 - RNA, 63 nt, Human
cuggaaccugacuuuagauguuuugggaucaggagcccccaacacaggcaaguccaccccaua

SEQ ID NO: 482012 - RNA, 63 nt, Human
ccucgagugccaucccugccaaacaacucucccagcccccacuaccucucuguguacugccgc

SEQ ID NO: 482013 - RNA, 63 nt, Human
ucgcuguuuccaauggcucaggagacaaugaaaagcccccauuuaaaaaaauaacaaacauuu

SEQ ID NO: 482014 - RNA, 63 nt, Human
ugagugaagaggaaggggucucuggucaaacccagcccccagggccuaggguugaaagccuuc

SEQ ID NO: 482015 - RNA, 63 nt, Human
ugccgcucugcccgaugcacagccaccucagccagcccccagguagaaacguggguuaagcuc

SEQ ID NO: 482016 - RNA, 56 nt, Human; identical to SEQ ID NO: 207825

SEQ ID NO: 482017 - RNA, 63 nt, Human
gcucuccuaggccacagggccuuuggcaggugcagcccccacugccuuugaccugccucccuu

SEQ ID NO: 482018 - RNA, 63 nt, Human
aaaaauauucuucugaacucaucaaaguagaagagcccccaaccuuuucucucugccuucaag

SEQ ID NO: 482019 - RNA, 63 nt, Human
cuggcagggcugcuaccuccucagaguuucagaagcccccacaugggggcucuaggaaugccg

SEQ ID NO: 482020 - RNA, 63 nt, Human
augcugaaaaagacaaaauugaagaagaaauguagcccccagccgguacccaccaaaggagag

SEQ ID NO: 482021 - RNA, 63 nt, Human
ccaccccaucugaggcagagaagacucgaguccagcccccaggaagccugcuccccucucugg

SEQ ID NO: 482022 - RNA, 63 nt, Human
uucuggcugcccccaaugccccgaggccuggggagcccccagcucacccaucuguagcucccu

SEQ ID NO: 482023 - RNA, 63 nt, Human
gcuucuuuccuuccugcaguucccagcccucggagcccccaucccuuaucuuacccccaccgc

SEQ ID NO: 482024 - RNA, 56 nt, Human; identical to SEQ ID NO: 207826

SEQ ID NO: 482025 - RNA, 63 nt, Human
cuccucccaugagguggggagaggcaacagggcagcccccagaggaguguccuggccgcuguc

SEQ ID NO: 482026 - RNA, 64 nt, Human
ccaccagcgguaucugaccucagaggcagaggaacaccaccagcucuucgaucugauugaaagc

SEQ ID NO: 482027 - RNA, 64 nt, Human
cucagccucccgaguagcugggauuacaggcacacaccaccacgcccggcuaauuuuuuguguc

SEQ ID NO: 482028 - RNA, 64 nt, Human
cucagccucccgaguagcugggauuaugggcgcccaccaccaugcccagcuaauuuuuguauuu

SEQ ID NO: 482029 - RNA, 64 nt, Human
uucagccucccuaguagcugggacuacagguaugcaccaccaugccuggcuaauuuuuuguauu

SEQ ID NO: 482030 - RNA, 63 nt, Human
uguuauuacugguggaugcaccguguccacagcagcccccaaucccagcgaugcgucagaucu

SEQ ID NO: 482031 - RNA, 63 nt, Human
cucugugcaaagcaucagaaagaccugcuucccagcccccagcauuccagugcucuccaggcu

SEQ ID NO: 482032 - RNA, 63 nt, Human
acccguuucucccucaaguuugaguauuucgggagcccccaaaacagccugagcaaaaagacc

SEQ ID NO: 482033 - RNA, 63 nt, Human
ccaccuccugagcucaagugauccucccaucuaagcccccaaguagcuaggacuacaggagca

SEQ ID NO: 482034 - RNA, 63 nt, Human
ccaagaucaacagcuccuucuccaaacaacucaagcccccaauucccaucgcauuccauuugg

SEQ ID NO: 482035 - RNA, 63 nt, Human
cgcgggaggccgggaggaggguggggaccuugcagcccccauccucuccgugcgcuuggagcc

SEQ ID NO: 482036 - RNA, 63 nt, Human
gcgccagguuuccuggagcucuuggcuucagccagcccccagccagaguccuggcuaggacag

SEQ ID NO: 482037 - RNA, 63 nt, Human
gggccagaggagccagggacuauuuucugcaccagcccccagggcugccaccccuguuguguc

SEQ ID NO: 482038 - RNA, 63 nt, Human
ccuaaauaucacuugcucugccacugcccgcccagcccccauggucuucuggaaggucccucg

SEQ ID NO: 482039 - RNA, 63 nt, Human
ugagaggugagaccuuuaaggguuacuaggcagagcccccaugaauggauuaaugccauuauu

SEQ ID NO: 482040 - RNA, 63 nt, Human
ugggaugagcccccuccccccaaugcacaagccagcccccaagacccuggggguggacaccac

SEQ ID NO: 482041 - RNA, 63 nt, Human
ucucccagucucucccugcaguccugcagcagcagcccccacccccaagcuuggugcugagcc

SEQ ID NO: 482042 - RNA, 63 nt, Human
cuccuccagccccugcacacucccacccaggacagcccccagcccaacuaggaaagggccaug

SEQ ID NO: 482043 - RNA, 63 nt, Human
cccagccucuuggcaccuccuguuuacuccccgagcccccagauucucaccuuugcccagagc

SEQ ID NO: 482044 - RNA, 63 nt, Human
agccaagaauuucgggcuguuugacuuucugugagcccccagcgaggggaggcccagccuccg

SEQ ID NO: 482045 - RNA, 63 nt, Human
ucagcagccccucagggcuucccaaggauguccagcccccacacccacacguuaacauaauga

SEQ ID NO: 482046 - RNA, 64 nt, Human
agaugugcuuuaucaucuccaucuuuagccuuuacaccaccaaucaaaacucuagguacaccaa

SEQ ID NO: 482047 - RNA, 64 nt, Human
cuuagccucccgagcagcugggauuauaggcguccaccaccacgcccagcuaauuuuuguauuu

SEQ ID NO: 482048 - RNA, 64 nt, Human
uguguaaaguaagccaagacacaucgacaaugagcaccaccaucaaugaccaccgccauucaca

SEQ ID NO: 482049 - RNA, 64 nt, Human
cucaucacugcacacaagugccaugcuuugccaccaccaccaagcacaucugugauccugaagg

SEQ ID NO: 482050 - RNA, 63 nt, Human
ccucugcuuugggggugccccugccuccagcagagcccccaccauucacugugacaucuuucc

SEQ ID NO: 482051 - RNA, 63 nt, Human
cuccaauggcaguguccuguuugagcacccugcagcccccacccaagauggccuggugagaug

SEQ ID NO: 482052 - RNA, 63 nt, Human
cuuccugggccaacuaaccagacaacugggaagagcccccaacuccaacaggauuauuuuccc

SEQ ID NO: 482053 - RNA, 63 nt, Human
uucuugaagccacacauggcuggcggaacccagagcccccaccccagcccaccuggcucuuug

SEQ ID NO: 482054 - RNA, 63 nt, Human
cuuaagggcuccuugauggaugccaucucuccuagcccccagcccuggugccacuggugggca

SEQ ID NO: 482055 - RNA, 63 nt, Human
ggggguggacaaacuggagucuggagugggcagagcccccaggaagcccaggagggcauccau

SEQ ID NO: 482056 - RNA, 63 nt, Human
gcuuaaauccuagcaggagagaggcucuggggcagcccccaugggcuccugccccuuucaggc

SEQ ID NO: 482057 - RNA, 63 nt, Human
agguguagauaaucuagaggcauagacugcuagagcccccagggaucugggguggucagggcu

SEQ ID NO: 482058 - RNA, 63 nt, Human
ggguggucaggaugggcuggggggcccacuagcagcccccagcaucucccacccacccagcua

SEQ ID NO: 482059 - RNA, 63 nt, Human
cuuucugcuuuagcguaauugcucagaguagagagcccccacaaaguuauuuaaaagaugccc

SEQ ID NO: 482060 - RNA, 63 nt, Human
ccaaggucugugggcucuaggcagcccggcagcagcccccagaggaacugcucccaccucucc

SEQ ID NO: 482061 - RNA, 63 nt, Human
ugagcuacaagagucaaauaguccucugaauggagcccccaucacaaaacagugcccaggagg

SEQ ID NO: 482062 - RNA, 63 nt, Human
augaaaaagaagaaaaacaauaaaguaaaccugagcccccacgucccaauuuuuuuaauagau

SEQ ID NO: 482063 - RNA, 63 nt, Human
gcaaagugaagaugacaguccuugcucucagggagcccccacuuuaaugggagacugauaaac

SEQ ID NO: 482064 - RNA, 63 nt, Human
gugucuacauguuugcuuagaggcggcuccaagagcccccagagcugccugcauagcacaccu

SEQ ID NO: 482065 - RNA, 63 nt, Human
ccuagcuuuuagcuauaaaccacucaaagauucagcccccagaucccacagucagaacugaau

SEQ ID NO: 482066 - RNA, 64 nt, Human
cugaggccaaagccagagacucgaacagccuccccaccaccaccagcauaugucaaggagcacu

SEQ ID NO: 482067 - RNA, 64 nt, Human
cuaacccuucugagguaacuagacugcagcuaaccaccaccaacagccauucaucaucugaucu

SEQ ID NO: 482068 - RNA, 64 nt, Human
cucaggcuucugaguagcugggauuauaggugcgcaccaccacacccggcuaguuucuguauuu

SEQ ID NO: 482069 - RNA, 63 nt, Human
ugcgauggcuacaagggcuacgaccuggucuacagcccccagagcggcuucaccugcgugucc

SEQ ID NO: 482070 - RNA, 63 nt, Human
acacgggcccagugcugccccugcugcugcaggagcccccaggcgagguucggccuuccucuc

SEQ ID NO: 482071 - RNA, 63 nt, Human
acguggggccaugacucucugggaccuugccacagcccccauuccccugcuugcagucugcaa

SEQ ID NO: 482072 - RNA, 63 nt, Human
gagggucaaauucaacauuauccugaucuagacagcccccauucucaauccacccuuuuccaa

SEQ ID NO: 482073 - RNA, 63 nt, Human
caauaaaugggggaauagguaguuuccugguuuagcccccaucuagucaggaauuaauauacu

SEQ ID NO: 482074 - RNA, 63 nt, Human
aaggaaacaaagcaauagguuugggggacgcccagcccccacccccgucaccccgcucuuccc

SEQ ID NO: 482075 - RNA, 63 nt, Human
uccgcggaggccccugagggacgagcagagcgcagcccccacgccgauauaagccauagcccc

SEQ ID NO: 482076 - RNA, 63 nt, Human
gcgggaggugggggaacaaggggucuuccgagcagcccccagcccuccccucccaucugugcc

SEQ ID NO: 482077 - RNA, 63 nt, Human
cccagcccuggacugaggauggaugguuccaugagcccccagaugaaaaccuggauucgacag

SEQ ID NO: 482078 - RNA, 63 nt, Human
uuuccauuccugaguuacuucccuuaggauaacagcccccaguuccguccaaguugcugcaaa

SEQ ID NO: 482079 - RNA, 63 nt, Human
agcagcugccggcugugugcccauggggagcccagcccccaccccccaccuccgacagcaaac

SEQ ID NO: 482080 - RNA, 63 nt, Human
cccuacuucuuauaaugcagaguuaaggagcugagcccccaugauuuuguagcuguacuuuug

SEQ ID NO: 482081 - RNA, 63 nt, Human
ucuacuuuuugcaccuuauuuucucuguuccugagcccccacauucucuaggagaaacuuaga

SEQ ID NO: 482082 - RNA, 63 nt, Human
cacccccgccaggcugcccaucagggcccagggagcccccagaggacuuuauucggaccaagc

SEQ ID NO: 482083 - RNA, 63 nt, Human
aaaggagccagccagguguaauacagucaaggcagcccccagccuagagacaaucugugaaau

SEQ ID NO: 482084 - RNA, 63 nt, Human
gggggacaaugaugagaagaccugaggauuugcagcccccagcccuggguucaagucccagcu

SEQ ID NO: 482085 - RNA, 64 nt, Human
cucaaccucccgaauggcugggacuacaggcacccaccaccacgccuggcuaacuaacuaacua

SEQ ID NO: 482086 - RNA, 64 nt, Human
ucccagccacccaagcauacuuaccaguacugcccaccaccacccacugcccaccucuaagaag

SEQ ID NO: 482087 - RNA, 64 nt, Human
acuauccuuaccuuuuaguuucagcaguccucaccaccaccauauccccagugcugggauggca

SEQ ID NO: 482088 - RNA, 63 nt, Human
ggugacacccagcccaggggcacccccuuccccagcccccaccuggagagacauggccccugc

SEQ ID NO: 482089 - RNA, 63 nt, Human
ccugccugggcacucccuccucccugcgcccacagcccccaugccaaucuccgucagcucuuu

SEQ ID NO: 482090 - RNA, 63 nt, Human
caccacacaccccgccccugaaaggagaucaucagcccccacaauuugucagagcugaagcca

SEQ ID NO: 482091 - RNA, 63 nt, Human
uccgccucccaguucaagugauucuccugccucagcccccaaguagcugggauuacaagugug

SEQ ID NO: 482092 - RNA, 63 nt, Human
gguccagguccucuccccucauuuccaucucccagcccccaggggccccuuccccuuuauggg

SEQ ID NO: 482093 - RNA, 63 nt, Human
ccuugacuuagagugacagccgguguccuggaaagcccccagcagcugccccagggacauggg

SEQ ID NO: 482094 - RNA, 63 nt, Human
gccccacacagcuacagcuuucuugcucccuucagcccccagccccucccccaucucccaccc

SEQ ID NO: 482095 - RNA, 63 nt, Human
auccccuuaaaagaaugccuuccacuucccaacagcccccaucaagggaccccaagaggccac

SEQ ID NO: 482096 - RNA, 61 nt, Human; identical to SEQ ID NO: 207126

SEQ ID NO: 482097 - RNA, 63 nt, Human
augaggagcugaaacugaccaguguccaguguuagcccccacauggggcugcucuugcuucua

SEQ ID NO: 482098 - RNA, 55 nt, Human; identical to SEQ ID NO: 207961

SEQ ID NO: 482099 - RNA, 63 nt, Human
gcagugccaagccuguggaucaggaauaucaacagcccccagagaguggugcuggcugagggu

SEQ ID NO: 482100 - RNA, 63 nt, Human
uggacgggcgcaccugcauggagggguccccagagcccccaaccagugccagcauacucagcg

SEQ ID NO: 482101 - RNA, 63 nt, Human
cagccccauuggggagugaucucuuggacacagagcccccauucaaaauggggcagggcaagg

SEQ ID NO: 482102 - RNA, 63 nt, Human
uaguaacccuaggcucagagacccaauuuuuuaagcccccagacuccuuagcccucagagccg

SEQ ID NO: 482103 - RNA, 63 nt, Human
ccucaggggccuguggcugaagaaaaggugcccagcccccaccacuccucagcugccccccaa

SEQ ID NO: 482104 - RNA, 64 nt, Human
cucagccuccugaguagcugggauuauaggcaugcaccaccaugcccagcuaauuuuguauuuu

SEQ ID NO: 482105 - RNA, 56 nt, Human; identical to SEQ ID NO: 335469

SEQ ID NO: 482106 - RNA, 64 nt, Human
cucagccucaugaauagcugggauuacaggugcccaccaccaugccuggcugguuuuuguauuu

SEQ ID NO: 482107 - RNA, 64 nt, Human
cagccuaccaaguagccaggaccacaggcaagugcaccaccaugacuggcuaguuuuguuuuuu

SEQ ID NO: 482108 - RNA, 63 nt, Human
uuugcuggcauuaaaaauaagcacacuuacauaagcccccauacauagagugggacucuugga

SEQ ID NO: 482109 - RNA, 63 nt, Human
cucugacccauuaggcuaaagagagacaagagaagcccccaaccugauucucaugacagcucc

SEQ ID NO: 482110 - RNA, 63 nt, Human
uuaagcagauacucuccauuccuuccuuccuccagcccccagcaaccaccaaucugcuuucug

SEQ ID NO: 482111 - RNA, 63 nt, Human
aagucagaaggcuggggcagaucacuucaagcaagcccccaugaugguucucaguccugcuuc

SEQ ID NO: 482112 - RNA, 63 nt, Human
ggugaaggagacacuacugcccccaccccugacagcccccaccccauggcuuccaucuuuugc

SEQ ID NO: 482113 - RNA, 63 nt, Human
cccacggacguggcuuggugcugaggauagcagagcccccagccaucacugcuggcagccugg

SEQ ID NO: 482114 - RNA, 63 nt, Human
gggaucuagaucuuuccuccuugacaucaccugagcccccaccuagccauccaugggagagag

SEQ ID NO: 482115 - RNA, 63 nt, Human
ggacuccugagaacacgguucucuccuagccucagcccccagcugggucucagaggagcuggg

SEQ ID NO: 482116 - RNA, 63 nt, Human
uuguggauuauuacagugaagugccuggcccggagcccccagugaugaagcaggaacuugagu

SEQ ID NO: 482117 - RNA, 63 nt, Human
ugugugcggugcccaggcccuaggagcucccccagcccccagguccuccugaccacuccccuc

SEQ ID NO: 482118 - RNA, 63 nt, Human
cccucugaugcugucugcagcucagucccugccagcccccaggagcgccuccagggccccgcc

SEQ ID NO: 482119 - RNA, 63 nt, Human
ccucagccaccaaaugucccugacacccuccccagcccccacagauaacaucagcugagguuu

SEQ ID NO: 482120 - RNA, 63 nt, Human
agcagccaccgcccaguuccaguggccccacgaagcccccaguggcuggcuguccagcugggc

SEQ ID NO: 482121 - RNA, 63 nt, Human
uggggcaucuggcuggugccugcugccauggccagcccccacucucacccugcacaggggguc

SEQ ID NO: 482122 - RNA, 63 nt, Human
gcccccacucucacccugcacagggggucuugcagcccccaggcccacagccucguugggagg

SEQ ID NO: 482123 - RNA, 63 nt, Human
ucuugauugagguagcaugaaggaugaggcuucagcccccauugucuuauguagaauguggca

SEQ ID NO: 482124 - RNA, 64 nt, Human
cuuaagcucccaaguagcugggauuacgggcgcccaccaccacgcccagcuaauuuuuuuuuuu

SEQ ID NO: 482125 - RNA, 64 nt, Human
uacagucccagauacacuaaaguuacaaacagaccaccaccaggacugugccugaacaauuuug

SEQ ID NO: 482126 - RNA, 64 nt, Human
aauggugauggagggcaacaaggacuccgaggagcaccaccaggccucgggccccagagguccc

SEQ ID NO: 482127 - RNA, 64 nt, Human
aggaccuccucuuggccacuuggccugggccugccaccaccacguccugcagaacgagcccugc

SEQ ID NO: 482128 - RNA, 63 nt, Human
cguggggcccugacaccacguuaucaaacaugcagcccccacaccccucgucugcccgccccc

SEQ ID NO: 482129 - RNA, 63 nt, Human
aagacuccucugggccuggggugcauccuccucagcccccaggccaggugagguccaccggcc

SEQ ID NO: 482130 - RNA, 63 nt, Human
aucugccuaguggaaaugagccacccccacugcagcccccaccuuuguguccuagagcucagc

SEQ ID NO: 482131 - RNA, 63 nt, Human
cccagagcaccucccagccaccguccccucaagagcccccagaacgagacccuguacucuguc

SEQ ID NO: 482132 - RNA, 63 nt, Human
cggucacaucaggcccgcuagguccagagagcgagcccccaaugcccggccaggcuaagccgc

SEQ ID NO: 482133 - RNA, 63 nt, Human
ugcccggccaggcuaagccgcagagacccucucagcccccaccucagguuagggcucugcccg

SEQ ID NO: 482134 - RNA, 63 nt, Human
ucccuugaaucccaaaagugccuccccagccucagcccccaccuccagccacacacacauuac

SEQ ID NO: 482135 - RNA, 50 nt, Human; identical to SEQ ID NO: 208033

SEQ ID NO: 482136 - RNA, 63 nt, Human
cugggagccucgcccuuugucccaacuggguagagcccccaggugcuguuugcucaggaggcu

SEQ ID NO: 482137 - RNA, 52 nt, Human; identical to SEQ ID NO: 208035

SEQ ID NO: 482138 - RNA, 63 nt, Human
ggggcucagccugggggagccuacuggggacugagcccccaggagggccagcauguggagagu

SEQ ID NO: 482139 - RNA, 63 nt, Human
cuucacgccucgguagauuugcauucugaugcaagcccccaaccucacggaccaagaggaucc

SEQ ID NO: 482140 - RNA, 63 nt, Human
ccagggcccagucuggcucccgagcucagacacagcccccaggagccgcccaccacggcugug

SEQ ID NO: 482141 - RNA, 63 nt, Human
gcgaggaagccccgggguuugucgucguugagcagcccccacggcugucggucagacucuugg

SEQ ID NO: 482142 - RNA, 63 nt, Human
acgagagcuauucauucauaagauggggcaaacagcccccaggcacuugcucccugcuccaua

SEQ ID NO: 482143 - RNA, 63 nt, Human
agccaccguguccagccaguuucuguuguuugaagcccccaacuucuagauugggaaacgaag

SEQ ID NO: 482144 - RNA, 52 nt, Human; identical to SEQ ID NO: 208046

SEQ ID NO: 482145 - RNA, 64 nt, Human
gcaggauauuugguuucagaguaaggacuaggugcaccaccaugacugacuaucaaucaaaaug

SEQ ID NO: 482146 - RNA, 64 nt, Human
cucagccucccgaguagcugggauuacaggugcucaccaccacacccagcuaauuuuuguauuu

SEQ ID NO: 482147 - RNA, 64 nt, Human
cucagccuccugaguagcugggacuacaggugugcaccaccacgcccggcuaauuuuuguauuu

SEQ ID NO: 482148 - RNA, 63 nt, Human
gggauggacccucgcagcaggugcaagagacagagcccccaagccucugccccaaggggccca

SEQ ID NO: 482149 - RNA, 63 nt, Human
cuucucuauaguucccgaguuggcccccauugcagcccccacccuguggguagucuuccagaa

SEQ ID NO: 482150 - RNA, 63 nt, Human
cagauuguacugugggcucagaaaccgugagagagcccccaccguggacaccggcucuagggc

SEQ ID NO: 482151 - RNA, 63 nt, Human
gaagcugcgccccaccuuuccagauacccacaaagcccccagacagaaucuagcaucgggacu

SEQ ID NO: 482152 - RNA, 60 nt, Human; identical to SEQ ID NO: 208051

SEQ ID NO: 482153 - RNA, 62 nt, Human; identical to SEQ ID NO: 208052

SEQ ID NO: 482154 - RNA, 55 nt, Human; identical to SEQ ID NO: 208053

SEQ ID NO: 482155 - RNA, 63 nt, Human
agccuucagcucuccccugaacuccaucuuaacagcccccaugguuuguucaacaucuccacc

SEQ ID NO: 482156 - RNA, 63 nt, Human
gcugcagccucagucccugccccuccagcccacagcccccaucccguagcccuuccuggaucu

SEQ ID NO: 482157 - RNA, 63 nt, Human
cugcccaccaagcccugcccccagcccaagaggagcccccacugccugcggggcagugauguc

SEQ ID NO: 482158 - RNA, 63 nt, Human
aguguguccaaccagcuguucucuccucaaagcagcccccaagcaagucccuucucuagggug

SEQ ID NO: 482159 - RNA, 63 nt, Human
auaucauccuaaaaguggggguugccucaagacagcccccaggaacugauaagaagggaugaa

SEQ ID NO: 482160 - RNA, 63 nt, Human
gaggccacccacguggcagccccaccucuugagagcccccagugccggagcagaaaggacccu

SEQ ID NO: 482161 - RNA, 63 nt, Human
gaccgcugcgggugguaaccaguggaagaccccagcccccagggagaggaacccguucuaucc

SEQ ID NO: 482162 - RNA, 63 nt, Human
cccagugagcggcagccucaggggccucaggggagcccccaccccacggauguugucaggaau

SEQ ID NO: 482163 - RNA, 63 nt, Human
ccugaguggaaguuucauucaucagugaugaauagcccccaaacagugggaguguguauguau

SEQ ID NO: 482164 - RNA, 64 nt, Human
auuuccaaaacugaacucaucaccccucuucccccaccaccaaaacugcuccuccuccuguauu

SEQ ID NO: 482165 - RNA, 64 nt, Human
cucagccuccugaguagcuaggacuacaggugugcaccaccacgccccgcuaauuuuuguauuu

SEQ ID NO: 482166 - RNA, 64 nt, Human
cuacgucuaagggacagacgcagggagaccccaccaccaccaccaccaccaacaccaccaccac

SEQ ID NO: 482167 - RNA, 64 nt, Human
agaagggugggucucaagugggaggauaaggcuucaccaccaggagauuccccucugcccgaug

SEQ ID NO: 482168 - RNA, 63 nt, Human
cgagggaggacccugagggccgcgaagcauccgagcccccagcugggaaggggcaggccggug

SEQ ID NO: 482169 - RNA, 63 nt, Human
aucugcuucucggaucucccucagucugcccccagcccccaaacuccuccuggcuagacugua

SEQ ID NO: 482170 - RNA, 63 nt, Human
cuggaggaaugugggggauugaaacuagcucccagcccccauggggcagcagcugggccacaa

SEQ ID NO: 482171 - RNA, 63 nt, Human
aaccacacccaacacuuagacaugcgaacaagcagcccccagcgagggucuccuucgccuuca

SEQ ID NO: 482172 - RNA, 63 nt, Human
uuucugagguugucgugugaguucuguacaaaaagcccccacaagucguccaguagaaaugca

SEQ ID NO: 482173 - RNA, 63 nt, Human
cgauuuccugggcucaagcaauccucccaccucagcccccaaguagcugggccuacaggugcg

SEQ ID NO: 482174 - RNA, 63 nt, Human
auucauauguccccacuggcauuacucagcaggagcccccagcugccaaagguuggcagugau

SEQ ID NO: 482175 - RNA, 63 nt, Human
uaaaauuugauaaacauuccuguugaugggaaaagcccccaguuaauacuccagagacaggga

SEQ ID NO: 482176 - RNA, 63 nt, Human
aggacagcaggguggaccccaguuuggaagcugagcccccagccacgaacauggaucugagga

SEQ ID NO: 482177 - RNA, 63 nt, Human
aggagaccaggcucuagcucugggcccuccuucagcccccaucaugggaauaaauuaauuuuc

SEQ ID NO: 482178 - RNA, 63 nt, Human
aguugaggcuggggcuaguggucccagcagcccagcccccacccuccuggcagcagcgccagg

SEQ ID NO: 482179 - RNA, 63 nt, Human
uggccuuugugcugcgccugcaggcagagcuggagcccccagcagaggcaggcugggacggac

SEQ ID NO: 482180 - RNA, 63 nt, Human
ggucccuaccugggcagucucauuugcacccauagcccccaucuauggacaggcugggacaga

SEQ ID NO: 482181 - RNA, 63 nt, Human
ucagacucccaaagcgguggaauuagaggcgugagcccccaugcuuggccuuaccuuucuacu

SEQ ID NO: 482182 - RNA, 63 nt, Human
uggugagcucagacuuggugcuucccuauccacagcccccaccccuuguuuuucaagauacua

SEQ ID NO: 482183 - RNA, 63 nt, Human
uggggcaggagauuguuucuucauucuucugacagcccccaucugacgcguaacugcccauuu

SEQ ID NO: 482184 - RNA, 62 nt, Human; identical to SEQ ID NO: 208087

SEQ ID NO: 482185 - RNA, 64 nt, Human
aaauuuaaaccaauuuuuaaaacaaaacugcggacaccaccauaaaaauggaaucaaaagaaag

SEQ ID NO: 482186 - RNA, 64 nt, Human
accaccgccaccaccaccaacaccgccacaccaacaccaccacuacaaaaaaaaaagaauuaau

SEQ ID NO: 482187 - RNA, 63 nt, Human
ccuccuccaggcccccggacgcucagcccccacagcccccacagccuggcgccagggcucaca

SEQ ID NO: 482188 - RNA, 63 nt, Human
gacggcugcccuccuccaggcccccggacgcucagcccccacagcccccacagccuggcgcca

SEQ ID NO: 482189 - RNA, 63 nt, Human
ccacagaggaugaagccaccccacagaggaugcagcccccagcugcauggaagguggaggaca

SEQ ID NO: 482190 - RNA, 63 nt, Human
guccccgacugccauuggcaacaguggcccugcagcccccagcccuccccacccagguuuucg

SEQ ID NO: 482191 - RNA, 63 nt, Human
ccuuccccaugggaagacgaggcccucgggcccagcccccacagugcugucugaucugugcuu

SEQ ID NO: 482192 - RNA, 63 nt, Human
aagggucuuucuaaguuaauacugugagcauugagcccccauuaaaacucuuuuuuacuucag

SEQ ID NO: 482193 - RNA, 63 nt, Human
cggcuuguccgugagcuccgugcacuucaccaaagcccccaucccagcacacaggacccgugu

SEQ ID NO: 482194 - RNA, 63 nt, Human
ccuuucucuguccucuccugagguucugccugcagcccccaggaggugggccugccccauccu

SEQ ID NO: 482195 - RNA, 63 nt, Human
gcaccucagccuggcacccccacuccccugcgcagcccccaggccucaggaccccaccccucu

SEQ ID NO: 482196 - RNA, 63 nt, Human
gaaguugaaucugguuauuauuuaaaaacuagaagcccccaaaccagcagaucuuacugaaga

SEQ ID NO: 482197 - RNA, 63 nt, Human
guuaaaacacuaauugcugggccucaacccaaaagcccccaaaguggcacuucugaguuccug

SEQ ID NO: 482198 - RNA, 63 nt, Human
cauagacccucaguagaauuggauuuccaugucagcccccacuccaggaaggcagcccaaucc

SEQ ID NO: 482199 - RNA, 63 nt, Human
ccucccugcccccugugacggagggggcaagcaagcccccagaggcugugucucuggacagac

SEQ ID NO: 482200 - RNA, 63 nt, Human
agacccaagaccaaacgcaucuaaaggauccccagcccccaagaccuagccuuugucugcgau

SEQ ID NO: 482201 - RNA, 63 nt, Human
aaguuaagugaaaauuagucaacugcacguggaagcccccaccacuuuggggaucucuuuauu

SEQ ID NO: 482202 - RNA, 63 nt, Human
cccagccaggccugacucaucauggucacauccagcccccacccccggccaacuaaccacugc

SEQ ID NO: 482203 - RNA, 64 nt, Human
cucagccucccgaguagcugggauuacaggcacccaccaccacgcccagcuaauuuuuguauuu

SEQ ID NO: 482204 - RNA, 64 nt, Human
cgucaccgcccacuucuagccccguggaugccgucaccaccagcacacggaacuaccucccacc

SEQ ID NO: 482205 - RNA, 64 nt, Human
ggggaggaggacgguugacggcccugcuuggauccaccaccaggacgcugugcucggccauggc

SEQ ID NO: 482206 - RNA, 63 nt, Human
gagggcggcugcaggagaggaaggggcucccacagcccccacugaugccgcugcaggccccug

SEQ ID NO: 482207 - RNA, 63 nt, Human
aaggaugaaagcaaaggagggccuugaggaagcagcccccaggccuggcagccacgcagcggc

SEQ ID NO: 482208 - RNA, 63 nt, Human
ccccugcccugggccccuuccccacugcccaggagcccccauccuaagcuccaagcaugucug

SEQ ID NO: 482209 - RNA, 63 nt, Human
guucagcaguucaucuucaugggaaauuugcugagcccccaccagggaaccggaugaugaaac

SEQ ID NO: 482210 - RNA, 63 nt, Human
ggccaagggggcuugcccacccaccccgaccccagcccccagccucagccccgguccgggggc

SEQ ID NO: 482211 - RNA, 63 nt, Human
guguuuguggcucccacuccccagccccccagcagcccccagccgaggggcccagggcccaca

SEQ ID NO: 482212 - RNA, 63 nt, Human
guguggcuuggggcuuguugccuccccucucugagcccccauuuccuccuucauccuguggag

SEQ ID NO: 482213 - RNA, 63 nt, Human
ccaggcuggacugagccccucacgccgcccugcagcccccaugccccugcccaacaugcuggg

SEQ ID NO: 482214 - RNA, 63 nt, Human
gucacccuacaacuacuacuucuugggaccucaagcccccaacaucccaguccucaguccuca

SEQ ID NO: 482215 - RNA, 63 nt, Human
gggagucucaagucugcuaagauucacauccauagcccccauggcuuugaggagaauccucuc

SEQ ID NO: 482216 - RNA, 50 nt, Human; identical to SEQ ID NO: 208118

SEQ ID NO: 482217 - RNA, 63 nt, Human
ccuccuuauuucuuuuuucuaucuguuccucuuagcccccaaacucccagguucucacuuccu

SEQ ID NO: 482218 - RNA, 63 nt, Human
auugcacagccaggcugggagcagccuagggagagcccccaucaugcccaccacccacucugg

SEQ ID NO: 482219 - RNA, 63 nt, Human
uaaagaugaggcgccauaggcauccgucuccagagcccccaggaggcaggaaccaggauaagg

SEQ ID NO: 482220 - RNA, 63 nt, Human
ucccaguuucccuuuugguuacagggggauaguagcccccagggaucaugugaaagugagaaa

SEQ ID NO: 482221 - RNA, 63 nt, Human
gaguguugagcccaaggggggauuuguagaacaagcccccaugagaaacagcuguuacucuac

SEQ ID NO: 482222 - RNA, 64 nt, Human
ucauccguccuuggcucaggauuuggagagcuugcaccaccaaaaauggcaaacaucaccagcu

SEQ ID NO: 482223 - RNA, 64 nt, Human
cccuguuccugagauggaaagcacaaauuuaauacaccaccacaauggaaaacaaguucaaaga

SEQ ID NO: 482224 - RNA, 64 nt, Human
caagcugcuuguccugggccugccccuguguauucaccaccaauaaaucagaccaugaaaccag

SEQ ID NO: 482225 - RNA, 64 nt, Human
cucagccucccaaguagcugggacuacaggcacacaccaccacgcccagcuaauuuuuguauuu

SEQ ID NO: 482226 - RNA, 63 nt, Human
agcucagcuuccccaacacgcaggagcacacccagcccccacauccugugccuccaucagcua

SEQ ID NO: 482227 - RNA, 63 nt, Human
aaauggaaacccccaucugaguauuuugggaggagcccccagcccucauccagcucuggcacg

SEQ ID NO: 482228 - RNA, 63 nt, Human
ccugaaacgagaagugcccuuaaggaucaccccagcccccacagcccuggaauaaauuucgca

SEQ ID NO: 482229 - RNA, 63 nt, Human
auuaucucagaacagaagucaucagaucaucagagcccccagauggcuacagaccagagauuc

SEQ ID NO: 482230 - RNA, 63 nt, Human
gccuggggucaggcccucacugacccucaggggagcccccaaggugcugucugucuagacagg

SEQ ID NO: 482231 - RNA, 63 nt, Human
uccacaccucgcucccuguuagugccguaugacagcccccaucaaaugaccuuggccaaguca

SEQ ID NO: 482232 - RNA, 63 nt, Human
cuaccuguuugggucagagagauguguuuuaaaagcccccaaggaaggaggcugggacugugc

SEQ ID NO: 482233 - RNA, 63 nt, Human
cagucaaagaaaguccauuguacauaacaaaacagcccccaaacagcccagugccgacaccau

SEQ ID NO: 482234 - RNA, 63 nt, Human
augcuuagaaagcugucuuuucagugguguugcagcccccagauguguggccaaccucugcug

SEQ ID NO: 482235 - RNA, 63 nt, Human
cagcuaacagaauaaacgacucugaagaggagaagcccccaguuaggagaagacagaguggca

SEQ ID NO: 482236 - RNA, 63 nt, Human
uaaccuggcagcccguuuuggggugcuuucuugagcccccaguucucuguccccuagcacuag

SEQ ID NO: 482237 - RNA, 63 nt, Human
ggauugcagggguccagccuugccuguuuccgaagcccccacacugccuuucgcccuacugag

SEQ ID NO: 482238 - RNA, 63 nt, Human
cacccacaggccauguccagccccacuucccucagcccccagggcuuccuucuggccccucug

SEQ ID NO: 482239 - RNA, 63 nt, Human
ggcuccaauuuggagagggaaugcugagcagauagcccccauuguuaauccaguauccuuaug

SEQ ID NO: 482240 - RNA, 63 nt, Human
agaguggccuggccccucccccucuaccucaguagcccccaggccugagauggcugagaaggg

SEQ ID NO: 482241 - RNA, 63 nt, Human
cugcgccaucuaccggcugaacuuucugaccacagcccccagcaggggaggcccacaccugcc

SEQ ID NO: 482242 - RNA, 64 nt, Human
acgucagugcacuuguccuuacgucaguuccuuacaccaccaaagcacuucaccuuucuggaaa

SEQ ID NO: 482243 - RNA, 64 nt, Human
cagaagugaccacugggacuucaggcaagaagcucaccaccaggcacacagcaaagggacugaa

SEQ ID NO: 482244 - RNA, 64 nt, Human
cucagcaucccaaguagcugggauuacaggcacccaccaccaugcccaacuaauuuuuguauuu

SEQ ID NO: 482245 - RNA, 63 nt, Human
uauaggaccucaagauuccuggaaagaagccccagcccccaggggaaaccuccagaggaacaa

SEQ ID NO: 482246 - RNA, 63 nt, Human
uuacccucccaguuggccagaaucugaggggagagcccccagagagcccccuuccccaucaga

SEQ ID NO: 482247 - RNA, 63 nt, Human
ugagguccaugcagcucuuugacaaugucaucuagcccccaggagagggggucaguguuuccu

SEQ ID NO: 482248 - RNA, 63 nt, Human
gaaagaauuuagcugcaaguggacaaaggaacaagcccccagaaaagaaagggaagaacugcc

SEQ ID NO: 482249 - RNA, 63 nt, Human
gguauguagaagggucugucagcacacauggaaagcccccauuugcacagauguagaacuuua

SEQ ID NO: 482250 - RNA, 63 nt, Human
uaauauaaagauuuuaaaacugcauuaugaccuagcccccauaauugggauuuaucauuuugg

SEQ ID NO: 482251 - RNA, 63 nt, Human
uggacggugccagcugaggcugaggcaugcagcagcccccagcuaccuuugcuuagggcuggg

SEQ ID NO: 482252 - RNA, 63 nt, Human
uucuuaaaaaucagcuuuaaggagcuggcagaaagcccccagccccacagcccugagagaugg

SEQ ID NO: 482253 - RNA, 63 nt, Human
gcccaggcagggcuggggugugcuggcaucgacagcccccacucugggcacuaggugggcccu

SEQ ID NO: 482254 - RNA, 63 nt, Human
caccagggccgcucgugggacuccacauccuccagcccccacaauccugucaggggcucccug

SEQ ID NO: 482255 - RNA, 63 nt, Human
cccaugggcaggagacuguggagacugcuccugagcccccagcuuccagcaggagggacaguc

SEQ ID NO: 482256 - RNA, 63 nt, Human
ccccacaucacccugaagaugacuuccugagccagcccccagccacagccuuagagcugcggg

SEQ ID NO: 482257 - RNA, 63 nt, Human
ucaauggcugcuuugaacuuacucaggaaagccagcccccauaauauuguauuaccaaacagu

SEQ ID NO: 482258 - RNA, 63 nt, Human
guguugcacccggggcugcaaacgucuccgugcagcccccagagagaggcccaugggcucaga

SEQ ID NO: 482259 - RNA, 63 nt, Human
uuucuuccccgcccccugcacauucggggucucagcccccaggcugugagcuccuugggggca

SEQ ID NO: 482260 - RNA, 63 nt, Human
gggaacaaagaggagccugguaaaaaacagccaagcccccaagaccucagcccaggcagaagc

SEQ ID NO: 482261 - RNA, 64 nt, Human
ucgacagcgccccugcugucuuccccaccgcagucaccaccacccgaaaugccacguggucacu

SEQ ID NO: 482262 - RNA, 64 nt, Human
acggggagauggccgcacccacagcugccuuucccaccaccagccucggugcucugccccaugc

SEQ ID NO: 482263 - RNA, 64 nt, Human
gaugcacccagagccugccagggagggcuggccucaccaccaccgucaauaaaggauuugaauc

SEQ ID NO: 482264 - RNA, 63 nt, Human
acggccccuugaccugagcuuaugccgugaaacagcccccagcccccgucugucccccaaccc

SEQ ID NO: 482265 - RNA, 63 nt, Human
caggagccuccaggauggagauggagacccagcagcccccagacuacuucuaucccugaaaac

SEQ ID NO: 482266 - RNA, 63 nt, Human
ugccccagccuguaccccagcccugcagcaggaagcccccagucccagcccuuugggacuguu

SEQ ID NO: 482267 - RNA, 63 nt, Human
uuucagagaacaguuaaucaaggcaaaucagcaagcccccaaagugcuguaauuuaacaucau

SEQ ID NO: 482268 - RNA, 63 nt, Human
uucuuagguuacacaugaaauccuaccgucacuagcccccauacaccaguguugcuggcugaa

SEQ ID NO: 482269 - RNA, 63 nt, Human
ggcuggcccagauauuccccaguggaugggcagagcccccaccuucaagucucuccagugugu

SEQ ID NO: 482270 - RNA, 63 nt, Human
gugccuaggccuuacgcauuugcugacugacucagcccccaugcuucuggggaccuuuccuac

SEQ ID NO: 482271 - RNA, 63 nt, Human
auaugauagcuucgcaugguggugugcaccuauagcccccacugccuggaaagcugagguggg

SEQ ID NO: 482272 - RNA, 53 nt, Human; identical to SEQ ID NO: 208175

SEQ ID NO: 482273 - RNA, 63 nt, Human
ggauuacuggauagaauucaggcuuuccccuccagcccccaaucauagcucacaaaccuuccu

SEQ ID NO: 482274 - RNA, 63 nt, Human
guauggguauauuuuucuuguguccuugcaguuagcccccaugucuuauguguguccugaaaa

SEQ ID NO: 482275 - RNA, 63 nt, Human
auuucagaagguggcacucaggucacccugaaaagcccccaggggcuugcaauucuggaaaau

SEQ ID NO: 482276 - RNA, 63 nt, Human
aucuucuuucucuuucugaagcuggagagcagaagcccccaucuuugaaaagcuccugagugc

SEQ ID NO: 482277 - RNA, 63 nt, Human
ccugaguucagccccacggacaaagggacacacagcccccaauggagaccauuguaaguggug

SEQ ID NO: 482278 - RNA, 63 nt, Human
uccucacucaggagugggggguguaggcuggccagcccccagggcuuguccaccagucuucuc

SEQ ID NO: 482279 - RNA, 63 nt, Human
caucuuccccugccgcaccggcagucucagcccagcccccaccuuuggguuguagguugggcu

SEQ ID NO: 482280 - RNA, 58 nt, Human
ucugguacaacuguccuuagacugaugagcaaaggaggagucaacuaaugaagaaaug

SEQ ID NO: 482281 - RNA, 64 nt, Human
gucaagccaugugucugaugacauuccuggugaagcaaaggagaggaggaugggucagcccuca

SEQ ID NO: 482282 - RNA, 64 nt, Human
acauuuguaucaccuuugcuaucuuggggaaagugcaaaggacaaacaucucaauuguaugaag

SEQ ID NO: 482283 - RNA, 64 nt, Human
gcugccauacugccacuguccagguggagacugagcaaaggaaguccugggcugugccagcucc

SEQ ID NO: 482284 - RNA, 63 nt, Human
ccgccugccccgcggaagaccgcccagugagccagcccccaccuuccaggcgccuucgcccug

SEQ ID NO: 482285 - RNA, 63 nt, Human
cgccaggcccccacagucuguggccguggucuuagcccccaguuccacucuggaugggccugu

SEQ ID NO: 482286 - RNA, 63 nt, Human
cagccucaccaaaguguugggauuacuggugugagcccccacaccuggccgagccagcgcuuc

SEQ ID NO: 482287 - RNA, 63 nt, Human
agaacugcucacccugccuuuuucugggggcugagcccccacaaccugucuuuuccaagugga

SEQ ID NO: 482288 - RNA, 63 nt, Human
cacugggcagcuccuggacagccucuuggcuccagcccccacccgaaaguggacacuggcucc

SEQ ID NO: 482289 - RNA, 63 nt, Human
uauucccugacgacacugaagaaucaagagggcagcccccacuuuccuacaaaauggagggag

SEQ ID NO: 482290 - RNA, 63 nt, Human
aguauauuccgugucguguguguguguggccaaagcccccaaggguggcaagugccaccuucg

SEQ ID NO: 482291 - RNA, 63 nt, Human
acacuucucaggaaauggcuuuucccaacccccagcccccacccggugguucuuccuguucug

SEQ ID NO: 482292 - RNA, 63 nt, Human
aacugccccagguuuaagcaauccucccaccucagcccccagguaacugggacuacaggcaug

SEQ ID NO: 482293 - RNA, 63 nt, Human
uggccccagagccuuugccacagugcucccaccagcccccaccucauccgucuguuugcagag

SEQ ID NO: 482294 - RNA, 63 nt, Human
gagacuacuagaaagaaacgacacccuuccccaagcccccacagcuacuccaacccaaacaac

SEQ ID NO: 482295 - RNA, 63 nt, Human
gcguuagacuggcaucaggcuggcacuaggcucagcccccaaaacccccugcccagccccagc

SEQ ID NO: 482296 - RNA, 63 nt, Human
uggcauccccagggaagggguugcuguagagauagcccccacccaggggauggaggucuaccc

SEQ ID NO: 482297 - RNA, 62 nt, Human; identical to SEQ ID NO: 208204

SEQ ID NO: 482298 - RNA, 63 nt, Human
ugguagcaagaggaguacccaguuagggguuggagcccccauauaacaucuuccugucagaag

SEQ ID NO: 482299 - RNA, 63 nt, Human
cucuagaaacgaguuggugucuuucgucucaguagcccccaccccaauaagcuguagacauug

SEQ ID NO: 482300 - RNA, 64 nt, Human
cuccccagauaccuccuauauuuccauauugugugcaaaggaugggcagaaaagaaagugcuug

SEQ ID NO: 482301 - RNA, 64 nt, Human
aagaauuuuguuguuucucagcuguuuuccaaaagcaaaggaagucuuuaugguuuuuuucuau

SEQ ID NO: 482302 - RNA, 64 nt, Human
uagcaauuucugagcaaaaaucugggaaacucaagcaaaggaauuucugaaaguaucagucuuc

SEQ ID NO: 482303 - RNA, 64 nt, Human
caaauuaaaagcagcuuugugaacuuuuaugugugcaaaggaucaaguucacauguuccaacuu

SEQ ID NO: 482304 - RNA, 63 nt, Human
uuucagcugcauccuggugucccacccaggucgagcccccaggcuucuggaaaagagugugug

SEQ ID NO: 482305 - RNA, 63 nt, Human
uuggcugccauucucacugacaaaauguauaucagcccccaccuccaccccccaauauuccuu

SEQ ID NO: 482306 - RNA, 63 nt, Human
ucacaggagcuuaaacagcuggucagcccccuaagcccccacuacaagugauccucaggcagg

SEQ ID NO: 482307 - RNA, 63 nt, Human
acugauugggcaauugugggcccaugggguggaagcccccagaugacugagcaguucuacaaa

SEQ ID NO: 482308 - RNA, 63 nt, Human
cccaggugugcaggggagcacacagggcccggcagcccccaggaaucaaggauagggcuaagg

SEQ ID NO: 482309 - RNA, 63 nt, Human
ugcucguuccaaagggaaaaacucggaugaagaagcccccaagacugcccagaagaaguuaaa

SEQ ID NO: 482310 - RNA, 63 nt, Human
gcuacccuggaucuuugcccaccucuuccucagagcccccacugaggggccguagcccuaucu

SEQ ID NO: 482311 - RNA, 63 nt, Human
cucuaaccugcugugucacccgcuuucccucccagcccccacauccuuaccauuuucccuccc

SEQ ID NO: 482312 - RNA, 63 nt, Human
ccucaccccuccccguguuaaucuguaacuugcagcccccaggccaaaguccuuucucacacu

SEQ ID NO: 482313 - RNA, 63 nt, Human
uugggaccugguucucuucuaaccccuggcaauagcccccauuccugggucuuuagagauccu

SEQ ID NO: 482314 - RNA, 63 nt, Human
aguccuggcugauugguguucgcuguucaucugagcccccaaaagcauuauuacugauacuug

SEQ ID NO: 482315 - RNA, 63 nt, Human
ucuuugucuaggacccagaucauccccagagagagcccccacaagcuccucaggaaacaggau

SEQ ID NO: 482316 - RNA, 55 nt, Human; identical to SEQ ID NO: 208219

SEQ ID NO: 482317 - RNA, 63 nt, Human
aucuguccucagccuugccagagauccaaaagaagcccccagcuaagaaccuggaacuugggg

SEQ ID NO: 482318 - RNA, 63 nt, Human
uuucucccugccuucuugcccugcccucucuguagcccccacccuccugccaagcugccucug

SEQ ID NO: 482319 - RNA, 63 nt, Human
ugggugagggggaagaauacggggguucccagaagcccccaugugauccaaggguuuguauuu

SEQ ID NO: 482320 - RNA, 64 nt, Human
ccuucugagagcuuggugaaggugucuccaucaccaccaccagagccuccugcccagcccuggc

SEQ ID NO: 482321 - RNA, 64 nt, Human
aagccuucugagagcuuggugaaggugucuccaucaccaccaccagagccuccugcccagcccu

SEQ ID NO: 482322 - RNA, 64 nt, Human
caccacugaugccucccacugugacaggcccugucaccaccaauaucuuauuucaaccucacag

SEQ ID NO: 482323 - RNA, 64 nt, Human
uagggaaaagagggugcagggcacggcugcuccccaccaccaggucugcauuuguucaucauca

SEQ ID NO: 482324 - RNA, 63 nt, Human
aaaaugucuauaaauuaucagucugggugggaaagcccccaccuccauccauuuuccugcuua

SEQ ID NO: 482325 - RNA, 63 nt, Human
aucacugcccuacaugugacuauguccaaguuaagcccccaacacgagaggaaagcugcugac

SEQ ID NO: 482326 - RNA, 63 nt, Human
ccacgggagcacuuccuacccccacgagggcacagcccccacgccuuccagaagacacaaacu

SEQ ID NO: 482327 - RNA, 63 nt, Human
cucuuuuaagucugauaacaugguuucaagcccagcccccagccuuucuuaccaaucaaggac

SEQ ID NO: 482328 - RNA, 63 nt, Human
aggugagcuguguccucuaggcugccagcucacagcccccaccccagggcccuguaagcugug

SEQ ID NO: 482329 - RNA, 63 nt, Human
uggggagcccaccgccuacacaguaggggcaguagcccccagcuccacgccuguugccaugug

SEQ ID NO: 482330 - RNA, 63 nt, Human
cgaagucacaucccagccccagagucacuguccagcccccaccccucaacacgcgggggaggc

SEQ ID NO: 482331 - RNA, 63 nt, Human
aucuaugacucaccuugcucugccaucccuggcagcccccaccgguguccuguuccugccaca

SEQ ID NO: 482332 - RNA, 63 nt, Human
ggggguuccugggggcuuccagcccaggcuagaagcccccauggcuucuggcagcuggacauc

SEQ ID NO: 482333 - RNA, 63 nt, Human
cucugcuccccugugaacccacugaaccuucugagcccccacugcuucuauggggcucucucu

SEQ ID NO: 482334 - RNA, 63 nt, Human
cccaucugaccaucuccuuaagguuucacccaaagcccccagugucagagacuugggauggga

SEQ ID NO: 482335 - RNA, 63 nt, Human
uauaaaaucaugaagcagguaaagggaggggcaagcccccaaacugcuguggggacauuuuau

SEQ ID NO: 482336 - RNA, 63 nt, Human
agcgcucuggacagauggacgcaggcccuguccagcccccagugcgcucguuccgguccccac

SEQ ID NO: 482337 - RNA, 63 nt, Human
ggaugcugcugagcaucccgcaguguacaggacagcccccaaacaaggaauuauccagcccca

SEQ ID NO: 482338 - RNA, 63 nt, Human
cacucgcggccuggaaggagaagguguccacggagcccccacccauccucggcgguucccauc

SEQ ID NO: 482339 - RNA, 63 nt, Human
uccuccugagucuggguaauuauaccucucccaagcccccauuguguguugaaauccugucau

SEQ ID NO: 482340 - RNA, 64 nt, Human
uggacgcugccacacaagccugaguagagcccaugcaaaggaagggauggggugagcgcaaggc

SEQ ID NO: 482341 - RNA, 64 nt, Human
aaguguaauagaaauuauguagcuccuuauguuggcaaaggagcucuauauaguuucacuuugu

SEQ ID NO: 482342 - RNA, 64 nt, Human
gaguaaaaaacaugaccugguagaaggaagagaggcaaaggaaacuggguggggaggaucaauu

SEQ ID NO: 482343 - RNA, 64 nt, Human
aaauacauauccuucuaagcagauucuuccuacugcaaaggacagugaauccagcaacucagug

SEQ ID NO: 482344 - RNA, 63 nt, Human
gccauuacugcaucauaauacaaggaaccucagagcccccauuuguucauuaaagaggcaacu

SEQ ID NO: 482345 - RNA, 63 nt, Human
agcaccggaaugccaauuaacuagagacccuccagcccccaaggggaggauuugggcagaacc

SEQ ID NO: 482346 - RNA, 63 nt, Human
guggagcccagacacgucuccuugggauucacuagcccccagcccgccaaaccccaccccagc

SEQ ID NO: 482347 - RNA, 63 nt, Human
cauugaacgcugcacuccugggcuccuguccccagcccccauucagacacgcugacucaggag

SEQ ID NO: 482348 - RNA, 63 nt, Human
ugaaucagccagugccuugcucuuggacuucccagcccccagaacugugagaaauaaauuucu

SEQ ID NO: 482349 - RNA, 63 nt, Human
cagcccaggagguggcuggauugcagggcuggcagcccccacgugguggcauccugacaggca

SEQ ID NO: 482350 - RNA, 63 nt, Human
ccccuggcccaggcccaguccuuggugucagggagcccccaggccgcagguggagggugauaa

SEQ ID NO: 482351 - RNA, 63 nt, Human
cagucgaacugggggcuagccaccuccucguccagcccccaaaccuccccuuccuuucccccu

SEQ ID NO: 482352 - RNA, 63 nt, Human
agaaacccagcccugccccugccuccugcauccagcccccaacauggugccaaagcuuccaga

SEQ ID NO: 482353 - RNA, 63 nt, Human
ccgcacccuacccagugucgauauccacaacccagcccccaggccugcacuuuggagauuucu

SEQ ID NO: 482354 - RNA, 63 nt, Human
guagacccagccucuagucuccugagccuguagagcccccaggagacugggacccaaagaacu

SEQ ID NO: 482355 - RNA, 63 nt, Human
cuggaacucuuccagccuuucuacuugaucuccagcccccaggucuuugccagaugaugggaa

SEQ ID NO: 482356 - RNA, 63 nt, Human
ucaucacugcugucugcuagagcccuuccucucagcccccauguugggagaggggaguggauu

SEQ ID NO: 482357 - RNA, 63 nt, Human
ugggauggcgaguaagaggcgaccccgcccggcagcccccauccaucugugucugucuguugg

SEQ ID NO: 482358 - RNA, 63 nt, Human
aagagccaccaaaaguuaggggacuucaguccuagcccccagauggccgcccugaagcucucu

SEQ ID NO: 482359 - RNA, 63 nt, Human
cuggaagauguggggugcugggugagaggcaucagcccccacaaguauguuuuugugucuuaa

SEQ ID NO: 482360 - RNA, 64 nt, Human
aagcuaacaaggugacccacacacucaccaugaggcaaaggauuagcagaguggaggagucggc

SEQ ID NO: 482361 - RNA, 64 nt, Human
gcugggugcugucuccaugccaugaaucaugagagcaaaggaucacugcuuaaaaauacugaau

SEQ ID NO: 482362 - RNA, 64 nt, Human
uugugcagugcuguguauggauuuuacucuaagagcaaaggaaagccacugaagaguauaaagc

SEQ ID NO: 482363 - RNA, 64 nt, Human
gacugcagcccccuauagucauggggucccugcugcaaaggacagugggcaggaggccccaggc

SEQ ID NO: 482364 - RNA, 63 nt, Human
uuuccuccuacuggucuccaccaaggcuuuguuagcccccacccugccuggugugcagcuaac

SEQ ID NO: 482365 - RNA, 63 nt, Human
gcacagcccagcagcccgaggccgcccgcgacuagcccccaccguaguauuuauaguuaaauu

SEQ ID NO: 482366 - RNA, 63 nt, Human
cuuagauucugguggagagaagugagaauaggcagcccccaaauaaaaaauauucauggauuu

SEQ ID NO: 482367 - RNA, 63 nt, Human
uuccuaagcagcuggccugaccucuuccugcccagcccccaacccagucucuggccucugccc

SEQ ID NO: 482368 - RNA, 63 nt, Human
gacagagccaggagaagcucagcugcauuccgcagcccccacccccaagguucuccaacauca

SEQ ID NO: 482369 - RNA, 63 nt, Human
aaaagguuaaugaacuucaggucccugcaacucagcccccaccacaaacacagcccuggaaac

SEQ ID NO: 482370 - RNA, 63 nt, Human
gagcagaggugagcagcaaugcacugguucgggagcccccaucagccuccuugugcaaacugg

SEQ ID NO: 482371 - RNA, 63 nt, Human
ccggccucgagaggggccgaugcccagagacacagcccccacggacaaaaccccccagauauc

SEQ ID NO: 482372 - RNA, 63 nt, Human
uauccuccuauaccgcacauaaauagauuucagagcccccauacaaugggcagugucugcuau

SEQ ID NO: 482373 - RNA, 63 nt, Human
cugcuccccgggcagccucccgccgaggggcccagcccccaacccacaggcacggaggggcau

SEQ ID NO: 482374 - RNA, 63 nt, Human
cccagcucagacucuaagcucaacaagcccuugagcccccagaaggagaccgcuaacucucag

SEQ ID NO: 482375 - RNA, 63 nt, Human
auauauauauauauauguauaugucuguaccccagcccccaccuuucagauucugcucuuggc

SEQ ID NO: 482376 - RNA, 63 nt, Human
uuguggugcuagauguguguuuagagcuaaaccagcccccacccccacccuccaccugccccu

SEQ ID NO: 482377 - RNA, 63 nt, Human
auuucagcaguuugccacugugacugucuggcaagcccccagauggcguuauauuaauuggau

SEQ ID NO: 482378 - RNA, 63 nt, Human
ccaaagccuucauuuuaacagauggggaaagugagcccccaagaugggaaagaaccacacagc

SEQ ID NO: 482379 - RNA, 63 nt, Human
cacgcacuuggagggcccaggugucucuccaccagcccccaugcaguagggacuggaagauau

SEQ ID NO: 482380 - RNA, 64 nt, Human
cucagccucccgaauagcuggaauuacgggcaugcaccaccacaccuggcuaauuuuuguauuu

SEQ ID NO: 482381 - RNA, 64 nt, Human
uuguuccaacucuuaugcccccaaccugcccuaccaccaccacgcgcucagccugauguguuua

SEQ ID NO: 482382 - RNA, 64 nt, Human
uucccucaccugccugccugucucccuccucugucaccaccagccucuccaagcucaaguacaa

SEQ ID NO: 482383 - RNA, 63 nt, Human
aaguuuugggggaaagauggaguuccuauccagagcccccagauuuccagaaucgagugagcu

SEQ ID NO: 482384 - RNA, 63 nt, Human
uugaaaacagugugaugcaauuacugcuguucuagcccccaaagaguuuucugugcaaaaucu

SEQ ID NO: 482385 - RNA, 63 nt, Human
guggaaaaagaucaccucccagugaccucccucagcccccaggggaguaggucuguguccaaa

SEQ ID NO: 482386 - RNA, 63 nt, Human
ccaaauuuccacuccacaaagaaaacagcugcaagcccccagggacuuaccuggggcuggcau

SEQ ID NO: 482387 - RNA, 63 nt, Human
gggguuuauggauaggcuucaagagggucugugagcccccagaaauugugugugagacugagu

SEQ ID NO: 482388 - RNA, 63 nt, Human
cgcuuccuuucucagcugaaccccuacucccggagcccccagcagggcccuccgagguggagc

SEQ ID NO: 482389 - RNA, 63 nt, Human
gccgcuuccuuucucagcugaaccccuacccggagcccccagcagggcccuccgagguggaac

SEQ ID NO: 482390 - RNA, 63 nt, Human
acaggaagucacaguggugcccagggaugugucagcccccagccacggggacgcgggauucaa

SEQ ID NO: 482391 - RNA, 63 nt, Human
aauagaaaaaucuaauucaauaaacucuguaucagcccccaacauauuauuuuucauuauuug

SEQ ID NO: 482392 - RNA, 63 nt, Human
uuauaagggcacuaaccccauucaugagagcagagcccccauggccuaaucaccuuuccaagg

SEQ ID NO: 482393 - RNA, 63 nt, Human
agugaauuuuuuuauauuaaaagguugagccaaagcccccaguguuuguauuuugaagccaag

SEQ ID NO: 482394 - RNA, 63 nt, Human
ccugauccucugcuuccuccucacaaccccaagagcccccagcccgguccauccacgucugga

SEQ ID NO: 482395 - RNA, 63 nt, Human
aguaagggaaccccaggcaggcggcccugccacagcccccaaagacacuggccuccugcucca

SEQ ID NO: 482396 - RNA, 63 nt, Human
ugcaaggccuucacgccugccagggucagcugcagcccccacucugccaagguggggaguggu

SEQ ID NO: 482397 - RNA, 63 nt, Human
aggagugggcccuggaguccugucccucccagaagcccccagggugggauuucucaggcugcc

SEQ ID NO: 482398 - RNA, 63 nt, Human
ugaccugcugggccaggcugcccugggacucucagcccccaguugcuuauccagaugugacag

SEQ ID NO: 482399 - RNA, 64 nt, Human
agucccgccuggugggcauuugccgccgccuccccaccaccagucacugccucgcagagcccua

SEQ ID NO: 482400 - RNA, 64 nt, Human
agguggcacaucuggagggcagggguugaggggccaccaccacacaugccuuucuggggugaag

SEQ ID NO: 482401 - RNA, 64 nt, Human
accugugugcagugcccuugccugccuucacccccaccaccacuucuccaauaaagccgccugg

SEQ ID NO: 482402 - RNA, 63 nt, Human
guuuggccacgcccugggccugggccacuccucagcccccaacuccauuaugaggcccuucua

SEQ ID NO: 482403 - RNA, 63 nt, Human
ccuccuguagggcacaaggccaggcugccucccagcccccaggcccucucccaccuacagaga

SEQ ID NO: 482404 - RNA, 63 nt, Human
ccaacccugcaaucaccuugaucuugggcuuucagcccccaaaggugugagaaaauaaacuuc

SEQ ID NO: 482405 - RNA, 63 nt, Human
ccugcaaccaguaucuccuuggaauucauccaaagcccccauggacgcauggacgcagggcga

SEQ ID NO: 482406 - RNA, 63 nt, Human
gguggccagcaggacucugcccagaccacacguagcccccaggcugcuggacacgucggacag

SEQ ID NO: 482407 - RNA, 63 nt, Human
agggccugacacucuccuaagagguucucuccaagcccccaaauagcuccaggcgcccucggc

SEQ ID NO: 482408 - RNA, 63 nt, Human
aggagagucuguugcuggcauagcccuggaaggagcccccagccucuccccuccuccuccuug

SEQ ID NO: 482409 - RNA, 63 nt, Human
aggggcgcucggcagcccacagggccuggccucagcccccacuccuguuccuugugcacccac

SEQ ID NO: 482410 - RNA, 63 nt, Human
uugugccagagaacccagcccacccccggcagcagcccccagcucccaccuccccuugggccc

SEQ ID NO: 482411 - RNA, 63 nt, Human
accuucucccugccuucucucuucucucgucugagcccccaggccuuuuccacuuugagggag

SEQ ID NO: 482412 - RNA, 63 nt, Human
ggcuuccuggcgcccccuaucgggggugagcgaagcccccacuacuaaauggccucucuccac

SEQ ID NO: 482413 - RNA, 63 nt, Human
cuucugugcucgcagagcaggggaacaggacucagcccccaucaccguggagccaaaguguuu

SEQ ID NO: 482414 - RNA, 63 nt, Human
agcuagaagggccggugggcaccggggccgggaagcccccaccucaccaccugagggccccug

SEQ ID NO: 482415 - RNA, 63 nt, Human
ucggcacuagaauucgccacucucccaccccccagcccccaccucugccuccaggucucaucu

SEQ ID NO: 482416 - RNA, 63 nt, Human
aggccauagcaauuccccuacaucaaaugcucaagcccccagcuggaaguuaagagaaaguca

SEQ ID NO: 482417 - RNA, 63 nt, Human
uuauuuagcauuucgaacaucucggccauucaaagcccccauguucucugcacuguuuggcca

SEQ ID NO: 482418 - RNA, 64 nt, Human
acauacacacacacggaccaaaauacuuacaccugcaaaggaauaaagaugugagaguaugucu

SEQ ID NO: 482419 - RNA, 64 nt, Human
aaaugaacuugaaagguugccuggacucgcuggagcaaaggaaagcgauuuuguuuguauaauu

SEQ ID NO: 482420 - RNA, 64 nt, Human
ccggcacgccacggccccucccccaaggaacagagcaaaggaugguggccgcaggccccacgcg

SEQ ID NO: 482421 - RNA, 64 nt, Human
uccaaugcaaggaggcagggaagaaagggggccugcaaaggaagcaguagagugacuuaaacau

SEQ ID NO: 482422 - RNA, 63 nt, Human
cccgagcccugacuccuggacuccggaggacugagcccccaccggaacugggcuggcgcuugg

SEQ ID NO: 482423 - RNA, 63 nt, Human
uccccgaucugccuccagccccaagaugccuacagcccccaggccccuucggcagcacugccu

SEQ ID NO: 482424 - RNA, 63 nt, Human
caugagaggcagcgcccgccacccuguguccacagcccccaccuucccgcuucccuuagaacc

SEQ ID NO: 482425 - RNA, 63 nt, Human
ucucuucucuaccagcugccgcggcgggggcaaagcccccagagccucacuggccccggcggg

SEQ ID NO: 482426 - RNA, 63 nt, Human
ucacugcguuugguuuucuuuucagaacuugggagcccccagggaggggcuaguguugguagg

SEQ ID NO: 482427 - RNA, 63 nt, Human
acucaaagggaaaccccccagucacccacugucagcccccaucugacaagaaagccuggagcg

SEQ ID NO: 482428 - RNA, 63 nt, Human
aucuguuuagcuuuuaugaagagucaccguagcagcccccacggcuggaaagaggccuguacg

SEQ ID NO: 482429 - RNA, 63 nt, Human
gguggagggaaggauaaagccacuucuggcuucagcccccaccaggggaaggaaggagggcac

SEQ ID NO: 482430 - RNA, 63 nt, Human
agcagcagcgucaguggacccagugcugagaaaagcccccacaucccggaaaacccacuuucc

SEQ ID NO: 482431 - RNA, 63 nt, Human
ugcagaaguacccauucaucacaccugccccauagcccccacucugcuguacugauaggauuu

SEQ ID NO: 482432 - RNA, 63 nt, Human
ucagcucuguccacgcuucgauaggccugacgcagcccccagcccagggccgcccuagcaacu

SEQ ID NO: 482433 - RNA, 53 nt, Human; identical to SEQ ID NO: 208338

SEQ ID NO: 482434 - RNA, 63 nt, Human
cagggcuacccacugcuuacucagggaccaggcagcccccauggcaguaaaagcagccuagac

SEQ ID NO: 482435 - RNA, 63 nt, Human
ucuccggcuuccagggagaccuccccgcccagcagcccccagagacacaacaaccuaccuucc

SEQ ID NO: 482436 - RNA, 63 nt, Human
ugccucaggaccuuuuggucuucagccucccucagcccccaggaucuggguuagguggccgcu

SEQ ID NO: 482437 - RNA, 63 nt, Human
ccucugcuucuuugccucccucagauagaaaacagcccccacuccaguccacuccugaccccu

SEQ ID NO: 482438 - RNA, 64 nt, Human
gugaugacuaucccauaucacagauaugauuuaccaccaccacccugcccccgcucccgugaag

SEQ ID NO: 482439 - RNA, 64 nt, Human
uuuugauuguuuucaauuucuucuuuuauguucacaccaccacauucccauucacuuugauuuu

SEQ ID NO: 482440 - RNA, 64 nt, Human
ccuccuagccccaugugaugugaaaacuaaaaggcaccaccaacuagacauguguucauaaauu

SEQ ID NO: 482441 - RNA, 64 nt, Human
cuuagccuccugaguagcugggacuacaggcaugcaccaccacgcccagcuaauuuuuguguuu

SEQ ID NO: 482442 - RNA, 63 nt, Human
ccucaacucacccccuacacacacaugagagagagcccccacccaguuccuuggccuaggucu

SEQ ID NO: 482443 - RNA, 63 nt, Human
cucccgucagggcccacaucaucuaggcuccccagcccccacugugaaggggcuggccagggg

SEQ ID NO: 482444 - RNA, 63 nt, Human
gauaaguugguccucccucugccuuuccucucaagcccccaaagagcaaaggcaacagcaaga

SEQ ID NO: 482445 - RNA, 63 nt, Human
uccacagcagucugagcuggcaggucauggagcagcccccaaagagcuguggcuggggggaug

SEQ ID NO: 482446 - RNA, 63 nt, Human
gugcugcuuacacuccagguguggaccggccgcagcccccacugaccugcccauguccagagg

SEQ ID NO: 482447 - RNA, 63 nt, Human
uuggauaccaaagguuucucauguuaauuucucagcccccaaagaagcaucuuacuccugaac

SEQ ID NO: 482448 - RNA, 63 nt, Human
ccuuaucauuuucucccuaggacauucccuuguagcccccagaauugucuggcccaaauugaa

SEQ ID NO: 482449 - RNA, 63 nt, Human
aggcaucccaguucuaaggcugcugcuaauuacagcccccaaccuccaacccaccagcugacc

SEQ ID NO: 482450 - RNA, 63 nt, Human
cuccacaagccuaguccauccugccugagcuccagcccccagcccccacugugcccagacaug

SEQ ID NO: 482451 - RNA, 63 nt, Human
agccuaguccauccugccugagcuccagcccccagcccccacugugcccagacaugugugcuc

SEQ ID NO: 482452 - RNA, 63 nt, Human
ccggggugggguggcugcagccucaggacugggagcccccagccugucagauccaggagcucc

SEQ ID NO: 482453 - RNA, 63 nt, Human
augaaacucaccagcgagaacaaacaccuccccagcccccagcccuccccgcagugggaagug

SEQ ID NO: 482454 - RNA, 63 nt, Human
gccuuaagcuuuccaggggccggggcaguggggagcccccaucccuucacaccgccaccaacu

SEQ ID NO: 482455 - RNA, 63 nt, Human
ccacaggccaacccuggcacaggucaugucugcagcccccagaauguucuggacaugcaccac

SEQ ID NO: 482456 - RNA, 63 nt, Human
cgcugcccagaagagaccagcaagccaaacuggagcccccauugcaggcugucgccaugugga

SEQ ID NO: 482457 - RNA, 63 nt, Human
cgcucacuucgcucgcuccgcgucccccaugccagcccccaacgcagggcgcccggcgaagcc

SEQ ID NO: 482458 - RNA, 64 nt, Human
ugggguucgagccccacuucugguugcauguucccaccaccacgcucugcugguuuuagucggc

SEQ ID NO: 482459 - RNA, 64 nt, Human
uggcccugcaaggcccgcuuuucagggaccaguccaccaccaucuccuccacguugagugaagc

SEQ ID NO: 482460 - RNA, 64 nt, Human
cauggcuggugccugaagaccccagaugugagggcaccaccaagaauuuguggccuaccuugug

SEQ ID NO: 482461 - RNA, 64 nt, Human
ccucagcccccagguaacugggacuacaggcaugcaccaccaugccuggcuaauuuuuguauuu

SEQ ID NO: 482462 - RNA, 63 nt, Human
cggaggaaauccugaagcugacccucaccuccgagcccccacucccaccccagccgcacaguu

SEQ ID NO: 482463 - RNA, 63 nt, Human
gccauggggagggaaggacuuucucccaggggaagcccccagcccugugggucauggucugug

SEQ ID NO: 482464 - RNA, 63 nt, Human
uggcugggcaagugggaaccacuaucucuugggagcccccaaaagcugggaaaugcuggagga

SEQ ID NO: 482465 - RNA, 63 nt, Human
gccaucuaagcgucgccacccuuugguuauuucagcccccaucacccaagccacaagcugacc

SEQ ID NO: 482466 - RNA, 63 nt, Human
ugagcaauauacuuaaccugaaucucuacucacagcccccaccagcucugaaugucuaaccug

SEQ ID NO: 482467 - RNA, 63 nt, Human
cagccguuccuccaccucucagccauaucuuucagcccccacuccccuggauccgugugugug

SEQ ID NO: 482468 - RNA, 63 nt, Human
cccagacacaacaccauguggucuggaggucccagcccccacccuaaaaagguuaucccugag

SEQ ID NO: 482469 - RNA, 63 nt, Human
agacaaguguguguguggaccauccgcaccuccagcccccaccccacccucuuugucucagcg

SEQ ID NO: 482470 - RNA, 63 nt, Human
uuuucuuuugccuuugcccgccccccuguccccagcccccagagcgcagggacacccccaucc

SEQ ID NO: 482471 - RNA, 63 nt, Human
uuucucacugaacuccaccgaccaacugcccuaagcccccagggccuccagggcccagguucg

SEQ ID NO: 482472 - RNA, 63 nt, Human
gcccaggccucugcccucugcccacccagcgucagcccccagaaaaaaggcaauaaagacgag

SEQ ID NO: 482473 - RNA, 63 nt, Human
cuccccuaggucacaacucugggaaggauacagagcccccacccuucacugaguucucuggau

SEQ ID NO: 482474 - RNA, 63 nt, Human
ccuccugaccugugacccccugccacaauccuuagcccccauaucuggcuguccuuggguaac

SEQ ID NO: 482475 - RNA, 63 nt, Human
ucccugcggguaucccggggggcacuggaugcgagcccccaggucugacguccuugggggugg

SEQ ID NO: 482476 - RNA, 63 nt, Human
ggagccugcagucacuggcuuggcuuuacuuugagcccccaaccccccucucccagcccuggu

SEQ ID NO: 482477 - RNA, 63 nt, Human
ggccaagggccauggggaagauggagcaaaccuagcccccaagccggugggcuagaaaguaca

SEQ ID NO: 482478 - RNA, 62 nt, Human
cccccuccuccggauggcacaggcucugcuagguuccggacacaggcuucugggggaagggu

SEQ ID NO: 482479 - RNA, 64 nt, Human
cucggccucuccaguagcugggauuacaggugugcaccaccacgccuggcuaaauuuuguauuu

SEQ ID NO: 482480 - RNA, 63 nt, Human
aaaggguuuuaaagcccaugccccaacucugccagcccccaccugccaggacguucuagcagg

SEQ ID NO: 482481 - RNA, 63 nt, Human
uugggaagcagcuccugcugggagcauggccucagcccccagcaucuccuggggcccccaugg

SEQ ID NO: 482482 - RNA, 63 nt, Human
gcaaggugcuagaccaaugggcugcaguauuauagcccccaggccuggcaggcaugcgcuggg

SEQ ID NO: 482483 - RNA, 63 nt, Human
ccuguuaagacuccugacccccaaguggcaugcagcccccaugcccaccgggaccuggucagc

SEQ ID NO: 482484 - RNA, 63 nt, Human
guggggagaaacaggcccuccuuguccuugugcagcccccacuuuuguccuggcugugggugg

SEQ ID NO: 482485 - RNA, 63 nt, Human
uccuggcccuuucaguuuuauaaguugguuuccagcccccaguguccugacuucugucugcca

SEQ ID NO: 482486 - RNA, 63 nt, Human
cccuaaggcguccucgagaugaagacgggggggagcccccagccagguggagaccccgcaggg

SEQ ID NO: 482487 - RNA, 63 nt, Human
gguguggagggaaaugcccuggucuggccuccgagcccccagguccaccgucuccccuccccu

SEQ ID NO: 482488 - RNA, 63 nt, Human
accucagcgguuagccugacucuucuuccccccagcccccacccacugcuguguugugugugc

SEQ ID NO: 482489 - RNA, 63 nt, Human
ucggccucccaaaguacugggauuacaggcgugagcccccacgcuggccugcuuuacguauuu

SEQ ID NO: 482490 - RNA, 63 nt, Human
ggggagcuugggcauccuccuccagccuccuccagcccccaggcagugccuuaccuguggugc

SEQ ID NO: 482491 - RNA, 63 nt, Human
ccaccgugcccagccccucaguagguuuuaaggagcccccagcccuccucccuucugggcccg

SEQ ID NO: 482492 - RNA, 63 nt, Human
caacucagggccgcugugagcaaagcugaccccagcccccacccccaguuaacacugcugcuu

SEQ ID NO: 482493 - RNA, 63 nt, Human
ccccagcaaguccucuggcaagccggaggacgcagcccccaagaccagcggacagcgccagaa

SEQ ID NO: 482494 - RNA, 63 nt, Human
cccgcgccucugccggacacggaccggccccucagcccccaccgaggacgcagccacuggggg

SEQ ID NO: 482495 - RNA, 63 nt, Human
gcccccuacccaauucugagcacacgguacuguagcccccaguuccucccuagccuuccaucc

SEQ ID NO: 482496 - RNA, 64 nt, Human
gacccagcucugcccucaagguggggauggaugggcaaaggagaguccugccuggcccuacgau

SEQ ID NO: 482497 - RNA, 64 nt, Human
cguuguauuugauaccccucccccccuuuuuuuggcaaaggaggggaaaggaagguuuaaaaua

SEQ ID NO: 482498 - RNA, 64 nt, Human
acccccugccaaaaaaaaaaaaaaaaaagccagggcaaaggaccuggcguggccacuuccuccu

SEQ ID NO: 482499 - RNA, 64 nt, Human
cugcauuuaaguagacuuuggaccguuaagcugggcaaaggaaaugacaaggggacggggucug

SEQ ID NO: 482500 - RNA, 63 nt, Human
ggguacccccaggaccagaagcucccccagcaaagcccccagagcccaggcucggccugcccc

SEQ ID NO: 482501 - RNA, 63 nt, Human
augacgagugaugccaggaagccaggccaccgaagcccccacccuacccuuauuccaugaaag

SEQ ID NO: 482502 - RNA, 63 nt, Human
ccuccacuuaccccaccccacccuugggcuaaaagcccccaggcgggcagggggugaccccug

SEQ ID NO: 482503 - RNA, 63 nt, Human
ggcacugucuuccuggccggggccugaaaccuuagcccccagccggccugagugggggauauu

SEQ ID NO: 482504 - RNA, 63 nt, Human
gugaagugccaacgcccuccccacccugggccgagcccccaccccucccugggcccccaagug

SEQ ID NO: 482505 - RNA, 63 nt, Human
cggcuccgcaggugaggagcccauggggcgggcagcccccagaaagcgggcagcaggccccga

SEQ ID NO: 482506 - RNA, 63 nt, Human
ccaccccuagcucagccagauccuuacacguggagcccccagcaugggaaugaggggcucugc

SEQ ID NO: 482507 - RNA, 63 nt, Human
ucuccugacuuuacguuggccccuccucugccaagcccccaggggagcccucccuggcguccg

SEQ ID NO: 482508 - RNA, 63 nt, Human
agaggccggcuggagccaggcccccucgcacgcagcccccaaaucauggacgcaccugugggg

SEQ ID NO: 482509 - RNA, 63 nt, Human
ugagagcucagaguuucugggguccucauuaggagcccccaucccuguguuccccaagaauuc

SEQ ID NO: 482510 - RNA, 63 nt, Human
acggggggaccgggugagccagugacccccuguagcccccagcuucaggccucagugucugcc

SEQ ID NO: 482511 - RNA, 63 nt, Human
gccuuguagggaggccucuacacagaagaaagcagcccccaugucccagccacuucugggucc

SEQ ID NO: 482512 - RNA, 63 nt, Human
gaucugagaggaggcugcugggccuucggggugagcccccagagcuggaccugagcuauucuc

SEQ ID NO: 482513 - RNA, 63 nt, Human
gcuaggcugaccccauccuccucucccuccaggagcccccagcauguccugaccugugcacgg

SEQ ID NO: 482514 - RNA, 63 nt, Human
gccccgggacccagcagagcugggggagggaucagcccccaaagaaaugggggugcaugcugg

SEQ ID NO: 482515 - RNA, 63 nt, Human
uugaugggggugggcagggggccaguugagccaagcccccagccccgaucugcagauccugcc

SEQ ID NO: 482516 - RNA, 64 nt, Human
gucugggccaggcagaggugcuccucauccaugacaccaccagucugaaugguccugggggcug

SEQ ID NO: 482517 - RNA, 64 nt, Human
augguccugggggcuggggcuggagaggccgcugcaccaccacccgagccugggagccagcguc

SEQ ID NO: 482518 - RNA, 64 nt, Human
gccuuuuaccuggauauaaauuaauugugccugccaccaccauccaacagaccuggugcucuaa

SEQ ID NO: 482519 - RNA, 63 nt, Human
agcugcuccuguggguugauggagcgucccugaagcccccagcccuggggauggggaaggaca

SEQ ID NO: 482520 - RNA, 63 nt, Human
cuuagaaugccacagucccccaacccuccacagagcccccagacccaccagaacuuccacaga

SEQ ID NO: 482521 - RNA, 63 nt, Human
uucuggccuccuaaggcuccccaccccgaaaucagcccccagccuuguuucugaugacagugu

SEQ ID NO: 482522 - RNA, 63 nt, Human
aggcagggacuguggcagcuuauguccaaagggagcccccaugcacaggaagccacaggguuc

SEQ ID NO: 482523 - RNA, 63 nt, Human
gccccuccgcagccccuucccuugcucggggaaagcccccaauucugcccacacccauuuauu

SEQ ID NO: 482524 - RNA, 63 nt, Human
cagacugagcccugcuggcggacuucaaggagaagcccccacaggggauuuugcuccuagagu

SEQ ID NO: 482525 - RNA, 63 nt, Human
uguagggguggggaccggggagcaccugccuguagcccccaucagacccugccccaagcacca

SEQ ID NO: 482526 - RNA, 63 nt, Human
uguggggucagugcuugggagccuguggccagcagcccccacugcaccccugcccccagguga

SEQ ID NO: 482527 - RNA, 63 nt, Human
cacccagcgaggaggggcgggggcaggggcugcagcccccagcgcugccuuugcggauucugu

SEQ ID NO: 482528 - RNA, 63 nt, Human
cucacuccgcuggugacuucguaccugcucaggagcccccacugucccagucccacucaggcc

SEQ ID NO: 482529 - RNA, 56 nt, Human; identical to SEQ ID NO: 208436

SEQ ID NO: 482530 - RNA, 63 nt, Human
ccuacggguggguucauuggccugggcccagcgagcccccaccugcauugaccuuaggcccau

SEQ ID NO: 482531 - RNA, 63 nt, Human
gcuccuggaacuucugccuccaccucgcuggggagcccccagggcugcuguggccacagcccu

SEQ ID NO: 482532 - RNA, 63 nt, Human
gggcaggaccugugagagccaccucacaggcagagcccccaccaggcagggcaaggagacucc

SEQ ID NO: 482533 - RNA, 63 nt, Human
cugccugaguugugugcauccaggggccuggugagcccccaggcugguggcauggccccccug

SEQ ID NO: 482534 - RNA, 63 nt, Human
gggcuggucaggcggaugaggucccuacucccgagcccccagccucacccacugcagggccag

SEQ ID NO: 482535 - RNA, 59 nt, Human
gcagccccguggacaugaagacacaaucucccacggacagcuuucccccuuccgcccuc

SEQ ID NO: 482536 - RNA, 59 nt, Human
uccaggggcccccggaaggcguggagacacccacggaccagggaggccaagcagccgag

SEQ ID NO: 482537 - RNA, 59 nt, Human
aucuggcuuuugagaacacaaacuuuucccccacggaccucccuuuaucacuuuaauag

SEQ ID NO: 482538 - RNA, 64 nt, Human
cugcuccgugagcugagucucccacugcccugcacaccaccacauuggaccugugcuguccugg

SEQ ID NO: 482539 - RNA, 63 nt, Human
agcugagcacagaccagcagcgaccucccuuccagcccccagaaagcucggucacuugagugu

SEQ ID NO: 482540 - RNA, 63 nt, Human
cccuccuccacucccuuuuuguaacucccuuacagcccccagacccuucuugaaacgagagcc

SEQ ID NO: 482541 - RNA, 63 nt, Human
gugcucuuagaaacacuaauguuccucuggggcagcccccaccuccguccugacccgacgggg

SEQ ID NO: 482542 - RNA, 63 nt, Human
gccguggagcuguggaauugggccccguggcagagcccccaucccuugggggcuguggggaug

SEQ ID NO: 482543 - RNA, 63 nt, Human
ccacaccucuaggucgccagagcccuggcccccagcccccagcaagccugagcccgggaagaa

SEQ ID NO: 482544 - RNA, 63 nt, Human
ggggccaggacugcgcucaggaucccgccccggagcccccagcccgggggagagggggaggga

SEQ ID NO: 482545 - RNA, 63 nt, Human
uuucuaaguuuuauuuuucaaaccaccccggacagcccccagcucugauuccuucaaggcccg

SEQ ID NO: 482546 - RNA, 63 nt, Human
gugaccuuguauuuaugaggccucugugaggccagcccccaccuuccucuuucccaccugucc

SEQ ID NO: 482547 - RNA, 63 nt, Human
aggguauggaaagaggggcucacgcuuaacuccagcccccacccacacccccaucccacccaa

SEQ ID NO: 482548 - RNA, 63 nt, Human
guccucaguaagguuuuccauuuaaugaaaagcagcccccaaaaucauuuucuuuucuaacaa

SEQ ID NO: 482549 - RNA, 63 nt, Human
cacugcgaugggggucaccaggugaccagugggagcccccaccccgagucacaccagaaagcu

SEQ ID NO: 482550 - RNA, 63 nt, Human
ccuuaggggugaccugggcccaagucucucaucagcccccaauccccuggguaccaggcuucu

SEQ ID NO: 482551 - RNA, 63 nt, Human
gccaggggcggaggugggugucccccaggucucagcccccaaggcugcccccucagcagaggc

SEQ ID NO: 482552 - RNA, 63 nt, Human
cagggcuccuguggggaggccuuggccugugacagcccccaggccugggggcacagauccccc

SEQ ID NO: 482553 - RNA, 54 nt, Human; identical to SEQ ID NO: 208464

SEQ ID NO: 482554 - RNA, 63 nt, Human
aagcggaacacccugccccagggccggacuuccagcccccagagcccucucccugucacuccc

SEQ ID NO: 482555 - RNA, 59 nt, Human
ggcgccccccccucuaaggguccucuggccccacggacagcaggacccggacacccugu

SEQ ID NO: 482556 - RNA, 59 nt, Human
agccugggcggcgugagcucuguguuggacccacggaggagggagucacugcagggaaa

SEQ ID NO: 482557 - RNA, 59 nt, Human
cauugggacugguuagacagugggugcagcccacggagggugagcugaagcaggguggg

SEQ ID NO: 482558 - RNA, 64 nt, Human
cucagccucccgaguagcugggaguacaggugcacaccaccaugccuggcuaauuucuguauuu

SEQ ID NO: 482559 - RNA, 63 nt, Human
gggagcaggucacaggucaccauggggaauucuagcccccacuggggggauguuacaacacca

SEQ ID NO: 482560 - RNA, 63 nt, Human
cgcuacaucccuugcccccuguccauuuauuuaagcccccauaggugcccuucacccccaaaa

SEQ ID NO: 482561 - RNA, 63 nt, Human
cucccaccccaaacuccaaccuguaucagaugcagcccccaagcccuuagacucuaagcccag

SEQ ID NO: 482562 - RNA, 63 nt, Human
ccccugccugcucucuuucccuacaacuaggucagcccccagccccgcuacggcggccgcacc

SEQ ID NO: 482563 - RNA, 63 nt, Human
cuagccuaucuccugugccccugacugagcagaagcccccacagcuggccagcagccccgccu

SEQ ID NO: 482564 - RNA, 63 nt, Human
agagcaguugcuucaggcguuuucuccccaccaagcccccacccuugcugugucaccaucacu

SEQ ID NO: 482565 - RNA, 63 nt, Human
ggcuugucuagccccccugcugggugcuuguucagcccccacucugggcuguggagugggugg

SEQ ID NO: 482566 - RNA, 63 nt, Human
ugcccaggucaggaguguuuucuuggugguuccagcccccaucaauugaacuguuucugggcu

SEQ ID NO: 482567 - RNA, 63 nt, Human
acucuugcaauccacaaucugacauucucaggaagcccccaaguugauauuucuauuuccugg

SEQ ID NO: 482568 - RNA, 63 nt, Human
gugcuucuggauucaugggugaguucccugggcagcccccaggaaggccuuccagaucuggcu

SEQ ID NO: 482569 - RNA, 63 nt, Human
gucauccaugcgugcacauaugggugcuggcagagcccccaaggacucuggccucucgaguuc

SEQ ID NO: 482570 - RNA, 63 nt, Human
uggccauggguccuugcccccgacagacagagcagcccccacccgggagccuugauggggguc

SEQ ID NO: 482571 - RNA, 63 nt, Human
gucccucccaccacccucgccgcaggcagcugcagcccccagaggggaccacaagcccaaaaa

SEQ ID NO: 482572 - RNA, 63 nt, Human
gggccagcacagaggggccuuccucccccacagagcccccaugacauagucugcucugggcgg

SEQ ID NO: 482573 - RNA, 63 nt, Human
ucagcugaaucucucugaccauuccucuacuggagcccccaaugaaagccgcaaaccuauacc

SEQ ID NO: 482574 - RNA, 63 nt, Human
ucccacccugucuucuccccuaggugguuccugagcccccacccccaaucccagugcuacacc

SEQ ID NO: 482575 - RNA, 64 nt, Human
gccagcccaccagcagccccacucacagcugcugcaccaccaccuuccgcaggaugcacaggug

SEQ ID NO: 482576 - RNA, 64 nt, Human
guugcagcccccagauguguggccaaccucugcugcaaaggaaucucuugcugaguccaggcca

SEQ ID NO: 482577 - RNA, 64 nt, Human
ugcugcuggcuuucuaucauuuuuauguuuuaaugcaaaggaaauuuuaaaauguucuggaagu

SEQ ID NO: 482578 - RNA, 64 nt, Human
aaugaaucguaaccaaaacuacaguugauccuccgcaaaggaaagcucuuuacccagaaugucc

SEQ ID NO: 482579 - RNA, 63 nt, Human
gaagguccagccuaggcccccugcaaggcuggcagcccccacccccaccccccaggccgccuu

SEQ ID NO: 482580 - RNA, 63 nt, Human
ccugagguuggcgucuuccuacgucccagaagcagcccccaccccacacaugacccacaccgc

SEQ ID NO: 482581 - RNA, 63 nt, Human
gaggaacauuuccucaguguagccuaacaaugcagcccccaaucuguuccuuuuuuuuuuuga

SEQ ID NO: 482582 - RNA, 63 nt, Human
aaucggcggauugucugaaugacacauauacagagcccccacggauuucugcacacucugggu

SEQ ID NO: 482583 - RNA, 63 nt, Human
cgccuaagggaccccugcucccagccugcugagagcccccaccuugaucccaauccuuauccc

SEQ ID NO: 482584 - RNA, 63 nt, Human
uuucccuccuugucuggccccaguggucuggggagcccccaggcacaccuaagcgucguggag

SEQ ID NO: 482585 - RNA, 63 nt, Human
uccgagccugcuaccugguugccaaccuucccuagcccccaaaccgaagccaucugccaaauu

SEQ ID NO: 482586 - RNA, 63 nt, Human
uuggacaacuggccuggccgcucccauccuguaagcccccaccacggggagacccucaucccu

SEQ ID NO: 482587 - RNA, 63 nt, Human
agcagcgagcuggucuggcgagggcaccucggcagcccccacggguuggcuccuacguuugcg

SEQ ID NO: 482588 - RNA, 63 nt, Human
auuuucaggaagaaagggaaauugcagccccucagcccccaggauugaccucuggggagugau

SEQ ID NO: 482589 - RNA, 63 nt, Human
cuucugaggccagccaugcccacgccccuccccagcccccacccaugccagcgcagcgccagg

SEQ ID NO: 482590 - RNA, 63 nt, Human
cggauggccggagaggaccggcggcucggaggaagcccccaccgugggcagggagcggccggc

SEQ ID NO: 482591 - RNA, 63 nt, Human
gcaugggcacuacucuucaugugcggugacaccagcccccagaugccuugaauuaaguguccu

SEQ ID NO: 482592 - RNA, 63 nt, Human
aaaagcaacgggaaaugugguccuauuuaagccagcccccaccuagggucuauuuguguggca

SEQ ID NO: 482593 - RNA, 63 nt, Human
uggacucccagacugcaggggagcacuuggggcagcccccagaaggaccacugcuggauccca

SEQ ID NO: 482594 - RNA, 63 nt, Human
uguucuggucucagccgcucccuuggcagcugcagcccccaugcagaagaggcucccaggccc

SEQ ID NO: 482595 - RNA, 64 nt, Human
aucuggaccccagagccagcccucccacuaccaccaccaccaccccggggcuccuuggcucacc

SEQ ID NO: 482596 - RNA, 64 nt, Human
aucaucuggaccccagagccagcccucccacuaccaccaccaccaccccggggcuccuuggcuc

SEQ ID NO: 482597 - RNA, 64 nt, Human
cuaccauucucguuuuggaggaaacaaucucugccaccaccaagucauugacuuugcucgaggc

SEQ ID NO: 482598 - RNA, 63 nt, Human
cggacuguucccgacccggagacgcggggccacagcccccagcugacccuaauuuauucucag

SEQ ID NO: 482599 - RNA, 63 nt, Human
ccaucacccagcaccccagaucaccgccaggccagcccccaaugguccccuuacggacagguc

SEQ ID NO: 482600 - RNA, 63 nt, Human
gcuggcaccaaagagcuugggcccgugcugaccagcccccaaggcccucuggccggaccaugc

SEQ ID NO: 482601 - RNA, 63 nt, Human
accagaggcccacauggaugccacuccccacacagcccccaggccugcccagcccaccuccuc

SEQ ID NO: 482602 - RNA, 63 nt, Human
accgggggcuucuugccucaguucuucccucugagcccccaggcccucccgcaucucagguug

SEQ ID NO: 482603 - RNA, 63 nt, Human
uggaaggaggaagggcugaccuggguucucuccagcccccaggugcgccgggucacccgugcc

SEQ ID NO: 482604 - RNA, 63 nt, Human
ggcuggcccgggccaugggcugcgcaaaucaccagcccccaacccagggaggaacuggccccu

SEQ ID NO: 482605 - RNA, 63 nt, Human
ggccagggggguggggggccgcccucaucaggcagcccccagcccccugaggcccuguccauc

SEQ ID NO: 482606 - RNA, 63 nt, Human
ggaucuggggcuuccuggccuggccagagcuggagcccccacaggguaaggaagagagagugg

SEQ ID NO: 482607 - RNA, 63 nt, Human
gggucagcagagcuucagagguggccccaccugagcccccacccgggagcaguguccugugcu

SEQ ID NO: 482608 - RNA, 63 nt, Human; identical to SEQ ID NO: 482594

SEQ ID NO: 482609 - RNA, 63 nt, Human
gguucgauucugccucuguagcucaaggggggcagcccccagaguccugugcauucugccaag

SEQ ID NO: 482610 - RNA, 63 nt, Human
ccaugcagagcccuggccgcuggagacucuuaaagcccccacagcccuccagguccuccagcu

SEQ ID NO: 482611 - RNA, 63 nt, Human
gcagcucgaagaccauccuggccauagcagccaagcccccauucccagagcagacccucuccc

SEQ ID NO: 482612 - RNA, 63 nt, Human
agggugagacagcagggcccaggggaguggaccagcccccagcaaauuaucaccaucugugcc

SEQ ID NO: 482613 - RNA, 63 nt, Human
cugucccaguuuaucaggaacgcaggccuggggagcccccaguggcggggacagggccagauu

SEQ ID NO: 482614 - RNA, 59 nt, Human
ccaagggguacccccaccccgcuaccuuccccacggacgggccccuccuggagcccaua

SEQ ID NO: 482615 - RNA, 59 nt, Human
ccugguaaccagcccaucagcacacggcucccacggagcaucucagaagauugggccgc

SEQ ID NO: 482616 - RNA, 59 nt, Human
accaaaaaguccuaaccccugcucggggccccacggaugcugguggacugugugccccu

SEQ ID NO: 482617 - RNA, 64 nt, Human
ccucagccucccuaguagcugggacuacagcacccaccaccacacccagcuaauuuuuguauuu

SEQ ID NO: 482618 - RNA, 63 nt, Human
ccuguuccagaggugcagacaagagguggcgagagcccccaucaugccccucaaccuaucccg

SEQ ID NO: 482619 - RNA, 63 nt, Human
ugugccaauaaccucauucuuugucugagaaacagcccccaguccuccuccacuacaaccucc

SEQ ID NO: 482620 - RNA, 63 nt, Human
cucccugagggccugccgggcugccucugccccagcccccagcaagggcacucccaggcuucc

SEQ ID NO: 482621 - RNA, 54 nt, Human; identical to SEQ ID NO: 208529

SEQ ID NO: 482622 - RNA, 63 nt, Human
accacugcaucucacugggccagcagcccccccagcccccagccuugguggggaccaagcagc

SEQ ID NO: 482623 - RNA, 63 nt, Human
gaaagcauuugcccaucugccuuucuuucccccagcccccacccgcuuugaauguagagaccc

SEQ ID NO: 482624 - RNA, 63 nt, Human
gcagaagcacagacacuacagaccacagcauucagcccccauggaguuuggugugcuugccuu

SEQ ID NO: 482625 - RNA, 63 nt, Human
acagccccggcccucgacaguauugaggccccgagcccccagcacuuguguguacagcccccg

SEQ ID NO: 482626 - RNA, 63 nt, Human
aacaacgagcagaaggcccuggcgacugggcugagcccccaagugaaacugagguucaggaga

SEQ ID NO: 482627 - RNA, 63 nt, Human
gcggcuggagggaugccacaccccucacagggcagcccccaacuacaucuucccugcuuacuc

SEQ ID NO: 482628 - RNA, 63 nt, Human
cacacugaggccaggucuaccccccaucauaccagcccccaggaccacuaccccacggccagc

SEQ ID NO: 482629 - RNA, 63 nt, Human
uuaauguagccaugggaccaaaccuagccccuuagcccccacccacuucccugggcaaaugaa

SEQ ID NO: 482630 - RNA, 63 nt, Human
ugagcaccucgcucuggugcccgucugugugggagcccccacuguaacacucuaauaaaucag

SEQ ID NO: 482631 - RNA, 63 nt, Human
cagggaggccaucuggggcuccuucuccaccccagcccccaaagcagcccuucccccagugcc

SEQ ID NO: 482632 - RNA, 63 nt, Human
cuuuuggucccagagcugggguauguuggccccagcccccagccuguggcucccaaaaggccu

SEQ ID NO: 482633 - RNA, 63 nt, Human
uuugggcccugcagggggaggggugacagggcgagcccccaccccagcagcagcaauaccccc

SEQ ID NO: 482634 - RNA, 64 nt, Human
acagucccauuugcauaucacccuucccugcucccaccaccagugagacaagcugaagauuagg

SEQ ID NO: 482635 - RNA, 64 nt, Human
agaugcguccuauuguccuuaagagggcguuucacaccaccaacaguaagccacccacucugga

SEQ ID NO: 482636 - RNA, 64 nt, Human
aggcaaagagggaguuccugacugcuagaggugccaccaccacaaacacuuuuuauucaggaga

SEQ ID NO: 482637 - RNA, 64 nt, Human
guauauuacauauguucauaaguuguacaaccaucaccaccauccaucuucagaauuauuuuca

SEQ ID NO: 482638 - RNA, 63 nt, Human
cgccagccccaaacuaagauaucccucacacccagcccccauuaccuagggacaagagucuuc

SEQ ID NO: 482639 - RNA, 63 nt, Human
aaggcugcucagaggggccccgguccuggccccagcccccaccuccgccccagacacaccccc

SEQ ID NO: 482640 - RNA, 63 nt, Human
cccagcagcccucucuucccccaccuccccagcagcccccacccuugccccagcugggcucca

SEQ ID NO: 482641 - RNA, 63 nt, Human
agacaagaccuagaggguuugggacaaacugggagcccccaccccacacucuaguugcccaug

SEQ ID NO: 482642 - RNA, 63 nt, Human
uguacuauucauugauucagugaugugaaauugagcccccaaaagguuguuucugaagcucga

SEQ ID NO: 482643 - RNA, 63 nt, Human
aucaugaaugauaagcuguuucugagggaugccagcccccaagagacucagagugccuucucc

SEQ ID NO: 482644 - RNA, 63 nt, Human
cagauguggaggcccagggaauagacccucaagagcccccaagagacaggagagacuccgaac

SEQ ID NO: 482645 - RNA, 63 nt, Human
ugaagugcccuccagccucagagcuagccacaaagcccccagagcugaauucauugaguauuu

SEQ ID NO: 482646 - RNA, 63 nt, Human
ugggaaucgcuguguuauuugcaaagaaaaaacagcccccacuccuccuccugaguuccaggg

SEQ ID NO: 482647 - RNA, 63 nt, Human
cuccaguuucuuaaggaaaccacuggaaucugcagcccccacaugcaucugucuaacgcaugc

SEQ ID NO: 482648 - RNA, 63 nt, Human
agccuccuguagcccgccucaugcacugaccacagcccccaggggaggaugguacuggaucug

SEQ ID NO: 482649 - RNA, 63 nt, Human
ggugcccugagucuggggcccgugccagccggcagcccccaagccugccccgcuacccaagca

SEQ ID NO: 482650 - RNA, 63 nt, Human
cugaggccucugggucaagcuuucaucagccccagcccccacacuccaccaaaguucucaugc

SEQ ID NO: 482651 - RNA, 63 nt, Human
gagugaugcggccacaagcccagggacaccuggagcccccaggagcugggagaggcaggaagg

SEQ ID NO: 482652 - RNA, 64 nt, Human
agggcaggucucuugugcccuguucucuuguccccaccaccaaccuauagcaggcaccaaagca

SEQ ID NO: 482653 - RNA, 64 nt, Human
cucagccuccugaguagcuggcauuauaggugcccaccaccaugccuggcugauuuuuguauuu

SEQ ID NO: 482654 - RNA, 64 nt, Human
cucagccucccaaauagcugugauuacaggcgugcaccaccacgcccggcuaauguuuguauuu

SEQ ID NO: 482655 - RNA, 64 nt, Human
ggcaccacggccucacccaggcaucugcuuuacucuggaccauaggaaacaagaccguuuggag

SEQ ID NO: 482656 - RNA, 64 nt, Human
gagcaaaacuguauaaacugauuuguaacuaacacuggaccauuggaucgauauuauaugcugu

SEQ ID NO: 482657 - RNA, 64 nt, Human
uccacuccucuacccucugggcaccagaaggcuccuggaccaugagcuucacccccagaauucc

SEQ ID NO: 482658 - RNA, 64 nt, Human
ggacugaaggucuccuggaagcuucugggucucacuggaccaucaggacugcugccgccccucu

SEQ ID NO: 482659 - RNA, 64 nt, Human
cuaggcagggcugggaugaggcuuguacaacccccaccaccaauuucccagggacuccaggguc

SEQ ID NO: 482660 - RNA, 64 nt, Human
cucagccucccgaguagcugggauuaccggcacccaccaccacgccuggcuaauuuuucaauuu

SEQ ID NO: 482661 - RNA, 64 nt, Human
cacuggcaguugguggcagugagaccagcccacccaccaccacccaccacagaaaagcacaaac

SEQ ID NO: 482662 - RNA, 64 nt, Human
aggccugggccucugcguucccaagcugugcguucuggaccagcuacugaauuauuaaucucac

SEQ ID NO: 482663 - RNA, 64 nt, Human
ccugagcuugguccuuuuccucucugcuuggauucuggaccaccaccugggaccaaccuucagc

SEQ ID NO: 482664 - RNA, 64 nt, Human
ucaccccaucuugucacaucuggcccugaccccacuggaccaaaaggggcagcacuggugccca

SEQ ID NO: 482665 - RNA, 64 nt, Human
uuuuucacuguugacaagcgaggcaaggguugcacuggaccaaaggcugaggcuuggccaucua

SEQ ID NO: 482666 - RNA, 64 nt, Human
ugugcgugcgugcgugcgugcguguauguuuggucuggaccagcuucugccagccccuggccuu

SEQ ID NO: 482667 - RNA, 64 nt, Human
caagacugccaggugguuggguucugccuuuagccuggaccaaagggaagugaggcccaaggag

SEQ ID NO: 482668 - RNA, 64 nt, Human
agacgcaggcuugcugagggccucuggacacaggcuggaccagaugcuguggaugucgaccccu

SEQ ID NO: 482669 - RNA, 64 nt, Human
uaaauuuauacauagaaacaaauuuugccaauugcuggaccaauggcaaacauuagugccaaau

SEQ ID NO: 482670 - RNA, 64 nt, Human
uggccugaguggguagacgcaggcggcagaggugcuggaccacaucuccgccaagucacugccc

SEQ ID NO: 482671 - RNA, 64 nt, Human
gucugcccuccaccagagcuccugccugccaggacuggaccagagcagccaggcuggggccccu

SEQ ID NO: 482672 - RNA, 64 nt, Human
agacuaguugaagggaguucuggggccaggcucacuggaccauugucacaacccucuguuucuc

SEQ ID NO: 482673 - RNA, 64 nt, Human
uccccccagcuccuaguugauagaaauggggguucuggaccagaugaucccuuccaauguggug

SEQ ID NO: 482674 - RNA, 64 nt, Human
ccuccauccacacacagcagcuccaaccuggaggcuggaccaacugcuuuguuuuggcugcucu

SEQ ID NO: 482675 - RNA, 64 nt, Human
ggcccaggcugaagaccuggggacaggucgauugcuggaccagggcaaagaagaagcccugcca

SEQ ID NO: 482676 - RNA, 64 nt, Human
uucuaccaagacuggucaaauguugcugaggggccuggaccagcuguccuuuacaccaccuucu

SEQ ID NO: 482677 - RNA, 59 nt, Human
ucagcacacucuccugggccccaaggagucccacggaauggggaaagcgggaacccugg

SEQ ID NO: 482678 - RNA, 59 nt, Human
ccucagagugaaggcaggguggcagccuccccacggacuccaugcggcccgcuggcuca

SEQ ID NO: 482679 - RNA, 59 nt, Human
uuaugucuccgcuuuguaccauaaccgaacccacggaaagacgcugcgcgggugcagaa

SEQ ID NO: 482680 - RNA, 59 nt, Human
gaucgcuggugcugagcccugcccugggccccacggacagucagccugccggccucccu

SEQ ID NO: 482681 - RNA, 64 nt, Human
ccugcacccuccauagccaccaaaccuguuagaacuggaccaaucaaaccucaggcgaucaaaa

SEQ ID NO: 482682 - RNA, 64 nt, Human
gccucacagcccuugaguaaaauaaaagugauuucuggaccauccuuauugaacccuauauuuc

SEQ ID NO: 482683 - RNA, 64 nt, Human
ugagcugccacgcccagccccaguacacucuucucuggaccagaucugucccaguccuggaugc

SEQ ID NO: 482684 - RNA, 64 nt, Human
ggggucacaugcuuuguuuccauucuuguccuggcuggaccagccacugugggaccaacacccc

SEQ ID NO: 482685 - RNA, 64 nt, Human
ggcccaagagcauaugggcaauucggauuuccugcuggaccacaagguucuguugauauuacau

SEQ ID NO: 482686 - RNA, 64 nt, Human
aagugggugcaggaagguggcagugaccagcgcccuggaccaugcaguucggcggccgcggcug

SEQ ID NO: 482687 - RNA, 64 nt, Human
gggggccaggacgggaggcaggguggggggcaggcuggaccaccaccaucugcccuggcagccu

SEQ ID NO: 482688 - RNA, 64 nt, Human
cuggggccacacugcgggacagcagccccuccaccuggaccagggagggccuccaugugcaagc

SEQ ID NO: 482689 - RNA, 64 nt, Human
ugcugacacagacucacucagagacccuuagacacuggaccaggccuccucucagccuucucuu

SEQ ID NO: 482690 - RNA, 64 nt, Human
agcuuuguauguguccuuuugggggauaacagggcuggaccaugcuucccugcccuuaaacgca

SEQ ID NO: 482691 - RNA, 64 nt, Human
ugcuuugacccucacaucaagaaaucugaaugaucuggaccaggggucagcaaagugcagccua

SEQ ID NO: 482692 - RNA, 64 nt, Human
gucuugacugucacggaacagaucuuguucuuugcuggaccaucaagggucauggcagugccug

SEQ ID NO: 482693 - RNA, 64 nt, Human
uauugucccaucugugggccucauucugccaaagcuggaccaaggcuaaccuuucuaagcuccc

SEQ ID NO: 482694 - RNA, 64 nt, Human
uggaguaucacccuuccucccuccccaggcaccacuggaccaauuaccuuugaaugcuguauuu

SEQ ID NO: 482695 - RNA, 64 nt, Human
uacuaauacauucccuuccccauagccaucaaaacuggaccaacuggccucuuccuuuccccug

SEQ ID NO: 482696 - RNA, 59 nt, Human
aaaucaguuagaaccaauguauuucuugccccacggaacacuauuccuauaagauagcu

SEQ ID NO: 482697 - RNA, 59 nt, Human
gguuucggcccagccccagccugccggagcccacggagcuaccucuaccuccacuccug

SEQ ID NO: 482698 - RNA, 59 nt, Human
cugaggauagauggcacccauggcccccacccacggaaggacuugaguuguuuacaagc

SEQ ID NO: 482699 - RNA, 59 nt, Human
agaaggagagagacaguagccaagagaaccccacggacaagauuuuucauuucacccaa

SEQ ID NO: 482700 - RNA, 64 nt, Human
gaaagccaggacaucugaguaccuaucucacacacuggaccaccagucacaaagucuggaaaag

SEQ ID NO: 482701 - RNA, 64 nt, Human
guagaauugagucuuccaggggacucuaucagaacuggaccaucuccaaguauauaacgaugag

SEQ ID NO: 482702 - RNA, 64 nt, Human
uagauuagcucuggaccagccuguuggacccgcucuggaccaacccuguuuccugaguuuggga

SEQ ID NO: 482703 - RNA, 64 nt, Human
ugaaucaaagacauggaauuaccuuagauuagcucuggaccagccuguuggacccgcucuggac

SEQ ID NO: 482704 - RNA, 64 nt, Human
auaugagagacuggcagcuauuaacauugcaaaacuggaccauauuucccuuauuuaauaagca

SEQ ID NO: 482705 - RNA, 64 nt, Human
acaaacuugcagcaguuccuguuuuuugagccuucuggaccaacaaaauggcagcacauccugc

SEQ ID NO: 482706 - RNA, 64 nt, Human
ucccccgccuuuaguucuccacuggggaggaauccuggaccaagcacaaaaacuuaacaaaagu

SEQ ID NO: 482707 - RNA, 64 nt, Human
cuccaggagacuuucaugcagccuaaaguacagccuggaccaccccugguguguagcuaguaag

SEQ ID NO: 482708 - RNA, 64 nt, Human
gacccaucacuuuggacagaauuaggaccugguucuggaccaaguggguaagguaaguuuuuac

SEQ ID NO: 482709 - RNA, 64 nt, Human
gucgcgccugccccugccggcacggcucccccuccuggaccagucccccgcgagcccggagaag

SEQ ID NO: 482710 - RNA, 64 nt, Human
caucucucuggcuucugaagagccugaagcuggccuggaccauuccugucccuuuguuaccaua

SEQ ID NO: 482711 - RNA, 64 nt, Human
caaugacuguggaguuccauucuuggcaucuacucuggaccaaggagcaucccuaauucuucau

SEQ ID NO: 482712 - RNA, 64 nt, Human
ugagccccuucccugaggcugucuccugggaaugcuggaccagggggauuacuucccccaccca

SEQ ID NO: 482713 - RNA, 64 nt, Human
agagagggcaggugcccaccccacaggcccuuuccuggaccauggagccaggugaaaccugucu

SEQ ID NO: 482714 - RNA, 64 nt, Human
gcaaaugucuuuagaucuccaucucccccucgagcuggaccauuugguuacccucgggauggcc

SEQ ID NO: 482715 - RNA, 59 nt, Human
ugcacugcggucccucccccagcccgaggcccacggagguuccucgggggacagucuca

SEQ ID NO: 482716 - RNA, 59 nt, Human
gaggacccggugccugccuggcagaugugcccacggaggcccccagcugcccuccgagc

SEQ ID NO: 482717 - RNA, 59 nt, Human
uaaucagcccucugugacauagguagcagcccacggagauccuaagcuggcugucuugu

SEQ ID NO: 482718 - RNA, 59 nt, Human
uuugcacuucggaaccuguugcguuuugacccacggagguggaggaguaacuuuuugac

SEQ ID NO: 482719 - RNA, 64 nt, Human
caacaugacagccaucacuauggccugggcccgccuggaccacaaguuugaccugauguaugcc

SEQ ID NO: 482720 - RNA, 64 nt, Human
gagcagugcaggcagaguggagccuccugcucuccuggaccagcugcagacccccaacccuggu

SEQ ID NO: 482721 - RNA, 64 nt, Human
uuugccgagguggauguguuagucucaggcccuccuggaccacguugcccaagucacacaggcu

SEQ ID NO: 482722 - RNA, 64 nt, Human
cccugugaucccuucggcgccagcagcuccaaaacuggaccaccagagaauggacaccauccag

SEQ ID NO: 482723 - RNA, 64 nt, Human
acucuugagugucuccuuuugauagggauuguuucuggaccaguuugucuaaguccuggcucuu

SEQ ID NO: 482724 - RNA, 64 nt, Human
gaggcacauuccucuccaucuuuccaccgcacaccuggaccaggcuugcaggcugccagacguc

SEQ ID NO: 482725 - RNA, 64 nt, Human
ccagaagcagcaagggccaugggguggugcuucccuggaccagaacagacuggaaacugggcag

SEQ ID NO: 482726 - RNA, 64 nt, Human
caagcacagggcuaaggagggauagaguaggacccuggaccacauucggaaggggaacuuagag

SEQ ID NO: 482727 - RNA, 64 nt, Human
agaauuaaacuggaccaucucucuccauaucaaucuggaccaucucuccucugcuaaauuugca

SEQ ID NO: 482728 - RNA, 64 nt, Human
ggucuaccaguuacuauggaguaaaagaauuaaacuggaccaucucucuccauaucaaucugga

SEQ ID NO: 482729 - RNA, 64 nt, Human
cacugccagagccauuucugaucacaccaccauccuggaccaugugacuggaagguggguaacc

SEQ ID NO: 482730 - RNA, 64 nt, Human
ggucacugauauguaaaugacugcuagcccacggcuggaccacuucucaaucagcaaauaaagc

SEQ ID NO: 482731 - RNA, 64 nt, Human
ccuuaacuugaagcuacuuuuaaaauuugagggucuggaccaaaagaagaggaauaucagguug

SEQ ID NO: 482732 - RNA, 64 nt, Human
ccaccucucagccuuguuauuggguuucaugccccuggaccagccuuaucucagaccugcuuac

SEQ ID NO: 482733 - RNA, 64 nt, Human
auaagaagaguguucuucugguaaagcuaaaauucuggaccacugaagcuaaaagcccuauugc

SEQ ID NO: 482734 - RNA, 59 nt, Human
aacagacauaagaugucaucacgaaacugcccacggaucuuuaggcuuucugcauugac

SEQ ID NO: 482735 - RNA, 59 nt, Human
caugaccugggugcucugagcccacgguucccacggagcugacuucuccggggugccug

SEQ ID NO: 482736 - RNA, 59 nt, Human
ucugacgcauugacacgugagcacuggcucccacggagggugcgccugccgccagcggc

SEQ ID NO: 482737 - RNA, 59 nt, Human
acuccgcggcacaugcuucccaagguggucccacggaggguguuacugggcaccagugg

SEQ ID NO: 482738 - RNA, 64 nt, Human
uauuuuguuacugucuguaguguuuuguggaguacuggaccaaaaaaauaaagcauuauaaaua

SEQ ID NO: 482739 - RNA, 64 nt, Human
acagccaccuuggaaggccgcagugaggagcugucuggaccaguggggcaccuuggggcuagca

SEQ ID NO: 482740 - RNA, 64 nt, Human
ucuccuccauucccuauggguucugugaccacugcuggaccaaggacguggaugacccuccccu

SEQ ID NO: 482741 - RNA, 64 nt, Human
accaguguaugaauaagggaaagauuaauuuuggcuggaccaauauaaaaaauuguauuugaag

SEQ ID NO: 482742 - RNA, 64 nt, Human
auuucaugggauaauuagcaggcuggucuaccaccuggaccauguaacucuaguguccuuccug

SEQ ID NO: 482743 - RNA, 64 nt, Human
agcagcacauacuucugauugaggucucuaagagcuggaccaucagcagcagggagcugccuaa

SEQ ID NO: 482744 - RNA, 64 nt, Human
aaggucccugaggcccuagcuggggucaaggggccuggaccaguagaagccaucaaccuacuga

SEQ ID NO: 482745 - RNA, 64 nt, Human
ccugcuacuggacugccaccccccauugaagagacuggaccaccaggaaggucguuucacauuc

SEQ ID NO: 482746 - RNA, 64 nt, Human
uuuaugcaguagaugcuuucuuccuccugcaguucuggaccauguggagcuacauggagaaauu

SEQ ID NO: 482747 - RNA, 64 nt, Human
ucuuccauccaggagugugcuacugaggggcuggcuggaccaaccugcuggcucaggcauguga

SEQ ID NO: 482748 - RNA, 64 nt, Human
uucucagccuacauucauuugcaagcuucaaucucuggaccaucugguguucacagguguuaga

SEQ ID NO: 482749 - RNA, 64 nt, Human
uccuccaccugcuucuaaaaugcccagaagacaacuggaccaguuugguauuagaaguaggagg

SEQ ID NO: 482750 - RNA, 50 nt, Human
agagagaaccuauaaacuagcuggaccaugaucuaguucaaugauuuggc

SEQ ID NO: 482751 - RNA, 64 nt, Human
agugguggggcuugguuauccucuuguuuugugacuggaccacugcccaggugcuugaugauga

SEQ ID NO: 482752 - RNA, 64 nt, Human
cuaugcugaccucacucuugagcagcgcuuucagcuggaccacucaggccuggacagccucauc

SEQ ID NO: 482753 - RNA, 64 nt, Human
uguauggagcuuuguaucuuuaugaaagacugagcuggaccacccaugccaaggagcgagccuu

SEQ ID NO: 482754 - RNA, 64 nt, Human
cucauccucccaaguagcuggaacuacaggugugcaccaccaugccugguucauuuuuguguuu

SEQ ID NO: 482755 - RNA, 64 nt, Human
gaagggugggagggcgugggggccccuggguggacaccaccagccaccagucccuggcaugccc

SEQ ID NO: 482756 - RNA, 64 nt, Human
uuacuaaguccccucucccugauagggaauccugcuggaccagcgcagcccugguguggagagg

SEQ ID NO: 482757 - RNA, 64 nt, Human
gaggguggguguggggccugaggcuucacaguaccuggaccagcaggaagauucugggagguca

SEQ ID NO: 482758 - RNA, 64 nt, Human
aguccuggcuccaccacuccuccagccagagggucuggaccauccagugccuguccucgccaca

SEQ ID NO: 482759 - RNA, 64 nt, Human
ugaagagaggaaacuggcgaucucccagggcucucuggaccauacgcggaggaguuuucugugu

SEQ ID NO: 482760 - RNA, 64 nt, Human
gugcuugaccucaacacacuggauuccagguggacuggaccaagagcaggcaaagacacgggaa

SEQ ID NO: 482761 - RNA, 64 nt, Human
ucuggcagcagggacaccugggccaaugggccaucuggaccaaaggugggguguggggcccugg

SEQ ID NO: 482762 - RNA, 64 nt, Human
auguguacacucagaguccugcugccgcuccaggcuggaccagacccccauccccaccccuccu

SEQ ID NO: 482763 - RNA, 64 nt, Human
gauuuguuucccucugcuguggcggugacugcuucuggaccagaacagcuccagcucccaggua

SEQ ID NO: 482764 - RNA, 64 nt, Human
cuucccccugcaacugcagggccgcuucuggggccuggaccaccauggggaggaagagucccac

SEQ ID NO: 482765 - RNA, 64 nt, Human
caaugaguuuaugcuagaauuuuucacauggccacuggaccauuguggaaguagacugguugaa

SEQ ID NO: 482766 - RNA, 64 nt, Human
cauccugaagccuuccuccuggaugucagggaagcuggaccaccuggaguugauccucugugau

SEQ ID NO: 482767 - RNA, 64 nt, Human
gacaggauuuuuugugcuaccaauucuggccuuacuggaccauaaaguuaauuauagcuuugaa

SEQ ID NO: 482768 - RNA, 64 nt, Human
ugguuaaacauggcaccuacucagcaaugccuuccuggaccacaaccccuaucccccugcccca

SEQ ID NO: 482769 - RNA, 64 nt, Human
ucacuguauuuuguucauaguguauccccagagccuggaccagugcuuggcacauaggagaugg

SEQ ID NO: 482770 - RNA, 64 nt, Human
ucagagccgccacuccuauccccaggccaggucccuggaccagccuccuguuugcaggcccaga

SEQ ID NO: 482771 - RNA, 59 nt, Human
aaugcaaaaauaacaaaauaguuacugugcccacggagccuacccgauuauagcagagg

SEQ ID NO: 482772 - RNA, 59 nt, Human
gucacaugaauugaaaaggagacgcugcucccacggaggggagcaggaaugcugcacug

SEQ ID NO: 482773 - RNA, 59 nt, Human
aguccucacuguagaucucuaaauuucaacccacggaaaugaaagccuuuugucugaaa

SEQ ID NO: 482774 - RNA, 59 nt, Human
uccagcaaaaacagcagcccuaauagcagcccacggacuuuggggaggagcaaagggag

SEQ ID NO: 482775 - RNA, 64 nt, Human
cuaacagccuagacaaucucgucagaugcucauacuggaccaucagccuccccauuuuagcuga

SEQ ID NO: 482776 - RNA, 64 nt, Human
gcaguagucauagucuucacagguuuaggagcuacuggaccaacauucuuguuuuugcuuuugu

SEQ ID NO: 482777 - RNA, 64 nt, Human
ccuuccuuucccacuggcucuguauaaaaaacuucuggaccaaaagccaucauuggaagauuua

SEQ ID NO: 482778 - RNA, 64 nt, Human
gccugaaacaguguagggaaagaccugggaaacacuggaccaaaaaagccugaucucauggaga

SEQ ID NO: 482779 - RNA, 64 nt, Human
augaaaacaguucucuguuaccauauuuuguauucuggaccacuuacuggugaaagcaaccaug

SEQ ID NO: 482780 - RNA, 64 nt, Human
gacuuucuucuguuuuugagaagaguuucauaugcuggaccacauuuuagcuuuuauuguuuuu

SEQ ID NO: 482781 - RNA, 64 nt, Human
acggaacuaaagucugugacaguggauauagcugcuggaccauuccaucuuauauguaaagaaa

SEQ ID NO: 482782 - RNA, 64 nt, Human
agaacauagugaagauucccgccuuuggggaggucuggaccacccagggccuccacugccaccu

SEQ ID NO: 482783 - RNA, 64 nt, Human
accacacgcugagccagaccugcagagugggaagcuggaccagggcagcugcgcacuuaugagc

SEQ ID NO: 482784 - RNA, 64 nt, Human
agaugugaugauuuauauuuauguagagauauuucuggaccacucaagcucuucgauaccaaaa

SEQ ID NO: 482785 - RNA, 64 nt, Human
aaguuuagggagcugggacaccugguccugcuagcuggaccacuggcucaucaugcaaugaaaa

SEQ ID NO: 482786 - RNA, 64 nt, Human
gaaguuggagguguggagaguucaggagaggguucuggaccacagauguugaggugggagucau

SEQ ID NO: 482787 - RNA, 64 nt, Human
gccugugcucugggggucccuugcuuagccugugcuggaccagcuggccuggggucccucugaa

SEQ ID NO: 482788 - RNA, 64 nt, Human
auccauuauucuucucaacccaagaaccuguuuccuggaccagugaccaaaccucauaugugaa

SEQ ID NO: 482789 - RNA, 64 nt, Human
caccuuccugggaaaggccuccaaagcaaaggaucuggaccaguuucccugcugugcuguggcc

SEQ ID NO: 482790 - RNA, 59 nt, Human
ugaggcgcugcggaggccccuugucuguucccacggacgggggcucgggcgcggacuaa

SEQ ID NO: 482791 - RNA, 59 nt, Human
ccaggaaugcaagugguuuccuggugcuucccacggaggaguuuuggcagccagacuuc

SEQ ID NO: 482792 - RNA, 59 nt, Human
acaugcacguggcagaucaugauuuccagcccacggagccagcauuugaaccuuguaua

SEQ ID NO: 482793 - RNA, 59 nt, Human
cugaucugauccuuagggggugcccuggccccacggacccgacucagcuugagacacuc

SEQ ID NO: 482794 - RNA, 64 nt, Human
uccagccagugauccuuaaaagauuaagagaugacuggaccaggucuaccuugaucuugaagau

SEQ ID NO: 482795 - RNA, 64 nt, Human
uuaucacccagagagggacaagauaggacauggccuggaccagggaggcaggccucccacucag

SEQ ID NO: 482796 - RNA, 64 nt, Human
uugagguuugagguccuggucgagcagggcaguacuggaccaggucuacgucagcauucagguu

SEQ ID NO: 482797 - RNA, 64 nt, Human
caggcagggcacccaggccuuauaggaauucacccuggaccaugcccuaaaauaaccucacccc

SEQ ID NO: 482798 - RNA, 64 nt, Human
ccccuuccuccuccagagccugcucuaugcggaucuggaccaucuagcccucagcaggccccgc

SEQ ID NO: 482799 - RNA, 64 nt, Human
ugggcuggguccugggauggggggcuguguguggcuggaccaggugucuccccacgcuuaccuu

SEQ ID NO: 482800 - RNA, 64 nt, Human
uuguggccugcuugucccucuguugacuggucaucuggaccaucguacuugcuguggcuacuuc

SEQ ID NO: 482801 - RNA, 64 nt, Human
cuuaaucauuuuguaauuuugacucaauccuuuucuggaccauuuuuguuaauaaauaucaaag

SEQ ID NO: 482802 - RNA, 64 nt, Human
ucauuuucucaucauuaauuaugcacuuuguccucuggaccauuuuaaucuaaaauugcucuca

SEQ ID NO: 482803 - RNA, 64 nt, Human
uuaaaccugcugcacauuggacucaaaaggaaaacuggaccaacaauaauugaggaaauagacu

SEQ ID NO: 482804 - RNA, 64 nt, Human
aaguugucaucucucuguaauagauaauggcugacuggaccauaguuguucacuuuugucugcc

SEQ ID NO: 482805 - RNA, 64 nt, Human
ggcaagcagacucuuggccacguguuuccaguggcuggaccacgccgacaccugggaucuugag

SEQ ID NO: 482806 - RNA, 64 nt, Human
cuguaucaccgguugaauggacaacuaacccgagcuggaccaacacaauucucuccagagacuu

SEQ ID NO: 482807 - RNA, 64 nt, Human
accacacgccccucaccaaacaaugcagcagcuacuggaccacccugagcagcacucaucucuc

SEQ ID NO: 482808 - RNA, 64 nt, Human
agagacuaacuggcauaaggaaaagauggaauuacuggaccaguuugacaaugaaagaaaggaa

SEQ ID NO: 482809 - RNA, 59 nt, Human
auaguggugcgggcacuggacccccgggccccacggaggccgcggucugaacugcuuuc

SEQ ID NO: 482810 - RNA, 59 nt, Human
aacaagaaaaauauaaaaagugaucucugcccacggaaaggauuuaauccaaauggucc

SEQ ID NO: 482811 - RNA, 59 nt, Human
gaagugaauugaugaggacuguccccaugcccacggaugcucagcagcccgccgcacug

SEQ ID NO: 482812 - RNA, 59 nt, Human
cuuccucuccucccagucccaccccuugccccacggaguccuggggacgcagugcccca

SEQ ID NO: 482813 - RNA, 64 nt, Human
cugggacagaaguccgaucucccuagggccccaccuggaccauuuucccuccguuuuauuuugu

SEQ ID NO: 482814 - RNA, 64 nt, Human
gccuaguaaccaaggcccugucucuggcuacucccuggaccacgaggcugauuccucucauuuc

SEQ ID NO: 482815 - RNA, 64 nt, Human
agaggaaccauuugugcagaucaucuagaagaaccuggaccauucuugauggagcugaauacag

SEQ ID NO: 482816 - RNA, 64 nt, Human
cgccuucucgcucccgccagcagcauagacuggacuggaccagacaauguuguguuuggauuug

SEQ ID NO: 482817 - RNA, 64 nt, Human
cuggcccccaggacauggcugcuccccccaacaucuggaccagcugcccuggcggagagacagc

SEQ ID NO: 482818 - RNA, 64 nt, Human
uuaggggagaugggggucuccccuaaugcgggggcuggaccaggcugaguccccacaggguccu

SEQ ID NO: 482819 - RNA, 64 nt, Human
agaauuucaucacccaaugcagggggagcucuuccuggaccaagggaggagccgcucauucacc

SEQ ID NO: 482820 - RNA, 64 nt, Human
guguuugugugugugugucugucuauuuuguauccuggaccacaaguuccuaaguagagcaaga

SEQ ID NO: 482821 - RNA, 64 nt, Human
ucaccuccccaucauccacgccaaguggaagccacuggaccacaggaggugugauagagccuuu

SEQ ID NO: 482822 - RNA, 64 nt, Human
acccugccugccaucacccuugccccugcuuguccuggaccacuuuuaaaggggaagucccuua

SEQ ID NO: 482823 - RNA, 64 nt, Human
ggugaggacagcaggaggggcccacaccucaagccuggaccagccaccucaaggccuuggggag

SEQ ID NO: 482824 - RNA, 64 nt, Human
guccagaggcagggccugaaccucgggcuccugccuggaccagugacagcauuggggagagaag

SEQ ID NO: 482825 - RNA, 64 nt, Human
uuuggaacuuagaaaagaucuugguuuuuccaaacuggaccauccugucuuauggugaaaaagu

SEQ ID NO: 482826 - RNA, 64 nt, Human
gcuccuggccaggauaauauauuugcagauaauucuggaccagagacuuggugcgggguuaaca

SEQ ID NO: 482827 - RNA, 64 nt, Human
ucuccugcuccguuccucauccaccccuccccaucuggaccauaauagacaccaaaacaaaccc

SEQ ID NO: 482828 - RNA, 64 nt, Human; identical to SEQ ID NO: 206283

SEQ ID NO: 482829 - RNA, 64 nt, Human; identical to SEQ ID NO: 206284

SEQ ID NO: 482830 - RNA, 64 nt, Human; identical to SEQ ID NO: 206285

SEQ ID NO: 482831 - RNA, 59 nt, Human
gccggaagagcacagggacacagccagagcccacggagggcccuucccgcaaagcagaa

SEQ ID NO: 482832 - RNA, 64 nt, Human
caugacuaauacgaccuauuagaguaaucuacaucuggaccauuccuuaaguuuuuccucaccg

SEQ ID NO: 482833 - RNA, 64 nt, Human
uccauuuuuuuaaaaaaaugguuuugcauggaaccuggaccaaggcaaaugucuuuucuucgca

SEQ ID NO: 482834 - RNA, 64 nt, Human
gcgagagcaccgcagcaugagagccaacguggagcuggaccacgccacccuggugcgcuucagc

SEQ ID NO: 482835 - RNA, 64 nt, Human
ugugcacacccuccgccagaccucacuggccuggcuggaccaguacugcucucugcccgcucuc

SEQ ID NO: 482836 - RNA, 64 nt, Human
cccaaccacaggagcugccaguauccagcaguaucuggaccacaggcaaagaaaaccacuagga

SEQ ID NO: 482837 - RNA, 64 nt, Human
guuuuaugagcacucuuuaucagaaagguauuuccuggaccagaaaugggcaauaguuacaaua

SEQ ID NO: 482838 - RNA, 64 nt, Human
auuuugagaauuuaaagcagauuaccuuuuaaaacuggaccaacuaaguaauugguauuuaauc

SEQ ID NO: 482839 - RNA, 64 nt, Human
ccagcugcagggccugcucguacacuugcucaaccuggaccagccccccagccuccaggugugc

SEQ ID NO: 482840 - RNA, 64 nt, Human
acugcauuccaguucucccuccugcgcccugagacuggaccaggguuugauggcuggcagcuuc

SEQ ID NO: 482841 - RNA, 64 nt, Human
uguagcacgcugccugccaaaguaguccuggcagcuggaccaucucuguaggaucguaaaaaaa

SEQ ID NO: 482842 - RNA, 64 nt, Human
ccaccgccgguuuauaugaucuucauaccuuucccuggaccacaggcguuucucggcuuuuagu

SEQ ID NO: 482843 - RNA, 64 nt, Human
cccaucacaggaguaccuggaccuguccaugccccuggaccaguacucccccagcuuucccgac

SEQ ID NO: 482844 - RNA, 64 nt, Human
caguucuguugaguuggaagaauuggcaaaauaucuggaccauuaagaaaacggauuuuguaac

SEQ ID NO: 482845 - RNA, 64 nt, Human
augugggcuccugacuggccuccuuuuccuuugacuggaccacugccaccucuugguagccauc

SEQ ID NO: 482846 - RNA, 64 nt, Human
ugaggaaugauacagaagaguguuuuuucauaaacuggaccauaauucuucauguuuaccaugg

SEQ ID NO: 482847 - RNA, 59 nt, Human
gagaugcuccuccaagggucucuucugaucccacggauccugcagagcgugucaggaau

SEQ ID NO: 482848 - RNA, 59 nt, Human
aggggcccaagagagacagcacaggcagccccacggacgacgcgagggccccacguccc

SEQ ID NO: 482849 - RNA, 59 nt, Human
ggcuugcuuggcuuguguccaugcuuaaacccacggaagggggagacucuuucggauuu

SEQ ID NO: 482850 - RNA, 64 nt, Human
cucagccuucugaguagcugggaccacaggcgugcaccaccaugcccaccuaauuuuuuauuuc

SEQ ID NO: 482851 - RNA, 64 nt, Human
ucuggacagacggauagacauacggaagcgaggccuggaccaagagaggcccaggcuacuggag

SEQ ID NO: 482852 - RNA, 64 nt, Human
uaagucagauccauagacgcauguugguaggucacuggaccagagcuugugaagcaggcaaccu

SEQ ID NO: 482853 - RNA, 64 nt, Human
gccccaggaccaucaccaggaaugcgaggccacccuggaccagagguaggagcccaagguccgg

SEQ ID NO: 482854 - RNA, 64 nt, Human
uaugugccaggcccucuccugccacacagacccgcuggaccaaagcagcugcagccgccuccuc

SEQ ID NO: 482855 - RNA, 64 nt, Human
cccgcccaccccgcugccuggcgggcagccccugcuggaccaaggugcggaccggagcggcuga

SEQ ID NO: 482856 - RNA, 64 nt, Human
cccugacuccgccgccccucugccuccgccagggcuggaccacgagcuggccuucucucgucug

SEQ ID NO: 482857 - RNA, 64 nt, Human
gggauggcaaggcgugaagccacccuggaaggaacuggaccaaggucuucagaggugcgacagg

SEQ ID NO: 482858 - RNA, 64 nt, Human
aacucaguuuuuuuucuccuacaaggagauauggcuggaccaaaauaaaaugacaugaaacugc

SEQ ID NO: 482859 - RNA, 64 nt, Human
caaucugacuuuucugugaauuuuucuccuaaaacuggaccauaauuucaguaaaaccuucaga

SEQ ID NO: 482860 - RNA, 64 nt, Human
uggcaggaagacauccccccuccaucccagcccacuggaccagaacugggagaggaagagagca

SEQ ID NO: 482861 - RNA, 64 nt, Human
gauagaggccuccguccccauggccgccaccgcucuggaccacaggcggggaggaagcaugcuc

SEQ ID NO: 482862 - RNA, 64 nt, Human
ccuccagagcccacccuaccaccagacacagagccuggaccaccuggaccuacccuccagccau

SEQ ID NO: 482863 - RNA, 64 nt, Human
ugagggccggggcuccgaugccuucuucgacgcgcuggaccacgucauagacauacacggacac

SEQ ID NO: 482864 - RNA, 64 nt, Human
gccuggcacugcucaccgcccaaggcgacgccggcuggaccaggcacugcuggccuuucuccug

SEQ ID NO: 482865 - RNA, 64 nt, Human
uuguaagucuacaauuugccaagaguaaauaacacuggaccagcuguaaaaguaaacagugugu

SEQ ID NO: 482866 - RNA, 64 nt, Human; identical to SEQ ID NO: 44771

SEQ ID NO: 482867 - RNA, 64 nt, Human; identical to SEQ ID NO: 44772

SEQ ID NO: 482868 - RNA, 64 nt, Human; identical to SEQ ID NO: 44773

SEQ ID NO: 482869 - RNA, 59 nt, Human
cccuccucugcuucccccugaacccaccccccacggaaaccagcccugcgggcuaagca

SEQ ID NO: 482870 - RNA, 64 nt, Human
cauguuuggaguuuguagugggugguuuguaaaacuggaccauucugccuugcuauggguuguu

SEQ ID NO: 482871 - RNA, 64 nt, Human
aaugcucagaaaggaaauaauuuuaugcuggacucuggaccauauaccaucuccagcuauuuac

SEQ ID NO: 482872 - RNA, 64 nt, Human
uuaaaguaggcuuuuuuuuuuuuuuuugagaauacuggaccaucauuaaauguguacugugaag

SEQ ID NO: 482873 - RNA, 52 nt, Human
gaguacagguggggccgugaggcuggaccaggacuagagaagcuugagcacc

SEQ ID NO: 482874 - RNA, 64 nt, Human
uaaauaccugcagcaacgugggagaaagaaguugcuggaccaggagaaaaggcaguuaugaagc

SEQ ID NO: 482875 - RNA, 64 nt, Human
uuuucuuuuggccuuugggcacagagucugaccucuggaccacucuaacuggagaaggaacuuu

SEQ ID NO: 482876 - RNA, 64 nt, Human
uaucaaggccccuccgcccccgaacccuggggagcuggaccaggagguggaggcucaggggacc

SEQ ID NO: 482877 - RNA, 64 nt, Human
gacaggccugaagcuggcccuguguggaacggugcuggaccaccuggucggggaggagaccaug

SEQ ID NO: 482878 - RNA, 64 nt, Human
ucuugagaguccugaagcaggcggacuagccuggcuggaccaugaggcugucuccccacagcuu

SEQ ID NO: 482879 - RNA, 64 nt, Human
gugccgccuuuggcgguucuguuucugugcugaucuggaccaucuuugucuugccuuuucacgg

SEQ ID NO: 482880 - RNA, 64 nt, Human
uuguguuaaaccaaauugugugaagcgaggucaccuggaccacucuugggaaaugcuucagaac

SEQ ID NO: 482881 - RNA, 64 nt, Human
gcaugucugccaagcacagagcaucucaguuggacuggaccacagugcucccgagagccugccu

SEQ ID NO: 482882 - RNA, 64 nt, Human
gucaagccgugagcuagccauggcaggacagcuccuggaccaggucucauaaugcauguggcac

SEQ ID NO: 482883 - RNA, 64 nt, Human
cuuuuaucuuuuaagaccuucccuuccuugaucccuggaccagacucaguggacauuugugcaa

SEQ ID NO: 482884 - RNA, 64 nt, Human
ucgggaccaccugcaccgcgaacagcgggaguaccuggaccagcuuaaugcccugcgccgcgag

SEQ ID NO: 482885 - RNA, 64 nt, Human
gucuuguaauuacaggagccauuucuguagguaacuggaccaagaaugagaaaaauaaugaauu

SEQ ID NO: 482886 - RNA, 64 nt, Human; identical to SEQ ID NO: 44745

SEQ ID NO: 482887 - RNA, 64 nt, Human; identical to SEQ ID NO: 44746

SEQ ID NO: 482888 - RNA, 64 nt, Human; identical to SEQ ID NO: 44747

SEQ ID NO: 482889 - RNA, 64 nt, Human
aggaaacucaucuccuuccugaggagccgggaggcuggaccagucccgucgugcagucaggugg

SEQ ID NO: 482890 - RNA, 64 nt, Human
ggcucccacuugagagcagccucuaccugacccccuggaccacagagagccacucugacccuca

SEQ ID NO: 482891 - RNA, 64 nt, Human
aucucauacacaacuguucccgauucacguuuuucuggaccaaggugaagcaaauuugugguug

SEQ ID NO: 482892 - RNA, 64 nt, Human
cugcuuuugauuuuagccaugccugcuccucugccuggaccaggaggagggccccuggggcaga

SEQ ID NO: 482893 - RNA, 64 nt, Human
ccccauccccagaggcuggaggaacaacugggcccuggaccagcaccacuuccgagguccccag

SEQ ID NO: 482894 - RNA, 64 nt, Human
ugggcugggggcccccgggccugggccgggcaggcuggaccauacccccaguccaccagcucca

SEQ ID NO: 482895 - RNA, 52 nt, Human
ugggaggggaagagauuuagaucuggaccaggcuguggguagaugugcaaua

SEQ ID NO: 482896 - RNA, 64 nt, Human
augcugucugucugucugagucucguggccgccccuggaccagugaugacugaugaaucuuaug

SEQ ID NO: 482897 - RNA, 64 nt, Human
ggagggaggggagcccccgacgccucugcaauaacuggaccagggggagcugcugucacucccc

SEQ ID NO: 482898 - RNA, 64 nt, Human
ccagcagggucugguuaagggguccagcccagcacuggaccauuccgucuccugcucuggacuu

SEQ ID NO: 482899 - RNA, 64 nt, Human
auaaucugccagggacaugaagaggcucagcuuccuggaccaugacuuuggcucagcugauccu

SEQ ID NO: 482900 - RNA, 64 nt, Human
aacaaaaacaaacaaacacguuuguagguucuuacuggaccagaggagucaagaaaccaagaug

SEQ ID NO: 482901 - RNA, 64 nt, Human
ugaggaggcccaugggcagaagauagagauuccccuggaccacaccuccgugguucacuuuggu

SEQ ID NO: 482902 - RNA, 64 nt, Human
auuagccccgaaucacuucagcucccuucccugccuggaccauucccagcucccugcucacucu

SEQ ID NO: 482903 - RNA, 55 nt, Human
acauggccuccaaggaguaagaccccuggaccaccagccccagcaagagcacaag

SEQ ID NO: 482904 - RNA, 64 nt, Human
caggcaccagaaggauuuugccagcguagugcuccuggaccagcgauaugcccggcccccuguc

SEQ ID NO: 482905 - RNA, 64 nt, Human; identical to SEQ ID NO: 44748

SEQ ID NO: 482906 - RNA, 64 nt, Human; identical to SEQ ID NO: 44749

SEQ ID NO: 482907 - RNA, 64 nt, Human; identical to SEQ ID NO: 44750

SEQ ID NO: 482908 - RNA, 64 nt, Human
ugccaucaucauugggaaguucacaguccacuggcuggaccaauuuucaaacuuggauaaagaa

SEQ ID NO: 482909 - RNA, 64 nt, Human
auguucuugaacaaucagguuucuaaauaaacaacuggaccaucaauccaucaaccuuuuuugu

SEQ ID NO: 482910 - RNA, 64 nt, Human
cagugcaucuugggggaaagggcuccaguguuaucuggaccaguuccuucauuuucagguggga

SEQ ID NO: 482911 - RNA, 64 nt, Human
gccccgcccuuucucucucauagucuuaaugcgucuggaccacuggggaaaauauuuuucuuuu

SEQ ID NO: 482912 - RNA, 57 nt, Human
cuggcuacgaagaugaauaaagagaaucuggaccacuacccgggcaccagggaccac

SEQ ID NO: 482913 - RNA, 64 nt, Human
cuuguguccuucuuugcagggucuugcuagugagcuggaccagugaggccuaccccacaccugg

SEQ ID NO: 482914 - RNA, 64 nt, Human
cagcucagccagaaaaagcccagaaacccaggugcuggaccagggcccucagggaggggacccu

SEQ ID NO: 482915 - RNA, 64 nt, Human
cucaguacugccuggucauguggagcuuuccuuccuggaccaggccugaagaggguccuggggg

SEQ ID NO: 482916 - RNA, 64 nt, Human
cucccagcccucugcuguuguaacacccuugauccuggaccaggcccuggcgagaugcauucac

SEQ ID NO: 482917 - RNA, 64 nt, Human
cuuuuuugcccuuggcucuugacacucuaaaccccuggaccaucugaauggagcagccaaguuc

SEQ ID NO: 482918 - RNA, 64 nt, Human
ucaugaaaucaguuauaaauauggugaauuuuuucuggaccauaggaauauuauuucaaagaaa

SEQ ID NO: 482919 - RNA, 64 nt, Human
caguuucuggagggccaggugggaaaugcuuucacuggaccaacacacaaaugaucauccugag

SEQ ID NO: 482920 - RNA, 64 nt, Human
cuuuggucuuucugaaucguaacugcacugcuuucuggaccauuucuaaggcggccuuuacaag

SEQ ID NO: 482921 - RNA, 64 nt, Human
gaaaaaauggcuucucaguuguuaaaaguauacccuggaccacccaucugaccaucuccuuaag

SEQ ID NO: 482922 - RNA, 64 nt, Human
aaaaaguuauuuauuaccguucccuuccuccugccuggaccaugguagcuucuguguucccgua

SEQ ID NO: 482923 - RNA, 64 nt, Human
agguacuucagaugugcuuaauauggagugaaaacuggaccagagguggaaagauguauuugcc

SEQ ID NO: 482924 - RNA, 59 nt, Human
ccgaggagcaggguccccagggggcagcucccacggagcgggcuugaacagggaccacc

SEQ ID NO: 482925 - RNA, 59 nt, Human
ccacgaggccccccagagaggaggaagaucccacggaggaacacaugagguuagggacc

SEQ ID NO: 482926 - RNA, 59 nt, Human
aaaggaggaugucccuggucuguuccauccccacggaugguguugcugcugggcaacag

SEQ ID NO: 482927 - RNA, 64 nt, Human
gggaggaggaagggaagaccccaguggugggacccuggaccaggccauggaugaaggacaaaga

SEQ ID NO: 482928 - RNA, 64 nt, Human
gacagaggaggaaacaggccaaggcaggacauggcuggaccauggugauacagcucugugugau

SEQ ID NO: 482929 - RNA, 64 nt, Human
gugaaaagaaacuacuuaaucgcuaauagcuagucuggaccagacacuuaacugcgcuuuggga

SEQ ID NO: 482930 - RNA, 64 nt, Human
cccugguggcugcaggcaccgcuggguucugacucuggaccaugcugagacaucccucaucuag

SEQ ID NO: 482931 - RNA, 64 nt, Human
gccccaccuggacagaggcuuacaagacuagggucuggaccagaaucuguguauuucugucugg

SEQ ID NO: 482932 - RNA, 64 nt, Human
gugguugguggggguggacgugggggugucccaccuggaccagacuggcgugggugagcuccac

SEQ ID NO: 482933 - RNA, 64 nt, Human
aggccugugcacagguagccccucaugcugggcucuggaccaugagcugaguaggaaggauagc

SEQ ID NO: 482934 - RNA, 64 nt, Human
guuacaguccaacuugguggcaaggacagagggccuggaccagcagguggacuggaacugguaa

SEQ ID NO: 482935 - RNA, 64 nt, Human
ggaacuucccaggagagccagcugggaagcaguacuggaccauccggccaugaggaagcugccu

SEQ ID NO: 482936 - RNA, 64 nt, Human
ugccaucuagggagcccucuguggccaucucugccuggaccaggguggaaaugccucuucuugg

SEQ ID NO: 482937 - RNA, 64 nt, Human
acagccgauucaccugagcaggaccucugaaacccuggaccaguggucucacauggugcuacgc

SEQ ID NO: 482938 - RNA, 64 nt, Human
cugccggaggcugccgcaacuucccagauacuuucuggaccaacccucaguaccgucugaagcu

SEQ ID NO: 482939 - RNA, 64 nt, Human
ccaguauguucggcccagcgcucuucgcacccuucuggaccaaagcgccaaggacugcagccag

SEQ ID NO: 482940 - RNA, 64 nt, Human
caagagugccccacaggagugccccacagacccgcuggaccagccugcugcggguccuggccag

SEQ ID NO: 482941 - RNA, 64 nt, Human
ccggcggagccaagcccuagagaagcugggccgccuggaccaggcuguccuugaccugcagaga

SEQ ID NO: 482942 - RNA, 59 nt, Human
accagacaugcuuccugcuccccgcuuagcccacggagugacugugguugugguggggg

SEQ ID NO: 482943 - RNA, 59 nt, Human
cugaagggaaaugaggcagcugcuguguccccacggaaacaaccaucuggggacugcug

SEQ ID NO: 482944 - RNA, 59 nt, Human
agaggggcuccuguucugccguggagcugcccacggagcaccucacagaagauugagaa

SEQ ID NO: 482945 - RNA, 59 nt, Human
caacugaccccgagggaccagucuucauacccacggaaaguuauugggacccugcuuac

SEQ ID NO: 482946 - RNA, 64 nt, Human
cagagcuggagcugggcacagccauaagacaggacuggaccagaugcuccuguaaacauccagg

SEQ ID NO: 482947 - RNA, 64 nt, Human
guagugagugaugaucaugccacugcacuucagccuggaccacagagcaagacccuguguaaaa

SEQ ID NO: 482948 - RNA, 64 nt, Human
aucucggaccugggggagccggggugugaggggacuggaccagcuuggacugagaccugagacc

SEQ ID NO: 482949 - RNA, 64 nt, Human
cuccugcggugcucccaagacuuccauagaccaucuggaccaguagcccaucccgcaguuuucu

SEQ ID NO: 482950 - RNA, 64 nt, Human
uuguuuugguuuucagcugauaggaucuaugccucuggaccagcugaacuuacuggugcagcuu

SEQ ID NO: 482951 - RNA, 64 nt, Human
ccaagacacagcaggacaggccaggggagggcaucuggaccagggcauccgucgggcuauuguc

SEQ ID NO: 482952 - RNA, 64 nt, Human
ucuucaggguggagacacaucgggaucugucauccuggaccaggauacuuguucaggguugcca

SEQ ID NO: 482953 - RNA, 64 nt, Human
gcaauuuccuuaaacguacaguuuaaauucaaggcuggaccacucaguuauuauugcuauuaga

SEQ ID NO: 482954 - RNA, 64 nt, Human
cugugcauaucacggccccccagggcaguuccugcuggaccagacucucuggcagaggaggugg

SEQ ID NO: 482955 - RNA, 64 nt, Human
ucugcucugacccuucucaggcccgccugaugugcuggaccaucccccugcugccacggccccu

SEQ ID NO: 482956 - RNA, 64 nt, Human
gugaaacugugcuuguauccccagccacgaagagcuggaccagcuucaaguacauguccacagc

SEQ ID NO: 482957 - RNA, 64 nt, Human
cgucuagguggggacaggguaucuuggcucccagcuggaccagagugcccugcuugccucugcu

SEQ ID NO: 482958 - RNA, 64 nt, Human
ucaccucccccauggcacagagcccuccacaccccuggaccagggcauccgggcccuagaaauu

SEQ ID NO: 482959 - RNA, 64 nt, Human
ccacaagcuucuguccugcccccaaggaggcagccuggaccacuccucauagcaauacuuggag

SEQ ID NO: 482960 - RNA, 64 nt, Human
guauaggggccgggggcuucugcccagggcuccccuggaccaggacgccagguagggcagggaa

SEQ ID NO: 482961 - RNA, 64 nt, Human; identical to SEQ ID NO: 44752

SEQ ID NO: 482962 - RNA, 64 nt, Human; identical to SEQ ID NO: 44753

SEQ ID NO: 482963 - RNA, 64 nt, Human; identical to SEQ ID NO: 44754

SEQ ID NO: 482964 - RNA, 64 nt, Human; identical to SEQ ID NO: 44755

SEQ ID NO: 482965 - RNA, 64 nt, Human
uccucacauggggucgggggccugggaguucauucuggaccagcccaccuaucuccauuuccuu

SEQ ID NO: 482966 - RNA, 64 nt, Human
uccccucuucccuacacgauccgcaacccaugcccuggaccagccgcccagaucaugccgccgc

SEQ ID NO: 482967 - RNA, 64 nt, Human
ggucgcucauugccuaccuuaccacggugaccaccuggaccauccgagacaaguuugcccggcu

SEQ ID NO: 482968 - RNA, 64 nt, Human
gaggggccguggcuguggcauccagagucccugccuggaccagccucuccacucaugugacucu

SEQ ID NO: 482969 - RNA, 64 nt, Human
ccacaucuucuaugagccagaugcuuaugaugaccuggaccaagaagacccagaugacgaccug

SEQ ID NO: 482970 - RNA, 64 nt, Human
gcuucuacgcgcuagagaggaucaaggggccacacuggaccaugugaacagccauccugaacug

SEQ ID NO: 482971 - RNA, 64 nt, Human
agccggucccccccugaggcacccggauucaccucuggaccacccugauauugcuucuccucug

SEQ ID NO: 482972 - RNA, 64 nt, Human
uucucccaaacccaccaguucuccacugucucuucuggaccaggaauuaguugcugugggugcc

SEQ ID NO: 482973 - RNA, 64 nt, Human
acacaaggugggcagggaggcaccauucaggaaccuggaccaaagcugacgaggcugggccaag

SEQ ID NO: 482974 - RNA, 64 nt, Human
gcccuucauuagccaaauugaaaaaagaaauucccuggaccagaugcugaaagagaaaagaggg

SEQ ID NO: 482975 - RNA, 64 nt, Human
ggauggcacagccugcgggccuaacauguugugccuggaccaucgcugccugccagcuucugcc

SEQ ID NO: 482976 - RNA, 64 nt, Human
ccuguaaggaaagaggcaggcugagcugggggcucuggaccaggaagaugcucugacagaugcc

SEQ ID NO: 482977 - RNA, 64 nt, Human
aggggaccccagggccagcuguuucagggguuuccuggaccacccacugcuucuccccaacccu

SEQ ID NO: 482978 - RNA, 64 nt, Human
cauugacccugucuuccuucccuggcuuuuucaacuggaccaaagaugaaggcacuuauggacc

SEQ ID NO: 482979 - RNA, 64 nt, Human
uuccuagcacauuccauucuuuguggcccagggccuggaccagaccauugugauaccugacccc

SEQ ID NO: 482980 - RNA, 64 nt, Human
agggacuggcugagauugcagcccaugguaggagcuggaccaacuguauauaguuuucaauaaa

SEQ ID NO: 482981 - RNA, 64 nt, Human; identical to SEQ ID NO: 44756

SEQ ID NO: 482982 - RNA, 64 nt, Human; identical to SEQ ID NO: 44757

SEQ ID NO: 482983 - RNA, 64 nt, Human; identical to SEQ ID NO: 44758

SEQ ID NO: 482984 - RNA, 64 nt, Human
caucaacagccagcauccugagccuccucaugcccuggaccagccuggaacacacuagcagagc

SEQ ID NO: 482985 - RNA, 64 nt, Human
aagcacugccucccuccugcucuguccagguggucuggaccauaaacucaacuugagagggaag

SEQ ID NO: 482986 - RNA, 64 nt, Human
gugagggcagcccucagggucggccgcuuucccucuggaccaccucccgcugcguuuccuacuc

SEQ ID NO: 482987 - RNA, 64 nt, Human
cuccaucugcuggcaccugaggagagugagcagccuggaccacaagcccaguggucaccccugu

SEQ ID NO: 482988 - RNA, 64 nt, Human
cagugucucugaacuguucaucccuugaccaccucuggaccacuaacaaguucucagacuuugc

SEQ ID NO: 482989 - RNA, 64 nt, Human
ugcaccccagacccauccugccacuucuaugucucuggaccacaggauggugguggcauugcag

SEQ ID NO: 482990 - RNA, 64 nt, Human
auuauucaaaguaggguguguauguaacuuaucacuggaccacuuuaguuuaaucagaaauucc

SEQ ID NO: 482991 - RNA, 64 nt, Human
uaccaagaugccaucuguguccugguuagcagagcuggaccaguggugccuuggagggauaagc

SEQ ID NO: 482992 - RNA, 64 nt, Human
uauuacaaggaaaggacugucagauucaucugaacuggaccaguguugaucuguaauguaauag

SEQ ID NO: 482993 - RNA, 64 nt, Human
ucgcagaugauaaaaggaaucuggcauucuacaccuggaccauuugauuguuuuauuuuggaau

SEQ ID NO: 482994 - RNA, 64 nt, Human
cucgcuccugccucacagcccacacucccuggggcuggaccacaacucagcccuucaccugugc

SEQ ID NO: 482995 - RNA, 64 nt, Human
gucuggccgucucgccccgccccuccacaggacccuggaccagggcggugcagggcgcagcccu

SEQ ID NO: 482996 - RNA, 64 nt, Human
cauaaguuaauauaacugauaccuugagagauggcuggaccaauucucuccaugacaaauguuu

SEQ ID NO: 482997 - RNA, 64 nt, Human
ccagccuggguuuccaugugaccccacaguggggcuggaccagggcccuggaggccaauaaaga

SEQ ID NO: 482998 - RNA, 64 nt, Human
cccaagaccuccccccucgucaccagccaucccucuggaccaggcagagggcggaccggguggg

SEQ ID NO: 482999 - RNA, 64 nt, Human; identical to SEQ ID NO: 44760

SEQ ID NO: 483000 - RNA, 64 nt, Human; identical to SEQ ID NO: 44761

SEQ ID NO: 483001 - RNA, 64 nt, Human; identical to SEQ ID NO: 44762

SEQ ID NO: 483002 - RNA, 64 nt, Human; identical to SEQ ID NO: 44763

SEQ ID NO: 483003 - RNA, 64 nt, Human
ugccccgcccagacugcccaggcagagggcagggcuggaccaugggugagggcaggggagcccg

SEQ ID NO: 483004 - RNA, 64 nt, Human
accagcuuucagccaccaugacuguggggaguggcuggaccaagggcugaccuccccgacugca

SEQ ID NO: 483005 - RNA, 64 nt, Human
ccuccaucucucagggagacaaagaaccuccuuccuggaccaaggaggugcugccaaguuuucu

SEQ ID NO: 483006 - RNA, 64 nt, Human
guaaggauuuggaauaaggauuugguccuguuuucuggaccaaauccuuacucuggcucugcuu

SEQ ID NO: 483007 - RNA, 64 nt, Human
aaccagauggaacacuggaacauuccaguggacccuggaccauuccaggaaaacugggacauag

SEQ ID NO: 483008 - RNA, 64 nt, Human
gacuguucuagccagcuguggacacauaggaaugcuggaccaggguaccagauuuuuucaacaa

SEQ ID NO: 483009 - RNA, 64 nt, Human
cuagggaugggcacgggggcgcuggugagguccccuggaccauccagggugcuagggggcaggg

SEQ ID NO: 483010 - RNA, 64 nt, Human
ggucagcaucauuggugaacagaugcaggcgcugcuggaccaucuggggagagugacaguccau

SEQ ID NO: 483011 - RNA, 64 nt, Human
gcaggcaauggcuccagugcccucccucuguucccuggaccaccaccccacguagcugcucaca

SEQ ID NO: 483012 - RNA, 64 nt, Human
cggggagagcgggcgggggagcucgcgccgaggacuggaccaucuguacagaccagcgggagug

SEQ ID NO: 483013 - RNA, 64 nt, Human
gagugcgcgcgcccgccucgcacagggccggggccuggaccaaaccacaugaacuggacugaga

SEQ ID NO: 483014 - RNA, 64 nt, Human
uuaaucacuaauuaaaaaucuaucaaacaaaacucuggaccagacagauuuauaguugaagccu

SEQ ID NO: 483015 - RNA, 64 nt, Human
agucugauaguccuaggagguucuggaagaaagucuggaccaucauucgggaaaccgucuacug

SEQ ID NO: 483016 - RNA, 64 nt, Human
gcagugagcgggcuccgcugcccccugcccugcacuggaccaggagucuggagaugccugggua

SEQ ID NO: 483017 - RNA, 64 nt, Human
acgccacccagcccuggggggaggcccacgccugcuggaccaacgcggguucuggggugcacag

SEQ ID NO: 483018 - RNA, 64 nt, Human; identical to SEQ ID NO: 44764

SEQ ID NO: 483019 - RNA, 64 nt, Human; identical to SEQ ID NO: 44765

SEQ ID NO: 483020 - RNA, 64 nt, Human; identical to SEQ ID NO: 44766

SEQ ID NO: 483021 - RNA, 59 nt, Human
cagcgggcgggccccuuccgagggagccucccacggagugaagagacaugggggacuuu

SEQ ID NO: 483022 - RNA, 64 nt, Human
ucacagaagagguggggaccgcagucagggucaccuggaccauggugaacaugugaccugcaga

SEQ ID NO: 483023 - RNA, 64 nt, Human
ugcugaggcacaauggcagcccugccugggaggacuggaccaggcaguggcugcagagggagcc

SEQ ID NO: 483024 - RNA, 64 nt, Human
ccuuuauggaacugcugaucgaugcuggcuccaccuggaccagggauucauguggaguuuccuu

SEQ ID NO: 483025 - RNA, 64 nt, Human
cuguguucuuccugucagcuccacgcccgggccccuggaccacgggguccaccucuccucuguc

SEQ ID NO: 483026 - RNA, 64 nt, Human
aaugguugucugguaucugaacugagccugcuggcuggaccaacuguccucgaaaagacacagc

SEQ ID NO: 483027 - RNA, 64 nt, Human
caguccagaugccuuccugucuuucuggcccuuucuggaccagauccuacucuuccuuucuaaa

SEQ ID NO: 483028 - RNA, 64 nt, Human
cacaaacguaacaugcaugcugagacuauuacuccuggaccacaacuguaggugaggauucaua

SEQ ID NO: 483029 - RNA, 64 nt, Human
cucccugcacacuguggaugacaugguacccuggcuggaccacauacuggccucuuucuucaac

SEQ ID NO: 483030 - RNA, 64 nt, Human
cgcccugcccuccacccagccuccuggacucggccuggaccaggggaccucgggacugcgcgug

SEQ ID NO: 483031 - RNA, 64 nt, Human
aggaauugccccuguucagagcagccggaguuugcuggaccacaaggaagaagagaagagacuu

SEQ ID NO: 483032 - RNA, 54 nt, Human
aggagcaagaagaguauuaacagccuggaccagcagagcaacaucggaauucuu

SEQ ID NO: 483033 - RNA, 64 nt, Human
cugagugaugcuuucccaggagcagggcagcuggcuggaccagaaaguagagggcccaugggag

SEQ ID NO: 483034 - RNA, 64 nt, Human
acauagcccuguugcuuagcaaccacuugaaaagcuggaccaauagcaagguaaguuugcuuuu

SEQ ID NO: 483035 - RNA, 64 nt, Human
cucuccucagaguuggcuuuugaaccaaagugcccuggaccaggucagggccuacagcuguguu

SEQ ID NO: 483036 - RNA, 64 nt, Human
cauccaugcugugguguugccucgagggaagucgcuggaccaguguguggagacccugcagaag

SEQ ID NO: 483037 - RNA, 64 nt, Human
gccagauucguuaggucccuggaggaaggacugacuggaccagagggacccucuggcucaggag

SEQ ID NO: 483038 - RNA, 64 nt, Human; identical to SEQ ID NO: 44768

SEQ ID NO: 483039 - RNA, 64 nt, Human; identical to SEQ ID NO: 44769

SEQ ID NO: 483040 - RNA, 64 nt, Human; identical to SEQ ID NO: 44770

SEQ ID NO: 483041 - RNA, 64 nt, Human
ccuuuggacaucuaacgagcagcugugccagaggcuggaccacacaggagaagcucggacuugg

SEQ ID NO: 483042 - RNA, 64 nt, Human
ucaggccuuugccagcggguggcccccaguccugcuggaccagcugaacccccagggagacccg

SEQ ID NO: 483043 - RNA, 64 nt, Human
aggagaaugagccucggccucuuccgugacgucacuggaccacugggcaaugauggcaauuuug

SEQ ID NO: 483044 - RNA, 64 nt, Human
gacauuugagucuucgucuucugcugcugcucggcuggaccagcuucuuuaacagcaagcauaa

SEQ ID NO: 483045 - RNA, 64 nt, Human
agcuuugaggaauguggaaaaucauaauugccgucuggaccauugauugauugugaccaguagc

SEQ ID NO: 483046 - RNA, 64 nt, Human
cauggagguguccugcuaagcagaugcuccuccccuggaccauugcaaguccauccuucaaaug

SEQ ID NO: 483047 - RNA, 64 nt, Human
ccuucaggggccucuggcaccagacauuugcagucuggaccagugugaccuuacgauguucccu

SEQ ID NO: 483048 - RNA, 64 nt, Human
cugucuccucccaccaguccaguuagcuucccuucuggaccaauagacgaggggagaccccaug

SEQ ID NO: 483049 - RNA, 64 nt, Human
ccaguggcagcacaaggugcacuucauggucucacuggaccauuccaugugguuccacgccccc

SEQ ID NO: 483050 - RNA, 64 nt, Human
uucuacacuaacaaguguuguuuuggguccaugccuggaccaugucacaaaaaggaggugcccc

SEQ ID NO: 483051 - RNA, 64 nt, Human
gcagugagcucugauggaaccacugcacuauagccuggaccacagagcaggccccugucucaaa

SEQ ID NO: 483052 - RNA, 64 nt, Human
cgggcccuugaggcuguugcuagcgugacccccacuggaccagccccugacccagcucgggccc

SEQ ID NO: 483053 - RNA, 64 nt, Human
cccccuuccagcggcuucugccaaccauggggggcuggaccaccauggccacugacccagcccc

SEQ ID NO: 483054 - RNA, 64 nt, Human
cuccugcucauguugugcaggccuccccuccauccuggaccagcugugcuuuugccuggucauc

SEQ ID NO: 483055 - RNA, 64 nt, Human
gcuuguuuaaacaguaccauugcuugugucccaccuggaccaguucagucagccccaguggugg

SEQ ID NO: 483056 - RNA, 64 nt, Human; identical to SEQ ID NO: 44775

SEQ ID NO: 483057 - RNA, 64 nt, Human; identical to SEQ ID NO: 44776

SEQ ID NO: 483058 - RNA, 64 nt, Human; identical to SEQ ID NO: 44777

SEQ ID NO: 483059 - RNA, 59 nt, Human
cacucccucccuggcucugccagucgguucccacggagccauuuuuagcucugaucagc

SEQ ID NO: 483060 - RNA, 64 nt, Human
aagaaaacgccacuggccauguggaauccauggccuggaccaccccagaucccacauccccuga

SEQ ID NO: 483061 - RNA, 64 nt, Human
agaggaugaauggggggaucucaaggcccaaaugcuggaccacaucuccugcuguucuggguaa

SEQ ID NO: 483062 - RNA, 64 nt, Human
aggucuagacucaaagccucucccaucccuuggccuggaccagugagcuggggagggacucgga

SEQ ID NO: 483063 - RNA, 64 nt, Human
uauuucaaugccaaaugaaccacauugacaugaccuggaccauagggcuuccuauccugggcuc

SEQ ID NO: 483064 - RNA, 64 nt, Human
aggcccugugcagccaguauauucuaaugacugccuggaccauguccuaauauggugguuuuaa

SEQ ID NO: 483065 - RNA, 64 nt, Human
gcugagcugggagccgccaugccuggccuuguuucuggaccacugggagcagcacugcagccca

SEQ ID NO: 483066 - RNA, 64 nt, Human
gggguggggcugcauccaaggcuuuguaaaccggcuggaccacgucucccuggccccagugacc

SEQ ID NO: 483067 - RNA, 64 nt, Human
cuucacaucaacccuguuacagcacucuguucugcuggaccacuuauuguaguuguagcuaauu

SEQ ID NO: 483068 - RNA, 64 nt, Human
uccaaagcuuccucagaauuguggcugugccacgcuggaccacagggucccccucaagcaucuc

SEQ ID NO: 483069 - RNA, 64 nt, Human
cacuugucgucgucaaagucaagggaaaguucuccuggaccaaggcuugggaaagguaacugga

SEQ ID NO: 483070 - RNA, 64 nt, Human
gggccuggagcaaggcacucucaaaucuugaacccuggaccaaagcuuuuccagaccccacccu

SEQ ID NO: 483071 - RNA, 64 nt, Human
aagggaagucagcucugggagcagcccucacuggcuggaccaagguacucuuccuggaguuugc

SEQ ID NO: 483072 - RNA, 64 nt, Human
aaugaaggugccccgcauccagaaagacgcacuccuggaccacaaccggcggcuaccucagccc

SEQ ID NO: 483073 - RNA, 64 nt, Human
uuguacauaacucauuuucucccuugcuuuuucucuggaccauccuggcuggaaacuuggcugu

SEQ ID NO: 483074 - RNA, 59 nt, Human
gcuccgcguccuaggaccgccggcgccuccccacggacgccaggcaggccaggccgcuc

SEQ ID NO: 483075 - RNA, 59 nt, Human
ccugaccguuccaggcacugagcugggcacccacggaaggacaugcuguccagacugug

SEQ ID NO: 483076 - RNA, 59 nt, Human
ggcagaaauuaaucagcucccaaugggagcccacggaacuaaguagggucccaagaaaa

SEQ ID NO: 483077 - RNA, 58 nt, Human; identical to SEQ ID NO: 150117

SEQ ID NO: 483078 - RNA, 64 nt, Human; identical to SEQ ID NO: 44729

SEQ ID NO: 483079 - RNA, 64 nt, Human; identical to SEQ ID NO: 44730

SEQ ID NO: 483080 - RNA, 64 nt, Human; identical to SEQ ID NO: 44731

SEQ ID NO: 483081 - RNA, 53 nt, Human; identical to SEQ ID NO: 44732

SEQ ID NO: 483082 - RNA, 64 nt, Human; identical to SEQ ID NO: 44733

SEQ ID NO: 483083 - RNA, 64 nt, Human; identical to SEQ ID NO: 44734

SEQ ID NO: 483084 - RNA, 64 nt, Human; identical to SEQ ID NO: 44735

SEQ ID NO: 483085 - RNA, 64 nt, Human; identical to SEQ ID NO: 44736

SEQ ID NO: 483086 - RNA, 64 nt, Human; identical to SEQ ID NO: 44737

SEQ ID NO: 483087 - RNA, 64 nt, Human; identical to SEQ ID NO: 44738

SEQ ID NO: 483088 - RNA, 64 nt, Human; identical to SEQ ID NO: 44739

SEQ ID NO: 483089 - RNA, 64 nt, Human; identical to SEQ ID NO: 44740

SEQ ID NO: 483090 - RNA, 64 nt, Human
uggugucggcaucauacuaaaagcaauguuuaaaucaaacuaaagauuaaaaauuaaaauucgu

SEQ ID NO: 483091 - RNA, 64 nt, Human
guuguuguuguuuuuaauuguaaauuguuaucaaucaaacuauuguagcagcuacaaaguaauu

SEQ ID NO: 483092 - RNA, 64 nt, Human
gacguuucuuccccaucaggguagaaaaaucaucucaaacuagccaaaaggcaguuuuggaaac

SEQ ID NO: 483093 - RNA, 64 nt, Human
cuacaauauauguuccuaaauggagcacagauguucaaacuaugcuuucauuuuuucacugaua

SEQ ID NO: 483094 - RNA, 64 nt, Human
uuacagccccuucagaauauaacuucaggacaauucaaacuaugcuuaauguaugauuuucgag

SEQ ID NO: 483095 - RNA, 59 nt, Human
uggcacaccacccgaggggggccccgggacccacggagcccucccuaugucugcaaagu

SEQ ID NO: 483096 - RNA, 59 nt, Human
ccagagcggagcucgaagcacccagguugcccacggaaaauccaauaaaaagacaccag

SEQ ID NO: 483097 - RNA, 59 nt, Human
uauguaaagcacuuuaacacagcaccaggcccacggaaaguggcuaauguuagcuacua

SEQ ID NO: 483098 - RNA, 64 nt, Human
uuaauuaaaguuaaaguuucugcagaucaacuacucaaacuacuaaauacauuuaccugagaaa

SEQ ID NO: 483099 - RNA, 64 nt, Human
gacugggaaggacauaaaagguuuaaugucagggucaaacuacauugagccccugaggacaggg

SEQ ID NO: 483100 - RNA, 64 nt, Human
agcacucaaaaggcauuacuuagagauugaaauuucaaacuaucucuaguuuuucaauggaaau

SEQ ID NO: 483101 - RNA, 64 nt, Human
cagucuauccuucugccuccauauauccugaacaucaaacuaucccaggaaaaccaucuagagu

SEQ ID NO: 483102 - RNA, 64 nt, Human
ggauaugauaaccacuaaaauuuuguuuucaaaaucaaacuaauucuuacagcuuuuuuauuag

SEQ ID NO: 483103 - RNA, 64 nt, Human
caaaaucagaaacacaguacaaauaaaacagaaaucaaacuauaaguugacuuuuaguuccuaa

SEQ ID NO: 483104 - RNA, 64 nt, Human
cuggugaaacaggucacccaaaauggagauggcaucaaacuaguggucaaggacuaacuccuaa

SEQ ID NO: 483105 - RNA, 64 nt, Human
accacugagaucccguucuauugauuuaauaaagucaaacuauuggaaugggccuugcacauua

SEQ ID NO: 483106 - RNA, 64 nt, Human
uuuugagcucaaagagaguucucauuuucccuauucaaacuaauacccaugccguguuuuuuac

SEQ ID NO: 483107 - RNA, 64 nt, Human
gugguggaguuaugguacucuagggcagucuuucucaaacuauguaugguaaaggaccagguuu

SEQ ID NO: 483108 - RNA, 64 nt, Human
auuaaauaaugauucacagaauuuaguaacagaaucaaacuaagccauguaugaggguaaucga

SEQ ID NO: 483109 - RNA, 64 nt, Human
uuagcagagauuuuagucaguaaaauguuagaaaucaaacuauaagaaaauucaaguccuuuau

SEQ ID NO: 483110 - RNA, 64 nt, Human
aagauuuuccaguuuuaacaaauuuaagacccucucaaacuaacaggcuuagugauguaauuau

SEQ ID NO: 483111 - RNA, 59 nt, Human
cugguucccugcugcgcugcuuggugugacccacggaggauccacucccaggaugacgu

SEQ ID NO: 483112 - RNA, 59 nt, Human
ugacaguggcagccucuagcccucagcuucccacggaaucagauggauccuccacgauu

SEQ ID NO: 483113 - RNA, 59 nt, Human
gcaucaucugagaggcuggagcagggucacccacggacagagaccaagagagguccugc

SEQ ID NO: 483114 - RNA, 59 nt, Human
ggagaaagggugucugcugccuggugaggcccacggacuucugagagccaggaauccug

SEQ ID NO: 483115 - RNA, 64 nt, Human
agucccaaaaucucacucuuauugacaauaaauaucaaacuaugaagaaacagaagucccauua

SEQ ID NO: 483116 - RNA, 64 nt, Human
agugccuucugaagcaucagagauuaaauauuguucaaacuaauaguuauugcuguggcuuuua

SEQ ID NO: 483117 - RNA, 64 nt, Human
ugugaaacaaaucguaaguauguacgcacgcauaucaaacuaugcucugaggauaaagcaaguu

SEQ ID NO: 483118 - RNA, 64 nt, Human
uauuuuugacguauaauguaguauaucaauccuuucaaacuauuuagauaaccacuugaugcac

SEQ ID NO: 483119 - RNA, 64 nt, Human
cacuuuauuaguuaauuuaaauuggaaaaaacccucaaacuaauauucuugucuguuccagucu

SEQ ID NO: 483120 - RNA, 64 nt, Human
acuaaaccaauuuggaaucauuaacuacaaaaugucaaacuaacugcaagacaagugucaaaau

SEQ ID NO: 483121 - RNA, 64 nt, Human
cuagauguucaguuaaauauacuuuagcacaaagucaaacuagagaauguguuaaggagggaau

SEQ ID NO: 483122 - RNA, 64 nt, Human
uacauauugauuuuucaaaaauuaaaaauguauuucaaacuauucuuacugugcugugaauuua

SEQ ID NO: 483123 - RNA, 64 nt, Human
ccagcuugcaagugaauggaaaaaaaaauaagcuucaaacuagguauucugggaaugauguaau

SEQ ID NO: 483124 - RNA, 64 nt, Human
uguguuuuucuuuuuuuuauacacaacauuuauuucaaacuauugggagggaugagaguggcuu

SEQ ID NO: 483125 - RNA, 64 nt, Human
gcgagggugguaaagugaacaaaaaggggaaguaucaaacuacugccauuucagugagaaaauc

SEQ ID NO: 483126 - RNA, 64 nt, Human
ggaauaauacuaaucuuguuaaaagcaauagaccucaaacuauugaaggaauaugauauaugca

SEQ ID NO: 483127 - RNA, 64 nt, Human
uuauauauaugaggcaaaagaacuaagacuuuuuucaaacuaaauuagaaaggagugucauuau

SEQ ID NO: 483128 - RNA, 59 nt, Human
cuucaauauuuaaaauguuucuuacaauacccacggagcacuuuuaugguuccagccga

SEQ ID NO: 483129 - RNA, 59 nt, Human
ggcugcagcucacguccagccaugggaaucccacggaccucucgcgugucaacagacga

SEQ ID NO: 483130 - RNA, 59 nt, Human
cugaugccaccccagcaucugucuuuucacccacggagggcacagaaccaccagcaaag

SEQ ID NO: 483131 - RNA, 64 nt, Human
auaacuuuuuaaauucugaagagacaugccaaugucaaacuaaacauguucuguuuuuaaacca

SEQ ID NO: 483132 - RNA, 64 nt, Human
uguccaccccuucucauuucccuuaaccuuaucuucaaacuacuuuagcugagaagcuuuucac

SEQ ID NO: 483133 - RNA, 64 nt, Human
uuuuuggaaaaccuuuugaacccucaaguuaccaucaaacuacuucucuuugaacuaccaauac

SEQ ID NO: 483134 - RNA, 64 nt, Human
gauacugguccugguuuggggggauucugaaaccucaaacuaauagaacuuucuucucuuuuuu

SEQ ID NO: 483135 - RNA, 64 nt, Human
ccuucaaaaauuaaguuggacuaacauucacguaucaaacuaauauaaaaagaaauaaaaccaa

SEQ ID NO: 483136 - RNA, 64 nt, Human
gaaauuguuuuguauaacugaggguacuguugguucaaacuauguuaguuuacaguuuguugca

SEQ ID NO: 483137 - RNA, 64 nt, Human
uagggauuuaaccaacuucagugguucagggagcucaaacuauauguaaaacaaguuuagaaug

SEQ ID NO: 483138 - RNA, 64 nt, Human
uuuugaugcuguagcuguuucaguaaaaguuaguucaaacuaaugauguagaaugcuuugacca

SEQ ID NO: 483139 - RNA, 64 nt, Human
aggaccagaaaauguaaggcaaugcugccuacuaucaaacuagcugucacuuuuuuucuuuuuc

SEQ ID NO: 483140 - RNA, 64 nt, Human
ugucuuagagggacugaaagguuuaaggaggcgaucaaacuaaaaugucuuaauggcuguguga

SEQ ID NO: 483141 - RNA, 64 nt, Human
uacauugcuucauuacuuucauuuuccgacaacaucaaacuaacaagaggcaguguuaaauauu

SEQ ID NO: 483142 - RNA, 64 nt, Human
aagucuuugauggguaggagagagagggaaaaccucaaacuacaucauagaaguauguuaaaac

SEQ ID NO: 483143 - RNA, 64 nt, Human
aauaucugaaugaaauccacccuaggagacggagucaaacuaaacuugugguuuuucauuuaac

SEQ ID NO: 483144 - RNA, 64 nt, Human
auguucacaauauauuuaguuguaaaccaagugaucaaacuacauauuguaaagcccauuuuua

SEQ ID NO: 483145 - RNA, 64 nt, Human
aagauguguuuucugcauucuguaaagaaacauaucaaacuaaauaaaagcagugucuuuauua

SEQ ID NO: 483146 - RNA, 64 nt, Human
cuuuuaaagcaagcaacacagaggaauuuauaccucaaacuaucuggccauauuuacuaccuua

SEQ ID NO: 483147 - RNA, 64 nt, Human
aaaugaguuuaauagcauaacauuaccaagguaaucaaacuaauaaaauuccauauaucuuccc

SEQ ID NO: 483148 - RNA, 64 nt, Human
gcauuuaucauucuuguugccacagcuggagcucucaaacuaaaagacauuuguuauuuuggaa

SEQ ID NO: 483149 - RNA, 64 nt, Human
ugauguaguuuuuaaucguacauuuucauaugcuucaaacuaacacauuuuuaaagcuuucccc

SEQ ID NO: 483150 - RNA, 64 nt, Human
aauuuggugccuuucuccucaaaauaucaaucuuucaaacuauaauaaagccuuuccuauaauu

SEQ ID NO: 483151 - RNA, 64 nt, Human
aagaaaaagauaagaaauacuagaguaaaggccaucaaacuacgcgauagucucuguucuucau

SEQ ID NO: 483152 - RNA, 64 nt, Human
uuugauaauuuugaggaagauuauucuuuuaaauucaaacuaguaugucaaugccuaccauuac

SEQ ID NO: 483153 - RNA, 64 nt, Human
ugugguaacuauagagguuuaacuuauaucauuuucaaacuauuuaauuuuuucuuuuccuggu

SEQ ID NO: 483154 - RNA, 64 nt, Human
caacaggacuuucuuauucccauuccuaauuuuuucaaacuaauugcuuaaaucuagaaccagu

SEQ ID NO: 483155 - RNA, 64 nt, Human
augaauuuuggcaccauccuauaaaagccagcauucaaacuaaaaucuaauauuuuaucuuucu

SEQ ID NO: 483156 - RNA, 64 nt, Human
aucuucagaucccuagcagaaaugacuguuuauuucaaacuauguuuuacuuguauaugaugua

SEQ ID NO: 483157 - RNA, 59 nt, Human
aacagugaaauacgccagaacugcuuuaucccacggaaaaugccaaucucuucuaaaaa

SEQ ID NO: 483158 - RNA, 59 nt, Human
gcagugagcaugucuaauguuccuuaaaucccacggagaggagcagcuuugggaacugu

SEQ ID NO: 483159 - RNA, 59 nt, Human
gccacauccugccccaccccacccccacucccacggacacuaaaacgcuaauaauuuau

SEQ ID NO: 483160 - RNA, 59 nt, Human
aagagagggaguaacaugucuucucauugcccacggacccaaccucuguccaggugccc

SEQ ID NO: 483161 - RNA, 64 nt, Human
caccauaaauguuacaauaucugaauaugcuuugucaaacuaucccuuuaugcaaucgucuuca

SEQ ID NO: 483162 - RNA, 64 nt, Human
acaagaugcuuugaagguucugauuuucaacugaucaaacuaaugcaaaaaaaaaaaaguaugu

SEQ ID NO: 483163 - RNA, 64 nt, Human
guuuucauguuucugauuaguuggguuuuuuauaucaaacuauauuucauguugcauagauuuc

SEQ ID NO: 483164 - RNA, 64 nt, Human
auagacuuagccuaguaauuuuauagugagaguuucaaacuauauaucagugucuauagcauca

SEQ ID NO: 483165 - RNA, 63 nt, Human
aggccuccaacauugaauaaaacucaguuugcaucaaacuagauguauuuaauauaauccuua

SEQ ID NO: 483166 - RNA, 64 nt, Human
ggguugauugaaauuugaucucuacauuucaaaaucaaacuagugaauacaguuugucuuucaa

SEQ ID NO: 483167 - RNA, 64 nt, Human
auuuugguuacauaaaguuguauguuuuaagugaucaaacuaagaauauuguuuauagguuuua

SEQ ID NO: 483168 - RNA, 64 nt, Human
uguacugcaauauagacaagaugucucuagagacucaaacuacuguuuuauuaaaaaaguaaac

SEQ ID NO: 483169 - RNA, 64 nt, Human
acaaagccccuaccuaugggcuaguguguggugaucaaacuaucacaauucagugugaugagca

SEQ ID NO: 483170 - RNA, 64 nt, Human
ugagauaauggaaaauugacuggaaauucaaaacucaaacuacuaucuuuagauauaaacacua

SEQ ID NO: 483171 - RNA, 64 nt, Human
gcucuuaguuuucauuccuauugcccaaguauugucaaacuaugguauuauuuuaauguuacuu

SEQ ID NO: 483172 - RNA, 64 nt, Human
auaaugauagguaauaauguguuccaaagcuuuuucaaacuagaauaaggaggcaaauagaaga

SEQ ID NO: 483173 - RNA, 64 nt, Human
ugauacugggacucaucaggaaaggauucugcuuucaaacuauacugaacauuccuguccuagc

SEQ ID NO: 483174 - RNA, 59 nt, Human
ggcccagcugucuugccugcccgugggcacccacggacguggcuuggugcugaggauag

SEQ ID NO: 483175 - RNA, 53 nt, Human; identical to SEQ ID NO: 150135

SEQ ID NO: 483176 - RNA, 59 nt, Human
gccccaccggcgcuggcggcgcgcccugccccacggacccgggcagugaaccagagauc

SEQ ID NO: 483177 - RNA, 59 nt, Human
ccuggucucucuuccuuuccuugcucucacccacggauaaaaccagaagcgacaggagg

SEQ ID NO: 483178 - RNA, 64 nt, Human
ugauguuaucagacagagcacugacuauguacuaucaaacuaucuaacaaucugcauaagucug

SEQ ID NO: 483179 - RNA, 64 nt, Human
ucauugugauuuuuguuuucuuuuuaucauuguaucaaacuauauggaaaucauaugguuagau

SEQ ID NO: 483180 - RNA, 64 nt, Human
uaguacuucaaagaagauagcuguauaaaugucaucaaacuauacuauauagagaaucuuaagu

SEQ ID NO: 483181 - RNA, 64 nt, Human
cuacugcuugauuacuuuaaguucauugcuugcuucaaacuaagguuucccuaccuucaaaaau

SEQ ID NO: 483182 - RNA, 64 nt, Human
uugaagguggcuccugccaccugcuaauagcaguucaaacuaaauuuuuuguaucaagucccug

SEQ ID NO: 483183 - RNA, 64 nt, Human
uaaauaaggacuuaacugccuguaacaugaaacuucaaacuaaaccacuaacucaaugaacuac

SEQ ID NO: 483184 - RNA, 64 nt, Human
guauuaguccaggggauuuugccuuaugcugaggucaaacuaaggauaagcaagcuuuuguccu

SEQ ID NO: 483185 - RNA, 64 nt, Human
aaaggaaaagcccacccgaaucuuguagaaauauucaaacuaauaaaaucaugaauauuuuuau

SEQ ID NO: 483186 - RNA, 64 nt, Human
aacaagacccugucucuaaaaaaagagaaagaaaucaaacuaaucaugcugcucauggauuuuu

SEQ ID NO: 483187 - RNA, 64 nt, Human
gugauucauuuuuauauuuuauugcuuugaaugcucaaacuaugggaaaucuuugguaaaaaua

SEQ ID NO: 483188 - RNA, 64 nt, Human
uccuugacuuugaacuaaugauaaaguaaugaucucaaacuaugacagaaaaguaauguaaaau

SEQ ID NO: 483189 - RNA, 64 nt, Human
ucauuuuguaauauuaaauuauggcaauuuuauuucaaacuaaaguuugaacaccggaaaguca

SEQ ID NO: 483190 - RNA, 64 nt, Human
gagcauuuuaagaggugcagccucuggaaguggaucaaacuagaacucauaugccauacuagau

SEQ ID NO: 483191 - RNA, 64 nt, Human; identical to SEQ ID NO: 344263

SEQ ID NO: 483192 - RNA, 64 nt, Human; identical to SEQ ID NO: 344264

SEQ ID NO: 483193 - RNA, 64 nt, Human; identical to SEQ ID NO: 331721

SEQ ID NO: 483194 - RNA, 64 nt, Human
aaagaaaucuguccguaaguacccccacaaucagucaaacuauauuuaaagccagccuguuuuc

SEQ ID NO: 483195 - RNA, 64 nt, Human
guuucucaauguacaucuuuuuaucccaacacccucaaacuagaauauuugucaguggucaaga

SEQ ID NO: 483196 - RNA, 64 nt, Human
guaugcaacagcuggguaauaagacuagcauagcucaaacuauccugccaaacgcucucaucug

SEQ ID NO: 483197 - RNA, 64 nt, Human
aaguuaacuccaaauuucuuuauagcugauuauuucaaacuaggauccaauuaaaguuuacaua

SEQ ID NO: 483198 - RNA, 64 nt, Human
auaauuuaugugcaaguguuuucagugcccugaaucaaacuauaaauguggggagaaaucaccu

SEQ ID NO: 483199 - RNA, 64 nt, Human
ccuccaucucugccuaagggagauauaaaagaguucaaacuauugcccauguuccccaggguca

SEQ ID NO: 483200 - RNA, 64 nt, Human
acaugucugaauuucuguguccagacgagccccaucaaacuaguugggaagggccccagugacc

SEQ ID NO: 483201 - RNA, 64 nt, Human
agaaaauacacgguaacuuuucugccuugcagcaucaaacuauaguacagcugagccccagugc

SEQ ID NO: 483202 - RNA, 64 nt, Human
ugaugaaagugaaaaauguggguagcuuauacuuucaaacuaaugccagugacuagagagaggu

SEQ ID NO: 483203 - RNA, 64 nt, Human
cauuuccuuccaggaaugaaagagaaccucguccucaaacuaaaggccacagaaaugggcacua

SEQ ID NO: 483204 - RNA, 64 nt, Human
guucaacugauccauuccacaauguauacauauuucaaacuaucgaguuguacaugauaaauau

SEQ ID NO: 483205 - RNA, 64 nt, Human
cucaacaguguauugauucauauucuccuagggcucaaacuacucucuauugguuccaggauaa

SEQ ID NO: 483206 - RNA, 64 nt, Human
uugugugaaggcuagccuaacagaacaggagguaucaaacuagcugcuaugugcaaacagcguc

SEQ ID NO: 483207 - RNA, 59 nt, Human
agccucaggggccucaggggagcccccaccccacggauguugucaggaaucaugaucug

SEQ ID NO: 483208 - RNA, 59 nt, Human
cacccaacuccacagggcuguuuugccuccccacggaaggcgggcugaggagacaacca

SEQ ID NO: 483209 - RNA, 59 nt, Human
acacucuuuuuagguguaaaagauggagucccacggaggaggggcagagccaggaggca

SEQ ID NO: 483210 - RNA, 64 nt, Human
cuuuugauuucuaaggaaaauauuagcauacauuucaaacuaaauguuuuacaguggcuuaucu

SEQ ID NO: 483211 - RNA, 64 nt, Human
ugcaagcuuuucaaaauuggacuuaaaaucuaauucaaacuaauagaauuaauggaauauguaa

SEQ ID NO: 483212 - RNA, 64 nt, Human
agaugaggucugucuuauguugcccaggcuggucucaaacuauccuacuucuuccucccaaagu

SEQ ID NO: 483213 - RNA, 64 nt, Human
ggaacuaaacagaacaaccauuuaccccuccuuuucaaacuagagaauaaagauuugguuuuag

SEQ ID NO: 483214 - RNA, 64 nt, Human
aucucaagcaagaauggcguugguuucuuccauuucaaacuaaucagcauucuccagcaaugac

SEQ ID NO: 483215 - RNA, 64 nt, Human
uuaaacuucacucuugaauucuuuacaaucuaagucaaacuaaguuauaauuuaggauugucuu

SEQ ID NO: 483216 - RNA, 64 nt, Human
cucaauagcuccaagcuguuaaagauauuuuuauucaaacuaccuauauuccuuguguaauuaa

SEQ ID NO: 483217 - RNA, 64 nt, Human
uugcauuuucuuccuuucgcagccagucagucuuucaaacuauugacaguaagauaauucucac

SEQ ID NO: 483218 - RNA, 64 nt, Human
acucaaugcucugaucucuagggagugugauuauucaaacuaaugagaggacaagaagacacag

SEQ ID NO: 483219 - RNA, 64 nt, Human
aagaacaaagcuggaggcaucacgcuacccagcuucaaacuauacuacaaggcuacaguaacca

SEQ ID NO: 483220 - RNA, 64 nt, Human
uuucuuaaauauaaauuugaccuaaaauauuuucucaaacuaauucaugaaacagcaacuuuua

SEQ ID NO: 483221 - RNA, 64 nt, Human
aaaguaauuuaugaaguaaacuucaguugcuuaaucaaacuaaugauagucuaacaacugagca

SEQ ID NO: 483222 - RNA, 64 nt, Human
aucucuacucaaaugugucagggucuucuacggaucaaacuacacaugcguuuucauuccaaaa

SEQ ID NO: 483223 - RNA, 64 nt, Human; identical to SEQ ID NO: 345357

SEQ ID NO: 483224 - RNA, 64 nt, Human; identical to SEQ ID NO: 344279

SEQ ID NO: 483225 - RNA, 64 nt, Human; identical to SEQ ID NO: 344280

SEQ ID NO: 483226 - RNA, 64 nt, Human; identical to SEQ ID NO: 331700

SEQ ID NO: 483227 - RNA, 64 nt, Human
aagaugcuucugaaaauugcauuuuauuaccauuucaaacuauuuuuuaaaaauaaauacaguu

SEQ ID NO: 483228 - RNA, 64 nt, Human
cacuagaggaguucuggacaaagcuuuuaauuagucaaacuaaauuaaggcucauuaaaaggaa

SEQ ID NO: 483229 - RNA, 64 nt, Human
uuuuuuuucacuucaccgaacccuucugauucuuucaaacuauugccagguaguuguuaguguu

SEQ ID NO: 483230 - RNA, 64 nt, Human
uaucacaauuugggugaaaaacuuaaguacccuuucaaacuauuuauaugaggaagucacuuua

SEQ ID NO: 483231 - RNA, 64 nt, Human
uaaaaagggaagaaacugcugagcuugcugugcuucaaacuacuacuggaccuuauuuuggaac

SEQ ID NO: 483232 - RNA, 64 nt, Human
uuuuaauacaugauucucuaugaaauugaugggcucaaacuagcugugaaucuucugagaguga

SEQ ID NO: 483233 - RNA, 64 nt, Human
uugaccucaauggagguuugcaaagacugaguguucaaacuacuguacauuuuuuuucaagugc

SEQ ID NO: 483234 - RNA, 64 nt, Human
gaaugugaaaaaggaauaaaaaauacuguugggcucaaacuaaauucaaagaaguacuuuauug

SEQ ID NO: 483235 - RNA, 64 nt, Human
caugaacaauauaaauuguguauauuacuuaacaucaaacuaaacaagauucagaauugauggu

SEQ ID NO: 483236 - RNA, 64 nt, Human
caguuguagucuacacugcagucuuauuccugguucaaacuaccucuuuaaauugauuugucuu

SEQ ID NO: 483237 - RNA, 64 nt, Human
uugguucuguuuuuuuaaaaauauuuuuauguguucaaacuauuuugguaaauuuuuagcaaaa

SEQ ID NO: 483238 - RNA, 64 nt, Human
cacguggguuucaguguauuugccuuugaacccuucaaacuaaacuuuagccuuuuggcuggug

SEQ ID NO: 483239 - RNA, 64 nt, Human
aaucaaaauuaauuaaaaaguuaaaucuaagaccucaaacuaugaaacagcuaaaagaaaacau

SEQ ID NO: 483240 - RNA, 64 nt, Human; identical to SEQ ID NO: 345463

SEQ ID NO: 483241 - RNA, 64 nt, Human; identical to SEQ ID NO: 345464

SEQ ID NO: 483242 - RNA, 64 nt, Human; identical to SEQ ID NO: 345465

SEQ ID NO: 483243 - RNA, 64 nt, Human; identical to SEQ ID NO: 344232

SEQ ID NO: 483244 - RNA, 64 nt, Human
gacuuaauacugagcaauguuuugaaacaagauuucaaacuaaucuggguuguaauacaguuua

SEQ ID NO: 483245 - RNA, 64 nt, Human
uauuauuuaaguauuuauugaaguagaggggccuucaaacuacuuuauacuagugauaguuuga

SEQ ID NO: 483246 - RNA, 64 nt, Human
cugccaauaccaggaugagcaacaacaguaacaaucaaacuacugcccaguuucccuggacuag

SEQ ID NO: 483247 - RNA, 64 nt, Human
aacagucucuaugcuuauuuacaucuucuacuguucaaacuaagagauuuuuaaauucugaaaa

SEQ ID NO: 483248 - RNA, 64 nt, Human
cgugggcugcgucugacuuuaauacaggcagugcucaaacuagaauaagcacuaauuaaaggaa

SEQ ID NO: 483249 - RNA, 64 nt, Human
acacauagaaacaccaagauuuucagcaucugaaucaaacuaaaauuacuugcuugacuucacu

SEQ ID NO: 483250 - RNA, 64 nt, Human
aaguugaacucuaagugugacuaaauuuuaaaugucaaacuauaaauauagaagcagcuuuauu

SEQ ID NO: 483251 - RNA, 64 nt, Human
cuuugagaagaauuuaauuaugucucaugagguaucaaacuauguaauuuuguccuuguuauuu

SEQ ID NO: 483252 - RNA, 64 nt, Human
uccucagcagaccucuuggaauuaggguuucuaaucaaacuaagucuugcaucauaaauucuau

SEQ ID NO: 483253 - RNA, 64 nt, Human
ugccccaucagugcucccucacaugucaguaccuucaaacuagggccaagcccagcacugcuug

SEQ ID NO: 483254 - RNA, 64 nt, Human
ucauucaugguaucucucauguuugauguauuuuucaaacuaagaucuaugauaguuuuuuuuc

SEQ ID NO: 483255 - RNA, 64 nt, Human
cauuuccauggugcaaaaacucuuauggccaaauucaaacuauaaacaugaugucaacuuccuu

SEQ ID NO: 483256 - RNA, 64 nt, Human
ccccaguugcaauugugucauagucaucuguauaucaaacuauuuuauucccauaacuucauug

SEQ ID NO: 483257 - RNA, 64 nt, Human; identical to SEQ ID NO: 344115

SEQ ID NO: 483258 - RNA, 64 nt, Human; identical to SEQ ID NO: 344116

SEQ ID NO: 483259 - RNA, 64 nt, Human; identical to SEQ ID NO: 331702

SEQ ID NO: 483260 - RNA, 64 nt, Human; identical to SEQ ID NO: 344098

SEQ ID NO: 483261 - RNA, 64 nt, Human
ucacgucauuaaagucagaagauuauagaccuucucaaacuauaagucccucuucuugccguug

SEQ ID NO: 483262 - RNA, 64 nt, Human
gaccaagacuccccuagagaacagaacaagcauaucaaacuacccucaucuuuugagaaauggg

SEQ ID NO: 483263 - RNA, 64 nt, Human
agaaagaugcugauugguaggugaugguaugauaucaaacuauuuugcaguuguaaauagggga

SEQ ID NO: 483264 - RNA, 64 nt, Human
uuuucuuuugaggcaugcacaucuggaauuaaggucaaacuaauucucacaucccucuaaaagu

SEQ ID NO: 483265 - RNA, 64 nt, Human
caccuucucuuuuugcccauauugcacuuugauuucaaacuaugcacugugaagagauuuuuuu

SEQ ID NO: 483266 - RNA, 64 nt, Human
uauugaucauuuuagacacugggagaagagaaccucaaacuaggaggaaaagacagagccucca

SEQ ID NO: 483267 - RNA, 64 nt, Human
cacccaccaggcaggcuacaagugaggcuaccuuucaaacuacauugcccacccugaaggugga

SEQ ID NO: 483268 - RNA, 64 nt, Human
agaguuuaaaaccacuaaaauagauugauguucuucaaacuaggcaaaacaacucauauguuaa

SEQ ID NO: 483269 - RNA, 64 nt, Human
ucuuaauuacuaaugccacacagaaauuauacaaucaaacuagaucugaagcauaauuuaagaa

SEQ ID NO: 483270 - RNA, 64 nt, Human
acagcuucuaguuaaaaccuuuguugcuguccucucaaacuauauuuauaaaaauuugcuaggg

SEQ ID NO: 483271 - RNA, 64 nt, Human
aaugauauuuaaaccaucuuggcuugugcuuuauucaaacuaaugugaaacaauaaauuuaaau

SEQ ID NO: 483272 - RNA, 64 nt, Human
uuacuuucugucaagauauuuacccgugucaaauucaaacuacaguacuguguaauuauguaua

SEQ ID NO: 483273 - RNA, 64 nt, Human
gaagcuuaguaaccagcgccaaaaaguagauucaucaaacuagagaccccagcuccccuucucg

SEQ ID NO: 483274 - RNA, 64 nt, Human; identical to SEQ ID NO: 331701

SEQ ID NO: 483275 - RNA, 64 nt, Human; identical to SEQ ID NO: 345744

SEQ ID NO: 483276 - RNA, 57 nt, Human; identical to SEQ ID NO: 345745

SEQ ID NO: 483277 - RNA, 59 nt, Human
guuugaguuuuuccucccagugagacugccccacggagacagaggaaagggcuggcucc

SEQ ID NO: 483278 - RNA, 64 nt, Human
uugguuuuaguguguuguauaacuuugcuguauaucaaacuaauuuugacaaguuuucauccua

SEQ ID NO: 483279 - RNA, 64 nt, Human
uuuucugggcaccuugaagcaucagggcgugaaaucaaacuagaugugggcagggagaggguug

SEQ ID NO: 483280 - RNA, 64 nt, Human
uguuauuucaggcaaaucaaauuaaaucagacuaucaaacuacaagagaaccuuagucuuuuuu

SEQ ID NO: 483281 - RNA, 64 nt, Human
guuggugaguuuugaagaauaacuacauuuuauuucaaacuaacaaauguauacgguuuuaguu

SEQ ID NO: 483282 - RNA, 64 nt, Human
gaaccccagcccacucccccaucccuccucccuaucaaacuaguauaaugauuuugaaucggua

SEQ ID NO: 483283 - RNA, 64 nt, Human
acacugugcacaaacguuuuauacuaaauaaauaucaaacuacauucuucugaaagauguuucu

SEQ ID NO: 483284 - RNA, 64 nt, Human
ugucuuuuugguuauuuagugacaaacguggcuuucaaacuaugcuuaaaaaguuccggcugga

SEQ ID NO: 483285 - RNA, 64 nt, Human
guauaagagagaauaaaugauuucucuaaggucaucaaacuauuuaguuuuuccacuuuaccuu

SEQ ID NO: 483286 - RNA, 64 nt, Human
augacuuuuaauguaaacaaacugcagguuuuuuucaaacuaauuuuaagaauuuagucuuauu

SEQ ID NO: 483287 - RNA, 64 nt, Human
cuaauuuuuuagcaaacuagaccagcauuauuacucaaacuaaaaauaucacaccugaaaaauu

SEQ ID NO: 483288 - RNA, 64 nt, Human
aggaaggaaauaauucucuccuuuguuuugaaccucaaacuagauaaacccuaggaauugcuua

SEQ ID NO: 483289 - RNA, 64 nt, Human
uguaaucccaacaucuaauuuuagucuuagaaacucaaacuauuaauaaguggaaaaaguuuaa

SEQ ID NO: 483290 - RNA, 64 nt, Human
aaggagcccaguaaguuuugaaaauguuugcgaaucaaacuaaauuuaagugggaugauuagau

SEQ ID NO: 483291 - RNA, 64 nt, Human; identical to SEQ ID NO: 344118

SEQ ID NO: 483292 - RNA, 64 nt, Human; identical to SEQ ID NO: 331719

SEQ ID NO: 483293 - RNA, 64 nt, Human; identical to SEQ ID NO: 344149

SEQ ID NO: 483294 - RNA, 64 nt, Human; identical to SEQ ID NO: 344150

SEQ ID NO: 483295 - RNA, 64 nt, Human
cuuuaccuugagaucugucuucauacccuuccccucaaacuaacaaaaacauuuccaauaaaaa

SEQ ID NO: 483296 - RNA, 64 nt, Human
uucauauaugauaaaagugaauguucuaagucucucaaacuagcguuuuauguaauaauaugua

SEQ ID NO: 483297 - RNA, 64 nt, Human
cacuugaagcucagaccuauuggucuugaucaaaucaaacuaagaagaccuuagaaauaagcua

SEQ ID NO: 483298 - RNA, 64 nt, Human
gguuaccugcuuacacacuauauuuuaauugaauucaaacuaucaagcacuacuuagaaacugg

SEQ ID NO: 483299 - RNA, 64 nt, Human
ccauuuaugguaccuauuuggugcuaguaaauuuucaaacuagauuuauaaaugcacuguaaua

SEQ ID NO: 483300 - RNA, 64 nt, Human
cccaggaucaucucuagcaacaggucacacauugucaaacuaccucucagcaggguaagugacc

SEQ ID NO: 483301 - RNA, 64 nt, Human
gcaccuguuauauaauucaguuuuaaauuguaguucaaacuaccuaaaacguuuuuuauuuuug

SEQ ID NO: 483302 - RNA, 64 nt, Human
uaauuccuaugacuuuuguuuuguauugcccaagucaaacuacaucacuuguaucuccagccca

SEQ ID NO: 483303 - RNA, 64 nt, Human
guggcauuucuucuguuucagguuuugucugaguucaaacuagugccuguguuguuacggaaag

SEQ ID NO: 483304 - RNA, 64 nt, Human
gugaauauguaaaucuuuuaucacuuucucaaauucaaacuaaaggggaaagaucaaaccccuu

SEQ ID NO: 483305 - RNA, 64 nt, Human
cccaaagcaauuuauagauucaaugcuauuccuaucaaacuaccaauaacauucuucacagaau

SEQ ID NO: 483306 - RNA, 64 nt, Human
aagaacaaagcuggaggcaucgcauuacccaacuucaaacuauacuacagggcuacaguaacca

SEQ ID NO: 483307 - RNA, 64 nt, Human
cggcagcacuauacacaaucgcaaagucagggaaucaaacuaaauguccaucagugguagaaag

SEQ ID NO: 483308 - RNA, 64 nt, Human; identical to SEQ ID NO: 344573

SEQ ID NO: 483309 - RNA, 64 nt, Human; identical to SEQ ID NO: 331720

SEQ ID NO: 483310 - RNA, 64 nt, Human; identical to SEQ ID NO: 344168

SEQ ID NO: 483311 - RNA, 64 nt, Human; identical to SEQ ID NO: 344169

SEQ ID NO: 483312 - RNA, 64 nt, Human
caaaaaaaaaaagcuauccaccuuuccaugugggucaaacuaaaauuagaaauguccccucacu

SEQ ID NO: 483313 - RNA, 64 nt, Human
ccaugaaaagccaaauuaaaaaucaaggauucagucaaacuaagcagguacucaugccagguac

SEQ ID NO: 483314 - RNA, 64 nt, Human
aaugggguuaaacaugggguagguauuuugucuuucaaacuacaaauggaauguggugacauaa

SEQ ID NO: 483315 - RNA, 64 nt, Human
agaaaaaucagggcauuuugugagugccuuaagaucaaacuaacaagaucugacccucuccccu

SEQ ID NO: 483316 - RNA, 64 nt, Human
acuuuauagaucacuaucuaaaugaaaauuuacaucaaacuaguguuuuaauaugacaguucua

SEQ ID NO: 483317 - RNA, 64 nt, Human
acauuguauacacaucaugcuauuuaaaauacguucaaacuauaguguaaaugcuaauuaacca

SEQ ID NO: 483318 - RNA, 64 nt, Human
ccauggcacggcuccguuucuuaaaguuaaaacgucaaacuaaaguguuauugacccugugagu

SEQ ID NO: 483319 - RNA, 64 nt, Human
cugcuugcucuccuuugcugauggauugcauuuaucaaacuauucaugcuagcauuuuuccaac

SEQ ID NO: 483320 - RNA, 64 nt, Human
uaaguuauggucauauauacccaaacaaaccaaaucaaacuaaauuacugcauauaauuuuggg

SEQ ID NO: 483321 - RNA, 64 nt, Human
auagugaaacagagccuuucugaagagaauuauaucaaacuaauuacaaccaagaaauaauagu

SEQ ID NO: 483322 - RNA, 64 nt, Human
auaugucaguuaugaaauuauuauaauucagccuucaaacuacuacugaucaacuaaaggaaag

SEQ ID NO: 483323 - RNA, 64 nt, Human
agaucacauaacuggcuuauuuuuaacagcuuugucaaacuacaauuuacaugccguaaaaugu

SEQ ID NO: 483324 - RNA, 64 nt, Human
gaguaaauuaagccacaauuugguaccuagggucucaaacuaaaauuuauuuuuauaaaugaau

SEQ ID NO: 483325 - RNA, 64 nt, Human; identical to SEQ ID NO: 344099

SEQ ID NO: 483326 - RNA, 64 nt, Human; identical to SEQ ID NO: 344100

SEQ ID NO: 483327 - RNA, 64 nt, Human; identical to SEQ ID NO: 344101

SEQ ID NO: 483328 - RNA, 64 nt, Human; identical to SEQ ID NO: 344184

SEQ ID NO: 483329 - RNA, 64 nt, Human
ccacuagggaaaguaaguugcacucauguaaguaucaaacuauauaaaaggaggccuugugcau

SEQ ID NO: 483330 - RNA, 64 nt, Human
acuuuuggaggggacccuugaauguuaguuucauucaaacuauauuuuguuuuuuucacuuuua

SEQ ID NO: 483331 - RNA, 64 nt, Human
gaggggacagagcgugagcugagcaggccacacuucaaacuacuuugcugcuaauauuuuccuc

SEQ ID NO: 483332 - RNA, 64 nt, Human
aaauagaguuugagaaacuuuuguauaaguaguuucaaacuauuugagaggagaauuaaagaca

SEQ ID NO: 483333 - RNA, 64 nt, Human
gcugaagaccauaaccuuuugggucaacuguuggucaaacuauaggagagaccagggaccauca

SEQ ID NO: 483334 - RNA, 64 nt, Human
auuauaacaaacugucucucagaccacagugcaaucaaacuagaacucaggauuaagaaacuca

SEQ ID NO: 483335 - RNA, 64 nt, Human
augaauaaagccggaggcaucacgcuaccugacuucaaacuaugcuacaaggcuacauaaccaa

SEQ ID NO: 483336 - RNA, 64 nt, Human
aaagaauacuguucauaugcauuguuuuuguguuucaaacuaaauacaggcaguuuugugccag

SEQ ID NO: 483337 - RNA, 64 nt, Human
uaaguuauaauaauuguagcuuucugaauaagugucaaacuauaucuuuaagugugcuguaugc

SEQ ID NO: 483338 - RNA, 64 nt, Human
cccaaagcaauuuacagagccaaugcuauuucuaucaaacuaccaauggcauuuuucacagaau

SEQ ID NO: 483339 - RNA, 64 nt, Human
aaugugugugaucccugcuauggagcagagguuaucaaacuaaagcccauggaccaaauccuau

SEQ ID NO: 483340 - RNA, 64 nt, Human
uuugucuuucccagacaguugcuuugauucuuccucaaacuacuuacaaucaccuacaguccaa

SEQ ID NO: 483341 - RNA, 64 nt, Human
guagaccucacaauucuuuuuuuuucuuuuucacucaaacuacagcaaaauauuauauuucuau

SEQ ID NO: 483342 - RNA, 64 nt, Human; identical to SEQ ID NO: 344363

SEQ ID NO: 483343 - RNA, 64 nt, Human; identical to SEQ ID NO: 344394

SEQ ID NO: 483344 - RNA, 64 nt, Human; identical to SEQ ID NO: 344395

SEQ ID NO: 483345 - RNA, 64 nt, Human; identical to SEQ ID NO: 344417

SEQ ID NO: 483346 - RNA, 64 nt, Human
uaaggaauuaccuucagcugcuaggaagagcgacucaaacuaacaauggcuucaacgagaagca

SEQ ID NO: 483347 - RNA, 64 nt, Human
acaagauuuaauaggaaaugaaacagcuugaauuucaaacuaaauuguauuuucagagcuaucc

SEQ ID NO: 483348 - RNA, 64 nt, Human
cacagcuagcuguaaaauugaaaauucaguucagucaaacuagccauauuucaagugcucaaca

SEQ ID NO: 483349 - RNA, 64 nt, Human
uuuuuaugugacugauuuuuuuuuaaaucgauguucaaacuaauaaauauuuuuuuaugaagag

SEQ ID NO: 483350 - RNA, 64 nt, Human
uuuuuacucaaguaagugguugauuuuuuuuaagucaaacuacacugaaacuuuuauccuuuuc

SEQ ID NO: 483351 - RNA, 64 nt, Human
uuuaucuuccucaugugcaguuuaacaaacuuggucaaacuaguuagcaaauuagaacuucaga

SEQ ID NO: 483352 - RNA, 64 nt, Human
auggguuuuguguacuguaaagaauuuagcuguaucaaacuagugcaugaauagauucucuccu

SEQ ID NO: 483353 - RNA, 64 nt, Human
cuaagagauuuugcaaugaggagaagcauuguuuucaaacuauauaacugagccuuauuuauaa

SEQ ID NO: 483354 - RNA, 64 nt, Human
aaccaauacaacaaaacgaguggcacgauuuauuucaaacuaggccagcugggauuccagcuuu

SEQ ID NO: 483355 - RNA, 64 nt, Human
aggcugcagugccaugcagacaccucauggcacuucaaacuauuaaaaugcauuuuaucuuauc

SEQ ID NO: 483356 - RNA, 64 nt, Human
ugaaaaauguaacucaugaugaucugugaaaccuucaaacuaggaccaauugacuuacuugaua

SEQ ID NO: 483357 - RNA, 64 nt, Human
aaauugaaaaaaaaaauaaaguaauacaaaaaaaucaaacuauaaagcaaaaacauuuauuaaa

SEQ ID NO: 483358 - RNA, 64 nt, Human
aaaucugaggacagugcuagugggaaaauaauuuucaaacuaccugguuaaccaaaauacaaaa

SEQ ID NO: 483359 - RNA, 64 nt, Human
ccggggcaagcacuucaucggagacuuccugccuccagacgagcuggaaaaguuuauggagacc

SEQ ID NO: 483360 - RNA, 59 nt, Human
ugggcucuggccccaagauguuggggggccccacggagaguugacuugguagaguuccu

SEQ ID NO: 483361 - RNA, 53 nt, Human; identical to SEQ ID NO: 150149

SEQ ID NO: 483362 - RNA, 59 nt, Human
ugaaggaccuagggagcccagcccaccuucccacggacugggguucccucacaugugca

SEQ ID NO: 483363 - RNA, 64 nt, Human
gucauucucauugaauuauaaaagccagcaggcuucaaacuaggggacaaagcaaaaagugaug

SEQ ID NO: 483364 - RNA, 64 nt, Human
gcaauaacaaccuuugauuacugaaucccuacacucaaacuauagugauauaucaguguuugag

SEQ ID NO: 483365 - RNA, 64 nt, Human
gaucaaagauaaugugauucuuaugauugauuucucaaacuagcuuuucccucccaaguccagg

SEQ ID NO: 483366 - RNA, 64 nt, Human
cuggaguguguuuuuaucucuuuccaaaaguuugucaaacuaugcagagcugcugaaggaagaa

SEQ ID NO: 483367 - RNA, 64 nt, Human
gccuuugauucaacuguuuuaaguccucauuuucucaaacuaagugcuugcuguucccaaauau

SEQ ID NO: 483368 - RNA, 64 nt, Human
cacauauauagggccuuuuugguguugaagggaaucaaacuacauuugcugcuugugugcgugu

SEQ ID NO: 483369 - RNA, 64 nt, Human
cucauuauguuucagauaagguaacuccuagauaucaaacuaauuuguugggguagagauuuua

SEQ ID NO: 483370 - RNA, 64 nt, Human
uggaauuuagugcauuucaaaaaguaaucauauaucaaacuaggcaccacacuaaguuccugau

SEQ ID NO: 483371 - RNA, 64 nt, Human
ugcaauaacaacuuugauuacugaauccauacacucaaacuauagugauauaucaguguuuggg

SEQ ID NO: 483372 - RNA, 64 nt, Human
uccacaaggcgggaguguuucacuuucuggugauaaacuugauggucauuguuaugauuaagau

SEQ ID NO: 483373 - RNA, 64 nt, Human
acuugguaauuucuccagacaggaaagcuuuagaaaacuugagugaaauggagcaagcuugaag

SEQ ID NO: 483374 - RNA, 64 nt, Human
cggaugagcaguaaguaaguaaguguggggauuuaaacuugaggguuucccuccugacuagccu

SEQ ID NO: 483375 - RNA, 64 nt, Human
ugugaggcagaugcucauuguucccaucuugaugaaacuugagucucagggaagugaagugacu

SEQ ID NO: 483376 - RNA, 64 nt, Human
aaaucugcauauuuguauuucaacaauguagcuaaaacuugauguaaauuccuccuuuuuuucc

SEQ ID NO: 483377 - RNA, 64 nt, Human
ugccauuccaagucccagaugucccucuucccccaaacuugaccuugaccaugucacuuuacgu

SEQ ID NO: 483378 - RNA, 64 nt, Human
ugaaacaacagcaaaacauguucaggaauuuuauaaacuugaugaggacauuaucccagaacuu

SEQ ID NO: 483379 - RNA, 64 nt, Human
auaaagcauuuggaagaugaccuuguugcccuugaaacuugaaaauagggauucuggggugagg

SEQ ID NO: 483380 - RNA, 64 nt, Human
cuuuuaggauuauuccuaaaugcaucuucuuuauaaacuugacuugcuaucucagcaagauaaa

SEQ ID NO: 483381 - RNA, 64 nt, Human
caguuuaaaaaacuaguacucuuguuaaaacucuaaacuugacuaaauacagaggacugguaau

SEQ ID NO: 483382 - RNA, 64 nt, Human
aguuucagccacaauuuagccaagaauaagauaaaaacuugaauaagaaguaaguagcauaaau

SEQ ID NO: 483383 - RNA, 64 nt, Human
uuacaguggaaugaguacuggacaaggagucaaaaaacuugauuucagguccuagcucuagcac

SEQ ID NO: 483384 - RNA, 64 nt, Human
cugcugugaauuugcaaacaagaaaucugagccaaaacuugacauuguggguuacauugccaga

SEQ ID NO: 483385 - RNA, 64 nt, Human
uauauguaacaaaacacauugcaucuagaaaucaaaacuugaaaguauuuccagggauuaggau

SEQ ID NO: 483386 - RNA, 64 nt, Human
uuccagggauuaggauuagaaggaauauuagaggaaacuugaaaucugaguuuaaaaagauuuu

SEQ ID NO: 483387 - RNA, 64 nt, Human
guauuauauaauggaauuuucuuuaggugugggaaaacuugaucugaaagaaaauuaucagcuu

SEQ ID NO: 483388 - RNA, 64 nt, Human
uuauaguacagugguguauaguggcauuucugauaaacuugaaaagacuugagucuuuccacug

SEQ ID NO: 483389 - RNA, 64 nt, Human; identical to SEQ ID NO: 314335

SEQ ID NO: 483390 - RNA, 64 nt, Human; identical to SEQ ID NO: 314336

SEQ ID NO: 483391 - RNA, 64 nt, Human; identical to SEQ ID NO: 314337

SEQ ID NO: 483392 - RNA, 59 nt, Human
gugugugguggggacaacagcacgugcagcccacggaagggcucuuucacagcuggcag

SEQ ID NO: 483393 - RNA, 64 nt, Human
aagaacugcugacguacuguggauguagaguauaaaacuugaaaaaugcagauguugaaggaau

SEQ ID NO: 483394 - RNA, 64 nt, Human
cuaaaaucaugucuugaaaacauguuuucucaugaaacuugaauacuaucucaaauaggaauau

SEQ ID NO: 483395 - RNA, 64 nt, Human
caagcccacuuaugaaucacugagaaaaagugaaaaacuugaguuggcaaagaugcagagcagc

SEQ ID NO: 483396 - RNA, 64 nt, Human
uaugcauccaagacaucagaacuuggauuuuaucaaacuugaugacuucucuaaaaggagcuuu

SEQ ID NO: 483397 - RNA, 64 nt, Human
augaguauaccaguuuauauauaaaaauguuuuuaaacuugacaaucauuacacuaaaacagau

SEQ ID NO: 483398 - RNA, 64 nt, Human
uggccccuaacagcaguuguacuguuuguauguuaaacuugauacauuuagaaguuaauguuaa

SEQ ID NO: 483399 - RNA, 64 nt, Human
uuuuuucuuucaugccucuuguaauguucugaacaaacuugaaugaugaaaguauuaaagagau

SEQ ID NO: 483400 - RNA, 64 nt, Human
ucccuuaagcuucuaggcuuucagaacacaacuuaaacuugaacucuuaugguugggacauucu

SEQ ID NO: 483401 - RNA, 64 nt, Human
acuuuagaugauaaaauggaauuuuugcauuauuaaacuugagaccagugaugcucagaagcuc

SEQ ID NO: 483402 - RNA, 64 nt, Human
guauagugcaaauucauuuuuaagauagaacacaaaacuugaaagaaguuuuaugcgugugaca

SEQ ID NO: 483403 - RNA, 64 nt, Human
uccagaguugcuacaauaaaauaaggggaauaauaaacuugagagugaauaaccauaguauucu

SEQ ID NO: 483404 - RNA, 64 nt, Human
aggaaauauauaauaaaaauguuaaccagaagguaaacuugaguguaauugucagacagacaca

SEQ ID NO: 483405 - RNA, 64 nt, Human
gaucgucgccugcuggcuaagaccagggagcuaaaaacuugaggaagggaaccugccugggugg

SEQ ID NO: 483406 - RNA, 64 nt, Human
cguccugaggucugucaaugucacaggaaaaggcaaacuugaggggaucgucgccugcuggcua

SEQ ID NO: 483407 - RNA, 64 nt, Human
uagagcaacccauuaaucuuuuguaguuuguauuaaacuugaacugagaccuugaugagucuuu

SEQ ID NO: 483408 - RNA, 64 nt, Human
uggcacucauaguugaauguauacuucuguaccaaaacuugaacauaaaaagacuagaauuugu

SEQ ID NO: 483409 - RNA, 64 nt, Human
ucauugaauguaaagaaugaaaccuucugacacaaaacuugagccacuuggauguuuacuccuc

SEQ ID NO: 483410 - RNA, 64 nt, Human
uuuuuucuuuuccauacuuguauauugaacauucaaacuugaauggaaaguugauuuugucugu

SEQ ID NO: 483411 - RNA, 64 nt, Human
ccuggccauccaugugaugguuuuggauggaguuaaacuugaugccagugggcagugcaugugg

SEQ ID NO: 483412 - RNA, 64 nt, Human
ggauuuucuauaacaccuuguguaagaaaauaaaaaacuugaucuaacugaaaaaauguguucc

SEQ ID NO: 483413 - RNA, 64 nt, Human
acuuuuguauugcugcuugcaaauaugcauuuccaaacuugaaauauaggugugaacagugugu

SEQ ID NO: 483414 - RNA, 64 nt, Human
gguucuucagguuucugcuugauugacuugguacaaacuugaagcaaguugccuucuaauuuuu

SEQ ID NO: 483415 - RNA, 64 nt, Human
ugaccaugacugaaguuccagcuuuacuuuuuauaaacuugaaugauaaagaauagaccauggg

SEQ ID NO: 483416 - RNA, 64 nt, Human
cuaagaauuaucagaaacaggaaagaauuuagaaaaacuugagaaaaccuaauccaaaauaaaa

SEQ ID NO: 483417 - RNA, 64 nt, Human
uacugaccagugucucuacuuuaaacccuaccugaaacuugagacuaugucuaauauagaaacu

SEQ ID NO: 483418 - RNA, 64 nt, Human
uagagaaauaaauguguauugaaccuuuuacugcaaacuugaaaaugcuagaaaaccaagcaug

SEQ ID NO: 483419 - RNA, 64 nt, Human; identical to SEQ ID NO: 345517

SEQ ID NO: 483420 - RNA, 64 nt, Human; identical to SEQ ID NO: 345518

SEQ ID NO: 483421 - RNA, 64 nt, Human; identical to SEQ ID NO: 345519

SEQ ID NO: 483422 - RNA, 64 nt, Human; identical to SEQ ID NO: 345535

SEQ ID NO: 483423 - RNA, 64 nt, Human
uaccuucuaguuggcauaaaaacaagaaccacaaaaacuugaaaaaucugaaacagagaacaga

SEQ ID NO: 483424 - RNA, 64 nt, Human
aucuuuuucucuucuauggaaaauccgaaggucuaaacuugacuuuuuugaggucuucucaacu

SEQ ID NO: 483425 - RNA, 64 nt, Human
uuuggguaugauuagagugaaaauggcagccagcaaacuugauagugcuuuugguccuagauga

SEQ ID NO: 483426 - RNA, 64 nt, Human
auacauggcucuauuuagcaaaguuuuuauacugaaacuugauuauugcugcccuuuauaauuu

SEQ ID NO: 483427 - RNA, 64 nt, Human
guuguaaaguagcaucaguuguauccuuucauuaaaacuugauaaacaaaagaacgaguuaagg

SEQ ID NO: 483428 - RNA, 64 nt, Human
uauaaaacacuguucacuguuuuuuuuaaaaaaaaaacuugauuuguuauuaacauugaucugc

SEQ ID NO: 483429 - RNA, 64 nt, Human
uauaauuguauuuaguuacuauuguagauaacuuaaacuugaguagugauuuacuguuuuauaa

SEQ ID NO: 483430 - RNA, 64 nt, Human
uuuuguguuugaaucuaacacacugacguuuggaaaacuugaucaaugagcuuuuaaccacgau

SEQ ID NO: 483431 - RNA, 64 nt, Human
uucucuagaacgcccacauuuccaccaacucaguaaacuugaggggagcugguuggcaccucgu

SEQ ID NO: 483432 - RNA, 64 nt, Human
uuuuucgaaacaaagcccuguggaagaaaauggaaaacuugaagaagcauuaaagucauucugu

SEQ ID NO: 483433 - RNA, 64 nt, Human
aaaucaaaauuccucauaaggcaugaaguuguaaaaacuugaauguguauaguuagauauuuaa

SEQ ID NO: 483434 - RNA, 64 nt, Human
aaacgaugagaguaaguugcaaccuugugacugaaaacuugaaaagaguggagcaggugggacc

SEQ ID NO: 483435 - RNA, 64 nt, Human
agguaaagcauucaauuuuuccauuucuuuuugaaaacuugaaaggacucacugaagaaaaucc

SEQ ID NO: 483436 - RNA, 64 nt, Human; identical to SEQ ID NO: 345536

SEQ ID NO: 483437 - RNA, 64 nt, Human; identical to SEQ ID NO: 331626

SEQ ID NO: 483438 - RNA, 64 nt, Human; identical to SEQ ID NO: 345537

SEQ ID NO: 483439 - RNA, 64 nt, Human; identical to SEQ ID NO: 345320

SEQ ID NO: 483440 - RNA, 64 nt, Human
auguguaauguaacuuuucucuuugaaucauauaaaacuugauuuuacauuggauguguguccu

SEQ ID NO: 483441 - RNA, 64 nt, Human
ggagccaggaagacuccgcagugggugagaaugaaaacuugagacucccaaguucugggccagc

SEQ ID NO: 483442 - RNA, 64 nt, Human
acaguuuuaaaaguaaaaugguguuaaaucucugaaacuugaacguaugaugcucuggacauuu

SEQ ID NO: 483443 - RNA, 64 nt, Human
caggacuuuuuagagucuuacauauuugugcaccaaacuugaagaugaaccagaaaacagacuu

SEQ ID NO: 483444 - RNA, 64 nt, Human
uacccagaccuuuuauagguaaugaagcaguucaaaacuugaaagaaaacaaaaccuguccuca

SEQ ID NO: 483445 - RNA, 64 nt, Human
cuauauaugugagcaagauuguguuuuagagaggaaacuugaaacuccaagaaagcacuugaug

SEQ ID NO: 483446 - RNA, 64 nt, Human
uguguacauaucuuugcaaaaauggauaaguacaaaacuugauguaaauuguaccaaugaauac

SEQ ID NO: 483447 - RNA, 64 nt, Human
cacuaauauucaguccuguauauuuuaauaaaauaaacuugacaaaggagagggauuccuguug

SEQ ID NO: 483448 - RNA, 64 nt, Human
auuggccuguuuuuuuuuucuaaauaauucuuuaaaacuugacuggaacaugccucugcauuuc

SEQ ID NO: 483449 - RNA, 64 nt, Human
agccauauacacuuggggagauuugccacaucuuaaacuugaauaauaguaugaguaaugcuua

SEQ ID NO: 483450 - RNA, 64 nt, Human
uuguaggaaacauuuuaauggaauuuaaacucaaaaacuugaauacaggacaaugcuugccuuu

SEQ ID NO: 483451 - RNA, 64 nt, Human
uauugcaaauaaauucuuggacaauuuuguauggaaacuugauauuaaaaacuagucugugguu

SEQ ID NO: 483452 - RNA, 64 nt, Human
uagaaucugaacuauaucuugacaaauauuauucaaacuugaauguaaauauauacaguaugua

SEQ ID NO: 483453 - RNA, 64 nt, Human; identical to SEQ ID NO: 345429

SEQ ID NO: 483454 - RNA, 64 nt, Human; identical to SEQ ID NO: 331643

SEQ ID NO: 483455 - RNA, 64 nt, Human; identical to SEQ ID NO: 345589

SEQ ID NO: 483456 - RNA, 64 nt, Human; identical to SEQ ID NO: 345590

SEQ ID NO: 483457 - RNA, 64 nt, Human
uuuuucauuugauucccuauuagaauuaauuuuaaaacuugaagacuuccagacuuauccaacu

SEQ ID NO: 483458 - RNA, 64 nt, Human
uuuuucuguuccagcaacuguuuuuaugaaagaaaaacuugaaaugcuacuuaacuuacuauuu

SEQ ID NO: 483459 - RNA, 64 nt, Human
acucaggacacuuuaacagggcagaauacucuaaaaacuugauaaaauuaaauauagauuuaau

SEQ ID NO: 483460 - RNA, 64 nt, Human
acugccagcuagccgccauggaugcagcagccugaaacuugagagcgaaagugagauaaauguc

SEQ ID NO: 483461 - RNA, 64 nt, Human
acaugucuguuuccaagagccacacauguuagagaaacuugaggaagaagggugugagucgugu

SEQ ID NO: 483462 - RNA, 64 nt, Human
agguaaaauuuugaaccauucccuagucauuuccaaacuugaaaacagaaucaguguuaaauuc

SEQ ID NO: 483463 - RNA, 64 nt, Human
cucauugucagccaaaugcuaucaugaacguaggaaacuugauuuuuuuguuuugaucauggcc

SEQ ID NO: 483464 - RNA, 64 nt, Human
uugauuuucuguaauaagagaaauccaauuuguaaaacuugaacaaugauaccguuuuauuuac

SEQ ID NO: 483465 - RNA, 64 nt, Human
aaauagcgucuacucgugcacugaauaaaaacagaaacuugaucauuuuauuccugauuagauu

SEQ ID NO: 483466 - RNA, 64 nt, Human
uaagcacagaaacucacuauauaagucacauaggaaacuugaaaggucugaggaugauguagau

SEQ ID NO: 483467 - RNA, 64 nt, Human
uuaaaauuucauuuuaggcuauuggcuacugaguaaacuugacuugugagggguuuuuauuuuu

SEQ ID NO: 483468 - RNA, 64 nt, Human
guaaaaaccuuuauguguaacuucuuuugauauuaaacuugauuuuugagccuguaauuuucuu

SEQ ID NO: 483469 - RNA, 64 nt, Human
uggguuuuaucuuguuuuaauuguuuuuguaucaaaacuugaaauuccucuauuucuauuggga

SEQ ID NO: 483470 - RNA, 64 nt, Human; identical to SEQ ID NO: 344631

SEQ ID NO: 483471 - RNA, 64 nt, Human; identical to SEQ ID NO: 344632

SEQ ID NO: 483472 - RNA, 64 nt, Human; identical to SEQ ID NO: 331644

SEQ ID NO: 483473 - RNA, 64 nt, Human; identical to SEQ ID NO: 345689

SEQ ID NO: 483474 - RNA, 64 nt, Human
aauugacugcuuuuuuuuuuuuuuuaaaugguugaaacuugaaggaaguucauucaaggauaag

SEQ ID NO: 483475 - RNA, 64 nt, Human
uucagaguuuuuccaaggucuacuuuugaguugcaaacuugacuuugaaauauuccuguugguc

SEQ ID NO: 483476 - RNA, 64 nt, Human
uucaguguaauauuguauuaauuuguuaaauucuaaacuugaauuucaauaaaauuuuaaagcu

SEQ ID NO: 483477 - RNA, 64 nt, Human
uggaaagucugguauuaaaaccucucuuacuuuuaaacuugauuuugcagacucuggcaauaag

SEQ ID NO: 483478 - RNA, 64 nt, Human
cuggcagagauaacuugggaaagauuuuaauauaaaacuugacauuggauauuagagcuuuaau

SEQ ID NO: 483479 - RNA, 64 nt, Human
cuuaagugauaggauuuguuauucuaaaggugauaaacuugaaaauaucagaaucugaguuuua

SEQ ID NO: 483480 - RNA, 64 nt, Human
auuaauauacuuauaaaauuaagauuuauuagccaaacuugaauucuaguuuuaaaacugacug

SEQ ID NO: 483481 - RNA, 64 nt, Human
aacagagugagacccugucuccaaagagaaagagaaacuugagaaggcuugugcccaaagcuug

SEQ ID NO: 483482 - RNA, 64 nt, Human
uaccuuuuuaauacucaguguucuguuuuuuuaaaaacuugauauuccuguauggugcauauau

SEQ ID NO: 483483 - RNA, 64 nt, Human
auaaaauacaaacuguggcauacauucucuauacaaacuugaaauuaaacugaguuuuacauuu

SEQ ID NO: 483484 - RNA, 64 nt, Human
aacaaagaucauucauuugguucuuuauacuaugaaacuugaguaaguauuaccuccuuaauuu

SEQ ID NO: 483485 - RNA, 64 nt, Human
gaaaacaaauaucaaagaucuaauaauacaaaacaaacuugauuaaaacuggugcuuaaaguuu

SEQ ID NO: 483486 - RNA, 64 nt, Human
uguuaauguguguguaugugcuuugguuguaggaaaacuugaaaauuccaaaauccuuauuuuc

SEQ ID NO: 483487 - RNA, 54 nt, Human; identical to SEQ ID NO: 344493

SEQ ID NO: 483488 - RNA, 64 nt, Human; identical to SEQ ID NO: 344494

SEQ ID NO: 483489 - RNA, 64 nt, Human; identical to SEQ ID NO: 331645

SEQ ID NO: 483490 - RNA, 64 nt, Human; identical to SEQ ID NO: 345355

SEQ ID NO: 483491 - RNA, 64 nt, Human
aauauagucaaugcacuaacaauuauguauauucaaacuugauuauuuuaaauucgaucuucag

SEQ ID NO: 483492 - RNA, 64 nt, Human
uuccaaaagauaauuucccugcccacaaaggcauaaacuugaaaacacaugagauugaaucaac

SEQ ID NO: 483493 - RNA, 64 nt, Human
aagcaauaauaauuuuaggcacccauccuagagaaaacuugaauucauagaaaaaguagguaca

SEQ ID NO: 483494 - RNA, 64 nt, Human
cuuauuaaaauacaaacagacaaaaaauaaaacaaaacuugaguucuauuuaccuugcacauuu

SEQ ID NO: 483495 - RNA, 64 nt, Human
gucagagaaaugucuguccauuuuuauucaggggaaacuugauuugagauuuuuaugccuguga

SEQ ID NO: 483496 - RNA, 64 nt, Human
uucuuuuuaaaaugacacuuaaaacaaucacugaaaacuugauccacaucacacccuguuuauu

SEQ ID NO: 483497 - RNA, 64 nt, Human
uuucugaguuuuuuuuuaaaaaaacuaauuauacaaacuugaaaggguucaccuugcccuagca

SEQ ID NO: 483498 - RNA, 64 nt, Human
aauuccugugaggucagaauuaucucugcauuugaaacuugaggaaacaugcucagagugcaag

SEQ ID NO: 483499 - RNA, 64 nt, Human
ccuauggagccuagaagaaaccuucacuugcagaaaacuugagucagaaaauucuggaacuuga

SEQ ID NO: 483500 - RNA, 64 nt, Human
acacagaauuuggucuguaucugacacuagaacaaaacuugaggguaaauaaacauugaauuag

SEQ ID NO: 483501 - RNA, 64 nt, Human
ugccauaguuaacuucaugacauguagacauucaaaacuugagccuuggauguuccuguggacc

SEQ ID NO: 483502 - RNA, 64 nt, Human
gagucuuuaucuuggggagcaaaagcugacuuuuaaacuugaccccugcuguuuuuaaacagcu

SEQ ID NO: 483503 - RNA, 64 nt, Human
ugcucuucaaaaagaugcacuuaguauuaaguugaaacuugaacaaauagauggucacauugcu

SEQ ID NO: 483504 - RNA, 64 nt, Human; identical to SEQ ID NO: 344327

SEQ ID NO: 483505 - RNA, 64 nt, Human
cugucagaggugaucuuuauuuucuaaauauuucaaacuugaaaacagaguaaaaaagugauag

SEQ ID NO: 483506 - RNA, 64 nt, Human
uuuugaggggccucauuuaccccaccucuguuaaaaacuugacuacucuccucuuuaauagaaa

SEQ ID NO: 483507 - RNA, 64 nt, Human
cuuuuccgcacuaccugaacauuguaauacagacaaacuugauuucuucuagaagauaacauuu

SEQ ID NO: 483508 - RNA, 64 nt, Human
uguccucaucucagguaauuuaugaaaucuauguaaacuugaaaaauauuucuuaauuuuuguu

SEQ ID NO: 483509 - RNA, 64 nt, Human
aaaagaugccaaaacauguccccucacccagacuaaacuugauacuguauuauuuuguucaaug

SEQ ID NO: 483510 - RNA, 64 nt, Human
acaaaaaaagggaucucagggagaggccagugucaaacuugaccucccuuguuuggccuagaau

SEQ ID NO: 483511 - RNA, 64 nt, Human
aacugggagggccuacaucuggauggcgguggaaaaacuugaggguuugggguucaaagucagc

SEQ ID NO: 483512 - RNA, 64 nt, Human
uuuguauuuauuaauaucaaauucacuuaugaauaaacuugauaauggaaacggacaaaaaaaa

SEQ ID NO: 483513 - RNA, 64 nt, Human
acugcugccauugcugugguuaugggcauuuagaaaacuugaaagucagcacuaaaggaugggc

SEQ ID NO: 483514 - RNA, 64 nt, Human
uccugcaccguguauaacuuagugugucauuuugaaacuugaauucauucuuaucaauuuaagg

SEQ ID NO: 483515 - RNA, 64 nt, Human
uuccugcacucagaagucugcagcggugccucacaaacuugauugugcauaaaaaucacugggg

SEQ ID NO: 483516 - RNA, 64 nt, Human
auauuuuaaaggaaacuugcuuacaggaaggauuaaacuugaacuacuuauccuauucuuuaag

SEQ ID NO: 483517 - RNA, 64 nt, Human
aagauaucucugcuuuguaugaguuucuuuuaugaaacuugauaccacgggaguccaguaauau

SEQ ID NO: 483518 - RNA, 64 nt, Human; identical to SEQ ID NO: 331662

SEQ ID NO: 483519 - RNA, 64 nt, Human; identical to SEQ ID NO: 344360

SEQ ID NO: 483520 - RNA, 64 nt, Human; identical to SEQ ID NO: 344361

SEQ ID NO: 483521 - RNA, 64 nt, Human; identical to SEQ ID NO: 344362

SEQ ID NO: 483522 - RNA, 64 nt, Human
uaguugagcuauuugguuugacaaagcucagcagaaacuugaugugaaaaaucuacgauuuucu

SEQ ID NO: 483523 - RNA, 64 nt, Human
ccuuauuguagcuacuguuuuuaauguaaagguuaaacuugaaaagaaauucuuaaucacggug

SEQ ID NO: 483524 - RNA, 64 nt, Human
auaaugaucuauuagauucaaauauuugaaauaaaaacuugauuuuuuuguauauuugauuuuu

SEQ ID NO: 483525 - RNA, 64 nt, Human
agugaguauaguaacccaagaugccauaaaaaaaaaacuugaucguuuucugacuuaaucaguu

SEQ ID NO: 483526 - RNA, 64 nt, Human
augggaaaggagaccauuuucuuagaaagcaaauaaacuugauuuuuuuaaaucuaaaauuuac

SEQ ID NO: 483527 - RNA, 64 nt, Human
auggaaaaaggucauauccuuugucaggaaauauaaacuugaaaguauguagucagcucuugua

SEQ ID NO: 483528 - RNA, 64 nt, Human
ugccagcaaauguuaucauuauuuuuuuauacugaaacuugagacuuugacugugccauguaua

SEQ ID NO: 483529 - RNA, 64 nt, Human
uuacuuuggucauacuauuuaccaaauuguuggcaaacuugauguaaccuuauauggugguuuu

SEQ ID NO: 483530 - RNA, 64 nt, Human
guaagaaacuuaucauaaggaaaaauagaaaggaaaacuugaaucaauacucauugauuaaaau

SEQ ID NO: 483531 - RNA, 64 nt, Human
uacucccaaugagcuuguauacuuccaaacagcuaaacuugauuuccaguuguggauuucacac

SEQ ID NO: 483532 - RNA, 64 nt, Human
guuagaagaagcuaauauuugaaacagauuuuaaaaacuugaaaaauuacaggugagauuucug

SEQ ID NO: 483533 - RNA, 64 nt, Human
aggaguucacuggcuuagcuacagugacgcauugaaacuugaguaauuccuguaaugucagauu

SEQ ID NO: 483534 - RNA, 64 nt, Human
caagaauuuuuuaacaauaaaaugaccagcaaguaaacuugaaacaaaaauggacaaauaucua

SEQ ID NO: 483535 - RNA, 64 nt, Human; identical to SEQ ID NO: 344396

SEQ ID NO: 483536 - RNA, 64 nt, Human; identical to SEQ ID NO: 344397

SEQ ID NO: 483537 - RNA, 64 nt, Human; identical to SEQ ID NO: 344633

SEQ ID NO: 483538 - RNA, 64 nt, Human
ugugcuuggagaggggagguggcucuccaguguaaaacuugaggcauucacuagaggugaaaac

SEQ ID NO: 483539 - RNA, 64 nt, Human
uggcugcacagagccucuccucaaagaugcuacaaaacuugaauauaacacauuuuggaaggcu

SEQ ID NO: 483540 - RNA, 64 nt, Human
aggcucuugauuccuuaugcaaguggaagaguugaaacuugauugaaggacuuaaaacauucac

SEQ ID NO: 483541 - RNA, 64 nt, Human
aaauugugauuguuuauucuauuacuauuguuaaaaacuugaaugguauuuauauuggcugaua

SEQ ID NO: 483542 - RNA, 64 nt, Human
gcauuaaggacuuaaagcaacaauaaccaaauaaaaacuugauaggaucuuugaagucuauuua

SEQ ID NO: 483543 - RNA, 64 nt, Human
ucucuagucaauaucuuuagugaucuucuuuaauaaacuugaaagcaaagauuuugguuucuua

SEQ ID NO: 483544 - RNA, 64 nt, Human
ggucuuuucccaccucuugauaucugugauacugaaacuugaggauguugaaauguauuacauu

SEQ ID NO: 483545 - RNA, 64 nt, Human
uuggaccuugcugccaugacuguuuaguuuacagaaacuugaccccggcucauccugucucugg

SEQ ID NO: 483546 - RNA, 64 nt, Human
ucucaaagaaugagacuuguaaugagaaugccacaaacuugaauaccuuaugcacaaaacacaa

SEQ ID NO: 483547 - RNA, 64 nt, Human
aaguacauauuuguuauguaaacuuauacuauguaaacuugaauuaguuuuuugcuuccuugaa

SEQ ID NO: 483548 - RNA, 64 nt, Human
aauguguaauacugagcacuuuacuucuuaauaaaaacuugauauaguagcagaugugagaguu

SEQ ID NO: 483549 - RNA, 64 nt, Human
cuuuuuuugauuuugauuuuugcuguguuaucaaaaacuugaauacugugagaagaagugaauu

SEQ ID NO: 483550 - RNA, 60 nt, Human
agcugcagaaaguaagauagcacugagagaaaacuugagacuucaucguccauguagaac

SEQ ID NO: 483551 - RNA, 64 nt, Human; identical to SEQ ID NO: 344634

SEQ ID NO: 483552 - RNA, 64 nt, Human; identical to SEQ ID NO: 331664

SEQ ID NO: 483553 - RNA, 64 nt, Human; identical to SEQ ID NO: 344414

SEQ ID NO: 483554 - RNA, 64 nt, Human; identical to SEQ ID NO: 345356

SEQ ID NO: 483555 - RNA, 64 nt, Human
acagucugcuccucagccugagauguucuuggccaaacuugaauuuucacaugaguaugccacu

SEQ ID NO: 483556 - RNA, 64 nt, Human
uaaaggauguauucugagagaacaaagcagaaugaaacuugagucacuuacuaaauauagugga

SEQ ID NO: 483557 - RNA, 64 nt, Human
aauuugugcauuauaaaugcaauaucacuguuuuaaacuugacuguuuuauauuauuuuugugu

SEQ ID NO: 483558 - RNA, 64 nt, Human
aaggaaccaguuguaacagucucaauuuuaacuaaaacuugaagaacuaaaacaacaaugcaaa

SEQ ID NO: 483559 - RNA, 64 nt, Human
aaaaggaguauuuacuagaauuuuuugucauauaaaacuugaaucaggauuuuaugccccacau

SEQ ID NO: 483560 - RNA, 64 nt, Human
gcucuugucuucuuuguuugugacccaugcuugaaaacuugaaggaaguuagauaugaauggca

SEQ ID NO: 483561 - RNA, 64 nt, Human
agaaguacuuuugauuauuuuccuggagugaagaaaacuugaacaagaaauugguauuaucaaa

SEQ ID NO: 483562 - RNA, 64 nt, Human
ugcuuuccuuuaaauauguuugaaaagauguuugaaacuugauuauacuauuuauaauuggcac

SEQ ID NO: 483563 - RNA, 64 nt, Human
uuacuugaagcuucuuucuguucagccauuaaagaaacuugacaaaauaggaacaggagauauu

SEQ ID NO: 483564 - RNA, 64 nt, Human
agaguuuuuaccugccuuaucugaauucuucuugaaacuugagcuuaaacucuaauagcuguuu

SEQ ID NO: 483565 - RNA, 64 nt, Human
cugcacaugggcugaauuuuuaaauuuuuuuuaaaaacuugaagcagaaccuuguaauuugugu

SEQ ID NO: 483566 - RNA, 62 nt, Human
agcaauugaugucauuuuauuaaagaacauugaaaaacuugaaggaaucccuuugcaagguu

SEQ ID NO: 483567 - RNA, 64 nt, Human
ugcaaagcuaucccgccccccacccugccccaugaaacuugagcauucaaaugaagauucagca

SEQ ID NO: 483568 - RNA, 64 nt, Human; identical to SEQ ID NO: 344328

SEQ ID NO: 483569 - RNA, 64 nt, Human; identical to SEQ ID NO: 344329

SEQ ID NO: 483570 - RNA, 64 nt, Human; identical to SEQ ID NO: 344343

SEQ ID NO: 483571 - RNA, 64 nt, Human; identical to SEQ ID NO: 344416

SEQ ID NO: 483572 - RNA, 64 nt, Human
ucugagcaaacacggaaauuuagcaaaauuauguaaacuugauccugaaguuuuagaauggcaa

SEQ ID NO: 483573 - RNA, 64 nt, Human
acagugcaaaaggaucguuuuuuuuugcuuuuuuaaacuugaauuuuuuuaauuuacacuuuuu

SEQ ID NO: 483574 - RNA, 64 nt, Human
uccaacccaaaggccuuucaucucaauaucugucaaacuugaauaaugucuucucuuuaauauu

SEQ ID NO: 483575 - RNA, 64 nt, Human
aguuugguuauggaaaaaagacuuuuugccacugaaacuugagccaucugugccucuaagaggc

SEQ ID NO: 483576 - RNA, 64 nt, Human
ucaguaucaauuagggccugggguagagagacagaaacuugagagaagagaaguuagugauucc

SEQ ID NO: 483577 - RNA, 64 nt, Human
guuuacaaggcuuaacuaauuuauuugcuuuuuuaaacuugaacuuuucguauaauagauacgu

SEQ ID NO: 483578 - RNA, 64 nt, Human
gcacugauuauugguuuuacuuaauauucccuaaaaacuugaggaaggaagaugauagaacaug

SEQ ID NO: 483579 - RNA, 64 nt, Human
auaaaugacagaaccugaagaagucauaggaaagaaacuugagcgguauacucagaauggugag

SEQ ID NO: 483580 - RNA, 64 nt, Human
ucugcccccgcacagaaaugcugcagaguauauaaaacuugagacauuuuuguaggaugccuga

SEQ ID NO: 483581 - RNA, 64 nt, Human
gccaaauuuacaggaauuuuuuuaaaaggcagaaaaacuugaaauaccaacauucuggcaaaaa

SEQ ID NO: 483582 - RNA, 64 nt, Human
uuuuguuuuaagaguuggggggaguaucuauaguaaacuugaauaaaggggacaaagcuagaac

SEQ ID NO: 483583 - RNA, 64 nt, Human
uuaaaaucuguaaaauuagaggauugcacuagagaaacuugaaugcuccauucaggccuaucau

SEQ ID NO: 483584 - RNA, 64 nt, Human
aaaagucagucuuauagcaagacuguuagcccucaaacuugacucuacugaucugaccauuucc

SEQ ID NO: 483585 - RNA, 64 nt, Human; identical to SEQ ID NO: 344151

SEQ ID NO: 483586 - RNA, 64 nt, Human; identical to SEQ ID NO: 344152

SEQ ID NO: 483587 - RNA, 64 nt, Human; identical to SEQ ID NO: 344166

SEQ ID NO: 483588 - RNA, 55 nt, Human
aggcuguggcaaagguguaacuuguaaacuugaguuggaguacuauauuuacaaa

SEQ ID NO: 483589 - RNA, 64 nt, Human
uugugcuguaccuuuucugauucagaauuauagaaaacuugauaaauacuugauuuuaaccaau

SEQ ID NO: 483590 - RNA, 64 nt, Human
cuuuuuuauuuuuuuuuuuugucauuuucuuucaaaacuugaguggucucugagcuccugucau

SEQ ID NO: 483591 - RNA, 64 nt, Human
auuccuuguuagggaacuuuaaagaagaaaagaaaaacuugaauuguguugaauuacuguaucu

SEQ ID NO: 483592 - RNA, 64 nt, Human
uguccuaauuuaaaaguacauugcaaacaucaugaaacuugaucccugaaagcuucagccugca

SEQ ID NO: 483593 - RNA, 64 nt, Human
uaaaaagaaaaaugcaaauauagagcaaaucccuaaacuugaaccauuuccuagugccuugcua

SEQ ID NO: 483594 - RNA, 64 nt, Human
uguggcuuuauaauuguuauguuacccaagggauaaacuugaacuggcuuugaacauccuuuag

SEQ ID NO: 483595 - RNA, 64 nt, Human
ugaagaguugaaucuucuguuaaaaggugauuuaaaacuugaaugugaugaauuguggcaaguu

SEQ ID NO: 483596 - RNA, 64 nt, Human
uacaaaguauuagauuuuucuucuauuuaacggaaaacuugacuuuggugaaugugcauuacuu

SEQ ID NO: 483597 - RNA, 64 nt, Human
uaugauaccucagugauuuuaaaagccauagaagaaacuugacuaugccuggucaccuucuugg

SEQ ID NO: 483598 - RNA, 64 nt, Human
aucugaauauguaaaugaauacauuuuaaagacaaaacuugaaaaauguauucuugaauaguga

SEQ ID NO: 483599 - RNA, 64 nt, Human
gggcuguccgggaguucucuacagaaaacaucuaaaacuugaaugugcaagugaguagcuaacu

SEQ ID NO: 483600 - RNA, 64 nt, Human
augaaaucacagggaucucugaaauaucuuuaggaaacuugaaauuuaugaggucugaauggac

SEQ ID NO: 483601 - RNA, 64 nt, Human; identical to SEQ ID NO: 331681

SEQ ID NO: 483602 - RNA, 64 nt, Human; identical to SEQ ID NO: 345301

SEQ ID NO: 483603 - RNA, 64 nt, Human; identical to SEQ ID NO: 345302

SEQ ID NO: 483604 - RNA, 64 nt, Human; identical to SEQ ID NO: 345303

SEQ ID NO: 483605 - RNA, 64 nt, Human
cuuucuuucucuaauguuguaucauacucuucuaaaacuugaguggcugucuuaaaagauauaa

SEQ ID NO: 483606 - RNA, 64 nt, Human
uguagauagaacaaauuacagacaaggaaagaaaaaacuugaaugaaauggauuuuacagaaag

SEQ ID NO: 483607 - RNA, 64 nt, Human
agucuuuaguaacuguuaguguucuauauagcacaaacuugaaucucucagccaaaaaagggaa

SEQ ID NO: 483608 - RNA, 64 nt, Human
uccagcuuguagcuaguuggggaaaaaagaugaaaaacuugaacuacaaauuaccuccauguau

SEQ ID NO: 483609 - RNA, 64 nt, Human
aaucaaaggucaggucaguaagcccauuauccucaaacuugaaguuucguuggauguucaaaau

SEQ ID NO: 483610 - RNA, 64 nt, Human
aaaaaaggcauguagaguauuauguuuauacuuuaaacuugauauuuuuaguguauuauuuaaa

SEQ ID NO: 483611 - RNA, 64 nt, Human
ugaaacuuuggcuguugaaaguuucaguauuaguaaacuugaguuacuuuuucuuuuccauuuu

SEQ ID NO: 483612 - RNA, 64 nt, Human
uuguaaaagcucaaacaugacgauuccauaaaauaaacuugagguuaaauaauggguaguaaau

SEQ ID NO: 483613 - RNA, 64 nt, Human
acaaaccaagauucucugcuuuugcacugaaauuaaacuugaaaggaauucuccucaaaggucg

SEQ ID NO: 483614 - RNA, 64 nt, Human
ccauaagugcuuuaucuucucuaugcacaggcuuaaacuugacuguuguauguuagcauauuuu

SEQ ID NO: 483615 - RNA, 64 nt, Human
ccuauaaaauugugguacuuuuugauguuucaguaaacuugacauugucagaguuucaaggacu

SEQ ID NO: 483616 - RNA, 64 nt, Human
uccccuucaaaugcuguaauuaacaacacuuaaaaaacuugaauaaaauauugaaaccucaucc

SEQ ID NO: 483617 - RNA, 64 nt, Human
ucccagggccccucccucaaauugucuccaugggaaacuugacccaguggcaaguugcacuuug

SEQ ID NO: 483618 - RNA, 64 nt, Human; identical to SEQ ID NO: 206385

SEQ ID NO: 483619 - RNA, 64 nt, Human; identical to SEQ ID NO: 206386

SEQ ID NO: 483620 - RNA, 64 nt, Human; identical to SEQ ID NO: 206387

SEQ ID NO: 483621 - RNA, 64 nt, Human; identical to SEQ ID NO: 206388

SEQ ID NO: 483622 - RNA, 64 nt, Human
auuaccauuacuuguauaaauacacuuccugcuuaaacuugacccagguggcuagcaaauuaga

SEQ ID NO: 483623 - RNA, 64 nt, Human
gcuaaccuuaauuucuaugauguuuucuaaaaugaaacuugauaaaguagaccaccagcugcac

SEQ ID NO: 483624 - RNA, 64 nt, Human
augucucuguaucaauugucauaauuuucgcaauaaacuugauuauuauuauaugugcuuaugg

SEQ ID NO: 483625 - RNA, 64 nt, Human
auaaauuuauuuaauauuaguggucuuuaaguauaaacuugauguaauugguuugggagggggc

SEQ ID NO: 483626 - RNA, 64 nt, Human
auaggagacacacgcgcacacacacacacacacgaaacuugaaauggcuuugcuuuggcugucg

SEQ ID NO: 483627 - RNA, 64 nt, Human
gucugcuaauauggaauggaacugcagcaaaugcaaacuugaagucaugcaaaaguaugaaaug

SEQ ID NO: 483628 - RNA, 64 nt, Human
uagauuuguugauaaacauuuuaugcuugcauuuaaacuugaaauguaugagcagaaugagaca

SEQ ID NO: 483629 - RNA, 64 nt, Human
caacguguggaggaagccccucauaauuuggagaaaacuugauacaauagaagcugacuuuuaa

SEQ ID NO: 483630 - RNA, 64 nt, Human
gccauuauuuucauuuucauuuuuggcucuucagaaacuugaauacuuaagcuuguacaugauc

SEQ ID NO: 483631 - RNA, 64 nt, Human
cugcaacuuuggacuaaggucauucaauguacccaaacuugaacaggggguucauuguuuugcu

SEQ ID NO: 483632 - RNA, 64 nt, Human
uaguacaauaaaaaucugaaguaaaaugaggcauaaacuugaugcagcugccucccucauucaa

SEQ ID NO: 483633 - RNA, 64 nt, Human
aagacaguauuggcaaucaugacaccuguaauaaaaacuugaauccaaagucaaaacuuaagca

SEQ ID NO: 483634 - RNA, 64 nt, Human
gacaacugaagaaaagcuggaaaaaaaaacaagcaaacuugaacacugaagcaaccucaagcau

SEQ ID NO: 483635 - RNA, 64 nt, Human; identical to SEQ ID NO: 206392

SEQ ID NO: 483636 - RNA, 64 nt, Human; identical to SEQ ID NO: 206393

SEQ ID NO: 483637 - RNA, 64 nt, Human; identical to SEQ ID NO: 206394

SEQ ID NO: 483638 - RNA, 64 nt, Human; identical to SEQ ID NO: 206395

SEQ ID NO: 483639 - RNA, 64 nt, Human
ucuuuguuuucauuuuccaaauauaaucuuuaauaaacuugauuuaguuucuugggaaauuuau

SEQ ID NO: 483640 - RNA, 64 nt, Human
aagauaauguaguuuaaaaaaaaaaaaaagaaaaaaacuugauguaaauuccuccuuuuccucu

SEQ ID NO: 483641 - RNA, 64 nt, Human
uugauggaagaaaucauuuuuaauguguacuguaaaacuugaaauacucaggagcugagugaau

SEQ ID NO: 483642 - RNA, 64 nt, Human
uuaaaugcauuuuuuaaaugcuaacaaaaaauaaaaacuugaaacaaaaaaaaaaguguggcau

SEQ ID NO: 483643 - RNA, 64 nt, Human
ucuagcaugcgcccgggguugacaacagcuggacaaacuugaaaagucaauucauguggccuuu

SEQ ID NO: 483644 - RNA, 64 nt, Human
gccaugcugcaguccgcacaagcugugaggcagaaaacuugacuugaagcagccuugaagagug

SEQ ID NO: 483645 - RNA, 64 nt, Human
guucucuccuggccacuuaaauaggaccauauguaaacuugacuuugacugcaugagauauccc

SEQ ID NO: 483646 - RNA, 64 nt, Human
ugaguagaacuacaaaacaauagcaguagggcagaaacuugaaagaaggcaggagaucauggug

SEQ ID NO: 483647 - RNA, 64 nt, Human
uaaauaugucuuguauaguucauauucauggcugaaacuugaccacacuauugcugauuguaug

SEQ ID NO: 483648 - RNA, 64 nt, Human
cccagcccaugugugauaggauuuauguaggaagaaacuugauuuucaaauaauuuuuuaaaug

SEQ ID NO: 483649 - RNA, 64 nt, Human
cuaggaacagccuucccuccguuuccccucagucaaacuugagccagccucuggaucgauguga

SEQ ID NO: 483650 - RNA, 64 nt, Human
ugaaaaacgaguauuccccaauggacuccagaagaaacuugauucaucgcugcaaaggaaagaa

SEQ ID NO: 483651 - RNA, 64 nt, Human
aucaggacaaaaaaucuaauugcuguuugggaaaaaacuugauuuugauguuuauucuccaggu

SEQ ID NO: 483652 - RNA, 64 nt, Human; identical to SEQ ID NO: 206396

SEQ ID NO: 483653 - RNA, 64 nt, Human; identical to SEQ ID NO: 206397

SEQ ID NO: 483654 - RNA, 64 nt, Human; identical to SEQ ID NO: 206401

SEQ ID NO: 483655 - RNA, 64 nt, Human; identical to SEQ ID NO: 206403

SEQ ID NO: 483656 - RNA, 64 nt, Human
gcuggccacaaaaccaagaacauaucuagcaagaaaacuugaaaaaguauaagcauuuguuaaa

SEQ ID NO: 483657 - RNA, 64 nt, Human
cuuaacaagacagcaaaacguaaacagaaauugaaaacuugaaggauauuucagugucauggac

SEQ ID NO: 483658 - RNA, 64 nt, Human
cagcccuuagcaucggaaagcuuauacuguaaauaaacuugaugaauauuauaugugaggaaaa

SEQ ID NO: 483659 - RNA, 64 nt, Human
acauauuagccacgaguuuuugcagugaccagauaaacuugaauugacacgugguguaauaaaa

SEQ ID NO: 483660 - RNA, 64 nt, Human
agccgugacaacacuccugucauauuggaguccaaaacuugaauucuggguugaauuuuuuaaa

SEQ ID NO: 483661 - RNA, 64 nt, Human
gcuaucacacagugggugguggaucuguccaaggaaacuugaaucaaagcaguuaacuuuaaga

SEQ ID NO: 483662 - RNA, 64 nt, Human
gagaugcucaccaagcuucuauuuaucuaauuuaaaacuugaaaguaaagccauaaacaaaaaa

SEQ ID NO: 483663 - RNA, 64 nt, Human
uugguucuaagaguuagucuggacuggcccuaggaaacuugaauuaaauaagccucuuccccuu

SEQ ID NO: 483664 - RNA, 64 nt, Human
agacagcaaagucaaagcagauaaauucuuguugaaacuugacuaaaauuuauuugauuuguug

SEQ ID NO: 483665 - RNA, 64 nt, Human
uuccucccagccuauuuuuguaaauaaaauguuuaaacuugaaauacaaaucgauguuuauauu

SEQ ID NO: 483666 - RNA, 64 nt, Human
uuaauacuaaaagauauguuucugauacaauagcaaacuugaaaaaaaaaaaagaaauagaaga

SEQ ID NO: 483667 - RNA, 64 nt, Human
uggagauuacaaugauuaaaucaauaaauaacugaaacuugauaugugucacuuuuuuaugcug

SEQ ID NO: 483668 - RNA, 64 nt, Human
uacuuccaguaaauauuugaaaauauauugaaguaaacuugauuuuuuuuuuuugucacaagaa

SEQ ID NO: 483669 - RNA, 64 nt, Human; identical to SEQ ID NO: 206234

SEQ ID NO: 483670 - RNA, 64 nt, Human; identical to SEQ ID NO: 206235

SEQ ID NO: 483671 - RNA, 64 nt, Human; identical to SEQ ID NO: 206236

SEQ ID NO: 483672 - RNA, 64 nt, Human; identical to SEQ ID NO: 331606

SEQ ID NO: 483673 - RNA, 64 nt, Human
ugcaauuaacuguagaacaguuuuauuuuuauuaaaacuugacugaacaaaaggggaccaucaa

SEQ ID NO: 483674 - RNA, 64 nt, Human
uuguaguuaagaacuguaaggcaaucgggcagugaaacuugauauuguauuaacuuaauaggaa

SEQ ID NO: 483675 - RNA, 64 nt, Human
ucuguucagaucuccaccggccuuuguucuuuuaaaacuugaauauaggugggagacauaagaa

SEQ ID NO: 483676 - RNA, 64 nt, Human
acaaccaaagacgacuuuaguggacugguuuucaaaacuugagcagcugaaaagcaaaagccgu

SEQ ID NO: 483677 - RNA, 64 nt, Human
uuacagccacugguuggcuggauuuuaaaccauaaaacuugaagauuaccuacaaaaguaacag

SEQ ID NO: 483678 - RNA, 64 nt, Human
gguuuuugaaaugccuaugguuucuuugaaugguaaacuugagcaucuuuucacuuuccaguag

SEQ ID NO: 483679 - RNA, 64 nt, Human
guucacacagcccaguucccgugacgaggcucaaaaacuugaucacaugcuugaauggagcugg

SEQ ID NO: 483680 - RNA, 64 nt, Human
ggagagagaagaguucaaaaaauaaaguaaucauaaacuugaacucucuccauucucuuguucc

SEQ ID NO: 483681 - RNA, 64 nt, Human
uucauagcauccagaagaaguguugaaguaaccuaaacuugaccugcuuaauacauucuagggc

SEQ ID NO: 483682 - RNA, 64 nt, Human
gcuccacaaauucaacuuguauauuuggcagauuaaacuugacauuaucguaaucuuuguuuug

SEQ ID NO: 483683 - RNA, 64 nt, Human
auuacuuuugcaccaaccuaauaggccgauucagaaacuugagugcaaugucuuggauaugcaa

SEQ ID NO: 483684 - RNA, 64 nt, Human
ucauagaggcccggggcugguccgaugguuggcaaaacuugacuccggcccaguccccacucuu

SEQ ID NO: 483685 - RNA, 64 nt, Human
aaucaagaccccgucuccaaaaaaaaaaaaaacaaaacuugauugggauccaaaaucauacaac

SEQ ID NO: 483686 - RNA, 64 nt, Human; identical to SEQ ID NO: 206408

SEQ ID NO: 483687 - RNA, 64 nt, Human; identical to SEQ ID NO: 206409

SEQ ID NO: 483688 - RNA, 64 nt, Human; identical to SEQ ID NO: 206410

SEQ ID NO: 483689 - RNA, 64 nt, Human; identical to SEQ ID NO: 206411

SEQ ID NO: 483690 - RNA, 64 nt, Human
ucagaauuaaaacuaaaaucuuaaauaaaacagaaaacuugauggugacacuuggguuguccuu

SEQ ID NO: 483691 - RNA, 64 nt, Human
guuuuaaguuuuguguugcaagaacaaauggaauaaacuugaauugugcuacagcuaauguguc

SEQ ID NO: 483692 - RNA, 64 nt, Human
gcagagggcagggggacgggucgggacaccagugaaacuugaaccgggaagugggaggacguag

SEQ ID NO: 483693 - RNA, 64 nt, Human
gaaggcggaaacccacaguguuaccugacuuaugaaacuugaaaccgccucuggagccgccauu

SEQ ID NO: 483694 - RNA, 64 nt, Human
ucaagaaacagcgagagggagacccagggggcugaaacuugaacucugguucuuuuaaaauuaa

SEQ ID NO: 483695 - RNA, 64 nt, Human
gccugguaaugacuccagaacaacaacugggaagaaacuugaagucgacaaucugguuagggga

SEQ ID NO: 483696 - RNA, 53 nt, Human
cggccacuaaggagaauugaaaaaaacuugauaugacugcaaaugauacuuaa

SEQ ID NO: 483697 - RNA, 64 nt, Human
cuugaaaauaaauuuugauucugagccaggagaaaaacuugaaauguugacuuaagugaggggg

SEQ ID NO: 483698 - RNA, 64 nt, Human
ugagaaaauaguugcagaaagcacuggaaauaauaaacuugaucuuauacaaaucuucuauugu

SEQ ID NO: 483699 - RNA, 64 nt, Human
gcauuugaaccgaccaacauuaaguccagagaguaaacuugaauggaauaacgacauuccagaa

SEQ ID NO: 483700 - RNA, 64 nt, Human
aagauggcuagaauggugccuuucugagugucuaaaacuugacaccccugguaaaucuuucaac

SEQ ID NO: 483701 - RNA, 64 nt, Human
uacuuuugcuuucaguaguuucauguaaagaaaaaaacuugaaaauaguaauaccugaguaccc

SEQ ID NO: 483702 - RNA, 64 nt, Human
agccauuagguugaaaguauauauuuaucauauaaaacuugaugcguuuugcacuacucuuucc

SEQ ID NO: 483703 - RNA, 64 nt, Human; identical to SEQ ID NO: 206230

SEQ ID NO: 483704 - RNA, 64 nt, Human; identical to SEQ ID NO: 206231

SEQ ID NO: 483705 - RNA, 53 nt, Human; identical to SEQ ID NO: 206232

SEQ ID NO: 483706 - RNA, 64 nt, Human; identical to SEQ ID NO: 206233

SEQ ID NO: 483707 - RNA, 64 nt, Human
auuagcugccagaagcaacugaggaccuuuuuugaaacuugaguagcaguguaauugagcugag

SEQ ID NO: 483708 - RNA, 64 nt, Human
uggacaucuuacacccgguggucaaguguguaauaaacuugagcauucgaaugggagaaaaagc

SEQ ID NO: 483709 - RNA, 64 nt, Human
ucuguauaaaugcauuuuagaacugauagacaguaaacuugaauuuaucuuugauaagaauaca

SEQ ID NO: 483710 - RNA, 64 nt, Human
cuguguuucaauagagcuuuauuucugcaaacugaaacuugaguuuuguguaauuuucaugugu

SEQ ID NO: 483711 - RNA, 64 nt, Human
uccacugcccuuugcccucuggugaccucuuccuaaacuugaagcccugccucccugaaggcua

SEQ ID NO: 483712 - RNA, 64 nt, Human
cucuaaguuggaaauugaagcuagccacucagagaaacuugaauugcuaaagaaggccuaugaa

SEQ ID NO: 483713 - RNA, 64 nt, Human
agugaugcaccuucccgcugcugugagguugauuaaacuugagcugugacggguucugcaaggg

SEQ ID NO: 483714 - RNA, 64 nt, Human
accccauuucuccuccucuuaggucauuuucagcaaacuugaauaucuagaccucucuuccaau

SEQ ID NO: 483715 - RNA, 64 nt, Human
uuuaucccacccauuaauauaauuucuguauaauaaacuugaccugaaauuauuucauucuuua

SEQ ID NO: 483716 - RNA, 64 nt, Human
gaaaggggucagcagggugaaaccgaaccccagaaaacuugaugaagaaaugucuuuugcccgu

SEQ ID NO: 483717 - RNA, 64 nt, Human
uuaauuauuugcuaucagcugaaacugaaagaagaaacuugaacuucauacuucgauaucauau

SEQ ID NO: 483718 - RNA, 64 nt, Human
accaucucauauacuagugucaaaagguuuauguaaacuugaauuuuaucugaacuaaauugua

SEQ ID NO: 483719 - RNA, 64 nt, Human
gagccauuaaaauagaaugauccuuuauggaccaaaacuugaaucacugcaaaaugaauccaga

SEQ ID NO: 483720 - RNA, 64 nt, Human; identical to SEQ ID NO: 206404

SEQ ID NO: 483721 - RNA, 64 nt, Human; identical to SEQ ID NO: 206405

SEQ ID NO: 483722 - RNA, 64 nt, Human; identical to SEQ ID NO: 206406

SEQ ID NO: 483723 - RNA, 64 nt, Human
acauagagccagcuugaaggggcucccacuggccaaacuugagccaaucugagagcaaaauaau

SEQ ID NO: 483724 - RNA, 64 nt, Human
aauuuaucuauagcugcuauagcaagcuauuauaaaacuugaauuucuacaaauggugaaauuu

SEQ ID NO: 483725 - RNA, 64 nt, Human
uaucaguacuuugagugagaagacaguuuauuuaaaacuugagcaggcuguucagcauuguuuc

SEQ ID NO: 483726 - RNA, 64 nt, Human
uaauggaauuauggcuggacuuucuuuugaaagaaaacuugauguauucuguguguaugguuuu

SEQ ID NO: 483727 - RNA, 64 nt, Human
gaagucuguggaugcagcuguuaugaagaugguuaaacuugaaacaaacaauuuuaagaauuau

SEQ ID NO: 483728 - RNA, 64 nt, Human
auacuaaugcaauucuacagcauucaaaugaagaaaacuugaggcuuuagggauaagugguuag

SEQ ID NO: 483729 - RNA, 64 nt, Human
aggccauaacuuuauuuguuagauacacugucagaaacuugagaucuuuuggccuaugauaaua

SEQ ID NO: 483730 - RNA, 64 nt, Human
gaauaguauggauaaguggaauuguacauuuuuuaaacuugauugccauuaaagcagaaauuau

SEQ ID NO: 483731 - RNA, 64 nt, Human
ccaccagaggcuccuaccccaaagauuuucacagaaacuugaggccaggugccguggcucacac

SEQ ID NO: 483732 - RNA, 64 nt, Human
uugugaguucuuuuccacuccuuuaaaguugggaaaacuugauucguggggcaggagauuguuu

SEQ ID NO: 483733 - RNA, 64 nt, Human
cucuggaaagccagaagacugcaguggauuucugaaacuugaacucagagcccagugggaagcc

SEQ ID NO: 483734 - RNA, 64 nt, Human
uuauacugccucuugaguaaucuuucugaaauuuaaacuugauauuuuucgcccucuugcuuga

SEQ ID NO: 483735 - RNA, 64 nt, Human
uauuauaaaaugcuauaauauaaaaauguagcaaaaacuugacagacuagaaaaaaaaagaucu

SEQ ID NO: 483736 - RNA, 52 nt, Human; identical to SEQ ID NO: 206390

SEQ ID NO: 483737 - RNA, 64 nt, Human
agucuggugaacuucaaaagcuuuuugauguauaaaacuugauaaauggaacuauuccaucaau

SEQ ID NO: 483738 - RNA, 64 nt, Human
gucucuauauuauacagguaccuauguaaaagaaaaacuugagaaccacuggaauaugaaaaau

SEQ ID NO: 483739 - RNA, 64 nt, Human
ugguagaaguggggaaauaugagagauggaggaaaaacuugauuaugucuuccauggcauauuu

SEQ ID NO: 483740 - RNA, 64 nt, Human
gcagcaguacuuggaagcuuugaaaacaugugcuaaacuugaauggagcaacacuccuuucuga

SEQ ID NO: 483741 - RNA, 64 nt, Human
ucuucacugcuuuaucucaugaugcuugcuuguaaaacuugauuuuaguuuuucauuucucaaa

SEQ ID NO: 483742 - RNA, 64 nt, Human
ccaaaagauugcugaaaaaguagauugaguauaaaaacuugaaaauauaugauggcucguggga

SEQ ID NO: 483743 - RNA, 64 nt, Human
auugcuaucuuuuaaagauauaauaauaggauguaaacuugaccacaacuacuguuuuuuugaa

SEQ ID NO: 483744 - RNA, 64 nt, Human
ccuuuuuguuccuuugccucuugccuguccccuaaaacuugacuguggcacucagggucaaaca

SEQ ID NO: 483745 - RNA, 64 nt, Human
gucaugacaauuuauuuuucuuggcaugcuauguaaacuugaauuuccuauguauuuuuauugu

SEQ ID NO: 483746 - RNA, 64 nt, Human
ugugcauaugucuuuucuuagcaaaaggauuuuaaaacuugagcccuggaccuuuuguccuaug

SEQ ID NO: 483747 - RNA, 64 nt, Human
gcuaaaucauauuaguauuaauacuacccauagaaaacuugacauguagcuucuucugaaagaa

SEQ ID NO: 483748 - RNA, 64 nt, Human
uuuggaucugcuaccaccagacuccuaacauagaaaacuugaauugucacauacauuuuacagu

SEQ ID NO: 483749 - RNA, 64 nt, Human
cacaaggucuaacucuuucccugcagugucuuugaaacuugaacauaaugugaaggcugaauga

SEQ ID NO: 483750 - RNA, 64 nt, Human; identical to SEQ ID NO: 206378

SEQ ID NO: 483751 - RNA, 50 nt, Human; identical to SEQ ID NO: 206379

SEQ ID NO: 483752 - RNA, 64 nt, Human; identical to SEQ ID NO: 206383

SEQ ID NO: 483753 - RNA, 64 nt, Human
uuauucuuaggaauaguucaauguaacaagaagaaaacuugaccuuugcucugguuaaaacagu

SEQ ID NO: 483754 - RNA, 64 nt, Human
uccugccuaccucacaaggucacucugaggauugaaacuugaucuuguccaggaaagcuuugua

SEQ ID NO: 483755 - RNA, 64 nt, Human
uagaaucuaaugcagaagagaucuuuuaaaaaauaaacuugagucuugaaugugagccacuuuc

SEQ ID NO: 483756 - RNA, 50 nt, Human
gggaucgagaugagcuuuaaaaacuugaaaaacaguuuguaagccuuuca

SEQ ID NO: 483757 - RNA, 64 nt, Human
cguagucuuuguaaaauaauauacucaucauagaaaacuugaaaaaugcagaaauguauaaaaa

SEQ ID NO: 483758 - RNA, 64 nt, Human
uucauauagaaucaguggauggaaacaaggguuuaaacuugauacaaaaccuuuuauaaaaaau

SEQ ID NO: 483759 - RNA, 64 nt, Human
auggcuuuucauucuucaauucaugacgagugccaaacuugauuuucucuaggcacagcuuucu

SEQ ID NO: 483760 - RNA, 64 nt, Human
uuuugauuuuaacaaaugcaaauuuaguucucuaaaacuugaaaaaaaaaaaagaaaccaguuc

SEQ ID NO: 483761 - RNA, 64 nt, Human
cacugaucucuugccucugcugaugggggcuggcaaacuugacgaccccaacuccugccugccc

SEQ ID NO: 483762 - RNA, 64 nt, Human
acacauguacuugugauuuguucauguuauauuaaaacuugagauuuguguauuuauguagagu

SEQ ID NO: 483763 - RNA, 64 nt, Human
ugcugugaauuuuuuuuuuaaaugauuccaaauaaaacuugagcccacuccugccaugcuuccu

SEQ ID NO: 483764 - RNA, 64 nt, Human
uuuuuuaucaagagggauaaaacaccaugaaaauaaacuugaauaaacugaaaauggaccuuuu

SEQ ID NO: 483765 - RNA, 64 nt, Human
ggaaauagacaaaucuuaaaagcugccugaaaucaaacuugauuuaacucaguaagaaugugaa

SEQ ID NO: 483766 - RNA, 51 nt, Human; identical to SEQ ID NO: 206373

SEQ ID NO: 483767 - RNA, 64 nt, Human; identical to SEQ ID NO: 206374

SEQ ID NO: 483768 - RNA, 64 nt, Human; identical to SEQ ID NO: 206375

SEQ ID NO: 483769 - RNA, 64 nt, Human; identical to SEQ ID NO: 206389

SEQ ID NO: 483770 - RNA, 64 nt, Human
ugcuaauuggauuuugguaguucuuaccucaagaaaacuugaauuauuugggggaaaguaggcu

SEQ ID NO: 483771 - RNA, 64 nt, Human
ugauggaaaugggaaugaaguuaaguggucugaaaaacuugaaucguucacauuucucagcucu

SEQ ID NO: 483772 - RNA, 64 nt, Human
agaugggggaaaacagcuuccucucuaaaaggaaaaacuugauauuuaucagucugagaaaaua

SEQ ID NO: 483773 - RNA, 64 nt, Human
acagaaaguuuaacuaacauagauaacuccccccaaacuugagaauuuaugcauucccuuuaaa

SEQ ID NO: 483774 - RNA, 64 nt, Human
cagcgugcauagggacucuugccuuaaggaguguaaacuugaucugcauuugcugauuuguuuu

SEQ ID NO: 483775 - RNA, 64 nt, Human
aucaagaacagguacuaccccuuuuuuucauuucaaacuugaaacugugaauaagguaagaaaa

SEQ ID NO: 483776 - RNA, 64 nt, Human
augggaauugagucccacucgguaagaguugcuuaaacuugacacuguugacauuugggcugga

SEQ ID NO: 483777 - RNA, 64 nt, Human
agggaaugcauugcagaggcaccugcacaacgacaaacuugaguguuucccugccacuucugug

SEQ ID NO: 483778 - RNA, 64 nt, Human
ugguaauggugugggggaaaugaacuugagcuuuaaacuugauuugaguuucagugucucugaa

SEQ ID NO: 483779 - RNA, 64 nt, Human
cauuuccuaauuuauggggauuuuaauugaaaauaaacuugagucccaauagagcuguuuuuuu

SEQ ID NO: 483780 - RNA, 64 nt, Human
gcuuuguuuaugucuuugagaugagaaaggcuuaaaacuugagaauauauauuuggaauacagc

SEQ ID NO: 483781 - RNA, 64 nt, Human
cuuaaagagaguuuugaaaaugaucacuuaccuaaaacuugaaagcuaugaauuaguuauccau

SEQ ID NO: 483782 - RNA, 64 nt, Human
ccuuuuaauuuguuucuugauauaugaagacuauaaacuugaaacaaagaguuagcugucagcu

SEQ ID NO: 483783 - RNA, 64 nt, Human; identical to SEQ ID NO: 345321

SEQ ID NO: 483784 - RNA, 64 nt, Human; identical to SEQ ID NO: 331682

SEQ ID NO: 483785 - RNA, 64 nt, Human; identical to SEQ ID NO: 345337

SEQ ID NO: 483786 - RNA, 64 nt, Human; identical to SEQ ID NO: 345339

SEQ ID NO: 483787 - RNA, 64 nt, Human
gucaaaguaaauuuuaauucaaaucaugucuguaaaacuugacguauuuuguguaugcauguuu

SEQ ID NO: 483788 - RNA, 64 nt, Human
cucuguagguaaaaaggaggugggaaaaauuuuaaaacuugaggguaaaaauguggaaaacaaa

SEQ ID NO: 483789 - RNA, 64 nt, Human
auaugagggugcaagagccacauuuacaaacaacaaacuugaucuuuaaaaauguuuuuaaaac

SEQ ID NO: 483790 - RNA, 64 nt, Human
gguaguuacaucauguuucuucauuggauuuguaaaacuugaagccauaaaaauauuaguuugg

SEQ ID NO: 483791 - RNA, 64 nt, Human
uuaaaugauuauuuauggucagauacauauuguuaaacuugaaaauguuuuauuacauuacauc

SEQ ID NO: 483792 - RNA, 64 nt, Human
gcccuguuacuuauagacagucuuugucauaggcaaacuugaauuugauuuaaaauagggcugg

SEQ ID NO: 483793 - RNA, 64 nt, Human
auuugaaaaaaaaucuacaaaguuucaaaaagcaaaacuugaauuugcugcaugccaagaagua

SEQ ID NO: 483794 - RNA, 64 nt, Human
ugacucucccagagaagaagccgcuggcuguaugaaacuugacggcgcuuuuguaaggugccac

SEQ ID NO: 483795 - RNA, 64 nt, Human
acgaacuguaaaagaccaugcaagaggcaaaauaaaacuugaagugaaugcuugucguguugua

SEQ ID NO: 483796 - RNA, 64 nt, Human
uggcggugccccauaggaugucauauugaggcccaaacuugauuggagaauuugcaaacuaccg

SEQ ID NO: 483797 - RNA, 64 nt, Human
cuuuggaaaaauaaagauuugucagcccuaucucaaacuugaaucaaaauuucugggguguggg

SEQ ID NO: 483798 - RNA, 64 nt, Human
cuuuuuuuuuucuauuaaaacuuaaaggggaacaaaacuugaaaaagcccuguucuucagaagg

SEQ ID NO: 483799 - RNA, 64 nt, Human
guguguguguauauauauauauaugcaugcugugaaacuugacuacacaacauaaaucacuuuu

SEQ ID NO: 483800 - RNA, 64 nt, Human; identical to SEQ ID NO: 206367

SEQ ID NO: 483801 - RNA, 64 nt, Human; identical to SEQ ID NO: 206368

SEQ ID NO: 483802 - RNA, 64 nt, Human; identical to SEQ ID NO: 206369

SEQ ID NO: 483803 - RNA, 64 nt, Human
aagguuuuuguuguuguuuguauuuuuuagauguaaacuugauuauuuuauugcuaauuuaaaa

SEQ ID NO: 483804 - RNA, 64 nt, Human
gauaauauggaaaaccuaaccauuauaaaaaagcaaacuugaguuuccuaaauguaagcauuua

SEQ ID NO: 483805 - RNA, 64 nt, Human
aagguuccagucccuggagaauacccagggccucaaacuugaagucacuccuccaaugucuggg

SEQ ID NO: 483806 - RNA, 64 nt, Human
gcaaaggcaggugcuuugcagaaagaaugcuuggaaacuugagucucccuagaggugaaaagug

SEQ ID NO: 483807 - RNA, 64 nt, Human
uuaucagaaauaauuuuaauguguguauacuuaaaaacuugacacggguuguacagaaacuggu

SEQ ID NO: 483808 - RNA, 64 nt, Human
cuagaaacagaaaaugaaaagguugauugaaauaaaacuugaucaacgcgacuguauuuugaaa

SEQ ID NO: 483809 - RNA, 64 nt, Human
ccuagggcggugcugagcacacagcaaguuuaauaaacuugacugaauucauuuacauaucucu

SEQ ID NO: 483810 - RNA, 64 nt, Human
guaaaauguuuuuacuauggaucauggauuuaagaaacuugaaaagcugggcacgguggcucac

SEQ ID NO: 483811 - RNA, 64 nt, Human
gucaaauauacuguugauaaauauuuauuuuuguaaacuugaagugugugguggccguggggga

SEQ ID NO: 483812 - RNA, 59 nt, Human
aacgcaggcaacagaccuaauacauuucaaaacuugauauuucauuuugcguuuuagcu

SEQ ID NO: 483813 - RNA, 64 nt, Human
agcacccucuuguggcuuguucuagcguguauuaaaacuugacacacacccacacacaaaaaca

SEQ ID NO: 483814 - RNA, 64 nt, Human
guuugucuuucugauagguugaaaauuguguaauaaacuugaugacgcugucaaucuuuuauac

SEQ ID NO: 483815 - RNA, 64 nt, Human
cuuugaaaacuccaucccuccuaagaaucuuaaaaaacuugaaaugcucgccaaauguccccau

SEQ ID NO: 483816 - RNA, 64 nt, Human; identical to SEQ ID NO: 206305

SEQ ID NO: 483817 - RNA, 64 nt, Human; identical to SEQ ID NO: 206306

SEQ ID NO: 483818 - RNA, 64 nt, Human; identical to SEQ ID NO: 206307

SEQ ID NO: 483819 - RNA, 64 nt, Human; identical to SEQ ID NO: 206311

SEQ ID NO: 483820 - RNA, 64 nt, Human
aaagugacuucuuuuugugaauguaaaauuugugaaacuugaguuuuuccaaugugcuguaaag

SEQ ID NO: 483821 - RNA, 64 nt, Human
uucgcccauuauucaggcugcacaacacagaaggaaacuugauuucaauaagacccaauucuua

SEQ ID NO: 483822 - RNA, 64 nt, Human
cuugcaguacagcucaaaauaguggaugcauuucaaacuugaccaccuuuuccuaccagcuagu

SEQ ID NO: 483823 - RNA, 62 nt, Human
gacaugcccuucuauuaauaaaacuacauuucucaaacuugaugaaaacugccuuguugcuc

SEQ ID NO: 483824 - RNA, 64 nt, Human
caguacugcuggcuuucugggugauuaauuagguaaacuugaauauucccaguaaauguuugag

SEQ ID NO: 483825 - RNA, 64 nt, Human
uuccuuuagucaagaugucacaaguuuaaaaacaaaacuugagaaacuaccaaaggcucaggag

SEQ ID NO: 483826 - RNA, 64 nt, Human
caaaacuauucaaaaacuucacucucuucccauuaaacuugaacuguggcuauauugaacuguu

SEQ ID NO: 483827 - RNA, 64 nt, Human
caaucguagguauaguuuauaaccugauagcaaaaaacuugaaauauugcagcccaguuuaauu

SEQ ID NO: 483828 - RNA, 64 nt, Human
aaauaauaaauaaaauaaaagccaaccuucaaagaaacuugaagcuuuguaggugagaugcaac

SEQ ID NO: 483829 - RNA, 64 nt, Human
guaucuccgaaugcagcuauguaaaagagaaccaaaacuugagugcucuggauaacuauaugga

SEQ ID NO: 483830 - RNA, 64 nt, Human
uguauuucuagggaagcagacuuuaaauuucuaaaaacuugauuuaauuauaguuaaauaugug

SEQ ID NO: 483831 - RNA, 64 nt, Human
uuccagucauaauaggugacaguguuaaccgugaaaacuugagaggcacucugcccucuucccu

SEQ ID NO: 483832 - RNA, 64 nt, Human
gaaacaggcuccccucaccaggacagucacccccaaacuugacccccaacauuucaaugcacag

SEQ ID NO: 483833 - RNA, 64 nt, Human; identical to SEQ ID NO: 206315

SEQ ID NO: 483834 - RNA, 64 nt, Human; identical to SEQ ID NO: 206316

SEQ ID NO: 483835 - RNA, 64 nt, Human; identical to SEQ ID NO: 206317

SEQ ID NO: 483836 - RNA, 64 nt, Human; identical to SEQ ID NO: 206318

SEQ ID NO: 483837 - RNA, 64 nt, Human
uuugugguuuagcuuuguauuuaaacaaggaaauaaacuugaaaauuauuugucaucauaaaaa

SEQ ID NO: 483838 - RNA, 64 nt, Human
ucucucgauguggaaugguuuauguggauccuaaaaacuugaaauaucgaccauacuggaaaaa

SEQ ID NO: 483839 - RNA, 64 nt, Human
aagagcugucaaaagacuggugguaggcuggugaaaacuugacagcuagacuugaugcuugcug

SEQ ID NO: 483840 - RNA, 64 nt, Human
aacccuugcaaugaagaugagcagauccacaggaaaacuugaaugcacaacugucuuauuuuaa

SEQ ID NO: 483841 - RNA, 64 nt, Human
cuuuauguaaaucacuucauuguuuuaaaggaauaaacuugauuauauuguuuuuuuauuuggc

SEQ ID NO: 483842 - RNA, 64 nt, Human
uuuccucauuugaaauauauccguacuaaugaacaaacuugaugugcacuuuuuuauuugcuuu

SEQ ID NO: 483843 - RNA, 64 nt, Human
cacugccugcuggaagcucugugggaaucagaugaaacuugagggaauugugacucuguucccu

SEQ ID NO: 483844 - RNA, 64 nt, Human
augauuuucuagucuuaagguuuggggacauuauaaacuugaguacauuuguuguacacaguug

SEQ ID NO: 483845 - RNA, 64 nt, Human
uuuuuuuuaagaaaggaaaaaagaaaaaaaaaucaaacuugaaacuuuucuuuugauguuccua

SEQ ID NO: 483846 - RNA, 64 nt, Human
cagauucaugguuugauaaauuuguuguauucaaaaacuugaaaugcaggacgccauuaagugu

SEQ ID NO: 483847 - RNA, 64 nt, Human
uuugguauauuacaaauuaaaaguauauaagaugaaacuugauuugcuaucaagccccaagcaa

SEQ ID NO: 483848 - RNA, 64 nt, Human
aucuugaaguagucuuaaaauguguaagaaguuaaaacuugagaagcaaaaaaaugccugcaaa

SEQ ID NO: 483849 - RNA, 64 nt, Human
ugagccaccacacccagccuucagcugucaccuuaaacuugacaguggcucaugcugauuuagu

SEQ ID NO: 483850 - RNA, 64 nt, Human; identical to SEQ ID NO: 206319

SEQ ID NO: 483851 - RNA, 64 nt, Human; identical to SEQ ID NO: 206320

SEQ ID NO: 483852 - RNA, 64 nt, Human; identical to SEQ ID NO: 206321

SEQ ID NO: 483853 - RNA, 64 nt, Human; identical to SEQ ID NO: 206352

SEQ ID NO: 483854 - RNA, 64 nt, Human
aauauuagccuuauuacccccacaagauuuuuuaaaacuugagguagguagcuacauuaaauaa

SEQ ID NO: 483855 - RNA, 64 nt, Human
aagccuucaaagaaagaaaggccuuucaagaaucaaacuugauaauaaugaaaucaguugccuc

SEQ ID NO: 483856 - RNA, 64 nt, Human
ugaaauggggagauauuuacauuccguacuuuguaaacuugagcuauuggacuucacugaugua

SEQ ID NO: 483857 - RNA, 64 nt, Human
gcagaucaaaagaggugaaguuggugacucaguaaaacuugacauuuuaaccuguggcauuuag

SEQ ID NO: 483858 - RNA, 64 nt, Human
guuuuaugagaggccuggcaauggguaaaacaccaaacuugaaaucagaacauaggugcaaaug

SEQ ID NO: 483859 - RNA, 64 nt, Human
ggcaugguaucauuccuagaagaaaaaaagagagaaacuugacugcacauuaaaaaaaaaaaaa

SEQ ID NO: 483860 - RNA, 64 nt, Human
aaaaaaaaaucaagacuuggaacgcccuuuuacuaaacuugacaaaguuucaguaaauucuuac

SEQ ID NO: 483861 - RNA, 64 nt, Human
acuggauggauaaugaugccauugagugagugaaaaacuugauggaaguggaagauucagaguu

SEQ ID NO: 483862 - RNA, 64 nt, Human
uuaguguuguaaucagguuaaacccacuuccauuaaacuugacaggacuauagaaggauaauau

SEQ ID NO: 483863 - RNA, 64 nt, Human
auuuuuuuuuucaacaaaauggucauccaaacucaaacuugagaaaauaucuugcuuucaaauu

SEQ ID NO: 483864 - RNA, 64 nt, Human
agaugacuguacauguaagaaaaaagcuuauuaaaaacuugaucaaagaauaaguuaaauauug

SEQ ID NO: 483865 - RNA, 64 nt, Human
uuuugacaguuauuuugauaacaaugacacuagaaaacuugacuccauuucaucauuguuucug

SEQ ID NO: 483866 - RNA, 64 nt, Human
ucucuuguauaccaguuugugauguuuucucuaaaaacuugaaguuccucaggccuguaacuuc

SEQ ID NO: 483867 - RNA, 64 nt, Human; identical to SEQ ID NO: 206323

SEQ ID NO: 483868 - RNA, 64 nt, Human; identical to SEQ ID NO: 206324

SEQ ID NO: 483869 - RNA, 64 nt, Human; identical to SEQ ID NO: 206325

SEQ ID NO: 483870 - RNA, 64 nt, Human; identical to SEQ ID NO: 206329

SEQ ID NO: 483871 - RNA, 64 nt, Human
agugguaaaauugggcccaagcugaaguacaggcaaacuugauguuugaaagauaaguuuugag

SEQ ID NO: 483872 - RNA, 64 nt, Human
auacagugacuuuuuuuucauacauuuaguaugaaaacuugaacagcgaaagcagagcauguua

SEQ ID NO: 483873 - RNA, 64 nt, Human
auuuauuuuuagguguuuuuuuuuuccccuuaaaaaacuugaagugauaugcagcaguaaucua

SEQ ID NO: 483874 - RNA, 64 nt, Human
cuauuaaucuugucagaaaacugucaccaaaacaaaacuugaguuuguccuuguucuaggaguu

SEQ ID NO: 483875 - RNA, 64 nt, Human
aaucuucaaagacugguuucuuuuuuaaaagaaaaaacuugaaagaacacuucuaagccuaagu

SEQ ID NO: 483876 - RNA, 64 nt, Human
auguuauauucucuaugcauuuaaaaaaaaauguaaacuugacauuuuagggucuucaguuaca

SEQ ID NO: 483877 - RNA, 64 nt, Human
cgcuuugggaaucauccugggcuaaucaggaaauaaacuugacuuuucuauuuuucucugaagc

SEQ ID NO: 483878 - RNA, 64 nt, Human
aauuauuuuaaguuauuacauuuacuguauugggaaacuugaggagaacucuuuaguucauaaa

SEQ ID NO: 483879 - RNA, 64 nt, Human
aaguguauauauuaugcaguuucucuaaguggaaaaacuugacaugacuuuaauaguguuaaaa

SEQ ID NO: 483880 - RNA, 64 nt, Human
cugauaggaaaucaccccagggaacccgaaaaagaaacuugauuccucuauugcuggccuuacu

SEQ ID NO: 483881 - RNA, 64 nt, Human
ccacggcgggggugggggcgggggguugguacagaaacuugaagcuguuugugauauguacaac

SEQ ID NO: 483882 - RNA, 64 nt, Human
guguguaaauaauguacauagagugagaagaaagaaacuugauauugagguguuugaaauaugg

SEQ ID NO: 483883 - RNA, 64 nt, Human
guauguauuuuuguguguucugcuuuuuuuaaauaaacuugaaaagcuacugaacuaauuuaac

SEQ ID NO: 483884 - RNA, 64 nt, Human; identical to SEQ ID NO: 206331

SEQ ID NO: 483885 - RNA, 64 nt, Human; identical to SEQ ID NO: 206333

SEQ ID NO: 483886 - RNA, 64 nt, Human; identical to SEQ ID NO: 206334

SEQ ID NO: 483887 - RNA, 64 nt, Human; identical to SEQ ID NO: 206335

SEQ ID NO: 483888 - RNA, 64 nt, Human
uggcacagaacacuaaauuuuggucccauggcugaaacuugagggugacuaaaaguaaugccug

SEQ ID NO: 483889 - RNA, 64 nt, Human
acaaguccgcuuugugagaugaauacuuccugagaaacuugacaaguaucucuccauuuuacca

SEQ ID NO: 483890 - RNA, 64 nt, Human
aagagcagcaaagcuuuccagaaggcauaaaaggaaacuugaauaaaggaagauauguuccaca

SEQ ID NO: 483891 - RNA, 64 nt, Human
augcuaaacaaaagaaacaugauuuuucuuccuuaaacuugaacaccaaaaaaacacacacaca

SEQ ID NO: 483892 - RNA, 64 nt, Human
gcuuucuugccaaaauaaguguuaacuguguuucaaacuugauuuucuuuccuuuuucuuuuuu

SEQ ID NO: 483893 - RNA, 64 nt, Human
acaauuugcugagagagugcagcuuuugugaauuaaacuugaaguccaggcagaauucuaaugc

SEQ ID NO: 483894 - RNA, 64 nt, Human
uagaaauaaacuuauuuuugcuuguuauguuuugaaacuugacauaggauauuuucccucuggc

SEQ ID NO: 483895 - RNA, 64 nt, Human
caacuccaaacuugcucaacuaauccuuaaaaauaaacuugagcuggaauuugaggcuugccug

SEQ ID NO: 483896 - RNA, 64 nt, Human
gcacgacuauuaaucuaucauguuaugauauaauaaacuugaauuugucacacauuccuuaggg

SEQ ID NO: 483897 - RNA, 64 nt, Human
acaugcagcccuuugagauuucugucguaaugcuaaacuugaauaagauggaauggcugaacau

SEQ ID NO: 483898 - RNA, 64 nt, Human
caugcuuuuuucccagaaucccucaucugccagaaaacuugaaaaguuuauugcuuguagaguu

SEQ ID NO: 483899 - RNA, 64 nt, Human
auuugaacaacaaagagaaaggcaagauaaucccaaacuugacagguaaauuaccauauauuua

SEQ ID NO: 483900 - RNA, 64 nt, Human
cuguauugcaguguuuauaggcuucuuguguguuaaacuugauuucauaaauuaaaaacaaugg

SEQ ID NO: 483901 - RNA, 64 nt, Human; identical to SEQ ID NO: 206336

SEQ ID NO: 483902 - RNA, 64 nt, Human; identical to SEQ ID NO: 206337

SEQ ID NO: 483903 - RNA, 64 nt, Human; identical to SEQ ID NO: 206338

SEQ ID NO: 483904 - RNA, 51 nt, Human; identical to SEQ ID NO: 206340

SEQ ID NO: 483905 - RNA, 64 nt, Human
cagaaagauucugauacccugccuugacaacaugaaacuugaggcugcuuugguucaugaaucc

SEQ ID NO: 483906 - RNA, 64 nt, Human
acugcuucccucaguaucugaaugucucaauuuaaaacuugaagcucuuuagaccaauagacug

SEQ ID NO: 483907 - RNA, 64 nt, Human
guuuauuuuuguuccacaaguuaaauaaaucauaaaacuugauguguuaucucuuauaucucac

SEQ ID NO: 483908 - RNA, 64 nt, Human
uuggguucauuccaaauaguuuugugccauugaaaaacuugaccuucaaaaaaauuuguuuuuc

SEQ ID NO: 483909 - RNA, 64 nt, Human
cugaaucuacaugucucuuguuuuauuucucucuaaacuugaaaacaguaaaucugcagauacu

SEQ ID NO: 483910 - RNA, 64 nt, Human
cauagauacaggauuauauaacgaaauuuugaauaaacuugaauuccuaaaagauggaaacagg

SEQ ID NO: 483911 - RNA, 64 nt, Human
cugcacaagaaauuacaaaaauguuucuguuuugaaacuugaucuacaaucaguaaaaguuuga

SEQ ID NO: 483912 - RNA, 64 nt, Human
gcacaaugugcacauguuaguuuuauauacagcaaaacuugauuuuuugcagauggaaagguau

SEQ ID NO: 483913 - RNA, 64 nt, Human
cccagaugauucuaauacaggagggccagaggccaaacuugaagaacugcugguguuacauguu

SEQ ID NO: 483914 - RNA, 64 nt, Human
acucaaaaauuuaccagaccuuacaacugugauaaaacuugaauguguaugaugaauaaggcca

SEQ ID NO: 483915 - RNA, 64 nt, Human
guuuaaagaaauauauucaaaaucauuugugaauaaacuugaucauccaucucaauauuguuug

SEQ ID NO: 483916 - RNA, 64 nt, Human
caggaacuguauuuuuuuuaaugauuugcuuuugaaacuugaagucuugaaaacagugugaugc

SEQ ID NO: 483917 - RNA, 64 nt, Human
aaaaaauuuugcuagcuuaguaaaacgaauuggaaaacuugacuaugaucuggaacagauaaug

SEQ ID NO: 483918 - RNA, 64 nt, Human; identical to SEQ ID NO: 206301

SEQ ID NO: 483919 - RNA, 64 nt, Human; identical to SEQ ID NO: 206302

SEQ ID NO: 483920 - RNA, 57 nt, Human; identical to SEQ ID NO: 206303

SEQ ID NO: 483921 - RNA, 64 nt, Human; identical to SEQ ID NO: 206312

SEQ ID NO: 483922 - RNA, 64 nt, Human
caagucuuggaaaaccgugugaagcaacuacuauaaacuugagucaucccgacguugaucucuu

SEQ ID NO: 483923 - RNA, 64 nt, Human
cuuuaucuucuggaaaauauuuuucagacuccucaaacuugacuaaaugcagcgaugcucccag

SEQ ID NO: 483924 - RNA, 64 nt, Human
uaacuuggguuucaauaauuauggauuuuuaugaaaacuugaaauaauaaaaagagaaaaaaac

SEQ ID NO: 483925 - RNA, 64 nt, Human
aagauuuauuuuuuuccaccuuauuuaucuucuaaaacuugaggaaugcauguguucuuaguga

SEQ ID NO: 483926 - RNA, 64 nt, Human
gcccaagaaacucugaacggggcccaauggaggcaaacuugagcaaauaauugggaugauaaga

SEQ ID NO: 483927 - RNA, 64 nt, Human
gcuauagacagaaauaauaagccacccuggguguaaacuugauuuucuuuauugagauguauca

SEQ ID NO: 483928 - RNA, 64 nt, Human
agaaaguuaaaacuagcuuuagaguaaggaugagaaacuugaguguuuuuaauuuaaagauaaa

SEQ ID NO: 483929 - RNA, 64 nt, Human
guaggcuaugcccauccaaauaaaucuccaugagaaacuugaggagacuucauaacaagaaucu

SEQ ID NO: 483930 - RNA, 64 nt, Human
gacuuuucagagcccagauuccuguugucuauuaaaacuugaagggaggggugaauaguguuuc

SEQ ID NO: 483931 - RNA, 64 nt, Human
ggaagugcucccugggugauggguagagcccucgaaacuugacauggggccagaagggccuggg

SEQ ID NO: 483932 - RNA, 64 nt, Human
gccagcacccagcuuagugcugggacuagcccagaaacuugaaugggacccugagagagccagg

SEQ ID NO: 483933 - RNA, 64 nt, Human
auaagguucauuuucuucuguuuaaaaagacacaaaacuugaaaaucagcuuuggccaucuacc

SEQ ID NO: 483934 - RNA, 64 nt, Human
aaacagcaaacucccucagacuuuguccauguauaaacuugaagugguuguguuguaggguugc

SEQ ID NO: 483935 - RNA, 64 nt, Human; identical to SEQ ID NO: 206294

SEQ ID NO: 483936 - RNA, 64 nt, Human; identical to SEQ ID NO: 206295

SEQ ID NO: 483937 - RNA, 64 nt, Human; identical to SEQ ID NO: 206296

SEQ ID NO: 483938 - RNA, 64 nt, Human; identical to SEQ ID NO: 206330

SEQ ID NO: 483939 - RNA, 64 nt, Human
uaugguaacucuuuggugguuuuaugaugcuuacaaacuugagcuuuagcucuuguuugggaga

SEQ ID NO: 483940 - RNA, 64 nt, Human
cauaugauugucaccacaaagugcuuuuacacaaaaacuugaaaauuugaaaaacaugauuuuu

SEQ ID NO: 483941 - RNA, 64 nt, Human
uaaucugaacaugaaggcuccauuagcaacacuaaaacuugaucauuaacagcccccugugcau

SEQ ID NO: 483942 - RNA, 64 nt, Human
gauaguuacacacauaaagacaccacucaaaaggaaacuugaauaauuuauaauuuugaucgag

SEQ ID NO: 483943 - RNA, 64 nt, Human
uagagaagaagccuucuuuucuuucuucuaugugaaacuugaaaugaggaaaagcaauucuagu

SEQ ID NO: 483944 - RNA, 64 nt, Human
caguggucacuuucuaguugccgucuucacagacaaacuugaaagguauuaaggaaaaaauucc

SEQ ID NO: 483945 - RNA, 64 nt, Human
cacacugcuuucuccacagagaugcugauaucaaaaacuugaagauacagugaaguucugaaua

SEQ ID NO: 483946 - RNA, 64 nt, Human
gauaacagcucugucaauauuuugaugccacaauaaacuugauuuuucuuuacauuccuuuuau

SEQ ID NO: 483947 - RNA, 62 nt, Human
aguaaauaaaaguuuucauugauaucuguccuugaaacuugauuugauucuccaaguuugcu

SEQ ID NO: 483948 - RNA, 64 nt, Human
uaaacucuggacacucuauauguagugcauuuuuaaacuugaaauauauaauauucagccagcu

SEQ ID NO: 483949 - RNA, 64 nt, Human
gguuccuuccagguuuagaagcuucaaccaaaugaaacuugaaucugucccucgugacaauuau

SEQ ID NO: 483950 - RNA, 64 nt, Human
uccuuaccaugcuccuggcuuacuccaucgcgucaaacuugauauuugguuggaaacuccguuc

SEQ ID NO: 483951 - RNA, 64 nt, Human
cuuccucugggaccagaugugccuuccacaguugaaacuugagaagcagagcucgccaccuucu

SEQ ID NO: 483952 - RNA, 59 nt, Human; identical to SEQ ID NO: 206348

SEQ ID NO: 483953 - RNA, 64 nt, Human; identical to SEQ ID NO: 206349

SEQ ID NO: 483954 - RNA, 50 nt, Human; identical to SEQ ID NO: 206350

SEQ ID NO: 483955 - RNA, 64 nt, Human; identical to SEQ ID NO: 206351

SEQ ID NO: 483956 - RNA, 64 nt, Human
cucaucugcuggcauuuugugggguguuagugccaaacuugaauaggggcuggggugcugucuu

SEQ ID NO: 483957 - RNA, 64 nt, Human
uauuuuuuuuuuuugaguucaguguggagacuugaaacuugaaugucccuuccaacuuuuauau

SEQ ID NO: 483958 - RNA, 64 nt, Human
ggguccuuaagguggcaaguccuuuauggagagaaaacuugacauucagaugauuguuuuuaaa

SEQ ID NO: 483959 - RNA, 64 nt, Human
aggcauuuaauccaguaucucuaguguacaaaggaaacuugaaguuuuaauggauuauuuuuaa

SEQ ID NO: 483960 - RNA, 64 nt, Human
aaaugguguacauuucuuguuaaccacguuauuaaaacuugaucagcacauaagcuuucuucug

SEQ ID NO: 483961 - RNA, 64 nt, Human
uauggguuuuuauguuuuguuuuguguuuuuccaaaacuugaacuugcaggcaagccuugguug

SEQ ID NO: 483962 - RNA, 64 nt, Human
ggaauaaaguaaucuuauauacaagcuuugauuaaaacuugaaacaaagagccuguguuuugug

SEQ ID NO: 483963 - RNA, 64 nt, Human
aaccuauuuagauuuaaugugaaauuuaagaaggaaacuugacuucuuaaccuuaauuugauau

SEQ ID NO: 483964 - RNA, 54 nt, Human
uuuucuuuuuucaguuaugacucaaaacuugagauaaaggaaaucugcuuguga

SEQ ID NO: 483965 - RNA, 64 nt, Human
ucauucaguucaugcagggcaaaggcuuacugauaaacuugagucugcccucguaugagggugu

SEQ ID NO: 483966 - RNA, 64 nt, Human
auaauuauuuuuucucaacuaauuuuuuucacuuaaacuugagagaacaaguucagcuuuuauc

SEQ ID NO: 483967 - RNA, 64 nt, Human
aggagauccagggcaaggccauugggauauucugaaacuugaauauuuuguuuugugcagagau

SEQ ID NO: 483968 - RNA, 64 nt, Human
aagaaaagggacugggggaaggaaacuuauuggaaaacuugaugcgaaugaguuucugcuuggc

SEQ ID NO: 483969 - RNA, 64 nt, Human
aacuuggagcuacuucacacucuacucuuaauggaaacuugaacuaaugauagauaguauuuuu

SEQ ID NO: 483970 - RNA, 64 nt, Human
uaaacuuuucucuuauauuaggacuaaggaacuaaaacuugaggcagagucuucuuugugccug

SEQ ID NO: 483971 - RNA, 64 nt, Human
aucugagccaguuauuauuagaguugcagaauagaaacuugaagugcuaaauggaauaauccaa

SEQ ID NO: 483972 - RNA, 64 nt, Human
acuaauguuuuuaaaaaauuuauuaaacauuauuaaacuugaucaggucaggccaaauaaaguu

SEQ ID NO: 483973 - RNA, 64 nt, Human
uucagaagccuaacagauugcuagacaagagaaaaaacuugaagaaaaaagaagcuuaauuuca

SEQ ID NO: 483974 - RNA, 64 nt, Human
ccagguuuuucaaaaggaauauaaacaggaucucaaacuugauuaaauguuagaccacagaagu

SEQ ID NO: 483975 - RNA, 64 nt, Human
auugcucaaagaaaauuauuuauuguuacagauaaaacuugagagauaaaaagcuauaccauaa

SEQ ID NO: 483976 - RNA, 64 nt, Human
auucuaacuuguuauuuaaaaggaaaaagguauuaaacuugaagcaaacuucucaugaucucau

SEQ ID NO: 483977 - RNA, 64 nt, Human
aagccuuaaauccuucugucuuccugacugaaugaaacuugaauuggcagagcauuuuccuuau

SEQ ID NO: 483978 - RNA, 64 nt, Human
ggggagauugauuguccuuaaaccuaagccccacaaacuugacaccugaucaggucugggagcu

SEQ ID NO: 483979 - RNA, 64 nt, Human
uaaaaugaaaugagaacaaagaggaaaaugguaaaaacuugaaaugaggcugggguauaguuug

SEQ ID NO: 483980 - RNA, 64 nt, Human
uuaaugcuuuauacagaaaccucuauacaaauccaaacuugaagaucagaaugguucuacaguu

SEQ ID NO: 483981 - RNA, 64 nt, Human
cccuggccauugccugguggucuagaaacacuuaaaacuugaaguagugacaccuaccugcggu

SEQ ID NO: 483982 - RNA, 64 nt, Human; identical to SEQ ID NO: 206412

SEQ ID NO: 483983 - RNA, 64 nt, Human; identical to SEQ ID NO: 206413

SEQ ID NO: 483984 - RNA, 64 nt, Human; identical to SEQ ID NO: 206414

SEQ ID NO: 483985 - RNA, 64 nt, Human; identical to SEQ ID NO: 345500

SEQ ID NO: 483986 - RNA, 64 nt, Human
aaaaaagauaauucauacugaaaagaaacucuacaaacuugaaagaugugacagugcuuuugac

SEQ ID NO: 483987 - RNA, 64 nt, Human
acuccaugccaucucccaaaauaauugucuaagaaaacuugaaaguguaagguuuuaaccuuua

SEQ ID NO: 483988 - RNA, 64 nt, Human
ccguucucuguccccagguccugucucugcacagaaacuugaacuccaggauggaauucuuccu

SEQ ID NO: 483989 - RNA, 64 nt, Human
cggggaggcugugucuugugcaaacaagucauagaaacuugaugggaguuggggagggacugaa

SEQ ID NO: 483990 - RNA, 64 nt, Human
caacacuuaccaucaggccauucaugguguagggaaacuugacuaauguaaugauugucacaaa

SEQ ID NO: 483991 - RNA, 64 nt, Human
aguagugggugagguuuugccuuuguugguuuuaaaacuugauucuauaaugccaaguuaguuu

SEQ ID NO: 483992 - RNA, 64 nt, Human
uguuaggaaacuugugagcauucacacuacagagaaacuugaaauauaaagaagaagagaaagc

SEQ ID NO: 483993 - RNA, 64 nt, Human
ggcacuaauccagcccuuaaaucccccagcuuccaaacuugaggcccaccaucuccaccaucug

SEQ ID NO: 483994 - RNA, 64 nt, Human
agcaagaccccaucucuuaaaaaaaaaggaaagaaaacuugaugugauugccauagguggaaua

SEQ ID NO: 483995 - RNA, 64 nt, Human
aucccugaaggggguuguacugggauuugugaauaaacuugauacacuaugcugucucauugug

SEQ ID NO: 483996 - RNA, 64 nt, Human
uguggaaaaguaaagaaacacaaauagcugaaacaaacuugacaaagcaaguagagaagacaca

SEQ ID NO: 483997 - RNA, 64 nt, Human
guaaggaauguguaaagaccuuuacuuggcuuucaaacuugaauaaacaucagacaauucacac

SEQ ID NO: 483998 - RNA, 64 nt, Human
uucuaucuuuuauuuccagauuuuuuuuguaucuaaacuugaagauuuguauuauacaaggaca

SEQ ID NO: 483999 - RNA, 64 nt, Human; identical to SEQ ID NO: 206355

SEQ ID NO: 484000 - RNA, 64 nt, Human; identical to SEQ ID NO: 206356

SEQ ID NO: 484001 - RNA, 64 nt, Human; identical to SEQ ID NO: 206357

SEQ ID NO: 484002 - RNA, 64 nt, Human; identical to SEQ ID NO: 206358

SEQ ID NO: 484003 - RNA, 64 nt, Human
gacuuuucaaccuggcaauuccauauacaauguuaaacuugauucuuaugacauauuccuauga

SEQ ID NO: 484004 - RNA, 64 nt, Human
acuuauucaccaucaggcaauucaugguguagggaaacuugacuaauguaaugauugucacaaa

SEQ ID NO: 484005 - RNA, 64 nt, Human
acuuauucaccaucaagcaauccauaguauagggaaacuugacuaauauaaugauugucacaaa

SEQ ID NO: 484006 - RNA, 64 nt, Human
acuuauucaccaucaagcaauccaugguauagggaaacuugacuaauguaaugauugucacaaa

SEQ ID NO: 484007 - RNA, 64 nt, Human
gugaaacgugcaaucuugaaacugagguguuagaaaacuugaucugugguguuuuguuuuguuu

SEQ ID NO: 484008 - RNA, 64 nt, Human
gaucagcuaaagcauguauauaagagcacguuguaaacuugaaagagacaaaggcacaaaugug

SEQ ID NO: 484009 - RNA, 64 nt, Human
cacggugcucauuuuuucuucuccuaaaacuuuaaaacuugaaguagguagcaacguggcuuuu

SEQ ID NO: 484010 - RNA, 64 nt, Human
gagauugacauaccaaugaucagaaauuuuagugaaacuugacucaacuauacacaaaguucuc

SEQ ID NO: 484011 - RNA, 64 nt, Human
ucacucucuauugucauggggaucaauuuucauuaaacuugaagcagucguggcuuuggcagug

SEQ ID NO: 484012 - RNA, 64 nt, Human
aaacauuuuauaauacuuuuuuuauuuguuuaauaaacuugaauauuguuuaaaaugauaauuu

SEQ ID NO: 484013 - RNA, 64 nt, Human
cuuuauuugcauauuuauuucagauguuucgaguaaacuugaaaaggguaggcacgaagcaauu

SEQ ID NO: 484014 - RNA, 64 nt, Human
uuucuuaaaauuugauuugucauauuuucuagagaaacuugaauuuaauuguguuauucuuagc

SEQ ID NO: 484015 - RNA, 64 nt, Human
ucuuucuaaugaaaaguaaagguuuuauauagagaaacuugaguaauuuuuacauuucuaagac

SEQ ID NO: 484016 - RNA, 64 nt, Human; identical to SEQ ID NO: 206359

SEQ ID NO: 484017 - RNA, 64 nt, Human; identical to SEQ ID NO: 206360

SEQ ID NO: 484018 - RNA, 64 nt, Human; identical to SEQ ID NO: 206361

SEQ ID NO: 484019 - RNA, 64 nt, Human; identical to SEQ ID NO: 206366

SEQ ID NO: 484020 - RNA, 64 nt, Human
agccuugagugauuggaguccccuaaugacuaauaaacuugaacauguaacacacacacacaca

SEQ ID NO: 484021 - RNA, 64 nt, Human
auguauuauauggacaacuuuugcuuugaguaauaaacuugauuguaggaaugugggagguguu

SEQ ID NO: 484022 - RNA, 64 nt, Human
aacagaguccuguagcuagcucgugacuacauugaaacuugaguuuguuucuuguguguuuuua

SEQ ID NO: 484023 - RNA, 64 nt, Human
aguugauucuuguauuccugauuaaccuacuuguaaacuugaaagcaagaccuugauugcacca

SEQ ID NO: 484024 - RNA, 64 nt, Human
aaaacauguaacgucugccuuagagccaugaccgaaacuugauauuuuuuucuuucaugagugu

SEQ ID NO: 484025 - RNA, 64 nt, Human
uauuuuucuuauuaacuggugacuaauauuaacaaaacuugagccaagaguaaagaauucagaa

SEQ ID NO: 484026 - RNA, 64 nt, Human
caaaugacaaguucauauauagaauuuacgggagaaacuugagaccauuuacggggagaaacuu

SEQ ID NO: 484027 - RNA, 64 nt, Human
uuuacgggagaaacuugagaccauuuacggggagaaacuugauucugggaagauagcagaguac

SEQ ID NO: 484028 - RNA, 64 nt, Human
uuugaagaacuuugaaauagaacuuucaaagcaaaaacuugagauauucaaaaauugugauucc

SEQ ID NO: 484029 - RNA, 64 nt, Human
uaauuuauuaaacuaauuauguuucuauagauaaaaacuugaaguucuucagacaugucucuaa

SEQ ID NO: 484030 - RNA, 64 nt, Human
cucuaacuuaacauguugagucucugagagugcaaaacuugaaacaagagaaaguggccugccu

SEQ ID NO: 484031 - RNA, 64 nt, Human
cauuaaggaaagcacacaucaccuugaaagagcuaaacuugacguccuacagaauuucucuaac

SEQ ID NO: 484032 - RNA, 64 nt, Human
cuucuuaaggaaaacguugucacuuuuauguuauaaacuugaauuuauaaagugcugguaaauu

SEQ ID NO: 484033 - RNA, 64 nt, Human; identical to SEQ ID NO: 206313

SEQ ID NO: 484034 - RNA, 50 nt, Human; identical to SEQ ID NO: 206353

SEQ ID NO: 484035 - RNA, 64 nt, Human; identical to SEQ ID NO: 206371

SEQ ID NO: 484036 - RNA, 64 nt, Human; identical to SEQ ID NO: 206372

SEQ ID NO: 484037 - RNA, 64 nt, Human
acacacacacacacacacacacacacuuucuauaaaacuugaaaauagcaaaaacccucaacug

SEQ ID NO: 484038 - RNA, 64 nt, Human
uaaaaauaaaaccagacucuguucugaaaauaaaaaacuugagacuugugacaagcuuccugug

SEQ ID NO: 484039 - RNA, 64 nt, Human
uucccuccacccucaacaggauguggugggggugaaacuugaagaauuuuuguuuccccuucuc

SEQ ID NO: 484040 - RNA, 64 nt, Human
cuuacuuuaaaaaagaauguucgauuugauacuuaaacuugaggagaggcagagagaggucugg

SEQ ID NO: 484041 - RNA, 64 nt, Human
augaaagaggccagaacccacaggaaaaacuucaaaacuugacauuugccagaauguuuaaaau

SEQ ID NO: 484042 - RNA, 64 nt, Human
guacagaucuauuguugaucuuacaccaagauccaaacuugaacauucuacuuuuguugauaca

SEQ ID NO: 484043 - RNA, 64 nt, Human
cuucacagagcacucuggcacaccauaucggagaaaacuugauagauuaguuaaugguuuuucu

SEQ ID NO: 484044 - RNA, 64 nt, Human
aucaaguaaaaugcaaagauguccacacuguuuuaaacuugacccugaugaaaaugugagcacu

SEQ ID NO: 484045 - RNA, 64 nt, Human
guaagccuaaaagugauucuuugaaaguuuaaagaaacuugaccaaaagacaguacaaaaacac

SEQ ID NO: 484046 - RNA, 64 nt, Human
gcauagcaagugaaagcaaguguucacaacggugaaacuugagcgucauuuuucuuagugugcc

SEQ ID NO: 484047 - RNA, 64 nt, Human
gaaaauuacuuaaaacaggaaagugucaauaaaaaaacuugagcaacaccaacauauuuuuucu

SEQ ID NO: 484048 - RNA, 64 nt, Human
uauaaugaagagaugccuuuguuucaugagauucaaacuugaugcuaugcuuuaaaauaaacuc

SEQ ID NO: 484049 - RNA, 64 nt, Human
cgagaaauuaaaucuuaaaaucuguguaaauagaaaacuugaaccauuaguaauaacagaacug

SEQ ID NO: 484050 - RNA, 64 nt, Human; identical to SEQ ID NO: 206287

SEQ ID NO: 484051 - RNA, 64 nt, Human; identical to SEQ ID NO: 206288

SEQ ID NO: 484052 - RNA, 64 nt, Human; identical to SEQ ID NO: 206289

SEQ ID NO: 484053 - RNA, 64 nt, Human; identical to SEQ ID NO: 206293

SEQ ID NO: 484054 - RNA, 64 nt, Human
aacccuuagcguaucuugccaugugucagcaggcaaacuugaggaagcccugguucuauuucac

SEQ ID NO: 484055 - RNA, 64 nt, Human
aggggaacucauuuggggugcaaaugcuaaugucaaacuugagucacaaagaacauguagaaaa

SEQ ID NO: 484056 - RNA, 64 nt, Human
agauaacauagcagaggaauuaauaauuuuuuugaaacuugaacuuagcagcaaaauagagcuc

SEQ ID NO: 484057 - RNA, 64 nt, Human
ggcaaaggaggcuuguauuuugcacauuuuauaaaaacuugagagaaugagauuucugcuugua

SEQ ID NO: 484058 - RNA, 64 nt, Human
aguagagacagaaacgaagcccagaacaaagaugaaacuugaauuaccaucucagaagucaagc

SEQ ID NO: 484059 - RNA, 64 nt, Human
uacacugagagccuuuuugaaaguaauugaguggaaacuugaugccauucuaaaucaaggcaua

SEQ ID NO: 484060 - RNA, 64 nt, Human
acagucagugucacuucaggaaagcuauuuaaaaaaacuugaaauuuaauugaaagaagaaaca

SEQ ID NO: 484061 - RNA, 64 nt, Human
uuaucaauauuuguguagugagguccuaaucaagaaacuugaacaggauaaugugucuaaaaau

SEQ ID NO: 484062 - RNA, 64 nt, Human
guaacagagagacaccucugucucugaaaaaacaaaacuugaaguuugaaacccccagcuugcu

SEQ ID NO: 484063 - RNA, 64 nt, Human
uaaauguggguuuugcaaauauuguuuaaaaaccaaacuugaagccaggcaugguggcccacac

SEQ ID NO: 484064 - RNA, 64 nt, Human
cuuggcacuucaguuucaaacacguaguccuuuaaaacuugauccgauagcuuuaaugcggccg

SEQ ID NO: 484065 - RNA, 64 nt, Human
guaagccuaaaaaugauucuuugaaaguuuaaagaaacuugaccaaaagacaguacaaaaaaca

SEQ ID NO: 484066 - RNA, 64 nt, Human
ugggguagugugagcuuuuaauguuaagucuguuaaacuugagucaaauuaagcagacccggca

SEQ ID NO: 484067 - RNA, 64 nt, Human; identical to SEQ ID NO: 206341

SEQ ID NO: 484068 - RNA, 64 nt, Human; identical to SEQ ID NO: 206342

SEQ ID NO: 484069 - RNA, 64 nt, Human; identical to SEQ ID NO: 206343

SEQ ID NO: 484070 - RNA, 64 nt, Human; identical to SEQ ID NO: 206377

SEQ ID NO: 484071 - RNA, 64 nt, Human
uuaaaucugccuaguuuugaugaauucuuuugugaaacuugaaagagaauagacaguaugacau

SEQ ID NO: 484072 - RNA, 64 nt, Human
agaaauaaacuucagauuugugauuuuuguuucuaaacuugauacagauuuacacuauuuauaa

SEQ ID NO: 484073 - RNA, 64 nt, Human; identical to SEQ ID NO: 384196

SEQ ID NO: 484074 - RNA, 64 nt, Human; identical to SEQ ID NO: 384197

SEQ ID NO: 484075 - RNA, 64 nt, Human; identical to SEQ ID NO: 384198

SEQ ID NO: 484076 - RNA, 64 nt, Human; identical to SEQ ID NO: 384199

SEQ ID NO: 484077 - RNA, 64 nt, Human; identical to SEQ ID NO: 384200

SEQ ID NO: 484078 - RNA, 64 nt, Human; identical to SEQ ID NO: 384201

SEQ ID NO: 484079 - RNA, 64 nt, Human; identical to SEQ ID NO: 384202

SEQ ID NO: 484080 - RNA, 64 nt, Human; identical to SEQ ID NO: 384203

SEQ ID NO: 484081 - RNA, 64 nt, Human; identical to SEQ ID NO: 384204

SEQ ID NO: 484082 - RNA, 64 nt, Human; identical to SEQ ID NO: 384205

SEQ ID NO: 484083 - RNA, 64 nt, Human; identical to SEQ ID NO: 385564

SEQ ID NO: 484084 - RNA, 57 nt, Human; identical to SEQ ID NO: 385584

SEQ ID NO: 484085 - RNA, 64 nt, Human; identical to SEQ ID NO: 206298

SEQ ID NO: 484086 - RNA, 64 nt, Human; identical to SEQ ID NO: 206299

SEQ ID NO: 484087 - RNA, 64 nt, Human; identical to SEQ ID NO: 206300

SEQ ID NO: 484088 - RNA, 64 nt, Human; identical to SEQ ID NO: 385585

SEQ ID NO: 484089 - RNA, 64 nt, Human; identical to SEQ ID NO: 385586

SEQ ID NO: 484090 - RNA, 64 nt, Human; identical to SEQ ID NO: 385587

SEQ ID NO: 484091 - RNA, 64 nt, Human; identical to SEQ ID NO: 385588

SEQ ID NO: 484092 - RNA, 64 nt, Human; identical to SEQ ID NO: 385589

SEQ ID NO: 484093 - RNA, 64 nt, Human; identical to SEQ ID NO: 385590

SEQ ID NO: 484094 - RNA, 64 nt, Human; identical to SEQ ID NO: 385591

SEQ ID NO: 484095 - RNA, 64 nt, Human; identical to SEQ ID NO: 385592

SEQ ID NO: 484096 - RNA, 64 nt, Human; identical to SEQ ID NO: 385593

SEQ ID NO: 484097 - RNA, 64 nt, Human; identical to SEQ ID NO: 385594

SEQ ID NO: 484098 - RNA, 64 nt, Human; identical to SEQ ID NO: 385595

SEQ ID NO: 484099 - RNA, 64 nt, Human; identical to SEQ ID NO: 385596

SEQ ID NO: 484100 - RNA, 64 nt, Human; identical to SEQ ID NO: 206279

SEQ ID NO: 484101 - RNA, 64 nt, Human; identical to SEQ ID NO: 206280

SEQ ID NO: 484102 - RNA, 64 nt, Human; identical to SEQ ID NO: 206281

SEQ ID NO: 484103 - RNA, 64 nt, Human; identical to SEQ ID NO: 206282

SEQ ID NO: 484104 - RNA, 59 nt, Human
agccugacacccaaggcugagauguuugugcuccguagcuucuagucuggaacugcugc

SEQ ID NO: 484105 - RNA, 64 nt, Human
cugacucugcuacucccguucuuccugcuuuccugcuccguaucucagucugcacugaccccag

SEQ ID NO: 484106 - RNA, 64 nt, Human
ccucauacaaccauuuggggaugugccuauuagggcuccguaagaacucagaugccugggaagc

SEQ ID NO: 484107 - RNA, 64 nt, Human
gugacccacggaggauccacucccaggaugacgugcuccguagcucugcugcugauacuggguc

SEQ ID NO: 484108 - RNA, 64 nt, Human
cuaaguggaauagccucccuguaacuccagcucugcuccguaugccaagaggagacuuuaauuc

SEQ ID NO: 484109 - RNA, 64 nt, Human
uaccgaguugccauccugagggguuuaacaacaugcuccguagacgaagggagaggaggagaga

SEQ ID NO: 484110 - RNA, 64 nt, Human
gcuggaauaaacuuuugaaacacuaauguaguaugcuccguauagugauuguagcuguuccucu

SEQ ID NO: 484111 - RNA, 64 nt, Human
uagccaccccaaguguggauaugccucuucgauugcuccguacucuaacaucuagcuggcuucc

SEQ ID NO: 484112 - RNA, 64 nt, Human
gguaggagucuauggugugaaacccuacagcauugcuccguagaguacgugcaaguuccuugac

SEQ ID NO: 484113 - RNA, 64 nt, Human
ugccagcucagcgcaccuccacaacgaaugaaaugcuccguaugauuugcacaaaugacauaga

SEQ ID NO: 484114 - RNA, 64 nt, Human
augcaggacugguucagcuugggcugucuguacagcuccguacugccuauguguagccaucuuu

SEQ ID NO: 484115 - RNA, 64 nt, Human
ugaauaacuuucaaagccagugcucagcuucucugcuccguacuagcguuuacaggucuuaauu

SEQ ID NO: 484116 - RNA, 64 nt, Human
gauggccuggaggcuccagugacugaggggccuggcuccguagaugagaagcugccugccccug

SEQ ID NO: 484117 - RNA, 64 nt, Human
aagggucaaaacccaucauccugacccuuguggggcuccguaagaagcugaaaccuucgaccgu

SEQ ID NO: 484118 - RNA, 64 nt, Human
aagugaggauauagccuuaucucauggaggacgagcuccguauuuacucaggagcagucagggu

SEQ ID NO: 484119 - RNA, 64 nt, Human; identical to SEQ ID NO: 331607

SEQ ID NO: 484120 - RNA, 64 nt, Human; identical to SEQ ID NO: 345445

SEQ ID NO: 484121 - RNA, 64 nt, Human; identical to SEQ ID NO: 345446

SEQ ID NO: 484122 - RNA, 64 nt, Human
cuaggcugaagcccucuucaguuccaugcaccacgcuccguagaagccccggcggaagccguag

SEQ ID NO: 484123 - RNA, 64 nt, Human
cccugcuugcugaagcgucaggugaccgaguucagcuccguaagguggcggcaccugaggagga

SEQ ID NO: 484124 - RNA, 64 nt, Human
gcggcggccucuucucuucagcucccuuagcuuggcuccguaaguggaucacuugccaaaugcu

SEQ ID NO: 484125 - RNA, 64 nt, Human
guagcgagccugccacgcuugugacuggggaggggcuccguauaaucucaccuuugcaagcguu

SEQ ID NO: 484126 - RNA, 64 nt, Human
gaugauuccggcauuccugggucuuccuacacuugcuccguaaugagaauucagagaagcagcc

SEQ ID NO: 484127 - RNA, 64 nt, Human
gccacucucacaucugaguguuggguacaaagcugcuccguagagugaugugcacuccuggugg

SEQ ID NO: 484128 - RNA, 64 nt, Human
uguggcuugggaccugaauaggcaggugcugcuggcuccguagaaacccuuuucccaucuuuug

SEQ ID NO: 484129 - RNA, 64 nt, Human
cagggcucaguacgaggcugcccggcccuggagggcuccguaggucucagcaacagcguguccc

SEQ ID NO: 484130 - RNA, 64 nt, Human
gugccgaguccugugucauccucggggccuaugagcuccguaccagccacucaaaagugucuga

SEQ ID NO: 484131 - RNA, 64 nt, Human
uauugcugucgacggggguggggcaaggacccgcgcuccguagagcuacacgcugcuucacaag

SEQ ID NO: 484132 - RNA, 64 nt, Human
augccuuucugcagagccggacaccugugcacucgcuccguaccuggaccugcugaaucauagc

SEQ ID NO: 484133 - RNA, 64 nt, Human
aaguggggacccaggucccugagcugucugcugggcuccguagagcgguggugggcaggcaccu

SEQ ID NO: 484134 - RNA, 64 nt, Human
cugcugguccggcuucugaccggccuuuguccuggcuccguagcagaacacuguaaaagugccc

SEQ ID NO: 484135 - RNA, 62 nt, Human
gcccuggugacccggcgggaccugcgggcgcgcggcccgacgaccagagggcgagccugcuc

SEQ ID NO: 484136 - RNA, 62 nt, Human
cauuuuuuaaaaagguuucucugacggccccacggcccgagccgcggugagcgucguguugc

SEQ ID NO: 484137 - RNA, 64 nt, Human; identical to SEQ ID NO: 345627

SEQ ID NO: 484138 - RNA, 64 nt, Human; identical to SEQ ID NO: 331624

SEQ ID NO: 484139 - RNA, 64 nt, Human; identical to SEQ ID NO: 345481

SEQ ID NO: 484140 - RNA, 62 nt, Human
uccucggggccugagcccaguggccuccuggccggcccgacacggccuucgucugguuccuc

SEQ ID NO: 484141 - RNA, 62 nt, Human
acuacccaagcccccugaacaaacacagcuuccggcccgaggccucaccuggacaacggugc

SEQ ID NO: 484142 - RNA, 62 nt, Human
gaccuaggcggucuuguggcccggagccggcccggcccgaaaaccauagaccugguuguacu

SEQ ID NO: 484143 - RNA, 62 nt, Human
aacuaaccuuuaccuaccaaagccacguuccacggcccgaggcuuaaacaggaccaaugaga

SEQ ID NO: 484144 - RNA, 62 nt, Human
ugccauaagugggccugugaggucacaccgcccggcccgagguaucgcaugugcgggggagg

SEQ ID NO: 484145 - RNA, 62 nt, Human
caugcccuccguggcugggcugccaccccacccggcccgaaucugucuugaccugcaggaau

SEQ ID NO: 484146 - RNA, 62 nt, Human
gggcaggggcaggggcagggacaguggccaggcggcccgaggacuuacggucggcacuucuc

SEQ ID NO: 484147 - RNA, 62 nt, Human
uaggaacccagccugaggggaagccacaggaucggcccgagacccaggccaugcccacuggg

SEQ ID NO: 484148 - RNA, 62 nt, Human
ccggcguccgaggccgggcggugagaagggugcggcccgaggugcucccaggugcuacucag

SEQ ID NO: 484149 - RNA, 62 nt, Human
cucggcuaucaggccacagcagcccccuggugcggcccgagaccgggcagaguggaccucac

SEQ ID NO: 484150 - RNA, 62 nt, Human
gugcugggauuacaggcguuagccacugcgcccggcccgagaaaauacaguuuuaaaaagag

SEQ ID NO: 484151 - RNA, 62 nt, Human
gggaacgugguacucacuggaugcacccaggccggcccgagccucccaccgcagacagugug

SEQ ID NO: 484152 - RNA, 62 nt, Human
cuccccaggcggugccccugagccccccgcagcggcccgagcuggcggaagccccacggcgg

SEQ ID NO: 484153 - RNA, 62 nt, Human
cccgcgggccuccgcugcccgacgcuucuguucggcccgaccuccaccccggcucccaauaa

SEQ ID NO: 484154 - RNA, 62 nt, Human
uagcugggacuacaggcacacgccaccucgcccggcccgaucuuucuaaaauacaguucuga

SEQ ID NO: 484155 - RNA, 64 nt, Human; identical to SEQ ID NO: 345482

SEQ ID NO: 484156 - RNA, 64 nt, Human; identical to SEQ ID NO: 345483

SEQ ID NO: 484157 - RNA, 64 nt, Human; identical to SEQ ID NO: 345501

SEQ ID NO: 484158 - RNA, 62 nt, Human
gucugcccaaaugggcucugaccgugcucugucggcccgagacauuuggaaguccuggggga

SEQ ID NO: 484159 - RNA, 62 nt, Human
gccgccuucagugcuguauuuagugcagugcccggcccgacccgcgggggugccacagccuu

SEQ ID NO: 484160 - RNA, 52 nt, Human; identical to SEQ ID NO: 36871

SEQ ID NO: 484161 - RNA, 62 nt, Human
cacgcggccggccaagugaggcccggagaccccggcccgaggcgcccaggccugagccccau

SEQ ID NO: 484162 - RNA, 62 nt, Human
gcugccggagcccagagcgcgcgucgaaccgucggcccgagggcgcagaccugaggcgaggc

SEQ ID NO: 484163 - RNA, 62 nt, Human
ggccccaccgcccccuuggucagcgcaggccacggcccgagggggcgcccgcaguggacagg

SEQ ID NO: 484164 - RNA, 62 nt, Human
uggaguggggaauggugggaguaggggucauccggcccgaggccugcccuggcacacgcguu

SEQ ID NO: 484165 - RNA, 62 nt, Human
cgugaggguugggacccaccgaggcgcagaggcggcccgaaugcagcccugguucaggcccg

SEQ ID NO: 484166 - RNA, 62 nt, Human
aucucuuguccguucccacccaccccccuccucggcccgagccuuuucccggugggugucag

SEQ ID NO: 484167 - RNA, 62 nt, Human
accuccagaaccgacaguuccagcaaaagcagcggcccgagcagaagaucgaggacaucagc

SEQ ID NO: 484168 - RNA, 62 nt, Human
gucgugaccgcuuacaccccuucuccacagcccggcccgaccuggagggcccccggggcacu

SEQ ID NO: 484169 - RNA, 64 nt, Human
gcaaugacuaagauccuucacuucucugaaaguaaggcccuagaugccucagggaagacaguaa

SEQ ID NO: 484170 - RNA, 64 nt, Human; identical to SEQ ID NO: 331588

SEQ ID NO: 484171 - RNA, 64 nt, Human; identical to SEQ ID NO: 345373

SEQ ID NO: 484172 - RNA, 64 nt, Human; identical to SEQ ID NO: 345374

SEQ ID NO: 484173 - RNA, 64 nt, Human; identical to SEQ ID NO: 345375

SEQ ID NO: 484174 - RNA, 64 nt, Human; identical to SEQ ID NO: 345798

SEQ ID NO: 484175 - RNA, 64 nt, Human; identical to SEQ ID NO: 345799

SEQ ID NO: 484176 - RNA, 64 nt, Human; identical to SEQ ID NO: 331605

SEQ ID NO: 484177 - RNA, 64 nt, Human; identical to SEQ ID NO: 345409

SEQ ID NO: 484178 - RNA, 64 nt, Human; identical to SEQ ID NO: 345410

SEQ ID NO: 484179 - RNA, 64 nt, Human; identical to SEQ ID NO: 345411

SEQ ID NO: 484180 - RNA, 64 nt, Human; identical to SEQ ID NO: 345427

SEQ ID NO: 484181 - RNA, 64 nt, Human; identical to SEQ ID NO: 345428

SEQ ID NO: 484182 - RNA, 64 nt, Human
accacaccaucuucuugcugugagaggucucaccccgggcuaccuccugucacuacucacugcc

SEQ ID NO: 484183 - RNA, 64 nt, Human
uauuuuuacuacagacggaguuuccccauguuggccgggcuagucucgaacuccugaccucagg

SEQ ID NO: 484184 - RNA, 56 nt, Human
gcaagcuccaggugcucugaccccagccgggcuacuaggacaggccagggcacuug

SEQ ID NO: 484185 - RNA, 64 nt, Human
cgaccgggagguccaccugcguugugagcucucaccgggcuacuaccuggcuguccccagcacc

SEQ ID NO: 484186 - RNA, 64 nt, Human
cuaugcacacagcacucgcucuuagcuccucuguccgggcuacuaggagugagaccagcuucug

SEQ ID NO: 484187 - RNA, 64 nt, Human
ggcaggauugggccacagacagccucucauugguccgggcuaauucacuccugcugcuccccuu

SEQ ID NO: 484188 - RNA, 64 nt, Human
gcuuagcugcaggcccaggcccucugcucugcucccgggcuaggagguggcccucugucugggc

SEQ ID NO: 484189 - RNA, 64 nt, Human
uucuugaagcacuuuggcccaaaagaguuaucgcccgggcuagaauuuagcagacagcuguucc

SEQ ID NO: 484190 - RNA, 64 nt, Human
ggccugauggaaucccugucaugcgcuggucccaccgggcuacggucagcucagucaagacaga

SEQ ID NO: 484191 - RNA, 64 nt, Human
caaguagcugggauuacaggcgugcaccaccacgccgggcuaaauuuuuuuguauuuuuaguag

SEQ ID NO: 484192 - RNA, 64 nt, Human
uaggauuuuuggaucuuucuacagcuacggggcuccgggcuacuuugcagggaugcgaugcgua

SEQ ID NO: 484193 - RNA, 64 nt, Human
gugucugucagacugcccuggguggagggagacgccgggcuagagccuuugggaucguccugga

SEQ ID NO: 484194 - RNA, 64 nt, Human
uguaauugcguuaaaucuuuugagaguguaaaugccgggcuaggcaauugcaguuaauacauac

SEQ ID NO: 484195 - RNA, 62 nt, Human
gcagcagcccagcuguuuaggguugcuggaggccgggcuaccgucuugugccugaaaaccac

SEQ ID NO: 484196 - RNA, 64 nt, Human
uuuaagauucccaaaccuaaugaucaucugaaucccgggcuaagaaugcagacuuuucagacug

SEQ ID NO: 484197 - RNA, 64 nt, Human
uagacagaaugaucauucaauggaucacagugaagcaaaggacacaacuuuuuauuguaccccu

SEQ ID NO: 484198 - RNA, 64 nt, Human
ccuucauuuccuaccuuccuuccuccucuguuuagcaaaggagggcagcucacuuggauguccu

SEQ ID NO: 484199 - RNA, 64 nt, Human
gggcaguaggccaucccccaggagaaugacagaagcaaaggacuuguuacuaagcagauuuaag

SEQ ID NO: 484200 - RNA, 64 nt, Human
cuuuaacuccagccgcggaaugacauuaguggaaccgggcuagggaacugcuggaaguucagga

SEQ ID NO: 484201 - RNA, 64 nt, Human
ccccuucccacucagcuucugccagcgggucgcaccgggcuagcuggcugcccagagccucuga

SEQ ID NO: 484202 - RNA, 64 nt, Human
cugcagacuuuugcaggauugucuagccugaguaccgggcuacuucuuaaaugccgucacuccu

SEQ ID NO: 484203 - RNA, 64 nt, Human
ccugccgcccaggagcugggcccugccacccaggccgggcuagggacauggcagggccugggca

SEQ ID NO: 484204 - RNA, 64 nt, Human
uccagggaucagcugugugugugugaccucccuaccgggcuaucggccucuugggagccagcgg

SEQ ID NO: 484205 - RNA, 64 nt, Human
auugcagcggcucuggcuaauugggccucagugcccgggcuauuuugaacccaggaauccuugg

SEQ ID NO: 484206 - RNA, 64 nt, Human
caaguagcugggauuacaggcacaugccuccauaccgggcuaauuuuuguauuuuuaguagaga

SEQ ID NO: 484207 - RNA, 56 nt, Human
acgacuuuggcugggauugagcagacccgggcuauguaccuuacccacguggcuua

SEQ ID NO: 484208 - RNA, 64 nt, Human
uguaauugcguuaaaucuuuugagaauguaaaugccgggcuaggcaauugcaguuaauacauac

SEQ ID NO: 484209 - RNA, 64 nt, Human
cuuugaccagccuugugagggcaucgaugcugccccgggcuaccuggcugcucugggcagggug

SEQ ID NO: 484210 - RNA, 64 nt, Human
auguuuauauuauaaaagaguguccuaacaguccccgggcuagagaggacuaaggaaaacagag

SEQ ID NO: 484211 - RNA, 64 nt, Human
cuuuuuuuuuuaagauagagucucacucugcugcccgggcuagagugcaguggugggaucucgg

SEQ ID NO: 484212 - RNA, 64 nt, Human
cagguauuugaaacuacagguguguaccaccacaccgggcuaauuuuuguauuuuuuguagaga

SEQ ID NO: 484213 - RNA, 64 nt, Human
ccauuccagaccuaacccagaccaucuccccccgccgggcuacgaugacauguaccugugaagg

SEQ ID NO: 484214 - RNA, 64 nt, Human
aggaacucccagggaugaagauuccuccugugacccgggcuaccuguagccaaaaugcaacugg

SEQ ID NO: 484215 - RNA, 59 nt, Human
ggugggucugcagcuggugugggaacuuccccacggauggcgguggaggggguucgcac

SEQ ID NO: 484216 - RNA, 64 nt, Human
cagcucuaggcaugcagacaaccccacacggccacaccaccacaugcccaaguguacacacaca

SEQ ID NO: 484217 - RNA, 64 nt, Human
caccuccgcauccacccccguccgccauccugcccaccaccaggucgguucccgaggccuggcc

SEQ ID NO: 484218 - RNA, 64 nt, Human
cauggugccccucacaagccgcagcggcuggugcccgggcuaccagggacaugccagagggcuc

SEQ ID NO: 484219 - RNA, 64 nt, Human
cuaccacuccuaccucaccaucuucgggcagaucccgggcuacaucgacgguaggagccgggcg

SEQ ID NO: 484220 - RNA, 64 nt, Human
cgaguagcugggacuacaggcacgugugaccaugccgggcuaauuuuuuauauuuuuaguagag

SEQ ID NO: 484221 - RNA, 64 nt, Human
uugugcgaaaacaccaccuggggcgcguccugcgccgggcuagggcucucuuugcugauuaccu

SEQ ID NO: 484222 - RNA, 64 nt, Human
guggggaaggugugagucagcgccccuggacgggccgggcuaaaaaaggcuguuagaaccuuug

SEQ ID NO: 484223 - RNA, 64 nt, Human
acuaaccgugaccacuacuccaaacaaaacacaauaugccuaggggcacggaugaacguccagg

SEQ ID NO: 484224 - RNA, 64 nt, Human
uugguuguuuuuucuuuauaauggcucugggcuauaugccuauauuuauaaaccagcagcaggg

SEQ ID NO: 484225 - RNA, 64 nt, Human
cugggcucauucuuccacugacuuaauuaugaucuaugccuaacagagccccaguacaacuauu

SEQ ID NO: 484226 - RNA, 64 nt, Human
uuuugccagauuucuuguauuuauuccacaucauuaugccuauaaugugccgcuuugugauugg

SEQ ID NO: 484227 - RNA, 64 nt, Human
ccacaauacaguuaucuuuuuuauuguguuguguuaugccuacaugugauauaaauuaauauuu

SEQ ID NO: 484228 - RNA, 64 nt, Human
auuuauuuuaccucuuucccaaaccuggagcauuuaugccuaggcuugucaagaaucuguucag

SEQ ID NO: 484229 - RNA, 64 nt, Human
aaauguauacuguaagucuaccuuuacuaucuacuaugccuacuucaccaucucuuaaggacuc

SEQ ID NO: 484230 - RNA, 64 nt, Human
ucuucuuuuguguccugcucuguuuggugggccauaugccuacagcccucacuaacaaagaacc

SEQ ID NO: 484231 - RNA, 64 nt, Human
uacgcuggaguugcccugccaucgccuccaucagccagacgagguccucacaggagaaggacag

SEQ ID NO: 484232 - RNA, 64 nt, Human
aucaugaguugccaccacucagaaguuuauucuuccagacgaccaguggauacugaggaaaguc

SEQ ID NO: 484233 - RNA, 64 nt, Human
aaucugggaggccuaucccccuaucccaggcaucccagacgaggacuggcugaggcuaggcgcu

SEQ ID NO: 484234 - RNA, 64 nt, Human
cucuaacaguguuagaaguuugugauucuccaaauaugccuagauuuaaagcugauuuaauuua

SEQ ID NO: 484235 - RNA, 64 nt, Human
guucuaaaaugaagucacacaggacaauuauucuuaugccuaaguuaacaguggauaaaagacu

SEQ ID NO: 484236 - RNA, 64 nt, Human
cauuucaguggauaauuuauuuuaaaaaaaaaacuaugccuaaauaucccuuauuugcaauauu

SEQ ID NO: 484237 - RNA, 64 nt, Human
cuaguggauugguuuucaacaucgugccugccgauaugccuacagaaucaucuguaagugucaa

SEQ ID NO: 484238 - RNA, 64 nt, Human
uaacucuuaggaccagggauugucuugcaccaaguaugccuaccccuggccagucugaggucuc

SEQ ID NO: 484239 - RNA, 64 nt, Human
uuuauuuucauguuaugccaguaauauaguguuguaugccuauugagugauuguggcaagaaaa

SEQ ID NO: 484240 - RNA, 64 nt, Human
ccugcugcuccuuccguaagaaaaugaaauauucuaugccuaauacucacacgcaacauuucuu

SEQ ID NO: 484241 - RNA, 59 nt, Human
aacccaaaagagaaaaguaaaauauuucuuaugccuauuuuuuuuuaaaucaaaaggga

SEQ ID NO: 484242 - RNA, 64 nt, Human
uuuauuuaaaaaguucaggccaggugcaguggcuuaugccuauaauccccgcacuuugggaggc

SEQ ID NO: 484243 - RNA, 64 nt, Human
ucagcaggcccaaguaaagguuaaaaauaaggucuaugccuagggaaacucagggcuucuaguu

SEQ ID NO: 484244 - RNA, 64 nt, Human
auaaauuuucuacucaacaauuccgagauaggauuaugccuaguuugucauaucacagaaaaac

SEQ ID NO: 484245 - RNA, 64 nt, Human
uuguaaacacaaugauaagcaaauucaaaacuguuaugccuaaauggugaauaugcaauuagga

SEQ ID NO: 484246 - RNA, 64 nt, Human
uuaagaaguuacacggcacuaauuuuaugaguuguaugccuaauuucaauuucuaaccuauuug

SEQ ID NO: 484247 - RNA, 64 nt, Human
gaaaauuaaccagaaaguaucaguucuuaaaaguuaugccuagaaauuauguaaagcuaaacua

SEQ ID NO: 484248 - RNA, 64 nt, Human
gagaauuccaagaacuguuacauauaaucauauauaugccuauaucuaaacguuuucccuccuu

SEQ ID NO: 484249 - RNA, 64 nt, Human
uugcgacccagcugccauaaccaccuuagaacuaccagacgagcacaucagaacccuuugacag

SEQ ID NO: 484250 - RNA, 64 nt, Human
auaugucaccguaugccuuaggauguucaaggagccagacgaaauaaggccugucuuccaauuu

SEQ ID NO: 484251 - RNA, 64 nt, Human
guuuuucuaaagaaagcugugcucuucuguugacccagacgaauagggcacagcccuguaacug

SEQ ID NO: 484252 - RNA, 64 nt, Human
gaaauccuaauuuagccaggaccugccaaugauuccagacgaccuuuuguuuuccuaccgacgu

SEQ ID NO: 484253 - RNA, 64 nt, Human
aauaauuugaaucauguaauauuuaagguuauacuaugccuauuugaaaaugauauuaguuauc

SEQ ID NO: 484254 - RNA, 64 nt, Human
agaacauuucaaauaagauucuuguuaacccauuuaugccuaguguuccauuauuggaaugcua

SEQ ID NO: 484255 - RNA, 64 nt, Human
gguagcagaaaaggccuagaaccaguuuuaagauuaugccuacaucucuagaagacuaguacac

SEQ ID NO: 484256 - RNA, 64 nt, Human
uaauuauagcucucuacaucacgguaaucaugccuaugccuacauaagaauggcugagcuaaca

SEQ ID NO: 484257 - RNA, 64 nt, Human
uuuuucguuaauuuacaaaguaacaucagcugccuaugccuaugauaagguagcagucugcauu

SEQ ID NO: 484258 - RNA, 64 nt, Human
cucaugagcuuuaucuuggcagucuuacggcucuuaugccuagcaaaucuccagccuaauuuua

SEQ ID NO: 484259 - RNA, 64 nt, Human
guguauaacuagauggauuuaaauggucugagccuaugccuaucuuucaaauugguguggauuu

SEQ ID NO: 484260 - RNA, 64 nt, Human
auuaaaagcugauugagucuguacauauguaaauuaugccuaguggagguucuguugacuuucu

SEQ ID NO: 484261 - RNA, 64 nt, Human
aggcccaccucuguguccaaguggauugagcauauaugccuaggaggagauagacuguuaaucg

SEQ ID NO: 484262 - RNA, 64 nt, Human
uucagaauauuuuaauguacauaugacauguguauaugccuaugguauaugugucaauuuaugu

SEQ ID NO: 484263 - RNA, 64 nt, Human
auguggaagagguaaaaagcugggcacaaguucauaugccuaugagucaguaaagacugaagua

SEQ ID NO: 484264 - RNA, 64 nt, Human
acaaaucaaguaaugguuugaacaccuuuaauaauaugccuaaucuguucaauuguuuuagaau

SEQ ID NO: 484265 - RNA, 64 nt, Human
uaguuuauauuacucucauucuuugaacaugaacuaugccuauguagugucuuuauuugcucag

SEQ ID NO: 484266 - RNA, 64 nt, Human
ucuuguucaaaauuguauauucagugacuuacacuaugccuagcacacaacacacacugaguaa

SEQ ID NO: 484267 - RNA, 64 nt, Human
aacccgugacuguauucucucccuuggauaccccuaugccuacaucauauuccuuaccucuuuu

SEQ ID NO: 484268 - RNA, 64 nt, Human
ucccauggcuuaauugccuaucagacgcauuuucccagacgaaagcaauguuggguuggggaag

SEQ ID NO: 484269 - RNA, 64 nt, Human
cuauguaauauuuuucaugccuuuucucauaaacccagacgagugguaaaaauuugccuucagu

SEQ ID NO: 484270 - RNA, 64 nt, Human
aggaagguucuggugugaacuaaacuuucacaccccagacgaugucuucauaccuacauguauu

SEQ ID NO: 484271 - RNA, 59 nt, Human
cagagaagcugccugcguaaaaagugccacccacggaggcaggacacaggcagcgugug

SEQ ID NO: 484272 - RNA, 64 nt, Human
cuauuauuccacuggcgcaucauaugcagugauauaugccuauaauauaagccauagguucaca

SEQ ID NO: 484273 - RNA, 64 nt, Human
cauuuaaaaauuaguuuauuaucagauaucagcauaugccuaauaaaacuuauuuuaauaagca

SEQ ID NO: 484274 - RNA, 64 nt, Human
uuugaagaucauuucuacuuggugcugaugaauuuaugccuagcuuuuuuuuucuaggugguga

SEQ ID NO: 484275 - RNA, 64 nt, Human
gggagcaaccccaggauagcuaaguguuauguaauaugccuagaaggugaugugaaugcgauuc

SEQ ID NO: 484276 - RNA, 64 nt, Human
guauuuguuuacuaugaaauuuuaaauacacauuuaugccuagaaggaacggacuuuuuuuuuc

SEQ ID NO: 484277 - RNA, 64 nt, Human
gaguugaaguuuacagagaugguguguucugcaauaugccuaguuucuuacacacugucuguau

SEQ ID NO: 484278 - RNA, 64 nt, Human
cuuaacagcuacaguuuaaaugauagcauagaauuaugccuaaaauagacauuucccauaauug

SEQ ID NO: 484279 - RNA, 64 nt, Human
aggaaaguacuacacuaaauucacucaacuauuguaugccuaccauaugccagauuuuauccua

SEQ ID NO: 484280 - RNA, 64 nt, Human
uuacuauaagagcugggauuugauucauuuuauuuaugccuaagucaucuaugcauuaacaugu

SEQ ID NO: 484281 - RNA, 64 nt, Human
cagcuacuuaggaggcugagguggcagaauagcuuaugccuaggagguugaggcugcagugagc

SEQ ID NO: 484282 - RNA, 64 nt, Human
guguucaaucaaugggcuuaaaucagcaaaauauuaugccuaaaguaaaucuguucuuaacaag

SEQ ID NO: 484283 - RNA, 64 nt, Human
uaauccccuuaucuucauggaaauggacugacuuuaugccuaugaaguccccaggagcuacacu

SEQ ID NO: 484284 - RNA, 64 nt, Human
uaucccuauuaaaacaggcaguuguuucuuugaauaugccuaaauaacaguauucuuaaaaucu

SEQ ID NO: 484285 - RNA, 64 nt, Human
uaucuacaucuauaucuguaugugcaucuauaucuaugccuauaucuauaucuauaucauauug

SEQ ID NO: 484286 - RNA, 64 nt, Human
gacacacacucacacgcacagucacucuuacacauaugccuaguccagugguucucaaagugug

SEQ ID NO: 484287 - RNA, 64 nt, Human
gcacacuuuccccuuagagcccccuaaguuuuucccagacgaaucuuuauaauuucuuuccaaa

SEQ ID NO: 484288 - RNA, 64 nt, Human
aaauuauguuaugaagugcaggaacagcacagacccagacgaggggaugcagcccggagccagu

SEQ ID NO: 484289 - RNA, 64 nt, Human
uccucugucccagauucaaaugaggaguaagagcccagacgagaggaaggcaggcuggaucuuu

SEQ ID NO: 484290 - RNA, 64 nt, Human
ccagagagaagcauccccuggcccggugggaagcccagacgaggaggacggggaaccggauuac

SEQ ID NO: 484291 - RNA, 64 nt, Human
cuuuucaagcuaccuugucauguauacagucauuuaugccuaaagccuggugauuauucauuua

SEQ ID NO: 484292 - RNA, 64 nt, Human
ugagaauguuggaacguuccaguuggaagguuccuaugccuagccugugugccauuucauggca

SEQ ID NO: 484293 - RNA, 64 nt, Human
gcuccuuuggagaggagauuaugaugugaaagauuaugccuaugugucuugcagauugcaagau

SEQ ID NO: 484294 - RNA, 64 nt, Human
gauaaacuucguauuguauagcuuugaaaauaauuaugccuaguauggagaaacaggaauaaga

SEQ ID NO: 484295 - RNA, 64 nt, Human
cugcuuugaaauguaugucuuuugggauguauuauaugccuagcuuuauaaucaguauaaauuu

SEQ ID NO: 484296 - RNA, 64 nt, Human
aaugcaacuccauuuaccaguaacuuauuuuaaauaugccuaguaacacauauguaguauaauu

SEQ ID NO: 484297 - RNA, 64 nt, Human
uguaaacuagaaugaaagaaggaaauuauguacguaugccuaauauucuuugugaaugucuuuc

SEQ ID NO: 484298 - RNA, 64 nt, Human
ccuuuuccugaauuuccuaccuaaauauuaaccauaugccuagucucugaaacuaaaaacuugg

SEQ ID NO: 484299 - RNA, 64 nt, Human
gauugagugccugcuggguacaagggauucaauuuaugccuauugauaucugcggaccaagaua

SEQ ID NO: 484300 - RNA, 64 nt, Human
cugaaugaauuacaagccuuuuuaagauaugaaauaugccuacccgcagagcuuggcacaaagu

SEQ ID NO: 484301 - RNA, 64 nt, Human
uaaucgaaaugaauuuaucugaauauaggaagcauaugccuacuuguaauuucuaacuccuuau

SEQ ID NO: 484302 - RNA, 64 nt, Human
uucuuuguuugauuuuucuguagguugaauaugauaugccuagguguaguuuucuuuucuuuuu

SEQ ID NO: 484303 - RNA, 64 nt, Human
aaauguauaauguuauuuguuuuauuauagcaauuaugccuaauuaaagcaguauuuaaugcaa

SEQ ID NO: 484304 - RNA, 64 nt, Human
ugaugcagagaagaaagaacggagugaagccauuuaugccuacggcagcagaaagagaugaaau

SEQ ID NO: 484305 - RNA, 64 nt, Human
cucaguaucuaucaaaaguguaaauuauauuuccuaugccuaguaauucacuucaugucuaaaa

SEQ ID NO: 484306 - RNA, 64 nt, Human
aaaugcagccaguguugugggucuacaacacuaaccagacgacuuuuuccaucaguguuuuacu

SEQ ID NO: 484307 - RNA, 64 nt, Human
aagaucuuaaguaacuuuuuccauccagcaacauccagacgauuucagugaccaaaugcucagc

SEQ ID NO: 484308 - RNA, 64 nt, Human
ucggcccuguggcggguaggcaggaaggacugucccagacgaggggcuuccucuagagucucac

SEQ ID NO: 484309 - RNA, 64 nt, Human
aaucccucacacuguggguuuuuuuuagaacuucccagacgaaaacucacgcccuugcccuaac

SEQ ID NO: 484310 - RNA, 64 nt, Human
aauggcacaaaaacaggcagucaucuuuaagggcuaugccuaggcaaacuacuaacaugcauug

SEQ ID NO: 484311 - RNA, 64 nt, Human
gguauggaaaacaagaaggaaaugaaaauauuuuuaugccuacuuaggaaaaaaaggguagcac

SEQ ID NO: 484312 - RNA, 64 nt, Human
ugugccuuuuuuauugccuaguaguauucugucauaugccuaucuuacaauuugauuaucuauu

SEQ ID NO: 484313 - RNA, 64 nt, Human
ccucacaugauaccccuuaucuuuuauaaugucuuaugccuauaccugaauauaacaaccuuua

SEQ ID NO: 484314 - RNA, 64 nt, Human
aaaaauaaucaccuuugauaccaaugugcaccaauaugccuaacuagcuagccagcuggagaua

SEQ ID NO: 484315 - RNA, 64 nt, Human
uuuuguauacccugaagaacucuuuuuccucuaauaugccuaaucuguaaucacauuucugagu

SEQ ID NO: 484316 - RNA, 64 nt, Human
cagaaguaaccaccuuuaaaaagcaacccccauguaugccuauauguguauuguauacuuuuuu

SEQ ID NO: 484317 - RNA, 64 nt, Human
uuuuaaaggauacguuucacuuaauaaacacguuuaugccuaucagcauguuugugauggauga

SEQ ID NO: 484318 - RNA, 64 nt, Human
aucaaagaaaagugaacuucaguuuuacaaucuguaugccuaaaagcggguacuaccguuuauu

SEQ ID NO: 484319 - RNA, 64 nt, Human
ggccgcuccugagcugcugucucccucucugaccuaugccuaccuucucuuucuucguucccug

SEQ ID NO: 484320 - RNA, 64 nt, Human
aguuaaaauggcauguuuucuuuucaagccguuauaugccuaguggguaguuccccugaugagc

SEQ ID NO: 484321 - RNA, 64 nt, Human
uuuacagugcuauuuacugaaguuauuuauuaaauaugccuaaaauacuuaaaucggaugucuu

SEQ ID NO: 484322 - RNA, 64 nt, Human
aaaaccaugacuuuuaacaaauuuuuauggguuauaugccuaaacccuuaugccacauaguggu

SEQ ID NO: 484323 - RNA, 64 nt, Human
uggagaccaaauagugaucugauccauaguauccuaugccuauacacuuuaaaauguauauaca

SEQ ID NO: 484324 - RNA, 64 nt, Human
guauguuuuuauagcugguuuuuaaaaagcauaauaugccuauagcugaaaaggaaacagggcu

SEQ ID NO: 484325 - RNA, 64 nt, Human
uacagggcccccucccccgggaaugcgcccaccaaggcccuagacucaucuuggcccuccucag

SEQ ID NO: 484326 - RNA, 64 nt, Human
ggccucagggagccccguggagggaugacaguucaggcccuacugcuggcacgucagagcacug

SEQ ID NO: 484327 - RNA, 64 nt, Human
acucccugggcuucccagagagugacagcugcucaggcccuaacccuuggcuccaggagacaca

SEQ ID NO: 484328 - RNA, 64 nt, Human
gauggacagacacucgguggagucugccuuucucaggcccuaaaucccucuccaaaggguacuu

SEQ ID NO: 484329 - RNA, 64 nt, Human
uauaccacuggggggccccagucuaagcucugcuuaugccuaucuugagaugcaauuacaccca

SEQ ID NO: 484330 - RNA, 64 nt, Human
uuaacuucuagggggaaaaauccauuauuuuagcuaugccuauacuauuaugcaaaguaacugu

SEQ ID NO: 484331 - RNA, 64 nt, Human
uguucaguaggaaaaaguuauauguggauaacuguaugccuaaguaguauauaaaagcugugcc

SEQ ID NO: 484332 - RNA, 64 nt, Human
guuuuuugcugugggugggguggguggguugguuuaugccuaucaaugcaauuuuuaauuuuug

SEQ ID NO: 484333 - RNA, 64 nt, Human
uugaugacuguaaagugaauuaacauuuggugauuaugccuagcuuuuuugacuaauauaaaga

SEQ ID NO: 484334 - RNA, 64 nt, Human
uaagcauuugcuguucaauaauaagcaucuucuuuaugccuaguauuugugauaagagcacaaa

SEQ ID NO: 484335 - RNA, 64 nt, Human
ucuagcugcccaccgcacccugaucucucuucucuaugccuaccuccccccauacccugcugau

SEQ ID NO: 484336 - RNA, 64 nt, Human
guucuugugugucacaguucagccaguuuugguuuaugccuagagcuacuucaaggaacuagac

SEQ ID NO: 484337 - RNA, 64 nt, Human
uaaaaacucuugagaacuauaaagugaacaccuauaugccuaccccuaccuagauucuauacuu

SEQ ID NO: 484338 - RNA, 64 nt, Human
guuuuccauuucucuccuucuucuuggucacauauaugccuaaaugcacagucaugugccuacg

SEQ ID NO: 484339 - RNA, 64 nt, Human
guggcgaaucaucagucccacccugcuagcagaauaugccuacgugcuaagaguuggggugagu

SEQ ID NO: 484340 - RNA, 64 nt, Human
aaugucaacuaauuugcaaucaauuaaagauacauaugccuagaaauuuugaaauuucgguaua

SEQ ID NO: 484341 - RNA, 64 nt, Human
gaguuuguggaacaauuugauuugcuguggccucuaugccuaaugagcuaguguuucuggcagc

SEQ ID NO: 484342 - RNA, 64 nt, Human
ucaugguugacugaggagccaauuaaaaccuguuuaugccuaguguuccauuauuggaacacua

SEQ ID NO: 484343 - RNA, 64 nt, Human
aaauuaagagaaaaaaauaucaggaaggucaauauaugccuaacauuucuaaacuggccacaua

SEQ ID NO: 484344 - RNA, 64 nt, Human
ccugaagcugugacucuguguuccucuguccccuaggcccuagaggacauuggucagcaggagc

SEQ ID NO: 484345 - RNA, 64 nt, Human
agauuagggugggguggccagcucacauagggguaggcccuagguaaaucagacaccgccuucu

SEQ ID NO: 484346 - RNA, 64 nt, Human
ccacuucuggauuacagugugccagguccuuuggaggcccuaccccuuccccauucauugccac

SEQ ID NO: 484347 - RNA, 64 nt, Human
gacucgaucccuagacauuuguuacagauaguuuuaugccuaagaccaagauguaaaguaccau

SEQ ID NO: 484348 - RNA, 64 nt, Human
cuaaacuacauuuuauuuuuguaucuuaaaaaucuaugccuaaaaaguaucauuacauauagga

SEQ ID NO: 484349 - RNA, 64 nt, Human
ugacaaaggaggcacucguucucuuuucuugcuguaugccuagaaagugguugaaggauucuug

SEQ ID NO: 484350 - RNA, 64 nt, Human
aaauccucagaaauggucuaaauaaaacacuugauaugccuagagaacacagcaaauguuuugg

SEQ ID NO: 484351 - RNA, 64 nt, Human
cuggguucaaauaaguugguuuguuagacauucauaugccuacccaucagccauuucguucucc

SEQ ID NO: 484352 - RNA, 64 nt, Human
cugaccauacuggaaucagacauaaauacuuauuuaugccuaaaaaugcacuguuacuuacagu

SEQ ID NO: 484353 - RNA, 64 nt, Human
gucugagacugcauucguaucugagcagguuuucuaugccuacugaugucaguauguuuauacu

SEQ ID NO: 484354 - RNA, 64 nt, Human
gacaccguuaccaccagaauggcugcucugacaauaugccuagggacuuucucauggcuuuuau

SEQ ID NO: 484355 - RNA, 64 nt, Human
acaaaaauuccucccagaggcacucuauaucugcuaugccuaaaaacuuaaacucaccaaaugg

SEQ ID NO: 484356 - RNA, 64 nt, Human
gaaaguguacuauauauaauguuugugucauguauaugccuaaauuuuaauuaucuauaaauaa

SEQ ID NO: 484357 - RNA, 64 nt, Human
ggagcuaacuacccaaccuguuaauaacaggcaguaugccuaaauagguacaguaaugaaaacu

SEQ ID NO: 484358 - RNA, 64 nt, Human
ugcuguaugagaauggcuuucaauccuuuguuucuaugccuacagacagaaagcaagaugucua

SEQ ID NO: 484359 - RNA, 64 nt, Human
agacugcuuuuccacugcacuuggaaggauauauuaugccuaacccugcccaacaaauuaaggu

SEQ ID NO: 484360 - RNA, 64 nt, Human
auauuuauauuuuaaaaacuguaugugacauuaauaugccuaaugauuaaaauuauagugauga

SEQ ID NO: 484361 - RNA, 64 nt, Human
uauuucuugcuuucaauuacaaagcaguuacuaauaugccuagcacaaguaccacucuugguca

SEQ ID NO: 484362 - RNA, 64 nt, Human
gcguaguucagauacuaaaauuugaaguuuccuuaggcccuagaacaucucuuuuccugguucc

SEQ ID NO: 484363 - RNA, 64 nt, Human
aaugagggaaguggggaguuagauuucagaguccaggcccuagguugggacccacuccaaauaa

SEQ ID NO: 484364 - RNA, 64 nt, Human
ggaagugcagcaggaauagcacccucuccccgggaggcccuagcuuccgugaggggccaucacc

SEQ ID NO: 484365 - RNA, 64 nt, Human
gcauaaucagacaagcuugaauauuguuuuugcaccagacgaacagugaggaaauucggagcua

SEQ ID NO: 484366 - RNA, 64 nt, Human
aaaggaguagaauauaaacacauaauugcuuauguaugccuauucagaauaaauggguaacacu

SEQ ID NO: 484367 - RNA, 64 nt, Human
gagaacaaguucagcuuuuaucauaagaaacucauaugccuagcuagaauauaugacugacuau

SEQ ID NO: 484368 - RNA, 64 nt, Human
uuauagagaaucguauuuuucuuucagaaauuguuaugccuacagccauugaaaaaugaagcau

SEQ ID NO: 484369 - RNA, 64 nt, Human
auuuuccaaacaacuuauacaugcuuuuuaugacuaugccuaauguaaagaaaauguauuacau

SEQ ID NO: 484370 - RNA, 64 nt, Human
acaaaacagguuuguuuuuuauuuuacaacaacauaugccuaauucugcaggauugcaaguaac

SEQ ID NO: 484371 - RNA, 64 nt, Human
uuauacucaguugcauuaucauaaaauuuucauauaugccuagauaauggggaaaaaaagucuu

SEQ ID NO: 484372 - RNA, 64 nt, Human
cucuuuguuucuuuaaguuuugccgagacaugguuaugccuaauuuauuuauaaaaggggaagu

SEQ ID NO: 484373 - RNA, 64 nt, Human
cugguuuacugccuuaguaauaucuaguuccuaauaugccuaugccuuuuaaugucugcacagu

SEQ ID NO: 484374 - RNA, 64 nt, Human
uggguuguuuauauguugguagaaauucucccuguaugccuagaaggaucagugaauguaagag

SEQ ID NO: 484375 - RNA, 64 nt, Human
aaaguuuucuguauauugcauagcauuacacauuuaugccuauuuuaacauuaacuucuaaaga

SEQ ID NO: 484376 - RNA, 64 nt, Human
uuuuuaaauuuuuuacaagagucuguauuccugauaugccuauauuuuuccucaaagauucugc

SEQ ID NO: 484377 - RNA, 64 nt, Human
guauuucagcugaucagaagcucagcauggccauuaugccuaguuuugaugaauaaacauggga

SEQ ID NO: 484378 - RNA, 64 nt, Human
aacucucaaaucaugaagugauauaaaagcugcauaugccuacaaagcucugaauucagguccc

SEQ ID NO: 484379 - RNA, 64 nt, Human
ugguucuuaaguuuuuuaucuccagauccuaauuuaugccuaugcaaaaaauaaaugacgccca

SEQ ID NO: 484380 - RNA, 64 nt, Human
uuaaaaucuuguauaauuugccacuguauucauuuaugccuaaaucucuauaacagaugaaaag

SEQ ID NO: 484381 - RNA, 64 nt, Human
aaaggacuauggccacauucaaucgcccaacuacccagacgauuaccggcccagcaaagucugc

SEQ ID NO: 484382 - RNA, 64 nt, Human
caaguaugaaauguaaaucagaaaugcagacaccccagacgagagccucacaggagggaggggg

SEQ ID NO: 484383 - RNA, 64 nt, Human
cucuuugguggugacugaggcaucauuagaaggcccagacgauuuccacuauucacagcauuuc

SEQ ID NO: 484384 - RNA, 64 nt, Human
uuguccuguauccagccuuucaacagaugucuggccagacgaagaacauuguguccuaauggua

SEQ ID NO: 484385 - RNA, 64 nt, Human
cacacuuuaaaaaguacauaaauccaugaguccauaugccuauuuuuagguugucuguuuuauu

SEQ ID NO: 484386 - RNA, 64 nt, Human
caacgcucccagacggucaggaaaacuguuccaaucaugaaaaggggggaugauuuuguaaaag

SEQ ID NO: 484387 - RNA, 64 nt, Human
uccacccuugaguagauccaguauuugaugaaacucaugaaaguggguggagcccaucuugccc

SEQ ID NO: 484388 - RNA, 64 nt, Human
aguauuggaagggguggggagauauauaaauaaaucaugaaaucaauacauaugccuggcucag

SEQ ID NO: 484389 - RNA, 64 nt, Human
aagccuucagcuauaacucuucacuuagucgacaucaugaaauacacaggaggaacgccuuccg

SEQ ID NO: 484390 - RNA, 64 nt, Human
ucugggcagaugaaaagcuaccaucacuuccucaucaugaaaacugggaggccgggcauggugg

SEQ ID NO: 484391 - RNA, 64 nt, Human
cauccaacaacacaaaacuauaugauuuuuaaaaucaugaaauagagacagcaaagcauauuuu

SEQ ID NO: 484392 - RNA, 64 nt, Human
ucauauguuuccucaacuguacaaugaacuauucucaugaaaaauggcuaaagaaauuauauuu

SEQ ID NO: 484393 - RNA, 64 nt, Human
uggcaguguguacuuuguuuuugugagucaugucucaugaaauuuauuggaauguuuaaucaua

SEQ ID NO: 484394 - RNA, 64 nt, Human
uuaaaauugaauucauccauuuuuaaaaaacacuucaugaaagcauucuggugugaauugccau

SEQ ID NO: 484395 - RNA, 64 nt, Human
gaugauuauauauuguuguuacuuuuucuuguauucaugaaaacuguuuuuacuaaguuuucaa

SEQ ID NO: 484396 - RNA, 64 nt, Human
gauguuuuuaggcacagaaguuggagaagagauuucaugaaagacaacaucacugcauugagag

SEQ ID NO: 484397 - RNA, 64 nt, Human
auuuccuaaaaucaugucuugaaaacauguuuucucaugaaacuugaauacuaucucaaauagg

SEQ ID NO: 484398 - RNA, 64 nt, Human
uuuuugggagcaggcaauaucugaaggugcaaacaggcccuacggcuguucccugcacaacucu

SEQ ID NO: 484399 - RNA, 64 nt, Human
aggaggagguguucaucugcaccacagagaguugaggcccuaacaaauuucaggcccagccaag

SEQ ID NO: 484400 - RNA, 64 nt, Human
cacuuugcugcuucuuucuggguuguggcugaugaggcccuaaguaaauaugugagcauuggcc

SEQ ID NO: 484401 - RNA, 64 nt, Human
gcuuacacuaauuggucagacaugcugucugcccucaugaaauuggcuccaaaugaaugaacua

SEQ ID NO: 484402 - RNA, 64 nt, Human
gcacagaaccuaacagcugauccccaacucucauucaugaaaauaaaaauugcuggagcuuggc

SEQ ID NO: 484403 - RNA, 64 nt, Human
gugucucaugagcagugagcacagucugcauucaucaugaaacacuaucuucuaccaggaggag

SEQ ID NO: 484404 - RNA, 64 nt, Human
cagaauuaggcauauguacaaaaccaaaauuuugucaugaaauuuugccuuuccacgcuucccu

SEQ ID NO: 484405 - RNA, 64 nt, Human
ggccuaaugaggugauuaggugaagucucugcccucaugaaaagauuaaucccauuaucucagg

SEQ ID NO: 484406 - RNA, 64 nt, Human
agaauaaagccuacuaggucucuaacuguugaacucaugaaagaagauaguguaugagacuuaa

SEQ ID NO: 484407 - RNA, 64 nt, Human
caggaggaaacaaagggugaaugaagaagaacaaucaugaaauggaagaaggaggaagagcaug

SEQ ID NO: 484408 - RNA, 64 nt, Human
ccaaaugaaaauuucaaagucaauaccagcagauucaugaaaguaaauuuaguccuauaauuuu

SEQ ID NO: 484409 - RNA, 64 nt, Human
cuaagauaccuuuguauuuuauuucauguggagaucaugaaaguaggaaauauaccuuuagaag

SEQ ID NO: 484410 - RNA, 64 nt, Human
aaucucaggaauacuggauucuauagccaagaacucaugaaaguaaguguaaacuauccuaggu

SEQ ID NO: 484411 - RNA, 64 nt, Human
auuucuugaagaauuucucgcaaacucacaacccucaugaaaaauuaauccucaguuccacgag

SEQ ID NO: 484412 - RNA, 64 nt, Human
uccugcuuuucuacaugccugugaaggagacuuuucaugaaacugaauaaaagaaauccuuucc

SEQ ID NO: 484413 - RNA, 64 nt, Human
aaauauaugaaaauuacuauaccucuaaguauuuucaugaaauucaccagcaguuugcaagcac

SEQ ID NO: 484414 - RNA, 64 nt, Human
uguacuauuuacuuagaagggagcccccuuccagucaugaaacuucauuuguuuuauccauauc

SEQ ID NO: 484415 - RNA, 64 nt, Human
aaauuagccaaaugaaucauuucuuauaucuuauucaugaaaguuugcauacagauguuugcau

SEQ ID NO: 484416 - RNA, 64 nt, Human
gugccccccacccccauagccugcauguccacucccagacgauggccaagagcagaaacacaag

SEQ ID NO: 484417 - RNA, 64 nt, Human
uuuucuucugccucacuugaaucccccguaaacaccagacgauugagucuaccuucuuuucuug

SEQ ID NO: 484418 - RNA, 64 nt, Human
gaugacucugccucuugucagcccagccaagagcccagacgaccccucuguccucguucccugu

SEQ ID NO: 484419 - RNA, 64 nt, Human
ccuucucuccagaagccgggcaggcagaauccggccagacgacggggcugagccaucaggagcu

SEQ ID NO: 484420 - RNA, 64 nt, Human
acuagcccaaguguuuuguauuacucagacaccaucaugaaauaauucugugaggucaugaugu

SEQ ID NO: 484421 - RNA, 64 nt, Human
cucuccccccccaccaccacccuccacccccaacucaugaaaagauucuauggacugaaaaagc

SEQ ID NO: 484422 - RNA, 64 nt, Human
auuggauuugaauucggcuccuguuuucuauuugucaugaaacaguguauuuggggagaugcug

SEQ ID NO: 484423 - RNA, 64 nt, Human
uuaacgcuauucagauuuucccaaagaucuuaccucaugaaaguaguucugggucagaaugauc

SEQ ID NO: 484424 - RNA, 64 nt, Human
uaucuccuagggcuaugguguggacugaaugggaucaugaaaguagacaguuuugagaacguaa

SEQ ID NO: 484425 - RNA, 64 nt, Human
cagauauuaucuaaauucuucuagaauuuauuuuucaugaaauauugauguauuuuaaucuaug

SEQ ID NO: 484426 - RNA, 64 nt, Human
aaauauuuauaauguagcuucuuucaaaauauuuucaugaaaaauuacuuuuauuauaccauua

SEQ ID NO: 484427 - RNA, 64 nt, Human
auauauuuuacauuucuaugagccuaaggaagauucaugaaacugaccuaugagagucgugaag

SEQ ID NO: 484428 - RNA, 64 nt, Human
ucagucucuguaauguuucugauugcauguuucuucaugaaaaguauguuguuguuuugauagu

SEQ ID NO: 484429 - RNA, 64 nt, Human
uuuguuuuugcugcaauugcuuauguuaucuucaucaugaaauuuuagccaagucuuaugucca

SEQ ID NO: 484430 - RNA, 64 nt, Human
gucugggagguuuuuuuuuucuauuuuuauuuuuucaugaaaauuauuggugggccacugaaag

SEQ ID NO: 484431 - RNA, 64 nt, Human
aacuucuaaauuuacaaggccuaucauguccuugucaugaaaagcacuaaaaaaaaaaagaguu

SEQ ID NO: 484432 - RNA, 64 nt, Human
guagcuaaagaaaaauuauuuuacaaaaauuacuucaugaaauauaguuuguaccccaguaguu

SEQ ID NO: 484433 - RNA, 64 nt, Human
gcaucaacacauuagagguacaggagcggcucagucaugaaaaaagaaggucuuuugccccauu

SEQ ID NO: 484434 - RNA, 64 nt, Human
cccucuacccaguauacgaagccuuucagauuacucaugaaacaggguagagggaaagaaggga

SEQ ID NO: 484435 - RNA, 64 nt, Human
caauucccuucugguucaugaugcauaaagcgcuaggcccuagaacuccagaaacagcacagcu

SEQ ID NO: 484436 - RNA, 64 nt, Human
ggcuggccugggggucuugggaaggccccuccccaggcccuaggccaccucgcggaagccuuca

SEQ ID NO: 484437 - RNA, 64 nt, Human
ucuguccccuucacaaugagaaguguuuucuggcaggcccuagguaaagggucgggggaggggg

SEQ ID NO: 484438 - RNA, 64 nt, Human
auggggaggagaagugaggccagggacagucuugccagacgacucugaggagggcaagggacag

SEQ ID NO: 484439 - RNA, 64 nt, Human
aucuaugaauucaucaugaaagacaagcaauccaucaugaaauucguucuaaaagugaaucaau

SEQ ID NO: 484440 - RNA, 64 nt, Human
aauuuaagaaauaggaaagucaucuaugaauucaucaugaaagacaagcaauccaucaugaaau

SEQ ID NO: 484441 - RNA, 64 nt, Human
guucacacugacuccuccuuccugucuaccuuaaucaugaaaccgaauucaugggguuguauuc

SEQ ID NO: 484442 - RNA, 64 nt, Human
uuccugggaguuuagcaaguuuaggagagaauagucaugaaaagaaagggaagaaaggggagaa

SEQ ID NO: 484443 - RNA, 64 nt, Human
aauauauuugugaaguuaaaauuuuaaagauagcucaugaaacuuuugcuuaagcaaaaagaaa

SEQ ID NO: 484444 - RNA, 64 nt, Human
auauauaauuucuccacaaagccuugaccaugguucaugaaaccguuuggguucauuuaaauuu

SEQ ID NO: 484445 - RNA, 64 nt, Human
auccuauuuugggguaucaguguuugacuagggaucaugaaauaauaaacugaaaaaaacuuua

SEQ ID NO: 484446 - RNA, 64 nt, Human
ugaauggcagaaagaggagucauauuucaauacaucaugaaauuccuuauaaaauauaauuuug

SEQ ID NO: 484447 - RNA, 64 nt, Human
uuuauuaggugacuuccuuuuaggcgauggcaggucaugaaauagguacacuaauaauuuucua

SEQ ID NO: 484448 - RNA, 64 nt, Human
acaaacaugauugauagcuggacagacaugcucgucaugaaaaaagaaccauuucugaagcccg

SEQ ID NO: 484449 - RNA, 64 nt, Human
uucccugauuagacuggaagaagaaaccacuauuucaugaaaagcauggaauauuauauuuuau

SEQ ID NO: 484450 - RNA, 64 nt, Human
ucauuuucuuuacuuuucugaaccauaaugaaaaucaugaaagaggcuuucggggggaaaaagc

SEQ ID NO: 484451 - RNA, 64 nt, Human
gccaaggguccucaccccucgccaccuuucacccucaugaaaacacacauacacgcaaauacac

SEQ ID NO: 484452 - RNA, 64 nt, Human
acauaucaguaauuguuuuuauaauuugugguuuucaugaaacauugcuaugcauuuauuagga

SEQ ID NO: 484453 - RNA, 64 nt, Human
uacaauuuaauccaaauguuaugacauucagaaaucaugaaacacaguagauaucuguuauaau

SEQ ID NO: 484454 - RNA, 64 nt, Human
cuaaauguuagauaauaguagucuuguucacauuucaugaaaccuaugaaacuauauuuuugua

SEQ ID NO: 484455 - RNA, 64 nt, Human
uuuuagaaaaacauauuacuuugaauucaaauugucaugaaaaccagaacaguguuuguccaug

SEQ ID NO: 484456 - RNA, 64 nt, Human
cuucucagagagcuaaaaccagaaauuuccagacucaugaaagcaaccccccagccucucccca

SEQ ID NO: 484457 - RNA, 64 nt, Human
uccaaggauccccucgagacuacucuguuaccagucaugaaacauuaaaaccuacaagccuuac

SEQ ID NO: 484458 - RNA, 64 nt, Human
cauaggagaguaaauagcccuucagcaugcucauucaugaaacagaagaggcuguacaagugaa

SEQ ID NO: 484459 - RNA, 64 nt, Human
ucaaaauucucaucaucucuguuauacaccuguaucaugaaagcaaaaagaaguaaacaucagg

SEQ ID NO: 484460 - RNA, 64 nt, Human
aauacaagccacacuccaucauaucccuuaaacuucaugaaaaaccauucaagauccccuugcu

SEQ ID NO: 484461 - RNA, 64 nt, Human
gucaguuacaucaagaaagcagauuuuucuuuagucaugaaaaauaucucaagugguaaguugu

SEQ ID NO: 484462 - RNA, 64 nt, Human
uagccauagcacugguuaguauaucucaguaguuucaugaaacguuuccuguauucuaaucuau

SEQ ID NO: 484463 - RNA, 64 nt, Human
ccaaagaaaaaauagcgaacuuucaccaaaguuuucaugaaaacccaaaagcuuuaaaaguuac

SEQ ID NO: 484464 - RNA, 64 nt, Human
cauauuuaaaaaccauuaaaacacugucucccacucaugaaaugagccacguaguuccuauuua

SEQ ID NO: 484465 - RNA, 64 nt, Human
aucggugaaaccauaaggagcccaguguuccuguucaugaaaucucccuuuuacuggaaaacag

SEQ ID NO: 484466 - RNA, 64 nt, Human
cugagaauccugcagcuugguuuaaugaguguguucaugaaauaaauaauggaggaauugucau

SEQ ID NO: 484467 - RNA, 64 nt, Human
caggggaaaaaaaugggucagaacucagcaucugucaugaaaaaaaucaauugaaaaacaagca

SEQ ID NO: 484468 - RNA, 64 nt, Human
uguagcgugaccucaagguaaagaugaaacuauuucaugaaaaggggaggaguauggcugugca

SEQ ID NO: 484469 - RNA, 64 nt, Human
agucugucaccugcuggauuuggccccaaguucaaggcccuauuugcaccugagcuucacugcu

SEQ ID NO: 484470 - RNA, 64 nt, Human
accuggggcacccagcaccccaccacagggcuagaggcccuaagacccugaaaaaggggcgggc

SEQ ID NO: 484471 - RNA, 64 nt, Human
gcucucuccccaucccgcuucuucccugggggccaggcccuaccugugugguggugggugggcu

SEQ ID NO: 484472 - RNA, 58 nt, Human
cuugagacaguaacuuuuugaauaaaaauaaaccuacaguauguuguauguuuucucu

SEQ ID NO: 484473 - RNA, 64 nt, Human
auacaauguauuuauuuaaaagauucauuuuuaaucaugaaauuacuuaucauccacauuguuu

SEQ ID NO: 484474 - RNA, 64 nt, Human
accucuguauucccccgugcuuuaccuucuggcaucaugaaaagcugccaugauucuguggugu

SEQ ID NO: 484475 - RNA, 63 nt, Human
guuguauacaacacuggcaaagaaaugauuaaaaucaugaaagaaaauucauuucccaauuuu

SEQ ID NO: 484476 - RNA, 64 nt, Human
gaguguuuuuuaaaaaauuguaaagucaagguuuucaugaaaaaugggaagaucagacaacauu

SEQ ID NO: 484477 - RNA, 64 nt, Human
ggaagcggucuagaaguguacggucacggucgccucaugaaaguguguagcagguggcucucag

SEQ ID NO: 484478 - RNA, 64 nt, Human
cugggugaauauuuuuauuggguaauaaauauuuucaugaaagcgccuuuggcuccagauccuu

SEQ ID NO: 484479 - RNA, 61 nt, Human
uagcauacuuugaagaauagacuuaacagaaucaugaaaacuauagcuuuuuaacccggau

SEQ ID NO: 484480 - RNA, 64 nt, Human
ugagcacaggaguuugagaccagccugugcaacaucaugaaacaucaucucuacauaaaaaaau

SEQ ID NO: 484481 - RNA, 63 nt, Human
cagaacuguaugaccccuuuagaaauaaaauuuaucaugaaaugcuaguucuuuuaaguuugu

SEQ ID NO: 484482 - RNA, 64 nt, Human
uaagcauguguauauaauaaauaagcauguuuuaucaugaaaaauuauugugaacaauuuagau

SEQ ID NO: 484483 - RNA, 64 nt, Human
gucagaaaaaaacagaggauaauuaagauacuagucaugaaaagugauucauucuuuuuuguca

SEQ ID NO: 484484 - RNA, 64 nt, Human
guuuuagcgccaccauuaacccacuuugcuugucucaugaaaaaucuuuguuaaaguuuguaca

SEQ ID NO: 484485 - RNA, 64 nt, Human
uauuauacuuuuuaaccaaucucuguggcuucacucaugaaauuuacuucaguuaauaugagac

SEQ ID NO: 484486 - RNA, 64 nt, Human
uuccauaugccacucuguaccccaaagagaguucucaugaaauauucuccagaauguauucauu

SEQ ID NO: 484487 - RNA, 64 nt, Human
ccuuccccaacacuaccuggaaguugugccuuccucaugaaacuggcagaaaccccuucccaag

SEQ ID NO: 484488 - RNA, 58 nt, Human
aaagcacccuggggagauugauuguccuuaaaccuaagccccacaaacuugacaccug

SEQ ID NO: 484489 - RNA, 58 nt, Human
aacuuauaaaaggcugcuaugguaacacuaaaccuaaguggucucuugucuauuaguu

SEQ ID NO: 484490 - RNA, 58 nt, Human
uaaagcucuguauauguuagauuccagcuaaaccuaacuuggcugucauuuuucuucc

SEQ ID NO: 484491 - RNA, 64 nt, Human
auccugaagcugcuguacauauuuuugaaggaacucaugaaaauccugaguuaauuuggaauga

SEQ ID NO: 484492 - RNA, 64 nt, Human
cugcccauucacaucccauuccugccuuuugcaaucaugaaaccugggaauccaaauaguugga

SEQ ID NO: 484493 - RNA, 64 nt, Human
guccaaagcaucacugcuuugguauaguauaaguucaugaaauucugguggguagaaagaaauu

SEQ ID NO: 484494 - RNA, 64 nt, Human
uuauuuuaaaauauuuauuuauauaacuugguaaucaugaaagcaucugagcuaacuuauauuu

SEQ ID NO: 484495 - RNA, 64 nt, Human
uaacaaaucaaauugcacuuuuggaagcccggugucaugaaaugaaaccaaaccucggugccau

SEQ ID NO: 484496 - RNA, 64 nt, Human
ugaguuguauaaaauacauacucccuaaacuagaucaugaaacugguuucuguuuuaugcaguu

SEQ ID NO: 484497 - RNA, 64 nt, Human
augggaaaauugugguaaagacuguuuguacccuucaugaaauaauucugaaguugccaucagu

SEQ ID NO: 484498 - RNA, 64 nt, Human
gcaaguuaggcuuaauuuuuuuaucuaaugaucaucaugaaaugaauaagagggcuuaagaauu

SEQ ID NO: 484499 - RNA, 64 nt, Human
acacuugaaaccuuuuuuuaucguuuuuguauuuucaugaaaauaccauuuaguaagaauacca

SEQ ID NO: 484500 - RNA, 64 nt, Human
uaacagaaagacucuuuuagggcauuuuucugacucaugaaaagagcacagaaaaggauguuug

SEQ ID NO: 484501 - RNA, 64 nt, Human
uggugagcucugauacagugagaagagauuauacucaugaaagagaauguuaguguuacagaga

SEQ ID NO: 484502 - RNA, 64 nt, Human
auauuucuuuugcuagcuauccaucauguaacccucaugaaaauuaucuuuauacguggacuau

SEQ ID NO: 484503 - RNA, 64 nt, Human
gaaaucaggguuugggcuguauugauauugucgaucaugaaauguccacacuuauucuaagugg

SEQ ID NO: 484504 - RNA, 64 nt, Human
auuucuaaaauugauguuuguaacaauuuggguuucaugaaacaaaaaggaacauuacuauacu

SEQ ID NO: 484505 - RNA, 64 nt, Human
aaaaaaaaaaguagauagugcuaaauauuuuagcucaugaaacuugguuaggauggcugggggu

SEQ ID NO: 484506 - RNA, 64 nt, Human
agagaaaaaugggggucguggcuugagaaauuccaggcccuaccgauccucugcccccuuugcg

SEQ ID NO: 484507 - RNA, 64 nt, Human
gcagccugcccgaggcuaacuggcuagagccuccaggcccuaugaugcucccugcccaggccau

SEQ ID NO: 484508 - RNA, 64 nt, Human
ggguggcggcugucuuggaaccucugugagcaggaggcccuaagccgcagcaguggauagaggu

SEQ ID NO: 484509 - RNA, 64 nt, Human
ugcuaauuauauaauauuuuuaauauauacuaugaggcccuaucuuuugcauccuacauuaauu

SEQ ID NO: 484510 - RNA, 64 nt, Human
acagaacuacuuuugagaugguaagauuagaauaucaugaaaguuuaaacugaauccuugcagc

SEQ ID NO: 484511 - RNA, 64 nt, Human
ccguuguauccaugucacccuuaguugugggcauucaugaaagcaaugcgcuugcuucagcaca

SEQ ID NO: 484512 - RNA, 64 nt, Human
caugagaggagagaaauacacgucugauaagacuucaugaaauaauaauuauagcaaagaacag

SEQ ID NO: 484513 - RNA, 64 nt, Human
uccauuugcagacagaccgucauauucuaauagcucaugaaauuugggcagcagggaggaaagu

SEQ ID NO: 484514 - RNA, 64 nt, Human
cauuaggagucgcuuuuaggguauucagcuuuguucaugaaauaaggcaucucugagaaagugg

SEQ ID NO: 484515 - RNA, 64 nt, Human
accacaaggacaaaguauggauguggcagaguccucaugaaagauguauccaaacaagauaacu

SEQ ID NO: 484516 - RNA, 64 nt, Human
uacauguuaucauuugcuguucuuacauaagcacucaugaaaauaugguauucuguaacuugaa

SEQ ID NO: 484517 - RNA, 64 nt, Human
agacuugguaugguuggaguguaggaaugaauauucaugaaauguuucuuauugcuuuuccuuc

SEQ ID NO: 484518 - RNA, 64 nt, Human
ugggcaaagucauaaauucuccacuugaaugcgcucaugaaaaauaaggccaaaacaagaguuc

SEQ ID NO: 484519 - RNA, 64 nt, Human
cucaaccuuugugcugacaucauaccauuucugaucaugaaauauuggcuacugguguauguag

SEQ ID NO: 484520 - RNA, 64 nt, Human
auauaguucacauaaaugacuuggaguuuuauguucaugaaaaaauuagggauuauguuaagag

SEQ ID NO: 484521 - RNA, 64 nt, Human
uucaaugaacauaauuguuaggaccacugaggaaucaugaaaaaugaucucugcuuaguacauu

SEQ ID NO: 484522 - RNA, 64 nt, Human
guaacauuaacugcaaugauguucuuccuggaauucaugaaaauauaauuaaaacacauuuuua

SEQ ID NO: 484523 - RNA, 64 nt, Human
gaggucagugugcuggcuuacacugaacugaaacucaugaaaaacccagacuggagacuggagg

SEQ ID NO: 484524 - RNA, 64 nt, Human
aacaaacuggcucuugauuuucagcacccuacucucaugaaaaaagccugaaaggacccuuucc

SEQ ID NO: 484525 - RNA, 64 nt, Human
agcgcuggacaacuagaauguugaccucgagccgaggcccuacuugcagcgcaccggaggagag

SEQ ID NO: 484526 - RNA, 64 nt, Human
aaauaaagugaugggcuuugcaaauccaggguagaggcccuaacaggcacagagagcaggggca

SEQ ID NO: 484527 - RNA, 64 nt, Human
uccucagcagugagcagugagcuacuccuggcccaggcccuaggggaaauggaucagucuuuga

SEQ ID NO: 484528 - RNA, 64 nt, Human
uuuuaauuuuuuucuuccagcaaaauaaacacugaggcccuaaaaauagauaaaguauaaagua

SEQ ID NO: 484529 - RNA, 64 nt, Human
gauucaucuaauggguacaggauuucuuuaugguucaugaaaauggucuaaacuuauuguggua

SEQ ID NO: 484530 - RNA, 64 nt, Human
ugacugaccaccagucagaggcacuuuauuuguaucaugaaaugauuugaaaucauuguaaagc

SEQ ID NO: 484531 - RNA, 64 nt, Human
ugccucuccuccaccucucccuucucaaaauacuucaugaaaggcaguguauucugaaaaagcc

SEQ ID NO: 484532 - RNA, 64 nt, Human
acuguccauuucucccugucugucccaugggcacucaugaaaaaacagaaugcucccaacuuua

SEQ ID NO: 484533 - RNA, 64 nt, Human
uauagaauuuccuguaauauauuuauauacuuuuucaugaaaauggaguuaucaguuaucuguu

SEQ ID NO: 484534 - RNA, 64 nt, Human
uuucuuugaucuggacagaacauuuauaucaguuucaugaaaugauuggaauauuacaauaccg

SEQ ID NO: 484535 - RNA, 64 nt, Human
cauuauugaaaguauauugcaaauacauguuuccucaugaaaucuaaguaauuuuguuguggaa

SEQ ID NO: 484536 - RNA, 64 nt, Human
ggcuaaacccacuggccuaagaucucaccaaaguucaugaaaaccaggacuaggacccacggcu

SEQ ID NO: 484537 - RNA, 64 nt, Human
uccgguggagaucccacccgaacgucuuaucuaaucaugaaacucccuaguuccuucauguaac

SEQ ID NO: 484538 - RNA, 64 nt, Human
uuuuauauuauuuuagcuuuaauugugcugucguucaugaaacagagcugcucugcuuuucugu

SEQ ID NO: 484539 - RNA, 64 nt, Human
aucauuccuguccauuccacuuguaaaugggaauucaugaaauuaaauauuacuuuaaaaagga

SEQ ID NO: 484540 - RNA, 64 nt, Human
aaaaaaauuacugugaauuguuuuuguacaguuaucaugaaaagcuuuuuuuuuuuuuuuuuug

SEQ ID NO: 484541 - RNA, 64 nt, Human
cacagauuucaugaacuuaggauguguuuuuuauucaugaaaaacuuagaauagugaacuauua

SEQ ID NO: 484542 - RNA, 59 nt, Human
uaauuccauuuuuguuuuaagugcguuuuucaugaaauuaucuucaacuugaagcuuuc

SEQ ID NO: 484543 - RNA, 64 nt, Human
ucauggucucuuccagcccagacauccugugaugucaugaaagcaccugcccucuguuuccccu

SEQ ID NO: 484544 - RNA, 64 nt, Human
aggugccuggagcccccggaacccuguuucuggaaggcccuagcucagguggcuucagggccuc

SEQ ID NO: 484545 - RNA, 64 nt, Human
cacccuggaguagccuucccccuuggccgugggcaggcccuaacucacugucgcuuuggaguug

SEQ ID NO: 484546 - RNA, 64 nt, Human
auacagacacacacguacgcacacugcauguccaaggcccuaaacauugcccguugacauaaac

SEQ ID NO: 484547 - RNA, 64 nt, Human
ggucggggauucucagucgaguuuccagagcaggaggcccuacagacauuuggccccaaauccc

SEQ ID NO: 484548 - RNA, 64 nt, Human
uuaaaguaguuuuguguggcaucacagugauuugucaugaaaagccauauaugggggacaugcu

SEQ ID NO: 484549 - RNA, 64 nt, Human
guaugugagagccugcugagaugaagaaaucacuucaugaaaauaagcaaagaccacacauuuu

SEQ ID NO: 484550 - RNA, 64 nt, Human
ucuuguuauugaguaagaaaauaaagcauggacaucaugaaaauaacagauguuacccaaacuc

SEQ ID NO: 484551 - RNA, 64 nt, Human
guuaaguguucuauauuuaguacuaaaaucacagucaugaaaucauagucauaaaauggucuuc

SEQ ID NO: 484552 - RNA, 64 nt, Human
aacgaaaucuuucauuucagucaaaucacugcagucaugaaauacugaacaauugccuuaaguc

SEQ ID NO: 484553 - RNA, 64 nt, Human
agcuuuuaaaaacuagagcacagaaggaauaaggucaugaaauuuaaaagguuaaauauuguca

SEQ ID NO: 484554 - RNA, 64 nt, Human
uuuuagugaucucauauuuucucuuuagugcuuaucaugaaaugugcuucacugguucagcucu

SEQ ID NO: 484555 - RNA, 64 nt, Human
accuaggauuguacaguuuaccauaaaauuuacuucaugaaagugggaaucacugaacauguag

SEQ ID NO: 484556 - RNA, 64 nt, Human
guuuaagagagauuuuggucuuaaaggcuucacaucaugaaaguguacaugcauaugcaagugu

SEQ ID NO: 484557 - RNA, 64 nt, Human
cagaugaggcuggccaagccggggagcugcucucucaugaaacaagagcuagaaacucaggaug

SEQ ID NO: 484558 - RNA, 64 nt, Human
ugucuaggauuuuggauguugagagguucuaaaaucaugaaacuuguuucacugaaaauuggac

SEQ ID NO: 484559 - RNA, 64 nt, Human
uuugacagauacuuuuaauuugugguugucuccaucaugaaauagaaacguguuuggcacuugu

SEQ ID NO: 484560 - RNA, 64 nt, Human
ugaaaaauagguuuguagugaaauaguuacuauuucaugaaaguagauauuuuuagaauuuuug

SEQ ID NO: 484561 - RNA, 64 nt, Human
ugaaauguucauuuauacugguugcauuuuaagaucaugaaacaauuccaguuacauuguaaaa

SEQ ID NO: 484562 - RNA, 64 nt, Human
aucuguaguuaacauuccucaauucaaguuagaaucaugaaacaauaaugaagcuccuccuaug

SEQ ID NO: 484563 - RNA, 52 nt, Human
ucagcagggacaggggcugaacaggcccuauuccagcccccuugcuucacuc

SEQ ID NO: 484564 - RNA, 64 nt, Human
cccccaguguccauccuaagacaggcaucaaaagaggcccuaacuuuacuucccaaauggugcu

SEQ ID NO: 484565 - RNA, 64 nt, Human
ccacuguucucccccuuugggacauguuaggacgaggcccuauuccaugccccucuuuaauggu

SEQ ID NO: 484566 - RNA, 64 nt, Human
cuccccagccccacucccuguucccuacccauauaggcccuaaauuugggaaaaaucacuauua

SEQ ID NO: 484567 - RNA, 64 nt, Human
uucucuguccuaauuuaaaaguacauugcaaacaucaugaaacuugaucccugaaagcuucagc

SEQ ID NO: 484568 - RNA, 64 nt, Human
uucauagaaaaaauguaaaaggucuuuuuaaaaaucaugaaaaauaguugaauauacauuuugu

SEQ ID NO: 484569 - RNA, 64 nt, Human
auaaucuuagcugccaaguaaauagcaacaugcuucaugaaaauccuaccaaccucugaagucu

SEQ ID NO: 484570 - RNA, 64 nt, Human
aaaaucacucaaaaccuguuuauaaccaaagaauucaugaaaaagaaagccuuugccauuuguc

SEQ ID NO: 484571 - RNA, 64 nt, Human
gucaacugcuuuaaaaauuaagaugaagauacagucaugaaauuaucugaaaaugggucaucac

SEQ ID NO: 484572 - RNA, 64 nt, Human
uuuuuauuugaggacacuugucugguguacuuuuucaugaaaaggaaaaaugguuaacauguuu

SEQ ID NO: 484573 - RNA, 64 nt, Human
ucuugauauuguaauugauuauugauaacugucaucaugaaauuaucucucaauaauaagauaa

SEQ ID NO: 484574 - RNA, 64 nt, Human
ugacaaugagcgugugauccauuaccaagucuccucaugaaaaccacagugagucagcccuuca

SEQ ID NO: 484575 - RNA, 64 nt, Human
aucuguaggaaacugaaugguuuuuuuuuuuuuuucaugaaaaagugcucaaauuaugguaggc

SEQ ID NO: 484576 - RNA, 64 nt, Human
ucagcuuuauuaauguugggcaaaaauugauaugucaugaaaaugaaacagaucuauaguuuug

SEQ ID NO: 484577 - RNA, 64 nt, Human
aacuucauaagguaauucauggcauugaacugguucaugaaaagaacacuagagucugucauuu

SEQ ID NO: 484578 - RNA, 64 nt, Human
aguuagacauaaugcauauaacgugauauuugguucaugaaagaguuguuuucaugugguuauu

SEQ ID NO: 484579 - RNA, 64 nt, Human
cacuuguguuucuacacagcaaaccauuuuucuuucaugaaaauaauauauuauuaacaugaau

SEQ ID NO: 484580 - RNA, 64 nt, Human
augugaaaauuuucucucugauuuuuacuuucauucaugaaaaaugaaaauucagaaauucuuu

SEQ ID NO: 484581 - RNA, 64 nt, Human
aggauuuccccuagcaagcuaccuucuguucaaaucaugaaaaaagacuauuuccccuuagaau

SEQ ID NO: 484582 - RNA, 64 nt, Human
uuugcaggcccagcagacuugagucugaggccccaggcccuaggauuccucccccagagccacu

SEQ ID NO: 484583 - RNA, 64 nt, Human
ggaaggcguggugggauuugcuccuggguucccuaggcccuagugagggcagaagagaaaccau

SEQ ID NO: 484584 - RNA, 64 nt, Human
cccauuguuaacucagccucaaaucucaacugucaggcccuacaaagaaaauggagagccucuu

SEQ ID NO: 484585 - RNA, 64 nt, Human
ucuccuggaacccagucuagcaaaaugagaggaaaggcccuagggagauuuauuucuguuaaau

SEQ ID NO: 484586 - RNA, 64 nt, Human
ucacaggcugagaacucguucaccuccaagcauuucaugaaaaagcugcuucuuauuaaucaua

SEQ ID NO: 484587 - RNA, 64 nt, Human
uugguggauuuuuguuucuugccugaccucaguuucaugaaagaaaguggaagcuacagaauua

SEQ ID NO: 484588 - RNA, 64 nt, Human
acgaauacuuuguucagggcucacucucucuuugucaugaaagccagcuccuuguggcgaggua

SEQ ID NO: 484589 - RNA, 64 nt, Human
aggcccaggcgcaggcaaagagaagauggugcugucaugaaauaaaauuacaacauagcuaccu

SEQ ID NO: 484590 - RNA, 64 nt, Human
uuauaaaagcaaggacuugggagugacugaugaaucaugaaauugcugcuuuuauagaucaaaa

SEQ ID NO: 484591 - RNA, 64 nt, Human
aaauaauucugugugaauuuucuuguagcgugcuucaugaaaauaucuacuuauccagguuugc

SEQ ID NO: 484592 - RNA, 64 nt, Human
acaauugauacuucaggugcuuuugaugugaaaaucaugaaaagaggaacagguggauguauag

SEQ ID NO: 484593 - RNA, 64 nt, Human
uaguaaacuuuuagacaaaauuuguuagggucauucaugaaaacuuuaauacuaaaagcacuuu

SEQ ID NO: 484594 - RNA, 64 nt, Human
gaguuaccuagcuuaccauacuauaucuuuggaaucaugaaaccuuaagacuucagaaugauuu

SEQ ID NO: 484595 - RNA, 64 nt, Human
caaaugagcaccauuuguaauaaugaugucaauuucaugaaaagccugaguguauugcaucucu

SEQ ID NO: 484596 - RNA, 64 nt, Human
auuuuuuuuggcccugggcccaacaguuuguacuucaugaaacauauuguacauuuuacauagu

SEQ ID NO: 484597 - RNA, 64 nt, Human
aguaaagcuuaaauauguuuggaucuaauagagcucaugaaauacuguaacuuggggauuguaa

SEQ ID NO: 484598 - RNA, 64 nt, Human
aagaaauuuuuacaaucuuaucaccugagucauuucaugaaauuuuuguuuagcauuuagaacc

SEQ ID NO: 484599 - RNA, 64 nt, Human
uguuacuuugugaaugagccauuucacauggacuucaugaaauuugccuccugaguucagguuu

SEQ ID NO: 484600 - RNA, 64 nt, Human
cccacaaugcuuugagcuucuuuuauagaagggaucaugaaaaggucuggucagcuacaguuua

SEQ ID NO: 484601 - RNA, 64 nt, Human
aagaaggccaagggaauucagauucugaccagccaggcccuaagaaaaaauuuaaagcucccca

SEQ ID NO: 484602 - RNA, 64 nt, Human
uucugccaaaugccauuaaugcugcuuuauccuuaggcccuagagauacugaaaguccuggggc

SEQ ID NO: 484603 - RNA, 64 nt, Human
cauuccuccaucuuagauagaugguacucuccaaaggcccuaccagagggaacacggccuacug

SEQ ID NO: 484604 - RNA, 64 nt, Human
ccugccaaccucuguugccaccaccuuuccuuccaggcccuaagcacgugcagcaaagcacacc

SEQ ID NO: 484605 - RNA, 64 nt, Human
gaguucaggacucgguggacccuuugggaaugggucaugaaagcugccauggggugaggaaaga

SEQ ID NO: 484606 - RNA, 64 nt, Human
acugcuuacuuucucuauaaaacucaucaauaaaucaugaaaggcacugaguuuuguaaaucag

SEQ ID NO: 484607 - RNA, 64 nt, Human
aauuguacuuguauuagauuuuuaaggccuauaaucaugaaauaucacuaguugccagaauaau

SEQ ID NO: 484608 - RNA, 64 nt, Human
acugaaucuguagauaacgagggagaaugaauugucaugaaaaauugggguugauuuuauguau

SEQ ID NO: 484609 - RNA, 64 nt, Human
gcacugaaaaguaaagggucuguuugugucauguucaugaaaaugcgguuagagaggugcuauu

SEQ ID NO: 484610 - RNA, 64 nt, Human
guauuuccuaaggugaccaugguugaacuuuagcucaugaaaguggaaacauugguuuaauuuu

SEQ ID NO: 484611 - RNA, 64 nt, Human
agugucaaaaauaguaucugaagauacugaaucaucaugaaaugaacucuacuucuggccaaag

SEQ ID NO: 484612 - RNA, 64 nt, Human
ugacuuaauaaaacaaaauucauuuaugguuguuucaugaaaguuauuagauaggaucaaguuu

SEQ ID NO: 484613 - RNA, 64 nt, Human
gucugauuuuccuggacaguuuucugcuuuaauuucaugaaaagauuaugaucucagaaauugu

SEQ ID NO: 484614 - RNA, 64 nt, Human
aauuuaugaauuuguucauugucacugccuuuauucaugaaacugucaaauagagugucuuuca

SEQ ID NO: 484615 - RNA, 64 nt, Human
gaggaagaauugucauaggagggaagcuucaaagucaugaaaccaaucaacagccaagucagca

SEQ ID NO: 484616 - RNA, 64 nt, Human
aaaacuccaguaaaagcuggggccguagcaaaaaucaugaaaaacacuucaacguguccuuuca

SEQ ID NO: 484617 - RNA, 64 nt, Human
acaguucaucauaacccaaccccccacccccgggucaugaaaaucacagaacuuauaaacacau

SEQ ID NO: 484618 - RNA, 64 nt, Human
gacuuuuacagguaagugcaaaggagaagugguuucaugaaauguucuaauguauaauaacauu

SEQ ID NO: 484619 - RNA, 64 nt, Human
auuugauuaucuuaaaaauuguuaaauaccguuuucaugaaauuucucaguauuguaacagcaa

SEQ ID NO: 484620 - RNA, 64 nt, Human
ugucugcugaggaguuauggugaacccacaacuuaggcccuagcggcagaaaggaaaaccugaa

SEQ ID NO: 484621 - RNA, 64 nt, Human
uuucuuguaaugcagcuuccacuccucucauuggaggcccuauuugggaacacugcaagcccuu

SEQ ID NO: 484622 - RNA, 64 nt, Human
uaaauuugugucuauuggggugggaaggggagugaggcccuaaagauaggaauucacugauagc

SEQ ID NO: 484623 - RNA, 64 nt, Human
gaaauguucguuuuuaggcaauauaggaugucuuaggcccuaauucaccauuucuuuuuuaaga

SEQ ID NO: 484624 - RNA, 64 nt, Human
uaaacagauuuggggguuuaauauguccaacuccucaugaaauauauucaauccacuuaaauau

SEQ ID NO: 484625 - RNA, 64 nt, Human
aaacuauuuuguacugauguagcccugagguaguucaugaaaaugcugugcacucauuccaugg

SEQ ID NO: 484626 - RNA, 64 nt, Human
uguaaaaugucaccagacauuuguauuauuuuuaucaugaaaucauguuuuucucugauuguuc

SEQ ID NO: 484627 - RNA, 64 nt, Human
uauguuaauaacuuguccuaugucaauuuguauaucaugaaacacuucucaucauauuguaugu

SEQ ID NO: 484628 - RNA, 64 nt, Human
uuuugaaacucaguaugcugccccugucuugcugucaugaaaucagcaagagaggaugacacau

SEQ ID NO: 484629 - RNA, 64 nt, Human
uagguacuucucgucuugugagcuaaggcuugugucaugaaagacaagaggccucucuuaacag

SEQ ID NO: 484630 - RNA, 64 nt, Human
uuaaauguguuaguuuagauucuuuaugugccuuucaugaaagauauguuuucauuaauuuuac

SEQ ID NO: 484631 - RNA, 64 nt, Human
uugagacaugaaauacauacugauaauacauaccucaugaaagauuuuauucuuuauuguguua

SEQ ID NO: 484632 - RNA, 64 nt, Human
aaugaugguuagcagaagcuguuguauacaaucuucaugaaaauuucaguguguauuuuucuuu

SEQ ID NO: 484633 - RNA, 64 nt, Human
ugcuucuuuucucuucugcccuccuugugggcagucaugaaaaucaauucagacuguguugauu

SEQ ID NO: 484634 - RNA, 64 nt, Human
ucucuugacuaccauuaaaacgaauauugggaggucaugaaagucauugguaggccauuagcau

SEQ ID NO: 484635 - RNA, 64 nt, Human
aaaaugcucucauaagaauuauugcauaccaucuucaugaaaaacaccuguauuuaaauauaga

SEQ ID NO: 484636 - RNA, 64 nt, Human
cauuggaaacucauuggaugagaucagaaaacguucaugaaaaaucauauucaggaaauaagga

SEQ ID NO: 484637 - RNA, 64 nt, Human
uccaguguuuagacaugaaaucaucuuccuugucucaugaaaaccuaaauauaaaaaaaaggaa

SEQ ID NO: 484638 - RNA, 64 nt, Human
ggaauaucuccgucaacucauauuuucaugcuguucaugaaagauucaaugccccugaauuuaa

SEQ ID NO: 484639 - RNA, 54 nt, Human
gacgugugcacaaaaugugaccugaggcccuagucuagcaagaggacauagcac

SEQ ID NO: 484640 - RNA, 64 nt, Human
aauaacuaauaggaaaagucagcuuaauuauuuaaggcccuaguuucuacauauaauauauucg

SEQ ID NO: 484641 - RNA, 64 nt, Human
gggaaaacauggaaucaggauucuauagacugauaggcccuauccacaagggccaugacuggga

SEQ ID NO: 484642 - RNA, 64 nt, Human
uugacauccccuauccccacccccuaaauucccaaggcccuaaggucccucaccugguugcucu

SEQ ID NO: 484643 - RNA, 64 nt, Human
cuuuuggggggaagaaaagcacauuguaagauucucaugaaacaacauggaauuugcacuguua

SEQ ID NO: 484644 - RNA, 64 nt, Human
agauacaauaaaacaaauaaauaugaaaguagauucaugaaaauguauuccuuuaaaauauugu

SEQ ID NO: 484645 - RNA, 64 nt, Human
acauuaagaaaauuuguaugaaauaauuuagucaucaugaaauauuuaguugucauauaaaaac

SEQ ID NO: 484646 - RNA, 64 nt, Human
uuuucuuaucuucugcaauugcuuaggauguuuuucaugaaaauagcucuuucagggggguugu

SEQ ID NO: 484647 - RNA, 64 nt, Human
uacaggagggcgcagauggcuaacugaguaacauucaugaaaugaggcuuucuguggcggcgua

SEQ ID NO: 484648 - RNA, 64 nt, Human
uuugucugcaaaugcauuuuucaucuauaaaaugucaugaaagaaaauaaagguagugaaauau

SEQ ID NO: 484649 - RNA, 64 nt, Human
cugcuugucugcaaaugcuuuggauuuagaagcgucaugaaagcacgagugacagcuccuaacc

SEQ ID NO: 484650 - RNA, 64 nt, Human
ucagcagggaagccgggugggaccagugugucugucaugaaaccacuaacugcauuccugacug

SEQ ID NO: 484651 - RNA, 64 nt, Human
caagaaggagcucaguuacgggguuuuuaaaccuucaugaaaaccugaagaguucacuuuuguu

SEQ ID NO: 484652 - RNA, 64 nt, Human; identical to SEQ ID NO: 484625

SEQ ID NO: 484653 - RNA, 64 nt, Human
gugagugccauacagaauuguguauucaccagcaucaugaaacaguuguggucuuuugaguuga

SEQ ID NO: 484654 - RNA, 64 nt, Human
gaaaaguagaaaagaguaguacuauuguccaaugucaugaaagugguaaaagugggaaccagug

SEQ ID NO: 484655 - RNA, 64 nt, Human
ucauugucuaaaaguaacuuuuaaaaagcagaguucaugaaaacugcaaugcugggaaaagaag

SEQ ID NO: 484656 - RNA, 64 nt, Human
uuggcuuauuuuuuuucuuaaaggaauguguuguucaugaaaaacugauagaagcaacagaaga

SEQ ID NO: 484657 - RNA, 64 nt, Human
auuacagagaaggcuuuuucucaggucaggcuuuucaugaaaguauuuugagaacaaugaauug

SEQ ID NO: 484658 - RNA, 64 nt, Human
cugagcaucuauucauguggcaggccccuguccuaggcccuagggauccaacuggcugucugcc

SEQ ID NO: 484659 - RNA, 64 nt, Human
cugcugucuccaggccuauagacguuucucuccaaggcccuaucccccaauguugucagcagau

SEQ ID NO: 484660 - RNA, 64 nt, Human
aaagaaaauaauuaugaaugccacugaggcacugaggcccuaccucaugccaaacaaaggguuc

SEQ ID NO: 484661 - RNA, 58 nt, Human
gaaaacuuuuguguauucucagcuuaucuaaaccuaaugaaauuccuuuuauauuuaa

SEQ ID NO: 484662 - RNA, 64 nt, Human
ucuuauguuuauuuuaauugcuguuguaacuuacucaugaaacaguauacagacaccuuguacu

SEQ ID NO: 484663 - RNA, 64 nt, Human
aauagcacauccuccaacguuaaaagacaguggaucaugaaaagugcuguuuuguccuuugaga

SEQ ID NO: 484664 - RNA, 64 nt, Human
acuguguuaauguacuugcaaaucuccugcuggcucaugaaacagcagaauuccagccaaggca

SEQ ID NO: 484665 - RNA, 64 nt, Human
ggcccacugucuguggcccauugucauuguuuccucaugaaacauugcagaguuugaauccuca

SEQ ID NO: 484666 - RNA, 64 nt, Human
caaugguugucucuuaucugucuaaauagcaaaaucaugaaaaucagcuguuuuauuugcauag

SEQ ID NO: 484667 - RNA, 64 nt, Human
uacucauguaguuuggaaaugcaacauuuuccuaucaugaaaucucuuucagagaggagaauac

SEQ ID NO: 484668 - RNA, 64 nt, Human
auaaauuugaccuaaaauauuuucucaaacuaauucaugaaacagcaacuuuuaccaauaccuu

SEQ ID NO: 484669 - RNA, 64 nt, Human
uauacauaaaaucaaccaacauaucugaaaaggaucaugaaaccugagaaaugcuaauggagau

SEQ ID NO: 484670 - RNA, 64 nt, Human
uuuguugggcaauaggcaaaagucuauagcauuuucaugaaaauauacuaaaaauauuuuuaug

SEQ ID NO: 484671 - RNA, 64 nt, Human
ugauacaacauuaaggaauuugaugauuuucauuucaugaaaaugacauuaaaugcaauaauuu

SEQ ID NO: 484672 - RNA, 64 nt, Human
uccagggagguuguggggcagcuagaggacaaaaucaugaaaacagagucccugucuuccagag

SEQ ID NO: 484673 - RNA, 64 nt, Human
aacugaaacuugaguuuuguguaauuuucaugugucaugaaauacuguuuucuccaaccauuua

SEQ ID NO: 484674 - RNA, 64 nt, Human
cagauggagaugaaggaggacgacguuucuuuucucaugaaacacaagagccgaaaacgccggu

SEQ ID NO: 484675 - RNA, 64 nt, Human
uggugaacugucaagugcaauuugcaauaaguuaucaugaaaaguuuuuagauuacacgaucgc

SEQ ID NO: 484676 - RNA, 64 nt, Human
auauuuucucucaucuaacaaacacaauccauugucaugaaauuacccuuaggaugagucuucu

SEQ ID NO: 484677 - RNA, 64 nt, Human
uucaucucccaaauggauaaugaagccucuugggaggcccuaccauaggaucuguugccaugcu

SEQ ID NO: 484678 - RNA, 64 nt, Human
aauuuagauuuuaaaaggcgugggacauacgaccaggcccuauagccacauaaauauaaauuuc

SEQ ID NO: 484679 - RNA, 64 nt, Human
gucaucacauucagcuuauucuuacgugccagugaggcccuaaggucucagugcauagcauacc

SEQ ID NO: 484680 - RNA, 64 nt, Human
ggagcccucaugaaugggaucagugccuuaugaaaggcccuagagagauaccucauccucucca

SEQ ID NO: 484681 - RNA, 64 nt, Human
auaaaauaacuagaauaguuuauuaccuuuucccucaugaaauuuuaaauauaugcaaauauau

SEQ ID NO: 484682 - RNA, 64 nt, Human
uauuuccagaacuuuuuaguauuguuguaaaacuucaugaaacaaaagaccauuuaaauaguga

SEQ ID NO: 484683 - RNA, 64 nt, Human
aaaacccauaaauuguugccuaaauuuauaaugaucaugaaacccuaggcagaggaggagaaau

SEQ ID NO: 484684 - RNA, 64 nt, Human
uaaaaagauguuuggauauauuugaguauuccgaucaugaaaacagaaauugcccugccuacua

SEQ ID NO: 484685 - RNA, 64 nt, Human
aaaagagguauucauaugcucuaguuguaaauguucaugaaaauccacuucucuacuagucgaa

SEQ ID NO: 484686 - RNA, 64 nt, Human
aauuaagaauagcuacacucacaaaaauacccccucaugaaauaacuguucucuuggaugguua

SEQ ID NO: 484687 - RNA, 64 nt, Human
uaagcuuaucaguguguuuuuuuauuuguaucagucaugaaaguccuguuagguaugcagaguu

SEQ ID NO: 484688 - RNA, 64 nt, Human
aauucucaacucugguugagaggguucauaaauuucaugaaaauaucucccuuuggagcugcuc

SEQ ID NO: 484689 - RNA, 64 nt, Human
agugaaacaucucauucaguuggugaucuuccugucaugaaaguugcuugacagcucuaauuac

SEQ ID NO: 484690 - RNA, 64 nt, Human
guuuuuuguucuguuuugaaggaaaccaugugcuucaugaaaccuacaguugacaagagaaugu

SEQ ID NO: 484691 - RNA, 64 nt, Human
cauuccaaaguuauugccuacuaaguaaugacugucaugaaagcagcauugaaauaauuuguuu

SEQ ID NO: 484692 - RNA, 64 nt, Human
cagaaacauaugggcugauaaacccggggugaccucaugaaaugaguugcagcagaaguuuauu

SEQ ID NO: 484693 - RNA, 64 nt, Human
gcuggaaagaaauuuucuagcccaacucccuguuucaugaaagagaaaagaggcucagaaaagu

SEQ ID NO: 484694 - RNA, 64 nt, Human
gacuggacaggagucuaccagcuuguuuugagacucaugaaauugcugugugaccuugggcaag

SEQ ID NO: 484695 - RNA, 64 nt, Human
agauguuuaaauuugcuaguugcauuauacugggucaugaaaaauuaucccuugaaauagauau

SEQ ID NO: 484696 - RNA, 64 nt, Human
acuggcccuccgaggugggucugggacauccuagaggcccuacauuuguccuuggauaggggac

SEQ ID NO: 484697 - RNA, 64 nt, Human
gccuugccuaagggggcauaucugggucccuagaaggcccuagauguggggcuucuagauuacc

SEQ ID NO: 484698 - RNA, 64 nt, Human
agccucuuauuccaggagaagggggcucugccccaggcccuacuacccauuguucccuuccucu

SEQ ID NO: 484699 - RNA, 64 nt, Human
gacugaccagacccucagggagucagggcacgggaggcccuaucucccauccuguggaacccgc

SEQ ID NO: 484700 - RNA, 64 nt, Human
uauucuugaaccuucugaaaauaaguugcagacaucaugaaaauguaaaauacuucaucauauu

SEQ ID NO: 484701 - RNA, 64 nt, Human
uaaagcccucuguggcugccacaaaagacuagaaucaugaaaucuuuguccaagcuaagaaagg

SEQ ID NO: 484702 - RNA, 64 nt, Human
ugugaaacaguguauuguguuuuguaaaaugaugucaugaaaugguggguccuuggaaaccucc

SEQ ID NO: 484703 - RNA, 64 nt, Human
gaaaacaauauugaaauuuugcucuauuuucugaucaugaaacugauuguaaagcuuuuugaca

SEQ ID NO: 484704 - RNA, 64 nt, Human
aaaaaugugaaaugucaucuuguacuuacaccuuucaugaaaagggauuuccugcuuuuguacu

SEQ ID NO: 484705 - RNA, 64 nt, Human
ugcuguuuauuuccugguuuggcacaguaugguuucaugaaauuggagcucuguauaaacugaa

SEQ ID NO: 484706 - RNA, 64 nt, Human
ucauaucgguuucugcuguauuaaugacaauuauucaugaaaauaaaaaaugaaauauuuugua

SEQ ID NO: 484707 - RNA, 64 nt, Human
ugauaguuuuugaaauaaaauuuaacauuuaauaucaugaaauguuauaaguagacauacauuu

SEQ ID NO: 484708 - RNA, 64 nt, Human
uaaaucuauaaaaugaugucuuaaaacagccauaucaugaaaaauucuacuuagcuauauuauu

SEQ ID NO: 484709 - RNA, 64 nt, Human
cccuguucaaauaaacaaaaaauccaagauugauucaugaaauaaagaagacaugaauuguuuu

SEQ ID NO: 484710 - RNA, 64 nt, Human
cucugaagccaacuucuguauaccuucacccauuucaugaaaauaaaaucaaaagggaaaucaa

SEQ ID NO: 484711 - RNA, 64 nt, Human
guguauucucuguaaguguagcucaaauaggucaucaugaaagguuaaaaaagcgagguggcca

SEQ ID NO: 484712 - RNA, 64 nt, Human
guagcuuuuagauugcaaacuggaaauguaaaacucaugaaauuuaagcaauauagguuuagcu

SEQ ID NO: 484713 - RNA, 64 nt, Human
accugaagcugcuggcuguuuccaguugaacaacucaugaaaucugcucugggacauuuugggg

SEQ ID NO: 484714 - RNA, 64 nt, Human
ucaaguuuauauguaaagacauaacugcccuuagucaugaaauuguugugaccucuacuuuuug

SEQ ID NO: 484715 - RNA, 64 nt, Human
cauaucuggcuguccuuggguaacagcucccagcaggcccuaagucuggcuucagcacagaggc

SEQ ID NO: 484716 - RNA, 61 nt, Human
aaguggccaugccugugugaggggcgggcccaggcccuagacccucccccaccauuccaca

SEQ ID NO: 484717 - RNA, 64 nt, Human
ucagugaauaucccuagagcuccuaccauaugucaggcccuaugccucacccugagaacgcagu

SEQ ID NO: 484718 - RNA, 64 nt, Human
agggucugcaaaauagaggccaaauccagggaccaggcccuaauaauagaaguuguaccaaaau

SEQ ID NO: 484719 - RNA, 64 nt, Human
gcaaaauugcacauacuccucuaugcugauuuuaucaugaaaacugucaugugucaugcuaaug

SEQ ID NO: 484720 - RNA, 64 nt, Human
uauccaauuuuauugguuauacaugauaaacuuuucaugaaagaaaugcaaaauuaaaucacag

SEQ ID NO: 484721 - RNA, 64 nt, Human
uugggaacccaauuuuggaaaaccagauucauagucaugaaaauggaaacuuccauauucuguu

SEQ ID NO: 484722 - RNA, 64 nt, Human
uauuugcagcugagagaaaauaaucauucuuauuucaugaaaauuguggggaugaugaaauaag

SEQ ID NO: 484723 - RNA, 64 nt, Human
ugagcccuggaauuccaugccagccuaugcaacaucaugaaaccccacuuaauaaaugaaugaa

SEQ ID NO: 484724 - RNA, 64 nt, Human
ugcuggagcuauccuuagacaaagaaaagucaagucaugaaagaaguccuugaagauauaccaa

SEQ ID NO: 484725 - RNA, 64 nt, Human
auuagcucgggucacuuagaguaaggauaacccuucaugaaaauaagccuuuaguugcucucua

SEQ ID NO: 484726 - RNA, 64 nt, Human
uauggguauuuuuuauuuuguguaauuuuacauuucaugaaaugaugucaguuucaaagagaaa

SEQ ID NO: 484727 - RNA, 64 nt, Human
aaagcaugaagaaaccccauuuuucccaggguaaucaugaaagaaggcucagagaaagagggaa

SEQ ID NO: 484728 - RNA, 64 nt, Human
cuuagaauuguauauaaaacaacauguaacccauucaugaaaaacguuuuuaaguauugcuuuu

SEQ ID NO: 484729 - RNA, 64 nt, Human
gggagggaggguuuaucacugcuuaacuucaucuucaugaaaugaaacuuuguaacuuauugua

SEQ ID NO: 484730 - RNA, 64 nt, Human
ugggagaaacuuugugaaugcaccauuuugaugaucaugaaacgcugaugaaaaaugccuccaa

SEQ ID NO: 484731 - RNA, 64 nt, Human
uccuucccucuuucuaguuggaagccaaauguacucaugaaaacagccacuccuauucugaguc

SEQ ID NO: 484732 - RNA, 64 nt, Human
aaaauacaaucucuguacuuuaaaguuauuuuagucaugaaauuuuauaugcagagagaaaaag

SEQ ID NO: 484733 - RNA, 64 nt, Human
ccugagcagaugaaugacuccaggaagaagguuaucaugaaacugaacucaccauuucuauuaa

SEQ ID NO: 484734 - RNA, 64 nt, Human
ucccauaguguccaggugucacagagacggccugaggcccuaagaucugguugugacuuugcca

SEQ ID NO: 484735 - RNA, 64 nt, Human
acccccaacacgucacccgaguagaagcugggcaaggcccuaccauccuggccgucuguucaca

SEQ ID NO: 484736 - RNA, 64 nt, Human
ggguuagagagucuguuuugauugauguuuucugaggcccuagaggaguuuguaucaauuugug

SEQ ID NO: 484737 - RNA, 64 nt, Human
aggaaaucuaauuucaauacauuuauccuagguuucaugaaaguuuuuaaagauugggauaaau

SEQ ID NO: 484738 - RNA, 64 nt, Human
ccuggaucugaggcacaccagcagcaugacaaacucaugaaauggugggagagagucugcugca

SEQ ID NO: 484739 - RNA, 64 nt, Human
acuauaacuguuggagagagauguuccucuuuaaucaugaaacaccuuaagaagucuauaaugc

SEQ ID NO: 484740 - RNA, 64 nt, Human
guuaucauaaauguaauuacuauugaaagaccuuucaugaaauauaagucuccagagcacacaa

SEQ ID NO: 484741 - RNA, 64 nt, Human
gauccuuuggucuuugcuaccaggcugaagucugucaugaaaccacuuauuuuaaaaagcagag

SEQ ID NO: 484742 - RNA, 64 nt, Human
uucgaagagggcacauucccaaagacauucccagucaugaaauguagaagacuggaaaauuaag

SEQ ID NO: 484743 - RNA, 64 nt, Human
aggcaaaauggcuaccaccuacuuggguccuucuucaugaaagcuauagauccuuuuuuguucu

SEQ ID NO: 484744 - RNA, 64 nt, Human
aaugccaaugauuguaagaaaacaaacaaauuuaucaugaaauucuccuugucauuuuauaaau

SEQ ID NO: 484745 - RNA, 64 nt, Human
uuucuccucucgaaccacuagucagccuggauauucaugaaagcugaaagaaggggugccaaaa

SEQ ID NO: 484746 - RNA, 64 nt, Human
guaggaagucugaaaugggugcuaauucccuucuucaugaaaccagggcccucuuccuucaucu

SEQ ID NO: 484747 - RNA, 64 nt, Human
gacuccccacccauauuuugguaccaguuucuccucaugaaaugcagucccuggauucugugcc

SEQ ID NO: 484748 - RNA, 64 nt, Human
augcaaaguucacuggagucucaacaucuaugacucaugaaaauaaaauuuucaucuucucaac

SEQ ID NO: 484749 - RNA, 64 nt, Human
cccaugucuugaaauaugaaaaggaaucugaaggucaugaaaaguccaguggagaaaaucucaa

SEQ ID NO: 484750 - RNA, 64 nt, Human
caugcccuucagauuagcccaauuaccagaaacaucaugaaagauauuuuaaaaacuaauuauu

SEQ ID NO: 484751 - RNA, 64 nt, Human
auuuucuauagcgaauguaauaugccucuuaucuucaugaaaaauaaauauugcuuuugaacaa

SEQ ID NO: 484752 - RNA, 64 nt, Human
acuucauaugcaaucguuugacaaauaguuauucaggcccuauaaugugucaggcacugacaug

SEQ ID NO: 484753 - RNA, 64 nt, Human
uaacuaucccaaagagccacagugccuacaacccaggcccuaaguugaugaagaaaaagucaag

SEQ ID NO: 484754 - RNA, 64 nt, Human
cauuuaguuauaaaaauauauagcgacauccucgaggcccuagcauuucuccuuggauagggga

SEQ ID NO: 484755 - RNA, 64 nt, Human
uuauuccaaagagcagccaacaguggccucccccaggcccuacccugcaaugggauucgcuuuc

SEQ ID NO: 484756 - RNA, 64 nt, Human
cuauaacaacauuuauauuucuaaaacaaacuuuucaugaaacaagauauaccuacauauguca

SEQ ID NO: 484757 - RNA, 64 nt, Human
uuguguuuuaaccaaauuuuaaagauuaauggaaucaugaaagggaaaaaaauugauacaacua

SEQ ID NO: 484758 - RNA, 64 nt, Human
gacccauuagcaagugacauugucacaucagaacucaugaaacugauguaaggcaauuaauuug

SEQ ID NO: 484759 - RNA, 64 nt, Human
cugacucccuuugggccucaguuuccccuccccuucaugaaaugaaaagaauacuacuuuuucu

SEQ ID NO: 484760 - RNA, 64 nt, Human
auuuuuucccugacgucuuuaaaauugaacccuaucaugaaaugauaauuucuuccugaauuua

SEQ ID NO: 484761 - RNA, 64 nt, Human
gguagggagaugacaguggugcaugaugggagaaucaugaaagucugggaagcauauggaccag

SEQ ID NO: 484762 - RNA, 64 nt, Human
uugaggaagauuggguaaugcugauguguuccauucaugaaacuguauuugauacauaauccua

SEQ ID NO: 484763 - RNA, 64 nt, Human
uccauauuuuaaggaaggagcuaaaaauggaaauucaugaaacauaaaugguaucaagaacuuu

SEQ ID NO: 484764 - RNA, 64 nt, Human
ccucuccgcauugccuauugauacacuuuacuaaucaugaaauucuaaccuaaaaggaaaacau

SEQ ID NO: 484765 - RNA, 64 nt, Human
gggcuaauaucugcugugcuucucugacagguagucaugaaaaucaaaugaugcaaaauauaua

SEQ ID NO: 484766 - RNA, 64 nt, Human
cuuuugcacaauaaguucugcaaaacccucucauucaugaaaaggugcuccuugcuagacagaa

SEQ ID NO: 484767 - RNA, 64 nt, Human
uguguauuugacaaauuauacuugcaauuuugggucaugaaaguuugcaauauaguaaaugcac

SEQ ID NO: 484768 - RNA, 64 nt, Human
ugucacaaagggacuuuggaaaacuacuuuuuggucaugaaauuguucaucgcugcuggagaau

SEQ ID NO: 484769 - RNA, 64 nt, Human
cuccccuguauaaugaguaagaagcuucuucaagucaugaaacuuauuccugcucagaauaccg

SEQ ID NO: 484770 - RNA, 64 nt, Human
auccugaacuuagagcucuucaauccuaagauuuucaugaaaagccucucacuugaacccaaac

SEQ ID NO: 484771 - RNA, 64 nt, Human
gcucacaggcugugggguugaucuggcucugcagaggcccuaggcagcuuguugacugcugucu

SEQ ID NO: 484772 - RNA, 64 nt, Human
ucaaccuugugguugggaguggggcugguuuuguaggcccuagggccugcuucuauguauuuau

SEQ ID NO: 484773 - RNA, 64 nt, Human
cacagcacucugaaaugcuccagucacaccuuauaggcccuaggccuggccaggcauugucccc

SEQ ID NO: 484774 - RNA, 64 nt, Human
caauuguacauucccugcauccaaucugcucagcaggcccuaagaugccuugagucuuuaaucc

SEQ ID NO: 484775 - RNA, 64 nt, Human
aaauuguauuugcaauaaacaacaucaaauuuuuucaugaaaucuugguacaaauucagaucuc

SEQ ID NO: 484776 - RNA, 64 nt, Human
ccuggcauauuuauuuugcagucuuguugaaaguucaugaaacuuuguacuuuuuaauaagaug

SEQ ID NO: 484777 - RNA, 64 nt, Human
cagacucacgcuuuuuuaaacaauaaaugucauuucaugaaaucuuuggugauaaaguauuuug

SEQ ID NO: 484778 - RNA, 64 nt, Human
uuugaaauggucguguaaauuuuugccuuauauaucaugaaaauagucauaacuuaauuucuuu

SEQ ID NO: 484779 - RNA, 64 nt, Human
uggaguuaggagggccugugguagacagcgugaaucaugaaaauaagccuggagaguucuguua

SEQ ID NO: 484780 - RNA, 64 nt, Human
guggauguuaccaguuaggggaagacuuuuauuuucaugaaaagacaauaaaacaaaauggaau

SEQ ID NO: 484781 - RNA, 64 nt, Human
ucgaugcacaccuuuauagcuugaccauaugcugucaugaaaguagcaccccgacggugcuugc

SEQ ID NO: 484782 - RNA, 64 nt, Human
gacuuauguacauacaacaauugaaaguguuugcucaugaaaucaguuauaaauauggugaauu

SEQ ID NO: 484783 - RNA, 64 nt, Human
auuuacaucacagcagugcaccucagagucacauucaugaaaagcacugauaaacagaauacuu

SEQ ID NO: 484784 - RNA, 64 nt, Human
uaccguauuaaggaauaauacuguacauaaaacaucaugaaacccuagauaugaaauccccuga

SEQ ID NO: 484785 - RNA, 64 nt, Human
uauauaauauaucaucuuuagagguaugauuuuuucaugaaagauaagcuuuugguaauauuca

SEQ ID NO: 484786 - RNA, 64 nt, Human
uaauauuucaugguuuacuauuuccuuuuaguauucaugaaaaugguauuuucugguugaauaa

SEQ ID NO: 484787 - RNA, 64 nt, Human
auuuaguagauuccuucagugucacaaagcuguuucaugaaagaaucaagauuauaaccuggau

SEQ ID NO: 484788 - RNA, 64 nt, Human
augcaguauuucuuaaaguauugaaauuagaauaucaugaaauaaaucaaaacauacaauggca

SEQ ID NO: 484789 - RNA, 64 nt, Human
uacguggccugacgcaucugcagacgguuccccuucaugaaacacuagaauguacccucagagc

SEQ ID NO: 484790 - RNA, 64 nt, Human
accugauccugccugggcaacccuuuccugucccaggcccuacauucagcagaaacgcacuuug

SEQ ID NO: 484791 - RNA, 64 nt, Human
agaucaacuccuccuacaaauauuauuggaugauaggcccuagaacccaauaaaggagcuccaa

SEQ ID NO: 484792 - RNA, 64 nt, Human
ccuuuacuaagcaucaagaacacauacuagagagaggcccuaugaaagcaggaaauagaggaag

SEQ ID NO: 484793 - RNA, 64 nt, Human
agguacuuaaaauaugcacuagaauaaauuugcaaggcccuaaaauaucacuguuauuuuugga

SEQ ID NO: 484794 - RNA, 64 nt, Human
cagugacagguagaggacucuggcacaggugcacucaugaaacucugcuuccaccauguuccug

SEQ ID NO: 484795 - RNA, 64 nt, Human
uucauuaacuuuuuauuuuaaggacaguaucuuuucaugaaagaguauuuggcugaauguuugc

SEQ ID NO: 484796 - RNA, 64 nt, Human
aacugaauuaccacaugaacacugucaucuuuucucaugaaaguaaaaagaaccaagaacauuu

SEQ ID NO: 484797 - RNA, 64 nt, Human
ucugggauccacgagacaaccagagagggauaucucaugaaauuugcaucugguggcugaacag

SEQ ID NO: 484798 - RNA, 64 nt, Human
gagacucuuacuaacauguuguaaauauuacaauucaugaaauguuauuguaagucuguaacuu

SEQ ID NO: 484799 - RNA, 64 nt, Human
auguauauuuagauuaauuuuuuuagucagaacuucaugaaauccacaccaaaggaaagguaaa

SEQ ID NO: 484800 - RNA, 64 nt, Human
gauacuaauaaaauacauuuagaaacuuuuaaagucaugaaaaagcauuaaccuucuaaacagu

SEQ ID NO: 484801 - RNA, 64 nt, Human
uaggccauguacagcuggcaucuaauaaauguuuucaugaaaaagauuuucuagccaagguccc

SEQ ID NO: 484802 - RNA, 64 nt, Human
agggcuugcagagaguggaaaguuaguggaauauucaugaaacuucauugcagggguaauagaa

SEQ ID NO: 484803 - RNA, 64 nt, Human
uauaaaaauugcugguuucacuauuagagggcauucaugaaagaacaacucuugcaccucucag

SEQ ID NO: 484804 - RNA, 64 nt, Human
ccauaaccagauauggcuuguuauuuguaaguuaucaugaaaagguuuauauucacuauucuuu

SEQ ID NO: 484805 - RNA, 64 nt, Human
aaaucugaaaaguggauuucuuauugaccuauauucaugaaagcauauaaauuaaaauauuuaa

SEQ ID NO: 484806 - RNA, 64 nt, Human
ugggaacagccauguuaacgugagcaaauuccucucaugaaauagccugcagcuauuaagaagc

SEQ ID NO: 484807 - RNA, 64 nt, Human
ccucaccgcgccagcgugaaguucccgggcauggucaugaaagcgugguucuguaagaaaucag

SEQ ID NO: 484808 - RNA, 64 nt, Human
uaauauuuaggcaauaacgucugcaucuucuaaaucaugaaauuaaagucugaggacgagagca

SEQ ID NO: 484809 - RNA, 64 nt, Human
agugucugucauguguugauauccacacagaauuaggcccuaaugagagccuuagacccucaac

SEQ ID NO: 484810 - RNA, 64 nt, Human
acauuauaaaagcuagguugucucuugaauuuugaggcccuagagauagucauuuugcaaguaa

SEQ ID NO: 484811 - RNA, 64 nt, Human
uuaaucaguuugcuuccaaaguggccuacucaagaggcccuaagacugguagaaauuaaaagga

SEQ ID NO: 484812 - RNA, 64 nt, Human
cugagucguacuaugguuuugccuugucacugugaggcccuacuagguguaagcauucucucug

SEQ ID NO: 484813 - RNA, 64 nt, Human
uucuaaaggauauauuugaagaaaaacaaauuguucaugaaaauggaacauuaaaucaugcugu

SEQ ID NO: 484814 - RNA, 64 nt, Human
aggaugacagagguuguauugguagcuauugaauucaugaaaacuuuuaaguuagcauuuguua

SEQ ID NO: 484815 - RNA, 64 nt, Human
gcuuaauaaaguaagcuugaaauuuaucauuuuaucaugaaaacuucuuugccuuaccagacca

SEQ ID NO: 484816 - RNA, 64 nt, Human
uuuuuaaauuugauuuuuuaaauauuauaaguggucaugaaauuuuaauguuaaguuuguaccu

SEQ ID NO: 484817 - RNA, 64 nt, Human
aacauuucacaugcacauuucaaaacaagaugugucaugaaaacagccccuuuaccugccaaga

SEQ ID NO: 484818 - RNA, 64 nt, Human
aucacuauagguuaguuuucuuuguuccagaacaucaugaaagcggcgucauguacuguguauu

SEQ ID NO: 484819 - RNA, 64 nt, Human
uaauguugaauuugccuuuuaggaaaacaauguuucaugaaacacuuguaagauacuuauuuug

SEQ ID NO: 484820 - RNA, 64 nt, Human
agagucacccguggcuccuaaggaaaaaacagcaucaugaaaggcaaaaaguauuugaaacgua

SEQ ID NO: 484821 - RNA, 64 nt, Human
acaaaucuucagcuugucucucaguauuucccaaucaugaaaaucccuugcuaugucuuuccua

SEQ ID NO: 484822 - RNA, 64 nt, Human
gauaacucucuggaaaaugacuugacuaaggcucucaugaaauucaaagugccauuuagaacau

SEQ ID NO: 484823 - RNA, 64 nt, Human
uucaugaagacuuaacuggcccagaagcugauuuucaugaaaaucugccacucagggucuggga

SEQ ID NO: 484824 - RNA, 64 nt, Human
auuuuccuuucacuuccugaaagccagggucgguucaugaaaagcuaugaaacagcaugcuaaa

SEQ ID NO: 484825 - RNA, 64 nt, Human
uaaaacacucagcagacauuuaucuuuguauucuucaugaaauguguuuugucuuuuuuuauua

SEQ ID NO: 484826 - RNA, 64 nt, Human
uauauaauaaccuaaaauaccauuguaaccucagucaugaaaaauacaucacucugucuuuuua

SEQ ID NO: 484827 - RNA, 64 nt, Human
acucuugauuuuguacauaguccucuggucuaucucaugaaaccucuucucagaccaguuuucu

SEQ ID NO: 484828 - RNA, 64 nt, Human
uguauagaccauacauaucugacaucagaaaagcaggcccuagagagaaguauauacuagggua

SEQ ID NO: 484829 - RNA, 64 nt, Human
aagggccuugcucaagguccccagcuucagccccaggcccuaagccagcgucagaacagucaau

SEQ ID NO: 484830 - RNA, 64 nt, Human
ccccccgucuccugccgggcaggucccagguuggaggcccuaggcgcgguucaggucagggcua

SEQ ID NO: 484831 - RNA, 64 nt, Human
acuucggauaauauagacaggauuuacaagcaggaggcccuaaaauuacacucaugucaaaaau

SEQ ID NO: 484832 - RNA, 64 nt, Human
aacuguuaguauuguugaaucaauuacuuugguuucaugaaaaaauaaacgauaaauaucuuua

SEQ ID NO: 484833 - RNA, 64 nt, Human
cagguuuaugucuucccgacaucacuuuuaucauucaugaaauugucuuaaaaaagcaagagac

SEQ ID NO: 484834 - RNA, 64 nt, Human
ccccccaaacuucuguuuuauaauauguaauuuuucaugaaaagaaagggcucagaaaaauuag

SEQ ID NO: 484835 - RNA, 64 nt, Human
auguuggaauaaauugaaguuguugauaaauacuucaugaaaacuaaagucugaaauaaauuac

SEQ ID NO: 484836 - RNA, 64 nt, Human
guuaaaucuuuacugauagauguacuuaaguaaaucaugaaaauucuacuuguaacuauagaag

SEQ ID NO: 484837 - RNA, 64 nt, Human
uaaauuuauuuuuaaaaaaggaaaaauaaaaguaucaugaaaaaaccuauuuuuuuuuccacug

SEQ ID NO: 484838 - RNA, 64 nt, Human
uguucagguuugcaugguaugaaaccaaauagauucaugaaaccuuggccaugagguuuguuuc

SEQ ID NO: 484839 - RNA, 64 nt, Human
uaaagggagaaaugacauguuuucuauuuucuuuucaugaaaacacuguuuuucccccuaauaa

SEQ ID NO: 484840 - RNA, 64 nt, Human
acagagagaccauuguaccuggcacaagggcuguucaugaaaagggagacuuacugggaggugc

SEQ ID NO: 484841 - RNA, 64 nt, Human
uuagcuugauuaauuuagauuagaaucauuaacaucaugaaaaauaaaaguacuacauuucuaa

SEQ ID NO: 484842 - RNA, 64 nt, Human
gcuuuuaaauagcaaaagaagaagauucugugacucaugaaaaugauaugagauucgaauucca

SEQ ID NO: 484843 - RNA, 64 nt, Human
aaaacucagcaauaauuugggcagcuaaugaaugucaugaaagcuguagaaucuacaucaccau

SEQ ID NO: 484844 - RNA, 64 nt, Human
uaaugucuguuuccaggguucagaaaaggcaaacucaugaaaugccacugaaaagaacuuucaa

SEQ ID NO: 484845 - RNA, 64 nt, Human
ugcccauccaggagaaguggguaguaauucuucaucaugaaaaugauauauuacauauuuagua

SEQ ID NO: 484846 - RNA, 64 nt, Human
aagauuagaacuaaauuuauuuuuuucauuucugucaugaaaucauuccagauaccucuuuucu

SEQ ID NO: 484847 - RNA, 64 nt, Human
caugggagaguugaguaauugugacauggaccauaggcccuaaagagccaaaauaaauauacuu

SEQ ID NO: 484848 - RNA, 64 nt, Human
uagcuauuaaauaacaucaaguaacaucuguaucaggcccuacauagaacauacaguugagugg

SEQ ID NO: 484849 - RNA, 64 nt, Human
ggcuucagucuggggccaucuggccccacucucuaggcccuacuccaguuaaaucaaacauugg

SEQ ID NO: 484850 - RNA, 64 nt, Human
agggugaagcccacguuuucuuccauggccucaaaggcccuagaacuugccuaccuuucuggcc

SEQ ID NO: 484851 - RNA, 64 nt, Human
ccaacugagaucgaucaguucauccaaucacagaucaugaaacaguaguguucccaccuaggag

SEQ ID NO: 484852 - RNA, 64 nt, Human
aaaaguggguuucaaaaauacauccuuuucugugucaugaaaaccccccgaagccauugacuuc

SEQ ID NO: 484853 - RNA, 64 nt, Human
uuuccaaacguuggggaggggaaaauucacuguaucaugaaacccuaaggguuuguugcacuuc

SEQ ID NO: 484854 - RNA, 64 nt, Human
uaugauuuuuagacuaggcucuaguguucagaauucaugaaauuauccaugguaaaaacuaguu

SEQ ID NO: 484855 - RNA, 64 nt, Human
uauucagacuauucuuaaaaugggacaaucagccucaugaaaaauugauguaaaucagaagaau

SEQ ID NO: 484856 - RNA, 64 nt, Human
ccagucucuaugaauguuauggccuagggaagaaucaugaaacucuuuagcuugauuagauggu

SEQ ID NO: 484857 - RNA, 64 nt, Human
gagaccucauccugcucuuuugugaugaacauauucaugaaauguggaagucaguacgaucaag

SEQ ID NO: 484858 - RNA, 64 nt, Human
ccuggauuccucuaagaucuugccucuuuccuccucaugaaagcagcacacauuguguuaacuu

SEQ ID NO: 484859 - RNA, 64 nt, Human
uuccugaagaagaucccagaggaugucacaaagaucaugaaaguccagguuagugcuuggccug

SEQ ID NO: 484860 - RNA, 64 nt, Human
cuguaagccuuuguggggagggaggccugcaaggucaugaaaggcagaagagucuaauugugcc

SEQ ID NO: 484861 - RNA, 64 nt, Human
gcccggcaagaguccauucucacugcugggacacucaugaaaaucuccacguccucccucuucc

SEQ ID NO: 484862 - RNA, 64 nt, Human
uuguugauuauuugaggcuuuuaaaacaaguaguucaugaaagaagcuguuggacucaacauag

SEQ ID NO: 484863 - RNA, 64 nt, Human
gcagaggcccccauauacucugcuacagcuccuaucaugaaaaauaaaauguuugucuuugcaa

SEQ ID NO: 484864 - RNA, 64 nt, Human
cuguuuuucuuuaaucucccuuuguuggaaaguaucaugaaaggaagaguuaugcuuuaucuug

SEQ ID NO: 484865 - RNA, 64 nt, Human
caagccucauucauucuugggauuggcccuuucuucaugaaaagugucugcaaaaccauggcag

SEQ ID NO: 484866 - RNA, 64 nt, Human
ucauuuuaacauguuuuauaauugauacaucucaaggcccuacccauaaaauuauuugaaaacu

SEQ ID NO: 484867 - RNA, 64 nt, Human
uauucauuaauggccccauggacuuaaagugaucaggcccuaaaacguuguugugaugagguuu

SEQ ID NO: 484868 - RNA, 64 nt, Human
uuggcagaaucuuuguagugugugggaucucugaaggcccuauuuaaguuuuucuucguuacuu

SEQ ID NO: 484869 - RNA, 64 nt, Human
ucacgaucaauuaauguuuucuggugaucacaucaggcccuaucuaagaagcucaugguauaca

SEQ ID NO: 484870 - RNA, 64 nt, Human
ucagagauaccaucuugagaaauccuccuugguaucaugaaacuggagcagaggaauugcaauu

SEQ ID NO: 484871 - RNA, 64 nt, Human
uucaguuguaguuuggaagguuccuugguguggcucaugaaaucacagagcucagagauaccau

SEQ ID NO: 484872 - RNA, 64 nt, Human
aaucaaugcaguuaacaaguauauuggcugugugucaugaaauaguucauguucagauggaaau

SEQ ID NO: 484873 - RNA, 64 nt, Human
uggccuaagugccucuucuuuuucuucuuguuucucaugaaaaguuugauuaaaauucaggaag

SEQ ID NO: 484874 - RNA, 64 nt, Human
uuuaaaaacguuugaaaggagucuuacaccuguaucaugaaaacugaauccuuuugaaauacca

SEQ ID NO: 484875 - RNA, 64 nt, Human
cacccuccugccccguggggcaauuuaaccuuuuucaugaaaguuauuuacaaugaaaaguuuu

SEQ ID NO: 484876 - RNA, 64 nt, Human
aaucgacauaagucauguaauuuuuguugauauaucaugaaaaugaacagaauucuuuuuccau

SEQ ID NO: 484877 - RNA, 64 nt, Human
uauaaaaauaaaagaacuggaaccagauucagaaucaugaaaacaacauuuuuacaacaacaaa

SEQ ID NO: 484878 - RNA, 64 nt, Human
acaugucuguagucagcaccacgauagcaccguuucaugaaaggcauggcggcugcauuucaua

SEQ ID NO: 484879 - RNA, 64 nt, Human
uuucuguaaaucccauuauugauauguuuauuuuucaugaaaauuucaauguaguugggguaga

SEQ ID NO: 484880 - RNA, 64 nt, Human
guauucuuaguaagaugaguuucuagacacgcugucaugaaaugagacccuggauuuugaugcu

SEQ ID NO: 484881 - RNA, 64 nt, Human
uguugcacuuguaguuucauuacaaaagaucagaucaugaaaggcaguaacucuccaggacugg

SEQ ID NO: 484882 - RNA, 64 nt, Human
ccaaaacaggugguagguguguaauuuuuaacugucaugaaauacuguaaugcgcaccuuugcu

SEQ ID NO: 484883 - RNA, 64 nt, Human
cuuucagcugcuccaaggauugagacccaagucaucaugaaaaaggcccaaguacagucuuaau

SEQ ID NO: 484884 - RNA, 64 nt, Human
uuccggugaauacgggacugcacguacucucucaucaugaaaacagagccccguucauaaauuu

SEQ ID NO: 484885 - RNA, 64 nt, Human
gcucacuuugaguuuuuaaaugacauuguuuuugaggcccuaggccugcugucuuuuugaagcc

SEQ ID NO: 484886 - RNA, 64 nt, Human
caauguucccuuggcgagcaauugaaacuuguuuaggcccuaggguugagcaauuuuaagguug

SEQ ID NO: 484887 - RNA, 64 nt, Human
gacaggggcccccacucuucuggaccccuugaagaggcccuaccacacccuaacugcaccuguc

SEQ ID NO: 484888 - RNA, 64 nt, Human
aauguguaacauuuauaguuaaauaggacaaagcaggcccuaugacuauuguuuucaaaaaauu

SEQ ID NO: 484889 - RNA, 64 nt, Human
ggaaagccuuuguuuccuucacuuccuuucgauaucaugaaaggacucacacuggagagaaccc

SEQ ID NO: 484890 - RNA, 64 nt, Human
gcaaagcuuucacuucuuccaguucuuuucaauaucaugaaagaacacacuagggagaaacccu

SEQ ID NO: 484891 - RNA, 64 nt, Human
caaaagccuuuauuucuuccacuucuuuucaauaucaugaaaggacucacaugggagagaaacc

SEQ ID NO: 484892 - RNA, 64 nt, Human
ggaaagccuucauuucuucuaguucccuucaauaucaugaaaggacucacacuggagagaagcc

SEQ ID NO: 484893 - RNA, 64 nt, Human
caaaagcuuucacuucuuccaguucuuuucaauaucaugaaaggacucacacuggggagaaacc

SEQ ID NO: 484894 - RNA, 64 nt, Human
guaaagccuucaaucuuuccaguuccuuucaguaucaugaaaggacucacacuggagagaaacc

SEQ ID NO: 484895 - RNA, 64 nt, Human
ggaaagccuucagaucugccucacaccuucaaauucaugaaaggacacaaacacacauaagaau

SEQ ID NO: 484896 - RNA, 64 nt, Human
ggaaagccuucagaucugccaagaaccuucgaauucaugaaaggacacaaacacacguaagaau

SEQ ID NO: 484897 - RNA, 64 nt, Human
agcauuccaugcucauggguaggaagaaucaauaucaugaaaauggcccauacugcccaaggua

SEQ ID NO: 484898 - RNA, 64 nt, Human
auucagccucgucucuuuacagaaguaguuuuguucaugaaauaaagacucuuggacuugaugc

SEQ ID NO: 484899 - RNA, 64 nt, Human
aauuuccaaaacuuuaaugaacuaacugacagcuucaugaaacuguccaccaagaucaagcaga

SEQ ID NO: 484900 - RNA, 64 nt, Human
guuugugccccucuccccaauuucauuaaagauuucaugaaacauuaccccugagccccauggu

SEQ ID NO: 484901 - RNA, 64 nt, Human
uuucuggaucuccuucccuccuuucucguccaaaucaugaaauguuuggccuuagucaaugucu

SEQ ID NO: 484902 - RNA, 64 nt, Human
gguuuguuggugguuuuuucaaacucuuaugcacucaugaaacacacagacacacacacacaca

SEQ ID NO: 484903 - RNA, 64 nt, Human
gugugagccagcaaucagauggagauucuagugcucaugaaaguuugaagaacacugguaaugu

SEQ ID NO: 484904 - RNA, 64 nt, Human
caguaaauaugcuucaaaccaugaguacacuauuaggcccuacaacuuuguuuuccuuauauuu

SEQ ID NO: 484905 - RNA, 64 nt, Human
ccaggauacuucaugagaacgaaccccuucagagaggcccuacaaaacagauuagagggaagac

SEQ ID NO: 484906 - RNA, 64 nt, Human
agauggcucagcggggcugcaccaaggggccaagaggcccuacccgugucuaaacccuccucuc

SEQ ID NO: 484907 - RNA, 64 nt, Human
gugaaauuuuaucccugugcccuuuccccaccucaggcccuaccccuggacccuccccaaccuu

SEQ ID NO: 484908 - RNA, 64 nt, Human
gcaggguuuuguauuguccagucccuggagaaaaucaugaaaugccugaguucauugggggucc

SEQ ID NO: 484909 - RNA, 64 nt, Human
acuggaggcucugugagcaaacagcaaacuguucucaugaaagcaggauguuggcgaacugaca

SEQ ID NO: 484910 - RNA, 64 nt, Human
ggaaagccuuucauaauuuuuauuccuuucaaaaucaugaaauaucucacacuggagagaugcu

SEQ ID NO: 484911 - RNA, 64 nt, Human
ggaaaggcuuugauuguuccaguacacugcaaagucaugaaagaacucacacuggagagaagaa

SEQ ID NO: 484912 - RNA, 64 nt, Human
ugugaaauguuugucuuuucuguuuuuuaaaugaucaugaaaccaaaaagagacugaucaucca

SEQ ID NO: 484913 - RNA, 64 nt, Human
gagugugucuuugugagaaauauaaaggcuugagucaugaaauacuuaacacaugugcacaugu

SEQ ID NO: 484914 - RNA, 64 nt, Human
ucucaaaaaaaaaguaacuuuuuaaaacuuucuaucaugaaaaaauuugaacauauacaaaaau

SEQ ID NO: 484915 - RNA, 64 nt, Human
uugacucagacuuuacugguaggguuacuucaucucaugaaaugacagaacugucuuguuacaa

SEQ ID NO: 484916 - RNA, 64 nt, Human
aaccgagucaauuuggugaauaggaaaagccuucucaugaaaacuacaauagaauacuguuacc

SEQ ID NO: 484917 - RNA, 64 nt, Human; identical to SEQ ID NO: 484916

SEQ ID NO: 484918 - RNA, 64 nt, Human
gaacuuucaaaauuuuaaugaacaggcugauacuucaugaaauucaagacaaagaaaaaaaccc

SEQ ID NO: 484919 - RNA, 64 nt, Human
aacuuucaaaauuuugaugaacaggcugauaccuucaugaaauucaagacaaagaagaaaagaa

SEQ ID NO: 484920 - RNA, 64 nt, Human
aacuuucaaaauuuuaaugaacaggcugauaccuucaugaaauucaagacaaagaagaaaaaua

SEQ ID NO: 484921 - RNA, 64 nt, Human
aacuuucaaaauuuuaaugaacaggcugauaccuucaugaaauucuagacaaagaagaaaaaaa

SEQ ID NO: 484922 - RNA, 64 nt, Human
cugagacacugagaaaaagaacaggcugauaccuucaugaaauucaagacaaagaagaaaaaaa

SEQ ID NO: 484923 - RNA, 64 nt, Human
ggccacgguccccgcgugcacuuuagggccggucaggcccuaaaguauucacugagcacuuagg

SEQ ID NO: 484924 - RNA, 64 nt, Human
gaggccgagggcccaggcccugugugcggugcccaggcccuaggagcucccccagcccccaggu

SEQ ID NO: 484925 - RNA, 64 nt, Human
uguagaggggaaaagagaugaugaaaauauuuaaaggcccuaucuguuuacaguguuccguggu

SEQ ID NO: 484926 - RNA, 64 nt, Human
aaacauguugcuccgaucaucacaggagagcaaaaggcccuagauacccccuuuggaaugugag

SEQ ID NO: 484927 - RNA, 64 nt, Human
ggcagccacucucuccaaagcauagucauaggugucaugaaaaaauaccaaauguaagagaacc

SEQ ID NO: 484928 - RNA, 64 nt, Human
guucacagcaucuucaccaggaguaaauuccaccucaugaaaccacuuucgaggcuccuucugg

SEQ ID NO: 484929 - RNA, 64 nt, Human
guugucaaaauugucuccuuauaugauacaaaacucaugaaaauuaugacuuuuuuguuugguu

SEQ ID NO: 484930 - RNA, 64 nt, Human
aucugcaauuuggcuucccuaacuuaacauugcaucaugaaacucuuuggaacaacagcuaucu

SEQ ID NO: 484931 - RNA, 64 nt, Human
ggaguuagacuacauaucuuuuggcacuaacaucucaugaaaaauuaugguuaauaaaauauca

SEQ ID NO: 484932 - RNA, 64 nt, Human
uuucaauuguaaccaagaaauuuccauuugugcuucaugaaaaaaaacuucugguuuuuuucau

SEQ ID NO: 484933 - RNA, 64 nt, Human
auaauaaaucaagccagguccuccaagugguaauucaugaaaaauauccccacuaccaccacca

SEQ ID NO: 484934 - RNA, 64 nt, Human
ucuaugguuggucugaguaaguaacuuccugucuucaugaaaaaaguugacuuugaaucccagg

SEQ ID NO: 484935 - RNA, 64 nt, Human
uauaaacaauacagaaggagagauagaugagagaucaugaaaaccaaauuuuaucuuuuacaug

SEQ ID NO: 484936 - RNA, 64 nt, Human
ggaccacaugaguucugguugguaaguguccuugucaugaaaacacuugccuuacaaggcucua

SEQ ID NO: 484937 - RNA, 64 nt, Human
ugaggucaggaguucaagacuagccuggccaacaucaugaaaccccgucucuacuaaaaauaca

SEQ ID NO: 484938 - RNA, 64 nt, Human
acauaugauaaugauaccaaaggaaagauaauuaucaugaaaccaacuuuuggaucauucccuu

SEQ ID NO: 484939 - RNA, 64 nt, Human
uagcaagguuugagaugcuauauuaacauuuaaaucaugaaaaugagcaaguaaauagaauaau

SEQ ID NO: 484940 - RNA, 64 nt, Human
uccaaguuguuagaguuuuuaauaaccauuuaauucaugaaaauaucauuaauccugcauuacu

SEQ ID NO: 484941 - RNA, 64 nt, Human
uaagaauaaauggucacauauccuaaaagcuucuucaugaaauuauuagcagaaaccauguuug

SEQ ID NO: 484942 - RNA, 64 nt, Human
aaucuuccucuuuggaaaugaauggaaaagcaaaaggcccuauuacuuuuaaccacuggcuuca

SEQ ID NO: 484943 - RNA, 64 nt, Human
ugcgggaggugcucugcugcacagcuguuccaucaggcccuauuggccucuguuagacauugac

SEQ ID NO: 484944 - RNA, 64 nt, Human
agcucugaugcacuauugugugucagcagcucaaaggcccuaaaacacugaagguucugcaucu

SEQ ID NO: 484945 - RNA, 64 nt, Human
cccuucauaccgccucgugccagcagccucgcacaggcccuagcuuuacgcucaucaccuaaac

SEQ ID NO: 484946 - RNA, 64 nt, Human
caaacguuuccuacauucuuuuccauguguaaaaucaugaaaaagccugucaccggacuugcau

SEQ ID NO: 484947 - RNA, 64 nt, Human
cuuuuguauaaauuccuguccugaaauauuuuauucaugaaaauaagguaagcaaaaaccaacu

SEQ ID NO: 484948 - RNA, 64 nt, Human
gcccuggccucccucccccuaccucacacgcugcucaugaaaguuuccacccacgcugucucca

SEQ ID NO: 484949 - RNA, 64 nt, Human
aaauaaauccuaccugguuuuuaaauuuuauuuuucaugaaaaugcuccuuucucuacauuuau

SEQ ID NO: 484950 - RNA, 64 nt, Human
auuuuuauuagaaauuuaauuucuucaugugaugucaugaaacuguacauacugcagugugaau

SEQ ID NO: 484951 - RNA, 64 nt, Human
uugggaauauggauguaaagaaguaacuugugucucaugaaaaucaguacaaucacacaaggag

SEQ ID NO: 484952 - RNA, 64 nt, Human
aagaagacauucaaaauuugaugugcuacaagccucaugaaagaacaaaagaaaugaagccuuu

SEQ ID NO: 484953 - RNA, 64 nt, Human
caaagaagaaacuucgccuuaucagcuucauacuucaugaaauccuggguuuucuuaaccaucu

SEQ ID NO: 484954 - RNA, 64 nt, Human
gaucaaggaugcguuccauuuucacacuucacagucaugaaaacugagaagacugucuucagcg

SEQ ID NO: 484955 - RNA, 64 nt, Human
aaguaaguuacucuuuuccuuuaaucuguaagauucaugaaauucggggccagggaaacaguuu

SEQ ID NO: 484956 - RNA, 64 nt, Human
ugccugcuaauaugaacagaaaugcauuuguaauucaugaaaauaaauguacaucuucuaucuu

SEQ ID NO: 484957 - RNA, 64 nt, Human
cuuccucuucaaaguauuuaaauuuccuagguuuucaugaaaaagcuggaaagcgaucagcauc

SEQ ID NO: 484958 - RNA, 64 nt, Human
auguaagacacacuguguugcauucuugcacaagucaugaaaauggagccagagagccuggaca

SEQ ID NO: 484959 - RNA, 64 nt, Human
cugaaaugcuugguuggaagacugugacaauagcucaugaaauugaguguuauuuuuuucuuuc

SEQ ID NO: 484960 - RNA, 64 nt, Human
aggaaaaagcaaggguaaaggcaagaagugggugucaugaaacucaauaaauagcaaaaugaau

SEQ ID NO: 484961 - RNA, 64 nt, Human
ccaaccagggucccaaagcccaaccucaggaagaaggcccuacagauuugccaugucccccaga

SEQ ID NO: 484962 - RNA, 64 nt, Human
ucaucaggcgcagggccccagacagcuucccagcaggcccuagagcccggccugggccaaugau

SEQ ID NO: 484963 - RNA, 64 nt, Human
uguaccacugcauuccagccugggugacggagugaggcccuaucugccugccagugaguucugu

SEQ ID NO: 484964 - RNA, 64 nt, Human
uuugaagguuuccucuccuaggcuaguuucaaacaggcccuaaacaagucugcugcugcccucu

SEQ ID NO: 484965 - RNA, 64 nt, Human
gaaccucucaggccuuucgaagaacuuucauaauucaugaaagcccaguucugaagauucacgu

SEQ ID NO: 484966 - RNA, 64 nt, Human
uaucaagacacacagguucagacuacacaauuauucaugaaauggcuguuuuccaauggaggaa

SEQ ID NO: 484967 - RNA, 64 nt, Human
gcaagguacccuuucucuuuuuaaaaacuuuuuaucaugaaaacuuucaaauacaaaaauaaaa

SEQ ID NO: 484968 - RNA, 64 nt, Human
gaacguaguaagccuuaccuuaauagaauuaaauucaugaaacauaagauagugaaaauauuuu

SEQ ID NO: 484969 - RNA, 64 nt, Human
caugagggccaugccuuuguuugcuuuuguggcaucaugaaacgccuggccgccaacuuccacc

SEQ ID NO: 484970 - RNA, 64 nt, Human
aguuaggcuuccaugauguuacauuaggaagauaucaugaaagaauaaauaagauugcuauggu

SEQ ID NO: 484971 - RNA, 64 nt, Human
uuuguucauauuuguacaguaucugauccugaaaucaugaaauuaacuaacaccuuagccuuuu

SEQ ID NO: 484972 - RNA, 64 nt, Human
auugacaaugacaaaaagaagauggauguaauucucaugaaagcagugaagcaauuucaguuuu

SEQ ID NO: 484973 - RNA, 64 nt, Human
aguuccuugccucagugaaauaugcauauguauaucaugaaagugggaugccaaguaagcuuaa

SEQ ID NO: 484974 - RNA, 64 nt, Human
gaucuuagucuagguaaagaaaaaaaaaaaaaggucaugaaacacaaauguccucaacugucau

SEQ ID NO: 484975 - RNA, 64 nt, Human
uucccuucuuauuucaguaauacucuauuuuuuuucaugaaaaugucaacaugguucuucugaa

SEQ ID NO: 484976 - RNA, 64 nt, Human
ccuuucacauuuugaucuuuaguugacucuacagucaugaaacauacaggucuuucaaagucau

SEQ ID NO: 484977 - RNA, 64 nt, Human
uuagacuucuguuuucaaucucguauagaagucuucaugaaaugcuaugucauuucauguccug

SEQ ID NO: 484978 - RNA, 64 nt, Human
cuaauacuaauagccuaaaagauuuugugaaauuucaugaaaacuuuuuaauggcaauaaugac

SEQ ID NO: 484979 - RNA, 64 nt, Human
aaaguauacuuauacaauguuuuguacuuguauuucaugaaauuaaaacagugaugcuaaaacu

SEQ ID NO: 484980 - RNA, 64 nt, Human
ugucagguuccuaugggcuuaagcuaggacaaucaggcccuaaacuccaaauuuggauaaaaua

SEQ ID NO: 484981 - RNA, 64 nt, Human
cacauucuuugcugagggaaauaacaguuuuuccaggcccuaggguuuauuuaguucaacauug

SEQ ID NO: 484982 - RNA, 64 nt, Human
cccucugcccuucuaagucauagacuagguaggaaggcccuauauugguccccagcaucuacug

SEQ ID NO: 484983 - RNA, 64 nt, Human
ugaauacaguaaaagagucgaacacucauuuccaaggcccuaacccuuauccuuuaaaaagaaa

SEQ ID NO: 484984 - RNA, 64 nt, Human
uuuugaaaaacuuuugacuuguacguguuagccuucaugaaauugcaguacagagauggguccc

SEQ ID NO: 484985 - RNA, 64 nt, Human
ugugacuuuucuauuucuccuaguuuuagguuguucaugaaacuagaaaugucauccugcuuga

SEQ ID NO: 484986 - RNA, 64 nt, Human
cugccccccccacugagaacuaugcaauggaguuucaugaaaugguccacauaguggggaagua

SEQ ID NO: 484987 - RNA, 64 nt, Human
aaauauugugcuuaauuuuuuucuauuguguuauucaugaaaauauuuaauauucacugacaua

SEQ ID NO: 484988 - RNA, 64 nt, Human
cuacuuucuguuuuugcagaauauuagaaaaaugucaugaaaauaguugaagagaaaugcucac

SEQ ID NO: 484989 - RNA, 64 nt, Human
uuguuugaaaaacuugcacagggcauuggagccaucaugaaaagcaggaaauguaaacguggaa

SEQ ID NO: 484990 - RNA, 64 nt, Human
uauuuuauuuuuccaucacuucuuugucccagauucaugaaauuugcugauguccauuuuaugu

SEQ ID NO: 484991 - RNA, 64 nt, Human
gggaauuugcuuuagccagaauaaagaaaccaaaucaugaaaauuauggaagacuauucugcca

SEQ ID NO: 484992 - RNA, 64 nt, Human
guuuuagaaaacuuugauuuguacauguuaguuuucaugaaauugcaacacagagauagguccu

SEQ ID NO: 484993 - RNA, 64 nt, Human
gugagggguuaccucccucgccccaagguuccagaggcccuaggcgggaugggcucgcugaacc

SEQ ID NO: 484994 - RNA, 64 nt, Human
ucccacucccaucuccuuaccucuggaaccccccaggcccuacaaugcucaugucccugucccc

SEQ ID NO: 484995 - RNA, 64 nt, Human
guuucucucagcuuuuugaccuggcucccuaaguaggcccuagaugauuuauucuuggcauggc

SEQ ID NO: 484996 - RNA, 64 nt, Human
ccuaaagcgccaccuucguugucauacaggagaaaggcccuauccaugucaagcuuguggaaaa

SEQ ID NO: 484997 - RNA, 64 nt, Human
gucuucccugccauggagugggaauccccagccgaggcccuaggccccucagcagggaagggau

SEQ ID NO: 484998 - RNA, 64 nt, Human
aagcuguuccuuucuaugcccaauagaagcaacaaggcccuagcuggagacucuggggaucugg

SEQ ID NO: 484999 - RNA, 64 nt, Human
gugcuagcaggcaggaucccuucuccaccuccaaaggcccuaaaggguggggagagaucaccac

SEQ ID NO: 485000 - RNA, 64 nt, Human
agaaaugagaugaggggaagaagcaaggagucuaaggcccuagcgauuugggcaucugccacau

SEQ ID NO: 485001 - RNA, 64 nt, Human
gcagacaccuggacugagccaaggaggccuggggaggcccuaggggagcaccgugauggagagg

SEQ ID NO: 485002 - RNA, 64 nt, Human
cguguagaauacuucacaaaauagucaacaucuaaggcccuaauuuauguuuugaaagaucaug

SEQ ID NO: 485003 - RNA, 64 nt, Human; identical to SEQ ID NO: 64517

SEQ ID NO: 485004 - RNA, 64 nt, Human; identical to SEQ ID NO: 64518

SEQ ID NO: 485005 - RNA, 55 nt, Human; identical to SEQ ID NO: 64519

SEQ ID NO: 485006 - RNA, 64 nt, Human; identical to SEQ ID NO: 64520

SEQ ID NO: 485007 - RNA, 64 nt, Human; identical to SEQ ID NO: 64521

SEQ ID NO: 485008 - RNA, 64 nt, Human; identical to SEQ ID NO: 64522

SEQ ID NO: 485009 - RNA, 64 nt, Human; identical to SEQ ID NO: 64523

SEQ ID NO: 485010 - RNA, 64 nt, Human; identical to SEQ ID NO: 64524

SEQ ID NO: 485011 - RNA, 64 nt, Human; identical to SEQ ID NO: 64525

SEQ ID NO: 485012 - RNA, 64 nt, Human; identical to SEQ ID NO: 64526

SEQ ID NO: 485013 - RNA, 64 nt, Human; identical to SEQ ID NO: 64527

SEQ ID NO: 485014 - RNA, 64 nt, Human; identical to SEQ ID NO: 64528

SEQ ID NO: 485015 - RNA, 64 nt, Human; identical to SEQ ID NO: 64529

SEQ ID NO: 485016 - RNA, 64 nt, Human; identical to SEQ ID NO: 64530

SEQ ID NO: 485017 - RNA, 59 nt, Human
gguguggcaggagcucccagcacuggagacccacggacucaacccaguuaccucacaug

SEQ ID NO: 485018 - RNA, 59 nt, Human
ccugcugcacacacaagcaucucacucggcccacggagggggccaggcuuccuuugccu

SEQ ID NO: 485019 - RNA, 54 nt, Human; identical to SEQ ID NO: 150156

SEQ ID NO: 485020 - RNA, 59 nt, Human
gcccucggugcucauagggaauggcugggcccacggaaggucggccugggauguggccu

SEQ ID NO: 485021 - RNA, 64 nt, Human; identical to SEQ ID NO: 64531

SEQ ID NO: 485022 - RNA, 64 nt, Human; identical to SEQ ID NO: 64532

SEQ ID NO: 485023 - RNA, 64 nt, Human; identical to SEQ ID NO: 64533

SEQ ID NO: 485024 - RNA, 64 nt, Human; identical to SEQ ID NO: 64534

SEQ ID NO: 485025 - RNA, 64 nt, Human; identical to SEQ ID NO: 64535

SEQ ID NO: 485026 - RNA, 64 nt, Human; identical to SEQ ID NO: 64536

SEQ ID NO: 485027 - RNA, 64 nt, Human; identical to SEQ ID NO: 64537

SEQ ID NO: 485028 - RNA, 64 nt, Human; identical to SEQ ID NO: 64538

SEQ ID NO: 485029 - RNA, 64 nt, Human; identical to SEQ ID NO: 64539

SEQ ID NO: 485030 - RNA, 64 nt, Human; identical to SEQ ID NO: 64540

SEQ ID NO: 485031 - RNA, 64 nt, Human; identical to SEQ ID NO: 64541

SEQ ID NO: 485032 - RNA, 64 nt, Human; identical to SEQ ID NO: 64542

SEQ ID NO: 485033 - RNA, 64 nt, Human; identical to SEQ ID NO: 64543

SEQ ID NO: 485034 - RNA, 64 nt, Human; identical to SEQ ID NO: 64544

SEQ ID NO: 485035 - RNA, 58 nt, Human
ugcauagccauucuguaacaauauuguguaaaccuauaguuugaaggaaugcaaggag

SEQ ID NO: 485036 - RNA, 58 nt, Human
uuuaagaaaacaccagaugaguuaggaauaaaccuauaacauuuacaaaaagagcaaa

SEQ ID NO: 485037 - RNA, 58 nt, Human
aauguuuuuuuauuaacugacauuauuuuaaaccuaacugagaugaucaguuacauuc

SEQ ID NO: 485038 - RNA, 58 nt, Human
gcuucugaguauaacgaauugggaugucuaaaccuauuuuuauagauguuauuuaaau

SEQ ID NO: 485039 - RNA, 64 nt, Human; identical to SEQ ID NO: 64545

SEQ ID NO: 485040 - RNA, 64 nt, Human; identical to SEQ ID NO: 64546

SEQ ID NO: 485041 - RNA, 64 nt, Human; identical to SEQ ID NO: 64547

SEQ ID NO: 485042 - RNA, 64 nt, Human; identical to SEQ ID NO: 64548

SEQ ID NO: 485043 - RNA, 64 nt, Human; identical to SEQ ID NO: 64549

SEQ ID NO: 485044 - RNA, 64 nt, Human; identical to SEQ ID NO: 64550

SEQ ID NO: 485045 - RNA, 64 nt, Human; identical to SEQ ID NO: 64551

SEQ ID NO: 485046 - RNA, 64 nt, Human; identical to SEQ ID NO: 64552

SEQ ID NO: 485047 - RNA, 64 nt, Human; identical to SEQ ID NO: 64553

SEQ ID NO: 485048 - RNA, 64 nt, Human; identical to SEQ ID NO: 64554

SEQ ID NO: 485049 - RNA, 64 nt, Human; identical to SEQ ID NO: 64555

SEQ ID NO: 485050 - RNA, 64 nt, Human; identical to SEQ ID NO: 64556

SEQ ID NO: 485051 - RNA, 64 nt, Human; identical to SEQ ID NO: 64557

SEQ ID NO: 485052 - RNA, 64 nt, Human; identical to SEQ ID NO: 64558

SEQ ID NO: 485053 - RNA, 58 nt, Human
cuccuaagcaaagguagagcugccuuuuuaaaccuaggucuuaccaggguuuuuacug

SEQ ID NO: 485054 - RNA, 58 nt, Human
uaccaaugugaaauuuccagaucaucuguaaaccuacaacuuuaauagaagacuacua

SEQ ID NO: 485055 - RNA, 58 nt, Human
gauaguacauguguuguucaaaccuuguuaaaccuaauauugaacuauuuuuauaucu

SEQ ID NO: 485056 - RNA, 58 nt, Human
ugcaaacaaaacuuaaagagauaagcauuaaaccuauugugcuguuaacaacguuagu

SEQ ID NO: 485057 - RNA, 64 nt, Human; identical to SEQ ID NO: 64559

SEQ ID NO: 485058 - RNA, 64 nt, Human; identical to SEQ ID NO: 64560

SEQ ID NO: 485059 - RNA, 64 nt, Human; identical to SEQ ID NO: 64561

SEQ ID NO: 485060 - RNA, 64 nt, Human; identical to SEQ ID NO: 64562

SEQ ID NO: 485061 - RNA, 64 nt, Human; identical to SEQ ID NO: 64563

SEQ ID NO: 485062 - RNA, 64 nt, Human; identical to SEQ ID NO: 64564

SEQ ID NO: 485063 - RNA, 64 nt, Human; identical to SEQ ID NO: 64565

SEQ ID NO: 485064 - RNA, 64 nt, Human; identical to SEQ ID NO: 64566

SEQ ID NO: 485065 - RNA, 64 nt, Human; identical to SEQ ID NO: 64567

SEQ ID NO: 485066 - RNA, 64 nt, Human; identical to SEQ ID NO: 64568

SEQ ID NO: 485067 - RNA, 64 nt, Human; identical to SEQ ID NO: 64569

SEQ ID NO: 485068 - RNA, 58 nt, Human; identical to SEQ ID NO: 64570

SEQ ID NO: 485069 - RNA, 64 nt, Human; identical to SEQ ID NO: 64571

SEQ ID NO: 485070 - RNA, 64 nt, Human; identical to SEQ ID NO: 64572

SEQ ID NO: 485071 - RNA, 58 nt, Human
guuuaugcuaauauuguguaacugauauuaaaccuaaauguucugccuacccuguugg

SEQ ID NO: 485072 - RNA, 58 nt, Human
cuugcuuagucguauacucaaaugaugauaaaccuacaugugcaaaggcucacguuua

SEQ ID NO: 485073 - RNA, 58 nt, Human
guuaacucuucucuuguguauaugcaaauaaaccuauuauucacuucucacgucuucc

SEQ ID NO: 485074 - RNA, 58 nt, Human
ugcacauaggaaggaaaagauaggacucuaaaccuagucaucuuggaauaaaaagaag

SEQ ID NO: 485075 - RNA, 64 nt, Human; identical to SEQ ID NO: 64573

SEQ ID NO: 485076 - RNA, 64 nt, Human; identical to SEQ ID NO: 64574

SEQ ID NO: 485077 - RNA, 64 nt, Human; identical to SEQ ID NO: 64575

SEQ ID NO: 485078 - RNA, 64 nt, Human; identical to SEQ ID NO: 64576

SEQ ID NO: 485079 - RNA, 64 nt, Human; identical to SEQ ID NO: 64577

SEQ ID NO: 485080 - RNA, 64 nt, Human; identical to SEQ ID NO: 64578

SEQ ID NO: 485081 - RNA, 64 nt, Human; identical to SEQ ID NO: 64579

SEQ ID NO: 485082 - RNA, 64 nt, Human; identical to SEQ ID NO: 64580

SEQ ID NO: 485083 - RNA, 64 nt, Human; identical to SEQ ID NO: 64581

SEQ ID NO: 485084 - RNA, 64 nt, Human; identical to SEQ ID NO: 64582

SEQ ID NO: 485085 - RNA, 64 nt, Human; identical to SEQ ID NO: 64583

SEQ ID NO: 485086 - RNA, 64 nt, Human; identical to SEQ ID NO: 64584

SEQ ID NO: 485087 - RNA, 64 nt, Human; identical to SEQ ID NO: 64585

SEQ ID NO: 485088 - RNA, 64 nt, Human; identical to SEQ ID NO: 64586

SEQ ID NO: 485089 - RNA, 58 nt, Human
ucucugugcuaucugcucaauuuuucucuaaaccuaaaacuguucuaaaauagaaagu

SEQ ID NO: 485090 - RNA, 58 nt, Human
aguuuauuaaacaauaauauaaaaauuuuaaaccuacuugauauuccauaacaaagcu

SEQ ID NO: 485091 - RNA, 58 nt, Human
aauaagaccccauuauuaucuauugcuauaaaccuagccaguucucuugcucuucugu

SEQ ID NO: 485092 - RNA, 58 nt, Human
auaaagaucucaucacugcuccuuauaauaaaccuaauaaagcaagaaaccaagccua

SEQ ID NO: 485093 - RNA, 64 nt, Human; identical to SEQ ID NO: 64587

SEQ ID NO: 485094 - RNA, 64 nt, Human; identical to SEQ ID NO: 64588

SEQ ID NO: 485095 - RNA, 64 nt, Human; identical to SEQ ID NO: 64589

SEQ ID NO: 485096 - RNA, 64 nt, Human; identical to SEQ ID NO: 64590

SEQ ID NO: 485097 - RNA, 64 nt, Human; identical to SEQ ID NO: 64591

SEQ ID NO: 485098 - RNA, 64 nt, Human; identical to SEQ ID NO: 64592

SEQ ID NO: 485099 - RNA, 64 nt, Human; identical to SEQ ID NO: 64593

SEQ ID NO: 485100 - RNA, 64 nt, Human; identical to SEQ ID NO: 64594

SEQ ID NO: 485101 - RNA, 64 nt, Human; identical to SEQ ID NO: 64595

SEQ ID NO: 485102 - RNA, 64 nt, Human; identical to SEQ ID NO: 64596

SEQ ID NO: 485103 - RNA, 64 nt, Human; identical to SEQ ID NO: 64597

SEQ ID NO: 485104 - RNA, 64 nt, Human; identical to SEQ ID NO: 64598

SEQ ID NO: 485105 - RNA, 64 nt, Human; identical to SEQ ID NO: 64599

SEQ ID NO: 485106 - RNA, 64 nt, Human; identical to SEQ ID NO: 64600

SEQ ID NO: 485107 - RNA, 58 nt, Human
ccuaaaacaaccagauucuuacuuggcuuaaaccuagaggccagaagaacccccagcu

SEQ ID NO: 485108 - RNA, 58 nt, Human
agccuuugcuaaagagcaacuaauaaauuaaaccuauucuuucugugugugugagcgu

SEQ ID NO: 485109 - RNA, 58 nt, Human
cagucucuuuucugggggaaaaaaauaauaaaccuagccuagccaggcgugguggcuc

SEQ ID NO: 485110 - RNA, 59 nt, Human
gcugcagggaggcagaaggcaaggcaggccccacggacacacuugggcugcucugaaau

SEQ ID NO: 485111 - RNA, 64 nt, Human; identical to SEQ ID NO: 64601

SEQ ID NO: 485112 - RNA, 64 nt, Human; identical to SEQ ID NO: 64602

SEQ ID NO: 485113 - RNA, 64 nt, Human; identical to SEQ ID NO: 64603

SEQ ID NO: 485114 - RNA, 64 nt, Human; identical to SEQ ID NO: 64604

SEQ ID NO: 485115 - RNA, 64 nt, Human; identical to SEQ ID NO: 64605

SEQ ID NO: 485116 - RNA, 64 nt, Human; identical to SEQ ID NO: 64606

SEQ ID NO: 485117 - RNA, 64 nt, Human; identical to SEQ ID NO: 64607

SEQ ID NO: 485118 - RNA, 50 nt, Human; identical to SEQ ID NO: 64608

SEQ ID NO: 485119 - RNA, 64 nt, Human; identical to SEQ ID NO: 64609

SEQ ID NO: 485120 - RNA, 64 nt, Human; identical to SEQ ID NO: 64610

SEQ ID NO: 485121 - RNA, 64 nt, Human; identical to SEQ ID NO: 64611

SEQ ID NO: 485122 - RNA, 64 nt, Human; identical to SEQ ID NO: 64612

SEQ ID NO: 485123 - RNA, 64 nt, Human; identical to SEQ ID NO: 64613

SEQ ID NO: 485124 - RNA, 64 nt, Human; identical to SEQ ID NO: 64614

SEQ ID NO: 485125 - RNA, 58 nt, Human
ugaguugucaaggaaccaaauggggauguaaaccuaaaagggguucccggcaccucgg

SEQ ID NO: 485126 - RNA, 58 nt, Human
ccacucaaaaaugcagugccaggagugcuaaaccuagaggccaauacugaugaccugg

SEQ ID NO: 485127 - RNA, 58 nt, Human
ccagucccaugaccuugggguacaauuguaaaccuagaguuuuaucaacuuuggugaa

SEQ ID NO: 485128 - RNA, 58 nt, Human
ccauucaaaagucuaauaacaaaaaauguaaaccuaauuuggcaguuuguuagguuag

SEQ ID NO: 485129 - RNA, 64 nt, Human; identical to SEQ ID NO: 64615

SEQ ID NO: 485130 - RNA, 64 nt, Human; identical to SEQ ID NO: 64616

SEQ ID NO: 485131 - RNA, 64 nt, Human; identical to SEQ ID NO: 64617

SEQ ID NO: 485132 - RNA, 64 nt, Human; identical to SEQ ID NO: 64618

SEQ ID NO: 485133 - RNA, 64 nt, Human; identical to SEQ ID NO: 64619

SEQ ID NO: 485134 - RNA, 64 nt, Human; identical to SEQ ID NO: 64620

SEQ ID NO: 485135 - RNA, 64 nt, Human; identical to SEQ ID NO: 64621

SEQ ID NO: 485136 - RNA, 64 nt, Human; identical to SEQ ID NO: 64622

SEQ ID NO: 485137 - RNA, 64 nt, Human; identical to SEQ ID NO: 64623

SEQ ID NO: 485138 - RNA, 64 nt, Human; identical to SEQ ID NO: 64624

SEQ ID NO: 485139 - RNA, 64 nt, Human; identical to SEQ ID NO: 64625

SEQ ID NO: 485140 - RNA, 64 nt, Human; identical to SEQ ID NO: 64626

SEQ ID NO: 485141 - RNA, 64 nt, Human; identical to SEQ ID NO: 64627

SEQ ID NO: 485142 - RNA, 64 nt, Human; identical to SEQ ID NO: 64628

SEQ ID NO: 485143 - RNA, 58 nt, Human
ugaaugucuaaccugcuccccugauucguaaaccuaggggaaaccaucucucucaccu

SEQ ID NO: 485144 - RNA, 58 nt, Human
ggaagcccuuguuuacagaagagagggguaaaccuaugaaaacaggggaagccuuauu

SEQ ID NO: 485145 - RNA, 58 nt, Human
gguugggggcucucuuugcuucgagaaguaaaccuaauaccauuuuuuuauuguuuaa

SEQ ID NO: 485146 - RNA, 58 nt, Human
gguguuuggcuaaucuacaaauaagucuuaaaccuauguuuuuaaauuuuuuucccuu

SEQ ID NO: 485147 - RNA, 64 nt, Human; identical to SEQ ID NO: 64629

SEQ ID NO: 485148 - RNA, 64 nt, Human; identical to SEQ ID NO: 64630

SEQ ID NO: 485149 - RNA, 64 nt, Human; identical to SEQ ID NO: 64631

SEQ ID NO: 485150 - RNA, 64 nt, Human; identical to SEQ ID NO: 64632

SEQ ID NO: 485151 - RNA, 64 nt, Human; identical to SEQ ID NO: 64633

SEQ ID NO: 485152 - RNA, 64 nt, Human; identical to SEQ ID NO: 64634

SEQ ID NO: 485153 - RNA, 64 nt, Human; identical to SEQ ID NO: 64635

SEQ ID NO: 485154 - RNA, 64 nt, Human; identical to SEQ ID NO: 64636

SEQ ID NO: 485155 - RNA, 64 nt, Human; identical to SEQ ID NO: 64637

SEQ ID NO: 485156 - RNA, 64 nt, Human; identical to SEQ ID NO: 64638

SEQ ID NO: 485157 - RNA, 64 nt, Human; identical to SEQ ID NO: 64639

SEQ ID NO: 485158 - RNA, 64 nt, Human; identical to SEQ ID NO: 64640

SEQ ID NO: 485159 - RNA, 57 nt, Human; identical to SEQ ID NO: 64641

SEQ ID NO: 485160 - RNA, 51 nt, Human; identical to SEQ ID NO: 64642

SEQ ID NO: 485161 - RNA, 58 nt, Human
auuuuuaauuuauguucuuaugaugguuuaaaccuauagucaggcuuuuaaguacaag

SEQ ID NO: 485162 - RNA, 58 nt, Human
aucuucuuaccaaguaccuuacuauaaguaaaccuaagauaagaaaacccagauuuac

SEQ ID NO: 485163 - RNA, 58 nt, Human
auuauauagaaaaugcucuuaaaaagauuaaaccuauuucucaguaugguaucuuggu

SEQ ID NO: 485164 - RNA, 58 nt, Human
cguuugggucuaguuuagaaccuguccuuaaaccuagggguugcugucaggauuugcu

SEQ ID NO: 485165 - RNA, 64 nt, Human; identical to SEQ ID NO: 64643

SEQ ID NO: 485166 - RNA, 64 nt, Human; identical to SEQ ID NO: 64644

SEQ ID NO: 485167 - RNA, 64 nt, Human; identical to SEQ ID NO: 64645

SEQ ID NO: 485168 - RNA, 64 nt, Human; identical to SEQ ID NO: 64646

SEQ ID NO: 485169 - RNA, 64 nt, Human; identical to SEQ ID NO: 64647

SEQ ID NO: 485170 - RNA, 64 nt, Human; identical to SEQ ID NO: 64648

SEQ ID NO: 485171 - RNA, 64 nt, Human; identical to SEQ ID NO: 64649

SEQ ID NO: 485172 - RNA, 64 nt, Human; identical to SEQ ID NO: 64650

SEQ ID NO: 485173 - RNA, 64 nt, Human; identical to SEQ ID NO: 64651

SEQ ID NO: 485174 - RNA, 64 nt, Human; identical to SEQ ID NO: 64652

SEQ ID NO: 485175 - RNA, 64 nt, Human; identical to SEQ ID NO: 64653

SEQ ID NO: 485176 - RNA, 64 nt, Human; identical to SEQ ID NO: 64654

SEQ ID NO: 485177 - RNA, 64 nt, Human; identical to SEQ ID NO: 64655

SEQ ID NO: 485178 - RNA, 64 nt, Human; identical to SEQ ID NO: 64656

SEQ ID NO: 485179 - RNA, 58 nt, Human
acuguaaaauucauaugcuuugcuacucuaaaccuaguuugaaaucaacagucuugag

SEQ ID NO: 485180 - RNA, 58 nt, Human
caggaggagcuucgcauauuuaaauaaauaaaccuagcaugcugaaugcacgugacac

SEQ ID NO: 485181 - RNA, 58 nt, Human
ucacagcagacuuguguuuuggguuuuuuaaaccuaagggaggugaugguaggaaccc

SEQ ID NO: 485182 - RNA, 58 nt, Human
cuccugggccgggguggaaggagggggauaaaccuaaggcccugauccaaagcagccu

SEQ ID NO: 485183 - RNA, 64 nt, Human; identical to SEQ ID NO: 64657

SEQ ID NO: 485184 - RNA, 64 nt, Human; identical to SEQ ID NO: 64658

SEQ ID NO: 485185 - RNA, 64 nt, Human; identical to SEQ ID NO: 64659

SEQ ID NO: 485186 - RNA, 64 nt, Human; identical to SEQ ID NO: 64660

SEQ ID NO: 485187 - RNA, 64 nt, Human; identical to SEQ ID NO: 64661

SEQ ID NO: 485188 - RNA, 64 nt, Human; identical to SEQ ID NO: 64662

SEQ ID NO: 485189 - RNA, 64 nt, Human; identical to SEQ ID NO: 64663

SEQ ID NO: 485190 - RNA, 64 nt, Human; identical to SEQ ID NO: 64664

SEQ ID NO: 485191 - RNA, 64 nt, Human; identical to SEQ ID NO: 64665

SEQ ID NO: 485192 - RNA, 64 nt, Human; identical to SEQ ID NO: 64666

SEQ ID NO: 485193 - RNA, 53 nt, Human; identical to SEQ ID NO: 64667

SEQ ID NO: 485194 - RNA, 64 nt, Human; identical to SEQ ID NO: 64668

SEQ ID NO: 485195 - RNA, 64 nt, Human; identical to SEQ ID NO: 64669

SEQ ID NO: 485196 - RNA, 64 nt, Human; identical to SEQ ID NO: 64670

SEQ ID NO: 485197 - RNA, 58 nt, Human
cuugccacaaucacuaaauaucuagugcuaaaccuaucuguauuggcagcacagcuac

SEQ ID NO: 485198 - RNA, 58 nt, Human
uaacacuuaaaaaaugcacucauuaucuuaaaccuaauaaauuccagaguuuauuuug

SEQ ID NO: 485199 - RNA, 58 nt, Human
caacaauaccugcacggcuuugcacacguaaaccuaggcuggucuacacgcagugcug

SEQ ID NO: 485200 - RNA, 64 nt, Human; identical to SEQ ID NO: 64671

SEQ ID NO: 485201 - RNA, 64 nt, Human; identical to SEQ ID NO: 64672

SEQ ID NO: 485202 - RNA, 64 nt, Human; identical to SEQ ID NO: 64673

SEQ ID NO: 485203 - RNA, 58 nt, Human
acaagugugaagaauguggcaaaaccuauaaaccuauaacaaguucucaauuccuuuu

SEQ ID NO: 485204 - RNA, 58 nt, Human
ccccuccccagugagggacauuuuuugguaaaccuauuuucauuuuggaaaauauuua

SEQ ID NO: 485205 - RNA, 58 nt, Human
cuuagauaccauccugagggucugaaauuaaaccuacagguucugaauacaacaucau

SEQ ID NO: 485206 - RNA, 64 nt, Human
caaggaggaugccggcaaggccuucgccagcuagaagcgggacugaggcugccucacguguugc

SEQ ID NO: 485207 - RNA, 64 nt, Human
gaggggugcggguaaacgaggaguggggcgaggaaagcgggaugggaacaaguggccugucccc

SEQ ID NO: 485208 - RNA, 64 nt, Human
acaauguccuucgcugaggccaaaguuuccauguaagcgggauccguuuuuuggaauuugguug

SEQ ID NO: 485209 - RNA, 64 nt, Human
cagcauccccguaggcaucucgcuggggcugcugaagcgggagauggcgcaggguaugcgggcu

SEQ ID NO: 485210 - RNA, 64 nt, Human
cuuaguuaacaacccaguuccaggaucgagccuaaagcgggagccaggccugaguguuccuguc

SEQ ID NO: 485211 - RNA, 64 nt, Human
auugucuuuucacuguauauacuucuaagacagcaagcgggacacugcaguggcaauaguguua

SEQ ID NO: 485212 - RNA, 64 nt, Human
cccucugguuuggacaaaaacccucaguagagacaagcgggaaggauaauuagcugaaagcuau

SEQ ID NO: 485213 - RNA, 64 nt, Human
uacugguuucuuugugaagcugaaaaggaacauuaagcgggacaaaaaaugccgauuuuauuua

SEQ ID NO: 485214 - RNA, 64 nt, Human
gaaggggcgcuuagaaaacguuaauagaaguucuaagcgggagaugacucccuacugggaugau

SEQ ID NO: 485215 - RNA, 64 nt, Human
ccaucagcuguuucucacaucuauagugacaauaaagcgggaaguauaagauuuaauaggaggg

SEQ ID NO: 485216 - RNA, 58 nt, Human
ugucaguuuuauugagaugggaaaaauguaaaccuauuuuuauuacuuaagacuuuau

SEQ ID NO: 485217 - RNA, 58 nt, Human
auaacuuacugggguaaaauaacagcaauaaaccuaaccuuuuaacagggucuaacau

SEQ ID NO: 485218 - RNA, 58 nt, Human
acugcugagaggacuguauauaugauuuuaaaccuaaguugauuuuuuuucucacucu

SEQ ID NO: 485219 - RNA, 64 nt, Human
acccccagaggccuuggccaagcugcugcuuugaaagcgggaucuuggagacaggccauccauc

SEQ ID NO: 485220 - RNA, 64 nt, Human
gagucuggucugcgccuugggauggggagucccaaagcgggacgccgcagguguuuggcaccca

SEQ ID NO: 485221 - RNA, 64 nt, Human
aggcuuugaaguagggagguuggcagggguggucaagcgggagggagauagucacuuguucuug

SEQ ID NO: 485222 - RNA, 64 nt, Human
agugacaggacuuucauuguucuuggcugaggagaagcgggaguggcugauggaagcaccuaaa

SEQ ID NO: 485223 - RNA, 64 nt, Human
ugagagggacagaagacgcuggaaggagagaaggaagcgggaagugugcuucucagggaggaaa

SEQ ID NO: 485224 - RNA, 64 nt, Human
uuuuuuucaggaugcaaaggcaauuauucuuuguaagcgggacauuuagaauauauuuguguac

SEQ ID NO: 485225 - RNA, 64 nt, Human
aagcgugccaggcucugggcuggaugcuggggauaagcgggaacccuuaggauccccucugucc

SEQ ID NO: 485226 - RNA, 64 nt, Human
ccugugguuucuguuggagcauaagguuuccaguaagcgggagggcagauccaacucagaacca

SEQ ID NO: 485227 - RNA, 64 nt, Human
cauuauguaaucacagguccagagagcuuuauggaagcgggagaggaggagcacuuacucaugu

SEQ ID NO: 485228 - RNA, 64 nt, Human
ccgccucgggacccccucuccaggcggagggaggaagcgggagcuuuaaagcagucggggauac

SEQ ID NO: 485229 - RNA, 64 nt, Human
agaggggaugugagugggaggaaaggggucuguaaagcgggagaacaaggcuagccucccccua

SEQ ID NO: 485230 - RNA, 64 nt, Human
cuccaccagguggugugagcgcgggggcugccagaagcgggaggggucacugccggaagagcag

SEQ ID NO: 485231 - RNA, 64 nt, Human
uuguaucuggauucaaauuuauuuccaauguuucaagcgggaaacaugacucuuuauugucugu

SEQ ID NO: 485232 - RNA, 64 nt, Human
cguuaccggguccagacugaaugugggcguaagaaagcgggaagggucccccacagcaagagag

SEQ ID NO: 485233 - RNA, 64 nt, Human
caacggggacacccuccgugucuucaagaugaccaagcgggaggaugggggcuacaccuucaca

SEQ ID NO: 485234 - RNA, 58 nt, Human
aaaugaucuaaauuauuguuuuaauuuuuaaaccuaauuuauucacucagugaacauu

SEQ ID NO: 485235 - RNA, 58 nt, Human
gacaauucaagaauucagacuugaaccuuaaaccuaggaaaaguuacuuuguaucagg

SEQ ID NO: 485236 - RNA, 58 nt, Human
acagccccuagaaucugaaaggccgggauaaaccuaaucacuguucccaaacauugac

SEQ ID NO: 485237 - RNA, 59 nt, Human
cugccuuuuagcacuuggauacacacagacccacggagcucucuguguuuggccucuca

SEQ ID NO: 485238 - RNA, 64 nt, Human
aagcgccccccuugacacucucgcuggugaagccaagcgggaggggagcugcgcccucccugac

SEQ ID NO: 485239 - RNA, 64 nt, Human
aggggaguaauaagggcucuucuggaaggggaggaagcgggaggcagggccugcaccugaugug

SEQ ID NO: 485240 - RNA, 64 nt, Human
cucuacagacuucuccagacccaccacaccgcagaagcgggacgagacccuacaggagagggaa

SEQ ID NO: 485241 - RNA, 64 nt, Human
ggccagggccccugcgcagacugucagagucauuaagcgggaucccagcaucucagaguccagu

SEQ ID NO: 485242 - RNA, 64 nt, Human
ccagggccucugugcagacagugucagagucauuaagcgggaucccagcaucucagaguccagu

SEQ ID NO: 485243 - RNA, 64 nt, Human
uauuccccuuuuacuuggguuuuggggugguggaaagcgggaaauuugggugauuuguugauug

SEQ ID NO: 485244 - RNA, 64 nt, Human
ccugcccccgcucccgcucccagguucccccagcaagcgggagcccgugguggcgguggcugcc

SEQ ID NO: 485245 - RNA, 64 nt, Human
augucuuguccacccugggacacuucugaguaugaagcgggaugcuauuaaaaacuacaugggg

SEQ ID NO: 485246 - RNA, 64 nt, Human
gcucacaccuguaagcccagcugucagggggcagaagcgggaggauagcuugagcccaggagug

SEQ ID NO: 485247 - RNA, 64 nt, Human
uguuuugucagugucuuggggucacaggagaagaaagcgggacuuuggugggaaggagucacac

SEQ ID NO: 485248 - RNA, 64 nt, Human
cuccugggccccaaggagucccacggaauggggaaagcgggaacccuggaguucuugggaaucu

SEQ ID NO: 485249 - RNA, 64 nt, Human
gaaugauuuuugagucguuaucaagcuaaguggcaagcgggaagcugaaacucguauagguaaa

SEQ ID NO: 485250 - RNA, 64 nt, Human
gggcagcguccuccggggcuucuucaccauccgcaagcgggagccaggcggccgccugcccacc

SEQ ID NO: 485251 - RNA, 64 nt, Human
gucucccauuaaggucccauccaugggggggcggaagcgggagcgcaaggcugccgucgaggag

SEQ ID NO: 485252 - RNA, 64 nt, Human
uuucuagaggaaauuuaggcgugcgggcgccugcaagcgggagacacccacaccccauucuggg

SEQ ID NO: 485253 - RNA, 58 nt, Human
gggcgccacaugcucauggccagaaucuuaaaccuauuugguaggaaagggucaguuu

SEQ ID NO: 485254 - RNA, 58 nt, Human
acagauuauuuuggaguuuuaguuguuuuaaaccuaacucaacaacccuuuaugugau

SEQ ID NO: 485255 - RNA, 58 nt, Human
caguagucucgcuccaucucuaauagacuaaaccuaaaugccucuaggacggacuguu

SEQ ID NO: 485256 - RNA, 58 nt, Human
ucacagcgucgccaggaagaagaucugauaaaccuagguuuacagauaaagaaagcaa

SEQ ID NO: 485257 - RNA, 64 nt, Human
uauacaacugauuaaauuauuguauauaaaccagaagcgggacccucaucuggguuugaccacu

SEQ ID NO: 485258 - RNA, 64 nt, Human
aaacucagcuagccagaaugaacaacacaaccggaagcgggauuccaagcuggcacugccacug

SEQ ID NO: 485259 - RNA, 64 nt, Human
gaugauuauauauggauacauuuacaaaaauaaaaagcgggaauuuucccuucgcuugaauauu

SEQ ID NO: 485260 - RNA, 64 nt, Human
ggcuccaucucaguggaccaggaagcaagaggggaagcgggaucccagcuagacuuagaacuug

SEQ ID NO: 485261 - RNA, 64 nt, Human
uggggaggugggguaggcagaagggacguggcagaagcgggaagacuuuggucaccauggcucu

SEQ ID NO: 485262 - RNA, 64 nt, Human
uuaauuucucucugaguguacauacaacauacucaagcgggaccuucuuucucugucaggcccu

SEQ ID NO: 485263 - RNA, 64 nt, Human
ccccacacccaacuccgagggcccacgcuggggaaagcgggaagcgcucgcucccuuuccccca

SEQ ID NO: 485264 - RNA, 64 nt, Human
accaggacaguccacccgcccuguuggcacacucaagcgggaguccaccccugccucaguggug

SEQ ID NO: 485265 - RNA, 64 nt, Human
aguuuacacacgacacuaaucuccccuggggaggaagcgggaagccagccagguugaacuguag

SEQ ID NO: 485266 - RNA, 64 nt, Human
gcagcucggugcccaagaacuggccaagccagcaaagcgggagcccugaaaaauuaggggggaa

SEQ ID NO: 485267 - RNA, 64 nt, Human
ggaaggaacccccccccccccgaaaaaaaaaucaaagcgggaagaaaaucagagggaagguuaa

SEQ ID NO: 485268 - RNA, 64 nt, Human
uguuagagagagaccuagcugagcggcuggcaggaagcgggacaggucuaggagucccuuaggg

SEQ ID NO: 485269 - RNA, 64 nt, Human
uuaagaagcgucugccgugaucauggagcuucggaagcgggaaugguucuuccggguuugcugu

SEQ ID NO: 485270 - RNA, 64 nt, Human
uccccccccccaacaagggggacaugguggagggaagcgggaaggcucuucuguggcaucgcac

SEQ ID NO: 485271 - RNA, 64 nt, Human
cucaguguuaaaaugacaucucaaaagaaguccaaagcgggaaucaugugccccucagcggagc

SEQ ID NO: 485272 - RNA, 58 nt, Human
cuacuaacuaauaaucauuucagucagauaaaccuaaacauuaaauaaauaucuccaa

SEQ ID NO: 485273 - RNA, 58 nt, Human
uuaaugaaccacguguuuugacaucauguaaaccuaagcacguagagaugauucggau

SEQ ID NO: 485274 - RNA, 58 nt, Human
uguagaauaagauuucuuucuugucuuuuaaaccuaauaucaccaagaagcaaguuuc

SEQ ID NO: 485275 - RNA, 59 nt, Human
gcugguuguuagaacucaucuccagguagcccacggauacgugguuggcacagacacaa

SEQ ID NO: 485276 - RNA, 64 nt, Human
gagcagccugggaucgcucuacgaauuacacaggaagcgggauucgggucucuaagaugucuua

SEQ ID NO: 485277 - RNA, 64 nt, Human
gucggccgcgcaugugcucaucccacucuccgcuaagcgggaggcugcuguuagagcaggcugc

SEQ ID NO: 485278 - RNA, 64 nt, Human
uguaaagcucuugaccuagcaucugacuggaaacaagcgggaauugcauuggggggcauuuucu

SEQ ID NO: 485279 - RNA, 64 nt, Human
ccgcucuggacugucauaagcuagcacccgugguaagcgggacgagacaagcucccgaagcccg

SEQ ID NO: 485280 - RNA, 64 nt, Human
cgcgcccgaagcgcccauccucgugguaggcaacaagcgggacaggcagcggcugcgcuucgga

SEQ ID NO: 485281 - RNA, 64 nt, Human
cagguacgggcggggcucaagucgcgaggcggggaagcgggaggcagacacggacgagggcgac

SEQ ID NO: 485282 - RNA, 64 nt, Human
ucucuucaacuagaaucauagaguucuggauguaaagcgggaaggacauuacagaccauggaua

SEQ ID NO: 485283 - RNA, 64 nt, Human
ggcuccaccuccagcucuccgugccuuaagggaaaagcgggacagcucccaccacccugcuggg

SEQ ID NO: 485284 - RNA, 64 nt, Human
agugcuauuguugccugugguggucucccuguccaagcgggaccgcuuugcagagaccagaggc

SEQ ID NO: 485285 - RNA, 64 nt, Human
cauacgggagccuaucucagugaaagagcagcauaagcgggaagggcuuggucuggauguagag

SEQ ID NO: 485286 - RNA, 64 nt, Human
ccagcucaagcccgcugguggcagggcguuuucccaccgggauacgggaagccaccugugucag

SEQ ID NO: 485287 - RNA, 64 nt, Human
caccuuaauucuccugcugccaccgucuuugauucaccgggauguacaguuuacaguugaagag

SEQ ID NO: 485288 - RNA, 58 nt, Human
cuuacauauaaauguguauauaugugaauaaaccuauagccuuaacuuacuuauuuua

SEQ ID NO: 485289 - RNA, 58 nt, Human
acagcuauaaccugcaguugagcaguuauaaaccuacaaaaugggcccugcccucaga

SEQ ID NO: 485290 - RNA, 58 nt, Human
gcugcagauguuaaauuuugauaccauguaaaccuacccagcuucucagacuuggguc

SEQ ID NO: 485291 - RNA, 58 nt, Human
auaaaugcuuacuuguauauagagauaauaaaccuauuaccccaagugcauaauaucc

SEQ ID NO: 485292 - RNA, 64 nt, Human
uggaccagcaagcccccguggacccuaaguuguucaccgggauuuaucagaacaggauuaguag

SEQ ID NO: 485293 - RNA, 64 nt, Human
gaaccaucuuccccuguuguccuccucucuccuccaccgggacugcuggucacugcuuagaacc

SEQ ID NO: 485294 - RNA, 64 nt, Human
uucuccccaaggagaugaggagcggugaugccagcaccgggaugcgcagagcacuggaagggcu

SEQ ID NO: 485295 - RNA, 64 nt, Human
gucuguggagaccgguggccugcagaccauugcccaccgggagccgacaccugaccuagcacac

SEQ ID NO: 485296 - RNA, 64 nt, Human
ccaucuuuagaaacaucaguuuuuguauggaagccaccgggagauuucuggaugguggugcauc

SEQ ID NO: 485297 - RNA, 64 nt, Human
cgguaaugacuggguccagagccucgugagaggucaccgggaugggggaaguggccucugucag

SEQ ID NO: 485298 - RNA, 64 nt, Human
gccucuguugcucucggagccccggcuuccccugcaccgggaaagcgcccccucucgagaggcu

SEQ ID NO: 485299 - RNA, 64 nt, Human
cucaggccuccaagggcugcaguucuacaggcuacaccgggaagaaaggcccaacuaccgucuc

SEQ ID NO: 485300 - RNA, 64 nt, Human
agccccucacaccaccgccaggagaggccuuucccaccgggagagaaacuuccagaccagcccc

SEQ ID NO: 485301 - RNA, 64 nt, Human
agccccucacaccacagccaggagaggccuuucccaccgggagagaaacuuccagaccagcccu

SEQ ID NO: 485302 - RNA, 64 nt, Human
cagcccucucacuacagccagaagaggccuuucccaccgggagaggaacuuccagaccagcccc

SEQ ID NO: 485303 - RNA, 64 nt, Human
cccaccugggccaaggacuccaaagccgcggggacaccgggaagugcagcgggccaggcaggcu

SEQ ID NO: 485304 - RNA, 64 nt, Human
gaugaguucugagugucgggcugcccacuggugacaccgggaucgggcugagcaggagaacauc

SEQ ID NO: 485305 - RNA, 64 nt, Human
acugcugacuggcuucacuggaauagguucaggucaccgggacuucucucagagucagcggccc

SEQ ID NO: 485306 - RNA, 64 nt, Human
ggcagacuucauucugaggcuuuggacaagcuaucaccgggaacccucccuguccccuucccga

SEQ ID NO: 485307 - RNA, 58 nt, Human
uuaaugugaagcuuauuuauaauagcaauaaaccuaacuggauuuggaugaagaaguc

SEQ ID NO: 485308 - RNA, 58 nt, Human
ugggagauuuagauaauguauccagauuuaaaccuaccaguuuguccuaccccuuaag

SEQ ID NO: 485309 - RNA, 58 nt, Human
uuuuuuacuuuggaaaggacaauaacuauaaaccuauauccagauuuucuuucugcug

SEQ ID NO: 485310 - RNA, 58 nt, Human
uagggcuucccuuaguuaaugguuauuauaaaccuauuaauucaucuguuuuaaccau

SEQ ID NO: 485311 - RNA, 64 nt, Human
cauugcgggcagugcuggacgugucccggagacccaccgggagggcgccgccaugccuuguacc

SEQ ID NO: 485312 - RNA, 64 nt, Human
ccagaggcuggaguggggguguguuagagccccucaccgggacuugcugugcggauggggccug

SEQ ID NO: 485313 - RNA, 64 nt, Human
gccucaagugauccucuuaccuuggccucccaaacaccgggauuauaggcgugagcccccgugc

SEQ ID NO: 485314 - RNA, 64 nt, Human
ggccugccccucaucugcgaaagaagagcccagacaccgggaaccccugacccaggaggcugga

SEQ ID NO: 485315 - RNA, 64 nt, Human
cucuccugaucacagcugcaugccgaccuugucccaccgggacccacaauggcccgagcccucu

SEQ ID NO: 485316 - RNA, 64 nt, Human
uacuuaaaccagacagcaggguucagagguggcacaccgggacaaagcugaggcccugcaccuc

SEQ ID NO: 485317 - RNA, 64 nt, Human
gcaugggagagcugucccuccuucuccaccugcccaccgggacacucccccugcucucuagaaa

SEQ ID NO: 485318 - RNA, 64 nt, Human
gggacaggcaccaugcugggccgggguguggaaucaccgggaacgcccccgcccccgccccgcu

SEQ ID NO: 485319 - RNA, 64 nt, Human
uugccuucgauuucggcaaagccugggcaggugccaccgggaaggaauggcauccgagaugcug

SEQ ID NO: 485320 - RNA, 64 nt, Human
cagaggcgcugaggugugcugggugcacuggagccaccgggaccccuugaggacaucgccaggc

SEQ ID NO: 485321 - RNA, 64 nt, Human
ccuccgcccagucaccaucaggccacucccucugcaccgggaccuggggcugggccgccucgug

SEQ ID NO: 485322 - RNA, 64 nt, Human
uggaccucagagcccacucuccuuggcacccugacaccgggaggccucauggccaacaauggac

SEQ ID NO: 485323 - RNA, 64 nt, Human
cacagaaauggagggcgcccaggauccaggcagccaccgggaacagucagcuuucuuuauuaaa

SEQ ID NO: 485324 - RNA, 64 nt, Human
uuaauucuuagcaagcuccuuguucucuacuguucaccgggaccuggcuggcaaaugacuuagc

SEQ ID NO: 485325 - RNA, 53 nt, Human
gccgccggucugggacuuagugucaccgggaggaaaagagagagaucuggggc

SEQ ID NO: 485326 - RNA, 58 nt, Human
aaauaguaauuuuuuacauuuuccuguguaaaccuaauugugguagaaauuuuuacca

SEQ ID NO: 485327 - RNA, 58 nt, Human
auacucaaggugagaauuaaguuuuaaauaaaccuauaauauuuuaucugaauaaugu

SEQ ID NO: 485328 - RNA, 58 nt, Human
gucuagaguugagagacaaagguaauuauaaaccuauuugaacuagcuucuugucuua

SEQ ID NO: 485329 - RNA, 58 nt, Human
ggccaucuucuucugacaugguccuaaauaaaccuaacugaguagccagaagaaucac

SEQ ID NO: 485330 - RNA, 64 nt, Human
ccggcugggccccagaccccagcuuccugcccuccaccgggagucugcaugguugggaguccug

SEQ ID NO: 485331 - RNA, 64 nt, Human
ccugaggcucccccugcagguggggggguacccgcaccgggaaugagcaggcucagcagggggg

SEQ ID NO: 485332 - RNA, 64 nt, Human
cagaaaggauguuuugucccauuuccuuggaggccaccgggacagaccuggacacuagggucag

SEQ ID NO: 485333 - RNA, 64 nt, Human
guccucaucucuacccauccccugaugcccaggucaccgggagggcugcugggagccucuccug

SEQ ID NO: 485334 - RNA, 64 nt, Human
gcgcuaagucgcgagccagguuuaaccguugcgucaccgggacccgagcccccgcgaugcccug

SEQ ID NO: 485335 - RNA, 64 nt, Human
uaguugaaggacuccuguuccguuggggccagcacaccgggauggauggagggagagcagaggc

SEQ ID NO: 485336 - RNA, 64 nt, Human
uauguggccaaggagauaauuuaucucacagaagcaccgggaagacuuagccuuaaagagccua

SEQ ID NO: 485337 - RNA, 64 nt, Human
ucacauuucucacugccuucugucugcccaguuucaccgggagaagucggccucuuccugaugg

SEQ ID NO: 485338 - RNA, 64 nt, Human
agcgcuugguggaaucugggcuggggaaagacggcaccgggaaacucugcuuccccauuguuuc

SEQ ID NO: 485339 - RNA, 63 nt, Human
agaagccuagcagggucugaggccucggccuugcaccgggacgccgaguuugggacaccgaac

SEQ ID NO: 485340 - RNA, 64 nt, Human
uuugggaaauuuuauaaugcuuguucuguuaacucaccgggaccuugaggguccaaugggaccu

SEQ ID NO: 485341 - RNA, 64 nt, Human
ucgagaccugaggcuggcucaagccggcugccuucaccgggagccacgccgugcauggcagccu

SEQ ID NO: 485342 - RNA, 64 nt, Human
gacaaacacuaaacaauacaaccaugaaauugaucaccgggauugcaaaucuaauugggaaaag

SEQ ID NO: 485343 - RNA, 64 nt, Human
uccccuucugugucacaguucuuggugacugucccaccgggagccucccccucagaugaucucu

SEQ ID NO: 485344 - RNA, 64 nt, Human
aguaagggaucaugcucaccacuggagaagcuuacaccgggacuuuuuuucuuuuuucuuuuuu

SEQ ID NO: 485345 - RNA, 58 nt, Human
auuagcuuugacaaccauacuguaacauuaaaccuagcauuccacaagagaauaaaua

SEQ ID NO: 485346 - RNA, 58 nt, Human
uggccucuagccccgaauugaacacuuuuaaaccuaaagagccuuauuauuauuagcu

SEQ ID NO: 485347 - RNA, 58 nt, Human
accuuucuuuuuaauguaaauacaaauuuaaaccuaggcuuaauauaggcguuucccc

SEQ ID NO: 485348 - RNA, 58 nt, Human
uuagugcacugauuauaguacugacagauaaaccuagauaaagagauagagagugagu

SEQ ID NO: 485349 - RNA, 64 nt, Human
ugucaaacaguucuuaguugcuggcucugcucggcaccgggacugugaaggguguacucccugc

SEQ ID NO: 485350 - RNA, 64 nt, Human
auuucuucugcaaagaaaguuguggggcauaagacaccgggaaugagggaggaggaagacaguu

SEQ ID NO: 485351 - RNA, 64 nt, Human
cuuuguuuacacuuggagccaccuuggugugggucaccgggacaguguacuccucuccugccag

SEQ ID NO: 485352 - RNA, 64 nt, Human
aagugcccaguggagccugccgcccccgccugggcaccgggacccccucaccauccagugggcc

SEQ ID NO: 485353 - RNA, 64 nt, Human
ugacuuugaggccccaacaugacagccacugggccaccgggacccaagaagacagcccccugcc

SEQ ID NO: 485354 - RNA, 64 nt, Human
uucccuaccccauuuguggucacagccaugaagucaccgggaugaaccuauccuuccaguggcu

SEQ ID NO: 485355 - RNA, 64 nt, Human
cagucaguggaaggcgggggggcccuggccucugcaccgggaucccagugggaaccuucaugcc

SEQ ID NO: 485356 - RNA, 64 nt, Human
uccuucacguccucccuucucagccucguccaagcaccgggaagaccuccaggcugaccccuug

SEQ ID NO: 485357 - RNA, 64 nt, Human
aggccagcugaggccccaagugcccaggcuuggucaccgggaagaacaacucucaucccacaau

SEQ ID NO: 485358 - RNA, 64 nt, Human
augaaauccgugugugaggcggacaguggguggccaccgggagcucuuggcugcaucuucuccc

SEQ ID NO: 485359 - RNA, 64 nt, Human
uccugacccccaaguggcaugcagcccccaugcccaccgggaccuggucagcacagaucuugau

SEQ ID NO: 485360 - RNA, 64 nt, Human
ugacacgucccccggucuaggaucgaaauguuaacaccgggagcucuccaggccacucacccag

SEQ ID NO: 485361 - RNA, 64 nt, Human
cuccgggaagccuucccugcccagcccacgccgccaccgggaggaagccugacuguccuuuggc

SEQ ID NO: 485362 - RNA, 64 nt, Human
cuuugaugucuucaucuguaugggguggaaaaaucaccgggaaucccccuucaguucuuugaaa

SEQ ID NO: 485363 - RNA, 64 nt, Human
gcuguagucacacauccuaaaggccaagcaaacccaccgggaugguggggggucuuggagccaa

SEQ ID NO: 485364 - RNA, 58 nt, Human
aauuaaauauaccuguuaaguucguaucuaaaccuaagacauuaccaagguuuguaca

SEQ ID NO: 485365 - RNA, 58 nt, Human
auuggguucuaguggacucugcuacacuuaaaccuaugugacaaaccgcccauuauuu

SEQ ID NO: 485366 - RNA, 58 nt, Human
guuuguuuuguuuuauuuuuuaaugaaauaaaccuauauuccugauuauuagucuauu

SEQ ID NO: 485367 - RNA, 64 nt, Human
guacacccugaguggacucuaucccucccccuuccaccgggacaacuucagcccuuaccuguuu

SEQ ID NO: 485368 - RNA, 64 nt, Human
aucucucauccuauccccgacccccuccggggaacaccgggaaggcucgacgcuccaggacagg

SEQ ID NO: 485369 - RNA, 64 nt, Human
aauuuaaaccugaugacuugcacagcaucuuucccaccgggaagagcgggccugcugccuuccc

SEQ ID NO: 485370 - RNA, 57 nt, Human
uucuacaggaauaccucugagccugcccaccgggagccgccacaucacagcacaagu

SEQ ID NO: 485371 - RNA, 64 nt, Human
aaaagaaaagaaaaaaaaucucaucacuugaagccaccgggagccugcggcccgggccagcccg

SEQ ID NO: 485372 - RNA, 64 nt, Human
ugagcagugggaaaaggcuaauguaagcaguccccaccgggaguuccccccugcuaccgccaga

SEQ ID NO: 485373 - RNA, 64 nt, Human
agauuaugguacuguggaacaugagggcagaggacaccgggaggcuguuagggggucacugaau

SEQ ID NO: 485374 - RNA, 64 nt, Human
ggcggggcaucagaggcucaaggugcugagaagccaccgggaaagcagccagcacaaagggccc

SEQ ID NO: 485375 - RNA, 64 nt, Human
ugcacagaacugggguaagaagacaaagaguagccaccgggagaggcuuccuuuguuacagcug

SEQ ID NO: 485376 - RNA, 64 nt, Human
uggguggccggcccugccccccacauucuggcuccaccgggagggacagucuggaggucccaga

SEQ ID NO: 485377 - RNA, 64 nt, Human
aggugugaugugggaagacaccgcagagcucacucaccgggacucgcccuuccugugcucuuac

SEQ ID NO: 485378 - RNA, 64 nt, Human
cugcacaccuccaagucagggcaccacaacacgccaccgggagagaugcugagaaaaacccaag

SEQ ID NO: 485379 - RNA, 64 nt, Human
uugaggaguauuuucugcaggauaagauguucaucaccgggaaccaaaucucacuggcugaccu

SEQ ID NO: 485380 - RNA, 64 nt, Human
ggcuccucagcucccucagugugccccguggugucaccgggacuccaggcacccgcuccccugc

SEQ ID NO: 485381 - RNA, 64 nt, Human
uggccuugacaugcuucuucgaggguuggcagcacaccgggaggggaugcuuggacaaguuucu

SEQ ID NO: 485382 - RNA, 58 nt, Human
ugauucucauacccaggaacuguaaauuuaaaccuaaauauuuggccaauaguuuuca

SEQ ID NO: 485383 - RNA, 58 nt, Human
uuggguacaaggcauuucugacauuuuauaaaccuacauuuaaggggaauuuuuaaag

SEQ ID NO: 485384 - RNA, 55 nt, Human
acgugaccucagaugauuaaaaacauaaaccuaaccccacagaaacggacaacau

SEQ ID NO: 485385 - RNA, 64 nt, Human
cgccgucuccuaccugcacagccuggggaucgugcaccgggaccucaaggugccuggcuggggc

SEQ ID NO: 485386 - RNA, 64 nt, Human
ugcuauaucaaacuccuucccugaaaccagcaaacaccgggaaacauuuuggcucauuauaauc

SEQ ID NO: 485387 - RNA, 64 nt, Human; identical to SEQ ID NO: 411022

SEQ ID NO: 485388 - RNA, 64 nt, Human; identical to SEQ ID NO: 411023

SEQ ID NO: 485389 - RNA, 64 nt, Human; identical to SEQ ID NO: 411024

SEQ ID NO: 485390 - RNA, 64 nt, Human; identical to SEQ ID NO: 411029

SEQ ID NO: 485391 - RNA, 64 nt, Human; identical to SEQ ID NO: 411030

SEQ ID NO: 485392 - RNA, 64 nt, Human; identical to SEQ ID NO: 411031

SEQ ID NO: 485393 - RNA, 64 nt, Human; identical to SEQ ID NO: 411032

SEQ ID NO: 485394 - RNA, 64 nt, Human; identical to SEQ ID NO: 411033

SEQ ID NO: 485395 - RNA, 58 nt, Human
aauucuguauggcuucuauauaaauauuuaaaccuauauagcggguucuucccaccgc

SEQ ID NO: 485396 - RNA, 58 nt, Human
ccaggugcgccaucaggaggagagaagcuaaaccuaggggggacauggagggcgguug

SEQ ID NO: 485397 - RNA, 58 nt, Human
aaggauuuuaauaaaauuuucaauagaauaaaccuaaucuguauggauacuuuaucaa

SEQ ID NO: 485398 - RNA, 64 nt, Human; identical to SEQ ID NO: 411034

SEQ ID NO: 485399 - RNA, 64 nt, Human; identical to SEQ ID NO: 411035

SEQ ID NO: 485400 - RNA, 64 nt, Human; identical to SEQ ID NO: 411036

SEQ ID NO: 485401 - RNA, 64 nt, Human; identical to SEQ ID NO: 411037

SEQ ID NO: 485402 - RNA, 64 nt, Human; identical to SEQ ID NO: 411038

SEQ ID NO: 485403 - RNA, 64 nt, Human; identical to SEQ ID NO: 411039

SEQ ID NO: 485404 - RNA, 64 nt, Human; identical to SEQ ID NO: 411040

SEQ ID NO: 485405 - RNA, 64 nt, Human; identical to SEQ ID NO: 411041

SEQ ID NO: 485406 - RNA, 64 nt, Human; identical to SEQ ID NO: 411042

SEQ ID NO: 485407 - RNA, 64 nt, Human; identical to SEQ ID NO: 411043

SEQ ID NO: 485408 - RNA, 64 nt, Human; identical to SEQ ID NO: 411044

SEQ ID NO: 485409 - RNA, 64 nt, Human; identical to SEQ ID NO: 411048

SEQ ID NO: 485410 - RNA, 64 nt, Human; identical to SEQ ID NO: 411049

SEQ ID NO: 485411 - RNA, 64 nt, Human; identical to SEQ ID NO: 411050

SEQ ID NO: 485412 - RNA, 64 nt, Human; identical to SEQ ID NO: 411051

SEQ ID NO: 485413 - RNA, 58 nt, Human
acugaugagaucaacaacaggugaacuauaaaccuauuauuuauugcagaacuaauaa

SEQ ID NO: 485414 - RNA, 58 nt, Human
aauauauacuugaaauaagcugagaauuuaaaccuauuauuguuauaaugaaagaaug

SEQ ID NO: 485415 - RNA, 58 nt, Human
uguuuuguuuuuguaauagcuuaacaaauaaaccuagguuuucuauauuacuuugcuc

SEQ ID NO: 485416 - RNA, 64 nt, Human; identical to SEQ ID NO: 411052

SEQ ID NO: 485417 - RNA, 64 nt, Human; identical to SEQ ID NO: 411053

SEQ ID NO: 485418 - RNA, 64 nt, Human; identical to SEQ ID NO: 411054

SEQ ID NO: 485419 - RNA, 64 nt, Human; identical to SEQ ID NO: 411055

SEQ ID NO: 485420 - RNA, 64 nt, Human; identical to SEQ ID NO: 411056

SEQ ID NO: 485421 - RNA, 64 nt, Human; identical to SEQ ID NO: 411057

SEQ ID NO: 485422 - RNA, 64 nt, Human; identical to SEQ ID NO: 411058

SEQ ID NO: 485423 - RNA, 64 nt, Human; identical to SEQ ID NO: 411059

SEQ ID NO: 485424 - RNA, 64 nt, Human; identical to SEQ ID NO: 411060

SEQ ID NO: 485425 - RNA, 64 nt, Human; identical to SEQ ID NO: 411061

SEQ ID NO: 485426 - RNA, 64 nt, Human; identical to SEQ ID NO: 411062

SEQ ID NO: 485427 - RNA, 64 nt, Human; identical to SEQ ID NO: 411063

SEQ ID NO: 485428 - RNA, 64 nt, Human; identical to SEQ ID NO: 411067

SEQ ID NO: 485429 - RNA, 64 nt, Human; identical to SEQ ID NO: 411068

SEQ ID NO: 485430 - RNA, 64 nt, Human; identical to SEQ ID NO: 411069

SEQ ID NO: 485431 - RNA, 58 nt, Human
aauaaacuuagaacauaugcauuaauacuaaaccuaugcaguaauaccauaauuagcc

SEQ ID NO: 485432 - RNA, 58 nt, Human
acuauacaagcauuaaacuggagugcaguaaaccuaggaaccuucccacaauuguuuu

SEQ ID NO: 485433 - RNA, 58 nt, Human
uuuuggugauguaaaacagaauauucuguaaaccuaaugucuguauaaauaaugagcg

SEQ ID NO: 485434 - RNA, 64 nt, Human; identical to SEQ ID NO: 411070

SEQ ID NO: 485435 - RNA, 64 nt, Human; identical to SEQ ID NO: 411071

SEQ ID NO: 485436 - RNA, 64 nt, Human; identical to SEQ ID NO: 411072

SEQ ID NO: 485437 - RNA, 64 nt, Human; identical to SEQ ID NO: 411073

SEQ ID NO: 485438 - RNA, 64 nt, Human; identical to SEQ ID NO: 411074

SEQ ID NO: 485439 - RNA, 64 nt, Human; identical to SEQ ID NO: 411075

SEQ ID NO: 485440 - RNA, 64 nt, Human; identical to SEQ ID NO: 411076

SEQ ID NO: 485441 - RNA, 64 nt, Human; identical to SEQ ID NO: 411077

SEQ ID NO: 485442 - RNA, 64 nt, Human; identical to SEQ ID NO: 411078

SEQ ID NO: 485443 - RNA, 64 nt, Human; identical to SEQ ID NO: 411079

SEQ ID NO: 485444 - RNA, 64 nt, Human; identical to SEQ ID NO: 411080

SEQ ID NO: 485445 - RNA, 64 nt, Human; identical to SEQ ID NO: 411081

SEQ ID NO: 485446 - RNA, 64 nt, Human; identical to SEQ ID NO: 411082

SEQ ID NO: 485447 - RNA, 64 nt, Human; identical to SEQ ID NO: 411086

SEQ ID NO: 485448 - RNA, 64 nt, Human; identical to SEQ ID NO: 411087

SEQ ID NO: 485449 - RNA, 58 nt, Human
gccggcccuuuucucagagaucacucaauaaaccuaagaacccuccuaccggcuccag

SEQ ID NO: 485450 - RNA, 58 nt, Human
uuugcagaucaagcuuuauucugaagaauaaaccuagcuggcaugcugguguguaccu

SEQ ID NO: 485451 - RNA, 58 nt, Human
uaaauuacaauuuauuugagguuauuccuaaaccuauuuauuugguguuuuggaggag

SEQ ID NO: 485452 - RNA, 64 nt, Human; identical to SEQ ID NO: 411088

SEQ ID NO: 485453 - RNA, 56 nt, Human; identical to SEQ ID NO: 411089

SEQ ID NO: 485454 - RNA, 64 nt, Human; identical to SEQ ID NO: 411090

SEQ ID NO: 485455 - RNA, 64 nt, Human; identical to SEQ ID NO: 411091

SEQ ID NO: 485456 - RNA, 64 nt, Human; identical to SEQ ID NO: 411092

SEQ ID NO: 485457 - RNA, 64 nt, Human; identical to SEQ ID NO: 411093

SEQ ID NO: 485458 - RNA, 64 nt, Human; identical to SEQ ID NO: 411094

SEQ ID NO: 485459 - RNA, 64 nt, Human; identical to SEQ ID NO: 411095

SEQ ID NO: 485460 - RNA, 64 nt, Human; identical to SEQ ID NO: 411096

SEQ ID NO: 485461 - RNA, 64 nt, Human; identical to SEQ ID NO: 411097

SEQ ID NO: 485462 - RNA, 64 nt, Human; identical to SEQ ID NO: 411098

SEQ ID NO: 485463 - RNA, 64 nt, Human; identical to SEQ ID NO: 411099

SEQ ID NO: 485464 - RNA, 64 nt, Human; identical to SEQ ID NO: 411100

SEQ ID NO: 485465 - RNA, 64 nt, Human; identical to SEQ ID NO: 411101

SEQ ID NO: 485466 - RNA, 64 nt, Human; identical to SEQ ID NO: 411105

SEQ ID NO: 485467 - RNA, 58 nt, Human
gaauauuuauaguugauucuuaacugcauaaaccuagauauaccauuaucccuuuuau

SEQ ID NO: 485468 - RNA, 58 nt, Human
accaaauggaagccuagcagcugcuccauaaaccuagccccauucuucauaucaauuu

SEQ ID NO: 485469 - RNA, 58 nt, Human
acccuuggggacagccaaguuuuguugauaaaccuauuuccuagcaugccuucaggaa

SEQ ID NO: 485470 - RNA, 64 nt, Human; identical to SEQ ID NO: 411106

SEQ ID NO: 485471 - RNA, 64 nt, Human; identical to SEQ ID NO: 411107

SEQ ID NO: 485472 - RNA, 64 nt, Human; identical to SEQ ID NO: 411108

SEQ ID NO: 485473 - RNA, 64 nt, Human; identical to SEQ ID NO: 411109

SEQ ID NO: 485474 - RNA, 64 nt, Human; identical to SEQ ID NO: 411110

SEQ ID NO: 485475 - RNA, 64 nt, Human; identical to SEQ ID NO: 411111

SEQ ID NO: 485476 - RNA, 64 nt, Human; identical to SEQ ID NO: 411112

SEQ ID NO: 485477 - RNA, 64 nt, Human; identical to SEQ ID NO: 411113

SEQ ID NO: 485478 - RNA, 64 nt, Human; identical to SEQ ID NO: 411114

SEQ ID NO: 485479 - RNA, 64 nt, Human; identical to SEQ ID NO: 411115

SEQ ID NO: 485480 - RNA, 64 nt, Human; identical to SEQ ID NO: 411116

SEQ ID NO: 485481 - RNA, 64 nt, Human; identical to SEQ ID NO: 411117

SEQ ID NO: 485482 - RNA, 64 nt, Human; identical to SEQ ID NO: 411118

SEQ ID NO: 485483 - RNA, 64 nt, Human; identical to SEQ ID NO: 411119

SEQ ID NO: 485484 - RNA, 64 nt, Human; identical to SEQ ID NO: 411120

SEQ ID NO: 485485 - RNA, 58 nt, Human
uuaaaaauacucugcugccuauacaauguaaaccuaggagcauuaagacuugucacac

SEQ ID NO: 485486 - RNA, 58 nt, Human
agaaagaagcaaaaguggaaaccccuaauaaaccuaucagaucuugugagacuuacua

SEQ ID NO: 485487 - RNA, 58 nt, Human
uuugcuuaguuuauuugaauaaaagcucuaaaccuagguuauauauuagccauuccua

SEQ ID NO: 485488 - RNA, 64 nt, Human; identical to SEQ ID NO: 411124

SEQ ID NO: 485489 - RNA, 64 nt, Human; identical to SEQ ID NO: 411125

SEQ ID NO: 485490 - RNA, 64 nt, Human; identical to SEQ ID NO: 411126

SEQ ID NO: 485491 - RNA, 64 nt, Human; identical to SEQ ID NO: 411127

SEQ ID NO: 485492 - RNA, 64 nt, Human; identical to SEQ ID NO: 411128

SEQ ID NO: 485493 - RNA, 64 nt, Human; identical to SEQ ID NO: 411129

SEQ ID NO: 485494 - RNA, 64 nt, Human; identical to SEQ ID NO: 411130

SEQ ID NO: 485495 - RNA, 64 nt, Human; identical to SEQ ID NO: 411131

SEQ ID NO: 485496 - RNA, 64 nt, Human; identical to SEQ ID NO: 411132

SEQ ID NO: 485497 - RNA, 64 nt, Human; identical to SEQ ID NO: 411133

SEQ ID NO: 485498 - RNA, 64 nt, Human; identical to SEQ ID NO: 411134

SEQ ID NO: 485499 - RNA, 64 nt, Human; identical to SEQ ID NO: 411135

SEQ ID NO: 485500 - RNA, 64 nt, Human; identical to SEQ ID NO: 411136

SEQ ID NO: 485501 - RNA, 64 nt, Human; identical to SEQ ID NO: 411137

SEQ ID NO: 485502 - RNA, 64 nt, Human; identical to SEQ ID NO: 411138

SEQ ID NO: 485503 - RNA, 58 nt, Human
gcggacccaagaauguaaauaauauucauaaaccuaugggagacucgugugacuauuu

SEQ ID NO: 485504 - RNA, 58 nt, Human
aaaaucuagccauuuauauuuaguuguguaaaccuaaauuaaaugcuguaguauuuug

SEQ ID NO: 485505 - RNA, 58 nt, Human
acaacaacaaaauuauaaagguagaaaauaaaccuaaauugugucguaauuaagauua

SEQ ID NO: 485506 - RNA, 64 nt, Human; identical to SEQ ID NO: 411139

SEQ ID NO: 485507 - RNA, 64 nt, Human; identical to SEQ ID NO: 411143

SEQ ID NO: 485508 - RNA, 64 nt, Human; identical to SEQ ID NO: 411144

SEQ ID NO: 485509 - RNA, 64 nt, Human; identical to SEQ ID NO: 411145

SEQ ID NO: 485510 - RNA, 64 nt, Human; identical to SEQ ID NO: 411146

SEQ ID NO: 485511 - RNA, 64 nt, Human; identical to SEQ ID NO: 411147

SEQ ID NO: 485512 - RNA, 64 nt, Human; identical to SEQ ID NO: 411148

SEQ ID NO: 485513 - RNA, 64 nt, Human; identical to SEQ ID NO: 411149

SEQ ID NO: 485514 - RNA, 64 nt, Human; identical to SEQ ID NO: 411150

SEQ ID NO: 485515 - RNA, 64 nt, Human; identical to SEQ ID NO: 411151

SEQ ID NO: 485516 - RNA, 64 nt, Human; identical to SEQ ID NO: 411152

SEQ ID NO: 485517 - RNA, 64 nt, Human; identical to SEQ ID NO: 411153

SEQ ID NO: 485518 - RNA, 64 nt, Human; identical to SEQ ID NO: 411154

SEQ ID NO: 485519 - RNA, 64 nt, Human; identical to SEQ ID NO: 411155

SEQ ID NO: 485520 - RNA, 64 nt, Human; identical to SEQ ID NO: 411156

SEQ ID NO: 485521 - RNA, 58 nt, Human
gaaaaacaacaaaguacagauuuauacauaaaccuaaaagcauuugaacaugacaccc

SEQ ID NO: 485522 - RNA, 58 nt, Human
aucguaaaaccaucuuaugccugacuauuaaaccuauucuucauaaacacaagaacac

SEQ ID NO: 485523 - RNA, 58 nt, Human
ugcuaauauugagaaugugucaaguuuguaaaccuaacuuuuaagaugccagauucuu

SEQ ID NO: 485524 - RNA, 64 nt, Human; identical to SEQ ID NO: 411157

SEQ ID NO: 485525 - RNA, 64 nt, Human; identical to SEQ ID NO: 411158

SEQ ID NO: 485526 - RNA, 64 nt, Human; identical to SEQ ID NO: 411162

SEQ ID NO: 485527 - RNA, 64 nt, Human; identical to SEQ ID NO: 411163

SEQ ID NO: 485528 - RNA, 64 nt, Human; identical to SEQ ID NO: 411164

SEQ ID NO: 485529 - RNA, 64 nt, Human; identical to SEQ ID NO: 411165

SEQ ID NO: 485530 - RNA, 64 nt, Human; identical to SEQ ID NO: 411166

SEQ ID NO: 485531 - RNA, 64 nt, Human; identical to SEQ ID NO: 411167

SEQ ID NO: 485532 - RNA, 64 nt, Human; identical to SEQ ID NO: 411168

SEQ ID NO: 485533 - RNA, 64 nt, Human; identical to SEQ ID NO: 411169

SEQ ID NO: 485534 - RNA, 64 nt, Human; identical to SEQ ID NO: 411170

SEQ ID NO: 485535 - RNA, 64 nt, Human; identical to SEQ ID NO: 411171

SEQ ID NO: 485536 - RNA, 64 nt, Human; identical to SEQ ID NO: 411172

SEQ ID NO: 485537 - RNA, 64 nt, Human; identical to SEQ ID NO: 411173

SEQ ID NO: 485538 - RNA, 64 nt, Human; identical to SEQ ID NO: 411174

SEQ ID NO: 485539 - RNA, 58 nt, Human
uuaaauuuucacuuuuuauggaugagcauaaaccuagucuuaguuuaaaggcaaacua

SEQ ID NO: 485540 - RNA, 58 nt, Human
gcuucccuuacuuugcugaggguuugaauaaaccuaggacuuccgagcuaugucagua

SEQ ID NO: 485541 - RNA, 58 nt, Human
ggagagggggccugggacuuccaugccuuaaaccuaccucccacacucccaagguugg

SEQ ID NO: 485542 - RNA, 64 nt, Human; identical to SEQ ID NO: 411175

SEQ ID NO: 485543 - RNA, 64 nt, Human; identical to SEQ ID NO: 411176

SEQ ID NO: 485544 - RNA, 64 nt, Human; identical to SEQ ID NO: 411177

SEQ ID NO: 485545 - RNA, 64 nt, Human; identical to SEQ ID NO: 411181

SEQ ID NO: 485546 - RNA, 64 nt, Human; identical to SEQ ID NO: 411182

SEQ ID NO: 485547 - RNA, 64 nt, Human; identical to SEQ ID NO: 411183

SEQ ID NO: 485548 - RNA, 64 nt, Human; identical to SEQ ID NO: 411184

SEQ ID NO: 485549 - RNA, 64 nt, Human; identical to SEQ ID NO: 411185

SEQ ID NO: 485550 - RNA, 64 nt, Human; identical to SEQ ID NO: 411186

SEQ ID NO: 485551 - RNA, 64 nt, Human; identical to SEQ ID NO: 411187

SEQ ID NO: 485552 - RNA, 64 nt, Human; identical to SEQ ID NO: 411188

SEQ ID NO: 485553 - RNA, 64 nt, Human; identical to SEQ ID NO: 411189

SEQ ID NO: 485554 - RNA, 64 nt, Human; identical to SEQ ID NO: 411190

SEQ ID NO: 485555 - RNA, 64 nt, Human; identical to SEQ ID NO: 411191

SEQ ID NO: 485556 - RNA, 64 nt, Human; identical to SEQ ID NO: 411192

SEQ ID NO: 485557 - RNA, 58 nt, Human
ggguuuucaucuaugaggguguuuccucuaaaccuacgagggaggaacaccugaucuu

SEQ ID NO: 485558 - RNA, 58 nt, Human
ucucugguugucuagucauugucauaaguaaaccuaguaaaaccuuguucuauuuuuc

SEQ ID NO: 485559 - RNA, 58 nt, Human
aguuuuccauaaacuguuacacaaaauauaaaccuaacguguauuuuucaggacugcg

SEQ ID NO: 485560 - RNA, 64 nt, Human; identical to SEQ ID NO: 411193

SEQ ID NO: 485561 - RNA, 64 nt, Human; identical to SEQ ID NO: 411194

SEQ ID NO: 485562 - RNA, 64 nt, Human; identical to SEQ ID NO: 411195

SEQ ID NO: 485563 - RNA, 64 nt, Human; identical to SEQ ID NO: 411196

SEQ ID NO: 485564 - RNA, 64 nt, Human; identical to SEQ ID NO: 411200

SEQ ID NO: 485565 - RNA, 64 nt, Human; identical to SEQ ID NO: 411201

SEQ ID NO: 485566 - RNA, 64 nt, Human; identical to SEQ ID NO: 411202

SEQ ID NO: 485567 - RNA, 64 nt, Human; identical to SEQ ID NO: 411203

SEQ ID NO: 485568 - RNA, 64 nt, Human; identical to SEQ ID NO: 411204

SEQ ID NO: 485569 - RNA, 64 nt, Human; identical to SEQ ID NO: 411205

SEQ ID NO: 485570 - RNA, 64 nt, Human; identical to SEQ ID NO: 411206

SEQ ID NO: 485571 - RNA, 64 nt, Human; identical to SEQ ID NO: 411207

SEQ ID NO: 485572 - RNA, 64 nt, Human; identical to SEQ ID NO: 411208

SEQ ID NO: 485573 - RNA, 64 nt, Human; identical to SEQ ID NO: 411209

SEQ ID NO: 485574 - RNA, 64 nt, Human; identical to SEQ ID NO: 411210

SEQ ID NO: 485575 - RNA, 58 nt, Human
gcggggcaaguaagguugagccugacuguaaaccuagaacugcggaaggacugggacu

SEQ ID NO: 485576 - RNA, 58 nt, Human
ccgcggugcaugaggcugggugcaguucuaaaccuacauucucgauuuuucuuaagcc

SEQ ID NO: 485577 - RNA, 58 nt, Human
acuuucaggagugagcaaguccuacuuauaaaccuauauuaacuuuauuuuugagaua

SEQ ID NO: 485578 - RNA, 64 nt, Human; identical to SEQ ID NO: 411211

SEQ ID NO: 485579 - RNA, 64 nt, Human; identical to SEQ ID NO: 411212

SEQ ID NO: 485580 - RNA, 64 nt, Human; identical to SEQ ID NO: 411213

SEQ ID NO: 485581 - RNA, 64 nt, Human; identical to SEQ ID NO: 411214

SEQ ID NO: 485582 - RNA, 64 nt, Human; identical to SEQ ID NO: 411215

SEQ ID NO: 485583 - RNA, 64 nt, Human; identical to SEQ ID NO: 411219

SEQ ID NO: 485584 - RNA, 64 nt, Human; identical to SEQ ID NO: 411220

SEQ ID NO: 485585 - RNA, 64 nt, Human; identical to SEQ ID NO: 411221

SEQ ID NO: 485586 - RNA, 64 nt, Human; identical to SEQ ID NO: 411222

SEQ ID NO: 485587 - RNA, 64 nt, Human; identical to SEQ ID NO: 411223

SEQ ID NO: 485588 - RNA, 64 nt, Human; identical to SEQ ID NO: 411224

SEQ ID NO: 485589 - RNA, 64 nt, Human; identical to SEQ ID NO: 411225

SEQ ID NO: 485590 - RNA, 64 nt, Human; identical to SEQ ID NO: 411226

SEQ ID NO: 485591 - RNA, 64 nt, Human; identical to SEQ ID NO: 411227

SEQ ID NO: 485592 - RNA, 64 nt, Human; identical to SEQ ID NO: 411228

SEQ ID NO: 485593 - RNA, 58 nt, Human
ugcgaaaaccugaugagggcaaaccaguuaaaccuaacacccugccuugucugggcuc

SEQ ID NO: 485594 - RNA, 58 nt, Human
ucucaguaauggugaauauuucgcucuuuaaaccuaaaacucuucauugaguagcuua

SEQ ID NO: 485595 - RNA, 58 nt, Human
gauucgacuguuaaaucagugggucuuuuaaaccuacuccugguagggaaauagcuac

SEQ ID NO: 485596 - RNA, 64 nt, Human; identical to SEQ ID NO: 411229

SEQ ID NO: 485597 - RNA, 64 nt, Human; identical to SEQ ID NO: 411230

SEQ ID NO: 485598 - RNA, 64 nt, Human; identical to SEQ ID NO: 411231

SEQ ID NO: 485599 - RNA, 64 nt, Human; identical to SEQ ID NO: 411232

SEQ ID NO: 485600 - RNA, 64 nt, Human; identical to SEQ ID NO: 411233

SEQ ID NO: 485601 - RNA, 64 nt, Human; identical to SEQ ID NO: 411234

SEQ ID NO: 485602 - RNA, 64 nt, Human; identical to SEQ ID NO: 411238

SEQ ID NO: 485603 - RNA, 64 nt, Human; identical to SEQ ID NO: 411239

SEQ ID NO: 485604 - RNA, 64 nt, Human; identical to SEQ ID NO: 411240

SEQ ID NO: 485605 - RNA, 64 nt, Human; identical to SEQ ID NO: 411241

SEQ ID NO: 485606 - RNA, 64 nt, Human; identical to SEQ ID NO: 411242

SEQ ID NO: 485607 - RNA, 64 nt, Human; identical to SEQ ID NO: 411243

SEQ ID NO: 485608 - RNA, 64 nt, Human; identical to SEQ ID NO: 411244

SEQ ID NO: 485609 - RNA, 64 nt, Human; identical to SEQ ID NO: 411245

SEQ ID NO: 485610 - RNA, 64 nt, Human; identical to SEQ ID NO: 411246

SEQ ID NO: 485611 - RNA, 58 nt, Human
uuauguuuuaaaagcuaaccauuuuuauuaaaccuaugaguaagcagcucauccuaau

SEQ ID NO: 485612 - RNA, 58 nt, Human
acaauaucauauauauauucacagaguauaaaccuaaauaaugaucuauuagauucaa

SEQ ID NO: 485613 - RNA, 58 nt, Human
auauauauauauauaaaauaaauauauauaaaccuaaaaaagauauauuaaaaauaua

SEQ ID NO: 485614 - RNA, 64 nt, Human; identical to SEQ ID NO: 411247

SEQ ID NO: 485615 - RNA, 64 nt, Human; identical to SEQ ID NO: 411248

SEQ ID NO: 485616 - RNA, 64 nt, Human; identical to SEQ ID NO: 411249

SEQ ID NO: 485617 - RNA, 64 nt, Human; identical to SEQ ID NO: 411250

SEQ ID NO: 485618 - RNA, 64 nt, Human; identical to SEQ ID NO: 411251

SEQ ID NO: 485619 - RNA, 64 nt, Human; identical to SEQ ID NO: 411252

SEQ ID NO: 485620 - RNA, 64 nt, Human; identical to SEQ ID NO: 411253

SEQ ID NO: 485621 - RNA, 64 nt, Human; identical to SEQ ID NO: 411257

SEQ ID NO: 485622 - RNA, 64 nt, Human; identical to SEQ ID NO: 411258

SEQ ID NO: 485623 - RNA, 64 nt, Human; identical to SEQ ID NO: 411259

SEQ ID NO: 485624 - RNA, 64 nt, Human; identical to SEQ ID NO: 411260

SEQ ID NO: 485625 - RNA, 64 nt, Human; identical to SEQ ID NO: 411261

SEQ ID NO: 485626 - RNA, 59 nt, Human; identical to SEQ ID NO: 411262

SEQ ID NO: 485627 - RNA, 64 nt, Human; identical to SEQ ID NO: 411263

SEQ ID NO: 485628 - RNA, 64 nt, Human; identical to SEQ ID NO: 411264

SEQ ID NO: 485629 - RNA, 58 nt, Human
ugacugcauuaugcaugcgaggaugaaauaaaccuagaaguggcagaacacuggauuu

SEQ ID NO: 485630 - RNA, 58 nt, Human
ccaauaaagaucauguucccucuucaguuaaaccuaaguaguuucucacuuuuugaaa

SEQ ID NO: 485631 - RNA, 58 nt, Human
gcuguagguaccucccuaauaagauuucuaaaccuauaguuagugugaucaugacuuu

SEQ ID NO: 485632 - RNA, 64 nt, Human; identical to SEQ ID NO: 411265

SEQ ID NO: 485633 - RNA, 64 nt, Human; identical to SEQ ID NO: 411266

SEQ ID NO: 485634 - RNA, 64 nt, Human; identical to SEQ ID NO: 411267

SEQ ID NO: 485635 - RNA, 64 nt, Human; identical to SEQ ID NO: 411268

SEQ ID NO: 485636 - RNA, 64 nt, Human; identical to SEQ ID NO: 411269

SEQ ID NO: 485637 - RNA, 64 nt, Human; identical to SEQ ID NO: 411270

SEQ ID NO: 485638 - RNA, 64 nt, Human; identical to SEQ ID NO: 411271

SEQ ID NO: 485639 - RNA, 64 nt, Human; identical to SEQ ID NO: 411272

SEQ ID NO: 485640 - RNA, 64 nt, Human; identical to SEQ ID NO: 411276

SEQ ID NO: 485641 - RNA, 64 nt, Human; identical to SEQ ID NO: 411277

SEQ ID NO: 485642 - RNA, 64 nt, Human; identical to SEQ ID NO: 411278

SEQ ID NO: 485643 - RNA, 64 nt, Human; identical to SEQ ID NO: 411279

SEQ ID NO: 485644 - RNA, 64 nt, Human; identical to SEQ ID NO: 411280

SEQ ID NO: 485645 - RNA, 64 nt, Human; identical to SEQ ID NO: 411281

SEQ ID NO: 485646 - RNA, 64 nt, Human; identical to SEQ ID NO: 411282

SEQ ID NO: 485647 - RNA, 58 nt, Human
ugauuugggaaaaugagccuuaauuuguuaaaccuauacacugagaacuagccucagg

SEQ ID NO: 485648 - RNA, 58 nt, Human
cuauucaucuccuguccuucaguuuguauaaaccuaaggagagugugaaauccagcaa

SEQ ID NO: 485649 - RNA, 58 nt, Human
guaggagagguugucuguggccagaauuuaaaccuauacucacuuucccaaauugaau

SEQ ID NO: 485650 - RNA, 64 nt, Human; identical to SEQ ID NO: 411283

SEQ ID NO: 485651 - RNA, 64 nt, Human; identical to SEQ ID NO: 411284

SEQ ID NO: 485652 - RNA, 64 nt, Human; identical to SEQ ID NO: 411285

SEQ ID NO: 485653 - RNA, 57 nt, Human; identical to SEQ ID NO: 411286

SEQ ID NO: 485654 - RNA, 64 nt, Human; identical to SEQ ID NO: 411287

SEQ ID NO: 485655 - RNA, 64 nt, Human; identical to SEQ ID NO: 411288

SEQ ID NO: 485656 - RNA, 64 nt, Human; identical to SEQ ID NO: 411289

SEQ ID NO: 485657 - RNA, 64 nt, Human; identical to SEQ ID NO: 411290

SEQ ID NO: 485658 - RNA, 64 nt, Human; identical to SEQ ID NO: 411291

SEQ ID NO: 485659 - RNA, 64 nt, Human; identical to SEQ ID NO: 411295

SEQ ID NO: 485660 - RNA, 64 nt, Human; identical to SEQ ID NO: 411296

SEQ ID NO: 485661 - RNA, 64 nt, Human; identical to SEQ ID NO: 411297

SEQ ID NO: 485662 - RNA, 64 nt, Human; identical to SEQ ID NO: 411298

SEQ ID NO: 485663 - RNA, 64 nt, Human; identical to SEQ ID NO: 411299

SEQ ID NO: 485664 - RNA, 64 nt, Human; identical to SEQ ID NO: 411300

SEQ ID NO: 485665 - RNA, 58 nt, Human
caucaccaucuuuuucauuauauauuaguaaaccuaugaagggaugauucuuuaauuu

SEQ ID NO: 485666 - RNA, 58 nt, Human
gucuuuggugaaugguuuuauauauacauaaaccuaaaacauauaagacaaaaauuua

SEQ ID NO: 485667 - RNA, 58 nt, Human
gaaauuuagcugacuagggacaaacauguaaaccuauuuuccuaugaaaaaaauuuua

SEQ ID NO: 485668 - RNA, 64 nt, Human; identical to SEQ ID NO: 411301

SEQ ID NO: 485669 - RNA, 64 nt, Human; identical to SEQ ID NO: 411302

SEQ ID NO: 485670 - RNA, 64 nt, Human; identical to SEQ ID NO: 411303

SEQ ID NO: 485671 - RNA, 60 nt, Human; identical to SEQ ID NO: 411304

SEQ ID NO: 485672 - RNA, 64 nt, Human; identical to SEQ ID NO: 411305

SEQ ID NO: 485673 - RNA, 64 nt, Human; identical to SEQ ID NO: 411306

SEQ ID NO: 485674 - RNA, 64 nt, Human; identical to SEQ ID NO: 411307

SEQ ID NO: 485675 - RNA, 64 nt, Human; identical to SEQ ID NO: 411308

SEQ ID NO: 485676 - RNA, 64 nt, Human; identical to SEQ ID NO: 411309

SEQ ID NO: 485677 - RNA, 64 nt, Human; identical to SEQ ID NO: 411310

SEQ ID NO: 485678 - RNA, 64 nt, Human; identical to SEQ ID NO: 411314

SEQ ID NO: 485679 - RNA, 64 nt, Human; identical to SEQ ID NO: 411315

SEQ ID NO: 485680 - RNA, 64 nt, Human; identical to SEQ ID NO: 411316

SEQ ID NO: 485681 - RNA, 64 nt, Human; identical to SEQ ID NO: 411317

SEQ ID NO: 485682 - RNA, 64 nt, Human; identical to SEQ ID NO: 411318

SEQ ID NO: 485683 - RNA, 58 nt, Human
guuacugcaauaaaggaaguggauucauuaaaccuauuuaauguccauucuuauaucu

SEQ ID NO: 485684 - RNA, 58 nt, Human
acuugaguggucucugagcuccugucauuaaaccuaucuauaucugucuaucagcaca

SEQ ID NO: 485685 - RNA, 58 nt, Human
uguguucaugaugacugaggaaaaaaauuaaaccuaugccauuuaaaaaacugacugu

SEQ ID NO: 485686 - RNA, 64 nt, Human; identical to SEQ ID NO: 411319

SEQ ID NO: 485687 - RNA, 64 nt, Human; identical to SEQ ID NO: 411320

SEQ ID NO: 485688 - RNA, 64 nt, Human; identical to SEQ ID NO: 411321

SEQ ID NO: 485689 - RNA, 64 nt, Human; identical to SEQ ID NO: 411322

SEQ ID NO: 485690 - RNA, 64 nt, Human; identical to SEQ ID NO: 411323

SEQ ID NO: 485691 - RNA, 64 nt, Human; identical to SEQ ID NO: 411324

SEQ ID NO: 485692 - RNA, 64 nt, Human; identical to SEQ ID NO: 411325

SEQ ID NO: 485693 - RNA, 64 nt, Human; identical to SEQ ID NO: 411326

SEQ ID NO: 485694 - RNA, 64 nt, Human; identical to SEQ ID NO: 411327

SEQ ID NO: 485695 - RNA, 54 nt, Human; identical to SEQ ID NO: 411328

SEQ ID NO: 485696 - RNA, 64 nt, Human; identical to SEQ ID NO: 411329

SEQ ID NO: 485697 - RNA, 64 nt, Human; identical to SEQ ID NO: 411333

SEQ ID NO: 485698 - RNA, 64 nt, Human; identical to SEQ ID NO: 411334

SEQ ID NO: 485699 - RNA, 64 nt, Human; identical to SEQ ID NO: 411335

SEQ ID NO: 485700 - RNA, 64 nt, Human; identical to SEQ ID NO: 411336

SEQ ID NO: 485701 - RNA, 58 nt, Human
ggaaauaaaaccaaucagucaguuagccuaaaccuauugauuccucgugauuauuucc

SEQ ID NO: 485702 - RNA, 58 nt, Human
ugaaagaagaaacaacaacaaaaaagccuaaaccuagccucugaacaacacuaacaug

SEQ ID NO: 485703 - RNA, 58 nt, Human
ucuaaagugcuuuagucauauaugaauuuaaaccuaguaccauccaaaaccauguaau

SEQ ID NO: 485704 - RNA, 64 nt, Human; identical to SEQ ID NO: 411337

SEQ ID NO: 485705 - RNA, 64 nt, Human; identical to SEQ ID NO: 411338

SEQ ID NO: 485706 - RNA, 64 nt, Human; identical to SEQ ID NO: 411339

SEQ ID NO: 485707 - RNA, 64 nt, Human; identical to SEQ ID NO: 411340

SEQ ID NO: 485708 - RNA, 64 nt, Human; identical to SEQ ID NO: 411341

SEQ ID NO: 485709 - RNA, 64 nt, Human; identical to SEQ ID NO: 411342

SEQ ID NO: 485710 - RNA, 64 nt, Human; identical to SEQ ID NO: 411343

SEQ ID NO: 485711 - RNA, 64 nt, Human; identical to SEQ ID NO: 411344

SEQ ID NO: 485712 - RNA, 64 nt, Human; identical to SEQ ID NO: 411345

SEQ ID NO: 485713 - RNA, 56 nt, Human; identical to SEQ ID NO: 411346

SEQ ID NO: 485714 - RNA, 61 nt, Human; identical to SEQ ID NO: 411347

SEQ ID NO: 485715 - RNA, 64 nt, Human; identical to SEQ ID NO: 411348

SEQ ID NO: 485716 - RNA, 64 nt, Human; identical to SEQ ID NO: 411352

SEQ ID NO: 485717 - RNA, 64 nt, Human; identical to SEQ ID NO: 411353

SEQ ID NO: 485718 - RNA, 64 nt, Human; identical to SEQ ID NO: 411354

SEQ ID NO: 485719 - RNA, 58 nt, Human
uaauugaaaguauuauuaguuaaagauguaaaccuagccaaaauuaccaguuuauuaa

SEQ ID NO: 485720 - RNA, 58 nt, Human
auuuguauuaucauaucugccuuuguauuaaaccuauugguauaucauaggucauguu

SEQ ID NO: 485721 - RNA, 58 nt, Human
ccguggaggcugccagggccuuguacgguaaaccuagcugcauguaaucuguggacaa

SEQ ID NO: 485722 - RNA, 64 nt, Human; identical to SEQ ID NO: 411355

SEQ ID NO: 485723 - RNA, 64 nt, Human; identical to SEQ ID NO: 411356

SEQ ID NO: 485724 - RNA, 64 nt, Human; identical to SEQ ID NO: 411357

SEQ ID NO: 485725 - RNA, 64 nt, Human; identical to SEQ ID NO: 411358

SEQ ID NO: 485726 - RNA, 64 nt, Human; identical to SEQ ID NO: 411359

SEQ ID NO: 485727 - RNA, 64 nt, Human; identical to SEQ ID NO: 411360

SEQ ID NO: 485728 - RNA, 64 nt, Human; identical to SEQ ID NO: 411361

SEQ ID NO: 485729 - RNA, 63 nt, Human; identical to SEQ ID NO: 411362

SEQ ID NO: 485730 - RNA, 64 nt, Human; identical to SEQ ID NO: 411363

SEQ ID NO: 485731 - RNA, 64 nt, Human; identical to SEQ ID NO: 411364

SEQ ID NO: 485732 - RNA, 64 nt, Human; identical to SEQ ID NO: 411365

SEQ ID NO: 485733 - RNA, 64 nt, Human; identical to SEQ ID NO: 411366

SEQ ID NO: 485734 - RNA, 64 nt, Human; identical to SEQ ID NO: 411367

SEQ ID NO: 485735 - RNA, 64 nt, Human; identical to SEQ ID NO: 411371

SEQ ID NO: 485736 - RNA, 64 nt, Human; identical to SEQ ID NO: 411372

SEQ ID NO: 485737 - RNA, 58 nt, Human
gagaccgaagccggcccuuccacuccccuaaaccuacaguccuggaaggucucugcug

SEQ ID NO: 485738 - RNA, 58 nt, Human
aaguuauaacauggcugaaaagaaagauuaaaccuacuuucauauguauuaauuuaaa

SEQ ID NO: 485739 - RNA, 58 nt, Human
auuccuuuugaaacauaagaaaaacauuuaaaccuaugcugaaaauacgauaaaagaa

SEQ ID NO: 485740 - RNA, 64 nt, Human; identical to SEQ ID NO: 411373

SEQ ID NO: 485741 - RNA, 64 nt, Human; identical to SEQ ID NO: 411374

SEQ ID NO: 485742 - RNA, 64 nt, Human; identical to SEQ ID NO: 411375

SEQ ID NO: 485743 - RNA, 64 nt, Human; identical to SEQ ID NO: 411376

SEQ ID NO: 485744 - RNA, 64 nt, Human; identical to SEQ ID NO: 411377

SEQ ID NO: 485745 - RNA, 64 nt, Human; identical to SEQ ID NO: 411378

SEQ ID NO: 485746 - RNA, 64 nt, Human; identical to SEQ ID NO: 411379

SEQ ID NO: 485747 - RNA, 64 nt, Human; identical to SEQ ID NO: 411380

SEQ ID NO: 485748 - RNA, 64 nt, Human; identical to SEQ ID NO: 411381

SEQ ID NO: 485749 - RNA, 64 nt, Human; identical to SEQ ID NO: 411382

SEQ ID NO: 485750 - RNA, 64 nt, Human; identical to SEQ ID NO: 411383

SEQ ID NO: 485751 - RNA, 64 nt, Human; identical to SEQ ID NO: 411384

SEQ ID NO: 485752 - RNA, 64 nt, Human; identical to SEQ ID NO: 411385

SEQ ID NO: 485753 - RNA, 64 nt, Human; identical to SEQ ID NO: 411386

SEQ ID NO: 485754 - RNA, 64 nt, Human; identical to SEQ ID NO: 411390

SEQ ID NO: 485755 - RNA, 64 nt, Human; identical to SEQ ID NO: 313177

SEQ ID NO: 485756 - RNA, 64 nt, Human; identical to SEQ ID NO: 314135

SEQ ID NO: 485757 - RNA, 64 nt, Human; identical to SEQ ID NO: 314136

SEQ ID NO: 485758 - RNA, 64 nt, Human; identical to SEQ ID NO: 411391

SEQ ID NO: 485759 - RNA, 64 nt, Human; identical to SEQ ID NO: 411392

SEQ ID NO: 485760 - RNA, 64 nt, Human; identical to SEQ ID NO: 411393

SEQ ID NO: 485761 - RNA, 64 nt, Human; identical to SEQ ID NO: 411394

SEQ ID NO: 485762 - RNA, 64 nt, Human; identical to SEQ ID NO: 411395

SEQ ID NO: 485763 - RNA, 64 nt, Human; identical to SEQ ID NO: 411396

SEQ ID NO: 485764 - RNA, 64 nt, Human; identical to SEQ ID NO: 411397

SEQ ID NO: 485765 - RNA, 64 nt, Human; identical to SEQ ID NO: 411398

SEQ ID NO: 485766 - RNA, 64 nt, Human; identical to SEQ ID NO: 411399

SEQ ID NO: 485767 - RNA, 64 nt, Human; identical to SEQ ID NO: 411400

SEQ ID NO: 485768 - RNA, 64 nt, Human; identical to SEQ ID NO: 411401

SEQ ID NO: 485769 - RNA, 57 nt, Human; identical to SEQ ID NO: 411402

SEQ ID NO: 485770 - RNA, 64 nt, Human; identical to SEQ ID NO: 411403

SEQ ID NO: 485771 - RNA, 64 nt, Human; identical to SEQ ID NO: 411404

SEQ ID NO: 485772 - RNA, 64 nt, Human; identical to SEQ ID NO: 411405

SEQ ID NO: 485773 - RNA, 54 nt, Human; identical to SEQ ID NO: 162181

SEQ ID NO: 485774 - RNA, 64 nt, Human; identical to SEQ ID NO: 314254

SEQ ID NO: 485775 - RNA, 64 nt, Human; identical to SEQ ID NO: 314255

SEQ ID NO: 485776 - RNA, 64 nt, Human; identical to SEQ ID NO: 411409

SEQ ID NO: 485777 - RNA, 64 nt, Human; identical to SEQ ID NO: 411410

SEQ ID NO: 485778 - RNA, 64 nt, Human; identical to SEQ ID NO: 411411

SEQ ID NO: 485779 - RNA, 64 nt, Human; identical to SEQ ID NO: 411412

SEQ ID NO: 485780 - RNA, 64 nt, Human; identical to SEQ ID NO: 411413

SEQ ID NO: 485781 - RNA, 64 nt, Human; identical to SEQ ID NO: 411414

SEQ ID NO: 485782 - RNA, 64 nt, Human; identical to SEQ ID NO: 411415

SEQ ID NO: 485783 - RNA, 64 nt, Human; identical to SEQ ID NO: 411416

SEQ ID NO: 485784 - RNA, 64 nt, Human; identical to SEQ ID NO: 411417

SEQ ID NO: 485785 - RNA, 64 nt, Human; identical to SEQ ID NO: 411418

SEQ ID NO: 485786 - RNA, 57 nt, Human; identical to SEQ ID NO: 411419

SEQ ID NO: 485787 - RNA, 64 nt, Human; identical to SEQ ID NO: 411420

SEQ ID NO: 485788 - RNA, 64 nt, Human; identical to SEQ ID NO: 411421

SEQ ID NO: 485789 - RNA, 64 nt, Human; identical to SEQ ID NO: 411422

SEQ ID NO: 485790 - RNA, 64 nt, Human; identical to SEQ ID NO: 411423

SEQ ID NO: 485791 - RNA, 64 nt, Human; identical to SEQ ID NO: 314154

SEQ ID NO: 485792 - RNA, 64 nt, Human; identical to SEQ ID NO: 314155

SEQ ID NO: 485793 - RNA, 64 nt, Human; identical to SEQ ID NO: 313995

SEQ ID NO: 485794 - RNA, 64 nt, Human; identical to SEQ ID NO: 411424

SEQ ID NO: 485795 - RNA, 64 nt, Human; identical to SEQ ID NO: 411428

SEQ ID NO: 485796 - RNA, 64 nt, Human; identical to SEQ ID NO: 411429

SEQ ID NO: 485797 - RNA, 64 nt, Human; identical to SEQ ID NO: 411430

SEQ ID NO: 485798 - RNA, 64 nt, Human; identical to SEQ ID NO: 411431

SEQ ID NO: 485799 - RNA, 64 nt, Human; identical to SEQ ID NO: 411432

SEQ ID NO: 485800 - RNA, 64 nt, Human; identical to SEQ ID NO: 411433

SEQ ID NO: 485801 - RNA, 64 nt, Human; identical to SEQ ID NO: 411434

SEQ ID NO: 485802 - RNA, 64 nt, Human; identical to SEQ ID NO: 411435

SEQ ID NO: 485803 - RNA, 64 nt, Human; identical to SEQ ID NO: 411436

SEQ ID NO: 485804 - RNA, 64 nt, Human; identical to SEQ ID NO: 411437

SEQ ID NO: 485805 - RNA, 64 nt, Human; identical to SEQ ID NO: 411438

SEQ ID NO: 485806 - RNA, 64 nt, Human; identical to SEQ ID NO: 411439

SEQ ID NO: 485807 - RNA, 64 nt, Human; identical to SEQ ID NO: 411440

SEQ ID NO: 485808 - RNA, 64 nt, Human; identical to SEQ ID NO: 411441

SEQ ID NO: 485809 - RNA, 64 nt, Human; identical to SEQ ID NO: 313996

SEQ ID NO: 485810 - RNA, 58 nt, Human; identical to SEQ ID NO: 411442

SEQ ID NO: 485811 - RNA, 64 nt, Human; identical to SEQ ID NO: 411443

SEQ ID NO: 485812 - RNA, 64 nt, Human; identical to SEQ ID NO: 411447

SEQ ID NO: 485813 - RNA, 64 nt, Human; identical to SEQ ID NO: 411448

SEQ ID NO: 485814 - RNA, 64 nt, Human; identical to SEQ ID NO: 411449

SEQ ID NO: 485815 - RNA, 64 nt, Human; identical to SEQ ID NO: 411450

SEQ ID NO: 485816 - RNA, 64 nt, Human; identical to SEQ ID NO: 411451

SEQ ID NO: 485817 - RNA, 64 nt, Human; identical to SEQ ID NO: 411452

SEQ ID NO: 485818 - RNA, 64 nt, Human; identical to SEQ ID NO: 411453

SEQ ID NO: 485819 - RNA, 64 nt, Human; identical to SEQ ID NO: 411454

SEQ ID NO: 485820 - RNA, 64 nt, Human; identical to SEQ ID NO: 411455

SEQ ID NO: 485821 - RNA, 64 nt, Human; identical to SEQ ID NO: 411456

SEQ ID NO: 485822 - RNA, 64 nt, Human; identical to SEQ ID NO: 411457

SEQ ID NO: 485823 - RNA, 64 nt, Human; identical to SEQ ID NO: 411458

SEQ ID NO: 485824 - RNA, 64 nt, Human; identical to SEQ ID NO: 411459

SEQ ID NO: 485825 - RNA, 51 nt, Human; identical to SEQ ID NO: 411460

SEQ ID NO: 485826 - RNA, 64 nt, Human; identical to SEQ ID NO: 411461

SEQ ID NO: 485827 - RNA, 64 nt, Human; identical to SEQ ID NO: 411462

SEQ ID NO: 485828 - RNA, 64 nt, Human; identical to SEQ ID NO: 411466

SEQ ID NO: 485829 - RNA, 64 nt, Human; identical to SEQ ID NO: 411467

SEQ ID NO: 485830 - RNA, 64 nt, Human; identical to SEQ ID NO: 411468

SEQ ID NO: 485831 - RNA, 64 nt, Human; identical to SEQ ID NO: 411469

SEQ ID NO: 485832 - RNA, 64 nt, Human; identical to SEQ ID NO: 411470

SEQ ID NO: 485833 - RNA, 64 nt, Human; identical to SEQ ID NO: 411471

SEQ ID NO: 485834 - RNA, 64 nt, Human; identical to SEQ ID NO: 411472

SEQ ID NO: 485835 - RNA, 64 nt, Human; identical to SEQ ID NO: 411473

SEQ ID NO: 485836 - RNA, 64 nt, Human; identical to SEQ ID NO: 411474

SEQ ID NO: 485837 - RNA, 64 nt, Human; identical to SEQ ID NO: 411475

SEQ ID NO: 485838 - RNA, 64 nt, Human; identical to SEQ ID NO: 411480

SEQ ID NO: 485839 - RNA, 64 nt, Human; identical to SEQ ID NO: 411481

SEQ ID NO: 485840 - RNA, 64 nt, Human; identical to SEQ ID NO: 411482

SEQ ID NO: 485841 - RNA, 64 nt, Human; identical to SEQ ID NO: 411483

SEQ ID NO: 485842 - RNA, 64 nt, Human; identical to SEQ ID NO: 411484

SEQ ID NO: 485843 - RNA, 64 nt, Human; identical to SEQ ID NO: 411485

SEQ ID NO: 485844 - RNA, 64 nt, Human; identical to SEQ ID NO: 411486

SEQ ID NO: 485845 - RNA, 64 nt, Human; identical to SEQ ID NO: 411487

SEQ ID NO: 485846 - RNA, 64 nt, Human; identical to SEQ ID NO: 411488

SEQ ID NO: 485847 - RNA, 64 nt, Human; identical to SEQ ID NO: 411489

SEQ ID NO: 485848 - RNA, 64 nt, Human; identical to SEQ ID NO: 411490

SEQ ID NO: 485849 - RNA, 64 nt, Human; identical to SEQ ID NO: 411491

SEQ ID NO: 485850 - RNA, 58 nt, Human
augauguucagggcuuuauagaaccaaauaaaccuaccauuacaugaaaauuuugaag

SEQ ID NO: 485851 - RNA, 58 nt, Human
uaaaugaaacaccuuuuuuuaguguuucuaaaccuaaaaucuacuugguuugaaauca

SEQ ID NO: 485852 - RNA, 58 nt, Human
cauugugaagagacuaccacaaucaagcuaaaccuacauuacugucccugcauuaguu

SEQ ID NO: 485853 - RNA, 64 nt, Human; identical to SEQ ID NO: 411492

SEQ ID NO: 485854 - RNA, 64 nt, Human; identical to SEQ ID NO: 411493

SEQ ID NO: 485855 - RNA, 64 nt, Human; identical to SEQ ID NO: 411494

SEQ ID NO: 485856 - RNA, 64 nt, Human; identical to SEQ ID NO: 411495

SEQ ID NO: 485857 - RNA, 64 nt, Human; identical to SEQ ID NO: 411499

SEQ ID NO: 485858 - RNA, 64 nt, Human; identical to SEQ ID NO: 411500

SEQ ID NO: 485859 - RNA, 64 nt, Human; identical to SEQ ID NO: 411501

SEQ ID NO: 485860 - RNA, 64 nt, Human; identical to SEQ ID NO: 411502

SEQ ID NO: 485861 - RNA, 64 nt, Human; identical to SEQ ID NO: 411503

SEQ ID NO: 485862 - RNA, 64 nt, Human; identical to SEQ ID NO: 411504

SEQ ID NO: 485863 - RNA, 64 nt, Human; identical to SEQ ID NO: 411505

SEQ ID NO: 485864 - RNA, 64 nt, Human; identical to SEQ ID NO: 411506

SEQ ID NO: 485865 - RNA, 64 nt, Human; identical to SEQ ID NO: 411507

SEQ ID NO: 485866 - RNA, 64 nt, Human; identical to SEQ ID NO: 411508

SEQ ID NO: 485867 - RNA, 64 nt, Human; identical to SEQ ID NO: 411509

SEQ ID NO: 485868 - RNA, 58 nt, Human
uagucaaucaacauagcagagacagucuuaaaccuaccauugaccuguguguaaauuu

SEQ ID NO: 485869 - RNA, 58 nt, Human
uauuuuccuguuacuacuguauaaagcuuaaaccuacuuaaacaacuacaagcuuuaa

SEQ ID NO: 485870 - RNA, 58 nt, Human
gggacuaacaacaugaucuucuuugaguuaaaccuaccuaaguagauuuuaggugggu

SEQ ID NO: 485871 - RNA, 64 nt, Human; identical to SEQ ID NO: 411510

SEQ ID NO: 485872 - RNA, 64 nt, Human; identical to SEQ ID NO: 411511

SEQ ID NO: 485873 - RNA, 64 nt, Human; identical to SEQ ID NO: 411512

SEQ ID NO: 485874 - RNA, 64 nt, Human; identical to SEQ ID NO: 411513

SEQ ID NO: 485875 - RNA, 64 nt, Human; identical to SEQ ID NO: 411514

SEQ ID NO: 485876 - RNA, 64 nt, Human; identical to SEQ ID NO: 411518

SEQ ID NO: 485877 - RNA, 64 nt, Human; identical to SEQ ID NO: 411519

SEQ ID NO: 485878 - RNA, 64 nt, Human; identical to SEQ ID NO: 411520

SEQ ID NO: 485879 - RNA, 64 nt, Human; identical to SEQ ID NO: 411521

SEQ ID NO: 485880 - RNA, 64 nt, Human; identical to SEQ ID NO: 411522

SEQ ID NO: 485881 - RNA, 64 nt, Human; identical to SEQ ID NO: 411523

SEQ ID NO: 485882 - RNA, 64 nt, Human; identical to SEQ ID NO: 411524

SEQ ID NO: 485883 - RNA, 64 nt, Human; identical to SEQ ID NO: 411525

SEQ ID NO: 485884 - RNA, 64 nt, Human; identical to SEQ ID NO: 411526

SEQ ID NO: 485885 - RNA, 64 nt, Human; identical to SEQ ID NO: 411527

SEQ ID NO: 485886 - RNA, 58 nt, Human
aguuguuccuacucagacuguugcacucuaaaccuagggagguugaagaaugagaccc

SEQ ID NO: 485887 - RNA, 58 nt, Human
auaguacuggcuuauuaaaaguaaaaaauaaaccuaaaaauugauuguuuuaagugau

SEQ ID NO: 485888 - RNA, 58 nt, Human
uaaagauacagugcuccccacugaaaauuaaaccuaaaaaaugucacauauugguaug

SEQ ID NO: 485889 - RNA, 64 nt, Human; identical to SEQ ID NO: 411528

SEQ ID NO: 485890 - RNA, 64 nt, Human; identical to SEQ ID NO: 411529

SEQ ID NO: 485891 - RNA, 64 nt, Human; identical to SEQ ID NO: 411530

SEQ ID NO: 485892 - RNA, 64 nt, Human; identical to SEQ ID NO: 411531

SEQ ID NO: 485893 - RNA, 64 nt, Human; identical to SEQ ID NO: 411532

SEQ ID NO: 485894 - RNA, 59 nt, Human; identical to SEQ ID NO: 411533

SEQ ID NO: 485895 - RNA, 64 nt, Human; identical to SEQ ID NO: 411537

SEQ ID NO: 485896 - RNA, 64 nt, Human; identical to SEQ ID NO: 411538

SEQ ID NO: 485897 - RNA, 64 nt, Human; identical to SEQ ID NO: 411539

SEQ ID NO: 485898 - RNA, 64 nt, Human; identical to SEQ ID NO: 411540

SEQ ID NO: 485899 - RNA, 64 nt, Human; identical to SEQ ID NO: 411541

SEQ ID NO: 485900 - RNA, 64 nt, Human; identical to SEQ ID NO: 411542

SEQ ID NO: 485901 - RNA, 64 nt, Human; identical to SEQ ID NO: 411543

SEQ ID NO: 485902 - RNA, 64 nt, Human; identical to SEQ ID NO: 411544

SEQ ID NO: 485903 - RNA, 64 nt, Human; identical to SEQ ID NO: 411545

SEQ ID NO: 485904 - RNA, 58 nt, Human
cacuacagcugagcagauguaauagaaauaaaccuaugaauaaauuuucuucuugguu

SEQ ID NO: 485905 - RNA, 58 nt, Human
ucaccaggcugcuggcuccgguaccauguaaaccuaggaagguaaaggagcaggcaac

SEQ ID NO: 485906 - RNA, 58 nt, Human
aaucugagcugaguggaaggccaacuauuaaaccuacauuguaauaaacaauggugga

SEQ ID NO: 485907 - RNA, 64 nt, Human; identical to SEQ ID NO: 411546

SEQ ID NO: 485908 - RNA, 64 nt, Human; identical to SEQ ID NO: 411547

SEQ ID NO: 485909 - RNA, 64 nt, Human; identical to SEQ ID NO: 411548

SEQ ID NO: 485910 - RNA, 64 nt, Human; identical to SEQ ID NO: 411549

SEQ ID NO: 485911 - RNA, 64 nt, Human; identical to SEQ ID NO: 411550

SEQ ID NO: 485912 - RNA, 64 nt, Human; identical to SEQ ID NO: 411551

SEQ ID NO: 485913 - RNA, 64 nt, Human; identical to SEQ ID NO: 411552

SEQ ID NO: 485914 - RNA, 64 nt, Human; identical to SEQ ID NO: 411556

SEQ ID NO: 485915 - RNA, 64 nt, Human; identical to SEQ ID NO: 411557

SEQ ID NO: 485916 - RNA, 64 nt, Human; identical to SEQ ID NO: 411558

SEQ ID NO: 485917 - RNA, 64 nt, Human; identical to SEQ ID NO: 411559

SEQ ID NO: 485918 - RNA, 64 nt, Human; identical to SEQ ID NO: 411560

SEQ ID NO: 485919 - RNA, 64 nt, Human; identical to SEQ ID NO: 411561

SEQ ID NO: 485920 - RNA, 64 nt, Human; identical to SEQ ID NO: 411562

SEQ ID NO: 485921 - RNA, 64 nt, Human; identical to SEQ ID NO: 411563

SEQ ID NO: 485922 - RNA, 58 nt, Human
cuacauguaugauuugugccacugaucuuaaaccuaugauucaguaacuucuuaccau

SEQ ID NO: 485923 - RNA, 58 nt, Human
auguaauuuguuuccccuagcuuacugauaaaccuaauauucaaugaacuuccauuug

SEQ ID NO: 485924 - RNA, 58 nt, Human
ccaaaauccaaaugcaaauugcuuugauuaaaccuagauuauuaaauccauucagaac

SEQ ID NO: 485925 - RNA, 64 nt, Human; identical to SEQ ID NO: 411564

SEQ ID NO: 485926 - RNA, 64 nt, Human; identical to SEQ ID NO: 411565

SEQ ID NO: 485927 - RNA, 64 nt, Human; identical to SEQ ID NO: 411566

SEQ ID NO: 485928 - RNA, 64 nt, Human; identical to SEQ ID NO: 411567

SEQ ID NO: 485929 - RNA, 64 nt, Human; identical to SEQ ID NO: 411568

SEQ ID NO: 485930 - RNA, 62 nt, Human; identical to SEQ ID NO: 411569

SEQ ID NO: 485931 - RNA, 64 nt, Human; identical to SEQ ID NO: 411570

SEQ ID NO: 485932 - RNA, 64 nt, Human; identical to SEQ ID NO: 411571

SEQ ID NO: 485933 - RNA, 50 nt, Human; identical to SEQ ID NO: 411575

SEQ ID NO: 485934 - RNA, 64 nt, Human; identical to SEQ ID NO: 411576

SEQ ID NO: 485935 - RNA, 64 nt, Human; identical to SEQ ID NO: 411577

SEQ ID NO: 485936 - RNA, 64 nt, Human; identical to SEQ ID NO: 411578

SEQ ID NO: 485937 - RNA, 64 nt, Human; identical to SEQ ID NO: 411579

SEQ ID NO: 485938 - RNA, 64 nt, Human; identical to SEQ ID NO: 411580

SEQ ID NO: 485939 - RNA, 64 nt, Human; identical to SEQ ID NO: 411581

SEQ ID NO: 485940 - RNA, 58 nt, Human
cugcuguggaacggguauggacaggucauaaaccuagagucaguguccuguugguccu

SEQ ID NO: 485941 - RNA, 58 nt, Human
gacuaacacaaguuguuaucuaaaccuuuaaaccuaucuuccaggcagcccagagaag

SEQ ID NO: 485942 - RNA, 58 nt, Human
gagggguacucagcuccaucuccaaagauaaaccuacuccccacaagaacuggccuuu

SEQ ID NO: 485943 - RNA, 64 nt, Human; identical to SEQ ID NO: 411582

SEQ ID NO: 485944 - RNA, 64 nt, Human; identical to SEQ ID NO: 411583

SEQ ID NO: 485945 - RNA, 64 nt, Human; identical to SEQ ID NO: 411584

SEQ ID NO: 485946 - RNA, 64 nt, Human; identical to SEQ ID NO: 411585

SEQ ID NO: 485947 - RNA, 64 nt, Human; identical to SEQ ID NO: 411586

SEQ ID NO: 485948 - RNA, 64 nt, Human; identical to SEQ ID NO: 411587

SEQ ID NO: 485949 - RNA, 64 nt, Human; identical to SEQ ID NO: 411588

SEQ ID NO: 485950 - RNA, 64 nt, Human; identical to SEQ ID NO: 411589

SEQ ID NO: 485951 - RNA, 64 nt, Human; identical to SEQ ID NO: 411590

SEQ ID NO: 485952 - RNA, 64 nt, Human; identical to SEQ ID NO: 411594

SEQ ID NO: 485953 - RNA, 64 nt, Human; identical to SEQ ID NO: 411595

SEQ ID NO: 485954 - RNA, 64 nt, Human; identical to SEQ ID NO: 411596

SEQ ID NO: 485955 - RNA, 64 nt, Human; identical to SEQ ID NO: 411597

SEQ ID NO: 485956 - RNA, 64 nt, Human; identical to SEQ ID NO: 411598

SEQ ID NO: 485957 - RNA, 64 nt, Human; identical to SEQ ID NO: 411599

SEQ ID NO: 485958 - RNA, 58 nt, Human
gagacuuaacguuguguuuccuguuucuuaaaccuagcaccucuguguauuugaaaau

SEQ ID NO: 485959 - RNA, 58 nt, Human
uaagacuuuuccucauucuguggggccauaaaccuauuuagucuggagccaaagggau

SEQ ID NO: 485960 - RNA, 58 nt, Human
aucaagauccugccucuacggaauuagcuaaaccuaaaaauguuugcauuaaugaaua

SEQ ID NO: 485961 - RNA, 64 nt, Human; identical to SEQ ID NO: 411600

SEQ ID NO: 485962 - RNA, 64 nt, Human; identical to SEQ ID NO: 411601

SEQ ID NO: 485963 - RNA, 64 nt, Human; identical to SEQ ID NO: 411602

SEQ ID NO: 485964 - RNA, 64 nt, Human; identical to SEQ ID NO: 411603

SEQ ID NO: 485965 - RNA, 64 nt, Human; identical to SEQ ID NO: 411604

SEQ ID NO: 485966 - RNA, 64 nt, Human; identical to SEQ ID NO: 411605

SEQ ID NO: 485967 - RNA, 64 nt, Human; identical to SEQ ID NO: 411606

SEQ ID NO: 485968 - RNA, 64 nt, Human; identical to SEQ ID NO: 411607

SEQ ID NO: 485969 - RNA, 64 nt, Human; identical to SEQ ID NO: 411608

SEQ ID NO: 485970 - RNA, 64 nt, Human; identical to SEQ ID NO: 411609

SEQ ID NO: 485971 - RNA, 64 nt, Human; identical to SEQ ID NO: 411613

SEQ ID NO: 485972 - RNA, 64 nt, Human; identical to SEQ ID NO: 411614

SEQ ID NO: 485973 - RNA, 64 nt, Human; identical to SEQ ID NO: 411615

SEQ ID NO: 485974 - RNA, 64 nt, Human; identical to SEQ ID NO: 411616

SEQ ID NO: 485975 - RNA, 64 nt, Human; identical to SEQ ID NO: 411617

SEQ ID NO: 485976 - RNA, 58 nt, Human
auuuaaaaauaauacagcaauaccaaaauaaaccuagaaauauuguuuuuuauauuau

SEQ ID NO: 485977 - RNA, 58 nt, Human
ccaugcaccaagagcaggagaaaagacguaaaccuaccccagcaacuguggccucucg

SEQ ID NO: 485978 - RNA, 58 nt, Human; identical to SEQ ID NO: 485235

SEQ ID NO: 485979 - RNA, 64 nt, Human; identical to SEQ ID NO: 411618

SEQ ID NO: 485980 - RNA, 64 nt, Human; identical to SEQ ID NO: 411619

SEQ ID NO: 485981 - RNA, 64 nt, Human; identical to SEQ ID NO: 411620

SEQ ID NO: 485982 - RNA, 64 nt, Human; identical to SEQ ID NO: 411621

SEQ ID NO: 485983 - RNA, 64 nt, Human; identical to SEQ ID NO: 411622

SEQ ID NO: 485984 - RNA, 64 nt, Human; identical to SEQ ID NO: 411623

SEQ ID NO: 485985 - RNA, 64 nt, Human; identical to SEQ ID NO: 411624

SEQ ID NO: 485986 - RNA, 64 nt, Human; identical to SEQ ID NO: 411625

SEQ ID NO: 485987 - RNA, 64 nt, Human; identical to SEQ ID NO: 411626

SEQ ID NO: 485988 - RNA, 64 nt, Human; identical to SEQ ID NO: 411627

SEQ ID NO: 485989 - RNA, 64 nt, Human; identical to SEQ ID NO: 411628

SEQ ID NO: 485990 - RNA, 64 nt, Human; identical to SEQ ID NO: 411632

SEQ ID NO: 485991 - RNA, 64 nt, Human; identical to SEQ ID NO: 411633

SEQ ID NO: 485992 - RNA, 64 nt, Human; identical to SEQ ID NO: 411634

SEQ ID NO: 485993 - RNA, 64 nt, Human; identical to SEQ ID NO: 411635

SEQ ID NO: 485994 - RNA, 64 nt, Human; identical to SEQ ID NO: 314339

SEQ ID NO: 485995 - RNA, 64 nt, Human; identical to SEQ ID NO: 314340

SEQ ID NO: 485996 - RNA, 64 nt, Human; identical to SEQ ID NO: 314341

SEQ ID NO: 485997 - RNA, 64 nt, Human; identical to SEQ ID NO: 411636

SEQ ID NO: 485998 - RNA, 64 nt, Human; identical to SEQ ID NO: 411637

SEQ ID NO: 485999 - RNA, 64 nt, Human; identical to SEQ ID NO: 411638

SEQ ID NO: 486000 - RNA, 64 nt, Human; identical to SEQ ID NO: 411639

SEQ ID NO: 486001 - RNA, 64 nt, Human; identical to SEQ ID NO: 411640

SEQ ID NO: 486002 - RNA, 64 nt, Human; identical to SEQ ID NO: 411641

SEQ ID NO: 486003 - RNA, 64 nt, Human; identical to SEQ ID NO: 411642

SEQ ID NO: 486004 - RNA, 64 nt, Human; identical to SEQ ID NO: 411643

SEQ ID NO: 486005 - RNA, 64 nt, Human; identical to SEQ ID NO: 411644

SEQ ID NO: 486006 - RNA, 64 nt, Human; identical to SEQ ID NO: 411645

SEQ ID NO: 486007 - RNA, 64 nt, Human; identical to SEQ ID NO: 411646

SEQ ID NO: 486008 - RNA, 64 nt, Human; identical to SEQ ID NO: 411647

SEQ ID NO: 486009 - RNA, 64 nt, Human; identical to SEQ ID NO: 411651

SEQ ID NO: 486010 - RNA, 64 nt, Human; identical to SEQ ID NO: 411652

SEQ ID NO: 486011 - RNA, 64 nt, Human; identical to SEQ ID NO: 411653

SEQ ID NO: 486012 - RNA, 64 nt, Human; identical to SEQ ID NO: 313943

SEQ ID NO: 486013 - RNA, 58 nt, Human; identical to SEQ ID NO: 162154

SEQ ID NO: 486014 - RNA, 64 nt, Human; identical to SEQ ID NO: 313164

SEQ ID NO: 486015 - RNA, 64 nt, Human; identical to SEQ ID NO: 411654

SEQ ID NO: 486016 - RNA, 64 nt, Human; identical to SEQ ID NO: 411655

SEQ ID NO: 486017 - RNA, 64 nt, Human; identical to SEQ ID NO: 411656

SEQ ID NO: 486018 - RNA, 64 nt, Human; identical to SEQ ID NO: 411657

SEQ ID NO: 486019 - RNA, 64 nt, Human; identical to SEQ ID NO: 411658

SEQ ID NO: 486020 - RNA, 64 nt, Human; identical to SEQ ID NO: 411659

SEQ ID NO: 486021 - RNA, 64 nt, Human; identical to SEQ ID NO: 411660

SEQ ID NO: 486022 - RNA, 64 nt, Human; identical to SEQ ID NO: 411661

SEQ ID NO: 486023 - RNA, 64 nt, Human; identical to SEQ ID NO: 411662

SEQ ID NO: 486024 - RNA, 64 nt, Human; identical to SEQ ID NO: 411663

SEQ ID NO: 486025 - RNA, 64 nt, Human; identical to SEQ ID NO: 411664

SEQ ID NO: 486026 - RNA, 64 nt, Human; identical to SEQ ID NO: 411665

SEQ ID NO: 486027 - RNA, 64 nt, Human; identical to SEQ ID NO: 411666

SEQ ID NO: 486028 - RNA, 64 nt, Human; identical to SEQ ID NO: 411670

SEQ ID NO: 486029 - RNA, 64 nt, Human; identical to SEQ ID NO: 411671

SEQ ID NO: 486030 - RNA, 58 nt, Human
uuauaacagaaaacugacagagaaguaauaaaccuauugauuucucugcuuauaaaug

SEQ ID NO: 486031 - RNA, 58 nt, Human
acugauuuauuuguaauucagguauuuauaaaccuauuggcuacaaagacuuuguuaa

SEQ ID NO: 486032 - RNA, 58 nt, Human
ugccucaguuaaagguuuaauuuuuguuuaaaccuagacgugcaacaaaaguuuuacc

SEQ ID NO: 486033 - RNA, 64 nt, Human; identical to SEQ ID NO: 411672

SEQ ID NO: 486034 - RNA, 64 nt, Human; identical to SEQ ID NO: 411673

SEQ ID NO: 486035 - RNA, 64 nt, Human; identical to SEQ ID NO: 411674

SEQ ID NO: 486036 - RNA, 64 nt, Human; identical to SEQ ID NO: 411675

SEQ ID NO: 486037 - RNA, 64 nt, Human; identical to SEQ ID NO: 411676

SEQ ID NO: 486038 - RNA, 64 nt, Human; identical to SEQ ID NO: 411677

SEQ ID NO: 486039 - RNA, 64 nt, Human; identical to SEQ ID NO: 411678

SEQ ID NO: 486040 - RNA, 58 nt, Human; identical to SEQ ID NO: 411679

SEQ ID NO: 486041 - RNA, 64 nt, Human; identical to SEQ ID NO: 411680

SEQ ID NO: 486042 - RNA, 64 nt, Human; identical to SEQ ID NO: 411681

SEQ ID NO: 486043 - RNA, 64 nt, Human; identical to SEQ ID NO: 411682

SEQ ID NO: 486044 - RNA, 64 nt, Human; identical to SEQ ID NO: 411683

SEQ ID NO: 486045 - RNA, 64 nt, Human; identical to SEQ ID NO: 411684

SEQ ID NO: 486046 - RNA, 64 nt, Human; identical to SEQ ID NO: 411685

SEQ ID NO: 486047 - RNA, 64 nt, Human; identical to SEQ ID NO: 411689

SEQ ID NO: 486048 - RNA, 64 nt, Human; identical to SEQ ID NO: 314306

SEQ ID NO: 486049 - RNA, 64 nt, Human; identical to SEQ ID NO: 314307

SEQ ID NO: 486050 - RNA, 64 nt, Human; identical to SEQ ID NO: 314170

SEQ ID NO: 486051 - RNA, 64 nt, Human; identical to SEQ ID NO: 411690

SEQ ID NO: 486052 - RNA, 64 nt, Human; identical to SEQ ID NO: 411691

SEQ ID NO: 486053 - RNA, 64 nt, Human; identical to SEQ ID NO: 411692

SEQ ID NO: 486054 - RNA, 64 nt, Human; identical to SEQ ID NO: 411693

SEQ ID NO: 486055 - RNA, 64 nt, Human; identical to SEQ ID NO: 411694

SEQ ID NO: 486056 - RNA, 64 nt, Human; identical to SEQ ID NO: 411695

SEQ ID NO: 486057 - RNA, 64 nt, Human; identical to SEQ ID NO: 411696

SEQ ID NO: 486058 - RNA, 64 nt, Human; identical to SEQ ID NO: 411697

SEQ ID NO: 486059 - RNA, 64 nt, Human; identical to SEQ ID NO: 411698

SEQ ID NO: 486060 - RNA, 64 nt, Human; identical to SEQ ID NO: 411699

SEQ ID NO: 486061 - RNA, 64 nt, Human; identical to SEQ ID NO: 411700

SEQ ID NO: 486062 - RNA, 64 nt, Human; identical to SEQ ID NO: 411701

SEQ ID NO: 486063 - RNA, 64 nt, Human; identical to SEQ ID NO: 411702

SEQ ID NO: 486064 - RNA, 64 nt, Human; identical to SEQ ID NO: 411703

SEQ ID NO: 486065 - RNA, 64 nt, Human; identical to SEQ ID NO: 411704

SEQ ID NO: 486066 - RNA, 64 nt, Human; identical to SEQ ID NO: 314171

SEQ ID NO: 486067 - RNA, 64 nt, Human; identical to SEQ ID NO: 313165

SEQ ID NO: 486068 - RNA, 64 nt, Human; identical to SEQ ID NO: 314046

SEQ ID NO: 486069 - RNA, 64 nt, Human; identical to SEQ ID NO: 411708

SEQ ID NO: 486070 - RNA, 64 nt, Human; identical to SEQ ID NO: 411709

SEQ ID NO: 486071 - RNA, 64 nt, Human; identical to SEQ ID NO: 411710

SEQ ID NO: 486072 - RNA, 64 nt, Human; identical to SEQ ID NO: 411711

SEQ ID NO: 486073 - RNA, 64 nt, Human; identical to SEQ ID NO: 411712

SEQ ID NO: 486074 - RNA, 64 nt, Human; identical to SEQ ID NO: 411713

SEQ ID NO: 486075 - RNA, 64 nt, Human; identical to SEQ ID NO: 411714

SEQ ID NO: 486076 - RNA, 64 nt, Human; identical to SEQ ID NO: 411715

SEQ ID NO: 486077 - RNA, 64 nt, Human; identical to SEQ ID NO: 411716

SEQ ID NO: 486078 - RNA, 64 nt, Human; identical to SEQ ID NO: 411717

SEQ ID NO: 486079 - RNA, 64 nt, Human; identical to SEQ ID NO: 411718

SEQ ID NO: 486080 - RNA, 64 nt, Human; identical to SEQ ID NO: 411719

SEQ ID NO: 486081 - RNA, 64 nt, Human; identical to SEQ ID NO: 411720

SEQ ID NO: 486082 - RNA, 64 nt, Human; identical to SEQ ID NO: 411721

SEQ ID NO: 486083 - RNA, 64 nt, Human; identical to SEQ ID NO: 411722

SEQ ID NO: 486084 - RNA, 64 nt, Human; identical to SEQ ID NO: 314048

SEQ ID NO: 486085 - RNA, 64 nt, Human; identical to SEQ ID NO: 314049

SEQ ID NO: 486086 - RNA, 64 nt, Human; identical to SEQ ID NO: 314172

SEQ ID NO: 486087 - RNA, 64 nt, Human; identical to SEQ ID NO: 411723

SEQ ID NO: 486088 - RNA, 64 nt, Human; identical to SEQ ID NO: 411727

SEQ ID NO: 486089 - RNA, 64 nt, Human; identical to SEQ ID NO: 411728

SEQ ID NO: 486090 - RNA, 64 nt, Human; identical to SEQ ID NO: 411729

SEQ ID NO: 486091 - RNA, 64 nt, Human; identical to SEQ ID NO: 411730

SEQ ID NO: 486092 - RNA, 64 nt, Human; identical to SEQ ID NO: 411731

SEQ ID NO: 486093 - RNA, 64 nt, Human; identical to SEQ ID NO: 411732

SEQ ID NO: 486094 - RNA, 64 nt, Human; identical to SEQ ID NO: 411733

SEQ ID NO: 486095 - RNA, 64 nt, Human; identical to SEQ ID NO: 411734

SEQ ID NO: 486096 - RNA, 64 nt, Human; identical to SEQ ID NO: 411735

SEQ ID NO: 486097 - RNA, 64 nt, Human; identical to SEQ ID NO: 411736

SEQ ID NO: 486098 - RNA, 64 nt, Human; identical to SEQ ID NO: 411737

SEQ ID NO: 486099 - RNA, 64 nt, Human; identical to SEQ ID NO: 411738

SEQ ID NO: 486100 - RNA, 64 nt, Human; identical to SEQ ID NO: 411739

SEQ ID NO: 486101 - RNA, 64 nt, Human; identical to SEQ ID NO: 411740

SEQ ID NO: 486102 - RNA, 64 nt, Human; identical to SEQ ID NO: 313166

SEQ ID NO: 486103 - RNA, 64 nt, Human; identical to SEQ ID NO: 314083

SEQ ID NO: 486104 - RNA, 64 nt, Human; identical to SEQ ID NO: 314084

SEQ ID NO: 486105 - RNA, 64 nt, Human; identical to SEQ ID NO: 411741

SEQ ID NO: 486106 - RNA, 64 nt, Human; identical to SEQ ID NO: 411742

SEQ ID NO: 486107 - RNA, 64 nt, Human; identical to SEQ ID NO: 411746

SEQ ID NO: 486108 - RNA, 64 nt, Human; identical to SEQ ID NO: 411747

SEQ ID NO: 486109 - RNA, 64 nt, Human; identical to SEQ ID NO: 411748

SEQ ID NO: 486110 - RNA, 64 nt, Human; identical to SEQ ID NO: 411749

SEQ ID NO: 486111 - RNA, 64 nt, Human; identical to SEQ ID NO: 411750

SEQ ID NO: 486112 - RNA, 64 nt, Human; identical to SEQ ID NO: 411751

SEQ ID NO: 486113 - RNA, 64 nt, Human; identical to SEQ ID NO: 411752

SEQ ID NO: 486114 - RNA, 64 nt, Human; identical to SEQ ID NO: 411753

SEQ ID NO: 486115 - RNA, 64 nt, Human; identical to SEQ ID NO: 411754

SEQ ID NO: 486116 - RNA, 64 nt, Human; identical to SEQ ID NO: 411755

SEQ ID NO: 486117 - RNA, 64 nt, Human; identical to SEQ ID NO: 411756

SEQ ID NO: 486118 - RNA, 64 nt, Human; identical to SEQ ID NO: 411757

SEQ ID NO: 486119 - RNA, 64 nt, Human; identical to SEQ ID NO: 411758

SEQ ID NO: 486120 - RNA, 64 nt, Human; identical to SEQ ID NO: 314100

SEQ ID NO: 486121 - RNA, 64 nt, Human; identical to SEQ ID NO: 314101

SEQ ID NO: 486122 - RNA, 64 nt, Human; identical to SEQ ID NO: 313167

SEQ ID NO: 486123 - RNA, 64 nt, Human; identical to SEQ ID NO: 411759

SEQ ID NO: 486124 - RNA, 64 nt, Human; identical to SEQ ID NO: 411760

SEQ ID NO: 486125 - RNA, 64 nt, Human; identical to SEQ ID NO: 411761

SEQ ID NO: 486126 - RNA, 64 nt, Human; identical to SEQ ID NO: 411765

SEQ ID NO: 486127 - RNA, 64 nt, Human; identical to SEQ ID NO: 411766

SEQ ID NO: 486128 - RNA, 64 nt, Human; identical to SEQ ID NO: 411767

SEQ ID NO: 486129 - RNA, 64 nt, Human; identical to SEQ ID NO: 411768

SEQ ID NO: 486130 - RNA, 64 nt, Human; identical to SEQ ID NO: 411769

SEQ ID NO: 486131 - RNA, 64 nt, Human; identical to SEQ ID NO: 411770

SEQ ID NO: 486132 - RNA, 64 nt, Human; identical to SEQ ID NO: 411771

SEQ ID NO: 486133 - RNA, 64 nt, Human; identical to SEQ ID NO: 411772

SEQ ID NO: 486134 - RNA, 64 nt, Human; identical to SEQ ID NO: 411773

SEQ ID NO: 486135 - RNA, 64 nt, Human; identical to SEQ ID NO: 411774

SEQ ID NO: 486136 - RNA, 64 nt, Human; identical to SEQ ID NO: 411775

SEQ ID NO: 486137 - RNA, 64 nt, Human; identical to SEQ ID NO: 411776

SEQ ID NO: 486138 - RNA, 64 nt, Human; identical to SEQ ID NO: 314102

SEQ ID NO: 486139 - RNA, 64 nt, Human; identical to SEQ ID NO: 314103

SEQ ID NO: 486140 - RNA, 64 nt, Human; identical to SEQ ID NO: 314152

SEQ ID NO: 486141 - RNA, 64 nt, Human; identical to SEQ ID NO: 411777

SEQ ID NO: 486142 - RNA, 64 nt, Human; identical to SEQ ID NO: 411778

SEQ ID NO: 486143 - RNA, 64 nt, Human; identical to SEQ ID NO: 411779

SEQ ID NO: 486144 - RNA, 64 nt, Human; identical to SEQ ID NO: 411780

SEQ ID NO: 486145 - RNA, 64 nt, Human; identical to SEQ ID NO: 411784

SEQ ID NO: 486146 - RNA, 64 nt, Human; identical to SEQ ID NO: 411785

SEQ ID NO: 486147 - RNA, 64 nt, Human; identical to SEQ ID NO: 411786

SEQ ID NO: 486148 - RNA, 64 nt, Human; identical to SEQ ID NO: 411787

SEQ ID NO: 486149 - RNA, 64 nt, Human; identical to SEQ ID NO: 411788

SEQ ID NO: 486150 - RNA, 64 nt, Human; identical to SEQ ID NO: 411789

SEQ ID NO: 486151 - RNA, 64 nt, Human; identical to SEQ ID NO: 411790

SEQ ID NO: 486152 - RNA, 64 nt, Human; identical to SEQ ID NO: 411791

SEQ ID NO: 486153 - RNA, 64 nt, Human; identical to SEQ ID NO: 411792

SEQ ID NO: 486154 - RNA, 64 nt, Human; identical to SEQ ID NO: 411793

SEQ ID NO: 486155 - RNA, 64 nt, Human; identical to SEQ ID NO: 411794

SEQ ID NO: 486156 - RNA, 58 nt, Human
aauguagucuuccuuauaaaaaugaaauuaaaccuaugcucucaauucuuuuauauuc

SEQ ID NO: 486157 - RNA, 58 nt, Human
uuaugcuauaggugauauucucuuugaauaaaccuauaauagaaaauagcagacaaca

SEQ ID NO: 486158 - RNA, 58 nt, Human
ucagaaucuaucaccuugguaaauuauauaaaccuaacuugagcagaucugauuauuc

SEQ ID NO: 486159 - RNA, 64 nt, Human; identical to SEQ ID NO: 411795

SEQ ID NO: 486160 - RNA, 64 nt, Human; identical to SEQ ID NO: 411796

SEQ ID NO: 486161 - RNA, 64 nt, Human; identical to SEQ ID NO: 411797

SEQ ID NO: 486162 - RNA, 64 nt, Human; identical to SEQ ID NO: 411798

SEQ ID NO: 486163 - RNA, 64 nt, Human; identical to SEQ ID NO: 411799

SEQ ID NO: 486164 - RNA, 64 nt, Human; identical to SEQ ID NO: 411803

SEQ ID NO: 486165 - RNA, 64 nt, Human; identical to SEQ ID NO: 411804

SEQ ID NO: 486166 - RNA, 64 nt, Human; identical to SEQ ID NO: 314322

SEQ ID NO: 486167 - RNA, 64 nt, Human; identical to SEQ ID NO: 314323

SEQ ID NO: 486168 - RNA, 64 nt, Human; identical to SEQ ID NO: 314324

SEQ ID NO: 486169 - RNA, 64 nt, Human; identical to SEQ ID NO: 314325

SEQ ID NO: 486170 - RNA, 64 nt, Human; identical to SEQ ID NO: 314326

SEQ ID NO: 486171 - RNA, 64 nt, Human; identical to SEQ ID NO: 314327

SEQ ID NO: 486172 - RNA, 64 nt, Human; identical to SEQ ID NO: 314328

SEQ ID NO: 486173 - RNA, 64 nt, Human; identical to SEQ ID NO: 314329

SEQ ID NO: 486174 - RNA, 64 nt, Human; identical to SEQ ID NO: 314330

SEQ ID NO: 486175 - RNA, 64 nt, Human; identical to SEQ ID NO: 314331

SEQ ID NO: 486176 - RNA, 64 nt, Human; identical to SEQ ID NO: 314332

SEQ ID NO: 486177 - RNA, 64 nt, Human; identical to SEQ ID NO: 314333

SEQ ID NO: 486178 - RNA, 64 nt, Human; identical to SEQ ID NO: 314334

SEQ ID NO: 486179 - RNA, 64 nt, Human
ucccugcguguggccacuccucagcauccuccccacccaccaugguucauuccgacuuuuccaa

SEQ ID NO: 486180 - RNA, 64 nt, Human
uucucacgcguuuccacaacauccccugggucagacccaccagguaccccguaggaauuuccag

SEQ ID NO: 486181 - RNA, 64 nt, Human
augaagcaggcagagcucagaggaucuuggcaucacccaccaaaguuagcugaaagcagggcac

SEQ ID NO: 486182 - RNA, 64 nt, Human
cgcugcugagaugggcgcucccgacacagcgcagacccaccaggaggaaagaggcccagcucuc

SEQ ID NO: 486183 - RNA, 60 nt, Human
gguggaacauggugcccugagacagcucccacccaccauccugucccccuggggcgggca

SEQ ID NO: 486184 - RNA, 64 nt, Human
ugccucagccuccaaaguagcugggauuacaggcacccaccacaucuggcuaauuuuuuguauu

SEQ ID NO: 486185 - RNA, 64 nt, Human
ugucuggggacucugccacucuacccccagcccuacccaccagcccccaggugaggcuuccagc

SEQ ID NO: 486186 - RNA, 64 nt, Human
gcagccccaagcuuuacacuggaugcagcgaucaacccaccacucaccaggccucuccuccccu

SEQ ID NO: 486187 - RNA, 64 nt, Human
uggccuggggcacccacugcacacucagggccagacccaccauccuggacuggcgaggaagauc

SEQ ID NO: 486188 - RNA, 64 nt, Human
gguuggucugccccucagucaggcccccuuacccacccaccagccccaaggcccgaccccuccc

SEQ ID NO: 486189 - RNA, 64 nt, Human
caucaauuuuuaggcgcuugccuggucucaggauacccaccauccuuuuccugagcacagccug

SEQ ID NO: 486190 - RNA, 64 nt, Human
ccacagggcauagaaacaagaggucacauucagcacccaccaccucccucuuucgcaucaguuc

SEQ ID NO: 486191 - RNA, 64 nt, Human
ugcagcucugggucaccugaccuguaguccuuuaacccaccaucaucccaaacucuccuguccu

SEQ ID NO: 486192 - RNA, 64 nt, Human
cuucccccauccuccaggagagggggcaagggcaacccaccaucuacccacuuacuaaccuggu

SEQ ID NO: 486193 - RNA, 64 nt, Human
agaggaaguaaaggacaaucagaacaccagucaaacccaccaaauugcuuuauuccccuuugca

SEQ ID NO: 486194 - RNA, 64 nt, Human
cugagagggcagaacacacauauccaaguaggcuacccaccacuggguagggauuucuguaaag

SEQ ID NO: 486195 - RNA, 64 nt, Human
acucccuccugccaucuacaggcuugucacaucucaccaccagaaacaggcuuccucaggcuuc

SEQ ID NO: 486196 - RNA, 64 nt, Human
gggcacccagcugccuuuccucccucacaggagccaccaccagccaccucucaggagaagccag

SEQ ID NO: 486197 - RNA, 64 nt, Human
aguagucccaggaguagcugggacuacaggugcccaccaccacacccagcuaauuuuuuuguau

SEQ ID NO: 486198 - RNA, 64 nt, Human
ucggcaggcuggacacacugcccagcacaggcagacccaccaggcuccuagguuuagcuuuuaa

SEQ ID NO: 486199 - RNA, 64 nt, Human
ggcaagccccucagcccuugcccccaucccucggacccaccaaacugcacacacagcuccucuu

SEQ ID NO: 486200 - RNA, 64 nt, Human
gguaccaggcacauggcugggggagggacugcugacccaccaaggucucacacuccuccugcca

SEQ ID NO: 486201 - RNA, 58 nt, Human
ccuucccuagaaaggccugacccuccuuacccaccagaacagggguuuugaugcccuc

SEQ ID NO: 486202 - RNA, 64 nt, Human
ggcuuggaagggaacagggcagaugaggcccuucacccaccaucuacgccauauacccaucacc

SEQ ID NO: 486203 - RNA, 64 nt, Human
gcccugucugauuuggcuccccuuucucucccuaacccaccaccccugcgucucccugcaggca

SEQ ID NO: 486204 - RNA, 64 nt, Human
gugggaauugcaggacuauccuguaauuguagacacccaccauuuaaauuuauuuaacaguuau

SEQ ID NO: 486205 - RNA, 64 nt, Human
acucagaacccucgaagcauccugcauugucuuuacccaccaucaucuucacuaagagaaacau

SEQ ID NO: 486206 - RNA, 64 nt, Human
acugaggucaagccaguccucccauggucaugccacccaccagggaagcaugccugaucucuuc

SEQ ID NO: 486207 - RNA, 64 nt, Human
ugugucagucuccugaguagcugggauuacaggcacccaccacuaugcccagcuaauuuuuuua

SEQ ID NO: 486208 - RNA, 64 nt, Human
ggaugaagagucuaacuagaauaaugacuuguaaacccaccaugaguuauuugguuuuugacuu

SEQ ID NO: 486209 - RNA, 64 nt, Human
cucaccaugcccuuccugcauccuucccccaaccacccaccagaggaguucugguccccaaacc

SEQ ID NO: 486210 - RNA, 64 nt, Human
aaaccucagaacuugaggcugaaacauugcuuccacccaccaucagugaagauguaacuagcau

SEQ ID NO: 486211 - RNA, 64 nt, Human
agaaggggaagaaaagaaggggaagaagaucaaaacccaccaugccccagguaacuuucagcaa

SEQ ID NO: 486212 - RNA, 64 nt, Human
caagcucuucugaccuuuccuuccccaguggggaacccaccaaguccgcuucagauaccaaagg

SEQ ID NO: 486213 - RNA, 64 nt, Human
uaaaccaccgggcgcaccaucuuuccuucaugcuacccaccaccucagugcugaggucaaggca

SEQ ID NO: 486214 - RNA, 64 nt, Human
gagaccccaccaccaccaccaccaccaacaccaccaccaccaccgcgagcuggagcgcgcacca

SEQ ID NO: 486215 - RNA, 64 nt, Human
agggagaccccaccaccaccaccaccaccaacaccaccaccaccaccgcgagcuggagcgcgca

SEQ ID NO: 486216 - RNA, 64 nt, Human
cgcagggagaccccaccaccaccaccaccaccaacaccaccaccaccaccgcgagcuggagcgc

SEQ ID NO: 486217 - RNA, 60 nt, Human
ccuugguccacucugagugaggccaccaucacccaccacacccugcccacuccugcgcuu

SEQ ID NO: 486218 - RNA, 64 nt, Human
aagaguccaacucacuuccagugcccaaaagggcacccaccagaaauuccaguaaauccucauu

SEQ ID NO: 486219 - RNA, 64 nt, Human
ucuccucugcuccucccaccucaucccuaggaggacccaccaguggagcacaugcagccucagu

SEQ ID NO: 486220 - RNA, 64 nt, Human
ugccagaggaccguggauaccucaguguccacacacccaccaugcccagcccuggagccaucac

SEQ ID NO: 486221 - RNA, 64 nt, Human
ugccucagccucccgaguagcugggacuacaggcacccaccaucaugcuuggcuaauuuuugua

SEQ ID NO: 486222 - RNA, 64 nt, Human
ugcagugcugcaaugcccagacaaacgugagcacacccaccaguuucuaaaauggaauagacag

SEQ ID NO: 486223 - RNA, 64 nt, Human
ugccucagccucccaaguagcugggauuacaggcacccaccaccucacccagcuaauuuuugua

SEQ ID NO: 486224 - RNA, 64 nt, Human
ccucuucguucuucaccuggguuuccucuuaucuacccaccaccuaggacagaggcugcccacu

SEQ ID NO: 486225 - RNA, 64 nt, Human
aaaguacagaggauaauacaacaaauauccagguacccaccacccagcauuuuuacauaguagc

SEQ ID NO: 486226 - RNA, 64 nt, Human
cuaaugagaggcagggagagcaugggcaauggagacccaccaaugauccccaaccccggugggu

SEQ ID NO: 486227 - RNA, 64 nt, Human
gacuuggaacucaggauggggcugucauagacagacccaccaguaggaacugucacagaauggc

SEQ ID NO: 486228 - RNA, 64 nt, Human
ccuccaaggaguccgggaggugccugugguuugcacccaccacugaaaaagccgcggagaugcg

SEQ ID NO: 486229 - RNA, 64 nt, Human
ugagcugaggaugggacgaugugcccagggagggacccaccagagcacaagagaagguggcuac

SEQ ID NO: 486230 - RNA, 64 nt, Human
cugaggcucuagccaccuaaaaccacgugcccaaacccaccaguuuaaaacgguguguguucgg

SEQ ID NO: 486231 - RNA, 64 nt, Human
guggcauuuccagaaccucagccccgauuccagcacccaccaccgccugacccuguguaaccug

SEQ ID NO: 486232 - RNA, 64 nt, Human
gcaauaaucaucucuguuuugcccccauucuacuacccaccacugcccaccccacccccacauc

SEQ ID NO: 486233 - RNA, 64 nt, Human
cauccuccuuuccccucucucuagaaucaucucgcaccaccaguuacacuugaauuaagaucug

SEQ ID NO: 486234 - RNA, 64 nt, Human
cucagcuuccugacuagcugggacuacuggugugcaccaccacacccagcuaauuuucaauuuu

SEQ ID NO: 486235 - RNA, 64 nt, Human
cgaguccugcaaggguggcggguggcugaggucacaccaccacuggaguggaugggcagugccc

SEQ ID NO: 486236 - RNA, 64 nt, Human
aacagaagcuguuugcucauguucugugccccacacccaccaauaccuaaaucuguuaaggaag

SEQ ID NO: 486237 - RNA, 64 nt, Human
caaaauugaagaagaaauguagcccccagccgguacccaccaaaggagagaagaagcaauagcc

SEQ ID NO: 486238 - RNA, 64 nt, Human
gcguuuuauaguccucuaaaaucuaggugcucccacccaccaaaggcauauccugcaaagggcu

SEQ ID NO: 486239 - RNA, 64 nt, Human
acaucagguuuucagaaggaaaaaacauuuaaaaacccaccaucacaugagagaaucacuugaa

SEQ ID NO: 486240 - RNA, 64 nt, Human
ccuuuggugguucugcccucugcccuccagcuuuacccaccagaguaagcaaucuuuucuuuuu

SEQ ID NO: 486241 - RNA, 64 nt, Human
uguggcugcccaggugcugagugagcuggugaccacccaccaccugaagcugaccaacacuaca

SEQ ID NO: 486242 - RNA, 64 nt, Human
ccuguaguaaggugcucaugggguuugucuucucacccaccaucagaggacuuuuaaaaucaua

SEQ ID NO: 486243 - RNA, 64 nt, Human
ggugauuccauuaccuagucaugaagaaguuaccacccaccaggccuuaccuaguguuucccau

SEQ ID NO: 486244 - RNA, 64 nt, Human
gcagcaggguacaugggugggagguucauucagcacccaccagucagguauguucugagugaac

SEQ ID NO: 486245 - RNA, 64 nt, Human
aguagccguuagggcgcaguaucggcagcuugacacccaccaagcaaaaguuucagccuggaaa

SEQ ID NO: 486246 - RNA, 64 nt, Human
ugccucagccuccugaguagcugauacuacaggcacccaccaccacgcccagcuaauuuuuuug

SEQ ID NO: 486247 - RNA, 64 nt, Human
gagcagcugugagcugagcgcccacuagaggggcacccaccaguugcugcugccccacuacagg

SEQ ID NO: 486248 - RNA, 64 nt, Human
cugagggucacucgcccugcaagagucacuaggcacccaccaugccaauaaggcucuccgcugg

SEQ ID NO: 486249 - RNA, 64 nt, Human
agggacuccaggccaaguccaacagagaccccaaacccaccacacaccagcagccacaaccuca

SEQ ID NO: 486250 - RNA, 64 nt, Human
gguuauaaugccccgcaucaucccuuugcugguuacccaccagguuaucccaugcaggccuaug

SEQ ID NO: 486251 - RNA, 64 nt, Human
ggcuuggcugccugacauaagcuaaaucucccagacccaccacuggcuaccgauaucuauuugg

SEQ ID NO: 486252 - RNA, 64 nt, Human
agggacagacgcagggagaccccaccaccaccaccaccaccaacaccaccaccaccaccgcgag

SEQ ID NO: 486253 - RNA, 64 nt, Human
cuaagggacagacgcagggagaccccaccaccaccaccaccaccaacaccaccaccaccaccgc

SEQ ID NO: 486254 - RNA, 64 nt, Human
cgucuaagggacagacgcagggagaccccaccaccaccaccaccaccaacaccaccaccaccac

SEQ ID NO: 486255 - RNA, 64 nt, Human
gccucuggugagagggagagcccuucccauccuuacccaccaggaacuagagccccaaccacag

SEQ ID NO: 486256 - RNA, 64 nt, Human
agggcugggggguggucugugcagacaccuccucacccaccaccccaugcauacucuugggaag

SEQ ID NO: 486257 - RNA, 64 nt, Human
ugccucaaccucccgaauggcugggacuacaggcacccaccaccacgccuggcuaacuaacuaa

SEQ ID NO: 486258 - RNA, 64 nt, Human
gagucuaauauauuguuucaaaagauacauuuuuacccaccauaaauguuacaauaucugaaua

SEQ ID NO: 486259 - RNA, 64 nt, Human
uuauuuaauuuguuuaaaaaaaaaaaggcagaaaacccaccaugggaaaauaagcauuuuuuaa

SEQ ID NO: 486260 - RNA, 64 nt, Human
ucaacuguggagguccgaggggaugagaagggauacccaccaucuuucaagggucacaagcuca

SEQ ID NO: 486261 - RNA, 64 nt, Human
uccuuuuacguugaaucagaugcuuugaguuuaaacccaccauguauggaagagcaagaaaaga

SEQ ID NO: 486262 - RNA, 64 nt, Human
acuuguccuagcguuuuggaagaggaaaacaggaacccaccaaaccaaccaaucaaccaaacaa

SEQ ID NO: 486263 - RNA, 64 nt, Human
ccuccuccucgggcacagacgacugucguucuccacccaccagucagggacagcagccucccug

SEQ ID NO: 486264 - RNA, 64 nt, Human
agcccucuccacccagaggucucccuauaccgagacccaccauccuuccauccugaggaccgcc

SEQ ID NO: 486265 - RNA, 64 nt, Human
ugggggguugccucgaguccccccaccccuccccacccaccaccgcucccgcgggaagccagcc

SEQ ID NO: 486266 - RNA, 64 nt, Human
uuaauucaacauugccauaaaugcuuuaaagaaaacccaccacacuuuccuccuacuccggucu

SEQ ID NO: 486267 - RNA, 64 nt, Human
uccuugucccuuugacaauaagguuaauugauagacccaccaccucuugcacucucgcuuuugg

SEQ ID NO: 486268 - RNA, 64 nt, Human
cagcacgcaaagugucacgugggccuuagccgucacccaccagcuuccucaccaggcaaggagg

SEQ ID NO: 486269 - RNA, 64 nt, Human
uguuaaaggcuaugauugucuuuguucuucuaccacccaccaguugaauuucaucaugcuuaag

SEQ ID NO: 486270 - RNA, 64 nt, Human
uuccauuugauacuuugaauacucugagguccuuacccaccaaauggauggaauucagcugcuc

SEQ ID NO: 486271 - RNA, 64 nt, Human
ggacuacgucuaagggacagacgcagggagaccccaccaccaccaccaccaccaacaccaccac

SEQ ID NO: 486272 - RNA, 64 nt, Human
uuuuuuugguccuucuuuccucuuaacguaaauccaccaccaaaauuauuaauccucuugagag

SEQ ID NO: 486273 - RNA, 64 nt, Human
caauucaaaagaaauuuuaaaaaaauccuacuaacaccaccacaaauaugcaaucagcaauauc

SEQ ID NO: 486274 - RNA, 64 nt, Human
ucauuuucccaccugccuccccuacccaccccccacccaccaccuggggcuuccucuggggguc

SEQ ID NO: 486275 - RNA, 64 nt, Human
ugccucagccuccugaguagcuggaauuacaggcacccaccaccacacccagcucauuuuugua

SEQ ID NO: 486276 - RNA, 64 nt, Human
ugccucugccucccaaguagcugggauuacaggcacccaccaccaugcccagcuaauuuuuugu

SEQ ID NO: 486277 - RNA, 64 nt, Human
uaccauguauaugacaggauguuuguccugggacacccaccagauuguacauacuguguuuggc

SEQ ID NO: 486278 - RNA, 64 nt, Human
uugacaggaaccuuaaguaaucaucuaagucaguacccaccaccuucuucuccuacauaucccu

SEQ ID NO: 486279 - RNA, 64 nt, Human
cuaguucaaauuauuuggaaguguucccugagaaacccaccagccuaagaagcucuggccccag

SEQ ID NO: 486280 - RNA, 64 nt, Human
cacccaucucugcucccacccuugccugccucuaacccaccacuggccagcccccuugcccuac

SEQ ID NO: 486281 - RNA, 64 nt, Human
ccuaagcagccaggcccggcccagggagcuacaaacccaccaauaaaacugauauaaggacaga

SEQ ID NO: 486282 - RNA, 64 nt, Human
ucaaucagucaauaaaaauuacaguaauuauuagacccaccacuaggucaucuuauuugaugca

SEQ ID NO: 486283 - RNA, 64 nt, Human
ccagccucucuugacuacagaauaacugauauucacccaccaaacagaaaaagugaaggcuggg

SEQ ID NO: 486284 - RNA, 64 nt, Human
caggcccgacaccuacacucucaccagcuuuggcacccaccaaggacaggcagaagccggacag

SEQ ID NO: 486285 - RNA, 64 nt, Human
gcucagcucagcaagguucucaacugccucgaguacccaccagaccaagaaggccugcggcaga

SEQ ID NO: 486286 - RNA, 64 nt, Human
ugugagaggugggcgcuuuggagguuugccccucacccaccagcugccccaucccugaggcagc

SEQ ID NO: 486287 - RNA, 64 nt, Human
gcugcugaguggagagaggccucauccggcuuugacccaccauccguugcagaagccuccagga

SEQ ID NO: 486288 - RNA, 64 nt, Human
cuagaggcucaguggugggagagaucccugcagaacccaccaaccagaacgugguuugccugag

SEQ ID NO: 486289 - RNA, 64 nt, Human
gccggggacucccaggcuggagagcacugccaggacccaccacuggaagcaggauggagcugac

SEQ ID NO: 486290 - RNA, 64 nt, Human
aucauugggguuuguagucccaacuugcugcugucaccaccaaacucaaucauuuuuuucccuu

SEQ ID NO: 486291 - RNA, 64 nt, Human
cucagccuccuaaguagcugggaguacaggcgcgcaccaccacgccuagcugauuuuuguauuu

SEQ ID NO: 486292 - RNA, 64 nt, Human
caggggguaccugugggguucuucucuucauuuucaccaccacaaagcuggucuaagcugccau

SEQ ID NO: 486293 - RNA, 64 nt, Human
accgugaagcucuuccuacccuccucccccaaaaacccaccaaaauuaguuuuagcuguagauc

SEQ ID NO: 486294 - RNA, 64 nt, Human
gccugaagagggccugacacuucacagaguggggacccaccagagccuauagaaucaauuccuu

SEQ ID NO: 486295 - RNA, 64 nt, Human
cacagcacccuccggcgcugaaaauacacgcaccacccaccaggagccuugggaucauaaacac

SEQ ID NO: 486296 - RNA, 64 nt, Human
cccccuccccccccgccccucugcuucccuccccacccaccaccucaaggguagggaguugcuc

SEQ ID NO: 486297 - RNA, 64 nt, Human
acugaaauaggaagucaugcucuucccacccuccacccaccagaguggaacccgcugcaaaauc

SEQ ID NO: 486298 - RNA, 64 nt, Human
aggggagggcuccacaagcgugucuggcauucccacccaccauggaagacuggauacgcaccug

SEQ ID NO: 486299 - RNA, 64 nt, Human
gcugaaacugauguuuaucuucauugacaaauuuacccaccaucugugguuuuucaguuguuua

SEQ ID NO: 486300 - RNA, 64 nt, Human
ggaguuuuugucauuguguacguuguguauuugaacccaccaugacagaaaguaaauuuuagga

SEQ ID NO: 486301 - RNA, 64 nt, Human
uggccucuagcccagagaagcccgcgcaucuuggacccaccaagcaggcccagccuuccugcug

SEQ ID NO: 486302 - RNA, 64 nt, Human
cccuucucccauuccagaucaucagcacacccacacccaccauaggucucucuccuccggucuu

SEQ ID NO: 486303 - RNA, 64 nt, Human
ugccuuagccucccgaguagcugggauuauaggcacccaccaccacgcccagcuaauuuuugua

SEQ ID NO: 486304 - RNA, 64 nt, Human
aaaccuuggcuuuagcccucuggaaucagagcuuacccaccauaguauauuuugauauuaggug

SEQ ID NO: 486305 - RNA, 64 nt, Human
ugcuucagccucccaaguagcugagacuacaagcacccaccaucacacccagcuaauuuuguau

SEQ ID NO: 486306 - RNA, 64 nt, Human
ggcucagcgguggggcagccuguccggggcgcugacccaccaucacccugcucugcccagccuc

SEQ ID NO: 486307 - RNA, 64 nt, Human
cacacucuugaagagcuuccaagaaguugauggaacccaccaauaugucauaguaaagucuccu

SEQ ID NO: 486308 - RNA, 64 nt, Human
uauaagccuuugccagguguaacuguugugaaauacccaccacuaaaguuuuuuaaguuccaua

SEQ ID NO: 486309 - RNA, 64 nt, Human
cucagccucccagguagcugggauuacaggcacccaccaccacgccuggcuaauuuuuguauuu

SEQ ID NO: 486310 - RNA, 63 nt, Human
ccucagucccaauuggcuaggacugcaggcacacaccaccagacccagcuaauguaauuucua

SEQ ID NO: 486311 - RNA, 64 nt, Human
aggaugugggaccuuugagccgaugugcacuggccaccaccaggguugggggcgccacagcugc

SEQ ID NO: 486312 - RNA, 64 nt, Human
ucuuccuguuuugcuguagucacugguguuccucacccaccagcuguaacucaguuugugugag

SEQ ID NO: 486313 - RNA, 64 nt, Human
auaugaaguaagauuacaacagagcagaacuugcacccaccauuuuuuuuaccugauuuuuguu

SEQ ID NO: 486314 - RNA, 64 nt, Human
accaugaauauuucucaccauaggaauaaccacaacccaccaaguacccauguuggcccugccu

SEQ ID NO: 486315 - RNA, 64 nt, Human
aucucauccaaauaacauuguucccauccuccccacccaccacaucaaaacauaacacaucaca

SEQ ID NO: 486316 - RNA, 64 nt, Human
uuuuaaagggaauauggauaagcauaguaacaaaacccaccagaaucuaagcaguuuucacccc

SEQ ID NO: 486317 - RNA, 64 nt, Human
agguggcaucagugucuuuccacuccuccuagccacccaccacacugauccagcccugaguucc

SEQ ID NO: 486318 - RNA, 64 nt, Human
ugauacccacacccagccaucuggagucauggagacccaccacgucucuaugccggaugaccuu

SEQ ID NO: 486319 - RNA, 64 nt, Human
gcacuuguuacaaacacacgaugcaccuuaacucacccaccacgaggcacuuuacagacugggg

SEQ ID NO: 486320 - RNA, 64 nt, Human
agaauccccggaagggggcaaugccagugccuggacccaccaggaugcagggcaagcugggauc

SEQ ID NO: 486321 - RNA, 64 nt, Human
caccucagccucccagguagcugggauuacaggcacccaccaccacgccuggcuaauuuuugua

SEQ ID NO: 486322 - RNA, 64 nt, Human
gggagacaggugaggcggucggaucuacagaacaacccaccauuucugggggccgcagaggauc

SEQ ID NO: 486323 - RNA, 64 nt, Human
cugaacacuuccuggggagcuacaggggcacuuaacccaccacagcacagccucaucaaaaugc

SEQ ID NO: 486324 - RNA, 64 nt, Human
ucccuacacaucuauggguaucacacccaagacuacccaccaagcucauacagggaaccacacc

SEQ ID NO: 486325 - RNA, 64 nt, Human
cucacagaggcccccucugucaucacuccuuggcacccaccaacuuccugcacacacuggcaga

SEQ ID NO: 486326 - RNA, 64 nt, Human
gacaguguagcgucauguuagaggagacgaucugacccaccaguuuguacaucacguccugcau

SEQ ID NO: 486327 - RNA, 64 nt, Human
ugccucagccucccgaguagcugggauuacaagcacccaccacuacacucagcuaauuuuuugu

SEQ ID NO: 486328 - RNA, 64 nt, Human
cacagccucccagguagcugggacuacaggcgugcaccaccacacccagcuaauuuuuaaguuu

SEQ ID NO: 486329 - RNA, 64 nt, Human
cucagccuccugaguagcugggauuacaggcacacaccaccacgcccagcuaauuuuuguauuu

SEQ ID NO: 486330 - RNA, 64 nt, Human
cccuauuuucagcuacuauuugaauauucuugaacaccaccacugaagaguuucauauacacca

SEQ ID NO: 486331 - RNA, 64 nt, Human
gaugcaauuugauuuuaugaaguauauacccuuuacccaccagagacaguacagaaucccugcc

SEQ ID NO: 486332 - RNA, 64 nt, Human
uuguuagaggagagcuugaugugauuaucuucaaacccaccaaaccaacaggauaauugacaaa

SEQ ID NO: 486333 - RNA, 64 nt, Human
agcacaccuacagagcaccuguagcugcugcgccacccaccaucaaaggaauauaagaaaagua

SEQ ID NO: 486334 - RNA, 64 nt, Human
auuccagagcaguacaucugcuauaucugccgggacccaccaggucagagguggagugcaaaau

SEQ ID NO: 486335 - RNA, 64 nt, Human
agauaacuaauuguguugaagaaacuuagacuucacccaccagcuggcacaggugcacagauuc

SEQ ID NO: 486336 - RNA, 64 nt, Human
gggauccccaucagcacagccaggcagagaugauacccaccacacaccugggggcccccacacc

SEQ ID NO: 486337 - RNA, 64 nt, Human
ugccucagccucccgaguagcugggauuacaggcacccaccaccacgcccagcuaauuuuugua

SEQ ID NO: 486338 - RNA, 64 nt, Human
gauggcacccgaggcauuauuugaccggaucuacacccaccagagugaugugugaguuuguaau

SEQ ID NO: 486339 - RNA, 64 nt, Human
caaaggcgcagugcuucucuacagacuucuccagacccaccacaccgcagaagcgggacgagac

SEQ ID NO: 486340 - RNA, 64 nt, Human
aaugauuacuucaaacacuggcaccuugggucucacccaccauaggaaacaagacaacauucaa

SEQ ID NO: 486341 - RNA, 64 nt, Human
aagauaaaaaaacagcuuuauugagguauaauucacccaccagacuuuuuuaaacaucaaauaa

SEQ ID NO: 486342 - RNA, 64 nt, Human
guguggcuuacuauuucauugugugcacccacccacccaccacacuggacuuuucuagagaugg

SEQ ID NO: 486343 - RNA, 64 nt, Human
ugccucagcuuccuaaguagcuggguuuacaggcacccaccaccaugcccagcuaauuuuugua

SEQ ID NO: 486344 - RNA, 64 nt, Human
uuugaaacaucuggcugcguugccauuggcugagacccaccagguccaguuuugguugguguag

SEQ ID NO: 486345 - RNA, 64 nt, Human
auuagucaccaugaggucacugggguggccccuaacccaccaugacugguguccuucuaaggag

SEQ ID NO: 486346 - RNA, 64 nt, Human
ggaaaaaauauuacauuuuaagggggaaaaaaaaacccaccauucucuucucccccuauuaaau

SEQ ID NO: 486347 - RNA, 64 nt, Human; identical to SEQ ID NO: 390051

SEQ ID NO: 486348 - RNA, 64 nt, Human; identical to SEQ ID NO: 390052

SEQ ID NO: 486349 - RNA, 64 nt, Human; identical to SEQ ID NO: 390053

SEQ ID NO: 486350 - RNA, 64 nt, Human
cugccucagccucccuaguagcugggacuacagcacccaccaccacacccagcuaauuuuugua

SEQ ID NO: 486351 - RNA, 64 nt, Human
guuggugucugugguagcuuuuaggcugcuccuaacccaccauuuauugccuucugagaggugg

SEQ ID NO: 486352 - RNA, 64 nt, Human
uggacagagacaccugcacuuggaacuggacuccacccaccaguuccauuuuggguggcagcag

SEQ ID NO: 486353 - RNA, 64 nt, Human
aaguguaauaggucaguuucaaaacgaccaaaagacccaccacuguauuuugaccaaauaauga

SEQ ID NO: 486354 - RNA, 62 nt, Human
ccuccuucuggcgcuccugaugucacuccaucacccaccaucaccgcugcugcaaagaggca

SEQ ID NO: 486355 - RNA, 64 nt, Human
uugguccuguuuucuauucuuuauuuuuccugcaacccaccagaccccaggccucaccggaggc

SEQ ID NO: 486356 - RNA, 64 nt, Human
agaacuaugacagucuucaagucaauuaaaauccacccaccagucuuaggcaucauaaugugcc

SEQ ID NO: 486357 - RNA, 64 nt, Human
aagggauaaagguaauagagcccuucugccccccacccaccaaauuuacacaacaaaaugacau

SEQ ID NO: 486358 - RNA, 64 nt, Human
guauucucuggugaggguggcugggauauaccugacccaccaucuucagaaggacccaugucag

SEQ ID NO: 486359 - RNA, 64 nt, Human
cacaccagcucagccacagcagagccaaucacagacccaccacacagcccagcagcccuucgug

SEQ ID NO: 486360 - RNA, 64 nt, Human
uuuacacaucaugucaaagauaacagcuguucccacccaccaguuccucuaagcacauacucug

SEQ ID NO: 486361 - RNA, 64 nt, Human
cucccucaggggaggugggccaugcagcuaacccacccaccaaagacccccucacccuggcccc

SEQ ID NO: 486362 - RNA, 64 nt, Human
ggggguaugauguggaagcugguuucagcccaggacccaccacugaggagaggaucuagacagg

SEQ ID NO: 486363 - RNA, 64 nt, Human
uugcuugcuauuaaaaagguuaagaggccagguuacccaccaguccuugcacuguucugacacu

SEQ ID NO: 486364 - RNA, 64 nt, Human
acgcucugcagcauucaccgacagucugucaugcacccaccacguuggccauguccuuguguuc

SEQ ID NO: 486365 - RNA, 64 nt, Human
ugcuaaaccuguuucuggugccucccauccccagacccaccagacaccacacagcagacaauac

SEQ ID NO: 486366 - RNA, 64 nt, Human; identical to SEQ ID NO: 390057

SEQ ID NO: 486367 - RNA, 64 nt, Human; identical to SEQ ID NO: 390058

SEQ ID NO: 486368 - RNA, 64 nt, Human; identical to SEQ ID NO: 390059

SEQ ID NO: 486369 - RNA, 64 nt, Human
ggccuggccuuucccucuccugcugagaaccagaacccaccaggagcaccacagaguccuccuc

SEQ ID NO: 486370 - RNA, 64 nt, Human
caaugccacagccaagcccacccugggaugggccacccaccagggcucagcuccuugguucccu

SEQ ID NO: 486371 - RNA, 64 nt, Human
gcaggggggcagguacacacacacccacaggcacacccaccaguacacacgcgugcgcauacac

SEQ ID NO: 486372 - RNA, 64 nt, Human
gaacuguuacgacccaggacaauuagaaaaauucacccaccaugccgcacauuacuggguaaaa

SEQ ID NO: 486373 - RNA, 64 nt, Human
cacacuguccgagcccucugcucagccgccugggacccaccagggugcagcugggcuccagggu

SEQ ID NO: 486374 - RNA, 64 nt, Human
auuuuggucccacagagcaggggauguaguuuguacccaccauggcgcagacuuccaaauaaau

SEQ ID NO: 486375 - RNA, 64 nt, Human
ugccucagccucccgaguagcugggauuaccggcacccaccaccacgccuggcuaauuuuucaa

SEQ ID NO: 486376 - RNA, 64 nt, Human
agauaggcucugcacagauggauuugccugugccacccaccagggcgaacgacaauagcuuuac

SEQ ID NO: 486377 - RNA, 64 nt, Human
cauuauuuaaauguauuuaacuguuaaaugcgcuacccaccaauaaugaaauagaccuuuauga

SEQ ID NO: 486378 - RNA, 64 nt, Human
gagcacuggcaguugguggcagugagaccagcccacccaccaccacccaccacagaaaagcaca

SEQ ID NO: 486379 - RNA, 64 nt, Human
aguugguggcagugagaccagcccacccaccaccacccaccacagaaaagcacaaaccucuggg

SEQ ID NO: 486380 - RNA, 64 nt, Human
aucacaggugauucacacguacacacauaaacacacccaccagugcagccugaaguaacuccca

SEQ ID NO: 486381 - RNA, 64 nt, Human
ggaaggcugcuagggauguuagaccucggccaggacccaccacauugcuuccuaauacccaccc

SEQ ID NO: 486382 - RNA, 64 nt, Human
uucaaauguccaucaauugauggggaaggcuggcacccaccaagaaguggaaguccucagaaau

SEQ ID NO: 486383 - RNA, 64 nt, Human
ggacuaucugggcucgucucucucugcuucgugaacccaccacaccagggccugucugcugugc

SEQ ID NO: 486384 - RNA, 64 nt, Human
gagacuuggugauggggggauugcgguaggugugacccaccagccucugagacaccagaucucu

SEQ ID NO: 486385 - RNA, 64 nt, Human; identical to SEQ ID NO: 390061

SEQ ID NO: 486386 - RNA, 64 nt, Human; identical to SEQ ID NO: 390062

SEQ ID NO: 486387 - RNA, 64 nt, Human; identical to SEQ ID NO: 390063

SEQ ID NO: 486388 - RNA, 64 nt, Human
uuccccagacgccuggcugcugaucgccuuccccacccaccaacccucagggcaaagccagguc

SEQ ID NO: 486389 - RNA, 64 nt, Human
gccuaagcaauucuguccucugauucccaccccuacccaccaaaaaaugguagacaugaaaggc

SEQ ID NO: 486390 - RNA, 64 nt, Human
ucgggacucaguggacaccaaagucaagaccagcacccaccacgggcccugccagccucugccu

SEQ ID NO: 486391 - RNA, 64 nt, Human
uccaugggggagugaaaccaauucucagagaacaacccaccagagacuuuuaaagagaggccag

SEQ ID NO: 486392 - RNA, 64 nt, Human
ugccucagcaucccaaguagcugggauuacaggcacccaccaccaugcccaacuaauuuuugua

SEQ ID NO: 486393 - RNA, 64 nt, Human
agaggguauggccugaagccugaagacucgccccacccaccacugcccagcacccaguguccuc

SEQ ID NO: 486394 - RNA, 64 nt, Human
gcccacgcccucccucucccaggcccgagaugugacccaccagugccuucugucugcucguuag

SEQ ID NO: 486395 - RNA, 64 nt, Human
auauugaggcuaugggguaggagaaaagugcacaacccaccacccccuuuacucgugcauuaaa

SEQ ID NO: 486396 - RNA, 64 nt, Human
ccauuaucaacuuuuaaaagugaauuugauuuguacccaccaggagaaauacaguugggaaggg

SEQ ID NO: 486397 - RNA, 64 nt, Human
ggcccgcgcuccgcccccagcgagccggggacccacccaccaccccccgcaccgccgacgccgc

SEQ ID NO: 486398 - RNA, 64 nt, Human
agucauuggcuggguucugauugcuagaugucacacccaccagcaucaccaaagugacucugag

SEQ ID NO: 486399 - RNA, 64 nt, Human
ugagugcaaguguuuuauaaaaaauaaaacaaaaacccaccaucacaaaaaaaaaaauuuugca

SEQ ID NO: 486400 - RNA, 64 nt, Human
guggacagauucucaaugccuuuuugaaguucugacccaccaaagaccuucugccuucacccuc

SEQ ID NO: 486401 - RNA, 64 nt, Human
cgaugcccaccguggucuuugaacucacccaagcacccaccaggcaggcuacaagugaggcuac

SEQ ID NO: 486402 - RNA, 64 nt, Human
gcaccuguggccagagcaccucaggacccuccccacccaccaaaugccucugccuugauggaga

SEQ ID NO: 486403 - RNA, 64 nt, Human
agcuccagguagggggccauguuucccagcggggacccaccaacagaggccaguuucaaaguca

SEQ ID NO: 486404 - RNA, 64 nt, Human; identical to SEQ ID NO: 390064

SEQ ID NO: 486405 - RNA, 64 nt, Human; identical to SEQ ID NO: 390065

SEQ ID NO: 486406 - RNA, 64 nt, Human; identical to SEQ ID NO: 390066

SEQ ID NO: 486407 - RNA, 64 nt, Human
ucugugcaucacucugcuagguugggggcccccgacccaccauaccuacgccuagggagcccgu

SEQ ID NO: 486408 - RNA, 64 nt, Human
ccugugcucuuccuagggagcuguguuguuucccacccaccacccuucccucugaacaaaugcc

SEQ ID NO: 486409 - RNA, 64 nt, Human
uuuccucuuuuaacgucugucuuguucucuuuuuacccaccacauauguauaacuaugugaaaa

SEQ ID NO: 486410 - RNA, 64 nt, Human
cuccagcacaaucccagugaaaaaggugugaagcacccaccauguucuugaacaaucagguuuc

SEQ ID NO: 486411 - RNA, 64 nt, Human
uccugcuggugguaucuauggaaaugaugaaguuacccaccacauuaaaacaaaagucugagau

SEQ ID NO: 486412 - RNA, 64 nt, Human
cacucccgggaccacggcaaaaggaaccacccagacccaccacccguacacccucagcagaccc

SEQ ID NO: 486413 - RNA, 64 nt, Human
ccagcgugguguccugucagcuuccucuuuaggaacccaccagagggcagcaagcuccuuucac

SEQ ID NO: 486414 - RNA, 64 nt, Human
cggccgauccucaggaugcagagaagucauguagacccaccagccccaccuuggggggaggcgu

SEQ ID NO: 486415 - RNA, 64 nt, Human
uuuacugauucguuuauggguaguaccgggaugaacccaccaccacaaagcaaauuagacaacu

SEQ ID NO: 486416 - RNA, 64 nt, Human
uaaaacaaccuacugugacugcaaaacugguuuuacccaccacugucacacaccaaucagaacu

SEQ ID NO: 486417 - RNA, 64 nt, Human
ugugagugaggcgugugugugugucuuuccuaggacccaccauacccuguguauguaugcaugu

SEQ ID NO: 486418 - RNA, 64 nt, Human
aucccaucacuccagcagcugggaccugaguccuacccaccauucuuaauacuguggcuuauac

SEQ ID NO: 486419 - RNA, 64 nt, Human
auucagcacuguguuccuguugucgugguucaagacccaccagguauuuucagauuauaaaacu

SEQ ID NO: 486420 - RNA, 64 nt, Human
uguuuuacagugucugauaaucuuguuagucuauacccaccaccucccuucauaaccuuuauau

SEQ ID NO: 486421 - RNA, 64 nt, Human
ucuugaaggcuccauggaaugagauaaagcauugacccaccacaggacaucucaugaagccaug

SEQ ID NO: 486422 - RNA, 64 nt, Human
ggugcuggacaagggccgcguagugcagcagggcacccaccagcagcugcuggcccagggcggc

SEQ ID NO: 486423 - RNA, 64 nt, Human; identical to SEQ ID NO: 390068

SEQ ID NO: 486424 - RNA, 64 nt, Human
cagccuccugaguagccggggagcuacaagcaugcaccaccacacccagcuaauuuuuuuuuuu

SEQ ID NO: 486425 - RNA, 64 nt, Human
cucagccucccuaguagcugggauuacaggugcacaccaccacaccuggcuaauuuuuguauuu

SEQ ID NO: 486426 - RNA, 64 nt, Human
aaaugcacaaguuauaaauacagaagaaagagcaacccaccaaaccuaacaaggacccccgaac

SEQ ID NO: 486427 - RNA, 64 nt, Human
cugaggugcagcugaucucuagcuaaucaacacaacccaccaacaaaugaccacagguuggcac

SEQ ID NO: 486428 - RNA, 64 nt, Human
uaccucagcuucccgaguagcugggauuauaggcacccaccaccacaccuggcuaauuuuugua

SEQ ID NO: 486429 - RNA, 64 nt, Human
agcuccugaacucugcgugaagggccuuaaugucacccaccagaaaacuaacuccaaauaaacg

SEQ ID NO: 486430 - RNA, 64 nt, Human
gcuugcacacaggaucacucacauauguacauguacccaccacaaacgugcaagcuccugcaca

SEQ ID NO: 486431 - RNA, 64 nt, Human
uacauagucagaacuuacacauuacuagaggcacacccaccaaggaguauugugucuacuuuua

SEQ ID NO: 486432 - RNA, 64 nt, Human
uauugaccagaaaacaaugauuuuauaauauuuaacccaccaaaaagucccuccaacagcaaua

SEQ ID NO: 486433 - RNA, 64 nt, Human
ucacauucugacacaagaugcaagucugugcaaaacccaccaaaaugcuccuauccaacaauua

SEQ ID NO: 486434 - RNA, 64 nt, Human
agauucauguuuagccaguguuuuccagccuuguacccaccauacagaucuguuuauucuguuu

SEQ ID NO: 486435 - RNA, 64 nt, Human
cuagauagcuauuaagauacuuagauuagaccuaacccaccauagucaauccaagacuagacua

SEQ ID NO: 486436 - RNA, 64 nt, Human
auaaaacagauugugauaagaaaagccagucaaaacccaccaaaaccaagauggcgacaaaagu

SEQ ID NO: 486437 - RNA, 64 nt, Human
gaucuucuagaugccacucccaaauccccuucauacccaccaggaugugugcccagccaggccu

SEQ ID NO: 486438 - RNA, 64 nt, Human
ugcucacauagccgguccccacgcccagcggcccacccaccagcagcugcuggaggucguagug

SEQ ID NO: 486439 - RNA, 64 nt, Human
acgaugugccgcaagcacugucucaccaucccgcacccaccagacaacagccagggcuggaguc

SEQ ID NO: 486440 - RNA, 64 nt, Human
caaagggaagcagauucuguauauguugguaacuacccaccaagagcacauggguagcagggaa

SEQ ID NO: 486441 - RNA, 64 nt, Human
gcgacugccaguauugcuggagccccaacacaguacccaccaggacggggcacuccgcccccac

SEQ ID NO: 486442 - RNA, 64 nt, Human
aagauuuaaaaucacaaacauuaacggcaguaggcaccaccauguaaaagugagcucagacguc

SEQ ID NO: 486443 - RNA, 64 nt, Human
auaucugccuccagggaggggaggggaugggaagcaccaccagccagcggaagagcagcccucu

SEQ ID NO: 486444 - RNA, 64 nt, Human
uaagcuguuugccaccucaaaacuuuaugaacuucaccaccacuagugucuguccauggaguua

SEQ ID NO: 486445 - RNA, 64 nt, Human
aaacaaaaaaaacacaaaaauuucaaaaaacaccacccaccaaauugcacaauagauacaccca

SEQ ID NO: 486446 - RNA, 64 nt, Human
ccagauagaaaguugcgggcaacacuuuucucagacccaccauguccccaacucagacuuagca

SEQ ID NO: 486447 - RNA, 64 nt, Human
ugccucagccucccaaguagcugggauuacaggcacccaccaccaugcccagcuaauuuuugua

SEQ ID NO: 486448 - RNA, 64 nt, Human
gaaaggugacaugacacaggcagagcagaguggcacccaccacagaauacaguguguguuauua

SEQ ID NO: 486449 - RNA, 64 nt, Human
accuggaucugaccucacaccaucagcagggggcacccaccaugcacaccugucucggaguagg

SEQ ID NO: 486450 - RNA, 64 nt, Human
gacauccucgagaggcagggcccaauccuuccagacccaccagcuggaaaagugaaggaagcau

SEQ ID NO: 486451 - RNA, 64 nt, Human
cacccuccccacaguaugcacucagccccacagaacccaccagucuuucugggaacucacaccu

SEQ ID NO: 486452 - RNA, 64 nt, Human
cuugugguugcuucugugaaccucuuccaggggaacccaccaagaccaaccuggucacauucuu

SEQ ID NO: 486453 - RNA, 64 nt, Human
caugcccaacacauuucugcuaauagggagagggacccaccacacacccacacaugccagaggu

SEQ ID NO: 486454 - RNA, 64 nt, Human
ugucucagccuccccaguagcugggauuacaggcacccaccaccaugcccagcuaauuguugua

SEQ ID NO: 486455 - RNA, 64 nt, Human
ccugagcuucguagccaaagcagccugaugacccacccaccaaggaagaaagcagaauaaacau

SEQ ID NO: 486456 - RNA, 64 nt, Human
gcaacagaaugaucuaaacugcaaacauuuucacacccaccaugcugcuugaaagccacuugau

SEQ ID NO: 486457 - RNA, 64 nt, Human
ugcuucagccucccgaguagcugggacuacaggcacccaccaucaugucuggcuaauuuuucau

SEQ ID NO: 486458 - RNA, 64 nt, Human
ugccucagcuucccgaguaacugagauuacaggcacccaccaccaugcccagcugcuuuuuugu

SEQ ID NO: 486459 - RNA, 64 nt, Human
gacugggcugcaggccccaggaagacuuuccuucacccaccaucccccuaaccucggcagggcu

SEQ ID NO: 486460 - RNA, 64 nt, Human
uggggagaccaguuucuggggagcuuccaagagcacccaccaagacacagcaggacaggccagg

SEQ ID NO: 486461 - RNA, 64 nt, Human
gaucuuacuccagccucccaagcagcugggacuacaccaccacagguaugcaccaccauaccug

SEQ ID NO: 486462 - RNA, 64 nt, Human
cccaagcagcugggacuacaccaccacagguaugcaccaccauaccuggcugauuuuuaaaauu

SEQ ID NO: 486463 - RNA, 64 nt, Human
uucugaguuuuggcaaaugcagucaagucacuaccaccaccacaauuaacagcuauaucacccu

SEQ ID NO: 486464 - RNA, 64 nt, Human
cucugcagccuucaggucuggggccaggagugggacccaccauuuguggggaaaguagcauucc

SEQ ID NO: 486465 - RNA, 64 nt, Human
ucucucgucugucugucugucugcccacucccccacccaccacugugcguuucugauuuccaaa

SEQ ID NO: 486466 - RNA, 64 nt, Human
gcauguacagagcucuguguauacacagcuucacacccaccagauuguuacuacaguggguugg

SEQ ID NO: 486467 - RNA, 64 nt, Human
augccuaaaaaagcuaaaggccaccccaccccccacccaccaccuccugccuccucuccucuuu

SEQ ID NO: 486468 - RNA, 64 nt, Human
ugucuccaggaaggcggccccguccccuacucauacccaccacagagcaccagccagugccaac

SEQ ID NO: 486469 - RNA, 64 nt, Human
ugccuguagcaauggccagagccucuggccccucacccaccauggaccagcccauuggccgagc

SEQ ID NO: 486470 - RNA, 64 nt, Human
uuccacuugugggcuucagguguuuucaagcacaacccaccacaacaagcaagugcauuuucag

SEQ ID NO: 486471 - RNA, 64 nt, Human
uuuggcucugcuguauccaucuauagugguagagacccaccagggcucaaguggaguccaucau

SEQ ID NO: 486472 - RNA, 64 nt, Human
ccucccucuuccaaacuccuacuguccucaccucacccaccacuguaaaaguauuacgucgugc

SEQ ID NO: 486473 - RNA, 64 nt, Human
agaguuccucauguugcaggguuuaagaaaucugacccaccaaggucaugugacuuuucuguac

SEQ ID NO: 486474 - RNA, 64 nt, Human
cacaguauagggggaaugggcuugcuucucccaaacccaccaguucuccacugucucuucugga

SEQ ID NO: 486475 - RNA, 64 nt, Human
gggagccacuaagcugacuaacaacuguccccucacccaccagcuauuuccccaggguagagug

SEQ ID NO: 486476 - RNA, 64 nt, Human
aaaggacaggcuccuggccuuggcacuugccugcacccaccaugaggcauggagcagggcagag

SEQ ID NO: 486477 - RNA, 64 nt, Human
ccugugaaaaacgugauuccugggccccaccaagacccaccaaaaccaucucuggggcuuggug

SEQ ID NO: 486478 - RNA, 64 nt, Human
uaaggcugcugcuaauuacagcccccaaccuccaacccaccagcugaccuagaagcagcaucuu

SEQ ID NO: 486479 - RNA, 64 nt, Human
uggaagugccaccuggaagugucucuggaagagcacccaccacuguucagccuuccccugcugu

SEQ ID NO: 486480 - RNA, 64 nt, Human
uggacuugggacaaagguuccucaggaccuuggacaccaccaccugcugagcuucccgucccag

SEQ ID NO: 486481 - RNA, 64 nt, Human
acaagguuuugaaaaaucuauacaccuguguaaccaccaccaccuguguaaccaccaccgccag

SEQ ID NO: 486482 - RNA, 64 nt, Human
aaaacguugcaaauuccuuuacuguuaucccccccaccaccaggaccauguagggugcagucuu

SEQ ID NO: 486483 - RNA, 64 nt, Human
cuugcugagccuccuugucuauccuuccucccccacccaccauuguaaaguuuaugucaccaga

SEQ ID NO: 486484 - RNA, 64 nt, Human
guuuuauaaucccgcucccucuccaggcaaccccacccaccagccuaggccugcuccuccaccc

SEQ ID NO: 486485 - RNA, 64 nt, Human
acgcggggggagccauccccgccgcccucacaggacccaccaggcagcggagacauguggaauu

SEQ ID NO: 486486 - RNA, 64 nt, Human
gggacagggagggggaccugucccccacucucucacccaccagcuccacacauuccagccaggc

SEQ ID NO: 486487 - RNA, 64 nt, Human
uuuuaggaggaaggcuuggcuccugucuucccagacccaccaugccuggagaggucaggaugga

SEQ ID NO: 486488 - RNA, 64 nt, Human
gcagccugggaaggcuggagaggcagacggugggacccaccagcucucuccccaucccgcuucu

SEQ ID NO: 486489 - RNA, 64 nt, Human
ugaguccccuccccguaaccucugcaaggccagcacccaccaucacuaccugcaccugcugugg

SEQ ID NO: 486490 - RNA, 64 nt, Human
cacuucuccugccuucccacccugacccggcagaacccaccaagugccugugugcagccuccug

SEQ ID NO: 486491 - RNA, 64 nt, Human
ucaggcaagcccggguucuaccccuaaugcaaauacccaccagggagaugucuagaggcagacu

SEQ ID NO: 486492 - RNA, 64 nt, Human
cagcccacccccuuugacucuggggugcagcuucacccaccaggccagcucaggaauucccugg

SEQ ID NO: 486493 - RNA, 64 nt, Human
cgugguccugcccugagccccuuuccccaccacaacccaccacggccaggcagagaagggcaac

SEQ ID NO: 486494 - RNA, 64 nt, Human
ugucccaaguugugccaagggaaugccucuugccacccaccauccugcccaggcccugagaggc

SEQ ID NO: 486495 - RNA, 64 nt, Human
uggggucccuuggggcgccccacgcugcuuccacacccaccaccucuggccuugggugguggca

SEQ ID NO: 486496 - RNA, 64 nt, Human
ugggcacgcggcccucuccugucagugccggcccacccaccagcaggcccccaacccccaggca

SEQ ID NO: 486497 - RNA, 64 nt, Human
gacaagcugugacuccagcugggggcgccacagcacccaccaccugccgccuucagacucucgg

SEQ ID NO: 486498 - RNA, 64 nt, Human
guaccugaaaaggauuuuagaaaacccugggaaaacccaccacaccaccacaaaauggccuuua

SEQ ID NO: 486499 - RNA, 64 nt, Human
ccucccuucccccaauacacagaaccaccgccaccaccaccaacaccgccacaccaacaccacc

SEQ ID NO: 486500 - RNA, 64 nt, Human
aacccucccuucccccaauacacagaaccaccgccaccaccaccaacaccgccacaccaacacc

SEQ ID NO: 486501 - RNA, 64 nt, Human
aucuaggugaucacugaagcaacgcaaccgcuuccaccaccaugguguuuguuucuagaacuuu

SEQ ID NO: 486502 - RNA, 64 nt, Human
agaaaaugacugacauuguuuuguuacugcuccuacccaccaaggggauaaagaaggcgaguuc

SEQ ID NO: 486503 - RNA, 64 nt, Human
aggaaagcugcuucauuuuugaaagaugauggagacccaccacuacuauaugaugaauagcacu

SEQ ID NO: 486504 - RNA, 64 nt, Human
guaacugacaaaccaccaaaaacugaaaccccagacccaccagaaagacaagugucuagcaaug

SEQ ID NO: 486505 - RNA, 64 nt, Human
ugucuccuuugagacagaggcauuucagauagauacccaccaugagguguucugggcaucugaa

SEQ ID NO: 486506 - RNA, 64 nt, Human
cuggggcgucaacauggggacucgaguaaaccugacccaccaauaaggauucagcuguccacac

SEQ ID NO: 486507 - RNA, 64 nt, Human
gauguaaaguuucuguaaaucuauuucauaucugacccaccaaacagauuucucuuuaauaaaa

SEQ ID NO: 486508 - RNA, 64 nt, Human
ugccucagccuccugaguagcugggauuacaggcacccaccaccacaccuggcuaauuuuuugu

SEQ ID NO: 486509 - RNA, 64 nt, Human
cgucuuguagcauggauuauucuucucauguuaaacccaccaaaauaaaggggacuaaauaggu

SEQ ID NO: 486510 - RNA, 64 nt, Human
gccugcagacccagacuccagccagaccugccucacccaccaaugcagccggggcuggcgacac

SEQ ID NO: 486511 - RNA, 64 nt, Human
cccgagaccccggcccccaccccacaccacagacacccaccagcccggccccucccggcgccug

SEQ ID NO: 486512 - RNA, 64 nt, Human
gagaggguggggcgggcugggguuggagggucccacccaccacccugcugugcuugggaacccc

SEQ ID NO: 486513 - RNA, 64 nt, Human
acaaaacugcgcccgucuuaggccugggugucugacccaccagcagugcaaugggcagguuucc

SEQ ID NO: 486514 - RNA, 64 nt, Human
gugaccaccaccacguucagguuucugaaugcagacccaccacgagggauggauuccacccgcc

SEQ ID NO: 486515 - RNA, 64 nt, Human
cucugggucccagaggggccggguggcucagacgacccaccacucccccacccugaccgugcug

SEQ ID NO: 486516 - RNA, 64 nt, Human
ugucucagccucccaaguagcugggauuacaggcacccaccaccacauccagcuaauuguugua

SEQ ID NO: 486517 - RNA, 64 nt, Human
uccugguggcagcaccaggggacacaccugccaaacccaccagauggaggggcccucccugguc

SEQ ID NO: 486518 - RNA, 64 nt, Human
aacaaaaucaauuguguggcagcuguauuuucugcaccaccauuuccagcagcaaucggcucuc

SEQ ID NO: 486519 - RNA, 64 nt, Human
cucagccauccaaauagcugggaccacaggugugcaccaccacgcccggcuaauuuuuuguauu

SEQ ID NO: 486520 - RNA, 64 nt, Human
ugggcugauaaccaaauuuuaacacaucagcauucaccaccagguuuacuuuuauuuucagauu

SEQ ID NO: 486521 - RNA, 64 nt, Human
cacgagaugcugucacucagccagaucaguauugacccaccaggggaggugggguuuggugaga

SEQ ID NO: 486522 - RNA, 64 nt, Human
ucccaggaggccuccuggaagcccaggacugcccacccaccacgcuggugcccaccgccuggcc

SEQ ID NO: 486523 - RNA, 64 nt, Human
cuucccucucccugcugaccugggagucgcaggcacccaccagcugccaagagaaucccuggac

SEQ ID NO: 486524 - RNA, 64 nt, Human
aguccaucugcaaucacaagcacauagccagguaacccaccaacuccccuggaucugcagccca

SEQ ID NO: 486525 - RNA, 64 nt, Human
ggagagaggaccuccucugacaaacuggucugguacccaccaugugccaggauccacccuggcc

SEQ ID NO: 486526 - RNA, 64 nt, Human
gccacagucccccaacccuccacagagcccccagacccaccagaacuuccacagacgcccccac

SEQ ID NO: 486527 - RNA, 64 nt, Human
augacuaggugguaagguucugccaugccuggugacccaccauggacauacuggaccuuaauuc

SEQ ID NO: 486528 - RNA, 64 nt, Human
caaucgguccacacuccccgcccuggccucugguacccaccauucuccucuguacuucucuaag

SEQ ID NO: 486529 - RNA, 64 nt, Human
ugccacagccuccugaguaccugagauuacaggcacccaccaccaugcccagcuaauuuuugua

SEQ ID NO: 486530 - RNA, 64 nt, Human
ccucgagcaaaaaccucuggcgccuccaauccagacccaccacagcuggagggccaggccuccu

SEQ ID NO: 486531 - RNA, 64 nt, Human
cgauuuauuuuuguacaaaauaauaaaaaaaaaaacccaccacaaacguagaauccacuucugu

SEQ ID NO: 486532 - RNA, 64 nt, Human
agaaagagagagacagagagagagaaaaaaaaucacccaccacccccccaaaaacacaaaaaaa

SEQ ID NO: 486533 - RNA, 64 nt, Human
ccccaggcacuggaucccagauucccaagccuucacccaccagauucuggcuccuaaaacaagu

SEQ ID NO: 486534 - RNA, 62 nt, Human
gucgcucucggagguccuagacucguccugacacccaccaggcggcccccuucggagccccc

SEQ ID NO: 486535 - RNA, 64 nt, Human
uagagcugcuggggaggggcugccuguuuuacucacccaccagcuuccgccucccccauccugg

SEQ ID NO: 486536 - RNA, 64 nt, Human
ucugccuuacggccagucggacagacgucccgccacccaccaccccucacaggacguccgcuca

SEQ ID NO: 486537 - RNA, 64 nt, Human
ucuuucucucuuuuucuuugaggagaaugauggucaccaccacaauuaauuguaauuaagggaa

SEQ ID NO: 486538 - RNA, 64 nt, Human
uguuuucuucuuguuauuccuccagcaacucccucaccaccacgccucccugccuaccaucccc

SEQ ID NO: 486539 - RNA, 64 nt, Human
aagguuuguagcuccucuccggcugccuugcagacaccaccacaugggcucugcucuaugggaa

SEQ ID NO: 486540 - RNA, 64 nt, Human
uccaggagggauggaauguucuuuaaaauucaacacccaccaggcucuaagcggcgaucugugc

SEQ ID NO: 486541 - RNA, 64 nt, Human
ugccucagccuccuaaguagcugggauuacaggcacccaccaccaugcccagcuaauuuuugua

SEQ ID NO: 486542 - RNA, 64 nt, Human
aacaaagacccuuguucuuaucccucaagaagaaacccaccauaaccagcccacugucaccccu

SEQ ID NO: 486543 - RNA, 64 nt, Human
ccuuccuccuuccagguccccugcccggugauggacccaccaucaacugcauccuccaagcugg

SEQ ID NO: 486544 - RNA, 64 nt, Human
cugugaccucccaaagugcuaggauuaaaacaugacccaccaugcucagaguccauuuucauuu

SEQ ID NO: 486545 - RNA, 64 nt, Human
agaaaccccgagacacuguacacuguuccuuuucacccaccaccccgaucccuaggugaggaga

SEQ ID NO: 486546 - RNA, 59 nt, Human
agacgaugaagaacaauuagacuggacccacccaccacagcccaucacccuccauuucc

SEQ ID NO: 486547 - RNA, 64 nt, Human
aaucgguccacacuccccgcccccggccucugguacccaccauucucuucucuacuucucugag

SEQ ID NO: 486548 - RNA, 64 nt, Human
ugucccugaauuuuccuagaucccuccaaaugccacccaccagagucacuggugaccccagaaa

SEQ ID NO: 486549 - RNA, 64 nt, Human
ugccucagccuccugaguagcugggcugacaggcacccaccaccacacccagcuaauuuuuaug

SEQ ID NO: 486550 - RNA, 64 nt, Human
cacugcaugauagcguucuggugagcugggaaggacccaccacugccacugaggauuguuuugg

SEQ ID NO: 486551 - RNA, 64 nt, Human
ugcuuacgaguaagugaauccugauuauuuccagacccaccaccagaguggaucuuauuuucaa

SEQ ID NO: 486552 - RNA, 64 nt, Human
gcuuggccccacaggcugaccccgcacuacaucuacccaccagccaucgugcagcccagcgugg

SEQ ID NO: 486553 - RNA, 64 nt, Human
ugcaaaucuaugaccuucacauuuuuuccaccacacccaccaguagcuguuggugauugcaugg

SEQ ID NO: 486554 - RNA, 64 nt, Human
uaaaagugaaacguaauuguacaagcaguuaaucacccaccauagggcaugauuaacaaagcaa

SEQ ID NO: 486555 - RNA, 64 nt, Human
gauuuuggcagagaaauuuucagcugugcuugauacccaccaaaagaauguaucucgaaagaau

SEQ ID NO: 486556 - RNA, 64 nt, Human
cuuagccucccaaguaccugggacuacaggcacgcaccaccaugccuagcuauucuuuuguauu

SEQ ID NO: 486557 - RNA, 64 nt, Human
cuuagccucccgaauagcuggaauuacaggcacgcaccaccaugccugacuaauuuuguauuuu

SEQ ID NO: 486558 - RNA, 64 nt, Human
acuaagcuaccugccuucaaaauaguuuagggaccaccaccauauuuuauuuuguuuuuauuuu

SEQ ID NO: 486559 - RNA, 64 nt, Human
cccgucuaacacugcauccucccaacugggcauuacccaccauuguagccaccugugcgccaug

SEQ ID NO: 486560 - RNA, 64 nt, Human
gccgguuagucuccaguuuccacagagaccaccuacccaccaccuucccaggucaccugccugg

SEQ ID NO: 486561 - RNA, 64 nt, Human
uuggucuaggacauauauuuuguauuuuccccucacccaccauccaauaaugaguaauagcaca

SEQ ID NO: 486562 - RNA, 64 nt, Human
uccugcccagaugcccuuuggaaagccauugaccacccaccauauuguuugaucuacuucauag

SEQ ID NO: 486563 - RNA, 64 nt, Human
agugaaaagauuccucuugcugcgagaaagcuuuacccaccaugaguuauugcugucgacgggg

SEQ ID NO: 486564 - RNA, 64 nt, Human
ccuuggagccucuuggccuucagagcagaggcaaacccaccacagggcagcugcguuuuaggaa

SEQ ID NO: 486565 - RNA, 64 nt, Human
gaacuguauuuacauacaucauguuuuaucagguacccaccaacuuuauacuuucugccuucag

SEQ ID NO: 486566 - RNA, 64 nt, Human
acccuacgggggucaggagagcccugcggcccccacccaccagcucagaaccugucacuaauac

SEQ ID NO: 486567 - RNA, 64 nt, Human
cuuacaaaaugcauuuggaaaccagaccuuugcuacccaccaaugucucuggguuuuguaccag

SEQ ID NO: 486568 - RNA, 64 nt, Human
cgacaaccagguuggaaaccaagacggagcucagacccaccacaucgccccagaggcuuuucca

SEQ ID NO: 486569 - RNA, 64 nt, Human
caucugggccugggcgacguggauccuccuuaccacccaccaggccagauuuacaggagagaga

SEQ ID NO: 486570 - RNA, 64 nt, Human
guuaggagcacuuggugaagacaaggccgucaggacccaccaugucugccccaucacgcggccg

SEQ ID NO: 486571 - RNA, 64 nt, Human
ucugaggucucuucagcccuuuucgcuaguggucacccaccaccaugguuacuugccagcaaca

SEQ ID NO: 486572 - RNA, 64 nt, Human
acagacaagccuccauuaaagccacagcagugcuacccaccacacacaccuugcuggcccggcc

SEQ ID NO: 486573 - RNA, 64 nt, Human
cugaagauccuucagguccccuggcccuuccuucacccaccacccccaucaucaccgauucuuc

SEQ ID NO: 486574 - RNA, 64 nt, Human
acugucuguggcccccagcaugggccacauaccaacccaccauggagcaaagcugauuuuaagu

SEQ ID NO: 486575 - RNA, 64 nt, Human
gagcuuuuguuuuuugaugggguuuuauccucuucaccaccacuacccacuccauuuuuuuucu

SEQ ID NO: 486576 - RNA, 64 nt, Human
cagggccccgcaccaguuggagcagaugccuccccaccaccaauugccaaagguccaauaaaau

SEQ ID NO: 486577 - RNA, 64 nt, Human
uuuuccccuggggcuccaggaccuucccuaccuccaccaccaaaccaagggauuuauagcaaag

SEQ ID NO: 486578 - RNA, 64 nt, Human
cuccccacccucugugggccacacgugcacuugcacccaccacacacacacacacacacacaca

SEQ ID NO: 486579 - RNA, 64 nt, Human
agaggccucuuucugccuccauggcuauccauccacccaccaagacccuguucccugagccugc

SEQ ID NO: 486580 - RNA, 64 nt, Human
ccucgggcccucucuccgccccggacaggguggcacccaccacucucaggaccacccugccaag

SEQ ID NO: 486581 - RNA, 64 nt, Human
gacugcagccucuuccucccucagaucccaccagacccaccaggugccauaauaaagcggauuc

SEQ ID NO: 486582 - RNA, 64 nt, Human
agucccaagaugccagaaaggcagucucccaaggacccaccaugcagaagugucaauaaaccac

SEQ ID NO: 486583 - RNA, 64 nt, Human
aaaauggauguuauggagcuucaagaaucgaguuacccaccagaacccuaaugguaaagcuaug

SEQ ID NO: 486584 - RNA, 64 nt, Human
gccagggccugcccggccuccuguuccugcccccacccaccaccugccuggagaggaacggguc

SEQ ID NO: 486585 - RNA, 64 nt, Human
ccuagcuaucaucuccugacuuaauguuuuuuaaacccaccaauauaaauuuaauuaaagauau

SEQ ID NO: 486586 - RNA, 64 nt, Human
uuuccauuuuuaauaaaacgccaaaaauaucacaacccaccaaaaauagaugccucucccccuc

SEQ ID NO: 486587 - RNA, 64 nt, Human
ugaaugugcuugaaagugaaaagcaaucaauuauacccaccaacaccacugaaaucauaagcua

SEQ ID NO: 486588 - RNA, 59 nt, Human
ccucagacaacuacuggugagcaagcuggacccaccauguacaguguguuauaguguua

SEQ ID NO: 486589 - RNA, 64 nt, Human
ccacugaaacgugaaguccuguuuugaaugccaaacccaccauucacuggugcugacuacauag

SEQ ID NO: 486590 - RNA, 64 nt, Human
augacauauaagcaaaggggucagggcaagugugacccaccaggcaaaauugagcagcauuuuc

SEQ ID NO: 486591 - RNA, 64 nt, Human
cuuucaggagcuccauacacacgcugccuucgguacccaccacacaacauccaaguggccuccg

SEQ ID NO: 486592 - RNA, 64 nt, Human
ccucagccucccaaguagcuggauuacaggcauacaccaccacgccuggcuauguuuuguauuu

SEQ ID NO: 486593 - RNA, 64 nt, Human
ccccuguucucaccacgaagaucauguucauuaccaccaccacccccccuuauuuuuuuuaucc

SEQ ID NO: 486594 - RNA, 64 nt, Human
cucagccucccaaguagcugggguuacaggcgcccaccaccacacucggcuaauuuuguguuuu

SEQ ID NO: 486595 - RNA, 64 nt, Human; identical to SEQ ID NO: 226189

SEQ ID NO: 486596 - RNA, 64 nt, Human; identical to SEQ ID NO: 226190

SEQ ID NO: 486597 - RNA, 64 nt, Human; identical to SEQ ID NO: 226191

SEQ ID NO: 486598 - RNA, 64 nt, Human; identical to SEQ ID NO: 226192

SEQ ID NO: 486599 - RNA, 64 nt, Human; identical to SEQ ID NO: 226193

SEQ ID NO: 486600 - RNA, 64 nt, Human; identical to SEQ ID NO: 226194

SEQ ID NO: 486601 - RNA, 64 nt, Human; identical to SEQ ID NO: 226195

SEQ ID NO: 486602 - RNA, 64 nt, Human; identical to SEQ ID NO: 226196

SEQ ID NO: 486603 - RNA, 64 nt, Human; identical to SEQ ID NO: 226197

SEQ ID NO: 486604 - RNA, 64 nt, Human; identical to SEQ ID NO: 226198

SEQ ID NO: 486605 - RNA, 64 nt, Human; identical to SEQ ID NO: 226199

SEQ ID NO: 486606 - RNA, 64 nt, Human; identical to SEQ ID NO: 226200

SEQ ID NO: 486607 - RNA, 64 nt, Human; identical to SEQ ID NO: 226201

SEQ ID NO: 486608 - RNA, 64 nt, Human; identical to SEQ ID NO: 226202

SEQ ID NO: 486609 - RNA, 64 nt, Human; identical to SEQ ID NO: 389993

SEQ ID NO: 486610 - RNA, 64 nt, Human; identical to SEQ ID NO: 389994

SEQ ID NO: 486611 - RNA, 64 nt, Human; identical to SEQ ID NO: 389995

SEQ ID NO: 486612 - RNA, 64 nt, Human; identical to SEQ ID NO: 226203

SEQ ID NO: 486613 - RNA, 64 nt, Human; identical to SEQ ID NO: 226204

SEQ ID NO: 486614 - RNA, 64 nt, Human; identical to SEQ ID NO: 226205

SEQ ID NO: 486615 - RNA, 64 nt, Human; identical to SEQ ID NO: 226206

SEQ ID NO: 486616 - RNA, 64 nt, Human; identical to SEQ ID NO: 226207

SEQ ID NO: 486617 - RNA, 64 nt, Human; identical to SEQ ID NO: 226208

SEQ ID NO: 486618 - RNA, 64 nt, Human; identical to SEQ ID NO: 226209

SEQ ID NO: 486619 - RNA, 64 nt, Human; identical to SEQ ID NO: 226210

SEQ ID NO: 486620 - RNA, 64 nt, Human; identical to SEQ ID NO: 226211

SEQ ID NO: 486621 - RNA, 64 nt, Human; identical to SEQ ID NO: 226212

SEQ ID NO: 486622 - RNA, 64 nt, Human; identical to SEQ ID NO: 226213

SEQ ID NO: 486623 - RNA, 64 nt, Human; identical to SEQ ID NO: 226214

SEQ ID NO: 486624 - RNA, 64 nt, Human; identical to SEQ ID NO: 226215

SEQ ID NO: 486625 - RNA, 64 nt, Human; identical to SEQ ID NO: 226216

SEQ ID NO: 486626 - RNA, 64 nt, Human; identical to SEQ ID NO: 226217

SEQ ID NO: 486627 - RNA, 64 nt, Human; identical to SEQ ID NO: 226218

SEQ ID NO: 486628 - RNA, 64 nt, Human; identical to SEQ ID NO: 389996

SEQ ID NO: 486629 - RNA, 64 nt, Human; identical to SEQ ID NO: 389997

SEQ ID NO: 486630 - RNA, 64 nt, Human; identical to SEQ ID NO: 389998

SEQ ID NO: 486631 - RNA, 64 nt, Human; identical to SEQ ID NO: 226219

SEQ ID NO: 486632 - RNA, 64 nt, Human; identical to SEQ ID NO: 226220

SEQ ID NO: 486633 - RNA, 64 nt, Human; identical to SEQ ID NO: 226221

SEQ ID NO: 486634 - RNA, 64 nt, Human; identical to SEQ ID NO: 226222

SEQ ID NO: 486635 - RNA, 64 nt, Human; identical to SEQ ID NO: 226223

SEQ ID NO: 486636 - RNA, 64 nt, Human; identical to SEQ ID NO: 390003

SEQ ID NO: 486637 - RNA, 64 nt, Human; identical to SEQ ID NO: 390004

SEQ ID NO: 486638 - RNA, 64 nt, Human; identical to SEQ ID NO: 390005

SEQ ID NO: 486639 - RNA, 64 nt, Human
gaaguggcucacgcuccuguggugagggcagggugcuccacagacaccuccagacccagccaag

SEQ ID NO: 486640 - RNA, 64 nt, Human; identical to SEQ ID NO: 390006

SEQ ID NO: 486641 - RNA, 64 nt, Human; identical to SEQ ID NO: 390007

SEQ ID NO: 486642 - RNA, 64 nt, Human; identical to SEQ ID NO: 390008

SEQ ID NO: 486643 - RNA, 64 nt, Human
uuucuuuuuaauaaagccacaggcaggcaucguagcuccacagcccgaggggacacaggaugga

SEQ ID NO: 486644 - RNA, 64 nt, Human
cuagaugucucgcuccaccugggucugggaccuggcuccacaccaguuaccugggaccaguagg

SEQ ID NO: 486645 - RNA, 64 nt, Human
guuaggcucuccagggcuucuuuccaaacccccagcuccacaccccccagacccagcugguucu

SEQ ID NO: 486646 - RNA, 64 nt, Human
cuuagaggaaggagauagggaaaaggggcuccuugcuccacagggcccuguugaauuuuguucu

SEQ ID NO: 486647 - RNA, 64 nt, Human
auuuacccaggagaguccuauauuuccauugguggcuccacagugguggcugucagacccgaag

SEQ ID NO: 486648 - RNA, 64 nt, Human
cuaaaauuugacccugucuucaccuuuguucucagcuccacagucuggauugcugacaguaggu

SEQ ID NO: 486649 - RNA, 64 nt, Human
aacaagacuccaguaugugaaaguuaauugcugugcuccacagaucuugucuauuggccccugu

SEQ ID NO: 486650 - RNA, 64 nt, Human
gaggucccuccggcgcucauguuccgagucugcagcuccacacuuuaaaucauacucgaaugca

SEQ ID NO: 486651 - RNA, 64 nt, Human
uguuuaucuacacugcugcccacuccucucuccagcuccacaugcuguaccuggaucauucuga

SEQ ID NO: 486652 - RNA, 64 nt, Human
agaucauguguucccaaaguauucccuauuguuggcuccacagccuuaaagugcuauagauuua

SEQ ID NO: 486653 - RNA, 64 nt, Human
gcuauauguacuguauguccuguagcccagugcggcuccacagcauggaaucugauguaugaua

SEQ ID NO: 486654 - RNA, 64 nt, Human
uagucugggaggagcuauuucaucuuccagcucagcuccacacaaagcugcagaaggacgaaau

SEQ ID NO: 486655 - RNA, 64 nt, Human
guucagcgucacaucugcaguggagccugaaaaggcuccacauuaggucaccugugcacagcca

SEQ ID NO: 486656 - RNA, 64 nt, Human
ucauugugucucuuuuauccagcuuuacuuuuuugcuccacauuuaaugcaaaagaaucuugug

SEQ ID NO: 486657 - RNA, 64 nt, Human
ugacuagcucuugccgauuaaugagaagagagcagcuccacaauuuuuaauuuuuuuaacuuuu

SEQ ID NO: 486658 - RNA, 64 nt, Human; identical to SEQ ID NO: 390010

SEQ ID NO: 486659 - RNA, 64 nt, Human; identical to SEQ ID NO: 390011

SEQ ID NO: 486660 - RNA, 64 nt, Human; identical to SEQ ID NO: 390012

SEQ ID NO: 486661 - RNA, 64 nt, Human
guguguguuuacaaagggagaguuggcugcuccagcuccacagcccugggaccccaacuccugu

SEQ ID NO: 486662 - RNA, 64 nt, Human
cuuucugcccugagggacaucuucccacuccccugcuccacaugagccaugcaugcuuagcaau

SEQ ID NO: 486663 - RNA, 64 nt, Human
uacuuagccagaugcuuggccuggugggaccagggcuccacagaggccacaaaauguugcaagu

SEQ ID NO: 486664 - RNA, 64 nt, Human
cagugcaagcccuggcugaggccaaugcugugaagcuccacagagccacauucugaagccgucc

SEQ ID NO: 486665 - RNA, 64 nt, Human
cccaacuuuccccuacccccaacuuuccccaccagcuccacaacccuguuuggagcuacugcag

SEQ ID NO: 486666 - RNA, 64 nt, Human
uggacgagggugccgacgaguacaaggucaucaugcuccacagaagcuuccugagcuucaaggu

SEQ ID NO: 486667 - RNA, 64 nt, Human
ggcucucacaacucaucuuucccuaagucaucaagcuccacaucacugaggucaaugucauccu

SEQ ID NO: 486668 - RNA, 64 nt, Human
gucgugguggagaaucugagggcacucucugccagcuccacagggugggaugagccucuccuug

SEQ ID NO: 486669 - RNA, 64 nt, Human
guggcccccaggagaguagcugccuguugcaccugcuccacaccuccccacagccucccugcag

SEQ ID NO: 486670 - RNA, 64 nt, Human
cuauggugugagagcccccguccugcccucuggggcuccacaggccccuggcaaggccgauggc

SEQ ID NO: 486671 - RNA, 64 nt, Human
uuuuuaguuucaauucuaugugcauagcaggaaugcuccacaggaauggcuucugacaauaauc

SEQ ID NO: 486672 - RNA, 64 nt, Human
ccgaagcccagacaguucaguugggcuggggguugcuccacacccuaaaacaagccucagccag

SEQ ID NO: 486673 - RNA, 64 nt, Human
aagguaccaggucagucuucuuccaugucuauuagcuccacaaagccaaucucaaucccucaaa

SEQ ID NO: 486674 - RNA, 64 nt, Human
cagaagccaccuuuuucucccccgcuggccaggggcuccacacagacuaacguaggcacuauaa

SEQ ID NO: 486675 - RNA, 64 nt, Human
uucuccugcccccaagcaccuccagcggugaugagcuccacacccccacacccauugcagcugu

SEQ ID NO: 486676 - RNA, 64 nt, Human; identical to SEQ ID NO: 390013

SEQ ID NO: 486677 - RNA, 63 nt, Human; identical to SEQ ID NO: 390014

SEQ ID NO: 486678 - RNA, 64 nt, Human; identical to SEQ ID NO: 390015

SEQ ID NO: 486679 - RNA, 64 nt, Human
aaaaguaagcugugacauugucuauaagcauuuggcuccacaaauguauuuggauuguuuucua

SEQ ID NO: 486680 - RNA, 64 nt, Human
uggggcuuuuuccaucuucuccccacagccucuggcuccacaccuccaccguucaagcgccaga

SEQ ID NO: 486681 - RNA, 64 nt, Human
ugauguuccccagucuuccuuggugcauguucuagcuccacacacuaguccuuggaggaagguu

SEQ ID NO: 486682 - RNA, 64 nt, Human
uugugggaagggaugggcaagggugaguggguuugcuccacaccguccugugcugcucgagagg

SEQ ID NO: 486683 - RNA, 64 nt, Human
cccaagacugucaagggaugagcaucccaaaccugcuccacagagguagcugcguccugaaaaa

SEQ ID NO: 486684 - RNA, 64 nt, Human
cagcagcuccaccaaaugaagucccucucacgcagcuccacagcgcugucucgugaauggacag

SEQ ID NO: 486685 - RNA, 64 nt, Human
cugcacagcuucuugcacucacaacggacacuuugcuccacacacauaauggcagcucacacag

SEQ ID NO: 486686 - RNA, 64 nt, Human
ucucagauuuagcuuguguguguuuuggacagaggcuccacagcgguggcucuugaggaauccu

SEQ ID NO: 486687 - RNA, 64 nt, Human
guuacaccgugcgcuccaaaguaccacaaagccugcuccacaccuggauggguaagaguuacau

SEQ ID NO: 486688 - RNA, 64 nt, Human
aaaauucucauuuucuuucuuuuuuuuccccccugcuccacacuucaaaacucccguuagauca

SEQ ID NO: 486689 - RNA, 64 nt, Human
ucuacucccacccccacuaccucugggaaccacagcuccacaagggggagaggcagcugggcca

SEQ ID NO: 486690 - RNA, 64 nt, Human
caggaaacucucccucuccaucgccauccugcaagcuccacagccucgggcugccagccugugg

SEQ ID NO: 486691 - RNA, 64 nt, Human
agguuucccagggaagggggguggggguaggugggcuccacaggaugggggaggagcaugucca

SEQ ID NO: 486692 - RNA, 64 nt, Human
gcuuuucaaaaauguacacggaaaucuggacagugcuccacagauugauacauuagccuuugcu

SEQ ID NO: 486693 - RNA, 64 nt, Human
uguggcaggccugggcccucaggauguuucaaaggcuccacagcuccaccgcuccaccuggcuu

SEQ ID NO: 486694 - RNA, 64 nt, Human
acucccuacccccagcuucggaaaauacagagaccaccaccacguacccuguauuccccaaggu

SEQ ID NO: 486695 - RNA, 64 nt, Human
augaggugcaaaaauuuuaaugcuagucaguaugcaccaccacaggaaaguuagaucccauuag

SEQ ID NO: 486696 - RNA, 64 nt, Human
agaaugauggauauucuggcucuggggcccucuccaccaccacucacaguagccuugcugaagc

SEQ ID NO: 486697 - RNA, 64 nt, Human
ugcccagcacggccugcacugugcccacccacuugcuccacaacguccaguugguccugcugcc

SEQ ID NO: 486698 - RNA, 64 nt, Human
uccggcccccagugugacuaaucuccuucucuucgcuccacaggucuauaaaugggccacagua

SEQ ID NO: 486699 - RNA, 64 nt, Human
cccacgggacccccaccaccagccucuugaaguggcuccacagcuccugucccuggaacauccu

SEQ ID NO: 486700 - RNA, 64 nt, Human
accaccaaucccgaucggcucuuauuagcuccccgcuccacaagacaccugugacauccuccag

SEQ ID NO: 486701 - RNA, 64 nt, Human
accaccaaucccgaucggcucuuauuagcuccccgcuccacaagacaccugugaucuggaaauc

SEQ ID NO: 486702 - RNA, 64 nt, Human
acgaccaaucccgaucggcucuuauuagcuccccgcuccacaagacaccugugcuuuggaaauc

SEQ ID NO: 486703 - RNA, 64 nt, Human
gugaaacaggggcccagaugacaaccucuccuucgcuccacagguacgcgggagccucagguuc

SEQ ID NO: 486704 - RNA, 64 nt, Human
cugaugcaauguaaaacauguauuagacauucaggcuccacaauaaauuuuaaugagcacuaca

SEQ ID NO: 486705 - RNA, 64 nt, Human
augaugauguaaacuugguacuacauaaugacuugcuccacacaugcaguaaacuacauaauga

SEQ ID NO: 486706 - RNA, 64 nt, Human
cuuguaaaaacagcccugaguagguauuuccagggcuccacaaaguugcuuaugggaauccuga

SEQ ID NO: 486707 - RNA, 64 nt, Human
uucugaggccgcaguggugguggcugcgcacacagcuccacagguugggagccgucgugggacc

SEQ ID NO: 486708 - RNA, 64 nt, Human
uauggaagaggaagcugagcucagggagauaugagcuccacagccacagcugguuaggggcggc

SEQ ID NO: 486709 - RNA, 64 nt, Human
gcuuaaaacgggggaaacacugguuuucacagaugcuccacauggcugucuuuaaaagacucaa

SEQ ID NO: 486710 - RNA, 64 nt, Human
ugaagccucaggaggggccucagacccagccccugcuccacacugugccaguagccuagguguc

SEQ ID NO: 486711 - RNA, 64 nt, Human
cagaaagcaaguagggccauccagcugccagagugcuccacagggacuugaggcaugcaguugg

SEQ ID NO: 486712 - RNA, 64 nt, Human; identical to SEQ ID NO: 390017

SEQ ID NO: 486713 - RNA, 64 nt, Human; identical to SEQ ID NO: 390021

SEQ ID NO: 486714 - RNA, 64 nt, Human; identical to SEQ ID NO: 390022

SEQ ID NO: 486715 - RNA, 64 nt, Human
uucugugcugccagccccaggucuuccuccgccugcuccacaccacucgccgcugucccucugc

SEQ ID NO: 486716 - RNA, 64 nt, Human
aauauugcaaaggcccauuggaguuucugaaguggcuccacagaauugaaauaauuucaaauaa

SEQ ID NO: 486717 - RNA, 64 nt, Human
guuuggccaagcauacucaucauuucuuuguucagcuccacauuuccugugaaacuaacaucuu

SEQ ID NO: 486718 - RNA, 64 nt, Human
uccaagagcagccaaauccugcuuuuccaguuuggcuccacaaguccuccaggacagagcccuc

SEQ ID NO: 486719 - RNA, 64 nt, Human
gguccugaccaaccugcaucaggggaugcccugagcuccacaggucuucaugggcagggguugu

SEQ ID NO: 486720 - RNA, 64 nt, Human
cucagaucugcccuugcuugccucauaccucugugcuccacacugcggccaggccagcugaguc

SEQ ID NO: 486721 - RNA, 64 nt, Human
accuaacccccucaggggcagggaacaggggagggcuccacaagcgugucuggcauucccaccc

SEQ ID NO: 486722 - RNA, 64 nt, Human
ccgggagcccaggggaaggccaggcuggaccccggcuccacacccacauccagccugcaggccu

SEQ ID NO: 486723 - RNA, 64 nt, Human
gcagcacaguguguggcauuuacaugguacccaggcuccacagaguaccaagauguugcccucu

SEQ ID NO: 486724 - RNA, 64 nt, Human
ccugugcuuacagcauuguggaaucauguuggaagcuccacauguccauggaaguuugugaugu

SEQ ID NO: 486725 - RNA, 64 nt, Human
cugcccucaugauuugccagcaugaauucaugaugcuccacacucgcuuaugcuacuuaaucag

SEQ ID NO: 486726 - RNA, 64 nt, Human
uugugccagucagccuagguuauacagaugccaugcuccacaccacgagcaguguacaaaucug

SEQ ID NO: 486727 - RNA, 64 nt, Human
augucuaacaaagcauccaucuuccuccuucuuugcuccacacucgugccuacccagccuccug

SEQ ID NO: 486728 - RNA, 64 nt, Human
uuccuuucccucugauggguacacugaagccccugcuccacagaguagauugcacauggaggga

SEQ ID NO: 486729 - RNA, 64 nt, Human
uguaguguguaggcacuguagugaguguauauaugcuccacacuacgucugauaaacacaaacc

SEQ ID NO: 486730 - RNA, 64 nt, Human; identical to SEQ ID NO: 390023

SEQ ID NO: 486731 - RNA, 64 nt, Human; identical to SEQ ID NO: 390024

SEQ ID NO: 486732 - RNA, 64 nt, Human; identical to SEQ ID NO: 390025

SEQ ID NO: 486733 - RNA, 64 nt, Human
cgccagaugcugccugcacuuccgcagccagcacgcuccacagguucaccuguaagaggugugg

SEQ ID NO: 486734 - RNA, 64 nt, Human
ucacucaacaucaggggaugccugaggagugcgagcuccacagcaacauggcaggcaggagguc

SEQ ID NO: 486735 - RNA, 64 nt, Human
aauguucaggagagaggaaagaaaaaaaauauaugcuccacaauuuauauuuagagagagaaca

SEQ ID NO: 486736 - RNA, 64 nt, Human
ccgugcucacggacauggauacagacccugcugugcuccacacccugcaggcgccucgggaagc

SEQ ID NO: 486737 - RNA, 64 nt, Human
gcacaaaaccccaggcuucaagucucugcagccugcuccacauuugggcacagaaggacucaga

SEQ ID NO: 486738 - RNA, 64 nt, Human
ccucuguuuacuguguggcacccaggcaaaacaugcuccacaaauucaacuuguauauuuggca

SEQ ID NO: 486739 - RNA, 64 nt, Human
ugcaggauacaguucaauaugaugcaugaaaaaugcuccacauuuaaaggacauacccguguau

SEQ ID NO: 486740 - RNA, 64 nt, Human
uauauauauaguucaaaaauacuuuagguggucagcuccacauucuuuguugacgugacacuaa

SEQ ID NO: 486741 - RNA, 64 nt, Human
gugguuggcaaacucaucgugucuguccugagaggcuccacaaugcccacccgcaucgccauuc

SEQ ID NO: 486742 - RNA, 64 nt, Human
cagaggaagaaccaucccaaucauuugaucuccagcuccacaguagagagaaaccuacaaaaug

SEQ ID NO: 486743 - RNA, 64 nt, Human
accaagaacuucucaauaaaagaaaaucaugaaugcuccacaauuucaacauaccacaagagaa

SEQ ID NO: 486744 - RNA, 64 nt, Human
cagucacugggcauauccuccuucuccuuaaccagcuccacagcagccccugagucaccugcac

SEQ ID NO: 486745 - RNA, 64 nt, Human
uucaaauuuuaucaugccaguaggagaaaucucagcuccacaacccaagcaacauuuguaugga

SEQ ID NO: 486746 - RNA, 64 nt, Human
uauuuuggauuuuuacacaacugucccguuccccgcuccacagagauacacagauauauacaca

SEQ ID NO: 486747 - RNA, 64 nt, Human
guuggccaauuucaccccauuuucugugguuugggcuccacauugcaauguucaaugccacgug

SEQ ID NO: 486748 - RNA, 64 nt, Human; identical to SEQ ID NO: 390027

SEQ ID NO: 486749 - RNA, 64 nt, Human; identical to SEQ ID NO: 390028

SEQ ID NO: 486750 - RNA, 64 nt, Human; identical to SEQ ID NO: 390029

SEQ ID NO: 486751 - RNA, 64 nt, Human
cucaucaucauggccccaccggguacccugagcagcuccacacucuucuugaggugucuagaag

SEQ ID NO: 486752 - RNA, 64 nt, Human
uuucagacccaacucuuagagggcacaucaccaggcuccacaucacgggaagugagauggauuu

SEQ ID NO: 486753 - RNA, 64 nt, Human
ccuagggugaccacgcagugaggcuggugcccaugcuccacacugggaggccaggcugacccca

SEQ ID NO: 486754 - RNA, 64 nt, Human
gcccagaaaguggggguggaggaccgaggcuacagcuccacacgccccggucccccagagcauc

SEQ ID NO: 486755 - RNA, 64 nt, Human
gccagaaaccgcuucugagcggggcacuucggcugcuccacagggaaggcgacacugaaagcug

SEQ ID NO: 486756 - RNA, 64 nt, Human
ccgaccagcacucagcuggccucuggggauucuagcuccacaaccaggccgugaggcuggagaa

SEQ ID NO: 486757 - RNA, 64 nt, Human
cuguguugcugucucuuagauuaaccgugcugaggcuccacauagcuccuggaccugugucuag

SEQ ID NO: 486758 - RNA, 64 nt, Human
cacagcuugacucacuaacugaggccuuuccauagcuccacagcuucccaccuccuccccacca

SEQ ID NO: 486759 - RNA, 64 nt, Human
ccauuguggaaugaugcccuggcuuuaagguuuagcuccacaucaugcuucucuugagaauucu

SEQ ID NO: 486760 - RNA, 64 nt, Human
cugcuggugaaucacaugcggcaagaggcaacuggcuccacagccugggaugcugccguaccaa

SEQ ID NO: 486761 - RNA, 64 nt, Human
gagggcugcggcacuggagcaggcugacuuacaugcuccacaugggaccugugucacccaauga

SEQ ID NO: 486762 - RNA, 64 nt, Human
cauuuccagaaguagcaaagcuuacuagccaaaggcuccacauuuaucaacucuuaagagcuag

SEQ ID NO: 486763 - RNA, 64 nt, Human
gaacccaggagacugcugugugaccucagacugggcuccacacucuugggcuucagucugccca

SEQ ID NO: 486764 - RNA, 64 nt, Human
uuggcuugagaguuguugucagaaaggugcaggugcuccacaaacgggugguaaaaaggccucg

SEQ ID NO: 486765 - RNA, 64 nt, Human
caacaggugcauggugaguguggcaguccccacagcuccacaaugggcucccccgccaacgggg

SEQ ID NO: 486766 - RNA, 64 nt, Human; identical to SEQ ID NO: 390030

SEQ ID NO: 486767 - RNA, 64 nt, Human; identical to SEQ ID NO: 390031

SEQ ID NO: 486768 - RNA, 64 nt, Human; identical to SEQ ID NO: 390032

SEQ ID NO: 486769 - RNA, 64 nt, Human
uuuccugcauuguugcuaaaauuguuuuauuguagcuccacauucugguguaguuuaaaaugcc

SEQ ID NO: 486770 - RNA, 64 nt, Human
ccuuggccagggccaugggagucccgcgcagucagcuccacauuggccucugcagcugggugac

SEQ ID NO: 486771 - RNA, 64 nt, Human
cuacucuaaacugucuccaacacauuguuucugagcuccacaaaugcaaaagauguauuuuccu

SEQ ID NO: 486772 - RNA, 64 nt, Human
auaauagugugcacugcacaucugucucuucccagcuccacauucagugcugucuugguagcuu

SEQ ID NO: 486773 - RNA, 64 nt, Human
ucugccugcggggcuggggaggcaggccaaaggggcuccacaugagagguccugcaugccccug

SEQ ID NO: 486774 - RNA, 64 nt, Human
cacauacacacacagagagcauuucaaggccacagcuccacaccugccaugggauguuaaugug

SEQ ID NO: 486775 - RNA, 64 nt, Human
ggacuugggucuuuggugcuaggagagggccugugcuccacacagccgugguuuucugauuuuc

SEQ ID NO: 486776 - RNA, 64 nt, Human
cugggugcgcugaggccuggaggcgucuacacuggcuccacauccacuucccccgcagcucgug

SEQ ID NO: 486777 - RNA, 64 nt, Human
caagcaauucugguggaaagucaaaccugucagugcuccacaccagggcugugguccucccaga

SEQ ID NO: 486778 - RNA, 64 nt, Human
agcuaaccaccauccauggucaagaccucuccuagcuccacacaagcaguagagucucagcucc

SEQ ID NO: 486779 - RNA, 64 nt, Human
ccucuccuagcuccacacaagcaguagagucucagcuccacagcuuuacccagaagcccuguaa

SEQ ID NO: 486780 - RNA, 64 nt, Human
uccugcugcagaggggcaggcccugcacuguccugcuccacaguguuggcgagaggaggggccc

SEQ ID NO: 486781 - RNA, 64 nt, Human
gaagacagcccuaugcugagcuuguagccuuuuagcuccacagagccccgccauguguuugcac

SEQ ID NO: 486782 - RNA, 64 nt, Human
caaagaguuauuaaagagcccgcaugcauuuguggcuccacaauuacaucagcagaauggucuu

SEQ ID NO: 486783 - RNA, 64 nt, Human
acaugauuaggccucagacccaacucugguccuggcuccacaacaguggcugccacucacuuug

SEQ ID NO: 486784 - RNA, 64 nt, Human; identical to SEQ ID NO: 390034

SEQ ID NO: 486785 - RNA, 64 nt, Human; identical to SEQ ID NO: 390035

SEQ ID NO: 486786 - RNA, 64 nt, Human; identical to SEQ ID NO: 390039

SEQ ID NO: 486787 - RNA, 55 nt, Human
gcuccgcccccucccagugaccuucgcuccacaucccgaaacuccacccguuccc

SEQ ID NO: 486788 - RNA, 64 nt, Human
aagugugucugaacucggagugcucugggagcgggcuccacagccuccuugugggcuccagccc

SEQ ID NO: 486789 - RNA, 64 nt, Human
ucucugcucucggagccugugacacuggcuaugugcuccacaguuucagucccaggucauacuc

SEQ ID NO: 486790 - RNA, 64 nt, Human
gcacacacauacacacugaaggccacgauugcuggcuccacaauuuaguaacauuuauauuaag

SEQ ID NO: 486791 - RNA, 64 nt, Human
cuacacaagcuuuuauaaauguugcugcuggguagcuccacaguguuucauaaggccauccugu

SEQ ID NO: 486792 - RNA, 64 nt, Human
gccuuauggcucuagugugugaccuacagagcaugcuccacaagccccugccucaccucacugu

SEQ ID NO: 486793 - RNA, 64 nt, Human
acaaagaaaggaagccacugaacaucccuucucugcuccacaggagugccuuagacagccugac

SEQ ID NO: 486794 - RNA, 64 nt, Human
gcggaugguggcccaggagacagcacaccaccaggcuccacacgugcaugcuuuccccaagagg

SEQ ID NO: 486795 - RNA, 64 nt, Human
aaauccuaaaagcuuuccucgcccucacugccuugcuccacaagguccacuuuccugggucuug

SEQ ID NO: 486796 - RNA, 64 nt, Human
cugaaaagugcuuugcuggaguccuguucucagagcuccacagaagacacguguuuuuguaucu

SEQ ID NO: 486797 - RNA, 64 nt, Human
agaauacaaagcacuacauucuuuuaucuuuuuugcuccacauguacauaagaauugacacagg

SEQ ID NO: 486798 - RNA, 64 nt, Human
cucugcaaaccccagacuuugcacacagccucaggcuccacacagaaaugugaacuuggccuca

SEQ ID NO: 486799 - RNA, 64 nt, Human
aaguggguccaaguggcugugacaucuacguauggcuccacaccuccaaugcugccugggagcc

SEQ ID NO: 486800 - RNA, 64 nt, Human
gacaugagaggccugggccagcagcagcauugccgcuccacaucuuugcucaauguuuucauuu

SEQ ID NO: 486801 - RNA, 64 nt, Human
cuuggaagggguaacagugaaccgcccuccaugggcuccacaucuuuuccuuuggcuuccaaag

SEQ ID NO: 486802 - RNA, 64 nt, Human; identical to SEQ ID NO: 390040

SEQ ID NO: 486803 - RNA, 64 nt, Human; identical to SEQ ID NO: 390041

SEQ ID NO: 486804 - RNA, 64 nt, Human; identical to SEQ ID NO: 390042

SEQ ID NO: 486805 - RNA, 64 nt, Human
ccugggcccgcggaccccacaggcaggcggcggcgcuccacaucugcggacagaguuuccuuac

SEQ ID NO: 486806 - RNA, 64 nt, Human
gggugucccaccuggaccagacuggcgugggugagcuccacacccugccuggcaaugguaugag

SEQ ID NO: 486807 - RNA, 64 nt, Human
acuuccuuggccagagucaggggacagggagagagcuccacacuguaaccacugggucugggcu

SEQ ID NO: 486808 - RNA, 64 nt, Human
ugugacugacucuucuucucggggacacaggccagcuccacaguguugccagagccuuaauaaa

SEQ ID NO: 486809 - RNA, 64 nt, Human
aucugcccagggugucacggaaggagauuuucuagcuccacaucugucugcacauaggaaggaa

SEQ ID NO: 486810 - RNA, 64 nt, Human
ugcugucuccauguuugauguaucugagcagguugcuccacagguagcucuaggagggcuggca

SEQ ID NO: 486811 - RNA, 64 nt, Human
cacccuagccuggcugggauccucaggaccugaggcuccacagagagaaauuccuggaaucugg

SEQ ID NO: 486812 - RNA, 64 nt, Human
guuuggagagaguguuugcugugauccauugaaagcuccacauuaaaccccagcccugucuggc

SEQ ID NO: 486813 - RNA, 64 nt, Human
gaacugcuuagcauggugccugguauauacgagagcuccacaaaugugagcuauaauccuacua

SEQ ID NO: 486814 - RNA, 64 nt, Human
uugaggauagcagcuucacuaggcuggccggccagcuccacaucugacuggguucuuacuucuc

SEQ ID NO: 486815 - RNA, 64 nt, Human
auuuuaaguguuuuccuuacauuaucucauuuaugcuccacaacaacccaauuaaauaaccaug

SEQ ID NO: 486816 - RNA, 64 nt, Human
caaauaaccaauauaaagcauauuucuuggccuugcuccacaggacauaggcaagccuugauca

SEQ ID NO: 486817 - RNA, 64 nt, Human
gguacccuaggcucccagggcaggugaggagcaggcuccacagacuguccuggggcccagagga

SEQ ID NO: 486818 - RNA, 64 nt, Human
ggcccuggagggugauccugccagcagcccuacagcuccacacccuacccacccaucggcagcc

SEQ ID NO: 486819 - RNA, 64 nt, Human
uuguguuuuugcuuuuuuuccaaaaagaucuccagcuccacacauguuuccacuuaauaccaga

SEQ ID NO: 486820 - RNA, 64 nt, Human
cucagccuccugaguggcugggauuacaggcaugcaccaccaugcccagcuaauuuguuguauu

SEQ ID NO: 486821 - RNA, 64 nt, Human
uucauuguugagcaaguuuuagcccugcaguuuucaccaccagcaccuacccagcauucugguu

SEQ ID NO: 486822 - RNA, 64 nt, Human
ccccacccaccuuauccucccaccccacucccuccaccaccacagcacaccggugcuggccaca

SEQ ID NO: 486823 - RNA, 64 nt, Human
auguagauuugguuaccuccugguugaaauaaaugcuccacagacuguggcugugaguggggac

SEQ ID NO: 486824 - RNA, 64 nt, Human
caccgggggaugugccugcucaggaaaccucuuugcuccacacagcauggggcuucagcugcug

SEQ ID NO: 486825 - RNA, 64 nt, Human
uccagcagccagcauucaguggccuugucaccaagcuccacaccuccuccuggugcuggcuuug

SEQ ID NO: 486826 - RNA, 64 nt, Human
agccuuccuuccauuguuuuucuuccguucacuggcuccacacguuuccuggggaguagccugg

SEQ ID NO: 486827 - RNA, 64 nt, Human
uuaucuggaucauuuggucaguuugguaauuccugcuccacaccccuauuuuccucuuaauaau

SEQ ID NO: 486828 - RNA, 64 nt, Human
uggaggcugucuucucaggcucugcccugcccuagcuccacacccucucccaggacccaucacg

SEQ ID NO: 486829 - RNA, 64 nt, Human
cucuucuggcuuucugagcaggaagcgagcagaggcuccacaggcuuacgcugcucuccugaca

SEQ ID NO: 486830 - RNA, 64 nt, Human
gcaggaccucccgggucaggcagggcggcccccugcuccacacacugcugcaucuugggucuca

SEQ ID NO: 486831 - RNA, 64 nt, Human
uaccugguaacuuguuagaaauguacauucucaggcuccacagcaggccgccugaaucaaaucc

SEQ ID NO: 486832 - RNA, 64 nt, Human
gcggccggagccuccccaaggagcgccgcccccugcuccacagcgcccagucccaucgaccacc

SEQ ID NO: 486833 - RNA, 64 nt, Human
aggcacccaggauaaggacaagguccugccuuuggcuccacauugccacaugacccuuaaggca

SEQ ID NO: 486834 - RNA, 64 nt, Human
ugcugaugguggaacugcugugaccuuaggacuggcuccacaggguggacuggcugggcccugg

SEQ ID NO: 486835 - RNA, 64 nt, Human
acuccgaugugagacgucacgcaggacagauaccgcuccacacucugcuuccuuugaguuuuuu

SEQ ID NO: 486836 - RNA, 64 nt, Human
acacaggacccuuaacuuugccccaaagugaggggcuccacaccaaccccaggcggaggaacac

SEQ ID NO: 486837 - RNA, 64 nt, Human
gaaacugaggcaugggccauuuauuuuccucggagcuccacaguaaggaugccaaugaugcaaa

SEQ ID NO: 486838 - RNA, 64 nt, Human; identical to SEQ ID NO: 389918

SEQ ID NO: 486839 - RNA, 64 nt, Human; identical to SEQ ID NO: 389919

SEQ ID NO: 486840 - RNA, 64 nt, Human; identical to SEQ ID NO: 389920

SEQ ID NO: 486841 - RNA, 64 nt, Human
cuguggucagguaggcugggcugugaacagcacugcuccacauggugucggcucacagagccac

SEQ ID NO: 486842 - RNA, 64 nt, Human
cgcggccaggcacccaugugggcgcccacccugggcuccacacagcaguguccccugccccaga

SEQ ID NO: 486843 - RNA, 64 nt, Human
aucgggagacaggauguugacauauaggaauucagcuccacaaagcuucaggccugaccacagc

SEQ ID NO: 486844 - RNA, 64 nt, Human
aaaaaaaaaacaaaaaaggcugaaggcagcuguagcuccacacagacccuacccuuuccccuag

SEQ ID NO: 486845 - RNA, 64 nt, Human
agggcucacuguccagagaauugcuuuuguaaaugcuccacaacguaugggcaaaaguuuaagg

SEQ ID NO: 486846 - RNA, 64 nt, Human
cuagcuugagggggcagaugccccaggugucccagcuccacagccccuggcagaucccagaccc

SEQ ID NO: 486847 - RNA, 64 nt, Human
cucagaugcccugcuuaaaucaggggcacuucaggcuccacaggcgucauguuggacugagacc

SEQ ID NO: 486848 - RNA, 64 nt, Human
uucuuuuuuuccgacagcaggauggggcucuugggcuccacacaccagaugcuuugguuuucua

SEQ ID NO: 486849 - RNA, 64 nt, Human
agcccagcucugcuuuuuccagauucuuccacuggcuccacauccaccccacuggaucuucaga

SEQ ID NO: 486850 - RNA, 64 nt, Human
aggguagggggccugaguugaggggcuucccucugcuccacagaaacccuguuuuauugaguuc

SEQ ID NO: 486851 - RNA, 64 nt, Human
gguuggauuagagggguuaaacaacuugucuuaggcuccacagcugggaacaaguggggcuggg

SEQ ID NO: 486852 - RNA, 64 nt, Human
gccccauucugggccuguggugcucguggcugaggcuccacagggcugcaagugcccugccagg

SEQ ID NO: 486853 - RNA, 64 nt, Human
cacgcaggacacugugauuguguugaugcagcuggcuccacagcugugcauuccacagagauuc

SEQ ID NO: 486854 - RNA, 64 nt, Human
augugucuuaucccaauccuuuggcaggcaugcagcuccacaggcgauuucuucaagcagcuga

SEQ ID NO: 486855 - RNA, 64 nt, Human
gcuccugggcaccuucagaagugauguccugugugcuccacagcucaccugcuugccaagguac

SEQ ID NO: 486856 - RNA, 64 nt, Human; identical to SEQ ID NO: 389922

SEQ ID NO: 486857 - RNA, 64 nt, Human; identical to SEQ ID NO: 389923

SEQ ID NO: 486858 - RNA, 64 nt, Human; identical to SEQ ID NO: 389924

SEQ ID NO: 486859 - RNA, 64 nt, Human
gagggggaccugucccccacucucucacccaccagcuccacacauuccagccaggcccaggcca

SEQ ID NO: 486860 - RNA, 64 nt, Human
uggacaccgggcacuggccacuccuacauccccagcuccacacggccugcacaccuguguuucc

SEQ ID NO: 486861 - RNA, 52 nt, Human
cccagagcuucccccagugaaggcuccacaggcugcacagucucugauaaug

SEQ ID NO: 486862 - RNA, 64 nt, Human
ccccaccucagguugggcuucccugggcacucaugcuccacaccaaagcaggacacgccauuuu

SEQ ID NO: 486863 - RNA, 64 nt, Human
ugugcccaagccaggagcugcuugggcagucccagcuccacacuggcccugagccccuucacuu

SEQ ID NO: 486864 - RNA, 64 nt, Human
agugaggaaagaugaggcaucgugccucacauccgcuccacauggugcaagagccucuagcggc

SEQ ID NO: 486865 - RNA, 64 nt, Human
ggagaacaggcccuaacccugcccuccaccgccggcuccacacugccggaagcagccuuccugc

SEQ ID NO: 486866 - RNA, 64 nt, Human
ugcuuucuucccaaaggacauguauauuugcagagcuccacauacagaaacacauuauuuugca

SEQ ID NO: 486867 - RNA, 64 nt, Human
ugacacagccacccccacagccggagcccccgccgcuccacagucccuggggccgagcacgagu

SEQ ID NO: 486868 - RNA, 64 nt, Human
cuugcuuugagaaggagcugccggccggggccacgcuccacagccgccgcgcgacaguggagcc

SEQ ID NO: 486869 - RNA, 64 nt, Human
ucagagguguagguuuccaaagauguccccagaagcuccacauucaaguucuaucuacaguuug

SEQ ID NO: 486870 - RNA, 64 nt, Human
gccaggccugaacugagcuaagcaccugccccgggcuccacacuuccaucuuucuuuugucuuc

SEQ ID NO: 486871 - RNA, 64 nt, Human
uaggagaggagcaguggaggggcccaggcucugagcuccacaggucugagcagggagcaacuca

SEQ ID NO: 486872 - RNA, 64 nt, Human
aaguggcccagguccagggucaguuaauuuagcggcuccacaaagucaucagucaccugagcuc

SEQ ID NO: 486873 - RNA, 64 nt, Human
gacacaaaaaccggccuugcccugcagggauggggcuccacaggccgugcccaacugggggugg

SEQ ID NO: 486874 - RNA, 64 nt, Human; identical to SEQ ID NO: 389925

SEQ ID NO: 486875 - RNA, 64 nt, Human; identical to SEQ ID NO: 389926

SEQ ID NO: 486876 - RNA, 64 nt, Human; identical to SEQ ID NO: 389927

SEQ ID NO: 486877 - RNA, 64 nt, Human
gaaugcagcauuugugggaaauccuuuagaugucgcuccacacuugauacacaucagagaauuc

SEQ ID NO: 486878 - RNA, 64 nt, Human
aaaugcagcaaaugugggaaauuuuuuauggacagcuccacacucauuagucaugagagaguuc

SEQ ID NO: 486879 - RNA, 64 nt, Human
ggucaccgcccgcccuucccggcgcagcccccgagcuccacagcuggggcagccccucuggcuu

SEQ ID NO: 486880 - RNA, 64 nt, Human
ccacguggagacauggccuagggggccaggcccggcuccacaggagucuccuucaggacuggug

SEQ ID NO: 486881 - RNA, 64 nt, Human
cucagaguuguaggucuccagauauguccccagugcuccacauuaaagauacaugcccacuuug

SEQ ID NO: 486882 - RNA, 64 nt, Human
cugcugcgcccccuccugccaggguggcgauuccgcuccacagucucggacggaucugcucaga

SEQ ID NO: 486883 - RNA, 64 nt, Human
cagaagcuggaggaguuccggaaagccaaggccagcuccacaggcagcuucacagcaccugauc

SEQ ID NO: 486884 - RNA, 64 nt, Human
ucuaccaagccacuccaagagccagccccuuucugcuccacaaaaaccacaguuauuggaaaag

SEQ ID NO: 486885 - RNA, 64 nt, Human
cugucauugugcaucucugagguucccucauggagcuccacagauccauuuuuagggaagggau

SEQ ID NO: 486886 - RNA, 64 nt, Human
auuguucauguaaaaaucauacacguggcauguugcuccacauuccuuacacacagggguagag

SEQ ID NO: 486887 - RNA, 64 nt, Human
cgagccagaucauucaguuucagcgaguccuugagcuccacaacaucuaccagauauagcagac

SEQ ID NO: 486888 - RNA, 64 nt, Human
ucccuugacuuuuguggccugggggagggguagugcuccacagcuuuuccuuccccacccccca

SEQ ID NO: 486889 - RNA, 64 nt, Human
gagcuggagcccagcaugcuggggagugcggucagcuccacacaguaguccccacguggcccac

SEQ ID NO: 486890 - RNA, 64 nt, Human
aaaagcuggcgccuccuuggucucuaggauccaggcuccacagagcacaugacuagccaggccc

SEQ ID NO: 486891 - RNA, 64 nt, Human
ucagcaggugugccuuaaccucccuauucagaaagcuccacaucaauaaacaugacacucugaa

SEQ ID NO: 486892 - RNA, 64 nt, Human; identical to SEQ ID NO: 389913

SEQ ID NO: 486893 - RNA, 64 nt, Human; identical to SEQ ID NO: 389929

SEQ ID NO: 486894 - RNA, 64 nt, Human; identical to SEQ ID NO: 389931

SEQ ID NO: 486895 - RNA, 64 nt, Human
uugggguaucucuagaaaacagcaacugaacagagcuccacacaucugucagggugugagcacu

SEQ ID NO: 486896 - RNA, 64 nt, Human
uuccccuuuucuguuugaaaaaccuguucugguagcuccacaagagagaugauacugacuuuuu

SEQ ID NO: 486897 - RNA, 64 nt, Human
gggauuggcggguccaagcccagcaaccggcuucgcuccacaacacacaccacaccugggacug

SEQ ID NO: 486898 - RNA, 64 nt, Human
acccggcuaugaccagggaucuguaagcccuguggcuccacaggugcugcuucucacuggccca

SEQ ID NO: 486899 - RNA, 64 nt, Human
cucauagccugcugguccuguaagcaagcacuaagcuccacagugccaguuccuugccccaacc

SEQ ID NO: 486900 - RNA, 64 nt, Human
auauauuuucuauauauaagauguauaauauaaggcuccacaaauauaucugugugugugugug

SEQ ID NO: 486901 - RNA, 64 nt, Human
ccuagugaggaagauggaccuggacagacagucagcuccacaccuugcgcugagcagcugugau

SEQ ID NO: 486902 - RNA, 62 nt, Human
gcgugacaugaucuucguaacggccucggcacgcuccacaccccuggagucucccgaggccc

SEQ ID NO: 486903 - RNA, 64 nt, Human
gugagacccuuguuggcagccagacaaggguggggcuccacaggcagcacaggcgccccaccac

SEQ ID NO: 486904 - RNA, 64 nt, Human
auucuuaaaauuaagugggcuggagaagaauggagcuccacaugccagcaccguauauggaaua

SEQ ID NO: 486905 - RNA, 64 nt, Human
gccauaggguccugaauguuucagaccacaaggggcuccacaccuuugcuguguguucuggggc

SEQ ID NO: 486906 - RNA, 64 nt, Human
gggaggcccuugggagcaggugcuuguggacaaggcuccacaagcguugagccuuggaaaggua

SEQ ID NO: 486907 - RNA, 64 nt, Human
cucagggacuggcacacuggccuccagaagggcagcuccacagggcagggccucauuauuuuuc

SEQ ID NO: 486908 - RNA, 64 nt, Human
uuccccucucagagcuacuugggccauagcuccugcuccacagccaucccagccuuggcaucua

SEQ ID NO: 486909 - RNA, 64 nt, Human
ugggucacaugacucucauuuuauuuacagcugugcuccacacucagaaaauucccugggguca

SEQ ID NO: 486910 - RNA, 64 nt, Human; identical to SEQ ID NO: 389932

SEQ ID NO: 486911 - RNA, 64 nt, Human; identical to SEQ ID NO: 389933

SEQ ID NO: 486912 - RNA, 64 nt, Human; identical to SEQ ID NO: 389934

SEQ ID NO: 486913 - RNA, 64 nt, Human
aucuuuaugucucuguaacauuggccuuuucauggcuccacacuggguggaaccauauucucuu

SEQ ID NO: 486914 - RNA, 64 nt, Human
ccucuucaguguuuuccuccagucccgggagcccgcuccacagcguggagacgucccucuaaca

SEQ ID NO: 486915 - RNA, 64 nt, Human
aggaauuccagcaucugaagacucaggcagagcagcuccacaaccaccuccagccugggagaua

SEQ ID NO: 486916 - RNA, 64 nt, Human
cuuuuuuaaggagaaaaaaaaaugaguaaaaggagcuccacacuuugacuuaauuucauacaaa

SEQ ID NO: 486917 - RNA, 64 nt, Human
gacccaccucagcucagccccccagccccugccagcuccacacuaucucuuagcugaguuuuug

SEQ ID NO: 486918 - RNA, 64 nt, Human
acccagacggggggcuggaggacacccucaguuugcuccacauggccgccacccccugcaccag

SEQ ID NO: 486919 - RNA, 64 nt, Human
gaggugggauggggccgugcacacagggaugcccgcuccacauccugccugccccucagcccug

SEQ ID NO: 486920 - RNA, 64 nt, Human
ucugagaagcacagcuaccugccuucacugaaauauaccucaggcugaaauuuggggugggaua

SEQ ID NO: 486921 - RNA, 64 nt, Human
aaagaaaugcaaguucauuguaacaauccaaacaauaccucacgauauaaaauaaaaaugaaag

SEQ ID NO: 486922 - RNA, 59 nt, Human
uggaaaagcuccacaguuaaucuggacagauaccucaauucuaggugaccaacgggagg

SEQ ID NO: 486923 - RNA, 64 nt, Human
aauccaaaucuauagaguauuugccucuuaaaugauaccucauugauauauugcacuauuucau

SEQ ID NO: 486924 - RNA, 64 nt, Human
caaagggagcacuggguugacuuucagguacuaaauaccucaaccuaugguauaaugguugacu

SEQ ID NO: 486925 - RNA, 58 nt, Human
aguggcuggaccaaaccugaacacacagauaccucacucaucccuccaauucaagccu

SEQ ID NO: 486926 - RNA, 64 nt, Human
cuuaaucacuuguuaugauugagccaauauacaaauaccucaucuguucuuuuuaauauuuuau

SEQ ID NO: 486927 - RNA, 64 nt, Human; identical to SEQ ID NO: 389936

SEQ ID NO: 486928 - RNA, 64 nt, Human; identical to SEQ ID NO: 389937

SEQ ID NO: 486929 - RNA, 64 nt, Human; identical to SEQ ID NO: 389938

SEQ ID NO: 486930 - RNA, 64 nt, Human
aguuugucaggaugcuuuaaggugauuaguaaauauaccucagcuuagacuugggcugcuccuu

SEQ ID NO: 486931 - RNA, 64 nt, Human
ccgugcucaugcugccgugacaacaggccaccacauaccucaaccuggggaacuguauuuuuaa

SEQ ID NO: 486932 - RNA, 64 nt, Human
ugauuauguuucuuaaacuuuccgcgaaacuaauauaccucaguauuccaucauggucugaaag

SEQ ID NO: 486933 - RNA, 64 nt, Human
auuauucaguaguggaaaugagugaacuacagcuauaccucacaauaagaaugaaucucagaaa

SEQ ID NO: 486934 - RNA, 64 nt, Human
ucuggaacuugagaccacuggaggcacaccugcuauaccucaugccuuucccagcagccacuga

SEQ ID NO: 486935 - RNA, 64 nt, Human
uguuuuguuccgagccugccugccugccgguucuauaccucaggggcauuuuuacaaaaagccc

SEQ ID NO: 486936 - RNA, 64 nt, Human
uaggaacagaccgggaccuugucucacacugaugauaccucacauguugaccggcuaugugaac

SEQ ID NO: 486937 - RNA, 64 nt, Human
gagcuccucuuccccugggguuccagcccuccuaauaccucauauuccccaucuuccucagccc

SEQ ID NO: 486938 - RNA, 64 nt, Human
guuaaaauaaggaguauuuugguagaguauauacauaccucacugccagugaaauugcuuuccu

SEQ ID NO: 486939 - RNA, 64 nt, Human
gaaagagaauuuguaugggcacuguaucuaugaaauaccucauaacuuacguuuacauguuuuc

SEQ ID NO: 486940 - RNA, 64 nt, Human
gaaacuugugaaacccaggaaaaccuuuagucuuauaccucaacuaccuuucaguccugucugg

SEQ ID NO: 486941 - RNA, 64 nt, Human
uugcucugaaaguaacccagcuuguugcucuaaaauaccucaguagccugaguguuauacuaga

SEQ ID NO: 486942 - RNA, 64 nt, Human
ucagaagcucagaagcuaagaauaagccuuugaaauaccucauugcauuucccuuugggcuucg

SEQ ID NO: 486943 - RNA, 64 nt, Human
guguaggaagcacagccagauccuauaggaaugaauaccucaaaucuguugucugagauucuag

SEQ ID NO: 486944 - RNA, 64 nt, Human
gauugaaggaaagcuugaaaaggcgcagagcccuauaccucauuuccuccaugauaaaaggauc

SEQ ID NO: 486945 - RNA, 64 nt, Human; identical to SEQ ID NO: 389939

SEQ ID NO: 486946 - RNA, 64 nt, Human; identical to SEQ ID NO: 389940

SEQ ID NO: 486947 - RNA, 64 nt, Human; identical to SEQ ID NO: 389941

SEQ ID NO: 486948 - RNA, 64 nt, Human
cccacaugggguuccugguuguuccugcaucccgauaccucagcccuggcccugcccagcccau

SEQ ID NO: 486949 - RNA, 64 nt, Human
aggaaaaaggauucccuuuuuuuaaaaaaaaucaauaccucaaaagcaggcuuugggacaagaa

SEQ ID NO: 486950 - RNA, 64 nt, Human
agcugaugugacucuugccccaugcgagauauuuauaccucaaacacuggccugugagcccuuu

SEQ ID NO: 486951 - RNA, 64 nt, Human
cuuucacggacacugacaagauccagagcuaucaauaccucaguuaugcaaccuuagagguuuu

SEQ ID NO: 486952 - RNA, 64 nt, Human
gcuggggccaugggcugcugccagaggaccguggauaccucaguguccacacacccaccaugcc

SEQ ID NO: 486953 - RNA, 64 nt, Human
uuguaccucucuuauagaauauuuauuaccucugauaccucaacccccauuucuauuuauuuac

SEQ ID NO: 486954 - RNA, 64 nt, Human
ugcauaugugaaagagaaugaugcauuaacugaaauaccucauugaauauuauacuacuacugg

SEQ ID NO: 486955 - RNA, 64 nt, Human
uuagacuggaaguucauaccuaaguacuguaauaauaccucaauguuugaggagcauguuuugu

SEQ ID NO: 486956 - RNA, 64 nt, Human
auauauuuagugcugcaucuuauagcacuuugaaauaccucauguuuaugaaaauaaauagcuu

SEQ ID NO: 486957 - RNA, 64 nt, Human
cucaguucuggacguguguauauagcuguauuuaauaccucaaggucauuguggcucuggggau

SEQ ID NO: 486958 - RNA, 64 nt, Human
gggcagaaggggaagauacugacuagucauagaaauaccucauucgccugugggaagagaaggg

SEQ ID NO: 486959 - RNA, 64 nt, Human
ggaugauaucauccagucuuuauauguugccaauauaccucauuguguguaauagaaccuucuu

SEQ ID NO: 486960 - RNA, 64 nt, Human
uuccaagcauuacuuuaaccucccucaacaagguauaccucaguuccacgguugcuaaauuaua

SEQ ID NO: 486961 - RNA, 64 nt, Human
accuauuuauauuuguauuaauugcuuacagauuauaccucauauuagcaauuacauuacacua

SEQ ID NO: 486962 - RNA, 64 nt, Human
uugccuugggaaacacuacuagcucugaccuuccauaccucacuugggggagcacagggccccg

SEQ ID NO: 486963 - RNA, 64 nt, Human; identical to SEQ ID NO: 390044

SEQ ID NO: 486964 - RNA, 64 nt, Human; identical to SEQ ID NO: 390045

SEQ ID NO: 486965 - RNA, 64 nt, Human; identical to SEQ ID NO: 390046

SEQ ID NO: 486966 - RNA, 64 nt, Human
aagucccuaugagagccauuucuggccauguucuauaccucaaagugaggcuggcagguacaga

SEQ ID NO: 486967 - RNA, 64 nt, Human
auuucuuagguccuugaauaaaugauacuuagguauaccucagaaaugccauauaugauacaaa

SEQ ID NO: 486968 - RNA, 64 nt, Human
guauuuugcuuaagguuguguguguauuguguauauaccucaaguucaaguuaauggcauugau

SEQ ID NO: 486969 - RNA, 64 nt, Human
agaagcugcccguugugaaacuuaguguuaguuaauaccucaccauacucaguuauuccacuau

SEQ ID NO: 486970 - RNA, 64 nt, Human
uuuuuuuucgccuuuaagaagguuuucagugauuauaccucagguauuucugaguguccuauug

SEQ ID NO: 486971 - RNA, 64 nt, Human
agacccagggggaagaaaggagggcugugaggagauaccucauuaaacuuggcuuagugaagaa

SEQ ID NO: 486972 - RNA, 64 nt, Human
uucuuuguccuuuucccaacagcccaggcuguugauaccucagagccuucucuuuacucuccaa

SEQ ID NO: 486973 - RNA, 64 nt, Human
aggccacagugcaccauugcacagggcuguccugauaccucauccagaaagccgucucagacuu

SEQ ID NO: 486974 - RNA, 64 nt, Human
aauauaaugaauuaaugauuaucaaaguacaggcauaccucauuuuauugcaguuuguuuuauu

SEQ ID NO: 486975 - RNA, 64 nt, Human
gagaugugcacccaugggcucugacagaaagcagauaccucacccugcuacacauacaggauuu

SEQ ID NO: 486976 - RNA, 64 nt, Human
uuucccuucacuuucagucuuccacacacaaaaaauaccucacagagcuucaccaaaucacaga

SEQ ID NO: 486977 - RNA, 64 nt, Human
auaaaaagaaugaagccuccuuagaaaaaaaauuauaccucaauguccccaacaagauugcuua

SEQ ID NO: 486978 - RNA, 64 nt, Human
aacagccuuaaucauuccaguuugauuuacguguauaccucauaaacauuuuucuuuuguuucu

SEQ ID NO: 486979 - RNA, 64 nt, Human
uguuucuuuuaaagcaagcaacacagaggaauuuauaccucaaacuaucuggccauauuuacua

SEQ ID NO: 486980 - RNA, 64 nt, Human
auaucauuuugucauccucuaaauauaaauccaaauaccucagcuaaguaauucuauuuuauua

SEQ ID NO: 486981 - RNA, 64 nt, Human; identical to SEQ ID NO: 389943

SEQ ID NO: 486982 - RNA, 64 nt, Human; identical to SEQ ID NO: 389944

SEQ ID NO: 486983 - RNA, 64 nt, Human; identical to SEQ ID NO: 389945

SEQ ID NO: 486984 - RNA, 64 nt, Human
augauuuguucauuucugagucacaaacagcaggauaccucacagguaagccauaccuaauugg

SEQ ID NO: 486985 - RNA, 64 nt, Human
guaaacccugacccaguguaugcccaugucuaucauaccucaccucugaugucugugacauguc

SEQ ID NO: 486986 - RNA, 64 nt, Human
acauuaauaaaaaaaguugguaaaacaugguuuuauaccucaguguauaagaugugcaagacaa

SEQ ID NO: 486987 - RNA, 57 nt, Human
agaaaugcuuuaaacucugaagacaggauaccucaccgaagaagccacacugaucca

SEQ ID NO: 486988 - RNA, 64 nt, Human
uagcugcuggugguucuuucacagacauuuccauauaccucaugcauuguggguuaaaaagucc

SEQ ID NO: 486989 - RNA, 64 nt, Human
aaagccugugucuuugagggauucuacccugaacauaccucacagauccucccugucaugccac

SEQ ID NO: 486990 - RNA, 64 nt, Human
caggccccaugcccagcacgccagccaccgcaggauaccucagucauaccaguuguaaaccuca

SEQ ID NO: 486991 - RNA, 64 nt, Human
gccccgacagucuacaagccucagcccacugaccauaccucagccccuagccccuggggggcag

SEQ ID NO: 486992 - RNA, 64 nt, Human
auagcaguguuaauauuuacaggauuuuggcucgauaccucaagauuuaucuaacagugcaguu

SEQ ID NO: 486993 - RNA, 64 nt, Human
guaaagauaacagcaugagaaacuguuaguacgcauaccucaguucaaaccuuuagggaaugau

SEQ ID NO: 486994 - RNA, 64 nt, Human
acuuuaaguaugugcaguuuguuguaugucaauuauaccucaauaaaucuguaauaaaaaacua

SEQ ID NO: 486995 - RNA, 64 nt, Human
cagcugcaugaccugugccuuuuaagccauaaagauaccucaagccuagcaccucuugaaaucc

SEQ ID NO: 486996 - RNA, 64 nt, Human
aaaguuaugcaagugguuuuuauaaauuggaauaauaccucaguuuugagguuaugcacacuaa

SEQ ID NO: 486997 - RNA, 64 nt, Human
uuuuuuugcucuccauuuugacuugcaagaaauaauaccucaagauaaucugauuuauuagcua

SEQ ID NO: 486998 - RNA, 64 nt, Human
cacacuuuuuuugacugaugacaucuccuuugcuauaccucaauuuuuggaauuuagagaagaa

SEQ ID NO: 486999 - RNA, 64 nt, Human; identical to SEQ ID NO: 389949

SEQ ID NO: 487000 - RNA, 64 nt, Human; identical to SEQ ID NO: 389950

SEQ ID NO: 487001 - RNA, 64 nt, Human; identical to SEQ ID NO: 389951

SEQ ID NO: 487002 - RNA, 64 nt, Human
ugagugccuugacaccuacauauggcugcauuccauaccucagugaagaagccgaaggaugcug

SEQ ID NO: 487003 - RNA, 64 nt, Human
ucacugcacuuuuuuauuguuuuuauuucuagccauaccucagauaauauguuuaguuuuacau

SEQ ID NO: 487004 - RNA, 64 nt, Human
uaaaaagaucugggauaaaaccagacugaaaggaauaccucagaagagaugcuucauugagugu

SEQ ID NO: 487005 - RNA, 64 nt, Human
aucguccaggggccuggcucccacgugguugcagauaccucagaccuggugcucuaggcugugc

SEQ ID NO: 487006 - RNA, 64 nt, Human
uguucccuagcugaggaugacagagggauggcgaauaccucaugggacagcgcguccuucccua

SEQ ID NO: 487007 - RNA, 64 nt, Human
uaccauuucacacaaaguuugaauagaauacauuauaccucauaggugucuagccucuacaguu

SEQ ID NO: 487008 - RNA, 64 nt, Human
ucauccuacccauugccacucuguuuccugagagauaccucacauuccaaugccaaacauuucu

SEQ ID NO: 487009 - RNA, 64 nt, Human
gccugacaacauuucuauagccaaaaauagcuaaauaccucaaucagucucagaaugucauuuu

SEQ ID NO: 487010 - RNA, 64 nt, Human
agacugagcaguuuuaaauccuuugcgugcaugcauaccucaucagugauuguacauaccuugc

SEQ ID NO: 487011 - RNA, 64 nt, Human
ucucccaggaaggugugaccucuccuuugccugcauaccucaaggccaggggaauaugccucag

SEQ ID NO: 487012 - RNA, 64 nt, Human
agccugcauugauaacagccuuaacccucgaggaauaccucaauaccucagacaaggcccuucc

SEQ ID NO: 487013 - RNA, 64 nt, Human
uugauaacagccuuaacccucgaggaauaccucaauaccucagacaaggcccuuccaauauguu

SEQ ID NO: 487014 - RNA, 64 nt, Human
accagcucuagguccaauuguucugcucuaacugauaccucaaccuuggggccagcaucuccca

SEQ ID NO: 487015 - RNA, 64 nt, Human
auuuugacguuaaaaaacaacaacagaucuagagauaccucaaggauaucauuuuugauuuugu

SEQ ID NO: 487016 - RNA, 64 nt, Human
cacacuuuucacugacgggauaucucuuuaugcaauaccucaauuuuucauauugcaaagagua

SEQ ID NO: 487017 - RNA, 64 nt, Human; identical to SEQ ID NO: 389953

SEQ ID NO: 487018 - RNA, 64 nt, Human; identical to SEQ ID NO: 389954

SEQ ID NO: 487019 - RNA, 64 nt, Human; identical to SEQ ID NO: 389955

SEQ ID NO: 487020 - RNA, 64 nt, Human
aaacauaaauaucagaagugaugauuaucauaugauaccucagugauuuuaaaagccauagaag

SEQ ID NO: 487021 - RNA, 64 nt, Human
gaaauagggcaagagaggcaggugaacacacaugauaccucaauugacaaucuuccucccacca

SEQ ID NO: 487022 - RNA, 64 nt, Human
uuuaccuuuuuagucacauugaccugcuggcugaauaccucaaauaguccaguagagggcaguc

SEQ ID NO: 487023 - RNA, 52 nt, Human
gcagcagcaggugccugugaacauaccucagacgccucuggauccaagaacc

SEQ ID NO: 487024 - RNA, 64 nt, Human
uaugugcagagagaguuugccagaucugaagcauauaccucauugacuaggcuguuacuuuggg

SEQ ID NO: 487025 - RNA, 64 nt, Human
cacaaaugucauugucuacuccuagaagaaccaaauaccucaauuuuuguuuuugaguacugua

SEQ ID NO: 487026 - RNA, 64 nt, Human
gugaggcguuggcuuuuucuccaagaagguacagauaccucagauucgggaaacucaaaaucaa

SEQ ID NO: 487027 - RNA, 64 nt, Human
gcuggacaaacugcaccaguugcugcuucaauuuauaccucaauuuucacuguguccagguggu

SEQ ID NO: 487028 - RNA, 64 nt, Human
gugaaugaucuuuagcuuguacaaauguuuaaaaauaccucaggcuauacugaaaggguugcag

SEQ ID NO: 487029 - RNA, 64 nt, Human
ugcuaauguuaaaugucagcccacagagcuaauaauaccucaguauaaugucaugagcaguuga

SEQ ID NO: 487030 - RNA, 64 nt, Human
auuuaauguuuauuaauaguuuaugaauaucaagauaccucauugaaucccuaaauuuaaaagc

SEQ ID NO: 487031 - RNA, 64 nt, Human
gccacccugaggguggugaugguaguuucuacccauaccucagccucaggcgaguggcuuauag

SEQ ID NO: 487032 - RNA, 64 nt, Human
aaaugauauaccuguaacuguaccuaucaggacuauaccucauuuacagucagaaagcuuacug

SEQ ID NO: 487033 - RNA, 64 nt, Human
agccacagcacuacaucaaucccugacguuagggauaccucaugacauuuuccuguuuuuaugg

SEQ ID NO: 487034 - RNA, 64 nt, Human
uauuugcuaguuaucuaauguuuuaaaagaaaauauaccucauuuagguuugaauugggcguau

SEQ ID NO: 487035 - RNA, 52 nt, Human; identical to SEQ ID NO: 389979

SEQ ID NO: 487036 - RNA, 64 nt, Human; identical to SEQ ID NO: 389980

SEQ ID NO: 487037 - RNA, 64 nt, Human; identical to SEQ ID NO: 389981

SEQ ID NO: 487038 - RNA, 64 nt, Human
uuauugaacagcuaauaaagauuuauuuauuguaauaccucacagacguuguaccauauccaug

SEQ ID NO: 487039 - RNA, 64 nt, Human
uauauuugagacaugaaauacauacugauaauacauaccucaugaaagauuuuauucuuuauug

SEQ ID NO: 487040 - RNA, 64 nt, Human
auccucucucucaucuuuaucuagagauugacugauaccucauucuguuuguaaaaccagccag

SEQ ID NO: 487041 - RNA, 64 nt, Human
aaaccacaugcugcugaauuuaccagggauccucauaccucacaaugcaaaccacuuacuacca

SEQ ID NO: 487042 - RNA, 64 nt, Human
aauucuaacagcaaauaacagucugagacuccucauaccucagugguuagaagcaugucucucu

SEQ ID NO: 487043 - RNA, 64 nt, Human
uagcuggauacauacaguggaguucuauaaacucauaccucaguggacuuaaccaaaauugugu

SEQ ID NO: 487044 - RNA, 64 nt, Human
aucugaaaucuugacccaguuauuuaacaaauaaauaccucauugauuauauuuaaaaguaaua

SEQ ID NO: 487045 - RNA, 64 nt, Human
acuuucauucccacguucuuaggcuuuguuacugauaccucaaaucggaaguuuuaguucugag

SEQ ID NO: 487046 - RNA, 64 nt, Human
gagaggguuuacuuaccuacugucuugagcucacauaccucaaaaucuacuacuguguggcacc

SEQ ID NO: 487047 - RNA, 64 nt, Human
uuucauuaggaacagugaggcuaguugagaaauuauaccucaccaguauauaggagaguaccau

SEQ ID NO: 487048 - RNA, 64 nt, Human
uuguugccuuuuuugcuuuuuuuuaaucugugcaauaccucauuuaaucuguaaagguuugucg

SEQ ID NO: 487049 - RNA, 64 nt, Human
uggucuuagagcauguguauucaucucagcgugaauaccucagccagucuuaugaauaggaggc

SEQ ID NO: 487050 - RNA, 64 nt, Human
gguacaggauuugauguuauuaacauuugucgucauaccucauaagucggucccugccuugucu

SEQ ID NO: 487051 - RNA, 64 nt, Human
ugaagagguucagagaacuuuccagguuuauacuauaccucaagaccacauagauuagcuacug

SEQ ID NO: 487052 - RNA, 64 nt, Human
ugacuaaaugaaaaugccuacccacucauauaacauaccucaggucuauuuuaccuuacacuga

SEQ ID NO: 487053 - RNA, 64 nt, Human; identical to SEQ ID NO: 389986

SEQ ID NO: 487054 - RNA, 64 nt, Human; identical to SEQ ID NO: 389987

SEQ ID NO: 487055 - RNA, 64 nt, Human; identical to SEQ ID NO: 389988

SEQ ID NO: 487056 - RNA, 64 nt, Human
cuuggacaaacuaccuaaccuuucugagccuccuauaccucauccgacacaaauggggaugaua

SEQ ID NO: 487057 - RNA, 64 nt, Human
agacuguauacucagugcaaauauagcugcauuuauaccucagaggggccaaguguuaaugccc

SEQ ID NO: 487058 - RNA, 64 nt, Human
gcaacccaguuuaagaaacauggcaacuaaagggauaccucaggcuuucuuucccaguggguca

SEQ ID NO: 487059 - RNA, 64 nt, Human
uucuuguuugccucuuuauuuuugccaguguacuauaccucaguccuauuugaaagaccuaauu

SEQ ID NO: 487060 - RNA, 64 nt, Human
caaacuacuaacaugcauugugagaaugccguguauaccucacguacuguguacuuuguacaua

SEQ ID NO: 487061 - RNA, 64 nt, Human
gauaaagauuauuauuuaagauauacuuguauuuauaccucagauauucuuuuggguuuuguac

SEQ ID NO: 487062 - RNA, 64 nt, Human
cgcggccggggcgggagagacucagcaacgacccauaccucagacccgacggcccggagcggag

SEQ ID NO: 487063 - RNA, 64 nt, Human
ucaguauacacagccgcuauucauugagggcuggauaccucaacaagacugagagccuuucccc

SEQ ID NO: 487064 - RNA, 64 nt, Human
cuuuugaugucuacucaaaucaugaauuaaucacauaccucaucauuaaucuuuucaagguccu

SEQ ID NO: 487065 - RNA, 64 nt, Human
auuuuguaugucuauacacuucacacuuuauauaauaccucaaaaauaaaaauaugaaaacagu

SEQ ID NO: 487066 - RNA, 64 nt, Human
uacugugcauccgccugaaaguguuuugcccuauauaccucacuagccaugcuuuauguggguu

SEQ ID NO: 487067 - RNA, 64 nt, Human
gaauagcaaaaauuuuuuuauauuaugcauccuuauaccucacauaucuuccuuaacuagauag

SEQ ID NO: 487068 - RNA, 64 nt, Human
cuacauauucuuuacaacagcaaccaaagaaaacauaccucaauacacucaaaacugaagacau

SEQ ID NO: 487069 - RNA, 64 nt, Human
aaaggaaagagagaaaaucacugcuguauacuaaauaccucacagauuagaugaaaagaugguu

SEQ ID NO: 487070 - RNA, 64 nt, Human
ggcgcagcuggccaagaggcgggcggggccagaaauaccucaugccccugcaccagccccuccg

SEQ ID NO: 487071 - RNA, 64 nt, Human; identical to SEQ ID NO: 389869

SEQ ID NO: 487072 - RNA, 64 nt, Human; identical to SEQ ID NO: 389870

SEQ ID NO: 487073 - RNA, 64 nt, Human; identical to SEQ ID NO: 389871

SEQ ID NO: 487074 - RNA, 64 nt, Human
agcccccaccagggaaccggaugaugaaacagggauaccucacagcuuggccauuugaggcaaa

SEQ ID NO: 487075 - RNA, 64 nt, Human
aacagccuauaugauuuuguguaaauugaucucuauaccucagcuucuucaucugcaaagugag

SEQ ID NO: 487076 - RNA, 64 nt, Human
auuucucuaguauucauaucccuuuucuuaccauauaccucaguguauccuuccugugucaagc

SEQ ID NO: 487077 - RNA, 64 nt, Human
auccagcaguacaauaaaaguaaaccacaaaaaaauaccucaggaaagaauagaaagaaagucu

SEQ ID NO: 487078 - RNA, 64 nt, Human
uuaacucccaaauuaaaacacaguugugcugucaauaccucauacugcuuuaccuuuuuuuccu

SEQ ID NO: 487079 - RNA, 64 nt, Human
uagggagccuagggagccuggucaucaacuugcaauaccucacagagccaguucacaucccacu

SEQ ID NO: 487080 - RNA, 64 nt, Human
uauuugugcucuguuuuugguuuacaguguaauaauaccucauuuaaaaaauaaaaaccacuac

SEQ ID NO: 487081 - RNA, 64 nt, Human
agcuacuguuuuuaaaaagggagacuaaaagcaaauaccucagugauuaauauuuaagcuacag

SEQ ID NO: 487082 - RNA, 64 nt, Human
uauuaagaaaauuuuccuuuucuaaccuauuaaaauaccucacuaucauuucaaaagguuaaau

SEQ ID NO: 487083 - RNA, 64 nt, Human
cuucagccuccggaccauuccggagcagccucacauaccucacugucucgucugucuaugugac

SEQ ID NO: 487084 - RNA, 64 nt, Human
auuuauuaaaaauggaagcugucuugaauuagagauaccucacguaagguagguuaagcaguca

SEQ ID NO: 487085 - RNA, 64 nt, Human
uaccagcuagaccaggaauagaacaaagaauucuauaccucaggauuucaaaaaguuagcaacu

SEQ ID NO: 487086 - RNA, 64 nt, Human
aaggcaugcuuucugacugacaugaucuuuugcaauaccucaauuuugaaauauaggaaagaaa

SEQ ID NO: 487087 - RNA, 64 nt, Human
agccuuuaguugcucucuauuuugacuuguaaggauaccucauaagcuggaucuuuuauuuuuc

SEQ ID NO: 487088 - RNA, 64 nt, Human
cacugcacacuccuagcugcugccgauacaccagauaccucagcuuauuggagccaugcccuuc

SEQ ID NO: 487089 - RNA, 64 nt, Human; identical to SEQ ID NO: 389865

SEQ ID NO: 487090 - RNA, 64 nt, Human; identical to SEQ ID NO: 389866

SEQ ID NO: 487091 - RNA, 64 nt, Human; identical to SEQ ID NO: 389867

SEQ ID NO: 487092 - RNA, 64 nt, Human
auauucauguaucuuguauauaaaauauaggcauauaccucauauauacauguguuuuuagaac

SEQ ID NO: 487093 - RNA, 64 nt, Human
uuacagcaguugugaucccacaaaaagcaaguuuauaccucagauugggguauaaaaauuguuu

SEQ ID NO: 487094 - RNA, 64 nt, Human
uuuucuuauuuuaacuacaguaaucuacauaaauauaccucagaaaucauuuuuggugauuauu

SEQ ID NO: 487095 - RNA, 64 nt, Human
cacccuaaauauauauaauuuuuauuugucaaauauaccucaauaaagauggaaaaaaaucgaa

SEQ ID NO: 487096 - RNA, 64 nt, Human
uacugcucuauuccaaaaagguugcuguuucacaauaccucaugcuucacuuagccauggugga

SEQ ID NO: 487097 - RNA, 64 nt, Human
cuuccuuuaccccucaacuuuaauuugcccaguuauaccucaguguuguagcaguacugugaua

SEQ ID NO: 487098 - RNA, 64 nt, Human
caucauuuuccguacuccuaaggaaaacugaccuauaccucauaaaaugagaccgcuauuuagg

SEQ ID NO: 487099 - RNA, 64 nt, Human
ucacuaaauaagacuuucuauccaauaaugauugauaccucaaauguaagaugcgugauacuca

SEQ ID NO: 487100 - RNA, 64 nt, Human
guguucucauggcacacuucauggcagcacagauauaccucauuuuaaccaauagauauucucu

SEQ ID NO: 487101 - RNA, 64 nt, Human
uuguacuuacacugugggcauguggucaagaugcauaccucaugaauucaacuauuuuuucaua

SEQ ID NO: 487102 - RNA, 64 nt, Human
gaagcuccuuagccuccuucgaccuagucucugcauaccucaacuuuuacguaccaaugcuacu

SEQ ID NO: 487103 - RNA, 64 nt, Human
uagagucacugauacacagaauauaaucuuauuuauaccucaguuugcauauuuuuuuacuauu

SEQ ID NO: 487104 - RNA, 64 nt, Human
aaguccucucagcagugggugacugcuguugccaauaccucagacuccagggaaagagaggagg

SEQ ID NO: 487105 - RNA, 64 nt, Human
uacaugacugagaagagaaaaacaaaaauaaaucauaccucaaaggauggagugcaucaauugg

SEQ ID NO: 487106 - RNA, 64 nt, Human
acaaaaggcaaugauucacgcuuuuguuuucauaauaccucacaaccguacaguuucugcuugg

SEQ ID NO: 487107 - RNA, 64 nt, Human; identical to SEQ ID NO: 389872

SEQ ID NO: 487108 - RNA, 64 nt, Human; identical to SEQ ID NO: 389873

SEQ ID NO: 487109 - RNA, 64 nt, Human; identical to SEQ ID NO: 389874

SEQ ID NO: 487110 - RNA, 64 nt, Human
cccaggaaggaacaggcauuguuagcaucagauuauaccucauuauuaaaaggaggcauggcca

SEQ ID NO: 487111 - RNA, 64 nt, Human
aaucaaaacacacuacuaccucuuaagucccaguauaccucauuuuucauacugaaaaaaaaag

SEQ ID NO: 487112 - RNA, 64 nt, Human
agucuguuuugcucuaauccuccauuaagcgagcauaccucaagugggucuauuagcauuuaau

SEQ ID NO: 487113 - RNA, 64 nt, Human
caaauccuaaguguauaauuaugugcaauguucaauaccucauauaauacuugcucaacaguau

SEQ ID NO: 487114 - RNA, 64 nt, Human
ugcccauauagugcucuuuagccaguaucuguaaauaccucaguaauauggguccuuucauuuu

SEQ ID NO: 487115 - RNA, 64 nt, Human
acuaucacccaggcuggagugcaguggcauaaucauaccucauugcagccucagacuccugggu

SEQ ID NO: 487116 - RNA, 64 nt, Human
uaggaacguaaaguccuuuaagcacucagaagccauaccucaucucucuggcugaucugggggu

SEQ ID NO: 487117 - RNA, 64 nt, Human
auagaaaaacggaaggguucagcugcugcucccaauaccucagcaugguaaggggacagagccc

SEQ ID NO: 487118 - RNA, 64 nt, Human
cuucgagaagaaucaaaauguuccugaauuucaaauaccucaugcaaaaugucuccugaaauaa

SEQ ID NO: 487119 - RNA, 64 nt, Human
gcauacaguaaaagucugugauuaaaacauuuauauaccucauucuuuaguguuguuaaaugaa

SEQ ID NO: 487120 - RNA, 64 nt, Human
ccauuaaauuucagacuguagagccacauuuacaauaccucaggcuaauuacuguuaauuuugg

SEQ ID NO: 487121 - RNA, 64 nt, Human
cuugagcuauuggacuucacugauguauauauuaauaccucagauuccucugauuuuguaagcu

SEQ ID NO: 487122 - RNA, 64 nt, Human
cauaugauacuaucauacuacugaaacagauuucauaccucagaauguaaaagaacuuacugau

SEQ ID NO: 487123 - RNA, 64 nt, Human
cuauggggcaaauguguggugcccagaauaaaauauaccucaugccuaggguagggacauccuu

SEQ ID NO: 487124 - RNA, 64 nt, Human
caauucuuugaaaggaccugcagaagcauuuuuaauaccucauucugucuaugcaagaugaaaa

SEQ ID NO: 487125 - RNA, 64 nt, Human; identical to SEQ ID NO: 389989

SEQ ID NO: 487126 - RNA, 64 nt, Human; identical to SEQ ID NO: 389990

SEQ ID NO: 487127 - RNA, 64 nt, Human; identical to SEQ ID NO: 389991

SEQ ID NO: 487128 - RNA, 64 nt, Human
cagacgguuuccaguacuaacaaagggaauaaaaauaccucacgccacaauccagcauauugau

SEQ ID NO: 487129 - RNA, 64 nt, Human
auaaaguaugauauugcauuuaaauauuauauuuauaccucauguauauuuuuaccucaauugu

SEQ ID NO: 487130 - RNA, 64 nt, Human
uuuacuauuuaaaauacccaacauguauuaugaaauaccucaaaaguaauuuaguuacauucuu

SEQ ID NO: 487131 - RNA, 64 nt, Human
aucuaaaaagcucugaaguguuuguauauuugaaauaccucaauaaagagagagcucauugacu

SEQ ID NO: 487132 - RNA, 63 nt, Human
acugcccuuuggauguuuaaucuucauuaauaaauaccucaaauggccaguaacucaauauua

SEQ ID NO: 487133 - RNA, 64 nt, Human
cagcacaccucaccacaccacaccgcacugcaccauaccucaccacaucucaccacaccacagc

SEQ ID NO: 487134 - RNA, 64 nt, Human
uugccuuuguuguuguauuacaaaucugcauaaaauaccucauuucaaaucaaaucuuacaaau

SEQ ID NO: 487135 - RNA, 64 nt, Human
uaggucaaaauuuucuguguuucuuauuccuucuauaccucaaaucugauucuaagaauuucuu

SEQ ID NO: 487136 - RNA, 64 nt, Human
uuuuguagugcaaaaagacuuuugugaaaagcugauaccucaaucuuuacuacuguauuuuuaa

SEQ ID NO: 487137 - RNA, 64 nt, Human
uaucacaugguaauuguagagaaaaagaagcuauauaccucaaaaucgugcccucuuuacauau

SEQ ID NO: 487138 - RNA, 64 nt, Human
agagaagccuggaagacuccucaugcuaguuaucauaccucaguacuguggcucuugagcuuug

SEQ ID NO: 487139 - RNA, 64 nt, Human
uugucuguucaccucauccuugccacuccgccuuauaccucaccaucggagaacuuaccauccc

SEQ ID NO: 487140 - RNA, 64 nt, Human
uagaagugaguuuccauguuugcagaguauuuaaauaccucagauuuuauuaaugagaaauaca

SEQ ID NO: 487141 - RNA, 64 nt, Human
uguucuuaacuccagaaccacucuuuuugcauaaauaccucaucgggcagcuuucuaaguguga

SEQ ID NO: 487142 - RNA, 64 nt, Human
ucuuuaauuagacuuguaggcacucuucacuuaaauaccucaguucuucuuuucuuuugcaugc

SEQ ID NO: 487143 - RNA, 64 nt, Human; identical to SEQ ID NO: 389876

SEQ ID NO: 487144 - RNA, 64 nt, Human; identical to SEQ ID NO: 389877

SEQ ID NO: 487145 - RNA, 64 nt, Human; identical to SEQ ID NO: 389878

SEQ ID NO: 487146 - RNA, 64 nt, Human
aagucuuucuucaaagugcaugcagucuuuugcgauaccucauucagccaaguauugguauucu

SEQ ID NO: 487147 - RNA, 64 nt, Human
cuagcacaccuguaugaaaaaucaguguagaagaauaccucaugugcagaugcuagguggcagg

SEQ ID NO: 487148 - RNA, 64 nt, Human
cauccccacacgugccgaugucagguucauugaaauaccucagauuuguaauuguugauguuug

SEQ ID NO: 487149 - RNA, 64 nt, Human
gaggaaagggaaucaaaagcuugagcacaaacagauaccucagcccgguaagcugcagcucugc

SEQ ID NO: 487150 - RNA, 64 nt, Human
gugauagcacauggguagccuaggcagugaguaaauaccucagauguccuccugcagcaagugu

SEQ ID NO: 487151 - RNA, 64 nt, Human; identical to SEQ ID NO: 487146

SEQ ID NO: 487152 - RNA, 64 nt, Human
aacacuguuuacagaaugagaugugacucuacagauaccucauagaagacaauccaagaucaua

SEQ ID NO: 487153 - RNA, 64 nt, Human
ggagcugaaagaucuccgaaaacaaagugaaaucauaccucagcucaugucagagugcgaauau

SEQ ID NO: 487154 - RNA, 64 nt, Human
ucccgacuacuagcucuguuaguuccagccugcuauaccucagaugggagagagccagagagag

SEQ ID NO: 487155 - RNA, 64 nt, Human
aauaaaaaggaaaaaaaauuacauuuuuuaucuuauaccucagauauuuuguucuguguauuuu

SEQ ID NO: 487156 - RNA, 64 nt, Human
aguggccuucauguuauucagaauuguuuuggugauaccucaccccuguaaucccagcacuuug

SEQ ID NO: 487157 - RNA, 64 nt, Human
agauuuccguuaugguaaaaaccauaugcaauaaauaccucauuguaagcuuacccaaaauuga

SEQ ID NO: 487158 - RNA, 64 nt, Human
augggaucagugccuuaugaaaggcccuagagagauaccucauccucuccacagugugagacuu

SEQ ID NO: 487159 - RNA, 64 nt, Human
ggcuuaccauguaggggaggggagaucuauccacauaccucagguaacagggaggugcgcgggu

SEQ ID NO: 487160 - RNA, 64 nt, Human
ccgcgccgcccgggcccuccccgcacacugaccuauaccucaggaugggcgcgucugggcgcgg

SEQ ID NO: 487161 - RNA, 64 nt, Human; identical to SEQ ID NO: 389882

SEQ ID NO: 487162 - RNA, 64 nt, Human; identical to SEQ ID NO: 389883

SEQ ID NO: 487163 - RNA, 64 nt, Human; identical to SEQ ID NO: 389884

SEQ ID NO: 487164 - RNA, 64 nt, Human
gaaaauucacagggaagaaaacauuucaagggcuauaccucagcaucuaggcuuuuuggacuaa

SEQ ID NO: 487165 - RNA, 64 nt, Human
ccccucggguccuccccguccccugcuccgaugcauaccucagugcagaaccacagaaucucug

SEQ ID NO: 487166 - RNA, 64 nt, Human
ugaagcucaacucucuuauugccucacuucagguauaccucacuuuacacaauagaauuauaac

SEQ ID NO: 487167 - RNA, 64 nt, Human
uguuuugcaauguuuuuuauaaaaaugcaauuaaauaccucacuauuaaacugccaugaugccu

SEQ ID NO: 487168 - RNA, 64 nt, Human
uucucucuuccauaggacaaaugauaaguacuacauaccucaucucuuggguuauuauuguagu

SEQ ID NO: 487169 - RNA, 64 nt, Human
uaaaaacccucaacaaaccaggcgucgaaggaacauaccucaaaauaauaagagccaucuauga

SEQ ID NO: 487170 - RNA, 64 nt, Human
gagcgggagcucaguaugacuugccacccaccugauaccucagggcaaggcccuuuuucccucc

SEQ ID NO: 487171 - RNA, 64 nt, Human
ugggcaagacuccuguucuacuuauccuuuugaaauaccucacccugccacuccaccauguaug

SEQ ID NO: 487172 - RNA, 64 nt, Human
guguaggguuuaugaauuauugcagcugacuaccauaccucacacagcguugguguugugagcg

SEQ ID NO: 487173 - RNA, 64 nt, Human
uguaaagccacagaaugggauuuauuaaugugggauaccucagacuguuuguuuucuuucuggg

SEQ ID NO: 487174 - RNA, 64 nt, Human
uugacuugucuaaaaggacaaagagaaaaaaaaaauaccucaugacugcauucucucugacuag

SEQ ID NO: 487175 - RNA, 64 nt, Human
aggggacgugagaaaggaaaaggcaugaaguucuauaccucagccagcagcugccuucguuugg

SEQ ID NO: 487176 - RNA, 64 nt, Human
cugaagucuucaacuugcacucggagcuccuuugauaccucagagcuggcugucagguggcagc

SEQ ID NO: 487177 - RNA, 64 nt, Human
agccuggugccugcugaagccaguccuggagcccauaccucaccccugccuggugaggaugucu

SEQ ID NO: 487178 - RNA, 64 nt, Human
cauccugaggccaguggcccccgggccugcacagauaccucaucauccacccgcugccccuccc

SEQ ID NO: 487179 - RNA, 64 nt, Human; identical to SEQ ID NO: 389850

SEQ ID NO: 487180 - RNA, 64 nt, Human; identical to SEQ ID NO: 389886

SEQ ID NO: 487181 - RNA, 64 nt, Human; identical to SEQ ID NO: 389887

SEQ ID NO: 487182 - RNA, 64 nt, Human
aagagacuaaguauaugcuucaaguuuuaaauuaauaccucaaguauuaaauaaauauuccaag

SEQ ID NO: 487183 - RNA, 64 nt, Human
uuauaguauaguaucaaauuucuauauagauuuuauaccucaguggggaaaaauaacugauucc

SEQ ID NO: 487184 - RNA, 64 nt, Human
aauacaguaacauuucuauacuaaauuaacaguaauaccucaaaacugcuccgguaguaguuuu

SEQ ID NO: 487185 - RNA, 64 nt, Human
aauccaucuuuuacuaggagaccagauuccuuuuauaccucauucaucaugcuggauuguaaua

SEQ ID NO: 487186 - RNA, 64 nt, Human
guuuugcaguagugaaaagcuuagaugaguacggauaccucauuugaaacucagccuaguaagg

SEQ ID NO: 487187 - RNA, 64 nt, Human
ucugccacccaggcuggaguccaguggcgugaucauaccucacugcagcuucaacuuccugggc

SEQ ID NO: 487188 - RNA, 64 nt, Human
uuaauuuuucuaauuuuaccaaaguuugcagccuauaccucaauaaaacagggauauuuuaaau

SEQ ID NO: 487189 - RNA, 64 nt, Human
uacaauccugaaugaugucacagugcuuuuaacaauaccucaaacuuuucuaaacauaaaaaaa

SEQ ID NO: 487190 - RNA, 64 nt, Human
accgacuucugaaucgcagcuccacucaugacuaauaccucauuauuucagcugucugcaccua

SEQ ID NO: 487191 - RNA, 64 nt, Human
ucucccuguacacucuaagucaucucuggauuaaauaccucaugcauuguaaaaacuauguaaa

SEQ ID NO: 487192 - RNA, 64 nt, Human
uuguauagucucaauuaugucuagauuacuuaaaauaccucaugcauuauaaaagcuaugcaaa

SEQ ID NO: 487193 - RNA, 64 nt, Human
aggcugacucaggaaacacuuagaaaguacagccauaccucaaagauauuguggauuggguugc

SEQ ID NO: 487194 - RNA, 64 nt, Human
guauagucugaugagaaagauguggauugccauaauaccucaaagauacacuuguuugcauuuu

SEQ ID NO: 487195 - RNA, 64 nt, Human
agcgagcacccucaucgggcugucgccugacagcauaccucaaaaggcccuagcuaauaaaccu

SEQ ID NO: 487196 - RNA, 64 nt, Human
cagaaaaucuacaagucucguugagaccaccaccauaccucagaagguaggacuguggccuaga

SEQ ID NO: 487197 - RNA, 64 nt, Human; identical to SEQ ID NO: 389888

SEQ ID NO: 487198 - RNA, 64 nt, Human; identical to SEQ ID NO: 389889

SEQ ID NO: 487199 - RNA, 64 nt, Human; identical to SEQ ID NO: 389890

SEQ ID NO: 487200 - RNA, 64 nt, Human
aaguccauuuuugccccugcuuuugcuuuggauuauaccucaccagcugcacaaaaugcauuuu

SEQ ID NO: 487201 - RNA, 64 nt, Human
uuuuccugucagagauuuaaaaaacugaaaagguauaccucaacccaaaaauaaagguuuguuu

SEQ ID NO: 487202 - RNA, 64 nt, Human
gaagggaugugcccgccucuccacgcacucagcuauaccucauucacagcuccuugugagugug

SEQ ID NO: 487203 - RNA, 64 nt, Human
acaucuaugaugcugcuuuaaguuuuuagaggcuauaccucaaaguagcugcggauuuugucuc

SEQ ID NO: 487204 - RNA, 64 nt, Human
caugcaggagaccccaggcccuggaggcugcaacauaccucaauccugucccaggccggauccu

SEQ ID NO: 487205 - RNA, 64 nt, Human
gccggggccccugaccccugagccucagauuccaauaccucacuccccagagccugaugccggg

SEQ ID NO: 487206 - RNA, 64 nt, Human
acuuuggcuucuaagccaguaauuccauucuuaaauaccucacugucuuggccauggggaagca

SEQ ID NO: 487207 - RNA, 64 nt, Human
aacgauaguaacaggaaaugacucuuuagcaucgauaccucaacaucaauuuaggguagagauu

SEQ ID NO: 487208 - RNA, 64 nt, Human
agccaccacuuccccgcaauggaccauguaacaaauaccucagcaggcccugcaaaaggccaug

SEQ ID NO: 487209 - RNA, 64 nt, Human
agccccggccggcacccggcuggucccaccccaaauaccucagccauggagaccaugucaugca

SEQ ID NO: 487210 - RNA, 64 nt, Human
gucagugacucugggggucuccucagugacccccauaccucaucaugaacccuuggguagcuug

SEQ ID NO: 487211 - RNA, 64 nt, Human
ucuauaaaggcauuucucuauauacauguuuuauauaccucauucugacaccugcauauagugu

SEQ ID NO: 487212 - RNA, 64 nt, Human
aaaaaaaacacaaaaaaagaaagaauacuuuuuuauaccucacuauguucuuugaauauguauu

SEQ ID NO: 487213 - RNA, 64 nt, Human
acgagaaguuugauggcuuugcccugggcugggaauaccucacccacgcccaguuccagaaagg

SEQ ID NO: 487214 - RNA, 64 nt, Human
gggcaauagagaagcaacagaacugccacaaaguauaccucaauauaauuccucuaguucugcu

SEQ ID NO: 487215 - RNA, 64 nt, Human; identical to SEQ ID NO: 389892

SEQ ID NO: 487216 - RNA, 64 nt, Human; identical to SEQ ID NO: 389893

SEQ ID NO: 487217 - RNA, 64 nt, Human; identical to SEQ ID NO: 389894

SEQ ID NO: 487218 - RNA, 64 nt, Human
cucggccugagcagggugcuggggggagagcgcaauaccucacgcgggcugccguccuaaucaa

SEQ ID NO: 487219 - RNA, 64 nt, Human
aaguuguauuuuuaaaagauaaauauuccuuuuuauaccucaguuuuguguccuguuuuuaaug

SEQ ID NO: 487220 - RNA, 64 nt, Human
uuuucacgugugucuaucuuugcuagcagcuuguauaccucaggccaggugagcuccccaaauu

SEQ ID NO: 487221 - RNA, 64 nt, Human
cucaagaaguuaaaagauacuuaauucuugccuuauaccucacucuauucuguaaauuugaaaa

SEQ ID NO: 487222 - RNA, 64 nt, Human
acaaggaacucaaaagauaguuaauucuugccuuauaccucagucuauuauguaaaauuaaaaa

SEQ ID NO: 487223 - RNA, 64 nt, Human
cuaaagaaauuaagagauagucaauucuugccuuauaccucagucuauucuguaaaauuuuuaa

SEQ ID NO: 487224 - RNA, 64 nt, Human
ugggaugacaggcgugagccaccgcgcccggccuauaccucauuuucuacaugucgcuuguugg

SEQ ID NO: 487225 - RNA, 64 nt, Human
ugggacaggcugggcagaggggagagagggcaggacaggccagagugacgcccccgugcagcuu

SEQ ID NO: 487226 - RNA, 64 nt, Human
cucuggagguggguggugcaggcgguggagggacacaggccagcucaagcccgcugguggcagg

SEQ ID NO: 487227 - RNA, 64 nt, Human
gaaagucuuugcuuuggaagcgucagacauuagaacaggccaaacuggacugucuguucauagc

SEQ ID NO: 487228 - RNA, 64 nt, Human
uauuugucauaaggcggcgugggcgaggccugacacaggccagccuuggcacgaggggggccag

SEQ ID NO: 487229 - RNA, 64 nt, Human
ccccagaagguagaaugugguggggugugauggaacaggccaguuggccuaagaauuaguacuu

SEQ ID NO: 487230 - RNA, 64 nt, Human
aaaacucccgugggagauuuuggccccaacccacacaggccaaugcaagaggccaaggcuggag

SEQ ID NO: 487231 - RNA, 64 nt, Human
uccaucuuugagagcucuggugggcagggcagaaacaggccacagugcucaacccggacacccu

SEQ ID NO: 487232 - RNA, 64 nt, Human
gucaggcaacagcuggggugauggccugugagccacaggccacaucaggaacuuuccccacugc

SEQ ID NO: 487233 - RNA, 64 nt, Human; identical to SEQ ID NO: 389895

SEQ ID NO: 487234 - RNA, 64 nt, Human; identical to SEQ ID NO: 389896

SEQ ID NO: 487235 - RNA, 64 nt, Human; identical to SEQ ID NO: 389900

SEQ ID NO: 487236 - RNA, 64 nt, Human
ugggugaacagcuuggccuuuuuugggugucuugacaggccaagaagaacaaaugacucagaau

SEQ ID NO: 487237 - RNA, 64 nt, Human
cccugggcgccgccgugcucaugcugccgugacaacaggccaccacauaccucaaccuggggaa

SEQ ID NO: 487238 - RNA, 64 nt, Human
aggucuccucaacacugggcugauccugaauggcacaggccaaggggaggccagccucgccuuu

SEQ ID NO: 487239 - RNA, 64 nt, Human
cccaggccggcuccgcgggaacucucucccucagacaggccaaaaaccaguagcgaggucgugg

SEQ ID NO: 487240 - RNA, 64 nt, Human
uucacuccugcccugcccccaccuucccagucccacaggccaccccuggcuugggcuggguucu

SEQ ID NO: 487241 - RNA, 64 nt, Human
ugcaggagcucagccaccacugugccauggugacacaggccaaggcagacauuggcccucccuu

SEQ ID NO: 487242 - RNA, 64 nt, Human
cccuugugccucuguagcuggccuucuuccugccacaggccaugccucuaccaaggacacaugg

SEQ ID NO: 487243 - RNA, 64 nt, Human
guggggugucaucacccccauugucccuagggugacaggccagggggaaaaauuauccccggac

SEQ ID NO: 487244 - RNA, 64 nt, Human
aaaaccaacaaugaugccuagugaguauguguccacaggccauaacaggguagaagagagacau

SEQ ID NO: 487245 - RNA, 64 nt, Human
gcuugagggcagcacagaggccccugggacaccuacaggccagaaagaucaaccucugugaagu

SEQ ID NO: 487246 - RNA, 64 nt, Human
gcuagaaccagguuuggauaaagauugaagagccacaggccacucuucccucugagccauuggg

SEQ ID NO: 487247 - RNA, 64 nt, Human
ggggagcagugacuccuccaaauauucauugcuaacaggccauucuaugcaguuuguuuuaaca

SEQ ID NO: 487248 - RNA, 64 nt, Human
guacguauuuagauaaucauacuuccucugugagacaggccauaacugaaaaacucuuaaauau

SEQ ID NO: 487249 - RNA, 64 nt, Human
gaacugugugaacuaacaugcaaagauccccaaaacaggccaggugugguugcucacagcugua

SEQ ID NO: 487250 - RNA, 64 nt, Human
uucuccuuguaggggucucucagagguucuuuccacaggccauccucuuauuccguucuggggc

SEQ ID NO: 487251 - RNA, 64 nt, Human; identical to SEQ ID NO: 389832

SEQ ID NO: 487252 - RNA, 64 nt, Human; identical to SEQ ID NO: 389833

SEQ ID NO: 487253 - RNA, 64 nt, Human; identical to SEQ ID NO: 389834

SEQ ID NO: 487254 - RNA, 64 nt, Human
uuuccucugucucucuaggaauagggucuguuucacaggccauuucugugaacccuacuccauu

SEQ ID NO: 487255 - RNA, 64 nt, Human
aauguacuaggauacugcugcgucauuacagggcacaggccauggauggaaaacgcucucuacu

SEQ ID NO: 487256 - RNA, 64 nt, Human
ccuuccugcccagaaguggaugaugugggaguugacaggccagggagagggugaagcagguauc

SEQ ID NO: 487257 - RNA, 64 nt, Human
gggcaaauauuucaccauugccagagaagaugugacaggccaaucagacagggcccagagcauc

SEQ ID NO: 487258 - RNA, 64 nt, Human
caagaucauccuucacccgagguccugcccaagcacaggccagaugcaagaauggggaaaaguc

SEQ ID NO: 487259 - RNA, 64 nt, Human
uacccccauccuuaacuuuguauccuggcuuauaacaggccauccauuuuuguagcacacuuuu

SEQ ID NO: 487260 - RNA, 64 nt, Human
uagacaaaguuugccaaccauaagugucaaaagcacaggccaguauuaagcagaaguucuacca

SEQ ID NO: 487261 - RNA, 64 nt, Human
gacaacauauuauuccauaaaaccaguuuagggcacaggccaguuccugauuagaacacaggac

SEQ ID NO: 487262 - RNA, 64 nt, Human
agaagcugggaguccacaccgcugagcugaacugacaggccaguggggggcaggggugcgccuc

SEQ ID NO: 487263 - RNA, 64 nt, Human
ucccagacccagccacuguuucugccacccuguaacaggccauuaaagcuccccaguguucagc

SEQ ID NO: 487264 - RNA, 64 nt, Human
uauucaugggagcaucagccaguuucuaaaacccacaggccaucagcagcuagagguggcuggc

SEQ ID NO: 487265 - RNA, 64 nt, Human
aaguacagcuggagcccuucccugagaaacucuuacaggccaggaagccaguacagaucuuuga

SEQ ID NO: 487266 - RNA, 64 nt, Human
augcauggcucaaagauugauucaaaaguguaagacaggccaguggauuuuaauguauuaacaa

SEQ ID NO: 487267 - RNA, 64 nt, Human
accgccggggccacaggacgucuguccuccagucacaggccauccuugcugcucccuacugacu

SEQ ID NO: 487268 - RNA, 64 nt, Human
ucugccagacacacacugccugaguugaagagacacaggccacacauuucaggcugguugccag

SEQ ID NO: 487269 - RNA, 64 nt, Human; identical to SEQ ID NO: 390047

SEQ ID NO: 487270 - RNA, 64 nt, Human; identical to SEQ ID NO: 390048

SEQ ID NO: 487271 - RNA, 64 nt, Human; identical to SEQ ID NO: 390049

SEQ ID NO: 487272 - RNA, 64 nt, Human
agagccaugccccugaaacaucacaugccuuugcacaggccaccccccucuucaggcugcugca

SEQ ID NO: 487273 - RNA, 64 nt, Human
cuccagaacaaaccucuauauguugcugaaacacacaggccauuucauugagggaaaacauaau

SEQ ID NO: 487274 - RNA, 64 nt, Human
uucuuuucuuuacaaaccauuuuguuauugacuaacaggccaaagagucuccaguuuacccuuc

SEQ ID NO: 487275 - RNA, 64 nt, Human
ggcuucaggcaaagcuugaaucaggacucaaucuacaggccagcaccuuucucuuggccggaug

SEQ ID NO: 487276 - RNA, 64 nt, Human
agacucugaaaugaaguaaaagagauuuccugugacaggccaagucuuacagugccauggccca

SEQ ID NO: 487277 - RNA, 64 nt, Human
agggagaggcgagagaaugaucuggccucaggggacaggccaccuggucaggaggaauauuuuu

SEQ ID NO: 487278 - RNA, 64 nt, Human
cuccaggugcucugaccccagccgggcuacuaggacaggccagggcacuugcuccugagccccc

SEQ ID NO: 487279 - RNA, 64 nt, Human
uucagagaacuuaagucaaggagaguugaaauucacaggccagggcacaucuuuuauuuauuuc

SEQ ID NO: 487280 - RNA, 64 nt, Human
ggggccuucacagugaccaucgcaaccaggauugacaggccauccauucacagccaggagaugc

SEQ ID NO: 487281 - RNA, 64 nt, Human
cagucaugaauuuuauuguauuucuuggguaaggacaggccagaaugagugucaccagugggua

SEQ ID NO: 487282 - RNA, 64 nt, Human
uuuccagagcaaaccuggagaagauucacaauagacaggccaagaaacccggugcuuccuccag

SEQ ID NO: 487283 - RNA, 64 nt, Human
aacuuuacuugccuacaacgguucacaaacuggaacaggccauauucaaagccagugccuauuu

SEQ ID NO: 487284 - RNA, 64 nt, Human
uauuggcaaaauugcucaucccuaauccugaaaaacaggccagaauggguaaagacuugucaaa

SEQ ID NO: 487285 - RNA, 64 nt, Human
cugcucaccuuacugcccugggauuaaaucaguuacaggccagagucuccuuggagggccugga

SEQ ID NO: 487286 - RNA, 64 nt, Human
auagguacuguuguuuuuuauuaccgccgaagaaacaggccagauaagugaaguaauuugccua

SEQ ID NO: 487287 - RNA, 64 nt, Human; identical to SEQ ID NO: 389902

SEQ ID NO: 487288 - RNA, 64 nt, Human; identical to SEQ ID NO: 389903

SEQ ID NO: 487289 - RNA, 64 nt, Human; identical to SEQ ID NO: 389904

SEQ ID NO: 487290 - RNA, 64 nt, Human
ugauuuaauuuucaauauuugguuucauuuuucaacaggccaagaggccucugguaaugaagug

SEQ ID NO: 487291 - RNA, 64 nt, Human
ucauuuuaaccccaguccaguggcuuguccgacaacaggccauuucccuuuacauuccuccaca

SEQ ID NO: 487292 - RNA, 64 nt, Human
ggggacagauaacagaacgagcaaaguaaccuauacaggccagcauggaacagcaucuccccug

SEQ ID NO: 487293 - RNA, 64 nt, Human
gacagaaggugggggggggggggcucugggaagcacaggccagcaccuccccagguggcaggau

SEQ ID NO: 487294 - RNA, 64 nt, Human
gggguggugggccaaaguuaggacacugcguaaaacaggccaucccaccaccucuaccugcuca

SEQ ID NO: 487295 - RNA, 64 nt, Human
accuccaaagaccugaccugccuaaagacugaugacaggccauccuuccugcuguucuagguac

SEQ ID NO: 487296 - RNA, 64 nt, Human
gacuaugucuuucaagauguacagaagacugacaacaggccagugcagacuuugcuuccuccuu

SEQ ID NO: 487297 - RNA, 64 nt, Human
cccucacugcuagucagcuucuuuuggaaacuggacaggccauugccaccugcacuuugaagaa

SEQ ID NO: 487298 - RNA, 64 nt, Human
cccacaugcugaucuauuggggaacagagaagagacaggccacgaaggucaggcucuuuauauu

SEQ ID NO: 487299 - RNA, 64 nt, Human
uagcaguagaugcauguacccuaaggucauuaccacaggccaggggcugggcagcguacucauc

SEQ ID NO: 487300 - RNA, 64 nt, Human
ugccuuggagaccaaggcaauaguccuuuccacuacaggccaggggaugggacaagaaguaggg

SEQ ID NO: 487301 - RNA, 64 nt, Human
auuucaucaaggacagggaauaucccucccacacacaggccagcugcucacccugccaccucca

SEQ ID NO: 487302 - RNA, 64 nt, Human
uuccucauccagcaccaaaucuuugcuuauguccacaggccagggccugugcugcagucgggga

SEQ ID NO: 487303 - RNA, 64 nt, Human
guuuuccugcagcucuccaacaaacgccugagucacaggccagagcugccuugguauguuguua

SEQ ID NO: 487304 - RNA, 64 nt, Human
auccuugcccagaacuuuggucaccugcuuguucacaggccaccauaucuuacuucacugaagu

SEQ ID NO: 487305 - RNA, 64 nt, Human; identical to SEQ ID NO: 389905

SEQ ID NO: 487306 - RNA, 64 nt, Human; identical to SEQ ID NO: 389906

SEQ ID NO: 487307 - RNA, 64 nt, Human; identical to SEQ ID NO: 389907

SEQ ID NO: 487308 - RNA, 64 nt, Human
gaagggagcugccauguccgaugaaugccaacagacaggccacucuuuggucagccugcugaca

SEQ ID NO: 487309 - RNA, 64 nt, Human
gccccuggcugagcauggcagccuugaagacaccacaggccaaaacaugaggggcagaaauggg

SEQ ID NO: 487310 - RNA, 64 nt, Human
aaauuagaaauuauuuccagguauuauauuugucacaggccauuguaaauaccaaguauauugu

SEQ ID NO: 487311 - RNA, 64 nt, Human
ggauuuacacccuugacaaaaccaaaagaaauuaacaggccacagguuucuuuaaagcuguguu

SEQ ID NO: 487312 - RNA, 64 nt, Human
aguggacaggacagaccacccagugcugcaggagacaggccacugcgucaccugugagugguca

SEQ ID NO: 487313 - RNA, 64 nt, Human
ggcugggcucagcaaaggacucgccuugcaaccgacaggccauucccacccccacacacaaccu

SEQ ID NO: 487314 - RNA, 64 nt, Human
accauggcaucccagagcaaggacacaggagcccacaggccaguugagguugggcaaggagacu

SEQ ID NO: 487315 - RNA, 64 nt, Human
ucugcagucagacaaaccuaagaucacauccuggacaggccacuugcuugcuguguggcauugg

SEQ ID NO: 487316 - RNA, 64 nt, Human
ccaugggccagagauggaggagccccaguggcugacaggccagccucacucaggcacguaccug

SEQ ID NO: 487317 - RNA, 64 nt, Human
guggggaaggacagcguugcauagaggggcaguuacaggccaugaagaauguguagaugcauua

SEQ ID NO: 487318 - RNA, 64 nt, Human
guaugcaggacaaggaaugucugcucuggggggcacaggccaacuauauggagggaggguccca

SEQ ID NO: 487319 - RNA, 64 nt, Human
aauuuuuaagaugaacuuaguucuaaagaagauaacaggccaauccugaagguacucccuguuu

SEQ ID NO: 487320 - RNA, 64 nt, Human
gccaagcugcugcuuugaaagcgggaucuuggagacaggccauccauccuggagccucauggaa

SEQ ID NO: 487321 - RNA, 64 nt, Human
cccaagggcacaacgguggccaaacucagggcucacaggccagcaguccaugucagccacauca

SEQ ID NO: 487322 - RNA, 64 nt, Human
gcauggcaacaaaaugugugucaccaucaggccaacaggccagcccuugaauggggauuuauua

SEQ ID NO: 487323 - RNA, 61 nt, Human
uguccaagaaggcugagugaagagaguccagguuccggagcaccaucccacgguggccuuc

SEQ ID NO: 487324 - RNA, 62 nt, Human
aaaaaaaaaguaaauacaauuucaaaaaaaaaguuccggaucuguuuuuaagcuccaucugg

SEQ ID NO: 487325 - RNA, 62 nt, Human
cuguagggagugggggcugcuagaggggauuaguuccggagacugagacuguuggcuccacc

SEQ ID NO: 487326 - RNA, 51 nt, Human
uacugaggaagcgcaaauagaguuccggagcuggguugcuucugcugcagu

SEQ ID NO: 487327 - RNA, 64 nt, Human
uagcaauguguuuuuauuaaacaugcugugugccacaggccaguguuguuggugaaauauauaa

SEQ ID NO: 487328 - RNA, 64 nt, Human
aaugccugagggcagcugccagggccuguggaggacaggccagagaggaggccagcaggcccag

SEQ ID NO: 487329 - RNA, 64 nt, Human
cagguuaugucagcagcucugagacagcaguaucacaggccagauguuguuccuggcuagaugu

SEQ ID NO: 487330 - RNA, 64 nt, Human
uuuuuuaacuuuuauuucgucucaguuuuuggucacaggccaaauaauacagcgcucucucugc

SEQ ID NO: 487331 - RNA, 64 nt, Human
acuauaauaacugaugcugcucuacugcuuuaauacaggccaaaguaacguggaagcgcacagc

SEQ ID NO: 487332 - RNA, 64 nt, Human
cguggugguucauaucuguaauccuaacacuuugacaggccaaggcaggggaauugcuugaguu

SEQ ID NO: 487333 - RNA, 64 nt, Human
ggaaauguauauucccacauaacuagacguucaaacaggccaggcuccagcacuucaguacguc

SEQ ID NO: 487334 - RNA, 64 nt, Human
uguguuuuucaccagauuguacuccuaaaacuuaacaggccaucacaagcaauugucuuuuguu

SEQ ID NO: 487335 - RNA, 64 nt, Human
agagugagucccccagaagaggcugggugguugcacaggccaggugcacagguuggaaaugcac

SEQ ID NO: 487336 - RNA, 64 nt, Human
gcugaugacaaguggacagaccugguguuugagcacaggccauucacauucugacccguugccu

SEQ ID NO: 487337 - RNA, 64 nt, Human
cugggugggcuaagcagccuagucuaugugggugacaggccacgcuggucucagaugcccagug

SEQ ID NO: 487338 - RNA, 64 nt, Human
uugagaugugguacugcuuccucacaagucucccacaggccauguaaaggguauuuuuuugugg

SEQ ID NO: 487339 - RNA, 64 nt, Human
agaacugcauuuuauuuauuaauuuauaagcagaacaggccagaguucuaggcucuguuucuag

SEQ ID NO: 487340 - RNA, 64 nt, Human
cugagcuggauggacagugaggaagccuguaccuacaggccauauugcucaggcucaggacaag

SEQ ID NO: 487341 - RNA, 64 nt, Human
ccggucacauggacacaccugugcacacaugccuacaggccagcucugugccaagggcaaccua

SEQ ID NO: 487342 - RNA, 62 nt, Human
ugggcagacagucgggauuguuggaagaacagguuccggaaagucaucguuaggaauggcuu

SEQ ID NO: 487343 - RNA, 62 nt, Human
agacuugcggccccggguugggaggaaaacccguuccggagccgccugcucccggaaccgga

SEQ ID NO: 487344 - RNA, 62 nt, Human
cccgaagguuggcccccacguggggagguggaguuccggaauuauucugugcgcuaccggcc

SEQ ID NO: 487345 - RNA, 62 nt, Human
gccugcguguugagugugugggcggcagugccguuccggaggccugguccaucuggaguuuu

SEQ ID NO: 487346 - RNA, 64 nt, Human
cuaccuugcaaagccuccugcuccuacccaugcuacaggccaggaaccagagcccaucaucuca

SEQ ID NO: 487347 - RNA, 64 nt, Human
cucucagcucaccaacuguguggcccgauuccuaacaggccacacacagcccagggcuggggac

SEQ ID NO: 487348 - RNA, 64 nt, Human
acuccccuccccccauuuacaugcaugcaaucagacaggccacuaagguaaaagagucugcucu

SEQ ID NO: 487349 - RNA, 64 nt, Human
uaucaaagcucagcucuuugaaacauccagcaagacaggccagagugugggugagugcugugcu

SEQ ID NO: 487350 - RNA, 64 nt, Human
ggagaacacagaggacuggcggccgcggccggggacaggccagucgcguuccuuccgcauccuu

SEQ ID NO: 487351 - RNA, 64 nt, Human
aaagccaccggcaugugaagcugccggaaaguggacaggccagaccagggagauguguaccuga

SEQ ID NO: 487352 - RNA, 64 nt, Human
ccuccccgcccgcucccaggcgccccauguccucacaggccaggacgccauggcaggauggaga

SEQ ID NO: 487353 - RNA, 64 nt, Human
ugauggugcggaaagagaaaaaggaaaacggggcacaggccauucgacgccuucuccaaggggu

SEQ ID NO: 487354 - RNA, 64 nt, Human
ugucaauuacuugauauuccuugucuccaguaccacaggccacucuugacaucccauguuugcc

SEQ ID NO: 487355 - RNA, 64 nt, Human
auagguaauaacacaucuuaguauuaagaguuuuacaggccacuaguauaagauaggcaucgug

SEQ ID NO: 487356 - RNA, 64 nt, Human
agaugucgguugggagaaacuagcucugauccuaacaggccacguuaaacugcccaucuggaga

SEQ ID NO: 487357 - RNA, 64 nt, Human
uguuuguauuuaugcuacuuaaauacaaaacuggacaggccaggcaugguggcucaugccugua

SEQ ID NO: 487358 - RNA, 64 nt, Human
uugaacaagcagucuuuaaaaacugcugugaaacacaggccaucagggaaaacgaaaugcugca

SEQ ID NO: 487359 - RNA, 64 nt, Human
auuugcuuuauaagugaggguagggugagggaggacaggccaguagggggagggaaagggagag

SEQ ID NO: 487360 - RNA, 64 nt, Human
augaggcaggcccaguccuccuccagaaaauaagacaggccacaggagggcagaguggagugga

SEQ ID NO: 487361 - RNA, 62 nt, Human
aggaugggguuuccuccugggauggugaaaauguuccggaccuagauagugaugaagguagc

SEQ ID NO: 487362 - RNA, 62 nt, Human
accccgccauaugcugccugccucggcuuugaguuccggaagcaccuggggaaucccgccaa

SEQ ID NO: 487363 - RNA, 62 nt, Human
gagaagucagcauuuuugaagcccuccacaccguuccggaagagcuggcaaaaggagccuca

SEQ ID NO: 487364 - RNA, 62 nt, Human
aguaugggguuuccucccgggauggugaaaauguuccggaccuagauacugacgaagguagc

SEQ ID NO: 487365 - RNA, 64 nt, Human
caucuuucccuucuguugugaaauauguuaagccacaggccaaacugcuauaagaucgaaguuu

SEQ ID NO: 487366 - RNA, 64 nt, Human
acauuguucaggcuacgugaacuuggaagcaccuacaggccauuugcaugaaauucacaugcac

SEQ ID NO: 487367 - RNA, 64 nt, Human
gaacgugaacacaguggaaggcagaggguuuacuacaggccaggccauggacaccccacccagg

SEQ ID NO: 487368 - RNA, 64 nt, Human
ugauguaacaagagagacuuuacagccccaugcuacaggccaucaagaugaccuggagcagaga

SEQ ID NO: 487369 - RNA, 64 nt, Human
cugagcacgcugugagcccagcgggccugcggggacaggccaggccugaucccaccucacuucc

SEQ ID NO: 487370 - RNA, 64 nt, Human
guacuguguggugaccgccccacuggugucuauuacaggccacuuugguaguuguguaucugcu

SEQ ID NO: 487371 - RNA, 64 nt, Human
aggcugucgucccccuccagugcuuggcugccccacaggccacacgcugcccaggcucugcuga

SEQ ID NO: 487372 - RNA, 64 nt, Human
ggugcacauggggugggaaugcuccgggggugacacaggccacgguggcuccagccaggaccag

SEQ ID NO: 487373 - RNA, 64 nt, Human
ccaggccaggaggggcccugcccaugcccacacuacaggccagggcugcggggcuggcgcaauc

SEQ ID NO: 487374 - RNA, 64 nt, Human
cuuguacugccugccaccgcggaggaggcuggugacaggccaaaggccaguggaagaaacaccc

SEQ ID NO: 487375 - RNA, 64 nt, Human
ucugacagagcaucagaaccagaggcuuggucccacaggccacggaccaauggccugcagccgu

SEQ ID NO: 487376 - RNA, 64 nt, Human
uaguaaugcucaggacaggagcggcagccccagaacaggccacucauuuagaauucuaguguuu

SEQ ID NO: 487377 - RNA, 64 nt, Human
acugucaaaaaaaaaaaaaaaauuaauagauaaaacaggccacuagagggugcaguuauaaaga

SEQ ID NO: 487378 - RNA, 64 nt, Human
aggaacaucaaguuuugguguuacuuucuugucuacaggccaaaugcgcacaguugauuuucgg

SEQ ID NO: 487379 - RNA, 64 nt, Human
uaauugaacgggucgagaugccgaccucagccucacaggccaaagcaucagcaccagaacgcac

SEQ ID NO: 487380 - RNA, 62 nt, Human
guggccuggaggcaccagaggggcaagagaauguuccggaacuccaguucugaggggucuug

SEQ ID NO: 487381 - RNA, 62 nt, Human
ccaaaacugugaggaagguuaucgggacagagguuccggauaaccuguuucauuuuggguuu

SEQ ID NO: 487382 - RNA, 61 nt, Human
cacccauggcuagacgcugaaaacccaccugguuccggaauccuguccucagcuucuuaau

SEQ ID NO: 487383 - RNA, 64 nt, Human
acaucuaacaucuacacuucucuagcucagccucacaggccaaagcaucagcaccagaacgcac

SEQ ID NO: 487384 - RNA, 64 nt, Human
gaggagcagacccaggcagggccgccagggugacacaggccacccuuccuugccuucaguaacu

SEQ ID NO: 487385 - RNA, 64 nt, Human
uguuaccuaucucguguguguuauuuccccagccacaggccaaauccuuggagucccaggggca

SEQ ID NO: 487386 - RNA, 64 nt, Human
uagaacuccaguacucacccagggacuccaguucacaggccagaaaacauaugcauuaugaagu

SEQ ID NO: 487387 - RNA, 64 nt, Human
aguugcugucccuggguccccucuuucaugucccacaggccacagagcccaguguguccaacca

SEQ ID NO: 487388 - RNA, 64 nt, Human
uugccuugcucuugccaccaggacaccuaugucaacaggccaaacagccaugcaucuauaaagg

SEQ ID NO: 487389 - RNA, 64 nt, Human
cgacaggagcacugcaugucagagcacuuuaaaaacaggccagccugcuugggcgcucggucuc

SEQ ID NO: 487390 - RNA, 64 nt, Human
cuucuccggggcacagugcuaguggggccuccccacaggccaccgucgcccagccuggcagccc

SEQ ID NO: 487391 - RNA, 64 nt, Human
cagccaacaggggugucugcuucugcugcacuacacaggccaggaguggcauuccaugccacua

SEQ ID NO: 487392 - RNA, 64 nt, Human
augugggggcagaauaggacccauuugggcagacacaggccacggaaaccacagggccagcguc

SEQ ID NO: 487393 - RNA, 64 nt, Human
ggauaagaagcagaggaccuuccagccacccgcgacaggccacaagcguuccacgagcgaaggc

SEQ ID NO: 487394 - RNA, 64 nt, Human
ugggucgggcccuggagacgacacacggcagcccacaggccacgacagacgcuggaugcccucc

SEQ ID NO: 487395 - RNA, 64 nt, Human
ccuggcuacaucccagccugugguuacagugcagacaggccaugugagccaccgcugccagcac

SEQ ID NO: 487396 - RNA, 64 nt, Human
uuuguacugguaguuuaugaaauuuaauuaaaacacaggccaugaauggaaggugguauugcac

SEQ ID NO: 487397 - RNA, 64 nt, Human
gauggugggccucagggaggauggggaucaagggacaggccaggagccaggaguggggaaggga

SEQ ID NO: 487398 - RNA, 64 nt, Human; identical to SEQ ID NO: 389909

SEQ ID NO: 487399 - RNA, 64 nt, Human; identical to SEQ ID NO: 389910

SEQ ID NO: 487400 - RNA, 64 nt, Human; identical to SEQ ID NO: 389911

SEQ ID NO: 487401 - RNA, 64 nt, Human
uggccccuucccagcacauugaauggguaagcagacaggccaugauuuaguuggccagcacuaa

SEQ ID NO: 487402 - RNA, 64 nt, Human
acuuuuggaaauuuggcugaacaauuagaacacaacaggccaacucauacucauuuggaucuau

SEQ ID NO: 487403 - RNA, 64 nt, Human
auccugcagggauggggucagugguuccaccuucacaggccacuuugaaggguggauucuuuga

SEQ ID NO: 487404 - RNA, 64 nt, Human
gagguggagcugggcagcuguggagccccaggccacaggccagucucgcuuggcucucaugacu

SEQ ID NO: 487405 - RNA, 64 nt, Human
uacgagcucccugcuggagccugggacccauggcacaggccaggcagcccggaggcuggguggg

SEQ ID NO: 487406 - RNA, 64 nt, Human
gaaaagaaaauacaauuagucacucaacauaaccacaggccaauuuguuggccaccagaaaacc

SEQ ID NO: 487407 - RNA, 64 nt, Human
aagcaagaagcagauuagguuuuugacaaaacaaacaggccaaaagggggcugaccuggagcag

SEQ ID NO: 487408 - RNA, 64 nt, Human
augaggaaggaaguagcauuagcaguaaagacccacaggccaugaccuuuuugaucacucugag

SEQ ID NO: 487409 - RNA, 64 nt, Human
ucaggcuucccuugugucucccuggaccugccugacaggccacaggagcagacagcacacccaa

SEQ ID NO: 487410 - RNA, 64 nt, Human
cuccacuacccuguuaagagcagccugggaacguacaggccaucaagacuauuuauuuaaauac

SEQ ID NO: 487411 - RNA, 64 nt, Human
acuucccuggagaacaagugccacaaaaaugaaaacaggccacuucucaggaguugaauaauca

SEQ ID NO: 487412 - RNA, 64 nt, Human
gcaagggguguaauggggcuggguucugucuucuacaggccaccccgagguccucagugguugc

SEQ ID NO: 487413 - RNA, 64 nt, Human
ggucugagcccagggcagcuucuggggccacugcacaggccaccugcuuggguuccucggaguu

SEQ ID NO: 487414 - RNA, 64 nt, Human
agcuaccagcgugcaugucagcgacccuggcccgacaggccacguccugcaaucggcccggcug

SEQ ID NO: 487415 - RNA, 64 nt, Human
uuuuauuaagaaaucagaucccagggugagaguaacaggccauuuggccaagaaagaaaccugu

SEQ ID NO: 487416 - RNA, 64 nt, Human; identical to SEQ ID NO: 389829

SEQ ID NO: 487417 - RNA, 64 nt, Human; identical to SEQ ID NO: 389830

SEQ ID NO: 487418 - RNA, 64 nt, Human; identical to SEQ ID NO: 389831

SEQ ID NO: 487419 - RNA, 64 nt, Human
uuccccgugcuguggugugaccugaguuggugacacaggccacagaccccagagcuuggcuuuu

SEQ ID NO: 487420 - RNA, 56 nt, Human
cccagagugggggagacuagagggcuacaggccagcguggaugaccugaagagcgc

SEQ ID NO: 487421 - RNA, 64 nt, Human
cagugccaccccgcagcccaguggggugccaugcacaggccacaggcccuccaccucaccucca

SEQ ID NO: 487422 - RNA, 64 nt, Human
caauuuaauauaaauuucuguuugugcauuucugacaggccauuauuaucugcuuugacaaagc

SEQ ID NO: 487423 - RNA, 64 nt, Human
gaugcaucugauccagaguuagggagaggcacguacaggccaggccuagaaaugaugcauauca

SEQ ID NO: 487424 - RNA, 64 nt, Human
ugcuaaaaaguccuugauuuagcacuauuuacauacaggccauacuuuacaaaguauuugcuga

SEQ ID NO: 487425 - RNA, 64 nt, Human
guugaaaugaaaauacuguguauuacuuuauuuuacaggccacaauugauuaugaagucacccu

SEQ ID NO: 487426 - RNA, 64 nt, Human
cccagcugagcaugaggcccagcccauagacggcacaggccaccuggcccauucccugggcauu

SEQ ID NO: 487427 - RNA, 64 nt, Human
ccaugaucuuccuccugccaggggagagccacccacaggccauguccagccccacuucccucag

SEQ ID NO: 487428 - RNA, 64 nt, Human
ucacaccugacgaugagccaggccugagccccacacaggccagggcacauucuuggauuuucca

SEQ ID NO: 487429 - RNA, 64 nt, Human
agguuauagcuccaaguuccacaggucugcuaccacaggccaucaaaauauaaguuuccaggcu

SEQ ID NO: 487430 - RNA, 64 nt, Human
aaccucagaaauccucagcuucaaacauggggaaacaggccagagcauugcccggcuccugaau

SEQ ID NO: 487431 - RNA, 64 nt, Human
agggacuucaccaauggauuacaugccaucugggacaggccaugugggagaccccaguugugcc

SEQ ID NO: 487432 - RNA, 64 nt, Human
ccucaguucugggagcgcuggggucgccugggccacaggccacagcagcucaccucaggacugg

SEQ ID NO: 487433 - RNA, 64 nt, Human
ccaaaaguucucuucccaaacugccaagaaugauacaggccauaauugaaaugggaauaccuuu

SEQ ID NO: 487434 - RNA, 62 nt, Human
ggguacaaguacuaccgacagaagcuggaggaguuccggaaagccaaggccagcuccacagg

SEQ ID NO: 487435 - RNA, 62 nt, Human
aaacccaugcacagugcugcagaaacuggacaguuccggacagcggucaaggcaaggauguc

SEQ ID NO: 487436 - RNA, 62 nt, Human
aagccagugccaucauccccaccccgcccaggguuccggaacauucauucccccaccgguga

SEQ ID NO: 487437 - RNA, 64 nt, Human; identical to SEQ ID NO: 389912

SEQ ID NO: 487438 - RNA, 64 nt, Human
ugucccagcagaagagggaggcuuccugacugacacaggccagccccaucuugguccugucacc

SEQ ID NO: 487439 - RNA, 64 nt, Human
uccaugggggcauucuggcacccccugcuccaggacaggccaugggcaagcugccucccaucac

SEQ ID NO: 487440 - RNA, 64 nt, Human
uuuccucuacgcccagguuccggaagguggugagacaggccagcgugcaugacaguggagagga

SEQ ID NO: 487441 - RNA, 64 nt, Human
caacccagguuaaauacagcccaugcacaaagccacaggccaaagccuauggaauuguuuuuaa

SEQ ID NO: 487442 - RNA, 64 nt, Human
acgccauggguucaggcugauccaggagaugcucacaggccacaggaccuggaaaacacucuug

SEQ ID NO: 487443 - RNA, 64 nt, Human
cguugaggcgguuuccugaauuuccccaucugccacaggccauauuuguggcccgugcagcuuc

SEQ ID NO: 487444 - RNA, 64 nt, Human
uguaauuuauaaaauaacauuucaauggggguaaacaggccagaagagugugccaaguuguuug

SEQ ID NO: 487445 - RNA, 64 nt, Human
cucccucuccggagugacaggcacauacaugagaacaggccaucucagcccuacacacuugcca

SEQ ID NO: 487446 - RNA, 64 nt, Human
cuuaccuuuccucauagagcuauccugguuaauaacaggccaagauucucccauuauccccugu

SEQ ID NO: 487447 - RNA, 55 nt, Human
accuacaauacuacgccuagggcacacaggccagccccagucucacggcugaagu

SEQ ID NO: 487448 - RNA, 64 nt, Human
uuccccagagccaagggaguuuaaguuugcaguuacaggccaguucuccagcucuccaucuuag

SEQ ID NO: 487449 - RNA, 64 nt, Human
ccagcccugagccagaggcagaauggauggacagacaggccauggaggcagcacugagccagca

SEQ ID NO: 487450 - RNA, 64 nt, Human
acuguggggucuggguccccagaacucuggagcuacaggccacucuaggcccaagggcuagucc

SEQ ID NO: 487451 - RNA, 64 nt, Human
gcuuacaaagcauggcaggccaagggccucgaccacaggccagcauuagcagaacauauaaugg

SEQ ID NO: 487452 - RNA, 64 nt, Human
uuaaaacaauauucucuuuuugaaaauaguauaaacaggccaugcauauaauguacaguguauu

SEQ ID NO: 487453 - RNA, 64 nt, Human; identical to SEQ ID NO: 389836

SEQ ID NO: 487454 - RNA, 64 nt, Human; identical to SEQ ID NO: 389837

SEQ ID NO: 487455 - RNA, 64 nt, Human; identical to SEQ ID NO: 389838

SEQ ID NO: 487456 - RNA, 64 nt, Human
uggcagggagaaaagaacaucaggguggguggggacaggccagugacgaagagagggacagagg

SEQ ID NO: 487457 - RNA, 64 nt, Human
ugcccucuccguccccucuccucccacccacgccacaggccagccuacucuucccuccauccau

SEQ ID NO: 487458 - RNA, 64 nt, Human
auuggagcagauaaaauuaucaaaaguuucaugaacaggccaaacaaaauauuuuuuaaaguuu

SEQ ID NO: 487459 - RNA, 64 nt, Human
aggccuuuccuuccuggagccacagugcuuagagacaggccacuggggucagcauuugagcuca

SEQ ID NO: 487460 - RNA, 64 nt, Human
ccagcacaggcagcgcauggcuccggaagcagacacaggccaggccugggccaggagucugcca

SEQ ID NO: 487461 - RNA, 64 nt, Human
uuaauugagcaauugaggagugucucaggauagcacaggccaagguaggggaguaaaaaggagg

SEQ ID NO: 487462 - RNA, 64 nt, Human
aagaacagcucagaugcacaaagauucacaccauacaggccaaauuauagaaucccccaacccc

SEQ ID NO: 487463 - RNA, 64 nt, Human
gcugcucugggggaugagcuggugcguuuaaggaacaggccagcacuggcauucgcaagcagug

SEQ ID NO: 487464 - RNA, 64 nt, Human
gucauucuugucauaugcaacuaaaacaggguagacaggccaggggaaaaaggcacucagggca

SEQ ID NO: 487465 - RNA, 64 nt, Human
uugcuaaaauaugguuggcacugccucuuguggcacaggccauaauuguuccauagaccccucu

SEQ ID NO: 487466 - RNA, 64 nt, Human
uuauaaaacuuuucuuucuuucuuaacaguuucaacaggccacucacucuuaagggugagaaga

SEQ ID NO: 487467 - RNA, 64 nt, Human
ucucccucccuaccucccagccauccuaacuccuacaggccagagaaugacaucucuaacuggc

SEQ ID NO: 487468 - RNA, 64 nt, Human
uuguggaaucguuccugcuuccaagcagcaugcuacaggccagccuucaaagaaagaccagaag

SEQ ID NO: 487469 - RNA, 64 nt, Human
ccucccaggucagggucccggagccggugcccucacaggccaauagggaagccgagggcuguuu

SEQ ID NO: 487470 - RNA, 64 nt, Human
uacaaugaccuuuuuguaugaaaauuacuuauuaacaggccaggcgugguguugcaugucugua

SEQ ID NO: 487471 - RNA, 64 nt, Human; identical to SEQ ID NO: 389839

SEQ ID NO: 487472 - RNA, 64 nt, Human; identical to SEQ ID NO: 389840

SEQ ID NO: 487473 - RNA, 64 nt, Human; identical to SEQ ID NO: 389841

SEQ ID NO: 487474 - RNA, 64 nt, Human
auuucccccuaaaccaacugaaggcuaaaaagcaacaggccauugugaaccaaugcaagacgcc

SEQ ID NO: 487475 - RNA, 64 nt, Human
ucucaaaaaaaaaaaaagagaagaaaaacugccuacaggccauaguuaaccugcaauagagaag

SEQ ID NO: 487476 - RNA, 64 nt, Human
cuucuguagauaacgucaguggaguaaauauucgacaggccauaacuugagucuauugccuugc

SEQ ID NO: 487477 - RNA, 64 nt, Human
gucuuauucaaagcccucauugacagaggaggaaacaggccaaggcaggacauggcuggaccau

SEQ ID NO: 487478 - RNA, 64 nt, Human
ccccgucccgccucugaggaccgggagacagcccacaggccagaguugggcucuagcuccuggu

SEQ ID NO: 487479 - RNA, 64 nt, Human; identical to SEQ ID NO: 487478

SEQ ID NO: 487480 - RNA, 64 nt, Human
cuucaagaugccucuucuaccucuuccaggaagcacaggccaggggaucugggugugugagugg

SEQ ID NO: 487481 - RNA, 64 nt, Human
uugagaugauuagucaagagucaagguugcgaguacaggccaagaccaugggaaaaaaagccau

SEQ ID NO: 487482 - RNA, 64 nt, Human
uggaaggaagagccaucguggucuuugucuggccacaggccaggcugcugggcauccuccuccu

SEQ ID NO: 487483 - RNA, 64 nt, Human
aaggaccaaaaauuauuuuuagcuauggcaaggcacaggccacauggccccugauggcgucccu

SEQ ID NO: 487484 - RNA, 64 nt, Human
cucccucucuuagggugagaugaagugguuggcaacaggccaaugcuacuuucagaggcguuug

SEQ ID NO: 487485 - RNA, 64 nt, Human
gccaccaccacugucccuaccacugagcccuugcacaggccacuugcucagacgagacacccua

SEQ ID NO: 487486 - RNA, 64 nt, Human
cccuccaggaagccccuucccugacuccuggcccacaggccaggccuaaaaaaaacucguggcu

SEQ ID NO: 487487 - RNA, 64 nt, Human
agccugcagcacacacuaggccaccugcagucucacaggccaugcccuggguagacagggaggu

SEQ ID NO: 487488 - RNA, 64 nt, Human
gaccccccugugacugacucuucuucucggggacacaggccagcuccacaguguugccagagcc

SEQ ID NO: 487489 - RNA, 64 nt, Human; identical to SEQ ID NO: 389846

SEQ ID NO: 487490 - RNA, 64 nt, Human; identical to SEQ ID NO: 389847

SEQ ID NO: 487491 - RNA, 64 nt, Human; identical to SEQ ID NO: 389848

SEQ ID NO: 487492 - RNA, 64 nt, Human
aagucuacuguauauaacaucuaauauauauauuacaggccaaaugaacuaaacauugccuugc

SEQ ID NO: 487493 - RNA, 64 nt, Human
agccuccuccacuccuccccacagcgcagaggaaacaggccagcccagugacaugacguuauua

SEQ ID NO: 487494 - RNA, 64 nt, Human
ucacgcugacccuagccugucucuggcuaaccacacaggccauuccccucucccagcaccuugc

SEQ ID NO: 487495 - RNA, 64 nt, Human
ccauaucagccugcgggacuaggguggggagcaaacaggccagcgguggaggucuggacaguuc

SEQ ID NO: 487496 - RNA, 64 nt, Human
ucacuucacaaugugacaguccccaggcaugcccacaggccaggcccagucacagcugggcuuc

SEQ ID NO: 487497 - RNA, 64 nt, Human
aggaggcaccacgcacaggccggaggcaccacgcacaggccagagucucccaaauccugucccg

SEQ ID NO: 487498 - RNA, 64 nt, Human
uccacaccagccgcaacccaagcagaugacaggcacaggccaccgcaugaggagauggagggcg

SEQ ID NO: 487499 - RNA, 64 nt, Human
cuuagcacucuugguggugggugggaggguggguacaggccagggauauucccuugcucuuuug

SEQ ID NO: 487500 - RNA, 64 nt, Human
ccuggcuucagcuuggaacccaauaccuaggcuuacaggccauccugagccaggggccucugga

SEQ ID NO: 487501 - RNA, 64 nt, Human
cauuaguugaacuauuuucacauuggccccccacacaggccacucucuucccuuucuuggugaa

SEQ ID NO: 487502 - RNA, 64 nt, Human
ccugcuucccgagguugugguauugguagggguaacaggccaaucgguguggcuucagcuucug

SEQ ID NO: 487503 - RNA, 64 nt, Human
ucugcagcaccccucaguuccugugccucagcccacaggccacugugauaauggucuguuuagc

SEQ ID NO: 487504 - RNA, 64 nt, Human
ccacaugcuugcaguccuacaggcuucccgacccacaggccagcuacggauuuugcacuuuugc

SEQ ID NO: 487505 - RNA, 64 nt, Human
uggccucuuggugggacagacauuuguauaagucacaggccaugucauacugugcuuaaguucu

SEQ ID NO: 487506 - RNA, 64 nt, Human
ccggccggaccaucaaggugugggacuacgccacacaggccagcccaggcccccaggugugugc

SEQ ID NO: 487507 - RNA, 64 nt, Human; identical to SEQ ID NO: 389849

SEQ ID NO: 487508 - RNA, 64 nt, Human
ccccccaccgcccugaccggcuaccugaggcugcacaggccagggcucgggcaugugguggccg

SEQ ID NO: 487509 - RNA, 64 nt, Human
ugcuuugguggccuugccccgcucugcagcacagacaggccagaugcauuuguccuuugccuag

SEQ ID NO: 487510 - RNA, 64 nt, Human
accaaacauggggguuugguaaugagaaaccaggacaggccaucugcagugacccagcccagga

SEQ ID NO: 487511 - RNA, 64 nt, Human
gaggaggaaggggacaguugcagucucacuugggacaggccacagccagggguccggccacuac

SEQ ID NO: 487512 - RNA, 64 nt, Human
acaccugggugccccugaccccuuggcaccggauacaggccacgauaaacauccuuucgugugu

SEQ ID NO: 487513 - RNA, 64 nt, Human
aggagugugcucaggccgggcuuuccagaaggccacaggccacugcaaacccugcugccugccg

SEQ ID NO: 487514 - RNA, 64 nt, Human
gagcuuccaagagcacccaccaagacacagcaggacaggccaggggagggcaucuggaccaggg

SEQ ID NO: 487515 - RNA, 64 nt, Human
agaugaagcgguuauagccauugacauuguggccacaggccacuggcccuggguggcucuguca

SEQ ID NO: 487516 - RNA, 64 nt, Human
ccagaagcaccuacucugugcaagggcauucacaacaggccagugggcaaacgugagccagggc

SEQ ID NO: 487517 - RNA, 64 nt, Human
auugcaucugcccugugcaugcgcauguuuaaccacaggccagagaacucaauucugaugucgu

SEQ ID NO: 487518 - RNA, 64 nt, Human
cauaccuggagcccuccgaggggugucaggggaaacaggccaccgccaaagccauggcccgccg

SEQ ID NO: 487519 - RNA, 50 nt, Human
gcuccaacuccucccgauaaacaggccacugaagcucucgccccuguaac

SEQ ID NO: 487520 - RNA, 64 nt, Human; identical to SEQ ID NO: 487511

SEQ ID NO: 487521 - RNA, 64 nt, Human
cauucucagaggauccagggaggcccagguacacacaggccauggcagacaccccaugucuuug

SEQ ID NO: 487522 - RNA, 64 nt, Human
auuagaagugagagguagaaguacuucaaauucaacaggccagcaagcaaucggcuuaaaauuc

SEQ ID NO: 487523 - RNA, 64 nt, Human; identical to SEQ ID NO: 389915

SEQ ID NO: 487524 - RNA, 64 nt, Human; identical to SEQ ID NO: 389916

SEQ ID NO: 487525 - RNA, 64 nt, Human; identical to SEQ ID NO: 389917

SEQ ID NO: 487526 - RNA, 64 nt, Human
agugggagaaagaaugauggaagaagaguccagaacaggccagaaagugaauccagggaacaca

SEQ ID NO: 487527 - RNA, 64 nt, Human
aaaggacaaaagcaaagaagcuauuuaggaauuuacaggccaaagucuucauuuauugcccagu

SEQ ID NO: 487528 - RNA, 64 nt, Human
cugcaucugggugaagaaacgggagcuguggaccacaggccagccagugaaccuccugggcuuu

SEQ ID NO: 487529 - RNA, 64 nt, Human
uuccccaggguugacaaggggccguccuuuccacacaggccagaagaggucuucaggcgaaccg

SEQ ID NO: 487530 - RNA, 64 nt, Human
cccaagaagacagcccccugccccaucuucuggcacaggccaucccgagugcaugucccuguug

SEQ ID NO: 487531 - RNA, 64 nt, Human
uuucugagaaaccuggcagccugcuguuaacaacacaggccaguauuggguuuuauugaauuug

SEQ ID NO: 487532 - RNA, 64 nt, Human
uucaugacuuuauuucugaccuauuaaaacaugaacaggccaggcaugguggcucacgccugua

SEQ ID NO: 487533 - RNA, 64 nt, Human
cucagcccugugccacucaccgaagccacuuucuacaggccagcaggggcuuguugcaggcugu

SEQ ID NO: 487534 - RNA, 64 nt, Human
gggaacuggcaucccauucagcaucucaggacucacaggccaacauguguuccauggcugggaa

SEQ ID NO: 487535 - RNA, 64 nt, Human
cuccuuccccggcaaaaaccaaacaaacuggcagacaggccagggauguauguugcuugcuuga

SEQ ID NO: 487536 - RNA, 62 nt, Human
ucggaaucacugccaaauaaguaacuagacguuuacaggccauacaugucuuaccacugaga

SEQ ID NO: 487537 - RNA, 64 nt, Human
aggagugugccccucuguaacaacucuagucagcacaggccauggugcacaaaagggacuugga

SEQ ID NO: 487538 - RNA, 64 nt, Human
gggaccaugaugucucagucacuccacgcuccccacaggccaacccuggcacaggucaugucug

SEQ ID NO: 487539 - RNA, 64 nt, Human
aagggugagaagguggaggcuaugcuuuggggggacaggccagaaugaaguccugggucaggag

SEQ ID NO: 487540 - RNA, 64 nt, Human
acaggaagacccagcagcuccacccucccaagugacaggccauuuucggacgcagccguucugu

SEQ ID NO: 487541 - RNA, 64 nt, Human; identical to SEQ ID NO: 389852

SEQ ID NO: 487542 - RNA, 64 nt, Human; identical to SEQ ID NO: 389853

SEQ ID NO: 487543 - RNA, 64 nt, Human; identical to SEQ ID NO: 389854

SEQ ID NO: 487544 - RNA, 64 nt, Human
ugcugcugcugggccccccgaucagaccucaaggacaggccagcgagagauggagcuaccgugu

SEQ ID NO: 487545 - RNA, 64 nt, Human
cucuacagagcaucuuuuagagcaagagauucauacaggccaagugaugagagggggagucacc

SEQ ID NO: 487546 - RNA, 64 nt, Human
aggacgacaccuggcuugccacccacagugcaccacaggccaaccuacgcccuucaucacuugg

SEQ ID NO: 487547 - RNA, 64 nt, Human
gugacacaucucuaguacuuuuugucauaaacaaacaggccaucugccgccaaauacauccacu

SEQ ID NO: 487548 - RNA, 64 nt, Human
ggcauccuucugccuguuucuguaagcaaaugccacaggccaccuauagcuacauacuccuggc

SEQ ID NO: 487549 - RNA, 64 nt, Human
caucucagccuccugaguagcugggacuacaggcacaggccaccaaaccuggcuaauguuuaaa

SEQ ID NO: 487550 - RNA, 64 nt, Human
agaggggaaagaagcugauaugaggaagggucugacaggccacagcccuugcagccggagggcu

SEQ ID NO: 487551 - RNA, 64 nt, Human
gcuuucugggaaaagcgugccuccagccguggggacaggccauccuacugacuaccucuugcuu

SEQ ID NO: 487552 - RNA, 64 nt, Human
gcaggccccuggggacacaucugcccacagcugcacaggccagggcgcaggcacaucuguuggu

SEQ ID NO: 487553 - RNA, 64 nt, Human
uaucacuccauacuggggugggcuggaggaggccacaggccagcuauuguaaaagcuuuuuauu

SEQ ID NO: 487554 - RNA, 64 nt, Human
aggcgcacucugucagagugaacagcaccgcgagacaggccaggcucguggcucggaagacaaa

SEQ ID NO: 487555 - RNA, 64 nt, Human
auaguguacuguccuuuuauaugaaauuuccagaacaggccaaucugaagagauguauagugga

SEQ ID NO: 487556 - RNA, 64 nt, Human
gauuccggcuucuacaugggacagacggggacgcacaggccaccuuccuucuggcagggacucu

SEQ ID NO: 487557 - RNA, 64 nt, Human
ugggccucugguggaccagagauuaccccucucaacaggccagcugcugguuggcuccagccag

SEQ ID NO: 487558 - RNA, 64 nt, Human
uugugacuucgaaaucuuuucaugugccuuccauacaggccauucacuguggucccugggaaag

SEQ ID NO: 487559 - RNA, 64 nt, Human; identical to SEQ ID NO: 389855

SEQ ID NO: 487560 - RNA, 64 nt, Human; identical to SEQ ID NO: 389856

SEQ ID NO: 487561 - RNA, 64 nt, Human; identical to SEQ ID NO: 389857

SEQ ID NO: 487562 - RNA, 64 nt, Human
guggccauauucccugaaggccugaaucuguuucacaggccacuguugguaagaucuaaagcau

SEQ ID NO: 487563 - RNA, 64 nt, Human
uggcaaacauggcaaaacugucucuauuaaaaauacaggccaggggccgggcacggugccucac

SEQ ID NO: 487564 - RNA, 64 nt, Human
ucugugauuuucucgcugaaaccauguuucucagacaggccaaggccaccugacuccuaucacg

SEQ ID NO: 487565 - RNA, 64 nt, Human
agugaccuccacuccucaaccucgggcagcucccacaggccacagccgggcuccccacccccgg

SEQ ID NO: 487566 - RNA, 64 nt, Human
ucuggcucccacaaggcccgguguugaccgagccacaggccacggacaggggccgggguugggg

SEQ ID NO: 487567 - RNA, 64 nt, Human
auaguguacuguccuuuuauacgaaauuuccagaacaggccaaucugaagagaugcauagcgga

SEQ ID NO: 487568 - RNA, 64 nt, Human
ggcugugagcuugaaucgggagugggguggaggcacaggccaaccugcgcucuccccuuagggg

SEQ ID NO: 487569 - RNA, 64 nt, Human
auagagucauuauguuugcaaagccccuggucauacaggccagggaacauaagaccgcaauucu

SEQ ID NO: 487570 - RNA, 64 nt, Human
uccacccaccucagccucccaaagugcugggauuacaggccacuacaccuggcacauuugagua

SEQ ID NO: 487571 - RNA, 64 nt, Human
ugucucagccuccugaguagaugggacuacaggcacaggccauuaugccuggcuaauuuuugua

SEQ ID NO: 487572 - RNA, 64 nt, Human
cagguacagcacuggcuuuucuuuucagccccugacaggccacccccacuccucugcaugucuu

SEQ ID NO: 487573 - RNA, 64 nt, Human
ucggggaccccucaguguagugacuaagccauccacaggccaacucggccaagggcaacuuuag

SEQ ID NO: 487574 - RNA, 64 nt, Human
gguucauuagaggggguugcuacuuuuauuuuggacaggccaguucuccauucugcaggacuau

SEQ ID NO: 487575 - RNA, 64 nt, Human
ugagggguuagggucccaguucccaguggaagaaacaggccaggagaagugcgugccgagcuga

SEQ ID NO: 487576 - RNA, 64 nt, Human
ggaggucaggaagccaggcaaggagagggacagcacaggccacagagggcugcccccaccacac

SEQ ID NO: 487577 - RNA, 64 nt, Human; identical to SEQ ID NO: 389859

SEQ ID NO: 487578 - RNA, 64 nt, Human; identical to SEQ ID NO: 389860

SEQ ID NO: 487579 - RNA, 64 nt, Human; identical to SEQ ID NO: 389864

SEQ ID NO: 487580 - RNA, 64 nt, Human
gacugcauucauaugagauccuuguaguauaagcacaggccauuuuucacuuugguauuaauaa

SEQ ID NO: 487581 - RNA, 64 nt, Human
accugucuuccaggacacauuuuuagauacucugacaggccacugcaucucagauucaggggag

SEQ ID NO: 487582 - RNA, 64 nt, Human
ugggcacagguuggggcucugcaggaugaggaagacaggccaaucccuucccucccagaagcug

SEQ ID NO: 487583 - RNA, 64 nt, Human
ugaggacauuccauccuucacccccuccucuggcacaggccaccacugcggugcugugccuuca

SEQ ID NO: 487584 - RNA, 64 nt, Human
gagcaggcuugccuggcagagaaccuguucagauacaggccaguuucuucuucgaggaaagcca

SEQ ID NO: 487585 - RNA, 64 nt, Human
uuguuuacuuaggaguggugcuuuuucucagaaaacaggccacgguguuucauacagaaugucu

SEQ ID NO: 487586 - RNA, 64 nt, Human
ugccucagccucccaaauagcugggacuacaggcacaggccaccacaccuggcuaauuuuuuug

SEQ ID NO: 487587 - RNA, 64 nt, Human
ccgacuggggugcgggugcacaggucgggggagcacaggccacagagcgcagccucuggggguc

SEQ ID NO: 487588 - RNA, 64 nt, Human
uucccauguucucuaacagggccagcugagcagcacaggccaggaggccacaguguaagcaaua

SEQ ID NO: 487589 - RNA, 64 nt, Human
agggcuucagggccaucugcucccagggcaggggacaggccaccaaggaccuuuggcaaaugaa

SEQ ID NO: 487590 - RNA, 64 nt, Human
guagguuuugaagagucccuuaauaugugguggaacaggccaggaguuagagaaagggcuggcu

SEQ ID NO: 487591 - RNA, 62 nt, Human
gccaggucgugggcuccuaggcugagugguucacaggccagcuggccggggguuggggagcc

SEQ ID NO: 487592 - RNA, 64 nt, Human
ggaggcagcagggaugcugcugggaguccauggcacaggccacagccccucaccuugccgcggu

SEQ ID NO: 487593 - RNA, 64 nt, Human
ccaaauuugacaauauaaaguaaggagcaaaguuacaggccaguuuuuacuuguuugcccugag

SEQ ID NO: 487594 - RNA, 64 nt, Human
gaccagugcagccagcaggggaggugagccauacacaggccacgacaaaaugcaggcauuuuau

SEQ ID NO: 487595 - RNA, 62 nt, Human
gacucaaaguagcccggcggcaagaggcccauguuccggagagaagccucccgacccugugc

SEQ ID NO: 487596 - RNA, 62 nt, Human
gggugagauugagccuccuguugcucccuggaguuccggaggcugggcugcagcccacucag

SEQ ID NO: 487597 - RNA, 62 nt, Human
cagggagagcccugcauuuccucuacgcccagguuccggaagguggugagacaggccagcgu

SEQ ID NO: 487598 - RNA, 62 nt, Human
caccuccagcagccuugagaagcaagaacaugguuccggacccagcccuagcagccuucucc

SEQ ID NO: 487599 - RNA, 64 nt, Human
gagcagugcagccaccagggcagaaaugccgggcacaggccaggacaaaaugcagacuuuuuuu

SEQ ID NO: 487600 - RNA, 60 nt, Human
auguggaggcgauccagugaugagucggggacaggccagcggggggacggaggcggcggg

SEQ ID NO: 487601 - RNA, 64 nt, Human
gucaggggccuggugguggggggcgucuccugagacaggccagcuuggauggccuccagcaacu

SEQ ID NO: 487602 - RNA, 64 nt, Human
gccaggaaagggcccauguggcagaaggcaaaguacaggccaagaauugggggugggggagaug

SEQ ID NO: 487603 - RNA, 64 nt, Human
ggacaggaaagggagccagagcuguauaccugggacaggccagggagccuuuagugccagcagg

SEQ ID NO: 487604 - RNA, 64 nt, Human
auuuagaucagguacccagugucugucucccacgacaggccaagggaugugauaguguuguugg

SEQ ID NO: 487605 - RNA, 64 nt, Human
acacuuugacuuaauuucauacaaagcucugaugacaggccaugacuguagaguggucagaacu

SEQ ID NO: 487606 - RNA, 64 nt, Human
cccaccaacuuggauucagauugcgacaugcaggacaggccagucauucucucucucugacuuu

SEQ ID NO: 487607 - RNA, 64 nt, Human
gggcaaggggcccuuccagaugccaccaccgccaacaggccaggccucugccuccucuucaucu

SEQ ID NO: 487608 - RNA, 64 nt, Human
ccagacgacaggucaucguucaagcagaaugcagacaggccauucacgagcccaaguugaagag

SEQ ID NO: 487609 - RNA, 64 nt, Human
gggccagacagcuuuuaauugaaauuguuauuucacaggccaggguucaguucugcuccuccac

SEQ ID NO: 487610 - RNA, 62 nt, Human
gcacuuauauuuuagccuuauuauuuucuguaguuccggagagaugguggguugccauucug

SEQ ID NO: 487611 - RNA, 62 nt, Human
ugccucccagcugggcuuguucucugagggagguuccggagacucauggacuuggggcucug

SEQ ID NO: 487612 - RNA, 62 nt, Human
aacccugugaucuauaccaccuucaauaucgaguuccggaaagccuuccucaagauccuguc

SEQ ID NO: 487613 - RNA, 62 nt, Human
uugccuuucucgauuuuaucuuucgcacagcaguuccggauuggcuuguguguuucacuuuu

SEQ ID NO: 487614 - RNA, 62 nt, Human
ggggccagggcaguccuuugaaagggaagcaaguuccggaauuuguucgcucauggaacuau

SEQ ID NO: 487615 - RNA, 62 nt, Human
gccccuacuauuccaggccaucacacuggccuguuccggagaauauuucucucacaauauua

SEQ ID NO: 487616 - RNA, 62 nt, Human
ggcagggugugugugugugugucuggcugugcguuccggagugugugacgaugcugaccuag

SEQ ID NO: 487617 - RNA, 64 nt, Human; identical to SEQ ID NO: 389956

SEQ ID NO: 487618 - RNA, 64 nt, Human; identical to SEQ ID NO: 389957

SEQ ID NO: 487619 - RNA, 64 nt, Human; identical to SEQ ID NO: 389958

SEQ ID NO: 487620 - RNA, 64 nt, Human; identical to SEQ ID NO: 389959

SEQ ID NO: 487621 - RNA, 64 nt, Human; identical to SEQ ID NO: 389960

SEQ ID NO: 487622 - RNA, 64 nt, Human; identical to SEQ ID NO: 389961

SEQ ID NO: 487623 - RNA, 64 nt, Human; identical to SEQ ID NO: 389962

SEQ ID NO: 487624 - RNA, 64 nt, Human; identical to SEQ ID NO: 389963

SEQ ID NO: 487625 - RNA, 64 nt, Human; identical to SEQ ID NO: 389967

SEQ ID NO: 487626 - RNA, 64 nt, Human; identical to SEQ ID NO: 389968

SEQ ID NO: 487627 - RNA, 64 nt, Human; identical to SEQ ID NO: 389969

SEQ ID NO: 487628 - RNA, 64 nt, Human; identical to SEQ ID NO: 389970

SEQ ID NO: 487629 - RNA, 58 nt, Human; identical to SEQ ID NO: 389971

SEQ ID NO: 487630 - RNA, 64 nt, Human; identical to SEQ ID NO: 389972

SEQ ID NO: 487631 - RNA, 64 nt, Human; identical to SEQ ID NO: 389973

SEQ ID NO: 487632 - RNA, 64 nt, Human; identical to SEQ ID NO: 389974

SEQ ID NO: 487633 - RNA, 64 nt, Human; identical to SEQ ID NO: 389975

SEQ ID NO: 487634 - RNA, 64 nt, Human; identical to SEQ ID NO: 389976

SEQ ID NO: 487635 - RNA, 64 nt, Human; identical to SEQ ID NO: 389977

SEQ ID NO: 487636 - RNA, 64 nt, Human; identical to SEQ ID NO: 389978

SEQ ID NO: 487637 - RNA, 64 nt, Human; identical to SEQ ID NO: 378450

SEQ ID NO: 487638 - RNA, 64 nt, Human; identical to SEQ ID NO: 378451

SEQ ID NO: 487639 - RNA, 64 nt, Human; identical to SEQ ID NO: 378452

SEQ ID NO: 487640 - RNA, 52 nt, Human; identical to SEQ ID NO: 378453

SEQ ID NO: 487641 - RNA, 64 nt, Human; identical to SEQ ID NO: 378468

SEQ ID NO: 487642 - RNA, 64 nt, Human; identical to SEQ ID NO: 378469

SEQ ID NO: 487643 - RNA, 64 nt, Human; identical to SEQ ID NO: 378470

SEQ ID NO: 487644 - RNA, 64 nt, Human; identical to SEQ ID NO: 378471

SEQ ID NO: 487645 - RNA, 64 nt, Human; identical to SEQ ID NO: 378472

SEQ ID NO: 487646 - RNA, 64 nt, Human; identical to SEQ ID NO: 378473

SEQ ID NO: 487647 - RNA, 64 nt, Human; identical to SEQ ID NO: 378474

SEQ ID NO: 487648 - RNA, 64 nt, Human; identical to SEQ ID NO: 378475

SEQ ID NO: 487649 - RNA, 64 nt, Human; identical to SEQ ID NO: 378476

SEQ ID NO: 487650 - RNA, 64 nt, Human; identical to SEQ ID NO: 378477

SEQ ID NO: 487651 - RNA, 64 nt, Human; identical to SEQ ID NO: 378478

SEQ ID NO: 487652 - RNA, 64 nt, Human
cuuauccuccugagcagcugggacuacaggcacacaccaccacaccuggcuaaguuuuguauuu

SEQ ID NO: 487653 - RNA, 64 nt, Human
cucagacucccgaauagcugggauuacagacaggcaccaccacacccagcuaauuuuuguauuu

SEQ ID NO: 487654 - RNA, 64 nt, Human
ucuggccgccacccccaucuuccaccugugcccucaccaccacacuacacagcacaccagccgc

SEQ ID NO: 487655 - RNA, 64 nt, Human; identical to SEQ ID NO: 378479

SEQ ID NO: 487656 - RNA, 64 nt, Human; identical to SEQ ID NO: 378480

SEQ ID NO: 487657 - RNA, 64 nt, Human; identical to SEQ ID NO: 378481

SEQ ID NO: 487658 - RNA, 64 nt, Human; identical to SEQ ID NO: 378482

SEQ ID NO: 487659 - RNA, 64 nt, Human; identical to SEQ ID NO: 378483

SEQ ID NO: 487660 - RNA, 64 nt, Human; identical to SEQ ID NO: 378484

SEQ ID NO: 487661 - RNA, 64 nt, Human; identical to SEQ ID NO: 378485

SEQ ID NO: 487662 - RNA, 64 nt, Human; identical to SEQ ID NO: 378486

SEQ ID NO: 487663 - RNA, 61 nt, Human; identical to SEQ ID NO: 378487

SEQ ID NO: 487664 - RNA, 64 nt, Human; identical to SEQ ID NO: 378488

SEQ ID NO: 487665 - RNA, 64 nt, Human; identical to SEQ ID NO: 378489

SEQ ID NO: 487666 - RNA, 64 nt, Human; identical to SEQ ID NO: 378490

SEQ ID NO: 487667 - RNA, 64 nt, Human; identical to SEQ ID NO: 378491

SEQ ID NO: 487668 - RNA, 64 nt, Human; identical to SEQ ID NO: 378492

SEQ ID NO: 487669 - RNA, 64 nt, Human; identical to SEQ ID NO: 378493

SEQ ID NO: 487670 - RNA, 64 nt, Human
cgguggccagcccugcugccaucauuggcugaagcaccaccaggauucacggcacccaacugcu

SEQ ID NO: 487671 - RNA, 64 nt, Human
cucagccucccaaguagcugggauuacaggcgugcaccaccacgccgggcuaaauuuuuuugua

SEQ ID NO: 487672 - RNA, 64 nt, Human
cucagccugcugaguaguugggauuacaggcgcccaccaccaugcccagcuaauuuuuguguuu

SEQ ID NO: 487673 - RNA, 64 nt, Human; identical to SEQ ID NO: 378494

SEQ ID NO: 487674 - RNA, 64 nt, Human; identical to SEQ ID NO: 378495

SEQ ID NO: 487675 - RNA, 64 nt, Human; identical to SEQ ID NO: 378496

SEQ ID NO: 487676 - RNA, 64 nt, Human; identical to SEQ ID NO: 378497

SEQ ID NO: 487677 - RNA, 64 nt, Human; identical to SEQ ID NO: 378498

SEQ ID NO: 487678 - RNA, 64 nt, Human; identical to SEQ ID NO: 378499

SEQ ID NO: 487679 - RNA, 64 nt, Human; identical to SEQ ID NO: 378500

SEQ ID NO: 487680 - RNA, 64 nt, Human; identical to SEQ ID NO: 378501

SEQ ID NO: 487681 - RNA, 64 nt, Human; identical to SEQ ID NO: 378502

SEQ ID NO: 487682 - RNA, 64 nt, Human; identical to SEQ ID NO: 378503

SEQ ID NO: 487683 - RNA, 64 nt, Human; identical to SEQ ID NO: 378504

SEQ ID NO: 487684 - RNA, 64 nt, Human; identical to SEQ ID NO: 378505

SEQ ID NO: 487685 - RNA, 64 nt, Human; identical to SEQ ID NO: 378506

SEQ ID NO: 487686 - RNA, 64 nt, Human; identical to SEQ ID NO: 378507

SEQ ID NO: 487687 - RNA, 57 nt, Human; identical to SEQ ID NO: 378508

SEQ ID NO: 487688 - RNA, 64 nt, Human
cuuagccucccgaguagcugggauuauaggcacccaccaccacgcccagcuaauuuuuguauua

SEQ ID NO: 487689 - RNA, 64 nt, Human
uuaauuuaucagauugcuuuugugcauuggauaacaccaccauucacaaguuaagauucuuggu

SEQ ID NO: 487690 - RNA, 64 nt, Human
acagcccccaccccauggcuuccaucuuuugcaucaccaccacuccugaacccccauuucugau

SEQ ID NO: 487691 - RNA, 64 nt, Human; identical to SEQ ID NO: 378509

SEQ ID NO: 487692 - RNA, 64 nt, Human; identical to SEQ ID NO: 378510

SEQ ID NO: 487693 - RNA, 64 nt, Human; identical to SEQ ID NO: 378511

SEQ ID NO: 487694 - RNA, 64 nt, Human; identical to SEQ ID NO: 378512

SEQ ID NO: 487695 - RNA, 64 nt, Human; identical to SEQ ID NO: 378513

SEQ ID NO: 487696 - RNA, 64 nt, Human; identical to SEQ ID NO: 378514

SEQ ID NO: 487697 - RNA, 64 nt, Human; identical to SEQ ID NO: 378515

SEQ ID NO: 487698 - RNA, 64 nt, Human; identical to SEQ ID NO: 378516

SEQ ID NO: 487699 - RNA, 64 nt, Human; identical to SEQ ID NO: 378517

SEQ ID NO: 487700 - RNA, 64 nt, Human; identical to SEQ ID NO: 378518

SEQ ID NO: 487701 - RNA, 64 nt, Human; identical to SEQ ID NO: 378519

SEQ ID NO: 487702 - RNA, 64 nt, Human; identical to SEQ ID NO: 378520

SEQ ID NO: 487703 - RNA, 64 nt, Human; identical to SEQ ID NO: 378521

SEQ ID NO: 487704 - RNA, 64 nt, Human; identical to SEQ ID NO: 378522

SEQ ID NO: 487705 - RNA, 64 nt, Human; identical to SEQ ID NO: 378523

SEQ ID NO: 487706 - RNA, 64 nt, Human
cucagcuuccuaaguagcuggguuuacaggcacccaccaccaugcccagcuaauuuuuguauuu

SEQ ID NO: 487707 - RNA, 64 nt, Human
augcccggagaucacccaggagaaauaauacaaacaccaccacuguccagagagaguaaagaag

SEQ ID NO: 487708 - RNA, 64 nt, Human
aggucagggguccuggaauaccccguagcucuggcaccaccacacuggccucugauggcaagac

SEQ ID NO: 487709 - RNA, 64 nt, Human; identical to SEQ ID NO: 378524

SEQ ID NO: 487710 - RNA, 64 nt, Human; identical to SEQ ID NO: 378525

SEQ ID NO: 487711 - RNA, 64 nt, Human; identical to SEQ ID NO: 378526

SEQ ID NO: 487712 - RNA, 64 nt, Human; identical to SEQ ID NO: 378527

SEQ ID NO: 487713 - RNA, 64 nt, Human; identical to SEQ ID NO: 378528

SEQ ID NO: 487714 - RNA, 64 nt, Human; identical to SEQ ID NO: 378529

SEQ ID NO: 487715 - RNA, 64 nt, Human; identical to SEQ ID NO: 378530

SEQ ID NO: 487716 - RNA, 64 nt, Human; identical to SEQ ID NO: 378531

SEQ ID NO: 487717 - RNA, 64 nt, Human; identical to SEQ ID NO: 378532

SEQ ID NO: 487718 - RNA, 64 nt, Human; identical to SEQ ID NO: 378533

SEQ ID NO: 487719 - RNA, 64 nt, Human; identical to SEQ ID NO: 378534

SEQ ID NO: 487720 - RNA, 64 nt, Human; identical to SEQ ID NO: 378535

SEQ ID NO: 487721 - RNA, 64 nt, Human; identical to SEQ ID NO: 378536

SEQ ID NO: 487722 - RNA, 64 nt, Human; identical to SEQ ID NO: 378537

SEQ ID NO: 487723 - RNA, 64 nt, Human; identical to SEQ ID NO: 378538

SEQ ID NO: 487724 - RNA, 64 nt, Human
aguggcugggagucuuuucccuaacuuguggggacaccaccaguugucaagcuacuaggcagua

SEQ ID NO: 487725 - RNA, 64 nt, Human
gugcugaggaaaggggaugcagagcccugcccagcaccaccaccuccuaugcuccuggaucccu

SEQ ID NO: 487726 - RNA, 64 nt, Human
aauuaaaaggacagugaguuuucgccuucccuuacaccaccaacuuuacuuuccaacauuuguu

SEQ ID NO: 487727 - RNA, 64 nt, Human; identical to SEQ ID NO: 378539

SEQ ID NO: 487728 - RNA, 64 nt, Human; identical to SEQ ID NO: 378540

SEQ ID NO: 487729 - RNA, 64 nt, Human; identical to SEQ ID NO: 378541

SEQ ID NO: 487730 - RNA, 64 nt, Human; identical to SEQ ID NO: 378542

SEQ ID NO: 487731 - RNA, 64 nt, Human; identical to SEQ ID NO: 378543

SEQ ID NO: 487732 - RNA, 64 nt, Human; identical to SEQ ID NO: 378544

SEQ ID NO: 487733 - RNA, 64 nt, Human; identical to SEQ ID NO: 378545

SEQ ID NO: 487734 - RNA, 64 nt, Human; identical to SEQ ID NO: 378546

SEQ ID NO: 487735 - RNA, 64 nt, Human; identical to SEQ ID NO: 378547

SEQ ID NO: 487736 - RNA, 64 nt, Human; identical to SEQ ID NO: 378548

SEQ ID NO: 487737 - RNA, 64 nt, Human; identical to SEQ ID NO: 378549

SEQ ID NO: 487738 - RNA, 64 nt, Human; identical to SEQ ID NO: 378550

SEQ ID NO: 487739 - RNA, 64 nt, Human; identical to SEQ ID NO: 378551

SEQ ID NO: 487740 - RNA, 64 nt, Human; identical to SEQ ID NO: 378552

SEQ ID NO: 487741 - RNA, 64 nt, Human; identical to SEQ ID NO: 378553

SEQ ID NO: 487742 - RNA, 64 nt, Human
gugguuuugaguuacuucauggaacuuggacauacaccaccagguccuuuauguguuguucucc

SEQ ID NO: 487743 - RNA, 64 nt, Human
cucagccucccgaguagcugggacuacgggcacgcaccaccacgucuggcuaauuuuuguauuu

SEQ ID NO: 487744 - RNA, 64 nt, Human
uugaaacauuuccgaguuaauuucccauaggcuucaccaccaagaaaguaagaauugcaucuuu

SEQ ID NO: 487745 - RNA, 64 nt, Human; identical to SEQ ID NO: 378554

SEQ ID NO: 487746 - RNA, 64 nt, Human; identical to SEQ ID NO: 378555

SEQ ID NO: 487747 - RNA, 64 nt, Human; identical to SEQ ID NO: 378556

SEQ ID NO: 487748 - RNA, 64 nt, Human; identical to SEQ ID NO: 378557

SEQ ID NO: 487749 - RNA, 64 nt, Human; identical to SEQ ID NO: 378558

SEQ ID NO: 487750 - RNA, 64 nt, Human; identical to SEQ ID NO: 378559

SEQ ID NO: 487751 - RNA, 64 nt, Human; identical to SEQ ID NO: 378560

SEQ ID NO: 487752 - RNA, 64 nt, Human; identical to SEQ ID NO: 378561

SEQ ID NO: 487753 - RNA, 64 nt, Human; identical to SEQ ID NO: 378562

SEQ ID NO: 487754 - RNA, 64 nt, Human; identical to SEQ ID NO: 378563

SEQ ID NO: 487755 - RNA, 64 nt, Human; identical to SEQ ID NO: 378564

SEQ ID NO: 487756 - RNA, 64 nt, Human; identical to SEQ ID NO: 378565

SEQ ID NO: 487757 - RNA, 64 nt, Human; identical to SEQ ID NO: 378566

SEQ ID NO: 487758 - RNA, 64 nt, Human; identical to SEQ ID NO: 378567

SEQ ID NO: 487759 - RNA, 64 nt, Human; identical to SEQ ID NO: 378568

SEQ ID NO: 487760 - RNA, 64 nt, Human
auuacucuauauaagcagucuugcaauaacuaaucaccaccauagaagaaagaaacagacugca

SEQ ID NO: 487761 - RNA, 64 nt, Human
guuuguccacacaagacagcagagccaucugcgacaccaccaacaggcguucucagccuccgga

SEQ ID NO: 487762 - RNA, 64 nt, Human
cucagccuccugaauagcugggguuacaggugcgcaccaccacgcccggcuaauuuuuguauuu

SEQ ID NO: 487763 - RNA, 64 nt, Human; identical to SEQ ID NO: 378569

SEQ ID NO: 487764 - RNA, 64 nt, Human; identical to SEQ ID NO: 378570

SEQ ID NO: 487765 - RNA, 64 nt, Human; identical to SEQ ID NO: 378571

SEQ ID NO: 487766 - RNA, 64 nt, Human; identical to SEQ ID NO: 378572

SEQ ID NO: 487767 - RNA, 64 nt, Human; identical to SEQ ID NO: 378573

SEQ ID NO: 487768 - RNA, 64 nt, Human; identical to SEQ ID NO: 378574

SEQ ID NO: 487769 - RNA, 64 nt, Human; identical to SEQ ID NO: 378575

SEQ ID NO: 487770 - RNA, 64 nt, Human; identical to SEQ ID NO: 378576

SEQ ID NO: 487771 - RNA, 64 nt, Human; identical to SEQ ID NO: 378577

SEQ ID NO: 487772 - RNA, 64 nt, Human; identical to SEQ ID NO: 378578

SEQ ID NO: 487773 - RNA, 64 nt, Human; identical to SEQ ID NO: 378579

SEQ ID NO: 487774 - RNA, 64 nt, Human; identical to SEQ ID NO: 378580

SEQ ID NO: 487775 - RNA, 64 nt, Human; identical to SEQ ID NO: 378581

SEQ ID NO: 487776 - RNA, 64 nt, Human; identical to SEQ ID NO: 378582

SEQ ID NO: 487777 - RNA, 64 nt, Human; identical to SEQ ID NO: 378583

SEQ ID NO: 487778 - RNA, 64 nt, Human
uucagacaucugcaugagugacaaacuuucugaacaccaccaccaccaauaauacuuaucagca

SEQ ID NO: 487779 - RNA, 64 nt, Human
agacaucugcaugagugacaaacuuucugaacaccaccaccaccaauaauacuuaucagcauca

SEQ ID NO: 487780 - RNA, 64 nt, Human
caucugcaugagugacaaacuuucugaacaccaccaccaccaauaauacuuaucagcaucauaa

SEQ ID NO: 487781 - RNA, 64 nt, Human; identical to SEQ ID NO: 378584

SEQ ID NO: 487782 - RNA, 64 nt, Human; identical to SEQ ID NO: 378585

SEQ ID NO: 487783 - RNA, 64 nt, Human; identical to SEQ ID NO: 378586

SEQ ID NO: 487784 - RNA, 64 nt, Human; identical to SEQ ID NO: 378587

SEQ ID NO: 487785 - RNA, 64 nt, Human; identical to SEQ ID NO: 378588

SEQ ID NO: 487786 - RNA, 64 nt, Human; identical to SEQ ID NO: 378589

SEQ ID NO: 487787 - RNA, 64 nt, Human; identical to SEQ ID NO: 378590

SEQ ID NO: 487788 - RNA, 64 nt, Human; identical to SEQ ID NO: 378591

SEQ ID NO: 487789 - RNA, 64 nt, Human; identical to SEQ ID NO: 378592

SEQ ID NO: 487790 - RNA, 64 nt, Human; identical to SEQ ID NO: 378593

SEQ ID NO: 487791 - RNA, 64 nt, Human; identical to SEQ ID NO: 378594

SEQ ID NO: 487792 - RNA, 64 nt, Human; identical to SEQ ID NO: 378595

SEQ ID NO: 487793 - RNA, 64 nt, Human; identical to SEQ ID NO: 378596

SEQ ID NO: 487794 - RNA, 64 nt, Human; identical to SEQ ID NO: 378597

SEQ ID NO: 487795 - RNA, 64 nt, Human; identical to SEQ ID NO: 378598

SEQ ID NO: 487796 - RNA, 64 nt, Human
ccaggaguguuuccaguuccacccuuuccuggggcaccaccacccuuuuuauauugcugaauuc

SEQ ID NO: 487797 - RNA, 64 nt, Human
cucagccuccugaguagcugggacuacaagugugcaccaccaugccuggcuaauuuuuugaauu

SEQ ID NO: 487798 - RNA, 64 nt, Human
cuccgccucccaaguagcugggauuacaggcaugcaccaccacaccuggcuaguuuuuguauuu

SEQ ID NO: 487799 - RNA, 64 nt, Human; identical to SEQ ID NO: 378599

SEQ ID NO: 487800 - RNA, 64 nt, Human; identical to SEQ ID NO: 378600

SEQ ID NO: 487801 - RNA, 64 nt, Human; identical to SEQ ID NO: 378601

SEQ ID NO: 487802 - RNA, 64 nt, Human; identical to SEQ ID NO: 378602

SEQ ID NO: 487803 - RNA, 64 nt, Human; identical to SEQ ID NO: 378603

SEQ ID NO: 487804 - RNA, 64 nt, Human; identical to SEQ ID NO: 378604

SEQ ID NO: 487805 - RNA, 64 nt, Human; identical to SEQ ID NO: 378605

SEQ ID NO: 487806 - RNA, 64 nt, Human; identical to SEQ ID NO: 378606

SEQ ID NO: 487807 - RNA, 64 nt, Human; identical to SEQ ID NO: 378607

SEQ ID NO: 487808 - RNA, 64 nt, Human; identical to SEQ ID NO: 378608

SEQ ID NO: 487809 - RNA, 64 nt, Human; identical to SEQ ID NO: 378609

SEQ ID NO: 487810 - RNA, 64 nt, Human; identical to SEQ ID NO: 378610

SEQ ID NO: 487811 - RNA, 64 nt, Human; identical to SEQ ID NO: 378611

SEQ ID NO: 487812 - RNA, 64 nt, Human; identical to SEQ ID NO: 378612

SEQ ID NO: 487813 - RNA, 64 nt, Human; identical to SEQ ID NO: 378613

SEQ ID NO: 487814 - RNA, 64 nt, Human
auucagcagcacauucugaggggggaacaauucacaccaccaauaauaaccugguaagauuuca

SEQ ID NO: 487815 - RNA, 64 nt, Human
guaaaaaguauagauaauuuaauuaacuuagugacaccaccaaguguuuugauauaacuaaauu

SEQ ID NO: 487816 - RNA, 64 nt, Human
ucaagccucccgaauagcugggacuacaggcgcacaccaccauccccggcuaauuuuuguauuu

SEQ ID NO: 487817 - RNA, 64 nt, Human; identical to SEQ ID NO: 378614

SEQ ID NO: 487818 - RNA, 64 nt, Human; identical to SEQ ID NO: 378615

SEQ ID NO: 487819 - RNA, 64 nt, Human; identical to SEQ ID NO: 378616

SEQ ID NO: 487820 - RNA, 64 nt, Human; identical to SEQ ID NO: 378617

SEQ ID NO: 487821 - RNA, 64 nt, Human; identical to SEQ ID NO: 378618

SEQ ID NO: 487822 - RNA, 64 nt, Human; identical to SEQ ID NO: 378619

SEQ ID NO: 487823 - RNA, 64 nt, Human; identical to SEQ ID NO: 378620

SEQ ID NO: 487824 - RNA, 64 nt, Human; identical to SEQ ID NO: 378621

SEQ ID NO: 487825 - RNA, 64 nt, Human; identical to SEQ ID NO: 378622

SEQ ID NO: 487826 - RNA, 64 nt, Human; identical to SEQ ID NO: 378623

SEQ ID NO: 487827 - RNA, 64 nt, Human; identical to SEQ ID NO: 378624

SEQ ID NO: 487828 - RNA, 64 nt, Human; identical to SEQ ID NO: 378625

SEQ ID NO: 487829 - RNA, 64 nt, Human; identical to SEQ ID NO: 378626

SEQ ID NO: 487830 - RNA, 64 nt, Human; identical to SEQ ID NO: 378627

SEQ ID NO: 487831 - RNA, 64 nt, Human; identical to SEQ ID NO: 378628

SEQ ID NO: 487832 - RNA, 64 nt, Human
cuaucuugagcccuauaaaugcccacgggacccccaccaccagccucuugaaguggcuccacag

SEQ ID NO: 487833 - RNA, 64 nt, Human
gagugaggaacugaauuuggcuccucagccccagcaccaccagcugugggcagucaguagcaga

SEQ ID NO: 487834 - RNA, 64 nt, Human
ccccgcuccacaagacaccugugcuuuggaaauccaccaccaaucccgaucggcucuuauuagc

SEQ ID NO: 487835 - RNA, 64 nt, Human; identical to SEQ ID NO: 378629

SEQ ID NO: 487836 - RNA, 64 nt, Human; identical to SEQ ID NO: 378630

SEQ ID NO: 487837 - RNA, 64 nt, Human; identical to SEQ ID NO: 378631

SEQ ID NO: 487838 - RNA, 64 nt, Human; identical to SEQ ID NO: 378632

SEQ ID NO: 487839 - RNA, 64 nt, Human; identical to SEQ ID NO: 378633

SEQ ID NO: 487840 - RNA, 64 nt, Human; identical to SEQ ID NO: 378634

SEQ ID NO: 487841 - RNA, 64 nt, Human; identical to SEQ ID NO: 378635

SEQ ID NO: 487842 - RNA, 64 nt, Human; identical to SEQ ID NO: 378636

SEQ ID NO: 487843 - RNA, 64 nt, Human; identical to SEQ ID NO: 378637

SEQ ID NO: 487844 - RNA, 64 nt, Human; identical to SEQ ID NO: 378638

SEQ ID NO: 487845 - RNA, 64 nt, Human; identical to SEQ ID NO: 378639

SEQ ID NO: 487846 - RNA, 64 nt, Human; identical to SEQ ID NO: 378640

SEQ ID NO: 487847 - RNA, 64 nt, Human; identical to SEQ ID NO: 378641

SEQ ID NO: 487848 - RNA, 64 nt, Human; identical to SEQ ID NO: 378642

SEQ ID NO: 487849 - RNA, 64 nt, Human; identical to SEQ ID NO: 378643

SEQ ID NO: 487850 - RNA, 64 nt, Human
cucagccuccugaguagcugggauuauaggcaugcaccaccacacccagcuauuuuuuguauuu

SEQ ID NO: 487851 - RNA, 64 nt, Human
aguaggcgcuggccacccggcccugccuucccaccaccaccaccgugcauggggcagcaaacac

SEQ ID NO: 487852 - RNA, 64 nt, Human
gcaaguaggcgcuggccacccggcccugccuucccaccaccaccaccgugcauggggcagcaaa

SEQ ID NO: 487853 - RNA, 64 nt, Human; identical to SEQ ID NO: 378644

SEQ ID NO: 487854 - RNA, 64 nt, Human; identical to SEQ ID NO: 378645

SEQ ID NO: 487855 - RNA, 64 nt, Human; identical to SEQ ID NO: 378646

SEQ ID NO: 487856 - RNA, 64 nt, Human; identical to SEQ ID NO: 378647

SEQ ID NO: 487857 - RNA, 64 nt, Human; identical to SEQ ID NO: 378648

SEQ ID NO: 487858 - RNA, 64 nt, Human; identical to SEQ ID NO: 378649

SEQ ID NO: 487859 - RNA, 64 nt, Human; identical to SEQ ID NO: 378650

SEQ ID NO: 487860 - RNA, 64 nt, Human; identical to SEQ ID NO: 378651

SEQ ID NO: 487861 - RNA, 64 nt, Human; identical to SEQ ID NO: 378652

SEQ ID NO: 487862 - RNA, 64 nt, Human; identical to SEQ ID NO: 378653

SEQ ID NO: 487863 - RNA, 64 nt, Human; identical to SEQ ID NO: 378654

SEQ ID NO: 487864 - RNA, 64 nt, Human; identical to SEQ ID NO: 378655

SEQ ID NO: 487865 - RNA, 64 nt, Human; identical to SEQ ID NO: 378656

SEQ ID NO: 487866 - RNA, 64 nt, Human; identical to SEQ ID NO: 378657

SEQ ID NO: 487867 - RNA, 64 nt, Human; identical to SEQ ID NO: 378658

SEQ ID NO: 487868 - RNA, 64 nt, Human
cugugcucacaauccagagcaauggauccuccaacaccaccagguggauguggagcaggagagc

SEQ ID NO: 487869 - RNA, 64 nt, Human
cucagccuccugaguagcugggacuacaggcgcccaccaccacacauggcuaauuuuuguauuu

SEQ ID NO: 487870 - RNA, 64 nt, Human
aagacuauccuuaccuuuuaguuucagcaguccucaccaccaccauauccccagugcugggaug

SEQ ID NO: 487871 - RNA, 64 nt, Human; identical to SEQ ID NO: 378659

SEQ ID NO: 487872 - RNA, 64 nt, Human; identical to SEQ ID NO: 378660

SEQ ID NO: 487873 - RNA, 64 nt, Human; identical to SEQ ID NO: 378661

SEQ ID NO: 487874 - RNA, 59 nt, Human; identical to SEQ ID NO: 378662

SEQ ID NO: 487875 - RNA, 64 nt, Human; identical to SEQ ID NO: 378663

SEQ ID NO: 487876 - RNA, 64 nt, Human; identical to SEQ ID NO: 378664

SEQ ID NO: 487877 - RNA, 64 nt, Human; identical to SEQ ID NO: 378665

SEQ ID NO: 487878 - RNA, 64 nt, Human; identical to SEQ ID NO: 378666

SEQ ID NO: 487879 - RNA, 64 nt, Human; identical to SEQ ID NO: 378667

SEQ ID NO: 487880 - RNA, 64 nt, Human; identical to SEQ ID NO: 378668

SEQ ID NO: 487881 - RNA, 64 nt, Human; identical to SEQ ID NO: 378669

SEQ ID NO: 487882 - RNA, 64 nt, Human; identical to SEQ ID NO: 378670

SEQ ID NO: 487883 - RNA, 64 nt, Human; identical to SEQ ID NO: 378671

SEQ ID NO: 487884 - RNA, 64 nt, Human
augucuuuauuuaguuguuuauuuauuuaguuauuuaucuuauuuauugaggggugaggagugc

SEQ ID NO: 487885 - RNA, 64 nt, Human
ugauuucccaccuuccagugaaauucugaaagucuuaucuuaaaaaucgauccgcuuaccaugg

SEQ ID NO: 487886 - RNA, 64 nt, Human
cugcaccccaaauaugaacaacugcagcaggugccaccaccaccacaaaagacaccacuacccu

SEQ ID NO: 487887 - RNA, 64 nt, Human
caccccaaauaugaacaacugcagcaggugccaccaccaccacaaaagacaccacuacccuugu

SEQ ID NO: 487888 - RNA, 64 nt, Human
aaagcacuaucauuaaucuuucaaucuaauuauucaccaccacaagaccuauuaacaagacaaa

SEQ ID NO: 487889 - RNA, 64 nt, Human
uaaacuuguagcauauguaaaguuuucuuggccuuuaucuuacaaaaauggaguauuuuaguau

SEQ ID NO: 487890 - RNA, 64 nt, Human
aagauuaggaucaaggauagacaagguauaguaguuaucuuaaaauauacacuccuaagcagua

SEQ ID NO: 487891 - RNA, 64 nt, Human
gaaaguuuuacagaguuuuauuaguuuuacuacuuuaucuuauugaucucugcagacuugugcu

SEQ ID NO: 487892 - RNA, 64 nt, Human
ugcacuaugaaaaucaguuauauucuuuaaauuuuuaucuuacuuuuggauaauauccacugca

SEQ ID NO: 487893 - RNA, 64 nt, Human
gauuuuuaucuugagauuucccugaauaauauauuuaucuuaagagccuucaaguuucaaauua

SEQ ID NO: 487894 - RNA, 64 nt, Human
auccuuaagagaaagcuugagaaauagauuuuuuuuaucuuaaagucacugucuauuuaagauu

SEQ ID NO: 487895 - RNA, 64 nt, Human
gacuaaaaggugguaucucuucuuaguguucuauuuaucuuauuugcuaaugggagcacuucuu

SEQ ID NO: 487896 - RNA, 64 nt, Human
uuuugcaaauuagauuuaaucuuauuaaauguuuuuaucuuacucuuucuguacagauauauca

SEQ ID NO: 487897 - RNA, 64 nt, Human
uauuacacuaaaauugggauacaucuaaggaacuuuaucuuacuaucaguagguuuugcauuga

SEQ ID NO: 487898 - RNA, 64 nt, Human
acacuucauuauuuauaaagaauuuacuaacaguuuaucuuauuuauacccauacaucugcuac

SEQ ID NO: 487899 - RNA, 64 nt, Human
aucauuaucacuacccauuuaguagcuaugguuguuaucuuacuucuacaguggaagagauuga

SEQ ID NO: 487900 - RNA, 64 nt, Human
uucgaacaccaaaaaugaugcgcaucaauguauuuuaucuuauuuucucaaucuccucucucuu

SEQ ID NO: 487901 - RNA, 64 nt, Human
gguguuauacagggcgauuuuuggugccuuacuuuuaucuuaauuuuugccaaugugaaaauua

SEQ ID NO: 487902 - RNA, 64 nt, Human
cagccuuuuaccuaagaaauuuucugucagugccuuaucuuaugaagaaacagaaccucucuag

SEQ ID NO: 487903 - RNA, 64 nt, Human
cagcuuuucaccuuacuucuccugugaucuaauauuaucuuagaaaaauuaauaugcaauuucc

SEQ ID NO: 487904 - RNA, 64 nt, Human
uuuuuauuuaugagucuuugagacuaaauucaaucaccaccagguaucaaaucaacuuuuaugc

SEQ ID NO: 487905 - RNA, 64 nt, Human
cauuacauagucaugugcgaggucaaaacugagucaccaccacaaccaaguuccagcuggcaag

SEQ ID NO: 487906 - RNA, 64 nt, Human
cucagccucccucagagcugggacuacaggcgugcaccaccacgccugguuaauuguuuuuuuu

SEQ ID NO: 487907 - RNA, 64 nt, Human
acucuaagauuugauaagggccacaucccaguguuuaucuuagcuugcaucagggcauguguau

SEQ ID NO: 487908 - RNA, 64 nt, Human
ccucuuccuugauguuuggggucuuugugguagcuuaucuuagaagcacuacaccuugccuugc

SEQ ID NO: 487909 - RNA, 64 nt, Human
uguuucauaucauaucacaguuugcauggacugauuaucuuaguuuuaugauaaaacuagaaga

SEQ ID NO: 487910 - RNA, 64 nt, Human
uuuaugagucuuggcuuugaaguggagaagggcuuuaucuuagagaaggugguuuaugucauau

SEQ ID NO: 487911 - RNA, 64 nt, Human
ccaaauuuauuaaggugguggagccacugcaguguuaucuuaaaauaagaauauuuuguugaga

SEQ ID NO: 487912 - RNA, 64 nt, Human
uaacuuuuuuuucugccuuacgauauaaaaauauuuaucuuagaauuugagauguucauagcau

SEQ ID NO: 487913 - RNA, 64 nt, Human
cauuaggagaccccucuauugaguucuaaauaguuuaucuuagaaagccuugggucauucacag

SEQ ID NO: 487914 - RNA, 64 nt, Human
aaacauuaccucugaaauguguaucuuuucuuuuuuaucuuaccauuaauuuuaaaucuagugg

SEQ ID NO: 487915 - RNA, 64 nt, Human
uuuauugaaaauggugauauagaccucagagcuguuaucuuaguuuaaagauuguauauguacu

SEQ ID NO: 487916 - RNA, 64 nt, Human
ccacacuccucuaauuuaaacaaguagugaaggcuuaucuuaaacuguguaguaccuuagacuu

SEQ ID NO: 487917 - RNA, 64 nt, Human
cuagauuuuaagauuauggagacugcugucauuuuuaucuuauuuaaaucucuagguuuauugg

SEQ ID NO: 487918 - RNA, 64 nt, Human
uauguaaugcuuuauguuuaaaaacauuccccaauuaucuuauuuaauuuuugcaauuauucua

SEQ ID NO: 487919 - RNA, 64 nt, Human
aauuaccaagcagccgaagaccacccacgaaugguuaucuuacgacuguuacguuacauugucc

SEQ ID NO: 487920 - RNA, 64 nt, Human
aguuguucuuggguucuuggaucuggacuacuuguuaucuuaugcuucucacuucuggcuaaaa

SEQ ID NO: 487921 - RNA, 64 nt, Human
uuggcugcuaugcgugguuuuucaggaaauuuaauuaucuuacugagaugugaaagcaaaacua

SEQ ID NO: 487922 - RNA, 64 nt, Human
cgugcacuuggugcugcgcccagggaggaagccgcaccaccagccagcgcaggcccugguggag

SEQ ID NO: 487923 - RNA, 64 nt, Human
auucuucuaccuuuaaauagcaaaguaccacuaccaccaccaccucuugcccccuucccucuuu

SEQ ID NO: 487924 - RNA, 64 nt, Human
cccaggaggcggagguugcagugagcugagaugccaccaccacaccagccugggugacagagug

SEQ ID NO: 487925 - RNA, 64 nt, Human
cagagagcuccccuuagugaucucaguucaaauauuaucuuaucaguaagacaaacccuucucc

SEQ ID NO: 487926 - RNA, 64 nt, Human
ucgaaaaccuuaagugaaaaagauuucuaucuuuuuaucuuagcgcauuuauggaaaaaauauu

SEQ ID NO: 487927 - RNA, 64 nt, Human
agaauguuacauuuaugaugggaaugaaugaacauuaucuuagacuugcaguuguacugccaga

SEQ ID NO: 487928 - RNA, 64 nt, Human
uuuuaaugagcuauuguuaaaccaacaggcuaguuuaucuuacaucagacccuuuucugguaga

SEQ ID NO: 487929 - RNA, 64 nt, Human
uugaggucuaacugaucuuuuccugccagaagaguuaucuuacguucugcuauauuuguauuug

SEQ ID NO: 487930 - RNA, 64 nt, Human
agugagacccgauaugucauuaugcauacuuauauuaucuuaagcauguguaaugcuggaugug

SEQ ID NO: 487931 - RNA, 64 nt, Human
cauacacagauauguaguacauauuuuaaaaguuuuaucuuaaauugauuaaaacuuuuuaaaa

SEQ ID NO: 487932 - RNA, 64 nt, Human
ggauggugaagggaaugguauagaauuggagagauuaucuuacugaacaccuguagucccagcu

SEQ ID NO: 487933 - RNA, 64 nt, Human
uauagauagguccuaaacauugcuguucacuagauuaucuuaacaaauaauacucagcuaaaua

SEQ ID NO: 487934 - RNA, 64 nt, Human
uaauuaggacuucauuccuccauguuuucuucccuuaucuuacugucauuguccuaaaaccuua

SEQ ID NO: 487935 - RNA, 64 nt, Human
auaacuguacuaguuacuaugaaaauggaaauaauuaucuuagaauauuuucaaaguagagcgu

SEQ ID NO: 487936 - RNA, 64 nt, Human
aaguaaucccucuucugaauccacaccccaucaauuaucuuacuuucuucuggggagauagaua

SEQ ID NO: 487937 - RNA, 64 nt, Human
uccugcaguucccagcccucggagcccccaucccuuaucuuacccccaccgcgcucccccagga

SEQ ID NO: 487938 - RNA, 64 nt, Human
cuuucaauucuguagcauacuuggagaaacugcauuaucuuaaaaggcagucaaaugguguuug

SEQ ID NO: 487939 - RNA, 64 nt, Human
uguauauacauuuaugaauuaaaguaauuguugguuaucuuaaaacaucuguucuaguuaauga

SEQ ID NO: 487940 - RNA, 64 nt, Human
gccaccacgccuggccagaguuuuuuauuuuuaucaccaccauagauguuacaguuggcugugg

SEQ ID NO: 487941 - RNA, 64 nt, Human
ucaagcuucccaaguagcugcaacaacaggcacacaccaccaugcucaacuaauuuuauuucua

SEQ ID NO: 487942 - RNA, 64 nt, Human
cucagccuccugaguagcugggauuacaggcaugcaccaccacaccaggcuaauuuuguauuuu

SEQ ID NO: 487943 - RNA, 64 nt, Human
uguagacuuuuguugugcucaaauaaauguuuacuuaucuuacaaagcucaaauacuggauugu

SEQ ID NO: 487944 - RNA, 64 nt, Human
acucaacugaguuagcauugucuuugugguagcauuaucuuagacauuaaauuugaaguaacau

SEQ ID NO: 487945 - RNA, 64 nt, Human
agauuuuuuaauguaacaaacuacauguuaauuguuaucuuauucuuuuuaucuuuaguagaca

SEQ ID NO: 487946 - RNA, 64 nt, Human
aggagaaaagcuggacauauacugggcuucacacuuaucuuauggcuuggcagaaucuuuguag

SEQ ID NO: 487947 - RNA, 64 nt, Human
uguuucuaauaagauaaacuuuuuugucuuugcuuuaucuuauuagggaguuguaugucagugu

SEQ ID NO: 487948 - RNA, 64 nt, Human
cuuuaggcuaguuagugcauuuuuuagcaaacauuuaucuuaaacaucacagauccacuggggg

SEQ ID NO: 487949 - RNA, 64 nt, Human
gcugguaguuggauuauauuuuuauuguauucauuuaucuuagggggaacauuguaaagaaaca

SEQ ID NO: 487950 - RNA, 64 nt, Human
cugcugguuucacagaaguuuggaugccuuacucuuaucuuaaagccagcauccagaauuuccu

SEQ ID NO: 487951 - RNA, 64 nt, Human
uaaaagaauuacggcuuuuacagcaacaauacgauuaucuuauaggaaaaaaaaaaucauugua

SEQ ID NO: 487952 - RNA, 64 nt, Human
aaagaugaauucacauaugaaaaagggggccaccuuaucuuaguuccagaauuuagucuuccuu

SEQ ID NO: 487953 - RNA, 64 nt, Human
auuagguauauaucuuagggauacagccuuuucuuuaucuuauagcaggaaaaaaaaacuuuug

SEQ ID NO: 487954 - RNA, 64 nt, Human
aaaauuaacucuucaaaagccguuaaacagagaguuaucuuaauuuuuauugcaguaggaggaa

SEQ ID NO: 487955 - RNA, 64 nt, Human
aucaguaacccccuuaaauuuaauaccagauaccuuaucuuacaauauugauugggaaaacauu

SEQ ID NO: 487956 - RNA, 64 nt, Human
acagggucaugaguuuccgaguauaguuuucuuuuuaucuuauuuuuacucguccguugaaaag

SEQ ID NO: 487957 - RNA, 64 nt, Human
uuguguauaaguuguauuauuagacucucuaguuuuaucuuaaacuguucuucauuagauguuu

SEQ ID NO: 487958 - RNA, 64 nt, Human
ugauauuuagccuaucaaaacuuccaaaagcccacaccaccaguuccugacucaaauuugaagg

SEQ ID NO: 487959 - RNA, 64 nt, Human
ugcacaaccaccaugugucuucuaggugcuggcccaccaccacacaucacaggcugauuuccac

SEQ ID NO: 487960 - RNA, 64 nt, Human
uaggugaagugggauuuacccauuaccauauauucaccaccaggucacugacgagagacuccag

SEQ ID NO: 487961 - RNA, 64 nt, Human
uuuccagguguuuucaggggucaaaguuuuuaaguuaucuuagucuuugauauuguguaagcga

SEQ ID NO: 487962 - RNA, 64 nt, Human
guaaauaguuggugcuuacuuucauuuauguuuauuaucuuaaagcaauugauagauuuuacau

SEQ ID NO: 487963 - RNA, 64 nt, Human
acaauguucgccauucacuagauauuuuuuucuauuaucuuacacuuauucaagcuugucugug

SEQ ID NO: 487964 - RNA, 64 nt, Human
auuuuggaaaaagagagggggaaaaguagaucacuuaucuuagcaaacgguugaaaauaugucu

SEQ ID NO: 487965 - RNA, 64 nt, Human
guuugagcgucagugauauucucccagaauguacuuaucuuaccucggcauguacuguagucac

SEQ ID NO: 487966 - RNA, 64 nt, Human
acauacagcccauaacuuuauaauggcugcucauuuaucuuaucuuucaguuaguggaaaaaca

SEQ ID NO: 487967 - RNA, 64 nt, Human
ggacucgauucuuuuuuacuacauauuucccaaguuaucuuaagaugucuguaaauuuaacuuu

SEQ ID NO: 487968 - RNA, 64 nt, Human
ggcuggcuaauagacacugaaucacccggagugcuuaucuuaaaauugcagauuuagggagccu

SEQ ID NO: 487969 - RNA, 64 nt, Human
uaugccuaaucuguucaauuguuuuagaaucuuuuuaucuuagauguaggcagccaugaacaau

SEQ ID NO: 487970 - RNA, 64 nt, Human
gaaauaaaucucaaaugcagcgcuacaauuuucauuaucuuaaguacauuguacauuucuacag

SEQ ID NO: 487971 - RNA, 64 nt, Human
uaucugaguuauuuaccuucauaguuauuucacuuuaucuuauuggaguuuuugaguuauuuau

SEQ ID NO: 487972 - RNA, 64 nt, Human
ccccugcacaauaaaacuuggccuccacaauccuuuaucuuaaccugaacauuccuuuccauug

SEQ ID NO: 487973 - RNA, 64 nt, Human
uaaaauaaucaguaaaguuagauuuuauccauuuuuaucuuaacuauugagaugcucauaucau

SEQ ID NO: 487974 - RNA, 64 nt, Human
ccaauauauaagaauguaauuuauuuuuacauaauuaucuuaugucuaguaauaauucugauaa

SEQ ID NO: 487975 - RNA, 64 nt, Human
ugcuuccuuuagauaaaaagcagcucaagagaccuuaucuuagggaugagaaaaacaugcauau

SEQ ID NO: 487976 - RNA, 64 nt, Human
cuuacaggugaguacucauaauuggccagcaucucaccaccagcaaguaguagggccaggucaa

SEQ ID NO: 487977 - RNA, 64 nt, Human
cucagccucaugaauagcugggauuacaggugcccaccaccaugccuggcuaguuuuuguauuu

SEQ ID NO: 487978 - RNA, 64 nt, Human
cucagccucucgaguagcugggauuacaggcaugcaccaccacacccagcuaauuuuguauuuu

SEQ ID NO: 487979 - RNA, 64 nt, Human
auauuauaaaagguuugcuuucuuuaaguguuauuuaucuuaaauuauaaucguuaaauguuug

SEQ ID NO: 487980 - RNA, 64 nt, Human
auuaaaaagcuuuuuuucuccaguauuuucuguauuaucuuaauguuuauggcaaauaaaaugu

SEQ ID NO: 487981 - RNA, 64 nt, Human
guugugccuaaggguggcugaaauacuaaaacacuuaucuuacagcaagugaacaggggcuacc

SEQ ID NO: 487982 - RNA, 64 nt, Human
guuuucauaaccaugauauuguuuugaaaaaauuuuaucuuaaaauacugaauguucugaccuu

SEQ ID NO: 487983 - RNA, 64 nt, Human
gaauuagaauuaaacauuguaccauacaauuucauuaucuuaucagaaugaaaccaauucacag

SEQ ID NO: 487984 - RNA, 64 nt, Human
aaaugguagacacugauagcuacuuuguuuuuaguuaucuuagggucucuaccaaguagacaca

SEQ ID NO: 487985 - RNA, 64 nt, Human
aacuuuucacauaaagagaaugcaucuuugacaguuaucuuauuuguaaggcagccuauaaaau

SEQ ID NO: 487986 - RNA, 64 nt, Human
agaaccauucucuauacacuugauaaggguaaauuuaucuuaguguuuuuaaacuugguuuugg

SEQ ID NO: 487987 - RNA, 64 nt, Human
uuuauuguaagcaucucaaucuugguuugucaguuuaucuuaagcaugucaauucauaaaaaca

SEQ ID NO: 487988 - RNA, 64 nt, Human
aggugacagcuucccauaacaauucuaacacuucuuaucuuaugugagaauaaaauauuuaagg

SEQ ID NO: 487989 - RNA, 64 nt, Human
acuuuucaagauuuuuaaaaauaacuaguguagcuuaucuuaaacauuuuauaaaaccuucaga

SEQ ID NO: 487990 - RNA, 64 nt, Human
uaaucauuuuaauaaaguucugcaaaauacacguuuaucuuacauucagaaauguggcaaaaaa

SEQ ID NO: 487991 - RNA, 64 nt, Human
gcuuguaggcuacauuaaacucaaauguaauaguuuaucuuauacuccugguuugauuugauua

SEQ ID NO: 487992 - RNA, 64 nt, Human
aaagaauuuuauuugacccagauuucuuauaaaguuaucuuacauuaaggaugucauuuucauc

SEQ ID NO: 487993 - RNA, 64 nt, Human
aacgauaaauacuuuccaagguuauauuguuaaauuaucuuaaauuaucaagguguaagaugua

SEQ ID NO: 487994 - RNA, 64 nt, Human
cucagccuccugaguagcugggacuacaggcacgcaccaccaugccaggcuaauuuuuuuguau

SEQ ID NO: 487995 - RNA, 64 nt, Human
cucagccuccugaguagcuggaauuacaggcacccaccaccacacccagcucauuuuuguauuu

SEQ ID NO: 487996 - RNA, 64 nt, Human
cucugccucccaaguagcugggauuacaggcacccaccaccaugcccagcuaauuuuuuguauu

SEQ ID NO: 487997 - RNA, 64 nt, Human
agguguucucuggaccuauucuaaccacuuaaaauuaucuuaaguaugcauacauaaaagcaac

SEQ ID NO: 487998 - RNA, 64 nt, Human
agucacaguguaaaguuagauguugaaacccaguuuaucuuauacaaaugagccucugcuuguu

SEQ ID NO: 487999 - RNA, 64 nt, Human
caaaacaaaaaaacaaggcugccacaguggaauauuaucuuacaagaauaagaacuacauaaaa

SEQ ID NO: 488000 - RNA, 64 nt, Human
cucagcuguuguuagaaggacagaauguuaaacuuuaucuuaauuaguauacuagaaagggcag

SEQ ID NO: 488001 - RNA, 64 nt, Human
cugccucuuaaauaaaccuuuuuggacacacaaauuaucuuaaaacuccuguuucacuugguuc

SEQ ID NO: 488002 - RNA, 64 nt, Human
ugaauuauuucucaugcucauuuucuugcggcaguuaucuuagaaagacccccaaaggcuuugu

SEQ ID NO: 488003 - RNA, 64 nt, Human
aaauacuuugucuggagcacaaaacaauaaaagguuaucuuauagucgugacuuuaaacuuuug

SEQ ID NO: 488004 - RNA, 64 nt, Human
caaauauaaaauucaucauaaugucuguucaacauuaucuuauuuggaaaauggggaaauuauc

SEQ ID NO: 488005 - RNA, 64 nt, Human
auaaaaauuuauuuauuuaagauacuuauucgacuuaucuuaacuaagguagcuaugaauguua

SEQ ID NO: 488006 - RNA, 64 nt, Human
aacacauccuauuuauugugauguugugguuuuauuaucuuaaacucuguuccauacacuugua

SEQ ID NO: 488007 - RNA, 64 nt, Human
ggguucauuuugcuuccuuuucuuuaugcuuagauuaucuuacugguucaacauuuuucugaua

SEQ ID NO: 488008 - RNA, 64 nt, Human
cagcacuagcgacauugcagucugcuucugcaccuuaucuuaaagcacuuacagauaggccuuc

SEQ ID NO: 488009 - RNA, 64 nt, Human
caagguauggauuuuaaauggaugaaacuucaaauuaucuuauuuggauagaagucuauauucu

SEQ ID NO: 488010 - RNA, 64 nt, Human
cucaucuacguggcccugcugcgagucacuccauuuaucuuaaagaaauuggacagcauaugaa

SEQ ID NO: 488011 - RNA, 64 nt, Human
cuuuaaauacuucaugagcauucauaauuaaaauuuaucuuaaguucuaugaagaguauuaaug

SEQ ID NO: 488012 - RNA, 64 nt, Human
ggcauaaagugcccucacacugcugugcagccaucaccaccauucaucuccagaauuuguucuc

SEQ ID NO: 488013 - RNA, 64 nt, Human
cucagccucccaaguagcugggauuacaggcaugcaccaccacgcccagcuaauuuuuauauuc

SEQ ID NO: 488014 - RNA, 64 nt, Human
uccacccugauuccggacccuguagauugggcgccaccaccagaucccccucccaggccuuccu

SEQ ID NO: 488015 - RNA, 64 nt, Human
auuuuuaauuuggcuuuucuuauuuaaaauuccauuaucuuaugaauaagcacuugaaucaguu

SEQ ID NO: 488016 - RNA, 64 nt, Human
aaaguaauuuggaaauuagguugaaacauaucucuuaucuuacgaaaaaaugguagcauuuuaa

SEQ ID NO: 488017 - RNA, 64 nt, Human
gagcaucaaacaaauauuuuacuuaaauuuuauuuuaucuuauuuuuaggugcuuuuaaucuca

SEQ ID NO: 488018 - RNA, 64 nt, Human
guaaaaugaauuuuguaauauccucaggauacuuuuaucuuaaaaguauguuguuaaagauuuu

SEQ ID NO: 488019 - RNA, 64 nt, Human
ugccuugaaaugcuugcuuagggcuucuuuuauguuaucuuaaaaagugcuggugaauuuucca

SEQ ID NO: 488020 - RNA, 64 nt, Human
gcacugauguuauccuuuguauuuauaggcacaguuaucuuacugaaaaugcaugcauggugaa

SEQ ID NO: 488021 - RNA, 64 nt, Human
guaacuguguaaaucugugcaaagguacguauguuuaucuuacucuuccuauaaacuaaaauaa

SEQ ID NO: 488022 - RNA, 64 nt, Human
uggauucugaguuuuucagccuagcccagacuucuuaucuuaguagacaaaaagagucaauacc

SEQ ID NO: 488023 - RNA, 64 nt, Human
ucaguguaaaugaguaacuauagaagacauugcguuaucuuauuuccaaaacguuccaacuaaa

SEQ ID NO: 488024 - RNA, 64 nt, Human
ccuaugcauccccuuguuagauuuuuuuuaaauuuuaucuuacuguuuuuauaauuucuauugg

SEQ ID NO: 488025 - RNA, 64 nt, Human
uucuuuuguuuuuguucuuuaaagaacguuuuacuuaucuuaguauuucauuuuucaucuauau

SEQ ID NO: 488026 - RNA, 64 nt, Human
ucuuggcuugcaagauaacgcuuuuauuuuuauuuuaucuuauuuucauuuucuuaagcacaac

SEQ ID NO: 488027 - RNA, 64 nt, Human
uuguuuugguuuuuaaacagacuuaccuguaaaguuaucuuacggaauuauucuuucuccauau

SEQ ID NO: 488028 - RNA, 64 nt, Human
aacacuucaguuaccaaauuucauugcacauagauuaucuuagguacccuuggaaaugcacauu

SEQ ID NO: 488029 - RNA, 64 nt, Human
uauauauaauauuaugguaauagcagaaguuuuguuaucuuaauagcgggagggggguauauuu

SEQ ID NO: 488030 - RNA, 64 nt, Human
uuaugauugucuuguugauuaaauuguucaugcucaccaccaccaauaagguauuuuucucuga

SEQ ID NO: 488031 - RNA, 64 nt, Human
ugauugucuuguugauuaaauuguucaugcucaccaccaccaauaagguauuuuucucugauug

SEQ ID NO: 488032 - RNA, 64 nt, Human
aucagccucccgaguagcuggcauuacaggcgcccaccaccacgcucggcuaaauuuuuuuuuu

SEQ ID NO: 488033 - RNA, 64 nt, Human
uuagaaauaaguaugaauauuaauaaaauagcauuuaucuuauuucucuauuuuauguugugac

SEQ ID NO: 488034 - RNA, 64 nt, Human
gaacagggugaaccacugauuuuaauuugccuaauuaucuuaugacaaguaucaaauuaagaug

SEQ ID NO: 488035 - RNA, 64 nt, Human
cuuuggcuucagaauuguuuuuagaaauuuauucuuaucuuaggauuuaccaaauagggcaaag

SEQ ID NO: 488036 - RNA, 64 nt, Human
acuuuccucuucuaugaccccucucuccccaguauuaucuuacuugcaaaauggagaccaaauu

SEQ ID NO: 488037 - RNA, 64 nt, Human
uaaaagaagaugguuucacuuuaauauaaugcuauuaucuuaagacuuaauggaguugcuggag

SEQ ID NO: 488038 - RNA, 64 nt, Human
uuugucuaauaucuuagcccaguuuaucaaucaguuaucuuaagucagcauuuucuaagccauu

SEQ ID NO: 488039 - RNA, 64 nt, Human
cuugagucucgaacagcgguuguuuuuacuuuauuuaucuuaggcccucagcucccugacgucc

SEQ ID NO: 488040 - RNA, 64 nt, Human
cccuuuguuaauaguuuuaagugaauuuuugaccuuaucuuaauggaaaacgguuaacuccaaa

SEQ ID NO: 488041 - RNA, 64 nt, Human
uuauucaaaauaguccacugacuccucacaucuguuaucuuauuauaaagaacuauuuguagua

SEQ ID NO: 488042 - RNA, 64 nt, Human
gcugaaaauaauuuucaaguugaaagaucuaguuuuaucuuaguuugccuucuuuguacagaca

SEQ ID NO: 488043 - RNA, 64 nt, Human
uucuaaguauuacuagaaaauacguuugaaagcuuuaucuuauuauuuacaguauuuuuauauu

SEQ ID NO: 488044 - RNA, 64 nt, Human
ucacugagaaaaauguguuacucuuuuggacaauuuaucuuauuucuaucauauaagauguauu

SEQ ID NO: 488045 - RNA, 64 nt, Human
uuuauccuaucccucugcguaggaauaaccauaauuaucuuacuaauuccaucccagaaaagcc

SEQ ID NO: 488046 - RNA, 64 nt, Human
acggucuuuaugaauuauuuugauaaauuacuaauuaucuuaucuacugacugaaaucaguggu

SEQ ID NO: 488047 - RNA, 64 nt, Human
guguguuugcugcggugggagggggugcuuguauuuaucuuauuuccagucacuauaagguugu

SEQ ID NO: 488048 - RNA, 64 nt, Human
uccaauggcacagauuacaaaaguaaagaacaaccaccaccaacaucgguaacucccuguauuc

SEQ ID NO: 488049 - RNA, 64 nt, Human
cagugccaaaaacaacaacaaaaugaaacgcaaccaccaccaaccacugcgaccacaagaagga

SEQ ID NO: 488050 - RNA, 64 nt, Human
ccagggagguagaggcuucagugagcugagaucgcaccaccacacuccagccugggugacagag

SEQ ID NO: 488051 - RNA, 64 nt, Human
aaaauuacuuuaagggcucucacauuuuaauaauuuaucuuauuauguauuaaguauacaggaa

SEQ ID NO: 488052 - RNA, 64 nt, Human
ccacaagaugcugcaaugugaguuaucacuucauuuaucuuaaagaaagacuaaacugguuguc

SEQ ID NO: 488053 - RNA, 64 nt, Human
gcuugggagggugggggugggggagggucuuauuuuaucuuaucuuuucuguggaucagaaaaa

SEQ ID NO: 488054 - RNA, 64 nt, Human
aaugcguuggcccacguagcaaaaagauauuugauuaucuuaaaaauuguuaaauaccguuuuc

SEQ ID NO: 488055 - RNA, 64 nt, Human
uaaaaugugguuggaagguguacuaauauauaauuuaucuuaauuuuucuaacuuuguauggau

SEQ ID NO: 488056 - RNA, 64 nt, Human
acuguggacaacucgaauaaguuugacuuguguuuuaucuuaaccaccagaucauuccuucugu

SEQ ID NO: 488057 - RNA, 64 nt, Human
ugacagauuauuuuguuuaaaaaugcaguuuuaauuaucuuagucuauagaaaugaucauugca

SEQ ID NO: 488058 - RNA, 64 nt, Human
guucccuuuagcaagggauucagaucuuuguaccuuaucuuauauccagagcagauuccauuug

SEQ ID NO: 488059 - RNA, 64 nt, Human
uguuucugcacuuuauaauaaagcauggaagaaauuaucuuaguaggcaauuguaacacuuuuu

SEQ ID NO: 488060 - RNA, 64 nt, Human
aaguauuauucaaaccaauuucuuccuuccacaguuaucuuagcuggauauaauguauuuucag

SEQ ID NO: 488061 - RNA, 64 nt, Human
cagaagaugugaugaauuauccuguaguacaagauuaucuuauuccccugcccaggugugagca

SEQ ID NO: 488062 - RNA, 64 nt, Human
agcugccuuuuuaauuuauugcauauccuuuuuauuaucuuauuuugguauuauucaaucuaua

SEQ ID NO: 488063 - RNA, 64 nt, Human
gacaccauuuccaguuugcacaaaagucaguauuuuaucuuaaaguggcuugauuuccaauagc

SEQ ID NO: 488064 - RNA, 64 nt, Human
gguuugagcacaaucuguucuacucuuaaugauguuaucuuaacacugaaauugccugaaaccc

SEQ ID NO: 488065 - RNA, 64 nt, Human
uuuucguauaugaguaacaacuuugcuuaaguguuuaucuuaguucagaaauacauaaugucau

SEQ ID NO: 488066 - RNA, 59 nt, Human; identical to SEQ ID NO: 335490

SEQ ID NO: 488067 - RNA, 64 nt, Human
gauaccaucuccucauccuaacccaggucuucggcaccaccacaauuaauucccuucccaacac

SEQ ID NO: 488068 - RNA, 64 nt, Human
cucagccuucugaguagcugggacuacagaugcacaccaccacaccuggcuaauuuuuguguuu

SEQ ID NO: 488069 - RNA, 64 nt, Human
caucuuucuuaagccgagagcugucuuugcagaauuaucuuauuaaaaaaaaauacaaaaaaaa

SEQ ID NO: 488070 - RNA, 64 nt, Human
auaagccuguuaguaucauaugaagagagaacaguuaucuuaguaccuauggauuuucuuuauu

SEQ ID NO: 488071 - RNA, 64 nt, Human
ccuuuuaguauuaguuuucuguauaugauauauauuaucuuauacugaaaaaaaauuccuuuca

SEQ ID NO: 488072 - RNA, 64 nt, Human
acucggcuggccguucccuccagccccuugcugguuaucuuacucugagugugaugcagucaga

SEQ ID NO: 488073 - RNA, 64 nt, Human
uaaauugcaaagcaaccugucuuacauucuuacauuaucuuaaaauaaauauuucugcccuuga

SEQ ID NO: 488074 - RNA, 64 nt, Human
auauuagaacuuuugauauauacuaaaauacugauuaucuuaaucacauuuuccccagagauaa

SEQ ID NO: 488075 - RNA, 64 nt, Human
ggacugaacaugcagaacuguuuuuuuuuuuuuuuuaucuuaaacacauacacaccuccaguuu

SEQ ID NO: 488076 - RNA, 64 nt, Human
aaacuuuaaaaauuauuauauauuuauagcaaaguuaucuuaaauaugaauucuguuguaauuu

SEQ ID NO: 488077 - RNA, 64 nt, Human
uagauuucuauuuguagcucucauucauuguuuuuuaucuuaguuugcagaaagguguugaaau

SEQ ID NO: 488078 - RNA, 64 nt, Human
uugguuaaacgacucuuuuauuuucuguuuugccuuaucuuacuaaagugaaguuuuccuaagg

SEQ ID NO: 488079 - RNA, 64 nt, Human
uaugaaauauguuuuauauaaucuccuauuauuuuuaucuuauguuuuguauuguugauaaauc

SEQ ID NO: 488080 - RNA, 64 nt, Human
gaguuuuacauuacaaauuucuguuuuuuuaaaguuaucuuacgcuauuucuguugguuaguag

SEQ ID NO: 488081 - RNA, 64 nt, Human
agaacucaguuaaaucuuugaagaauauuuguaguuaucuuagaagauagcaugggaggugagg

SEQ ID NO: 488082 - RNA, 64 nt, Human
aauuuuguagauaccauauccccugaaauagcauuuaucuuacuggguugacuggaaaggaaug

SEQ ID NO: 488083 - RNA, 64 nt, Human
uuuaaaagcauggcuagauuuacuucaguauaaauuaucuuaugaaaaccaaauuuuaaaagcc

SEQ ID NO: 488084 - RNA, 64 nt, Human
uccgagaggugggccagucuguggaucagagaugcaccaccaagccaagggaaccuguguccgg

SEQ ID NO: 488085 - RNA, 64 nt, Human
agaccuguuccucuuccaaaagaccucucuuuaccaccaccacccucaucacucagaaacccua

SEQ ID NO: 488086 - RNA, 64 nt, Human
gccuuuggaauuacuccugcagaagguugccugccaccaccagcuggaccugagcuugggcaac

SEQ ID NO: 488087 - RNA, 64 nt, Human
aauaacaucugaaaagaaaugcuaauguaaucauuuaucuuaucuagcaagaagauucuaaaac

SEQ ID NO: 488088 - RNA, 64 nt, Human
auuuauuuuuuuaauuuaagauuucugaauuauuuuaucuuaaauugugauuuuaaacgagcua

SEQ ID NO: 488089 - RNA, 64 nt, Human
aauaauguugaguggcagucaaaagucaugauuuuuaucuuaguucuucauuacugcauugaaa

SEQ ID NO: 488090 - RNA, 64 nt, Human
aaauaaauuaaagguacaaaaucgugaaucucaguuaucuuaaauauuccaauacuauuuacaa

SEQ ID NO: 488091 - RNA, 64 nt, Human
aguauuccaaucacugugcuuaauuuaaauagcauuaucuuaucauuuaucagccuuuuaugua

SEQ ID NO: 488092 - RNA, 64 nt, Human
uugacugaauaucuggauggcuaagaacagacauuuaucuuacacauggaaaacugacgaaacc

SEQ ID NO: 488093 - RNA, 64 nt, Human
ccuuauaggucuuacaugcauaugcaaggauauuuuaucuuauucauucauuucauacucucaa

SEQ ID NO: 488094 - RNA, 64 nt, Human
augaauugguauaccauauccggaaucacacauguuaucuuaaacccagccaucauaccuaagu

SEQ ID NO: 488095 - RNA, 64 nt, Human
uguuacaggagauuauaggcuagucuguaauaaauuaucuuauagcagccuuugggguuuggua

SEQ ID NO: 488096 - RNA, 64 nt, Human
aaaauuuuuaaaaauuacaaauauacaaaguuauuuaucuuagcacauuuauuaugugugacug

SEQ ID NO: 488097 - RNA, 64 nt, Human
aaacuguaaaaguguacagacucuucacagauuuuuaucuuaauugcaagucugccgauuuugu

SEQ ID NO: 488098 - RNA, 64 nt, Human
ucagugaaauuugccuucacauuuuaagaaaacuuuaucuuauggaguuauuuaagccaucuac

SEQ ID NO: 488099 - RNA, 64 nt, Human
uuugaauuacugaagacagcaagauauuuguaaauuaucuuaaaauaaacaacuuaaaauaaaa

SEQ ID NO: 488100 - RNA, 64 nt, Human
ugcuacucuggaaucauuuuacuguuuguuuuuauuaucuuaagugcuaauuaaaaaaaaaaua

SEQ ID NO: 488101 - RNA, 64 nt, Human
uucgaaauaaaauccauugcaauucauuuaugaguuaucuuacauaucacaaagaccaauuaga

SEQ ID NO: 488102 - RNA, 64 nt, Human
accaccaacaccucaucauccuucucaucgcuaacaccaccaccuccaucggcacccaagcggg

SEQ ID NO: 488103 - RNA, 64 nt, Human
cugggucucaguguccucaucuguaaaauggagacaccaccacccuugccauggagguuaagca

SEQ ID NO: 488104 - RNA, 64 nt, Human
cucagccucccuaguagcugggauuacaggcacacaccaccauaccuggcuaauuuuuguauuu

SEQ ID NO: 488105 - RNA, 64 nt, Human
ugcacucuauaaugauuuuuaaauuaagaauuuuuuaucuuaggcaaagugugucucuuucaau

SEQ ID NO: 488106 - RNA, 64 nt, Human
gaguuaaaaggcugaaaggaauauagucaguaauuuaucuuaaccucaaaacuguauauaaauc

SEQ ID NO: 488107 - RNA, 64 nt, Human
aagcugauuaauuagauaugcaucuggcauuguuuuaucuuaucaguauuaucacucuuauguu

SEQ ID NO: 488108 - RNA, 64 nt, Human
cauggcuuuguccauuaagagcuaauucauuuguuuaucuuagcauacuagauuugggaaaaug

SEQ ID NO: 488109 - RNA, 64 nt, Human
aaaaggccaaaacuccauauauguuagucuuccuuuaucuuacagcgcagcauuuauuuuauga

SEQ ID NO: 488110 - RNA, 64 nt, Human
uaagggauauuugucuuuauaggaguacauaaauuuaucuuaaugauauuuaaguaguuuuuuu

SEQ ID NO: 488111 - RNA, 64 nt, Human
caaaaugugccuguuguaaguuugguuaaaacuuuuaucuuaguauugaaaauauauagcaagu

SEQ ID NO: 488112 - RNA, 64 nt, Human
gauucaaggaauuccaguuuuaucuauuaagauuuuaucuuaaugaugaguagccaaggucuaa

SEQ ID NO: 488113 - RNA, 64 nt, Human
cucuauugugcuaucagauaguagaucauucuuuuuaucuuauuuguuuuuguacccauuaacc

SEQ ID NO: 488114 - RNA, 64 nt, Human
guauguacuacuuuuauggcagucauaugaaccauuaucuuagcaugguaaaccuggguuuugu

SEQ ID NO: 488115 - RNA, 64 nt, Human
ugcuacuucaagaaacuaaauugaucucguagaauuaucuuaauaaaauaauggcuauaauuuc

SEQ ID NO: 488116 - RNA, 64 nt, Human
ucucaauauguuaacuuggaaaaaaauuuuagccuuaucuuaaucugucccaacagcaauguga

SEQ ID NO: 488117 - RNA, 64 nt, Human
ugaccacuggccucuaggaaaccuucuacccccauuaucuuaccucaacuguuuccucuggagc

SEQ ID NO: 488118 - RNA, 64 nt, Human
uucugauaagaacaucuuuuacucugacuugcuuuuaucuuaguaguaugcuuauggauuuagu

SEQ ID NO: 488119 - RNA, 64 nt, Human
gaacuucugauuagcucucagucuucagcucuauuuaucuuaggaguuuaauuugcccuucucu

SEQ ID NO: 488120 - RNA, 64 nt, Human
ggccucagggcuugugggggguaggcugagaccccaccaccaaagguuaagugagguccccuug

SEQ ID NO: 488121 - RNA, 64 nt, Human
cagcuagacgcuauaccguggacucucccugguccaccaccauguugaagcccuuggcagccug

SEQ ID NO: 488122 - RNA, 64 nt, Human
gcaaaaugggcacugccagagccauuucugaucacaccaccauccuggaccaugugacuggaag

SEQ ID NO: 488123 - RNA, 64 nt, Human
gcugucaucuuaguuggaccaacuucccauuuauuuaucuuaaaacuauacaguuacaucuuaa

SEQ ID NO: 488124 - RNA, 64 nt, Human
cccucuuuuucacuuugagcuuugggaaaacucuuuaucuuaugaggcuguauuccucaauacc

SEQ ID NO: 488125 - RNA, 64 nt, Human
accucucacacucuguucuuuaguguccuuaccuuuaucuuaccacacacauggguguuucuau

SEQ ID NO: 488126 - RNA, 64 nt, Human
uuuuguuuugcuuuuugaaauaaggaaaauaagcuuaucuuaaguuuauuuuuccuuggauaua

SEQ ID NO: 488127 - RNA, 64 nt, Human
ccauggcccuguacuggaauaacaggguaaauaauuaucuuaucuguuuuuauuaauccgucuu

SEQ ID NO: 488128 - RNA, 64 nt, Human
uuugccauggacaucagaaguuugaauuccagucuuaucuuauguuccauggcugaauuuuaaa

SEQ ID NO: 488129 - RNA, 64 nt, Human
uugucauuucaauaguuauuaacaugacuaaauauuaucuuaauuaagaggaaaauagaaguug

SEQ ID NO: 488130 - RNA, 64 nt, Human
gagguuuaccuagagaacaggugguuuuuaaggguuaucuuagauguuucacaccggaagguuu

SEQ ID NO: 488131 - RNA, 64 nt, Human
ggaguagggccugcuggguguuuagcucauggcuuuaucuuauuugucccccuccuccuuucac

SEQ ID NO: 488132 - RNA, 64 nt, Human
ucugaaaauaucucacaauuuuugaauguucuuuuuaucuuaccgaccuaacuucucuuuuccc

SEQ ID NO: 488133 - RNA, 64 nt, Human
agucuggaauagguuauccacuccaucuucuagguuaucuuaguuguaugacgaacugauaaau

SEQ ID NO: 488134 - RNA, 64 nt, Human
ugccuuuaacccugacauucagucuuaacacauuuuaucuuaaauaauuuauucauuccagaau

SEQ ID NO: 488135 - RNA, 64 nt, Human
auuaaacuguacauacugugcauauaaugaauuuuuaucuuauguaaauuauuuuuagaacaca

SEQ ID NO: 488136 - RNA, 64 nt, Human
gugguuuagugcagugaggaaaugaugggaauuuuuaucuuagaaauggaugauucgugaauaa

SEQ ID NO: 488137 - RNA, 64 nt, Human
auuuugugcuuuuuauugaagaauuuuauuguuuuuaucuuaaaaucaguuucuauuauccuug

SEQ ID NO: 488138 - RNA, 64 nt, Human
acuauucuguuaaaaucaggauuuuagugcuugccaccaccagaugagaaguuaagcagccuuu

SEQ ID NO: 488139 - RNA, 64 nt, Human
cugaucaugccccuucucucccaccccaucuccccaccaccaccucuguggccuccaugguacc

SEQ ID NO: 488140 - RNA, 64 nt, Human
cucagccucccaaguagcugggacuaugggugcacaccaccacgccuggcuaauuuuuguauuu

SEQ ID NO: 488141 - RNA, 64 nt, Human
uaaaaaguauuuuccagcaguccaaagauguaaguuaucuuacacauaaaauguuuuauuuugu

SEQ ID NO: 488142 - RNA, 64 nt, Human
uuacagaaacaguuuaugugguuggaucaccaaauuaucuuagguacuaaggccucaaaaauaa

SEQ ID NO: 488143 - RNA, 64 nt, Human
auuuuuguuuucugaaauuggauuuuauuuuauuuuaucuuauaauuucaguucaucuaaauug

SEQ ID NO: 488144 - RNA, 64 nt, Human
aauacuaacauguuauuugccuuuugaauucucauuaucuuaaaauuguauuguggaguuuucc

SEQ ID NO: 488145 - RNA, 64 nt, Human
cuuaaugcacagcuuauuaaaaaaaucaaaauuguuaucuuaauagauauauuuuuucaaaaac

SEQ ID NO: 488146 - RNA, 64 nt, Human
uuccgguuaaguucuuuaauaauaauccuacaguuuaucuuaagaaaaaaaaaaagguuugaaa

SEQ ID NO: 488147 - RNA, 64 nt, Human
augcccaauauuaaguaaaaaauauaagaaaagguuaucuuaaauagaucuuaggcaaaauacc

SEQ ID NO: 488148 - RNA, 64 nt, Human
gaaaaaaaucauuuuaacuaaaagcaaaagaauuuuaucuuauaucuaaaaaauauauaacuua

SEQ ID NO: 488149 - RNA, 64 nt, Human
acagcucuacgcggcaaauuaacuugaguuuuauuuaucuuauccucugguuuaauuacauaaa

SEQ ID NO: 488150 - RNA, 64 nt, Human
uaauuuccucaucuuuaaaaugagaagguuaaauuuaucuuaguacugcugggcgcaguggcuc

SEQ ID NO: 488151 - RNA, 64 nt, Human
gucagggagguggugcugccccagugggccaugauuaucuuaaaggcauuauucuccagccuua

SEQ ID NO: 488152 - RNA, 64 nt, Human
uagcuuaauggauguaauacauuucugaguaccauuaucuuaucuaguaauguagauuuacaua

SEQ ID NO: 488153 - RNA, 64 nt, Human
ugaaagggaaauguucuuuauuaaaaucaauacauuaucuuauuaaacaaagauccuaaaagua

SEQ ID NO: 488154 - RNA, 64 nt, Human
aauaacuuucuuuuaacguaaagcugcuuucugcuuaucuuauugcacugcuaguuguauguag

SEQ ID NO: 488155 - RNA, 64 nt, Human
ccuacgaguucugcugaucaggaaauuuaagaauuuaucuuaaaaaugcaaggaaaaaagacug

SEQ ID NO: 488156 - RNA, 64 nt, Human
ccaguggccugggagaggcagugagccuucucuccaccaccauagacagguguuaaugcaucua

SEQ ID NO: 488157 - RNA, 64 nt, Human
acaaguggggcaaagccagcaugcaagcagaccccaccaccacagcccaccuccguccucacau

SEQ ID NO: 488158 - RNA, 64 nt, Human
cuucucaucacugcacacaagugccaugcuuugccaccaccaccaagcacaucugugauccuga

SEQ ID NO: 488159 - RNA, 64 nt, Human
cugggggagacagaaaagaggugcggcaggacucuuaucuuaaaaaguaaacaaaacaaaacaa

SEQ ID NO: 488160 - RNA, 64 nt, Human
uuuuuaagcauugauuuaaaagaugcacggaaaguuaucuuacagcaaacuguaguuugccucc

SEQ ID NO: 488161 - RNA, 64 nt, Human
aaguuuugaugucuugagucuccaucuuaggggauuaucuuacguuuaagcuuaacauuucaug

SEQ ID NO: 488162 - RNA, 64 nt, Human
ugagggaacuuaccaagaacaucuacaugguuuuuuaucuuauuguaauagaugagcauauuuu

SEQ ID NO: 488163 - RNA, 64 nt, Human
aauacuugcuguaaagucuuucuaagaccaauuauuaucuuagcauguuucaguaucuucucua

SEQ ID NO: 488164 - RNA, 50 nt, Human
ugcagacgcuucuuuccugauuaucuuauuucauuguguuagcaaaauau

SEQ ID NO: 488165 - RNA, 64 nt, Human
uuaaaauuuuuuuugacaauuuuggguucccaacuuaucuuacaagugaaaacuuaaauuguaa

SEQ ID NO: 488166 - RNA, 64 nt, Human
uuacuuuuguaauuauuugcaauuaauuguucuuuuaucuuacaauuguuuaagccugugaucu

SEQ ID NO: 488167 - RNA, 64 nt, Human
ucagcaaaaaaguccaauuuuaauuuaguaaauguuaucuuauacuguacaauaaaaacauugc

SEQ ID NO: 488168 - RNA, 64 nt, Human
gaucaguuugcauuuaaaaggaaaaaaaagaauuuuaucuuagccagaaugucccuggauucag

SEQ ID NO: 488169 - RNA, 64 nt, Human
aaaagcacucauuaaggaauuaaaguuacaaguuuuaucuuaauaauauguaaucuagaaaagc

SEQ ID NO: 488170 - RNA, 64 nt, Human
aauucauguuggucaaagucgaauuacuaucuauuuaucuuauaucguagaucugauaacccua

SEQ ID NO: 488171 - RNA, 64 nt, Human
cuuggauuuuccuuuaauaccaaguaucauuugguuaucuuacugggacauuuucauugauauu

SEQ ID NO: 488172 - RNA, 64 nt, Human
cuguggcugacuucuuguauucaacucugguuuauuaucuuaaucuucaacuucagacauauau

SEQ ID NO: 488173 - RNA, 64 nt, Human
uuucagaccaaaaaaaacuuuauuguaugagagcuuaucuuauccuguuuauuuuuccaaugcu

SEQ ID NO: 488174 - RNA, 64 nt, Human
ucuaagcccccaaguagcuaggacuacaggagcacaccaccacaccuggcuaauuuuuguauuu

SEQ ID NO: 488175 - RNA, 64 nt, Human
ugggaagcuauccuuucucagcuaugugguuuggcaccaccaccaucuucaugaguggacccug

SEQ ID NO: 488176 - RNA, 64 nt, Human
gaagcuauccuuucucagcuaugugguuuggcaccaccaccaucuucaugaguggacccuguuu

SEQ ID NO: 488177 - RNA, 64 nt, Human
aaucgccccagaguuugccuguuuccauauuuuauuaucuuauaaucuucgggagugcuuacac

SEQ ID NO: 488178 - RNA, 64 nt, Human
ugcaacaaaaugucuuuauugaaagaaguggaaguuaucuuaaugccacgguucaccaucaauu

SEQ ID NO: 488179 - RNA, 64 nt, Human
caaaauuucaaaugcaaaguauuacagccaaauauuaucuuaauuaauuucuuacacuuaaaag

SEQ ID NO: 488180 - RNA, 63 nt, Human
uggccacagauaaauccuaguuaaauuuuauaguuaucuuaauauuaugauuuugauaaaaac

SEQ ID NO: 488181 - RNA, 64 nt, Human
gagaaauucaacagucauuuucaccagcauaauuuuaucuuaaggaauaacuaauaggaaaagu

SEQ ID NO: 488182 - RNA, 64 nt, Human
uuuauuguggcgcuuuuguagaucacugagaagcuuaucuuauuaaccaauauaccacuuccua

SEQ ID NO: 488183 - RNA, 64 nt, Human
accuuuacauuccugaagauaaacauguaaucuuuuaucuuauuuugcucaauaaaauuguuca

SEQ ID NO: 488184 - RNA, 64 nt, Human
aagaaccuucucaccucuaugccucaugaugcaauuaucuuacucagaggagauuugccaggaa

SEQ ID NO: 488185 - RNA, 64 nt, Human
uucauccucuugaaaaucuuuguucuuuacaaaauuaucuuaauaaguucuauauggucagcuu

SEQ ID NO: 488186 - RNA, 64 nt, Human
caugaggcugauuuccaguuugucaucaaccucuuuaucuuauaauuuaggauagaguugaacg

SEQ ID NO: 488187 - RNA, 64 nt, Human
guaucugcuugaccuuucuaagaaaaagggauucuuaucuuacucugagcuuuugauguuuugu

SEQ ID NO: 488188 - RNA, 64 nt, Human
aagagauuuauuuuaaaagagauugcucugaaauuuaucuuaaaagagcuugcucugucuaccu

SEQ ID NO: 488189 - RNA, 64 nt, Human
gaggugcauccuccaccucuaaucuuggaggcuauuaucuuaccuccaagcacugagcuggguu

SEQ ID NO: 488190 - RNA, 64 nt, Human
cacaguguguguaaaugccagauguggugagauuuuaucuuauaaaugugaucagauaaaauaa

SEQ ID NO: 488191 - RNA, 64 nt, Human
caagggugccaugguauuuuuagauaacucgugauuaucuuaagagagguaaauuuagugauca

SEQ ID NO: 488192 - RNA, 64 nt, Human
uguagaucagagcagcagugaaaacaagugcuggcaccaccaggcaccucacagaaaugagauc

SEQ ID NO: 488193 - RNA, 64 nt, Human
cuucucuuggcucacucccuugccucucccccuccaccaccaccuugugacugaugguuugguu

SEQ ID NO: 488194 - RNA, 64 nt, Human
uuaugagcucccuuugcccuucuccuguaucccacaccaccacauccaaccuccuugccugccu

SEQ ID NO: 488195 - RNA, 64 nt, Human
auacuugugguuaguuuugugccauaggaaaaaauuaucuuaaaacuuuggccauaguuaauaa

SEQ ID NO: 488196 - RNA, 64 nt, Human
auuuuaauccuggaagcuguugccuuauuaaugauuaucuuaaaauuuccuccauuggggcagc

SEQ ID NO: 488197 - RNA, 64 nt, Human
auguguacugugauguaaaaauaagacauuaacuuuaucuuaaguuacauauaaucaagcaaau

SEQ ID NO: 488198 - RNA, 64 nt, Human
acaaacaaaaaaaacaauucuucauucagaaaaauuaucuuagggacugauauugguaauuaug

SEQ ID NO: 488199 - RNA, 64 nt, Human
cauccucaccagcauuugguauuacuacuauuuuuuaucuuaaccauucacauagaugugugua

SEQ ID NO: 488200 - RNA, 64 nt, Human
cuuaaauaauaagaguagaauacuuucuguguuuuuaucuuauacacaugaauaaaugcuaugg

SEQ ID NO: 488201 - RNA, 64 nt, Human
uuccuuuuccccaguaacauuccugaauuuacuguuaucuuauuguaguacuugcaugacaugg

SEQ ID NO: 488202 - RNA, 64 nt, Human
auuuuacacucuuaagucuuaaccacagucagaauuaucuuaauguagauuauaauuuuggucu

SEQ ID NO: 488203 - RNA, 64 nt, Human
cugucccucagagggcaccuggaggcagcaaagauuaucuuauuuauuuuauuuuguuuucugc

SEQ ID NO: 488204 - RNA, 64 nt, Human
auaucuauugagcuuguuucuuguaaacuuuucuuuaucuuauaaaggcauaucucgcuuuugu

SEQ ID NO: 488205 - RNA, 64 nt, Human
ggucauuauuaaguuacuuaaucauccuuaauccuuaucuuagggauacuugaacacaaacacu

SEQ ID NO: 488206 - RNA, 64 nt, Human
gugaucacuuugacuugagcaaaugguuuaauuuuuaucuuaaaaaucaguuaagaauauauaa

SEQ ID NO: 488207 - RNA, 64 nt, Human
cagucacauuguaggagccaguguagcuauggaauuaucuuaggaacucaagcuucuaaaacua

SEQ ID NO: 488208 - RNA, 64 nt, Human
aaauacaaauaaaaaggaaaaaaaauuacauuuuuuaucuuauaccucagauauuuuguucugu

SEQ ID NO: 488209 - RNA, 64 nt, Human
gacuucauaacaagaaucuggcauuucucuucaguuaucuuauauguacauauaauuguuuuug

SEQ ID NO: 488210 - RNA, 64 nt, Human
gucacagauauauuucuccaagaaagccaacaaccaccaccacaaugacagaaaugacaacaag

SEQ ID NO: 488211 - RNA, 64 nt, Human
aaaaaaauaauaauaauaaaaugaaagaaacaaucaccaccaccauuauuaaacuguaacuugu

SEQ ID NO: 488212 - RNA, 64 nt, Human
aaaauaauaauaauaaaaugaaagaaacaaucaccaccaccauuauuaaacuguaacuugucua

SEQ ID NO: 488213 - RNA, 64 nt, Human
uacaccuaugagauagccaaaguuucaaacacaguuaucuuaguuuaccgguggaguauuucaa

SEQ ID NO: 488214 - RNA, 64 nt, Human
ccuuuugaauaacuuucaauagaauugucuaaaauuaucuuacugguuguuaggccuuuggugu

SEQ ID NO: 488215 - RNA, 64 nt, Human
auugaaaugaagauaaaauugcucuuuuguaacuuuaucuuaguaauguaaagauucaguaaau

SEQ ID NO: 488216 - RNA, 64 nt, Human
cagaagauaccugauaagagaagguguaagguuuuuaucuuauaugccagaggcaccaggccag

SEQ ID NO: 488217 - RNA, 64 nt, Human
cauugguccugggguugaccagugagccaguaaauuaucuuauugcuuuaaacaaguuugugcu

SEQ ID NO: 488218 - RNA, 64 nt, Human
agagcucggcugaaccagccuuuagugccuaccauuaucuuauccgucucuucccgucccugau

SEQ ID NO: 488219 - RNA, 64 nt, Human
uuagccagaaacuauacaagugguuuaacaugcauuaucuuacucaauccauacaaaagucuua

SEQ ID NO: 488220 - RNA, 64 nt, Human
aggaaacuauguggaggacgaugcaaaaacauauuuaucuuaguuugcucugcuguaguucugu

SEQ ID NO: 488221 - RNA, 64 nt, Human
uauuaauaucuaguucucagagcauuuggaaagguuaucuuaaauggcuaccuaaauugaaauc

SEQ ID NO: 488222 - RNA, 64 nt, Human
gcuacugacuguauuuuguuuuccuuuuaccauuuuaucuuaucuugcuuuggaggaccuuaaa

SEQ ID NO: 488223 - RNA, 64 nt, Human
uuuuccaucccacauaaauacaguauucccacucuuaucuuacaacucccccaccgcccacucu

SEQ ID NO: 488224 - RNA, 64 nt, Human
gcaauacagcauaucugcuuuugccuucuguuguuuaucuuaccugcagauauuaagaauguau

SEQ ID NO: 488225 - RNA, 64 nt, Human
aaaaacucuuaauuuagugacuuauggcaaaauuuuaucuuaaaucaaugugauucuuucuugu

SEQ ID NO: 488226 - RNA, 64 nt, Human
acuguucagggucucucucuuacaaccaagaacauuaucuuaguggaagaugguacgucaugcu

SEQ ID NO: 488227 - RNA, 64 nt, Human
auuaagccuaauugauuaaaauuuaucuuuuuuauuaucuuacaugcuuguaucuucaguugga

SEQ ID NO: 488228 - RNA, 64 nt, Human
aggccaaagccagagacucgaacagccuccccaccaccaccagcauaugucaaggagcacuugc

SEQ ID NO: 488229 - RNA, 64 nt, Human
uuugguucauuuggguggggaucaaaguccuguccaccaccaaaacuaaguucuuagauuuugg

SEQ ID NO: 488230 - RNA, 64 nt, Human
aucguaaggaagcuguuucuuuuaaaacacaaaccaccaccaaaaauuuaaauguacauauugc

SEQ ID NO: 488231 - RNA, 64 nt, Human
ugggcaaaagaagaucugacagcuccuauauaccuuaucuuacugaauucuuaaacuuugaacc

SEQ ID NO: 488232 - RNA, 64 nt, Human; identical to SEQ ID NO: 488221

SEQ ID NO: 488233 - RNA, 64 nt, Human
ucaguagauaugagauagagcauaauuaucuguuuuaucuuaguuuuauacauaauuuaccauc

SEQ ID NO: 488234 - RNA, 64 nt, Human
cuguuuuaaaaugugaggcgauuauuuuaaguaauuaucuuaccaagcccaagacugguuuuaa

SEQ ID NO: 488235 - RNA, 64 nt, Human
ucaaaauuacauauuaacuguucuucaauaaauauuaucuuaauaucaguaauucuuuucucuu

SEQ ID NO: 488236 - RNA, 64 nt, Human
uuugugugaacugggauguuggggguguuugugguuaucuuaccuggggaaguucuuauguuua

SEQ ID NO: 488237 - RNA, 64 nt, Human; identical to SEQ ID NO: 488221

SEQ ID NO: 488238 - RNA, 64 nt, Human
auucucaauuaccaaauguuucauuugaaacaauuuaucuuaaugaaauauagaccaauucucu

SEQ ID NO: 488239 - RNA, 64 nt, Human
augggcgacaccaagaagaccagugccccaccuuuuaucuuaguaggcucaaauguucaggaag

SEQ ID NO: 488240 - RNA, 64 nt, Human
ugaaagcagaaaguucuacucucguaucuguuuuuuaucuuaucuuauucuccauuuaagaguu

SEQ ID NO: 488241 - RNA, 64 nt, Human
gcagaaaguucuacucucguaucuguuuuuuaucuuaucuuauucuccauuuaagaguuuugcu

SEQ ID NO: 488242 - RNA, 64 nt, Human
ccaaugaucgccuuugcuuuaccacucuuuccuuuuaucuuauuaauaaaaauguuggucucca

SEQ ID NO: 488243 - RNA, 64 nt, Human
aacagaaugagcuaguaagcgaugcugcaacuuguuaucuuaacaagaauucaagucguuuuaa

SEQ ID NO: 488244 - RNA, 64 nt, Human
uuucaagagucaagagaaaguacaguaaacacuauuaucuuaucuugacuuuaaggggaaauaa

SEQ ID NO: 488245 - RNA, 64 nt, Human
cagauuaacacuagggaauuauuugauaaccagcuuaucuuaucaguaguuuuauugcugauca

SEQ ID NO: 488246 - RNA, 64 nt, Human
cucagccucccgaguagcugggacuacaggcgcccaccaccaugcccggcuaauuuuuguuuuu

SEQ ID NO: 488247 - RNA, 64 nt, Human
cucagccucucaaguggcugggaccacagaagugcaccaccaugccuggcuuuuuuuuuuuuuu

SEQ ID NO: 488248 - RNA, 64 nt, Human
cucagcuuccagauuagcuggugcuauaggcaugcaccaccacguccaucuaaauuucuuuauu

SEQ ID NO: 488249 - RNA, 64 nt, Human
aaaauuuucuuucuaaaaguauaauuuaauagaauuaucuuaaaauacaugaucaguauucagu

SEQ ID NO: 488250 - RNA, 59 nt, Human
cacuuucaggaggcagauaaauaaaggccuuaucuuaugaaagcacacaagagccucca

SEQ ID NO: 488251 - RNA, 64 nt, Human
ccuuugcugagacagcaguuacacuaacccuuaauuaucuuacuugucuaugaaggagauaaac

SEQ ID NO: 488252 - RNA, 64 nt, Human
auuaaaacaagagaccacuuccuuaacagcuguauuaucuuaaacccacauaaacacuucuccu

SEQ ID NO: 488253 - RNA, 64 nt, Human
uuagccauauugaaaacaaauaucuuuuucaacguuaucuuagcucuacuaguugaucuuuuug

SEQ ID NO: 488254 - RNA, 64 nt, Human
cuuagaugagauaguguuuuuuuagaaaaaaacuuuaucuuaccauuaaguaaaauguuugcca

SEQ ID NO: 488255 - RNA, 64 nt, Human
ggagagguagaugcauauuuuuguguggaaccauuuaucuuaaaacauugaggugcaguuuuca

SEQ ID NO: 488256 - RNA, 64 nt, Human
cauauucuguauggauauaccacaguuuauccauuuaucuuaauugaugucuguacuccacccc

SEQ ID NO: 488257 - RNA, 64 nt, Human
ucuuggcacuuuguaacggaacggguacuacacuuuaucuuaauucuuaauuuaaaaacauguu

SEQ ID NO: 488258 - RNA, 64 nt, Human
guugccauguguagcugcuauguccccuggggcguuaucuuauacaugcaaaccuaccaucugu

SEQ ID NO: 488259 - RNA, 64 nt, Human
aguaguuccgauauguacccucgaaaugugaauguuaucuuaugagacucuguuuuauuuguau

SEQ ID NO: 488260 - RNA, 64 nt, Human
cacaaauuuaauggcuuaaaacaacacaaaaucauuaucuuacaguucuggaggacugaagucc

SEQ ID NO: 488261 - RNA, 64 nt, Human
acuuacacaaaacuguuuugguaguuggauuucauuaucuuagugaauuuagucauuuuacaau

SEQ ID NO: 488262 - RNA, 64 nt, Human
agcucauaauaaugaauuccugcucugucuuuuauuaucuuaugucagagugcagcaaaaucuc

SEQ ID NO: 488263 - RNA, 64 nt, Human
aauauagugccccaaaaggcggaugcuucuuccauuaucuuauuuucuuugauacuuuauuuaa

SEQ ID NO: 488264 - RNA, 64 nt, Human
cugauacuaaggacguauccaggaguaccacaaccaccaccagugcuaccaccguugccacuga

SEQ ID NO: 488265 - RNA, 64 nt, Human
auaaaauauuguuacaaaaaauguacaguacugacaccaccacaaaucaugguuaauaaaagag

SEQ ID NO: 488266 - RNA, 64 nt, Human
ggcaccuggcaaaaggcauggccucccugaugaucaccaccaaggguagccccagaggggagcu

SEQ ID NO: 488267 - RNA, 64 nt, Human
aguaccggaaaggaagcucccauucaaaggaaauuuaucuuaagauacuguaaaugauacuaau

SEQ ID NO: 488268 - RNA, 64 nt, Human
gcauucaaauguggucacaaauauuguggacacauuaucuuauguuuugaaauaccugugaauu

SEQ ID NO: 488269 - RNA, 64 nt, Human
gauaaacguguauuccugaaacuuuuugacuuacuuaucuuacauguggugucuuccuguauau

SEQ ID NO: 488270 - RNA, 64 nt, Human
acacguggcuugguuuaaaaaggucaucuuagauuuaucuuaguaaauguaauaaauuauuuuu

SEQ ID NO: 488271 - RNA, 64 nt, Human
aucaugacuucuuuacuaacacuggcuagcuauauuaucuuauauacuaauaucauguuuuaaa

SEQ ID NO: 488272 - RNA, 64 nt, Human
gggaauugauaaaggagagugguugcuguuaauauuaucuuaucuauugggugguaugugaaau

SEQ ID NO: 488273 - RNA, 64 nt, Human
gcuuuauauuuuauaucugcaaauaaaucacauuuuaucuuauauuuagggaaagccggagagc

SEQ ID NO: 488274 - RNA, 64 nt, Human
uuauacguagccuaacacuuaaaaaaugcacucauuaucuuaaaccuaauaaauuccagaguuu

SEQ ID NO: 488275 - RNA, 64 nt, Human
ccuucccggguggaagaaggaguucacugaaaacuuaucuuaaacugacccuucccuuugagug

SEQ ID NO: 488276 - RNA, 64 nt, Human
auaauugagaacuacagcuuuuaagauuguacuuuuaucuuaaaagggugguaguuuucccuaa

SEQ ID NO: 488277 - RNA, 64 nt, Human
aagaaaagucagcaaagagauuuaaaucuuauauuuaucuuaaaagucccugauuuaugauaac

SEQ ID NO: 488278 - RNA, 64 nt, Human
agcuaggcacauuacucucugaacgaaauucauauuaucuuauuaaggaagaguguuggucuuc

SEQ ID NO: 488279 - RNA, 64 nt, Human
aggauaaacaaaauaccacugucuucaagaaacauuaucuuagguuuguuuguuugguuugagu

SEQ ID NO: 488280 - RNA, 64 nt, Human
uuugcuguaccauagacuuaaaauuccucuauuguuaucuuaugcuugagguaggcacugguuu

SEQ ID NO: 488281 - RNA, 64 nt, Human
agcacuacucugugccagccacacaaacguuuacuuaucuuaugccacgggaaguuuagagagc

SEQ ID NO: 488282 - RNA, 64 nt, Human
uggaggaggggacuccaggaauggggaaaugugacaccaccauccugaagccagcuugcaccuc

SEQ ID NO: 488283 - RNA, 64 nt, Human
cacauccuugguguguguaaguaccgaugcacgccaccaccaugccuguguuacagcagcucca

SEQ ID NO: 488284 - RNA, 64 nt, Human
cucagccuccugaguagcugauacuacaggcacccaccaccacgcccagcuaauuuuuuuguau

SEQ ID NO: 488285 - RNA, 64 nt, Human
gcaggaauuacaaggcaaugaagaauucuuaagguuaucuuagaguauauuaaugugagcuaua

SEQ ID NO: 488286 - RNA, 64 nt, Human
uuuuaacacacauaaaggauaaacuuuuagaaacuuaucuuacaaaguguauuuuauaaaauua

SEQ ID NO: 488287 - RNA, 64 nt, Human
aauauuuacucaaaguuaagcuuaaaaauaaguuuuaucuuaaaaucauauuugaagacaguaa

SEQ ID NO: 488288 - RNA, 64 nt, Human
uuagauaguaaagaauggcuacacuaagacugaauuaucuuauuagucuggcaagcauauaaag

SEQ ID NO: 488289 - RNA, 64 nt, Human
gcaagaugcuguuuaaaauuaccauauuguuuuuuuaucuuauacuuagcucucuggcuauuga

SEQ ID NO: 488290 - RNA, 64 nt, Human
agcaguuuauucaucugugaaaggaaaauaauacuuaucuuacaagguugcaagagcucaagga

SEQ ID NO: 488291 - RNA, 64 nt, Human
gcaauuaaaaaugugguuuaguuuuccaaacauguuaucuuaaauaccccuuuauccuuacagg

SEQ ID NO: 488292 - RNA, 64 nt, Human
uaggaagguuuugaaaauuguuugguuguagauuuuaucuuauccuuuaguguuguguuccuac

SEQ ID NO: 488293 - RNA, 64 nt, Human
uugauccuauuaugugagagauuuuccugauauguuaucuuauuuauauuuucccuuauuuucc

SEQ ID NO: 488294 - RNA, 64 nt, Human
aauaauauugugguaauuguaaguagugcauauuuuaucuuaaaaacucaggauugauguaagc

SEQ ID NO: 488295 - RNA, 64 nt, Human
uaguugcagaaauugaacacuagguggcacucaguuaucuuaacaggggaaguacugauacaau

SEQ ID NO: 488296 - RNA, 64 nt, Human
uuuugguuuuuuuaaaacugauaauaaugcugaauuaucuuaagugagauguuaagcccacuuu

SEQ ID NO: 488297 - RNA, 64 nt, Human
aauuuaucauauacacuugucaauuuuuccuuuguuaucuuaaaagaucugccuuagcaauggc

SEQ ID NO: 488298 - RNA, 64 nt, Human
uacuacugcucuaaaaguuggagaagucuugcaguuaucuuagcauuguauaaacagccuuaag

SEQ ID NO: 488299 - RNA, 64 nt, Human
uugauuauaugugaauacacaaauuuuacuggauuuaucuuaauaaaaagacucugacgaugau

SEQ ID NO: 488300 - RNA, 64 nt, Human
ccccaaacccaccacacaccagcagccacaaccucaccaccaacaaagaggacuuuuguggggc

SEQ ID NO: 488301 - RNA, 64 nt, Human
ccuuagccuggaagaugcagggaaccuccacgcccaccaccaugagcuggaguggggaugacaa

SEQ ID NO: 488302 - RNA, 64 nt, Human
gggaagccuggcuuacagugccauuucugcugggcaccaccaccugccugagggccuagcucac

SEQ ID NO: 488303 - RNA, 64 nt, Human
aggucuugauaugaagcuaaaagccuuauuuauauuaucuuaauauuucggcuaaaauguuaag

SEQ ID NO: 488304 - RNA, 64 nt, Human
aacaaaacuugcaucuaaccaaaaagucuugguuuuaucuuaauccauuaaaaaguuguucuuu

SEQ ID NO: 488305 - RNA, 64 nt, Human
aauagcuguacagaagcagguuuuauuuaucauguuaucuuauuaaaagaaaaagcccaaaaag

SEQ ID NO: 488306 - RNA, 64 nt, Human
auaaaauuguacuucguaaugaaaaugacacauuuuaucuuaaauuuagacaauaaacaaaacu

SEQ ID NO: 488307 - RNA, 64 nt, Human
uaggaagguuuugaaaauuguuucguuauagauuuuaucuuaucuuuugguguugucuugguuu

SEQ ID NO: 488308 - RNA, 64 nt, Human
ucaaaguguacguuuguguguucaucaccuuaaauuaucuuaauuugagacuuuuuuauaaugg

SEQ ID NO: 488309 - RNA, 64 nt, Human
gaguuaaagaaaccgaacaauaaguggcaaccaauuaucuuaacauuggaaauacuggggugcc

SEQ ID NO: 488310 - RNA, 64 nt, Human
uucuguauaacuuguauuauuagacucucuaguuuuaucuuaacacugaaacuguucuucauua

SEQ ID NO: 488311 - RNA, 64 nt, Human; identical to SEQ ID NO: 488310

SEQ ID NO: 488312 - RNA, 64 nt, Human
cacucucaccuguucgugagcgcaugaggcgaaguuaucuuauauuuccagguuuaacuaguug

SEQ ID NO: 488313 - RNA, 64 nt, Human
aauucacuagaaacauuaaccaauaggauuuuggugagcuuagcuucuguauuccuacugccgc

SEQ ID NO: 488314 - RNA, 64 nt, Human
agaaucuucugugcuuaggguuugcugcugcuggugagcuuagaauuuugggguugggaaaaag

SEQ ID NO: 488315 - RNA, 64 nt, Human
uugucuuaauugaaaaaagaccaaauauuucaaaugagcuuauaggcagcuguggccagugaaa

SEQ ID NO: 488316 - RNA, 64 nt, Human
aauaaugccaugggagucacacugaaagcaauuuugagcuuaucugucuuauuuaugcuuugag

SEQ ID NO: 488317 - RNA, 64 nt, Human
gagucacuuaggaggcagcaugagaacaguggcacaccaccagugaggcacauguugccuuuuu

SEQ ID NO: 488318 - RNA, 64 nt, Human
uacccucucacuggcugaaaagcaaaggggcccacaccaccauggcagaugcccucuggcgccu

SEQ ID NO: 488319 - RNA, 64 nt, Human
gauaauguauugcagugcggcucacaucacuguccaccaccaccuggagcggcucaucagaacu

SEQ ID NO: 488320 - RNA, 64 nt, Human
acuuagaaaggcaaaguacauuguaaaauaaaguugagcuuaguuuuuuuuaaaaaaaaaaaca

SEQ ID NO: 488321 - RNA, 64 nt, Human
ccuuuccuaaugcucacacaagcaccagguacccugagcuuauacugaguccagugguuccuau

SEQ ID NO: 488322 - RNA, 64 nt, Human
auuggcucuauaaacuaugugcccagcacuaugcugagcuuacacuaauuggucagacaugcug

SEQ ID NO: 488323 - RNA, 64 nt, Human
cuuuggaacgacaaaaugaaacagaacuugacccugagcuuaaauaacaaaacugugccaacua

SEQ ID NO: 488324 - RNA, 64 nt, Human
ucuuuuuaagcuuauuuaauuaaaaaauuuccagugagcuuaucaugcugucuuuacauggggu

SEQ ID NO: 488325 - RNA, 64 nt, Human
aaucuuauuaauuaggcuuauacagcgggggauuugagcuuacaggauuccuccaugguaaagc

SEQ ID NO: 488326 - RNA, 64 nt, Human
uaaagagcugcuaguagguucgcuuuaaaccacaugagcuuaaccaagaauauguuaugagaag

SEQ ID NO: 488327 - RNA, 64 nt, Human
ucugagaaaaccuuccugcagaggccagaaaccuugagcuuaggugccuggggaccagcuucga

SEQ ID NO: 488328 - RNA, 64 nt, Human
aaacuuuauaaauucauaacugguagcuauaacuugagcuuauucaggaugguuucuuuaaaac

SEQ ID NO: 488329 - RNA, 64 nt, Human
uguauucuuucugccuuuaauuuucuuguuuguuugagcuuagggaugagauacuuaugcaaga

SEQ ID NO: 488330 - RNA, 64 nt, Human
cuuuagaaaccacacucacacuuuugcagaguguugagcuuaauaacuaccugccacagauugg

SEQ ID NO: 488331 - RNA, 64 nt, Human
aguugaguacagugaggaggguggaggaaggugcugagcuuagccuugugcccugcccccaucu

SEQ ID NO: 488332 - RNA, 64 nt, Human
cguguccuuugcaggaaggagguaggcaccuuucugagcuuauucuauuccccacccacacccc

SEQ ID NO: 488333 - RNA, 64 nt, Human
gcuagaacuuuuggucugguagauguggccuuugugagcuuacaucaguuugcuuuucuggaau

SEQ ID NO: 488334 - RNA, 64 nt, Human
aguauauaccaaagcuuugacuuguuugagcucuugagcuuagaaguugauuuugcacuuauuu

SEQ ID NO: 488335 - RNA, 64 nt, Human
gaucccuuuggugaguaugguguucaggaugcaccaccaccaccucuagauaccuucaggcaac

SEQ ID NO: 488336 - RNA, 64 nt, Human
caggaucccuuuggugaguaugguguucaggaugcaccaccaccaccucuagauaccuucaggc

SEQ ID NO: 488337 - RNA, 64 nt, Human
ucagccucccaaagcagcugggacuacaggcaugcaccaccauacccagcccuagaaagcucuu

SEQ ID NO: 488338 - RNA, 64 nt, Human
uugaguugaaaacugcaaauaaaaguuugucacuugagcuuauguacagaaugcuauaugagaa

SEQ ID NO: 488339 - RNA, 64 nt, Human
gucugugacuaaagagggcacagcagggccagugugagcuuacagcgacguaagcccaggggca

SEQ ID NO: 488340 - RNA, 64 nt, Human
uucuuaguuucaaaugaccauuucccugaugcucugagcuuaugaucacacagagccaguccau

SEQ ID NO: 488341 - RNA, 64 nt, Human
acuaaaaguuuugagaaauuuuuuuuuccaguaaugagcuuaagaaauuuguggaaaauaacuc

SEQ ID NO: 488342 - RNA, 64 nt, Human
agcuaggaauaguuuagucaggacucagaaaauuugagcuuaguucugggauuaugaaaacaug

SEQ ID NO: 488343 - RNA, 64 nt, Human
cugcguuuuagagaucauaauucucaccuacuucugagcuuauuuuuccauuugauauucauug

SEQ ID NO: 488344 - RNA, 64 nt, Human
auuuaaauuuuaagucugagauuuuaaauguuuuugagcuuagaaaacccaguuagaugcaauu

SEQ ID NO: 488345 - RNA, 64 nt, Human
agaauuucacagauacuuuauaagccauaguacaugagcuuaauaggcuguguuuuguuucuca

SEQ ID NO: 488346 - RNA, 64 nt, Human
agucuuggcuuuaaagugaggggugacccuuuagugagcuuagcacagcgggauuaaacagucc

SEQ ID NO: 488347 - RNA, 64 nt, Human
uauuuuuuaaauaaacugacaaaugacaaaauggugagcuuaugauguuuacauaaaaguucua

SEQ ID NO: 488348 - RNA, 64 nt, Human
gcccuucuauuagcagccaaggaaaagggaaacaugagcuuauccagaacgguggcagagucuc

SEQ ID NO: 488349 - RNA, 64 nt, Human
uaauuauauugccuaauuguugggucuuuuuucuugagcuuauaauguaccuggaaaauaaacc

SEQ ID NO: 488350 - RNA, 64 nt, Human
cuggcaaacuucagacugaacauguacacugguuugagcuuagugaaauuacuucuggauaauu

SEQ ID NO: 488351 - RNA, 64 nt, Human
cuugguguucaaaaaccacguucuuagccuagauugagcuuagauugccucucuagacaacuac

SEQ ID NO: 488352 - RNA, 64 nt, Human
ccaacucuuuuaaauggugcccaacuuuucuaagugagcuuagcaaugagaagaaaaaaaaaca

SEQ ID NO: 488353 - RNA, 64 nt, Human
uggaaguauuuggacaaaaaccuaauagaagagucaccaccaaaugaagaauaaaacucccagg

SEQ ID NO: 488354 - RNA, 64 nt, Human
cucagccuccagaguagcugggacuauagacaugcaccaccacgcccggcuaauuuuguauuuu

SEQ ID NO: 488355 - RNA, 64 nt, Human
gugaggucaggucacugcggacaucaagggcggacaccaccaaggggcccucuggaacuugaga

SEQ ID NO: 488356 - RNA, 64 nt, Human
auagugagcuaugagaagagauuuagagccuagaugagcuuaggauagagagugggcucauugg

SEQ ID NO: 488357 - RNA, 64 nt, Human
acauguaaaacacacuaacacuaaccauaguugaugagcuuaaaaaaauaaaaauagaaaauug

SEQ ID NO: 488358 - RNA, 64 nt, Human
agcauguuuaaauugaaauggaacuuagagaacuugagcuuacuuacguacuucaaugccaccg

SEQ ID NO: 488359 - RNA, 64 nt, Human
aaaaaaaaacuuugccagccauuuacuugacuauugagcuuacuuacuuggacgcaacauugca

SEQ ID NO: 488360 - RNA, 64 nt, Human
uaaaauuguauagaccuaaaauaaaaugaaguggugagcuuaacccuggaaaaugaaucccucu

SEQ ID NO: 488361 - RNA, 64 nt, Human
agucuguuagauuuuauaaagauugguaguuaucugagcuuaaacauuuucucaauuguaaaau

SEQ ID NO: 488362 - RNA, 63 nt, Human
aauuaaaucagcaaggaugagcagaaaaugagcugagcuuagcucugcccuggaaccuaccag

SEQ ID NO: 488363 - RNA, 64 nt, Human
auaacggcuaggaauaauucugucaauauggaguugagcuuauuucuuuggaaacccuuuuaag

SEQ ID NO: 488364 - RNA, 64 nt, Human
gaggaaaaugggggaauggguugcaaaauagaaaugagcuuaauccaggccgcagagccaggga

SEQ ID NO: 488365 - RNA, 64 nt, Human
agccaguggccauuagauaaauaccuuucaagugugagcuuagacgucaacccuaaaauacuua

SEQ ID NO: 488366 - RNA, 64 nt, Human
uuggggugccacagacugcauccaucuaagacagugagcuuaguugauguguguguguguguuc

SEQ ID NO: 488367 - RNA, 64 nt, Human
aaugcuguauuagucacagagauaauucuagcuuugagcuuaagaauuuugagcaggugguaug

SEQ ID NO: 488368 - RNA, 64 nt, Human
ugcaaacuaacgugcacuuagauauccaagugggugagcuuagccacucuuacccaugcucuuu

SEQ ID NO: 488369 - RNA, 64 nt, Human
aaacugaaagcucuuugcaaccacacaccuucccugagcuuacaucacugcccuuuugagcaga

SEQ ID NO: 488370 - RNA, 64 nt, Human
gcaaugauuuguuuuauauuuggacuaagguucuugagcuuaucucccaagguacuuuccauaa

SEQ ID NO: 488371 - RNA, 64 nt, Human
cucagccuccugaguagcugggauuauaggcgugcaccaccaugcccagcuaauuuuuguauuu

SEQ ID NO: 488372 - RNA, 64 nt, Human
ugccaauaauaaaugcccucuucucgugccuccccaccaccacuuaccacucgugcaucccuga

SEQ ID NO: 488373 - RNA, 64 nt, Human
cucagccucccgaguaccugggacuauaugugcgcaccaccacgccuggcuaauuuuuuguauu

SEQ ID NO: 488374 - RNA, 64 nt, Human
caaucuacauaggcucaccagcuagaaacauuuaugagcuuacauuccuucuucccauaucuua

SEQ ID NO: 488375 - RNA, 64 nt, Human
uggagaaaggaagaauugugccuugcauauuacuugagcuuaaacugacaaccuggauguaaau

SEQ ID NO: 488376 - RNA, 64 nt, Human
cucagcuggccugucauauaaaacauacugucauugagcuuaagcuccgcuuguucugagguuu

SEQ ID NO: 488377 - RNA, 64 nt, Human
gccagccugugugcuugugggaacaccuuguaccugagcuuacagguaccaauaaagaggcuuu

SEQ ID NO: 488378 - RNA, 64 nt, Human
cagacuggcuuuuguuaccugacaugccguagggugagcuuagaggaagaaagaaaacaauuuu

SEQ ID NO: 488379 - RNA, 64 nt, Human
aagaaucuggagaugagauugauguuccaaaggaugagcuuaguauagaauuagaaaauuuauu

SEQ ID NO: 488380 - RNA, 64 nt, Human
uucccauaguguuucuucuauaacuugacguuggugagcuuauauuucccuuggaagagagcau

SEQ ID NO: 488381 - RNA, 64 nt, Human
ucucgaagauuuuaauuaaggaauugcuuauuguugagcuuagcaaauuaauaacacuauuucu

SEQ ID NO: 488382 - RNA, 64 nt, Human
aauggggcauuccuuuccacucuggcauaguucaugagcuuaauacauagcuuucuuuuaagaa

SEQ ID NO: 488383 - RNA, 64 nt, Human
gucaaguagcauguuucccauucacaggaaaaugugagcuuaucaguucuuucucuguauuuua

SEQ ID NO: 488384 - RNA, 64 nt, Human
uuuuaccugccuuaucugaauucuucuugaaacuugagcuuaaacucuaauagcuguuucccuu

SEQ ID NO: 488385 - RNA, 64 nt, Human
auauaaagccauaugagguuauauugaaauguauugagcuuauauugaaauuuauuguuccaau

SEQ ID NO: 488386 - RNA, 64 nt, Human
ucuugcucuaaugaucaaaacaugcuugaauaacugagcuuagaguauaccuccuauaugucca

SEQ ID NO: 488387 - RNA, 64 nt, Human
uaaugguacuauuuagaagcccaguuagucuuacugagcuuaugcuucacuccuuuauguuuaa

SEQ ID NO: 488388 - RNA, 64 nt, Human
auugcccggucugacccugcaggaagcaaagaggugagcuuaaagaacaaccaaacucugccag

SEQ ID NO: 488389 - RNA, 64 nt, Human
auuuccacaaucccagggaucuacagaacuauuucaccaccagauaugaccuaguuuuauauuu

SEQ ID NO: 488390 - RNA, 64 nt, Human
uaagugcaauaguugacuuuuaaccaaccaccaccaccaccaaaaccaguuuaugcaguuggac

SEQ ID NO: 488391 - RNA, 64 nt, Human
cuguaagugcaauaguugacuuuuaaccaaccaccaccaccaccaaaaccaguuuaugcaguug

SEQ ID NO: 488392 - RNA, 64 nt, Human
uuuaauuuuagagaaacuuugaguacagauacugugagcuuacauugaaaacagauauuacagc

SEQ ID NO: 488393 - RNA, 64 nt, Human
ugccauguuucuuaaaaucaaguaaaaagacuuaugagcuuaaaaaaaagugaguuugagaggg

SEQ ID NO: 488394 - RNA, 64 nt, Human
uauuuuaucuaauuuuuuuuuuuuuuugguauacugagcuuauagacuaugagagaaaagugag

SEQ ID NO: 488395 - RNA, 64 nt, Human
uugagcugcuguugaaguggugagugcuguguuuugagcuuauuuugaaccuagauccuuguga

SEQ ID NO: 488396 - RNA, 64 nt, Human
acuuguuuaauuuuaauuuucauugucaauauuuugagcuuagaacauuuaugguauaaaaauu

SEQ ID NO: 488397 - RNA, 64 nt, Human
ggugggggagguccaucucagaacaccccagccuugagcuuagcugcaggcccaggcccucugc

SEQ ID NO: 488398 - RNA, 64 nt, Human
gaucaucaaagaaaaccauuguuacuaucuccuuugagcuuaggaaaauguacaagagaacaaa

SEQ ID NO: 488399 - RNA, 64 nt, Human
aagcauggaaaaucagugacaucugauuggcagaugagcuuauuucaaaaggaaggguggcuuu

SEQ ID NO: 488400 - RNA, 64 nt, Human
uggcacaguaccauauaacuggaguaauaaaacaugagcuuacauucuuacaauaacuaaacca

SEQ ID NO: 488401 - RNA, 64 nt, Human
agagagagugagagagucguguuucguaagugccugagcuuaggaaguuuucuucuggauauau

SEQ ID NO: 488402 - RNA, 64 nt, Human
aucuugaucuuccagguaccccauguaccuuuauugagcuuaauuauaauacugucaaauugcc

SEQ ID NO: 488403 - RNA, 64 nt, Human
ucuuaaaugaaauuaaaaggcaaaagaacaugauugagcuuaaaugaucauuucuuccugcagu

SEQ ID NO: 488404 - RNA, 64 nt, Human
agcauggaagagaaguguaaccaugcaaauacaaugagcuuaauaugcuaacuuuagcaagaug

SEQ ID NO: 488405 - RNA, 64 nt, Human
aaaauaugaaaguaaauagugaaaagguaaguuaugagcuuagauuaccuagauuauuccagua

SEQ ID NO: 488406 - RNA, 64 nt, Human
aaauuguuuugugaauaaaacucagaaaugaagaugagcuuaauuaaccuaguauacuggguga

SEQ ID NO: 488407 - RNA, 64 nt, Human
uuacuguaagugcaauaguugacuuuuaaccaaccaccaccaccaccaaaaccaguuuaugcag

SEQ ID NO: 488408 - RNA, 64 nt, Human
cucagccucccgaguagcuggaauuauaggcgugcaccaccacgcccagcuaauuuuuguauuu

SEQ ID NO: 488409 - RNA, 64 nt, Human
ccucaucaccaucccucuucuuggccccaucccccaccaccauuccuuuccucccuucccccug

SEQ ID NO: 488410 - RNA, 64 nt, Human
cacuuuuuuccuugguauguuauugaguauauucugagcuuaguuuucucuacagugauacuuu

SEQ ID NO: 488411 - RNA, 64 nt, Human
auucacuuauuugugguuuuuuucucagcuauucugagcuuauuuauuuauuuguauguucuaa

SEQ ID NO: 488412 - RNA, 64 nt, Human
agguaacugcagaaauagcaaauuaaaugauuaaugagcuuauuagucauaguaaacauacaga

SEQ ID NO: 488413 - RNA, 64 nt, Human
aaaaacugacagaugcuuuugcuaauaccaaaauugagcuuacaauuaggaacugaguaugugu

SEQ ID NO: 488414 - RNA, 64 nt, Human
ucuacuggcagcugauacguuuaacucauuuccuugagcuuauacaaaacauagaaaagcaaac

SEQ ID NO: 488415 - RNA, 64 nt, Human
guggaggagguagaauugcagaucagauaaaaagugagcuuacacuugaacuuaguuauucacu

SEQ ID NO: 488416 - RNA, 64 nt, Human
acauauucucaauguacaguaaaacagacagaagugagcuuaucuguuugaugcuguggcaggg

SEQ ID NO: 488417 - RNA, 64 nt, Human
ucccugauggcgaaugauauugagcaucuuuucaugagcuuauuggccauuugcauaucuucuu

SEQ ID NO: 488418 - RNA, 64 nt, Human
ugguggucuuacugagcugggugggugucuguuuugagcuuauuuagaguccuaguuuuccuac

SEQ ID NO: 488419 - RNA, 64 nt, Human
ugcuaaauggauuagaugaauguacuucuuuuugugagcuuacuugccuggauugcuuuaaaau

SEQ ID NO: 488420 - RNA, 64 nt, Human
gggauuugcacuaaaauuauaucaaggucucagaugagcuuagugcacaagcacuaucacuuua

SEQ ID NO: 488421 - RNA, 64 nt, Human
cuauaugacacaaaguaugauaccuuuaaaaaggugagcuuauauauuguuuauuaaccuggaa

SEQ ID NO: 488422 - RNA, 64 nt, Human
uuggauggaugaagucagagagguggggugagggugagcuuacucagggcccccagaggaagcc

SEQ ID NO: 488423 - RNA, 64 nt, Human
accaugaguaaaguauacuuuugcauuaauuuuuugagcuuauaugcaaacauaauaaauauua

SEQ ID NO: 488424 - RNA, 64 nt, Human
caaaaaugauuguuaaugauuggugcucuuaaagugagcuuaaaauuuauccaagacguauauc

SEQ ID NO: 488425 - RNA, 64 nt, Human
aaacaaaacaaaacaaaacacaguccugcauacucaccaccaagcucaagaaauaaaucaucac

SEQ ID NO: 488426 - RNA, 64 nt, Human
cucagccucccaaguaacuaagacuacaggcaugcaccaccauacccaacuaauuuuauuuuuu

SEQ ID NO: 488427 - RNA, 64 nt, Human
ccucccaggucagccucccaaguagcugggauuacaccaccaugcccagcuacuaaaaauacuu

SEQ ID NO: 488428 - RNA, 64 nt, Human
cuaccugugagagauauuuguaguccuaugugaaugagcuuaucccuccacaaccaggugcaua

SEQ ID NO: 488429 - RNA, 64 nt, Human
ucuugugaaaugguuuccuugacaaaauuuaagcugagcuuaaaagcaaaaaacaaaaaguaca

SEQ ID NO: 488430 - RNA, 64 nt, Human
ggcccgaggaagccucucuggggccagggguagcugagcuuaaaggcccuggguccugccaguu

SEQ ID NO: 488431 - RNA, 64 nt, Human
cauucuuugccuuccuggagcucccagccagagcugagcuuaggcacccgaguggagccugcag

SEQ ID NO: 488432 - RNA, 64 nt, Human
uaaugaauauauaagaacuguacucuucucagcuugagcuuacauagguaaauaucaccaacau

SEQ ID NO: 488433 - RNA, 64 nt, Human
uaggucuagaauauuuuuuuaaaagccucugaacugagcuuaaaacuggcgauuuuaugaaaug

SEQ ID NO: 488434 - RNA, 64 nt, Human
uuauuuugugcauuauauuuauauguuaagagccugagcuuagaaguauuuuuuucaaagaaau

SEQ ID NO: 488435 - RNA, 54 nt, Human
accccuccucccagccuuaaugcaugagcuuagucugaauuucaaguugggacu

SEQ ID NO: 488436 - RNA, 64 nt, Human
ugaagccugcuuaaacugugugaugugcaauaacugagcuuagaguuaggaauuguguucaagu

SEQ ID NO: 488437 - RNA, 64 nt, Human
auugggaugcaugagaucccaugaucuuguguauugagcuuauuguugaaagggauuuuugaag

SEQ ID NO: 488438 - RNA, 64 nt, Human
cugaauaagacaucagcauucuucagcauugucaugagcuuaauauacuuaaauucuacuacuc

SEQ ID NO: 488439 - RNA, 64 nt, Human
ccauaagcucaaggcugugacuggggaaaaagauugagcuuaguuuucaugucuaggaaaaaaa

SEQ ID NO: 488440 - RNA, 64 nt, Human
cccgcucucugaccuucugacuccugugggcuccugagcuuacaaagcauggcaggccaagggc

SEQ ID NO: 488441 - RNA, 64 nt, Human
auguugaaguucuaaccccagguacccaugaaugugagcuuaccagggucuuugcagauguaau

SEQ ID NO: 488442 - RNA, 64 nt, Human
ggucaaaagcaccauccucguacuguugucacuaugagcuuaagaaauuugauaccauaaaaug

SEQ ID NO: 488443 - RNA, 64 nt, Human
auuccuuguugguuucugguucagagugcucucccaccaccagagacaaguggguaaaaagguc

SEQ ID NO: 488444 - RNA, 64 nt, Human
aucgugcugcucccuggccagccuuuggccacagcaccaccagcugcuguugcugagagagcuu

SEQ ID NO: 488445 - RNA, 64 nt, Human
gagaaacacaaaauuuugaggcuagacccaugaucaccaccaacuauaauugcacaaggucuug

SEQ ID NO: 488446 - RNA, 64 nt, Human
caugggagagaagggaggaggugggcacagguggugagcuuaugugugggcacucuacugccuc

SEQ ID NO: 488447 - RNA, 64 nt, Human
cgaggugcaaauucauuucauggugacugacccuugagcuuaaacagaagcagcaaaugaaaga

SEQ ID NO: 488448 - RNA, 64 nt, Human
ggcagagaugaucaaucaucauauuaaaucauaaugagcuuauaauccucccacuggagcugcu

SEQ ID NO: 488449 - RNA, 64 nt, Human
ggugcuggaacaucgaugaaggagcccuacuuacugagcuuaguuauggacuuuuuugaugcau

SEQ ID NO: 488450 - RNA, 64 nt, Human
ugugccauucacacuggucuuuuucacauuguuuugagcuuauugcaguauauguuuugggauu

SEQ ID NO: 488451 - RNA, 64 nt, Human
uuccuguauuuuaugugcaucauagugauuuaucugagcuuagugacccccaucuuguaaccug

SEQ ID NO: 488452 - RNA, 64 nt, Human
uuaauucauguauuaugauuaaaucugaggcagaugagcuuacaaguauugaaauaauuacuaa

SEQ ID NO: 488453 - RNA, 64 nt, Human
gcuuuuugcacuguuuguucucuuaucuguauuuugagcuuagugcuaggacugagaggcugca

SEQ ID NO: 488454 - RNA, 64 nt, Human
uuaggccuucuuccuauccccaucucuggccucuugagcuuaagcuuguauuguccuggaauca

SEQ ID NO: 488455 - RNA, 64 nt, Human
caccucauguuugaauccuguuguagaauggaaaugagcuuaaauuacccaagcuuacuuucca

SEQ ID NO: 488456 - RNA, 64 nt, Human
uugaugcaccaggccugacuuugucuccucuuucugagcuuagggggcuaggguggccauuuag

SEQ ID NO: 488457 - RNA, 64 nt, Human
uuuaaucuaauuuuuuucuaaucaaaaagaaaauugagcuuaaggcaaaaggccugguuuuaga

SEQ ID NO: 488458 - RNA, 64 nt, Human
ggguggacuucggagaaauucucauacugaagcaugagcuuaggaguuucuguuagugguagug

SEQ ID NO: 488459 - RNA, 64 nt, Human
cuauagaaacauuuguugcaucugucccucugccugagcuuagaagguuauagaaaaaggguau

SEQ ID NO: 488460 - RNA, 64 nt, Human
uuuaagcuucauauccucagugcuuguagaaugaugagcuuagagguaccaggucauugcaguu

SEQ ID NO: 488461 - RNA, 64 nt, Human
ugguuggaaggauagacugcccccuaccucccaccaccaccaugaaguuuggugacuugaggcu

SEQ ID NO: 488462 - RNA, 64 nt, Human
augugguuggaaggauagacugcccccuaccucccaccaccaccaugaaguuuggugacuugag

SEQ ID NO: 488463 - RNA, 64 nt, Human
auuggauuagaccaauuacugcacucuuaaacagcaccaccauuuaauuucauguauaucuaac

SEQ ID NO: 488464 - RNA, 64 nt, Human
acucaguuuaaauuggugauggacguugcuugauugagcuuauuacucucuauuuugagaaggu

SEQ ID NO: 488465 - RNA, 64 nt, Human
cugucaguaauuuauuagaccuggcagcuuugggugagcuuagauuuuucaccuucaguguuac

SEQ ID NO: 488466 - RNA, 64 nt, Human
uuacuaaccccaugauaaaaggagaagacaacagugagcuuagaauaucuauaaagcaaaaaau

SEQ ID NO: 488467 - RNA, 64 nt, Human
uuaaagaagaccugagaauguauccccaaaagcgugagcuuaaaauacaagacugccauauuaa

SEQ ID NO: 488468 - RNA, 64 nt, Human
uuaaaaaacugaauugccugaccucguuaucacaugagcuuauauuuugggaacacauagaacu

SEQ ID NO: 488469 - RNA, 64 nt, Human
uauaggccauggguggcucaaaacuuugaacauuugagcuuaaacaaaugccacucucaugcau

SEQ ID NO: 488470 - RNA, 64 nt, Human
cauuuaagaaaauaugaaagcuuaaggaauuaugugagcuuaaaacuagucaagcaguuuagaa

SEQ ID NO: 488471 - RNA, 64 nt, Human
gaauauggugucuauuauagugaaacauguacuuugagcuuauuguuuuuauucuguauuaaau

SEQ ID NO: 488472 - RNA, 64 nt, Human
aaauaaggcugagaccuacugggcugcauucccaugagcuuaggcauucuaagucacaggauga

SEQ ID NO: 488473 - RNA, 64 nt, Human
aacgguagugggcccucaggggcgauuagcuuagugagcuuaccccgccggagcgggggagcgc

SEQ ID NO: 488474 - RNA, 64 nt, Human
gggggcgacuggccuuuuucccaugugugcagucugagcuuaggcacacacaggaggguuccag

SEQ ID NO: 488475 - RNA, 64 nt, Human
aucuuagccauucuauccuagaaagauuuuaaugugagcuuaagauguaaauaaauaauuuugc

SEQ ID NO: 488476 - RNA, 64 nt, Human
uguggaagggauuucuguacagggucauucuaggugagcuuacacauuccuuccaaccccaagg

SEQ ID NO: 488477 - RNA, 64 nt, Human
auccauaugguccauccuaauucacagaauuaaaugagcuuaaauagaaaauucaguauuuuau

SEQ ID NO: 488478 - RNA, 64 nt, Human
uuuuuguuuugguuuguuguugccauucuagcaaugagcuuaguccuuguacaucugcauuaag

SEQ ID NO: 488479 - RNA, 64 nt, Human
aaaagucagagacagauaccuccaacccugccgucaccaccaccccuaccacauauguccacau

SEQ ID NO: 488480 - RNA, 64 nt, Human
cucagccucccaaguagcugggauuacaggcaugcaccaccaugcccagcuaauuuuuguauuu

SEQ ID NO: 488481 - RNA, 64 nt, Human
cuuguccugucacuggaucugggcuaaaguccuccaccaccacucuggaccuaagaccuggggu

SEQ ID NO: 488482 - RNA, 64 nt, Human
uaauaccuuguaaguugcuuuuguuuguaaaaucugagcuuauaguuuuccuuagugaguaaau

SEQ ID NO: 488483 - RNA, 64 nt, Human
uaaagcugcuggaugaaaugguccagugccaaaaugagcuuaaaaucuuuguuuccaggaauua

SEQ ID NO: 488484 - RNA, 64 nt, Human
gugagccacugugccuggcugaguuuucuuaaagugagcuuaauuucugaacucuuagugauuc

SEQ ID NO: 488485 - RNA, 64 nt, Human
aggguuuuaaauuauguaaaauguuuacuuauucugagcuuagagagaauggggaggguauuuu

SEQ ID NO: 488486 - RNA, 64 nt, Human
agaaucacaucaaccugggaggcggagguugcagugagcuuagaucaugccaccaugccacugc

SEQ ID NO: 488487 - RNA, 64 nt, Human
auuggaucaucacuugaaucaagauuuugacuagugagcuuaauuguccauuucuuacaauuuc

SEQ ID NO: 488488 - RNA, 64 nt, Human
aaaaauuuggaaguauuuacauccucuuucaagaugagcuuauaugacacaauuauuauuugcu

SEQ ID NO: 488489 - RNA, 64 nt, Human
auauuuaauuaaagccuuacugaagaauaagaaaugagcuuagaaugacuaguguucuuugaaa

SEQ ID NO: 488490 - RNA, 64 nt, Human
cuuaaccgaggugcuucuaguuggugagcaguguugagcuuagaaguggugugugcucugucug

SEQ ID NO: 488491 - RNA, 64 nt, Human
accacuuguuuauguauauguaggugauguuacuugagcuuaaauguacuuuacugagcaaagu

SEQ ID NO: 488492 - RNA, 64 nt, Human
gucaaucuggcaagaaauaugacuugcuuuuugcugagcuuaauucagauaucaguaaaauuaa

SEQ ID NO: 488493 - RNA, 64 nt, Human
ucucuuucugucuucuacagaugagucacaccuuugagcuuaaucuuugaaagguuagagaaua

SEQ ID NO: 488494 - RNA, 64 nt, Human
ggcuguuugaccagaccacaaaguucacaucuccugagcuuaguguccguggcuguccaccucc

SEQ ID NO: 488495 - RNA, 64 nt, Human
cuucaggggugugucagggaugaggacgggugccugagcuuagguuguggaguggcugagaggg

SEQ ID NO: 488496 - RNA, 64 nt, Human
agcuggucagacggcccuuucuaauccuacauguugagcuuauguaaaaaauguuguuuccucc

SEQ ID NO: 488497 - RNA, 64 nt, Human
cucagccucccauguagcaggaaccacaggcaggcaccaccauacccagcuaauuuuuguauuu

SEQ ID NO: 488498 - RNA, 64 nt, Human
cggccacgucccugcacucucagcccccgcccgucaccaccaccggccaccugaguguccguga

SEQ ID NO: 488499 - RNA, 64 nt, Human
cucagccucccgaguagcugggacuacaggcgcccaccaccacgcccggcuaauuuuuuguauu

SEQ ID NO: 488500 - RNA, 64 nt, Human
aauuaaauacaaaacugagaagucuaguugcuguugagcuuaaucuuuuuaauccaaaggugcu

SEQ ID NO: 488501 - RNA, 64 nt, Human
ggcugacuugcuaagucugacagugacaaacuugugagcuuacugcagucagucacagaggcug

SEQ ID NO: 488502 - RNA, 64 nt, Human
uuguccuuucauguaaauuauucuggauguagauugagcuuauuaaauguuacacacaaaguau

SEQ ID NO: 488503 - RNA, 64 nt, Human
ugguaggaaagaaagucaggucaagugaugcuuuugagcuuacacacaauucacaggcccacca

SEQ ID NO: 488504 - RNA, 64 nt, Human
aguugacaaauaaauaaaagguaguguuuaugucugagcuuauuguguuugagcuaacaccagg

SEQ ID NO: 488505 - RNA, 64 nt, Human
uauugaggccagcagaauaggugcagagaugaagugagcuuagagauguugcaaaugcucuuua

SEQ ID NO: 488506 - RNA, 64 nt, Human
gcacacauuguguuaacuuaugucucuuguuaaaugagcuuaaugucuuuguguuuuguccaaa

SEQ ID NO: 488507 - RNA, 64 nt, Human
acuguagacuguagaaagcacgggccccaggcucugagcuuaguaauaaccuggcugguagauu

SEQ ID NO: 488508 - RNA, 64 nt, Human
uucugugaaaggagcagaaugugaggagcacgcgugagcuuauguaccgugaagaugaucagag

SEQ ID NO: 488509 - RNA, 64 nt, Human
uuuagaggaagaaugagagcuuuguguguuuaacugagcuuauaguaggacuucuuugcauaug

SEQ ID NO: 488510 - RNA, 64 nt, Human
agggaaaccaggcagacggcugcucuuuuugaguugagcuuaacucuccuugucugaacuuggu

SEQ ID NO: 488511 - RNA, 64 nt, Human
cuauaaauauagauuauuuguucaauaaacuggcugagcuuagagagaggugcagaauuccugg

SEQ ID NO: 488512 - RNA, 64 nt, Human
agaugccuggcuggaccguaggagcgcugugcucugagcuuagaaagggagguggcggauggag

SEQ ID NO: 488513 - RNA, 64 nt, Human
gauccgucccccuggccccucaguguccaugucuugagcuuaauaaaugugcauuugguuuuuu

SEQ ID NO: 488514 - RNA, 64 nt, Human
uauucaauggaaucauauaguauguaaccuguuuugagcuuaaaaaaaaaguauacaugacuuu

SEQ ID NO: 488515 - RNA, 64 nt, Human
ccagcugguaggaucccugagccccuugcgauaucaccaccaagagccugauaacugagcaggg

SEQ ID NO: 488516 - RNA, 64 nt, Human
uuuuuaaacucaauaauuuugugaaaaaaaaaaccaccaccaaacuuuugguuguaaaagagaa

SEQ ID NO: 488517 - RNA, 64 nt, Human
uucagccucuugaauagcugggacuagaagcaugcaccaccaugcccaucuaauauuuguauuu

SEQ ID NO: 488518 - RNA, 64 nt, Human
uuuuauguucuaagaaguauuauuuauucuaugcugagcuuacauagaauuucuuccauguuuu

SEQ ID NO: 488519 - RNA, 64 nt, Human
gcgcccuuacauucugcacuucauaguuggauucugagcuuaggaucaucuggagaccccaugg

SEQ ID NO: 488520 - RNA, 64 nt, Human
auauuaugauuagcucuuuuccuuucuuuggcucugagcuuaauuguacauuaagcaaacuuaa

SEQ ID NO: 488521 - RNA, 64 nt, Human
uauuaucagguuucaucauagauuucaacguaagugagcuuauuguugauagaaacaugaugac

SEQ ID NO: 488522 - RNA, 64 nt, Human
acugagugucguggcugcuccaaaugccccuucaugagcuuauuauggaccgucauugaggggu

SEQ ID NO: 488523 - RNA, 64 nt, Human
ccuaaagaugcuuuguaaagcuguauuuuacccuugagcuuagccgcgggucccugugaaccgg

SEQ ID NO: 488524 - RNA, 64 nt, Human
uuuguaugaaaacauggaacaguguggccucuucugagcuuacguaguucuaccggcuuugcca

SEQ ID NO: 488525 - RNA, 64 nt, Human
agacaaggaugaagucucaguugcugauacucgcugagcuuacuggcccucuaacccaguguuu

SEQ ID NO: 488526 - RNA, 64 nt, Human
cauuagaugcugguaaaagcuagaggagacacaaugagcuuaguaccuccaacuuccuuucuuu

SEQ ID NO: 488527 - RNA, 64 nt, Human
uuaaaccgaggugguccaggcaccagcagggaccugagcuuaggacaagcaugcuuggaaccuc

SEQ ID NO: 488528 - RNA, 64 nt, Human
ggcgguucucauuuuguuauuaguggaagagccuugagcuuaaaagcucuucauuuucuuugcc

SEQ ID NO: 488529 - RNA, 64 nt, Human
cucaauuacuauuuucccuauaagaguuucagcaugagcuuaauuaaauucuugugaaaaaacc

SEQ ID NO: 488530 - RNA, 64 nt, Human
auuuaaaaaagcaaauggaaaauguauauuuugaugagcuuaggguguuuuuuuuuugaaaguc

SEQ ID NO: 488531 - RNA, 64 nt, Human
ugaaguucugugcauacaggaagaaguuauuuucugagcuuagauaauacuauguguauaugug

SEQ ID NO: 488532 - RNA, 64 nt, Human
uauuugucuuguccacauugugauguucaguauuugagcuuauagugaacugagcaaucauaaa

SEQ ID NO: 488533 - RNA, 64 nt, Human
aaugauuuaaagagucgacuauacaaaaaucaaucaccaccacgaggacaagagggcaaaagca

SEQ ID NO: 488534 - RNA, 64 nt, Human
uuggcuggauuguacuacuuuaccucuacuuuaccaccaccacccuuuuccucccuccuuucca

SEQ ID NO: 488535 - RNA, 64 nt, Human
ucuguaaaaugcugcacugcagcaaaaacaaaaccaccaccaccccagagaaaaccauguacua

SEQ ID NO: 488536 - RNA, 64 nt, Human
ugauugaaacuuacacguuuuauucuacucauagugagcuuauucuuauuuuggauugauuuuc

SEQ ID NO: 488537 - RNA, 64 nt, Human
cugcagcaggcuguuugucuuggaagcuuuuguuugagcuuauaagaacauagacagcuuuuuu

SEQ ID NO: 488538 - RNA, 64 nt, Human
ucuccuaagcccaucacuguggcacacuguagagugagcuuauaguuuaauugagauauuuauc

SEQ ID NO: 488539 - RNA, 64 nt, Human
aagacccuuauugacuuugaaaaacuggcauaaaugagcuuaagaaauccauuguauacagucc

SEQ ID NO: 488540 - RNA, 64 nt, Human
uuuaggauuaguuuuaguuuuuuguuugcuuauaugagcuuagcguaaagaauauuuuuaaacu

SEQ ID NO: 488541 - RNA, 64 nt, Human
uaaaaauauucagcauaaauccagcagagguggcugagcuuaauugcuuaaauaaguucuagaa

SEQ ID NO: 488542 - RNA, 64 nt, Human
agaaaugugggguggucagggacauucggauaauucgggcuauuuguauucaggugugagcugg

SEQ ID NO: 488543 - RNA, 64 nt, Human
gagugcugggggaggccauccaagauggcaugaaucgggcuaaggucccugggggugcagaugg

SEQ ID NO: 488544 - RNA, 64 nt, Human
uuaaauuguggcucugucauuuaucucugugacuucgggcuagauguuuaacuuucuaagccuc

SEQ ID NO: 488545 - RNA, 64 nt, Human
ucucuuguugaccccuuuguugcaggaaugugcgucgggcuagguuauccaugaguuucuuuau

SEQ ID NO: 488546 - RNA, 64 nt, Human
aaaauguuuuccuuuuguuuuaccaggaaugaguucgggcuauacucuuugaaacugccuuugu

SEQ ID NO: 488547 - RNA, 64 nt, Human
uaucugaccuuacgugccuuuugaacuaggagaaucgggcuaauuuauuaaugaugauaauuau

SEQ ID NO: 488548 - RNA, 64 nt, Human
ucucacaagccagccaacucuuucucucugggcuucgggcuaugcaagagcguugucuaccuuc

SEQ ID NO: 488549 - RNA, 64 nt, Human
ggaauugggucgaaggaguggagaaugggagggcucgggcuacugagaguggagaugggggcgg

SEQ ID NO: 488550 - RNA, 64 nt, Human
ccuccuauuaaguguaacaaauaguuaagcaaacucgggcuacaaacaaagacuuugcuaccuc

SEQ ID NO: 488551 - RNA, 64 nt, Human
cucugccucuaaggccaaggccucaggagagcaucaccaccacaccccugccggccuuggccuu

SEQ ID NO: 488552 - RNA, 64 nt, Human
cacagacuuugcccggccucaucugccuggcacgcaccaccagucacaaccuaugcagcgcccc

SEQ ID NO: 488553 - RNA, 64 nt, Human
aagauuauuuagucaccuuucuccuguccaacuucaccaccaccugauaauggguauauaacag

SEQ ID NO: 488554 - RNA, 64 nt, Human
ggcuuggaaccguaggacccaagcagagaagcucucgggcuaggaagaucucugcagggccgcc

SEQ ID NO: 488555 - RNA, 53 nt, Human
acagugauaaugaaagcuaagccucgggcuaauuuccccauagccguggggug

SEQ ID NO: 488556 - RNA, 64 nt, Human
ccccgcagugcauaccggacuugucacacggaccucgggcuaguuaaggugugcaaagaucucu

SEQ ID NO: 488557 - RNA, 64 nt, Human
cgugagcaguuggugauuuuaguuggucugguguucgggcuaagaauauuuuauuguggacuua

SEQ ID NO: 488558 - RNA, 64 nt, Human
aggccaggggagggcaucuggaccagggcauccgucgggcuauugucacagagaaaagaagaga

SEQ ID NO: 488559 - RNA, 64 nt, Human
agaggugggggucggcgccuucuaccugcaggacucgggcuaaguccaguucaagagucuccug

SEQ ID NO: 488560 - RNA, 64 nt, Human
uuuuguucccuucugucugcucgaaccacuugccucgggcuaaucccucccucuuccuccaccc

SEQ ID NO: 488561 - RNA, 64 nt, Human
uccuccuggcugaagcuguuugucaggauuacccucgggcuaaagaggaaaaauaaagauguug

SEQ ID NO: 488562 - RNA, 64 nt, Human; identical to SEQ ID NO: 446897

SEQ ID NO: 488563 - RNA, 64 nt, Human; identical to SEQ ID NO: 446898

SEQ ID NO: 488564 - RNA, 64 nt, Human; identical to SEQ ID NO: 446899

SEQ ID NO: 488565 - RNA, 64 nt, Human; identical to SEQ ID NO: 446900

SEQ ID NO: 488566 - RNA, 64 nt, Human; identical to SEQ ID NO: 446901

SEQ ID NO: 488567 - RNA, 64 nt, Human
cucagccuccugaguagcugagacuacaggugcacaccaccaagccuggcuuuauguauuuauu

SEQ ID NO: 488568 - RNA, 64 nt, Human
uuauaucaauauuuagacuauggcagauagcuaccaccaccacagggugcuaaaagaaacagug

SEQ ID NO: 488569 - RNA, 64 nt, Human
uucuccaccugaagugaugauggaugagaaaaaacaccaccaaaugacaagucacacccucccc

SEQ ID NO: 488570 - RNA, 64 nt, Human; identical to SEQ ID NO: 446902

SEQ ID NO: 488571 - RNA, 64 nt, Human; identical to SEQ ID NO: 446906

SEQ ID NO: 488572 - RNA, 64 nt, Human; identical to SEQ ID NO: 446907

SEQ ID NO: 488573 - RNA, 64 nt, Human; identical to SEQ ID NO: 446908

SEQ ID NO: 488574 - RNA, 64 nt, Human; identical to SEQ ID NO: 446909

SEQ ID NO: 488575 - RNA, 64 nt, Human; identical to SEQ ID NO: 446910

SEQ ID NO: 488576 - RNA, 64 nt, Human; identical to SEQ ID NO: 446911

SEQ ID NO: 488577 - RNA, 64 nt, Human; identical to SEQ ID NO: 446912

SEQ ID NO: 488578 - RNA, 64 nt, Human; identical to SEQ ID NO: 446913

SEQ ID NO: 488579 - RNA, 64 nt, Human; identical to SEQ ID NO: 446914

SEQ ID NO: 488580 - RNA, 64 nt, Human; identical to SEQ ID NO: 446915

SEQ ID NO: 488581 - RNA, 64 nt, Human; identical to SEQ ID NO: 446916

SEQ ID NO: 488582 - RNA, 64 nt, Human; identical to SEQ ID NO: 446917

SEQ ID NO: 488583 - RNA, 64 nt, Human; identical to SEQ ID NO: 446918

SEQ ID NO: 488584 - RNA, 64 nt, Human; identical to SEQ ID NO: 446919

SEQ ID NO: 488585 - RNA, 64 nt, Human; identical to SEQ ID NO: 446920

SEQ ID NO: 488586 - RNA, 64 nt, Human
cuuagccucccaaguagcugggauuacaggcgugcaccaccacgcccaguugauuuuuguauuu

SEQ ID NO: 488587 - RNA, 64 nt, Human
ccucagccaccugacuagcugggauugcagccugcaccaccacaccuggcuaaauuuuuguugu

SEQ ID NO: 488588 - RNA, 64 nt, Human
agucauuuauuauuuuauaaauugagaacaaccacaccaccaaaugucacaccuucuuauaaag

SEQ ID NO: 488589 - RNA, 64 nt, Human; identical to SEQ ID NO: 446921

SEQ ID NO: 488590 - RNA, 64 nt, Human; identical to SEQ ID NO: 446922

SEQ ID NO: 488591 - RNA, 64 nt, Human; identical to SEQ ID NO: 446923

SEQ ID NO: 488592 - RNA, 64 nt, Human; identical to SEQ ID NO: 446924

SEQ ID NO: 488593 - RNA, 64 nt, Human; identical to SEQ ID NO: 446925

SEQ ID NO: 488594 - RNA, 64 nt, Human; identical to SEQ ID NO: 446373

SEQ ID NO: 488595 - RNA, 64 nt, Human; identical to SEQ ID NO: 446374

SEQ ID NO: 488596 - RNA, 64 nt, Human; identical to SEQ ID NO: 446375

SEQ ID NO: 488597 - RNA, 64 nt, Human; identical to SEQ ID NO: 442340

SEQ ID NO: 488598 - RNA, 64 nt, Human; identical to SEQ ID NO: 446526

SEQ ID NO: 488599 - RNA, 64 nt, Human; identical to SEQ ID NO: 446926

SEQ ID NO: 488600 - RNA, 64 nt, Human; identical to SEQ ID NO: 446927

SEQ ID NO: 488601 - RNA, 64 nt, Human; identical to SEQ ID NO: 446928

SEQ ID NO: 488602 - RNA, 64 nt, Human; identical to SEQ ID NO: 446929

SEQ ID NO: 488603 - RNA, 64 nt, Human; identical to SEQ ID NO: 446930

SEQ ID NO: 488604 - RNA, 64 nt, Human; identical to SEQ ID NO: 446931

SEQ ID NO: 488605 - RNA, 64 nt, Human
uucuaauuuacuguugcccauugcacuuacauaccaccaccaagaaagccuucaagaugucaaa

SEQ ID NO: 488606 - RNA, 64 nt, Human
cucagccuccugaguagcugggauuacaggcacgcaccaccauaccuggcuaauuuuuguauuu

SEQ ID NO: 488607 - RNA, 64 nt, Human
ccagcccagcccacuccccgcauggggaggccgccaccaccaacaccucaucauccuucucauc

SEQ ID NO: 488608 - RNA, 64 nt, Human; identical to SEQ ID NO: 446932

SEQ ID NO: 488609 - RNA, 64 nt, Human; identical to SEQ ID NO: 446933

SEQ ID NO: 488610 - RNA, 64 nt, Human; identical to SEQ ID NO: 446934

SEQ ID NO: 488611 - RNA, 64 nt, Human; identical to SEQ ID NO: 446935

SEQ ID NO: 488612 - RNA, 64 nt, Human; identical to SEQ ID NO: 446936

SEQ ID NO: 488613 - RNA, 64 nt, Human; identical to SEQ ID NO: 446937

SEQ ID NO: 488614 - RNA, 64 nt, Human; identical to SEQ ID NO: 446938

SEQ ID NO: 488615 - RNA, 64 nt, Human; identical to SEQ ID NO: 446939

SEQ ID NO: 488616 - RNA, 64 nt, Human; identical to SEQ ID NO: 446940

SEQ ID NO: 488617 - RNA, 64 nt, Human; identical to SEQ ID NO: 446941

SEQ ID NO: 488618 - RNA, 64 nt, Human; identical to SEQ ID NO: 446942

SEQ ID NO: 488619 - RNA, 64 nt, Human; identical to SEQ ID NO: 446946

SEQ ID NO: 488620 - RNA, 64 nt, Human; identical to SEQ ID NO: 446947

SEQ ID NO: 488621 - RNA, 58 nt, Human; identical to SEQ ID NO: 141716

SEQ ID NO: 488622 - RNA, 64 nt, Human; identical to SEQ ID NO: 446949

SEQ ID NO: 488623 - RNA, 64 nt, Human; identical to SEQ ID NO: 446950

SEQ ID NO: 488624 - RNA, 64 nt, Human
uccuccuuacccucccucccuuacucuccccccccaccaccacccuccacccccaacucaugaa

SEQ ID NO: 488625 - RNA, 64 nt, Human
caggacgggaggcaggguggggggcaggcuggaccaccaccaucugcccuggcagccuggcugc

SEQ ID NO: 488626 - RNA, 64 nt, Human
gucucacucugucacccaggcuggagugcaguggcaccaccauggcucucugcagccuugaccu

SEQ ID NO: 488627 - RNA, 58 nt, Human; identical to SEQ ID NO: 141719

SEQ ID NO: 488628 - RNA, 64 nt, Human; identical to SEQ ID NO: 446952

SEQ ID NO: 488629 - RNA, 64 nt, Human; identical to SEQ ID NO: 446953

SEQ ID NO: 488630 - RNA, 64 nt, Human; identical to SEQ ID NO: 446954

SEQ ID NO: 488631 - RNA, 64 nt, Human; identical to SEQ ID NO: 446955

SEQ ID NO: 488632 - RNA, 64 nt, Human; identical to SEQ ID NO: 446956

SEQ ID NO: 488633 - RNA, 64 nt, Human; identical to SEQ ID NO: 446957

SEQ ID NO: 488634 - RNA, 64 nt, Human; identical to SEQ ID NO: 446958

SEQ ID NO: 488635 - RNA, 64 nt, Human; identical to SEQ ID NO: 446959

SEQ ID NO: 488636 - RNA, 64 nt, Human
uccuccuuucucccaucaaagcaaaauauggccucaccaccagccccaaaucagugcucagacc

SEQ ID NO: 488637 - RNA, 64 nt, Human
augugaagaaggucguugcuuccccuucaccuuccaccaccaugauuguaaguuccuuuuuucu

SEQ ID NO: 488638 - RNA, 64 nt, Human
cucagccucuggaguagcugagacuacaggcgcccaccaccaugcccggcuaauuuuguuugua

SEQ ID NO: 488639 - RNA, 64 nt, Human
acuuacuucucagcuucugcgaucagauuaucaucaccaccacccuccagagaauuuuuacgca

SEQ ID NO: 488640 - RNA, 64 nt, Human
uaagaagucucccuuccagcuguuccauucucuccaccaccagcguaacuggcaaguuaccaag

SEQ ID NO: 488641 - RNA, 64 nt, Human
cucagccucccaaguagcugggaugacaggcgcacaccaccacgcccagcaaauuuuuuguauu

SEQ ID NO: 488642 - RNA, 64 nt, Human
accucagccucucaaguagcugggacuacaggugcaccaccacaccuggcuaauuuuuguauuu

SEQ ID NO: 488643 - RNA, 64 nt, Human
acaagcuuaccuguggguuucaguccugagaggccaccaccaguucccaucagcacugucucca

SEQ ID NO: 488644 - RNA, 64 nt, Human
cucggccucccuaguagcugggauuacaggcgcacaccaccacacacagcuaauuuuuuuuuuu

SEQ ID NO: 488645 - RNA, 64 nt, Human
gagugggcccagcacauggccauagaggcccaggcaccaccaggagcagcagccagcaccaccu

SEQ ID NO: 488646 - RNA, 64 nt, Human
ggagugggaauaaaauguugccuuccccacuucucaccaccaccgccaucaugacgcucauacu

SEQ ID NO: 488647 - RNA, 64 nt, Human
uuuucuguuuguuuguuuucauguugaaugcccacaccaccauccucucaucccagccaguaag

SEQ ID NO: 488648 - RNA, 64 nt, Human
cuacaaauauaaguagucauuagaaguuugcaaccaccaccaagucugagagaacucugggaua

SEQ ID NO: 488649 - RNA, 64 nt, Human
agucucuccgugggaggagacauuauggggcguccaccaccaccccucccuggccauccuccug

SEQ ID NO: 488650 - RNA, 64 nt, Human
cucacccuccugaguagcugggacuacaggugugcaccaccacaccuggcuaauucuucuuaaa

SEQ ID NO: 488651 - RNA, 64 nt, Human
cucagccucccaaguagcugggauuacaggcauacaccaccacgccccacuaauuuuuuguauu

SEQ ID NO: 488652 - RNA, 64 nt, Human
cucagccuccugaguagcugggauuacaggcacacaccaccacgcuugguuaauuuuuguauuu

SEQ ID NO: 488653 - RNA, 64 nt, Human
aaacuuuucuaauacucuacccucuuagaaaaaccaccaccaucaccagacaggugcgaaagga

SEQ ID NO: 488654 - RNA, 64 nt, Human
ugugcugguaacugcuuugcuucuugaguagagccaccaccaccauagcccagccagaugagug

SEQ ID NO: 488655 - RNA, 64 nt, Human
gcugguaacugcuuugcuucuugaguagagccaccaccaccauagcccagccagaugagugcuc

SEQ ID NO: 488656 - RNA, 64 nt, Human
cucugucaggugugauaaaauguugaacccuccccaccaccacuuuuuuuuuuuuaaaccaggg

SEQ ID NO: 488657 - RNA, 64 nt, Human
auauaccugguugaaauacaacacuauacauacacaccaccauauauacuagcuguuaauccua

SEQ ID NO: 488658 - RNA, 64 nt, Human
gaaugagacccuuagguuuuaacacgaauccugacaccaccaucuauagggucccaacuugguu

SEQ ID NO: 488659 - RNA, 64 nt, Human
uaguuaacaaauguuccuccucccucugggauaccaccaccacuuguuucuguguguguuuauu

SEQ ID NO: 488660 - RNA, 64 nt, Human
gauuuaagcuugaagcuacagauuauaucacuaucaccaccaccccucacccuaugcaaucaau

SEQ ID NO: 488661 - RNA, 64 nt, Human
uuucuugguugggacacuccucuggcagccccagcaccaccacaaccccuugcagugugcccca

SEQ ID NO: 488662 - RNA, 64 nt, Human
gggagacaaaaccacugcagaccuaccacgaagccaccaccaccuucaguaacaaggguacgau

SEQ ID NO: 488663 - RNA, 64 nt, Human
uaccuagguaguccauaggaaccacccccaugaccaccaccaacaucaacuaaagguucuugga

SEQ ID NO: 488664 - RNA, 64 nt, Human
cucagccucccgaauagcugggauuacacgugcccaccaccaugcccagcuaauuuuuguauuu

SEQ ID NO: 488665 - RNA, 64 nt, Human
cucagucuccugaguagcugggaucacaggugcacaccaccacgccuggcuaauuuuuuuauuu

SEQ ID NO: 488666 - RNA, 64 nt, Human
cucagccucuugaguagcugggauuacaggcgcccaccaccacagccugcuaauuuuuguauuu

SEQ ID NO: 488667 - RNA, 64 nt, Human
cugccuggacuuggagagaugggaggcagacccccaccaccauacaugcugucuguggccccuc

SEQ ID NO: 488668 - RNA, 64 nt, Human
uuagagcaauuuguuuaaugagugguucagccaucaccaccaguggccaccuguucaauaaaau

SEQ ID NO: 488669 - RNA, 64 nt, Human
gacaccugcccaccuaccuggcucugaccguucccaccaccaucugcauguccccacugggccu

SEQ ID NO: 488670 - RNA, 64 nt, Human
ccucagccucucaaguagcgggauuacaggcgcccaccaccaaaaauuagcccagcuaauuuuu

SEQ ID NO: 488671 - RNA, 64 nt, Human
gagugccacuuccccacccgggaaaggcugccgccaccaccaccaccaacacaacagcaauggc

SEQ ID NO: 488672 - RNA, 64 nt, Human
ugccacuuccccacccgggaaaggcugccgccaccaccaccaccaacacaacagcaauggcaac

SEQ ID NO: 488673 - RNA, 64 nt, Human
cacuuccccacccgggaaaggcugccgccaccaccaccaccaacacaacagcaauggcaacacc

SEQ ID NO: 488674 - RNA, 64 nt, Human
cccguccagaggccaccaggagcugagacagugccaccaccagcaccucccacaagcccaccgc

SEQ ID NO: 488675 - RNA, 64 nt, Human
cacacuuccggauggagggagagguugugcugaccaccaccacacuggcacaggcgggagccuu

SEQ ID NO: 488676 - RNA, 64 nt, Human
cucagccucccaaguagcugggauuacaggugcccaccaccaccccuggcuaaauuuguauuuu

SEQ ID NO: 488677 - RNA, 64 nt, Human
ggcagccucggacuaugacuggcuacggggaggccaccaccaggccccagcucuccacccugaa

SEQ ID NO: 488678 - RNA, 64 nt, Human
acagcaacauggccuguacccagcagagugguggcaccaccaugguuacagcggaugccccgag

SEQ ID NO: 488679 - RNA, 64 nt, Human
uagcgaccaggcuugggcuuccccagcgccccaccaccaccacgugcagguggagcucugggau

SEQ ID NO: 488680 - RNA, 64 nt, Human
cauuagcgaccaggcuugggcuuccccagcgccccaccaccaccacgugcagguggagcucugg

SEQ ID NO: 488681 - RNA, 64 nt, Human
gcaagaccccccucucuuccccacuggguucugccaccaccaggaggauuucaagaaagcacca

SEQ ID NO: 488682 - RNA, 64 nt, Human
cucagcauccuaauuaguugggauuacaggcgcccaccaccaugcccggcuaauuuuuguguuu

SEQ ID NO: 488683 - RNA, 64 nt, Human
uagccacugcuuucuccucugugccauccacucccaccaccagguuguuuuggccugaggagca

SEQ ID NO: 488684 - RNA, 64 nt, Human
gagucagcacagccccaucaguccaggaacuucccaccaccagcccuugacugucccauuaacu

SEQ ID NO: 488685 - RNA, 64 nt, Human
ccucacagccaugcccagaagccucacaccucgucaccaccaccaccccccaccccauccugag

SEQ ID NO: 488686 - RNA, 64 nt, Human
cacagccaugcccagaagccucacaccucgucaccaccaccaccccccaccccauccugaggca

SEQ ID NO: 488687 - RNA, 64 nt, Human
ccugcuucuucuuccaaaugcaguucauugcagacaccaccauauugcuaucuaauggggaaau

SEQ ID NO: 488688 - RNA, 64 nt, Human
cagccaacgguuucucuugggggcuuugaaauaacaccaccaguggacuuaagguugaagugug

SEQ ID NO: 488689 - RNA, 64 nt, Human
gcuucagccccaaguaggugggacuccaggcaugcaccaccaugccuggcuaauuuuugcauuu

SEQ ID NO: 488690 - RNA, 64 nt, Human
uucuggguagggaaacaaccaacuaauugacuaacaccaccaacaacaaaaaacaaacccaauc

SEQ ID NO: 488691 - RNA, 64 nt, Human
uagaggucgggacagacgacgcuaccugcccagacaccaccaaguucucugccugcaaaaccug

SEQ ID NO: 488692 - RNA, 64 nt, Human
aaugcagauucauccauaaucccuuucugcuguucaccaccacccaugauccaucuguguaguu

SEQ ID NO: 488693 - RNA, 64 nt, Human
uuugugccccacuacagaacagggcuaaauuagccaccaccacugaaaacucagccgaauuuuu

SEQ ID NO: 488694 - RNA, 64 nt, Human
cucagucucccaaguagcugggauuacaggugugcaccaccacgccugacuaauuuuguauuuu

SEQ ID NO: 488695 - RNA, 64 nt, Human
uuuuuuaaagaaacuggggaaggauuuaugaauacaccaccaccagaguggauaaugcuuagaa

SEQ ID NO: 488696 - RNA, 64 nt, Human
uuuaaagaaacuggggaaggauuuaugaauacaccaccaccagaguggauaaugcuuagaauuc

SEQ ID NO: 488697 - RNA, 64 nt, Human
cucagccuccuagauaacugggauuacaggugcccaccaccaugcccggcuaauuuuuguauuu

SEQ ID NO: 488698 - RNA, 64 nt, Human
auuugcauccuucuuccugagccaacugcuugggcaccaccacagcgucuucuauagcucggug

SEQ ID NO: 488699 - RNA, 64 nt, Human
acccacccucucccaccucaugcuccugcaccugcaccaccaagguugaugccggauucgaagc

SEQ ID NO: 488700 - RNA, 64 nt, Human
aaucaaaucuggaacaaaugaaacaucuuuuagccaccaccacccuguugcaauuaagacaacc

SEQ ID NO: 488701 - RNA, 64 nt, Human
guauuuacuuggggugcucuucugugacacuugccaccaccaccuuccaguagcaagcugguag

SEQ ID NO: 488702 - RNA, 64 nt, Human
uaucaacccauggggcuagagacugccaugcaaccaccaccacgacagcccuuccuccaucaga

SEQ ID NO: 488703 - RNA, 64 nt, Human
gagcugggggcggaugguggcccaggagacagcacaccaccaggcuccacacgugcaugcuuuc

SEQ ID NO: 488704 - RNA, 64 nt, Human
cucagccgcccaaguaucugggaccacaggcgugcaccaccaugcauagcuaauuuauuuuuug

SEQ ID NO: 488705 - RNA, 64 nt, Human
uuggaauuuucuggcacuuccucucuauugcccccaccaccaccacccccaucacugcuuucuc

SEQ ID NO: 488706 - RNA, 64 nt, Human
gaauuuucuggcacuuccucucuauugcccccaccaccaccacccccaucacugcuuucuccca

SEQ ID NO: 488707 - RNA, 64 nt, Human
cagcagagacuagcagcggggccaccuccacaaccaccaccacaagguaggugcagcguccacc

SEQ ID NO: 488708 - RNA, 64 nt, Human
cuagcuggagcagcuccuuccccuuugcugauaacaccaccacugggacgugccauguugggac

SEQ ID NO: 488709 - RNA, 64 nt, Human
guaugacuaucaggccaugugcaaacccucgagucaccaccacagugcagcccagccccugguc

SEQ ID NO: 488710 - RNA, 64 nt, Human
cccaauaccaccccaaacacaacucaacuucccacaccaccaugucucucaccacaccuucugg

SEQ ID NO: 488711 - RNA, 64 nt, Human
ugagccggaagaucuggcgaagcucaggcaaaaacaccaccaaucacguggaaguuaauuuuau

SEQ ID NO: 488712 - RNA, 64 nt, Human
acugauucguuuauggguaguaccgggaugaacccaccaccacaaagcaaauuagacaacuuaa

SEQ ID NO: 488713 - RNA, 64 nt, Human
cucagccucccaaguagcugggauuacagucaggcaccaccacacccggcuaauuuuguauuuu

SEQ ID NO: 488714 - RNA, 64 nt, Human
uuuuucuggaugauaggacagaugauggauucuucaccaccauuuuccuuguacucuucucucc

SEQ ID NO: 488715 - RNA, 64 nt, Human
gagccccuucugccugccagacgugccacugccccaccaccagcugaaaacagcagcacaucgc

SEQ ID NO: 488716 - RNA, 64 nt, Human
cccuauuaacuccuuggcuguggucccccagcuacaccaccagcccagguccuggcugccagcu

SEQ ID NO: 488717 - RNA, 61 nt, Human
ugaccuucucuuuuagauaaagaugagcccccaccaccaccgacucucccaacccagacuc

SEQ ID NO: 488718 - RNA, 64 nt, Human
cucagccuccugaguagcugggauuacaggcacacaccaccacaccuggcccagcuaauucuuu

SEQ ID NO: 488719 - RNA, 64 nt, Human
cucagccuccccaguagcugggauuacagaucugcaccaccaugcccagcuaauuuuguauuuu

SEQ ID NO: 488720 - RNA, 64 nt, Human
cuccgccuccugaguagcugggauuauaggcacgcaccaccacgcccagcuaauuuuuuguauu

SEQ ID NO: 488721 - RNA, 64 nt, Human
ccucucucuuucauccacacuucuguuaacuucccaccaccaucaaucaucugauuuccugaaa

SEQ ID NO: 488722 - RNA, 64 nt, Human
auggcuuaauaaaauagcauuaggucuaucuagccaccaccaccuuucaacuuuuuaucacuca

SEQ ID NO: 488723 - RNA, 64 nt, Human
cucccagccuggcauccaggcagggacacccucacaccaccagccccagggagcuucccugcua

SEQ ID NO: 488724 - RNA, 64 nt, Human
uggggaccgggacagccgcuccagcuucugcacucaccaccaugugggcuggggggcggggcgg

SEQ ID NO: 488725 - RNA, 64 nt, Human
cucagccuccugaguagcugggacuacaugcgcacaccaccacguccggcuaauuuuuguauuu

SEQ ID NO: 488726 - RNA, 64 nt, Human
cucagccuccugaguagcugggacuacaggcaugcaccaccacacccggcuaauuuuuguauuu

SEQ ID NO: 488727 - RNA, 64 nt, Human
ucagccuccagaguagcugggacuacgggcgccccaccaccacgcccggcuaauuuuuuguauu

SEQ ID NO: 488728 - RNA, 64 nt, Human
uuccaggggaccucaucucccgccugaccucggacaccaccauggucagcgaccuggucuccca

SEQ ID NO: 488729 - RNA, 64 nt, Human
cucagccucacgaguagcugggacuacaggcaugcaccaccacgcccagcuaauuuuuguauuu

SEQ ID NO: 488730 - RNA, 64 nt, Human
cucagcuucccgaguagcugggauuauaggcacccaccaccacaccuggcuaauuuuuguauuu

SEQ ID NO: 488731 - RNA, 64 nt, Human
cauaaguuucugcugcuucucccauaacugcugccaccaccaucagaauucauaaucaaaccua

SEQ ID NO: 488732 - RNA, 64 nt, Human
ucuucagcacauugacccauagcacacacauacacaccaccaccaacaacgcuugugaauguau

SEQ ID NO: 488733 - RNA, 64 nt, Human
ucagcacauugacccauagcacacacauacacaccaccaccaacaacgcuugugaauguauuuu

SEQ ID NO: 488734 - RNA, 64 nt, Human
uggguugguuuguuaauuuauacaaagagauuaccaccaccacccccuccuucagacggcggag

SEQ ID NO: 488735 - RNA, 64 nt, Human
cuucagacgcugaaacugcugccuuucaggaaagcaccaccaacgcuggaggaggagccggccc

SEQ ID NO: 488736 - RNA, 64 nt, Human
cucagccucccaaguagcugggauuacaggugcgcaccaccaugccuggcuguguuuucacuuu

SEQ ID NO: 488737 - RNA, 64 nt, Human
ugagugcagcaucuuucccacauucaauaugaagcaccaccagauggcuaccaaaugauaagaa

SEQ ID NO: 488738 - RNA, 64 nt, Human
aacuucauuuucccccauagaagagaaaaaagagcaccaccauuauuaccaccuccccaacccu

SEQ ID NO: 488739 - RNA, 64 nt, Human
cucagccucccaaguagcugggauuacaggugcccaccaccaugccuggcuuaauuuuuuguau

SEQ ID NO: 488740 - RNA, 64 nt, Human
cucagccucccgaguggcugggauuagcggcaugcaccaccacgcccagcuauuuuuguauuuu

SEQ ID NO: 488741 - RNA, 64 nt, Human
uguacguggccauggccagacaccccagucccuucaccaccaccugcuccccacgccaccacca

SEQ ID NO: 488742 - RNA, 64 nt, Human
ccccagucccuucaccaccaccugcuccccacgccaccaccauuuggguggcuguuuuuaaaaa

SEQ ID NO: 488743 - RNA, 64 nt, Human
ugucugauacccaggcccguuucucaccugagcgcaccaccaccuggcguguagaaucuccagg

SEQ ID NO: 488744 - RNA, 64 nt, Human
gcccuccccugucccccucucgccgcccgcccgccaccaccacucucacuccacccagaguaga

SEQ ID NO: 488745 - RNA, 64 nt, Human
ccuaaaucaaacccauccucaaaggaugaagacucaccaccauccaggacauucagaagaguuc

SEQ ID NO: 488746 - RNA, 64 nt, Human
ucuugcauaucuuaaucgacauucccaguccuuucaccaccagaaccaacuccucuuucaaaca

SEQ ID NO: 488747 - RNA, 64 nt, Human
cucagcaucucgaguagcugggauuacaggcaugcaccaccacgcccagcuaauuuuguauuuu

SEQ ID NO: 488748 - RNA, 64 nt, Human
ccuguugcaugagccugcgacaggaccucacccccaccaccaggcuucuauuugggauucacau

SEQ ID NO: 488749 - RNA, 64 nt, Human
cucaaagacucaagugggaacgacugggcacugccaccaccagaaagcuguucgacgagacggu

SEQ ID NO: 488750 - RNA, 64 nt, Human
gucuugcccagaggaucacagugcugagaccccccaccaccagccgguaccugggaagggggag

SEQ ID NO: 488751 - RNA, 64 nt, Human
cccuuccuggacuggcccuugcccaacucccagccaccaccacugucccuaccacugagcccuu

SEQ ID NO: 488752 - RNA, 64 nt, Human
gugaucaaaagcauucuagccaugugcaaccaaacaccaccaaaaauaaaaucaaacaaaacua

SEQ ID NO: 488753 - RNA, 64 nt, Human
uuugaacaccacgcuguagucuccaacagaaaaacaccaccaaaacagauacccauguugaggg

SEQ ID NO: 488754 - RNA, 64 nt, Human
cucagccuccugaguagcugggauuauaggcacacaccaccacacccagcuaaucuuuuuguau

SEQ ID NO: 488755 - RNA, 64 nt, Human
gggacugacuccagagcccccuccuaagaaccaucaccaccacucagccaaucuguucugggcc

SEQ ID NO: 488756 - RNA, 64 nt, Human
cggucauugccuccaugcccuugcuuggcucaagcaccaccaaucgcuuuaaugcuucagccac

SEQ ID NO: 488757 - RNA, 64 nt, Human
uuugcccucagcuccucccugccagcaucccagucaccaccagguggcgcuucugacacggucc

SEQ ID NO: 488758 - RNA, 64 nt, Human
cucagccuccugaguagcugggaauauaggugcacaccaccaugccuggcuaauuuuuguauuu

SEQ ID NO: 488759 - RNA, 64 nt, Human
uuugcaaaaccucucccacccuuguguuucacuccaccaccaaccccagguaaaaaagucuccc

SEQ ID NO: 488760 - RNA, 64 nt, Human
cuuccuucucuaccaucacuccuguggcggucaccaccaccaccucucccgcccuuaccagcag

SEQ ID NO: 488761 - RNA, 64 nt, Human
caucuuccuucucuaccaucacuccuguggcggucaccaccaccaccucucccgcccuuaccag

SEQ ID NO: 488762 - RNA, 64 nt, Human
cucagccuccugaguagcugggacuacaggugugcaccaccacacccagccaaaacagccaucc

SEQ ID NO: 488763 - RNA, 64 nt, Human
cucagccucccaaguagcugggauuacaggugugcaccaccaugcccggcuaauuuuuuguauu

SEQ ID NO: 488764 - RNA, 64 nt, Human
cucagccucccaaguagcugggauuacaggcacccaccaccaugcccagcuaauuuuuguauuu

SEQ ID NO: 488765 - RNA, 64 nt, Human
cucauccucccaagaagcugagauuacagaugaccaccaccacuccuggcuaauuuuuuguauu

SEQ ID NO: 488766 - RNA, 64 nt, Human
ccccuagauccuucagguccccacccucagcugucaccaccacccuccccaggggacuccaucu

SEQ ID NO: 488767 - RNA, 64 nt, Human
ucuaaauuuggaaaggagcuaguagcuuuaaggccaccaccauauuuuacuuuuuuaggauuuu

SEQ ID NO: 488768 - RNA, 64 nt, Human
cucagucgaggaagcccuggaauguucagcagaacaccaccacugugacauggggcuguggcag

SEQ ID NO: 488769 - RNA, 64 nt, Human
acuuuggcagugccacauuugaccaugagcaccacaccaccauuguggccacccgucacuaucg

SEQ ID NO: 488770 - RNA, 56 nt, Human; identical to SEQ ID NO: 335818

SEQ ID NO: 488771 - RNA, 64 nt, Human
cucagccucccaaguagcugagacuacaggcacacaccaccacgccuggcuaauuuuuguauuu

SEQ ID NO: 488772 - RNA, 64 nt, Human
gugucccaugacccaccccugugcuccgugccuccaccaccacuggccaccaggcuggcgcagc

SEQ ID NO: 488773 - RNA, 64 nt, Human
caagaugggguacuaacaccacccccaccgcccccaccaccacccccagcuccugaggugcugg

SEQ ID NO: 488774 - RNA, 51 nt, Human; identical to SEQ ID NO: 335822

SEQ ID NO: 488775 - RNA, 64 nt, Human
ugaaggagcaccuggccuuaggaauccuggcugccaccaccacaaggcuccccauuuggacauu

SEQ ID NO: 488776 - RNA, 64 nt, Human
ugucuuuagaguuaggugccugccuaaagccaggcaccaccacaccuggcuuuagaguucacac

SEQ ID NO: 488777 - RNA, 64 nt, Human
aaaaauuucagugacuccagaagaaaugagccuccaccaccaagaaaugaacuuagagaaucag

SEQ ID NO: 488778 - RNA, 64 nt, Human
ggugacuugggggaaaaauuagugaugaaacagccaccaccauauugccauuaguggaaaaaaa

SEQ ID NO: 488779 - RNA, 64 nt, Human
guacauuuuaaauaggggcauugaaauuuacucccaccaccagggcuuuuuugggggaugccug

SEQ ID NO: 488780 - RNA, 64 nt, Human
ggacaggacugcagcaggacagggacuggcuucucaccaccagccuuuccgucugauggacagc

SEQ ID NO: 488781 - RNA, 64 nt, Human
cugcaugagccaccagugccccggcacccuuuaacaccaccagauggguguuuucccccaucca

SEQ ID NO: 488782 - RNA, 64 nt, Human
ggggacuggggaaggggaggguguucagaggcagcaccaccacacagucaccccucccucccuc

SEQ ID NO: 488783 - RNA, 64 nt, Human
cucagccuccccaguagcugggauuacaggcacccaccaccaugcccagcuaauuguuguaugu

SEQ ID NO: 488784 - RNA, 64 nt, Human
cuuugccucccgaguagcugggauuacaggcacacaccaccacgcccagcuaguuuuuuuguau

SEQ ID NO: 488785 - RNA, 64 nt, Human
caagcaggacugagggaacugcuggcucgccuggcaccaccacacggccacagccagccaucug

SEQ ID NO: 488786 - RNA, 64 nt, Human
guguucaugccgcccccgugcccugcacaaaaaccaccaccagcagcucacauuucacgucucg

SEQ ID NO: 488787 - RNA, 64 nt, Human
gcuaucguggaacagccuagaaaccaagggacuccaccaccaagucacuuccccugcucgugca

SEQ ID NO: 488788 - RNA, 64 nt, Human
cugcccgcguuucagggccucgguccauagagaacaccaccaccauggccagguggaaggguuu

SEQ ID NO: 488789 - RNA, 64 nt, Human
cccgcguuucagggccucgguccauagagaacaccaccaccauggccagguggaaggguuuauu

SEQ ID NO: 488790 - RNA, 64 nt, Human
cucagccuuccaaguagcugggacuacaggugugcaccaccacagcuggcuaauucuauuuuuu

SEQ ID NO: 488791 - RNA, 64 nt, Human
cucagccucccaaguagcugggauuacuggugcacaccaccacacucagcuaauuuuugcauuu

SEQ ID NO: 488792 - RNA, 64 nt, Human
agaaaggagcagucagcauucuuccaauuugccccaccaccaccuccucgggcuucauuuucuc

SEQ ID NO: 488793 - RNA, 64 nt, Human
cgucagccccagaguagcuggaauuacaggcacacaccaccacgccuggcuaauuuuuguauuu

SEQ ID NO: 488794 - RNA, 64 nt, Human
gugacuuggagaugucccuucaccccuccccuuucaccaccauccucuuuuccucauggaaaug

SEQ ID NO: 488795 - RNA, 64 nt, Human
cucagcuucccgaguaacugagauuacaggcacccaccaccaugcccagcugcuuuuuuguauu

SEQ ID NO: 488796 - RNA, 64 nt, Human
gacuuaaccguggugagggcuggaaauccaaacucaccaccaugaucugugaaauaaagcccuu

SEQ ID NO: 488797 - RNA, 53 nt, Human; identical to SEQ ID NO: 335848

SEQ ID NO: 488798 - RNA, 64 nt, Human
ugggcucuaacagugcuuacugcagccuuguguccaccaccaacuucucagcauguuucucucc

SEQ ID NO: 488799 - RNA, 64 nt, Human
ggggcuugccagagacuguguguuuuguuucccccaccaccaucacugccaccuggcuucugcc

SEQ ID NO: 488800 - RNA, 64 nt, Human
cacggucucuuccccugccccaacuggcccucuccaccaccaacuucucuacuuuggguuuguu

SEQ ID NO: 488801 - RNA, 64 nt, Human
gagccaaggaggugaggagcagagcaggcaauuucaccaccaaaugccaagaaaagggcugaca

SEQ ID NO: 488802 - RNA, 64 nt, Human
ucagggcagaagacacugcucuuuguaacccagccaccaccaaaaagcaaacagaaagaaggaa

SEQ ID NO: 488803 - RNA, 64 nt, Human
ugggcaacagagacccugucucaaccaccaccaccaccaccaccccuacuaccccuguauucaa

SEQ ID NO: 488804 - RNA, 64 nt, Human
gccugggcaacagagacccugucucaaccaccaccaccaccaccaccccuacuaccccuguauu

SEQ ID NO: 488805 - RNA, 64 nt, Human
ccagccugggcaacagagacccugucucaaccaccaccaccaccaccaccccuacuaccccugu

SEQ ID NO: 488806 - RNA, 64 nt, Human
acuccagccugggcaacagagacccugucucaaccaccaccaccaccaccaccccuacuacccc

SEQ ID NO: 488807 - RNA, 59 nt, Human; identical to SEQ ID NO: 335861

SEQ ID NO: 488808 - RNA, 64 nt, Human
acuggccaagaucagacgucgcugaggggcuguucaccaccauccucguucuccagggucaagg

SEQ ID NO: 488809 - RNA, 64 nt, Human
gacuggagguucccugcacucccagugagccagccaccaccacaaccugucucccaguccugcu

SEQ ID NO: 488810 - RNA, 64 nt, Human
ccuggucggggcccacuggaagcauccagaacagcaccaccaucuagcggccgcucgagggaag

SEQ ID NO: 488811 - RNA, 64 nt, Human
ucuccugggacaaccagacucuguaacucacccccaccaccauacacacacacaaaaacagaaa

SEQ ID NO: 488812 - RNA, 64 nt, Human
cucagccucccgaguagcugggaguacaggcacacaccaccacacccagcuaauuuuuguauuu

SEQ ID NO: 488813 - RNA, 64 nt, Human
caccuccggcuccggcggacgcgcgaccguugugcaccaccagggaccgccgcgccuacucugc

SEQ ID NO: 488814 - RNA, 64 nt, Human
uauuuuucuuugacucgugugaguucaaaguaaacaccaccaccguggacaacucuugaauuaa

SEQ ID NO: 488815 - RNA, 64 nt, Human
cuuaacugccugaguagcugggacuacaggcaugcaccaccacgcccagcuaauuuuucuuauu

SEQ ID NO: 488816 - RNA, 64 nt, Human
aaauacagguauuuuuaauuuuaaaauuucauuccaccaccaucagaugcaguucccuauuuug

SEQ ID NO: 488817 - RNA, 64 nt, Human
gaacccuccacguagcgaggggcucccugcuggucaccaccaaggguaugagcucucugccuca

SEQ ID NO: 488818 - RNA, 57 nt, Human; identical to SEQ ID NO: 335875

SEQ ID NO: 488819 - RNA, 64 nt, Human
accuggggggauuggagggaaaugaccugcccuccaccaccacccaaagugugggauuaaagua

SEQ ID NO: 488820 - RNA, 64 nt, Human
cucagccuccucaguagcuaggacuaccggcgugcaccaccaugccaggcuaauuuuuauauuu

SEQ ID NO: 488821 - RNA, 64 nt, Human
cucagccucccgaguagcugggauuacaggcacgcaccaccacaccuggcuaauuuuuguacuu

SEQ ID NO: 488822 - RNA, 64 nt, Human
gggguuugggugggggcuguggcccugcccuuggcaccaccaggguggaccaggccuggagggc

SEQ ID NO: 488823 - RNA, 64 nt, Human
cggcaugugugccaaugcacacgagugugccacucaccaccauuccuuggccagccuuuugccu

SEQ ID NO: 488824 - RNA, 64 nt, Human
guuuucugugacaucuuggagggggagcuagugccaccaccaugcgcggugcuuaggaaaugaa

SEQ ID NO: 488825 - RNA, 64 nt, Human
acaaguggggcugggaagcugacuucgugcucuucaccaccacaaaggaugugugugcauccug

SEQ ID NO: 488826 - RNA, 64 nt, Human
gccaccuggucaccagaccuccaaauauggcugccaccaccaggaccuuuccaguuacuccuua

SEQ ID NO: 488827 - RNA, 64 nt, Human
aggggaguggcagugaggagggggccaggucaggcaccaccaucaagagagcuguguguucucu

SEQ ID NO: 488828 - RNA, 64 nt, Human
ucaugucugcagcccccagaauguucuggacaugcaccaccagccgguggucccaauguccacc

SEQ ID NO: 488829 - RNA, 64 nt, Human
cauaggcuggcacucucaauccuacaucaggugccaccaccaccagacucaggcccugguguaa

SEQ ID NO: 488830 - RNA, 64 nt, Human
aggcuggcacucucaauccuacaucaggugccaccaccaccagacucaggcccugguguaagaa

SEQ ID NO: 488831 - RNA, 54 nt, Human; identical to SEQ ID NO: 335888

SEQ ID NO: 488832 - RNA, 64 nt, Human
ccaccacacagugccagagccagagaaggggccccaccaccaaggccaagcuugaccaggucag

SEQ ID NO: 488833 - RNA, 64 nt, Human
ugccuccuccugaguagcugggacuacaggugcucaccaccacacccggcuaauuuuuuguauu

SEQ ID NO: 488834 - RNA, 50 nt, Human; identical to SEQ ID NO: 335894

SEQ ID NO: 488835 - RNA, 64 nt, Human
gccuccugaagccucugggaacuccuccuguggccaccaccaaaggaugaggaaucugaguugc

SEQ ID NO: 488836 - RNA, 64 nt, Human
guucacaccccaaaaugacccaacgauguccacacaccaccaaaacccagccaaugggccaccu

SEQ ID NO: 488837 - RNA, 64 nt, Human
cuuccuuucccauucaccuggcucaauccuccuccaccaccaggggccucaaaaggcacaucau

SEQ ID NO: 488838 - RNA, 64 nt, Human
ccauguagaauacccugccuucuugaagcaguuccaccaccaauaugauggggaagggcaggaa

SEQ ID NO: 488839 - RNA, 64 nt, Human
guuuguguauuaauuuuuuuucuuguccauaucacaccaccaaaggcuuuuggaccauuuagca

SEQ ID NO: 488840 - RNA, 64 nt, Human
ccuccccccaccccucugcugcaggaggcguggccaccaccagaugcucccugucuggggcagg

SEQ ID NO: 488841 - RNA, 64 nt, Human
cucagccuucugaguagcugggacuacaggugugcaccaccaugcccagcuaguuuuuguauuu

SEQ ID NO: 488842 - RNA, 64 nt, Human
ccuucccucucucccugccucacuccuccgugagcaccaccagggcuccaggagccucauccag

SEQ ID NO: 488843 - RNA, 64 nt, Human
gccuuccggccauagcaaccaugaguggcauggccaccaccacgguggucacuggaacucagug

SEQ ID NO: 488844 - RNA, 64 nt, Human
gcgggguagcagccuugaacccacccagcugggacaccaccagaagguccagggcucuccccau

SEQ ID NO: 488845 - RNA, 64 nt, Human
ucaagccucccugugucccagacccuccugcugccaccaccacccagguccucccuaguccucc

SEQ ID NO: 488846 - RNA, 64 nt, Human
cucagccucccuaguagcugggauuacaggcaugcaccaccauacccagcuaauuucuguauuu

SEQ ID NO: 488847 - RNA, 64 nt, Human
agagcaugugaccagagcaugugcccagccccuccaccaccaggggcacugccgucauggcagg

SEQ ID NO: 488848 - RNA, 64 nt, Human
cgccugcugcgucagagcucaaggaaucugugcccaccaccagcuccugguccguaggagguga

SEQ ID NO: 488849 - RNA, 64 nt, Human
aaaggauuuuagaaaacccugggaaaacccaccacaccaccacaaaauggccuuuaguguauga

SEQ ID NO: 488850 - RNA, 64 nt, Human
acugguacuuaugugaacuguuguccuugcuuuacaccaccauuuggaaaacuuaccaguuuuu

SEQ ID NO: 488851 - RNA, 64 nt, Human
ucauccagcaguacucugaggcccugauggcucucaccaccauggcgucacuccgcgaccacag

SEQ ID NO: 488852 - RNA, 64 nt, Human
uuuauagcaauggcaacaagugaacgaggacaaccaccaccauguucuaacauguggacccuuu

SEQ ID NO: 488853 - RNA, 64 nt, Human
ggagccagcccucuuccauccgcccggcucugcccaccaccacugccaggcugaacaggggacu

SEQ ID NO: 488854 - RNA, 64 nt, Human
cucagccucccgaguagcugggacuacaggugcccaccaccacgccuggcuaguuuuuuguauu

SEQ ID NO: 488855 - RNA, 64 nt, Human
cucagccuccugaguagcugggacuacaggcgcccaccaccacgcccggcuaauuuuuuguauu

SEQ ID NO: 488856 - RNA, 64 nt, Human
cucagccuccugaguagcugggauuacaggcacccaccaccacaccuggcuaauuuuuuguauu

SEQ ID NO: 488857 - RNA, 64 nt, Human
acccugauaggaagaggggaagcagaaauccaagcaccaccaaacacaguguaugaaggggggc

SEQ ID NO: 488858 - RNA, 64 nt, Human
cgguggggagggucguccgguaucccccagugcccaccaccaccaaccagaaucacuucucaga

SEQ ID NO: 488859 - RNA, 64 nt, Human
uggggagggucguccgguaucccccagugcccaccaccaccaaccagaaucacuucucagacug

SEQ ID NO: 488860 - RNA, 50 nt, Human; identical to SEQ ID NO: 335923

SEQ ID NO: 488861 - RNA, 64 nt, Human
cccagccucccagguagcuaguacuauaggugugcaccaccacgcccagcaaauuuuuaaauuu

SEQ ID NO: 488862 - RNA, 64 nt, Human
caggacuucccuuaacaguuuccggaucagugaccaccaccacguucagguuucugaaugcaga

SEQ ID NO: 488863 - RNA, 64 nt, Human
ucuguccuggcagggaaacauacaccccuugucucaccaccaaccuugcuuguguagucagcag

SEQ ID NO: 488864 - RNA, 64 nt, Human
uucagccuccugaguagcugggacuacaggcaugcaccaccacgccaggcuaauuuuuuguauu

SEQ ID NO: 488865 - RNA, 64 nt, Human
cucagccucccaaguagcugggauuacaggcacccaccaccacauccagcuaauuguuguauuu

SEQ ID NO: 488866 - RNA, 64 nt, Human
cucagccucuugaguagcugggacuacaggcgcacaccaccacgccaggcuaauuuuuguauuu

SEQ ID NO: 488867 - RNA, 64 nt, Human
acuuuacagacaagcaaaugcugagagauuuugucaccaccaggccugcccuaaaagagcuccu

SEQ ID NO: 488868 - RNA, 57 nt, Human; identical to SEQ ID NO: 335934

SEQ ID NO: 488869 - RNA, 64 nt, Human
ugccugggccaugcgaggggccagcagagggcgccaccaccaccugacggcuggggacccaccc

SEQ ID NO: 488870 - RNA, 64 nt, Human
aguggcgugugguucauucacaaagcuguacaaccaccaccaucuaguuccaaacauuuucuuu

SEQ ID NO: 488871 - RNA, 64 nt, Human
aaauucugacaguguuuuucuuccucuuucauaccaccaccaccacaaucaucaacauaaagga

SEQ ID NO: 488872 - RNA, 64 nt, Human
uucugacaguguuuuucuuccucuuucauaccaccaccaccacaaucaucaacauaaaggaagu

SEQ ID NO: 488873 - RNA, 64 nt, Human
cucagccuccccaguagcugggauuacagacaugcaccaccacaccuggcuaauuuuuguauuu

SEQ ID NO: 488874 - RNA, 64 nt, Human
ugcccguccucggccccccacccugaagugccagcaccaccagcaccagauccuccgccgccac

SEQ ID NO: 488875 - RNA, 64 nt, Human
cacagccuccugaguaccugagauuacaggcacccaccaccaugcccagcuaauuuuuguauuu

SEQ ID NO: 488876 - RNA, 55 nt, Human; identical to SEQ ID NO: 335942

SEQ ID NO: 488877 - RNA, 64 nt, Human
cucagccucccgaguagcagggauuaccggugugcaccaccaugccuggauaacuuuuuuuuuu

SEQ ID NO: 488878 - RNA, 64 nt, Human
ccagggaggccugugucacucuggcacaagcugccaccaccagccacccacacccaccccagca

SEQ ID NO: 488879 - RNA, 64 nt, Human
caggacucagagcauggacagguggauaguaaaucaccaccacggggacagccgugcccagacu

SEQ ID NO: 488880 - RNA, 64 nt, Human
cucagccuuccaaguagcugggauuacaagugcccaccaccaugcccagcuaauuuuuauauuu

SEQ ID NO: 488881 - RNA, 64 nt, Human
gugagugcgagccgcccgccaaggcugcagggagcaccaccaggagcccagugucugacggccu

SEQ ID NO: 488882 - RNA, 64 nt, Human
uuugggccacuguccccucccugauccaggguuccaccaccaggagggcagacccagccacaua

SEQ ID NO: 488883 - RNA, 64 nt, Human
cucagccucccgaguagcugggauuacaggugugcaccaccacacccggcuaauuuuuuuuauu

SEQ ID NO: 488884 - RNA, 64 nt, Human
cucagccucuggaguagcugggacuacagacaugcaccaccacaccugguuaauuuuuuauuuu

SEQ ID NO: 488885 - RNA, 64 nt, Human
agggccagggcaucaagaacccagugaacaagggcaccaccacaguggacggcgcuggcuucgg

SEQ ID NO: 488886 - RNA, 64 nt, Human
cucagccuacugaguagcugagauuacaggugcacaccaccacguccggcugacuuuuguauuu

SEQ ID NO: 488887 - RNA, 64 nt, Human
cucagccuccuaaguagcugggauuacaggcacccaccaccaugcccagcuaauuuuuguauuu

SEQ ID NO: 488888 - RNA, 64 nt, Human
cuguggcaggaaagaaugcaacaaaaaaguuaaccaccaccaucucucuccucuucaaagcuaa

SEQ ID NO: 488889 - RNA, 64 nt, Human
acacacuuccugacguaaugcaauaggaaguccacaccaccaucuacaaagccuuauugcugga

SEQ ID NO: 488890 - RNA, 64 nt, Human
ggugcuuaacuccugucccugcaaguguuacugccaccaccagccacgccaucgccgccugcca

SEQ ID NO: 488891 - RNA, 64 nt, Human
accaggagguugaggcugcagugagccgugauuucaccaccacuccagccugggugagaaagca

SEQ ID NO: 488892 - RNA, 64 nt, Human
ucgccacagccaggauuugaacaaacuugguauucaccaccacauucuuugccucuauuccaaa

SEQ ID NO: 488893 - RNA, 64 nt, Human
ggggguggggacugagccgcccgccucugccgcccaccaccaucucaggaaaggcuguugugcu

SEQ ID NO: 488894 - RNA, 64 nt, Human
cucagccuccagaguagcugggauuacaggcaugcaccaccacagcccagcuaauuuuuuguau

SEQ ID NO: 488895 - RNA, 64 nt, Human
gcauuguguccuggggugacgucccuugugacaacaccaccaagccuggugucuauaccaaagu

SEQ ID NO: 488896 - RNA, 64 nt, Human
agccccuuccccuggagagggacugcucagccaacaccaccagcugccacauccugggcugggg

SEQ ID NO: 488897 - RNA, 64 nt, Human
uucagccucccaaguaccugggacuacaggugugcaccaccacaccaggcuaauuuuuugugua

SEQ ID NO: 488898 - RNA, 64 nt, Human
uuuaagaaaucuuaacacauauauugauucaugucaccaccaccguaaucgagauucagaaugu

SEQ ID NO: 488899 - RNA, 64 nt, Human
cucagccucccgaguagcugggauuacaggcaugcaccaccacgcccagcuuauuuuguauuuu

SEQ ID NO: 488900 - RNA, 64 nt, Human
cucagccucccgauuagcugggaucacaggugugcaccaccaugcccagcuaauuauuuauuuc

SEQ ID NO: 488901 - RNA, 64 nt, Human
uguauuuccuccauuuuccugcuaugaaauauaucaccaccagcuugauucaaccuuaaaaaua

SEQ ID NO: 488902 - RNA, 64 nt, Human
cucagccucccgaguagcugggauuacaggcgcccaccaccaugcccggcuaguuuuuuuguau

SEQ ID NO: 488903 - RNA, 64 nt, Human
cucagccucccuaauagcugggacuacaggcaaccaccaccacuccuaccuuuuuuguauuuuu

SEQ ID NO: 488904 - RNA, 64 nt, Human
cucagccuccugaguagcugggcugacaggcacccaccaccacacccagcuaauuuuuauguuu

SEQ ID NO: 488905 - RNA, 64 nt, Human
agugugucucuuucaccaucagcuccuccccuuucaccaccagcuccucuccacuucccaaggg

SEQ ID NO: 488906 - RNA, 64 nt, Human
agaaaaucccaccuccccugaccuccaccaccuccaccaccaccaccaccaccaccaccaccac

SEQ ID NO: 488907 - RNA, 64 nt, Human
aaaucccaccuccccugaccuccaccaccuccaccaccaccaccaccaccaccaccaccacuac

SEQ ID NO: 488908 - RNA, 64 nt, Human
ucccaccuccccugaccuccaccaccuccaccaccaccaccaccaccaccaccaccacuaccac

SEQ ID NO: 488909 - RNA, 64 nt, Human
caccuccccugaccuccaccaccuccaccaccaccaccaccaccaccaccaccacuaccaccac

SEQ ID NO: 488910 - RNA, 64 nt, Human
cuccccugaccuccaccaccuccaccaccaccaccaccaccaccaccaccacuaccaccaccac

SEQ ID NO: 488911 - RNA, 64 nt, Human
cccugaccuccaccaccuccaccaccaccaccaccaccaccaccaccacuaccaccaccaccca

SEQ ID NO: 488912 - RNA, 64 nt, Human
ugaccuccaccaccuccaccaccaccaccaccaccaccaccaccacuaccaccaccacccaacu

SEQ ID NO: 488913 - RNA, 64 nt, Human
ccuccaccaccuccaccaccaccaccaccaccaccaccaccacuaccaccaccacccaacuggg

SEQ ID NO: 488914 - RNA, 64 nt, Human
ccaccaccaccaccaccaccaccaccaccacuaccaccaccacccaacuggggcuagagugggg

SEQ ID NO: 488915 - RNA, 64 nt, Human
aggcugccagcagcucucuggugcaucgucucaacaccaccaaguuuguaggaccugcccaagu

SEQ ID NO: 488916 - RNA, 64 nt, Human
cuuccugagggcuguagccagguccgcaucuccccaccaccaccagggcacucacucgcagcua

SEQ ID NO: 488917 - RNA, 64 nt, Human
ccugagggcuguagccagguccgcaucuccccaccaccaccagggcacucacucgcagcuauag

SEQ ID NO: 488918 - RNA, 64 nt, Human
cucauccucccaaguaggugggauuacaggugcccaccaccaagcccugcaaauuuuuuuguau

SEQ ID NO: 488919 - RNA, 64 nt, Human
cuuauagacaugaugaggaucugguggguguuuccaccaccacagcuguugggaaagugauuug

SEQ ID NO: 488920 - RNA, 64 nt, Human
ccuuaauggcugcuugcugccauaugugacaaaucaccaccaccaguguuaagugcuucuggau

SEQ ID NO: 488921 - RNA, 64 nt, Human
uaauggcugcuugcugccauaugugacaaaucaccaccaccaguguuaagugcuucuggauuca

SEQ ID NO: 488922 - RNA, 64 nt, Human
ucagccucccagguagcugccacuacaggugcugcaccaccacgcccggcuaauuuuuguauuu

SEQ ID NO: 488923 - RNA, 64 nt, Human
uguccugugucacucccaauuucugagguccagccaccaccaggcugagcagugaggagagaaa

SEQ ID NO: 488924 - RNA, 64 nt, Human
ccaagugguaauucaugaaaaauauccccacuaccaccaccaaggggaagaaaggacucagaag

SEQ ID NO: 488925 - RNA, 64 nt, Human
uuacgaguaagugaauccugauuauuuccagacccaccaccagaguggaucuuauuuucaaagc

SEQ ID NO: 488926 - RNA, 64 nt, Human
aacccucuguggcuccccugcaucagcaccgucccaccaccaaguucaccagguucaccagaca

SEQ ID NO: 488927 - RNA, 64 nt, Human
ucucuuaagaaaagggaauucucuuuaaagaaaccaccaccaacaacaaaacaaccaaaaacca

SEQ ID NO: 488928 - RNA, 64 nt, Human
aauuacuucuguuuggcuaguuugcuuagcugaucaccaccaacaucauaggucuauaaaucac

SEQ ID NO: 488929 - RNA, 64 nt, Human
cacaauuacccuguaaacucucuguuagggcaaccaccaccaccugucuuccaggacacauuuu

SEQ ID NO: 488930 - RNA, 64 nt, Human
cucagccuccagaauagcugggauuacaggcguacaccaccaugccuggcuaauuuuuuuguau

SEQ ID NO: 488931 - RNA, 64 nt, Human
ucauuuucagaaaaucuacaagucucguugagaccaccaccauaccucagaagguaggacugug

SEQ ID NO: 488932 - RNA, 64 nt, Human
acagcccagagccugccgcuacccucggccugcccaccaccaagcaagcagcaagcaagauggg

SEQ ID NO: 488933 - RNA, 64 nt, Human
cauuuuccuuuacccaggaaaucuccggagccaacaccaccacccccagggggucuccccaccc

SEQ ID NO: 488934 - RNA, 64 nt, Human
cucagcuucccaaguagcugagauuacaggcgcacaccaccacgcccaacugauuuuuguauuu

SEQ ID NO: 488935 - RNA, 64 nt, Human
cucagccucccgaguagcugggacuacaggugcacaccaccacaccuggcuaauuuuuuguauu

SEQ ID NO: 488936 - RNA, 64 nt, Human
gcccccugcggcggaggccaacgcagggcaccaccaccaccaacuugaauuccgucaucaaugc

SEQ ID NO: 488937 - RNA, 64 nt, Human
cuggcccccugcggcggaggccaacgcagggcaccaccaccaccaacuugaauuccgucaucaa

SEQ ID NO: 488938 - RNA, 64 nt, Human
acacuggcccccugcggcggaggccaacgcagggcaccaccaccaccaacuugaauuccgucau

SEQ ID NO: 488939 - RNA, 64 nt, Human
cgcagccuccagaguagcugggauaacaggugcccaccaccacaccccacuaauuuuuguauuu

SEQ ID NO: 488940 - RNA, 64 nt, Human
gcugagcacacaacaggcuguguguggaaauggccaccaccauucuccuuccccaccccaccac

SEQ ID NO: 488941 - RNA, 64 nt, Human
gcaucaucaccaugguaacaguucccaucaccaucaccaccaccaccaccaucaccaccaccau

SEQ ID NO: 488942 - RNA, 64 nt, Human
ucaucaccaugguaacaguucccaucaccaucaccaccaccaccaccaucaccaccaccaugga

SEQ ID NO: 488943 - RNA, 64 nt, Human
ucaccaugguaacaguucccaucaccaucaccaccaccaccaccaucaccaccaccauggacaa

SEQ ID NO: 488944 - RNA, 64 nt, Human
ccaugguaacaguucccaucaccaucaccaccaccaccaccaucaccaccaccauggacaacaa

SEQ ID NO: 488945 - RNA, 64 nt, Human
caguucccaucaccaucaccaccaccaccaccaucaccaccaccauggacaacaagccuugggu

SEQ ID NO: 488946 - RNA, 64 nt, Human
uucccaucaccaucaccaccaccaccaccaucaccaccaccauggacaacaagccuuggguaac

SEQ ID NO: 488947 - RNA, 64 nt, Human
gaagacgggggcaguccugggggugcugcggcuacaccaccacccgcgcggcccccgcagccua

SEQ ID NO: 488948 - RNA, 64 nt, Human
cucagccucccaaguaggugggauuacagguacucaccaccagguccagcuaacuuuuguauuu

SEQ ID NO: 488949 - RNA, 64 nt, Human
uggauguuucagacgcucggccgggaacgaaucccaccaccaggaggaaugccaaggcugggcc

SEQ ID NO: 488950 - RNA, 64 nt, Human
cucagccuccugaguagcugggacuacaggcaugcaccaccaagcuuggcuaauuuaaaaaaaa

SEQ ID NO: 488951 - RNA, 64 nt, Human
ccauuuuacagaaaucauuuuuaggucuuugugccaccaccacgaggggcaucugcaaagaggg

SEQ ID NO: 488952 - RNA, 64 nt, Human
gccaaggcugccugccgugcaccaccaccaccaccaccaccaugcuguguggccaccuggggcu

SEQ ID NO: 488953 - RNA, 64 nt, Human
caggccaaggcugccugccgugcaccaccaccaccaccaccaccaugcuguguggccaccuggg

SEQ ID NO: 488954 - RNA, 64 nt, Human
ugccaggccaaggcugccugccgugcaccaccaccaccaccaccaccaugcuguguggccaccu

SEQ ID NO: 488955 - RNA, 64 nt, Human
agcugccaggccaaggcugccugccgugcaccaccaccaccaccaccaccaugcuguguggcca

SEQ ID NO: 488956 - RNA, 64 nt, Human
acgagcugccaggccaaggcugccugccgugcaccaccaccaccaccaccaccaugcugugugg

SEQ ID NO: 488957 - RNA, 64 nt, Human
cccacgagcugccaggccaaggcugccugccgugcaccaccaccaccaccaccaccaugcugug

SEQ ID NO: 488958 - RNA, 64 nt, Human
gaggucucuucagcccuuuucgcuaguggucacccaccaccaugguuacuugccagcaacaucu

SEQ ID NO: 488959 - RNA, 64 nt, Human
uuggggagccucgcugugucuugcuguucccaggcaccaccacagcaggugcugccauacucuu

SEQ ID NO: 488960 - RNA, 64 nt, Human
cucagccucccaaguagcugggauuacaggcaugcaccaccaugccuggcuaauuuuguauuuu

SEQ ID NO: 488961 - RNA, 64 nt, Human
cccaggaggucgaggcugcagugagcuaugaucacaccaccacacuccagccugagcagcagag

SEQ ID NO: 488962 - RNA, 64 nt, Human
cucagccucccaaguagcugggacuacaggcaugcaccaccacacuuggccaauguucuguauu

SEQ ID NO: 488963 - RNA, 64 nt, Human
uagaggacggaagcagagggugcuguuucaacgccaccaccaggagagaggcagaggggcugug

SEQ ID NO: 488964 - RNA, 64 nt, Human
uaaauaauuuucuccuuuuuucucucuugaugcucaccaccaccuuuugcccccuucuguucug

SEQ ID NO: 488965 - RNA, 64 nt, Human
aagaucuucuuccaagaaaugcaaacagaccguucaccaccaucuccagcugcucacagacgcc

SEQ ID NO: 488966 - RNA, 64 nt, Human
aagaucuucuuccaagaaaugcaaacagaccguucaccaccaucuccagcugcucacagacacc

SEQ ID NO: 488967 - RNA, 64 nt, Human
aagaucuucuuccaagaaaugcaaacaggcuguucaccaccaucuccagcugaucacagacacc

SEQ ID NO: 488968 - RNA, 64 nt, Human
gcaggugguggacgggcccagugcuggguguuuucaccaccauccccccaucccccaucuaaga

SEQ ID NO: 488969 - RNA, 64 nt, Human
ccauggcccggguguagagaaaccaagcggcagccaccaccaguguuguuuugaauaaaagccc

SEQ ID NO: 488970 - RNA, 64 nt, Human
cuucuagcuggaagccagcccagcguuucucuaccaccaccaccaugccuccaccugacuuugg

SEQ ID NO: 488971 - RNA, 64 nt, Human
cuagcuggaagccagcccagcguuucucuaccaccaccaccaugccuccaccugacuuuggcuu

SEQ ID NO: 488972 - RNA, 64 nt, Human
acauacccacuucacacacacacaucccaaauaccaccaccaaccaccuucuuccucucaacuc

SEQ ID NO: 488973 - RNA, 64 nt, Human
gccaagcccuuuuuagugcugugcucguccagcucaccaccacagccccucucagcccucagua

SEQ ID NO: 488974 - RNA, 64 nt, Human
caaggguggggcuccacaggcagcacaggcgccccaccaccacccaguuuggggacccaguggg

SEQ ID NO: 488975 - RNA, 64 nt, Human
cucagccuccugaguagcugggauuacaggcaugcaccaccaugcccggauaauuuuuguauuu

SEQ ID NO: 488976 - RNA, 64 nt, Human
caugaggagagcuggacucgcucaucuguucuugcaccaccauccagaaugcccccuuugcaag

SEQ ID NO: 488977 - RNA, 64 nt, Human
aaauccauguguccccccuguggucugugugugacaccaccacugugucccagugucuggccca

SEQ ID NO: 488978 - RNA, 64 nt, Human
ugcauaugccccugugcccagugguugaugauaccaccaccaccugccuacccaugggcccaag

SEQ ID NO: 488979 - RNA, 64 nt, Human
gcgaacguggggugauucacagcacaaaagaccucaccaccacaccugcacucaccccaccuug

SEQ ID NO: 488980 - RNA, 64 nt, Human
agggcaggauggggacaggaucaccugcccgggacaccaccauuaucauucuccucuagugacg

SEQ ID NO: 488981 - RNA, 64 nt, Human
auuccccggaaauaugagggaaaucucugcauugcaccaccagaggggcauaaauuugaaaguu

SEQ ID NO: 488982 - RNA, 64 nt, Human
cuucagccuccagagaguugggaccauaggugcacaccaccacaccuagcuaauuuuuugggga

SEQ ID NO: 488983 - RNA, 64 nt, Human
cucagccuccugaguagcugggauuacaggcacacaccaccaugcccagcuaacuuuuguauuu

SEQ ID NO: 488984 - RNA, 64 nt, Human
cauugacucugugacauuucuagcauauccaaggcaccaccagugauuucuccuguuucuuggu

SEQ ID NO: 488985 - RNA, 64 nt, Human
accaccuugaugucugcugugacaucagaggugccaccaccaaagcacucuucccacccuaguc

SEQ ID NO: 488986 - RNA, 64 nt, Human
cccaggaguuugaggcugcggugagcugugaucacaccaccacacuccaaccuguguaacagag

SEQ ID NO: 488987 - RNA, 64 nt, Human
uucagccucccgaguagcugggauuacaggcaugcaccaccacaccuggcuaauuuuuguguuu

SEQ ID NO: 488988 - RNA, 64 nt, Human
uucagccucccgaguagcugagauuauaggcgugcaccaccacaccuggcuaauuuuuguauuu

SEQ ID NO: 488989 - RNA, 64 nt, Human
aauuucaauuugaucauauuuuaaaauauguuuucaccaccauauaagauuuugguucuacuug

SEQ ID NO: 488990 - RNA, 64 nt, Human
aagcaauucuccugccucagcgauuacaggaaugcaccaccacgcccagcuaauuuuguagaga

SEQ ID NO: 488991 - RNA, 64 nt, Human
cuacuagaaccaauagucucaaaguaaaaacaaccaccaccauccaacaaaaggauuacgucug

SEQ ID NO: 488992 - RNA, 63 nt, Human
cagggccccagaagccaugacuacuaccaccaccaccaccaccccuucuggggucacuccauc

SEQ ID NO: 488993 - RNA, 60 nt, Human; identical to SEQ ID NO: 336083

SEQ ID NO: 488994 - RNA, 57 nt, Human; identical to SEQ ID NO: 336084

SEQ ID NO: 488995 - RNA, 64 nt, Human
auuugggaaggaauggaagauggacaccaccggacaccaccagacacuaggaugggauggaugg

SEQ ID NO: 488996 - RNA, 64 nt, Human
auuaaacauggagaaaccaaauuggacaaauccucaccaccaacggugaugauuacaauaaaau

SEQ ID NO: 488997 - RNA, 64 nt, Human
uucaucugcuucuuccacgcaccaccaccaccaccaccaccaucauggccauagccacgguggc

SEQ ID NO: 488998 - RNA, 64 nt, Human
cucuucaucugcuucuuccacgcaccaccaccaccaccaccaccaucauggccauagccacggu

SEQ ID NO: 488999 - RNA, 64 nt, Human
cuccucuucaucugcuucuuccacgcaccaccaccaccaccaccaccaucauggccauagccac

SEQ ID NO: 489000 - RNA, 64 nt, Human
ugccuccucuucaucugcuucuuccacgcaccaccaccaccaccaccaccaucauggccauagc

SEQ ID NO: 489001 - RNA, 64 nt, Human
cucugccuccucuucaucugcuucuuccacgcaccaccaccaccaccaccaccaucauggccau

SEQ ID NO: 489002 - RNA, 64 nt, Human
ggccucugccuccucuucaucugcuucuuccacgcaccaccaccaccaccaccaccaucauggc

SEQ ID NO: 489003 - RNA, 64 nt, Human
uauccucgcucccgggacucacuggcagccccagcaccaccaggucucccgggaagccacccuc

SEQ ID NO: 489004 - RNA, 64 nt, Human
cucagccuccugaguagcugggacuacaguugugcaccaccacaccaaacaagaauugauuaua

SEQ ID NO: 489005 - RNA, 64 nt, Human
accaccaaccacgaccaccaccaccaccaccacucaccaccaucaucaccuccggaaaguguag

SEQ ID NO: 489006 - RNA, 64 nt, Human
cacugccaccaccaccaaccacgaccaccaccaccaccaccacucaccaccaucaucaccuccg

SEQ ID NO: 489007 - RNA, 64 nt, Human
caccacugccaccaccaccaaccacgaccaccaccaccaccaccacucaccaccaucaucaccu

SEQ ID NO: 489008 - RNA, 64 nt, Human
agacaccacugccaccaccaccaaccacgaccaccaccaccaccaccacucaccaccaucauca

SEQ ID NO: 489009 - RNA, 64 nt, Human
uacagacaccacugccaccaccaccaaccacgaccaccaccaccaccaccacucaccaccauca

SEQ ID NO: 489010 - RNA, 64 nt, Human
uuaaguccccaacccuuacagacaccacugccaccaccaccaaccacgaccaccaccaccacca

SEQ ID NO: 489011 - RNA, 64 nt, Human
gcuuuaaguccccaacccuuacagacaccacugccaccaccaccaaccacgaccaccaccacca

SEQ ID NO: 489012 - RNA, 64 nt, Human
uucacuuaaaaauuaaaaacaucaguacuaccaccaccaccaacaacaucaacacagaucuuca

SEQ ID NO: 489013 - RNA, 64 nt, Human
uccuucacuuaaaaauuaaaaacaucaguacuaccaccaccaccaacaacaucaacacagaucu

SEQ ID NO: 489014 - RNA, 64 nt, Human
uucucuuuuuuuuuuguaaagauuaacuccaccucaccaccacaaugagguauuuuucucagca

SEQ ID NO: 489015 - RNA, 64 nt, Human
ugucagagcuugauuagaagccaagacaguggcagcaaaggaagacuuggcccaggaaaaaccu

SEQ ID NO: 489016 - RNA, 64 nt, Human
aagguuaauuccagaagagaggaaugacuugaaggcaaaggaaacuaaggaaggagguucagug

SEQ ID NO: 489017 - RNA, 64 nt, Human
guuaucuuuaagaacggucagcucaggggcuggugcaaaggaugaacugcacauuguugaagca

SEQ ID NO: 489018 - RNA, 64 nt, Human
cccuacaacugagcacaaccucuuuccccacagugcaauucagaauaugcucagggaaugccag

SEQ ID NO: 489019 - RNA, 64 nt, Human
aaaagaagaaaaauucagaaaucaguagaucuuggcaauucagauaauauguuuuuuccuacuu

SEQ ID NO: 489020 - RNA, 64 nt, Human
uucaugauguauuuucaaauagaguucaggaucugcaauucaguucaacacaaguuuguugagc

SEQ ID NO: 489021 - RNA, 64 nt, Human
aucaaaugaaacguuauccuauuggauagacuaggcaauucaucagcucaccugaaaucagcca

SEQ ID NO: 489022 - RNA, 64 nt, Human
uucuaaaauagagaaugguacgacauucuauauugcaauucaagccauccaugaagccaauguc

SEQ ID NO: 489023 - RNA, 64 nt, Human
cauaucaauuucuggauucauaauagcaagauuagcaaaggauaaaugccgaaggucacuucau

SEQ ID NO: 489024 - RNA, 64 nt, Human
aagaauaaacuuuuccagaagcacgagguaguuugcaaaggaaaagucugcacuguuugcucua

SEQ ID NO: 489025 - RNA, 64 nt, Human
gccccauuaaauuacaguguuucuuaaugaacuugcaaaggaauauugcuaaaaacaaacaaaa

SEQ ID NO: 489026 - RNA, 64 nt, Human
cuuuuuuuagaauugaagucugaaacaaacaaaagcaauucaaugucaauagacauuaagcaac

SEQ ID NO: 489027 - RNA, 64 nt, Human
aaggaggaaaaggugucuugcuggcuugccucuugcaauucaauacagaucaguuuagcaaauc

SEQ ID NO: 489028 - RNA, 64 nt, Human
uuccaaccagacaagagugccagaaacuuggcaagcaauucauccuguggaaguugcaaauacu

SEQ ID NO: 489029 - RNA, 64 nt, Human
agguuaaguaugaggucaauguuuuaccuacagagcaauucaacucaugcuuauuuauaguacu

SEQ ID NO: 489030 - RNA, 64 nt, Human
uaagauacguauguaagcucuuauuuuucaauuggcaauucaguuaauuuuuaaauguuuacau

SEQ ID NO: 489031 - RNA, 64 nt, Human
aaaagaaaauuucuacuaauuucagaccucuagagcaauucaguccuguuggaaauuuagaaca

SEQ ID NO: 489032 - RNA, 64 nt, Human
caaggcgacaugcaacuguuguugaaugaugacagcaauucaggaaagacuuaaauaugaaagc

SEQ ID NO: 489033 - RNA, 64 nt, Human
caggggcauccagggcucccuggaugaauagaaugcaauucauucagaagcucagaagcuaaga

SEQ ID NO: 489034 - RNA, 64 nt, Human
caccauuaaacacggggugggggugagggccccugcaauucacggugcaauauucaccaguuuu

SEQ ID NO: 489035 - RNA, 64 nt, Human
caugacugaggaccaaugacgucauguggcuuuugcaauucacgccccccuuaaguccuuaaug

SEQ ID NO: 489036 - RNA, 64 nt, Human
uacuacuacaaagaaaaaaaaacccaaccaaucugcaauucaaaucagaaaguuuggacagcuu

SEQ ID NO: 489037 - RNA, 64 nt, Human
ugacuguagugugauucuagauaaaucaucauuagcaauucauucagauggucaauaacuugaa

SEQ ID NO: 489038 - RNA, 64 nt, Human
aggugucuuacucagaaaaaaaaaugccuggucagcaauucacugucaugcaccuauuuuuaga

SEQ ID NO: 489039 - RNA, 64 nt, Human
aaaguagcugucaacaaggggaaagugaaauugagcaauucacuguuucaggauacuugaggau

SEQ ID NO: 489040 - RNA, 64 nt, Human
ucuccucggccacuccccagauaccagaccugaggcaauucacuugccagcacagauggccaac

SEQ ID NO: 489041 - RNA, 64 nt, Human
aaauguuuauaaaguuuauuuuuaccaaagagaugcaauucauuaugagaaaguauugcauaau

SEQ ID NO: 489042 - RNA, 64 nt, Human
ucaggagacaaaucugaagucaggagaggaaaaugcaaaggagcccugccgugugauggaugug

SEQ ID NO: 489043 - RNA, 64 nt, Human
ugcggcccgcuggcucagggcagggagccuggaagcaaaggaggaccuggcuccugacucucag

SEQ ID NO: 489044 - RNA, 64 nt, Human
caacaucccuuaccuccuuucguugauggccaaagcaaaggagaguccugggagcccacaagau

SEQ ID NO: 489045 - RNA, 64 nt, Human
cggggugaaugaacccaugugugaacugcacagagcaauucauagaaaaugcauagaaauuugu

SEQ ID NO: 489046 - RNA, 64 nt, Human
cugcuucuuagcaauauuagaauguuuuauaaaagcaauucauguuacuuuucuggucuuuuca

SEQ ID NO: 489047 - RNA, 64 nt, Human
aaaauuaauacacaaauagaaaccauuuucaaaagcaauucagaaaggaugcacagucaggaag

SEQ ID NO: 489048 - RNA, 64 nt, Human
agagauauuuuuaaaacuuguuuaaaauuuuugugcaauucauauauuaaauugcacuuacuug

SEQ ID NO: 489049 - RNA, 64 nt, Human
accagcuuuuuguuuguuuauguuacagaaugcugcaauucagggcucuucaaacuuguuugau

SEQ ID NO: 489050 - RNA, 64 nt, Human
agcuauaguacauguaggcauuuaguuaaguauagcaauucaaacugaccugcauccauccaaa

SEQ ID NO: 489051 - RNA, 64 nt, Human
ggagcacagagaacauuuguugaaguauaguuuugcaauucauauacuguuuucuaaaacuaag

SEQ ID NO: 489052 - RNA, 64 nt, Human
aaaaaaaaaaaaaaaaaaaaauugcacaauuugagcaauucauuucacuuuaaagucuuuccgu

SEQ ID NO: 489053 - RNA, 64 nt, Human
cauaaauggacuuguugaaugcgaacgaauauaugcaauucauauacuuuuggagaugaacgua

SEQ ID NO: 489054 - RNA, 64 nt, Human
agacauuuuucauacacuuaauaguacuguaacugcaauucacauacaaaaugucugauuuuaa

SEQ ID NO: 489055 - RNA, 64 nt, Human
cugcaggcuuuccacugccuguauuggaaaucuugcaauucacauaauuauucagucacugccu

SEQ ID NO: 489056 - RNA, 64 nt, Human
uggacccauacccugucuccaacccugccuugaagcaauucaauaaagaggaagcaaacagcca

SEQ ID NO: 489057 - RNA, 64 nt, Human
gauuguauuuaagacauaaacaaagacauugacagcaauucaugguucaaguauuaagcaguuc

SEQ ID NO: 489058 - RNA, 64 nt, Human
cagaaauuuguaacauuacuucugauuugaaaaugcaauucacaaaauauagggaaauuuuuau

SEQ ID NO: 489059 - RNA, 64 nt, Human
guuagucuccauccugcucagauaugacuccugggcaauucacuuaacuucuccauggcugcuu

SEQ ID NO: 489060 - RNA, 64 nt, Human
auaggugcuuugaucuauuuacuggauauguucugcaauucaacacauccacagguucgagccc

SEQ ID NO: 489061 - RNA, 64 nt, Human
auuauuuuaucuccucccaugaugcugagaggaagcuucguauucugaucucugagugaauccc

SEQ ID NO: 489062 - RNA, 64 nt, Human
cacaagcacgcccagcccccgccgaauucuuuuagcuucguaauuggaaccuuugaccugaucu

SEQ ID NO: 489063 - RNA, 64 nt, Human
ucccguccccccgguagacucuguccugcuggucccaccacacauggcugggacaucuguuccc

SEQ ID NO: 489064 - RNA, 64 nt, Human
uucuggagaauguucuuucacaucacuggaaucugcaauucaagaagugacaagggagaauucu

SEQ ID NO: 489065 - RNA, 64 nt, Human
uggaguuugguaucuagggaguaggccuuauuuagcaauucaaauuuuauggagaugaaugauc

SEQ ID NO: 489066 - RNA, 64 nt, Human
caguugccuauaaaaagugcucuauguuauccaagcaauucauacuauaagcuucacucuuauu

SEQ ID NO: 489067 - RNA, 64 nt, Human
agaccucagaaaacacaagugccuucuccacggugcaauucagacuucagugaucuccaguggu

SEQ ID NO: 489068 - RNA, 64 nt, Human
caaagaacuaaggauuuuuccauggacaugggcagcaauucacgcugucucuucuuaacccuga

SEQ ID NO: 489069 - RNA, 64 nt, Human
acucuagagaacuggguuuucucccaguacuccagcaauucauuucugaaagcaguugagccac

SEQ ID NO: 489070 - RNA, 64 nt, Human
uggaggauuccuuugaggaaauguucucaauugagcaauucagucccucuccccaaagacuaga

SEQ ID NO: 489071 - RNA, 64 nt, Human
auauauuaagccccaggcugaauacucagggacagcaauucacagccugccucugguucuauaa

SEQ ID NO: 489072 - RNA, 64 nt, Human
ugcucuauguaugauccuguuacaaguccaguuugcaauucauuuguuuccuagaacacagaag

SEQ ID NO: 489073 - RNA, 62 nt, Human
uuuggcaaccuuuguguuacagauuaaaaauucagcaauucaguacugcgucgaggucuugg

SEQ ID NO: 489074 - RNA, 64 nt, Human
uugccagcaaguagauucuuacgaacuccaacuugcaauucagggggcaugucccaguguuuuu

SEQ ID NO: 489075 - RNA, 64 nt, Human
cugacccuaaguuaucaagguggaaaaaaaacaugcaauucaguaauugaaaauguggugaaaa

SEQ ID NO: 489076 - RNA, 64 nt, Human
uaccccgccaaggaaaggcauguacaaaaauuaugcaauucaguguuccaagucucuguguaac

SEQ ID NO: 489077 - RNA, 64 nt, Human
cugacuggucaggugcuacuuaagaccagcuugggcaauucagggcagaacuccuguaucagcc

SEQ ID NO: 489078 - RNA, 64 nt, Human
ccuauaaaacuaguuaaaaauggaauuucuuuuagcaauucaguuuaguacaggagugacauua

SEQ ID NO: 489079 - RNA, 64 nt, Human
aaacaauaugugauauauuuccccucuugaagaggcaauucauuaaacucucaaauuuucuaua

SEQ ID NO: 489080 - RNA, 64 nt, Human
ggggguucagcugugcccgcccccaggcugugccccaccacagauucugccaaggaucagaacu

SEQ ID NO: 489081 - RNA, 62 nt, Human
uugcagaccuaagguggaguaacaaggaguauuaccaccacauggcuacugaccgugucauc

SEQ ID NO: 489082 - RNA, 64 nt, Human
agaagugagaguauuuauuuuuggcauguuuggcccaccacacagacucuguguguguaugugu

SEQ ID NO: 489083 - RNA, 64 nt, Human
acagugcuugucuuuuuuuguuauuacacuaacugcaauucaguaagcugcaugacaaaauaug

SEQ ID NO: 489084 - RNA, 64 nt, Human
uugaaacuuuuaugaacuucugagcuguccccuugcaauucaaccgcaguuugaauuaaucaua

SEQ ID NO: 489085 - RNA, 64 nt, Human
ucugggaguuaucaauuuuaaagagaacuuuugugcaauucaaaugaaguuuuuauaaguaauu

SEQ ID NO: 489086 - RNA, 64 nt, Human
gauguuuguuuguauaauuuugaacacuauaauagcaauucagagacagacauuguuaaagguu

SEQ ID NO: 489087 - RNA, 64 nt, Human
uuuuguagcugcuauauauuuuaagccuucauuugcaauucauguaacaguugugucauaaauu

SEQ ID NO: 489088 - RNA, 64 nt, Human
gagcuuuaugaucuguggaaauuuggaaugaaaugcaauucauuuuguacauacauaguauauu

SEQ ID NO: 489089 - RNA, 64 nt, Human
uccaucuaguuuacuucuaaaaugggaacuugaggcaauucagguauccaggcaaaucuuugua

SEQ ID NO: 489090 - RNA, 64 nt, Human
uuuaacguaugaggaagguuguccugcuacggaugcaauucaauucuuccuuuuuuauuacuau

SEQ ID NO: 489091 - RNA, 64 nt, Human
gagaucuauaaaaccuugauuauuuguuaguuuugcaauucaaaacagcuaaugucugguuauu

SEQ ID NO: 489092 - RNA, 64 nt, Human
uuccgugagcuaugauaagauugaaauuccaguugcaauucauaacuaaugaauugaaauuuua

SEQ ID NO: 489093 - RNA, 64 nt, Human
cagguuaauuuuuuggauauuucagaaacccauagcaauucagugauuuuucuuuuuguaguag

SEQ ID NO: 489094 - RNA, 64 nt, Human
cuccccagucucacccacccgugcucccaagagagcaauucaucaugucagugucugguguuuu

SEQ ID NO: 489095 - RNA, 64 nt, Human
gcucagucaagacagacauccuggcguacuugaagcaauucaaaaccaaauaggaagguggagu

SEQ ID NO: 489096 - RNA, 64 nt, Human
gcuucuugucugagaacaguagugaccccuggcagcaauucauuaccaaaacacagacaaacca

SEQ ID NO: 489097 - RNA, 64 nt, Human
uuacacaaauauuuaagaggaaagaguauuaagagcaauucaaaaaaaguaaccuuauacuacu

SEQ ID NO: 489098 - RNA, 64 nt, Human
gaaugccgcgugcuuucuccugacuuggggcaaugcaauucaaaacuuuuuuuccccuauuauu

SEQ ID NO: 489099 - RNA, 64 nt, Human
gucaaagucagggaaucccuccuccugggagcccccaccacaaacuucugcuggggauuugagu

SEQ ID NO: 489100 - RNA, 64 nt, Human
cagccuccugaguagcugggaucauaggcacgcgccaccacacccagcuaauuuuuuguauuuu

SEQ ID NO: 489101 - RNA, 64 nt, Human
cagccucccaaagugcugggauuacaagugugagccaccacaccuggcuccagaaauuuuauuu

SEQ ID NO: 489102 - RNA, 64 nt, Human
caguuguauagacaauaaacuauaauuuucauaugcaauucagcaauugcuguucugugugugc

SEQ ID NO: 489103 - RNA, 64 nt, Human
ggauggcaagcaaaguucuucuagaauuccacaugcaauucacucuggcgacccugugcuuucc

SEQ ID NO: 489104 - RNA, 64 nt, Human
uguuuauuuuacaaaagaguagguacucuugagagcaauucaaaucaugcugacaaggauacug

SEQ ID NO: 489105 - RNA, 64 nt, Human
aagaaaauuuaagaccccauugaguuacuguaaugcaauucaacuuugaguuaucuuuuaaaua

SEQ ID NO: 489106 - RNA, 64 nt, Human
cagcaggccaucaggaacucuuaauaucagcacagcaauucauuuuaguuuggucacgcauuug

SEQ ID NO: 489107 - RNA, 64 nt, Human
uaguuucuggaagguaagccugggagacacauaagcaauucacugcuauaauuuaguugaugua

SEQ ID NO: 489108 - RNA, 64 nt, Human
cuaaaucucuagaagaggcacaagaauggcuaaagcaauucauccaagggccaccggaaguaau

SEQ ID NO: 489109 - RNA, 64 nt, Human
aguaaguaaaauuucaaauagcauuuuagugaaugcaauucaguaguccugaagccugacuuaa

SEQ ID NO: 489110 - RNA, 64 nt, Human
guuuaaaaagaaauugagguuguucaaaguuuaagcaauucauucucucugaacacacauugcu

SEQ ID NO: 489111 - RNA, 64 nt, Human
ggagggagagagacucuuaaacguaaauaaaaaugcaauucacucacaacucuaaaugauaauu

SEQ ID NO: 489112 - RNA, 64 nt, Human
aucccggcuuucccguaacgcacaggacacgugugcaauucauaggaacggcccagaucgcccu

SEQ ID NO: 489113 - RNA, 64 nt, Human
caaggaaagcgaguuagucuuuucagugucuuuugcaauucaauucuuuugucauguauaacug

SEQ ID NO: 489114 - RNA, 64 nt, Human
gccagacaauuagacaacuauggaggaaugaaaggcaauucaaacaucugcuugauucccgccc

SEQ ID NO: 489115 - RNA, 64 nt, Human
ugccauugcacuuuauagucugauuacaaaacgugcaauucaggagcccagcagugacacacuu

SEQ ID NO: 489116 - RNA, 64 nt, Human
uaaugauccccaaaugcugaaaaagugaaauacagcaauucaacagauaauagagcaauguuua

SEQ ID NO: 489117 - RNA, 64 nt, Human
gggauuaacuucugucuuucuggugaacaauauagcaauucacgcauucuucaagcagcaaaag

SEQ ID NO: 489118 - RNA, 64 nt, Human
agcaauuaaaagcaaaccgcgacacccuuugucuccaccacacauaguguacuuuggaagcaca

SEQ ID NO: 489119 - RNA, 64 nt, Human
aagaccucuuuucuuuagauggugccaccuaugcccaccacaacagagauuuuacauggaaacc

SEQ ID NO: 489120 - RNA, 64 nt, Human
cccaggcccagcaccgagcagaacagaccagagcccaccacaccacaaagagcagcaccugacu

SEQ ID NO: 489121 - RNA, 64 nt, Human
aaccugaauuugaucaggucucuggaucuuauuugcaauucaaaagaaauuuuaaaaaaauccu

SEQ ID NO: 489122 - RNA, 64 nt, Human
ugaaauguauagugaauaggauguugcacugguggcaauucaucauggagcauaauaaaauuaa

SEQ ID NO: 489123 - RNA, 64 nt, Human
uuauugaagaacuggcaucuuaaaucagccuuccgcaauucauguaguuucugggucuucuggg

SEQ ID NO: 489124 - RNA, 64 nt, Human
aagcccuggugaaggagcuuagcuugucuucuuggcaauucacaaugccucacuccacacccua

SEQ ID NO: 489125 - RNA, 64 nt, Human
ucacccaugcuaagggcacaugcacacauuuucugcaauucacucucagaccaucagcauccuc

SEQ ID NO: 489126 - RNA, 64 nt, Human
guaauuuaauugcugcuguugggcuuucguuucugcaauucagcuuuguuuaaagugauuugaa

SEQ ID NO: 489127 - RNA, 64 nt, Human
gaggcagggcucucccgugcauccccccugcucagcaauucagaccccuuugagagacgccacu

SEQ ID NO: 489128 - RNA, 64 nt, Human
cucauuaaaaggaaaggaacuacugggaaauuaugcaauucaauaauuuagacucuguuaccag

SEQ ID NO: 489129 - RNA, 64 nt, Human
gugacugaaagugcaaagaggaaauggacagcaugcaauucauccuaauguacaaaacguuaua

SEQ ID NO: 489130 - RNA, 64 nt, Human
caaauuaacucuuagaagaaaccccacaaauaaagcaauucaaucaaggcuguucuauuuaaau

SEQ ID NO: 489131 - RNA, 64 nt, Human
ucugaaaacacacuggcaggugcuccucuccuuggcaauucauugaguauccagaguucuacga

SEQ ID NO: 489132 - RNA, 64 nt, Human
caauguuuguaauaauugcucauaagcaauaccagcaauucauaaaaacugcuuacuuaugcca

SEQ ID NO: 489133 - RNA, 64 nt, Human
ugggcaaggacaccauagugucacagagagcuuggcaauucauggggcaucugaagcuuuacca

SEQ ID NO: 489134 - RNA, 64 nt, Human
uacaggcacacagucacugaagcaggcccuguuugcaauucacguugccaccuccaacuuaaac

SEQ ID NO: 489135 - RNA, 64 nt, Human
aacuggauacuguacugauacuauucaaugcaaugcaauucaaugcaaugaaaacaaaauucca

SEQ ID NO: 489136 - RNA, 64 nt, Human
aaggauggaaaggugacaguauuacucucgagaggcaauucaguccugggcaaagguauuagua

SEQ ID NO: 489137 - RNA, 64 nt, Human
aaguggggcaaagccagcaugcaagcagaccccaccaccacagcccaccuccguccucacauac

SEQ ID NO: 489138 - RNA, 64 nt, Human
augagcucccuuugcccuucuccuguaucccacaccaccacauccaaccuccuugccugccugu

SEQ ID NO: 489139 - RNA, 64 nt, Human
aagggggcagaucccagagccccucucaccccccccaccacaggccugcuccuuccuuagccuu

SEQ ID NO: 489140 - RNA, 64 nt, Human
auaaauauauaguuaauucgaaauaaaauccauugcaauucauuuaugaguuaucuuacauauc

SEQ ID NO: 489141 - RNA, 64 nt, Human; identical to SEQ ID NO: 388252

SEQ ID NO: 489142 - RNA, 64 nt, Human; identical to SEQ ID NO: 388256

SEQ ID NO: 489143 - RNA, 64 nt, Human; identical to SEQ ID NO: 388257

SEQ ID NO: 489144 - RNA, 64 nt, Human; identical to SEQ ID NO: 388258

SEQ ID NO: 489145 - RNA, 64 nt, Human; identical to SEQ ID NO: 388259

SEQ ID NO: 489146 - RNA, 64 nt, Human; identical to SEQ ID NO: 388260

SEQ ID NO: 489147 - RNA, 64 nt, Human; identical to SEQ ID NO: 388261

SEQ ID NO: 489148 - RNA, 64 nt, Human; identical to SEQ ID NO: 388262

SEQ ID NO: 489149 - RNA, 64 nt, Human; identical to SEQ ID NO: 388263

SEQ ID NO: 489150 - RNA, 64 nt, Human; identical to SEQ ID NO: 388264

SEQ ID NO: 489151 - RNA, 64 nt, Human; identical to SEQ ID NO: 388265

SEQ ID NO: 489152 - RNA, 64 nt, Human; identical to SEQ ID NO: 388266

SEQ ID NO: 489153 - RNA, 64 nt, Human; identical to SEQ ID NO: 388267

SEQ ID NO: 489154 - RNA, 64 nt, Human; identical to SEQ ID NO: 388268

SEQ ID NO: 489155 - RNA, 64 nt, Human; identical to SEQ ID NO: 388269

SEQ ID NO: 489156 - RNA, 64 nt, Human
cagccucccgaguagcugagacuucaggugcauuccaccacacauggcuaauuuuuguauuuuu

SEQ ID NO: 489157 - RNA, 64 nt, Human
cccucugaggcccacaggucugucaucccauaggccaccacacagagaaaugcuggcugagggu

SEQ ID NO: 489158 - RNA, 64 nt, Human
cucagccuccugaguagcuagguacaggcaccugccaccacacccagcuaauuuuuuguauuuu

SEQ ID NO: 489159 - RNA, 64 nt, Human
guuuauuuuucauguucuuucugacauuacuuuagcaauucaacuugaugugagaagaaaaaac

SEQ ID NO: 489160 - RNA, 64 nt, Human
uugauaaauuggcaugacagaguggggaaaaaaagcaauucacaaaaccauuucauauuuuuua

SEQ ID NO: 489161 - RNA, 64 nt, Human
auuuucagaugcuuugaacuugacacauacucuagcaauucauuggaacaccaaggcaaaaaca

SEQ ID NO: 489162 - RNA, 64 nt, Human
gcaccuaccacagugucauaccugguagaggugagcaauucauauucaaagguugcaaaguguu

SEQ ID NO: 489163 - RNA, 64 nt, Human
cuuggccuguuuuguuuuucuuuccuugggcucagcaauucaaauucuaguuguuauuuggugg

SEQ ID NO: 489164 - RNA, 64 nt, Human
uuaaacuaaaauuuuggguauaugaaagaaggcagcaauucagaaguaaagaagauacuaacgu

SEQ ID NO: 489165 - RNA, 64 nt, Human
aaagugaagaauuaacuucuccuccagaacaagugcaauucagaaggcagcucugcauucuacc

SEQ ID NO: 489166 - RNA, 64 nt, Human
ggcuugaaccuuuucccuucaguaauaacguauugcaauucaucauugcugccugucucgugga

SEQ ID NO: 489167 - RNA, 64 nt, Human
gacaugggcccacacaucugcuuuggcuuugccggcaauucagggcuugggguauuccauguga

SEQ ID NO: 489168 - RNA, 64 nt, Human
cccccauagcacuguguauaccgcuacuaccacugcaauucacauuauauuggaaugaacaauu

SEQ ID NO: 489169 - RNA, 64 nt, Human
gguugcagugaacugagauagugauagugccacugcaauucagccugggugacauagagagacu

SEQ ID NO: 489170 - RNA, 64 nt, Human
aaucucacugaauagacauguaccaagcuaaauagcaauucauuucuccuccccucuacccuua

SEQ ID NO: 489171 - RNA, 64 nt, Human
cuuccgagaaacaggcgauaauuuuucagauguggcaauucagggcggaauaaugggcauugag

SEQ ID NO: 489172 - RNA, 64 nt, Human
guuagucucagguccucuucccagaauuuacaaagcaauucacuaccuuuugcuacauuugccu

SEQ ID NO: 489173 - RNA, 64 nt, Human
acuucuuuagagggaguaaauuuaucaauucagagcaauucauccuccucuuuccaucuuugau

SEQ ID NO: 489174 - RNA, 64 nt, Human
gauucuccaagacaaaagaagagagauccuaaaggcaauucagauauccccaaggcugccucuc

SEQ ID NO: 489175 - RNA, 64 nt, Human
aagccucccggggagcugggaccacaggcacgugccaccacacccagcucucuuucuugguuuu

SEQ ID NO: 489176 - RNA, 64 nt, Human
uuacauagucaugugcgaggucaaaacugagucaccaccacaaccaaguuccagcuggcaagaa

SEQ ID NO: 489177 - RNA, 64 nt, Human
cagccuccugaguagcugggacuacaggcgcccgccaccacacccggcuaauuuuuuguauuuu

SEQ ID NO: 489178 - RNA, 64 nt, Human
uuaauguuuaauuggguugaucaaaugagauucagcaauucacaagugcauuaauauaaacaga

SEQ ID NO: 489179 - RNA, 64 nt, Human
ucuagcucagucucaaaucugagugggaccaagugcaauucagggccuuuuucuccacucaccu

SEQ ID NO: 489180 - RNA, 64 nt, Human
caaagagguggaauuucaucagaauggaguaaaugcaauucaaaaauuguauaaaaaugaacac

SEQ ID NO: 489181 - RNA, 64 nt, Human
uaguagguaauuccuuagagauacaguauaccuggcaauucacaaauagccauugaacaaaugu

SEQ ID NO: 489182 - RNA, 64 nt, Human
agcugaguguuuuuuccccuaauauuuuccuugugcaauucagacuuaagcaucgaguuuuuac

SEQ ID NO: 489183 - RNA, 64 nt, Human
ucccuccucaauuggcuuauuuuuuagaucaccugcaauucauuugcaaauugcaauaaaacac

SEQ ID NO: 489184 - RNA, 64 nt, Human
ucguagagucuaauguuuuuuaaaauuggugccagcaauucacgauuuauauuuuuugaauuac

SEQ ID NO: 489185 - RNA, 64 nt, Human
caacacuaugugaaggguucacaucuuaaccugugcaauucagauugauacucagaauaugggu

SEQ ID NO: 489186 - RNA, 64 nt, Human
uaaagaacucuguagcucaccaagguggagaaacgcaauucagaaaaguaauuucuccaagguc

SEQ ID NO: 489187 - RNA, 64 nt, Human
gcaugagaugauauuguacuuguauaggauucuagcaauucauaauaaauauguaagacuaggc

SEQ ID NO: 489188 - RNA, 64 nt, Human
guuucucaggcuggucuugaacuccugggcucaagcaauucaucccccucagccucccaaagug

SEQ ID NO: 489189 - RNA, 64 nt, Human
aaaaaacaaaaacuaaaaaccucuuagcuuuucugcaauucaacuuuuuauuuuuauuuuuauu

SEQ ID NO: 489190 - RNA, 64 nt, Human; identical to SEQ ID NO: 489189

SEQ ID NO: 489191 - RNA, 64 nt, Human
ugcagaaccuuucauuuugauuuuuaugaaaguugcaauucauguaauuuauauaaacuuuuua

SEQ ID NO: 489192 - RNA, 64 nt, Human
ccaaacaccacagcaucagcaugguuuaggggaagcaauucacagauuaauguacccugcguuu

SEQ ID NO: 489193 - RNA, 64 nt, Human
aggggugguguggagauuguuaaucuuguauaaagcaauucaauaaauuguuucaagguuucca

SEQ ID NO: 489194 - RNA, 64 nt, Human
gggcuggcaccaguggaaacacauacugaagcugccaccacaauagcuugugagguuuuaucca

SEQ ID NO: 489195 - RNA, 64 nt, Human
agggagguagaggcuucagugagcugagaucgcaccaccacacuccagccugggugacagagug

SEQ ID NO: 489196 - RNA, 61 nt, Human
agcagcaacaguuuguguagccagucuaccaccaccacagcaccccagacagcuaggcuua

SEQ ID NO: 489197 - RNA, 64 nt, Human
gugggguuuuaaaaaugaaauuuggcuaauaggagcaauucagcuauuuuucuauacaguaauu

SEQ ID NO: 489198 - RNA, 64 nt, Human
aaauuacuggcuuguuagccaacagcuucugauagcaauucauauaacccucuaagaauaccug

SEQ ID NO: 489199 - RNA, 64 nt, Human
uagcugggcacaguggcucaugccgauaaucccagcaauucagaaagcugaggcaggaggauua

SEQ ID NO: 489200 - RNA, 64 nt, Human
agauuauuaaaauuagugcuguaaaucagggugggcaauucacagccuuucugaacugacugaa

SEQ ID NO: 489201 - RNA, 64 nt, Human
uccagaauuaaauucuauugaaaaaggaaaaucagcaauucagcaaaaaauaaauaaaaaauaa

SEQ ID NO: 489202 - RNA, 64 nt, Human
auguuguuuaauucuguagguaaccauuugagcugcaauucaggaucuuuuuuauaacaccagu

SEQ ID NO: 489203 - RNA, 64 nt, Human
uacauuuaaucaacacugugaagucuguucuacagcaauucagccauuacacaguauaugacug

SEQ ID NO: 489204 - RNA, 64 nt, Human
ccuguguguauguguguguuugugugucuauuuggcaauucacaaguccugccaagugguuucu

SEQ ID NO: 489205 - RNA, 64 nt, Human
gaaaaaaacaaacaaaaaacugccuuugauacaggcaauucaguggacuauaauaauaguggag

SEQ ID NO: 489206 - RNA, 64 nt, Human
aaagaagcauuuauucuuguguucuggauuuagagcaauucaucuaauaaacaguuucucacuu

SEQ ID NO: 489207 - RNA, 64 nt, Human
gguaauaaucaaauuuaagaauuugugacauguagcaauucaagaaacaaaaagguauuuugcu

SEQ ID NO: 489208 - RNA, 64 nt, Human
ucuagacucugaaaaaaaugcuuuuaucauuuuugcaauucagacaaggguaaacauuuuacuu

SEQ ID NO: 489209 - RNA, 64 nt, Human
auuuauugcauuuugaaauaaucauuaacaugcugcaauucaggagcugguuagaacauuuuaa

SEQ ID NO: 489210 - RNA, 64 nt, Human
ggcccuccuugucauugaccuuagcuaaaccauggcaauucauaaauagaggaaacauuaauga

SEQ ID NO: 489211 - RNA, 64 nt, Human
uuuacauuugaacugaaaauauguauaaaaucuagcaauucacaaaaaugcccuagaaauauag

SEQ ID NO: 489212 - RNA, 64 nt, Human
aaguuauucuaucuuggagauaaaaucuguaugugcaauucaccgguauuaccaguuuauuaug

SEQ ID NO: 489213 - RNA, 64 nt, Human
acuaguaguaaacauuauuauuuuuuuuauauuugcaaaggaaacauaucuaauccuuccuaua

SEQ ID NO: 489214 - RNA, 64 nt, Human
aaagaaggccagcaacauuggcacaugccaccuggcaaaggacccuugaguaagugaaggucuc

SEQ ID NO: 489215 - RNA, 64 nt, Human
cagagauucccccuucuccucuccccuacuggaggcaaaggaaggggaggguggaugggggggc

SEQ ID NO: 489216 - RNA, 64 nt, Human
agagcugagaagcagggucaaagcacaauacugggcaauucagagcaugguuagaagaggaaag

SEQ ID NO: 489217 - RNA, 64 nt, Human
ccucuuguguuggcaagauggcugccaacucuuggcaauucauacauccuuguuucugucuggu

SEQ ID NO: 489218 - RNA, 64 nt, Human
ccauuaccucuagcauuuauucuuuuuauuacaagcaauucaauuguacacuuuuaguuauuuu

SEQ ID NO: 489219 - RNA, 64 nt, Human
uccuagauccuaagggucgaaagcucuagaaucugcaauucaaaaguuccaagagucuaaagau

SEQ ID NO: 489220 - RNA, 64 nt, Human
aagaaacagccacugacccuggucaccagaggcugcaauucaggccgcaagcagcugccugggg

SEQ ID NO: 489221 - RNA, 64 nt, Human
ccaaggagguggccacccugagcaaggaacuccugcaauucacggcauccaagguacccuccac

SEQ ID NO: 489222 - RNA, 64 nt, Human
ccagccuuccugaaccugccucucugaggauaaagcaauucauuuucucccacccucggcccuc

SEQ ID NO: 489223 - RNA, 64 nt, Human
aguucugguuccuuuuuccuuaacaauuuuuucugcaauucaggucuccuuuugcauuuuugcu

SEQ ID NO: 489224 - RNA, 64 nt, Human
aguucugguuccuuuuuccuuaacaauuucuucugcaauucaggucuccuuuugcauuuuugcc

SEQ ID NO: 489225 - RNA, 64 nt, Human
uuaaagugacaugaaugugggaaguccuucagcagcaauucaaaacuuaaauacuaugauguuu

SEQ ID NO: 489226 - RNA, 64 nt, Human
aaaauacuguggauggauuuaauagguaaucaaggcaauucaguaucucccucucuuaaagucu

SEQ ID NO: 489227 - RNA, 64 nt, Human
ugggcucaaaucuaggcccuggcacugucaucaagcaauucacugcaucccucugugccucagu

SEQ ID NO: 489228 - RNA, 64 nt, Human
cuuuggcaagcagucaacacuuauucaccaucaggcaauucaugguguagggaaacuugacuaa

SEQ ID NO: 489229 - RNA, 64 nt, Human
ccuuccaucacaauucaacccuguaagucauaaggcaauucauacuggagagaaaccuuacaag

SEQ ID NO: 489230 - RNA, 64 nt, Human
uuguauggagccucuucugccaagagagggccaugcaauucaucccagaggaaccugaggccug

SEQ ID NO: 489231 - RNA, 64 nt, Human
gaaucuuuuggauuuuaagcaguccgaaauaauagcaauucaugggcuguguguguguguguau

SEQ ID NO: 489232 - RNA, 64 nt, Human
cauccaggcccccugggggcgcccgucucccacagcaaaggaccuggugugggaugggagaacu

SEQ ID NO: 489233 - RNA, 64 nt, Human
gggggugggaggguaagaguuuugacaaguuguggcaaaggaaacuauacuuuucauuuuuaaa

SEQ ID NO: 489234 - RNA, 64 nt, Human
cccuagcuuccccaaaucaguagcuugaagaaaggcaaaggagacaccuguuccuucccaacca

SEQ ID NO: 489235 - RNA, 64 nt, Human
ucccuuccccaccuccagcaguauuacuuguaacgcaauucagggauauuaaagggacuuuggc

SEQ ID NO: 489236 - RNA, 64 nt, Human
acguaacuaaaacauggcggguaccgaaaggagggcaauucauggaagaaauuuccucuguuca

SEQ ID NO: 489237 - RNA, 64 nt, Human
aaaugcugaaauguggaugcauaccgaaauaaaagcaauucauuguguacuaaagguuuuuuuu

SEQ ID NO: 489238 - RNA, 64 nt, Human
acagauuguuccucuuauauuuguguguauacaggcaauucauguuuuaauguaaauaaauacc

SEQ ID NO: 489239 - RNA, 64 nt, Human
aucaucucuguugcacauguuuaauuggcaaaaagcaauucaugauaaauaaaauuacugcuuu

SEQ ID NO: 489240 - RNA, 64 nt, Human
gucagcauuuucuugagauacauuucuuugaaaagcaauucauucucucucuaguaauuguaau

SEQ ID NO: 489241 - RNA, 64 nt, Human
ugcacauagcagacuagaauucugggaacccugugcaauucagucugcucucccuuguggaccc

SEQ ID NO: 489242 - RNA, 64 nt, Human
guucuguuauccaauccgaaacacggaacaugcugcaauucaggagucuggcucucuucuuaag

SEQ ID NO: 489243 - RNA, 64 nt, Human
ggccucugagggcaccaggcccuggagaagaggugcaauucaggguguguguguguuuuuuuuc

SEQ ID NO: 489244 - RNA, 64 nt, Human
aacugugggauggcgauggugggaugugucgcaagcaauucacuagacaaucuucacaugaaug

SEQ ID NO: 489245 - RNA, 64 nt, Human
acagcucucaugagucucccgcacucagccuuuagcaauucauuaaaaauucuuguugaauucu

SEQ ID NO: 489246 - RNA, 64 nt, Human
cuguguuuucaaugcacaaggggaaauuuggcuugcaauucaucacuuugaaaagguuagucau

SEQ ID NO: 489247 - RNA, 64 nt, Human
auuuaaggugugcaauuuucuauaggugacuuuugcaauucagggaagauuugggcauauuaaa

SEQ ID NO: 489248 - RNA, 64 nt, Human
aaauaugcucagcugauuuugaaaaagugaaaaagcaauucaauggaggaagaauagccuuucu

SEQ ID NO: 489249 - RNA, 62 nt, Human
aaggaacugaaagagauugagccaccacacgagcaauucacaaaggucuguucuauuuggua

SEQ ID NO: 489250 - RNA, 64 nt, Human
acugaugaugcugacuguugcuccagcuguguuggcaauucaagaugaccuuguuacuaacuga

SEQ ID NO: 489251 - RNA, 64 nt, Human
accauuugagaagagaaacuuggcuucuguuuucgcaaaggaaaaaaaaaauaggauaggcuuc

SEQ ID NO: 489252 - RNA, 64 nt, Human
auugugguuuaauuuuugacuuuuacagguaagugcaaaggagaagugguuucaugaaauguuc

SEQ ID NO: 489253 - RNA, 64 nt, Human
acaugugacaguaauuccagcucggucccuccaggcaaaggagaaacgggacuuacuucacagg

SEQ ID NO: 489254 - RNA, 64 nt, Human; identical to SEQ ID NO: 489018

SEQ ID NO: 489255 - RNA, 64 nt, Human; identical to SEQ ID NO: 489019

SEQ ID NO: 489256 - RNA, 64 nt, Human; identical to SEQ ID NO: 489020

SEQ ID NO: 489257 - RNA, 64 nt, Human; identical to SEQ ID NO: 489021

SEQ ID NO: 489258 - RNA, 64 nt, Human; identical to SEQ ID NO: 489022

SEQ ID NO: 489259 - RNA, 64 nt, Human; identical to SEQ ID NO: 489026

SEQ ID NO: 489260 - RNA, 64 nt, Human; identical to SEQ ID NO: 489027

SEQ ID NO: 489261 - RNA, 64 nt, Human; identical to SEQ ID NO: 489028

SEQ ID NO: 489262 - RNA, 64 nt, Human; identical to SEQ ID NO: 489029

SEQ ID NO: 489263 - RNA, 64 nt, Human; identical to SEQ ID NO: 489030

SEQ ID NO: 489264 - RNA, 64 nt, Human; identical to SEQ ID NO: 489031

SEQ ID NO: 489265 - RNA, 64 nt, Human; identical to SEQ ID NO: 489032

SEQ ID NO: 489266 - RNA, 64 nt, Human; identical to SEQ ID NO: 489033

SEQ ID NO: 489267 - RNA, 64 nt, Human; identical to SEQ ID NO: 489034

SEQ ID NO: 489268 - RNA, 64 nt, Human
ugaggcuuuuccuucuugcccuuuucggaguauugcaaaggagcuaaaacuggugugcaaccgc

SEQ ID NO: 489269 - RNA, 64 nt, Human
ccccgcaaggacccgcugacccgcuggauggagagcaaaggagaccccucccgagccgcucaca

SEQ ID NO: 489270 - RNA, 64 nt, Human
uugauugauugaagaauguaucacucuuauucaagcaaaggaauucagacuuaaaugccuaccu

SEQ ID NO: 489271 - RNA, 64 nt, Human; identical to SEQ ID NO: 489035

SEQ ID NO: 489272 - RNA, 64 nt, Human; identical to SEQ ID NO: 489036

SEQ ID NO: 489273 - RNA, 64 nt, Human; identical to SEQ ID NO: 489037

SEQ ID NO: 489274 - RNA, 64 nt, Human; identical to SEQ ID NO: 489038

SEQ ID NO: 489275 - RNA, 64 nt, Human; identical to SEQ ID NO: 489039

SEQ ID NO: 489276 - RNA, 64 nt, Human; identical to SEQ ID NO: 489040

SEQ ID NO: 489277 - RNA, 64 nt, Human; identical to SEQ ID NO: 489041

SEQ ID NO: 489278 - RNA, 64 nt, Human; identical to SEQ ID NO: 489045

SEQ ID NO: 489279 - RNA, 64 nt, Human; identical to SEQ ID NO: 489046

SEQ ID NO: 489280 - RNA, 64 nt, Human; identical to SEQ ID NO: 489047

SEQ ID NO: 489281 - RNA, 64 nt, Human; identical to SEQ ID NO: 489048

SEQ ID NO: 489282 - RNA, 64 nt, Human; identical to SEQ ID NO: 489049

SEQ ID NO: 489283 - RNA, 64 nt, Human; identical to SEQ ID NO: 489050

SEQ ID NO: 489284 - RNA, 64 nt, Human; identical to SEQ ID NO: 489051

SEQ ID NO: 489285 - RNA, 64 nt, Human; identical to SEQ ID NO: 489052

SEQ ID NO: 489286 - RNA, 64 nt, Human
uuggcgcugaggugucuggccugaggucaauggugcaaaggagccgccaccgggcaugucugcc

SEQ ID NO: 489287 - RNA, 64 nt, Human
caguggugccccugcaguugggugggguacgccagcaaaggaucaguuuggcugccuuauccca

SEQ ID NO: 489288 - RNA, 64 nt, Human
uuuuugguuucuucaaccaaaaaagaaagaaauugcaaaggaccaaaaaaauguuggggaaucu

SEQ ID NO: 489289 - RNA, 64 nt, Human; identical to SEQ ID NO: 489053

SEQ ID NO: 489290 - RNA, 64 nt, Human; identical to SEQ ID NO: 489054

SEQ ID NO: 489291 - RNA, 64 nt, Human; identical to SEQ ID NO: 489055

SEQ ID NO: 489292 - RNA, 64 nt, Human; identical to SEQ ID NO: 489056

SEQ ID NO: 489293 - RNA, 64 nt, Human; identical to SEQ ID NO: 489057

SEQ ID NO: 489294 - RNA, 64 nt, Human; identical to SEQ ID NO: 489058

SEQ ID NO: 489295 - RNA, 64 nt, Human; identical to SEQ ID NO: 489059

SEQ ID NO: 489296 - RNA, 64 nt, Human; identical to SEQ ID NO: 489060

SEQ ID NO: 489297 - RNA, 64 nt, Human; identical to SEQ ID NO: 489064

SEQ ID NO: 489298 - RNA, 64 nt, Human; identical to SEQ ID NO: 489065

SEQ ID NO: 489299 - RNA, 64 nt, Human; identical to SEQ ID NO: 489066

SEQ ID NO: 489300 - RNA, 64 nt, Human; identical to SEQ ID NO: 489067

SEQ ID NO: 489301 - RNA, 64 nt, Human; identical to SEQ ID NO: 489068

SEQ ID NO: 489302 - RNA, 64 nt, Human; identical to SEQ ID NO: 489069

SEQ ID NO: 489303 - RNA, 64 nt, Human; identical to SEQ ID NO: 489070

SEQ ID NO: 489304 - RNA, 64 nt, Human
uauuggugucagaauaccagcauuuuccugccaugcaaaggauuaaaacuuaguuuacacuaug

SEQ ID NO: 489305 - RNA, 64 nt, Human
auccaaaacucuaugcuagagcaaaaaucaaauagcaaaggacacuagccagaaaauacagugu

SEQ ID NO: 489306 - RNA, 64 nt, Human
agccaucuuugccuuuugcugcaauagaagaugagcaaaggauuaaacagaggcccacagcuag

SEQ ID NO: 489307 - RNA, 64 nt, Human; identical to SEQ ID NO: 489071

SEQ ID NO: 489308 - RNA, 64 nt, Human; identical to SEQ ID NO: 489072

SEQ ID NO: 489309 - RNA, 62 nt, Human; identical to SEQ ID NO: 489073

SEQ ID NO: 489310 - RNA, 64 nt, Human; identical to SEQ ID NO: 489074

SEQ ID NO: 489311 - RNA, 64 nt, Human; identical to SEQ ID NO: 489075

SEQ ID NO: 489312 - RNA, 64 nt, Human; identical to SEQ ID NO: 489076

SEQ ID NO: 489313 - RNA, 64 nt, Human; identical to SEQ ID NO: 489077

SEQ ID NO: 489314 - RNA, 64 nt, Human; identical to SEQ ID NO: 489078

SEQ ID NO: 489315 - RNA, 64 nt, Human; identical to SEQ ID NO: 489079

SEQ ID NO: 489316 - RNA, 64 nt, Human; identical to SEQ ID NO: 489083

SEQ ID NO: 489317 - RNA, 64 nt, Human; identical to SEQ ID NO: 489084

SEQ ID NO: 489318 - RNA, 64 nt, Human; identical to SEQ ID NO: 489085

SEQ ID NO: 489319 - RNA, 64 nt, Human; identical to SEQ ID NO: 489086

SEQ ID NO: 489320 - RNA, 64 nt, Human; identical to SEQ ID NO: 489087

SEQ ID NO: 489321 - RNA, 64 nt, Human; identical to SEQ ID NO: 489088

SEQ ID NO: 489322 - RNA, 64 nt, Human
auuuagaagaaaaaaccaccccauuaaaaagugggcaaaggacaugaacagacacuuuucaaaa

SEQ ID NO: 489323 - RNA, 64 nt, Human
cuagacgcuuguagagccuggggggcgccggguggcaaaggacucacccccgcacaggcccgcc

SEQ ID NO: 489324 - RNA, 64 nt, Human
ccagcuuuccuuugauuuuauacuugaaaaacuggcaaaggaauggaagaauauuuuagucaug

SEQ ID NO: 489325 - RNA, 64 nt, Human; identical to SEQ ID NO: 489089

SEQ ID NO: 489326 - RNA, 64 nt, Human; identical to SEQ ID NO: 489090

SEQ ID NO: 489327 - RNA, 64 nt, Human; identical to SEQ ID NO: 489091

SEQ ID NO: 489328 - RNA, 64 nt, Human; identical to SEQ ID NO: 489092

SEQ ID NO: 489329 - RNA, 64 nt, Human; identical to SEQ ID NO: 489093

SEQ ID NO: 489330 - RNA, 64 nt, Human; identical to SEQ ID NO: 489094

SEQ ID NO: 489331 - RNA, 64 nt, Human; identical to SEQ ID NO: 489095

SEQ ID NO: 489332 - RNA, 64 nt, Human; identical to SEQ ID NO: 489096

SEQ ID NO: 489333 - RNA, 64 nt, Human; identical to SEQ ID NO: 489097

SEQ ID NO: 489334 - RNA, 64 nt, Human; identical to SEQ ID NO: 489098

SEQ ID NO: 489335 - RNA, 64 nt, Human; identical to SEQ ID NO: 489102

SEQ ID NO: 489336 - RNA, 64 nt, Human; identical to SEQ ID NO: 489103

SEQ ID NO: 489337 - RNA, 64 nt, Human; identical to SEQ ID NO: 489104

SEQ ID NO: 489338 - RNA, 64 nt, Human; identical to SEQ ID NO: 489105

SEQ ID NO: 489339 - RNA, 64 nt, Human; identical to SEQ ID NO: 489106

SEQ ID NO: 489340 - RNA, 64 nt, Human
ggauggacucuuaucuagaauacauagcagcucugcaaaggaacaguuuuuaaaaaugggaacu

SEQ ID NO: 489341 - RNA, 64 nt, Human
uguacacugccccaggacugucauuuuggcaucugcaaaggaaucacuuuagaaagccagcacc

SEQ ID NO: 489342 - RNA, 64 nt, Human
caaaagaacacauacagaguaauccugagaguaagcaaaggaaccaugagaaccgaagcuagaa

SEQ ID NO: 489343 - RNA, 64 nt, Human; identical to SEQ ID NO: 489107

SEQ ID NO: 489344 - RNA, 64 nt, Human; identical to SEQ ID NO: 489108

SEQ ID NO: 489345 - RNA, 64 nt, Human; identical to SEQ ID NO: 489109

SEQ ID NO: 489346 - RNA, 64 nt, Human; identical to SEQ ID NO: 489110

SEQ ID NO: 489347 - RNA, 64 nt, Human; identical to SEQ ID NO: 489111

SEQ ID NO: 489348 - RNA, 64 nt, Human; identical to SEQ ID NO: 489112

SEQ ID NO: 489349 - RNA, 64 nt, Human; identical to SEQ ID NO: 489113

SEQ ID NO: 489350 - RNA, 64 nt, Human; identical to SEQ ID NO: 489114

SEQ ID NO: 489351 - RNA, 64 nt, Human; identical to SEQ ID NO: 489115

SEQ ID NO: 489352 - RNA, 64 nt, Human; identical to SEQ ID NO: 489116

SEQ ID NO: 489353 - RNA, 64 nt, Human; identical to SEQ ID NO: 489117

SEQ ID NO: 489354 - RNA, 64 nt, Human; identical to SEQ ID NO: 489121

SEQ ID NO: 489355 - RNA, 64 nt, Human; identical to SEQ ID NO: 489122

SEQ ID NO: 489356 - RNA, 64 nt, Human; identical to SEQ ID NO: 489123

SEQ ID NO: 489357 - RNA, 64 nt, Human; identical to SEQ ID NO: 489124

SEQ ID NO: 489358 - RNA, 64 nt, Human
guauggaaggcuuucaguuuuaauauggcugaaagcaaaggauaacgaauucagaauuaguaau

SEQ ID NO: 489359 - RNA, 64 nt, Human
uaaguaauugguuaguuaacacugaauuuuggaggcaaaggaggguuggccugaguuaggaaac

SEQ ID NO: 489360 - RNA, 64 nt, Human
aacugagaaaggagugagaaggaagaaacaaugcgcaaaggaaagcagucuuucagaaucuguc

SEQ ID NO: 489361 - RNA, 64 nt, Human; identical to SEQ ID NO: 489125

SEQ ID NO: 489362 - RNA, 64 nt, Human; identical to SEQ ID NO: 489126

SEQ ID NO: 489363 - RNA, 64 nt, Human; identical to SEQ ID NO: 489127

SEQ ID NO: 489364 - RNA, 64 nt, Human; identical to SEQ ID NO: 489128

SEQ ID NO: 489365 - RNA, 64 nt, Human; identical to SEQ ID NO: 489129

SEQ ID NO: 489366 - RNA, 64 nt, Human; identical to SEQ ID NO: 489130

SEQ ID NO: 489367 - RNA, 64 nt, Human; identical to SEQ ID NO: 489131

SEQ ID NO: 489368 - RNA, 64 nt, Human; identical to SEQ ID NO: 489132

SEQ ID NO: 489369 - RNA, 64 nt, Human; identical to SEQ ID NO: 489133

SEQ ID NO: 489370 - RNA, 64 nt, Human; identical to SEQ ID NO: 489134

SEQ ID NO: 489371 - RNA, 64 nt, Human; identical to SEQ ID NO: 489135

SEQ ID NO: 489372 - RNA, 64 nt, Human; identical to SEQ ID NO: 489136

SEQ ID NO: 489373 - RNA, 64 nt, Human; identical to SEQ ID NO: 489140

SEQ ID NO: 489374 - RNA, 64 nt, Human; identical to SEQ ID NO: 489159

SEQ ID NO: 489375 - RNA, 64 nt, Human; identical to SEQ ID NO: 489160

SEQ ID NO: 489376 - RNA, 64 nt, Human
ggguaaccuagacuucagagagaaugagcagagagcaaaggagaaaucuggcuguccuuccauu

SEQ ID NO: 489377 - RNA, 64 nt, Human
uauguguugacaaccagcccugugguucuggguagcaaaggaaauacaguauaacuuaauuugu

SEQ ID NO: 489378 - RNA, 64 nt, Human
acaggcacugguguggggcacaguccaugcagaggcaaaggagacaaagcaagaccagaagggu

SEQ ID NO: 489379 - RNA, 64 nt, Human; identical to SEQ ID NO: 489161

SEQ ID NO: 489380 - RNA, 64 nt, Human; identical to SEQ ID NO: 489162

SEQ ID NO: 489381 - RNA, 64 nt, Human; identical to SEQ ID NO: 489163

SEQ ID NO: 489382 - RNA, 64 nt, Human; identical to SEQ ID NO: 489164

SEQ ID NO: 489383 - RNA, 64 nt, Human; identical to SEQ ID NO: 489165

SEQ ID NO: 489384 - RNA, 64 nt, Human; identical to SEQ ID NO: 489166

SEQ ID NO: 489385 - RNA, 64 nt, Human; identical to SEQ ID NO: 489167

SEQ ID NO: 489386 - RNA, 64 nt, Human; identical to SEQ ID NO: 489168

SEQ ID NO: 489387 - RNA, 64 nt, Human; identical to SEQ ID NO: 489169

SEQ ID NO: 489388 - RNA, 64 nt, Human; identical to SEQ ID NO: 489170

SEQ ID NO: 489389 - RNA, 64 nt, Human; identical to SEQ ID NO: 489171

SEQ ID NO: 489390 - RNA, 64 nt, Human; identical to SEQ ID NO: 489172

SEQ ID NO: 489391 - RNA, 64 nt, Human; identical to SEQ ID NO: 489173

SEQ ID NO: 489392 - RNA, 64 nt, Human; identical to SEQ ID NO: 489174

SEQ ID NO: 489393 - RNA, 64 nt, Human; identical to SEQ ID NO: 489178

SEQ ID NO: 489394 - RNA, 64 nt, Human
cagacucuacuugaccuuuucuucccuggcuacagcaaaggacgaugaucugccugcuuucacu

SEQ ID NO: 489395 - RNA, 64 nt, Human
aacaccauggucaguugugagcauuuugguuuccgcaaaggauggauggugagcaucaugggaa

SEQ ID NO: 489396 - RNA, 64 nt, Human
guucugugugcgcucauucuuauuacaggagugagcaaaggaagcauuuaccccgaugguuacc

SEQ ID NO: 489397 - RNA, 64 nt, Human; identical to SEQ ID NO: 489179

SEQ ID NO: 489398 - RNA, 64 nt, Human; identical to SEQ ID NO: 489180

SEQ ID NO: 489399 - RNA, 64 nt, Human; identical to SEQ ID NO: 489181

SEQ ID NO: 489400 - RNA, 64 nt, Human; identical to SEQ ID NO: 489182

SEQ ID NO: 489401 - RNA, 64 nt, Human; identical to SEQ ID NO: 489183

SEQ ID NO: 489402 - RNA, 64 nt, Human; identical to SEQ ID NO: 489184

SEQ ID NO: 489403 - RNA, 64 nt, Human; identical to SEQ ID NO: 489185

SEQ ID NO: 489404 - RNA, 64 nt, Human; identical to SEQ ID NO: 489186

SEQ ID NO: 489405 - RNA, 64 nt, Human; identical to SEQ ID NO: 489187

SEQ ID NO: 489406 - RNA, 64 nt, Human; identical to SEQ ID NO: 489188

SEQ ID NO: 489407 - RNA, 64 nt, Human; identical to SEQ ID NO: 489189

SEQ ID NO: 489408 - RNA, 64 nt, Human; identical to SEQ ID NO: 489189

SEQ ID NO: 489409 - RNA, 64 nt, Human; identical to SEQ ID NO: 489191

SEQ ID NO: 489410 - RNA, 64 nt, Human; identical to SEQ ID NO: 489192

SEQ ID NO: 489411 - RNA, 64 nt, Human; identical to SEQ ID NO: 489193

SEQ ID NO: 489412 - RNA, 64 nt, Human
gguaacucugcugugcuggagaucaucuuuaagggcaaaggaguuggauugcugaauuacaaug

SEQ ID NO: 489413 - RNA, 64 nt, Human
ggaccaggucuucuugcugaccucgucuacaaaggcaaaggaaggcaaaggaagcugucucggg

SEQ ID NO: 489414 - RNA, 64 nt, Human
uucuugcugaccucgucuacaaaggcaaaggaaggcaaaggaagcugucucggguguuucugaa

SEQ ID NO: 489415 - RNA, 64 nt, Human; identical to SEQ ID NO: 489197

SEQ ID NO: 489416 - RNA, 64 nt, Human; identical to SEQ ID NO: 489198

SEQ ID NO: 489417 - RNA, 64 nt, Human; identical to SEQ ID NO: 489199

SEQ ID NO: 489418 - RNA, 64 nt, Human; identical to SEQ ID NO: 489200

SEQ ID NO: 489419 - RNA, 64 nt, Human; identical to SEQ ID NO: 489201

SEQ ID NO: 489420 - RNA, 64 nt, Human; identical to SEQ ID NO: 489202

SEQ ID NO: 489421 - RNA, 64 nt, Human; identical to SEQ ID NO: 489203

SEQ ID NO: 489422 - RNA, 64 nt, Human; identical to SEQ ID NO: 489204

SEQ ID NO: 489423 - RNA, 64 nt, Human; identical to SEQ ID NO: 489205

SEQ ID NO: 489424 - RNA, 64 nt, Human; identical to SEQ ID NO: 489206

SEQ ID NO: 489425 - RNA, 64 nt, Human; identical to SEQ ID NO: 489207

SEQ ID NO: 489426 - RNA, 64 nt, Human; identical to SEQ ID NO: 489208

SEQ ID NO: 489427 - RNA, 64 nt, Human; identical to SEQ ID NO: 489209

SEQ ID NO: 489428 - RNA, 64 nt, Human; identical to SEQ ID NO: 489210

SEQ ID NO: 489429 - RNA, 64 nt, Human; identical to SEQ ID NO: 489211

SEQ ID NO: 489430 - RNA, 64 nt, Human
guucuuggagaagcaggugaaccuaaggaugaaagcaaaggagggccuugaggaagcagccccc

SEQ ID NO: 489431 - RNA, 64 nt, Human
ucagagauggaucccauucccuaaaggucucacagcaaaggagcaggacucccaggccccugua

SEQ ID NO: 489432 - RNA, 64 nt, Human
caggcaccaaacaagucugcagguucugggccuggcaaaggaguaucagugucuucaagcacca

SEQ ID NO: 489433 - RNA, 64 nt, Human; identical to SEQ ID NO: 489212

SEQ ID NO: 489434 - RNA, 64 nt, Human; identical to SEQ ID NO: 489216

SEQ ID NO: 489435 - RNA, 64 nt, Human; identical to SEQ ID NO: 489217

SEQ ID NO: 489436 - RNA, 64 nt, Human; identical to SEQ ID NO: 489218

SEQ ID NO: 489437 - RNA, 64 nt, Human; identical to SEQ ID NO: 489219

SEQ ID NO: 489438 - RNA, 64 nt, Human; identical to SEQ ID NO: 489220

SEQ ID NO: 489439 - RNA, 64 nt, Human; identical to SEQ ID NO: 489221

SEQ ID NO: 489440 - RNA, 64 nt, Human; identical to SEQ ID NO: 489222

SEQ ID NO: 489441 - RNA, 64 nt, Human; identical to SEQ ID NO: 489223

SEQ ID NO: 489442 - RNA, 64 nt, Human; identical to SEQ ID NO: 489224

SEQ ID NO: 489443 - RNA, 64 nt, Human; identical to SEQ ID NO: 489225

SEQ ID NO: 489444 - RNA, 64 nt, Human; identical to SEQ ID NO: 489226

SEQ ID NO: 489445 - RNA, 64 nt, Human; identical to SEQ ID NO: 489227

SEQ ID NO: 489446 - RNA, 64 nt, Human; identical to SEQ ID NO: 489228

SEQ ID NO: 489447 - RNA, 64 nt, Human; identical to SEQ ID NO: 489229

SEQ ID NO: 489448 - RNA, 64 nt, Human
gaaaaaacauucauaaaauggaaaaguaguucacgcaaaggaaaaaauaaaugccaggccacuc

SEQ ID NO: 489449 - RNA, 64 nt, Human
cucaaucuuggcuugggguguuugaaugucuauagcaaaggaauucauaaugggaaaucuuuuu

SEQ ID NO: 489450 - RNA, 64 nt, Human
ugaaggcagaaagcaaaauuauguuugccacuuugcaaaggagcucacuguggugucuguguuc

SEQ ID NO: 489451 - RNA, 64 nt, Human; identical to SEQ ID NO: 489230

SEQ ID NO: 489452 - RNA, 64 nt, Human; identical to SEQ ID NO: 489231

SEQ ID NO: 489453 - RNA, 64 nt, Human; identical to SEQ ID NO: 489235

SEQ ID NO: 489454 - RNA, 64 nt, Human; identical to SEQ ID NO: 489236

SEQ ID NO: 489455 - RNA, 64 nt, Human; identical to SEQ ID NO: 489237

SEQ ID NO: 489456 - RNA, 64 nt, Human; identical to SEQ ID NO: 489238

SEQ ID NO: 489457 - RNA, 64 nt, Human; identical to SEQ ID NO: 489239

SEQ ID NO: 489458 - RNA, 64 nt, Human; identical to SEQ ID NO: 489240

SEQ ID NO: 489459 - RNA, 64 nt, Human; identical to SEQ ID NO: 489241

SEQ ID NO: 489460 - RNA, 64 nt, Human; identical to SEQ ID NO: 489242

SEQ ID NO: 489461 - RNA, 64 nt, Human; identical to SEQ ID NO: 489243

SEQ ID NO: 489462 - RNA, 64 nt, Human; identical to SEQ ID NO: 489244

SEQ ID NO: 489463 - RNA, 64 nt, Human; identical to SEQ ID NO: 489245

SEQ ID NO: 489464 - RNA, 64 nt, Human; identical to SEQ ID NO: 489246

SEQ ID NO: 489465 - RNA, 64 nt, Human; identical to SEQ ID NO: 489247

SEQ ID NO: 489466 - RNA, 64 nt, Human
gauuucuaucucuuguaagucacucuuuuaaccagcaaaggacuuucaucuuagauuauccuuu

SEQ ID NO: 489467 - RNA, 64 nt, Human
auguaucaaauguauuauagauaagguguuaggugcaaaggaugucuaauaaucccugcacacg

SEQ ID NO: 489468 - RNA, 64 nt, Human
aaaacuuuaggacuacccaagucaucuagaaauugcaaaggaaaagacauucucuccccuauuu

SEQ ID NO: 489469 - RNA, 64 nt, Human; identical to SEQ ID NO: 489248

SEQ ID NO: 489470 - RNA, 62 nt, Human; identical to SEQ ID NO: 489249

SEQ ID NO: 489471 - RNA, 64 nt, Human; identical to SEQ ID NO: 489250

SEQ ID NO: 489472 - RNA, 64 nt, Human; identical to SEQ ID NO: 489018

SEQ ID NO: 489473 - RNA, 64 nt, Human; identical to SEQ ID NO: 489019

SEQ ID NO: 489474 - RNA, 64 nt, Human; identical to SEQ ID NO: 489020

SEQ ID NO: 489475 - RNA, 64 nt, Human; identical to SEQ ID NO: 489021

SEQ ID NO: 489476 - RNA, 64 nt, Human; identical to SEQ ID NO: 489022

SEQ ID NO: 489477 - RNA, 64 nt, Human; identical to SEQ ID NO: 489026

SEQ ID NO: 489478 - RNA, 64 nt, Human; identical to SEQ ID NO: 489027

SEQ ID NO: 489479 - RNA, 64 nt, Human; identical to SEQ ID NO: 489028

SEQ ID NO: 489480 - RNA, 64 nt, Human; identical to SEQ ID NO: 489029

SEQ ID NO: 489481 - RNA, 64 nt, Human; identical to SEQ ID NO: 489030

SEQ ID NO: 489482 - RNA, 64 nt, Human; identical to SEQ ID NO: 489031

SEQ ID NO: 489483 - RNA, 64 nt, Human; identical to SEQ ID NO: 489032

SEQ ID NO: 489484 - RNA, 64 nt, Human
uaagaaaccccuuauugauguauuucauggcacugcaaaggaagaggaauauuaauuguauacu

SEQ ID NO: 489485 - RNA, 64 nt, Human
aaauucacgugcacaaagauuagcacacuuaaaagcaaaggaaaaaauaaaucagaacuccaua

SEQ ID NO: 489486 - RNA, 64 nt, Human
gauucaggcaauuguuuacacacuuugaauaacugcaaaggauuuacgguuugugaaaaaugug

SEQ ID NO: 489487 - RNA, 64 nt, Human; identical to SEQ ID NO: 489033

SEQ ID NO: 489488 - RNA, 64 nt, Human; identical to SEQ ID NO: 489034

SEQ ID NO: 489489 - RNA, 64 nt, Human; identical to SEQ ID NO: 489035

SEQ ID NO: 489490 - RNA, 64 nt, Human; identical to SEQ ID NO: 489036

SEQ ID NO: 489491 - RNA, 64 nt, Human; identical to SEQ ID NO: 489037

SEQ ID NO: 489492 - RNA, 64 nt, Human; identical to SEQ ID NO: 489038

SEQ ID NO: 489493 - RNA, 64 nt, Human; identical to SEQ ID NO: 489039

SEQ ID NO: 489494 - RNA, 64 nt, Human; identical to SEQ ID NO: 489040

SEQ ID NO: 489495 - RNA, 64 nt, Human; identical to SEQ ID NO: 489041

SEQ ID NO: 489496 - RNA, 64 nt, Human; identical to SEQ ID NO: 489045

SEQ ID NO: 489497 - RNA, 64 nt, Human; identical to SEQ ID NO: 489046

SEQ ID NO: 489498 - RNA, 64 nt, Human; identical to SEQ ID NO: 489047

SEQ ID NO: 489499 - RNA, 64 nt, Human; identical to SEQ ID NO: 489048

SEQ ID NO: 489500 - RNA, 64 nt, Human; identical to SEQ ID NO: 489049

SEQ ID NO: 489501 - RNA, 64 nt, Human; identical to SEQ ID NO: 489050

SEQ ID NO: 489502 - RNA, 64 nt, Human
uaguggauuaaccaguccagacgcacugaucuuugcaaaggagacuuaauuucaaaucuguaau

SEQ ID NO: 489503 - RNA, 64 nt, Human
cuuuccccacccccaucacagggcuuucaguuuggcaaaggaaaagcagauaaaaacagaacau

SEQ ID NO: 489504 - RNA, 64 nt, Human
cugggaggcagauggaacuugagccugucaagaggcaaaggaauccauguaguagauauccucu

SEQ ID NO: 489505 - RNA, 64 nt, Human; identical to SEQ ID NO: 489051

SEQ ID NO: 489506 - RNA, 64 nt, Human; identical to SEQ ID NO: 489052

SEQ ID NO: 489507 - RNA, 64 nt, Human; identical to SEQ ID NO: 489053

SEQ ID NO: 489508 - RNA, 64 nt, Human; identical to SEQ ID NO: 489054

SEQ ID NO: 489509 - RNA, 64 nt, Human; identical to SEQ ID NO: 489055

SEQ ID NO: 489510 - RNA, 64 nt, Human; identical to SEQ ID NO: 489056

SEQ ID NO: 489511 - RNA, 64 nt, Human; identical to SEQ ID NO: 489057

SEQ ID NO: 489512 - RNA, 64 nt, Human; identical to SEQ ID NO: 489058

SEQ ID NO: 489513 - RNA, 64 nt, Human; identical to SEQ ID NO: 489059

SEQ ID NO: 489514 - RNA, 64 nt, Human; identical to SEQ ID NO: 489060

SEQ ID NO: 489515 - RNA, 64 nt, Human; identical to SEQ ID NO: 489064

SEQ ID NO: 489516 - RNA, 64 nt, Human; identical to SEQ ID NO: 489065

SEQ ID NO: 489517 - RNA, 64 nt, Human; identical to SEQ ID NO: 489066

SEQ ID NO: 489518 - RNA, 64 nt, Human; identical to SEQ ID NO: 489067

SEQ ID NO: 489519 - RNA, 64 nt, Human; identical to SEQ ID NO: 489068

SEQ ID NO: 489520 - RNA, 64 nt, Human
ccagugcccucuguccauaccuacuucuaggauugcaaaggagucuuccaacuagagaaaaauu

SEQ ID NO: 489521 - RNA, 64 nt, Human
cucuguacauuaaauuuauuuaaauauucaauuagcaaaggagaaacuuucucaauuuaaaaag

SEQ ID NO: 489522 - RNA, 64 nt, Human
aauugaaaguuuaaagagggggaagaguugguuugcaaaggaaaaguuuaaauagcuuaauauc

SEQ ID NO: 489523 - RNA, 64 nt, Human; identical to SEQ ID NO: 489069

SEQ ID NO: 489524 - RNA, 64 nt, Human; identical to SEQ ID NO: 489070

SEQ ID NO: 489525 - RNA, 64 nt, Human; identical to SEQ ID NO: 489071

SEQ ID NO: 489526 - RNA, 64 nt, Human; identical to SEQ ID NO: 489072

SEQ ID NO: 489527 - RNA, 62 nt, Human; identical to SEQ ID NO: 489073

SEQ ID NO: 489528 - RNA, 64 nt, Human; identical to SEQ ID NO: 489074

SEQ ID NO: 489529 - RNA, 64 nt, Human; identical to SEQ ID NO: 489075

SEQ ID NO: 489530 - RNA, 64 nt, Human; identical to SEQ ID NO: 489076

SEQ ID NO: 489531 - RNA, 64 nt, Human; identical to SEQ ID NO: 489077

SEQ ID NO: 489532 - RNA, 64 nt, Human; identical to SEQ ID NO: 489078

SEQ ID NO: 489533 - RNA, 64 nt, Human; identical to SEQ ID NO: 489079

SEQ ID NO: 489534 - RNA, 64 nt, Human; identical to SEQ ID NO: 489083

SEQ ID NO: 489535 - RNA, 64 nt, Human; identical to SEQ ID NO: 489084

SEQ ID NO: 489536 - RNA, 64 nt, Human; identical to SEQ ID NO: 489085

SEQ ID NO: 489537 - RNA, 64 nt, Human; identical to SEQ ID NO: 489086

SEQ ID NO: 489538 - RNA, 64 nt, Human
cugaggaugagaaguaagcaaacuguggaaacaugcaaaggaaaaagugauagaauaauauuca

SEQ ID NO: 489539 - RNA, 64 nt, Human
uacaaacaguuauacucaauguacuguaauaaucgcaaaggaaaaaguuuugggauaacuuauu

SEQ ID NO: 489540 - RNA, 64 nt, Human
cccucuacugacaaaguaugccaucaugcaagcugcaaaggaaacauuucaagagucuauaucu

SEQ ID NO: 489541 - RNA, 64 nt, Human; identical to SEQ ID NO: 489087

SEQ ID NO: 489542 - RNA, 64 nt, Human; identical to SEQ ID NO: 489088

SEQ ID NO: 489543 - RNA, 64 nt, Human; identical to SEQ ID NO: 489089

SEQ ID NO: 489544 - RNA, 64 nt, Human; identical to SEQ ID NO: 489090

SEQ ID NO: 489545 - RNA, 64 nt, Human; identical to SEQ ID NO: 489091

SEQ ID NO: 489546 - RNA, 64 nt, Human; identical to SEQ ID NO: 489092

SEQ ID NO: 489547 - RNA, 64 nt, Human; identical to SEQ ID NO: 489093

SEQ ID NO: 489548 - RNA, 64 nt, Human; identical to SEQ ID NO: 489094

SEQ ID NO: 489549 - RNA, 64 nt, Human; identical to SEQ ID NO: 489095

SEQ ID NO: 489550 - RNA, 64 nt, Human; identical to SEQ ID NO: 489096

SEQ ID NO: 489551 - RNA, 64 nt, Human; identical to SEQ ID NO: 489097

SEQ ID NO: 489552 - RNA, 64 nt, Human; identical to SEQ ID NO: 489098

SEQ ID NO: 489553 - RNA, 64 nt, Human; identical to SEQ ID NO: 489102

SEQ ID NO: 489554 - RNA, 64 nt, Human; identical to SEQ ID NO: 489103

SEQ ID NO: 489555 - RNA, 64 nt, Human; identical to SEQ ID NO: 489104

SEQ ID NO: 489556 - RNA, 64 nt, Human
uaggcgaaucauuuguucaaagcuguuggccucugcaaaggaaauaccaguucugggcaaucag

SEQ ID NO: 489557 - RNA, 64 nt, Human
ccacagacuuccuggccuccugugacucuggaaagcaaaggauuggcuguguauuguccauuga

SEQ ID NO: 489558 - RNA, 64 nt, Human
uugauagcucaaaugcauguaauucauaaacacugcaaaggagagccacuuggugucugcaguc

SEQ ID NO: 489559 - RNA, 64 nt, Human; identical to SEQ ID NO: 489105

SEQ ID NO: 489560 - RNA, 64 nt, Human; identical to SEQ ID NO: 489106

SEQ ID NO: 489561 - RNA, 64 nt, Human; identical to SEQ ID NO: 489107

SEQ ID NO: 489562 - RNA, 64 nt, Human; identical to SEQ ID NO: 489108

SEQ ID NO: 489563 - RNA, 64 nt, Human; identical to SEQ ID NO: 489109

SEQ ID NO: 489564 - RNA, 64 nt, Human; identical to SEQ ID NO: 489110

SEQ ID NO: 489565 - RNA, 64 nt, Human; identical to SEQ ID NO: 489111

SEQ ID NO: 489566 - RNA, 64 nt, Human; identical to SEQ ID NO: 489112

SEQ ID NO: 489567 - RNA, 64 nt, Human; identical to SEQ ID NO: 489113

SEQ ID NO: 489568 - RNA, 64 nt, Human; identical to SEQ ID NO: 489114

SEQ ID NO: 489569 - RNA, 64 nt, Human; identical to SEQ ID NO: 489115

SEQ ID NO: 489570 - RNA, 64 nt, Human; identical to SEQ ID NO: 489116

SEQ ID NO: 489571 - RNA, 64 nt, Human; identical to SEQ ID NO: 489117

SEQ ID NO: 489572 - RNA, 64 nt, Human; identical to SEQ ID NO: 489121

SEQ ID NO: 489573 - RNA, 64 nt, Human; identical to SEQ ID NO: 489122

SEQ ID NO: 489574 - RNA, 64 nt, Human
aggaaaggccuucacacccucacagaggcaucaugcaaaggacagcggcuuuggcuuuuccaau

SEQ ID NO: 489575 - RNA, 64 nt, Human
uucauaaucuuugcaagcgcauugauuaaugucugcaaaggaaucugcucuuugagguuucuuu

SEQ ID NO: 489576 - RNA, 64 nt, Human
uuauaucuuuaugcaaaaacauaugucugucuuugcaaaggacuguaagcagauuacaauaaau

SEQ ID NO: 489577 - RNA, 64 nt, Human; identical to SEQ ID NO: 489123

SEQ ID NO: 489578 - RNA, 64 nt, Human; identical to SEQ ID NO: 489124

SEQ ID NO: 489579 - RNA, 64 nt, Human; identical to SEQ ID NO: 489125

SEQ ID NO: 489580 - RNA, 64 nt, Human; identical to SEQ ID NO: 489126

SEQ ID NO: 489581 - RNA, 64 nt, Human; identical to SEQ ID NO: 489127

SEQ ID NO: 489582 - RNA, 64 nt, Human; identical to SEQ ID NO: 489128

SEQ ID NO: 489583 - RNA, 64 nt, Human; identical to SEQ ID NO: 489129

SEQ ID NO: 489584 - RNA, 64 nt, Human; identical to SEQ ID NO: 489130

SEQ ID NO: 489585 - RNA, 64 nt, Human; identical to SEQ ID NO: 489131

SEQ ID NO: 489586 - RNA, 64 nt, Human; identical to SEQ ID NO: 489132

SEQ ID NO: 489587 - RNA, 64 nt, Human; identical to SEQ ID NO: 489133

SEQ ID NO: 489588 - RNA, 64 nt, Human; identical to SEQ ID NO: 489134

SEQ ID NO: 489589 - RNA, 64 nt, Human; identical to SEQ ID NO: 489135

SEQ ID NO: 489590 - RNA, 64 nt, Human; identical to SEQ ID NO: 489136

SEQ ID NO: 489591 - RNA, 64 nt, Human; identical to SEQ ID NO: 489140

SEQ ID NO: 489592 - RNA, 64 nt, Human
agccauuucuuguuagcaguguaagaaccuuagagcaaaggaguugaccuucugauugaauaua

SEQ ID NO: 489593 - RNA, 64 nt, Human
cacauuuguggacuuccagauggucaggagaugagcaaaggauugguaugugacucugaugccc

SEQ ID NO: 489594 - RNA, 64 nt, Human
gauaaauugccccccucucccccacuuaccccuggcaaaggacucacaagucacuucucuucuc

SEQ ID NO: 489595 - RNA, 64 nt, Human; identical to SEQ ID NO: 489159

SEQ ID NO: 489596 - RNA, 64 nt, Human; identical to SEQ ID NO: 489160

SEQ ID NO: 489597 - RNA, 64 nt, Human; identical to SEQ ID NO: 489161

SEQ ID NO: 489598 - RNA, 64 nt, Human; identical to SEQ ID NO: 489162

SEQ ID NO: 489599 - RNA, 64 nt, Human; identical to SEQ ID NO: 489163

SEQ ID NO: 489600 - RNA, 64 nt, Human; identical to SEQ ID NO: 489164

SEQ ID NO: 489601 - RNA, 64 nt, Human; identical to SEQ ID NO: 489165

SEQ ID NO: 489602 - RNA, 64 nt, Human; identical to SEQ ID NO: 489166

SEQ ID NO: 489603 - RNA, 64 nt, Human; identical to SEQ ID NO: 489167

SEQ ID NO: 489604 - RNA, 64 nt, Human; identical to SEQ ID NO: 489168

SEQ ID NO: 489605 - RNA, 64 nt, Human; identical to SEQ ID NO: 489169

SEQ ID NO: 489606 - RNA, 64 nt, Human; identical to SEQ ID NO: 489170

SEQ ID NO: 489607 - RNA, 64 nt, Human; identical to SEQ ID NO: 489171

SEQ ID NO: 489608 - RNA, 64 nt, Human; identical to SEQ ID NO: 489172

SEQ ID NO: 489609 - RNA, 64 nt, Human; identical to SEQ ID NO: 489173

SEQ ID NO: 489610 - RNA, 64 nt, Human
cuauaauuacauaaauuguaugagacuuuuuguugcaaaggacacauuuaucauauucauucac

SEQ ID NO: 489611 - RNA, 64 nt, Human
ugauuucuagaacccgugacuguuacuuuauacagcaaaggaaacuuugcagaugugauuaaag

SEQ ID NO: 489612 - RNA, 64 nt, Human
aaccaggcuuguaauccauagcaucaccgacucugcaaaggauuucauuuugggguacagcagg

SEQ ID NO: 489613 - RNA, 64 nt, Human; identical to SEQ ID NO: 489174

SEQ ID NO: 489614 - RNA, 64 nt, Human; identical to SEQ ID NO: 489178

SEQ ID NO: 489615 - RNA, 64 nt, Human; identical to SEQ ID NO: 489179

SEQ ID NO: 489616 - RNA, 64 nt, Human; identical to SEQ ID NO: 489180

SEQ ID NO: 489617 - RNA, 64 nt, Human; identical to SEQ ID NO: 489181

SEQ ID NO: 489618 - RNA, 64 nt, Human; identical to SEQ ID NO: 489182

SEQ ID NO: 489619 - RNA, 64 nt, Human; identical to SEQ ID NO: 489183

SEQ ID NO: 489620 - RNA, 64 nt, Human; identical to SEQ ID NO: 489184

SEQ ID NO: 489621 - RNA, 64 nt, Human; identical to SEQ ID NO: 489185

SEQ ID NO: 489622 - RNA, 64 nt, Human; identical to SEQ ID NO: 489186

SEQ ID NO: 489623 - RNA, 64 nt, Human; identical to SEQ ID NO: 489187

SEQ ID NO: 489624 - RNA, 64 nt, Human; identical to SEQ ID NO: 489188

SEQ ID NO: 489625 - RNA, 64 nt, Human; identical to SEQ ID NO: 489189

SEQ ID NO: 489626 - RNA, 64 nt, Human; identical to SEQ ID NO: 489189

SEQ ID NO: 489627 - RNA, 64 nt, Human; identical to SEQ ID NO: 489191

SEQ ID NO: 489628 - RNA, 64 nt, Human
aaaaagcagacccaaguuuccuuucuccuccgccgcaaaggagaggcuucccagccccgccagu

SEQ ID NO: 489629 - RNA, 64 nt, Human
gguauugauauguuauuuggugcucucauucauggcaaaggauuugauaaauaaaaguucuuua

SEQ ID NO: 489630 - RNA, 64 nt, Human
aguaccaguguaaauucagucuuuucucugaaaagcaaaggauguguuuucagucuuucuauca

SEQ ID NO: 489631 - RNA, 64 nt, Human; identical to SEQ ID NO: 489192

SEQ ID NO: 489632 - RNA, 64 nt, Human; identical to SEQ ID NO: 489193

SEQ ID NO: 489633 - RNA, 64 nt, Human; identical to SEQ ID NO: 489197

SEQ ID NO: 489634 - RNA, 64 nt, Human; identical to SEQ ID NO: 489198

SEQ ID NO: 489635 - RNA, 64 nt, Human; identical to SEQ ID NO: 489199

SEQ ID NO: 489636 - RNA, 64 nt, Human; identical to SEQ ID NO: 489200

SEQ ID NO: 489637 - RNA, 64 nt, Human; identical to SEQ ID NO: 489201

SEQ ID NO: 489638 - RNA, 64 nt, Human; identical to SEQ ID NO: 489202

SEQ ID NO: 489639 - RNA, 64 nt, Human; identical to SEQ ID NO: 489203

SEQ ID NO: 489640 - RNA, 64 nt, Human; identical to SEQ ID NO: 489204

SEQ ID NO: 489641 - RNA, 64 nt, Human; identical to SEQ ID NO: 489205

SEQ ID NO: 489642 - RNA, 64 nt, Human; identical to SEQ ID NO: 489206

SEQ ID NO: 489643 - RNA, 64 nt, Human; identical to SEQ ID NO: 489207

SEQ ID NO: 489644 - RNA, 64 nt, Human; identical to SEQ ID NO: 489208

SEQ ID NO: 489645 - RNA, 64 nt, Human; identical to SEQ ID NO: 489209

SEQ ID NO: 489646 - RNA, 64 nt, Human
gaccacaauggaugcugcaaaaacguugacuggggcaaaggauuuuuuauuuuauuuuuuauuu

SEQ ID NO: 489647 - RNA, 64 nt, Human
gaagggaaaacuccaaaccaguugggagacuugugcaaaggacuuugcagauuaaaaaaaaaaa

SEQ ID NO: 489648 - RNA, 64 nt, Human
ccuuuaccccaccuuccugggaaaggccuccaaagcaaaggaucuggaccaguuucccugcugu

SEQ ID NO: 489649 - RNA, 64 nt, Human; identical to SEQ ID NO: 489210

SEQ ID NO: 489650 - RNA, 64 nt, Human; identical to SEQ ID NO: 489211

SEQ ID NO: 489651 - RNA, 64 nt, Human; identical to SEQ ID NO: 489212

SEQ ID NO: 489652 - RNA, 64 nt, Human; identical to SEQ ID NO: 489216

SEQ ID NO: 489653 - RNA, 64 nt, Human; identical to SEQ ID NO: 489217

SEQ ID NO: 489654 - RNA, 64 nt, Human; identical to SEQ ID NO: 489218

SEQ ID NO: 489655 - RNA, 64 nt, Human; identical to SEQ ID NO: 489219

SEQ ID NO: 489656 - RNA, 64 nt, Human; identical to SEQ ID NO: 489220

SEQ ID NO: 489657 - RNA, 64 nt, Human; identical to SEQ ID NO: 489221

SEQ ID NO: 489658 - RNA, 64 nt, Human; identical to SEQ ID NO: 489222

SEQ ID NO: 489659 - RNA, 64 nt, Human; identical to SEQ ID NO: 489223

SEQ ID NO: 489660 - RNA, 64 nt, Human; identical to SEQ ID NO: 489224

SEQ ID NO: 489661 - RNA, 64 nt, Human; identical to SEQ ID NO: 489225

SEQ ID NO: 489662 - RNA, 64 nt, Human; identical to SEQ ID NO: 489226

SEQ ID NO: 489663 - RNA, 64 nt, Human; identical to SEQ ID NO: 489227

SEQ ID NO: 489664 - RNA, 64 nt, Human
cagagcaggagcauccucugcugguuccugacuggcaaaggaccagcguccucguucaaaacau

SEQ ID NO: 489665 - RNA, 64 nt, Human
acuugaguguuuuaguuaugcauaaguauuucuagcaaaggaaggguagaaaggaauugaaaau

SEQ ID NO: 489666 - RNA, 64 nt, Human
ggcuguggucauacacacuguguacguggccaccgcaaaggacggcgucgugcaacccuaggac

SEQ ID NO: 489667 - RNA, 64 nt, Human; identical to SEQ ID NO: 489228

SEQ ID NO: 489668 - RNA, 64 nt, Human; identical to SEQ ID NO: 489229

SEQ ID NO: 489669 - RNA, 64 nt, Human; identical to SEQ ID NO: 489230

SEQ ID NO: 489670 - RNA, 64 nt, Human; identical to SEQ ID NO: 489231

SEQ ID NO: 489671 - RNA, 64 nt, Human; identical to SEQ ID NO: 489235

SEQ ID NO: 489672 - RNA, 64 nt, Human; identical to SEQ ID NO: 489236

SEQ ID NO: 489673 - RNA, 64 nt, Human; identical to SEQ ID NO: 489237

SEQ ID NO: 489674 - RNA, 64 nt, Human; identical to SEQ ID NO: 489238

SEQ ID NO: 489675 - RNA, 64 nt, Human; identical to SEQ ID NO: 489239

SEQ ID NO: 489676 - RNA, 64 nt, Human; identical to SEQ ID NO: 489240

SEQ ID NO: 489677 - RNA, 64 nt, Human; identical to SEQ ID NO: 489241

SEQ ID NO: 489678 - RNA, 64 nt, Human; identical to SEQ ID NO: 489242

SEQ ID NO: 489679 - RNA, 64 nt, Human; identical to SEQ ID NO: 489243

SEQ ID NO: 489680 - RNA, 64 nt, Human; identical to SEQ ID NO: 489244

SEQ ID NO: 489681 - RNA, 64 nt, Human; identical to SEQ ID NO: 489245

SEQ ID NO: 489682 - RNA, 64 nt, Human
cagaauuuuuauuuccuguaguaggcuugcuggagcaaaggaaaugugcugcuaaaaaucaacu

SEQ ID NO: 489683 - RNA, 64 nt, Human
agugcaacuguuuuagagauuuuucuccuaacaugcaaaggaaauacugauuggccuauaauaa

SEQ ID NO: 489684 - RNA, 64 nt, Human
cacucugugaagccagcaucuaggggcuaaagaugcaaaggaaagcagcaugcauugucuguac

SEQ ID NO: 489685 - RNA, 64 nt, Human; identical to SEQ ID NO: 489246

SEQ ID NO: 489686 - RNA, 64 nt, Human; identical to SEQ ID NO: 489247

SEQ ID NO: 489687 - RNA, 64 nt, Human; identical to SEQ ID NO: 489248

SEQ ID NO: 489688 - RNA, 62 nt, Human; identical to SEQ ID NO: 489249

SEQ ID NO: 489689 - RNA, 64 nt, Human; identical to SEQ ID NO: 489250

SEQ ID NO: 489690 - RNA, 64 nt, Human
gucccucccccaaugcaggccacuucuccucccuccucucuaaauguaguccccucuccuccau

SEQ ID NO: 489691 - RNA, 64 nt, Human
ugaugcuucucaguagccuuaucauucacaggugccucucuagccugcacaaaugauugacaag

SEQ ID NO: 489692 - RNA, 64 nt, Human
aguucuucuuagccucugcuccuucccugggaacccucucuauauccucuucacaagucauggg

SEQ ID NO: 489693 - RNA, 64 nt, Human
uccuucugcccugccugccucccugcaccugcggccucucuaggaagcuguuccuuucuaugcc

SEQ ID NO: 489694 - RNA, 64 nt, Human
auccuccuuccucuuccccuuucuaguuccccuaccucucuaucuuucuauucucaccaauaau

SEQ ID NO: 489695 - RNA, 64 nt, Human
cucaggacugagucaacccccuucaaccuccucaccucucuaaacaccauccauaguaacaugu

SEQ ID NO: 489696 - RNA, 64 nt, Human
uuuuaaaacaaaguguguuacacuaaaaaccaguccucucuaaucucaggugggacuuggcgcu

SEQ ID NO: 489697 - RNA, 52 nt, Human
acuuggaagcugguagcuagugccucucuaucaaaucaggguuugcaccuug

SEQ ID NO: 489698 - RNA, 64 nt, Human
guugcauccugucaggaggcagauaaugcuggugccucucuauugguaauguuaagacugcugg

SEQ ID NO: 489699 - RNA, 64 nt, Human
ccuagguccucugaggcacucaucuacugaaugaccucucuacuuccccuucuugccauuauua

SEQ ID NO: 489700 - RNA, 64 nt, Human
cuuagaauggggcuaagggaagugcugaaauagagcaaaggauggaagauaauauagacuacca

SEQ ID NO: 489701 - RNA, 64 nt, Human
ccccagagaaauacugacgaaguuuucugauguggcaaaggauauuucccaucuaauaccaguu

SEQ ID NO: 489702 - RNA, 64 nt, Human
uuuuuucccagagaagaggagaaaucuguagugagcaaaggacagaccaugaauccuccuugag

SEQ ID NO: 489703 - RNA, 64 nt, Human
gacaaacugcuuucuccuguccaaaagcaaaaaggcaaaggaaagaaagaaagcuucagaccgc

SEQ ID NO: 489704 - RNA, 64 nt, Human
uucugucagugccuuaucuuaugaagaaacagaaccucucuagcuaaugugugguuucuccuuc

SEQ ID NO: 489705 - RNA, 64 nt, Human
cuuggccuccuuuccgcuucuccucucugcuguuccucucuacaagaaccugggaggccaacgc

SEQ ID NO: 489706 - RNA, 64 nt, Human
ccuggguggggcuuguccaagaggggcaggugggccucucuaggaucagugucccacccagagg

SEQ ID NO: 489707 - RNA, 64 nt, Human
cucugggcacugaggaguauuuccccucauucuaccucucuaaggcuaugcaacccuccccacg

SEQ ID NO: 489708 - RNA, 64 nt, Human
gguucugaugaugauuauccaacaaacaucuggcccucucuacaucucuucccuccaucuccuu

SEQ ID NO: 489709 - RNA, 64 nt, Human
guuugggaccaggcugggcaacacagggagacccccucucuacaaaaacauuuuuaaaaaauua

SEQ ID NO: 489710 - RNA, 64 nt, Human
aacugcucagcaguugggccacuccacuauuccaccucucuaaaagaagguaauuuccucccca

SEQ ID NO: 489711 - RNA, 64 nt, Human
auagagauacacauggaaagaggguuuaacagacccucucuaggacacaacuguuucugcuuug

SEQ ID NO: 489712 - RNA, 64 nt, Human
guggcgugugagucaggagaccuagguuucagccccucucuacugucagcgagcugugcaacgu

SEQ ID NO: 489713 - RNA, 64 nt, Human
uuauuuuggauuaaaagaaguuuuccauuugauaccucucuaaauuaaauaaauuauagaaugu

SEQ ID NO: 489714 - RNA, 64 nt, Human
cuuuaauagccuccuucagaucccauaccugaccccucucuaacacaaaacuuauuggguaagu

SEQ ID NO: 489715 - RNA, 64 nt, Human
cccuuucccuucuggcuguuccccugcucuguugccucucuaagguaacauuuauagaagaaau

SEQ ID NO: 489716 - RNA, 64 nt, Human
ccucucccacccucuuccuacuggucucucuaugccucucuacagucucgucucuuuuacccug

SEQ ID NO: 489717 - RNA, 64 nt, Human
auuucucuggauuugcaaccccaucauccucaggccucucuacaagcagcaggaaacauagaac

SEQ ID NO: 489718 - RNA, 64 nt, Human
acuuucuugcucucuuuuucucaaucucccagccccucucuaccauauugggacccucaagagg

SEQ ID NO: 489719 - RNA, 64 nt, Human
auuuguugcccugaugauaacugaugauuuucacccucucuagcugagguaacucagacagugc

SEQ ID NO: 489720 - RNA, 64 nt, Human
agacagccaugcucuucaggaggagacuccaagggcaaaggagggugucuuggcugugcuugaa

SEQ ID NO: 489721 - RNA, 64 nt, Human
agaggccuggcccgcuaaggugaaaagggguguggcaaaggagccuacuccaagaauggaggcu

SEQ ID NO: 489722 - RNA, 64 nt, Human
ccugaugugaggcugugaaaaggcauauggaccugcaaaggaggcccccaaccagacagaccua

SEQ ID NO: 489723 - RNA, 64 nt, Human
cuggggaggggcccaguggguccucggccagagcccucucuaaggacagguuggggaggguugg

SEQ ID NO: 489724 - RNA, 64 nt, Human
ugagauauagauccguagaauugucaggagugcaccucucuacuugggagguacaauugccaua

SEQ ID NO: 489725 - RNA, 64 nt, Human
cacgucaauggcugugcugagcacaauggugggcccucucuagacacauacggaagugauggcc

SEQ ID NO: 489726 - RNA, 64 nt, Human
uccaguuuuuuuuucuuuaaaaaagcgguuucuaccucucuaugugccugagugaugauacaau

SEQ ID NO: 489727 - RNA, 64 nt, Human
gaacuccugaccucaggugauccacccaccuuggccucucuaaauacugggauuacaggcguga

SEQ ID NO: 489728 - RNA, 59 nt, Human
uugaaguugcugucccuuaacuggcgccuccucucuacuuucauggacuuguuccuuug

SEQ ID NO: 489729 - RNA, 64 nt, Human
aaccacguucuuagccuagauugagcuuagauugccucucuagacaacuaccccuuaguuauaa

SEQ ID NO: 489730 - RNA, 64 nt, Human
gguggggaggggacaccaagggcccauuuccuccccucucuaccugcagugaguuccagaccug

SEQ ID NO: 489731 - RNA, 64 nt, Human
uuaucccagacauguucuuucaagcccuuggagcccucucuaaauucacugucaucauuuagua

SEQ ID NO: 489732 - RNA, 64 nt, Human
ucaguuugaugaaccaauucacaagaggcuaggcccucucuagcaaaguuaugggcugcuuuac

SEQ ID NO: 489733 - RNA, 64 nt, Human
aauaaagaacugaaugaauucauccccccggccaccucucuacccguccagccugcccagaccc

SEQ ID NO: 489734 - RNA, 64 nt, Human
uacuuccuuaugguuugagaggcuagaaacugagccucucuacuuuuggaaaaaugaacaugug

SEQ ID NO: 489735 - RNA, 64 nt, Human
agcaucaguuuuuacuauauuaugauaaaagcaaccucucuauaaaucauauaauguaaaggau

SEQ ID NO: 489736 - RNA, 64 nt, Human
uugugcugguggugaagaggcccucaaagccaggccucucuauuccuuugacugucuccucagc

SEQ ID NO: 489737 - RNA, 64 nt, Human
aaugacagcuuuagcacaauuuuaagaaaaugccccucucuauuaccacauuuucucuuauuaa

SEQ ID NO: 489738 - RNA, 64 nt, Human
cuuuuaauggcuguuuuccuuuuucuauuuaaauccucucuacuugacucaggggcucacaagg

SEQ ID NO: 489739 - RNA, 64 nt, Human
cccaccuuccacaacucagucugcaccucaguuggcaaaggagacuggauggccaucuuuccuc

SEQ ID NO: 489740 - RNA, 64 nt, Human
augacacuagugaccaguaaaaugaaaaggaggagcaaaggagauuuugagucacagaaaugaa

SEQ ID NO: 489741 - RNA, 64 nt, Human
aucacuaucaauuuuaaggaaacuuuuuaauugugcaaaggauaaauuuuuugaccuauuuuag

SEQ ID NO: 489742 - RNA, 64 nt, Human
guuauuuaaagcagacuuacauguaaaccggaauccucucuauacaaguuuauuaaagauuauu

SEQ ID NO: 489743 - RNA, 64 nt, Human
uccuguauggaaaacgggagacuuuguacaguggccucucuaaaaguacaaaacauucauaaga

SEQ ID NO: 489744 - RNA, 64 nt, Human
acuaucacaaaaagucuccauuuucauuuuacauccucucuauuggaggcagcacuuuucccuc

SEQ ID NO: 489745 - RNA, 64 nt, Human
uccuuccucuuuaucccuccuguuuuacuuuauaccucucuauuccuugcucaaauuauugcaa

SEQ ID NO: 489746 - RNA, 64 nt, Human
gugucacaaaagcaguuauuuuaaaaucugauccccucucuacccuaccacuuugguuugaauu

SEQ ID NO: 489747 - RNA, 64 nt, Human
aggucagauggcagagcaagguugguccucagggccucucuaagccuuagggccccuccucucc

SEQ ID NO: 489748 - RNA, 64 nt, Human
aucugaggcaauaucacuaggacuuuagcugugaccucucuaacacagagaagcacuaacuuag

SEQ ID NO: 489749 - RNA, 64 nt, Human
uauuuuagccagugggucccuuccuuucuccuuuccucucuacugcucaagaacagauuugagg

SEQ ID NO: 489750 - RNA, 64 nt, Human
cccuuuuugugccuucaugcccuacuucuuaaugccucucuaaagccaaaaaaaaaaaaaaaga

SEQ ID NO: 489751 - RNA, 64 nt, Human
ugcaagcugagugacuguaggcagggaaccuuaaccucucuaagccacagcuucuucaucuuua

SEQ ID NO: 489752 - RNA, 64 nt, Human
caacacucugucuugaauuuggcccucccucuccccucucuacuuuaauucauuggagcauggg

SEQ ID NO: 489753 - RNA, 64 nt, Human
uuugauagccaucuauucaucuggaucaugggacccucucuaauccuuccaccaaucaaauaag

SEQ ID NO: 489754 - RNA, 64 nt, Human
cucuaaggucucugacgguggguccaggaccagaccucucuacaaaaaauugccccaacuacag

SEQ ID NO: 489755 - RNA, 64 nt, Human
aaaaccuagugauucugucuggucaucccacacaccucucuacugagugcuccagagucuuagc

SEQ ID NO: 489756 - RNA, 64 nt, Human
acaugggaucauggguuggggugcucaggugagcccucucuauagugcuucccugggccaagcu

SEQ ID NO: 489757 - RNA, 64 nt, Human
auuuuuuuguguguuuaccacugcaacuauugcaccucucuauuugaauuuacuguggaccaug

SEQ ID NO: 489758 - RNA, 64 nt, Human
aaaacaucccuggggauucugaaggcuuaauuuugcaaaggaggaugcauugucugaacuuugc

SEQ ID NO: 489759 - RNA, 64 nt, Human
guacugcagugauaccgaacuguggcacgccaaagcaaaggauaaccauccuccaaaacgccuc

SEQ ID NO: 489760 - RNA, 64 nt, Human
auccaccuucuuccuuagguccccuccuccaucagcaaaggagcacuucucuaaucaugcccuc

SEQ ID NO: 489761 - RNA, 64 nt, Human
ccugcacaagggcagugagagacauuuacagccuccucucuauuuguuuuuuuaaggaaaaguc

SEQ ID NO: 489762 - RNA, 64 nt, Human
cagcauggggaaggagguccccuuccccaagaguccucucuauccuggaugagcucaugaacau

SEQ ID NO: 489763 - RNA, 64 nt, Human
ccucuggugccugaagaaaugagauuuuauuaucccucucuauuaugcaaaugaauuuaguuuu

SEQ ID NO: 489764 - RNA, 64 nt, Human
aaaagccuggcugaaaucuuuagacuauuuguacccucucuacccacacuguuugugauuuauc

SEQ ID NO: 489765 - RNA, 64 nt, Human
gcaaugccgugaucuccgcucacugccaccuccgccucucuaguucaagcgauuuuccugccuc

SEQ ID NO: 489766 - RNA, 64 nt, Human
ugcccuccggcuggaaacugcagcucuguaaaugccucucuagguagcugcuggcggugguggg

SEQ ID NO: 489767 - RNA, 64 nt, Human
cugaucaugaaucaaguaucugugguuucaugccccucucuauaccuuucaaagaacuccugaa

SEQ ID NO: 489768 - RNA, 64 nt, Human
acuguugcccagucacuucugcuccaauucucuuccucucuaaauaguaguuuauuacugccac

SEQ ID NO: 489769 - RNA, 64 nt, Human
aaugggaaaaaucuuuuuguagacucuauaguacccucucuauucacuagcuucugaaaaggga

SEQ ID NO: 489770 - RNA, 64 nt, Human
agggaagcaacuccaggaacacuccuuccacuccccucucuaccaacagaugucaggacuguca

SEQ ID NO: 489771 - RNA, 64 nt, Human
gugauggggagagccugaaaggcaggcucuguuaccucucuaaggagagcuaccagguugucac

SEQ ID NO: 489772 - RNA, 64 nt, Human
cugagugucuugugguuuuaaacaagucucuuaaccucucuaagacugauuccucauuuauaac

SEQ ID NO: 489773 - RNA, 64 nt, Human
uccugagguggccuuuacauacguaggaccaaacccucucuaccaugagggaagaagacacagc

SEQ ID NO: 489774 - RNA, 64 nt, Human
auccaucaucagaaucacagugcucuccagaccuccucucuaaacugcuucauugaccuaaguc

SEQ ID NO: 489775 - RNA, 64 nt, Human
ccuaaguuagaacacagccuuggcuggugggugcccucucuagacugguaucagcagccugugu

SEQ ID NO: 489776 - RNA, 64 nt, Human
guguagcauacuggcuucaccaucaauccugauuccucucuaagugggcauugccauguggaag

SEQ ID NO: 489777 - RNA, 64 nt, Human
uuugcaaaaugcacuuuuuugagaugcagauauagcaaaggauuaguaauauagccugaaaaca

SEQ ID NO: 489778 - RNA, 64 nt, Human
ggagcagaggacauuagaacaagauguugcaugagcaaaggaccuaaauuguuauuuuugugug

SEQ ID NO: 489779 - RNA, 64 nt, Human
agugguuguaaagcucauuuuggggagguugauugcaaaggaaauuugaaagauaagauuuauu

SEQ ID NO: 489780 - RNA, 64 nt, Human
uaggucagauggagguucucagagccaaguccucccucucuacuggaguggaaggucuauuggc

SEQ ID NO: 489781 - RNA, 64 nt, Human
gauggcacauucaguguggcuaugaagagcgaauccucucuauuguuuaaauagauuacuguag

SEQ ID NO: 489782 - RNA, 64 nt, Human
auaagaaauaaggacaagccuaacuucauagaaaccucucuauuuuuaaucaguuguuuaauaa

SEQ ID NO: 489783 - RNA, 64 nt, Human
auuuucacacauucacgcauacuuggauaucaacccucucuacagguccguuuccuuacacauu

SEQ ID NO: 489784 - RNA, 64 nt, Human
uucuguaagacugcuacagcuaggcucccccuccccucucuaaaccaaaguauaaaacaaaauc

SEQ ID NO: 489785 - RNA, 64 nt, Human
auuuaauagccauuucaagaaaucccauaaagaaccucucuaugucccuuuuuuuaauuuaaaa

SEQ ID NO: 489786 - RNA, 64 nt, Human
gcaugggcauauguaaaauguccuuuucugguugccucucuaugcuauuguguucagauacuua

SEQ ID NO: 489787 - RNA, 64 nt, Human
ucagcuuuagcuuccauggcaguccucacccccaccucucuaaaagacacaggaggaugacaca

SEQ ID NO: 489788 - RNA, 64 nt, Human
cauuggcccucuggacuccuuucuccuuuucuuuccucucuaggcugcuccugaauccuguucu

SEQ ID NO: 489789 - RNA, 64 nt, Human
aaaaaggaucuccuuuuuucccagcccaaauucuccucucuaaaaguguccacaagaaggggug

SEQ ID NO: 489790 - RNA, 64 nt, Human
ucauaaauucuuucccuauaacauuccuucucugccucucuauggcccacuuugaccacuaaca

SEQ ID NO: 489791 - RNA, 64 nt, Human
ucuccggcagcccagauguucaguucucuuggccccucucuaccccuuacugggauccgguuuu

SEQ ID NO: 489792 - RNA, 64 nt, Human
uuucuaguuuccuuuccuugucucucucugccugccucucuacuguucccccuuuucuaacaca

SEQ ID NO: 489793 - RNA, 64 nt, Human
gcccagcccccaccacuccucagcugccccccaaccucucuauggcagagaggcagggaguggc

SEQ ID NO: 489794 - RNA, 64 nt, Human
ccuccccaggaagggacugcagaggcgggcaagcccucucuauguguuuuuauccccaccuucc

SEQ ID NO: 489795 - RNA, 64 nt, Human
gacccugggcugcuuccugggggcucuccagaccccucucuaggaccaagucacccgucgugcu

SEQ ID NO: 489796 - RNA, 64 nt, Human
gucuccugugaagccaaaagggaccaggaaccgugcaaaggaaacuggaaacuuuuccccgcug

SEQ ID NO: 489797 - RNA, 64 nt, Human
gagauuuucuuggcaguauuccaugggauguuaagcaaaggaaaccaaaggaaucguuucaaau

SEQ ID NO: 489798 - RNA, 64 nt, Human
ugcggaacccaaauuacguguacuacaauuuaaagcaaaggaguagaaagacagagcugggaug

SEQ ID NO: 489799 - RNA, 64 nt, Human
ugcucccuacuggcugucuugggggaaggcagcgccucucuagcuacucaagggagggggaugu

SEQ ID NO: 489800 - RNA, 64 nt, Human
gaaggcaguaaacuaagggugucaagccccauucccucucuacucuugacagcaggauuggaug

SEQ ID NO: 489801 - RNA, 64 nt, Human
auacuacuuuugugucacaauuuauuuuuaucacccucucuaggguaacguguauauuuuggug

SEQ ID NO: 489802 - RNA, 64 nt, Human
uucgguccuuggcccuuucccggcccucuuguucccucucuaacuucugauuguucuuuuauuu

SEQ ID NO: 489803 - RNA, 64 nt, Human
ucuuuaaacacuuuuuaaauuucuaaccacaagaccucucuauaaugguaaauguaagacauca

SEQ ID NO: 489804 - RNA, 64 nt, Human
uuugucauggaagagaagcauggguucagcagugccucucuagcagcugugcggaauaaugugc

SEQ ID NO: 489805 - RNA, 64 nt, Human
aguuugagaccagccuggccaacauggcgaaaccccucucuacuaaaaauacaaaaauuugcca

SEQ ID NO: 489806 - RNA, 64 nt, Human
cuacgguacucuccccagagauaugucuugucagccucucuaguuccccuuggccugcauguac

SEQ ID NO: 489807 - RNA, 64 nt, Human
aaaguaugaugguggugaauaaagaccaaaggguccucucuaccuuugaaaacucuccuggggu

SEQ ID NO: 489808 - RNA, 64 nt, Human
aauuccacagcugccuccagaaacauuaaccaccccucucuagucuuacugguauuuuuuguuu

SEQ ID NO: 489809 - RNA, 64 nt, Human
gauuuguuuccuaacgccauuggaggccuucaucccucucuacgauaagguugcagaaauggga

SEQ ID NO: 489810 - RNA, 64 nt, Human
uguuaguauuauucacacauucaugacaauugagccucucuacugugagaaauguuuuagaggc

SEQ ID NO: 489811 - RNA, 64 nt, Human
ggauuauuuguaggacaaccaaccuggaguuuugccucucuagaguaccacccaguaagucugg

SEQ ID NO: 489812 - RNA, 64 nt, Human
augagagccaucucaccucacccaggagucacuuccucucuacaccccaacaccugguucauuu

SEQ ID NO: 489813 - RNA, 64 nt, Human
acagugcauuaucuguucuuguauuucuauagcaccucucuauuggguuuaucaucaucaacaa

SEQ ID NO: 489814 - RNA, 64 nt, Human
uauuccuccaggaaggagcaaaacgccucuuuucccucucuaggccuguugccucgggccuggg

SEQ ID NO: 489815 - RNA, 59 nt, Human
aaagagaaagcauucuuugagaaaaacaagcaaaggagaagaguguuacuguaccuuua

SEQ ID NO: 489816 - RNA, 64 nt, Human
guguugccaagcuccaagccccaucuucuaaauggcaaaggaagguggauggccccagcacagc

SEQ ID NO: 489817 - RNA, 64 nt, Human
gcugauuccaacaggacugaguuuugccagcauugcaaaggaauccaagugccuuucuguagcc

SEQ ID NO: 489818 - RNA, 64 nt, Human
agcaccgcacaucgacacacuguacuuauuugucccucucuaacauuuuaacuaaaaguugauu

SEQ ID NO: 489819 - RNA, 64 nt, Human
aggcaugagccaccgcaccuggccuucccugcuuccucucuagaauccaauuagggauguuugu

SEQ ID NO: 489820 - RNA, 64 nt, Human
ccccaaaaucggcccucccucaccccuuucccuuccucucuauuuauaaggucccugcuccacc

SEQ ID NO: 489821 - RNA, 64 nt, Human
uacuaaaugguguguuaaaauuaggguuucuuugccucucuacacuacacuaaucugccuaaag

SEQ ID NO: 489822 - RNA, 64 nt, Human
aagaacgauucaccuggguuugcaagaaucuaaaccucucuaggggaagcccacuggguuuaaa

SEQ ID NO: 489823 - RNA, 64 nt, Human
cucacuaauuaucaacuuaugugcuaucagauauccucucuacccucacguuauuuugaagaaa

SEQ ID NO: 489824 - RNA, 64 nt, Human
ccaguucccuuugcuugucuucuugacugucuucccucucuaucggggucacuugcaauuguua

SEQ ID NO: 489825 - RNA, 64 nt, Human
ucccagucucagauugagugggugcucucauuggccucucuagcuaggccgucucccuggucag

SEQ ID NO: 489826 - RNA, 64 nt, Human
aauguccaugacuauugcccagagaaggcuuaccccucucuaggguugcaguugcuuucuuugu

SEQ ID NO: 489827 - RNA, 64 nt, Human
ugccuugacccagaagggaugagacgggcucuuaccucucuacaaccuucccuccccuucccac

SEQ ID NO: 489828 - RNA, 64 nt, Human
auugauaaccaggacaaccagguagucacccaguccucucuaagcagggagcacuuguccuucu

SEQ ID NO: 489829 - RNA, 64 nt, Human
gaggcuggcugcaccugcucucugaagacgccuuccucucuagguucauuguucaguguugcug

SEQ ID NO: 489830 - RNA, 64 nt, Human
acagaggaugcugaaguacagucccagcacauuuccucucuaucuuuuuuuuaggcaaaaccuu

SEQ ID NO: 489831 - RNA, 64 nt, Human
ggaugggcagugccacucaggucucugggguuucccucucuaauuuuaaguaaauugacauaua

SEQ ID NO: 489832 - RNA, 64 nt, Human
cacagacaaggccuccagcacagauggccacaggccucucuauacacauuuacagaauuucaca

SEQ ID NO: 489833 - RNA, 64 nt, Human
ugaacaguuucucuuggccuucaggaagaaagcgccucucuaccauacaguauuucaucccucc

SEQ ID NO: 489834 - RNA, 64 nt, Human
guuuacuuguuauggaguaaauagaauugagacugcaaaggaagaauaaugacuccuagaguaa

SEQ ID NO: 489835 - RNA, 64 nt, Human
ucucuuccuauugacuugcugccucaacagaucugcaaaggacaaccagccagguaugauucau

SEQ ID NO: 489836 - RNA, 64 nt, Human
cuaaaagacagugaugaccgcacgcauucauaaagcaaaggaguacuacagcaucaaggcacaa

SEQ ID NO: 489837 - RNA, 64 nt, Human
ugcaggagcuguuuuuccauugcuaggccugaccccucucuaccugugagcguucagggggucc

SEQ ID NO: 489838 - RNA, 64 nt, Human
uaccagggauaucuguucuacuguuuuaaaaguuccucucuauuuuauuuuuuauuuaacauga

SEQ ID NO: 489839 - RNA, 64 nt, Human
cuccuaaauguagagaugccuguggcugagggggccucucuaccuguguccccacucacuccag

SEQ ID NO: 489840 - RNA, 64 nt, Human
accagcauuacuaaggcaggugggcagacagugaccucucuagguguguccacagaguuuuuca

SEQ ID NO: 489841 - RNA, 64 nt, Human
ccugaaaugggcagggaagaaaacagggauuuccccucucuagaucccugccaggucccucucc

SEQ ID NO: 489842 - RNA, 64 nt, Human
ugggaaguaccaggggacuggcagaagcccaggcccucucuacuuuuaccagcaacugaucaug

SEQ ID NO: 489843 - RNA, 64 nt, Human
aaucugaugaggccucugcucucugggauguggcccucucuaugcagguuacuccaaugauuag

SEQ ID NO: 489844 - RNA, 64 nt, Human
ccuuguauccuggaauagcuccauuuccccuccuccucucuaccagacaaaggagugccugugu

SEQ ID NO: 489845 - RNA, 64 nt, Human
uucauacugagacccagaugggggaaaacagcuuccucucuaaaaggaaaaacuugauauuuau

SEQ ID NO: 489846 - RNA, 64 nt, Human
aauacauuuaaucauagggauauagauauaagcaccucucuaaagaaucuuuaguuuccgacgu

SEQ ID NO: 489847 - RNA, 64 nt, Human
acucacaacaccuguauaaugugaugcaagucauccucucuaucauaaccccuccccccaacac

SEQ ID NO: 489848 - RNA, 64 nt, Human
cuucacuacaaucuucacuacaaccuuuggccuuccucucuacauuuaagaguagcaauagaac

SEQ ID NO: 489849 - RNA, 64 nt, Human
ggcuuugcugcuuuuaacucuucuuccuucugugccucucuaagugggucaguauccuaaggaa

SEQ ID NO: 489850 - RNA, 64 nt, Human
cccugauugccacagacccagcacccagcaaaucccucucuaccucccaaggugauaugggcag

SEQ ID NO: 489851 - RNA, 64 nt, Human
gaaaauuagacaguguuuaauuuucgaaaacuucccucucuagacaguagauaccaccuacuga

SEQ ID NO: 489852 - RNA, 64 nt, Human
ccagcggaauuggccacauuuccaguguaugugcccucucuaaggaaagaugacaaagaaauca

SEQ ID NO: 489853 - RNA, 64 nt, Human
auugcugcuacuuguucuguccucugaccuuggggcaaaggagccccaggcccugucuccccag

SEQ ID NO: 489854 - RNA, 64 nt, Human
gagccaaggggucugcuccuguggcggugcaguggcaaaggauccagauagccuagggugaggg

SEQ ID NO: 489855 - RNA, 64 nt, Human
cagccuauacucccaagacuacaaaguuaccaucgcaaaggaaagguuauuccaguaaaaggaa

SEQ ID NO: 489856 - RNA, 64 nt, Human
guuauguguucuaacuauuaucaaaugaauaaauccucucuaucacaucccccaaaaauguucu

SEQ ID NO: 489857 - RNA, 64 nt, Human
uaauagaagcuccaggggcuccuucccauucagaccucucuagacuauagucuaugcuuagaga

SEQ ID NO: 489858 - RNA, 64 nt, Human
cuuauucugaaacuucagcuuccucuagcccggcccucucuaagggagcccucugcacucgugu

SEQ ID NO: 489859 - RNA, 64 nt, Human
caagcuccuuugcuuuuaguguuaccgcucauugccucucuaauccugccugauuguguuuaca

SEQ ID NO: 489860 - RNA, 64 nt, Human
ggcacgaucucagcucacugcacugcaauguccaccucucuaguucaagcgauucuccugucuc

SEQ ID NO: 489861 - RNA, 64 nt, Human
gcauuuccagaaccauggauucugccuuuggaccccucucuauuaauauuaaaacucugggccu

SEQ ID NO: 489862 - RNA, 64 nt, Human
gggaagaagguacagaagaaagauuggagaagggccucucuagcagucaacuccauuuguaaua

SEQ ID NO: 489863 - RNA, 52 nt, Human
uuguggucuuccuugcuugaacccucucuacucugaggcacucuguuggggu

SEQ ID NO: 489864 - RNA, 64 nt, Human
ccaccaaagcugcccacuguuucucuugagcuggccucucuagcacaauuugcacuaaaucaga

SEQ ID NO: 489865 - RNA, 64 nt, Human
auguagauuaucucaggcauuguggccagcucugccucucuaaaacugaccagaaaaaucucuc

SEQ ID NO: 489866 - RNA, 64 nt, Human
cucuccccucucccguucuuccucccauccaccuccucucuacucugccagucucagccuucaa

SEQ ID NO: 489867 - RNA, 64 nt, Human
uacauaauucagagugguuucauugccuuccuacccucucuaauggccccuccauuuauuugac

SEQ ID NO: 489868 - RNA, 64 nt, Human
ugccuuaguccugaauccuagcccuuacccccauccucucuagacgguauguccugacauaaca

SEQ ID NO: 489869 - RNA, 64 nt, Human
ugccccucccccacuccucccaauuccuauggagccucucuauuuuaccucuuuccgugcaucc

SEQ ID NO: 489870 - RNA, 64 nt, Human
uaucucaccauccaauuaucuacccaccugucuuccucucuagcaaucuauuuacuguuuauca

SEQ ID NO: 489871 - RNA, 64 nt, Human
acagacauuccugcuagaaacugucagacaaauaccucucuaguucggaugcugcucacuuucc

SEQ ID NO: 489872 - RNA, 64 nt, Human
uccuaguccuccaccuggcacaguauuugaaauggcaaaggaugugcuucauccucuaacagug

SEQ ID NO: 489873 - RNA, 64 nt, Human
aaggauaauggccuccagccccauccauguuccugcaaaggacaugaucuuucuuuggcaacca

SEQ ID NO: 489874 - RNA, 64 nt, Human
uccaccgacaaggucccuaccccagagcuuccaugcaaaggaauucuucaaguuuaaaucugga

SEQ ID NO: 489875 - RNA, 64 nt, Human
ucccuucucccaaagggauuuuaaucauucuuggccucucuacucacucuuaaucaaagugugg

SEQ ID NO: 489876 - RNA, 64 nt, Human
cucauuccuacaucucaagcuagccaggcagucuccucucuaucagaagaaagcacugguaauu

SEQ ID NO: 489877 - RNA, 64 nt, Human
gguuccugucccugcgccuuuccuuuucgccuuuccucucuauauuucgggucgggggcaggug

SEQ ID NO: 489878 - RNA, 64 nt, Human
ucauucauucuguucuguuucucuacuggguguuccucucuaaagaaacucuugcaagugaaac

SEQ ID NO: 489879 - RNA, 64 nt, Human
ugaccaacaugccaggugacauuggccccuagacccucucuauagccaugagacuccuuguggc

SEQ ID NO: 489880 - RNA, 64 nt, Human
cgucuucaugccaggggcacucauuucuuagcagccucucuacauacaucucucagguggugcc

SEQ ID NO: 489881 - RNA, 64 nt, Human
ggacgugcaaagcccuuggaauuuucuggcacuuccucucuauugcccccaccaccaccacccc

SEQ ID NO: 489882 - RNA, 64 nt, Human
uuuuaacuagaugauguuuuaaaaauuacuuuucccucucuauauaguuugauuuaagcauuag

SEQ ID NO: 489883 - RNA, 64 nt, Human
aaguucacugucucagcaaaguugaacugggcuaccucucuacagcuguuuccucagagggaaa

SEQ ID NO: 489884 - RNA, 64 nt, Human
uuuuuugcaaggcauuuuaaugcccuuucccagaccucucuagucccuccugccuucuguucuc

SEQ ID NO: 489885 - RNA, 64 nt, Human
aaacuuggaacuuuuugauugacaaauuaauaaaccucucuaugccucaggcuccucaucugua

SEQ ID NO: 489886 - RNA, 64 nt, Human
ucuuguggcacaggccauaauuguuccauagaccccucucuagcccugugacuguaguuaguua

SEQ ID NO: 489887 - RNA, 64 nt, Human
gugggugugcuugcgugguaggauguggugcagcccucucuacgcucuucuauuuuugguauau

SEQ ID NO: 489888 - RNA, 64 nt, Human
uugguuaguaaugaugucccagcauuugauguucccucucuaaugauaacaaguaaauauuuag

SEQ ID NO: 489889 - RNA, 64 nt, Human
uguuuugauuaugcaacuaaguaggccuccagagccucucuaguggcagagcagcucacacucc

SEQ ID NO: 489890 - RNA, 64 nt, Human
ucauauguaaauacugugaggugaugugcccaccccucucuaagaccccucgggggugaggggc

SEQ ID NO: 489891 - RNA, 64 nt, Human
cuuccuauuaagacuuacuugcauugcuggacuagcaaaggaaaauugcacuauugcacaucau

SEQ ID NO: 489892 - RNA, 64 nt, Human
cccaaguccauucccacuguaggccgaugccugugcaaaggacgcagugccauaucagagagga

SEQ ID NO: 489893 - RNA, 64 nt, Human
gugguguccuuuggaggcaugguggaugaaaggcgcaaaggaagcaagagguuaaagauaaugg

SEQ ID NO: 489894 - RNA, 64 nt, Human
uuccuggcuuuucugauggaccuauuuaggacaaccucucuauccccagggagaccucccaaau

SEQ ID NO: 489895 - RNA, 64 nt, Human
uugggaaacuugccucaccuucaggcuuguggggccucucuaugcccaaugaguccaggcaguc

SEQ ID NO: 489896 - RNA, 64 nt, Human
uccaccagaggagcggacagugaaauguaauaucccucucuagagcagguauguauaugguaua

SEQ ID NO: 489897 - RNA, 64 nt, Human
aacugcauguguaaacagcaucacauuauuaccaccucucuaugguauuauaguggcaguaugc

SEQ ID NO: 489898 - RNA, 64 nt, Human
aucuccaucucccaauuaauuuuauugucucuuuccucucuauucgcuuucuccuguuuuuuuu

SEQ ID NO: 489899 - RNA, 64 nt, Human
guaaccuauuacaccaaguuacuugcuuugcuuuccucucuaugaugugauaauacaguaaaag

SEQ ID NO: 489900 - RNA, 64 nt, Human
ugaccgaaaguuacaaggaccccaaccccuuuguccucucuacccacagauggcccugggaauc

SEQ ID NO: 489901 - RNA, 64 nt, Human
auacuguaaacugucuuccugaacuacuguagggccucucuaagaauuugaaauguauaaacca

SEQ ID NO: 489902 - RNA, 64 nt, Human
gcagagguauuggguuuuuuuguuuuuuuccauuccucucuacuucuguuuccuagcuuuuucu

SEQ ID NO: 489903 - RNA, 64 nt, Human
caugggugaagaggaggggaagaggccuguuuggccucucuauccucucuuccucuucccccaa

SEQ ID NO: 489904 - RNA, 64 nt, Human
uuaucacucuuuuucuacuacuuuuucucaaauaccucucuaauccaagaggcacuuccaagaa

SEQ ID NO: 489905 - RNA, 64 nt, Human
cuguccugcccgugagggugggggggaccgggccccucucuagggaccccucgccccagccuca

SEQ ID NO: 489906 - RNA, 64 nt, Human
cccgugugaggggucugauacucccuuugucuucccucucuacuccucgcuacaccugagccag

SEQ ID NO: 489907 - RNA, 64 nt, Human
gggacuuaccaggguuagcucugcccucuccucuccucucuacguggccgccgcucugucucuc

SEQ ID NO: 489908 - RNA, 64 nt, Human
ccguuuccccuccacauccaaacagcacccugguccucucuauccccccucuccuggggucccu

SEQ ID NO: 489909 - RNA, 64 nt, Human
gacaaaccaaacuaagugaauuuuagccugguagccucucuaaggaaacaguaauaauaacuuc

SEQ ID NO: 489910 - RNA, 64 nt, Human
uauaaaaauuccagagggguguguguauagagaggcaaaggacacagaguagcuaaccuaguuu

SEQ ID NO: 489911 - RNA, 64 nt, Human
aguguggccuggugcuggggugaaggugagcugggcaaaggagaaauaugagcuacugaggagg

SEQ ID NO: 489912 - RNA, 64 nt, Human
uaccuggcccaaccagacuucucccgugagccaggcaaaggaaauugucaucugccaacugucc

SEQ ID NO: 489913 - RNA, 64 nt, Human
ggcuguauggaaaugcacccucccuccugccgcuccucucuagaaccuucuagaaccugggcug

SEQ ID NO: 489914 - RNA, 64 nt, Human
agcgggauuggaccggcucggcugaugucugcucccucucuaggagcugucugcuggcuccggg

SEQ ID NO: 489915 - RNA, 64 nt, Human
aaagccagaugcuagagccucugccugacagcauccucucuaugggccauauuccgcacugggc

SEQ ID NO: 489916 - RNA, 64 nt, Human
uuuccccucacccuccaaguccuaaccccuccauccucucuaacuuuucaagccaaucccuuaa

SEQ ID NO: 489917 - RNA, 64 nt, Human
gagggcuauggccucccuaugcuuucacuucccaccucucuaccuaaguuccuucccagcacau

SEQ ID NO: 489918 - RNA, 64 nt, Human
gauguguguggccauuggacuaacuggcacggggccucucuagggaagucugguuguagagccu

SEQ ID NO: 489919 - RNA, 64 nt, Human
ucugucuaugucacaguguuccucuacgacccgaccucucuauguaagcacacaugcgcacaca

SEQ ID NO: 489920 - RNA, 64 nt, Human
ggguuucuuguggcgucugguguggaauggccuuccucucuaggugccugagguguccgcugac

SEQ ID NO: 489921 - RNA, 64 nt, Human
ccucagcccugccccucugagacaauaaaacugcccucucuaaggccaacugucugcugucucg

SEQ ID NO: 489922 - RNA, 64 nt, Human
guucgaaaccagccuggccaacauagugaaacccccucucuacuaaaaaugcaaaaauuagucc

SEQ ID NO: 489923 - RNA, 64 nt, Human
cccuuuguccuccagcaucccuucacuuccucauccucucuaaccuccuuuuucuuuuuuuaau

SEQ ID NO: 489924 - RNA, 64 nt, Human
gaagcuucucgacugcccagauagggaggugaguccucucuaucuccucuggcucuggaagcac

SEQ ID NO: 489925 - RNA, 64 nt, Human
uuccuuggccuaggucuccccuccaggcugagggccucucuacuuccccagaugccugggugca

SEQ ID NO: 489926 - RNA, 64 nt, Human
ugggcugggucuacccccagccaccagcccucauccucucuacccagugcucugguuuaugcuu

SEQ ID NO: 489927 - RNA, 64 nt, Human
accauccaguacuuguggacacuacacguuucaaccucucuacuagcaccaucacccuugaaaa

SEQ ID NO: 489928 - RNA, 64 nt, Human
caaugcuaucaagugugcugggaagggaggaaggccucucuacauauggaaaagcccaugcgug

SEQ ID NO: 489929 - RNA, 64 nt, Human
ucccauaucauauaaaauuucagggaaaacagaagcaaaggagagcuuggggguggggagaaaa

SEQ ID NO: 489930 - RNA, 64 nt, Human
aucaggagcuuuuuaaggaaaguaaguauaacaugcaaaggaagcuuuuuuuguauucauuuug

SEQ ID NO: 489931 - RNA, 64 nt, Human
ccaauggacuccagaagaaacuugauucaucgcugcaaaggaaagaacaaccuuaaaacuuuua

SEQ ID NO: 489932 - RNA, 64 nt, Human
cauaucccagucccagcccuucuuugcagcugggccucucuauaccccuggaugaacagcuugc

SEQ ID NO: 489933 - RNA, 64 nt, Human
ucaucuugaccaaagcugcuguguggcagcucggccucucuacgaccccaucuugguggcugca

SEQ ID NO: 489934 - RNA, 64 nt, Human
ugcaucagggcaggacggggucucagcccgccucccucucuacgucucuguaccgagccucugg

SEQ ID NO: 489935 - RNA, 64 nt, Human
uuccucgucauagggguucucacucugaacuuucccucucuacuacccauggcaggaaccuagu

SEQ ID NO: 489936 - RNA, 64 nt, Human
uguauucaguuuugacugugcuucauaucauguaccucucuagucaaagugguauuacagacau

SEQ ID NO: 489937 - RNA, 64 nt, Human
uguguaaccacuugucgccuuagggccagauuccccucucuaguccccuuuuuuaaauguccau

SEQ ID NO: 489938 - RNA, 64 nt, Human
cuggccuccaaauauaugcuccccccacauuuuaccucucuaccaaaugaacauaaguuguaau

SEQ ID NO: 489939 - RNA, 64 nt, Human
uggggccacacagccgggguagaucugagcccguccucucuacuccugugcuguagcaccuuca

SEQ ID NO: 489940 - RNA, 64 nt, Human
ccccaguacggcccccucuuugcaggcuuuuccuccucucuagaaccuccuucuguuggaggcc

SEQ ID NO: 489941 - RNA, 64 nt, Human
gccuggaccgagaugugaguccuguugaagacuuccucucuaccccccaccuuggucccucuca

SEQ ID NO: 489942 - RNA, 64 nt, Human
aaugaggugguggcacaggguggggcaaggagauccucucuaaggccucuggggucuuugccug

SEQ ID NO: 489943 - RNA, 64 nt, Human
cacagcugggagccagcaagagagcuuggagucgccucucuagaccagaucuagccccacccuc

SEQ ID NO: 489944 - RNA, 64 nt, Human
ccuccuccugucgugggcucauugugaccacuggccucucuacagcacggccuguggccuguuc

SEQ ID NO: 489945 - RNA, 64 nt, Human
uucugcguuuggacauaggacucugcagggcugcccucucuaacuggccuggcucuggaagggc

SEQ ID NO: 489946 - RNA, 64 nt, Human
cucuuuuccacugcccauccucugugaacccauaccucucuagauggagcagguggccacuggu

SEQ ID NO: 489947 - RNA, 64 nt, Human
auuuugccugcaggaaaauucaaaagcuacucauccucucuauaauuuggagucaucuuacuaa

SEQ ID NO: 489948 - RNA, 64 nt, Human
agaaaaaggggacaccuaguuugguugucauuuggcaaaggagaugacuuaaaauccgcuuaau

SEQ ID NO: 489949 - RNA, 64 nt, Human
augguuuucaguugggguguagaaauaggaagaugcaaaggaacaaugguguuggcaaagucuu

SEQ ID NO: 489950 - RNA, 64 nt, Human
uauugugguaagcucauuggcagcuuagcauuuugcaaaggaauugcuuugcaggaaauauuua

SEQ ID NO: 489951 - RNA, 64 nt, Human
cuaaaggaugaauuuccuuuaggccuuugaucuuccucucuaguguauaacuuuaaauauuugc

SEQ ID NO: 489952 - RNA, 64 nt, Human
cuguguguagcagcuguuaccugaagacgugcuaccucucuacaaaguguugauccccuucuuu

SEQ ID NO: 489953 - RNA, 64 nt, Human
gcuccagaacccagcccagaucggaggacaaguuccucucuagaacccaauccaauuuggagcc

SEQ ID NO: 489954 - RNA, 64 nt, Human
guucgagaucagccuggccaacauggugaaauccccucucuacuaaaaauauaaaaauuagcca

SEQ ID NO: 489955 - RNA, 64 nt, Human
aucucauucuaacagcaaugagaacuuaggcuccccucucuacuaaaauacaaaaguuagcugg

SEQ ID NO: 489956 - RNA, 64 nt, Human
ucccugccagcacccccacgcccucauuacggcuccucucuaaccuccuuuacccucaucuguc

SEQ ID NO: 489957 - RNA, 64 nt, Human
acucagcggggaggcaggggaggcagaggggcagccucucuaaugcuuccuacucauuuuguuu

SEQ ID NO: 489958 - RNA, 64 nt, Human
uguuggacaccuuuagguucuuugcugcauucugccucucuaggaccaugguuaagaguccaag

SEQ ID NO: 489959 - RNA, 64 nt, Human
cucuggagcccacaauugucuuacccacuaugccccucucuagucaugguccccaagaggggcu

SEQ ID NO: 489960 - RNA, 64 nt, Human
aaucaacccuucuuccccaccaaaccacccaacuccucucuacucuuauccuuuuauccucugu

SEQ ID NO: 489961 - RNA, 64 nt, Human
gauccaugaaggaccauuaaccugugauaccuuuccucucuauuaauguugacuucccuugguu

SEQ ID NO: 489962 - RNA, 64 nt, Human
agcugugcugugugagccugugcaagugacaugaccucucuaaaccuugguuuucugcucucug

SEQ ID NO: 489963 - RNA, 64 nt, Human
uccacagcucagcaaagccucuguagccagacugccucucuagauuccuccucucugggcagcg

SEQ ID NO: 489964 - RNA, 64 nt, Human
guuagagaucagccugggcaacauagccagaccuccucucuacaaaaagaaaaaagaaugacau

SEQ ID NO: 489965 - RNA, 64 nt, Human
aguuaaaauguagguccacauuuuauuuaguugaccucucuaucucuauauuauaguacccaug

SEQ ID NO: 489966 - RNA, 64 nt, Human
uuucccagccaccccucccccugaaauuucugccccucucuaccacccucacuccaugaccugu

SEQ ID NO: 489967 - RNA, 64 nt, Human
ggaaagugguaggauuuuuuuuuuuuaauccugugcaaaggaaaagaggugcuuugugggaaau

SEQ ID NO: 489968 - RNA, 64 nt, Human
cucucgucaccaaacuggaaccucacaccagccggcaaaggaaggaagaaagguuuuagagcug

SEQ ID NO: 489969 - RNA, 64 nt, Human
auugaaugaaacaagcagguguuuauauggaguagcaaaggacuuaaaauuaccaaaugcuucu

SEQ ID NO: 489970 - RNA, 64 nt, Human
gggaaacaaccaaaaucgcaauuuuaacaauaugccucucuacccccgugcacuuuuucugaca

SEQ ID NO: 489971 - RNA, 64 nt, Human
ccuggcuggaccacauacuggccucuuucuucaaccucucuaauaugggcuccagacggaucuc

SEQ ID NO: 489972 - RNA, 64 nt, Human
aguaauguggaucuuucccuuaaaacuccaaguuccucucuauuuuugcuaucuauaaaaugac

SEQ ID NO: 489973 - RNA, 64 nt, Human
caugcaaguguguuugccagcucaggagcugucuccucucuaccuggcuaguaagaggugggac

SEQ ID NO: 489974 - RNA, 64 nt, Human
aagaggggcaugagcugauucacauucugaaggaccucucuagcuggccagugcugaggagguu

SEQ ID NO: 489975 - RNA, 62 nt, Human
caguccaggaaugggugugagcagcccagagcccucucuauccacuuggucuggccagccag

SEQ ID NO: 489976 - RNA, 64 nt, Human
gucaccagcauaagaacaucaacaggaaugccgcccucucuacugucugaaccccuugucccug

SEQ ID NO: 489977 - RNA, 64 nt, Human
aacauuugggaaaugacaaacucaggcuggcucuccucucuaaccucacugggcuauaaauguu

SEQ ID NO: 489978 - RNA, 64 nt, Human
cacccacucccagccccagcuccagcugcccucaccucucuagcagcucucaccccucugaguc

SEQ ID NO: 489979 - RNA, 64 nt, Human
cacaaaaaguccagaccccagggacgguacuuucccucucuaccuggugcuccucccuaaugcu

SEQ ID NO: 489980 - RNA, 64 nt, Human
uauuuauacugcucuuuacaaaagcaccggugcuccucucuaggcagcgggugggcacagcccc

SEQ ID NO: 489981 - RNA, 64 nt, Human
ggcgcugggacagucagggugaccccaccgccuaccucucuacaucuaaagagcccucugggcc

SEQ ID NO: 489982 - RNA, 64 nt, Human
uguuuugacuuguuguaaccuguauacuggaaucccucucuagcuguauuaaaaauucccacag

SEQ ID NO: 489983 - RNA, 64 nt, Human
ccccaaauccuuacuuauuuuaaaaagacuagacccucucuaaagacuguuccauuuuaacaug

SEQ ID NO: 489984 - RNA, 64 nt, Human
gagacuugagcccagccuucugacugcauucagcccucucuaggacgcagcagccucuccccag

SEQ ID NO: 489985 - RNA, 64 nt, Human
ccccuuauuaaggccccagaugaucccagucacuccucucuagggcagaagacuagaggccagg

SEQ ID NO: 489986 - RNA, 64 nt, Human
cucaagaaaaaguuagcaaaccacuccuuuuguugcaaaggagcugaggucaaggguggcaaag

SEQ ID NO: 489987 - RNA, 64 nt, Human
aaucuguaacccggaaacagcaaaaaacuucuuagcaaaggaucacuaaguacccuuuggaugu

SEQ ID NO: 489988 - RNA, 64 nt, Human
uagccagauaaagcugcaggaaauagcauuccaggcaaaggaacaaaacuggugcagacccagc

SEQ ID NO: 489989 - RNA, 64 nt, Human
agguagguaaauagguaggccucuaauugaaccaccucucuaaguuauguacguauauauaagc

SEQ ID NO: 489990 - RNA, 64 nt, Human
guuccagaccagccugaccaaaauggugaaaccuccucucuacuaaaacuacaaaaauuaacug

SEQ ID NO: 489991 - RNA, 64 nt, Human
cauuugccauuauucaccuugucccuugccugccccucucuauuaguaccucauccuccacuca

SEQ ID NO: 489992 - RNA, 64 nt, Human
agacagacaucuaauuauucucucuuuuucccccccucucuauguguauauuucuaauggaucu

SEQ ID NO: 489993 - RNA, 64 nt, Human
ccuucuaguaucucugccgggggcuucugguacuccucucuaaauaccagagggaagaugccca

SEQ ID NO: 489994 - RNA, 64 nt, Human
gucacauugagaucauaaucccuccugucccacuccucucuaccaaccccacccuacuagcuag

SEQ ID NO: 489995 - RNA, 64 nt, Human
aguccuuccauaauaguaacaacuccacagauuuccucucuaaauuuuuaugccugcuuuuagc

SEQ ID NO: 489996 - RNA, 64 nt, Human
agauaguguaacccaauguaucugugggccuauuccucucuaccuuuaaggugcguucauuuug

SEQ ID NO: 489997 - RNA, 64 nt, Human
gagccuuugugcucccacucaauacaaaaaggccccucucuacaucugggaaugcaccucuucu

SEQ ID NO: 489998 - RNA, 64 nt, Human; identical to SEQ ID NO: 333042

SEQ ID NO: 489999 - RNA, 64 nt, Human; identical to SEQ ID NO: 330365

SEQ ID NO: 490000 - RNA, 64 nt, Human; identical to SEQ ID NO: 333043

SEQ ID NO: 490001 - RNA, 64 nt, Human; identical to SEQ ID NO: 332907

SEQ ID NO: 490002 - RNA, 64 nt, Human; identical to SEQ ID NO: 332908

SEQ ID NO: 490003 - RNA, 64 nt, Human
gugggaggugggcagaagucuuggggaggaaugggcaaaggagguucucagucaauaaaaccaa

SEQ ID NO: 490004 - RNA, 64 nt, Human
caccccaacccugccccuauguacaggaauaagagcaaaggacccacaggcuacagagaagagg

SEQ ID NO: 490005 - RNA, 60 nt, Human
gauacuauuacuaugaguaagaaauuaauggcaaaggaauuaauccaagaauagaagaau

SEQ ID NO: 490006 - RNA, 64 nt, Human; identical to SEQ ID NO: 330382

SEQ ID NO: 490007 - RNA, 64 nt, Human; identical to SEQ ID NO: 333470

SEQ ID NO: 490008 - RNA, 64 nt, Human; identical to SEQ ID NO: 333471

SEQ ID NO: 490009 - RNA, 64 nt, Human; identical to SEQ ID NO: 333472

SEQ ID NO: 490010 - RNA, 64 nt, Human; identical to SEQ ID NO: 332832

SEQ ID NO: 490011 - RNA, 64 nt, Human; identical to SEQ ID NO: 332833

SEQ ID NO: 490012 - RNA, 64 nt, Human; identical to SEQ ID NO: 330383

SEQ ID NO: 490013 - RNA, 64 nt, Human; identical to SEQ ID NO: 332627

SEQ ID NO: 490014 - RNA, 64 nt, Human; identical to SEQ ID NO: 332628

SEQ ID NO: 490015 - RNA, 64 nt, Human; identical to SEQ ID NO: 332629

SEQ ID NO: 490016 - RNA, 64 nt, Human; identical to SEQ ID NO: 332834

SEQ ID NO: 490017 - RNA, 64 nt, Human; identical to SEQ ID NO: 330384

SEQ ID NO: 490018 - RNA, 64 nt, Human; identical to SEQ ID NO: 332645

SEQ ID NO: 490019 - RNA, 64 nt, Human; identical to SEQ ID NO: 332646

SEQ ID NO: 490020 - RNA, 64 nt, Human
uaaagcccauaagcugggucucaggcugggcucagcaaaggacucgccuugcaaccgacaggcc

SEQ ID NO: 490021 - RNA, 64 nt, Human
ucaccagacucauugauuuuguuuugcuuguuaagcaaaggaaugucacauaccucuguccagc

SEQ ID NO: 490022 - RNA, 64 nt, Human
cauuuuaucauguuucuuuugaauauaugaauuggcaaaggacuugaugaaacugaguacuaag

SEQ ID NO: 490023 - RNA, 64 nt, Human
guugaagcaaaaagcaagaaucaauuacuuaaaggcaaaggagugauauugcuaaagcauguga

SEQ ID NO: 490024 - RNA, 64 nt, Human; identical to SEQ ID NO: 332647

SEQ ID NO: 490025 - RNA, 64 nt, Human; identical to SEQ ID NO: 332664

SEQ ID NO: 490026 - RNA, 64 nt, Human; identical to SEQ ID NO: 332665

SEQ ID NO: 490027 - RNA, 64 nt, Human; identical to SEQ ID NO: 330386

SEQ ID NO: 490028 - RNA, 64 nt, Human; identical to SEQ ID NO: 332683

SEQ ID NO: 490029 - RNA, 64 nt, Human; identical to SEQ ID NO: 332684

SEQ ID NO: 490030 - RNA, 64 nt, Human; identical to SEQ ID NO: 332685

SEQ ID NO: 490031 - RNA, 50 nt, Human; identical to SEQ ID NO: 332740

SEQ ID NO: 490032 - RNA, 64 nt, Human; identical to SEQ ID NO: 332741

SEQ ID NO: 490033 - RNA, 64 nt, Human; identical to SEQ ID NO: 330387

SEQ ID NO: 490034 - RNA, 64 nt, Human; identical to SEQ ID NO: 332702

SEQ ID NO: 490035 - RNA, 64 nt, Human; identical to SEQ ID NO: 332703

SEQ ID NO: 490036 - RNA, 64 nt, Human; identical to SEQ ID NO: 332704

SEQ ID NO: 490037 - RNA, 64 nt, Human; identical to SEQ ID NO: 332974

SEQ ID NO: 490038 - RNA, 64 nt, Human
ggggaccucaggccugggggcugggcagaggaaagcaaaggagauuggaaggaacguccccugu

SEQ ID NO: 490039 - RNA, 64 nt, Human
caggagggagggguauguuugucucccagucugggcaaaggagugcuaugcggaauucucugca

SEQ ID NO: 490040 - RNA, 64 nt, Human
uugugagggcugggggcauccaggcacucagaaggcaaaggaaccacccuacccauuuggccuc

SEQ ID NO: 490041 - RNA, 64 nt, Human
gacccaagugagucacgcuuccugauuccucggcgcaaaggagacguuuauccuuucaaauucc

SEQ ID NO: 490042 - RNA, 64 nt, Human; identical to SEQ ID NO: 332975

SEQ ID NO: 490043 - RNA, 64 nt, Human; identical to SEQ ID NO: 330388

SEQ ID NO: 490044 - RNA, 64 nt, Human; identical to SEQ ID NO: 332721

SEQ ID NO: 490045 - RNA, 64 nt, Human; identical to SEQ ID NO: 332722

SEQ ID NO: 490046 - RNA, 64 nt, Human; identical to SEQ ID NO: 332723

SEQ ID NO: 490047 - RNA, 64 nt, Human; identical to SEQ ID NO: 332589

SEQ ID NO: 490048 - RNA, 64 nt, Human; identical to SEQ ID NO: 332590

SEQ ID NO: 490049 - RNA, 64 nt, Human; identical to SEQ ID NO: 330389

SEQ ID NO: 490050 - RNA, 64 nt, Human; identical to SEQ ID NO: 332742

SEQ ID NO: 490051 - RNA, 64 nt, Human; identical to SEQ ID NO: 332909

SEQ ID NO: 490052 - RNA, 59 nt, Human; identical to SEQ ID NO: 330390

SEQ ID NO: 490053 - RNA, 64 nt, Human; identical to SEQ ID NO: 332759

SEQ ID NO: 490054 - RNA, 64 nt, Human; identical to SEQ ID NO: 332760

SEQ ID NO: 490055 - RNA, 64 nt, Human; identical to SEQ ID NO: 332761

SEQ ID NO: 490056 - RNA, 64 nt, Human
ucuaaugucucacuuuuaaaggaacagcuugauugcaaaggagaaaauagauaagcaaugaauu

SEQ ID NO: 490057 - RNA, 64 nt, Human
cugcuccaucgauauacucauagaauggaagugagcaaaggaaaauuuuaagccaggauaguua

SEQ ID NO: 490058 - RNA, 64 nt, Human
caauagccugaauuugaggagggaaugauugguagcaaaggaugggggaaagaaguagguucug

SEQ ID NO: 490059 - RNA, 64 nt, Human
caaauuuugggggaauaaauuuuuauuuaacacugcaaaggaaagagagagaaaacaagcaaag

SEQ ID NO: 490060 - RNA, 64 nt, Human; identical to SEQ ID NO: 332778

SEQ ID NO: 490061 - RNA, 64 nt, Human; identical to SEQ ID NO: 332779

SEQ ID NO: 490062 - RNA, 64 nt, Human; identical to SEQ ID NO: 330391

SEQ ID NO: 490063 - RNA, 64 nt, Human; identical to SEQ ID NO: 332780

SEQ ID NO: 490064 - RNA, 64 nt, Human; identical to SEQ ID NO: 332552

SEQ ID NO: 490065 - RNA, 64 nt, Human; identical to SEQ ID NO: 332553

SEQ ID NO: 490066 - RNA, 64 nt, Human; identical to SEQ ID NO: 330392

SEQ ID NO: 490067 - RNA, 64 nt, Human; identical to SEQ ID NO: 332813

SEQ ID NO: 490068 - RNA, 64 nt, Human; identical to SEQ ID NO: 332814

SEQ ID NO: 490069 - RNA, 64 nt, Human; identical to SEQ ID NO: 332815

SEQ ID NO: 490070 - RNA, 64 nt, Human; identical to SEQ ID NO: 332480

SEQ ID NO: 490071 - RNA, 64 nt, Human; identical to SEQ ID NO: 332481

SEQ ID NO: 490072 - RNA, 64 nt, Human; identical to SEQ ID NO: 330393

SEQ ID NO: 490073 - RNA, 64 nt, Human; identical to SEQ ID NO: 332976

SEQ ID NO: 490074 - RNA, 64 nt, Human
acaaagggaauaaauggcuguauuugugcuaagagcaaaggaugcaucuucccacagccuccuc

SEQ ID NO: 490075 - RNA, 64 nt, Human
aucauuaaauuuuucucauaguucagaaaaaugugcaaaggaaacuauugucucgcuccuucaa

SEQ ID NO: 490076 - RNA, 64 nt, Human
gugaagcuguggaaugcccagcuaguuaaagaaugcaaaggaaaauauuuucacaaaggguuau

SEQ ID NO: 490077 - RNA, 64 nt, Human
gcccccaaaaagccgggacuggcagcuuuaagaagcaaaggaauuuccucucaggaccgugccg

SEQ ID NO: 490078 - RNA, 64 nt, Human; identical to SEQ ID NO: 332426

SEQ ID NO: 490079 - RNA, 64 nt, Human; identical to SEQ ID NO: 332427

SEQ ID NO: 490080 - RNA, 64 nt, Human; identical to SEQ ID NO: 330394

SEQ ID NO: 490081 - RNA, 64 nt, Human; identical to SEQ ID NO: 333009

SEQ ID NO: 490082 - RNA, 64 nt, Human; identical to SEQ ID NO: 333204

SEQ ID NO: 490083 - RNA, 64 nt, Human; identical to SEQ ID NO: 333205

SEQ ID NO: 490084 - RNA, 64 nt, Human; identical to SEQ ID NO: 330395

SEQ ID NO: 490085 - RNA, 53 nt, Human; identical to SEQ ID NO: 333206

SEQ ID NO: 490086 - RNA, 64 nt, Human; identical to SEQ ID NO: 332666

SEQ ID NO: 490087 - RNA, 64 nt, Human
cuacagguagagccaccuagaaaugcauauggcugcaaaggaaacuuugaaggguuaaauagag

SEQ ID NO: 490088 - RNA, 64 nt, Human
ugggccuggacucuccagaaacuacuugggcagagcaaaggaaaaccucuuguuuuaaaaaaau

SEQ ID NO: 490089 - RNA, 64 nt, Human
ccacagccacccagcugagguccugggucucugagcaaaggagcaugcuugggcguuguggccu

SEQ ID NO: 490090 - RNA, 64 nt, Human
cuugaacauuuguuuuaaauucuggggccaaaaugcaaaggagaaguucuauucaaaggcagua

SEQ ID NO: 490091 - RNA, 64 nt, Human
ugagugaaagaagccaagggucaagaaugcagaagcaaaggaaggacuaaaaagccuccacgga

SEQ ID NO: 490092 - RNA, 64 nt, Human
gcgugcgcucccucccccgaaaucacuucucagggcaaaggagccccaggcaucucaugcuuug

SEQ ID NO: 490093 - RNA, 64 nt, Human
ucucgagacauacaaauccuugcuuugucagcuugcaaaggaggagaguuuaggauuagggcca

SEQ ID NO: 490094 - RNA, 64 nt, Human
uuuggauugggacuuuucagguccuuuuuggagggcaaaggaagugccagcuucucuggggaac

SEQ ID NO: 490095 - RNA, 64 nt, Human
gaucaagugaagagccccagauucccccuaagaagcaaaggaucgucuuuuaugccucuggcua

SEQ ID NO: 490096 - RNA, 64 nt, Human
aaugugauuggcuuccucucgccguguugugagggcaaaggagagaagggagaaaaaaaaaaaa

SEQ ID NO: 490097 - RNA, 64 nt, Human
acacagcugcaucuugagcagugaccugccaagggcaaaggaccccgcucccuagacuuacaga

SEQ ID NO: 490098 - RNA, 64 nt, Human
cucuucuucaaaaggaacaucagcccuccugauugcaaaggaauacugagcugauggugucauc

SEQ ID NO: 490099 - RNA, 64 nt, Human
accuguuauuucacuuaauccucauaccauauuugcaaaggauguguuauuaucuaugugugac

SEQ ID NO: 490100 - RNA, 64 nt, Human
uccuagaaauccuggguagaagugguggaccugugcaaaggagguuuuagaacucugcaguauu

SEQ ID NO: 490101 - RNA, 64 nt, Human
aaaugcgaaagaggucaugucuucucaaaaucuagcaaaggaaguagucugcauuggugugcau

SEQ ID NO: 490102 - RNA, 64 nt, Human
uaagggaugggcauaaaaaagugaucaaaacauugcaaaggagaaucaaagauugauuguccug

SEQ ID NO: 490103 - RNA, 64 nt, Human
uuuuuuuuuuuuuuuuuucuggcuaaaauaguuugcaaaggaccagguaauuggggaggggaga

SEQ ID NO: 490104 - RNA, 64 nt, Human
uagaggugauuaaaaccaacaaggaguuucaugugcaaaggagauaaggaaugaauauaaagau

SEQ ID NO: 490105 - RNA, 64 nt, Human
cucagugaccuaccucccaggcuccucugcaccugcaaaggaacaggagugagucgugacugac

SEQ ID NO: 490106 - RNA, 64 nt, Human
gcaguucagaauuagggaaugcugguuuugaagagcaaaggacagguagucuagagagggucgu

SEQ ID NO: 490107 - RNA, 64 nt, Human
gagcugggcagagcugcggcacagggccugggcugcaaaggagcccugcuccuuuaguuuccug

SEQ ID NO: 490108 - RNA, 64 nt, Human
aaaaaaugaccuagcaacucuugaggaaacaagugcaaaggaggaugucuuggcaaguuuaagc

SEQ ID NO: 490109 - RNA, 64 nt, Human
gaaggcaggaaaccggcuagaugaccaucacacagcaaaggagggaguggaagagagaugagaa

SEQ ID NO: 490110 - RNA, 64 nt, Human
ugcaacugacauccucaauagcuacagagaacuugcaaaggaguagagagaauguuugaggucc

SEQ ID NO: 490111 - RNA, 64 nt, Human
gucauuuuucugaagagaauauuuugcuugaaaugcaaaggacugaaagagauuuguagguugu

SEQ ID NO: 490112 - RNA, 64 nt, Human
aacuuuagaggauggaaaggggcagaguaaucuagcaaaggagacugaggccagugaaguagga

SEQ ID NO: 490113 - RNA, 64 nt, Human
aaauaaagacaaacuaaaacaaaacagaacaaaagcaaaggaaaaugcuuuagaaauuuuaacu

SEQ ID NO: 490114 - RNA, 64 nt, Human
accuguaaauugauucaagugagccaggaaagcagcaaaggaaagagaaaccugagugacgacg

SEQ ID NO: 490115 - RNA, 64 nt, Human
caagucauaccuacauucaaggagaggggaccaugcaaaggauaaacugcaggugaagaacuug

SEQ ID NO: 490116 - RNA, 64 nt, Human
uaugugaucgucaaugugaauagcuuagaauacugcaaaggauaagcuaauugaaugccuugaa

SEQ ID NO: 490117 - RNA, 64 nt, Human
ucuugcuggagugguguaauguaucuaacuuuuagcaaaggaggguugcagagcagcuuaaauu

SEQ ID NO: 490118 - RNA, 64 nt, Human
auugacaguugaaaaaaaaaagagugaccagagggcaaaggacccauucucaguaaugggagau

SEQ ID NO: 490119 - RNA, 64 nt, Human
cuguuuuuauccuagaaaauguugcugucagaaggcaaaggaaauguuaccaguguuuucgguu

SEQ ID NO: 490120 - RNA, 64 nt, Human
ugaguucagcauuuuuagggaccuaggugcaagugcaaaggaaauuucccuguuucaaaaucua

SEQ ID NO: 490121 - RNA, 64 nt, Human
acuuagggacaggguauagcuuagaugguggaaagcaaaggagagcaggaaguuguaaaucacu

SEQ ID NO: 490122 - RNA, 64 nt, Human
uuucaugucaggauugcaagcauuagcuaucacagcaaaggauuccuagccuauucuuacuuac

SEQ ID NO: 490123 - RNA, 64 nt, Human
agagauaccuguuuugaugaguaccuauuuugaugcaaaggaacggcccugggaccucagaggg

SEQ ID NO: 490124 - RNA, 64 nt, Human
aggcuucccaggccagaguguggcuucuuaaacggcaaaggaaauuccuuugagucacaagcca

SEQ ID NO: 490125 - RNA, 64 nt, Human
cacggaggagagggagguuggagacuucaaccgggcaaaggagcacaaggaaaccaagcagcag

SEQ ID NO: 490126 - RNA, 64 nt, Human
cgcgucacccaacgacccaugaccguucucugaggcaaaggagggcaaccugacagcaaacaca

SEQ ID NO: 490127 - RNA, 64 nt, Human
aucuucuucggugaaauauuuauaugcauaaauggcaaaggaaagaaauaauauauauuuuuau

SEQ ID NO: 490128 - RNA, 64 nt, Human
cacacacugcacaucuuuuggugaucggggucaggcaaaggaggggaaacaaugaaaacaaaua

SEQ ID NO: 490129 - RNA, 64 nt, Human
ucuccagguaguaggacaaugaaaauuguucuaagcaaaggaaagaaaacugacuuuguugcac

SEQ ID NO: 490130 - RNA, 64 nt, Human
ggggggccucagugacauccaugaggccuuauuagcaaaggacacccagaccuccaagguuugu

SEQ ID NO: 490131 - RNA, 64 nt, Human
gaaagccacuugauccucaacauauacuauaauugcaaaggaaacaugaggccaucuucccuug

SEQ ID NO: 490132 - RNA, 64 nt, Human
uguucgggacugagagcgccaagggucuuugccagcaaaggagguucugccuguaauugagccu

SEQ ID NO: 490133 - RNA, 64 nt, Human
gcuuuugauugggaagaugggcuucaauuagauggcaaaggagaggacaccgccagugguccaa

SEQ ID NO: 490134 - RNA, 64 nt, Human
gaagcuuacaaaaugagaaugugccaugcaugaagcaaaggauuccaggcuccagaaaaaauga

SEQ ID NO: 490135 - RNA, 63 nt, Human
ccacccccaagaagaacugaauaaagauugcugagcaaaggaaggcuucagucuggaaccugg

SEQ ID NO: 490136 - RNA, 64 nt, Human
ucggaucaaauuugggggaauaaaaaauauuagagcaaaggaguuugcugguugugucauuauu

SEQ ID NO: 490137 - RNA, 64 nt, Human
gccuccccgaccuugcugacuaggcacaugggacgcaaaggagggagggaagcaaggccuugcc

SEQ ID NO: 490138 - RNA, 64 nt, Human
guuccacgucaaguucuggccuucugaugcaaaugcaaaggaacuuagucuguuaugaacccag

SEQ ID NO: 490139 - RNA, 64 nt, Human
uuuaaguaaaaauccaaaaaguuuuuuuaaaaaagcaaaggaagcauacuugugaacuaccuug

SEQ ID NO: 490140 - RNA, 64 nt, Human
ccccccucgugcgcaucucagaacccaucgguaggcaaaggaaaauacgcucaggugguugugg

SEQ ID NO: 490141 - RNA, 64 nt, Human
ugggaagccaggagugagaaggaauucagggagagcaaaggagccagugcugagaugcugcugu

SEQ ID NO: 490142 - RNA, 64 nt, Human
cccugcugcccagugcaaaccacuucuccaugcugcaaaggagaagcacagcuccugccagggu

SEQ ID NO: 490143 - RNA, 64 nt, Human
gguauguaucugaauuaauucucacuaaaauucagcaaaggacuugauagccccuccccgccuu

SEQ ID NO: 490144 - RNA, 64 nt, Human
agacagccuuuauacuagauucuaucaaaaucuugcaaaggaaaacaaaaugaacaacuucuac

SEQ ID NO: 490145 - RNA, 64 nt, Human
agccccucauggaaggagcuggcuuuguggggcugcaaaggacuuuuaaguccugccuguacug

SEQ ID NO: 490146 - RNA, 64 nt, Human
gcagugugguagcgccauggcugucucaaaccaagcaaaggaaggacccugaggccuucacgcu

SEQ ID NO: 490147 - RNA, 64 nt, Human
ccuguggggauuucucccagcucuagacaacccugcaaaggacuguuuuuuccugagcuuggcc

SEQ ID NO: 490148 - RNA, 64 nt, Human
gcacuuggaggaccuggcgugcucagacccaacagcaaaggaacuagaaagaaggacccagaac

SEQ ID NO: 490149 - RNA, 64 nt, Human
gggaaccuggaaggaggcucuuugugagaccugggcaaaggauggggcagcucgucgaugauuu

SEQ ID NO: 490150 - RNA, 64 nt, Human
cacagcaucauauuagauguaagauguaagacuugcaaaggacagaaggaaucuucuguaacca

SEQ ID NO: 490151 - RNA, 64 nt, Human
uugagggcuucagcugcugcuauuaugauguuuugcaaaggaaaauaaucaaaccaaagaguau

SEQ ID NO: 490152 - RNA, 64 nt, Human
uucacugcagucuuaagaaagagguaaaaggcaagcaaaggagaugaaaucuguucugggaaug

SEQ ID NO: 490153 - RNA, 64 nt, Human
uucccucuguaauuauuguguauucuacccuguugcaaaggaaauaaagcauaggguaguuugc

SEQ ID NO: 490154 - RNA, 64 nt, Human
cagaauggcaacuccuggaacagcacaacaaguggcaaaggacacagcuagcaacgggcuggaa

SEQ ID NO: 490155 - RNA, 64 nt, Human
gcucuuuccuccuuccauggaaccugacguagcugcaaaggacagauccagggacugaagccaa

SEQ ID NO: 490156 - RNA, 64 nt, Human
ugcgugcgcgcgcuucugggaaacagucccgcgugcaaaggaaaggggcaaaauggcaccuaag

SEQ ID NO: 490157 - RNA, 64 nt, Human
cugucuggauugccugcugcaaagcuuugauuuggcaaaggagaccauggaagaaucauggugg

SEQ ID NO: 490158 - RNA, 64 nt, Human
uauuuuucccuccgggcaggggagccaggguagagcaaaggagacaaagcaggaguggaaggug

SEQ ID NO: 490159 - RNA, 64 nt, Human
guggggugggcucagcagaagugggugcauuucugcaaaggaagcuguagguuucuugucaguu

SEQ ID NO: 490160 - RNA, 64 nt, Human
ugggauaucccucgguaaggguaaaggagcagaggcaaaggagaaaagcagaaguugcagcuga

SEQ ID NO: 490161 - RNA, 64 nt, Human
cuuagacaaauuaaauuuggcagaguuuaauugagcaaaggacaauucacaaaucagguagccc

SEQ ID NO: 490162 - RNA, 62 nt, Human
cauugaucuuaaaauuuuucucagucacugauaugcaaaggaccacacugucucugcuucca

SEQ ID NO: 490163 - RNA, 64 nt, Human
aaauuauucuguauugcaacuuuucucagagauugcaaaggauuuuuuagguagagauuauuuu

SEQ ID NO: 490164 - RNA, 64 nt, Human
ugggaucacaugagcaaauuuucagcucucaaaggcaaaggacacuccuuucuaauugcaucac

SEQ ID NO: 490165 - RNA, 64 nt, Human
auuugaauagcagcauuagugguuugagugucuagcaaaggaaaaauugaugaauaaaaugaag

SEQ ID NO: 490166 - RNA, 64 nt, Human
cagucaaugggggaccgcccgugucuaagcaugugcaaaggagaggagggagaugaggucauug

SEQ ID NO: 490167 - RNA, 64 nt, Human
ggcccccauggggaagacacggauggaagguggagcaaaggaaaauacaugaaauugagagugg

SEQ ID NO: 490168 - RNA, 64 nt, Human
ccuuugcugaguguucuguuuuugcagaauaaaagcaaaggaugcagacuuaccccacccucca

SEQ ID NO: 490169 - RNA, 64 nt, Human
auuuacaggaacaaacaaccccaucaaaaagucggcaaaggacaugaacagacacuucucaaaa

SEQ ID NO: 490170 - RNA, 64 nt, Human
gcucgggcuuguuugaggguucacgaccccuccagcaaaggagucugaggcugauuccaguaga

SEQ ID NO: 490171 - RNA, 64 nt, Human
auugcgaggaaccugggcucugacucgaacaccugcaaaggacagggacugggaccguuacuua

SEQ ID NO: 490172 - RNA, 64 nt, Human
agcacuggugaggggaaucuguugcccagguccugcaaaggagccaggugccauggcauauaag

SEQ ID NO: 490173 - RNA, 64 nt, Human
gccccgccuuaguuuuccccgauuuggggcucgagcaaaggaaguugcugaggccaagguagcc

SEQ ID NO: 490174 - RNA, 64 nt, Human
ccaucugggaggguggcauucugggacaugaggagcaaaggaagggggcaauaaauguugagcc

SEQ ID NO: 490175 - RNA, 64 nt, Human
agcccuguucucggugcugggaguacagcagugagcaaaggagacaauauucccugcucacaga

SEQ ID NO: 490176 - RNA, 64 nt, Human
agugcagugggcagggaagacauaacagauggaagcaaaggaauccugccugccuucagcagag

SEQ ID NO: 490177 - RNA, 64 nt, Human
guucuucuccagcaucucuaaggcccacuugaaugcaaaggaaaacacuugcacagcaaagcaa

SEQ ID NO: 490178 - RNA, 64 nt, Human
cccuaagagagcaccuggugaucacguggucacggcaaaggaagacgugaugccaggaccaguc

SEQ ID NO: 490179 - RNA, 64 nt, Human
ugacaagguauauuuguuuucuagugacagaaaggcaaaggaacaaguccuaguuguuguuguu

SEQ ID NO: 490180 - RNA, 64 nt, Human
uuucugacuacuucuauggaaggccagugaagaagcaaaggaagacaugaaaauugacgcucau

SEQ ID NO: 490181 - RNA, 64 nt, Human
aguucuuacauuucuaauagccuuggguuuauuugcaaaggaagcuugaaaaauaugagaaaag

SEQ ID NO: 490182 - RNA, 64 nt, Human
agucuuggaagcagagucuggguugguguggauagcaaaggaggaagucugagccccucauugg

SEQ ID NO: 490183 - RNA, 64 nt, Human
cuuuuagugcuggcccucucuguggguguggccugcaaaggaaccaacagacccuaugcugggg

SEQ ID NO: 490184 - RNA, 64 nt, Human
agguucaaaaggaagugccucaaagcaaaggcaagcaaaggaaccccacgaugaacuugcucuu

SEQ ID NO: 490185 - RNA, 64 nt, Human
gaggauaacggcuuccagcuucauccaugucccugcaaaggacgugaucucauuucuuuuuaug

SEQ ID NO: 490186 - RNA, 64 nt, Human
aacuaagaguaucagguuauuuauauauuugcaagcaaaggacaguaagaaguugacuggcaaa

SEQ ID NO: 490187 - RNA, 64 nt, Human
gcuagggagugguggaaguaggaaggauuugugugcaaaggaaaaucgugguugaguuucacug

SEQ ID NO: 490188 - RNA, 64 nt, Human
ccuccugggaugcgugcaaggcagaccuggugcugcaaaggaaagggccugaggccucagggag

SEQ ID NO: 490189 - RNA, 64 nt, Human
acagucugcagccuauaaacaguggugucucaaagcaaaggaaaccuccacaagugcugcaaca

SEQ ID NO: 490190 - RNA, 64 nt, Human
ucacagucuaaguaagugucugugaugcucccaagcaaaggaaaugcaagcucuggaaauucgu

SEQ ID NO: 490191 - RNA, 64 nt, Human
caacauccuuucugucugaaacaaacagucacaagcaaaggaagaggcugggggacuagaaaga

SEQ ID NO: 490192 - RNA, 64 nt, Human
cagcaggagagaggugguagggagcagccagccggcaaaggaaggagggggaaaaaaaccgcca

SEQ ID NO: 490193 - RNA, 63 nt, Human
uaaauuuuuguaagaaaauuuaaaaauuaaagcagcaaaggaacuuuuugcuuucugccacuc

SEQ ID NO: 490194 - RNA, 64 nt, Human
ugcacccaggaggugacugggaaggagaaaaccagcaaaggaagcucugccuuuuauaauugaa

SEQ ID NO: 490195 - RNA, 64 nt, Human
uaaaccuaaauucaaaucuccuccaugccuuugcgcaaaggaccucccucuugcacucuaagcc

SEQ ID NO: 490196 - RNA, 64 nt, Human
gcuuuagagcccucagcaggucuggggagcuagagcaaaggagggaccucaggccuuccguuuc

SEQ ID NO: 490197 - RNA, 64 nt, Human
cacggaggcuuucucacagcccagccugccugaagcaaaggaggcucccguguccugggcagcu

SEQ ID NO: 490198 - RNA, 64 nt, Human
acuucuuuuccuuuauuucucucccaaccuggcugcaaaggagguucauauuccccagaugugu

SEQ ID NO: 490199 - RNA, 64 nt, Human
guuagagagauggaggcgugagugagaacgggaagcaaaggaauacacgugggaacuaaagaga

SEQ ID NO: 490200 - RNA, 64 nt, Human
acguuaagucaugauuucgcgccauaauaaagaugcaaaggaaugacauuucuguauuaguuau

SEQ ID NO: 490201 - RNA, 64 nt, Human
ugaugagucaucuuuguagaguuacuaagcauuagcaaaggaggaaaugcuauguaauagaaau

SEQ ID NO: 490202 - RNA, 64 nt, Human
caaaacagguaaaaaucuuaaaugugcaccaagagcaaaggaucaacuuuuagucaugauguuc

SEQ ID NO: 490203 - RNA, 64 nt, Human
uguugaacgucuguaaaugauuuuuuuuuuuuuugcaaaggaaaaaauugauacuggaaaagau

SEQ ID NO: 490204 - RNA, 64 nt, Human
uggaccaggguggcugugaagggaagucuuuguugcaaaggaggaggaggaaaagggaggacuu

SEQ ID NO: 490205 - RNA, 64 nt, Human
aaaggugaaugccagauguaaauggcgccucugggcaaaggaggcuuguauuuugcacauuuua

SEQ ID NO: 490206 - RNA, 64 nt, Human
agaaugugcacuucaucaccagguucuagcucuggcaaaggagugcugucuacagcaagauuuu

SEQ ID NO: 490207 - RNA, 64 nt, Human
auaauauuuaaugugugaacagcuacugugacaugcaaaggaaaggacagugcagaauuaaacc

SEQ ID NO: 490208 - RNA, 64 nt, Human
ugaucuuuaaauuuucccacaccauaagagaggagcaaaggaaauuaccaguuuagacuaaguu

SEQ ID NO: 490209 - RNA, 64 nt, Human
ggcucccagggccugggcaacuuagcugcaacuggcaaaggagaaggguaguuugaggugugac

SEQ ID NO: 490210 - RNA, 64 nt, Human
gggaagggcagaaggaaggagggaagaaaagaaagcaaaggaacagaaggaaggaaagaaagau

SEQ ID NO: 490211 - RNA, 64 nt, Human
ccugagcaaccacaaauaggcucuccaugaaacugcaaaggaacugauguguggcauccaugcu

SEQ ID NO: 490212 - RNA, 64 nt, Human
aaaggcagacgugcuuuauagcuaaaugaacaaagcaaaggauacagagguauguucucucuua

SEQ ID NO: 490213 - RNA, 64 nt, Human
ccucgacaacgugcgagaacccugacgucccccagcaaaggaagacguugcaagcaggcaaaau

SEQ ID NO: 490214 - RNA, 64 nt, Human
cugccgagaccccaagaacucggggugucagagggcaaaggaacuaccugccuuucacggcugc

SEQ ID NO: 490215 - RNA, 62 nt, Human
cauucucuucccagugccuaucggacagugcggcggucgaggucccgcucccgguccccucg

SEQ ID NO: 490216 - RNA, 64 nt, Human; identical to SEQ ID NO: 9076

SEQ ID NO: 490217 - RNA, 64 nt, Human; identical to SEQ ID NO: 9077

SEQ ID NO: 490218 - RNA, 64 nt, Human; identical to SEQ ID NO: 9078

SEQ ID NO: 490219 - RNA, 64 nt, Human; identical to SEQ ID NO: 9079

SEQ ID NO: 490220 - RNA, 64 nt, Human; identical to SEQ ID NO: 9080

SEQ ID NO: 490221 - RNA, 64 nt, Human; identical to SEQ ID NO: 9081

SEQ ID NO: 490222 - RNA, 64 nt, Human; identical to SEQ ID NO: 9082

SEQ ID NO: 490223 - RNA, 64 nt, Human; identical to SEQ ID NO: 9083

SEQ ID NO: 490224 - RNA, 64 nt, Human; identical to SEQ ID NO: 9084

SEQ ID NO: 490225 - RNA, 64 nt, Human; identical to SEQ ID NO: 9085

SEQ ID NO: 490226 - RNA, 64 nt, Human; identical to SEQ ID NO: 9086

SEQ ID NO: 490227 - RNA, 64 nt, Human; identical to SEQ ID NO: 9087

SEQ ID NO: 490228 - RNA, 64 nt, Human; identical to SEQ ID NO: 9088

SEQ ID NO: 490229 - RNA, 64 nt, Human; identical to SEQ ID NO: 9089

SEQ ID NO: 490230 - RNA, 64 nt, Human; identical to SEQ ID NO: 9090

SEQ ID NO: 490231 - RNA, 64 nt, Human; identical to SEQ ID NO: 9091

SEQ ID NO: 490232 - RNA, 64 nt, Human; identical to SEQ ID NO: 9092

SEQ ID NO: 490233 - RNA, 64 nt, Human; identical to SEQ ID NO: 9093

SEQ ID NO: 490234 - RNA, 64 nt, Human; identical to SEQ ID NO: 9094

SEQ ID NO: 490235 - RNA, 64 nt, Human; identical to SEQ ID NO: 9095

SEQ ID NO: 490236 - RNA, 64 nt, Human; identical to SEQ ID NO: 9096

SEQ ID NO: 490237 - RNA, 64 nt, Human; identical to SEQ ID NO: 9097

SEQ ID NO: 490238 - RNA, 64 nt, Human; identical to SEQ ID NO: 9098

SEQ ID NO: 490239 - RNA, 64 nt, Human; identical to SEQ ID NO: 9099

SEQ ID NO: 490240 - RNA, 64 nt, Human; identical to SEQ ID NO: 9100

SEQ ID NO: 490241 - RNA, 64 nt, Human; identical to SEQ ID NO: 9101

SEQ ID NO: 490242 - RNA, 64 nt, Human; identical to SEQ ID NO: 9102

SEQ ID NO: 490243 - RNA, 64 nt, Human; identical to SEQ ID NO: 9103

SEQ ID NO: 490244 - RNA, 64 nt, Human; identical to SEQ ID NO: 9104

SEQ ID NO: 490245 - RNA, 61 nt, Human; identical to SEQ ID NO: 9105

SEQ ID NO: 490246 - RNA, 64 nt, Human; identical to SEQ ID NO: 9106

SEQ ID NO: 490247 - RNA, 64 nt, Human; identical to SEQ ID NO: 9107

SEQ ID NO: 490248 - RNA, 64 nt, Human; identical to SEQ ID NO: 9108

SEQ ID NO: 490249 - RNA, 64 nt, Human; identical to SEQ ID NO: 9109

SEQ ID NO: 490250 - RNA, 64 nt, Human; identical to SEQ ID NO: 9110

SEQ ID NO: 490251 - RNA, 64 nt, Human; identical to SEQ ID NO: 9111

SEQ ID NO: 490252 - RNA, 64 nt, Human; identical to SEQ ID NO: 9112

SEQ ID NO: 490253 - RNA, 64 nt, Human; identical to SEQ ID NO: 9113

SEQ ID NO: 490254 - RNA, 64 nt, Human; identical to SEQ ID NO: 9114

SEQ ID NO: 490255 - RNA, 64 nt, Human; identical to SEQ ID NO: 9115

SEQ ID NO: 490256 - RNA, 64 nt, Human; identical to SEQ ID NO: 9116

SEQ ID NO: 490257 - RNA, 64 nt, Human; identical to SEQ ID NO: 9117

SEQ ID NO: 490258 - RNA, 64 nt, Human; identical to SEQ ID NO: 9118

SEQ ID NO: 490259 - RNA, 64 nt, Human; identical to SEQ ID NO: 9119

SEQ ID NO: 490260 - RNA, 64 nt, Human; identical to SEQ ID NO: 9120

SEQ ID NO: 490261 - RNA, 64 nt, Human; identical to SEQ ID NO: 9121

SEQ ID NO: 490262 - RNA, 64 nt, Human; identical to SEQ ID NO: 9122

SEQ ID NO: 490263 - RNA, 64 nt, Human; identical to SEQ ID NO: 9123

SEQ ID NO: 490264 - RNA, 64 nt, Human; identical to SEQ ID NO: 9124

SEQ ID NO: 490265 - RNA, 64 nt, Human; identical to SEQ ID NO: 9125

SEQ ID NO: 490266 - RNA, 64 nt, Human; identical to SEQ ID NO: 9126

SEQ ID NO: 490267 - RNA, 64 nt, Human; identical to SEQ ID NO: 9127

SEQ ID NO: 490268 - RNA, 64 nt, Human; identical to SEQ ID NO: 9128

SEQ ID NO: 490269 - RNA, 64 nt, Human; identical to SEQ ID NO: 9129

SEQ ID NO: 490270 - RNA, 64 nt, Human; identical to SEQ ID NO: 9130

SEQ ID NO: 490271 - RNA, 64 nt, Human; identical to SEQ ID NO: 9131

SEQ ID NO: 490272 - RNA, 64 nt, Human; identical to SEQ ID NO: 9132

SEQ ID NO: 490273 - RNA, 64 nt, Human; identical to SEQ ID NO: 9133

SEQ ID NO: 490274 - RNA, 64 nt, Human; identical to SEQ ID NO: 9134

SEQ ID NO: 490275 - RNA, 64 nt, Human; identical to SEQ ID NO: 9135

SEQ ID NO: 490276 - RNA, 64 nt, Human; identical to SEQ ID NO: 9136

SEQ ID NO: 490277 - RNA, 64 nt, Human; identical to SEQ ID NO: 9137

SEQ ID NO: 490278 - RNA, 64 nt, Human; identical to SEQ ID NO: 9138

SEQ ID NO: 490279 - RNA, 64 nt, Human; identical to SEQ ID NO: 9139

SEQ ID NO: 490280 - RNA, 64 nt, Human; identical to SEQ ID NO: 9140

SEQ ID NO: 490281 - RNA, 64 nt, Human; identical to SEQ ID NO: 9141

SEQ ID NO: 490282 - RNA, 64 nt, Human; identical to SEQ ID NO: 9142

SEQ ID NO: 490283 - RNA, 64 nt, Human; identical to SEQ ID NO: 9143

SEQ ID NO: 490284 - RNA, 64 nt, Human; identical to SEQ ID NO: 9144

SEQ ID NO: 490285 - RNA, 64 nt, Human; identical to SEQ ID NO: 9145

SEQ ID NO: 490286 - RNA, 64 nt, Human; identical to SEQ ID NO: 9146

SEQ ID NO: 490287 - RNA, 64 nt, Human; identical to SEQ ID NO: 9147

SEQ ID NO: 490288 - RNA, 64 nt, Human; identical to SEQ ID NO: 9148

SEQ ID NO: 490289 - RNA, 64 nt, Human; identical to SEQ ID NO: 9149

SEQ ID NO: 490290 - RNA, 64 nt, Human; identical to SEQ ID NO: 9150

SEQ ID NO: 490291 - RNA, 64 nt, Human; identical to SEQ ID NO: 9151

SEQ ID NO: 490292 - RNA, 64 nt, Human; identical to SEQ ID NO: 9152

SEQ ID NO: 490293 - RNA, 64 nt, Human; identical to SEQ ID NO: 9153

SEQ ID NO: 490294 - RNA, 64 nt, Human; identical to SEQ ID NO: 9154

SEQ ID NO: 490295 - RNA, 64 nt, Human; identical to SEQ ID NO: 9155

SEQ ID NO: 490296 - RNA, 64 nt, Human; identical to SEQ ID NO: 9156

SEQ ID NO: 490297 - RNA, 64 nt, Human; identical to SEQ ID NO: 9157

SEQ ID NO: 490298 - RNA, 64 nt, Human; identical to SEQ ID NO: 9158

SEQ ID NO: 490299 - RNA, 64 nt, Human; identical to SEQ ID NO: 9159

SEQ ID NO: 490300 - RNA, 64 nt, Human; identical to SEQ ID NO: 9160

SEQ ID NO: 490301 - RNA, 64 nt, Human; identical to SEQ ID NO: 9161

SEQ ID NO: 490302 - RNA, 64 nt, Human; identical to SEQ ID NO: 9162

SEQ ID NO: 490303 - RNA, 64 nt, Human; identical to SEQ ID NO: 9163

SEQ ID NO: 490304 - RNA, 64 nt, Human; identical to SEQ ID NO: 9164

SEQ ID NO: 490305 - RNA, 64 nt, Human; identical to SEQ ID NO: 9165

SEQ ID NO: 490306 - RNA, 64 nt, Human; identical to SEQ ID NO: 9166

SEQ ID NO: 490307 - RNA, 64 nt, Human; identical to SEQ ID NO: 9167

SEQ ID NO: 490308 - RNA, 64 nt, Human; identical to SEQ ID NO: 9168

SEQ ID NO: 490309 - RNA, 64 nt, Human; identical to SEQ ID NO: 9169

SEQ ID NO: 490310 - RNA, 64 nt, Human; identical to SEQ ID NO: 9170

SEQ ID NO: 490311 - RNA, 64 nt, Human; identical to SEQ ID NO: 9171

SEQ ID NO: 490312 - RNA, 64 nt, Human; identical to SEQ ID NO: 9172

SEQ ID NO: 490313 - RNA, 64 nt, Human; identical to SEQ ID NO: 9173

SEQ ID NO: 490314 - RNA, 64 nt, Human; identical to SEQ ID NO: 9174

SEQ ID NO: 490315 - RNA, 64 nt, Human; identical to SEQ ID NO: 9175

SEQ ID NO: 490316 - RNA, 64 nt, Human; identical to SEQ ID NO: 9176

SEQ ID NO: 490317 - RNA, 64 nt, Human; identical to SEQ ID NO: 9177

SEQ ID NO: 490318 - RNA, 64 nt, Human; identical to SEQ ID NO: 9178

SEQ ID NO: 490319 - RNA, 64 nt, Human; identical to SEQ ID NO: 9179

SEQ ID NO: 490320 - RNA, 64 nt, Human; identical to SEQ ID NO: 9180

SEQ ID NO: 490321 - RNA, 64 nt, Human; identical to SEQ ID NO: 9181

SEQ ID NO: 490322 - RNA, 64 nt, Human; identical to SEQ ID NO: 9182

SEQ ID NO: 490323 - RNA, 64 nt, Human; identical to SEQ ID NO: 9183

SEQ ID NO: 490324 - RNA, 64 nt, Human; identical to SEQ ID NO: 9184

SEQ ID NO: 490325 - RNA, 64 nt, Human; identical to SEQ ID NO: 9185

SEQ ID NO: 490326 - RNA, 64 nt, Human; identical to SEQ ID NO: 9186

SEQ ID NO: 490327 - RNA, 64 nt, Human; identical to SEQ ID NO: 9187

SEQ ID NO: 490328 - RNA, 64 nt, Human; identical to SEQ ID NO: 9188

SEQ ID NO: 490329 - RNA, 64 nt, Human; identical to SEQ ID NO: 9189

SEQ ID NO: 490330 - RNA, 64 nt, Human; identical to SEQ ID NO: 9190

SEQ ID NO: 490331 - RNA, 64 nt, Human; identical to SEQ ID NO: 9191

SEQ ID NO: 490332 - RNA, 64 nt, Human; identical to SEQ ID NO: 9192

SEQ ID NO: 490333 - RNA, 64 nt, Human; identical to SEQ ID NO: 9193

SEQ ID NO: 490334 - RNA, 64 nt, Human; identical to SEQ ID NO: 9194

SEQ ID NO: 490335 - RNA, 64 nt, Human; identical to SEQ ID NO: 9195

SEQ ID NO: 490336 - RNA, 64 nt, Human; identical to SEQ ID NO: 9196

SEQ ID NO: 490337 - RNA, 64 nt, Human; identical to SEQ ID NO: 9197

SEQ ID NO: 490338 - RNA, 64 nt, Human; identical to SEQ ID NO: 9198

SEQ ID NO: 490339 - RNA, 64 nt, Human; identical to SEQ ID NO: 9199

SEQ ID NO: 490340 - RNA, 64 nt, Human; identical to SEQ ID NO: 9200

SEQ ID NO: 490341 - RNA, 64 nt, Human; identical to SEQ ID NO: 9201

SEQ ID NO: 490342 - RNA, 64 nt, Human; identical to SEQ ID NO: 9202

SEQ ID NO: 490343 - RNA, 64 nt, Human; identical to SEQ ID NO: 9203

SEQ ID NO: 490344 - RNA, 64 nt, Human; identical to SEQ ID NO: 9204

SEQ ID NO: 490345 - RNA, 64 nt, Human; identical to SEQ ID NO: 9205

SEQ ID NO: 490346 - RNA, 64 nt, Human; identical to SEQ ID NO: 9206

SEQ ID NO: 490347 - RNA, 64 nt, Human; identical to SEQ ID NO: 9207

SEQ ID NO: 490348 - RNA, 64 nt, Human; identical to SEQ ID NO: 9208

SEQ ID NO: 490349 - RNA, 64 nt, Human; identical to SEQ ID NO: 9209

SEQ ID NO: 490350 - RNA, 64 nt, Human; identical to SEQ ID NO: 9210

SEQ ID NO: 490351 - RNA, 64 nt, Human; identical to SEQ ID NO: 9211

SEQ ID NO: 490352 - RNA, 64 nt, Human; identical to SEQ ID NO: 9212

SEQ ID NO: 490353 - RNA, 64 nt, Human; identical to SEQ ID NO: 9213

SEQ ID NO: 490354 - RNA, 64 nt, Human; identical to SEQ ID NO: 9214

SEQ ID NO: 490355 - RNA, 64 nt, Human; identical to SEQ ID NO: 9215

SEQ ID NO: 490356 - RNA, 64 nt, Human; identical to SEQ ID NO: 9216

SEQ ID NO: 490357 - RNA, 64 nt, Human; identical to SEQ ID NO: 9217

SEQ ID NO: 490358 - RNA, 64 nt, Human; identical to SEQ ID NO: 9218

SEQ ID NO: 490359 - RNA, 64 nt, Human; identical to SEQ ID NO: 9219

SEQ ID NO: 490360 - RNA, 64 nt, Human; identical to SEQ ID NO: 9220

SEQ ID NO: 490361 - RNA, 64 nt, Human; identical to SEQ ID NO: 9221

SEQ ID NO: 490362 - RNA, 64 nt, Human; identical to SEQ ID NO: 9222

SEQ ID NO: 490363 - RNA, 64 nt, Human; identical to SEQ ID NO: 9223

SEQ ID NO: 490364 - RNA, 64 nt, Human; identical to SEQ ID NO: 9224

SEQ ID NO: 490365 - RNA, 64 nt, Human; identical to SEQ ID NO: 9225

SEQ ID NO: 490366 - RNA, 64 nt, Human; identical to SEQ ID NO: 9226

SEQ ID NO: 490367 - RNA, 64 nt, Human; identical to SEQ ID NO: 9227

SEQ ID NO: 490368 - RNA, 64 nt, Human; identical to SEQ ID NO: 9228

SEQ ID NO: 490369 - RNA, 64 nt, Human; identical to SEQ ID NO: 9229

SEQ ID NO: 490370 - RNA, 64 nt, Human; identical to SEQ ID NO: 9230

SEQ ID NO: 490371 - RNA, 64 nt, Human; identical to SEQ ID NO: 9231

SEQ ID NO: 490372 - RNA, 64 nt, Human; identical to SEQ ID NO: 9232

SEQ ID NO: 490373 - RNA, 64 nt, Human; identical to SEQ ID NO: 9233

SEQ ID NO: 490374 - RNA, 64 nt, Human; identical to SEQ ID NO: 9234

SEQ ID NO: 490375 - RNA, 64 nt, Human; identical to SEQ ID NO: 9235

SEQ ID NO: 490376 - RNA, 64 nt, Human; identical to SEQ ID NO: 9236

SEQ ID NO: 490377 - RNA, 64 nt, Human; identical to SEQ ID NO: 9237

SEQ ID NO: 490378 - RNA, 64 nt, Human; identical to SEQ ID NO: 9238

SEQ ID NO: 490379 - RNA, 64 nt, Human; identical to SEQ ID NO: 9239

SEQ ID NO: 490380 - RNA, 64 nt, Human; identical to SEQ ID NO: 9240

SEQ ID NO: 490381 - RNA, 64 nt, Human; identical to SEQ ID NO: 9241

SEQ ID NO: 490382 - RNA, 64 nt, Human; identical to SEQ ID NO: 9242

SEQ ID NO: 490383 - RNA, 64 nt, Human; identical to SEQ ID NO: 9243

SEQ ID NO: 490384 - RNA, 64 nt, Human; identical to SEQ ID NO: 9244

SEQ ID NO: 490385 - RNA, 64 nt, Human; identical to SEQ ID NO: 9245

SEQ ID NO: 490386 - RNA, 64 nt, Human; identical to SEQ ID NO: 9246

SEQ ID NO: 490387 - RNA, 64 nt, Human; identical to SEQ ID NO: 9247

SEQ ID NO: 490388 - RNA, 64 nt, Human; identical to SEQ ID NO: 9248

SEQ ID NO: 490389 - RNA, 63 nt, Human; identical to SEQ ID NO: 9249

SEQ ID NO: 490390 - RNA, 64 nt, Human; identical to SEQ ID NO: 9250

SEQ ID NO: 490391 - RNA, 64 nt, Human; identical to SEQ ID NO: 9251

SEQ ID NO: 490392 - RNA, 64 nt, Human; identical to SEQ ID NO: 9252

SEQ ID NO: 490393 - RNA, 64 nt, Human; identical to SEQ ID NO: 9253

SEQ ID NO: 490394 - RNA, 64 nt, Human; identical to SEQ ID NO: 9254

SEQ ID NO: 490395 - RNA, 64 nt, Human; identical to SEQ ID NO: 9255

SEQ ID NO: 490396 - RNA, 64 nt, Human; identical to SEQ ID NO: 9256

SEQ ID NO: 490397 - RNA, 64 nt, Human; identical to SEQ ID NO: 9257

SEQ ID NO: 490398 - RNA, 64 nt, Human; identical to SEQ ID NO: 9258

SEQ ID NO: 490399 - RNA, 64 nt, Human; identical to SEQ ID NO: 9259

SEQ ID NO: 490400 - RNA, 64 nt, Human; identical to SEQ ID NO: 9260

SEQ ID NO: 490401 - RNA, 64 nt, Human; identical to SEQ ID NO: 9261

SEQ ID NO: 490402 - RNA, 64 nt, Human; identical to SEQ ID NO: 9262

SEQ ID NO: 490403 - RNA, 64 nt, Human; identical to SEQ ID NO: 9263

SEQ ID NO: 490404 - RNA, 64 nt, Human; identical to SEQ ID NO: 9264

SEQ ID NO: 490405 - RNA, 64 nt, Human; identical to SEQ ID NO: 9265

SEQ ID NO: 490406 - RNA, 64 nt, Human; identical to SEQ ID NO: 9266

SEQ ID NO: 490407 - RNA, 64 nt, Human; identical to SEQ ID NO: 9267

SEQ ID NO: 490408 - RNA, 64 nt, Human; identical to SEQ ID NO: 9268

SEQ ID NO: 490409 - RNA, 64 nt, Human; identical to SEQ ID NO: 9269

SEQ ID NO: 490410 - RNA, 64 nt, Human; identical to SEQ ID NO: 9270

SEQ ID NO: 490411 - RNA, 64 nt, Human; identical to SEQ ID NO: 9271

SEQ ID NO: 490412 - RNA, 64 nt, Human; identical to SEQ ID NO: 9272

SEQ ID NO: 490413 - RNA, 64 nt, Human; identical to SEQ ID NO: 9273

SEQ ID NO: 490414 - RNA, 64 nt, Human; identical to SEQ ID NO: 9274

SEQ ID NO: 490415 - RNA, 64 nt, Human; identical to SEQ ID NO: 9275

SEQ ID NO: 490416 - RNA, 64 nt, Human; identical to SEQ ID NO: 9276

SEQ ID NO: 490417 - RNA, 64 nt, Human; identical to SEQ ID NO: 9277

SEQ ID NO: 490418 - RNA, 64 nt, Human; identical to SEQ ID NO: 9278

SEQ ID NO: 490419 - RNA, 64 nt, Human; identical to SEQ ID NO: 9279

SEQ ID NO: 490420 - RNA, 64 nt, Human; identical to SEQ ID NO: 9280

SEQ ID NO: 490421 - RNA, 64 nt, Human; identical to SEQ ID NO: 9281

SEQ ID NO: 490422 - RNA, 64 nt, Human; identical to SEQ ID NO: 9282

SEQ ID NO: 490423 - RNA, 64 nt, Human; identical to SEQ ID NO: 9283

SEQ ID NO: 490424 - RNA, 64 nt, Human; identical to SEQ ID NO: 9284

SEQ ID NO: 490425 - RNA, 64 nt, Human; identical to SEQ ID NO: 9285

SEQ ID NO: 490426 - RNA, 64 nt, Human; identical to SEQ ID NO: 9286

SEQ ID NO: 490427 - RNA, 64 nt, Human; identical to SEQ ID NO: 9287

SEQ ID NO: 490428 - RNA, 64 nt, Human; identical to SEQ ID NO: 9288

SEQ ID NO: 490429 - RNA, 64 nt, Human; identical to SEQ ID NO: 9289

SEQ ID NO: 490430 - RNA, 64 nt, Human; identical to SEQ ID NO: 9290

SEQ ID NO: 490431 - RNA, 64 nt, Human; identical to SEQ ID NO: 9291

SEQ ID NO: 490432 - RNA, 64 nt, Human; identical to SEQ ID NO: 9292

SEQ ID NO: 490433 - RNA, 64 nt, Human; identical to SEQ ID NO: 9293

SEQ ID NO: 490434 - RNA, 64 nt, Human; identical to SEQ ID NO: 9294

SEQ ID NO: 490435 - RNA, 64 nt, Human; identical to SEQ ID NO: 9295

SEQ ID NO: 490436 - RNA, 64 nt, Human; identical to SEQ ID NO: 9296

SEQ ID NO: 490437 - RNA, 64 nt, Human; identical to SEQ ID NO: 9297

SEQ ID NO: 490438 - RNA, 64 nt, Human; identical to SEQ ID NO: 9298

SEQ ID NO: 490439 - RNA, 64 nt, Human; identical to SEQ ID NO: 9299

SEQ ID NO: 490440 - RNA, 64 nt, Human; identical to SEQ ID NO: 9300

SEQ ID NO: 490441 - RNA, 64 nt, Human; identical to SEQ ID NO: 9301

SEQ ID NO: 490442 - RNA, 64 nt, Human; identical to SEQ ID NO: 9302

SEQ ID NO: 490443 - RNA, 64 nt, Human; identical to SEQ ID NO: 9303

SEQ ID NO: 490444 - RNA, 64 nt, Human; identical to SEQ ID NO: 9304

SEQ ID NO: 490445 - RNA, 64 nt, Human; identical to SEQ ID NO: 9305

SEQ ID NO: 490446 - RNA, 64 nt, Human; identical to SEQ ID NO: 9306

SEQ ID NO: 490447 - RNA, 64 nt, Human; identical to SEQ ID NO: 9307

SEQ ID NO: 490448 - RNA, 64 nt, Human; identical to SEQ ID NO: 9308

SEQ ID NO: 490449 - RNA, 64 nt, Human; identical to SEQ ID NO: 9309

SEQ ID NO: 490450 - RNA, 64 nt, Human; identical to SEQ ID NO: 9310

SEQ ID NO: 490451 - RNA, 64 nt, Human; identical to SEQ ID NO: 9311

SEQ ID NO: 490452 - RNA, 64 nt, Human; identical to SEQ ID NO: 9312

SEQ ID NO: 490453 - RNA, 64 nt, Human; identical to SEQ ID NO: 9313

SEQ ID NO: 490454 - RNA, 64 nt, Human; identical to SEQ ID NO: 9314

SEQ ID NO: 490455 - RNA, 64 nt, Human; identical to SEQ ID NO: 9315

SEQ ID NO: 490456 - RNA, 64 nt, Human; identical to SEQ ID NO: 9316

SEQ ID NO: 490457 - RNA, 64 nt, Human; identical to SEQ ID NO: 9317

SEQ ID NO: 490458 - RNA, 64 nt, Human; identical to SEQ ID NO: 9318

SEQ ID NO: 490459 - RNA, 64 nt, Human; identical to SEQ ID NO: 9319

SEQ ID NO: 490460 - RNA, 64 nt, Human; identical to SEQ ID NO: 9320

SEQ ID NO: 490461 - RNA, 61 nt, Human; identical to SEQ ID NO: 9321

SEQ ID NO: 490462 - RNA, 64 nt, Human; identical to SEQ ID NO: 9322

SEQ ID NO: 490463 - RNA, 56 nt, Human; identical to SEQ ID NO: 9323

SEQ ID NO: 490464 - RNA, 64 nt, Human; identical to SEQ ID NO: 9324

SEQ ID NO: 490465 - RNA, 64 nt, Human; identical to SEQ ID NO: 9325

SEQ ID NO: 490466 - RNA, 64 nt, Human; identical to SEQ ID NO: 9326

SEQ ID NO: 490467 - RNA, 64 nt, Human; identical to SEQ ID NO: 9327

SEQ ID NO: 490468 - RNA, 64 nt, Human; identical to SEQ ID NO: 9328

SEQ ID NO: 490469 - RNA, 64 nt, Human; identical to SEQ ID NO: 9329

SEQ ID NO: 490470 - RNA, 64 nt, Human; identical to SEQ ID NO: 9330

SEQ ID NO: 490471 - RNA, 64 nt, Human; identical to SEQ ID NO: 9331

SEQ ID NO: 490472 - RNA, 64 nt, Human; identical to SEQ ID NO: 9332

SEQ ID NO: 490473 - RNA, 64 nt, Human; identical to SEQ ID NO: 9333

SEQ ID NO: 490474 - RNA, 64 nt, Human; identical to SEQ ID NO: 9334

SEQ ID NO: 490475 - RNA, 64 nt, Human; identical to SEQ ID NO: 9335

SEQ ID NO: 490476 - RNA, 64 nt, Human; identical to SEQ ID NO: 9336

SEQ ID NO: 490477 - RNA, 64 nt, Human; identical to SEQ ID NO: 9337

SEQ ID NO: 490478 - RNA, 64 nt, Human; identical to SEQ ID NO: 9338

SEQ ID NO: 490479 - RNA, 64 nt, Human; identical to SEQ ID NO: 9339

SEQ ID NO: 490480 - RNA, 64 nt, Human; identical to SEQ ID NO: 9340

SEQ ID NO: 490481 - RNA, 64 nt, Human; identical to SEQ ID NO: 9341

SEQ ID NO: 490482 - RNA, 64 nt, Human; identical to SEQ ID NO: 9342

SEQ ID NO: 490483 - RNA, 64 nt, Human; identical to SEQ ID NO: 9343

SEQ ID NO: 490484 - RNA, 64 nt, Human; identical to SEQ ID NO: 9344

SEQ ID NO: 490485 - RNA, 64 nt, Human; identical to SEQ ID NO: 9345

SEQ ID NO: 490486 - RNA, 64 nt, Human; identical to SEQ ID NO: 9346

SEQ ID NO: 490487 - RNA, 64 nt, Human; identical to SEQ ID NO: 9347

SEQ ID NO: 490488 - RNA, 64 nt, Human; identical to SEQ ID NO: 9348

SEQ ID NO: 490489 - RNA, 64 nt, Human; identical to SEQ ID NO: 9349

SEQ ID NO: 490490 - RNA, 64 nt, Human; identical to SEQ ID NO: 9350

SEQ ID NO: 490491 - RNA, 64 nt, Human; identical to SEQ ID NO: 9351

SEQ ID NO: 490492 - RNA, 64 nt, Human; identical to SEQ ID NO: 9352

SEQ ID NO: 490493 - RNA, 64 nt, Human; identical to SEQ ID NO: 9353

SEQ ID NO: 490494 - RNA, 64 nt, Human; identical to SEQ ID NO: 9354

SEQ ID NO: 490495 - RNA, 64 nt, Human; identical to SEQ ID NO: 9355

SEQ ID NO: 490496 - RNA, 64 nt, Human; identical to SEQ ID NO: 9356

SEQ ID NO: 490497 - RNA, 64 nt, Human; identical to SEQ ID NO: 9357

SEQ ID NO: 490498 - RNA, 64 nt, Human; identical to SEQ ID NO: 9358

SEQ ID NO: 490499 - RNA, 64 nt, Human; identical to SEQ ID NO: 9359

SEQ ID NO: 490500 - RNA, 64 nt, Human; identical to SEQ ID NO: 9360

SEQ ID NO: 490501 - RNA, 64 nt, Human; identical to SEQ ID NO: 9361

SEQ ID NO: 490502 - RNA, 64 nt, Human; identical to SEQ ID NO: 9362

SEQ ID NO: 490503 - RNA, 64 nt, Human; identical to SEQ ID NO: 9363

SEQ ID NO: 490504 - RNA, 64 nt, Human; identical to SEQ ID NO: 9364

SEQ ID NO: 490505 - RNA, 64 nt, Human; identical to SEQ ID NO: 9365

SEQ ID NO: 490506 - RNA, 64 nt, Human; identical to SEQ ID NO: 9366

SEQ ID NO: 490507 - RNA, 60 nt, Human; identical to SEQ ID NO: 9367

SEQ ID NO: 490508 - RNA, 64 nt, Human; identical to SEQ ID NO: 9368

SEQ ID NO: 490509 - RNA, 64 nt, Human; identical to SEQ ID NO: 9369

SEQ ID NO: 490510 - RNA, 64 nt, Human; identical to SEQ ID NO: 9370

SEQ ID NO: 490511 - RNA, 64 nt, Human; identical to SEQ ID NO: 9371

SEQ ID NO: 490512 - RNA, 64 nt, Human; identical to SEQ ID NO: 9372

SEQ ID NO: 490513 - RNA, 64 nt, Human; identical to SEQ ID NO: 9373

SEQ ID NO: 490514 - RNA, 64 nt, Human; identical to SEQ ID NO: 9374

SEQ ID NO: 490515 - RNA, 64 nt, Human; identical to SEQ ID NO: 9375

SEQ ID NO: 490516 - RNA, 64 nt, Human; identical to SEQ ID NO: 9376

SEQ ID NO: 490517 - RNA, 64 nt, Human; identical to SEQ ID NO: 9377

SEQ ID NO: 490518 - RNA, 64 nt, Human; identical to SEQ ID NO: 9378

SEQ ID NO: 490519 - RNA, 64 nt, Human; identical to SEQ ID NO: 9379

SEQ ID NO: 490520 - RNA, 51 nt, Human; identical to SEQ ID NO: 9380

SEQ ID NO: 490521 - RNA, 64 nt, Human; identical to SEQ ID NO: 9381

SEQ ID NO: 490522 - RNA, 64 nt, Human; identical to SEQ ID NO: 9382

SEQ ID NO: 490523 - RNA, 64 nt, Human; identical to SEQ ID NO: 9383

SEQ ID NO: 490524 - RNA, 64 nt, Human; identical to SEQ ID NO: 9384

SEQ ID NO: 490525 - RNA, 64 nt, Human; identical to SEQ ID NO: 9385

SEQ ID NO: 490526 - RNA, 64 nt, Human; identical to SEQ ID NO: 9386

SEQ ID NO: 490527 - RNA, 64 nt, Human; identical to SEQ ID NO: 9387

SEQ ID NO: 490528 - RNA, 64 nt, Human; identical to SEQ ID NO: 9388

SEQ ID NO: 490529 - RNA, 64 nt, Human; identical to SEQ ID NO: 9389

SEQ ID NO: 490530 - RNA, 64 nt, Human; identical to SEQ ID NO: 9390

SEQ ID NO: 490531 - RNA, 64 nt, Human; identical to SEQ ID NO: 9391

SEQ ID NO: 490532 - RNA, 64 nt, Human; identical to SEQ ID NO: 9392

SEQ ID NO: 490533 - RNA, 64 nt, Human; identical to SEQ ID NO: 9393

SEQ ID NO: 490534 - RNA, 64 nt, Human; identical to SEQ ID NO: 9394

SEQ ID NO: 490535 - RNA, 64 nt, Human; identical to SEQ ID NO: 9395

SEQ ID NO: 490536 - RNA, 64 nt, Human; identical to SEQ ID NO: 9396

SEQ ID NO: 490537 - RNA, 64 nt, Human; identical to SEQ ID NO: 9397

SEQ ID NO: 490538 - RNA, 64 nt, Human; identical to SEQ ID NO: 9398

SEQ ID NO: 490539 - RNA, 64 nt, Human; identical to SEQ ID NO: 9399

SEQ ID NO: 490540 - RNA, 64 nt, Human; identical to SEQ ID NO: 9400

SEQ ID NO: 490541 - RNA, 64 nt, Human; identical to SEQ ID NO: 9401

SEQ ID NO: 490542 - RNA, 64 nt, Human; identical to SEQ ID NO: 9402

SEQ ID NO: 490543 - RNA, 64 nt, Human; identical to SEQ ID NO: 9403

SEQ ID NO: 490544 - RNA, 64 nt, Human; identical to SEQ ID NO: 9404

SEQ ID NO: 490545 - RNA, 64 nt, Human; identical to SEQ ID NO: 9405

SEQ ID NO: 490546 - RNA, 64 nt, Human; identical to SEQ ID NO: 9406

SEQ ID NO: 490547 - RNA, 64 nt, Human; identical to SEQ ID NO: 9407

SEQ ID NO: 490548 - RNA, 64 nt, Human; identical to SEQ ID NO: 9408

SEQ ID NO: 490549 - RNA, 64 nt, Human; identical to SEQ ID NO: 9409

SEQ ID NO: 490550 - RNA, 64 nt, Human; identical to SEQ ID NO: 9410

SEQ ID NO: 490551 - RNA, 64 nt, Human; identical to SEQ ID NO: 9411

SEQ ID NO: 490552 - RNA, 64 nt, Human; identical to SEQ ID NO: 9412

SEQ ID NO: 490553 - RNA, 64 nt, Human; identical to SEQ ID NO: 9413

SEQ ID NO: 490554 - RNA, 64 nt, Human; identical to SEQ ID NO: 9414

SEQ ID NO: 490555 - RNA, 64 nt, Human; identical to SEQ ID NO: 9415

SEQ ID NO: 490556 - RNA, 64 nt, Human; identical to SEQ ID NO: 9416

SEQ ID NO: 490557 - RNA, 64 nt, Human; identical to SEQ ID NO: 9417

SEQ ID NO: 490558 - RNA, 64 nt, Human; identical to SEQ ID NO: 9418

SEQ ID NO: 490559 - RNA, 64 nt, Human; identical to SEQ ID NO: 9419

SEQ ID NO: 490560 - RNA, 64 nt, Human; identical to SEQ ID NO: 9420

SEQ ID NO: 490561 - RNA, 64 nt, Human; identical to SEQ ID NO: 9421

SEQ ID NO: 490562 - RNA, 64 nt, Human; identical to SEQ ID NO: 9422

SEQ ID NO: 490563 - RNA, 64 nt, Human; identical to SEQ ID NO: 9423

SEQ ID NO: 490564 - RNA, 64 nt, Human; identical to SEQ ID NO: 9424

SEQ ID NO: 490565 - RNA, 64 nt, Human; identical to SEQ ID NO: 9425

SEQ ID NO: 490566 - RNA, 64 nt, Human; identical to SEQ ID NO: 9426

SEQ ID NO: 490567 - RNA, 64 nt, Human; identical to SEQ ID NO: 9427

SEQ ID NO: 490568 - RNA, 64 nt, Human; identical to SEQ ID NO: 9428

SEQ ID NO: 490569 - RNA, 64 nt, Human; identical to SEQ ID NO: 9429

SEQ ID NO: 490570 - RNA, 64 nt, Human; identical to SEQ ID NO: 9430

SEQ ID NO: 490571 - RNA, 64 nt, Human; identical to SEQ ID NO: 9431

SEQ ID NO: 490572 - RNA, 64 nt, Human; identical to SEQ ID NO: 9432

SEQ ID NO: 490573 - RNA, 64 nt, Human; identical to SEQ ID NO: 9433

SEQ ID NO: 490574 - RNA, 64 nt, Human; identical to SEQ ID NO: 9434

SEQ ID NO: 490575 - RNA, 64 nt, Human; identical to SEQ ID NO: 9435

SEQ ID NO: 490576 - RNA, 64 nt, Human; identical to SEQ ID NO: 9436

SEQ ID NO: 490577 - RNA, 64 nt, Human; identical to SEQ ID NO: 9437

SEQ ID NO: 490578 - RNA, 64 nt, Human; identical to SEQ ID NO: 9438

SEQ ID NO: 490579 - RNA, 64 nt, Human; identical to SEQ ID NO: 9439

SEQ ID NO: 490580 - RNA, 64 nt, Human; identical to SEQ ID NO: 9440

SEQ ID NO: 490581 - RNA, 64 nt, Human; identical to SEQ ID NO: 9441

SEQ ID NO: 490582 - RNA, 64 nt, Human; identical to SEQ ID NO: 9442

SEQ ID NO: 490583 - RNA, 64 nt, Human; identical to SEQ ID NO: 9443

SEQ ID NO: 490584 - RNA, 64 nt, Human; identical to SEQ ID NO: 9444

SEQ ID NO: 490585 - RNA, 64 nt, Human; identical to SEQ ID NO: 9445

SEQ ID NO: 490586 - RNA, 64 nt, Human; identical to SEQ ID NO: 9446

SEQ ID NO: 490587 - RNA, 64 nt, Human; identical to SEQ ID NO: 9447

SEQ ID NO: 490588 - RNA, 64 nt, Human; identical to SEQ ID NO: 9448

SEQ ID NO: 490589 - RNA, 64 nt, Human; identical to SEQ ID NO: 9449

SEQ ID NO: 490590 - RNA, 64 nt, Human; identical to SEQ ID NO: 9450

SEQ ID NO: 490591 - RNA, 64 nt, Human; identical to SEQ ID NO: 9451

SEQ ID NO: 490592 - RNA, 64 nt, Human; identical to SEQ ID NO: 9452

SEQ ID NO: 490593 - RNA, 64 nt, Human; identical to SEQ ID NO: 9453

SEQ ID NO: 490594 - RNA, 64 nt, Human; identical to SEQ ID NO: 9454

SEQ ID NO: 490595 - RNA, 64 nt, Human; identical to SEQ ID NO: 9455

SEQ ID NO: 490596 - RNA, 64 nt, Human; identical to SEQ ID NO: 9456

SEQ ID NO: 490597 - RNA, 64 nt, Human; identical to SEQ ID NO: 9457

SEQ ID NO: 490598 - RNA, 64 nt, Human; identical to SEQ ID NO: 9458

SEQ ID NO: 490599 - RNA, 64 nt, Human; identical to SEQ ID NO: 9459

SEQ ID NO: 490600 - RNA, 64 nt, Human; identical to SEQ ID NO: 9460

SEQ ID NO: 490601 - RNA, 64 nt, Human; identical to SEQ ID NO: 9461

SEQ ID NO: 490602 - RNA, 64 nt, Human; identical to SEQ ID NO: 9462

SEQ ID NO: 490603 - RNA, 64 nt, Human; identical to SEQ ID NO: 9463

SEQ ID NO: 490604 - RNA, 64 nt, Human; identical to SEQ ID NO: 9464

SEQ ID NO: 490605 - RNA, 64 nt, Human; identical to SEQ ID NO: 9465

SEQ ID NO: 490606 - RNA, 64 nt, Human; identical to SEQ ID NO: 9466

SEQ ID NO: 490607 - RNA, 64 nt, Human; identical to SEQ ID NO: 9467

SEQ ID NO: 490608 - RNA, 64 nt, Human; identical to SEQ ID NO: 9468

SEQ ID NO: 490609 - RNA, 64 nt, Human; identical to SEQ ID NO: 9469

SEQ ID NO: 490610 - RNA, 64 nt, Human; identical to SEQ ID NO: 9470

SEQ ID NO: 490611 - RNA, 64 nt, Human; identical to SEQ ID NO: 9471

SEQ ID NO: 490612 - RNA, 64 nt, Human; identical to SEQ ID NO: 9472

SEQ ID NO: 490613 - RNA, 64 nt, Human; identical to SEQ ID NO: 9473

SEQ ID NO: 490614 - RNA, 64 nt, Human; identical to SEQ ID NO: 9474

SEQ ID NO: 490615 - RNA, 64 nt, Human; identical to SEQ ID NO: 9475

SEQ ID NO: 490616 - RNA, 64 nt, Human; identical to SEQ ID NO: 9476

SEQ ID NO: 490617 - RNA, 64 nt, Human; identical to SEQ ID NO: 9477

SEQ ID NO: 490618 - RNA, 64 nt, Human; identical to SEQ ID NO: 9478

SEQ ID NO: 490619 - RNA, 64 nt, Human; identical to SEQ ID NO: 9479

SEQ ID NO: 490620 - RNA, 64 nt, Human; identical to SEQ ID NO: 9480

SEQ ID NO: 490621 - RNA, 64 nt, Human; identical to SEQ ID NO: 9481

SEQ ID NO: 490622 - RNA, 64 nt, Human; identical to SEQ ID NO: 9482

SEQ ID NO: 490623 - RNA, 64 nt, Human; identical to SEQ ID NO: 9483

SEQ ID NO: 490624 - RNA, 64 nt, Human; identical to SEQ ID NO: 9484

SEQ ID NO: 490625 - RNA, 64 nt, Human; identical to SEQ ID NO: 9485

SEQ ID NO: 490626 - RNA, 64 nt, Human; identical to SEQ ID NO: 9486

SEQ ID NO: 490627 - RNA, 64 nt, Human; identical to SEQ ID NO: 9487

SEQ ID NO: 490628 - RNA, 64 nt, Human; identical to SEQ ID NO: 9488

SEQ ID NO: 490629 - RNA, 64 nt, Human; identical to SEQ ID NO: 9489

SEQ ID NO: 490630 - RNA, 64 nt, Human; identical to SEQ ID NO: 9490

SEQ ID NO: 490631 - RNA, 64 nt, Human; identical to SEQ ID NO: 9491

SEQ ID NO: 490632 - RNA, 64 nt, Human; identical to SEQ ID NO: 9492

SEQ ID NO: 490633 - RNA, 64 nt, Human; identical to SEQ ID NO: 9493

SEQ ID NO: 490634 - RNA, 64 nt, Human; identical to SEQ ID NO: 9494

SEQ ID NO: 490635 - RNA, 64 nt, Human; identical to SEQ ID NO: 9495

SEQ ID NO: 490636 - RNA, 64 nt, Human; identical to SEQ ID NO: 9496

SEQ ID NO: 490637 - RNA, 64 nt, Human; identical to SEQ ID NO: 9497

SEQ ID NO: 490638 - RNA, 64 nt, Human; identical to SEQ ID NO: 9498

SEQ ID NO: 490639 - RNA, 64 nt, Human; identical to SEQ ID NO: 9499

SEQ ID NO: 490640 - RNA, 64 nt, Human; identical to SEQ ID NO: 9500

SEQ ID NO: 490641 - RNA, 64 nt, Human; identical to SEQ ID NO: 9501

SEQ ID NO: 490642 - RNA, 64 nt, Human; identical to SEQ ID NO: 9502

SEQ ID NO: 490643 - RNA, 64 nt, Human; identical to SEQ ID NO: 9503

SEQ ID NO: 490644 - RNA, 64 nt, Human; identical to SEQ ID NO: 9504

SEQ ID NO: 490645 - RNA, 64 nt, Human; identical to SEQ ID NO: 9505

SEQ ID NO: 490646 - RNA, 64 nt, Human; identical to SEQ ID NO: 9506

SEQ ID NO: 490647 - RNA, 64 nt, Human; identical to SEQ ID NO: 9507

SEQ ID NO: 490648 - RNA, 64 nt, Human; identical to SEQ ID NO: 9508

SEQ ID NO: 490649 - RNA, 64 nt, Human; identical to SEQ ID NO: 9509

SEQ ID NO: 490650 - RNA, 64 nt, Human; identical to SEQ ID NO: 9510

SEQ ID NO: 490651 - RNA, 64 nt, Human; identical to SEQ ID NO: 9511

SEQ ID NO: 490652 - RNA, 64 nt, Human; identical to SEQ ID NO: 9512

SEQ ID NO: 490653 - RNA, 64 nt, Human; identical to SEQ ID NO: 9513

SEQ ID NO: 490654 - RNA, 64 nt, Human; identical to SEQ ID NO: 9514

SEQ ID NO: 490655 - RNA, 64 nt, Human; identical to SEQ ID NO: 9515

SEQ ID NO: 490656 - RNA, 64 nt, Human; identical to SEQ ID NO: 9516

SEQ ID NO: 490657 - RNA, 64 nt, Human; identical to SEQ ID NO: 9517

SEQ ID NO: 490658 - RNA, 64 nt, Human; identical to SEQ ID NO: 9518

SEQ ID NO: 490659 - RNA, 64 nt, Human; identical to SEQ ID NO: 9519

SEQ ID NO: 490660 - RNA, 64 nt, Human; identical to SEQ ID NO: 9520

SEQ ID NO: 490661 - RNA, 64 nt, Human; identical to SEQ ID NO: 9521

SEQ ID NO: 490662 - RNA, 64 nt, Human; identical to SEQ ID NO: 9522

SEQ ID NO: 490663 - RNA, 64 nt, Human; identical to SEQ ID NO: 9523

SEQ ID NO: 490664 - RNA, 56 nt, Human; identical to SEQ ID NO: 9524

SEQ ID NO: 490665 - RNA, 64 nt, Human; identical to SEQ ID NO: 9525

SEQ ID NO: 490666 - RNA, 64 nt, Human; identical to SEQ ID NO: 9526

SEQ ID NO: 490667 - RNA, 64 nt, Human; identical to SEQ ID NO: 9527

SEQ ID NO: 490668 - RNA, 64 nt, Human; identical to SEQ ID NO: 9528

SEQ ID NO: 490669 - RNA, 62 nt, Human; identical to SEQ ID NO: 9529

SEQ ID NO: 490670 - RNA, 64 nt, Human; identical to SEQ ID NO: 9530

SEQ ID NO: 490671 - RNA, 64 nt, Human; identical to SEQ ID NO: 9531

SEQ ID NO: 490672 - RNA, 64 nt, Human; identical to SEQ ID NO: 9532

SEQ ID NO: 490673 - RNA, 64 nt, Human; identical to SEQ ID NO: 9533

SEQ ID NO: 490674 - RNA, 64 nt, Human; identical to SEQ ID NO: 9534

SEQ ID NO: 490675 - RNA, 64 nt, Human; identical to SEQ ID NO: 9535

SEQ ID NO: 490676 - RNA, 64 nt, Human; identical to SEQ ID NO: 9536

SEQ ID NO: 490677 - RNA, 64 nt, Human; identical to SEQ ID NO: 9537

SEQ ID NO: 490678 - RNA, 64 nt, Human; identical to SEQ ID NO: 9538

SEQ ID NO: 490679 - RNA, 64 nt, Human; identical to SEQ ID NO: 9539

SEQ ID NO: 490680 - RNA, 64 nt, Human; identical to SEQ ID NO: 9540

SEQ ID NO: 490681 - RNA, 64 nt, Human; identical to SEQ ID NO: 9541

SEQ ID NO: 490682 - RNA, 64 nt, Human; identical to SEQ ID NO: 9542

SEQ ID NO: 490683 - RNA, 64 nt, Human; identical to SEQ ID NO: 9543

SEQ ID NO: 490684 - RNA, 64 nt, Human; identical to SEQ ID NO: 9544

SEQ ID NO: 490685 - RNA, 64 nt, Human; identical to SEQ ID NO: 9545

SEQ ID NO: 490686 - RNA, 64 nt, Human; identical to SEQ ID NO: 9546

SEQ ID NO: 490687 - RNA, 64 nt, Human; identical to SEQ ID NO: 9547

SEQ ID NO: 490688 - RNA, 64 nt, Human; identical to SEQ ID NO: 9548

SEQ ID NO: 490689 - RNA, 64 nt, Human; identical to SEQ ID NO: 9549

SEQ ID NO: 490690 - RNA, 64 nt, Human; identical to SEQ ID NO: 9550

SEQ ID NO: 490691 - RNA, 64 nt, Human; identical to SEQ ID NO: 9551

SEQ ID NO: 490692 - RNA, 64 nt, Human; identical to SEQ ID NO: 9552

SEQ ID NO: 490693 - RNA, 64 nt, Human; identical to SEQ ID NO: 9553

SEQ ID NO: 490694 - RNA, 64 nt, Human; identical to SEQ ID NO: 9554

SEQ ID NO: 490695 - RNA, 64 nt, Human; identical to SEQ ID NO: 9555

SEQ ID NO: 490696 - RNA, 64 nt, Human; identical to SEQ ID NO: 9556

SEQ ID NO: 490697 - RNA, 64 nt, Human; identical to SEQ ID NO: 9557

SEQ ID NO: 490698 - RNA, 64 nt, Human; identical to SEQ ID NO: 9558

SEQ ID NO: 490699 - RNA, 64 nt, Human; identical to SEQ ID NO: 9559

SEQ ID NO: 490700 - RNA, 64 nt, Human; identical to SEQ ID NO: 9560

SEQ ID NO: 490701 - RNA, 64 nt, Human; identical to SEQ ID NO: 9561

SEQ ID NO: 490702 - RNA, 64 nt, Human; identical to SEQ ID NO: 9562

SEQ ID NO: 490703 - RNA, 64 nt, Human; identical to SEQ ID NO: 9563

SEQ ID NO: 490704 - RNA, 64 nt, Human; identical to SEQ ID NO: 9564

SEQ ID NO: 490705 - RNA, 64 nt, Human; identical to SEQ ID NO: 9565

SEQ ID NO: 490706 - RNA, 55 nt, Human; identical to SEQ ID NO: 9566

SEQ ID NO: 490707 - RNA, 64 nt, Human; identical to SEQ ID NO: 9567

SEQ ID NO: 490708 - RNA, 64 nt, Human; identical to SEQ ID NO: 9568

SEQ ID NO: 490709 - RNA, 64 nt, Human; identical to SEQ ID NO: 9569

SEQ ID NO: 490710 - RNA, 64 nt, Human; identical to SEQ ID NO: 9570

SEQ ID NO: 490711 - RNA, 64 nt, Human; identical to SEQ ID NO: 9571

SEQ ID NO: 490712 - RNA, 64 nt, Human; identical to SEQ ID NO: 9572

SEQ ID NO: 490713 - RNA, 64 nt, Human; identical to SEQ ID NO: 9573

SEQ ID NO: 490714 - RNA, 64 nt, Human; identical to SEQ ID NO: 9574

SEQ ID NO: 490715 - RNA, 64 nt, Human; identical to SEQ ID NO: 9575

SEQ ID NO: 490716 - RNA, 64 nt, Human; identical to SEQ ID NO: 9576

SEQ ID NO: 490717 - RNA, 64 nt, Human; identical to SEQ ID NO: 9577

SEQ ID NO: 490718 - RNA, 64 nt, Human; identical to SEQ ID NO: 9578

SEQ ID NO: 490719 - RNA, 61 nt, Human; identical to SEQ ID NO: 9579

SEQ ID NO: 490720 - RNA, 64 nt, Human; identical to SEQ ID NO: 9580

SEQ ID NO: 490721 - RNA, 64 nt, Human; identical to SEQ ID NO: 9581

SEQ ID NO: 490722 - RNA, 64 nt, Human; identical to SEQ ID NO: 9582

SEQ ID NO: 490723 - RNA, 64 nt, Human; identical to SEQ ID NO: 9583

SEQ ID NO: 490724 - RNA, 64 nt, Human; identical to SEQ ID NO: 9584

SEQ ID NO: 490725 - RNA, 64 nt, Human; identical to SEQ ID NO: 9585

SEQ ID NO: 490726 - RNA, 64 nt, Human; identical to SEQ ID NO: 9586

SEQ ID NO: 490727 - RNA, 64 nt, Human; identical to SEQ ID NO: 9587

SEQ ID NO: 490728 - RNA, 64 nt, Human; identical to SEQ ID NO: 9588

SEQ ID NO: 490729 - RNA, 64 nt, Human; identical to SEQ ID NO: 9589

SEQ ID NO: 490730 - RNA, 64 nt, Human; identical to SEQ ID NO: 9590

SEQ ID NO: 490731 - RNA, 64 nt, Human; identical to SEQ ID NO: 9591

SEQ ID NO: 490732 - RNA, 64 nt, Human; identical to SEQ ID NO: 9592

SEQ ID NO: 490733 - RNA, 64 nt, Human; identical to SEQ ID NO: 9593

SEQ ID NO: 490734 - RNA, 64 nt, Human; identical to SEQ ID NO: 9594

SEQ ID NO: 490735 - RNA, 64 nt, Human; identical to SEQ ID NO: 9595

SEQ ID NO: 490736 - RNA, 64 nt, Human; identical to SEQ ID NO: 9596

SEQ ID NO: 490737 - RNA, 64 nt, Human; identical to SEQ ID NO: 9597

SEQ ID NO: 490738 - RNA, 64 nt, Human; identical to SEQ ID NO: 9598

SEQ ID NO: 490739 - RNA, 64 nt, Human; identical to SEQ ID NO: 9599

SEQ ID NO: 490740 - RNA, 64 nt, Human; identical to SEQ ID NO: 9600

SEQ ID NO: 490741 - RNA, 64 nt, Human; identical to SEQ ID NO: 9601

SEQ ID NO: 490742 - RNA, 64 nt, Human; identical to SEQ ID NO: 9602

SEQ ID NO: 490743 - RNA, 64 nt, Human; identical to SEQ ID NO: 9603

SEQ ID NO: 490744 - RNA, 64 nt, Human; identical to SEQ ID NO: 9604

SEQ ID NO: 490745 - RNA, 64 nt, Human; identical to SEQ ID NO: 9605

SEQ ID NO: 490746 - RNA, 64 nt, Human; identical to SEQ ID NO: 9606

SEQ ID NO: 490747 - RNA, 64 nt, Human; identical to SEQ ID NO: 9607

SEQ ID NO: 490748 - RNA, 57 nt, Human; identical to SEQ ID NO: 9608

SEQ ID NO: 490749 - RNA, 64 nt, Human; identical to SEQ ID NO: 9609

SEQ ID NO: 490750 - RNA, 64 nt, Human; identical to SEQ ID NO: 9610

SEQ ID NO: 490751 - RNA, 64 nt, Human; identical to SEQ ID NO: 9611

SEQ ID NO: 490752 - RNA, 64 nt, Human; identical to SEQ ID NO: 9612

SEQ ID NO: 490753 - RNA, 64 nt, Human; identical to SEQ ID NO: 9613

SEQ ID NO: 490754 - RNA, 64 nt, Human; identical to SEQ ID NO: 9614

SEQ ID NO: 490755 - RNA, 64 nt, Human; identical to SEQ ID NO: 9615

SEQ ID NO: 490756 - RNA, 64 nt, Human; identical to SEQ ID NO: 9616

SEQ ID NO: 490757 - RNA, 64 nt, Human; identical to SEQ ID NO: 9617

SEQ ID NO: 490758 - RNA, 64 nt, Human; identical to SEQ ID NO: 9618

SEQ ID NO: 490759 - RNA, 64 nt, Human; identical to SEQ ID NO: 9619

SEQ ID NO: 490760 - RNA, 64 nt, Human; identical to SEQ ID NO: 9620

SEQ ID NO: 490761 - RNA, 64 nt, Human; identical to SEQ ID NO: 9621

SEQ ID NO: 490762 - RNA, 64 nt, Human; identical to SEQ ID NO: 9622

SEQ ID NO: 490763 - RNA, 64 nt, Human; identical to SEQ ID NO: 9623

SEQ ID NO: 490764 - RNA, 64 nt, Human; identical to SEQ ID NO: 9624

SEQ ID NO: 490765 - RNA, 64 nt, Human; identical to SEQ ID NO: 9625

SEQ ID NO: 490766 - RNA, 64 nt, Human; identical to SEQ ID NO: 9626

SEQ ID NO: 490767 - RNA, 64 nt, Human; identical to SEQ ID NO: 9627

SEQ ID NO: 490768 - RNA, 64 nt, Human; identical to SEQ ID NO: 9628

SEQ ID NO: 490769 - RNA, 64 nt, Human; identical to SEQ ID NO: 9629

SEQ ID NO: 490770 - RNA, 64 nt, Human; identical to SEQ ID NO: 9630

SEQ ID NO: 490771 - RNA, 64 nt, Human; identical to SEQ ID NO: 9631

SEQ ID NO: 490772 - RNA, 64 nt, Human; identical to SEQ ID NO: 9632

SEQ ID NO: 490773 - RNA, 64 nt, Human; identical to SEQ ID NO: 9633

SEQ ID NO: 490774 - RNA, 64 nt, Human; identical to SEQ ID NO: 9634

SEQ ID NO: 490775 - RNA, 64 nt, Human; identical to SEQ ID NO: 9635

SEQ ID NO: 490776 - RNA, 64 nt, Human; identical to SEQ ID NO: 9636

SEQ ID NO: 490777 - RNA, 64 nt, Human; identical to SEQ ID NO: 9637

SEQ ID NO: 490778 - RNA, 64 nt, Human; identical to SEQ ID NO: 9638

SEQ ID NO: 490779 - RNA, 64 nt, Human; identical to SEQ ID NO: 9639

SEQ ID NO: 490780 - RNA, 64 nt, Human; identical to SEQ ID NO: 9640

SEQ ID NO: 490781 - RNA, 64 nt, Human; identical to SEQ ID NO: 9641

SEQ ID NO: 490782 - RNA, 64 nt, Human; identical to SEQ ID NO: 9642

SEQ ID NO: 490783 - RNA, 64 nt, Human; identical to SEQ ID NO: 9643

SEQ ID NO: 490784 - RNA, 64 nt, Human; identical to SEQ ID NO: 9644

SEQ ID NO: 490785 - RNA, 64 nt, Human; identical to SEQ ID NO: 9645

SEQ ID NO: 490786 - RNA, 64 nt, Human; identical to SEQ ID NO: 9646

SEQ ID NO: 490787 - RNA, 64 nt, Human; identical to SEQ ID NO: 9647

SEQ ID NO: 490788 - RNA, 64 nt, Human; identical to SEQ ID NO: 9648

SEQ ID NO: 490789 - RNA, 64 nt, Human; identical to SEQ ID NO: 9649

SEQ ID NO: 490790 - RNA, 64 nt, Human; identical to SEQ ID NO: 9650

SEQ ID NO: 490791 - RNA, 64 nt, Human; identical to SEQ ID NO: 9651

SEQ ID NO: 490792 - RNA, 64 nt, Human; identical to SEQ ID NO: 9652

SEQ ID NO: 490793 - RNA, 64 nt, Human; identical to SEQ ID NO: 9653

SEQ ID NO: 490794 - RNA, 64 nt, Human; identical to SEQ ID NO: 9654

SEQ ID NO: 490795 - RNA, 64 nt, Human; identical to SEQ ID NO: 9655

SEQ ID NO: 490796 - RNA, 64 nt, Human; identical to SEQ ID NO: 9656

SEQ ID NO: 490797 - RNA, 64 nt, Human; identical to SEQ ID NO: 9657

SEQ ID NO: 490798 - RNA, 64 nt, Human; identical to SEQ ID NO: 9658

SEQ ID NO: 490799 - RNA, 64 nt, Human; identical to SEQ ID NO: 9659

SEQ ID NO: 490800 - RNA, 64 nt, Human; identical to SEQ ID NO: 9660

SEQ ID NO: 490801 - RNA, 64 nt, Human; identical to SEQ ID NO: 9661

SEQ ID NO: 490802 - RNA, 64 nt, Human; identical to SEQ ID NO: 9662

SEQ ID NO: 490803 - RNA, 51 nt, Human; identical to SEQ ID NO: 9663

SEQ ID NO: 490804 - RNA, 64 nt, Human; identical to SEQ ID NO: 9664

SEQ ID NO: 490805 - RNA, 64 nt, Human; identical to SEQ ID NO: 9665

SEQ ID NO: 490806 - RNA, 64 nt, Human; identical to SEQ ID NO: 9666

SEQ ID NO: 490807 - RNA, 64 nt, Human; identical to SEQ ID NO: 9667

SEQ ID NO: 490808 - RNA, 64 nt, Human; identical to SEQ ID NO: 9668

SEQ ID NO: 490809 - RNA, 64 nt, Human; identical to SEQ ID NO: 9669

SEQ ID NO: 490810 - RNA, 64 nt, Human; identical to SEQ ID NO: 9669

SEQ ID NO: 490811 - RNA, 64 nt, Human; identical to SEQ ID NO: 9671

SEQ ID NO: 490812 - RNA, 64 nt, Human; identical to SEQ ID NO: 9672

SEQ ID NO: 490813 - RNA, 64 nt, Human; identical to SEQ ID NO: 9673

SEQ ID NO: 490814 - RNA, 64 nt, Human; identical to SEQ ID NO: 9674

SEQ ID NO: 490815 - RNA, 64 nt, Human; identical to SEQ ID NO: 9675

SEQ ID NO: 490816 - RNA, 64 nt, Human; identical to SEQ ID NO: 9676

SEQ ID NO: 490817 - RNA, 64 nt, Human; identical to SEQ ID NO: 9677

SEQ ID NO: 490818 - RNA, 64 nt, Human; identical to SEQ ID NO: 9678

SEQ ID NO: 490819 - RNA, 64 nt, Human; identical to SEQ ID NO: 9679

SEQ ID NO: 490820 - RNA, 64 nt, Human; identical to SEQ ID NO: 9680

SEQ ID NO: 490821 - RNA, 64 nt, Human; identical to SEQ ID NO: 9681

SEQ ID NO: 490822 - RNA, 64 nt, Human; identical to SEQ ID NO: 9682

SEQ ID NO: 490823 - RNA, 64 nt, Human; identical to SEQ ID NO: 9683

SEQ ID NO: 490824 - RNA, 64 nt, Human; identical to SEQ ID NO: 9684

SEQ ID NO: 490825 - RNA, 52 nt, Human; identical to SEQ ID NO: 9685

SEQ ID NO: 490826 - RNA, 64 nt, Human; identical to SEQ ID NO: 9686

SEQ ID NO: 490827 - RNA, 64 nt, Human; identical to SEQ ID NO: 9687

SEQ ID NO: 490828 - RNA, 64 nt, Human; identical to SEQ ID NO: 9688

SEQ ID NO: 490829 - RNA, 64 nt, Human; identical to SEQ ID NO: 9689

SEQ ID NO: 490830 - RNA, 64 nt, Human; identical to SEQ ID NO: 9690

SEQ ID NO: 490831 - RNA, 64 nt, Human; identical to SEQ ID NO: 9691

SEQ ID NO: 490832 - RNA, 64 nt, Human; identical to SEQ ID NO: 9692

SEQ ID NO: 490833 - RNA, 64 nt, Human; identical to SEQ ID NO: 9693

SEQ ID NO: 490834 - RNA, 64 nt, Human; identical to SEQ ID NO: 9694

SEQ ID NO: 490835 - RNA, 64 nt, Human; identical to SEQ ID NO: 9695

SEQ ID NO: 490836 - RNA, 52 nt, Human; identical to SEQ ID NO: 9696

SEQ ID NO: 490837 - RNA, 64 nt, Human; identical to SEQ ID NO: 9697

SEQ ID NO: 490838 - RNA, 64 nt, Human; identical to SEQ ID NO: 9698

SEQ ID NO: 490839 - RNA, 64 nt, Human; identical to SEQ ID NO: 9699

SEQ ID NO: 490840 - RNA, 64 nt, Human; identical to SEQ ID NO: 9700

SEQ ID NO: 490841 - RNA, 64 nt, Human; identical to SEQ ID NO: 9701

SEQ ID NO: 490842 - RNA, 59 nt, Human; identical to SEQ ID NO: 9702

SEQ ID NO: 490843 - RNA, 64 nt, Human; identical to SEQ ID NO: 9703

SEQ ID NO: 490844 - RNA, 64 nt, Human; identical to SEQ ID NO: 9704

SEQ ID NO: 490845 - RNA, 64 nt, Human; identical to SEQ ID NO: 9705

SEQ ID NO: 490846 - RNA, 64 nt, Human; identical to SEQ ID NO: 9706

SEQ ID NO: 490847 - RNA, 64 nt, Human; identical to SEQ ID NO: 9707

SEQ ID NO: 490848 - RNA, 64 nt, Human; identical to SEQ ID NO: 9708

SEQ ID NO: 490849 - RNA, 64 nt, Human; identical to SEQ ID NO: 9709

SEQ ID NO: 490850 - RNA, 64 nt, Human; identical to SEQ ID NO: 9710

SEQ ID NO: 490851 - RNA, 64 nt, Human; identical to SEQ ID NO: 9711

SEQ ID NO: 490852 - RNA, 64 nt, Human; identical to SEQ ID NO: 9712

SEQ ID NO: 490853 - RNA, 56 nt, Human; identical to SEQ ID NO: 9713

SEQ ID NO: 490854 - RNA, 64 nt, Human; identical to SEQ ID NO: 9714

SEQ ID NO: 490855 - RNA, 64 nt, Human; identical to SEQ ID NO: 9715

SEQ ID NO: 490856 - RNA, 64 nt, Human; identical to SEQ ID NO: 9716

SEQ ID NO: 490857 - RNA, 64 nt, Human; identical to SEQ ID NO: 9717

SEQ ID NO: 490858 - RNA, 64 nt, Human; identical to SEQ ID NO: 9718

SEQ ID NO: 490859 - RNA, 64 nt, Human; identical to SEQ ID NO: 9719

SEQ ID NO: 490860 - RNA, 64 nt, Human; identical to SEQ ID NO: 9720

SEQ ID NO: 490861 - RNA, 64 nt, Human; identical to SEQ ID NO: 9721

SEQ ID NO: 490862 - RNA, 64 nt, Human; identical to SEQ ID NO: 9722

SEQ ID NO: 490863 - RNA, 64 nt, Human; identical to SEQ ID NO: 9723

SEQ ID NO: 490864 - RNA, 64 nt, Human; identical to SEQ ID NO: 9724

SEQ ID NO: 490865 - RNA, 64 nt, Human; identical to SEQ ID NO: 9725

SEQ ID NO: 490866 - RNA, 64 nt, Human; identical to SEQ ID NO: 9726

SEQ ID NO: 490867 - RNA, 64 nt, Human; identical to SEQ ID NO: 9727

SEQ ID NO: 490868 - RNA, 64 nt, Human; identical to SEQ ID NO: 9728

SEQ ID NO: 490869 - RNA, 64 nt, Human; identical to SEQ ID NO: 9729

SEQ ID NO: 490870 - RNA, 64 nt, Human; identical to SEQ ID NO: 9730

SEQ ID NO: 490871 - RNA, 64 nt, Human; identical to SEQ ID NO: 9731

SEQ ID NO: 490872 - RNA, 64 nt, Human; identical to SEQ ID NO: 9732

SEQ ID NO: 490873 - RNA, 64 nt, Human; identical to SEQ ID NO: 9733

SEQ ID NO: 490874 - RNA, 64 nt, Human; identical to SEQ ID NO: 9734

SEQ ID NO: 490875 - RNA, 64 nt, Human; identical to SEQ ID NO: 9735

SEQ ID NO: 490876 - RNA, 64 nt, Human; identical to SEQ ID NO: 9736

SEQ ID NO: 490877 - RNA, 64 nt, Human; identical to SEQ ID NO: 9737

SEQ ID NO: 490878 - RNA, 52 nt, Human; identical to SEQ ID NO: 9738

SEQ ID NO: 490879 - RNA, 64 nt, Human; identical to SEQ ID NO: 9739

SEQ ID NO: 490880 - RNA, 64 nt, Human; identical to SEQ ID NO: 9740

SEQ ID NO: 490881 - RNA, 64 nt, Human; identical to SEQ ID NO: 9741

SEQ ID NO: 490882 - RNA, 64 nt, Human; identical to SEQ ID NO: 9742

SEQ ID NO: 490883 - RNA, 55 nt, Human; identical to SEQ ID NO: 9743

SEQ ID NO: 490884 - RNA, 64 nt, Human; identical to SEQ ID NO: 9744

SEQ ID NO: 490885 - RNA, 64 nt, Human; identical to SEQ ID NO: 9745

SEQ ID NO: 490886 - RNA, 63 nt, Human; identical to SEQ ID NO: 9746

SEQ ID NO: 490887 - RNA, 64 nt, Human; identical to SEQ ID NO: 9747

SEQ ID NO: 490888 - RNA, 64 nt, Human; identical to SEQ ID NO: 9748

SEQ ID NO: 490889 - RNA, 64 nt, Human; identical to SEQ ID NO: 9749

SEQ ID NO: 490890 - RNA, 64 nt, Human; identical to SEQ ID NO: 9750

SEQ ID NO: 490891 - RNA, 64 nt, Human; identical to SEQ ID NO: 9751

SEQ ID NO: 490892 - RNA, 64 nt, Human; identical to SEQ ID NO: 9752

SEQ ID NO: 490893 - RNA, 64 nt, Human; identical to SEQ ID NO: 9753

SEQ ID NO: 490894 - RNA, 64 nt, Human; identical to SEQ ID NO: 9754

SEQ ID NO: 490895 - RNA, 64 nt, Human; identical to SEQ ID NO: 9755

SEQ ID NO: 490896 - RNA, 64 nt, Human; identical to SEQ ID NO: 9756

SEQ ID NO: 490897 - RNA, 64 nt, Human; identical to SEQ ID NO: 9757

SEQ ID NO: 490898 - RNA, 64 nt, Human; identical to SEQ ID NO: 9758

SEQ ID NO: 490899 - RNA, 64 nt, Human; identical to SEQ ID NO: 9759

SEQ ID NO: 490900 - RNA, 64 nt, Human; identical to SEQ ID NO: 9760

SEQ ID NO: 490901 - RNA, 64 nt, Human; identical to SEQ ID NO: 9761

SEQ ID NO: 490902 - RNA, 64 nt, Human; identical to SEQ ID NO: 9762

SEQ ID NO: 490903 - RNA, 64 nt, Human; identical to SEQ ID NO: 9763

SEQ ID NO: 490904 - RNA, 64 nt, Human; identical to SEQ ID NO: 9764

SEQ ID NO: 490905 - RNA, 64 nt, Human; identical to SEQ ID NO: 9765

SEQ ID NO: 490906 - RNA, 64 nt, Human; identical to SEQ ID NO: 9766

SEQ ID NO: 490907 - RNA, 64 nt, Human; identical to SEQ ID NO: 9767

SEQ ID NO: 490908 - RNA, 64 nt, Human; identical to SEQ ID NO: 9768

SEQ ID NO: 490909 - RNA, 64 nt, Human; identical to SEQ ID NO: 9769

SEQ ID NO: 490910 - RNA, 64 nt, Human; identical to SEQ ID NO: 9770

SEQ ID NO: 490911 - RNA, 64 nt, Human; identical to SEQ ID NO: 9771

SEQ ID NO: 490912 - RNA, 64 nt, Human; identical to SEQ ID NO: 9772

SEQ ID NO: 490913 - RNA, 64 nt, Human; identical to SEQ ID NO: 9773

SEQ ID NO: 490914 - RNA, 64 nt, Human; identical to SEQ ID NO: 9774

SEQ ID NO: 490915 - RNA, 64 nt, Human; identical to SEQ ID NO: 9775

SEQ ID NO: 490916 - RNA, 64 nt, Human; identical to SEQ ID NO: 9776

SEQ ID NO: 490917 - RNA, 64 nt, Human; identical to SEQ ID NO: 9777

SEQ ID NO: 490918 - RNA, 64 nt, Human; identical to SEQ ID NO: 9778

SEQ ID NO: 490919 - RNA, 64 nt, Human; identical to SEQ ID NO: 9779

SEQ ID NO: 490920 - RNA, 64 nt, Human; identical to SEQ ID NO: 9780

SEQ ID NO: 490921 - RNA, 64 nt, Human; identical to SEQ ID NO: 9781

SEQ ID NO: 490922 - RNA, 64 nt, Human; identical to SEQ ID NO: 9782

SEQ ID NO: 490923 - RNA, 64 nt, Human; identical to SEQ ID NO: 9783

SEQ ID NO: 490924 - RNA, 64 nt, Human; identical to SEQ ID NO: 9784

SEQ ID NO: 490925 - RNA, 64 nt, Human; identical to SEQ ID NO: 9785

SEQ ID NO: 490926 - RNA, 64 nt, Human; identical to SEQ ID NO: 9786

SEQ ID NO: 490927 - RNA, 64 nt, Human; identical to SEQ ID NO: 9787

SEQ ID NO: 490928 - RNA, 64 nt, Human; identical to SEQ ID NO: 9788

SEQ ID NO: 490929 - RNA, 64 nt, Human; identical to SEQ ID NO: 9789

SEQ ID NO: 490930 - RNA, 64 nt, Human; identical to SEQ ID NO: 9790

SEQ ID NO: 490931 - RNA, 64 nt, Human; identical to SEQ ID NO: 9791

SEQ ID NO: 490932 - RNA, 64 nt, Human; identical to SEQ ID NO: 9792

SEQ ID NO: 490933 - RNA, 64 nt, Human; identical to SEQ ID NO: 9793

SEQ ID NO: 490934 - RNA, 64 nt, Human; identical to SEQ ID NO: 9794

SEQ ID NO: 490935 - RNA, 64 nt, Human; identical to SEQ ID NO: 9795

SEQ ID NO: 490936 - RNA, 64 nt, Human; identical to SEQ ID NO: 9796

SEQ ID NO: 490937 - RNA, 64 nt, Human; identical to SEQ ID NO: 9797

SEQ ID NO: 490938 - RNA, 64 nt, Human; identical to SEQ ID NO: 9798

SEQ ID NO: 490939 - RNA, 64 nt, Human; identical to SEQ ID NO: 9799

SEQ ID NO: 490940 - RNA, 64 nt, Human; identical to SEQ ID NO: 9800

SEQ ID NO: 490941 - RNA, 64 nt, Human; identical to SEQ ID NO: 9801

SEQ ID NO: 490942 - RNA, 64 nt, Human; identical to SEQ ID NO: 9802

SEQ ID NO: 490943 - RNA, 64 nt, Human; identical to SEQ ID NO: 9803

SEQ ID NO: 490944 - RNA, 64 nt, Human; identical to SEQ ID NO: 9804

SEQ ID NO: 490945 - RNA, 64 nt, Human; identical to SEQ ID NO: 9805

SEQ ID NO: 490946 - RNA, 64 nt, Human; identical to SEQ ID NO: 9806

SEQ ID NO: 490947 - RNA, 64 nt, Human; identical to SEQ ID NO: 9807

SEQ ID NO: 490948 - RNA, 64 nt, Human; identical to SEQ ID NO: 9808

SEQ ID NO: 490949 - RNA, 64 nt, Human; identical to SEQ ID NO: 9809

SEQ ID NO: 490950 - RNA, 64 nt, Human; identical to SEQ ID NO: 9810

SEQ ID NO: 490951 - RNA, 50 nt, Human; identical to SEQ ID NO: 9811

SEQ ID NO: 490952 - RNA, 64 nt, Human; identical to SEQ ID NO: 9812

SEQ ID NO: 490953 - RNA, 64 nt, Human; identical to SEQ ID NO: 9813

SEQ ID NO: 490954 - RNA, 64 nt, Human; identical to SEQ ID NO: 9814

SEQ ID NO: 490955 - RNA, 64 nt, Human; identical to SEQ ID NO: 9815

SEQ ID NO: 490956 - RNA, 64 nt, Human; identical to SEQ ID NO: 9816

SEQ ID NO: 490957 - RNA, 64 nt, Human; identical to SEQ ID NO: 9817

SEQ ID NO: 490958 - RNA, 64 nt, Human; identical to SEQ ID NO: 9818

SEQ ID NO: 490959 - RNA, 64 nt, Human; identical to SEQ ID NO: 9819

SEQ ID NO: 490960 - RNA, 64 nt, Human; identical to SEQ ID NO: 9820

SEQ ID NO: 490961 - RNA, 64 nt, Human; identical to SEQ ID NO: 9821

SEQ ID NO: 490962 - RNA, 64 nt, Human; identical to SEQ ID NO: 9822

SEQ ID NO: 490963 - RNA, 64 nt, Human; identical to SEQ ID NO: 9823

SEQ ID NO: 490964 - RNA, 64 nt, Human; identical to SEQ ID NO: 9824

SEQ ID NO: 490965 - RNA, 64 nt, Human; identical to SEQ ID NO: 9825

SEQ ID NO: 490966 - RNA, 64 nt, Human; identical to SEQ ID NO: 9826

SEQ ID NO: 490967 - RNA, 64 nt, Human; identical to SEQ ID NO: 9827

SEQ ID NO: 490968 - RNA, 64 nt, Human; identical to SEQ ID NO: 9828

SEQ ID NO: 490969 - RNA, 64 nt, Human; identical to SEQ ID NO: 9829

SEQ ID NO: 490970 - RNA, 64 nt, Human; identical to SEQ ID NO: 9830

SEQ ID NO: 490971 - RNA, 64 nt, Human; identical to SEQ ID NO: 9831

SEQ ID NO: 490972 - RNA, 64 nt, Human; identical to SEQ ID NO: 9832

SEQ ID NO: 490973 - RNA, 64 nt, Human; identical to SEQ ID NO: 9833

SEQ ID NO: 490974 - RNA, 64 nt, Human; identical to SEQ ID NO: 9834

SEQ ID NO: 490975 - RNA, 64 nt, Human; identical to SEQ ID NO: 9835

SEQ ID NO: 490976 - RNA, 64 nt, Human; identical to SEQ ID NO: 9836

SEQ ID NO: 490977 - RNA, 64 nt, Human; identical to SEQ ID NO: 9837

SEQ ID NO: 490978 - RNA, 64 nt, Human; identical to SEQ ID NO: 9838

SEQ ID NO: 490979 - RNA, 64 nt, Human; identical to SEQ ID NO: 9839

SEQ ID NO: 490980 - RNA, 64 nt, Human; identical to SEQ ID NO: 9840

SEQ ID NO: 490981 - RNA, 64 nt, Human; identical to SEQ ID NO: 9841

SEQ ID NO: 490982 - RNA, 64 nt, Human; identical to SEQ ID NO: 9842

SEQ ID NO: 490983 - RNA, 64 nt, Human; identical to SEQ ID NO: 9843

SEQ ID NO: 490984 - RNA, 64 nt, Human; identical to SEQ ID NO: 9844

SEQ ID NO: 490985 - RNA, 64 nt, Human; identical to SEQ ID NO: 9845

SEQ ID NO: 490986 - RNA, 64 nt, Human; identical to SEQ ID NO: 9846

SEQ ID NO: 490987 - RNA, 64 nt, Human; identical to SEQ ID NO: 9847

SEQ ID NO: 490988 - RNA, 64 nt, Human; identical to SEQ ID NO: 9848

SEQ ID NO: 490989 - RNA, 64 nt, Human; identical to SEQ ID NO: 9849

SEQ ID NO: 490990 - RNA, 64 nt, Human; identical to SEQ ID NO: 9850

SEQ ID NO: 490991 - RNA, 64 nt, Human; identical to SEQ ID NO: 9851

SEQ ID NO: 490992 - RNA, 64 nt, Human; identical to SEQ ID NO: 9852

SEQ ID NO: 490993 - RNA, 64 nt, Human; identical to SEQ ID NO: 9853

SEQ ID NO: 490994 - RNA, 64 nt, Human; identical to SEQ ID NO: 9854

SEQ ID NO: 490995 - RNA, 64 nt, Human; identical to SEQ ID NO: 9855

SEQ ID NO: 490996 - RNA, 64 nt, Human; identical to SEQ ID NO: 9856

SEQ ID NO: 490997 - RNA, 64 nt, Human; identical to SEQ ID NO: 9857

SEQ ID NO: 490998 - RNA, 64 nt, Human; identical to SEQ ID NO: 9858

SEQ ID NO: 490999 - RNA, 64 nt, Human; identical to SEQ ID NO: 9859

SEQ ID NO: 491000 - RNA, 64 nt, Human; identical to SEQ ID NO: 9860

SEQ ID NO: 491001 - RNA, 64 nt, Human; identical to SEQ ID NO: 9861

SEQ ID NO: 491002 - RNA, 64 nt, Human; identical to SEQ ID NO: 9862

SEQ ID NO: 491003 - RNA, 64 nt, Human; identical to SEQ ID NO: 9863

SEQ ID NO: 491004 - RNA, 64 nt, Human; identical to SEQ ID NO: 9864

SEQ ID NO: 491005 - RNA, 64 nt, Human; identical to SEQ ID NO: 9865

SEQ ID NO: 491006 - RNA, 64 nt, Human; identical to SEQ ID NO: 9866

SEQ ID NO: 491007 - RNA, 64 nt, Human; identical to SEQ ID NO: 9867

SEQ ID NO: 491008 - RNA, 64 nt, Human; identical to SEQ ID NO: 9868

SEQ ID NO: 491009 - RNA, 64 nt, Human; identical to SEQ ID NO: 9869

SEQ ID NO: 491010 - RNA, 64 nt, Human; identical to SEQ ID NO: 9870

SEQ ID NO: 491011 - RNA, 64 nt, Human; identical to SEQ ID NO: 9871

SEQ ID NO: 491012 - RNA, 64 nt, Human; identical to SEQ ID NO: 9872

SEQ ID NO: 491013 - RNA, 64 nt, Human; identical to SEQ ID NO: 9873

SEQ ID NO: 491014 - RNA, 64 nt, Human; identical to SEQ ID NO: 9874

SEQ ID NO: 491015 - RNA, 64 nt, Human; identical to SEQ ID NO: 9875

SEQ ID NO: 491016 - RNA, 64 nt, Human; identical to SEQ ID NO: 9876

SEQ ID NO: 491017 - RNA, 64 nt, Human; identical to SEQ ID NO: 9877

SEQ ID NO: 491018 - RNA, 64 nt, Human; identical to SEQ ID NO: 9878

SEQ ID NO: 491019 - RNA, 64 nt, Human; identical to SEQ ID NO: 9879

SEQ ID NO: 491020 - RNA, 64 nt, Human; identical to SEQ ID NO: 9880

SEQ ID NO: 491021 - RNA, 64 nt, Human; identical to SEQ ID NO: 9881

SEQ ID NO: 491022 - RNA, 64 nt, Human; identical to SEQ ID NO: 9882

SEQ ID NO: 491023 - RNA, 64 nt, Human; identical to SEQ ID NO: 9883

SEQ ID NO: 491024 - RNA, 64 nt, Human; identical to SEQ ID NO: 9884

SEQ ID NO: 491025 - RNA, 64 nt, Human; identical to SEQ ID NO: 9885

SEQ ID NO: 491026 - RNA, 64 nt, Human; identical to SEQ ID NO: 9886

SEQ ID NO: 491027 - RNA, 64 nt, Human; identical to SEQ ID NO: 9887

SEQ ID NO: 491028 - RNA, 64 nt, Human; identical to SEQ ID NO: 9888

SEQ ID NO: 491029 - RNA, 64 nt, Human; identical to SEQ ID NO: 9889

SEQ ID NO: 491030 - RNA, 64 nt, Human; identical to SEQ ID NO: 9890

SEQ ID NO: 491031 - RNA, 64 nt, Human; identical to SEQ ID NO: 9891

SEQ ID NO: 491032 - RNA, 64 nt, Human; identical to SEQ ID NO: 9892

SEQ ID NO: 491033 - RNA, 64 nt, Human; identical to SEQ ID NO: 9893

SEQ ID NO: 491034 - RNA, 64 nt, Human; identical to SEQ ID NO: 9894

SEQ ID NO: 491035 - RNA, 64 nt, Human; identical to SEQ ID NO: 9895

SEQ ID NO: 491036 - RNA, 64 nt, Human; identical to SEQ ID NO: 9896

SEQ ID NO: 491037 - RNA, 64 nt, Human; identical to SEQ ID NO: 9897

SEQ ID NO: 491038 - RNA, 64 nt, Human; identical to SEQ ID NO: 9898

SEQ ID NO: 491039 - RNA, 64 nt, Human; identical to SEQ ID NO: 9899

SEQ ID NO: 491040 - RNA, 64 nt, Human; identical to SEQ ID NO: 9900

SEQ ID NO: 491041 - RNA, 64 nt, Human; identical to SEQ ID NO: 9901

SEQ ID NO: 491042 - RNA, 64 nt, Human; identical to SEQ ID NO: 9902

SEQ ID NO: 491043 - RNA, 64 nt, Human; identical to SEQ ID NO: 9903

SEQ ID NO: 491044 - RNA, 64 nt, Human; identical to SEQ ID NO: 9904

SEQ ID NO: 491045 - RNA, 64 nt, Human; identical to SEQ ID NO: 9905

SEQ ID NO: 491046 - RNA, 64 nt, Human; identical to SEQ ID NO: 9906

SEQ ID NO: 491047 - RNA, 55 nt, Human; identical to SEQ ID NO: 9907

SEQ ID NO: 491048 - RNA, 64 nt, Human; identical to SEQ ID NO: 9908

SEQ ID NO: 491049 - RNA, 64 nt, Human; identical to SEQ ID NO: 9909

SEQ ID NO: 491050 - RNA, 64 nt, Human; identical to SEQ ID NO: 9910

SEQ ID NO: 491051 - RNA, 64 nt, Human; identical to SEQ ID NO: 9911

SEQ ID NO: 491052 - RNA, 64 nt, Human; identical to SEQ ID NO: 9912

SEQ ID NO: 491053 - RNA, 64 nt, Human; identical to SEQ ID NO: 9913

SEQ ID NO: 491054 - RNA, 64 nt, Human; identical to SEQ ID NO: 9914

SEQ ID NO: 491055 - RNA, 64 nt, Human; identical to SEQ ID NO: 9915

SEQ ID NO: 491056 - RNA, 64 nt, Human; identical to SEQ ID NO: 9916

SEQ ID NO: 491057 - RNA, 64 nt, Human; identical to SEQ ID NO: 9917

SEQ ID NO: 491058 - RNA, 64 nt, Human; identical to SEQ ID NO: 9918

SEQ ID NO: 491059 - RNA, 64 nt, Human; identical to SEQ ID NO: 9919

SEQ ID NO: 491060 - RNA, 64 nt, Human; identical to SEQ ID NO: 9920

SEQ ID NO: 491061 - RNA, 64 nt, Human; identical to SEQ ID NO: 9921

SEQ ID NO: 491062 - RNA, 64 nt, Human; identical to SEQ ID NO: 9922

SEQ ID NO: 491063 - RNA, 64 nt, Human; identical to SEQ ID NO: 9923

SEQ ID NO: 491064 - RNA, 64 nt, Human; identical to SEQ ID NO: 9924

SEQ ID NO: 491065 - RNA, 64 nt, Human; identical to SEQ ID NO: 9925

SEQ ID NO: 491066 - RNA, 64 nt, Human; identical to SEQ ID NO: 9926

SEQ ID NO: 491067 - RNA, 64 nt, Human; identical to SEQ ID NO: 9927

SEQ ID NO: 491068 - RNA, 64 nt, Human; identical to SEQ ID NO: 9928

SEQ ID NO: 491069 - RNA, 64 nt, Human; identical to SEQ ID NO: 9929

SEQ ID NO: 491070 - RNA, 64 nt, Human; identical to SEQ ID NO: 9930

SEQ ID NO: 491071 - RNA, 64 nt, Human; identical to SEQ ID NO: 9931

SEQ ID NO: 491072 - RNA, 64 nt, Human; identical to SEQ ID NO: 9932

SEQ ID NO: 491073 - RNA, 64 nt, Human; identical to SEQ ID NO: 9933

SEQ ID NO: 491074 - RNA, 64 nt, Human; identical to SEQ ID NO: 9934

SEQ ID NO: 491075 - RNA, 64 nt, Human; identical to SEQ ID NO: 9935

SEQ ID NO: 491076 - RNA, 64 nt, Human; identical to SEQ ID NO: 9936

SEQ ID NO: 491077 - RNA, 64 nt, Human; identical to SEQ ID NO: 9937

SEQ ID NO: 491078 - RNA, 62 nt, Human
agccaugaucugcaggggucugggagucaggcccggccuauugcuugggucucucuccauuu

SEQ ID NO: 491079 - RNA, 62 nt, Human
guugcagugagcugagauggcaccacugcacuccggccuaggcaacgagagcaaaacuccaa

SEQ ID NO: 491080 - RNA, 62 nt, Human
ggacucugcaggucaaggauaugugaugagcaccggccuaaguguuugcucuucagauuccu

SEQ ID NO: 491081 - RNA, 62 nt, Human
uagaaagucuccugcgggagcggaaaugcaguccggccuagggcucccagcccuugacuguc

SEQ ID NO: 491082 - RNA, 62 nt, Human
uccugcauaaccccauuaggaguagauggugcccggccuaucugucagggaggcaaaaaagg

SEQ ID NO: 491083 - RNA, 62 nt, Human
agugcuggaauuacaggccugagccaccccacccggccuauuuucuuaaaggggaacaaaug

SEQ ID NO: 491084 - RNA, 62 nt, Human
uuaaaggaauccuuuuguaugacuuguccagaccggccuauugcccuacccguuugauucuc

SEQ ID NO: 491085 - RNA, 62 nt, Human
uggugacuuaaggagcugcgaagucugauuuaccggccuacucucgaccugccccccacccc

SEQ ID NO: 491086 - RNA, 62 nt, Human
agccuuucuuuccccucugaugcacguuccucccggccuaguccguggaggcccaucacacc

SEQ ID NO: 491087 - RNA, 62 nt, Human
agugcugggauuacaggcgugagccaccgcgcccggccuauuccauauuuuuuuaaugggac

SEQ ID NO: 491088 - RNA, 62 nt, Human
agugcugggauuacaggugugagcuaccgcgcccggccuauuaucuuguacuuucuaacuga

SEQ ID NO: 491089 - RNA, 62 nt, Human
acaguaaauauauuguguuugcugacaaucagccggccuauaaaucuccuuauuuuauuucu

SEQ ID NO: 491090 - RNA, 62 nt, Human
aaaagcugcacucaccaaggaccacaaugcccccggccuaaaguacugccauucagaaaagc

SEQ ID NO: 491091 - RNA, 62 nt, Human
gagcauucgguagcguauucagacugcaugggccggccuaggagucuuugccuucauaaauu

SEQ ID NO: 491092 - RNA, 62 nt, Human
aagccaagcccgggacccucgugugagccagcccggccuaaucugaccgccucaacgccauu

SEQ ID NO: 491093 - RNA, 62 nt, Human
cgggccggccucgggccacccacgagggccucccggccuagggcccgaccgcgccggacgcg

SEQ ID NO: 491094 - RNA, 62 nt, Human
agugagcggagacugcaccacugcauuccagcccggccuacaagaacaaaacuccaucucaa

SEQ ID NO: 491095 - RNA, 62 nt, Human
gggguuaaacauucucacucagguaugcugugccggccuacagguugugaauguguuuuuau

SEQ ID NO: 491096 - RNA, 62 nt, Human
aguacugggauuacaggccugagccaccgcgcccggccuauuuuucacuuuaauuuggcagc

SEQ ID NO: 491097 - RNA, 62 nt, Human
agggaccuugaccuucuggugccugccccuccccggccuaugugccauccgcgugacgcuag

SEQ ID NO: 491098 - RNA, 62 nt, Human
agugcugggauuacaggcgugagccaccgugcccggccuacaaauguuaacaaagcaauuac

SEQ ID NO: 491099 - RNA, 62 nt, Human
ccugcagaguuuggaagaagucaccagcaaagccggccuaaccaagaaaagucaaggcccuu

SEQ ID NO: 491100 - RNA, 62 nt, Human
guugaccagaaaggacacuccauauugugaaaccggccuaauuuuucugacugauauggaaa

SEQ ID NO: 491101 - RNA, 62 nt, Human
uucccuccaaucaucacugugcuccuuuuuucccggccuacgaggcagcuccugccacuauc

SEQ ID NO: 491102 - RNA, 62 nt, Human
cggcacaaagcggagggaggcuguggucgcugccggccuaggugucccaggugccccgccuu

SEQ ID NO: 491103 - RNA, 62 nt, Human
agugcugggauuacaggcaugagccacugugcccggccuaugauucuuuuuuuuuuuuuuuu

SEQ ID NO: 491104 - RNA, 62 nt, Human
accccagccaacaccaaggccacaaggggaccccggccuaggaggcaggaagccaaggugca

SEQ ID NO: 491105 - RNA, 62 nt, Human
agccccuucuggccggugcuggguucccacucccggccuaggcaccuccccgcucucccugu

SEQ ID NO: 491106 - RNA, 62 nt, Human
ucaaucacgacguuaaccggcucgagagagcgccggccuagaggcucauuaucuauuuauuu

SEQ ID NO: 491107 - RNA, 62 nt, Human
gaaauaacuggaacccagccucuccuccuacaccggccuacccaucugggcccaagagcugc

SEQ ID NO: 491108 - RNA, 62 nt, Human
gugccccuguaggagguagguccuuuucuccuccggccuaguaggggaccuuggguaacauc

SEQ ID NO: 491109 - RNA, 62 nt, Human
uguggcauggcucagucuggcccccuugauuaccggccuagccccugcucacaucacagcug

SEQ ID NO: 491110 - RNA, 62 nt, Human
guugcagugagcugagaucaugccacugcacuccggccuaggugacagagggaaacuccauc

SEQ ID NO: 491111 - RNA, 62 nt, Human
agugcugggauuacaggcgugagccacugcgcccggccuauuuccccaccuuucguguaagg

SEQ ID NO: 491112 - RNA, 62 nt, Human
aaugugggaaucagaaaaaccuguucccaucaccggccuagccuagaauccuagccuagaag

SEQ ID NO: 491113 - RNA, 62 nt, Human
ggcccggcccucccgcccccgaccugaccacgccggccuaggguuccagacugguuggacuu

SEQ ID NO: 491114 - RNA, 62 nt, Human
agugcugggauuacaggcaugagcuacugcacccggccuaaccaggcuggagugcaguggug

SEQ ID NO: 491115 - RNA, 62 nt, Human
ccucgcccuacauugaguacacgccggccagcccggccuacgcccaguacccaccggccacc

SEQ ID NO: 491116 - RNA, 62 nt, Human
agugcuaggauuacaggcaugagccaccaugcccggccuaaacuuuguuuuuaaaaugaacu

SEQ ID NO: 491117 - RNA, 62 nt, Human
cugcugccaggcccucuccccacugccccaaaccggccuagacacgaagaccaaagcagccu

SEQ ID NO: 491118 - RNA, 62 nt, Human
uuccuucgccagaggccugcggucucccacuuccggccuagucugccagcuuuugcuggcac

SEQ ID NO: 491119 - RNA, 62 nt, Human
uugccaguccugcuuuuccuggcaggcauuugccggccuaugugcuuuaaccuuaagcugau

SEQ ID NO: 491120 - RNA, 62 nt, Human
uucgaaguuacaggacuaaaagagcaaacugaccggccuaaaacuaaaaugacauuuauucc

SEQ ID NO: 491121 - RNA, 62 nt, Human
agugcugggaugacaggcgugagccaccgcgcccggccuauaccucauuuucuacaugucgc

SEQ ID NO: 491122 - RNA, 64 nt, Human; identical to SEQ ID NO: 12017

SEQ ID NO: 491123 - RNA, 64 nt, Human; identical to SEQ ID NO: 12018

SEQ ID NO: 491124 - RNA, 64 nt, Human; identical to SEQ ID NO: 12019

SEQ ID NO: 491125 - RNA, 64 nt, Human; identical to SEQ ID NO: 12020

SEQ ID NO: 491126 - RNA, 56 nt, Human; identical to SEQ ID NO: 12021

SEQ ID NO: 491127 - RNA, 64 nt, Human; identical to SEQ ID NO: 12022

SEQ ID NO: 491128 - RNA, 64 nt, Human; identical to SEQ ID NO: 12023

SEQ ID NO: 491129 - RNA, 64 nt, Human; identical to SEQ ID NO: 12024

SEQ ID NO: 491130 - RNA, 64 nt, Human; identical to SEQ ID NO: 12025

SEQ ID NO: 491131 - RNA, 64 nt, Human; identical to SEQ ID NO: 12026

SEQ ID NO: 491132 - RNA, 64 nt, Human; identical to SEQ ID NO: 12027

SEQ ID NO: 491133 - RNA, 52 nt, Human; identical to SEQ ID NO: 12028

SEQ ID NO: 491134 - RNA, 64 nt, Human; identical to SEQ ID NO: 12029

SEQ ID NO: 491135 - RNA, 51 nt, Human; identical to SEQ ID NO: 12030

SEQ ID NO: 491136 - RNA, 64 nt, Human; identical to SEQ ID NO: 12031

SEQ ID NO: 491137 - RNA, 64 nt, Human; identical to SEQ ID NO: 12032

SEQ ID NO: 491138 - RNA, 64 nt, Human; identical to SEQ ID NO: 12033

SEQ ID NO: 491139 - RNA, 64 nt, Human; identical to SEQ ID NO: 12034

SEQ ID NO: 491140 - RNA, 64 nt, Human; identical to SEQ ID NO: 12035

SEQ ID NO: 491141 - RNA, 64 nt, Human; identical to SEQ ID NO: 12036

SEQ ID NO: 491142 - RNA, 64 nt, Human; identical to SEQ ID NO: 12037

SEQ ID NO: 491143 - RNA, 64 nt, Human; identical to SEQ ID NO: 12038

SEQ ID NO: 491144 - RNA, 64 nt, Human; identical to SEQ ID NO: 12039

SEQ ID NO: 491145 - RNA, 64 nt, Human; identical to SEQ ID NO: 12040

SEQ ID NO: 491146 - RNA, 64 nt, Human; identical to SEQ ID NO: 12041

SEQ ID NO: 491147 - RNA, 64 nt, Human; identical to SEQ ID NO: 12042

SEQ ID NO: 491148 - RNA, 64 nt, Human; identical to SEQ ID NO: 12043

SEQ ID NO: 491149 - RNA, 64 nt, Human; identical to SEQ ID NO: 12044

SEQ ID NO: 491150 - RNA, 64 nt, Human; identical to SEQ ID NO: 12045

SEQ ID NO: 491151 - RNA, 64 nt, Human; identical to SEQ ID NO: 12046

SEQ ID NO: 491152 - RNA, 64 nt, Human; identical to SEQ ID NO: 12047

SEQ ID NO: 491153 - RNA, 64 nt, Human; identical to SEQ ID NO: 12048

SEQ ID NO: 491154 - RNA, 64 nt, Human; identical to SEQ ID NO: 12049

SEQ ID NO: 491155 - RNA, 64 nt, Human; identical to SEQ ID NO: 12050

SEQ ID NO: 491156 - RNA, 64 nt, Human; identical to SEQ ID NO: 12051

SEQ ID NO: 491157 - RNA, 64 nt, Human; identical to SEQ ID NO: 12052

SEQ ID NO: 491158 - RNA, 64 nt, Human; identical to SEQ ID NO: 12053

SEQ ID NO: 491159 - RNA, 63 nt, Human
ucugggacacucagcgggaagggggcuggcaucgccagcgacccacacauuccucacguagcu

SEQ ID NO: 491160 - RNA, 63 nt, Human
uaaacuuccccucuaccagccuccaagccccacgccagcgagcaggcugccugcccaccccgu

SEQ ID NO: 491161 - RNA, 63 nt, Human
ccgaguccaggagccccagccagcccuucccaggccagcgaggcgaggcugccucugggugag

SEQ ID NO: 491162 - RNA, 63 nt, Human
acuucaguuuucggccagcgcgucgagggaggggccagcgacacauggccuaguaaccguccg

SEQ ID NO: 491163 - RNA, 63 nt, Human
gucucaugcccccucugcauuuuguccuggagugccagcgagugugcacccccaguuuccuuc

SEQ ID NO: 491164 - RNA, 63 nt, Human
cagcuacugaagggacccaaggcacccccugaagccagcgauagagggucccucucugcuccc

SEQ ID NO: 491165 - RNA, 63 nt, Human
cagacguaaccccugccccaccucagcccggcagccagcgagguacaccagguggugcuugga

SEQ ID NO: 491166 - RNA, 63 nt, Human
uaguauagcguaucgcaaggguuugacacggcugccagcgacucuaggcuuccagucuguguu

SEQ ID NO: 491167 - RNA, 63 nt, Human
aacguucagugaaagaaauuucaacccuucauagccagcgaagaaauuugccuuggaagccaa

SEQ ID NO: 491168 - RNA, 63 nt, Human
uaggaauaacacugcagcccucuccacccuccggccagcgaguggucaaggauuuuuauaaaa

SEQ ID NO: 491169 - RNA, 63 nt, Human
cgcaugcggcacccagcggcugcuucccugcaagccagcgacuugccgagcagaaugagcucu

SEQ ID NO: 491170 - RNA, 63 nt, Human
ccaaggaaaagaaacuaucucggucacgugagcgccagcgaaaagaaacuguaucagucaucc

SEQ ID NO: 491171 - RNA, 63 nt, Human
ccccucccgagaagagaagccacagaugagugggccagcgaggccagucuucaauguccacua

SEQ ID NO: 491172 - RNA, 63 nt, Human
aauaauacaaaaauaguaaaggucuugaagaaugccagcgaagcaauucuuuuuuauuugagg

SEQ ID NO: 491173 - RNA, 63 nt, Human
uucaccacccagccgcuggaggaagccuucucugccagcgaucucgcagcacuguguuuacag

SEQ ID NO: 491174 - RNA, 63 nt, Human
gaguuuaugauggaaccuuaaauauauaauguugccagcgauuuuaguucaauauuuguuacu

SEQ ID NO: 491175 - RNA, 63 nt, Human
uuugugcucccagggacuauuuucuccucguaagccagcgaccugccuaaagcuugggcugug

SEQ ID NO: 491176 - RNA, 63 nt, Human
auaccuggcucaggaaugcugucagaccagccagccagcgagcucuaggcaaaaggacaugga

SEQ ID NO: 491177 - RNA, 63 nt, Human
ucacucagcagugggacagcaaccuguagaguggccagcgagggcgugucuagcuugauguug

SEQ ID NO: 491178 - RNA, 63 nt, Human
cccuggugggcuguucagcuuccugcugcuggggccagcgauuuuugaggauuuaucuuuagg

SEQ ID NO: 491179 - RNA, 63 nt, Human
acuucuguauuaugcacgugaagccuucccggagccagcgagcauaugcugcaugaggaccuu

SEQ ID NO: 491180 - RNA, 63 nt, Human
ccggaaaagcagcccagucagaugugggaacgugccagcgagggagagaccuuuccacugcag

SEQ ID NO: 491181 - RNA, 52 nt, Human; identical to SEQ ID NO: 467012

SEQ ID NO: 491182 - RNA, 63 nt, Human
ccguccgcuggaaaaacguuucgaagcacaguggccagcgagcgagcacguggcuacucccug

SEQ ID NO: 491183 - RNA, 63 nt, Human
aaccugagccauccccaguucuuagccaguugagccagcgacaacagcaccagagccaggcag

SEQ ID NO: 491184 - RNA, 63 nt, Human
cucacccuggccccuugggcuggacccuccaaugccagcgacucccaggagcccuugggggac

SEQ ID NO: 491185 - RNA, 63 nt, Human
gggguugcaacaauaauucaucaaguaaucauggccagcgauuauugaucaaaaucaaaaggu

SEQ ID NO: 491186 - RNA, 63 nt, Human
uucaguccccaggagcaggagcugcugcucacggccagcgacgacgccaccaucaaagccugg

SEQ ID NO: 491187 - RNA, 63 nt, Human
agagcagcuugccgaggaccccgcgugaagaaagccagcgaggggggcuucugcucccugaga

SEQ ID NO: 491188 - RNA, 63 nt, Human
ucucucuuguccaauggggcuuggagcaccgaggccagcgaagccaucgcgcuccuugcggag

SEQ ID NO: 491189 - RNA, 63 nt, Human
auauuauaccaguugcuucugcagcccgcagaugccagcgaugccaggaaacaaguugaaauc

SEQ ID NO: 491190 - RNA, 63 nt, Human
gaucuucuaccagcguagaguugacagaagcaggccagcgaggaggugugggacauaauagcc

SEQ ID NO: 491191 - RNA, 63 nt, Human
gggaaggaggccacauuccugucugcagcagccgccagcgauggucuucagcaauaaaaguug

SEQ ID NO: 491192 - RNA, 63 nt, Human
cuccugauggugucauucugccugcuccaucgcgccagcgaccucucugccucucuucuuccc

SEQ ID NO: 491193 - RNA, 63 nt, Human
uuauucugggggcugcaguucgacucugugcuggccagcgagcgcccagcuccugacacugcu

SEQ ID NO: 491194 - RNA, 63 nt, Human
ccacggugggagucagccaagauuuaaagggaugccagcgauugcucuuuucaaaaccuacca

SEQ ID NO: 491195 - RNA, 63 nt, Human
aggagcccacuaugcagaggccaaaggucggcagccagcgaggcuaugaauuggaccuuuuug

SEQ ID NO: 491196 - RNA, 63 nt, Human
gggggcaugcuggccucugagcgaucaggcgaggccagcgagggugugcuugcaaauucaagc

SEQ ID NO: 491197 - RNA, 63 nt, Human
cccagccugcagcugacugaggaccacgagugagccagcgagggggcgggagaccucagccgc

SEQ ID NO: 491198 - RNA, 63 nt, Human
aaccacaccauccugcaguacuaucgcugcauggccagcgagcuuguccgugucaacaucacc

SEQ ID NO: 491199 - RNA, 63 nt, Human
augagaccaggucccugcucugaggagacgugugccagcgaaguuucucucccacgugagugu

SEQ ID NO: 491200 - RNA, 63 nt, Human
ggccugaguauucauguaacauucuaaaauugugccagcgagcaccgugaacgacugcaaugc

SEQ ID NO: 491201 - RNA, 63 nt, Human
ccagugagguugguccgaggcugugugcccucugccagcgaccccgaagcagauaucucagug

SEQ ID NO: 491202 - RNA, 63 nt, Human
ggcgcaggaccgcuggaggacgcagcguccagggccagcgagcucccccggcagcaggucccc

SEQ ID NO: 491203 - RNA, 63 nt, Human
cucccggagcagcauuccagagccuccugcagagccagcgaaggaaagcucuagagggagacg

SEQ ID NO: 491204 - RNA, 63 nt, Human
gugcccauccccaucucuaaaaccaguaaaucagccagcgaauacccggaagcaagaugcaca

SEQ ID NO: 491205 - RNA, 63 nt, Human
cugcaaggaaauagaugcugaggcagucuuccugccagcgagcccacuguaucugggcccaag

SEQ ID NO: 491206 - RNA, 63 nt, Human
uuauguccguuaauuugauaauuaugaaaucuagccagcgauuucaaaauuuuaaucuccaac

SEQ ID NO: 491207 - RNA, 63 nt, Human
gguuugguuccugaccuaggcuugggaagacaagccagcgaauaaaggaugguugaacgugaa

SEQ ID NO: 491208 - RNA, 63 nt, Human
aagggagcagaacugaaccggcuuuaccaaaccgccagcgaacuugacaauuguauugcgaug

SEQ ID NO: 491209 - RNA, 63 nt, Human
cccaagggcacuuaaagugaccugucauuccgagccagcgaaccccagcaguaggaauccgua

SEQ ID NO: 491210 - RNA, 63 nt, Human
acucuguaauuuguugagguucucaaacugacagccagcgagacugggugggaggcccuggau

SEQ ID NO: 491211 - RNA, 63 nt, Human
cugcugggccccccgaucagaccucaaggacaggccagcgagagauggagcuaccguguccag

SEQ ID NO: 491212 - RNA, 63 nt, Human
ggccacaagaggaagcugaaugaagaggacgccgccagcgaguccagcagggaguccagcaac

SEQ ID NO: 491213 - RNA, 63 nt, Human
gaggcaauuugguuaccugcaauggcugcuuuugccagcgaggccaccauucauuggucaucu

SEQ ID NO: 491214 - RNA, 63 nt, Human
gguucuccucgaguccuuggggacguggcagaugccagcgaccaucagacaacguggaggccc

SEQ ID NO: 491215 - RNA, 63 nt, Human
uuggcacuacccaccccgugugacagaauaggagccagcgacucaggacugcucacgggucag

SEQ ID NO: 491216 - RNA, 63 nt, Human
gaggggagaaccccauccucagagcugcucccagccagcgagucaggagcgggggagacaggg

SEQ ID NO: 491217 - RNA, 63 nt, Human
ucuccuggacgaucgcgggucgcagaagcccaggccagcgagcccuacagagugaggacacug

SEQ ID NO: 491218 - RNA, 63 nt, Human
caaggggccggggaggugggcgugugugugcgugccagcgaaggcugcugugggcgugugugu

SEQ ID NO: 491219 - RNA, 63 nt, Human
cgggggcgugugcucugcgggacaguccccacggccagcgacguccaggucaccaaugggauu

SEQ ID NO: 491220 - RNA, 63 nt, Human
caguauggcauccccuccccaggaucucgggcugccagcgaugggcaggcgagaccccuccag

SEQ ID NO: 491221 - RNA, 63 nt, Human
gccccucggccgccgacuggacgcgcgggccuugccagcgagcacccucaucgggcugucgcc

SEQ ID NO: 491222 - RNA, 63 nt, Human
cugccgggagggccacgcaggucguggucaccugccagcgacugucucagacugggcagggag

SEQ ID NO: 491223 - RNA, 63 nt, Human
aggcagagccucgaaaauaggcagaccguuugagccagcgaccucaccucuaggaacugagcc

SEQ ID NO: 491224 - RNA, 63 nt, Human
acguugucuuugaccagugguccccaguaccaggccagcgaagacaacuuuauaaugucauuu

SEQ ID NO: 491225 - RNA, 63 nt, Human
gagagcucugacuccuauggugaccucucagaugccagcgaccugaagacgccagagaagcag

SEQ ID NO: 491226 - RNA, 63 nt, Human
uaagcucuugcuaacuugaaaaaucccuguucugccagcgaagcuuccuccuccucuccagcu

SEQ ID NO: 491227 - RNA, 63 nt, Human
uuuuccaaaagaaaaacuaguugcagucagggagccagcgaaaagacaaaaaaaaaaaaaaaa

SEQ ID NO: 491228 - RNA, 63 nt, Human
gucuaaauccugcuuagccuaaacauaucuauagccagcgaugggcaaauuauauuugcuguc

SEQ ID NO: 491229 - RNA, 63 nt, Human
gcauguggauauguuuagcuacguuuacucacagccagcgaacugacauuaaaauaacuaaca

SEQ ID NO: 491230 - RNA, 64 nt, Human; identical to SEQ ID NO: 12017

SEQ ID NO: 491231 - RNA, 64 nt, Human; identical to SEQ ID NO: 12018

SEQ ID NO: 491232 - RNA, 64 nt, Human; identical to SEQ ID NO: 12019

SEQ ID NO: 491233 - RNA, 64 nt, Human; identical to SEQ ID NO: 12020

SEQ ID NO: 491234 - RNA, 56 nt, Human; identical to SEQ ID NO: 12021

SEQ ID NO: 491235 - RNA, 64 nt, Human; identical to SEQ ID NO: 12022

SEQ ID NO: 491236 - RNA, 64 nt, Human; identical to SEQ ID NO: 12023

SEQ ID NO: 491237 - RNA, 64 nt, Human; identical to SEQ ID NO: 12024

SEQ ID NO: 491238 - RNA, 64 nt, Human; identical to SEQ ID NO: 12025

SEQ ID NO: 491239 - RNA, 64 nt, Human; identical to SEQ ID NO: 12026

SEQ ID NO: 491240 - RNA, 64 nt, Human; identical to SEQ ID NO: 12027

SEQ ID NO: 491241 - RNA, 52 nt, Human; identical to SEQ ID NO: 12028

SEQ ID NO: 491242 - RNA, 64 nt, Human; identical to SEQ ID NO: 12029

SEQ ID NO: 491243 - RNA, 51 nt, Human; identical to SEQ ID NO: 12030

SEQ ID NO: 491244 - RNA, 64 nt, Human; identical to SEQ ID NO: 12031

SEQ ID NO: 491245 - RNA, 64 nt, Human; identical to SEQ ID NO: 12032

SEQ ID NO: 491246 - RNA, 64 nt, Human; identical to SEQ ID NO: 12033

SEQ ID NO: 491247 - RNA, 64 nt, Human; identical to SEQ ID NO: 12034

SEQ ID NO: 491248 - RNA, 64 nt, Human; identical to SEQ ID NO: 12035

SEQ ID NO: 491249 - RNA, 64 nt, Human; identical to SEQ ID NO: 12036

SEQ ID NO: 491250 - RNA, 64 nt, Human; identical to SEQ ID NO: 12037

SEQ ID NO: 491251 - RNA, 64 nt, Human; identical to SEQ ID NO: 12038

SEQ ID NO: 491252 - RNA, 64 nt, Human; identical to SEQ ID NO: 12039

SEQ ID NO: 491253 - RNA, 64 nt, Human; identical to SEQ ID NO: 12040

SEQ ID NO: 491254 - RNA, 64 nt, Human; identical to SEQ ID NO: 12041

SEQ ID NO: 491255 - RNA, 64 nt, Human; identical to SEQ ID NO: 12042

SEQ ID NO: 491256 - RNA, 64 nt, Human; identical to SEQ ID NO: 12043

SEQ ID NO: 491257 - RNA, 64 nt, Human; identical to SEQ ID NO: 12044

SEQ ID NO: 491258 - RNA, 64 nt, Human; identical to SEQ ID NO: 12045

SEQ ID NO: 491259 - RNA, 64 nt, Human; identical to SEQ ID NO: 12046

SEQ ID NO: 491260 - RNA, 64 nt, Human; identical to SEQ ID NO: 12047

SEQ ID NO: 491261 - RNA, 64 nt, Human; identical to SEQ ID NO: 12048

SEQ ID NO: 491262 - RNA, 64 nt, Human; identical to SEQ ID NO: 12049

SEQ ID NO: 491263 - RNA, 64 nt, Human; identical to SEQ ID NO: 12050

SEQ ID NO: 491264 - RNA, 64 nt, Human; identical to SEQ ID NO: 12051

SEQ ID NO: 491265 - RNA, 64 nt, Human; identical to SEQ ID NO: 12052

SEQ ID NO: 491266 - RNA, 64 nt, Human; identical to SEQ ID NO: 12053

SEQ ID NO: 491267 - RNA, 63 nt, Human; identical to SEQ ID NO: 491159

SEQ ID NO: 491268 - RNA, 63 nt, Human; identical to SEQ ID NO: 491160

SEQ ID NO: 491269 - RNA, 63 nt, Human; identical to SEQ ID NO: 491161

SEQ ID NO: 491270 - RNA, 63 nt, Human; identical to SEQ ID NO: 491162

SEQ ID NO: 491271 - RNA, 63 nt, Human; identical to SEQ ID NO: 491163

SEQ ID NO: 491272 - RNA, 63 nt, Human; identical to SEQ ID NO: 491164

SEQ ID NO: 491273 - RNA, 63 nt, Human; identical to SEQ ID NO: 491165

SEQ ID NO: 491274 - RNA, 63 nt, Human; identical to SEQ ID NO: 491166

SEQ ID NO: 491275 - RNA, 63 nt, Human; identical to SEQ ID NO: 491167

SEQ ID NO: 491276 - RNA, 63 nt, Human; identical to SEQ ID NO: 491168

SEQ ID NO: 491277 - RNA, 63 nt, Human; identical to SEQ ID NO: 491169

SEQ ID NO: 491278 - RNA, 63 nt, Human; identical to SEQ ID NO: 491170

SEQ ID NO: 491279 - RNA, 63 nt, Human; identical to SEQ ID NO: 491171

SEQ ID NO: 491280 - RNA, 63 nt, Human; identical to SEQ ID NO: 491172

SEQ ID NO: 491281 - RNA, 63 nt, Human; identical to SEQ ID NO: 491173

SEQ ID NO: 491282 - RNA, 63 nt, Human; identical to SEQ ID NO: 491174

SEQ ID NO: 491283 - RNA, 63 nt, Human; identical to SEQ ID NO: 491175

SEQ ID NO: 491284 - RNA, 63 nt, Human; identical to SEQ ID NO: 491176

SEQ ID NO: 491285 - RNA, 63 nt, Human; identical to SEQ ID NO: 491177

SEQ ID NO: 491286 - RNA, 63 nt, Human; identical to SEQ ID NO: 491178

SEQ ID NO: 491287 - RNA, 63 nt, Human; identical to SEQ ID NO: 491179

SEQ ID NO: 491288 - RNA, 63 nt, Human; identical to SEQ ID NO: 491180

SEQ ID NO: 491289 - RNA, 52 nt, Human; identical to SEQ ID NO: 467012

SEQ ID NO: 491290 - RNA, 63 nt, Human; identical to SEQ ID NO: 491182

SEQ ID NO: 491291 - RNA, 63 nt, Human; identical to SEQ ID NO: 491183

SEQ ID NO: 491292 - RNA, 63 nt, Human; identical to SEQ ID NO: 491184

SEQ ID NO: 491293 - RNA, 63 nt, Human; identical to SEQ ID NO: 491185

SEQ ID NO: 491294 - RNA, 63 nt, Human; identical to SEQ ID NO: 491186

SEQ ID NO: 491295 - RNA, 63 nt, Human; identical to SEQ ID NO: 491187

SEQ ID NO: 491296 - RNA, 63 nt, Human; identical to SEQ ID NO: 491188

SEQ ID NO: 491297 - RNA, 63 nt, Human; identical to SEQ ID NO: 491189

SEQ ID NO: 491298 - RNA, 63 nt, Human; identical to SEQ ID NO: 491190

SEQ ID NO: 491299 - RNA, 63 nt, Human; identical to SEQ ID NO: 491191

SEQ ID NO: 491300 - RNA, 63 nt, Human; identical to SEQ ID NO: 491192

SEQ ID NO: 491301 - RNA, 63 nt, Human; identical to SEQ ID NO: 491193

SEQ ID NO: 491302 - RNA, 63 nt, Human; identical to SEQ ID NO: 491194

SEQ ID NO: 491303 - RNA, 63 nt, Human; identical to SEQ ID NO: 491195

SEQ ID NO: 491304 - RNA, 63 nt, Human; identical to SEQ ID NO: 491196

SEQ ID NO: 491305 - RNA, 63 nt, Human; identical to SEQ ID NO: 491197

SEQ ID NO: 491306 - RNA, 63 nt, Human; identical to SEQ ID NO: 491198

SEQ ID NO: 491307 - RNA, 63 nt, Human; identical to SEQ ID NO: 491199

SEQ ID NO: 491308 - RNA, 63 nt, Human; identical to SEQ ID NO: 491200

SEQ ID NO: 491309 - RNA, 63 nt, Human; identical to SEQ ID NO: 491201

SEQ ID NO: 491310 - RNA, 63 nt, Human; identical to SEQ ID NO: 491202

SEQ ID NO: 491311 - RNA, 63 nt, Human; identical to SEQ ID NO: 491203

SEQ ID NO: 491312 - RNA, 63 nt, Human; identical to SEQ ID NO: 491204

SEQ ID NO: 491313 - RNA, 63 nt, Human; identical to SEQ ID NO: 491205

SEQ ID NO: 491314 - RNA, 63 nt, Human; identical to SEQ ID NO: 491206

SEQ ID NO: 491315 - RNA, 63 nt, Human; identical to SEQ ID NO: 491207

SEQ ID NO: 491316 - RNA, 63 nt, Human; identical to SEQ ID NO: 491208

SEQ ID NO: 491317 - RNA, 63 nt, Human; identical to SEQ ID NO: 491209

SEQ ID NO: 491318 - RNA, 63 nt, Human; identical to SEQ ID NO: 491210

SEQ ID NO: 491319 - RNA, 63 nt, Human; identical to SEQ ID NO: 491211

SEQ ID NO: 491320 - RNA, 63 nt, Human; identical to SEQ ID NO: 491212

SEQ ID NO: 491321 - RNA, 63 nt, Human; identical to SEQ ID NO: 491213

SEQ ID NO: 491322 - RNA, 63 nt, Human; identical to SEQ ID NO: 491214

SEQ ID NO: 491323 - RNA, 63 nt, Human; identical to SEQ ID NO: 491215

SEQ ID NO: 491324 - RNA, 63 nt, Human; identical to SEQ ID NO: 491216

SEQ ID NO: 491325 - RNA, 63 nt, Human; identical to SEQ ID NO: 491217

SEQ ID NO: 491326 - RNA, 63 nt, Human; identical to SEQ ID NO: 491218

SEQ ID NO: 491327 - RNA, 63 nt, Human; identical to SEQ ID NO: 491219

SEQ ID NO: 491328 - RNA, 63 nt, Human; identical to SEQ ID NO: 491220

SEQ ID NO: 491329 - RNA, 63 nt, Human; identical to SEQ ID NO: 491221

SEQ ID NO: 491330 - RNA, 63 nt, Human; identical to SEQ ID NO: 491222

SEQ ID NO: 491331 - RNA, 63 nt, Human; identical to SEQ ID NO: 491223

SEQ ID NO: 491332 - RNA, 63 nt, Human; identical to SEQ ID NO: 491224

SEQ ID NO: 491333 - RNA, 63 nt, Human; identical to SEQ ID NO: 491225

SEQ ID NO: 491334 - RNA, 63 nt, Human; identical to SEQ ID NO: 491226

SEQ ID NO: 491335 - RNA, 63 nt, Human; identical to SEQ ID NO: 491227

SEQ ID NO: 491336 - RNA, 63 nt, Human; identical to SEQ ID NO: 491228

SEQ ID NO: 491337 - RNA, 63 nt, Human; identical to SEQ ID NO: 491229

SEQ ID NO: 491338 - RNA, 64 nt, Human
ugccaccuaaacgaucaguguggugcugcguucuggccaguaaauuccauguuuuuggcuauau

SEQ ID NO: 491339 - RNA, 64 nt, Human
uucuagaccuuagacacucaagauuacggucccgggccaguaacagcaccugggagcuugguag

SEQ ID NO: 491340 - RNA, 64 nt, Human
ggagaacuaaguaagaaacacaaugccaacagcuggccaguaauuaguguugugcacuucaugu

SEQ ID NO: 491341 - RNA, 64 nt, Human
uauuuauuuauugagaguuuuuuagugcaaucugggccaguauuuuuauagauuaugauuaugu

SEQ ID NO: 491342 - RNA, 64 nt, Human
ggaaaaguuuggcuacuaacaguagcauugugauggccaguauauccaguccauggauaaagaa

SEQ ID NO: 491343 - RNA, 64 nt, Human
aaugucagaacagagugcaacccagucacacuguggccaguaaaauacuauugccucauauugu

SEQ ID NO: 491344 - RNA, 64 nt, Human
agccacaaacaaguacuuuaccccacagcuuaguggccaguaaacacccuggggacuaggaaaa

SEQ ID NO: 491345 - RNA, 64 nt, Human
cagcugucuugguaaaggagagagagagacauggggccaguaauuccggggugcucagaaguuu

SEQ ID NO: 491346 - RNA, 64 nt, Human
agucccaaggguccacgauguacaaagucauuucggccaguaggugugcagaccccuccccgcc

SEQ ID NO: 491347 - RNA, 64 nt, Human
ccuuccucacuguaucuuugcccagacccaccugggccaguaggccccuguccccagccacaca

SEQ ID NO: 491348 - RNA, 64 nt, Human
agcccagcccugaccucaggaagugucagagcauggccaguaguuggcagcccgaaagacacac

SEQ ID NO: 491349 - RNA, 64 nt, Human
uugccacccccugugagcagggauuagguguucaggccaguaucuugggcaugggggagccuuu

SEQ ID NO: 491350 - RNA, 64 nt, Human
aaagacuuaauuuccuuguugagaacaggaaaguggccaguagccaggcaagucauagaauuga

SEQ ID NO: 491351 - RNA, 64 nt, Human
ccagcuuuuuuuuuuuuuuuuuuaaauuggcuuuggccaguagcuaaagugcaagacugaauua

SEQ ID NO: 491352 - RNA, 64 nt, Human
acaaaguuugccaaccauaagugucaaaagcacaggccaguauuaagcagaaguucuaccaccu

SEQ ID NO: 491353 - RNA, 64 nt, Human
guauacauccuggguaaugagagguggcuuuugcggccaguauuagacuggaaguucauaccua

SEQ ID NO: 491354 - RNA, 64 nt, Human
ugcaggggcagagaaggaagggaccaggggacugggccaguauguggaggauggggccugcgug

SEQ ID NO: 491355 - RNA, 64 nt, Human
aauaucuguuuuuaauguuuuguuucucccuccaggccaguauaaagggacuugaaguauuuuu

SEQ ID NO: 491356 - RNA, 64 nt, Human
uguauaauuuuuaugcucuuugauuaucuaauaaggccaguauuucaaaagcuguucugaauuu

SEQ ID NO: 491357 - RNA, 64 nt, Human
uauagagcuagcuaaucucuacaaacccucuguaggccaguaguucucaaaguguggucucugg

SEQ ID NO: 491358 - RNA, 64 nt, Human
uugcuagccucucuuacuaauggaauuauauacuggccaguaaaaugggccucccaauugcugu

SEQ ID NO: 491359 - RNA, 64 nt, Human
caugaagugcucucguucucaguagcggcaucauggccaguagugucuuugaggaguucaccac

SEQ ID NO: 491360 - RNA, 64 nt, Human
gauuauugauugugagauagguuagguuuuggggggccaguaguucagugagaauguuuauguu

SEQ ID NO: 491361 - RNA, 64 nt, Human
cuuucucucucccucuuucucucucucuuucguaggccaguagcaauguuguguucacagucua

SEQ ID NO: 491362 - RNA, 64 nt, Human
gccuucccuuggagagggccuggcuucaacauugggccaguaggcaucuuagcuuggcaggugu

SEQ ID NO: 491363 - RNA, 64 nt, Human
ucucugcacgcuugaccaaagcagugaugagggcggccaguaccugcggugugcgugguagguu

SEQ ID NO: 491364 - RNA, 64 nt, Human
ccguacuaacgucugcaaaccccaagacguuugaggccaguaggaaguugagaaagaaagccac

SEQ ID NO: 491365 - RNA, 64 nt, Human
cucucuuucucugguggucuuccuucuaccccaaggccaguaguuuugacacuucccaguggaa

SEQ ID NO: 491366 - RNA, 64 nt, Human
ccccuaaacccaacucacguuucuguaugucuuaggccaguaucccaaaccucuuccacgucac

SEQ ID NO: 491367 - RNA, 64 nt, Human
auguggcucaguggagggagacccagcauagccaggccaguauggagcaccucacgcacagcuc

SEQ ID NO: 491368 - RNA, 64 nt, Human
uuggugaaauugcuguggggguaucgggggauauggccaguaaaguauugagagacuaacaaau

SEQ ID NO: 491369 - RNA, 64 nt, Human
gguugguugccccucaccucagagcucccccaaaggccaguaauggauccccggccucaguccc

SEQ ID NO: 491370 - RNA, 64 nt, Human
cggugcaggcauagcugccugcugcucuggcagaggccaguaaauacaguuccuagaagcagcc

SEQ ID NO: 491371 - RNA, 64 nt, Human
uccauaugaccucaugcaucuccaccugcucccaggccaguaagggaaauagaaaaacccugcc

SEQ ID NO: 491372 - RNA, 64 nt, Human
aggucucauacaaggauauuuggagugaaaugcuggccaguacuuguucucccuugccccaacc

SEQ ID NO: 491373 - RNA, 64 nt, Human
uucuuucaauccucauuaucuuuagcccucagcuggccaguacuuauugcuaaagaaagggaga

SEQ ID NO: 491374 - RNA, 64 nt, Human
uuuagccuccuucgcaggcauguccuggacaccgggccaguaucuauauauguguauguacguu

SEQ ID NO: 491375 - RNA, 64 nt, Human
agugcugggauuacaggugugagccaccacacuuggccaguauauccucaguaugaagauauuu

SEQ ID NO: 491376 - RNA, 64 nt, Human
augucugcaucugugcuguguguguagugugguuggccaguaggugaguaucccugugugugug

SEQ ID NO: 491377 - RNA, 64 nt, Human
gugugaguguuuauauagaaaugaacauagaccuggccaguaaaaggcucugaggaggcuuaaa

SEQ ID NO: 491378 - RNA, 64 nt, Human
ggagugcagggaggggcaggaaaggagacaaggaggccaguauggacacuguguccaguauggc

SEQ ID NO: 491379 - RNA, 64 nt, Human
acaguuccccacccagcgauuagggagcugggcuggccaguacagccaguggggaguggguggg

SEQ ID NO: 491380 - RNA, 64 nt, Human
cuucacacagaaaucuguagcacugcuuuuuugaggccaguagcaacauccagagaucauucuu

SEQ ID NO: 491381 - RNA, 64 nt, Human
uauuuggggcaucucuauagaaagugaccaccaaggccaguaaguacgggaaaaaauguuuacu

SEQ ID NO: 491382 - RNA, 64 nt, Human
acucucucaugacugcacaccccauucaggcagaggccaguacagaggaggagccauuguggca

SEQ ID NO: 491383 - RNA, 64 nt, Human
gccuuacccucuguaagauacugauucuuccuggggccaguauuaccuuguaugcaaauauuac

SEQ ID NO: 491384 - RNA, 64 nt, Human
agaaagucacauuuaggguuuauuuuuuacacuuggccaguaaaauaggguaaauccuauuaga

SEQ ID NO: 491385 - RNA, 64 nt, Human
cauuauguacagaauaggaccuauccaguagccaggccaguaggcaguuggggaaggugggaag

SEQ ID NO: 491386 - RNA, 64 nt, Human
ugcuuuauaagugaggguagggugagggaggacaggccaguagggggagggaaagggagagggg

SEQ ID NO: 491387 - RNA, 64 nt, Human
ggccccaggggguuagaggaggggugaagauuggggccaguaucgaucuuaugaagcuggagga

SEQ ID NO: 491388 - RNA, 64 nt, Human
aaguuucugaagucuucacagcucuuaaaagccaggccaguacugacuguguggugguaaaugc

SEQ ID NO: 491389 - RNA, 64 nt, Human
ugugcuuuggguugaaaagaaguuuuuaguccuaggccaguagauggcagcagcuuuucauugc

SEQ ID NO: 491390 - RNA, 64 nt, Human
uaacuguaucuugaggugguaguaaaacacagagggccaguaacgggucguaaugacuuauugu

SEQ ID NO: 491391 - RNA, 64 nt, Human
gcuuuauucuuccaaguucauucauacucaaagaggccaguacuuugccauccuugcacuucug

SEQ ID NO: 491392 - RNA, 64 nt, Human
ugaauuuauagagcauuuuuuuucuuaccaagauggccaguaucauuuuacccccaccucccaa

SEQ ID NO: 491393 - RNA, 64 nt, Human
cugauauuuaauccuuaaaaccccuuuaaaugagggccaguauuaucucugcuuucagaaguag

SEQ ID NO: 491394 - RNA, 64 nt, Human
acaaauuuaauaacuuuaugggugagguacuuugggccaguagaguauacuacaguuauguuua

SEQ ID NO: 491395 - RNA, 64 nt, Human
uuuuauuuaauacaaucggauuuaauaauuuuguggccaguaaaauuauaccauuggcaugaag

SEQ ID NO: 491396 - RNA, 64 nt, Human
ggggaacgucaggucucucugaggucaggucugaggccaguauccuccagcccucccaaugcca

SEQ ID NO: 491397 - RNA, 64 nt, Human
aagcagagauaacacuucccaacucauuuugugaggccaguauuacccuaauagcaaaaccagg

SEQ ID NO: 491398 - RNA, 64 nt, Human
aaaaaagauggaacuuuuccaauucaguuuuugaggccaguacaaccuugauaacaaaaccuaa

SEQ ID NO: 491399 - RNA, 64 nt, Human
ccaggccucuuggcagucacaucucuuccuccgaggccaguaccuuuccauuuauucuuugauc

SEQ ID NO: 491400 - RNA, 64 nt, Human
uguccuggcaggaagccaccauuggagaaggugaggccaguaaccaucucaugggauucgcuau

SEQ ID NO: 491401 - RNA, 64 nt, Human
ugggguacaaaggggcccaugcaggagaugcccuggccaguaggaccuccaacagguuguuucc

SEQ ID NO: 491402 - RNA, 64 nt, Human
uacucuaaauacuaccggagucucuuuguagguuggccaguauauguuuuuagugaaauauuau

SEQ ID NO: 491403 - RNA, 64 nt, Human
uaaaaaguauauuuauugcagaggauguucauaaggccaguaugauuuauaaaugcaaucuccc

SEQ ID NO: 491404 - RNA, 64 nt, Human
ggcuaucauuagccacagguacugcugauuauaaggccaguaaaauuuuaguaccuggagguuu

SEQ ID NO: 491405 - RNA, 64 nt, Human
gugcugugggcuggucccacacauccaggaaagaggccaguagagaauucugcccacuuuuuau

SEQ ID NO: 491406 - RNA, 64 nt, Human
ccucuaccugaacaaagagaugaauaauuccaugggccaguaugccaguuugaauucucagucu

SEQ ID NO: 491407 - RNA, 64 nt, Human
uggcuaauaggaauucccuccuggugccaccacuggccaguaccuuuccuaagucuuugcucaa

SEQ ID NO: 491408 - RNA, 52 nt, Human
ucuuucaggcaaagcacuaaagggccaguaccagugaguggccccaccugug

SEQ ID NO: 491409 - RNA, 64 nt, Human
uaugacauaauuuaugucuccauuuuguuguauuggccaguacuuuuacaaaucaaaacaucuc

SEQ ID NO: 491410 - RNA, 64 nt, Human
aucugagucuagaacccaggcuucuaaauuucuaggccaguacuacugcucucaaaagagauua

SEQ ID NO: 491411 - RNA, 64 nt, Human
uguaccaagugaauuuaaauaauugguguggauuggccaguagcuaagaagugggcuuuuaaag

SEQ ID NO: 491412 - RNA, 64 nt, Human
uccccccaaccacaggaauggaggcgggacacagggccaguaggagcaauaggauuuuaauaaa

SEQ ID NO: 491413 - RNA, 64 nt, Human
aaucauauuuguauuucagguucuuuuuuaucuuggccaguauauuaugacuaaacgauuauau

SEQ ID NO: 491414 - RNA, 64 nt, Human
gucauugucugaccaaaauuccuucugcacaugaggccaguauaggcaacgucacauuuguuug

SEQ ID NO: 491415 - RNA, 64 nt, Human
ugcccacugccuaccgcgugagccgcagcccuggggccaguaggaagcggacccgcuccaggua

SEQ ID NO: 491416 - RNA, 64 nt, Human
uguucuuccuacauaaaaugcaagaaaacagcauggccaguaaacugagcaagggccuuggaau

SEQ ID NO: 491417 - RNA, 64 nt, Human
aaacacucuguacugugugcggacccgcagugacggccaguaaaguggacuuaacucccaagug

SEQ ID NO: 491418 - RNA, 64 nt, Human
aaugcauuacaacucuguagauuguuaguuacuaggccaguagcuaggaauugguauaaauuua

SEQ ID NO: 491419 - RNA, 64 nt, Human
guucagagggagccagcucuuuauguuggccccaggccaguacuaagcaaauuaaaaagaccga

SEQ ID NO: 491420 - RNA, 64 nt, Human
aauuauggauaacucgaaagacagcucaggugaaggccaguaaugauuuuuuugaaguuucaau

SEQ ID NO: 491421 - RNA, 64 nt, Human
uagcacagcacuuugguuuugcugagaucgaagaggccaguaggagacacgacagcacacacag

SEQ ID NO: 491422 - RNA, 64 nt, Human
cccguucuuauagaugauuuuguagaauaugcacggccaguagucacagguggaaaacgcagcc

SEQ ID NO: 491423 - RNA, 64 nt, Human
auccaggccugaggcugcugacguuugacaccagggccaguagagagugcccuuuuguaucuua

SEQ ID NO: 491424 - RNA, 64 nt, Human
ggauguuuaaucuucauuaauaaauaccucaaauggccaguaacucaauauuacuuuucuuccu

SEQ ID NO: 491425 - RNA, 64 nt, Human
uagugcuuugucuauucuuuauuucucucaggguggccaguauuuugacuuauuuauccugcuu

SEQ ID NO: 491426 - RNA, 64 nt, Human
uuuggucuaacuucuacauuccuacuguuaaaaaggccaguauaucuuaaacaaaugaauaggc

SEQ ID NO: 491427 - RNA, 64 nt, Human
uuaagcacugaauucacuacugaucccaucgccuggccaguagaacagucauuacuccauuaac

SEQ ID NO: 491428 - RNA, 64 nt, Human
gcacugggcccauuugaaggugucucagacauuuggccaguaugucuuucucagggguuugguc

SEQ ID NO: 491429 - RNA, 64 nt, Human
caguuuuauaagguauuugcauuuuagaagcucuggccaguaguuguuaagauguuggcauuaa

SEQ ID NO: 491430 - RNA, 64 nt, Human
caagcauucccuuggugaauugucacgugaguggggccaguaagagugaagucugcuccuugaa

SEQ ID NO: 491431 - RNA, 64 nt, Human
gcuagauaaauguggugaaauugccacuagaaagggccaguagcaauguguucuuaauuccuag

SEQ ID NO: 491432 - RNA, 64 nt, Human
ugcuuggcaccuuagcagacugcuggaaccuuuuggccaguaggucgugcccgccuggugccuu

SEQ ID NO: 491433 - RNA, 64 nt, Human
cuauugggacaguccucuucuauauguuuuaaguggccaguaauuuaaugaauuucugguuugu

SEQ ID NO: 491434 - RNA, 64 nt, Human
uccagguucguauagaaaaagcacagcucucacuggccaguagcugccaaaaagaacacccauc

SEQ ID NO: 491435 - RNA, 64 nt, Human
cugagaggcaguggccucuugagugaacaggggaggccaguagaugccccagauccagagccgu

SEQ ID NO: 491436 - RNA, 64 nt, Human
ucugguuacccaacuacagaaccuccuuugaucaggccaguagguugugaugcaggcuggagcc

SEQ ID NO: 491437 - RNA, 64 nt, Human
ccucccauagggcuuuuccaagcugccacuggucggccaguacagccuccggaagcagcccuac

SEQ ID NO: 491438 - RNA, 64 nt, Human
cggaucaugaagucaagaguucgagaccagcaauggccaguauggugaaacccugucucuccua

SEQ ID NO: 491439 - RNA, 64 nt, Human
cagccucuagcuacccuguaucgaggcaaggggaggccaguaaaguuugccaagccugauccug

SEQ ID NO: 491440 - RNA, 64 nt, Human
caauguaacuaagcauuuguguucugauaucugaggccaguaacuauuaauaucuaguucucag

SEQ ID NO: 491441 - RNA, 64 nt, Human
uuaauaauguuuauaagcugggcauggucgcucaggccaguaaucccagugacuuaggaggcug

SEQ ID NO: 491442 - RNA, 64 nt, Human
acggccuggcagaggagcccaagggacugaagauggccaguagcuggguccugaggccccugaa

SEQ ID NO: 491443 - RNA, 64 nt, Human
ucugaccucagggcucccagcucggggccuguggggccaguaugcuggucugggagucccuccu

SEQ ID NO: 491444 - RNA, 64 nt, Human
cugagaaaccuggcagccugcuguuaacaacacaggccaguauuggguuuuauugaauuuggua

SEQ ID NO: 491445 - RNA, 64 nt, Human
guggauuguauugugagauccugugauuccugguggccaguauccuggauuccucuaagaucuu

SEQ ID NO: 491446 - RNA, 64 nt, Human
aauagaagcagaaaaacauuuagggauaacaucaggccaguagaauuaagccucuccaccuguc

SEQ ID NO: 491447 - RNA, 64 nt, Human
ccacccccaaaguaagaagaaacauguuuccaguggccaguaugucuuucauugcuuugcaccc

SEQ ID NO: 491448 - RNA, 64 nt, Human
uauuaacugccaaaacaagagccugauuuuuugaggccaguaauucguuugcuagaauugauuu

SEQ ID NO: 491449 - RNA, 64 nt, Human
acuaaugggauccagcagggccauuucuccagagggccaguauccuauuaggagacucuuggaa

SEQ ID NO: 491450 - RNA, 64 nt, Human
ccagaagcgaugggguaccguguaggggagccaaggccaguaguuuggggguaggaguccccua

SEQ ID NO: 491451 - RNA, 64 nt, Human
aagacaccaccuuccugccagcuguuugcccuuaggccaguacacagaauuaaagugggggaga

SEQ ID NO: 491452 - RNA, 64 nt, Human
caguguaacuaagcauuuguguucugauaucugaggccaguaacuauuaauaucuaguucucag

SEQ ID NO: 491453 - RNA, 64 nt, Human
cauccacuuucuucuaaaauaaagagaagaaaauggccaguauucauccuguccuucucuuucc

SEQ ID NO: 491454 - RNA, 64 nt, Human
caauguaacuaaguauuuguguucugauaucugaggccaguaacuauuaauaucuaguucucag

SEQ ID NO: 491455 - RNA, 64 nt, Human
aaagcugcggucuccuguuugauaaaagaauauuggccaguauugcagauuuuaacugauuugg

SEQ ID NO: 491456 - RNA, 64 nt, Human
gccuuucacguauuccgucugcacaggcaaccaaggccaguagaaagcuauggcugcaaaaccc

SEQ ID NO: 491457 - RNA, 64 nt, Human
aaaaaauuggauaaaguauaggaggguuacuuggggccaguaaaucaguagacugaacauucaa

SEQ ID NO: 491458 - RNA, 64 nt, Human
cccccugcuggucgcuguuucggggacucggggcggccaguaccaccgccugaggcggggcuca

SEQ ID NO: 491459 - RNA, 64 nt, Human
gggcugcaaugcagcauguugcccuggcaccuguggccaguacucgggacagacuaagggcgcu

SEQ ID NO: 491460 - RNA, 64 nt, Human
ucuguguuggccccugugccucagucccgcggauggccaguagggggcgcuggaggacugcggg

SEQ ID NO: 491461 - RNA, 64 nt, Human
cuuaauccuauuuauccccuggaaugugcgugcuggccaguaggagggcuggcuuuggcagcuc

SEQ ID NO: 491462 - RNA, 64 nt, Human
caaagagccccccgggucacccccgccccacugaggccaguagggggccaggccucccacuccu

SEQ ID NO: 491463 - RNA, 64 nt, Human
aacuacuaguuauuugugauagcaacauacacauggccaguaaugcucuuguccaggaagaucu

SEQ ID NO: 491464 - RNA, 64 nt, Human
ugauugaguucaucaugagccguugcuaaugccaggccaguaaaaguauaacagcaaauaacca

SEQ ID NO: 491465 - RNA, 64 nt, Human
cucgccagaggagcacuuggcaaggucagugaggggccaguagacccccggagaagcaguaccg

SEQ ID NO: 491466 - RNA, 64 nt, Human
accaucagggaagcuuguuguaacggcuuuugaaggccaguaaccauuguugugguuguguuuu

SEQ ID NO: 491467 - RNA, 64 nt, Human
cuuuugcuuguacagaaucuguagugauuuugguggccaguaaaugccagccauuucucaaacc

SEQ ID NO: 491468 - RNA, 64 nt, Human
aaaaaaugaagucugacuagaauucuauugcagaggccaguacauuuaguauggcauugaguug

SEQ ID NO: 491469 - RNA, 64 nt, Human
ucaguuuacuucuaaguaaucacagauaauacauggccaguaaucccaggcuggccauucauuc

SEQ ID NO: 491470 - RNA, 64 nt, Human
ccuugcagcuagcaagguugugugacuaagcccuggccaguaggcauggaagugaagacuguaa

SEQ ID NO: 491471 - RNA, 64 nt, Human
aucacuguguccacaugagcgaaccccagcacguggccaguaucaucagcuccuucuuacagug

SEQ ID NO: 491472 - RNA, 64 nt, Human
uuuaguggggaaagggacggggugcagacggcagggccaguauggggcccccucccucuccucu

SEQ ID NO: 491473 - RNA, 64 nt, Human
acuacuuaaguacuugucauguacucuuagaggaggccaguaaugaucagaaccauuuuacuuu

SEQ ID NO: 491474 - RNA, 64 nt, Human
gacagugaccuccacccccgcagcccucuuaaaaggccaguacucuuggggguggggggagggu

SEQ ID NO: 491475 - RNA, 64 nt, Human
ucacccacauucgcugaagcgauggagagucgggggccaguagccagccaaccccguggggacc

SEQ ID NO: 491476 - RNA, 64 nt, Human
uacaguacaggaucuuuggucuacucuaucacaaggccaguaccacacucaugaagaaagaaca

SEQ ID NO: 491477 - RNA, 64 nt, Human
aaaauaugcucacaguuuguagucauguagaaaaggccaguauaaaaauguaguagacuuaaag

SEQ ID NO: 491478 - RNA, 64 nt, Human
uccggaagggcuccauacugucccaauaaggugaggccaguagcaggaauaauaaaucccacuu

SEQ ID NO: 491479 - RNA, 64 nt, Human; identical to SEQ ID NO: 388109

SEQ ID NO: 491480 - RNA, 64 nt, Human; identical to SEQ ID NO: 388113

SEQ ID NO: 491481 - RNA, 64 nt, Human; identical to SEQ ID NO: 388114

SEQ ID NO: 491482 - RNA, 64 nt, Human; identical to SEQ ID NO: 388115

SEQ ID NO: 491483 - RNA, 64 nt, Human; identical to SEQ ID NO: 388116

SEQ ID NO: 491484 - RNA, 64 nt, Human; identical to SEQ ID NO: 388117

SEQ ID NO: 491485 - RNA, 64 nt, Human; identical to SEQ ID NO: 388118

SEQ ID NO: 491486 - RNA, 64 nt, Human; identical to SEQ ID NO: 388119

SEQ ID NO: 491487 - RNA, 64 nt, Human
ggccuccuuuaguaggugggauuacaggugcauaccaccacaccuuucuaauuuuugcauuuuu

SEQ ID NO: 491488 - RNA, 64 nt, Human
cuucauuucccccucacuguagcccauuuccaccccaccacaaaguugccacagguuuucuuug

SEQ ID NO: 491489 - RNA, 64 nt, Human
uucauguaauuuuaccauuucccauccccauuccccaccacauuaugucaagauucaaguuaua

SEQ ID NO: 491490 - RNA, 64 nt, Human; identical to SEQ ID NO: 388120

SEQ ID NO: 491491 - RNA, 64 nt, Human; identical to SEQ ID NO: 388121

SEQ ID NO: 491492 - RNA, 64 nt, Human; identical to SEQ ID NO: 388122

SEQ ID NO: 491493 - RNA, 64 nt, Human; identical to SEQ ID NO: 388123

SEQ ID NO: 491494 - RNA, 64 nt, Human; identical to SEQ ID NO: 388124

SEQ ID NO: 491495 - RNA, 64 nt, Human; identical to SEQ ID NO: 388125

SEQ ID NO: 491496 - RNA, 64 nt, Human; identical to SEQ ID NO: 388126

SEQ ID NO: 491497 - RNA, 57 nt, Human; identical to SEQ ID NO: 388127

SEQ ID NO: 491498 - RNA, 64 nt, Human; identical to SEQ ID NO: 388131

SEQ ID NO: 491499 - RNA, 64 nt, Human; identical to SEQ ID NO: 388132

SEQ ID NO: 491500 - RNA, 64 nt, Human; identical to SEQ ID NO: 388133

SEQ ID NO: 491501 - RNA, 64 nt, Human; identical to SEQ ID NO: 388134

SEQ ID NO: 491502 - RNA, 64 nt, Human; identical to SEQ ID NO: 388135

SEQ ID NO: 491503 - RNA, 64 nt, Human; identical to SEQ ID NO: 388136

SEQ ID NO: 491504 - RNA, 64 nt, Human; identical to SEQ ID NO: 388137

SEQ ID NO: 491505 - RNA, 64 nt, Human; identical to SEQ ID NO: 388138

SEQ ID NO: 491506 - RNA, 64 nt, Human
auguccaagacacagcagaacagaaaguucaacugcuucguaauuggcaucaacuucauggaaa

SEQ ID NO: 491507 - RNA, 64 nt, Human
cagaugagaugcuauaugugaaaacauucuguaagcuucguacaaaugugaaguauuaauauua

SEQ ID NO: 491508 - RNA, 64 nt, Human
uccgcacccgcccauuuuccuucugucuuuaccugcuucguauccuuucccugcugauguggcu

SEQ ID NO: 491509 - RNA, 64 nt, Human; identical to SEQ ID NO: 388139

SEQ ID NO: 491510 - RNA, 64 nt, Human; identical to SEQ ID NO: 388140

SEQ ID NO: 491511 - RNA, 64 nt, Human; identical to SEQ ID NO: 388141

SEQ ID NO: 491512 - RNA, 64 nt, Human; identical to SEQ ID NO: 388142

SEQ ID NO: 491513 - RNA, 64 nt, Human; identical to SEQ ID NO: 388143

SEQ ID NO: 491514 - RNA, 64 nt, Human; identical to SEQ ID NO: 388144

SEQ ID NO: 491515 - RNA, 64 nt, Human; identical to SEQ ID NO: 388145

SEQ ID NO: 491516 - RNA, 64 nt, Human; identical to SEQ ID NO: 388149

SEQ ID NO: 491517 - RNA, 64 nt, Human; identical to SEQ ID NO: 388150

SEQ ID NO: 491518 - RNA, 64 nt, Human; identical to SEQ ID NO: 388151

SEQ ID NO: 491519 - RNA, 64 nt, Human; identical to SEQ ID NO: 388152

SEQ ID NO: 491520 - RNA, 58 nt, Human; identical to SEQ ID NO: 388153

SEQ ID NO: 491521 - RNA, 64 nt, Human; identical to SEQ ID NO: 388154

SEQ ID NO: 491522 - RNA, 64 nt, Human; identical to SEQ ID NO: 388155

SEQ ID NO: 491523 - RNA, 64 nt, Human; identical to SEQ ID NO: 388156

SEQ ID NO: 491524 - RNA, 59 nt, Human; identical to SEQ ID NO: 388157

SEQ ID NO: 491525 - RNA, 64 nt, Human
ucugucucaccuucauccacucugcaggccugcuccaccacagcccuaauccucuggacgcuug

SEQ ID NO: 491526 - RNA, 64 nt, Human
cucuugauucucuccuacuguuuaaauucccauuccaccacagugccccucagccagaucacca

SEQ ID NO: 491527 - RNA, 64 nt, Human
cagccucccaaguagcuggaauuacagacaccugccaccacauccagcuaacuuuuuuuguauu

SEQ ID NO: 491528 - RNA, 64 nt, Human; identical to SEQ ID NO: 388158

SEQ ID NO: 491529 - RNA, 64 nt, Human; identical to SEQ ID NO: 388159

SEQ ID NO: 491530 - RNA, 64 nt, Human; identical to SEQ ID NO: 388160

SEQ ID NO: 491531 - RNA, 64 nt, Human; identical to SEQ ID NO: 388161

SEQ ID NO: 491532 - RNA, 64 nt, Human; identical to SEQ ID NO: 388162

SEQ ID NO: 491533 - RNA, 64 nt, Human; identical to SEQ ID NO: 388163

SEQ ID NO: 491534 - RNA, 64 nt, Human; identical to SEQ ID NO: 388167

SEQ ID NO: 491535 - RNA, 64 nt, Human; identical to SEQ ID NO: 388168

SEQ ID NO: 491536 - RNA, 64 nt, Human; identical to SEQ ID NO: 388169

SEQ ID NO: 491537 - RNA, 64 nt, Human; identical to SEQ ID NO: 388170

SEQ ID NO: 491538 - RNA, 64 nt, Human; identical to SEQ ID NO: 388171

SEQ ID NO: 491539 - RNA, 64 nt, Human; identical to SEQ ID NO: 388172

SEQ ID NO: 491540 - RNA, 64 nt, Human; identical to SEQ ID NO: 388173

SEQ ID NO: 491541 - RNA, 64 nt, Human; identical to SEQ ID NO: 388174

SEQ ID NO: 491542 - RNA, 64 nt, Human; identical to SEQ ID NO: 388175

SEQ ID NO: 491543 - RNA, 64 nt, Human; identical to SEQ ID NO: 388176

SEQ ID NO: 491544 - RNA, 64 nt, Human
cagccucccgaguagcugggacuacaggagcucgccaccacacccagcuaauuuuuuuuuuuuu

SEQ ID NO: 491545 - RNA, 64 nt, Human
cagccucucaaauagcugggcuuacaggcaugagccaccacaccuggccaggauuugguuguuu

SEQ ID NO: 491546 - RNA, 64 nt, Human
cagcuuccugacuagcugggacuacuggugugcaccaccacacccagcuaauuuucaauuuuuc

SEQ ID NO: 491547 - RNA, 64 nt, Human; identical to SEQ ID NO: 388177

SEQ ID NO: 491548 - RNA, 64 nt, Human; identical to SEQ ID NO: 388178

SEQ ID NO: 491549 - RNA, 64 nt, Human; identical to SEQ ID NO: 388179

SEQ ID NO: 491550 - RNA, 64 nt, Human; identical to SEQ ID NO: 388180

SEQ ID NO: 491551 - RNA, 64 nt, Human; identical to SEQ ID NO: 388181

SEQ ID NO: 491552 - RNA, 64 nt, Human; identical to SEQ ID NO: 388184

SEQ ID NO: 491553 - RNA, 64 nt, Human; identical to SEQ ID NO: 388185

SEQ ID NO: 491554 - RNA, 64 nt, Human; identical to SEQ ID NO: 388186

SEQ ID NO: 491555 - RNA, 64 nt, Human; identical to SEQ ID NO: 388187

SEQ ID NO: 491556 - RNA, 64 nt, Human; identical to SEQ ID NO: 388188

SEQ ID NO: 491557 - RNA, 64 nt, Human; identical to SEQ ID NO: 388189

SEQ ID NO: 491558 - RNA, 64 nt, Human; identical to SEQ ID NO: 388190

SEQ ID NO: 491559 - RNA, 64 nt, Human; identical to SEQ ID NO: 388191

SEQ ID NO: 491560 - RNA, 64 nt, Human; identical to SEQ ID NO: 388192

SEQ ID NO: 491561 - RNA, 64 nt, Human; identical to SEQ ID NO: 388193

SEQ ID NO: 491562 - RNA, 64 nt, Human; identical to SEQ ID NO: 388194

SEQ ID NO: 491563 - RNA, 64 nt, Human
aacuuauguggaagguaaauauauuguuccccauccaccacauaacacucuccccaacacacac

SEQ ID NO: 491564 - RNA, 64 nt, Human
ucuuguggcacaggaaagcugcccucucccucucccaccacacuccugacuaauggccuucacu

SEQ ID NO: 491565 - RNA, 64 nt, Human
ggcugcaaaauuaaaucuagacauucuuuuaaugccaccacacguguuccgcuucucucuuuua

SEQ ID NO: 491566 - RNA, 64 nt, Human; identical to SEQ ID NO: 388195

SEQ ID NO: 491567 - RNA, 64 nt, Human; identical to SEQ ID NO: 388196

SEQ ID NO: 491568 - RNA, 64 nt, Human; identical to SEQ ID NO: 388197

SEQ ID NO: 491569 - RNA, 64 nt, Human; identical to SEQ ID NO: 388198

SEQ ID NO: 491570 - RNA, 64 nt, Human; identical to SEQ ID NO: 388202

SEQ ID NO: 491571 - RNA, 64 nt, Human; identical to SEQ ID NO: 388203

SEQ ID NO: 491572 - RNA, 64 nt, Human; identical to SEQ ID NO: 388204

SEQ ID NO: 491573 - RNA, 64 nt, Human; identical to SEQ ID NO: 388205

SEQ ID NO: 491574 - RNA, 64 nt, Human; identical to SEQ ID NO: 388206

SEQ ID NO: 491575 - RNA, 64 nt, Human; identical to SEQ ID NO: 388207

SEQ ID NO: 491576 - RNA, 64 nt, Human; identical to SEQ ID NO: 388208

SEQ ID NO: 491577 - RNA, 64 nt, Human; identical to SEQ ID NO: 388209

SEQ ID NO: 491578 - RNA, 64 nt, Human; identical to SEQ ID NO: 388210

SEQ ID NO: 491579 - RNA, 64 nt, Human; identical to SEQ ID NO: 388211

SEQ ID NO: 491580 - RNA, 64 nt, Human; identical to SEQ ID NO: 388212

SEQ ID NO: 491581 - RNA, 64 nt, Human; identical to SEQ ID NO: 388213

SEQ ID NO: 491582 - RNA, 64 nt, Human
cgccacgccguggcucccaccagcagugccaccgccaccacaccccagaucccacccaccuugc

SEQ ID NO: 491583 - RNA, 64 nt, Human
gcuccgugagcugagucucccacugcccugcacaccaccacauuggaccugugcuguccuggga

SEQ ID NO: 491584 - RNA, 64 nt, Human
agggcaugucccuuugggagcccgccuuguggauccaccacaccccaccgagcacuagaagcug

SEQ ID NO: 491585 - RNA, 64 nt, Human; identical to SEQ ID NO: 388214

SEQ ID NO: 491586 - RNA, 64 nt, Human; identical to SEQ ID NO: 388215

SEQ ID NO: 491587 - RNA, 64 nt, Human; identical to SEQ ID NO: 388216

SEQ ID NO: 491588 - RNA, 64 nt, Human; identical to SEQ ID NO: 388220

SEQ ID NO: 491589 - RNA, 64 nt, Human; identical to SEQ ID NO: 388221

SEQ ID NO: 491590 - RNA, 64 nt, Human; identical to SEQ ID NO: 388222

SEQ ID NO: 491591 - RNA, 64 nt, Human; identical to SEQ ID NO: 388223

SEQ ID NO: 491592 - RNA, 64 nt, Human; identical to SEQ ID NO: 388224

SEQ ID NO: 491593 - RNA, 64 nt, Human; identical to SEQ ID NO: 388225

SEQ ID NO: 491594 - RNA, 64 nt, Human; identical to SEQ ID NO: 388226

SEQ ID NO: 491595 - RNA, 64 nt, Human; identical to SEQ ID NO: 388227

SEQ ID NO: 491596 - RNA, 59 nt, Human; identical to SEQ ID NO: 388228

SEQ ID NO: 491597 - RNA, 64 nt, Human; identical to SEQ ID NO: 388229

SEQ ID NO: 491598 - RNA, 64 nt, Human; identical to SEQ ID NO: 388230

SEQ ID NO: 491599 - RNA, 64 nt, Human; identical to SEQ ID NO: 388231

SEQ ID NO: 491600 - RNA, 64 nt, Human; identical to SEQ ID NO: 388232

SEQ ID NO: 491601 - RNA, 64 nt, Human
cccguccccaccucaaaucacacacacccccuccccaccacagagacaccauuacauacacaga

SEQ ID NO: 491602 - RNA, 64 nt, Human
ugcuauucuccauacucuguaucacuuguauugaccaccacauaugcuaauaccuaucuacugc

SEQ ID NO: 491603 - RNA, 64 nt, Human
ccuucuagaaaaucaguguucacagagacugccuccaccacaggcauccugcaaaugcagacuc

SEQ ID NO: 491604 - RNA, 64 nt, Human; identical to SEQ ID NO: 388233

SEQ ID NO: 491605 - RNA, 64 nt, Human; identical to SEQ ID NO: 388234

SEQ ID NO: 491606 - RNA, 64 nt, Human; identical to SEQ ID NO: 388238

SEQ ID NO: 491607 - RNA, 64 nt, Human; identical to SEQ ID NO: 388239

SEQ ID NO: 491608 - RNA, 64 nt, Human; identical to SEQ ID NO: 388240

SEQ ID NO: 491609 - RNA, 64 nt, Human; identical to SEQ ID NO: 388241

SEQ ID NO: 491610 - RNA, 64 nt, Human; identical to SEQ ID NO: 388242

SEQ ID NO: 491611 - RNA, 64 nt, Human; identical to SEQ ID NO: 388243

SEQ ID NO: 491612 - RNA, 64 nt, Human; identical to SEQ ID NO: 388244

SEQ ID NO: 491613 - RNA, 64 nt, Human; identical to SEQ ID NO: 388245

SEQ ID NO: 491614 - RNA, 64 nt, Human; identical to SEQ ID NO: 388246

SEQ ID NO: 491615 - RNA, 64 nt, Human; identical to SEQ ID NO: 388247

SEQ ID NO: 491616 - RNA, 64 nt, Human; identical to SEQ ID NO: 388248

SEQ ID NO: 491617 - RNA, 64 nt, Human; identical to SEQ ID NO: 388249

SEQ ID NO: 491618 - RNA, 64 nt, Human; identical to SEQ ID NO: 388250

SEQ ID NO: 491619 - RNA, 64 nt, Human; identical to SEQ ID NO: 388251

SEQ ID NO: 491620 - RNA, 64 nt, Human
uuucucucuuuuucuuugaggagaaugauggucaccaccacaauuaauuguaauuaagggaaau

SEQ ID NO: 491621 - RNA, 64 nt, Human
uccuaugguuuacaaagagggccccagcccagccccaccacagaucccagagauaggggcccag

SEQ ID NO: 491622 - RNA, 64 nt, Human
accacccagaccuaggcuucccucuucucaggauccaccacaggguuaggggacaggaagccug

SEQ ID NO: 491623 - RNA, 64 nt, Human; identical to SEQ ID NO: 388270

SEQ ID NO: 491624 - RNA, 64 nt, Human
gcagugucucuggaacugccuuacucacaggcuuccaccacagcccuaugagagcuuugccaac

SEQ ID NO: 491625 - RNA, 64 nt, Human
aaaggauggcagccucagggcuuccuuauguccuccaccacaagagcuccuugaugaaggucau

SEQ ID NO: 491626 - RNA, 64 nt, Human
aacaugaauaucuccaacaagaucaggaaccucuccaccacacugcaaacaauagccaccaaau

SEQ ID NO: 491627 - RNA, 64 nt, Human
uggccagaaggaauguaaacaguaguaguagcugccaccacaucucuaggguagccaugcagag

SEQ ID NO: 491628 - RNA, 64 nt, Human
agcuaggcuuggcccuaccauucuggggccauuuccaccacaguuggggcucuccugccuucac

SEQ ID NO: 491629 - RNA, 64 nt, Human
auccuuugcuuacuauuuaugcagcuucucuaccccaccacacaaauuucccauuucccccccg

SEQ ID NO: 491630 - RNA, 64 nt, Human
cagccuucugaguagcugggacuacaggugcaugccaccacacccugcuaauuuuuguauuuuu

SEQ ID NO: 491631 - RNA, 64 nt, Human
aguuuaccgaccugaauguuuaccugugggauguccaccacaguaaaaggcuuauuaaagugga

SEQ ID NO: 491632 - RNA, 64 nt, Human
gcauucuuucagaaaaauuaccauauuuuuguccccaccacaagcuggguuuuuuuccagcuuu

SEQ ID NO: 491633 - RNA, 64 nt, Human
cccucccucaaggaauggccuugcccaggaaugcccaccacacauacccucuucuuuuuuucua

SEQ ID NO: 491634 - RNA, 64 nt, Human
cauaauuuauugcuuuucuuugcaucugcaccugccaccacagaauaaccauuacccucagcug

SEQ ID NO: 491635 - RNA, 64 nt, Human
cggccucccaaaauccugggauuacaggcgcgagccaccacacccggcuggaaguaaacauuuu

SEQ ID NO: 491636 - RNA, 64 nt, Human
cggcucuuccugccuggaugcaggagggcaggggccaccacagauuaaagcuguuacugcacac

SEQ ID NO: 491637 - RNA, 64 nt, Human
cagccucccaaagugcugggauuacaggugugaaccaccacacccagcccacuucugccauauu

SEQ ID NO: 491638 - RNA, 64 nt, Human
uuuguaaacgaaaacagacucgaacuauuguguaccaccacauagcacaugcacgucuguccca

SEQ ID NO: 491639 - RNA, 64 nt, Human
cuucugcugcugccaccugcgccagcccuaccuuccaccacagaugucucccagaugggccuug

SEQ ID NO: 491640 - RNA, 64 nt, Human
ccacuugugggcuucagguguuuucaagcacaacccaccacaacaagcaagugcauuuucaguc

SEQ ID NO: 491641 - RNA, 64 nt, Human
uggccucccaaagugcugggauuacaggugugagccaccacacugggccaaugcuuaauauuuu

SEQ ID NO: 491642 - RNA, 64 nt, Human
acaacugaaauuuccccacucuguuggggcuuccccaccacauucaugucccucucccguguag

SEQ ID NO: 491643 - RNA, 64 nt, Human
ccuccuccugaguagcugggacuacaggugcucaccaccacacccggcuaauuuuuuguauuuu

SEQ ID NO: 491644 - RNA, 64 nt, Human; identical to SEQ ID NO: 388274

SEQ ID NO: 491645 - RNA, 64 nt, Human; identical to SEQ ID NO: 388275

SEQ ID NO: 491646 - RNA, 64 nt, Human; identical to SEQ ID NO: 388276

SEQ ID NO: 491647 - RNA, 64 nt, Human; identical to SEQ ID NO: 388277

SEQ ID NO: 491648 - RNA, 64 nt, Human; identical to SEQ ID NO: 388278

SEQ ID NO: 491649 - RNA, 64 nt, Human; identical to SEQ ID NO: 388279

SEQ ID NO: 491650 - RNA, 64 nt, Human; identical to SEQ ID NO: 388280

SEQ ID NO: 491651 - RNA, 64 nt, Human; identical to SEQ ID NO: 388281

SEQ ID NO: 491652 - RNA, 64 nt, Human; identical to SEQ ID NO: 388282

SEQ ID NO: 491653 - RNA, 64 nt, Human; identical to SEQ ID NO: 388283

SEQ ID NO: 491654 - RNA, 64 nt, Human; identical to SEQ ID NO: 388284

SEQ ID NO: 491655 - RNA, 64 nt, Human; identical to SEQ ID NO: 388285

SEQ ID NO: 491656 - RNA, 64 nt, Human; identical to SEQ ID NO: 388286

SEQ ID NO: 491657 - RNA, 64 nt, Human; identical to SEQ ID NO: 388287

SEQ ID NO: 491658 - RNA, 64 nt, Human; identical to SEQ ID NO: 388288

SEQ ID NO: 491659 - RNA, 64 nt, Human; identical to SEQ ID NO: 388292

SEQ ID NO: 491660 - RNA, 64 nt, Human
cagccuccugaguagcugggacuacaggcuugcgccaccacaccuggcuaauuuuuguauuuuu

SEQ ID NO: 491661 - RNA, 64 nt, Human
gagggcuuggcugccugccaccgccaucuggagcccaccacagcucuucucccuguucucuggg

SEQ ID NO: 491662 - RNA, 64 nt, Human
agcagccuggcagcagccucaccgaagagaggaaccaccacacccagcagcuccugacagaccc

SEQ ID NO: 491663 - RNA, 64 nt, Human; identical to SEQ ID NO: 388293

SEQ ID NO: 491664 - RNA, 64 nt, Human; identical to SEQ ID NO: 388294

SEQ ID NO: 491665 - RNA, 64 nt, Human; identical to SEQ ID NO: 388295

SEQ ID NO: 491666 - RNA, 64 nt, Human; identical to SEQ ID NO: 388296

SEQ ID NO: 491667 - RNA, 64 nt, Human; identical to SEQ ID NO: 388297

SEQ ID NO: 491668 - RNA, 64 nt, Human; identical to SEQ ID NO: 388298

SEQ ID NO: 491669 - RNA, 64 nt, Human; identical to SEQ ID NO: 388299

SEQ ID NO: 491670 - RNA, 64 nt, Human; identical to SEQ ID NO: 388300

SEQ ID NO: 491671 - RNA, 64 nt, Human; identical to SEQ ID NO: 388301

SEQ ID NO: 491672 - RNA, 64 nt, Human; identical to SEQ ID NO: 388302

SEQ ID NO: 491673 - RNA, 64 nt, Human; identical to SEQ ID NO: 388303

SEQ ID NO: 491674 - RNA, 64 nt, Human; identical to SEQ ID NO: 388304

SEQ ID NO: 491675 - RNA, 64 nt, Human; identical to SEQ ID NO: 388305

SEQ ID NO: 491676 - RNA, 64 nt, Human; identical to SEQ ID NO: 388306

SEQ ID NO: 491677 - RNA, 64 nt, Human; identical to SEQ ID NO: 388310

SEQ ID NO: 491678 - RNA, 64 nt, Human; identical to SEQ ID NO: 388311

SEQ ID NO: 491679 - RNA, 64 nt, Human
gggccucccaaaaugcugggauuacaggcaugagccaccacaccuggcaaggguaccugacauu

SEQ ID NO: 491680 - RNA, 64 nt, Human
guagcuugucucagauucccucuuuggccuucugccaccacacucuccacccuguggucuuguu

SEQ ID NO: 491681 - RNA, 64 nt, Human
cugacaguguuuuucuuccucuuucauaccaccaccaccacaaucaucaacauaaaggaagucu

SEQ ID NO: 491682 - RNA, 64 nt, Human; identical to SEQ ID NO: 388312

SEQ ID NO: 491683 - RNA, 64 nt, Human; identical to SEQ ID NO: 388313

SEQ ID NO: 491684 - RNA, 64 nt, Human; identical to SEQ ID NO: 388314

SEQ ID NO: 491685 - RNA, 64 nt, Human; identical to SEQ ID NO: 388315

SEQ ID NO: 491686 - RNA, 64 nt, Human; identical to SEQ ID NO: 388316

SEQ ID NO: 491687 - RNA, 64 nt, Human; identical to SEQ ID NO: 388317

SEQ ID NO: 491688 - RNA, 64 nt, Human; identical to SEQ ID NO: 388318

SEQ ID NO: 491689 - RNA, 64 nt, Human; identical to SEQ ID NO: 388319

SEQ ID NO: 491690 - RNA, 64 nt, Human; identical to SEQ ID NO: 388320

SEQ ID NO: 491691 - RNA, 64 nt, Human; identical to SEQ ID NO: 388321

SEQ ID NO: 491692 - RNA, 64 nt, Human; identical to SEQ ID NO: 388322

SEQ ID NO: 491693 - RNA, 64 nt, Human; identical to SEQ ID NO: 388323

SEQ ID NO: 491694 - RNA, 64 nt, Human; identical to SEQ ID NO: 388324

SEQ ID NO: 491695 - RNA, 64 nt, Human; identical to SEQ ID NO: 388328

SEQ ID NO: 491696 - RNA, 64 nt, Human; identical to SEQ ID NO: 388329

SEQ ID NO: 491697 - RNA, 64 nt, Human; identical to SEQ ID NO: 388330

SEQ ID NO: 491698 - RNA, 64 nt, Human
auuuauuuuuguacaaaauaauaaaaaaaaaaacccaccacaaacguagaauccacuucuguuc

SEQ ID NO: 491699 - RNA, 64 nt, Human
cagccucccgaguagcugggauuacaggugugcaccaccacacccggcuaauuuuuuuuauuuu

SEQ ID NO: 491700 - RNA, 64 nt, Human
cagccuccagaagugcugggauuacaaaugugagccaccacaucuggccccauuauuuuauuuu

SEQ ID NO: 491701 - RNA, 64 nt, Human; identical to SEQ ID NO: 388331

SEQ ID NO: 491702 - RNA, 64 nt, Human; identical to SEQ ID NO: 388332

SEQ ID NO: 491703 - RNA, 64 nt, Human; identical to SEQ ID NO: 388333

SEQ ID NO: 491704 - RNA, 64 nt, Human; identical to SEQ ID NO: 388334

SEQ ID NO: 491705 - RNA, 64 nt, Human; identical to SEQ ID NO: 388335

SEQ ID NO: 491706 - RNA, 64 nt, Human; identical to SEQ ID NO: 388336

SEQ ID NO: 491707 - RNA, 64 nt, Human; identical to SEQ ID NO: 388337

SEQ ID NO: 491708 - RNA, 64 nt, Human; identical to SEQ ID NO: 388338

SEQ ID NO: 491709 - RNA, 64 nt, Human; identical to SEQ ID NO: 388339

SEQ ID NO: 491710 - RNA, 64 nt, Human; identical to SEQ ID NO: 388340

SEQ ID NO: 491711 - RNA, 64 nt, Human; identical to SEQ ID NO: 388341

SEQ ID NO: 491712 - RNA, 64 nt, Human; identical to SEQ ID NO: 388342

SEQ ID NO: 491713 - RNA, 64 nt, Human; identical to SEQ ID NO: 388345

SEQ ID NO: 491714 - RNA, 64 nt, Human; identical to SEQ ID NO: 388346

SEQ ID NO: 491715 - RNA, 64 nt, Human; identical to SEQ ID NO: 388347

SEQ ID NO: 491716 - RNA, 64 nt, Human; identical to SEQ ID NO: 388348

SEQ ID NO: 491717 - RNA, 57 nt, Human
ugggcgaggagcguaacuaaguccgccccaccacacuccccgccuguccugccucuc

SEQ ID NO: 491718 - RNA, 64 nt, Human
cagucucccaaguagcugacacuacaguugugugccaccacaccuggguaauuuuuuguguuuu

SEQ ID NO: 491719 - RNA, 64 nt, Human
uauagacaugaugaggaucugguggguguuuccaccaccacagcuguugggaaagugauuugug

SEQ ID NO: 491720 - RNA, 64 nt, Human; identical to SEQ ID NO: 388349

SEQ ID NO: 491721 - RNA, 64 nt, Human; identical to SEQ ID NO: 388350

SEQ ID NO: 491722 - RNA, 64 nt, Human; identical to SEQ ID NO: 388351

SEQ ID NO: 491723 - RNA, 64 nt, Human; identical to SEQ ID NO: 388352

SEQ ID NO: 491724 - RNA, 64 nt, Human; identical to SEQ ID NO: 388353

SEQ ID NO: 491725 - RNA, 64 nt, Human; identical to SEQ ID NO: 388354

SEQ ID NO: 491726 - RNA, 64 nt, Human; identical to SEQ ID NO: 388355

SEQ ID NO: 491727 - RNA, 64 nt, Human; identical to SEQ ID NO: 388356

SEQ ID NO: 491728 - RNA, 64 nt, Human; identical to SEQ ID NO: 388357

SEQ ID NO: 491729 - RNA, 64 nt, Human; identical to SEQ ID NO: 388358

SEQ ID NO: 491730 - RNA, 64 nt, Human; identical to SEQ ID NO: 388359

SEQ ID NO: 491731 - RNA, 64 nt, Human; identical to SEQ ID NO: 388363

SEQ ID NO: 491732 - RNA, 64 nt, Human; identical to SEQ ID NO: 388364

SEQ ID NO: 491733 - RNA, 64 nt, Human; identical to SEQ ID NO: 388365

SEQ ID NO: 491734 - RNA, 64 nt, Human; identical to SEQ ID NO: 388366

SEQ ID NO: 491735 - RNA, 64 nt, Human; identical to SEQ ID NO: 388367

SEQ ID NO: 491736 - RNA, 64 nt, Human
ggagagggacagcacaggccacagagggcugcccccaccacacacacccccgcgucucgggaga

SEQ ID NO: 491737 - RNA, 64 nt, Human
uuggagccucuuggccuucagagcagaggcaaacccaccacagggcagcugcguuuuaggaaga

SEQ ID NO: 491738 - RNA, 64 nt, Human
cagccuccugaguagcugagacuacaggugagugccaccacacucagcuaauuuucaaauuuuu

SEQ ID NO: 491739 - RNA, 64 nt, Human; identical to SEQ ID NO: 388368

SEQ ID NO: 491740 - RNA, 64 nt, Human; identical to SEQ ID NO: 388369

SEQ ID NO: 491741 - RNA, 64 nt, Human; identical to SEQ ID NO: 388370

SEQ ID NO: 491742 - RNA, 64 nt, Human; identical to SEQ ID NO: 388371

SEQ ID NO: 491743 - RNA, 64 nt, Human; identical to SEQ ID NO: 388372

SEQ ID NO: 491744 - RNA, 64 nt, Human; identical to SEQ ID NO: 388373

SEQ ID NO: 491745 - RNA, 64 nt, Human; identical to SEQ ID NO: 388374

SEQ ID NO: 491746 - RNA, 64 nt, Human; identical to SEQ ID NO: 388375

SEQ ID NO: 491747 - RNA, 63 nt, Human; identical to SEQ ID NO: 388376

SEQ ID NO: 491748 - RNA, 64 nt, Human; identical to SEQ ID NO: 388377

SEQ ID NO: 491749 - RNA, 64 nt, Human; identical to SEQ ID NO: 388381

SEQ ID NO: 491750 - RNA, 64 nt, Human; identical to SEQ ID NO: 388382

SEQ ID NO: 491751 - RNA, 64 nt, Human; identical to SEQ ID NO: 388383

SEQ ID NO: 491752 - RNA, 64 nt, Human; identical to SEQ ID NO: 388384

SEQ ID NO: 491753 - RNA, 64 nt, Human; identical to SEQ ID NO: 388385

SEQ ID NO: 491754 - RNA, 64 nt, Human; identical to SEQ ID NO: 388386

SEQ ID NO: 491755 - RNA, 64 nt, Human
caggaggucgaggcugcagugagcuaugaucacaccaccacacuccagccugagcagcagagcg

SEQ ID NO: 491756 - RNA, 64 nt, Human
cgggaugccugcaucccacccccggccccagggcccaccacauaaaaucugggagcccagagcu

SEQ ID NO: 491757 - RNA, 64 nt, Human
ggguuuuuuucuucuuucuuuaaacauagagguaccaccacaagggaugcccuacucucucgca

SEQ ID NO: 491758 - RNA, 64 nt, Human; identical to SEQ ID NO: 388387

SEQ ID NO: 491759 - RNA, 64 nt, Human; identical to SEQ ID NO: 388388

SEQ ID NO: 491760 - RNA, 64 nt, Human; identical to SEQ ID NO: 388389

SEQ ID NO: 491761 - RNA, 64 nt, Human; identical to SEQ ID NO: 388390

SEQ ID NO: 491762 - RNA, 64 nt, Human; identical to SEQ ID NO: 388391

SEQ ID NO: 491763 - RNA, 64 nt, Human; identical to SEQ ID NO: 388392

SEQ ID NO: 491764 - RNA, 64 nt, Human; identical to SEQ ID NO: 388393

SEQ ID NO: 491765 - RNA, 64 nt, Human; identical to SEQ ID NO: 388394

SEQ ID NO: 491766 - RNA, 64 nt, Human; identical to SEQ ID NO: 388395

SEQ ID NO: 491767 - RNA, 64 nt, Human; identical to SEQ ID NO: 388399

SEQ ID NO: 491768 - RNA, 64 nt, Human; identical to SEQ ID NO: 388400

SEQ ID NO: 491769 - RNA, 64 nt, Human; identical to SEQ ID NO: 388401

SEQ ID NO: 491770 - RNA, 64 nt, Human; identical to SEQ ID NO: 388402

SEQ ID NO: 491771 - RNA, 64 nt, Human; identical to SEQ ID NO: 388403

SEQ ID NO: 491772 - RNA, 64 nt, Human; identical to SEQ ID NO: 388404

SEQ ID NO: 491773 - RNA, 64 nt, Human; identical to SEQ ID NO: 388405

SEQ ID NO: 491774 - RNA, 64 nt, Human
gggaagagugacaguagggagggaggacagaccuccaccacacugacaucagcuccagcucccc

SEQ ID NO: 491775 - RNA, 64 nt, Human
caggaguuugaggcugcggugagcugugaucacaccaccacacuccaaccuguguaacagagug

SEQ ID NO: 491776 - RNA, 64 nt, Human
agacagccuggaucagccacaucaacucaguuguccaccacaggggaauuuugaaugucuuuug

SEQ ID NO: 491777 - RNA, 64 nt, Human; identical to SEQ ID NO: 388406

SEQ ID NO: 491778 - RNA, 57 nt, Human; identical to SEQ ID NO: 388407

SEQ ID NO: 491779 - RNA, 64 nt, Human; identical to SEQ ID NO: 388408

SEQ ID NO: 491780 - RNA, 64 nt, Human; identical to SEQ ID NO: 388409

SEQ ID NO: 491781 - RNA, 64 nt, Human; identical to SEQ ID NO: 388410

SEQ ID NO: 491782 - RNA, 64 nt, Human; identical to SEQ ID NO: 388411

SEQ ID NO: 491783 - RNA, 64 nt, Human; identical to SEQ ID NO: 388412

SEQ ID NO: 491784 - RNA, 64 nt, Human; identical to SEQ ID NO: 388413

SEQ ID NO: 491785 - RNA, 64 nt, Human; identical to SEQ ID NO: 388417

SEQ ID NO: 491786 - RNA, 64 nt, Human; identical to SEQ ID NO: 388418

SEQ ID NO: 491787 - RNA, 64 nt, Human; identical to SEQ ID NO: 388419

SEQ ID NO: 491788 - RNA, 64 nt, Human; identical to SEQ ID NO: 388420

SEQ ID NO: 491789 - RNA, 64 nt, Human; identical to SEQ ID NO: 388421

SEQ ID NO: 491790 - RNA, 55 nt, Human; identical to SEQ ID NO: 388422

SEQ ID NO: 491791 - RNA, 64 nt, Human; identical to SEQ ID NO: 388423

SEQ ID NO: 491792 - RNA, 64 nt, Human; identical to SEQ ID NO: 388424

SEQ ID NO: 491793 - RNA, 64 nt, Human
cacuugcucucaccugagccccaggugaaggggcccggaacaccugcucucaccugagcccccg

SEQ ID NO: 491794 - RNA, 64 nt, Human
cauuauuugguguucaccaacgugggagacuucaccggaacaggcuuuuuugcuuugggcucug

SEQ ID NO: 491795 - RNA, 64 nt, Human; identical to SEQ ID NO: 388425

SEQ ID NO: 491796 - RNA, 64 nt, Human; identical to SEQ ID NO: 388426

SEQ ID NO: 491797 - RNA, 64 nt, Human; identical to SEQ ID NO: 388427

SEQ ID NO: 491798 - RNA, 64 nt, Human; identical to SEQ ID NO: 388428

SEQ ID NO: 491799 - RNA, 64 nt, Human; identical to SEQ ID NO: 388429

SEQ ID NO: 491800 - RNA, 64 nt, Human; identical to SEQ ID NO: 388430

SEQ ID NO: 491801 - RNA, 64 nt, Human; identical to SEQ ID NO: 388431

SEQ ID NO: 491802 - RNA, 64 nt, Human; identical to SEQ ID NO: 388435

SEQ ID NO: 491803 - RNA, 64 nt, Human; identical to SEQ ID NO: 388436

SEQ ID NO: 491804 - RNA, 64 nt, Human; identical to SEQ ID NO: 388437

SEQ ID NO: 491805 - RNA, 64 nt, Human; identical to SEQ ID NO: 388438

SEQ ID NO: 491806 - RNA, 64 nt, Human; identical to SEQ ID NO: 388439

SEQ ID NO: 491807 - RNA, 64 nt, Human; identical to SEQ ID NO: 388440

SEQ ID NO: 491808 - RNA, 64 nt, Human; identical to SEQ ID NO: 388441

SEQ ID NO: 491809 - RNA, 64 nt, Human; identical to SEQ ID NO: 388442

SEQ ID NO: 491810 - RNA, 64 nt, Human; identical to SEQ ID NO: 388443

SEQ ID NO: 491811 - RNA, 64 nt, Human
cccuggacugaaguucugcaaaguccuccgaggaccggaacacguuucugcgacccggggcucu

SEQ ID NO: 491812 - RNA, 64 nt, Human
gaagugccucacuguucucgugaccuggaguuaaccggaacagcgucuucauucauuucuguug

SEQ ID NO: 491813 - RNA, 64 nt, Human
gcucugaucaggaaagugaggaacagcaacaauuccggaacauuuucaagcagauagcaggaga

SEQ ID NO: 491814 - RNA, 64 nt, Human; identical to SEQ ID NO: 388444

SEQ ID NO: 491815 - RNA, 64 nt, Human; identical to SEQ ID NO: 388445

SEQ ID NO: 491816 - RNA, 64 nt, Human; identical to SEQ ID NO: 388446

SEQ ID NO: 491817 - RNA, 64 nt, Human; identical to SEQ ID NO: 388447

SEQ ID NO: 491818 - RNA, 64 nt, Human; identical to SEQ ID NO: 388448

SEQ ID NO: 491819 - RNA, 64 nt, Human; identical to SEQ ID NO: 388449

SEQ ID NO: 491820 - RNA, 64 nt, Human; identical to SEQ ID NO: 388453

SEQ ID NO: 491821 - RNA, 64 nt, Human; identical to SEQ ID NO: 388454

SEQ ID NO: 491822 - RNA, 64 nt, Human; identical to SEQ ID NO: 388455

SEQ ID NO: 491823 - RNA, 64 nt, Human; identical to SEQ ID NO: 388456

SEQ ID NO: 491824 - RNA, 64 nt, Human; identical to SEQ ID NO: 388457

SEQ ID NO: 491825 - RNA, 64 nt, Human; identical to SEQ ID NO: 388458

SEQ ID NO: 491826 - RNA, 64 nt, Human; identical to SEQ ID NO: 388459

SEQ ID NO: 491827 - RNA, 64 nt, Human; identical to SEQ ID NO: 388460

SEQ ID NO: 491828 - RNA, 64 nt, Human; identical to SEQ ID NO: 388461

SEQ ID NO: 491829 - RNA, 64 nt, Human; identical to SEQ ID NO: 388462

SEQ ID NO: 491830 - RNA, 64 nt, Human
cucagcuggaugagacuguccuggaggauccaccccggaacagacagaauggugucucucagga

SEQ ID NO: 491831 - RNA, 64 nt, Human
uaaauauauuauauauggaugugugugugugcgugcgcgugagugugugagcgcuucugcagcc

SEQ ID NO: 491832 - RNA, 64 nt, Human
gaucccauaguuucaauucauguaaguucaacagacaccugaagucuagcaugugggaggcuga

SEQ ID NO: 491833 - RNA, 64 nt, Human; identical to SEQ ID NO: 388463

SEQ ID NO: 491834 - RNA, 64 nt, Human; identical to SEQ ID NO: 388464

SEQ ID NO: 491835 - RNA, 57 nt, Human; identical to SEQ ID NO: 388465

SEQ ID NO: 491836 - RNA, 64 nt, Human; identical to SEQ ID NO: 388466

SEQ ID NO: 491837 - RNA, 64 nt, Human; identical to SEQ ID NO: 388467

SEQ ID NO: 491838 - RNA, 64 nt, Human; identical to SEQ ID NO: 388471

SEQ ID NO: 491839 - RNA, 64 nt, Human; identical to SEQ ID NO: 388472

SEQ ID NO: 491840 - RNA, 64 nt, Human; identical to SEQ ID NO: 388473

SEQ ID NO: 491841 - RNA, 64 nt, Human; identical to SEQ ID NO: 388474

SEQ ID NO: 491842 - RNA, 64 nt, Human; identical to SEQ ID NO: 388475

SEQ ID NO: 491843 - RNA, 64 nt, Human; identical to SEQ ID NO: 388476

SEQ ID NO: 491844 - RNA, 64 nt, Human; identical to SEQ ID NO: 388477

SEQ ID NO: 491845 - RNA, 64 nt, Human; identical to SEQ ID NO: 388478

SEQ ID NO: 491846 - RNA, 64 nt, Human; identical to SEQ ID NO: 388479

SEQ ID NO: 491847 - RNA, 64 nt, Human; identical to SEQ ID NO: 388480

SEQ ID NO: 491848 - RNA, 64 nt, Human; identical to SEQ ID NO: 388481

SEQ ID NO: 491849 - RNA, 64 nt, Human
ugagcugagcacagggccaaagcagccauggcagacaccugacggagggcacggggcuggcuga

SEQ ID NO: 491850 - RNA, 64 nt, Human
agcagcaaugggucucaccauagcugcuggaaucacaccugagaacugagauauaccaauauuu

SEQ ID NO: 491851 - RNA, 64 nt, Human
ugccgagugccugcgauuacaggcgcgcgccgccacaccugacugguuuucguauuuuuuuggu

SEQ ID NO: 491852 - RNA, 64 nt, Human; identical to SEQ ID NO: 388482

SEQ ID NO: 491853 - RNA, 64 nt, Human; identical to SEQ ID NO: 388483

SEQ ID NO: 491854 - RNA, 64 nt, Human; identical to SEQ ID NO: 388484

SEQ ID NO: 491855 - RNA, 64 nt, Human; identical to SEQ ID NO: 388485

SEQ ID NO: 491856 - RNA, 64 nt, Human; identical to SEQ ID NO: 388489

SEQ ID NO: 491857 - RNA, 64 nt, Human; identical to SEQ ID NO: 388490

SEQ ID NO: 491858 - RNA, 64 nt, Human; identical to SEQ ID NO: 388491

SEQ ID NO: 491859 - RNA, 64 nt, Human; identical to SEQ ID NO: 388492

SEQ ID NO: 491860 - RNA, 64 nt, Human; identical to SEQ ID NO: 388493

SEQ ID NO: 491861 - RNA, 64 nt, Human; identical to SEQ ID NO: 388494

SEQ ID NO: 491862 - RNA, 64 nt, Human; identical to SEQ ID NO: 388495

SEQ ID NO: 491863 - RNA, 64 nt, Human; identical to SEQ ID NO: 388496

SEQ ID NO: 491864 - RNA, 64 nt, Human; identical to SEQ ID NO: 388497

SEQ ID NO: 491865 - RNA, 64 nt, Human; identical to SEQ ID NO: 388498

SEQ ID NO: 491866 - RNA, 64 nt, Human; identical to SEQ ID NO: 388499

SEQ ID NO: 491867 - RNA, 64 nt, Human; identical to SEQ ID NO: 388500

SEQ ID NO: 491868 - RNA, 64 nt, Human
caaagggccuaagguccacuggacaguugggaaaacaccugaccaccauuuaaggacucuaagc

SEQ ID NO: 491869 - RNA, 64 nt, Human
cgguggccugcagaccauugcccaccgggagccgacaccugaccuagcacacacugacacaggg

SEQ ID NO: 491870 - RNA, 64 nt, Human
aucacauugauauauguuuguuaguaaaaugugcacaccugacuugcaauguuguguuaaacua

SEQ ID NO: 491871 - RNA, 64 nt, Human; identical to SEQ ID NO: 388501

SEQ ID NO: 491872 - RNA, 64 nt, Human; identical to SEQ ID NO: 388502

SEQ ID NO: 491873 - RNA, 64 nt, Human; identical to SEQ ID NO: 388503

SEQ ID NO: 491874 - RNA, 64 nt, Human; identical to SEQ ID NO: 388505

SEQ ID NO: 491875 - RNA, 64 nt, Human; identical to SEQ ID NO: 388506

SEQ ID NO: 491876 - RNA, 64 nt, Human; identical to SEQ ID NO: 388507

SEQ ID NO: 491877 - RNA, 64 nt, Human; identical to SEQ ID NO: 388508

SEQ ID NO: 491878 - RNA, 64 nt, Human; identical to SEQ ID NO: 388509

SEQ ID NO: 491879 - RNA, 59 nt, Human; identical to SEQ ID NO: 388510

SEQ ID NO: 491880 - RNA, 64 nt, Human; identical to SEQ ID NO: 388511

SEQ ID NO: 491881 - RNA, 64 nt, Human; identical to SEQ ID NO: 388512

SEQ ID NO: 491882 - RNA, 64 nt, Human; identical to SEQ ID NO: 388513

SEQ ID NO: 491883 - RNA, 64 nt, Human; identical to SEQ ID NO: 388514

SEQ ID NO: 491884 - RNA, 64 nt, Human; identical to SEQ ID NO: 388515

SEQ ID NO: 491885 - RNA, 64 nt, Human; identical to SEQ ID NO: 388516

SEQ ID NO: 491886 - RNA, 64 nt, Human; identical to SEQ ID NO: 388517

SEQ ID NO: 491887 - RNA, 64 nt, Human
gccucugcucagaacgcccuuccuccagacccugacaccugagcugggguugcaaagucacugg

SEQ ID NO: 491888 - RNA, 64 nt, Human
gagagagagauuuggaaggggcucuggcucccuaacaccugaaucccagaugaugggaaguaug

SEQ ID NO: 491889 - RNA, 52 nt, Human
agcgcacaggugggaauugaacacaccugaagaagacuugguuccugguaac

SEQ ID NO: 491890 - RNA, 64 nt, Human; identical to SEQ ID NO: 388518

SEQ ID NO: 491891 - RNA, 64 nt, Human; identical to SEQ ID NO: 388519

SEQ ID NO: 491892 - RNA, 64 nt, Human; identical to SEQ ID NO: 388523

SEQ ID NO: 491893 - RNA, 64 nt, Human; identical to SEQ ID NO: 388524

SEQ ID NO: 491894 - RNA, 64 nt, Human; identical to SEQ ID NO: 388525

SEQ ID NO: 491895 - RNA, 64 nt, Human; identical to SEQ ID NO: 388526

SEQ ID NO: 491896 - RNA, 64 nt, Human; identical to SEQ ID NO: 388527

SEQ ID NO: 491897 - RNA, 64 nt, Human; identical to SEQ ID NO: 388528

SEQ ID NO: 491898 - RNA, 58 nt, Human; identical to SEQ ID NO: 388529

SEQ ID NO: 491899 - RNA, 64 nt, Human; identical to SEQ ID NO: 388530

SEQ ID NO: 491900 - RNA, 64 nt, Human; identical to SEQ ID NO: 388531

SEQ ID NO: 491901 - RNA, 64 nt, Human; identical to SEQ ID NO: 388532

SEQ ID NO: 491902 - RNA, 64 nt, Human; identical to SEQ ID NO: 388533

SEQ ID NO: 491903 - RNA, 64 nt, Human; identical to SEQ ID NO: 388534

SEQ ID NO: 491904 - RNA, 64 nt, Human
ccuuaugugaugggaguuaacaacucagauaaguacaccugagagcauuucuaucagguaaacu

SEQ ID NO: 491905 - RNA, 64 nt, Human
uuaccaauuuuuauucuuuauuucucaaauggaaacaccugaaaaagcauucuggagugcugaa

SEQ ID NO: 491906 - RNA, 61 nt, Human
caccaccuuauucaccuuaagagccagcgagacaccugagacaugcugaaauuauuucucu

SEQ ID NO: 491907 - RNA, 64 nt, Human; identical to SEQ ID NO: 388109

SEQ ID NO: 491908 - RNA, 64 nt, Human; identical to SEQ ID NO: 388113

SEQ ID NO: 491909 - RNA, 64 nt, Human; identical to SEQ ID NO: 388114

SEQ ID NO: 491910 - RNA, 64 nt, Human; identical to SEQ ID NO: 388115

SEQ ID NO: 491911 - RNA, 64 nt, Human; identical to SEQ ID NO: 388116

SEQ ID NO: 491912 - RNA, 64 nt, Human; identical to SEQ ID NO: 388117

SEQ ID NO: 491913 - RNA, 64 nt, Human; identical to SEQ ID NO: 388118

SEQ ID NO: 491914 - RNA, 64 nt, Human; identical to SEQ ID NO: 388119

SEQ ID NO: 491915 - RNA, 64 nt, Human; identical to SEQ ID NO: 388120

SEQ ID NO: 491916 - RNA, 64 nt, Human; identical to SEQ ID NO: 388121

SEQ ID NO: 491917 - RNA, 64 nt, Human; identical to SEQ ID NO: 388122

SEQ ID NO: 491918 - RNA, 64 nt, Human; identical to SEQ ID NO: 388123

SEQ ID NO: 491919 - RNA, 64 nt, Human; identical to SEQ ID NO: 388124

SEQ ID NO: 491920 - RNA, 64 nt, Human
cucagacccggggaaugguguggugcuaaucucaacaccugacauucacagcaagcauggccca

SEQ ID NO: 491921 - RNA, 64 nt, Human
cccagagccaccuggaucuaucccugcggccuccacaccugaacuugccuaacuaacuggcagg

SEQ ID NO: 491922 - RNA, 64 nt, Human
uguguggcauggagcauggcuguuccccaagugcacaccugaacacuuggaggaauaaaguucu

SEQ ID NO: 491923 - RNA, 64 nt, Human
gugugggaauacacaaccuacuagccuaugugaaacaccugaaaggccagaaugaggaagcccu

SEQ ID NO: 491924 - RNA, 64 nt, Human; identical to SEQ ID NO: 388125

SEQ ID NO: 491925 - RNA, 64 nt, Human; identical to SEQ ID NO: 388126

SEQ ID NO: 491926 - RNA, 57 nt, Human; identical to SEQ ID NO: 388127

SEQ ID NO: 491927 - RNA, 64 nt, Human; identical to SEQ ID NO: 388131

SEQ ID NO: 491928 - RNA, 64 nt, Human; identical to SEQ ID NO: 388132

SEQ ID NO: 491929 - RNA, 64 nt, Human; identical to SEQ ID NO: 388133

SEQ ID NO: 491930 - RNA, 64 nt, Human; identical to SEQ ID NO: 388134

SEQ ID NO: 491931 - RNA, 64 nt, Human; identical to SEQ ID NO: 388135

SEQ ID NO: 491932 - RNA, 64 nt, Human; identical to SEQ ID NO: 388136

SEQ ID NO: 491933 - RNA, 64 nt, Human; identical to SEQ ID NO: 388137

SEQ ID NO: 491934 - RNA, 64 nt, Human; identical to SEQ ID NO: 388138

SEQ ID NO: 491935 - RNA, 64 nt, Human; identical to SEQ ID NO: 388139

SEQ ID NO: 491936 - RNA, 64 nt, Human; identical to SEQ ID NO: 388140

SEQ ID NO: 491937 - RNA, 64 nt, Human; identical to SEQ ID NO: 388141

SEQ ID NO: 491938 - RNA, 64 nt, Human; identical to SEQ ID NO: 388142

SEQ ID NO: 491939 - RNA, 64 nt, Human; identical to SEQ ID NO: 388143

SEQ ID NO: 491940 - RNA, 64 nt, Human
cugcauacauccaucggcuccccauggugucuucacaccugacgaugagccaggccugagcccc

SEQ ID NO: 491941 - RNA, 64 nt, Human
ucuguacagcaccucuuguccaggugcaucucauacaccugaacucauuugcaucauuuuaacc

SEQ ID NO: 491942 - RNA, 64 nt, Human
uccaaacaggauuugccuccuccacgcucccuacacaccugagauguaaacuggcagucagugu

SEQ ID NO: 491943 - RNA, 64 nt, Human; identical to SEQ ID NO: 388144

SEQ ID NO: 491944 - RNA, 64 nt, Human; identical to SEQ ID NO: 388145

SEQ ID NO: 491945 - RNA, 64 nt, Human; identical to SEQ ID NO: 388149

SEQ ID NO: 491946 - RNA, 64 nt, Human; identical to SEQ ID NO: 388150

SEQ ID NO: 491947 - RNA, 64 nt, Human; identical to SEQ ID NO: 388151

SEQ ID NO: 491948 - RNA, 64 nt, Human; identical to SEQ ID NO: 388152

SEQ ID NO: 491949 - RNA, 58 nt, Human; identical to SEQ ID NO: 388153

SEQ ID NO: 491950 - RNA, 64 nt, Human; identical to SEQ ID NO: 388154

SEQ ID NO: 491951 - RNA, 64 nt, Human; identical to SEQ ID NO: 388155

SEQ ID NO: 491952 - RNA, 64 nt, Human; identical to SEQ ID NO: 388156

SEQ ID NO: 491953 - RNA, 59 nt, Human; identical to SEQ ID NO: 388157

SEQ ID NO: 491954 - RNA, 64 nt, Human; identical to SEQ ID NO: 388158

SEQ ID NO: 491955 - RNA, 64 nt, Human; identical to SEQ ID NO: 388159

SEQ ID NO: 491956 - RNA, 64 nt, Human; identical to SEQ ID NO: 388160

SEQ ID NO: 491957 - RNA, 64 nt, Human; identical to SEQ ID NO: 388161

SEQ ID NO: 491958 - RNA, 64 nt, Human; identical to SEQ ID NO: 388162

SEQ ID NO: 491959 - RNA, 64 nt, Human
ucaaauuguaacaauucaauugaauuuuaaaaugacaccugaaaagauacaucugauauuuucu

SEQ ID NO: 491960 - RNA, 64 nt, Human
auggggcuuucaccuucucauacccaggcaaccaacaccugauuuugucucaacuggcuagcaa

SEQ ID NO: 491961 - RNA, 64 nt, Human
ggacgcgugccggcgggaggagccacgcgugagcacaccugacacguuuuauaauagacuagcc

SEQ ID NO: 491962 - RNA, 64 nt, Human; identical to SEQ ID NO: 388163

SEQ ID NO: 491963 - RNA, 64 nt, Human; identical to SEQ ID NO: 388167

SEQ ID NO: 491964 - RNA, 64 nt, Human; identical to SEQ ID NO: 388168

SEQ ID NO: 491965 - RNA, 64 nt, Human; identical to SEQ ID NO: 388169

SEQ ID NO: 491966 - RNA, 64 nt, Human; identical to SEQ ID NO: 388170

SEQ ID NO: 491967 - RNA, 64 nt, Human; identical to SEQ ID NO: 388171

SEQ ID NO: 491968 - RNA, 64 nt, Human; identical to SEQ ID NO: 388172

SEQ ID NO: 491969 - RNA, 64 nt, Human; identical to SEQ ID NO: 388173

SEQ ID NO: 491970 - RNA, 64 nt, Human; identical to SEQ ID NO: 388174

SEQ ID NO: 491971 - RNA, 64 nt, Human; identical to SEQ ID NO: 388175

SEQ ID NO: 491972 - RNA, 64 nt, Human; identical to SEQ ID NO: 388176

SEQ ID NO: 491973 - RNA, 64 nt, Human; identical to SEQ ID NO: 388177

SEQ ID NO: 491974 - RNA, 64 nt, Human; identical to SEQ ID NO: 388178

SEQ ID NO: 491975 - RNA, 64 nt, Human; identical to SEQ ID NO: 388179

SEQ ID NO: 491976 - RNA, 64 nt, Human; identical to SEQ ID NO: 388180

SEQ ID NO: 491977 - RNA, 64 nt, Human; identical to SEQ ID NO: 388181

SEQ ID NO: 491978 - RNA, 64 nt, Human
cuggagcugggaggagagguccacuucccuuagaacaccugagcugcugcaugaguggacguca

SEQ ID NO: 491979 - RNA, 64 nt, Human
cgaggguccgcugggcccgccgccggcgagauggacaccugagaugcugugcugcgcccugccu

SEQ ID NO: 491980 - RNA, 64 nt, Human
agccuggccuuuuucugugugagaucugugcugcacaccugagggagggggagggaucggccac

SEQ ID NO: 491981 - RNA, 64 nt, Human; identical to SEQ ID NO: 388184

SEQ ID NO: 491982 - RNA, 64 nt, Human; identical to SEQ ID NO: 388185

SEQ ID NO: 491983 - RNA, 64 nt, Human; identical to SEQ ID NO: 388186

SEQ ID NO: 491984 - RNA, 64 nt, Human; identical to SEQ ID NO: 388187

SEQ ID NO: 491985 - RNA, 64 nt, Human; identical to SEQ ID NO: 388188

SEQ ID NO: 491986 - RNA, 64 nt, Human; identical to SEQ ID NO: 388189

SEQ ID NO: 491987 - RNA, 64 nt, Human; identical to SEQ ID NO: 388190

SEQ ID NO: 491988 - RNA, 64 nt, Human; identical to SEQ ID NO: 388191

SEQ ID NO: 491989 - RNA, 64 nt, Human; identical to SEQ ID NO: 388192

SEQ ID NO: 491990 - RNA, 64 nt, Human; identical to SEQ ID NO: 388193

SEQ ID NO: 491991 - RNA, 64 nt, Human; identical to SEQ ID NO: 388194

SEQ ID NO: 491992 - RNA, 64 nt, Human; identical to SEQ ID NO: 388195

SEQ ID NO: 491993 - RNA, 64 nt, Human; identical to SEQ ID NO: 388196

SEQ ID NO: 491994 - RNA, 64 nt, Human; identical to SEQ ID NO: 388197

SEQ ID NO: 491995 - RNA, 64 nt, Human; identical to SEQ ID NO: 388198

SEQ ID NO: 491996 - RNA, 64 nt, Human; identical to SEQ ID NO: 388202

SEQ ID NO: 491997 - RNA, 64 nt, Human
auuccauuuuuguuugguugguuuuggcuuuggcacaccugaguuagguuuucuugccuuggaa

SEQ ID NO: 491998 - RNA, 64 nt, Human
gggcauccauuccuaagccagacccggcuccccuacaccugaaguuacacugccagcaguuccc

SEQ ID NO: 491999 - RNA, 64 nt, Human
gggagggaaagacaagaugcaacuaggaagagacacaccugaccagccccuccccccaggcuca

SEQ ID NO: 492000 - RNA, 64 nt, Human; identical to SEQ ID NO: 388203

SEQ ID NO: 492001 - RNA, 64 nt, Human; identical to SEQ ID NO: 388204

SEQ ID NO: 492002 - RNA, 64 nt, Human; identical to SEQ ID NO: 388205

SEQ ID NO: 492003 - RNA, 64 nt, Human; identical to SEQ ID NO: 388206

SEQ ID NO: 492004 - RNA, 64 nt, Human; identical to SEQ ID NO: 388207

SEQ ID NO: 492005 - RNA, 64 nt, Human; identical to SEQ ID NO: 388208

SEQ ID NO: 492006 - RNA, 64 nt, Human; identical to SEQ ID NO: 388209

SEQ ID NO: 492007 - RNA, 64 nt, Human; identical to SEQ ID NO: 388210

SEQ ID NO: 492008 - RNA, 64 nt, Human; identical to SEQ ID NO: 388211

SEQ ID NO: 492009 - RNA, 64 nt, Human; identical to SEQ ID NO: 388212

SEQ ID NO: 492010 - RNA, 64 nt, Human; identical to SEQ ID NO: 388213

SEQ ID NO: 492011 - RNA, 64 nt, Human; identical to SEQ ID NO: 388214

SEQ ID NO: 492012 - RNA, 64 nt, Human; identical to SEQ ID NO: 388215

SEQ ID NO: 492013 - RNA, 64 nt, Human; identical to SEQ ID NO: 388216

SEQ ID NO: 492014 - RNA, 64 nt, Human; identical to SEQ ID NO: 388220

SEQ ID NO: 492015 - RNA, 64 nt, Human; identical to SEQ ID NO: 388221

SEQ ID NO: 492016 - RNA, 64 nt, Human
agucuccauugcagaauugucgugcuuugagaaaacaccugaggcagugugggaguugaacgac

SEQ ID NO: 492017 - RNA, 64 nt, Human
cguucuggcaucacuuggccuuucuggaugcuggacaccugaagcuuggaacucaccuggccga

SEQ ID NO: 492018 - RNA, 64 nt, Human
uugaugguuaagacagguuuauuuuagagaaaacacaccugagaggggcugcuggcugaauuag

SEQ ID NO: 492019 - RNA, 64 nt, Human; identical to SEQ ID NO: 388222

SEQ ID NO: 492020 - RNA, 64 nt, Human; identical to SEQ ID NO: 388223

SEQ ID NO: 492021 - RNA, 64 nt, Human; identical to SEQ ID NO: 388224

SEQ ID NO: 492022 - RNA, 64 nt, Human; identical to SEQ ID NO: 388225

SEQ ID NO: 492023 - RNA, 64 nt, Human; identical to SEQ ID NO: 388226

SEQ ID NO: 492024 - RNA, 64 nt, Human; identical to SEQ ID NO: 388227

SEQ ID NO: 492025 - RNA, 59 nt, Human; identical to SEQ ID NO: 388228

SEQ ID NO: 492026 - RNA, 64 nt, Human; identical to SEQ ID NO: 388229

SEQ ID NO: 492027 - RNA, 64 nt, Human; identical to SEQ ID NO: 388230

SEQ ID NO: 492028 - RNA, 64 nt, Human; identical to SEQ ID NO: 388231

SEQ ID NO: 492029 - RNA, 64 nt, Human; identical to SEQ ID NO: 388232

SEQ ID NO: 492030 - RNA, 64 nt, Human; identical to SEQ ID NO: 388233

SEQ ID NO: 492031 - RNA, 64 nt, Human; identical to SEQ ID NO: 388234

SEQ ID NO: 492032 - RNA, 64 nt, Human; identical to SEQ ID NO: 388238

SEQ ID NO: 492033 - RNA, 64 nt, Human; identical to SEQ ID NO: 388239

SEQ ID NO: 492034 - RNA, 64 nt, Human; identical to SEQ ID NO: 388240

SEQ ID NO: 492035 - RNA, 64 nt, Human
aaugucaguaggagacuuaaccuuaguguguuacacaccugacuuaacaucucuaaacucagau

SEQ ID NO: 492036 - RNA, 64 nt, Human
ugguuccugagcccccacccccaaucccagugcuacaccugagguucuggagcucagaaucuga

SEQ ID NO: 492037 - RNA, 64 nt, Human
ugggguuucacuauguuggccaggcuggucucgaacaccugaccucgugguccacccgccucgg

SEQ ID NO: 492038 - RNA, 64 nt, Human; identical to SEQ ID NO: 388241

SEQ ID NO: 492039 - RNA, 64 nt, Human; identical to SEQ ID NO: 388242

SEQ ID NO: 492040 - RNA, 64 nt, Human; identical to SEQ ID NO: 388243

SEQ ID NO: 492041 - RNA, 64 nt, Human; identical to SEQ ID NO: 388244

SEQ ID NO: 492042 - RNA, 64 nt, Human; identical to SEQ ID NO: 388245

SEQ ID NO: 492043 - RNA, 64 nt, Human; identical to SEQ ID NO: 388246

SEQ ID NO: 492044 - RNA, 64 nt, Human; identical to SEQ ID NO: 388247

SEQ ID NO: 492045 - RNA, 64 nt, Human; identical to SEQ ID NO: 388248

SEQ ID NO: 492046 - RNA, 64 nt, Human; identical to SEQ ID NO: 388249

SEQ ID NO: 492047 - RNA, 64 nt, Human; identical to SEQ ID NO: 388250

SEQ ID NO: 492048 - RNA, 64 nt, Human; identical to SEQ ID NO: 388251

SEQ ID NO: 492049 - RNA, 64 nt, Human; identical to SEQ ID NO: 388252

SEQ ID NO: 492050 - RNA, 64 nt, Human; identical to SEQ ID NO: 388256

SEQ ID NO: 492051 - RNA, 64 nt, Human; identical to SEQ ID NO: 388257

SEQ ID NO: 492052 - RNA, 64 nt, Human; identical to SEQ ID NO: 388258

SEQ ID NO: 492053 - RNA, 64 nt, Human; identical to SEQ ID NO: 388259

SEQ ID NO: 492054 - RNA, 64 nt, Human
ggacaggaggaugaaaugagaucccagaguccucacaccugaaugaauuauacaugugccuuac

SEQ ID NO: 492055 - RNA, 64 nt, Human
ucccucccugguagccucuaaccagcauucccagacaccugaggcagauagauggaugggcugg

SEQ ID NO: 492056 - RNA, 61 nt, Human
uuggugcccucuucggcagccaagggugaaggccccauagaggagaggauccaaaggagca

SEQ ID NO: 492057 - RNA, 64 nt, Human; identical to SEQ ID NO: 388260

SEQ ID NO: 492058 - RNA, 64 nt, Human; identical to SEQ ID NO: 388261

SEQ ID NO: 492059 - RNA, 64 nt, Human; identical to SEQ ID NO: 388262

SEQ ID NO: 492060 - RNA, 64 nt, Human; identical to SEQ ID NO: 388263

SEQ ID NO: 492061 - RNA, 64 nt, Human; identical to SEQ ID NO: 388264

SEQ ID NO: 492062 - RNA, 64 nt, Human; identical to SEQ ID NO: 388265

SEQ ID NO: 492063 - RNA, 64 nt, Human; identical to SEQ ID NO: 388266

SEQ ID NO: 492064 - RNA, 64 nt, Human; identical to SEQ ID NO: 388267

SEQ ID NO: 492065 - RNA, 64 nt, Human; identical to SEQ ID NO: 388268

SEQ ID NO: 492066 - RNA, 64 nt, Human; identical to SEQ ID NO: 388269

SEQ ID NO: 492067 - RNA, 64 nt, Human; identical to SEQ ID NO: 388270

SEQ ID NO: 492068 - RNA, 64 nt, Human; identical to SEQ ID NO: 388274

SEQ ID NO: 492069 - RNA, 64 nt, Human; identical to SEQ ID NO: 388275

SEQ ID NO: 492070 - RNA, 64 nt, Human; identical to SEQ ID NO: 388276

SEQ ID NO: 492071 - RNA, 64 nt, Human; identical to SEQ ID NO: 388277

SEQ ID NO: 492072 - RNA, 64 nt, Human; identical to SEQ ID NO: 388278

SEQ ID NO: 492073 - RNA, 51 nt, Human
aaggaacugaaagagauugagccaccacacgagcaauucacaaaggucugu

SEQ ID NO: 492074 - RNA, 64 nt, Human
cagccucccgaguagcugggauuacaggcaugcaccaccacaccuggcuaauuuuuguguuuuu

SEQ ID NO: 492075 - RNA, 64 nt, Human
cagccucccgaguagcugagauuauaggcgugcaccaccacaccuggcuaauuuuuguauuuuu

SEQ ID NO: 492076 - RNA, 64 nt, Human; identical to SEQ ID NO: 388279

SEQ ID NO: 492077 - RNA, 64 nt, Human; identical to SEQ ID NO: 388280

SEQ ID NO: 492078 - RNA, 64 nt, Human; identical to SEQ ID NO: 388281

SEQ ID NO: 492079 - RNA, 64 nt, Human; identical to SEQ ID NO: 388282

SEQ ID NO: 492080 - RNA, 64 nt, Human; identical to SEQ ID NO: 388283

SEQ ID NO: 492081 - RNA, 64 nt, Human; identical to SEQ ID NO: 388284

SEQ ID NO: 492082 - RNA, 64 nt, Human; identical to SEQ ID NO: 388285

SEQ ID NO: 492083 - RNA, 64 nt, Human; identical to SEQ ID NO: 388286

SEQ ID NO: 492084 - RNA, 64 nt, Human; identical to SEQ ID NO: 388287

SEQ ID NO: 492085 - RNA, 64 nt, Human; identical to SEQ ID NO: 388288

SEQ ID NO: 492086 - RNA, 64 nt, Human; identical to SEQ ID NO: 388292

SEQ ID NO: 492087 - RNA, 64 nt, Human; identical to SEQ ID NO: 388293

SEQ ID NO: 492088 - RNA, 64 nt, Human; identical to SEQ ID NO: 388294

SEQ ID NO: 492089 - RNA, 64 nt, Human; identical to SEQ ID NO: 388295

SEQ ID NO: 492090 - RNA, 64 nt, Human; identical to SEQ ID NO: 388296

SEQ ID NO: 492091 - RNA, 64 nt, Human; identical to SEQ ID NO: 388297

SEQ ID NO: 492092 - RNA, 64 nt, Human
cuuuuuuugcauauuaaagauaagacuuccucuaccaccacaccaaaugacuacuacacacugc

SEQ ID NO: 492093 - RNA, 64 nt, Human
augaugugucaccccacauuggcaccuccuacuaccaccacacaaacuuaguucauaugcucuu

SEQ ID NO: 492094 - RNA, 64 nt, Human
guagggugaggcgugggauccagagagaagcaccccaccacacacacccuuccccacucccgug

SEQ ID NO: 492095 - RNA, 64 nt, Human; identical to SEQ ID NO: 388298

SEQ ID NO: 492096 - RNA, 64 nt, Human; identical to SEQ ID NO: 388299

SEQ ID NO: 492097 - RNA, 64 nt, Human; identical to SEQ ID NO: 388300

SEQ ID NO: 492098 - RNA, 64 nt, Human; identical to SEQ ID NO: 388301

SEQ ID NO: 492099 - RNA, 64 nt, Human; identical to SEQ ID NO: 388302

SEQ ID NO: 492100 - RNA, 64 nt, Human; identical to SEQ ID NO: 388303

SEQ ID NO: 492101 - RNA, 64 nt, Human; identical to SEQ ID NO: 388304

SEQ ID NO: 492102 - RNA, 64 nt, Human; identical to SEQ ID NO: 388305

SEQ ID NO: 492103 - RNA, 64 nt, Human; identical to SEQ ID NO: 388306

SEQ ID NO: 492104 - RNA, 64 nt, Human; identical to SEQ ID NO: 388310

SEQ ID NO: 492105 - RNA, 64 nt, Human; identical to SEQ ID NO: 388311

SEQ ID NO: 492106 - RNA, 64 nt, Human; identical to SEQ ID NO: 388312

SEQ ID NO: 492107 - RNA, 64 nt, Human; identical to SEQ ID NO: 388313

SEQ ID NO: 492108 - RNA, 64 nt, Human; identical to SEQ ID NO: 388314

SEQ ID NO: 492109 - RNA, 64 nt, Human; identical to SEQ ID NO: 388315

SEQ ID NO: 492110 - RNA, 64 nt, Human; identical to SEQ ID NO: 388316

SEQ ID NO: 492111 - RNA, 64 nt, Human
ucucccagugcuaucccuccccccucccccgaccccaccacaguccccagagugugauauuccc

SEQ ID NO: 492112 - RNA, 64 nt, Human
cagccuccugaguagcugggacuacaguugugcaccaccacaccaaacaagaauugauuauauu

SEQ ID NO: 492113 - RNA, 64 nt, Human
uucaggagcuccauacacacgcugccuucgguacccaccacacaacauccaaguggccuccguc

SEQ ID NO: 492114 - RNA, 64 nt, Human; identical to SEQ ID NO: 388317

SEQ ID NO: 492115 - RNA, 64 nt, Human; identical to SEQ ID NO: 388318

SEQ ID NO: 492116 - RNA, 64 nt, Human; identical to SEQ ID NO: 388319

SEQ ID NO: 492117 - RNA, 64 nt, Human; identical to SEQ ID NO: 388320

SEQ ID NO: 492118 - RNA, 64 nt, Human; identical to SEQ ID NO: 388321

SEQ ID NO: 492119 - RNA, 64 nt, Human; identical to SEQ ID NO: 388322

SEQ ID NO: 492120 - RNA, 64 nt, Human; identical to SEQ ID NO: 388323

SEQ ID NO: 492121 - RNA, 64 nt, Human; identical to SEQ ID NO: 388324

SEQ ID NO: 492122 - RNA, 64 nt, Human; identical to SEQ ID NO: 388328

SEQ ID NO: 492123 - RNA, 64 nt, Human; identical to SEQ ID NO: 388329

SEQ ID NO: 492124 - RNA, 64 nt, Human; identical to SEQ ID NO: 388330

SEQ ID NO: 492125 - RNA, 64 nt, Human; identical to SEQ ID NO: 388331

SEQ ID NO: 492126 - RNA, 64 nt, Human; identical to SEQ ID NO: 388332

SEQ ID NO: 492127 - RNA, 64 nt, Human; identical to SEQ ID NO: 388333

SEQ ID NO: 492128 - RNA, 64 nt, Human; identical to SEQ ID NO: 388334

SEQ ID NO: 492129 - RNA, 64 nt, Human; identical to SEQ ID NO: 388335

SEQ ID NO: 492130 - RNA, 64 nt, Human
cucuuuuuuuuuuguaaagauuaacuccaccucaccaccacaaugagguauuuuucucagcaau

SEQ ID NO: 492131 - RNA, 64 nt, Human; identical to SEQ ID NO: 388336

SEQ ID NO: 492132 - RNA, 64 nt, Human; identical to SEQ ID NO: 388337

SEQ ID NO: 492133 - RNA, 64 nt, Human; identical to SEQ ID NO: 388338

SEQ ID NO: 492134 - RNA, 64 nt, Human; identical to SEQ ID NO: 388339

SEQ ID NO: 492135 - RNA, 64 nt, Human; identical to SEQ ID NO: 388340

SEQ ID NO: 492136 - RNA, 64 nt, Human; identical to SEQ ID NO: 388341

SEQ ID NO: 492137 - RNA, 64 nt, Human; identical to SEQ ID NO: 388342

SEQ ID NO: 492138 - RNA, 64 nt, Human; identical to SEQ ID NO: 388345

SEQ ID NO: 492139 - RNA, 64 nt, Human; identical to SEQ ID NO: 388346

SEQ ID NO: 492140 - RNA, 64 nt, Human; identical to SEQ ID NO: 388347

SEQ ID NO: 492141 - RNA, 64 nt, Human; identical to SEQ ID NO: 388348

SEQ ID NO: 492142 - RNA, 64 nt, Human; identical to SEQ ID NO: 388349

SEQ ID NO: 492143 - RNA, 64 nt, Human; identical to SEQ ID NO: 388350

SEQ ID NO: 492144 - RNA, 64 nt, Human; identical to SEQ ID NO: 388351

SEQ ID NO: 492145 - RNA, 64 nt, Human; identical to SEQ ID NO: 388352

SEQ ID NO: 492146 - RNA, 64 nt, Human; identical to SEQ ID NO: 388353

SEQ ID NO: 492147 - RNA, 61 nt, Human
agcugguaaaugaauuugaaucgacauaguagccccauaagcaucagcccuguagagugag

SEQ ID NO: 492148 - RNA, 61 nt, Human
gacagagcuguccaauagaaauauaaugugagccccauauacaauuuuuacauuucuaaua

SEQ ID NO: 492149 - RNA, 61 nt, Human
agguguccugcugcuguuaccagccaugugggccccauaggggcacugcgccugcugcccu

SEQ ID NO: 492150 - RNA, 64 nt, Human; identical to SEQ ID NO: 388354

SEQ ID NO: 492151 - RNA, 64 nt, Human; identical to SEQ ID NO: 388355

SEQ ID NO: 492152 - RNA, 64 nt, Human; identical to SEQ ID NO: 388356

SEQ ID NO: 492153 - RNA, 64 nt, Human; identical to SEQ ID NO: 388357

SEQ ID NO: 492154 - RNA, 64 nt, Human; identical to SEQ ID NO: 388358

SEQ ID NO: 492155 - RNA, 64 nt, Human; identical to SEQ ID NO: 388359

SEQ ID NO: 492156 - RNA, 64 nt, Human; identical to SEQ ID NO: 388363

SEQ ID NO: 492157 - RNA, 64 nt, Human; identical to SEQ ID NO: 388364

SEQ ID NO: 492158 - RNA, 64 nt, Human; identical to SEQ ID NO: 388365

SEQ ID NO: 492159 - RNA, 64 nt, Human; identical to SEQ ID NO: 388366

SEQ ID NO: 492160 - RNA, 64 nt, Human; identical to SEQ ID NO: 388367

SEQ ID NO: 492161 - RNA, 64 nt, Human; identical to SEQ ID NO: 388368

SEQ ID NO: 492162 - RNA, 64 nt, Human; identical to SEQ ID NO: 388369

SEQ ID NO: 492163 - RNA, 64 nt, Human; identical to SEQ ID NO: 388370

SEQ ID NO: 492164 - RNA, 64 nt, Human; identical to SEQ ID NO: 388371

SEQ ID NO: 492165 - RNA, 64 nt, Human; identical to SEQ ID NO: 388372

SEQ ID NO: 492166 - RNA, 61 nt, Human
guugggaaccucauuagaaaugaccucagcugccccauaucuacguuccuuucagcaguug

SEQ ID NO: 492167 - RNA, 61 nt, Human
aaauuuuagauuuaccuuguuagaagagguggccccauauuaacaaauugcauuuguggga

SEQ ID NO: 492168 - RNA, 61 nt, Human
gagcaggcggguguccccguccucccucacugccccauaugugucccuccuaaagcugcau

SEQ ID NO: 492169 - RNA, 64 nt, Human; identical to SEQ ID NO: 388373

SEQ ID NO: 492170 - RNA, 64 nt, Human; identical to SEQ ID NO: 388374

SEQ ID NO: 492171 - RNA, 64 nt, Human; identical to SEQ ID NO: 388375

SEQ ID NO: 492172 - RNA, 63 nt, Human; identical to SEQ ID NO: 388376

SEQ ID NO: 492173 - RNA, 64 nt, Human; identical to SEQ ID NO: 388377

SEQ ID NO: 492174 - RNA, 64 nt, Human; identical to SEQ ID NO: 388381

SEQ ID NO: 492175 - RNA, 64 nt, Human; identical to SEQ ID NO: 388382

SEQ ID NO: 492176 - RNA, 64 nt, Human; identical to SEQ ID NO: 388383

SEQ ID NO: 492177 - RNA, 64 nt, Human; identical to SEQ ID NO: 388384

SEQ ID NO: 492178 - RNA, 64 nt, Human; identical to SEQ ID NO: 388385

SEQ ID NO: 492179 - RNA, 64 nt, Human; identical to SEQ ID NO: 388386

SEQ ID NO: 492180 - RNA, 64 nt, Human; identical to SEQ ID NO: 388387

SEQ ID NO: 492181 - RNA, 64 nt, Human; identical to SEQ ID NO: 388388

SEQ ID NO: 492182 - RNA, 64 nt, Human; identical to SEQ ID NO: 388389

SEQ ID NO: 492183 - RNA, 64 nt, Human; identical to SEQ ID NO: 388390

SEQ ID NO: 492184 - RNA, 64 nt, Human; identical to SEQ ID NO: 388391

SEQ ID NO: 492185 - RNA, 64 nt, Human
caccugcucucaccugagccccaggugaaggggcccggaacaccugcucucaccugagccccag

SEQ ID NO: 492186 - RNA, 64 nt, Human; identical to SEQ ID NO: 492185

SEQ ID NO: 492187 - RNA, 64 nt, Human
caccugcucucaccugagccccuggugaaggggcccggaacacuugcucucaccugagccccag

SEQ ID NO: 492188 - RNA, 64 nt, Human; identical to SEQ ID NO: 388392

SEQ ID NO: 492189 - RNA, 64 nt, Human; identical to SEQ ID NO: 388393

SEQ ID NO: 492190 - RNA, 64 nt, Human; identical to SEQ ID NO: 388394

SEQ ID NO: 492191 - RNA, 64 nt, Human; identical to SEQ ID NO: 388395

SEQ ID NO: 492192 - RNA, 64 nt, Human; identical to SEQ ID NO: 388399

SEQ ID NO: 492193 - RNA, 64 nt, Human; identical to SEQ ID NO: 388400

SEQ ID NO: 492194 - RNA, 64 nt, Human; identical to SEQ ID NO: 388401

SEQ ID NO: 492195 - RNA, 64 nt, Human; identical to SEQ ID NO: 388402

SEQ ID NO: 492196 - RNA, 64 nt, Human; identical to SEQ ID NO: 388403

SEQ ID NO: 492197 - RNA, 64 nt, Human; identical to SEQ ID NO: 388404

SEQ ID NO: 492198 - RNA, 64 nt, Human; identical to SEQ ID NO: 388405

SEQ ID NO: 492199 - RNA, 64 nt, Human; identical to SEQ ID NO: 388406

SEQ ID NO: 492200 - RNA, 57 nt, Human; identical to SEQ ID NO: 388407

SEQ ID NO: 492201 - RNA, 64 nt, Human; identical to SEQ ID NO: 388408

SEQ ID NO: 492202 - RNA, 64 nt, Human; identical to SEQ ID NO: 388409

SEQ ID NO: 492203 - RNA, 64 nt, Human; identical to SEQ ID NO: 388410

SEQ ID NO: 492204 - RNA, 61 nt, Human
aguuaaaacaaaacauggaugucugggucccgccccauagagaaugacuuaauuggcaugg

SEQ ID NO: 492205 - RNA, 61 nt, Human
uuccccucaccuuaaaggagacuaccccuuugccccauauugucaaccuaauuuucucucg

SEQ ID NO: 492206 - RNA, 61 nt, Human
gacaggauacuacagguggccugcugaggcugccccauauuuuagaaaauguaaaaauggu

SEQ ID NO: 492207 - RNA, 64 nt, Human; identical to SEQ ID NO: 388411

SEQ ID NO: 492208 - RNA, 64 nt, Human; identical to SEQ ID NO: 388412

SEQ ID NO: 492209 - RNA, 64 nt, Human; identical to SEQ ID NO: 388413

SEQ ID NO: 492210 - RNA, 64 nt, Human; identical to SEQ ID NO: 388417

SEQ ID NO: 492211 - RNA, 64 nt, Human; identical to SEQ ID NO: 388418

SEQ ID NO: 492212 - RNA, 64 nt, Human; identical to SEQ ID NO: 388419

SEQ ID NO: 492213 - RNA, 64 nt, Human; identical to SEQ ID NO: 388420

SEQ ID NO: 492214 - RNA, 64 nt, Human; identical to SEQ ID NO: 388421

SEQ ID NO: 492215 - RNA, 55 nt, Human; identical to SEQ ID NO: 388422

SEQ ID NO: 492216 - RNA, 64 nt, Human; identical to SEQ ID NO: 388423

SEQ ID NO: 492217 - RNA, 64 nt, Human; identical to SEQ ID NO: 388424

SEQ ID NO: 492218 - RNA, 64 nt, Human; identical to SEQ ID NO: 388425

SEQ ID NO: 492219 - RNA, 64 nt, Human; identical to SEQ ID NO: 388426

SEQ ID NO: 492220 - RNA, 64 nt, Human; identical to SEQ ID NO: 388427

SEQ ID NO: 492221 - RNA, 64 nt, Human; identical to SEQ ID NO: 388428

SEQ ID NO: 492222 - RNA, 64 nt, Human; identical to SEQ ID NO: 388429

SEQ ID NO: 492223 - RNA, 61 nt, Human
aguguaugcauauguauauguacauagggaagccccauauguauauaguauguuguacacu

SEQ ID NO: 492224 - RNA, 61 nt, Human
auucauauuuagccauaguauaugauagauugccccauaacauaguuuuucaucaagaguu

SEQ ID NO: 492225 - RNA, 61 nt, Human
uccauucuugacauucaguuaguccagaucugccccauaauuugcuuuaguaaagucacuu

SEQ ID NO: 492226 - RNA, 64 nt, Human; identical to SEQ ID NO: 388430

SEQ ID NO: 492227 - RNA, 64 nt, Human; identical to SEQ ID NO: 388431

SEQ ID NO: 492228 - RNA, 64 nt, Human; identical to SEQ ID NO: 388435

SEQ ID NO: 492229 - RNA, 64 nt, Human; identical to SEQ ID NO: 388436

SEQ ID NO: 492230 - RNA, 64 nt, Human; identical to SEQ ID NO: 388437

SEQ ID NO: 492231 - RNA, 64 nt, Human; identical to SEQ ID NO: 388438

SEQ ID NO: 492232 - RNA, 64 nt, Human; identical to SEQ ID NO: 388439

SEQ ID NO: 492233 - RNA, 64 nt, Human; identical to SEQ ID NO: 388440

SEQ ID NO: 492234 - RNA, 64 nt, Human; identical to SEQ ID NO: 388441

SEQ ID NO: 492235 - RNA, 64 nt, Human; identical to SEQ ID NO: 388442

SEQ ID NO: 492236 - RNA, 64 nt, Human; identical to SEQ ID NO: 388443

SEQ ID NO: 492237 - RNA, 64 nt, Human; identical to SEQ ID NO: 388444

SEQ ID NO: 492238 - RNA, 64 nt, Human; identical to SEQ ID NO: 388445

SEQ ID NO: 492239 - RNA, 64 nt, Human; identical to SEQ ID NO: 388446

SEQ ID NO: 492240 - RNA, 64 nt, Human; identical to SEQ ID NO: 388447

SEQ ID NO: 492241 - RNA, 64 nt, Human; identical to SEQ ID NO: 388448

SEQ ID NO: 492242 - RNA, 61 nt, Human
ccagcccugaugauuggccccaccuccugcugccccauaacccucucuucauuucggcuuu

SEQ ID NO: 492243 - RNA, 61 nt, Human
ggguggggaugcaggaccccacucugcgggagccccauagccaccucucuugcccaaggug

SEQ ID NO: 492244 - RNA, 61 nt, Human
uggcccugccccuaggucugggugggcaguggccccauagccucuggaacugugcguucug

SEQ ID NO: 492245 - RNA, 64 nt, Human; identical to SEQ ID NO: 388449

SEQ ID NO: 492246 - RNA, 64 nt, Human; identical to SEQ ID NO: 388453

SEQ ID NO: 492247 - RNA, 64 nt, Human; identical to SEQ ID NO: 388454

SEQ ID NO: 492248 - RNA, 64 nt, Human; identical to SEQ ID NO: 388455

SEQ ID NO: 492249 - RNA, 64 nt, Human; identical to SEQ ID NO: 388456

SEQ ID NO: 492250 - RNA, 64 nt, Human; identical to SEQ ID NO: 388457

SEQ ID NO: 492251 - RNA, 64 nt, Human; identical to SEQ ID NO: 388458

SEQ ID NO: 492252 - RNA, 64 nt, Human; identical to SEQ ID NO: 388459

SEQ ID NO: 492253 - RNA, 64 nt, Human; identical to SEQ ID NO: 388460

SEQ ID NO: 492254 - RNA, 64 nt, Human; identical to SEQ ID NO: 388461

SEQ ID NO: 492255 - RNA, 64 nt, Human; identical to SEQ ID NO: 388462

SEQ ID NO: 492256 - RNA, 64 nt, Human; identical to SEQ ID NO: 388463

SEQ ID NO: 492257 - RNA, 64 nt, Human; identical to SEQ ID NO: 388464

SEQ ID NO: 492258 - RNA, 57 nt, Human; identical to SEQ ID NO: 388465

SEQ ID NO: 492259 - RNA, 64 nt, Human; identical to SEQ ID NO: 388466

SEQ ID NO: 492260 - RNA, 64 nt, Human; identical to SEQ ID NO: 388467

SEQ ID NO: 492261 - RNA, 61 nt, Human
uuccaagaguuacuguccacccggugguguggccccauagcgaagucuaaaugccuguaga

SEQ ID NO: 492262 - RNA, 64 nt, Human; identical to SEQ ID NO: 242455

SEQ ID NO: 492263 - RNA, 64 nt, Human; identical to SEQ ID NO: 388471

SEQ ID NO: 492264 - RNA, 64 nt, Human; identical to SEQ ID NO: 388472

SEQ ID NO: 492265 - RNA, 64 nt, Human; identical to SEQ ID NO: 388473

SEQ ID NO: 492266 - RNA, 64 nt, Human; identical to SEQ ID NO: 388474

SEQ ID NO: 492267 - RNA, 64 nt, Human; identical to SEQ ID NO: 388475

SEQ ID NO: 492268 - RNA, 64 nt, Human; identical to SEQ ID NO: 388476

SEQ ID NO: 492269 - RNA, 64 nt, Human; identical to SEQ ID NO: 388477

SEQ ID NO: 492270 - RNA, 64 nt, Human; identical to SEQ ID NO: 388478

SEQ ID NO: 492271 - RNA, 64 nt, Human; identical to SEQ ID NO: 388479

SEQ ID NO: 492272 - RNA, 64 nt, Human; identical to SEQ ID NO: 388480

SEQ ID NO: 492273 - RNA, 64 nt, Human; identical to SEQ ID NO: 388481

SEQ ID NO: 492274 - RNA, 64 nt, Human; identical to SEQ ID NO: 388482

SEQ ID NO: 492275 - RNA, 64 nt, Human; identical to SEQ ID NO: 388483

SEQ ID NO: 492276 - RNA, 64 nt, Human; identical to SEQ ID NO: 388484

SEQ ID NO: 492277 - RNA, 64 nt, Human; identical to SEQ ID NO: 388485

SEQ ID NO: 492278 - RNA, 64 nt, Human; identical to SEQ ID NO: 388489

SEQ ID NO: 492279 - RNA, 64 nt, Human; identical to SEQ ID NO: 242258

SEQ ID NO: 492280 - RNA, 64 nt, Human; identical to SEQ ID NO: 240619

SEQ ID NO: 492281 - RNA, 64 nt, Human; identical to SEQ ID NO: 300271

SEQ ID NO: 492282 - RNA, 64 nt, Human; identical to SEQ ID NO: 388490

SEQ ID NO: 492283 - RNA, 64 nt, Human; identical to SEQ ID NO: 388491

SEQ ID NO: 492284 - RNA, 64 nt, Human; identical to SEQ ID NO: 388492

SEQ ID NO: 492285 - RNA, 64 nt, Human; identical to SEQ ID NO: 388493

SEQ ID NO: 492286 - RNA, 64 nt, Human; identical to SEQ ID NO: 388494

SEQ ID NO: 492287 - RNA, 64 nt, Human; identical to SEQ ID NO: 388495

SEQ ID NO: 492288 - RNA, 64 nt, Human; identical to SEQ ID NO: 388496

SEQ ID NO: 492289 - RNA, 64 nt, Human; identical to SEQ ID NO: 388497

SEQ ID NO: 492290 - RNA, 64 nt, Human; identical to SEQ ID NO: 388498

SEQ ID NO: 492291 - RNA, 64 nt, Human; identical to SEQ ID NO: 388499

SEQ ID NO: 492292 - RNA, 64 nt, Human; identical to SEQ ID NO: 388500

SEQ ID NO: 492293 - RNA, 64 nt, Human; identical to SEQ ID NO: 388501

SEQ ID NO: 492294 - RNA, 64 nt, Human; identical to SEQ ID NO: 388502

SEQ ID NO: 492295 - RNA, 64 nt, Human; identical to SEQ ID NO: 388503

SEQ ID NO: 492296 - RNA, 64 nt, Human; identical to SEQ ID NO: 388505

SEQ ID NO: 492297 - RNA, 64 nt, Human; identical to SEQ ID NO: 388506

SEQ ID NO: 492298 - RNA, 64 nt, Human; identical to SEQ ID NO: 300279

SEQ ID NO: 492299 - RNA, 64 nt, Human; identical to SEQ ID NO: 300289

SEQ ID NO: 492300 - RNA, 64 nt, Human; identical to SEQ ID NO: 300296

SEQ ID NO: 492301 - RNA, 64 nt, Human; identical to SEQ ID NO: 388507

SEQ ID NO: 492302 - RNA, 64 nt, Human; identical to SEQ ID NO: 388508

SEQ ID NO: 492303 - RNA, 64 nt, Human; identical to SEQ ID NO: 388509

SEQ ID NO: 492304 - RNA, 59 nt, Human; identical to SEQ ID NO: 388510

SEQ ID NO: 492305 - RNA, 64 nt, Human; identical to SEQ ID NO: 388511

SEQ ID NO: 492306 - RNA, 64 nt, Human; identical to SEQ ID NO: 388512

SEQ ID NO: 492307 - RNA, 64 nt, Human; identical to SEQ ID NO: 388513

SEQ ID NO: 492308 - RNA, 64 nt, Human; identical to SEQ ID NO: 388514

SEQ ID NO: 492309 - RNA, 64 nt, Human; identical to SEQ ID NO: 388515

SEQ ID NO: 492310 - RNA, 64 nt, Human; identical to SEQ ID NO: 388516

SEQ ID NO: 492311 - RNA, 64 nt, Human; identical to SEQ ID NO: 388517

SEQ ID NO: 492312 - RNA, 64 nt, Human; identical to SEQ ID NO: 388518

SEQ ID NO: 492313 - RNA, 64 nt, Human; identical to SEQ ID NO: 388519

SEQ ID NO: 492314 - RNA, 64 nt, Human; identical to SEQ ID NO: 388523

SEQ ID NO: 492315 - RNA, 64 nt, Human; identical to SEQ ID NO: 388524

SEQ ID NO: 492316 - RNA, 64 nt, Human; identical to SEQ ID NO: 388525

SEQ ID NO: 492317 - RNA, 64 nt, Human; identical to SEQ ID NO: 300306

SEQ ID NO: 492318 - RNA, 64 nt, Human; identical to SEQ ID NO: 300313

SEQ ID NO: 492319 - RNA, 64 nt, Human; identical to SEQ ID NO: 300318

SEQ ID NO: 492320 - RNA, 64 nt, Human; identical to SEQ ID NO: 388526

SEQ ID NO: 492321 - RNA, 64 nt, Human; identical to SEQ ID NO: 388527

SEQ ID NO: 492322 - RNA, 64 nt, Human; identical to SEQ ID NO: 388528

SEQ ID NO: 492323 - RNA, 58 nt, Human; identical to SEQ ID NO: 388529

SEQ ID NO: 492324 - RNA, 64 nt, Human; identical to SEQ ID NO: 388530

SEQ ID NO: 492325 - RNA, 64 nt, Human; identical to SEQ ID NO: 388531

SEQ ID NO: 492326 - RNA, 64 nt, Human; identical to SEQ ID NO: 388532

SEQ ID NO: 492327 - RNA, 64 nt, Human; identical to SEQ ID NO: 388533

SEQ ID NO: 492328 - RNA, 64 nt, Human; identical to SEQ ID NO: 388534

SEQ ID NO: 492329 - RNA, 64 nt, Human; identical to SEQ ID NO: 195072

SEQ ID NO: 492330 - RNA, 64 nt, Human; identical to SEQ ID NO: 195073

SEQ ID NO: 492331 - RNA, 64 nt, Human
cagccuccugaguagcugggauuacaggcauguaccaccacacccagcuaauuuuguauuuuua

SEQ ID NO: 492332 - RNA, 64 nt, Human
acgggacgggguagagccaggggugauggaggaaccaccacagcagugccuucucgucgaagcg

SEQ ID NO: 492333 - RNA, 64 nt, Human
ccauccacucuacccucccacccccuucucugcuccaccacauccuccguccagccgccauugc

SEQ ID NO: 492334 - RNA, 64 nt, Human; identical to SEQ ID NO: 195074

SEQ ID NO: 492335 - RNA, 64 nt, Human; identical to SEQ ID NO: 195075

SEQ ID NO: 492336 - RNA, 64 nt, Human; identical to SEQ ID NO: 195076

SEQ ID NO: 492337 - RNA, 64 nt, Human; identical to SEQ ID NO: 195077

SEQ ID NO: 492338 - RNA, 64 nt, Human; identical to SEQ ID NO: 195078

SEQ ID NO: 492339 - RNA, 64 nt, Human; identical to SEQ ID NO: 195079

SEQ ID NO: 492340 - RNA, 64 nt, Human; identical to SEQ ID NO: 195080

SEQ ID NO: 492341 - RNA, 64 nt, Human; identical to SEQ ID NO: 195081

SEQ ID NO: 492342 - RNA, 64 nt, Human; identical to SEQ ID NO: 192582

SEQ ID NO: 492343 - RNA, 64 nt, Human; identical to SEQ ID NO: 191787

SEQ ID NO: 492344 - RNA, 64 nt, Human; identical to SEQ ID NO: 195084

SEQ ID NO: 492345 - RNA, 64 nt, Human; identical to SEQ ID NO: 195085

SEQ ID NO: 492346 - RNA, 64 nt, Human; identical to SEQ ID NO: 195086

SEQ ID NO: 492347 - RNA, 61 nt, Human; identical to SEQ ID NO: 195087

SEQ ID NO: 492348 - RNA, 64 nt, Human; identical to SEQ ID NO: 195088

SEQ ID NO: 492349 - RNA, 64 nt, Human
cagccccccaaguagcugggacuaaagucaugugccaccacacccagcuuacucugaacuuuua

SEQ ID NO: 492350 - RNA, 64 nt, Human
cagccuccugaguagcugggacuacaggcacccgccaccacacccggcuaauuuuuggauuuuu

SEQ ID NO: 492351 - RNA, 64 nt, Human
cagccucccgaguagcugggacuacaggugcacaccaccacaccuggcuaauuuuuuguauuuu

SEQ ID NO: 492352 - RNA, 64 nt, Human; identical to SEQ ID NO: 191788

SEQ ID NO: 492353 - RNA, 63 nt, Human; identical to SEQ ID NO: 195090

SEQ ID NO: 492354 - RNA, 64 nt, Human; identical to SEQ ID NO: 195091

SEQ ID NO: 492355 - RNA, 64 nt, Human; identical to SEQ ID NO: 194651

SEQ ID NO: 492356 - RNA, 64 nt, Human; identical to SEQ ID NO: 191312

SEQ ID NO: 492357 - RNA, 64 nt, Human; identical to SEQ ID NO: 194784

SEQ ID NO: 492358 - RNA, 64 nt, Human; identical to SEQ ID NO: 191805

SEQ ID NO: 492359 - RNA, 64 nt, Human; identical to SEQ ID NO: 194786

SEQ ID NO: 492360 - RNA, 64 nt, Human; identical to SEQ ID NO: 194824

SEQ ID NO: 492361 - RNA, 64 nt, Human; identical to SEQ ID NO: 191313

SEQ ID NO: 492362 - RNA, 64 nt, Human; identical to SEQ ID NO: 194803

SEQ ID NO: 492363 - RNA, 64 nt, Human; identical to SEQ ID NO: 191806

SEQ ID NO: 492364 - RNA, 64 nt, Human; identical to SEQ ID NO: 194805

SEQ ID NO: 492365 - RNA, 64 nt, Human; identical to SEQ ID NO: 194842

SEQ ID NO: 492366 - RNA, 64 nt, Human; identical to SEQ ID NO: 191314

SEQ ID NO: 492367 - RNA, 64 nt, Human
cuccccuggccucgccuucugcaaaccaccgcagccaccacagcgucaggguggagaucugggu

SEQ ID NO: 492368 - RNA, 64 nt, Human
cagccuccagaguagcugggauaacaggugcccaccaccacaccccacuaauuuuuguauuugu

SEQ ID NO: 492369 - RNA, 64 nt, Human
guggaaauggccaccaccauucuccuuccccaccccaccacaaaaagagaagcugugucuuuag

SEQ ID NO: 492370 - RNA, 64 nt, Human; identical to SEQ ID NO: 194843

SEQ ID NO: 492371 - RNA, 64 nt, Human; identical to SEQ ID NO: 191807

SEQ ID NO: 492372 - RNA, 64 nt, Human; identical to SEQ ID NO: 191331

SEQ ID NO: 492373 - RNA, 64 nt, Human; identical to SEQ ID NO: 194880

SEQ ID NO: 492374 - RNA, 64 nt, Human; identical to SEQ ID NO: 194881

SEQ ID NO: 492375 - RNA, 64 nt, Human; identical to SEQ ID NO: 191824

SEQ ID NO: 492376 - RNA, 64 nt, Human; identical to SEQ ID NO: 191332

SEQ ID NO: 492377 - RNA, 64 nt, Human; identical to SEQ ID NO: 194898

SEQ ID NO: 492378 - RNA, 64 nt, Human; identical to SEQ ID NO: 194899

SEQ ID NO: 492379 - RNA, 64 nt, Human; identical to SEQ ID NO: 194900

SEQ ID NO: 492380 - RNA, 64 nt, Human; identical to SEQ ID NO: 191825

SEQ ID NO: 492381 - RNA, 64 nt, Human; identical to SEQ ID NO: 191333

SEQ ID NO: 492382 - RNA, 64 nt, Human; identical to SEQ ID NO: 194918

SEQ ID NO: 492383 - RNA, 64 nt, Human; identical to SEQ ID NO: 194919

SEQ ID NO: 492384 - RNA, 64 nt, Human; identical to SEQ ID NO: 194936

SEQ ID NO: 492385 - RNA, 64 nt, Human
acaaccagguuggaaaccaagacggagcucagacccaccacaucgccccagaggcuuuuccagc

SEQ ID NO: 492386 - RNA, 64 nt, Human
uagccuccugaguagcugggauuacaggcaugcgccaccacacccggcuaauuuuguauuuuua

SEQ ID NO: 492387 - RNA, 64 nt, Human
cagccucccaaauagcugggacuacaggcacaggccaccacaccuggcuaauuuuuuuguauuu

SEQ ID NO: 492388 - RNA, 64 nt, Human; identical to SEQ ID NO: 191350

SEQ ID NO: 492389 - RNA, 64 nt, Human; identical to SEQ ID NO: 194992

SEQ ID NO: 492390 - RNA, 64 nt, Human; identical to SEQ ID NO: 194993

SEQ ID NO: 492391 - RNA, 64 nt, Human; identical to SEQ ID NO: 194709

SEQ ID NO: 492392 - RNA, 59 nt, Human; identical to SEQ ID NO: 191351

SEQ ID NO: 492393 - RNA, 64 nt, Human; identical to SEQ ID NO: 195061

SEQ ID NO: 492394 - RNA, 64 nt, Human; identical to SEQ ID NO: 191843

SEQ ID NO: 492395 - RNA, 64 nt, Human; identical to SEQ ID NO: 195063

SEQ ID NO: 492396 - RNA, 64 nt, Human; identical to SEQ ID NO: 194652

SEQ ID NO: 492397 - RNA, 64 nt, Human; identical to SEQ ID NO: 191352

SEQ ID NO: 492398 - RNA, 64 nt, Human; identical to SEQ ID NO: 195069

SEQ ID NO: 492399 - RNA, 64 nt, Human; identical to SEQ ID NO: 195070

SEQ ID NO: 492400 - RNA, 64 nt, Human; identical to SEQ ID NO: 191844

SEQ ID NO: 492401 - RNA, 64 nt, Human; identical to SEQ ID NO: 194632

SEQ ID NO: 492402 - RNA, 64 nt, Human; identical to SEQ ID NO: 191369

SEQ ID NO: 492403 - RNA, 64 nt, Human
uggccucccaaagugcugggauuacaggugugagccaccacacccagccucuguaguucuuuuu

SEQ ID NO: 492404 - RNA, 64 nt, Human
cagccucccaaguagcugggauuacaggcacgcgccaccacaccuggcuaauucuauuuaguag

SEQ ID NO: 492405 - RNA, 64 nt, Human
cagcuuccccaguagcugggaccacaggugcccgccaccacacccaacuaauuuuuguauuuuu

SEQ ID NO: 492406 - RNA, 64 nt, Human; identical to SEQ ID NO: 194502

SEQ ID NO: 492407 - RNA, 64 nt, Human; identical to SEQ ID NO: 194503

SEQ ID NO: 492408 - RNA, 64 nt, Human; identical to SEQ ID NO: 194504

SEQ ID NO: 492409 - RNA, 64 nt, Human; identical to SEQ ID NO: 191845

SEQ ID NO: 492410 - RNA, 64 nt, Human; identical to SEQ ID NO: 191370

SEQ ID NO: 492411 - RNA, 64 nt, Human; identical to SEQ ID NO: 194521

SEQ ID NO: 492412 - RNA, 64 nt, Human; identical to SEQ ID NO: 194522

SEQ ID NO: 492413 - RNA, 64 nt, Human; identical to SEQ ID NO: 194523

SEQ ID NO: 492414 - RNA, 64 nt, Human; identical to SEQ ID NO: 191862

SEQ ID NO: 492415 - RNA, 64 nt, Human; identical to SEQ ID NO: 191371

SEQ ID NO: 492416 - RNA, 64 nt, Human; identical to SEQ ID NO: 194541

SEQ ID NO: 492417 - RNA, 64 nt, Human; identical to SEQ ID NO: 194542

SEQ ID NO: 492418 - RNA, 64 nt, Human
ggggagccucgcugugucuugcuguucccaggcaccaccacagcaggugcugccauacucuugu

SEQ ID NO: 492419 - RNA, 64 nt, Human
agacaagccuccauuaaagccacagcagugcuacccaccacacacaccuugcuggcccggccac

SEQ ID NO: 492420 - RNA, 64 nt, Human
uggaucccuugggcugugggccuucccauccaccccaccacaacugcccagguagcuggagcug

SEQ ID NO: 492421 - RNA, 64 nt, Human
ccuggcgccugcccuccagggcuggggccucgccuggcgggaccccgcagcagccccggcccca

SEQ ID NO: 492422 - RNA, 64 nt, Human
ccucagcugcugccugaccggcugggggaggcacuggcgggaggccucgggcuccccuggaagg

SEQ ID NO: 492423 - RNA, 64 nt, Human
ggaacuguuuaugaggcucuaguuguugcuguuguggcgggaaaguuaagaaacauagcccuua

SEQ ID NO: 492424 - RNA, 64 nt, Human
uuuuaguauccaaggaagagaccaaggagccagcuggcgggaaggggugggggugugcagucug

SEQ ID NO: 492425 - RNA, 64 nt, Human
ccugagaugggccggcccccuuccuggccccucauggcgggacuggagaaaugguccgcuuucc

SEQ ID NO: 492426 - RNA, 64 nt, Human
agcaucaggcccagacagagccuggcaggcauccuggcgggaaggaccagguccccucugggug

SEQ ID NO: 492427 - RNA, 64 nt, Human
aggagcauugaccccccugaaucagcucuguccuuggcgggacaguccuucccugcuggcaguc

SEQ ID NO: 492428 - RNA, 64 nt, Human
gcucacaauuugaagaugaaacuugucauuagguuggcgggaaugagacuaaagauugcgcugu

SEQ ID NO: 492429 - RNA, 63 nt, Human
aaugccccaaaggagacugacccggcgcggugcuggcgggagcgcucaagggcagcggauuug

SEQ ID NO: 492430 - RNA, 64 nt, Human; identical to SEQ ID NO: 300327

SEQ ID NO: 492431 - RNA, 64 nt, Human; identical to SEQ ID NO: 300333

SEQ ID NO: 492432 - RNA, 64 nt, Human; identical to SEQ ID NO: 300343

SEQ ID NO: 492433 - RNA, 64 nt, Human
uuggggccuggguguugggguucugaucagaauuuggcgggaugauauguuugccauuuucuca

SEQ ID NO: 492434 - RNA, 64 nt, Human
gggcacaccguccuuuugucucugccuuugagguuggcgggaacugaaacugguacggucuuuu

SEQ ID NO: 492435 - RNA, 64 nt, Human
acaguuccacauggcuggggaggccucagaaucauggcgggaggugaaaggcacuucuuacaug

SEQ ID NO: 492436 - RNA, 64 nt, Human
gccacaugugcucaucaaacuugcauuaagcaguuggcgggagauggcuguggagcuggggguu

SEQ ID NO: 492437 - RNA, 64 nt, Human
gccaacagagggagcaggcagagggugggggaccuggcgggagcccugggguagugucagagcg

SEQ ID NO: 492438 - RNA, 64 nt, Human
aggacugcggccucuucugaggggcagcggggccuggcgggauggugagccagaggggcugugg

SEQ ID NO: 492439 - RNA, 64 nt, Human
ugagucucgcacugucacccaggguggagugcaguggcgggaucucagcucagugcaaccucca

SEQ ID NO: 492440 - RNA, 64 nt, Human
gcaguccauggcuagacgcgccggacaggacugauggcgggaccgcgcugcccgagaaagggac

SEQ ID NO: 492441 - RNA, 64 nt, Human
guccagaauguccuuuuucacacagaggaagagauggcgggaaaacacugacugacuccuuggg

SEQ ID NO: 492442 - RNA, 64 nt, Human
aagagacuggccgggacaagauaaacggagcugguggcgggagggacagccccagagcagaccc

SEQ ID NO: 492443 - RNA, 64 nt, Human
uaucuucucuuuuagugucauuacgagggagugauggcgggaaucucagucgcacucaagcucu

SEQ ID NO: 492444 - RNA, 64 nt, Human
auuuugcaaaagaaguagcuggaagccaugggacuggcgggagccuguuugggggaucuggaug

SEQ ID NO: 492445 - RNA, 64 nt, Human
uaaggccacggagcgacagcgggcagugcgggccuggcgggaggugggggagguccaucucaga

SEQ ID NO: 492446 - RNA, 64 nt, Human
gggcuuaagaagcugcaguaaaagugccaggugcuggcgggaugugguagcucaugccuauaau

SEQ ID NO: 492447 - RNA, 64 nt, Human
ggcgcuguguuccaggaccauguaccgcguuauguggcgggaggugaggcgggagguucagcag

SEQ ID NO: 492448 - RNA, 64 nt, Human
cagccucccaaguagcugggacuacaggcaugcaccaccacacuuggccaauguucuguauuuu

SEQ ID NO: 492449 - RNA, 64 nt, Human
ccucugccucccaaguaacugggacuauagcaugccaccacacccagcugauuaucauauuuuu

SEQ ID NO: 492450 - RNA, 64 nt, Human
cuucugccucccaaguaacugggacuauagcaugccaccacacccagcugauuaucauauuuuu

SEQ ID NO: 492451 - RNA, 64 nt, Human
acgauuuuucgguguuucucuguacauaguuuucuggcgggauaggggagguaggauggauggg

SEQ ID NO: 492452 - RNA, 53 nt, Human
cagcuccgaagaaaaagugaaacuggcgggacguuccccuuugaaaauuuuaa

SEQ ID NO: 492453 - RNA, 64 nt, Human
caccugggagguggggcagggaugguguuucggguggcgggauggggagcagcuugguccaugu

SEQ ID NO: 492454 - RNA, 64 nt, Human
gcugguguaucucacaaugcaaagacaugcuggcuggcgggacaggugggcaggacugacccug

SEQ ID NO: 492455 - RNA, 64 nt, Human
ccucucuucccuuuguuauucagugugaccaggauggcgggaggggaucugugucacuguaggu

SEQ ID NO: 492456 - RNA, 64 nt, Human
caagccuugaaaggcaggcuucacagugccgaguuggcgggaaaagcaaauucuuuugaagucu

SEQ ID NO: 492457 - RNA, 64 nt, Human
ggagucucgcucugucgcccaggcuggagugcaguggcgggaucucggcucacugcaagcuccg

SEQ ID NO: 492458 - RNA, 64 nt, Human
ucauuguguguggaaugucgcagacuccuccacguggcgggaaugagcuguguaaauacuucaa

SEQ ID NO: 492459 - RNA, 64 nt, Human
ccuuucccuucuuaauccaaggacugggcugggguggcgggaggggagccagauccccgaggga

SEQ ID NO: 492460 - RNA, 64 nt, Human
ggaaggacgcccccugacuccaggccccugagccuggcgggaaguggcugcggcccaggcagcc

SEQ ID NO: 492461 - RNA, 64 nt, Human
agucccagcuacuugggaggcugaggcaggagaauggcgggaaccugggaggcggagcuuacag

SEQ ID NO: 492462 - RNA, 64 nt, Human
uggacucugaccagauuuuugccauacugggggguggcgggauggaggauggguacucaggcau

SEQ ID NO: 492463 - RNA, 64 nt, Human
aacaacauguauuaaagcaggugauuccuccccuuggcgggagagcucucucagugugaacaug

SEQ ID NO: 492464 - RNA, 64 nt, Human
aaagccgugcaguggcaggcgggacccccucugguggcgggacccccucuugcgguggucuugc

SEQ ID NO: 492465 - RNA, 64 nt, Human
gcaugugggucagggaucugggggcccccccagcuggcgggaaccccaaauggacacaaacugu

SEQ ID NO: 492466 - RNA, 64 nt, Human
cccaggauggagguccgggccugccccaagggucccaccacagccagcgggcuggccucccacc

SEQ ID NO: 492467 - RNA, 64 nt, Human
ccccacccucugugggccacacgugcacuugcacccaccacacacacacacacacacacacaca

SEQ ID NO: 492468 - RNA, 64 nt, Human
gcaggaguguuuauggcagagugaaguucugugcccaccacaagaggcugugagauguucugac

SEQ ID NO: 492469 - RNA, 64 nt, Human
gcugggcugagaacgcugcccagggcccugcagcuggcgggagaggugucuggugggagcggug

SEQ ID NO: 492470 - RNA, 64 nt, Human
acaguuccacauggccggggaggccucagaaucauggcgggaggugaaaagcacuucguacaug

SEQ ID NO: 492471 - RNA, 64 nt, Human
caaucacgggcuaugcccggggagcugucgggaguggcgggaaucggggccaugcccggggagc

SEQ ID NO: 492472 - RNA, 64 nt, Human
ggaaucggggccaugcccggggagcugucgggaguggcgggaaucggggccaugcccggggagc

SEQ ID NO: 492473 - RNA, 64 nt, Human
ggaaucggggccaugcccggggagcugucgggaguggcgggaaauggggggcaucaccaugccu

SEQ ID NO: 492474 - RNA, 64 nt, Human
ugcccgcugcugcucuguggccacccggcucccauggcgggagggcugugcccuggcugucucu

SEQ ID NO: 492475 - RNA, 64 nt, Human
aagcgggugcccggcauggccauccugauguugcuggcgggauccccaugcaccuuguccuucu

SEQ ID NO: 492476 - RNA, 64 nt, Human
aggaaacagaaaagagaagaaagaagcacucugcuggcgggaauacucuuggucaccucaaauu

SEQ ID NO: 492477 - RNA, 64 nt, Human
ugggccuaauaggcacccccuguaccucaggcuguggcgggagcagagucccccccuccggccc

SEQ ID NO: 492478 - RNA, 64 nt, Human
auccuggccacuaggccaagaggcccuaugaagguggcgggaacucagcuucaaccucgauguc

SEQ ID NO: 492479 - RNA, 64 nt, Human
gcuaaggucauaucaucugaccaggucuggaggcuggcgggaggcucccugaaagugggugcga

SEQ ID NO: 492480 - RNA, 64 nt, Human
cuugcaggaccugccuggagguucucccuggggguggcgggagggggaggcuugaccuuuuguc

SEQ ID NO: 492481 - RNA, 64 nt, Human
agcuacugaaaauacaaaaauaagccaggcgugguggcgggaggcugaggcaaggagaaucacu

SEQ ID NO: 492482 - RNA, 64 nt, Human
uaaaaacaguuagccagacuguuuuuaaagcaccuggcgggaagcagaagguuggauccaagcc

SEQ ID NO: 492483 - RNA, 64 nt, Human
ggcgucuugcuuugucacccacgcuggaaugcaguggcgggaucucagcucaccgcaaccucca

SEQ ID NO: 492484 - RNA, 64 nt, Human
caagcccuuuuuagugcugugcucguccagcucaccaccacagccccucucagcccucaguagg

SEQ ID NO: 492485 - RNA, 64 nt, Human
uccagcugggugucccacauguuggauuccguccccaccacacuuccagagaccggagaacugu

SEQ ID NO: 492486 - RNA, 64 nt, Human
gaggccaagucccaggcuuucaggugugugugucccaccacacuggccgugguaaacaucugcc

SEQ ID NO: 492487 - RNA, 64 nt, Human
gcugggugcagguggggacuguccaaugcagagcuggcgggacagagaguuaagccacuuccug

SEQ ID NO: 492488 - RNA, 64 nt, Human
ccaacccugcccucugagcggccucugaguacccuggcgggaggcuggcccacacagaaaggug

SEQ ID NO: 492489 - RNA, 64 nt, Human
aaagcuugcucugccuccugccagccagaauugguggcgggacuuggggauacagcgugaaggu

SEQ ID NO: 492490 - RNA, 64 nt, Human
aguagcccuugcggccuguaccaccaguaccaccuggcgggacacuacgccucggccacgcuau

SEQ ID NO: 492491 - RNA, 64 nt, Human
ggcccaccuuccuggcugcaguccaggcccgugcuggcgggauugggcaugggaaggagcaggg

SEQ ID NO: 492492 - RNA, 64 nt, Human
cuuugcuagauagggucccccaggcaguccccaguggcgggacacagggguccggcuguggagc

SEQ ID NO: 492493 - RNA, 64 nt, Human
gaggauggcagcagguauuggguccucagccuucuggcgggagcccugaggcugcggacaaagc

SEQ ID NO: 492494 - RNA, 64 nt, Human
aggagguggaguucuuccaugcaggagcacggcauggcgggagcggggcugcagaguauccgag

SEQ ID NO: 492495 - RNA, 64 nt, Human
cuguggagcagaggcacagacaacccuucccaucuggcgggacccagaggugcugagauggggg

SEQ ID NO: 492496 - RNA, 64 nt, Human
gucaccggcuccucuguccugccuacccugguccuggcgggacuucacuauuugacuugguuuc

SEQ ID NO: 492497 - RNA, 64 nt, Human
uucuccucucuccgccaccggcuucugaacagccuggcgggaaauguagucccaagcuuucacu

SEQ ID NO: 492498 - RNA, 64 nt, Human
agcugcuuccucucugcuccuacgcauccuguccuggcgggaagagagcgucuggguccauuca

SEQ ID NO: 492499 - RNA, 64 nt, Human
guuggaucuguagcgguccuuuggagaguguguguggcgggagagugaaaccuugggggaaaau

SEQ ID NO: 492500 - RNA, 64 nt, Human
accagccuggccaacauagcgagagcagcuccgguggcgggaggaguggcagcggccaggcagc

SEQ ID NO: 492501 - RNA, 64 nt, Human
gagccuaccaagagaacuguggggaugugggauguggcgggacaggguugcuggguacagaagc

SEQ ID NO: 492502 - RNA, 64 nt, Human
cagucucccgaagugcugggauuacugacaugagccaccacacucagcccuuuaaaccuuuccc

SEQ ID NO: 492503 - RNA, 64 nt, Human
cagccucgcgaguaguuggaauuauaggcaugugccaccacacccagcugauuuuugcauuuuu

SEQ ID NO: 492504 - RNA, 64 nt, Human
agccuuuggagaguagcuaggacuacaggcgcagccaccacacccagcuaguuuuuuauuuuaa

SEQ ID NO: 492505 - RNA, 64 nt, Human
cuacugcugaugucucuguuggggaucagagggcuggcgggaacgcgagaagggcaccagcagc

SEQ ID NO: 492506 - RNA, 64 nt, Human
gcgcggcacaguggccucaccucccgucgggcacuggcgggagcaaggucgggggcaggcgcug

SEQ ID NO: 492507 - RNA, 64 nt, Human
ccccaacgcagggcgcccggcgaagccacgggacuggcgggaggagcacgcggggccggaggaa

SEQ ID NO: 492508 - RNA, 64 nt, Human
gcagcggggccggacaggccgcacagaccuacuguggcgggagggaggggcggcugcugccugg

SEQ ID NO: 492509 - RNA, 64 nt, Human
ccaauugcaggucggcuuggcugggagagauggauggcgggaaaggggcagcagucuugaggag

SEQ ID NO: 492510 - RNA, 64 nt, Human
cugucccuguaccccaguccugaagccccugcaguggcgggacucaagcuccugaccuuugccc

SEQ ID NO: 492511 - RNA, 64 nt, Human
cccuccuaguuggcuuugucugucaggugcagucuggcgggaguccaggaggcagcagcucagg

SEQ ID NO: 492512 - RNA, 64 nt, Human
ggucgucggcauccaggccugugccggcuucacguggcgggaagacccucugcaagggggacag

SEQ ID NO: 492513 - RNA, 64 nt, Human
aaccuccagucuccgcguuuugcgauuuuaauuuuggcgggaggggaaguggauugagaggaaa

SEQ ID NO: 492514 - RNA, 64 nt, Human
uauuaauacucugcagugauuagaaggggugggguggcgggaauccuauuuaucagacucugua

SEQ ID NO: 492515 - RNA, 64 nt, Human
gaggucccaaggauugggagcaugggaggggagcuggcgggagggugggaggugggauuuagcc

SEQ ID NO: 492516 - RNA, 64 nt, Human
uggacagaggccacacugacugcccacccagcuguggcgggaggugcagagcagagggcuuuag

SEQ ID NO: 492517 - RNA, 64 nt, Human
gaggccaacggaucccccugccugucgcaccccuuggcgggagacgggaaggcagcgggcugcg

SEQ ID NO: 492518 - RNA, 64 nt, Human
gggacgcccacguggcagaccgugaccaucuuuguggcgggagugcucaccgccucacucacca

SEQ ID NO: 492519 - RNA, 64 nt, Human; identical to SEQ ID NO: 492457

SEQ ID NO: 492520 - RNA, 64 nt, Human
gaacguggggugauucacagcacaaaagaccucaccaccacaccugcacucaccccaccuugca

SEQ ID NO: 492521 - RNA, 64 nt, Human
aagagaagugauucucccuugacucuggcuccugccaccacaaauguuacccucauuggcuuga

SEQ ID NO: 492522 - RNA, 64 nt, Human
caucuccuuggucacccucugcuccaggccuucuccaccacaggaccucagcugucccuccuuc

SEQ ID NO: 492523 - RNA, 64 nt, Human
cugccagggaugggccccguggaaccccgaagccuggcgggagagagagagagagaagucuccu

SEQ ID NO: 492524 - RNA, 64 nt, Human
agucccagcuacuugguaggcugaggcaggagaauggcgggaacccgggaggcagagguugcag

SEQ ID NO: 492525 - RNA, 64 nt, Human
ggcacaaaaaaaaaaaaaaaguagccaggcaugguggcgggagccuguugucccagcuguuccg

SEQ ID NO: 492526 - RNA, 64 nt, Human
uggcggcugugucgaggaugcguggcgccugccguggcgggacagcgugggcaggcucauuucu

SEQ ID NO: 492527 - RNA, 64 nt, Human
cagccauccugaccccucucauuauuuuuccuauuggcgggaccugauuucuuugaccggcuug

SEQ ID NO: 492528 - RNA, 63 nt, Human
ccaacaucccccgggacuaggcacacccugccuuggcgggaccagcgggcauuuguuuucuug

SEQ ID NO: 492529 - RNA, 64 nt, Human
ugaaucuuggugcagcaccaaccgcgugccuguguggcgggacuggagggcacaguugaggaag

SEQ ID NO: 492530 - RNA, 64 nt, Human
uccaauuuuuuuuccugccuuauuuagaauucuuuggcgggaaggguaugauggguucccagag

SEQ ID NO: 492531 - RNA, 64 nt, Human
gaggggccccaggauuuguugggggcaaaggggguggcgggaccguucccaggagguaccagca

SEQ ID NO: 492532 - RNA, 64 nt, Human
uguucuccagguuuucaccagauagauuugggguuggcgggaccugcuggugacgugcagguga

SEQ ID NO: 492533 - RNA, 64 nt, Human
cccucuggggcccuuuucuuacaguaacugaguguggcgggaagggugggcccuggaggggccc

SEQ ID NO: 492534 - RNA, 64 nt, Human
gaagacagagccccacccucagaugcacaugagcuggcgggauugaaggaugcugucuucguac

SEQ ID NO: 492535 - RNA, 64 nt, Human
cuccacgggcugcgccgucugcucggggcugagcuggcgggagcaguuugcguguuuggguuuu

SEQ ID NO: 492536 - RNA, 64 nt, Human
cuccccugccucacaacgacuccuuucucuuguguggcgggacucgcccuuuugcugugcucag

SEQ ID NO: 492537 - RNA, 64 nt, Human
ccugcagccgcuccuggauuggagcagugugcucuggcgggaagggcccaucccguuggucgag

SEQ ID NO: 492538 - RNA, 64 nt, Human
uaugggggguggccuguggcuuguauccuucaguccaccacagcaaauguguguagauuucaug

SEQ ID NO: 492539 - RNA, 64 nt, Human
cagccucccgaguagcugagauuacaggugcgcgccaccacacuuggcuaauuuuuguauuauu

SEQ ID NO: 492540 - RNA, 64 nt, Human
aaucacaccauuuucaugccugucaauccccaccccaccacaaggcaggaaggggguggugccu

SEQ ID NO: 492541 - RNA, 64 nt, Human
cccucauucugcagggccaccugguguguggagguggcgggaggggucagugacucuggggguc

SEQ ID NO: 492542 - RNA, 64 nt, Human
ccccaagagggagcugauaucaugaggauaacauuggcgggaggggaguuaacuggcaggcaug

SEQ ID NO: 492543 - RNA, 64 nt, Human
gcagguagaggaggacugaugacacgagcugccauggcgggaggaggggcaguaguuauugaua

SEQ ID NO: 492544 - RNA, 64 nt, Human
cucacgcgggcugccguccuaaucaacgugccuauggcgggaccacgcucggagccugccucuu

SEQ ID NO: 492545 - RNA, 64 nt, Human
accacagagcacagccuggacauuauggaggguguggcgggacggcccacaccuggguccucca

SEQ ID NO: 492546 - RNA, 64 nt, Human
cucugcacaucuagccucuggcccuccucuucacugccuccaccugcucccgcuugccaucccu

SEQ ID NO: 492547 - RNA, 64 nt, Human
cagaggucccuggucuucccucauccuccguggcugccuccaugggacaaggaccgauuccaac

SEQ ID NO: 492548 - RNA, 62 nt, Human
acgagagugagcgggacuagggcugcgccugcugccuccagcccugaggauggcaucuagug

SEQ ID NO: 492549 - RNA, 64 nt, Human
cagacuccaagggcugcccugagucugggacuucugccuccauggcuggucaugagagcaaacc

SEQ ID NO: 492550 - RNA, 64 nt, Human; identical to SEQ ID NO: 300350

SEQ ID NO: 492551 - RNA, 64 nt, Human; identical to SEQ ID NO: 300360

SEQ ID NO: 492552 - RNA, 64 nt, Human; identical to SEQ ID NO: 300367

SEQ ID NO: 492553 - RNA, 64 nt, Human
uugccaucagcacaaggaaaaccaggagagagucugccuccaggacucugagccuucugccucg

SEQ ID NO: 492554 - RNA, 64 nt, Human
ccccaacugauucugcccagauaaucgugucuccugccuccacucagcugcuucucagucauga

SEQ ID NO: 492555 - RNA, 64 nt, Human
ugaggcuggccaccugccacuuugcccugcccucugccuccagggcuccacuccccuuccuuuu

SEQ ID NO: 492556 - RNA, 64 nt, Human
caccugccucgcagaggccagcaccccacucuccugccuccaguggcccugccgcagaugucuc

SEQ ID NO: 492557 - RNA, 54 nt, Human
uggagggcuuccagcuauaauaucugccuccagggaggggaggggaugggaagc

SEQ ID NO: 492558 - RNA, 64 nt, Human
cuuccuaucagcuucagugacccagggucugaacugccuccauccuagggcaaccuggggcaga

SEQ ID NO: 492559 - RNA, 64 nt, Human
ggggcgaagaagaacccuguguucucaggaagacugccuccaccaccgcuacccagagaaccuc

SEQ ID NO: 492560 - RNA, 64 nt, Human
ggaugugucagggaagaaagacuucucaaggaggugccuccaucagacccaaaggacucauggg

SEQ ID NO: 492561 - RNA, 64 nt, Human
aagauauuauuuaaauguugaaaucuuaaaaaccugccuccaagauuucagaagccaaguuuuu

SEQ ID NO: 492562 - RNA, 64 nt, Human
ccacagucacucuuaaaacuucucucuguuugccugccuccaacaguacuuuuaacuuuuugcu

SEQ ID NO: 492563 - RNA, 64 nt, Human
gugagccacaggccacaucaggaacuuuccccacugccuccaugcaaggcugcagagcuauggu

SEQ ID NO: 492564 - RNA, 64 nt, Human
ggggagaagcggcgauaccauagaguccagaucuugccuccagagauuugcuuuaccuuccuga

SEQ ID NO: 492565 - RNA, 64 nt, Human
uugggugguauggauuuucaacuggccaacccuuugccuccacuauugaauuuuuuucagaccc

SEQ ID NO: 492566 - RNA, 64 nt, Human
ggcaaggggccaggaaggggacaggauugucugcugccuccaagucaugggagaagagggguau

SEQ ID NO: 492567 - RNA, 64 nt, Human
cagccucucaaguagcugggacuacaggcaugugccaccacaccuaauuucuauauuuuuugua

SEQ ID NO: 492568 - RNA, 64 nt, Human
ugugcuguuucagcauguguguacaccuaugaaaccaccacagucaagauauccaacacaacaa

SEQ ID NO: 492569 - RNA, 64 nt, Human
ucgagcaaaaaccucuggcgccuccaauccagacccaccacagcuggagggccaggccuccucu

SEQ ID NO: 492570 - RNA, 64 nt, Human
cucgcucuaccucugaccucuccggagguuccgcugccuccaagccggacuuagggcuucaaga

SEQ ID NO: 492571 - RNA, 64 nt, Human
uucauaaaguauuaaccaacuggcaccaaggaauugccuccagccugaguccuaggcucuaaaa

SEQ ID NO: 492572 - RNA, 64 nt, Human
ucccuuuuuuuucuggguagaagccacccuucccugccuccagcugucagccugguuuucguca

SEQ ID NO: 492573 - RNA, 64 nt, Human
caaagguuaaagaaggcucaucagucuauccuucugccuccauauauccugaacaucaaacuau

SEQ ID NO: 492574 - RNA, 64 nt, Human
agaaauccucugcugaagaccccugguucuguucugccuccaacauguauaauuuuauuugaaa

SEQ ID NO: 492575 - RNA, 64 nt, Human
auucucauggcugcacacccugccccagcccagcugccuccagaccccuaagcaucuccugucc

SEQ ID NO: 492576 - RNA, 64 nt, Human
uggggcucacggugggcugucuggggagggugggugccuccacuaugauccuuaaaggauuccu

SEQ ID NO: 492577 - RNA, 64 nt, Human
accuggagaguacauuugcuuuaaugagugcaccugccuccaccagcaaggggaccccgagaac

SEQ ID NO: 492578 - RNA, 57 nt, Human
gcguguggguagaacccugagcgacccugccuccacucucccccagcugccuggagg

SEQ ID NO: 492579 - RNA, 64 nt, Human
ggcuccaggcaccagagccuugaguacuuucuccugccuccaggcauuggcucagggugaauua

SEQ ID NO: 492580 - RNA, 64 nt, Human
cguguguuucugugaacaugaaguucugcgguagugccuccaggggcagaggaaaagaagaagu

SEQ ID NO: 492581 - RNA, 64 nt, Human
uggagauccaggcugcuggagauccaaugccugcugccuccagacucuuucaugagcgccaauc

SEQ ID NO: 492582 - RNA, 64 nt, Human
gggucagauuugcccugagcugcacuggacaaaaugccuccaggacccacuucgcgugcuacuu

SEQ ID NO: 492583 - RNA, 64 nt, Human
aagggggccaucuagguccccaacccauggacuuugccuccauuuucagcuccgccuuuuuucu

SEQ ID NO: 492584 - RNA, 64 nt, Human
cacuucccuaagucucucuucagcugugacuuauccaccacauagcccaguaagucuucaguuu

SEQ ID NO: 492585 - RNA, 64 nt, Human
cagccuccaaaguagcugggauuacaggcaugcgccaccacacccagcuaauuuuuuguauuug

SEQ ID NO: 492586 - RNA, 64 nt, Human
cagccuccugaguagcugggacuauaggcgcgugccaccacaaccagcuaaauuuuuuuguauu

SEQ ID NO: 492587 - RNA, 64 nt, Human
agaugcccaugagcugacauuuuacucaucccucugccuccaagaaggccuguauuauacgugu

SEQ ID NO: 492588 - RNA, 64 nt, Human
uugaaguccuggcuucaggcaauucuccugccuuugccuccagaagcacugggaucacaggugu

SEQ ID NO: 492589 - RNA, 64 nt, Human
aaccccugcguggcaacuguguacagcuuaccccugccuccaguugcaccacuucuagaugugc

SEQ ID NO: 492590 - RNA, 64 nt, Human
agccucccugcuugccaccacucugcucccugcuugccuccacucccuucugacuuuccagacc

SEQ ID NO: 492591 - RNA, 64 nt, Human
aguauguugucugucaaguuuuaaauacuuaucuugccuccauaucaauccauucucaugaacc

SEQ ID NO: 492592 - RNA, 64 nt, Human
gcugucauggcuacaaagugcucccucuuuucagugccuccaggaagcccgccaguggugagac

SEQ ID NO: 492593 - RNA, 64 nt, Human
cuuuuuccauucccagucgcucccagcccaccucugccuccaagccccagaugguucuggaggc

SEQ ID NO: 492594 - RNA, 64 nt, Human
ccaaaccauagcugucuguccagugcucucuuccugccuccagcucugccccaggcuccuccua

SEQ ID NO: 492595 - RNA, 64 nt, Human
uauugggacccucaagagguuugugcuagcccgaugccuccaccgggcacuuagaaggcaagag

SEQ ID NO: 492596 - RNA, 64 nt, Human
gccaccuugggucugugucacuuguagguuucucugccuccagguugccucaacagcaggaggc

SEQ ID NO: 492597 - RNA, 64 nt, Human
uggggacuacucagaggcaaagaggagcugcuccugccuccaugguugcuggccacucccacca

SEQ ID NO: 492598 - RNA, 64 nt, Human
aaucaaaagaaagaacaaggacucugguuacccuugccuccacccaugugucauaagaguaggc

SEQ ID NO: 492599 - RNA, 64 nt, Human
ggucauuauuuuauuucuauccaguucuaagaacugccuccacuguuuauauauucauaauuaa

SEQ ID NO: 492600 - RNA, 64 nt, Human
gacugaggcuugugccacugggccuuucugauuuugccuccaaaggagagcgcugugauaccua

SEQ ID NO: 492601 - RNA, 64 nt, Human
auccacucuccugcgguuaccagcccugcaccaaccaccacagucagaauaaucucaaaacugc

SEQ ID NO: 492602 - RNA, 64 nt, Human
uggccucccaaagugcugggauuacaggcgugagccaccacacccggcccccaguucuuuuuuu

SEQ ID NO: 492603 - RNA, 64 nt, Human
ucccccuccagguauuugaaacuacagguguguaccaccacaccgggcuaauuuuuguauuuuu

SEQ ID NO: 492604 - RNA, 64 nt, Human
uugagacaaucaccaagugcaguuucauggugggugccuccaggugauguggacuggagcaggg

SEQ ID NO: 492605 - RNA, 64 nt, Human
uacauuccaucuccaauggacucuuccgucucaaugccuccauuccaaacuguugucugcuuuc

SEQ ID NO: 492606 - RNA, 64 nt, Human
gcaaccuccgccuccuggguucaagugauucuucugccuccaccccccgaguggcugguauuac

SEQ ID NO: 492607 - RNA, 51 nt, Human
agugccucaagcuggccuagcugccuccaacacacuacgucagaaggaccc

SEQ ID NO: 492608 - RNA, 64 nt, Human
caacucuguaucuguuggcuucaagagaauauuuugccuccacauauguaccccuucuccuuuu

SEQ ID NO: 492609 - RNA, 64 nt, Human
uucuccuuuuuuuaaagauggauuuaaaccaagaugccuccaggaaagaggacgaaaugaguau

SEQ ID NO: 492610 - RNA, 64 nt, Human
augacagcaccugacauucugcaccagcuaccucugccuccauggcagagaaaaggccauaaga

SEQ ID NO: 492611 - RNA, 64 nt, Human
uagguuaacugaaguucaaacaucagugccagcuugccuccauccuuuucacauauuaugcagg

SEQ ID NO: 492612 - RNA, 64 nt, Human
ggggcagcuagacuucacccccuucccgcagaccugccuccagagcaaggagaauucugccuua

SEQ ID NO: 492613 - RNA, 64 nt, Human
ccuggcuccaggcuccaggcugacugggggccucugccuccaggagggcaucagcuuucccugg

SEQ ID NO: 492614 - RNA, 64 nt, Human
cucugccuccucuucaacugaccagccuccaugcugccuccagaauggucuuucuaauguguga
